United States Patent 9,205,144 (IDENTIFICATION OF CONSERVED PEPTIDE BLOCKS IN HOMOLOGOUS POLYPEPTIDES) - sequence listing, part 6

SEQ ID NO: 195417 - protein, 9 aa, Tick-borne encephalitis virus
RRMSLVLAI

SEQ ID NO: 195418 - protein, 9 aa, Tick-borne encephalitis virus
MSLVLATVL

SEQ ID NO: 195419 - protein, 9 aa, Tick-borne encephalitis virus
SLVLATVLC

SEQ ID NO: 195420 - protein, 9 aa, Tick-borne encephalitis virus
LVLATVLCL

SEQ ID NO: 195421 - protein, 9 aa, Tick-borne encephalitis virus
VLCLISVVM

SEQ ID NO: 195422 - protein, 9 aa, Tick-borne encephalitis virus
MSVVMNRTM

SEQ ID NO: 195423 - protein, 9 aa, Tick-borne encephalitis virus
SVVMNRTMA

SEQ ID NO: 195424 - protein, 9 aa, Tick-borne encephalitis virus
VVMNRTMAS

SEQ ID NO: 195425 - protein, 9 aa, Tick-borne encephalitis virus
VMNRTMASI

SEQ ID NO: 195426 - protein, 9 aa, Tick-borne encephalitis virus
MNRTMASIT

SEQ ID NO: 195427 - protein, 9 aa, Tick-borne encephalitis virus
NRTVLSITE

SEQ ID NO: 195428 - protein, 9 aa, Tick-borne encephalitis virus
RTVLSITEA

SEQ ID NO: 195429 - protein, 9 aa, Tick-borne encephalitis virus
TMASITEAS

SEQ ID NO: 195430 - protein, 9 aa, Tick-borne encephalitis virus
MASITEASA

SEQ ID NO: 195431 - protein, 9 aa, Tick-borne encephalitis virus
LSITEASAV

SEQ ID NO: 195432 - protein, 9 aa, Tick-borne encephalitis virus
ASAVGLAAL

SEQ ID NO: 195433 - protein, 9 aa, Tick-borne encephalitis virus
SAVGLAALG

SEQ ID NO: 195434 - protein, 9 aa, Tick-borne encephalitis virus
LAALGQLLR

SEQ ID NO: 195435 - protein, 9 aa, Tick-borne encephalitis virus
AALGQLLRP

SEQ ID NO: 195436 - protein, 9 aa, Tick-borne encephalitis virus
AAGQLLKPE

SEQ ID NO: 195437 - protein, 9 aa, Tick-borne encephalitis virus
GQLLRPEED

SEQ ID NO: 195438 - protein, 9 aa, Tick-borne encephalitis virus
QLLRPEEDT

SEQ ID NO: 195439 - protein, 9 aa, Tick-borne encephalitis virus
LLKPEADTL

SEQ ID NO: 195440 - protein, 9 aa, Tick-borne encephalitis virus
LRPEEDTLW

SEQ ID NO: 195441 - protein, 9 aa, Tick-borne encephalitis virus
RPEEDTLWT

SEQ ID NO: 195442 - protein, 9 aa, Tick-borne encephalitis virus
ACGLSGVVT

SEQ ID NO: 195443 - protein, 9 aa, Tick-borne encephalitis virus
CGLSGVVTG

SEQ ID NO: 195444 - protein, 9 aa, Tick-borne encephalitis virus
GLSGVVTGS

SEQ ID NO: 195445 - protein, 9 aa, Tick-borne encephalitis virus
LSGVVTGSL

SEQ ID NO: 195446 - protein, 9 aa, Tick-borne encephalitis virus
SGSRRGGSD

SEQ ID NO: 195447 - protein, 9 aa, Tick-borne encephalitis virus
GSRRGGSDG

SEQ ID NO: 195448 - protein, 9 aa, Tick-borne encephalitis virus
SRRGGSDGD

SEQ ID NO: 195449 - protein, 9 aa, Tick-borne encephalitis virus
LNSCTREEF

SEQ ID NO: 195450 - protein, 9 aa, Tick-borne encephalitis virus
NSCTREEFF

SEQ ID NO: 195451 - protein, 9 aa, Tick-borne encephalitis virus
SCTREEFFI

SEQ ID NO: 195452 - protein, 9 aa, Tick-borne encephalitis virus
CTREEFFIY

SEQ ID NO: 195453 - protein, 9 aa, Tick-borne encephalitis virus
TREEFFIYR

SEQ ID NO: 195454 - protein, 9 aa, Tick-borne encephalitis virus
REEFFIYRR

SEQ ID NO: 195455 - protein, 9 aa, Tick-borne encephalitis virus
EEFFVYRRA

SEQ ID NO: 195456 - protein, 9 aa, Tick-borne encephalitis virus
EFFVYRRAG

SEQ ID NO: 195457 - protein, 9 aa, Tick-borne encephalitis virus
FFIYRRTGI

SEQ ID NO: 195458 - protein, 9 aa, Tick-borne encephalitis virus
FVYRRTGIM

SEQ ID NO: 195459 - protein, 9 aa, Tick-borne encephalitis virus
VYRRTGIME

SEQ ID NO: 195460 - protein, 9 aa, Tick-borne encephalitis virus
DKARELLKK

SEQ ID NO: 195461 - protein, 9 aa, Tick-borne encephalitis virus
KARELLKRG

SEQ ID NO: 195462 - protein, 9 aa, Tick-borne encephalitis virus
ARELLKRGE

SEQ ID NO: 195463 - protein, 9 aa, Tick-borne encephalitis virus
RELLKKGET

SEQ ID NO: 195464 - protein, 9 aa, Tick-borne encephalitis virus
ELLKKGETN

SEQ ID NO: 195465 - protein, 9 aa, Tick-borne encephalitis virus
RGETNVGLA

SEQ ID NO: 195466 - protein, 9 aa, Tick-borne encephalitis virus
SRPAVMNVR

SEQ ID NO: 195467 - protein, 9 aa, Tick-borne encephalitis virus
RPAVMNVRA

SEQ ID NO: 195468 - protein, 9 aa, Tick-borne encephalitis virus
PAVMNVRAY

SEQ ID NO: 195469 - protein, 9 aa, Tick-borne encephalitis virus
AVMNVRAYT

SEQ ID NO: 195470 - protein, 9 aa, Tick-borne encephalitis virus
VKAYTIGGR

SEQ ID NO: 195471 - protein, 9 aa, Tick-borne encephalitis virus
KAYTIGGRG

SEQ ID NO: 195472 - protein, 9 aa, Tick-borne encephalitis virus
TIGGRGHET

SEQ ID NO: 195473 - protein, 9 aa, Tick-borne encephalitis virus
IGGRGHETP

SEQ ID NO: 195474 - protein, 9 aa, Tick-borne encephalitis virus
GGRGHETPK

SEQ ID NO: 195475 - protein, 9 aa, Tick-borne encephalitis virus
GKGHETPRM

SEQ ID NO: 195476 - protein, 9 aa, Tick-borne encephalitis virus
RGHETPKMV

SEQ ID NO: 195477 - protein, 9 aa, Tick-borne encephalitis virus
VMCDIGESN

SEQ ID NO: 195478 - protein, 9 aa, Tick-borne encephalitis virus
VVEGEKTRK

SEQ ID NO: 195479 - protein, 9 aa, Tick-borne encephalitis virus
WKIRNPTAT

SEQ ID NO: 195480 - protein, 9 aa, Tick-borne encephalitis virus
KNRNPAAAC

SEQ ID NO: 195481 - protein, 9 aa, Tick-borne encephalitis virus
IRNPTATCV

SEQ ID NO: 195482 - protein, 9 aa, Tick-borne encephalitis virus
ETLHRFQLQ

SEQ ID NO: 195483 - protein, 9 aa, Tick-borne encephalitis virus
TLHRFQLQW

SEQ ID NO: 195484 - protein, 9 aa, Tick-borne encephalitis virus
RCVFLAEDK

SEQ ID NO: 195485 - protein, 9 aa, Tick-borne encephalitis virus
CVFLAEDKV

SEQ ID NO: 195486 - protein, 9 aa, Tick-borne encephalitis virus
VFLAEDKVK

SEQ ID NO: 195487 - protein, 9 aa, Tick-borne encephalitis virus
FLAEDKVKE

SEQ ID NO: 195488 - protein, 9 aa, Tick-borne encephalitis virus
LAEDKVREK

SEQ ID NO: 195489 - protein, 9 aa, Tick-borne encephalitis virus
AEDKVREKD

SEQ ID NO: 195490 - protein, 9 aa, Tick-borne encephalitis virus
EDKVREKDV

SEQ ID NO: 195491 - protein, 9 aa, Tick-borne encephalitis virus
DKVREKDVQ

SEQ ID NO: 195492 - protein, 9 aa, Tick-borne encephalitis virus
KVREKDVQE

SEQ ID NO: 195493 - protein, 9 aa, Tick-borne encephalitis virus
VKEQDVRER

SEQ ID NO: 195494 - protein, 9 aa, Tick-borne encephalitis virus
KEQDVRERI

SEQ ID NO: 195495 - protein, 9 aa, Tick-borne encephalitis virus
DVRERIRAL

SEQ ID NO: 195496 - protein, 9 aa, Tick-borne encephalitis virus
ERIKALREQ

SEQ ID NO: 195497 - protein, 9 aa, Tick-borne encephalitis virus
RINALREQY

SEQ ID NO: 195498 - protein, 9 aa, Tick-borne encephalitis virus
NGEHPYRTW

SEQ ID NO: 195499 - protein, 9 aa, Tick-borne encephalitis virus
AEHPYRTWQ

SEQ ID NO: 195500 - protein, 9 aa, Tick-borne encephalitis virus
WILERLAQR

SEQ ID NO: 195501 - protein, 9 aa, Tick-borne encephalitis virus
ILERLARKN

SEQ ID NO: 195502 - protein, 9 aa, Tick-borne encephalitis virus
RPRMCSREE

SEQ ID NO: 195503 - protein, 9 aa, Tick-borne encephalitis virus
NAALGAWSN

SEQ ID NO: 195504 - protein, 9 aa, Tick-borne encephalitis virus
WSEEQNRWS

SEQ ID NO: 195505 - protein, 9 aa, Tick-borne encephalitis virus
GAREAVEDP

SEQ ID NO: 195506 - protein, 9 aa, Tick-borne encephalitis virus
AVEDPAFWR

SEQ ID NO: 195507 - protein, 9 aa, Tick-borne encephalitis virus
VEDPAFWRL

SEQ ID NO: 195508 - protein, 9 aa, Tick-borne encephalitis virus
EDPAFWRLV

SEQ ID NO: 195509 - protein, 9 aa, Tick-borne encephalitis virus
DPAFWRLVD

SEQ ID NO: 195510 - protein, 9 aa, Tick-borne encephalitis virus
PAFWRLVDE

SEQ ID NO: 195511 - protein, 9 aa, Tick-borne encephalitis virus
AFWRLVDEE

SEQ ID NO: 195512 - protein, 9 aa, Tick-borne encephalitis virus
FWKLVDEER

SEQ ID NO: 195513 - protein, 9 aa, Tick-borne encephalitis virus
WKLVDEERE

SEQ ID NO: 195514 - protein, 9 aa, Tick-borne encephalitis virus
KLVDEERER

SEQ ID NO: 195515 - protein, 9 aa, Tick-borne encephalitis virus
DEERERDLA

SEQ ID NO: 195516 - protein, 9 aa, Tick-borne encephalitis virus
EERERHLTG

SEQ ID NO: 195517 - protein, 9 aa, Tick-borne encephalitis virus
ERERDLAGR

SEQ ID NO: 195518 - protein, 9 aa, Tick-borne encephalitis virus
RERDLAGRS

SEQ ID NO: 195519 - protein, 9 aa, Tick-borne encephalitis virus
ERHLTGRCA

SEQ ID NO: 195520 - protein, 9 aa, Tick-borne encephalitis virus
RHLTGRCAH

SEQ ID NO: 195521 - protein, 9 aa, Tick-borne encephalitis virus
HLTGRCAHC

SEQ ID NO: 195522 - protein, 9 aa, Tick-borne encephalitis virus
LAGRSAHGV

SEQ ID NO: 195523 - protein, 9 aa, Tick-borne encephalitis virus
GRSAHGVFN

SEQ ID NO: 195524 - protein, 9 aa, Tick-borne encephalitis virus
RCAHCAYNM

SEQ ID NO: 195525 - protein, 9 aa, Tick-borne encephalitis virus
CAHCAYNMM

SEQ ID NO: 195526 - protein, 9 aa, Tick-borne encephalitis virus
AHCAYNMMG

SEQ ID NO: 195527 - protein, 9 aa, Tick-borne encephalitis virus
HCAYNMMGK

SEQ ID NO: 195528 - protein, 9 aa, Tick-borne encephalitis virus
CAYNMMGKR

SEQ ID NO: 195529 - protein, 9 aa, Tick-borne encephalitis virus
AYNMMGKRE

SEQ ID NO: 195530 - protein, 9 aa, Tick-borne encephalitis virus
WASRESSGS

SEQ ID NO: 195531 - protein, 9 aa, Tick-borne encephalitis virus
ASRGFSGSG

SEQ ID NO: 195532 - protein, 9 aa, Tick-borne encephalitis virus
SRGFSGSGV

SEQ ID NO: 195533 - protein, 9 aa, Tick-borne encephalitis virus
RESSGSGVE

SEQ ID NO: 195534 - protein, 9 aa, Tick-borne encephalitis virus
GFSGSGVEG

SEQ ID NO: 195535 - protein, 9 aa, Tick-borne encephalitis virus
NYLGWYLKE

SEQ ID NO: 195536 - protein, 9 aa, Tick-borne encephalitis virus
YLGWHLKRL

SEQ ID NO: 195537 - protein, 9 aa, Tick-borne encephalitis virus
LGWYLKELS

SEQ ID NO: 195538 - protein, 9 aa, Tick-borne encephalitis virus
LSTPEGGLF

SEQ ID NO: 195539 - protein, 9 aa, Tick-borne encephalitis virus
STPEGGLFY

SEQ ID NO: 195540 - protein, 9 aa, Tick-borne encephalitis virus
TPEGGLFYA

SEQ ID NO: 195541 - protein, 9 aa, Tick-borne encephalitis virus
EHKQLAATV

SEQ ID NO: 195542 - protein, 9 aa, Tick-borne encephalitis virus
HKQLAATVM

SEQ ID NO: 195543 - protein, 9 aa, Tick-borne encephalitis virus
KQLAATVMQ

SEQ ID NO: 195544 - protein, 9 aa, Tick-borne encephalitis virus
EGEGVVEAS

SEQ ID NO: 195545 - protein, 9 aa, Tick-borne encephalitis virus
GEGVVEASD

SEQ ID NO: 195546 - protein, 9 aa, Tick-borne encephalitis virus
EGVVEASDA

SEQ ID NO: 195547 - protein, 9 aa, Tick-borne encephalitis virus
GVVEASDAH

SEQ ID NO: 195548 - protein, 9 aa, Tick-borne encephalitis virus
VVEASDAHN

SEQ ID NO: 195549 - protein, 9 aa, Tick-borne encephalitis virus
VEASDAHNP

SEQ ID NO: 195550 - protein, 9 aa, Tick-borne encephalitis virus
TDAHNPRLF

SEQ ID NO: 195551 - protein, 9 aa, Tick-borne encephalitis virus
LRVERWLRN

SEQ ID NO: 195552 - protein, 9 aa, Tick-borne encephalitis virus
RVERWLRDY

SEQ ID NO: 195553 - protein, 9 aa, Tick-borne encephalitis virus
VERWLRNHG

SEQ ID NO: 195554 - protein, 9 aa, Tick-borne encephalitis virus
NHGEERLGR

SEQ ID NO: 195555 - protein, 9 aa, Tick-borne encephalitis virus
GDDCVVRGI

SEQ ID NO: 195556 - protein, 9 aa, Tick-borne encephalitis virus
DDCVVRGID

SEQ ID NO: 195557 - protein, 9 aa, Tick-borne encephalitis virus
DCVVRGIDD

SEQ ID NO: 195558 - protein, 9 aa, Tick-borne encephalitis virus
CVVRGIDDR

SEQ ID NO: 195559 - protein, 9 aa, Tick-borne encephalitis virus
VVRGIDDRF

SEQ ID NO: 195560 - protein, 9 aa, Tick-borne encephalitis virus
VRPVDDRFG

SEQ ID NO: 195561 - protein, 9 aa, Tick-borne encephalitis virus
DDRFGRALY

SEQ ID NO: 195562 - protein, 9 aa, Tick-borne encephalitis virus
DRFGRALYF

SEQ ID NO: 195563 - protein, 9 aa, Tick-borne encephalitis virus
RFGRALYFL

SEQ ID NO: 195564 - protein, 9 aa, Tick-borne encephalitis virus
FGRALYFLN

SEQ ID NO: 195565 - protein, 9 aa, Tick-borne encephalitis virus
GRALYFLND

SEQ ID NO: 195566 - protein, 9 aa, Tick-borne encephalitis virus
EWEHSAGFA

SEQ ID NO: 195567 - protein, 9 aa, Tick-borne encephalitis virus
SWEAVPFCS

SEQ ID NO: 195568 - protein, 9 aa, Tick-borne encephalitis virus
VMKDGRALV

SEQ ID NO: 195569 - protein, 9 aa, Tick-borne encephalitis virus
MKDGRALVV

SEQ ID NO: 195570 - protein, 9 aa, Tick-borne encephalitis virus
KDGRALVVP

SEQ ID NO: 195571 - protein, 9 aa, Tick-borne encephalitis virus
DGRALVVPC

SEQ ID NO: 195572 - protein, 9 aa, Tick-borne encephalitis virus
GRALVVPCR

SEQ ID NO: 195573 - protein, 9 aa, Tick-borne encephalitis virus
RALVVPCRD

SEQ ID NO: 195574 - protein, 9 aa, Tick-borne encephalitis virus
ALVVPCRDQ

SEQ ID NO: 195575 - protein, 9 aa, Tick-borne encephalitis virus
LRTLGLAIS

SEQ ID NO: 195576 - protein, 9 aa, Tick-borne encephalitis virus
RTLGLTICS

SEQ ID NO: 195577 - protein, 9 aa, Tick-borne encephalitis virus
TLGLAISSA

SEQ ID NO: 195578 - protein, 9 aa, Tick-borne encephalitis virus
LGLAISSAV

SEQ ID NO: 195579 - protein, 9 aa, Tick-borne encephalitis virus
GLTICSAVP

SEQ ID NO: 195580 - protein, 9 aa, Tick-borne encephalitis virus
SAVPTDWVP

SEQ ID NO: 195581 - protein, 9 aa, Tick-borne encephalitis virus
AVPTDWVPT

SEQ ID NO: 195582 - protein, 9 aa, Tick-borne encephalitis virus
VPTDWVPTG

SEQ ID NO: 195583 - protein, 9 aa, Tick-borne encephalitis virus
PTDWVPTGR

SEQ ID NO: 195584 - protein, 9 aa, Tick-borne encephalitis virus
TDWVPTGRT

SEQ ID NO: 195585 - protein, 9 aa, Tick-borne encephalitis virus
SGAWITTED

SEQ ID NO: 195586 - protein, 9 aa, Tick-borne encephalitis virus
GSWMTTEDM

SEQ ID NO: 195587 - protein, 9 aa, Tick-borne encephalitis virus
SWMTTEDML

SEQ ID NO: 195588 - protein, 9 aa, Tick-borne encephalitis virus
DNPFMHGKE

SEQ ID NO: 195589 - protein, 9 aa, Tick-borne encephalitis virus
NPFMHGKEK

SEQ ID NO: 195590 - protein, 9 aa, Tick-borne encephalitis virus
RNVPYLPKA

SEQ ID NO: 195591 - protein, 9 aa, Tick-borne encephalitis virus
VPYLPKAHD

SEQ ID NO: 195592 - protein, 9 aa, Tick-borne encephalitis virus
RTERAEWAK

SEQ ID NO: 195593 - protein, 9 aa, Tick-borne encephalitis virus
TERAEWAKN

SEQ ID NO: 195594 - protein, 9 aa, Tick-borne encephalitis virus
AVEKVRKMV

SEQ ID NO: 195595 - protein, 9 aa, Tick-borne encephalitis virus
VEKVRKMMG

SEQ ID NO: 195596 - protein, 9 aa, Tick-borne encephalitis virus
KCKDYPSCM

SEQ ID NO: 195597 - protein, 9 aa, Tick-borne encephalitis virus
LHWELKLEG

SEQ ID NO: 195598 - protein, 9 aa, Tick-borne encephalitis virus
HWNLKLESS

SEQ ID NO: 195599 - protein, 9 aa, Tick-borne encephalitis virus
WNLKLESSI

SEQ ID NO: 195600 - protein, 9 aa, Tick-borne encephalitis virus
NLKLESSIF

SEQ ID NO: 195601 - protein, 9 aa, Tick-borne encephalitis virus
RRASKETAK

SEQ ID NO: 195602 - protein, 9 aa, Tick-borne encephalitis virus
RVSKEAAKK

SEQ ID NO: 195603 - protein, 9 aa, Tick-borne encephalitis virus
VSKEAAKKT

SEQ ID NO: 195604 - protein, 9 aa, Tick-borne encephalitis virus
SFWKPVPLK

SEQ ID NO: 195605 - protein, 9 aa, Tick-borne encephalitis virus
KPVPLKQAT

SEQ ID NO: 195606 - protein, 9 aa, Tick-borne encephalitis virus
PVPLKQATA

SEQ ID NO: 195607 - protein, 9 aa, Tick-borne encephalitis virus
RKIKMAVSA

SEQ ID NO: 195608 - protein, 9 aa, Tick-borne encephalitis virus
KIKRAVSTL

SEQ ID NO: 195609 - protein, 9 aa, Tick-borne encephalitis virus
IKKAVSALM

SEQ ID NO: 195610 - protein, 9 aa, Tick-borne encephalitis virus
AVSTLMIGL

SEQ ID NO: 195611 - protein, 9 aa, Tick-borne encephalitis virus
VGLQRREKK

SEQ ID NO: 195612 - protein, 9 aa, Tick-borne encephalitis virus
QRREKKRST

SEQ ID NO: 195613 - protein, 9 aa, Tick-borne encephalitis virus
FAATVRREG

SEQ ID NO: 195614 - protein, 9 aa, Tick-borne encephalitis virus
TVRREGDGT

SEQ ID NO: 195615 - protein, 9 aa, Tick-borne encephalitis virus
VRKERDDTT

SEQ ID NO: 195616 - protein, 9 aa, Tick-borne encephalitis virus
RKERDDTTV

SEQ ID NO: 195617 - protein, 9 aa, Tick-borne encephalitis virus
KERDDTTVI

SEQ ID NO: 195618 - protein, 9 aa, Tick-borne encephalitis virus
VVWMTVESV

SEQ ID NO: 195619 - protein, 9 aa, Tick-borne encephalitis virus
TVESVVTRT

SEQ ID NO: 195620 - protein, 9 aa, Tick-borne encephalitis virus
VVALLCLAP

SEQ ID NO: 195621 - protein, 9 aa, Tick-borne encephalitis virus
AIYQENPAQ

SEQ ID NO: 195622 - protein, 9 aa, Tick-borne encephalitis virus
SIVTCVKVS

SEQ ID NO: 195623 - protein, 9 aa, Tick-borne encephalitis virus
IVTCVKVSC

SEQ ID NO: 195624 - protein, 9 aa, Tick-borne encephalitis virus
VTCVKVSCE

SEQ ID NO: 195625 - protein, 9 aa, Tick-borne encephalitis virus
TCVKVSCEA

SEQ ID NO: 195626 - protein, 9 aa, Tick-borne encephalitis virus
HEGARNWNN

SEQ ID NO: 195627 - protein, 9 aa, Tick-borne encephalitis virus
EGVQNWNNA

SEQ ID NO: 195628 - protein, 9 aa, Tick-borne encephalitis virus
GARNWNNAE

SEQ ID NO: 195629 - protein, 9 aa, Tick-borne encephalitis virus
VQNWNNAER

SEQ ID NO: 195630 - protein, 9 aa, Tick-borne encephalitis virus
KTKFTWRRT

SEQ ID NO: 195631 - protein, 9 aa, Tick-borne encephalitis virus
TKFTWRRTP

SEQ ID NO: 195632 - protein, 9 aa, Tick-borne encephalitis virus
KFTWRRTPT

SEQ ID NO: 195633 - protein, 9 aa, Tick-borne encephalitis virus
FTWRRTPTD

SEQ ID NO: 195634 - protein, 9 aa, Tick-borne encephalitis virus
TWRRTPTDS

SEQ ID NO: 195635 - protein, 9 aa, Tick-borne encephalitis virus
FLSSIGKAL

SEQ ID NO: 195636 - protein, 9 aa, Tick-borne encephalitis virus
VGFIPKLLL

SEQ ID NO: 195637 - protein, 9 aa, Tick-borne encephalitis virus
GFLPKILIG

SEQ ID NO: 195638 - protein, 9 aa, Tick-borne encephalitis virus
IKEAFEEGT

SEQ ID NO: 195639 - protein, 9 aa, Tick-borne encephalitis virus
RETFEEGTC

SEQ ID NO: 195640 - protein, 9 aa, Tick-borne encephalitis virus
EMAMWRSAA

SEQ ID NO: 195641 - protein, 9 aa, Tick-borne encephalitis virus
MAMWRSAAT

SEQ ID NO: 195642 - protein, 9 aa, Tick-borne encephalitis virus
AMWRSSSTE

SEQ ID NO: 195643 - protein, 9 aa, Tick-borne encephalitis virus
MWRSAATEL

SEQ ID NO: 195644 - protein, 9 aa, Tick-borne encephalitis virus
WRSSSTELN

SEQ ID NO: 195645 - protein, 9 aa, Tick-borne encephalitis virus
RSAATELNL

SEQ ID NO: 195646 - protein, 9 aa, Tick-borne encephalitis virus
SSSTELNLA

SEQ ID NO: 195647 - protein, 9 aa, Tick-borne encephalitis virus
AATELNLAL

SEQ ID NO: 195648 - protein, 9 aa, Tick-borne encephalitis virus
SWGHSIIWS

SEQ ID NO: 195649 - protein, 9 aa, Tick-borne encephalitis virus
SVIWSIPEA

SEQ ID NO: 195650 - protein, 9 aa, Tick-borne encephalitis virus
VIWSIPEAP

SEQ ID NO: 195651 - protein, 9 aa, Tick-borne encephalitis virus
LWMKSVRNE

SEQ ID NO: 195652 - protein, 9 aa, Tick-borne encephalitis virus
WMKSVRNET

SEQ ID NO: 195653 - protein, 9 aa, Tick-borne encephalitis virus
MKSVRNETG

SEQ ID NO: 195654 - protein, 9 aa, Tick-borne encephalitis virus
KSVRNETGT

SEQ ID NO: 195655 - protein, 9 aa, Tick-borne encephalitis virus
VRGECPGTK

SEQ ID NO: 195656 - protein, 9 aa, Tick-borne encephalitis virus
ECPGTTVVI

SEQ ID NO: 195657 - protein, 9 aa, Tick-borne encephalitis virus
ITADCDKRG

SEQ ID NO: 195658 - protein, 9 aa, Tick-borne encephalitis virus
SADCDRRGA

SEQ ID NO: 195659 - protein, 9 aa, Tick-borne encephalitis virus
RPATGTTAV

SEQ ID NO: 195660 - protein, 9 aa, Tick-borne encephalitis virus
PATGTTAVW

SEQ ID NO: 195661 - protein, 9 aa, Tick-borne encephalitis virus
ATGTTAVWG

SEQ ID NO: 195662 - protein, 9 aa, Tick-borne encephalitis virus
TGSTVVWGG

SEQ ID NO: 195663 - protein, 9 aa, Tick-borne encephalitis virus
WGGLIVLAL

SEQ ID NO: 195664 - protein, 9 aa, Tick-borne encephalitis virus
GGIVVFALL

SEQ ID NO: 195665 - protein, 9 aa, Tick-borne encephalitis virus
GIVVFALLV

SEQ ID NO: 195666 - protein, 9 aa, Tick-borne encephalitis virus
IVVFALLVT

SEQ ID NO: 195667 - protein, 9 aa, Tick-borne encephalitis virus
LMALMTQQN

SEQ ID NO: 195668 - protein, 9 aa, Tick-borne encephalitis virus
VHYGLMLFL

SEQ ID NO: 195669 - protein, 9 aa, Tick-borne encephalitis virus
HYGLIFFLG

SEQ ID NO: 195670 - protein, 9 aa, Tick-borne encephalitis virus
WRLLEGHRE

SEQ ID NO: 195671 - protein, 9 aa, Tick-borne encephalitis virus
RLLEGHREQ

SEQ ID NO: 195672 - protein, 9 aa, Tick-borne encephalitis virus
KGLSWIVPM

SEQ ID NO: 195673 - protein, 9 aa, Tick-borne encephalitis virus
GLSWIVPMA

SEQ ID NO: 195674 - protein, 9 aa, Tick-borne encephalitis virus
VPLAGLVGG

SEQ ID NO: 195675 - protein, 9 aa, Tick-borne encephalitis virus
PMARLLGGE

SEQ ID NO: 195676 - protein, 9 aa, Tick-borne encephalitis virus
LAGLVGGEG

SEQ ID NO: 195677 - protein, 9 aa, Tick-borne encephalitis virus
AGLAASALH

SEQ ID NO: 195678 - protein, 9 aa, Tick-borne encephalitis virus
GLAASALHW

SEQ ID NO: 195679 - protein, 9 aa, Tick-borne encephalitis virus
LSASAFHWS

SEQ ID NO: 195680 - protein, 9 aa, Tick-borne encephalitis virus
AASALHWSG

SEQ ID NO: 195681 - protein, 9 aa, Tick-borne encephalitis virus
SAIHWSGII

SEQ ID NO: 195682 - protein, 9 aa, Tick-borne encephalitis virus
ALHWSGILG

SEQ ID NO: 195683 - protein, 9 aa, Tick-borne encephalitis virus
LHWSGILGV

SEQ ID NO: 195684 - protein, 9 aa, Tick-borne encephalitis virus
LWTLSEMLK

SEQ ID NO: 195685 - protein, 9 aa, Tick-borne encephalitis virus
DLAFSGQGG

SEQ ID NO: 195686 - protein, 9 aa, Tick-borne encephalitis virus
ALYIDDAVA

SEQ ID NO: 195687 - protein, 9 aa, Tick-borne encephalitis virus
LSIDDAVVG

SEQ ID NO: 195688 - protein, 9 aa, Tick-borne encephalitis virus
SVDDAVVGP

SEQ ID NO: 195689 - protein, 9 aa, Tick-borne encephalitis virus
AGPYWAEVK

SEQ ID NO: 195690 - protein, 9 aa, Tick-borne encephalitis virus
TSRSPILNA

SEQ ID NO: 195691 - protein, 9 aa, Tick-borne encephalitis virus
SGSPIINSQ

SEQ ID NO: 195692 - protein, 9 aa, Tick-borne encephalitis virus
GSPIINSQG

SEQ ID NO: 195693 - protein, 9 aa, Tick-borne encephalitis virus
SPTLNSQGV

SEQ ID NO: 195694 - protein, 9 aa, Tick-borne encephalitis virus
PTLNSQGVV

SEQ ID NO: 195695 - protein, 9 aa, Tick-borne encephalitis virus
TLNSQGVVV

SEQ ID NO: 195696 - protein, 9 aa, Tick-borne encephalitis virus
GSGWTAKGQ

SEQ ID NO: 195697 - protein, 9 aa, Tick-borne encephalitis virus
SGWTAKGQI

SEQ ID NO: 195698 - protein, 9 aa, Tick-borne encephalitis virus
FHSPAVGDH

SEQ ID NO: 195699 - protein, 9 aa, Tick-borne encephalitis virus
LSPAVSDQQ

SEQ ID NO: 195700 - protein, 9 aa, Tick-borne encephalitis virus
DHQGGGAIV

SEQ ID NO: 195701 - protein, 9 aa, Tick-borne encephalitis virus
HQGGGAIVD

SEQ ID NO: 195702 - protein, 9 aa, Tick-borne encephalitis virus
SEERQIPNG

SEQ ID NO: 195703 - protein, 9 aa, Tick-borne encephalitis virus
EVKQIPEGE

SEQ ID NO: 195704 - protein, 9 aa, Tick-borne encephalitis virus
ERQIPNGEW

SEQ ID NO: 195705 - protein, 9 aa, Tick-borne encephalitis virus
AKGGIIARA

SEQ ID NO: 195706 - protein, 9 aa, Tick-borne encephalitis virus
EEPGSSAMR

SEQ ID NO: 195707 - protein, 9 aa, Tick-borne encephalitis virus
APEAFLTMA

SEQ ID NO: 195708 - protein, 9 aa, Tick-borne encephalitis virus
PEAFLTVAE

SEQ ID NO: 195709 - protein, 9 aa, Tick-borne encephalitis virus
AEMLVLGLA

SEQ ID NO: 195710 - protein, 9 aa, Tick-borne encephalitis virus
EMRSWEEWT

SEQ ID NO: 195711 - protein, 9 aa, Tick-borne encephalitis virus
VRSWEEWTN

SEQ ID NO: 195712 - protein, 9 aa, Tick-borne encephalitis virus
GGGAPFFGI

SEQ ID NO: 195713 - protein, 9 aa, Tick-borne encephalitis virus
GGAPFLGVA

SEQ ID NO: 195714 - protein, 9 aa, Tick-borne encephalitis virus
GAPFLGVAG

SEQ ID NO: 195715 - protein, 9 aa, Tick-borne encephalitis virus
APFFGIAGH

SEQ ID NO: 195716 - protein, 9 aa, Tick-borne encephalitis virus
FIGVAGHVM

SEQ ID NO: 195717 - protein, 9 aa, Tick-borne encephalitis virus
GIAGHVMAL

SEQ ID NO: 195718 - protein, 9 aa, Tick-borne encephalitis virus
IAGHVMALG

SEQ ID NO: 195719 - protein, 9 aa, Tick-borne encephalitis virus
MSLVLAVAL

SEQ ID NO: 195720 - protein, 9 aa, Tick-borne encephalitis virus
SLVLAVALC

SEQ ID NO: 195721 - protein, 9 aa, Tick-borne encephalitis virus
LVLAVALCL

SEQ ID NO: 195722 - protein, 9 aa, Tick-borne encephalitis virus
SVVMNRTVL

SEQ ID NO: 195723 - protein, 9 aa, Tick-borne encephalitis virus
TVPSITEAA

SEQ ID NO: 195724 - protein, 9 aa, Tick-borne encephalitis virus
VLSITEASA

SEQ ID NO: 195725 - protein, 9 aa, Tick-borne encephalitis virus
LAAAGQLLK

SEQ ID NO: 195726 - protein, 9 aa, Tick-borne encephalitis virus
AAAGQLLKP

SEQ ID NO: 195727 - protein, 9 aa, Tick-borne encephalitis virus
ALGQLLRPE

SEQ ID NO: 195728 - protein, 9 aa, Tick-borne encephalitis virus
GQLLKPEAD

SEQ ID NO: 195729 - protein, 9 aa, Tick-borne encephalitis virus
QLLKPEADT

SEQ ID NO: 195730 - protein, 9 aa, Tick-borne encephalitis virus
LLRPEEDTL

SEQ ID NO: 195731 - protein, 9 aa, Tick-borne encephalitis virus
LKPEADTLW

SEQ ID NO: 195732 - protein, 9 aa, Tick-borne encephalitis virus
KPEADTLWT

SEQ ID NO: 195733 - protein, 9 aa, Tick-borne encephalitis virus
SCTREEFFA

SEQ ID NO: 195734 - protein, 9 aa, Tick-borne encephalitis virus
CTREEFFAY

SEQ ID NO: 195735 - protein, 9 aa, Tick-borne encephalitis virus
TREEFFAYR

SEQ ID NO: 195736 - protein, 9 aa, Tick-borne encephalitis virus
REEFFAYRR

SEQ ID NO: 195737 - protein, 9 aa, Tick-borne encephalitis virus
FIYRRTGIL

SEQ ID NO: 195738 - protein, 9 aa, Tick-borne encephalitis virus
VYRRAGILE

SEQ ID NO: 195739 - protein, 9 aa, Tick-borne encephalitis virus
DRARELLRR

SEQ ID NO: 195740 - protein, 9 aa, Tick-borne encephalitis virus
RARELLRRG

SEQ ID NO: 195741 - protein, 9 aa, Tick-borne encephalitis virus
GGKGHETPR

SEQ ID NO: 195742 - protein, 9 aa, Tick-borne encephalitis virus
GRGHETPKM

SEQ ID NO: 195743 - protein, 9 aa, Tick-borne encephalitis virus
KGHETPRMV

SEQ ID NO: 195744 - protein, 9 aa, Tick-borne encephalitis virus
VVLADDKVK

SEQ ID NO: 195745 - protein, 9 aa, Tick-borne encephalitis virus
VLADDKVKE

SEQ ID NO: 195746 - protein, 9 aa, Tick-borne encephalitis virus
LADDKVKEK

SEQ ID NO: 195747 - protein, 9 aa, Tick-borne encephalitis virus
ADDKVKEKD

SEQ ID NO: 195748 - protein, 9 aa, Tick-borne encephalitis virus
DDKVKEKDV

SEQ ID NO: 195749 - protein, 9 aa, Tick-borne encephalitis virus
DKVKEQDVR

SEQ ID NO: 195750 - protein, 9 aa, Tick-borne encephalitis virus
KVKEQDVRE

SEQ ID NO: 195751 - protein, 9 aa, Tick-borne encephalitis virus
DVQERIKAL

SEQ ID NO: 195752 - protein, 9 aa, Tick-borne encephalitis virus
ERIRALKEQ

SEQ ID NO: 195753 - protein, 9 aa, Tick-borne encephalitis virus
RIRALKEQY

SEQ ID NO: 195754 - protein, 9 aa, Tick-borne encephalitis virus
DAEHPYRTW

SEQ ID NO: 195755 - protein, 9 aa, Tick-borne encephalitis virus
MLDRLAQKS

SEQ ID NO: 195756 - protein, 9 aa, Tick-borne encephalitis virus
RPRMCSKEE

SEQ ID NO: 195757 - protein, 9 aa, Tick-borne encephalitis virus
AVEDPAFWK

SEQ ID NO: 195758 - protein, 9 aa, Tick-borne encephalitis virus
VEDPAFWKL

SEQ ID NO: 195759 - protein, 9 aa, Tick-borne encephalitis virus
EDPAFWKLV

SEQ ID NO: 195760 - protein, 9 aa, Tick-borne encephalitis virus
DPAFWKLVD

SEQ ID NO: 195761 - protein, 9 aa, Tick-borne encephalitis virus
PAFWKLVDE

SEQ ID NO: 195762 - protein, 9 aa, Tick-borne encephalitis virus
AFWKLVDEE

SEQ ID NO: 195763 - protein, 9 aa, Tick-borne encephalitis virus
LTGRCAHCV

SEQ ID NO: 195764 - protein, 9 aa, Tick-borne encephalitis virus
WASRGSSGA

SEQ ID NO: 195765 - protein, 9 aa, Tick-borne encephalitis virus
ASRGSSGAG

SEQ ID NO: 195766 - protein, 9 aa, Tick-borne encephalitis virus
SRGSSGAGV

SEQ ID NO: 195767 - protein, 9 aa, Tick-borne encephalitis virus
RGSSGAGVE

SEQ ID NO: 195768 - protein, 9 aa, Tick-borne encephalitis virus
GSSGAGVEG

SEQ ID NO: 195769 - protein, 9 aa, Tick-borne encephalitis virus
NYLGWHLKR

SEQ ID NO: 195770 - protein, 9 aa, Tick-borne encephalitis virus
YLGWYLKEL

SEQ ID NO: 195771 - protein, 9 aa, Tick-borne encephalitis virus
LGWHLKRLS

SEQ ID NO: 195772 - protein, 9 aa, Tick-borne encephalitis virus
FRVERWLRD

SEQ ID NO: 195773 - protein, 9 aa, Tick-borne encephalitis virus
RVERWLREH

SEQ ID NO: 195774 - protein, 9 aa, Tick-borne encephalitis virus
VERWLREHG

SEQ ID NO: 195775 - protein, 9 aa, Tick-borne encephalitis virus
DYGEERLGR

SEQ ID NO: 195776 - protein, 9 aa, Tick-borne encephalitis virus
VRGIDDRFG

SEQ ID NO: 195777 - protein, 9 aa, Tick-borne encephalitis virus
DDRFSGALY

SEQ ID NO: 195778 - protein, 9 aa, Tick-borne encephalitis virus
DRFSGALYF

SEQ ID NO: 195779 - protein, 9 aa, Tick-borne encephalitis virus
RFSGALYFL

SEQ ID NO: 195780 - protein, 9 aa, Tick-borne encephalitis virus
FSGALYFLN

SEQ ID NO: 195781 - protein, 9 aa, Tick-borne encephalitis virus
SGALYFLND

SEQ ID NO: 195782 - protein, 9 aa, Tick-borne encephalitis virus
SVEEVPFCS

SEQ ID NO: 195783 - protein, 9 aa, Tick-borne encephalitis virus
LRTLGFAIC

SEQ ID NO: 195784 - protein, 9 aa, Tick-borne encephalitis virus
RTLGFAICS

SEQ ID NO: 195785 - protein, 9 aa, Tick-borne encephalitis virus
TLGFAICSA

SEQ ID NO: 195786 - protein, 9 aa, Tick-borne encephalitis virus
LGFAICSAV

SEQ ID NO: 195787 - protein, 9 aa, Tick-borne encephalitis virus
GLAISSAVP

SEQ ID NO: 195788 - protein, 9 aa, Tick-borne encephalitis virus
NPFMQNKGK

SEQ ID NO: 195789 - protein, 9 aa, Tick-borne encephalitis virus
IPYLPKAQD

SEQ ID NO: 195790 - protein, 9 aa, Tick-borne encephalitis virus
AVEKVRKIV

SEQ ID NO: 195791 - protein, 9 aa, Tick-borne encephalitis virus
VEKVRKMVG

SEQ ID NO: 195792 - protein, 10 aa, Tick-borne encephalitis virus
MAGKAILKGK

SEQ ID NO: 195793 - protein, 10 aa, Tick-borne encephalitis virus
AGKAILKGKG

SEQ ID NO: 195794 - protein, 10 aa, Tick-borne encephalitis virus
GKAILKGKGG

SEQ ID NO: 195795 - protein, 10 aa, Tick-borne encephalitis virus
KAILKGKGGG

SEQ ID NO: 195796 - protein, 10 aa, Tick-borne encephalitis virus
AILKGKGGGP

SEQ ID NO: 195797 - protein, 10 aa, Tick-borne encephalitis virus
ILKGKGGGPP

SEQ ID NO: 195798 - protein, 10 aa, Tick-borne encephalitis virus
LKGKGGGPPR

SEQ ID NO: 195799 - protein, 10 aa, Tick-borne encephalitis virus
KGKGGGPPRR

SEQ ID NO: 195800 - protein, 10 aa, Tick-borne encephalitis virus
GKGGGPPRRV

SEQ ID NO: 195801 - protein, 10 aa, Tick-borne encephalitis virus
KGGGPPRRVS

SEQ ID NO: 195802 - protein, 10 aa, Tick-borne encephalitis virus
GGGPPRRVSK

SEQ ID NO: 195803 - protein, 10 aa, Tick-borne encephalitis virus
GGPPRRVSKE

SEQ ID NO: 195804 - protein, 10 aa, Tick-borne encephalitis virus
GPPRRVSKET

SEQ ID NO: 195805 - protein, 10 aa, Tick-borne encephalitis virus
PPRRVSKETA

SEQ ID NO: 195806 - protein, 10 aa, Tick-borne encephalitis virus
PRRVSKETAK

SEQ ID NO: 195807 - protein, 10 aa, Tick-borne encephalitis virus
RRVSKETAKK

SEQ ID NO: 195808 - protein, 10 aa, Tick-borne encephalitis virus
RVSKETAKKT

SEQ ID NO: 195809 - protein, 10 aa, Tick-borne encephalitis virus
VSKETAKKTR

SEQ ID NO: 195810 - protein, 10 aa, Tick-borne encephalitis virus
SKETAKKTRQ

SEQ ID NO: 195811 - protein, 10 aa, Tick-borne encephalitis virus
KETAKKTRQS

SEQ ID NO: 195812 - protein, 10 aa, Tick-borne encephalitis virus
ETAKKTRQSR

SEQ ID NO: 195813 - protein, 10 aa, Tick-borne encephalitis virus
TAKKTRQSRV

SEQ ID NO: 195814 - protein, 10 aa, Tick-borne encephalitis virus
AKKTRQSRVQ

SEQ ID NO: 195815 - protein, 10 aa, Tick-borne encephalitis virus
KKTRQSRVQM

SEQ ID NO: 195816 - protein, 10 aa, Tick-borne encephalitis virus
KTRQSRVQMP

SEQ ID NO: 195817 - protein, 10 aa, Tick-borne encephalitis virus
TRQSRVQMPN

SEQ ID NO: 195818 - protein, 10 aa, Tick-borne encephalitis virus
RQSRVQMPNG

SEQ ID NO: 195819 - protein, 10 aa, Tick-borne encephalitis virus
QSRVQMPNGL

SEQ ID NO: 195820 - protein, 10 aa, Tick-borne encephalitis virus
SRVQMPNGLV

SEQ ID NO: 195821 - protein, 10 aa, Tick-borne encephalitis virus
RVQMPNGLVL

SEQ ID NO: 195822 - protein, 10 aa, Tick-borne encephalitis virus
VQMPNGLVLM

SEQ ID NO: 195823 - protein, 10 aa, Tick-borne encephalitis virus
QMPNGLVLMR

SEQ ID NO: 195824 - protein, 10 aa, Tick-borne encephalitis virus
MPNGLVLMRM

SEQ ID NO: 195825 - protein, 10 aa, Tick-borne encephalitis virus
PNGLVLMRMM

SEQ ID NO: 195826 - protein, 10 aa, Tick-borne encephalitis virus
NGLVLMRMMG

SEQ ID NO: 195827 - protein, 10 aa, Tick-borne encephalitis virus
GLVLMRMMGI

SEQ ID NO: 195828 - protein, 10 aa, Tick-borne encephalitis virus
LVLMRMMGIL

SEQ ID NO: 195829 - protein, 10 aa, Tick-borne encephalitis virus
VLMRMMGILW

SEQ ID NO: 195830 - protein, 10 aa, Tick-borne encephalitis virus
LMRMMGILWH

SEQ ID NO: 195831 - protein, 10 aa, Tick-borne encephalitis virus
MRMMGILWHA

SEQ ID NO: 195832 - protein, 10 aa, Tick-borne encephalitis virus
RMMGILWHAV

SEQ ID NO: 195833 - protein, 10 aa, Tick-borne encephalitis virus
MMGILWHAVA

SEQ ID NO: 195834 - protein, 10 aa, Tick-borne encephalitis virus
MGILWHAVAG

SEQ ID NO: 195835 - protein, 10 aa, Tick-borne encephalitis virus
GILWHAVAGT

SEQ ID NO: 195836 - protein, 10 aa, Tick-borne encephalitis virus
ILWHAVAGTA

SEQ ID NO: 195837 - protein, 10 aa, Tick-borne encephalitis virus
LWHAVAGTAR

SEQ ID NO: 195838 - protein, 10 aa, Tick-borne encephalitis virus
WHAVAGTARS

SEQ ID NO: 195839 - protein, 10 aa, Tick-borne encephalitis virus
HAVAGTARSP

SEQ ID NO: 195840 - protein, 10 aa, Tick-borne encephalitis virus
AVAGTARSPV

SEQ ID NO: 195841 - protein, 10 aa, Tick-borne encephalitis virus
VAGTARSPVL

SEQ ID NO: 195842 - protein, 10 aa, Tick-borne encephalitis virus
AGTARSPVLK

SEQ ID NO: 195843 - protein, 10 aa, Tick-borne encephalitis virus
GTARSPVLKS

SEQ ID NO: 195844 - protein, 10 aa, Tick-borne encephalitis virus
TARSPVLKSF

SEQ ID NO: 195845 - protein, 10 aa, Tick-borne encephalitis virus
ARSPVLKSFW

SEQ ID NO: 195846 - protein, 10 aa, Tick-borne encephalitis virus
RSPVLKSFWN

SEQ ID NO: 195847 - protein, 10 aa, Tick-borne encephalitis virus
SPVLKSFWNS

SEQ ID NO: 195848 - protein, 10 aa, Tick-borne encephalitis virus
PVLKSFWNSV

SEQ ID NO: 195849 - protein, 10 aa, Tick-borne encephalitis virus
VLKSFWNSVP

SEQ ID NO: 195850 - protein, 10 aa, Tick-borne encephalitis virus
LKSFWNSVPL

SEQ ID NO: 195851 - protein, 10 aa, Tick-borne encephalitis virus
KSFWNSVPLK

SEQ ID NO: 195852 - protein, 10 aa, Tick-borne encephalitis virus
SFWNSVPLKQ

SEQ ID NO: 195853 - protein, 10 aa, Tick-borne encephalitis virus
FWNSVPLKQA

SEQ ID NO: 195854 - protein, 10 aa, Tick-borne encephalitis virus
WNSVPLKQAT

SEQ ID NO: 195855 - protein, 10 aa, Tick-borne encephalitis virus
SVPLKQATAA

SEQ ID NO: 195856 - protein, 10 aa, Tick-borne encephalitis virus
VPLKQATAAL

SEQ ID NO: 195857 - protein, 10 aa, Tick-borne encephalitis virus
PLKQATAALR

SEQ ID NO: 195858 - protein, 10 aa, Tick-borne encephalitis virus
LKQATAALRK

SEQ ID NO: 195859 - protein, 10 aa, Tick-borne encephalitis virus
KQATAALRKI

SEQ ID NO: 195860 - protein, 10 aa, Tick-borne encephalitis virus
QATAALRKIK

SEQ ID NO: 195861 - protein, 10 aa, Tick-borne encephalitis virus
ATAALRKIKK

SEQ ID NO: 195862 - protein, 10 aa, Tick-borne encephalitis virus
TAALRKIKKA

SEQ ID NO: 195863 - protein, 10 aa, Tick-borne encephalitis virus
AALRKIKKAV

SEQ ID NO: 195864 - protein, 10 aa, Tick-borne encephalitis virus
ALRKIKKAVS

SEQ ID NO: 195865 - protein, 10 aa, Tick-borne encephalitis virus
LRKIKKAVST

SEQ ID NO: 195866 - protein, 10 aa, Tick-borne encephalitis virus
RKIKKAVSTL

SEQ ID NO: 195867 - protein, 10 aa, Tick-borne encephalitis virus
KIKKAVSTLM

SEQ ID NO: 195868 - protein, 10 aa, Tick-borne encephalitis virus
AVSTLMVGLQ

SEQ ID NO: 195869 - protein, 10 aa, Tick-borne encephalitis virus
LMVGLQRRGK

SEQ ID NO: 195870 - protein, 10 aa, Tick-borne encephalitis virus
MVGLQRRGKR

SEQ ID NO: 195871 - protein, 10 aa, Tick-borne encephalitis virus
VGLQRRGKRR

SEQ ID NO: 195872 - protein, 10 aa, Tick-borne encephalitis virus
GLQRRGKRRS

SEQ ID NO: 195873 - protein, 10 aa, Tick-borne encephalitis virus
LQRRGKRRSA

SEQ ID NO: 195874 - protein, 10 aa, Tick-borne encephalitis virus
TLAATVRKER

SEQ ID NO: 195875 - protein, 10 aa, Tick-borne encephalitis virus
LAATVRKERD

SEQ ID NO: 195876 - protein, 10 aa, Tick-borne encephalitis virus
AATVRKERDG

SEQ ID NO: 195877 - protein, 10 aa, Tick-borne encephalitis virus
ATVRKERDGT

SEQ ID NO: 195878 - protein, 10 aa, Tick-borne encephalitis virus
TVRKERDGTT

SEQ ID NO: 195879 - protein, 10 aa, Tick-borne encephalitis virus
VRKERDGTTV

SEQ ID NO: 195880 - protein, 10 aa, Tick-borne encephalitis virus
RKERDGTTVI

SEQ ID NO: 195881 - protein, 10 aa, Tick-borne encephalitis virus
KERDGTTVIR

SEQ ID NO: 195882 - protein, 10 aa, Tick-borne encephalitis virus
ERDGTTVIRA

SEQ ID NO: 195883 - protein, 10 aa, Tick-borne encephalitis virus
RDGTTVIRAE

SEQ ID NO: 195884 - protein, 10 aa, Tick-borne encephalitis virus
DGTTVIRAEG

SEQ ID NO: 195885 - protein, 10 aa, Tick-borne encephalitis virus
GTTVIRAEGK

SEQ ID NO: 195886 - protein, 10 aa, Tick-borne encephalitis virus
TTVIRAEGKD

SEQ ID NO: 195887 - protein, 10 aa, Tick-borne encephalitis virus
TVIRAEGKDA

SEQ ID NO: 195888 - protein, 10 aa, Tick-borne encephalitis virus
VIRAEGKDAA

SEQ ID NO: 195889 - protein, 10 aa, Tick-borne encephalitis virus
IRAEGKDAAT

SEQ ID NO: 195890 - protein, 10 aa, Tick-borne encephalitis virus
RAEGKDAATQ

SEQ ID NO: 195891 - protein, 10 aa, Tick-borne encephalitis virus
AEGKDAATQV

SEQ ID NO: 195892 - protein, 10 aa, Tick-borne encephalitis virus
EGKDAATQVR

SEQ ID NO: 195893 - protein, 10 aa, Tick-borne encephalitis virus
GKDAATQVRV

SEQ ID NO: 195894 - protein, 10 aa, Tick-borne encephalitis virus
KDAATQVRVE

SEQ ID NO: 195895 - protein, 10 aa, Tick-borne encephalitis virus
DAATQVRVEN

SEQ ID NO: 195896 - protein, 10 aa, Tick-borne encephalitis virus
AATQVRVENG

SEQ ID NO: 195897 - protein, 10 aa, Tick-borne encephalitis virus
ATQVRVENGT

SEQ ID NO: 195898 - protein, 10 aa, Tick-borne encephalitis virus
TQVRVENGTC

SEQ ID NO: 195899 - protein, 10 aa, Tick-borne encephalitis virus
QVRVENGTCV

SEQ ID NO: 195900 - protein, 10 aa, Tick-borne encephalitis virus
VRVENGTCVI

SEQ ID NO: 195901 - protein, 10 aa, Tick-borne encephalitis virus
RVENGTCVIL

SEQ ID NO: 195902 - protein, 10 aa, Tick-borne encephalitis virus
VENGTCVILA

SEQ ID NO: 195903 - protein, 10 aa, Tick-borne encephalitis virus
ENGTCVILAT

SEQ ID NO: 195904 - protein, 10 aa, Tick-borne encephalitis virus
NGTCVILATD

SEQ ID NO: 195905 - protein, 10 aa, Tick-borne encephalitis virus
GTCVILATDM

SEQ ID NO: 195906 - protein, 10 aa, Tick-borne encephalitis virus
TCVILATDMG

SEQ ID NO: 195907 - protein, 10 aa, Tick-borne encephalitis virus
CVILATDMGS

SEQ ID NO: 195908 - protein, 10 aa, Tick-borne encephalitis virus
VILATDMGSW

SEQ ID NO: 195909 - protein, 10 aa, Tick-borne encephalitis virus
ILATDMGSWC

SEQ ID NO: 195910 - protein, 10 aa, Tick-borne encephalitis virus
LATDMGSWCD

SEQ ID NO: 195911 - protein, 10 aa, Tick-borne encephalitis virus
ATDMGSWCDD

SEQ ID NO: 195912 - protein, 10 aa, Tick-borne encephalitis virus
TDMGSWCDDS

SEQ ID NO: 195913 - protein, 10 aa, Tick-borne encephalitis virus
DMGSWCDDSL

SEQ ID NO: 195914 - protein, 10 aa, Tick-borne encephalitis virus
MGSWCDDSLT

SEQ ID NO: 195915 - protein, 10 aa, Tick-borne encephalitis virus
GSWCDDSLTY

SEQ ID NO: 195916 - protein, 10 aa, Tick-borne encephalitis virus
SWCDDSLTYE

SEQ ID NO: 195917 - protein, 10 aa, Tick-borne encephalitis virus
WCDDSLTYEC

SEQ ID NO: 195918 - protein, 10 aa, Tick-borne encephalitis virus
CDDSLTYECV

SEQ ID NO: 195919 - protein, 10 aa, Tick-borne encephalitis virus
DDSLTYECVT

SEQ ID NO: 195920 - protein, 10 aa, Tick-borne encephalitis virus
DSLTYECVTI

SEQ ID NO: 195921 - protein, 10 aa, Tick-borne encephalitis virus
SLTYECVTID

SEQ ID NO: 195922 - protein, 10 aa, Tick-borne encephalitis virus
LTYECVTIDQ

SEQ ID NO: 195923 - protein, 10 aa, Tick-borne encephalitis virus
TYECVTIDQG

SEQ ID NO: 195924 - protein, 10 aa, Tick-borne encephalitis virus
YECVTIDQGE

SEQ ID NO: 195925 - protein, 10 aa, Tick-borne encephalitis virus
ECVTIDQGEE

SEQ ID NO: 195926 - protein, 10 aa, Tick-borne encephalitis virus
CVTIDQGEEP

SEQ ID NO: 195927 - protein, 10 aa, Tick-borne encephalitis virus
VTIDQGEEPV

SEQ ID NO: 195928 - protein, 10 aa, Tick-borne encephalitis virus
TIDQGEEPVD

SEQ ID NO: 195929 - protein, 10 aa, Tick-borne encephalitis virus
IDQGEEPVDV

SEQ ID NO: 195930 - protein, 10 aa, Tick-borne encephalitis virus
DQGEEPVDVD

SEQ ID NO: 195931 - protein, 10 aa, Tick-borne encephalitis virus
QGEEPVDVDC

SEQ ID NO: 195932 - protein, 10 aa, Tick-borne encephalitis virus
GEEPVDVDCF

SEQ ID NO: 195933 - protein, 10 aa, Tick-borne encephalitis virus
EEPVDVDCFC

SEQ ID NO: 195934 - protein, 10 aa, Tick-borne encephalitis virus
EPVDVDCFCR

SEQ ID NO: 195935 - protein, 10 aa, Tick-borne encephalitis virus
PVDVDCFCRN

SEQ ID NO: 195936 - protein, 10 aa, Tick-borne encephalitis virus
VDVDCFCRNV

SEQ ID NO: 195937 - protein, 10 aa, Tick-borne encephalitis virus
DVDCFCRNVD

SEQ ID NO: 195938 - protein, 10 aa, Tick-borne encephalitis virus
VDCFCRNVDG

SEQ ID NO: 195939 - protein, 10 aa, Tick-borne encephalitis virus
DCFCRNVDGV

SEQ ID NO: 195940 - protein, 10 aa, Tick-borne encephalitis virus
CFCRNVDGVY

SEQ ID NO: 195941 - protein, 10 aa, Tick-borne encephalitis virus
FCRNVDGVYL

SEQ ID NO: 195942 - protein, 10 aa, Tick-borne encephalitis virus
CRNVDGVYLE

SEQ ID NO: 195943 - protein, 10 aa, Tick-borne encephalitis virus
RNVDGVYLEY

SEQ ID NO: 195944 - protein, 10 aa, Tick-borne encephalitis virus
NVDGVYLEYG

SEQ ID NO: 195945 - protein, 10 aa, Tick-borne encephalitis virus
VDGVYLEYGR

SEQ ID NO: 195946 - protein, 10 aa, Tick-borne encephalitis virus
DGVYLEYGRC

SEQ ID NO: 195947 - protein, 10 aa, Tick-borne encephalitis virus
GVYLEYGRCG

SEQ ID NO: 195948 - protein, 10 aa, Tick-borne encephalitis virus
VYLEYGRCGK

SEQ ID NO: 195949 - protein, 10 aa, Tick-borne encephalitis virus
YLEYGRCGKQ

SEQ ID NO: 195950 - protein, 10 aa, Tick-borne encephalitis virus
LEYGRCGKQE

SEQ ID NO: 195951 - protein, 10 aa, Tick-borne encephalitis virus
EYGRCGKQEG

SEQ ID NO: 195952 - protein, 10 aa, Tick-borne encephalitis virus
YGRCGKQEGS

SEQ ID NO: 195953 - protein, 10 aa, Tick-borne encephalitis virus
GRCGKQEGSR

SEQ ID NO: 195954 - protein, 10 aa, Tick-borne encephalitis virus
RCGKQEGSRT

SEQ ID NO: 195955 - protein, 10 aa, Tick-borne encephalitis virus
CGKQEGSRTR

SEQ ID NO: 195956 - protein, 10 aa, Tick-borne encephalitis virus
GKQEGSRTRR

SEQ ID NO: 195957 - protein, 10 aa, Tick-borne encephalitis virus
KQEGSRTRRS

SEQ ID NO: 195958 - protein, 10 aa, Tick-borne encephalitis virus
QEGSRTRRSV

SEQ ID NO: 195959 - protein, 10 aa, Tick-borne encephalitis virus
EGSRTRRSVL

SEQ ID NO: 195960 - protein, 10 aa, Tick-borne encephalitis virus
GSRTRRSVLI

SEQ ID NO: 195961 - protein, 10 aa, Tick-borne encephalitis virus
SRTRRSVLIP

SEQ ID NO: 195962 - protein, 10 aa, Tick-borne encephalitis virus
RTRRSVLIPS

SEQ ID NO: 195963 - protein, 10 aa, Tick-borne encephalitis virus
TRRSVLIPSH

SEQ ID NO: 195964 - protein, 10 aa, Tick-borne encephalitis virus
RRSVLIPSHA

SEQ ID NO: 195965 - protein, 10 aa, Tick-borne encephalitis virus
RSVLIPSHAQ

SEQ ID NO: 195966 - protein, 10 aa, Tick-borne encephalitis virus
SVLIPSHAQG

SEQ ID NO: 195967 - protein, 10 aa, Tick-borne encephalitis virus
VLIPSHAQGD

SEQ ID NO: 195968 - protein, 10 aa, Tick-borne encephalitis virus
LIPSHAQGDL

SEQ ID NO: 195969 - protein, 10 aa, Tick-borne encephalitis virus
IPSHAQGDLT

SEQ ID NO: 195970 - protein, 10 aa, Tick-borne encephalitis virus
PSHAQGDLTG

SEQ ID NO: 195971 - protein, 10 aa, Tick-borne encephalitis virus
SHAQGDLTGR

SEQ ID NO: 195972 - protein, 10 aa, Tick-borne encephalitis virus
HAQGDLTGRG

SEQ ID NO: 195973 - protein, 10 aa, Tick-borne encephalitis virus
AQGDLTGRGH

SEQ ID NO: 195974 - protein, 10 aa, Tick-borne encephalitis virus
QGDLTGRGHK

SEQ ID NO: 195975 - protein, 10 aa, Tick-borne encephalitis virus
GDLTGRGHKW

SEQ ID NO: 195976 - protein, 10 aa, Tick-borne encephalitis virus
DLTGRGHKWL

SEQ ID NO: 195977 - protein, 10 aa, Tick-borne encephalitis virus
LTGRGHKWLE

SEQ ID NO: 195978 - protein, 10 aa, Tick-borne encephalitis virus
TGRGHKWLEG

SEQ ID NO: 195979 - protein, 10 aa, Tick-borne encephalitis virus
GRGHKWLEGD

SEQ ID NO: 195980 - protein, 10 aa, Tick-borne encephalitis virus
RGHKWLEGDS

SEQ ID NO: 195981 - protein, 10 aa, Tick-borne encephalitis virus
GHKWLEGDSL

SEQ ID NO: 195982 - protein, 10 aa, Tick-borne encephalitis virus
HKWLEGDSLR

SEQ ID NO: 195983 - protein, 10 aa, Tick-borne encephalitis virus
KWLEGDSLRT

SEQ ID NO: 195984 - protein, 10 aa, Tick-borne encephalitis virus
WLEGDSLRTH

SEQ ID NO: 195985 - protein, 10 aa, Tick-borne encephalitis virus
LEGDSLRTHL

SEQ ID NO: 195986 - protein, 10 aa, Tick-borne encephalitis virus
EGDSLRTHLT

SEQ ID NO: 195987 - protein, 10 aa, Tick-borne encephalitis virus
GDSLRTHLTR

SEQ ID NO: 195988 - protein, 10 aa, Tick-borne encephalitis virus
DSLRTHLTRV

SEQ ID NO: 195989 - protein, 10 aa, Tick-borne encephalitis virus
SLRTHLTRVE

SEQ ID NO: 195990 - protein, 10 aa, Tick-borne encephalitis virus
LRTHLTRVEG

SEQ ID NO: 195991 - protein, 10 aa, Tick-borne encephalitis virus
RTHLTRVEGW

SEQ ID NO: 195992 - protein, 10 aa, Tick-borne encephalitis virus
THLTRVEGWV

SEQ ID NO: 195993 - protein, 10 aa, Tick-borne encephalitis virus
HLTRVEGWVW

SEQ ID NO: 195994 - protein, 10 aa, Tick-borne encephalitis virus
LTRVEGWVWK

SEQ ID NO: 195995 - protein, 10 aa, Tick-borne encephalitis virus
TRVEGWVWKN

SEQ ID NO: 195996 - protein, 10 aa, Tick-borne encephalitis virus
RVEGWVWKNK

SEQ ID NO: 195997 - protein, 10 aa, Tick-borne encephalitis virus
VVWLTVESVV

SEQ ID NO: 195998 - protein, 10 aa, Tick-borne encephalitis virus
VWLTVESVVT

SEQ ID NO: 195999 - protein, 10 aa, Tick-borne encephalitis virus
WLTVESVVTR

SEQ ID NO: 196000 - protein, 10 aa, Tick-borne encephalitis virus
VVVLLCLAPV

SEQ ID NO: 196001 - protein, 10 aa, Tick-borne encephalitis virus
VVLLCLAPVY

SEQ ID NO: 196002 - protein, 10 aa, Tick-borne encephalitis virus
VLLCLAPVYA

SEQ ID NO: 196003 - protein, 10 aa, Tick-borne encephalitis virus
LLCLAPVYAS

SEQ ID NO: 196004 - protein, 10 aa, Tick-borne encephalitis virus
LCLAPVYASR

SEQ ID NO: 196005 - protein, 10 aa, Tick-borne encephalitis virus
CLAPVYASRC

SEQ ID NO: 196006 - protein, 10 aa, Tick-borne encephalitis virus
LAPVYASRCT

SEQ ID NO: 196007 - protein, 10 aa, Tick-borne encephalitis virus
APVYASRCTH

SEQ ID NO: 196008 - protein, 10 aa, Tick-borne encephalitis virus
PVYASRCTHL

SEQ ID NO: 196009 - protein, 10 aa, Tick-borne encephalitis virus
VYASRCTHLE

SEQ ID NO: 196010 - protein, 10 aa, Tick-borne encephalitis virus
YASRCTHLEN

SEQ ID NO: 196011 - protein, 10 aa, Tick-borne encephalitis virus
ASRCTHLENR

SEQ ID NO: 196012 - protein, 10 aa, Tick-borne encephalitis virus
SRCTHLENRD

SEQ ID NO: 196013 - protein, 10 aa, Tick-borne encephalitis virus
RCTHLENRDF

SEQ ID NO: 196014 - protein, 10 aa, Tick-borne encephalitis virus
CTHLENRDFV

SEQ ID NO: 196015 - protein, 10 aa, Tick-borne encephalitis virus
THLENRDFVT

SEQ ID NO: 196016 - protein, 10 aa, Tick-borne encephalitis virus
HLENRDFVTG

SEQ ID NO: 196017 - protein, 10 aa, Tick-borne encephalitis virus
LENRDFVTGT

SEQ ID NO: 196018 - protein, 10 aa, Tick-borne encephalitis virus
ENRDFVTGTQ

SEQ ID NO: 196019 - protein, 10 aa, Tick-borne encephalitis virus
NRDFVTGTQG

SEQ ID NO: 196020 - protein, 10 aa, Tick-borne encephalitis virus
RDFVTGTQGT

SEQ ID NO: 196021 - protein, 10 aa, Tick-borne encephalitis virus
DFVTGTQGTT

SEQ ID NO: 196022 - protein, 10 aa, Tick-borne encephalitis virus
FVTGTQGTTR

SEQ ID NO: 196023 - protein, 10 aa, Tick-borne encephalitis virus
VTGTQGTTRV

SEQ ID NO: 196024 - protein, 10 aa, Tick-borne encephalitis virus
TGTQGTTRVT

SEQ ID NO: 196025 - protein, 10 aa, Tick-borne encephalitis virus
GTQGTTRVTL

SEQ ID NO: 196026 - protein, 10 aa, Tick-borne encephalitis virus
TQGTTRVTLV

SEQ ID NO: 196027 - protein, 10 aa, Tick-borne encephalitis virus
QGTTRVTLVL

SEQ ID NO: 196028 - protein, 10 aa, Tick-borne encephalitis virus
GTTRVTLVLE

SEQ ID NO: 196029 - protein, 10 aa, Tick-borne encephalitis virus
TTRVTLVLEL

SEQ ID NO: 196030 - protein, 10 aa, Tick-borne encephalitis virus
TRVTLVLELG

SEQ ID NO: 196031 - protein, 10 aa, Tick-borne encephalitis virus
RVTLVLELGG

SEQ ID NO: 196032 - protein, 10 aa, Tick-borne encephalitis virus
VTLVLELGGC

SEQ ID NO: 196033 - protein, 10 aa, Tick-borne encephalitis virus
TLVLELGGCV

SEQ ID NO: 196034 - protein, 10 aa, Tick-borne encephalitis virus
LVLELGGCVT

SEQ ID NO: 196035 - protein, 10 aa, Tick-borne encephalitis virus
VLELGGCVTI

SEQ ID NO: 196036 - protein, 10 aa, Tick-borne encephalitis virus
LELGGCVTIT

SEQ ID NO: 196037 - protein, 10 aa, Tick-borne encephalitis virus
ELGGCVTITA

SEQ ID NO: 196038 - protein, 10 aa, Tick-borne encephalitis virus
LGGCVTITAE

SEQ ID NO: 196039 - protein, 10 aa, Tick-borne encephalitis virus
GGCVTITAEG

SEQ ID NO: 196040 - protein, 10 aa, Tick-borne encephalitis virus
GCVTITAEGK

SEQ ID NO: 196041 - protein, 10 aa, Tick-borne encephalitis virus
CVTITAEGKP

SEQ ID NO: 196042 - protein, 10 aa, Tick-borne encephalitis virus
VTITAEGKPS

SEQ ID NO: 196043 - protein, 10 aa, Tick-borne encephalitis virus
TITAEGKPSM

SEQ ID NO: 196044 - protein, 10 aa, Tick-borne encephalitis virus
ITAEGKPSMD

SEQ ID NO: 196045 - protein, 10 aa, Tick-borne encephalitis virus
TAEGKPSMDV

SEQ ID NO: 196046 - protein, 10 aa, Tick-borne encephalitis virus
AEGKPSMDVW

SEQ ID NO: 196047 - protein, 10 aa, Tick-borne encephalitis virus
EGKPSMDVWL

SEQ ID NO: 196048 - protein, 10 aa, Tick-borne encephalitis virus
GKPSMDVWLD

SEQ ID NO: 196049 - protein, 10 aa, Tick-borne encephalitis virus
KPSMDVWLDS

SEQ ID NO: 196050 - protein, 10 aa, Tick-borne encephalitis virus
PSMDVWLDSI

SEQ ID NO: 196051 - protein, 10 aa, Tick-borne encephalitis virus
SMDVWLDSIY

SEQ ID NO: 196052 - protein, 10 aa, Tick-borne encephalitis virus
MDVWLDSIYQ

SEQ ID NO: 196053 - protein, 10 aa, Tick-borne encephalitis virus
DVWLDSIYQE

SEQ ID NO: 196054 - protein, 10 aa, Tick-borne encephalitis virus
VWLDSIYQEN

SEQ ID NO: 196055 - protein, 10 aa, Tick-borne encephalitis virus
WLDSIYQENP

SEQ ID NO: 196056 - protein, 10 aa, Tick-borne encephalitis virus
LDSIYQENPA

SEQ ID NO: 196057 - protein, 10 aa, Tick-borne encephalitis virus
DSIYQENPAK

SEQ ID NO: 196058 - protein, 10 aa, Tick-borne encephalitis virus
SIYQENPAKT

SEQ ID NO: 196059 - protein, 10 aa, Tick-borne encephalitis virus
IYQENPAKTR

SEQ ID NO: 196060 - protein, 10 aa, Tick-borne encephalitis virus
YQENPAKTRE

SEQ ID NO: 196061 - protein, 10 aa, Tick-borne encephalitis virus
QENPAKTREY

SEQ ID NO: 196062 - protein, 10 aa, Tick-borne encephalitis virus
ENPAKTREYC

SEQ ID NO: 196063 - protein, 10 aa, Tick-borne encephalitis virus
NPAKTREYCL

SEQ ID NO: 196064 - protein, 10 aa, Tick-borne encephalitis virus
PAKTREYCLH

SEQ ID NO: 196065 - protein, 10 aa, Tick-borne encephalitis virus
AKTREYCLHA

SEQ ID NO: 196066 - protein, 10 aa, Tick-borne encephalitis virus
KTREYCLHAK

SEQ ID NO: 196067 - protein, 10 aa, Tick-borne encephalitis virus
TREYCLHAKL

SEQ ID NO: 196068 - protein, 10 aa, Tick-borne encephalitis virus
REYCLHAKLS

SEQ ID NO: 196069 - protein, 10 aa, Tick-borne encephalitis virus
EYCLHAKLSD

SEQ ID NO: 196070 - protein, 10 aa, Tick-borne encephalitis virus
YCLHAKLSDT

SEQ ID NO: 196071 - protein, 10 aa, Tick-borne encephalitis virus
CLHAKLSDTK

SEQ ID NO: 196072 - protein, 10 aa, Tick-borne encephalitis virus
LHAKLSDTKV

SEQ ID NO: 196073 - protein, 10 aa, Tick-borne encephalitis virus
HAKLSDTKVA

SEQ ID NO: 196074 - protein, 10 aa, Tick-borne encephalitis virus
AKLSDTKVAA

SEQ ID NO: 196075 - protein, 10 aa, Tick-borne encephalitis virus
KLSDTKVAAR

SEQ ID NO: 196076 - protein, 10 aa, Tick-borne encephalitis virus
LSDTKVAARC

SEQ ID NO: 196077 - protein, 10 aa, Tick-borne encephalitis virus
SDTKVAARCP

SEQ ID NO: 196078 - protein, 10 aa, Tick-borne encephalitis virus
DTKVAARCPT

SEQ ID NO: 196079 - protein, 10 aa, Tick-borne encephalitis virus
TKVAARCPTM

SEQ ID NO: 196080 - protein, 10 aa, Tick-borne encephalitis virus
KVAARCPTMG

SEQ ID NO: 196081 - protein, 10 aa, Tick-borne encephalitis virus
VAARCPTMGP

SEQ ID NO: 196082 - protein, 10 aa, Tick-borne encephalitis virus
AARCPTMGPA

SEQ ID NO: 196083 - protein, 10 aa, Tick-borne encephalitis virus
ARCPTMGPAT

SEQ ID NO: 196084 - protein, 10 aa, Tick-borne encephalitis virus
RCPTMGPATL

SEQ ID NO: 196085 - protein, 10 aa, Tick-borne encephalitis virus
CPTMGPATLA

SEQ ID NO: 196086 - protein, 10 aa, Tick-borne encephalitis virus
PTMGPATLAE

SEQ ID NO: 196087 - protein, 10 aa, Tick-borne encephalitis virus
TMGPATLAEE

SEQ ID NO: 196088 - protein, 10 aa, Tick-borne encephalitis virus
MGPATLAEEH

SEQ ID NO: 196089 - protein, 10 aa, Tick-borne encephalitis virus
GPATLAEEHQ

SEQ ID NO: 196090 - protein, 10 aa, Tick-borne encephalitis virus
PATLAEEHQS

SEQ ID NO: 196091 - protein, 10 aa, Tick-borne encephalitis virus
ATLAEEHQSG

SEQ ID NO: 196092 - protein, 10 aa, Tick-borne encephalitis virus
TLAEEHQSGT

SEQ ID NO: 196093 - protein, 10 aa, Tick-borne encephalitis virus
LAEEHQSGTV

SEQ ID NO: 196094 - protein, 10 aa, Tick-borne encephalitis virus
AEEHQSGTVC

SEQ ID NO: 196095 - protein, 10 aa, Tick-borne encephalitis virus
EEHQSGTVCK

SEQ ID NO: 196096 - protein, 10 aa, Tick-borne encephalitis virus
EHQSGTVCKR

SEQ ID NO: 196097 - protein, 10 aa, Tick-borne encephalitis virus
HQSGTVCKRD

SEQ ID NO: 196098 - protein, 10 aa, Tick-borne encephalitis virus
QSGTVCKRDQ

SEQ ID NO: 196099 - protein, 10 aa, Tick-borne encephalitis virus
SGTVCKRDQS

SEQ ID NO: 196100 - protein, 10 aa, Tick-borne encephalitis virus
GTVCKRDQSD

SEQ ID NO: 196101 - protein, 10 aa, Tick-borne encephalitis virus
TVCKRDQSDR

SEQ ID NO: 196102 - protein, 10 aa, Tick-borne encephalitis virus
VCKRDQSDRG

SEQ ID NO: 196103 - protein, 10 aa, Tick-borne encephalitis virus
CKRDQSDRGW

SEQ ID NO: 196104 - protein, 10 aa, Tick-borne encephalitis virus
KRDQSDRGWG

SEQ ID NO: 196105 - protein, 10 aa, Tick-borne encephalitis virus
RDQSDRGWGN

SEQ ID NO: 196106 - protein, 10 aa, Tick-borne encephalitis virus
DQSDRGWGNH

SEQ ID NO: 196107 - protein, 10 aa, Tick-borne encephalitis virus
QSDRGWGNHC

SEQ ID NO: 196108 - protein, 10 aa, Tick-borne encephalitis virus
SDRGWGNHCG

SEQ ID NO: 196109 - protein, 10 aa, Tick-borne encephalitis virus
DRGWGNHCGL

SEQ ID NO: 196110 - protein, 10 aa, Tick-borne encephalitis virus
RGWGNHCGLF

SEQ ID NO: 196111 - protein, 10 aa, Tick-borne encephalitis virus
GWGNHCGLFG

SEQ ID NO: 196112 - protein, 10 aa, Tick-borne encephalitis virus
WGNHCGLFGK

SEQ ID NO: 196113 - protein, 10 aa, Tick-borne encephalitis virus
GNHCGLFGKG

SEQ ID NO: 196114 - protein, 10 aa, Tick-borne encephalitis virus
NHCGLFGKGS

SEQ ID NO: 196115 - protein, 10 aa, Tick-borne encephalitis virus
HCGLFGKGSI

SEQ ID NO: 196116 - protein, 10 aa, Tick-borne encephalitis virus
CGLFGKGSIV

SEQ ID NO: 196117 - protein, 10 aa, Tick-borne encephalitis virus
GLFGKGSIVT

SEQ ID NO: 196118 - protein, 10 aa, Tick-borne encephalitis virus
LFGKGSIVTC

SEQ ID NO: 196119 - protein, 10 aa, Tick-borne encephalitis virus
FGKGSIVTCV

SEQ ID NO: 196120 - protein, 10 aa, Tick-borne encephalitis virus
GKGSIVTCVK

SEQ ID NO: 196121 - protein, 10 aa, Tick-borne encephalitis virus
KGSIVTCVKA

SEQ ID NO: 196122 - protein, 10 aa, Tick-borne encephalitis virus
GSIVTCVKAS

SEQ ID NO: 196123 - protein, 10 aa, Tick-borne encephalitis virus
SIVTCVKASC

SEQ ID NO: 196124 - protein, 10 aa, Tick-borne encephalitis virus
IVTCVKASCE

SEQ ID NO: 196125 - protein, 10 aa, Tick-borne encephalitis virus
VTCVKASCEA

SEQ ID NO: 196126 - protein, 10 aa, Tick-borne encephalitis virus
TCVKASCEAK

SEQ ID NO: 196127 - protein, 10 aa, Tick-borne encephalitis virus
CVKASCEAKK

SEQ ID NO: 196128 - protein, 10 aa, Tick-borne encephalitis virus
VKASCEAKKK

SEQ ID NO: 196129 - protein, 10 aa, Tick-borne encephalitis virus
KASCEAKKKA

SEQ ID NO: 196130 - protein, 10 aa, Tick-borne encephalitis virus
ASCEAKKKAT

SEQ ID NO: 196131 - protein, 10 aa, Tick-borne encephalitis virus
SCEAKKKATG

SEQ ID NO: 196132 - protein, 10 aa, Tick-borne encephalitis virus
CEAKKKATGH

SEQ ID NO: 196133 - protein, 10 aa, Tick-borne encephalitis virus
EAKKKATGHV

SEQ ID NO: 196134 - protein, 10 aa, Tick-borne encephalitis virus
AKKKATGHVY

SEQ ID NO: 196135 - protein, 10 aa, Tick-borne encephalitis virus
KKKATGHVYD

SEQ ID NO: 196136 - protein, 10 aa, Tick-borne encephalitis virus
KKATGHVYDA

SEQ ID NO: 196137 - protein, 10 aa, Tick-borne encephalitis virus
KATGHVYDAN

SEQ ID NO: 196138 - protein, 10 aa, Tick-borne encephalitis virus
ATGHVYDANK

SEQ ID NO: 196139 - protein, 10 aa, Tick-borne encephalitis virus
TGHVYDANKI

SEQ ID NO: 196140 - protein, 10 aa, Tick-borne encephalitis virus
GHVYDANKIV

SEQ ID NO: 196141 - protein, 10 aa, Tick-borne encephalitis virus
HVYDANKIVY

SEQ ID NO: 196142 - protein, 10 aa, Tick-borne encephalitis virus
VYDANKIVYT

SEQ ID NO: 196143 - protein, 10 aa, Tick-borne encephalitis virus
YDANKIVYTV

SEQ ID NO: 196144 - protein, 10 aa, Tick-borne encephalitis virus
DANKIVYTVK

SEQ ID NO: 196145 - protein, 10 aa, Tick-borne encephalitis virus
ANKIVYTVKV

SEQ ID NO: 196146 - protein, 10 aa, Tick-borne encephalitis virus
NKIVYTVKVE

SEQ ID NO: 196147 - protein, 10 aa, Tick-borne encephalitis virus
KIVYTVKVEP

SEQ ID NO: 196148 - protein, 10 aa, Tick-borne encephalitis virus
IVYTVKVEPH

SEQ ID NO: 196149 - protein, 10 aa, Tick-borne encephalitis virus
VYTVKVEPHT

SEQ ID NO: 196150 - protein, 10 aa, Tick-borne encephalitis virus
YTVKVEPHTG

SEQ ID NO: 196151 - protein, 10 aa, Tick-borne encephalitis virus
TVKVEPHTGD

SEQ ID NO: 196152 - protein, 10 aa, Tick-borne encephalitis virus
VKVEPHTGDY

SEQ ID NO: 196153 - protein, 10 aa, Tick-borne encephalitis virus
KVEPHTGDYV

SEQ ID NO: 196154 - protein, 10 aa, Tick-borne encephalitis virus
VEPHTGDYVA

SEQ ID NO: 196155 - protein, 10 aa, Tick-borne encephalitis virus
EPHTGDYVAA

SEQ ID NO: 196156 - protein, 10 aa, Tick-borne encephalitis virus
PHTGDYVAAN

SEQ ID NO: 196157 - protein, 10 aa, Tick-borne encephalitis virus
HTGDYVAANE

SEQ ID NO: 196158 - protein, 10 aa, Tick-borne encephalitis virus
TGDYVAANET

SEQ ID NO: 196159 - protein, 10 aa, Tick-borne encephalitis virus
GDYVAANETH

SEQ ID NO: 196160 - protein, 10 aa, Tick-borne encephalitis virus
DYVAANETHS

SEQ ID NO: 196161 - protein, 10 aa, Tick-borne encephalitis virus
YVAANETHSG

SEQ ID NO: 196162 - protein, 10 aa, Tick-borne encephalitis virus
VAANETHSGR

SEQ ID NO: 196163 - protein, 10 aa, Tick-borne encephalitis virus
AANETHSGRK

SEQ ID NO: 196164 - protein, 10 aa, Tick-borne encephalitis virus
ANETHSGRKT

SEQ ID NO: 196165 - protein, 10 aa, Tick-borne encephalitis virus
NETHSGRKTA

SEQ ID NO: 196166 - protein, 10 aa, Tick-borne encephalitis virus
ETHSGRKTAS

SEQ ID NO: 196167 - protein, 10 aa, Tick-borne encephalitis virus
THSGRKTASF

SEQ ID NO: 196168 - protein, 10 aa, Tick-borne encephalitis virus
HSGRKTASFT

SEQ ID NO: 196169 - protein, 10 aa, Tick-borne encephalitis virus
SGRKTASFTV

SEQ ID NO: 196170 - protein, 10 aa, Tick-borne encephalitis virus
GRKTASFTVS

SEQ ID NO: 196171 - protein, 10 aa, Tick-borne encephalitis virus
RKTASFTVSS

SEQ ID NO: 196172 - protein, 10 aa, Tick-borne encephalitis virus
KTASFTVSSE

SEQ ID NO: 196173 - protein, 10 aa, Tick-borne encephalitis virus
TASFTVSSEK

SEQ ID NO: 196174 - protein, 10 aa, Tick-borne encephalitis virus
ASFTVSSEKT

SEQ ID NO: 196175 - protein, 10 aa, Tick-borne encephalitis virus
SFTVSSEKTI

SEQ ID NO: 196176 - protein, 10 aa, Tick-borne encephalitis virus
FTVSSEKTIL

SEQ ID NO: 196177 - protein, 10 aa, Tick-borne encephalitis virus
TVSSEKTILT

SEQ ID NO: 196178 - protein, 10 aa, Tick-borne encephalitis virus
VSSEKTILTM

SEQ ID NO: 196179 - protein, 10 aa, Tick-borne encephalitis virus
SSEKTILTMG

SEQ ID NO: 196180 - protein, 10 aa, Tick-borne encephalitis virus
SEKTILTMGD

SEQ ID NO: 196181 - protein, 10 aa, Tick-borne encephalitis virus
EKTILTMGDY

SEQ ID NO: 196182 - protein, 10 aa, Tick-borne encephalitis virus
KTILTMGDYG

SEQ ID NO: 196183 - protein, 10 aa, Tick-borne encephalitis virus
TILTMGDYGD

SEQ ID NO: 196184 - protein, 10 aa, Tick-borne encephalitis virus
ILTMGDYGDV

SEQ ID NO: 196185 - protein, 10 aa, Tick-borne encephalitis virus
LTMGDYGDVS

SEQ ID NO: 196186 - protein, 10 aa, Tick-borne encephalitis virus
TMGDYGDVSL

SEQ ID NO: 196187 - protein, 10 aa, Tick-borne encephalitis virus
MGDYGDVSLL

SEQ ID NO: 196188 - protein, 10 aa, Tick-borne encephalitis virus
GDYGDVSLLC

SEQ ID NO: 196189 - protein, 10 aa, Tick-borne encephalitis virus
DYGDVSLLCR

SEQ ID NO: 196190 - protein, 10 aa, Tick-borne encephalitis virus
YGDVSLLCRV

SEQ ID NO: 196191 - protein, 10 aa, Tick-borne encephalitis virus
GDVSLLCRVA

SEQ ID NO: 196192 - protein, 10 aa, Tick-borne encephalitis virus
DVSLLCRVAS

SEQ ID NO: 196193 - protein, 10 aa, Tick-borne encephalitis virus
VSLLCRVASG

SEQ ID NO: 196194 - protein, 10 aa, Tick-borne encephalitis virus
SLLCRVASGV

SEQ ID NO: 196195 - protein, 10 aa, Tick-borne encephalitis virus
LLCRVASGVD

SEQ ID NO: 196196 - protein, 10 aa, Tick-borne encephalitis virus
LCRVASGVDL

SEQ ID NO: 196197 - protein, 10 aa, Tick-borne encephalitis virus
CRVASGVDLA

SEQ ID NO: 196198 - protein, 10 aa, Tick-borne encephalitis virus
RVASGVDLAQ

SEQ ID NO: 196199 - protein, 10 aa, Tick-borne encephalitis virus
VASGVDLAQT

SEQ ID NO: 196200 - protein, 10 aa, Tick-borne encephalitis virus
ASGVDLAQTV

SEQ ID NO: 196201 - protein, 10 aa, Tick-borne encephalitis virus
SGVDLAQTVI

SEQ ID NO: 196202 - protein, 10 aa, Tick-borne encephalitis virus
GVDLAQTVIL

SEQ ID NO: 196203 - protein, 10 aa, Tick-borne encephalitis virus
VDLAQTVILE

SEQ ID NO: 196204 - protein, 10 aa, Tick-borne encephalitis virus
DLAQTVILEL

SEQ ID NO: 196205 - protein, 10 aa, Tick-borne encephalitis virus
LAQTVILELD

SEQ ID NO: 196206 - protein, 10 aa, Tick-borne encephalitis virus
AQTVILELDK

SEQ ID NO: 196207 - protein, 10 aa, Tick-borne encephalitis virus
QTVILELDKT

SEQ ID NO: 196208 - protein, 10 aa, Tick-borne encephalitis virus
TVILELDKTS

SEQ ID NO: 196209 - protein, 10 aa, Tick-borne encephalitis virus
VILELDKTSE

SEQ ID NO: 196210 - protein, 10 aa, Tick-borne encephalitis virus
ILELDKTSEH

SEQ ID NO: 196211 - protein, 10 aa, Tick-borne encephalitis virus
LELDKTSEHL

SEQ ID NO: 196212 - protein, 10 aa, Tick-borne encephalitis virus
ELDKTSEHLP

SEQ ID NO: 196213 - protein, 10 aa, Tick-borne encephalitis virus
LDKTSEHLPT

SEQ ID NO: 196214 - protein, 10 aa, Tick-borne encephalitis virus
DKTSEHLPTA

SEQ ID NO: 196215 - protein, 10 aa, Tick-borne encephalitis virus
KTSEHLPTAW

SEQ ID NO: 196216 - protein, 10 aa, Tick-borne encephalitis virus
TSEHLPTAWQ

SEQ ID NO: 196217 - protein, 10 aa, Tick-borne encephalitis virus
SEHLPTAWQV

SEQ ID NO: 196218 - protein, 10 aa, Tick-borne encephalitis virus
EHLPTAWQVH

SEQ ID NO: 196219 - protein, 10 aa, Tick-borne encephalitis virus
HLPTAWQVHR

SEQ ID NO: 196220 - protein, 10 aa, Tick-borne encephalitis virus
LPTAWQVHRD

SEQ ID NO: 196221 - protein, 10 aa, Tick-borne encephalitis virus
PTAWQVHRDW

SEQ ID NO: 196222 - protein, 10 aa, Tick-borne encephalitis virus
TAWQVHRDWF

SEQ ID NO: 196223 - protein, 10 aa, Tick-borne encephalitis virus
AWQVHRDWFN

SEQ ID NO: 196224 - protein, 10 aa, Tick-borne encephalitis virus
WQVHRDWFND

SEQ ID NO: 196225 - protein, 10 aa, Tick-borne encephalitis virus
QVHRDWFNDL

SEQ ID NO: 196226 - protein, 10 aa, Tick-borne encephalitis virus
VHRDWFNDLA

SEQ ID NO: 196227 - protein, 10 aa, Tick-borne encephalitis virus
HRDWFNDLAL

SEQ ID NO: 196228 - protein, 10 aa, Tick-borne encephalitis virus
RDWFNDLALP

SEQ ID NO: 196229 - protein, 10 aa, Tick-borne encephalitis virus
DWFNDLALPW

SEQ ID NO: 196230 - protein, 10 aa, Tick-borne encephalitis virus
WFNDLALPWK

SEQ ID NO: 196231 - protein, 10 aa, Tick-borne encephalitis virus
FNDLALPWKH

SEQ ID NO: 196232 - protein, 10 aa, Tick-borne encephalitis virus
NDLALPWKHE

SEQ ID NO: 196233 - protein, 10 aa, Tick-borne encephalitis virus
DLALPWKHEG

SEQ ID NO: 196234 - protein, 10 aa, Tick-borne encephalitis virus
LALPWKHEGA

SEQ ID NO: 196235 - protein, 10 aa, Tick-borne encephalitis virus
ALPWKHEGAQ

SEQ ID NO: 196236 - protein, 10 aa, Tick-borne encephalitis virus
HEGAQNWNNA

SEQ ID NO: 196237 - protein, 10 aa, Tick-borne encephalitis virus
EGAQNWNNAE

SEQ ID NO: 196238 - protein, 10 aa, Tick-borne encephalitis virus
GAQNWNNAER

SEQ ID NO: 196239 - protein, 10 aa, Tick-borne encephalitis virus
AQNWNNAERL

SEQ ID NO: 196240 - protein, 10 aa, Tick-borne encephalitis virus
QNWNNAERLV

SEQ ID NO: 196241 - protein, 10 aa, Tick-borne encephalitis virus
NWNNAERLVE

SEQ ID NO: 196242 - protein, 10 aa, Tick-borne encephalitis virus
WNNAERLVEF

SEQ ID NO: 196243 - protein, 10 aa, Tick-borne encephalitis virus
NNAERLVEFG

SEQ ID NO: 196244 - protein, 10 aa, Tick-borne encephalitis virus
NAERLVEFGA

SEQ ID NO: 196245 - protein, 10 aa, Tick-borne encephalitis virus
AERLVEFGAP

SEQ ID NO: 196246 - protein, 10 aa, Tick-borne encephalitis virus
ERLVEFGAPH

SEQ ID NO: 196247 - protein, 10 aa, Tick-borne encephalitis virus
RLVEFGAPHA

SEQ ID NO: 196248 - protein, 10 aa, Tick-borne encephalitis virus
LVEFGAPHAV

SEQ ID NO: 196249 - protein, 10 aa, Tick-borne encephalitis virus
VEFGAPHAVK

SEQ ID NO: 196250 - protein, 10 aa, Tick-borne encephalitis virus
EFGAPHAVKM

SEQ ID NO: 196251 - protein, 10 aa, Tick-borne encephalitis virus
FGAPHAVKMD

SEQ ID NO: 196252 - protein, 10 aa, Tick-borne encephalitis virus
GAPHAVKMDV

SEQ ID NO: 196253 - protein, 10 aa, Tick-borne encephalitis virus
APHAVKMDVY

SEQ ID NO: 196254 - protein, 10 aa, Tick-borne encephalitis virus
PHAVKMDVYN

SEQ ID NO: 196255 - protein, 10 aa, Tick-borne encephalitis virus
HAVKMDVYNL

SEQ ID NO: 196256 - protein, 10 aa, Tick-borne encephalitis virus
AVKMDVYNLG

SEQ ID NO: 196257 - protein, 10 aa, Tick-borne encephalitis virus
VKMDVYNLGD

SEQ ID NO: 196258 - protein, 10 aa, Tick-borne encephalitis virus
KMDVYNLGDQ

SEQ ID NO: 196259 - protein, 10 aa, Tick-borne encephalitis virus
MDVYNLGDQT

SEQ ID NO: 196260 - protein, 10 aa, Tick-borne encephalitis virus
DVYNLGDQTG

SEQ ID NO: 196261 - protein, 10 aa, Tick-borne encephalitis virus
VYNLGDQTGV

SEQ ID NO: 196262 - protein, 10 aa, Tick-borne encephalitis virus
YNLGDQTGVL

SEQ ID NO: 196263 - protein, 10 aa, Tick-borne encephalitis virus
NLGDQTGVLL

SEQ ID NO: 196264 - protein, 10 aa, Tick-borne encephalitis virus
LGDQTGVLLK

SEQ ID NO: 196265 - protein, 10 aa, Tick-borne encephalitis virus
GDQTGVLLKS

SEQ ID NO: 196266 - protein, 10 aa, Tick-borne encephalitis virus
DQTGVLLKSL

SEQ ID NO: 196267 - protein, 10 aa, Tick-borne encephalitis virus
QTGVLLKSLA

SEQ ID NO: 196268 - protein, 10 aa, Tick-borne encephalitis virus
TGVLLKSLAG

SEQ ID NO: 196269 - protein, 10 aa, Tick-borne encephalitis virus
GVLLKSLAGV

SEQ ID NO: 196270 - protein, 10 aa, Tick-borne encephalitis virus
VLLKSLAGVP

SEQ ID NO: 196271 - protein, 10 aa, Tick-borne encephalitis virus
LLKSLAGVPV

SEQ ID NO: 196272 - protein, 10 aa, Tick-borne encephalitis virus
LKSLAGVPVA

SEQ ID NO: 196273 - protein, 10 aa, Tick-borne encephalitis virus
KSLAGVPVAH

SEQ ID NO: 196274 - protein, 10 aa, Tick-borne encephalitis virus
SLAGVPVAHI

SEQ ID NO: 196275 - protein, 10 aa, Tick-borne encephalitis virus
LAGVPVAHID

SEQ ID NO: 196276 - protein, 10 aa, Tick-borne encephalitis virus
AGVPVAHIDG

SEQ ID NO: 196277 - protein, 10 aa, Tick-borne encephalitis virus
GVPVAHIDGT

SEQ ID NO: 196278 - protein, 10 aa, Tick-borne encephalitis virus
VPVAHIDGTK

SEQ ID NO: 196279 - protein, 10 aa, Tick-borne encephalitis virus
PVAHIDGTKY

SEQ ID NO: 196280 - protein, 10 aa, Tick-borne encephalitis virus
VAHIDGTKYH

SEQ ID NO: 196281 - protein, 10 aa, Tick-borne encephalitis virus
AHIDGTKYHL

SEQ ID NO: 196282 - protein, 10 aa, Tick-borne encephalitis virus
HIDGTKYHLK

SEQ ID NO: 196283 - protein, 10 aa, Tick-borne encephalitis virus
IDGTKYHLKS

SEQ ID NO: 196284 - protein, 10 aa, Tick-borne encephalitis virus
DGTKYHLKSG

SEQ ID NO: 196285 - protein, 10 aa, Tick-borne encephalitis virus
GTKYHLKSGH

SEQ ID NO: 196286 - protein, 10 aa, Tick-borne encephalitis virus
TKYHLKSGHV

SEQ ID NO: 196287 - protein, 10 aa, Tick-borne encephalitis virus
KYHLKSGHVT

SEQ ID NO: 196288 - protein, 10 aa, Tick-borne encephalitis virus
YHLKSGHVTC

SEQ ID NO: 196289 - protein, 10 aa, Tick-borne encephalitis virus
HLKSGHVTCE

SEQ ID NO: 196290 - protein, 10 aa, Tick-borne encephalitis virus
LKSGHVTCEV

SEQ ID NO: 196291 - protein, 10 aa, Tick-borne encephalitis virus
KSGHVTCEVG

SEQ ID NO: 196292 - protein, 10 aa, Tick-borne encephalitis virus
SGHVTCEVGL

SEQ ID NO: 196293 - protein, 10 aa, Tick-borne encephalitis virus
GHVTCEVGLE

SEQ ID NO: 196294 - protein, 10 aa, Tick-borne encephalitis virus
HVTCEVGLEK

SEQ ID NO: 196295 - protein, 10 aa, Tick-borne encephalitis virus
VTCEVGLEKL

SEQ ID NO: 196296 - protein, 10 aa, Tick-borne encephalitis virus
TCEVGLEKLK

SEQ ID NO: 196297 - protein, 10 aa, Tick-borne encephalitis virus
CEVGLEKLKM

SEQ ID NO: 196298 - protein, 10 aa, Tick-borne encephalitis virus
EVGLEKLKMK

SEQ ID NO: 196299 - protein, 10 aa, Tick-borne encephalitis virus
VGLEKLKMKG

SEQ ID NO: 196300 - protein, 10 aa, Tick-borne encephalitis virus
GLEKLKMKGL

SEQ ID NO: 196301 - protein, 10 aa, Tick-borne encephalitis virus
LEKLKMKGLT

SEQ ID NO: 196302 - protein, 10 aa, Tick-borne encephalitis virus
EKLKMKGLTY

SEQ ID NO: 196303 - protein, 10 aa, Tick-borne encephalitis virus
KLKMKGLTYT

SEQ ID NO: 196304 - protein, 10 aa, Tick-borne encephalitis virus
LKMKGLTYTM

SEQ ID NO: 196305 - protein, 10 aa, Tick-borne encephalitis virus
KMKGLTYTMC

SEQ ID NO: 196306 - protein, 10 aa, Tick-borne encephalitis virus
MKGLTYTMCD

SEQ ID NO: 196307 - protein, 10 aa, Tick-borne encephalitis virus
KGLTYTMCDK

SEQ ID NO: 196308 - protein, 10 aa, Tick-borne encephalitis virus
GLTYTMCDKT

SEQ ID NO: 196309 - protein, 10 aa, Tick-borne encephalitis virus
LTYTMCDKTK

SEQ ID NO: 196310 - protein, 10 aa, Tick-borne encephalitis virus
TYTMCDKTKF

SEQ ID NO: 196311 - protein, 10 aa, Tick-borne encephalitis virus
YTMCDKTKFT

SEQ ID NO: 196312 - protein, 10 aa, Tick-borne encephalitis virus
TMCDKTKFTW

SEQ ID NO: 196313 - protein, 10 aa, Tick-borne encephalitis virus
MCDKTKFTWK

SEQ ID NO: 196314 - protein, 10 aa, Tick-borne encephalitis virus
CDKTKFTWKR

SEQ ID NO: 196315 - protein, 10 aa, Tick-borne encephalitis virus
DKTKFTWKRI

SEQ ID NO: 196316 - protein, 10 aa, Tick-borne encephalitis virus
KTKFTWKRIP

SEQ ID NO: 196317 - protein, 10 aa, Tick-borne encephalitis virus
TKFTWKRIPT

SEQ ID NO: 196318 - protein, 10 aa, Tick-borne encephalitis virus
KFTWKRIPTD

SEQ ID NO: 196319 - protein, 10 aa, Tick-borne encephalitis virus
FTWKRIPTDS

SEQ ID NO: 196320 - protein, 10 aa, Tick-borne encephalitis virus
TWKRIPTDSG

SEQ ID NO: 196321 - protein, 10 aa, Tick-borne encephalitis virus
WKRIPTDSGH

SEQ ID NO: 196322 - protein, 10 aa, Tick-borne encephalitis virus
KRIPTDSGHD

SEQ ID NO: 196323 - protein, 10 aa, Tick-borne encephalitis virus
RIPTDSGHDT

SEQ ID NO: 196324 - protein, 10 aa, Tick-borne encephalitis virus
IPTDSGHDTV

SEQ ID NO: 196325 - protein, 10 aa, Tick-borne encephalitis virus
PTDSGHDTVV

SEQ ID NO: 196326 - protein, 10 aa, Tick-borne encephalitis virus
TDSGHDTVVM

SEQ ID NO: 196327 - protein, 10 aa, Tick-borne encephalitis virus
DSGHDTVVME

SEQ ID NO: 196328 - protein, 10 aa, Tick-borne encephalitis virus
SGHDTVVMEV

SEQ ID NO: 196329 - protein, 10 aa, Tick-borne encephalitis virus
GHDTVVMEVA

SEQ ID NO: 196330 - protein, 10 aa, Tick-borne encephalitis virus
HDTVVMEVAF

SEQ ID NO: 196331 - protein, 10 aa, Tick-borne encephalitis virus
DTVVMEVAFS

SEQ ID NO: 196332 - protein, 10 aa, Tick-borne encephalitis virus
TVVMEVAFSG

SEQ ID NO: 196333 - protein, 10 aa, Tick-borne encephalitis virus
VVMEVAFSGT

SEQ ID NO: 196334 - protein, 10 aa, Tick-borne encephalitis virus
VMEVAFSGTK

SEQ ID NO: 196335 - protein, 10 aa, Tick-borne encephalitis virus
MEVAFSGTKP

SEQ ID NO: 196336 - protein, 10 aa, Tick-borne encephalitis virus
EVAFSGTKPC

SEQ ID NO: 196337 - protein, 10 aa, Tick-borne encephalitis virus
VAFSGTKPCR

SEQ ID NO: 196338 - protein, 10 aa, Tick-borne encephalitis virus
AFSGTKPCRI

SEQ ID NO: 196339 - protein, 10 aa, Tick-borne encephalitis virus
FSGTKPCRIP

SEQ ID NO: 196340 - protein, 10 aa, Tick-borne encephalitis virus
SGTKPCRIPV

SEQ ID NO: 196341 - protein, 10 aa, Tick-borne encephalitis virus
GTKPCRIPVR

SEQ ID NO: 196342 - protein, 10 aa, Tick-borne encephalitis virus
TKPCRIPVRA

SEQ ID NO: 196343 - protein, 10 aa, Tick-borne encephalitis virus
KPCRIPVRAV

SEQ ID NO: 196344 - protein, 10 aa, Tick-borne encephalitis virus
PCRIPVRAVA

SEQ ID NO: 196345 - protein, 10 aa, Tick-borne encephalitis virus
CRIPVRAVAH

SEQ ID NO: 196346 - protein, 10 aa, Tick-borne encephalitis virus
RIPVRAVAHG

SEQ ID NO: 196347 - protein, 10 aa, Tick-borne encephalitis virus
IPVRAVAHGS

SEQ ID NO: 196348 - protein, 10 aa, Tick-borne encephalitis virus
PVRAVAHGSP

SEQ ID NO: 196349 - protein, 10 aa, Tick-borne encephalitis virus
VRAVAHGSPD

SEQ ID NO: 196350 - protein, 10 aa, Tick-borne encephalitis virus
RAVAHGSPDV

SEQ ID NO: 196351 - protein, 10 aa, Tick-borne encephalitis virus
AVAHGSPDVN

SEQ ID NO: 196352 - protein, 10 aa, Tick-borne encephalitis virus
VAHGSPDVNV

SEQ ID NO: 196353 - protein, 10 aa, Tick-borne encephalitis virus
AHGSPDVNVA

SEQ ID NO: 196354 - protein, 10 aa, Tick-borne encephalitis virus
HGSPDVNVAM

SEQ ID NO: 196355 - protein, 10 aa, Tick-borne encephalitis virus
GSPDVNVAML

SEQ ID NO: 196356 - protein, 10 aa, Tick-borne encephalitis virus
SPDVNVAMLI

SEQ ID NO: 196357 - protein, 10 aa, Tick-borne encephalitis virus
PDVNVAMLIT

SEQ ID NO: 196358 - protein, 10 aa, Tick-borne encephalitis virus
DVNVAMLITP

SEQ ID NO: 196359 - protein, 10 aa, Tick-borne encephalitis virus
VNVAMLITPN

SEQ ID NO: 196360 - protein, 10 aa, Tick-borne encephalitis virus
NVAMLITPNP

SEQ ID NO: 196361 - protein, 10 aa, Tick-borne encephalitis virus
VAMLITPNPT

SEQ ID NO: 196362 - protein, 10 aa, Tick-borne encephalitis virus
AMLITPNPTI

SEQ ID NO: 196363 - protein, 10 aa, Tick-borne encephalitis virus
MLITPNPTIE

SEQ ID NO: 196364 - protein, 10 aa, Tick-borne encephalitis virus
LITPNPTIEN

SEQ ID NO: 196365 - protein, 10 aa, Tick-borne encephalitis virus
ITPNPTIENN

SEQ ID NO: 196366 - protein, 10 aa, Tick-borne encephalitis virus
TPNPTIENNG

SEQ ID NO: 196367 - protein, 10 aa, Tick-borne encephalitis virus
PNPTIENNGG

SEQ ID NO: 196368 - protein, 10 aa, Tick-borne encephalitis virus
NPTIENNGGG

SEQ ID NO: 196369 - protein, 10 aa, Tick-borne encephalitis virus
PTIENNGGGF

SEQ ID NO: 196370 - protein, 10 aa, Tick-borne encephalitis virus
TIENNGGGFI

SEQ ID NO: 196371 - protein, 10 aa, Tick-borne encephalitis virus
IENNGGGFIE

SEQ ID NO: 196372 - protein, 10 aa, Tick-borne encephalitis virus
ENNGGGFIEM

SEQ ID NO: 196373 - protein, 10 aa, Tick-borne encephalitis virus
NNGGGFIEMQ

SEQ ID NO: 196374 - protein, 10 aa, Tick-borne encephalitis virus
NGGGFIEMQL

SEQ ID NO: 196375 - protein, 10 aa, Tick-borne encephalitis virus
GGGFIEMQLP

SEQ ID NO: 196376 - protein, 10 aa, Tick-borne encephalitis virus
GGFIEMQLPP

SEQ ID NO: 196377 - protein, 10 aa, Tick-borne encephalitis virus
GFIEMQLPPG

SEQ ID NO: 196378 - protein, 10 aa, Tick-borne encephalitis virus
FIEMQLPPGD

SEQ ID NO: 196379 - protein, 10 aa, Tick-borne encephalitis virus
IEMQLPPGDN

SEQ ID NO: 196380 - protein, 10 aa, Tick-borne encephalitis virus
EMQLPPGDNI

SEQ ID NO: 196381 - protein, 10 aa, Tick-borne encephalitis virus
MQLPPGDNII

SEQ ID NO: 196382 - protein, 10 aa, Tick-borne encephalitis virus
QLPPGDNIIY

SEQ ID NO: 196383 - protein, 10 aa, Tick-borne encephalitis virus
LPPGDNIIYV

SEQ ID NO: 196384 - protein, 10 aa, Tick-borne encephalitis virus
PPGDNIIYVG

SEQ ID NO: 196385 - protein, 10 aa, Tick-borne encephalitis virus
PGDNIIYVGE

SEQ ID NO: 196386 - protein, 10 aa, Tick-borne encephalitis virus
GDNIIYVGEL

SEQ ID NO: 196387 - protein, 10 aa, Tick-borne encephalitis virus
DNIIYVGELS

SEQ ID NO: 196388 - protein, 10 aa, Tick-borne encephalitis virus
NIIYVGELSH

SEQ ID NO: 196389 - protein, 10 aa, Tick-borne encephalitis virus
IIYVGELSHQ

SEQ ID NO: 196390 - protein, 10 aa, Tick-borne encephalitis virus
IYVGELSHQW

SEQ ID NO: 196391 - protein, 10 aa, Tick-borne encephalitis virus
YVGELSHQWF

SEQ ID NO: 196392 - protein, 10 aa, Tick-borne encephalitis virus
VGELSHQWFQ

SEQ ID NO: 196393 - protein, 10 aa, Tick-borne encephalitis virus
GELSHQWFQK

SEQ ID NO: 196394 - protein, 10 aa, Tick-borne encephalitis virus
ELSHQWFQKG

SEQ ID NO: 196395 - protein, 10 aa, Tick-borne encephalitis virus
LSHQWFQKGS

SEQ ID NO: 196396 - protein, 10 aa, Tick-borne encephalitis virus
SHQWFQKGSS

SEQ ID NO: 196397 - protein, 10 aa, Tick-borne encephalitis virus
HQWFQKGSSI

SEQ ID NO: 196398 - protein, 10 aa, Tick-borne encephalitis virus
QWFQKGSSIG

SEQ ID NO: 196399 - protein, 10 aa, Tick-borne encephalitis virus
WFQKGSSIGR

SEQ ID NO: 196400 - protein, 10 aa, Tick-borne encephalitis virus
FQKGSSIGRV

SEQ ID NO: 196401 - protein, 10 aa, Tick-borne encephalitis virus
QKGSSIGRVF

SEQ ID NO: 196402 - protein, 10 aa, Tick-borne encephalitis virus
KGSSIGRVFQ

SEQ ID NO: 196403 - protein, 10 aa, Tick-borne encephalitis virus
GSSIGRVFQK

SEQ ID NO: 196404 - protein, 10 aa, Tick-borne encephalitis virus
SSIGRVFQKT

SEQ ID NO: 196405 - protein, 10 aa, Tick-borne encephalitis virus
SIGRVFQKTR

SEQ ID NO: 196406 - protein, 10 aa, Tick-borne encephalitis virus
IGRVFQKTRK

SEQ ID NO: 196407 - protein, 10 aa, Tick-borne encephalitis virus
GRVFQKTRKG

SEQ ID NO: 196408 - protein, 10 aa, Tick-borne encephalitis virus
RVFQKTRKGI

SEQ ID NO: 196409 - protein, 10 aa, Tick-borne encephalitis virus
VFQKTRKGIE

SEQ ID NO: 196410 - protein, 10 aa, Tick-borne encephalitis virus
FQKTRKGIER

SEQ ID NO: 196411 - protein, 10 aa, Tick-borne encephalitis virus
QKTRKGIERL

SEQ ID NO: 196412 - protein, 10 aa, Tick-borne encephalitis virus
KTRKGIERLT

SEQ ID NO: 196413 - protein, 10 aa, Tick-borne encephalitis virus
TRKGIERLTV

SEQ ID NO: 196414 - protein, 10 aa, Tick-borne encephalitis virus
RKGIERLTVI

SEQ ID NO: 196415 - protein, 10 aa, Tick-borne encephalitis virus
KGIERLTVIG

SEQ ID NO: 196416 - protein, 10 aa, Tick-borne encephalitis virus
GIERLTVIGE

SEQ ID NO: 196417 - protein, 10 aa, Tick-borne encephalitis virus
IERLTVIGEH

SEQ ID NO: 196418 - protein, 10 aa, Tick-borne encephalitis virus
ERLTVIGEHA

SEQ ID NO: 196419 - protein, 10 aa, Tick-borne encephalitis virus
RLTVIGEHAW

SEQ ID NO: 196420 - protein, 10 aa, Tick-borne encephalitis virus
LTVIGEHAWD

SEQ ID NO: 196421 - protein, 10 aa, Tick-borne encephalitis virus
TVIGEHAWDF

SEQ ID NO: 196422 - protein, 10 aa, Tick-borne encephalitis virus
VIGEHAWDFG

SEQ ID NO: 196423 - protein, 10 aa, Tick-borne encephalitis virus
IGEHAWDFGS

SEQ ID NO: 196424 - protein, 10 aa, Tick-borne encephalitis virus
GEHAWDFGST

SEQ ID NO: 196425 - protein, 10 aa, Tick-borne encephalitis virus
EHAWDFGSTG

SEQ ID NO: 196426 - protein, 10 aa, Tick-borne encephalitis virus
HAWDFGSTGG

SEQ ID NO: 196427 - protein, 10 aa, Tick-borne encephalitis virus
AWDFGSTGGF

SEQ ID NO: 196428 - protein, 10 aa, Tick-borne encephalitis virus
WDFGSTGGFL

SEQ ID NO: 196429 - protein, 10 aa, Tick-borne encephalitis virus
DFGSTGGFLT

SEQ ID NO: 196430 - protein, 10 aa, Tick-borne encephalitis virus
FGSTGGFLTS

SEQ ID NO: 196431 - protein, 10 aa, Tick-borne encephalitis virus
GSTGGFLTSV

SEQ ID NO: 196432 - protein, 10 aa, Tick-borne encephalitis virus
STGGFLTSVG

SEQ ID NO: 196433 - protein, 10 aa, Tick-borne encephalitis virus
TGGFLTSVGK

SEQ ID NO: 196434 - protein, 10 aa, Tick-borne encephalitis virus
GGFLTSVGKA

SEQ ID NO: 196435 - protein, 10 aa, Tick-borne encephalitis virus
GFLTSVGKAL

SEQ ID NO: 196436 - protein, 10 aa, Tick-borne encephalitis virus
FLTSVGKALH

SEQ ID NO: 196437 - protein, 10 aa, Tick-borne encephalitis virus
LTSVGKALHT

SEQ ID NO: 196438 - protein, 10 aa, Tick-borne encephalitis virus
TSVGKALHTV

SEQ ID NO: 196439 - protein, 10 aa, Tick-borne encephalitis virus
SVGKALHTVL

SEQ ID NO: 196440 - protein, 10 aa, Tick-borne encephalitis virus
VGKALHTVLG

SEQ ID NO: 196441 - protein, 10 aa, Tick-borne encephalitis virus
GKALHTVLGG

SEQ ID NO: 196442 - protein, 10 aa, Tick-borne encephalitis virus
KALHTVLGGA

SEQ ID NO: 196443 - protein, 10 aa, Tick-borne encephalitis virus
ALHTVLGGAF

SEQ ID NO: 196444 - protein, 10 aa, Tick-borne encephalitis virus
LHTVLGGAFN

SEQ ID NO: 196445 - protein, 10 aa, Tick-borne encephalitis virus
HTVLGGAFNS

SEQ ID NO: 196446 - protein, 10 aa, Tick-borne encephalitis virus
TVLGGAFNSL

SEQ ID NO: 196447 - protein, 10 aa, Tick-borne encephalitis virus
VLGGAFNSLF

SEQ ID NO: 196448 - protein, 10 aa, Tick-borne encephalitis virus
LGGAFNSLFG

SEQ ID NO: 196449 - protein, 10 aa, Tick-borne encephalitis virus
GGAFNSLFGG

SEQ ID NO: 196450 - protein, 10 aa, Tick-borne encephalitis virus
GAFNSLFGGV

SEQ ID NO: 196451 - protein, 10 aa, Tick-borne encephalitis virus
AFNSLFGGVG

SEQ ID NO: 196452 - protein, 10 aa, Tick-borne encephalitis virus
FNSLFGGVGF

SEQ ID NO: 196453 - protein, 10 aa, Tick-borne encephalitis virus
NSLFGGVGFL

SEQ ID NO: 196454 - protein, 10 aa, Tick-borne encephalitis virus
SLFGGVGFLP

SEQ ID NO: 196455 - protein, 10 aa, Tick-borne encephalitis virus
LFGGVGFLPK

SEQ ID NO: 196456 - protein, 10 aa, Tick-borne encephalitis virus
FGGVGFLPKI

SEQ ID NO: 196457 - protein, 10 aa, Tick-borne encephalitis virus
GGVGFLPKIL

SEQ ID NO: 196458 - protein, 10 aa, Tick-borne encephalitis virus
GVGFLPKILV

SEQ ID NO: 196459 - protein, 10 aa, Tick-borne encephalitis virus
VGFLPKILVG

SEQ ID NO: 196460 - protein, 10 aa, Tick-borne encephalitis virus
GVALAWLGLN

SEQ ID NO: 196461 - protein, 10 aa, Tick-borne encephalitis virus
VALAWLGLNM

SEQ ID NO: 196462 - protein, 10 aa, Tick-borne encephalitis virus
ALAWLGLNMR

SEQ ID NO: 196463 - protein, 10 aa, Tick-borne encephalitis virus
LAWLGLNMRN

SEQ ID NO: 196464 - protein, 10 aa, Tick-borne encephalitis virus
AWLGLNMRNP

SEQ ID NO: 196465 - protein, 10 aa, Tick-borne encephalitis virus
WLGLNMRNPT

SEQ ID NO: 196466 - protein, 10 aa, Tick-borne encephalitis virus
LGLNMRNPTM

SEQ ID NO: 196467 - protein, 10 aa, Tick-borne encephalitis virus
GLNMRNPTMS

SEQ ID NO: 196468 - protein, 10 aa, Tick-borne encephalitis virus
LNMRNPTMSM

SEQ ID NO: 196469 - protein, 10 aa, Tick-borne encephalitis virus
NMRNPTMSMS

SEQ ID NO: 196470 - protein, 10 aa, Tick-borne encephalitis virus
MRNPTMSMSF

SEQ ID NO: 196471 - protein, 10 aa, Tick-borne encephalitis virus
RNPTMSMSFL

SEQ ID NO: 196472 - protein, 10 aa, Tick-borne encephalitis virus
NPTMSMSFLL

SEQ ID NO: 196473 - protein, 10 aa, Tick-borne encephalitis virus
PTMSMSFLLA

SEQ ID NO: 196474 - protein, 10 aa, Tick-borne encephalitis virus
TMSMSFLLAG

SEQ ID NO: 196475 - protein, 10 aa, Tick-borne encephalitis virus
MSMSFLLAGG

SEQ ID NO: 196476 - protein, 10 aa, Tick-borne encephalitis virus
SMSFLLAGGL

SEQ ID NO: 196477 - protein, 10 aa, Tick-borne encephalitis virus
MSFLLAGGLV

SEQ ID NO: 196478 - protein, 10 aa, Tick-borne encephalitis virus
SFLLAGGLVL

SEQ ID NO: 196479 - protein, 10 aa, Tick-borne encephalitis virus
FLLAGGLVLA

SEQ ID NO: 196480 - protein, 10 aa, Tick-borne encephalitis virus
LLAGGLVLAM

SEQ ID NO: 196481 - protein, 10 aa, Tick-borne encephalitis virus
LAGGLVLAMT

SEQ ID NO: 196482 - protein, 10 aa, Tick-borne encephalitis virus
AGGLVLAMTL

SEQ ID NO: 196483 - protein, 10 aa, Tick-borne encephalitis virus
GGLVLAMTLG

SEQ ID NO: 196484 - protein, 10 aa, Tick-borne encephalitis virus
GLVLAMTLGV

SEQ ID NO: 196485 - protein, 10 aa, Tick-borne encephalitis virus
LVLAMTLGVG

SEQ ID NO: 196486 - protein, 10 aa, Tick-borne encephalitis virus
VLAMTLGVGA

SEQ ID NO: 196487 - protein, 10 aa, Tick-borne encephalitis virus
LAMTLGVGAD

SEQ ID NO: 196488 - protein, 10 aa, Tick-borne encephalitis virus
AMTLGVGADV

SEQ ID NO: 196489 - protein, 10 aa, Tick-borne encephalitis virus
MTLGVGADVG

SEQ ID NO: 196490 - protein, 10 aa, Tick-borne encephalitis virus
TLGVGADVGC

SEQ ID NO: 196491 - protein, 10 aa, Tick-borne encephalitis virus
LGVGADVGCA

SEQ ID NO: 196492 - protein, 10 aa, Tick-borne encephalitis virus
GVGADVGCAV

SEQ ID NO: 196493 - protein, 10 aa, Tick-borne encephalitis virus
VGADVGCAVD

SEQ ID NO: 196494 - protein, 10 aa, Tick-borne encephalitis virus
GADVGCAVDT

SEQ ID NO: 196495 - protein, 10 aa, Tick-borne encephalitis virus
ADVGCAVDTE

SEQ ID NO: 196496 - protein, 10 aa, Tick-borne encephalitis virus
DVGCAVDTER

SEQ ID NO: 196497 - protein, 10 aa, Tick-borne encephalitis virus
VGCAVDTERM

SEQ ID NO: 196498 - protein, 10 aa, Tick-borne encephalitis virus
GCAVDTERME

SEQ ID NO: 196499 - protein, 10 aa, Tick-borne encephalitis virus
CAVDTERMEL

SEQ ID NO: 196500 - protein, 10 aa, Tick-borne encephalitis virus
AVDTERMELR

SEQ ID NO: 196501 - protein, 10 aa, Tick-borne encephalitis virus
VDTERMELRC

SEQ ID NO: 196502 - protein, 10 aa, Tick-borne encephalitis virus
DTERMELRCG

SEQ ID NO: 196503 - protein, 10 aa, Tick-borne encephalitis virus
TERMELRCGE

SEQ ID NO: 196504 - protein, 10 aa, Tick-borne encephalitis virus
ERMELRCGEG

SEQ ID NO: 196505 - protein, 10 aa, Tick-borne encephalitis virus
RMELRCGEGL

SEQ ID NO: 196506 - protein, 10 aa, Tick-borne encephalitis virus
MELRCGEGLV

SEQ ID NO: 196507 - protein, 10 aa, Tick-borne encephalitis virus
ELRCGEGLVV

SEQ ID NO: 196508 - protein, 10 aa, Tick-borne encephalitis virus
LRCGEGLVVW

SEQ ID NO: 196509 - protein, 10 aa, Tick-borne encephalitis virus
RCGEGLVVWR

SEQ ID NO: 196510 - protein, 10 aa, Tick-borne encephalitis virus
CGEGLVVWRE

SEQ ID NO: 196511 - protein, 10 aa, Tick-borne encephalitis virus
GEGLVVWREV

SEQ ID NO: 196512 - protein, 10 aa, Tick-borne encephalitis virus
EGLVVWREVS

SEQ ID NO: 196513 - protein, 10 aa, Tick-borne encephalitis virus
GLVVWREVSE

SEQ ID NO: 196514 - protein, 10 aa, Tick-borne encephalitis virus
LVVWREVSEW

SEQ ID NO: 196515 - protein, 10 aa, Tick-borne encephalitis virus
VVWREVSEWY

SEQ ID NO: 196516 - protein, 10 aa, Tick-borne encephalitis virus
VWREVSEWYD

SEQ ID NO: 196517 - protein, 10 aa, Tick-borne encephalitis virus
WREVSEWYDN

SEQ ID NO: 196518 - protein, 10 aa, Tick-borne encephalitis virus
REVSEWYDNY

SEQ ID NO: 196519 - protein, 10 aa, Tick-borne encephalitis virus
EVSEWYDNYA

SEQ ID NO: 196520 - protein, 10 aa, Tick-borne encephalitis virus
VSEWYDNYAY

SEQ ID NO: 196521 - protein, 10 aa, Tick-borne encephalitis virus
SEWYDNYAYY

SEQ ID NO: 196522 - protein, 10 aa, Tick-borne encephalitis virus
EWYDNYAYYP

SEQ ID NO: 196523 - protein, 10 aa, Tick-borne encephalitis virus
WYDNYAYYPE

SEQ ID NO: 196524 - protein, 10 aa, Tick-borne encephalitis virus
YDNYAYYPET

SEQ ID NO: 196525 - protein, 10 aa, Tick-borne encephalitis virus
DNYAYYPETP

SEQ ID NO: 196526 - protein, 10 aa, Tick-borne encephalitis virus
NYAYYPETPG

SEQ ID NO: 196527 - protein, 10 aa, Tick-borne encephalitis virus
YAYYPETPGA

SEQ ID NO: 196528 - protein, 10 aa, Tick-borne encephalitis virus
AYYPETPGAL

SEQ ID NO: 196529 - protein, 10 aa, Tick-borne encephalitis virus
YYPETPGALA

SEQ ID NO: 196530 - protein, 10 aa, Tick-borne encephalitis virus
YPETPGALAS

SEQ ID NO: 196531 - protein, 10 aa, Tick-borne encephalitis virus
PETPGALASA

SEQ ID NO: 196532 - protein, 10 aa, Tick-borne encephalitis virus
ETPGALASAI

SEQ ID NO: 196533 - protein, 10 aa, Tick-borne encephalitis virus
TPGALASAIK

SEQ ID NO: 196534 - protein, 10 aa, Tick-borne encephalitis virus
PGALASAIKE

SEQ ID NO: 196535 - protein, 10 aa, Tick-borne encephalitis virus
GALASAIKET

SEQ ID NO: 196536 - protein, 10 aa, Tick-borne encephalitis virus
ALASAIKETF

SEQ ID NO: 196537 - protein, 10 aa, Tick-borne encephalitis virus
LASAIKETFE

SEQ ID NO: 196538 - protein, 10 aa, Tick-borne encephalitis virus
ASAIKETFEE

SEQ ID NO: 196539 - protein, 10 aa, Tick-borne encephalitis virus
SAIKETFEEG

SEQ ID NO: 196540 - protein, 10 aa, Tick-borne encephalitis virus
AIKETFEEGT

SEQ ID NO: 196541 - protein, 10 aa, Tick-borne encephalitis virus
IKETFEEGTC

SEQ ID NO: 196542 - protein, 10 aa, Tick-borne encephalitis virus
KETFEEGTCG

SEQ ID NO: 196543 - protein, 10 aa, Tick-borne encephalitis virus
ETFEEGTCGI

SEQ ID NO: 196544 - protein, 10 aa, Tick-borne encephalitis virus
TFEEGTCGIV

SEQ ID NO: 196545 - protein, 10 aa, Tick-borne encephalitis virus
FEEGTCGIVP

SEQ ID NO: 196546 - protein, 10 aa, Tick-borne encephalitis virus
EEGTCGIVPQ

SEQ ID NO: 196547 - protein, 10 aa, Tick-borne encephalitis virus
EGTCGIVPQN

SEQ ID NO: 196548 - protein, 10 aa, Tick-borne encephalitis virus
GTCGIVPQNR

SEQ ID NO: 196549 - protein, 10 aa, Tick-borne encephalitis virus
TCGIVPQNRL

SEQ ID NO: 196550 - protein, 10 aa, Tick-borne encephalitis virus
CGIVPQNRLE

SEQ ID NO: 196551 - protein, 10 aa, Tick-borne encephalitis virus
GIVPQNRLEM

SEQ ID NO: 196552 - protein, 10 aa, Tick-borne encephalitis virus
IVPQNRLEMA

SEQ ID NO: 196553 - protein, 10 aa, Tick-borne encephalitis virus
VPQNRLEMAM

SEQ ID NO: 196554 - protein, 10 aa, Tick-borne encephalitis virus
PQNRLEMAMW

SEQ ID NO: 196555 - protein, 10 aa, Tick-borne encephalitis virus
QNRLEMAMWR

SEQ ID NO: 196556 - protein, 10 aa, Tick-borne encephalitis virus
NRLEMAMWRS

SEQ ID NO: 196557 - protein, 10 aa, Tick-borne encephalitis virus
RLEMAMWRSS

SEQ ID NO: 196558 - protein, 10 aa, Tick-borne encephalitis virus
LEMAMWRSSA

SEQ ID NO: 196559 - protein, 10 aa, Tick-borne encephalitis virus
EMAMWRSSAT

SEQ ID NO: 196560 - protein, 10 aa, Tick-borne encephalitis virus
MAMWRSSATE

SEQ ID NO: 196561 - protein, 10 aa, Tick-borne encephalitis virus
AMWRSSATEL

SEQ ID NO: 196562 - protein, 10 aa, Tick-borne encephalitis virus
MWRSSATELN

SEQ ID NO: 196563 - protein, 10 aa, Tick-borne encephalitis virus
WRSSATELNL

SEQ ID NO: 196564 - protein, 10 aa, Tick-borne encephalitis virus
RSSATELNLA

SEQ ID NO: 196565 - protein, 10 aa, Tick-borne encephalitis virus
SSATELNLAL

SEQ ID NO: 196566 - protein, 10 aa, Tick-borne encephalitis virus
SATELNLALA

SEQ ID NO: 196567 - protein, 10 aa, Tick-borne encephalitis virus
ATELNLALAE

SEQ ID NO: 196568 - protein, 10 aa, Tick-borne encephalitis virus
TELNLALAEG

SEQ ID NO: 196569 - protein, 10 aa, Tick-borne encephalitis virus
ELNLALAEGD

SEQ ID NO: 196570 - protein, 10 aa, Tick-borne encephalitis virus
LNLALAEGDA

SEQ ID NO: 196571 - protein, 10 aa, Tick-borne encephalitis virus
NLALAEGDAN

SEQ ID NO: 196572 - protein, 10 aa, Tick-borne encephalitis virus
LALAEGDANL

SEQ ID NO: 196573 - protein, 10 aa, Tick-borne encephalitis virus
ALAEGDANLT

SEQ ID NO: 196574 - protein, 10 aa, Tick-borne encephalitis virus
LAEGDANLTV

SEQ ID NO: 196575 - protein, 10 aa, Tick-borne encephalitis virus
AEGDANLTVV

SEQ ID NO: 196576 - protein, 10 aa, Tick-borne encephalitis virus
EGDANLTVVV

SEQ ID NO: 196577 - protein, 10 aa, Tick-borne encephalitis virus
GDANLTVVVD

SEQ ID NO: 196578 - protein, 10 aa, Tick-borne encephalitis virus
DANLTVVVDK

SEQ ID NO: 196579 - protein, 10 aa, Tick-borne encephalitis virus
ANLTVVVDKL

SEQ ID NO: 196580 - protein, 10 aa, Tick-borne encephalitis virus
NLTVVVDKLD

SEQ ID NO: 196581 - protein, 10 aa, Tick-borne encephalitis virus
LTVVVDKLDP

SEQ ID NO: 196582 - protein, 10 aa, Tick-borne encephalitis virus
TVVVDKLDPT

SEQ ID NO: 196583 - protein, 10 aa, Tick-borne encephalitis virus
VVVDKLDPTD

SEQ ID NO: 196584 - protein, 10 aa, Tick-borne encephalitis virus
VVDKLDPTDY

SEQ ID NO: 196585 - protein, 10 aa, Tick-borne encephalitis virus
VDKLDPTDYR

SEQ ID NO: 196586 - protein, 10 aa, Tick-borne encephalitis virus
DKLDPTDYRG

SEQ ID NO: 196587 - protein, 10 aa, Tick-borne encephalitis virus
KLDPTDYRGG

SEQ ID NO: 196588 - protein, 10 aa, Tick-borne encephalitis virus
LDPTDYRGGI

SEQ ID NO: 196589 - protein, 10 aa, Tick-borne encephalitis virus
DPTDYRGGIP

SEQ ID NO: 196590 - protein, 10 aa, Tick-borne encephalitis virus
PTDYRGGIPG

SEQ ID NO: 196591 - protein, 10 aa, Tick-borne encephalitis virus
TDYRGGIPGL

SEQ ID NO: 196592 - protein, 10 aa, Tick-borne encephalitis virus
DYRGGIPGLL

SEQ ID NO: 196593 - protein, 10 aa, Tick-borne encephalitis virus
YRGGIPGLLK

SEQ ID NO: 196594 - protein, 10 aa, Tick-borne encephalitis virus
RGGIPGLLKK

SEQ ID NO: 196595 - protein, 10 aa, Tick-borne encephalitis virus
GGIPGLLKKG

SEQ ID NO: 196596 - protein, 10 aa, Tick-borne encephalitis virus
GIPGLLKKGK

SEQ ID NO: 196597 - protein, 10 aa, Tick-borne encephalitis virus
IPGLLKKGKD

SEQ ID NO: 196598 - protein, 10 aa, Tick-borne encephalitis virus
PGLLKKGKDI

SEQ ID NO: 196599 - protein, 10 aa, Tick-borne encephalitis virus
GLLKKGKDIK

SEQ ID NO: 196600 - protein, 10 aa, Tick-borne encephalitis virus
LLKKGKDIKV

SEQ ID NO: 196601 - protein, 10 aa, Tick-borne encephalitis virus
LKKGKDIKVS

SEQ ID NO: 196602 - protein, 10 aa, Tick-borne encephalitis virus
KKGKDIKVSW

SEQ ID NO: 196603 - protein, 10 aa, Tick-borne encephalitis virus
KGKDIKVSWK

SEQ ID NO: 196604 - protein, 10 aa, Tick-borne encephalitis virus
GKDIKVSWKS

SEQ ID NO: 196605 - protein, 10 aa, Tick-borne encephalitis virus
KDIKVSWKSW

SEQ ID NO: 196606 - protein, 10 aa, Tick-borne encephalitis virus
DIKVSWKSWG

SEQ ID NO: 196607 - protein, 10 aa, Tick-borne encephalitis virus
IKVSWKSWGH

SEQ ID NO: 196608 - protein, 10 aa, Tick-borne encephalitis virus
KVSWKSWGHS

SEQ ID NO: 196609 - protein, 10 aa, Tick-borne encephalitis virus
MIWSVPEAPR

SEQ ID NO: 196610 - protein, 10 aa, Tick-borne encephalitis virus
IWSVPEAPRR

SEQ ID NO: 196611 - protein, 10 aa, Tick-borne encephalitis virus
WSVPEAPRRF

SEQ ID NO: 196612 - protein, 10 aa, Tick-borne encephalitis virus
SVPEAPRRFM

SEQ ID NO: 196613 - protein, 10 aa, Tick-borne encephalitis virus
VPEAPRRFMV

SEQ ID NO: 196614 - protein, 10 aa, Tick-borne encephalitis virus
PEAPRRFMVG

SEQ ID NO: 196615 - protein, 10 aa, Tick-borne encephalitis virus
EAPRRFMVGT

SEQ ID NO: 196616 - protein, 10 aa, Tick-borne encephalitis virus
APRRFMVGTE

SEQ ID NO: 196617 - protein, 10 aa, Tick-borne encephalitis virus
PRRFMVGTEG

SEQ ID NO: 196618 - protein, 10 aa, Tick-borne encephalitis virus
RRFMVGTEGG

SEQ ID NO: 196619 - protein, 10 aa, Tick-borne encephalitis virus
SECPLERRKT

SEQ ID NO: 196620 - protein, 10 aa, Tick-borne encephalitis virus
ECPLERRKTG

SEQ ID NO: 196621 - protein, 10 aa, Tick-borne encephalitis virus
CPLERRKTGV

SEQ ID NO: 196622 - protein, 10 aa, Tick-borne encephalitis virus
PLERRKTGVF

SEQ ID NO: 196623 - protein, 10 aa, Tick-borne encephalitis virus
LERRKTGVFT

SEQ ID NO: 196624 - protein, 10 aa, Tick-borne encephalitis virus
ERRKTGVFTV

SEQ ID NO: 196625 - protein, 10 aa, Tick-borne encephalitis virus
RRKTGVFTVA

SEQ ID NO: 196626 - protein, 10 aa, Tick-borne encephalitis virus
RKTGVFTVAE

SEQ ID NO: 196627 - protein, 10 aa, Tick-borne encephalitis virus
KTGVFTVAEF

SEQ ID NO: 196628 - protein, 10 aa, Tick-borne encephalitis virus
TGVFTVAEFG

SEQ ID NO: 196629 - protein, 10 aa, Tick-borne encephalitis virus
GVFTVAEFGV

SEQ ID NO: 196630 - protein, 10 aa, Tick-borne encephalitis virus
VFTVAEFGVG

SEQ ID NO: 196631 - protein, 10 aa, Tick-borne encephalitis virus
FTVAEFGVGL

SEQ ID NO: 196632 - protein, 10 aa, Tick-borne encephalitis virus
TVAEFGVGLR

SEQ ID NO: 196633 - protein, 10 aa, Tick-borne encephalitis virus
VAEFGVGLRT

SEQ ID NO: 196634 - protein, 10 aa, Tick-borne encephalitis virus
AEFGVGLRTK

SEQ ID NO: 196635 - protein, 10 aa, Tick-borne encephalitis virus
EFGVGLRTKV

SEQ ID NO: 196636 - protein, 10 aa, Tick-borne encephalitis virus
FGVGLRTKVF

SEQ ID NO: 196637 - protein, 10 aa, Tick-borne encephalitis virus
GVGLRTKVFL

SEQ ID NO: 196638 - protein, 10 aa, Tick-borne encephalitis virus
VGLRTKVFLD

SEQ ID NO: 196639 - protein, 10 aa, Tick-borne encephalitis virus
GLRTKVFLDF

SEQ ID NO: 196640 - protein, 10 aa, Tick-borne encephalitis virus
LRTKVFLDFR

SEQ ID NO: 196641 - protein, 10 aa, Tick-borne encephalitis virus
RTKVFLDFRQ

SEQ ID NO: 196642 - protein, 10 aa, Tick-borne encephalitis virus
TKVFLDFRQE

SEQ ID NO: 196643 - protein, 10 aa, Tick-borne encephalitis virus
KVFLDFRQES

SEQ ID NO: 196644 - protein, 10 aa, Tick-borne encephalitis virus
VFLDFRQEST

SEQ ID NO: 196645 - protein, 10 aa, Tick-borne encephalitis virus
FLDFRQESTH

SEQ ID NO: 196646 - protein, 10 aa, Tick-borne encephalitis virus
LDFRQESTHE

SEQ ID NO: 196647 - protein, 10 aa, Tick-borne encephalitis virus
DFRQESTHEC

SEQ ID NO: 196648 - protein, 10 aa, Tick-borne encephalitis virus
FRQESTHECD

SEQ ID NO: 196649 - protein, 10 aa, Tick-borne encephalitis virus
RQESTHECDT

SEQ ID NO: 196650 - protein, 10 aa, Tick-borne encephalitis virus
QESTHECDTG

SEQ ID NO: 196651 - protein, 10 aa, Tick-borne encephalitis virus
ESTHECDTGV

SEQ ID NO: 196652 - protein, 10 aa, Tick-borne encephalitis virus
STHECDTGVM

SEQ ID NO: 196653 - protein, 10 aa, Tick-borne encephalitis virus
THECDTGVMG

SEQ ID NO: 196654 - protein, 10 aa, Tick-borne encephalitis virus
HECDTGVMGA

SEQ ID NO: 196655 - protein, 10 aa, Tick-borne encephalitis virus
ECDTGVMGAA

SEQ ID NO: 196656 - protein, 10 aa, Tick-borne encephalitis virus
CDTGVMGAAV

SEQ ID NO: 196657 - protein, 10 aa, Tick-borne encephalitis virus
DTGVMGAAVK

SEQ ID NO: 196658 - protein, 10 aa, Tick-borne encephalitis virus
TGVMGAAVKN

SEQ ID NO: 196659 - protein, 10 aa, Tick-borne encephalitis virus
GVMGAAVKNG

SEQ ID NO: 196660 - protein, 10 aa, Tick-borne encephalitis virus
VMGAAVKNGM

SEQ ID NO: 196661 - protein, 10 aa, Tick-borne encephalitis virus
MGAAVKNGMA

SEQ ID NO: 196662 - protein, 10 aa, Tick-borne encephalitis virus
GAAVKNGMAV

SEQ ID NO: 196663 - protein, 10 aa, Tick-borne encephalitis virus
AAVKNGMAVH

SEQ ID NO: 196664 - protein, 10 aa, Tick-borne encephalitis virus
AVKNGMAVHT

SEQ ID NO: 196665 - protein, 10 aa, Tick-borne encephalitis virus
VKNGMAVHTD

SEQ ID NO: 196666 - protein, 10 aa, Tick-borne encephalitis virus
KNGMAVHTDQ

SEQ ID NO: 196667 - protein, 10 aa, Tick-borne encephalitis virus
NGMAVHTDQS

SEQ ID NO: 196668 - protein, 10 aa, Tick-borne encephalitis virus
GMAVHTDQSL

SEQ ID NO: 196669 - protein, 10 aa, Tick-borne encephalitis virus
MAVHTDQSLW

SEQ ID NO: 196670 - protein, 10 aa, Tick-borne encephalitis virus
AVHTDQSLWM

SEQ ID NO: 196671 - protein, 10 aa, Tick-borne encephalitis virus
VHTDQSLWMK

SEQ ID NO: 196672 - protein, 10 aa, Tick-borne encephalitis virus
HTDQSLWMKS

SEQ ID NO: 196673 - protein, 10 aa, Tick-borne encephalitis virus
TDQSLWMKSV

SEQ ID NO: 196674 - protein, 10 aa, Tick-borne encephalitis virus
DQSLWMKSVR

SEQ ID NO: 196675 - protein, 10 aa, Tick-borne encephalitis virus
QSLWMKSVRN

SEQ ID NO: 196676 - protein, 10 aa, Tick-borne encephalitis virus
SLWMKSVRND

SEQ ID NO: 196677 - protein, 10 aa, Tick-borne encephalitis virus
LWMKSVRNDT

SEQ ID NO: 196678 - protein, 10 aa, Tick-borne encephalitis virus
WMKSVRNDTG

SEQ ID NO: 196679 - protein, 10 aa, Tick-borne encephalitis virus
MKSVRNDTGT

SEQ ID NO: 196680 - protein, 10 aa, Tick-borne encephalitis virus
KSVRNDTGTY

SEQ ID NO: 196681 - protein, 10 aa, Tick-borne encephalitis virus
SVRNDTGTYI

SEQ ID NO: 196682 - protein, 10 aa, Tick-borne encephalitis virus
VRNDTGTYIV

SEQ ID NO: 196683 - protein, 10 aa, Tick-borne encephalitis virus
RNDTGTYIVE

SEQ ID NO: 196684 - protein, 10 aa, Tick-borne encephalitis virus
NDTGTYIVEL

SEQ ID NO: 196685 - protein, 10 aa, Tick-borne encephalitis virus
DTGTYIVELL

SEQ ID NO: 196686 - protein, 10 aa, Tick-borne encephalitis virus
TGTYIVELLV

SEQ ID NO: 196687 - protein, 10 aa, Tick-borne encephalitis virus
GTYIVELLVT

SEQ ID NO: 196688 - protein, 10 aa, Tick-borne encephalitis virus
TYIVELLVTD

SEQ ID NO: 196689 - protein, 10 aa, Tick-borne encephalitis virus
YIVELLVTDL

SEQ ID NO: 196690 - protein, 10 aa, Tick-borne encephalitis virus
IVELLVTDLR

SEQ ID NO: 196691 - protein, 10 aa, Tick-borne encephalitis virus
VELLVTDLRN

SEQ ID NO: 196692 - protein, 10 aa, Tick-borne encephalitis virus
ELLVTDLRNC

SEQ ID NO: 196693 - protein, 10 aa, Tick-borne encephalitis virus
LLVTDLRNCS

SEQ ID NO: 196694 - protein, 10 aa, Tick-borne encephalitis virus
LVTDLRNCSW

SEQ ID NO: 196695 - protein, 10 aa, Tick-borne encephalitis virus
VTDLRNCSWP

SEQ ID NO: 196696 - protein, 10 aa, Tick-borne encephalitis virus
TDLRNCSWPA

SEQ ID NO: 196697 - protein, 10 aa, Tick-borne encephalitis virus
DLRNCSWPAS

SEQ ID NO: 196698 - protein, 10 aa, Tick-borne encephalitis virus
LRNCSWPASH

SEQ ID NO: 196699 - protein, 10 aa, Tick-borne encephalitis virus
RNCSWPASHT

SEQ ID NO: 196700 - protein, 10 aa, Tick-borne encephalitis virus
NCSWPASHTI

SEQ ID NO: 196701 - protein, 10 aa, Tick-borne encephalitis virus
CSWPASHTID

SEQ ID NO: 196702 - protein, 10 aa, Tick-borne encephalitis virus
SWPASHTIDN

SEQ ID NO: 196703 - protein, 10 aa, Tick-borne encephalitis virus
WPASHTIDNA

SEQ ID NO: 196704 - protein, 10 aa, Tick-borne encephalitis virus
PASHTIDNAE

SEQ ID NO: 196705 - protein, 10 aa, Tick-borne encephalitis virus
ASHTIDNAEV

SEQ ID NO: 196706 - protein, 10 aa, Tick-borne encephalitis virus
SHTIDNAEVV

SEQ ID NO: 196707 - protein, 10 aa, Tick-borne encephalitis virus
HTIDNAEVVD

SEQ ID NO: 196708 - protein, 10 aa, Tick-borne encephalitis virus
TIDNAEVVDS

SEQ ID NO: 196709 - protein, 10 aa, Tick-borne encephalitis virus
IDNAEVVDSE

SEQ ID NO: 196710 - protein, 10 aa, Tick-borne encephalitis virus
DNAEVVDSEL

SEQ ID NO: 196711 - protein, 10 aa, Tick-borne encephalitis virus
NAEVVDSELF

SEQ ID NO: 196712 - protein, 10 aa, Tick-borne encephalitis virus
AEVVDSELFL

SEQ ID NO: 196713 - protein, 10 aa, Tick-borne encephalitis virus
EVVDSELFLP

SEQ ID NO: 196714 - protein, 10 aa, Tick-borne encephalitis virus
VVDSELFLPA

SEQ ID NO: 196715 - protein, 10 aa, Tick-borne encephalitis virus
VDSELFLPAS

SEQ ID NO: 196716 - protein, 10 aa, Tick-borne encephalitis virus
DSELFLPASL

SEQ ID NO: 196717 - protein, 10 aa, Tick-borne encephalitis virus
SELFLPASLA

SEQ ID NO: 196718 - protein, 10 aa, Tick-borne encephalitis virus
ELFLPASLAG

SEQ ID NO: 196719 - protein, 10 aa, Tick-borne encephalitis virus
LFLPASLAGP

SEQ ID NO: 196720 - protein, 10 aa, Tick-borne encephalitis virus
FLPASLAGPR

SEQ ID NO: 196721 - protein, 10 aa, Tick-borne encephalitis virus
LPASLAGPRS

SEQ ID NO: 196722 - protein, 10 aa, Tick-borne encephalitis virus
PASLAGPRSW

SEQ ID NO: 196723 - protein, 10 aa, Tick-borne encephalitis virus
ASLAGPRSWY

SEQ ID NO: 196724 - protein, 10 aa, Tick-borne encephalitis virus
SLAGPRSWYN

SEQ ID NO: 196725 - protein, 10 aa, Tick-borne encephalitis virus
LAGPRSWYNR

SEQ ID NO: 196726 - protein, 10 aa, Tick-borne encephalitis virus
AGPRSWYNRI

SEQ ID NO: 196727 - protein, 10 aa, Tick-borne encephalitis virus
GPRSWYNRIP

SEQ ID NO: 196728 - protein, 10 aa, Tick-borne encephalitis virus
PRSWYNRIPG

SEQ ID NO: 196729 - protein, 10 aa, Tick-borne encephalitis virus
RSWYNRIPGY

SEQ ID NO: 196730 - protein, 10 aa, Tick-borne encephalitis virus
SWYNRIPGYS

SEQ ID NO: 196731 - protein, 10 aa, Tick-borne encephalitis virus
WYNRIPGYSE

SEQ ID NO: 196732 - protein, 10 aa, Tick-borne encephalitis virus
YNRIPGYSEQ

SEQ ID NO: 196733 - protein, 10 aa, Tick-borne encephalitis virus
NRIPGYSEQV

SEQ ID NO: 196734 - protein, 10 aa, Tick-borne encephalitis virus
RIPGYSEQVK

SEQ ID NO: 196735 - protein, 10 aa, Tick-borne encephalitis virus
IPGYSEQVKG

SEQ ID NO: 196736 - protein, 10 aa, Tick-borne encephalitis virus
PGYSEQVKGP

SEQ ID NO: 196737 - protein, 10 aa, Tick-borne encephalitis virus
GYSEQVKGPW

SEQ ID NO: 196738 - protein, 10 aa, Tick-borne encephalitis virus
YSEQVKGPWK

SEQ ID NO: 196739 - protein, 10 aa, Tick-borne encephalitis virus
SEQVKGPWKY

SEQ ID NO: 196740 - protein, 10 aa, Tick-borne encephalitis virus
EQVKGPWKYS

SEQ ID NO: 196741 - protein, 10 aa, Tick-borne encephalitis virus
QVKGPWKYSP

SEQ ID NO: 196742 - protein, 10 aa, Tick-borne encephalitis virus
VKGPWKYSPI

SEQ ID NO: 196743 - protein, 10 aa, Tick-borne encephalitis virus
KGPWKYSPIR

SEQ ID NO: 196744 - protein, 10 aa, Tick-borne encephalitis virus
GPWKYSPIRV

SEQ ID NO: 196745 - protein, 10 aa, Tick-borne encephalitis virus
PIRVTREECP

SEQ ID NO: 196746 - protein, 10 aa, Tick-borne encephalitis virus
IRVTREECPG

SEQ ID NO: 196747 - protein, 10 aa, Tick-borne encephalitis virus
RVTREECPGT

SEQ ID NO: 196748 - protein, 10 aa, Tick-borne encephalitis virus
VTREECPGTR

SEQ ID NO: 196749 - protein, 10 aa, Tick-borne encephalitis virus
TREECPGTRV

SEQ ID NO: 196750 - protein, 10 aa, Tick-borne encephalitis virus
INADCDKRGA

SEQ ID NO: 196751 - protein, 10 aa, Tick-borne encephalitis virus
NADCDKRGAS

SEQ ID NO: 196752 - protein, 10 aa, Tick-borne encephalitis virus
ADCDKRGASV

SEQ ID NO: 196753 - protein, 10 aa, Tick-borne encephalitis virus
DCDKRGASVR

SEQ ID NO: 196754 - protein, 10 aa, Tick-borne encephalitis virus
CDKRGASVRS

SEQ ID NO: 196755 - protein, 10 aa, Tick-borne encephalitis virus
DKRGASVRST

SEQ ID NO: 196756 - protein, 10 aa, Tick-borne encephalitis virus
KRGASVRSTT

SEQ ID NO: 196757 - protein, 10 aa, Tick-borne encephalitis virus
RGASVRSTTE

SEQ ID NO: 196758 - protein, 10 aa, Tick-borne encephalitis virus
GASVRSTTES

SEQ ID NO: 196759 - protein, 10 aa, Tick-borne encephalitis virus
ASVRSTTESG

SEQ ID NO: 196760 - protein, 10 aa, Tick-borne encephalitis virus
SVRSTTESGK

SEQ ID NO: 196761 - protein, 10 aa, Tick-borne encephalitis virus
VRSTTESGKV

SEQ ID NO: 196762 - protein, 10 aa, Tick-borne encephalitis virus
RSTTESGKVI

SEQ ID NO: 196763 - protein, 10 aa, Tick-borne encephalitis virus
STTESGKVIP

SEQ ID NO: 196764 - protein, 10 aa, Tick-borne encephalitis virus
TTESGKVIPE

SEQ ID NO: 196765 - protein, 10 aa, Tick-borne encephalitis virus
TESGKVIPEW

SEQ ID NO: 196766 - protein, 10 aa, Tick-borne encephalitis virus
ESGKVIPEWC

SEQ ID NO: 196767 - protein, 10 aa, Tick-borne encephalitis virus
SGKVIPEWCC

SEQ ID NO: 196768 - protein, 10 aa, Tick-borne encephalitis virus
GKVIPEWCCR

SEQ ID NO: 196769 - protein, 10 aa, Tick-borne encephalitis virus
KVIPEWCCRT

SEQ ID NO: 196770 - protein, 10 aa, Tick-borne encephalitis virus
VIPEWCCRTC

SEQ ID NO: 196771 - protein, 10 aa, Tick-borne encephalitis virus
IPEWCCRTCT

SEQ ID NO: 196772 - protein, 10 aa, Tick-borne encephalitis virus
PEWCCRTCTL

SEQ ID NO: 196773 - protein, 10 aa, Tick-borne encephalitis virus
EWCCRTCTLP

SEQ ID NO: 196774 - protein, 10 aa, Tick-borne encephalitis virus
WCCRTCTLPP

SEQ ID NO: 196775 - protein, 10 aa, Tick-borne encephalitis virus
CCRTCTLPPV

SEQ ID NO: 196776 - protein, 10 aa, Tick-borne encephalitis virus
CRTCTLPPVT

SEQ ID NO: 196777 - protein, 10 aa, Tick-borne encephalitis virus
RTCTLPPVTF

SEQ ID NO: 196778 - protein, 10 aa, Tick-borne encephalitis virus
TCTLPPVTFR

SEQ ID NO: 196779 - protein, 10 aa, Tick-borne encephalitis virus
CTLPPVTFRT

SEQ ID NO: 196780 - protein, 10 aa, Tick-borne encephalitis virus
TLPPVTFRTG

SEQ ID NO: 196781 - protein, 10 aa, Tick-borne encephalitis virus
LPPVTFRTGT

SEQ ID NO: 196782 - protein, 10 aa, Tick-borne encephalitis virus
PPVTFRTGTD

SEQ ID NO: 196783 - protein, 10 aa, Tick-borne encephalitis virus
PVTFRTGTDC

SEQ ID NO: 196784 - protein, 10 aa, Tick-borne encephalitis virus
VTFRTGTDCW

SEQ ID NO: 196785 - protein, 10 aa, Tick-borne encephalitis virus
TFRTGTDCWY

SEQ ID NO: 196786 - protein, 10 aa, Tick-borne encephalitis virus
FRTGTDCWYA

SEQ ID NO: 196787 - protein, 10 aa, Tick-borne encephalitis virus
RTGTDCWYAM

SEQ ID NO: 196788 - protein, 10 aa, Tick-borne encephalitis virus
TGTDCWYAME

SEQ ID NO: 196789 - protein, 10 aa, Tick-borne encephalitis virus
GTDCWYAMEI

SEQ ID NO: 196790 - protein, 10 aa, Tick-borne encephalitis virus
TDCWYAMEIR

SEQ ID NO: 196791 - protein, 10 aa, Tick-borne encephalitis virus
DCWYAMEIRP

SEQ ID NO: 196792 - protein, 10 aa, Tick-borne encephalitis virus
CWYAMEIRPV

SEQ ID NO: 196793 - protein, 10 aa, Tick-borne encephalitis virus
WYAMEIRPVH

SEQ ID NO: 196794 - protein, 10 aa, Tick-borne encephalitis virus
YAMEIRPVHD

SEQ ID NO: 196795 - protein, 10 aa, Tick-borne encephalitis virus
AMEIRPVHDQ

SEQ ID NO: 196796 - protein, 10 aa, Tick-borne encephalitis virus
MEIRPVHDQG

SEQ ID NO: 196797 - protein, 10 aa, Tick-borne encephalitis virus
EIRPVHDQGG

SEQ ID NO: 196798 - protein, 10 aa, Tick-borne encephalitis virus
IRPVHDQGGL

SEQ ID NO: 196799 - protein, 10 aa, Tick-borne encephalitis virus
RPVHDQGGLV

SEQ ID NO: 196800 - protein, 10 aa, Tick-borne encephalitis virus
PVHDQGGLVR

SEQ ID NO: 196801 - protein, 10 aa, Tick-borne encephalitis virus
VHDQGGLVRS

SEQ ID NO: 196802 - protein, 10 aa, Tick-borne encephalitis virus
HDQGGLVRSM

SEQ ID NO: 196803 - protein, 10 aa, Tick-borne encephalitis virus
DQGGLVRSMV

SEQ ID NO: 196804 - protein, 10 aa, Tick-borne encephalitis virus
QGGLVRSMVV

SEQ ID NO: 196805 - protein, 10 aa, Tick-borne encephalitis virus
GGLVRSMVVA

SEQ ID NO: 196806 - protein, 10 aa, Tick-borne encephalitis virus
GLVRSMVVAD

SEQ ID NO: 196807 - protein, 10 aa, Tick-borne encephalitis virus
LVRSMVVADN

SEQ ID NO: 196808 - protein, 10 aa, Tick-borne encephalitis virus
VRSMVVADNG

SEQ ID NO: 196809 - protein, 10 aa, Tick-borne encephalitis virus
RSMVVADNGE

SEQ ID NO: 196810 - protein, 10 aa, Tick-borne encephalitis virus
SMVVADNGEL

SEQ ID NO: 196811 - protein, 10 aa, Tick-borne encephalitis virus
MVVADNGELL

SEQ ID NO: 196812 - protein, 10 aa, Tick-borne encephalitis virus
VVADNGELLS

SEQ ID NO: 196813 - protein, 10 aa, Tick-borne encephalitis virus
VADNGELLSE

SEQ ID NO: 196814 - protein, 10 aa, Tick-borne encephalitis virus
ADNGELLSEG

SEQ ID NO: 196815 - protein, 10 aa, Tick-borne encephalitis virus
DNGELLSEGG

SEQ ID NO: 196816 - protein, 10 aa, Tick-borne encephalitis virus
NGELLSEGGI

SEQ ID NO: 196817 - protein, 10 aa, Tick-borne encephalitis virus
GELLSEGGVP

SEQ ID NO: 196818 - protein, 10 aa, Tick-borne encephalitis virus
ELLSEGGVPG

SEQ ID NO: 196819 - protein, 10 aa, Tick-borne encephalitis virus
LLSEGGIPGI

SEQ ID NO: 196820 - protein, 10 aa, Tick-borne encephalitis virus
LSEGGIPGIV

SEQ ID NO: 196821 - protein, 10 aa, Tick-borne encephalitis virus
SEGGIPGIVA

SEQ ID NO: 196822 - protein, 10 aa, Tick-borne encephalitis virus
EGGVPGIVAL

SEQ ID NO: 196823 - protein, 10 aa, Tick-borne encephalitis virus
GGIPGIVALF

SEQ ID NO: 196824 - protein, 10 aa, Tick-borne encephalitis virus
GVPGIVALFV

SEQ ID NO: 196825 - protein, 10 aa, Tick-borne encephalitis virus
VPGIVALFVV

SEQ ID NO: 196826 - protein, 10 aa, Tick-borne encephalitis virus
PGIVALFVVL

SEQ ID NO: 196827 - protein, 10 aa, Tick-borne encephalitis virus
GIVALFVVLE

SEQ ID NO: 196828 - protein, 10 aa, Tick-borne encephalitis virus
IVALFVVLEY

SEQ ID NO: 196829 - protein, 10 aa, Tick-borne encephalitis virus
VALFVVLEYV

SEQ ID NO: 196830 - protein, 10 aa, Tick-borne encephalitis virus
ALFVVLEYVI

SEQ ID NO: 196831 - protein, 10 aa, Tick-borne encephalitis virus
LFVVLEYVIR

SEQ ID NO: 196832 - protein, 10 aa, Tick-borne encephalitis virus
FVVLEYVIRR

SEQ ID NO: 196833 - protein, 10 aa, Tick-borne encephalitis virus
VVLEYVIRRR

SEQ ID NO: 196834 - protein, 10 aa, Tick-borne encephalitis virus
VLEYVIRRRP

SEQ ID NO: 196835 - protein, 10 aa, Tick-borne encephalitis virus
LEYVIRRRPA

SEQ ID NO: 196836 - protein, 10 aa, Tick-borne encephalitis virus
EYVIRRRPAT

SEQ ID NO: 196837 - protein, 10 aa, Tick-borne encephalitis virus
YVIRRRPATG

SEQ ID NO: 196838 - protein, 10 aa, Tick-borne encephalitis virus
VIRRRPATGT

SEQ ID NO: 196839 - protein, 10 aa, Tick-borne encephalitis virus
IRRRPATGTT

SEQ ID NO: 196840 - protein, 10 aa, Tick-borne encephalitis virus
RRRPATGTTA

SEQ ID NO: 196841 - protein, 10 aa, Tick-borne encephalitis virus
RRPATGTTAM

SEQ ID NO: 196842 - protein, 10 aa, Tick-borne encephalitis virus
RPATGTTAMW

SEQ ID NO: 196843 - protein, 10 aa, Tick-borne encephalitis virus
PATGTTAMWG

SEQ ID NO: 196844 - protein, 10 aa, Tick-borne encephalitis virus
ATGTTAMWGG

SEQ ID NO: 196845 - protein, 10 aa, Tick-borne encephalitis virus
WGGIVVLALL

SEQ ID NO: 196846 - protein, 10 aa, Tick-borne encephalitis virus
GGIVVLALLV

SEQ ID NO: 196847 - protein, 10 aa, Tick-borne encephalitis virus
GIVVLALLVT

SEQ ID NO: 196848 - protein, 10 aa, Tick-borne encephalitis virus
IVVLALLVTG

SEQ ID NO: 196849 - protein, 10 aa, Tick-borne encephalitis virus
VVLALLVTGL

SEQ ID NO: 196850 - protein, 10 aa, Tick-borne encephalitis virus
VLALLVTGLV

SEQ ID NO: 196851 - protein, 10 aa, Tick-borne encephalitis virus
LALLVTGLVR

SEQ ID NO: 196852 - protein, 10 aa, Tick-borne encephalitis virus
VRIESLVRYV

SEQ ID NO: 196853 - protein, 10 aa, Tick-borne encephalitis virus
RIESLVRYVV

SEQ ID NO: 196854 - protein, 10 aa, Tick-borne encephalitis virus
IESLVRYVVA

SEQ ID NO: 196855 - protein, 10 aa, Tick-borne encephalitis virus
ESLVRYVVAV

SEQ ID NO: 196856 - protein, 10 aa, Tick-borne encephalitis virus
SLVRYVVAVG

SEQ ID NO: 196857 - protein, 10 aa, Tick-borne encephalitis virus
LVRYVVAVGI

SEQ ID NO: 196858 - protein, 10 aa, Tick-borne encephalitis virus
VRYVVAVGIT

SEQ ID NO: 196859 - protein, 10 aa, Tick-borne encephalitis virus
RYVVAVGITF

SEQ ID NO: 196860 - protein, 10 aa, Tick-borne encephalitis virus
YVVAVGITFH

SEQ ID NO: 196861 - protein, 10 aa, Tick-borne encephalitis virus
VVAVGITFHL

SEQ ID NO: 196862 - protein, 10 aa, Tick-borne encephalitis virus
VAVGITFHLE

SEQ ID NO: 196863 - protein, 10 aa, Tick-borne encephalitis virus
AVGITFHLEL

SEQ ID NO: 196864 - protein, 10 aa, Tick-borne encephalitis virus
VGITFHLELG

SEQ ID NO: 196865 - protein, 10 aa, Tick-borne encephalitis virus
GITFHLELGP

SEQ ID NO: 196866 - protein, 10 aa, Tick-borne encephalitis virus
ITFHLELGPE

SEQ ID NO: 196867 - protein, 10 aa, Tick-borne encephalitis virus
TFHLELGPEI

SEQ ID NO: 196868 - protein, 10 aa, Tick-borne encephalitis virus
FHLELGPEIV

SEQ ID NO: 196869 - protein, 10 aa, Tick-borne encephalitis virus
HLELGPEIVA

SEQ ID NO: 196870 - protein, 10 aa, Tick-borne encephalitis virus
LELGPEIVAL

SEQ ID NO: 196871 - protein, 10 aa, Tick-borne encephalitis virus
ELGPEIVALT

SEQ ID NO: 196872 - protein, 10 aa, Tick-borne encephalitis virus
LGPEIVALTL

SEQ ID NO: 196873 - protein, 10 aa, Tick-borne encephalitis virus
GPEIVALTLL

SEQ ID NO: 196874 - protein, 10 aa, Tick-borne encephalitis virus
PEIVALTLLQ

SEQ ID NO: 196875 - protein, 10 aa, Tick-borne encephalitis virus
EIVALTLLQA

SEQ ID NO: 196876 - protein, 10 aa, Tick-borne encephalitis virus
IVALTLLQAV

SEQ ID NO: 196877 - protein, 10 aa, Tick-borne encephalitis virus
VALTLLQAVF

SEQ ID NO: 196878 - protein, 10 aa, Tick-borne encephalitis virus
ALTLLQAVFE

SEQ ID NO: 196879 - protein, 10 aa, Tick-borne encephalitis virus
LTLLQAVFEL

SEQ ID NO: 196880 - protein, 10 aa, Tick-borne encephalitis virus
TLLQAVFELR

SEQ ID NO: 196881 - protein, 10 aa, Tick-borne encephalitis virus
LLQAVFELRV

SEQ ID NO: 196882 - protein, 10 aa, Tick-borne encephalitis virus
LQAVFELRVG

SEQ ID NO: 196883 - protein, 10 aa, Tick-borne encephalitis virus
QAVFELRVGL

SEQ ID NO: 196884 - protein, 10 aa, Tick-borne encephalitis virus
AVFELRVGLL

SEQ ID NO: 196885 - protein, 10 aa, Tick-borne encephalitis virus
VFELRVGLLS

SEQ ID NO: 196886 - protein, 10 aa, Tick-borne encephalitis virus
FELRVGLLSA

SEQ ID NO: 196887 - protein, 10 aa, Tick-borne encephalitis virus
ELRVGLLSAF

SEQ ID NO: 196888 - protein, 10 aa, Tick-borne encephalitis virus
LRVGLLSAFA

SEQ ID NO: 196889 - protein, 10 aa, Tick-borne encephalitis virus
RVGLLSAFAL

SEQ ID NO: 196890 - protein, 10 aa, Tick-borne encephalitis virus
VGLLSAFALR

SEQ ID NO: 196891 - protein, 10 aa, Tick-borne encephalitis virus
GLLSAFALRS

SEQ ID NO: 196892 - protein, 10 aa, Tick-borne encephalitis virus
LLSAFALRSN

SEQ ID NO: 196893 - protein, 10 aa, Tick-borne encephalitis virus
LSAFALRSNL

SEQ ID NO: 196894 - protein, 10 aa, Tick-borne encephalitis virus
SAFALRSNLT

SEQ ID NO: 196895 - protein, 10 aa, Tick-borne encephalitis virus
AFALRSNLTV

SEQ ID NO: 196896 - protein, 10 aa, Tick-borne encephalitis virus
FALRSNLTVR

SEQ ID NO: 196897 - protein, 10 aa, Tick-borne encephalitis virus
ALRSNLTVRE

SEQ ID NO: 196898 - protein, 10 aa, Tick-borne encephalitis virus
LRSNLTVREM

SEQ ID NO: 196899 - protein, 10 aa, Tick-borne encephalitis virus
RSNLTVREMV

SEQ ID NO: 196900 - protein, 10 aa, Tick-borne encephalitis virus
SNLTVREMVT

SEQ ID NO: 196901 - protein, 10 aa, Tick-borne encephalitis virus
NLTVREMVTI

SEQ ID NO: 196902 - protein, 10 aa, Tick-borne encephalitis virus
LTVREMVTIY

SEQ ID NO: 196903 - protein, 10 aa, Tick-borne encephalitis virus
TVREMVTIYF

SEQ ID NO: 196904 - protein, 10 aa, Tick-borne encephalitis virus
VREMVTIYFL

SEQ ID NO: 196905 - protein, 10 aa, Tick-borne encephalitis virus
REMVTIYFLL

SEQ ID NO: 196906 - protein, 10 aa, Tick-borne encephalitis virus
EMVTIYFLLL

SEQ ID NO: 196907 - protein, 10 aa, Tick-borne encephalitis virus
MVTIYFLLLV

SEQ ID NO: 196908 - protein, 10 aa, Tick-borne encephalitis virus
VTIYFLLLVL

SEQ ID NO: 196909 - protein, 10 aa, Tick-borne encephalitis virus
TIYFLLLVLE

SEQ ID NO: 196910 - protein, 10 aa, Tick-borne encephalitis virus
IYFLLLVLEL

SEQ ID NO: 196911 - protein, 10 aa, Tick-borne encephalitis virus
YFLLLVLELG

SEQ ID NO: 196912 - protein, 10 aa, Tick-borne encephalitis virus
FLLLVLELGL

SEQ ID NO: 196913 - protein, 10 aa, Tick-borne encephalitis virus
LLLVLELGLP

SEQ ID NO: 196914 - protein, 10 aa, Tick-borne encephalitis virus
LLVLELGLPS

SEQ ID NO: 196915 - protein, 10 aa, Tick-borne encephalitis virus
LWKWGDALAM

SEQ ID NO: 196916 - protein, 10 aa, Tick-borne encephalitis virus
WKWGDALAMG

SEQ ID NO: 196917 - protein, 10 aa, Tick-borne encephalitis virus
KWGDALAMGA

SEQ ID NO: 196918 - protein, 10 aa, Tick-borne encephalitis virus
WGDALAMGAL

SEQ ID NO: 196919 - protein, 10 aa, Tick-borne encephalitis virus
GDALAMGALI

SEQ ID NO: 196920 - protein, 10 aa, Tick-borne encephalitis virus
DALAMGALIF

SEQ ID NO: 196921 - protein, 10 aa, Tick-borne encephalitis virus
ALAMGALIFR

SEQ ID NO: 196922 - protein, 10 aa, Tick-borne encephalitis virus
LAMGALIFRA

SEQ ID NO: 196923 - protein, 10 aa, Tick-borne encephalitis virus
AMGALIFRAC

SEQ ID NO: 196924 - protein, 10 aa, Tick-borne encephalitis virus
MGALIFRACT

SEQ ID NO: 196925 - protein, 10 aa, Tick-borne encephalitis virus
GALIFRACTA

SEQ ID NO: 196926 - protein, 10 aa, Tick-borne encephalitis virus
ALIFRACTAE

SEQ ID NO: 196927 - protein, 10 aa, Tick-borne encephalitis virus
LIFRACTAEG

SEQ ID NO: 196928 - protein, 10 aa, Tick-borne encephalitis virus
IFRACTAEGK

SEQ ID NO: 196929 - protein, 10 aa, Tick-borne encephalitis virus
FRACTAEEKT

SEQ ID NO: 196930 - protein, 10 aa, Tick-borne encephalitis virus
RACTAEEKTG

SEQ ID NO: 196931 - protein, 10 aa, Tick-borne encephalitis virus
ACTAEEKTGV

SEQ ID NO: 196932 - protein, 10 aa, Tick-borne encephalitis virus
CTAEEKTGVG

SEQ ID NO: 196933 - protein, 10 aa, Tick-borne encephalitis virus
TAEEKTGVGL

SEQ ID NO: 196934 - protein, 10 aa, Tick-borne encephalitis virus
AEEKTGVGLL

SEQ ID NO: 196935 - protein, 10 aa, Tick-borne encephalitis virus
EEKTGVGLLL

SEQ ID NO: 196936 - protein, 10 aa, Tick-borne encephalitis virus
EKTGVGLLLM

SEQ ID NO: 196937 - protein, 10 aa, Tick-borne encephalitis virus
KTGVGLLLMA

SEQ ID NO: 196938 - protein, 10 aa, Tick-borne encephalitis virus
TGVGLLLMAL

SEQ ID NO: 196939 - protein, 10 aa, Tick-borne encephalitis virus
GVGLLLMALM

SEQ ID NO: 196940 - protein, 10 aa, Tick-borne encephalitis virus
VGLLLMALMT

SEQ ID NO: 196941 - protein, 10 aa, Tick-borne encephalitis virus
GLLLMALMTQ

SEQ ID NO: 196942 - protein, 10 aa, Tick-borne encephalitis virus
LLLMALMTQQ

SEQ ID NO: 196943 - protein, 10 aa, Tick-borne encephalitis virus
LLMALMTQQD

SEQ ID NO: 196944 - protein, 10 aa, Tick-borne encephalitis virus
WKLIRGHREQ

SEQ ID NO: 196945 - protein, 10 aa, Tick-borne encephalitis virus
KLIRGHREQK

SEQ ID NO: 196946 - protein, 10 aa, Tick-borne encephalitis virus
LIRGHREQKG

SEQ ID NO: 196947 - protein, 10 aa, Tick-borne encephalitis virus
IRGHREQKGL

SEQ ID NO: 196948 - protein, 10 aa, Tick-borne encephalitis virus
RGHREQKGLT

SEQ ID NO: 196949 - protein, 10 aa, Tick-borne encephalitis virus
GHREQKGLTW

SEQ ID NO: 196950 - protein, 10 aa, Tick-borne encephalitis virus
HREQKGLTWI

SEQ ID NO: 196951 - protein, 10 aa, Tick-borne encephalitis virus
REQKGLTWIV

SEQ ID NO: 196952 - protein, 10 aa, Tick-borne encephalitis virus
EQKGLTWIVP

SEQ ID NO: 196953 - protein, 10 aa, Tick-borne encephalitis virus
QKGLTWIVPL

SEQ ID NO: 196954 - protein, 10 aa, Tick-borne encephalitis virus
KGLTWIVPLA

SEQ ID NO: 196955 - protein, 10 aa, Tick-borne encephalitis virus
VPLAGLLGGE

SEQ ID NO: 196956 - protein, 10 aa, Tick-borne encephalitis virus
PLAGLLGGEG

SEQ ID NO: 196957 - protein, 10 aa, Tick-borne encephalitis virus
LAGLLGGEGS

SEQ ID NO: 196958 - protein, 10 aa, Tick-borne encephalitis virus
AGLLGGEGSG

SEQ ID NO: 196959 - protein, 10 aa, Tick-borne encephalitis virus
GLLGGEGSGV

SEQ ID NO: 196960 - protein, 10 aa, Tick-borne encephalitis virus
LLGGEGSGVR

SEQ ID NO: 196961 - protein, 10 aa, Tick-borne encephalitis virus
LGGEGSGVRL

SEQ ID NO: 196962 - protein, 10 aa, Tick-borne encephalitis virus
GGEGSGVRLL

SEQ ID NO: 196963 - protein, 10 aa, Tick-borne encephalitis virus
GEGSGVRLLA

SEQ ID NO: 196964 - protein, 10 aa, Tick-borne encephalitis virus
EGSGVRLLAF

SEQ ID NO: 196965 - protein, 10 aa, Tick-borne encephalitis virus
GSGVRLLAFW

SEQ ID NO: 196966 - protein, 10 aa, Tick-borne encephalitis virus
SGVRLLAFWE

SEQ ID NO: 196967 - protein, 10 aa, Tick-borne encephalitis virus
GVRLLAFWEL

SEQ ID NO: 196968 - protein, 10 aa, Tick-borne encephalitis virus
VRLLAFWELA

SEQ ID NO: 196969 - protein, 10 aa, Tick-borne encephalitis virus
HRGRRSFSEP

SEQ ID NO: 196970 - protein, 10 aa, Tick-borne encephalitis virus
GRRRSFSEPL

SEQ ID NO: 196971 - protein, 10 aa, Tick-borne encephalitis virus
RRRSFSEPLT

SEQ ID NO: 196972 - protein, 10 aa, Tick-borne encephalitis virus
RRSFSEPLTV

SEQ ID NO: 196973 - protein, 10 aa, Tick-borne encephalitis virus
RSFSEPLTVV

SEQ ID NO: 196974 - protein, 10 aa, Tick-borne encephalitis virus
SFSEPLTVVG

SEQ ID NO: 196975 - protein, 10 aa, Tick-borne encephalitis virus
FSEPLTVVGV

SEQ ID NO: 196976 - protein, 10 aa, Tick-borne encephalitis virus
SEPLTVVGVM

SEQ ID NO: 196977 - protein, 10 aa, Tick-borne encephalitis virus
EPLTVVGVML

SEQ ID NO: 196978 - protein, 10 aa, Tick-borne encephalitis virus
PLTVVGVMLT

SEQ ID NO: 196979 - protein, 10 aa, Tick-borne encephalitis virus
LTVVGVMLTL

SEQ ID NO: 196980 - protein, 10 aa, Tick-borne encephalitis virus
TVVGVMLTLA

SEQ ID NO: 196981 - protein, 10 aa, Tick-borne encephalitis virus
VVGVMLTLAS

SEQ ID NO: 196982 - protein, 10 aa, Tick-borne encephalitis virus
VGVMLTLASG

SEQ ID NO: 196983 - protein, 10 aa, Tick-borne encephalitis virus
GVMLTLASGM

SEQ ID NO: 196984 - protein, 10 aa, Tick-borne encephalitis virus
VMLTLASGMM

SEQ ID NO: 196985 - protein, 10 aa, Tick-borne encephalitis virus
MLTLASGMMR

SEQ ID NO: 196986 - protein, 10 aa, Tick-borne encephalitis virus
LTLASGMMRH

SEQ ID NO: 196987 - protein, 10 aa, Tick-borne encephalitis virus
TLASGMMRHT

SEQ ID NO: 196988 - protein, 10 aa, Tick-borne encephalitis virus
LASGMMRHTS

SEQ ID NO: 196989 - protein, 10 aa, Tick-borne encephalitis virus
ASGMMRHTSQ

SEQ ID NO: 196990 - protein, 10 aa, Tick-borne encephalitis virus
SGMMRHTSQE

SEQ ID NO: 196991 - protein, 10 aa, Tick-borne encephalitis virus
GMMRHTSQEA

SEQ ID NO: 196992 - protein, 10 aa, Tick-borne encephalitis virus
MMRHTSQEAL

SEQ ID NO: 196993 - protein, 10 aa, Tick-borne encephalitis virus
MRHTSQEALC

SEQ ID NO: 196994 - protein, 10 aa, Tick-borne encephalitis virus
RHTSQEALCA

SEQ ID NO: 196995 - protein, 10 aa, Tick-borne encephalitis virus
HTSQEALCAL

SEQ ID NO: 196996 - protein, 10 aa, Tick-borne encephalitis virus
TSQEALCALA

SEQ ID NO: 196997 - protein, 10 aa, Tick-borne encephalitis virus
SQEALCALAV

SEQ ID NO: 196998 - protein, 10 aa, Tick-borne encephalitis virus
QEALCALAVA

SEQ ID NO: 196999 - protein, 10 aa, Tick-borne encephalitis virus
EALCALAVAS

SEQ ID NO: 197000 - protein, 10 aa, Tick-borne encephalitis virus
ALCALAVASF

SEQ ID NO: 197001 - protein, 10 aa, Tick-borne encephalitis virus
LCALAVASFL

SEQ ID NO: 197002 - protein, 10 aa, Tick-borne encephalitis virus
CALAVASFLL

SEQ ID NO: 197003 - protein, 10 aa, Tick-borne encephalitis virus
ALAVASFLLL

SEQ ID NO: 197004 - protein, 10 aa, Tick-borne encephalitis virus
LAVASFLLLM

SEQ ID NO: 197005 - protein, 10 aa, Tick-borne encephalitis virus
AVASFLLLML

SEQ ID NO: 197006 - protein, 10 aa, Tick-borne encephalitis virus
VASFLLLMLV

SEQ ID NO: 197007 - protein, 10 aa, Tick-borne encephalitis virus
ASFLLLMLVL

SEQ ID NO: 197008 - protein, 10 aa, Tick-borne encephalitis virus
SFLLLMLVLG

SEQ ID NO: 197009 - protein, 10 aa, Tick-borne encephalitis virus
FLLLMLVLGT

SEQ ID NO: 197010 - protein, 10 aa, Tick-borne encephalitis virus
LLLMLVLGTR

SEQ ID NO: 197011 - protein, 10 aa, Tick-borne encephalitis virus
LLMLVLGTRK

SEQ ID NO: 197012 - protein, 10 aa, Tick-borne encephalitis virus
LMLVLGTRKM

SEQ ID NO: 197013 - protein, 10 aa, Tick-borne encephalitis virus
MLVLGTRKMQ

SEQ ID NO: 197014 - protein, 10 aa, Tick-borne encephalitis virus
LVLGTRKMQL

SEQ ID NO: 197015 - protein, 10 aa, Tick-borne encephalitis virus
VLGTRKMQLV

SEQ ID NO: 197016 - protein, 10 aa, Tick-borne encephalitis virus
LGTRKMQLVA

SEQ ID NO: 197017 - protein, 10 aa, Tick-borne encephalitis virus
GTRKMQLVAE

SEQ ID NO: 197018 - protein, 10 aa, Tick-borne encephalitis virus
TRKMQLVAEW

SEQ ID NO: 197019 - protein, 10 aa, Tick-borne encephalitis virus
RKMQLVAEWS

SEQ ID NO: 197020 - protein, 10 aa, Tick-borne encephalitis virus
KMQLVAEWSG

SEQ ID NO: 197021 - protein, 10 aa, Tick-borne encephalitis virus
MQLVAEWSGC

SEQ ID NO: 197022 - protein, 10 aa, Tick-borne encephalitis virus
QLVAEWSGCV

SEQ ID NO: 197023 - protein, 10 aa, Tick-borne encephalitis virus
LVAEWSGCVE

SEQ ID NO: 197024 - protein, 10 aa, Tick-borne encephalitis virus
VAEWSGCVEW

SEQ ID NO: 197025 - protein, 10 aa, Tick-borne encephalitis virus
AEWSGCVEWH

SEQ ID NO: 197026 - protein, 10 aa, Tick-borne encephalitis virus
EWSGCVEWHP

SEQ ID NO: 197027 - protein, 10 aa, Tick-borne encephalitis virus
WSGCVEWHPE

SEQ ID NO: 197028 - protein, 10 aa, Tick-borne encephalitis virus
SGCVEWHPEL

SEQ ID NO: 197029 - protein, 10 aa, Tick-borne encephalitis virus
GCVEWHPELM

SEQ ID NO: 197030 - protein, 10 aa, Tick-borne encephalitis virus
CVEWHPELMN

SEQ ID NO: 197031 - protein, 10 aa, Tick-borne encephalitis virus
VEWHPELMNE

SEQ ID NO: 197032 - protein, 10 aa, Tick-borne encephalitis virus
EWHPELMNEG

SEQ ID NO: 197033 - protein, 10 aa, Tick-borne encephalitis virus
WHPELMNEGG

SEQ ID NO: 197034 - protein, 10 aa, Tick-borne encephalitis virus
HPELMNEGGE

SEQ ID NO: 197035 - protein, 10 aa, Tick-borne encephalitis virus
PELMNEGGEV

SEQ ID NO: 197036 - protein, 10 aa, Tick-borne encephalitis virus
ELMNEGGEVS

SEQ ID NO: 197037 - protein, 10 aa, Tick-borne encephalitis virus
LMNEGGEVSL

SEQ ID NO: 197038 - protein, 10 aa, Tick-borne encephalitis virus
MNEGGEVSLR

SEQ ID NO: 197039 - protein, 10 aa, Tick-borne encephalitis virus
NEGGEVSLRV

SEQ ID NO: 197040 - protein, 10 aa, Tick-borne encephalitis virus
EGGEVSLRVR

SEQ ID NO: 197041 - protein, 10 aa, Tick-borne encephalitis virus
GGEVSLRVRQ

SEQ ID NO: 197042 - protein, 10 aa, Tick-borne encephalitis virus
GEVSLRVRQD

SEQ ID NO: 197043 - protein, 10 aa, Tick-borne encephalitis virus
EVSLRVRQDS

SEQ ID NO: 197044 - protein, 10 aa, Tick-borne encephalitis virus
VSLRVRQDSM

SEQ ID NO: 197045 - protein, 10 aa, Tick-borne encephalitis virus
SLRVRQDSMG

SEQ ID NO: 197046 - protein, 10 aa, Tick-borne encephalitis virus
LRVRQDSMGN

SEQ ID NO: 197047 - protein, 10 aa, Tick-borne encephalitis virus
RVRQDSMGNF

SEQ ID NO: 197048 - protein, 10 aa, Tick-borne encephalitis virus
VRQDSMGNFH

SEQ ID NO: 197049 - protein, 10 aa, Tick-borne encephalitis virus
RQDSMGNFHL

SEQ ID NO: 197050 - protein, 10 aa, Tick-borne encephalitis virus
QDSMGNFHLT

SEQ ID NO: 197051 - protein, 10 aa, Tick-borne encephalitis virus
DSMGNFHLTE

SEQ ID NO: 197052 - protein, 10 aa, Tick-borne encephalitis virus
SMGNFHLTEL

SEQ ID NO: 197053 - protein, 10 aa, Tick-borne encephalitis virus
MGNFHLTELE

SEQ ID NO: 197054 - protein, 10 aa, Tick-borne encephalitis virus
GNFHLTELEK

SEQ ID NO: 197055 - protein, 10 aa, Tick-borne encephalitis virus
NFHLTELEKE

SEQ ID NO: 197056 - protein, 10 aa, Tick-borne encephalitis virus
FHLTELEKEE

SEQ ID NO: 197057 - protein, 10 aa, Tick-borne encephalitis virus
HLTELEKEER

SEQ ID NO: 197058 - protein, 10 aa, Tick-borne encephalitis virus
LTELEKEERV

SEQ ID NO: 197059 - protein, 10 aa, Tick-borne encephalitis virus
TELEKEERVM

SEQ ID NO: 197060 - protein, 10 aa, Tick-borne encephalitis virus
ELEKEERVMA

SEQ ID NO: 197061 - protein, 10 aa, Tick-borne encephalitis virus
LEKEERVMAF

SEQ ID NO: 197062 - protein, 10 aa, Tick-borne encephalitis virus
EKEERVMAFW

SEQ ID NO: 197063 - protein, 10 aa, Tick-borne encephalitis virus
KEERVMAFWL

SEQ ID NO: 197064 - protein, 10 aa, Tick-borne encephalitis virus
EERVMAFWLL

SEQ ID NO: 197065 - protein, 10 aa, Tick-borne encephalitis virus
ERVMAFWLLA

SEQ ID NO: 197066 - protein, 10 aa, Tick-borne encephalitis virus
RVMAFWLLAG

SEQ ID NO: 197067 - protein, 10 aa, Tick-borne encephalitis virus
VMAFWLLAGL

SEQ ID NO: 197068 - protein, 10 aa, Tick-borne encephalitis virus
MAFWLLAGLA

SEQ ID NO: 197069 - protein, 10 aa, Tick-borne encephalitis virus
AFWLLAGLAA

SEQ ID NO: 197070 - protein, 10 aa, Tick-borne encephalitis virus
FWLLAGLAAS

SEQ ID NO: 197071 - protein, 10 aa, Tick-borne encephalitis virus
WLLAGLAASA

SEQ ID NO: 197072 - protein, 10 aa, Tick-borne encephalitis virus
AGLAASAFHW

SEQ ID NO: 197073 - protein, 10 aa, Tick-borne encephalitis virus
GLAASAFHWS

SEQ ID NO: 197074 - protein, 10 aa, Tick-borne encephalitis virus
LAASAFHWSG

SEQ ID NO: 197075 - protein, 10 aa, Tick-borne encephalitis virus
AASAFHWSGI

SEQ ID NO: 197076 - protein, 10 aa, Tick-borne encephalitis virus
ASAFHWSGIL

SEQ ID NO: 197077 - protein, 10 aa, Tick-borne encephalitis virus
SAFHWSGILG

SEQ ID NO: 197078 - protein, 10 aa, Tick-borne encephalitis virus
AFHWSGILGV

SEQ ID NO: 197079 - protein, 10 aa, Tick-borne encephalitis virus
FHWSGILGVM

SEQ ID NO: 197080 - protein, 10 aa, Tick-borne encephalitis virus
HWSGILGVMG

SEQ ID NO: 197081 - protein, 10 aa, Tick-borne encephalitis virus
WSGILGVMGL

SEQ ID NO: 197082 - protein, 10 aa, Tick-borne encephalitis virus
SGILGVMGLW

SEQ ID NO: 197083 - protein, 10 aa, Tick-borne encephalitis virus
GILGVMGLWT

SEQ ID NO: 197084 - protein, 10 aa, Tick-borne encephalitis virus
ILGVMGLWTL

SEQ ID NO: 197085 - protein, 10 aa, Tick-borne encephalitis virus
LGVMGLWTLS

SEQ ID NO: 197086 - protein, 10 aa, Tick-borne encephalitis virus
GVMGLWTLSE

SEQ ID NO: 197087 - protein, 10 aa, Tick-borne encephalitis virus
VMGLWTLSEM

SEQ ID NO: 197088 - protein, 10 aa, Tick-borne encephalitis virus
MGLWTLSEML

SEQ ID NO: 197089 - protein, 10 aa, Tick-borne encephalitis virus
GLWTLSEMLR

SEQ ID NO: 197090 - protein, 10 aa, Tick-borne encephalitis virus
ARRSDLVFSG

SEQ ID NO: 197091 - protein, 10 aa, Tick-borne encephalitis virus
RRSDLVFSGQ

SEQ ID NO: 197092 - protein, 10 aa, Tick-borne encephalitis virus
RSDLVFSGQG

SEQ ID NO: 197093 - protein, 10 aa, Tick-borne encephalitis virus
SDLVFSGQGG

SEQ ID NO: 197094 - protein, 10 aa, Tick-borne encephalitis virus
DLVFSGQGGR

SEQ ID NO: 197095 - protein, 10 aa, Tick-borne encephalitis virus
LVFSGQGGRE

SEQ ID NO: 197096 - protein, 10 aa, Tick-borne encephalitis virus
VFSGQGGRER

SEQ ID NO: 197097 - protein, 10 aa, Tick-borne encephalitis virus
FSGQGGRERG

SEQ ID NO: 197098 - protein, 10 aa, Tick-borne encephalitis virus
SGQGGRERGD

SEQ ID NO: 197099 - protein, 10 aa, Tick-borne encephalitis virus
GQGGRERGDR

SEQ ID NO: 197100 - protein, 10 aa, Tick-borne encephalitis virus
QGGRERGDRP

SEQ ID NO: 197101 - protein, 10 aa, Tick-borne encephalitis virus
GGRERGDRPF

SEQ ID NO: 197102 - protein, 10 aa, Tick-borne encephalitis virus
GRERGDRPFE

SEQ ID NO: 197103 - protein, 10 aa, Tick-borne encephalitis virus
RERGDRPFEV

SEQ ID NO: 197104 - protein, 10 aa, Tick-borne encephalitis virus
ERGDRPFEVK

SEQ ID NO: 197105 - protein, 10 aa, Tick-borne encephalitis virus
RGDRPFEVKD

SEQ ID NO: 197106 - protein, 10 aa, Tick-borne encephalitis virus
GDRPFEVKDG

SEQ ID NO: 197107 - protein, 10 aa, Tick-borne encephalitis virus
DRPFEVKDGV

SEQ ID NO: 197108 - protein, 10 aa, Tick-borne encephalitis virus
RPFEVKDGVY

SEQ ID NO: 197109 - protein, 10 aa, Tick-borne encephalitis virus
PFEVKDGVYR

SEQ ID NO: 197110 - protein, 10 aa, Tick-borne encephalitis virus
FEVKDGVYRI

SEQ ID NO: 197111 - protein, 10 aa, Tick-borne encephalitis virus
EVKDGVYRIF

SEQ ID NO: 197112 - protein, 10 aa, Tick-borne encephalitis virus
VKDGVYRIFS

SEQ ID NO: 197113 - protein, 10 aa, Tick-borne encephalitis virus
KDGVYRIFSP

SEQ ID NO: 197114 - protein, 10 aa, Tick-borne encephalitis virus
DGVYRIFSPG

SEQ ID NO: 197115 - protein, 10 aa, Tick-borne encephalitis virus
GVYRIFSPGL

SEQ ID NO: 197116 - protein, 10 aa, Tick-borne encephalitis virus
VYRIFSPGLL

SEQ ID NO: 197117 - protein, 10 aa, Tick-borne encephalitis virus
YRIFSPGLLW

SEQ ID NO: 197118 - protein, 10 aa, Tick-borne encephalitis virus
RIFSPGLLWG

SEQ ID NO: 197119 - protein, 10 aa, Tick-borne encephalitis virus
IFSPGLLWGQ

SEQ ID NO: 197120 - protein, 10 aa, Tick-borne encephalitis virus
FSPGLLWGQR

SEQ ID NO: 197121 - protein, 10 aa, Tick-borne encephalitis virus
SPGLLWGQRQ

SEQ ID NO: 197122 - protein, 10 aa, Tick-borne encephalitis virus
PGLLWGQRQV

SEQ ID NO: 197123 - protein, 10 aa, Tick-borne encephalitis virus
GLLWGQRQVG

SEQ ID NO: 197124 - protein, 10 aa, Tick-borne encephalitis virus
LLWGQRQVGV

SEQ ID NO: 197125 - protein, 10 aa, Tick-borne encephalitis virus
LWGQRQVGVG

SEQ ID NO: 197126 - protein, 10 aa, Tick-borne encephalitis virus
WGQRQVGVGY

SEQ ID NO: 197127 - protein, 10 aa, Tick-borne encephalitis virus
GQRQVGVGYG

SEQ ID NO: 197128 - protein, 10 aa, Tick-borne encephalitis virus
QRQVGVGYGF

SEQ ID NO: 197129 - protein, 10 aa, Tick-borne encephalitis virus
RQVGVGYGFK

SEQ ID NO: 197130 - protein, 10 aa, Tick-borne encephalitis virus
QVGVGYGSKG

SEQ ID NO: 197131 - protein, 10 aa, Tick-borne encephalitis virus
VGVGYGSKGV

SEQ ID NO: 197132 - protein, 10 aa, Tick-borne encephalitis virus
GVGYGSKGVL

SEQ ID NO: 197133 - protein, 10 aa, Tick-borne encephalitis virus
VGYGSKGVLH

SEQ ID NO: 197134 - protein, 10 aa, Tick-borne encephalitis virus
GYGSKGVLHT

SEQ ID NO: 197135 - protein, 10 aa, Tick-borne encephalitis virus
YGSKGVLHTM

SEQ ID NO: 197136 - protein, 10 aa, Tick-borne encephalitis virus
GSKGVLHTMW

SEQ ID NO: 197137 - protein, 10 aa, Tick-borne encephalitis virus
SKGVLHTMWH

SEQ ID NO: 197138 - protein, 10 aa, Tick-borne encephalitis virus
KGVLHTMWHV

SEQ ID NO: 197139 - protein, 10 aa, Tick-borne encephalitis virus
GVLHTMWHVT

SEQ ID NO: 197140 - protein, 10 aa, Tick-borne encephalitis virus
VLHTMWHVTR

SEQ ID NO: 197141 - protein, 10 aa, Tick-borne encephalitis virus
LHTMWHVTRG

SEQ ID NO: 197142 - protein, 10 aa, Tick-borne encephalitis virus
HTMWHVTRGA

SEQ ID NO: 197143 - protein, 10 aa, Tick-borne encephalitis virus
TMWHVTRGAA

SEQ ID NO: 197144 - protein, 10 aa, Tick-borne encephalitis virus
MWHVTRGAAL

SEQ ID NO: 197145 - protein, 10 aa, Tick-borne encephalitis virus
WHVTRGAALS

SEQ ID NO: 197146 - protein, 10 aa, Tick-borne encephalitis virus
HVTRGAALSI

SEQ ID NO: 197147 - protein, 10 aa, Tick-borne encephalitis virus
VTRGAALSID

SEQ ID NO: 197148 - protein, 10 aa, Tick-borne encephalitis virus
TRGAALSIDD

SEQ ID NO: 197149 - protein, 10 aa, Tick-borne encephalitis virus
RGAALSIDDA

SEQ ID NO: 197150 - protein, 10 aa, Tick-borne encephalitis virus
GAALSIDDAV

SEQ ID NO: 197151 - protein, 10 aa, Tick-borne encephalitis virus
AALSIDDAVA

SEQ ID NO: 197152 - protein, 10 aa, Tick-borne encephalitis virus
ALSIDDAVAG

SEQ ID NO: 197153 - protein, 10 aa, Tick-borne encephalitis virus
LSIDDAVAGP

SEQ ID NO: 197154 - protein, 10 aa, Tick-borne encephalitis virus
SIDDAVAGPY

SEQ ID NO: 197155 - protein, 10 aa, Tick-borne encephalitis virus
IDDAVAGPYW

SEQ ID NO: 197156 - protein, 10 aa, Tick-borne encephalitis virus
DDAVAGPYWA

SEQ ID NO: 197157 - protein, 10 aa, Tick-borne encephalitis virus
DAVAGPYWAD

SEQ ID NO: 197158 - protein, 10 aa, Tick-borne encephalitis virus
AVAGPYWADV

SEQ ID NO: 197159 - protein, 10 aa, Tick-borne encephalitis virus
VAGPYWADVK

SEQ ID NO: 197160 - protein, 10 aa, Tick-borne encephalitis virus
AGPYWADVKE

SEQ ID NO: 197161 - protein, 10 aa, Tick-borne encephalitis virus
GPYWADVKED

SEQ ID NO: 197162 - protein, 10 aa, Tick-borne encephalitis virus
PYWADVKEDV

SEQ ID NO: 197163 - protein, 10 aa, Tick-borne encephalitis virus
YWADVKEDVV

SEQ ID NO: 197164 - protein, 10 aa, Tick-borne encephalitis virus
WADVKEDVVC

SEQ ID NO: 197165 - protein, 10 aa, Tick-borne encephalitis virus
ADVKEDVVCY

SEQ ID NO: 197166 - protein, 10 aa, Tick-borne encephalitis virus
DVKEDVVCYG

SEQ ID NO: 197167 - protein, 10 aa, Tick-borne encephalitis virus
VKEDVVCYGG

SEQ ID NO: 197168 - protein, 10 aa, Tick-borne encephalitis virus
KEDVVCYGGA

SEQ ID NO: 197169 - protein, 10 aa, Tick-borne encephalitis virus
EDVVCYGGAW

SEQ ID NO: 197170 - protein, 10 aa, Tick-borne encephalitis virus
DVVCYGGAWS

SEQ ID NO: 197171 - protein, 10 aa, Tick-borne encephalitis virus
VVCYGGAWSL

SEQ ID NO: 197172 - protein, 10 aa, Tick-borne encephalitis virus
VCYGGAWSLE

SEQ ID NO: 197173 - protein, 10 aa, Tick-borne encephalitis virus
CYGGAWSLEE

SEQ ID NO: 197174 - protein, 10 aa, Tick-borne encephalitis virus
YGGAWSLEEK

SEQ ID NO: 197175 - protein, 10 aa, Tick-borne encephalitis virus
GGAWSLEEKW

SEQ ID NO: 197176 - protein, 10 aa, Tick-borne encephalitis virus
GAWSLEEKWK

SEQ ID NO: 197177 - protein, 10 aa, Tick-borne encephalitis virus
AWSLEEKWKG

SEQ ID NO: 197178 - protein, 10 aa, Tick-borne encephalitis virus
WSLEEKWKGE

SEQ ID NO: 197179 - protein, 10 aa, Tick-borne encephalitis virus
SLEEKWKGET

SEQ ID NO: 197180 - protein, 10 aa, Tick-borne encephalitis virus
LEEKWKGETV

SEQ ID NO: 197181 - protein, 10 aa, Tick-borne encephalitis virus
EEKWKGETVQ

SEQ ID NO: 197182 - protein, 10 aa, Tick-borne encephalitis virus
EKWKGETVQV

SEQ ID NO: 197183 - protein, 10 aa, Tick-borne encephalitis virus
KWKGETVQVH

SEQ ID NO: 197184 - protein, 10 aa, Tick-borne encephalitis virus
WKGETVQVHA

SEQ ID NO: 197185 - protein, 10 aa, Tick-borne encephalitis virus
KGETVQVHAF

SEQ ID NO: 197186 - protein, 10 aa, Tick-borne encephalitis virus
GETVQVHAFP

SEQ ID NO: 197187 - protein, 10 aa, Tick-borne encephalitis virus
ETVQVHAFPP

SEQ ID NO: 197188 - protein, 10 aa, Tick-borne encephalitis virus
TVQVHAFPPG

SEQ ID NO: 197189 - protein, 10 aa, Tick-borne encephalitis virus
VQVHAFPPGR

SEQ ID NO: 197190 - protein, 10 aa, Tick-borne encephalitis virus
QVHAFPPGRA

SEQ ID NO: 197191 - protein, 10 aa, Tick-borne encephalitis virus
VHAFPPGRAH

SEQ ID NO: 197192 - protein, 10 aa, Tick-borne encephalitis virus
HAFPPGRAHE

SEQ ID NO: 197193 - protein, 10 aa, Tick-borne encephalitis virus
AFPPGRAHEV

SEQ ID NO: 197194 - protein, 10 aa, Tick-borne encephalitis virus
FPPGRAHEVH

SEQ ID NO: 197195 - protein, 10 aa, Tick-borne encephalitis virus
PPGRAHEVHQ

SEQ ID NO: 197196 - protein, 10 aa, Tick-borne encephalitis virus
PGRAHEVHQC

SEQ ID NO: 197197 - protein, 10 aa, Tick-borne encephalitis virus
GRAHEVHQCQ

SEQ ID NO: 197198 - protein, 10 aa, Tick-borne encephalitis virus
RAHEVHQCQP

SEQ ID NO: 197199 - protein, 10 aa, Tick-borne encephalitis virus
AHEVHQCQPG

SEQ ID NO: 197200 - protein, 10 aa, Tick-borne encephalitis virus
HEVHQCQPGE

SEQ ID NO: 197201 - protein, 10 aa, Tick-borne encephalitis virus
EVHQCQPGEL

SEQ ID NO: 197202 - protein, 10 aa, Tick-borne encephalitis virus
VHQCQPGELL

SEQ ID NO: 197203 - protein, 10 aa, Tick-borne encephalitis virus
HQCQPGELLL

SEQ ID NO: 197204 - protein, 10 aa, Tick-borne encephalitis virus
QCQPGELLLD

SEQ ID NO: 197205 - protein, 10 aa, Tick-borne encephalitis virus
CQPGELLLDT

SEQ ID NO: 197206 - protein, 10 aa, Tick-borne encephalitis virus
QPGELLLDTG

SEQ ID NO: 197207 - protein, 10 aa, Tick-borne encephalitis virus
PGELLLDTGR

SEQ ID NO: 197208 - protein, 10 aa, Tick-borne encephalitis virus
GELLLDTGRR

SEQ ID NO: 197209 - protein, 10 aa, Tick-borne encephalitis virus
GAVPIDLAKG

SEQ ID NO: 197210 - protein, 10 aa, Tick-borne encephalitis virus
AVPIDLAKGT

SEQ ID NO: 197211 - protein, 10 aa, Tick-borne encephalitis virus
VPIDLAKGTS

SEQ ID NO: 197212 - protein, 10 aa, Tick-borne encephalitis virus
PIDLAKGTSG

SEQ ID NO: 197213 - protein, 10 aa, Tick-borne encephalitis virus
IDLAKGTSGS

SEQ ID NO: 197214 - protein, 10 aa, Tick-borne encephalitis virus
DLAKGTSGSP

SEQ ID NO: 197215 - protein, 10 aa, Tick-borne encephalitis virus
LAKGTSGSPI

SEQ ID NO: 197216 - protein, 10 aa, Tick-borne encephalitis virus
AKGTSGSPIL

SEQ ID NO: 197217 - protein, 10 aa, Tick-borne encephalitis virus
KGTSGSPILN

SEQ ID NO: 197218 - protein, 10 aa, Tick-borne encephalitis virus
GTSGSPILNS

SEQ ID NO: 197219 - protein, 10 aa, Tick-borne encephalitis virus
TSGSPILNSQ

SEQ ID NO: 197220 - protein, 10 aa, Tick-borne encephalitis virus
SGSPILNSQG

SEQ ID NO: 197221 - protein, 10 aa, Tick-borne encephalitis virus
SPILNSQGVV

SEQ ID NO: 197222 - protein, 10 aa, Tick-borne encephalitis virus
PILNSQGVVV

SEQ ID NO: 197223 - protein, 10 aa, Tick-borne encephalitis virus
ILNSQGVVVG

SEQ ID NO: 197224 - protein, 10 aa, Tick-borne encephalitis virus
LNSQGVVVGL

SEQ ID NO: 197225 - protein, 10 aa, Tick-borne encephalitis virus
NSQGVVVGLY

SEQ ID NO: 197226 - protein, 10 aa, Tick-borne encephalitis virus
SQGVVVGLYG

SEQ ID NO: 197227 - protein, 10 aa, Tick-borne encephalitis virus
QGVVVGLYGN

SEQ ID NO: 197228 - protein, 10 aa, Tick-borne encephalitis virus
GVVVGLYGNG

SEQ ID NO: 197229 - protein, 10 aa, Tick-borne encephalitis virus
VVVGLYGNGL

SEQ ID NO: 197230 - protein, 10 aa, Tick-borne encephalitis virus
VVGLYGNGLK

SEQ ID NO: 197231 - protein, 10 aa, Tick-borne encephalitis virus
VGLYGNGLKT

SEQ ID NO: 197232 - protein, 10 aa, Tick-borne encephalitis virus
GLYGNGLKTN

SEQ ID NO: 197233 - protein, 10 aa, Tick-borne encephalitis virus
LYGNGLKTNE

SEQ ID NO: 197234 - protein, 10 aa, Tick-borne encephalitis virus
YGNGLKTNET

SEQ ID NO: 197235 - protein, 10 aa, Tick-borne encephalitis virus
GNGLKTNETY

SEQ ID NO: 197236 - protein, 10 aa, Tick-borne encephalitis virus
NGLKTNETYV

SEQ ID NO: 197237 - protein, 10 aa, Tick-borne encephalitis virus
GLKTNETYVS

SEQ ID NO: 197238 - protein, 10 aa, Tick-borne encephalitis virus
LKTNETYVSS

SEQ ID NO: 197239 - protein, 10 aa, Tick-borne encephalitis virus
KTNETYVSSI

SEQ ID NO: 197240 - protein, 10 aa, Tick-borne encephalitis virus
TNETYVSSIA

SEQ ID NO: 197241 - protein, 10 aa, Tick-borne encephalitis virus
NETYVSSIAQ

SEQ ID NO: 197242 - protein, 10 aa, Tick-borne encephalitis virus
ETYVSSIAQG

SEQ ID NO: 197243 - protein, 10 aa, Tick-borne encephalitis virus
TYVSSIAQGE

SEQ ID NO: 197244 - protein, 10 aa, Tick-borne encephalitis virus
YVSSIAQGEA

SEQ ID NO: 197245 - protein, 10 aa, Tick-borne encephalitis virus
VSSIAQGEAE

SEQ ID NO: 197246 - protein, 10 aa, Tick-borne encephalitis virus
SSIAQGEAEK

SEQ ID NO: 197247 - protein, 10 aa, Tick-borne encephalitis virus
SIAQGEAEKS

SEQ ID NO: 197248 - protein, 10 aa, Tick-borne encephalitis virus
IAQGEAEKSR

SEQ ID NO: 197249 - protein, 10 aa, Tick-borne encephalitis virus
AQGEAEKSRP

SEQ ID NO: 197250 - protein, 10 aa, Tick-borne encephalitis virus
QGEAEKSRPN

SEQ ID NO: 197251 - protein, 10 aa, Tick-borne encephalitis virus
GEAEKSRPNL

SEQ ID NO: 197252 - protein, 10 aa, Tick-borne encephalitis virus
EAEKSRPNLP

SEQ ID NO: 197253 - protein, 10 aa, Tick-borne encephalitis virus
AEKSRPNLPP

SEQ ID NO: 197254 - protein, 10 aa, Tick-borne encephalitis virus
EKSRPNLPPA

SEQ ID NO: 197255 - protein, 10 aa, Tick-borne encephalitis virus
KSRPNLPPAV

SEQ ID NO: 197256 - protein, 10 aa, Tick-borne encephalitis virus
GTGWTAKGQI

SEQ ID NO: 197257 - protein, 10 aa, Tick-borne encephalitis virus
TGWTAKGQIT

SEQ ID NO: 197258 - protein, 10 aa, Tick-borne encephalitis virus
GWTAKGQITV

SEQ ID NO: 197259 - protein, 10 aa, Tick-borne encephalitis virus
WTAKGQITVL

SEQ ID NO: 197260 - protein, 10 aa, Tick-borne encephalitis virus
TAKGQITVLD

SEQ ID NO: 197261 - protein, 10 aa, Tick-borne encephalitis virus
AKGQITVLDM

SEQ ID NO: 197262 - protein, 10 aa, Tick-borne encephalitis virus
KGQITVLDMH

SEQ ID NO: 197263 - protein, 10 aa, Tick-borne encephalitis virus
GQITVLDMHP

SEQ ID NO: 197264 - protein, 10 aa, Tick-borne encephalitis virus
QITVLDMHPG

SEQ ID NO: 197265 - protein, 10 aa, Tick-borne encephalitis virus
ITVLDMHPGS

SEQ ID NO: 197266 - protein, 10 aa, Tick-borne encephalitis virus
TVLDMHPGSG

SEQ ID NO: 197267 - protein, 10 aa, Tick-borne encephalitis virus
VLDMHPGSGK

SEQ ID NO: 197268 - protein, 10 aa, Tick-borne encephalitis virus
LDMHPGSGKT

SEQ ID NO: 197269 - protein, 10 aa, Tick-borne encephalitis virus
DMHPGSGKTH

SEQ ID NO: 197270 - protein, 10 aa, Tick-borne encephalitis virus
MHPGSGKTHR

SEQ ID NO: 197271 - protein, 10 aa, Tick-borne encephalitis virus
HPGSGKTHRV

SEQ ID NO: 197272 - protein, 10 aa, Tick-borne encephalitis virus
PGSGKTHRVL

SEQ ID NO: 197273 - protein, 10 aa, Tick-borne encephalitis virus
GSGKTHRVLP

SEQ ID NO: 197274 - protein, 10 aa, Tick-borne encephalitis virus
SGKTHRVLPE

SEQ ID NO: 197275 - protein, 10 aa, Tick-borne encephalitis virus
GKTHRVLPEL

SEQ ID NO: 197276 - protein, 10 aa, Tick-borne encephalitis virus
KTHRVLPELI

SEQ ID NO: 197277 - protein, 10 aa, Tick-borne encephalitis virus
THRVLPELIR

SEQ ID NO: 197278 - protein, 10 aa, Tick-borne encephalitis virus
HRVLPELIRQ

SEQ ID NO: 197279 - protein, 10 aa, Tick-borne encephalitis virus
RVLPELIRQC

SEQ ID NO: 197280 - protein, 10 aa, Tick-borne encephalitis virus
VLPELIRQCI

SEQ ID NO: 197281 - protein, 10 aa, Tick-borne encephalitis virus
LPELIRQCID

SEQ ID NO: 197282 - protein, 10 aa, Tick-borne encephalitis virus
PELIRQCIDR

SEQ ID NO: 197283 - protein, 10 aa, Tick-borne encephalitis virus
ELIRQCIDRR

SEQ ID NO: 197284 - protein, 10 aa, Tick-borne encephalitis virus
LIRQCIDRRL

SEQ ID NO: 197285 - protein, 10 aa, Tick-borne encephalitis virus
IRQCIDRRLR

SEQ ID NO: 197286 - protein, 10 aa, Tick-borne encephalitis virus
RQCIDRRLRT

SEQ ID NO: 197287 - protein, 10 aa, Tick-borne encephalitis virus
QCIDRRLRTL

SEQ ID NO: 197288 - protein, 10 aa, Tick-borne encephalitis virus
CIDRRLRTLV

SEQ ID NO: 197289 - protein, 10 aa, Tick-borne encephalitis virus
IDRRLRTLVL

SEQ ID NO: 197290 - protein, 10 aa, Tick-borne encephalitis virus
DRRLRTLVLA

SEQ ID NO: 197291 - protein, 10 aa, Tick-borne encephalitis virus
RRLRTLVLAP

SEQ ID NO: 197292 - protein, 10 aa, Tick-borne encephalitis virus
RLRTLVLAPT

SEQ ID NO: 197293 - protein, 10 aa, Tick-borne encephalitis virus
LRTLVLAPTR

SEQ ID NO: 197294 - protein, 10 aa, Tick-borne encephalitis virus
RTLVLAPTRV

SEQ ID NO: 197295 - protein, 10 aa, Tick-borne encephalitis virus
TLVLAPTRVV

SEQ ID NO: 197296 - protein, 10 aa, Tick-borne encephalitis virus
LVLAPTRVVL

SEQ ID NO: 197297 - protein, 10 aa, Tick-borne encephalitis virus
VLAPTRVVLK

SEQ ID NO: 197298 - protein, 10 aa, Tick-borne encephalitis virus
LAPTRVVLKE

SEQ ID NO: 197299 - protein, 10 aa, Tick-borne encephalitis virus
APTRVVLKEM

SEQ ID NO: 197300 - protein, 10 aa, Tick-borne encephalitis virus
PTRVVLKEME

SEQ ID NO: 197301 - protein, 10 aa, Tick-borne encephalitis virus
TRVVLKEMER

SEQ ID NO: 197302 - protein, 10 aa, Tick-borne encephalitis virus
RVVLKEMERA

SEQ ID NO: 197303 - protein, 10 aa, Tick-borne encephalitis virus
VVLKEMERAL

SEQ ID NO: 197304 - protein, 10 aa, Tick-borne encephalitis virus
VLKEMERALN

SEQ ID NO: 197305 - protein, 10 aa, Tick-borne encephalitis virus
LKEMERALNG

SEQ ID NO: 197306 - protein, 10 aa, Tick-borne encephalitis virus
KEMERALNGK

SEQ ID NO: 197307 - protein, 10 aa, Tick-borne encephalitis virus
EMERALNGKR

SEQ ID NO: 197308 - protein, 10 aa, Tick-borne encephalitis virus
MERALNGKRV

SEQ ID NO: 197309 - protein, 10 aa, Tick-borne encephalitis virus
ERALNGKRVR

SEQ ID NO: 197310 - protein, 10 aa, Tick-borne encephalitis virus
RALNGKRVRF

SEQ ID NO: 197311 - protein, 10 aa, Tick-borne encephalitis virus
ALNGKRVRFH

SEQ ID NO: 197312 - protein, 10 aa, Tick-borne encephalitis virus
LNGKRVRFHS

SEQ ID NO: 197313 - protein, 10 aa, Tick-borne encephalitis virus
NGKRVRFHSP

SEQ ID NO: 197314 - protein, 10 aa, Tick-borne encephalitis virus
GKRVRFHSPA

SEQ ID NO: 197315 - protein, 10 aa, Tick-borne encephalitis virus
KRVRFHSPAV

SEQ ID NO: 197316 - protein, 10 aa, Tick-borne encephalitis virus
RVRFHSPAVG

SEQ ID NO: 197317 - protein, 10 aa, Tick-borne encephalitis virus
VRFHSPAVGD

SEQ ID NO: 197318 - protein, 10 aa, Tick-borne encephalitis virus
RFHSPAVGDQ

SEQ ID NO: 197319 - protein, 10 aa, Tick-borne encephalitis virus
FHSPAVGDQQ

SEQ ID NO: 197320 - protein, 10 aa, Tick-borne encephalitis virus
DQQVGGAIVD

SEQ ID NO: 197321 - protein, 10 aa, Tick-borne encephalitis virus
GGAIVDVMCH

SEQ ID NO: 197322 - protein, 10 aa, Tick-borne encephalitis virus
GAIVDVMCHA

SEQ ID NO: 197323 - protein, 10 aa, Tick-borne encephalitis virus
AIVDVMCHAT

SEQ ID NO: 197324 - protein, 10 aa, Tick-borne encephalitis virus
IVDVMCHATY

SEQ ID NO: 197325 - protein, 10 aa, Tick-borne encephalitis virus
VDVMCHATYV

SEQ ID NO: 197326 - protein, 10 aa, Tick-borne encephalitis virus
DVMCHATYVN

SEQ ID NO: 197327 - protein, 10 aa, Tick-borne encephalitis virus
VMCHATYVNR

SEQ ID NO: 197328 - protein, 10 aa, Tick-borne encephalitis virus
MCHATYVNRR

SEQ ID NO: 197329 - protein, 10 aa, Tick-borne encephalitis virus
CHATYVNRRL

SEQ ID NO: 197330 - protein, 10 aa, Tick-borne encephalitis virus
HATYVNRRLL

SEQ ID NO: 197331 - protein, 10 aa, Tick-borne encephalitis virus
ATYVNRRLLP

SEQ ID NO: 197332 - protein, 10 aa, Tick-borne encephalitis virus
TYVNRRLLPQ

SEQ ID NO: 197333 - protein, 10 aa, Tick-borne encephalitis virus
YVNRRLLPQG

SEQ ID NO: 197334 - protein, 10 aa, Tick-borne encephalitis virus
VNRRLLPQGR

SEQ ID NO: 197335 - protein, 10 aa, Tick-borne encephalitis virus
NRRLLPQGRQ

SEQ ID NO: 197336 - protein, 10 aa, Tick-borne encephalitis virus
RRLLPQGRQN

SEQ ID NO: 197337 - protein, 10 aa, Tick-borne encephalitis virus
RLLPQGRQNW

SEQ ID NO: 197338 - protein, 10 aa, Tick-borne encephalitis virus
LLPQGRQNWE

SEQ ID NO: 197339 - protein, 10 aa, Tick-borne encephalitis virus
LPQGRQNWEV

SEQ ID NO: 197340 - protein, 10 aa, Tick-borne encephalitis virus
PQGRQNWEVA

SEQ ID NO: 197341 - protein, 10 aa, Tick-borne encephalitis virus
QGRQNWEVAI

SEQ ID NO: 197342 - protein, 10 aa, Tick-borne encephalitis virus
GRQNWEVAIM

SEQ ID NO: 197343 - protein, 10 aa, Tick-borne encephalitis virus
RQNWEVAIMD

SEQ ID NO: 197344 - protein, 10 aa, Tick-borne encephalitis virus
QNWEVAIMDE

SEQ ID NO: 197345 - protein, 10 aa, Tick-borne encephalitis virus
NWEVAIMDEA

SEQ ID NO: 197346 - protein, 10 aa, Tick-borne encephalitis virus
WEVAIMDEAH

SEQ ID NO: 197347 - protein, 10 aa, Tick-borne encephalitis virus
EVAIMDEAHW

SEQ ID NO: 197348 - protein, 10 aa, Tick-borne encephalitis virus
VAIMDEAHWT

SEQ ID NO: 197349 - protein, 10 aa, Tick-borne encephalitis virus
AIMDEAHWTD

SEQ ID NO: 197350 - protein, 10 aa, Tick-borne encephalitis virus
IMDEAHWTDP

SEQ ID NO: 197351 - protein, 10 aa, Tick-borne encephalitis virus
MDEAHWTDPH

SEQ ID NO: 197352 - protein, 10 aa, Tick-borne encephalitis virus
DEAHWTDPHS

SEQ ID NO: 197353 - protein, 10 aa, Tick-borne encephalitis virus
EAHWTDPHSI

SEQ ID NO: 197354 - protein, 10 aa, Tick-borne encephalitis virus
AHWTDPHSIA

SEQ ID NO: 197355 - protein, 10 aa, Tick-borne encephalitis virus
HWTDPHSIAA

SEQ ID NO: 197356 - protein, 10 aa, Tick-borne encephalitis virus
WTDPHSIAAR

SEQ ID NO: 197357 - protein, 10 aa, Tick-borne encephalitis virus
TDPHSIAARG

SEQ ID NO: 197358 - protein, 10 aa, Tick-borne encephalitis virus
DPHSIAARGH

SEQ ID NO: 197359 - protein, 10 aa, Tick-borne encephalitis virus
PHSIAARGHL

SEQ ID NO: 197360 - protein, 10 aa, Tick-borne encephalitis virus
HSIAARGHLY

SEQ ID NO: 197361 - protein, 10 aa, Tick-borne encephalitis virus
SIAARGHLYT

SEQ ID NO: 197362 - protein, 10 aa, Tick-borne encephalitis virus
IAARGHLYTL

SEQ ID NO: 197363 - protein, 10 aa, Tick-borne encephalitis virus
AARGHLYTLA

SEQ ID NO: 197364 - protein, 10 aa, Tick-borne encephalitis virus
ARGHLYTLAK

SEQ ID NO: 197365 - protein, 10 aa, Tick-borne encephalitis virus
RGHLYTLAKE

SEQ ID NO: 197366 - protein, 10 aa, Tick-borne encephalitis virus
GHLYTLAKEN

SEQ ID NO: 197367 - protein, 10 aa, Tick-borne encephalitis virus
HLYTLAKENK

SEQ ID NO: 197368 - protein, 10 aa, Tick-borne encephalitis virus
LYTLAKENKC

SEQ ID NO: 197369 - protein, 10 aa, Tick-borne encephalitis virus
YTLAKENKCA

SEQ ID NO: 197370 - protein, 10 aa, Tick-borne encephalitis virus
TLAKENKCAL

SEQ ID NO: 197371 - protein, 10 aa, Tick-borne encephalitis virus
LAKENKCALV

SEQ ID NO: 197372 - protein, 10 aa, Tick-borne encephalitis virus
AKENKCALVL

SEQ ID NO: 197373 - protein, 10 aa, Tick-borne encephalitis virus
KENKCALVLM

SEQ ID NO: 197374 - protein, 10 aa, Tick-borne encephalitis virus
ENKCALVLMT

SEQ ID NO: 197375 - protein, 10 aa, Tick-borne encephalitis virus
NKCALVLMTA

SEQ ID NO: 197376 - protein, 10 aa, Tick-borne encephalitis virus
KCALVLMTAT

SEQ ID NO: 197377 - protein, 10 aa, Tick-borne encephalitis virus
CALVLMTATP

SEQ ID NO: 197378 - protein, 10 aa, Tick-borne encephalitis virus
ALVLMTATPP

SEQ ID NO: 197379 - protein, 10 aa, Tick-borne encephalitis virus
LVLMTATPPG

SEQ ID NO: 197380 - protein, 10 aa, Tick-borne encephalitis virus
VLMTATPPGK

SEQ ID NO: 197381 - protein, 10 aa, Tick-borne encephalitis virus
LMTATPPGKS

SEQ ID NO: 197382 - protein, 10 aa, Tick-borne encephalitis virus
MTATPPGKSE

SEQ ID NO: 197383 - protein, 10 aa, Tick-borne encephalitis virus
TATPPGKSEP

SEQ ID NO: 197384 - protein, 10 aa, Tick-borne encephalitis virus
ATPPGKSEPF

SEQ ID NO: 197385 - protein, 10 aa, Tick-borne encephalitis virus
TPPGKSEPFP

SEQ ID NO: 197386 - protein, 10 aa, Tick-borne encephalitis virus
PPGKSEPFPE

SEQ ID NO: 197387 - protein, 10 aa, Tick-borne encephalitis virus
PGKSEPFPES

SEQ ID NO: 197388 - protein, 10 aa, Tick-borne encephalitis virus
GKSEPFPESN

SEQ ID NO: 197389 - protein, 10 aa, Tick-borne encephalitis virus
KSEPFPESNG

SEQ ID NO: 197390 - protein, 10 aa, Tick-borne encephalitis virus
SEPFPESNGA

SEQ ID NO: 197391 - protein, 10 aa, Tick-borne encephalitis virus
EPFPESNGAI

SEQ ID NO: 197392 - protein, 10 aa, Tick-borne encephalitis virus
PFPESNGAIT

SEQ ID NO: 197393 - protein, 10 aa, Tick-borne encephalitis virus
FPESNGAITS

SEQ ID NO: 197394 - protein, 10 aa, Tick-borne encephalitis virus
PESNGAITSE

SEQ ID NO: 197395 - protein, 10 aa, Tick-borne encephalitis virus
ESNGAITSEE

SEQ ID NO: 197396 - protein, 10 aa, Tick-borne encephalitis virus
SNGAISSEEK

SEQ ID NO: 197397 - protein, 10 aa, Tick-borne encephalitis virus
NGAISSEEKQ

SEQ ID NO: 197398 - protein, 10 aa, Tick-borne encephalitis virus
GAISSEEKQI

SEQ ID NO: 197399 - protein, 10 aa, Tick-borne encephalitis virus
AISSEEKQIP

SEQ ID NO: 197400 - protein, 10 aa, Tick-borne encephalitis virus
SEEKQIPDGE

SEQ ID NO: 197401 - protein, 10 aa, Tick-borne encephalitis virus
EEKQIPDGEW

SEQ ID NO: 197402 - protein, 10 aa, Tick-borne encephalitis virus
EKQIPDGEWR

SEQ ID NO: 197403 - protein, 10 aa, Tick-borne encephalitis virus
KQIPDGEWRD

SEQ ID NO: 197404 - protein, 10 aa, Tick-borne encephalitis virus
QIPDGEWRDG

SEQ ID NO: 197405 - protein, 10 aa, Tick-borne encephalitis virus
IPDGEWRDGF

SEQ ID NO: 197406 - protein, 10 aa, Tick-borne encephalitis virus
PDGEWRDGFD

SEQ ID NO: 197407 - protein, 10 aa, Tick-borne encephalitis virus
DGEWRDGFDW

SEQ ID NO: 197408 - protein, 10 aa, Tick-borne encephalitis virus
GEWRDGFDWI

SEQ ID NO: 197409 - protein, 10 aa, Tick-borne encephalitis virus
EWRDGFDWIT

SEQ ID NO: 197410 - protein, 10 aa, Tick-borne encephalitis virus
WRDGFDWITE

SEQ ID NO: 197411 - protein, 10 aa, Tick-borne encephalitis virus
RDGFDWITEY

SEQ ID NO: 197412 - protein, 10 aa, Tick-borne encephalitis virus
DGFDWITEYE

SEQ ID NO: 197413 - protein, 10 aa, Tick-borne encephalitis virus
GFDWITEYEG

SEQ ID NO: 197414 - protein, 10 aa, Tick-borne encephalitis virus
FDWITEYEGR

SEQ ID NO: 197415 - protein, 10 aa, Tick-borne encephalitis virus
DWITEYEGRT

SEQ ID NO: 197416 - protein, 10 aa, Tick-borne encephalitis virus
WITEYEGRTA

SEQ ID NO: 197417 - protein, 10 aa, Tick-borne encephalitis virus
ITEYEGRTAW

SEQ ID NO: 197418 - protein, 10 aa, Tick-borne encephalitis virus
TEYEGRTAWF

SEQ ID NO: 197419 - protein, 10 aa, Tick-borne encephalitis virus
EYEGRTAWFV

SEQ ID NO: 197420 - protein, 10 aa, Tick-borne encephalitis virus
YEGRTAWFVP

SEQ ID NO: 197421 - protein, 10 aa, Tick-borne encephalitis virus
EGRTAWFVPS

SEQ ID NO: 197422 - protein, 10 aa, Tick-borne encephalitis virus
GRTAWFVPSI

SEQ ID NO: 197423 - protein, 10 aa, Tick-borne encephalitis virus
RTAWFVPSIA

SEQ ID NO: 197424 - protein, 10 aa, Tick-borne encephalitis virus
TAWFVPSIAK

SEQ ID NO: 197425 - protein, 10 aa, Tick-borne encephalitis virus
AWFVPSIAKG

SEQ ID NO: 197426 - protein, 10 aa, Tick-borne encephalitis virus
WFVPSIAKGG

SEQ ID NO: 197427 - protein, 10 aa, Tick-borne encephalitis virus
FVPSIAKGGI

SEQ ID NO: 197428 - protein, 10 aa, Tick-borne encephalitis virus
VPSIAKGGII

SEQ ID NO: 197429 - protein, 10 aa, Tick-borne encephalitis virus
PSIAKGGIIA

SEQ ID NO: 197430 - protein, 10 aa, Tick-borne encephalitis virus
SIAKGGIIAR

SEQ ID NO: 197431 - protein, 10 aa, Tick-borne encephalitis virus
IAKGGIIART

SEQ ID NO: 197432 - protein, 10 aa, Tick-borne encephalitis virus
AKGGIIARTL

SEQ ID NO: 197433 - protein, 10 aa, Tick-borne encephalitis virus
KGGIIARTLR

SEQ ID NO: 197434 - protein, 10 aa, Tick-borne encephalitis virus
GGIIARTLRQ

SEQ ID NO: 197435 - protein, 10 aa, Tick-borne encephalitis virus
GIIARTLRQK

SEQ ID NO: 197436 - protein, 10 aa, Tick-borne encephalitis virus
IIARTLRQKG

SEQ ID NO: 197437 - protein, 10 aa, Tick-borne encephalitis virus
IARTLRQKGK

SEQ ID NO: 197438 - protein, 10 aa, Tick-borne encephalitis virus
ARTLRQKGKS

SEQ ID NO: 197439 - protein, 10 aa, Tick-borne encephalitis virus
RTLRQKGKSV

SEQ ID NO: 197440 - protein, 10 aa, Tick-borne encephalitis virus
TLRQKGKSVI

SEQ ID NO: 197441 - protein, 10 aa, Tick-borne encephalitis virus
LRQKGKSVIC

SEQ ID NO: 197442 - protein, 10 aa, Tick-borne encephalitis virus
RQKGKSVICL

SEQ ID NO: 197443 - protein, 10 aa, Tick-borne encephalitis virus
QKGKSVICLN

SEQ ID NO: 197444 - protein, 10 aa, Tick-borne encephalitis virus
KGKSVICLNS

SEQ ID NO: 197445 - protein, 10 aa, Tick-borne encephalitis virus
GKSVICLNSK

SEQ ID NO: 197446 - protein, 10 aa, Tick-borne encephalitis virus
KSVICLNSKT

SEQ ID NO: 197447 - protein, 10 aa, Tick-borne encephalitis virus
SVICLNSKTF

SEQ ID NO: 197448 - protein, 10 aa, Tick-borne encephalitis virus
VICLNSKTFE

SEQ ID NO: 197449 - protein, 10 aa, Tick-borne encephalitis virus
ICLNSKTFEK

SEQ ID NO: 197450 - protein, 10 aa, Tick-borne encephalitis virus
CLNSKTFEKD

SEQ ID NO: 197451 - protein, 10 aa, Tick-borne encephalitis virus
LNSKTFEKDY

SEQ ID NO: 197452 - protein, 10 aa, Tick-borne encephalitis virus
NSKTFEKDYS

SEQ ID NO: 197453 - protein, 10 aa, Tick-borne encephalitis virus
SKTFEKDYSR

SEQ ID NO: 197454 - protein, 10 aa, Tick-borne encephalitis virus
KTFEKDYSRV

SEQ ID NO: 197455 - protein, 10 aa, Tick-borne encephalitis virus
TFEKDYSRVR

SEQ ID NO: 197456 - protein, 10 aa, Tick-borne encephalitis virus
FEKDYSRVRD

SEQ ID NO: 197457 - protein, 10 aa, Tick-borne encephalitis virus
EKDYSRVRDE

SEQ ID NO: 197458 - protein, 10 aa, Tick-borne encephalitis virus
KDYSRVRDEK

SEQ ID NO: 197459 - protein, 10 aa, Tick-borne encephalitis virus
DYSRVRDEKP

SEQ ID NO: 197460 - protein, 10 aa, Tick-borne encephalitis virus
YSRVRDEKPD

SEQ ID NO: 197461 - protein, 10 aa, Tick-borne encephalitis virus
SRVRDEKPDF

SEQ ID NO: 197462 - protein, 10 aa, Tick-borne encephalitis virus
RVRDEKPDFV

SEQ ID NO: 197463 - protein, 10 aa, Tick-borne encephalitis virus
VRDEKPDFVV

SEQ ID NO: 197464 - protein, 10 aa, Tick-borne encephalitis virus
RDEKPDFVVT

SEQ ID NO: 197465 - protein, 10 aa, Tick-borne encephalitis virus
DEKPDFVVTT

SEQ ID NO: 197466 - protein, 10 aa, Tick-borne encephalitis virus
EKPDFVVTTD

SEQ ID NO: 197467 - protein, 10 aa, Tick-borne encephalitis virus
KPDFVVTTDI

SEQ ID NO: 197468 - protein, 10 aa, Tick-borne encephalitis virus
PDFVVTTDIS

SEQ ID NO: 197469 - protein, 10 aa, Tick-borne encephalitis virus
DFVVTTDISE

SEQ ID NO: 197470 - protein, 10 aa, Tick-borne encephalitis virus
FVVTTDISEM

SEQ ID NO: 197471 - protein, 10 aa, Tick-borne encephalitis virus
VVTTDISEMG

SEQ ID NO: 197472 - protein, 10 aa, Tick-borne encephalitis virus
VTTDISEMGA

SEQ ID NO: 197473 - protein, 10 aa, Tick-borne encephalitis virus
TTDISEMGAN

SEQ ID NO: 197474 - protein, 10 aa, Tick-borne encephalitis virus
TDISEMGANL

SEQ ID NO: 197475 - protein, 10 aa, Tick-borne encephalitis virus
DISEMGANLD

SEQ ID NO: 197476 - protein, 10 aa, Tick-borne encephalitis virus
ISEMGANLDV

SEQ ID NO: 197477 - protein, 10 aa, Tick-borne encephalitis virus
SEMGANLDVS

SEQ ID NO: 197478 - protein, 10 aa, Tick-borne encephalitis virus
EMGANLDVSR

SEQ ID NO: 197479 - protein, 10 aa, Tick-borne encephalitis virus
MGANLDVSRV

SEQ ID NO: 197480 - protein, 10 aa, Tick-borne encephalitis virus
GANLDVSRVI

SEQ ID NO: 197481 - protein, 10 aa, Tick-borne encephalitis virus
ANLDVSRVID

SEQ ID NO: 197482 - protein, 10 aa, Tick-borne encephalitis virus
NLDVSRVIDG

SEQ ID NO: 197483 - protein, 10 aa, Tick-borne encephalitis virus
LDVSRVIDGR

SEQ ID NO: 197484 - protein, 10 aa, Tick-borne encephalitis virus
DVSRVIDGRT

SEQ ID NO: 197485 - protein, 10 aa, Tick-borne encephalitis virus
VSRVIDGRTN

SEQ ID NO: 197486 - protein, 10 aa, Tick-borne encephalitis virus
SRVIDGRTNI

SEQ ID NO: 197487 - protein, 10 aa, Tick-borne encephalitis virus
RVIDGRTNIK

SEQ ID NO: 197488 - protein, 10 aa, Tick-borne encephalitis virus
VIDGRTNIKP

SEQ ID NO: 197489 - protein, 10 aa, Tick-borne encephalitis virus
IDGRTNIKPE

SEQ ID NO: 197490 - protein, 10 aa, Tick-borne encephalitis virus
DGRTNIKPEE

SEQ ID NO: 197491 - protein, 10 aa, Tick-borne encephalitis virus
GRTNIKPEEV

SEQ ID NO: 197492 - protein, 10 aa, Tick-borne encephalitis virus
RTNIKPEEVD

SEQ ID NO: 197493 - protein, 10 aa, Tick-borne encephalitis virus
TNIKPEEVDG

SEQ ID NO: 197494 - protein, 10 aa, Tick-borne encephalitis virus
NIKPEEVDGR

SEQ ID NO: 197495 - protein, 10 aa, Tick-borne encephalitis virus
IKPEEVDGRV

SEQ ID NO: 197496 - protein, 10 aa, Tick-borne encephalitis virus
KPEEVDGRVE

SEQ ID NO: 197497 - protein, 10 aa, Tick-borne encephalitis virus
PEEVDGRVEL

SEQ ID NO: 197498 - protein, 10 aa, Tick-borne encephalitis virus
EEVDGRVELT

SEQ ID NO: 197499 - protein, 10 aa, Tick-borne encephalitis virus
EVDGRVELTG

SEQ ID NO: 197500 - protein, 10 aa, Tick-borne encephalitis virus
VDGRVELTGT

SEQ ID NO: 197501 - protein, 10 aa, Tick-borne encephalitis virus
DGRVELTGTR

SEQ ID NO: 197502 - protein, 10 aa, Tick-borne encephalitis virus
GRVELTGTRR

SEQ ID NO: 197503 - protein, 10 aa, Tick-borne encephalitis virus
RVELTGTRRV

SEQ ID NO: 197504 - protein, 10 aa, Tick-borne encephalitis virus
VELTGTRRVT

SEQ ID NO: 197505 - protein, 10 aa, Tick-borne encephalitis virus
ELTGTRRVTT

SEQ ID NO: 197506 - protein, 10 aa, Tick-borne encephalitis virus
LTGTRRVTTA

SEQ ID NO: 197507 - protein, 10 aa, Tick-borne encephalitis virus
TGTRRVTTAS

SEQ ID NO: 197508 - protein, 10 aa, Tick-borne encephalitis virus
GTRRVTTASA

SEQ ID NO: 197509 - protein, 10 aa, Tick-borne encephalitis virus
TRRVTTASAA

SEQ ID NO: 197510 - protein, 10 aa, Tick-borne encephalitis virus
RRVTTASAAQ

SEQ ID NO: 197511 - protein, 10 aa, Tick-borne encephalitis virus
RVTTASAAQR

SEQ ID NO: 197512 - protein, 10 aa, Tick-borne encephalitis virus
VTTASAAQRR

SEQ ID NO: 197513 - protein, 10 aa, Tick-borne encephalitis virus
TTASAAQRRG

SEQ ID NO: 197514 - protein, 10 aa, Tick-borne encephalitis virus
TASAAQRRGR

SEQ ID NO: 197515 - protein, 10 aa, Tick-borne encephalitis virus
ASAAQRRGRV

SEQ ID NO: 197516 - protein, 10 aa, Tick-borne encephalitis virus
SAAQRRGRVG

SEQ ID NO: 197517 - protein, 10 aa, Tick-borne encephalitis virus
AAQRRGRVGR

SEQ ID NO: 197518 - protein, 10 aa, Tick-borne encephalitis virus
AQRRGRVGRQ

SEQ ID NO: 197519 - protein, 10 aa, Tick-borne encephalitis virus
QRRGRVGRQE

SEQ ID NO: 197520 - protein, 10 aa, Tick-borne encephalitis virus
RRGRVGRQEG

SEQ ID NO: 197521 - protein, 10 aa, Tick-borne encephalitis virus
RGRVGRQEGR

SEQ ID NO: 197522 - protein, 10 aa, Tick-borne encephalitis virus
GRVGRQEGRT

SEQ ID NO: 197523 - protein, 10 aa, Tick-borne encephalitis virus
RVGRQEGRTD

SEQ ID NO: 197524 - protein, 10 aa, Tick-borne encephalitis virus
VGRQEGRTDE

SEQ ID NO: 197525 - protein, 10 aa, Tick-borne encephalitis virus
GRQEGRTDEY

SEQ ID NO: 197526 - protein, 10 aa, Tick-borne encephalitis virus
RQEGRTDEYI

SEQ ID NO: 197527 - protein, 10 aa, Tick-borne encephalitis virus
QEGRTDEYIY

SEQ ID NO: 197528 - protein, 10 aa, Tick-borne encephalitis virus
EGRTDEYIYS

SEQ ID NO: 197529 - protein, 10 aa, Tick-borne encephalitis virus
GRTDEYIYSG

SEQ ID NO: 197530 - protein, 10 aa, Tick-borne encephalitis virus
RTDEYIYSGQ

SEQ ID NO: 197531 - protein, 10 aa, Tick-borne encephalitis virus
TDEYIYSGQC

SEQ ID NO: 197532 - protein, 10 aa, Tick-borne encephalitis virus
DEYIYSGQCD

SEQ ID NO: 197533 - protein, 10 aa, Tick-borne encephalitis virus
EYIYSGQCDD

SEQ ID NO: 197534 - protein, 10 aa, Tick-borne encephalitis virus
YIYSGQCDDD

SEQ ID NO: 197535 - protein, 10 aa, Tick-borne encephalitis virus
IYSGQCDDDD

SEQ ID NO: 197536 - protein, 10 aa, Tick-borne encephalitis virus
YSGQCDDDDS

SEQ ID NO: 197537 - protein, 10 aa, Tick-borne encephalitis virus
SGQCDDDDSG

SEQ ID NO: 197538 - protein, 10 aa, Tick-borne encephalitis virus
GQCDDDDSGL

SEQ ID NO: 197539 - protein, 10 aa, Tick-borne encephalitis virus
QCDDDDSGLV

SEQ ID NO: 197540 - protein, 10 aa, Tick-borne encephalitis virus
CDDDDSGLVQ

SEQ ID NO: 197541 - protein, 10 aa, Tick-borne encephalitis virus
DDDDSGLVQW

SEQ ID NO: 197542 - protein, 10 aa, Tick-borne encephalitis virus
DDDSGLVQWK

SEQ ID NO: 197543 - protein, 10 aa, Tick-borne encephalitis virus
DDSGLVQWKE

SEQ ID NO: 197544 - protein, 10 aa, Tick-borne encephalitis virus
DSGLVQWKEA

SEQ ID NO: 197545 - protein, 10 aa, Tick-borne encephalitis virus
SGLVQWKEAQ

SEQ ID NO: 197546 - protein, 10 aa, Tick-borne encephalitis virus
GLVQWKEAQI

SEQ ID NO: 197547 - protein, 10 aa, Tick-borne encephalitis virus
LVQWKEAQIL

SEQ ID NO: 197548 - protein, 10 aa, Tick-borne encephalitis virus
VQWKEAQILL

SEQ ID NO: 197549 - protein, 10 aa, Tick-borne encephalitis virus
QWKEAQILLD

SEQ ID NO: 197550 - protein, 10 aa, Tick-borne encephalitis virus
WKEAQILLDN

SEQ ID NO: 197551 - protein, 10 aa, Tick-borne encephalitis virus
KEAQILLDNI

SEQ ID NO: 197552 - protein, 10 aa, Tick-borne encephalitis virus
EAQILLDNIT

SEQ ID NO: 197553 - protein, 10 aa, Tick-borne encephalitis virus
AQILLDNITT

SEQ ID NO: 197554 - protein, 10 aa, Tick-borne encephalitis virus
QILLDNITTL

SEQ ID NO: 197555 - protein, 10 aa, Tick-borne encephalitis virus
ILLDNITTLR

SEQ ID NO: 197556 - protein, 10 aa, Tick-borne encephalitis virus
LLDNITTLRG

SEQ ID NO: 197557 - protein, 10 aa, Tick-borne encephalitis virus
LDNITTLRGP

SEQ ID NO: 197558 - protein, 10 aa, Tick-borne encephalitis virus
DNITTLRGPV

SEQ ID NO: 197559 - protein, 10 aa, Tick-borne encephalitis virus
NITTLRGPVA

SEQ ID NO: 197560 - protein, 10 aa, Tick-borne encephalitis virus
ITTLRGPVAT

SEQ ID NO: 197561 - protein, 10 aa, Tick-borne encephalitis virus
TTLRGPVATF

SEQ ID NO: 197562 - protein, 10 aa, Tick-borne encephalitis virus
TLRGPVATFY

SEQ ID NO: 197563 - protein, 10 aa, Tick-borne encephalitis virus
LRGPVATFYG

SEQ ID NO: 197564 - protein, 10 aa, Tick-borne encephalitis virus
RGPVATFYGP

SEQ ID NO: 197565 - protein, 10 aa, Tick-borne encephalitis virus
GPVATFYGPE

SEQ ID NO: 197566 - protein, 10 aa, Tick-borne encephalitis virus
PVATFYGPEQ

SEQ ID NO: 197567 - protein, 10 aa, Tick-borne encephalitis virus
VATFYGPEQD

SEQ ID NO: 197568 - protein, 10 aa, Tick-borne encephalitis virus
ATFYGPEQDK

SEQ ID NO: 197569 - protein, 10 aa, Tick-borne encephalitis virus
TFYGPEQDKM

SEQ ID NO: 197570 - protein, 10 aa, Tick-borne encephalitis virus
FYGPEQDKMP

SEQ ID NO: 197571 - protein, 10 aa, Tick-borne encephalitis virus
YGPEQDKMPE

SEQ ID NO: 197572 - protein, 10 aa, Tick-borne encephalitis virus
GPEQDKMPEV

SEQ ID NO: 197573 - protein, 10 aa, Tick-borne encephalitis virus
PEQDKMPEVA

SEQ ID NO: 197574 - protein, 10 aa, Tick-borne encephalitis virus
EQDKMPEVAG

SEQ ID NO: 197575 - protein, 10 aa, Tick-borne encephalitis virus
QDKMPEVAGH

SEQ ID NO: 197576 - protein, 10 aa, Tick-borne encephalitis virus
DKMPEVAGHF

SEQ ID NO: 197577 - protein, 10 aa, Tick-borne encephalitis virus
KMPEVAGHFR

SEQ ID NO: 197578 - protein, 10 aa, Tick-borne encephalitis virus
MPEVAGHFRL

SEQ ID NO: 197579 - protein, 10 aa, Tick-borne encephalitis virus
PEVAGHFRLT

SEQ ID NO: 197580 - protein, 10 aa, Tick-borne encephalitis virus
EVAGHFRLTE

SEQ ID NO: 197581 - protein, 10 aa, Tick-borne encephalitis virus
VAGHFRLTEE

SEQ ID NO: 197582 - protein, 10 aa, Tick-borne encephalitis virus
AGHFRLTEEK

SEQ ID NO: 197583 - protein, 10 aa, Tick-borne encephalitis virus
GHFRLTEEKR

SEQ ID NO: 197584 - protein, 10 aa, Tick-borne encephalitis virus
HFRLTEEKRK

SEQ ID NO: 197585 - protein, 10 aa, Tick-borne encephalitis virus
FRLTEEKRKH

SEQ ID NO: 197586 - protein, 10 aa, Tick-borne encephalitis virus
RLTEEKRKHF

SEQ ID NO: 197587 - protein, 10 aa, Tick-borne encephalitis virus
LTEEKRKHFR

SEQ ID NO: 197588 - protein, 10 aa, Tick-borne encephalitis virus
TEEKRKHFRH

SEQ ID NO: 197589 - protein, 10 aa, Tick-borne encephalitis virus
EEKRKHFRHL

SEQ ID NO: 197590 - protein, 10 aa, Tick-borne encephalitis virus
EKRKHFRHLL

SEQ ID NO: 197591 - protein, 10 aa, Tick-borne encephalitis virus
KRKHFRHLLT

SEQ ID NO: 197592 - protein, 10 aa, Tick-borne encephalitis virus
RKHFRHLLTH

SEQ ID NO: 197593 - protein, 10 aa, Tick-borne encephalitis virus
KHFRHLLTHC

SEQ ID NO: 197594 - protein, 10 aa, Tick-borne encephalitis virus
HFRHLLTHCD

SEQ ID NO: 197595 - protein, 10 aa, Tick-borne encephalitis virus
FRHLLTHCDF

SEQ ID NO: 197596 - protein, 10 aa, Tick-borne encephalitis virus
RHLLTHCDFT

SEQ ID NO: 197597 - protein, 10 aa, Tick-borne encephalitis virus
HLLTHCDFTP

SEQ ID NO: 197598 - protein, 10 aa, Tick-borne encephalitis virus
LLTHCDFTPW

SEQ ID NO: 197599 - protein, 10 aa, Tick-borne encephalitis virus
LTHCDFTPWL

SEQ ID NO: 197600 - protein, 10 aa, Tick-borne encephalitis virus
THCDFTPWLA

SEQ ID NO: 197601 - protein, 10 aa, Tick-borne encephalitis virus
HCDFTPWLAW

SEQ ID NO: 197602 - protein, 10 aa, Tick-borne encephalitis virus
CDFTPWLAWH

SEQ ID NO: 197603 - protein, 10 aa, Tick-borne encephalitis virus
DFTPWLAWHV

SEQ ID NO: 197604 - protein, 10 aa, Tick-borne encephalitis virus
FTPWLAWHVA

SEQ ID NO: 197605 - protein, 10 aa, Tick-borne encephalitis virus
TPWLAWHVAA

SEQ ID NO: 197606 - protein, 10 aa, Tick-borne encephalitis virus
PWLAWHVAAN

SEQ ID NO: 197607 - protein, 10 aa, Tick-borne encephalitis virus
WLAWHVAANV

SEQ ID NO: 197608 - protein, 10 aa, Tick-borne encephalitis virus
LAWHVAANVS

SEQ ID NO: 197609 - protein, 10 aa, Tick-borne encephalitis virus
AWHVAANVSS

SEQ ID NO: 197610 - protein, 10 aa, Tick-borne encephalitis virus
WHVAANVSSV

SEQ ID NO: 197611 - protein, 10 aa, Tick-borne encephalitis virus
HVAANVSSVT

SEQ ID NO: 197612 - protein, 10 aa, Tick-borne encephalitis virus
VAANVSSVTS

SEQ ID NO: 197613 - protein, 10 aa, Tick-borne encephalitis virus
AANVSSVTSR

SEQ ID NO: 197614 - protein, 10 aa, Tick-borne encephalitis virus
ANVSSVTSRN

SEQ ID NO: 197615 - protein, 10 aa, Tick-borne encephalitis virus
NVSSVTSRNW

SEQ ID NO: 197616 - protein, 10 aa, Tick-borne encephalitis virus
VSSVTSRNWT

SEQ ID NO: 197617 - protein, 10 aa, Tick-borne encephalitis virus
SSVTSRNWTW

SEQ ID NO: 197618 - protein, 10 aa, Tick-borne encephalitis virus
SVTSRNWTWE

SEQ ID NO: 197619 - protein, 10 aa, Tick-borne encephalitis virus
VTSRNWTWEG

SEQ ID NO: 197620 - protein, 10 aa, Tick-borne encephalitis virus
TSRNWTWEGP

SEQ ID NO: 197621 - protein, 10 aa, Tick-borne encephalitis virus
SRNWTWEGPE

SEQ ID NO: 197622 - protein, 10 aa, Tick-borne encephalitis virus
RNWTWEGPEE

SEQ ID NO: 197623 - protein, 10 aa, Tick-borne encephalitis virus
NWTWEGPEEN

SEQ ID NO: 197624 - protein, 10 aa, Tick-borne encephalitis virus
WTWEGPEENT

SEQ ID NO: 197625 - protein, 10 aa, Tick-borne encephalitis virus
TWEGPEENTV

SEQ ID NO: 197626 - protein, 10 aa, Tick-borne encephalitis virus
WEGPEENTVD

SEQ ID NO: 197627 - protein, 10 aa, Tick-borne encephalitis virus
EGPEENTVDE

SEQ ID NO: 197628 - protein, 10 aa, Tick-borne encephalitis virus
GPEENTVDEA

SEQ ID NO: 197629 - protein, 10 aa, Tick-borne encephalitis virus
PEENTVDEAN

SEQ ID NO: 197630 - protein, 10 aa, Tick-borne encephalitis virus
EENTVDEANG

SEQ ID NO: 197631 - protein, 10 aa, Tick-borne encephalitis virus
ENTVDEANGD

SEQ ID NO: 197632 - protein, 10 aa, Tick-borne encephalitis virus
NTVDEANGDL

SEQ ID NO: 197633 - protein, 10 aa, Tick-borne encephalitis virus
TVDEANGDLV

SEQ ID NO: 197634 - protein, 10 aa, Tick-borne encephalitis virus
VDEANGDLVT

SEQ ID NO: 197635 - protein, 10 aa, Tick-borne encephalitis virus
DEANGDLVTF

SEQ ID NO: 197636 - protein, 10 aa, Tick-borne encephalitis virus
EANGDLVTFR

SEQ ID NO: 197637 - protein, 10 aa, Tick-borne encephalitis virus
ANGDLVTFRS

SEQ ID NO: 197638 - protein, 10 aa, Tick-borne encephalitis virus
NGDLVTFRSP

SEQ ID NO: 197639 - protein, 10 aa, Tick-borne encephalitis virus
GDLVTFRSPN

SEQ ID NO: 197640 - protein, 10 aa, Tick-borne encephalitis virus
DLVTFRSPNG

SEQ ID NO: 197641 - protein, 10 aa, Tick-borne encephalitis virus
LVTFRSPNGA

SEQ ID NO: 197642 - protein, 10 aa, Tick-borne encephalitis virus
VTFRSPNGAE

SEQ ID NO: 197643 - protein, 10 aa, Tick-borne encephalitis virus
TFRSPNGAER

SEQ ID NO: 197644 - protein, 10 aa, Tick-borne encephalitis virus
FRSPNGAERT

SEQ ID NO: 197645 - protein, 10 aa, Tick-borne encephalitis virus
RSPNGAERTL

SEQ ID NO: 197646 - protein, 10 aa, Tick-borne encephalitis virus
SPNGAERTLR

SEQ ID NO: 197647 - protein, 10 aa, Tick-borne encephalitis virus
PNGAERTLRP

SEQ ID NO: 197648 - protein, 10 aa, Tick-borne encephalitis virus
NGAERTLRPV

SEQ ID NO: 197649 - protein, 10 aa, Tick-borne encephalitis virus
GAERTLRPVW

SEQ ID NO: 197650 - protein, 10 aa, Tick-borne encephalitis virus
AERTLRPVWR

SEQ ID NO: 197651 - protein, 10 aa, Tick-borne encephalitis virus
ERTLRPVWRD

SEQ ID NO: 197652 - protein, 10 aa, Tick-borne encephalitis virus
RTLRPVWRDA

SEQ ID NO: 197653 - protein, 10 aa, Tick-borne encephalitis virus
TLRPVWRDAR

SEQ ID NO: 197654 - protein, 10 aa, Tick-borne encephalitis virus
LRPVWRDARM

SEQ ID NO: 197655 - protein, 10 aa, Tick-borne encephalitis virus
RPVWRDARMF

SEQ ID NO: 197656 - protein, 10 aa, Tick-borne encephalitis virus
PVWRDARMFR

SEQ ID NO: 197657 - protein, 10 aa, Tick-borne encephalitis virus
VWRDARMFRE

SEQ ID NO: 197658 - protein, 10 aa, Tick-borne encephalitis virus
WRDARMFREG

SEQ ID NO: 197659 - protein, 10 aa, Tick-borne encephalitis virus
RDARMFREGR

SEQ ID NO: 197660 - protein, 10 aa, Tick-borne encephalitis virus
DARMFREGRD

SEQ ID NO: 197661 - protein, 10 aa, Tick-borne encephalitis virus
ARMFREGRDI

SEQ ID NO: 197662 - protein, 10 aa, Tick-borne encephalitis virus
RMFREGRDIR

SEQ ID NO: 197663 - protein, 10 aa, Tick-borne encephalitis virus
MFREGRDIRE

SEQ ID NO: 197664 - protein, 10 aa, Tick-borne encephalitis virus
FREGRDIREF

SEQ ID NO: 197665 - protein, 10 aa, Tick-borne encephalitis virus
REGRDIREFV

SEQ ID NO: 197666 - protein, 10 aa, Tick-borne encephalitis virus
EGRDIREFVA

SEQ ID NO: 197667 - protein, 10 aa, Tick-borne encephalitis virus
GRDIREFVAY

SEQ ID NO: 197668 - protein, 10 aa, Tick-borne encephalitis virus
RDIREFVAYA

SEQ ID NO: 197669 - protein, 10 aa, Tick-borne encephalitis virus
DIREFVAYAS

SEQ ID NO: 197670 - protein, 10 aa, Tick-borne encephalitis virus
IREFVAYASG

SEQ ID NO: 197671 - protein, 10 aa, Tick-borne encephalitis virus
REFVAYASGR

SEQ ID NO: 197672 - protein, 10 aa, Tick-borne encephalitis virus
EFVAYASGRR

SEQ ID NO: 197673 - protein, 10 aa, Tick-borne encephalitis virus
FVAYASGRRS

SEQ ID NO: 197674 - protein, 10 aa, Tick-borne encephalitis virus
VAYASGRRSF

SEQ ID NO: 197675 - protein, 10 aa, Tick-borne encephalitis virus
AYASGRRSFG

SEQ ID NO: 197676 - protein, 10 aa, Tick-borne encephalitis virus
YASGRRSFGD

SEQ ID NO: 197677 - protein, 10 aa, Tick-borne encephalitis virus
ASGRRSFGDV

SEQ ID NO: 197678 - protein, 10 aa, Tick-borne encephalitis virus
SGRRSFGDVL

SEQ ID NO: 197679 - protein, 10 aa, Tick-borne encephalitis virus
GRRSFGDVLS

SEQ ID NO: 197680 - protein, 10 aa, Tick-borne encephalitis virus
RRSFGDVLSG

SEQ ID NO: 197681 - protein, 10 aa, Tick-borne encephalitis virus
RSFGDVLSGM

SEQ ID NO: 197682 - protein, 10 aa, Tick-borne encephalitis virus
SFGDVLSGMS

SEQ ID NO: 197683 - protein, 10 aa, Tick-borne encephalitis virus
FGDVLSGMSG

SEQ ID NO: 197684 - protein, 10 aa, Tick-borne encephalitis virus
GDVLSGMSGV

SEQ ID NO: 197685 - protein, 10 aa, Tick-borne encephalitis virus
DVLSGMSGVP

SEQ ID NO: 197686 - protein, 10 aa, Tick-borne encephalitis virus
VLSGMSGVPE

SEQ ID NO: 197687 - protein, 10 aa, Tick-borne encephalitis virus
LSGMSGVPEL

SEQ ID NO: 197688 - protein, 10 aa, Tick-borne encephalitis virus
SGMSGVPELL

SEQ ID NO: 197689 - protein, 10 aa, Tick-borne encephalitis virus
GMSGVPELLR

SEQ ID NO: 197690 - protein, 10 aa, Tick-borne encephalitis virus
MSGVPELLRH

SEQ ID NO: 197691 - protein, 10 aa, Tick-borne encephalitis virus
SGVPELLRHR

SEQ ID NO: 197692 - protein, 10 aa, Tick-borne encephalitis virus
GVPELLRHRC

SEQ ID NO: 197693 - protein, 10 aa, Tick-borne encephalitis virus
VPELLRHRCV

SEQ ID NO: 197694 - protein, 10 aa, Tick-borne encephalitis virus
PELLRHRCVS

SEQ ID NO: 197695 - protein, 10 aa, Tick-borne encephalitis virus
ELLRHRCVSA

SEQ ID NO: 197696 - protein, 10 aa, Tick-borne encephalitis virus
LLRHRCVSAM

SEQ ID NO: 197697 - protein, 10 aa, Tick-borne encephalitis virus
LRHRCVSAMD

SEQ ID NO: 197698 - protein, 10 aa, Tick-borne encephalitis virus
RHRCVSAMDV

SEQ ID NO: 197699 - protein, 10 aa, Tick-borne encephalitis virus
HRCVSAMDVF

SEQ ID NO: 197700 - protein, 10 aa, Tick-borne encephalitis virus
RCVSAMDVFY

SEQ ID NO: 197701 - protein, 10 aa, Tick-borne encephalitis virus
CVSAMDVFYT

SEQ ID NO: 197702 - protein, 10 aa, Tick-borne encephalitis virus
VSAMDVFYTL

SEQ ID NO: 197703 - protein, 10 aa, Tick-borne encephalitis virus
SAMDVFYTLM

SEQ ID NO: 197704 - protein, 10 aa, Tick-borne encephalitis virus
AMDVFYTLMH

SEQ ID NO: 197705 - protein, 10 aa, Tick-borne encephalitis virus
MDVFYTLMHE

SEQ ID NO: 197706 - protein, 10 aa, Tick-borne encephalitis virus
DVFYTLMHEE

SEQ ID NO: 197707 - protein, 10 aa, Tick-borne encephalitis virus
VFYTLMHEEP

SEQ ID NO: 197708 - protein, 10 aa, Tick-borne encephalitis virus
FYTLMHEEPG

SEQ ID NO: 197709 - protein, 10 aa, Tick-borne encephalitis virus
YTLMHEEPGS

SEQ ID NO: 197710 - protein, 10 aa, Tick-borne encephalitis virus
TLMHEEPGSR

SEQ ID NO: 197711 - protein, 10 aa, Tick-borne encephalitis virus
LMHEEPGSRA

SEQ ID NO: 197712 - protein, 10 aa, Tick-borne encephalitis virus
MHEEPGSRAM

SEQ ID NO: 197713 - protein, 10 aa, Tick-borne encephalitis virus
HEEPGSRAMR

SEQ ID NO: 197714 - protein, 10 aa, Tick-borne encephalitis virus
EEPGSRAMRM

SEQ ID NO: 197715 - protein, 10 aa, Tick-borne encephalitis virus
EPGSRAMRMA

SEQ ID NO: 197716 - protein, 10 aa, Tick-borne encephalitis virus
PGSRAMRMAE

SEQ ID NO: 197717 - protein, 10 aa, Tick-borne encephalitis virus
GSRAMRMAER

SEQ ID NO: 197718 - protein, 10 aa, Tick-borne encephalitis virus
SRAMRMAERD

SEQ ID NO: 197719 - protein, 10 aa, Tick-borne encephalitis virus
RAMRMAERDA

SEQ ID NO: 197720 - protein, 10 aa, Tick-borne encephalitis virus
AMRMAERDAP

SEQ ID NO: 197721 - protein, 10 aa, Tick-borne encephalitis virus
MRMAERDAPE

SEQ ID NO: 197722 - protein, 10 aa, Tick-borne encephalitis virus
RMAERDAPEA

SEQ ID NO: 197723 - protein, 10 aa, Tick-borne encephalitis virus
MAERDAPEAF

SEQ ID NO: 197724 - protein, 10 aa, Tick-borne encephalitis virus
AERDAPEAFL

SEQ ID NO: 197725 - protein, 10 aa, Tick-borne encephalitis virus
ERDAPEAFLT

SEQ ID NO: 197726 - protein, 10 aa, Tick-borne encephalitis virus
RDAPEAFLTV

SEQ ID NO: 197727 - protein, 10 aa, Tick-borne encephalitis virus
DAPEAFLTVV

SEQ ID NO: 197728 - protein, 10 aa, Tick-borne encephalitis virus
APEAFLTVVE

SEQ ID NO: 197729 - protein, 10 aa, Tick-borne encephalitis virus
VEMMVLGLAT

SEQ ID NO: 197730 - protein, 10 aa, Tick-borne encephalitis virus
EMMVLGLATL

SEQ ID NO: 197731 - protein, 10 aa, Tick-borne encephalitis virus
MMVLGLATLG

SEQ ID NO: 197732 - protein, 10 aa, Tick-borne encephalitis virus
MVLGLATLGV

SEQ ID NO: 197733 - protein, 10 aa, Tick-borne encephalitis virus
VLGLATLGVV

SEQ ID NO: 197734 - protein, 10 aa, Tick-borne encephalitis virus
LGLATLGVVW

SEQ ID NO: 197735 - protein, 10 aa, Tick-borne encephalitis virus
GLATLGVVWC

SEQ ID NO: 197736 - protein, 10 aa, Tick-borne encephalitis virus
LATLGVVWCF

SEQ ID NO: 197737 - protein, 10 aa, Tick-borne encephalitis virus
ATLGVVWCFV

SEQ ID NO: 197738 - protein, 10 aa, Tick-borne encephalitis virus
TLGVVWCFVV

SEQ ID NO: 197739 - protein, 10 aa, Tick-borne encephalitis virus
LGVVWCFVVR

SEQ ID NO: 197740 - protein, 10 aa, Tick-borne encephalitis virus
GVVWCFVVRT

SEQ ID NO: 197741 - protein, 10 aa, Tick-borne encephalitis virus
VVWCFVVRTS

SEQ ID NO: 197742 - protein, 10 aa, Tick-borne encephalitis virus
VWCFVVRTSI

SEQ ID NO: 197743 - protein, 10 aa, Tick-borne encephalitis virus
WCFVVRTSIS

SEQ ID NO: 197744 - protein, 10 aa, Tick-borne encephalitis virus
CFVVRTSISR

SEQ ID NO: 197745 - protein, 10 aa, Tick-borne encephalitis virus
FVVRTSISRM

SEQ ID NO: 197746 - protein, 10 aa, Tick-borne encephalitis virus
VVRTSISRMM

SEQ ID NO: 197747 - protein, 10 aa, Tick-borne encephalitis virus
VRTSISRMML

SEQ ID NO: 197748 - protein, 10 aa, Tick-borne encephalitis virus
RTSISRMMLG

SEQ ID NO: 197749 - protein, 10 aa, Tick-borne encephalitis virus
TSISRMMLGT

SEQ ID NO: 197750 - protein, 10 aa, Tick-borne encephalitis virus
SISRMMLGTL

SEQ ID NO: 197751 - protein, 10 aa, Tick-borne encephalitis virus
ISRMMLGTLV

SEQ ID NO: 197752 - protein, 10 aa, Tick-borne encephalitis virus
SRMMLGTLVL

SEQ ID NO: 197753 - protein, 10 aa, Tick-borne encephalitis virus
RMMLGTLVLL

SEQ ID NO: 197754 - protein, 10 aa, Tick-borne encephalitis virus
MMLGTLVLLA

SEQ ID NO: 197755 - protein, 10 aa, Tick-borne encephalitis virus
MLGTLVLLAS

SEQ ID NO: 197756 - protein, 10 aa, Tick-borne encephalitis virus
LGTLVLLASL

SEQ ID NO: 197757 - protein, 10 aa, Tick-borne encephalitis virus
GTLVLLASLA

SEQ ID NO: 197758 - protein, 10 aa, Tick-borne encephalitis virus
TLVLLASLAL

SEQ ID NO: 197759 - protein, 10 aa, Tick-borne encephalitis virus
LVLLASLALL

SEQ ID NO: 197760 - protein, 10 aa, Tick-borne encephalitis virus
VLLASLALLW

SEQ ID NO: 197761 - protein, 10 aa, Tick-borne encephalitis virus
LLASLALLWA

SEQ ID NO: 197762 - protein, 10 aa, Tick-borne encephalitis virus
LASLALLWAG

SEQ ID NO: 197763 - protein, 10 aa, Tick-borne encephalitis virus
ASLALLWAGG

SEQ ID NO: 197764 - protein, 10 aa, Tick-borne encephalitis virus
SLALLWAGGV

SEQ ID NO: 197765 - protein, 10 aa, Tick-borne encephalitis virus
LALLWAGGVS

SEQ ID NO: 197766 - protein, 10 aa, Tick-borne encephalitis virus
ALLWAGGVSY

SEQ ID NO: 197767 - protein, 10 aa, Tick-borne encephalitis virus
LLWAGGVSYG

SEQ ID NO: 197768 - protein, 10 aa, Tick-borne encephalitis virus
LWAGGVSYGN

SEQ ID NO: 197769 - protein, 10 aa, Tick-borne encephalitis virus
WAGGVSYGNM

SEQ ID NO: 197770 - protein, 10 aa, Tick-borne encephalitis virus
AGGVSYGNMA

SEQ ID NO: 197771 - protein, 10 aa, Tick-borne encephalitis virus
GGVSYGNMAG

SEQ ID NO: 197772 - protein, 10 aa, Tick-borne encephalitis virus
GVSYGNMAGV

SEQ ID NO: 197773 - protein, 10 aa, Tick-borne encephalitis virus
VSYGNMAGVA

SEQ ID NO: 197774 - protein, 10 aa, Tick-borne encephalitis virus
SYGNMAGVAL

SEQ ID NO: 197775 - protein, 10 aa, Tick-borne encephalitis virus
YGNMAGVALI

SEQ ID NO: 197776 - protein, 10 aa, Tick-borne encephalitis virus
GNMAGVALIF

SEQ ID NO: 197777 - protein, 10 aa, Tick-borne encephalitis virus
NMAGVALIFY

SEQ ID NO: 197778 - protein, 10 aa, Tick-borne encephalitis virus
MAGVALIFYT

SEQ ID NO: 197779 - protein, 10 aa, Tick-borne encephalitis virus
AGVALIFYTL

SEQ ID NO: 197780 - protein, 10 aa, Tick-borne encephalitis virus
GVALIFYTLL

SEQ ID NO: 197781 - protein, 10 aa, Tick-borne encephalitis virus
VALIFYTLLT

SEQ ID NO: 197782 - protein, 10 aa, Tick-borne encephalitis virus
ALIFYTLLTV

SEQ ID NO: 197783 - protein, 10 aa, Tick-borne encephalitis virus
LIFYTLLTVL

SEQ ID NO: 197784 - protein, 10 aa, Tick-borne encephalitis virus
IFYTLLTVLQ

SEQ ID NO: 197785 - protein, 10 aa, Tick-borne encephalitis virus
FYTLLTVLQP

SEQ ID NO: 197786 - protein, 10 aa, Tick-borne encephalitis virus
YTLLTVLQPE

SEQ ID NO: 197787 - protein, 10 aa, Tick-borne encephalitis virus
TLLTVLQPEA

SEQ ID NO: 197788 - protein, 10 aa, Tick-borne encephalitis virus
LLTVLQPEAG

SEQ ID NO: 197789 - protein, 10 aa, Tick-borne encephalitis virus
LTVLQPEAGK

SEQ ID NO: 197790 - protein, 10 aa, Tick-borne encephalitis virus
TVLQPEAGKQ

SEQ ID NO: 197791 - protein, 10 aa, Tick-borne encephalitis virus
VLQPEAGKQR

SEQ ID NO: 197792 - protein, 10 aa, Tick-borne encephalitis virus
LQPEAGKQRS

SEQ ID NO: 197793 - protein, 10 aa, Tick-borne encephalitis virus
QPEAGKQRSS

SEQ ID NO: 197794 - protein, 10 aa, Tick-borne encephalitis virus
PEAGKQRSSD

SEQ ID NO: 197795 - protein, 10 aa, Tick-borne encephalitis virus
EAGKQRSSDD

SEQ ID NO: 197796 - protein, 10 aa, Tick-borne encephalitis virus
AGKQRSSDDN

SEQ ID NO: 197797 - protein, 10 aa, Tick-borne encephalitis virus
GKQRSSDDNK

SEQ ID NO: 197798 - protein, 10 aa, Tick-borne encephalitis virus
KQRSSDDNKL

SEQ ID NO: 197799 - protein, 10 aa, Tick-borne encephalitis virus
QRSSDDNKLA

SEQ ID NO: 197800 - protein, 10 aa, Tick-borne encephalitis virus
RSSDDNKLAY

SEQ ID NO: 197801 - protein, 10 aa, Tick-borne encephalitis virus
SSDDNKLAYF

SEQ ID NO: 197802 - protein, 10 aa, Tick-borne encephalitis virus
SDDNKLAYFL

SEQ ID NO: 197803 - protein, 10 aa, Tick-borne encephalitis virus
DDNKLAYFLL

SEQ ID NO: 197804 - protein, 10 aa, Tick-borne encephalitis virus
DNKLAYFLLT

SEQ ID NO: 197805 - protein, 10 aa, Tick-borne encephalitis virus
NKLAYFLLTL

SEQ ID NO: 197806 - protein, 10 aa, Tick-borne encephalitis virus
KLAYFLLTLC

SEQ ID NO: 197807 - protein, 10 aa, Tick-borne encephalitis virus
LAYFLLTLCS

SEQ ID NO: 197808 - protein, 10 aa, Tick-borne encephalitis virus
AYFLLTLCSL

SEQ ID NO: 197809 - protein, 10 aa, Tick-borne encephalitis virus
YFLLTLCSLA

SEQ ID NO: 197810 - protein, 10 aa, Tick-borne encephalitis virus
FLLTLCSLAG

SEQ ID NO: 197811 - protein, 10 aa, Tick-borne encephalitis virus
LLTLCSLAGL

SEQ ID NO: 197812 - protein, 10 aa, Tick-borne encephalitis virus
LTLCSLAGLV

SEQ ID NO: 197813 - protein, 10 aa, Tick-borne encephalitis virus
TLCSLAGLVA

SEQ ID NO: 197814 - protein, 10 aa, Tick-borne encephalitis virus
LCSLAGLVAA

SEQ ID NO: 197815 - protein, 10 aa, Tick-borne encephalitis virus
CSLAGLVAAN

SEQ ID NO: 197816 - protein, 10 aa, Tick-borne encephalitis virus
SLAGLVAANE

SEQ ID NO: 197817 - protein, 10 aa, Tick-borne encephalitis virus
LAGLVAANEM

SEQ ID NO: 197818 - protein, 10 aa, Tick-borne encephalitis virus
AGLVAANEMG

SEQ ID NO: 197819 - protein, 10 aa, Tick-borne encephalitis virus
GLVAANEMGF

SEQ ID NO: 197820 - protein, 10 aa, Tick-borne encephalitis virus
LVAANEMGFL

SEQ ID NO: 197821 - protein, 10 aa, Tick-borne encephalitis virus
VAANEMGFLE

SEQ ID NO: 197822 - protein, 10 aa, Tick-borne encephalitis virus
AANEMGFLEK

SEQ ID NO: 197823 - protein, 10 aa, Tick-borne encephalitis virus
ANEMGFLEKT

SEQ ID NO: 197824 - protein, 10 aa, Tick-borne encephalitis virus
NEMGFLEKTK

SEQ ID NO: 197825 - protein, 10 aa, Tick-borne encephalitis virus
EMGFLEKTKA

SEQ ID NO: 197826 - protein, 10 aa, Tick-borne encephalitis virus
MGFLEKTKAD

SEQ ID NO: 197827 - protein, 10 aa, Tick-borne encephalitis virus
GFLEKTKADL

SEQ ID NO: 197828 - protein, 10 aa, Tick-borne encephalitis virus
FLEKTKADLS

SEQ ID NO: 197829 - protein, 10 aa, Tick-borne encephalitis virus
LEKTKADLST

SEQ ID NO: 197830 - protein, 10 aa, Tick-borne encephalitis virus
EKTKADLSTV

SEQ ID NO: 197831 - protein, 10 aa, Tick-borne encephalitis virus
KTKADLSTVL

SEQ ID NO: 197832 - protein, 10 aa, Tick-borne encephalitis virus
TKADLSTVLW

SEQ ID NO: 197833 - protein, 10 aa, Tick-borne encephalitis virus
KADLSTVLWS

SEQ ID NO: 197834 - protein, 10 aa, Tick-borne encephalitis virus
ELRSWEEWTN

SEQ ID NO: 197835 - protein, 10 aa, Tick-borne encephalitis virus
LRSWEEWTNI

SEQ ID NO: 197836 - protein, 10 aa, Tick-borne encephalitis virus
RSWEEWTNID

SEQ ID NO: 197837 - protein, 10 aa, Tick-borne encephalitis virus
SWEEWTNIDI

SEQ ID NO: 197838 - protein, 10 aa, Tick-borne encephalitis virus
WEEWTNIDIQ

SEQ ID NO: 197839 - protein, 10 aa, Tick-borne encephalitis virus
EEWTNIDIQP

SEQ ID NO: 197840 - protein, 10 aa, Tick-borne encephalitis virus
EWTNIDIQPA

SEQ ID NO: 197841 - protein, 10 aa, Tick-borne encephalitis virus
WTNIDIQPAR

SEQ ID NO: 197842 - protein, 10 aa, Tick-borne encephalitis virus
TNIDIQPARS

SEQ ID NO: 197843 - protein, 10 aa, Tick-borne encephalitis virus
NIDIQPARSW

SEQ ID NO: 197844 - protein, 10 aa, Tick-borne encephalitis virus
IDIQPARSWG

SEQ ID NO: 197845 - protein, 10 aa, Tick-borne encephalitis virus
DIQPARSWGT

SEQ ID NO: 197846 - protein, 10 aa, Tick-borne encephalitis virus
IQPARSWGTY

SEQ ID NO: 197847 - protein, 10 aa, Tick-borne encephalitis virus
QPARSWGTYV

SEQ ID NO: 197848 - protein, 10 aa, Tick-borne encephalitis virus
PARSWGTYVL

SEQ ID NO: 197849 - protein, 10 aa, Tick-borne encephalitis virus
ARSWGTYVLV

SEQ ID NO: 197850 - protein, 10 aa, Tick-borne encephalitis virus
RSWGTYVLVV

SEQ ID NO: 197851 - protein, 10 aa, Tick-borne encephalitis virus
SWGTYVLVVS

SEQ ID NO: 197852 - protein, 10 aa, Tick-borne encephalitis virus
WGTYVLVVSL

SEQ ID NO: 197853 - protein, 10 aa, Tick-borne encephalitis virus
GTYVLVVSLF

SEQ ID NO: 197854 - protein, 10 aa, Tick-borne encephalitis virus
TYVLVVSLFT

SEQ ID NO: 197855 - protein, 10 aa, Tick-borne encephalitis virus
YVLVVSLFTP

SEQ ID NO: 197856 - protein, 10 aa, Tick-borne encephalitis virus
VLVVSLFTPY

SEQ ID NO: 197857 - protein, 10 aa, Tick-borne encephalitis virus
LVVSLFTPYI

SEQ ID NO: 197858 - protein, 10 aa, Tick-borne encephalitis virus
VVSLFTPYII

SEQ ID NO: 197859 - protein, 10 aa, Tick-borne encephalitis virus
VSLFTPYIIH

SEQ ID NO: 197860 - protein, 10 aa, Tick-borne encephalitis virus
SLFTPYIIHQ

SEQ ID NO: 197861 - protein, 10 aa, Tick-borne encephalitis virus
LFTPYIIHQL

SEQ ID NO: 197862 - protein, 10 aa, Tick-borne encephalitis virus
FTPYIIHQLQ

SEQ ID NO: 197863 - protein, 10 aa, Tick-borne encephalitis virus
TPYIIHQLQT

SEQ ID NO: 197864 - protein, 10 aa, Tick-borne encephalitis virus
PYIIHQLQTK

SEQ ID NO: 197865 - protein, 10 aa, Tick-borne encephalitis virus
YIIHQLQTKI

SEQ ID NO: 197866 - protein, 10 aa, Tick-borne encephalitis virus
IIHQLQTKIQ

SEQ ID NO: 197867 - protein, 10 aa, Tick-borne encephalitis virus
IHQLQTKIQQ

SEQ ID NO: 197868 - protein, 10 aa, Tick-borne encephalitis virus
HQLQTKIQQL

SEQ ID NO: 197869 - protein, 10 aa, Tick-borne encephalitis virus
QLQTKIQQLV

SEQ ID NO: 197870 - protein, 10 aa, Tick-borne encephalitis virus
LQTKIQQLVN

SEQ ID NO: 197871 - protein, 10 aa, Tick-borne encephalitis virus
QTKIQQLVNS

SEQ ID NO: 197872 - protein, 10 aa, Tick-borne encephalitis virus
TKIQQLVNSA

SEQ ID NO: 197873 - protein, 10 aa, Tick-borne encephalitis virus
KIQQLVNSAV

SEQ ID NO: 197874 - protein, 10 aa, Tick-borne encephalitis virus
IQQLVNSAVA

SEQ ID NO: 197875 - protein, 10 aa, Tick-borne encephalitis virus
QQLVNSAVAT

SEQ ID NO: 197876 - protein, 10 aa, Tick-borne encephalitis virus
QLVNSAVATG

SEQ ID NO: 197877 - protein, 10 aa, Tick-borne encephalitis virus
LVNSAVATGA

SEQ ID NO: 197878 - protein, 10 aa, Tick-borne encephalitis virus
VNSAVATGAQ

SEQ ID NO: 197879 - protein, 10 aa, Tick-borne encephalitis virus
NSAVATGAQA

SEQ ID NO: 197880 - protein, 10 aa, Tick-borne encephalitis virus
SAVATGAQAM

SEQ ID NO: 197881 - protein, 10 aa, Tick-borne encephalitis virus
AVATGAQAMR

SEQ ID NO: 197882 - protein, 10 aa, Tick-borne encephalitis virus
VATGAQAMRD

SEQ ID NO: 197883 - protein, 10 aa, Tick-borne encephalitis virus
ATGAQAMRDL

SEQ ID NO: 197884 - protein, 10 aa, Tick-borne encephalitis virus
TGAQAMRDLG

SEQ ID NO: 197885 - protein, 10 aa, Tick-borne encephalitis virus
GAQAMRDLGG

SEQ ID NO: 197886 - protein, 10 aa, Tick-borne encephalitis virus
AQAMRDLGGG

SEQ ID NO: 197887 - protein, 10 aa, Tick-borne encephalitis virus
QAMRDLGGGA

SEQ ID NO: 197888 - protein, 10 aa, Tick-borne encephalitis virus
AMRDLGGGAP

SEQ ID NO: 197889 - protein, 10 aa, Tick-borne encephalitis virus
MRDLGGGAPF

SEQ ID NO: 197890 - protein, 10 aa, Tick-borne encephalitis virus
RDLGGGAPFF

SEQ ID NO: 197891 - protein, 10 aa, Tick-borne encephalitis virus
DLGGGAPFFG

SEQ ID NO: 197892 - protein, 10 aa, Tick-borne encephalitis virus
LGGGAPFFGV

SEQ ID NO: 197893 - protein, 10 aa, Tick-borne encephalitis virus
GGGAPFFGVA

SEQ ID NO: 197894 - protein, 10 aa, Tick-borne encephalitis virus
GGAPFFGVAG

SEQ ID NO: 197895 - protein, 10 aa, Tick-borne encephalitis virus
GAPFFGVAGH

SEQ ID NO: 197896 - protein, 10 aa, Tick-borne encephalitis virus
APFFGVAGHV

SEQ ID NO: 197897 - protein, 10 aa, Tick-borne encephalitis virus
PFFGVAGHVM

SEQ ID NO: 197898 - protein, 10 aa, Tick-borne encephalitis virus
GVAGHVMALG

SEQ ID NO: 197899 - protein, 10 aa, Tick-borne encephalitis virus
VAGHVMALGV

SEQ ID NO: 197900 - protein, 10 aa, Tick-borne encephalitis virus
AGHVMALGVV

SEQ ID NO: 197901 - protein, 10 aa, Tick-borne encephalitis virus
GHVMALGVVS

SEQ ID NO: 197902 - protein, 10 aa, Tick-borne encephalitis virus
HVMALGVVSL

SEQ ID NO: 197903 - protein, 10 aa, Tick-borne encephalitis virus
VMALGVVSLV

SEQ ID NO: 197904 - protein, 10 aa, Tick-borne encephalitis virus
MALGVVSLVG

SEQ ID NO: 197905 - protein, 10 aa, Tick-borne encephalitis virus
ALGVVSLVGA

SEQ ID NO: 197906 - protein, 10 aa, Tick-borne encephalitis virus
LGVVSLVGAT

SEQ ID NO: 197907 - protein, 10 aa, Tick-borne encephalitis virus
GVVSLVGATP

SEQ ID NO: 197908 - protein, 10 aa, Tick-borne encephalitis virus
VVSLVGATPT

SEQ ID NO: 197909 - protein, 10 aa, Tick-borne encephalitis virus
VSLVGATPTS

SEQ ID NO: 197910 - protein, 10 aa, Tick-borne encephalitis virus
SLVGATPTSL

SEQ ID NO: 197911 - protein, 10 aa, Tick-borne encephalitis virus
LVGATPTSLV

SEQ ID NO: 197912 - protein, 10 aa, Tick-borne encephalitis virus
VGATPTSLVV

SEQ ID NO: 197913 - protein, 10 aa, Tick-borne encephalitis virus
GATPTSLVVG

SEQ ID NO: 197914 - protein, 10 aa, Tick-borne encephalitis virus
ATPTSLVVGV

SEQ ID NO: 197915 - protein, 10 aa, Tick-borne encephalitis virus
TPTSLVVGVG

SEQ ID NO: 197916 - protein, 10 aa, Tick-borne encephalitis virus
PTSLVVGVGL

SEQ ID NO: 197917 - protein, 10 aa, Tick-borne encephalitis virus
TSLVVGVGLA

SEQ ID NO: 197918 - protein, 10 aa, Tick-borne encephalitis virus
SLVVGVGLAA

SEQ ID NO: 197919 - protein, 10 aa, Tick-borne encephalitis virus
LVVGVGLAAF

SEQ ID NO: 197920 - protein, 10 aa, Tick-borne encephalitis virus
VVGVGLAAFH

SEQ ID NO: 197921 - protein, 10 aa, Tick-borne encephalitis virus
VGVGLAAFHL

SEQ ID NO: 197922 - protein, 10 aa, Tick-borne encephalitis virus
GVGLAAFHLA

SEQ ID NO: 197923 - protein, 10 aa, Tick-borne encephalitis virus
VGLAAFHLAI

SEQ ID NO: 197924 - protein, 10 aa, Tick-borne encephalitis virus
GLAAFHLAIV

SEQ ID NO: 197925 - protein, 10 aa, Tick-borne encephalitis virus
LAAFHLAIVV

SEQ ID NO: 197926 - protein, 10 aa, Tick-borne encephalitis virus
AAFHLAIVVS

SEQ ID NO: 197927 - protein, 10 aa, Tick-borne encephalitis virus
AFHLAIVVSG

SEQ ID NO: 197928 - protein, 10 aa, Tick-borne encephalitis virus
FHLAIVVSGL

SEQ ID NO: 197929 - protein, 10 aa, Tick-borne encephalitis virus
HLAIVVSGLE

SEQ ID NO: 197930 - protein, 10 aa, Tick-borne encephalitis virus
LAIVVSGLEA

SEQ ID NO: 197931 - protein, 10 aa, Tick-borne encephalitis virus
AIVVSGLEAE

SEQ ID NO: 197932 - protein, 10 aa, Tick-borne encephalitis virus
IVVSGLEAEL

SEQ ID NO: 197933 - protein, 10 aa, Tick-borne encephalitis virus
VVSGLEAELT

SEQ ID NO: 197934 - protein, 10 aa, Tick-borne encephalitis virus
VSGLEAELTQ

SEQ ID NO: 197935 - protein, 10 aa, Tick-borne encephalitis virus
SGLEAELTQR

SEQ ID NO: 197936 - protein, 10 aa, Tick-borne encephalitis virus
GLEAELTQRA

SEQ ID NO: 197937 - protein, 10 aa, Tick-borne encephalitis virus
LEAELTQRAH

SEQ ID NO: 197938 - protein, 10 aa, Tick-borne encephalitis virus
EAELTQRAHK

SEQ ID NO: 197939 - protein, 10 aa, Tick-borne encephalitis virus
AELTQRAHKV

SEQ ID NO: 197940 - protein, 10 aa, Tick-borne encephalitis virus
ELTQRAHKVF

SEQ ID NO: 197941 - protein, 10 aa, Tick-borne encephalitis virus
LTQRAHKVFF

SEQ ID NO: 197942 - protein, 10 aa, Tick-borne encephalitis virus
TQRAHKVFFS

SEQ ID NO: 197943 - protein, 10 aa, Tick-borne encephalitis virus
QRAHKVFFSA

SEQ ID NO: 197944 - protein, 10 aa, Tick-borne encephalitis virus
RAHKVFFSAM

SEQ ID NO: 197945 - protein, 10 aa, Tick-borne encephalitis virus
AHKVFFSAMV

SEQ ID NO: 197946 - protein, 10 aa, Tick-borne encephalitis virus
HKVFFSAMVR

SEQ ID NO: 197947 - protein, 10 aa, Tick-borne encephalitis virus
KVFFSAMVRN

SEQ ID NO: 197948 - protein, 10 aa, Tick-borne encephalitis virus
VFFSAMVRNP

SEQ ID NO: 197949 - protein, 10 aa, Tick-borne encephalitis virus
FFSAMVRNPM

SEQ ID NO: 197950 - protein, 10 aa, Tick-borne encephalitis virus
FSAMVRNPMV

SEQ ID NO: 197951 - protein, 10 aa, Tick-borne encephalitis virus
SAMVRNPMVD

SEQ ID NO: 197952 - protein, 10 aa, Tick-borne encephalitis virus
AMVRNPMVDG

SEQ ID NO: 197953 - protein, 10 aa, Tick-borne encephalitis virus
MVRNPMVDGD

SEQ ID NO: 197954 - protein, 10 aa, Tick-borne encephalitis virus
VRNPMVDGDV

SEQ ID NO: 197955 - protein, 10 aa, Tick-borne encephalitis virus
RNPMVDGDVI

SEQ ID NO: 197956 - protein, 10 aa, Tick-borne encephalitis virus
NPMVDGDVIN

SEQ ID NO: 197957 - protein, 10 aa, Tick-borne encephalitis virus
PMVDGDVINP

SEQ ID NO: 197958 - protein, 10 aa, Tick-borne encephalitis virus
MVDGDVINPF

SEQ ID NO: 197959 - protein, 10 aa, Tick-borne encephalitis virus
VDGDVINPFG

SEQ ID NO: 197960 - protein, 10 aa, Tick-borne encephalitis virus
DGDVINPFGE

SEQ ID NO: 197961 - protein, 10 aa, Tick-borne encephalitis virus
GDVINPFGEG

SEQ ID NO: 197962 - protein, 10 aa, Tick-borne encephalitis virus
DVINPFGEGE

SEQ ID NO: 197963 - protein, 10 aa, Tick-borne encephalitis virus
VINPFGEGEA

SEQ ID NO: 197964 - protein, 10 aa, Tick-borne encephalitis virus
INPFGEGEAK

SEQ ID NO: 197965 - protein, 10 aa, Tick-borne encephalitis virus
NPFGEGEAKP

SEQ ID NO: 197966 - protein, 10 aa, Tick-borne encephalitis virus
PFGEGEAKPA

SEQ ID NO: 197967 - protein, 10 aa, Tick-borne encephalitis virus
FGEGEAKPAL

SEQ ID NO: 197968 - protein, 10 aa, Tick-borne encephalitis virus
GEGEAKPALY

SEQ ID NO: 197969 - protein, 10 aa, Tick-borne encephalitis virus
EGEAKPALYE

SEQ ID NO: 197970 - protein, 10 aa, Tick-borne encephalitis virus
GEAKPALYER

SEQ ID NO: 197971 - protein, 10 aa, Tick-borne encephalitis virus
EAKPALYERK

SEQ ID NO: 197972 - protein, 10 aa, Tick-borne encephalitis virus
AKPALYERKM

SEQ ID NO: 197973 - protein, 10 aa, Tick-borne encephalitis virus
KPALYERKMS

SEQ ID NO: 197974 - protein, 10 aa, Tick-borne encephalitis virus
PALYERKMSL

SEQ ID NO: 197975 - protein, 10 aa, Tick-borne encephalitis virus
ALYERKMSLV

SEQ ID NO: 197976 - protein, 10 aa, Tick-borne encephalitis virus
LYERKMSLVL

SEQ ID NO: 197977 - protein, 10 aa, Tick-borne encephalitis virus
YERKMSLVLA

SEQ ID NO: 197978 - protein, 10 aa, Tick-borne encephalitis virus
ERKMSLVLAI

SEQ ID NO: 197979 - protein, 10 aa, Tick-borne encephalitis virus
MSLVLAIVLC

SEQ ID NO: 197980 - protein, 10 aa, Tick-borne encephalitis virus
SLVLAIVLCL

SEQ ID NO: 197981 - protein, 10 aa, Tick-borne encephalitis virus
VLCLMSVVMN

SEQ ID NO: 197982 - protein, 10 aa, Tick-borne encephalitis virus
LCLMSVVMNR

SEQ ID NO: 197983 - protein, 10 aa, Tick-borne encephalitis virus
CLMSVVMNRT

SEQ ID NO: 197984 - protein, 10 aa, Tick-borne encephalitis virus
LMSVVMNRTV

SEQ ID NO: 197985 - protein, 10 aa, Tick-borne encephalitis virus
SVVMNRTVPS

SEQ ID NO: 197986 - protein, 10 aa, Tick-borne encephalitis virus
VVMNRTVPSI

SEQ ID NO: 197987 - protein, 10 aa, Tick-borne encephalitis virus
VMNRTVPSIT

SEQ ID NO: 197988 - protein, 10 aa, Tick-borne encephalitis virus
MNRTVPSITE

SEQ ID NO: 197989 - protein, 10 aa, Tick-borne encephalitis virus
NRTVPSITEA

SEQ ID NO: 197990 - protein, 10 aa, Tick-borne encephalitis virus
RTVPSITEAS

SEQ ID NO: 197991 - protein, 10 aa, Tick-borne encephalitis virus
TVPSITEASA

SEQ ID NO: 197992 - protein, 10 aa, Tick-borne encephalitis virus
VPSITEASAV

SEQ ID NO: 197993 - protein, 10 aa, Tick-borne encephalitis virus
PSITEASAVG

SEQ ID NO: 197994 - protein, 10 aa, Tick-borne encephalitis virus
SITEASAVGL

SEQ ID NO: 197995 - protein, 10 aa, Tick-borne encephalitis virus
ITEASAVGLA

SEQ ID NO: 197996 - protein, 10 aa, Tick-borne encephalitis virus
TEASAVGLAA

SEQ ID NO: 197997 - protein, 10 aa, Tick-borne encephalitis virus
EASAVGLAAA

SEQ ID NO: 197998 - protein, 10 aa, Tick-borne encephalitis virus
ASAVGLAAAG

SEQ ID NO: 197999 - protein, 10 aa, Tick-borne encephalitis virus
SAVGLAAAGQ

SEQ ID NO: 198000 - protein, 10 aa, Tick-borne encephalitis virus
AVGLAAAGQL

SEQ ID NO: 198001 - protein, 10 aa, Tick-borne encephalitis virus
VGLAAAGQLL

SEQ ID NO: 198002 - protein, 10 aa, Tick-borne encephalitis virus
GLAAAGQLLR

SEQ ID NO: 198003 - protein, 10 aa, Tick-borne encephalitis virus
LAAAGQLLRP

SEQ ID NO: 198004 - protein, 10 aa, Tick-borne encephalitis virus
AAAGQLLRPE

SEQ ID NO: 198005 - protein, 10 aa, Tick-borne encephalitis virus
GQLLRPEADT

SEQ ID NO: 198006 - protein, 10 aa, Tick-borne encephalitis virus
QLLRPEADTL

SEQ ID NO: 198007 - protein, 10 aa, Tick-borne encephalitis virus
LLRPEADTLW

SEQ ID NO: 198008 - protein, 10 aa, Tick-borne encephalitis virus
LRPEADTLWT

SEQ ID NO: 198009 - protein, 10 aa, Tick-borne encephalitis virus
RPEADTLWTM

SEQ ID NO: 198010 - protein, 10 aa, Tick-borne encephalitis virus
PEADTLWTMP

SEQ ID NO: 198011 - protein, 10 aa, Tick-borne encephalitis virus
EADTLWTMPV

SEQ ID NO: 198012 - protein, 10 aa, Tick-borne encephalitis virus
ADTLWTMPVA

SEQ ID NO: 198013 - protein, 10 aa, Tick-borne encephalitis virus
DTLWTMPVAC

SEQ ID NO: 198014 - protein, 10 aa, Tick-borne encephalitis virus
TLWTMPVACG

SEQ ID NO: 198015 - protein, 10 aa, Tick-borne encephalitis virus
LWTMPVACGL

SEQ ID NO: 198016 - protein, 10 aa, Tick-borne encephalitis virus
WTMPVACGLS

SEQ ID NO: 198017 - protein, 10 aa, Tick-borne encephalitis virus
TMPVACGLSG

SEQ ID NO: 198018 - protein, 10 aa, Tick-borne encephalitis virus
MPVACGLSGV

SEQ ID NO: 198019 - protein, 10 aa, Tick-borne encephalitis virus
PVACGLSGVV

SEQ ID NO: 198020 - protein, 10 aa, Tick-borne encephalitis virus
VACGLSGVVR

SEQ ID NO: 198021 - protein, 10 aa, Tick-borne encephalitis virus
ACGLSGVVRG

SEQ ID NO: 198022 - protein, 10 aa, Tick-borne encephalitis virus
CGLSGVVRGS

SEQ ID NO: 198023 - protein, 10 aa, Tick-borne encephalitis virus
GLSGVVRGSL

SEQ ID NO: 198024 - protein, 10 aa, Tick-borne encephalitis virus
LSGVVRGSLW

SEQ ID NO: 198025 - protein, 10 aa, Tick-borne encephalitis virus
SGVVRGSLWG

SEQ ID NO: 198026 - protein, 10 aa, Tick-borne encephalitis virus
GVVRGSLWGF

SEQ ID NO: 198027 - protein, 10 aa, Tick-borne encephalitis virus
VVRGSLWGFL

SEQ ID NO: 198028 - protein, 10 aa, Tick-borne encephalitis virus
VRGSLWGFLP

SEQ ID NO: 198029 - protein, 10 aa, Tick-borne encephalitis virus
RGSLWGFLPL

SEQ ID NO: 198030 - protein, 10 aa, Tick-borne encephalitis virus
GSLWGFLPLG

SEQ ID NO: 198031 - protein, 10 aa, Tick-borne encephalitis virus
SLWGFLPLGH

SEQ ID NO: 198032 - protein, 10 aa, Tick-borne encephalitis virus
LWGFLPLGHR

SEQ ID NO: 198033 - protein, 10 aa, Tick-borne encephalitis virus
WGFLPLGHRL

SEQ ID NO: 198034 - protein, 10 aa, Tick-borne encephalitis virus
GFLPLGHRLW

SEQ ID NO: 198035 - protein, 10 aa, Tick-borne encephalitis virus
FLPLGHRLWL

SEQ ID NO: 198036 - protein, 10 aa, Tick-borne encephalitis virus
LPLGHRLWLR

SEQ ID NO: 198037 - protein, 10 aa, Tick-borne encephalitis virus
PLGHRLWLRA

SEQ ID NO: 198038 - protein, 10 aa, Tick-borne encephalitis virus
LGHRLWLRAS

SEQ ID NO: 198039 - protein, 10 aa, Tick-borne encephalitis virus
GHRLWLRASG

SEQ ID NO: 198040 - protein, 10 aa, Tick-borne encephalitis virus
HRLWLRASGS

SEQ ID NO: 198041 - protein, 10 aa, Tick-borne encephalitis virus
RLWLRASGSR

SEQ ID NO: 198042 - protein, 10 aa, Tick-borne encephalitis virus
LWLRASGSRR

SEQ ID NO: 198043 - protein, 10 aa, Tick-borne encephalitis virus
WLRASGSRRG

SEQ ID NO: 198044 - protein, 10 aa, Tick-borne encephalitis virus
LRASGSRRGG

SEQ ID NO: 198045 - protein, 10 aa, Tick-borne encephalitis virus
RASGSRRGGS

SEQ ID NO: 198046 - protein, 10 aa, Tick-borne encephalitis virus
ASGSRRGGSE

SEQ ID NO: 198047 - protein, 10 aa, Tick-borne encephalitis virus
SGSRRGGSEG

SEQ ID NO: 198048 - protein, 10 aa, Tick-borne encephalitis virus
GSRRGGSEGD

SEQ ID NO: 198049 - protein, 10 aa, Tick-borne encephalitis virus
SRRGGSEGDT

SEQ ID NO: 198050 - protein, 10 aa, Tick-borne encephalitis virus
RRGGSEGDTL

SEQ ID NO: 198051 - protein, 10 aa, Tick-borne encephalitis virus
RGGSEGDTLG

SEQ ID NO: 198052 - protein, 10 aa, Tick-borne encephalitis virus
GGSEGDTLGD

SEQ ID NO: 198053 - protein, 10 aa, Tick-borne encephalitis virus
GSEGDTLGDL

SEQ ID NO: 198054 - protein, 10 aa, Tick-borne encephalitis virus
SEGDTLGDLW

SEQ ID NO: 198055 - protein, 10 aa, Tick-borne encephalitis virus
EGDTLGDLWK

SEQ ID NO: 198056 - protein, 10 aa, Tick-borne encephalitis virus
GDTLGDLWKR

SEQ ID NO: 198057 - protein, 10 aa, Tick-borne encephalitis virus
DTLGDLWKRK

SEQ ID NO: 198058 - protein, 10 aa, Tick-borne encephalitis virus
TLGDLWKRKL

SEQ ID NO: 198059 - protein, 10 aa, Tick-borne encephalitis virus
LGDLWKRKLN

SEQ ID NO: 198060 - protein, 10 aa, Tick-borne encephalitis virus
LNGCTKEEFF

SEQ ID NO: 198061 - protein, 10 aa, Tick-borne encephalitis virus
NGCTKEEFFA

SEQ ID NO: 198062 - protein, 10 aa, Tick-borne encephalitis virus
GCTKEEFFAY

SEQ ID NO: 198063 - protein, 10 aa, Tick-borne encephalitis virus
CTKEEFFAYR

SEQ ID NO: 198064 - protein, 10 aa, Tick-borne encephalitis virus
TKEEFFAYRR

SEQ ID NO: 198065 - protein, 10 aa, Tick-borne encephalitis virus
EEFFAYRRTG

SEQ ID NO: 198066 - protein, 10 aa, Tick-borne encephalitis virus
EFFAYRRTGI

SEQ ID NO: 198067 - protein, 10 aa, Tick-borne encephalitis virus
FFAYRRTGIL

SEQ ID NO: 198068 - protein, 10 aa, Tick-borne encephalitis virus
FAYRRTGILE

SEQ ID NO: 198069 - protein, 10 aa, Tick-borne encephalitis virus
AYRRTGILET

SEQ ID NO: 198070 - protein, 10 aa, Tick-borne encephalitis virus
YRRTGILETE

SEQ ID NO: 198071 - protein, 10 aa, Tick-borne encephalitis virus
RRTGILETER

SEQ ID NO: 198072 - protein, 10 aa, Tick-borne encephalitis virus
RTGILETERD

SEQ ID NO: 198073 - protein, 10 aa, Tick-borne encephalitis virus
TGILETERDK

SEQ ID NO: 198074 - protein, 10 aa, Tick-borne encephalitis virus
GILETERDKA

SEQ ID NO: 198075 - protein, 10 aa, Tick-borne encephalitis virus
ILETERDKAR

SEQ ID NO: 198076 - protein, 10 aa, Tick-borne encephalitis virus
LETERDKARE

SEQ ID NO: 198077 - protein, 10 aa, Tick-borne encephalitis virus
ETERDKAREL

SEQ ID NO: 198078 - protein, 10 aa, Tick-borne encephalitis virus
TERDKARELL

SEQ ID NO: 198079 - protein, 10 aa, Tick-borne encephalitis virus
ERDKARELLR

SEQ ID NO: 198080 - protein, 10 aa, Tick-borne encephalitis virus
RDKARELLRR

SEQ ID NO: 198081 - protein, 10 aa, Tick-borne encephalitis virus
DKARELLRRG

SEQ ID NO: 198082 - protein, 10 aa, Tick-borne encephalitis virus
KARELLRRGE

SEQ ID NO: 198083 - protein, 10 aa, Tick-borne encephalitis virus
ARELLRRGET

SEQ ID NO: 198084 - protein, 10 aa, Tick-borne encephalitis virus
RELLRRGETN

SEQ ID NO: 198085 - protein, 10 aa, Tick-borne encephalitis virus
RGETNMGLAV

SEQ ID NO: 198086 - protein, 10 aa, Tick-borne encephalitis virus
GETNMGLAVS

SEQ ID NO: 198087 - protein, 10 aa, Tick-borne encephalitis virus
ETNMGLAVSR

SEQ ID NO: 198088 - protein, 10 aa, Tick-borne encephalitis virus
TNMGLAVSRG

SEQ ID NO: 198089 - protein, 10 aa, Tick-borne encephalitis virus
NMGLAVSRGT

SEQ ID NO: 198090 - protein, 10 aa, Tick-borne encephalitis virus
MGLAVSRGTA

SEQ ID NO: 198091 - protein, 10 aa, Tick-borne encephalitis virus
GLAVSRGTAK

SEQ ID NO: 198092 - protein, 10 aa, Tick-borne encephalitis virus
LAVSRGTAKL

SEQ ID NO: 198093 - protein, 10 aa, Tick-borne encephalitis virus
AVSRGTAKLA

SEQ ID NO: 198094 - protein, 10 aa, Tick-borne encephalitis virus
VSRGTAKLAW

SEQ ID NO: 198095 - protein, 10 aa, Tick-borne encephalitis virus
SRGTAKLAWL

SEQ ID NO: 198096 - protein, 10 aa, Tick-borne encephalitis virus
RGTAKLAWLE

SEQ ID NO: 198097 - protein, 10 aa, Tick-borne encephalitis virus
GTAKLAWLEE

SEQ ID NO: 198098 - protein, 10 aa, Tick-borne encephalitis virus
TAKLAWLEER

SEQ ID NO: 198099 - protein, 10 aa, Tick-borne encephalitis virus
AKLAWLEERG

SEQ ID NO: 198100 - protein, 10 aa, Tick-borne encephalitis virus
KLAWLEERGY

SEQ ID NO: 198101 - protein, 10 aa, Tick-borne encephalitis virus
LAWLEERGYA

SEQ ID NO: 198102 - protein, 10 aa, Tick-borne encephalitis virus
AWLEERGYAT

SEQ ID NO: 198103 - protein, 10 aa, Tick-borne encephalitis virus
WLEERGYATL

SEQ ID NO: 198104 - protein, 10 aa, Tick-borne encephalitis virus
LEERGYATLK

SEQ ID NO: 198105 - protein, 10 aa, Tick-borne encephalitis virus
EERGYATLKG

SEQ ID NO: 198106 - protein, 10 aa, Tick-borne encephalitis virus
ERGYATLKGE

SEQ ID NO: 198107 - protein, 10 aa, Tick-borne encephalitis virus
RGYATLKGEV

SEQ ID NO: 198108 - protein, 10 aa, Tick-borne encephalitis virus
GYATLKGEVV

SEQ ID NO: 198109 - protein, 10 aa, Tick-borne encephalitis virus
YATLKGEVVD

SEQ ID NO: 198110 - protein, 10 aa, Tick-borne encephalitis virus
ATLKGEVVDL

SEQ ID NO: 198111 - protein, 10 aa, Tick-borne encephalitis virus
TLKGEVVDLG

SEQ ID NO: 198112 - protein, 10 aa, Tick-borne encephalitis virus
LKGEVVDLGC

SEQ ID NO: 198113 - protein, 10 aa, Tick-borne encephalitis virus
KGEVVDLGCG

SEQ ID NO: 198114 - protein, 10 aa, Tick-borne encephalitis virus
GEVVDLGCGR

SEQ ID NO: 198115 - protein, 10 aa, Tick-borne encephalitis virus
EVVDLGCGRG

SEQ ID NO: 198116 - protein, 10 aa, Tick-borne encephalitis virus
VVDLGCGRGG

SEQ ID NO: 198117 - protein, 10 aa, Tick-borne encephalitis virus
VDLGCGRGGW

SEQ ID NO: 198118 - protein, 10 aa, Tick-borne encephalitis virus
DLGCGRGGWS

SEQ ID NO: 198119 - protein, 10 aa, Tick-borne encephalitis virus
LGCGRGGWSY

SEQ ID NO: 198120 - protein, 10 aa, Tick-borne encephalitis virus
GCGRGGWSYY

SEQ ID NO: 198121 - protein, 10 aa, Tick-borne encephalitis virus
CGRGGWSYYA

SEQ ID NO: 198122 - protein, 10 aa, Tick-borne encephalitis virus
GRGGWSYYAA

SEQ ID NO: 198123 - protein, 10 aa, Tick-borne encephalitis virus
RGGWSYYAAS

SEQ ID NO: 198124 - protein, 10 aa, Tick-borne encephalitis virus
GGWSYYAASR

SEQ ID NO: 198125 - protein, 10 aa, Tick-borne encephalitis virus
GWSYYAASRP

SEQ ID NO: 198126 - protein, 10 aa, Tick-borne encephalitis virus
WSYYAASRPA

SEQ ID NO: 198127 - protein, 10 aa, Tick-borne encephalitis virus
SYYAASRPAV

SEQ ID NO: 198128 - protein, 10 aa, Tick-borne encephalitis virus
YYAASRPAVM

SEQ ID NO: 198129 - protein, 10 aa, Tick-borne encephalitis virus
YAASRPAVMS

SEQ ID NO: 198130 - protein, 10 aa, Tick-borne encephalitis virus
AASRPAVMSV

SEQ ID NO: 198131 - protein, 10 aa, Tick-borne encephalitis virus
ASRPAVMSVK

SEQ ID NO: 198132 - protein, 10 aa, Tick-borne encephalitis virus
SRPAVMSVKA

SEQ ID NO: 198133 - protein, 10 aa, Tick-borne encephalitis virus
RPAVMSVKAY

SEQ ID NO: 198134 - protein, 10 aa, Tick-borne encephalitis virus
PAVMSVKAYT

SEQ ID NO: 198135 - protein, 10 aa, Tick-borne encephalitis virus
AVMSVKAYTI

SEQ ID NO: 198136 - protein, 10 aa, Tick-borne encephalitis virus
VMSVKAYTIG

SEQ ID NO: 198137 - protein, 10 aa, Tick-borne encephalitis virus
MSVKAYTIGG

SEQ ID NO: 198138 - protein, 10 aa, Tick-borne encephalitis virus
SVKAYTIGGK

SEQ ID NO: 198139 - protein, 10 aa, Tick-borne encephalitis virus
VKAYTIGGKG

SEQ ID NO: 198140 - protein, 10 aa, Tick-borne encephalitis virus
KAYTIGGKGH

SEQ ID NO: 198141 - protein, 10 aa, Tick-borne encephalitis virus
AYTIGGKGHE

SEQ ID NO: 198142 - protein, 10 aa, Tick-borne encephalitis virus
YTIGGKGHET

SEQ ID NO: 198143 - protein, 10 aa, Tick-borne encephalitis virus
TIGGKGHETP

SEQ ID NO: 198144 - protein, 10 aa, Tick-borne encephalitis virus
IGGKGHETPK

SEQ ID NO: 198145 - protein, 10 aa, Tick-borne encephalitis virus
GGKGHETPKM

SEQ ID NO: 198146 - protein, 10 aa, Tick-borne encephalitis virus
GKGHETPKMV

SEQ ID NO: 198147 - protein, 10 aa, Tick-borne encephalitis virus
KGHETPKMVT

SEQ ID NO: 198148 - protein, 10 aa, Tick-borne encephalitis virus
GHETPKMVTS

SEQ ID NO: 198149 - protein, 10 aa, Tick-borne encephalitis virus
HETPKMVTSL

SEQ ID NO: 198150 - protein, 10 aa, Tick-borne encephalitis virus
ETPKMVTSLG

SEQ ID NO: 198151 - protein, 10 aa, Tick-borne encephalitis virus
TPKMVTSLGW

SEQ ID NO: 198152 - protein, 10 aa, Tick-borne encephalitis virus
PKMVTSLGWN

SEQ ID NO: 198153 - protein, 10 aa, Tick-borne encephalitis virus
KMVTSLGWNL

SEQ ID NO: 198154 - protein, 10 aa, Tick-borne encephalitis virus
MVTSLGWNLI

SEQ ID NO: 198155 - protein, 10 aa, Tick-borne encephalitis virus
VTSLGWNLIK

SEQ ID NO: 198156 - protein, 10 aa, Tick-borne encephalitis virus
TSLGWNLIKF

SEQ ID NO: 198157 - protein, 10 aa, Tick-borne encephalitis virus
SLGWNLIKFR

SEQ ID NO: 198158 - protein, 10 aa, Tick-borne encephalitis virus
LGWNLIKFRA

SEQ ID NO: 198159 - protein, 10 aa, Tick-borne encephalitis virus
GWNLIKFRAG

SEQ ID NO: 198160 - protein, 10 aa, Tick-borne encephalitis virus
WNLIKFRAGM

SEQ ID NO: 198161 - protein, 10 aa, Tick-borne encephalitis virus
NLIKFRAGMD

SEQ ID NO: 198162 - protein, 10 aa, Tick-borne encephalitis virus
LIKFRAGMDV

SEQ ID NO: 198163 - protein, 10 aa, Tick-borne encephalitis virus
IKFRAGMDVF

SEQ ID NO: 198164 - protein, 10 aa, Tick-borne encephalitis virus
KFRAGMDVFS

SEQ ID NO: 198165 - protein, 10 aa, Tick-borne encephalitis virus
FRAGMDVFSM

SEQ ID NO: 198166 - protein, 10 aa, Tick-borne encephalitis virus
RAGMDVFSMQ

SEQ ID NO: 198167 - protein, 10 aa, Tick-borne encephalitis virus
AGMDVFSMQP

SEQ ID NO: 198168 - protein, 10 aa, Tick-borne encephalitis virus
GMDVFSMQPH

SEQ ID NO: 198169 - protein, 10 aa, Tick-borne encephalitis virus
MDVFSMQPHR

SEQ ID NO: 198170 - protein, 10 aa, Tick-borne encephalitis virus
DVFSMQPHRA

SEQ ID NO: 198171 - protein, 10 aa, Tick-borne encephalitis virus
VFSMQPHRAD

SEQ ID NO: 198172 - protein, 10 aa, Tick-borne encephalitis virus
FSMQPHRADT

SEQ ID NO: 198173 - protein, 10 aa, Tick-borne encephalitis virus
SMQPHRADTI

SEQ ID NO: 198174 - protein, 10 aa, Tick-borne encephalitis virus
MQPHRADTIM

SEQ ID NO: 198175 - protein, 10 aa, Tick-borne encephalitis virus
QPHRADTIMC

SEQ ID NO: 198176 - protein, 10 aa, Tick-borne encephalitis virus
PHRADTIMCD

SEQ ID NO: 198177 - protein, 10 aa, Tick-borne encephalitis virus
HRADTIMCDI

SEQ ID NO: 198178 - protein, 10 aa, Tick-borne encephalitis virus
RADTIMCDIG

SEQ ID NO: 198179 - protein, 10 aa, Tick-borne encephalitis virus
ADTIMCDIGE

SEQ ID NO: 198180 - protein, 10 aa, Tick-borne encephalitis virus
DTIMCDIGES

SEQ ID NO: 198181 - protein, 10 aa, Tick-borne encephalitis virus
TIMCDIGESN

SEQ ID NO: 198182 - protein, 10 aa, Tick-borne encephalitis virus
IMCDIGESNP

SEQ ID NO: 198183 - protein, 10 aa, Tick-borne encephalitis virus
MCDIGESNPD

SEQ ID NO: 198184 - protein, 10 aa, Tick-borne encephalitis virus
CDIGESNPDA

SEQ ID NO: 198185 - protein, 10 aa, Tick-borne encephalitis virus
DIGESNPDAV

SEQ ID NO: 198186 - protein, 10 aa, Tick-borne encephalitis virus
IGESNPDAVV

SEQ ID NO: 198187 - protein, 10 aa, Tick-borne encephalitis virus
GESNPDAVVE

SEQ ID NO: 198188 - protein, 10 aa, Tick-borne encephalitis virus
ESNPDAVVEG

SEQ ID NO: 198189 - protein, 10 aa, Tick-borne encephalitis virus
SNPDAVVEGE

SEQ ID NO: 198190 - protein, 10 aa, Tick-borne encephalitis virus
NPDAVVEGER

SEQ ID NO: 198191 - protein, 10 aa, Tick-borne encephalitis virus
PDAVVEGERT

SEQ ID NO: 198192 - protein, 10 aa, Tick-borne encephalitis virus
DAVVEGERTR

SEQ ID NO: 198193 - protein, 10 aa, Tick-borne encephalitis virus
AVVEGERTRK

SEQ ID NO: 198194 - protein, 10 aa, Tick-borne encephalitis virus
VVEGERTRKV

SEQ ID NO: 198195 - protein, 10 aa, Tick-borne encephalitis virus
VEGERTRKVI

SEQ ID NO: 198196 - protein, 10 aa, Tick-borne encephalitis virus
EGERTRKVIL

SEQ ID NO: 198197 - protein, 10 aa, Tick-borne encephalitis virus
GERTRKVILL

SEQ ID NO: 198198 - protein, 10 aa, Tick-borne encephalitis virus
ERTRKVILLM

SEQ ID NO: 198199 - protein, 10 aa, Tick-borne encephalitis virus
RTRKVILLME

SEQ ID NO: 198200 - protein, 10 aa, Tick-borne encephalitis virus
TRKVILLMEQ

SEQ ID NO: 198201 - protein, 10 aa, Tick-borne encephalitis virus
RKVILLMEQW

SEQ ID NO: 198202 - protein, 10 aa, Tick-borne encephalitis virus
KVILLMEQWK

SEQ ID NO: 198203 - protein, 10 aa, Tick-borne encephalitis virus
VILLMEQWKN

SEQ ID NO: 198204 - protein, 10 aa, Tick-borne encephalitis virus
ILLMEQWKNR

SEQ ID NO: 198205 - protein, 10 aa, Tick-borne encephalitis virus
LLMEQWKNRN

SEQ ID NO: 198206 - protein, 10 aa, Tick-borne encephalitis virus
LMEQWKNRNP

SEQ ID NO: 198207 - protein, 10 aa, Tick-borne encephalitis virus
MEQWKNRNPT

SEQ ID NO: 198208 - protein, 10 aa, Tick-borne encephalitis virus
EQWKNRNPTA

SEQ ID NO: 198209 - protein, 10 aa, Tick-borne encephalitis virus
QWKNRNPTAT

SEQ ID NO: 198210 - protein, 10 aa, Tick-borne encephalitis virus
WKNRNPTATC

SEQ ID NO: 198211 - protein, 10 aa, Tick-borne encephalitis virus
KNRNPTATCV

SEQ ID NO: 198212 - protein, 10 aa, Tick-borne encephalitis virus
NRNPTATCVF

SEQ ID NO: 198213 - protein, 10 aa, Tick-borne encephalitis virus
RNPTATCVFK

SEQ ID NO: 198214 - protein, 10 aa, Tick-borne encephalitis virus
NPTATCVFKV

SEQ ID NO: 198215 - protein, 10 aa, Tick-borne encephalitis virus
PTATCVFKVL

SEQ ID NO: 198216 - protein, 10 aa, Tick-borne encephalitis virus
TATCVFKVLA

SEQ ID NO: 198217 - protein, 10 aa, Tick-borne encephalitis virus
ATCVFKVLAP

SEQ ID NO: 198218 - protein, 10 aa, Tick-borne encephalitis virus
TCVFKVLAPY

SEQ ID NO: 198219 - protein, 10 aa, Tick-borne encephalitis virus
CVFKVLAPYR

SEQ ID NO: 198220 - protein, 10 aa, Tick-borne encephalitis virus
VFKVLAPYRP

SEQ ID NO: 198221 - protein, 10 aa, Tick-borne encephalitis virus
FKVLAPYRPE

SEQ ID NO: 198222 - protein, 10 aa, Tick-borne encephalitis virus
KVLAPYRPEV

SEQ ID NO: 198223 - protein, 10 aa, Tick-borne encephalitis virus
VLAPYRPEVI

SEQ ID NO: 198224 - protein, 10 aa, Tick-borne encephalitis virus
LAPYRPEVIE

SEQ ID NO: 198225 - protein, 10 aa, Tick-borne encephalitis virus
APYRPEVIEA

SEQ ID NO: 198226 - protein, 10 aa, Tick-borne encephalitis virus
PYRPEVIEAL

SEQ ID NO: 198227 - protein, 10 aa, Tick-borne encephalitis virus
YRPEVIEALH

SEQ ID NO: 198228 - protein, 10 aa, Tick-borne encephalitis virus
RPEVIEALHR

SEQ ID NO: 198229 - protein, 10 aa, Tick-borne encephalitis virus
PEVIEALHRF

SEQ ID NO: 198230 - protein, 10 aa, Tick-borne encephalitis virus
EVIEALHRFQ

SEQ ID NO: 198231 - protein, 10 aa, Tick-borne encephalitis virus
VIEALHRFQL

SEQ ID NO: 198232 - protein, 10 aa, Tick-borne encephalitis virus
IEALHRFQLQ

SEQ ID NO: 198233 - protein, 10 aa, Tick-borne encephalitis virus
EALHRFQLQW

SEQ ID NO: 198234 - protein, 10 aa, Tick-borne encephalitis virus
ALHRFQLQWG

SEQ ID NO: 198235 - protein, 10 aa, Tick-borne encephalitis virus
LHRFQLQWGG

SEQ ID NO: 198236 - protein, 10 aa, Tick-borne encephalitis virus
HRFQLQWGGG

SEQ ID NO: 198237 - protein, 10 aa, Tick-borne encephalitis virus
RFQLQWGGGL

SEQ ID NO: 198238 - protein, 10 aa, Tick-borne encephalitis virus
FQLQWGGGLV

SEQ ID NO: 198239 - protein, 10 aa, Tick-borne encephalitis virus
QLQWGGGLVR

SEQ ID NO: 198240 - protein, 10 aa, Tick-borne encephalitis virus
LQWGGGLVRT

SEQ ID NO: 198241 - protein, 10 aa, Tick-borne encephalitis virus
QWGGGLVRTP

SEQ ID NO: 198242 - protein, 10 aa, Tick-borne encephalitis virus
WGGGLVRTPF

SEQ ID NO: 198243 - protein, 10 aa, Tick-borne encephalitis virus
GGGLVRTPFS

SEQ ID NO: 198244 - protein, 10 aa, Tick-borne encephalitis virus
GGLVRTPFSR

SEQ ID NO: 198245 - protein, 10 aa, Tick-borne encephalitis virus
GLVRTPFSRN

SEQ ID NO: 198246 - protein, 10 aa, Tick-borne encephalitis virus
LVRTPFSRNS

SEQ ID NO: 198247 - protein, 10 aa, Tick-borne encephalitis virus
VRTPFSRNST

SEQ ID NO: 198248 - protein, 10 aa, Tick-borne encephalitis virus
RTPFSRNSTH

SEQ ID NO: 198249 - protein, 10 aa, Tick-borne encephalitis virus
TPFSRNSTHE

SEQ ID NO: 198250 - protein, 10 aa, Tick-borne encephalitis virus
PFSRNSTHEM

SEQ ID NO: 198251 - protein, 10 aa, Tick-borne encephalitis virus
FSRNSTHEMY

SEQ ID NO: 198252 - protein, 10 aa, Tick-borne encephalitis virus
SRNSTHEMYY

SEQ ID NO: 198253 - protein, 10 aa, Tick-borne encephalitis virus
RNSTHEMYYS

SEQ ID NO: 198254 - protein, 10 aa, Tick-borne encephalitis virus
NSTHEMYYST

SEQ ID NO: 198255 - protein, 10 aa, Tick-borne encephalitis virus
STHEMYYSTA

SEQ ID NO: 198256 - protein, 10 aa, Tick-borne encephalitis virus
THEMYYSTAV

SEQ ID NO: 198257 - protein, 10 aa, Tick-borne encephalitis virus
HEMYYSTAVT

SEQ ID NO: 198258 - protein, 10 aa, Tick-borne encephalitis virus
EMYYSTAVTG

SEQ ID NO: 198259 - protein, 10 aa, Tick-borne encephalitis virus
MYYSTAVTGN

SEQ ID NO: 198260 - protein, 10 aa, Tick-borne encephalitis virus
YYSTAVTGNI

SEQ ID NO: 198261 - protein, 10 aa, Tick-borne encephalitis virus
YSTAVTGNIV

SEQ ID NO: 198262 - protein, 10 aa, Tick-borne encephalitis virus
STAVTGNIVN

SEQ ID NO: 198263 - protein, 10 aa, Tick-borne encephalitis virus
TAVTGNIVNS

SEQ ID NO: 198264 - protein, 10 aa, Tick-borne encephalitis virus
AVTGNIVNSV

SEQ ID NO: 198265 - protein, 10 aa, Tick-borne encephalitis virus
VTGNIVNSVN

SEQ ID NO: 198266 - protein, 10 aa, Tick-borne encephalitis virus
TGNIVNSVNI

SEQ ID NO: 198267 - protein, 10 aa, Tick-borne encephalitis virus
GNIVNSVNIQ

SEQ ID NO: 198268 - protein, 10 aa, Tick-borne encephalitis virus
NIVNSVNIQS

SEQ ID NO: 198269 - protein, 10 aa, Tick-borne encephalitis virus
IVNSVNIQSR

SEQ ID NO: 198270 - protein, 10 aa, Tick-borne encephalitis virus
VNSVNIQSRK

SEQ ID NO: 198271 - protein, 10 aa, Tick-borne encephalitis virus
NSVNIQSRKL

SEQ ID NO: 198272 - protein, 10 aa, Tick-borne encephalitis virus
SVNIQSRKLL

SEQ ID NO: 198273 - protein, 10 aa, Tick-borne encephalitis virus
VNIQSRKLLA

SEQ ID NO: 198274 - protein, 10 aa, Tick-borne encephalitis virus
NIQSRKLLAR

SEQ ID NO: 198275 - protein, 10 aa, Tick-borne encephalitis virus
IQSRKLLARF

SEQ ID NO: 198276 - protein, 10 aa, Tick-borne encephalitis virus
QSRKLLARFG

SEQ ID NO: 198277 - protein, 10 aa, Tick-borne encephalitis virus
SRKLLARFGD

SEQ ID NO: 198278 - protein, 10 aa, Tick-borne encephalitis virus
RKLLARFGDQ

SEQ ID NO: 198279 - protein, 10 aa, Tick-borne encephalitis virus
KLLARFGDQR

SEQ ID NO: 198280 - protein, 10 aa, Tick-borne encephalitis virus
LLARFGDQRG

SEQ ID NO: 198281 - protein, 10 aa, Tick-borne encephalitis virus
LARFGDQRGP

SEQ ID NO: 198282 - protein, 10 aa, Tick-borne encephalitis virus
ARFGDQRGPT

SEQ ID NO: 198283 - protein, 10 aa, Tick-borne encephalitis virus
RFGDQRGPTR

SEQ ID NO: 198284 - protein, 10 aa, Tick-borne encephalitis virus
FGDQRGPTRV

SEQ ID NO: 198285 - protein, 10 aa, Tick-borne encephalitis virus
GDQRGPTRVP

SEQ ID NO: 198286 - protein, 10 aa, Tick-borne encephalitis virus
DQRGPTRVPE

SEQ ID NO: 198287 - protein, 10 aa, Tick-borne encephalitis virus
QRGPTRVPEL

SEQ ID NO: 198288 - protein, 10 aa, Tick-borne encephalitis virus
RGPTRVPELD

SEQ ID NO: 198289 - protein, 10 aa, Tick-borne encephalitis virus
GPTRVPELDL

SEQ ID NO: 198290 - protein, 10 aa, Tick-borne encephalitis virus
PTRVPELDLG

SEQ ID NO: 198291 - protein, 10 aa, Tick-borne encephalitis virus
TRVPELDLGV

SEQ ID NO: 198292 - protein, 10 aa, Tick-borne encephalitis virus
RVPELDLGVG

SEQ ID NO: 198293 - protein, 10 aa, Tick-borne encephalitis virus
VPELDLGVGT

SEQ ID NO: 198294 - protein, 10 aa, Tick-borne encephalitis virus
PELDLGVGTR

SEQ ID NO: 198295 - protein, 10 aa, Tick-borne encephalitis virus
ELDLGVGTRC

SEQ ID NO: 198296 - protein, 10 aa, Tick-borne encephalitis virus
LDLGVGTRCV

SEQ ID NO: 198297 - protein, 10 aa, Tick-borne encephalitis virus
DLGVGTRCVV

SEQ ID NO: 198298 - protein, 10 aa, Tick-borne encephalitis virus
LGVGTRCVVL

SEQ ID NO: 198299 - protein, 10 aa, Tick-borne encephalitis virus
GVGTRCVVLA

SEQ ID NO: 198300 - protein, 10 aa, Tick-borne encephalitis virus
VGTRCVVLAE

SEQ ID NO: 198301 - protein, 10 aa, Tick-borne encephalitis virus
GTRCVVLAED

SEQ ID NO: 198302 - protein, 10 aa, Tick-borne encephalitis virus
TRCVVLAEDK

SEQ ID NO: 198303 - protein, 10 aa, Tick-borne encephalitis virus
RCVVLAEDKV

SEQ ID NO: 198304 - protein, 10 aa, Tick-borne encephalitis virus
CVVLAEDKVK

SEQ ID NO: 198305 - protein, 10 aa, Tick-borne encephalitis virus
VVLAEDKVKE

SEQ ID NO: 198306 - protein, 10 aa, Tick-borne encephalitis virus
LAEDKVKEKD

SEQ ID NO: 198307 - protein, 10 aa, Tick-borne encephalitis virus
AEDKVKEKDV

SEQ ID NO: 198308 - protein, 10 aa, Tick-borne encephalitis virus
DKVKEKDVQE

SEQ ID NO: 198309 - protein, 10 aa, Tick-borne encephalitis virus
KVKEKDVQER

SEQ ID NO: 198310 - protein, 10 aa, Tick-borne encephalitis virus
VKEKDVQERI

SEQ ID NO: 198311 - protein, 10 aa, Tick-borne encephalitis virus
ERISALREQY

SEQ ID NO: 198312 - protein, 10 aa, Tick-borne encephalitis virus
ALREQYGETW

SEQ ID NO: 198313 - protein, 10 aa, Tick-borne encephalitis virus
LREQYGETWH

SEQ ID NO: 198314 - protein, 10 aa, Tick-borne encephalitis virus
DREHPYRTWQ

SEQ ID NO: 198315 - protein, 10 aa, Tick-borne encephalitis virus
REHPYRTWQY

SEQ ID NO: 198316 - protein, 10 aa, Tick-borne encephalitis virus
EHPYRTWQYW

SEQ ID NO: 198317 - protein, 10 aa, Tick-borne encephalitis virus
HPYRTWQYWG

SEQ ID NO: 198318 - protein, 10 aa, Tick-borne encephalitis virus
PYRTWQYWGS

SEQ ID NO: 198319 - protein, 10 aa, Tick-borne encephalitis virus
YRTWQYWGSY

SEQ ID NO: 198320 - protein, 10 aa, Tick-borne encephalitis virus
RTWQYWGSYR

SEQ ID NO: 198321 - protein, 10 aa, Tick-borne encephalitis virus
TWQYWGSYRT

SEQ ID NO: 198322 - protein, 10 aa, Tick-borne encephalitis virus
WQYWGSYRTA

SEQ ID NO: 198323 - protein, 10 aa, Tick-borne encephalitis virus
QYWGSYRTAP

SEQ ID NO: 198324 - protein, 10 aa, Tick-borne encephalitis virus
YWGSYRTAPT

SEQ ID NO: 198325 - protein, 10 aa, Tick-borne encephalitis virus
WGSYRTAPTG

SEQ ID NO: 198326 - protein, 10 aa, Tick-borne encephalitis virus
GSYRTAPTGS

SEQ ID NO: 198327 - protein, 10 aa, Tick-borne encephalitis virus
SYRTAPTGSA

SEQ ID NO: 198328 - protein, 10 aa, Tick-borne encephalitis virus
YRTAPTGSAA

SEQ ID NO: 198329 - protein, 10 aa, Tick-borne encephalitis virus
RTAPTGSAAS

SEQ ID NO: 198330 - protein, 10 aa, Tick-borne encephalitis virus
TAPTGSAASL

SEQ ID NO: 198331 - protein, 10 aa, Tick-borne encephalitis virus
APTGSAASLI

SEQ ID NO: 198332 - protein, 10 aa, Tick-borne encephalitis virus
PTGSAASLIN

SEQ ID NO: 198333 - protein, 10 aa, Tick-borne encephalitis virus
TGSAASLING

SEQ ID NO: 198334 - protein, 10 aa, Tick-borne encephalitis virus
GSAASLINGV

SEQ ID NO: 198335 - protein, 10 aa, Tick-borne encephalitis virus
SAASLINGVV

SEQ ID NO: 198336 - protein, 10 aa, Tick-borne encephalitis virus
AASLINGVVK

SEQ ID NO: 198337 - protein, 10 aa, Tick-borne encephalitis virus
ASLINGVVKL

SEQ ID NO: 198338 - protein, 10 aa, Tick-borne encephalitis virus
SLINGVVKLL

SEQ ID NO: 198339 - protein, 10 aa, Tick-borne encephalitis virus
LINGVVKLLS

SEQ ID NO: 198340 - protein, 10 aa, Tick-borne encephalitis virus
INGVVKLLSW

SEQ ID NO: 198341 - protein, 10 aa, Tick-borne encephalitis virus
NGVVKLLSWP

SEQ ID NO: 198342 - protein, 10 aa, Tick-borne encephalitis virus
GVVKLLSWPW

SEQ ID NO: 198343 - protein, 10 aa, Tick-borne encephalitis virus
VVKLLSWPWN

SEQ ID NO: 198344 - protein, 10 aa, Tick-borne encephalitis virus
VKLLSWPWNA

SEQ ID NO: 198345 - protein, 10 aa, Tick-borne encephalitis virus
KLLSWPWNAR

SEQ ID NO: 198346 - protein, 10 aa, Tick-borne encephalitis virus
LLSWPWNARE

SEQ ID NO: 198347 - protein, 10 aa, Tick-borne encephalitis virus
LSWPWNARED

SEQ ID NO: 198348 - protein, 10 aa, Tick-borne encephalitis virus
SWPWNAREDV

SEQ ID NO: 198349 - protein, 10 aa, Tick-borne encephalitis virus
WPWNAREDVV

SEQ ID NO: 198350 - protein, 10 aa, Tick-borne encephalitis virus
PWNAREDVVR

SEQ ID NO: 198351 - protein, 10 aa, Tick-borne encephalitis virus
WNAREDVVRM

SEQ ID NO: 198352 - protein, 10 aa, Tick-borne encephalitis virus
NAREDVVRMA

SEQ ID NO: 198353 - protein, 10 aa, Tick-borne encephalitis virus
AREDVVRMAM

SEQ ID NO: 198354 - protein, 10 aa, Tick-borne encephalitis virus
REDVVRMAMT

SEQ ID NO: 198355 - protein, 10 aa, Tick-borne encephalitis virus
EDVVRMAMTD

SEQ ID NO: 198356 - protein, 10 aa, Tick-borne encephalitis virus
DVVRMAMTDT

SEQ ID NO: 198357 - protein, 10 aa, Tick-borne encephalitis virus
VVRMAMTDTT

SEQ ID NO: 198358 - protein, 10 aa, Tick-borne encephalitis virus
VRMAMTDTTA

SEQ ID NO: 198359 - protein, 10 aa, Tick-borne encephalitis virus
RMAMTDTTAF

SEQ ID NO: 198360 - protein, 10 aa, Tick-borne encephalitis virus
MAMTDTTAFG

SEQ ID NO: 198361 - protein, 10 aa, Tick-borne encephalitis virus
AMTDTTAFGQ

SEQ ID NO: 198362 - protein, 10 aa, Tick-borne encephalitis virus
MTDTTAFGQQ

SEQ ID NO: 198363 - protein, 10 aa, Tick-borne encephalitis virus
TDTTAFGQQR

SEQ ID NO: 198364 - protein, 10 aa, Tick-borne encephalitis virus
DTTAFGQQRV

SEQ ID NO: 198365 - protein, 10 aa, Tick-borne encephalitis virus
TTAFGQQRVF

SEQ ID NO: 198366 - protein, 10 aa, Tick-borne encephalitis virus
TAFGQQRVFK

SEQ ID NO: 198367 - protein, 10 aa, Tick-borne encephalitis virus
AFGQQRVFKE

SEQ ID NO: 198368 - protein, 10 aa, Tick-borne encephalitis virus
FGQQRVFKEK

SEQ ID NO: 198369 - protein, 10 aa, Tick-borne encephalitis virus
GQQRVFKEKV

SEQ ID NO: 198370 - protein, 10 aa, Tick-borne encephalitis virus
QQRVFKEKVD

SEQ ID NO: 198371 - protein, 10 aa, Tick-borne encephalitis virus
QRVFKEKVDT

SEQ ID NO: 198372 - protein, 10 aa, Tick-borne encephalitis virus
RVFKEKVDTK

SEQ ID NO: 198373 - protein, 10 aa, Tick-borne encephalitis virus
VFKEKVDTKA

SEQ ID NO: 198374 - protein, 10 aa, Tick-borne encephalitis virus
FKEKVDTKAQ

SEQ ID NO: 198375 - protein, 10 aa, Tick-borne encephalitis virus
KEKVDTKAQE

SEQ ID NO: 198376 - protein, 10 aa, Tick-borne encephalitis virus
EKVDTKAQEP

SEQ ID NO: 198377 - protein, 10 aa, Tick-borne encephalitis virus
KVDTKAQEPQ

SEQ ID NO: 198378 - protein, 10 aa, Tick-borne encephalitis virus
VDTKAQEPQP

SEQ ID NO: 198379 - protein, 10 aa, Tick-borne encephalitis virus
DTKAQEPQPG

SEQ ID NO: 198380 - protein, 10 aa, Tick-borne encephalitis virus
TKAQEPQPGT

SEQ ID NO: 198381 - protein, 10 aa, Tick-borne encephalitis virus
KAQEPQPGTK

SEQ ID NO: 198382 - protein, 10 aa, Tick-borne encephalitis virus
AQEPQPGTKV

SEQ ID NO: 198383 - protein, 10 aa, Tick-borne encephalitis virus
QEPQPGTKVI

SEQ ID NO: 198384 - protein, 10 aa, Tick-borne encephalitis virus
EPQPGTKVIM

SEQ ID NO: 198385 - protein, 10 aa, Tick-borne encephalitis virus
PQPGTKVIMR

SEQ ID NO: 198386 - protein, 10 aa, Tick-borne encephalitis virus
QPGTKVIMRA

SEQ ID NO: 198387 - protein, 10 aa, Tick-borne encephalitis virus
PGTKVIMRAV

SEQ ID NO: 198388 - protein, 10 aa, Tick-borne encephalitis virus
GTKVIMRAVN

SEQ ID NO: 198389 - protein, 10 aa, Tick-borne encephalitis virus
TKVIMRAVND

SEQ ID NO: 198390 - protein, 10 aa, Tick-borne encephalitis virus
KVIMRAVNDW

SEQ ID NO: 198391 - protein, 10 aa, Tick-borne encephalitis virus
VIMRAVNDWI

SEQ ID NO: 198392 - protein, 10 aa, Tick-borne encephalitis virus
IMRAVNDWIL

SEQ ID NO: 198393 - protein, 10 aa, Tick-borne encephalitis virus
MRAVNDWILE

SEQ ID NO: 198394 - protein, 10 aa, Tick-borne encephalitis virus
RAVNDWILER

SEQ ID NO: 198395 - protein, 10 aa, Tick-borne encephalitis virus
AVNDWILERL

SEQ ID NO: 198396 - protein, 10 aa, Tick-borne encephalitis virus
VNDWILERLA

SEQ ID NO: 198397 - protein, 10 aa, Tick-borne encephalitis virus
NDWILERLAR

SEQ ID NO: 198398 - protein, 10 aa, Tick-borne encephalitis virus
DWILERLARK

SEQ ID NO: 198399 - protein, 10 aa, Tick-borne encephalitis virus
WILERLARKS

SEQ ID NO: 198400 - protein, 10 aa, Tick-borne encephalitis virus
KPRMCSREEF

SEQ ID NO: 198401 - protein, 10 aa, Tick-borne encephalitis virus
PRMCSREEFI

SEQ ID NO: 198402 - protein, 10 aa, Tick-borne encephalitis virus
RMCSREEFIA

SEQ ID NO: 198403 - protein, 10 aa, Tick-borne encephalitis virus
MCSREEFIAK

SEQ ID NO: 198404 - protein, 10 aa, Tick-borne encephalitis virus
CSREEFIAKV

SEQ ID NO: 198405 - protein, 10 aa, Tick-borne encephalitis virus
SREEFIAKVK

SEQ ID NO: 198406 - protein, 10 aa, Tick-borne encephalitis virus
REEFIAKVKS

SEQ ID NO: 198407 - protein, 10 aa, Tick-borne encephalitis virus
EEFIAKVKSN

SEQ ID NO: 198408 - protein, 10 aa, Tick-borne encephalitis virus
EFIAKVKSNA

SEQ ID NO: 198409 - protein, 10 aa, Tick-borne encephalitis virus
FIAKVKSNAA

SEQ ID NO: 198410 - protein, 10 aa, Tick-borne encephalitis virus
IAKVKSNAAL

SEQ ID NO: 198411 - protein, 10 aa, Tick-borne encephalitis virus
AKVKSNAALG

SEQ ID NO: 198412 - protein, 10 aa, Tick-borne encephalitis virus
KVKSNAALGA

SEQ ID NO: 198413 - protein, 10 aa, Tick-borne encephalitis virus
VKSNAALGAW

SEQ ID NO: 198414 - protein, 10 aa, Tick-borne encephalitis virus
KSNAALGAWS

SEQ ID NO: 198415 - protein, 10 aa, Tick-borne encephalitis virus
SNAALGAWSD

SEQ ID NO: 198416 - protein, 10 aa, Tick-borne encephalitis virus
NAALGAWSDE

SEQ ID NO: 198417 - protein, 10 aa, Tick-borne encephalitis virus
AALGAWSDEQ

SEQ ID NO: 198418 - protein, 10 aa, Tick-borne encephalitis virus
ALGAWSDEQN

SEQ ID NO: 198419 - protein, 10 aa, Tick-borne encephalitis virus
LGAWSDEQNR

SEQ ID NO: 198420 - protein, 10 aa, Tick-borne encephalitis virus
GAWSDEQNRW

SEQ ID NO: 198421 - protein, 10 aa, Tick-borne encephalitis virus
AWSDEQNRWS

SEQ ID NO: 198422 - protein, 10 aa, Tick-borne encephalitis virus
SAKEAVEDPA

SEQ ID NO: 198423 - protein, 10 aa, Tick-borne encephalitis virus
AKEAVEDPAF

SEQ ID NO: 198424 - protein, 10 aa, Tick-borne encephalitis virus
KEAVEDPAFW

SEQ ID NO: 198425 - protein, 10 aa, Tick-borne encephalitis virus
EAVEDPAFWQ

SEQ ID NO: 198426 - protein, 10 aa, Tick-borne encephalitis virus
AVEDPAFWQL

SEQ ID NO: 198427 - protein, 10 aa, Tick-borne encephalitis virus
VEDPAFWQLV

SEQ ID NO: 198428 - protein, 10 aa, Tick-borne encephalitis virus
EDPAFWQLVD

SEQ ID NO: 198429 - protein, 10 aa, Tick-borne encephalitis virus
DPAFWQLVDE

SEQ ID NO: 198430 - protein, 10 aa, Tick-borne encephalitis virus
PAFWQLVDEE

SEQ ID NO: 198431 - protein, 10 aa, Tick-borne encephalitis virus
AFWQLVDEER

SEQ ID NO: 198432 - protein, 10 aa, Tick-borne encephalitis virus
FWQLVDEERE

SEQ ID NO: 198433 - protein, 10 aa, Tick-borne encephalitis virus
WQLVDEERER

SEQ ID NO: 198434 - protein, 10 aa, Tick-borne encephalitis virus
QLVDEERERH

SEQ ID NO: 198435 - protein, 10 aa, Tick-borne encephalitis virus
LVDEERERHL

SEQ ID NO: 198436 - protein, 10 aa, Tick-borne encephalitis virus
VDEERERHLA

SEQ ID NO: 198437 - protein, 10 aa, Tick-borne encephalitis virus
DEERERHLAG

SEQ ID NO: 198438 - protein, 10 aa, Tick-borne encephalitis virus
EERERHLAGR

SEQ ID NO: 198439 - protein, 10 aa, Tick-borne encephalitis virus
ERERHLAGRC

SEQ ID NO: 198440 - protein, 10 aa, Tick-borne encephalitis virus
RERHLAGRCA

SEQ ID NO: 198441 - protein, 10 aa, Tick-borne encephalitis virus
ERHLAGRCAH

SEQ ID NO: 198442 - protein, 10 aa, Tick-borne encephalitis virus
RHLAGRCAHC

SEQ ID NO: 198443 - protein, 10 aa, Tick-borne encephalitis virus
HLAGRCAHCV

SEQ ID NO: 198444 - protein, 10 aa, Tick-borne encephalitis virus
GRCAHCVYNM

SEQ ID NO: 198445 - protein, 10 aa, Tick-borne encephalitis virus
RCAHCVYNMM

SEQ ID NO: 198446 - protein, 10 aa, Tick-borne encephalitis virus
CAHCVYNMMG

SEQ ID NO: 198447 - protein, 10 aa, Tick-borne encephalitis virus
AHCVYNMMGK

SEQ ID NO: 198448 - protein, 10 aa, Tick-borne encephalitis virus
HCVYNMMGKR

SEQ ID NO: 198449 - protein, 10 aa, Tick-borne encephalitis virus
CVYNMMGKRE

SEQ ID NO: 198450 - protein, 10 aa, Tick-borne encephalitis virus
VYNMMGKREK

SEQ ID NO: 198451 - protein, 10 aa, Tick-borne encephalitis virus
YNMMGKREKK

SEQ ID NO: 198452 - protein, 10 aa, Tick-borne encephalitis virus
NMMGKREKKL

SEQ ID NO: 198453 - protein, 10 aa, Tick-borne encephalitis virus
MMGKREKKLG

SEQ ID NO: 198454 - protein, 10 aa, Tick-borne encephalitis virus
MGKREKKLGE

SEQ ID NO: 198455 - protein, 10 aa, Tick-borne encephalitis virus
GKREKKLGEF

SEQ ID NO: 198456 - protein, 10 aa, Tick-borne encephalitis virus
KREKKLGEFG

SEQ ID NO: 198457 - protein, 10 aa, Tick-borne encephalitis virus
REKKLGEFGV

SEQ ID NO: 198458 - protein, 10 aa, Tick-borne encephalitis virus
EKKLGEFGVA

SEQ ID NO: 198459 - protein, 10 aa, Tick-borne encephalitis virus
KKLGEFGVAK

SEQ ID NO: 198460 - protein, 10 aa, Tick-borne encephalitis virus
KLGEFGVAKG

SEQ ID NO: 198461 - protein, 10 aa, Tick-borne encephalitis virus
LGEFGVAKGS

SEQ ID NO: 198462 - protein, 10 aa, Tick-borne encephalitis virus
GEFGVAKGSR

SEQ ID NO: 198463 - protein, 10 aa, Tick-borne encephalitis virus
EFGVAKGSRA

SEQ ID NO: 198464 - protein, 10 aa, Tick-borne encephalitis virus
FGVAKGSRAI

SEQ ID NO: 198465 - protein, 10 aa, Tick-borne encephalitis virus
GVAKGSRAIW

SEQ ID NO: 198466 - protein, 10 aa, Tick-borne encephalitis virus
VAKGSRAIWY

SEQ ID NO: 198467 - protein, 10 aa, Tick-borne encephalitis virus
AKGSRAIWYM

SEQ ID NO: 198468 - protein, 10 aa, Tick-borne encephalitis virus
KGSRAIWYMW

SEQ ID NO: 198469 - protein, 10 aa, Tick-borne encephalitis virus
GSRAIWYMWL

SEQ ID NO: 198470 - protein, 10 aa, Tick-borne encephalitis virus
SRAIWYMWLG

SEQ ID NO: 198471 - protein, 10 aa, Tick-borne encephalitis virus
RAIWYMWLGS

SEQ ID NO: 198472 - protein, 10 aa, Tick-borne encephalitis virus
AIWYMWLGSR

SEQ ID NO: 198473 - protein, 10 aa, Tick-borne encephalitis virus
IWYMWLGSRF

SEQ ID NO: 198474 - protein, 10 aa, Tick-borne encephalitis virus
WYMWLGSRFL

SEQ ID NO: 198475 - protein, 10 aa, Tick-borne encephalitis virus
YMWLGSRFLE

SEQ ID NO: 198476 - protein, 10 aa, Tick-borne encephalitis virus
MWLGSRFLEF

SEQ ID NO: 198477 - protein, 10 aa, Tick-borne encephalitis virus
WLGSRFLEFE

SEQ ID NO: 198478 - protein, 10 aa, Tick-borne encephalitis virus
LGSRFLEFEA

SEQ ID NO: 198479 - protein, 10 aa, Tick-borne encephalitis virus
GSRFLEFEAL

SEQ ID NO: 198480 - protein, 10 aa, Tick-borne encephalitis virus
SRFLEFEALG

SEQ ID NO: 198481 - protein, 10 aa, Tick-borne encephalitis virus
RFLEFEALGF

SEQ ID NO: 198482 - protein, 10 aa, Tick-borne encephalitis virus
FLEFEALGFL

SEQ ID NO: 198483 - protein, 10 aa, Tick-borne encephalitis virus
LEFEALGFLN

SEQ ID NO: 198484 - protein, 10 aa, Tick-borne encephalitis virus
EFEALGFLNE

SEQ ID NO: 198485 - protein, 10 aa, Tick-borne encephalitis virus
FEALGFLNED

SEQ ID NO: 198486 - protein, 10 aa, Tick-borne encephalitis virus
EALGFLNEDH

SEQ ID NO: 198487 - protein, 10 aa, Tick-borne encephalitis virus
ALGFLNEDHW

SEQ ID NO: 198488 - protein, 10 aa, Tick-borne encephalitis virus
LGFLNEDHWA

SEQ ID NO: 198489 - protein, 10 aa, Tick-borne encephalitis virus
GFLNEDHWAS

SEQ ID NO: 198490 - protein, 10 aa, Tick-borne encephalitis virus
FLNEDHWASR

SEQ ID NO: 198491 - protein, 10 aa, Tick-borne encephalitis virus
LNEDHWASRG

SEQ ID NO: 198492 - protein, 10 aa, Tick-borne encephalitis virus
NEDHWASRGS

SEQ ID NO: 198493 - protein, 10 aa, Tick-borne encephalitis virus
EDHWASRGSS

SEQ ID NO: 198494 - protein, 10 aa, Tick-borne encephalitis virus
DHWASRGSSG

SEQ ID NO: 198495 - protein, 10 aa, Tick-borne encephalitis virus
HWASRGSSGS

SEQ ID NO: 198496 - protein, 10 aa, Tick-borne encephalitis virus
WASRGSSGSG

SEQ ID NO: 198497 - protein, 10 aa, Tick-borne encephalitis virus
ASRGSSGSGV

SEQ ID NO: 198498 - protein, 10 aa, Tick-borne encephalitis virus
SRGSSGSGVE

SEQ ID NO: 198499 - protein, 10 aa, Tick-borne encephalitis virus
RGSSGSGVEG

SEQ ID NO: 198500 - protein, 10 aa, Tick-borne encephalitis virus
GSSGSGVEGI

SEQ ID NO: 198501 - protein, 10 aa, Tick-borne encephalitis virus
SSGSGVEGIS

SEQ ID NO: 198502 - protein, 10 aa, Tick-borne encephalitis virus
SGSGVEGISL

SEQ ID NO: 198503 - protein, 10 aa, Tick-borne encephalitis virus
GSGVEGISLN

SEQ ID NO: 198504 - protein, 10 aa, Tick-borne encephalitis virus
SGVEGISLNY

SEQ ID NO: 198505 - protein, 10 aa, Tick-borne encephalitis virus
GVEGISLNYL

SEQ ID NO: 198506 - protein, 10 aa, Tick-borne encephalitis virus
VEGISLNYLG

SEQ ID NO: 198507 - protein, 10 aa, Tick-borne encephalitis virus
EGISLNYLGW

SEQ ID NO: 198508 - protein, 10 aa, Tick-borne encephalitis virus
GISLNYLGWH

SEQ ID NO: 198509 - protein, 10 aa, Tick-borne encephalitis virus
ISLNYLGWHL

SEQ ID NO: 198510 - protein, 10 aa, Tick-borne encephalitis virus
SLNYLGWHLK

SEQ ID NO: 198511 - protein, 10 aa, Tick-borne encephalitis virus
LNYLGWHLKK

SEQ ID NO: 198512 - protein, 10 aa, Tick-borne encephalitis virus
NYLGWYLKGL

SEQ ID NO: 198513 - protein, 10 aa, Tick-borne encephalitis virus
YLGWYLKGLS

SEQ ID NO: 198514 - protein, 10 aa, Tick-borne encephalitis virus
LSTLEGGLFY

SEQ ID NO: 198515 - protein, 10 aa, Tick-borne encephalitis virus
STLEGGLFYA

SEQ ID NO: 198516 - protein, 10 aa, Tick-borne encephalitis virus
TLEGGLFYAD

SEQ ID NO: 198517 - protein, 10 aa, Tick-borne encephalitis virus
LEGGLFYADD

SEQ ID NO: 198518 - protein, 10 aa, Tick-borne encephalitis virus
EGGLFYADDT

SEQ ID NO: 198519 - protein, 10 aa, Tick-borne encephalitis virus
GGLFYADDTA

SEQ ID NO: 198520 - protein, 10 aa, Tick-borne encephalitis virus
GLFYADDTAG

SEQ ID NO: 198521 - protein, 10 aa, Tick-borne encephalitis virus
LFYADDTAGW

SEQ ID NO: 198522 - protein, 10 aa, Tick-borne encephalitis virus
FYADDTAGWD

SEQ ID NO: 198523 - protein, 10 aa, Tick-borne encephalitis virus
YADDTAGWDT

SEQ ID NO: 198524 - protein, 10 aa, Tick-borne encephalitis virus
ADDTAGWDTK

SEQ ID NO: 198525 - protein, 10 aa, Tick-borne encephalitis virus
DDTAGWDTKV

SEQ ID NO: 198526 - protein, 10 aa, Tick-borne encephalitis virus
DTAGWDTKVT

SEQ ID NO: 198527 - protein, 10 aa, Tick-borne encephalitis virus
TAGWDTKVTN

SEQ ID NO: 198528 - protein, 10 aa, Tick-borne encephalitis virus
AGWDTKVTNA

SEQ ID NO: 198529 - protein, 10 aa, Tick-borne encephalitis virus
GWDTKVTNAD

SEQ ID NO: 198530 - protein, 10 aa, Tick-borne encephalitis virus
WDTKVTNADL

SEQ ID NO: 198531 - protein, 10 aa, Tick-borne encephalitis virus
DTKVTNADLE

SEQ ID NO: 198532 - protein, 10 aa, Tick-borne encephalitis virus
TKVTNADLED

SEQ ID NO: 198533 - protein, 10 aa, Tick-borne encephalitis virus
KVTNADLEDE

SEQ ID NO: 198534 - protein, 10 aa, Tick-borne encephalitis virus
VTNADLEDEE

SEQ ID NO: 198535 - protein, 10 aa, Tick-borne encephalitis virus
TNADLEDEEQ

SEQ ID NO: 198536 - protein, 10 aa, Tick-borne encephalitis virus
NADLEDEEQL

SEQ ID NO: 198537 - protein, 10 aa, Tick-borne encephalitis virus
ADLEDEEQLL

SEQ ID NO: 198538 - protein, 10 aa, Tick-borne encephalitis virus
DLEDEEQLLR

SEQ ID NO: 198539 - protein, 10 aa, Tick-borne encephalitis virus
LEDEEQLLRY

SEQ ID NO: 198540 - protein, 10 aa, Tick-borne encephalitis virus
EDEEQLLRYM

SEQ ID NO: 198541 - protein, 10 aa, Tick-borne encephalitis virus
DEEQLLRYME

SEQ ID NO: 198542 - protein, 10 aa, Tick-borne encephalitis virus
EEQLLRYMEG

SEQ ID NO: 198543 - protein, 10 aa, Tick-borne encephalitis virus
EQLLRYMEGE

SEQ ID NO: 198544 - protein, 10 aa, Tick-borne encephalitis virus
QLLRYMEGEH

SEQ ID NO: 198545 - protein, 10 aa, Tick-borne encephalitis virus
LLRYMEGEHK

SEQ ID NO: 198546 - protein, 10 aa, Tick-borne encephalitis virus
LRYMEGEHKQ

SEQ ID NO: 198547 - protein, 10 aa, Tick-borne encephalitis virus
RYMEGEHKQL

SEQ ID NO: 198548 - protein, 10 aa, Tick-borne encephalitis virus
YMEGEHKQLA

SEQ ID NO: 198549 - protein, 10 aa, Tick-borne encephalitis virus
MEGEHKQLAA

SEQ ID NO: 198550 - protein, 10 aa, Tick-borne encephalitis virus
EGEHKQLAAT

SEQ ID NO: 198551 - protein, 10 aa, Tick-borne encephalitis virus
GEHKQLAATI

SEQ ID NO: 198552 - protein, 10 aa, Tick-borne encephalitis virus
EHKQLAATIM

SEQ ID NO: 198553 - protein, 10 aa, Tick-borne encephalitis virus
HKQLAATIMQ

SEQ ID NO: 198554 - protein, 10 aa, Tick-borne encephalitis virus
KQLAATIMQK

SEQ ID NO: 198555 - protein, 10 aa, Tick-borne encephalitis virus
QLAATIMQKA

SEQ ID NO: 198556 - protein, 10 aa, Tick-borne encephalitis virus
LAATIMQKAY

SEQ ID NO: 198557 - protein, 10 aa, Tick-borne encephalitis virus
AATIMQKAYH

SEQ ID NO: 198558 - protein, 10 aa, Tick-borne encephalitis virus
ATIMQKAYHA

SEQ ID NO: 198559 - protein, 10 aa, Tick-borne encephalitis virus
TIMQKAYHAK

SEQ ID NO: 198560 - protein, 10 aa, Tick-borne encephalitis virus
IMQKAYHAKV

SEQ ID NO: 198561 - protein, 10 aa, Tick-borne encephalitis virus
MQKAYHAKVV

SEQ ID NO: 198562 - protein, 10 aa, Tick-borne encephalitis virus
QKAYHAKVVK

SEQ ID NO: 198563 - protein, 10 aa, Tick-borne encephalitis virus
KAYHAKVVKV

SEQ ID NO: 198564 - protein, 10 aa, Tick-borne encephalitis virus
AYHAKVVKVA

SEQ ID NO: 198565 - protein, 10 aa, Tick-borne encephalitis virus
YHAKVVKVAR

SEQ ID NO: 198566 - protein, 10 aa, Tick-borne encephalitis virus
HAKVVKVARP

SEQ ID NO: 198567 - protein, 10 aa, Tick-borne encephalitis virus
AKVVKVARPS

SEQ ID NO: 198568 - protein, 10 aa, Tick-borne encephalitis virus
KVVKVARPSR

SEQ ID NO: 198569 - protein, 10 aa, Tick-borne encephalitis virus
VVKVARPSRD

SEQ ID NO: 198570 - protein, 10 aa, Tick-borne encephalitis virus
VKVARPSRDG

SEQ ID NO: 198571 - protein, 10 aa, Tick-borne encephalitis virus
KVARPSRDGG

SEQ ID NO: 198572 - protein, 10 aa, Tick-borne encephalitis virus
VARPSRDGGC

SEQ ID NO: 198573 - protein, 10 aa, Tick-borne encephalitis virus
ARPSRDGGCI

SEQ ID NO: 198574 - protein, 10 aa, Tick-borne encephalitis virus
RPSRDGGCIM

SEQ ID NO: 198575 - protein, 10 aa, Tick-borne encephalitis virus
PSRDGGCIMD

SEQ ID NO: 198576 - protein, 10 aa, Tick-borne encephalitis virus
SRDGGCIMDV

SEQ ID NO: 198577 - protein, 10 aa, Tick-borne encephalitis virus
RDGGCIMDVI

SEQ ID NO: 198578 - protein, 10 aa, Tick-borne encephalitis virus
DGGCIMDVIT

SEQ ID NO: 198579 - protein, 10 aa, Tick-borne encephalitis virus
GGCIMDVITR

SEQ ID NO: 198580 - protein, 10 aa, Tick-borne encephalitis virus
GCIMDVITRR

SEQ ID NO: 198581 - protein, 10 aa, Tick-borne encephalitis virus
CIMDVITRRD

SEQ ID NO: 198582 - protein, 10 aa, Tick-borne encephalitis virus
IMDVITRRDQ

SEQ ID NO: 198583 - protein, 10 aa, Tick-borne encephalitis virus
MDVITRRDQR

SEQ ID NO: 198584 - protein, 10 aa, Tick-borne encephalitis virus
DVITRRDQRG

SEQ ID NO: 198585 - protein, 10 aa, Tick-borne encephalitis virus
VITRRDQRGS

SEQ ID NO: 198586 - protein, 10 aa, Tick-borne encephalitis virus
ITRRDQRGSG

SEQ ID NO: 198587 - protein, 10 aa, Tick-borne encephalitis virus
TRRDQRGSGQ

SEQ ID NO: 198588 - protein, 10 aa, Tick-borne encephalitis virus
RRDQRGSGQV

SEQ ID NO: 198589 - protein, 10 aa, Tick-borne encephalitis virus
RDQRGSGQVV

SEQ ID NO: 198590 - protein, 10 aa, Tick-borne encephalitis virus
DQRGSGQVVT

SEQ ID NO: 198591 - protein, 10 aa, Tick-borne encephalitis virus
QRGSGQVVTY

SEQ ID NO: 198592 - protein, 10 aa, Tick-borne encephalitis virus
RGSGQVVTYA

SEQ ID NO: 198593 - protein, 10 aa, Tick-borne encephalitis virus
GSGQVVTYAL

SEQ ID NO: 198594 - protein, 10 aa, Tick-borne encephalitis virus
SGQVVTYALN

SEQ ID NO: 198595 - protein, 10 aa, Tick-borne encephalitis virus
GQVVTYALNT

SEQ ID NO: 198596 - protein, 10 aa, Tick-borne encephalitis virus
QVVTYALNTL

SEQ ID NO: 198597 - protein, 10 aa, Tick-borne encephalitis virus
VVTYALNTLT

SEQ ID NO: 198598 - protein, 10 aa, Tick-borne encephalitis virus
VTYALNTLTN

SEQ ID NO: 198599 - protein, 10 aa, Tick-borne encephalitis virus
TYALNTLTNI

SEQ ID NO: 198600 - protein, 10 aa, Tick-borne encephalitis virus
YALNTLTNIK

SEQ ID NO: 198601 - protein, 10 aa, Tick-borne encephalitis virus
ALNTLTNIKV

SEQ ID NO: 198602 - protein, 10 aa, Tick-borne encephalitis virus
LNTLTNIKVQ

SEQ ID NO: 198603 - protein, 10 aa, Tick-borne encephalitis virus
NTLTNIKVQL

SEQ ID NO: 198604 - protein, 10 aa, Tick-borne encephalitis virus
TLTNIKVQLI

SEQ ID NO: 198605 - protein, 10 aa, Tick-borne encephalitis virus
LTNIKVQLIR

SEQ ID NO: 198606 - protein, 10 aa, Tick-borne encephalitis virus
TNIKVQLIRM

SEQ ID NO: 198607 - protein, 10 aa, Tick-borne encephalitis virus
NIKVQLIRMM

SEQ ID NO: 198608 - protein, 10 aa, Tick-borne encephalitis virus
IKVQLIRMME

SEQ ID NO: 198609 - protein, 10 aa, Tick-borne encephalitis virus
KVQLIRMMEG

SEQ ID NO: 198610 - protein, 10 aa, Tick-borne encephalitis virus
VQLIRMMEGE

SEQ ID NO: 198611 - protein, 10 aa, Tick-borne encephalitis virus
QLIRMMEGEG

SEQ ID NO: 198612 - protein, 10 aa, Tick-borne encephalitis virus
LIRMMEGEGV

SEQ ID NO: 198613 - protein, 10 aa, Tick-borne encephalitis virus
IRMMEGEGVI

SEQ ID NO: 198614 - protein, 10 aa, Tick-borne encephalitis virus
RMMEGEGVIE

SEQ ID NO: 198615 - protein, 10 aa, Tick-borne encephalitis virus
MMEGEGVIEA

SEQ ID NO: 198616 - protein, 10 aa, Tick-borne encephalitis virus
MEGEGVIEAS

SEQ ID NO: 198617 - protein, 10 aa, Tick-borne encephalitis virus
EGEGVIEASD

SEQ ID NO: 198618 - protein, 10 aa, Tick-borne encephalitis virus
GEGVIEASDA

SEQ ID NO: 198619 - protein, 10 aa, Tick-borne encephalitis virus
EGVIEASDAH

SEQ ID NO: 198620 - protein, 10 aa, Tick-borne encephalitis virus
GVIEASDAHN

SEQ ID NO: 198621 - protein, 10 aa, Tick-borne encephalitis virus
VIEASDAHNP

SEQ ID NO: 198622 - protein, 10 aa, Tick-borne encephalitis virus
IEASDAHNPR

SEQ ID NO: 198623 - protein, 10 aa, Tick-borne encephalitis virus
EASDAHNPRL

SEQ ID NO: 198624 - protein, 10 aa, Tick-borne encephalitis virus
ASDAHNPRLL

SEQ ID NO: 198625 - protein, 10 aa, Tick-borne encephalitis virus
SDAHNPRLLR

SEQ ID NO: 198626 - protein, 10 aa, Tick-borne encephalitis virus
DAHNPRLLRV

SEQ ID NO: 198627 - protein, 10 aa, Tick-borne encephalitis virus
AHNPRLLRVE

SEQ ID NO: 198628 - protein, 10 aa, Tick-borne encephalitis virus
HNPRLLRVER

SEQ ID NO: 198629 - protein, 10 aa, Tick-borne encephalitis virus
NPRLLRVERW

SEQ ID NO: 198630 - protein, 10 aa, Tick-borne encephalitis virus
PRLLRVERWL

SEQ ID NO: 198631 - protein, 10 aa, Tick-borne encephalitis virus
RLLRVERWLR

SEQ ID NO: 198632 - protein, 10 aa, Tick-borne encephalitis virus
LLRVERWLRD

SEQ ID NO: 198633 - protein, 10 aa, Tick-borne encephalitis virus
RVERWLRDHG

SEQ ID NO: 198634 - protein, 10 aa, Tick-borne encephalitis virus
DHGEERLGRM

SEQ ID NO: 198635 - protein, 10 aa, Tick-borne encephalitis virus
HGEERLGRML

SEQ ID NO: 198636 - protein, 10 aa, Tick-borne encephalitis virus
GEERLGRMLV

SEQ ID NO: 198637 - protein, 10 aa, Tick-borne encephalitis virus
EERLGRMLVS

SEQ ID NO: 198638 - protein, 10 aa, Tick-borne encephalitis virus
ERLGRMLVSG

SEQ ID NO: 198639 - protein, 10 aa, Tick-borne encephalitis virus
RLGRMLVSGD

SEQ ID NO: 198640 - protein, 10 aa, Tick-borne encephalitis virus
LGRMLVSGDD

SEQ ID NO: 198641 - protein, 10 aa, Tick-borne encephalitis virus
GRMLVSGDDC

SEQ ID NO: 198642 - protein, 10 aa, Tick-borne encephalitis virus
RMLVSGDDCV

SEQ ID NO: 198643 - protein, 10 aa, Tick-borne encephalitis virus
MLVSGDDCVV

SEQ ID NO: 198644 - protein, 10 aa, Tick-borne encephalitis virus
LVSGDDCVVR

SEQ ID NO: 198645 - protein, 10 aa, Tick-borne encephalitis virus
VSGDDCVVRP

SEQ ID NO: 198646 - protein, 10 aa, Tick-borne encephalitis virus
SGDDCVVRPV

SEQ ID NO: 198647 - protein, 10 aa, Tick-borne encephalitis virus
GDDCVVRPVD

SEQ ID NO: 198648 - protein, 10 aa, Tick-borne encephalitis virus
DDCVVRPVDD

SEQ ID NO: 198649 - protein, 10 aa, Tick-borne encephalitis virus
DCVVRPVDDR

SEQ ID NO: 198650 - protein, 10 aa, Tick-borne encephalitis virus
CVVRPVDDRF

SEQ ID NO: 198651 - protein, 10 aa, Tick-borne encephalitis virus
VVRPVDDRFS

SEQ ID NO: 198652 - protein, 10 aa, Tick-borne encephalitis virus
DDRFGKALYF

SEQ ID NO: 198653 - protein, 10 aa, Tick-borne encephalitis virus
DRFGKALYFL

SEQ ID NO: 198654 - protein, 10 aa, Tick-borne encephalitis virus
RFGKALYFLN

SEQ ID NO: 198655 - protein, 10 aa, Tick-borne encephalitis virus
FGKALYFLND

SEQ ID NO: 198656 - protein, 10 aa, Tick-borne encephalitis virus
GKALYFLNDM

SEQ ID NO: 198657 - protein, 10 aa, Tick-borne encephalitis virus
KALYFLNDMA

SEQ ID NO: 198658 - protein, 10 aa, Tick-borne encephalitis virus
ALYFLNDMAK

SEQ ID NO: 198659 - protein, 10 aa, Tick-borne encephalitis virus
LYFLNDMAKT

SEQ ID NO: 198660 - protein, 10 aa, Tick-borne encephalitis virus
YFLNDMAKTR

SEQ ID NO: 198661 - protein, 10 aa, Tick-borne encephalitis virus
FLNDMAKTRK

SEQ ID NO: 198662 - protein, 10 aa, Tick-borne encephalitis virus
LNDMAKTRKD

SEQ ID NO: 198663 - protein, 10 aa, Tick-borne encephalitis virus
NDMAKTRKDI

SEQ ID NO: 198664 - protein, 10 aa, Tick-borne encephalitis virus
DMAKTRKDIG

SEQ ID NO: 198665 - protein, 10 aa, Tick-borne encephalitis virus
MAKTRKDIGE

SEQ ID NO: 198666 - protein, 10 aa, Tick-borne encephalitis virus
AKTRKDIGEW

SEQ ID NO: 198667 - protein, 10 aa, Tick-borne encephalitis virus
KTRKDIGEWE

SEQ ID NO: 198668 - protein, 10 aa, Tick-borne encephalitis virus
TRKDIGEWEH

SEQ ID NO: 198669 - protein, 10 aa, Tick-borne encephalitis virus
RKDIGEWEHS

SEQ ID NO: 198670 - protein, 10 aa, Tick-borne encephalitis virus
KDIGEWEHSV

SEQ ID NO: 198671 - protein, 10 aa, Tick-borne encephalitis virus
DIGEWEHSVG

SEQ ID NO: 198672 - protein, 10 aa, Tick-borne encephalitis virus
IGEWEHSVGF

SEQ ID NO: 198673 - protein, 10 aa, Tick-borne encephalitis virus
GEWEHSVGFS

SEQ ID NO: 198674 - protein, 10 aa, Tick-borne encephalitis virus
NWEEVPFCSH

SEQ ID NO: 198675 - protein, 10 aa, Tick-borne encephalitis virus
WEEVPFCSHH

SEQ ID NO: 198676 - protein, 10 aa, Tick-borne encephalitis virus
EEVPFCSHHF

SEQ ID NO: 198677 - protein, 10 aa, Tick-borne encephalitis virus
EVPFCSHHFH

SEQ ID NO: 198678 - protein, 10 aa, Tick-borne encephalitis virus
VPFCSHHFHE

SEQ ID NO: 198679 - protein, 10 aa, Tick-borne encephalitis virus
PFCSHHFHEL

SEQ ID NO: 198680 - protein, 10 aa, Tick-borne encephalitis virus
FCSHHFHELV

SEQ ID NO: 198681 - protein, 10 aa, Tick-borne encephalitis virus
CSHHFHELVM

SEQ ID NO: 198682 - protein, 10 aa, Tick-borne encephalitis virus
SHHFHELVMK

SEQ ID NO: 198683 - protein, 10 aa, Tick-borne encephalitis virus
HHFHELVMKD

SEQ ID NO: 198684 - protein, 10 aa, Tick-borne encephalitis virus
HFHELVMKDG

SEQ ID NO: 198685 - protein, 10 aa, Tick-borne encephalitis virus
FHELVMKDGR

SEQ ID NO: 198686 - protein, 10 aa, Tick-borne encephalitis virus
HELVMKDGRA

SEQ ID NO: 198687 - protein, 10 aa, Tick-borne encephalitis virus
ELVMKDGRAL

SEQ ID NO: 198688 - protein, 10 aa, Tick-borne encephalitis virus
LVMKDGRALI

SEQ ID NO: 198689 - protein, 10 aa, Tick-borne encephalitis virus
VMKDGRALIV

SEQ ID NO: 198690 - protein, 10 aa, Tick-borne encephalitis virus
MKDGRALIVP

SEQ ID NO: 198691 - protein, 10 aa, Tick-borne encephalitis virus
KDGRALIVPC

SEQ ID NO: 198692 - protein, 10 aa, Tick-borne encephalitis virus
DGRALIVPCR

SEQ ID NO: 198693 - protein, 10 aa, Tick-borne encephalitis virus
GRALIVPCRD

SEQ ID NO: 198694 - protein, 10 aa, Tick-borne encephalitis virus
RALIVPCRDQ

SEQ ID NO: 198695 - protein, 10 aa, Tick-borne encephalitis virus
ALIVPCRDQD

SEQ ID NO: 198696 - protein, 10 aa, Tick-borne encephalitis virus
LIVPCRDQDE

SEQ ID NO: 198697 - protein, 10 aa, Tick-borne encephalitis virus
IVPCRDQDEL

SEQ ID NO: 198698 - protein, 10 aa, Tick-borne encephalitis virus
VPCRDQDELV

SEQ ID NO: 198699 - protein, 10 aa, Tick-borne encephalitis virus
PCRDQDELVG

SEQ ID NO: 198700 - protein, 10 aa, Tick-borne encephalitis virus
CRDQDELVGR

SEQ ID NO: 198701 - protein, 10 aa, Tick-borne encephalitis virus
RDQDELVGRA

SEQ ID NO: 198702 - protein, 10 aa, Tick-borne encephalitis virus
DQDELVGRAR

SEQ ID NO: 198703 - protein, 10 aa, Tick-borne encephalitis virus
QDELVGRARV

SEQ ID NO: 198704 - protein, 10 aa, Tick-borne encephalitis virus
DELVGRARVS

SEQ ID NO: 198705 - protein, 10 aa, Tick-borne encephalitis virus
ELVGRARVSP

SEQ ID NO: 198706 - protein, 10 aa, Tick-borne encephalitis virus
LVGRARVSPG

SEQ ID NO: 198707 - protein, 10 aa, Tick-borne encephalitis virus
VGRARVSPGC

SEQ ID NO: 198708 - protein, 10 aa, Tick-borne encephalitis virus
GRARVSPGCG

SEQ ID NO: 198709 - protein, 10 aa, Tick-borne encephalitis virus
RARVSPGCGW

SEQ ID NO: 198710 - protein, 10 aa, Tick-borne encephalitis virus
ARVSPGCGWS

SEQ ID NO: 198711 - protein, 10 aa, Tick-borne encephalitis virus
RVSPGCGWSV

SEQ ID NO: 198712 - protein, 10 aa, Tick-borne encephalitis virus
VSPGCGWSVR

SEQ ID NO: 198713 - protein, 10 aa, Tick-borne encephalitis virus
SPGCGWSVRE

SEQ ID NO: 198714 - protein, 10 aa, Tick-borne encephalitis virus
PGCGWSVRET

SEQ ID NO: 198715 - protein, 10 aa, Tick-borne encephalitis virus
GCGWSVRETA

SEQ ID NO: 198716 - protein, 10 aa, Tick-borne encephalitis virus
CGWSVRETAC

SEQ ID NO: 198717 - protein, 10 aa, Tick-borne encephalitis virus
GWSVRETACL

SEQ ID NO: 198718 - protein, 10 aa, Tick-borne encephalitis virus
WSVRETACLS

SEQ ID NO: 198719 - protein, 10 aa, Tick-borne encephalitis virus
SVRETACLSK

SEQ ID NO: 198720 - protein, 10 aa, Tick-borne encephalitis virus
VRETACLSKA

SEQ ID NO: 198721 - protein, 10 aa, Tick-borne encephalitis virus
RETACLSKAY

SEQ ID NO: 198722 - protein, 10 aa, Tick-borne encephalitis virus
ETACLSKAYG

SEQ ID NO: 198723 - protein, 10 aa, Tick-borne encephalitis virus
TACLSKAYGQ

SEQ ID NO: 198724 - protein, 10 aa, Tick-borne encephalitis virus
ACLSKAYGQM

SEQ ID NO: 198725 - protein, 10 aa, Tick-borne encephalitis virus
CLSKAYGQMW

SEQ ID NO: 198726 - protein, 10 aa, Tick-borne encephalitis virus
LSKAYGQMWL

SEQ ID NO: 198727 - protein, 10 aa, Tick-borne encephalitis virus
SKAYGQMWLL

SEQ ID NO: 198728 - protein, 10 aa, Tick-borne encephalitis virus
KAYGQMWLLS

SEQ ID NO: 198729 - protein, 10 aa, Tick-borne encephalitis virus
AYGQMWLLSY

SEQ ID NO: 198730 - protein, 10 aa, Tick-borne encephalitis virus
YGQMWLLSYF

SEQ ID NO: 198731 - protein, 10 aa, Tick-borne encephalitis virus
GQMWLLSYFH

SEQ ID NO: 198732 - protein, 10 aa, Tick-borne encephalitis virus
QMWLLSYFHR

SEQ ID NO: 198733 - protein, 10 aa, Tick-borne encephalitis virus
MWLLSYFHRR

SEQ ID NO: 198734 - protein, 10 aa, Tick-borne encephalitis virus
WLLSYFHRRD

SEQ ID NO: 198735 - protein, 10 aa, Tick-borne encephalitis virus
LLSYFHRRDL

SEQ ID NO: 198736 - protein, 10 aa, Tick-borne encephalitis virus
LSYFHRRDLR

SEQ ID NO: 198737 - protein, 10 aa, Tick-borne encephalitis virus
SYFHRRDLRT

SEQ ID NO: 198738 - protein, 10 aa, Tick-borne encephalitis virus
YFHRRDLRTL

SEQ ID NO: 198739 - protein, 10 aa, Tick-borne encephalitis virus
FHRRDLRTLG

SEQ ID NO: 198740 - protein, 10 aa, Tick-borne encephalitis virus
HRRDLRTLGL

SEQ ID NO: 198741 - protein, 10 aa, Tick-borne encephalitis virus
RRDLRTLGLA

SEQ ID NO: 198742 - protein, 10 aa, Tick-borne encephalitis virus
RDLRTLGLAI

SEQ ID NO: 198743 - protein, 10 aa, Tick-borne encephalitis virus
DLRTLGLAIC

SEQ ID NO: 198744 - protein, 10 aa, Tick-borne encephalitis virus
LRTLGLAICS

SEQ ID NO: 198745 - protein, 10 aa, Tick-borne encephalitis virus
RTLGLAICSA

SEQ ID NO: 198746 - protein, 10 aa, Tick-borne encephalitis virus
TLGLAICSAV

SEQ ID NO: 198747 - protein, 10 aa, Tick-borne encephalitis virus
LGLAICSAVP

SEQ ID NO: 198748 - protein, 10 aa, Tick-borne encephalitis virus
SAVPVDWVPT

SEQ ID NO: 198749 - protein, 10 aa, Tick-borne encephalitis virus
AVPVDWVPTG

SEQ ID NO: 198750 - protein, 10 aa, Tick-borne encephalitis virus
VPVDWVPTGR

SEQ ID NO: 198751 - protein, 10 aa, Tick-borne encephalitis virus
PVDWVPTGRT

SEQ ID NO: 198752 - protein, 10 aa, Tick-borne encephalitis virus
VDWVPTGRTT

SEQ ID NO: 198753 - protein, 10 aa, Tick-borne encephalitis virus
DWVPTGRTTW

SEQ ID NO: 198754 - protein, 10 aa, Tick-borne encephalitis virus
WVPTGRTTWS

SEQ ID NO: 198755 - protein, 10 aa, Tick-borne encephalitis virus
VPTGRTTWSI

SEQ ID NO: 198756 - protein, 10 aa, Tick-borne encephalitis virus
PTGRTTWSIH

SEQ ID NO: 198757 - protein, 10 aa, Tick-borne encephalitis virus
TGRTTWSIHA

SEQ ID NO: 198758 - protein, 10 aa, Tick-borne encephalitis virus
GRTTWSIHAS

SEQ ID NO: 198759 - protein, 10 aa, Tick-borne encephalitis virus
RTTWSIHASG

SEQ ID NO: 198760 - protein, 10 aa, Tick-borne encephalitis virus
TTWSIHASGA

SEQ ID NO: 198761 - protein, 10 aa, Tick-borne encephalitis virus
TWSIHASGAW

SEQ ID NO: 198762 - protein, 10 aa, Tick-borne encephalitis virus
WSIHASGAWM

SEQ ID NO: 198763 - protein, 10 aa, Tick-borne encephalitis virus
SIHASGAWMT

SEQ ID NO: 198764 - protein, 10 aa, Tick-borne encephalitis virus
IHASGAWMTT

SEQ ID NO: 198765 - protein, 10 aa, Tick-borne encephalitis virus
HASGAWMTTE

SEQ ID NO: 198766 - protein, 10 aa, Tick-borne encephalitis virus
ASGAWMTTED

SEQ ID NO: 198767 - protein, 10 aa, Tick-borne encephalitis virus
SGAWMTTEDM

SEQ ID NO: 198768 - protein, 10 aa, Tick-borne encephalitis virus
GAWMTTEDML

SEQ ID NO: 198769 - protein, 10 aa, Tick-borne encephalitis virus
AWMTTEDMLD

SEQ ID NO: 198770 - protein, 10 aa, Tick-borne encephalitis virus
WMTTEDMLDV

SEQ ID NO: 198771 - protein, 10 aa, Tick-borne encephalitis virus
MTTEDMLDVW

SEQ ID NO: 198772 - protein, 10 aa, Tick-borne encephalitis virus
TTEDMLDVWN

SEQ ID NO: 198773 - protein, 10 aa, Tick-borne encephalitis virus
TEDMLDVWNR

SEQ ID NO: 198774 - protein, 10 aa, Tick-borne encephalitis virus
EDMLDVWNRV

SEQ ID NO: 198775 - protein, 10 aa, Tick-borne encephalitis virus
DMLDVWNRVW

SEQ ID NO: 198776 - protein, 10 aa, Tick-borne encephalitis virus
MLDVWNRVWI

SEQ ID NO: 198777 - protein, 10 aa, Tick-borne encephalitis virus
LDVWNRVWIL

SEQ ID NO: 198778 - protein, 10 aa, Tick-borne encephalitis virus
DVWNRVWILD

SEQ ID NO: 198779 - protein, 10 aa, Tick-borne encephalitis virus
VWNRVWILDN

SEQ ID NO: 198780 - protein, 10 aa, Tick-borne encephalitis virus
WNRVWILDNP

SEQ ID NO: 198781 - protein, 10 aa, Tick-borne encephalitis virus
NRVWILDNPF

SEQ ID NO: 198782 - protein, 10 aa, Tick-borne encephalitis virus
RVWILDNPFM

SEQ ID NO: 198783 - protein, 10 aa, Tick-borne encephalitis virus
VWILDNPFMH

SEQ ID NO: 198784 - protein, 10 aa, Tick-borne encephalitis virus
WILDNPFMHS

SEQ ID NO: 198785 - protein, 10 aa, Tick-borne encephalitis virus
ILDNPFMHSK

SEQ ID NO: 198786 - protein, 10 aa, Tick-borne encephalitis virus
LDNPFMHSKE

SEQ ID NO: 198787 - protein, 10 aa, Tick-borne encephalitis virus
DNPFMHSKEK

SEQ ID NO: 198788 - protein, 10 aa, Tick-borne encephalitis virus
EWRDVPYLPK

SEQ ID NO: 198789 - protein, 10 aa, Tick-borne encephalitis virus
WRDVPYLPKS

SEQ ID NO: 198790 - protein, 10 aa, Tick-borne encephalitis virus
VPYLPKSHDM

SEQ ID NO: 198791 - protein, 10 aa, Tick-borne encephalitis virus
PYLPKSHDML

SEQ ID NO: 198792 - protein, 10 aa, Tick-borne encephalitis virus
YLPKSHDMLC

SEQ ID NO: 198793 - protein, 10 aa, Tick-borne encephalitis virus
LPKSHDMLCS

SEQ ID NO: 198794 - protein, 10 aa, Tick-borne encephalitis virus
PKSHDMLCSS

SEQ ID NO: 198795 - protein, 10 aa, Tick-borne encephalitis virus
KSHDMLCSSL

SEQ ID NO: 198796 - protein, 10 aa, Tick-borne encephalitis virus
SHDMLCSSLV

SEQ ID NO: 198797 - protein, 10 aa, Tick-borne encephalitis virus
HDMLCSSLVG

SEQ ID NO: 198798 - protein, 10 aa, Tick-borne encephalitis virus
DMLCSSLVGR

SEQ ID NO: 198799 - protein, 10 aa, Tick-borne encephalitis virus
MLCSSLVGRK

SEQ ID NO: 198800 - protein, 10 aa, Tick-borne encephalitis virus
LCSSLVGRKE

SEQ ID NO: 198801 - protein, 10 aa, Tick-borne encephalitis virus
CSSLVGRKER

SEQ ID NO: 198802 - protein, 10 aa, Tick-borne encephalitis virus
SSLVGRKERA

SEQ ID NO: 198803 - protein, 10 aa, Tick-borne encephalitis virus
SLVGRKERAE

SEQ ID NO: 198804 - protein, 10 aa, Tick-borne encephalitis virus
LVGRKERAEW

SEQ ID NO: 198805 - protein, 10 aa, Tick-borne encephalitis virus
VGRKERAEWA

SEQ ID NO: 198806 - protein, 10 aa, Tick-borne encephalitis virus
GRKERAEWAK

SEQ ID NO: 198807 - protein, 10 aa, Tick-borne encephalitis virus
RKERAEWAKN

SEQ ID NO: 198808 - protein, 10 aa, Tick-borne encephalitis virus
KERAEWAKNI

SEQ ID NO: 198809 - protein, 10 aa, Tick-borne encephalitis virus
ERAEWAKNIW

SEQ ID NO: 198810 - protein, 10 aa, Tick-borne encephalitis virus
RAEWAKNIWG

SEQ ID NO: 198811 - protein, 10 aa, Tick-borne encephalitis virus
AEWAKNIWGA

SEQ ID NO: 198812 - protein, 10 aa, Tick-borne encephalitis virus
EWAKNIWGAV

SEQ ID NO: 198813 - protein, 10 aa, Tick-borne encephalitis virus
WAKNIWGAVE

SEQ ID NO: 198814 - protein, 10 aa, Tick-borne encephalitis virus
AKNIWGAVEK

SEQ ID NO: 198815 - protein, 10 aa, Tick-borne encephalitis virus
KNIWGAVEKV

SEQ ID NO: 198816 - protein, 10 aa, Tick-borne encephalitis virus
NIWGAVEKVR

SEQ ID NO: 198817 - protein, 10 aa, Tick-borne encephalitis virus
IWGAVEKVRK

SEQ ID NO: 198818 - protein, 10 aa, Tick-borne encephalitis virus
WGAVEKVRKM

SEQ ID NO: 198819 - protein, 10 aa, Tick-borne encephalitis virus
GAVEKVRKMI

SEQ ID NO: 198820 - protein, 10 aa, Tick-borne encephalitis virus
AVEKVRKMIG

SEQ ID NO: 198821 - protein, 10 aa, Tick-borne encephalitis virus
KFKDYLSCMD

SEQ ID NO: 198822 - protein, 10 aa, Tick-borne encephalitis virus
FKDYLSCMDR

SEQ ID NO: 198823 - protein, 10 aa, Tick-borne encephalitis virus
KDYLSCMDRH

SEQ ID NO: 198824 - protein, 10 aa, Tick-borne encephalitis virus
DYLSCMDRHD

SEQ ID NO: 198825 - protein, 10 aa, Tick-borne encephalitis virus
YLSCMDRHDL

SEQ ID NO: 198826 - protein, 10 aa, Tick-borne encephalitis virus
LSCMDRHDLH

SEQ ID NO: 198827 - protein, 10 aa, Tick-borne encephalitis virus
SCMDRHDLHW

SEQ ID NO: 198828 - protein, 10 aa, Tick-borne encephalitis virus
CMDRHDLHWE

SEQ ID NO: 198829 - protein, 10 aa, Tick-borne encephalitis virus
MDRHDLHWEL

SEQ ID NO: 198830 - protein, 10 aa, Tick-borne encephalitis virus
DRHDLHWELK

SEQ ID NO: 198831 - protein, 10 aa, Tick-borne encephalitis virus
RHDLHWELKL

SEQ ID NO: 198832 - protein, 10 aa, Tick-borne encephalitis virus
HDLHWELKLE

SEQ ID NO: 198833 - protein, 10 aa, Tick-borne encephalitis virus
DLHWELKLES

SEQ ID NO: 198834 - protein, 10 aa, Tick-borne encephalitis virus
LHWELKLESS

SEQ ID NO: 198835 - protein, 10 aa, Tick-borne encephalitis virus
HWELKLESSI

SEQ ID NO: 198836 - protein, 10 aa, Tick-borne encephalitis virus
WELKLESSII

SEQ ID NO: 198837 - protein, 10 aa, Tick-borne encephalitis virus
MVKKAILKGK

SEQ ID NO: 198838 - protein, 10 aa, Tick-borne encephalitis virus
VKKAILKGKG

SEQ ID NO: 198839 - protein, 10 aa, Tick-borne encephalitis virus
KKAILKGKGG

SEQ ID NO: 198840 - protein, 10 aa, Tick-borne encephalitis virus
GKGGGPPRRA

SEQ ID NO: 198841 - protein, 10 aa, Tick-borne encephalitis virus
KGGGPPRRAS

SEQ ID NO: 198842 - protein, 10 aa, Tick-borne encephalitis virus
GGGPPRRASK

SEQ ID NO: 198843 - protein, 10 aa, Tick-borne encephalitis virus
GGPPRRASKE

SEQ ID NO: 198844 - protein, 10 aa, Tick-borne encephalitis virus
GPPRRASKET

SEQ ID NO: 198845 - protein, 10 aa, Tick-borne encephalitis virus
PPRRASKETA

SEQ ID NO: 198846 - protein, 10 aa, Tick-borne encephalitis virus
PRRVSKETAT

SEQ ID NO: 198847 - protein, 10 aa, Tick-borne encephalitis virus
RRVSKETATK

SEQ ID NO: 198848 - protein, 10 aa, Tick-borne encephalitis virus
RVSKETATKT

SEQ ID NO: 198849 - protein, 10 aa, Tick-borne encephalitis virus
VSKETATKTR

SEQ ID NO: 198850 - protein, 10 aa, Tick-borne encephalitis virus
SKETATKTRQ

SEQ ID NO: 198851 - protein, 10 aa, Tick-borne encephalitis virus
KETATKTRQP

SEQ ID NO: 198852 - protein, 10 aa, Tick-borne encephalitis virus
ETATKTRQPR

SEQ ID NO: 198853 - protein, 10 aa, Tick-borne encephalitis virus
TATKTRQPRV

SEQ ID NO: 198854 - protein, 10 aa, Tick-borne encephalitis virus
AKKTRQSRVR

SEQ ID NO: 198855 - protein, 10 aa, Tick-borne encephalitis virus
KKTRQSRVRM

SEQ ID NO: 198856 - protein, 10 aa, Tick-borne encephalitis virus
KTRQSRVRMP

SEQ ID NO: 198857 - protein, 10 aa, Tick-borne encephalitis virus
TRQSRVRMPN

SEQ ID NO: 198858 - protein, 10 aa, Tick-borne encephalitis virus
RQSRVRMPNG

SEQ ID NO: 198859 - protein, 10 aa, Tick-borne encephalitis virus
QSRVRMPNGL

SEQ ID NO: 198860 - protein, 10 aa, Tick-borne encephalitis virus
SRVRMPNGLV

SEQ ID NO: 198861 - protein, 10 aa, Tick-borne encephalitis virus
RVRMPNGLVL

SEQ ID NO: 198862 - protein, 10 aa, Tick-borne encephalitis virus
VRMPNGLVLM

SEQ ID NO: 198863 - protein, 10 aa, Tick-borne encephalitis virus
RMPNGLVLMR

SEQ ID NO: 198864 - protein, 10 aa, Tick-borne encephalitis virus
MPSGLVLMRM

SEQ ID NO: 198865 - protein, 10 aa, Tick-borne encephalitis virus
PNGLVLMRML

SEQ ID NO: 198866 - protein, 10 aa, Tick-borne encephalitis virus
NGLVLMRMLG

SEQ ID NO: 198867 - protein, 10 aa, Tick-borne encephalitis virus
GLVLMRMLGI

SEQ ID NO: 198868 - protein, 10 aa, Tick-borne encephalitis virus
LVLMRMLGIL

SEQ ID NO: 198869 - protein, 10 aa, Tick-borne encephalitis virus
VLMRMLGILW

SEQ ID NO: 198870 - protein, 10 aa, Tick-borne encephalitis virus
LMRMLGILWH

SEQ ID NO: 198871 - protein, 10 aa, Tick-borne encephalitis virus
MRMLGILWHA

SEQ ID NO: 198872 - protein, 10 aa, Tick-borne encephalitis virus
RMMGILWHAI

SEQ ID NO: 198873 - protein, 10 aa, Tick-borne encephalitis virus
MMGILWHAIA

SEQ ID NO: 198874 - protein, 10 aa, Tick-borne encephalitis virus
MGILWHAIAG

SEQ ID NO: 198875 - protein, 10 aa, Tick-borne encephalitis virus
GILWHAIAGT

SEQ ID NO: 198876 - protein, 10 aa, Tick-borne encephalitis virus
ILWHAIAGTA

SEQ ID NO: 198877 - protein, 10 aa, Tick-borne encephalitis virus
LWHAIAGTAR

SEQ ID NO: 198878 - protein, 10 aa, Tick-borne encephalitis virus
WHAVAGTARN

SEQ ID NO: 198879 - protein, 10 aa, Tick-borne encephalitis virus
HAVAGTARNP

SEQ ID NO: 198880 - protein, 10 aa, Tick-borne encephalitis virus
AVAGTARNPV

SEQ ID NO: 198881 - protein, 10 aa, Tick-borne encephalitis virus
VAGTARNPVL

SEQ ID NO: 198882 - protein, 10 aa, Tick-borne encephalitis virus
AGTARNPVLK

SEQ ID NO: 198883 - protein, 10 aa, Tick-borne encephalitis virus
GTARNPVLKA

SEQ ID NO: 198884 - protein, 10 aa, Tick-borne encephalitis virus
TARNPVLKAF

SEQ ID NO: 198885 - protein, 10 aa, Tick-borne encephalitis virus
ARNPVLKAFW

SEQ ID NO: 198886 - protein, 10 aa, Tick-borne encephalitis virus
RNPVLKAFWN

SEQ ID NO: 198887 - protein, 10 aa, Tick-borne encephalitis virus
NPVLKAFWNS

SEQ ID NO: 198888 - protein, 10 aa, Tick-borne encephalitis virus
PVLKAFWNSV

SEQ ID NO: 198889 - protein, 10 aa, Tick-borne encephalitis virus
VLKAFWNSVP

SEQ ID NO: 198890 - protein, 10 aa, Tick-borne encephalitis virus
LKAFWNSVPL

SEQ ID NO: 198891 - protein, 10 aa, Tick-borne encephalitis virus
KSFWNSVPLR

SEQ ID NO: 198892 - protein, 10 aa, Tick-borne encephalitis virus
AFWNSVPLKQ

SEQ ID NO: 198893 - protein, 10 aa, Tick-borne encephalitis virus
FWNSVPLRQA

SEQ ID NO: 198894 - protein, 10 aa, Tick-borne encephalitis virus
WNSVPLRQAT

SEQ ID NO: 198895 - protein, 10 aa, Tick-borne encephalitis virus
SVPLRQATAA

SEQ ID NO: 198896 - protein, 10 aa, Tick-borne encephalitis virus
VPLRQATAAL

SEQ ID NO: 198897 - protein, 10 aa, Tick-borne encephalitis virus
PLRQATAALR

SEQ ID NO: 198898 - protein, 10 aa, Tick-borne encephalitis virus
LRQATAALRK

SEQ ID NO: 198899 - protein, 10 aa, Tick-borne encephalitis virus
RQATAALRKI

SEQ ID NO: 198900 - protein, 10 aa, Tick-borne encephalitis virus
QAMAALRKIK

SEQ ID NO: 198901 - protein, 10 aa, Tick-borne encephalitis virus
ATAALRKIKR

SEQ ID NO: 198902 - protein, 10 aa, Tick-borne encephalitis virus
TAALRKIKRT

SEQ ID NO: 198903 - protein, 10 aa, Tick-borne encephalitis virus
AALRKIKRTV

SEQ ID NO: 198904 - protein, 10 aa, Tick-borne encephalitis virus
ALRKIKRTVS

SEQ ID NO: 198905 - protein, 10 aa, Tick-borne encephalitis virus
LRKIKRTVSA

SEQ ID NO: 198906 - protein, 10 aa, Tick-borne encephalitis virus
RKIKRTVSAL

SEQ ID NO: 198907 - protein, 10 aa, Tick-borne encephalitis virus
KIKRTVSALM

SEQ ID NO: 198908 - protein, 10 aa, Tick-borne encephalitis virus
TVSALMVGLQ

SEQ ID NO: 198909 - protein, 10 aa, Tick-borne encephalitis virus
LMVGLQKRGK

SEQ ID NO: 198910 - protein, 10 aa, Tick-borne encephalitis virus
MVGLQKRGKR

SEQ ID NO: 198911 - protein, 10 aa, Tick-borne encephalitis virus
VGLQKRGKRR

SEQ ID NO: 198912 - protein, 10 aa, Tick-borne encephalitis virus
GLQKRGKRRS

SEQ ID NO: 198913 - protein, 10 aa, Tick-borne encephalitis virus
LQKRGKRRSA

SEQ ID NO: 198914 - protein, 10 aa, Tick-borne encephalitis virus
TLAATVRKEG

SEQ ID NO: 198915 - protein, 10 aa, Tick-borne encephalitis virus
LAATVRKEGD

SEQ ID NO: 198916 - protein, 10 aa, Tick-borne encephalitis virus
AATVRKEGDG

SEQ ID NO: 198917 - protein, 10 aa, Tick-borne encephalitis virus
ATVRKERDGS

SEQ ID NO: 198918 - protein, 10 aa, Tick-borne encephalitis virus
TVRKERDGST

SEQ ID NO: 198919 - protein, 10 aa, Tick-borne encephalitis virus
VRKERDGSTV

SEQ ID NO: 198920 - protein, 10 aa, Tick-borne encephalitis virus
RKERDGSTVI

SEQ ID NO: 198921 - protein, 10 aa, Tick-borne encephalitis virus
KERDGSTVIR

SEQ ID NO: 198922 - protein, 10 aa, Tick-borne encephalitis virus
ERDGSTVIRA

SEQ ID NO: 198923 - protein, 10 aa, Tick-borne encephalitis virus
RDGSTVIRAE

SEQ ID NO: 198924 - protein, 10 aa, Tick-borne encephalitis virus
DGSTVIRAEG

SEQ ID NO: 198925 - protein, 10 aa, Tick-borne encephalitis virus
GSTVIRAEGK

SEQ ID NO: 198926 - protein, 10 aa, Tick-borne encephalitis virus
STVIRAEGKD

SEQ ID NO: 198927 - protein, 10 aa, Tick-borne encephalitis virus
TVIRAEGRDA

SEQ ID NO: 198928 - protein, 10 aa, Tick-borne encephalitis virus
VIRAEGRDAA

SEQ ID NO: 198929 - protein, 10 aa, Tick-borne encephalitis virus
IRAEGRDAAT

SEQ ID NO: 198930 - protein, 10 aa, Tick-borne encephalitis virus
RAEGRDAATQ

SEQ ID NO: 198931 - protein, 10 aa, Tick-borne encephalitis virus
AEGRDAATQV

SEQ ID NO: 198932 - protein, 10 aa, Tick-borne encephalitis virus
EGRDAATQVR

SEQ ID NO: 198933 - protein, 10 aa, Tick-borne encephalitis virus
GRDAATQVRV

SEQ ID NO: 198934 - protein, 10 aa, Tick-borne encephalitis virus
RDAATQVRVE

SEQ ID NO: 198935 - protein, 10 aa, Tick-borne encephalitis virus
RVENGTCVIM

SEQ ID NO: 198936 - protein, 10 aa, Tick-borne encephalitis virus
VENGTCVILV

SEQ ID NO: 198937 - protein, 10 aa, Tick-borne encephalitis virus
ENGTCVILVT

SEQ ID NO: 198938 - protein, 10 aa, Tick-borne encephalitis virus
NGTCVILVTD

SEQ ID NO: 198939 - protein, 10 aa, Tick-borne encephalitis virus
GTCVILVTDM

SEQ ID NO: 198940 - protein, 10 aa, Tick-borne encephalitis virus
TCVILVTDMG

SEQ ID NO: 198941 - protein, 10 aa, Tick-borne encephalitis virus
CVILVTDMGS

SEQ ID NO: 198942 - protein, 10 aa, Tick-borne encephalitis virus
VILVTDMGSW

SEQ ID NO: 198943 - protein, 10 aa, Tick-borne encephalitis virus
ILVTDMGSWC

SEQ ID NO: 198944 - protein, 10 aa, Tick-borne encephalitis virus
LVTDMGSWCD

SEQ ID NO: 198945 - protein, 10 aa, Tick-borne encephalitis virus
VTDMGSWCDD

SEQ ID NO: 198946 - protein, 10 aa, Tick-borne encephalitis virus
TDMGAWCDDS

SEQ ID NO: 198947 - protein, 10 aa, Tick-borne encephalitis virus
DMGAWCDDSL

SEQ ID NO: 198948 - protein, 10 aa, Tick-borne encephalitis virus
MGSWCDDSLS

SEQ ID NO: 198949 - protein, 10 aa, Tick-borne encephalitis virus
GSWCDDSLSY

SEQ ID NO: 198950 - protein, 10 aa, Tick-borne encephalitis virus
SWCDDSLSYE

SEQ ID NO: 198951 - protein, 10 aa, Tick-borne encephalitis virus
WCDDSLSYEC

SEQ ID NO: 198952 - protein, 10 aa, Tick-borne encephalitis virus
CDDSLSYECV

SEQ ID NO: 198953 - protein, 10 aa, Tick-borne encephalitis virus
DDSLSYECVT

SEQ ID NO: 198954 - protein, 10 aa, Tick-borne encephalitis virus
DSLSYECVTI

SEQ ID NO: 198955 - protein, 10 aa, Tick-borne encephalitis virus
SLSYECVTID

SEQ ID NO: 198956 - protein, 10 aa, Tick-borne encephalitis virus
LSYECVTIDQ

SEQ ID NO: 198957 - protein, 10 aa, Tick-borne encephalitis virus
SYECVTIDQG

SEQ ID NO: 198958 - protein, 10 aa, Tick-borne encephalitis virus
VDCFCRNVDR

SEQ ID NO: 198959 - protein, 10 aa, Tick-borne encephalitis virus
DCFCRNVDRV

SEQ ID NO: 198960 - protein, 10 aa, Tick-borne encephalitis virus
CFCRNVDGVH

SEQ ID NO: 198961 - protein, 10 aa, Tick-borne encephalitis virus
FCRNVDGVHL

SEQ ID NO: 198962 - protein, 10 aa, Tick-borne encephalitis virus
CRNVDGVHLE

SEQ ID NO: 198963 - protein, 10 aa, Tick-borne encephalitis virus
RNVDGVHLEY

SEQ ID NO: 198964 - protein, 10 aa, Tick-borne encephalitis virus
NVDGVHLEYG

SEQ ID NO: 198965 - protein, 10 aa, Tick-borne encephalitis virus
VDGVHLEYGR

SEQ ID NO: 198966 - protein, 10 aa, Tick-borne encephalitis virus
DGVHLEYGRC

SEQ ID NO: 198967 - protein, 10 aa, Tick-borne encephalitis virus
GVHLEYGRCG

SEQ ID NO: 198968 - protein, 10 aa, Tick-borne encephalitis virus
VHLEYGRCGK

SEQ ID NO: 198969 - protein, 10 aa, Tick-borne encephalitis virus
HLEYGRCGKQ

SEQ ID NO: 198970 - protein, 10 aa, Tick-borne encephalitis virus
SRTRRSVLIR

SEQ ID NO: 198971 - protein, 10 aa, Tick-borne encephalitis virus
RTRRSVLIRS

SEQ ID NO: 198972 - protein, 10 aa, Tick-borne encephalitis virus
TRRSVLIRSH

SEQ ID NO: 198973 - protein, 10 aa, Tick-borne encephalitis virus
RRSVLIRSHA

SEQ ID NO: 198974 - protein, 10 aa, Tick-borne encephalitis virus
RSVLIRSHAQ

SEQ ID NO: 198975 - protein, 10 aa, Tick-borne encephalitis virus
SVLIRSHAQG

SEQ ID NO: 198976 - protein, 10 aa, Tick-borne encephalitis virus
VLIPSHAQGE

SEQ ID NO: 198977 - protein, 10 aa, Tick-borne encephalitis virus
LIPSHAQGEL

SEQ ID NO: 198978 - protein, 10 aa, Tick-borne encephalitis virus
IPSHAQGELT

SEQ ID NO: 198979 - protein, 10 aa, Tick-borne encephalitis virus
PSHAQGELTG

SEQ ID NO: 198980 - protein, 10 aa, Tick-borne encephalitis virus
SHAQGELTGR

SEQ ID NO: 198981 - protein, 10 aa, Tick-borne encephalitis virus
HAQGELTGRG

SEQ ID NO: 198982 - protein, 10 aa, Tick-borne encephalitis virus
AQGELTGRGH

SEQ ID NO: 198983 - protein, 10 aa, Tick-borne encephalitis virus
QGELTGRGHK

SEQ ID NO: 198984 - protein, 10 aa, Tick-borne encephalitis virus
GELTGRGHKW

SEQ ID NO: 198985 - protein, 10 aa, Tick-borne encephalitis virus
ELTGRGHKWL

SEQ ID NO: 198986 - protein, 10 aa, Tick-borne encephalitis virus
LTGRGRKWLE

SEQ ID NO: 198987 - protein, 10 aa, Tick-borne encephalitis virus
TGRGRKWLEG

SEQ ID NO: 198988 - protein, 10 aa, Tick-borne encephalitis virus
GRGRKWLEGD

SEQ ID NO: 198989 - protein, 10 aa, Tick-borne encephalitis virus
RGRKWLEGDS

SEQ ID NO: 198990 - protein, 10 aa, Tick-borne encephalitis virus
GRKWLEGDSL

SEQ ID NO: 198991 - protein, 10 aa, Tick-borne encephalitis virus
RKWLEGDSLR

SEQ ID NO: 198992 - protein, 10 aa, Tick-borne encephalitis virus
RVEGWVWKNR

SEQ ID NO: 198993 - protein, 10 aa, Tick-borne encephalitis virus
VVWLTLESVV

SEQ ID NO: 198994 - protein, 10 aa, Tick-borne encephalitis virus
VWLTLESVVT

SEQ ID NO: 198995 - protein, 10 aa, Tick-borne encephalitis virus
WLTLESVVTR

SEQ ID NO: 198996 - protein, 10 aa, Tick-borne encephalitis virus
LVVLLCLAPV

SEQ ID NO: 198997 - protein, 10 aa, Tick-borne encephalitis virus
AVLLCLAPVY

SEQ ID NO: 198998 - protein, 10 aa, Tick-borne encephalitis virus
ALLCLAPVYA

SEQ ID NO: 198999 - protein, 10 aa, Tick-borne encephalitis virus
LFCLAPVYAS

SEQ ID NO: 199000 - protein, 10 aa, Tick-borne encephalitis virus
FCLAPVYASR

SEQ ID NO: 199001 - protein, 10 aa, Tick-borne encephalitis virus
KPSMDVWLDA

SEQ ID NO: 199002 - protein, 10 aa, Tick-borne encephalitis virus
PSMDVWLDAI

SEQ ID NO: 199003 - protein, 10 aa, Tick-borne encephalitis virus
SMDVWLDAIY

SEQ ID NO: 199004 - protein, 10 aa, Tick-borne encephalitis virus
MDVWLDAIYQ

SEQ ID NO: 199005 - protein, 10 aa, Tick-borne encephalitis virus
DVWLDAIYQE

SEQ ID NO: 199006 - protein, 10 aa, Tick-borne encephalitis virus
VWLDAIYQEN

SEQ ID NO: 199007 - protein, 10 aa, Tick-borne encephalitis virus
WLDAIYQENP

SEQ ID NO: 199008 - protein, 10 aa, Tick-borne encephalitis virus
LDAIYQENPA

SEQ ID NO: 199009 - protein, 10 aa, Tick-borne encephalitis virus
DAIYQENPAK

SEQ ID NO: 199010 - protein, 10 aa, Tick-borne encephalitis virus
AIYQENPAKT

SEQ ID NO: 199011 - protein, 10 aa, Tick-borne encephalitis virus
IYQESPAKTR

SEQ ID NO: 199012 - protein, 10 aa, Tick-borne encephalitis virus
YQESPAKTRE

SEQ ID NO: 199013 - protein, 10 aa, Tick-borne encephalitis virus
QESPAKTREY

SEQ ID NO: 199014 - protein, 10 aa, Tick-borne encephalitis virus
ESPAKTREYC

SEQ ID NO: 199015 - protein, 10 aa, Tick-borne encephalitis virus
SPAKTREYCL

SEQ ID NO: 199016 - protein, 10 aa, Tick-borne encephalitis virus
PAQTREYCLH

SEQ ID NO: 199017 - protein, 10 aa, Tick-borne encephalitis virus
AQTREYCLHA

SEQ ID NO: 199018 - protein, 10 aa, Tick-borne encephalitis virus
KTREYCLHVK

SEQ ID NO: 199019 - protein, 10 aa, Tick-borne encephalitis virus
TREYCLHVKL

SEQ ID NO: 199020 - protein, 10 aa, Tick-borne encephalitis virus
REYCLHVKLS

SEQ ID NO: 199021 - protein, 10 aa, Tick-borne encephalitis virus
EYCLHVKLSD

SEQ ID NO: 199022 - protein, 10 aa, Tick-borne encephalitis virus
YCLHVKLSDT

SEQ ID NO: 199023 - protein, 10 aa, Tick-borne encephalitis virus
CLHVKLSDTK

SEQ ID NO: 199024 - protein, 10 aa, Tick-borne encephalitis virus
LHVKLSDTKV

SEQ ID NO: 199025 - protein, 10 aa, Tick-borne encephalitis virus
HVKLSDTKVA

SEQ ID NO: 199026 - protein, 10 aa, Tick-borne encephalitis virus
VKLSDTKVAA

SEQ ID NO: 199027 - protein, 10 aa, Tick-borne encephalitis virus
TKVAARCPTT

SEQ ID NO: 199028 - protein, 10 aa, Tick-borne encephalitis virus
KVAARCPTTG

SEQ ID NO: 199029 - protein, 10 aa, Tick-borne encephalitis virus
VAARCPTTGP

SEQ ID NO: 199030 - protein, 10 aa, Tick-borne encephalitis virus
AARCPTTGPA

SEQ ID NO: 199031 - protein, 10 aa, Tick-borne encephalitis virus
ARCPTTGPAT

SEQ ID NO: 199032 - protein, 10 aa, Tick-borne encephalitis virus
RCPTTGPATL

SEQ ID NO: 199033 - protein, 10 aa, Tick-borne encephalitis virus
CPTMGPATLT

SEQ ID NO: 199034 - protein, 10 aa, Tick-borne encephalitis virus
PTTGPATLAE

SEQ ID NO: 199035 - protein, 10 aa, Tick-borne encephalitis virus
TTGPATLAEQ

SEQ ID NO: 199036 - protein, 10 aa, Tick-borne encephalitis virus
TGPATLAEQH

SEQ ID NO: 199037 - protein, 10 aa, Tick-borne encephalitis virus
GPATLTEEHQ

SEQ ID NO: 199038 - protein, 10 aa, Tick-borne encephalitis virus
PATLAEEHQG

SEQ ID NO: 199039 - protein, 10 aa, Tick-borne encephalitis virus
ATLAEEHQGG

SEQ ID NO: 199040 - protein, 10 aa, Tick-borne encephalitis virus
TLAEEHQGGT

SEQ ID NO: 199041 - protein, 10 aa, Tick-borne encephalitis virus
LAEEHQGGTV

SEQ ID NO: 199042 - protein, 10 aa, Tick-borne encephalitis virus
AEEHQGGTVC

SEQ ID NO: 199043 - protein, 10 aa, Tick-borne encephalitis virus
EEHQGGTVCK

SEQ ID NO: 199044 - protein, 10 aa, Tick-borne encephalitis virus
EHQGGTVCKR

SEQ ID NO: 199045 - protein, 10 aa, Tick-borne encephalitis virus
HQGGTVCKRD

SEQ ID NO: 199046 - protein, 10 aa, Tick-borne encephalitis virus
QGGTVCKRDQ

SEQ ID NO: 199047 - protein, 10 aa, Tick-borne encephalitis virus
GGTVCKRDQS

SEQ ID NO: 199048 - protein, 10 aa, Tick-borne encephalitis virus
GLFGKGSIVA

SEQ ID NO: 199049 - protein, 10 aa, Tick-borne encephalitis virus
LFGKGSIVAC

SEQ ID NO: 199050 - protein, 10 aa, Tick-borne encephalitis virus
FGKGSIVACV

SEQ ID NO: 199051 - protein, 10 aa, Tick-borne encephalitis virus
GKGSIVACVK

SEQ ID NO: 199052 - protein, 10 aa, Tick-borne encephalitis virus
KGSIVACVKA

SEQ ID NO: 199053 - protein, 10 aa, Tick-borne encephalitis virus
GSIVACVKAA

SEQ ID NO: 199054 - protein, 10 aa, Tick-borne encephalitis virus
SIVACVKAAC

SEQ ID NO: 199055 - protein, 10 aa, Tick-borne encephalitis virus
IVACVKAACE

SEQ ID NO: 199056 - protein, 10 aa, Tick-borne encephalitis virus
VACVKAACEA

SEQ ID NO: 199057 - protein, 10 aa, Tick-borne encephalitis virus
ACVKAACEAK

SEQ ID NO: 199058 - protein, 10 aa, Tick-borne encephalitis virus
CVKAACEAKK

SEQ ID NO: 199059 - protein, 10 aa, Tick-borne encephalitis virus
VKAACEAKKK

SEQ ID NO: 199060 - protein, 10 aa, Tick-borne encephalitis virus
KAACEAKKKA

SEQ ID NO: 199061 - protein, 10 aa, Tick-borne encephalitis virus
AACEAKKKAT

SEQ ID NO: 199062 - protein, 10 aa, Tick-borne encephalitis virus
ACEAKKKATG

SEQ ID NO: 199063 - protein, 10 aa, Tick-borne encephalitis virus
KKATGHVYDP

SEQ ID NO: 199064 - protein, 10 aa, Tick-borne encephalitis virus
KATGHVYDPN

SEQ ID NO: 199065 - protein, 10 aa, Tick-borne encephalitis virus
ATGHVYDANR

SEQ ID NO: 199066 - protein, 10 aa, Tick-borne encephalitis virus
TGHVYDPNKI

SEQ ID NO: 199067 - protein, 10 aa, Tick-borne encephalitis virus
GHVYDANRIV

SEQ ID NO: 199068 - protein, 10 aa, Tick-borne encephalitis virus
HVYDPNKIVY

SEQ ID NO: 199069 - protein, 10 aa, Tick-borne encephalitis virus
VYDPNKIVYP

SEQ ID NO: 199070 - protein, 10 aa, Tick-borne encephalitis virus
YDPNKIVYPV

SEQ ID NO: 199071 - protein, 10 aa, Tick-borne encephalitis virus
DANRIVYTVK

SEQ ID NO: 199072 - protein, 10 aa, Tick-borne encephalitis virus
ANKIVYTIKV

SEQ ID NO: 199073 - protein, 10 aa, Tick-borne encephalitis virus
NKIVYPVKVE

SEQ ID NO: 199074 - protein, 10 aa, Tick-borne encephalitis virus
KIVYTIKVEP

SEQ ID NO: 199075 - protein, 10 aa, Tick-borne encephalitis virus
IVYPVKVEPH

SEQ ID NO: 199076 - protein, 10 aa, Tick-borne encephalitis virus
VYPVKVEPHT

SEQ ID NO: 199077 - protein, 10 aa, Tick-borne encephalitis virus
YPVKVEPHTG

SEQ ID NO: 199078 - protein, 10 aa, Tick-borne encephalitis virus
PVKVEPHTGD

SEQ ID NO: 199079 - protein, 10 aa, Tick-borne encephalitis virus
IKVEPHTGDY

SEQ ID NO: 199080 - protein, 10 aa, Tick-borne encephalitis virus
EPHTGDYVAV

SEQ ID NO: 199081 - protein, 10 aa, Tick-borne encephalitis virus
PHTGDYVAPH

SEQ ID NO: 199082 - protein, 10 aa, Tick-borne encephalitis virus
HTGDYVAPHE

SEQ ID NO: 199083 - protein, 10 aa, Tick-borne encephalitis virus
TGDYVAPHET

SEQ ID NO: 199084 - protein, 10 aa, Tick-borne encephalitis virus
GDYVAPHETH

SEQ ID NO: 199085 - protein, 10 aa, Tick-borne encephalitis virus
DYVAPHETHS

SEQ ID NO: 199086 - protein, 10 aa, Tick-borne encephalitis virus
YVAVNETHSG

SEQ ID NO: 199087 - protein, 10 aa, Tick-borne encephalitis virus
VAVNETHSGR

SEQ ID NO: 199088 - protein, 10 aa, Tick-borne encephalitis virus
AVNETHSGRK

SEQ ID NO: 199089 - protein, 10 aa, Tick-borne encephalitis virus
PHETHSGRKT

SEQ ID NO: 199090 - protein, 10 aa, Tick-borne encephalitis virus
HETHSGRKTA

SEQ ID NO: 199091 - protein, 10 aa, Tick-borne encephalitis virus
ETHSGRKTPS

SEQ ID NO: 199092 - protein, 10 aa, Tick-borne encephalitis virus
THSGRKTPSF

SEQ ID NO: 199093 - protein, 10 aa, Tick-borne encephalitis virus
HSGRKTPSFT

SEQ ID NO: 199094 - protein, 10 aa, Tick-borne encephalitis virus
SGRKTASFTI

SEQ ID NO: 199095 - protein, 10 aa, Tick-borne encephalitis virus
GRKTASFTIS

SEQ ID NO: 199096 - protein, 10 aa, Tick-borne encephalitis virus
RKTASFTISS

SEQ ID NO: 199097 - protein, 10 aa, Tick-borne encephalitis virus
KTASFTISSE

SEQ ID NO: 199098 - protein, 10 aa, Tick-borne encephalitis virus
TASFTISSEK

SEQ ID NO: 199099 - protein, 10 aa, Tick-borne encephalitis virus
ASFTISSEKT

SEQ ID NO: 199100 - protein, 10 aa, Tick-borne encephalitis virus
SFTISSEKTI

SEQ ID NO: 199101 - protein, 10 aa, Tick-borne encephalitis virus
FTISSEKTIL

SEQ ID NO: 199102 - protein, 10 aa, Tick-borne encephalitis virus
TISSEKTILT

SEQ ID NO: 199103 - protein, 10 aa, Tick-borne encephalitis virus
ISSEKTILTM

SEQ ID NO: 199104 - protein, 10 aa, Tick-borne encephalitis virus
SSEKTILNMG

SEQ ID NO: 199105 - protein, 10 aa, Tick-borne encephalitis virus
SEKTILTMGE

SEQ ID NO: 199106 - protein, 10 aa, Tick-borne encephalitis virus
EKTILTMGEY

SEQ ID NO: 199107 - protein, 10 aa, Tick-borne encephalitis virus
KTILTMGEYG

SEQ ID NO: 199108 - protein, 10 aa, Tick-borne encephalitis virus
TILTMGEYGD

SEQ ID NO: 199109 - protein, 10 aa, Tick-borne encephalitis virus
ILTMGEYGDV

SEQ ID NO: 199110 - protein, 10 aa, Tick-borne encephalitis virus
LTMGEYGDVS

SEQ ID NO: 199111 - protein, 10 aa, Tick-borne encephalitis virus
TMGEYGDVSL

SEQ ID NO: 199112 - protein, 10 aa, Tick-borne encephalitis virus
MGEYGDVSLL

SEQ ID NO: 199113 - protein, 10 aa, Tick-borne encephalitis virus
GEYGDVSLLC

SEQ ID NO: 199114 - protein, 10 aa, Tick-borne encephalitis virus
EYGDVSLLCR

SEQ ID NO: 199115 - protein, 10 aa, Tick-borne encephalitis virus
YGDVSLLCKV

SEQ ID NO: 199116 - protein, 10 aa, Tick-borne encephalitis virus
GDVSLLCKVP

SEQ ID NO: 199117 - protein, 10 aa, Tick-borne encephalitis virus
DVSLLCKVPS

SEQ ID NO: 199118 - protein, 10 aa, Tick-borne encephalitis virus
VSLLCKVPSG

SEQ ID NO: 199119 - protein, 10 aa, Tick-borne encephalitis virus
SLLCKVPSGV

SEQ ID NO: 199120 - protein, 10 aa, Tick-borne encephalitis virus
LLCKVPSGVD

SEQ ID NO: 199121 - protein, 10 aa, Tick-borne encephalitis virus
LCKVPSGVDL

SEQ ID NO: 199122 - protein, 10 aa, Tick-borne encephalitis virus
CKVPSGVDLA

SEQ ID NO: 199123 - protein, 10 aa, Tick-borne encephalitis virus
KVPSGVDLAQ

SEQ ID NO: 199124 - protein, 10 aa, Tick-borne encephalitis virus
VPSGVDLAQT

SEQ ID NO: 199125 - protein, 10 aa, Tick-borne encephalitis virus
PSGVDLAQTV

SEQ ID NO: 199126 - protein, 10 aa, Tick-borne encephalitis virus
TVILELDKTV

SEQ ID NO: 199127 - protein, 10 aa, Tick-borne encephalitis virus
VILELDKTVE

SEQ ID NO: 199128 - protein, 10 aa, Tick-borne encephalitis virus
ILELDKTVEH

SEQ ID NO: 199129 - protein, 10 aa, Tick-borne encephalitis virus
LELDKTVEHL

SEQ ID NO: 199130 - protein, 10 aa, Tick-borne encephalitis virus
ELDKTVEHLP

SEQ ID NO: 199131 - protein, 10 aa, Tick-borne encephalitis virus
LDKTVEHLPT

SEQ ID NO: 199132 - protein, 10 aa, Tick-borne encephalitis virus
DKTVEHLPTA

SEQ ID NO: 199133 - protein, 10 aa, Tick-borne encephalitis virus
KTVEHLPTAW

SEQ ID NO: 199134 - protein, 10 aa, Tick-borne encephalitis virus
TVEHLPTAWQ

SEQ ID NO: 199135 - protein, 10 aa, Tick-borne encephalitis virus
VEHLPTAWQV

SEQ ID NO: 199136 - protein, 10 aa, Tick-borne encephalitis virus
EHLPTAWQVR

SEQ ID NO: 199137 - protein, 10 aa, Tick-borne encephalitis virus
HLPTAWQVRR

SEQ ID NO: 199138 - protein, 10 aa, Tick-borne encephalitis virus
LPTAWQVRRD

SEQ ID NO: 199139 - protein, 10 aa, Tick-borne encephalitis virus
PTAWQVRRDW

SEQ ID NO: 199140 - protein, 10 aa, Tick-borne encephalitis virus
TAWQVRRDWF

SEQ ID NO: 199141 - protein, 10 aa, Tick-borne encephalitis virus
AWQVRRDWFN

SEQ ID NO: 199142 - protein, 10 aa, Tick-borne encephalitis virus
WQVRRDWFND

SEQ ID NO: 199143 - protein, 10 aa, Tick-borne encephalitis virus
QVRRDWFNDL

SEQ ID NO: 199144 - protein, 10 aa, Tick-borne encephalitis virus
VRRDWFNDLA

SEQ ID NO: 199145 - protein, 10 aa, Tick-borne encephalitis virus
RRDWFNDLAL

SEQ ID NO: 199146 - protein, 10 aa, Tick-borne encephalitis virus
WFNDLALPWR

SEQ ID NO: 199147 - protein, 10 aa, Tick-borne encephalitis virus
FNDLALPWRH

SEQ ID NO: 199148 - protein, 10 aa, Tick-borne encephalitis virus
NDLALPWRHE

SEQ ID NO: 199149 - protein, 10 aa, Tick-borne encephalitis virus
DLALPWRHEG

SEQ ID NO: 199150 - protein, 10 aa, Tick-borne encephalitis virus
LALPWRHEGA

SEQ ID NO: 199151 - protein, 10 aa, Tick-borne encephalitis virus
ALPWRHEGAQ

SEQ ID NO: 199152 - protein, 10 aa, Tick-borne encephalitis virus
HEGAQQWNNA

SEQ ID NO: 199153 - protein, 10 aa, Tick-borne encephalitis virus
EGAQQWNNAE

SEQ ID NO: 199154 - protein, 10 aa, Tick-borne encephalitis virus
GAQQWNNAER

SEQ ID NO: 199155 - protein, 10 aa, Tick-borne encephalitis virus
AQQWNNAERL

SEQ ID NO: 199156 - protein, 10 aa, Tick-borne encephalitis virus
QQWNNAERLV

SEQ ID NO: 199157 - protein, 10 aa, Tick-borne encephalitis virus
QWNNAERLVE

SEQ ID NO: 199158 - protein, 10 aa, Tick-borne encephalitis virus
NAERLVEFGV

SEQ ID NO: 199159 - protein, 10 aa, Tick-borne encephalitis virus
AERLVEFGVP

SEQ ID NO: 199160 - protein, 10 aa, Tick-borne encephalitis virus
ERLVEFGVPH

SEQ ID NO: 199161 - protein, 10 aa, Tick-borne encephalitis virus
RLVEFGVPHA

SEQ ID NO: 199162 - protein, 10 aa, Tick-borne encephalitis virus
LVEFGVPHAV

SEQ ID NO: 199163 - protein, 10 aa, Tick-borne encephalitis virus
VEFGVPHAVK

SEQ ID NO: 199164 - protein, 10 aa, Tick-borne encephalitis virus
EFGVPHAVKM

SEQ ID NO: 199165 - protein, 10 aa, Tick-borne encephalitis virus
FGVPHAVKMD

SEQ ID NO: 199166 - protein, 10 aa, Tick-borne encephalitis virus
GVPHAVKMDV

SEQ ID NO: 199167 - protein, 10 aa, Tick-borne encephalitis virus
VPHAVKMDVY

SEQ ID NO: 199168 - protein, 10 aa, Tick-borne encephalitis virus
GDQTGVLLKA

SEQ ID NO: 199169 - protein, 10 aa, Tick-borne encephalitis virus
DQTGVLLKAL

SEQ ID NO: 199170 - protein, 10 aa, Tick-borne encephalitis virus
QTGVLLKALA

SEQ ID NO: 199171 - protein, 10 aa, Tick-borne encephalitis virus
TGVLLKALAG

SEQ ID NO: 199172 - protein, 10 aa, Tick-borne encephalitis virus
GVLLKALAGV

SEQ ID NO: 199173 - protein, 10 aa, Tick-borne encephalitis virus
VLLKALAGVP

SEQ ID NO: 199174 - protein, 10 aa, Tick-borne encephalitis virus
LLKALAGVPV

SEQ ID NO: 199175 - protein, 10 aa, Tick-borne encephalitis virus
LKALAGVPVA

SEQ ID NO: 199176 - protein, 10 aa, Tick-borne encephalitis virus
KALAGVPVAH

SEQ ID NO: 199177 - protein, 10 aa, Tick-borne encephalitis virus
ALAGVPVAHI

SEQ ID NO: 199178 - protein, 10 aa, Tick-borne encephalitis virus
LAGVPVAHIE

SEQ ID NO: 199179 - protein, 10 aa, Tick-borne encephalitis virus
AGVPVAHIEG

SEQ ID NO: 199180 - protein, 10 aa, Tick-borne encephalitis virus
GVPVAHIEGT

SEQ ID NO: 199181 - protein, 10 aa, Tick-borne encephalitis virus
VPVAHIEGTK

SEQ ID NO: 199182 - protein, 10 aa, Tick-borne encephalitis virus
PVAHIEGTKY

SEQ ID NO: 199183 - protein, 10 aa, Tick-borne encephalitis virus
VAHIEGTKYH

SEQ ID NO: 199184 - protein, 10 aa, Tick-borne encephalitis virus
AHIEGTKYHL

SEQ ID NO: 199185 - protein, 10 aa, Tick-borne encephalitis virus
HIEGTKYHLK

SEQ ID NO: 199186 - protein, 10 aa, Tick-borne encephalitis virus
IEGTKYHLKS

SEQ ID NO: 199187 - protein, 10 aa, Tick-borne encephalitis virus
EGTKYHLKSG

SEQ ID NO: 199188 - protein, 10 aa, Tick-borne encephalitis virus
GAKYHLKSGH

SEQ ID NO: 199189 - protein, 10 aa, Tick-borne encephalitis virus
AKYHLKSGHV

SEQ ID NO: 199190 - protein, 10 aa, Tick-borne encephalitis virus
EVGLEKLKMN

SEQ ID NO: 199191 - protein, 10 aa, Tick-borne encephalitis virus
VGLEKLKMNG

SEQ ID NO: 199192 - protein, 10 aa, Tick-borne encephalitis virus
GLEKLKMNGL

SEQ ID NO: 199193 - protein, 10 aa, Tick-borne encephalitis virus
LEKLKMNGLT

SEQ ID NO: 199194 - protein, 10 aa, Tick-borne encephalitis virus
EKLKMNGLTY

SEQ ID NO: 199195 - protein, 10 aa, Tick-borne encephalitis virus
KLKMNGLTYT

SEQ ID NO: 199196 - protein, 10 aa, Tick-borne encephalitis virus
LKMKGLTYTV

SEQ ID NO: 199197 - protein, 10 aa, Tick-borne encephalitis virus
KMKGLTYTVC

SEQ ID NO: 199198 - protein, 10 aa, Tick-borne encephalitis virus
MKGLTYTVCD

SEQ ID NO: 199199 - protein, 10 aa, Tick-borne encephalitis virus
KGLTYTVCDK

SEQ ID NO: 199200 - protein, 10 aa, Tick-borne encephalitis virus
GLTYTVCDKT

SEQ ID NO: 199201 - protein, 10 aa, Tick-borne encephalitis virus
LTYTVCDKTK

SEQ ID NO: 199202 - protein, 10 aa, Tick-borne encephalitis virus
TYTVCDKTKF

SEQ ID NO: 199203 - protein, 10 aa, Tick-borne encephalitis virus
YTMCDKTKFA

SEQ ID NO: 199204 - protein, 10 aa, Tick-borne encephalitis virus
TMCDKTKFAW

SEQ ID NO: 199205 - protein, 10 aa, Tick-borne encephalitis virus
MCDKTKFAWK

SEQ ID NO: 199206 - protein, 10 aa, Tick-borne encephalitis virus
CDKTKFAWKR

SEQ ID NO: 199207 - protein, 10 aa, Tick-borne encephalitis virus
DKTKFTWKRA

SEQ ID NO: 199208 - protein, 10 aa, Tick-borne encephalitis virus
KTKFTWKRAP

SEQ ID NO: 199209 - protein, 10 aa, Tick-borne encephalitis virus
TKFTWKRAPT

SEQ ID NO: 199210 - protein, 10 aa, Tick-borne encephalitis virus
KFTWKRAPTD

SEQ ID NO: 199211 - protein, 10 aa, Tick-borne encephalitis virus
FTWKRAPTDS

SEQ ID NO: 199212 - protein, 10 aa, Tick-borne encephalitis virus
TWKRAPTDSG

SEQ ID NO: 199213 - protein, 10 aa, Tick-borne encephalitis virus
WKRAPTDSGH

SEQ ID NO: 199214 - protein, 10 aa, Tick-borne encephalitis virus
KRAPTDSGHD

SEQ ID NO: 199215 - protein, 10 aa, Tick-borne encephalitis virus
RAPTDSGHDT

SEQ ID NO: 199216 - protein, 10 aa, Tick-borne encephalitis virus
TPTDSGHDTV

SEQ ID NO: 199217 - protein, 10 aa, Tick-borne encephalitis virus
GHDTVVMEVT

SEQ ID NO: 199218 - protein, 10 aa, Tick-borne encephalitis virus
HDTVVMEVTF

SEQ ID NO: 199219 - protein, 10 aa, Tick-borne encephalitis virus
DTVVMEVTFS

SEQ ID NO: 199220 - protein, 10 aa, Tick-borne encephalitis virus
TVVMEVTFSG

SEQ ID NO: 199221 - protein, 10 aa, Tick-borne encephalitis virus
VVMEVTFSGT

SEQ ID NO: 199222 - protein, 10 aa, Tick-borne encephalitis virus
VMEVTFSGTK

SEQ ID NO: 199223 - protein, 10 aa, Tick-borne encephalitis virus
MEVTFSGTKP

SEQ ID NO: 199224 - protein, 10 aa, Tick-borne encephalitis virus
EVTFSGTKPC

SEQ ID NO: 199225 - protein, 10 aa, Tick-borne encephalitis virus
VTFSGTKPCR

SEQ ID NO: 199226 - protein, 10 aa, Tick-borne encephalitis virus
TFSGTKPCRI

SEQ ID NO: 199227 - protein, 10 aa, Tick-borne encephalitis virus
IPVRAVAHGF

SEQ ID NO: 199228 - protein, 10 aa, Tick-borne encephalitis virus
PVRAVAHGFP

SEQ ID NO: 199229 - protein, 10 aa, Tick-borne encephalitis virus
VRAVAHGFPD

SEQ ID NO: 199230 - protein, 10 aa, Tick-borne encephalitis virus
RAVAHGFPDV

SEQ ID NO: 199231 - protein, 10 aa, Tick-borne encephalitis virus
AVAHGFPDVN

SEQ ID NO: 199232 - protein, 10 aa, Tick-borne encephalitis virus
VAHGFPDVNV

SEQ ID NO: 199233 - protein, 10 aa, Tick-borne encephalitis virus
AHGFPDVNVA

SEQ ID NO: 199234 - protein, 10 aa, Tick-borne encephalitis virus
HGFPDVNVAM

SEQ ID NO: 199235 - protein, 10 aa, Tick-borne encephalitis virus
GFPDVNVAML

SEQ ID NO: 199236 - protein, 10 aa, Tick-borne encephalitis virus
FPDVNVAMLI

SEQ ID NO: 199237 - protein, 10 aa, Tick-borne encephalitis virus
LITPNPTIET

SEQ ID NO: 199238 - protein, 10 aa, Tick-borne encephalitis virus
ITPNPTIETN

SEQ ID NO: 199239 - protein, 10 aa, Tick-borne encephalitis virus
TPNPTIETNG

SEQ ID NO: 199240 - protein, 10 aa, Tick-borne encephalitis virus
PNPTIETNGG

SEQ ID NO: 199241 - protein, 10 aa, Tick-borne encephalitis virus
NPTIETNGGG

SEQ ID NO: 199242 - protein, 10 aa, Tick-borne encephalitis virus
PTIETNGGGF

SEQ ID NO: 199243 - protein, 10 aa, Tick-borne encephalitis virus
TIETNGGGFI

SEQ ID NO: 199244 - protein, 10 aa, Tick-borne encephalitis virus
IETNGGGFIE

SEQ ID NO: 199245 - protein, 10 aa, Tick-borne encephalitis virus
ETNGGGFIEM

SEQ ID NO: 199246 - protein, 10 aa, Tick-borne encephalitis virus
TNGGGFIEMQ

SEQ ID NO: 199247 - protein, 10 aa, Tick-borne encephalitis virus
NIIYVGELSY

SEQ ID NO: 199248 - protein, 10 aa, Tick-borne encephalitis virus
IIYVGELSYQ

SEQ ID NO: 199249 - protein, 10 aa, Tick-borne encephalitis virus
IYVGELSYQW

SEQ ID NO: 199250 - protein, 10 aa, Tick-borne encephalitis virus
YVGELSYQWF

SEQ ID NO: 199251 - protein, 10 aa, Tick-borne encephalitis virus
VGELSYQWFQ

SEQ ID NO: 199252 - protein, 10 aa, Tick-borne encephalitis virus
GELSYQWFQK

SEQ ID NO: 199253 - protein, 10 aa, Tick-borne encephalitis virus
ELSYQWFQKG

SEQ ID NO: 199254 - protein, 10 aa, Tick-borne encephalitis virus
LSYQWFQKGS

SEQ ID NO: 199255 - protein, 10 aa, Tick-borne encephalitis virus
SYQWFQKGSS

SEQ ID NO: 199256 - protein, 10 aa, Tick-borne encephalitis virus
YQWFQKGSSI

SEQ ID NO: 199257 - protein, 10 aa, Tick-borne encephalitis virus
SIGRVFQKTK

SEQ ID NO: 199258 - protein, 10 aa, Tick-borne encephalitis virus
IGRVFQKTKK

SEQ ID NO: 199259 - protein, 10 aa, Tick-borne encephalitis virus
GRVFQKTKKG

SEQ ID NO: 199260 - protein, 10 aa, Tick-borne encephalitis virus
RVFQKTKKGI

SEQ ID NO: 199261 - protein, 10 aa, Tick-borne encephalitis virus
VFQKTKKGIE

SEQ ID NO: 199262 - protein, 10 aa, Tick-borne encephalitis virus
FQKTKKGIER

SEQ ID NO: 199263 - protein, 10 aa, Tick-borne encephalitis virus
QKTKKGIERL

SEQ ID NO: 199264 - protein, 10 aa, Tick-borne encephalitis virus
KTKKGIERLT

SEQ ID NO: 199265 - protein, 10 aa, Tick-borne encephalitis virus
TKKGIERLTV

SEQ ID NO: 199266 - protein, 10 aa, Tick-borne encephalitis virus
KKGIERLTVI

SEQ ID NO: 199267 - protein, 10 aa, Tick-borne encephalitis virus
RGIERLTVIG

SEQ ID NO: 199268 - protein, 10 aa, Tick-borne encephalitis virus
GEHAWDFGSA

SEQ ID NO: 199269 - protein, 10 aa, Tick-borne encephalitis virus
EHAWDFGSAG

SEQ ID NO: 199270 - protein, 10 aa, Tick-borne encephalitis virus
HAWDFGSAGG

SEQ ID NO: 199271 - protein, 10 aa, Tick-borne encephalitis virus
AWDFGSAGGF

SEQ ID NO: 199272 - protein, 10 aa, Tick-borne encephalitis virus
WDFGSAGGFL

SEQ ID NO: 199273 - protein, 10 aa, Tick-borne encephalitis virus
DFGSAGGFLS

SEQ ID NO: 199274 - protein, 10 aa, Tick-borne encephalitis virus
FGSAGGFLSS

SEQ ID NO: 199275 - protein, 10 aa, Tick-borne encephalitis virus
GSAGGFLSSI

SEQ ID NO: 199276 - protein, 10 aa, Tick-borne encephalitis virus
SAGGFLSSIG

SEQ ID NO: 199277 - protein, 10 aa, Tick-borne encephalitis virus
AGGFLSSIGK

SEQ ID NO: 199278 - protein, 10 aa, Tick-borne encephalitis virus
GGFLSSIGKA

SEQ ID NO: 199279 - protein, 10 aa, Tick-borne encephalitis virus
GFLSSIGKAV

SEQ ID NO: 199280 - protein, 10 aa, Tick-borne encephalitis virus
FLSSIGKAVH

SEQ ID NO: 199281 - protein, 10 aa, Tick-borne encephalitis virus
LSSIGKAVHT

SEQ ID NO: 199282 - protein, 10 aa, Tick-borne encephalitis virus
SSIGKAVHTV

SEQ ID NO: 199283 - protein, 10 aa, Tick-borne encephalitis virus
SIGKAVHTVL

SEQ ID NO: 199284 - protein, 10 aa, Tick-borne encephalitis virus
IGKAVHTVLG

SEQ ID NO: 199285 - protein, 10 aa, Tick-borne encephalitis virus
GKAVHTVLGG

SEQ ID NO: 199286 - protein, 10 aa, Tick-borne encephalitis virus
KAVHTVLGGA

SEQ ID NO: 199287 - protein, 10 aa, Tick-borne encephalitis virus
AVHTVLGGAF

SEQ ID NO: 199288 - protein, 10 aa, Tick-borne encephalitis virus
VHTVLGGAFN

SEQ ID NO: 199289 - protein, 10 aa, Tick-borne encephalitis virus
TVLGGAFNSI

SEQ ID NO: 199290 - protein, 10 aa, Tick-borne encephalitis virus
VLGGAFNSIF

SEQ ID NO: 199291 - protein, 10 aa, Tick-borne encephalitis virus
LGGAFNSIFG

SEQ ID NO: 199292 - protein, 10 aa, Tick-borne encephalitis virus
GGAFNSIFGG

SEQ ID NO: 199293 - protein, 10 aa, Tick-borne encephalitis virus
GAFNSIFGGV

SEQ ID NO: 199294 - protein, 10 aa, Tick-borne encephalitis virus
AFNSIFGGVG

SEQ ID NO: 199295 - protein, 10 aa, Tick-borne encephalitis virus
FNSIFGGVGF

SEQ ID NO: 199296 - protein, 10 aa, Tick-borne encephalitis virus
NSIFGGVGFL

SEQ ID NO: 199297 - protein, 10 aa, Tick-borne encephalitis virus
SIFGGVGFLP

SEQ ID NO: 199298 - protein, 10 aa, Tick-borne encephalitis virus
IFGGVGFLPK

SEQ ID NO: 199299 - protein, 10 aa, Tick-borne encephalitis virus
FGGVGFLPKL

SEQ ID NO: 199300 - protein, 10 aa, Tick-borne encephalitis virus
GGVGFLPKLL

SEQ ID NO: 199301 - protein, 10 aa, Tick-borne encephalitis virus
GVGFLPKLLL

SEQ ID NO: 199302 - protein, 10 aa, Tick-borne encephalitis virus
VGFLPKLLLG

SEQ ID NO: 199303 - protein, 10 aa, Tick-borne encephalitis virus
GVVLAWLGLN

SEQ ID NO: 199304 - protein, 10 aa, Tick-borne encephalitis virus
VVLAWLGLNM

SEQ ID NO: 199305 - protein, 10 aa, Tick-borne encephalitis virus
VLAWLGLNMR

SEQ ID NO: 199306 - protein, 10 aa, Tick-borne encephalitis virus
NMRNPTMSMG

SEQ ID NO: 199307 - protein, 10 aa, Tick-borne encephalitis virus
MRNPTMSMGF

SEQ ID NO: 199308 - protein, 10 aa, Tick-borne encephalitis virus
RNPTMSMGFL

SEQ ID NO: 199309 - protein, 10 aa, Tick-borne encephalitis virus
NPTMSMGFLL

SEQ ID NO: 199310 - protein, 10 aa, Tick-borne encephalitis virus
PTMSMGFLLA

SEQ ID NO: 199311 - protein, 10 aa, Tick-borne encephalitis virus
TMSMGFLLAG

SEQ ID NO: 199312 - protein, 10 aa, Tick-borne encephalitis virus
MSMGFLLAGG

SEQ ID NO: 199313 - protein, 10 aa, Tick-borne encephalitis virus
SMGFLLAGGL

SEQ ID NO: 199314 - protein, 10 aa, Tick-borne encephalitis virus
MGFLLAGGLV

SEQ ID NO: 199315 - protein, 10 aa, Tick-borne encephalitis virus
GFLLAGGLVL

SEQ ID NO: 199316 - protein, 10 aa, Tick-borne encephalitis virus
FLLAGVLVLA

SEQ ID NO: 199317 - protein, 10 aa, Tick-borne encephalitis virus
LLAGVLVLAM

SEQ ID NO: 199318 - protein, 10 aa, Tick-borne encephalitis virus
LAGVLVLAMT

SEQ ID NO: 199319 - protein, 10 aa, Tick-borne encephalitis virus
AGVLVLAMTL

SEQ ID NO: 199320 - protein, 10 aa, Tick-borne encephalitis virus
GVLVLAMTLG

SEQ ID NO: 199321 - protein, 10 aa, Tick-borne encephalitis virus
VLVLAMTLGV

SEQ ID NO: 199322 - protein, 10 aa, Tick-borne encephalitis virus
TLGVGADVGG

SEQ ID NO: 199323 - protein, 10 aa, Tick-borne encephalitis virus
LGVGADVGGA

SEQ ID NO: 199324 - protein, 10 aa, Tick-borne encephalitis virus
GVGADVGGAV

SEQ ID NO: 199325 - protein, 10 aa, Tick-borne encephalitis virus
VGADVGGAVD

SEQ ID NO: 199326 - protein, 10 aa, Tick-borne encephalitis virus
GADVGGAVDT

SEQ ID NO: 199327 - protein, 10 aa, Tick-borne encephalitis virus
ADVGGAVDTE

SEQ ID NO: 199328 - protein, 10 aa, Tick-borne encephalitis virus
DVGGAVDTER

SEQ ID NO: 199329 - protein, 10 aa, Tick-borne encephalitis virus
VGGAVDTERM

SEQ ID NO: 199330 - protein, 10 aa, Tick-borne encephalitis virus
GGAVDTERME

SEQ ID NO: 199331 - protein, 10 aa, Tick-borne encephalitis virus
GAVDTERMEL

SEQ ID NO: 199332 - protein, 10 aa, Tick-borne encephalitis virus
VSEWYDNYAF

SEQ ID NO: 199333 - protein, 10 aa, Tick-borne encephalitis virus
SEWYDNYAFY

SEQ ID NO: 199334 - protein, 10 aa, Tick-borne encephalitis virus
EWYDNYAFYP

SEQ ID NO: 199335 - protein, 10 aa, Tick-borne encephalitis virus
WYDNYAFYPE

SEQ ID NO: 199336 - protein, 10 aa, Tick-borne encephalitis virus
YDNYAFYPET

SEQ ID NO: 199337 - protein, 10 aa, Tick-borne encephalitis virus
DNYAFYPETP

SEQ ID NO: 199338 - protein, 10 aa, Tick-borne encephalitis virus
NYAFYPETPG

SEQ ID NO: 199339 - protein, 10 aa, Tick-borne encephalitis virus
YAFYPETPGA

SEQ ID NO: 199340 - protein, 10 aa, Tick-borne encephalitis virus
AFYPETPGAL

SEQ ID NO: 199341 - protein, 10 aa, Tick-borne encephalitis virus
FYPETPGALA

SEQ ID NO: 199342 - protein, 10 aa, Tick-borne encephalitis virus
TPGALASAIR

SEQ ID NO: 199343 - protein, 10 aa, Tick-borne encephalitis virus
PGALASAIRE

SEQ ID NO: 199344 - protein, 10 aa, Tick-borne encephalitis virus
GALASAIKEA

SEQ ID NO: 199345 - protein, 10 aa, Tick-borne encephalitis virus
ALASAIKEAF

SEQ ID NO: 199346 - protein, 10 aa, Tick-borne encephalitis virus
LASAIRETFE

SEQ ID NO: 199347 - protein, 10 aa, Tick-borne encephalitis virus
ASAIRETFEE

SEQ ID NO: 199348 - protein, 10 aa, Tick-borne encephalitis virus
SAIRETFEEG

SEQ ID NO: 199349 - protein, 10 aa, Tick-borne encephalitis virus
AIKETFEEGS

SEQ ID NO: 199350 - protein, 10 aa, Tick-borne encephalitis virus
IKETFEEGSC

SEQ ID NO: 199351 - protein, 10 aa, Tick-borne encephalitis virus
KETFEEGSCG

SEQ ID NO: 199352 - protein, 10 aa, Tick-borne encephalitis virus
ETFEEGSCGV

SEQ ID NO: 199353 - protein, 10 aa, Tick-borne encephalitis virus
TFEEGSCGVV

SEQ ID NO: 199354 - protein, 10 aa, Tick-borne encephalitis virus
FEEGSCGVVP

SEQ ID NO: 199355 - protein, 10 aa, Tick-borne encephalitis virus
EEGSCGVVPQ

SEQ ID NO: 199356 - protein, 10 aa, Tick-borne encephalitis virus
EGSCGVVPQN

SEQ ID NO: 199357 - protein, 10 aa, Tick-borne encephalitis virus
GSCGVVPQNR

SEQ ID NO: 199358 - protein, 10 aa, Tick-borne encephalitis virus
SCGVVPQNRL

SEQ ID NO: 199359 - protein, 10 aa, Tick-borne encephalitis virus
CGVVPQNRLE

SEQ ID NO: 199360 - protein, 10 aa, Tick-borne encephalitis virus
GVVPQNRLEM

SEQ ID NO: 199361 - protein, 10 aa, Tick-borne encephalitis virus
VVPQNRLEMA

SEQ ID NO: 199362 - protein, 10 aa, Tick-borne encephalitis virus
LPQNRLEMAM

SEQ ID NO: 199363 - protein, 10 aa, Tick-borne encephalitis virus
RLEMAMWRSA

SEQ ID NO: 199364 - protein, 10 aa, Tick-borne encephalitis virus
LEMAMWRSSV

SEQ ID NO: 199365 - protein, 10 aa, Tick-borne encephalitis virus
EMAMWRSSVT

SEQ ID NO: 199366 - protein, 10 aa, Tick-borne encephalitis virus
MAMWRSSVTE

SEQ ID NO: 199367 - protein, 10 aa, Tick-borne encephalitis virus
AMWRSSVTEL

SEQ ID NO: 199368 - protein, 10 aa, Tick-borne encephalitis virus
MWRSSVTELN

SEQ ID NO: 199369 - protein, 10 aa, Tick-borne encephalitis virus
WRSSVTELNL

SEQ ID NO: 199370 - protein, 10 aa, Tick-borne encephalitis virus
RSSVTELNLA

SEQ ID NO: 199371 - protein, 10 aa, Tick-borne encephalitis virus
SSVTELNLAL

SEQ ID NO: 199372 - protein, 10 aa, Tick-borne encephalitis virus
SVTELNLALA

SEQ ID NO: 199373 - protein, 10 aa, Tick-borne encephalitis virus
VTELNLALAE

SEQ ID NO: 199374 - protein, 10 aa, Tick-borne encephalitis virus
ELNLALAEGE

SEQ ID NO: 199375 - protein, 10 aa, Tick-borne encephalitis virus
LNLALAEGEA

SEQ ID NO: 199376 - protein, 10 aa, Tick-borne encephalitis virus
NLALAEGEAN

SEQ ID NO: 199377 - protein, 10 aa, Tick-borne encephalitis virus
LALAEGEANL

SEQ ID NO: 199378 - protein, 10 aa, Tick-borne encephalitis virus
ALAEGEANLT

SEQ ID NO: 199379 - protein, 10 aa, Tick-borne encephalitis virus
LAEGEANLTV

SEQ ID NO: 199380 - protein, 10 aa, Tick-borne encephalitis virus
AEGEANLTVV

SEQ ID NO: 199381 - protein, 10 aa, Tick-borne encephalitis virus
EGEANLTVVV

SEQ ID NO: 199382 - protein, 10 aa, Tick-borne encephalitis virus
GEANLTVVVD

SEQ ID NO: 199383 - protein, 10 aa, Tick-borne encephalitis virus
EANLTVVVDK

SEQ ID NO: 199384 - protein, 10 aa, Tick-borne encephalitis virus
ANLTVVVDKF

SEQ ID NO: 199385 - protein, 10 aa, Tick-borne encephalitis virus
NLTVVVDKFD

SEQ ID NO: 199386 - protein, 10 aa, Tick-borne encephalitis virus
LTVVVDKFDP

SEQ ID NO: 199387 - protein, 10 aa, Tick-borne encephalitis virus
TVVVDKFDPT

SEQ ID NO: 199388 - protein, 10 aa, Tick-borne encephalitis virus
VVVDKFDPTD

SEQ ID NO: 199389 - protein, 10 aa, Tick-borne encephalitis virus
VVDKFDPTDY

SEQ ID NO: 199390 - protein, 10 aa, Tick-borne encephalitis virus
VDKFDPTDYR

SEQ ID NO: 199391 - protein, 10 aa, Tick-borne encephalitis virus
DKFDPTDYRG

SEQ ID NO: 199392 - protein, 10 aa, Tick-borne encephalitis virus
KFDPTDYRGG

SEQ ID NO: 199393 - protein, 10 aa, Tick-borne encephalitis virus
FDPTDYRGGV

SEQ ID NO: 199394 - protein, 10 aa, Tick-borne encephalitis virus
DPTDYRGGVP

SEQ ID NO: 199395 - protein, 10 aa, Tick-borne encephalitis virus
PTDYRGGVPG

SEQ ID NO: 199396 - protein, 10 aa, Tick-borne encephalitis virus
TDYRGGVPGL

SEQ ID NO: 199397 - protein, 10 aa, Tick-borne encephalitis virus
DYRGGVPGLL

SEQ ID NO: 199398 - protein, 10 aa, Tick-borne encephalitis virus
YRGGVPGLLK

SEQ ID NO: 199399 - protein, 10 aa, Tick-borne encephalitis virus
RGGVPGLLKK

SEQ ID NO: 199400 - protein, 10 aa, Tick-borne encephalitis virus
GGVPGLLKKG

SEQ ID NO: 199401 - protein, 10 aa, Tick-borne encephalitis virus
GVPGLLKKGK

SEQ ID NO: 199402 - protein, 10 aa, Tick-borne encephalitis virus
VPGLLKKGKD

SEQ ID NO: 199403 - protein, 10 aa, Tick-borne encephalitis virus
PGLLRKGKDI

SEQ ID NO: 199404 - protein, 10 aa, Tick-borne encephalitis virus
GLLRKGKDIK

SEQ ID NO: 199405 - protein, 10 aa, Tick-borne encephalitis virus
LLRKGKDIKV

SEQ ID NO: 199406 - protein, 10 aa, Tick-borne encephalitis virus
LRKGKDIKVS

SEQ ID NO: 199407 - protein, 10 aa, Tick-borne encephalitis virus
RKGKDIKVSW

SEQ ID NO: 199408 - protein, 10 aa, Tick-borne encephalitis virus
KGKDIRVSWK

SEQ ID NO: 199409 - protein, 10 aa, Tick-borne encephalitis virus
GKDIKVSWRS

SEQ ID NO: 199410 - protein, 10 aa, Tick-borne encephalitis virus
KDIRVSWKSW

SEQ ID NO: 199411 - protein, 10 aa, Tick-borne encephalitis virus
DIRVSWKSWG

SEQ ID NO: 199412 - protein, 10 aa, Tick-borne encephalitis virus
IKVSWKSWGQ

SEQ ID NO: 199413 - protein, 10 aa, Tick-borne encephalitis virus
KVSWKSWGQS

SEQ ID NO: 199414 - protein, 10 aa, Tick-borne encephalitis virus
MIWSIPEAPR

SEQ ID NO: 199415 - protein, 10 aa, Tick-borne encephalitis virus
IWSIPEAPRR

SEQ ID NO: 199416 - protein, 10 aa, Tick-borne encephalitis virus
WSIPEAPRRF

SEQ ID NO: 199417 - protein, 10 aa, Tick-borne encephalitis virus
SIPEAPRRFM

SEQ ID NO: 199418 - protein, 10 aa, Tick-borne encephalitis virus
IPEAPRRFMV

SEQ ID NO: 199419 - protein, 10 aa, Tick-borne encephalitis virus
PEASRRFMVG

SEQ ID NO: 199420 - protein, 10 aa, Tick-borne encephalitis virus
EAPRRFMVGI

SEQ ID NO: 199421 - protein, 10 aa, Tick-borne encephalitis virus
APRRFMVGIE

SEQ ID NO: 199422 - protein, 10 aa, Tick-borne encephalitis virus
PRRFMVGIEG

SEQ ID NO: 199423 - protein, 10 aa, Tick-borne encephalitis virus
RRFMVGTEGS

SEQ ID NO: 199424 - protein, 10 aa, Tick-borne encephalitis virus
NECPLERRKT

SEQ ID NO: 199425 - protein, 10 aa, Tick-borne encephalitis virus
ECPPERRKTG

SEQ ID NO: 199426 - protein, 10 aa, Tick-borne encephalitis virus
CPLERRKTGI

SEQ ID NO: 199427 - protein, 10 aa, Tick-borne encephalitis virus
PPERRKTGVF

SEQ ID NO: 199428 - protein, 10 aa, Tick-borne encephalitis virus
LERRKTGIFT

SEQ ID NO: 199429 - protein, 10 aa, Tick-borne encephalitis virus
ERRKTGIFTV

SEQ ID NO: 199430 - protein, 10 aa, Tick-borne encephalitis virus
RRKTGIFTVA

SEQ ID NO: 199431 - protein, 10 aa, Tick-borne encephalitis virus
RKTGIFTVAE

SEQ ID NO: 199432 - protein, 10 aa, Tick-borne encephalitis virus
KTGIFTVAEF

SEQ ID NO: 199433 - protein, 10 aa, Tick-borne encephalitis virus
TGIFTVAEFG

SEQ ID NO: 199434 - protein, 10 aa, Tick-borne encephalitis virus
GIFTVAEFGV

SEQ ID NO: 199435 - protein, 10 aa, Tick-borne encephalitis virus
IFTVAEFGVG

SEQ ID NO: 199436 - protein, 10 aa, Tick-borne encephalitis virus
GVGLRTKVFV

SEQ ID NO: 199437 - protein, 10 aa, Tick-borne encephalitis virus
VGLRTKVFVD

SEQ ID NO: 199438 - protein, 10 aa, Tick-borne encephalitis virus
GLRTKVFVDF

SEQ ID NO: 199439 - protein, 10 aa, Tick-borne encephalitis virus
LRTKVFVDFR

SEQ ID NO: 199440 - protein, 10 aa, Tick-borne encephalitis virus
RTKVFVDFRQ

SEQ ID NO: 199441 - protein, 10 aa, Tick-borne encephalitis virus
TKVFVDFRQE

SEQ ID NO: 199442 - protein, 10 aa, Tick-borne encephalitis virus
KVFLDFRQEP

SEQ ID NO: 199443 - protein, 10 aa, Tick-borne encephalitis virus
VFLDFRQEPT

SEQ ID NO: 199444 - protein, 10 aa, Tick-borne encephalitis virus
FLDFRQEPTH

SEQ ID NO: 199445 - protein, 10 aa, Tick-borne encephalitis virus
LDFRQEPTHE

SEQ ID NO: 199446 - protein, 10 aa, Tick-borne encephalitis virus
DFRQEPTHEC

SEQ ID NO: 199447 - protein, 10 aa, Tick-borne encephalitis virus
FRQEPTHECD

SEQ ID NO: 199448 - protein, 10 aa, Tick-borne encephalitis virus
RQEPTHECDT

SEQ ID NO: 199449 - protein, 10 aa, Tick-borne encephalitis virus
QEPTHECDTG

SEQ ID NO: 199450 - protein, 10 aa, Tick-borne encephalitis virus
EPTHECDTGV

SEQ ID NO: 199451 - protein, 10 aa, Tick-borne encephalitis virus
PTHECDTGVM

SEQ ID NO: 199452 - protein, 10 aa, Tick-borne encephalitis virus
GAAVKNGMAI

SEQ ID NO: 199453 - protein, 10 aa, Tick-borne encephalitis virus
AAVKNGMAIH

SEQ ID NO: 199454 - protein, 10 aa, Tick-borne encephalitis virus
AVKNGMAIHT

SEQ ID NO: 199455 - protein, 10 aa, Tick-borne encephalitis virus
VKNGMAIHTD

SEQ ID NO: 199456 - protein, 10 aa, Tick-borne encephalitis virus
KNGMAIHTDQ

SEQ ID NO: 199457 - protein, 10 aa, Tick-borne encephalitis virus
NGMAIHTDQS

SEQ ID NO: 199458 - protein, 10 aa, Tick-borne encephalitis virus
GMAIHTDQSL

SEQ ID NO: 199459 - protein, 10 aa, Tick-borne encephalitis virus
MAIHTDQSLW

SEQ ID NO: 199460 - protein, 10 aa, Tick-borne encephalitis virus
AIHTDQSLWM

SEQ ID NO: 199461 - protein, 10 aa, Tick-borne encephalitis virus
IHTDQSLWMR

SEQ ID NO: 199462 - protein, 10 aa, Tick-borne encephalitis virus
HTDQSLWMRS

SEQ ID NO: 199463 - protein, 10 aa, Tick-borne encephalitis virus
TDQSLWMRSM

SEQ ID NO: 199464 - protein, 10 aa, Tick-borne encephalitis virus
DQSLWMRSMK

SEQ ID NO: 199465 - protein, 10 aa, Tick-borne encephalitis virus
QSLWMRSMKN

SEQ ID NO: 199466 - protein, 10 aa, Tick-borne encephalitis virus
SLWMRSMKND

SEQ ID NO: 199467 - protein, 10 aa, Tick-borne encephalitis virus
LWMRSMKNDT

SEQ ID NO: 199468 - protein, 10 aa, Tick-borne encephalitis virus
WMRSMKNDTG

SEQ ID NO: 199469 - protein, 10 aa, Tick-borne encephalitis virus
MRSMKNDTGT

SEQ ID NO: 199470 - protein, 10 aa, Tick-borne encephalitis virus
RSMKNDTGTY

SEQ ID NO: 199471 - protein, 10 aa, Tick-borne encephalitis virus
SMKNDTGTYI

SEQ ID NO: 199472 - protein, 10 aa, Tick-borne encephalitis virus
MKNDTGTYIV

SEQ ID NO: 199473 - protein, 10 aa, Tick-borne encephalitis virus
KNDTGTYIVE

SEQ ID NO: 199474 - protein, 10 aa, Tick-borne encephalitis virus
NETGTYIVEL

SEQ ID NO: 199475 - protein, 10 aa, Tick-borne encephalitis virus
ETGTYIVELL

SEQ ID NO: 199476 - protein, 10 aa, Tick-borne encephalitis virus
WPASHTIDNP

SEQ ID NO: 199477 - protein, 10 aa, Tick-borne encephalitis virus
PASHTIDNAD

SEQ ID NO: 199478 - protein, 10 aa, Tick-borne encephalitis virus
ASHTIDNADV

SEQ ID NO: 199479 - protein, 10 aa, Tick-borne encephalitis virus
SHTIDNADVV

SEQ ID NO: 199480 - protein, 10 aa, Tick-borne encephalitis virus
HTIDNADVVD

SEQ ID NO: 199481 - protein, 10 aa, Tick-borne encephalitis virus
TIDNADVVDS

SEQ ID NO: 199482 - protein, 10 aa, Tick-borne encephalitis virus
IDNADVVDSE

SEQ ID NO: 199483 - protein, 10 aa, Tick-borne encephalitis virus
DNADVVDSEL

SEQ ID NO: 199484 - protein, 10 aa, Tick-borne encephalitis virus
NADVVDSELF

SEQ ID NO: 199485 - protein, 10 aa, Tick-borne encephalitis virus
ADVVDSELFL

SEQ ID NO: 199486 - protein, 10 aa, Tick-borne encephalitis virus
DVVDSELFLP

SEQ ID NO: 199487 - protein, 10 aa, Tick-borne encephalitis virus
VVDSESFLPA

SEQ ID NO: 199488 - protein, 10 aa, Tick-borne encephalitis virus
VDSESFLPAS

SEQ ID NO: 199489 - protein, 10 aa, Tick-borne encephalitis virus
DSESFLPASL

SEQ ID NO: 199490 - protein, 10 aa, Tick-borne encephalitis virus
SESFLPASLA

SEQ ID NO: 199491 - protein, 10 aa, Tick-borne encephalitis virus
ESFLPASLAG

SEQ ID NO: 199492 - protein, 10 aa, Tick-borne encephalitis virus
SFLPASLAGP

SEQ ID NO: 199493 - protein, 10 aa, Tick-borne encephalitis virus
SWYNRIPGYA

SEQ ID NO: 199494 - protein, 10 aa, Tick-borne encephalitis virus
WYNRIPGYAE

SEQ ID NO: 199495 - protein, 10 aa, Tick-borne encephalitis virus
YNRIPGYAEQ

SEQ ID NO: 199496 - protein, 10 aa, Tick-borne encephalitis virus
NRIPGYAEQV

SEQ ID NO: 199497 - protein, 10 aa, Tick-borne encephalitis virus
RIPGYAEQVK

SEQ ID NO: 199498 - protein, 10 aa, Tick-borne encephalitis virus
IPGYAEQVKG

SEQ ID NO: 199499 - protein, 10 aa, Tick-borne encephalitis virus
PGYAEQVKGP

SEQ ID NO: 199500 - protein, 10 aa, Tick-borne encephalitis virus
GYAEQVKGPW

SEQ ID NO: 199501 - protein, 10 aa, Tick-borne encephalitis virus
YAEQVKGPWK

SEQ ID NO: 199502 - protein, 10 aa, Tick-borne encephalitis virus
AEQVKGPWKY

SEQ ID NO: 199503 - protein, 10 aa, Tick-borne encephalitis virus
EQVKGPWKHT

SEQ ID NO: 199504 - protein, 10 aa, Tick-borne encephalitis virus
QVKGPWKHTP

SEQ ID NO: 199505 - protein, 10 aa, Tick-borne encephalitis virus
VKGPWKHTPI

SEQ ID NO: 199506 - protein, 10 aa, Tick-borne encephalitis virus
KGPWKHTPIR

SEQ ID NO: 199507 - protein, 10 aa, Tick-borne encephalitis virus
GPWKHTPIRV

SEQ ID NO: 199508 - protein, 10 aa, Tick-borne encephalitis virus
PIRVIREECP

SEQ ID NO: 199509 - protein, 10 aa, Tick-borne encephalitis virus
IRVIREECPG

SEQ ID NO: 199510 - protein, 10 aa, Tick-borne encephalitis virus
RVIREECPGT

SEQ ID NO: 199511 - protein, 10 aa, Tick-borne encephalitis virus
VIREECPGTT

SEQ ID NO: 199512 - protein, 10 aa, Tick-borne encephalitis virus
IREECPGTTV

SEQ ID NO: 199513 - protein, 10 aa, Tick-borne encephalitis virus
INAKCDKRGA

SEQ ID NO: 199514 - protein, 10 aa, Tick-borne encephalitis virus
NAKCDKRGAS

SEQ ID NO: 199515 - protein, 10 aa, Tick-borne encephalitis virus
AKCDKRGASV

SEQ ID NO: 199516 - protein, 10 aa, Tick-borne encephalitis virus
KCDKRGASVR

SEQ ID NO: 199517 - protein, 10 aa, Tick-borne encephalitis virus
CDRRGASVRS

SEQ ID NO: 199518 - protein, 10 aa, Tick-borne encephalitis virus
DRRGASVRST

SEQ ID NO: 199519 - protein, 10 aa, Tick-borne encephalitis virus
RRGASVRSTT

SEQ ID NO: 199520 - protein, 10 aa, Tick-borne encephalitis virus
KVIPEWCCRA

SEQ ID NO: 199521 - protein, 10 aa, Tick-borne encephalitis virus
VIPEWCCRAC

SEQ ID NO: 199522 - protein, 10 aa, Tick-borne encephalitis virus
IPEWCCRACT

SEQ ID NO: 199523 - protein, 10 aa, Tick-borne encephalitis virus
PEWCCRACTM

SEQ ID NO: 199524 - protein, 10 aa, Tick-borne encephalitis virus
EWCCRACTMP

SEQ ID NO: 199525 - protein, 10 aa, Tick-borne encephalitis virus
WCCRACTMPP

SEQ ID NO: 199526 - protein, 10 aa, Tick-borne encephalitis virus
CCRACTMPPV

SEQ ID NO: 199527 - protein, 10 aa, Tick-borne encephalitis virus
CRACTMPPVT

SEQ ID NO: 199528 - protein, 10 aa, Tick-borne encephalitis virus
RACTMPPVTF

SEQ ID NO: 199529 - protein, 10 aa, Tick-borne encephalitis virus
ACTMPPVTFR

SEQ ID NO: 199530 - protein, 10 aa, Tick-borne encephalitis virus
CTMPPVTFRT

SEQ ID NO: 199531 - protein, 10 aa, Tick-borne encephalitis virus
TMPPVTFRTG

SEQ ID NO: 199532 - protein, 10 aa, Tick-borne encephalitis virus
MPPVTFRTGT

SEQ ID NO: 199533 - protein, 10 aa, Tick-borne encephalitis virus
PPVTIRTGTD

SEQ ID NO: 199534 - protein, 10 aa, Tick-borne encephalitis virus
PVTIRTGTDC

SEQ ID NO: 199535 - protein, 10 aa, Tick-borne encephalitis virus
VTIRTGTDCW

SEQ ID NO: 199536 - protein, 10 aa, Tick-borne encephalitis virus
TIRTGTDCWY

SEQ ID NO: 199537 - protein, 10 aa, Tick-borne encephalitis virus
IRTGTDCWYA

SEQ ID NO: 199538 - protein, 10 aa, Tick-borne encephalitis virus
RPVHDQGGLI

SEQ ID NO: 199539 - protein, 10 aa, Tick-borne encephalitis virus
PVHDQGGLIR

SEQ ID NO: 199540 - protein, 10 aa, Tick-borne encephalitis virus
VHDQGGLIRS

SEQ ID NO: 199541 - protein, 10 aa, Tick-borne encephalitis virus
HDQGGLVRST

SEQ ID NO: 199542 - protein, 10 aa, Tick-borne encephalitis virus
DQGGLIRSMV

SEQ ID NO: 199543 - protein, 10 aa, Tick-borne encephalitis virus
QGGLVRSTVV

SEQ ID NO: 199544 - protein, 10 aa, Tick-borne encephalitis virus
GGLVRSTVVA

SEQ ID NO: 199545 - protein, 10 aa, Tick-borne encephalitis virus
GLIRSMVVAD

SEQ ID NO: 199546 - protein, 10 aa, Tick-borne encephalitis virus
LVRSTVVADN

SEQ ID NO: 199547 - protein, 10 aa, Tick-borne encephalitis virus
IRSMVVADNG

SEQ ID NO: 199548 - protein, 10 aa, Tick-borne encephalitis virus
RSTVVADNGE

SEQ ID NO: 199549 - protein, 10 aa, Tick-borne encephalitis virus
STVVADNGEL

SEQ ID NO: 199550 - protein, 10 aa, Tick-borne encephalitis virus
TVVADNGELL

SEQ ID NO: 199551 - protein, 10 aa, Tick-borne encephalitis virus
NGELLSEGGV

SEQ ID NO: 199552 - protein, 10 aa, Tick-borne encephalitis virus
GELLSEGGIP

SEQ ID NO: 199553 - protein, 10 aa, Tick-borne encephalitis virus
ELLSEGGIPG

SEQ ID NO: 199554 - protein, 10 aa, Tick-borne encephalitis virus
LLSEGGVPGI

SEQ ID NO: 199555 - protein, 10 aa, Tick-borne encephalitis virus
LSEGGVPGIV

SEQ ID NO: 199556 - protein, 10 aa, Tick-borne encephalitis virus
SEGGVPGIVA

SEQ ID NO: 199557 - protein, 10 aa, Tick-borne encephalitis virus
EGGIPGIVAL

SEQ ID NO: 199558 - protein, 10 aa, Tick-borne encephalitis virus
GGVPGIVALF

SEQ ID NO: 199559 - protein, 10 aa, Tick-borne encephalitis virus
GIPGIVALFV

SEQ ID NO: 199560 - protein, 10 aa, Tick-borne encephalitis virus
IPGIVALFVV

SEQ ID NO: 199561 - protein, 10 aa, Tick-borne encephalitis virus
VALFVVLEYI

SEQ ID NO: 199562 - protein, 10 aa, Tick-borne encephalitis virus
ALFVVLEYII

SEQ ID NO: 199563 - protein, 10 aa, Tick-borne encephalitis virus
LFVVLEYIIR

SEQ ID NO: 199564 - protein, 10 aa, Tick-borne encephalitis virus
FVVLEYIIRR

SEQ ID NO: 199565 - protein, 10 aa, Tick-borne encephalitis virus
VVLEYIIRRR

SEQ ID NO: 199566 - protein, 10 aa, Tick-borne encephalitis virus
VLEYIIRRRP

SEQ ID NO: 199567 - protein, 10 aa, Tick-borne encephalitis virus
LEYIIRRRPS

SEQ ID NO: 199568 - protein, 10 aa, Tick-borne encephalitis virus
EYIIRRRPST

SEQ ID NO: 199569 - protein, 10 aa, Tick-borne encephalitis virus
YIIRRRPSTG

SEQ ID NO: 199570 - protein, 10 aa, Tick-borne encephalitis virus
IIRRRPSTGT

SEQ ID NO: 199571 - protein, 10 aa, Tick-borne encephalitis virus
IRRRPSTGTT

SEQ ID NO: 199572 - protein, 10 aa, Tick-borne encephalitis virus
RRRPSTGTTV

SEQ ID NO: 199573 - protein, 10 aa, Tick-borne encephalitis virus
RRPSTGTTVV

SEQ ID NO: 199574 - protein, 10 aa, Tick-borne encephalitis virus
RPSTGTTVVW

SEQ ID NO: 199575 - protein, 10 aa, Tick-borne encephalitis virus
PSTGTTVVWG

SEQ ID NO: 199576 - protein, 10 aa, Tick-borne encephalitis virus
STGTTVVWGG

SEQ ID NO: 199577 - protein, 10 aa, Tick-borne encephalitis virus
WGGVVVLALL

SEQ ID NO: 199578 - protein, 10 aa, Tick-borne encephalitis virus
GGVVVLALLV

SEQ ID NO: 199579 - protein, 10 aa, Tick-borne encephalitis virus
GVVVLALLVT

SEQ ID NO: 199580 - protein, 10 aa, Tick-borne encephalitis virus
VVVLALLVTG

SEQ ID NO: 199581 - protein, 10 aa, Tick-borne encephalitis virus
VVLALLVTGM

SEQ ID NO: 199582 - protein, 10 aa, Tick-borne encephalitis virus
VLALLVTGMV

SEQ ID NO: 199583 - protein, 10 aa, Tick-borne encephalitis virus
LALLVTGMVR

SEQ ID NO: 199584 - protein, 10 aa, Tick-borne encephalitis virus
VKIESLVRYV

SEQ ID NO: 199585 - protein, 10 aa, Tick-borne encephalitis virus
KIESLVRYVV

SEQ ID NO: 199586 - protein, 10 aa, Tick-borne encephalitis virus
VESLVRYVVA

SEQ ID NO: 199587 - protein, 10 aa, Tick-borne encephalitis virus
VRYVVAVGIA

SEQ ID NO: 199588 - protein, 10 aa, Tick-borne encephalitis virus
RYVVAVGIAF

SEQ ID NO: 199589 - protein, 10 aa, Tick-borne encephalitis virus
YVVAVGIAFH

SEQ ID NO: 199590 - protein, 10 aa, Tick-borne encephalitis virus
VVAVGIAFHL

SEQ ID NO: 199591 - protein, 10 aa, Tick-borne encephalitis virus
VAVGIAFHLE

SEQ ID NO: 199592 - protein, 10 aa, Tick-borne encephalitis virus
AVGITFHFEL

SEQ ID NO: 199593 - protein, 10 aa, Tick-borne encephalitis virus
VGITFHFELG

SEQ ID NO: 199594 - protein, 10 aa, Tick-borne encephalitis virus
GITFHFELGP

SEQ ID NO: 199595 - protein, 10 aa, Tick-borne encephalitis virus
ITFHFELGPE

SEQ ID NO: 199596 - protein, 10 aa, Tick-borne encephalitis virus
TFHFELGPEI

SEQ ID NO: 199597 - protein, 10 aa, Tick-borne encephalitis virus
FHFELGPEIV

SEQ ID NO: 199598 - protein, 10 aa, Tick-borne encephalitis virus
HFELGPEIVA

SEQ ID NO: 199599 - protein, 10 aa, Tick-borne encephalitis virus
FELGPEIVAL

SEQ ID NO: 199600 - protein, 10 aa, Tick-borne encephalitis virus
ELGPEIVALM

SEQ ID NO: 199601 - protein, 10 aa, Tick-borne encephalitis virus
LGPEIVALML

SEQ ID NO: 199602 - protein, 10 aa, Tick-borne encephalitis virus
GPEIVALMLL

SEQ ID NO: 199603 - protein, 10 aa, Tick-borne encephalitis virus
PEIVALMLLQ

SEQ ID NO: 199604 - protein, 10 aa, Tick-borne encephalitis virus
EIVALMLLQA

SEQ ID NO: 199605 - protein, 10 aa, Tick-borne encephalitis virus
IVALMLLQAV

SEQ ID NO: 199606 - protein, 10 aa, Tick-borne encephalitis virus
VALMLLQAVF

SEQ ID NO: 199607 - protein, 10 aa, Tick-borne encephalitis virus
ALMLLQAVFE

SEQ ID NO: 199608 - protein, 10 aa, Tick-borne encephalitis virus
LMLLQAVFEL

SEQ ID NO: 199609 - protein, 10 aa, Tick-borne encephalitis virus
MLLQAVFELR

SEQ ID NO: 199610 - protein, 10 aa, Tick-borne encephalitis virus
GLLSAFALRR

SEQ ID NO: 199611 - protein, 10 aa, Tick-borne encephalitis virus
LLSAFALRRS

SEQ ID NO: 199612 - protein, 10 aa, Tick-borne encephalitis virus
LSAFALRRSL

SEQ ID NO: 199613 - protein, 10 aa, Tick-borne encephalitis virus
SAFALRRSLT

SEQ ID NO: 199614 - protein, 10 aa, Tick-borne encephalitis virus
AFALRRSLTV

SEQ ID NO: 199615 - protein, 10 aa, Tick-borne encephalitis virus
FALRRSLTVR

SEQ ID NO: 199616 - protein, 10 aa, Tick-borne encephalitis virus
ALRRSLTVRE

SEQ ID NO: 199617 - protein, 10 aa, Tick-borne encephalitis virus
LRRSLTVREM

SEQ ID NO: 199618 - protein, 10 aa, Tick-borne encephalitis virus
RRSLTVREMV

SEQ ID NO: 199619 - protein, 10 aa, Tick-borne encephalitis virus
RSLTVREMVT

SEQ ID NO: 199620 - protein, 10 aa, Tick-borne encephalitis virus
SLTVREMVTT

SEQ ID NO: 199621 - protein, 10 aa, Tick-borne encephalitis virus
LTVREMVTTY

SEQ ID NO: 199622 - protein, 10 aa, Tick-borne encephalitis virus
TVREMVTTYF

SEQ ID NO: 199623 - protein, 10 aa, Tick-borne encephalitis virus
VREMVTTYFL

SEQ ID NO: 199624 - protein, 10 aa, Tick-borne encephalitis virus
REMVTTYFLL

SEQ ID NO: 199625 - protein, 10 aa, Tick-borne encephalitis virus
EMVTTYFLLL

SEQ ID NO: 199626 - protein, 10 aa, Tick-borne encephalitis virus
MVTTYFLLLV

SEQ ID NO: 199627 - protein, 10 aa, Tick-borne encephalitis virus
VTTYFLLLVL

SEQ ID NO: 199628 - protein, 10 aa, Tick-borne encephalitis virus
TTYFLLLVLE

SEQ ID NO: 199629 - protein, 10 aa, Tick-borne encephalitis virus
TYFLLLVLEL

SEQ ID NO: 199630 - protein, 10 aa, Tick-borne encephalitis virus
LLVLELGLPG

SEQ ID NO: 199631 - protein, 10 aa, Tick-borne encephalitis virus
FWKWGDALAM

SEQ ID NO: 199632 - protein, 10 aa, Tick-borne encephalitis virus
WRWGDALAMG

SEQ ID NO: 199633 - protein, 10 aa, Tick-borne encephalitis virus
RWGDALAMGA

SEQ ID NO: 199634 - protein, 10 aa, Tick-borne encephalitis virus
DALAMGALIL

SEQ ID NO: 199635 - protein, 10 aa, Tick-borne encephalitis virus
ALAMGALILR

SEQ ID NO: 199636 - protein, 10 aa, Tick-borne encephalitis virus
LAMGALILRA

SEQ ID NO: 199637 - protein, 10 aa, Tick-borne encephalitis virus
AMGALILRAC

SEQ ID NO: 199638 - protein, 10 aa, Tick-borne encephalitis virus
MGALILRACT

SEQ ID NO: 199639 - protein, 10 aa, Tick-borne encephalitis virus
GALILRACTA

SEQ ID NO: 199640 - protein, 10 aa, Tick-borne encephalitis virus
ALILRACTAE

SEQ ID NO: 199641 - protein, 10 aa, Tick-borne encephalitis virus
LIFRACTAEE

SEQ ID NO: 199642 - protein, 10 aa, Tick-borne encephalitis virus
IFRACTAEEK

SEQ ID NO: 199643 - protein, 10 aa, Tick-borne encephalitis virus
FRACTAEGKT

SEQ ID NO: 199644 - protein, 10 aa, Tick-borne encephalitis virus
RACTAEGKTG

SEQ ID NO: 199645 - protein, 10 aa, Tick-borne encephalitis virus
ACTAEGKTGA

SEQ ID NO: 199646 - protein, 10 aa, Tick-borne encephalitis virus
CTAEGKTGAG

SEQ ID NO: 199647 - protein, 10 aa, Tick-borne encephalitis virus
TAEGKTGAGL

SEQ ID NO: 199648 - protein, 10 aa, Tick-borne encephalitis virus
AEGKTGAGLL

SEQ ID NO: 199649 - protein, 10 aa, Tick-borne encephalitis virus
EGKTGAGLLL

SEQ ID NO: 199650 - protein, 10 aa, Tick-borne encephalitis virus
GKTGAGLLLM

SEQ ID NO: 199651 - protein, 10 aa, Tick-borne encephalitis virus
KTGAGLLLMA

SEQ ID NO: 199652 - protein, 10 aa, Tick-borne encephalitis virus
TGAGLLLMAL

SEQ ID NO: 199653 - protein, 10 aa, Tick-borne encephalitis virus
GAGLLLMALM

SEQ ID NO: 199654 - protein, 10 aa, Tick-borne encephalitis virus
AGLLLMALMT

SEQ ID NO: 199655 - protein, 10 aa, Tick-borne encephalitis virus
GLLLMPLLTK

SEQ ID NO: 199656 - protein, 10 aa, Tick-borne encephalitis virus
LLLMALMTQR

SEQ ID NO: 199657 - protein, 10 aa, Tick-borne encephalitis virus
LLMALMTQRD

SEQ ID NO: 199658 - protein, 10 aa, Tick-borne encephalitis virus
WRLIRGHREQ

SEQ ID NO: 199659 - protein, 10 aa, Tick-borne encephalitis virus
RLIRGHREQK

SEQ ID NO: 199660 - protein, 10 aa, Tick-borne encephalitis virus
LLKGHREQKG

SEQ ID NO: 199661 - protein, 10 aa, Tick-borne encephalitis virus
LKGHREQKGL

SEQ ID NO: 199662 - protein, 10 aa, Tick-borne encephalitis virus
KGHREQKGLT

SEQ ID NO: 199663 - protein, 10 aa, Tick-borne encephalitis virus
GHREQKGLSW

SEQ ID NO: 199664 - protein, 10 aa, Tick-borne encephalitis virus
HREQKGLSWI

SEQ ID NO: 199665 - protein, 10 aa, Tick-borne encephalitis virus
REQKGLTWVV

SEQ ID NO: 199666 - protein, 10 aa, Tick-borne encephalitis virus
EQKGLTWVVP

SEQ ID NO: 199667 - protein, 10 aa, Tick-borne encephalitis virus
QKGLTWVVPL

SEQ ID NO: 199668 - protein, 10 aa, Tick-borne encephalitis virus
KGLTWVVPLA

SEQ ID NO: 199669 - protein, 10 aa, Tick-borne encephalitis virus
VPLARLLGGE

SEQ ID NO: 199670 - protein, 10 aa, Tick-borne encephalitis virus
PLARLLGGEG

SEQ ID NO: 199671 - protein, 10 aa, Tick-borne encephalitis virus
LARLLGGEGS

SEQ ID NO: 199672 - protein, 10 aa, Tick-borne encephalitis virus
ARLLGGEGSG

SEQ ID NO: 199673 - protein, 10 aa, Tick-borne encephalitis virus
RLLGGEGSGI

SEQ ID NO: 199674 - protein, 10 aa, Tick-borne encephalitis virus
LLGGEGSGIR

SEQ ID NO: 199675 - protein, 10 aa, Tick-borne encephalitis virus
LGGEGSGIRL

SEQ ID NO: 199676 - protein, 10 aa, Tick-borne encephalitis virus
GGEGSGIRLL

SEQ ID NO: 199677 - protein, 10 aa, Tick-borne encephalitis virus
GEGSGIRLLA

SEQ ID NO: 199678 - protein, 10 aa, Tick-borne encephalitis virus
EGSGIRLLAF

SEQ ID NO: 199679 - protein, 10 aa, Tick-borne encephalitis virus
GSGIRLLAFW

SEQ ID NO: 199680 - protein, 10 aa, Tick-borne encephalitis virus
SGIRLLAFWE

SEQ ID NO: 199681 - protein, 10 aa, Tick-borne encephalitis virus
GIRLLAFWEL

SEQ ID NO: 199682 - protein, 10 aa, Tick-borne encephalitis virus
IRLLAFWELS

SEQ ID NO: 199683 - protein, 10 aa, Tick-borne encephalitis virus
HGRRRSFSEP

SEQ ID NO: 199684 - protein, 10 aa, Tick-borne encephalitis virus
RGRRSFSEPL

SEQ ID NO: 199685 - protein, 10 aa, Tick-borne encephalitis virus
GRRSFSEPLT

SEQ ID NO: 199686 - protein, 10 aa, Tick-borne encephalitis virus
VVGVMLTLAG

SEQ ID NO: 199687 - protein, 10 aa, Tick-borne encephalitis virus
VGVMLTLAGG

SEQ ID NO: 199688 - protein, 10 aa, Tick-borne encephalitis virus
GVMLTLAGGM

SEQ ID NO: 199689 - protein, 10 aa, Tick-borne encephalitis virus
VMLTLAGGMM

SEQ ID NO: 199690 - protein, 10 aa, Tick-borne encephalitis virus
MLTLAGGMMR

SEQ ID NO: 199691 - protein, 10 aa, Tick-borne encephalitis virus
LTLAGGMMRH

SEQ ID NO: 199692 - protein, 10 aa, Tick-borne encephalitis virus
TLAGGMMRHT

SEQ ID NO: 199693 - protein, 10 aa, Tick-borne encephalitis virus
LAGGMMRHTS

SEQ ID NO: 199694 - protein, 10 aa, Tick-borne encephalitis virus
AGGMMRHTSQ

SEQ ID NO: 199695 - protein, 10 aa, Tick-borne encephalitis virus
GGMMRHTSQE

SEQ ID NO: 199696 - protein, 10 aa, Tick-borne encephalitis virus
GMMRHTPQEA

SEQ ID NO: 199697 - protein, 10 aa, Tick-borne encephalitis virus
MMRHTPQEAL

SEQ ID NO: 199698 - protein, 10 aa, Tick-borne encephalitis virus
MRHTPQEALC

SEQ ID NO: 199699 - protein, 10 aa, Tick-borne encephalitis virus
RHTPQEALCA

SEQ ID NO: 199700 - protein, 10 aa, Tick-borne encephalitis virus
HTPQEALCAL

SEQ ID NO: 199701 - protein, 10 aa, Tick-borne encephalitis virus
TPQEALCALA

SEQ ID NO: 199702 - protein, 10 aa, Tick-borne encephalitis virus
PQEALCALAV

SEQ ID NO: 199703 - protein, 10 aa, Tick-borne encephalitis virus
AEWSGCVEWY

SEQ ID NO: 199704 - protein, 10 aa, Tick-borne encephalitis virus
EWSGCVEWYP

SEQ ID NO: 199705 - protein, 10 aa, Tick-borne encephalitis virus
WSGCVEWYPE

SEQ ID NO: 199706 - protein, 10 aa, Tick-borne encephalitis virus
SGCVEWYPEL

SEQ ID NO: 199707 - protein, 10 aa, Tick-borne encephalitis virus
GCVEWHPELV

SEQ ID NO: 199708 - protein, 10 aa, Tick-borne encephalitis virus
CVEWHPELVN

SEQ ID NO: 199709 - protein, 10 aa, Tick-borne encephalitis virus
VEWHPELVNE

SEQ ID NO: 199710 - protein, 10 aa, Tick-borne encephalitis virus
EWHPELVNEG

SEQ ID NO: 199711 - protein, 10 aa, Tick-borne encephalitis virus
WHPELVNEGG

SEQ ID NO: 199712 - protein, 10 aa, Tick-borne encephalitis virus
HPELVNEGGE

SEQ ID NO: 199713 - protein, 10 aa, Tick-borne encephalitis virus
PELVNEGGEV

SEQ ID NO: 199714 - protein, 10 aa, Tick-borne encephalitis virus
ELVNEGGEVS

SEQ ID NO: 199715 - protein, 10 aa, Tick-borne encephalitis virus
LVNEGGEVSL

SEQ ID NO: 199716 - protein, 10 aa, Tick-borne encephalitis virus
VNEGGEVSLR

SEQ ID NO: 199717 - protein, 10 aa, Tick-borne encephalitis virus
EVSLRVRQDA

SEQ ID NO: 199718 - protein, 10 aa, Tick-borne encephalitis virus
VSLRVRQDAM

SEQ ID NO: 199719 - protein, 10 aa, Tick-borne encephalitis virus
SLRVRQDAMG

SEQ ID NO: 199720 - protein, 10 aa, Tick-borne encephalitis virus
LRVRQDAMGN

SEQ ID NO: 199721 - protein, 10 aa, Tick-borne encephalitis virus
RVRQDAMGNF

SEQ ID NO: 199722 - protein, 10 aa, Tick-borne encephalitis virus
VRQDAMGNFH

SEQ ID NO: 199723 - protein, 10 aa, Tick-borne encephalitis virus
RQDAMGNFHL

SEQ ID NO: 199724 - protein, 10 aa, Tick-borne encephalitis virus
QDAMGNFHLT

SEQ ID NO: 199725 - protein, 10 aa, Tick-borne encephalitis virus
DAMGNFHLTE

SEQ ID NO: 199726 - protein, 10 aa, Tick-borne encephalitis virus
AMGNFHLTEL

SEQ ID NO: 199727 - protein, 10 aa, Tick-borne encephalitis virus
LTELEKEERM

SEQ ID NO: 199728 - protein, 10 aa, Tick-borne encephalitis virus
TELEKEERMM

SEQ ID NO: 199729 - protein, 10 aa, Tick-borne encephalitis virus
ELEKEERMMA

SEQ ID NO: 199730 - protein, 10 aa, Tick-borne encephalitis virus
LEKEERMMAF

SEQ ID NO: 199731 - protein, 10 aa, Tick-borne encephalitis virus
EKEERMMAFW

SEQ ID NO: 199732 - protein, 10 aa, Tick-borne encephalitis virus
KEERMMAFWL

SEQ ID NO: 199733 - protein, 10 aa, Tick-borne encephalitis virus
EERMMAFWLL

SEQ ID NO: 199734 - protein, 10 aa, Tick-borne encephalitis virus
ERMMAFWLLA

SEQ ID NO: 199735 - protein, 10 aa, Tick-borne encephalitis virus
RMMAFWLLAG

SEQ ID NO: 199736 - protein, 10 aa, Tick-borne encephalitis virus
MMAFWLLAGL

SEQ ID NO: 199737 - protein, 10 aa, Tick-borne encephalitis virus
MAFWLIAGLA

SEQ ID NO: 199738 - protein, 10 aa, Tick-borne encephalitis virus
AFWLIAGLAA

SEQ ID NO: 199739 - protein, 10 aa, Tick-borne encephalitis virus
FWLIAGLAAS

SEQ ID NO: 199740 - protein, 10 aa, Tick-borne encephalitis virus
WLIAGLAASA

SEQ ID NO: 199741 - protein, 10 aa, Tick-borne encephalitis virus
AGLAASAIHW

SEQ ID NO: 199742 - protein, 10 aa, Tick-borne encephalitis virus
GLAASAIHWS

SEQ ID NO: 199743 - protein, 10 aa, Tick-borne encephalitis virus
LAASAIHWSG

SEQ ID NO: 199744 - protein, 10 aa, Tick-borne encephalitis virus
AASAIHWSGI

SEQ ID NO: 199745 - protein, 10 aa, Tick-borne encephalitis virus
ASAIHWSGIL

SEQ ID NO: 199746 - protein, 10 aa, Tick-borne encephalitis virus
SAIHWSGILG

SEQ ID NO: 199747 - protein, 10 aa, Tick-borne encephalitis virus
AIHWSGILGV

SEQ ID NO: 199748 - protein, 10 aa, Tick-borne encephalitis virus
IHWSGILGVM

SEQ ID NO: 199749 - protein, 10 aa, Tick-borne encephalitis virus
HWSGIIGVMG

SEQ ID NO: 199750 - protein, 10 aa, Tick-borne encephalitis virus
WSGIIGVMGL

SEQ ID NO: 199751 - protein, 10 aa, Tick-borne encephalitis virus
SGIIGVMGLW

SEQ ID NO: 199752 - protein, 10 aa, Tick-borne encephalitis virus
GIIGVMGLWT

SEQ ID NO: 199753 - protein, 10 aa, Tick-borne encephalitis virus
IIGVMGLWTL

SEQ ID NO: 199754 - protein, 10 aa, Tick-borne encephalitis virus
LGVMGLWTLT

SEQ ID NO: 199755 - protein, 10 aa, Tick-borne encephalitis virus
GVMGLWTLTE

SEQ ID NO: 199756 - protein, 10 aa, Tick-borne encephalitis virus
VMGLWTLTEM

SEQ ID NO: 199757 - protein, 10 aa, Tick-borne encephalitis virus
MGLWTLTEML

SEQ ID NO: 199758 - protein, 10 aa, Tick-borne encephalitis virus
GLWTLTEMLR

SEQ ID NO: 199759 - protein, 10 aa, Tick-borne encephalitis virus
SRRSDLVFSG

SEQ ID NO: 199760 - protein, 10 aa, Tick-borne encephalitis virus
RRSDLAFSGQ

SEQ ID NO: 199761 - protein, 10 aa, Tick-borne encephalitis virus
RSDLAFSGQG

SEQ ID NO: 199762 - protein, 10 aa, Tick-borne encephalitis virus
SDLAFSGQGG

SEQ ID NO: 199763 - protein, 10 aa, Tick-borne encephalitis virus
DLAFSGQGGR

SEQ ID NO: 199764 - protein, 10 aa, Tick-borne encephalitis virus
LVFSGQGNRE

SEQ ID NO: 199765 - protein, 10 aa, Tick-borne encephalitis virus
AFSGQGGRER

SEQ ID NO: 199766 - protein, 10 aa, Tick-borne encephalitis virus
FSGQGRGERG

SEQ ID NO: 199767 - protein, 10 aa, Tick-borne encephalitis virus
SGQGRGERGD

SEQ ID NO: 199768 - protein, 10 aa, Tick-borne encephalitis virus
GQGGRERGDK

SEQ ID NO: 199769 - protein, 10 aa, Tick-borne encephalitis virus
QGGRERGDKP

SEQ ID NO: 199770 - protein, 10 aa, Tick-borne encephalitis virus
GGRERGDKPF

SEQ ID NO: 199771 - protein, 10 aa, Tick-borne encephalitis virus
GRERGDKPFE

SEQ ID NO: 199772 - protein, 10 aa, Tick-borne encephalitis virus
RERGDKPFEV

SEQ ID NO: 199773 - protein, 10 aa, Tick-borne encephalitis virus
ERGDKPFEVK

SEQ ID NO: 199774 - protein, 10 aa, Tick-borne encephalitis virus
RGDKPFEVKD

SEQ ID NO: 199775 - protein, 10 aa, Tick-borne encephalitis virus
GDKPFEVKDG

SEQ ID NO: 199776 - protein, 10 aa, Tick-borne encephalitis virus
DKPFEVKDGV

SEQ ID NO: 199777 - protein, 10 aa, Tick-borne encephalitis virus
KPFEVKDGVY

SEQ ID NO: 199778 - protein, 10 aa, Tick-borne encephalitis virus
PFEVRDGVYR

SEQ ID NO: 199779 - protein, 10 aa, Tick-borne encephalitis virus
FEVRDGVYRI

SEQ ID NO: 199780 - protein, 10 aa, Tick-borne encephalitis virus
EVRDGVYRIF

SEQ ID NO: 199781 - protein, 10 aa, Tick-borne encephalitis virus
VRDGVYRIFS

SEQ ID NO: 199782 - protein, 10 aa, Tick-borne encephalitis virus
RDGVYRIFSP

SEQ ID NO: 199783 - protein, 10 aa, Tick-borne encephalitis virus
VYRIFSPGLF

SEQ ID NO: 199784 - protein, 10 aa, Tick-borne encephalitis virus
YRIFSPGLFW

SEQ ID NO: 199785 - protein, 10 aa, Tick-borne encephalitis virus
RIFSPGLFWG

SEQ ID NO: 199786 - protein, 10 aa, Tick-borne encephalitis virus
IFSPGLFWGQ

SEQ ID NO: 199787 - protein, 10 aa, Tick-borne encephalitis virus
FSPGLFWGQN

SEQ ID NO: 199788 - protein, 10 aa, Tick-borne encephalitis virus
SPGLFWGQNQ

SEQ ID NO: 199789 - protein, 10 aa, Tick-borne encephalitis virus
PGLFWGQNQV

SEQ ID NO: 199790 - protein, 10 aa, Tick-borne encephalitis virus
GLFWGQNQVG

SEQ ID NO: 199791 - protein, 10 aa, Tick-borne encephalitis virus
LFWGQNQVGV

SEQ ID NO: 199792 - protein, 10 aa, Tick-borne encephalitis virus
FWGQNQVGVG

SEQ ID NO: 199793 - protein, 10 aa, Tick-borne encephalitis virus
WGQNQVGVGY

SEQ ID NO: 199794 - protein, 10 aa, Tick-borne encephalitis virus
GQNQVGVGYG

SEQ ID NO: 199795 - protein, 10 aa, Tick-borne encephalitis virus
QRQVGVGYGS

SEQ ID NO: 199796 - protein, 10 aa, Tick-borne encephalitis virus
RQVGVGYGSK

SEQ ID NO: 199797 - protein, 10 aa, Tick-borne encephalitis virus
QVGVGYGFKG

SEQ ID NO: 199798 - protein, 10 aa, Tick-borne encephalitis virus
VGVGYGFKGV

SEQ ID NO: 199799 - protein, 10 aa, Tick-borne encephalitis virus
GVGYGFKGVL

SEQ ID NO: 199800 - protein, 10 aa, Tick-borne encephalitis virus
VGYGFKGVLH

SEQ ID NO: 199801 - protein, 10 aa, Tick-borne encephalitis virus
GYGFKGVLHT

SEQ ID NO: 199802 - protein, 10 aa, Tick-borne encephalitis virus
YGFKGVLHTM

SEQ ID NO: 199803 - protein, 10 aa, Tick-borne encephalitis virus
GFKGVLHTMW

SEQ ID NO: 199804 - protein, 10 aa, Tick-borne encephalitis virus
FKGVLHTMWH

SEQ ID NO: 199805 - protein, 10 aa, Tick-borne encephalitis virus
RGVLHTMWHV

SEQ ID NO: 199806 - protein, 10 aa, Tick-borne encephalitis virus
WHVTRGAALY

SEQ ID NO: 199807 - protein, 10 aa, Tick-borne encephalitis virus
HVTRGAALYI

SEQ ID NO: 199808 - protein, 10 aa, Tick-borne encephalitis virus
VTRGAALSIN

SEQ ID NO: 199809 - protein, 10 aa, Tick-borne encephalitis virus
TRGAALSIND

SEQ ID NO: 199810 - protein, 10 aa, Tick-borne encephalitis virus
RGAALSINDA

SEQ ID NO: 199811 - protein, 10 aa, Tick-borne encephalitis virus
GAALSINDAV

SEQ ID NO: 199812 - protein, 10 aa, Tick-borne encephalitis virus
AALSINDAVA

SEQ ID NO: 199813 - protein, 10 aa, Tick-borne encephalitis virus
ALSINDAVAG

SEQ ID NO: 199814 - protein, 10 aa, Tick-borne encephalitis virus
LSINDAVAGP

SEQ ID NO: 199815 - protein, 10 aa, Tick-borne encephalitis virus
SINDAVAGPY

SEQ ID NO: 199816 - protein, 10 aa, Tick-borne encephalitis virus
INDAVAGPYW

SEQ ID NO: 199817 - protein, 10 aa, Tick-borne encephalitis virus
NDAVAGPYWA

SEQ ID NO: 199818 - protein, 10 aa, Tick-borne encephalitis virus
DAVVGPYWAD

SEQ ID NO: 199819 - protein, 10 aa, Tick-borne encephalitis virus
AVVGPYWADV

SEQ ID NO: 199820 - protein, 10 aa, Tick-borne encephalitis virus
VAGPYWADVR

SEQ ID NO: 199821 - protein, 10 aa, Tick-borne encephalitis virus
AGPYWADVRE

SEQ ID NO: 199822 - protein, 10 aa, Tick-borne encephalitis virus
GPYWADVRED

SEQ ID NO: 199823 - protein, 10 aa, Tick-borne encephalitis virus
PYWADVREDV

SEQ ID NO: 199824 - protein, 10 aa, Tick-borne encephalitis virus
YWADVREDVV

SEQ ID NO: 199825 - protein, 10 aa, Tick-borne encephalitis virus
WADVREDVVC

SEQ ID NO: 199826 - protein, 10 aa, Tick-borne encephalitis virus
ADVREDVVCY

SEQ ID NO: 199827 - protein, 10 aa, Tick-borne encephalitis virus
DVREDVVCYG

SEQ ID NO: 199828 - protein, 10 aa, Tick-borne encephalitis virus
VREDVVCYGG

SEQ ID NO: 199829 - protein, 10 aa, Tick-borne encephalitis virus
REDVVCYGGA

SEQ ID NO: 199830 - protein, 10 aa, Tick-borne encephalitis virus
EDVVCYGGTW

SEQ ID NO: 199831 - protein, 10 aa, Tick-borne encephalitis virus
DVVCYGGTWS

SEQ ID NO: 199832 - protein, 10 aa, Tick-borne encephalitis virus
VVCYGGTWSL

SEQ ID NO: 199833 - protein, 10 aa, Tick-borne encephalitis virus
VCYGGTWSLE

SEQ ID NO: 199834 - protein, 10 aa, Tick-borne encephalitis virus
CYGGTWSLEE

SEQ ID NO: 199835 - protein, 10 aa, Tick-borne encephalitis virus
YGGTWSLEEK

SEQ ID NO: 199836 - protein, 10 aa, Tick-borne encephalitis virus
GGTWSLEEKW

SEQ ID NO: 199837 - protein, 10 aa, Tick-borne encephalitis virus
GAWSLEEKWR

SEQ ID NO: 199838 - protein, 10 aa, Tick-borne encephalitis virus
AWSLEEKWRG

SEQ ID NO: 199839 - protein, 10 aa, Tick-borne encephalitis virus
WSLEEKWRGE

SEQ ID NO: 199840 - protein, 10 aa, Tick-borne encephalitis virus
SLEEKWRGET

SEQ ID NO: 199841 - protein, 10 aa, Tick-borne encephalitis virus
LEEKWRGETV

SEQ ID NO: 199842 - protein, 10 aa, Tick-borne encephalitis virus
EEKWRGETVQ

SEQ ID NO: 199843 - protein, 10 aa, Tick-borne encephalitis virus
EKWRGETVQV

SEQ ID NO: 199844 - protein, 10 aa, Tick-borne encephalitis virus
KWRGETVQVH

SEQ ID NO: 199845 - protein, 10 aa, Tick-borne encephalitis virus
WRGETVQVHA

SEQ ID NO: 199846 - protein, 10 aa, Tick-borne encephalitis virus
RGETVQVHAF

SEQ ID NO: 199847 - protein, 10 aa, Tick-borne encephalitis virus
VQVHAFPPGK

SEQ ID NO: 199848 - protein, 10 aa, Tick-borne encephalitis virus
QVHAFPPGKA

SEQ ID NO: 199849 - protein, 10 aa, Tick-borne encephalitis virus
VHAFPPGKAH

SEQ ID NO: 199850 - protein, 10 aa, Tick-borne encephalitis virus
HAFPPGKAHE

SEQ ID NO: 199851 - protein, 10 aa, Tick-borne encephalitis virus
AFPPGKAHEV

SEQ ID NO: 199852 - protein, 10 aa, Tick-borne encephalitis virus
FPPGKAHEVH

SEQ ID NO: 199853 - protein, 10 aa, Tick-borne encephalitis virus
PPGKAHEVHQ

SEQ ID NO: 199854 - protein, 10 aa, Tick-borne encephalitis virus
PGKAHEVHQC

SEQ ID NO: 199855 - protein, 10 aa, Tick-borne encephalitis virus
GKAHEVHQCQ

SEQ ID NO: 199856 - protein, 10 aa, Tick-borne encephalitis virus
KAHEVHQCQP

SEQ ID NO: 199857 - protein, 10 aa, Tick-borne encephalitis virus
VHQCQPGELI

SEQ ID NO: 199858 - protein, 10 aa, Tick-borne encephalitis virus
HQCQPGELIL

SEQ ID NO: 199859 - protein, 10 aa, Tick-borne encephalitis virus
QCQPGELILD

SEQ ID NO: 199860 - protein, 10 aa, Tick-borne encephalitis virus
CQPGELILDT

SEQ ID NO: 199861 - protein, 10 aa, Tick-borne encephalitis virus
QPGELILDTG

SEQ ID NO: 199862 - protein, 10 aa, Tick-borne encephalitis virus
PGELILDTGR

SEQ ID NO: 199863 - protein, 10 aa, Tick-borne encephalitis virus
GELILDTGRK

SEQ ID NO: 199864 - protein, 10 aa, Tick-borne encephalitis virus
GAIPIDLVKG

SEQ ID NO: 199865 - protein, 10 aa, Tick-borne encephalitis virus
AIPIDLVKGT

SEQ ID NO: 199866 - protein, 10 aa, Tick-borne encephalitis virus
IPIDLVKGTS

SEQ ID NO: 199867 - protein, 10 aa, Tick-borne encephalitis virus
PIDLVKGTSG

SEQ ID NO: 199868 - protein, 10 aa, Tick-borne encephalitis virus
IDLVKGTSGS

SEQ ID NO: 199869 - protein, 10 aa, Tick-borne encephalitis virus
DLVKGTSGSP

SEQ ID NO: 199870 - protein, 10 aa, Tick-borne encephalitis virus
LVKGTSGSPI

SEQ ID NO: 199871 - protein, 10 aa, Tick-borne encephalitis virus
VKGTSGSPIL

SEQ ID NO: 199872 - protein, 10 aa, Tick-borne encephalitis virus
KGTSGSPTLN

SEQ ID NO: 199873 - protein, 10 aa, Tick-borne encephalitis virus
GTSGSPILNA

SEQ ID NO: 199874 - protein, 10 aa, Tick-borne encephalitis virus
TSGSPILNAQ

SEQ ID NO: 199875 - protein, 10 aa, Tick-borne encephalitis virus
SGSPILNAQG

SEQ ID NO: 199876 - protein, 10 aa, Tick-borne encephalitis virus
SPILNAQGVV

SEQ ID NO: 199877 - protein, 10 aa, Tick-borne encephalitis virus
PILNAQGVVV

SEQ ID NO: 199878 - protein, 10 aa, Tick-borne encephalitis virus
ILNAQGVVVG

SEQ ID NO: 199879 - protein, 10 aa, Tick-borne encephalitis virus
LNAQGVVVGL

SEQ ID NO: 199880 - protein, 10 aa, Tick-borne encephalitis virus
NAQGVVVGLY

SEQ ID NO: 199881 - protein, 10 aa, Tick-borne encephalitis virus
AQGVVVGLYG

SEQ ID NO: 199882 - protein, 10 aa, Tick-borne encephalitis virus
QGAVVGLYGN

SEQ ID NO: 199883 - protein, 10 aa, Tick-borne encephalitis virus
GAVVGLYGNG

SEQ ID NO: 199884 - protein, 10 aa, Tick-borne encephalitis virus
AVVGLYGNGL

SEQ ID NO: 199885 - protein, 10 aa, Tick-borne encephalitis virus
LYGNGLKTNG

SEQ ID NO: 199886 - protein, 10 aa, Tick-borne encephalitis virus
YGNGLKTNGT

SEQ ID NO: 199887 - protein, 10 aa, Tick-borne encephalitis virus
GNGLKTNGTY

SEQ ID NO: 199888 - protein, 10 aa, Tick-borne encephalitis virus
NGLKTNGTYV

SEQ ID NO: 199889 - protein, 10 aa, Tick-borne encephalitis virus
GLKTNGTYVS

SEQ ID NO: 199890 - protein, 10 aa, Tick-borne encephalitis virus
LKTNGTYVSS

SEQ ID NO: 199891 - protein, 10 aa, Tick-borne encephalitis virus
KTNGTYVSSI

SEQ ID NO: 199892 - protein, 10 aa, Tick-borne encephalitis virus
TNGTYVSSIA

SEQ ID NO: 199893 - protein, 10 aa, Tick-borne encephalitis virus
NGTYVSSIAQ

SEQ ID NO: 199894 - protein, 10 aa, Tick-borne encephalitis virus
GTYVSSIAQG

SEQ ID NO: 199895 - protein, 10 aa, Tick-borne encephalitis virus
YVSSIAQGEV

SEQ ID NO: 199896 - protein, 10 aa, Tick-borne encephalitis virus
VSSIAQGEVE

SEQ ID NO: 199897 - protein, 10 aa, Tick-borne encephalitis virus
SSIAQGEVEK

SEQ ID NO: 199898 - protein, 10 aa, Tick-borne encephalitis virus
SIAQGEVEKS

SEQ ID NO: 199899 - protein, 10 aa, Tick-borne encephalitis virus
IAQGEVEKSR

SEQ ID NO: 199900 - protein, 10 aa, Tick-borne encephalitis virus
AQGEVEKSRP

SEQ ID NO: 199901 - protein, 10 aa, Tick-borne encephalitis virus
QGEVEKSRPN

SEQ ID NO: 199902 - protein, 10 aa, Tick-borne encephalitis virus
GEVEKSRPNL

SEQ ID NO: 199903 - protein, 10 aa, Tick-borne encephalitis virus
EVEKSRPNLP

SEQ ID NO: 199904 - protein, 10 aa, Tick-borne encephalitis virus
AEKSRPNLPQ

SEQ ID NO: 199905 - protein, 10 aa, Tick-borne encephalitis virus
EKSRPNLPQA

SEQ ID NO: 199906 - protein, 10 aa, Tick-borne encephalitis virus
KSRPNLPQAV

SEQ ID NO: 199907 - protein, 10 aa, Tick-borne encephalitis virus
GTGWTSKGQI

SEQ ID NO: 199908 - protein, 10 aa, Tick-borne encephalitis virus
TGWTSKGQIT

SEQ ID NO: 199909 - protein, 10 aa, Tick-borne encephalitis virus
GWTSKGQITV

SEQ ID NO: 199910 - protein, 10 aa, Tick-borne encephalitis virus
WTSKGQITVL

SEQ ID NO: 199911 - protein, 10 aa, Tick-borne encephalitis virus
TSKGQITVLD

SEQ ID NO: 199912 - protein, 10 aa, Tick-borne encephalitis virus
SKGQITVLDM

SEQ ID NO: 199913 - protein, 10 aa, Tick-borne encephalitis virus
VLPELIRQCT

SEQ ID NO: 199914 - protein, 10 aa, Tick-borne encephalitis virus
LPELIRQCTD

SEQ ID NO: 199915 - protein, 10 aa, Tick-borne encephalitis virus
PELIRQCTDR

SEQ ID NO: 199916 - protein, 10 aa, Tick-borne encephalitis virus
ELIRQCTDRR

SEQ ID NO: 199917 - protein, 10 aa, Tick-borne encephalitis virus
LIRQCTDRRL

SEQ ID NO: 199918 - protein, 10 aa, Tick-borne encephalitis virus
IRQCTDRRLR

SEQ ID NO: 199919 - protein, 10 aa, Tick-borne encephalitis virus
RQCTDRRLRT

SEQ ID NO: 199920 - protein, 10 aa, Tick-borne encephalitis virus
QCTDRRLRTL

SEQ ID NO: 199921 - protein, 10 aa, Tick-borne encephalitis virus
CTDRRLRTLV

SEQ ID NO: 199922 - protein, 10 aa, Tick-borne encephalitis virus
TDRRLRTLVL

SEQ ID NO: 199923 - protein, 10 aa, Tick-borne encephalitis virus
VLKEMERALS

SEQ ID NO: 199924 - protein, 10 aa, Tick-borne encephalitis virus
LKEMERALSG

SEQ ID NO: 199925 - protein, 10 aa, Tick-borne encephalitis virus
KEMERALSGK

SEQ ID NO: 199926 - protein, 10 aa, Tick-borne encephalitis virus
EMERALSGKR

SEQ ID NO: 199927 - protein, 10 aa, Tick-borne encephalitis virus
MERALSGKRV

SEQ ID NO: 199928 - protein, 10 aa, Tick-borne encephalitis virus
ERALSGKRVR

SEQ ID NO: 199929 - protein, 10 aa, Tick-borne encephalitis virus
RALSGKRVRF

SEQ ID NO: 199930 - protein, 10 aa, Tick-borne encephalitis virus
ALSGKRVRFH

SEQ ID NO: 199931 - protein, 10 aa, Tick-borne encephalitis virus
LSGKRVRFHS

SEQ ID NO: 199932 - protein, 10 aa, Tick-borne encephalitis virus
SGKRVRFHSP

SEQ ID NO: 199933 - protein, 10 aa, Tick-borne encephalitis virus
GKRVRFHSPV

SEQ ID NO: 199934 - protein, 10 aa, Tick-borne encephalitis virus
KRVRFHSPVV

SEQ ID NO: 199935 - protein, 10 aa, Tick-borne encephalitis virus
RVRFHSPAVS

SEQ ID NO: 199936 - protein, 10 aa, Tick-borne encephalitis virus
VRFHSPAVSD

SEQ ID NO: 199937 - protein, 10 aa, Tick-borne encephalitis virus
RFHSPAVSDQ

SEQ ID NO: 199938 - protein, 10 aa, Tick-borne encephalitis virus
FHSPAVSDQQ

SEQ ID NO: 199939 - protein, 10 aa, Tick-borne encephalitis virus
DQQAGGAIVD

SEQ ID NO: 199940 - protein, 10 aa, Tick-borne encephalitis virus
GGSIVDVMCH

SEQ ID NO: 199941 - protein, 10 aa, Tick-borne encephalitis virus
GSIVDVMCHA

SEQ ID NO: 199942 - protein, 10 aa, Tick-borne encephalitis virus
SIVDVMCHAT

SEQ ID NO: 199943 - protein, 10 aa, Tick-borne encephalitis virus
IVDLMCHTTY

SEQ ID NO: 199944 - protein, 10 aa, Tick-borne encephalitis virus
VDLMCHTTYV

SEQ ID NO: 199945 - protein, 10 aa, Tick-borne encephalitis virus
DVMCHATYVS

SEQ ID NO: 199946 - protein, 10 aa, Tick-borne encephalitis virus
VMCHATYVSR

SEQ ID NO: 199947 - protein, 10 aa, Tick-borne encephalitis virus
MCHATYVSRR

SEQ ID NO: 199948 - protein, 10 aa, Tick-borne encephalitis virus
CHTTYVNRRL

SEQ ID NO: 199949 - protein, 10 aa, Tick-borne encephalitis virus
HTTYVNRRLL

SEQ ID NO: 199950 - protein, 10 aa, Tick-borne encephalitis virus
TTYVNRRLLP

SEQ ID NO: 199951 - protein, 10 aa, Tick-borne encephalitis virus
TYVSRRLLPQ

SEQ ID NO: 199952 - protein, 10 aa, Tick-borne encephalitis virus
YVSRRLLPQG

SEQ ID NO: 199953 - protein, 10 aa, Tick-borne encephalitis virus
VSRRLLPQGR

SEQ ID NO: 199954 - protein, 10 aa, Tick-borne encephalitis virus
SRRLLPQGRQ

SEQ ID NO: 199955 - protein, 10 aa, Tick-borne encephalitis virus
QGRQNWEVAT

SEQ ID NO: 199956 - protein, 10 aa, Tick-borne encephalitis virus
GRQNWEVATI

SEQ ID NO: 199957 - protein, 10 aa, Tick-borne encephalitis virus
RQNWEVATID

SEQ ID NO: 199958 - protein, 10 aa, Tick-borne encephalitis virus
QNWEVATIDE

SEQ ID NO: 199959 - protein, 10 aa, Tick-borne encephalitis virus
NWEVATIDEA

SEQ ID NO: 199960 - protein, 10 aa, Tick-borne encephalitis virus
WEVATIDEAH

SEQ ID NO: 199961 - protein, 10 aa, Tick-borne encephalitis virus
EVATIDEAHW

SEQ ID NO: 199962 - protein, 10 aa, Tick-borne encephalitis virus
VATIDEAHWT

SEQ ID NO: 199963 - protein, 10 aa, Tick-borne encephalitis virus
ATIDEAHWTD

SEQ ID NO: 199964 - protein, 10 aa, Tick-borne encephalitis virus
TIDEAHWTDP

SEQ ID NO: 199965 - protein, 10 aa, Tick-borne encephalitis virus
IDEAHWTDPH

SEQ ID NO: 199966 - protein, 10 aa, Tick-borne encephalitis virus
ARGHLYTLAQ

SEQ ID NO: 199967 - protein, 10 aa, Tick-borne encephalitis virus
RGHLYTLAQE

SEQ ID NO: 199968 - protein, 10 aa, Tick-borne encephalitis virus
GHLYTLAQEN

SEQ ID NO: 199969 - protein, 10 aa, Tick-borne encephalitis virus
HLYTLAQENK

SEQ ID NO: 199970 - protein, 10 aa, Tick-borne encephalitis virus
LYTLAQENKC

SEQ ID NO: 199971 - protein, 10 aa, Tick-borne encephalitis virus
YTLAQENKCA

SEQ ID NO: 199972 - protein, 10 aa, Tick-borne encephalitis virus
TLAQENKCAL

SEQ ID NO: 199973 - protein, 10 aa, Tick-borne encephalitis virus
LAQENKCALV

SEQ ID NO: 199974 - protein, 10 aa, Tick-borne encephalitis virus
AQENKCALVL

SEQ ID NO: 199975 - protein, 10 aa, Tick-borne encephalitis virus
QENKCALVLM

SEQ ID NO: 199976 - protein, 10 aa, Tick-borne encephalitis virus
CALVLMTATR

SEQ ID NO: 199977 - protein, 10 aa, Tick-borne encephalitis virus
ALVLMTATRP

SEQ ID NO: 199978 - protein, 10 aa, Tick-borne encephalitis virus
LVLMTATRPG

SEQ ID NO: 199979 - protein, 10 aa, Tick-borne encephalitis virus
VLMTATRPGK

SEQ ID NO: 199980 - protein, 10 aa, Tick-borne encephalitis virus
LMTATRPGKS

SEQ ID NO: 199981 - protein, 10 aa, Tick-borne encephalitis virus
MTATRPGKSE

SEQ ID NO: 199982 - protein, 10 aa, Tick-borne encephalitis virus
TATRPGKSEP

SEQ ID NO: 199983 - protein, 10 aa, Tick-borne encephalitis virus
ATRPGKSEPF

SEQ ID NO: 199984 - protein, 10 aa, Tick-borne encephalitis virus
TRPGKSEPFP

SEQ ID NO: 199985 - protein, 10 aa, Tick-borne encephalitis virus
RPGKSEPFPE

SEQ ID NO: 199986 - protein, 10 aa, Tick-borne encephalitis virus
KSEPFPESNR

SEQ ID NO: 199987 - protein, 10 aa, Tick-borne encephalitis virus
SEPFPESNRG

SEQ ID NO: 199988 - protein, 10 aa, Tick-borne encephalitis virus
EPFPESNRGI

SEQ ID NO: 199989 - protein, 10 aa, Tick-borne encephalitis virus
PFPESNGAIS

SEQ ID NO: 199990 - protein, 10 aa, Tick-borne encephalitis virus
FPESNGAISS

SEQ ID NO: 199991 - protein, 10 aa, Tick-borne encephalitis virus
PESNGAISSE

SEQ ID NO: 199992 - protein, 10 aa, Tick-borne encephalitis virus
ESNGAISSEE

SEQ ID NO: 199993 - protein, 10 aa, Tick-borne encephalitis virus
SNGAITSEEK

SEQ ID NO: 199994 - protein, 10 aa, Tick-borne encephalitis virus
NGAITSEEKQ

SEQ ID NO: 199995 - protein, 10 aa, Tick-borne encephalitis virus
GAITSEEKQI

SEQ ID NO: 199996 - protein, 10 aa, Tick-borne encephalitis virus
AITSEEKQIP

SEQ ID NO: 199997 - protein, 10 aa, Tick-borne encephalitis virus
SEERQIPDGE

SEQ ID NO: 199998 - protein, 10 aa, Tick-borne encephalitis virus
EERQIPDGEW

SEQ ID NO: 199999 - protein, 10 aa, Tick-borne encephalitis virus
ERQIPDGEWR

SEQ ID NO: 200000 - protein, 10 aa, Tick-borne encephalitis virus
RQIPDGEWRD

SEQ ID NO: 200001 - protein, 10 aa, Tick-borne encephalitis virus
QIPEGEWRDG

SEQ ID NO: 200002 - protein, 10 aa, Tick-borne encephalitis virus
IPEGEWRDGF

SEQ ID NO: 200003 - protein, 10 aa, Tick-borne encephalitis virus
PEGEWRDGFD

SEQ ID NO: 200004 - protein, 10 aa, Tick-borne encephalitis virus
EGEWRDGFDW

SEQ ID NO: 200005 - protein, 10 aa, Tick-borne encephalitis virus
DWITEYEGRS

SEQ ID NO: 200006 - protein, 10 aa, Tick-borne encephalitis virus
WITEYEGRSA

SEQ ID NO: 200007 - protein, 10 aa, Tick-borne encephalitis virus
ITEYEGRSAW

SEQ ID NO: 200008 - protein, 10 aa, Tick-borne encephalitis virus
TEYEGRSAWF

SEQ ID NO: 200009 - protein, 10 aa, Tick-borne encephalitis virus
EYEGRSAWFV

SEQ ID NO: 200010 - protein, 10 aa, Tick-borne encephalitis virus
YEGRSAWFVP

SEQ ID NO: 200011 - protein, 10 aa, Tick-borne encephalitis virus
EGRSAWFVPS

SEQ ID NO: 200012 - protein, 10 aa, Tick-borne encephalitis virus
GRSAWFVPSI

SEQ ID NO: 200013 - protein, 10 aa, Tick-borne encephalitis virus
RSAWFVPSIA

SEQ ID NO: 200014 - protein, 10 aa, Tick-borne encephalitis virus
TAWFVPSIVK

SEQ ID NO: 200015 - protein, 10 aa, Tick-borne encephalitis virus
AWFVPSIVKG

SEQ ID NO: 200016 - protein, 10 aa, Tick-borne encephalitis virus
WFVPSIVKGG

SEQ ID NO: 200017 - protein, 10 aa, Tick-borne encephalitis virus
FVPSIAKGGA

SEQ ID NO: 200018 - protein, 10 aa, Tick-borne encephalitis virus
VPSIAKGGAI

SEQ ID NO: 200019 - protein, 10 aa, Tick-borne encephalitis virus
PSIAKGGAIA

SEQ ID NO: 200020 - protein, 10 aa, Tick-borne encephalitis virus
SIAKGGAIAR

SEQ ID NO: 200021 - protein, 10 aa, Tick-borne encephalitis virus
IAKGGAIART

SEQ ID NO: 200022 - protein, 10 aa, Tick-borne encephalitis virus
AKGGAIARTL

SEQ ID NO: 200023 - protein, 10 aa, Tick-borne encephalitis virus
KGGAIARTLR

SEQ ID NO: 200024 - protein, 10 aa, Tick-borne encephalitis virus
GGAIARTLRQ

SEQ ID NO: 200025 - protein, 10 aa, Tick-borne encephalitis virus
GAIARTLRQK

SEQ ID NO: 200026 - protein, 10 aa, Tick-borne encephalitis virus
AIARTLRQKG

SEQ ID NO: 200027 - protein, 10 aa, Tick-borne encephalitis virus
IARALRQKGK

SEQ ID NO: 200028 - protein, 10 aa, Tick-borne encephalitis virus
ARALRQKGKS

SEQ ID NO: 200029 - protein, 10 aa, Tick-borne encephalitis virus
RALRQKGKSV

SEQ ID NO: 200030 - protein, 10 aa, Tick-borne encephalitis virus
ALRQKGKSVI

SEQ ID NO: 200031 - protein, 10 aa, Tick-borne encephalitis virus
NSKTFEKDYT

SEQ ID NO: 200032 - protein, 10 aa, Tick-borne encephalitis virus
SKTFEKDYTR

SEQ ID NO: 200033 - protein, 10 aa, Tick-borne encephalitis virus
KTFEKDYTRV

SEQ ID NO: 200034 - protein, 10 aa, Tick-borne encephalitis virus
TFEKDYTRVR

SEQ ID NO: 200035 - protein, 10 aa, Tick-borne encephalitis virus
FEKDYTRVRD

SEQ ID NO: 200036 - protein, 10 aa, Tick-borne encephalitis virus
EKDYTRVRDE

SEQ ID NO: 200037 - protein, 10 aa, Tick-borne encephalitis virus
KDYTRVRDEK

SEQ ID NO: 200038 - protein, 10 aa, Tick-borne encephalitis virus
DYTRVRDEKP

SEQ ID NO: 200039 - protein, 10 aa, Tick-borne encephalitis virus
YTRVRDEKPD

SEQ ID NO: 200040 - protein, 10 aa, Tick-borne encephalitis virus
TRVRDEKPDF

SEQ ID NO: 200041 - protein, 10 aa, Tick-borne encephalitis virus
NIKPEEVDGK

SEQ ID NO: 200042 - protein, 10 aa, Tick-borne encephalitis virus
IKPEEVDGKV

SEQ ID NO: 200043 - protein, 10 aa, Tick-borne encephalitis virus
KPEEVDGKVE

SEQ ID NO: 200044 - protein, 10 aa, Tick-borne encephalitis virus
PEEVDGKVEL

SEQ ID NO: 200045 - protein, 10 aa, Tick-borne encephalitis virus
EEVDGKVELT

SEQ ID NO: 200046 - protein, 10 aa, Tick-borne encephalitis virus
EVDGKVELTG

SEQ ID NO: 200047 - protein, 10 aa, Tick-borne encephalitis virus
VDGKVELTGT

SEQ ID NO: 200048 - protein, 10 aa, Tick-borne encephalitis virus
DGKVELTGTR

SEQ ID NO: 200049 - protein, 10 aa, Tick-borne encephalitis virus
GKVELTGTRR

SEQ ID NO: 200050 - protein, 10 aa, Tick-borne encephalitis virus
KVELTGTRRV

SEQ ID NO: 200051 - protein, 10 aa, Tick-borne encephalitis virus
VELIGTRRVT

SEQ ID NO: 200052 - protein, 10 aa, Tick-borne encephalitis virus
ELIGTRRVTT

SEQ ID NO: 200053 - protein, 10 aa, Tick-borne encephalitis virus
LIGTRRVTTA

SEQ ID NO: 200054 - protein, 10 aa, Tick-borne encephalitis virus
IGTRRVTTAS

SEQ ID NO: 200055 - protein, 10 aa, Tick-borne encephalitis virus
RRVTTASAAP

SEQ ID NO: 200056 - protein, 10 aa, Tick-borne encephalitis virus
RVTTASAAPR

SEQ ID NO: 200057 - protein, 10 aa, Tick-borne encephalitis virus
VTTASAAPRR

SEQ ID NO: 200058 - protein, 10 aa, Tick-borne encephalitis virus
TTASAAPRRG

SEQ ID NO: 200059 - protein, 10 aa, Tick-borne encephalitis virus
TASAAPRRGR

SEQ ID NO: 200060 - protein, 10 aa, Tick-borne encephalitis virus
ASAAPRRGRV

SEQ ID NO: 200061 - protein, 10 aa, Tick-borne encephalitis virus
SAAPRRGRVG

SEQ ID NO: 200062 - protein, 10 aa, Tick-borne encephalitis virus
AAPRRGRVGR

SEQ ID NO: 200063 - protein, 10 aa, Tick-borne encephalitis virus
AQRRGRVGRH

SEQ ID NO: 200064 - protein, 10 aa, Tick-borne encephalitis virus
QRRGRVGRQD

SEQ ID NO: 200065 - protein, 10 aa, Tick-borne encephalitis virus
RRGRVGRQDG

SEQ ID NO: 200066 - protein, 10 aa, Tick-borne encephalitis virus
RGRVGRQDGR

SEQ ID NO: 200067 - protein, 10 aa, Tick-borne encephalitis virus
GRVGRQDGRT

SEQ ID NO: 200068 - protein, 10 aa, Tick-borne encephalitis virus
RVGRQDGRTD

SEQ ID NO: 200069 - protein, 10 aa, Tick-borne encephalitis virus
VGRQDGRTDE

SEQ ID NO: 200070 - protein, 10 aa, Tick-borne encephalitis virus
GRQDGRTDEY

SEQ ID NO: 200071 - protein, 10 aa, Tick-borne encephalitis virus
RQDGRTDEYI

SEQ ID NO: 200072 - protein, 10 aa, Tick-borne encephalitis virus
QDGRTDEYIY

SEQ ID NO: 200073 - protein, 10 aa, Tick-borne encephalitis virus
DGRTDEYIYS

SEQ ID NO: 200074 - protein, 10 aa, Tick-borne encephalitis virus
GRIDEYIYSG

SEQ ID NO: 200075 - protein, 10 aa, Tick-borne encephalitis virus
RIDEYIYSGQ

SEQ ID NO: 200076 - protein, 10 aa, Tick-borne encephalitis virus
IDEYIYSGQC

SEQ ID NO: 200077 - protein, 10 aa, Tick-borne encephalitis virus
EYIYSGQCDE

SEQ ID NO: 200078 - protein, 10 aa, Tick-borne encephalitis virus
YIYSGQCDEY

SEQ ID NO: 200079 - protein, 10 aa, Tick-borne encephalitis virus
IYSGQCDEYD

SEQ ID NO: 200080 - protein, 10 aa, Tick-borne encephalitis virus
YSGQCDDDDG

SEQ ID NO: 200081 - protein, 10 aa, Tick-borne encephalitis virus
SGQCDEYDSG

SEQ ID NO: 200082 - protein, 10 aa, Tick-borne encephalitis virus
GQCDDDDGGL

SEQ ID NO: 200083 - protein, 10 aa, Tick-borne encephalitis virus
QCDDDDGGLV

SEQ ID NO: 200084 - protein, 10 aa, Tick-borne encephalitis virus
CDDDDSVLVQ

SEQ ID NO: 200085 - protein, 10 aa, Tick-borne encephalitis virus
DDDDGGLVQW

SEQ ID NO: 200086 - protein, 10 aa, Tick-borne encephalitis virus
EYDSGLVQWK

SEQ ID NO: 200087 - protein, 10 aa, Tick-borne encephalitis virus
YDSGLVQWKE

SEQ ID NO: 200088 - protein, 10 aa, Tick-borne encephalitis virus
DSGLVQWKEG

SEQ ID NO: 200089 - protein, 10 aa, Tick-borne encephalitis virus
SGLVQWKEGQ

SEQ ID NO: 200090 - protein, 10 aa, Tick-borne encephalitis virus
VLVQWKEAQI

SEQ ID NO: 200091 - protein, 10 aa, Tick-borne encephalitis virus
LVQWKEGQIL

SEQ ID NO: 200092 - protein, 10 aa, Tick-borne encephalitis virus
VQWKEGQILL

SEQ ID NO: 200093 - protein, 10 aa, Tick-borne encephalitis virus
QWKEGQILLD

SEQ ID NO: 200094 - protein, 10 aa, Tick-borne encephalitis virus
WKEAQILLDD

SEQ ID NO: 200095 - protein, 10 aa, Tick-borne encephalitis virus
KEAQILLDDI

SEQ ID NO: 200096 - protein, 10 aa, Tick-borne encephalitis virus
EGQILLDNIT

SEQ ID NO: 200097 - protein, 10 aa, Tick-borne encephalitis virus
GQILLDNITT

SEQ ID NO: 200098 - protein, 10 aa, Tick-borne encephalitis virus
QILLDNIITL

SEQ ID NO: 200099 - protein, 10 aa, Tick-borne encephalitis virus
ILLDDITTLR

SEQ ID NO: 200100 - protein, 10 aa, Tick-borne encephalitis virus
LLDDITTLRG

SEQ ID NO: 200101 - protein, 10 aa, Tick-borne encephalitis virus
LDDITTLRGP

SEQ ID NO: 200102 - protein, 10 aa, Tick-borne encephalitis virus
DDITTLRGPV

SEQ ID NO: 200103 - protein, 10 aa, Tick-borne encephalitis virus
DITTLRGPVA

SEQ ID NO: 200104 - protein, 10 aa, Tick-borne encephalitis virus
ITTLRGPVVT

SEQ ID NO: 200105 - protein, 10 aa, Tick-borne encephalitis virus
ITLRGPVATF

SEQ ID NO: 200106 - protein, 10 aa, Tick-borne encephalitis virus
TLRGPVVTFY

SEQ ID NO: 200107 - protein, 10 aa, Tick-borne encephalitis virus
LRGPVVTFYG

SEQ ID NO: 200108 - protein, 10 aa, Tick-borne encephalitis virus
RGPVVTFYGP

SEQ ID NO: 200109 - protein, 10 aa, Tick-borne encephalitis virus
GPVVTFYGPE

SEQ ID NO: 200110 - protein, 10 aa, Tick-borne encephalitis virus
PVVTFYGPEQ

SEQ ID NO: 200111 - protein, 10 aa, Tick-borne encephalitis virus
VVTFYGPEQD

SEQ ID NO: 200112 - protein, 10 aa, Tick-borne encephalitis virus
ATFYGPEQDR

SEQ ID NO: 200113 - protein, 10 aa, Tick-borne encephalitis virus
TFYGPEQDRM

SEQ ID NO: 200114 - protein, 10 aa, Tick-borne encephalitis virus
FYGPEQDRMP

SEQ ID NO: 200115 - protein, 10 aa, Tick-borne encephalitis virus
YGPEQDRMPE

SEQ ID NO: 200116 - protein, 10 aa, Tick-borne encephalitis virus
GPEQDRMPEV

SEQ ID NO: 200117 - protein, 10 aa, Tick-borne encephalitis virus
PEQDRMPEVA

SEQ ID NO: 200118 - protein, 10 aa, Tick-borne encephalitis virus
EQDRMPEVAG

SEQ ID NO: 200119 - protein, 10 aa, Tick-borne encephalitis virus
QDRMPEVAGH

SEQ ID NO: 200120 - protein, 10 aa, Tick-borne encephalitis virus
DKMPEVAGHY

SEQ ID NO: 200121 - protein, 10 aa, Tick-borne encephalitis virus
KMPEVAGHYR

SEQ ID NO: 200122 - protein, 10 aa, Tick-borne encephalitis virus
MPEVAGHYRL

SEQ ID NO: 200123 - protein, 10 aa, Tick-borne encephalitis virus
PEVAGHYRLT

SEQ ID NO: 200124 - protein, 10 aa, Tick-borne encephalitis virus
EVAGHYRLTE

SEQ ID NO: 200125 - protein, 10 aa, Tick-borne encephalitis virus
VAGHYRLTEE

SEQ ID NO: 200126 - protein, 10 aa, Tick-borne encephalitis virus
AGHYRLTEEK

SEQ ID NO: 200127 - protein, 10 aa, Tick-borne encephalitis virus
GHYRLTEEKR

SEQ ID NO: 200128 - protein, 10 aa, Tick-borne encephalitis virus
HYRLTEEKRK

SEQ ID NO: 200129 - protein, 10 aa, Tick-borne encephalitis virus
YRLTEEKRKH

SEQ ID NO: 200130 - protein, 10 aa, Tick-borne encephalitis virus
AWHVAANVSG

SEQ ID NO: 200131 - protein, 10 aa, Tick-borne encephalitis virus
WHVAANVSGV

SEQ ID NO: 200132 - protein, 10 aa, Tick-borne encephalitis virus
HVAANVSGVT

SEQ ID NO: 200133 - protein, 10 aa, Tick-borne encephalitis virus
VAANVSSVTD

SEQ ID NO: 200134 - protein, 10 aa, Tick-borne encephalitis virus
AANVSSVTDR

SEQ ID NO: 200135 - protein, 10 aa, Tick-borne encephalitis virus
ANVSSVTDRS

SEQ ID NO: 200136 - protein, 10 aa, Tick-borne encephalitis virus
NVSSVTDRSW

SEQ ID NO: 200137 - protein, 10 aa, Tick-borne encephalitis virus
VSSVTDRSWT

SEQ ID NO: 200138 - protein, 10 aa, Tick-borne encephalitis virus
SSVTDRSWTW

SEQ ID NO: 200139 - protein, 10 aa, Tick-borne encephalitis virus
SVTDRSWTWE

SEQ ID NO: 200140 - protein, 10 aa, Tick-borne encephalitis virus
VTDRSWTWEG

SEQ ID NO: 200141 - protein, 10 aa, Tick-borne encephalitis virus
TDRSWTWEGP

SEQ ID NO: 200142 - protein, 10 aa, Tick-borne encephalitis virus
DRSWTWEGPE

SEQ ID NO: 200143 - protein, 10 aa, Tick-borne encephalitis virus
RSWTWEGPEA

SEQ ID NO: 200144 - protein, 10 aa, Tick-borne encephalitis virus
SWTWEGPEAN

SEQ ID NO: 200145 - protein, 10 aa, Tick-borne encephalitis virus
WTWEGPEANA

SEQ ID NO: 200146 - protein, 10 aa, Tick-borne encephalitis virus
TWEGPEENAV

SEQ ID NO: 200147 - protein, 10 aa, Tick-borne encephalitis virus
WEGPEENAVD

SEQ ID NO: 200148 - protein, 10 aa, Tick-borne encephalitis virus
EGPEANAVDE

SEQ ID NO: 200149 - protein, 10 aa, Tick-borne encephalitis virus
GPEANAVDEA

SEQ ID NO: 200150 - protein, 10 aa, Tick-borne encephalitis virus
PEENAVDEAN

SEQ ID NO: 200151 - protein, 10 aa, Tick-borne encephalitis virus
EENAVDEANG

SEQ ID NO: 200152 - protein, 10 aa, Tick-borne encephalitis virus
ENAVDEANGD

SEQ ID NO: 200153 - protein, 10 aa, Tick-borne encephalitis virus
NAVDEANGDL

SEQ ID NO: 200154 - protein, 10 aa, Tick-borne encephalitis virus
AVDEANGDLV

SEQ ID NO: 200155 - protein, 10 aa, Tick-borne encephalitis virus
VDEASGDLVT

SEQ ID NO: 200156 - protein, 10 aa, Tick-borne encephalitis virus
DEASGDLVTF

SEQ ID NO: 200157 - protein, 10 aa, Tick-borne encephalitis virus
EASGDLVTFR

SEQ ID NO: 200158 - protein, 10 aa, Tick-borne encephalitis virus
ASGDLVTFRS

SEQ ID NO: 200159 - protein, 10 aa, Tick-borne encephalitis virus
SGDLVTFRSP

SEQ ID NO: 200160 - protein, 10 aa, Tick-borne encephalitis virus
GDLVTFKSPN

SEQ ID NO: 200161 - protein, 10 aa, Tick-borne encephalitis virus
DLVTFKSPNG

SEQ ID NO: 200162 - protein, 10 aa, Tick-borne encephalitis virus
LVTFKSPNGA

SEQ ID NO: 200163 - protein, 10 aa, Tick-borne encephalitis virus
VTFKSPNGAE

SEQ ID NO: 200164 - protein, 10 aa, Tick-borne encephalitis virus
TFKSPNGAER

SEQ ID NO: 200165 - protein, 10 aa, Tick-borne encephalitis virus
FKSPNGAERT

SEQ ID NO: 200166 - protein, 10 aa, Tick-borne encephalitis virus
KSPNGAERTL

SEQ ID NO: 200167 - protein, 10 aa, Tick-borne encephalitis virus
SPNGAERTLK

SEQ ID NO: 200168 - protein, 10 aa, Tick-borne encephalitis virus
PNGAERTLKP

SEQ ID NO: 200169 - protein, 10 aa, Tick-borne encephalitis virus
NGAERTLKPV

SEQ ID NO: 200170 - protein, 10 aa, Tick-borne encephalitis virus
GAERTLKPVW

SEQ ID NO: 200171 - protein, 10 aa, Tick-borne encephalitis virus
AERTLRPVWK

SEQ ID NO: 200172 - protein, 10 aa, Tick-borne encephalitis virus
ERTLRPVWKD

SEQ ID NO: 200173 - protein, 10 aa, Tick-borne encephalitis virus
RTLRPVWKDA

SEQ ID NO: 200174 - protein, 10 aa, Tick-borne encephalitis virus
TLRPVWKDAR

SEQ ID NO: 200175 - protein, 10 aa, Tick-borne encephalitis virus
LRPVWKDARM

SEQ ID NO: 200176 - protein, 10 aa, Tick-borne encephalitis virus
RPVWKDARMF

SEQ ID NO: 200177 - protein, 10 aa, Tick-borne encephalitis virus
PVWKDARMFK

SEQ ID NO: 200178 - protein, 10 aa, Tick-borne encephalitis virus
VWKDARMFKE

SEQ ID NO: 200179 - protein, 10 aa, Tick-borne encephalitis virus
WKDARMFKEG

SEQ ID NO: 200180 - protein, 10 aa, Tick-borne encephalitis virus
KDARMFKEGR

SEQ ID NO: 200181 - protein, 10 aa, Tick-borne encephalitis virus
DARMFKEGRD

SEQ ID NO: 200182 - protein, 10 aa, Tick-borne encephalitis virus
ARMFKEGRDI

SEQ ID NO: 200183 - protein, 10 aa, Tick-borne encephalitis virus
RMFKEGRDIK

SEQ ID NO: 200184 - protein, 10 aa, Tick-borne encephalitis virus
MFKEGRDIKE

SEQ ID NO: 200185 - protein, 10 aa, Tick-borne encephalitis virus
FKEGRDIKEF

SEQ ID NO: 200186 - protein, 10 aa, Tick-borne encephalitis virus
KEGRDIKEFV

SEQ ID NO: 200187 - protein, 10 aa, Tick-borne encephalitis virus
EGRDIKEFVA

SEQ ID NO: 200188 - protein, 10 aa, Tick-borne encephalitis virus
GRDIKEFVAY

SEQ ID NO: 200189 - protein, 10 aa, Tick-borne encephalitis virus
RDIKEFVAYA

SEQ ID NO: 200190 - protein, 10 aa, Tick-borne encephalitis virus
DIKEFVAYAS

SEQ ID NO: 200191 - protein, 10 aa, Tick-borne encephalitis virus
IKEFVAYASG

SEQ ID NO: 200192 - protein, 10 aa, Tick-borne encephalitis virus
KEFVAYASGR

SEQ ID NO: 200193 - protein, 10 aa, Tick-borne encephalitis virus
EFIAYASGRR

SEQ ID NO: 200194 - protein, 10 aa, Tick-borne encephalitis virus
FIAYASGRRS

SEQ ID NO: 200195 - protein, 10 aa, Tick-borne encephalitis virus
VAYASGRRSI

SEQ ID NO: 200196 - protein, 10 aa, Tick-borne encephalitis virus
AYASGRRSIG

SEQ ID NO: 200197 - protein, 10 aa, Tick-borne encephalitis virus
YASGRRSIGD

SEQ ID NO: 200198 - protein, 10 aa, Tick-borne encephalitis virus
ASGRRSIGDV

SEQ ID NO: 200199 - protein, 10 aa, Tick-borne encephalitis virus
SGRRSIGDVL

SEQ ID NO: 200200 - protein, 10 aa, Tick-borne encephalitis virus
GRRSFGDVLT

SEQ ID NO: 200201 - protein, 10 aa, Tick-borne encephalitis virus
RRSFGDVLTG

SEQ ID NO: 200202 - protein, 10 aa, Tick-borne encephalitis virus
RSFGDVLTGM

SEQ ID NO: 200203 - protein, 10 aa, Tick-borne encephalitis virus
SFGDVLTGMS

SEQ ID NO: 200204 - protein, 10 aa, Tick-borne encephalitis virus
FGDVLTGMSG

SEQ ID NO: 200205 - protein, 10 aa, Tick-borne encephalitis virus
GDVLTGMSGV

SEQ ID NO: 200206 - protein, 10 aa, Tick-borne encephalitis virus
DVLTGMSGVP

SEQ ID NO: 200207 - protein, 10 aa, Tick-borne encephalitis virus
VLTGMSGVPE

SEQ ID NO: 200208 - protein, 10 aa, Tick-borne encephalitis virus
LTGMSGVPEL

SEQ ID NO: 200209 - protein, 10 aa, Tick-borne encephalitis virus
TGMSGVPELL

SEQ ID NO: 200210 - protein, 10 aa, Tick-borne encephalitis virus
LLRHRCVSAL

SEQ ID NO: 200211 - protein, 10 aa, Tick-borne encephalitis virus
LRHRCVSALD

SEQ ID NO: 200212 - protein, 10 aa, Tick-borne encephalitis virus
RHRCVSALDV

SEQ ID NO: 200213 - protein, 10 aa, Tick-borne encephalitis virus
HRCVSALDVF

SEQ ID NO: 200214 - protein, 10 aa, Tick-borne encephalitis virus
RCVSALDVFY

SEQ ID NO: 200215 - protein, 10 aa, Tick-borne encephalitis virus
CVSALDVFYT

SEQ ID NO: 200216 - protein, 10 aa, Tick-borne encephalitis virus
VSALDVFYTL

SEQ ID NO: 200217 - protein, 10 aa, Tick-borne encephalitis virus
SALDVFYTLM

SEQ ID NO: 200218 - protein, 10 aa, Tick-borne encephalitis virus
ALDVFYTLMH

SEQ ID NO: 200219 - protein, 10 aa, Tick-borne encephalitis virus
LDVFYTLMHE

SEQ ID NO: 200220 - protein, 10 aa, Tick-borne encephalitis virus
DVFYTLMHDE

SEQ ID NO: 200221 - protein, 10 aa, Tick-borne encephalitis virus
VFYTLMHDEP

SEQ ID NO: 200222 - protein, 10 aa, Tick-borne encephalitis virus
FYTLMHDEPG

SEQ ID NO: 200223 - protein, 10 aa, Tick-borne encephalitis virus
YTLMHDEPGS

SEQ ID NO: 200224 - protein, 10 aa, Tick-borne encephalitis virus
TLMHDEPGSR

SEQ ID NO: 200225 - protein, 10 aa, Tick-borne encephalitis virus
LMHEKPDSRA

SEQ ID NO: 200226 - protein, 10 aa, Tick-borne encephalitis virus
MHDEPGSRAM

SEQ ID NO: 200227 - protein, 10 aa, Tick-borne encephalitis virus
HEEPGSRAMK

SEQ ID NO: 200228 - protein, 10 aa, Tick-borne encephalitis virus
EEPGSRAMKM

SEQ ID NO: 200229 - protein, 10 aa, Tick-borne encephalitis virus
EPGSRAMKMA

SEQ ID NO: 200230 - protein, 10 aa, Tick-borne encephalitis virus
PGSRAMKMAE

SEQ ID NO: 200231 - protein, 10 aa, Tick-borne encephalitis virus
GSRAMKMAER

SEQ ID NO: 200232 - protein, 10 aa, Tick-borne encephalitis virus
SRAMKMAERD

SEQ ID NO: 200233 - protein, 10 aa, Tick-borne encephalitis virus
RAMKMAERDA

SEQ ID NO: 200234 - protein, 10 aa, Tick-borne encephalitis virus
AMKMAERDAP

SEQ ID NO: 200235 - protein, 10 aa, Tick-borne encephalitis virus
MKMAERDAPE

SEQ ID NO: 200236 - protein, 10 aa, Tick-borne encephalitis virus
KMAERDAPEA

SEQ ID NO: 200237 - protein, 10 aa, Tick-borne encephalitis virus
RDAPEAFLTM

SEQ ID NO: 200238 - protein, 10 aa, Tick-borne encephalitis virus
DAPEAFLTMV

SEQ ID NO: 200239 - protein, 10 aa, Tick-borne encephalitis virus
APEAFLTMVE

SEQ ID NO: 200240 - protein, 10 aa, Tick-borne encephalitis virus
AEMMVLGLAT

SEQ ID NO: 200241 - protein, 10 aa, Tick-borne encephalitis virus
EVMVLGLATL

SEQ ID NO: 200242 - protein, 10 aa, Tick-borne encephalitis virus
VMVLGLATLG

SEQ ID NO: 200243 - protein, 10 aa, Tick-borne encephalitis virus
LVLGLATLGV

SEQ ID NO: 200244 - protein, 10 aa, Tick-borne encephalitis virus
VLGLATLGVI

SEQ ID NO: 200245 - protein, 10 aa, Tick-borne encephalitis virus
LGLATLGVIW

SEQ ID NO: 200246 - protein, 10 aa, Tick-borne encephalitis virus
GLATLGVIWC

SEQ ID NO: 200247 - protein, 10 aa, Tick-borne encephalitis virus
LATLGVIWCF

SEQ ID NO: 200248 - protein, 10 aa, Tick-borne encephalitis virus
ATLGVIWCFV

SEQ ID NO: 200249 - protein, 10 aa, Tick-borne encephalitis virus
TLGVIWCFVV

SEQ ID NO: 200250 - protein, 10 aa, Tick-borne encephalitis virus
LGVIWCFVVR

SEQ ID NO: 200251 - protein, 10 aa, Tick-borne encephalitis virus
GVIWCFVVRT

SEQ ID NO: 200252 - protein, 10 aa, Tick-borne encephalitis virus
VIWCFVVRTS

SEQ ID NO: 200253 - protein, 10 aa, Tick-borne encephalitis virus
IWCFVVRTSI

SEQ ID NO: 200254 - protein, 10 aa, Tick-borne encephalitis virus
WCFVVRASIS

SEQ ID NO: 200255 - protein, 10 aa, Tick-borne encephalitis virus
CFVVRASISR

SEQ ID NO: 200256 - protein, 10 aa, Tick-borne encephalitis virus
FVARTSISRM

SEQ ID NO: 200257 - protein, 10 aa, Tick-borne encephalitis virus
VVRASISRMM

SEQ ID NO: 200258 - protein, 10 aa, Tick-borne encephalitis virus
VRASISRMML

SEQ ID NO: 200259 - protein, 10 aa, Tick-borne encephalitis virus
RASISRMMLG

SEQ ID NO: 200260 - protein, 10 aa, Tick-borne encephalitis virus
ASISRMMLGT

SEQ ID NO: 200261 - protein, 10 aa, Tick-borne encephalitis virus
GTLVLLASLL

SEQ ID NO: 200262 - protein, 10 aa, Tick-borne encephalitis virus
TLVLLASLLL

SEQ ID NO: 200263 - protein, 10 aa, Tick-borne encephalitis virus
LVLLASLLLL

SEQ ID NO: 200264 - protein, 10 aa, Tick-borne encephalitis virus
VLLASLLLLW

SEQ ID NO: 200265 - protein, 10 aa, Tick-borne encephalitis virus
LLASLLLLWA

SEQ ID NO: 200266 - protein, 10 aa, Tick-borne encephalitis virus
LASLLLLWAG

SEQ ID NO: 200267 - protein, 10 aa, Tick-borne encephalitis virus
ASLLLLWAGG

SEQ ID NO: 200268 - protein, 10 aa, Tick-borne encephalitis virus
SLLLLWAGGV

SEQ ID NO: 200269 - protein, 10 aa, Tick-borne encephalitis virus
LLLLWAGGVG

SEQ ID NO: 200270 - protein, 10 aa, Tick-borne encephalitis virus
LLLWAGGVGY

SEQ ID NO: 200271 - protein, 10 aa, Tick-borne encephalitis virus
LLWAGGVGYG

SEQ ID NO: 200272 - protein, 10 aa, Tick-borne encephalitis virus
LWAGGVGYGN

SEQ ID NO: 200273 - protein, 10 aa, Tick-borne encephalitis virus
WAGGVGYGNM

SEQ ID NO: 200274 - protein, 10 aa, Tick-borne encephalitis virus
AGGVGYGNMA

SEQ ID NO: 200275 - protein, 10 aa, Tick-borne encephalitis virus
GGVGYGNMAG

SEQ ID NO: 200276 - protein, 10 aa, Tick-borne encephalitis virus
GVGYGNMAGV

SEQ ID NO: 200277 - protein, 10 aa, Tick-borne encephalitis virus
VGYGNMAGVA

SEQ ID NO: 200278 - protein, 10 aa, Tick-borne encephalitis virus
GYGNMAGVAL

SEQ ID NO: 200279 - protein, 10 aa, Tick-borne encephalitis virus
TLLTVLQPEV

SEQ ID NO: 200280 - protein, 10 aa, Tick-borne encephalitis virus
LLTVLQPEVG

SEQ ID NO: 200281 - protein, 10 aa, Tick-borne encephalitis virus
LTVLQPEVGK

SEQ ID NO: 200282 - protein, 10 aa, Tick-borne encephalitis virus
TVLQPEVGKQ

SEQ ID NO: 200283 - protein, 10 aa, Tick-borne encephalitis virus
VLQPEVGKQR

SEQ ID NO: 200284 - protein, 10 aa, Tick-borne encephalitis virus
LQPEVGKQRS

SEQ ID NO: 200285 - protein, 10 aa, Tick-borne encephalitis virus
QPEVGKQRSS

SEQ ID NO: 200286 - protein, 10 aa, Tick-borne encephalitis virus
PEVGKQRSSD

SEQ ID NO: 200287 - protein, 10 aa, Tick-borne encephalitis virus
EVGKQRSSDD

SEQ ID NO: 200288 - protein, 10 aa, Tick-borne encephalitis virus
VGKQRSSDDN

SEQ ID NO: 200289 - protein, 10 aa, Tick-borne encephalitis virus
AYFLLTLCSV

SEQ ID NO: 200290 - protein, 10 aa, Tick-borne encephalitis virus
YFLLTLCSVA

SEQ ID NO: 200291 - protein, 10 aa, Tick-borne encephalitis virus
FLLTLCSVAG

SEQ ID NO: 200292 - protein, 10 aa, Tick-borne encephalitis virus
LLTLCSVAGL

SEQ ID NO: 200293 - protein, 10 aa, Tick-borne encephalitis virus
LTLCSVAGLV

SEQ ID NO: 200294 - protein, 10 aa, Tick-borne encephalitis virus
TLCSVAGLVA

SEQ ID NO: 200295 - protein, 10 aa, Tick-borne encephalitis virus
LCSVAGLVAA

SEQ ID NO: 200296 - protein, 10 aa, Tick-borne encephalitis virus
CSVAGLVAAN

SEQ ID NO: 200297 - protein, 10 aa, Tick-borne encephalitis virus
SVAGLVAANE

SEQ ID NO: 200298 - protein, 10 aa, Tick-borne encephalitis virus
VAGLVAANEM

SEQ ID NO: 200299 - protein, 10 aa, Tick-borne encephalitis virus
GLVAANEMGL

SEQ ID NO: 200300 - protein, 10 aa, Tick-borne encephalitis virus
LVAANEMGLL

SEQ ID NO: 200301 - protein, 10 aa, Tick-borne encephalitis virus
VAANEMGLLE

SEQ ID NO: 200302 - protein, 10 aa, Tick-borne encephalitis virus
AANEMGFLER

SEQ ID NO: 200303 - protein, 10 aa, Tick-borne encephalitis virus
ANEMGFLERT

SEQ ID NO: 200304 - protein, 10 aa, Tick-borne encephalitis virus
NEMGFLERTK

SEQ ID NO: 200305 - protein, 10 aa, Tick-borne encephalitis virus
EMGFLERTKA

SEQ ID NO: 200306 - protein, 10 aa, Tick-borne encephalitis virus
MGFLERTKAD

SEQ ID NO: 200307 - protein, 10 aa, Tick-borne encephalitis virus
GFLERTKADL

SEQ ID NO: 200308 - protein, 10 aa, Tick-borne encephalitis virus
FLERTKADLS

SEQ ID NO: 200309 - protein, 10 aa, Tick-borne encephalitis virus
LERTKADLST

SEQ ID NO: 200310 - protein, 10 aa, Tick-borne encephalitis virus
ERTKADLSTV

SEQ ID NO: 200311 - protein, 10 aa, Tick-borne encephalitis virus
RTKADLSTVL

SEQ ID NO: 200312 - protein, 10 aa, Tick-borne encephalitis virus
TKADLSTALW

SEQ ID NO: 200313 - protein, 10 aa, Tick-borne encephalitis virus
KADLSTALWS

SEQ ID NO: 200314 - protein, 10 aa, Tick-borne encephalitis virus
EPRPWSEWTN

SEQ ID NO: 200315 - protein, 10 aa, Tick-borne encephalitis virus
PRPWSEWTNV

SEQ ID NO: 200316 - protein, 10 aa, Tick-borne encephalitis virus
RPWSEWTNVD

SEQ ID NO: 200317 - protein, 10 aa, Tick-borne encephalitis virus
PWSEWTNVDI

SEQ ID NO: 200318 - protein, 10 aa, Tick-borne encephalitis virus
WSEWTNVDIQ

SEQ ID NO: 200319 - protein, 10 aa, Tick-borne encephalitis virus
SEWTNVDIQP

SEQ ID NO: 200320 - protein, 10 aa, Tick-borne encephalitis virus
EWTNVDIQPA

SEQ ID NO: 200321 - protein, 10 aa, Tick-borne encephalitis virus
WTNVDIQPAR

SEQ ID NO: 200322 - protein, 10 aa, Tick-borne encephalitis virus
TNVDIQPARS

SEQ ID NO: 200323 - protein, 10 aa, Tick-borne encephalitis virus
NVDIQPARSW

SEQ ID NO: 200324 - protein, 10 aa, Tick-borne encephalitis virus
VDIQPARSWG

SEQ ID NO: 200325 - protein, 10 aa, Tick-borne encephalitis virus
LVVSLFTPYM

SEQ ID NO: 200326 - protein, 10 aa, Tick-borne encephalitis virus
VVSLFTPYMI

SEQ ID NO: 200327 - protein, 10 aa, Tick-borne encephalitis virus
VSLFTPYMIH

SEQ ID NO: 200328 - protein, 10 aa, Tick-borne encephalitis virus
SLFTPYMIHQ

SEQ ID NO: 200329 - protein, 10 aa, Tick-borne encephalitis virus
LFTPYMIHQL

SEQ ID NO: 200330 - protein, 10 aa, Tick-borne encephalitis virus
FTPYMIHQLQ

SEQ ID NO: 200331 - protein, 10 aa, Tick-borne encephalitis virus
TPYMIHQLQT

SEQ ID NO: 200332 - protein, 10 aa, Tick-borne encephalitis virus
PYMIHQLQTK

SEQ ID NO: 200333 - protein, 10 aa, Tick-borne encephalitis virus
YMIHQLQTKI

SEQ ID NO: 200334 - protein, 10 aa, Tick-borne encephalitis virus
MIHQLQTKIQ

SEQ ID NO: 200335 - protein, 10 aa, Tick-borne encephalitis virus
IQQLVNSAVV

SEQ ID NO: 200336 - protein, 10 aa, Tick-borne encephalitis virus
QQLVNSAVAS

SEQ ID NO: 200337 - protein, 10 aa, Tick-borne encephalitis virus
QLVNSAVASG

SEQ ID NO: 200338 - protein, 10 aa, Tick-borne encephalitis virus
LVNSAVASGA

SEQ ID NO: 200339 - protein, 10 aa, Tick-borne encephalitis virus
VNSAVASGAQ

SEQ ID NO: 200340 - protein, 10 aa, Tick-borne encephalitis virus
NSAVASGAQA

SEQ ID NO: 200341 - protein, 10 aa, Tick-borne encephalitis virus
SAVASGAQAM

SEQ ID NO: 200342 - protein, 10 aa, Tick-borne encephalitis virus
AVASGAQAMR

SEQ ID NO: 200343 - protein, 10 aa, Tick-borne encephalitis virus
VASGAQAMRD

SEQ ID NO: 200344 - protein, 10 aa, Tick-borne encephalitis virus
ASGAQAMRDL

SEQ ID NO: 200345 - protein, 10 aa, Tick-borne encephalitis virus
SGAQAMRDLG

SEQ ID NO: 200346 - protein, 10 aa, Tick-borne encephalitis virus
QAMRDLGGGT

SEQ ID NO: 200347 - protein, 10 aa, Tick-borne encephalitis virus
AMRDLGGGTP

SEQ ID NO: 200348 - protein, 10 aa, Tick-borne encephalitis virus
MRDLGGGTPF

SEQ ID NO: 200349 - protein, 10 aa, Tick-borne encephalitis virus
RDLGGGTPFF

SEQ ID NO: 200350 - protein, 10 aa, Tick-borne encephalitis virus
DLGGGTPFFG

SEQ ID NO: 200351 - protein, 10 aa, Tick-borne encephalitis virus
LGGGTPFFGV

SEQ ID NO: 200352 - protein, 10 aa, Tick-borne encephalitis virus
GGGTPFFGVA

SEQ ID NO: 200353 - protein, 10 aa, Tick-borne encephalitis virus
GGTPFFGVAG

SEQ ID NO: 200354 - protein, 10 aa, Tick-borne encephalitis virus
GTPFFGVAGH

SEQ ID NO: 200355 - protein, 10 aa, Tick-borne encephalitis virus
TPFFGVAGHV

SEQ ID NO: 200356 - protein, 10 aa, Tick-borne encephalitis virus
PFFGVAGHVV

SEQ ID NO: 200357 - protein, 10 aa, Tick-borne encephalitis virus
GVAGHVMTLG

SEQ ID NO: 200358 - protein, 10 aa, Tick-borne encephalitis virus
VAGHVMTLGV

SEQ ID NO: 200359 - protein, 10 aa, Tick-borne encephalitis virus
AGHVMTLGVV

SEQ ID NO: 200360 - protein, 10 aa, Tick-borne encephalitis virus
GHVMTLGVVS

SEQ ID NO: 200361 - protein, 10 aa, Tick-borne encephalitis virus
HVMTLGVVSL

SEQ ID NO: 200362 - protein, 10 aa, Tick-borne encephalitis virus
VMTLGVVSLI

SEQ ID NO: 200363 - protein, 10 aa, Tick-borne encephalitis virus
MTLGVVSLIG

SEQ ID NO: 200364 - protein, 10 aa, Tick-borne encephalitis virus
TLGVVSLIGA

SEQ ID NO: 200365 - protein, 10 aa, Tick-borne encephalitis virus
LGVVSLIGAT

SEQ ID NO: 200366 - protein, 10 aa, Tick-borne encephalitis virus
GVVSLIGATP

SEQ ID NO: 200367 - protein, 10 aa, Tick-borne encephalitis virus
VVSLIGATPT

SEQ ID NO: 200368 - protein, 10 aa, Tick-borne encephalitis virus
VSLIGATPTS

SEQ ID NO: 200369 - protein, 10 aa, Tick-borne encephalitis virus
SLIGATPTSL

SEQ ID NO: 200370 - protein, 10 aa, Tick-borne encephalitis virus
LIGATPTSLM

SEQ ID NO: 200371 - protein, 10 aa, Tick-borne encephalitis virus
IGATPTSLMV

SEQ ID NO: 200372 - protein, 10 aa, Tick-borne encephalitis virus
GATPTSLMVG

SEQ ID NO: 200373 - protein, 10 aa, Tick-borne encephalitis virus
ATPTSLMVGV

SEQ ID NO: 200374 - protein, 10 aa, Tick-borne encephalitis virus
TPTSLMVGVG

SEQ ID NO: 200375 - protein, 10 aa, Tick-borne encephalitis virus
PTSLMVGVGL

SEQ ID NO: 200376 - protein, 10 aa, Tick-borne encephalitis virus
TSLMVGVGLA

SEQ ID NO: 200377 - protein, 10 aa, Tick-borne encephalitis virus
SLMVGVGLAA

SEQ ID NO: 200378 - protein, 10 aa, Tick-borne encephalitis virus
LMVGVGLAAL

SEQ ID NO: 200379 - protein, 10 aa, Tick-borne encephalitis virus
MVGVGLAALH

SEQ ID NO: 200380 - protein, 10 aa, Tick-borne encephalitis virus
VGVGLAALHL

SEQ ID NO: 200381 - protein, 10 aa, Tick-borne encephalitis virus
GVGLAALHLA

SEQ ID NO: 200382 - protein, 10 aa, Tick-borne encephalitis virus
VGLAALHLAI

SEQ ID NO: 200383 - protein, 10 aa, Tick-borne encephalitis virus
GLAALHLAIV

SEQ ID NO: 200384 - protein, 10 aa, Tick-borne encephalitis virus
LAALHLAIVV

SEQ ID NO: 200385 - protein, 10 aa, Tick-borne encephalitis virus
AALHLAIVVS

SEQ ID NO: 200386 - protein, 10 aa, Tick-borne encephalitis virus
ALHLAIVVSG

SEQ ID NO: 200387 - protein, 10 aa, Tick-borne encephalitis virus
LHLAIVVSGL

SEQ ID NO: 200388 - protein, 10 aa, Tick-borne encephalitis virus
FSAMVRNPML

SEQ ID NO: 200389 - protein, 10 aa, Tick-borne encephalitis virus
SAMVRNPMLD

SEQ ID NO: 200390 - protein, 10 aa, Tick-borne encephalitis virus
AMVRNPMLDG

SEQ ID NO: 200391 - protein, 10 aa, Tick-borne encephalitis virus
MVRNPMLDGD

SEQ ID NO: 200392 - protein, 10 aa, Tick-borne encephalitis virus
VRNPMLDGDV

SEQ ID NO: 200393 - protein, 10 aa, Tick-borne encephalitis virus
RNPMLDGDVI

SEQ ID NO: 200394 - protein, 10 aa, Tick-borne encephalitis virus
NPMLDGDVIY

SEQ ID NO: 200395 - protein, 10 aa, Tick-borne encephalitis virus
PMLDGDVIYP

SEQ ID NO: 200396 - protein, 10 aa, Tick-borne encephalitis virus
MLDGDVIYPF

SEQ ID NO: 200397 - protein, 10 aa, Tick-borne encephalitis virus
LDGDVIYPFG

SEQ ID NO: 200398 - protein, 10 aa, Tick-borne encephalitis virus
DGDVIYPFGE

SEQ ID NO: 200399 - protein, 10 aa, Tick-borne encephalitis virus
GDVIYPFGEG

SEQ ID NO: 200400 - protein, 10 aa, Tick-borne encephalitis virus
DVIYPFGEGE

SEQ ID NO: 200401 - protein, 10 aa, Tick-borne encephalitis virus
VINPFGEGET

SEQ ID NO: 200402 - protein, 10 aa, Tick-borne encephalitis virus
INPFGEGETK

SEQ ID NO: 200403 - protein, 10 aa, Tick-borne encephalitis virus
NPFGEGETKP

SEQ ID NO: 200404 - protein, 10 aa, Tick-borne encephalitis virus
PFGEGETKPA

SEQ ID NO: 200405 - protein, 10 aa, Tick-borne encephalitis virus
FGEGETKPAL

SEQ ID NO: 200406 - protein, 10 aa, Tick-borne encephalitis virus
GEGETKPALY

SEQ ID NO: 200407 - protein, 10 aa, Tick-borne encephalitis virus
EGETKPALYE

SEQ ID NO: 200408 - protein, 10 aa, Tick-borne encephalitis virus
GETKPALYER

SEQ ID NO: 200409 - protein, 10 aa, Tick-borne encephalitis virus
ETKPALYERK

SEQ ID NO: 200410 - protein, 10 aa, Tick-borne encephalitis virus
TKPALYERKM

SEQ ID NO: 200411 - protein, 10 aa, Tick-borne encephalitis virus
KPALYERRMS

SEQ ID NO: 200412 - protein, 10 aa, Tick-borne encephalitis virus
PALYERRMSL

SEQ ID NO: 200413 - protein, 10 aa, Tick-borne encephalitis virus
ALYERRMSLV

SEQ ID NO: 200414 - protein, 10 aa, Tick-borne encephalitis virus
LYERRMSLVL

SEQ ID NO: 200415 - protein, 10 aa, Tick-borne encephalitis virus
YERRMSLVLA

SEQ ID NO: 200416 - protein, 10 aa, Tick-borne encephalitis virus
ERKMSLVLAV

SEQ ID NO: 200417 - protein, 10 aa, Tick-borne encephalitis virus
MSLVLAIALC

SEQ ID NO: 200418 - protein, 10 aa, Tick-borne encephalitis virus
SLVLAIALCL

SEQ ID NO: 200419 - protein, 10 aa, Tick-borne encephalitis virus
ALCLMSVVMN

SEQ ID NO: 200420 - protein, 10 aa, Tick-borne encephalitis virus
LCLMAVVMNR

SEQ ID NO: 200421 - protein, 10 aa, Tick-borne encephalitis virus
CLMAVVMNRT

SEQ ID NO: 200422 - protein, 10 aa, Tick-borne encephalitis virus
LMAVVMNRTV

SEQ ID NO: 200423 - protein, 10 aa, Tick-borne encephalitis virus
SVVMNRTVAS

SEQ ID NO: 200424 - protein, 10 aa, Tick-borne encephalitis virus
VVMNRTVASI

SEQ ID NO: 200425 - protein, 10 aa, Tick-borne encephalitis virus
VMNRTVASIT

SEQ ID NO: 200426 - protein, 10 aa, Tick-borne encephalitis virus
MNRTVASITE

SEQ ID NO: 200427 - protein, 10 aa, Tick-borne encephalitis virus
NRTVASITEA

SEQ ID NO: 200428 - protein, 10 aa, Tick-borne encephalitis virus
RTVASITEAS

SEQ ID NO: 200429 - protein, 10 aa, Tick-borne encephalitis virus
TVASITEASA

SEQ ID NO: 200430 - protein, 10 aa, Tick-borne encephalitis virus
VASITEASAV

SEQ ID NO: 200431 - protein, 10 aa, Tick-borne encephalitis virus
ASITEASAVG

SEQ ID NO: 200432 - protein, 10 aa, Tick-borne encephalitis virus
SITEAAAVGL

SEQ ID NO: 200433 - protein, 10 aa, Tick-borne encephalitis virus
ITEAAAVGLA

SEQ ID NO: 200434 - protein, 10 aa, Tick-borne encephalitis virus
TEAAAVGLAA

SEQ ID NO: 200435 - protein, 10 aa, Tick-borne encephalitis virus
EASAVGLAAV

SEQ ID NO: 200436 - protein, 10 aa, Tick-borne encephalitis virus
ASAVGLAAVG

SEQ ID NO: 200437 - protein, 10 aa, Tick-borne encephalitis virus
SAVGLAAVGQ

SEQ ID NO: 200438 - protein, 10 aa, Tick-borne encephalitis virus
AVGLAAVGQL

SEQ ID NO: 200439 - protein, 10 aa, Tick-borne encephalitis virus
VGLAAVGQLL

SEQ ID NO: 200440 - protein, 10 aa, Tick-borne encephalitis virus
GLAAVGQLLR

SEQ ID NO: 200441 - protein, 10 aa, Tick-borne encephalitis virus
LAAVGQLLRP

SEQ ID NO: 200442 - protein, 10 aa, Tick-borne encephalitis virus
AAVGQLLRPE

SEQ ID NO: 200443 - protein, 10 aa, Tick-borne encephalitis virus
GQLLRPEVDT

SEQ ID NO: 200444 - protein, 10 aa, Tick-borne encephalitis virus
QLLRPEVDTL

SEQ ID NO: 200445 - protein, 10 aa, Tick-borne encephalitis virus
LLRPEVDTLW

SEQ ID NO: 200446 - protein, 10 aa, Tick-borne encephalitis virus
LRPEVDTLWT

SEQ ID NO: 200447 - protein, 10 aa, Tick-borne encephalitis virus
RPEVDTLWTM

SEQ ID NO: 200448 - protein, 10 aa, Tick-borne encephalitis virus
PEVDTLWTMP

SEQ ID NO: 200449 - protein, 10 aa, Tick-borne encephalitis virus
EVDTLWTMPV

SEQ ID NO: 200450 - protein, 10 aa, Tick-borne encephalitis virus
VDTLWTMPVA

SEQ ID NO: 200451 - protein, 10 aa, Tick-borne encephalitis virus
LWTMPVACGM

SEQ ID NO: 200452 - protein, 10 aa, Tick-borne encephalitis virus
WTMPVACGMS

SEQ ID NO: 200453 - protein, 10 aa, Tick-borne encephalitis virus
TMPVACGMSG

SEQ ID NO: 200454 - protein, 10 aa, Tick-borne encephalitis virus
MPVACGMSGV

SEQ ID NO: 200455 - protein, 10 aa, Tick-borne encephalitis virus
PVACGMSGVV

SEQ ID NO: 200456 - protein, 10 aa, Tick-borne encephalitis virus
VACGMSGVVR

SEQ ID NO: 200457 - protein, 10 aa, Tick-borne encephalitis virus
ACGMSGVVRG

SEQ ID NO: 200458 - protein, 10 aa, Tick-borne encephalitis virus
CGMSGVVRGS

SEQ ID NO: 200459 - protein, 10 aa, Tick-borne encephalitis virus
GMSGVVRGSL

SEQ ID NO: 200460 - protein, 10 aa, Tick-borne encephalitis virus
MSGVVRGSLW

SEQ ID NO: 200461 - protein, 10 aa, Tick-borne encephalitis virus
SSVVRGSLWG

SEQ ID NO: 200462 - protein, 10 aa, Tick-borne encephalitis virus
SVVRGSLWGF

SEQ ID NO: 200463 - protein, 10 aa, Tick-borne encephalitis virus
VVTGSLWGFL

SEQ ID NO: 200464 - protein, 10 aa, Tick-borne encephalitis virus
VTGSLWGFLP

SEQ ID NO: 200465 - protein, 10 aa, Tick-borne encephalitis virus
TGSLWGFLPL

SEQ ID NO: 200466 - protein, 10 aa, Tick-borne encephalitis virus
HRLWLRASGG

SEQ ID NO: 200467 - protein, 10 aa, Tick-borne encephalitis virus
RLWLRASGGR

SEQ ID NO: 200468 - protein, 10 aa, Tick-borne encephalitis virus
LWLRASGGRR

SEQ ID NO: 200469 - protein, 10 aa, Tick-borne encephalitis virus
WLRASGGRRG

SEQ ID NO: 200470 - protein, 10 aa, Tick-borne encephalitis virus
LRASGGRRGG

SEQ ID NO: 200471 - protein, 10 aa, Tick-borne encephalitis virus
RASGGRRGGS

SEQ ID NO: 200472 - protein, 10 aa, Tick-borne encephalitis virus
ASGGRRGGSE

SEQ ID NO: 200473 - protein, 10 aa, Tick-borne encephalitis virus
SGGRRGGSEG

SEQ ID NO: 200474 - protein, 10 aa, Tick-borne encephalitis virus
GGRRGGSEGD

SEQ ID NO: 200475 - protein, 10 aa, Tick-borne encephalitis virus
GRRGGSEGDT

SEQ ID NO: 200476 - protein, 10 aa, Tick-borne encephalitis virus
RRGGAEGDTL

SEQ ID NO: 200477 - protein, 10 aa, Tick-borne encephalitis virus
RGGAEGDTLG

SEQ ID NO: 200478 - protein, 10 aa, Tick-borne encephalitis virus
GGAEGDTLGD

SEQ ID NO: 200479 - protein, 10 aa, Tick-borne encephalitis virus
GAEGDTLGDL

SEQ ID NO: 200480 - protein, 10 aa, Tick-borne encephalitis virus
AEGDTLGDLW

SEQ ID NO: 200481 - protein, 10 aa, Tick-borne encephalitis virus
DGDTLGDLWK

SEQ ID NO: 200482 - protein, 10 aa, Tick-borne encephalitis virus
GDTLGDLWKQ

SEQ ID NO: 200483 - protein, 10 aa, Tick-borne encephalitis virus
DTLGDLWKRR

SEQ ID NO: 200484 - protein, 10 aa, Tick-borne encephalitis virus
TLGDLWKRRL

SEQ ID NO: 200485 - protein, 10 aa, Tick-borne encephalitis virus
LGDLWKRRLN

SEQ ID NO: 200486 - protein, 10 aa, Tick-borne encephalitis virus
LNNCTREEFF

SEQ ID NO: 200487 - protein, 10 aa, Tick-borne encephalitis virus
NNCTREEFFV

SEQ ID NO: 200488 - protein, 10 aa, Tick-borne encephalitis virus
NCTREEFFVY

SEQ ID NO: 200489 - protein, 10 aa, Tick-borne encephalitis virus
CTREEFFVYR

SEQ ID NO: 200490 - protein, 10 aa, Tick-borne encephalitis virus
TREEFFVYRR

SEQ ID NO: 200491 - protein, 10 aa, Tick-borne encephalitis virus
EEFFVYRRTG

SEQ ID NO: 200492 - protein, 10 aa, Tick-borne encephalitis virus
EFFVYRRTGI

SEQ ID NO: 200493 - protein, 10 aa, Tick-borne encephalitis virus
FFVYRRTGIL

SEQ ID NO: 200494 - protein, 10 aa, Tick-borne encephalitis virus
FVYRRTGILE

SEQ ID NO: 200495 - protein, 10 aa, Tick-borne encephalitis virus
VYRRTGILET

SEQ ID NO: 200496 - protein, 10 aa, Tick-borne encephalitis virus
YRRTGIMETE

SEQ ID NO: 200497 - protein, 10 aa, Tick-borne encephalitis virus
RRAGILETER

SEQ ID NO: 200498 - protein, 10 aa, Tick-borne encephalitis virus
RAGILETERD

SEQ ID NO: 200499 - protein, 10 aa, Tick-borne encephalitis virus
AGILETERDK

SEQ ID NO: 200500 - protein, 10 aa, Tick-borne encephalitis virus
GILETERDRA

SEQ ID NO: 200501 - protein, 10 aa, Tick-borne encephalitis virus
IMETERDKAR

SEQ ID NO: 200502 - protein, 10 aa, Tick-borne encephalitis virus
METERDKARE

SEQ ID NO: 200503 - protein, 10 aa, Tick-borne encephalitis virus
ETERDRAREL

SEQ ID NO: 200504 - protein, 10 aa, Tick-borne encephalitis virus
TERDRARELL

SEQ ID NO: 200505 - protein, 10 aa, Tick-borne encephalitis virus
ERDKARELLK

SEQ ID NO: 200506 - protein, 10 aa, Tick-borne encephalitis virus
RDKARELLRK

SEQ ID NO: 200507 - protein, 10 aa, Tick-borne encephalitis virus
DKARELLRKG

SEQ ID NO: 200508 - protein, 10 aa, Tick-borne encephalitis virus
KARELLRKGE

SEQ ID NO: 200509 - protein, 10 aa, Tick-borne encephalitis virus
ARELLRKGET

SEQ ID NO: 200510 - protein, 10 aa, Tick-borne encephalitis virus
RELLRKGETN

SEQ ID NO: 200511 - protein, 10 aa, Tick-borne encephalitis virus
KGETNTGLAV

SEQ ID NO: 200512 - protein, 10 aa, Tick-borne encephalitis virus
GETNTGLAVS

SEQ ID NO: 200513 - protein, 10 aa, Tick-borne encephalitis virus
ETNTGLAVSR

SEQ ID NO: 200514 - protein, 10 aa, Tick-borne encephalitis virus
TNTGLAVSRG

SEQ ID NO: 200515 - protein, 10 aa, Tick-borne encephalitis virus
NTGLAVSRGT

SEQ ID NO: 200516 - protein, 10 aa, Tick-borne encephalitis virus
TGLAVSRGTA

SEQ ID NO: 200517 - protein, 10 aa, Tick-borne encephalitis virus
WSYYAASRPS

SEQ ID NO: 200518 - protein, 10 aa, Tick-borne encephalitis virus
SYYAASRPSV

SEQ ID NO: 200519 - protein, 10 aa, Tick-borne encephalitis virus
YYAASRPSVM

SEQ ID NO: 200520 - protein, 10 aa, Tick-borne encephalitis virus
YAASRPAVMN

SEQ ID NO: 200521 - protein, 10 aa, Tick-borne encephalitis virus
AASRPAVMNV

SEQ ID NO: 200522 - protein, 10 aa, Tick-borne encephalitis virus
ASRPAVMSVR

SEQ ID NO: 200523 - protein, 10 aa, Tick-borne encephalitis virus
SRPAVMSVRA

SEQ ID NO: 200524 - protein, 10 aa, Tick-borne encephalitis virus
RPAVMSVRAY

SEQ ID NO: 200525 - protein, 10 aa, Tick-borne encephalitis virus
PAVMSVRAYT

SEQ ID NO: 200526 - protein, 10 aa, Tick-borne encephalitis virus
AVMSVRAYTI

SEQ ID NO: 200527 - protein, 10 aa, Tick-borne encephalitis virus
VMSVRAYTIG

SEQ ID NO: 200528 - protein, 10 aa, Tick-borne encephalitis virus
MSVRAYTIGG

SEQ ID NO: 200529 - protein, 10 aa, Tick-borne encephalitis virus
SVRAYTIGGR

SEQ ID NO: 200530 - protein, 10 aa, Tick-borne encephalitis virus
VRAYTIGGRG

SEQ ID NO: 200531 - protein, 10 aa, Tick-borne encephalitis virus
RAYTIGGRGH

SEQ ID NO: 200532 - protein, 10 aa, Tick-borne encephalitis virus
AYTIGGRGHE

SEQ ID NO: 200533 - protein, 10 aa, Tick-borne encephalitis virus
YTIGGRGHEA

SEQ ID NO: 200534 - protein, 10 aa, Tick-borne encephalitis virus
TIGGRGHEAP

SEQ ID NO: 200535 - protein, 10 aa, Tick-borne encephalitis virus
IGGRGHEAPK

SEQ ID NO: 200536 - protein, 10 aa, Tick-borne encephalitis virus
GGRGHEAPKM

SEQ ID NO: 200537 - protein, 10 aa, Tick-borne encephalitis virus
GRGHEAPKMV

SEQ ID NO: 200538 - protein, 10 aa, Tick-borne encephalitis virus
RGHEAPKMVT

SEQ ID NO: 200539 - protein, 10 aa, Tick-borne encephalitis virus
GHEAPKMVTS

SEQ ID NO: 200540 - protein, 10 aa, Tick-borne encephalitis virus
HEAPKMVTSL

SEQ ID NO: 200541 - protein, 10 aa, Tick-borne encephalitis virus
EAPKMVTSLG

SEQ ID NO: 200542 - protein, 10 aa, Tick-borne encephalitis virus
APKMVTSLGW

SEQ ID NO: 200543 - protein, 10 aa, Tick-borne encephalitis virus
PRMVTSLGWN

SEQ ID NO: 200544 - protein, 10 aa, Tick-borne encephalitis virus
RMVTSLGWNL

SEQ ID NO: 200545 - protein, 10 aa, Tick-borne encephalitis virus
LGWNLIKFRS

SEQ ID NO: 200546 - protein, 10 aa, Tick-borne encephalitis virus
GWNLIKFRSG

SEQ ID NO: 200547 - protein, 10 aa, Tick-borne encephalitis virus
WNLIKFRSGM

SEQ ID NO: 200548 - protein, 10 aa, Tick-borne encephalitis virus
NLIKFRSGMD

SEQ ID NO: 200549 - protein, 10 aa, Tick-borne encephalitis virus
LIKFRSGMDV

SEQ ID NO: 200550 - protein, 10 aa, Tick-borne encephalitis virus
IKFRSGMDVF

SEQ ID NO: 200551 - protein, 10 aa, Tick-borne encephalitis virus
KFRSGMDVFS

SEQ ID NO: 200552 - protein, 10 aa, Tick-borne encephalitis virus
FRSGMDVFSM

SEQ ID NO: 200553 - protein, 10 aa, Tick-borne encephalitis virus
RSGMDVFSMQ

SEQ ID NO: 200554 - protein, 10 aa, Tick-borne encephalitis virus
SGMDVFSMQP

SEQ ID NO: 200555 - protein, 10 aa, Tick-borne encephalitis virus
GVDVFSMQPH

SEQ ID NO: 200556 - protein, 10 aa, Tick-borne encephalitis virus
VDVFSMQPHR

SEQ ID NO: 200557 - protein, 10 aa, Tick-borne encephalitis virus
SMQPHRADTV

SEQ ID NO: 200558 - protein, 10 aa, Tick-borne encephalitis virus
MQPHRADTVM

SEQ ID NO: 200559 - protein, 10 aa, Tick-borne encephalitis virus
QPHRADTVMC

SEQ ID NO: 200560 - protein, 10 aa, Tick-borne encephalitis virus
PHRADTVMCD

SEQ ID NO: 200561 - protein, 10 aa, Tick-borne encephalitis virus
HRADTVMCDI

SEQ ID NO: 200562 - protein, 10 aa, Tick-borne encephalitis virus
RADTVMCDIG

SEQ ID NO: 200563 - protein, 10 aa, Tick-borne encephalitis virus
ADTVMCDIGE

SEQ ID NO: 200564 - protein, 10 aa, Tick-borne encephalitis virus
DTVMCDIGES

SEQ ID NO: 200565 - protein, 10 aa, Tick-borne encephalitis virus
TVMCDIGESS

SEQ ID NO: 200566 - protein, 10 aa, Tick-borne encephalitis virus
VMCDIGESSP

SEQ ID NO: 200567 - protein, 10 aa, Tick-borne encephalitis virus
MCDIGESSPD

SEQ ID NO: 200568 - protein, 10 aa, Tick-borne encephalitis virus
CDIGESSPDA

SEQ ID NO: 200569 - protein, 10 aa, Tick-borne encephalitis virus
DIGESSPDAA

SEQ ID NO: 200570 - protein, 10 aa, Tick-borne encephalitis virus
IGESSPDAAV

SEQ ID NO: 200571 - protein, 10 aa, Tick-borne encephalitis virus
GESSPDAAVE

SEQ ID NO: 200572 - protein, 10 aa, Tick-borne encephalitis virus
ESSPDAAVEG

SEQ ID NO: 200573 - protein, 10 aa, Tick-borne encephalitis virus
SSPDAAVEGE

SEQ ID NO: 200574 - protein, 10 aa, Tick-borne encephalitis virus
SPDAAVEGER

SEQ ID NO: 200575 - protein, 10 aa, Tick-borne encephalitis virus
PDAAVEGERT

SEQ ID NO: 200576 - protein, 10 aa, Tick-borne encephalitis virus
DAAVEGERTR

SEQ ID NO: 200577 - protein, 10 aa, Tick-borne encephalitis virus
AAVEGERTRK

SEQ ID NO: 200578 - protein, 10 aa, Tick-borne encephalitis virus
AVEGERTRKV

SEQ ID NO: 200579 - protein, 10 aa, Tick-borne encephalitis virus
VEGERTRRVI

SEQ ID NO: 200580 - protein, 10 aa, Tick-borne encephalitis virus
EGERTRRVIL

SEQ ID NO: 200581 - protein, 10 aa, Tick-borne encephalitis virus
GERTRRVILL

SEQ ID NO: 200582 - protein, 10 aa, Tick-borne encephalitis virus
ERTRRVILLM

SEQ ID NO: 200583 - protein, 10 aa, Tick-borne encephalitis virus
RTRRVILLME

SEQ ID NO: 200584 - protein, 10 aa, Tick-borne encephalitis virus
TRRVILLMEQ

SEQ ID NO: 200585 - protein, 10 aa, Tick-borne encephalitis virus
RRVILLMEQW

SEQ ID NO: 200586 - protein, 10 aa, Tick-borne encephalitis virus
RVILLMEQWK

SEQ ID NO: 200587 - protein, 10 aa, Tick-borne encephalitis virus
VILLMEQWKI

SEQ ID NO: 200588 - protein, 10 aa, Tick-borne encephalitis virus
ILLMEQWKIR

SEQ ID NO: 200589 - protein, 10 aa, Tick-borne encephalitis virus
LLMEQWKIRN

SEQ ID NO: 200590 - protein, 10 aa, Tick-borne encephalitis virus
LMEQWKIRNP

SEQ ID NO: 200591 - protein, 10 aa, Tick-borne encephalitis virus
MEQWKIRNPT

SEQ ID NO: 200592 - protein, 10 aa, Tick-borne encephalitis virus
EQWKNRNPAA

SEQ ID NO: 200593 - protein, 10 aa, Tick-borne encephalitis virus
QWKNRNPTAA

SEQ ID NO: 200594 - protein, 10 aa, Tick-borne encephalitis virus
WKNRNPTAAC

SEQ ID NO: 200595 - protein, 10 aa, Tick-borne encephalitis virus
KNRNPTAACV

SEQ ID NO: 200596 - protein, 10 aa, Tick-borne encephalitis virus
NRNPTAACVF

SEQ ID NO: 200597 - protein, 10 aa, Tick-borne encephalitis virus
RNPTAACVFK

SEQ ID NO: 200598 - protein, 10 aa, Tick-borne encephalitis virus
NPTAACVFKV

SEQ ID NO: 200599 - protein, 10 aa, Tick-borne encephalitis virus
PTAACVFKVL

SEQ ID NO: 200600 - protein, 10 aa, Tick-borne encephalitis virus
TAACVFKVLA

SEQ ID NO: 200601 - protein, 10 aa, Tick-borne encephalitis virus
AACVFKVLAP

SEQ ID NO: 200602 - protein, 10 aa, Tick-borne encephalitis virus
ACVFKVLAPY

SEQ ID NO: 200603 - protein, 10 aa, Tick-borne encephalitis virus
FKVLAPYRPK

SEQ ID NO: 200604 - protein, 10 aa, Tick-borne encephalitis virus
KVLAPYRPKV

SEQ ID NO: 200605 - protein, 10 aa, Tick-borne encephalitis virus
VLAPYRPKVI

SEQ ID NO: 200606 - protein, 10 aa, Tick-borne encephalitis virus
LAPYRPKVIE

SEQ ID NO: 200607 - protein, 10 aa, Tick-borne encephalitis virus
APYRPKVIEA

SEQ ID NO: 200608 - protein, 10 aa, Tick-borne encephalitis virus
PYRPKVIEAL

SEQ ID NO: 200609 - protein, 10 aa, Tick-borne encephalitis virus
YRPKVIEALH

SEQ ID NO: 200610 - protein, 10 aa, Tick-borne encephalitis virus
RPKVIEALHR

SEQ ID NO: 200611 - protein, 10 aa, Tick-borne encephalitis virus
PEVIETLHRF

SEQ ID NO: 200612 - protein, 10 aa, Tick-borne encephalitis virus
EVIETLHRFQ

SEQ ID NO: 200613 - protein, 10 aa, Tick-borne encephalitis virus
VIETLHRFQL

SEQ ID NO: 200614 - protein, 10 aa, Tick-borne encephalitis virus
IEALHRFQLR

SEQ ID NO: 200615 - protein, 10 aa, Tick-borne encephalitis virus
EALHRFQLRW

SEQ ID NO: 200616 - protein, 10 aa, Tick-borne encephalitis virus
ALHRFQLRWG

SEQ ID NO: 200617 - protein, 10 aa, Tick-borne encephalitis virus
LHRFQLRWGG

SEQ ID NO: 200618 - protein, 10 aa, Tick-borne encephalitis virus
HRFQLRWGGG

SEQ ID NO: 200619 - protein, 10 aa, Tick-borne encephalitis virus
RFQLRWGGGL

SEQ ID NO: 200620 - protein, 10 aa, Tick-borne encephalitis virus
FQLRWGGGLV

SEQ ID NO: 200621 - protein, 10 aa, Tick-borne encephalitis virus
QLRWGGGLVR

SEQ ID NO: 200622 - protein, 10 aa, Tick-borne encephalitis virus
LRWGGGLVRT

SEQ ID NO: 200623 - protein, 10 aa, Tick-borne encephalitis virus
RWGGGLVRTP

SEQ ID NO: 200624 - protein, 10 aa, Tick-borne encephalitis virus
TPFSRNSTHK

SEQ ID NO: 200625 - protein, 10 aa, Tick-borne encephalitis virus
PFSRNSTHKV

SEQ ID NO: 200626 - protein, 10 aa, Tick-borne encephalitis virus
FSRNSTHKVY

SEQ ID NO: 200627 - protein, 10 aa, Tick-borne encephalitis virus
SRNSTHKVYY

SEQ ID NO: 200628 - protein, 10 aa, Tick-borne encephalitis virus
RNSTHKVYYS

SEQ ID NO: 200629 - protein, 10 aa, Tick-borne encephalitis virus
NSTHKVYYST

SEQ ID NO: 200630 - protein, 10 aa, Tick-borne encephalitis virus
STHKVYYSTA

SEQ ID NO: 200631 - protein, 10 aa, Tick-borne encephalitis virus
THKVYYSTAV

SEQ ID NO: 200632 - protein, 10 aa, Tick-borne encephalitis virus
HKVYYSTAVT

SEQ ID NO: 200633 - protein, 10 aa, Tick-borne encephalitis virus
EMYYSTAITG

SEQ ID NO: 200634 - protein, 10 aa, Tick-borne encephalitis virus
VYYSTAVTGN

SEQ ID NO: 200635 - protein, 10 aa, Tick-borne encephalitis virus
YYSTAITGNI

SEQ ID NO: 200636 - protein, 10 aa, Tick-borne encephalitis virus
YSTAITGNIV

SEQ ID NO: 200637 - protein, 10 aa, Tick-borne encephalitis virus
STAITGNIVN

SEQ ID NO: 200638 - protein, 10 aa, Tick-borne encephalitis virus
TAITGNIVNS

SEQ ID NO: 200639 - protein, 10 aa, Tick-borne encephalitis virus
AITGNIVNSV

SEQ ID NO: 200640 - protein, 10 aa, Tick-borne encephalitis virus
ITGNIVNSVN

SEQ ID NO: 200641 - protein, 10 aa, Tick-borne encephalitis virus
TGNIVNSVNV

SEQ ID NO: 200642 - protein, 10 aa, Tick-borne encephalitis virus
GNIVNSVNVQ

SEQ ID NO: 200643 - protein, 10 aa, Tick-borne encephalitis virus
NIVNSVNVQS

SEQ ID NO: 200644 - protein, 10 aa, Tick-borne encephalitis virus
IVNSVNVQSR

SEQ ID NO: 200645 - protein, 10 aa, Tick-borne encephalitis virus
VNSVNVQSRK

SEQ ID NO: 200646 - protein, 10 aa, Tick-borne encephalitis virus
NSVNVQSRKL

SEQ ID NO: 200647 - protein, 10 aa, Tick-borne encephalitis virus
SVNVQSRKLL

SEQ ID NO: 200648 - protein, 10 aa, Tick-borne encephalitis virus
VNVQSRKLLA

SEQ ID NO: 200649 - protein, 10 aa, Tick-borne encephalitis virus
NVQSRKLLAR

SEQ ID NO: 200650 - protein, 10 aa, Tick-borne encephalitis virus
VQSRKLLARF

SEQ ID NO: 200651 - protein, 10 aa, Tick-borne encephalitis virus
QSRKLLARFA

SEQ ID NO: 200652 - protein, 10 aa, Tick-borne encephalitis virus
SRKLLARFAG

SEQ ID NO: 200653 - protein, 10 aa, Tick-borne encephalitis virus
RKLLARFAGQ

SEQ ID NO: 200654 - protein, 10 aa, Tick-borne encephalitis virus
KLLARFAGQR

SEQ ID NO: 200655 - protein, 10 aa, Tick-borne encephalitis virus
LLARFAGQRG

SEQ ID NO: 200656 - protein, 10 aa, Tick-borne encephalitis virus
LARFAGQRGP

SEQ ID NO: 200657 - protein, 10 aa, Tick-borne encephalitis virus
ARFAGQRGPT

SEQ ID NO: 200658 - protein, 10 aa, Tick-borne encephalitis virus
RFGDQRGPTK

SEQ ID NO: 200659 - protein, 10 aa, Tick-borne encephalitis virus
FGDQRGPTKV

SEQ ID NO: 200660 - protein, 10 aa, Tick-borne encephalitis virus
GDQRGPTKVP

SEQ ID NO: 200661 - protein, 10 aa, Tick-borne encephalitis virus
DQRGPTKVPE

SEQ ID NO: 200662 - protein, 10 aa, Tick-borne encephalitis virus
QRGPTKVPEL

SEQ ID NO: 200663 - protein, 10 aa, Tick-borne encephalitis virus
RGPTKVPELD

SEQ ID NO: 200664 - protein, 10 aa, Tick-borne encephalitis virus
GPTKVPELDL

SEQ ID NO: 200665 - protein, 10 aa, Tick-borne encephalitis virus
PTKVPELDLG

SEQ ID NO: 200666 - protein, 10 aa, Tick-borne encephalitis virus
TRVPELDLGI

SEQ ID NO: 200667 - protein, 10 aa, Tick-borne encephalitis virus
RVPELDLGIG

SEQ ID NO: 200668 - protein, 10 aa, Tick-borne encephalitis virus
VPELDLGIGT

SEQ ID NO: 200669 - protein, 10 aa, Tick-borne encephalitis virus
PELDLGIGTR

SEQ ID NO: 200670 - protein, 10 aa, Tick-borne encephalitis virus
ELDLGIGTRC

SEQ ID NO: 200671 - protein, 10 aa, Tick-borne encephalitis virus
LDLGIGTRCV

SEQ ID NO: 200672 - protein, 10 aa, Tick-borne encephalitis virus
DLGIGTRCVV

SEQ ID NO: 200673 - protein, 10 aa, Tick-borne encephalitis virus
LGIGTRCVVL

SEQ ID NO: 200674 - protein, 10 aa, Tick-borne encephalitis virus
GIGTRCVVLA

SEQ ID NO: 200675 - protein, 10 aa, Tick-borne encephalitis virus
IGTRCVVLAE

SEQ ID NO: 200676 - protein, 10 aa, Tick-borne encephalitis virus
GTRCVFLAED

SEQ ID NO: 200677 - protein, 10 aa, Tick-borne encephalitis virus
TRCVVLAEDR

SEQ ID NO: 200678 - protein, 10 aa, Tick-borne encephalitis virus
RCVVLAEDRV

SEQ ID NO: 200679 - protein, 10 aa, Tick-borne encephalitis virus
CVVLAEDRVR

SEQ ID NO: 200680 - protein, 10 aa, Tick-borne encephalitis virus
VVLAEDRVRE

SEQ ID NO: 200681 - protein, 10 aa, Tick-borne encephalitis virus
LAEDKVKEQD

SEQ ID NO: 200682 - protein, 10 aa, Tick-borne encephalitis virus
AEDKVKEQDV

SEQ ID NO: 200683 - protein, 10 aa, Tick-borne encephalitis virus
DKVKEQDVQE

SEQ ID NO: 200684 - protein, 10 aa, Tick-borne encephalitis virus
KVKEQDVQER

SEQ ID NO: 200685 - protein, 10 aa, Tick-borne encephalitis virus
VKEQDVQERI

SEQ ID NO: 200686 - protein, 10 aa, Tick-borne encephalitis virus
ERIRALREQY

SEQ ID NO: 200687 - protein, 10 aa, Tick-borne encephalitis virus
ALREQYSETW

SEQ ID NO: 200688 - protein, 10 aa, Tick-borne encephalitis virus
LREQYSETWH

SEQ ID NO: 200689 - protein, 10 aa, Tick-borne encephalitis virus
DEEHPYRTWQ

SEQ ID NO: 200690 - protein, 10 aa, Tick-borne encephalitis virus
EEHPYRTWQY

SEQ ID NO: 200691 - protein, 10 aa, Tick-borne encephalitis virus
APTGSAASLT

SEQ ID NO: 200692 - protein, 10 aa, Tick-borne encephalitis virus
PTGSAASLTN

SEQ ID NO: 200693 - protein, 10 aa, Tick-borne encephalitis virus
TGSAASLTNG

SEQ ID NO: 200694 - protein, 10 aa, Tick-borne encephalitis virus
GSAASLTNGV

SEQ ID NO: 200695 - protein, 10 aa, Tick-borne encephalitis virus
SAASLTNGVV

SEQ ID NO: 200696 - protein, 10 aa, Tick-borne encephalitis virus
AASLTNGVVK

SEQ ID NO: 200697 - protein, 10 aa, Tick-borne encephalitis virus
ASLTNGVVKL

SEQ ID NO: 200698 - protein, 10 aa, Tick-borne encephalitis virus
SLTNGVVKLL

SEQ ID NO: 200699 - protein, 10 aa, Tick-borne encephalitis virus
LTNGVVKLLS

SEQ ID NO: 200700 - protein, 10 aa, Tick-borne encephalitis virus
TNGVVKLLSW

SEQ ID NO: 200701 - protein, 10 aa, Tick-borne encephalitis virus
DVVRMAMTDP

SEQ ID NO: 200702 - protein, 10 aa, Tick-borne encephalitis virus
VVRMAMTDPT

SEQ ID NO: 200703 - protein, 10 aa, Tick-borne encephalitis virus
VRMAMTDPTP

SEQ ID NO: 200704 - protein, 10 aa, Tick-borne encephalitis virus
RMAMTDPTPA

SEQ ID NO: 200705 - protein, 10 aa, Tick-borne encephalitis virus
MAMTDPTPAW

SEQ ID NO: 200706 - protein, 10 aa, Tick-borne encephalitis virus
AMTDPTPAWQ

SEQ ID NO: 200707 - protein, 10 aa, Tick-borne encephalitis virus
MTDPTPAWQQ

SEQ ID NO: 200708 - protein, 10 aa, Tick-borne encephalitis virus
TDPTPAWQQR

SEQ ID NO: 200709 - protein, 10 aa, Tick-borne encephalitis virus
DPTPAWQQRV

SEQ ID NO: 200710 - protein, 10 aa, Tick-borne encephalitis virus
PTPAWQQRVF

SEQ ID NO: 200711 - protein, 10 aa, Tick-borne encephalitis virus
TPAWQQRVFK

SEQ ID NO: 200712 - protein, 10 aa, Tick-borne encephalitis virus
AFGQQRVFKD

SEQ ID NO: 200713 - protein, 10 aa, Tick-borne encephalitis virus
FGQQRVFKDK

SEQ ID NO: 200714 - protein, 10 aa, Tick-borne encephalitis virus
GQQRVFKDKV

SEQ ID NO: 200715 - protein, 10 aa, Tick-borne encephalitis virus
QQRVFKDKVD

SEQ ID NO: 200716 - protein, 10 aa, Tick-borne encephalitis virus
QRVFKDKVDT

SEQ ID NO: 200717 - protein, 10 aa, Tick-borne encephalitis virus
RVFKDKVDTK

SEQ ID NO: 200718 - protein, 10 aa, Tick-borne encephalitis virus
VFKDKVDTKA

SEQ ID NO: 200719 - protein, 10 aa, Tick-borne encephalitis virus
FKDKVDTKAQ

SEQ ID NO: 200720 - protein, 10 aa, Tick-borne encephalitis virus
KDKVDTKAQE

SEQ ID NO: 200721 - protein, 10 aa, Tick-borne encephalitis virus
DKVDTKAQEP

SEQ ID NO: 200722 - protein, 10 aa, Tick-borne encephalitis virus
NADTKAQEPQ

SEQ ID NO: 200723 - protein, 10 aa, Tick-borne encephalitis virus
ADTKAQEPQP

SEQ ID NO: 200724 - protein, 10 aa, Tick-borne encephalitis virus
KAQEPQPGTR

SEQ ID NO: 200725 - protein, 10 aa, Tick-borne encephalitis virus
AQEPQPGTRV

SEQ ID NO: 200726 - protein, 10 aa, Tick-borne encephalitis virus
QEPQPGTRVI

SEQ ID NO: 200727 - protein, 10 aa, Tick-borne encephalitis virus
EPQPGTRVIM

SEQ ID NO: 200728 - protein, 10 aa, Tick-borne encephalitis virus
PQPGTRVIMR

SEQ ID NO: 200729 - protein, 10 aa, Tick-borne encephalitis virus
QPGTRVIMRA

SEQ ID NO: 200730 - protein, 10 aa, Tick-borne encephalitis virus
PGTRVIMRAV

SEQ ID NO: 200731 - protein, 10 aa, Tick-borne encephalitis virus
GTRVIMRAVN

SEQ ID NO: 200732 - protein, 10 aa, Tick-borne encephalitis virus
TRVIMRAVND

SEQ ID NO: 200733 - protein, 10 aa, Tick-borne encephalitis virus
RVIMRAVNDW

SEQ ID NO: 200734 - protein, 10 aa, Tick-borne encephalitis virus
VIMRAVNDWM

SEQ ID NO: 200735 - protein, 10 aa, Tick-borne encephalitis virus
IMRAVNDWML

SEQ ID NO: 200736 - protein, 10 aa, Tick-borne encephalitis virus
MRAVNDWMLD

SEQ ID NO: 200737 - protein, 10 aa, Tick-borne encephalitis virus
RAVNDWMLDR

SEQ ID NO: 200738 - protein, 10 aa, Tick-borne encephalitis virus
AVNDWMLDRL

SEQ ID NO: 200739 - protein, 10 aa, Tick-borne encephalitis virus
VNDWMLDRLA

SEQ ID NO: 200740 - protein, 10 aa, Tick-borne encephalitis virus
NDWILERLAQ

SEQ ID NO: 200741 - protein, 10 aa, Tick-borne encephalitis virus
DWILERLAQK

SEQ ID NO: 200742 - protein, 10 aa, Tick-borne encephalitis virus
WILERLAQKS

SEQ ID NO: 200743 - protein, 10 aa, Tick-borne encephalitis virus
KPRMCSKEEF

SEQ ID NO: 200744 - protein, 10 aa, Tick-borne encephalitis virus
PRMCSKEEFI

SEQ ID NO: 200745 - protein, 10 aa, Tick-borne encephalitis virus
RMCSKEEFIA

SEQ ID NO: 200746 - protein, 10 aa, Tick-borne encephalitis virus
MCSKEEFIAK

SEQ ID NO: 200747 - protein, 10 aa, Tick-borne encephalitis virus
CSKEEFIAKV

SEQ ID NO: 200748 - protein, 10 aa, Tick-borne encephalitis virus
SKEEFIAKVK

SEQ ID NO: 200749 - protein, 10 aa, Tick-borne encephalitis virus
KEEFIAKVKS

SEQ ID NO: 200750 - protein, 10 aa, Tick-borne encephalitis virus
EEFIAKVRSN

SEQ ID NO: 200751 - protein, 10 aa, Tick-borne encephalitis virus
EFIAKVRSNA

SEQ ID NO: 200752 - protein, 10 aa, Tick-borne encephalitis virus
FIAKVRSNAA

SEQ ID NO: 200753 - protein, 10 aa, Tick-borne encephalitis virus
IAKVRSNAAL

SEQ ID NO: 200754 - protein, 10 aa, Tick-borne encephalitis virus
AKVRSNAALG

SEQ ID NO: 200755 - protein, 10 aa, Tick-borne encephalitis virus
KVRSNAALGA

SEQ ID NO: 200756 - protein, 10 aa, Tick-borne encephalitis virus
VKSSAALGAW

SEQ ID NO: 200757 - protein, 10 aa, Tick-borne encephalitis virus
RSNAALGAWS

SEQ ID NO: 200758 - protein, 10 aa, Tick-borne encephalitis virus
SNAALGAWSN

SEQ ID NO: 200759 - protein, 10 aa, Tick-borne encephalitis virus
NAALGAWSNE

SEQ ID NO: 200760 - protein, 10 aa, Tick-borne encephalitis virus
AALGAWSEEQ

SEQ ID NO: 200761 - protein, 10 aa, Tick-borne encephalitis virus
ALGAWSEEQN

SEQ ID NO: 200762 - protein, 10 aa, Tick-borne encephalitis virus
LGAWSNEQNR

SEQ ID NO: 200763 - protein, 10 aa, Tick-borne encephalitis virus
GAWSEEQNRW

SEQ ID NO: 200764 - protein, 10 aa, Tick-borne encephalitis virus
AWSDEQNRWA

SEQ ID NO: 200765 - protein, 10 aa, Tick-borne encephalitis virus
SAREAVEDPA

SEQ ID NO: 200766 - protein, 10 aa, Tick-borne encephalitis virus
AREAVEDPAF

SEQ ID NO: 200767 - protein, 10 aa, Tick-borne encephalitis virus
REAVEDPAFW

SEQ ID NO: 200768 - protein, 10 aa, Tick-borne encephalitis virus
EAVEDPAFWH

SEQ ID NO: 200769 - protein, 10 aa, Tick-borne encephalitis virus
AVEDPAFWHL

SEQ ID NO: 200770 - protein, 10 aa, Tick-borne encephalitis virus
VEDPAFWHLV

SEQ ID NO: 200771 - protein, 10 aa, Tick-borne encephalitis virus
EDPAFWHLVD

SEQ ID NO: 200772 - protein, 10 aa, Tick-borne encephalitis virus
DPAFWHLVDE

SEQ ID NO: 200773 - protein, 10 aa, Tick-borne encephalitis virus
PAFWHLVDEE

SEQ ID NO: 200774 - protein, 10 aa, Tick-borne encephalitis virus
AFWHLVDEER

SEQ ID NO: 200775 - protein, 10 aa, Tick-borne encephalitis virus
FWHLVDEERE

SEQ ID NO: 200776 - protein, 10 aa, Tick-borne encephalitis virus
WHLVDEERER

SEQ ID NO: 200777 - protein, 10 aa, Tick-borne encephalitis virus
HLVDEERERH

SEQ ID NO: 200778 - protein, 10 aa, Tick-borne encephalitis virus
LVDEERERDL

SEQ ID NO: 200779 - protein, 10 aa, Tick-borne encephalitis virus
VDEERERHLM

SEQ ID NO: 200780 - protein, 10 aa, Tick-borne encephalitis virus
DEERERHLMG

SEQ ID NO: 200781 - protein, 10 aa, Tick-borne encephalitis virus
EERERHLMGR

SEQ ID NO: 200782 - protein, 10 aa, Tick-borne encephalitis virus
ERERHLMGRC

SEQ ID NO: 200783 - protein, 10 aa, Tick-borne encephalitis virus
RERHLMGRCA

SEQ ID NO: 200784 - protein, 10 aa, Tick-borne encephalitis virus
ERHLMGRCAH

SEQ ID NO: 200785 - protein, 10 aa, Tick-borne encephalitis virus
RHLMGRCAHC

SEQ ID NO: 200786 - protein, 10 aa, Tick-borne encephalitis virus
HLMGRCAHCV

SEQ ID NO: 200787 - protein, 10 aa, Tick-borne encephalitis virus
GRCAHCVHNM

SEQ ID NO: 200788 - protein, 10 aa, Tick-borne encephalitis virus
RCAHCVHNMM

SEQ ID NO: 200789 - protein, 10 aa, Tick-borne encephalitis virus
CAHCVHNMMG

SEQ ID NO: 200790 - protein, 10 aa, Tick-borne encephalitis virus
AHCVHNMMGK

SEQ ID NO: 200791 - protein, 10 aa, Tick-borne encephalitis virus
HCVHNMMGKR

SEQ ID NO: 200792 - protein, 10 aa, Tick-borne encephalitis virus
CVHNMMGKRE

SEQ ID NO: 200793 - protein, 10 aa, Tick-borne encephalitis virus
VHNMMGKREK

SEQ ID NO: 200794 - protein, 10 aa, Tick-borne encephalitis virus
HNMMGKREKK

SEQ ID NO: 200795 - protein, 10 aa, Tick-borne encephalitis virus
NIMGKREKKL

SEQ ID NO: 200796 - protein, 10 aa, Tick-borne encephalitis virus
IMGKREKKLG

SEQ ID NO: 200797 - protein, 10 aa, Tick-borne encephalitis virus
EKKLGEFGVS

SEQ ID NO: 200798 - protein, 10 aa, Tick-borne encephalitis virus
KKLGEFGVSK

SEQ ID NO: 200799 - protein, 10 aa, Tick-borne encephalitis virus
KLGEFGVSKG

SEQ ID NO: 200800 - protein, 10 aa, Tick-borne encephalitis virus
LGEFGVSKGS

SEQ ID NO: 200801 - protein, 10 aa, Tick-borne encephalitis virus
GEFGVSKGSR

SEQ ID NO: 200802 - protein, 10 aa, Tick-borne encephalitis virus
EFGVSKGSRA

SEQ ID NO: 200803 - protein, 10 aa, Tick-borne encephalitis virus
FGVSKGSRAM

SEQ ID NO: 200804 - protein, 10 aa, Tick-borne encephalitis virus
GVSKGSRAMW

SEQ ID NO: 200805 - protein, 10 aa, Tick-borne encephalitis virus
VSKGSRAMWY

SEQ ID NO: 200806 - protein, 10 aa, Tick-borne encephalitis virus
SKGSRAMWYM

SEQ ID NO: 200807 - protein, 10 aa, Tick-borne encephalitis virus
KGSRAMWYMW

SEQ ID NO: 200808 - protein, 10 aa, Tick-borne encephalitis virus
GSRAMWYMWL

SEQ ID NO: 200809 - protein, 10 aa, Tick-borne encephalitis virus
SRAMWYMWLG

SEQ ID NO: 200810 - protein, 10 aa, Tick-borne encephalitis virus
RAMWYMWLGS

SEQ ID NO: 200811 - protein, 10 aa, Tick-borne encephalitis virus
AMWYMWLGSR

SEQ ID NO: 200812 - protein, 10 aa, Tick-borne encephalitis virus
MWYMWLGSRF

SEQ ID NO: 200813 - protein, 10 aa, Tick-borne encephalitis virus
WYMWLGSRFQ

SEQ ID NO: 200814 - protein, 10 aa, Tick-borne encephalitis virus
YMWLGSRFQE

SEQ ID NO: 200815 - protein, 10 aa, Tick-borne encephalitis virus
MWLGSRFQEF

SEQ ID NO: 200816 - protein, 10 aa, Tick-borne encephalitis virus
WLGSRFQEFE

SEQ ID NO: 200817 - protein, 10 aa, Tick-borne encephalitis virus
LGSRFQEFEA

SEQ ID NO: 200818 - protein, 10 aa, Tick-borne encephalitis virus
GSRFQEFEAL

SEQ ID NO: 200819 - protein, 10 aa, Tick-borne encephalitis virus
SRFQEFEALG

SEQ ID NO: 200820 - protein, 10 aa, Tick-borne encephalitis virus
RFQEFEALGF

SEQ ID NO: 200821 - protein, 10 aa, Tick-borne encephalitis virus
FQEFEALGFL

SEQ ID NO: 200822 - protein, 10 aa, Tick-borne encephalitis virus
QEFEALGFLN

SEQ ID NO: 200823 - protein, 10 aa, Tick-borne encephalitis virus
LNEDHWASRE

SEQ ID NO: 200824 - protein, 10 aa, Tick-borne encephalitis virus
NEDHWASRES

SEQ ID NO: 200825 - protein, 10 aa, Tick-borne encephalitis virus
EDHWASRESS

SEQ ID NO: 200826 - protein, 10 aa, Tick-borne encephalitis virus
DHWASRESSG

SEQ ID NO: 200827 - protein, 10 aa, Tick-borne encephalitis virus
HWASRESSGA

SEQ ID NO: 200828 - protein, 10 aa, Tick-borne encephalitis virus
WASRESSGAG

SEQ ID NO: 200829 - protein, 10 aa, Tick-borne encephalitis virus
ASRESSGAGV

SEQ ID NO: 200830 - protein, 10 aa, Tick-borne encephalitis virus
SRESSGAGVE

SEQ ID NO: 200831 - protein, 10 aa, Tick-borne encephalitis virus
RESSGAGVEG

SEQ ID NO: 200832 - protein, 10 aa, Tick-borne encephalitis virus
ESSGAGVEGI

SEQ ID NO: 200833 - protein, 10 aa, Tick-borne encephalitis virus
SSGAGVEGIS

SEQ ID NO: 200834 - protein, 10 aa, Tick-borne encephalitis virus
SGAGVEGISL

SEQ ID NO: 200835 - protein, 10 aa, Tick-borne encephalitis virus
GAGVEGISLN

SEQ ID NO: 200836 - protein, 10 aa, Tick-borne encephalitis virus
AGVEGISLNY

SEQ ID NO: 200837 - protein, 10 aa, Tick-borne encephalitis virus
GISLNYLGWY

SEQ ID NO: 200838 - protein, 10 aa, Tick-borne encephalitis virus
ISLNYLGWYL

SEQ ID NO: 200839 - protein, 10 aa, Tick-borne encephalitis virus
SLNYLGWYLK

SEQ ID NO: 200840 - protein, 10 aa, Tick-borne encephalitis virus
LNYLGWYLKG

SEQ ID NO: 200841 - protein, 10 aa, Tick-borne encephalitis virus
NYLGWHLKKL

SEQ ID NO: 200842 - protein, 10 aa, Tick-borne encephalitis virus
YLGWHLKKLS

SEQ ID NO: 200843 - protein, 10 aa, Tick-borne encephalitis virus
LSTLNGGLFY

SEQ ID NO: 200844 - protein, 10 aa, Tick-borne encephalitis virus
STLNGGLFYA

SEQ ID NO: 200845 - protein, 10 aa, Tick-borne encephalitis virus
TLNGGLFYAD

SEQ ID NO: 200846 - protein, 10 aa, Tick-borne encephalitis virus
LNGGLFYADD

SEQ ID NO: 200847 - protein, 10 aa, Tick-borne encephalitis virus
NGGLFYADDT

SEQ ID NO: 200848 - protein, 10 aa, Tick-borne encephalitis virus
NADLEDEEQI

SEQ ID NO: 200849 - protein, 10 aa, Tick-borne encephalitis virus
ADLEDEEQIL

SEQ ID NO: 200850 - protein, 10 aa, Tick-borne encephalitis virus
DLEDEEQILR

SEQ ID NO: 200851 - protein, 10 aa, Tick-borne encephalitis virus
LEDEEQILRY

SEQ ID NO: 200852 - protein, 10 aa, Tick-borne encephalitis virus
EDEEQILRYM

SEQ ID NO: 200853 - protein, 10 aa, Tick-borne encephalitis virus
DEEQILRYME

SEQ ID NO: 200854 - protein, 10 aa, Tick-borne encephalitis virus
EEQILRYMEG

SEQ ID NO: 200855 - protein, 10 aa, Tick-borne encephalitis virus
EQILRYMEGE

SEQ ID NO: 200856 - protein, 10 aa, Tick-borne encephalitis virus
QILRYMEGEH

SEQ ID NO: 200857 - protein, 10 aa, Tick-borne encephalitis virus
ILRYMEGEHK

SEQ ID NO: 200858 - protein, 10 aa, Tick-borne encephalitis virus
LRYMEGEHRQ

SEQ ID NO: 200859 - protein, 10 aa, Tick-borne encephalitis virus
RYMEGEHRQL

SEQ ID NO: 200860 - protein, 10 aa, Tick-borne encephalitis virus
YMEGEHRQLA

SEQ ID NO: 200861 - protein, 10 aa, Tick-borne encephalitis virus
MEGEHKQLAT

SEQ ID NO: 200862 - protein, 10 aa, Tick-borne encephalitis virus
EGEHKQLATT

SEQ ID NO: 200863 - protein, 10 aa, Tick-borne encephalitis virus
GEHKQLATTI

SEQ ID NO: 200864 - protein, 10 aa, Tick-borne encephalitis virus
EHKQLATTIM

SEQ ID NO: 200865 - protein, 10 aa, Tick-borne encephalitis virus
HKQLATTIMQ

SEQ ID NO: 200866 - protein, 10 aa, Tick-borne encephalitis virus
KQLATTIMQK

SEQ ID NO: 200867 - protein, 10 aa, Tick-borne encephalitis virus
QLATTIMQKA

SEQ ID NO: 200868 - protein, 10 aa, Tick-borne encephalitis virus
LATTIMQKAY

SEQ ID NO: 200869 - protein, 10 aa, Tick-borne encephalitis virus
ATTIMQKAYH

SEQ ID NO: 200870 - protein, 10 aa, Tick-borne encephalitis virus
TTIMQKAYHA

SEQ ID NO: 200871 - protein, 10 aa, Tick-borne encephalitis virus
TVMQKAYHAK

SEQ ID NO: 200872 - protein, 10 aa, Tick-borne encephalitis virus
VMQKAYHAKV

SEQ ID NO: 200873 - protein, 10 aa, Tick-borne encephalitis virus
VVKVARPSRE

SEQ ID NO: 200874 - protein, 10 aa, Tick-borne encephalitis virus
VKVARPSREG

SEQ ID NO: 200875 - protein, 10 aa, Tick-borne encephalitis virus
KVARPSREGG

SEQ ID NO: 200876 - protein, 10 aa, Tick-borne encephalitis virus
VARPSREGGC

SEQ ID NO: 200877 - protein, 10 aa, Tick-borne encephalitis virus
ARPSRDGGCV

SEQ ID NO: 200878 - protein, 10 aa, Tick-borne encephalitis virus
RPSRDGGCVM

SEQ ID NO: 200879 - protein, 10 aa, Tick-borne encephalitis virus
PSRDGGCVMD

SEQ ID NO: 200880 - protein, 10 aa, Tick-borne encephalitis virus
SRDGGCVMDV

SEQ ID NO: 200881 - protein, 10 aa, Tick-borne encephalitis virus
RDGGCVMDVI

SEQ ID NO: 200882 - protein, 10 aa, Tick-borne encephalitis virus
DGGCVMDVIT

SEQ ID NO: 200883 - protein, 10 aa, Tick-borne encephalitis virus
GGCVMDVITR

SEQ ID NO: 200884 - protein, 10 aa, Tick-borne encephalitis virus
GCVMDVITRR

SEQ ID NO: 200885 - protein, 10 aa, Tick-borne encephalitis virus
CVMDVITRRD

SEQ ID NO: 200886 - protein, 10 aa, Tick-borne encephalitis virus
VMDVITRRDQ

SEQ ID NO: 200887 - protein, 10 aa, Tick-borne encephalitis virus
ITRRDQRGSV

SEQ ID NO: 200888 - protein, 10 aa, Tick-borne encephalitis virus
TRRDQRGSVQ

SEQ ID NO: 200889 - protein, 10 aa, Tick-borne encephalitis virus
RRDQRGSVQV

SEQ ID NO: 200890 - protein, 10 aa, Tick-borne encephalitis virus
RDQRGSVQVV

SEQ ID NO: 200891 - protein, 10 aa, Tick-borne encephalitis virus
DQRGSVQVVT

SEQ ID NO: 200892 - protein, 10 aa, Tick-borne encephalitis virus
QRGSVQVVTY

SEQ ID NO: 200893 - protein, 10 aa, Tick-borne encephalitis virus
RGSVQVVTYA

SEQ ID NO: 200894 - protein, 10 aa, Tick-borne encephalitis virus
GSVQVVTYAL

SEQ ID NO: 200895 - protein, 10 aa, Tick-borne encephalitis virus
SVQVVTYALN

SEQ ID NO: 200896 - protein, 10 aa, Tick-borne encephalitis virus
VQVVTYALNT

SEQ ID NO: 200897 - protein, 10 aa, Tick-borne encephalitis virus
QVVTYALNTH

SEQ ID NO: 200898 - protein, 10 aa, Tick-borne encephalitis virus
VVTYALNTHT

SEQ ID NO: 200899 - protein, 10 aa, Tick-borne encephalitis virus
VTYALNTHTN

SEQ ID NO: 200900 - protein, 10 aa, Tick-borne encephalitis virus
TYALNTHTNI

SEQ ID NO: 200901 - protein, 10 aa, Tick-borne encephalitis virus
YALNTHTNIK

SEQ ID NO: 200902 - protein, 10 aa, Tick-borne encephalitis virus
ALNTHTNIKV

SEQ ID NO: 200903 - protein, 10 aa, Tick-borne encephalitis virus
LNTHTNIKVQ

SEQ ID NO: 200904 - protein, 10 aa, Tick-borne encephalitis virus
NTHTNIKVQL

SEQ ID NO: 200905 - protein, 10 aa, Tick-borne encephalitis virus
THTNIKVQLI

SEQ ID NO: 200906 - protein, 10 aa, Tick-borne encephalitis virus
HTNIKVQLIR

SEQ ID NO: 200907 - protein, 10 aa, Tick-borne encephalitis virus
IRMMEGEGVV

SEQ ID NO: 200908 - protein, 10 aa, Tick-borne encephalitis virus
RMMEGEGVVE

SEQ ID NO: 200909 - protein, 10 aa, Tick-borne encephalitis virus
MMEGEGVVEA

SEQ ID NO: 200910 - protein, 10 aa, Tick-borne encephalitis virus
MEGEGVIEAA

SEQ ID NO: 200911 - protein, 10 aa, Tick-borne encephalitis virus
EGEGVIEAAD

SEQ ID NO: 200912 - protein, 10 aa, Tick-borne encephalitis virus
GEGVIEAADA

SEQ ID NO: 200913 - protein, 10 aa, Tick-borne encephalitis virus
EGVIEAADAH

SEQ ID NO: 200914 - protein, 10 aa, Tick-borne encephalitis virus
GVIEAADAHN

SEQ ID NO: 200915 - protein, 10 aa, Tick-borne encephalitis virus
VIEAADAHNP

SEQ ID NO: 200916 - protein, 10 aa, Tick-borne encephalitis virus
IEAADAHNPR

SEQ ID NO: 200917 - protein, 10 aa, Tick-borne encephalitis virus
EAADAHNPRL

SEQ ID NO: 200918 - protein, 10 aa, Tick-borne encephalitis virus
AADAHNPRLL

SEQ ID NO: 200919 - protein, 10 aa, Tick-borne encephalitis virus
ADAHNPRLLR

SEQ ID NO: 200920 - protein, 10 aa, Tick-borne encephalitis virus
DAHNPRLFRV

SEQ ID NO: 200921 - protein, 10 aa, Tick-borne encephalitis virus
AHNPRLFRVE

SEQ ID NO: 200922 - protein, 10 aa, Tick-borne encephalitis virus
HNPRLFRVER

SEQ ID NO: 200923 - protein, 10 aa, Tick-borne encephalitis virus
NPRLFRVERW

SEQ ID NO: 200924 - protein, 10 aa, Tick-borne encephalitis virus
PRLFRVERWL

SEQ ID NO: 200925 - protein, 10 aa, Tick-borne encephalitis virus
RLLRVERWLK

SEQ ID NO: 200926 - protein, 10 aa, Tick-borne encephalitis virus
LLRVERWLKE

SEQ ID NO: 200927 - protein, 10 aa, Tick-borne encephalitis virus
RVERWLKEHG

SEQ ID NO: 200928 - protein, 10 aa, Tick-borne encephalitis virus
EHGEERLGRM

SEQ ID NO: 200929 - protein, 10 aa, Tick-borne encephalitis virus
HGGERLGRML

SEQ ID NO: 200930 - protein, 10 aa, Tick-borne encephalitis virus
GGERLGRMLV

SEQ ID NO: 200931 - protein, 10 aa, Tick-borne encephalitis virus
GERLGRMLVS

SEQ ID NO: 200932 - protein, 10 aa, Tick-borne encephalitis virus
VSGDDCVVRG

SEQ ID NO: 200933 - protein, 10 aa, Tick-borne encephalitis virus
SGDDCVVRPL

SEQ ID NO: 200934 - protein, 10 aa, Tick-borne encephalitis virus
GDDCVVRPLD

SEQ ID NO: 200935 - protein, 10 aa, Tick-borne encephalitis virus
DDCVVRPLDD

SEQ ID NO: 200936 - protein, 10 aa, Tick-borne encephalitis virus
DCVVRPLDDR

SEQ ID NO: 200937 - protein, 10 aa, Tick-borne encephalitis virus
CVVRPLDDRF

SEQ ID NO: 200938 - protein, 10 aa, Tick-borne encephalitis virus
VVRPLDDRFG

SEQ ID NO: 200939 - protein, 10 aa, Tick-borne encephalitis virus
DDRFSKALYF

SEQ ID NO: 200940 - protein, 10 aa, Tick-borne encephalitis virus
DRFSKALYFL

SEQ ID NO: 200941 - protein, 10 aa, Tick-borne encephalitis virus
RFSKALYFLN

SEQ ID NO: 200942 - protein, 10 aa, Tick-borne encephalitis virus
FSKALYFLND

SEQ ID NO: 200943 - protein, 10 aa, Tick-borne encephalitis virus
SKALYFLNDM

SEQ ID NO: 200944 - protein, 10 aa, Tick-borne encephalitis virus
RALYFLNDMA

SEQ ID NO: 200945 - protein, 10 aa, Tick-borne encephalitis virus
NDMAKTRKDV

SEQ ID NO: 200946 - protein, 10 aa, Tick-borne encephalitis virus
DMAKTRKDVG

SEQ ID NO: 200947 - protein, 10 aa, Tick-borne encephalitis virus
MAKTRKDVGE

SEQ ID NO: 200948 - protein, 10 aa, Tick-borne encephalitis virus
AKTRKDVGEW

SEQ ID NO: 200949 - protein, 10 aa, Tick-borne encephalitis virus
KTRKDVGEWE

SEQ ID NO: 200950 - protein, 10 aa, Tick-borne encephalitis virus
TRKDVGEWEH

SEQ ID NO: 200951 - protein, 10 aa, Tick-borne encephalitis virus
RKDVGEWEHS

SEQ ID NO: 200952 - protein, 10 aa, Tick-borne encephalitis virus
KDVGEWEHSV

SEQ ID NO: 200953 - protein, 10 aa, Tick-borne encephalitis virus
DVGEWEHSVG

SEQ ID NO: 200954 - protein, 10 aa, Tick-borne encephalitis virus
VGEWEHSVGF

SEQ ID NO: 200955 - protein, 10 aa, Tick-borne encephalitis virus
GEWEHSAGFS

SEQ ID NO: 200956 - protein, 10 aa, Tick-borne encephalitis virus
SWEEVPFCSH

SEQ ID NO: 200957 - protein, 10 aa, Tick-borne encephalitis virus
WEAVPFCSHH

SEQ ID NO: 200958 - protein, 10 aa, Tick-borne encephalitis virus
EAVPFCSHHF

SEQ ID NO: 200959 - protein, 10 aa, Tick-borne encephalitis virus
AVPFCSHHFH

SEQ ID NO: 200960 - protein, 10 aa, Tick-borne encephalitis virus
HELVMKDGRT

SEQ ID NO: 200961 - protein, 10 aa, Tick-borne encephalitis virus
ELVMKDGRSL

SEQ ID NO: 200962 - protein, 10 aa, Tick-borne encephalitis virus
LVMKDGRSLI

SEQ ID NO: 200963 - protein, 10 aa, Tick-borne encephalitis virus
VMKDGRTLVV

SEQ ID NO: 200964 - protein, 10 aa, Tick-borne encephalitis virus
MKDGRTLVVP

SEQ ID NO: 200965 - protein, 10 aa, Tick-borne encephalitis virus
KDGRTLVVPC

SEQ ID NO: 200966 - protein, 10 aa, Tick-borne encephalitis virus
DGRSLIVPCR

SEQ ID NO: 200967 - protein, 10 aa, Tick-borne encephalitis virus
GRSLIVPCRD

SEQ ID NO: 200968 - protein, 10 aa, Tick-borne encephalitis virus
RSLIVPCRDQ

SEQ ID NO: 200969 - protein, 10 aa, Tick-borne encephalitis virus
SLIVPCRDQD

SEQ ID NO: 200970 - protein, 10 aa, Tick-borne encephalitis virus
LVVPCRDQDE

SEQ ID NO: 200971 - protein, 10 aa, Tick-borne encephalitis virus
VVPCRDQDEL

SEQ ID NO: 200972 - protein, 10 aa, Tick-borne encephalitis virus
DQDELVGRAP

SEQ ID NO: 200973 - protein, 10 aa, Tick-borne encephalitis virus
QDELVGRARI

SEQ ID NO: 200974 - protein, 10 aa, Tick-borne encephalitis virus
DELVGRARIS

SEQ ID NO: 200975 - protein, 10 aa, Tick-borne encephalitis virus
ELVGRARISP

SEQ ID NO: 200976 - protein, 10 aa, Tick-borne encephalitis virus
LVGRARISPG

SEQ ID NO: 200977 - protein, 10 aa, Tick-borne encephalitis virus
VGRARISPGC

SEQ ID NO: 200978 - protein, 10 aa, Tick-borne encephalitis virus
GRARISPGCG

SEQ ID NO: 200979 - protein, 10 aa, Tick-borne encephalitis virus
RARISPGCGW

SEQ ID NO: 200980 - protein, 10 aa, Tick-borne encephalitis virus
ARISPGCGWS

SEQ ID NO: 200981 - protein, 10 aa, Tick-borne encephalitis virus
RISPGCGWSV

SEQ ID NO: 200982 - protein, 10 aa, Tick-borne encephalitis virus
ISPGCGWSVR

SEQ ID NO: 200983 - protein, 10 aa, Tick-borne encephalitis virus
SPGCGWSIRE

SEQ ID NO: 200984 - protein, 10 aa, Tick-borne encephalitis virus
PGCGWSIRET

SEQ ID NO: 200985 - protein, 10 aa, Tick-borne encephalitis virus
GCGWSIRETA

SEQ ID NO: 200986 - protein, 10 aa, Tick-borne encephalitis virus
CGWSIRETAC

SEQ ID NO: 200987 - protein, 10 aa, Tick-borne encephalitis virus
GWSIRETACL

SEQ ID NO: 200988 - protein, 10 aa, Tick-borne encephalitis virus
WSIRETACLS

SEQ ID NO: 200989 - protein, 10 aa, Tick-borne encephalitis virus
SIRETACLSK

SEQ ID NO: 200990 - protein, 10 aa, Tick-borne encephalitis virus
IRETACLSKA

SEQ ID NO: 200991 - protein, 10 aa, Tick-borne encephalitis virus
HRRDLRTLGF

SEQ ID NO: 200992 - protein, 10 aa, Tick-borne encephalitis virus
RRDLRTLGFA

SEQ ID NO: 200993 - protein, 10 aa, Tick-borne encephalitis virus
RDLRTLGFAI

SEQ ID NO: 200994 - protein, 10 aa, Tick-borne encephalitis virus
DLRTLGLAIN

SEQ ID NO: 200995 - protein, 10 aa, Tick-borne encephalitis virus
LRTLGLAINS

SEQ ID NO: 200996 - protein, 10 aa, Tick-borne encephalitis virus
RTLGLAINSA

SEQ ID NO: 200997 - protein, 10 aa, Tick-borne encephalitis virus
TLGLAINSAV

SEQ ID NO: 200998 - protein, 10 aa, Tick-borne encephalitis virus
LGLAINSAVP

SEQ ID NO: 200999 - protein, 10 aa, Tick-borne encephalitis virus
SAVPIDWVPT

SEQ ID NO: 201000 - protein, 10 aa, Tick-borne encephalitis virus
AVPADWVPTG

SEQ ID NO: 201001 - protein, 10 aa, Tick-borne encephalitis virus
VPIDWVPTGR

SEQ ID NO: 201002 - protein, 10 aa, Tick-borne encephalitis virus
PADWVPTGRT

SEQ ID NO: 201003 - protein, 10 aa, Tick-borne encephalitis virus
IDWVPTGRTT

SEQ ID NO: 201004 - protein, 10 aa, Tick-borne encephalitis virus
TTWSIHASGS

SEQ ID NO: 201005 - protein, 10 aa, Tick-borne encephalitis virus
TWSIHASGSW

SEQ ID NO: 201006 - protein, 10 aa, Tick-borne encephalitis virus
WSIHASGAWI

SEQ ID NO: 201007 - protein, 10 aa, Tick-borne encephalitis virus
SIHASGSWMT

SEQ ID NO: 201008 - protein, 10 aa, Tick-borne encephalitis virus
IHASGSWMTT

SEQ ID NO: 201009 - protein, 10 aa, Tick-borne encephalitis virus
HASGSWMTTE

SEQ ID NO: 201010 - protein, 10 aa, Tick-borne encephalitis virus
ASGAWMTTEN

SEQ ID NO: 201011 - protein, 10 aa, Tick-borne encephalitis virus
SGAWITTEDM

SEQ ID NO: 201012 - protein, 10 aa, Tick-borne encephalitis virus
GSWMTTEDML

SEQ ID NO: 201013 - protein, 10 aa, Tick-borne encephalitis virus
SWMTTEDMLD

SEQ ID NO: 201014 - protein, 10 aa, Tick-borne encephalitis virus
WITTEDMLDV

SEQ ID NO: 201015 - protein, 10 aa, Tick-borne encephalitis virus
ITTEDMLDVW

SEQ ID NO: 201016 - protein, 10 aa, Tick-borne encephalitis virus
TTENMLDVWN

SEQ ID NO: 201017 - protein, 10 aa, Tick-borne encephalitis virus
TENMLDVWNR

SEQ ID NO: 201018 - protein, 10 aa, Tick-borne encephalitis virus
ENMLDVWNRV

SEQ ID NO: 201019 - protein, 10 aa, Tick-borne encephalitis virus
NMLDVWNRVW

SEQ ID NO: 201020 - protein, 10 aa, Tick-borne encephalitis virus
VWILDNPFMQ

SEQ ID NO: 201021 - protein, 10 aa, Tick-borne encephalitis virus
WILDNPFMQN

SEQ ID NO: 201022 - protein, 10 aa, Tick-borne encephalitis virus
ILDNPFMQNK

SEQ ID NO: 201023 - protein, 10 aa, Tick-borne encephalitis virus
LDNPFMQNKE

SEQ ID NO: 201024 - protein, 10 aa, Tick-borne encephalitis virus
DNPFMQNKEK

SEQ ID NO: 201025 - protein, 10 aa, Tick-borne encephalitis virus
EWRDIPYLPK

SEQ ID NO: 201026 - protein, 10 aa, Tick-borne encephalitis virus
WRDVPYLPKA

SEQ ID NO: 201027 - protein, 10 aa, Tick-borne encephalitis virus
VPYLPKAQDM

SEQ ID NO: 201028 - protein, 10 aa, Tick-borne encephalitis virus
PYLPKAQDML

SEQ ID NO: 201029 - protein, 10 aa, Tick-borne encephalitis virus
YLPKAQDMLC

SEQ ID NO: 201030 - protein, 10 aa, Tick-borne encephalitis virus
LPKAQDMLCS

SEQ ID NO: 201031 - protein, 10 aa, Tick-borne encephalitis virus
PKAQDMLCSS

SEQ ID NO: 201032 - protein, 10 aa, Tick-borne encephalitis virus
KAQDMLCSSL

SEQ ID NO: 201033 - protein, 10 aa, Tick-borne encephalitis virus
AQDMLCSSLV

SEQ ID NO: 201034 - protein, 10 aa, Tick-borne encephalitis virus
QDMLCSSLVG

SEQ ID NO: 201035 - protein, 10 aa, Tick-borne encephalitis virus
MLCSSLVGRR

SEQ ID NO: 201036 - protein, 10 aa, Tick-borne encephalitis virus
LCSSLVGRRE

SEQ ID NO: 201037 - protein, 10 aa, Tick-borne encephalitis virus
CSSLVGRRER

SEQ ID NO: 201038 - protein, 10 aa, Tick-borne encephalitis virus
SSLVGRRERA

SEQ ID NO: 201039 - protein, 10 aa, Tick-borne encephalitis virus
SLVGRRERAE

SEQ ID NO: 201040 - protein, 10 aa, Tick-borne encephalitis virus
LVGRRERAEW

SEQ ID NO: 201041 - protein, 10 aa, Tick-borne encephalitis virus
VGRRERAEWA

SEQ ID NO: 201042 - protein, 10 aa, Tick-borne encephalitis virus
GRRERAEWAK

SEQ ID NO: 201043 - protein, 10 aa, Tick-borne encephalitis virus
RRERAEWAKN

SEQ ID NO: 201044 - protein, 10 aa, Tick-borne encephalitis virus
RERAEWAKNI

SEQ ID NO: 201045 - protein, 10 aa, Tick-borne encephalitis virus
ERAEWARNIW

SEQ ID NO: 201046 - protein, 10 aa, Tick-borne encephalitis virus
RAEWARNIWG

SEQ ID NO: 201047 - protein, 10 aa, Tick-borne encephalitis virus
AEWARNIWGA

SEQ ID NO: 201048 - protein, 10 aa, Tick-borne encephalitis virus
EWARNIWGAV

SEQ ID NO: 201049 - protein, 10 aa, Tick-borne encephalitis virus
WARNIWGAVE

SEQ ID NO: 201050 - protein, 10 aa, Tick-borne encephalitis virus
ARNIWGAVEK

SEQ ID NO: 201051 - protein, 10 aa, Tick-borne encephalitis virus
RNIWGAVEKV

SEQ ID NO: 201052 - protein, 10 aa, Tick-borne encephalitis virus
IWGAVEKVRR

SEQ ID NO: 201053 - protein, 10 aa, Tick-borne encephalitis virus
WGAVEKVRRM

SEQ ID NO: 201054 - protein, 10 aa, Tick-borne encephalitis virus
GAVEKVRRMI

SEQ ID NO: 201055 - protein, 10 aa, Tick-borne encephalitis virus
AVEKVRRMIG

SEQ ID NO: 201056 - protein, 10 aa, Tick-borne encephalitis virus
KFRDYLSCMD

SEQ ID NO: 201057 - protein, 10 aa, Tick-borne encephalitis virus
FRDYLSCMDR

SEQ ID NO: 201058 - protein, 10 aa, Tick-borne encephalitis virus
RDYLSCMDRH

SEQ ID NO: 201059 - protein, 10 aa, Tick-borne encephalitis virus
DYPSCMDRHD

SEQ ID NO: 201060 - protein, 10 aa, Tick-borne encephalitis virus
YPSCMDRHDL

SEQ ID NO: 201061 - protein, 10 aa, Tick-borne encephalitis virus
PSCMDRHDLH

SEQ ID NO: 201062 - protein, 10 aa, Tick-borne encephalitis virus
SCMDRHYLHW

SEQ ID NO: 201063 - protein, 10 aa, Tick-borne encephalitis virus
CMDRHYLHWN

SEQ ID NO: 201064 - protein, 10 aa, Tick-borne encephalitis virus
MDRHYLHWNL

SEQ ID NO: 201065 - protein, 10 aa, Tick-borne encephalitis virus
DRHDLHWELR

SEQ ID NO: 201066 - protein, 10 aa, Tick-borne encephalitis virus
RHDLHWELRL

SEQ ID NO: 201067 - protein, 10 aa, Tick-borne encephalitis virus
HDLHWELRLE

SEQ ID NO: 201068 - protein, 10 aa, Tick-borne encephalitis virus
DLHWELRLES

SEQ ID NO: 201069 - protein, 10 aa, Tick-borne encephalitis virus
LHWELRLESS

SEQ ID NO: 201070 - protein, 10 aa, Tick-borne encephalitis virus
HWELRLESSI

SEQ ID NO: 201071 - protein, 10 aa, Tick-borne encephalitis virus
WELRLESSII

SEQ ID NO: 201072 - protein, 10 aa, Tick-borne encephalitis virus
MARKAILKGK

SEQ ID NO: 201073 - protein, 10 aa, Tick-borne encephalitis virus
ARKAILKGKG

SEQ ID NO: 201074 - protein, 10 aa, Tick-borne encephalitis virus
RKAILKGKGG

SEQ ID NO: 201075 - protein, 10 aa, Tick-borne encephalitis virus
GPPRRVSKEA

SEQ ID NO: 201076 - protein, 10 aa, Tick-borne encephalitis virus
PPRRVSKEAA

SEQ ID NO: 201077 - protein, 10 aa, Tick-borne encephalitis virus
PRRVSKETAR

SEQ ID NO: 201078 - protein, 10 aa, Tick-borne encephalitis virus
RRVSKETARK

SEQ ID NO: 201079 - protein, 10 aa, Tick-borne encephalitis virus
RVSKETARKT

SEQ ID NO: 201080 - protein, 10 aa, Tick-borne encephalitis virus
VSKETARKTR

SEQ ID NO: 201081 - protein, 10 aa, Tick-borne encephalitis virus
SKETARKTRQ

SEQ ID NO: 201082 - protein, 10 aa, Tick-borne encephalitis virus
KETARKTRQS

SEQ ID NO: 201083 - protein, 10 aa, Tick-borne encephalitis virus
ETARKTRQSR

SEQ ID NO: 201084 - protein, 10 aa, Tick-borne encephalitis virus
TARKTRQSRV

SEQ ID NO: 201085 - protein, 10 aa, Tick-borne encephalitis virus
ATKTRQPRVQ

SEQ ID NO: 201086 - protein, 10 aa, Tick-borne encephalitis virus
TKTRQPRVQM

SEQ ID NO: 201087 - protein, 10 aa, Tick-borne encephalitis virus
KTRQPRVQMP

SEQ ID NO: 201088 - protein, 10 aa, Tick-borne encephalitis virus
TRQPRVQMPN

SEQ ID NO: 201089 - protein, 10 aa, Tick-borne encephalitis virus
RQPRVQMPNG

SEQ ID NO: 201090 - protein, 10 aa, Tick-borne encephalitis virus
QPRVQMPNGL

SEQ ID NO: 201091 - protein, 10 aa, Tick-borne encephalitis virus
PRVQMPNGLV

SEQ ID NO: 201092 - protein, 10 aa, Tick-borne encephalitis virus
RVQMPSGLVL

SEQ ID NO: 201093 - protein, 10 aa, Tick-borne encephalitis virus
VQMPSGLVLM

SEQ ID NO: 201094 - protein, 10 aa, Tick-borne encephalitis virus
QMPSGLVLMR

SEQ ID NO: 201095 - protein, 10 aa, Tick-borne encephalitis virus
PSGLVLMRMM

SEQ ID NO: 201096 - protein, 10 aa, Tick-borne encephalitis virus
SGLVLMRMMG

SEQ ID NO: 201097 - protein, 10 aa, Tick-borne encephalitis virus
GLVLMRMMGF

SEQ ID NO: 201098 - protein, 10 aa, Tick-borne encephalitis virus
LVLMRMMGFL

SEQ ID NO: 201099 - protein, 10 aa, Tick-borne encephalitis virus
VLMRMMGFLW

SEQ ID NO: 201100 - protein, 10 aa, Tick-borne encephalitis virus
LMRMMGFLWH

SEQ ID NO: 201101 - protein, 10 aa, Tick-borne encephalitis virus
MRMMGFLWHA

SEQ ID NO: 201102 - protein, 10 aa, Tick-borne encephalitis virus
RMLGILWHAV

SEQ ID NO: 201103 - protein, 10 aa, Tick-borne encephalitis virus
MLGILWHAVA

SEQ ID NO: 201104 - protein, 10 aa, Tick-borne encephalitis virus
LGILWHAVAG

SEQ ID NO: 201105 - protein, 10 aa, Tick-borne encephalitis virus
GFLWHAIAGT

SEQ ID NO: 201106 - protein, 10 aa, Tick-borne encephalitis virus
ILWHAVAGTV

SEQ ID NO: 201107 - protein, 10 aa, Tick-borne encephalitis virus
LWHAVAGTVR

SEQ ID NO: 201108 - protein, 10 aa, Tick-borne encephalitis virus
WHAIAGTARS

SEQ ID NO: 201109 - protein, 10 aa, Tick-borne encephalitis virus
HAIAGTARSP

SEQ ID NO: 201110 - protein, 10 aa, Tick-borne encephalitis virus
AIAGTARSPV

SEQ ID NO: 201111 - protein, 10 aa, Tick-borne encephalitis virus
IAGTARSPVL

SEQ ID NO: 201112 - protein, 10 aa, Tick-borne encephalitis virus
AGTVRSPVLK

SEQ ID NO: 201113 - protein, 10 aa, Tick-borne encephalitis virus
GTVRSPVLKS

SEQ ID NO: 201114 - protein, 10 aa, Tick-borne encephalitis virus
TVRSPVLKSF

SEQ ID NO: 201115 - protein, 10 aa, Tick-borne encephalitis virus
VRSPVLKSFW

SEQ ID NO: 201116 - protein, 10 aa, Tick-borne encephalitis virus
RSPVLKSFWK

SEQ ID NO: 201117 - protein, 10 aa, Tick-borne encephalitis virus
SPVLKSFWKS

SEQ ID NO: 201118 - protein, 10 aa, Tick-borne encephalitis virus
PVLKSFWKSV

SEQ ID NO: 201119 - protein, 10 aa, Tick-borne encephalitis virus
VLKSFWKSVP

SEQ ID NO: 201120 - protein, 10 aa, Tick-borne encephalitis virus
LKSFWKSVPL

SEQ ID NO: 201121 - protein, 10 aa, Tick-borne encephalitis virus
KAFWNSVPLK

SEQ ID NO: 201122 - protein, 10 aa, Tick-borne encephalitis virus
SFWNSVPLRQ

SEQ ID NO: 201123 - protein, 10 aa, Tick-borne encephalitis virus
FWKSVPLKQA

SEQ ID NO: 201124 - protein, 10 aa, Tick-borne encephalitis virus
WKSVPLKQAT

SEQ ID NO: 201125 - protein, 10 aa, Tick-borne encephalitis virus
SVPLKQAMAA

SEQ ID NO: 201126 - protein, 10 aa, Tick-borne encephalitis virus
VPLKQAMAAL

SEQ ID NO: 201127 - protein, 10 aa, Tick-borne encephalitis virus
PLKQAMAALR

SEQ ID NO: 201128 - protein, 10 aa, Tick-borne encephalitis virus
LKQAMAALRK

SEQ ID NO: 201129 - protein, 10 aa, Tick-borne encephalitis virus
KQAMAALRKI

SEQ ID NO: 201130 - protein, 10 aa, Tick-borne encephalitis virus
QATTALRKIK

SEQ ID NO: 201131 - protein, 10 aa, Tick-borne encephalitis virus
AMAALRKIKK

SEQ ID NO: 201132 - protein, 10 aa, Tick-borne encephalitis virus
MAALRKIKKA

SEQ ID NO: 201133 - protein, 10 aa, Tick-borne encephalitis virus
AALRKIKRAV

SEQ ID NO: 201134 - protein, 10 aa, Tick-borne encephalitis virus
ALRKIKRAVS

SEQ ID NO: 201135 - protein, 10 aa, Tick-borne encephalitis virus
LRKIKKAVSA

SEQ ID NO: 201136 - protein, 10 aa, Tick-borne encephalitis virus
RKIKKAVSAL

SEQ ID NO: 201137 - protein, 10 aa, Tick-borne encephalitis virus
KIKKAVSALM

SEQ ID NO: 201138 - protein, 10 aa, Tick-borne encephalitis virus
AVSALMIGLQ

SEQ ID NO: 201139 - protein, 10 aa, Tick-borne encephalitis virus
LMIGLQRRGK

SEQ ID NO: 201140 - protein, 10 aa, Tick-borne encephalitis virus
MVGLQRRGKK

SEQ ID NO: 201141 - protein, 10 aa, Tick-borne encephalitis virus
IGLQRRGKKR

SEQ ID NO: 201142 - protein, 10 aa, Tick-borne encephalitis virus
GLQRRGKKRS

SEQ ID NO: 201143 - protein, 10 aa, Tick-borne encephalitis virus
LQRRGKKRST

SEQ ID NO: 201144 - protein, 10 aa, Tick-borne encephalitis virus
TIAATVRKER

SEQ ID NO: 201145 - protein, 10 aa, Tick-borne encephalitis virus
FAATVRREGD

SEQ ID NO: 201146 - protein, 10 aa, Tick-borne encephalitis virus
AATVRKERDD

SEQ ID NO: 201147 - protein, 10 aa, Tick-borne encephalitis virus
ATVRKEGDGT

SEQ ID NO: 201148 - protein, 10 aa, Tick-borne encephalitis virus
TVRKEGDGTT

SEQ ID NO: 201149 - protein, 10 aa, Tick-borne encephalitis virus
VRKEGDGTTV

SEQ ID NO: 201150 - protein, 10 aa, Tick-borne encephalitis virus
RKEGDGTTVI

SEQ ID NO: 201151 - protein, 10 aa, Tick-borne encephalitis virus
KEGDGTTVIR

SEQ ID NO: 201152 - protein, 10 aa, Tick-borne encephalitis virus
EGDGTTVIRA

SEQ ID NO: 201153 - protein, 10 aa, Tick-borne encephalitis virus
GDGTTVIRAE

SEQ ID NO: 201154 - protein, 10 aa, Tick-borne encephalitis virus
DDTTVIRAEG

SEQ ID NO: 201155 - protein, 10 aa, Tick-borne encephalitis virus
DTTVIRAEGK

SEQ ID NO: 201156 - protein, 10 aa, Tick-borne encephalitis virus
TTVIRAEGRD

SEQ ID NO: 201157 - protein, 10 aa, Tick-borne encephalitis virus
VENGTCVIMA

SEQ ID NO: 201158 - protein, 10 aa, Tick-borne encephalitis virus
ENGTCVIMAT

SEQ ID NO: 201159 - protein, 10 aa, Tick-borne encephalitis virus
NGTCVIMATD

SEQ ID NO: 201160 - protein, 10 aa, Tick-borne encephalitis virus
GTCVIMATDM

SEQ ID NO: 201161 - protein, 10 aa, Tick-borne encephalitis virus
TCVIMATDMG

SEQ ID NO: 201162 - protein, 10 aa, Tick-borne encephalitis virus
CVILATDMGA

SEQ ID NO: 201163 - protein, 10 aa, Tick-borne encephalitis virus
VILATDMGAW

SEQ ID NO: 201164 - protein, 10 aa, Tick-borne encephalitis virus
IMATDMGSWC

SEQ ID NO: 201165 - protein, 10 aa, Tick-borne encephalitis virus
LATDMGAWCD

SEQ ID NO: 201166 - protein, 10 aa, Tick-borne encephalitis virus
ATDMGAWCDD

SEQ ID NO: 201167 - protein, 10 aa, Tick-borne encephalitis virus
MGAWCDDSLS

SEQ ID NO: 201168 - protein, 10 aa, Tick-borne encephalitis virus
GAWCDDSLSY

SEQ ID NO: 201169 - protein, 10 aa, Tick-borne encephalitis virus
AWCDDSLSYE

SEQ ID NO: 201170 - protein, 10 aa, Tick-borne encephalitis virus
CFCRNVDRVY

SEQ ID NO: 201171 - protein, 10 aa, Tick-borne encephalitis virus
FCRNVDRVYL

SEQ ID NO: 201172 - protein, 10 aa, Tick-borne encephalitis virus
CRNVDRVYLE

SEQ ID NO: 201173 - protein, 10 aa, Tick-borne encephalitis virus
RNVDRVYLEY

SEQ ID NO: 201174 - protein, 10 aa, Tick-borne encephalitis virus
NVDRVYLEYG

SEQ ID NO: 201175 - protein, 10 aa, Tick-borne encephalitis virus
VDRVYLEYGR

SEQ ID NO: 201176 - protein, 10 aa, Tick-borne encephalitis virus
DRVYLEYGRC

SEQ ID NO: 201177 - protein, 10 aa, Tick-borne encephalitis virus
RVYLEYGRCG

SEQ ID NO: 201178 - protein, 10 aa, Tick-borne encephalitis virus
VLIRSHAQGD

SEQ ID NO: 201179 - protein, 10 aa, Tick-borne encephalitis virus
LIRSHAQGDL

SEQ ID NO: 201180 - protein, 10 aa, Tick-borne encephalitis virus
IRSHAQGDLT

SEQ ID NO: 201181 - protein, 10 aa, Tick-borne encephalitis virus
RSHAQGDLTG

SEQ ID NO: 201182 - protein, 10 aa, Tick-borne encephalitis virus
AQGELTGRGR

SEQ ID NO: 201183 - protein, 10 aa, Tick-borne encephalitis virus
QGELTGRGRK

SEQ ID NO: 201184 - protein, 10 aa, Tick-borne encephalitis virus
GELTGRGRKW

SEQ ID NO: 201185 - protein, 10 aa, Tick-borne encephalitis virus
ELTGRGRKWL

SEQ ID NO: 201186 - protein, 10 aa, Tick-borne encephalitis virus
IVWLTVESVV

SEQ ID NO: 201187 - protein, 10 aa, Tick-borne encephalitis virus
VWLTLESVVA

SEQ ID NO: 201188 - protein, 10 aa, Tick-borne encephalitis virus
WLTLESVVAR

SEQ ID NO: 201189 - protein, 10 aa, Tick-borne encephalitis virus
VVALLCLAPV

SEQ ID NO: 201190 - protein, 10 aa, Tick-borne encephalitis virus
VALLCLAPVY

SEQ ID NO: 201191 - protein, 10 aa, Tick-borne encephalitis virus
VLFCLAPVYA

SEQ ID NO: 201192 - protein, 10 aa, Tick-borne encephalitis virus
VWLDAIYQES

SEQ ID NO: 201193 - protein, 10 aa, Tick-borne encephalitis virus
WLDAIYQESP

SEQ ID NO: 201194 - protein, 10 aa, Tick-borne encephalitis virus
LDAIYQESPA

SEQ ID NO: 201195 - protein, 10 aa, Tick-borne encephalitis virus
DAIYQESPAK

SEQ ID NO: 201196 - protein, 10 aa, Tick-borne encephalitis virus
AIYQESPAKT

SEQ ID NO: 201197 - protein, 10 aa, Tick-borne encephalitis virus
IYQEKPAKTR

SEQ ID NO: 201198 - protein, 10 aa, Tick-borne encephalitis virus
YQENPAQTRE

SEQ ID NO: 201199 - protein, 10 aa, Tick-borne encephalitis virus
QEKPAKTREY

SEQ ID NO: 201200 - protein, 10 aa, Tick-borne encephalitis virus
EKPAKTREYC

SEQ ID NO: 201201 - protein, 10 aa, Tick-borne encephalitis virus
NPAQTREYCL

SEQ ID NO: 201202 - protein, 10 aa, Tick-borne encephalitis virus
AKTREYCLHV

SEQ ID NO: 201203 - protein, 10 aa, Tick-borne encephalitis virus
QTREYCLHAK

SEQ ID NO: 201204 - protein, 10 aa, Tick-borne encephalitis virus
CPTTGPATLA

SEQ ID NO: 201205 - protein, 10 aa, Tick-borne encephalitis virus
PTMGPATLTE

SEQ ID NO: 201206 - protein, 10 aa, Tick-borne encephalitis virus
TMGPATLTEE

SEQ ID NO: 201207 - protein, 10 aa, Tick-borne encephalitis virus
MGPATLTEEH

SEQ ID NO: 201208 - protein, 10 aa, Tick-borne encephalitis virus
GPATLAEQHQ

SEQ ID NO: 201209 - protein, 10 aa, Tick-borne encephalitis virus
PATLAEQHQS

SEQ ID NO: 201210 - protein, 10 aa, Tick-borne encephalitis virus
ATLAEQHQSG

SEQ ID NO: 201211 - protein, 10 aa, Tick-borne encephalitis virus
TLAEQHQSGT

SEQ ID NO: 201212 - protein, 10 aa, Tick-borne encephalitis virus
LTEEHQGGTV

SEQ ID NO: 201213 - protein, 10 aa, Tick-borne encephalitis virus
AEQHQSGTVC

SEQ ID NO: 201214 - protein, 10 aa, Tick-borne encephalitis virus
EQHQSGTVCK

SEQ ID NO: 201215 - protein, 10 aa, Tick-borne encephalitis virus
QHQSGTVCKR

SEQ ID NO: 201216 - protein, 10 aa, Tick-borne encephalitis virus
KGSIVTCVKV

SEQ ID NO: 201217 - protein, 10 aa, Tick-borne encephalitis virus
GSIVTCVKVA

SEQ ID NO: 201218 - protein, 10 aa, Tick-borne encephalitis virus
SIVTCVKVAC

SEQ ID NO: 201219 - protein, 10 aa, Tick-borne encephalitis virus
IVTCVKVACE

SEQ ID NO: 201220 - protein, 10 aa, Tick-borne encephalitis virus
VTCVKVACEA

SEQ ID NO: 201221 - protein, 10 aa, Tick-borne encephalitis virus
TCVKVACEAK

SEQ ID NO: 201222 - protein, 10 aa, Tick-borne encephalitis virus
CVKVACEAKK

SEQ ID NO: 201223 - protein, 10 aa, Tick-borne encephalitis virus
VKVACEAKKK

SEQ ID NO: 201224 - protein, 10 aa, Tick-borne encephalitis virus
KVACEAKKKA

SEQ ID NO: 201225 - protein, 10 aa, Tick-borne encephalitis virus
VACEAKKKAT

SEQ ID NO: 201226 - protein, 10 aa, Tick-borne encephalitis virus
ATGHVYDPNK

SEQ ID NO: 201227 - protein, 10 aa, Tick-borne encephalitis virus
TGHVYDANRI

SEQ ID NO: 201228 - protein, 10 aa, Tick-borne encephalitis virus
GHVYDPNKIV

SEQ ID NO: 201229 - protein, 10 aa, Tick-borne encephalitis virus
HVYDANRIVY

SEQ ID NO: 201230 - protein, 10 aa, Tick-borne encephalitis virus
VYDANRIVYT

SEQ ID NO: 201231 - protein, 10 aa, Tick-borne encephalitis virus
YDANRIVYTV

SEQ ID NO: 201232 - protein, 10 aa, Tick-borne encephalitis virus
DANKIVYTIK

SEQ ID NO: 201233 - protein, 10 aa, Tick-borne encephalitis virus
PNKIVYPVKV

SEQ ID NO: 201234 - protein, 10 aa, Tick-borne encephalitis virus
NKIVYTIKVE

SEQ ID NO: 201235 - protein, 10 aa, Tick-borne encephalitis virus
RIVYTVKVEP

SEQ ID NO: 201236 - protein, 10 aa, Tick-borne encephalitis virus
IVYTIKVEPH

SEQ ID NO: 201237 - protein, 10 aa, Tick-borne encephalitis virus
VYTIKVEPHT

SEQ ID NO: 201238 - protein, 10 aa, Tick-borne encephalitis virus
YTIKVEPHTG

SEQ ID NO: 201239 - protein, 10 aa, Tick-borne encephalitis virus
TIKVEPHTGD

SEQ ID NO: 201240 - protein, 10 aa, Tick-borne encephalitis virus
EPHTGDYVAP

SEQ ID NO: 201241 - protein, 10 aa, Tick-borne encephalitis virus
PHTGDYVAVN

SEQ ID NO: 201242 - protein, 10 aa, Tick-borne encephalitis virus
HTGDYVAVNE

SEQ ID NO: 201243 - protein, 10 aa, Tick-borne encephalitis virus
TGDYVAVNET

SEQ ID NO: 201244 - protein, 10 aa, Tick-borne encephalitis virus
GDYVAVNETH

SEQ ID NO: 201245 - protein, 10 aa, Tick-borne encephalitis virus
DYVAVNETHS

SEQ ID NO: 201246 - protein, 10 aa, Tick-borne encephalitis virus
YVAPHETHSG

SEQ ID NO: 201247 - protein, 10 aa, Tick-borne encephalitis virus
VAPHETHSGR

SEQ ID NO: 201248 - protein, 10 aa, Tick-borne encephalitis virus
APHETHSGRK

SEQ ID NO: 201249 - protein, 10 aa, Tick-borne encephalitis virus
VNETHSGRKT

SEQ ID NO: 201250 - protein, 10 aa, Tick-borne encephalitis virus
NETHSGRKTP

SEQ ID NO: 201251 - protein, 10 aa, Tick-borne encephalitis virus
SGRKTPSFTV

SEQ ID NO: 201252 - protein, 10 aa, Tick-borne encephalitis virus
GRKTPSFTVS

SEQ ID NO: 201253 - protein, 10 aa, Tick-borne encephalitis virus
RKTPSFTVSS

SEQ ID NO: 201254 - protein, 10 aa, Tick-borne encephalitis virus
KTPSFTVSSE

SEQ ID NO: 201255 - protein, 10 aa, Tick-borne encephalitis virus
TPSFTVSSEK

SEQ ID NO: 201256 - protein, 10 aa, Tick-borne encephalitis virus
PSFTVSSEKT

SEQ ID NO: 201257 - protein, 10 aa, Tick-borne encephalitis virus
TVSSEKTILN

SEQ ID NO: 201258 - protein, 10 aa, Tick-borne encephalitis virus
VSSEKTILNM

SEQ ID NO: 201259 - protein, 10 aa, Tick-borne encephalitis virus
SEKTILNMGD

SEQ ID NO: 201260 - protein, 10 aa, Tick-borne encephalitis virus
EKTILNMGDY

SEQ ID NO: 201261 - protein, 10 aa, Tick-borne encephalitis virus
KTILNMGDYG

SEQ ID NO: 201262 - protein, 10 aa, Tick-borne encephalitis virus
TILNMGDYGD

SEQ ID NO: 201263 - protein, 10 aa, Tick-borne encephalitis virus
ILNMGDYGDV

SEQ ID NO: 201264 - protein, 10 aa, Tick-borne encephalitis virus
LNMGDYGDVS

SEQ ID NO: 201265 - protein, 10 aa, Tick-borne encephalitis virus
NMGDYGDVSL

SEQ ID NO: 201266 - protein, 10 aa, Tick-borne encephalitis virus
DYGDVSLLCK

SEQ ID NO: 201267 - protein, 10 aa, Tick-borne encephalitis virus
TVILELDKTL

SEQ ID NO: 201268 - protein, 10 aa, Tick-borne encephalitis virus
VILELDKTLE

SEQ ID NO: 201269 - protein, 10 aa, Tick-borne encephalitis virus
ILELDKTLEH

SEQ ID NO: 201270 - protein, 10 aa, Tick-borne encephalitis virus
LELDKTLEHL

SEQ ID NO: 201271 - protein, 10 aa, Tick-borne encephalitis virus
ELDKTLEHLP

SEQ ID NO: 201272 - protein, 10 aa, Tick-borne encephalitis virus
LDKTLEHLPT

SEQ ID NO: 201273 - protein, 10 aa, Tick-borne encephalitis virus
DKTLEHLPTA

SEQ ID NO: 201274 - protein, 10 aa, Tick-borne encephalitis virus
KTLEHLPTAW

SEQ ID NO: 201275 - protein, 10 aa, Tick-borne encephalitis virus
TLEHLPTAWQ

SEQ ID NO: 201276 - protein, 10 aa, Tick-borne encephalitis virus
LEHLPTAWQV

SEQ ID NO: 201277 - protein, 10 aa, Tick-borne encephalitis virus
LALPWRHEGV

SEQ ID NO: 201278 - protein, 10 aa, Tick-borne encephalitis virus
ALPWRHEGVQ

SEQ ID NO: 201279 - protein, 10 aa, Tick-borne encephalitis virus
HEGAQHWNNA

SEQ ID NO: 201280 - protein, 10 aa, Tick-borne encephalitis virus
EGAQHWNNAE

SEQ ID NO: 201281 - protein, 10 aa, Tick-borne encephalitis virus
GAQHWNNAER

SEQ ID NO: 201282 - protein, 10 aa, Tick-borne encephalitis virus
AQHWNNAERL

SEQ ID NO: 201283 - protein, 10 aa, Tick-borne encephalitis virus
QHWNNAERLV

SEQ ID NO: 201284 - protein, 10 aa, Tick-borne encephalitis virus
HWNNAERLVE

SEQ ID NO: 201285 - protein, 10 aa, Tick-borne encephalitis virus
GVPVAHIDGA

SEQ ID NO: 201286 - protein, 10 aa, Tick-borne encephalitis virus
VPVAHIDGAK

SEQ ID NO: 201287 - protein, 10 aa, Tick-borne encephalitis virus
PVAHIDGAKY

SEQ ID NO: 201288 - protein, 10 aa, Tick-borne encephalitis virus
VAHIDGAKYH

SEQ ID NO: 201289 - protein, 10 aa, Tick-borne encephalitis virus
AHIDGAKYHL

SEQ ID NO: 201290 - protein, 10 aa, Tick-borne encephalitis virus
HIDGAKYHLK

SEQ ID NO: 201291 - protein, 10 aa, Tick-borne encephalitis virus
IDGAKYHLKS

SEQ ID NO: 201292 - protein, 10 aa, Tick-borne encephalitis virus
DGAKYHLKSG

SEQ ID NO: 201293 - protein, 10 aa, Tick-borne encephalitis virus
LKMNGLTYTM

SEQ ID NO: 201294 - protein, 10 aa, Tick-borne encephalitis virus
KMNGLTYTMC

SEQ ID NO: 201295 - protein, 10 aa, Tick-borne encephalitis virus
MNGLTYTMCD

SEQ ID NO: 201296 - protein, 10 aa, Tick-borne encephalitis virus
NGLTYTMCDK

SEQ ID NO: 201297 - protein, 10 aa, Tick-borne encephalitis virus
YTVCDKTKFT

SEQ ID NO: 201298 - protein, 10 aa, Tick-borne encephalitis virus
TVCDKTKFTW

SEQ ID NO: 201299 - protein, 10 aa, Tick-borne encephalitis virus
VCDKTKFTWK

SEQ ID NO: 201300 - protein, 10 aa, Tick-borne encephalitis virus
CDKTKFTWRR

SEQ ID NO: 201301 - protein, 10 aa, Tick-borne encephalitis virus
DKTKFAWKRT

SEQ ID NO: 201302 - protein, 10 aa, Tick-borne encephalitis virus
KTKFAWKRTP

SEQ ID NO: 201303 - protein, 10 aa, Tick-borne encephalitis virus
TKFAWKRTPT

SEQ ID NO: 201304 - protein, 10 aa, Tick-borne encephalitis virus
KFAWKRTPTD

SEQ ID NO: 201305 - protein, 10 aa, Tick-borne encephalitis virus
FAWKRTPTDS

SEQ ID NO: 201306 - protein, 10 aa, Tick-borne encephalitis virus
AWKRTPTDSG

SEQ ID NO: 201307 - protein, 10 aa, Tick-borne encephalitis virus
WKRTPTDSGH

SEQ ID NO: 201308 - protein, 10 aa, Tick-borne encephalitis virus
KRTPTDSGHD

SEQ ID NO: 201309 - protein, 10 aa, Tick-borne encephalitis virus
RTPTDSGHDT

SEQ ID NO: 201310 - protein, 10 aa, Tick-borne encephalitis virus
APTDSGHDTV

SEQ ID NO: 201311 - protein, 10 aa, Tick-borne encephalitis virus
GHDTVVMEVS

SEQ ID NO: 201312 - protein, 10 aa, Tick-borne encephalitis virus
HDTVVMEVSF

SEQ ID NO: 201313 - protein, 10 aa, Tick-borne encephalitis virus
DTVVMEVSFS

SEQ ID NO: 201314 - protein, 10 aa, Tick-borne encephalitis virus
TVVMEVSFSG

SEQ ID NO: 201315 - protein, 10 aa, Tick-borne encephalitis virus
VVMEVSFSGT

SEQ ID NO: 201316 - protein, 10 aa, Tick-borne encephalitis virus
VMEVSFSGTK

SEQ ID NO: 201317 - protein, 10 aa, Tick-borne encephalitis virus
MEVSFSGTKP

SEQ ID NO: 201318 - protein, 10 aa, Tick-borne encephalitis virus
EVSFSGTKPC

SEQ ID NO: 201319 - protein, 10 aa, Tick-borne encephalitis virus
VSFSGTKPCR

SEQ ID NO: 201320 - protein, 10 aa, Tick-borne encephalitis virus
SFSGTKPCRI

SEQ ID NO: 201321 - protein, 10 aa, Tick-borne encephalitis virus
IGRVFQKTRR

SEQ ID NO: 201322 - protein, 10 aa, Tick-borne encephalitis virus
GRVFQKTRRG

SEQ ID NO: 201323 - protein, 10 aa, Tick-borne encephalitis virus
RVFQKTRRGI

SEQ ID NO: 201324 - protein, 10 aa, Tick-borne encephalitis virus
VFQKTRRGIE

SEQ ID NO: 201325 - protein, 10 aa, Tick-borne encephalitis virus
FQKTRRGIER

SEQ ID NO: 201326 - protein, 10 aa, Tick-borne encephalitis virus
QKTRRGIERL

SEQ ID NO: 201327 - protein, 10 aa, Tick-borne encephalitis virus
KTRRGIERLT

SEQ ID NO: 201328 - protein, 10 aa, Tick-borne encephalitis virus
TRRGIERLTV

SEQ ID NO: 201329 - protein, 10 aa, Tick-borne encephalitis virus
RRGIERLTVI

SEQ ID NO: 201330 - protein, 10 aa, Tick-borne encephalitis virus
AWDFGSTGGL

SEQ ID NO: 201331 - protein, 10 aa, Tick-borne encephalitis virus
WDFGSTGGLL

SEQ ID NO: 201332 - protein, 10 aa, Tick-borne encephalitis virus
DFGSTGGFLA

SEQ ID NO: 201333 - protein, 10 aa, Tick-borne encephalitis virus
FGSTGGFLAS

SEQ ID NO: 201334 - protein, 10 aa, Tick-borne encephalitis virus
GSTGGFLASV

SEQ ID NO: 201335 - protein, 10 aa, Tick-borne encephalitis virus
STGGFLASVG

SEQ ID NO: 201336 - protein, 10 aa, Tick-borne encephalitis virus
TGGFLASVGK

SEQ ID NO: 201337 - protein, 10 aa, Tick-borne encephalitis virus
GGFLASVGKA

SEQ ID NO: 201338 - protein, 10 aa, Tick-borne encephalitis virus
GFLASVGKAL

SEQ ID NO: 201339 - protein, 10 aa, Tick-borne encephalitis virus
FLASVGKALH

SEQ ID NO: 201340 - protein, 10 aa, Tick-borne encephalitis virus
LASVGKALHT

SEQ ID NO: 201341 - protein, 10 aa, Tick-borne encephalitis virus
ASVGKALHTV

SEQ ID NO: 201342 - protein, 10 aa, Tick-borne encephalitis virus
SIGKALHTVL

SEQ ID NO: 201343 - protein, 10 aa, Tick-borne encephalitis virus
IGKALHTVLG

SEQ ID NO: 201344 - protein, 10 aa, Tick-borne encephalitis virus
NSLFGGVGFI

SEQ ID NO: 201345 - protein, 10 aa, Tick-borne encephalitis virus
SLFGGVGFIP

SEQ ID NO: 201346 - protein, 10 aa, Tick-borne encephalitis virus
LFGGVGFIPK

SEQ ID NO: 201347 - protein, 10 aa, Tick-borne encephalitis virus
FGGVGFIPKL

SEQ ID NO: 201348 - protein, 10 aa, Tick-borne encephalitis virus
GGVGFIPKLL

SEQ ID NO: 201349 - protein, 10 aa, Tick-borne encephalitis virus
GVGFLPKILM

SEQ ID NO: 201350 - protein, 10 aa, Tick-borne encephalitis virus
VGFLPKILMG

SEQ ID NO: 201351 - protein, 10 aa, Tick-borne encephalitis virus
GAALAWLGLN

SEQ ID NO: 201352 - protein, 10 aa, Tick-borne encephalitis virus
AALAWLGLNM

SEQ ID NO: 201353 - protein, 10 aa, Tick-borne encephalitis virus
MSMSFLLAGV

SEQ ID NO: 201354 - protein, 10 aa, Tick-borne encephalitis virus
SMSFLLAGVL

SEQ ID NO: 201355 - protein, 10 aa, Tick-borne encephalitis virus
MSFLLAGVLV

SEQ ID NO: 201356 - protein, 10 aa, Tick-borne encephalitis virus
SFLLAGVLVL

SEQ ID NO: 201357 - protein, 10 aa, Tick-borne encephalitis virus
GALASAIRET

SEQ ID NO: 201358 - protein, 10 aa, Tick-borne encephalitis virus
ALASAIRETF

SEQ ID NO: 201359 - protein, 10 aa, Tick-borne encephalitis virus
LASAIKEAFE

SEQ ID NO: 201360 - protein, 10 aa, Tick-borne encephalitis virus
ASAIKEAFEE

SEQ ID NO: 201361 - protein, 10 aa, Tick-borne encephalitis virus
SAIKEAFEEG

SEQ ID NO: 201362 - protein, 10 aa, Tick-borne encephalitis virus
AIKETFEEGN

SEQ ID NO: 201363 - protein, 10 aa, Tick-borne encephalitis virus
IKETFEEGNC

SEQ ID NO: 201364 - protein, 10 aa, Tick-borne encephalitis virus
KETFEEGNCG

SEQ ID NO: 201365 - protein, 10 aa, Tick-borne encephalitis virus
ETFEEGNCGI

SEQ ID NO: 201366 - protein, 10 aa, Tick-borne encephalitis virus
TFEEGNCGIV

SEQ ID NO: 201367 - protein, 10 aa, Tick-borne encephalitis virus
FEEGNCGIVP

SEQ ID NO: 201368 - protein, 10 aa, Tick-borne encephalitis virus
EEGNCGIVPQ

SEQ ID NO: 201369 - protein, 10 aa, Tick-borne encephalitis virus
EGNCGIVPQN

SEQ ID NO: 201370 - protein, 10 aa, Tick-borne encephalitis virus
GNCGIVPQNR

SEQ ID NO: 201371 - protein, 10 aa, Tick-borne encephalitis virus
NCGIVPQNRL

SEQ ID NO: 201372 - protein, 10 aa, Tick-borne encephalitis virus
CGILPQNRLE

SEQ ID NO: 201373 - protein, 10 aa, Tick-borne encephalitis virus
GILPQNRLEM

SEQ ID NO: 201374 - protein, 10 aa, Tick-borne encephalitis virus
ILPQNRLEMA

SEQ ID NO: 201375 - protein, 10 aa, Tick-borne encephalitis virus
LEMAMWRSAV

SEQ ID NO: 201376 - protein, 10 aa, Tick-borne encephalitis virus
EMAMWRSAVT

SEQ ID NO: 201377 - protein, 10 aa, Tick-borne encephalitis virus
MAMWRSAVTE

SEQ ID NO: 201378 - protein, 10 aa, Tick-borne encephalitis virus
AMWRSAVTEL

SEQ ID NO: 201379 - protein, 10 aa, Tick-borne encephalitis virus
MWRSAVTELN

SEQ ID NO: 201380 - protein, 10 aa, Tick-borne encephalitis virus
WRSAVTELNL

SEQ ID NO: 201381 - protein, 10 aa, Tick-borne encephalitis virus
RSAVTELNLA

SEQ ID NO: 201382 - protein, 10 aa, Tick-borne encephalitis virus
SAVTELNLAL

SEQ ID NO: 201383 - protein, 10 aa, Tick-borne encephalitis virus
AVTELNLALA

SEQ ID NO: 201384 - protein, 10 aa, Tick-borne encephalitis virus
STELNLALAE

SEQ ID NO: 201385 - protein, 10 aa, Tick-borne encephalitis virus
AEGEANLTVM

SEQ ID NO: 201386 - protein, 10 aa, Tick-borne encephalitis virus
EGEANLTVMV

SEQ ID NO: 201387 - protein, 10 aa, Tick-borne encephalitis virus
GEANLTVMVD

SEQ ID NO: 201388 - protein, 10 aa, Tick-borne encephalitis virus
EANLTVMVDK

SEQ ID NO: 201389 - protein, 10 aa, Tick-borne encephalitis virus
ANLTVMVDKF

SEQ ID NO: 201390 - protein, 10 aa, Tick-borne encephalitis virus
NLTVMVDKFD

SEQ ID NO: 201391 - protein, 10 aa, Tick-borne encephalitis virus
LTVMVDKFDP

SEQ ID NO: 201392 - protein, 10 aa, Tick-borne encephalitis virus
TVMVDKFDPT

SEQ ID NO: 201393 - protein, 10 aa, Tick-borne encephalitis virus
VMVDKFDPTD

SEQ ID NO: 201394 - protein, 10 aa, Tick-borne encephalitis virus
MVDKFDPTDY

SEQ ID NO: 201395 - protein, 10 aa, Tick-borne encephalitis virus
LDPTDYRGGV

SEQ ID NO: 201396 - protein, 10 aa, Tick-borne encephalitis virus
DPTDYRGGVS

SEQ ID NO: 201397 - protein, 10 aa, Tick-borne encephalitis virus
PTDYRGGVSG

SEQ ID NO: 201398 - protein, 10 aa, Tick-borne encephalitis virus
TDYRGGVSGL

SEQ ID NO: 201399 - protein, 10 aa, Tick-borne encephalitis virus
DYRGGVSGLL

SEQ ID NO: 201400 - protein, 10 aa, Tick-borne encephalitis virus
YRGGIPGLLR

SEQ ID NO: 201401 - protein, 10 aa, Tick-borne encephalitis virus
RGGIPGLLRK

SEQ ID NO: 201402 - protein, 10 aa, Tick-borne encephalitis virus
GGVSGLLRKG

SEQ ID NO: 201403 - protein, 10 aa, Tick-borne encephalitis virus
GIPGLLRKGK

SEQ ID NO: 201404 - protein, 10 aa, Tick-borne encephalitis virus
VSGLLRKGKD

SEQ ID NO: 201405 - protein, 10 aa, Tick-borne encephalitis virus
SGLLRKGKDI

SEQ ID NO: 201406 - protein, 10 aa, Tick-borne encephalitis virus
GLLKKGKDIR

SEQ ID NO: 201407 - protein, 10 aa, Tick-borne encephalitis virus
LLKKGKDIRV

SEQ ID NO: 201408 - protein, 10 aa, Tick-borne encephalitis virus
LKKGKDIRVS

SEQ ID NO: 201409 - protein, 10 aa, Tick-borne encephalitis virus
KKGKDIRVSW

SEQ ID NO: 201410 - protein, 10 aa, Tick-borne encephalitis virus
KGKDIKVSWR

SEQ ID NO: 201411 - protein, 10 aa, Tick-borne encephalitis virus
GKDIRVSWKS

SEQ ID NO: 201412 - protein, 10 aa, Tick-borne encephalitis virus
KDIKVSWRSW

SEQ ID NO: 201413 - protein, 10 aa, Tick-borne encephalitis virus
DIKVSWRSWG

SEQ ID NO: 201414 - protein, 10 aa, Tick-borne encephalitis virus
IRVSWKSWGH

SEQ ID NO: 201415 - protein, 10 aa, Tick-borne encephalitis virus
KVSWKSWGQA

SEQ ID NO: 201416 - protein, 10 aa, Tick-borne encephalitis virus
IIWSIPEAPR

SEQ ID NO: 201417 - protein, 10 aa, Tick-borne encephalitis virus
IWSIPEASRR

SEQ ID NO: 201418 - protein, 10 aa, Tick-borne encephalitis virus
WSIPEASRRF

SEQ ID NO: 201419 - protein, 10 aa, Tick-borne encephalitis virus
SIPEASRRFM

SEQ ID NO: 201420 - protein, 10 aa, Tick-borne encephalitis virus
IPEASRRFMV

SEQ ID NO: 201421 - protein, 10 aa, Tick-borne encephalitis virus
EASRRFMVGT

SEQ ID NO: 201422 - protein, 10 aa, Tick-borne encephalitis virus
ASRRFMVGTE

SEQ ID NO: 201423 - protein, 10 aa, Tick-borne encephalitis virus
SRRFMVGTEG

SEQ ID NO: 201424 - protein, 10 aa, Tick-borne encephalitis virus
RRFMVGTEGQ

SEQ ID NO: 201425 - protein, 10 aa, Tick-borne encephalitis virus
SECPPERRKT

SEQ ID NO: 201426 - protein, 10 aa, Tick-borne encephalitis virus
CPPERRKTGV

SEQ ID NO: 201427 - protein, 10 aa, Tick-borne encephalitis virus
PLERRKTGIF

SEQ ID NO: 201428 - protein, 10 aa, Tick-borne encephalitis virus
PERRKTGVFT

SEQ ID NO: 201429 - protein, 10 aa, Tick-borne encephalitis virus
KVFLDFRQEA

SEQ ID NO: 201430 - protein, 10 aa, Tick-borne encephalitis virus
VFVDFRQEST

SEQ ID NO: 201431 - protein, 10 aa, Tick-borne encephalitis virus
FLDFRQEATH

SEQ ID NO: 201432 - protein, 10 aa, Tick-borne encephalitis virus
VDFRQESTHE

SEQ ID NO: 201433 - protein, 10 aa, Tick-borne encephalitis virus
DFRQEATHEC

SEQ ID NO: 201434 - protein, 10 aa, Tick-borne encephalitis virus
FRQEATHECD

SEQ ID NO: 201435 - protein, 10 aa, Tick-borne encephalitis virus
RQEATHECDT

SEQ ID NO: 201436 - protein, 10 aa, Tick-borne encephalitis virus
QEATHECDTG

SEQ ID NO: 201437 - protein, 10 aa, Tick-borne encephalitis virus
EATHECDTGV

SEQ ID NO: 201438 - protein, 10 aa, Tick-borne encephalitis virus
ATHECDTGVM

SEQ ID NO: 201439 - protein, 10 aa, Tick-borne encephalitis virus
IHTDQSLWMK

SEQ ID NO: 201440 - protein, 10 aa, Tick-borne encephalitis virus
TDQSLWMKSM

SEQ ID NO: 201441 - protein, 10 aa, Tick-borne encephalitis virus
DQSLWMKSVK

SEQ ID NO: 201442 - protein, 10 aa, Tick-borne encephalitis virus
QSLWMKSVKN

SEQ ID NO: 201443 - protein, 10 aa, Tick-borne encephalitis virus
SLWMKSVKND

SEQ ID NO: 201444 - protein, 10 aa, Tick-borne encephalitis virus
LWMKSVKNDT

SEQ ID NO: 201445 - protein, 10 aa, Tick-borne encephalitis virus
WMKSVKNDTG

SEQ ID NO: 201446 - protein, 10 aa, Tick-borne encephalitis virus
MKSVKNDTGT

SEQ ID NO: 201447 - protein, 10 aa, Tick-borne encephalitis virus
KSVKNDTGTY

SEQ ID NO: 201448 - protein, 10 aa, Tick-borne encephalitis virus
SVKNDTGTYI

SEQ ID NO: 201449 - protein, 10 aa, Tick-borne encephalitis virus
VKNDTGTYIV

SEQ ID NO: 201450 - protein, 10 aa, Tick-borne encephalitis virus
RNETGTYIVE

SEQ ID NO: 201451 - protein, 10 aa, Tick-borne encephalitis virus
PASHTIDNPE

SEQ ID NO: 201452 - protein, 10 aa, Tick-borne encephalitis virus
ASHTIDNPEV

SEQ ID NO: 201453 - protein, 10 aa, Tick-borne encephalitis virus
SHTIDNPEVV

SEQ ID NO: 201454 - protein, 10 aa, Tick-borne encephalitis virus
HTIDNPEVVD

SEQ ID NO: 201455 - protein, 10 aa, Tick-borne encephalitis virus
TIDNPEVVDS

SEQ ID NO: 201456 - protein, 10 aa, Tick-borne encephalitis virus
IDNPEVVDSE

SEQ ID NO: 201457 - protein, 10 aa, Tick-borne encephalitis virus
DNADVVDSES

SEQ ID NO: 201458 - protein, 10 aa, Tick-borne encephalitis virus
NADVVDSESF

SEQ ID NO: 201459 - protein, 10 aa, Tick-borne encephalitis virus
ADVVDSESFL

SEQ ID NO: 201460 - protein, 10 aa, Tick-borne encephalitis virus
DVVDSESFLP

SEQ ID NO: 201461 - protein, 10 aa, Tick-borne encephalitis virus
SEQVKGPWKH

SEQ ID NO: 201462 - protein, 10 aa, Tick-borne encephalitis virus
EQVKGPWKYT

SEQ ID NO: 201463 - protein, 10 aa, Tick-borne encephalitis virus
QVKGPWKYTP

SEQ ID NO: 201464 - protein, 10 aa, Tick-borne encephalitis virus
VKGPWKYTPI

SEQ ID NO: 201465 - protein, 10 aa, Tick-borne encephalitis virus
KGPWKYTPIR

SEQ ID NO: 201466 - protein, 10 aa, Tick-borne encephalitis virus
GPWKYTPIRV

SEQ ID NO: 201467 - protein, 10 aa, Tick-borne encephalitis virus
PIRVVRGECP

SEQ ID NO: 201468 - protein, 10 aa, Tick-borne encephalitis virus
IRVVRGECPG

SEQ ID NO: 201469 - protein, 10 aa, Tick-borne encephalitis virus
RVVRGECPGT

SEQ ID NO: 201470 - protein, 10 aa, Tick-borne encephalitis virus
VTREECPGTK

SEQ ID NO: 201471 - protein, 10 aa, Tick-borne encephalitis virus
TREECPGTKV

SEQ ID NO: 201472 - protein, 10 aa, Tick-borne encephalitis virus
ISADCDKRGA

SEQ ID NO: 201473 - protein, 10 aa, Tick-borne encephalitis virus
SADCDKRGAS

SEQ ID NO: 201474 - protein, 10 aa, Tick-borne encephalitis virus
ADCDRRGASV

SEQ ID NO: 201475 - protein, 10 aa, Tick-borne encephalitis virus
DCDRRGASVR

SEQ ID NO: 201476 - protein, 10 aa, Tick-borne encephalitis virus
RTCTLPPVTI

SEQ ID NO: 201477 - protein, 10 aa, Tick-borne encephalitis virus
TCTLPPVTIR

SEQ ID NO: 201478 - protein, 10 aa, Tick-borne encephalitis virus
CTLPPVTIRT

SEQ ID NO: 201479 - protein, 10 aa, Tick-borne encephalitis virus
TLPPVTIRTG

SEQ ID NO: 201480 - protein, 10 aa, Tick-borne encephalitis virus
LPPVTIRTGT

SEQ ID NO: 201481 - protein, 10 aa, Tick-borne encephalitis virus
HDQGGLIRSM

SEQ ID NO: 201482 - protein, 10 aa, Tick-borne encephalitis virus
DQGGLVRSTV

SEQ ID NO: 201483 - protein, 10 aa, Tick-borne encephalitis virus
QGGLIRSMVV

SEQ ID NO: 201484 - protein, 10 aa, Tick-borne encephalitis virus
GGLIRSMVVA

SEQ ID NO: 201485 - protein, 10 aa, Tick-borne encephalitis virus
GLVRSTVVAD

SEQ ID NO: 201486 - protein, 10 aa, Tick-borne encephalitis virus
LIRSMVVADN

SEQ ID NO: 201487 - protein, 10 aa, Tick-borne encephalitis virus
VRSTVVADNG

SEQ ID NO: 201488 - protein, 10 aa, Tick-borne encephalitis virus
IIRRRPSTGS

SEQ ID NO: 201489 - protein, 10 aa, Tick-borne encephalitis virus
IRRRPATGTA

SEQ ID NO: 201490 - protein, 10 aa, Tick-borne encephalitis virus
RRRPATGTAV

SEQ ID NO: 201491 - protein, 10 aa, Tick-borne encephalitis virus
RRPATGTAVV

SEQ ID NO: 201492 - protein, 10 aa, Tick-borne encephalitis virus
RPATGTAVVW

SEQ ID NO: 201493 - protein, 10 aa, Tick-borne encephalitis virus
PATGTAVVWG

SEQ ID NO: 201494 - protein, 10 aa, Tick-borne encephalitis virus
ATGTAVVWGG

SEQ ID NO: 201495 - protein, 10 aa, Tick-borne encephalitis virus
WGGFVVLALL

SEQ ID NO: 201496 - protein, 10 aa, Tick-borne encephalitis virus
GGFVVLALLV

SEQ ID NO: 201497 - protein, 10 aa, Tick-borne encephalitis virus
GFVVLALLVT

SEQ ID NO: 201498 - protein, 10 aa, Tick-borne encephalitis virus
FVVLALLVTG

SEQ ID NO: 201499 - protein, 10 aa, Tick-borne encephalitis virus
VVFALLVTGL

SEQ ID NO: 201500 - protein, 10 aa, Tick-borne encephalitis virus
VFALLVTGLV

SEQ ID NO: 201501 - protein, 10 aa, Tick-borne encephalitis virus
LALLVTGLVK

SEQ ID NO: 201502 - protein, 10 aa, Tick-borne encephalitis virus
VRMESLVRYV

SEQ ID NO: 201503 - protein, 10 aa, Tick-borne encephalitis virus
RMESLVRYVV

SEQ ID NO: 201504 - protein, 10 aa, Tick-borne encephalitis virus
MESLVRYVVA

SEQ ID NO: 201505 - protein, 10 aa, Tick-borne encephalitis virus
VVAVGITFHF

SEQ ID NO: 201506 - protein, 10 aa, Tick-borne encephalitis virus
VAVGITFHFE

SEQ ID NO: 201507 - protein, 10 aa, Tick-borne encephalitis virus
AVGIAFHLEL

SEQ ID NO: 201508 - protein, 10 aa, Tick-borne encephalitis virus
VGIAFHLELG

SEQ ID NO: 201509 - protein, 10 aa, Tick-borne encephalitis virus
GIAFHLELGP

SEQ ID NO: 201510 - protein, 10 aa, Tick-borne encephalitis virus
IAFHLELGPE

SEQ ID NO: 201511 - protein, 10 aa, Tick-borne encephalitis virus
AFHLELGPEI

SEQ ID NO: 201512 - protein, 10 aa, Tick-borne encephalitis virus
LLSAFALRRG

SEQ ID NO: 201513 - protein, 10 aa, Tick-borne encephalitis virus
LSAFALRRGL

SEQ ID NO: 201514 - protein, 10 aa, Tick-borne encephalitis virus
SAFALRRGLT

SEQ ID NO: 201515 - protein, 10 aa, Tick-borne encephalitis virus
AFALRRGLTV

SEQ ID NO: 201516 - protein, 10 aa, Tick-borne encephalitis virus
FALRRGLTVR

SEQ ID NO: 201517 - protein, 10 aa, Tick-borne encephalitis virus
ALRRGLTVRE

SEQ ID NO: 201518 - protein, 10 aa, Tick-borne encephalitis virus
LRRGLTVREM

SEQ ID NO: 201519 - protein, 10 aa, Tick-borne encephalitis virus
RRGLTVREMV

SEQ ID NO: 201520 - protein, 10 aa, Tick-borne encephalitis virus
RGLTVREMVT

SEQ ID NO: 201521 - protein, 10 aa, Tick-borne encephalitis virus
GLTVREMVTI

SEQ ID NO: 201522 - protein, 10 aa, Tick-borne encephalitis virus
LTVREMVITY

SEQ ID NO: 201523 - protein, 10 aa, Tick-borne encephalitis virus
TVREMVITYF

SEQ ID NO: 201524 - protein, 10 aa, Tick-borne encephalitis virus
VREMVITYFL

SEQ ID NO: 201525 - protein, 10 aa, Tick-borne encephalitis virus
REMVITYFLL

SEQ ID NO: 201526 - protein, 10 aa, Tick-borne encephalitis virus
EMVITYFLLL

SEQ ID NO: 201527 - protein, 10 aa, Tick-borne encephalitis virus
MVITYFLLLV

SEQ ID NO: 201528 - protein, 10 aa, Tick-borne encephalitis virus
VITYFLLLVL

SEQ ID NO: 201529 - protein, 10 aa, Tick-borne encephalitis virus
ITYFLLLVLE

SEQ ID NO: 201530 - protein, 10 aa, Tick-borne encephalitis virus
LLVLELGLPY

SEQ ID NO: 201531 - protein, 10 aa, Tick-borne encephalitis virus
LWRWGDALAM

SEQ ID NO: 201532 - protein, 10 aa, Tick-borne encephalitis virus
LILRACTAEG

SEQ ID NO: 201533 - protein, 10 aa, Tick-borne encephalitis virus
ILRACTAEGK

SEQ ID NO: 201534 - protein, 10 aa, Tick-borne encephalitis virus
FRACTAEGKA

SEQ ID NO: 201535 - protein, 10 aa, Tick-borne encephalitis virus
RACTAEGKAG

SEQ ID NO: 201536 - protein, 10 aa, Tick-borne encephalitis virus
ACTAEGKAGV

SEQ ID NO: 201537 - protein, 10 aa, Tick-borne encephalitis virus
CTAEGKTGVG

SEQ ID NO: 201538 - protein, 10 aa, Tick-borne encephalitis virus
TAEGKTGVGL

SEQ ID NO: 201539 - protein, 10 aa, Tick-borne encephalitis virus
AEGKAGVGLL

SEQ ID NO: 201540 - protein, 10 aa, Tick-borne encephalitis virus
EGKAGVGLLL

SEQ ID NO: 201541 - protein, 10 aa, Tick-borne encephalitis virus
GKTGVGLLLM

SEQ ID NO: 201542 - protein, 10 aa, Tick-borne encephalitis virus
KAGVGLLLMA

SEQ ID NO: 201543 - protein, 10 aa, Tick-borne encephalitis virus
AGVGLLLMAL

SEQ ID NO: 201544 - protein, 10 aa, Tick-borne encephalitis virus
GVGLLLMALI

SEQ ID NO: 201545 - protein, 10 aa, Tick-borne encephalitis virus
VGLLLMPLLT

SEQ ID NO: 201546 - protein, 10 aa, Tick-borne encephalitis virus
GLLLMALITQ

SEQ ID NO: 201547 - protein, 10 aa, Tick-borne encephalitis virus
LLLMPLLTKR

SEQ ID NO: 201548 - protein, 10 aa, Tick-borne encephalitis virus
LLMPLLTKRG

SEQ ID NO: 201549 - protein, 10 aa, Tick-borne encephalitis virus
WRLLKGHREQ

SEQ ID NO: 201550 - protein, 10 aa, Tick-borne encephalitis virus
RLLKGHREQK

SEQ ID NO: 201551 - protein, 10 aa, Tick-borne encephalitis virus
LLRGHREQKG

SEQ ID NO: 201552 - protein, 10 aa, Tick-borne encephalitis virus
LRGHREQKGL

SEQ ID NO: 201553 - protein, 10 aa, Tick-borne encephalitis virus
RGHREQKGLS

SEQ ID NO: 201554 - protein, 10 aa, Tick-borne encephalitis virus
HREQKGLTWV

SEQ ID NO: 201555 - protein, 10 aa, Tick-borne encephalitis virus
REQKGLSWIV

SEQ ID NO: 201556 - protein, 10 aa, Tick-borne encephalitis virus
EQKGLSWIVP

SEQ ID NO: 201557 - protein, 10 aa, Tick-borne encephalitis virus
QKGLSWIVPL

SEQ ID NO: 201558 - protein, 10 aa, Tick-borne encephalitis virus
KGLSWIVPLA

SEQ ID NO: 201559 - protein, 10 aa, Tick-borne encephalitis virus
VPLAGLMGGE

SEQ ID NO: 201560 - protein, 10 aa, Tick-borne encephalitis virus
PLAGLMGGEG

SEQ ID NO: 201561 - protein, 10 aa, Tick-borne encephalitis virus
LAGLMGGEGS

SEQ ID NO: 201562 - protein, 10 aa, Tick-borne encephalitis virus
AGLMGGEGSG

SEQ ID NO: 201563 - protein, 10 aa, Tick-borne encephalitis virus
GLLGGEGSGI

SEQ ID NO: 201564 - protein, 10 aa, Tick-borne encephalitis virus
LMGGEGSGIR

SEQ ID NO: 201565 - protein, 10 aa, Tick-borne encephalitis virus
MGGEGSGIRL

SEQ ID NO: 201566 - protein, 10 aa, Tick-borne encephalitis virus
GEGSGIRLLS

SEQ ID NO: 201567 - protein, 10 aa, Tick-borne encephalitis virus
EGSGIRLLSF

SEQ ID NO: 201568 - protein, 10 aa, Tick-borne encephalitis virus
GSGIRLLSFW

SEQ ID NO: 201569 - protein, 10 aa, Tick-borne encephalitis virus
SGIRLLSFWE

SEQ ID NO: 201570 - protein, 10 aa, Tick-borne encephalitis virus
GIRLLSFWEL

SEQ ID NO: 201571 - protein, 10 aa, Tick-borne encephalitis virus
IRLLAFWELA

SEQ ID NO: 201572 - protein, 10 aa, Tick-borne encephalitis virus
HGKRRSFSEP

SEQ ID NO: 201573 - protein, 10 aa, Tick-borne encephalitis virus
GKRRSFSEPL

SEQ ID NO: 201574 - protein, 10 aa, Tick-borne encephalitis virus
KRRSFSEPLT

SEQ ID NO: 201575 - protein, 10 aa, Tick-borne encephalitis virus
LASGMMRHTP

SEQ ID NO: 201576 - protein, 10 aa, Tick-borne encephalitis virus
ASGMMRHTPQ

SEQ ID NO: 201577 - protein, 10 aa, Tick-borne encephalitis virus
SGMMRHTPQE

SEQ ID NO: 201578 - protein, 10 aa, Tick-borne encephalitis virus
GCVEWYPELV

SEQ ID NO: 201579 - protein, 10 aa, Tick-borne encephalitis virus
CVEWYPELVN

SEQ ID NO: 201580 - protein, 10 aa, Tick-borne encephalitis virus
VEWYPELVNE

SEQ ID NO: 201581 - protein, 10 aa, Tick-borne encephalitis virus
EWYPELVNEG

SEQ ID NO: 201582 - protein, 10 aa, Tick-borne encephalitis virus
WYPELVNEGG

SEQ ID NO: 201583 - protein, 10 aa, Tick-borne encephalitis virus
YPELVNEGGE

SEQ ID NO: 201584 - protein, 10 aa, Tick-borne encephalitis virus
EERMMAFWLI

SEQ ID NO: 201585 - protein, 10 aa, Tick-borne encephalitis virus
ERMMAFWLIA

SEQ ID NO: 201586 - protein, 10 aa, Tick-borne encephalitis virus
RMMAFWLIAG

SEQ ID NO: 201587 - protein, 10 aa, Tick-borne encephalitis virus
MMAFWLIAGL

SEQ ID NO: 201588 - protein, 10 aa, Tick-borne encephalitis virus
MAFWLLAGLS

SEQ ID NO: 201589 - protein, 10 aa, Tick-borne encephalitis virus
AFWLLAGLSA

SEQ ID NO: 201590 - protein, 10 aa, Tick-borne encephalitis virus
FWLLAGLSAS

SEQ ID NO: 201591 - protein, 10 aa, Tick-borne encephalitis virus
WLLAGLSASA

SEQ ID NO: 201592 - protein, 10 aa, Tick-borne encephalitis virus
AGLAASAVHW

SEQ ID NO: 201593 - protein, 10 aa, Tick-borne encephalitis virus
GLAASAVHWS

SEQ ID NO: 201594 - protein, 10 aa, Tick-borne encephalitis virus
LAASAVHWSG

SEQ ID NO: 201595 - protein, 10 aa, Tick-borne encephalitis virus
AASAVHWSGI

SEQ ID NO: 201596 - protein, 10 aa, Tick-borne encephalitis virus
ASAVHWSGIL

SEQ ID NO: 201597 - protein, 10 aa, Tick-borne encephalitis virus
SAVHWSGILG

SEQ ID NO: 201598 - protein, 10 aa, Tick-borne encephalitis virus
AVHWSGILGV

SEQ ID NO: 201599 - protein, 10 aa, Tick-borne encephalitis virus
VHWSGILGVM

SEQ ID NO: 201600 - protein, 10 aa, Tick-borne encephalitis virus
IGVMGLWTLT

SEQ ID NO: 201601 - protein, 10 aa, Tick-borne encephalitis virus
GVMGLWTLTK

SEQ ID NO: 201602 - protein, 10 aa, Tick-borne encephalitis virus
VMGLWTLTKM

SEQ ID NO: 201603 - protein, 10 aa, Tick-borne encephalitis virus
MGLWTLSEMM

SEQ ID NO: 201604 - protein, 10 aa, Tick-borne encephalitis virus
GLWTLSEMMR

SEQ ID NO: 201605 - protein, 10 aa, Tick-borne encephalitis virus
ARRSGLVFSG

SEQ ID NO: 201606 - protein, 10 aa, Tick-borne encephalitis virus
RRSGLVFSGQ

SEQ ID NO: 201607 - protein, 10 aa, Tick-borne encephalitis virus
RSGLVFSGQG

SEQ ID NO: 201608 - protein, 10 aa, Tick-borne encephalitis virus
SDLVFSGQGR

SEQ ID NO: 201609 - protein, 10 aa, Tick-borne encephalitis virus
DLVFSGQGNR

SEQ ID NO: 201610 - protein, 10 aa, Tick-borne encephalitis virus
LAFSGQGGRE

SEQ ID NO: 201611 - protein, 10 aa, Tick-borne encephalitis virus
VFSGQGNRER

SEQ ID NO: 201612 - protein, 10 aa, Tick-borne encephalitis virus
FSGQGNRERG

SEQ ID NO: 201613 - protein, 10 aa, Tick-borne encephalitis virus
SGQGNRERGD

SEQ ID NO: 201614 - protein, 10 aa, Tick-borne encephalitis virus
GQGRGERGDK

SEQ ID NO: 201615 - protein, 10 aa, Tick-borne encephalitis virus
QGRGERGDKP

SEQ ID NO: 201616 - protein, 10 aa, Tick-borne encephalitis virus
GNRERGDRPF

SEQ ID NO: 201617 - protein, 10 aa, Tick-borne encephalitis virus
RGERGDKPFE

SEQ ID NO: 201618 - protein, 10 aa, Tick-borne encephalitis virus
GERGDKPFEV

SEQ ID NO: 201619 - protein, 10 aa, Tick-borne encephalitis virus
ERGDRPFEVR

SEQ ID NO: 201620 - protein, 10 aa, Tick-borne encephalitis virus
RGDRPFEVRD

SEQ ID NO: 201621 - protein, 10 aa, Tick-borne encephalitis virus
GDRPFEVRDG

SEQ ID NO: 201622 - protein, 10 aa, Tick-borne encephalitis virus
DRPFEVRDGV

SEQ ID NO: 201623 - protein, 10 aa, Tick-borne encephalitis virus
RPFEVRDGVY

SEQ ID NO: 201624 - protein, 10 aa, Tick-borne encephalitis virus
FSPGLFWGQS

SEQ ID NO: 201625 - protein, 10 aa, Tick-borne encephalitis virus
SPGLFWGQRQ

SEQ ID NO: 201626 - protein, 10 aa, Tick-borne encephalitis virus
PGLFWGQSQV

SEQ ID NO: 201627 - protein, 10 aa, Tick-borne encephalitis virus
GLFWGQRQVG

SEQ ID NO: 201628 - protein, 10 aa, Tick-borne encephalitis virus
LFWGQSQVGV

SEQ ID NO: 201629 - protein, 10 aa, Tick-borne encephalitis virus
FWGQSQVGVG

SEQ ID NO: 201630 - protein, 10 aa, Tick-borne encephalitis virus
WGQSQVGVGY

SEQ ID NO: 201631 - protein, 10 aa, Tick-borne encephalitis virus
GQSQVGVGYG

SEQ ID NO: 201632 - protein, 10 aa, Tick-borne encephalitis virus
QNQVGVGYGS

SEQ ID NO: 201633 - protein, 10 aa, Tick-borne encephalitis virus
NQVGVGYGSK

SEQ ID NO: 201634 - protein, 10 aa, Tick-borne encephalitis virus
QVGVGYGFRG

SEQ ID NO: 201635 - protein, 10 aa, Tick-borne encephalitis virus
VGVGYGFRGV

SEQ ID NO: 201636 - protein, 10 aa, Tick-borne encephalitis virus
GVGYGFRGVL

SEQ ID NO: 201637 - protein, 10 aa, Tick-borne encephalitis virus
VGYGFRGVLH

SEQ ID NO: 201638 - protein, 10 aa, Tick-borne encephalitis virus
GYGFRGVLHT

SEQ ID NO: 201639 - protein, 10 aa, Tick-borne encephalitis virus
YGFRGVLHTM

SEQ ID NO: 201640 - protein, 10 aa, Tick-borne encephalitis virus
GFRGVLHTMW

SEQ ID NO: 201641 - protein, 10 aa, Tick-borne encephalitis virus
FRGVLHTMWH

SEQ ID NO: 201642 - protein, 10 aa, Tick-borne encephalitis virus
HVTRGAALSV

SEQ ID NO: 201643 - protein, 10 aa, Tick-borne encephalitis virus
VTRGAALYID

SEQ ID NO: 201644 - protein, 10 aa, Tick-borne encephalitis virus
TRGAALSVDD

SEQ ID NO: 201645 - protein, 10 aa, Tick-borne encephalitis virus
RGAALSVDDA

SEQ ID NO: 201646 - protein, 10 aa, Tick-borne encephalitis virus
GAALSVDDAV

SEQ ID NO: 201647 - protein, 10 aa, Tick-borne encephalitis virus
AALSVDDAVV

SEQ ID NO: 201648 - protein, 10 aa, Tick-borne encephalitis virus
ALSVDDAVVG

SEQ ID NO: 201649 - protein, 10 aa, Tick-borne encephalitis virus
LSIDDAVVGP

SEQ ID NO: 201650 - protein, 10 aa, Tick-borne encephalitis virus
SVDDAVVGPY

SEQ ID NO: 201651 - protein, 10 aa, Tick-borne encephalitis virus
IDDAVVGPYW

SEQ ID NO: 201652 - protein, 10 aa, Tick-borne encephalitis virus
DDAVVGPYWA

SEQ ID NO: 201653 - protein, 10 aa, Tick-borne encephalitis virus
DAVAGPYWAE

SEQ ID NO: 201654 - protein, 10 aa, Tick-borne encephalitis virus
AVAGPYWAEV

SEQ ID NO: 201655 - protein, 10 aa, Tick-borne encephalitis virus
VVGPYWADVK

SEQ ID NO: 201656 - protein, 10 aa, Tick-borne encephalitis virus
VGPYWADVKE

SEQ ID NO: 201657 - protein, 10 aa, Tick-borne encephalitis virus
GPYWSDVRED

SEQ ID NO: 201658 - protein, 10 aa, Tick-borne encephalitis virus
PYWSDVREDV

SEQ ID NO: 201659 - protein, 10 aa, Tick-borne encephalitis virus
YWAEVKEDVV

SEQ ID NO: 201660 - protein, 10 aa, Tick-borne encephalitis virus
WAEVKEDVVC

SEQ ID NO: 201661 - protein, 10 aa, Tick-borne encephalitis virus
AEVKEDVVCY

SEQ ID NO: 201662 - protein, 10 aa, Tick-borne encephalitis virus
EVKEDVVCYG

SEQ ID NO: 201663 - protein, 10 aa, Tick-borne encephalitis virus
KEDVVCYGGT

SEQ ID NO: 201664 - protein, 10 aa, Tick-borne encephalitis virus
GTWSLEEKWK

SEQ ID NO: 201665 - protein, 10 aa, Tick-borne encephalitis virus
TWSLEEKWKG

SEQ ID NO: 201666 - protein, 10 aa, Tick-borne encephalitis virus
PGELLLDTGG

SEQ ID NO: 201667 - protein, 10 aa, Tick-borne encephalitis virus
GELLLDTGGR

SEQ ID NO: 201668 - protein, 10 aa, Tick-borne encephalitis virus
GAIPIDLAKG

SEQ ID NO: 201669 - protein, 10 aa, Tick-borne encephalitis virus
AIPIDLAKGT

SEQ ID NO: 201670 - protein, 10 aa, Tick-borne encephalitis virus
IPIDLAKGTS

SEQ ID NO: 201671 - protein, 10 aa, Tick-borne encephalitis virus
LIDLSKGTSR

SEQ ID NO: 201672 - protein, 10 aa, Tick-borne encephalitis virus
IDLSKGTSRS

SEQ ID NO: 201673 - protein, 10 aa, Tick-borne encephalitis virus
DLSKGTSRSP

SEQ ID NO: 201674 - protein, 10 aa, Tick-borne encephalitis virus
LAKGTSGSPT

SEQ ID NO: 201675 - protein, 10 aa, Tick-borne encephalitis virus
SKGTSRSPIL

SEQ ID NO: 201676 - protein, 10 aa, Tick-borne encephalitis virus
KGTSRSPILN

SEQ ID NO: 201677 - protein, 10 aa, Tick-borne encephalitis virus
GTSRSPILNA

SEQ ID NO: 201678 - protein, 10 aa, Tick-borne encephalitis virus
TSGSPIINSQ

SEQ ID NO: 201679 - protein, 10 aa, Tick-borne encephalitis virus
SRSPILNAQG

SEQ ID NO: 201680 - protein, 10 aa, Tick-borne encephalitis virus
SPILNAQGAV

SEQ ID NO: 201681 - protein, 10 aa, Tick-borne encephalitis virus
PILNAQGAVV

SEQ ID NO: 201682 - protein, 10 aa, Tick-borne encephalitis virus
ILNAQGAVVG

SEQ ID NO: 201683 - protein, 10 aa, Tick-borne encephalitis virus
LNAQGAVVGL

SEQ ID NO: 201684 - protein, 10 aa, Tick-borne encephalitis virus
NAQGAVVGLY

SEQ ID NO: 201685 - protein, 10 aa, Tick-borne encephalitis virus
AQGAVVGLYG

SEQ ID NO: 201686 - protein, 10 aa, Tick-borne encephalitis virus
SSIAQGEAER

SEQ ID NO: 201687 - protein, 10 aa, Tick-borne encephalitis virus
SIAQGEAERS

SEQ ID NO: 201688 - protein, 10 aa, Tick-borne encephalitis virus
IAQGEAERSR

SEQ ID NO: 201689 - protein, 10 aa, Tick-borne encephalitis virus
AQGEAERSRP

SEQ ID NO: 201690 - protein, 10 aa, Tick-borne encephalitis virus
QGEAERSRPN

SEQ ID NO: 201691 - protein, 10 aa, Tick-borne encephalitis virus
GEAERSRPNL

SEQ ID NO: 201692 - protein, 10 aa, Tick-borne encephalitis virus
EAEKSRPSLP

SEQ ID NO: 201693 - protein, 10 aa, Tick-borne encephalitis virus
VEKSRPNLPQ

SEQ ID NO: 201694 - protein, 10 aa, Tick-borne encephalitis virus
ERSRPNLPQA

SEQ ID NO: 201695 - protein, 10 aa, Tick-borne encephalitis virus
KSRPSLPPAV

SEQ ID NO: 201696 - protein, 10 aa, Tick-borne encephalitis virus
GMGWTAKGQI

SEQ ID NO: 201697 - protein, 10 aa, Tick-borne encephalitis virus
MGWTAKGQIT

SEQ ID NO: 201698 - protein, 10 aa, Tick-borne encephalitis virus
VLKEMERALT

SEQ ID NO: 201699 - protein, 10 aa, Tick-borne encephalitis virus
LKEMERALTG

SEQ ID NO: 201700 - protein, 10 aa, Tick-borne encephalitis virus
KEMERALTGK

SEQ ID NO: 201701 - protein, 10 aa, Tick-borne encephalitis virus
EMERALTGKR

SEQ ID NO: 201702 - protein, 10 aa, Tick-borne encephalitis virus
MERALTGKRV

SEQ ID NO: 201703 - protein, 10 aa, Tick-borne encephalitis virus
ERALTGKRVR

SEQ ID NO: 201704 - protein, 10 aa, Tick-borne encephalitis virus
RALTGKRVRF

SEQ ID NO: 201705 - protein, 10 aa, Tick-borne encephalitis virus
ALTGKRVRFL

SEQ ID NO: 201706 - protein, 10 aa, Tick-borne encephalitis virus
LTGKRVRFLS

SEQ ID NO: 201707 - protein, 10 aa, Tick-borne encephalitis virus
TGKRVRFLSP

SEQ ID NO: 201708 - protein, 10 aa, Tick-borne encephalitis virus
GKRVRFLSPA

SEQ ID NO: 201709 - protein, 10 aa, Tick-borne encephalitis virus
KRVRFLSPAV

SEQ ID NO: 201710 - protein, 10 aa, Tick-borne encephalitis virus
RVRFLSPAVS

SEQ ID NO: 201711 - protein, 10 aa, Tick-borne encephalitis virus
VRFHSPVVGD

SEQ ID NO: 201712 - protein, 10 aa, Tick-borne encephalitis virus
RFHSPVVGDQ

SEQ ID NO: 201713 - protein, 10 aa, Tick-borne encephalitis virus
FHSPAVGDHQ

SEQ ID NO: 201714 - protein, 10 aa, Tick-borne encephalitis virus
DQQMGGAIVD

SEQ ID NO: 201715 - protein, 10 aa, Tick-borne encephalitis virus
GGAIVDLMCH

SEQ ID NO: 201716 - protein, 10 aa, Tick-borne encephalitis virus
GAIVDLMCHT

SEQ ID NO: 201717 - protein, 10 aa, Tick-borne encephalitis virus
AIVDLMCHTT

SEQ ID NO: 201718 - protein, 10 aa, Tick-borne encephalitis virus
DLMCHTTYVN

SEQ ID NO: 201719 - protein, 10 aa, Tick-borne encephalitis virus
LMCHTTYVNR

SEQ ID NO: 201720 - protein, 10 aa, Tick-borne encephalitis virus
MCHTTYVNRR

SEQ ID NO: 201721 - protein, 10 aa, Tick-borne encephalitis virus
CHATYVSRRL

SEQ ID NO: 201722 - protein, 10 aa, Tick-borne encephalitis virus
HATYVSRRLL

SEQ ID NO: 201723 - protein, 10 aa, Tick-borne encephalitis virus
ATYVSRRLLP

SEQ ID NO: 201724 - protein, 10 aa, Tick-borne encephalitis virus
PFPESNRGIT

SEQ ID NO: 201725 - protein, 10 aa, Tick-borne encephalitis virus
FPESNRGITS

SEQ ID NO: 201726 - protein, 10 aa, Tick-borne encephalitis virus
PESNRGITSE

SEQ ID NO: 201727 - protein, 10 aa, Tick-borne encephalitis virus
ESNRGITSEV

SEQ ID NO: 201728 - protein, 10 aa, Tick-borne encephalitis virus
SNGAITSEER

SEQ ID NO: 201729 - protein, 10 aa, Tick-borne encephalitis virus
NGAITSEERQ

SEQ ID NO: 201730 - protein, 10 aa, Tick-borne encephalitis virus
GAITSEERQI

SEQ ID NO: 201731 - protein, 10 aa, Tick-borne encephalitis virus
AITSEERQIP

SEQ ID NO: 201732 - protein, 10 aa, Tick-borne encephalitis virus
SEEKQIPEGE

SEQ ID NO: 201733 - protein, 10 aa, Tick-borne encephalitis virus
EEKQIPEGEW

SEQ ID NO: 201734 - protein, 10 aa, Tick-borne encephalitis virus
EKQIPEGEWR

SEQ ID NO: 201735 - protein, 10 aa, Tick-borne encephalitis virus
KQIPEGEWRD

SEQ ID NO: 201736 - protein, 10 aa, Tick-borne encephalitis virus
QIPNGEWRDG

SEQ ID NO: 201737 - protein, 10 aa, Tick-borne encephalitis virus
IPNGEWRDGF

SEQ ID NO: 201738 - protein, 10 aa, Tick-borne encephalitis virus
PNGEWRDGFD

SEQ ID NO: 201739 - protein, 10 aa, Tick-borne encephalitis virus
NGEWRDGFDW

SEQ ID NO: 201740 - protein, 10 aa, Tick-borne encephalitis virus
RTAWFVPSIV

SEQ ID NO: 201741 - protein, 10 aa, Tick-borne encephalitis virus
SAWFVPSIAK

SEQ ID NO: 201742 - protein, 10 aa, Tick-borne encephalitis virus
FVPSIAKGGV

SEQ ID NO: 201743 - protein, 10 aa, Tick-borne encephalitis virus
VPSIAKGGVI

SEQ ID NO: 201744 - protein, 10 aa, Tick-borne encephalitis virus
PSIAKGGVIA

SEQ ID NO: 201745 - protein, 10 aa, Tick-borne encephalitis virus
SIAKGGVIAR

SEQ ID NO: 201746 - protein, 10 aa, Tick-borne encephalitis virus
IAKGGVIART

SEQ ID NO: 201747 - protein, 10 aa, Tick-borne encephalitis virus
AKGGVIARTL

SEQ ID NO: 201748 - protein, 10 aa, Tick-borne encephalitis virus
KGGVIARTLR

SEQ ID NO: 201749 - protein, 10 aa, Tick-borne encephalitis virus
GGVIARTLRQ

SEQ ID NO: 201750 - protein, 10 aa, Tick-borne encephalitis virus
GVIARTLRQK

SEQ ID NO: 201751 - protein, 10 aa, Tick-borne encephalitis virus
VIARTLRQKG

SEQ ID NO: 201752 - protein, 10 aa, Tick-borne encephalitis virus
EEVDGRVELI

SEQ ID NO: 201753 - protein, 10 aa, Tick-borne encephalitis virus
EVDGRVELIG

SEQ ID NO: 201754 - protein, 10 aa, Tick-borne encephalitis virus
VDGRVELIGT

SEQ ID NO: 201755 - protein, 10 aa, Tick-borne encephalitis virus
DGRVELIGTR

SEQ ID NO: 201756 - protein, 10 aa, Tick-borne encephalitis virus
GRVELIGTRR

SEQ ID NO: 201757 - protein, 10 aa, Tick-borne encephalitis virus
RVELIGTRRV

SEQ ID NO: 201758 - protein, 10 aa, Tick-borne encephalitis virus
APRRGRVGRQ

SEQ ID NO: 201759 - protein, 10 aa, Tick-borne encephalitis virus
QRRGRVGRHE

SEQ ID NO: 201760 - protein, 10 aa, Tick-borne encephalitis virus
RRGRVGRHEG

SEQ ID NO: 201761 - protein, 10 aa, Tick-borne encephalitis virus
RGRVGRHEGR

SEQ ID NO: 201762 - protein, 10 aa, Tick-borne encephalitis virus
GRVGRHEGRT

SEQ ID NO: 201763 - protein, 10 aa, Tick-borne encephalitis virus
RVGRHEGRTD

SEQ ID NO: 201764 - protein, 10 aa, Tick-borne encephalitis virus
VGRHEGRTDE

SEQ ID NO: 201765 - protein, 10 aa, Tick-borne encephalitis virus
GRHEGRTDEY

SEQ ID NO: 201766 - protein, 10 aa, Tick-borne encephalitis virus
RHEGRTDEYI

SEQ ID NO: 201767 - protein, 10 aa, Tick-borne encephalitis virus
HEGRTDEYIY

SEQ ID NO: 201768 - protein, 10 aa, Tick-borne encephalitis virus
EGRIDEYIYS

SEQ ID NO: 201769 - protein, 10 aa, Tick-borne encephalitis virus
YSGQCDEYDS

SEQ ID NO: 201770 - protein, 10 aa, Tick-borne encephalitis virus
SGQCDDDDSV

SEQ ID NO: 201771 - protein, 10 aa, Tick-borne encephalitis virus
GQCDEYDSGL

SEQ ID NO: 201772 - protein, 10 aa, Tick-borne encephalitis virus
QCDEYDSGLV

SEQ ID NO: 201773 - protein, 10 aa, Tick-borne encephalitis virus
CDEYDSGLVQ

SEQ ID NO: 201774 - protein, 10 aa, Tick-borne encephalitis virus
DEYDSGLVQW

SEQ ID NO: 201775 - protein, 10 aa, Tick-borne encephalitis virus
DDDSVLVQWK

SEQ ID NO: 201776 - protein, 10 aa, Tick-borne encephalitis virus
DDGGLVQWKE

SEQ ID NO: 201777 - protein, 10 aa, Tick-borne encephalitis virus
DGGLVQWKEA

SEQ ID NO: 201778 - protein, 10 aa, Tick-borne encephalitis virus
GGLVQWKEAQ

SEQ ID NO: 201779 - protein, 10 aa, Tick-borne encephalitis virus
GLVQWKEGQI

SEQ ID NO: 201780 - protein, 10 aa, Tick-borne encephalitis virus
WKEGQILLDN

SEQ ID NO: 201781 - protein, 10 aa, Tick-borne encephalitis virus
KEGQILLDNI

SEQ ID NO: 201782 - protein, 10 aa, Tick-borne encephalitis virus
EAQILLDDIT

SEQ ID NO: 201783 - protein, 10 aa, Tick-borne encephalitis virus
AQILLDDITT

SEQ ID NO: 201784 - protein, 10 aa, Tick-borne encephalitis virus
QILLDDITTL

SEQ ID NO: 201785 - protein, 10 aa, Tick-borne encephalitis virus
ILLDNIITLR

SEQ ID NO: 201786 - protein, 10 aa, Tick-borne encephalitis virus
LLDNIITLRG

SEQ ID NO: 201787 - protein, 10 aa, Tick-borne encephalitis virus
LDNIITLRGP

SEQ ID NO: 201788 - protein, 10 aa, Tick-borne encephalitis virus
DNIITLRGPV

SEQ ID NO: 201789 - protein, 10 aa, Tick-borne encephalitis virus
NIITLRGPVA

SEQ ID NO: 201790 - protein, 10 aa, Tick-borne encephalitis virus
IITLRGPVAT

SEQ ID NO: 201791 - protein, 10 aa, Tick-borne encephalitis virus
TTLRGPVVTF

SEQ ID NO: 201792 - protein, 10 aa, Tick-borne encephalitis virus
VTFYGPEQDK

SEQ ID NO: 201793 - protein, 10 aa, Tick-borne encephalitis virus
DRMPEVAGHF

SEQ ID NO: 201794 - protein, 10 aa, Tick-borne encephalitis virus
RMPEVAGHFR

SEQ ID NO: 201795 - protein, 10 aa, Tick-borne encephalitis virus
VAANVSGVTS

SEQ ID NO: 201796 - protein, 10 aa, Tick-borne encephalitis virus
AANVSGVTSR

SEQ ID NO: 201797 - protein, 10 aa, Tick-borne encephalitis virus
ANVSSVTSRS

SEQ ID NO: 201798 - protein, 10 aa, Tick-borne encephalitis virus
NVSGVTSRNW

SEQ ID NO: 201799 - protein, 10 aa, Tick-borne encephalitis virus
VSSVTSRSWT

SEQ ID NO: 201800 - protein, 10 aa, Tick-borne encephalitis virus
SSVTSRSWTW

SEQ ID NO: 201801 - protein, 10 aa, Tick-borne encephalitis virus
GVTSRNWTWE

SEQ ID NO: 201802 - protein, 10 aa, Tick-borne encephalitis virus
VTSRSWTWEG

SEQ ID NO: 201803 - protein, 10 aa, Tick-borne encephalitis virus
TSRSWTWEGP

SEQ ID NO: 201804 - protein, 10 aa, Tick-borne encephalitis virus
SRSWTWEGPE

SEQ ID NO: 201805 - protein, 10 aa, Tick-borne encephalitis virus
RSWTWEGPEE

SEQ ID NO: 201806 - protein, 10 aa, Tick-borne encephalitis virus
SWTWEGPEEN

SEQ ID NO: 201807 - protein, 10 aa, Tick-borne encephalitis virus
WTWEGPEENA

SEQ ID NO: 201808 - protein, 10 aa, Tick-borne encephalitis virus
TWEGPEANAV

SEQ ID NO: 201809 - protein, 10 aa, Tick-borne encephalitis virus
WEGPEANAVD

SEQ ID NO: 201810 - protein, 10 aa, Tick-borne encephalitis virus
EGPEENAVDE

SEQ ID NO: 201811 - protein, 10 aa, Tick-borne encephalitis virus
GPEENAVDEA

SEQ ID NO: 201812 - protein, 10 aa, Tick-borne encephalitis virus
PEANAVDEAS

SEQ ID NO: 201813 - protein, 10 aa, Tick-borne encephalitis virus
EANAVDEASG

SEQ ID NO: 201814 - protein, 10 aa, Tick-borne encephalitis virus
ANAVDEASGD

SEQ ID NO: 201815 - protein, 10 aa, Tick-borne encephalitis virus
NAVDEASGDL

SEQ ID NO: 201816 - protein, 10 aa, Tick-borne encephalitis virus
AVDEASGDLV

SEQ ID NO: 201817 - protein, 10 aa, Tick-borne encephalitis virus
VDEASGGLVT

SEQ ID NO: 201818 - protein, 10 aa, Tick-borne encephalitis virus
DEASGGLVTF

SEQ ID NO: 201819 - protein, 10 aa, Tick-borne encephalitis virus
EANGDLVTFK

SEQ ID NO: 201820 - protein, 10 aa, Tick-borne encephalitis virus
ANGDLVTFKS

SEQ ID NO: 201821 - protein, 10 aa, Tick-borne encephalitis virus
NGDLVTFKSP

SEQ ID NO: 201822 - protein, 10 aa, Tick-borne encephalitis virus
GGLVTFRSPN

SEQ ID NO: 201823 - protein, 10 aa, Tick-borne encephalitis virus
GLVTFRSPNG

SEQ ID NO: 201824 - protein, 10 aa, Tick-borne encephalitis virus
AERTLKPVWR

SEQ ID NO: 201825 - protein, 10 aa, Tick-borne encephalitis virus
ERTLKPVWRD

SEQ ID NO: 201826 - protein, 10 aa, Tick-borne encephalitis virus
RTLKPVWRDA

SEQ ID NO: 201827 - protein, 10 aa, Tick-borne encephalitis virus
TLKPVWRDAR

SEQ ID NO: 201828 - protein, 10 aa, Tick-borne encephalitis virus
LKPVWRDARM

SEQ ID NO: 201829 - protein, 10 aa, Tick-borne encephalitis virus
KPVWRDARMF

SEQ ID NO: 201830 - protein, 10 aa, Tick-borne encephalitis virus
REGRDIREFI

SEQ ID NO: 201831 - protein, 10 aa, Tick-borne encephalitis virus
EGRDIREFIA

SEQ ID NO: 201832 - protein, 10 aa, Tick-borne encephalitis virus
GRDIREFIAY

SEQ ID NO: 201833 - protein, 10 aa, Tick-borne encephalitis virus
RDIREFIAYA

SEQ ID NO: 201834 - protein, 10 aa, Tick-borne encephalitis virus
DIREFIAYAS

SEQ ID NO: 201835 - protein, 10 aa, Tick-borne encephalitis virus
IREFIAYASG

SEQ ID NO: 201836 - protein, 10 aa, Tick-borne encephalitis virus
REFIAYASGR

SEQ ID NO: 201837 - protein, 10 aa, Tick-borne encephalitis virus
IAYASGRRSF

SEQ ID NO: 201838 - protein, 10 aa, Tick-borne encephalitis virus
GRRSIGDVLT

SEQ ID NO: 201839 - protein, 10 aa, Tick-borne encephalitis virus
RRSIGDVLTG

SEQ ID NO: 201840 - protein, 10 aa, Tick-borne encephalitis virus
RSIGDVLTGM

SEQ ID NO: 201841 - protein, 10 aa, Tick-borne encephalitis virus
SIGDVLTGMS

SEQ ID NO: 201842 - protein, 10 aa, Tick-borne encephalitis virus
IGDVLTGMSG

SEQ ID NO: 201843 - protein, 10 aa, Tick-borne encephalitis virus
MDVFYTLMHD

SEQ ID NO: 201844 - protein, 10 aa, Tick-borne encephalitis virus
DVFYTLMHEK

SEQ ID NO: 201845 - protein, 10 aa, Tick-borne encephalitis virus
VFYTLMHEKP

SEQ ID NO: 201846 - protein, 10 aa, Tick-borne encephalitis virus
FYTLMHEKPD

SEQ ID NO: 201847 - protein, 10 aa, Tick-borne encephalitis virus
YTLMHEKPDS

SEQ ID NO: 201848 - protein, 10 aa, Tick-borne encephalitis virus
TLMHEEPGSS

SEQ ID NO: 201849 - protein, 10 aa, Tick-borne encephalitis virus
LMHEEPGSSA

SEQ ID NO: 201850 - protein, 10 aa, Tick-borne encephalitis virus
MHEKPDSRAM

SEQ ID NO: 201851 - protein, 10 aa, Tick-borne encephalitis virus
HEEPGSSAMR

SEQ ID NO: 201852 - protein, 10 aa, Tick-borne encephalitis virus
EKPDSRAMRM

SEQ ID NO: 201853 - protein, 10 aa, Tick-borne encephalitis virus
EPGSSAMRMA

SEQ ID NO: 201854 - protein, 10 aa, Tick-borne encephalitis virus
PGSSAMRMAE

SEQ ID NO: 201855 - protein, 10 aa, Tick-borne encephalitis virus
DSRAMRMAER

SEQ ID NO: 201856 - protein, 10 aa, Tick-borne encephalitis virus
SSAMRMAERD

SEQ ID NO: 201857 - protein, 10 aa, Tick-borne encephalitis virus
SAMRMAERDA

SEQ ID NO: 201858 - protein, 10 aa, Tick-borne encephalitis virus
RDAPEAFLTL

SEQ ID NO: 201859 - protein, 10 aa, Tick-borne encephalitis virus
DAPEAFLTVA

SEQ ID NO: 201860 - protein, 10 aa, Tick-borne encephalitis virus
APEAFLTVAE

SEQ ID NO: 201861 - protein, 10 aa, Tick-borne encephalitis virus
VEVMVLGLAT

SEQ ID NO: 201862 - protein, 10 aa, Tick-borne encephalitis virus
EMLVLGLATL

SEQ ID NO: 201863 - protein, 10 aa, Tick-borne encephalitis virus
MLVLGLATLG

SEQ ID NO: 201864 - protein, 10 aa, Tick-borne encephalitis virus
MVLGLGTLGV

SEQ ID NO: 201865 - protein, 10 aa, Tick-borne encephalitis virus
VLGLGTLGVV

SEQ ID NO: 201866 - protein, 10 aa, Tick-borne encephalitis virus
LGLGTLGVVW

SEQ ID NO: 201867 - protein, 10 aa, Tick-borne encephalitis virus
GLGTLGVVWC

SEQ ID NO: 201868 - protein, 10 aa, Tick-borne encephalitis virus
LGTLGVVWCF

SEQ ID NO: 201869 - protein, 10 aa, Tick-borne encephalitis virus
GTLGVVWCFV

SEQ ID NO: 201870 - protein, 10 aa, Tick-borne encephalitis virus
TLGVVWCFVA

SEQ ID NO: 201871 - protein, 10 aa, Tick-borne encephalitis virus
LGVVWCFVAR

SEQ ID NO: 201872 - protein, 10 aa, Tick-borne encephalitis virus
GVVWCFVVRA

SEQ ID NO: 201873 - protein, 10 aa, Tick-borne encephalitis virus
VVWCFVARTS

SEQ ID NO: 201874 - protein, 10 aa, Tick-borne encephalitis virus
VWCFVARTSI

SEQ ID NO: 201875 - protein, 10 aa, Tick-borne encephalitis virus
WCFVARTSIS

SEQ ID NO: 201876 - protein, 10 aa, Tick-borne encephalitis virus
CFVARTSISR

SEQ ID NO: 201877 - protein, 10 aa, Tick-borne encephalitis virus
FVVRASISRM

SEQ ID NO: 201878 - protein, 10 aa, Tick-borne encephalitis virus
VARTSISRMM

SEQ ID NO: 201879 - protein, 10 aa, Tick-borne encephalitis virus
ARTSISRMML

SEQ ID NO: 201880 - protein, 10 aa, Tick-borne encephalitis virus
GTLVLLASLV

SEQ ID NO: 201881 - protein, 10 aa, Tick-borne encephalitis virus
TLVLLASLVL

SEQ ID NO: 201882 - protein, 10 aa, Tick-borne encephalitis virus
LVLLASLVLL

SEQ ID NO: 201883 - protein, 10 aa, Tick-borne encephalitis virus
VLLASLVLLW

SEQ ID NO: 201884 - protein, 10 aa, Tick-borne encephalitis virus
LLASLVLLWA

SEQ ID NO: 201885 - protein, 10 aa, Tick-borne encephalitis virus
LASLVLLWAG

SEQ ID NO: 201886 - protein, 10 aa, Tick-borne encephalitis virus
ASLVLLWAGG

SEQ ID NO: 201887 - protein, 10 aa, Tick-borne encephalitis virus
SLVLLWAGGV

SEQ ID NO: 201888 - protein, 10 aa, Tick-borne encephalitis virus
LALLWAGGVG

SEQ ID NO: 201889 - protein, 10 aa, Tick-borne encephalitis virus
ALLWAGGVGY

SEQ ID NO: 201890 - protein, 10 aa, Tick-borne encephalitis virus
AANEMGLLER

SEQ ID NO: 201891 - protein, 10 aa, Tick-borne encephalitis virus
ANEMGLLERT

SEQ ID NO: 201892 - protein, 10 aa, Tick-borne encephalitis virus
NEMGLLERTK

SEQ ID NO: 201893 - protein, 10 aa, Tick-borne encephalitis virus
EMGLLERTKA

SEQ ID NO: 201894 - protein, 10 aa, Tick-borne encephalitis virus
MGLLERTKAD

SEQ ID NO: 201895 - protein, 10 aa, Tick-borne encephalitis virus
GLLERTKADL

SEQ ID NO: 201896 - protein, 10 aa, Tick-borne encephalitis virus
LLERTKADLS

SEQ ID NO: 201897 - protein, 10 aa, Tick-borne encephalitis virus
LEKTKADLSA

SEQ ID NO: 201898 - protein, 10 aa, Tick-borne encephalitis virus
EKTKADLSTA

SEQ ID NO: 201899 - protein, 10 aa, Tick-borne encephalitis virus
KTKADLSTAL

SEQ ID NO: 201900 - protein, 10 aa, Tick-borne encephalitis virus
TKADLSAVLW

SEQ ID NO: 201901 - protein, 10 aa, Tick-borne encephalitis virus
KADLSTVLWA

SEQ ID NO: 201902 - protein, 10 aa, Tick-borne encephalitis virus
EPRSWGEWTN

SEQ ID NO: 201903 - protein, 10 aa, Tick-borne encephalitis virus
PRSWGEWTNI

SEQ ID NO: 201904 - protein, 10 aa, Tick-borne encephalitis virus
RSWGEWTNID

SEQ ID NO: 201905 - protein, 10 aa, Tick-borne encephalitis virus
SWGEWTNIDI

SEQ ID NO: 201906 - protein, 10 aa, Tick-borne encephalitis virus
WGEWTNIDIQ

SEQ ID NO: 201907 - protein, 10 aa, Tick-borne encephalitis virus
GEWTNIDIQP

SEQ ID NO: 201908 - protein, 10 aa, Tick-borne encephalitis virus
QQLVNSAVVT

SEQ ID NO: 201909 - protein, 10 aa, Tick-borne encephalitis virus
QLVNSAVVTG

SEQ ID NO: 201910 - protein, 10 aa, Tick-borne encephalitis virus
LVNSAVVTGA

SEQ ID NO: 201911 - protein, 10 aa, Tick-borne encephalitis virus
VNSAVVTGAQ

SEQ ID NO: 201912 - protein, 10 aa, Tick-borne encephalitis virus
NSAVVTGAQA

SEQ ID NO: 201913 - protein, 10 aa, Tick-borne encephalitis virus
SAVVTGAQAM

SEQ ID NO: 201914 - protein, 10 aa, Tick-borne encephalitis virus
AVVTGAQAMR

SEQ ID NO: 201915 - protein, 10 aa, Tick-borne encephalitis virus
VVTGAQAMRD

SEQ ID NO: 201916 - protein, 10 aa, Tick-borne encephalitis virus
VTGAQAMRDL

SEQ ID NO: 201917 - protein, 10 aa, Tick-borne encephalitis virus
RDLGGGAPFI

SEQ ID NO: 201918 - protein, 10 aa, Tick-borne encephalitis virus
DLGGGAPFLG

SEQ ID NO: 201919 - protein, 10 aa, Tick-borne encephalitis virus
LGGGAPFFGI

SEQ ID NO: 201920 - protein, 10 aa, Tick-borne encephalitis virus
GGGAPFIGVA

SEQ ID NO: 201921 - protein, 10 aa, Tick-borne encephalitis virus
GGAPFLGVAG

SEQ ID NO: 201922 - protein, 10 aa, Tick-borne encephalitis virus
GAPFLGVAGH

SEQ ID NO: 201923 - protein, 10 aa, Tick-borne encephalitis virus
APFLGVAGHV

SEQ ID NO: 201924 - protein, 10 aa, Tick-borne encephalitis virus
PFLGVAGHVM

SEQ ID NO: 201925 - protein, 10 aa, Tick-borne encephalitis virus
GVAGHVVALG

SEQ ID NO: 201926 - protein, 10 aa, Tick-borne encephalitis virus
VAGHVVALGV

SEQ ID NO: 201927 - protein, 10 aa, Tick-borne encephalitis virus
AGHVVALGVV

SEQ ID NO: 201928 - protein, 10 aa, Tick-borne encephalitis virus
GHVVALGVVS

SEQ ID NO: 201929 - protein, 10 aa, Tick-borne encephalitis virus
HVVALGVVSL

SEQ ID NO: 201930 - protein, 10 aa, Tick-borne encephalitis virus
VVALGVVSLV

SEQ ID NO: 201931 - protein, 10 aa, Tick-borne encephalitis virus
VALGVVSLVG

SEQ ID NO: 201932 - protein, 10 aa, Tick-borne encephalitis virus
SLGVVSLVGA

SEQ ID NO: 201933 - protein, 10 aa, Tick-borne encephalitis virus
LMVGVGLAAF

SEQ ID NO: 201934 - protein, 10 aa, Tick-borne encephalitis virus
MVGVGLAAFH

SEQ ID NO: 201935 - protein, 10 aa, Tick-borne encephalitis virus
VIYPFGEGET

SEQ ID NO: 201936 - protein, 10 aa, Tick-borne encephalitis virus
IYPFGEGETK

SEQ ID NO: 201937 - protein, 10 aa, Tick-borne encephalitis virus
YPFGEGETKP

SEQ ID NO: 201938 - protein, 10 aa, Tick-borne encephalitis virus
EAKPALYERR

SEQ ID NO: 201939 - protein, 10 aa, Tick-borne encephalitis virus
AKPALYERRM

SEQ ID NO: 201940 - protein, 10 aa, Tick-borne encephalitis virus
ERKMSLVLAT

SEQ ID NO: 201941 - protein, 10 aa, Tick-borne encephalitis virus
MSLVLAVVLC

SEQ ID NO: 201942 - protein, 10 aa, Tick-borne encephalitis virus
SLVLAVVLCL

SEQ ID NO: 201943 - protein, 10 aa, Tick-borne encephalitis virus
VLCLMAVVMN

SEQ ID NO: 201944 - protein, 10 aa, Tick-borne encephalitis virus
LCLISVVMNR

SEQ ID NO: 201945 - protein, 10 aa, Tick-borne encephalitis virus
CLISVVMNRT

SEQ ID NO: 201946 - protein, 10 aa, Tick-borne encephalitis virus
LISVVMNRTV

SEQ ID NO: 201947 - protein, 10 aa, Tick-borne encephalitis virus
AVVMNRTVAS

SEQ ID NO: 201948 - protein, 10 aa, Tick-borne encephalitis virus
VVMNRTVLSI

SEQ ID NO: 201949 - protein, 10 aa, Tick-borne encephalitis virus
VMNRTVLSIT

SEQ ID NO: 201950 - protein, 10 aa, Tick-borne encephalitis virus
MNRTMASITE

SEQ ID NO: 201951 - protein, 10 aa, Tick-borne encephalitis virus
NRTVLSITEA

SEQ ID NO: 201952 - protein, 10 aa, Tick-borne encephalitis virus
RTMASITEAS

SEQ ID NO: 201953 - protein, 10 aa, Tick-borne encephalitis virus
TMASITEASA

SEQ ID NO: 201954 - protein, 10 aa, Tick-borne encephalitis virus
VPSITEAAAV

SEQ ID NO: 201955 - protein, 10 aa, Tick-borne encephalitis virus
PSITEAAAVG

SEQ ID NO: 201956 - protein, 10 aa, Tick-borne encephalitis virus
EASAVGLAAL

SEQ ID NO: 201957 - protein, 10 aa, Tick-borne encephalitis virus
ASAVGLAALG

SEQ ID NO: 201958 - protein, 10 aa, Tick-borne encephalitis virus
SAVGLAALGQ

SEQ ID NO: 201959 - protein, 10 aa, Tick-borne encephalitis virus
AVGLAALGQL

SEQ ID NO: 201960 - protein, 10 aa, Tick-borne encephalitis virus
VGLAALGQLL

SEQ ID NO: 201961 - protein, 10 aa, Tick-borne encephalitis virus
GLAAAGQLLS

SEQ ID NO: 201962 - protein, 10 aa, Tick-borne encephalitis virus
LAAAGQLLSP

SEQ ID NO: 201963 - protein, 10 aa, Tick-borne encephalitis virus
AAAGQLLSPE

SEQ ID NO: 201964 - protein, 10 aa, Tick-borne encephalitis virus
GQLLSPEADT

SEQ ID NO: 201965 - protein, 10 aa, Tick-borne encephalitis virus
QLLSPEADTL

SEQ ID NO: 201966 - protein, 10 aa, Tick-borne encephalitis virus
LLSPEADTLW

SEQ ID NO: 201967 - protein, 10 aa, Tick-borne encephalitis virus
LSPEADTLWT

SEQ ID NO: 201968 - protein, 10 aa, Tick-borne encephalitis virus
SPEADTLWTM

SEQ ID NO: 201969 - protein, 10 aa, Tick-borne encephalitis virus
PEEDTLWTMP

SEQ ID NO: 201970 - protein, 10 aa, Tick-borne encephalitis virus
EEDTLWTMPV

SEQ ID NO: 201971 - protein, 10 aa, Tick-borne encephalitis virus
EDTLWTMPVA

SEQ ID NO: 201972 - protein, 10 aa, Tick-borne encephalitis virus
TMPVACGLSS

SEQ ID NO: 201973 - protein, 10 aa, Tick-borne encephalitis virus
MPVACGLSSV

SEQ ID NO: 201974 - protein, 10 aa, Tick-borne encephalitis virus
PVACGLSSVV

SEQ ID NO: 201975 - protein, 10 aa, Tick-borne encephalitis virus
VACGLSSVVR

SEQ ID NO: 201976 - protein, 10 aa, Tick-borne encephalitis virus
ACGLSSVVRG

SEQ ID NO: 201977 - protein, 10 aa, Tick-borne encephalitis virus
CGLSSVVRGS

SEQ ID NO: 201978 - protein, 10 aa, Tick-borne encephalitis virus
GLSSVVRGSL

SEQ ID NO: 201979 - protein, 10 aa, Tick-borne encephalitis virus
LSSVVRGSLW

SEQ ID NO: 201980 - protein, 10 aa, Tick-borne encephalitis virus
SGVVTGSLWG

SEQ ID NO: 201981 - protein, 10 aa, Tick-borne encephalitis virus
GVVTGSLWGF

SEQ ID NO: 201982 - protein, 10 aa, Tick-borne encephalitis virus
RASGSRRGGA

SEQ ID NO: 201983 - protein, 10 aa, Tick-borne encephalitis virus
ASGSRRGGAE

SEQ ID NO: 201984 - protein, 10 aa, Tick-borne encephalitis virus
SGSRRGGAEG

SEQ ID NO: 201985 - protein, 10 aa, Tick-borne encephalitis virus
GSRRGGAEGD

SEQ ID NO: 201986 - protein, 10 aa, Tick-borne encephalitis virus
SRRGGAEGDT

SEQ ID NO: 201987 - protein, 10 aa, Tick-borne encephalitis virus
RRGGSDGDTL

SEQ ID NO: 201988 - protein, 10 aa, Tick-borne encephalitis virus
RGGSDGDTLG

SEQ ID NO: 201989 - protein, 10 aa, Tick-borne encephalitis virus
GGSDGDTLGD

SEQ ID NO: 201990 - protein, 10 aa, Tick-borne encephalitis virus
GSDGDTLGDL

SEQ ID NO: 201991 - protein, 10 aa, Tick-borne encephalitis virus
SDGDTLGDLW

SEQ ID NO: 201992 - protein, 10 aa, Tick-borne encephalitis virus
DTLGDLWKQR

SEQ ID NO: 201993 - protein, 10 aa, Tick-borne encephalitis virus
TLGDLWKQRL

SEQ ID NO: 201994 - protein, 10 aa, Tick-borne encephalitis virus
LGDLWKQRLN

SEQ ID NO: 201995 - protein, 10 aa, Tick-borne encephalitis virus
LNSCTKEEFF

SEQ ID NO: 201996 - protein, 10 aa, Tick-borne encephalitis virus
NSCTKEEFFV

SEQ ID NO: 201997 - protein, 10 aa, Tick-borne encephalitis virus
SCTKEEFFVY

SEQ ID NO: 201998 - protein, 10 aa, Tick-borne encephalitis virus
CTKEEFFVYR

SEQ ID NO: 201999 - protein, 10 aa, Tick-borne encephalitis virus
TKEEFFVYRR

SEQ ID NO: 202000 - protein, 10 aa, Tick-borne encephalitis virus
EEFFIYRRTG

SEQ ID NO: 202001 - protein, 10 aa, Tick-borne encephalitis virus
EFFVYRRAGI

SEQ ID NO: 202002 - protein, 10 aa, Tick-borne encephalitis virus
FFVYRRTGIM

SEQ ID NO: 202003 - protein, 10 aa, Tick-borne encephalitis virus
FVYRRAGILE

SEQ ID NO: 202004 - protein, 10 aa, Tick-borne encephalitis virus
VYRRAGILET

SEQ ID NO: 202005 - protein, 10 aa, Tick-borne encephalitis virus
YRRAGILETE

SEQ ID NO: 202006 - protein, 10 aa, Tick-borne encephalitis virus
RRTGIMETER

SEQ ID NO: 202007 - protein, 10 aa, Tick-borne encephalitis virus
RTGIMETERD

SEQ ID NO: 202008 - protein, 10 aa, Tick-borne encephalitis virus
TGILETERDR

SEQ ID NO: 202009 - protein, 10 aa, Tick-borne encephalitis virus
GIMETERDKA

SEQ ID NO: 202010 - protein, 10 aa, Tick-borne encephalitis virus
ILETERDRAR

SEQ ID NO: 202011 - protein, 10 aa, Tick-borne encephalitis virus
LETERDRARE

SEQ ID NO: 202012 - protein, 10 aa, Tick-borne encephalitis virus
ERDRARELLR

SEQ ID NO: 202013 - protein, 10 aa, Tick-borne encephalitis virus
RDKARELLKR

SEQ ID NO: 202014 - protein, 10 aa, Tick-borne encephalitis virus
DRARELLRRG

SEQ ID NO: 202015 - protein, 10 aa, Tick-borne encephalitis virus
RARELLRRGE

SEQ ID NO: 202016 - protein, 10 aa, Tick-borne encephalitis virus
ARELLKRGET

SEQ ID NO: 202017 - protein, 10 aa, Tick-borne encephalitis virus
RELLKRGETN

SEQ ID NO: 202018 - protein, 10 aa, Tick-borne encephalitis virus
KGETNMGLAV

SEQ ID NO: 202019 - protein, 10 aa, Tick-borne encephalitis virus
GETNVGLAVS

SEQ ID NO: 202020 - protein, 10 aa, Tick-borne encephalitis virus
ETNVGLAVSR

SEQ ID NO: 202021 - protein, 10 aa, Tick-borne encephalitis virus
TNVGLAVSRG

SEQ ID NO: 202022 - protein, 10 aa, Tick-borne encephalitis virus
NVGLAVSRGT

SEQ ID NO: 202023 - protein, 10 aa, Tick-borne encephalitis virus
VGLAVSRGTA

SEQ ID NO: 202024 - protein, 10 aa, Tick-borne encephalitis virus
YAASRPSVMS

SEQ ID NO: 202025 - protein, 10 aa, Tick-borne encephalitis virus
AASRPSVMSV

SEQ ID NO: 202026 - protein, 10 aa, Tick-borne encephalitis virus
ASRPSVMSVK

SEQ ID NO: 202027 - protein, 10 aa, Tick-borne encephalitis virus
SRPSVMSVKA

SEQ ID NO: 202028 - protein, 10 aa, Tick-borne encephalitis virus
RPSVMSVKAY

SEQ ID NO: 202029 - protein, 10 aa, Tick-borne encephalitis virus
PSVMSVKAYT

SEQ ID NO: 202030 - protein, 10 aa, Tick-borne encephalitis virus
SVMSVKAYTI

SEQ ID NO: 202031 - protein, 10 aa, Tick-borne encephalitis virus
VMNVRAYTIG

SEQ ID NO: 202032 - protein, 10 aa, Tick-borne encephalitis virus
MNVRAYTIGG

SEQ ID NO: 202033 - protein, 10 aa, Tick-borne encephalitis virus
SVRAYTIGGK

SEQ ID NO: 202034 - protein, 10 aa, Tick-borne encephalitis virus
VRAYTIGGKG

SEQ ID NO: 202035 - protein, 10 aa, Tick-borne encephalitis virus
RAYTIGGKGH

SEQ ID NO: 202036 - protein, 10 aa, Tick-borne encephalitis virus
YTIGGKGHEA

SEQ ID NO: 202037 - protein, 10 aa, Tick-borne encephalitis virus
TIGGKGHEAP

SEQ ID NO: 202038 - protein, 10 aa, Tick-borne encephalitis virus
IGGKGHEAPK

SEQ ID NO: 202039 - protein, 10 aa, Tick-borne encephalitis virus
GGKGHEAPKM

SEQ ID NO: 202040 - protein, 10 aa, Tick-borne encephalitis virus
GKGHEAPKMV

SEQ ID NO: 202041 - protein, 10 aa, Tick-borne encephalitis virus
KGHEAPKMVT

SEQ ID NO: 202042 - protein, 10 aa, Tick-borne encephalitis virus
GHETPRMVTS

SEQ ID NO: 202043 - protein, 10 aa, Tick-borne encephalitis virus
HETPRMVTSL

SEQ ID NO: 202044 - protein, 10 aa, Tick-borne encephalitis virus
ETPRMVTSLG

SEQ ID NO: 202045 - protein, 10 aa, Tick-borne encephalitis virus
TPRMVTSLGW

SEQ ID NO: 202046 - protein, 10 aa, Tick-borne encephalitis virus
WNLIKFRAGV

SEQ ID NO: 202047 - protein, 10 aa, Tick-borne encephalitis virus
NLIKFRAGVD

SEQ ID NO: 202048 - protein, 10 aa, Tick-borne encephalitis virus
LIKFRAGVDV

SEQ ID NO: 202049 - protein, 10 aa, Tick-borne encephalitis virus
IKFRAGVDVF

SEQ ID NO: 202050 - protein, 10 aa, Tick-borne encephalitis virus
KFRAGVDVFS

SEQ ID NO: 202051 - protein, 10 aa, Tick-borne encephalitis virus
FRAGVDVFSM

SEQ ID NO: 202052 - protein, 10 aa, Tick-borne encephalitis virus
RAGVDVFSMQ

SEQ ID NO: 202053 - protein, 10 aa, Tick-borne encephalitis virus
AGVDVFSMQP

SEQ ID NO: 202054 - protein, 10 aa, Tick-borne encephalitis virus
TIMCDIGESS

SEQ ID NO: 202055 - protein, 10 aa, Tick-borne encephalitis virus
IMCDIGESSP

SEQ ID NO: 202056 - protein, 10 aa, Tick-borne encephalitis virus
DIGESNPDAA

SEQ ID NO: 202057 - protein, 10 aa, Tick-borne encephalitis virus
IGESNPDAAV

SEQ ID NO: 202058 - protein, 10 aa, Tick-borne encephalitis virus
GESNPDAAVE

SEQ ID NO: 202059 - protein, 10 aa, Tick-borne encephalitis virus
ESNPDAAVEG

SEQ ID NO: 202060 - protein, 10 aa, Tick-borne encephalitis virus
SNPDAAVEGE

SEQ ID NO: 202061 - protein, 10 aa, Tick-borne encephalitis virus
NPDAAVEGER

SEQ ID NO: 202062 - protein, 10 aa, Tick-borne encephalitis virus
PDAVVEGEKT

SEQ ID NO: 202063 - protein, 10 aa, Tick-borne encephalitis virus
DAVVEGEKTR

SEQ ID NO: 202064 - protein, 10 aa, Tick-borne encephalitis virus
AAVEGERTRR

SEQ ID NO: 202065 - protein, 10 aa, Tick-borne encephalitis virus
AVEGERTRRV

SEQ ID NO: 202066 - protein, 10 aa, Tick-borne encephalitis virus
VEGEKTRKVI

SEQ ID NO: 202067 - protein, 10 aa, Tick-borne encephalitis virus
EGEKTRKVIL

SEQ ID NO: 202068 - protein, 10 aa, Tick-borne encephalitis virus
GEKTRKVILL

SEQ ID NO: 202069 - protein, 10 aa, Tick-borne encephalitis virus
EKTRKVILLM

SEQ ID NO: 202070 - protein, 10 aa, Tick-borne encephalitis virus
KTRKVILLME

SEQ ID NO: 202071 - protein, 10 aa, Tick-borne encephalitis virus
MEQWKNRNPA

SEQ ID NO: 202072 - protein, 10 aa, Tick-borne encephalitis virus
EQWKIRNPTA

SEQ ID NO: 202073 - protein, 10 aa, Tick-borne encephalitis virus
QWKIRNPTAT

SEQ ID NO: 202074 - protein, 10 aa, Tick-borne encephalitis virus
WKIRNPTATC

SEQ ID NO: 202075 - protein, 10 aa, Tick-borne encephalitis virus
KNRNPAAACV

SEQ ID NO: 202076 - protein, 10 aa, Tick-borne encephalitis virus
IRNPTATCVF

SEQ ID NO: 202077 - protein, 10 aa, Tick-borne encephalitis virus
RNPAAACVFK

SEQ ID NO: 202078 - protein, 10 aa, Tick-borne encephalitis virus
NPAAACVFKV

SEQ ID NO: 202079 - protein, 10 aa, Tick-borne encephalitis virus
PAAACVFKVL

SEQ ID NO: 202080 - protein, 10 aa, Tick-borne encephalitis virus
AAACVFKVLA

SEQ ID NO: 202081 - protein, 10 aa, Tick-borne encephalitis virus
APYRPEVIET

SEQ ID NO: 202082 - protein, 10 aa, Tick-borne encephalitis virus
PYRPEVIETL

SEQ ID NO: 202083 - protein, 10 aa, Tick-borne encephalitis virus
YRPEVIETLH

SEQ ID NO: 202084 - protein, 10 aa, Tick-borne encephalitis virus
RPEVIETLHR

SEQ ID NO: 202085 - protein, 10 aa, Tick-borne encephalitis virus
PKVIEALHRF

SEQ ID NO: 202086 - protein, 10 aa, Tick-borne encephalitis virus
KVIEALHRFQ

SEQ ID NO: 202087 - protein, 10 aa, Tick-borne encephalitis virus
IEALHRFQLK

SEQ ID NO: 202088 - protein, 10 aa, Tick-borne encephalitis virus
EALHRFQLKW

SEQ ID NO: 202089 - protein, 10 aa, Tick-borne encephalitis virus
ALHRFQLKWG

SEQ ID NO: 202090 - protein, 10 aa, Tick-borne encephalitis virus
LHRFQLKWGG

SEQ ID NO: 202091 - protein, 10 aa, Tick-borne encephalitis virus
HRFQLKWGGG

SEQ ID NO: 202092 - protein, 10 aa, Tick-borne encephalitis virus
RFQLKWGGGL

SEQ ID NO: 202093 - protein, 10 aa, Tick-borne encephalitis virus
FQLKWGGGLV

SEQ ID NO: 202094 - protein, 10 aa, Tick-borne encephalitis virus
QLKWGGGLVR

SEQ ID NO: 202095 - protein, 10 aa, Tick-borne encephalitis virus
LKWGGGLVRT

SEQ ID NO: 202096 - protein, 10 aa, Tick-borne encephalitis virus
KWGGGLVRTP

SEQ ID NO: 202097 - protein, 10 aa, Tick-borne encephalitis virus
THEMYYSTAI

SEQ ID NO: 202098 - protein, 10 aa, Tick-borne encephalitis virus
HEMYYSTAIT

SEQ ID NO: 202099 - protein, 10 aa, Tick-borne encephalitis virus
KVYYSTAVTG

SEQ ID NO: 202100 - protein, 10 aa, Tick-borne encephalitis virus
MYYSTAITGN

SEQ ID NO: 202101 - protein, 10 aa, Tick-borne encephalitis virus
RFAGQRGPTR

SEQ ID NO: 202102 - protein, 10 aa, Tick-borne encephalitis virus
FAGQRGPTRV

SEQ ID NO: 202103 - protein, 10 aa, Tick-borne encephalitis virus
AGQRGPTRVP

SEQ ID NO: 202104 - protein, 10 aa, Tick-borne encephalitis virus
GQRGPTRVPE

SEQ ID NO: 202105 - protein, 10 aa, Tick-borne encephalitis virus
TKVPELDLGV

SEQ ID NO: 202106 - protein, 10 aa, Tick-borne encephalitis virus
KVPELDLGVG

SEQ ID NO: 202107 - protein, 10 aa, Tick-borne encephalitis virus
DLGVGTRCVF

SEQ ID NO: 202108 - protein, 10 aa, Tick-borne encephalitis virus
LGVGTRCVFL

SEQ ID NO: 202109 - protein, 10 aa, Tick-borne encephalitis virus
GVGTRCVFLA

SEQ ID NO: 202110 - protein, 10 aa, Tick-borne encephalitis virus
VGTRCVVLAD

SEQ ID NO: 202111 - protein, 10 aa, Tick-borne encephalitis virus
GTRCVVLADD

SEQ ID NO: 202112 - protein, 10 aa, Tick-borne encephalitis virus
TRCVVLADDK

SEQ ID NO: 202113 - protein, 10 aa, Tick-borne encephalitis virus
RCVFLAEDKV

SEQ ID NO: 202114 - protein, 10 aa, Tick-borne encephalitis virus
CVVLAEDKVR

SEQ ID NO: 202115 - protein, 10 aa, Tick-borne encephalitis virus
VVLAEDKVRE

SEQ ID NO: 202116 - protein, 10 aa, Tick-borne encephalitis virus
LAEDRVREKD

SEQ ID NO: 202117 - protein, 10 aa, Tick-borne encephalitis virus
AEDRVREKDV

SEQ ID NO: 202118 - protein, 10 aa, Tick-borne encephalitis virus
DRVREKDVQE

SEQ ID NO: 202119 - protein, 10 aa, Tick-borne encephalitis virus
RVREKDVQER

SEQ ID NO: 202120 - protein, 10 aa, Tick-borne encephalitis virus
VREKDVQERI

SEQ ID NO: 202121 - protein, 10 aa, Tick-borne encephalitis virus
ERIRALKEQY

SEQ ID NO: 202122 - protein, 10 aa, Tick-borne encephalitis virus
ALKEQYGETW

SEQ ID NO: 202123 - protein, 10 aa, Tick-borne encephalitis virus
LKEQYGETWH

SEQ ID NO: 202124 - protein, 10 aa, Tick-borne encephalitis virus
DGEHPYRTWQ

SEQ ID NO: 202125 - protein, 10 aa, Tick-borne encephalitis virus
GEHPYRTWQY

SEQ ID NO: 202126 - protein, 10 aa, Tick-borne encephalitis virus
PAWQQRVFKK

SEQ ID NO: 202127 - protein, 10 aa, Tick-borne encephalitis virus
AWQQRVFKKN

SEQ ID NO: 202128 - protein, 10 aa, Tick-borne encephalitis virus
WQQRVFKKNA

SEQ ID NO: 202129 - protein, 10 aa, Tick-borne encephalitis virus
QQRVFKKNAD

SEQ ID NO: 202130 - protein, 10 aa, Tick-borne encephalitis virus
QRVFKKNADT

SEQ ID NO: 202131 - protein, 10 aa, Tick-borne encephalitis virus
RVFKKNADTK

SEQ ID NO: 202132 - protein, 10 aa, Tick-borne encephalitis virus
VFKKNADTKA

SEQ ID NO: 202133 - protein, 10 aa, Tick-borne encephalitis virus
FKKNADTKAQ

SEQ ID NO: 202134 - protein, 10 aa, Tick-borne encephalitis virus
KKNADTKAQE

SEQ ID NO: 202135 - protein, 10 aa, Tick-borne encephalitis virus
KNADTKAQEP

SEQ ID NO: 202136 - protein, 10 aa, Tick-borne encephalitis virus
NDWMLDRLAQ

SEQ ID NO: 202137 - protein, 10 aa, Tick-borne encephalitis virus
DWMLDRLAQK

SEQ ID NO: 202138 - protein, 10 aa, Tick-borne encephalitis virus
WILERLARKN

SEQ ID NO: 202139 - protein, 10 aa, Tick-borne encephalitis virus
RPRMCSKEEF

SEQ ID NO: 202140 - protein, 10 aa, Tick-borne encephalitis virus
SRIHSKEEFI

SEQ ID NO: 202141 - protein, 10 aa, Tick-borne encephalitis virus
RIHSKEEFIA

SEQ ID NO: 202142 - protein, 10 aa, Tick-borne encephalitis virus
IHSKEEFIAK

SEQ ID NO: 202143 - protein, 10 aa, Tick-borne encephalitis virus
HSKEEFIAKV

SEQ ID NO: 202144 - protein, 10 aa, Tick-borne encephalitis virus
SKEEFIAKVR

SEQ ID NO: 202145 - protein, 10 aa, Tick-borne encephalitis virus
KEEFIAKVRS

SEQ ID NO: 202146 - protein, 10 aa, Tick-borne encephalitis virus
EEFIAKVKSS

SEQ ID NO: 202147 - protein, 10 aa, Tick-borne encephalitis virus
EFIAKVKSSA

SEQ ID NO: 202148 - protein, 10 aa, Tick-borne encephalitis virus
FIAKVKSSAA

SEQ ID NO: 202149 - protein, 10 aa, Tick-borne encephalitis virus
IAKVKSSAAL

SEQ ID NO: 202150 - protein, 10 aa, Tick-borne encephalitis virus
AKVKSSAALG

SEQ ID NO: 202151 - protein, 10 aa, Tick-borne encephalitis virus
KVKSSAALGA

SEQ ID NO: 202152 - protein, 10 aa, Tick-borne encephalitis virus
VRSNAALGAW

SEQ ID NO: 202153 - protein, 10 aa, Tick-borne encephalitis virus
KSSAALGAWS

SEQ ID NO: 202154 - protein, 10 aa, Tick-borne encephalitis virus
SNAALGAWSE

SEQ ID NO: 202155 - protein, 10 aa, Tick-borne encephalitis virus
SAALGAWSDE

SEQ ID NO: 202156 - protein, 10 aa, Tick-borne encephalitis virus
AALGAWSNEQ

SEQ ID NO: 202157 - protein, 10 aa, Tick-borne encephalitis virus
ALGAWSNEQN

SEQ ID NO: 202158 - protein, 10 aa, Tick-borne encephalitis virus
LGAWSEEQNR

SEQ ID NO: 202159 - protein, 10 aa, Tick-borne encephalitis virus
GAWSNEQNRW

SEQ ID NO: 202160 - protein, 10 aa, Tick-borne encephalitis virus
AWSEEQNRWS

SEQ ID NO: 202161 - protein, 10 aa, Tick-borne encephalitis virus
NAKEAVEDPV

SEQ ID NO: 202162 - protein, 10 aa, Tick-borne encephalitis virus
AKEAVEDPVF

SEQ ID NO: 202163 - protein, 10 aa, Tick-borne encephalitis virus
KEAVEDPVFW

SEQ ID NO: 202164 - protein, 10 aa, Tick-borne encephalitis virus
EAVEDPVFWQ

SEQ ID NO: 202165 - protein, 10 aa, Tick-borne encephalitis virus
AVEDPVFWQL

SEQ ID NO: 202166 - protein, 10 aa, Tick-borne encephalitis virus
VEDPVFWQLV

SEQ ID NO: 202167 - protein, 10 aa, Tick-borne encephalitis virus
EDPVFWQLVD

SEQ ID NO: 202168 - protein, 10 aa, Tick-borne encephalitis virus
DPVFWQLVDE

SEQ ID NO: 202169 - protein, 10 aa, Tick-borne encephalitis virus
PVFWQLVDEE

SEQ ID NO: 202170 - protein, 10 aa, Tick-borne encephalitis virus
VFWQLVDEER

SEQ ID NO: 202171 - protein, 10 aa, Tick-borne encephalitis virus
FWRLVDEERE

SEQ ID NO: 202172 - protein, 10 aa, Tick-borne encephalitis virus
WRLVDEERER

SEQ ID NO: 202173 - protein, 10 aa, Tick-borne encephalitis virus
RLVDEERERH

SEQ ID NO: 202174 - protein, 10 aa, Tick-borne encephalitis virus
VDEERERHLT

SEQ ID NO: 202175 - protein, 10 aa, Tick-borne encephalitis virus
DEERERDLAG

SEQ ID NO: 202176 - protein, 10 aa, Tick-borne encephalitis virus
EERERDLAGR

SEQ ID NO: 202177 - protein, 10 aa, Tick-borne encephalitis virus
ERERHLTGRC

SEQ ID NO: 202178 - protein, 10 aa, Tick-borne encephalitis virus
RERHLTGRCA

SEQ ID NO: 202179 - protein, 10 aa, Tick-borne encephalitis virus
ERHLTGRCAH

SEQ ID NO: 202180 - protein, 10 aa, Tick-borne encephalitis virus
RDLAGRSAHG

SEQ ID NO: 202181 - protein, 10 aa, Tick-borne encephalitis virus
DLAGRSAHGV

SEQ ID NO: 202182 - protein, 10 aa, Tick-borne encephalitis virus
GRSAHGVFNI

SEQ ID NO: 202183 - protein, 10 aa, Tick-borne encephalitis virus
RCAHCAYNMM

SEQ ID NO: 202184 - protein, 10 aa, Tick-borne encephalitis virus
SAHGVFNIMG

SEQ ID NO: 202185 - protein, 10 aa, Tick-borne encephalitis virus
AHGVFNIMGK

SEQ ID NO: 202186 - protein, 10 aa, Tick-borne encephalitis virus
HCAYNMMGKR

SEQ ID NO: 202187 - protein, 10 aa, Tick-borne encephalitis virus
CAYNMMGKRE

SEQ ID NO: 202188 - protein, 10 aa, Tick-borne encephalitis virus
AYNMMGKREK

SEQ ID NO: 202189 - protein, 10 aa, Tick-borne encephalitis virus
FNIMGKREKK

SEQ ID NO: 202190 - protein, 10 aa, Tick-borne encephalitis virus
NEDHWASRGF

SEQ ID NO: 202191 - protein, 10 aa, Tick-borne encephalitis virus
EDHWASRGFS

SEQ ID NO: 202192 - protein, 10 aa, Tick-borne encephalitis virus
DHWASRGFSG

SEQ ID NO: 202193 - protein, 10 aa, Tick-borne encephalitis virus
HWASRESSGS

SEQ ID NO: 202194 - protein, 10 aa, Tick-borne encephalitis virus
WASRGSSGAG

SEQ ID NO: 202195 - protein, 10 aa, Tick-borne encephalitis virus
ASRGFSGSGV

SEQ ID NO: 202196 - protein, 10 aa, Tick-borne encephalitis virus
SRGSSGAGVE

SEQ ID NO: 202197 - protein, 10 aa, Tick-borne encephalitis virus
RESSGSGVEG

SEQ ID NO: 202198 - protein, 10 aa, Tick-borne encephalitis virus
ESSGSGVEGI

SEQ ID NO: 202199 - protein, 10 aa, Tick-borne encephalitis virus
FSGSGVEGIS

SEQ ID NO: 202200 - protein, 10 aa, Tick-borne encephalitis virus
LNYLGWHLKG

SEQ ID NO: 202201 - protein, 10 aa, Tick-borne encephalitis virus
NYLGWHLKGL

SEQ ID NO: 202202 - protein, 10 aa, Tick-borne encephalitis virus
YLGWHLKGLS

SEQ ID NO: 202203 - protein, 10 aa, Tick-borne encephalitis virus
LSILEGGLFY

SEQ ID NO: 202204 - protein, 10 aa, Tick-borne encephalitis virus
SILEGGLFYA

SEQ ID NO: 202205 - protein, 10 aa, Tick-borne encephalitis virus
ILEGGLFYAD

SEQ ID NO: 202206 - protein, 10 aa, Tick-borne encephalitis virus
PEGGLFYADD

SEQ ID NO: 202207 - protein, 10 aa, Tick-borne encephalitis virus
ILRYMEGEHR

SEQ ID NO: 202208 - protein, 10 aa, Tick-borne encephalitis virus
MEGEHRQLAA

SEQ ID NO: 202209 - protein, 10 aa, Tick-borne encephalitis virus
EGEHRQLAAT

SEQ ID NO: 202210 - protein, 10 aa, Tick-borne encephalitis virus
GEHRQLAATI

SEQ ID NO: 202211 - protein, 10 aa, Tick-borne encephalitis virus
EHRQLAATIM

SEQ ID NO: 202212 - protein, 10 aa, Tick-borne encephalitis virus
HRQLAATIMQ

SEQ ID NO: 202213 - protein, 10 aa, Tick-borne encephalitis virus
RQLAATIMQK

SEQ ID NO: 202214 - protein, 10 aa, Tick-borne encephalitis virus
QLAATVMQKA

SEQ ID NO: 202215 - protein, 10 aa, Tick-borne encephalitis virus
LAATVMQKAY

SEQ ID NO: 202216 - protein, 10 aa, Tick-borne encephalitis virus
AATVMQKAYH

SEQ ID NO: 202217 - protein, 10 aa, Tick-borne encephalitis virus
ATVMQKAYHA

SEQ ID NO: 202218 - protein, 10 aa, Tick-borne encephalitis virus
ARPSREGGCV

SEQ ID NO: 202219 - protein, 10 aa, Tick-borne encephalitis virus
RPSREGGCVM

SEQ ID NO: 202220 - protein, 10 aa, Tick-borne encephalitis virus
PSREGGCVMD

SEQ ID NO: 202221 - protein, 10 aa, Tick-borne encephalitis virus
SREGGCVMDV

SEQ ID NO: 202222 - protein, 10 aa, Tick-borne encephalitis virus
REGGCVMDVI

SEQ ID NO: 202223 - protein, 10 aa, Tick-borne encephalitis virus
EGGCVMDVIT

SEQ ID NO: 202224 - protein, 10 aa, Tick-borne encephalitis virus
MEGEGVIEAT

SEQ ID NO: 202225 - protein, 10 aa, Tick-borne encephalitis virus
EGEGVIEATD

SEQ ID NO: 202226 - protein, 10 aa, Tick-borne encephalitis virus
GEGVIEATDA

SEQ ID NO: 202227 - protein, 10 aa, Tick-borne encephalitis virus
EGVIEATDAH

SEQ ID NO: 202228 - protein, 10 aa, Tick-borne encephalitis virus
GVIEATDAHN

SEQ ID NO: 202229 - protein, 10 aa, Tick-borne encephalitis virus
VIEATDAHNP

SEQ ID NO: 202230 - protein, 10 aa, Tick-borne encephalitis virus
IEATDAHNPR

SEQ ID NO: 202231 - protein, 10 aa, Tick-borne encephalitis virus
EATDAHNPRL

SEQ ID NO: 202232 - protein, 10 aa, Tick-borne encephalitis virus
ATDAHNPRLL

SEQ ID NO: 202233 - protein, 10 aa, Tick-borne encephalitis virus
TDAHNPRLLR

SEQ ID NO: 202234 - protein, 10 aa, Tick-borne encephalitis virus
RLFRVERWLR

SEQ ID NO: 202235 - protein, 10 aa, Tick-borne encephalitis virus
LFRVERWLRD

SEQ ID NO: 202236 - protein, 10 aa, Tick-borne encephalitis virus
RVERWLRNHG

SEQ ID NO: 202237 - protein, 10 aa, Tick-borne encephalitis virus
NHGEERLGRM

SEQ ID NO: 202238 - protein, 10 aa, Tick-borne encephalitis virus
YGEERLGRML

SEQ ID NO: 202239 - protein, 10 aa, Tick-borne encephalitis virus
SGDDCVVRPI

SEQ ID NO: 202240 - protein, 10 aa, Tick-borne encephalitis virus
GDDCVVRPID

SEQ ID NO: 202241 - protein, 10 aa, Tick-borne encephalitis virus
DDCVVRPIDD

SEQ ID NO: 202242 - protein, 10 aa, Tick-borne encephalitis virus
DCVVRPIDDR

SEQ ID NO: 202243 - protein, 10 aa, Tick-borne encephalitis virus
CVVRPIDDRF

SEQ ID NO: 202244 - protein, 10 aa, Tick-borne encephalitis virus
VVRPIDDRFG

SEQ ID NO: 202245 - protein, 10 aa, Tick-borne encephalitis virus
DDRFSRALYF

SEQ ID NO: 202246 - protein, 10 aa, Tick-borne encephalitis virus
DRFSRALYFL

SEQ ID NO: 202247 - protein, 10 aa, Tick-borne encephalitis virus
RFSRALYFLN

SEQ ID NO: 202248 - protein, 10 aa, Tick-borne encephalitis virus
FSRALYFLND

SEQ ID NO: 202249 - protein, 10 aa, Tick-borne encephalitis virus
SRALYFLNDM

SEQ ID NO: 202250 - protein, 10 aa, Tick-borne encephalitis virus
GALYFLNDMA

SEQ ID NO: 202251 - protein, 10 aa, Tick-borne encephalitis virus
KDIGEWEHSA

SEQ ID NO: 202252 - protein, 10 aa, Tick-borne encephalitis virus
DIGEWEHSAG

SEQ ID NO: 202253 - protein, 10 aa, Tick-borne encephalitis virus
IGEWEHSAGF

SEQ ID NO: 202254 - protein, 10 aa, Tick-borne encephalitis virus
GEWEHSAGFA

SEQ ID NO: 202255 - protein, 10 aa, Tick-borne encephalitis virus
SWEAVPFCSH

SEQ ID NO: 202256 - protein, 10 aa, Tick-borne encephalitis virus
VEEVPFCSHH

SEQ ID NO: 202257 - protein, 10 aa, Tick-borne encephalitis virus
HELVMKDGRS

SEQ ID NO: 202258 - protein, 10 aa, Tick-borne encephalitis virus
ELVMKDGRTL

SEQ ID NO: 202259 - protein, 10 aa, Tick-borne encephalitis virus
LVMKDGRTLV

SEQ ID NO: 202260 - protein, 10 aa, Tick-borne encephalitis virus
VMKDGRSLIV

SEQ ID NO: 202261 - protein, 10 aa, Tick-borne encephalitis virus
MKDGRSLIVP

SEQ ID NO: 202262 - protein, 10 aa, Tick-borne encephalitis virus
KDGRSLIVPC

SEQ ID NO: 202263 - protein, 10 aa, Tick-borne encephalitis virus
DGRTLVVPCR

SEQ ID NO: 202264 - protein, 10 aa, Tick-borne encephalitis virus
GRTLVVPCRD

SEQ ID NO: 202265 - protein, 10 aa, Tick-borne encephalitis virus
RTLVVPCRDQ

SEQ ID NO: 202266 - protein, 10 aa, Tick-borne encephalitis virus
TLVVPCRDQD

SEQ ID NO: 202267 - protein, 10 aa, Tick-borne encephalitis virus
QDELVGRAPV

SEQ ID NO: 202268 - protein, 10 aa, Tick-borne encephalitis virus
DELVGRAPVS

SEQ ID NO: 202269 - protein, 10 aa, Tick-borne encephalitis virus
ELVGRAPVSP

SEQ ID NO: 202270 - protein, 10 aa, Tick-borne encephalitis virus
LVGRAPVSPG

SEQ ID NO: 202271 - protein, 10 aa, Tick-borne encephalitis virus
VGRAPVSPGC

SEQ ID NO: 202272 - protein, 10 aa, Tick-borne encephalitis virus
GRAPVSPGCG

SEQ ID NO: 202273 - protein, 10 aa, Tick-borne encephalitis virus
RAPVSPGCGW

SEQ ID NO: 202274 - protein, 10 aa, Tick-borne encephalitis virus
APVSPGCGWS

SEQ ID NO: 202275 - protein, 10 aa, Tick-borne encephalitis virus
PVSPGCGWSV

SEQ ID NO: 202276 - protein, 10 aa, Tick-borne encephalitis virus
VSPGCGWSIR

SEQ ID NO: 202277 - protein, 10 aa, Tick-borne encephalitis virus
RRDLRTLGLT

SEQ ID NO: 202278 - protein, 10 aa, Tick-borne encephalitis virus
RDLRTLGLTI

SEQ ID NO: 202279 - protein, 10 aa, Tick-borne encephalitis virus
DLRTLGFAIC

SEQ ID NO: 202280 - protein, 10 aa, Tick-borne encephalitis virus
LRTLGLAISS

SEQ ID NO: 202281 - protein, 10 aa, Tick-borne encephalitis virus
RTLGFAICSA

SEQ ID NO: 202282 - protein, 10 aa, Tick-borne encephalitis virus
TLGLAISSAV

SEQ ID NO: 202283 - protein, 10 aa, Tick-borne encephalitis virus
LGLAISSAVP

SEQ ID NO: 202284 - protein, 10 aa, Tick-borne encephalitis virus
SAVPADWVPT

SEQ ID NO: 202285 - protein, 10 aa, Tick-borne encephalitis virus
AVPIDWVPTG

SEQ ID NO: 202286 - protein, 10 aa, Tick-borne encephalitis virus
VPADWVPTGR

SEQ ID NO: 202287 - protein, 10 aa, Tick-borne encephalitis virus
PIDWVPTGRT

SEQ ID NO: 202288 - protein, 10 aa, Tick-borne encephalitis virus
ADWVPTGRTT

SEQ ID NO: 202289 - protein, 10 aa, Tick-borne encephalitis virus
WSIHASGSWM

SEQ ID NO: 202290 - protein, 10 aa, Tick-borne encephalitis virus
SIHASGAWIT

SEQ ID NO: 202291 - protein, 10 aa, Tick-borne encephalitis virus
IHASGAWITT

SEQ ID NO: 202292 - protein, 10 aa, Tick-borne encephalitis virus
HASGAWITTE

SEQ ID NO: 202293 - protein, 10 aa, Tick-borne encephalitis virus
ASGAWITTED

SEQ ID NO: 202294 - protein, 10 aa, Tick-borne encephalitis virus
SGAWMTTENM

SEQ ID NO: 202295 - protein, 10 aa, Tick-borne encephalitis virus
GAWMTTENML

SEQ ID NO: 202296 - protein, 10 aa, Tick-borne encephalitis virus
AWITTEDMLD

SEQ ID NO: 202297 - protein, 10 aa, Tick-borne encephalitis virus
WMTTENMLDV

SEQ ID NO: 202298 - protein, 10 aa, Tick-borne encephalitis virus
MTTENMLDVW

SEQ ID NO: 202299 - protein, 10 aa, Tick-borne encephalitis virus
WILDNPFMHG

SEQ ID NO: 202300 - protein, 10 aa, Tick-borne encephalitis virus
ILDNPFMHGK

SEQ ID NO: 202301 - protein, 10 aa, Tick-borne encephalitis virus
LDNPFMQNKG

SEQ ID NO: 202302 - protein, 10 aa, Tick-borne encephalitis virus
DNPFMQNKER

SEQ ID NO: 202303 - protein, 10 aa, Tick-borne encephalitis virus
EWRNVPYLPK

SEQ ID NO: 202304 - protein, 10 aa, Tick-borne encephalitis virus
WRDIPYLPKA

SEQ ID NO: 202305 - protein, 10 aa, Tick-borne encephalitis virus
IPYLPKAHDM

SEQ ID NO: 202306 - protein, 10 aa, Tick-borne encephalitis virus
PYLPKAHDML

SEQ ID NO: 202307 - protein, 10 aa, Tick-borne encephalitis virus
YLPKAHDMLC

SEQ ID NO: 202308 - protein, 10 aa, Tick-borne encephalitis virus
LPKAHDMLCS

SEQ ID NO: 202309 - protein, 10 aa, Tick-borne encephalitis virus
PKAHDMLCSS

SEQ ID NO: 202310 - protein, 10 aa, Tick-borne encephalitis virus
KAHDMLCSSL

SEQ ID NO: 202311 - protein, 10 aa, Tick-borne encephalitis virus
AHDMLCSSLV

SEQ ID NO: 202312 - protein, 10 aa, Tick-borne encephalitis virus
MLCSSLVGRT

SEQ ID NO: 202313 - protein, 10 aa, Tick-borne encephalitis virus
LCSSLVGRTE

SEQ ID NO: 202314 - protein, 10 aa, Tick-borne encephalitis virus
CSSLVGRTER

SEQ ID NO: 202315 - protein, 10 aa, Tick-borne encephalitis virus
SSLVGRTERA

SEQ ID NO: 202316 - protein, 10 aa, Tick-borne encephalitis virus
SLVGRTERAE

SEQ ID NO: 202317 - protein, 10 aa, Tick-borne encephalitis virus
LVGRTERAEW

SEQ ID NO: 202318 - protein, 10 aa, Tick-borne encephalitis virus
VGRTERAEWA

SEQ ID NO: 202319 - protein, 10 aa, Tick-borne encephalitis virus
GRKERAEWAR

SEQ ID NO: 202320 - protein, 10 aa, Tick-borne encephalitis virus
RKERAEWARN

SEQ ID NO: 202321 - protein, 10 aa, Tick-borne encephalitis virus
KERAEWARNI

SEQ ID NO: 202322 - protein, 10 aa, Tick-borne encephalitis virus
WGAVEKVRKI

SEQ ID NO: 202323 - protein, 10 aa, Tick-borne encephalitis virus
GAVEKVRKIV

SEQ ID NO: 202324 - protein, 10 aa, Tick-borne encephalitis virus
AVEKVRKIVG

SEQ ID NO: 202325 - protein, 10 aa, Tick-borne encephalitis virus
KCKDYPSCMD

SEQ ID NO: 202326 - protein, 10 aa, Tick-borne encephalitis virus
CKDYPSCMDR

SEQ ID NO: 202327 - protein, 10 aa, Tick-borne encephalitis virus
KDYPSCMDRH

SEQ ID NO: 202328 - protein, 10 aa, Tick-borne encephalitis virus
DYLSCMDRHY

SEQ ID NO: 202329 - protein, 10 aa, Tick-borne encephalitis virus
YLSCMDRHYL

SEQ ID NO: 202330 - protein, 10 aa, Tick-borne encephalitis virus
LSCMDRHYLH

SEQ ID NO: 202331 - protein, 10 aa, Tick-borne encephalitis virus
DRHYLHWNLK

SEQ ID NO: 202332 - protein, 10 aa, Tick-borne encephalitis virus
RHYLHWNLKL

SEQ ID NO: 202333 - protein, 10 aa, Tick-borne encephalitis virus
HYLHWNLKLE

SEQ ID NO: 202334 - protein, 10 aa, Tick-borne encephalitis virus
DLHWELKLEG

SEQ ID NO: 202335 - protein, 10 aa, Tick-borne encephalitis virus
LHWELKLEGS

SEQ ID NO: 202336 - protein, 10 aa, Tick-borne encephalitis virus
HWNLKLESSI

SEQ ID NO: 202337 - protein, 10 aa, Tick-borne encephalitis virus
WELKLEGSII

SEQ ID NO: 202338 - protein, 10 aa, Tick-borne encephalitis virus
PRRASKETAK

SEQ ID NO: 202339 - protein, 10 aa, Tick-borne encephalitis virus
RRVSKEAAKK

SEQ ID NO: 202340 - protein, 10 aa, Tick-borne encephalitis virus
RASKETAKKT

SEQ ID NO: 202341 - protein, 10 aa, Tick-borne encephalitis virus
VSKEAAKKTR

SEQ ID NO: 202342 - protein, 10 aa, Tick-borne encephalitis virus
SKEAAKKTRQ

SEQ ID NO: 202343 - protein, 10 aa, Tick-borne encephalitis virus
KEAAKKTRQS

SEQ ID NO: 202344 - protein, 10 aa, Tick-borne encephalitis virus
EAAKKTRQSR

SEQ ID NO: 202345 - protein, 10 aa, Tick-borne encephalitis virus
AAKKTRQSRV

SEQ ID NO: 202346 - protein, 10 aa, Tick-borne encephalitis virus
ARKTRQSRVQ

SEQ ID NO: 202347 - protein, 10 aa, Tick-borne encephalitis virus
RKTRQSRVQM

SEQ ID NO: 202348 - protein, 10 aa, Tick-borne encephalitis virus
TRQSRVQMPS

SEQ ID NO: 202349 - protein, 10 aa, Tick-borne encephalitis virus
RQSRVQMPSG

SEQ ID NO: 202350 - protein, 10 aa, Tick-borne encephalitis virus
QSRVQMPSGL

SEQ ID NO: 202351 - protein, 10 aa, Tick-borne encephalitis virus
SRVQMPSGLV

SEQ ID NO: 202352 - protein, 10 aa, Tick-borne encephalitis virus
RMMGFLWHAI

SEQ ID NO: 202353 - protein, 10 aa, Tick-borne encephalitis virus
MMGFLWHAIA

SEQ ID NO: 202354 - protein, 10 aa, Tick-borne encephalitis virus
MGFLWHAIAG

SEQ ID NO: 202355 - protein, 10 aa, Tick-borne encephalitis virus
FLWHAIAGTA

SEQ ID NO: 202356 - protein, 10 aa, Tick-borne encephalitis virus
WHAVAGTVRS

SEQ ID NO: 202357 - protein, 10 aa, Tick-borne encephalitis virus
HAVAGTVRSP

SEQ ID NO: 202358 - protein, 10 aa, Tick-borne encephalitis virus
AVAGTVRSPV

SEQ ID NO: 202359 - protein, 10 aa, Tick-borne encephalitis virus
VAGTVRSPVL

SEQ ID NO: 202360 - protein, 10 aa, Tick-borne encephalitis virus
SPVLKSFWKP

SEQ ID NO: 202361 - protein, 10 aa, Tick-borne encephalitis virus
PVLKSFWKPV

SEQ ID NO: 202362 - protein, 10 aa, Tick-borne encephalitis virus
VLKSFWKPVP

SEQ ID NO: 202363 - protein, 10 aa, Tick-borne encephalitis virus
LKSFWKPVPL

SEQ ID NO: 202364 - protein, 10 aa, Tick-borne encephalitis virus
KSFWKSVPLK

SEQ ID NO: 202365 - protein, 10 aa, Tick-borne encephalitis virus
SFWKSVPLKQ

SEQ ID NO: 202366 - protein, 10 aa, Tick-borne encephalitis virus
FWKPVPLKQA

SEQ ID NO: 202367 - protein, 10 aa, Tick-borne encephalitis virus
WNSVPLKQAM

SEQ ID NO: 202368 - protein, 10 aa, Tick-borne encephalitis virus
SVPLKQATTA

SEQ ID NO: 202369 - protein, 10 aa, Tick-borne encephalitis virus
VPLKQATTAL

SEQ ID NO: 202370 - protein, 10 aa, Tick-borne encephalitis virus
PLKQATTALR

SEQ ID NO: 202371 - protein, 10 aa, Tick-borne encephalitis virus
LKQATTALRK

SEQ ID NO: 202372 - protein, 10 aa, Tick-borne encephalitis virus
KQATTALRKI

SEQ ID NO: 202373 - protein, 10 aa, Tick-borne encephalitis virus
ATTALRKIKM

SEQ ID NO: 202374 - protein, 10 aa, Tick-borne encephalitis virus
TTALRKIKMA

SEQ ID NO: 202375 - protein, 10 aa, Tick-borne encephalitis virus
TALRKIKMAV

SEQ ID NO: 202376 - protein, 10 aa, Tick-borne encephalitis virus
ALRKIKMAVS

SEQ ID NO: 202377 - protein, 10 aa, Tick-borne encephalitis virus
LRKIKRAVST

SEQ ID NO: 202378 - protein, 10 aa, Tick-borne encephalitis virus
RKIKMAVSAL

SEQ ID NO: 202379 - protein, 10 aa, Tick-borne encephalitis virus
KIKMAVSALM

SEQ ID NO: 202380 - protein, 10 aa, Tick-borne encephalitis virus
AVSTLMIGLQ

SEQ ID NO: 202381 - protein, 10 aa, Tick-borne encephalitis virus
LMVGLQRREK

SEQ ID NO: 202382 - protein, 10 aa, Tick-borne encephalitis virus
MIGLQRRGKK

SEQ ID NO: 202383 - protein, 10 aa, Tick-borne encephalitis virus
VGLQRRGKKR

SEQ ID NO: 202384 - protein, 10 aa, Tick-borne encephalitis virus
GLQRREKKRS

SEQ ID NO: 202385 - protein, 10 aa, Tick-borne encephalitis virus
LQRREKKRST

SEQ ID NO: 202386 - protein, 10 aa, Tick-borne encephalitis virus
AFAATVRREG

SEQ ID NO: 202387 - protein, 10 aa, Tick-borne encephalitis virus
FAATVRKERD

SEQ ID NO: 202388 - protein, 10 aa, Tick-borne encephalitis virus
AATVRREGDG

SEQ ID NO: 202389 - protein, 10 aa, Tick-borne encephalitis virus
ATVRKERDDT

SEQ ID NO: 202390 - protein, 10 aa, Tick-borne encephalitis virus
TVRKERDDTT

SEQ ID NO: 202391 - protein, 10 aa, Tick-borne encephalitis virus
VRKERDDTTV

SEQ ID NO: 202392 - protein, 10 aa, Tick-borne encephalitis virus
RKERDDTTVI

SEQ ID NO: 202393 - protein, 10 aa, Tick-borne encephalitis virus
REGDGTTVIR

SEQ ID NO: 202394 - protein, 10 aa, Tick-borne encephalitis virus
ERDDTTVIRA

SEQ ID NO: 202395 - protein, 10 aa, Tick-borne encephalitis virus
RDDTTVIRAE

SEQ ID NO: 202396 - protein, 10 aa, Tick-borne encephalitis virus
GTTVIRAEGR

SEQ ID NO: 202397 - protein, 10 aa, Tick-borne encephalitis virus
CVIMATDMGS

SEQ ID NO: 202398 - protein, 10 aa, Tick-borne encephalitis virus
VIMATDMGSW

SEQ ID NO: 202399 - protein, 10 aa, Tick-borne encephalitis virus
ILATDMGAWC

SEQ ID NO: 202400 - protein, 10 aa, Tick-borne encephalitis virus
MATDMGSWCD

SEQ ID NO: 202401 - protein, 10 aa, Tick-borne encephalitis virus
VVWMTVESVV

SEQ ID NO: 202402 - protein, 10 aa, Tick-borne encephalitis virus
VWMTVESVVT

SEQ ID NO: 202403 - protein, 10 aa, Tick-borne encephalitis virus
WMTVESVVTR

SEQ ID NO: 202404 - protein, 10 aa, Tick-borne encephalitis virus
VAVLLCLAPV

SEQ ID NO: 202405 - protein, 10 aa, Tick-borne encephalitis virus
VVLFCLAPVY

SEQ ID NO: 202406 - protein, 10 aa, Tick-borne encephalitis virus
VWLDAIYQEK

SEQ ID NO: 202407 - protein, 10 aa, Tick-borne encephalitis virus
WLDAIYQEKP

SEQ ID NO: 202408 - protein, 10 aa, Tick-borne encephalitis virus
LDAIYQEKPA

SEQ ID NO: 202409 - protein, 10 aa, Tick-borne encephalitis virus
DAIYQENPAQ

SEQ ID NO: 202410 - protein, 10 aa, Tick-borne encephalitis virus
AIYQENPAQT

SEQ ID NO: 202411 - protein, 10 aa, Tick-borne encephalitis virus
IYQENPAQTR

SEQ ID NO: 202412 - protein, 10 aa, Tick-borne encephalitis virus
YQEKPAKTRE

SEQ ID NO: 202413 - protein, 10 aa, Tick-borne encephalitis virus
QENPAQTREY

SEQ ID NO: 202414 - protein, 10 aa, Tick-borne encephalitis virus
ENPAQTREYC

SEQ ID NO: 202415 - protein, 10 aa, Tick-borne encephalitis virus
KPAKTREYCL

SEQ ID NO: 202416 - protein, 10 aa, Tick-borne encephalitis virus
PATLTEEHQG

SEQ ID NO: 202417 - protein, 10 aa, Tick-borne encephalitis virus
ATLTEEHQGG

SEQ ID NO: 202418 - protein, 10 aa, Tick-borne encephalitis virus
TLTEEHQGGT

SEQ ID NO: 202419 - protein, 10 aa, Tick-borne encephalitis virus
LAEQHQSGTV

SEQ ID NO: 202420 - protein, 10 aa, Tick-borne encephalitis virus
TEEHQGGTVC

SEQ ID NO: 202421 - protein, 10 aa, Tick-borne encephalitis virus
GSIVTCVKAA

SEQ ID NO: 202422 - protein, 10 aa, Tick-borne encephalitis virus
SIVTCVKAAC

SEQ ID NO: 202423 - protein, 10 aa, Tick-borne encephalitis virus
IVTCVKAACE

SEQ ID NO: 202424 - protein, 10 aa, Tick-borne encephalitis virus
VTCVKAACEA

SEQ ID NO: 202425 - protein, 10 aa, Tick-borne encephalitis virus
TCVKAACEAK

SEQ ID NO: 202426 - protein, 10 aa, Tick-borne encephalitis virus
CVKVSCEAKK

SEQ ID NO: 202427 - protein, 10 aa, Tick-borne encephalitis virus
VKVSCEAKKK

SEQ ID NO: 202428 - protein, 10 aa, Tick-borne encephalitis virus
KVSCEAKKKA

SEQ ID NO: 202429 - protein, 10 aa, Tick-borne encephalitis virus
VSCEAKKKAT

SEQ ID NO: 202430 - protein, 10 aa, Tick-borne encephalitis virus
YDANKIVYTI

SEQ ID NO: 202431 - protein, 10 aa, Tick-borne encephalitis virus
DPNKIVYPVK

SEQ ID NO: 202432 - protein, 10 aa, Tick-borne encephalitis virus
ANRIVYTVKV

SEQ ID NO: 202433 - protein, 10 aa, Tick-borne encephalitis virus
NRIVYTVKVE

SEQ ID NO: 202434 - protein, 10 aa, Tick-borne encephalitis virus
KIVYPVKVEP

SEQ ID NO: 202435 - protein, 10 aa, Tick-borne encephalitis virus
ALPWKHEGAR

SEQ ID NO: 202436 - protein, 10 aa, Tick-borne encephalitis virus
HEGARNWNNA

SEQ ID NO: 202437 - protein, 10 aa, Tick-borne encephalitis virus
EGARNWNNAE

SEQ ID NO: 202438 - protein, 10 aa, Tick-borne encephalitis virus
GVQNWNNAER

SEQ ID NO: 202439 - protein, 10 aa, Tick-borne encephalitis virus
VQNWNNAERL

SEQ ID NO: 202440 - protein, 10 aa, Tick-borne encephalitis virus
RNWNNAERLV

SEQ ID NO: 202441 - protein, 10 aa, Tick-borne encephalitis virus
MCDKTKFTWR

SEQ ID NO: 202442 - protein, 10 aa, Tick-borne encephalitis virus
DKTKFTWKRT

SEQ ID NO: 202443 - protein, 10 aa, Tick-borne encephalitis virus
KTKFTWKRTP

SEQ ID NO: 202444 - protein, 10 aa, Tick-borne encephalitis virus
TKFTWKRTPT

SEQ ID NO: 202445 - protein, 10 aa, Tick-borne encephalitis virus
KFTWKRTPTD

SEQ ID NO: 202446 - protein, 10 aa, Tick-borne encephalitis virus
FTWKRTPTDS

SEQ ID NO: 202447 - protein, 10 aa, Tick-borne encephalitis virus
TWKRTPTDSG

SEQ ID NO: 202448 - protein, 10 aa, Tick-borne encephalitis virus
WRRTPTDSGH

SEQ ID NO: 202449 - protein, 10 aa, Tick-borne encephalitis virus
RRTPTDSGHD

SEQ ID NO: 202450 - protein, 10 aa, Tick-borne encephalitis virus
DFGSTGGLLT

SEQ ID NO: 202451 - protein, 10 aa, Tick-borne encephalitis virus
FGSTGGLLTS

SEQ ID NO: 202452 - protein, 10 aa, Tick-borne encephalitis virus
GSTGGLLTSV

SEQ ID NO: 202453 - protein, 10 aa, Tick-borne encephalitis virus
STGGLLTSVG

SEQ ID NO: 202454 - protein, 10 aa, Tick-borne encephalitis virus
TGGLLTSVGK

SEQ ID NO: 202455 - protein, 10 aa, Tick-borne encephalitis virus
GGLLTSVGKA

SEQ ID NO: 202456 - protein, 10 aa, Tick-borne encephalitis virus
GLLTSVGKAL

SEQ ID NO: 202457 - protein, 10 aa, Tick-borne encephalitis virus
LLTSVGKALH

SEQ ID NO: 202458 - protein, 10 aa, Tick-borne encephalitis virus
LSSIGKALHT

SEQ ID NO: 202459 - protein, 10 aa, Tick-borne encephalitis virus
SSIGKALHTV

SEQ ID NO: 202460 - protein, 10 aa, Tick-borne encephalitis virus
GVGFLPKILI

SEQ ID NO: 202461 - protein, 10 aa, Tick-borne encephalitis virus
VGFIPKLLLG

SEQ ID NO: 202462 - protein, 10 aa, Tick-borne encephalitis virus
GMALAWLGLN

SEQ ID NO: 202463 - protein, 10 aa, Tick-borne encephalitis virus
MALAWLGLNM

SEQ ID NO: 202464 - protein, 10 aa, Tick-borne encephalitis virus
AIKEAFEEGT

SEQ ID NO: 202465 - protein, 10 aa, Tick-borne encephalitis virus
IKEAFEEGTC

SEQ ID NO: 202466 - protein, 10 aa, Tick-borne encephalitis virus
KEAFEEGTCG

SEQ ID NO: 202467 - protein, 10 aa, Tick-borne encephalitis virus
EAFEEGTCGI

SEQ ID NO: 202468 - protein, 10 aa, Tick-borne encephalitis virus
AFEEGTCGIV

SEQ ID NO: 202469 - protein, 10 aa, Tick-borne encephalitis virus
FEEGTCGILP

SEQ ID NO: 202470 - protein, 10 aa, Tick-borne encephalitis virus
EEGTCGILPQ

SEQ ID NO: 202471 - protein, 10 aa, Tick-borne encephalitis virus
EGTCGILPQN

SEQ ID NO: 202472 - protein, 10 aa, Tick-borne encephalitis virus
GTCGILPQNR

SEQ ID NO: 202473 - protein, 10 aa, Tick-borne encephalitis virus
TCGILPQNRL

SEQ ID NO: 202474 - protein, 10 aa, Tick-borne encephalitis virus
LEMAMWRSSS

SEQ ID NO: 202475 - protein, 10 aa, Tick-borne encephalitis virus
EMAMWRSSST

SEQ ID NO: 202476 - protein, 10 aa, Tick-borne encephalitis virus
MAMWRSAATE

SEQ ID NO: 202477 - protein, 10 aa, Tick-borne encephalitis virus
AMWRSSSTEL

SEQ ID NO: 202478 - protein, 10 aa, Tick-borne encephalitis virus
MWRSSSTELN

SEQ ID NO: 202479 - protein, 10 aa, Tick-borne encephalitis virus
WRSSSTELNL

SEQ ID NO: 202480 - protein, 10 aa, Tick-borne encephalitis virus
RSAATELNLA

SEQ ID NO: 202481 - protein, 10 aa, Tick-borne encephalitis virus
SAATELNLAL

SEQ ID NO: 202482 - protein, 10 aa, Tick-borne encephalitis virus
SSTELNLALA

SEQ ID NO: 202483 - protein, 10 aa, Tick-borne encephalitis virus
FDPTDYRGGI

SEQ ID NO: 202484 - protein, 10 aa, Tick-borne encephalitis virus
YRGGVSGLLR

SEQ ID NO: 202485 - protein, 10 aa, Tick-borne encephalitis virus
RGGVSGLLRK

SEQ ID NO: 202486 - protein, 10 aa, Tick-borne encephalitis virus
GGIPGLLRKG

SEQ ID NO: 202487 - protein, 10 aa, Tick-borne encephalitis virus
GVSGLLRKGK

SEQ ID NO: 202488 - protein, 10 aa, Tick-borne encephalitis virus
IPGLLRKGKD

SEQ ID NO: 202489 - protein, 10 aa, Tick-borne encephalitis virus
IKVSWRSWGH

SEQ ID NO: 202490 - protein, 10 aa, Tick-borne encephalitis virus
KVSWRSWGHS

SEQ ID NO: 202491 - protein, 10 aa, Tick-borne encephalitis virus
MIWSIPEASR

SEQ ID NO: 202492 - protein, 10 aa, Tick-borne encephalitis virus
RRFMVGIEGS

SEQ ID NO: 202493 - protein, 10 aa, Tick-borne encephalitis virus
KVFVDFRQES

SEQ ID NO: 202494 - protein, 10 aa, Tick-borne encephalitis virus
VFLDFRQEAT

SEQ ID NO: 202495 - protein, 10 aa, Tick-borne encephalitis virus
FVDFRQESTH

SEQ ID NO: 202496 - protein, 10 aa, Tick-borne encephalitis virus
LDFRQEATHE

SEQ ID NO: 202497 - protein, 10 aa, Tick-borne encephalitis virus
DQSLWMKSMK

SEQ ID NO: 202498 - protein, 10 aa, Tick-borne encephalitis virus
QSLWMKSMKN

SEQ ID NO: 202499 - protein, 10 aa, Tick-borne encephalitis virus
SLWMKSMKND

SEQ ID NO: 202500 - protein, 10 aa, Tick-borne encephalitis virus
LWMKSMKNDT

SEQ ID NO: 202501 - protein, 10 aa, Tick-borne encephalitis virus
WMKSMKNDTG

SEQ ID NO: 202502 - protein, 10 aa, Tick-borne encephalitis virus
MKSMKNDTGT

SEQ ID NO: 202503 - protein, 10 aa, Tick-borne encephalitis virus
KSMKNDTGTY

SEQ ID NO: 202504 - protein, 10 aa, Tick-borne encephalitis virus
SVRNETGTYI

SEQ ID NO: 202505 - protein, 10 aa, Tick-borne encephalitis virus
VRNETGTYIV

SEQ ID NO: 202506 - protein, 10 aa, Tick-borne encephalitis virus
DNPEVVDSEL

SEQ ID NO: 202507 - protein, 10 aa, Tick-borne encephalitis virus
NPEVVDSELF

SEQ ID NO: 202508 - protein, 10 aa, Tick-borne encephalitis virus
PEVVDSELFL

SEQ ID NO: 202509 - protein, 10 aa, Tick-borne encephalitis virus
EQVKGPWKYL

SEQ ID NO: 202510 - protein, 10 aa, Tick-borne encephalitis virus
QVKGPWKYLP

SEQ ID NO: 202511 - protein, 10 aa, Tick-borne encephalitis virus
VKGPWKYLPI

SEQ ID NO: 202512 - protein, 10 aa, Tick-borne encephalitis virus
KGPWKYLPIR

SEQ ID NO: 202513 - protein, 10 aa, Tick-borne encephalitis virus
GPWKYLPIRV

SEQ ID NO: 202514 - protein, 10 aa, Tick-borne encephalitis virus
VVRGECPGTK

SEQ ID NO: 202515 - protein, 10 aa, Tick-borne encephalitis virus
IREECPGTRV

SEQ ID NO: 202516 - protein, 10 aa, Tick-borne encephalitis virus
ITADCDKRGA

SEQ ID NO: 202517 - protein, 10 aa, Tick-borne encephalitis virus
SADCDRRGAS

SEQ ID NO: 202518 - protein, 10 aa, Tick-borne encephalitis virus
IRRRPSTGST

SEQ ID NO: 202519 - protein, 10 aa, Tick-borne encephalitis virus
RRRPSTGSTV

SEQ ID NO: 202520 - protein, 10 aa, Tick-borne encephalitis virus
RRPATGTTAV

SEQ ID NO: 202521 - protein, 10 aa, Tick-borne encephalitis virus
RPATGTTAVW

SEQ ID NO: 202522 - protein, 10 aa, Tick-borne encephalitis virus
PATGTTAVWG

SEQ ID NO: 202523 - protein, 10 aa, Tick-borne encephalitis virus
STGSTVVWGG

SEQ ID NO: 202524 - protein, 10 aa, Tick-borne encephalitis virus
WGGLIVLALL

SEQ ID NO: 202525 - protein, 10 aa, Tick-borne encephalitis virus
GGLIVLALLV

SEQ ID NO: 202526 - protein, 10 aa, Tick-borne encephalitis virus
GLIVLALLVT

SEQ ID NO: 202527 - protein, 10 aa, Tick-borne encephalitis virus
IVVFALLVTG

SEQ ID NO: 202528 - protein, 10 aa, Tick-borne encephalitis virus
IVLALLVTGM

SEQ ID NO: 202529 - protein, 10 aa, Tick-borne encephalitis virus
LALLVTGMVK

SEQ ID NO: 202530 - protein, 10 aa, Tick-borne encephalitis virus
VKVESLVRYV

SEQ ID NO: 202531 - protein, 10 aa, Tick-borne encephalitis virus
KVESLVRYVV

SEQ ID NO: 202532 - protein, 10 aa, Tick-borne encephalitis virus
LLSAFALRRN

SEQ ID NO: 202533 - protein, 10 aa, Tick-borne encephalitis virus
LSAFALRRNL

SEQ ID NO: 202534 - protein, 10 aa, Tick-borne encephalitis virus
SAFALRRNLT

SEQ ID NO: 202535 - protein, 10 aa, Tick-borne encephalitis virus
AFALRRNLTV

SEQ ID NO: 202536 - protein, 10 aa, Tick-borne encephalitis virus
FALRRNLTVR

SEQ ID NO: 202537 - protein, 10 aa, Tick-borne encephalitis virus
ALRRNLTVRE

SEQ ID NO: 202538 - protein, 10 aa, Tick-borne encephalitis virus
LRRNLTVREM

SEQ ID NO: 202539 - protein, 10 aa, Tick-borne encephalitis virus
RRNLTVREMV

SEQ ID NO: 202540 - protein, 10 aa, Tick-borne encephalitis virus
RNLTVREMVT

SEQ ID NO: 202541 - protein, 10 aa, Tick-borne encephalitis virus
SLTVREMVIT

SEQ ID NO: 202542 - protein, 10 aa, Tick-borne encephalitis virus
LRACTAEGKA

SEQ ID NO: 202543 - protein, 10 aa, Tick-borne encephalitis virus
ACTAEGKTGV

SEQ ID NO: 202544 - protein, 10 aa, Tick-borne encephalitis virus
CTAEGKAGVG

SEQ ID NO: 202545 - protein, 10 aa, Tick-borne encephalitis virus
TAEGKAGVGL

SEQ ID NO: 202546 - protein, 10 aa, Tick-borne encephalitis virus
AEGKTGVGLL

SEQ ID NO: 202547 - protein, 10 aa, Tick-borne encephalitis virus
EGKTGVGLLL

SEQ ID NO: 202548 - protein, 10 aa, Tick-borne encephalitis virus
GKAGVGLLLM

SEQ ID NO: 202549 - protein, 10 aa, Tick-borne encephalitis virus
KAGVGLLLMP

SEQ ID NO: 202550 - protein, 10 aa, Tick-borne encephalitis virus
AGVGLLLMPL

SEQ ID NO: 202551 - protein, 10 aa, Tick-borne encephalitis virus
GVGLLLMPLL

SEQ ID NO: 202552 - protein, 10 aa, Tick-borne encephalitis virus
VGLLLMALIT

SEQ ID NO: 202553 - protein, 10 aa, Tick-borne encephalitis virus
LLLMALITQQ

SEQ ID NO: 202554 - protein, 10 aa, Tick-borne encephalitis virus
LLMALMTQQN

SEQ ID NO: 202555 - protein, 10 aa, Tick-borne encephalitis virus
WRLLRGHREQ

SEQ ID NO: 202556 - protein, 10 aa, Tick-borne encephalitis virus
RLLRGHREQK

SEQ ID NO: 202557 - protein, 10 aa, Tick-borne encephalitis virus
LLEGHREQKG

SEQ ID NO: 202558 - protein, 10 aa, Tick-borne encephalitis virus
LEGHREQKGL

SEQ ID NO: 202559 - protein, 10 aa, Tick-borne encephalitis virus
EGHREQKGLT

SEQ ID NO: 202560 - protein, 10 aa, Tick-borne encephalitis virus
HREQKGLSWT

SEQ ID NO: 202561 - protein, 10 aa, Tick-borne encephalitis virus
REQKGLSWTV

SEQ ID NO: 202562 - protein, 10 aa, Tick-borne encephalitis virus
EQKGLSWTVP

SEQ ID NO: 202563 - protein, 10 aa, Tick-borne encephalitis virus
QKGLSWTVPL

SEQ ID NO: 202564 - protein, 10 aa, Tick-borne encephalitis virus
KGLSWTVPLA

SEQ ID NO: 202565 - protein, 10 aa, Tick-borne encephalitis virus
VPMARLLGGE

SEQ ID NO: 202566 - protein, 10 aa, Tick-borne encephalitis virus
PLAGLVGGEG

SEQ ID NO: 202567 - protein, 10 aa, Tick-borne encephalitis virus
MARLLGGEGS

SEQ ID NO: 202568 - protein, 10 aa, Tick-borne encephalitis virus
AGLVGGEGSG

SEQ ID NO: 202569 - protein, 10 aa, Tick-borne encephalitis virus
GLMGGEGSGI

SEQ ID NO: 202570 - protein, 10 aa, Tick-borne encephalitis virus
LVGGEGSGIR

SEQ ID NO: 202571 - protein, 10 aa, Tick-borne encephalitis virus
VGGEGSGIRL

SEQ ID NO: 202572 - protein, 10 aa, Tick-borne encephalitis virus
IRLLSFWELS

SEQ ID NO: 202573 - protein, 10 aa, Tick-borne encephalitis virus
SGRRRSFSEP

SEQ ID NO: 202574 - protein, 10 aa, Tick-borne encephalitis virus
AGLAASALHW

SEQ ID NO: 202575 - protein, 10 aa, Tick-borne encephalitis virus
GLAASALHWS

SEQ ID NO: 202576 - protein, 10 aa, Tick-borne encephalitis virus
LSASAFHWSG

SEQ ID NO: 202577 - protein, 10 aa, Tick-borne encephalitis virus
AASALHWSGI

SEQ ID NO: 202578 - protein, 10 aa, Tick-borne encephalitis virus
ASAIHWSGII

SEQ ID NO: 202579 - protein, 10 aa, Tick-borne encephalitis virus
SAIHWSGIIG

SEQ ID NO: 202580 - protein, 10 aa, Tick-borne encephalitis virus
AIHWSGIIGV

SEQ ID NO: 202581 - protein, 10 aa, Tick-borne encephalitis virus
IHWSGIIGVM

SEQ ID NO: 202582 - protein, 10 aa, Tick-borne encephalitis virus
MGLWTLTKML

SEQ ID NO: 202583 - protein, 10 aa, Tick-borne encephalitis virus
GLWTLSEMLK

SEQ ID NO: 202584 - protein, 10 aa, Tick-borne encephalitis virus
ARRSDLAFSG

SEQ ID NO: 202585 - protein, 10 aa, Tick-borne encephalitis virus
SDLVFSGQGN

SEQ ID NO: 202586 - protein, 10 aa, Tick-borne encephalitis virus
DLVFSGQGRG

SEQ ID NO: 202587 - protein, 10 aa, Tick-borne encephalitis virus
LVFSGQGRGE

SEQ ID NO: 202588 - protein, 10 aa, Tick-borne encephalitis virus
VFSGQGRGER

SEQ ID NO: 202589 - protein, 10 aa, Tick-borne encephalitis virus
GQGNRERGDR

SEQ ID NO: 202590 - protein, 10 aa, Tick-borne encephalitis virus
QGNRERGDRP

SEQ ID NO: 202591 - protein, 10 aa, Tick-borne encephalitis virus
GRGERGDKPF

SEQ ID NO: 202592 - protein, 10 aa, Tick-borne encephalitis virus
NRERGDRPFE

SEQ ID NO: 202593 - protein, 10 aa, Tick-borne encephalitis virus
ERGDKPFEVR

SEQ ID NO: 202594 - protein, 10 aa, Tick-borne encephalitis virus
RGDKPFEVRD

SEQ ID NO: 202595 - protein, 10 aa, Tick-borne encephalitis virus
GDKPFEVRDG

SEQ ID NO: 202596 - protein, 10 aa, Tick-borne encephalitis virus
DKPFEVRDGV

SEQ ID NO: 202597 - protein, 10 aa, Tick-borne encephalitis virus
KPFEVRDGVY

SEQ ID NO: 202598 - protein, 10 aa, Tick-borne encephalitis virus
FSPGLFWGQR

SEQ ID NO: 202599 - protein, 10 aa, Tick-borne encephalitis virus
SPGLFWGQSQ

SEQ ID NO: 202600 - protein, 10 aa, Tick-borne encephalitis virus
PGLFWGQRQV

SEQ ID NO: 202601 - protein, 10 aa, Tick-borne encephalitis virus
GLFWGQSQVG

SEQ ID NO: 202602 - protein, 10 aa, Tick-borne encephalitis virus
LFWGQRQVGV

SEQ ID NO: 202603 - protein, 10 aa, Tick-borne encephalitis virus
FWGQRQVGVG

SEQ ID NO: 202604 - protein, 10 aa, Tick-borne encephalitis virus
QSQVGVGYGS

SEQ ID NO: 202605 - protein, 10 aa, Tick-borne encephalitis virus
SQVGVGYGSK

SEQ ID NO: 202606 - protein, 10 aa, Tick-borne encephalitis virus
VTRGAALSVD

SEQ ID NO: 202607 - protein, 10 aa, Tick-borne encephalitis virus
TRGAALYIDD

SEQ ID NO: 202608 - protein, 10 aa, Tick-borne encephalitis virus
RGAALYIDDA

SEQ ID NO: 202609 - protein, 10 aa, Tick-borne encephalitis virus
GAALYIDDAV

SEQ ID NO: 202610 - protein, 10 aa, Tick-borne encephalitis virus
AALYIDDAVA

SEQ ID NO: 202611 - protein, 10 aa, Tick-borne encephalitis virus
ALYIDDAVAG

SEQ ID NO: 202612 - protein, 10 aa, Tick-borne encephalitis virus
LSVDDAVVGP

SEQ ID NO: 202613 - protein, 10 aa, Tick-borne encephalitis virus
YIDDAVAGPY

SEQ ID NO: 202614 - protein, 10 aa, Tick-borne encephalitis virus
VDDAVVGPYW

SEQ ID NO: 202615 - protein, 10 aa, Tick-borne encephalitis virus
DDAVAGPYWS

SEQ ID NO: 202616 - protein, 10 aa, Tick-borne encephalitis virus
DAVAGPYWSD

SEQ ID NO: 202617 - protein, 10 aa, Tick-borne encephalitis virus
AVAGPYWSDV

SEQ ID NO: 202618 - protein, 10 aa, Tick-borne encephalitis virus
VAGPYWAEVK

SEQ ID NO: 202619 - protein, 10 aa, Tick-borne encephalitis virus
AGPYWAEVKE

SEQ ID NO: 202620 - protein, 10 aa, Tick-borne encephalitis virus
GPYWAEVKED

SEQ ID NO: 202621 - protein, 10 aa, Tick-borne encephalitis virus
PYWAEVKEDV

SEQ ID NO: 202622 - protein, 10 aa, Tick-borne encephalitis virus
YWSDVREDVV

SEQ ID NO: 202623 - protein, 10 aa, Tick-borne encephalitis virus
WSDVREDVVC

SEQ ID NO: 202624 - protein, 10 aa, Tick-borne encephalitis virus
SDVREDVVCY

SEQ ID NO: 202625 - protein, 10 aa, Tick-borne encephalitis virus
GAVLIDLSKG

SEQ ID NO: 202626 - protein, 10 aa, Tick-borne encephalitis virus
AVLIDLSKGT

SEQ ID NO: 202627 - protein, 10 aa, Tick-borne encephalitis virus
VLIDLSKGTS

SEQ ID NO: 202628 - protein, 10 aa, Tick-borne encephalitis virus
LSKGTSRSPI

SEQ ID NO: 202629 - protein, 10 aa, Tick-borne encephalitis virus
AKGTSGSPTL

SEQ ID NO: 202630 - protein, 10 aa, Tick-borne encephalitis virus
KGTSGSPIIN

SEQ ID NO: 202631 - protein, 10 aa, Tick-borne encephalitis virus
GTSGSPIINS

SEQ ID NO: 202632 - protein, 10 aa, Tick-borne encephalitis virus
TSGSPTLNSQ

SEQ ID NO: 202633 - protein, 10 aa, Tick-borne encephalitis virus
SGSPIINSQG

SEQ ID NO: 202634 - protein, 10 aa, Tick-borne encephalitis virus
SPTLNSQGVV

SEQ ID NO: 202635 - protein, 10 aa, Tick-borne encephalitis virus
PIINSQGVVV

SEQ ID NO: 202636 - protein, 10 aa, Tick-borne encephalitis virus
IINSQGVVVG

SEQ ID NO: 202637 - protein, 10 aa, Tick-borne encephalitis virus
INSQGVVVGL

SEQ ID NO: 202638 - protein, 10 aa, Tick-borne encephalitis virus
QGEAEKSRPS

SEQ ID NO: 202639 - protein, 10 aa, Tick-borne encephalitis virus
GEAEKSRPSL

SEQ ID NO: 202640 - protein, 10 aa, Tick-borne encephalitis virus
EAERSRPNLP

SEQ ID NO: 202641 - protein, 10 aa, Tick-borne encephalitis virus
AERSRPNLPQ

SEQ ID NO: 202642 - protein, 10 aa, Tick-borne encephalitis virus
EKSRPSLPPA

SEQ ID NO: 202643 - protein, 10 aa, Tick-borne encephalitis virus
RSRPNLPQAV

SEQ ID NO: 202644 - protein, 10 aa, Tick-borne encephalitis virus
GIGWTAKGQI

SEQ ID NO: 202645 - protein, 10 aa, Tick-borne encephalitis virus
IGWTAKGQIT

SEQ ID NO: 202646 - protein, 10 aa, Tick-borne encephalitis virus
RVRFHSPVVG

SEQ ID NO: 202647 - protein, 10 aa, Tick-borne encephalitis virus
VRFLSPAVSD

SEQ ID NO: 202648 - protein, 10 aa, Tick-borne encephalitis virus
RFHSPAVGDH

SEQ ID NO: 202649 - protein, 10 aa, Tick-borne encephalitis virus
FLSPAVSDQQ

SEQ ID NO: 202650 - protein, 10 aa, Tick-borne encephalitis virus
DQQVGGSIVD

SEQ ID NO: 202651 - protein, 10 aa, Tick-borne encephalitis virus
SNRGITSEVK

SEQ ID NO: 202652 - protein, 10 aa, Tick-borne encephalitis virus
NRGITSEVKQ

SEQ ID NO: 202653 - protein, 10 aa, Tick-borne encephalitis virus
RGITSEVKQI

SEQ ID NO: 202654 - protein, 10 aa, Tick-borne encephalitis virus
GITSEVKQIP

SEQ ID NO: 202655 - protein, 10 aa, Tick-borne encephalitis virus
SEERQIPNGE

SEQ ID NO: 202656 - protein, 10 aa, Tick-borne encephalitis virus
EERQIPNGEW

SEQ ID NO: 202657 - protein, 10 aa, Tick-borne encephalitis virus
VKQIPEGEWR

SEQ ID NO: 202658 - protein, 10 aa, Tick-borne encephalitis virus
RQIPNGEWRD

SEQ ID NO: 202659 - protein, 10 aa, Tick-borne encephalitis virus
FVPSIVKGGI

SEQ ID NO: 202660 - protein, 10 aa, Tick-borne encephalitis virus
VPSIVKGGII

SEQ ID NO: 202661 - protein, 10 aa, Tick-borne encephalitis virus
PSIVKGGIIA

SEQ ID NO: 202662 - protein, 10 aa, Tick-borne encephalitis virus
SIVKGGIIAR

SEQ ID NO: 202663 - protein, 10 aa, Tick-borne encephalitis virus
IVKGGIIART

SEQ ID NO: 202664 - protein, 10 aa, Tick-borne encephalitis virus
VKGGIIARTL

SEQ ID NO: 202665 - protein, 10 aa, Tick-borne encephalitis virus
KGGIIARALR

SEQ ID NO: 202666 - protein, 10 aa, Tick-borne encephalitis virus
GGIIARALRQ

SEQ ID NO: 202667 - protein, 10 aa, Tick-borne encephalitis virus
GIIARALRQK

SEQ ID NO: 202668 - protein, 10 aa, Tick-borne encephalitis virus
IIARALRQKG

SEQ ID NO: 202669 - protein, 10 aa, Tick-borne encephalitis virus
PRRGRVGRQE

SEQ ID NO: 202670 - protein, 10 aa, Tick-borne encephalitis virus
GRVGRQEGRI

SEQ ID NO: 202671 - protein, 10 aa, Tick-borne encephalitis virus
RVGRQEGRID

SEQ ID NO: 202672 - protein, 10 aa, Tick-borne encephalitis virus
VGRQEGRIDE

SEQ ID NO: 202673 - protein, 10 aa, Tick-borne encephalitis virus
GRQEGRIDEY

SEQ ID NO: 202674 - protein, 10 aa, Tick-borne encephalitis virus
RQEGRIDEYI

SEQ ID NO: 202675 - protein, 10 aa, Tick-borne encephalitis virus
QEGRIDEYIY

SEQ ID NO: 202676 - protein, 10 aa, Tick-borne encephalitis virus
SGQCDDDDGG

SEQ ID NO: 202677 - protein, 10 aa, Tick-borne encephalitis virus
GQCDDDDSVL

SEQ ID NO: 202678 - protein, 10 aa, Tick-borne encephalitis virus
QCDDDDSVLV

SEQ ID NO: 202679 - protein, 10 aa, Tick-borne encephalitis virus
CDDDDGGLVQ

SEQ ID NO: 202680 - protein, 10 aa, Tick-borne encephalitis virus
DDDDSVLVQW

SEQ ID NO: 202681 - protein, 10 aa, Tick-borne encephalitis virus
DDDGGLVQWK

SEQ ID NO: 202682 - protein, 10 aa, Tick-borne encephalitis virus
DDSVLVQWKE

SEQ ID NO: 202683 - protein, 10 aa, Tick-borne encephalitis virus
DSVLVQWKEA

SEQ ID NO: 202684 - protein, 10 aa, Tick-borne encephalitis virus
SVLVQWKEAQ

SEQ ID NO: 202685 - protein, 10 aa, Tick-borne encephalitis virus
EAQILLDNII

SEQ ID NO: 202686 - protein, 10 aa, Tick-borne encephalitis virus
AQILLDNIIT

SEQ ID NO: 202687 - protein, 10 aa, Tick-borne encephalitis virus
NITTLRGPVV

SEQ ID NO: 202688 - protein, 10 aa, Tick-borne encephalitis virus
ANVSGVTSRN

SEQ ID NO: 202689 - protein, 10 aa, Tick-borne encephalitis virus
NVSSVTSRSW

SEQ ID NO: 202690 - protein, 10 aa, Tick-borne encephalitis virus
VSGVTSRNWT

SEQ ID NO: 202691 - protein, 10 aa, Tick-borne encephalitis virus
SGVTSRNWTW

SEQ ID NO: 202692 - protein, 10 aa, Tick-borne encephalitis virus
SVTSRSWTWE

SEQ ID NO: 202693 - protein, 10 aa, Tick-borne encephalitis virus
ANAVDEASGG

SEQ ID NO: 202694 - protein, 10 aa, Tick-borne encephalitis virus
NAVDEASGGL

SEQ ID NO: 202695 - protein, 10 aa, Tick-borne encephalitis virus
AVDEASGGLV

SEQ ID NO: 202696 - protein, 10 aa, Tick-borne encephalitis virus
EASGGLVTFR

SEQ ID NO: 202697 - protein, 10 aa, Tick-borne encephalitis virus
ASGGLVTFRS

SEQ ID NO: 202698 - protein, 10 aa, Tick-borne encephalitis virus
SGGLVTFRSP

SEQ ID NO: 202699 - protein, 10 aa, Tick-borne encephalitis virus
TLMHEKPDSR

SEQ ID NO: 202700 - protein, 10 aa, Tick-borne encephalitis virus
LMHDEPGSRA

SEQ ID NO: 202701 - protein, 10 aa, Tick-borne encephalitis virus
MHEEPGSSAM

SEQ ID NO: 202702 - protein, 10 aa, Tick-borne encephalitis virus
HEKPDSRAMR

SEQ ID NO: 202703 - protein, 10 aa, Tick-borne encephalitis virus
DEPGSRAMKM

SEQ ID NO: 202704 - protein, 10 aa, Tick-borne encephalitis virus
KPDSRAMRMA

SEQ ID NO: 202705 - protein, 10 aa, Tick-borne encephalitis virus
PDSRAMRMAE

SEQ ID NO: 202706 - protein, 10 aa, Tick-borne encephalitis virus
GSSAMRMAER

SEQ ID NO: 202707 - protein, 10 aa, Tick-borne encephalitis virus
DAPEAFLTMA

SEQ ID NO: 202708 - protein, 10 aa, Tick-borne encephalitis virus
APEAFLTLVE

SEQ ID NO: 202709 - protein, 10 aa, Tick-borne encephalitis virus
AEMLVLGLAT

SEQ ID NO: 202710 - protein, 10 aa, Tick-borne encephalitis virus
EMMVLGLGTL

SEQ ID NO: 202711 - protein, 10 aa, Tick-borne encephalitis virus
MMVLGLGTLG

SEQ ID NO: 202712 - protein, 10 aa, Tick-borne encephalitis virus
GVVWCFVART

SEQ ID NO: 202713 - protein, 10 aa, Tick-borne encephalitis virus
VVWCFVVRAS

SEQ ID NO: 202714 - protein, 10 aa, Tick-borne encephalitis virus
VWCFVVRASI

SEQ ID NO: 202715 - protein, 10 aa, Tick-borne encephalitis virus
LVLLWAGGVS

SEQ ID NO: 202716 - protein, 10 aa, Tick-borne encephalitis virus
VLLWAGGVSY

SEQ ID NO: 202717 - protein, 10 aa, Tick-borne encephalitis virus
EKTKADLSAV

SEQ ID NO: 202718 - protein, 10 aa, Tick-borne encephalitis virus
KTKADLSAVL

SEQ ID NO: 202719 - protein, 10 aa, Tick-borne encephalitis virus
KADLSAVLWS

SEQ ID NO: 202720 - protein, 10 aa, Tick-borne encephalitis virus
EMRSWEEWTN

SEQ ID NO: 202721 - protein, 10 aa, Tick-borne encephalitis virus
VRSWEEWTNI

SEQ ID NO: 202722 - protein, 10 aa, Tick-borne encephalitis virus
RDLGGGAPFL

SEQ ID NO: 202723 - protein, 10 aa, Tick-borne encephalitis virus
DLGGGAPFIG

SEQ ID NO: 202724 - protein, 10 aa, Tick-borne encephalitis virus
LGGGAPFLGV

SEQ ID NO: 202725 - protein, 10 aa, Tick-borne encephalitis virus
GGGAPFLGVA

SEQ ID NO: 202726 - protein, 10 aa, Tick-borne encephalitis virus
GGAPFIGVAG

SEQ ID NO: 202727 - protein, 10 aa, Tick-borne encephalitis virus
GAPFIGVAGH

SEQ ID NO: 202728 - protein, 10 aa, Tick-borne encephalitis virus
APFFGIAGHV

SEQ ID NO: 202729 - protein, 10 aa, Tick-borne encephalitis virus
PFFGIAGHVM

SEQ ID NO: 202730 - protein, 10 aa, Tick-borne encephalitis virus
GVAGHVMSLG

SEQ ID NO: 202731 - protein, 10 aa, Tick-borne encephalitis virus
VAGHVMSLGV

SEQ ID NO: 202732 - protein, 10 aa, Tick-borne encephalitis virus
AGHVMSLGVV

SEQ ID NO: 202733 - protein, 10 aa, Tick-borne encephalitis virus
GHVMSLGVVS

SEQ ID NO: 202734 - protein, 10 aa, Tick-borne encephalitis virus
HVMSLGVVSL

SEQ ID NO: 202735 - protein, 10 aa, Tick-borne encephalitis virus
VMSLGVVSLV

SEQ ID NO: 202736 - protein, 10 aa, Tick-borne encephalitis virus
MSLGVVSLVG

SEQ ID NO: 202737 - protein, 10 aa, Tick-borne encephalitis virus
ERRMSLVLAI

SEQ ID NO: 202738 - protein, 10 aa, Tick-borne encephalitis virus
MSLVLATVLC

SEQ ID NO: 202739 - protein, 10 aa, Tick-borne encephalitis virus
SLVLATVLCL

SEQ ID NO: 202740 - protein, 10 aa, Tick-borne encephalitis virus
VLCLISVVMN

SEQ ID NO: 202741 - protein, 10 aa, Tick-borne encephalitis virus
LMSVVMNRTM

SEQ ID NO: 202742 - protein, 10 aa, Tick-borne encephalitis virus
SVVMNRTVLS

SEQ ID NO: 202743 - protein, 10 aa, Tick-borne encephalitis virus
VVMNRTMASI

SEQ ID NO: 202744 - protein, 10 aa, Tick-borne encephalitis virus
VMNRTMASIT

SEQ ID NO: 202745 - protein, 10 aa, Tick-borne encephalitis virus
MNRTVLSITE

SEQ ID NO: 202746 - protein, 10 aa, Tick-borne encephalitis virus
NRTMASITEA

SEQ ID NO: 202747 - protein, 10 aa, Tick-borne encephalitis virus
RTVLSITEAS

SEQ ID NO: 202748 - protein, 10 aa, Tick-borne encephalitis virus
TVLSITEASA

SEQ ID NO: 202749 - protein, 10 aa, Tick-borne encephalitis virus
MASITEASAV

SEQ ID NO: 202750 - protein, 10 aa, Tick-borne encephalitis virus
LSITEASAVG

SEQ ID NO: 202751 - protein, 10 aa, Tick-borne encephalitis virus
EAAAVGLAAA

SEQ ID NO: 202752 - protein, 10 aa, Tick-borne encephalitis virus
AAAVGLAAAG

SEQ ID NO: 202753 - protein, 10 aa, Tick-borne encephalitis virus
AAVGLAAAGQ

SEQ ID NO: 202754 - protein, 10 aa, Tick-borne encephalitis virus
GLAALGQLLR

SEQ ID NO: 202755 - protein, 10 aa, Tick-borne encephalitis virus
LAALGQLLRP

SEQ ID NO: 202756 - protein, 10 aa, Tick-borne encephalitis virus
AAAGQLLKPE

SEQ ID NO: 202757 - protein, 10 aa, Tick-borne encephalitis virus
GQLLKPEADT

SEQ ID NO: 202758 - protein, 10 aa, Tick-borne encephalitis virus
QLLKPEADTL

SEQ ID NO: 202759 - protein, 10 aa, Tick-borne encephalitis virus
LLKPEADTLW

SEQ ID NO: 202760 - protein, 10 aa, Tick-borne encephalitis virus
LKPEADTLWT

SEQ ID NO: 202761 - protein, 10 aa, Tick-borne encephalitis virus
RPEEDTLWTM

SEQ ID NO: 202762 - protein, 10 aa, Tick-borne encephalitis virus
VACGLSGVVT

SEQ ID NO: 202763 - protein, 10 aa, Tick-borne encephalitis virus
ACGLSGVVTG

SEQ ID NO: 202764 - protein, 10 aa, Tick-borne encephalitis virus
CGLSGVVTGS

SEQ ID NO: 202765 - protein, 10 aa, Tick-borne encephalitis virus
GLSGVVTGSL

SEQ ID NO: 202766 - protein, 10 aa, Tick-borne encephalitis virus
LSGVVTGSLW

SEQ ID NO: 202767 - protein, 10 aa, Tick-borne encephalitis virus
ASGSRRGGSD

SEQ ID NO: 202768 - protein, 10 aa, Tick-borne encephalitis virus
SGSRRGGSDG

SEQ ID NO: 202769 - protein, 10 aa, Tick-borne encephalitis virus
GSRRGGSDGD

SEQ ID NO: 202770 - protein, 10 aa, Tick-borne encephalitis virus
SRRGGSDGDT

SEQ ID NO: 202771 - protein, 10 aa, Tick-borne encephalitis virus
LNSCTREEFF

SEQ ID NO: 202772 - protein, 10 aa, Tick-borne encephalitis virus
NSCTREEFFI

SEQ ID NO: 202773 - protein, 10 aa, Tick-borne encephalitis virus
SCTREEFFAY

SEQ ID NO: 202774 - protein, 10 aa, Tick-borne encephalitis virus
CTREEFFAYR

SEQ ID NO: 202775 - protein, 10 aa, Tick-borne encephalitis virus
TREEFFIYRR

SEQ ID NO: 202776 - protein, 10 aa, Tick-borne encephalitis virus
EEFFVYRRAG

SEQ ID NO: 202777 - protein, 10 aa, Tick-borne encephalitis virus
EFFIYRRTGI

SEQ ID NO: 202778 - protein, 10 aa, Tick-borne encephalitis virus
FFIYRRTGIL

SEQ ID NO: 202779 - protein, 10 aa, Tick-borne encephalitis virus
FVYRRTGIME

SEQ ID NO: 202780 - protein, 10 aa, Tick-borne encephalitis virus
IYRRTGILET

SEQ ID NO: 202781 - protein, 10 aa, Tick-borne encephalitis virus
TGIMETERDK

SEQ ID NO: 202782 - protein, 10 aa, Tick-borne encephalitis virus
RDKARELLKK

SEQ ID NO: 202783 - protein, 10 aa, Tick-borne encephalitis virus
DKARELLKKG

SEQ ID NO: 202784 - protein, 10 aa, Tick-borne encephalitis virus
KARELLKKGE

SEQ ID NO: 202785 - protein, 10 aa, Tick-borne encephalitis virus
ARELLKKGET

SEQ ID NO: 202786 - protein, 10 aa, Tick-borne encephalitis virus
RELLKKGETN

SEQ ID NO: 202787 - protein, 10 aa, Tick-borne encephalitis virus
RGETNVGLAV

SEQ ID NO: 202788 - protein, 10 aa, Tick-borne encephalitis virus
ASRPAVMNVR

SEQ ID NO: 202789 - protein, 10 aa, Tick-borne encephalitis virus
SRPAVMNVRA

SEQ ID NO: 202790 - protein, 10 aa, Tick-borne encephalitis virus
RPAVMNVRAY

SEQ ID NO: 202791 - protein, 10 aa, Tick-borne encephalitis virus
PAVMNVRAYT

SEQ ID NO: 202792 - protein, 10 aa, Tick-borne encephalitis virus
AVMNVRAYTI

SEQ ID NO: 202793 - protein, 10 aa, Tick-borne encephalitis virus
NVRAYTIGGK

SEQ ID NO: 202794 - protein, 10 aa, Tick-borne encephalitis virus
VKAYTIGGRG

SEQ ID NO: 202795 - protein, 10 aa, Tick-borne encephalitis virus
KAYTIGGRGH

SEQ ID NO: 202796 - protein, 10 aa, Tick-borne encephalitis virus
YTIGGRGHET

SEQ ID NO: 202797 - protein, 10 aa, Tick-borne encephalitis virus
TIGGRGHETP

SEQ ID NO: 202798 - protein, 10 aa, Tick-borne encephalitis virus
IGGRGHETPK

SEQ ID NO: 202799 - protein, 10 aa, Tick-borne encephalitis virus
GGKGHETPRM

SEQ ID NO: 202800 - protein, 10 aa, Tick-borne encephalitis virus
GKGHETPRMV

SEQ ID NO: 202801 - protein, 10 aa, Tick-borne encephalitis virus
RGHETPKMVT

SEQ ID NO: 202802 - protein, 10 aa, Tick-borne encephalitis virus
TVMCDIGESN

SEQ ID NO: 202803 - protein, 10 aa, Tick-borne encephalitis virus
VMCDIGESNP

SEQ ID NO: 202804 - protein, 10 aa, Tick-borne encephalitis virus
NPDAVVEGEK

SEQ ID NO: 202805 - protein, 10 aa, Tick-borne encephalitis virus
AVVEGEKTRK

SEQ ID NO: 202806 - protein, 10 aa, Tick-borne encephalitis virus
VVEGEKTRKV

SEQ ID NO: 202807 - protein, 10 aa, Tick-borne encephalitis virus
QWKNRNPAAA

SEQ ID NO: 202808 - protein, 10 aa, Tick-borne encephalitis virus
WKNRNPAAAC

SEQ ID NO: 202809 - protein, 10 aa, Tick-borne encephalitis virus
KIRNPTATCV

SEQ ID NO: 202810 - protein, 10 aa, Tick-borne encephalitis virus
NRNPAAACVF

SEQ ID NO: 202811 - protein, 10 aa, Tick-borne encephalitis virus
IETLHRFQLQ

SEQ ID NO: 202812 - protein, 10 aa, Tick-borne encephalitis virus
ETLHRFQLQW

SEQ ID NO: 202813 - protein, 10 aa, Tick-borne encephalitis virus
TLHRFQLQWG

SEQ ID NO: 202814 - protein, 10 aa, Tick-borne encephalitis virus
VGTRCVFLAE

SEQ ID NO: 202815 - protein, 10 aa, Tick-borne encephalitis virus
TRCVFLAEDK

SEQ ID NO: 202816 - protein, 10 aa, Tick-borne encephalitis virus
RCVVLADDKV

SEQ ID NO: 202817 - protein, 10 aa, Tick-borne encephalitis virus
CVFLAEDKVK

SEQ ID NO: 202818 - protein, 10 aa, Tick-borne encephalitis virus
VFLAEDKVKE

SEQ ID NO: 202819 - protein, 10 aa, Tick-borne encephalitis virus
LAEDKVREKD

SEQ ID NO: 202820 - protein, 10 aa, Tick-borne encephalitis virus
AEDKVREKDV

SEQ ID NO: 202821 - protein, 10 aa, Tick-borne encephalitis virus
DKVREKDVQE

SEQ ID NO: 202822 - protein, 10 aa, Tick-borne encephalitis virus
KVREKDVQER

SEQ ID NO: 202823 - protein, 10 aa, Tick-borne encephalitis virus
VKEQDVRERI

SEQ ID NO: 202824 - protein, 10 aa, Tick-borne encephalitis virus
ERINALREQY

SEQ ID NO: 202825 - protein, 10 aa, Tick-borne encephalitis virus
DAEHPYRTWQ

SEQ ID NO: 202826 - protein, 10 aa, Tick-borne encephalitis virus
AEHPYRTWQY

SEQ ID NO: 202827 - protein, 10 aa, Tick-borne encephalitis virus
DWILERLAQR

SEQ ID NO: 202828 - protein, 10 aa, Tick-borne encephalitis virus
WMLDRLAQKS

SEQ ID NO: 202829 - protein, 10 aa, Tick-borne encephalitis virus
RPRMCSREEF

SEQ ID NO: 202830 - protein, 10 aa, Tick-borne encephalitis virus
SSAALGAWSD

SEQ ID NO: 202831 - protein, 10 aa, Tick-borne encephalitis virus
NAALGAWSEE

SEQ ID NO: 202832 - protein, 10 aa, Tick-borne encephalitis virus
AWSNEQNRWS

SEQ ID NO: 202833 - protein, 10 aa, Tick-borne encephalitis virus
SAKEAVEDPV

SEQ ID NO: 202834 - protein, 10 aa, Tick-borne encephalitis virus
EAVEDPAFWR

SEQ ID NO: 202835 - protein, 10 aa, Tick-borne encephalitis virus
AVEDPAFWRL

SEQ ID NO: 202836 - protein, 10 aa, Tick-borne encephalitis virus
VEDPAFWRLV

SEQ ID NO: 202837 - protein, 10 aa, Tick-borne encephalitis virus
EDPAFWRLVD

SEQ ID NO: 202838 - protein, 10 aa, Tick-borne encephalitis virus
DPAFWRLVDE

SEQ ID NO: 202839 - protein, 10 aa, Tick-borne encephalitis virus
PAFWRLVDEE

SEQ ID NO: 202840 - protein, 10 aa, Tick-borne encephalitis virus
AFWRLVDEER

SEQ ID NO: 202841 - protein, 10 aa, Tick-borne encephalitis virus
FWKLVDEERE

SEQ ID NO: 202842 - protein, 10 aa, Tick-borne encephalitis virus
WKLVDEERER

SEQ ID NO: 202843 - protein, 10 aa, Tick-borne encephalitis virus
QLVDEERERD

SEQ ID NO: 202844 - protein, 10 aa, Tick-borne encephalitis virus
VDEERERDLA

SEQ ID NO: 202845 - protein, 10 aa, Tick-borne encephalitis virus
DEERERHLTG

SEQ ID NO: 202846 - protein, 10 aa, Tick-borne encephalitis virus
EERERHLTGR

SEQ ID NO: 202847 - protein, 10 aa, Tick-borne encephalitis virus
ERERDLAGRS

SEQ ID NO: 202848 - protein, 10 aa, Tick-borne encephalitis virus
RERDLAGRSA

SEQ ID NO: 202849 - protein, 10 aa, Tick-borne encephalitis virus
ERDLAGRSAH

SEQ ID NO: 202850 - protein, 10 aa, Tick-borne encephalitis virus
RHLTGRCAHC

SEQ ID NO: 202851 - protein, 10 aa, Tick-borne encephalitis virus
HLTGRCAHCV

SEQ ID NO: 202852 - protein, 10 aa, Tick-borne encephalitis virus
GRCAHCAYNM

SEQ ID NO: 202853 - protein, 10 aa, Tick-borne encephalitis virus
RSAHGVFNIM

SEQ ID NO: 202854 - protein, 10 aa, Tick-borne encephalitis virus
CAHCAYNMMG

SEQ ID NO: 202855 - protein, 10 aa, Tick-borne encephalitis virus
AHCAYNMMGK

SEQ ID NO: 202856 - protein, 10 aa, Tick-borne encephalitis virus
HGVFNIMGKR

SEQ ID NO: 202857 - protein, 10 aa, Tick-borne encephalitis virus
GVFNIMGKRE

SEQ ID NO: 202858 - protein, 10 aa, Tick-borne encephalitis virus
VFNIMGKREK

SEQ ID NO: 202859 - protein, 10 aa, Tick-borne encephalitis virus
HWASRGFSGS

SEQ ID NO: 202860 - protein, 10 aa, Tick-borne encephalitis virus
WASRGFSGSG

SEQ ID NO: 202861 - protein, 10 aa, Tick-borne encephalitis virus
ASRESSGSGV

SEQ ID NO: 202862 - protein, 10 aa, Tick-borne encephalitis virus
SRGFSGSGVE

SEQ ID NO: 202863 - protein, 10 aa, Tick-borne encephalitis virus
RGFSGSGVEG

SEQ ID NO: 202864 - protein, 10 aa, Tick-borne encephalitis virus
GSSGAGVEGI

SEQ ID NO: 202865 - protein, 10 aa, Tick-borne encephalitis virus
LNYLGWHLKR

SEQ ID NO: 202866 - protein, 10 aa, Tick-borne encephalitis virus
NYLGWYLKEL

SEQ ID NO: 202867 - protein, 10 aa, Tick-borne encephalitis virus
YLGWYLKELS

SEQ ID NO: 202868 - protein, 10 aa, Tick-borne encephalitis virus
LSTPEGGLFY

SEQ ID NO: 202869 - protein, 10 aa, Tick-borne encephalitis virus
STPEGGLFYA

SEQ ID NO: 202870 - protein, 10 aa, Tick-borne encephalitis virus
TPEGGLFYAD

SEQ ID NO: 202871 - protein, 10 aa, Tick-borne encephalitis virus
LLRYMEGEHR

SEQ ID NO: 202872 - protein, 10 aa, Tick-borne encephalitis virus
GEHKQLAATV

SEQ ID NO: 202873 - protein, 10 aa, Tick-borne encephalitis virus
EHKQLAATVM

SEQ ID NO: 202874 - protein, 10 aa, Tick-borne encephalitis virus
HKQLAATVMQ

SEQ ID NO: 202875 - protein, 10 aa, Tick-borne encephalitis virus
KQLAATVMQK

SEQ ID NO: 202876 - protein, 10 aa, Tick-borne encephalitis virus
MEGEGVVEAS

SEQ ID NO: 202877 - protein, 10 aa, Tick-borne encephalitis virus
EGEGVVEASD

SEQ ID NO: 202878 - protein, 10 aa, Tick-borne encephalitis virus
GEGVVEASDA

SEQ ID NO: 202879 - protein, 10 aa, Tick-borne encephalitis virus
EGVVEASDAH

SEQ ID NO: 202880 - protein, 10 aa, Tick-borne encephalitis virus
GVVEASDAHN

SEQ ID NO: 202881 - protein, 10 aa, Tick-borne encephalitis virus
VVEASDAHNP

SEQ ID NO: 202882 - protein, 10 aa, Tick-borne encephalitis virus
VEASDAHNPR

SEQ ID NO: 202883 - protein, 10 aa, Tick-borne encephalitis virus
ATDAHNPRLF

SEQ ID NO: 202884 - protein, 10 aa, Tick-borne encephalitis virus
TDAHNPRLFR

SEQ ID NO: 202885 - protein, 10 aa, Tick-borne encephalitis virus
LLRVERWLRE

SEQ ID NO: 202886 - protein, 10 aa, Tick-borne encephalitis virus
RVERWLRDYG

SEQ ID NO: 202887 - protein, 10 aa, Tick-borne encephalitis virus
EHGGERLGRM

SEQ ID NO: 202888 - protein, 10 aa, Tick-borne encephalitis virus
SGDDCVVRGI

SEQ ID NO: 202889 - protein, 10 aa, Tick-borne encephalitis virus
GDDCVVRGID

SEQ ID NO: 202890 - protein, 10 aa, Tick-borne encephalitis virus
DDCVVRGIDD

SEQ ID NO: 202891 - protein, 10 aa, Tick-borne encephalitis virus
DCVVRGIDDR

SEQ ID NO: 202892 - protein, 10 aa, Tick-borne encephalitis virus
CVVRGIDDRF

SEQ ID NO: 202893 - protein, 10 aa, Tick-borne encephalitis virus
VVRPVDDRFG

SEQ ID NO: 202894 - protein, 10 aa, Tick-borne encephalitis virus
DDRFGRALYF

SEQ ID NO: 202895 - protein, 10 aa, Tick-borne encephalitis virus
DRFGRALYFL

SEQ ID NO: 202896 - protein, 10 aa, Tick-borne encephalitis virus
RFGRALYFLN

SEQ ID NO: 202897 - protein, 10 aa, Tick-borne encephalitis virus
FGRALYFLND

SEQ ID NO: 202898 - protein, 10 aa, Tick-borne encephalitis virus
GRALYFLNDM

SEQ ID NO: 202899 - protein, 10 aa, Tick-borne encephalitis virus
IGEWEHSAGL

SEQ ID NO: 202900 - protein, 10 aa, Tick-borne encephalitis virus
GEWEHSAGLS

SEQ ID NO: 202901 - protein, 10 aa, Tick-borne encephalitis virus
GWEEVPFCSH

SEQ ID NO: 202902 - protein, 10 aa, Tick-borne encephalitis virus
LVMKDGRALV

SEQ ID NO: 202903 - protein, 10 aa, Tick-borne encephalitis virus
VMKDGRALVV

SEQ ID NO: 202904 - protein, 10 aa, Tick-borne encephalitis virus
MKDGRALVVP

SEQ ID NO: 202905 - protein, 10 aa, Tick-borne encephalitis virus
KDGRALVVPC

SEQ ID NO: 202906 - protein, 10 aa, Tick-borne encephalitis virus
DGRALVVPCR

SEQ ID NO: 202907 - protein, 10 aa, Tick-borne encephalitis virus
GRALVVPCRD

SEQ ID NO: 202908 - protein, 10 aa, Tick-borne encephalitis virus
RALVVPCRDQ

SEQ ID NO: 202909 - protein, 10 aa, Tick-borne encephalitis virus
ALVVPCRDQD

SEQ ID NO: 202910 - protein, 10 aa, Tick-borne encephalitis virus
RVSPGCGWSI

SEQ ID NO: 202911 - protein, 10 aa, Tick-borne encephalitis virus
DLRTLGLAIS

SEQ ID NO: 202912 - protein, 10 aa, Tick-borne encephalitis virus
LRTLGLTICS

SEQ ID NO: 202913 - protein, 10 aa, Tick-borne encephalitis virus
RTLGLAISSA

SEQ ID NO: 202914 - protein, 10 aa, Tick-borne encephalitis virus
TLGLTICSAV

SEQ ID NO: 202915 - protein, 10 aa, Tick-borne encephalitis virus
LGFAICSAVP

SEQ ID NO: 202916 - protein, 10 aa, Tick-borne encephalitis virus
SAVPTDWVPT

SEQ ID NO: 202917 - protein, 10 aa, Tick-borne encephalitis virus
AVPTDWVPTG

SEQ ID NO: 202918 - protein, 10 aa, Tick-borne encephalitis virus
VPTDWVPTGR

SEQ ID NO: 202919 - protein, 10 aa, Tick-borne encephalitis virus
PTDWVPTGRT

SEQ ID NO: 202920 - protein, 10 aa, Tick-borne encephalitis virus
TDWVPTGRTT

SEQ ID NO: 202921 - protein, 10 aa, Tick-borne encephalitis virus
ASGSWMTTED

SEQ ID NO: 202922 - protein, 10 aa, Tick-borne encephalitis virus
SGSWMTTEDM

SEQ ID NO: 202923 - protein, 10 aa, Tick-borne encephalitis virus
GAWITTEDML

SEQ ID NO: 202924 - protein, 10 aa, Tick-borne encephalitis virus
AWMTTENMLD

SEQ ID NO: 202925 - protein, 10 aa, Tick-borne encephalitis virus
LDNPFMHGKE

SEQ ID NO: 202926 - protein, 10 aa, Tick-borne encephalitis virus
DNPFMQNKGK

SEQ ID NO: 202927 - protein, 10 aa, Tick-borne encephalitis virus
WRNVPYLPKA

SEQ ID NO: 202928 - protein, 10 aa, Tick-borne encephalitis virus
VPYLPKAHDM

SEQ ID NO: 202929 - protein, 10 aa, Tick-borne encephalitis virus
GRTERAEWAK

SEQ ID NO: 202930 - protein, 10 aa, Tick-borne encephalitis virus
RTERAEWAKN

SEQ ID NO: 202931 - protein, 10 aa, Tick-borne encephalitis virus
TERAEWAKNI

SEQ ID NO: 202932 - protein, 10 aa, Tick-borne encephalitis virus
GAVEKVRKMV

SEQ ID NO: 202933 - protein, 10 aa, Tick-borne encephalitis virus
AVEKVRKMMG

SEQ ID NO: 202934 - protein, 10 aa, Tick-borne encephalitis virus
RFKDYLSCMD

SEQ ID NO: 202935 - protein, 10 aa, Tick-borne encephalitis virus
YLHWNLKLES

SEQ ID NO: 202936 - protein, 10 aa, Tick-borne encephalitis virus
LHWNLKLESS

SEQ ID NO: 202937 - protein, 10 aa, Tick-borne encephalitis virus
HWELKLEGSI

SEQ ID NO: 202938 - protein, 10 aa, Tick-borne encephalitis virus
WNLKLESSIF

SEQ ID NO: 202939 - protein, 10 aa, Tick-borne encephalitis virus
PRRVSKEAAK

SEQ ID NO: 202940 - protein, 10 aa, Tick-borne encephalitis virus
RRASKETAKK

SEQ ID NO: 202941 - protein, 10 aa, Tick-borne encephalitis virus
RVSKEAAKKT

SEQ ID NO: 202942 - protein, 10 aa, Tick-borne encephalitis virus
ASKETAKKTR

SEQ ID NO: 202943 - protein, 10 aa, Tick-borne encephalitis virus
KSFWKPVPLK

SEQ ID NO: 202944 - protein, 10 aa, Tick-borne encephalitis virus
SFWKPVPLKQ

SEQ ID NO: 202945 - protein, 10 aa, Tick-borne encephalitis virus
WKPVPLKQAT

SEQ ID NO: 202946 - protein, 10 aa, Tick-borne encephalitis virus
PVPLKQATAA

SEQ ID NO: 202947 - protein, 10 aa, Tick-borne encephalitis virus
TAALRKIKRA

SEQ ID NO: 202948 - protein, 10 aa, Tick-borne encephalitis virus
LRKIKMAVSA

SEQ ID NO: 202949 - protein, 10 aa, Tick-borne encephalitis virus
RKIKRAVSTL

SEQ ID NO: 202950 - protein, 10 aa, Tick-borne encephalitis virus
KIKRAVSTLM

SEQ ID NO: 202951 - protein, 10 aa, Tick-borne encephalitis virus
AVSALMVGLQ

SEQ ID NO: 202952 - protein, 10 aa, Tick-borne encephalitis virus
MVGLQRREKK

SEQ ID NO: 202953 - protein, 10 aa, Tick-borne encephalitis virus
VGLQRREKKR

SEQ ID NO: 202954 - protein, 10 aa, Tick-borne encephalitis virus
LQKRGKRRSV

SEQ ID NO: 202955 - protein, 10 aa, Tick-borne encephalitis virus
TFAATVRKER

SEQ ID NO: 202956 - protein, 10 aa, Tick-borne encephalitis virus
IAATVRKERD

SEQ ID NO: 202957 - protein, 10 aa, Tick-borne encephalitis virus
ATVRREGDGT

SEQ ID NO: 202958 - protein, 10 aa, Tick-borne encephalitis virus
TVRREGDGTT

SEQ ID NO: 202959 - protein, 10 aa, Tick-borne encephalitis virus
VRREGDGTTV

SEQ ID NO: 202960 - protein, 10 aa, Tick-borne encephalitis virus
RREGDGTTVI

SEQ ID NO: 202961 - protein, 10 aa, Tick-borne encephalitis virus
KERDDTTVIR

SEQ ID NO: 202962 - protein, 10 aa, Tick-borne encephalitis virus
IVWMTVESVV

SEQ ID NO: 202963 - protein, 10 aa, Tick-borne encephalitis virus
VVVLFCLAPV

SEQ ID NO: 202964 - protein, 10 aa, Tick-borne encephalitis virus
DAIYQEKPAK

SEQ ID NO: 202965 - protein, 10 aa, Tick-borne encephalitis virus
AIYQEKPAKT

SEQ ID NO: 202966 - protein, 10 aa, Tick-borne encephalitis virus
GSIVTCVKVS

SEQ ID NO: 202967 - protein, 10 aa, Tick-borne encephalitis virus
SIVTCVKVSC

SEQ ID NO: 202968 - protein, 10 aa, Tick-borne encephalitis virus
IVTCVKVSCE

SEQ ID NO: 202969 - protein, 10 aa, Tick-borne encephalitis virus
VTCVKVSCEA

SEQ ID NO: 202970 - protein, 10 aa, Tick-borne encephalitis virus
TCVKVSCEAK

SEQ ID NO: 202971 - protein, 10 aa, Tick-borne encephalitis virus
HEGVQNWNNA

SEQ ID NO: 202972 - protein, 10 aa, Tick-borne encephalitis virus
EGVQNWNNAE

SEQ ID NO: 202973 - protein, 10 aa, Tick-borne encephalitis virus
GARNWNNAER

SEQ ID NO: 202974 - protein, 10 aa, Tick-borne encephalitis virus
ARNWNNAERL

SEQ ID NO: 202975 - protein, 10 aa, Tick-borne encephalitis virus
DKTKFTWRRT

SEQ ID NO: 202976 - protein, 10 aa, Tick-borne encephalitis virus
KTKFTWRRTP

SEQ ID NO: 202977 - protein, 10 aa, Tick-borne encephalitis virus
TKFTWRRTPT

SEQ ID NO: 202978 - protein, 10 aa, Tick-borne encephalitis virus
KFTWRRTPTD

SEQ ID NO: 202979 - protein, 10 aa, Tick-borne encephalitis virus
FTWRRTPTDS

SEQ ID NO: 202980 - protein, 10 aa, Tick-borne encephalitis virus
TWRRTPTDSG

SEQ ID NO: 202981 - protein, 10 aa, Tick-borne encephalitis virus
GFLSSIGKAL

SEQ ID NO: 202982 - protein, 10 aa, Tick-borne encephalitis virus
FLSSIGKALH

SEQ ID NO: 202983 - protein, 10 aa, Tick-borne encephalitis virus
GVGFIPKLLL

SEQ ID NO: 202984 - protein, 10 aa, Tick-borne encephalitis virus
VGFLPKILIG

SEQ ID NO: 202985 - protein, 10 aa, Tick-borne encephalitis virus
AIRETFEEGT

SEQ ID NO: 202986 - protein, 10 aa, Tick-borne encephalitis virus
IRETFEEGTC

SEQ ID NO: 202987 - protein, 10 aa, Tick-borne encephalitis virus
RETFEEGTCG

SEQ ID NO: 202988 - protein, 10 aa, Tick-borne encephalitis virus
TFEEGTCGIL

SEQ ID NO: 202989 - protein, 10 aa, Tick-borne encephalitis virus
LEMAMWRSAA

SEQ ID NO: 202990 - protein, 10 aa, Tick-borne encephalitis virus
EMAMWRSAAT

SEQ ID NO: 202991 - protein, 10 aa, Tick-borne encephalitis virus
MAMWRSSSTE

SEQ ID NO: 202992 - protein, 10 aa, Tick-borne encephalitis virus
AMWRSAATEL

SEQ ID NO: 202993 - protein, 10 aa, Tick-borne encephalitis virus
MWRSAATELN

SEQ ID NO: 202994 - protein, 10 aa, Tick-borne encephalitis virus
WRSAATELNL

SEQ ID NO: 202995 - protein, 10 aa, Tick-borne encephalitis virus
RSSSTELNLA

SEQ ID NO: 202996 - protein, 10 aa, Tick-borne encephalitis virus
SSSTELNLAL

SEQ ID NO: 202997 - protein, 10 aa, Tick-borne encephalitis virus
AATELNLALA

SEQ ID NO: 202998 - protein, 10 aa, Tick-borne encephalitis virus
RVSWKSWGHS

SEQ ID NO: 202999 - protein, 10 aa, Tick-borne encephalitis virus
VIWSIPEAPR

SEQ ID NO: 203000 - protein, 10 aa, Tick-borne encephalitis virus
SLWMKSVRNE

SEQ ID NO: 203001 - protein, 10 aa, Tick-borne encephalitis virus
LWMKSVRNET

SEQ ID NO: 203002 - protein, 10 aa, Tick-borne encephalitis virus
WMKSVRNETG

SEQ ID NO: 203003 - protein, 10 aa, Tick-borne encephalitis virus
MKSVRNETGT

SEQ ID NO: 203004 - protein, 10 aa, Tick-borne encephalitis virus
KSVRNETGTY

SEQ ID NO: 203005 - protein, 10 aa, Tick-borne encephalitis virus
VIREECPGTR

SEQ ID NO: 203006 - protein, 10 aa, Tick-borne encephalitis virus
VRGECPGTKV

SEQ ID NO: 203007 - protein, 10 aa, Tick-borne encephalitis virus
ISADCDRRGA

SEQ ID NO: 203008 - protein, 10 aa, Tick-borne encephalitis virus
TADCDKRGAS

SEQ ID NO: 203009 - protein, 10 aa, Tick-borne encephalitis virus
RRPSTGSTVV

SEQ ID NO: 203010 - protein, 10 aa, Tick-borne encephalitis virus
RPSTGSTVVW

SEQ ID NO: 203011 - protein, 10 aa, Tick-borne encephalitis virus
PSTGSTVVWG

SEQ ID NO: 203012 - protein, 10 aa, Tick-borne encephalitis virus
ATGTTAVWGG

SEQ ID NO: 203013 - protein, 10 aa, Tick-borne encephalitis virus
WGGIVVFALL

SEQ ID NO: 203014 - protein, 10 aa, Tick-borne encephalitis virus
GGIVVFALLV

SEQ ID NO: 203015 - protein, 10 aa, Tick-borne encephalitis virus
GIVVFALLVT

SEQ ID NO: 203016 - protein, 10 aa, Tick-borne encephalitis virus
LIVLALLVTG

SEQ ID NO: 203017 - protein, 10 aa, Tick-borne encephalitis virus
FALLVTGLVR

SEQ ID NO: 203018 - protein, 10 aa, Tick-borne encephalitis virus
RSLTVREMVI

SEQ ID NO: 203019 - protein, 10 aa, Tick-borne encephalitis virus
SLTVREMVTI

SEQ ID NO: 203020 - protein, 10 aa, Tick-borne encephalitis virus
LLMALITQQD

SEQ ID NO: 203021 - protein, 10 aa, Tick-borne encephalitis virus
WRLLEGHREQ

SEQ ID NO: 203022 - protein, 10 aa, Tick-borne encephalitis virus
RLLEGHREQK

SEQ ID NO: 203023 - protein, 10 aa, Tick-borne encephalitis virus
QKGLSWIVPM

SEQ ID NO: 203024 - protein, 10 aa, Tick-borne encephalitis virus
KGLSWIVPMA

SEQ ID NO: 203025 - protein, 10 aa, Tick-borne encephalitis virus
VPLAGLVGGE

SEQ ID NO: 203026 - protein, 10 aa, Tick-borne encephalitis virus
PMARLLGGEG

SEQ ID NO: 203027 - protein, 10 aa, Tick-borne encephalitis virus
LAGLVGGEGS

SEQ ID NO: 203028 - protein, 10 aa, Tick-borne encephalitis virus
GLVGGEGSGI

SEQ ID NO: 203029 - protein, 10 aa, Tick-borne encephalitis virus
AGLSASAFHW

SEQ ID NO: 203030 - protein, 10 aa, Tick-borne encephalitis virus
GLSASAFHWS

SEQ ID NO: 203031 - protein, 10 aa, Tick-borne encephalitis virus
LAASALHWSG

SEQ ID NO: 203032 - protein, 10 aa, Tick-borne encephalitis virus
SASAFHWSGI

SEQ ID NO: 203033 - protein, 10 aa, Tick-borne encephalitis virus
ASALHWSGIL

SEQ ID NO: 203034 - protein, 10 aa, Tick-borne encephalitis virus
SALHWSGILG

SEQ ID NO: 203035 - protein, 10 aa, Tick-borne encephalitis virus
ALHWSGILGV

SEQ ID NO: 203036 - protein, 10 aa, Tick-borne encephalitis virus
LHWSGILGVM

SEQ ID NO: 203037 - protein, 10 aa, Tick-borne encephalitis virus
GLWTLTKMLR

SEQ ID NO: 203038 - protein, 10 aa, Tick-borne encephalitis virus
SGLVFSGQGG

SEQ ID NO: 203039 - protein, 10 aa, Tick-borne encephalitis virus
GLVFSGQGGR

SEQ ID NO: 203040 - protein, 10 aa, Tick-borne encephalitis virus
RQVGVGYGFR

SEQ ID NO: 203041 - protein, 10 aa, Tick-borne encephalitis virus
AALSIDDAVV

SEQ ID NO: 203042 - protein, 10 aa, Tick-borne encephalitis virus
ALSIDDAVVG

SEQ ID NO: 203043 - protein, 10 aa, Tick-borne encephalitis virus
LYIDDAVAGP

SEQ ID NO: 203044 - protein, 10 aa, Tick-borne encephalitis virus
SIDDAVVGPY

SEQ ID NO: 203045 - protein, 10 aa, Tick-borne encephalitis virus
VAGPYWSDVR

SEQ ID NO: 203046 - protein, 10 aa, Tick-borne encephalitis virus
AGPYWSDVRE

SEQ ID NO: 203047 - protein, 10 aa, Tick-borne encephalitis virus
AKGTSGSPII

SEQ ID NO: 203048 - protein, 10 aa, Tick-borne encephalitis virus
GTSGSPTLNS

SEQ ID NO: 203049 - protein, 10 aa, Tick-borne encephalitis virus
TSRSPILNAQ

SEQ ID NO: 203050 - protein, 10 aa, Tick-borne encephalitis virus
SGSPTLNSQG

SEQ ID NO: 203051 - protein, 10 aa, Tick-borne encephalitis virus
SPIINSQGVV

SEQ ID NO: 203052 - protein, 10 aa, Tick-borne encephalitis virus
PTLNSQGVVV

SEQ ID NO: 203053 - protein, 10 aa, Tick-borne encephalitis virus
TLNSQGVVVG

SEQ ID NO: 203054 - protein, 10 aa, Tick-borne encephalitis virus
AEKSRPSLPP

SEQ ID NO: 203055 - protein, 10 aa, Tick-borne encephalitis virus
GSGWTAKGQI

SEQ ID NO: 203056 - protein, 10 aa, Tick-borne encephalitis virus
SGWTAKGQIT

SEQ ID NO: 203057 - protein, 10 aa, Tick-borne encephalitis virus
RFLSPAVSDQ

SEQ ID NO: 203058 - protein, 10 aa, Tick-borne encephalitis virus
FHSPVVGDQQ

SEQ ID NO: 203059 - protein, 10 aa, Tick-borne encephalitis virus
DHQGGGAIVD

SEQ ID NO: 203060 - protein, 10 aa, Tick-borne encephalitis virus
SEVKQIPEGE

SEQ ID NO: 203061 - protein, 10 aa, Tick-borne encephalitis virus
EVKQIPEGEW

SEQ ID NO: 203062 - protein, 10 aa, Tick-borne encephalitis virus
ERQIPNGEWR

SEQ ID NO: 203063 - protein, 10 aa, Tick-borne encephalitis virus
IAKGGIIARA

SEQ ID NO: 203064 - protein, 10 aa, Tick-borne encephalitis virus
AKGGIIARAL

SEQ ID NO: 203065 - protein, 10 aa, Tick-borne encephalitis virus
HDEPGSRAMK

SEQ ID NO: 203066 - protein, 10 aa, Tick-borne encephalitis virus
EEPGSSAMRM

SEQ ID NO: 203067 - protein, 10 aa, Tick-borne encephalitis virus
DAPEAFLTLV

SEQ ID NO: 203068 - protein, 10 aa, Tick-borne encephalitis virus
APEAFLTMAE

SEQ ID NO: 203069 - protein, 10 aa, Tick-borne encephalitis virus
VEMMVLGLGT

SEQ ID NO: 203070 - protein, 10 aa, Tick-borne encephalitis virus
EVRSWEEWTN

SEQ ID NO: 203071 - protein, 10 aa, Tick-borne encephalitis virus
MRSWEEWTNI

SEQ ID NO: 203072 - protein, 10 aa, Tick-borne encephalitis virus
LGGGAPFIGV

SEQ ID NO: 203073 - protein, 10 aa, Tick-borne encephalitis virus
GGGAPFFGIA

SEQ ID NO: 203074 - protein, 10 aa, Tick-borne encephalitis virus
GGAPFFGIAG

SEQ ID NO: 203075 - protein, 10 aa, Tick-borne encephalitis virus
GAPFFGIAGH

SEQ ID NO: 203076 - protein, 10 aa, Tick-borne encephalitis virus
APFIGVAGHV

SEQ ID NO: 203077 - protein, 10 aa, Tick-borne encephalitis virus
PFIGVAGHVM

SEQ ID NO: 203078 - protein, 10 aa, Tick-borne encephalitis virus
GIAGHVMALG

SEQ ID NO: 203079 - protein, 10 aa, Tick-borne encephalitis virus
IAGHVMALGV

SEQ ID NO: 203080 - protein, 10 aa, Tick-borne encephalitis virus
MSLVLAVALC

SEQ ID NO: 203081 - protein, 10 aa, Tick-borne encephalitis virus
SLVLAVALCL

SEQ ID NO: 203082 - protein, 10 aa, Tick-borne encephalitis virus
SVVMNRTMAS

SEQ ID NO: 203083 - protein, 10 aa, Tick-borne encephalitis virus
RTVPSITEAA

SEQ ID NO: 203084 - protein, 10 aa, Tick-borne encephalitis virus
TVPSITEAAA

SEQ ID NO: 203085 - protein, 10 aa, Tick-borne encephalitis virus
VLSITEASAV

SEQ ID NO: 203086 - protein, 10 aa, Tick-borne encephalitis virus
GLAAAGQLLK

SEQ ID NO: 203087 - protein, 10 aa, Tick-borne encephalitis virus
LAAAGQLLKP

SEQ ID NO: 203088 - protein, 10 aa, Tick-borne encephalitis virus
AALGQLLRPE

SEQ ID NO: 203089 - protein, 10 aa, Tick-borne encephalitis virus
GQLLRPEEDT

SEQ ID NO: 203090 - protein, 10 aa, Tick-borne encephalitis virus
QLLRPEEDTL

SEQ ID NO: 203091 - protein, 10 aa, Tick-borne encephalitis virus
LLRPEEDTLW

SEQ ID NO: 203092 - protein, 10 aa, Tick-borne encephalitis virus
LRPEEDTLWT

SEQ ID NO: 203093 - protein, 10 aa, Tick-borne encephalitis virus
KPEADTLWTM

SEQ ID NO: 203094 - protein, 10 aa, Tick-borne encephalitis virus
NSCTREEFFA

SEQ ID NO: 203095 - protein, 10 aa, Tick-borne encephalitis virus
SCTREEFFIY

SEQ ID NO: 203096 - protein, 10 aa, Tick-borne encephalitis virus
CTREEFFIYR

SEQ ID NO: 203097 - protein, 10 aa, Tick-borne encephalitis virus
TREEFFAYRR

SEQ ID NO: 203098 - protein, 10 aa, Tick-borne encephalitis virus
FFVYRRAGIL

SEQ ID NO: 203099 - protein, 10 aa, Tick-borne encephalitis virus
FIYRRTGILE

SEQ ID NO: 203100 - protein, 10 aa, Tick-borne encephalitis virus
VYRRTGIMET

SEQ ID NO: 203101 - protein, 10 aa, Tick-borne encephalitis virus
RDRARELLRR

SEQ ID NO: 203102 - protein, 10 aa, Tick-borne encephalitis virus
DKARELLKRG

SEQ ID NO: 203103 - protein, 10 aa, Tick-borne encephalitis virus
KARELLKRGE

SEQ ID NO: 203104 - protein, 10 aa, Tick-borne encephalitis virus
SVKAYTIGGR

SEQ ID NO: 203105 - protein, 10 aa, Tick-borne encephalitis virus
IGGKGHETPR

SEQ ID NO: 203106 - protein, 10 aa, Tick-borne encephalitis virus
GGRGHETPKM

SEQ ID NO: 203107 - protein, 10 aa, Tick-borne encephalitis virus
GRGHETPKMV

SEQ ID NO: 203108 - protein, 10 aa, Tick-borne encephalitis virus
KGHETPRMVT

SEQ ID NO: 203109 - protein, 10 aa, Tick-borne encephalitis virus
CVVLADDKVK

SEQ ID NO: 203110 - protein, 10 aa, Tick-borne encephalitis virus
VVLADDKVKE

SEQ ID NO: 203111 - protein, 10 aa, Tick-borne encephalitis virus
LADDKVKEKD

SEQ ID NO: 203112 - protein, 10 aa, Tick-borne encephalitis virus
ADDKVKEKDV

SEQ ID NO: 203113 - protein, 10 aa, Tick-borne encephalitis virus
DKVKEQDVRE

SEQ ID NO: 203114 - protein, 10 aa, Tick-borne encephalitis virus
KVKEQDVRER

SEQ ID NO: 203115 - protein, 10 aa, Tick-borne encephalitis virus
ERIKALREQY

SEQ ID NO: 203116 - protein, 10 aa, Tick-borne encephalitis virus
NGEHPYRTWQ

SEQ ID NO: 203117 - protein, 10 aa, Tick-borne encephalitis virus
WILERLAQRS

SEQ ID NO: 203118 - protein, 10 aa, Tick-borne encephalitis virus
NSRIHSKEEF

SEQ ID NO: 203119 - protein, 10 aa, Tick-borne encephalitis virus
GAREAVEDPA

SEQ ID NO: 203120 - protein, 10 aa, Tick-borne encephalitis virus
EAVEDPAFWK

SEQ ID NO: 203121 - protein, 10 aa, Tick-borne encephalitis virus
AVEDPAFWKL

SEQ ID NO: 203122 - protein, 10 aa, Tick-borne encephalitis virus
VEDPAFWKLV

SEQ ID NO: 203123 - protein, 10 aa, Tick-borne encephalitis virus
EDPAFWKLVD

SEQ ID NO: 203124 - protein, 10 aa, Tick-borne encephalitis virus
DPAFWKLVDE

SEQ ID NO: 203125 - protein, 10 aa, Tick-borne encephalitis virus
PAFWKLVDEE

SEQ ID NO: 203126 - protein, 10 aa, Tick-borne encephalitis virus
AFWKLVDEER

SEQ ID NO: 203127 - protein, 10 aa, Tick-borne encephalitis virus
KLVDEERERH

SEQ ID NO: 203128 - protein, 10 aa, Tick-borne encephalitis virus
HLAGRCAHCA

SEQ ID NO: 203129 - protein, 10 aa, Tick-borne encephalitis virus
HWASRGSSGA

SEQ ID NO: 203130 - protein, 10 aa, Tick-borne encephalitis virus
WASRESSGSG

SEQ ID NO: 203131 - protein, 10 aa, Tick-borne encephalitis virus
ASRGSSGAGV

SEQ ID NO: 203132 - protein, 10 aa, Tick-borne encephalitis virus
SRESSGSGVE

SEQ ID NO: 203133 - protein, 10 aa, Tick-borne encephalitis virus
RGSSGAGVEG

SEQ ID NO: 203134 - protein, 10 aa, Tick-borne encephalitis virus
GFSGSGVEGI

SEQ ID NO: 203135 - protein, 10 aa, Tick-borne encephalitis virus
LNYLGWYLKE

SEQ ID NO: 203136 - protein, 10 aa, Tick-borne encephalitis virus
NYLGWHLKRL

SEQ ID NO: 203137 - protein, 10 aa, Tick-borne encephalitis virus
YLGWHLKRLS

SEQ ID NO: 203138 - protein, 10 aa, Tick-borne encephalitis virus
LLRVERWLRN

SEQ ID NO: 203139 - protein, 10 aa, Tick-borne encephalitis virus
RVERWLREHG

SEQ ID NO: 203140 - protein, 10 aa, Tick-borne encephalitis virus
DYGEERLGRM

SEQ ID NO: 203141 - protein, 10 aa, Tick-borne encephalitis virus
VVRGIDDRFG

SEQ ID NO: 203142 - protein, 10 aa, Tick-borne encephalitis virus
DDRFSGALYF

SEQ ID NO: 203143 - protein, 10 aa, Tick-borne encephalitis virus
DRFSGALYFL

SEQ ID NO: 203144 - protein, 10 aa, Tick-borne encephalitis virus
RFSGALYFLN

SEQ ID NO: 203145 - protein, 10 aa, Tick-borne encephalitis virus
FSGALYFLND

SEQ ID NO: 203146 - protein, 10 aa, Tick-borne encephalitis virus
SGALYFLNDM

SEQ ID NO: 203147 - protein, 10 aa, Tick-borne encephalitis virus
SVEEVPFCSH

SEQ ID NO: 203148 - protein, 10 aa, Tick-borne encephalitis virus
DLRTLGLTIC

SEQ ID NO: 203149 - protein, 10 aa, Tick-borne encephalitis virus
LRTLGFAICS

SEQ ID NO: 203150 - protein, 10 aa, Tick-borne encephalitis virus
RTLGLTICSA

SEQ ID NO: 203151 - protein, 10 aa, Tick-borne encephalitis virus
TLGFAICSAV

SEQ ID NO: 203152 - protein, 10 aa, Tick-borne encephalitis virus
LGLTICSAVP

SEQ ID NO: 203153 - protein, 10 aa, Tick-borne encephalitis virus
DNPFMHGKEK

SEQ ID NO: 203154 - protein, 10 aa, Tick-borne encephalitis virus
IPYLPKAQDM

SEQ ID NO: 203155 - protein, 10 aa, Tick-borne encephalitis virus
GAVEKVRKMM

SEQ ID NO: 203156 - protein, 10 aa, Tick-borne encephalitis virus
AVEKVRKMVG

SEQ ID NO: 203157 - protein, 11 aa, Tick-borne encephalitis virus
MAGKAILKGKG

SEQ ID NO: 203158 - protein, 11 aa, Tick-borne encephalitis virus
AGKAILKGKGG

SEQ ID NO: 203159 - protein, 11 aa, Tick-borne encephalitis virus
GKAILKGKGGG

SEQ ID NO: 203160 - protein, 11 aa, Tick-borne encephalitis virus
KAILKGKGGGP

SEQ ID NO: 203161 - protein, 11 aa, Tick-borne encephalitis virus
AILKGKGGGPP

SEQ ID NO: 203162 - protein, 11 aa, Tick-borne encephalitis virus
ILKGKGGGPPR

SEQ ID NO: 203163 - protein, 11 aa, Tick-borne encephalitis virus
LKGKGGGPPRR

SEQ ID NO: 203164 - protein, 11 aa, Tick-borne encephalitis virus
KGKGGGPPRRV

SEQ ID NO: 203165 - protein, 11 aa, Tick-borne encephalitis virus
GKGGGPPRRVS

SEQ ID NO: 203166 - protein, 11 aa, Tick-borne encephalitis virus
KGGGPPRRVSK

SEQ ID NO: 203167 - protein, 11 aa, Tick-borne encephalitis virus
GGGPPRRVSKE

SEQ ID NO: 203168 - protein, 11 aa, Tick-borne encephalitis virus
GGPPRRVSKET

SEQ ID NO: 203169 - protein, 11 aa, Tick-borne encephalitis virus
GPPRRVSKETA

SEQ ID NO: 203170 - protein, 11 aa, Tick-borne encephalitis virus
PPRRVSKETAK

SEQ ID NO: 203171 - protein, 11 aa, Tick-borne encephalitis virus
PRRVSKETAKK

SEQ ID NO: 203172 - protein, 11 aa, Tick-borne encephalitis virus
RRVSKETAKKT

SEQ ID NO: 203173 - protein, 11 aa, Tick-borne encephalitis virus
RVSKETAKKTR

SEQ ID NO: 203174 - protein, 11 aa, Tick-borne encephalitis virus
VSKETAKKTRQ

SEQ ID NO: 203175 - protein, 11 aa, Tick-borne encephalitis virus
SKETAKKTRQS

SEQ ID NO: 203176 - protein, 11 aa, Tick-borne encephalitis virus
KETAKKTRQSR

SEQ ID NO: 203177 - protein, 11 aa, Tick-borne encephalitis virus
ETAKKTRQSRV

SEQ ID NO: 203178 - protein, 11 aa, Tick-borne encephalitis virus
TAKKTRQSRVQ

SEQ ID NO: 203179 - protein, 11 aa, Tick-borne encephalitis virus
AKKTRQSRVQM

SEQ ID NO: 203180 - protein, 11 aa, Tick-borne encephalitis virus
KKTRQSRVQMP

SEQ ID NO: 203181 - protein, 11 aa, Tick-borne encephalitis virus
KTRQSRVQMPN

SEQ ID NO: 203182 - protein, 11 aa, Tick-borne encephalitis virus
TRQSRVQMPNG

SEQ ID NO: 203183 - protein, 11 aa, Tick-borne encephalitis virus
RQSRVQMPNGL

SEQ ID NO: 203184 - protein, 11 aa, Tick-borne encephalitis virus
QSRVQMPNGLV

SEQ ID NO: 203185 - protein, 11 aa, Tick-borne encephalitis virus
SRVQMPNGLVL

SEQ ID NO: 203186 - protein, 11 aa, Tick-borne encephalitis virus
RVQMPNGLVLM

SEQ ID NO: 203187 - protein, 11 aa, Tick-borne encephalitis virus
VQMPNGLVLMR

SEQ ID NO: 203188 - protein, 11 aa, Tick-borne encephalitis virus
QMPNGLVLMRM

SEQ ID NO: 203189 - protein, 11 aa, Tick-borne encephalitis virus
MPNGLVLMRMM

SEQ ID NO: 203190 - protein, 11 aa, Tick-borne encephalitis virus
PNGLVLMRMMG

SEQ ID NO: 203191 - protein, 11 aa, Tick-borne encephalitis virus
NGLVLMRMMGI

SEQ ID NO: 203192 - protein, 11 aa, Tick-borne encephalitis virus
GLVLMRMMGIL

SEQ ID NO: 203193 - protein, 11 aa, Tick-borne encephalitis virus
LVLMRMMGILW

SEQ ID NO: 203194 - protein, 11 aa, Tick-borne encephalitis virus
VLMRMMGILWH

SEQ ID NO: 203195 - protein, 11 aa, Tick-borne encephalitis virus
LMRMMGILWHA

SEQ ID NO: 203196 - protein, 11 aa, Tick-borne encephalitis virus
MRMMGILWHAV

SEQ ID NO: 203197 - protein, 11 aa, Tick-borne encephalitis virus
RMMGILWHAVA

SEQ ID NO: 203198 - protein, 11 aa, Tick-borne encephalitis virus
MMGILWHAVAG

SEQ ID NO: 203199 - protein, 11 aa, Tick-borne encephalitis virus
MGILWHAVAGT

SEQ ID NO: 203200 - protein, 11 aa, Tick-borne encephalitis virus
GILWHAVAGTA

SEQ ID NO: 203201 - protein, 11 aa, Tick-borne encephalitis virus
ILWHAVAGTAR

SEQ ID NO: 203202 - protein, 11 aa, Tick-borne encephalitis virus
LWHAVAGTARS

SEQ ID NO: 203203 - protein, 11 aa, Tick-borne encephalitis virus
WHAVAGTARSP

SEQ ID NO: 203204 - protein, 11 aa, Tick-borne encephalitis virus
HAVAGTARSPV

SEQ ID NO: 203205 - protein, 11 aa, Tick-borne encephalitis virus
AVAGTARSPVL

SEQ ID NO: 203206 - protein, 11 aa, Tick-borne encephalitis virus
VAGTARSPVLK

SEQ ID NO: 203207 - protein, 11 aa, Tick-borne encephalitis virus
AGTARSPVLKS

SEQ ID NO: 203208 - protein, 11 aa, Tick-borne encephalitis virus
GTARSPVLKSF

SEQ ID NO: 203209 - protein, 11 aa, Tick-borne encephalitis virus
TARSPVLKSFW

SEQ ID NO: 203210 - protein, 11 aa, Tick-borne encephalitis virus
ARSPVLKSFWN

SEQ ID NO: 203211 - protein, 11 aa, Tick-borne encephalitis virus
RSPVLKSFWNS

SEQ ID NO: 203212 - protein, 11 aa, Tick-borne encephalitis virus
SPVLKSFWNSV

SEQ ID NO: 203213 - protein, 11 aa, Tick-borne encephalitis virus
PVLKSFWNSVP

SEQ ID NO: 203214 - protein, 11 aa, Tick-borne encephalitis virus
VLKSFWNSVPL

SEQ ID NO: 203215 - protein, 11 aa, Tick-borne encephalitis virus
LKSFWNSVPLK

SEQ ID NO: 203216 - protein, 11 aa, Tick-borne encephalitis virus
KSFWNSVPLKQ

SEQ ID NO: 203217 - protein, 11 aa, Tick-borne encephalitis virus
SFWNSVPLKQA

SEQ ID NO: 203218 - protein, 11 aa, Tick-borne encephalitis virus
FWNSVPLKQAT

SEQ ID NO: 203219 - protein, 11 aa, Tick-borne encephalitis virus
SVPLKQATAAL

SEQ ID NO: 203220 - protein, 11 aa, Tick-borne encephalitis virus
VPLKQATAALR

SEQ ID NO: 203221 - protein, 11 aa, Tick-borne encephalitis virus
PLKQATAALRK

SEQ ID NO: 203222 - protein, 11 aa, Tick-borne encephalitis virus
LKQATAALRKI

SEQ ID NO: 203223 - protein, 11 aa, Tick-borne encephalitis virus
KQATAALRKIK

SEQ ID NO: 203224 - protein, 11 aa, Tick-borne encephalitis virus
QATAALRKIKK

SEQ ID NO: 203225 - protein, 11 aa, Tick-borne encephalitis virus
ATAALRKIKKA

SEQ ID NO: 203226 - protein, 11 aa, Tick-borne encephalitis virus
TAALRKIKKAV

SEQ ID NO: 203227 - protein, 11 aa, Tick-borne encephalitis virus
AALRKIKKAVS

SEQ ID NO: 203228 - protein, 11 aa, Tick-borne encephalitis virus
ALRKIKKAVST

SEQ ID NO: 203229 - protein, 11 aa, Tick-borne encephalitis virus
LRKIKKAVSTL

SEQ ID NO: 203230 - protein, 11 aa, Tick-borne encephalitis virus
RKIKKAVSTLM

SEQ ID NO: 203231 - protein, 11 aa, Tick-borne encephalitis virus
LMVGLQRRGKR

SEQ ID NO: 203232 - protein, 11 aa, Tick-borne encephalitis virus
MVGLQRRGKRR

SEQ ID NO: 203233 - protein, 11 aa, Tick-borne encephalitis virus
VGLQRRGKRRS

SEQ ID NO: 203234 - protein, 11 aa, Tick-borne encephalitis virus
GLQRRGKRRSA

SEQ ID NO: 203235 - protein, 11 aa, Tick-borne encephalitis virus
TLAATVRKERD

SEQ ID NO: 203236 - protein, 11 aa, Tick-borne encephalitis virus
AATVRKERDGT

SEQ ID NO: 203237 - protein, 11 aa, Tick-borne encephalitis virus
ATVRKERDGTT

SEQ ID NO: 203238 - protein, 11 aa, Tick-borne encephalitis virus
TVRKERDGTTV

SEQ ID NO: 203239 - protein, 11 aa, Tick-borne encephalitis virus
VRKERDGTTVI

SEQ ID NO: 203240 - protein, 11 aa, Tick-borne encephalitis virus
RKERDGTTVIR

SEQ ID NO: 203241 - protein, 11 aa, Tick-borne encephalitis virus
KERDGTTVIRA

SEQ ID NO: 203242 - protein, 11 aa, Tick-borne encephalitis virus
ERDGTTVIRAE

SEQ ID NO: 203243 - protein, 11 aa, Tick-borne encephalitis virus
RDGTTVIRAEG

SEQ ID NO: 203244 - protein, 11 aa, Tick-borne encephalitis virus
DGTTVIRAEGK

SEQ ID NO: 203245 - protein, 11 aa, Tick-borne encephalitis virus
GTTVIRAEGKD

SEQ ID NO: 203246 - protein, 11 aa, Tick-borne encephalitis virus
TTVIRAEGKDA

SEQ ID NO: 203247 - protein, 11 aa, Tick-borne encephalitis virus
TVIRAEGKDAA

SEQ ID NO: 203248 - protein, 11 aa, Tick-borne encephalitis virus
VIRAEGKDAAT

SEQ ID NO: 203249 - protein, 11 aa, Tick-borne encephalitis virus
IRAEGKDAATQ

SEQ ID NO: 203250 - protein, 11 aa, Tick-borne encephalitis virus
RAEGKDAATQV

SEQ ID NO: 203251 - protein, 11 aa, Tick-borne encephalitis virus
AEGKDAATQVR

SEQ ID NO: 203252 - protein, 11 aa, Tick-borne encephalitis virus
EGKDAATQVRV

SEQ ID NO: 203253 - protein, 11 aa, Tick-borne encephalitis virus
GKDAATQVRVE

SEQ ID NO: 203254 - protein, 11 aa, Tick-borne encephalitis virus
KDAATQVRVEN

SEQ ID NO: 203255 - protein, 11 aa, Tick-borne encephalitis virus
DAATQVRVENG

SEQ ID NO: 203256 - protein, 11 aa, Tick-borne encephalitis virus
AATQVRVENGT

SEQ ID NO: 203257 - protein, 11 aa, Tick-borne encephalitis virus
ATQVRVENGTC

SEQ ID NO: 203258 - protein, 11 aa, Tick-borne encephalitis virus
TQVRVENGTCV

SEQ ID NO: 203259 - protein, 11 aa, Tick-borne encephalitis virus
QVRVENGTCVI

SEQ ID NO: 203260 - protein, 11 aa, Tick-borne encephalitis virus
VRVENGTCVIL

SEQ ID NO: 203261 - protein, 11 aa, Tick-borne encephalitis virus
RVENGTCVILA

SEQ ID NO: 203262 - protein, 11 aa, Tick-borne encephalitis virus
VENGTCVILAT

SEQ ID NO: 203263 - protein, 11 aa, Tick-borne encephalitis virus
ENGTCVILATD

SEQ ID NO: 203264 - protein, 11 aa, Tick-borne encephalitis virus
NGTCVILATDM

SEQ ID NO: 203265 - protein, 11 aa, Tick-borne encephalitis virus
GTCVILATDMG

SEQ ID NO: 203266 - protein, 11 aa, Tick-borne encephalitis virus
TCVILATDMGS

SEQ ID NO: 203267 - protein, 11 aa, Tick-borne encephalitis virus
CVILATDMGSW

SEQ ID NO: 203268 - protein, 11 aa, Tick-borne encephalitis virus
VILATDMGSWC

SEQ ID NO: 203269 - protein, 11 aa, Tick-borne encephalitis virus
ILATDMGSWCD

SEQ ID NO: 203270 - protein, 11 aa, Tick-borne encephalitis virus
LATDMGSWCDD

SEQ ID NO: 203271 - protein, 11 aa, Tick-borne encephalitis virus
ATDMGSWCDDS

SEQ ID NO: 203272 - protein, 11 aa, Tick-borne encephalitis virus
TDMGSWCDDSL

SEQ ID NO: 203273 - protein, 11 aa, Tick-borne encephalitis virus
DMGSWCDDSLT

SEQ ID NO: 203274 - protein, 11 aa, Tick-borne encephalitis virus
MGSWCDDSLTY

SEQ ID NO: 203275 - protein, 11 aa, Tick-borne encephalitis virus
GSWCDDSLTYE

SEQ ID NO: 203276 - protein, 11 aa, Tick-borne encephalitis virus
SWCDDSLTYEC

SEQ ID NO: 203277 - protein, 11 aa, Tick-borne encephalitis virus
WCDDSLTYECV

SEQ ID NO: 203278 - protein, 11 aa, Tick-borne encephalitis virus
CDDSLTYECVT

SEQ ID NO: 203279 - protein, 11 aa, Tick-borne encephalitis virus
DDSLTYECVTI

SEQ ID NO: 203280 - protein, 11 aa, Tick-borne encephalitis virus
DSLTYECVTID

SEQ ID NO: 203281 - protein, 11 aa, Tick-borne encephalitis virus
SLTYECVTIDQ

SEQ ID NO: 203282 - protein, 11 aa, Tick-borne encephalitis virus
LTYECVTIDQG

SEQ ID NO: 203283 - protein, 11 aa, Tick-borne encephalitis virus
TYECVTIDQGE

SEQ ID NO: 203284 - protein, 11 aa, Tick-borne encephalitis virus
YECVTIDQGEE

SEQ ID NO: 203285 - protein, 11 aa, Tick-borne encephalitis virus
ECVTIDQGEEP

SEQ ID NO: 203286 - protein, 11 aa, Tick-borne encephalitis virus
CVTIDQGEEPV

SEQ ID NO: 203287 - protein, 11 aa, Tick-borne encephalitis virus
VTIDQGEEPVD

SEQ ID NO: 203288 - protein, 11 aa, Tick-borne encephalitis virus
TIDQGEEPVDV

SEQ ID NO: 203289 - protein, 11 aa, Tick-borne encephalitis virus
IDQGEEPVDVD

SEQ ID NO: 203290 - protein, 11 aa, Tick-borne encephalitis virus
DQGEEPVDVDC

SEQ ID NO: 203291 - protein, 11 aa, Tick-borne encephalitis virus
QGEEPVDVDCF

SEQ ID NO: 203292 - protein, 11 aa, Tick-borne encephalitis virus
GEEPVDVDCFC

SEQ ID NO: 203293 - protein, 11 aa, Tick-borne encephalitis virus
EEPVDVDCFCR

SEQ ID NO: 203294 - protein, 11 aa, Tick-borne encephalitis virus
EPVDVDCFCRN

SEQ ID NO: 203295 - protein, 11 aa, Tick-borne encephalitis virus
PVDVDCFCRNV

SEQ ID NO: 203296 - protein, 11 aa, Tick-borne encephalitis virus
VDVDCFCRNVD

SEQ ID NO: 203297 - protein, 11 aa, Tick-borne encephalitis virus
DVDCFCRNVDG

SEQ ID NO: 203298 - protein, 11 aa, Tick-borne encephalitis virus
VDCFCRNVDGV

SEQ ID NO: 203299 - protein, 11 aa, Tick-borne encephalitis virus
DCFCRNVDGVY

SEQ ID NO: 203300 - protein, 11 aa, Tick-borne encephalitis virus
CFCRNVDGVYL

SEQ ID NO: 203301 - protein, 11 aa, Tick-borne encephalitis virus
FCRNVDGVYLE

SEQ ID NO: 203302 - protein, 11 aa, Tick-borne encephalitis virus
CRNVDGVYLEY

SEQ ID NO: 203303 - protein, 11 aa, Tick-borne encephalitis virus
RNVDGVYLEYG

SEQ ID NO: 203304 - protein, 11 aa, Tick-borne encephalitis virus
NVDGVYLEYGR

SEQ ID NO: 203305 - protein, 11 aa, Tick-borne encephalitis virus
VDGVYLEYGRC

SEQ ID NO: 203306 - protein, 11 aa, Tick-borne encephalitis virus
DGVYLEYGRCG

SEQ ID NO: 203307 - protein, 11 aa, Tick-borne encephalitis virus
GVYLEYGRCGK

SEQ ID NO: 203308 - protein, 11 aa, Tick-borne encephalitis virus
VYLEYGRCGKQ

SEQ ID NO: 203309 - protein, 11 aa, Tick-borne encephalitis virus
YLEYGRCGKQE

SEQ ID NO: 203310 - protein, 11 aa, Tick-borne encephalitis virus
LEYGRCGKQEG

SEQ ID NO: 203311 - protein, 11 aa, Tick-borne encephalitis virus
EYGRCGKQEGS

SEQ ID NO: 203312 - protein, 11 aa, Tick-borne encephalitis virus
YGRCGKQEGSR

SEQ ID NO: 203313 - protein, 11 aa, Tick-borne encephalitis virus
GRCGKQEGSRT

SEQ ID NO: 203314 - protein, 11 aa, Tick-borne encephalitis virus
RCGKQEGSRTR

SEQ ID NO: 203315 - protein, 11 aa, Tick-borne encephalitis virus
CGKQEGSRTRR

SEQ ID NO: 203316 - protein, 11 aa, Tick-borne encephalitis virus
GKQEGSRTRRS

SEQ ID NO: 203317 - protein, 11 aa, Tick-borne encephalitis virus
KQEGSRTRRSV

SEQ ID NO: 203318 - protein, 11 aa, Tick-borne encephalitis virus
QEGSRTRRSVL

SEQ ID NO: 203319 - protein, 11 aa, Tick-borne encephalitis virus
EGSRTRRSVLI

SEQ ID NO: 203320 - protein, 11 aa, Tick-borne encephalitis virus
GSRTRRSVLIP

SEQ ID NO: 203321 - protein, 11 aa, Tick-borne encephalitis virus
SRTRRSVLIPS

SEQ ID NO: 203322 - protein, 11 aa, Tick-borne encephalitis virus
RTRRSVLIPSH

SEQ ID NO: 203323 - protein, 11 aa, Tick-borne encephalitis virus
TRRSVLIPSHA

SEQ ID NO: 203324 - protein, 11 aa, Tick-borne encephalitis virus
RRSVLIPSHAQ

SEQ ID NO: 203325 - protein, 11 aa, Tick-borne encephalitis virus
RSVLIPSHAQG

SEQ ID NO: 203326 - protein, 11 aa, Tick-borne encephalitis virus
SVLIPSHAQGD

SEQ ID NO: 203327 - protein, 11 aa, Tick-borne encephalitis virus
VLIPSHAQGDL

SEQ ID NO: 203328 - protein, 11 aa, Tick-borne encephalitis virus
LIPSHAQGDLT

SEQ ID NO: 203329 - protein, 11 aa, Tick-borne encephalitis virus
IPSHAQGDLTG

SEQ ID NO: 203330 - protein, 11 aa, Tick-borne encephalitis virus
PSHAQGDLTGR

SEQ ID NO: 203331 - protein, 11 aa, Tick-borne encephalitis virus
SHAQGDLTGRG

SEQ ID NO: 203332 - protein, 11 aa, Tick-borne encephalitis virus
HAQGDLTGRGH

SEQ ID NO: 203333 - protein, 11 aa, Tick-borne encephalitis virus
AQGDLTGRGHK

SEQ ID NO: 203334 - protein, 11 aa, Tick-borne encephalitis virus
QGDLTGRGHKW

SEQ ID NO: 203335 - protein, 11 aa, Tick-borne encephalitis virus
GDLTGRGHKWL

SEQ ID NO: 203336 - protein, 11 aa, Tick-borne encephalitis virus
DLTGRGHKWLE

SEQ ID NO: 203337 - protein, 11 aa, Tick-borne encephalitis virus
LTGRGHKWLEG

SEQ ID NO: 203338 - protein, 11 aa, Tick-borne encephalitis virus
TGRGHKWLEGD

SEQ ID NO: 203339 - protein, 11 aa, Tick-borne encephalitis virus
GRGHKWLEGDS

SEQ ID NO: 203340 - protein, 11 aa, Tick-borne encephalitis virus
RGHKWLEGDSL

SEQ ID NO: 203341 - protein, 11 aa, Tick-borne encephalitis virus
GHKWLEGDSLR

SEQ ID NO: 203342 - protein, 11 aa, Tick-borne encephalitis virus
HKWLEGDSLRT

SEQ ID NO: 203343 - protein, 11 aa, Tick-borne encephalitis virus
KWLEGDSLRTH

SEQ ID NO: 203344 - protein, 11 aa, Tick-borne encephalitis virus
WLEGDSLRTHL

SEQ ID NO: 203345 - protein, 11 aa, Tick-borne encephalitis virus
LEGDSLRTHLT

SEQ ID NO: 203346 - protein, 11 aa, Tick-borne encephalitis virus
EGDSLRTHLTR

SEQ ID NO: 203347 - protein, 11 aa, Tick-borne encephalitis virus
GDSLRTHLTRV

SEQ ID NO: 203348 - protein, 11 aa, Tick-borne encephalitis virus
DSLRTHLTRVE

SEQ ID NO: 203349 - protein, 11 aa, Tick-borne encephalitis virus
SLRTHLTRVEG

SEQ ID NO: 203350 - protein, 11 aa, Tick-borne encephalitis virus
LRTHLTRVEGW

SEQ ID NO: 203351 - protein, 11 aa, Tick-borne encephalitis virus
RTHLTRVEGWV

SEQ ID NO: 203352 - protein, 11 aa, Tick-borne encephalitis virus
THLTRVEGWVW

SEQ ID NO: 203353 - protein, 11 aa, Tick-borne encephalitis virus
HLTRVEGWVWK

SEQ ID NO: 203354 - protein, 11 aa, Tick-borne encephalitis virus
LTRVEGWVWKN

SEQ ID NO: 203355 - protein, 11 aa, Tick-borne encephalitis virus
TRVEGWVWKNK

SEQ ID NO: 203356 - protein, 11 aa, Tick-borne encephalitis virus
VWLTVESVVTR

SEQ ID NO: 203357 - protein, 11 aa, Tick-borne encephalitis virus
VVVLLCLAPVY

SEQ ID NO: 203358 - protein, 11 aa, Tick-borne encephalitis virus
VVLLCLAPVYA

SEQ ID NO: 203359 - protein, 11 aa, Tick-borne encephalitis virus
VLLCLAPVYAS

SEQ ID NO: 203360 - protein, 11 aa, Tick-borne encephalitis virus
LLCLAPVYASR

SEQ ID NO: 203361 - protein, 11 aa, Tick-borne encephalitis virus
LCLAPVYASRC

SEQ ID NO: 203362 - protein, 11 aa, Tick-borne encephalitis virus
CLAPVYASRCT

SEQ ID NO: 203363 - protein, 11 aa, Tick-borne encephalitis virus
LAPVYASRCTH

SEQ ID NO: 203364 - protein, 11 aa, Tick-borne encephalitis virus
APVYASRCTHL

SEQ ID NO: 203365 - protein, 11 aa, Tick-borne encephalitis virus
PVYASRCTHLE

SEQ ID NO: 203366 - protein, 11 aa, Tick-borne encephalitis virus
VYASRCTHLEN

SEQ ID NO: 203367 - protein, 11 aa, Tick-borne encephalitis virus
YASRCTHLENR

SEQ ID NO: 203368 - protein, 11 aa, Tick-borne encephalitis virus
ASRCTHLENRD

SEQ ID NO: 203369 - protein, 11 aa, Tick-borne encephalitis virus
SRCTHLENRDF

SEQ ID NO: 203370 - protein, 11 aa, Tick-borne encephalitis virus
RCTHLENRDFV

SEQ ID NO: 203371 - protein, 11 aa, Tick-borne encephalitis virus
CTHLENRDFVT

SEQ ID NO: 203372 - protein, 11 aa, Tick-borne encephalitis virus
THLENRDFVTG

SEQ ID NO: 203373 - protein, 11 aa, Tick-borne encephalitis virus
HLENRDFVTGT

SEQ ID NO: 203374 - protein, 11 aa, Tick-borne encephalitis virus
LENRDFVTGTQ

SEQ ID NO: 203375 - protein, 11 aa, Tick-borne encephalitis virus
ENRDFVTGTQG

SEQ ID NO: 203376 - protein, 11 aa, Tick-borne encephalitis virus
NRDFVTGTQGT

SEQ ID NO: 203377 - protein, 11 aa, Tick-borne encephalitis virus
RDFVTGTQGTT

SEQ ID NO: 203378 - protein, 11 aa, Tick-borne encephalitis virus
DFVTGTQGTTR

SEQ ID NO: 203379 - protein, 11 aa, Tick-borne encephalitis virus
FVTGTQGTTRV

SEQ ID NO: 203380 - protein, 11 aa, Tick-borne encephalitis virus
VTGTQGTTRVT

SEQ ID NO: 203381 - protein, 11 aa, Tick-borne encephalitis virus
TGTQGTTRVTL

SEQ ID NO: 203382 - protein, 11 aa, Tick-borne encephalitis virus
GTQGTTRVTLV

SEQ ID NO: 203383 - protein, 11 aa, Tick-borne encephalitis virus
TQGTTRVTLVL

SEQ ID NO: 203384 - protein, 11 aa, Tick-borne encephalitis virus
QGTTRVTLVLE

SEQ ID NO: 203385 - protein, 11 aa, Tick-borne encephalitis virus
GTTRVTLVLEL

SEQ ID NO: 203386 - protein, 11 aa, Tick-borne encephalitis virus
TTRVTLVLELG

SEQ ID NO: 203387 - protein, 11 aa, Tick-borne encephalitis virus
TRVTLVLELGG

SEQ ID NO: 203388 - protein, 11 aa, Tick-borne encephalitis virus
RVTLVLELGGC

SEQ ID NO: 203389 - protein, 11 aa, Tick-borne encephalitis virus
VTLVLELGGCV

SEQ ID NO: 203390 - protein, 11 aa, Tick-borne encephalitis virus
TLVLELGGCVT

SEQ ID NO: 203391 - protein, 11 aa, Tick-borne encephalitis virus
LVLELGGCVTI

SEQ ID NO: 203392 - protein, 11 aa, Tick-borne encephalitis virus
VLELGGCVTIT

SEQ ID NO: 203393 - protein, 11 aa, Tick-borne encephalitis virus
LELGGCVTITA

SEQ ID NO: 203394 - protein, 11 aa, Tick-borne encephalitis virus
ELGGCVTITAE

SEQ ID NO: 203395 - protein, 11 aa, Tick-borne encephalitis virus
LGGCVTITAEG

SEQ ID NO: 203396 - protein, 11 aa, Tick-borne encephalitis virus
GGCVTITAEGK

SEQ ID NO: 203397 - protein, 11 aa, Tick-borne encephalitis virus
GCVTITAEGKP

SEQ ID NO: 203398 - protein, 11 aa, Tick-borne encephalitis virus
CVTITAEGKPS

SEQ ID NO: 203399 - protein, 11 aa, Tick-borne encephalitis virus
VTITAEGKPSM

SEQ ID NO: 203400 - protein, 11 aa, Tick-borne encephalitis virus
TITAEGKPSMD

SEQ ID NO: 203401 - protein, 11 aa, Tick-borne encephalitis virus
ITAEGKPSMDV

SEQ ID NO: 203402 - protein, 11 aa, Tick-borne encephalitis virus
TAEGKPSMDVW

SEQ ID NO: 203403 - protein, 11 aa, Tick-borne encephalitis virus
AEGKPSMDVWL

SEQ ID NO: 203404 - protein, 11 aa, Tick-borne encephalitis virus
EGKPSMDVWLD

SEQ ID NO: 203405 - protein, 11 aa, Tick-borne encephalitis virus
GKPSMDVWLDS

SEQ ID NO: 203406 - protein, 11 aa, Tick-borne encephalitis virus
KPSMDVWLDSI

SEQ ID NO: 203407 - protein, 11 aa, Tick-borne encephalitis virus
PSMDVWLDSIY

SEQ ID NO: 203408 - protein, 11 aa, Tick-borne encephalitis virus
SMDVWLDSIYQ

SEQ ID NO: 203409 - protein, 11 aa, Tick-borne encephalitis virus
MDVWLDSIYQE

SEQ ID NO: 203410 - protein, 11 aa, Tick-borne encephalitis virus
DVWLDSIYQEN

SEQ ID NO: 203411 - protein, 11 aa, Tick-borne encephalitis virus
VWLDSIYQENP

SEQ ID NO: 203412 - protein, 11 aa, Tick-borne encephalitis virus
WLDSIYQENPA

SEQ ID NO: 203413 - protein, 11 aa, Tick-borne encephalitis virus
LDSIYQENPAK

SEQ ID NO: 203414 - protein, 11 aa, Tick-borne encephalitis virus
DSIYQENPAKT

SEQ ID NO: 203415 - protein, 11 aa, Tick-borne encephalitis virus
SIYQENPAKTR

SEQ ID NO: 203416 - protein, 11 aa, Tick-borne encephalitis virus
IYQENPAKTRE

SEQ ID NO: 203417 - protein, 11 aa, Tick-borne encephalitis virus
YQENPAKTREY

SEQ ID NO: 203418 - protein, 11 aa, Tick-borne encephalitis virus
QENPAKTREYC

SEQ ID NO: 203419 - protein, 11 aa, Tick-borne encephalitis virus
ENPAKTREYCL

SEQ ID NO: 203420 - protein, 11 aa, Tick-borne encephalitis virus
NPAKTREYCLH

SEQ ID NO: 203421 - protein, 11 aa, Tick-borne encephalitis virus
PAKTREYCLHA

SEQ ID NO: 203422 - protein, 11 aa, Tick-borne encephalitis virus
AKTREYCLHAK

SEQ ID NO: 203423 - protein, 11 aa, Tick-borne encephalitis virus
KTREYCLHAKL

SEQ ID NO: 203424 - protein, 11 aa, Tick-borne encephalitis virus
TREYCLHAKLS

SEQ ID NO: 203425 - protein, 11 aa, Tick-borne encephalitis virus
REYCLHAKLSD

SEQ ID NO: 203426 - protein, 11 aa, Tick-borne encephalitis virus
EYCLHAKLSDT

SEQ ID NO: 203427 - protein, 11 aa, Tick-borne encephalitis virus
YCLHAKLSDTK

SEQ ID NO: 203428 - protein, 11 aa, Tick-borne encephalitis virus
CLHAKLSDTKV

SEQ ID NO: 203429 - protein, 11 aa, Tick-borne encephalitis virus
LHAKLSDTKVA

SEQ ID NO: 203430 - protein, 11 aa, Tick-borne encephalitis virus
HAKLSDTKVAA

SEQ ID NO: 203431 - protein, 11 aa, Tick-borne encephalitis virus
AKLSDTKVAAR

SEQ ID NO: 203432 - protein, 11 aa, Tick-borne encephalitis virus
KLSDTKVAARC

SEQ ID NO: 203433 - protein, 11 aa, Tick-borne encephalitis virus
LSDTKVAARCP

SEQ ID NO: 203434 - protein, 11 aa, Tick-borne encephalitis virus
SDTKVAARCPT

SEQ ID NO: 203435 - protein, 11 aa, Tick-borne encephalitis virus
DTKVAARCPTM

SEQ ID NO: 203436 - protein, 11 aa, Tick-borne encephalitis virus
TKVAARCPTMG

SEQ ID NO: 203437 - protein, 11 aa, Tick-borne encephalitis virus
KVAARCPTMGP

SEQ ID NO: 203438 - protein, 11 aa, Tick-borne encephalitis virus
VAARCPTMGPA

SEQ ID NO: 203439 - protein, 11 aa, Tick-borne encephalitis virus
AARCPTMGPAT

SEQ ID NO: 203440 - protein, 11 aa, Tick-borne encephalitis virus
ARCPTMGPATL

SEQ ID NO: 203441 - protein, 11 aa, Tick-borne encephalitis virus
RCPTMGPATLA

SEQ ID NO: 203442 - protein, 11 aa, Tick-borne encephalitis virus
CPTMGPATLAE

SEQ ID NO: 203443 - protein, 11 aa, Tick-borne encephalitis virus
PTMGPATLAEE

SEQ ID NO: 203444 - protein, 11 aa, Tick-borne encephalitis virus
TMGPATLAEEH

SEQ ID NO: 203445 - protein, 11 aa, Tick-borne encephalitis virus
MGPATLAEEHQ

SEQ ID NO: 203446 - protein, 11 aa, Tick-borne encephalitis virus
GPATLAEEHQS

SEQ ID NO: 203447 - protein, 11 aa, Tick-borne encephalitis virus
PATLAEEHQSG

SEQ ID NO: 203448 - protein, 11 aa, Tick-borne encephalitis virus
ATLAEEHQSGT

SEQ ID NO: 203449 - protein, 11 aa, Tick-borne encephalitis virus
TLAEEHQSGTV

SEQ ID NO: 203450 - protein, 11 aa, Tick-borne encephalitis virus
LAEEHQSGTVC

SEQ ID NO: 203451 - protein, 11 aa, Tick-borne encephalitis virus
AEEHQSGTVCK

SEQ ID NO: 203452 - protein, 11 aa, Tick-borne encephalitis virus
EEHQSGTVCKR

SEQ ID NO: 203453 - protein, 11 aa, Tick-borne encephalitis virus
EHQSGTVCKRD

SEQ ID NO: 203454 - protein, 11 aa, Tick-borne encephalitis virus
HQSGTVCKRDQ

SEQ ID NO: 203455 - protein, 11 aa, Tick-borne encephalitis virus
QSGTVCKRDQS

SEQ ID NO: 203456 - protein, 11 aa, Tick-borne encephalitis virus
SGTVCKRDQSD

SEQ ID NO: 203457 - protein, 11 aa, Tick-borne encephalitis virus
GTVCKRDQSDR

SEQ ID NO: 203458 - protein, 11 aa, Tick-borne encephalitis virus
TVCKRDQSDRG

SEQ ID NO: 203459 - protein, 11 aa, Tick-borne encephalitis virus
VCKRDQSDRGW

SEQ ID NO: 203460 - protein, 11 aa, Tick-borne encephalitis virus
CKRDQSDRGWG

SEQ ID NO: 203461 - protein, 11 aa, Tick-borne encephalitis virus
KRDQSDRGWGN

SEQ ID NO: 203462 - protein, 11 aa, Tick-borne encephalitis virus
RDQSDRGWGNH

SEQ ID NO: 203463 - protein, 11 aa, Tick-borne encephalitis virus
DQSDRGWGNHC

SEQ ID NO: 203464 - protein, 11 aa, Tick-borne encephalitis virus
QSDRGWGNHCG

SEQ ID NO: 203465 - protein, 11 aa, Tick-borne encephalitis virus
SDRGWGNHCGL

SEQ ID NO: 203466 - protein, 11 aa, Tick-borne encephalitis virus
DRGWGNHCGLF

SEQ ID NO: 203467 - protein, 11 aa, Tick-borne encephalitis virus
RGWGNHCGLFG

SEQ ID NO: 203468 - protein, 11 aa, Tick-borne encephalitis virus
GWGNHCGLFGK

SEQ ID NO: 203469 - protein, 11 aa, Tick-borne encephalitis virus
WGNHCGLFGKG

SEQ ID NO: 203470 - protein, 11 aa, Tick-borne encephalitis virus
GNHCGLFGKGS

SEQ ID NO: 203471 - protein, 11 aa, Tick-borne encephalitis virus
NHCGLFGKGSI

SEQ ID NO: 203472 - protein, 11 aa, Tick-borne encephalitis virus
HCGLFGKGSIV

SEQ ID NO: 203473 - protein, 11 aa, Tick-borne encephalitis virus
CGLFGKGSIVT

SEQ ID NO: 203474 - protein, 11 aa, Tick-borne encephalitis virus
GLFGKGSIVTC

SEQ ID NO: 203475 - protein, 11 aa, Tick-borne encephalitis virus
LFGKGSIVTCV

SEQ ID NO: 203476 - protein, 11 aa, Tick-borne encephalitis virus
FGKGSIVTCVK

SEQ ID NO: 203477 - protein, 11 aa, Tick-borne encephalitis virus
GKGSIVTCVKA

SEQ ID NO: 203478 - protein, 11 aa, Tick-borne encephalitis virus
KGSIVTCVKAS

SEQ ID NO: 203479 - protein, 11 aa, Tick-borne encephalitis virus
GSIVTCVKASC

SEQ ID NO: 203480 - protein, 11 aa, Tick-borne encephalitis virus
SIVTCVKASCE

SEQ ID NO: 203481 - protein, 11 aa, Tick-borne encephalitis virus
IVTCVKASCEA

SEQ ID NO: 203482 - protein, 11 aa, Tick-borne encephalitis virus
VTCVKASCEAK

SEQ ID NO: 203483 - protein, 11 aa, Tick-borne encephalitis virus
TCVKASCEAKK

SEQ ID NO: 203484 - protein, 11 aa, Tick-borne encephalitis virus
CVKASCEAKKK

SEQ ID NO: 203485 - protein, 11 aa, Tick-borne encephalitis virus
VKASCEAKKKA

SEQ ID NO: 203486 - protein, 11 aa, Tick-borne encephalitis virus
KASCEAKKKAT

SEQ ID NO: 203487 - protein, 11 aa, Tick-borne encephalitis virus
ASCEAKKKATG

SEQ ID NO: 203488 - protein, 11 aa, Tick-borne encephalitis virus
SCEAKKKATGH

SEQ ID NO: 203489 - protein, 11 aa, Tick-borne encephalitis virus
CEAKKKATGHV

SEQ ID NO: 203490 - protein, 11 aa, Tick-borne encephalitis virus
EAKKKATGHVY

SEQ ID NO: 203491 - protein, 11 aa, Tick-borne encephalitis virus
AKKKATGHVYD

SEQ ID NO: 203492 - protein, 11 aa, Tick-borne encephalitis virus
KKKATGHVYDA

SEQ ID NO: 203493 - protein, 11 aa, Tick-borne encephalitis virus
KKATGHVYDAN

SEQ ID NO: 203494 - protein, 11 aa, Tick-borne encephalitis virus
KATGHVYDANK

SEQ ID NO: 203495 - protein, 11 aa, Tick-borne encephalitis virus
ATGHVYDANKI

SEQ ID NO: 203496 - protein, 11 aa, Tick-borne encephalitis virus
TGHVYDANKIV

SEQ ID NO: 203497 - protein, 11 aa, Tick-borne encephalitis virus
GHVYDANKIVY

SEQ ID NO: 203498 - protein, 11 aa, Tick-borne encephalitis virus
HVYDANKIVYT

SEQ ID NO: 203499 - protein, 11 aa, Tick-borne encephalitis virus
VYDANKIVYTV

SEQ ID NO: 203500 - protein, 11 aa, Tick-borne encephalitis virus
YDANKIVYTVK

SEQ ID NO: 203501 - protein, 11 aa, Tick-borne encephalitis virus
DANKIVYTVKV

SEQ ID NO: 203502 - protein, 11 aa, Tick-borne encephalitis virus
ANKIVYTVKVE

SEQ ID NO: 203503 - protein, 11 aa, Tick-borne encephalitis virus
NKIVYTVKVEP

SEQ ID NO: 203504 - protein, 11 aa, Tick-borne encephalitis virus
KIVYTVKVEPH

SEQ ID NO: 203505 - protein, 11 aa, Tick-borne encephalitis virus
IVYTVKVEPHT

SEQ ID NO: 203506 - protein, 11 aa, Tick-borne encephalitis virus
VYTVKVEPHTG

SEQ ID NO: 203507 - protein, 11 aa, Tick-borne encephalitis virus
YTVKVEPHTGD

SEQ ID NO: 203508 - protein, 11 aa, Tick-borne encephalitis virus
TVKVEPHTGDY

SEQ ID NO: 203509 - protein, 11 aa, Tick-borne encephalitis virus
VKVEPHTGDYV

SEQ ID NO: 203510 - protein, 11 aa, Tick-borne encephalitis virus
KVEPHTGDYVA

SEQ ID NO: 203511 - protein, 11 aa, Tick-borne encephalitis virus
VEPHTGDYVAA

SEQ ID NO: 203512 - protein, 11 aa, Tick-borne encephalitis virus
EPHTGDYVAAN

SEQ ID NO: 203513 - protein, 11 aa, Tick-borne encephalitis virus
PHTGDYVAANE

SEQ ID NO: 203514 - protein, 11 aa, Tick-borne encephalitis virus
HTGDYVAANET

SEQ ID NO: 203515 - protein, 11 aa, Tick-borne encephalitis virus
TGDYVAANETH

SEQ ID NO: 203516 - protein, 11 aa, Tick-borne encephalitis virus
GDYVAANETHS

SEQ ID NO: 203517 - protein, 11 aa, Tick-borne encephalitis virus
DYVAANETHSG

SEQ ID NO: 203518 - protein, 11 aa, Tick-borne encephalitis virus
YVAANETHSGR

SEQ ID NO: 203519 - protein, 11 aa, Tick-borne encephalitis virus
VAANETHSGRK

SEQ ID NO: 203520 - protein, 11 aa, Tick-borne encephalitis virus
AANETHSGRKT

SEQ ID NO: 203521 - protein, 11 aa, Tick-borne encephalitis virus
ANETHSGRKTA

SEQ ID NO: 203522 - protein, 11 aa, Tick-borne encephalitis virus
NETHSGRKTAS

SEQ ID NO: 203523 - protein, 11 aa, Tick-borne encephalitis virus
ETHSGRKTASF

SEQ ID NO: 203524 - protein, 11 aa, Tick-borne encephalitis virus
THSGRKTASFT

SEQ ID NO: 203525 - protein, 11 aa, Tick-borne encephalitis virus
HSGRKTASFTV

SEQ ID NO: 203526 - protein, 11 aa, Tick-borne encephalitis virus
SGRKTASFTVS

SEQ ID NO: 203527 - protein, 11 aa, Tick-borne encephalitis virus
GRKTASFTVSS

SEQ ID NO: 203528 - protein, 11 aa, Tick-borne encephalitis virus
RKTASFTVSSE

SEQ ID NO: 203529 - protein, 11 aa, Tick-borne encephalitis virus
KTASFTVSSEK

SEQ ID NO: 203530 - protein, 11 aa, Tick-borne encephalitis virus
TASFTVSSEKT

SEQ ID NO: 203531 - protein, 11 aa, Tick-borne encephalitis virus
ASFTVSSEKTI

SEQ ID NO: 203532 - protein, 11 aa, Tick-borne encephalitis virus
SFTVSSEKTIL

SEQ ID NO: 203533 - protein, 11 aa, Tick-borne encephalitis virus
FTVSSEKTILT

SEQ ID NO: 203534 - protein, 11 aa, Tick-borne encephalitis virus
TVSSEKTILTM

SEQ ID NO: 203535 - protein, 11 aa, Tick-borne encephalitis virus
VSSEKTILTMG

SEQ ID NO: 203536 - protein, 11 aa, Tick-borne encephalitis virus
SSEKTILTMGD

SEQ ID NO: 203537 - protein, 11 aa, Tick-borne encephalitis virus
SEKTILTMGDY

SEQ ID NO: 203538 - protein, 11 aa, Tick-borne encephalitis virus
EKTILTMGDYG

SEQ ID NO: 203539 - protein, 11 aa, Tick-borne encephalitis virus
KTILTMGDYGD

SEQ ID NO: 203540 - protein, 11 aa, Tick-borne encephalitis virus
TILTMGDYGDV

SEQ ID NO: 203541 - protein, 11 aa, Tick-borne encephalitis virus
ILTMGDYGDVS

SEQ ID NO: 203542 - protein, 11 aa, Tick-borne encephalitis virus
LTMGDYGDVSL

SEQ ID NO: 203543 - protein, 11 aa, Tick-borne encephalitis virus
TMGDYGDVSLL

SEQ ID NO: 203544 - protein, 11 aa, Tick-borne encephalitis virus
MGDYGDVSLLC

SEQ ID NO: 203545 - protein, 11 aa, Tick-borne encephalitis virus
GDYGDVSLLCR

SEQ ID NO: 203546 - protein, 11 aa, Tick-borne encephalitis virus
DYGDVSLLCRV

SEQ ID NO: 203547 - protein, 11 aa, Tick-borne encephalitis virus
YGDVSLLCRVA

SEQ ID NO: 203548 - protein, 11 aa, Tick-borne encephalitis virus
GDVSLLCRVAS

SEQ ID NO: 203549 - protein, 11 aa, Tick-borne encephalitis virus
DVSLLCRVASG

SEQ ID NO: 203550 - protein, 11 aa, Tick-borne encephalitis virus
VSLLCRVASGV

SEQ ID NO: 203551 - protein, 11 aa, Tick-borne encephalitis virus
SLLCRVASGVD

SEQ ID NO: 203552 - protein, 11 aa, Tick-borne encephalitis virus
LLCRVASGVDL

SEQ ID NO: 203553 - protein, 11 aa, Tick-borne encephalitis virus
LCRVASGVDLA

SEQ ID NO: 203554 - protein, 11 aa, Tick-borne encephalitis virus
CRVASGVDLAQ

SEQ ID NO: 203555 - protein, 11 aa, Tick-borne encephalitis virus
RVASGVDLAQT

SEQ ID NO: 203556 - protein, 11 aa, Tick-borne encephalitis virus
VASGVDLAQTV

SEQ ID NO: 203557 - protein, 11 aa, Tick-borne encephalitis virus
ASGVDLAQTVI

SEQ ID NO: 203558 - protein, 11 aa, Tick-borne encephalitis virus
SGVDLAQTVIL

SEQ ID NO: 203559 - protein, 11 aa, Tick-borne encephalitis virus
GVDLAQTVILE

SEQ ID NO: 203560 - protein, 11 aa, Tick-borne encephalitis virus
VDLAQTVILEL

SEQ ID NO: 203561 - protein, 11 aa, Tick-borne encephalitis virus
DLAQTVILELD

SEQ ID NO: 203562 - protein, 11 aa, Tick-borne encephalitis virus
LAQTVILELDK

SEQ ID NO: 203563 - protein, 11 aa, Tick-borne encephalitis virus
AQTVILELDKT

SEQ ID NO: 203564 - protein, 11 aa, Tick-borne encephalitis virus
QTVILELDKTS

SEQ ID NO: 203565 - protein, 11 aa, Tick-borne encephalitis virus
TVILELDKTSE

SEQ ID NO: 203566 - protein, 11 aa, Tick-borne encephalitis virus
VILELDKTSEH

SEQ ID NO: 203567 - protein, 11 aa, Tick-borne encephalitis virus
ILELDKTSEHL

SEQ ID NO: 203568 - protein, 11 aa, Tick-borne encephalitis virus
LELDKTSEHLP

SEQ ID NO: 203569 - protein, 11 aa, Tick-borne encephalitis virus
ELDKTSEHLPT

SEQ ID NO: 203570 - protein, 11 aa, Tick-borne encephalitis virus
LDKTSEHLPTA

SEQ ID NO: 203571 - protein, 11 aa, Tick-borne encephalitis virus
DKTSEHLPTAW

SEQ ID NO: 203572 - protein, 11 aa, Tick-borne encephalitis virus
KTSEHLPTAWQ

SEQ ID NO: 203573 - protein, 11 aa, Tick-borne encephalitis virus
TSEHLPTAWQV

SEQ ID NO: 203574 - protein, 11 aa, Tick-borne encephalitis virus
SEHLPTAWQVH

SEQ ID NO: 203575 - protein, 11 aa, Tick-borne encephalitis virus
EHLPTAWQVHR

SEQ ID NO: 203576 - protein, 11 aa, Tick-borne encephalitis virus
HLPTAWQVHRD

SEQ ID NO: 203577 - protein, 11 aa, Tick-borne encephalitis virus
LPTAWQVHRDW

SEQ ID NO: 203578 - protein, 11 aa, Tick-borne encephalitis virus
PTAWQVHRDWF

SEQ ID NO: 203579 - protein, 11 aa, Tick-borne encephalitis virus
TAWQVHRDWFN

SEQ ID NO: 203580 - protein, 11 aa, Tick-borne encephalitis virus
AWQVHRDWFND

SEQ ID NO: 203581 - protein, 11 aa, Tick-borne encephalitis virus
WQVHRDWFNDL

SEQ ID NO: 203582 - protein, 11 aa, Tick-borne encephalitis virus
QVHRDWFNDLA

SEQ ID NO: 203583 - protein, 11 aa, Tick-borne encephalitis virus
VHRDWFNDLAL

SEQ ID NO: 203584 - protein, 11 aa, Tick-borne encephalitis virus
HRDWFNDLALP

SEQ ID NO: 203585 - protein, 11 aa, Tick-borne encephalitis virus
RDWFNDLALPW

SEQ ID NO: 203586 - protein, 11 aa, Tick-borne encephalitis virus
DWFNDLALPWK

SEQ ID NO: 203587 - protein, 11 aa, Tick-borne encephalitis virus
WFNDLALPWKH

SEQ ID NO: 203588 - protein, 11 aa, Tick-borne encephalitis virus
FNDLALPWKHE

SEQ ID NO: 203589 - protein, 11 aa, Tick-borne encephalitis virus
NDLALPWKHEG

SEQ ID NO: 203590 - protein, 11 aa, Tick-borne encephalitis virus
DLALPWKHEGA

SEQ ID NO: 203591 - protein, 11 aa, Tick-borne encephalitis virus
LALPWKHEGAQ

SEQ ID NO: 203592 - protein, 11 aa, Tick-borne encephalitis virus
HEGAQNWNNAE

SEQ ID NO: 203593 - protein, 11 aa, Tick-borne encephalitis virus
EGAQNWNNAER

SEQ ID NO: 203594 - protein, 11 aa, Tick-borne encephalitis virus
GAQNWNNAERL

SEQ ID NO: 203595 - protein, 11 aa, Tick-borne encephalitis virus
AQNWNNAERLV

SEQ ID NO: 203596 - protein, 11 aa, Tick-borne encephalitis virus
QNWNNAERLVE

SEQ ID NO: 203597 - protein, 11 aa, Tick-borne encephalitis virus
NWNNAERLVEF

SEQ ID NO: 203598 - protein, 11 aa, Tick-borne encephalitis virus
WNNAERLVEFG

SEQ ID NO: 203599 - protein, 11 aa, Tick-borne encephalitis virus
NNAERLVEFGA

SEQ ID NO: 203600 - protein, 11 aa, Tick-borne encephalitis virus
NAERLVEFGAP

SEQ ID NO: 203601 - protein, 11 aa, Tick-borne encephalitis virus
AERLVEFGAPH

SEQ ID NO: 203602 - protein, 11 aa, Tick-borne encephalitis virus
ERLVEFGAPHA

SEQ ID NO: 203603 - protein, 11 aa, Tick-borne encephalitis virus
RLVEFGAPHAV

SEQ ID NO: 203604 - protein, 11 aa, Tick-borne encephalitis virus
LVEFGAPHAVK

SEQ ID NO: 203605 - protein, 11 aa, Tick-borne encephalitis virus
VEFGAPHAVKM

SEQ ID NO: 203606 - protein, 11 aa, Tick-borne encephalitis virus
EFGAPHAVKMD

SEQ ID NO: 203607 - protein, 11 aa, Tick-borne encephalitis virus
FGAPHAVKMDV

SEQ ID NO: 203608 - protein, 11 aa, Tick-borne encephalitis virus
GAPHAVKMDVY

SEQ ID NO: 203609 - protein, 11 aa, Tick-borne encephalitis virus
APHAVKMDVYN

SEQ ID NO: 203610 - protein, 11 aa, Tick-borne encephalitis virus
PHAVKMDVYNL

SEQ ID NO: 203611 - protein, 11 aa, Tick-borne encephalitis virus
HAVKMDVYNLG

SEQ ID NO: 203612 - protein, 11 aa, Tick-borne encephalitis virus
AVKMDVYNLGD

SEQ ID NO: 203613 - protein, 11 aa, Tick-borne encephalitis virus
VKMDVYNLGDQ

SEQ ID NO: 203614 - protein, 11 aa, Tick-borne encephalitis virus
KMDVYNLGDQT

SEQ ID NO: 203615 - protein, 11 aa, Tick-borne encephalitis virus
MDVYNLGDQTG

SEQ ID NO: 203616 - protein, 11 aa, Tick-borne encephalitis virus
DVYNLGDQTGV

SEQ ID NO: 203617 - protein, 11 aa, Tick-borne encephalitis virus
VYNLGDQTGVL

SEQ ID NO: 203618 - protein, 11 aa, Tick-borne encephalitis virus
YNLGDQTGVLL

SEQ ID NO: 203619 - protein, 11 aa, Tick-borne encephalitis virus
NLGDQTGVLLK

SEQ ID NO: 203620 - protein, 11 aa, Tick-borne encephalitis virus
LGDQTGVLLKS

SEQ ID NO: 203621 - protein, 11 aa, Tick-borne encephalitis virus
GDQTGVLLKSL

SEQ ID NO: 203622 - protein, 11 aa, Tick-borne encephalitis virus
DQTGVLLKSLA

SEQ ID NO: 203623 - protein, 11 aa, Tick-borne encephalitis virus
QTGVLLKSLAG

SEQ ID NO: 203624 - protein, 11 aa, Tick-borne encephalitis virus
TGVLLKSLAGV

SEQ ID NO: 203625 - protein, 11 aa, Tick-borne encephalitis virus
GVLLKSLAGVP

SEQ ID NO: 203626 - protein, 11 aa, Tick-borne encephalitis virus
VLLKSLAGVPV

SEQ ID NO: 203627 - protein, 11 aa, Tick-borne encephalitis virus
LLKSLAGVPVA

SEQ ID NO: 203628 - protein, 11 aa, Tick-borne encephalitis virus
LKSLAGVPVAH

SEQ ID NO: 203629 - protein, 11 aa, Tick-borne encephalitis virus
KSLAGVPVAHI

SEQ ID NO: 203630 - protein, 11 aa, Tick-borne encephalitis virus
SLAGVPVAHID

SEQ ID NO: 203631 - protein, 11 aa, Tick-borne encephalitis virus
LAGVPVAHIDG

SEQ ID NO: 203632 - protein, 11 aa, Tick-borne encephalitis virus
AGVPVAHIDGT

SEQ ID NO: 203633 - protein, 11 aa, Tick-borne encephalitis virus
GVPVAHIDGTK

SEQ ID NO: 203634 - protein, 11 aa, Tick-borne encephalitis virus
VPVAHIDGTKY

SEQ ID NO: 203635 - protein, 11 aa, Tick-borne encephalitis virus
PVAHIDGTKYH

SEQ ID NO: 203636 - protein, 11 aa, Tick-borne encephalitis virus
VAHIDGTKYHL

SEQ ID NO: 203637 - protein, 11 aa, Tick-borne encephalitis virus
AHIDGTKYHLK

SEQ ID NO: 203638 - protein, 11 aa, Tick-borne encephalitis virus
HIDGTKYHLKS

SEQ ID NO: 203639 - protein, 11 aa, Tick-borne encephalitis virus
IDGTKYHLKSG

SEQ ID NO: 203640 - protein, 11 aa, Tick-borne encephalitis virus
DGTKYHLKSGH

SEQ ID NO: 203641 - protein, 11 aa, Tick-borne encephalitis virus
GTKYHLKSGHV

SEQ ID NO: 203642 - protein, 11 aa, Tick-borne encephalitis virus
TKYHLKSGHVT

SEQ ID NO: 203643 - protein, 11 aa, Tick-borne encephalitis virus
KYHLKSGHVTC

SEQ ID NO: 203644 - protein, 11 aa, Tick-borne encephalitis virus
YHLKSGHVTCE

SEQ ID NO: 203645 - protein, 11 aa, Tick-borne encephalitis virus
HLKSGHVTCEV

SEQ ID NO: 203646 - protein, 11 aa, Tick-borne encephalitis virus
LKSGHVTCEVG

SEQ ID NO: 203647 - protein, 11 aa, Tick-borne encephalitis virus
KSGHVTCEVGL

SEQ ID NO: 203648 - protein, 11 aa, Tick-borne encephalitis virus
SGHVTCEVGLE

SEQ ID NO: 203649 - protein, 11 aa, Tick-borne encephalitis virus
GHVTCEVGLEK

SEQ ID NO: 203650 - protein, 11 aa, Tick-borne encephalitis virus
HVTCEVGLEKL

SEQ ID NO: 203651 - protein, 11 aa, Tick-borne encephalitis virus
VTCEVGLEKLK

SEQ ID NO: 203652 - protein, 11 aa, Tick-borne encephalitis virus
TCEVGLEKLKM

SEQ ID NO: 203653 - protein, 11 aa, Tick-borne encephalitis virus
CEVGLEKLKMK

SEQ ID NO: 203654 - protein, 11 aa, Tick-borne encephalitis virus
EVGLEKLKMKG

SEQ ID NO: 203655 - protein, 11 aa, Tick-borne encephalitis virus
VGLEKLKMKGL

SEQ ID NO: 203656 - protein, 11 aa, Tick-borne encephalitis virus
GLEKLKMKGLT

SEQ ID NO: 203657 - protein, 11 aa, Tick-borne encephalitis virus
LEKLKMKGLTY

SEQ ID NO: 203658 - protein, 11 aa, Tick-borne encephalitis virus
EKLKMKGLTYT

SEQ ID NO: 203659 - protein, 11 aa, Tick-borne encephalitis virus
KLKMKGLTYTM

SEQ ID NO: 203660 - protein, 11 aa, Tick-borne encephalitis virus
LKMKGLTYTMC

SEQ ID NO: 203661 - protein, 11 aa, Tick-borne encephalitis virus
KMKGLTYTMCD

SEQ ID NO: 203662 - protein, 11 aa, Tick-borne encephalitis virus
MKGLTYTMCDK

SEQ ID NO: 203663 - protein, 11 aa, Tick-borne encephalitis virus
KGLTYTMCDKT

SEQ ID NO: 203664 - protein, 11 aa, Tick-borne encephalitis virus
GLTYTMCDKTK

SEQ ID NO: 203665 - protein, 11 aa, Tick-borne encephalitis virus
LTYTMCDKTKF

SEQ ID NO: 203666 - protein, 11 aa, Tick-borne encephalitis virus
TYTMCDKTKFT

SEQ ID NO: 203667 - protein, 11 aa, Tick-borne encephalitis virus
YTMCDKTKFTW

SEQ ID NO: 203668 - protein, 11 aa, Tick-borne encephalitis virus
TMCDKTKFTWK

SEQ ID NO: 203669 - protein, 11 aa, Tick-borne encephalitis virus
MCDKTKFTWKR

SEQ ID NO: 203670 - protein, 11 aa, Tick-borne encephalitis virus
CDKTKFTWKRI

SEQ ID NO: 203671 - protein, 11 aa, Tick-borne encephalitis virus
DKTKFTWKRIP

SEQ ID NO: 203672 - protein, 11 aa, Tick-borne encephalitis virus
KTKFTWKRIPT

SEQ ID NO: 203673 - protein, 11 aa, Tick-borne encephalitis virus
TKFTWKRIPTD

SEQ ID NO: 203674 - protein, 11 aa, Tick-borne encephalitis virus
KFTWKRIPTDS

SEQ ID NO: 203675 - protein, 11 aa, Tick-borne encephalitis virus
FTWKRIPTDSG

SEQ ID NO: 203676 - protein, 11 aa, Tick-borne encephalitis virus
TWKRIPTDSGH

SEQ ID NO: 203677 - protein, 11 aa, Tick-borne encephalitis virus
WKRIPTDSGHD

SEQ ID NO: 203678 - protein, 11 aa, Tick-borne encephalitis virus
KRIPTDSGHDT

SEQ ID NO: 203679 - protein, 11 aa, Tick-borne encephalitis virus
RIPTDSGHDTV

SEQ ID NO: 203680 - protein, 11 aa, Tick-borne encephalitis virus
IPTDSGHDTVV

SEQ ID NO: 203681 - protein, 11 aa, Tick-borne encephalitis virus
PTDSGHDTVVM

SEQ ID NO: 203682 - protein, 11 aa, Tick-borne encephalitis virus
TDSGHDTVVME

SEQ ID NO: 203683 - protein, 11 aa, Tick-borne encephalitis virus
DSGHDTVVMEV

SEQ ID NO: 203684 - protein, 11 aa, Tick-borne encephalitis virus
SGHDTVVMEVA

SEQ ID NO: 203685 - protein, 11 aa, Tick-borne encephalitis virus
GHDTVVMEVAF

SEQ ID NO: 203686 - protein, 11 aa, Tick-borne encephalitis virus
HDTVVMEVAFS

SEQ ID NO: 203687 - protein, 11 aa, Tick-borne encephalitis virus
DTVVMEVAFSG

SEQ ID NO: 203688 - protein, 11 aa, Tick-borne encephalitis virus
TVVMEVAFSGT

SEQ ID NO: 203689 - protein, 11 aa, Tick-borne encephalitis virus
VVMEVAFSGTK

SEQ ID NO: 203690 - protein, 11 aa, Tick-borne encephalitis virus
VMEVAFSGTKP

SEQ ID NO: 203691 - protein, 11 aa, Tick-borne encephalitis virus
MEVAFSGTKPC

SEQ ID NO: 203692 - protein, 11 aa, Tick-borne encephalitis virus
EVAFSGTKPCR

SEQ ID NO: 203693 - protein, 11 aa, Tick-borne encephalitis virus
VAFSGTKPCRI

SEQ ID NO: 203694 - protein, 11 aa, Tick-borne encephalitis virus
AFSGTKPCRIP

SEQ ID NO: 203695 - protein, 11 aa, Tick-borne encephalitis virus
FSGTKPCRIPV

SEQ ID NO: 203696 - protein, 11 aa, Tick-borne encephalitis virus
SGTKPCRIPVR

SEQ ID NO: 203697 - protein, 11 aa, Tick-borne encephalitis virus
GTKPCRIPVRA

SEQ ID NO: 203698 - protein, 11 aa, Tick-borne encephalitis virus
TKPCRIPVRAV

SEQ ID NO: 203699 - protein, 11 aa, Tick-borne encephalitis virus
KPCRIPVRAVA

SEQ ID NO: 203700 - protein, 11 aa, Tick-borne encephalitis virus
PCRIPVRAVAH

SEQ ID NO: 203701 - protein, 11 aa, Tick-borne encephalitis virus
CRIPVRAVAHG

SEQ ID NO: 203702 - protein, 11 aa, Tick-borne encephalitis virus
RIPVRAVAHGS

SEQ ID NO: 203703 - protein, 11 aa, Tick-borne encephalitis virus
IPVRAVAHGSP

SEQ ID NO: 203704 - protein, 11 aa, Tick-borne encephalitis virus
PVRAVAHGSPD

SEQ ID NO: 203705 - protein, 11 aa, Tick-borne encephalitis virus
VRAVAHGSPDV

SEQ ID NO: 203706 - protein, 11 aa, Tick-borne encephalitis virus
RAVAHGSPDVN

SEQ ID NO: 203707 - protein, 11 aa, Tick-borne encephalitis virus
AVAHGSPDVNV

SEQ ID NO: 203708 - protein, 11 aa, Tick-borne encephalitis virus
VAHGSPDVNVA

SEQ ID NO: 203709 - protein, 11 aa, Tick-borne encephalitis virus
AHGSPDVNVAM

SEQ ID NO: 203710 - protein, 11 aa, Tick-borne encephalitis virus
HGSPDVNVAML

SEQ ID NO: 203711 - protein, 11 aa, Tick-borne encephalitis virus
GSPDVNVAMLI

SEQ ID NO: 203712 - protein, 11 aa, Tick-borne encephalitis virus
SPDVNVAMLIT

SEQ ID NO: 203713 - protein, 11 aa, Tick-borne encephalitis virus
PDVNVAMLITP

SEQ ID NO: 203714 - protein, 11 aa, Tick-borne encephalitis virus
DVNVAMLITPN

SEQ ID NO: 203715 - protein, 11 aa, Tick-borne encephalitis virus
VNVAMLITPNP

SEQ ID NO: 203716 - protein, 11 aa, Tick-borne encephalitis virus
NVAMLITPNPT

SEQ ID NO: 203717 - protein, 11 aa, Tick-borne encephalitis virus
VAMLITPNPTI

SEQ ID NO: 203718 - protein, 11 aa, Tick-borne encephalitis virus
AMLITPNPTIE

SEQ ID NO: 203719 - protein, 11 aa, Tick-borne encephalitis virus
MLITPNPTIEN

SEQ ID NO: 203720 - protein, 11 aa, Tick-borne encephalitis virus
LITPNPTIENN

SEQ ID NO: 203721 - protein, 11 aa, Tick-borne encephalitis virus
ITPNPTIENNG

SEQ ID NO: 203722 - protein, 11 aa, Tick-borne encephalitis virus
TPNPTIENNGG

SEQ ID NO: 203723 - protein, 11 aa, Tick-borne encephalitis virus
PNPTIENNGGG

SEQ ID NO: 203724 - protein, 11 aa, Tick-borne encephalitis virus
NPTIENNGGGF

SEQ ID NO: 203725 - protein, 11 aa, Tick-borne encephalitis virus
PTIENNGGGFI

SEQ ID NO: 203726 - protein, 11 aa, Tick-borne encephalitis virus
TIENNGGGFIE

SEQ ID NO: 203727 - protein, 11 aa, Tick-borne encephalitis virus
IENNGGGFIEM

SEQ ID NO: 203728 - protein, 11 aa, Tick-borne encephalitis virus
ENNGGGFIEMQ

SEQ ID NO: 203729 - protein, 11 aa, Tick-borne encephalitis virus
NNGGGFIEMQL

SEQ ID NO: 203730 - protein, 11 aa, Tick-borne encephalitis virus
NGGGFIEMQLP

SEQ ID NO: 203731 - protein, 11 aa, Tick-borne encephalitis virus
GGGFIEMQLPP

SEQ ID NO: 203732 - protein, 11 aa, Tick-borne encephalitis virus
GGFIEMQLPPG

SEQ ID NO: 203733 - protein, 11 aa, Tick-borne encephalitis virus
GFIEMQLPPGD

SEQ ID NO: 203734 - protein, 11 aa, Tick-borne encephalitis virus
FIEMQLPPGDN

SEQ ID NO: 203735 - protein, 11 aa, Tick-borne encephalitis virus
IEMQLPPGDNI

SEQ ID NO: 203736 - protein, 11 aa, Tick-borne encephalitis virus
EMQLPPGDNII

SEQ ID NO: 203737 - protein, 11 aa, Tick-borne encephalitis virus
MQLPPGDNIIY

SEQ ID NO: 203738 - protein, 11 aa, Tick-borne encephalitis virus
QLPPGDNIIYV

SEQ ID NO: 203739 - protein, 11 aa, Tick-borne encephalitis virus
LPPGDNIIYVG

SEQ ID NO: 203740 - protein, 11 aa, Tick-borne encephalitis virus
PPGDNIIYVGE

SEQ ID NO: 203741 - protein, 11 aa, Tick-borne encephalitis virus
PGDNIIYVGEL

SEQ ID NO: 203742 - protein, 11 aa, Tick-borne encephalitis virus
GDNIIYVGELS

SEQ ID NO: 203743 - protein, 11 aa, Tick-borne encephalitis virus
DNIIYVGELSH

SEQ ID NO: 203744 - protein, 11 aa, Tick-borne encephalitis virus
NIIYVGELSHQ

SEQ ID NO: 203745 - protein, 11 aa, Tick-borne encephalitis virus
IIYVGELSHQW

SEQ ID NO: 203746 - protein, 11 aa, Tick-borne encephalitis virus
IYVGELSHQWF

SEQ ID NO: 203747 - protein, 11 aa, Tick-borne encephalitis virus
YVGELSHQWFQ

SEQ ID NO: 203748 - protein, 11 aa, Tick-borne encephalitis virus
VGELSHQWFQK

SEQ ID NO: 203749 - protein, 11 aa, Tick-borne encephalitis virus
GELSHQWFQKG

SEQ ID NO: 203750 - protein, 11 aa, Tick-borne encephalitis virus
ELSHQWFQKGS

SEQ ID NO: 203751 - protein, 11 aa, Tick-borne encephalitis virus
LSHQWFQKGSS

SEQ ID NO: 203752 - protein, 11 aa, Tick-borne encephalitis virus
SHQWFQKGSSI

SEQ ID NO: 203753 - protein, 11 aa, Tick-borne encephalitis virus
HQWFQKGSSIG

SEQ ID NO: 203754 - protein, 11 aa, Tick-borne encephalitis virus
QWFQKGSSIGR

SEQ ID NO: 203755 - protein, 11 aa, Tick-borne encephalitis virus
WFQKGSSIGRV

SEQ ID NO: 203756 - protein, 11 aa, Tick-borne encephalitis virus
FQKGSSIGRVF

SEQ ID NO: 203757 - protein, 11 aa, Tick-borne encephalitis virus
QKGSSIGRVFQ

SEQ ID NO: 203758 - protein, 11 aa, Tick-borne encephalitis virus
KGSSIGRVFQK

SEQ ID NO: 203759 - protein, 11 aa, Tick-borne encephalitis virus
GSSIGRVFQKT

SEQ ID NO: 203760 - protein, 11 aa, Tick-borne encephalitis virus
SSIGRVFQKTR

SEQ ID NO: 203761 - protein, 11 aa, Tick-borne encephalitis virus
SIGRVFQKTRK

SEQ ID NO: 203762 - protein, 11 aa, Tick-borne encephalitis virus
IGRVFQKTRKG

SEQ ID NO: 203763 - protein, 11 aa, Tick-borne encephalitis virus
GRVFQKTRKGI

SEQ ID NO: 203764 - protein, 11 aa, Tick-borne encephalitis virus
RVFQKTRKGIE

SEQ ID NO: 203765 - protein, 11 aa, Tick-borne encephalitis virus
VFQKTRKGIER

SEQ ID NO: 203766 - protein, 11 aa, Tick-borne encephalitis virus
FQKTRKGIERL

SEQ ID NO: 203767 - protein, 11 aa, Tick-borne encephalitis virus
QKTRKGIERLT

SEQ ID NO: 203768 - protein, 11 aa, Tick-borne encephalitis virus
KTRKGIERLTV

SEQ ID NO: 203769 - protein, 11 aa, Tick-borne encephalitis virus
TRKGIERLTVI

SEQ ID NO: 203770 - protein, 11 aa, Tick-borne encephalitis virus
RKGIERLTVIG

SEQ ID NO: 203771 - protein, 11 aa, Tick-borne encephalitis virus
KGIERLTVIGE

SEQ ID NO: 203772 - protein, 11 aa, Tick-borne encephalitis virus
GIERLTVIGEH

SEQ ID NO: 203773 - protein, 11 aa, Tick-borne encephalitis virus
IERLTVIGEHA

SEQ ID NO: 203774 - protein, 11 aa, Tick-borne encephalitis virus
ERLTVIGEHAW

SEQ ID NO: 203775 - protein, 11 aa, Tick-borne encephalitis virus
RLTVIGEHAWD

SEQ ID NO: 203776 - protein, 11 aa, Tick-borne encephalitis virus
LTVIGEHAWDF

SEQ ID NO: 203777 - protein, 11 aa, Tick-borne encephalitis virus
TVIGEHAWDFG

SEQ ID NO: 203778 - protein, 11 aa, Tick-borne encephalitis virus
VIGEHAWDFGS

SEQ ID NO: 203779 - protein, 11 aa, Tick-borne encephalitis virus
IGEHAWDFGST

SEQ ID NO: 203780 - protein, 11 aa, Tick-borne encephalitis virus
GEHAWDFGSTG

SEQ ID NO: 203781 - protein, 11 aa, Tick-borne encephalitis virus
EHAWDFGSTGG

SEQ ID NO: 203782 - protein, 11 aa, Tick-borne encephalitis virus
HAWDFGSTGGF

SEQ ID NO: 203783 - protein, 11 aa, Tick-borne encephalitis virus
AWDFGSTGGFL

SEQ ID NO: 203784 - protein, 11 aa, Tick-borne encephalitis virus
WDFGSTGGFLT

SEQ ID NO: 203785 - protein, 11 aa, Tick-borne encephalitis virus
DFGSTGGFLTS

SEQ ID NO: 203786 - protein, 11 aa, Tick-borne encephalitis virus
FGSTGGFLTSV

SEQ ID NO: 203787 - protein, 11 aa, Tick-borne encephalitis virus
GSTGGFLTSVG

SEQ ID NO: 203788 - protein, 11 aa, Tick-borne encephalitis virus
STGGFLTSVGK

SEQ ID NO: 203789 - protein, 11 aa, Tick-borne encephalitis virus
TGGFLTSVGKA

SEQ ID NO: 203790 - protein, 11 aa, Tick-borne encephalitis virus
GGFLTSVGKAL

SEQ ID NO: 203791 - protein, 11 aa, Tick-borne encephalitis virus
GFLTSVGKALH

SEQ ID NO: 203792 - protein, 11 aa, Tick-borne encephalitis virus
FLTSVGKALHT

SEQ ID NO: 203793 - protein, 11 aa, Tick-borne encephalitis virus
LTSVGKALHTV

SEQ ID NO: 203794 - protein, 11 aa, Tick-borne encephalitis virus
TSVGKALHTVL

SEQ ID NO: 203795 - protein, 11 aa, Tick-borne encephalitis virus
SVGKALHTVLG

SEQ ID NO: 203796 - protein, 11 aa, Tick-borne encephalitis virus
VGKALHTVLGG

SEQ ID NO: 203797 - protein, 11 aa, Tick-borne encephalitis virus
GKALHTVLGGA

SEQ ID NO: 203798 - protein, 11 aa, Tick-borne encephalitis virus
KALHTVLGGAF

SEQ ID NO: 203799 - protein, 11 aa, Tick-borne encephalitis virus
ALHTVLGGAFN

SEQ ID NO: 203800 - protein, 11 aa, Tick-borne encephalitis virus
LHTVLGGAFNS

SEQ ID NO: 203801 - protein, 11 aa, Tick-borne encephalitis virus
HTVLGGAFNSL

SEQ ID NO: 203802 - protein, 11 aa, Tick-borne encephalitis virus
TVLGGAFNSLF

SEQ ID NO: 203803 - protein, 11 aa, Tick-borne encephalitis virus
VLGGAFNSLFG

SEQ ID NO: 203804 - protein, 11 aa, Tick-borne encephalitis virus
LGGAFNSLFGG

SEQ ID NO: 203805 - protein, 11 aa, Tick-borne encephalitis virus
GGAFNSLFGGV

SEQ ID NO: 203806 - protein, 11 aa, Tick-borne encephalitis virus
GAFNSLFGGVG

SEQ ID NO: 203807 - protein, 11 aa, Tick-borne encephalitis virus
AFNSLFGGVGF

SEQ ID NO: 203808 - protein, 11 aa, Tick-borne encephalitis virus
FNSLFGGVGFL

SEQ ID NO: 203809 - protein, 11 aa, Tick-borne encephalitis virus
NSLFGGVGFLP

SEQ ID NO: 203810 - protein, 11 aa, Tick-borne encephalitis virus
SLFGGVGFLPK

SEQ ID NO: 203811 - protein, 11 aa, Tick-borne encephalitis virus
LFGGVGFLPKI

SEQ ID NO: 203812 - protein, 11 aa, Tick-borne encephalitis virus
FGGVGFLPKIL

SEQ ID NO: 203813 - protein, 11 aa, Tick-borne encephalitis virus
GGVGFLPKILV

SEQ ID NO: 203814 - protein, 11 aa, Tick-borne encephalitis virus
GVGFLPKILVG

SEQ ID NO: 203815 - protein, 11 aa, Tick-borne encephalitis virus
GVALAWLGLNM

SEQ ID NO: 203816 - protein, 11 aa, Tick-borne encephalitis virus
VALAWLGLNMR

SEQ ID NO: 203817 - protein, 11 aa, Tick-borne encephalitis virus
ALAWLGLNMRN

SEQ ID NO: 203818 - protein, 11 aa, Tick-borne encephalitis virus
LAWLGLNMRNP

SEQ ID NO: 203819 - protein, 11 aa, Tick-borne encephalitis virus
AWLGLNMRNPT

SEQ ID NO: 203820 - protein, 11 aa, Tick-borne encephalitis virus
WLGLNMRNPTM

SEQ ID NO: 203821 - protein, 11 aa, Tick-borne encephalitis virus
LGLNMRNPTMS

SEQ ID NO: 203822 - protein, 11 aa, Tick-borne encephalitis virus
GLNMRNPTMSM

SEQ ID NO: 203823 - protein, 11 aa, Tick-borne encephalitis virus
LNMRNPTMSMS

SEQ ID NO: 203824 - protein, 11 aa, Tick-borne encephalitis virus
NMRNPTMSMSF

SEQ ID NO: 203825 - protein, 11 aa, Tick-borne encephalitis virus
MRNPTMSMSFL

SEQ ID NO: 203826 - protein, 11 aa, Tick-borne encephalitis virus
RNPTMSMSFLL

SEQ ID NO: 203827 - protein, 11 aa, Tick-borne encephalitis virus
NPTMSMSFLLA

SEQ ID NO: 203828 - protein, 11 aa, Tick-borne encephalitis virus
PTMSMSFLLAG

SEQ ID NO: 203829 - protein, 11 aa, Tick-borne encephalitis virus
TMSMSFLLAGG

SEQ ID NO: 203830 - protein, 11 aa, Tick-borne encephalitis virus
MSMSFLLAGGL

SEQ ID NO: 203831 - protein, 11 aa, Tick-borne encephalitis virus
SMSFLLAGGLV

SEQ ID NO: 203832 - protein, 11 aa, Tick-borne encephalitis virus
MSFLLAGGLVL

SEQ ID NO: 203833 - protein, 11 aa, Tick-borne encephalitis virus
SFLLAGGLVLA

SEQ ID NO: 203834 - protein, 11 aa, Tick-borne encephalitis virus
FLLAGGLVLAM

SEQ ID NO: 203835 - protein, 11 aa, Tick-borne encephalitis virus
LLAGGLVLAMT

SEQ ID NO: 203836 - protein, 11 aa, Tick-borne encephalitis virus
LAGGLVLAMTL

SEQ ID NO: 203837 - protein, 11 aa, Tick-borne encephalitis virus
AGGLVLAMTLG

SEQ ID NO: 203838 - protein, 11 aa, Tick-borne encephalitis virus
GGLVLAMTLGV

SEQ ID NO: 203839 - protein, 11 aa, Tick-borne encephalitis virus
GLVLAMTLGVG

SEQ ID NO: 203840 - protein, 11 aa, Tick-borne encephalitis virus
LVLAMTLGVGA

SEQ ID NO: 203841 - protein, 11 aa, Tick-borne encephalitis virus
VLAMTLGVGAD

SEQ ID NO: 203842 - protein, 11 aa, Tick-borne encephalitis virus
LAMTLGVGADV

SEQ ID NO: 203843 - protein, 11 aa, Tick-borne encephalitis virus
AMTLGVGADVG

SEQ ID NO: 203844 - protein, 11 aa, Tick-borne encephalitis virus
MTLGVGADVGC

SEQ ID NO: 203845 - protein, 11 aa, Tick-borne encephalitis virus
TLGVGADVGCA

SEQ ID NO: 203846 - protein, 11 aa, Tick-borne encephalitis virus
LGVGADVGCAV

SEQ ID NO: 203847 - protein, 11 aa, Tick-borne encephalitis virus
GVGADVGCAVD

SEQ ID NO: 203848 - protein, 11 aa, Tick-borne encephalitis virus
VGADVGCAVDT

SEQ ID NO: 203849 - protein, 11 aa, Tick-borne encephalitis virus
GADVGCAVDTE

SEQ ID NO: 203850 - protein, 11 aa, Tick-borne encephalitis virus
ADVGCAVDTER

SEQ ID NO: 203851 - protein, 11 aa, Tick-borne encephalitis virus
DVGCAVDTERM

SEQ ID NO: 203852 - protein, 11 aa, Tick-borne encephalitis virus
VGCAVDTERME

SEQ ID NO: 203853 - protein, 11 aa, Tick-borne encephalitis virus
GCAVDTERMEL

SEQ ID NO: 203854 - protein, 11 aa, Tick-borne encephalitis virus
CAVDTERMELR

SEQ ID NO: 203855 - protein, 11 aa, Tick-borne encephalitis virus
AVDTERMELRC

SEQ ID NO: 203856 - protein, 11 aa, Tick-borne encephalitis virus
VDTERMELRCG

SEQ ID NO: 203857 - protein, 11 aa, Tick-borne encephalitis virus
DTERMELRCGE

SEQ ID NO: 203858 - protein, 11 aa, Tick-borne encephalitis virus
TERMELRCGEG

SEQ ID NO: 203859 - protein, 11 aa, Tick-borne encephalitis virus
ERMELRCGEGL

SEQ ID NO: 203860 - protein, 11 aa, Tick-borne encephalitis virus
RMELRCGEGLV

SEQ ID NO: 203861 - protein, 11 aa, Tick-borne encephalitis virus
MELRCGEGLVV

SEQ ID NO: 203862 - protein, 11 aa, Tick-borne encephalitis virus
ELRCGEGLVVW

SEQ ID NO: 203863 - protein, 11 aa, Tick-borne encephalitis virus
LRCGEGLVVWR

SEQ ID NO: 203864 - protein, 11 aa, Tick-borne encephalitis virus
RCGEGLVVWRE

SEQ ID NO: 203865 - protein, 11 aa, Tick-borne encephalitis virus
CGEGLVVWREV

SEQ ID NO: 203866 - protein, 11 aa, Tick-borne encephalitis virus
GEGLVVWREVS

SEQ ID NO: 203867 - protein, 11 aa, Tick-borne encephalitis virus
EGLVVWREVSE

SEQ ID NO: 203868 - protein, 11 aa, Tick-borne encephalitis virus
GLVVWREVSEW

SEQ ID NO: 203869 - protein, 11 aa, Tick-borne encephalitis virus
LVVWREVSEWY

SEQ ID NO: 203870 - protein, 11 aa, Tick-borne encephalitis virus
VVWREVSEWYD

SEQ ID NO: 203871 - protein, 11 aa, Tick-borne encephalitis virus
VWREVSEWYDN

SEQ ID NO: 203872 - protein, 11 aa, Tick-borne encephalitis virus
WREVSEWYDNY

SEQ ID NO: 203873 - protein, 11 aa, Tick-borne encephalitis virus
REVSEWYDNYA

SEQ ID NO: 203874 - protein, 11 aa, Tick-borne encephalitis virus
EVSEWYDNYAY

SEQ ID NO: 203875 - protein, 11 aa, Tick-borne encephalitis virus
VSEWYDNYAYY

SEQ ID NO: 203876 - protein, 11 aa, Tick-borne encephalitis virus
SEWYDNYAYYP

SEQ ID NO: 203877 - protein, 11 aa, Tick-borne encephalitis virus
EWYDNYAYYPE

SEQ ID NO: 203878 - protein, 11 aa, Tick-borne encephalitis virus
WYDNYAYYPET

SEQ ID NO: 203879 - protein, 11 aa, Tick-borne encephalitis virus
YDNYAYYPETP

SEQ ID NO: 203880 - protein, 11 aa, Tick-borne encephalitis virus
DNYAYYPETPG

SEQ ID NO: 203881 - protein, 11 aa, Tick-borne encephalitis virus
NYAYYPETPGA

SEQ ID NO: 203882 - protein, 11 aa, Tick-borne encephalitis virus
YAYYPETPGAL

SEQ ID NO: 203883 - protein, 11 aa, Tick-borne encephalitis virus
AYYPETPGALA

SEQ ID NO: 203884 - protein, 11 aa, Tick-borne encephalitis virus
YYPETPGALAS

SEQ ID NO: 203885 - protein, 11 aa, Tick-borne encephalitis virus
YPETPGALASA

SEQ ID NO: 203886 - protein, 11 aa, Tick-borne encephalitis virus
PETPGALASAI

SEQ ID NO: 203887 - protein, 11 aa, Tick-borne encephalitis virus
ETPGALASAIK

SEQ ID NO: 203888 - protein, 11 aa, Tick-borne encephalitis virus
TPGALASAIKE

SEQ ID NO: 203889 - protein, 11 aa, Tick-borne encephalitis virus
PGALASAIKET

SEQ ID NO: 203890 - protein, 11 aa, Tick-borne encephalitis virus
GALASAIKETF

SEQ ID NO: 203891 - protein, 11 aa, Tick-borne encephalitis virus
ALASAIKETFE

SEQ ID NO: 203892 - protein, 11 aa, Tick-borne encephalitis virus
LASAIKETFEE

SEQ ID NO: 203893 - protein, 11 aa, Tick-borne encephalitis virus
ASAIKETFEEG

SEQ ID NO: 203894 - protein, 11 aa, Tick-borne encephalitis virus
SAIKETFEEGT

SEQ ID NO: 203895 - protein, 11 aa, Tick-borne encephalitis virus
AIKETFEEGTC

SEQ ID NO: 203896 - protein, 11 aa, Tick-borne encephalitis virus
IKETFEEGTCG

SEQ ID NO: 203897 - protein, 11 aa, Tick-borne encephalitis virus
KETFEEGTCGI

SEQ ID NO: 203898 - protein, 11 aa, Tick-borne encephalitis virus
ETFEEGTCGIV

SEQ ID NO: 203899 - protein, 11 aa, Tick-borne encephalitis virus
TFEEGTCGIVP

SEQ ID NO: 203900 - protein, 11 aa, Tick-borne encephalitis virus
FEEGTCGIVPQ

SEQ ID NO: 203901 - protein, 11 aa, Tick-borne encephalitis virus
EEGTCGIVPQN

SEQ ID NO: 203902 - protein, 11 aa, Tick-borne encephalitis virus
EGTCGIVPQNR

SEQ ID NO: 203903 - protein, 11 aa, Tick-borne encephalitis virus
GTCGIVPQNRL

SEQ ID NO: 203904 - protein, 11 aa, Tick-borne encephalitis virus
TCGIVPQNRLE

SEQ ID NO: 203905 - protein, 11 aa, Tick-borne encephalitis virus
CGIVPQNRLEM

SEQ ID NO: 203906 - protein, 11 aa, Tick-borne encephalitis virus
GIVPQNRLEMA

SEQ ID NO: 203907 - protein, 11 aa, Tick-borne encephalitis virus
IVPQNRLEMAM

SEQ ID NO: 203908 - protein, 11 aa, Tick-borne encephalitis virus
VPQNRLEMAMW

SEQ ID NO: 203909 - protein, 11 aa, Tick-borne encephalitis virus
PQNRLEMAMWR

SEQ ID NO: 203910 - protein, 11 aa, Tick-borne encephalitis virus
QNRLEMAMWRS

SEQ ID NO: 203911 - protein, 11 aa, Tick-borne encephalitis virus
NRLEMAMWRSS

SEQ ID NO: 203912 - protein, 11 aa, Tick-borne encephalitis virus
RLEMAMWRSSA

SEQ ID NO: 203913 - protein, 11 aa, Tick-borne encephalitis virus
LEMAMWRSSAT

SEQ ID NO: 203914 - protein, 11 aa, Tick-borne encephalitis virus
EMAMWRSSATE

SEQ ID NO: 203915 - protein, 11 aa, Tick-borne encephalitis virus
MAMWRSSATEL

SEQ ID NO: 203916 - protein, 11 aa, Tick-borne encephalitis virus
AMWRSSATELN

SEQ ID NO: 203917 - protein, 11 aa, Tick-borne encephalitis virus
MWRSSATELNL

SEQ ID NO: 203918 - protein, 11 aa, Tick-borne encephalitis virus
WRSSATELNLA

SEQ ID NO: 203919 - protein, 11 aa, Tick-borne encephalitis virus
RSSATELNLAL

SEQ ID NO: 203920 - protein, 11 aa, Tick-borne encephalitis virus
SSATELNLALA

SEQ ID NO: 203921 - protein, 11 aa, Tick-borne encephalitis virus
SATELNLALAE

SEQ ID NO: 203922 - protein, 11 aa, Tick-borne encephalitis virus
ATELNLALAEG

SEQ ID NO: 203923 - protein, 11 aa, Tick-borne encephalitis virus
TELNLALAEGD

SEQ ID NO: 203924 - protein, 11 aa, Tick-borne encephalitis virus
ELNLALAEGDA

SEQ ID NO: 203925 - protein, 11 aa, Tick-borne encephalitis virus
LNLALAEGDAN

SEQ ID NO: 203926 - protein, 11 aa, Tick-borne encephalitis virus
NLALAEGDANL

SEQ ID NO: 203927 - protein, 11 aa, Tick-borne encephalitis virus
LALAEGDANLT

SEQ ID NO: 203928 - protein, 11 aa, Tick-borne encephalitis virus
ALAEGDANLTV

SEQ ID NO: 203929 - protein, 11 aa, Tick-borne encephalitis virus
LAEGDANLTVV

SEQ ID NO: 203930 - protein, 11 aa, Tick-borne encephalitis virus
AEGDANLTVVV

SEQ ID NO: 203931 - protein, 11 aa, Tick-borne encephalitis virus
EGDANLTVVVD

SEQ ID NO: 203932 - protein, 11 aa, Tick-borne encephalitis virus
GDANLTVVVDK

SEQ ID NO: 203933 - protein, 11 aa, Tick-borne encephalitis virus
DANLTVVVDKL

SEQ ID NO: 203934 - protein, 11 aa, Tick-borne encephalitis virus
ANLTVVVDKLD

SEQ ID NO: 203935 - protein, 11 aa, Tick-borne encephalitis virus
NLTVVVDKLDP

SEQ ID NO: 203936 - protein, 11 aa, Tick-borne encephalitis virus
LTVVVDKLDPT

SEQ ID NO: 203937 - protein, 11 aa, Tick-borne encephalitis virus
TVVVDKLDPTD

SEQ ID NO: 203938 - protein, 11 aa, Tick-borne encephalitis virus
VVVDKLDPTDY

SEQ ID NO: 203939 - protein, 11 aa, Tick-borne encephalitis virus
VVDKLDPTDYR

SEQ ID NO: 203940 - protein, 11 aa, Tick-borne encephalitis virus
VDKLDPTDYRG

SEQ ID NO: 203941 - protein, 11 aa, Tick-borne encephalitis virus
DKLDPTDYRGG

SEQ ID NO: 203942 - protein, 11 aa, Tick-borne encephalitis virus
KLDPTDYRGGI

SEQ ID NO: 203943 - protein, 11 aa, Tick-borne encephalitis virus
LDPTDYRGGIP

SEQ ID NO: 203944 - protein, 11 aa, Tick-borne encephalitis virus
DPTDYRGGIPG

SEQ ID NO: 203945 - protein, 11 aa, Tick-borne encephalitis virus
PTDYRGGIPGL

SEQ ID NO: 203946 - protein, 11 aa, Tick-borne encephalitis virus
TDYRGGIPGLL

SEQ ID NO: 203947 - protein, 11 aa, Tick-borne encephalitis virus
DYRGGIPGLLK

SEQ ID NO: 203948 - protein, 11 aa, Tick-borne encephalitis virus
YRGGIPGLLKK

SEQ ID NO: 203949 - protein, 11 aa, Tick-borne encephalitis virus
RGGIPGLLKKG

SEQ ID NO: 203950 - protein, 11 aa, Tick-borne encephalitis virus
GGIPGLLKKGK

SEQ ID NO: 203951 - protein, 11 aa, Tick-borne encephalitis virus
GIPGLLKKGKD

SEQ ID NO: 203952 - protein, 11 aa, Tick-borne encephalitis virus
IPGLLKKGKDI

SEQ ID NO: 203953 - protein, 11 aa, Tick-borne encephalitis virus
PGLLKKGKDIK

SEQ ID NO: 203954 - protein, 11 aa, Tick-borne encephalitis virus
GLLKKGKDIKV

SEQ ID NO: 203955 - protein, 11 aa, Tick-borne encephalitis virus
LLKKGKDIKVS

SEQ ID NO: 203956 - protein, 11 aa, Tick-borne encephalitis virus
LKKGKDIKVSW

SEQ ID NO: 203957 - protein, 11 aa, Tick-borne encephalitis virus
KKGKDIKVSWK

SEQ ID NO: 203958 - protein, 11 aa, Tick-borne encephalitis virus
KGKDIKVSWKS

SEQ ID NO: 203959 - protein, 11 aa, Tick-borne encephalitis virus
GKDIKVSWKSW

SEQ ID NO: 203960 - protein, 11 aa, Tick-borne encephalitis virus
KDIKVSWKSWG

SEQ ID NO: 203961 - protein, 11 aa, Tick-borne encephalitis virus
DIKVSWKSWGH

SEQ ID NO: 203962 - protein, 11 aa, Tick-borne encephalitis virus
IKVSWKSWGHS

SEQ ID NO: 203963 - protein, 11 aa, Tick-borne encephalitis virus
MIWSVPEAPRR

SEQ ID NO: 203964 - protein, 11 aa, Tick-borne encephalitis virus
IWSVPEAPRRF

SEQ ID NO: 203965 - protein, 11 aa, Tick-borne encephalitis virus
WSVPEAPRRFM

SEQ ID NO: 203966 - protein, 11 aa, Tick-borne encephalitis virus
SVPEAPRRFMV

SEQ ID NO: 203967 - protein, 11 aa, Tick-borne encephalitis virus
VPEAPRRFMVG

SEQ ID NO: 203968 - protein, 11 aa, Tick-borne encephalitis virus
PEAPRRFMVGT

SEQ ID NO: 203969 - protein, 11 aa, Tick-borne encephalitis virus
EAPRRFMVGTE

SEQ ID NO: 203970 - protein, 11 aa, Tick-borne encephalitis virus
APRRFMVGTEG

SEQ ID NO: 203971 - protein, 11 aa, Tick-borne encephalitis virus
PRRFMVGTEGG

SEQ ID NO: 203972 - protein, 11 aa, Tick-borne encephalitis virus
SECPLERRKTG

SEQ ID NO: 203973 - protein, 11 aa, Tick-borne encephalitis virus
ECPLERRKTGV

SEQ ID NO: 203974 - protein, 11 aa, Tick-borne encephalitis virus
CPLERRKTGVF

SEQ ID NO: 203975 - protein, 11 aa, Tick-borne encephalitis virus
PLERRKTGVFT

SEQ ID NO: 203976 - protein, 11 aa, Tick-borne encephalitis virus
LERRKTGVFTV

SEQ ID NO: 203977 - protein, 11 aa, Tick-borne encephalitis virus
ERRKTGVFTVA

SEQ ID NO: 203978 - protein, 11 aa, Tick-borne encephalitis virus
RRKTGVFTVAE

SEQ ID NO: 203979 - protein, 11 aa, Tick-borne encephalitis virus
RKTGVFTVAEF

SEQ ID NO: 203980 - protein, 11 aa, Tick-borne encephalitis virus
KTGVFTVAEFG

SEQ ID NO: 203981 - protein, 11 aa, Tick-borne encephalitis virus
TGVFTVAEFGV

SEQ ID NO: 203982 - protein, 11 aa, Tick-borne encephalitis virus
GVFTVAEFGVG

SEQ ID NO: 203983 - protein, 11 aa, Tick-borne encephalitis virus
VFTVAEFGVGL

SEQ ID NO: 203984 - protein, 11 aa, Tick-borne encephalitis virus
FTVAEFGVGLR

SEQ ID NO: 203985 - protein, 11 aa, Tick-borne encephalitis virus
TVAEFGVGLRT

SEQ ID NO: 203986 - protein, 11 aa, Tick-borne encephalitis virus
VAEFGVGLRTK

SEQ ID NO: 203987 - protein, 11 aa, Tick-borne encephalitis virus
AEFGVGLRTKV

SEQ ID NO: 203988 - protein, 11 aa, Tick-borne encephalitis virus
EFGVGLRTKVF

SEQ ID NO: 203989 - protein, 11 aa, Tick-borne encephalitis virus
FGVGLRTKVFL

SEQ ID NO: 203990 - protein, 11 aa, Tick-borne encephalitis virus
GVGLRTKVFLD

SEQ ID NO: 203991 - protein, 11 aa, Tick-borne encephalitis virus
VGLRTKVFLDF

SEQ ID NO: 203992 - protein, 11 aa, Tick-borne encephalitis virus
GLRTKVFLDFR

SEQ ID NO: 203993 - protein, 11 aa, Tick-borne encephalitis virus
LRTKVFLDFRQ

SEQ ID NO: 203994 - protein, 11 aa, Tick-borne encephalitis virus
RTKVFLDFRQE

SEQ ID NO: 203995 - protein, 11 aa, Tick-borne encephalitis virus
TKVFLDFRQES

SEQ ID NO: 203996 - protein, 11 aa, Tick-borne encephalitis virus
KVFLDFRQEST

SEQ ID NO: 203997 - protein, 11 aa, Tick-borne encephalitis virus
VFLDFRQESTH

SEQ ID NO: 203998 - protein, 11 aa, Tick-borne encephalitis virus
FLDFRQESTHE

SEQ ID NO: 203999 - protein, 11 aa, Tick-borne encephalitis virus
LDFRQESTHEC

SEQ ID NO: 204000 - protein, 11 aa, Tick-borne encephalitis virus
DFRQESTHECD

SEQ ID NO: 204001 - protein, 11 aa, Tick-borne encephalitis virus
FRQESTHECDT

SEQ ID NO: 204002 - protein, 11 aa, Tick-borne encephalitis virus
RQESTHECDTG

SEQ ID NO: 204003 - protein, 11 aa, Tick-borne encephalitis virus
QESTHECDTGV

SEQ ID NO: 204004 - protein, 11 aa, Tick-borne encephalitis virus
ESTHECDTGVM

SEQ ID NO: 204005 - protein, 11 aa, Tick-borne encephalitis virus
STHECDTGVMG

SEQ ID NO: 204006 - protein, 11 aa, Tick-borne encephalitis virus
THECDTGVMGA

SEQ ID NO: 204007 - protein, 11 aa, Tick-borne encephalitis virus
HECDTGVMGAA

SEQ ID NO: 204008 - protein, 11 aa, Tick-borne encephalitis virus
ECDTGVMGAAV

SEQ ID NO: 204009 - protein, 11 aa, Tick-borne encephalitis virus
CDTGVMGAAVK

SEQ ID NO: 204010 - protein, 11 aa, Tick-borne encephalitis virus
DTGVMGAAVKN

SEQ ID NO: 204011 - protein, 11 aa, Tick-borne encephalitis virus
TGVMGAAVKNG

SEQ ID NO: 204012 - protein, 11 aa, Tick-borne encephalitis virus
GVMGAAVKNGM

SEQ ID NO: 204013 - protein, 11 aa, Tick-borne encephalitis virus
VMGAAVKNGMA

SEQ ID NO: 204014 - protein, 11 aa, Tick-borne encephalitis virus
MGAAVKNGMAV

SEQ ID NO: 204015 - protein, 11 aa, Tick-borne encephalitis virus
GAAVKNGMAVH

SEQ ID NO: 204016 - protein, 11 aa, Tick-borne encephalitis virus
AAVKNGMAVHT

SEQ ID NO: 204017 - protein, 11 aa, Tick-borne encephalitis virus
AVKNGMAVHTD

SEQ ID NO: 204018 - protein, 11 aa, Tick-borne encephalitis virus
VKNGMAVHTDQ

SEQ ID NO: 204019 - protein, 11 aa, Tick-borne encephalitis virus
KNGMAVHTDQS

SEQ ID NO: 204020 - protein, 11 aa, Tick-borne encephalitis virus
NGMAVHTDQSL

SEQ ID NO: 204021 - protein, 11 aa, Tick-borne encephalitis virus
GMAVHTDQSLW

SEQ ID NO: 204022 - protein, 11 aa, Tick-borne encephalitis virus
MAVHTDQSLWM

SEQ ID NO: 204023 - protein, 11 aa, Tick-borne encephalitis virus
AVHTDQSLWMK

SEQ ID NO: 204024 - protein, 11 aa, Tick-borne encephalitis virus
VHTDQSLWMKS

SEQ ID NO: 204025 - protein, 11 aa, Tick-borne encephalitis virus
HTDQSLWMKSV

SEQ ID NO: 204026 - protein, 11 aa, Tick-borne encephalitis virus
TDQSLWMKSVR

SEQ ID NO: 204027 - protein, 11 aa, Tick-borne encephalitis virus
DQSLWMKSVRN

SEQ ID NO: 204028 - protein, 11 aa, Tick-borne encephalitis virus
QSLWMKSVRND

SEQ ID NO: 204029 - protein, 11 aa, Tick-borne encephalitis virus
SLWMKSVRNDT

SEQ ID NO: 204030 - protein, 11 aa, Tick-borne encephalitis virus
LWMKSVRNDTG

SEQ ID NO: 204031 - protein, 11 aa, Tick-borne encephalitis virus
WMKSVRNDTGT

SEQ ID NO: 204032 - protein, 11 aa, Tick-borne encephalitis virus
MKSVRNDTGTY

SEQ ID NO: 204033 - protein, 11 aa, Tick-borne encephalitis virus
KSVRNDTGTYI

SEQ ID NO: 204034 - protein, 11 aa, Tick-borne encephalitis virus
SVRNDTGTYIV

SEQ ID NO: 204035 - protein, 11 aa, Tick-borne encephalitis virus
VRNDTGTYIVE

SEQ ID NO: 204036 - protein, 11 aa, Tick-borne encephalitis virus
RNDTGTYIVEL

SEQ ID NO: 204037 - protein, 11 aa, Tick-borne encephalitis virus
NDTGTYIVELL

SEQ ID NO: 204038 - protein, 11 aa, Tick-borne encephalitis virus
DTGTYIVELLV

SEQ ID NO: 204039 - protein, 11 aa, Tick-borne encephalitis virus
TGTYIVELLVT

SEQ ID NO: 204040 - protein, 11 aa, Tick-borne encephalitis virus
GTYIVELLVTD

SEQ ID NO: 204041 - protein, 11 aa, Tick-borne encephalitis virus
TYIVELLVTDL

SEQ ID NO: 204042 - protein, 11 aa, Tick-borne encephalitis virus
YIVELLVTDLR

SEQ ID NO: 204043 - protein, 11 aa, Tick-borne encephalitis virus
IVELLVTDLRN

SEQ ID NO: 204044 - protein, 11 aa, Tick-borne encephalitis virus
VELLVTDLRNC

SEQ ID NO: 204045 - protein, 11 aa, Tick-borne encephalitis virus
ELLVTDLRNCS

SEQ ID NO: 204046 - protein, 11 aa, Tick-borne encephalitis virus
LLVTDLRNCSW

SEQ ID NO: 204047 - protein, 11 aa, Tick-borne encephalitis virus
LVTDLRNCSWP

SEQ ID NO: 204048 - protein, 11 aa, Tick-borne encephalitis virus
VTDLRNCSWPA

SEQ ID NO: 204049 - protein, 11 aa, Tick-borne encephalitis virus
TDLRNCSWPAS

SEQ ID NO: 204050 - protein, 11 aa, Tick-borne encephalitis virus
DLRNCSWPASH

SEQ ID NO: 204051 - protein, 11 aa, Tick-borne encephalitis virus
LRNCSWPASHT

SEQ ID NO: 204052 - protein, 11 aa, Tick-borne encephalitis virus
RNCSWPASHTI

SEQ ID NO: 204053 - protein, 11 aa, Tick-borne encephalitis virus
NCSWPASHTID

SEQ ID NO: 204054 - protein, 11 aa, Tick-borne encephalitis virus
CSWPASHTIDN

SEQ ID NO: 204055 - protein, 11 aa, Tick-borne encephalitis virus
SWPASHTIDNA

SEQ ID NO: 204056 - protein, 11 aa, Tick-borne encephalitis virus
WPASHTIDNAE

SEQ ID NO: 204057 - protein, 11 aa, Tick-borne encephalitis virus
PASHTIDNAEV

SEQ ID NO: 204058 - protein, 11 aa, Tick-borne encephalitis virus
ASHTIDNAEVV

SEQ ID NO: 204059 - protein, 11 aa, Tick-borne encephalitis virus
SHTIDNAEVVD

SEQ ID NO: 204060 - protein, 11 aa, Tick-borne encephalitis virus
HTIDNAEVVDS

SEQ ID NO: 204061 - protein, 11 aa, Tick-borne encephalitis virus
TIDNAEVVDSE

SEQ ID NO: 204062 - protein, 11 aa, Tick-borne encephalitis virus
IDNAEVVDSEL

SEQ ID NO: 204063 - protein, 11 aa, Tick-borne encephalitis virus
DNAEVVDSELF

SEQ ID NO: 204064 - protein, 11 aa, Tick-borne encephalitis virus
NAEVVDSELFL

SEQ ID NO: 204065 - protein, 11 aa, Tick-borne encephalitis virus
AEVVDSELFLP

SEQ ID NO: 204066 - protein, 11 aa, Tick-borne encephalitis virus
EVVDSELFLPA

SEQ ID NO: 204067 - protein, 11 aa, Tick-borne encephalitis virus
VVDSELFLPAS

SEQ ID NO: 204068 - protein, 11 aa, Tick-borne encephalitis virus
VDSELFLPASL

SEQ ID NO: 204069 - protein, 11 aa, Tick-borne encephalitis virus
DSELFLPASLA

SEQ ID NO: 204070 - protein, 11 aa, Tick-borne encephalitis virus
SELFLPASLAG

SEQ ID NO: 204071 - protein, 11 aa, Tick-borne encephalitis virus
ELFLPASLAGP

SEQ ID NO: 204072 - protein, 11 aa, Tick-borne encephalitis virus
LFLPASLAGPR

SEQ ID NO: 204073 - protein, 11 aa, Tick-borne encephalitis virus
FLPASLAGPRS

SEQ ID NO: 204074 - protein, 11 aa, Tick-borne encephalitis virus
LPASLAGPRSW

SEQ ID NO: 204075 - protein, 11 aa, Tick-borne encephalitis virus
PASLAGPRSWY

SEQ ID NO: 204076 - protein, 11 aa, Tick-borne encephalitis virus
ASLAGPRSWYN

SEQ ID NO: 204077 - protein, 11 aa, Tick-borne encephalitis virus
SLAGPRSWYNR

SEQ ID NO: 204078 - protein, 11 aa, Tick-borne encephalitis virus
LAGPRSWYNRI

SEQ ID NO: 204079 - protein, 11 aa, Tick-borne encephalitis virus
AGPRSWYNRIP

SEQ ID NO: 204080 - protein, 11 aa, Tick-borne encephalitis virus
GPRSWYNRIPG

SEQ ID NO: 204081 - protein, 11 aa, Tick-borne encephalitis virus
PRSWYNRIPGY

SEQ ID NO: 204082 - protein, 11 aa, Tick-borne encephalitis virus
RSWYNRIPGYS

SEQ ID NO: 204083 - protein, 11 aa, Tick-borne encephalitis virus
SWYNRIPGYSE

SEQ ID NO: 204084 - protein, 11 aa, Tick-borne encephalitis virus
WYNRIPGYSEQ

SEQ ID NO: 204085 - protein, 11 aa, Tick-borne encephalitis virus
YNRIPGYSEQV

SEQ ID NO: 204086 - protein, 11 aa, Tick-borne encephalitis virus
NRIPGYSEQVK

SEQ ID NO: 204087 - protein, 11 aa, Tick-borne encephalitis virus
RIPGYSEQVKG

SEQ ID NO: 204088 - protein, 11 aa, Tick-borne encephalitis virus
IPGYSEQVKGP

SEQ ID NO: 204089 - protein, 11 aa, Tick-borne encephalitis virus
PGYSEQVKGPW

SEQ ID NO: 204090 - protein, 11 aa, Tick-borne encephalitis virus
GYSEQVKGPWK

SEQ ID NO: 204091 - protein, 11 aa, Tick-borne encephalitis virus
YSEQVKGPWKY

SEQ ID NO: 204092 - protein, 11 aa, Tick-borne encephalitis virus
SEQVKGPWKYS

SEQ ID NO: 204093 - protein, 11 aa, Tick-borne encephalitis virus
EQVKGPWKYSP

SEQ ID NO: 204094 - protein, 11 aa, Tick-borne encephalitis virus
QVKGPWKYSPI

SEQ ID NO: 204095 - protein, 11 aa, Tick-borne encephalitis virus
VKGPWKYSPIR

SEQ ID NO: 204096 - protein, 11 aa, Tick-borne encephalitis virus
KGPWKYSPIRV

SEQ ID NO: 204097 - protein, 11 aa, Tick-borne encephalitis virus
PIRVTREECPG

SEQ ID NO: 204098 - protein, 11 aa, Tick-borne encephalitis virus
IRVTREECPGT

SEQ ID NO: 204099 - protein, 11 aa, Tick-borne encephalitis virus
RVTREECPGTR

SEQ ID NO: 204100 - protein, 11 aa, Tick-borne encephalitis virus
VTREECPGTRV

SEQ ID NO: 204101 - protein, 11 aa, Tick-borne encephalitis virus
INADCDKRGAS

SEQ ID NO: 204102 - protein, 11 aa, Tick-borne encephalitis virus
NADCDKRGASV

SEQ ID NO: 204103 - protein, 11 aa, Tick-borne encephalitis virus
ADCDKRGASVR

SEQ ID NO: 204104 - protein, 11 aa, Tick-borne encephalitis virus
DCDKRGASVRS

SEQ ID NO: 204105 - protein, 11 aa, Tick-borne encephalitis virus
CDKRGASVRST

SEQ ID NO: 204106 - protein, 11 aa, Tick-borne encephalitis virus
DKRGASVRSTT

SEQ ID NO: 204107 - protein, 11 aa, Tick-borne encephalitis virus
KRGASVRSTTE

SEQ ID NO: 204108 - protein, 11 aa, Tick-borne encephalitis virus
RGASVRSTTES

SEQ ID NO: 204109 - protein, 11 aa, Tick-borne encephalitis virus
GASVRSTTESG

SEQ ID NO: 204110 - protein, 11 aa, Tick-borne encephalitis virus
ASVRSTTESGK

SEQ ID NO: 204111 - protein, 11 aa, Tick-borne encephalitis virus
SVRSTTESGKV

SEQ ID NO: 204112 - protein, 11 aa, Tick-borne encephalitis virus
VRSTTESGKVI

SEQ ID NO: 204113 - protein, 11 aa, Tick-borne encephalitis virus
RSTTESGKVIP

SEQ ID NO: 204114 - protein, 11 aa, Tick-borne encephalitis virus
STTESGKVIPE

SEQ ID NO: 204115 - protein, 11 aa, Tick-borne encephalitis virus
TTESGKVIPEW

SEQ ID NO: 204116 - protein, 11 aa, Tick-borne encephalitis virus
TESGKVIPEWC

SEQ ID NO: 204117 - protein, 11 aa, Tick-borne encephalitis virus
ESGKVIPEWCC

SEQ ID NO: 204118 - protein, 11 aa, Tick-borne encephalitis virus
SGKVIPEWCCR

SEQ ID NO: 204119 - protein, 11 aa, Tick-borne encephalitis virus
GKVIPEWCCRT

SEQ ID NO: 204120 - protein, 11 aa, Tick-borne encephalitis virus
KVIPEWCCRTC

SEQ ID NO: 204121 - protein, 11 aa, Tick-borne encephalitis virus
VIPEWCCRTCT

SEQ ID NO: 204122 - protein, 11 aa, Tick-borne encephalitis virus
IPEWCCRTCTL

SEQ ID NO: 204123 - protein, 11 aa, Tick-borne encephalitis virus
PEWCCRTCTLP

SEQ ID NO: 204124 - protein, 11 aa, Tick-borne encephalitis virus
EWCCRTCTLPP

SEQ ID NO: 204125 - protein, 11 aa, Tick-borne encephalitis virus
WCCRTCTLPPV

SEQ ID NO: 204126 - protein, 11 aa, Tick-borne encephalitis virus
CCRTCTLPPVT

SEQ ID NO: 204127 - protein, 11 aa, Tick-borne encephalitis virus
CRTCTLPPVTF

SEQ ID NO: 204128 - protein, 11 aa, Tick-borne encephalitis virus
RTCTLPPVTFR

SEQ ID NO: 204129 - protein, 11 aa, Tick-borne encephalitis virus
TCTLPPVTFRT

SEQ ID NO: 204130 - protein, 11 aa, Tick-borne encephalitis virus
CTLPPVTFRTG

SEQ ID NO: 204131 - protein, 11 aa, Tick-borne encephalitis virus
TLPPVTFRTGT

SEQ ID NO: 204132 - protein, 11 aa, Tick-borne encephalitis virus
LPPVTFRTGTD

SEQ ID NO: 204133 - protein, 11 aa, Tick-borne encephalitis virus
PPVTFRTGTDC

SEQ ID NO: 204134 - protein, 11 aa, Tick-borne encephalitis virus
PVTFRTGTDCW

SEQ ID NO: 204135 - protein, 11 aa, Tick-borne encephalitis virus
VTFRTGTDCWY

SEQ ID NO: 204136 - protein, 11 aa, Tick-borne encephalitis virus
TFRTGTDCWYA

SEQ ID NO: 204137 - protein, 11 aa, Tick-borne encephalitis virus
FRTGTDCWYAM

SEQ ID NO: 204138 - protein, 11 aa, Tick-borne encephalitis virus
RTGTDCWYAME

SEQ ID NO: 204139 - protein, 11 aa, Tick-borne encephalitis virus
TGTDCWYAMEI

SEQ ID NO: 204140 - protein, 11 aa, Tick-borne encephalitis virus
GTDCWYAMEIR

SEQ ID NO: 204141 - protein, 11 aa, Tick-borne encephalitis virus
TDCWYAMEIRP

SEQ ID NO: 204142 - protein, 11 aa, Tick-borne encephalitis virus
DCWYAMEIRPV

SEQ ID NO: 204143 - protein, 11 aa, Tick-borne encephalitis virus
CWYAMEIRPVH

SEQ ID NO: 204144 - protein, 11 aa, Tick-borne encephalitis virus
WYAMEIRPVHD

SEQ ID NO: 204145 - protein, 11 aa, Tick-borne encephalitis virus
YAMEIRPVHDQ

SEQ ID NO: 204146 - protein, 11 aa, Tick-borne encephalitis virus
AMEIRPVHDQG

SEQ ID NO: 204147 - protein, 11 aa, Tick-borne encephalitis virus
MEIRPVHDQGG

SEQ ID NO: 204148 - protein, 11 aa, Tick-borne encephalitis virus
EIRPVHDQGGL

SEQ ID NO: 204149 - protein, 11 aa, Tick-borne encephalitis virus
IRPVHDQGGLV

SEQ ID NO: 204150 - protein, 11 aa, Tick-borne encephalitis virus
RPVHDQGGLVR

SEQ ID NO: 204151 - protein, 11 aa, Tick-borne encephalitis virus
PVHDQGGLVRS

SEQ ID NO: 204152 - protein, 11 aa, Tick-borne encephalitis virus
VHDQGGLVRSM

SEQ ID NO: 204153 - protein, 11 aa, Tick-borne encephalitis virus
HDQGGLVRSMV

SEQ ID NO: 204154 - protein, 11 aa, Tick-borne encephalitis virus
DQGGLVRSMVV

SEQ ID NO: 204155 - protein, 11 aa, Tick-borne encephalitis virus
QGGLVRSMVVA

SEQ ID NO: 204156 - protein, 11 aa, Tick-borne encephalitis virus
GGLVRSMVVAD

SEQ ID NO: 204157 - protein, 11 aa, Tick-borne encephalitis virus
GLVRSMVVADN

SEQ ID NO: 204158 - protein, 11 aa, Tick-borne encephalitis virus
LVRSMVVADNG

SEQ ID NO: 204159 - protein, 11 aa, Tick-borne encephalitis virus
VRSMVVADNGE

SEQ ID NO: 204160 - protein, 11 aa, Tick-borne encephalitis virus
RSMVVADNGEL

SEQ ID NO: 204161 - protein, 11 aa, Tick-borne encephalitis virus
SMVVADNGELL

SEQ ID NO: 204162 - protein, 11 aa, Tick-borne encephalitis virus
MVVADNGELLS

SEQ ID NO: 204163 - protein, 11 aa, Tick-borne encephalitis virus
VVADNGELLSE

SEQ ID NO: 204164 - protein, 11 aa, Tick-borne encephalitis virus
VADNGELLSEG

SEQ ID NO: 204165 - protein, 11 aa, Tick-borne encephalitis virus
ADNGELLSEGG

SEQ ID NO: 204166 - protein, 11 aa, Tick-borne encephalitis virus
DNGELLSEGGV

SEQ ID NO: 204167 - protein, 11 aa, Tick-borne encephalitis virus
NGELLSEGGVP

SEQ ID NO: 204168 - protein, 11 aa, Tick-borne encephalitis virus
GELLSEGGIPG

SEQ ID NO: 204169 - protein, 11 aa, Tick-borne encephalitis virus
ELLSEGGVPGI

SEQ ID NO: 204170 - protein, 11 aa, Tick-borne encephalitis virus
LLSEGGIPGIV

SEQ ID NO: 204171 - protein, 11 aa, Tick-borne encephalitis virus
LSEGGVPGIVA

SEQ ID NO: 204172 - protein, 11 aa, Tick-borne encephalitis virus
SEGGIPGIVAL

SEQ ID NO: 204173 - protein, 11 aa, Tick-borne encephalitis virus
EGGVPGIVALF

SEQ ID NO: 204174 - protein, 11 aa, Tick-borne encephalitis virus
GGIPGIVALFV

SEQ ID NO: 204175 - protein, 11 aa, Tick-borne encephalitis virus
GIPGIVALFVV

SEQ ID NO: 204176 - protein, 11 aa, Tick-borne encephalitis virus
IPGIVALFVVL

SEQ ID NO: 204177 - protein, 11 aa, Tick-borne encephalitis virus
PGIVALFVVLE

SEQ ID NO: 204178 - protein, 11 aa, Tick-borne encephalitis virus
GIVALFVVLEY

SEQ ID NO: 204179 - protein, 11 aa, Tick-borne encephalitis virus
IVALFVVLEYV

SEQ ID NO: 204180 - protein, 11 aa, Tick-borne encephalitis virus
VALFVVLEYVI

SEQ ID NO: 204181 - protein, 11 aa, Tick-borne encephalitis virus
ALFVVLEYVIR

SEQ ID NO: 204182 - protein, 11 aa, Tick-borne encephalitis virus
LFVVLEYVIRR

SEQ ID NO: 204183 - protein, 11 aa, Tick-borne encephalitis virus
FVVLEYVIRRR

SEQ ID NO: 204184 - protein, 11 aa, Tick-borne encephalitis virus
VVLEYVIRRRP

SEQ ID NO: 204185 - protein, 11 aa, Tick-borne encephalitis virus
VLEYVIRRRPA

SEQ ID NO: 204186 - protein, 11 aa, Tick-borne encephalitis virus
LEYVIRRRPAT

SEQ ID NO: 204187 - protein, 11 aa, Tick-borne encephalitis virus
EYVIRRRPATG

SEQ ID NO: 204188 - protein, 11 aa, Tick-borne encephalitis virus
YVIRRRPATGT

SEQ ID NO: 204189 - protein, 11 aa, Tick-borne encephalitis virus
VIRRRPATGTT

SEQ ID NO: 204190 - protein, 11 aa, Tick-borne encephalitis virus
IRRRPATGTTA

SEQ ID NO: 204191 - protein, 11 aa, Tick-borne encephalitis virus
RRRPATGTTAM

SEQ ID NO: 204192 - protein, 11 aa, Tick-borne encephalitis virus
RRPATGTTAMW

SEQ ID NO: 204193 - protein, 11 aa, Tick-borne encephalitis virus
RPATGTTAMWG

SEQ ID NO: 204194 - protein, 11 aa, Tick-borne encephalitis virus
PATGTTAMWGG

SEQ ID NO: 204195 - protein, 11 aa, Tick-borne encephalitis virus
WGGIVVLALLV

SEQ ID NO: 204196 - protein, 11 aa, Tick-borne encephalitis virus
GGIVVLALLVT

SEQ ID NO: 204197 - protein, 11 aa, Tick-borne encephalitis virus
GIVVLALLVTG

SEQ ID NO: 204198 - protein, 11 aa, Tick-borne encephalitis virus
VVLALLVTGLV

SEQ ID NO: 204199 - protein, 11 aa, Tick-borne encephalitis virus
VLALLVTGLVR

SEQ ID NO: 204200 - protein, 11 aa, Tick-borne encephalitis virus
VRIESLVRYVV

SEQ ID NO: 204201 - protein, 11 aa, Tick-borne encephalitis virus
RIESLVRYVVA

SEQ ID NO: 204202 - protein, 11 aa, Tick-borne encephalitis virus
IESLVRYVVAV

SEQ ID NO: 204203 - protein, 11 aa, Tick-borne encephalitis virus
ESLVRYVVAVG

SEQ ID NO: 204204 - protein, 11 aa, Tick-borne encephalitis virus
SLVRYVVAVGI

SEQ ID NO: 204205 - protein, 11 aa, Tick-borne encephalitis virus
LVRYVVAVGIT

SEQ ID NO: 204206 - protein, 11 aa, Tick-borne encephalitis virus
VRYVVAVGITF

SEQ ID NO: 204207 - protein, 11 aa, Tick-borne encephalitis virus
RYVVAVGITFH

SEQ ID NO: 204208 - protein, 11 aa, Tick-borne encephalitis virus
YVVAVGITFHL

SEQ ID NO: 204209 - protein, 11 aa, Tick-borne encephalitis virus
VVAVGITFHLE

SEQ ID NO: 204210 - protein, 11 aa, Tick-borne encephalitis virus
VAVGITFHLEL

SEQ ID NO: 204211 - protein, 11 aa, Tick-borne encephalitis virus
AVGITFHLELG

SEQ ID NO: 204212 - protein, 11 aa, Tick-borne encephalitis virus
VGITFHLELGP

SEQ ID NO: 204213 - protein, 11 aa, Tick-borne encephalitis virus
GITFHLELGPE

SEQ ID NO: 204214 - protein, 11 aa, Tick-borne encephalitis virus
ITFHLELGPEI

SEQ ID NO: 204215 - protein, 11 aa, Tick-borne encephalitis virus
TFHLELGPEIV

SEQ ID NO: 204216 - protein, 11 aa, Tick-borne encephalitis virus
FHLELGPEIVA

SEQ ID NO: 204217 - protein, 11 aa, Tick-borne encephalitis virus
HLELGPEIVAL

SEQ ID NO: 204218 - protein, 11 aa, Tick-borne encephalitis virus
LELGPEIVALT

SEQ ID NO: 204219 - protein, 11 aa, Tick-borne encephalitis virus
ELGPEIVALTL

SEQ ID NO: 204220 - protein, 11 aa, Tick-borne encephalitis virus
LGPEIVALTLL

SEQ ID NO: 204221 - protein, 11 aa, Tick-borne encephalitis virus
GPEIVALTLLQ

SEQ ID NO: 204222 - protein, 11 aa, Tick-borne encephalitis virus
PEIVALTLLQA

SEQ ID NO: 204223 - protein, 11 aa, Tick-borne encephalitis virus
EIVALTLLQAV

SEQ ID NO: 204224 - protein, 11 aa, Tick-borne encephalitis virus
IVALTLLQAVF

SEQ ID NO: 204225 - protein, 11 aa, Tick-borne encephalitis virus
VALTLLQAVFE

SEQ ID NO: 204226 - protein, 11 aa, Tick-borne encephalitis virus
ALTLLQAVFEL

SEQ ID NO: 204227 - protein, 11 aa, Tick-borne encephalitis virus
LTLLQAVFELR

SEQ ID NO: 204228 - protein, 11 aa, Tick-borne encephalitis virus
TLLQAVFELRV

SEQ ID NO: 204229 - protein, 11 aa, Tick-borne encephalitis virus
LLQAVFELRVG

SEQ ID NO: 204230 - protein, 11 aa, Tick-borne encephalitis virus
LQAVFELRVGL

SEQ ID NO: 204231 - protein, 11 aa, Tick-borne encephalitis virus
QAVFELRVGLL

SEQ ID NO: 204232 - protein, 11 aa, Tick-borne encephalitis virus
AVFELRVGLLS

SEQ ID NO: 204233 - protein, 11 aa, Tick-borne encephalitis virus
VFELRVGLLSA

SEQ ID NO: 204234 - protein, 11 aa, Tick-borne encephalitis virus
FELRVGLLSAF

SEQ ID NO: 204235 - protein, 11 aa, Tick-borne encephalitis virus
ELRVGLLSAFA

SEQ ID NO: 204236 - protein, 11 aa, Tick-borne encephalitis virus
LRVGLLSAFAL

SEQ ID NO: 204237 - protein, 11 aa, Tick-borne encephalitis virus
RVGLLSAFALR

SEQ ID NO: 204238 - protein, 11 aa, Tick-borne encephalitis virus
VGLLSAFALRS

SEQ ID NO: 204239 - protein, 11 aa, Tick-borne encephalitis virus
GLLSAFALRSN

SEQ ID NO: 204240 - protein, 11 aa, Tick-borne encephalitis virus
LLSAFALRSNL

SEQ ID NO: 204241 - protein, 11 aa, Tick-borne encephalitis virus
LSAFALRSNLT

SEQ ID NO: 204242 - protein, 11 aa, Tick-borne encephalitis virus
SAFALRSNLTV

SEQ ID NO: 204243 - protein, 11 aa, Tick-borne encephalitis virus
AFALRSNLTVR

SEQ ID NO: 204244 - protein, 11 aa, Tick-borne encephalitis virus
FALRSNLTVRE

SEQ ID NO: 204245 - protein, 11 aa, Tick-borne encephalitis virus
ALRSNLTVREM

SEQ ID NO: 204246 - protein, 11 aa, Tick-borne encephalitis virus
LRSNLTVREMV

SEQ ID NO: 204247 - protein, 11 aa, Tick-borne encephalitis virus
RSNLTVREMVT

SEQ ID NO: 204248 - protein, 11 aa, Tick-borne encephalitis virus
NLTVREMVTIY

SEQ ID NO: 204249 - protein, 11 aa, Tick-borne encephalitis virus
LTVREMVTIYF

SEQ ID NO: 204250 - protein, 11 aa, Tick-borne encephalitis virus
TVREMVTIYFL

SEQ ID NO: 204251 - protein, 11 aa, Tick-borne encephalitis virus
VREMVTIYFLL

SEQ ID NO: 204252 - protein, 11 aa, Tick-borne encephalitis virus
REMVTIYFLLL

SEQ ID NO: 204253 - protein, 11 aa, Tick-borne encephalitis virus
EMVTIYFLLLV

SEQ ID NO: 204254 - protein, 11 aa, Tick-borne encephalitis virus
MVTIYFLLLVL

SEQ ID NO: 204255 - protein, 11 aa, Tick-borne encephalitis virus
VTIYFLLLVLE

SEQ ID NO: 204256 - protein, 11 aa, Tick-borne encephalitis virus
TIYFLLLVLEL

SEQ ID NO: 204257 - protein, 11 aa, Tick-borne encephalitis virus
IYFLLLVLELG

SEQ ID NO: 204258 - protein, 11 aa, Tick-borne encephalitis virus
YFLLLVLELGL

SEQ ID NO: 204259 - protein, 11 aa, Tick-borne encephalitis virus
FLLLVLELGLP

SEQ ID NO: 204260 - protein, 11 aa, Tick-borne encephalitis virus
LLLVLELGLPS

SEQ ID NO: 204261 - protein, 11 aa, Tick-borne encephalitis virus
LWKWGDALAMG

SEQ ID NO: 204262 - protein, 11 aa, Tick-borne encephalitis virus
WKWGDALAMGA

SEQ ID NO: 204263 - protein, 11 aa, Tick-borne encephalitis virus
KWGDALAMGAL

SEQ ID NO: 204264 - protein, 11 aa, Tick-borne encephalitis virus
WGDALAMGALI

SEQ ID NO: 204265 - protein, 11 aa, Tick-borne encephalitis virus
GDALAMGALIF

SEQ ID NO: 204266 - protein, 11 aa, Tick-borne encephalitis virus
DALAMGALIFR

SEQ ID NO: 204267 - protein, 11 aa, Tick-borne encephalitis virus
ALAMGALIFRA

SEQ ID NO: 204268 - protein, 11 aa, Tick-borne encephalitis virus
LAMGALIFRAC

SEQ ID NO: 204269 - protein, 11 aa, Tick-borne encephalitis virus
AMGALIFRACT

SEQ ID NO: 204270 - protein, 11 aa, Tick-borne encephalitis virus
MGALIFRACTA

SEQ ID NO: 204271 - protein, 11 aa, Tick-borne encephalitis virus
GALIFRACTAE

SEQ ID NO: 204272 - protein, 11 aa, Tick-borne encephalitis virus
ALIFRACTAEG

SEQ ID NO: 204273 - protein, 11 aa, Tick-borne encephalitis virus
LIFRACTAEGK

SEQ ID NO: 204274 - protein, 11 aa, Tick-borne encephalitis virus
IFRACTAEEKT

SEQ ID NO: 204275 - protein, 11 aa, Tick-borne encephalitis virus
FRACTAEEKTG

SEQ ID NO: 204276 - protein, 11 aa, Tick-borne encephalitis virus
RACTAEEKTGV

SEQ ID NO: 204277 - protein, 11 aa, Tick-borne encephalitis virus
ACTAEEKTGVG

SEQ ID NO: 204278 - protein, 11 aa, Tick-borne encephalitis virus
CTAEEKTGVGL

SEQ ID NO: 204279 - protein, 11 aa, Tick-borne encephalitis virus
TAEEKTGVGLL

SEQ ID NO: 204280 - protein, 11 aa, Tick-borne encephalitis virus
AEEKTGVGLLL

SEQ ID NO: 204281 - protein, 11 aa, Tick-borne encephalitis virus
EEKTGVGLLLM

SEQ ID NO: 204282 - protein, 11 aa, Tick-borne encephalitis virus
EKTGVGLLLMA

SEQ ID NO: 204283 - protein, 11 aa, Tick-borne encephalitis virus
KTGVGLLLMAL

SEQ ID NO: 204284 - protein, 11 aa, Tick-borne encephalitis virus
TGVGLLLMALM

SEQ ID NO: 204285 - protein, 11 aa, Tick-borne encephalitis virus
GVGLLLMALMT

SEQ ID NO: 204286 - protein, 11 aa, Tick-borne encephalitis virus
VGLLLMALMTQ

SEQ ID NO: 204287 - protein, 11 aa, Tick-borne encephalitis virus
GLLLMALMTQQ

SEQ ID NO: 204288 - protein, 11 aa, Tick-borne encephalitis virus
LLLMALMTQQD

SEQ ID NO: 204289 - protein, 11 aa, Tick-borne encephalitis virus
WKLIRGHREQK

SEQ ID NO: 204290 - protein, 11 aa, Tick-borne encephalitis virus
KLIRGHREQKG

SEQ ID NO: 204291 - protein, 11 aa, Tick-borne encephalitis virus
LIRGHREQKGL

SEQ ID NO: 204292 - protein, 11 aa, Tick-borne encephalitis virus
IRGHREQKGLT

SEQ ID NO: 204293 - protein, 11 aa, Tick-borne encephalitis virus
RGHREQKGLTW

SEQ ID NO: 204294 - protein, 11 aa, Tick-borne encephalitis virus
GHREQKGLTWI

SEQ ID NO: 204295 - protein, 11 aa, Tick-borne encephalitis virus
HREQKGLTWIV

SEQ ID NO: 204296 - protein, 11 aa, Tick-borne encephalitis virus
REQKGLTWIVP

SEQ ID NO: 204297 - protein, 11 aa, Tick-borne encephalitis virus
EQKGLTWIVPL

SEQ ID NO: 204298 - protein, 11 aa, Tick-borne encephalitis virus
QKGLTWIVPLA

SEQ ID NO: 204299 - protein, 11 aa, Tick-borne encephalitis virus
VPLAGLLGGEG

SEQ ID NO: 204300 - protein, 11 aa, Tick-borne encephalitis virus
PLAGLLGGEGS

SEQ ID NO: 204301 - protein, 11 aa, Tick-borne encephalitis virus
LAGLLGGEGSG

SEQ ID NO: 204302 - protein, 11 aa, Tick-borne encephalitis virus
AGLLGGEGSGV

SEQ ID NO: 204303 - protein, 11 aa, Tick-borne encephalitis virus
GLLGGEGSGVR

SEQ ID NO: 204304 - protein, 11 aa, Tick-borne encephalitis virus
LLGGEGSGVRL

SEQ ID NO: 204305 - protein, 11 aa, Tick-borne encephalitis virus
LGGEGSGVRLL

SEQ ID NO: 204306 - protein, 11 aa, Tick-borne encephalitis virus
GGEGSGVRLLA

SEQ ID NO: 204307 - protein, 11 aa, Tick-borne encephalitis virus
GEGSGVRLLAF

SEQ ID NO: 204308 - protein, 11 aa, Tick-borne encephalitis virus
EGSGVRLLAFW

SEQ ID NO: 204309 - protein, 11 aa, Tick-borne encephalitis virus
GSGVRLLAFWE

SEQ ID NO: 204310 - protein, 11 aa, Tick-borne encephalitis virus
SGVRLLAFWEL

SEQ ID NO: 204311 - protein, 11 aa, Tick-borne encephalitis virus
GVRLLAFWELA

SEQ ID NO: 204312 - protein, 11 aa, Tick-borne encephalitis virus
HRGRRSFSEPL

SEQ ID NO: 204313 - protein, 11 aa, Tick-borne encephalitis virus
RGRRSFSEPLT

SEQ ID NO: 204314 - protein, 11 aa, Tick-borne encephalitis virus
RRRSFSEPLTV

SEQ ID NO: 204315 - protein, 11 aa, Tick-borne encephalitis virus
RRSFSEPLTVV

SEQ ID NO: 204316 - protein, 11 aa, Tick-borne encephalitis virus
RSFSEPLTVVG

SEQ ID NO: 204317 - protein, 11 aa, Tick-borne encephalitis virus
SFSEPLTVVGV

SEQ ID NO: 204318 - protein, 11 aa, Tick-borne encephalitis virus
FSEPLTVVGVM

SEQ ID NO: 204319 - protein, 11 aa, Tick-borne encephalitis virus
SEPLTVVGVML

SEQ ID NO: 204320 - protein, 11 aa, Tick-borne encephalitis virus
EPLTVVGVMLT

SEQ ID NO: 204321 - protein, 11 aa, Tick-borne encephalitis virus
PLTVVGVMLTL

SEQ ID NO: 204322 - protein, 11 aa, Tick-borne encephalitis virus
LTVVGVMLTLA

SEQ ID NO: 204323 - protein, 11 aa, Tick-borne encephalitis virus
TVVGVMLTLAS

SEQ ID NO: 204324 - protein, 11 aa, Tick-borne encephalitis virus
VVGVMLTLASG

SEQ ID NO: 204325 - protein, 11 aa, Tick-borne encephalitis virus
VGVMLTLASGM

SEQ ID NO: 204326 - protein, 11 aa, Tick-borne encephalitis virus
GVMLTLASGMM

SEQ ID NO: 204327 - protein, 11 aa, Tick-borne encephalitis virus
VMLTLASGMMR

SEQ ID NO: 204328 - protein, 11 aa, Tick-borne encephalitis virus
MLTLASGMMRH

SEQ ID NO: 204329 - protein, 11 aa, Tick-borne encephalitis virus
LTLASGMMRHT

SEQ ID NO: 204330 - protein, 11 aa, Tick-borne encephalitis virus
TLASGMMRHTS

SEQ ID NO: 204331 - protein, 11 aa, Tick-borne encephalitis virus
LASGMMRHTSQ

SEQ ID NO: 204332 - protein, 11 aa, Tick-borne encephalitis virus
ASGMMRHTSQE

SEQ ID NO: 204333 - protein, 11 aa, Tick-borne encephalitis virus
SGMMRHTSQEA

SEQ ID NO: 204334 - protein, 11 aa, Tick-borne encephalitis virus
GMMRHTSQEAL

SEQ ID NO: 204335 - protein, 11 aa, Tick-borne encephalitis virus
MMRHTSQEALC

SEQ ID NO: 204336 - protein, 11 aa, Tick-borne encephalitis virus
MRHTSQEALCA

SEQ ID NO: 204337 - protein, 11 aa, Tick-borne encephalitis virus
RHTSQEALCAL

SEQ ID NO: 204338 - protein, 11 aa, Tick-borne encephalitis virus
HTSQEALCALA

SEQ ID NO: 204339 - protein, 11 aa, Tick-borne encephalitis virus
TSQEALCALAV

SEQ ID NO: 204340 - protein, 11 aa, Tick-borne encephalitis virus
SQEALCALAVA

SEQ ID NO: 204341 - protein, 11 aa, Tick-borne encephalitis virus
QEALCALAVAS

SEQ ID NO: 204342 - protein, 11 aa, Tick-borne encephalitis virus
EALCALAVASF

SEQ ID NO: 204343 - protein, 11 aa, Tick-borne encephalitis virus
ALCALAVASFL

SEQ ID NO: 204344 - protein, 11 aa, Tick-borne encephalitis virus
LCALAVASFLL

SEQ ID NO: 204345 - protein, 11 aa, Tick-borne encephalitis virus
CALAVASFLLL

SEQ ID NO: 204346 - protein, 11 aa, Tick-borne encephalitis virus
ALAVASFLLLM

SEQ ID NO: 204347 - protein, 11 aa, Tick-borne encephalitis virus
LAVASFLLLML

SEQ ID NO: 204348 - protein, 11 aa, Tick-borne encephalitis virus
AVASFLLLMLV

SEQ ID NO: 204349 - protein, 11 aa, Tick-borne encephalitis virus
VASFLLLMLVL

SEQ ID NO: 204350 - protein, 11 aa, Tick-borne encephalitis virus
ASFLLLMLVLG

SEQ ID NO: 204351 - protein, 11 aa, Tick-borne encephalitis virus
SFLLLMLVLGT

SEQ ID NO: 204352 - protein, 11 aa, Tick-borne encephalitis virus
FLLLMLVLGTR

SEQ ID NO: 204353 - protein, 11 aa, Tick-borne encephalitis virus
LLLMLVLGTRK

SEQ ID NO: 204354 - protein, 11 aa, Tick-borne encephalitis virus
LLMLVLGTRKM

SEQ ID NO: 204355 - protein, 11 aa, Tick-borne encephalitis virus
LMLVLGTRKMQ

SEQ ID NO: 204356 - protein, 11 aa, Tick-borne encephalitis virus
MLVLGTRKMQL

SEQ ID NO: 204357 - protein, 11 aa, Tick-borne encephalitis virus
LVLGTRKMQLV

SEQ ID NO: 204358 - protein, 11 aa, Tick-borne encephalitis virus
VLGTRKMQLVA

SEQ ID NO: 204359 - protein, 11 aa, Tick-borne encephalitis virus
LGTRKMQLVAE

SEQ ID NO: 204360 - protein, 11 aa, Tick-borne encephalitis virus
GTRKMQLVAEW

SEQ ID NO: 204361 - protein, 11 aa, Tick-borne encephalitis virus
TRKMQLVAEWS

SEQ ID NO: 204362 - protein, 11 aa, Tick-borne encephalitis virus
RKMQLVAEWSG

SEQ ID NO: 204363 - protein, 11 aa, Tick-borne encephalitis virus
KMQLVAEWSGC

SEQ ID NO: 204364 - protein, 11 aa, Tick-borne encephalitis virus
MQLVAEWSGCV

SEQ ID NO: 204365 - protein, 11 aa, Tick-borne encephalitis virus
QLVAEWSGCVE

SEQ ID NO: 204366 - protein, 11 aa, Tick-borne encephalitis virus
LVAEWSGCVEW

SEQ ID NO: 204367 - protein, 11 aa, Tick-borne encephalitis virus
VAEWSGCVEWH

SEQ ID NO: 204368 - protein, 11 aa, Tick-borne encephalitis virus
AEWSGCVEWHP

SEQ ID NO: 204369 - protein, 11 aa, Tick-borne encephalitis virus
EWSGCVEWHPE

SEQ ID NO: 204370 - protein, 11 aa, Tick-borne encephalitis virus
WSGCVEWHPEL

SEQ ID NO: 204371 - protein, 11 aa, Tick-borne encephalitis virus
SGCVEWHPELM

SEQ ID NO: 204372 - protein, 11 aa, Tick-borne encephalitis virus
GCVEWHPELMN

SEQ ID NO: 204373 - protein, 11 aa, Tick-borne encephalitis virus
CVEWHPELMNE

SEQ ID NO: 204374 - protein, 11 aa, Tick-borne encephalitis virus
VEWHPELMNEG

SEQ ID NO: 204375 - protein, 11 aa, Tick-borne encephalitis virus
EWHPELMNEGG

SEQ ID NO: 204376 - protein, 11 aa, Tick-borne encephalitis virus
WHPELMNEGGE

SEQ ID NO: 204377 - protein, 11 aa, Tick-borne encephalitis virus
HPELMNEGGEV

SEQ ID NO: 204378 - protein, 11 aa, Tick-borne encephalitis virus
PELMNEGGEVS

SEQ ID NO: 204379 - protein, 11 aa, Tick-borne encephalitis virus
ELMNEGGEVSL

SEQ ID NO: 204380 - protein, 11 aa, Tick-borne encephalitis virus
LMNEGGEVSLR

SEQ ID NO: 204381 - protein, 11 aa, Tick-borne encephalitis virus
MNEGGEVSLRV

SEQ ID NO: 204382 - protein, 11 aa, Tick-borne encephalitis virus
NEGGEVSLRVR

SEQ ID NO: 204383 - protein, 11 aa, Tick-borne encephalitis virus
EGGEVSLRVRQ

SEQ ID NO: 204384 - protein, 11 aa, Tick-borne encephalitis virus
GGEVSLRVRQD

SEQ ID NO: 204385 - protein, 11 aa, Tick-borne encephalitis virus
GEVSLRVRQDS

SEQ ID NO: 204386 - protein, 11 aa, Tick-borne encephalitis virus
EVSLRVRQDSM

SEQ ID NO: 204387 - protein, 11 aa, Tick-borne encephalitis virus
VSLRVRQDSMG

SEQ ID NO: 204388 - protein, 11 aa, Tick-borne encephalitis virus
SLRVRQDSMGN

SEQ ID NO: 204389 - protein, 11 aa, Tick-borne encephalitis virus
LRVRQDSMGNF

SEQ ID NO: 204390 - protein, 11 aa, Tick-borne encephalitis virus
RVRQDSMGNFH

SEQ ID NO: 204391 - protein, 11 aa, Tick-borne encephalitis virus
VRQDSMGNFHL

SEQ ID NO: 204392 - protein, 11 aa, Tick-borne encephalitis virus
RQDSMGNFHLT

SEQ ID NO: 204393 - protein, 11 aa, Tick-borne encephalitis virus
QDSMGNFHLTE

SEQ ID NO: 204394 - protein, 11 aa, Tick-borne encephalitis virus
DSMGNFHLTEL

SEQ ID NO: 204395 - protein, 11 aa, Tick-borne encephalitis virus
SMGNFHLTELE

SEQ ID NO: 204396 - protein, 11 aa, Tick-borne encephalitis virus
MGNFHLTELEK

SEQ ID NO: 204397 - protein, 11 aa, Tick-borne encephalitis virus
GNFHLTELEKE

SEQ ID NO: 204398 - protein, 11 aa, Tick-borne encephalitis virus
NFHLTELEKEE

SEQ ID NO: 204399 - protein, 11 aa, Tick-borne encephalitis virus
FHLTELEKEER

SEQ ID NO: 204400 - protein, 11 aa, Tick-borne encephalitis virus
HLTELEKEERV

SEQ ID NO: 204401 - protein, 11 aa, Tick-borne encephalitis virus
LTELEKEERVM

SEQ ID NO: 204402 - protein, 11 aa, Tick-borne encephalitis virus
TELEKEERVMA

SEQ ID NO: 204403 - protein, 11 aa, Tick-borne encephalitis virus
ELEKEERVMAF

SEQ ID NO: 204404 - protein, 11 aa, Tick-borne encephalitis virus
LEKEERVMAFW

SEQ ID NO: 204405 - protein, 11 aa, Tick-borne encephalitis virus
EKEERVMAFWL

SEQ ID NO: 204406 - protein, 11 aa, Tick-borne encephalitis virus
KEERVMAFWLL

SEQ ID NO: 204407 - protein, 11 aa, Tick-borne encephalitis virus
EERVMAFWLLA

SEQ ID NO: 204408 - protein, 11 aa, Tick-borne encephalitis virus
ERVMAFWLLAG

SEQ ID NO: 204409 - protein, 11 aa, Tick-borne encephalitis virus
RVMAFWLLAGL

SEQ ID NO: 204410 - protein, 11 aa, Tick-borne encephalitis virus
VMAFWLLAGLA

SEQ ID NO: 204411 - protein, 11 aa, Tick-borne encephalitis virus
MAFWLLAGLAA

SEQ ID NO: 204412 - protein, 11 aa, Tick-borne encephalitis virus
AFWLLAGLAAS

SEQ ID NO: 204413 - protein, 11 aa, Tick-borne encephalitis virus
FWLLAGLAASA

SEQ ID NO: 204414 - protein, 11 aa, Tick-borne encephalitis virus
AGLAASAFHWS

SEQ ID NO: 204415 - protein, 11 aa, Tick-borne encephalitis virus
GLAASAFHWSG

SEQ ID NO: 204416 - protein, 11 aa, Tick-borne encephalitis virus
LAASAFHWSGI

SEQ ID NO: 204417 - protein, 11 aa, Tick-borne encephalitis virus
ASAFHWSGILG

SEQ ID NO: 204418 - protein, 11 aa, Tick-borne encephalitis virus
SAFHWSGILGV

SEQ ID NO: 204419 - protein, 11 aa, Tick-borne encephalitis virus
AFHWSGILGVM

SEQ ID NO: 204420 - protein, 11 aa, Tick-borne encephalitis virus
FHWSGILGVMG

SEQ ID NO: 204421 - protein, 11 aa, Tick-borne encephalitis virus
HWSGILGVMGL

SEQ ID NO: 204422 - protein, 11 aa, Tick-borne encephalitis virus
WSGILGVMGLW

SEQ ID NO: 204423 - protein, 11 aa, Tick-borne encephalitis virus
SGILGVMGLWT

SEQ ID NO: 204424 - protein, 11 aa, Tick-borne encephalitis virus
GILGVMGLWTL

SEQ ID NO: 204425 - protein, 11 aa, Tick-borne encephalitis virus
ILGVMGLWTLS

SEQ ID NO: 204426 - protein, 11 aa, Tick-borne encephalitis virus
LGVMGLWTLSE

SEQ ID NO: 204427 - protein, 11 aa, Tick-borne encephalitis virus
GVMGLWTLSEM

SEQ ID NO: 204428 - protein, 11 aa, Tick-borne encephalitis virus
VMGLWTLSEML

SEQ ID NO: 204429 - protein, 11 aa, Tick-borne encephalitis virus
MGLWTLSEMLR

SEQ ID NO: 204430 - protein, 11 aa, Tick-borne encephalitis virus
ARRSDLVFSGQ

SEQ ID NO: 204431 - protein, 11 aa, Tick-borne encephalitis virus
RRSDLVFSGQG

SEQ ID NO: 204432 - protein, 11 aa, Tick-borne encephalitis virus
RSDLVFSGQGG

SEQ ID NO: 204433 - protein, 11 aa, Tick-borne encephalitis virus
SDLVFSGQGGR

SEQ ID NO: 204434 - protein, 11 aa, Tick-borne encephalitis virus
DLVFSGQGGRE

SEQ ID NO: 204435 - protein, 11 aa, Tick-borne encephalitis virus
LVFSGQGGRER

SEQ ID NO: 204436 - protein, 11 aa, Tick-borne encephalitis virus
VFSGQGGRERG

SEQ ID NO: 204437 - protein, 11 aa, Tick-borne encephalitis virus
FSGQGGRERGD

SEQ ID NO: 204438 - protein, 11 aa, Tick-borne encephalitis virus
SGQGGRERGDR

SEQ ID NO: 204439 - protein, 11 aa, Tick-borne encephalitis virus
GQGGRERGDRP

SEQ ID NO: 204440 - protein, 11 aa, Tick-borne encephalitis virus
QGGRERGDRPF

SEQ ID NO: 204441 - protein, 11 aa, Tick-borne encephalitis virus
GGRERGDRPFE

SEQ ID NO: 204442 - protein, 11 aa, Tick-borne encephalitis virus
GRERGDRPFEV

SEQ ID NO: 204443 - protein, 11 aa, Tick-borne encephalitis virus
RERGDRPFEVK

SEQ ID NO: 204444 - protein, 11 aa, Tick-borne encephalitis virus
ERGDRPFEVKD

SEQ ID NO: 204445 - protein, 11 aa, Tick-borne encephalitis virus
RGDRPFEVKDG

SEQ ID NO: 204446 - protein, 11 aa, Tick-borne encephalitis virus
GDRPFEVKDGV

SEQ ID NO: 204447 - protein, 11 aa, Tick-borne encephalitis virus
DRPFEVKDGVY

SEQ ID NO: 204448 - protein, 11 aa, Tick-borne encephalitis virus
RPFEVKDGVYR

SEQ ID NO: 204449 - protein, 11 aa, Tick-borne encephalitis virus
PFEVKDGVYRI

SEQ ID NO: 204450 - protein, 11 aa, Tick-borne encephalitis virus
FEVKDGVYRIF

SEQ ID NO: 204451 - protein, 11 aa, Tick-borne encephalitis virus
EVKDGVYRIFS

SEQ ID NO: 204452 - protein, 11 aa, Tick-borne encephalitis virus
VKDGVYRIFSP

SEQ ID NO: 204453 - protein, 11 aa, Tick-borne encephalitis virus
KDGVYRIFSPG

SEQ ID NO: 204454 - protein, 11 aa, Tick-borne encephalitis virus
DGVYRIFSPGL

SEQ ID NO: 204455 - protein, 11 aa, Tick-borne encephalitis virus
GVYRIFSPGLL

SEQ ID NO: 204456 - protein, 11 aa, Tick-borne encephalitis virus
VYRIFSPGLLW

SEQ ID NO: 204457 - protein, 11 aa, Tick-borne encephalitis virus
YRIFSPGLLWG

SEQ ID NO: 204458 - protein, 11 aa, Tick-borne encephalitis virus
RIFSPGLLWGQ

SEQ ID NO: 204459 - protein, 11 aa, Tick-borne encephalitis virus
IFSPGLLWGQR

SEQ ID NO: 204460 - protein, 11 aa, Tick-borne encephalitis virus
FSPGLLWGQRQ

SEQ ID NO: 204461 - protein, 11 aa, Tick-borne encephalitis virus
SPGLLWGQRQV

SEQ ID NO: 204462 - protein, 11 aa, Tick-borne encephalitis virus
PGLLWGQRQVG

SEQ ID NO: 204463 - protein, 11 aa, Tick-borne encephalitis virus
GLLWGQRQVGV

SEQ ID NO: 204464 - protein, 11 aa, Tick-borne encephalitis virus
LLWGQRQVGVG

SEQ ID NO: 204465 - protein, 11 aa, Tick-borne encephalitis virus
LWGQRQVGVGY

SEQ ID NO: 204466 - protein, 11 aa, Tick-borne encephalitis virus
WGQRQVGVGYG

SEQ ID NO: 204467 - protein, 11 aa, Tick-borne encephalitis virus
GQRQVGVGYGF

SEQ ID NO: 204468 - protein, 11 aa, Tick-borne encephalitis virus
QRQVGVGYGFK

SEQ ID NO: 204469 - protein, 11 aa, Tick-borne encephalitis virus
RQVGVGYGFKG

SEQ ID NO: 204470 - protein, 11 aa, Tick-borne encephalitis virus
QVGVGYGSKGV

SEQ ID NO: 204471 - protein, 11 aa, Tick-borne encephalitis virus
VGVGYGSKGVL

SEQ ID NO: 204472 - protein, 11 aa, Tick-borne encephalitis virus
GVGYGSKGVLH

SEQ ID NO: 204473 - protein, 11 aa, Tick-borne encephalitis virus
VGYGSKGVLHT

SEQ ID NO: 204474 - protein, 11 aa, Tick-borne encephalitis virus
GYGSKGVLHTM

SEQ ID NO: 204475 - protein, 11 aa, Tick-borne encephalitis virus
YGSKGVLHTMW

SEQ ID NO: 204476 - protein, 11 aa, Tick-borne encephalitis virus
GSKGVLHTMWH

SEQ ID NO: 204477 - protein, 11 aa, Tick-borne encephalitis virus
SKGVLHTMWHV

SEQ ID NO: 204478 - protein, 11 aa, Tick-borne encephalitis virus
KGVLHTMWHVT

SEQ ID NO: 204479 - protein, 11 aa, Tick-borne encephalitis virus
GVLHTMWHVTR

SEQ ID NO: 204480 - protein, 11 aa, Tick-borne encephalitis virus
VLHTMWHVTRG

SEQ ID NO: 204481 - protein, 11 aa, Tick-borne encephalitis virus
LHTMWHVTRGA

SEQ ID NO: 204482 - protein, 11 aa, Tick-borne encephalitis virus
HTMWHVTRGAA

SEQ ID NO: 204483 - protein, 11 aa, Tick-borne encephalitis virus
TMWHVTRGAAL

SEQ ID NO: 204484 - protein, 11 aa, Tick-borne encephalitis virus
MWHVTRGAALS

SEQ ID NO: 204485 - protein, 11 aa, Tick-borne encephalitis virus
WHVTRGAALSI

SEQ ID NO: 204486 - protein, 11 aa, Tick-borne encephalitis virus
HVTRGAALSID

SEQ ID NO: 204487 - protein, 11 aa, Tick-borne encephalitis virus
VTRGAALSIDD

SEQ ID NO: 204488 - protein, 11 aa, Tick-borne encephalitis virus
TRGAALSIDDA

SEQ ID NO: 204489 - protein, 11 aa, Tick-borne encephalitis virus
RGAALSIDDAV

SEQ ID NO: 204490 - protein, 11 aa, Tick-borne encephalitis virus
GAALSIDDAVA

SEQ ID NO: 204491 - protein, 11 aa, Tick-borne encephalitis virus
AALSIDDAVAG

SEQ ID NO: 204492 - protein, 11 aa, Tick-borne encephalitis virus
ALSIDDAVAGP

SEQ ID NO: 204493 - protein, 11 aa, Tick-borne encephalitis virus
LSIDDAVAGPY

SEQ ID NO: 204494 - protein, 11 aa, Tick-borne encephalitis virus
SIDDAVAGPYW

SEQ ID NO: 204495 - protein, 11 aa, Tick-borne encephalitis virus
IDDAVAGPYWA

SEQ ID NO: 204496 - protein, 11 aa, Tick-borne encephalitis virus
DDAVAGPYWAD

SEQ ID NO: 204497 - protein, 11 aa, Tick-borne encephalitis virus
DAVAGPYWADV

SEQ ID NO: 204498 - protein, 11 aa, Tick-borne encephalitis virus
AVAGPYWADVK

SEQ ID NO: 204499 - protein, 11 aa, Tick-borne encephalitis virus
VAGPYWADVKE

SEQ ID NO: 204500 - protein, 11 aa, Tick-borne encephalitis virus
AGPYWADVKED

SEQ ID NO: 204501 - protein, 11 aa, Tick-borne encephalitis virus
GPYWADVKEDV

SEQ ID NO: 204502 - protein, 11 aa, Tick-borne encephalitis virus
PYWADVKEDVV

SEQ ID NO: 204503 - protein, 11 aa, Tick-borne encephalitis virus
YWADVKEDVVC

SEQ ID NO: 204504 - protein, 11 aa, Tick-borne encephalitis virus
WADVKEDVVCY

SEQ ID NO: 204505 - protein, 11 aa, Tick-borne encephalitis virus
ADVKEDVVCYG

SEQ ID NO: 204506 - protein, 11 aa, Tick-borne encephalitis virus
DVKEDVVCYGG

SEQ ID NO: 204507 - protein, 11 aa, Tick-borne encephalitis virus
VKEDVVCYGGA

SEQ ID NO: 204508 - protein, 11 aa, Tick-borne encephalitis virus
KEDVVCYGGAW

SEQ ID NO: 204509 - protein, 11 aa, Tick-borne encephalitis virus
EDVVCYGGAWS

SEQ ID NO: 204510 - protein, 11 aa, Tick-borne encephalitis virus
DVVCYGGAWSL

SEQ ID NO: 204511 - protein, 11 aa, Tick-borne encephalitis virus
VVCYGGAWSLE

SEQ ID NO: 204512 - protein, 11 aa, Tick-borne encephalitis virus
VCYGGAWSLEE

SEQ ID NO: 204513 - protein, 11 aa, Tick-borne encephalitis virus
CYGGAWSLEEK

SEQ ID NO: 204514 - protein, 11 aa, Tick-borne encephalitis virus
YGGAWSLEEKW

SEQ ID NO: 204515 - protein, 11 aa, Tick-borne encephalitis virus
GGAWSLEEKWK

SEQ ID NO: 204516 - protein, 11 aa, Tick-borne encephalitis virus
GAWSLEEKWKG

SEQ ID NO: 204517 - protein, 11 aa, Tick-borne encephalitis virus
AWSLEEKWKGE

SEQ ID NO: 204518 - protein, 11 aa, Tick-borne encephalitis virus
WSLEEKWKGET

SEQ ID NO: 204519 - protein, 11 aa, Tick-borne encephalitis virus
SLEEKWKGETV

SEQ ID NO: 204520 - protein, 11 aa, Tick-borne encephalitis virus
LEEKWKGETVQ

SEQ ID NO: 204521 - protein, 11 aa, Tick-borne encephalitis virus
EEKWKGETVQV

SEQ ID NO: 204522 - protein, 11 aa, Tick-borne encephalitis virus
EKWKGETVQVH

SEQ ID NO: 204523 - protein, 11 aa, Tick-borne encephalitis virus
KWKGETVQVHA

SEQ ID NO: 204524 - protein, 11 aa, Tick-borne encephalitis virus
WKGETVQVHAF

SEQ ID NO: 204525 - protein, 11 aa, Tick-borne encephalitis virus
KGETVQVHAFP

SEQ ID NO: 204526 - protein, 11 aa, Tick-borne encephalitis virus
GETVQVHAFPP

SEQ ID NO: 204527 - protein, 11 aa, Tick-borne encephalitis virus
ETVQVHAFPPG

SEQ ID NO: 204528 - protein, 11 aa, Tick-borne encephalitis virus
TVQVHAFPPGR

SEQ ID NO: 204529 - protein, 11 aa, Tick-borne encephalitis virus
VQVHAFPPGRA

SEQ ID NO: 204530 - protein, 11 aa, Tick-borne encephalitis virus
QVHAFPPGRAH

SEQ ID NO: 204531 - protein, 11 aa, Tick-borne encephalitis virus
VHAFPPGRAHE

SEQ ID NO: 204532 - protein, 11 aa, Tick-borne encephalitis virus
HAFPPGRAHEV

SEQ ID NO: 204533 - protein, 11 aa, Tick-borne encephalitis virus
AFPPGRAHEVH

SEQ ID NO: 204534 - protein, 11 aa, Tick-borne encephalitis virus
FPPGRAHEVHQ

SEQ ID NO: 204535 - protein, 11 aa, Tick-borne encephalitis virus
PPGRAHEVHQC

SEQ ID NO: 204536 - protein, 11 aa, Tick-borne encephalitis virus
PGRAHEVHQCQ

SEQ ID NO: 204537 - protein, 11 aa, Tick-borne encephalitis virus
GRAHEVHQCQP

SEQ ID NO: 204538 - protein, 11 aa, Tick-borne encephalitis virus
RAHEVHQCQPG

SEQ ID NO: 204539 - protein, 11 aa, Tick-borne encephalitis virus
AHEVHQCQPGE

SEQ ID NO: 204540 - protein, 11 aa, Tick-borne encephalitis virus
HEVHQCQPGEL

SEQ ID NO: 204541 - protein, 11 aa, Tick-borne encephalitis virus
EVHQCQPGELL

SEQ ID NO: 204542 - protein, 11 aa, Tick-borne encephalitis virus
VHQCQPGELLL

SEQ ID NO: 204543 - protein, 11 aa, Tick-borne encephalitis virus
HQCQPGELLLD

SEQ ID NO: 204544 - protein, 11 aa, Tick-borne encephalitis virus
QCQPGELLLDT

SEQ ID NO: 204545 - protein, 11 aa, Tick-borne encephalitis virus
CQPGELLLDTG

SEQ ID NO: 204546 - protein, 11 aa, Tick-borne encephalitis virus
QPGELLLDTGR

SEQ ID NO: 204547 - protein, 11 aa, Tick-borne encephalitis virus
PGELLLDTGRR

SEQ ID NO: 204548 - protein, 11 aa, Tick-borne encephalitis virus
GAVPIDLAKGT

SEQ ID NO: 204549 - protein, 11 aa, Tick-borne encephalitis virus
AVPIDLAKGTS

SEQ ID NO: 204550 - protein, 11 aa, Tick-borne encephalitis virus
VPIDLAKGTSG

SEQ ID NO: 204551 - protein, 11 aa, Tick-borne encephalitis virus
PIDLAKGTSGS

SEQ ID NO: 204552 - protein, 11 aa, Tick-borne encephalitis virus
IDLAKGTSGSP

SEQ ID NO: 204553 - protein, 11 aa, Tick-borne encephalitis virus
DLAKGTSGSPI

SEQ ID NO: 204554 - protein, 11 aa, Tick-borne encephalitis virus
LAKGTSGSPIL

SEQ ID NO: 204555 - protein, 11 aa, Tick-borne encephalitis virus
AKGTSGSPILN

SEQ ID NO: 204556 - protein, 11 aa, Tick-borne encephalitis virus
KGTSGSPILNS

SEQ ID NO: 204557 - protein, 11 aa, Tick-borne encephalitis virus
GTSGSPILNSQ

SEQ ID NO: 204558 - protein, 11 aa, Tick-borne encephalitis virus
TSGSPILNSQG

SEQ ID NO: 204559 - protein, 11 aa, Tick-borne encephalitis virus
SPILNSQGVVV

SEQ ID NO: 204560 - protein, 11 aa, Tick-borne encephalitis virus
PILNSQGVVVG

SEQ ID NO: 204561 - protein, 11 aa, Tick-borne encephalitis virus
ILNSQGVVVGL

SEQ ID NO: 204562 - protein, 11 aa, Tick-borne encephalitis virus
LNSQGVVVGLY

SEQ ID NO: 204563 - protein, 11 aa, Tick-borne encephalitis virus
NSQGVVVGLYG

SEQ ID NO: 204564 - protein, 11 aa, Tick-borne encephalitis virus
SQGVVVGLYGN

SEQ ID NO: 204565 - protein, 11 aa, Tick-borne encephalitis virus
QGVVVGLYGNG

SEQ ID NO: 204566 - protein, 11 aa, Tick-borne encephalitis virus
GVVVGLYGNGL

SEQ ID NO: 204567 - protein, 11 aa, Tick-borne encephalitis virus
VVVGLYGNGLK

SEQ ID NO: 204568 - protein, 11 aa, Tick-borne encephalitis virus
VVGLYGNGLKT

SEQ ID NO: 204569 - protein, 11 aa, Tick-borne encephalitis virus
VGLYGNGLKTN

SEQ ID NO: 204570 - protein, 11 aa, Tick-borne encephalitis virus
GLYGNGLKTNE

SEQ ID NO: 204571 - protein, 11 aa, Tick-borne encephalitis virus
LYGNGLKTNET

SEQ ID NO: 204572 - protein, 11 aa, Tick-borne encephalitis virus
YGNGLKTNETY

SEQ ID NO: 204573 - protein, 11 aa, Tick-borne encephalitis virus
GNGLKTNETYV

SEQ ID NO: 204574 - protein, 11 aa, Tick-borne encephalitis virus
NGLKTNETYVS

SEQ ID NO: 204575 - protein, 11 aa, Tick-borne encephalitis virus
GLKTNETYVSS

SEQ ID NO: 204576 - protein, 11 aa, Tick-borne encephalitis virus
LKTNETYVSSI

SEQ ID NO: 204577 - protein, 11 aa, Tick-borne encephalitis virus
KTNETYVSSIA

SEQ ID NO: 204578 - protein, 11 aa, Tick-borne encephalitis virus
TNETYVSSIAQ

SEQ ID NO: 204579 - protein, 11 aa, Tick-borne encephalitis virus
NETYVSSIAQG

SEQ ID NO: 204580 - protein, 11 aa, Tick-borne encephalitis virus
ETYVSSIAQGE

SEQ ID NO: 204581 - protein, 11 aa, Tick-borne encephalitis virus
TYVSSIAQGEA

SEQ ID NO: 204582 - protein, 11 aa, Tick-borne encephalitis virus
YVSSIAQGEAE

SEQ ID NO: 204583 - protein, 11 aa, Tick-borne encephalitis virus
VSSIAQGEAEK

SEQ ID NO: 204584 - protein, 11 aa, Tick-borne encephalitis virus
SSIAQGEAEKS

SEQ ID NO: 204585 - protein, 11 aa, Tick-borne encephalitis virus
SIAQGEAEKSR

SEQ ID NO: 204586 - protein, 11 aa, Tick-borne encephalitis virus
IAQGEAEKSRP

SEQ ID NO: 204587 - protein, 11 aa, Tick-borne encephalitis virus
AQGEAEKSRPN

SEQ ID NO: 204588 - protein, 11 aa, Tick-borne encephalitis virus
QGEAEKSRPNL

SEQ ID NO: 204589 - protein, 11 aa, Tick-borne encephalitis virus
GEAEKSRPNLP

SEQ ID NO: 204590 - protein, 11 aa, Tick-borne encephalitis virus
EAEKSRPNLPP

SEQ ID NO: 204591 - protein, 11 aa, Tick-borne encephalitis virus
AEKSRPNLPPA

SEQ ID NO: 204592 - protein, 11 aa, Tick-borne encephalitis virus
EKSRPNLPPAV

SEQ ID NO: 204593 - protein, 11 aa, Tick-borne encephalitis virus
GTGWTAKGQIT

SEQ ID NO: 204594 - protein, 11 aa, Tick-borne encephalitis virus
TGWTAKGQITV

SEQ ID NO: 204595 - protein, 11 aa, Tick-borne encephalitis virus
GWTAKGQITVL

SEQ ID NO: 204596 - protein, 11 aa, Tick-borne encephalitis virus
WTAKGQITVLD

SEQ ID NO: 204597 - protein, 11 aa, Tick-borne encephalitis virus
TAKGQITVLDM

SEQ ID NO: 204598 - protein, 11 aa, Tick-borne encephalitis virus
AKGQITVLDMH

SEQ ID NO: 204599 - protein, 11 aa, Tick-borne encephalitis virus
KGQITVLDMHP

SEQ ID NO: 204600 - protein, 11 aa, Tick-borne encephalitis virus
GQITVLDMHPG

SEQ ID NO: 204601 - protein, 11 aa, Tick-borne encephalitis virus
QITVLDMHPGS

SEQ ID NO: 204602 - protein, 11 aa, Tick-borne encephalitis virus
ITVLDMHPGSG

SEQ ID NO: 204603 - protein, 11 aa, Tick-borne encephalitis virus
TVLDMHPGSGK

SEQ ID NO: 204604 - protein, 11 aa, Tick-borne encephalitis virus
VLDMHPGSGKT

SEQ ID NO: 204605 - protein, 11 aa, Tick-borne encephalitis virus
LDMHPGSGKTH

SEQ ID NO: 204606 - protein, 11 aa, Tick-borne encephalitis virus
DMHPGSGKTHR

SEQ ID NO: 204607 - protein, 11 aa, Tick-borne encephalitis virus
MHPGSGKTHRV

SEQ ID NO: 204608 - protein, 11 aa, Tick-borne encephalitis virus
HPGSGKTHRVL

SEQ ID NO: 204609 - protein, 11 aa, Tick-borne encephalitis virus
PGSGKTHRVLP

SEQ ID NO: 204610 - protein, 11 aa, Tick-borne encephalitis virus
GSGKTHRVLPE

SEQ ID NO: 204611 - protein, 11 aa, Tick-borne encephalitis virus
SGKTHRVLPEL

SEQ ID NO: 204612 - protein, 11 aa, Tick-borne encephalitis virus
GKTHRVLPELI

SEQ ID NO: 204613 - protein, 11 aa, Tick-borne encephalitis virus
KTHRVLPELIR

SEQ ID NO: 204614 - protein, 11 aa, Tick-borne encephalitis virus
THRVLPELIRQ

SEQ ID NO: 204615 - protein, 11 aa, Tick-borne encephalitis virus
HRVLPELIRQC

SEQ ID NO: 204616 - protein, 11 aa, Tick-borne encephalitis virus
RVLPELIRQCI

SEQ ID NO: 204617 - protein, 11 aa, Tick-borne encephalitis virus
VLPELIRQCID

SEQ ID NO: 204618 - protein, 11 aa, Tick-borne encephalitis virus
LPELIRQCIDR

SEQ ID NO: 204619 - protein, 11 aa, Tick-borne encephalitis virus
PELIRQCIDRR

SEQ ID NO: 204620 - protein, 11 aa, Tick-borne encephalitis virus
ELIRQCIDRRL

SEQ ID NO: 204621 - protein, 11 aa, Tick-borne encephalitis virus
LIRQCIDRRLR

SEQ ID NO: 204622 - protein, 11 aa, Tick-borne encephalitis virus
IRQCIDRRLRT

SEQ ID NO: 204623 - protein, 11 aa, Tick-borne encephalitis virus
RQCIDRRLRTL

SEQ ID NO: 204624 - protein, 11 aa, Tick-borne encephalitis virus
QCIDRRLRTLV

SEQ ID NO: 204625 - protein, 11 aa, Tick-borne encephalitis virus
CIDRRLRTLVL

SEQ ID NO: 204626 - protein, 11 aa, Tick-borne encephalitis virus
IDRRLRTLVLA

SEQ ID NO: 204627 - protein, 11 aa, Tick-borne encephalitis virus
DRRLRTLVLAP

SEQ ID NO: 204628 - protein, 11 aa, Tick-borne encephalitis virus
RRLRTLVLAPT

SEQ ID NO: 204629 - protein, 11 aa, Tick-borne encephalitis virus
RLRTLVLAPTR

SEQ ID NO: 204630 - protein, 11 aa, Tick-borne encephalitis virus
LRTLVLAPTRV

SEQ ID NO: 204631 - protein, 11 aa, Tick-borne encephalitis virus
RTLVLAPTRVV

SEQ ID NO: 204632 - protein, 11 aa, Tick-borne encephalitis virus
TLVLAPTRVVL

SEQ ID NO: 204633 - protein, 11 aa, Tick-borne encephalitis virus
LVLAPTRVVLK

SEQ ID NO: 204634 - protein, 11 aa, Tick-borne encephalitis virus
VLAPTRVVLKE

SEQ ID NO: 204635 - protein, 11 aa, Tick-borne encephalitis virus
LAPTRVVLKEM

SEQ ID NO: 204636 - protein, 11 aa, Tick-borne encephalitis virus
APTRVVLKEME

SEQ ID NO: 204637 - protein, 11 aa, Tick-borne encephalitis virus
PTRVVLKEMER

SEQ ID NO: 204638 - protein, 11 aa, Tick-borne encephalitis virus
TRVVLKEMERA

SEQ ID NO: 204639 - protein, 11 aa, Tick-borne encephalitis virus
RVVLKEMERAL

SEQ ID NO: 204640 - protein, 11 aa, Tick-borne encephalitis virus
VVLKEMERALN

SEQ ID NO: 204641 - protein, 11 aa, Tick-borne encephalitis virus
VLKEMERALNG

SEQ ID NO: 204642 - protein, 11 aa, Tick-borne encephalitis virus
LKEMERALNGK

SEQ ID NO: 204643 - protein, 11 aa, Tick-borne encephalitis virus
KEMERALNGKR

SEQ ID NO: 204644 - protein, 11 aa, Tick-borne encephalitis virus
EMERALNGKRV

SEQ ID NO: 204645 - protein, 11 aa, Tick-borne encephalitis virus
MERALNGKRVR

SEQ ID NO: 204646 - protein, 11 aa, Tick-borne encephalitis virus
ERALNGKRVRF

SEQ ID NO: 204647 - protein, 11 aa, Tick-borne encephalitis virus
RALNGKRVRFH

SEQ ID NO: 204648 - protein, 11 aa, Tick-borne encephalitis virus
ALNGKRVRFHS

SEQ ID NO: 204649 - protein, 11 aa, Tick-borne encephalitis virus
LNGKRVRFHSP

SEQ ID NO: 204650 - protein, 11 aa, Tick-borne encephalitis virus
NGKRVRFHSPA

SEQ ID NO: 204651 - protein, 11 aa, Tick-borne encephalitis virus
GKRVRFHSPAV

SEQ ID NO: 204652 - protein, 11 aa, Tick-borne encephalitis virus
KRVRFHSPAVG

SEQ ID NO: 204653 - protein, 11 aa, Tick-borne encephalitis virus
RVRFHSPAVGD

SEQ ID NO: 204654 - protein, 11 aa, Tick-borne encephalitis virus
VRFHSPAVGDQ

SEQ ID NO: 204655 - protein, 11 aa, Tick-borne encephalitis virus
RFHSPAVGDQQ

SEQ ID NO: 204656 - protein, 11 aa, Tick-borne encephalitis virus
GGAIVDVMCHA

SEQ ID NO: 204657 - protein, 11 aa, Tick-borne encephalitis virus
GAIVDVMCHAT

SEQ ID NO: 204658 - protein, 11 aa, Tick-borne encephalitis virus
AIVDVMCHATY

SEQ ID NO: 204659 - protein, 11 aa, Tick-borne encephalitis virus
IVDVMCHATYV

SEQ ID NO: 204660 - protein, 11 aa, Tick-borne encephalitis virus
VDVMCHATYVN

SEQ ID NO: 204661 - protein, 11 aa, Tick-borne encephalitis virus
DVMCHATYVNR

SEQ ID NO: 204662 - protein, 11 aa, Tick-borne encephalitis virus
VMCHATYVNRR

SEQ ID NO: 204663 - protein, 11 aa, Tick-borne encephalitis virus
MCHATYVNRRL

SEQ ID NO: 204664 - protein, 11 aa, Tick-borne encephalitis virus
CHATYVNRRLL

SEQ ID NO: 204665 - protein, 11 aa, Tick-borne encephalitis virus
HATYVNRRLLP

SEQ ID NO: 204666 - protein, 11 aa, Tick-borne encephalitis virus
ATYVNRRLLPQ

SEQ ID NO: 204667 - protein, 11 aa, Tick-borne encephalitis virus
TYVNRRLLPQG

SEQ ID NO: 204668 - protein, 11 aa, Tick-borne encephalitis virus
YVNRRLLPQGR

SEQ ID NO: 204669 - protein, 11 aa, Tick-borne encephalitis virus
VNRRLLPQGRQ

SEQ ID NO: 204670 - protein, 11 aa, Tick-borne encephalitis virus
NRRLLPQGRQN

SEQ ID NO: 204671 - protein, 11 aa, Tick-borne encephalitis virus
RRLLPQGRQNW

SEQ ID NO: 204672 - protein, 11 aa, Tick-borne encephalitis virus
RLLPQGRQNWE

SEQ ID NO: 204673 - protein, 11 aa, Tick-borne encephalitis virus
LLPQGRQNWEV

SEQ ID NO: 204674 - protein, 11 aa, Tick-borne encephalitis virus
LPQGRQNWEVA

SEQ ID NO: 204675 - protein, 11 aa, Tick-borne encephalitis virus
PQGRQNWEVAI

SEQ ID NO: 204676 - protein, 11 aa, Tick-borne encephalitis virus
QGRQNWEVAIM

SEQ ID NO: 204677 - protein, 11 aa, Tick-borne encephalitis virus
GRQNWEVAIMD

SEQ ID NO: 204678 - protein, 11 aa, Tick-borne encephalitis virus
RQNWEVAIMDE

SEQ ID NO: 204679 - protein, 11 aa, Tick-borne encephalitis virus
QNWEVAIMDEA

SEQ ID NO: 204680 - protein, 11 aa, Tick-borne encephalitis virus
NWEVAIMDEAH

SEQ ID NO: 204681 - protein, 11 aa, Tick-borne encephalitis virus
WEVAIMDEAHW

SEQ ID NO: 204682 - protein, 11 aa, Tick-borne encephalitis virus
EVAIMDEAHWT

SEQ ID NO: 204683 - protein, 11 aa, Tick-borne encephalitis virus
VAIMDEAHWTD

SEQ ID NO: 204684 - protein, 11 aa, Tick-borne encephalitis virus
AIMDEAHWTDP

SEQ ID NO: 204685 - protein, 11 aa, Tick-borne encephalitis virus
IMDEAHWTDPH

SEQ ID NO: 204686 - protein, 11 aa, Tick-borne encephalitis virus
MDEAHWTDPHS

SEQ ID NO: 204687 - protein, 11 aa, Tick-borne encephalitis virus
DEAHWTDPHSI

SEQ ID NO: 204688 - protein, 11 aa, Tick-borne encephalitis virus
EAHWTDPHSIA

SEQ ID NO: 204689 - protein, 11 aa, Tick-borne encephalitis virus
AHWTDPHSIAA

SEQ ID NO: 204690 - protein, 11 aa, Tick-borne encephalitis virus
HWTDPHSIAAR

SEQ ID NO: 204691 - protein, 11 aa, Tick-borne encephalitis virus
WTDPHSIAARG

SEQ ID NO: 204692 - protein, 11 aa, Tick-borne encephalitis virus
TDPHSIAARGH

SEQ ID NO: 204693 - protein, 11 aa, Tick-borne encephalitis virus
DPHSIAARGHL

SEQ ID NO: 204694 - protein, 11 aa, Tick-borne encephalitis virus
PHSIAARGHLY

SEQ ID NO: 204695 - protein, 11 aa, Tick-borne encephalitis virus
HSIAARGHLYT

SEQ ID NO: 204696 - protein, 11 aa, Tick-borne encephalitis virus
SIAARGHLYTL

SEQ ID NO: 204697 - protein, 11 aa, Tick-borne encephalitis virus
IAARGHLYTLA

SEQ ID NO: 204698 - protein, 11 aa, Tick-borne encephalitis virus
AARGHLYTLAK

SEQ ID NO: 204699 - protein, 11 aa, Tick-borne encephalitis virus
ARGHLYTLAKE

SEQ ID NO: 204700 - protein, 11 aa, Tick-borne encephalitis virus
RGHLYTLAKEN

SEQ ID NO: 204701 - protein, 11 aa, Tick-borne encephalitis virus
GHLYTLAKENK

SEQ ID NO: 204702 - protein, 11 aa, Tick-borne encephalitis virus
HLYTLAKENKC

SEQ ID NO: 204703 - protein, 11 aa, Tick-borne encephalitis virus
LYTLAKENKCA

SEQ ID NO: 204704 - protein, 11 aa, Tick-borne encephalitis virus
YTLAKENKCAL

SEQ ID NO: 204705 - protein, 11 aa, Tick-borne encephalitis virus
TLAKENKCALV

SEQ ID NO: 204706 - protein, 11 aa, Tick-borne encephalitis virus
LAKENKCALVL

SEQ ID NO: 204707 - protein, 11 aa, Tick-borne encephalitis virus
AKENKCALVLM

SEQ ID NO: 204708 - protein, 11 aa, Tick-borne encephalitis virus
KENKCALVLMT

SEQ ID NO: 204709 - protein, 11 aa, Tick-borne encephalitis virus
ENKCALVLMTA

SEQ ID NO: 204710 - protein, 11 aa, Tick-borne encephalitis virus
NKCALVLMTAT

SEQ ID NO: 204711 - protein, 11 aa, Tick-borne encephalitis virus
KCALVLMTATP

SEQ ID NO: 204712 - protein, 11 aa, Tick-borne encephalitis virus
CALVLMTATPP

SEQ ID NO: 204713 - protein, 11 aa, Tick-borne encephalitis virus
ALVLMTATPPG

SEQ ID NO: 204714 - protein, 11 aa, Tick-borne encephalitis virus
LVLMTATPPGK

SEQ ID NO: 204715 - protein, 11 aa, Tick-borne encephalitis virus
VLMTATPPGKS

SEQ ID NO: 204716 - protein, 11 aa, Tick-borne encephalitis virus
LMTATPPGKSE

SEQ ID NO: 204717 - protein, 11 aa, Tick-borne encephalitis virus
MTATPPGKSEP

SEQ ID NO: 204718 - protein, 11 aa, Tick-borne encephalitis virus
TATPPGKSEPF

SEQ ID NO: 204719 - protein, 11 aa, Tick-borne encephalitis virus
ATPPGKSEPFP

SEQ ID NO: 204720 - protein, 11 aa, Tick-borne encephalitis virus
TPPGKSEPFPE

SEQ ID NO: 204721 - protein, 11 aa, Tick-borne encephalitis virus
PPGKSEPFPES

SEQ ID NO: 204722 - protein, 11 aa, Tick-borne encephalitis virus
PGKSEPFPESN

SEQ ID NO: 204723 - protein, 11 aa, Tick-borne encephalitis virus
GKSEPFPESNG

SEQ ID NO: 204724 - protein, 11 aa, Tick-borne encephalitis virus
KSEPFPESNGA

SEQ ID NO: 204725 - protein, 11 aa, Tick-borne encephalitis virus
SEPFPESNGAI

SEQ ID NO: 204726 - protein, 11 aa, Tick-borne encephalitis virus
EPFPESNGAIT

SEQ ID NO: 204727 - protein, 11 aa, Tick-borne encephalitis virus
PFPESNGAITS

SEQ ID NO: 204728 - protein, 11 aa, Tick-borne encephalitis virus
FPESNGAITSE

SEQ ID NO: 204729 - protein, 11 aa, Tick-borne encephalitis virus
PESNGAITSEE

SEQ ID NO: 204730 - protein, 11 aa, Tick-borne encephalitis virus
ESNGAISSEEK

SEQ ID NO: 204731 - protein, 11 aa, Tick-borne encephalitis virus
SNGAISSEEKQ

SEQ ID NO: 204732 - protein, 11 aa, Tick-borne encephalitis virus
NGAISSEEKQI

SEQ ID NO: 204733 - protein, 11 aa, Tick-borne encephalitis virus
GAISSEEKQIP

SEQ ID NO: 204734 - protein, 11 aa, Tick-borne encephalitis virus
SEEKQIPDGEW

SEQ ID NO: 204735 - protein, 11 aa, Tick-borne encephalitis virus
EEKQIPDGEWR

SEQ ID NO: 204736 - protein, 11 aa, Tick-borne encephalitis virus
EKQIPDGEWRD

SEQ ID NO: 204737 - protein, 11 aa, Tick-borne encephalitis virus
KQIPDGEWRDG

SEQ ID NO: 204738 - protein, 11 aa, Tick-borne encephalitis virus
QIPDGEWRDGF

SEQ ID NO: 204739 - protein, 11 aa, Tick-borne encephalitis virus
IPDGEWRDGFD

SEQ ID NO: 204740 - protein, 11 aa, Tick-borne encephalitis virus
PDGEWRDGFDW

SEQ ID NO: 204741 - protein, 11 aa, Tick-borne encephalitis virus
DGEWRDGFDWI

SEQ ID NO: 204742 - protein, 11 aa, Tick-borne encephalitis virus
GEWRDGFDWIT

SEQ ID NO: 204743 - protein, 11 aa, Tick-borne encephalitis virus
EWRDGFDWITE

SEQ ID NO: 204744 - protein, 11 aa, Tick-borne encephalitis virus
WRDGFDWITEY

SEQ ID NO: 204745 - protein, 11 aa, Tick-borne encephalitis virus
RDGFDWITEYE

SEQ ID NO: 204746 - protein, 11 aa, Tick-borne encephalitis virus
DGFDWITEYEG

SEQ ID NO: 204747 - protein, 11 aa, Tick-borne encephalitis virus
GFDWITEYEGR

SEQ ID NO: 204748 - protein, 11 aa, Tick-borne encephalitis virus
FDWITEYEGRT

SEQ ID NO: 204749 - protein, 11 aa, Tick-borne encephalitis virus
DWITEYEGRTA

SEQ ID NO: 204750 - protein, 11 aa, Tick-borne encephalitis virus
WITEYEGRTAW

SEQ ID NO: 204751 - protein, 11 aa, Tick-borne encephalitis virus
ITEYEGRTAWF

SEQ ID NO: 204752 - protein, 11 aa, Tick-borne encephalitis virus
TEYEGRTAWFV

SEQ ID NO: 204753 - protein, 11 aa, Tick-borne encephalitis virus
EYEGRTAWFVP

SEQ ID NO: 204754 - protein, 11 aa, Tick-borne encephalitis virus
YEGRTAWFVPS

SEQ ID NO: 204755 - protein, 11 aa, Tick-borne encephalitis virus
EGRTAWFVPSI

SEQ ID NO: 204756 - protein, 11 aa, Tick-borne encephalitis virus
GRTAWFVPSIA

SEQ ID NO: 204757 - protein, 11 aa, Tick-borne encephalitis virus
RTAWFVPSIAK

SEQ ID NO: 204758 - protein, 11 aa, Tick-borne encephalitis virus
TAWFVPSIAKG

SEQ ID NO: 204759 - protein, 11 aa, Tick-borne encephalitis virus
AWFVPSIAKGG

SEQ ID NO: 204760 - protein, 11 aa, Tick-borne encephalitis virus
WFVPSIAKGGI

SEQ ID NO: 204761 - protein, 11 aa, Tick-borne encephalitis virus
FVPSIAKGGII

SEQ ID NO: 204762 - protein, 11 aa, Tick-borne encephalitis virus
VPSIAKGGIIA

SEQ ID NO: 204763 - protein, 11 aa, Tick-borne encephalitis virus
PSIAKGGIIAR

SEQ ID NO: 204764 - protein, 11 aa, Tick-borne encephalitis virus
SIAKGGIIART

SEQ ID NO: 204765 - protein, 11 aa, Tick-borne encephalitis virus
IAKGGIIARTL

SEQ ID NO: 204766 - protein, 11 aa, Tick-borne encephalitis virus
AKGGIIARTLR

SEQ ID NO: 204767 - protein, 11 aa, Tick-borne encephalitis virus
KGGIIARTLRQ

SEQ ID NO: 204768 - protein, 11 aa, Tick-borne encephalitis virus
GGIIARTLRQK

SEQ ID NO: 204769 - protein, 11 aa, Tick-borne encephalitis virus
GIIARTLRQKG

SEQ ID NO: 204770 - protein, 11 aa, Tick-borne encephalitis virus
IIARTLRQKGK

SEQ ID NO: 204771 - protein, 11 aa, Tick-borne encephalitis virus
IARTLRQKGKS

SEQ ID NO: 204772 - protein, 11 aa, Tick-borne encephalitis virus
ARTLRQKGKSV

SEQ ID NO: 204773 - protein, 11 aa, Tick-borne encephalitis virus
RTLRQKGKSVI

SEQ ID NO: 204774 - protein, 11 aa, Tick-borne encephalitis virus
TLRQKGKSVIC

SEQ ID NO: 204775 - protein, 11 aa, Tick-borne encephalitis virus
LRQKGKSVICL

SEQ ID NO: 204776 - protein, 11 aa, Tick-borne encephalitis virus
RQKGKSVICLN

SEQ ID NO: 204777 - protein, 11 aa, Tick-borne encephalitis virus
QKGKSVICLNS

SEQ ID NO: 204778 - protein, 11 aa, Tick-borne encephalitis virus
KGKSVICLNSK

SEQ ID NO: 204779 - protein, 11 aa, Tick-borne encephalitis virus
GKSVICLNSKT

SEQ ID NO: 204780 - protein, 11 aa, Tick-borne encephalitis virus
KSVICLNSKTF

SEQ ID NO: 204781 - protein, 11 aa, Tick-borne encephalitis virus
SVICLNSKTFE

SEQ ID NO: 204782 - protein, 11 aa, Tick-borne encephalitis virus
VICLNSKTFEK

SEQ ID NO: 204783 - protein, 11 aa, Tick-borne encephalitis virus
ICLNSKTFEKD

SEQ ID NO: 204784 - protein, 11 aa, Tick-borne encephalitis virus
CLNSKTFEKDY

SEQ ID NO: 204785 - protein, 11 aa, Tick-borne encephalitis virus
LNSKTFEKDYS

SEQ ID NO: 204786 - protein, 11 aa, Tick-borne encephalitis virus
NSKTFEKDYSR

SEQ ID NO: 204787 - protein, 11 aa, Tick-borne encephalitis virus
SKTFEKDYSRV

SEQ ID NO: 204788 - protein, 11 aa, Tick-borne encephalitis virus
KTFEKDYSRVR

SEQ ID NO: 204789 - protein, 11 aa, Tick-borne encephalitis virus
TFEKDYSRVRD

SEQ ID NO: 204790 - protein, 11 aa, Tick-borne encephalitis virus
FEKDYSRVRDE

SEQ ID NO: 204791 - protein, 11 aa, Tick-borne encephalitis virus
EKDYSRVRDEK

SEQ ID NO: 204792 - protein, 11 aa, Tick-borne encephalitis virus
KDYSRVRDEKP

SEQ ID NO: 204793 - protein, 11 aa, Tick-borne encephalitis virus
DYSRVRDEKPD

SEQ ID NO: 204794 - protein, 11 aa, Tick-borne encephalitis virus
YSRVRDEKPDF

SEQ ID NO: 204795 - protein, 11 aa, Tick-borne encephalitis virus
SRVRDEKPDFV

SEQ ID NO: 204796 - protein, 11 aa, Tick-borne encephalitis virus
RVRDEKPDFVV

SEQ ID NO: 204797 - protein, 11 aa, Tick-borne encephalitis virus
VRDEKPDFVVT

SEQ ID NO: 204798 - protein, 11 aa, Tick-borne encephalitis virus
RDEKPDFVVTT

SEQ ID NO: 204799 - protein, 11 aa, Tick-borne encephalitis virus
DEKPDFVVTTD

SEQ ID NO: 204800 - protein, 11 aa, Tick-borne encephalitis virus
EKPDFVVTTDI

SEQ ID NO: 204801 - protein, 11 aa, Tick-borne encephalitis virus
KPDFVVTTDIS

SEQ ID NO: 204802 - protein, 11 aa, Tick-borne encephalitis virus
PDFVVTTDISE

SEQ ID NO: 204803 - protein, 11 aa, Tick-borne encephalitis virus
DFVVTTDISEM

SEQ ID NO: 204804 - protein, 11 aa, Tick-borne encephalitis virus
FVVTTDISEMG

SEQ ID NO: 204805 - protein, 11 aa, Tick-borne encephalitis virus
VVTTDISEMGA

SEQ ID NO: 204806 - protein, 11 aa, Tick-borne encephalitis virus
VTTDISEMGAN

SEQ ID NO: 204807 - protein, 11 aa, Tick-borne encephalitis virus
TTDISEMGANL

SEQ ID NO: 204808 - protein, 11 aa, Tick-borne encephalitis virus
TDISEMGANLD

SEQ ID NO: 204809 - protein, 11 aa, Tick-borne encephalitis virus
DISEMGANLDV

SEQ ID NO: 204810 - protein, 11 aa, Tick-borne encephalitis virus
ISEMGANLDVS

SEQ ID NO: 204811 - protein, 11 aa, Tick-borne encephalitis virus
SEMGANLDVSR

SEQ ID NO: 204812 - protein, 11 aa, Tick-borne encephalitis virus
EMGANLDVSRV

SEQ ID NO: 204813 - protein, 11 aa, Tick-borne encephalitis virus
MGANLDVSRVI

SEQ ID NO: 204814 - protein, 11 aa, Tick-borne encephalitis virus
GANLDVSRVID

SEQ ID NO: 204815 - protein, 11 aa, Tick-borne encephalitis virus
ANLDVSRVIDG

SEQ ID NO: 204816 - protein, 11 aa, Tick-borne encephalitis virus
NLDVSRVIDGR

SEQ ID NO: 204817 - protein, 11 aa, Tick-borne encephalitis virus
LDVSRVIDGRT

SEQ ID NO: 204818 - protein, 11 aa, Tick-borne encephalitis virus
DVSRVIDGRTN

SEQ ID NO: 204819 - protein, 11 aa, Tick-borne encephalitis virus
VSRVIDGRTNI

SEQ ID NO: 204820 - protein, 11 aa, Tick-borne encephalitis virus
SRVIDGRTNIK

SEQ ID NO: 204821 - protein, 11 aa, Tick-borne encephalitis virus
RVIDGRTNIKP

SEQ ID NO: 204822 - protein, 11 aa, Tick-borne encephalitis virus
VIDGRTNIKPE

SEQ ID NO: 204823 - protein, 11 aa, Tick-borne encephalitis virus
IDGRTNIKPEE

SEQ ID NO: 204824 - protein, 11 aa, Tick-borne encephalitis virus
DGRTNIKPEEV

SEQ ID NO: 204825 - protein, 11 aa, Tick-borne encephalitis virus
GRTNIKPEEVD

SEQ ID NO: 204826 - protein, 11 aa, Tick-borne encephalitis virus
RTNIKPEEVDG

SEQ ID NO: 204827 - protein, 11 aa, Tick-borne encephalitis virus
TNIKPEEVDGR

SEQ ID NO: 204828 - protein, 11 aa, Tick-borne encephalitis virus
NIKPEEVDGRV

SEQ ID NO: 204829 - protein, 11 aa, Tick-borne encephalitis virus
IKPEEVDGRVE

SEQ ID NO: 204830 - protein, 11 aa, Tick-borne encephalitis virus
KPEEVDGRVEL

SEQ ID NO: 204831 - protein, 11 aa, Tick-borne encephalitis virus
PEEVDGRVELT

SEQ ID NO: 204832 - protein, 11 aa, Tick-borne encephalitis virus
EEVDGRVELTG

SEQ ID NO: 204833 - protein, 11 aa, Tick-borne encephalitis virus
EVDGRVELTGT

SEQ ID NO: 204834 - protein, 11 aa, Tick-borne encephalitis virus
VDGRVELTGTR

SEQ ID NO: 204835 - protein, 11 aa, Tick-borne encephalitis virus
DGRVELTGTRR

SEQ ID NO: 204836 - protein, 11 aa, Tick-borne encephalitis virus
GRVELTGTRRV

SEQ ID NO: 204837 - protein, 11 aa, Tick-borne encephalitis virus
RVELTGTRRVT

SEQ ID NO: 204838 - protein, 11 aa, Tick-borne encephalitis virus
VELTGTRRVTT

SEQ ID NO: 204839 - protein, 11 aa, Tick-borne encephalitis virus
ELTGTRRVTTA

SEQ ID NO: 204840 - protein, 11 aa, Tick-borne encephalitis virus
LTGTRRVTTAS

SEQ ID NO: 204841 - protein, 11 aa, Tick-borne encephalitis virus
TGTRRVTTASA

SEQ ID NO: 204842 - protein, 11 aa, Tick-borne encephalitis virus
GTRRVTTASAA

SEQ ID NO: 204843 - protein, 11 aa, Tick-borne encephalitis virus
TRRVTTASAAQ

SEQ ID NO: 204844 - protein, 11 aa, Tick-borne encephalitis virus
RRVTTASAAQR

SEQ ID NO: 204845 - protein, 11 aa, Tick-borne encephalitis virus
RVTTASAAQRR

SEQ ID NO: 204846 - protein, 11 aa, Tick-borne encephalitis virus
VTTASAAQRRG

SEQ ID NO: 204847 - protein, 11 aa, Tick-borne encephalitis virus
TTASAAQRRGR

SEQ ID NO: 204848 - protein, 11 aa, Tick-borne encephalitis virus
TASAAQRRGRV

SEQ ID NO: 204849 - protein, 11 aa, Tick-borne encephalitis virus
ASAAQRRGRVG

SEQ ID NO: 204850 - protein, 11 aa, Tick-borne encephalitis virus
SAAQRRGRVGR

SEQ ID NO: 204851 - protein, 11 aa, Tick-borne encephalitis virus
AAQRRGRVGRQ

SEQ ID NO: 204852 - protein, 11 aa, Tick-borne encephalitis virus
AQRRGRVGRQE

SEQ ID NO: 204853 - protein, 11 aa, Tick-borne encephalitis virus
QRRGRVGRQEG

SEQ ID NO: 204854 - protein, 11 aa, Tick-borne encephalitis virus
RRGRVGRQEGR

SEQ ID NO: 204855 - protein, 11 aa, Tick-borne encephalitis virus
RGRVGRQEGRT

SEQ ID NO: 204856 - protein, 11 aa, Tick-borne encephalitis virus
GRVGRQEGRTD

SEQ ID NO: 204857 - protein, 11 aa, Tick-borne encephalitis virus
RVGRQEGRTDE

SEQ ID NO: 204858 - protein, 11 aa, Tick-borne encephalitis virus
VGRQEGRTDEY

SEQ ID NO: 204859 - protein, 11 aa, Tick-borne encephalitis virus
GRQEGRTDEYI

SEQ ID NO: 204860 - protein, 11 aa, Tick-borne encephalitis virus
RQEGRTDEYIY

SEQ ID NO: 204861 - protein, 11 aa, Tick-borne encephalitis virus
QEGRTDEYIYS

SEQ ID NO: 204862 - protein, 11 aa, Tick-borne encephalitis virus
EGRTDEYIYSG

SEQ ID NO: 204863 - protein, 11 aa, Tick-borne encephalitis virus
GRTDEYIYSGQ

SEQ ID NO: 204864 - protein, 11 aa, Tick-borne encephalitis virus
RTDEYIYSGQC

SEQ ID NO: 204865 - protein, 11 aa, Tick-borne encephalitis virus
TDEYIYSGQCD

SEQ ID NO: 204866 - protein, 11 aa, Tick-borne encephalitis virus
DEYIYSGQCDD

SEQ ID NO: 204867 - protein, 11 aa, Tick-borne encephalitis virus
EYIYSGQCDDD

SEQ ID NO: 204868 - protein, 11 aa, Tick-borne encephalitis virus
YIYSGQCDDDD

SEQ ID NO: 204869 - protein, 11 aa, Tick-borne encephalitis virus
IYSGQCDDDDS

SEQ ID NO: 204870 - protein, 11 aa, Tick-borne encephalitis virus
YSGQCDDDDSG

SEQ ID NO: 204871 - protein, 11 aa, Tick-borne encephalitis virus
SGQCDDDDSGL

SEQ ID NO: 204872 - protein, 11 aa, Tick-borne encephalitis virus
GQCDDDDSGLV

SEQ ID NO: 204873 - protein, 11 aa, Tick-borne encephalitis virus
QCDDDDSGLVQ

SEQ ID NO: 204874 - protein, 11 aa, Tick-borne encephalitis virus
CDDDDSGLVQW

SEQ ID NO: 204875 - protein, 11 aa, Tick-borne encephalitis virus
DDDDSGLVQWK

SEQ ID NO: 204876 - protein, 11 aa, Tick-borne encephalitis virus
DDDSGLVQWKE

SEQ ID NO: 204877 - protein, 11 aa, Tick-borne encephalitis virus
DDSGLVQWKEA

SEQ ID NO: 204878 - protein, 11 aa, Tick-borne encephalitis virus
DSGLVQWKEAQ

SEQ ID NO: 204879 - protein, 11 aa, Tick-borne encephalitis virus
SGLVQWKEAQI

SEQ ID NO: 204880 - protein, 11 aa, Tick-borne encephalitis virus
GLVQWKEAQIL

SEQ ID NO: 204881 - protein, 11 aa, Tick-borne encephalitis virus
LVQWKEAQILL

SEQ ID NO: 204882 - protein, 11 aa, Tick-borne encephalitis virus
VQWKEAQILLD

SEQ ID NO: 204883 - protein, 11 aa, Tick-borne encephalitis virus
QWKEAQILLDN

SEQ ID NO: 204884 - protein, 11 aa, Tick-borne encephalitis virus
WKEAQILLDNI

SEQ ID NO: 204885 - protein, 11 aa, Tick-borne encephalitis virus
KEAQILLDNIT

SEQ ID NO: 204886 - protein, 11 aa, Tick-borne encephalitis virus
EAQILLDNITT

SEQ ID NO: 204887 - protein, 11 aa, Tick-borne encephalitis virus
AQILLDNITTL

SEQ ID NO: 204888 - protein, 11 aa, Tick-borne encephalitis virus
QILLDNITTLR

SEQ ID NO: 204889 - protein, 11 aa, Tick-borne encephalitis virus
ILLDNITTLRG

SEQ ID NO: 204890 - protein, 11 aa, Tick-borne encephalitis virus
LLDNITTLRGP

SEQ ID NO: 204891 - protein, 11 aa, Tick-borne encephalitis virus
LDNITTLRGPV

SEQ ID NO: 204892 - protein, 11 aa, Tick-borne encephalitis virus
DNITTLRGPVA

SEQ ID NO: 204893 - protein, 11 aa, Tick-borne encephalitis virus
NITTLRGPVAT

SEQ ID NO: 204894 - protein, 11 aa, Tick-borne encephalitis virus
ITTLRGPVATF

SEQ ID NO: 204895 - protein, 11 aa, Tick-borne encephalitis virus
TTLRGPVATFY

SEQ ID NO: 204896 - protein, 11 aa, Tick-borne encephalitis virus
TLRGPVATFYG

SEQ ID NO: 204897 - protein, 11 aa, Tick-borne encephalitis virus
LRGPVATFYGP

SEQ ID NO: 204898 - protein, 11 aa, Tick-borne encephalitis virus
RGPVATFYGPE

SEQ ID NO: 204899 - protein, 11 aa, Tick-borne encephalitis virus
GPVATFYGPEQ

SEQ ID NO: 204900 - protein, 11 aa, Tick-borne encephalitis virus
PVATFYGPEQD

SEQ ID NO: 204901 - protein, 11 aa, Tick-borne encephalitis virus
VATFYGPEQDK

SEQ ID NO: 204902 - protein, 11 aa, Tick-borne encephalitis virus
ATFYGPEQDKM

SEQ ID NO: 204903 - protein, 11 aa, Tick-borne encephalitis virus
TFYGPEQDKMP

SEQ ID NO: 204904 - protein, 11 aa, Tick-borne encephalitis virus
FYGPEQDKMPE

SEQ ID NO: 204905 - protein, 11 aa, Tick-borne encephalitis virus
YGPEQDKMPEV

SEQ ID NO: 204906 - protein, 11 aa, Tick-borne encephalitis virus
GPEQDKMPEVA

SEQ ID NO: 204907 - protein, 11 aa, Tick-borne encephalitis virus
PEQDKMPEVAG

SEQ ID NO: 204908 - protein, 11 aa, Tick-borne encephalitis virus
EQDKMPEVAGH

SEQ ID NO: 204909 - protein, 11 aa, Tick-borne encephalitis virus
QDKMPEVAGHF

SEQ ID NO: 204910 - protein, 11 aa, Tick-borne encephalitis virus
DKMPEVAGHFR

SEQ ID NO: 204911 - protein, 11 aa, Tick-borne encephalitis virus
KMPEVAGHFRL

SEQ ID NO: 204912 - protein, 11 aa, Tick-borne encephalitis virus
MPEVAGHFRLT

SEQ ID NO: 204913 - protein, 11 aa, Tick-borne encephalitis virus
PEVAGHFRLTE

SEQ ID NO: 204914 - protein, 11 aa, Tick-borne encephalitis virus
EVAGHFRLTEE

SEQ ID NO: 204915 - protein, 11 aa, Tick-borne encephalitis virus
VAGHFRLTEEK

SEQ ID NO: 204916 - protein, 11 aa, Tick-borne encephalitis virus
AGHFRLTEEKR

SEQ ID NO: 204917 - protein, 11 aa, Tick-borne encephalitis virus
GHFRLTEEKRK

SEQ ID NO: 204918 - protein, 11 aa, Tick-borne encephalitis virus
HFRLTEEKRKH

SEQ ID NO: 204919 - protein, 11 aa, Tick-borne encephalitis virus
FRLTEEKRKHF

SEQ ID NO: 204920 - protein, 11 aa, Tick-borne encephalitis virus
RLTEEKRKHFR

SEQ ID NO: 204921 - protein, 11 aa, Tick-borne encephalitis virus
LTEEKRKHFRH

SEQ ID NO: 204922 - protein, 11 aa, Tick-borne encephalitis virus
TEEKRKHFRHL

SEQ ID NO: 204923 - protein, 11 aa, Tick-borne encephalitis virus
EEKRKHFRHLL

SEQ ID NO: 204924 - protein, 11 aa, Tick-borne encephalitis virus
EKRKHFRHLLT

SEQ ID NO: 204925 - protein, 11 aa, Tick-borne encephalitis virus
KRKHFRHLLTH

SEQ ID NO: 204926 - protein, 11 aa, Tick-borne encephalitis virus
RKHFRHLLTHC

SEQ ID NO: 204927 - protein, 11 aa, Tick-borne encephalitis virus
KHFRHLLTHCD

SEQ ID NO: 204928 - protein, 11 aa, Tick-borne encephalitis virus
HFRHLLTHCDF

SEQ ID NO: 204929 - protein, 11 aa, Tick-borne encephalitis virus
FRHLLTHCDFT

SEQ ID NO: 204930 - protein, 11 aa, Tick-borne encephalitis virus
RHLLTHCDFTP

SEQ ID NO: 204931 - protein, 11 aa, Tick-borne encephalitis virus
HLLTHCDFTPW

SEQ ID NO: 204932 - protein, 11 aa, Tick-borne encephalitis virus
LLTHCDFTPWL

SEQ ID NO: 204933 - protein, 11 aa, Tick-borne encephalitis virus
LTHCDFTPWLA

SEQ ID NO: 204934 - protein, 11 aa, Tick-borne encephalitis virus
THCDFTPWLAW

SEQ ID NO: 204935 - protein, 11 aa, Tick-borne encephalitis virus
HCDFTPWLAWH

SEQ ID NO: 204936 - protein, 11 aa, Tick-borne encephalitis virus
CDFTPWLAWHV

SEQ ID NO: 204937 - protein, 11 aa, Tick-borne encephalitis virus
DFTPWLAWHVA

SEQ ID NO: 204938 - protein, 11 aa, Tick-borne encephalitis virus
FTPWLAWHVAA

SEQ ID NO: 204939 - protein, 11 aa, Tick-borne encephalitis virus
TPWLAWHVAAN

SEQ ID NO: 204940 - protein, 11 aa, Tick-borne encephalitis virus
PWLAWHVAANV

SEQ ID NO: 204941 - protein, 11 aa, Tick-borne encephalitis virus
WLAWHVAANVS

SEQ ID NO: 204942 - protein, 11 aa, Tick-borne encephalitis virus
LAWHVAANVSS

SEQ ID NO: 204943 - protein, 11 aa, Tick-borne encephalitis virus
AWHVAANVSSV

SEQ ID NO: 204944 - protein, 11 aa, Tick-borne encephalitis virus
WHVAANVSSVT

SEQ ID NO: 204945 - protein, 11 aa, Tick-borne encephalitis virus
HVAANVSSVTS

SEQ ID NO: 204946 - protein, 11 aa, Tick-borne encephalitis virus
VAANVSSVTSR

SEQ ID NO: 204947 - protein, 11 aa, Tick-borne encephalitis virus
AANVSSVTSRN

SEQ ID NO: 204948 - protein, 11 aa, Tick-borne encephalitis virus
ANVSSVTSRNW

SEQ ID NO: 204949 - protein, 11 aa, Tick-borne encephalitis virus
NVSSVTSRNWT

SEQ ID NO: 204950 - protein, 11 aa, Tick-borne encephalitis virus
VSSVTSRNWTW

SEQ ID NO: 204951 - protein, 11 aa, Tick-borne encephalitis virus
SSVTSRNWTWE

SEQ ID NO: 204952 - protein, 11 aa, Tick-borne encephalitis virus
SVTSRNWTWEG

SEQ ID NO: 204953 - protein, 11 aa, Tick-borne encephalitis virus
VTSRNWTWEGP

SEQ ID NO: 204954 - protein, 11 aa, Tick-borne encephalitis virus
TSRNWTWEGPE

SEQ ID NO: 204955 - protein, 11 aa, Tick-borne encephalitis virus
SRNWTWEGPEE

SEQ ID NO: 204956 - protein, 11 aa, Tick-borne encephalitis virus
RNWTWEGPEEN

SEQ ID NO: 204957 - protein, 11 aa, Tick-borne encephalitis virus
NWTWEGPEENT

SEQ ID NO: 204958 - protein, 11 aa, Tick-borne encephalitis virus
WTWEGPEENTV

SEQ ID NO: 204959 - protein, 11 aa, Tick-borne encephalitis virus
TWEGPEENTVD

SEQ ID NO: 204960 - protein, 11 aa, Tick-borne encephalitis virus
WEGPEENTVDE

SEQ ID NO: 204961 - protein, 11 aa, Tick-borne encephalitis virus
EGPEENTVDEA

SEQ ID NO: 204962 - protein, 11 aa, Tick-borne encephalitis virus
GPEENTVDEAN

SEQ ID NO: 204963 - protein, 11 aa, Tick-borne encephalitis virus
PEENTVDEANG

SEQ ID NO: 204964 - protein, 11 aa, Tick-borne encephalitis virus
EENTVDEANGD

SEQ ID NO: 204965 - protein, 11 aa, Tick-borne encephalitis virus
ENTVDEANGDL

SEQ ID NO: 204966 - protein, 11 aa, Tick-borne encephalitis virus
NTVDEANGDLV

SEQ ID NO: 204967 - protein, 11 aa, Tick-borne encephalitis virus
TVDEANGDLVT

SEQ ID NO: 204968 - protein, 11 aa, Tick-borne encephalitis virus
VDEANGDLVTF

SEQ ID NO: 204969 - protein, 11 aa, Tick-borne encephalitis virus
DEANGDLVTFR

SEQ ID NO: 204970 - protein, 11 aa, Tick-borne encephalitis virus
EANGDLVTFRS

SEQ ID NO: 204971 - protein, 11 aa, Tick-borne encephalitis virus
ANGDLVTFRSP

SEQ ID NO: 204972 - protein, 11 aa, Tick-borne encephalitis virus
NGDLVTFRSPN

SEQ ID NO: 204973 - protein, 11 aa, Tick-borne encephalitis virus
GDLVTFRSPNG

SEQ ID NO: 204974 - protein, 11 aa, Tick-borne encephalitis virus
DLVTFRSPNGA

SEQ ID NO: 204975 - protein, 11 aa, Tick-borne encephalitis virus
LVTFRSPNGAE

SEQ ID NO: 204976 - protein, 11 aa, Tick-borne encephalitis virus
VTFRSPNGAER

SEQ ID NO: 204977 - protein, 11 aa, Tick-borne encephalitis virus
TFRSPNGAERT

SEQ ID NO: 204978 - protein, 11 aa, Tick-borne encephalitis virus
FRSPNGAERTL

SEQ ID NO: 204979 - protein, 11 aa, Tick-borne encephalitis virus
RSPNGAERTLR

SEQ ID NO: 204980 - protein, 11 aa, Tick-borne encephalitis virus
SPNGAERTLRP

SEQ ID NO: 204981 - protein, 11 aa, Tick-borne encephalitis virus
PNGAERTLRPV

SEQ ID NO: 204982 - protein, 11 aa, Tick-borne encephalitis virus
NGAERTLRPVW

SEQ ID NO: 204983 - protein, 11 aa, Tick-borne encephalitis virus
GAERTLRPVWR

SEQ ID NO: 204984 - protein, 11 aa, Tick-borne encephalitis virus
AERTLRPVWRD

SEQ ID NO: 204985 - protein, 11 aa, Tick-borne encephalitis virus
ERTLRPVWRDA

SEQ ID NO: 204986 - protein, 11 aa, Tick-borne encephalitis virus
RTLRPVWRDAR

SEQ ID NO: 204987 - protein, 11 aa, Tick-borne encephalitis virus
TLRPVWRDARM

SEQ ID NO: 204988 - protein, 11 aa, Tick-borne encephalitis virus
LRPVWRDARMF

SEQ ID NO: 204989 - protein, 11 aa, Tick-borne encephalitis virus
RPVWRDARMFR

SEQ ID NO: 204990 - protein, 11 aa, Tick-borne encephalitis virus
PVWRDARMFRE

SEQ ID NO: 204991 - protein, 11 aa, Tick-borne encephalitis virus
VWRDARMFREG

SEQ ID NO: 204992 - protein, 11 aa, Tick-borne encephalitis virus
WRDARMFREGR

SEQ ID NO: 204993 - protein, 11 aa, Tick-borne encephalitis virus
RDARMFREGRD

SEQ ID NO: 204994 - protein, 11 aa, Tick-borne encephalitis virus
DARMFREGRDI

SEQ ID NO: 204995 - protein, 11 aa, Tick-borne encephalitis virus
ARMFREGRDIR

SEQ ID NO: 204996 - protein, 11 aa, Tick-borne encephalitis virus
RMFREGRDIRE

SEQ ID NO: 204997 - protein, 11 aa, Tick-borne encephalitis virus
MFREGRDIREF

SEQ ID NO: 204998 - protein, 11 aa, Tick-borne encephalitis virus
FREGRDIREFV

SEQ ID NO: 204999 - protein, 11 aa, Tick-borne encephalitis virus
REGRDIREFVA

SEQ ID NO: 205000 - protein, 11 aa, Tick-borne encephalitis virus
EGRDIREFVAY

SEQ ID NO: 205001 - protein, 11 aa, Tick-borne encephalitis virus
GRDIREFVAYA

SEQ ID NO: 205002 - protein, 11 aa, Tick-borne encephalitis virus
RDIREFVAYAS

SEQ ID NO: 205003 - protein, 11 aa, Tick-borne encephalitis virus
DIREFVAYASG

SEQ ID NO: 205004 - protein, 11 aa, Tick-borne encephalitis virus
IREFVAYASGR

SEQ ID NO: 205005 - protein, 11 aa, Tick-borne encephalitis virus
REFVAYASGRR

SEQ ID NO: 205006 - protein, 11 aa, Tick-borne encephalitis virus
EFVAYASGRRS

SEQ ID NO: 205007 - protein, 11 aa, Tick-borne encephalitis virus
FVAYASGRRSF

SEQ ID NO: 205008 - protein, 11 aa, Tick-borne encephalitis virus
VAYASGRRSFG

SEQ ID NO: 205009 - protein, 11 aa, Tick-borne encephalitis virus
AYASGRRSFGD

SEQ ID NO: 205010 - protein, 11 aa, Tick-borne encephalitis virus
YASGRRSFGDV

SEQ ID NO: 205011 - protein, 11 aa, Tick-borne encephalitis virus
ASGRRSFGDVL

SEQ ID NO: 205012 - protein, 11 aa, Tick-borne encephalitis virus
SGRRSFGDVLS

SEQ ID NO: 205013 - protein, 11 aa, Tick-borne encephalitis virus
GRRSFGDVLSG

SEQ ID NO: 205014 - protein, 11 aa, Tick-borne encephalitis virus
RRSFGDVLSGM

SEQ ID NO: 205015 - protein, 11 aa, Tick-borne encephalitis virus
RSFGDVLSGMS

SEQ ID NO: 205016 - protein, 11 aa, Tick-borne encephalitis virus
SFGDVLSGMSG

SEQ ID NO: 205017 - protein, 11 aa, Tick-borne encephalitis virus
FGDVLSGMSGV

SEQ ID NO: 205018 - protein, 11 aa, Tick-borne encephalitis virus
GDVLSGMSGVP

SEQ ID NO: 205019 - protein, 11 aa, Tick-borne encephalitis virus
DVLSGMSGVPE

SEQ ID NO: 205020 - protein, 11 aa, Tick-borne encephalitis virus
VLSGMSGVPEL

SEQ ID NO: 205021 - protein, 11 aa, Tick-borne encephalitis virus
LSGMSGVPELL

SEQ ID NO: 205022 - protein, 11 aa, Tick-borne encephalitis virus
SGMSGVPELLR

SEQ ID NO: 205023 - protein, 11 aa, Tick-borne encephalitis virus
GMSGVPELLRH

SEQ ID NO: 205024 - protein, 11 aa, Tick-borne encephalitis virus
MSGVPELLRHR

SEQ ID NO: 205025 - protein, 11 aa, Tick-borne encephalitis virus
SGVPELLRHRC

SEQ ID NO: 205026 - protein, 11 aa, Tick-borne encephalitis virus
GVPELLRHRCV

SEQ ID NO: 205027 - protein, 11 aa, Tick-borne encephalitis virus
VPELLRHRCVS

SEQ ID NO: 205028 - protein, 11 aa, Tick-borne encephalitis virus
PELLRHRCVSA

SEQ ID NO: 205029 - protein, 11 aa, Tick-borne encephalitis virus
ELLRHRCVSAM

SEQ ID NO: 205030 - protein, 11 aa, Tick-borne encephalitis virus
LLRHRCVSAMD

SEQ ID NO: 205031 - protein, 11 aa, Tick-borne encephalitis virus
LRHRCVSAMDV

SEQ ID NO: 205032 - protein, 11 aa, Tick-borne encephalitis virus
RHRCVSAMDVF

SEQ ID NO: 205033 - protein, 11 aa, Tick-borne encephalitis virus
HRCVSAMDVFY

SEQ ID NO: 205034 - protein, 11 aa, Tick-borne encephalitis virus
RCVSAMDVFYT

SEQ ID NO: 205035 - protein, 11 aa, Tick-borne encephalitis virus
CVSAMDVFYTL

SEQ ID NO: 205036 - protein, 11 aa, Tick-borne encephalitis virus
VSAMDVFYTLM

SEQ ID NO: 205037 - protein, 11 aa, Tick-borne encephalitis virus
SAMDVFYTLMH

SEQ ID NO: 205038 - protein, 11 aa, Tick-borne encephalitis virus
AMDVFYTLMHE

SEQ ID NO: 205039 - protein, 11 aa, Tick-borne encephalitis virus
MDVFYTLMHEE

SEQ ID NO: 205040 - protein, 11 aa, Tick-borne encephalitis virus
DVFYTLMHEEP

SEQ ID NO: 205041 - protein, 11 aa, Tick-borne encephalitis virus
VFYTLMHEEPG

SEQ ID NO: 205042 - protein, 11 aa, Tick-borne encephalitis virus
FYTLMHEEPGS

SEQ ID NO: 205043 - protein, 11 aa, Tick-borne encephalitis virus
YTLMHEEPGSR

SEQ ID NO: 205044 - protein, 11 aa, Tick-borne encephalitis virus
TLMHEEPGSRA

SEQ ID NO: 205045 - protein, 11 aa, Tick-borne encephalitis virus
LMHEEPGSRAM

SEQ ID NO: 205046 - protein, 11 aa, Tick-borne encephalitis virus
MHEEPGSRAMR

SEQ ID NO: 205047 - protein, 11 aa, Tick-borne encephalitis virus
HEEPGSRAMRM

SEQ ID NO: 205048 - protein, 11 aa, Tick-borne encephalitis virus
EEPGSRAMRMA

SEQ ID NO: 205049 - protein, 11 aa, Tick-borne encephalitis virus
EPGSRAMRMAE

SEQ ID NO: 205050 - protein, 11 aa, Tick-borne encephalitis virus
PGSRAMRMAER

SEQ ID NO: 205051 - protein, 11 aa, Tick-borne encephalitis virus
GSRAMRMAERD

SEQ ID NO: 205052 - protein, 11 aa, Tick-borne encephalitis virus
SRAMRMAERDA

SEQ ID NO: 205053 - protein, 11 aa, Tick-borne encephalitis virus
RAMRMAERDAP

SEQ ID NO: 205054 - protein, 11 aa, Tick-borne encephalitis virus
AMRMAERDAPE

SEQ ID NO: 205055 - protein, 11 aa, Tick-borne encephalitis virus
MRMAERDAPEA

SEQ ID NO: 205056 - protein, 11 aa, Tick-borne encephalitis virus
RMAERDAPEAF

SEQ ID NO: 205057 - protein, 11 aa, Tick-borne encephalitis virus
MAERDAPEAFL

SEQ ID NO: 205058 - protein, 11 aa, Tick-borne encephalitis virus
AERDAPEAFLT

SEQ ID NO: 205059 - protein, 11 aa, Tick-borne encephalitis virus
ERDAPEAFLTV

SEQ ID NO: 205060 - protein, 11 aa, Tick-borne encephalitis virus
RDAPEAFLTVV

SEQ ID NO: 205061 - protein, 11 aa, Tick-borne encephalitis virus
DAPEAFLTVVE

SEQ ID NO: 205062 - protein, 11 aa, Tick-borne encephalitis virus
VEMMVLGLATL

SEQ ID NO: 205063 - protein, 11 aa, Tick-borne encephalitis virus
EMMVLGLATLG

SEQ ID NO: 205064 - protein, 11 aa, Tick-borne encephalitis virus
MMVLGLATLGV

SEQ ID NO: 205065 - protein, 11 aa, Tick-borne encephalitis virus
MVLGLATLGVV

SEQ ID NO: 205066 - protein, 11 aa, Tick-borne encephalitis virus
VLGLATLGVVW

SEQ ID NO: 205067 - protein, 11 aa, Tick-borne encephalitis virus
LGLATLGVVWC

SEQ ID NO: 205068 - protein, 11 aa, Tick-borne encephalitis virus
GLATLGVVWCF

SEQ ID NO: 205069 - protein, 11 aa, Tick-borne encephalitis virus
LATLGVVWCFV

SEQ ID NO: 205070 - protein, 11 aa, Tick-borne encephalitis virus
ATLGVVWCFVV

SEQ ID NO: 205071 - protein, 11 aa, Tick-borne encephalitis virus
TLGVVWCFVVR

SEQ ID NO: 205072 - protein, 11 aa, Tick-borne encephalitis virus
LGVVWCFVVRT

SEQ ID NO: 205073 - protein, 11 aa, Tick-borne encephalitis virus
GVVWCFVVRTS

SEQ ID NO: 205074 - protein, 11 aa, Tick-borne encephalitis virus
VVWCFVVRTSI

SEQ ID NO: 205075 - protein, 11 aa, Tick-borne encephalitis virus
VWCFVVRTSIS

SEQ ID NO: 205076 - protein, 11 aa, Tick-borne encephalitis virus
WCFVVRTSISR

SEQ ID NO: 205077 - protein, 11 aa, Tick-borne encephalitis virus
CFVVRTSISRM

SEQ ID NO: 205078 - protein, 11 aa, Tick-borne encephalitis virus
FVVRTSISRMM

SEQ ID NO: 205079 - protein, 11 aa, Tick-borne encephalitis virus
VVRTSISRMML

SEQ ID NO: 205080 - protein, 11 aa, Tick-borne encephalitis virus
VRTSISRMMLG

SEQ ID NO: 205081 - protein, 11 aa, Tick-borne encephalitis virus
RTSISRMMLGT

SEQ ID NO: 205082 - protein, 11 aa, Tick-borne encephalitis virus
TSISRMMLGTL

SEQ ID NO: 205083 - protein, 11 aa, Tick-borne encephalitis virus
SISRMMLGTLV

SEQ ID NO: 205084 - protein, 11 aa, Tick-borne encephalitis virus
ISRMMLGTLVL

SEQ ID NO: 205085 - protein, 11 aa, Tick-borne encephalitis virus
SRMMLGTLVLL

SEQ ID NO: 205086 - protein, 11 aa, Tick-borne encephalitis virus
RMMLGTLVLLA

SEQ ID NO: 205087 - protein, 11 aa, Tick-borne encephalitis virus
MMLGTLVLLAS

SEQ ID NO: 205088 - protein, 11 aa, Tick-borne encephalitis virus
MLGTLVLLASL

SEQ ID NO: 205089 - protein, 11 aa, Tick-borne encephalitis virus
LGTLVLLASLA

SEQ ID NO: 205090 - protein, 11 aa, Tick-borne encephalitis virus
GTLVLLASLAL

SEQ ID NO: 205091 - protein, 11 aa, Tick-borne encephalitis virus
TLVLLASLALL

SEQ ID NO: 205092 - protein, 11 aa, Tick-borne encephalitis virus
LVLLASLALLW

SEQ ID NO: 205093 - protein, 11 aa, Tick-borne encephalitis virus
VLLASLALLWA

SEQ ID NO: 205094 - protein, 11 aa, Tick-borne encephalitis virus
LLASLALLWAG

SEQ ID NO: 205095 - protein, 11 aa, Tick-borne encephalitis virus
LASLALLWAGG

SEQ ID NO: 205096 - protein, 11 aa, Tick-borne encephalitis virus
ASLALLWAGGV

SEQ ID NO: 205097 - protein, 11 aa, Tick-borne encephalitis virus
SLALLWAGGVS

SEQ ID NO: 205098 - protein, 11 aa, Tick-borne encephalitis virus
LALLWAGGVSY

SEQ ID NO: 205099 - protein, 11 aa, Tick-borne encephalitis virus
ALLWAGGVSYG

SEQ ID NO: 205100 - protein, 11 aa, Tick-borne encephalitis virus
LLWAGGVSYGN

SEQ ID NO: 205101 - protein, 11 aa, Tick-borne encephalitis virus
LWAGGVSYGNM

SEQ ID NO: 205102 - protein, 11 aa, Tick-borne encephalitis virus
WAGGVSYGNMA

SEQ ID NO: 205103 - protein, 11 aa, Tick-borne encephalitis virus
AGGVSYGNMAG

SEQ ID NO: 205104 - protein, 11 aa, Tick-borne encephalitis virus
GGVSYGNMAGV

SEQ ID NO: 205105 - protein, 11 aa, Tick-borne encephalitis virus
GVSYGNMAGVA

SEQ ID NO: 205106 - protein, 11 aa, Tick-borne encephalitis virus
VSYGNMAGVAL

SEQ ID NO: 205107 - protein, 11 aa, Tick-borne encephalitis virus
SYGNMAGVALI

SEQ ID NO: 205108 - protein, 11 aa, Tick-borne encephalitis virus
YGNMAGVALIF

SEQ ID NO: 205109 - protein, 11 aa, Tick-borne encephalitis virus
GNMAGVALIFY

SEQ ID NO: 205110 - protein, 11 aa, Tick-borne encephalitis virus
NMAGVALIFYT

SEQ ID NO: 205111 - protein, 11 aa, Tick-borne encephalitis virus
MAGVALIFYTL

SEQ ID NO: 205112 - protein, 11 aa, Tick-borne encephalitis virus
AGVALIFYTLL

SEQ ID NO: 205113 - protein, 11 aa, Tick-borne encephalitis virus
GVALIFYTLLT

SEQ ID NO: 205114 - protein, 11 aa, Tick-borne encephalitis virus
VALIFYTLLTV

SEQ ID NO: 205115 - protein, 11 aa, Tick-borne encephalitis virus
ALIFYTLLTVL

SEQ ID NO: 205116 - protein, 11 aa, Tick-borne encephalitis virus
LIFYTLLTVLQ

SEQ ID NO: 205117 - protein, 11 aa, Tick-borne encephalitis virus
IFYTLLTVLQP

SEQ ID NO: 205118 - protein, 11 aa, Tick-borne encephalitis virus
FYTLLTVLQPE

SEQ ID NO: 205119 - protein, 11 aa, Tick-borne encephalitis virus
YTLLTVLQPEA

SEQ ID NO: 205120 - protein, 11 aa, Tick-borne encephalitis virus
TLLTVLQPEAG

SEQ ID NO: 205121 - protein, 11 aa, Tick-borne encephalitis virus
LLTVLQPEAGK

SEQ ID NO: 205122 - protein, 11 aa, Tick-borne encephalitis virus
LTVLQPEAGKQ

SEQ ID NO: 205123 - protein, 11 aa, Tick-borne encephalitis virus
TVLQPEAGKQR

SEQ ID NO: 205124 - protein, 11 aa, Tick-borne encephalitis virus
VLQPEAGKQRS

SEQ ID NO: 205125 - protein, 11 aa, Tick-borne encephalitis virus
LQPEAGKQRSS

SEQ ID NO: 205126 - protein, 11 aa, Tick-borne encephalitis virus
QPEAGKQRSSD

SEQ ID NO: 205127 - protein, 11 aa, Tick-borne encephalitis virus
PEAGKQRSSDD

SEQ ID NO: 205128 - protein, 11 aa, Tick-borne encephalitis virus
EAGKQRSSDDN

SEQ ID NO: 205129 - protein, 11 aa, Tick-borne encephalitis virus
AGKQRSSDDNK

SEQ ID NO: 205130 - protein, 11 aa, Tick-borne encephalitis virus
GKQRSSDDNKL

SEQ ID NO: 205131 - protein, 11 aa, Tick-borne encephalitis virus
KQRSSDDNKLA

SEQ ID NO: 205132 - protein, 11 aa, Tick-borne encephalitis virus
QRSSDDNKLAY

SEQ ID NO: 205133 - protein, 11 aa, Tick-borne encephalitis virus
RSSDDNKLAYF

SEQ ID NO: 205134 - protein, 11 aa, Tick-borne encephalitis virus
SSDDNKLAYFL

SEQ ID NO: 205135 - protein, 11 aa, Tick-borne encephalitis virus
SDDNKLAYFLL

SEQ ID NO: 205136 - protein, 11 aa, Tick-borne encephalitis virus
DDNKLAYFLLT

SEQ ID NO: 205137 - protein, 11 aa, Tick-borne encephalitis virus
DNKLAYFLLTL

SEQ ID NO: 205138 - protein, 11 aa, Tick-borne encephalitis virus
NKLAYFLLTLC

SEQ ID NO: 205139 - protein, 11 aa, Tick-borne encephalitis virus
KLAYFLLTLCS

SEQ ID NO: 205140 - protein, 11 aa, Tick-borne encephalitis virus
LAYFLLTLCSL

SEQ ID NO: 205141 - protein, 11 aa, Tick-borne encephalitis virus
AYFLLTLCSLA

SEQ ID NO: 205142 - protein, 11 aa, Tick-borne encephalitis virus
YFLLTLCSLAG

SEQ ID NO: 205143 - protein, 11 aa, Tick-borne encephalitis virus
FLLTLCSLAGL

SEQ ID NO: 205144 - protein, 11 aa, Tick-borne encephalitis virus
LLTLCSLAGLV

SEQ ID NO: 205145 - protein, 11 aa, Tick-borne encephalitis virus
LTLCSLAGLVA

SEQ ID NO: 205146 - protein, 11 aa, Tick-borne encephalitis virus
TLCSLAGLVAA

SEQ ID NO: 205147 - protein, 11 aa, Tick-borne encephalitis virus
LCSLAGLVAAN

SEQ ID NO: 205148 - protein, 11 aa, Tick-borne encephalitis virus
CSLAGLVAANE

SEQ ID NO: 205149 - protein, 11 aa, Tick-borne encephalitis virus
SLAGLVAANEM

SEQ ID NO: 205150 - protein, 11 aa, Tick-borne encephalitis virus
LAGLVAANEMG

SEQ ID NO: 205151 - protein, 11 aa, Tick-borne encephalitis virus
AGLVAANEMGF

SEQ ID NO: 205152 - protein, 11 aa, Tick-borne encephalitis virus
GLVAANEMGFL

SEQ ID NO: 205153 - protein, 11 aa, Tick-borne encephalitis virus
LVAANEMGFLE

SEQ ID NO: 205154 - protein, 11 aa, Tick-borne encephalitis virus
VAANEMGFLEK

SEQ ID NO: 205155 - protein, 11 aa, Tick-borne encephalitis virus
AANEMGFLEKT

SEQ ID NO: 205156 - protein, 11 aa, Tick-borne encephalitis virus
ANEMGFLEKTK

SEQ ID NO: 205157 - protein, 11 aa, Tick-borne encephalitis virus
NEMGFLEKTKA

SEQ ID NO: 205158 - protein, 11 aa, Tick-borne encephalitis virus
EMGFLEKTKAD

SEQ ID NO: 205159 - protein, 11 aa, Tick-borne encephalitis virus
MGFLEKTKADL

SEQ ID NO: 205160 - protein, 11 aa, Tick-borne encephalitis virus
GFLEKTKADLS

SEQ ID NO: 205161 - protein, 11 aa, Tick-borne encephalitis virus
FLEKTKADLST

SEQ ID NO: 205162 - protein, 11 aa, Tick-borne encephalitis virus
LEKTKADLSTV

SEQ ID NO: 205163 - protein, 11 aa, Tick-borne encephalitis virus
EKTKADLSTVL

SEQ ID NO: 205164 - protein, 11 aa, Tick-borne encephalitis virus
KTKADLSTVLW

SEQ ID NO: 205165 - protein, 11 aa, Tick-borne encephalitis virus
TKADLSTVLWS

SEQ ID NO: 205166 - protein, 11 aa, Tick-borne encephalitis virus
ELRSWEEWTNI

SEQ ID NO: 205167 - protein, 11 aa, Tick-borne encephalitis virus
LRSWEEWTNID

SEQ ID NO: 205168 - protein, 11 aa, Tick-borne encephalitis virus
RSWEEWTNIDI

SEQ ID NO: 205169 - protein, 11 aa, Tick-borne encephalitis virus
SWEEWTNIDIQ

SEQ ID NO: 205170 - protein, 11 aa, Tick-borne encephalitis virus
WEEWTNIDIQP

SEQ ID NO: 205171 - protein, 11 aa, Tick-borne encephalitis virus
EEWTNIDIQPA

SEQ ID NO: 205172 - protein, 11 aa, Tick-borne encephalitis virus
EWTNIDIQPAR

SEQ ID NO: 205173 - protein, 11 aa, Tick-borne encephalitis virus
WTNIDIQPARS

SEQ ID NO: 205174 - protein, 11 aa, Tick-borne encephalitis virus
TNIDIQPARSW

SEQ ID NO: 205175 - protein, 11 aa, Tick-borne encephalitis virus
NIDIQPARSWG

SEQ ID NO: 205176 - protein, 11 aa, Tick-borne encephalitis virus
IDIQPARSWGT

SEQ ID NO: 205177 - protein, 11 aa, Tick-borne encephalitis virus
DIQPARSWGTY

SEQ ID NO: 205178 - protein, 11 aa, Tick-borne encephalitis virus
IQPARSWGTYV

SEQ ID NO: 205179 - protein, 11 aa, Tick-borne encephalitis virus
QPARSWGTYVL

SEQ ID NO: 205180 - protein, 11 aa, Tick-borne encephalitis virus
PARSWGTYVLV

SEQ ID NO: 205181 - protein, 11 aa, Tick-borne encephalitis virus
ARSWGTYVLVV

SEQ ID NO: 205182 - protein, 11 aa, Tick-borne encephalitis virus
RSWGTYVLVVS

SEQ ID NO: 205183 - protein, 11 aa, Tick-borne encephalitis virus
SWGTYVLVVSL

SEQ ID NO: 205184 - protein, 11 aa, Tick-borne encephalitis virus
WGTYVLVVSLF

SEQ ID NO: 205185 - protein, 11 aa, Tick-borne encephalitis virus
GTYVLVVSLFT

SEQ ID NO: 205186 - protein, 11 aa, Tick-borne encephalitis virus
TYVLVVSLFTP

SEQ ID NO: 205187 - protein, 11 aa, Tick-borne encephalitis virus
YVLVVSLFTPY

SEQ ID NO: 205188 - protein, 11 aa, Tick-borne encephalitis virus
VLVVSLFTPYI

SEQ ID NO: 205189 - protein, 11 aa, Tick-borne encephalitis virus
LVVSLFTPYII

SEQ ID NO: 205190 - protein, 11 aa, Tick-borne encephalitis virus
VVSLFTPYIIH

SEQ ID NO: 205191 - protein, 11 aa, Tick-borne encephalitis virus
VSLFTPYIIHQ

SEQ ID NO: 205192 - protein, 11 aa, Tick-borne encephalitis virus
SLFTPYIIHQL

SEQ ID NO: 205193 - protein, 11 aa, Tick-borne encephalitis virus
LFTPYIIHQLQ

SEQ ID NO: 205194 - protein, 11 aa, Tick-borne encephalitis virus
FTPYIIHQLQT

SEQ ID NO: 205195 - protein, 11 aa, Tick-borne encephalitis virus
TPYIIHQLQTK

SEQ ID NO: 205196 - protein, 11 aa, Tick-borne encephalitis virus
PYIIHQLQTKI

SEQ ID NO: 205197 - protein, 11 aa, Tick-borne encephalitis virus
YIIHQLQTKIQ

SEQ ID NO: 205198 - protein, 11 aa, Tick-borne encephalitis virus
IIHQLQTKIQQ

SEQ ID NO: 205199 - protein, 11 aa, Tick-borne encephalitis virus
IHQLQTKIQQL

SEQ ID NO: 205200 - protein, 11 aa, Tick-borne encephalitis virus
HQLQTKIQQLV

SEQ ID NO: 205201 - protein, 11 aa, Tick-borne encephalitis virus
QLQTKIQQLVN

SEQ ID NO: 205202 - protein, 11 aa, Tick-borne encephalitis virus
LQTKIQQLVNS

SEQ ID NO: 205203 - protein, 11 aa, Tick-borne encephalitis virus
QTKIQQLVNSA

SEQ ID NO: 205204 - protein, 11 aa, Tick-borne encephalitis virus
TKIQQLVNSAV

SEQ ID NO: 205205 - protein, 11 aa, Tick-borne encephalitis virus
KIQQLVNSAVA

SEQ ID NO: 205206 - protein, 11 aa, Tick-borne encephalitis virus
IQQLVNSAVAT

SEQ ID NO: 205207 - protein, 11 aa, Tick-borne encephalitis virus
QQLVNSAVATG

SEQ ID NO: 205208 - protein, 11 aa, Tick-borne encephalitis virus
QLVNSAVATGA

SEQ ID NO: 205209 - protein, 11 aa, Tick-borne encephalitis virus
LVNSAVATGAQ

SEQ ID NO: 205210 - protein, 11 aa, Tick-borne encephalitis virus
VNSAVATGAQA

SEQ ID NO: 205211 - protein, 11 aa, Tick-borne encephalitis virus
NSAVATGAQAM

SEQ ID NO: 205212 - protein, 11 aa, Tick-borne encephalitis virus
SAVATGAQAMR

SEQ ID NO: 205213 - protein, 11 aa, Tick-borne encephalitis virus
AVATGAQAMRD

SEQ ID NO: 205214 - protein, 11 aa, Tick-borne encephalitis virus
VATGAQAMRDL

SEQ ID NO: 205215 - protein, 11 aa, Tick-borne encephalitis virus
ATGAQAMRDLG

SEQ ID NO: 205216 - protein, 11 aa, Tick-borne encephalitis virus
TGAQAMRDLGG

SEQ ID NO: 205217 - protein, 11 aa, Tick-borne encephalitis virus
GAQAMRDLGGG

SEQ ID NO: 205218 - protein, 11 aa, Tick-borne encephalitis virus
AQAMRDLGGGA

SEQ ID NO: 205219 - protein, 11 aa, Tick-borne encephalitis virus
QAMRDLGGGAP

SEQ ID NO: 205220 - protein, 11 aa, Tick-borne encephalitis virus
AMRDLGGGAPF

SEQ ID NO: 205221 - protein, 11 aa, Tick-borne encephalitis virus
MRDLGGGAPFF

SEQ ID NO: 205222 - protein, 11 aa, Tick-borne encephalitis virus
RDLGGGAPFFG

SEQ ID NO: 205223 - protein, 11 aa, Tick-borne encephalitis virus
DLGGGAPFFGV

SEQ ID NO: 205224 - protein, 11 aa, Tick-borne encephalitis virus
LGGGAPFFGVA

SEQ ID NO: 205225 - protein, 11 aa, Tick-borne encephalitis virus
GGGAPFFGVAG

SEQ ID NO: 205226 - protein, 11 aa, Tick-borne encephalitis virus
GGAPFFGVAGH

SEQ ID NO: 205227 - protein, 11 aa, Tick-borne encephalitis virus
GAPFFGVAGHV

SEQ ID NO: 205228 - protein, 11 aa, Tick-borne encephalitis virus
GVAGHVMALGV

SEQ ID NO: 205229 - protein, 11 aa, Tick-borne encephalitis virus
VAGHVMALGVV

SEQ ID NO: 205230 - protein, 11 aa, Tick-borne encephalitis virus
AGHVMALGVVS

SEQ ID NO: 205231 - protein, 11 aa, Tick-borne encephalitis virus
GHVMALGVVSL

SEQ ID NO: 205232 - protein, 11 aa, Tick-borne encephalitis virus
HVMALGVVSLV

SEQ ID NO: 205233 - protein, 11 aa, Tick-borne encephalitis virus
VMALGVVSLVG

SEQ ID NO: 205234 - protein, 11 aa, Tick-borne encephalitis virus
MALGVVSLVGA

SEQ ID NO: 205235 - protein, 11 aa, Tick-borne encephalitis virus
ALGVVSLVGAT

SEQ ID NO: 205236 - protein, 11 aa, Tick-borne encephalitis virus
LGVVSLVGATP

SEQ ID NO: 205237 - protein, 11 aa, Tick-borne encephalitis virus
GVVSLVGATPT

SEQ ID NO: 205238 - protein, 11 aa, Tick-borne encephalitis virus
VVSLVGATPTS

SEQ ID NO: 205239 - protein, 11 aa, Tick-borne encephalitis virus
VSLVGATPTSL

SEQ ID NO: 205240 - protein, 11 aa, Tick-borne encephalitis virus
SLVGATPTSLV

SEQ ID NO: 205241 - protein, 11 aa, Tick-borne encephalitis virus
LVGATPTSLVV

SEQ ID NO: 205242 - protein, 11 aa, Tick-borne encephalitis virus
VGATPTSLVVG

SEQ ID NO: 205243 - protein, 11 aa, Tick-borne encephalitis virus
GATPTSLVVGV

SEQ ID NO: 205244 - protein, 11 aa, Tick-borne encephalitis virus
ATPTSLVVGVG

SEQ ID NO: 205245 - protein, 11 aa, Tick-borne encephalitis virus
TPTSLVVGVGL

SEQ ID NO: 205246 - protein, 11 aa, Tick-borne encephalitis virus
PTSLVVGVGLA

SEQ ID NO: 205247 - protein, 11 aa, Tick-borne encephalitis virus
TSLVVGVGLAA

SEQ ID NO: 205248 - protein, 11 aa, Tick-borne encephalitis virus
SLVVGVGLAAF

SEQ ID NO: 205249 - protein, 11 aa, Tick-borne encephalitis virus
LVVGVGLAAFH

SEQ ID NO: 205250 - protein, 11 aa, Tick-borne encephalitis virus
VVGVGLAAFHL

SEQ ID NO: 205251 - protein, 11 aa, Tick-borne encephalitis virus
VGVGLAAFHLA

SEQ ID NO: 205252 - protein, 11 aa, Tick-borne encephalitis virus
GVGLAAFHLAI

SEQ ID NO: 205253 - protein, 11 aa, Tick-borne encephalitis virus
VGLAAFHLAIV

SEQ ID NO: 205254 - protein, 11 aa, Tick-borne encephalitis virus
GLAAFHLAIVV

SEQ ID NO: 205255 - protein, 11 aa, Tick-borne encephalitis virus
LAAFHLAIVVS

SEQ ID NO: 205256 - protein, 11 aa, Tick-borne encephalitis virus
AAFHLAIVVSG

SEQ ID NO: 205257 - protein, 11 aa, Tick-borne encephalitis virus
AFHLAIVVSGL

SEQ ID NO: 205258 - protein, 11 aa, Tick-borne encephalitis virus
FHLAIVVSGLE

SEQ ID NO: 205259 - protein, 11 aa, Tick-borne encephalitis virus
HLAIVVSGLEA

SEQ ID NO: 205260 - protein, 11 aa, Tick-borne encephalitis virus
LAIVVSGLEAE

SEQ ID NO: 205261 - protein, 11 aa, Tick-borne encephalitis virus
AIVVSGLEAEL

SEQ ID NO: 205262 - protein, 11 aa, Tick-borne encephalitis virus
IVVSGLEAELT

SEQ ID NO: 205263 - protein, 11 aa, Tick-borne encephalitis virus
VVSGLEAELTQ

SEQ ID NO: 205264 - protein, 11 aa, Tick-borne encephalitis virus
VSGLEAELTQR

SEQ ID NO: 205265 - protein, 11 aa, Tick-borne encephalitis virus
SGLEAELTQRA

SEQ ID NO: 205266 - protein, 11 aa, Tick-borne encephalitis virus
GLEAELTQRAH

SEQ ID NO: 205267 - protein, 11 aa, Tick-borne encephalitis virus
LEAELTQRAHK

SEQ ID NO: 205268 - protein, 11 aa, Tick-borne encephalitis virus
EAELTQRAHKV

SEQ ID NO: 205269 - protein, 11 aa, Tick-borne encephalitis virus
AELTQRAHKVF

SEQ ID NO: 205270 - protein, 11 aa, Tick-borne encephalitis virus
ELTQRAHKVFF

SEQ ID NO: 205271 - protein, 11 aa, Tick-borne encephalitis virus
LTQRAHKVFFS

SEQ ID NO: 205272 - protein, 11 aa, Tick-borne encephalitis virus
TQRAHKVFFSA

SEQ ID NO: 205273 - protein, 11 aa, Tick-borne encephalitis virus
QRAHKVFFSAM

SEQ ID NO: 205274 - protein, 11 aa, Tick-borne encephalitis virus
RAHKVFFSAMV

SEQ ID NO: 205275 - protein, 11 aa, Tick-borne encephalitis virus
AHKVFFSAMVR

SEQ ID NO: 205276 - protein, 11 aa, Tick-borne encephalitis virus
HKVFFSAMVRN

SEQ ID NO: 205277 - protein, 11 aa, Tick-borne encephalitis virus
KVFFSAMVRNP

SEQ ID NO: 205278 - protein, 11 aa, Tick-borne encephalitis virus
VFFSAMVRNPM

SEQ ID NO: 205279 - protein, 11 aa, Tick-borne encephalitis virus
FFSAMVRNPMV

SEQ ID NO: 205280 - protein, 11 aa, Tick-borne encephalitis virus
FSAMVRNPMVD

SEQ ID NO: 205281 - protein, 11 aa, Tick-borne encephalitis virus
SAMVRNPMVDG

SEQ ID NO: 205282 - protein, 11 aa, Tick-borne encephalitis virus
AMVRNPMVDGD

SEQ ID NO: 205283 - protein, 11 aa, Tick-borne encephalitis virus
MVRNPMVDGDV

SEQ ID NO: 205284 - protein, 11 aa, Tick-borne encephalitis virus
VRNPMVDGDVI

SEQ ID NO: 205285 - protein, 11 aa, Tick-borne encephalitis virus
RNPMVDGDVIN

SEQ ID NO: 205286 - protein, 11 aa, Tick-borne encephalitis virus
NPMVDGDVINP

SEQ ID NO: 205287 - protein, 11 aa, Tick-borne encephalitis virus
PMVDGDVINPF

SEQ ID NO: 205288 - protein, 11 aa, Tick-borne encephalitis virus
MVDGDVINPFG

SEQ ID NO: 205289 - protein, 11 aa, Tick-borne encephalitis virus
VDGDVINPFGE

SEQ ID NO: 205290 - protein, 11 aa, Tick-borne encephalitis virus
DGDVINPFGEG

SEQ ID NO: 205291 - protein, 11 aa, Tick-borne encephalitis virus
GDVINPFGEGE

SEQ ID NO: 205292 - protein, 11 aa, Tick-borne encephalitis virus
DVINPFGEGEA

SEQ ID NO: 205293 - protein, 11 aa, Tick-borne encephalitis virus
VINPFGEGEAK

SEQ ID NO: 205294 - protein, 11 aa, Tick-borne encephalitis virus
INPFGEGEAKP

SEQ ID NO: 205295 - protein, 11 aa, Tick-borne encephalitis virus
NPFGEGEAKPA

SEQ ID NO: 205296 - protein, 11 aa, Tick-borne encephalitis virus
PFGEGEAKPAL

SEQ ID NO: 205297 - protein, 11 aa, Tick-borne encephalitis virus
FGEGEAKPALY

SEQ ID NO: 205298 - protein, 11 aa, Tick-borne encephalitis virus
GEGEAKPALYE

SEQ ID NO: 205299 - protein, 11 aa, Tick-borne encephalitis virus
EGEAKPALYER

SEQ ID NO: 205300 - protein, 11 aa, Tick-borne encephalitis virus
GEAKPALYERK

SEQ ID NO: 205301 - protein, 11 aa, Tick-borne encephalitis virus
EAKPALYERKM

SEQ ID NO: 205302 - protein, 11 aa, Tick-borne encephalitis virus
AKPALYERKMS

SEQ ID NO: 205303 - protein, 11 aa, Tick-borne encephalitis virus
KPALYERKMSL

SEQ ID NO: 205304 - protein, 11 aa, Tick-borne encephalitis virus
PALYERKMSLV

SEQ ID NO: 205305 - protein, 11 aa, Tick-borne encephalitis virus
ALYERKMSLVL

SEQ ID NO: 205306 - protein, 11 aa, Tick-borne encephalitis virus
LYERKMSLVLA

SEQ ID NO: 205307 - protein, 11 aa, Tick-borne encephalitis virus
YERKMSLVLAI

SEQ ID NO: 205308 - protein, 11 aa, Tick-borne encephalitis virus
MSLVLAIVLCL

SEQ ID NO: 205309 - protein, 11 aa, Tick-borne encephalitis virus
VLCLMSVVMNR

SEQ ID NO: 205310 - protein, 11 aa, Tick-borne encephalitis virus
LCLMSVVMNRT

SEQ ID NO: 205311 - protein, 11 aa, Tick-borne encephalitis virus
CLMSVVMNRTV

SEQ ID NO: 205312 - protein, 11 aa, Tick-borne encephalitis virus
SVVMNRTVPSI

SEQ ID NO: 205313 - protein, 11 aa, Tick-borne encephalitis virus
VVMNRTVPSIT

SEQ ID NO: 205314 - protein, 11 aa, Tick-borne encephalitis virus
VMNRTVPSITE

SEQ ID NO: 205315 - protein, 11 aa, Tick-borne encephalitis virus
MNRTVPSITEA

SEQ ID NO: 205316 - protein, 11 aa, Tick-borne encephalitis virus
NRTVPSITEAS

SEQ ID NO: 205317 - protein, 11 aa, Tick-borne encephalitis virus
RTVPSITEASA

SEQ ID NO: 205318 - protein, 11 aa, Tick-borne encephalitis virus
TVPSITEASAV

SEQ ID NO: 205319 - protein, 11 aa, Tick-borne encephalitis virus
VPSITEASAVG

SEQ ID NO: 205320 - protein, 11 aa, Tick-borne encephalitis virus
PSITEASAVGL

SEQ ID NO: 205321 - protein, 11 aa, Tick-borne encephalitis virus
SITEASAVGLA

SEQ ID NO: 205322 - protein, 11 aa, Tick-borne encephalitis virus
ITEASAVGLAA

SEQ ID NO: 205323 - protein, 11 aa, Tick-borne encephalitis virus
TEASAVGLAAA

SEQ ID NO: 205324 - protein, 11 aa, Tick-borne encephalitis virus
EASAVGLAAAG

SEQ ID NO: 205325 - protein, 11 aa, Tick-borne encephalitis virus
ASAVGLAAAGQ

SEQ ID NO: 205326 - protein, 11 aa, Tick-borne encephalitis virus
SAVGLAAAGQL

SEQ ID NO: 205327 - protein, 11 aa, Tick-borne encephalitis virus
AVGLAAAGQLL

SEQ ID NO: 205328 - protein, 11 aa, Tick-borne encephalitis virus
VGLAAAGQLLR

SEQ ID NO: 205329 - protein, 11 aa, Tick-borne encephalitis virus
GLAAAGQLLRP

SEQ ID NO: 205330 - protein, 11 aa, Tick-borne encephalitis virus
LAAAGQLLRPE

SEQ ID NO: 205331 - protein, 11 aa, Tick-borne encephalitis virus
GQLLRPEADTL

SEQ ID NO: 205332 - protein, 11 aa, Tick-borne encephalitis virus
QLLRPEADTLW

SEQ ID NO: 205333 - protein, 11 aa, Tick-borne encephalitis virus
LLRPEADTLWT

SEQ ID NO: 205334 - protein, 11 aa, Tick-borne encephalitis virus
LRPEADTLWTM

SEQ ID NO: 205335 - protein, 11 aa, Tick-borne encephalitis virus
RPEADTLWTMP

SEQ ID NO: 205336 - protein, 11 aa, Tick-borne encephalitis virus
PEADTLWTMPV

SEQ ID NO: 205337 - protein, 11 aa, Tick-borne encephalitis virus
EADTLWTMPVA

SEQ ID NO: 205338 - protein, 11 aa, Tick-borne encephalitis virus
ADTLWTMPVAC

SEQ ID NO: 205339 - protein, 11 aa, Tick-borne encephalitis virus
DTLWTMPVACG

SEQ ID NO: 205340 - protein, 11 aa, Tick-borne encephalitis virus
TLWTMPVACGL

SEQ ID NO: 205341 - protein, 11 aa, Tick-borne encephalitis virus
LWTMPVACGLS

SEQ ID NO: 205342 - protein, 11 aa, Tick-borne encephalitis virus
WTMPVACGLSG

SEQ ID NO: 205343 - protein, 11 aa, Tick-borne encephalitis virus
TMPVACGLSGV

SEQ ID NO: 205344 - protein, 11 aa, Tick-borne encephalitis virus
MPVACGLSGVV

SEQ ID NO: 205345 - protein, 11 aa, Tick-borne encephalitis virus
PVACGLSGVVR

SEQ ID NO: 205346 - protein, 11 aa, Tick-borne encephalitis virus
VACGLSGVVRG

SEQ ID NO: 205347 - protein, 11 aa, Tick-borne encephalitis virus
ACGLSGVVRGS

SEQ ID NO: 205348 - protein, 11 aa, Tick-borne encephalitis virus
CGLSGVVRGSL

SEQ ID NO: 205349 - protein, 11 aa, Tick-borne encephalitis virus
GLSGVVRGSLW

SEQ ID NO: 205350 - protein, 11 aa, Tick-borne encephalitis virus
LSGVVRGSLWG

SEQ ID NO: 205351 - protein, 11 aa, Tick-borne encephalitis virus
SGVVRGSLWGF

SEQ ID NO: 205352 - protein, 11 aa, Tick-borne encephalitis virus
GVVRGSLWGFL

SEQ ID NO: 205353 - protein, 11 aa, Tick-borne encephalitis virus
VVRGSLWGFLP

SEQ ID NO: 205354 - protein, 11 aa, Tick-borne encephalitis virus
VRGSLWGFLPL

SEQ ID NO: 205355 - protein, 11 aa, Tick-borne encephalitis virus
RGSLWGFLPLG

SEQ ID NO: 205356 - protein, 11 aa, Tick-borne encephalitis virus
GSLWGFLPLGH

SEQ ID NO: 205357 - protein, 11 aa, Tick-borne encephalitis virus
SLWGFLPLGHR

SEQ ID NO: 205358 - protein, 11 aa, Tick-borne encephalitis virus
LWGFLPLGHRL

SEQ ID NO: 205359 - protein, 11 aa, Tick-borne encephalitis virus
WGFLPLGHRLW

SEQ ID NO: 205360 - protein, 11 aa, Tick-borne encephalitis virus
GFLPLGHRLWL

SEQ ID NO: 205361 - protein, 11 aa, Tick-borne encephalitis virus
FLPLGHRLWLR

SEQ ID NO: 205362 - protein, 11 aa, Tick-borne encephalitis virus
LPLGHRLWLRA

SEQ ID NO: 205363 - protein, 11 aa, Tick-borne encephalitis virus
PLGHRLWLRAS

SEQ ID NO: 205364 - protein, 11 aa, Tick-borne encephalitis virus
LGHRLWLRASG

SEQ ID NO: 205365 - protein, 11 aa, Tick-borne encephalitis virus
GHRLWLRASGS

SEQ ID NO: 205366 - protein, 11 aa, Tick-borne encephalitis virus
HRLWLRASGSR

SEQ ID NO: 205367 - protein, 11 aa, Tick-borne encephalitis virus
RLWLRASGSRR

SEQ ID NO: 205368 - protein, 11 aa, Tick-borne encephalitis virus
LWLRASGSRRG

SEQ ID NO: 205369 - protein, 11 aa, Tick-borne encephalitis virus
WLRASGSRRGG

SEQ ID NO: 205370 - protein, 11 aa, Tick-borne encephalitis virus
LRASGSRRGGS

SEQ ID NO: 205371 - protein, 11 aa, Tick-borne encephalitis virus
RASGSRRGGSE

SEQ ID NO: 205372 - protein, 11 aa, Tick-borne encephalitis virus
ASGSRRGGSEG

SEQ ID NO: 205373 - protein, 11 aa, Tick-borne encephalitis virus
SGSRRGGSEGD

SEQ ID NO: 205374 - protein, 11 aa, Tick-borne encephalitis virus
GSRRGGSEGDT

SEQ ID NO: 205375 - protein, 11 aa, Tick-borne encephalitis virus
SRRGGSEGDTL

SEQ ID NO: 205376 - protein, 11 aa, Tick-borne encephalitis virus
RRGGSEGDTLG

SEQ ID NO: 205377 - protein, 11 aa, Tick-borne encephalitis virus
RGGSEGDTLGD

SEQ ID NO: 205378 - protein, 11 aa, Tick-borne encephalitis virus
GGSEGDTLGDL

SEQ ID NO: 205379 - protein, 11 aa, Tick-borne encephalitis virus
GSEGDTLGDLW

SEQ ID NO: 205380 - protein, 11 aa, Tick-borne encephalitis virus
SEGDTLGDLWK

SEQ ID NO: 205381 - protein, 11 aa, Tick-borne encephalitis virus
EGDTLGDLWKR

SEQ ID NO: 205382 - protein, 11 aa, Tick-borne encephalitis virus
GDTLGDLWKRK

SEQ ID NO: 205383 - protein, 11 aa, Tick-borne encephalitis virus
DTLGDLWKRKL

SEQ ID NO: 205384 - protein, 11 aa, Tick-borne encephalitis virus
TLGDLWKRKLN

SEQ ID NO: 205385 - protein, 11 aa, Tick-borne encephalitis virus
LNGCTKEEFFA

SEQ ID NO: 205386 - protein, 11 aa, Tick-borne encephalitis virus
NGCTKEEFFAY

SEQ ID NO: 205387 - protein, 11 aa, Tick-borne encephalitis virus
GCTKEEFFAYR

SEQ ID NO: 205388 - protein, 11 aa, Tick-borne encephalitis virus
CTKEEFFAYRR

SEQ ID NO: 205389 - protein, 11 aa, Tick-borne encephalitis virus
EEFFAYRRTGI

SEQ ID NO: 205390 - protein, 11 aa, Tick-borne encephalitis virus
EFFAYRRTGIL

SEQ ID NO: 205391 - protein, 11 aa, Tick-borne encephalitis virus
FFAYRRTGILE

SEQ ID NO: 205392 - protein, 11 aa, Tick-borne encephalitis virus
FAYRRTGILET

SEQ ID NO: 205393 - protein, 11 aa, Tick-borne encephalitis virus
AYRRTGILETE

SEQ ID NO: 205394 - protein, 11 aa, Tick-borne encephalitis virus
YRRTGILETER

SEQ ID NO: 205395 - protein, 11 aa, Tick-borne encephalitis virus
RRTGILETERD

SEQ ID NO: 205396 - protein, 11 aa, Tick-borne encephalitis virus
RTGILETERDK

SEQ ID NO: 205397 - protein, 11 aa, Tick-borne encephalitis virus
TGILETERDKA

SEQ ID NO: 205398 - protein, 11 aa, Tick-borne encephalitis virus
GILETERDKAR

SEQ ID NO: 205399 - protein, 11 aa, Tick-borne encephalitis virus
ILETERDKARE

SEQ ID NO: 205400 - protein, 11 aa, Tick-borne encephalitis virus
LETERDKAREL

SEQ ID NO: 205401 - protein, 11 aa, Tick-borne encephalitis virus
ETERDKARELL

SEQ ID NO: 205402 - protein, 11 aa, Tick-borne encephalitis virus
TERDKARELLR

SEQ ID NO: 205403 - protein, 11 aa, Tick-borne encephalitis virus
ERDKARELLRR

SEQ ID NO: 205404 - protein, 11 aa, Tick-borne encephalitis virus
RDKARELLRRG

SEQ ID NO: 205405 - protein, 11 aa, Tick-borne encephalitis virus
DKARELLRRGE

SEQ ID NO: 205406 - protein, 11 aa, Tick-borne encephalitis virus
KARELLRRGET

SEQ ID NO: 205407 - protein, 11 aa, Tick-borne encephalitis virus
ARELLRRGETN

SEQ ID NO: 205408 - protein, 11 aa, Tick-borne encephalitis virus
RGETNMGLAVS

SEQ ID NO: 205409 - protein, 11 aa, Tick-borne encephalitis virus
GETNMGLAVSR

SEQ ID NO: 205410 - protein, 11 aa, Tick-borne encephalitis virus
ETNMGLAVSRG

SEQ ID NO: 205411 - protein, 11 aa, Tick-borne encephalitis virus
TNMGLAVSRGT

SEQ ID NO: 205412 - protein, 11 aa, Tick-borne encephalitis virus
NMGLAVSRGTA

SEQ ID NO: 205413 - protein, 11 aa, Tick-borne encephalitis virus
MGLAVSRGTAK

SEQ ID NO: 205414 - protein, 11 aa, Tick-borne encephalitis virus
GLAVSRGTAKL

SEQ ID NO: 205415 - protein, 11 aa, Tick-borne encephalitis virus
LAVSRGTAKLA

SEQ ID NO: 205416 - protein, 11 aa, Tick-borne encephalitis virus
AVSRGTAKLAW

SEQ ID NO: 205417 - protein, 11 aa, Tick-borne encephalitis virus
VSRGTAKLAWL

SEQ ID NO: 205418 - protein, 11 aa, Tick-borne encephalitis virus
SRGTAKLAWLE

SEQ ID NO: 205419 - protein, 11 aa, Tick-borne encephalitis virus
RGTAKLAWLEE

SEQ ID NO: 205420 - protein, 11 aa, Tick-borne encephalitis virus
GTAKLAWLEER

SEQ ID NO: 205421 - protein, 11 aa, Tick-borne encephalitis virus
TAKLAWLEERG

SEQ ID NO: 205422 - protein, 11 aa, Tick-borne encephalitis virus
AKLAWLEERGY

SEQ ID NO: 205423 - protein, 11 aa, Tick-borne encephalitis virus
KLAWLEERGYA

SEQ ID NO: 205424 - protein, 11 aa, Tick-borne encephalitis virus
LAWLEERGYAT

SEQ ID NO: 205425 - protein, 11 aa, Tick-borne encephalitis virus
AWLEERGYATL

SEQ ID NO: 205426 - protein, 11 aa, Tick-borne encephalitis virus
WLEERGYATLK

SEQ ID NO: 205427 - protein, 11 aa, Tick-borne encephalitis virus
LEERGYATLKG

SEQ ID NO: 205428 - protein, 11 aa, Tick-borne encephalitis virus
EERGYATLKGE

SEQ ID NO: 205429 - protein, 11 aa, Tick-borne encephalitis virus
ERGYATLKGEV

SEQ ID NO: 205430 - protein, 11 aa, Tick-borne encephalitis virus
RGYATLKGEVV

SEQ ID NO: 205431 - protein, 11 aa, Tick-borne encephalitis virus
GYATLKGEVVD

SEQ ID NO: 205432 - protein, 11 aa, Tick-borne encephalitis virus
YATLKGEVVDL

SEQ ID NO: 205433 - protein, 11 aa, Tick-borne encephalitis virus
ATLKGEVVDLG

SEQ ID NO: 205434 - protein, 11 aa, Tick-borne encephalitis virus
TLKGEVVDLGC

SEQ ID NO: 205435 - protein, 11 aa, Tick-borne encephalitis virus
LKGEVVDLGCG

SEQ ID NO: 205436 - protein, 11 aa, Tick-borne encephalitis virus
KGEVVDLGCGR

SEQ ID NO: 205437 - protein, 11 aa, Tick-borne encephalitis virus
GEVVDLGCGRG

SEQ ID NO: 205438 - protein, 11 aa, Tick-borne encephalitis virus
EVVDLGCGRGG

SEQ ID NO: 205439 - protein, 11 aa, Tick-borne encephalitis virus
VVDLGCGRGGW

SEQ ID NO: 205440 - protein, 11 aa, Tick-borne encephalitis virus
VDLGCGRGGWS

SEQ ID NO: 205441 - protein, 11 aa, Tick-borne encephalitis virus
DLGCGRGGWSY

SEQ ID NO: 205442 - protein, 11 aa, Tick-borne encephalitis virus
LGCGRGGWSYY

SEQ ID NO: 205443 - protein, 11 aa, Tick-borne encephalitis virus
GCGRGGWSYYA

SEQ ID NO: 205444 - protein, 11 aa, Tick-borne encephalitis virus
CGRGGWSYYAA

SEQ ID NO: 205445 - protein, 11 aa, Tick-borne encephalitis virus
GRGGWSYYAAS

SEQ ID NO: 205446 - protein, 11 aa, Tick-borne encephalitis virus
RGGWSYYAASR

SEQ ID NO: 205447 - protein, 11 aa, Tick-borne encephalitis virus
GGWSYYAASRP

SEQ ID NO: 205448 - protein, 11 aa, Tick-borne encephalitis virus
GWSYYAASRPA

SEQ ID NO: 205449 - protein, 11 aa, Tick-borne encephalitis virus
WSYYAASRPAV

SEQ ID NO: 205450 - protein, 11 aa, Tick-borne encephalitis virus
SYYAASRPAVM

SEQ ID NO: 205451 - protein, 11 aa, Tick-borne encephalitis virus
YYAASRPAVMS

SEQ ID NO: 205452 - protein, 11 aa, Tick-borne encephalitis virus
YAASRPAVMSV

SEQ ID NO: 205453 - protein, 11 aa, Tick-borne encephalitis virus
AASRPAVMSVK

SEQ ID NO: 205454 - protein, 11 aa, Tick-borne encephalitis virus
ASRPAVMSVKA

SEQ ID NO: 205455 - protein, 11 aa, Tick-borne encephalitis virus
SRPAVMSVKAY

SEQ ID NO: 205456 - protein, 11 aa, Tick-borne encephalitis virus
RPAVMSVKAYT

SEQ ID NO: 205457 - protein, 11 aa, Tick-borne encephalitis virus
PAVMSVKAYTI

SEQ ID NO: 205458 - protein, 11 aa, Tick-borne encephalitis virus
AVMSVKAYTIG

SEQ ID NO: 205459 - protein, 11 aa, Tick-borne encephalitis virus
VMSVKAYTIGG

SEQ ID NO: 205460 - protein, 11 aa, Tick-borne encephalitis virus
MSVKAYTIGGK

SEQ ID NO: 205461 - protein, 11 aa, Tick-borne encephalitis virus
SVKAYTIGGKG

SEQ ID NO: 205462 - protein, 11 aa, Tick-borne encephalitis virus
VKAYTIGGKGH

SEQ ID NO: 205463 - protein, 11 aa, Tick-borne encephalitis virus
KAYTIGGKGHE

SEQ ID NO: 205464 - protein, 11 aa, Tick-borne encephalitis virus
AYTIGGKGHET

SEQ ID NO: 205465 - protein, 11 aa, Tick-borne encephalitis virus
YTIGGKGHETP

SEQ ID NO: 205466 - protein, 11 aa, Tick-borne encephalitis virus
TIGGKGHETPK

SEQ ID NO: 205467 - protein, 11 aa, Tick-borne encephalitis virus
IGGKGHETPKM

SEQ ID NO: 205468 - protein, 11 aa, Tick-borne encephalitis virus
GGKGHETPKMV

SEQ ID NO: 205469 - protein, 11 aa, Tick-borne encephalitis virus
GKGHETPKMVT

SEQ ID NO: 205470 - protein, 11 aa, Tick-borne encephalitis virus
KGHETPKMVTS

SEQ ID NO: 205471 - protein, 11 aa, Tick-borne encephalitis virus
GHETPKMVTSL

SEQ ID NO: 205472 - protein, 11 aa, Tick-borne encephalitis virus
HETPKMVTSLG

SEQ ID NO: 205473 - protein, 11 aa, Tick-borne encephalitis virus
ETPKMVTSLGW

SEQ ID NO: 205474 - protein, 11 aa, Tick-borne encephalitis virus
TPKMVTSLGWN

SEQ ID NO: 205475 - protein, 11 aa, Tick-borne encephalitis virus
PKMVTSLGWNL

SEQ ID NO: 205476 - protein, 11 aa, Tick-borne encephalitis virus
KMVTSLGWNLI

SEQ ID NO: 205477 - protein, 11 aa, Tick-borne encephalitis virus
MVTSLGWNLIK

SEQ ID NO: 205478 - protein, 11 aa, Tick-borne encephalitis virus
VTSLGWNLIKF

SEQ ID NO: 205479 - protein, 11 aa, Tick-borne encephalitis virus
TSLGWNLIKFR

SEQ ID NO: 205480 - protein, 11 aa, Tick-borne encephalitis virus
SLGWNLIKFRA

SEQ ID NO: 205481 - protein, 11 aa, Tick-borne encephalitis virus
LGWNLIKFRAG

SEQ ID NO: 205482 - protein, 11 aa, Tick-borne encephalitis virus
GWNLIKFRAGM

SEQ ID NO: 205483 - protein, 11 aa, Tick-borne encephalitis virus
WNLIKFRAGMD

SEQ ID NO: 205484 - protein, 11 aa, Tick-borne encephalitis virus
NLIKFRAGMDV

SEQ ID NO: 205485 - protein, 11 aa, Tick-borne encephalitis virus
LIKFRAGMDVF

SEQ ID NO: 205486 - protein, 11 aa, Tick-borne encephalitis virus
IKFRAGMDVFS

SEQ ID NO: 205487 - protein, 11 aa, Tick-borne encephalitis virus
KFRAGMDVFSM

SEQ ID NO: 205488 - protein, 11 aa, Tick-borne encephalitis virus
FRAGMDVFSMQ

SEQ ID NO: 205489 - protein, 11 aa, Tick-borne encephalitis virus
RAGMDVFSMQP

SEQ ID NO: 205490 - protein, 11 aa, Tick-borne encephalitis virus
AGMDVFSMQPH

SEQ ID NO: 205491 - protein, 11 aa, Tick-borne encephalitis virus
GMDVFSMQPHR

SEQ ID NO: 205492 - protein, 11 aa, Tick-borne encephalitis virus
MDVFSMQPHRA

SEQ ID NO: 205493 - protein, 11 aa, Tick-borne encephalitis virus
DVFSMQPHRAD

SEQ ID NO: 205494 - protein, 11 aa, Tick-borne encephalitis virus
VFSMQPHRADT

SEQ ID NO: 205495 - protein, 11 aa, Tick-borne encephalitis virus
FSMQPHRADTI

SEQ ID NO: 205496 - protein, 11 aa, Tick-borne encephalitis virus
SMQPHRADTIM

SEQ ID NO: 205497 - protein, 11 aa, Tick-borne encephalitis virus
MQPHRADTIMC

SEQ ID NO: 205498 - protein, 11 aa, Tick-borne encephalitis virus
QPHRADTIMCD

SEQ ID NO: 205499 - protein, 11 aa, Tick-borne encephalitis virus
PHRADTIMCDI

SEQ ID NO: 205500 - protein, 11 aa, Tick-borne encephalitis virus
HRADTIMCDIG

SEQ ID NO: 205501 - protein, 11 aa, Tick-borne encephalitis virus
RADTIMCDIGE

SEQ ID NO: 205502 - protein, 11 aa, Tick-borne encephalitis virus
ADTIMCDIGES

SEQ ID NO: 205503 - protein, 11 aa, Tick-borne encephalitis virus
DTIMCDIGESN

SEQ ID NO: 205504 - protein, 11 aa, Tick-borne encephalitis virus
TIMCDIGESNP

SEQ ID NO: 205505 - protein, 11 aa, Tick-borne encephalitis virus
IMCDIGESNPD

SEQ ID NO: 205506 - protein, 11 aa, Tick-borne encephalitis virus
MCDIGESNPDA

SEQ ID NO: 205507 - protein, 11 aa, Tick-borne encephalitis virus
CDIGESNPDAV

SEQ ID NO: 205508 - protein, 11 aa, Tick-borne encephalitis virus
DIGESNPDAVV

SEQ ID NO: 205509 - protein, 11 aa, Tick-borne encephalitis virus
IGESNPDAVVE

SEQ ID NO: 205510 - protein, 11 aa, Tick-borne encephalitis virus
GESNPDAVVEG

SEQ ID NO: 205511 - protein, 11 aa, Tick-borne encephalitis virus
ESNPDAVVEGE

SEQ ID NO: 205512 - protein, 11 aa, Tick-borne encephalitis virus
SNPDAVVEGER

SEQ ID NO: 205513 - protein, 11 aa, Tick-borne encephalitis virus
NPDAVVEGERT

SEQ ID NO: 205514 - protein, 11 aa, Tick-borne encephalitis virus
PDAVVEGERTR

SEQ ID NO: 205515 - protein, 11 aa, Tick-borne encephalitis virus
DAVVEGERTRK

SEQ ID NO: 205516 - protein, 11 aa, Tick-borne encephalitis virus
AVVEGERTRKV

SEQ ID NO: 205517 - protein, 11 aa, Tick-borne encephalitis virus
VVEGERTRKVI

SEQ ID NO: 205518 - protein, 11 aa, Tick-borne encephalitis virus
VEGERTRKVIL

SEQ ID NO: 205519 - protein, 11 aa, Tick-borne encephalitis virus
EGERTRKVILL

SEQ ID NO: 205520 - protein, 11 aa, Tick-borne encephalitis virus
GERTRKVILLM

SEQ ID NO: 205521 - protein, 11 aa, Tick-borne encephalitis virus
ERTRKVILLME

SEQ ID NO: 205522 - protein, 11 aa, Tick-borne encephalitis virus
RTRKVILLMEQ

SEQ ID NO: 205523 - protein, 11 aa, Tick-borne encephalitis virus
TRKVILLMEQW

SEQ ID NO: 205524 - protein, 11 aa, Tick-borne encephalitis virus
RKVILLMEQWK

SEQ ID NO: 205525 - protein, 11 aa, Tick-borne encephalitis virus
KVILLMEQWKN

SEQ ID NO: 205526 - protein, 11 aa, Tick-borne encephalitis virus
VILLMEQWKNR

SEQ ID NO: 205527 - protein, 11 aa, Tick-borne encephalitis virus
ILLMEQWKNRN

SEQ ID NO: 205528 - protein, 11 aa, Tick-borne encephalitis virus
LLMEQWKNRNP

SEQ ID NO: 205529 - protein, 11 aa, Tick-borne encephalitis virus
LMEQWKNRNPT

SEQ ID NO: 205530 - protein, 11 aa, Tick-borne encephalitis virus
MEQWKNRNPTA

SEQ ID NO: 205531 - protein, 11 aa, Tick-borne encephalitis virus
EQWKNRNPTAT

SEQ ID NO: 205532 - protein, 11 aa, Tick-borne encephalitis virus
QWKNRNPTATC

SEQ ID NO: 205533 - protein, 11 aa, Tick-borne encephalitis virus
WKNRNPTATCV

SEQ ID NO: 205534 - protein, 11 aa, Tick-borne encephalitis virus
KNRNPTATCVF

SEQ ID NO: 205535 - protein, 11 aa, Tick-borne encephalitis virus
NRNPTATCVFK

SEQ ID NO: 205536 - protein, 11 aa, Tick-borne encephalitis virus
RNPTATCVFKV

SEQ ID NO: 205537 - protein, 11 aa, Tick-borne encephalitis virus
NPTATCVFKVL

SEQ ID NO: 205538 - protein, 11 aa, Tick-borne encephalitis virus
PTATCVFKVLA

SEQ ID NO: 205539 - protein, 11 aa, Tick-borne encephalitis virus
TATCVFKVLAP

SEQ ID NO: 205540 - protein, 11 aa, Tick-borne encephalitis virus
ATCVFKVLAPY

SEQ ID NO: 205541 - protein, 11 aa, Tick-borne encephalitis virus
TCVFKVLAPYR

SEQ ID NO: 205542 - protein, 11 aa, Tick-borne encephalitis virus
CVFKVLAPYRP

SEQ ID NO: 205543 - protein, 11 aa, Tick-borne encephalitis virus
VFKVLAPYRPE

SEQ ID NO: 205544 - protein, 11 aa, Tick-borne encephalitis virus
FKVLAPYRPEV

SEQ ID NO: 205545 - protein, 11 aa, Tick-borne encephalitis virus
KVLAPYRPEVI

SEQ ID NO: 205546 - protein, 11 aa, Tick-borne encephalitis virus
VLAPYRPEVIE

SEQ ID NO: 205547 - protein, 11 aa, Tick-borne encephalitis virus
LAPYRPEVIEA

SEQ ID NO: 205548 - protein, 11 aa, Tick-borne encephalitis virus
APYRPEVIEAL

SEQ ID NO: 205549 - protein, 11 aa, Tick-borne encephalitis virus
PYRPEVIEALH

SEQ ID NO: 205550 - protein, 11 aa, Tick-borne encephalitis virus
YRPEVIEALHR

SEQ ID NO: 205551 - protein, 11 aa, Tick-borne encephalitis virus
RPEVIEALHRF

SEQ ID NO: 205552 - protein, 11 aa, Tick-borne encephalitis virus
PEVIEALHRFQ

SEQ ID NO: 205553 - protein, 11 aa, Tick-borne encephalitis virus
EVIEALHRFQL

SEQ ID NO: 205554 - protein, 11 aa, Tick-borne encephalitis virus
VIEALHRFQLQ

SEQ ID NO: 205555 - protein, 11 aa, Tick-borne encephalitis virus
IEALHRFQLQW

SEQ ID NO: 205556 - protein, 11 aa, Tick-borne encephalitis virus
EALHRFQLQWG

SEQ ID NO: 205557 - protein, 11 aa, Tick-borne encephalitis virus
ALHRFQLQWGG

SEQ ID NO: 205558 - protein, 11 aa, Tick-borne encephalitis virus
LHRFQLQWGGG

SEQ ID NO: 205559 - protein, 11 aa, Tick-borne encephalitis virus
HRFQLQWGGGL

SEQ ID NO: 205560 - protein, 11 aa, Tick-borne encephalitis virus
RFQLQWGGGLV

SEQ ID NO: 205561 - protein, 11 aa, Tick-borne encephalitis virus
FQLQWGGGLVR

SEQ ID NO: 205562 - protein, 11 aa, Tick-borne encephalitis virus
QLQWGGGLVRT

SEQ ID NO: 205563 - protein, 11 aa, Tick-borne encephalitis virus
LQWGGGLVRTP

SEQ ID NO: 205564 - protein, 11 aa, Tick-borne encephalitis virus
QWGGGLVRTPF

SEQ ID NO: 205565 - protein, 11 aa, Tick-borne encephalitis virus
WGGGLVRTPFS

SEQ ID NO: 205566 - protein, 11 aa, Tick-borne encephalitis virus
GGGLVRTPFSR

SEQ ID NO: 205567 - protein, 11 aa, Tick-borne encephalitis virus
GGLVRTPFSRN

SEQ ID NO: 205568 - protein, 11 aa, Tick-borne encephalitis virus
GLVRTPFSRNS

SEQ ID NO: 205569 - protein, 11 aa, Tick-borne encephalitis virus
LVRTPFSRNST

SEQ ID NO: 205570 - protein, 11 aa, Tick-borne encephalitis virus
VRTPFSRNSTH

SEQ ID NO: 205571 - protein, 11 aa, Tick-borne encephalitis virus
RTPFSRNSTHE

SEQ ID NO: 205572 - protein, 11 aa, Tick-borne encephalitis virus
TPFSRNSTHEM

SEQ ID NO: 205573 - protein, 11 aa, Tick-borne encephalitis virus
PFSRNSTHEMY

SEQ ID NO: 205574 - protein, 11 aa, Tick-borne encephalitis virus
FSRNSTHEMYY

SEQ ID NO: 205575 - protein, 11 aa, Tick-borne encephalitis virus
SRNSTHEMYYS

SEQ ID NO: 205576 - protein, 11 aa, Tick-borne encephalitis virus
RNSTHEMYYST

SEQ ID NO: 205577 - protein, 11 aa, Tick-borne encephalitis virus
NSTHEMYYSTA

SEQ ID NO: 205578 - protein, 11 aa, Tick-borne encephalitis virus
STHEMYYSTAV

SEQ ID NO: 205579 - protein, 11 aa, Tick-borne encephalitis virus
THEMYYSTAVT

SEQ ID NO: 205580 - protein, 11 aa, Tick-borne encephalitis virus
HEMYYSTAVTG

SEQ ID NO: 205581 - protein, 11 aa, Tick-borne encephalitis virus
EMYYSTAVTGN

SEQ ID NO: 205582 - protein, 11 aa, Tick-borne encephalitis virus
MYYSTAVTGNI

SEQ ID NO: 205583 - protein, 11 aa, Tick-borne encephalitis virus
YYSTAVTGNIV

SEQ ID NO: 205584 - protein, 11 aa, Tick-borne encephalitis virus
YSTAVTGNIVN

SEQ ID NO: 205585 - protein, 11 aa, Tick-borne encephalitis virus
STAVTGNIVNS

SEQ ID NO: 205586 - protein, 11 aa, Tick-borne encephalitis virus
TAVTGNIVNSV

SEQ ID NO: 205587 - protein, 11 aa, Tick-borne encephalitis virus
AVTGNIVNSVN

SEQ ID NO: 205588 - protein, 11 aa, Tick-borne encephalitis virus
VTGNIVNSVNI

SEQ ID NO: 205589 - protein, 11 aa, Tick-borne encephalitis virus
TGNIVNSVNIQ

SEQ ID NO: 205590 - protein, 11 aa, Tick-borne encephalitis virus
GNIVNSVNIQS

SEQ ID NO: 205591 - protein, 11 aa, Tick-borne encephalitis virus
NIVNSVNIQSR

SEQ ID NO: 205592 - protein, 11 aa, Tick-borne encephalitis virus
IVNSVNIQSRK

SEQ ID NO: 205593 - protein, 11 aa, Tick-borne encephalitis virus
VNSVNIQSRKL

SEQ ID NO: 205594 - protein, 11 aa, Tick-borne encephalitis virus
NSVNIQSRKLL

SEQ ID NO: 205595 - protein, 11 aa, Tick-borne encephalitis virus
SVNIQSRKLLA

SEQ ID NO: 205596 - protein, 11 aa, Tick-borne encephalitis virus
VNIQSRKLLAR

SEQ ID NO: 205597 - protein, 11 aa, Tick-borne encephalitis virus
NIQSRKLLARF

SEQ ID NO: 205598 - protein, 11 aa, Tick-borne encephalitis virus
IQSRKLLARFG

SEQ ID NO: 205599 - protein, 11 aa, Tick-borne encephalitis virus
QSRKLLARFGD

SEQ ID NO: 205600 - protein, 11 aa, Tick-borne encephalitis virus
SRKLLARFGDQ

SEQ ID NO: 205601 - protein, 11 aa, Tick-borne encephalitis virus
RKLLARFGDQR

SEQ ID NO: 205602 - protein, 11 aa, Tick-borne encephalitis virus
KLLARFGDQRG

SEQ ID NO: 205603 - protein, 11 aa, Tick-borne encephalitis virus
LLARFGDQRGP

SEQ ID NO: 205604 - protein, 11 aa, Tick-borne encephalitis virus
LARFGDQRGPT

SEQ ID NO: 205605 - protein, 11 aa, Tick-borne encephalitis virus
ARFGDQRGPTR

SEQ ID NO: 205606 - protein, 11 aa, Tick-borne encephalitis virus
RFGDQRGPTRV

SEQ ID NO: 205607 - protein, 11 aa, Tick-borne encephalitis virus
FGDQRGPTRVP

SEQ ID NO: 205608 - protein, 11 aa, Tick-borne encephalitis virus
GDQRGPTRVPE

SEQ ID NO: 205609 - protein, 11 aa, Tick-borne encephalitis virus
DQRGPTRVPEL

SEQ ID NO: 205610 - protein, 11 aa, Tick-borne encephalitis virus
QRGPTRVPELD

SEQ ID NO: 205611 - protein, 11 aa, Tick-borne encephalitis virus
RGPTRVPELDL

SEQ ID NO: 205612 - protein, 11 aa, Tick-borne encephalitis virus
GPTRVPELDLG

SEQ ID NO: 205613 - protein, 11 aa, Tick-borne encephalitis virus
PTRVPELDLGV

SEQ ID NO: 205614 - protein, 11 aa, Tick-borne encephalitis virus
TRVPELDLGVG

SEQ ID NO: 205615 - protein, 11 aa, Tick-borne encephalitis virus
RVPELDLGVGT

SEQ ID NO: 205616 - protein, 11 aa, Tick-borne encephalitis virus
VPELDLGVGTR

SEQ ID NO: 205617 - protein, 11 aa, Tick-borne encephalitis virus
PELDLGVGTRC

SEQ ID NO: 205618 - protein, 11 aa, Tick-borne encephalitis virus
ELDLGVGTRCV

SEQ ID NO: 205619 - protein, 11 aa, Tick-borne encephalitis virus
LDLGVGTRCVV

SEQ ID NO: 205620 - protein, 11 aa, Tick-borne encephalitis virus
DLGVGTRCVVL

SEQ ID NO: 205621 - protein, 11 aa, Tick-borne encephalitis virus
LGVGTRCVVLA

SEQ ID NO: 205622 - protein, 11 aa, Tick-borne encephalitis virus
GVGTRCVVLAE

SEQ ID NO: 205623 - protein, 11 aa, Tick-borne encephalitis virus
VGTRCVVLAED

SEQ ID NO: 205624 - protein, 11 aa, Tick-borne encephalitis virus
GTRCVVLAEDK

SEQ ID NO: 205625 - protein, 11 aa, Tick-borne encephalitis virus
TRCVVLAEDKV

SEQ ID NO: 205626 - protein, 11 aa, Tick-borne encephalitis virus
RCVVLAEDKVK

SEQ ID NO: 205627 - protein, 11 aa, Tick-borne encephalitis virus
CVVLAEDKVKE

SEQ ID NO: 205628 - protein, 11 aa, Tick-borne encephalitis virus
LAEDKVKEKDV

SEQ ID NO: 205629 - protein, 11 aa, Tick-borne encephalitis virus
DKVKEKDVQER

SEQ ID NO: 205630 - protein, 11 aa, Tick-borne encephalitis virus
KVKEKDVQERI

SEQ ID NO: 205631 - protein, 11 aa, Tick-borne encephalitis virus
ALREQYGETWH

SEQ ID NO: 205632 - protein, 11 aa, Tick-borne encephalitis virus
DREHPYRTWQY

SEQ ID NO: 205633 - protein, 11 aa, Tick-borne encephalitis virus
REHPYRTWQYW

SEQ ID NO: 205634 - protein, 11 aa, Tick-borne encephalitis virus
EHPYRTWQYWG

SEQ ID NO: 205635 - protein, 11 aa, Tick-borne encephalitis virus
HPYRTWQYWGS

SEQ ID NO: 205636 - protein, 11 aa, Tick-borne encephalitis virus
PYRTWQYWGSY

SEQ ID NO: 205637 - protein, 11 aa, Tick-borne encephalitis virus
YRTWQYWGSYR

SEQ ID NO: 205638 - protein, 11 aa, Tick-borne encephalitis virus
RTWQYWGSYRT

SEQ ID NO: 205639 - protein, 11 aa, Tick-borne encephalitis virus
TWQYWGSYRTA

SEQ ID NO: 205640 - protein, 11 aa, Tick-borne encephalitis virus
WQYWGSYRTAP

SEQ ID NO: 205641 - protein, 11 aa, Tick-borne encephalitis virus
QYWGSYRTAPT

SEQ ID NO: 205642 - protein, 11 aa, Tick-borne encephalitis virus
YWGSYRTAPTG

SEQ ID NO: 205643 - protein, 11 aa, Tick-borne encephalitis virus
WGSYRTAPTGS

SEQ ID NO: 205644 - protein, 11 aa, Tick-borne encephalitis virus
GSYRTAPTGSA

SEQ ID NO: 205645 - protein, 11 aa, Tick-borne encephalitis virus
SYRTAPTGSAA

SEQ ID NO: 205646 - protein, 11 aa, Tick-borne encephalitis virus
YRTAPTGSAAS

SEQ ID NO: 205647 - protein, 11 aa, Tick-borne encephalitis virus
RTAPTGSAASL

SEQ ID NO: 205648 - protein, 11 aa, Tick-borne encephalitis virus
TAPTGSAASLI

SEQ ID NO: 205649 - protein, 11 aa, Tick-borne encephalitis virus
APTGSAASLIN

SEQ ID NO: 205650 - protein, 11 aa, Tick-borne encephalitis virus
PTGSAASLING

SEQ ID NO: 205651 - protein, 11 aa, Tick-borne encephalitis virus
TGSAASLINGV

SEQ ID NO: 205652 - protein, 11 aa, Tick-borne encephalitis virus
GSAASLINGVV

SEQ ID NO: 205653 - protein, 11 aa, Tick-borne encephalitis virus
SAASLINGVVK

SEQ ID NO: 205654 - protein, 11 aa, Tick-borne encephalitis virus
AASLINGVVKL

SEQ ID NO: 205655 - protein, 11 aa, Tick-borne encephalitis virus
ASLINGVVKLL

SEQ ID NO: 205656 - protein, 11 aa, Tick-borne encephalitis virus
SLINGVVKLLS

SEQ ID NO: 205657 - protein, 11 aa, Tick-borne encephalitis virus
LINGVVKLLSW

SEQ ID NO: 205658 - protein, 11 aa, Tick-borne encephalitis virus
INGVVKLLSWP

SEQ ID NO: 205659 - protein, 11 aa, Tick-borne encephalitis virus
NGVVKLLSWPW

SEQ ID NO: 205660 - protein, 11 aa, Tick-borne encephalitis virus
GVVKLLSWPWN

SEQ ID NO: 205661 - protein, 11 aa, Tick-borne encephalitis virus
VVKLLSWPWNA

SEQ ID NO: 205662 - protein, 11 aa, Tick-borne encephalitis virus
VKLLSWPWNAR

SEQ ID NO: 205663 - protein, 11 aa, Tick-borne encephalitis virus
KLLSWPWNARE

SEQ ID NO: 205664 - protein, 11 aa, Tick-borne encephalitis virus
LLSWPWNARED

SEQ ID NO: 205665 - protein, 11 aa, Tick-borne encephalitis virus
LSWPWNAREDV

SEQ ID NO: 205666 - protein, 11 aa, Tick-borne encephalitis virus
SWPWNAREDVV

SEQ ID NO: 205667 - protein, 11 aa, Tick-borne encephalitis virus
WPWNAREDVVR

SEQ ID NO: 205668 - protein, 11 aa, Tick-borne encephalitis virus
PWNAREDVVRM

SEQ ID NO: 205669 - protein, 11 aa, Tick-borne encephalitis virus
WNAREDVVRMA

SEQ ID NO: 205670 - protein, 11 aa, Tick-borne encephalitis virus
NAREDVVRMAM

SEQ ID NO: 205671 - protein, 11 aa, Tick-borne encephalitis virus
AREDVVRMAMT

SEQ ID NO: 205672 - protein, 11 aa, Tick-borne encephalitis virus
REDVVRMAMTD

SEQ ID NO: 205673 - protein, 11 aa, Tick-borne encephalitis virus
EDVVRMAMTDT

SEQ ID NO: 205674 - protein, 11 aa, Tick-borne encephalitis virus
DVVRMAMTDTT

SEQ ID NO: 205675 - protein, 11 aa, Tick-borne encephalitis virus
VVRMAMTDTTA

SEQ ID NO: 205676 - protein, 11 aa, Tick-borne encephalitis virus
VRMAMTDTTAF

SEQ ID NO: 205677 - protein, 11 aa, Tick-borne encephalitis virus
RMAMTDTTAFG

SEQ ID NO: 205678 - protein, 11 aa, Tick-borne encephalitis virus
MAMTDTTAFGQ

SEQ ID NO: 205679 - protein, 11 aa, Tick-borne encephalitis virus
AMTDTTAFGQQ

SEQ ID NO: 205680 - protein, 11 aa, Tick-borne encephalitis virus
MTDTTAFGQQR

SEQ ID NO: 205681 - protein, 11 aa, Tick-borne encephalitis virus
TDTTAFGQQRV

SEQ ID NO: 205682 - protein, 11 aa, Tick-borne encephalitis virus
DTTAFGQQRVF

SEQ ID NO: 205683 - protein, 11 aa, Tick-borne encephalitis virus
TTAFGQQRVFK

SEQ ID NO: 205684 - protein, 11 aa, Tick-borne encephalitis virus
TAFGQQRVFKE

SEQ ID NO: 205685 - protein, 11 aa, Tick-borne encephalitis virus
AFGQQRVFKEK

SEQ ID NO: 205686 - protein, 11 aa, Tick-borne encephalitis virus
FGQQRVFKEKV

SEQ ID NO: 205687 - protein, 11 aa, Tick-borne encephalitis virus
GQQRVFKEKVD

SEQ ID NO: 205688 - protein, 11 aa, Tick-borne encephalitis virus
QQRVFKEKVDT

SEQ ID NO: 205689 - protein, 11 aa, Tick-borne encephalitis virus
QRVFKEKVDTK

SEQ ID NO: 205690 - protein, 11 aa, Tick-borne encephalitis virus
RVFKEKVDTKA

SEQ ID NO: 205691 - protein, 11 aa, Tick-borne encephalitis virus
VFKEKVDTKAQ

SEQ ID NO: 205692 - protein, 11 aa, Tick-borne encephalitis virus
FKEKVDTKAQE

SEQ ID NO: 205693 - protein, 11 aa, Tick-borne encephalitis virus
KEKVDTKAQEP

SEQ ID NO: 205694 - protein, 11 aa, Tick-borne encephalitis virus
EKVDTKAQEPQ

SEQ ID NO: 205695 - protein, 11 aa, Tick-borne encephalitis virus
KVDTKAQEPQP

SEQ ID NO: 205696 - protein, 11 aa, Tick-borne encephalitis virus
VDTKAQEPQPG

SEQ ID NO: 205697 - protein, 11 aa, Tick-borne encephalitis virus
DTKAQEPQPGT

SEQ ID NO: 205698 - protein, 11 aa, Tick-borne encephalitis virus
TKAQEPQPGTK

SEQ ID NO: 205699 - protein, 11 aa, Tick-borne encephalitis virus
KAQEPQPGTKV

SEQ ID NO: 205700 - protein, 11 aa, Tick-borne encephalitis virus
AQEPQPGTKVI

SEQ ID NO: 205701 - protein, 11 aa, Tick-borne encephalitis virus
QEPQPGTKVIM

SEQ ID NO: 205702 - protein, 11 aa, Tick-borne encephalitis virus
EPQPGTKVIMR

SEQ ID NO: 205703 - protein, 11 aa, Tick-borne encephalitis virus
PQPGTKVIMRA

SEQ ID NO: 205704 - protein, 11 aa, Tick-borne encephalitis virus
QPGTKVIMRAV

SEQ ID NO: 205705 - protein, 11 aa, Tick-borne encephalitis virus
PGTKVIMRAVN

SEQ ID NO: 205706 - protein, 11 aa, Tick-borne encephalitis virus
GTKVIMRAVND

SEQ ID NO: 205707 - protein, 11 aa, Tick-borne encephalitis virus
TKVIMRAVNDW

SEQ ID NO: 205708 - protein, 11 aa, Tick-borne encephalitis virus
KVIMRAVNDWI

SEQ ID NO: 205709 - protein, 11 aa, Tick-borne encephalitis virus
VIMRAVNDWIL

SEQ ID NO: 205710 - protein, 11 aa, Tick-borne encephalitis virus
IMRAVNDWILE

SEQ ID NO: 205711 - protein, 11 aa, Tick-borne encephalitis virus
MRAVNDWILER

SEQ ID NO: 205712 - protein, 11 aa, Tick-borne encephalitis virus
RAVNDWILERL

SEQ ID NO: 205713 - protein, 11 aa, Tick-borne encephalitis virus
AVNDWILERLA

SEQ ID NO: 205714 - protein, 11 aa, Tick-borne encephalitis virus
VNDWILERLAR

SEQ ID NO: 205715 - protein, 11 aa, Tick-borne encephalitis virus
NDWILERLARK

SEQ ID NO: 205716 - protein, 11 aa, Tick-borne encephalitis virus
DWILERLARKS

SEQ ID NO: 205717 - protein, 11 aa, Tick-borne encephalitis virus
KPRMCSREEFI

SEQ ID NO: 205718 - protein, 11 aa, Tick-borne encephalitis virus
PRMCSREEFIA

SEQ ID NO: 205719 - protein, 11 aa, Tick-borne encephalitis virus
RMCSREEFIAK

SEQ ID NO: 205720 - protein, 11 aa, Tick-borne encephalitis virus
MCSREEFIAKV

SEQ ID NO: 205721 - protein, 11 aa, Tick-borne encephalitis virus
CSREEFIAKVK

SEQ ID NO: 205722 - protein, 11 aa, Tick-borne encephalitis virus
SREEFIAKVKS

SEQ ID NO: 205723 - protein, 11 aa, Tick-borne encephalitis virus
REEFIAKVKSN

SEQ ID NO: 205724 - protein, 11 aa, Tick-borne encephalitis virus
EEFIAKVKSNA

SEQ ID NO: 205725 - protein, 11 aa, Tick-borne encephalitis virus
EFIAKVKSNAA

SEQ ID NO: 205726 - protein, 11 aa, Tick-borne encephalitis virus
FIAKVKSNAAL

SEQ ID NO: 205727 - protein, 11 aa, Tick-borne encephalitis virus
IAKVKSNAALG

SEQ ID NO: 205728 - protein, 11 aa, Tick-borne encephalitis virus
AKVKSNAALGA

SEQ ID NO: 205729 - protein, 11 aa, Tick-borne encephalitis virus
KVKSNAALGAW

SEQ ID NO: 205730 - protein, 11 aa, Tick-borne encephalitis virus
VKSNAALGAWS

SEQ ID NO: 205731 - protein, 11 aa, Tick-borne encephalitis virus
KSNAALGAWSD

SEQ ID NO: 205732 - protein, 11 aa, Tick-borne encephalitis virus
SNAALGAWSDE

SEQ ID NO: 205733 - protein, 11 aa, Tick-borne encephalitis virus
NAALGAWSDEQ

SEQ ID NO: 205734 - protein, 11 aa, Tick-borne encephalitis virus
AALGAWSDEQN

SEQ ID NO: 205735 - protein, 11 aa, Tick-borne encephalitis virus
ALGAWSDEQNR

SEQ ID NO: 205736 - protein, 11 aa, Tick-borne encephalitis virus
LGAWSDEQNRW

SEQ ID NO: 205737 - protein, 11 aa, Tick-borne encephalitis virus
GAWSDEQNRWS

SEQ ID NO: 205738 - protein, 11 aa, Tick-borne encephalitis virus
SAKEAVEDPAF

SEQ ID NO: 205739 - protein, 11 aa, Tick-borne encephalitis virus
AKEAVEDPAFW

SEQ ID NO: 205740 - protein, 11 aa, Tick-borne encephalitis virus
EAVEDPAFWQL

SEQ ID NO: 205741 - protein, 11 aa, Tick-borne encephalitis virus
AVEDPAFWQLV

SEQ ID NO: 205742 - protein, 11 aa, Tick-borne encephalitis virus
VEDPAFWQLVD

SEQ ID NO: 205743 - protein, 11 aa, Tick-borne encephalitis virus
EDPAFWQLVDE

SEQ ID NO: 205744 - protein, 11 aa, Tick-borne encephalitis virus
DPAFWQLVDEE

SEQ ID NO: 205745 - protein, 11 aa, Tick-borne encephalitis virus
PAFWQLVDEER

SEQ ID NO: 205746 - protein, 11 aa, Tick-borne encephalitis virus
AFWQLVDEERE

SEQ ID NO: 205747 - protein, 11 aa, Tick-borne encephalitis virus
FWQLVDEERER

SEQ ID NO: 205748 - protein, 11 aa, Tick-borne encephalitis virus
WQLVDEERERH

SEQ ID NO: 205749 - protein, 11 aa, Tick-borne encephalitis virus
QLVDEERERHL

SEQ ID NO: 205750 - protein, 11 aa, Tick-borne encephalitis virus
LVDEERERHLA

SEQ ID NO: 205751 - protein, 11 aa, Tick-borne encephalitis virus
VDEERERHLAG

SEQ ID NO: 205752 - protein, 11 aa, Tick-borne encephalitis virus
DEERERHLAGR

SEQ ID NO: 205753 - protein, 11 aa, Tick-borne encephalitis virus
EERERHLAGRC

SEQ ID NO: 205754 - protein, 11 aa, Tick-borne encephalitis virus
ERERHLAGRCA

SEQ ID NO: 205755 - protein, 11 aa, Tick-borne encephalitis virus
RERHLAGRCAH

SEQ ID NO: 205756 - protein, 11 aa, Tick-borne encephalitis virus
ERHLAGRCAHC

SEQ ID NO: 205757 - protein, 11 aa, Tick-borne encephalitis virus
RHLAGRCAHCV

SEQ ID NO: 205758 - protein, 11 aa, Tick-borne encephalitis virus
GRCAHCVYNMM

SEQ ID NO: 205759 - protein, 11 aa, Tick-borne encephalitis virus
RCAHCVYNMMG

SEQ ID NO: 205760 - protein, 11 aa, Tick-borne encephalitis virus
CAHCVYNMMGK

SEQ ID NO: 205761 - protein, 11 aa, Tick-borne encephalitis virus
AHCVYNMMGKR

SEQ ID NO: 205762 - protein, 11 aa, Tick-borne encephalitis virus
HCVYNMMGKRE

SEQ ID NO: 205763 - protein, 11 aa, Tick-borne encephalitis virus
CVYNMMGKREK

SEQ ID NO: 205764 - protein, 11 aa, Tick-borne encephalitis virus
VYNMMGKREKK

SEQ ID NO: 205765 - protein, 11 aa, Tick-borne encephalitis virus
YNMMGKREKKL

SEQ ID NO: 205766 - protein, 11 aa, Tick-borne encephalitis virus
NMMGKREKKLG

SEQ ID NO: 205767 - protein, 11 aa, Tick-borne encephalitis virus
MMGKREKKLGE

SEQ ID NO: 205768 - protein, 11 aa, Tick-borne encephalitis virus
MGKREKKLGEF

SEQ ID NO: 205769 - protein, 11 aa, Tick-borne encephalitis virus
GKREKKLGEFG

SEQ ID NO: 205770 - protein, 11 aa, Tick-borne encephalitis virus
KREKKLGEFGV

SEQ ID NO: 205771 - protein, 11 aa, Tick-borne encephalitis virus
REKKLGEFGVA

SEQ ID NO: 205772 - protein, 11 aa, Tick-borne encephalitis virus
EKKLGEFGVAK

SEQ ID NO: 205773 - protein, 11 aa, Tick-borne encephalitis virus
KKLGEFGVAKG

SEQ ID NO: 205774 - protein, 11 aa, Tick-borne encephalitis virus
KLGEFGVAKGS

SEQ ID NO: 205775 - protein, 11 aa, Tick-borne encephalitis virus
LGEFGVAKGSR

SEQ ID NO: 205776 - protein, 11 aa, Tick-borne encephalitis virus
GEFGVAKGSRA

SEQ ID NO: 205777 - protein, 11 aa, Tick-borne encephalitis virus
EFGVAKGSRAI

SEQ ID NO: 205778 - protein, 11 aa, Tick-borne encephalitis virus
FGVAKGSRAIW

SEQ ID NO: 205779 - protein, 11 aa, Tick-borne encephalitis virus
GVAKGSRAIWY

SEQ ID NO: 205780 - protein, 11 aa, Tick-borne encephalitis virus
VAKGSRAIWYM

SEQ ID NO: 205781 - protein, 11 aa, Tick-borne encephalitis virus
AKGSRAIWYMW

SEQ ID NO: 205782 - protein, 11 aa, Tick-borne encephalitis virus
KGSRAIWYMWL

SEQ ID NO: 205783 - protein, 11 aa, Tick-borne encephalitis virus
GSRAIWYMWLG

SEQ ID NO: 205784 - protein, 11 aa, Tick-borne encephalitis virus
SRAIWYMWLGS

SEQ ID NO: 205785 - protein, 11 aa, Tick-borne encephalitis virus
RAIWYMWLGSR

SEQ ID NO: 205786 - protein, 11 aa, Tick-borne encephalitis virus
AIWYMWLGSRF

SEQ ID NO: 205787 - protein, 11 aa, Tick-borne encephalitis virus
IWYMWLGSRFL

SEQ ID NO: 205788 - protein, 11 aa, Tick-borne encephalitis virus
WYMWLGSRFLE

SEQ ID NO: 205789 - protein, 11 aa, Tick-borne encephalitis virus
YMWLGSRFLEF

SEQ ID NO: 205790 - protein, 11 aa, Tick-borne encephalitis virus
MWLGSRFLEFE

SEQ ID NO: 205791 - protein, 11 aa, Tick-borne encephalitis virus
WLGSRFLEFEA

SEQ ID NO: 205792 - protein, 11 aa, Tick-borne encephalitis virus
LGSRFLEFEAL

SEQ ID NO: 205793 - protein, 11 aa, Tick-borne encephalitis virus
GSRFLEFEALG

SEQ ID NO: 205794 - protein, 11 aa, Tick-borne encephalitis virus
SRFLEFEALGF

SEQ ID NO: 205795 - protein, 11 aa, Tick-borne encephalitis virus
RFLEFEALGFL

SEQ ID NO: 205796 - protein, 11 aa, Tick-borne encephalitis virus
FLEFEALGFLN

SEQ ID NO: 205797 - protein, 11 aa, Tick-borne encephalitis virus
LEFEALGFLNE

SEQ ID NO: 205798 - protein, 11 aa, Tick-borne encephalitis virus
EFEALGFLNED

SEQ ID NO: 205799 - protein, 11 aa, Tick-borne encephalitis virus
FEALGFLNEDH

SEQ ID NO: 205800 - protein, 11 aa, Tick-borne encephalitis virus
EALGFLNEDHW

SEQ ID NO: 205801 - protein, 11 aa, Tick-borne encephalitis virus
ALGFLNEDHWA

SEQ ID NO: 205802 - protein, 11 aa, Tick-borne encephalitis virus
LGFLNEDHWAS

SEQ ID NO: 205803 - protein, 11 aa, Tick-borne encephalitis virus
GFLNEDHWASR

SEQ ID NO: 205804 - protein, 11 aa, Tick-borne encephalitis virus
FLNEDHWASRG

SEQ ID NO: 205805 - protein, 11 aa, Tick-borne encephalitis virus
LNEDHWASRGS

SEQ ID NO: 205806 - protein, 11 aa, Tick-borne encephalitis virus
NEDHWASRGSS

SEQ ID NO: 205807 - protein, 11 aa, Tick-borne encephalitis virus
EDHWASRGSSG

SEQ ID NO: 205808 - protein, 11 aa, Tick-borne encephalitis virus
DHWASRGSSGS

SEQ ID NO: 205809 - protein, 11 aa, Tick-borne encephalitis virus
HWASRGSSGSG

SEQ ID NO: 205810 - protein, 11 aa, Tick-borne encephalitis virus
WASRGSSGSGV

SEQ ID NO: 205811 - protein, 11 aa, Tick-borne encephalitis virus
ASRGSSGSGVE

SEQ ID NO: 205812 - protein, 11 aa, Tick-borne encephalitis virus
SRGSSGSGVEG

SEQ ID NO: 205813 - protein, 11 aa, Tick-borne encephalitis virus
RGSSGSGVEGI

SEQ ID NO: 205814 - protein, 11 aa, Tick-borne encephalitis virus
GSSGSGVEGIS

SEQ ID NO: 205815 - protein, 11 aa, Tick-borne encephalitis virus
SSGSGVEGISL

SEQ ID NO: 205816 - protein, 11 aa, Tick-borne encephalitis virus
SGSGVEGISLN

SEQ ID NO: 205817 - protein, 11 aa, Tick-borne encephalitis virus
GSGVEGISLNY

SEQ ID NO: 205818 - protein, 11 aa, Tick-borne encephalitis virus
SGVEGISLNYL

SEQ ID NO: 205819 - protein, 11 aa, Tick-borne encephalitis virus
GVEGISLNYLG

SEQ ID NO: 205820 - protein, 11 aa, Tick-borne encephalitis virus
VEGISLNYLGW

SEQ ID NO: 205821 - protein, 11 aa, Tick-borne encephalitis virus
EGISLNYLGWH

SEQ ID NO: 205822 - protein, 11 aa, Tick-borne encephalitis virus
GISLNYLGWHL

SEQ ID NO: 205823 - protein, 11 aa, Tick-borne encephalitis virus
ISLNYLGWHLK

SEQ ID NO: 205824 - protein, 11 aa, Tick-borne encephalitis virus
SLNYLGWYLKG

SEQ ID NO: 205825 - protein, 11 aa, Tick-borne encephalitis virus
LNYLGWHLKKL

SEQ ID NO: 205826 - protein, 11 aa, Tick-borne encephalitis virus
NYLGWYLKGLS

SEQ ID NO: 205827 - protein, 11 aa, Tick-borne encephalitis virus
LSTLEGGLFYA

SEQ ID NO: 205828 - protein, 11 aa, Tick-borne encephalitis virus
STLEGGLFYAD

SEQ ID NO: 205829 - protein, 11 aa, Tick-borne encephalitis virus
TLEGGLFYADD

SEQ ID NO: 205830 - protein, 11 aa, Tick-borne encephalitis virus
LEGGLFYADDT

SEQ ID NO: 205831 - protein, 11 aa, Tick-borne encephalitis virus
EGGLFYADDTA

SEQ ID NO: 205832 - protein, 11 aa, Tick-borne encephalitis virus
GGLFYADDTAG

SEQ ID NO: 205833 - protein, 11 aa, Tick-borne encephalitis virus
GLFYADDTAGW

SEQ ID NO: 205834 - protein, 11 aa, Tick-borne encephalitis virus
LFYADDTAGWD

SEQ ID NO: 205835 - protein, 11 aa, Tick-borne encephalitis virus
FYADDTAGWDT

SEQ ID NO: 205836 - protein, 11 aa, Tick-borne encephalitis virus
YADDTAGWDTK

SEQ ID NO: 205837 - protein, 11 aa, Tick-borne encephalitis virus
ADDTAGWDTKV

SEQ ID NO: 205838 - protein, 11 aa, Tick-borne encephalitis virus
DDTAGWDTKVT

SEQ ID NO: 205839 - protein, 11 aa, Tick-borne encephalitis virus
DTAGWDTKVTN

SEQ ID NO: 205840 - protein, 11 aa, Tick-borne encephalitis virus
TAGWDTKVTNA

SEQ ID NO: 205841 - protein, 11 aa, Tick-borne encephalitis virus
AGWDTKVTNAD

SEQ ID NO: 205842 - protein, 11 aa, Tick-borne encephalitis virus
GWDTKVTNADL

SEQ ID NO: 205843 - protein, 11 aa, Tick-borne encephalitis virus
WDTKVTNADLE

SEQ ID NO: 205844 - protein, 11 aa, Tick-borne encephalitis virus
DTKVTNADLED

SEQ ID NO: 205845 - protein, 11 aa, Tick-borne encephalitis virus
TKVTNADLEDE

SEQ ID NO: 205846 - protein, 11 aa, Tick-borne encephalitis virus
KVTNADLEDEE

SEQ ID NO: 205847 - protein, 11 aa, Tick-borne encephalitis virus
VTNADLEDEEQ

SEQ ID NO: 205848 - protein, 11 aa, Tick-borne encephalitis virus
TNADLEDEEQL

SEQ ID NO: 205849 - protein, 11 aa, Tick-borne encephalitis virus
NADLEDEEQLL

SEQ ID NO: 205850 - protein, 11 aa, Tick-borne encephalitis virus
ADLEDEEQLLR

SEQ ID NO: 205851 - protein, 11 aa, Tick-borne encephalitis virus
DLEDEEQLLRY

SEQ ID NO: 205852 - protein, 11 aa, Tick-borne encephalitis virus
LEDEEQLLRYM

SEQ ID NO: 205853 - protein, 11 aa, Tick-borne encephalitis virus
EDEEQLLRYME

SEQ ID NO: 205854 - protein, 11 aa, Tick-borne encephalitis virus
DEEQLLRYMEG

SEQ ID NO: 205855 - protein, 11 aa, Tick-borne encephalitis virus
EEQLLRYMEGE

SEQ ID NO: 205856 - protein, 11 aa, Tick-borne encephalitis virus
EQLLRYMEGEH

SEQ ID NO: 205857 - protein, 11 aa, Tick-borne encephalitis virus
QLLRYMEGEHK

SEQ ID NO: 205858 - protein, 11 aa, Tick-borne encephalitis virus
LLRYMEGEHKQ

SEQ ID NO: 205859 - protein, 11 aa, Tick-borne encephalitis virus
LRYMEGEHKQL

SEQ ID NO: 205860 - protein, 11 aa, Tick-borne encephalitis virus
RYMEGEHKQLA

SEQ ID NO: 205861 - protein, 11 aa, Tick-borne encephalitis virus
YMEGEHKQLAA

SEQ ID NO: 205862 - protein, 11 aa, Tick-borne encephalitis virus
MEGEHKQLAAT

SEQ ID NO: 205863 - protein, 11 aa, Tick-borne encephalitis virus
EGEHKQLAATI

SEQ ID NO: 205864 - protein, 11 aa, Tick-borne encephalitis virus
GEHKQLAATIM

SEQ ID NO: 205865 - protein, 11 aa, Tick-borne encephalitis virus
EHKQLAATIMQ

SEQ ID NO: 205866 - protein, 11 aa, Tick-borne encephalitis virus
HKQLAATIMQK

SEQ ID NO: 205867 - protein, 11 aa, Tick-borne encephalitis virus
KQLAATIMQKA

SEQ ID NO: 205868 - protein, 11 aa, Tick-borne encephalitis virus
QLAATIMQKAY

SEQ ID NO: 205869 - protein, 11 aa, Tick-borne encephalitis virus
LAATIMQKAYH

SEQ ID NO: 205870 - protein, 11 aa, Tick-borne encephalitis virus
AATIMQKAYHA

SEQ ID NO: 205871 - protein, 11 aa, Tick-borne encephalitis virus
ATIMQKAYHAK

SEQ ID NO: 205872 - protein, 11 aa, Tick-borne encephalitis virus
TIMQKAYHAKV

SEQ ID NO: 205873 - protein, 11 aa, Tick-borne encephalitis virus
IMQKAYHAKVV

SEQ ID NO: 205874 - protein, 11 aa, Tick-borne encephalitis virus
MQKAYHAKVVK

SEQ ID NO: 205875 - protein, 11 aa, Tick-borne encephalitis virus
QKAYHAKVVKV

SEQ ID NO: 205876 - protein, 11 aa, Tick-borne encephalitis virus
KAYHAKVVKVA

SEQ ID NO: 205877 - protein, 11 aa, Tick-borne encephalitis virus
AYHAKVVKVAR

SEQ ID NO: 205878 - protein, 11 aa, Tick-borne encephalitis virus
YHAKVVKVARP

SEQ ID NO: 205879 - protein, 11 aa, Tick-borne encephalitis virus
HAKVVKVARPS

SEQ ID NO: 205880 - protein, 11 aa, Tick-borne encephalitis virus
AKVVKVARPSR

SEQ ID NO: 205881 - protein, 11 aa, Tick-borne encephalitis virus
KVVKVARPSRD

SEQ ID NO: 205882 - protein, 11 aa, Tick-borne encephalitis virus
VVKVARPSRDG

SEQ ID NO: 205883 - protein, 11 aa, Tick-borne encephalitis virus
VKVARPSRDGG

SEQ ID NO: 205884 - protein, 11 aa, Tick-borne encephalitis virus
KVARPSRDGGC

SEQ ID NO: 205885 - protein, 11 aa, Tick-borne encephalitis virus
VARPSRDGGCI

SEQ ID NO: 205886 - protein, 11 aa, Tick-borne encephalitis virus
ARPSRDGGCIM

SEQ ID NO: 205887 - protein, 11 aa, Tick-borne encephalitis virus
RPSRDGGCIMD

SEQ ID NO: 205888 - protein, 11 aa, Tick-borne encephalitis virus
PSRDGGCIMDV

SEQ ID NO: 205889 - protein, 11 aa, Tick-borne encephalitis virus
SRDGGCIMDVI

SEQ ID NO: 205890 - protein, 11 aa, Tick-borne encephalitis virus
RDGGCIMDVIT

SEQ ID NO: 205891 - protein, 11 aa, Tick-borne encephalitis virus
DGGCIMDVITR

SEQ ID NO: 205892 - protein, 11 aa, Tick-borne encephalitis virus
GGCIMDVITRR

SEQ ID NO: 205893 - protein, 11 aa, Tick-borne encephalitis virus
GCIMDVITRRD

SEQ ID NO: 205894 - protein, 11 aa, Tick-borne encephalitis virus
CIMDVITRRDQ

SEQ ID NO: 205895 - protein, 11 aa, Tick-borne encephalitis virus
IMDVITRRDQR

SEQ ID NO: 205896 - protein, 11 aa, Tick-borne encephalitis virus
MDVITRRDQRG

SEQ ID NO: 205897 - protein, 11 aa, Tick-borne encephalitis virus
DVITRRDQRGS

SEQ ID NO: 205898 - protein, 11 aa, Tick-borne encephalitis virus
VITRRDQRGSG

SEQ ID NO: 205899 - protein, 11 aa, Tick-borne encephalitis virus
ITRRDQRGSGQ

SEQ ID NO: 205900 - protein, 11 aa, Tick-borne encephalitis virus
TRRDQRGSGQV

SEQ ID NO: 205901 - protein, 11 aa, Tick-borne encephalitis virus
RRDQRGSGQVV

SEQ ID NO: 205902 - protein, 11 aa, Tick-borne encephalitis virus
RDQRGSGQVVT

SEQ ID NO: 205903 - protein, 11 aa, Tick-borne encephalitis virus
DQRGSGQVVTY

SEQ ID NO: 205904 - protein, 11 aa, Tick-borne encephalitis virus
QRGSGQVVTYA

SEQ ID NO: 205905 - protein, 11 aa, Tick-borne encephalitis virus
RGSGQVVTYAL

SEQ ID NO: 205906 - protein, 11 aa, Tick-borne encephalitis virus
GSGQVVTYALN

SEQ ID NO: 205907 - protein, 11 aa, Tick-borne encephalitis virus
SGQVVTYALNT

SEQ ID NO: 205908 - protein, 11 aa, Tick-borne encephalitis virus
GQVVTYALNTL

SEQ ID NO: 205909 - protein, 11 aa, Tick-borne encephalitis virus
QVVTYALNTLT

SEQ ID NO: 205910 - protein, 11 aa, Tick-borne encephalitis virus
VVTYALNTLTN

SEQ ID NO: 205911 - protein, 11 aa, Tick-borne encephalitis virus
VTYALNTLTNI

SEQ ID NO: 205912 - protein, 11 aa, Tick-borne encephalitis virus
TYALNTLTNIK

SEQ ID NO: 205913 - protein, 11 aa, Tick-borne encephalitis virus
YALNTLTNIKV

SEQ ID NO: 205914 - protein, 11 aa, Tick-borne encephalitis virus
ALNTLTNIKVQ

SEQ ID NO: 205915 - protein, 11 aa, Tick-borne encephalitis virus
LNTLTNIKVQL

SEQ ID NO: 205916 - protein, 11 aa, Tick-borne encephalitis virus
NTLTNIKVQLI

SEQ ID NO: 205917 - protein, 11 aa, Tick-borne encephalitis virus
TLTNIKVQLIR

SEQ ID NO: 205918 - protein, 11 aa, Tick-borne encephalitis virus
LTNIKVQLIRM

SEQ ID NO: 205919 - protein, 11 aa, Tick-borne encephalitis virus
TNIKVQLIRMM

SEQ ID NO: 205920 - protein, 11 aa, Tick-borne encephalitis virus
NIKVQLIRMME

SEQ ID NO: 205921 - protein, 11 aa, Tick-borne encephalitis virus
IKVQLIRMMEG

SEQ ID NO: 205922 - protein, 11 aa, Tick-borne encephalitis virus
KVQLIRMMEGE

SEQ ID NO: 205923 - protein, 11 aa, Tick-borne encephalitis virus
VQLIRMMEGEG

SEQ ID NO: 205924 - protein, 11 aa, Tick-borne encephalitis virus
QLIRMMEGEGV

SEQ ID NO: 205925 - protein, 11 aa, Tick-borne encephalitis virus
LIRMMEGEGVI

SEQ ID NO: 205926 - protein, 11 aa, Tick-borne encephalitis virus
IRMMEGEGVIE

SEQ ID NO: 205927 - protein, 11 aa, Tick-borne encephalitis virus
RMMEGEGVIEA

SEQ ID NO: 205928 - protein, 11 aa, Tick-borne encephalitis virus
MMEGEGVIEAS

SEQ ID NO: 205929 - protein, 11 aa, Tick-borne encephalitis virus
MEGEGVIEASD

SEQ ID NO: 205930 - protein, 11 aa, Tick-borne encephalitis virus
EGEGVIEASDA

SEQ ID NO: 205931 - protein, 11 aa, Tick-borne encephalitis virus
GEGVIEASDAH

SEQ ID NO: 205932 - protein, 11 aa, Tick-borne encephalitis virus
EGVIEASDAHN

SEQ ID NO: 205933 - protein, 11 aa, Tick-borne encephalitis virus
GVIEASDAHNP

SEQ ID NO: 205934 - protein, 11 aa, Tick-borne encephalitis virus
VIEASDAHNPR

SEQ ID NO: 205935 - protein, 11 aa, Tick-borne encephalitis virus
IEASDAHNPRL

SEQ ID NO: 205936 - protein, 11 aa, Tick-borne encephalitis virus
EASDAHNPRLL

SEQ ID NO: 205937 - protein, 11 aa, Tick-borne encephalitis virus
ASDAHNPRLLR

SEQ ID NO: 205938 - protein, 11 aa, Tick-borne encephalitis virus
SDAHNPRLLRV

SEQ ID NO: 205939 - protein, 11 aa, Tick-borne encephalitis virus
DAHNPRLLRVE

SEQ ID NO: 205940 - protein, 11 aa, Tick-borne encephalitis virus
AHNPRLLRVER

SEQ ID NO: 205941 - protein, 11 aa, Tick-borne encephalitis virus
HNPRLLRVERW

SEQ ID NO: 205942 - protein, 11 aa, Tick-borne encephalitis virus
NPRLLRVERWL

SEQ ID NO: 205943 - protein, 11 aa, Tick-borne encephalitis virus
PRLLRVERWLR

SEQ ID NO: 205944 - protein, 11 aa, Tick-borne encephalitis virus
RLLRVERWLRD

SEQ ID NO: 205945 - protein, 11 aa, Tick-borne encephalitis virus
DHGEERLGRML

SEQ ID NO: 205946 - protein, 11 aa, Tick-borne encephalitis virus
HGEERLGRMLV

SEQ ID NO: 205947 - protein, 11 aa, Tick-borne encephalitis virus
GEERLGRMLVS

SEQ ID NO: 205948 - protein, 11 aa, Tick-borne encephalitis virus
EERLGRMLVSG

SEQ ID NO: 205949 - protein, 11 aa, Tick-borne encephalitis virus
ERLGRMLVSGD

SEQ ID NO: 205950 - protein, 11 aa, Tick-borne encephalitis virus
RLGRMLVSGDD

SEQ ID NO: 205951 - protein, 11 aa, Tick-borne encephalitis virus
LGRMLVSGDDC

SEQ ID NO: 205952 - protein, 11 aa, Tick-borne encephalitis virus
GRMLVSGDDCV

SEQ ID NO: 205953 - protein, 11 aa, Tick-borne encephalitis virus
RMLVSGDDCVV

SEQ ID NO: 205954 - protein, 11 aa, Tick-borne encephalitis virus
MLVSGDDCVVR

SEQ ID NO: 205955 - protein, 11 aa, Tick-borne encephalitis virus
LVSGDDCVVRP

SEQ ID NO: 205956 - protein, 11 aa, Tick-borne encephalitis virus
VSGDDCVVRPV

SEQ ID NO: 205957 - protein, 11 aa, Tick-borne encephalitis virus
SGDDCVVRPVD

SEQ ID NO: 205958 - protein, 11 aa, Tick-borne encephalitis virus
GDDCVVRPVDD

SEQ ID NO: 205959 - protein, 11 aa, Tick-borne encephalitis virus
DDCVVRPVDDR

SEQ ID NO: 205960 - protein, 11 aa, Tick-borne encephalitis virus
DCVVRPVDDRF

SEQ ID NO: 205961 - protein, 11 aa, Tick-borne encephalitis virus
CVVRPVDDRFS

SEQ ID NO: 205962 - protein, 11 aa, Tick-borne encephalitis virus
DDRFGKALYFL

SEQ ID NO: 205963 - protein, 11 aa, Tick-borne encephalitis virus
DRFGKALYFLN

SEQ ID NO: 205964 - protein, 11 aa, Tick-borne encephalitis virus
RFGKALYFLND

SEQ ID NO: 205965 - protein, 11 aa, Tick-borne encephalitis virus
FGKALYFLNDM

SEQ ID NO: 205966 - protein, 11 aa, Tick-borne encephalitis virus
GKALYFLNDMA

SEQ ID NO: 205967 - protein, 11 aa, Tick-borne encephalitis virus
KALYFLNDMAK

SEQ ID NO: 205968 - protein, 11 aa, Tick-borne encephalitis virus
ALYFLNDMAKT

SEQ ID NO: 205969 - protein, 11 aa, Tick-borne encephalitis virus
LYFLNDMAKTR

SEQ ID NO: 205970 - protein, 11 aa, Tick-borne encephalitis virus
YFLNDMAKTRK

SEQ ID NO: 205971 - protein, 11 aa, Tick-borne encephalitis virus
FLNDMAKTRKD

SEQ ID NO: 205972 - protein, 11 aa, Tick-borne encephalitis virus
LNDMAKTRKDI

SEQ ID NO: 205973 - protein, 11 aa, Tick-borne encephalitis virus
NDMAKTRKDIG

SEQ ID NO: 205974 - protein, 11 aa, Tick-borne encephalitis virus
DMAKTRKDIGE

SEQ ID NO: 205975 - protein, 11 aa, Tick-borne encephalitis virus
MAKTRKDIGEW

SEQ ID NO: 205976 - protein, 11 aa, Tick-borne encephalitis virus
AKTRKDIGEWE

SEQ ID NO: 205977 - protein, 11 aa, Tick-borne encephalitis virus
KTRKDIGEWEH

SEQ ID NO: 205978 - protein, 11 aa, Tick-borne encephalitis virus
TRKDIGEWEHS

SEQ ID NO: 205979 - protein, 11 aa, Tick-borne encephalitis virus
RKDIGEWEHSV

SEQ ID NO: 205980 - protein, 11 aa, Tick-borne encephalitis virus
KDIGEWEHSVG

SEQ ID NO: 205981 - protein, 11 aa, Tick-borne encephalitis virus
DIGEWEHSVGF

SEQ ID NO: 205982 - protein, 11 aa, Tick-borne encephalitis virus
IGEWEHSVGFS

SEQ ID NO: 205983 - protein, 11 aa, Tick-borne encephalitis virus
NWEEVPFCSHH

SEQ ID NO: 205984 - protein, 11 aa, Tick-borne encephalitis virus
WEEVPFCSHHF

SEQ ID NO: 205985 - protein, 11 aa, Tick-borne encephalitis virus
EEVPFCSHHFH

SEQ ID NO: 205986 - protein, 11 aa, Tick-borne encephalitis virus
EVPFCSHHFHE

SEQ ID NO: 205987 - protein, 11 aa, Tick-borne encephalitis virus
VPFCSHHFHEL

SEQ ID NO: 205988 - protein, 11 aa, Tick-borne encephalitis virus
PFCSHHFHELV

SEQ ID NO: 205989 - protein, 11 aa, Tick-borne encephalitis virus
FCSHHFHELVM

SEQ ID NO: 205990 - protein, 11 aa, Tick-borne encephalitis virus
CSHHFHELVMK

SEQ ID NO: 205991 - protein, 11 aa, Tick-borne encephalitis virus
SHHFHELVMKD

SEQ ID NO: 205992 - protein, 11 aa, Tick-borne encephalitis virus
HHFHELVMKDG

SEQ ID NO: 205993 - protein, 11 aa, Tick-borne encephalitis virus
HFHELVMKDGR

SEQ ID NO: 205994 - protein, 11 aa, Tick-borne encephalitis virus
FHELVMKDGRA

SEQ ID NO: 205995 - protein, 11 aa, Tick-borne encephalitis virus
HELVMKDGRAL

SEQ ID NO: 205996 - protein, 11 aa, Tick-borne encephalitis virus
ELVMKDGRALI

SEQ ID NO: 205997 - protein, 11 aa, Tick-borne encephalitis virus
LVMKDGRALIV

SEQ ID NO: 205998 - protein, 11 aa, Tick-borne encephalitis virus
VMKDGRALIVP

SEQ ID NO: 205999 - protein, 11 aa, Tick-borne encephalitis virus
MKDGRALIVPC

SEQ ID NO: 206000 - protein, 11 aa, Tick-borne encephalitis virus
KDGRALIVPCR

SEQ ID NO: 206001 - protein, 11 aa, Tick-borne encephalitis virus
DGRALIVPCRD

SEQ ID NO: 206002 - protein, 11 aa, Tick-borne encephalitis virus
GRALIVPCRDQ

SEQ ID NO: 206003 - protein, 11 aa, Tick-borne encephalitis virus
RALIVPCRDQD

SEQ ID NO: 206004 - protein, 11 aa, Tick-borne encephalitis virus
ALIVPCRDQDE

SEQ ID NO: 206005 - protein, 11 aa, Tick-borne encephalitis virus
LIVPCRDQDEL

SEQ ID NO: 206006 - protein, 11 aa, Tick-borne encephalitis virus
IVPCRDQDELV

SEQ ID NO: 206007 - protein, 11 aa, Tick-borne encephalitis virus
VPCRDQDELVG

SEQ ID NO: 206008 - protein, 11 aa, Tick-borne encephalitis virus
PCRDQDELVGR

SEQ ID NO: 206009 - protein, 11 aa, Tick-borne encephalitis virus
CRDQDELVGRA

SEQ ID NO: 206010 - protein, 11 aa, Tick-borne encephalitis virus
RDQDELVGRAR

SEQ ID NO: 206011 - protein, 11 aa, Tick-borne encephalitis virus
DQDELVGRARV

SEQ ID NO: 206012 - protein, 11 aa, Tick-borne encephalitis virus
QDELVGRARVS

SEQ ID NO: 206013 - protein, 11 aa, Tick-borne encephalitis virus
DELVGRARVSP

SEQ ID NO: 206014 - protein, 11 aa, Tick-borne encephalitis virus
ELVGRARVSPG

SEQ ID NO: 206015 - protein, 11 aa, Tick-borne encephalitis virus
LVGRARVSPGC

SEQ ID NO: 206016 - protein, 11 aa, Tick-borne encephalitis virus
VGRARVSPGCG

SEQ ID NO: 206017 - protein, 11 aa, Tick-borne encephalitis virus
GRARVSPGCGW

SEQ ID NO: 206018 - protein, 11 aa, Tick-borne encephalitis virus
RARVSPGCGWS

SEQ ID NO: 206019 - protein, 11 aa, Tick-borne encephalitis virus
ARVSPGCGWSV

SEQ ID NO: 206020 - protein, 11 aa, Tick-borne encephalitis virus
RVSPGCGWSVR

SEQ ID NO: 206021 - protein, 11 aa, Tick-borne encephalitis virus
VSPGCGWSVRE

SEQ ID NO: 206022 - protein, 11 aa, Tick-borne encephalitis virus
SPGCGWSVRET

SEQ ID NO: 206023 - protein, 11 aa, Tick-borne encephalitis virus
PGCGWSVRETA

SEQ ID NO: 206024 - protein, 11 aa, Tick-borne encephalitis virus
GCGWSVRETAC

SEQ ID NO: 206025 - protein, 11 aa, Tick-borne encephalitis virus
CGWSVRETACL

SEQ ID NO: 206026 - protein, 11 aa, Tick-borne encephalitis virus
GWSVRETACLS

SEQ ID NO: 206027 - protein, 11 aa, Tick-borne encephalitis virus
WSVRETACLSK

SEQ ID NO: 206028 - protein, 11 aa, Tick-borne encephalitis virus
SVRETACLSKA

SEQ ID NO: 206029 - protein, 11 aa, Tick-borne encephalitis virus
VRETACLSKAY

SEQ ID NO: 206030 - protein, 11 aa, Tick-borne encephalitis virus
RETACLSKAYG

SEQ ID NO: 206031 - protein, 11 aa, Tick-borne encephalitis virus
ETACLSKAYGQ

SEQ ID NO: 206032 - protein, 11 aa, Tick-borne encephalitis virus
TACLSKAYGQM

SEQ ID NO: 206033 - protein, 11 aa, Tick-borne encephalitis virus
ACLSKAYGQMW

SEQ ID NO: 206034 - protein, 11 aa, Tick-borne encephalitis virus
CLSKAYGQMWL

SEQ ID NO: 206035 - protein, 11 aa, Tick-borne encephalitis virus
LSKAYGQMWLL

SEQ ID NO: 206036 - protein, 11 aa, Tick-borne encephalitis virus
SKAYGQMWLLS

SEQ ID NO: 206037 - protein, 11 aa, Tick-borne encephalitis virus
KAYGQMWLLSY

SEQ ID NO: 206038 - protein, 11 aa, Tick-borne encephalitis virus
AYGQMWLLSYF

SEQ ID NO: 206039 - protein, 11 aa, Tick-borne encephalitis virus
YGQMWLLSYFH

SEQ ID NO: 206040 - protein, 11 aa, Tick-borne encephalitis virus
GQMWLLSYFHR

SEQ ID NO: 206041 - protein, 11 aa, Tick-borne encephalitis virus
QMWLLSYFHRR

SEQ ID NO: 206042 - protein, 11 aa, Tick-borne encephalitis virus
MWLLSYFHRRD

SEQ ID NO: 206043 - protein, 11 aa, Tick-borne encephalitis virus
WLLSYFHRRDL

SEQ ID NO: 206044 - protein, 11 aa, Tick-borne encephalitis virus
LLSYFHRRDLR

SEQ ID NO: 206045 - protein, 11 aa, Tick-borne encephalitis virus
LSYFHRRDLRT

SEQ ID NO: 206046 - protein, 11 aa, Tick-borne encephalitis virus
SYFHRRDLRTL

SEQ ID NO: 206047 - protein, 11 aa, Tick-borne encephalitis virus
YFHRRDLRTLG

SEQ ID NO: 206048 - protein, 11 aa, Tick-borne encephalitis virus
FHRRDLRTLGL

SEQ ID NO: 206049 - protein, 11 aa, Tick-borne encephalitis virus
HRRDLRTLGLA

SEQ ID NO: 206050 - protein, 11 aa, Tick-borne encephalitis virus
RRDLRTLGLAI

SEQ ID NO: 206051 - protein, 11 aa, Tick-borne encephalitis virus
RDLRTLGLAIC

SEQ ID NO: 206052 - protein, 11 aa, Tick-borne encephalitis virus
DLRTLGLAICS

SEQ ID NO: 206053 - protein, 11 aa, Tick-borne encephalitis virus
LRTLGLAICSA

SEQ ID NO: 206054 - protein, 11 aa, Tick-borne encephalitis virus
RTLGLAICSAV

SEQ ID NO: 206055 - protein, 11 aa, Tick-borne encephalitis virus
TLGLAICSAVP

SEQ ID NO: 206056 - protein, 11 aa, Tick-borne encephalitis virus
SAVPVDWVPTG

SEQ ID NO: 206057 - protein, 11 aa, Tick-borne encephalitis virus
AVPVDWVPTGR

SEQ ID NO: 206058 - protein, 11 aa, Tick-borne encephalitis virus
VPVDWVPTGRT

SEQ ID NO: 206059 - protein, 11 aa, Tick-borne encephalitis virus
PVDWVPTGRTT

SEQ ID NO: 206060 - protein, 11 aa, Tick-borne encephalitis virus
VDWVPTGRTTW

SEQ ID NO: 206061 - protein, 11 aa, Tick-borne encephalitis virus
DWVPTGRTTWS

SEQ ID NO: 206062 - protein, 11 aa, Tick-borne encephalitis virus
WVPTGRTTWSI

SEQ ID NO: 206063 - protein, 11 aa, Tick-borne encephalitis virus
VPTGRTTWSIH

SEQ ID NO: 206064 - protein, 11 aa, Tick-borne encephalitis virus
PTGRTTWSIHA

SEQ ID NO: 206065 - protein, 11 aa, Tick-borne encephalitis virus
TGRTTWSIHAS

SEQ ID NO: 206066 - protein, 11 aa, Tick-borne encephalitis virus
GRTTWSIHASG

SEQ ID NO: 206067 - protein, 11 aa, Tick-borne encephalitis virus
RTTWSIHASGA

SEQ ID NO: 206068 - protein, 11 aa, Tick-borne encephalitis virus
TTWSIHASGAW

SEQ ID NO: 206069 - protein, 11 aa, Tick-borne encephalitis virus
TWSIHASGAWM

SEQ ID NO: 206070 - protein, 11 aa, Tick-borne encephalitis virus
WSIHASGAWMT

SEQ ID NO: 206071 - protein, 11 aa, Tick-borne encephalitis virus
SIHASGAWMTT

SEQ ID NO: 206072 - protein, 11 aa, Tick-borne encephalitis virus
IHASGAWMTTE

SEQ ID NO: 206073 - protein, 11 aa, Tick-borne encephalitis virus
HASGAWMTTED

SEQ ID NO: 206074 - protein, 11 aa, Tick-borne encephalitis virus
ASGAWMTTEDM

SEQ ID NO: 206075 - protein, 11 aa, Tick-borne encephalitis virus
SGAWMTTEDML

SEQ ID NO: 206076 - protein, 11 aa, Tick-borne encephalitis virus
GAWMTTEDMLD

SEQ ID NO: 206077 - protein, 11 aa, Tick-borne encephalitis virus
AWMTTEDMLDV

SEQ ID NO: 206078 - protein, 11 aa, Tick-borne encephalitis virus
WMTTEDMLDVW

SEQ ID NO: 206079 - protein, 11 aa, Tick-borne encephalitis virus
MTTEDMLDVWN

SEQ ID NO: 206080 - protein, 11 aa, Tick-borne encephalitis virus
TTEDMLDVWNR

SEQ ID NO: 206081 - protein, 11 aa, Tick-borne encephalitis virus
TEDMLDVWNRV

SEQ ID NO: 206082 - protein, 11 aa, Tick-borne encephalitis virus
EDMLDVWNRVW

SEQ ID NO: 206083 - protein, 11 aa, Tick-borne encephalitis virus
DMLDVWNRVWI

SEQ ID NO: 206084 - protein, 11 aa, Tick-borne encephalitis virus
MLDVWNRVWIL

SEQ ID NO: 206085 - protein, 11 aa, Tick-borne encephalitis virus
LDVWNRVWILD

SEQ ID NO: 206086 - protein, 11 aa, Tick-borne encephalitis virus
DVWNRVWILDN

SEQ ID NO: 206087 - protein, 11 aa, Tick-borne encephalitis virus
VWNRVWILDNP

SEQ ID NO: 206088 - protein, 11 aa, Tick-borne encephalitis virus
WNRVWILDNPF

SEQ ID NO: 206089 - protein, 11 aa, Tick-borne encephalitis virus
NRVWILDNPFM

SEQ ID NO: 206090 - protein, 11 aa, Tick-borne encephalitis virus
RVWILDNPFMH

SEQ ID NO: 206091 - protein, 11 aa, Tick-borne encephalitis virus
VWILDNPFMHS

SEQ ID NO: 206092 - protein, 11 aa, Tick-borne encephalitis virus
WILDNPFMHSK

SEQ ID NO: 206093 - protein, 11 aa, Tick-borne encephalitis virus
ILDNPFMHSKE

SEQ ID NO: 206094 - protein, 11 aa, Tick-borne encephalitis virus
LDNPFMHSKEK

SEQ ID NO: 206095 - protein, 11 aa, Tick-borne encephalitis virus
EWRDVPYLPKS

SEQ ID NO: 206096 - protein, 11 aa, Tick-borne encephalitis virus
VPYLPKSHDML

SEQ ID NO: 206097 - protein, 11 aa, Tick-borne encephalitis virus
PYLPKSHDMLC

SEQ ID NO: 206098 - protein, 11 aa, Tick-borne encephalitis virus
YLPKSHDMLCS

SEQ ID NO: 206099 - protein, 11 aa, Tick-borne encephalitis virus
LPKSHDMLCSS

SEQ ID NO: 206100 - protein, 11 aa, Tick-borne encephalitis virus
PKSHDMLCSSL

SEQ ID NO: 206101 - protein, 11 aa, Tick-borne encephalitis virus
KSHDMLCSSLV

SEQ ID NO: 206102 - protein, 11 aa, Tick-borne encephalitis virus
SHDMLCSSLVG

SEQ ID NO: 206103 - protein, 11 aa, Tick-borne encephalitis virus
HDMLCSSLVGR

SEQ ID NO: 206104 - protein, 11 aa, Tick-borne encephalitis virus
DMLCSSLVGRK

SEQ ID NO: 206105 - protein, 11 aa, Tick-borne encephalitis virus
MLCSSLVGRKE

SEQ ID NO: 206106 - protein, 11 aa, Tick-borne encephalitis virus
LCSSLVGRKER

SEQ ID NO: 206107 - protein, 11 aa, Tick-borne encephalitis virus
CSSLVGRKERA

SEQ ID NO: 206108 - protein, 11 aa, Tick-borne encephalitis virus
SSLVGRKERAE

SEQ ID NO: 206109 - protein, 11 aa, Tick-borne encephalitis virus
SLVGRKERAEW

SEQ ID NO: 206110 - protein, 11 aa, Tick-borne encephalitis virus
LVGRKERAEWA

SEQ ID NO: 206111 - protein, 11 aa, Tick-borne encephalitis virus
VGRKERAEWAK

SEQ ID NO: 206112 - protein, 11 aa, Tick-borne encephalitis virus
GRKERAEWAKN

SEQ ID NO: 206113 - protein, 11 aa, Tick-borne encephalitis virus
RKERAEWAKNI

SEQ ID NO: 206114 - protein, 11 aa, Tick-borne encephalitis virus
KERAEWAKNIW

SEQ ID NO: 206115 - protein, 11 aa, Tick-borne encephalitis virus
ERAEWAKNIWG

SEQ ID NO: 206116 - protein, 11 aa, Tick-borne encephalitis virus
RAEWAKNIWGA

SEQ ID NO: 206117 - protein, 11 aa, Tick-borne encephalitis virus
AEWAKNIWGAV

SEQ ID NO: 206118 - protein, 11 aa, Tick-borne encephalitis virus
EWAKNIWGAVE

SEQ ID NO: 206119 - protein, 11 aa, Tick-borne encephalitis virus
WAKNIWGAVEK

SEQ ID NO: 206120 - protein, 11 aa, Tick-borne encephalitis virus
AKNIWGAVEKV

SEQ ID NO: 206121 - protein, 11 aa, Tick-borne encephalitis virus
KNIWGAVEKVR

SEQ ID NO: 206122 - protein, 11 aa, Tick-borne encephalitis virus
NIWGAVEKVRK

SEQ ID NO: 206123 - protein, 11 aa, Tick-borne encephalitis virus
IWGAVEKVRKM

SEQ ID NO: 206124 - protein, 11 aa, Tick-borne encephalitis virus
WGAVEKVRKMI

SEQ ID NO: 206125 - protein, 11 aa, Tick-borne encephalitis virus
GAVEKVRKMIG

SEQ ID NO: 206126 - protein, 11 aa, Tick-borne encephalitis virus
KFKDYLSCMDR

SEQ ID NO: 206127 - protein, 11 aa, Tick-borne encephalitis virus
FKDYLSCMDRH

SEQ ID NO: 206128 - protein, 11 aa, Tick-borne encephalitis virus
KDYLSCMDRHD

SEQ ID NO: 206129 - protein, 11 aa, Tick-borne encephalitis virus
DYLSCMDRHDL

SEQ ID NO: 206130 - protein, 11 aa, Tick-borne encephalitis virus
YLSCMDRHDLH

SEQ ID NO: 206131 - protein, 11 aa, Tick-borne encephalitis virus
LSCMDRHDLHW

SEQ ID NO: 206132 - protein, 11 aa, Tick-borne encephalitis virus
SCMDRHDLHWE

SEQ ID NO: 206133 - protein, 11 aa, Tick-borne encephalitis virus
CMDRHDLHWEL

SEQ ID NO: 206134 - protein, 11 aa, Tick-borne encephalitis virus
MDRHDLHWELK

SEQ ID NO: 206135 - protein, 11 aa, Tick-borne encephalitis virus
DRHDLHWELKL

SEQ ID NO: 206136 - protein, 11 aa, Tick-borne encephalitis virus
RHDLHWELKLE

SEQ ID NO: 206137 - protein, 11 aa, Tick-borne encephalitis virus
HDLHWELKLES

SEQ ID NO: 206138 - protein, 11 aa, Tick-borne encephalitis virus
DLHWELKLESS

SEQ ID NO: 206139 - protein, 11 aa, Tick-borne encephalitis virus
LHWELKLESSI

SEQ ID NO: 206140 - protein, 11 aa, Tick-borne encephalitis virus
HWELKLESSII

SEQ ID NO: 206141 - protein, 11 aa, Tick-borne encephalitis virus
MVKKAILKGKG

SEQ ID NO: 206142 - protein, 11 aa, Tick-borne encephalitis virus
VKKAILKGKGG

SEQ ID NO: 206143 - protein, 11 aa, Tick-borne encephalitis virus
KKAILKGKGGG

SEQ ID NO: 206144 - protein, 11 aa, Tick-borne encephalitis virus
KGKGGGPPRRA

SEQ ID NO: 206145 - protein, 11 aa, Tick-borne encephalitis virus
GKGGGPPRRAS

SEQ ID NO: 206146 - protein, 11 aa, Tick-borne encephalitis virus
KGGGPPRRASK

SEQ ID NO: 206147 - protein, 11 aa, Tick-borne encephalitis virus
GGGPPRRASKE

SEQ ID NO: 206148 - protein, 11 aa, Tick-borne encephalitis virus
GGPPRRVSKEA

SEQ ID NO: 206149 - protein, 11 aa, Tick-borne encephalitis virus
GPPRRASKETA

SEQ ID NO: 206150 - protein, 11 aa, Tick-borne encephalitis virus
PPRRVSKETAT

SEQ ID NO: 206151 - protein, 11 aa, Tick-borne encephalitis virus
PRRVSKETATK

SEQ ID NO: 206152 - protein, 11 aa, Tick-borne encephalitis virus
RRVSKETATKT

SEQ ID NO: 206153 - protein, 11 aa, Tick-borne encephalitis virus
RVSKETATKTR

SEQ ID NO: 206154 - protein, 11 aa, Tick-borne encephalitis virus
VSKETATKTRQ

SEQ ID NO: 206155 - protein, 11 aa, Tick-borne encephalitis virus
SKETATKTRQP

SEQ ID NO: 206156 - protein, 11 aa, Tick-borne encephalitis virus
KETATKTRQPR

SEQ ID NO: 206157 - protein, 11 aa, Tick-borne encephalitis virus
ETATKTRQPRV

SEQ ID NO: 206158 - protein, 11 aa, Tick-borne encephalitis virus
TAKKTRQSRVR

SEQ ID NO: 206159 - protein, 11 aa, Tick-borne encephalitis virus
AKKTRQSRVRM

SEQ ID NO: 206160 - protein, 11 aa, Tick-borne encephalitis virus
KKTRQSRVRMP

SEQ ID NO: 206161 - protein, 11 aa, Tick-borne encephalitis virus
KTRQSRVRMPN

SEQ ID NO: 206162 - protein, 11 aa, Tick-borne encephalitis virus
TRQSRVRMPNG

SEQ ID NO: 206163 - protein, 11 aa, Tick-borne encephalitis virus
RQSRVRMPNGL

SEQ ID NO: 206164 - protein, 11 aa, Tick-borne encephalitis virus
QSRVRMPNGLV

SEQ ID NO: 206165 - protein, 11 aa, Tick-borne encephalitis virus
SRVRMPNGLVL

SEQ ID NO: 206166 - protein, 11 aa, Tick-borne encephalitis virus
RVRMPNGLVLM

SEQ ID NO: 206167 - protein, 11 aa, Tick-borne encephalitis virus
VRMPNGLVLMR

SEQ ID NO: 206168 - protein, 11 aa, Tick-borne encephalitis virus
RMPNGLVLMRM

SEQ ID NO: 206169 - protein, 11 aa, Tick-borne encephalitis virus
MPNGLVLMRML

SEQ ID NO: 206170 - protein, 11 aa, Tick-borne encephalitis virus
PNGLVLMRMLG

SEQ ID NO: 206171 - protein, 11 aa, Tick-borne encephalitis virus
NGLVLMRMLGI

SEQ ID NO: 206172 - protein, 11 aa, Tick-borne encephalitis virus
GLVLMRMLGIL

SEQ ID NO: 206173 - protein, 11 aa, Tick-borne encephalitis virus
LVLMRMLGILW

SEQ ID NO: 206174 - protein, 11 aa, Tick-borne encephalitis virus
VLMRMLGILWH

SEQ ID NO: 206175 - protein, 11 aa, Tick-borne encephalitis virus
LMRMLGILWHA

SEQ ID NO: 206176 - protein, 11 aa, Tick-borne encephalitis virus
MRMMGILWHAI

SEQ ID NO: 206177 - protein, 11 aa, Tick-borne encephalitis virus
RMMGILWHAIA

SEQ ID NO: 206178 - protein, 11 aa, Tick-borne encephalitis virus
MMGILWHAIAG

SEQ ID NO: 206179 - protein, 11 aa, Tick-borne encephalitis virus
MGILWHAIAGT

SEQ ID NO: 206180 - protein, 11 aa, Tick-borne encephalitis virus
GILWHAIAGTA

SEQ ID NO: 206181 - protein, 11 aa, Tick-borne encephalitis virus
ILWHAIAGTAR

SEQ ID NO: 206182 - protein, 11 aa, Tick-borne encephalitis virus
LWHAVAGTARN

SEQ ID NO: 206183 - protein, 11 aa, Tick-borne encephalitis virus
WHAVAGTARNP

SEQ ID NO: 206184 - protein, 11 aa, Tick-borne encephalitis virus
HAVAGTARNPV

SEQ ID NO: 206185 - protein, 11 aa, Tick-borne encephalitis virus
AVAGTARNPVL

SEQ ID NO: 206186 - protein, 11 aa, Tick-borne encephalitis virus
VAGTARNPVLK

SEQ ID NO: 206187 - protein, 11 aa, Tick-borne encephalitis virus
AGTARNPVLKA

SEQ ID NO: 206188 - protein, 11 aa, Tick-borne encephalitis virus
GTARNPVLKAF

SEQ ID NO: 206189 - protein, 11 aa, Tick-borne encephalitis virus
TARNPVLKAFW

SEQ ID NO: 206190 - protein, 11 aa, Tick-borne encephalitis virus
ARNPVLKAFWN

SEQ ID NO: 206191 - protein, 11 aa, Tick-borne encephalitis virus
RNPVLKAFWNS

SEQ ID NO: 206192 - protein, 11 aa, Tick-borne encephalitis virus
NPVLKAFWNSV

SEQ ID NO: 206193 - protein, 11 aa, Tick-borne encephalitis virus
PVLKAFWNSVP

SEQ ID NO: 206194 - protein, 11 aa, Tick-borne encephalitis virus
VLKAFWNSVPL

SEQ ID NO: 206195 - protein, 11 aa, Tick-borne encephalitis virus
LKSFWNSVPLR

SEQ ID NO: 206196 - protein, 11 aa, Tick-borne encephalitis virus
KSFWNSVPLRQ

SEQ ID NO: 206197 - protein, 11 aa, Tick-borne encephalitis virus
AFWNSVPLKQA

SEQ ID NO: 206198 - protein, 11 aa, Tick-borne encephalitis virus
FWNSVPLRQAT

SEQ ID NO: 206199 - protein, 11 aa, Tick-borne encephalitis virus
SVPLRQATAAL

SEQ ID NO: 206200 - protein, 11 aa, Tick-borne encephalitis virus
VPLRQATAALR

SEQ ID NO: 206201 - protein, 11 aa, Tick-borne encephalitis virus
PLRQATAALRK

SEQ ID NO: 206202 - protein, 11 aa, Tick-borne encephalitis virus
LRQATAALRKI

SEQ ID NO: 206203 - protein, 11 aa, Tick-borne encephalitis virus
RQATAALRKIK

SEQ ID NO: 206204 - protein, 11 aa, Tick-borne encephalitis virus
QATAALRKIKR

SEQ ID NO: 206205 - protein, 11 aa, Tick-borne encephalitis virus
ATAALRKIKRT

SEQ ID NO: 206206 - protein, 11 aa, Tick-borne encephalitis virus
TAALRKIKRTV

SEQ ID NO: 206207 - protein, 11 aa, Tick-borne encephalitis virus
AALRKIKRTVS

SEQ ID NO: 206208 - protein, 11 aa, Tick-borne encephalitis virus
ALRKIKRTVSA

SEQ ID NO: 206209 - protein, 11 aa, Tick-borne encephalitis virus
LRKIKRTVSAL

SEQ ID NO: 206210 - protein, 11 aa, Tick-borne encephalitis virus
RKIKRTVSALM

SEQ ID NO: 206211 - protein, 11 aa, Tick-borne encephalitis virus
LMVGLQKRGKR

SEQ ID NO: 206212 - protein, 11 aa, Tick-borne encephalitis virus
MVGLQKRGKRR

SEQ ID NO: 206213 - protein, 11 aa, Tick-borne encephalitis virus
VGLQKRGKRRS

SEQ ID NO: 206214 - protein, 11 aa, Tick-borne encephalitis virus
GLQKRGKRRSA

SEQ ID NO: 206215 - protein, 11 aa, Tick-borne encephalitis virus
TLAATVRKEGD

SEQ ID NO: 206216 - protein, 11 aa, Tick-borne encephalitis virus
AATVRKERDGS

SEQ ID NO: 206217 - protein, 11 aa, Tick-borne encephalitis virus
ATVRKERDGST

SEQ ID NO: 206218 - protein, 11 aa, Tick-borne encephalitis virus
TVRKERDGSTV

SEQ ID NO: 206219 - protein, 11 aa, Tick-borne encephalitis virus
VRKERDGSTVI

SEQ ID NO: 206220 - protein, 11 aa, Tick-borne encephalitis virus
RKERDGSTVIR

SEQ ID NO: 206221 - protein, 11 aa, Tick-borne encephalitis virus
KERDGSTVIRA

SEQ ID NO: 206222 - protein, 11 aa, Tick-borne encephalitis virus
ERDGSTVIRAE

SEQ ID NO: 206223 - protein, 11 aa, Tick-borne encephalitis virus
RDGSTVIRAEG

SEQ ID NO: 206224 - protein, 11 aa, Tick-borne encephalitis virus
DGSTVIRAEGK

SEQ ID NO: 206225 - protein, 11 aa, Tick-borne encephalitis virus
GSTVIRAEGKD

SEQ ID NO: 206226 - protein, 11 aa, Tick-borne encephalitis virus
STVIRAEGKDA

SEQ ID NO: 206227 - protein, 11 aa, Tick-borne encephalitis virus
TVIRAEGRDAA

SEQ ID NO: 206228 - protein, 11 aa, Tick-borne encephalitis virus
VIRAEGRDAAT

SEQ ID NO: 206229 - protein, 11 aa, Tick-borne encephalitis virus
IRAEGRDAATQ

SEQ ID NO: 206230 - protein, 11 aa, Tick-borne encephalitis virus
RAEGRDAATQV

SEQ ID NO: 206231 - protein, 11 aa, Tick-borne encephalitis virus
AEGRDAATQVR

SEQ ID NO: 206232 - protein, 11 aa, Tick-borne encephalitis virus
EGRDAATQVRV

SEQ ID NO: 206233 - protein, 11 aa, Tick-borne encephalitis virus
GRDAATQVRVE

SEQ ID NO: 206234 - protein, 11 aa, Tick-borne encephalitis virus
RDAATQVRVEN

SEQ ID NO: 206235 - protein, 11 aa, Tick-borne encephalitis virus
VRVENGTCVIM

SEQ ID NO: 206236 - protein, 11 aa, Tick-borne encephalitis virus
RVENGTCVILV

SEQ ID NO: 206237 - protein, 11 aa, Tick-borne encephalitis virus
VENGTCVILVT

SEQ ID NO: 206238 - protein, 11 aa, Tick-borne encephalitis virus
ENGTCVILVTD

SEQ ID NO: 206239 - protein, 11 aa, Tick-borne encephalitis virus
NGTCVILVTDM

SEQ ID NO: 206240 - protein, 11 aa, Tick-borne encephalitis virus
GTCVILVTDMG

SEQ ID NO: 206241 - protein, 11 aa, Tick-borne encephalitis virus
TCVILVTDMGS

SEQ ID NO: 206242 - protein, 11 aa, Tick-borne encephalitis virus
CVILVTDMGSW

SEQ ID NO: 206243 - protein, 11 aa, Tick-borne encephalitis virus
VILVTDMGSWC

SEQ ID NO: 206244 - protein, 11 aa, Tick-borne encephalitis virus
ILVTDMGSWCD

SEQ ID NO: 206245 - protein, 11 aa, Tick-borne encephalitis virus
LVTDMGSWCDD

SEQ ID NO: 206246 - protein, 11 aa, Tick-borne encephalitis virus
VTDMGSWCDDS

SEQ ID NO: 206247 - protein, 11 aa, Tick-borne encephalitis virus
TDMGAWCDDSL

SEQ ID NO: 206248 - protein, 11 aa, Tick-borne encephalitis virus
DMGSWCDDSLS

SEQ ID NO: 206249 - protein, 11 aa, Tick-borne encephalitis virus
MGSWCDDSLSY

SEQ ID NO: 206250 - protein, 11 aa, Tick-borne encephalitis virus
GSWCDDSLSYE

SEQ ID NO: 206251 - protein, 11 aa, Tick-borne encephalitis virus
SWCDDSLSYEC

SEQ ID NO: 206252 - protein, 11 aa, Tick-borne encephalitis virus
WCDDSLSYECV

SEQ ID NO: 206253 - protein, 11 aa, Tick-borne encephalitis virus
CDDSLSYECVT

SEQ ID NO: 206254 - protein, 11 aa, Tick-borne encephalitis virus
DDSLSYECVTI

SEQ ID NO: 206255 - protein, 11 aa, Tick-borne encephalitis virus
DSLSYECVTID

SEQ ID NO: 206256 - protein, 11 aa, Tick-borne encephalitis virus
SLSYECVTIDQ

SEQ ID NO: 206257 - protein, 11 aa, Tick-borne encephalitis virus
LSYECVTIDQG

SEQ ID NO: 206258 - protein, 11 aa, Tick-borne encephalitis virus
SYECVTIDQGE

SEQ ID NO: 206259 - protein, 11 aa, Tick-borne encephalitis virus
DVDCFCRNVDR

SEQ ID NO: 206260 - protein, 11 aa, Tick-borne encephalitis virus
VDCFCRNVDRV

SEQ ID NO: 206261 - protein, 11 aa, Tick-borne encephalitis virus
DCFCRNVDGVH

SEQ ID NO: 206262 - protein, 11 aa, Tick-borne encephalitis virus
CFCRNVDGVHL

SEQ ID NO: 206263 - protein, 11 aa, Tick-borne encephalitis virus
FCRNVDGVHLE

SEQ ID NO: 206264 - protein, 11 aa, Tick-borne encephalitis virus
CRNVDGVHLEY

SEQ ID NO: 206265 - protein, 11 aa, Tick-borne encephalitis virus
RNVDGVHLEYG

SEQ ID NO: 206266 - protein, 11 aa, Tick-borne encephalitis virus
NVDGVHLEYGR

SEQ ID NO: 206267 - protein, 11 aa, Tick-borne encephalitis virus
VDGVHLEYGRC

SEQ ID NO: 206268 - protein, 11 aa, Tick-borne encephalitis virus
DGVHLEYGRCG

SEQ ID NO: 206269 - protein, 11 aa, Tick-borne encephalitis virus
GVHLEYGRCGK

SEQ ID NO: 206270 - protein, 11 aa, Tick-borne encephalitis virus
VHLEYGRCGKQ

SEQ ID NO: 206271 - protein, 11 aa, Tick-borne encephalitis virus
HLEYGRCGKQE

SEQ ID NO: 206272 - protein, 11 aa, Tick-borne encephalitis virus
GSRTRRSVLIR

SEQ ID NO: 206273 - protein, 11 aa, Tick-borne encephalitis virus
SRTRRSVLIRS

SEQ ID NO: 206274 - protein, 11 aa, Tick-borne encephalitis virus
RTRRSVLIRSH

SEQ ID NO: 206275 - protein, 11 aa, Tick-borne encephalitis virus
TRRSVLIRSHA

SEQ ID NO: 206276 - protein, 11 aa, Tick-borne encephalitis virus
RRSVLIRSHAQ

SEQ ID NO: 206277 - protein, 11 aa, Tick-borne encephalitis virus
RSVLIRSHAQG

SEQ ID NO: 206278 - protein, 11 aa, Tick-borne encephalitis virus
SVLIPSHAQGE

SEQ ID NO: 206279 - protein, 11 aa, Tick-borne encephalitis virus
VLIPSHAQGEL

SEQ ID NO: 206280 - protein, 11 aa, Tick-borne encephalitis virus
LIPSHAQGELT

SEQ ID NO: 206281 - protein, 11 aa, Tick-borne encephalitis virus
IPSHAQGELTG

SEQ ID NO: 206282 - protein, 11 aa, Tick-borne encephalitis virus
PSHAQGELTGR

SEQ ID NO: 206283 - protein, 11 aa, Tick-borne encephalitis virus
SHAQGELTGRG

SEQ ID NO: 206284 - protein, 11 aa, Tick-borne encephalitis virus
HAQGELTGRGH

SEQ ID NO: 206285 - protein, 11 aa, Tick-borne encephalitis virus
AQGELTGRGHK

SEQ ID NO: 206286 - protein, 11 aa, Tick-borne encephalitis virus
QGELTGRGHKW

SEQ ID NO: 206287 - protein, 11 aa, Tick-borne encephalitis virus
GELTGRGHKWL

SEQ ID NO: 206288 - protein, 11 aa, Tick-borne encephalitis virus
ELTGRGHKWLE

SEQ ID NO: 206289 - protein, 11 aa, Tick-borne encephalitis virus
LTGRGRKWLEG

SEQ ID NO: 206290 - protein, 11 aa, Tick-borne encephalitis virus
TGRGRKWLEGD

SEQ ID NO: 206291 - protein, 11 aa, Tick-borne encephalitis virus
GRGRKWLEGDS

SEQ ID NO: 206292 - protein, 11 aa, Tick-borne encephalitis virus
RGRKWLEGDSL

SEQ ID NO: 206293 - protein, 11 aa, Tick-borne encephalitis virus
GRKWLEGDSLR

SEQ ID NO: 206294 - protein, 11 aa, Tick-borne encephalitis virus
RKWLEGDSLRT

SEQ ID NO: 206295 - protein, 11 aa, Tick-borne encephalitis virus
TRVEGWVWKNR

SEQ ID NO: 206296 - protein, 11 aa, Tick-borne encephalitis virus
VWLTLESVVTR

SEQ ID NO: 206297 - protein, 11 aa, Tick-borne encephalitis virus
LVVLLCLAPVY

SEQ ID NO: 206298 - protein, 11 aa, Tick-borne encephalitis virus
VALLCLAPVYA

SEQ ID NO: 206299 - protein, 11 aa, Tick-borne encephalitis virus
VLFCLAPVYAS

SEQ ID NO: 206300 - protein, 11 aa, Tick-borne encephalitis virus
LFCLAPVYASR

SEQ ID NO: 206301 - protein, 11 aa, Tick-borne encephalitis virus
FCLAPVYASRC

SEQ ID NO: 206302 - protein, 11 aa, Tick-borne encephalitis virus
GKPSMDVWLDA

SEQ ID NO: 206303 - protein, 11 aa, Tick-borne encephalitis virus
KPSMDVWLDAI

SEQ ID NO: 206304 - protein, 11 aa, Tick-borne encephalitis virus
PSMDVWLDAIY

SEQ ID NO: 206305 - protein, 11 aa, Tick-borne encephalitis virus
SMDVWLDAIYQ

SEQ ID NO: 206306 - protein, 11 aa, Tick-borne encephalitis virus
MDVWLDAIYQE

SEQ ID NO: 206307 - protein, 11 aa, Tick-borne encephalitis virus
DVWLDAIYQEN

SEQ ID NO: 206308 - protein, 11 aa, Tick-borne encephalitis virus
VWLDAIYQENP

SEQ ID NO: 206309 - protein, 11 aa, Tick-borne encephalitis virus
WLDAIYQENPA

SEQ ID NO: 206310 - protein, 11 aa, Tick-borne encephalitis virus
LDAIYQENPAK

SEQ ID NO: 206311 - protein, 11 aa, Tick-borne encephalitis virus
DAIYQENPAKT

SEQ ID NO: 206312 - protein, 11 aa, Tick-borne encephalitis virus
AIYQENPAKTR

SEQ ID NO: 206313 - protein, 11 aa, Tick-borne encephalitis virus
IYQESPAKTRE

SEQ ID NO: 206314 - protein, 11 aa, Tick-borne encephalitis virus
YQESPAKTREY

SEQ ID NO: 206315 - protein, 11 aa, Tick-borne encephalitis virus
QESPAKTREYC

SEQ ID NO: 206316 - protein, 11 aa, Tick-borne encephalitis virus
ESPAKTREYCL

SEQ ID NO: 206317 - protein, 11 aa, Tick-borne encephalitis virus
SPAKTREYCLH

SEQ ID NO: 206318 - protein, 11 aa, Tick-borne encephalitis virus
PAKTREYCLHV

SEQ ID NO: 206319 - protein, 11 aa, Tick-borne encephalitis virus
AKTREYCLHVK

SEQ ID NO: 206320 - protein, 11 aa, Tick-borne encephalitis virus
KTREYCLHVKL

SEQ ID NO: 206321 - protein, 11 aa, Tick-borne encephalitis virus
TREYCLHVKLS

SEQ ID NO: 206322 - protein, 11 aa, Tick-borne encephalitis virus
REYCLHVKLSD

SEQ ID NO: 206323 - protein, 11 aa, Tick-borne encephalitis virus
EYCLHVKLSDT

SEQ ID NO: 206324 - protein, 11 aa, Tick-borne encephalitis virus
YCLHVKLSDTK

SEQ ID NO: 206325 - protein, 11 aa, Tick-borne encephalitis virus
CLHVKLSDTKV

SEQ ID NO: 206326 - protein, 11 aa, Tick-borne encephalitis virus
LHVKLSDTKVA

SEQ ID NO: 206327 - protein, 11 aa, Tick-borne encephalitis virus
HVKLSDTKVAA

SEQ ID NO: 206328 - protein, 11 aa, Tick-borne encephalitis virus
VKLSDTKVAAR

SEQ ID NO: 206329 - protein, 11 aa, Tick-borne encephalitis virus
DTKVAARCPTT

SEQ ID NO: 206330 - protein, 11 aa, Tick-borne encephalitis virus
TKVAARCPTTG

SEQ ID NO: 206331 - protein, 11 aa, Tick-borne encephalitis virus
KVAARCPTTGP

SEQ ID NO: 206332 - protein, 11 aa, Tick-borne encephalitis virus
VAARCPTTGPA

SEQ ID NO: 206333 - protein, 11 aa, Tick-borne encephalitis virus
AARCPTTGPAT

SEQ ID NO: 206334 - protein, 11 aa, Tick-borne encephalitis virus
ARCPTTGPATL

SEQ ID NO: 206335 - protein, 11 aa, Tick-borne encephalitis virus
RCPTTGPATLA

SEQ ID NO: 206336 - protein, 11 aa, Tick-borne encephalitis virus
CPTTGPATLAE

SEQ ID NO: 206337 - protein, 11 aa, Tick-borne encephalitis virus
PTMGPATLTEE

SEQ ID NO: 206338 - protein, 11 aa, Tick-borne encephalitis virus
TMGPATLTEEH

SEQ ID NO: 206339 - protein, 11 aa, Tick-borne encephalitis virus
MGPATLTEEHQ

SEQ ID NO: 206340 - protein, 11 aa, Tick-borne encephalitis virus
GPATLAEEHQG

SEQ ID NO: 206341 - protein, 11 aa, Tick-borne encephalitis virus
PATLAEEHQGG

SEQ ID NO: 206342 - protein, 11 aa, Tick-borne encephalitis virus
ATLAEEHQGGT

SEQ ID NO: 206343 - protein, 11 aa, Tick-borne encephalitis virus
TLAEEHQGGTV

SEQ ID NO: 206344 - protein, 11 aa, Tick-borne encephalitis virus
LAEEHQGGTVC

SEQ ID NO: 206345 - protein, 11 aa, Tick-borne encephalitis virus
AEEHQGGTVCK

SEQ ID NO: 206346 - protein, 11 aa, Tick-borne encephalitis virus
EEHQGGTVCKR

SEQ ID NO: 206347 - protein, 11 aa, Tick-borne encephalitis virus
EHQGGTVCKRD

SEQ ID NO: 206348 - protein, 11 aa, Tick-borne encephalitis virus
HQGGTVCKRDQ

SEQ ID NO: 206349 - protein, 11 aa, Tick-borne encephalitis virus
QGGTVCKRDQS

SEQ ID NO: 206350 - protein, 11 aa, Tick-borne encephalitis virus
GGTVCKRDQSD

SEQ ID NO: 206351 - protein, 11 aa, Tick-borne encephalitis virus
CGLFGKGSIVA

SEQ ID NO: 206352 - protein, 11 aa, Tick-borne encephalitis virus
GLFGKGSIVAC

SEQ ID NO: 206353 - protein, 11 aa, Tick-borne encephalitis virus
LFGKGSIVACV

SEQ ID NO: 206354 - protein, 11 aa, Tick-borne encephalitis virus
FGKGSIVACVK

SEQ ID NO: 206355 - protein, 11 aa, Tick-borne encephalitis virus
GKGSIVACVKA

SEQ ID NO: 206356 - protein, 11 aa, Tick-borne encephalitis virus
KGSIVACVKAA

SEQ ID NO: 206357 - protein, 11 aa, Tick-borne encephalitis virus
GSIVACVKAAC

SEQ ID NO: 206358 - protein, 11 aa, Tick-borne encephalitis virus
SIVACVKAACE

SEQ ID NO: 206359 - protein, 11 aa, Tick-borne encephalitis virus
IVACVKAACEA

SEQ ID NO: 206360 - protein, 11 aa, Tick-borne encephalitis virus
VACVKAACEAK

SEQ ID NO: 206361 - protein, 11 aa, Tick-borne encephalitis virus
ACVKAACEAKK

SEQ ID NO: 206362 - protein, 11 aa, Tick-borne encephalitis virus
CVKAACEAKKK

SEQ ID NO: 206363 - protein, 11 aa, Tick-borne encephalitis virus
VKAACEAKKKA

SEQ ID NO: 206364 - protein, 11 aa, Tick-borne encephalitis virus
KAACEAKKKAT

SEQ ID NO: 206365 - protein, 11 aa, Tick-borne encephalitis virus
AACEAKKKATG

SEQ ID NO: 206366 - protein, 11 aa, Tick-borne encephalitis virus
ACEAKKKATGH

SEQ ID NO: 206367 - protein, 11 aa, Tick-borne encephalitis virus
KKKATGHVYDP

SEQ ID NO: 206368 - protein, 11 aa, Tick-borne encephalitis virus
KKATGHVYDPN

SEQ ID NO: 206369 - protein, 11 aa, Tick-borne encephalitis virus
KATGHVYDPNK

SEQ ID NO: 206370 - protein, 11 aa, Tick-borne encephalitis virus
ATGHVYDPNKI

SEQ ID NO: 206371 - protein, 11 aa, Tick-borne encephalitis virus
TGHVYDANRIV

SEQ ID NO: 206372 - protein, 11 aa, Tick-borne encephalitis virus
GHVYDANRIVY

SEQ ID NO: 206373 - protein, 11 aa, Tick-borne encephalitis virus
HVYDPNKIVYP

SEQ ID NO: 206374 - protein, 11 aa, Tick-borne encephalitis virus
VYDPNKIVYPV

SEQ ID NO: 206375 - protein, 11 aa, Tick-borne encephalitis virus
YDANKIVYTIK

SEQ ID NO: 206376 - protein, 11 aa, Tick-borne encephalitis virus
DANRIVYTVKV

SEQ ID NO: 206377 - protein, 11 aa, Tick-borne encephalitis virus
PNKIVYPVKVE

SEQ ID NO: 206378 - protein, 11 aa, Tick-borne encephalitis virus
NRIVYTVKVEP

SEQ ID NO: 206379 - protein, 11 aa, Tick-borne encephalitis virus
RIVYTVKVEPH

SEQ ID NO: 206380 - protein, 11 aa, Tick-borne encephalitis virus
IVYTIKVEPHT

SEQ ID NO: 206381 - protein, 11 aa, Tick-borne encephalitis virus
VYTIKVEPHTG

SEQ ID NO: 206382 - protein, 11 aa, Tick-borne encephalitis virus
YPVKVEPHTGD

SEQ ID NO: 206383 - protein, 11 aa, Tick-borne encephalitis virus
PVKVEPHTGDY

SEQ ID NO: 206384 - protein, 11 aa, Tick-borne encephalitis virus
IKVEPHTGDYV

SEQ ID NO: 206385 - protein, 11 aa, Tick-borne encephalitis virus
VEPHTGDYVAP

SEQ ID NO: 206386 - protein, 11 aa, Tick-borne encephalitis virus
EPHTGDYVAVN

SEQ ID NO: 206387 - protein, 11 aa, Tick-borne encephalitis virus
PHTGDYVAVNE

SEQ ID NO: 206388 - protein, 11 aa, Tick-borne encephalitis virus
HTGDYVAPHET

SEQ ID NO: 206389 - protein, 11 aa, Tick-borne encephalitis virus
TGDYVAPHETH

SEQ ID NO: 206390 - protein, 11 aa, Tick-borne encephalitis virus
GDYVAPHETHS

SEQ ID NO: 206391 - protein, 11 aa, Tick-borne encephalitis virus
DYVAVNETHSG

SEQ ID NO: 206392 - protein, 11 aa, Tick-borne encephalitis virus
YVAVNETHSGR

SEQ ID NO: 206393 - protein, 11 aa, Tick-borne encephalitis virus
VAPHETHSGRK

SEQ ID NO: 206394 - protein, 11 aa, Tick-borne encephalitis virus
APHETHSGRKT

SEQ ID NO: 206395 - protein, 11 aa, Tick-borne encephalitis virus
PHETHSGRKTA

SEQ ID NO: 206396 - protein, 11 aa, Tick-borne encephalitis virus
HETHSGRKTAS

SEQ ID NO: 206397 - protein, 11 aa, Tick-borne encephalitis virus
ETHSGRKTPSF

SEQ ID NO: 206398 - protein, 11 aa, Tick-borne encephalitis virus
THSGRKTPSFT

SEQ ID NO: 206399 - protein, 11 aa, Tick-borne encephalitis virus
HSGRKTASFTI

SEQ ID NO: 206400 - protein, 11 aa, Tick-borne encephalitis virus
SGRKTASFTIS

SEQ ID NO: 206401 - protein, 11 aa, Tick-borne encephalitis virus
GRKTASFTISS

SEQ ID NO: 206402 - protein, 11 aa, Tick-borne encephalitis virus
RKTASFTISSE

SEQ ID NO: 206403 - protein, 11 aa, Tick-borne encephalitis virus
KTASFTISSEK

SEQ ID NO: 206404 - protein, 11 aa, Tick-borne encephalitis virus
TASFTISSEKT

SEQ ID NO: 206405 - protein, 11 aa, Tick-borne encephalitis virus
ASFTISSEKTI

SEQ ID NO: 206406 - protein, 11 aa, Tick-borne encephalitis virus
SFTISSEKTIL

SEQ ID NO: 206407 - protein, 11 aa, Tick-borne encephalitis virus
FTISSEKTILT

SEQ ID NO: 206408 - protein, 11 aa, Tick-borne encephalitis virus
TISSEKTILTM

SEQ ID NO: 206409 - protein, 11 aa, Tick-borne encephalitis virus
ISSEKTILTMG

SEQ ID NO: 206410 - protein, 11 aa, Tick-borne encephalitis virus
SSEKTILTMGE

SEQ ID NO: 206411 - protein, 11 aa, Tick-borne encephalitis virus
SEKTILTMGEY

SEQ ID NO: 206412 - protein, 11 aa, Tick-borne encephalitis virus
EKTILTMGEYG

SEQ ID NO: 206413 - protein, 11 aa, Tick-borne encephalitis virus
KTILTMGEYGD

SEQ ID NO: 206414 - protein, 11 aa, Tick-borne encephalitis virus
TILTMGEYGDV

SEQ ID NO: 206415 - protein, 11 aa, Tick-borne encephalitis virus
ILTMGEYGDVS

SEQ ID NO: 206416 - protein, 11 aa, Tick-borne encephalitis virus
LTMGEYGDVSL

SEQ ID NO: 206417 - protein, 11 aa, Tick-borne encephalitis virus
TMGEYGDVSLL

SEQ ID NO: 206418 - protein, 11 aa, Tick-borne encephalitis virus
MGEYGDVSLLC

SEQ ID NO: 206419 - protein, 11 aa, Tick-borne encephalitis virus
GEYGDVSLLCR

SEQ ID NO: 206420 - protein, 11 aa, Tick-borne encephalitis virus
EYGDVSLLCRV

SEQ ID NO: 206421 - protein, 11 aa, Tick-borne encephalitis virus
YGDVSLLCKVP

SEQ ID NO: 206422 - protein, 11 aa, Tick-borne encephalitis virus
GDVSLLCKVPS

SEQ ID NO: 206423 - protein, 11 aa, Tick-borne encephalitis virus
DVSLLCKVPSG

SEQ ID NO: 206424 - protein, 11 aa, Tick-borne encephalitis virus
VSLLCKVPSGV

SEQ ID NO: 206425 - protein, 11 aa, Tick-borne encephalitis virus
SLLCKVPSGVD

SEQ ID NO: 206426 - protein, 11 aa, Tick-borne encephalitis virus
LLCKVPSGVDL

SEQ ID NO: 206427 - protein, 11 aa, Tick-borne encephalitis virus
LCKVPSGVDLA

SEQ ID NO: 206428 - protein, 11 aa, Tick-borne encephalitis virus
CKVPSGVDLAQ

SEQ ID NO: 206429 - protein, 11 aa, Tick-borne encephalitis virus
KVPSGVDLAQT

SEQ ID NO: 206430 - protein, 11 aa, Tick-borne encephalitis virus
VPSGVDLAQTV

SEQ ID NO: 206431 - protein, 11 aa, Tick-borne encephalitis virus
PSGVDLAQTVI

SEQ ID NO: 206432 - protein, 11 aa, Tick-borne encephalitis virus
QTVILELDKTV

SEQ ID NO: 206433 - protein, 11 aa, Tick-borne encephalitis virus
TVILELDKTVE

SEQ ID NO: 206434 - protein, 11 aa, Tick-borne encephalitis virus
VILELDKTVEH

SEQ ID NO: 206435 - protein, 11 aa, Tick-borne encephalitis virus
ILELDKTVEHL

SEQ ID NO: 206436 - protein, 11 aa, Tick-borne encephalitis virus
LELDKTVEHLP

SEQ ID NO: 206437 - protein, 11 aa, Tick-borne encephalitis virus
ELDKTVEHLPT

SEQ ID NO: 206438 - protein, 11 aa, Tick-borne encephalitis virus
LDKTVEHLPTA

SEQ ID NO: 206439 - protein, 11 aa, Tick-borne encephalitis virus
DKTVEHLPTAW

SEQ ID NO: 206440 - protein, 11 aa, Tick-borne encephalitis virus
KTVEHLPTAWQ

SEQ ID NO: 206441 - protein, 11 aa, Tick-borne encephalitis virus
TVEHLPTAWQV

SEQ ID NO: 206442 - protein, 11 aa, Tick-borne encephalitis virus
VEHLPTAWQVH

SEQ ID NO: 206443 - protein, 11 aa, Tick-borne encephalitis virus
EHLPTAWQVRR

SEQ ID NO: 206444 - protein, 11 aa, Tick-borne encephalitis virus
HLPTAWQVRRD

SEQ ID NO: 206445 - protein, 11 aa, Tick-borne encephalitis virus
LPTAWQVRRDW

SEQ ID NO: 206446 - protein, 11 aa, Tick-borne encephalitis virus
PTAWQVRRDWF

SEQ ID NO: 206447 - protein, 11 aa, Tick-borne encephalitis virus
TAWQVRRDWFN

SEQ ID NO: 206448 - protein, 11 aa, Tick-borne encephalitis virus
AWQVRRDWFND

SEQ ID NO: 206449 - protein, 11 aa, Tick-borne encephalitis virus
WQVRRDWFNDL

SEQ ID NO: 206450 - protein, 11 aa, Tick-borne encephalitis virus
QVRRDWFNDLA

SEQ ID NO: 206451 - protein, 11 aa, Tick-borne encephalitis virus
VRRDWFNDLAL

SEQ ID NO: 206452 - protein, 11 aa, Tick-borne encephalitis virus
RRDWFNDLALP

SEQ ID NO: 206453 - protein, 11 aa, Tick-borne encephalitis virus
DWFNDLALPWR

SEQ ID NO: 206454 - protein, 11 aa, Tick-borne encephalitis virus
WFNDLALPWRH

SEQ ID NO: 206455 - protein, 11 aa, Tick-borne encephalitis virus
FNDLALPWRHE

SEQ ID NO: 206456 - protein, 11 aa, Tick-borne encephalitis virus
NDLALPWRHEG

SEQ ID NO: 206457 - protein, 11 aa, Tick-borne encephalitis virus
DLALPWRHEGA

SEQ ID NO: 206458 - protein, 11 aa, Tick-borne encephalitis virus
LALPWRHEGAQ

SEQ ID NO: 206459 - protein, 11 aa, Tick-borne encephalitis virus
HEGAQQWNNAE

SEQ ID NO: 206460 - protein, 11 aa, Tick-borne encephalitis virus
EGAQQWNNAER

SEQ ID NO: 206461 - protein, 11 aa, Tick-borne encephalitis virus
GAQQWNNAERL

SEQ ID NO: 206462 - protein, 11 aa, Tick-borne encephalitis virus
AQQWNNAERLV

SEQ ID NO: 206463 - protein, 11 aa, Tick-borne encephalitis virus
QQWNNAERLVE

SEQ ID NO: 206464 - protein, 11 aa, Tick-borne encephalitis virus
QWNNAERLVEF

SEQ ID NO: 206465 - protein, 11 aa, Tick-borne encephalitis virus
NNAERLVEFGV

SEQ ID NO: 206466 - protein, 11 aa, Tick-borne encephalitis virus
NAERLVEFGVP

SEQ ID NO: 206467 - protein, 11 aa, Tick-borne encephalitis virus
AERLVEFGVPH

SEQ ID NO: 206468 - protein, 11 aa, Tick-borne encephalitis virus
ERLVEFGVPHA

SEQ ID NO: 206469 - protein, 11 aa, Tick-borne encephalitis virus
RLVEFGVPHAV

SEQ ID NO: 206470 - protein, 11 aa, Tick-borne encephalitis virus
LVEFGVPHAVK

SEQ ID NO: 206471 - protein, 11 aa, Tick-borne encephalitis virus
VEFGVPHAVKM

SEQ ID NO: 206472 - protein, 11 aa, Tick-borne encephalitis virus
EFGVPHAVKMD

SEQ ID NO: 206473 - protein, 11 aa, Tick-borne encephalitis virus
FGVPHAVKMDV

SEQ ID NO: 206474 - protein, 11 aa, Tick-borne encephalitis virus
GVPHAVKMDVY

SEQ ID NO: 206475 - protein, 11 aa, Tick-borne encephalitis virus
VPHAVKMDVYN

SEQ ID NO: 206476 - protein, 11 aa, Tick-borne encephalitis virus
LGDQTGVLLKA

SEQ ID NO: 206477 - protein, 11 aa, Tick-borne encephalitis virus
GDQTGVLLKAL

SEQ ID NO: 206478 - protein, 11 aa, Tick-borne encephalitis virus
DQTGVLLKALA

SEQ ID NO: 206479 - protein, 11 aa, Tick-borne encephalitis virus
QTGVLLKALAG

SEQ ID NO: 206480 - protein, 11 aa, Tick-borne encephalitis virus
TGVLLKALAGV

SEQ ID NO: 206481 - protein, 11 aa, Tick-borne encephalitis virus
GVLLKALAGVP

SEQ ID NO: 206482 - protein, 11 aa, Tick-borne encephalitis virus
VLLKALAGVPV

SEQ ID NO: 206483 - protein, 11 aa, Tick-borne encephalitis virus
LLKALAGVPVA

SEQ ID NO: 206484 - protein, 11 aa, Tick-borne encephalitis virus
LKALAGVPVAH

SEQ ID NO: 206485 - protein, 11 aa, Tick-borne encephalitis virus
KALAGVPVAHI

SEQ ID NO: 206486 - protein, 11 aa, Tick-borne encephalitis virus
ALAGVPVAHIE

SEQ ID NO: 206487 - protein, 11 aa, Tick-borne encephalitis virus
LAGVPVAHIEG

SEQ ID NO: 206488 - protein, 11 aa, Tick-borne encephalitis virus
AGVPVAHIEGT

SEQ ID NO: 206489 - protein, 11 aa, Tick-borne encephalitis virus
GVPVAHIEGTK

SEQ ID NO: 206490 - protein, 11 aa, Tick-borne encephalitis virus
VPVAHIEGTKY

SEQ ID NO: 206491 - protein, 11 aa, Tick-borne encephalitis virus
PVAHIEGTKYH

SEQ ID NO: 206492 - protein, 11 aa, Tick-borne encephalitis virus
VAHIEGTKYHL

SEQ ID NO: 206493 - protein, 11 aa, Tick-borne encephalitis virus
AHIEGTKYHLK

SEQ ID NO: 206494 - protein, 11 aa, Tick-borne encephalitis virus
HIEGTKYHLKS

SEQ ID NO: 206495 - protein, 11 aa, Tick-borne encephalitis virus
IEGTKYHLKSG

SEQ ID NO: 206496 - protein, 11 aa, Tick-borne encephalitis virus
EGTKYHLKSGH

SEQ ID NO: 206497 - protein, 11 aa, Tick-borne encephalitis virus
GAKYHLKSGHV

SEQ ID NO: 206498 - protein, 11 aa, Tick-borne encephalitis virus
AKYHLKSGHVT

SEQ ID NO: 206499 - protein, 11 aa, Tick-borne encephalitis virus
CEVGLEKLKMN

SEQ ID NO: 206500 - protein, 11 aa, Tick-borne encephalitis virus
EVGLEKLKMNG

SEQ ID NO: 206501 - protein, 11 aa, Tick-borne encephalitis virus
VGLEKLKMNGL

SEQ ID NO: 206502 - protein, 11 aa, Tick-borne encephalitis virus
GLEKLKMNGLT

SEQ ID NO: 206503 - protein, 11 aa, Tick-borne encephalitis virus
LEKLKMNGLTY

SEQ ID NO: 206504 - protein, 11 aa, Tick-borne encephalitis virus
EKLKMNGLTYT

SEQ ID NO: 206505 - protein, 11 aa, Tick-borne encephalitis virus
KLKMKGLTYTV

SEQ ID NO: 206506 - protein, 11 aa, Tick-borne encephalitis virus
LKMKGLTYTVC

SEQ ID NO: 206507 - protein, 11 aa, Tick-borne encephalitis virus
KMKGLTYTVCD

SEQ ID NO: 206508 - protein, 11 aa, Tick-borne encephalitis virus
MKGLTYTVCDK

SEQ ID NO: 206509 - protein, 11 aa, Tick-borne encephalitis virus
KGLTYTVCDKT

SEQ ID NO: 206510 - protein, 11 aa, Tick-borne encephalitis virus
GLTYTVCDKTK

SEQ ID NO: 206511 - protein, 11 aa, Tick-borne encephalitis virus
LTYTVCDKTKF

SEQ ID NO: 206512 - protein, 11 aa, Tick-borne encephalitis virus
TYTMCDKTKFA

SEQ ID NO: 206513 - protein, 11 aa, Tick-borne encephalitis virus
YTMCDKTKFAW

SEQ ID NO: 206514 - protein, 11 aa, Tick-borne encephalitis virus
TMCDKTKFAWK

SEQ ID NO: 206515 - protein, 11 aa, Tick-borne encephalitis virus
MCDKTKFAWKR

SEQ ID NO: 206516 - protein, 11 aa, Tick-borne encephalitis virus
CDKTKFTWKRA

SEQ ID NO: 206517 - protein, 11 aa, Tick-borne encephalitis virus
DKTKFTWKRAP

SEQ ID NO: 206518 - protein, 11 aa, Tick-borne encephalitis virus
KTKFTWKRAPT

SEQ ID NO: 206519 - protein, 11 aa, Tick-borne encephalitis virus
TKFTWKRAPTD

SEQ ID NO: 206520 - protein, 11 aa, Tick-borne encephalitis virus
KFTWKRAPTDS

SEQ ID NO: 206521 - protein, 11 aa, Tick-borne encephalitis virus
FTWKRAPTDSG

SEQ ID NO: 206522 - protein, 11 aa, Tick-borne encephalitis virus
TWKRAPTDSGH

SEQ ID NO: 206523 - protein, 11 aa, Tick-borne encephalitis virus
WKRAPTDSGHD

SEQ ID NO: 206524 - protein, 11 aa, Tick-borne encephalitis virus
KRAPTDSGHDT

SEQ ID NO: 206525 - protein, 11 aa, Tick-borne encephalitis virus
RAPTDSGHDTV

SEQ ID NO: 206526 - protein, 11 aa, Tick-borne encephalitis virus
TPTDSGHDTVV

SEQ ID NO: 206527 - protein, 11 aa, Tick-borne encephalitis virus
SGHDTVVMEVT

SEQ ID NO: 206528 - protein, 11 aa, Tick-borne encephalitis virus
GHDTVVMEVTF

SEQ ID NO: 206529 - protein, 11 aa, Tick-borne encephalitis virus
HDTVVMEVTFS

SEQ ID NO: 206530 - protein, 11 aa, Tick-borne encephalitis virus
DTVVMEVTFSG

SEQ ID NO: 206531 - protein, 11 aa, Tick-borne encephalitis virus
TVVMEVTFSGT

SEQ ID NO: 206532 - protein, 11 aa, Tick-borne encephalitis virus
VVMEVTFSGTK

SEQ ID NO: 206533 - protein, 11 aa, Tick-borne encephalitis virus
VMEVTFSGTKP

SEQ ID NO: 206534 - protein, 11 aa, Tick-borne encephalitis virus
MEVTFSGTKPC

SEQ ID NO: 206535 - protein, 11 aa, Tick-borne encephalitis virus
EVTFSGTKPCR

SEQ ID NO: 206536 - protein, 11 aa, Tick-borne encephalitis virus
VTFSGTKPCRI

SEQ ID NO: 206537 - protein, 11 aa, Tick-borne encephalitis virus
TFSGTKPCRIP

SEQ ID NO: 206538 - protein, 11 aa, Tick-borne encephalitis virus
RIPVRAVAHGF

SEQ ID NO: 206539 - protein, 11 aa, Tick-borne encephalitis virus
IPVRAVAHGFP

SEQ ID NO: 206540 - protein, 11 aa, Tick-borne encephalitis virus
PVRAVAHGFPD

SEQ ID NO: 206541 - protein, 11 aa, Tick-borne encephalitis virus
VRAVAHGFPDV

SEQ ID NO: 206542 - protein, 11 aa, Tick-borne encephalitis virus
RAVAHGFPDVN

SEQ ID NO: 206543 - protein, 11 aa, Tick-borne encephalitis virus
AVAHGFPDVNV

SEQ ID NO: 206544 - protein, 11 aa, Tick-borne encephalitis virus
VAHGFPDVNVA

SEQ ID NO: 206545 - protein, 11 aa, Tick-borne encephalitis virus
AHGFPDVNVAM

SEQ ID NO: 206546 - protein, 11 aa, Tick-borne encephalitis virus
HGFPDVNVAML

SEQ ID NO: 206547 - protein, 11 aa, Tick-borne encephalitis virus
GFPDVNVAMLI

SEQ ID NO: 206548 - protein, 11 aa, Tick-borne encephalitis virus
FPDVNVAMLIT

SEQ ID NO: 206549 - protein, 11 aa, Tick-borne encephalitis virus
MLITPNPTIET

SEQ ID NO: 206550 - protein, 11 aa, Tick-borne encephalitis virus
LITPNPTIETN

SEQ ID NO: 206551 - protein, 11 aa, Tick-borne encephalitis virus
ITPNPTIETNG

SEQ ID NO: 206552 - protein, 11 aa, Tick-borne encephalitis virus
TPNPTIETNGG

SEQ ID NO: 206553 - protein, 11 aa, Tick-borne encephalitis virus
PNPTIETNGGG

SEQ ID NO: 206554 - protein, 11 aa, Tick-borne encephalitis virus
NPTIETNGGGF

SEQ ID NO: 206555 - protein, 11 aa, Tick-borne encephalitis virus
PTIETNGGGFI

SEQ ID NO: 206556 - protein, 11 aa, Tick-borne encephalitis virus
TIETNGGGFIE

SEQ ID NO: 206557 - protein, 11 aa, Tick-borne encephalitis virus
IETNGGGFIEM

SEQ ID NO: 206558 - protein, 11 aa, Tick-borne encephalitis virus
ETNGGGFIEMQ

SEQ ID NO: 206559 - protein, 11 aa, Tick-borne encephalitis virus
TNGGGFIEMQL

SEQ ID NO: 206560 - protein, 11 aa, Tick-borne encephalitis virus
DNIIYVGELSY

SEQ ID NO: 206561 - protein, 11 aa, Tick-borne encephalitis virus
NIIYVGELSYQ

SEQ ID NO: 206562 - protein, 11 aa, Tick-borne encephalitis virus
IIYVGELSYQW

SEQ ID NO: 206563 - protein, 11 aa, Tick-borne encephalitis virus
IYVGELSYQWF

SEQ ID NO: 206564 - protein, 11 aa, Tick-borne encephalitis virus
YVGELSYQWFQ

SEQ ID NO: 206565 - protein, 11 aa, Tick-borne encephalitis virus
VGELSYQWFQK

SEQ ID NO: 206566 - protein, 11 aa, Tick-borne encephalitis virus
GELSYQWFQKG

SEQ ID NO: 206567 - protein, 11 aa, Tick-borne encephalitis virus
ELSYQWFQKGS

SEQ ID NO: 206568 - protein, 11 aa, Tick-borne encephalitis virus
LSYQWFQKGSS

SEQ ID NO: 206569 - protein, 11 aa, Tick-borne encephalitis virus
SYQWFQKGSSI

SEQ ID NO: 206570 - protein, 11 aa, Tick-borne encephalitis virus
YQWFQKGSSIG

SEQ ID NO: 206571 - protein, 11 aa, Tick-borne encephalitis virus
SSIGRVFQKTK

SEQ ID NO: 206572 - protein, 11 aa, Tick-borne encephalitis virus
SIGRVFQKTKK

SEQ ID NO: 206573 - protein, 11 aa, Tick-borne encephalitis virus
IGRVFQKTKKG

SEQ ID NO: 206574 - protein, 11 aa, Tick-borne encephalitis virus
GRVFQKTKKGI

SEQ ID NO: 206575 - protein, 11 aa, Tick-borne encephalitis virus
RVFQKTKKGIE

SEQ ID NO: 206576 - protein, 11 aa, Tick-borne encephalitis virus
VFQKTKKGIER

SEQ ID NO: 206577 - protein, 11 aa, Tick-borne encephalitis virus
FQKTKKGIERL

SEQ ID NO: 206578 - protein, 11 aa, Tick-borne encephalitis virus
QKTKKGIERLT

SEQ ID NO: 206579 - protein, 11 aa, Tick-borne encephalitis virus
KTKKGIERLTV

SEQ ID NO: 206580 - protein, 11 aa, Tick-borne encephalitis virus
TKKGIERLTVI

SEQ ID NO: 206581 - protein, 11 aa, Tick-borne encephalitis virus
KKGIERLTVIG

SEQ ID NO: 206582 - protein, 11 aa, Tick-borne encephalitis virus
RGIERLTVIGE

SEQ ID NO: 206583 - protein, 11 aa, Tick-borne encephalitis virus
IGEHAWDFGSA

SEQ ID NO: 206584 - protein, 11 aa, Tick-borne encephalitis virus
GEHAWDFGSAG

SEQ ID NO: 206585 - protein, 11 aa, Tick-borne encephalitis virus
EHAWDFGSAGG

SEQ ID NO: 206586 - protein, 11 aa, Tick-borne encephalitis virus
HAWDFGSAGGF

SEQ ID NO: 206587 - protein, 11 aa, Tick-borne encephalitis virus
AWDFGSAGGFL

SEQ ID NO: 206588 - protein, 11 aa, Tick-borne encephalitis virus
WDFGSAGGFLS

SEQ ID NO: 206589 - protein, 11 aa, Tick-borne encephalitis virus
DFGSAGGFLSS

SEQ ID NO: 206590 - protein, 11 aa, Tick-borne encephalitis virus
FGSAGGFLSSI

SEQ ID NO: 206591 - protein, 11 aa, Tick-borne encephalitis virus
GSAGGFLSSIG

SEQ ID NO: 206592 - protein, 11 aa, Tick-borne encephalitis virus
SAGGFLSSIGK

SEQ ID NO: 206593 - protein, 11 aa, Tick-borne encephalitis virus
AGGFLSSIGKA

SEQ ID NO: 206594 - protein, 11 aa, Tick-borne encephalitis virus
GGFLSSIGKAV

SEQ ID NO: 206595 - protein, 11 aa, Tick-borne encephalitis virus
GFLSSIGKAVH

SEQ ID NO: 206596 - protein, 11 aa, Tick-borne encephalitis virus
FLSSIGKAVHT

SEQ ID NO: 206597 - protein, 11 aa, Tick-borne encephalitis virus
LSSIGKAVHTV

SEQ ID NO: 206598 - protein, 11 aa, Tick-borne encephalitis virus
SSIGKAVHTVL

SEQ ID NO: 206599 - protein, 11 aa, Tick-borne encephalitis virus
SIGKAVHTVLG

SEQ ID NO: 206600 - protein, 11 aa, Tick-borne encephalitis virus
IGKAVHTVLGG

SEQ ID NO: 206601 - protein, 11 aa, Tick-borne encephalitis virus
GKAVHTVLGGA

SEQ ID NO: 206602 - protein, 11 aa, Tick-borne encephalitis virus
KAVHTVLGGAF

SEQ ID NO: 206603 - protein, 11 aa, Tick-borne encephalitis virus
AVHTVLGGAFN

SEQ ID NO: 206604 - protein, 11 aa, Tick-borne encephalitis virus
VHTVLGGAFNS

SEQ ID NO: 206605 - protein, 11 aa, Tick-borne encephalitis virus
HTVLGGAFNSI

SEQ ID NO: 206606 - protein, 11 aa, Tick-borne encephalitis virus
TVLGGAFNSIF

SEQ ID NO: 206607 - protein, 11 aa, Tick-borne encephalitis virus
VLGGAFNSIFG

SEQ ID NO: 206608 - protein, 11 aa, Tick-borne encephalitis virus
LGGAFNSIFGG

SEQ ID NO: 206609 - protein, 11 aa, Tick-borne encephalitis virus
GGAFNSIFGGV

SEQ ID NO: 206610 - protein, 11 aa, Tick-borne encephalitis virus
GAFNSIFGGVG

SEQ ID NO: 206611 - protein, 11 aa, Tick-borne encephalitis virus
AFNSIFGGVGF

SEQ ID NO: 206612 - protein, 11 aa, Tick-borne encephalitis virus
FNSIFGGVGFL

SEQ ID NO: 206613 - protein, 11 aa, Tick-borne encephalitis virus
NSIFGGVGFLP

SEQ ID NO: 206614 - protein, 11 aa, Tick-borne encephalitis virus
SIFGGVGFLPK

SEQ ID NO: 206615 - protein, 11 aa, Tick-borne encephalitis virus
IFGGVGFLPKL

SEQ ID NO: 206616 - protein, 11 aa, Tick-borne encephalitis virus
FGGVGFLPKLL

SEQ ID NO: 206617 - protein, 11 aa, Tick-borne encephalitis virus
GGVGFLPKLLL

SEQ ID NO: 206618 - protein, 11 aa, Tick-borne encephalitis virus
GVGFLPKLLLG

SEQ ID NO: 206619 - protein, 11 aa, Tick-borne encephalitis virus
GVVLAWLGLNM

SEQ ID NO: 206620 - protein, 11 aa, Tick-borne encephalitis virus
VVLAWLGLNMR

SEQ ID NO: 206621 - protein, 11 aa, Tick-borne encephalitis virus
VLAWLGLNMRN

SEQ ID NO: 206622 - protein, 11 aa, Tick-borne encephalitis virus
LNMRNPTMSMG

SEQ ID NO: 206623 - protein, 11 aa, Tick-borne encephalitis virus
NMRNPTMSMGF

SEQ ID NO: 206624 - protein, 11 aa, Tick-borne encephalitis virus
MRNPTMSMGFL

SEQ ID NO: 206625 - protein, 11 aa, Tick-borne encephalitis virus
RNPTMSMGFLL

SEQ ID NO: 206626 - protein, 11 aa, Tick-borne encephalitis virus
NPTMSMGFLLA

SEQ ID NO: 206627 - protein, 11 aa, Tick-borne encephalitis virus
PTMSMGFLLAG

SEQ ID NO: 206628 - protein, 11 aa, Tick-borne encephalitis virus
TMSMGFLLAGG

SEQ ID NO: 206629 - protein, 11 aa, Tick-borne encephalitis virus
MSMGFLLAGGL

SEQ ID NO: 206630 - protein, 11 aa, Tick-borne encephalitis virus
SMGFLLAGGLV

SEQ ID NO: 206631 - protein, 11 aa, Tick-borne encephalitis virus
MGFLLAGGLVL

SEQ ID NO: 206632 - protein, 11 aa, Tick-borne encephalitis virus
GFLLAGGLVLA

SEQ ID NO: 206633 - protein, 11 aa, Tick-borne encephalitis virus
FLLAGVLVLAM

SEQ ID NO: 206634 - protein, 11 aa, Tick-borne encephalitis virus
LLAGVLVLAMT

SEQ ID NO: 206635 - protein, 11 aa, Tick-borne encephalitis virus
LAGVLVLAMTL

SEQ ID NO: 206636 - protein, 11 aa, Tick-borne encephalitis virus
AGVLVLAMTLG

SEQ ID NO: 206637 - protein, 11 aa, Tick-borne encephalitis virus
GVLVLAMTLGV

SEQ ID NO: 206638 - protein, 11 aa, Tick-borne encephalitis virus
VLVLAMTLGVG

SEQ ID NO: 206639 - protein, 11 aa, Tick-borne encephalitis virus
MTLGVGADVGG

SEQ ID NO: 206640 - protein, 11 aa, Tick-borne encephalitis virus
TLGVGADVGGA

SEQ ID NO: 206641 - protein, 11 aa, Tick-borne encephalitis virus
LGVGADVGGAV

SEQ ID NO: 206642 - protein, 11 aa, Tick-borne encephalitis virus
GVGADVGGAVD

SEQ ID NO: 206643 - protein, 11 aa, Tick-borne encephalitis virus
VGADVGGAVDT

SEQ ID NO: 206644 - protein, 11 aa, Tick-borne encephalitis virus
GADVGGAVDTE

SEQ ID NO: 206645 - protein, 11 aa, Tick-borne encephalitis virus
ADVGGAVDTER

SEQ ID NO: 206646 - protein, 11 aa, Tick-borne encephalitis virus
DVGGAVDTERM

SEQ ID NO: 206647 - protein, 11 aa, Tick-borne encephalitis virus
VGGAVDTERME

SEQ ID NO: 206648 - protein, 11 aa, Tick-borne encephalitis virus
GGAVDTERMEL

SEQ ID NO: 206649 - protein, 11 aa, Tick-borne encephalitis virus
GAVDTERMELR

SEQ ID NO: 206650 - protein, 11 aa, Tick-borne encephalitis virus
EVSEWYDNYAF

SEQ ID NO: 206651 - protein, 11 aa, Tick-borne encephalitis virus
VSEWYDNYAFY

SEQ ID NO: 206652 - protein, 11 aa, Tick-borne encephalitis virus
SEWYDNYAFYP

SEQ ID NO: 206653 - protein, 11 aa, Tick-borne encephalitis virus
EWYDNYAFYPE

SEQ ID NO: 206654 - protein, 11 aa, Tick-borne encephalitis virus
WYDNYAFYPET

SEQ ID NO: 206655 - protein, 11 aa, Tick-borne encephalitis virus
YDNYAFYPETP

SEQ ID NO: 206656 - protein, 11 aa, Tick-borne encephalitis virus
DNYAFYPETPG

SEQ ID NO: 206657 - protein, 11 aa, Tick-borne encephalitis virus
NYAFYPETPGA

SEQ ID NO: 206658 - protein, 11 aa, Tick-borne encephalitis virus
YAFYPETPGAL

SEQ ID NO: 206659 - protein, 11 aa, Tick-borne encephalitis virus
AFYPETPGALA

SEQ ID NO: 206660 - protein, 11 aa, Tick-borne encephalitis virus
FYPETPGALAS

SEQ ID NO: 206661 - protein, 11 aa, Tick-borne encephalitis virus
ETPGALASAIR

SEQ ID NO: 206662 - protein, 11 aa, Tick-borne encephalitis virus
TPGALASAIRE

SEQ ID NO: 206663 - protein, 11 aa, Tick-borne encephalitis virus
PGALASAIKEA

SEQ ID NO: 206664 - protein, 11 aa, Tick-borne encephalitis virus
GALASAIKEAF

SEQ ID NO: 206665 - protein, 11 aa, Tick-borne encephalitis virus
ALASAIRETFE

SEQ ID NO: 206666 - protein, 11 aa, Tick-borne encephalitis virus
LASAIKEAFEE

SEQ ID NO: 206667 - protein, 11 aa, Tick-borne encephalitis virus
ASAIRETFEEG

SEQ ID NO: 206668 - protein, 11 aa, Tick-borne encephalitis virus
SAIKETFEEGS

SEQ ID NO: 206669 - protein, 11 aa, Tick-borne encephalitis virus
AIKETFEEGSC

SEQ ID NO: 206670 - protein, 11 aa, Tick-borne encephalitis virus
IKETFEEGSCG

SEQ ID NO: 206671 - protein, 11 aa, Tick-borne encephalitis virus
KETFEEGSCGV

SEQ ID NO: 206672 - protein, 11 aa, Tick-borne encephalitis virus
ETFEEGSCGVV

SEQ ID NO: 206673 - protein, 11 aa, Tick-borne encephalitis virus
TFEEGSCGVVP

SEQ ID NO: 206674 - protein, 11 aa, Tick-borne encephalitis virus
FEEGSCGVVPQ

SEQ ID NO: 206675 - protein, 11 aa, Tick-borne encephalitis virus
EEGSCGVVPQN

SEQ ID NO: 206676 - protein, 11 aa, Tick-borne encephalitis virus
EGSCGVVPQNR

SEQ ID NO: 206677 - protein, 11 aa, Tick-borne encephalitis virus
GSCGVVPQNRL

SEQ ID NO: 206678 - protein, 11 aa, Tick-borne encephalitis virus
SCGVVPQNRLE

SEQ ID NO: 206679 - protein, 11 aa, Tick-borne encephalitis virus
CGVVPQNRLEM

SEQ ID NO: 206680 - protein, 11 aa, Tick-borne encephalitis virus
GVVPQNRLEMA

SEQ ID NO: 206681 - protein, 11 aa, Tick-borne encephalitis virus
VVPQNRLEMAM

SEQ ID NO: 206682 - protein, 11 aa, Tick-borne encephalitis virus
LPQNRLEMAMW

SEQ ID NO: 206683 - protein, 11 aa, Tick-borne encephalitis virus
NRLEMAMWRSA

SEQ ID NO: 206684 - protein, 11 aa, Tick-borne encephalitis virus
RLEMAMWRSSV

SEQ ID NO: 206685 - protein, 11 aa, Tick-borne encephalitis virus
LEMAMWRSSVT

SEQ ID NO: 206686 - protein, 11 aa, Tick-borne encephalitis virus
EMAMWRSSVTE

SEQ ID NO: 206687 - protein, 11 aa, Tick-borne encephalitis virus
MAMWRSSVTEL

SEQ ID NO: 206688 - protein, 11 aa, Tick-borne encephalitis virus
AMWRSSVTELN

SEQ ID NO: 206689 - protein, 11 aa, Tick-borne encephalitis virus
MWRSSVTELNL

SEQ ID NO: 206690 - protein, 11 aa, Tick-borne encephalitis virus
WRSSVTELNLA

SEQ ID NO: 206691 - protein, 11 aa, Tick-borne encephalitis virus
RSSVTELNLAL

SEQ ID NO: 206692 - protein, 11 aa, Tick-borne encephalitis virus
SSVTELNLALA

SEQ ID NO: 206693 - protein, 11 aa, Tick-borne encephalitis virus
SVTELNLALAE

SEQ ID NO: 206694 - protein, 11 aa, Tick-borne encephalitis virus
VTELNLALAEG

SEQ ID NO: 206695 - protein, 11 aa, Tick-borne encephalitis virus
TELNLALAEGE

SEQ ID NO: 206696 - protein, 11 aa, Tick-borne encephalitis virus
ELNLALAEGEA

SEQ ID NO: 206697 - protein, 11 aa, Tick-borne encephalitis virus
LNLALAEGEAN

SEQ ID NO: 206698 - protein, 11 aa, Tick-borne encephalitis virus
NLALAEGEANL

SEQ ID NO: 206699 - protein, 11 aa, Tick-borne encephalitis virus
LALAEGEANLT

SEQ ID NO: 206700 - protein, 11 aa, Tick-borne encephalitis virus
ALAEGEANLTV

SEQ ID NO: 206701 - protein, 11 aa, Tick-borne encephalitis virus
LAEGEANLTVV

SEQ ID NO: 206702 - protein, 11 aa, Tick-borne encephalitis virus
AEGEANLTVVV

SEQ ID NO: 206703 - protein, 11 aa, Tick-borne encephalitis virus
EGEANLTVVVD

SEQ ID NO: 206704 - protein, 11 aa, Tick-borne encephalitis virus
GEANLTVVVDK

SEQ ID NO: 206705 - protein, 11 aa, Tick-borne encephalitis virus
EANLTVVVDKF

SEQ ID NO: 206706 - protein, 11 aa, Tick-borne encephalitis virus
ANLTVVVDKFD

SEQ ID NO: 206707 - protein, 11 aa, Tick-borne encephalitis virus
NLTVVVDKFDP

SEQ ID NO: 206708 - protein, 11 aa, Tick-borne encephalitis virus
LTVVVDKFDPT

SEQ ID NO: 206709 - protein, 11 aa, Tick-borne encephalitis virus
TVVVDKFDPTD

SEQ ID NO: 206710 - protein, 11 aa, Tick-borne encephalitis virus
VVVDKFDPTDY

SEQ ID NO: 206711 - protein, 11 aa, Tick-borne encephalitis virus
VVDKFDPTDYR

SEQ ID NO: 206712 - protein, 11 aa, Tick-borne encephalitis virus
VDKFDPTDYRG

SEQ ID NO: 206713 - protein, 11 aa, Tick-borne encephalitis virus
DKFDPTDYRGG

SEQ ID NO: 206714 - protein, 11 aa, Tick-borne encephalitis virus
KFDPTDYRGGV

SEQ ID NO: 206715 - protein, 11 aa, Tick-borne encephalitis virus
FDPTDYRGGVP

SEQ ID NO: 206716 - protein, 11 aa, Tick-borne encephalitis virus
DPTDYRGGVPG

SEQ ID NO: 206717 - protein, 11 aa, Tick-borne encephalitis virus
PTDYRGGVPGL

SEQ ID NO: 206718 - protein, 11 aa, Tick-borne encephalitis virus
TDYRGGVPGLL

SEQ ID NO: 206719 - protein, 11 aa, Tick-borne encephalitis virus
DYRGGVPGLLK

SEQ ID NO: 206720 - protein, 11 aa, Tick-borne encephalitis virus
YRGGVPGLLKK

SEQ ID NO: 206721 - protein, 11 aa, Tick-borne encephalitis virus
RGGVPGLLKKG

SEQ ID NO: 206722 - protein, 11 aa, Tick-borne encephalitis virus
GGVPGLLKKGK

SEQ ID NO: 206723 - protein, 11 aa, Tick-borne encephalitis virus
GVPGLLKKGKD

SEQ ID NO: 206724 - protein, 11 aa, Tick-borne encephalitis virus
VPGLLKKGKDI

SEQ ID NO: 206725 - protein, 11 aa, Tick-borne encephalitis virus
PGLLKKGKDIR

SEQ ID NO: 206726 - protein, 11 aa, Tick-borne encephalitis virus
GLLRKGKDIKV

SEQ ID NO: 206727 - protein, 11 aa, Tick-borne encephalitis virus
LLRKGKDIKVS

SEQ ID NO: 206728 - protein, 11 aa, Tick-borne encephalitis virus
LRKGKDIKVSW

SEQ ID NO: 206729 - protein, 11 aa, Tick-borne encephalitis virus
RKGKDIKVSWK

SEQ ID NO: 206730 - protein, 11 aa, Tick-borne encephalitis virus
KGKDIKVSWRS

SEQ ID NO: 206731 - protein, 11 aa, Tick-borne encephalitis virus
GKDIRVSWKSW

SEQ ID NO: 206732 - protein, 11 aa, Tick-borne encephalitis virus
KDIRVSWKSWG

SEQ ID NO: 206733 - protein, 11 aa, Tick-borne encephalitis virus
DIKVSWKSWGQ

SEQ ID NO: 206734 - protein, 11 aa, Tick-borne encephalitis virus
IKVSWKSWGQS

SEQ ID NO: 206735 - protein, 11 aa, Tick-borne encephalitis virus
MIWSIPEAPRR

SEQ ID NO: 206736 - protein, 11 aa, Tick-borne encephalitis virus
IWSIPEAPRRF

SEQ ID NO: 206737 - protein, 11 aa, Tick-borne encephalitis virus
WSIPEAPRRFM

SEQ ID NO: 206738 - protein, 11 aa, Tick-borne encephalitis virus
SIPEAPRRFMV

SEQ ID NO: 206739 - protein, 11 aa, Tick-borne encephalitis virus
IPEAPRRFMVG

SEQ ID NO: 206740 - protein, 11 aa, Tick-borne encephalitis virus
PEASRRFMVGT

SEQ ID NO: 206741 - protein, 11 aa, Tick-borne encephalitis virus
EAPRRFMVGIE

SEQ ID NO: 206742 - protein, 11 aa, Tick-borne encephalitis virus
ASRRFMVGTEG

SEQ ID NO: 206743 - protein, 11 aa, Tick-borne encephalitis virus
PRRFMVGTEGS

SEQ ID NO: 206744 - protein, 11 aa, Tick-borne encephalitis virus
NECPLERRKTG

SEQ ID NO: 206745 - protein, 11 aa, Tick-borne encephalitis virus
ECPLERRKTGI

SEQ ID NO: 206746 - protein, 11 aa, Tick-borne encephalitis virus
CPLERRKTGIF

SEQ ID NO: 206747 - protein, 11 aa, Tick-borne encephalitis virus
PPERRKTGVFT

SEQ ID NO: 206748 - protein, 11 aa, Tick-borne encephalitis virus
PERRKTGVFTV

SEQ ID NO: 206749 - protein, 11 aa, Tick-borne encephalitis virus
ERRKTGIFTVA

SEQ ID NO: 206750 - protein, 11 aa, Tick-borne encephalitis virus
RRKTGIFTVAE

SEQ ID NO: 206751 - protein, 11 aa, Tick-borne encephalitis virus
RKTGIFTVAEF

SEQ ID NO: 206752 - protein, 11 aa, Tick-borne encephalitis virus
KTGIFTVAEFG

SEQ ID NO: 206753 - protein, 11 aa, Tick-borne encephalitis virus
TGIFTVAEFGV

SEQ ID NO: 206754 - protein, 11 aa, Tick-borne encephalitis virus
GIFTVAEFGVG

SEQ ID NO: 206755 - protein, 11 aa, Tick-borne encephalitis virus
IFTVAEFGVGL

SEQ ID NO: 206756 - protein, 11 aa, Tick-borne encephalitis virus
FGVGLRTKVFV

SEQ ID NO: 206757 - protein, 11 aa, Tick-borne encephalitis virus
GVGLRTKVFVD

SEQ ID NO: 206758 - protein, 11 aa, Tick-borne encephalitis virus
VGLRTKVFVDF

SEQ ID NO: 206759 - protein, 11 aa, Tick-borne encephalitis virus
GLRTKVFVDFR

SEQ ID NO: 206760 - protein, 11 aa, Tick-borne encephalitis virus
LRTKVFVDFRQ

SEQ ID NO: 206761 - protein, 11 aa, Tick-borne encephalitis virus
RTKVFVDFRQE

SEQ ID NO: 206762 - protein, 11 aa, Tick-borne encephalitis virus
TKVFLDFRQEP

SEQ ID NO: 206763 - protein, 11 aa, Tick-borne encephalitis virus
KVFLDFRQEPT

SEQ ID NO: 206764 - protein, 11 aa, Tick-borne encephalitis virus
VFLDFRQEPTH

SEQ ID NO: 206765 - protein, 11 aa, Tick-borne encephalitis virus
FLDFRQEPTHE

SEQ ID NO: 206766 - protein, 11 aa, Tick-borne encephalitis virus
LDFRQEPTHEC

SEQ ID NO: 206767 - protein, 11 aa, Tick-borne encephalitis virus
DFRQEPTHECD

SEQ ID NO: 206768 - protein, 11 aa, Tick-borne encephalitis virus
FRQEPTHECDT

SEQ ID NO: 206769 - protein, 11 aa, Tick-borne encephalitis virus
RQEPTHECDTG

SEQ ID NO: 206770 - protein, 11 aa, Tick-borne encephalitis virus
QEPTHECDTGV

SEQ ID NO: 206771 - protein, 11 aa, Tick-borne encephalitis virus
EPTHECDTGVM

SEQ ID NO: 206772 - protein, 11 aa, Tick-borne encephalitis virus
PTHECDTGVMG

SEQ ID NO: 206773 - protein, 11 aa, Tick-borne encephalitis virus
MGAAVKNGMAI

SEQ ID NO: 206774 - protein, 11 aa, Tick-borne encephalitis virus
GAAVKNGMAIH

SEQ ID NO: 206775 - protein, 11 aa, Tick-borne encephalitis virus
AAVKNGMAIHT

SEQ ID NO: 206776 - protein, 11 aa, Tick-borne encephalitis virus
AVKNGMAIHTD

SEQ ID NO: 206777 - protein, 11 aa, Tick-borne encephalitis virus
VKNGMAIHTDQ

SEQ ID NO: 206778 - protein, 11 aa, Tick-borne encephalitis virus
KNGMAIHTDQS

SEQ ID NO: 206779 - protein, 11 aa, Tick-borne encephalitis virus
NGMAIHTDQSL

SEQ ID NO: 206780 - protein, 11 aa, Tick-borne encephalitis virus
GMAIHTDQSLW

SEQ ID NO: 206781 - protein, 11 aa, Tick-borne encephalitis virus
MAIHTDQSLWM

SEQ ID NO: 206782 - protein, 11 aa, Tick-borne encephalitis virus
AIHTDQSLWMR

SEQ ID NO: 206783 - protein, 11 aa, Tick-borne encephalitis virus
IHTDQSLWMRS

SEQ ID NO: 206784 - protein, 11 aa, Tick-borne encephalitis virus
HTDQSLWMRSM

SEQ ID NO: 206785 - protein, 11 aa, Tick-borne encephalitis virus
TDQSLWMRSMK

SEQ ID NO: 206786 - protein, 11 aa, Tick-borne encephalitis virus
DQSLWMRSMKN

SEQ ID NO: 206787 - protein, 11 aa, Tick-borne encephalitis virus
QSLWMRSMKND

SEQ ID NO: 206788 - protein, 11 aa, Tick-borne encephalitis virus
SLWMRSMKNDT

SEQ ID NO: 206789 - protein, 11 aa, Tick-borne encephalitis virus
LWMRSMKNDTG

SEQ ID NO: 206790 - protein, 11 aa, Tick-borne encephalitis virus
WMRSMKNDTGT

SEQ ID NO: 206791 - protein, 11 aa, Tick-borne encephalitis virus
MRSMKNDTGTY

SEQ ID NO: 206792 - protein, 11 aa, Tick-borne encephalitis virus
RSMKNDTGTYI

SEQ ID NO: 206793 - protein, 11 aa, Tick-borne encephalitis virus
SMKNDTGTYIV

SEQ ID NO: 206794 - protein, 11 aa, Tick-borne encephalitis virus
MKNDTGTYIVE

SEQ ID NO: 206795 - protein, 11 aa, Tick-borne encephalitis virus
KNDTGTYIVEL

SEQ ID NO: 206796 - protein, 11 aa, Tick-borne encephalitis virus
NETGTYIVELL

SEQ ID NO: 206797 - protein, 11 aa, Tick-borne encephalitis virus
ETGTYIVELLV

SEQ ID NO: 206798 - protein, 11 aa, Tick-borne encephalitis virus
SWPASHTIDNP

SEQ ID NO: 206799 - protein, 11 aa, Tick-borne encephalitis virus
WPASHTIDNAD

SEQ ID NO: 206800 - protein, 11 aa, Tick-borne encephalitis virus
PASHTIDNADV

SEQ ID NO: 206801 - protein, 11 aa, Tick-borne encephalitis virus
ASHTIDNADVV

SEQ ID NO: 206802 - protein, 11 aa, Tick-borne encephalitis virus
SHTIDNADVVD

SEQ ID NO: 206803 - protein, 11 aa, Tick-borne encephalitis virus
HTIDNADVVDS

SEQ ID NO: 206804 - protein, 11 aa, Tick-borne encephalitis virus
TIDNADVVDSE

SEQ ID NO: 206805 - protein, 11 aa, Tick-borne encephalitis virus
IDNADVVDSEL

SEQ ID NO: 206806 - protein, 11 aa, Tick-borne encephalitis virus
DNADVVDSELF

SEQ ID NO: 206807 - protein, 11 aa, Tick-borne encephalitis virus
NADVVDSELFL

SEQ ID NO: 206808 - protein, 11 aa, Tick-borne encephalitis virus
ADVVDSELFLP

SEQ ID NO: 206809 - protein, 11 aa, Tick-borne encephalitis virus
DVVDSELFLPA

SEQ ID NO: 206810 - protein, 11 aa, Tick-borne encephalitis virus
VVDSESFLPAS

SEQ ID NO: 206811 - protein, 11 aa, Tick-borne encephalitis virus
VDSESFLPASL

SEQ ID NO: 206812 - protein, 11 aa, Tick-borne encephalitis virus
DSESFLPASLA

SEQ ID NO: 206813 - protein, 11 aa, Tick-borne encephalitis virus
SESFLPASLAG

SEQ ID NO: 206814 - protein, 11 aa, Tick-borne encephalitis virus
ESFLPASLAGP

SEQ ID NO: 206815 - protein, 11 aa, Tick-borne encephalitis virus
SFLPASLAGPR

SEQ ID NO: 206816 - protein, 11 aa, Tick-borne encephalitis virus
RSWYNRIPGYA

SEQ ID NO: 206817 - protein, 11 aa, Tick-borne encephalitis virus
SWYNRIPGYAE

SEQ ID NO: 206818 - protein, 11 aa, Tick-borne encephalitis virus
WYNRIPGYAEQ

SEQ ID NO: 206819 - protein, 11 aa, Tick-borne encephalitis virus
YNRIPGYAEQV

SEQ ID NO: 206820 - protein, 11 aa, Tick-borne encephalitis virus
NRIPGYAEQVK

SEQ ID NO: 206821 - protein, 11 aa, Tick-borne encephalitis virus
RIPGYAEQVKG

SEQ ID NO: 206822 - protein, 11 aa, Tick-borne encephalitis virus
IPGYAEQVKGP

SEQ ID NO: 206823 - protein, 11 aa, Tick-borne encephalitis virus
PGYAEQVKGPW

SEQ ID NO: 206824 - protein, 11 aa, Tick-borne encephalitis virus
GYAEQVKGPWK

SEQ ID NO: 206825 - protein, 11 aa, Tick-borne encephalitis virus
YSEQVKGPWKH

SEQ ID NO: 206826 - protein, 11 aa, Tick-borne encephalitis virus
SEQVKGPWKHT

SEQ ID NO: 206827 - protein, 11 aa, Tick-borne encephalitis virus
EQVKGPWKHTP

SEQ ID NO: 206828 - protein, 11 aa, Tick-borne encephalitis virus
QVKGPWKHTPI

SEQ ID NO: 206829 - protein, 11 aa, Tick-borne encephalitis virus
VKGPWKHTPIR

SEQ ID NO: 206830 - protein, 11 aa, Tick-borne encephalitis virus
KGPWKHTPIRV

SEQ ID NO: 206831 - protein, 11 aa, Tick-borne encephalitis virus
PIRVIREECPG

SEQ ID NO: 206832 - protein, 11 aa, Tick-borne encephalitis virus
IRVIREECPGT

SEQ ID NO: 206833 - protein, 11 aa, Tick-borne encephalitis virus
RVIREECPGTT

SEQ ID NO: 206834 - protein, 11 aa, Tick-borne encephalitis virus
VIREECPGTTV

SEQ ID NO: 206835 - protein, 11 aa, Tick-borne encephalitis virus
INAKCDKRGAS

SEQ ID NO: 206836 - protein, 11 aa, Tick-borne encephalitis virus
NAKCDKRGASV

SEQ ID NO: 206837 - protein, 11 aa, Tick-borne encephalitis virus
AKCDKRGASVR

SEQ ID NO: 206838 - protein, 11 aa, Tick-borne encephalitis virus
KCDKRGASVRS

SEQ ID NO: 206839 - protein, 11 aa, Tick-borne encephalitis virus
CDRRGASVRST

SEQ ID NO: 206840 - protein, 11 aa, Tick-borne encephalitis virus
DRRGASVRSTT

SEQ ID NO: 206841 - protein, 11 aa, Tick-borne encephalitis virus
RRGASVRSTTE

SEQ ID NO: 206842 - protein, 11 aa, Tick-borne encephalitis virus
GKVIPEWCCRA

SEQ ID NO: 206843 - protein, 11 aa, Tick-borne encephalitis virus
KVIPEWCCRAC

SEQ ID NO: 206844 - protein, 11 aa, Tick-borne encephalitis virus
VIPEWCCRACT

SEQ ID NO: 206845 - protein, 11 aa, Tick-borne encephalitis virus
IPEWCCRACTM

SEQ ID NO: 206846 - protein, 11 aa, Tick-borne encephalitis virus
PEWCCRACTMP

SEQ ID NO: 206847 - protein, 11 aa, Tick-borne encephalitis virus
EWCCRACTMPP

SEQ ID NO: 206848 - protein, 11 aa, Tick-borne encephalitis virus
WCCRACTMPPV

SEQ ID NO: 206849 - protein, 11 aa, Tick-borne encephalitis virus
CCRACTMPPVT

SEQ ID NO: 206850 - protein, 11 aa, Tick-borne encephalitis virus
CRACTMPPVTF

SEQ ID NO: 206851 - protein, 11 aa, Tick-borne encephalitis virus
RACTMPPVTFR

SEQ ID NO: 206852 - protein, 11 aa, Tick-borne encephalitis virus
ACTMPPVTFRT

SEQ ID NO: 206853 - protein, 11 aa, Tick-borne encephalitis virus
CTMPPVTFRTG

SEQ ID NO: 206854 - protein, 11 aa, Tick-borne encephalitis virus
TMPPVTFRTGT

SEQ ID NO: 206855 - protein, 11 aa, Tick-borne encephalitis virus
MPPVTFRTGTD

SEQ ID NO: 206856 - protein, 11 aa, Tick-borne encephalitis virus
PPVTIRTGTDC

SEQ ID NO: 206857 - protein, 11 aa, Tick-borne encephalitis virus
PVTIRTGTDCW

SEQ ID NO: 206858 - protein, 11 aa, Tick-borne encephalitis virus
VTIRTGTDCWY

SEQ ID NO: 206859 - protein, 11 aa, Tick-borne encephalitis virus
TIRTGTDCWYA

SEQ ID NO: 206860 - protein, 11 aa, Tick-borne encephalitis virus
IRTGTDCWYAM

SEQ ID NO: 206861 - protein, 11 aa, Tick-borne encephalitis virus
IRPVHDQGGLI

SEQ ID NO: 206862 - protein, 11 aa, Tick-borne encephalitis virus
RPVHDQGGLIR

SEQ ID NO: 206863 - protein, 11 aa, Tick-borne encephalitis virus
PVHDQGGLIRS

SEQ ID NO: 206864 - protein, 11 aa, Tick-borne encephalitis virus
VHDQGGLIRSM

SEQ ID NO: 206865 - protein, 11 aa, Tick-borne encephalitis virus
HDQGGLIRSMV

SEQ ID NO: 206866 - protein, 11 aa, Tick-borne encephalitis virus
DQGGLIRSMVV

SEQ ID NO: 206867 - protein, 11 aa, Tick-borne encephalitis virus
QGGLVRSTVVA

SEQ ID NO: 206868 - protein, 11 aa, Tick-borne encephalitis virus
GGLVRSTVVAD

SEQ ID NO: 206869 - protein, 11 aa, Tick-borne encephalitis virus
GLVRSTVVADN

SEQ ID NO: 206870 - protein, 11 aa, Tick-borne encephalitis virus
LIRSMVVADNG

SEQ ID NO: 206871 - protein, 11 aa, Tick-borne encephalitis virus
IRSMVVADNGE

SEQ ID NO: 206872 - protein, 11 aa, Tick-borne encephalitis virus
RSTVVADNGEL

SEQ ID NO: 206873 - protein, 11 aa, Tick-borne encephalitis virus
STVVADNGELL

SEQ ID NO: 206874 - protein, 11 aa, Tick-borne encephalitis virus
TVVADNGELLS

SEQ ID NO: 206875 - protein, 11 aa, Tick-borne encephalitis virus
DNGELLSEGGI

SEQ ID NO: 206876 - protein, 11 aa, Tick-borne encephalitis virus
NGELLSEGGIP

SEQ ID NO: 206877 - protein, 11 aa, Tick-borne encephalitis virus
GELLSEGGVPG

SEQ ID NO: 206878 - protein, 11 aa, Tick-borne encephalitis virus
ELLSEGGIPGI

SEQ ID NO: 206879 - protein, 11 aa, Tick-borne encephalitis virus
LLSEGGVPGIV

SEQ ID NO: 206880 - protein, 11 aa, Tick-borne encephalitis virus
LSEGGIPGIVA

SEQ ID NO: 206881 - protein, 11 aa, Tick-borne encephalitis virus
SEGGVPGIVAL

SEQ ID NO: 206882 - protein, 11 aa, Tick-borne encephalitis virus
EGGIPGIVALF

SEQ ID NO: 206883 - protein, 11 aa, Tick-borne encephalitis virus
GGVPGIVALFV

SEQ ID NO: 206884 - protein, 11 aa, Tick-borne encephalitis virus
GVPGIVALFVV

SEQ ID NO: 206885 - protein, 11 aa, Tick-borne encephalitis virus
VPGIVALFVVL

SEQ ID NO: 206886 - protein, 11 aa, Tick-borne encephalitis virus
IVALFVVLEYI

SEQ ID NO: 206887 - protein, 11 aa, Tick-borne encephalitis virus
VALFVVLEYII

SEQ ID NO: 206888 - protein, 11 aa, Tick-borne encephalitis virus
ALFVVLEYIIR

SEQ ID NO: 206889 - protein, 11 aa, Tick-borne encephalitis virus
LFVVLEYIIRR

SEQ ID NO: 206890 - protein, 11 aa, Tick-borne encephalitis virus
FVVLEYIIRRR

SEQ ID NO: 206891 - protein, 11 aa, Tick-borne encephalitis virus
VVLEYIIRRRP

SEQ ID NO: 206892 - protein, 11 aa, Tick-borne encephalitis virus
VLEYIIRRRPS

SEQ ID NO: 206893 - protein, 11 aa, Tick-borne encephalitis virus
LEYIIRRRPST

SEQ ID NO: 206894 - protein, 11 aa, Tick-borne encephalitis virus
EYIIRRRPSTG

SEQ ID NO: 206895 - protein, 11 aa, Tick-borne encephalitis virus
YIIRRRPSTGT

SEQ ID NO: 206896 - protein, 11 aa, Tick-borne encephalitis virus
IIRRRPSTGTT

SEQ ID NO: 206897 - protein, 11 aa, Tick-borne encephalitis virus
IRRRPSTGTTV

SEQ ID NO: 206898 - protein, 11 aa, Tick-borne encephalitis virus
RRRPSTGTTVV

SEQ ID NO: 206899 - protein, 11 aa, Tick-borne encephalitis virus
RRPSTGTTVVW

SEQ ID NO: 206900 - protein, 11 aa, Tick-borne encephalitis virus
RPSTGTTVVWG

SEQ ID NO: 206901 - protein, 11 aa, Tick-borne encephalitis virus
PSTGTTVVWGG

SEQ ID NO: 206902 - protein, 11 aa, Tick-borne encephalitis virus
WGGVVVLALLV

SEQ ID NO: 206903 - protein, 11 aa, Tick-borne encephalitis virus
GGVVVLALLVT

SEQ ID NO: 206904 - protein, 11 aa, Tick-borne encephalitis virus
GVVVLALLVTG

SEQ ID NO: 206905 - protein, 11 aa, Tick-borne encephalitis virus
VVLALLVTGMV

SEQ ID NO: 206906 - protein, 11 aa, Tick-borne encephalitis virus
VLALLVTGMVR

SEQ ID NO: 206907 - protein, 11 aa, Tick-borne encephalitis virus
VKIESLVRYVV

SEQ ID NO: 206908 - protein, 11 aa, Tick-borne encephalitis virus
KIESLVRYVVA

SEQ ID NO: 206909 - protein, 11 aa, Tick-borne encephalitis virus
MESLVRYVVAV

SEQ ID NO: 206910 - protein, 11 aa, Tick-borne encephalitis virus
LVRYVVAVGIA

SEQ ID NO: 206911 - protein, 11 aa, Tick-borne encephalitis virus
VRYVVAVGIAF

SEQ ID NO: 206912 - protein, 11 aa, Tick-borne encephalitis virus
RYVVAVGIAFH

SEQ ID NO: 206913 - protein, 11 aa, Tick-borne encephalitis virus
YVVAVGITFHF

SEQ ID NO: 206914 - protein, 11 aa, Tick-borne encephalitis virus
VVAVGITFHFE

SEQ ID NO: 206915 - protein, 11 aa, Tick-borne encephalitis virus
VAVGITFHFEL

SEQ ID NO: 206916 - protein, 11 aa, Tick-borne encephalitis virus
AVGIAFHLELG

SEQ ID NO: 206917 - protein, 11 aa, Tick-borne encephalitis virus
VGITFHFELGP

SEQ ID NO: 206918 - protein, 11 aa, Tick-borne encephalitis virus
GITFHFELGPE

SEQ ID NO: 206919 - protein, 11 aa, Tick-borne encephalitis virus
ITFHFELGPEI

SEQ ID NO: 206920 - protein, 11 aa, Tick-borne encephalitis virus
TFHFELGPEIV

SEQ ID NO: 206921 - protein, 11 aa, Tick-borne encephalitis virus
FHFELGPEIVA

SEQ ID NO: 206922 - protein, 11 aa, Tick-borne encephalitis virus
HFELGPEIVAL

SEQ ID NO: 206923 - protein, 11 aa, Tick-borne encephalitis virus
LELGPEIVALM

SEQ ID NO: 206924 - protein, 11 aa, Tick-borne encephalitis virus
ELGPEIVALML

SEQ ID NO: 206925 - protein, 11 aa, Tick-borne encephalitis virus
LGPEIVALMLL

SEQ ID NO: 206926 - protein, 11 aa, Tick-borne encephalitis virus
GPEIVALMLLQ

SEQ ID NO: 206927 - protein, 11 aa, Tick-borne encephalitis virus
PEIVALMLLQA

SEQ ID NO: 206928 - protein, 11 aa, Tick-borne encephalitis virus
EIVALMLLQAV

SEQ ID NO: 206929 - protein, 11 aa, Tick-borne encephalitis virus
IVALMLLQAVF

SEQ ID NO: 206930 - protein, 11 aa, Tick-borne encephalitis virus
VALMLLQAVFE

SEQ ID NO: 206931 - protein, 11 aa, Tick-borne encephalitis virus
ALMLLQAVFEL

SEQ ID NO: 206932 - protein, 11 aa, Tick-borne encephalitis virus
LMLLQAVFELR

SEQ ID NO: 206933 - protein, 11 aa, Tick-borne encephalitis virus
MLLQAVFELRV

SEQ ID NO: 206934 - protein, 11 aa, Tick-borne encephalitis virus
VGLLSAFALRR

SEQ ID NO: 206935 - protein, 11 aa, Tick-borne encephalitis virus
GLLSAFALRRS

SEQ ID NO: 206936 - protein, 11 aa, Tick-borne encephalitis virus
LLSAFALRRSL

SEQ ID NO: 206937 - protein, 11 aa, Tick-borne encephalitis virus
LSAFALRRSLT

SEQ ID NO: 206938 - protein, 11 aa, Tick-borne encephalitis virus
SAFALRRSLTV

SEQ ID NO: 206939 - protein, 11 aa, Tick-borne encephalitis virus
AFALRRSLTVR

SEQ ID NO: 206940 - protein, 11 aa, Tick-borne encephalitis virus
FALRRSLTVRE

SEQ ID NO: 206941 - protein, 11 aa, Tick-borne encephalitis virus
ALRRSLTVREM

SEQ ID NO: 206942 - protein, 11 aa, Tick-borne encephalitis virus
LRRSLTVREMV

SEQ ID NO: 206943 - protein, 11 aa, Tick-borne encephalitis virus
RRSLTVREMVT

SEQ ID NO: 206944 - protein, 11 aa, Tick-borne encephalitis virus
SLTVREMVTTY

SEQ ID NO: 206945 - protein, 11 aa, Tick-borne encephalitis virus
LTVREMVTTYF

SEQ ID NO: 206946 - protein, 11 aa, Tick-borne encephalitis virus
TVREMVTTYFL

SEQ ID NO: 206947 - protein, 11 aa, Tick-borne encephalitis virus
VREMVTTYFLL

SEQ ID NO: 206948 - protein, 11 aa, Tick-borne encephalitis virus
REMVTTYFLLL

SEQ ID NO: 206949 - protein, 11 aa, Tick-borne encephalitis virus
EMVTTYFLLLV

SEQ ID NO: 206950 - protein, 11 aa, Tick-borne encephalitis virus
MVTTYFLLLVL

SEQ ID NO: 206951 - protein, 11 aa, Tick-borne encephalitis virus
VTTYFLLLVLE

SEQ ID NO: 206952 - protein, 11 aa, Tick-borne encephalitis virus
TTYFLLLVLEL

SEQ ID NO: 206953 - protein, 11 aa, Tick-borne encephalitis virus
TYFLLLVLELG

SEQ ID NO: 206954 - protein, 11 aa, Tick-borne encephalitis virus
LLLVLELGLPG

SEQ ID NO: 206955 - protein, 11 aa, Tick-borne encephalitis virus
FWKWGDALAMG

SEQ ID NO: 206956 - protein, 11 aa, Tick-borne encephalitis virus
WRWGDALAMGA

SEQ ID NO: 206957 - protein, 11 aa, Tick-borne encephalitis virus
RWGDALAMGAL

SEQ ID NO: 206958 - protein, 11 aa, Tick-borne encephalitis virus
GDALAMGALIL

SEQ ID NO: 206959 - protein, 11 aa, Tick-borne encephalitis virus
DALAMGALILR

SEQ ID NO: 206960 - protein, 11 aa, Tick-borne encephalitis virus
ALAMGALILRA

SEQ ID NO: 206961 - protein, 11 aa, Tick-borne encephalitis virus
LAMGALILRAC

SEQ ID NO: 206962 - protein, 11 aa, Tick-borne encephalitis virus
AMGALILRACT

SEQ ID NO: 206963 - protein, 11 aa, Tick-borne encephalitis virus
MGALILRACTA

SEQ ID NO: 206964 - protein, 11 aa, Tick-borne encephalitis virus
GALILRACTAE

SEQ ID NO: 206965 - protein, 11 aa, Tick-borne encephalitis virus
ALIFRACTAEE

SEQ ID NO: 206966 - protein, 11 aa, Tick-borne encephalitis virus
LIFRACTAEEK

SEQ ID NO: 206967 - protein, 11 aa, Tick-borne encephalitis virus
IFRACTAEGKT

SEQ ID NO: 206968 - protein, 11 aa, Tick-borne encephalitis virus
FRACTAEGKTG

SEQ ID NO: 206969 - protein, 11 aa, Tick-borne encephalitis virus
RACTAEGKTGA

SEQ ID NO: 206970 - protein, 11 aa, Tick-borne encephalitis virus
ACTAEGKTGAG

SEQ ID NO: 206971 - protein, 11 aa, Tick-borne encephalitis virus
CTAEGKTGAGL

SEQ ID NO: 206972 - protein, 11 aa, Tick-borne encephalitis virus
TAEGKTGAGLL

SEQ ID NO: 206973 - protein, 11 aa, Tick-borne encephalitis virus
AEGKTGAGLLL

SEQ ID NO: 206974 - protein, 11 aa, Tick-borne encephalitis virus
EGKTGAGLLLM

SEQ ID NO: 206975 - protein, 11 aa, Tick-borne encephalitis virus
GKTGAGLLLMA

SEQ ID NO: 206976 - protein, 11 aa, Tick-borne encephalitis virus
KTGAGLLLMAL

SEQ ID NO: 206977 - protein, 11 aa, Tick-borne encephalitis virus
TGAGLLLMALM

SEQ ID NO: 206978 - protein, 11 aa, Tick-borne encephalitis virus
GAGLLLMALMT

SEQ ID NO: 206979 - protein, 11 aa, Tick-borne encephalitis virus
AGLLLMALMTQ

SEQ ID NO: 206980 - protein, 11 aa, Tick-borne encephalitis virus
GLLLMALMTQR

SEQ ID NO: 206981 - protein, 11 aa, Tick-borne encephalitis virus
LLLMALMTQRD

SEQ ID NO: 206982 - protein, 11 aa, Tick-borne encephalitis virus
WRLIRGHREQK

SEQ ID NO: 206983 - protein, 11 aa, Tick-borne encephalitis virus
RLIRGHREQKG

SEQ ID NO: 206984 - protein, 11 aa, Tick-borne encephalitis virus
LLKGHREQKGL

SEQ ID NO: 206985 - protein, 11 aa, Tick-borne encephalitis virus
IRGHREQKGLS

SEQ ID NO: 206986 - protein, 11 aa, Tick-borne encephalitis virus
RGHREQKGLSW

SEQ ID NO: 206987 - protein, 11 aa, Tick-borne encephalitis virus
GHREQKGLSWI

SEQ ID NO: 206988 - protein, 11 aa, Tick-borne encephalitis virus
HREQKGLTWVV

SEQ ID NO: 206989 - protein, 11 aa, Tick-borne encephalitis virus
REQKGLTWVVP

SEQ ID NO: 206990 - protein, 11 aa, Tick-borne encephalitis virus
EQKGLTWVVPL

SEQ ID NO: 206991 - protein, 11 aa, Tick-borne encephalitis virus
QKGLTWVVPLA

SEQ ID NO: 206992 - protein, 11 aa, Tick-borne encephalitis virus
VPLARLLGGEG

SEQ ID NO: 206993 - protein, 11 aa, Tick-borne encephalitis virus
PLARLLGGEGS

SEQ ID NO: 206994 - protein, 11 aa, Tick-borne encephalitis virus
LARLLGGEGSG

SEQ ID NO: 206995 - protein, 11 aa, Tick-borne encephalitis virus
ARLLGGEGSGI

SEQ ID NO: 206996 - protein, 11 aa, Tick-borne encephalitis virus
RLLGGEGSGIR

SEQ ID NO: 206997 - protein, 11 aa, Tick-borne encephalitis virus
LLGGEGSGIRL

SEQ ID NO: 206998 - protein, 11 aa, Tick-borne encephalitis virus
LGGEGSGIRLL

SEQ ID NO: 206999 - protein, 11 aa, Tick-borne encephalitis virus
GGEGSGIRLLA

SEQ ID NO: 207000 - protein, 11 aa, Tick-borne encephalitis virus
GEGSGIRLLAF

SEQ ID NO: 207001 - protein, 11 aa, Tick-borne encephalitis virus
EGSGIRLLAFW

SEQ ID NO: 207002 - protein, 11 aa, Tick-borne encephalitis virus
GSGIRLLAFWE

SEQ ID NO: 207003 - protein, 11 aa, Tick-borne encephalitis virus
SGIRLLAFWEL

SEQ ID NO: 207004 - protein, 11 aa, Tick-borne encephalitis virus
GIRLLAFWELS

SEQ ID NO: 207005 - protein, 11 aa, Tick-borne encephalitis virus
HGRRRSFSEPL

SEQ ID NO: 207006 - protein, 11 aa, Tick-borne encephalitis virus
GRRRSFSEPLT

SEQ ID NO: 207007 - protein, 11 aa, Tick-borne encephalitis virus
GRRSFSEPLTV

SEQ ID NO: 207008 - protein, 11 aa, Tick-borne encephalitis virus
TVVGVMLTLAG

SEQ ID NO: 207009 - protein, 11 aa, Tick-borne encephalitis virus
VVGVMLTLAGG

SEQ ID NO: 207010 - protein, 11 aa, Tick-borne encephalitis virus
VGVMLTLAGGM

SEQ ID NO: 207011 - protein, 11 aa, Tick-borne encephalitis virus
GVMLTLAGGMM

SEQ ID NO: 207012 - protein, 11 aa, Tick-borne encephalitis virus
VMLTLAGGMMR

SEQ ID NO: 207013 - protein, 11 aa, Tick-borne encephalitis virus
MLTLAGGMMRH

SEQ ID NO: 207014 - protein, 11 aa, Tick-borne encephalitis virus
LTLAGGMMRHT

SEQ ID NO: 207015 - protein, 11 aa, Tick-borne encephalitis virus
TLAGGMMRHTS

SEQ ID NO: 207016 - protein, 11 aa, Tick-borne encephalitis virus
LAGGMMRHTSQ

SEQ ID NO: 207017 - protein, 11 aa, Tick-borne encephalitis virus
AGGMMRHTSQE

SEQ ID NO: 207018 - protein, 11 aa, Tick-borne encephalitis virus
GGMMRHTSQEA

SEQ ID NO: 207019 - protein, 11 aa, Tick-borne encephalitis virus
GMMRHTPQEAL

SEQ ID NO: 207020 - protein, 11 aa, Tick-borne encephalitis virus
MMRHTPQEALC

SEQ ID NO: 207021 - protein, 11 aa, Tick-borne encephalitis virus
MRHTPQEALCA

SEQ ID NO: 207022 - protein, 11 aa, Tick-borne encephalitis virus
RHTPQEALCAL

SEQ ID NO: 207023 - protein, 11 aa, Tick-borne encephalitis virus
HTPQEALCALA

SEQ ID NO: 207024 - protein, 11 aa, Tick-borne encephalitis virus
TPQEALCALAV

SEQ ID NO: 207025 - protein, 11 aa, Tick-borne encephalitis virus
PQEALCALAVA

SEQ ID NO: 207026 - protein, 11 aa, Tick-borne encephalitis virus
VAEWSGCVEWY

SEQ ID NO: 207027 - protein, 11 aa, Tick-borne encephalitis virus
AEWSGCVEWYP

SEQ ID NO: 207028 - protein, 11 aa, Tick-borne encephalitis virus
EWSGCVEWYPE

SEQ ID NO: 207029 - protein, 11 aa, Tick-borne encephalitis virus
WSGCVEWYPEL

SEQ ID NO: 207030 - protein, 11 aa, Tick-borne encephalitis virus
SGCVEWHPELV

SEQ ID NO: 207031 - protein, 11 aa, Tick-borne encephalitis virus
GCVEWHPELVN

SEQ ID NO: 207032 - protein, 11 aa, Tick-borne encephalitis virus
CVEWHPELVNE

SEQ ID NO: 207033 - protein, 11 aa, Tick-borne encephalitis virus
VEWHPELVNEG

SEQ ID NO: 207034 - protein, 11 aa, Tick-borne encephalitis virus
EWHPELVNEGG

SEQ ID NO: 207035 - protein, 11 aa, Tick-borne encephalitis virus
WHPELVNEGGE

SEQ ID NO: 207036 - protein, 11 aa, Tick-borne encephalitis virus
HPELVNEGGEV

SEQ ID NO: 207037 - protein, 11 aa, Tick-borne encephalitis virus
PELVNEGGEVS

SEQ ID NO: 207038 - protein, 11 aa, Tick-borne encephalitis virus
ELVNEGGEVSL

SEQ ID NO: 207039 - protein, 11 aa, Tick-borne encephalitis virus
LVNEGGEVSLR

SEQ ID NO: 207040 - protein, 11 aa, Tick-borne encephalitis virus
VNEGGEVSLRV

SEQ ID NO: 207041 - protein, 11 aa, Tick-borne encephalitis virus
GEVSLRVRQDA

SEQ ID NO: 207042 - protein, 11 aa, Tick-borne encephalitis virus
EVSLRVRQDAM

SEQ ID NO: 207043 - protein, 11 aa, Tick-borne encephalitis virus
VSLRVRQDAMG

SEQ ID NO: 207044 - protein, 11 aa, Tick-borne encephalitis virus
SLRVRQDAMGN

SEQ ID NO: 207045 - protein, 11 aa, Tick-borne encephalitis virus
LRVRQDAMGNF

SEQ ID NO: 207046 - protein, 11 aa, Tick-borne encephalitis virus
RVRQDAMGNFH

SEQ ID NO: 207047 - protein, 11 aa, Tick-borne encephalitis virus
VRQDAMGNFHL

SEQ ID NO: 207048 - protein, 11 aa, Tick-borne encephalitis virus
RQDAMGNFHLT

SEQ ID NO: 207049 - protein, 11 aa, Tick-borne encephalitis virus
QDAMGNFHLTE

SEQ ID NO: 207050 - protein, 11 aa, Tick-borne encephalitis virus
DAMGNFHLTEL

SEQ ID NO: 207051 - protein, 11 aa, Tick-borne encephalitis virus
AMGNFHLTELE

SEQ ID NO: 207052 - protein, 11 aa, Tick-borne encephalitis virus
HLTELEKEERM

SEQ ID NO: 207053 - protein, 11 aa, Tick-borne encephalitis virus
LTELEKEERMM

SEQ ID NO: 207054 - protein, 11 aa, Tick-borne encephalitis virus
TELEKEERMMA

SEQ ID NO: 207055 - protein, 11 aa, Tick-borne encephalitis virus
ELEKEERMMAF

SEQ ID NO: 207056 - protein, 11 aa, Tick-borne encephalitis virus
LEKEERMMAFW

SEQ ID NO: 207057 - protein, 11 aa, Tick-borne encephalitis virus
EKEERMMAFWL

SEQ ID NO: 207058 - protein, 11 aa, Tick-borne encephalitis virus
KEERMMAFWLL

SEQ ID NO: 207059 - protein, 11 aa, Tick-borne encephalitis virus
EERMMAFWLLA

SEQ ID NO: 207060 - protein, 11 aa, Tick-borne encephalitis virus
ERMMAFWLLAG

SEQ ID NO: 207061 - protein, 11 aa, Tick-borne encephalitis virus
RMMAFWLLAGL

SEQ ID NO: 207062 - protein, 11 aa, Tick-borne encephalitis virus
MMAFWLLAGLA

SEQ ID NO: 207063 - protein, 11 aa, Tick-borne encephalitis virus
MAFWLIAGLAA

SEQ ID NO: 207064 - protein, 11 aa, Tick-borne encephalitis virus
AFWLIAGLAAS

SEQ ID NO: 207065 - protein, 11 aa, Tick-borne encephalitis virus
FWLIAGLAASA

SEQ ID NO: 207066 - protein, 11 aa, Tick-borne encephalitis virus
AGLAASAIHWS

SEQ ID NO: 207067 - protein, 11 aa, Tick-borne encephalitis virus
GLAASAIHWSG

SEQ ID NO: 207068 - protein, 11 aa, Tick-borne encephalitis virus
LAASAIHWSGI

SEQ ID NO: 207069 - protein, 11 aa, Tick-borne encephalitis virus
ASAVHWSGILG

SEQ ID NO: 207070 - protein, 11 aa, Tick-borne encephalitis virus
SAVHWSGILGV

SEQ ID NO: 207071 - protein, 11 aa, Tick-borne encephalitis virus
AVHWSGILGVM

SEQ ID NO: 207072 - protein, 11 aa, Tick-borne encephalitis virus
VHWSGILGVMG

SEQ ID NO: 207073 - protein, 11 aa, Tick-borne encephalitis virus
HWSGIIGVMGL

SEQ ID NO: 207074 - protein, 11 aa, Tick-borne encephalitis virus
WSGIIGVMGLW

SEQ ID NO: 207075 - protein, 11 aa, Tick-borne encephalitis virus
SGIIGVMGLWT

SEQ ID NO: 207076 - protein, 11 aa, Tick-borne encephalitis virus
GIIGVMGLWTL

SEQ ID NO: 207077 - protein, 11 aa, Tick-borne encephalitis virus
ILGVMGLWTLT

SEQ ID NO: 207078 - protein, 11 aa, Tick-borne encephalitis virus
LGVMGLWTLTE

SEQ ID NO: 207079 - protein, 11 aa, Tick-borne encephalitis virus
GVMGLWTLTEM

SEQ ID NO: 207080 - protein, 11 aa, Tick-borne encephalitis virus
VMGLWTLTEML

SEQ ID NO: 207081 - protein, 11 aa, Tick-borne encephalitis virus
MGLWTLTEMLR

SEQ ID NO: 207082 - protein, 11 aa, Tick-borne encephalitis virus
SRRSDLVFSGQ

SEQ ID NO: 207083 - protein, 11 aa, Tick-borne encephalitis virus
RRSGLVFSGQG

SEQ ID NO: 207084 - protein, 11 aa, Tick-borne encephalitis virus
RSDLVFSGQGR

SEQ ID NO: 207085 - protein, 11 aa, Tick-borne encephalitis virus
SGLVFSGQGGR

SEQ ID NO: 207086 - protein, 11 aa, Tick-borne encephalitis virus
DLVFSGQGNRE

SEQ ID NO: 207087 - protein, 11 aa, Tick-borne encephalitis virus
LVFSGQGRGER

SEQ ID NO: 207088 - protein, 11 aa, Tick-borne encephalitis virus
VFSGQGRGERG

SEQ ID NO: 207089 - protein, 11 aa, Tick-borne encephalitis virus
FSGQGRGERGD

SEQ ID NO: 207090 - protein, 11 aa, Tick-borne encephalitis virus
SGQGGRERGDK

SEQ ID NO: 207091 - protein, 11 aa, Tick-borne encephalitis virus
GQGGRERGDKP

SEQ ID NO: 207092 - protein, 11 aa, Tick-borne encephalitis virus
QGGRERGDKPF

SEQ ID NO: 207093 - protein, 11 aa, Tick-borne encephalitis virus
GGRERGDKPFE

SEQ ID NO: 207094 - protein, 11 aa, Tick-borne encephalitis virus
GRERGDKPFEV

SEQ ID NO: 207095 - protein, 11 aa, Tick-borne encephalitis virus
RERGDKPFEVK

SEQ ID NO: 207096 - protein, 11 aa, Tick-borne encephalitis virus
ERGDKPFEVKD

SEQ ID NO: 207097 - protein, 11 aa, Tick-borne encephalitis virus
RGDKPFEVKDG

SEQ ID NO: 207098 - protein, 11 aa, Tick-borne encephalitis virus
GDKPFEVKDGV

SEQ ID NO: 207099 - protein, 11 aa, Tick-borne encephalitis virus
DKPFEVKDGVY

SEQ ID NO: 207100 - protein, 11 aa, Tick-borne encephalitis virus
KPFEVKDGVYR

SEQ ID NO: 207101 - protein, 11 aa, Tick-borne encephalitis virus
PFEVRDGVYRI

SEQ ID NO: 207102 - protein, 11 aa, Tick-borne encephalitis virus
FEVRDGVYRIF

SEQ ID NO: 207103 - protein, 11 aa, Tick-borne encephalitis virus
EVRDGVYRIFS

SEQ ID NO: 207104 - protein, 11 aa, Tick-borne encephalitis virus
VRDGVYRIFSP

SEQ ID NO: 207105 - protein, 11 aa, Tick-borne encephalitis virus
RDGVYRIFSPG

SEQ ID NO: 207106 - protein, 11 aa, Tick-borne encephalitis virus
GVYRIFSPGLF

SEQ ID NO: 207107 - protein, 11 aa, Tick-borne encephalitis virus
VYRIFSPGLFW

SEQ ID NO: 207108 - protein, 11 aa, Tick-borne encephalitis virus
YRIFSPGLFWG

SEQ ID NO: 207109 - protein, 11 aa, Tick-borne encephalitis virus
RIFSPGLFWGQ

SEQ ID NO: 207110 - protein, 11 aa, Tick-borne encephalitis virus
IFSPGLFWGQN

SEQ ID NO: 207111 - protein, 11 aa, Tick-borne encephalitis virus
FSPGLFWGQNQ

SEQ ID NO: 207112 - protein, 11 aa, Tick-borne encephalitis virus
SPGLFWGQNQV

SEQ ID NO: 207113 - protein, 11 aa, Tick-borne encephalitis virus
PGLFWGQNQVG

SEQ ID NO: 207114 - protein, 11 aa, Tick-borne encephalitis virus
GLFWGQNQVGV

SEQ ID NO: 207115 - protein, 11 aa, Tick-borne encephalitis virus
LFWGQNQVGVG

SEQ ID NO: 207116 - protein, 11 aa, Tick-borne encephalitis virus
FWGQNQVGVGY

SEQ ID NO: 207117 - protein, 11 aa, Tick-borne encephalitis virus
WGQNQVGVGYG

SEQ ID NO: 207118 - protein, 11 aa, Tick-borne encephalitis virus
GQRQVGVGYGS

SEQ ID NO: 207119 - protein, 11 aa, Tick-borne encephalitis virus
QRQVGVGYGSK

SEQ ID NO: 207120 - protein, 11 aa, Tick-borne encephalitis virus
RQVGVGYGSKG

SEQ ID NO: 207121 - protein, 11 aa, Tick-borne encephalitis virus
QVGVGYGFKGV

SEQ ID NO: 207122 - protein, 11 aa, Tick-borne encephalitis virus
VGVGYGFKGVL

SEQ ID NO: 207123 - protein, 11 aa, Tick-borne encephalitis virus
GVGYGFKGVLH

SEQ ID NO: 207124 - protein, 11 aa, Tick-borne encephalitis virus
VGYGFKGVLHT

SEQ ID NO: 207125 - protein, 11 aa, Tick-borne encephalitis virus
GYGFKGVLHTM

SEQ ID NO: 207126 - protein, 11 aa, Tick-borne encephalitis virus
YGFKGVLHTMW

SEQ ID NO: 207127 - protein, 11 aa, Tick-borne encephalitis virus
GFKGVLHTMWH

SEQ ID NO: 207128 - protein, 11 aa, Tick-borne encephalitis virus
FKGVLHTMWHV

SEQ ID NO: 207129 - protein, 11 aa, Tick-borne encephalitis virus
RGVLHTMWHVT

SEQ ID NO: 207130 - protein, 11 aa, Tick-borne encephalitis virus
MWHVTRGAALY

SEQ ID NO: 207131 - protein, 11 aa, Tick-borne encephalitis virus
WHVTRGAALSV

SEQ ID NO: 207132 - protein, 11 aa, Tick-borne encephalitis virus
HVTRGAALSIN

SEQ ID NO: 207133 - protein, 11 aa, Tick-borne encephalitis virus
VTRGAALSIND

SEQ ID NO: 207134 - protein, 11 aa, Tick-borne encephalitis virus
TRGAALSINDA

SEQ ID NO: 207135 - protein, 11 aa, Tick-borne encephalitis virus
RGAALSINDAV

SEQ ID NO: 207136 - protein, 11 aa, Tick-borne encephalitis virus
GAALSINDAVA

SEQ ID NO: 207137 - protein, 11 aa, Tick-borne encephalitis virus
AALSINDAVAG

SEQ ID NO: 207138 - protein, 11 aa, Tick-borne encephalitis virus
ALSINDAVAGP

SEQ ID NO: 207139 - protein, 11 aa, Tick-borne encephalitis virus
LSINDAVAGPY

SEQ ID NO: 207140 - protein, 11 aa, Tick-borne encephalitis virus
SINDAVAGPYW

SEQ ID NO: 207141 - protein, 11 aa, Tick-borne encephalitis virus
INDAVAGPYWA

SEQ ID NO: 207142 - protein, 11 aa, Tick-borne encephalitis virus
NDAVAGPYWAD

SEQ ID NO: 207143 - protein, 11 aa, Tick-borne encephalitis virus
DAVVGPYWADV

SEQ ID NO: 207144 - protein, 11 aa, Tick-borne encephalitis virus
AVAGPYWADVR

SEQ ID NO: 207145 - protein, 11 aa, Tick-borne encephalitis virus
VAGPYWADVRE

SEQ ID NO: 207146 - protein, 11 aa, Tick-borne encephalitis virus
AGPYWADVRED

SEQ ID NO: 207147 - protein, 11 aa, Tick-borne encephalitis virus
GPYWADVREDV

SEQ ID NO: 207148 - protein, 11 aa, Tick-borne encephalitis virus
PYWADVREDVV

SEQ ID NO: 207149 - protein, 11 aa, Tick-borne encephalitis virus
YWADVREDVVC

SEQ ID NO: 207150 - protein, 11 aa, Tick-borne encephalitis virus
WADVREDVVCY

SEQ ID NO: 207151 - protein, 11 aa, Tick-borne encephalitis virus
ADVREDVVCYG

SEQ ID NO: 207152 - protein, 11 aa, Tick-borne encephalitis virus
DVREDVVCYGG

SEQ ID NO: 207153 - protein, 11 aa, Tick-borne encephalitis virus
VREDVVCYGGA

SEQ ID NO: 207154 - protein, 11 aa, Tick-borne encephalitis virus
REDVVCYGGAW

SEQ ID NO: 207155 - protein, 11 aa, Tick-borne encephalitis virus
EDVVCYGGTWS

SEQ ID NO: 207156 - protein, 11 aa, Tick-borne encephalitis virus
DVVCYGGTWSL

SEQ ID NO: 207157 - protein, 11 aa, Tick-borne encephalitis virus
VVCYGGTWSLE

SEQ ID NO: 207158 - protein, 11 aa, Tick-borne encephalitis virus
VCYGGTWSLEE

SEQ ID NO: 207159 - protein, 11 aa, Tick-borne encephalitis virus
CYGGTWSLEEK

SEQ ID NO: 207160 - protein, 11 aa, Tick-borne encephalitis virus
YGGTWSLEEKW

SEQ ID NO: 207161 - protein, 11 aa, Tick-borne encephalitis virus
GGTWSLEEKWK

SEQ ID NO: 207162 - protein, 11 aa, Tick-borne encephalitis virus
GAWSLEEKWRG

SEQ ID NO: 207163 - protein, 11 aa, Tick-borne encephalitis virus
TWSLEEKWKGE

SEQ ID NO: 207164 - protein, 11 aa, Tick-borne encephalitis virus
WSLEEKWRGET

SEQ ID NO: 207165 - protein, 11 aa, Tick-borne encephalitis virus
SLEEKWRGETV

SEQ ID NO: 207166 - protein, 11 aa, Tick-borne encephalitis virus
LEEKWRGETVQ

SEQ ID NO: 207167 - protein, 11 aa, Tick-borne encephalitis virus
EEKWRGETVQV

SEQ ID NO: 207168 - protein, 11 aa, Tick-borne encephalitis virus
EKWRGETVQVH

SEQ ID NO: 207169 - protein, 11 aa, Tick-borne encephalitis virus
KWRGETVQVHA

SEQ ID NO: 207170 - protein, 11 aa, Tick-borne encephalitis virus
WRGETVQVHAF

SEQ ID NO: 207171 - protein, 11 aa, Tick-borne encephalitis virus
RGETVQVHAFP

SEQ ID NO: 207172 - protein, 11 aa, Tick-borne encephalitis virus
TVQVHAFPPGK

SEQ ID NO: 207173 - protein, 11 aa, Tick-borne encephalitis virus
VQVHAFPPGKA

SEQ ID NO: 207174 - protein, 11 aa, Tick-borne encephalitis virus
QVHAFPPGKAH

SEQ ID NO: 207175 - protein, 11 aa, Tick-borne encephalitis virus
VHAFPPGKAHE

SEQ ID NO: 207176 - protein, 11 aa, Tick-borne encephalitis virus
HAFPPGKAHEV

SEQ ID NO: 207177 - protein, 11 aa, Tick-borne encephalitis virus
AFPPGKAHEVH

SEQ ID NO: 207178 - protein, 11 aa, Tick-borne encephalitis virus
FPPGKAHEVHQ

SEQ ID NO: 207179 - protein, 11 aa, Tick-borne encephalitis virus
PPGKAHEVHQC

SEQ ID NO: 207180 - protein, 11 aa, Tick-borne encephalitis virus
PGKAHEVHQCQ

SEQ ID NO: 207181 - protein, 11 aa, Tick-borne encephalitis virus
GKAHEVHQCQP

SEQ ID NO: 207182 - protein, 11 aa, Tick-borne encephalitis virus
KAHEVHQCQPG

SEQ ID NO: 207183 - protein, 11 aa, Tick-borne encephalitis virus
EVHQCQPGELI

SEQ ID NO: 207184 - protein, 11 aa, Tick-borne encephalitis virus
VHQCQPGELIL

SEQ ID NO: 207185 - protein, 11 aa, Tick-borne encephalitis virus
HQCQPGELILD

SEQ ID NO: 207186 - protein, 11 aa, Tick-borne encephalitis virus
QCQPGELILDT

SEQ ID NO: 207187 - protein, 11 aa, Tick-borne encephalitis virus
CQPGELILDTG

SEQ ID NO: 207188 - protein, 11 aa, Tick-borne encephalitis virus
QPGELILDTGR

SEQ ID NO: 207189 - protein, 11 aa, Tick-borne encephalitis virus
PGELILDTGRK

SEQ ID NO: 207190 - protein, 11 aa, Tick-borne encephalitis virus
GAIPIDLVKGT

SEQ ID NO: 207191 - protein, 11 aa, Tick-borne encephalitis virus
AIPIDLVKGTS

SEQ ID NO: 207192 - protein, 11 aa, Tick-borne encephalitis virus
IPIDLVKGTSG

SEQ ID NO: 207193 - protein, 11 aa, Tick-borne encephalitis virus
PIDLVKGTSGS

SEQ ID NO: 207194 - protein, 11 aa, Tick-borne encephalitis virus
IDLVKGTSGSP

SEQ ID NO: 207195 - protein, 11 aa, Tick-borne encephalitis virus
DLVKGTSGSPI

SEQ ID NO: 207196 - protein, 11 aa, Tick-borne encephalitis virus
LVKGTSGSPIL

SEQ ID NO: 207197 - protein, 11 aa, Tick-borne encephalitis virus
VKGTSGSPILN

SEQ ID NO: 207198 - protein, 11 aa, Tick-borne encephalitis virus
KGTSGSPILNA

SEQ ID NO: 207199 - protein, 11 aa, Tick-borne encephalitis virus
GTSGSPILNAQ

SEQ ID NO: 207200 - protein, 11 aa, Tick-borne encephalitis virus
TSGSPILNAQG

SEQ ID NO: 207201 - protein, 11 aa, Tick-borne encephalitis virus
SPILNAQGVVV

SEQ ID NO: 207202 - protein, 11 aa, Tick-borne encephalitis virus
PILNAQGVVVG

SEQ ID NO: 207203 - protein, 11 aa, Tick-borne encephalitis virus
ILNAQGVVVGL

SEQ ID NO: 207204 - protein, 11 aa, Tick-borne encephalitis virus
LNAQGVVVGLY

SEQ ID NO: 207205 - protein, 11 aa, Tick-borne encephalitis virus
NAQGVVVGLYG

SEQ ID NO: 207206 - protein, 11 aa, Tick-borne encephalitis virus
AQGVVVGLYGN

SEQ ID NO: 207207 - protein, 11 aa, Tick-borne encephalitis virus
QGAVVGLYGNG

SEQ ID NO: 207208 - protein, 11 aa, Tick-borne encephalitis virus
GAVVGLYGNGL

SEQ ID NO: 207209 - protein, 11 aa, Tick-borne encephalitis virus
AVVGLYGNGLK

SEQ ID NO: 207210 - protein, 11 aa, Tick-borne encephalitis virus
GLYGNGLKTNG

SEQ ID NO: 207211 - protein, 11 aa, Tick-borne encephalitis virus
LYGNGLKTNGT

SEQ ID NO: 207212 - protein, 11 aa, Tick-borne encephalitis virus
YGNGLKTNGTY

SEQ ID NO: 207213 - protein, 11 aa, Tick-borne encephalitis virus
GNGLKTNGTYV

SEQ ID NO: 207214 - protein, 11 aa, Tick-borne encephalitis virus
NGLKTNGTYVS

SEQ ID NO: 207215 - protein, 11 aa, Tick-borne encephalitis virus
GLKTNGTYVSS

SEQ ID NO: 207216 - protein, 11 aa, Tick-borne encephalitis virus
LKTNGTYVSSI

SEQ ID NO: 207217 - protein, 11 aa, Tick-borne encephalitis virus
KTNGTYVSSIA

SEQ ID NO: 207218 - protein, 11 aa, Tick-borne encephalitis virus
TNGTYVSSIAQ

SEQ ID NO: 207219 - protein, 11 aa, Tick-borne encephalitis virus
NGTYVSSIAQG

SEQ ID NO: 207220 - protein, 11 aa, Tick-borne encephalitis virus
GTYVSSIAQGE

SEQ ID NO: 207221 - protein, 11 aa, Tick-borne encephalitis virus
TYVSSIAQGEV

SEQ ID NO: 207222 - protein, 11 aa, Tick-borne encephalitis virus
YVSSIAQGEVE

SEQ ID NO: 207223 - protein, 11 aa, Tick-borne encephalitis virus
VSSIAQGEVEK

SEQ ID NO: 207224 - protein, 11 aa, Tick-borne encephalitis virus
SSIAQGEVEKS

SEQ ID NO: 207225 - protein, 11 aa, Tick-borne encephalitis virus
SIAQGEVEKSR

SEQ ID NO: 207226 - protein, 11 aa, Tick-borne encephalitis virus
IAQGEVEKSRP

SEQ ID NO: 207227 - protein, 11 aa, Tick-borne encephalitis virus
AQGEVEKSRPN

SEQ ID NO: 207228 - protein, 11 aa, Tick-borne encephalitis virus
QGEVEKSRPNL

SEQ ID NO: 207229 - protein, 11 aa, Tick-borne encephalitis virus
GEVEKSRPNLP

SEQ ID NO: 207230 - protein, 11 aa, Tick-borne encephalitis virus
EAEKSRPNLPQ

SEQ ID NO: 207231 - protein, 11 aa, Tick-borne encephalitis virus
AEKSRPNLPQA

SEQ ID NO: 207232 - protein, 11 aa, Tick-borne encephalitis virus
EKSRPNLPQAV

SEQ ID NO: 207233 - protein, 11 aa, Tick-borne encephalitis virus
GTGWTSKGQIT

SEQ ID NO: 207234 - protein, 11 aa, Tick-borne encephalitis virus
TGWTSKGQITV

SEQ ID NO: 207235 - protein, 11 aa, Tick-borne encephalitis virus
GWTSKGQITVL

SEQ ID NO: 207236 - protein, 11 aa, Tick-borne encephalitis virus
WTSKGQITVLD

SEQ ID NO: 207237 - protein, 11 aa, Tick-borne encephalitis virus
TSKGQITVLDM

SEQ ID NO: 207238 - protein, 11 aa, Tick-borne encephalitis virus
SKGQITVLDMH

SEQ ID NO: 207239 - protein, 11 aa, Tick-borne encephalitis virus
RVLPELIRQCT

SEQ ID NO: 207240 - protein, 11 aa, Tick-borne encephalitis virus
VLPELIRQCTD

SEQ ID NO: 207241 - protein, 11 aa, Tick-borne encephalitis virus
LPELIRQCTDR

SEQ ID NO: 207242 - protein, 11 aa, Tick-borne encephalitis virus
PELIRQCTDRR

SEQ ID NO: 207243 - protein, 11 aa, Tick-borne encephalitis virus
ELIRQCTDRRL

SEQ ID NO: 207244 - protein, 11 aa, Tick-borne encephalitis virus
LIRQCTDRRLR

SEQ ID NO: 207245 - protein, 11 aa, Tick-borne encephalitis virus
IRQCTDRRLRT

SEQ ID NO: 207246 - protein, 11 aa, Tick-borne encephalitis virus
RQCTDRRLRTL

SEQ ID NO: 207247 - protein, 11 aa, Tick-borne encephalitis virus
QCTDRRLRTLV

SEQ ID NO: 207248 - protein, 11 aa, Tick-borne encephalitis virus
CTDRRLRTLVL

SEQ ID NO: 207249 - protein, 11 aa, Tick-borne encephalitis virus
TDRRLRTLVLA

SEQ ID NO: 207250 - protein, 11 aa, Tick-borne encephalitis virus
VVLKEMERALS

SEQ ID NO: 207251 - protein, 11 aa, Tick-borne encephalitis virus
VLKEMERALSG

SEQ ID NO: 207252 - protein, 11 aa, Tick-borne encephalitis virus
LKEMERALSGK

SEQ ID NO: 207253 - protein, 11 aa, Tick-borne encephalitis virus
KEMERALSGKR

SEQ ID NO: 207254 - protein, 11 aa, Tick-borne encephalitis virus
EMERALSGKRV

SEQ ID NO: 207255 - protein, 11 aa, Tick-borne encephalitis virus
MERALSGKRVR

SEQ ID NO: 207256 - protein, 11 aa, Tick-borne encephalitis virus
ERALSGKRVRF

SEQ ID NO: 207257 - protein, 11 aa, Tick-borne encephalitis virus
RALSGKRVRFH

SEQ ID NO: 207258 - protein, 11 aa, Tick-borne encephalitis virus
ALSGKRVRFHS

SEQ ID NO: 207259 - protein, 11 aa, Tick-borne encephalitis virus
LSGKRVRFHSP

SEQ ID NO: 207260 - protein, 11 aa, Tick-borne encephalitis virus
SGKRVRFHSPA

SEQ ID NO: 207261 - protein, 11 aa, Tick-borne encephalitis virus
GKRVRFLSPAV

SEQ ID NO: 207262 - protein, 11 aa, Tick-borne encephalitis virus
KRVRFHSPAVS

SEQ ID NO: 207263 - protein, 11 aa, Tick-borne encephalitis virus
RVRFHSPAVSD

SEQ ID NO: 207264 - protein, 11 aa, Tick-borne encephalitis virus
VRFHSPAVSDQ

SEQ ID NO: 207265 - protein, 11 aa, Tick-borne encephalitis virus
RFHSPAVSDQQ

SEQ ID NO: 207266 - protein, 11 aa, Tick-borne encephalitis virus
GGSIVDVMCHA

SEQ ID NO: 207267 - protein, 11 aa, Tick-borne encephalitis virus
GSIVDVMCHAT

SEQ ID NO: 207268 - protein, 11 aa, Tick-borne encephalitis virus
SIVDVMCHATY

SEQ ID NO: 207269 - protein, 11 aa, Tick-borne encephalitis virus
IVDLMCHTTYV

SEQ ID NO: 207270 - protein, 11 aa, Tick-borne encephalitis virus
VDLMCHTTYVN

SEQ ID NO: 207271 - protein, 11 aa, Tick-borne encephalitis virus
DVMCHATYVSR

SEQ ID NO: 207272 - protein, 11 aa, Tick-borne encephalitis virus
VMCHATYVSRR

SEQ ID NO: 207273 - protein, 11 aa, Tick-borne encephalitis virus
MCHTTYVNRRL

SEQ ID NO: 207274 - protein, 11 aa, Tick-borne encephalitis virus
CHTTYVNRRLL

SEQ ID NO: 207275 - protein, 11 aa, Tick-borne encephalitis virus
HTTYVNRRLLP

SEQ ID NO: 207276 - protein, 11 aa, Tick-borne encephalitis virus
ATYVSRRLLPQ

SEQ ID NO: 207277 - protein, 11 aa, Tick-borne encephalitis virus
TYVSRRLLPQG

SEQ ID NO: 207278 - protein, 11 aa, Tick-borne encephalitis virus
YVSRRLLPQGR

SEQ ID NO: 207279 - protein, 11 aa, Tick-borne encephalitis virus
VSRRLLPQGRQ

SEQ ID NO: 207280 - protein, 11 aa, Tick-borne encephalitis virus
SRRLLPQGRQN

SEQ ID NO: 207281 - protein, 11 aa, Tick-borne encephalitis virus
PQGRQNWEVAT

SEQ ID NO: 207282 - protein, 11 aa, Tick-borne encephalitis virus
QGRQNWEVATI

SEQ ID NO: 207283 - protein, 11 aa, Tick-borne encephalitis virus
GRQNWEVATID

SEQ ID NO: 207284 - protein, 11 aa, Tick-borne encephalitis virus
RQNWEVATIDE

SEQ ID NO: 207285 - protein, 11 aa, Tick-borne encephalitis virus
QNWEVATIDEA

SEQ ID NO: 207286 - protein, 11 aa, Tick-borne encephalitis virus
NWEVATIDEAH

SEQ ID NO: 207287 - protein, 11 aa, Tick-borne encephalitis virus
WEVATIDEAHW

SEQ ID NO: 207288 - protein, 11 aa, Tick-borne encephalitis virus
EVATIDEAHWT

SEQ ID NO: 207289 - protein, 11 aa, Tick-borne encephalitis virus
VATIDEAHWTD

SEQ ID NO: 207290 - protein, 11 aa, Tick-borne encephalitis virus
ATIDEAHWTDP

SEQ ID NO: 207291 - protein, 11 aa, Tick-borne encephalitis virus
TIDEAHWTDPH

SEQ ID NO: 207292 - protein, 11 aa, Tick-borne encephalitis virus
IDEAHWTDPHS

SEQ ID NO: 207293 - protein, 11 aa, Tick-borne encephalitis virus
AARGHLYTLAQ

SEQ ID NO: 207294 - protein, 11 aa, Tick-borne encephalitis virus
ARGHLYTLAQE

SEQ ID NO: 207295 - protein, 11 aa, Tick-borne encephalitis virus
RGHLYTLAQEN

SEQ ID NO: 207296 - protein, 11 aa, Tick-borne encephalitis virus
GHLYTLAQENK

SEQ ID NO: 207297 - protein, 11 aa, Tick-borne encephalitis virus
HLYTLAQENKC

SEQ ID NO: 207298 - protein, 11 aa, Tick-borne encephalitis virus
LYTLAQENKCA

SEQ ID NO: 207299 - protein, 11 aa, Tick-borne encephalitis virus
YTLAQENKCAL

SEQ ID NO: 207300 - protein, 11 aa, Tick-borne encephalitis virus
TLAQENKCALV

SEQ ID NO: 207301 - protein, 11 aa, Tick-borne encephalitis virus
LAQENKCALVL

SEQ ID NO: 207302 - protein, 11 aa, Tick-borne encephalitis virus
AQENKCALVLM

SEQ ID NO: 207303 - protein, 11 aa, Tick-borne encephalitis virus
QENKCALVLMT

SEQ ID NO: 207304 - protein, 11 aa, Tick-borne encephalitis virus
KCALVLMTATR

SEQ ID NO: 207305 - protein, 11 aa, Tick-borne encephalitis virus
CALVLMTATRP

SEQ ID NO: 207306 - protein, 11 aa, Tick-borne encephalitis virus
ALVLMTATRPG

SEQ ID NO: 207307 - protein, 11 aa, Tick-borne encephalitis virus
LVLMTATRPGK

SEQ ID NO: 207308 - protein, 11 aa, Tick-borne encephalitis virus
VLMTATRPGKS

SEQ ID NO: 207309 - protein, 11 aa, Tick-borne encephalitis virus
LMTATRPGKSE

SEQ ID NO: 207310 - protein, 11 aa, Tick-borne encephalitis virus
MTATRPGKSEP

SEQ ID NO: 207311 - protein, 11 aa, Tick-borne encephalitis virus
TATRPGKSEPF

SEQ ID NO: 207312 - protein, 11 aa, Tick-borne encephalitis virus
ATRPGKSEPFP

SEQ ID NO: 207313 - protein, 11 aa, Tick-borne encephalitis virus
TRPGKSEPFPE

SEQ ID NO: 207314 - protein, 11 aa, Tick-borne encephalitis virus
RPGKSEPFPES

SEQ ID NO: 207315 - protein, 11 aa, Tick-borne encephalitis virus
GKSEPFPESNR

SEQ ID NO: 207316 - protein, 11 aa, Tick-borne encephalitis virus
KSEPFPESNRG

SEQ ID NO: 207317 - protein, 11 aa, Tick-borne encephalitis virus
SEPFPESNRGI

SEQ ID NO: 207318 - protein, 11 aa, Tick-borne encephalitis virus
EPFPESNGAIS

SEQ ID NO: 207319 - protein, 11 aa, Tick-borne encephalitis virus
PFPESNGAISS

SEQ ID NO: 207320 - protein, 11 aa, Tick-borne encephalitis virus
FPESNGAISSE

SEQ ID NO: 207321 - protein, 11 aa, Tick-borne encephalitis virus
PESNGAISSEE

SEQ ID NO: 207322 - protein, 11 aa, Tick-borne encephalitis virus
ESNGAITSEEK

SEQ ID NO: 207323 - protein, 11 aa, Tick-borne encephalitis virus
SNGAITSEEKQ

SEQ ID NO: 207324 - protein, 11 aa, Tick-borne encephalitis virus
NGAITSEEKQI

SEQ ID NO: 207325 - protein, 11 aa, Tick-borne encephalitis virus
GAITSEEKQIP

SEQ ID NO: 207326 - protein, 11 aa, Tick-borne encephalitis virus
SEERQIPDGEW

SEQ ID NO: 207327 - protein, 11 aa, Tick-borne encephalitis virus
EERQIPDGEWR

SEQ ID NO: 207328 - protein, 11 aa, Tick-borne encephalitis virus
ERQIPDGEWRD

SEQ ID NO: 207329 - protein, 11 aa, Tick-borne encephalitis virus
RQIPDGEWRDG

SEQ ID NO: 207330 - protein, 11 aa, Tick-borne encephalitis virus
QIPEGEWRDGF

SEQ ID NO: 207331 - protein, 11 aa, Tick-borne encephalitis virus
IPEGEWRDGFD

SEQ ID NO: 207332 - protein, 11 aa, Tick-borne encephalitis virus
PEGEWRDGFDW

SEQ ID NO: 207333 - protein, 11 aa, Tick-borne encephalitis virus
EGEWRDGFDWI

SEQ ID NO: 207334 - protein, 11 aa, Tick-borne encephalitis virus
FDWITEYEGRS

SEQ ID NO: 207335 - protein, 11 aa, Tick-borne encephalitis virus
DWITEYEGRSA

SEQ ID NO: 207336 - protein, 11 aa, Tick-borne encephalitis virus
WITEYEGRSAW

SEQ ID NO: 207337 - protein, 11 aa, Tick-borne encephalitis virus
ITEYEGRSAWF

SEQ ID NO: 207338 - protein, 11 aa, Tick-borne encephalitis virus
TEYEGRSAWFV

SEQ ID NO: 207339 - protein, 11 aa, Tick-borne encephalitis virus
EYEGRSAWFVP

SEQ ID NO: 207340 - protein, 11 aa, Tick-borne encephalitis virus
YEGRSAWFVPS

SEQ ID NO: 207341 - protein, 11 aa, Tick-borne encephalitis virus
EGRSAWFVPSI

SEQ ID NO: 207342 - protein, 11 aa, Tick-borne encephalitis virus
GRTAWFVPSIV

SEQ ID NO: 207343 - protein, 11 aa, Tick-borne encephalitis virus
RTAWFVPSIVK

SEQ ID NO: 207344 - protein, 11 aa, Tick-borne encephalitis virus
TAWFVPSIVKG

SEQ ID NO: 207345 - protein, 11 aa, Tick-borne encephalitis virus
AWFVPSIVKGG

SEQ ID NO: 207346 - protein, 11 aa, Tick-borne encephalitis virus
WFVPSIAKGGA

SEQ ID NO: 207347 - protein, 11 aa, Tick-borne encephalitis virus
FVPSIAKGGAI

SEQ ID NO: 207348 - protein, 11 aa, Tick-borne encephalitis virus
VPSIAKGGAIA

SEQ ID NO: 207349 - protein, 11 aa, Tick-borne encephalitis virus
PSIAKGGAIAR

SEQ ID NO: 207350 - protein, 11 aa, Tick-borne encephalitis virus
SIAKGGAIART

SEQ ID NO: 207351 - protein, 11 aa, Tick-borne encephalitis virus
IAKGGAIARTL

SEQ ID NO: 207352 - protein, 11 aa, Tick-borne encephalitis virus
AKGGAIARTLR

SEQ ID NO: 207353 - protein, 11 aa, Tick-borne encephalitis virus
KGGAIARTLRQ

SEQ ID NO: 207354 - protein, 11 aa, Tick-borne encephalitis virus
GGAIARTLRQK

SEQ ID NO: 207355 - protein, 11 aa, Tick-borne encephalitis virus
GAIARTLRQKG

SEQ ID NO: 207356 - protein, 11 aa, Tick-borne encephalitis virus
AIARTLRQKGK

SEQ ID NO: 207357 - protein, 11 aa, Tick-borne encephalitis virus
IARALRQKGKS

SEQ ID NO: 207358 - protein, 11 aa, Tick-borne encephalitis virus
ARALRQKGKSV

SEQ ID NO: 207359 - protein, 11 aa, Tick-borne encephalitis virus
RALRQKGKSVI

SEQ ID NO: 207360 - protein, 11 aa, Tick-borne encephalitis virus
ALRQKGKSVIC

SEQ ID NO: 207361 - protein, 11 aa, Tick-borne encephalitis virus
LNSKTFEKDYT

SEQ ID NO: 207362 - protein, 11 aa, Tick-borne encephalitis virus
NSKTFEKDYTR

SEQ ID NO: 207363 - protein, 11 aa, Tick-borne encephalitis virus
SKTFEKDYTRV

SEQ ID NO: 207364 - protein, 11 aa, Tick-borne encephalitis virus
KTFEKDYTRVR

SEQ ID NO: 207365 - protein, 11 aa, Tick-borne encephalitis virus
TFEKDYTRVRD

SEQ ID NO: 207366 - protein, 11 aa, Tick-borne encephalitis virus
FEKDYTRVRDE

SEQ ID NO: 207367 - protein, 11 aa, Tick-borne encephalitis virus
EKDYTRVRDEK

SEQ ID NO: 207368 - protein, 11 aa, Tick-borne encephalitis virus
KDYTRVRDEKP

SEQ ID NO: 207369 - protein, 11 aa, Tick-borne encephalitis virus
DYTRVRDEKPD

SEQ ID NO: 207370 - protein, 11 aa, Tick-borne encephalitis virus
YTRVRDEKPDF

SEQ ID NO: 207371 - protein, 11 aa, Tick-borne encephalitis virus
TRVRDEKPDFV

SEQ ID NO: 207372 - protein, 11 aa, Tick-borne encephalitis virus
TNIKPEEVDGK

SEQ ID NO: 207373 - protein, 11 aa, Tick-borne encephalitis virus
NIKPEEVDGKV

SEQ ID NO: 207374 - protein, 11 aa, Tick-borne encephalitis virus
IKPEEVDGKVE

SEQ ID NO: 207375 - protein, 11 aa, Tick-borne encephalitis virus
KPEEVDGKVEL

SEQ ID NO: 207376 - protein, 11 aa, Tick-borne encephalitis virus
PEEVDGKVELT

SEQ ID NO: 207377 - protein, 11 aa, Tick-borne encephalitis virus
EEVDGKVELTG

SEQ ID NO: 207378 - protein, 11 aa, Tick-borne encephalitis virus
EVDGKVELTGT

SEQ ID NO: 207379 - protein, 11 aa, Tick-borne encephalitis virus
VDGKVELTGTR

SEQ ID NO: 207380 - protein, 11 aa, Tick-borne encephalitis virus
DGKVELTGTRR

SEQ ID NO: 207381 - protein, 11 aa, Tick-borne encephalitis virus
GKVELTGTRRV

SEQ ID NO: 207382 - protein, 11 aa, Tick-borne encephalitis virus
KVELTGTRRVT

SEQ ID NO: 207383 - protein, 11 aa, Tick-borne encephalitis virus
VELIGTRRVTT

SEQ ID NO: 207384 - protein, 11 aa, Tick-borne encephalitis virus
ELIGTRRVTTA

SEQ ID NO: 207385 - protein, 11 aa, Tick-borne encephalitis virus
LIGTRRVTTAS

SEQ ID NO: 207386 - protein, 11 aa, Tick-borne encephalitis virus
IGTRRVTTASA

SEQ ID NO: 207387 - protein, 11 aa, Tick-borne encephalitis virus
TRRVTTASAAP

SEQ ID NO: 207388 - protein, 11 aa, Tick-borne encephalitis virus
RRVTTASAAPR

SEQ ID NO: 207389 - protein, 11 aa, Tick-borne encephalitis virus
RVTTASAAPRR

SEQ ID NO: 207390 - protein, 11 aa, Tick-borne encephalitis virus
VTTASAAPRRG

SEQ ID NO: 207391 - protein, 11 aa, Tick-borne encephalitis virus
TTASAAPRRGR

SEQ ID NO: 207392 - protein, 11 aa, Tick-borne encephalitis virus
TASAAPRRGRV

SEQ ID NO: 207393 - protein, 11 aa, Tick-borne encephalitis virus
ASAAPRRGRVG

SEQ ID NO: 207394 - protein, 11 aa, Tick-borne encephalitis virus
SAAPRRGRVGR

SEQ ID NO: 207395 - protein, 11 aa, Tick-borne encephalitis virus
AAQRRGRVGRH

SEQ ID NO: 207396 - protein, 11 aa, Tick-borne encephalitis virus
AQRRGRVGRQD

SEQ ID NO: 207397 - protein, 11 aa, Tick-borne encephalitis virus
QRRGRVGRQDG

SEQ ID NO: 207398 - protein, 11 aa, Tick-borne encephalitis virus
RRGRVGRQDGR

SEQ ID NO: 207399 - protein, 11 aa, Tick-borne encephalitis virus
RGRVGRQDGRT

SEQ ID NO: 207400 - protein, 11 aa, Tick-borne encephalitis virus
GRVGRQDGRTD

SEQ ID NO: 207401 - protein, 11 aa, Tick-borne encephalitis virus
RVGRQDGRTDE

SEQ ID NO: 207402 - protein, 11 aa, Tick-borne encephalitis virus
VGRQDGRTDEY

SEQ ID NO: 207403 - protein, 11 aa, Tick-borne encephalitis virus
GRQDGRTDEYI

SEQ ID NO: 207404 - protein, 11 aa, Tick-borne encephalitis virus
RQDGRTDEYIY

SEQ ID NO: 207405 - protein, 11 aa, Tick-borne encephalitis virus
QDGRTDEYIYS

SEQ ID NO: 207406 - protein, 11 aa, Tick-borne encephalitis virus
DGRTDEYIYSG

SEQ ID NO: 207407 - protein, 11 aa, Tick-borne encephalitis virus
GRIDEYIYSGQ

SEQ ID NO: 207408 - protein, 11 aa, Tick-borne encephalitis virus
RIDEYIYSGQC

SEQ ID NO: 207409 - protein, 11 aa, Tick-borne encephalitis virus
IDEYIYSGQCD

SEQ ID NO: 207410 - protein, 11 aa, Tick-borne encephalitis virus
DEYIYSGQCDE

SEQ ID NO: 207411 - protein, 11 aa, Tick-borne encephalitis virus
EYIYSGQCDEY

SEQ ID NO: 207412 - protein, 11 aa, Tick-borne encephalitis virus
YIYSGQCDEYD

SEQ ID NO: 207413 - protein, 11 aa, Tick-borne encephalitis virus
IYSGQCDEYDS

SEQ ID NO: 207414 - protein, 11 aa, Tick-borne encephalitis virus
YSGQCDDDDGG

SEQ ID NO: 207415 - protein, 11 aa, Tick-borne encephalitis virus
SGQCDDDDSVL

SEQ ID NO: 207416 - protein, 11 aa, Tick-borne encephalitis virus
GQCDDDDGGLV

SEQ ID NO: 207417 - protein, 11 aa, Tick-borne encephalitis virus
QCDEYDSGLVQ

SEQ ID NO: 207418 - protein, 11 aa, Tick-borne encephalitis virus
CDEYDSGLVQW

SEQ ID NO: 207419 - protein, 11 aa, Tick-borne encephalitis virus
DDDDSVLVQWK

SEQ ID NO: 207420 - protein, 11 aa, Tick-borne encephalitis virus
EYDSGLVQWKE

SEQ ID NO: 207421 - protein, 11 aa, Tick-borne encephalitis virus
YDSGLVQWKEA

SEQ ID NO: 207422 - protein, 11 aa, Tick-borne encephalitis virus
DGGLVQWKEAQ

SEQ ID NO: 207423 - protein, 11 aa, Tick-borne encephalitis virus
GGLVQWKEAQI

SEQ ID NO: 207424 - protein, 11 aa, Tick-borne encephalitis virus
GLVQWKEGQIL

SEQ ID NO: 207425 - protein, 11 aa, Tick-borne encephalitis virus
LVQWKEGQILL

SEQ ID NO: 207426 - protein, 11 aa, Tick-borne encephalitis virus
VQWKEGQILLD

SEQ ID NO: 207427 - protein, 11 aa, Tick-borne encephalitis virus
QWKEAQILLDD

SEQ ID NO: 207428 - protein, 11 aa, Tick-borne encephalitis virus
WKEGQILLDNI

SEQ ID NO: 207429 - protein, 11 aa, Tick-borne encephalitis virus
KEAQILLDNII

SEQ ID NO: 207430 - protein, 11 aa, Tick-borne encephalitis virus
EAQILLDDITT

SEQ ID NO: 207431 - protein, 11 aa, Tick-borne encephalitis virus
AQILLDNIITL

SEQ ID NO: 207432 - protein, 11 aa, Tick-borne encephalitis virus
QILLDDITTLR

SEQ ID NO: 207433 - protein, 11 aa, Tick-borne encephalitis virus
ILLDDITTLRG

SEQ ID NO: 207434 - protein, 11 aa, Tick-borne encephalitis virus
LLDNIITLRGP

SEQ ID NO: 207435 - protein, 11 aa, Tick-borne encephalitis virus
LDDITTLRGPV

SEQ ID NO: 207436 - protein, 11 aa, Tick-borne encephalitis virus
DNIITLRGPVA

SEQ ID NO: 207437 - protein, 11 aa, Tick-borne encephalitis virus
NITTLRGPVVT

SEQ ID NO: 207438 - protein, 11 aa, Tick-borne encephalitis virus
ITTLRGPVVTF

SEQ ID NO: 207439 - protein, 11 aa, Tick-borne encephalitis virus
TTLRGPVVTFY

SEQ ID NO: 207440 - protein, 11 aa, Tick-borne encephalitis virus
TLRGPVVTFYG

SEQ ID NO: 207441 - protein, 11 aa, Tick-borne encephalitis virus
LRGPVVTFYGP

SEQ ID NO: 207442 - protein, 11 aa, Tick-borne encephalitis virus
RGPVVTFYGPE

SEQ ID NO: 207443 - protein, 11 aa, Tick-borne encephalitis virus
GPVVTFYGPEQ

SEQ ID NO: 207444 - protein, 11 aa, Tick-borne encephalitis virus
PVVTFYGPEQD

SEQ ID NO: 207445 - protein, 11 aa, Tick-borne encephalitis virus
VVTFYGPEQDK

SEQ ID NO: 207446 - protein, 11 aa, Tick-borne encephalitis virus
ATFYGPEQDRM

SEQ ID NO: 207447 - protein, 11 aa, Tick-borne encephalitis virus
TFYGPEQDRMP

SEQ ID NO: 207448 - protein, 11 aa, Tick-borne encephalitis virus
FYGPEQDRMPE

SEQ ID NO: 207449 - protein, 11 aa, Tick-borne encephalitis virus
YGPEQDRMPEV

SEQ ID NO: 207450 - protein, 11 aa, Tick-borne encephalitis virus
GPEQDRMPEVA

SEQ ID NO: 207451 - protein, 11 aa, Tick-borne encephalitis virus
PEQDRMPEVAG

SEQ ID NO: 207452 - protein, 11 aa, Tick-borne encephalitis virus
EQDRMPEVAGH

SEQ ID NO: 207453 - protein, 11 aa, Tick-borne encephalitis virus
QDRMPEVAGHF

SEQ ID NO: 207454 - protein, 11 aa, Tick-borne encephalitis virus
DRMPEVAGHFR

SEQ ID NO: 207455 - protein, 11 aa, Tick-borne encephalitis virus
KMPEVAGHYRL

SEQ ID NO: 207456 - protein, 11 aa, Tick-borne encephalitis virus
MPEVAGHYRLT

SEQ ID NO: 207457 - protein, 11 aa, Tick-borne encephalitis virus
PEVAGHYRLTE

SEQ ID NO: 207458 - protein, 11 aa, Tick-borne encephalitis virus
EVAGHYRLTEE

SEQ ID NO: 207459 - protein, 11 aa, Tick-borne encephalitis virus
VAGHYRLTEEK

SEQ ID NO: 207460 - protein, 11 aa, Tick-borne encephalitis virus
AGHYRLTEEKR

SEQ ID NO: 207461 - protein, 11 aa, Tick-borne encephalitis virus
GHYRLTEEKRK

SEQ ID NO: 207462 - protein, 11 aa, Tick-borne encephalitis virus
HYRLTEEKRKH

SEQ ID NO: 207463 - protein, 11 aa, Tick-borne encephalitis virus
YRLTEEKRKHF

SEQ ID NO: 207464 - protein, 11 aa, Tick-borne encephalitis virus
LAWHVAANVSG

SEQ ID NO: 207465 - protein, 11 aa, Tick-borne encephalitis virus
AWHVAANVSGV

SEQ ID NO: 207466 - protein, 11 aa, Tick-borne encephalitis virus
WHVAANVSGVT

SEQ ID NO: 207467 - protein, 11 aa, Tick-borne encephalitis virus
HVAANVSSVTD

SEQ ID NO: 207468 - protein, 11 aa, Tick-borne encephalitis virus
VAANVSSVTDR

SEQ ID NO: 207469 - protein, 11 aa, Tick-borne encephalitis virus
AANVSSVTDRS

SEQ ID NO: 207470 - protein, 11 aa, Tick-borne encephalitis virus
ANVSSVTDRSW

SEQ ID NO: 207471 - protein, 11 aa, Tick-borne encephalitis virus
NVSSVTDRSWT

SEQ ID NO: 207472 - protein, 11 aa, Tick-borne encephalitis virus
VSSVTDRSWTW

SEQ ID NO: 207473 - protein, 11 aa, Tick-borne encephalitis virus
SSVTDRSWTWE

SEQ ID NO: 207474 - protein, 11 aa, Tick-borne encephalitis virus
SVTDRSWTWEG

SEQ ID NO: 207475 - protein, 11 aa, Tick-borne encephalitis virus
VTDRSWTWEGP

SEQ ID NO: 207476 - protein, 11 aa, Tick-borne encephalitis virus
TDRSWTWEGPE

SEQ ID NO: 207477 - protein, 11 aa, Tick-borne encephalitis virus
DRSWTWEGPEA

SEQ ID NO: 207478 - protein, 11 aa, Tick-borne encephalitis virus
RSWTWEGPEAN

SEQ ID NO: 207479 - protein, 11 aa, Tick-borne encephalitis virus
SWTWEGPEANA

SEQ ID NO: 207480 - protein, 11 aa, Tick-borne encephalitis virus
WTWEGPEENAV

SEQ ID NO: 207481 - protein, 11 aa, Tick-borne encephalitis virus
TWEGPEENAVD

SEQ ID NO: 207482 - protein, 11 aa, Tick-borne encephalitis virus
WEGPEENAVDE

SEQ ID NO: 207483 - protein, 11 aa, Tick-borne encephalitis virus
EGPEENAVDEA

SEQ ID NO: 207484 - protein, 11 aa, Tick-borne encephalitis virus
GPEENAVDEAN

SEQ ID NO: 207485 - protein, 11 aa, Tick-borne encephalitis virus
PEANAVDEASG

SEQ ID NO: 207486 - protein, 11 aa, Tick-borne encephalitis virus
EENAVDEANGD

SEQ ID NO: 207487 - protein, 11 aa, Tick-borne encephalitis virus
ENAVDEANGDL

SEQ ID NO: 207488 - protein, 11 aa, Tick-borne encephalitis virus
NAVDEANGDLV

SEQ ID NO: 207489 - protein, 11 aa, Tick-borne encephalitis virus
AVDEANGDLVT

SEQ ID NO: 207490 - protein, 11 aa, Tick-borne encephalitis virus
VDEASGDLVTF

SEQ ID NO: 207491 - protein, 11 aa, Tick-borne encephalitis virus
DEASGDLVTFR

SEQ ID NO: 207492 - protein, 11 aa, Tick-borne encephalitis virus
EASGDLVTFRS

SEQ ID NO: 207493 - protein, 11 aa, Tick-borne encephalitis virus
ASGDLVTFRSP

SEQ ID NO: 207494 - protein, 11 aa, Tick-borne encephalitis virus
SGDLVTFRSPN

SEQ ID NO: 207495 - protein, 11 aa, Tick-borne encephalitis virus
GDLVTFKSPNG

SEQ ID NO: 207496 - protein, 11 aa, Tick-borne encephalitis virus
DLVTFKSPNGA

SEQ ID NO: 207497 - protein, 11 aa, Tick-borne encephalitis virus
LVTFKSPNGAE

SEQ ID NO: 207498 - protein, 11 aa, Tick-borne encephalitis virus
VTFKSPNGAER

SEQ ID NO: 207499 - protein, 11 aa, Tick-borne encephalitis virus
TFKSPNGAERT

SEQ ID NO: 207500 - protein, 11 aa, Tick-borne encephalitis virus
FKSPNGAERTL

SEQ ID NO: 207501 - protein, 11 aa, Tick-borne encephalitis virus
KSPNGAERTLR

SEQ ID NO: 207502 - protein, 11 aa, Tick-borne encephalitis virus
SPNGAERTLKP

SEQ ID NO: 207503 - protein, 11 aa, Tick-borne encephalitis virus
PNGAERTLKPV

SEQ ID NO: 207504 - protein, 11 aa, Tick-borne encephalitis virus
NGAERTLKPVW

SEQ ID NO: 207505 - protein, 11 aa, Tick-borne encephalitis virus
GAERTLRPVWK

SEQ ID NO: 207506 - protein, 11 aa, Tick-borne encephalitis virus
AERTLRPVWKD

SEQ ID NO: 207507 - protein, 11 aa, Tick-borne encephalitis virus
ERTLRPVWKDA

SEQ ID NO: 207508 - protein, 11 aa, Tick-borne encephalitis virus
RTLRPVWKDAR

SEQ ID NO: 207509 - protein, 11 aa, Tick-borne encephalitis virus
TLRPVWKDARM

SEQ ID NO: 207510 - protein, 11 aa, Tick-borne encephalitis virus
LRPVWKDARMF

SEQ ID NO: 207511 - protein, 11 aa, Tick-borne encephalitis virus
RPVWKDARMFK

SEQ ID NO: 207512 - protein, 11 aa, Tick-borne encephalitis virus
PVWKDARMFKE

SEQ ID NO: 207513 - protein, 11 aa, Tick-borne encephalitis virus
VWKDARMFKEG

SEQ ID NO: 207514 - protein, 11 aa, Tick-borne encephalitis virus
WKDARMFKEGR

SEQ ID NO: 207515 - protein, 11 aa, Tick-borne encephalitis virus
KDARMFKEGRD

SEQ ID NO: 207516 - protein, 11 aa, Tick-borne encephalitis virus
DARMFKEGRDI

SEQ ID NO: 207517 - protein, 11 aa, Tick-borne encephalitis virus
ARMFKEGRDIK

SEQ ID NO: 207518 - protein, 11 aa, Tick-borne encephalitis virus
RMFKEGRDIKE

SEQ ID NO: 207519 - protein, 11 aa, Tick-borne encephalitis virus
MFKEGRDIKEF

SEQ ID NO: 207520 - protein, 11 aa, Tick-borne encephalitis virus
FKEGRDIKEFV

SEQ ID NO: 207521 - protein, 11 aa, Tick-borne encephalitis virus
KEGRDIKEFVA

SEQ ID NO: 207522 - protein, 11 aa, Tick-borne encephalitis virus
EGRDIKEFVAY

SEQ ID NO: 207523 - protein, 11 aa, Tick-borne encephalitis virus
GRDIKEFVAYA

SEQ ID NO: 207524 - protein, 11 aa, Tick-borne encephalitis virus
RDIKEFVAYAS

SEQ ID NO: 207525 - protein, 11 aa, Tick-borne encephalitis virus
DIKEFVAYASG

SEQ ID NO: 207526 - protein, 11 aa, Tick-borne encephalitis virus
IKEFVAYASGR

SEQ ID NO: 207527 - protein, 11 aa, Tick-borne encephalitis virus
KEFVAYASGRR

SEQ ID NO: 207528 - protein, 11 aa, Tick-borne encephalitis virus
EFIAYASGRRS

SEQ ID NO: 207529 - protein, 11 aa, Tick-borne encephalitis virus
FVAYASGRRSI

SEQ ID NO: 207530 - protein, 11 aa, Tick-borne encephalitis virus
VAYASGRRSIG

SEQ ID NO: 207531 - protein, 11 aa, Tick-borne encephalitis virus
AYASGRRSIGD

SEQ ID NO: 207532 - protein, 11 aa, Tick-borne encephalitis virus
YASGRRSIGDV

SEQ ID NO: 207533 - protein, 11 aa, Tick-borne encephalitis virus
ASGRRSIGDVL

SEQ ID NO: 207534 - protein, 11 aa, Tick-borne encephalitis virus
SGRRSFGDVLT

SEQ ID NO: 207535 - protein, 11 aa, Tick-borne encephalitis virus
GRRSFGDVLTG

SEQ ID NO: 207536 - protein, 11 aa, Tick-borne encephalitis virus
RRSFGDVLTGM

SEQ ID NO: 207537 - protein, 11 aa, Tick-borne encephalitis virus
RSFGDVLTGMS

SEQ ID NO: 207538 - protein, 11 aa, Tick-borne encephalitis virus
SFGDVLTGMSG

SEQ ID NO: 207539 - protein, 11 aa, Tick-borne encephalitis virus
FGDVLTGMSGV

SEQ ID NO: 207540 - protein, 11 aa, Tick-borne encephalitis virus
GDVLTGMSGVP

SEQ ID NO: 207541 - protein, 11 aa, Tick-borne encephalitis virus
DVLTGMSGVPE

SEQ ID NO: 207542 - protein, 11 aa, Tick-borne encephalitis virus
VLTGMSGVPEL

SEQ ID NO: 207543 - protein, 11 aa, Tick-borne encephalitis virus
LTGMSGVPELL

SEQ ID NO: 207544 - protein, 11 aa, Tick-borne encephalitis virus
TGMSGVPELLR

SEQ ID NO: 207545 - protein, 11 aa, Tick-borne encephalitis virus
ELLRHRCVSAL

SEQ ID NO: 207546 - protein, 11 aa, Tick-borne encephalitis virus
LLRHRCVSALD

SEQ ID NO: 207547 - protein, 11 aa, Tick-borne encephalitis virus
LRHRCVSALDV

SEQ ID NO: 207548 - protein, 11 aa, Tick-borne encephalitis virus
RHRCVSALDVF

SEQ ID NO: 207549 - protein, 11 aa, Tick-borne encephalitis virus
HRCVSALDVFY

SEQ ID NO: 207550 - protein, 11 aa, Tick-borne encephalitis virus
RCVSALDVFYT

SEQ ID NO: 207551 - protein, 11 aa, Tick-borne encephalitis virus
CVSALDVFYTL

SEQ ID NO: 207552 - protein, 11 aa, Tick-borne encephalitis virus
VSALDVFYTLM

SEQ ID NO: 207553 - protein, 11 aa, Tick-borne encephalitis virus
SALDVFYTLMH

SEQ ID NO: 207554 - protein, 11 aa, Tick-borne encephalitis virus
ALDVFYTLMHE

SEQ ID NO: 207555 - protein, 11 aa, Tick-borne encephalitis virus
LDVFYTLMHEE

SEQ ID NO: 207556 - protein, 11 aa, Tick-borne encephalitis virus
DVFYTLMHDEP

SEQ ID NO: 207557 - protein, 11 aa, Tick-borne encephalitis virus
VFYTLMHDEPG

SEQ ID NO: 207558 - protein, 11 aa, Tick-borne encephalitis virus
FYTLMHEKPDS

SEQ ID NO: 207559 - protein, 11 aa, Tick-borne encephalitis virus
YTLMHDEPGSR

SEQ ID NO: 207560 - protein, 11 aa, Tick-borne encephalitis virus
TLMHDEPGSRA

SEQ ID NO: 207561 - protein, 11 aa, Tick-borne encephalitis virus
LMHEEPGSSAM

SEQ ID NO: 207562 - protein, 11 aa, Tick-borne encephalitis virus
MHEEPGSRAMK

SEQ ID NO: 207563 - protein, 11 aa, Tick-borne encephalitis virus
HEEPGSRAMKM

SEQ ID NO: 207564 - protein, 11 aa, Tick-borne encephalitis virus
EEPGSRAMKMA

SEQ ID NO: 207565 - protein, 11 aa, Tick-borne encephalitis virus
EPGSRAMKMAE

SEQ ID NO: 207566 - protein, 11 aa, Tick-borne encephalitis virus
PGSRAMKMAER

SEQ ID NO: 207567 - protein, 11 aa, Tick-borne encephalitis virus
GSRAMKMAERD

SEQ ID NO: 207568 - protein, 11 aa, Tick-borne encephalitis virus
SRAMKMAERDA

SEQ ID NO: 207569 - protein, 11 aa, Tick-borne encephalitis virus
RAMKMAERDAP

SEQ ID NO: 207570 - protein, 11 aa, Tick-borne encephalitis virus
AMKMAERDAPE

SEQ ID NO: 207571 - protein, 11 aa, Tick-borne encephalitis virus
MKMAERDAPEA

SEQ ID NO: 207572 - protein, 11 aa, Tick-borne encephalitis virus
KMAERDAPEAF

SEQ ID NO: 207573 - protein, 11 aa, Tick-borne encephalitis virus
ERDAPEAFLTM

SEQ ID NO: 207574 - protein, 11 aa, Tick-borne encephalitis virus
RDAPEAFLTMV

SEQ ID NO: 207575 - protein, 11 aa, Tick-borne encephalitis virus
DAPEAFLTMVE

SEQ ID NO: 207576 - protein, 11 aa, Tick-borne encephalitis virus
AEMMVLGLATL

SEQ ID NO: 207577 - protein, 11 aa, Tick-borne encephalitis virus
EVMVLGLATLG

SEQ ID NO: 207578 - protein, 11 aa, Tick-borne encephalitis virus
VMVLGLATLGV

SEQ ID NO: 207579 - protein, 11 aa, Tick-borne encephalitis virus
MVLGLATLGVI

SEQ ID NO: 207580 - protein, 11 aa, Tick-borne encephalitis virus
VLGLATLGVIW

SEQ ID NO: 207581 - protein, 11 aa, Tick-borne encephalitis virus
LGLATLGVIWC

SEQ ID NO: 207582 - protein, 11 aa, Tick-borne encephalitis virus
GLATLGVIWCF

SEQ ID NO: 207583 - protein, 11 aa, Tick-borne encephalitis virus
LATLGVIWCFV

SEQ ID NO: 207584 - protein, 11 aa, Tick-borne encephalitis virus
ATLGVIWCFVV

SEQ ID NO: 207585 - protein, 11 aa, Tick-borne encephalitis virus
TLGVIWCFVVR

SEQ ID NO: 207586 - protein, 11 aa, Tick-borne encephalitis virus
LGVIWCFVVRT

SEQ ID NO: 207587 - protein, 11 aa, Tick-borne encephalitis virus
GVIWCFVVRTS

SEQ ID NO: 207588 - protein, 11 aa, Tick-borne encephalitis virus
VIWCFVVRTSI

SEQ ID NO: 207589 - protein, 11 aa, Tick-borne encephalitis virus
IWCFVVRTSIS

SEQ ID NO: 207590 - protein, 11 aa, Tick-borne encephalitis virus
WCFVARTSISR

SEQ ID NO: 207591 - protein, 11 aa, Tick-borne encephalitis virus
CFVARTSISRM

SEQ ID NO: 207592 - protein, 11 aa, Tick-borne encephalitis virus
FVARTSISRMM

SEQ ID NO: 207593 - protein, 11 aa, Tick-borne encephalitis virus
VVRASISRMML

SEQ ID NO: 207594 - protein, 11 aa, Tick-borne encephalitis virus
VRASISRMMLG

SEQ ID NO: 207595 - protein, 11 aa, Tick-borne encephalitis virus
RASISRMMLGT

SEQ ID NO: 207596 - protein, 11 aa, Tick-borne encephalitis virus
ASISRMMLGTL

SEQ ID NO: 207597 - protein, 11 aa, Tick-borne encephalitis virus
LGTLVLLASLL

SEQ ID NO: 207598 - protein, 11 aa, Tick-borne encephalitis virus
GTLVLLASLLL

SEQ ID NO: 207599 - protein, 11 aa, Tick-borne encephalitis virus
TLVLLASLLLL

SEQ ID NO: 207600 - protein, 11 aa, Tick-borne encephalitis virus
LVLLASLLLLW

SEQ ID NO: 207601 - protein, 11 aa, Tick-borne encephalitis virus
VLLASLLLLWA

SEQ ID NO: 207602 - protein, 11 aa, Tick-borne encephalitis virus
LLASLLLLWAG

SEQ ID NO: 207603 - protein, 11 aa, Tick-borne encephalitis virus
LASLLLLWAGG

SEQ ID NO: 207604 - protein, 11 aa, Tick-borne encephalitis virus
ASLLLLWAGGV

SEQ ID NO: 207605 - protein, 11 aa, Tick-borne encephalitis virus
SLLLLWAGGVG

SEQ ID NO: 207606 - protein, 11 aa, Tick-borne encephalitis virus
LLLLWAGGVGY

SEQ ID NO: 207607 - protein, 11 aa, Tick-borne encephalitis virus
LLLWAGGVGYG

SEQ ID NO: 207608 - protein, 11 aa, Tick-borne encephalitis virus
LLWAGGVGYGN

SEQ ID NO: 207609 - protein, 11 aa, Tick-borne encephalitis virus
LWAGGVGYGNM

SEQ ID NO: 207610 - protein, 11 aa, Tick-borne encephalitis virus
WAGGVGYGNMA

SEQ ID NO: 207611 - protein, 11 aa, Tick-borne encephalitis virus
AGGVGYGNMAG

SEQ ID NO: 207612 - protein, 11 aa, Tick-borne encephalitis virus
GGVGYGNMAGV

SEQ ID NO: 207613 - protein, 11 aa, Tick-borne encephalitis virus
GVGYGNMAGVA

SEQ ID NO: 207614 - protein, 11 aa, Tick-borne encephalitis virus
VGYGNMAGVAL

SEQ ID NO: 207615 - protein, 11 aa, Tick-borne encephalitis virus
GYGNMAGVALI

SEQ ID NO: 207616 - protein, 11 aa, Tick-borne encephalitis virus
YTLLTVLQPEV

SEQ ID NO: 207617 - protein, 11 aa, Tick-borne encephalitis virus
TLLTVLQPEVG

SEQ ID NO: 207618 - protein, 11 aa, Tick-borne encephalitis virus
LLTVLQPEVGK

SEQ ID NO: 207619 - protein, 11 aa, Tick-borne encephalitis virus
LTVLQPEVGKQ

SEQ ID NO: 207620 - protein, 11 aa, Tick-borne encephalitis virus
TVLQPEVGKQR

SEQ ID NO: 207621 - protein, 11 aa, Tick-borne encephalitis virus
VLQPEVGKQRS

SEQ ID NO: 207622 - protein, 11 aa, Tick-borne encephalitis virus
LQPEVGKQRSS

SEQ ID NO: 207623 - protein, 11 aa, Tick-borne encephalitis virus
QPEVGKQRSSD

SEQ ID NO: 207624 - protein, 11 aa, Tick-borne encephalitis virus
PEVGKQRSSDD

SEQ ID NO: 207625 - protein, 11 aa, Tick-borne encephalitis virus
EVGKQRSSDDN

SEQ ID NO: 207626 - protein, 11 aa, Tick-borne encephalitis virus
VGKQRSSDDNK

SEQ ID NO: 207627 - protein, 11 aa, Tick-borne encephalitis virus
LAYFLLTLCSV

SEQ ID NO: 207628 - protein, 11 aa, Tick-borne encephalitis virus
AYFLLTLCSVA

SEQ ID NO: 207629 - protein, 11 aa, Tick-borne encephalitis virus
YFLLTLCSVAG

SEQ ID NO: 207630 - protein, 11 aa, Tick-borne encephalitis virus
FLLTLCSVAGL

SEQ ID NO: 207631 - protein, 11 aa, Tick-borne encephalitis virus
LLTLCSVAGLV

SEQ ID NO: 207632 - protein, 11 aa, Tick-borne encephalitis virus
LTLCSVAGLVA

SEQ ID NO: 207633 - protein, 11 aa, Tick-borne encephalitis virus
TLCSVAGLVAA

SEQ ID NO: 207634 - protein, 11 aa, Tick-borne encephalitis virus
LCSVAGLVAAN

SEQ ID NO: 207635 - protein, 11 aa, Tick-borne encephalitis virus
CSVAGLVAANE

SEQ ID NO: 207636 - protein, 11 aa, Tick-borne encephalitis virus
SVAGLVAANEM

SEQ ID NO: 207637 - protein, 11 aa, Tick-borne encephalitis virus
VAGLVAANEMG

SEQ ID NO: 207638 - protein, 11 aa, Tick-borne encephalitis virus
AGLVAANEMGL

SEQ ID NO: 207639 - protein, 11 aa, Tick-borne encephalitis virus
GLVAANEMGLL

SEQ ID NO: 207640 - protein, 11 aa, Tick-borne encephalitis virus
LVAANEMGLLE

SEQ ID NO: 207641 - protein, 11 aa, Tick-borne encephalitis virus
VAANEMGFLER

SEQ ID NO: 207642 - protein, 11 aa, Tick-borne encephalitis virus
AANEMGFLERT

SEQ ID NO: 207643 - protein, 11 aa, Tick-borne encephalitis virus
ANEMGFLERTK

SEQ ID NO: 207644 - protein, 11 aa, Tick-borne encephalitis virus
NEMGFLERTKA

SEQ ID NO: 207645 - protein, 11 aa, Tick-borne encephalitis virus
EMGFLERTKAD

SEQ ID NO: 207646 - protein, 11 aa, Tick-borne encephalitis virus
MGFLERTKADL

SEQ ID NO: 207647 - protein, 11 aa, Tick-borne encephalitis virus
GFLERTKADLS

SEQ ID NO: 207648 - protein, 11 aa, Tick-borne encephalitis virus
FLERTKADLST

SEQ ID NO: 207649 - protein, 11 aa, Tick-borne encephalitis virus
LERTKADLSTV

SEQ ID NO: 207650 - protein, 11 aa, Tick-borne encephalitis virus
ERTKADLSTVL

SEQ ID NO: 207651 - protein, 11 aa, Tick-borne encephalitis virus
RTKADLSTVLW

SEQ ID NO: 207652 - protein, 11 aa, Tick-borne encephalitis virus
TKADLSTALWS

SEQ ID NO: 207653 - protein, 11 aa, Tick-borne encephalitis virus
EPRPWSEWTNV

SEQ ID NO: 207654 - protein, 11 aa, Tick-borne encephalitis virus
PRPWSEWTNVD

SEQ ID NO: 207655 - protein, 11 aa, Tick-borne encephalitis virus
RPWSEWTNVDI

SEQ ID NO: 207656 - protein, 11 aa, Tick-borne encephalitis virus
PWSEWTNVDIQ

SEQ ID NO: 207657 - protein, 11 aa, Tick-borne encephalitis virus
WSEWTNVDIQP

SEQ ID NO: 207658 - protein, 11 aa, Tick-borne encephalitis virus
SEWTNVDIQPA

SEQ ID NO: 207659 - protein, 11 aa, Tick-borne encephalitis virus
EWTNVDIQPAR

SEQ ID NO: 207660 - protein, 11 aa, Tick-borne encephalitis virus
WTNVDIQPARS

SEQ ID NO: 207661 - protein, 11 aa, Tick-borne encephalitis virus
TNVDIQPARSW

SEQ ID NO: 207662 - protein, 11 aa, Tick-borne encephalitis virus
NVDIQPARSWG

SEQ ID NO: 207663 - protein, 11 aa, Tick-borne encephalitis virus
VDIQPARSWGT

SEQ ID NO: 207664 - protein, 11 aa, Tick-borne encephalitis virus
VLVVSLFTPYM

SEQ ID NO: 207665 - protein, 11 aa, Tick-borne encephalitis virus
LVVSLFTPYMI

SEQ ID NO: 207666 - protein, 11 aa, Tick-borne encephalitis virus
VVSLFTPYMIH

SEQ ID NO: 207667 - protein, 11 aa, Tick-borne encephalitis virus
VSLFTPYMIHQ

SEQ ID NO: 207668 - protein, 11 aa, Tick-borne encephalitis virus
SLFTPYMIHQL

SEQ ID NO: 207669 - protein, 11 aa, Tick-borne encephalitis virus
LFTPYMIHQLQ

SEQ ID NO: 207670 - protein, 11 aa, Tick-borne encephalitis virus
FTPYMIHQLQT

SEQ ID NO: 207671 - protein, 11 aa, Tick-borne encephalitis virus
TPYMIHQLQTK

SEQ ID NO: 207672 - protein, 11 aa, Tick-borne encephalitis virus
PYMIHQLQTKI

SEQ ID NO: 207673 - protein, 11 aa, Tick-borne encephalitis virus
YMIHQLQTKIQ

SEQ ID NO: 207674 - protein, 11 aa, Tick-borne encephalitis virus
MIHQLQTKIQQ

SEQ ID NO: 207675 - protein, 11 aa, Tick-borne encephalitis virus
KIQQLVNSAVV

SEQ ID NO: 207676 - protein, 11 aa, Tick-borne encephalitis virus
IQQLVNSAVAS

SEQ ID NO: 207677 - protein, 11 aa, Tick-borne encephalitis virus
QQLVNSAVASG

SEQ ID NO: 207678 - protein, 11 aa, Tick-borne encephalitis virus
QLVNSAVASGA

SEQ ID NO: 207679 - protein, 11 aa, Tick-borne encephalitis virus
LVNSAVASGAQ

SEQ ID NO: 207680 - protein, 11 aa, Tick-borne encephalitis virus
VNSAVASGAQA

SEQ ID NO: 207681 - protein, 11 aa, Tick-borne encephalitis virus
NSAVASGAQAM

SEQ ID NO: 207682 - protein, 11 aa, Tick-borne encephalitis virus
SAVASGAQAMR

SEQ ID NO: 207683 - protein, 11 aa, Tick-borne encephalitis virus
AVASGAQAMRD

SEQ ID NO: 207684 - protein, 11 aa, Tick-borne encephalitis virus
VASGAQAMRDL

SEQ ID NO: 207685 - protein, 11 aa, Tick-borne encephalitis virus
ASGAQAMRDLG

SEQ ID NO: 207686 - protein, 11 aa, Tick-borne encephalitis virus
SGAQAMRDLGG

SEQ ID NO: 207687 - protein, 11 aa, Tick-borne encephalitis virus
AQAMRDLGGGT

SEQ ID NO: 207688 - protein, 11 aa, Tick-borne encephalitis virus
QAMRDLGGGTP

SEQ ID NO: 207689 - protein, 11 aa, Tick-borne encephalitis virus
AMRDLGGGTPF

SEQ ID NO: 207690 - protein, 11 aa, Tick-borne encephalitis virus
MRDLGGGTPFF

SEQ ID NO: 207691 - protein, 11 aa, Tick-borne encephalitis virus
RDLGGGTPFFG

SEQ ID NO: 207692 - protein, 11 aa, Tick-borne encephalitis virus
DLGGGTPFFGV

SEQ ID NO: 207693 - protein, 11 aa, Tick-borne encephalitis virus
LGGGTPFFGVA

SEQ ID NO: 207694 - protein, 11 aa, Tick-borne encephalitis virus
GGGTPFFGVAG

SEQ ID NO: 207695 - protein, 11 aa, Tick-borne encephalitis virus
GGTPFFGVAGH

SEQ ID NO: 207696 - protein, 11 aa, Tick-borne encephalitis virus
GTPFFGVAGHV

SEQ ID NO: 207697 - protein, 11 aa, Tick-borne encephalitis virus
GVAGHVMTLGV

SEQ ID NO: 207698 - protein, 11 aa, Tick-borne encephalitis virus
VAGHVMTLGVV

SEQ ID NO: 207699 - protein, 11 aa, Tick-borne encephalitis virus
AGHVMTLGVVS

SEQ ID NO: 207700 - protein, 11 aa, Tick-borne encephalitis virus
GHVMTLGVVSL

SEQ ID NO: 207701 - protein, 11 aa, Tick-borne encephalitis virus
HVMTLGVVSLI

SEQ ID NO: 207702 - protein, 11 aa, Tick-borne encephalitis virus
VMTLGVVSLIG

SEQ ID NO: 207703 - protein, 11 aa, Tick-borne encephalitis virus
MTLGVVSLIGA

SEQ ID NO: 207704 - protein, 11 aa, Tick-borne encephalitis virus
TLGVVSLIGAT

SEQ ID NO: 207705 - protein, 11 aa, Tick-borne encephalitis virus
LGVVSLIGATP

SEQ ID NO: 207706 - protein, 11 aa, Tick-borne encephalitis virus
GVVSLIGATPT

SEQ ID NO: 207707 - protein, 11 aa, Tick-borne encephalitis virus
VVSLIGATPTS

SEQ ID NO: 207708 - protein, 11 aa, Tick-borne encephalitis virus
VSLIGATPTSL

SEQ ID NO: 207709 - protein, 11 aa, Tick-borne encephalitis virus
SLIGATPTSLM

SEQ ID NO: 207710 - protein, 11 aa, Tick-borne encephalitis virus
LIGATPTSLMV

SEQ ID NO: 207711 - protein, 11 aa, Tick-borne encephalitis virus
IGATPTSLMVG

SEQ ID NO: 207712 - protein, 11 aa, Tick-borne encephalitis virus
GATPTSLMVGV

SEQ ID NO: 207713 - protein, 11 aa, Tick-borne encephalitis virus
ATPTSLMVGVG

SEQ ID NO: 207714 - protein, 11 aa, Tick-borne encephalitis virus
TPTSLMVGVGL

SEQ ID NO: 207715 - protein, 11 aa, Tick-borne encephalitis virus
PTSLMVGVGLA

SEQ ID NO: 207716 - protein, 11 aa, Tick-borne encephalitis virus
TSLMVGVGLAA

SEQ ID NO: 207717 - protein, 11 aa, Tick-borne encephalitis virus
SLMVGVGLAAL

SEQ ID NO: 207718 - protein, 11 aa, Tick-borne encephalitis virus
LMVGVGLAALH

SEQ ID NO: 207719 - protein, 11 aa, Tick-borne encephalitis virus
MVGVGLAALHL

SEQ ID NO: 207720 - protein, 11 aa, Tick-borne encephalitis virus
VGVGLAALHLA

SEQ ID NO: 207721 - protein, 11 aa, Tick-borne encephalitis virus
GVGLAALHLAI

SEQ ID NO: 207722 - protein, 11 aa, Tick-borne encephalitis virus
VGLAALHLAIV

SEQ ID NO: 207723 - protein, 11 aa, Tick-borne encephalitis virus
GLAALHLAIVV

SEQ ID NO: 207724 - protein, 11 aa, Tick-borne encephalitis virus
LAALHLAIVVS

SEQ ID NO: 207725 - protein, 11 aa, Tick-borne encephalitis virus
AALHLAIVVSG

SEQ ID NO: 207726 - protein, 11 aa, Tick-borne encephalitis virus
ALHLAIVVSGL

SEQ ID NO: 207727 - protein, 11 aa, Tick-borne encephalitis virus
LHLAIVVSGLE

SEQ ID NO: 207728 - protein, 11 aa, Tick-borne encephalitis virus
FFSAMVRNPML

SEQ ID NO: 207729 - protein, 11 aa, Tick-borne encephalitis virus
FSAMVRNPMLD

SEQ ID NO: 207730 - protein, 11 aa, Tick-borne encephalitis virus
SAMVRNPMLDG

SEQ ID NO: 207731 - protein, 11 aa, Tick-borne encephalitis virus
AMVRNPMLDGD

SEQ ID NO: 207732 - protein, 11 aa, Tick-borne encephalitis virus
MVRNPMLDGDV

SEQ ID NO: 207733 - protein, 11 aa, Tick-borne encephalitis virus
VRNPMLDGDVI

SEQ ID NO: 207734 - protein, 11 aa, Tick-borne encephalitis virus
RNPMLDGDVIY

SEQ ID NO: 207735 - protein, 11 aa, Tick-borne encephalitis virus
NPMLDGDVIYP

SEQ ID NO: 207736 - protein, 11 aa, Tick-borne encephalitis virus
PMLDGDVIYPF

SEQ ID NO: 207737 - protein, 11 aa, Tick-borne encephalitis virus
MLDGDVIYPFG

SEQ ID NO: 207738 - protein, 11 aa, Tick-borne encephalitis virus
LDGDVIYPFGE

SEQ ID NO: 207739 - protein, 11 aa, Tick-borne encephalitis virus
DGDVIYPFGEG

SEQ ID NO: 207740 - protein, 11 aa, Tick-borne encephalitis virus
GDVIYPFGEGE

SEQ ID NO: 207741 - protein, 11 aa, Tick-borne encephalitis virus
DVINPFGEGET

SEQ ID NO: 207742 - protein, 11 aa, Tick-borne encephalitis virus
VINPFGEGETK

SEQ ID NO: 207743 - protein, 11 aa, Tick-borne encephalitis virus
INPFGEGETKP

SEQ ID NO: 207744 - protein, 11 aa, Tick-borne encephalitis virus
NPFGEGETKPA

SEQ ID NO: 207745 - protein, 11 aa, Tick-borne encephalitis virus
PFGEGETKPAL

SEQ ID NO: 207746 - protein, 11 aa, Tick-borne encephalitis virus
FGEGETKPALY

SEQ ID NO: 207747 - protein, 11 aa, Tick-borne encephalitis virus
GEGETKPALYE

SEQ ID NO: 207748 - protein, 11 aa, Tick-borne encephalitis virus
EGETKPALYER

SEQ ID NO: 207749 - protein, 11 aa, Tick-borne encephalitis virus
GETKPALYERK

SEQ ID NO: 207750 - protein, 11 aa, Tick-borne encephalitis virus
ETKPALYERKM

SEQ ID NO: 207751 - protein, 11 aa, Tick-borne encephalitis virus
TKPALYERKMS

SEQ ID NO: 207752 - protein, 11 aa, Tick-borne encephalitis virus
KPALYERRMSL

SEQ ID NO: 207753 - protein, 11 aa, Tick-borne encephalitis virus
PALYERRMSLV

SEQ ID NO: 207754 - protein, 11 aa, Tick-borne encephalitis virus
ALYERRMSLVL

SEQ ID NO: 207755 - protein, 11 aa, Tick-borne encephalitis virus
LYERRMSLVLA

SEQ ID NO: 207756 - protein, 11 aa, Tick-borne encephalitis virus
YERKMSLVLAV

SEQ ID NO: 207757 - protein, 11 aa, Tick-borne encephalitis virus
MSLVLAIALCL

SEQ ID NO: 207758 - protein, 11 aa, Tick-borne encephalitis virus
ALCLMSVVMNR

SEQ ID NO: 207759 - protein, 11 aa, Tick-borne encephalitis virus
LCLMAVVMNRT

SEQ ID NO: 207760 - protein, 11 aa, Tick-borne encephalitis virus
CLMAVVMNRTV

SEQ ID NO: 207761 - protein, 11 aa, Tick-borne encephalitis virus
SVVMNRTVASI

SEQ ID NO: 207762 - protein, 11 aa, Tick-borne encephalitis virus
VVMNRTVASIT

SEQ ID NO: 207763 - protein, 11 aa, Tick-borne encephalitis virus
VMNRTVASITE

SEQ ID NO: 207764 - protein, 11 aa, Tick-borne encephalitis virus
MNRTVASITEA

SEQ ID NO: 207765 - protein, 11 aa, Tick-borne encephalitis virus
NRTVASITEAS

SEQ ID NO: 207766 - protein, 11 aa, Tick-borne encephalitis virus
RTVASITEASA

SEQ ID NO: 207767 - protein, 11 aa, Tick-borne encephalitis virus
TVASITEASAV

SEQ ID NO: 207768 - protein, 11 aa, Tick-borne encephalitis virus
VASITEASAVG

SEQ ID NO: 207769 - protein, 11 aa, Tick-borne encephalitis virus
ASITEASAVGL

SEQ ID NO: 207770 - protein, 11 aa, Tick-borne encephalitis virus
SITEAAAVGLA

SEQ ID NO: 207771 - protein, 11 aa, Tick-borne encephalitis virus
ITEAAAVGLAA

SEQ ID NO: 207772 - protein, 11 aa, Tick-borne encephalitis virus
TEASAVGLAAV

SEQ ID NO: 207773 - protein, 11 aa, Tick-borne encephalitis virus
EASAVGLAAVG

SEQ ID NO: 207774 - protein, 11 aa, Tick-borne encephalitis virus
ASAVGLAAVGQ

SEQ ID NO: 207775 - protein, 11 aa, Tick-borne encephalitis virus
SAVGLAAVGQL

SEQ ID NO: 207776 - protein, 11 aa, Tick-borne encephalitis virus
AVGLAAVGQLL

SEQ ID NO: 207777 - protein, 11 aa, Tick-borne encephalitis virus
VGLAAVGQLLR

SEQ ID NO: 207778 - protein, 11 aa, Tick-borne encephalitis virus
GLAAVGQLLRP

SEQ ID NO: 207779 - protein, 11 aa, Tick-borne encephalitis virus
LAAVGQLLRPE

SEQ ID NO: 207780 - protein, 11 aa, Tick-borne encephalitis virus
GQLLRPEVDTL

SEQ ID NO: 207781 - protein, 11 aa, Tick-borne encephalitis virus
QLLRPEVDTLW

SEQ ID NO: 207782 - protein, 11 aa, Tick-borne encephalitis virus
LLRPEVDTLWT

SEQ ID NO: 207783 - protein, 11 aa, Tick-borne encephalitis virus
LRPEVDTLWTM

SEQ ID NO: 207784 - protein, 11 aa, Tick-borne encephalitis virus
RPEVDTLWTMP

SEQ ID NO: 207785 - protein, 11 aa, Tick-borne encephalitis virus
PEVDTLWTMPV

SEQ ID NO: 207786 - protein, 11 aa, Tick-borne encephalitis virus
EVDTLWTMPVA

SEQ ID NO: 207787 - protein, 11 aa, Tick-borne encephalitis virus
VDTLWTMPVAC

SEQ ID NO: 207788 - protein, 11 aa, Tick-borne encephalitis virus
TLWTMPVACGM

SEQ ID NO: 207789 - protein, 11 aa, Tick-borne encephalitis virus
LWTMPVACGMS

SEQ ID NO: 207790 - protein, 11 aa, Tick-borne encephalitis virus
WTMPVACGMSG

SEQ ID NO: 207791 - protein, 11 aa, Tick-borne encephalitis virus
TMPVACGMSGV

SEQ ID NO: 207792 - protein, 11 aa, Tick-borne encephalitis virus
MPVACGMSGVV

SEQ ID NO: 207793 - protein, 11 aa, Tick-borne encephalitis virus
PVACGMSGVVR

SEQ ID NO: 207794 - protein, 11 aa, Tick-borne encephalitis virus
VACGMSGVVRG

SEQ ID NO: 207795 - protein, 11 aa, Tick-borne encephalitis virus
ACGMSGVVRGS

SEQ ID NO: 207796 - protein, 11 aa, Tick-borne encephalitis virus
CGMSGVVRGSL

SEQ ID NO: 207797 - protein, 11 aa, Tick-borne encephalitis virus
GMSGVVRGSLW

SEQ ID NO: 207798 - protein, 11 aa, Tick-borne encephalitis virus
MSGVVRGSLWG

SEQ ID NO: 207799 - protein, 11 aa, Tick-borne encephalitis virus
SSVVRGSLWGF

SEQ ID NO: 207800 - protein, 11 aa, Tick-borne encephalitis virus
SVVRGSLWGFL

SEQ ID NO: 207801 - protein, 11 aa, Tick-borne encephalitis virus
VVTGSLWGFLP

SEQ ID NO: 207802 - protein, 11 aa, Tick-borne encephalitis virus
VTGSLWGFLPL

SEQ ID NO: 207803 - protein, 11 aa, Tick-borne encephalitis virus
TGSLWGFLPLG

SEQ ID NO: 207804 - protein, 11 aa, Tick-borne encephalitis virus
GHRLWLRASGG

SEQ ID NO: 207805 - protein, 11 aa, Tick-borne encephalitis virus
HRLWLRASGGR

SEQ ID NO: 207806 - protein, 11 aa, Tick-borne encephalitis virus
RLWLRASGGRR

SEQ ID NO: 207807 - protein, 11 aa, Tick-borne encephalitis virus
LWLRASGGRRG

SEQ ID NO: 207808 - protein, 11 aa, Tick-borne encephalitis virus
WLRASGGRRGG

SEQ ID NO: 207809 - protein, 11 aa, Tick-borne encephalitis virus
LRASGGRRGGS

SEQ ID NO: 207810 - protein, 11 aa, Tick-borne encephalitis virus
RASGGRRGGSE

SEQ ID NO: 207811 - protein, 11 aa, Tick-borne encephalitis virus
ASGGRRGGSEG

SEQ ID NO: 207812 - protein, 11 aa, Tick-borne encephalitis virus
SGGRRGGSEGD

SEQ ID NO: 207813 - protein, 11 aa, Tick-borne encephalitis virus
GGRRGGSEGDT

SEQ ID NO: 207814 - protein, 11 aa, Tick-borne encephalitis virus
GRRGGSEGDTL

SEQ ID NO: 207815 - protein, 11 aa, Tick-borne encephalitis virus
RRGGAEGDTLG

SEQ ID NO: 207816 - protein, 11 aa, Tick-borne encephalitis virus
RGGAEGDTLGD

SEQ ID NO: 207817 - protein, 11 aa, Tick-borne encephalitis virus
GGAEGDTLGDL

SEQ ID NO: 207818 - protein, 11 aa, Tick-borne encephalitis virus
GAEGDTLGDLW

SEQ ID NO: 207819 - protein, 11 aa, Tick-borne encephalitis virus
AEGDTLGDLWK

SEQ ID NO: 207820 - protein, 11 aa, Tick-borne encephalitis virus
EGDTLGDLWKQ

SEQ ID NO: 207821 - protein, 11 aa, Tick-borne encephalitis virus
GDTLGDLWKRR

SEQ ID NO: 207822 - protein, 11 aa, Tick-borne encephalitis virus
DTLGDLWKRRL

SEQ ID NO: 207823 - protein, 11 aa, Tick-borne encephalitis virus
TLGDLWKRRLN

SEQ ID NO: 207824 - protein, 11 aa, Tick-borne encephalitis virus
LNNCTREEFFV

SEQ ID NO: 207825 - protein, 11 aa, Tick-borne encephalitis virus
NNCTREEFFVY

SEQ ID NO: 207826 - protein, 11 aa, Tick-borne encephalitis virus
NCTREEFFVYR

SEQ ID NO: 207827 - protein, 11 aa, Tick-borne encephalitis virus
CTREEFFVYRR

SEQ ID NO: 207828 - protein, 11 aa, Tick-borne encephalitis virus
EEFFVYRRTGI

SEQ ID NO: 207829 - protein, 11 aa, Tick-borne encephalitis virus
EFFVYRRTGIL

SEQ ID NO: 207830 - protein, 11 aa, Tick-borne encephalitis virus
FFVYRRTGILE

SEQ ID NO: 207831 - protein, 11 aa, Tick-borne encephalitis virus
FVYRRTGILET

SEQ ID NO: 207832 - protein, 11 aa, Tick-borne encephalitis virus
VYRRTGILETE

SEQ ID NO: 207833 - protein, 11 aa, Tick-borne encephalitis virus
YRRAGILETER

SEQ ID NO: 207834 - protein, 11 aa, Tick-borne encephalitis virus
RRAGILETERD

SEQ ID NO: 207835 - protein, 11 aa, Tick-borne encephalitis virus
RTGILETERDR

SEQ ID NO: 207836 - protein, 11 aa, Tick-borne encephalitis virus
TGIMETERDKA

SEQ ID NO: 207837 - protein, 11 aa, Tick-borne encephalitis virus
GIMETERDKAR

SEQ ID NO: 207838 - protein, 11 aa, Tick-borne encephalitis virus
IMETERDKARE

SEQ ID NO: 207839 - protein, 11 aa, Tick-borne encephalitis virus
LETERDRAREL

SEQ ID NO: 207840 - protein, 11 aa, Tick-borne encephalitis virus
ETERDRARELL

SEQ ID NO: 207841 - protein, 11 aa, Tick-borne encephalitis virus
TERDKARELLK

SEQ ID NO: 207842 - protein, 11 aa, Tick-borne encephalitis virus
ERDKARELLRK

SEQ ID NO: 207843 - protein, 11 aa, Tick-borne encephalitis virus
RDKARELLRKG

SEQ ID NO: 207844 - protein, 11 aa, Tick-borne encephalitis virus
DKARELLRKGE

SEQ ID NO: 207845 - protein, 11 aa, Tick-borne encephalitis virus
KARELLRKGET

SEQ ID NO: 207846 - protein, 11 aa, Tick-borne encephalitis virus
ARELLRKGETN

SEQ ID NO: 207847 - protein, 11 aa, Tick-borne encephalitis virus
KGETNTGLAVS

SEQ ID NO: 207848 - protein, 11 aa, Tick-borne encephalitis virus
GETNTGLAVSR

SEQ ID NO: 207849 - protein, 11 aa, Tick-borne encephalitis virus
ETNTGLAVSRG

SEQ ID NO: 207850 - protein, 11 aa, Tick-borne encephalitis virus
TNTGLAVSRGT

SEQ ID NO: 207851 - protein, 11 aa, Tick-borne encephalitis virus
NTGLAVSRGTA

SEQ ID NO: 207852 - protein, 11 aa, Tick-borne encephalitis virus
TGLAVSRGTAK

SEQ ID NO: 207853 - protein, 11 aa, Tick-borne encephalitis virus
GWSYYAASRPS

SEQ ID NO: 207854 - protein, 11 aa, Tick-borne encephalitis virus
WSYYAASRPSV

SEQ ID NO: 207855 - protein, 11 aa, Tick-borne encephalitis virus
SYYAASRPSVM

SEQ ID NO: 207856 - protein, 11 aa, Tick-borne encephalitis virus
YYAASRPSVMS

SEQ ID NO: 207857 - protein, 11 aa, Tick-borne encephalitis virus
YAASRPSVMSV

SEQ ID NO: 207858 - protein, 11 aa, Tick-borne encephalitis virus
AASRPAVMSVR

SEQ ID NO: 207859 - protein, 11 aa, Tick-borne encephalitis virus
ASRPAVMSVRA

SEQ ID NO: 207860 - protein, 11 aa, Tick-borne encephalitis virus
SRPAVMSVRAY

SEQ ID NO: 207861 - protein, 11 aa, Tick-borne encephalitis virus
RPAVMSVRAYT

SEQ ID NO: 207862 - protein, 11 aa, Tick-borne encephalitis virus
PAVMSVRAYTI

SEQ ID NO: 207863 - protein, 11 aa, Tick-borne encephalitis virus
AVMSVRAYTIG

SEQ ID NO: 207864 - protein, 11 aa, Tick-borne encephalitis virus
VMSVRAYTIGG

SEQ ID NO: 207865 - protein, 11 aa, Tick-borne encephalitis virus
MSVRAYTIGGR

SEQ ID NO: 207866 - protein, 11 aa, Tick-borne encephalitis virus
SVRAYTIGGRG

SEQ ID NO: 207867 - protein, 11 aa, Tick-borne encephalitis virus
VRAYTIGGRGH

SEQ ID NO: 207868 - protein, 11 aa, Tick-borne encephalitis virus
RAYTIGGRGHE

SEQ ID NO: 207869 - protein, 11 aa, Tick-borne encephalitis virus
AYTIGGRGHEA

SEQ ID NO: 207870 - protein, 11 aa, Tick-borne encephalitis virus
YTIGGRGHEAP

SEQ ID NO: 207871 - protein, 11 aa, Tick-borne encephalitis virus
TIGGRGHEAPK

SEQ ID NO: 207872 - protein, 11 aa, Tick-borne encephalitis virus
IGGRGHEAPKM

SEQ ID NO: 207873 - protein, 11 aa, Tick-borne encephalitis virus
GGRGHEAPKMV

SEQ ID NO: 207874 - protein, 11 aa, Tick-borne encephalitis virus
GRGHEAPKMVT

SEQ ID NO: 207875 - protein, 11 aa, Tick-borne encephalitis virus
RGHEAPKMVTS

SEQ ID NO: 207876 - protein, 11 aa, Tick-borne encephalitis virus
GHEAPKMVTSL

SEQ ID NO: 207877 - protein, 11 aa, Tick-borne encephalitis virus
HEAPKMVTSLG

SEQ ID NO: 207878 - protein, 11 aa, Tick-borne encephalitis virus
EAPKMVTSLGW

SEQ ID NO: 207879 - protein, 11 aa, Tick-borne encephalitis virus
APKMVTSLGWN

SEQ ID NO: 207880 - protein, 11 aa, Tick-borne encephalitis virus
PRMVTSLGWNL

SEQ ID NO: 207881 - protein, 11 aa, Tick-borne encephalitis virus
RMVTSLGWNLI

SEQ ID NO: 207882 - protein, 11 aa, Tick-borne encephalitis virus
SLGWNLIKFRS

SEQ ID NO: 207883 - protein, 11 aa, Tick-borne encephalitis virus
LGWNLIKFRSG

SEQ ID NO: 207884 - protein, 11 aa, Tick-borne encephalitis virus
GWNLIKFRSGM

SEQ ID NO: 207885 - protein, 11 aa, Tick-borne encephalitis virus
WNLIKFRSGMD

SEQ ID NO: 207886 - protein, 11 aa, Tick-borne encephalitis virus
NLIKFRSGMDV

SEQ ID NO: 207887 - protein, 11 aa, Tick-borne encephalitis virus
LIKFRSGMDVF

SEQ ID NO: 207888 - protein, 11 aa, Tick-borne encephalitis virus
IKFRSGMDVFS

SEQ ID NO: 207889 - protein, 11 aa, Tick-borne encephalitis virus
KFRSGMDVFSM

SEQ ID NO: 207890 - protein, 11 aa, Tick-borne encephalitis virus
FRSGMDVFSMQ

SEQ ID NO: 207891 - protein, 11 aa, Tick-borne encephalitis virus
RSGMDVFSMQP

SEQ ID NO: 207892 - protein, 11 aa, Tick-borne encephalitis virus
SGMDVFSMQPH

SEQ ID NO: 207893 - protein, 11 aa, Tick-borne encephalitis virus
GVDVFSMQPHR

SEQ ID NO: 207894 - protein, 11 aa, Tick-borne encephalitis virus
VDVFSMQPHRA

SEQ ID NO: 207895 - protein, 11 aa, Tick-borne encephalitis virus
FSMQPHRADTV

SEQ ID NO: 207896 - protein, 11 aa, Tick-borne encephalitis virus
SMQPHRADTVM

SEQ ID NO: 207897 - protein, 11 aa, Tick-borne encephalitis virus
MQPHRADTVMC

SEQ ID NO: 207898 - protein, 11 aa, Tick-borne encephalitis virus
QPHRADTVMCD

SEQ ID NO: 207899 - protein, 11 aa, Tick-borne encephalitis virus
PHRADTVMCDI

SEQ ID NO: 207900 - protein, 11 aa, Tick-borne encephalitis virus
HRADTVMCDIG

SEQ ID NO: 207901 - protein, 11 aa, Tick-borne encephalitis virus
RADTVMCDIGE

SEQ ID NO: 207902 - protein, 11 aa, Tick-borne encephalitis virus
ADTVMCDIGES

SEQ ID NO: 207903 - protein, 11 aa, Tick-borne encephalitis virus
DTVMCDIGESS

SEQ ID NO: 207904 - protein, 11 aa, Tick-borne encephalitis virus
TVMCDIGESSP

SEQ ID NO: 207905 - protein, 11 aa, Tick-borne encephalitis virus
VMCDIGESSPD

SEQ ID NO: 207906 - protein, 11 aa, Tick-borne encephalitis virus
MCDIGESSPDA

SEQ ID NO: 207907 - protein, 11 aa, Tick-borne encephalitis virus
CDIGESSPDAA

SEQ ID NO: 207908 - protein, 11 aa, Tick-borne encephalitis virus
DIGESSPDAAV

SEQ ID NO: 207909 - protein, 11 aa, Tick-borne encephalitis virus
IGESSPDAAVE

SEQ ID NO: 207910 - protein, 11 aa, Tick-borne encephalitis virus
GESSPDAAVEG

SEQ ID NO: 207911 - protein, 11 aa, Tick-borne encephalitis virus
ESSPDAAVEGE

SEQ ID NO: 207912 - protein, 11 aa, Tick-borne encephalitis virus
SSPDAAVEGER

SEQ ID NO: 207913 - protein, 11 aa, Tick-borne encephalitis virus
SPDAAVEGERT

SEQ ID NO: 207914 - protein, 11 aa, Tick-borne encephalitis virus
PDAAVEGERTR

SEQ ID NO: 207915 - protein, 11 aa, Tick-borne encephalitis virus
DAAVEGERTRK

SEQ ID NO: 207916 - protein, 11 aa, Tick-borne encephalitis virus
AAVEGERTRKV

SEQ ID NO: 207917 - protein, 11 aa, Tick-borne encephalitis virus
AVEGERTRKVI

SEQ ID NO: 207918 - protein, 11 aa, Tick-borne encephalitis virus
VEGERTRRVIL

SEQ ID NO: 207919 - protein, 11 aa, Tick-borne encephalitis virus
EGERTRRVILL

SEQ ID NO: 207920 - protein, 11 aa, Tick-borne encephalitis virus
GERTRRVILLM

SEQ ID NO: 207921 - protein, 11 aa, Tick-borne encephalitis virus
ERTRRVILLME

SEQ ID NO: 207922 - protein, 11 aa, Tick-borne encephalitis virus
RTRRVILLMEQ

SEQ ID NO: 207923 - protein, 11 aa, Tick-borne encephalitis virus
TRRVILLMEQW

SEQ ID NO: 207924 - protein, 11 aa, Tick-borne encephalitis virus
RRVILLMEQWK

SEQ ID NO: 207925 - protein, 11 aa, Tick-borne encephalitis virus
RVILLMEQWKN

SEQ ID NO: 207926 - protein, 11 aa, Tick-borne encephalitis virus
VILLMEQWKIR

SEQ ID NO: 207927 - protein, 11 aa, Tick-borne encephalitis virus
ILLMEQWKIRN

SEQ ID NO: 207928 - protein, 11 aa, Tick-borne encephalitis virus
LLMEQWKIRNP

SEQ ID NO: 207929 - protein, 11 aa, Tick-borne encephalitis virus
LMEQWKNRNPA

SEQ ID NO: 207930 - protein, 11 aa, Tick-borne encephalitis virus
MEQWKIRNPTA

SEQ ID NO: 207931 - protein, 11 aa, Tick-borne encephalitis virus
EQWKNRNPTAA

SEQ ID NO: 207932 - protein, 11 aa, Tick-borne encephalitis virus
QWKNRNPTAAC

SEQ ID NO: 207933 - protein, 11 aa, Tick-borne encephalitis virus
WKNRNPTAACV

SEQ ID NO: 207934 - protein, 11 aa, Tick-borne encephalitis virus
KNRNPTAACVF

SEQ ID NO: 207935 - protein, 11 aa, Tick-borne encephalitis virus
NRNPTAACVFK

SEQ ID NO: 207936 - protein, 11 aa, Tick-borne encephalitis virus
RNPTAACVFKV

SEQ ID NO: 207937 - protein, 11 aa, Tick-borne encephalitis virus
NPTAACVFKVL

SEQ ID NO: 207938 - protein, 11 aa, Tick-borne encephalitis virus
PTAACVFKVLA

SEQ ID NO: 207939 - protein, 11 aa, Tick-borne encephalitis virus
TAACVFKVLAP

SEQ ID NO: 207940 - protein, 11 aa, Tick-borne encephalitis virus
AACVFKVLAPY

SEQ ID NO: 207941 - protein, 11 aa, Tick-borne encephalitis virus
ACVFKVLAPYR

SEQ ID NO: 207942 - protein, 11 aa, Tick-borne encephalitis virus
VFKVLAPYRPK

SEQ ID NO: 207943 - protein, 11 aa, Tick-borne encephalitis virus
FKVLAPYRPKV

SEQ ID NO: 207944 - protein, 11 aa, Tick-borne encephalitis virus
KVLAPYRPKVI

SEQ ID NO: 207945 - protein, 11 aa, Tick-borne encephalitis virus
VLAPYRPKVIE

SEQ ID NO: 207946 - protein, 11 aa, Tick-borne encephalitis virus
LAPYRPKVIEA

SEQ ID NO: 207947 - protein, 11 aa, Tick-borne encephalitis virus
APYRPKVIEAL

SEQ ID NO: 207948 - protein, 11 aa, Tick-borne encephalitis virus
PYRPKVIEALH

SEQ ID NO: 207949 - protein, 11 aa, Tick-borne encephalitis virus
YRPKVIEALHR

SEQ ID NO: 207950 - protein, 11 aa, Tick-borne encephalitis virus
RPEVIETLHRF

SEQ ID NO: 207951 - protein, 11 aa, Tick-borne encephalitis virus
PEVIETLHRFQ

SEQ ID NO: 207952 - protein, 11 aa, Tick-borne encephalitis virus
EVIETLHRFQL

SEQ ID NO: 207953 - protein, 11 aa, Tick-borne encephalitis virus
VIEALHRFQLR

SEQ ID NO: 207954 - protein, 11 aa, Tick-borne encephalitis virus
IEALHRFQLRW

SEQ ID NO: 207955 - protein, 11 aa, Tick-borne encephalitis virus
EALHRFQLRWG

SEQ ID NO: 207956 - protein, 11 aa, Tick-borne encephalitis virus
ALHRFQLRWGG

SEQ ID NO: 207957 - protein, 11 aa, Tick-borne encephalitis virus
LHRFQLRWGGG

SEQ ID NO: 207958 - protein, 11 aa, Tick-borne encephalitis virus
HRFQLRWGGGL

SEQ ID NO: 207959 - protein, 11 aa, Tick-borne encephalitis virus
RFQLRWGGGLV

SEQ ID NO: 207960 - protein, 11 aa, Tick-borne encephalitis virus
FQLRWGGGLVR

SEQ ID NO: 207961 - protein, 11 aa, Tick-borne encephalitis virus
QLRWGGGLVRT

SEQ ID NO: 207962 - protein, 11 aa, Tick-borne encephalitis virus
LRWGGGLVRTP

SEQ ID NO: 207963 - protein, 11 aa, Tick-borne encephalitis virus
RWGGGLVRTPF

SEQ ID NO: 207964 - protein, 11 aa, Tick-borne encephalitis virus
RTPFSRNSTHK

SEQ ID NO: 207965 - protein, 11 aa, Tick-borne encephalitis virus
TPFSRNSTHKV

SEQ ID NO: 207966 - protein, 11 aa, Tick-borne encephalitis virus
PFSRNSTHKVY

SEQ ID NO: 207967 - protein, 11 aa, Tick-borne encephalitis virus
FSRNSTHKVYY

SEQ ID NO: 207968 - protein, 11 aa, Tick-borne encephalitis virus
SRNSTHKVYYS

SEQ ID NO: 207969 - protein, 11 aa, Tick-borne encephalitis virus
RNSTHKVYYST

SEQ ID NO: 207970 - protein, 11 aa, Tick-borne encephalitis virus
NSTHKVYYSTA

SEQ ID NO: 207971 - protein, 11 aa, Tick-borne encephalitis virus
STHEMYYSTAI

SEQ ID NO: 207972 - protein, 11 aa, Tick-borne encephalitis virus
THEMYYSTAIT

SEQ ID NO: 207973 - protein, 11 aa, Tick-borne encephalitis virus
HKVYYSTAVTG

SEQ ID NO: 207974 - protein, 11 aa, Tick-borne encephalitis virus
KVYYSTAVTGN

SEQ ID NO: 207975 - protein, 11 aa, Tick-borne encephalitis virus
VYYSTAVTGNI

SEQ ID NO: 207976 - protein, 11 aa, Tick-borne encephalitis virus
YYSTAITGNIV

SEQ ID NO: 207977 - protein, 11 aa, Tick-borne encephalitis virus
YSTAITGNIVN

SEQ ID NO: 207978 - protein, 11 aa, Tick-borne encephalitis virus
STAITGNIVNS

SEQ ID NO: 207979 - protein, 11 aa, Tick-borne encephalitis virus
TAITGNIVNSV

SEQ ID NO: 207980 - protein, 11 aa, Tick-borne encephalitis virus
AITGNIVNSVN

SEQ ID NO: 207981 - protein, 11 aa, Tick-borne encephalitis virus
VTGNIVNSVNV

SEQ ID NO: 207982 - protein, 11 aa, Tick-borne encephalitis virus
TGNIVNSVNVQ

SEQ ID NO: 207983 - protein, 11 aa, Tick-borne encephalitis virus
GNIVNSVNVQS

SEQ ID NO: 207984 - protein, 11 aa, Tick-borne encephalitis virus
NIVNSVNVQSR

SEQ ID NO: 207985 - protein, 11 aa, Tick-borne encephalitis virus
IVNSVNVQSRK

SEQ ID NO: 207986 - protein, 11 aa, Tick-borne encephalitis virus
VNSVNVQSRKL

SEQ ID NO: 207987 - protein, 11 aa, Tick-borne encephalitis virus
NSVNVQSRKLL

SEQ ID NO: 207988 - protein, 11 aa, Tick-borne encephalitis virus
SVNVQSRKLLA

SEQ ID NO: 207989 - protein, 11 aa, Tick-borne encephalitis virus
VNVQSRKLLAR

SEQ ID NO: 207990 - protein, 11 aa, Tick-borne encephalitis virus
NVQSRKLLARF

SEQ ID NO: 207991 - protein, 11 aa, Tick-borne encephalitis virus
VQSRKLLARFG

SEQ ID NO: 207992 - protein, 11 aa, Tick-borne encephalitis virus
QSRKLLARFAG

SEQ ID NO: 207993 - protein, 11 aa, Tick-borne encephalitis virus
SRKLLARFAGQ

SEQ ID NO: 207994 - protein, 11 aa, Tick-borne encephalitis virus
RKLLARFAGQR

SEQ ID NO: 207995 - protein, 11 aa, Tick-borne encephalitis virus
KLLARFAGQRG

SEQ ID NO: 207996 - protein, 11 aa, Tick-borne encephalitis virus
LLARFAGQRGP

SEQ ID NO: 207997 - protein, 11 aa, Tick-borne encephalitis virus
LARFAGQRGPT

SEQ ID NO: 207998 - protein, 11 aa, Tick-borne encephalitis virus
ARFGDQRGPTK

SEQ ID NO: 207999 - protein, 11 aa, Tick-borne encephalitis virus
RFGDQRGPTKV

SEQ ID NO: 208000 - protein, 11 aa, Tick-borne encephalitis virus
FGDQRGPTKVP

SEQ ID NO: 208001 - protein, 11 aa, Tick-borne encephalitis virus
GDQRGPTKVPE

SEQ ID NO: 208002 - protein, 11 aa, Tick-borne encephalitis virus
DQRGPTKVPEL

SEQ ID NO: 208003 - protein, 11 aa, Tick-borne encephalitis virus
QRGPTKVPELD

SEQ ID NO: 208004 - protein, 11 aa, Tick-borne encephalitis virus
RGPTKVPELDL

SEQ ID NO: 208005 - protein, 11 aa, Tick-borne encephalitis virus
GPTKVPELDLG

SEQ ID NO: 208006 - protein, 11 aa, Tick-borne encephalitis virus
PTRVPELDLGI

SEQ ID NO: 208007 - protein, 11 aa, Tick-borne encephalitis virus
TRVPELDLGIG

SEQ ID NO: 208008 - protein, 11 aa, Tick-borne encephalitis virus
RVPELDLGIGT

SEQ ID NO: 208009 - protein, 11 aa, Tick-borne encephalitis virus
VPELDLGIGTR

SEQ ID NO: 208010 - protein, 11 aa, Tick-borne encephalitis virus
PELDLGIGTRC

SEQ ID NO: 208011 - protein, 11 aa, Tick-borne encephalitis virus
ELDLGIGTRCV

SEQ ID NO: 208012 - protein, 11 aa, Tick-borne encephalitis virus
LDLGIGTRCVV

SEQ ID NO: 208013 - protein, 11 aa, Tick-borne encephalitis virus
DLGIGTRCVVL

SEQ ID NO: 208014 - protein, 11 aa, Tick-borne encephalitis virus
LGIGTRCVVLA

SEQ ID NO: 208015 - protein, 11 aa, Tick-borne encephalitis virus
GIGTRCVVLAE

SEQ ID NO: 208016 - protein, 11 aa, Tick-borne encephalitis virus
IGTRCVVLAED

SEQ ID NO: 208017 - protein, 11 aa, Tick-borne encephalitis virus
GTRCVVLAEDR

SEQ ID NO: 208018 - protein, 11 aa, Tick-borne encephalitis virus
TRCVVLAEDRV

SEQ ID NO: 208019 - protein, 11 aa, Tick-borne encephalitis virus
RCVVLAEDRVR

SEQ ID NO: 208020 - protein, 11 aa, Tick-borne encephalitis virus
CVVLAEDRVRE

SEQ ID NO: 208021 - protein, 11 aa, Tick-borne encephalitis virus
LAEDKVKEQDV

SEQ ID NO: 208022 - protein, 11 aa, Tick-borne encephalitis virus
DKVKEQDVQER

SEQ ID NO: 208023 - protein, 11 aa, Tick-borne encephalitis virus
KVKEQDVQERI

SEQ ID NO: 208024 - protein, 11 aa, Tick-borne encephalitis virus
ALREQYSETWH

SEQ ID NO: 208025 - protein, 11 aa, Tick-borne encephalitis virus
DEEHPYRTWQY

SEQ ID NO: 208026 - protein, 11 aa, Tick-borne encephalitis virus
EEHPYRTWQYW

SEQ ID NO: 208027 - protein, 11 aa, Tick-borne encephalitis virus
TAPTGSAASLT

SEQ ID NO: 208028 - protein, 11 aa, Tick-borne encephalitis virus
APTGSAASLTN

SEQ ID NO: 208029 - protein, 11 aa, Tick-borne encephalitis virus
PTGSAASLTNG

SEQ ID NO: 208030 - protein, 11 aa, Tick-borne encephalitis virus
TGSAASLTNGV

SEQ ID NO: 208031 - protein, 11 aa, Tick-borne encephalitis virus
GSAASLTNGVV

SEQ ID NO: 208032 - protein, 11 aa, Tick-borne encephalitis virus
SAASLTNGVVK

SEQ ID NO: 208033 - protein, 11 aa, Tick-borne encephalitis virus
AASLTNGVVKL

SEQ ID NO: 208034 - protein, 11 aa, Tick-borne encephalitis virus
ASLTNGVVKLL

SEQ ID NO: 208035 - protein, 11 aa, Tick-borne encephalitis virus
SLTNGVVKLLS

SEQ ID NO: 208036 - protein, 11 aa, Tick-borne encephalitis virus
LTNGVVKLLSW

SEQ ID NO: 208037 - protein, 11 aa, Tick-borne encephalitis virus
TNGVVKLLSWP

SEQ ID NO: 208038 - protein, 11 aa, Tick-borne encephalitis virus
EDVVRMAMTDP

SEQ ID NO: 208039 - protein, 11 aa, Tick-borne encephalitis virus
DVVRMAMTDPT

SEQ ID NO: 208040 - protein, 11 aa, Tick-borne encephalitis virus
VVRMAMTDPTP

SEQ ID NO: 208041 - protein, 11 aa, Tick-borne encephalitis virus
VRMAMTDPTPA

SEQ ID NO: 208042 - protein, 11 aa, Tick-borne encephalitis virus
RMAMTDPTPAW

SEQ ID NO: 208043 - protein, 11 aa, Tick-borne encephalitis virus
MAMTDPTPAWQ

SEQ ID NO: 208044 - protein, 11 aa, Tick-borne encephalitis virus
AMTDPTPAWQQ

SEQ ID NO: 208045 - protein, 11 aa, Tick-borne encephalitis virus
MTDPTPAWQQR

SEQ ID NO: 208046 - protein, 11 aa, Tick-borne encephalitis virus
TDPTPAWQQRV

SEQ ID NO: 208047 - protein, 11 aa, Tick-borne encephalitis virus
DPTPAWQQRVF

SEQ ID NO: 208048 - protein, 11 aa, Tick-borne encephalitis virus
PTPAWQQRVFK

SEQ ID NO: 208049 - protein, 11 aa, Tick-borne encephalitis virus
TAFGQQRVFKD

SEQ ID NO: 208050 - protein, 11 aa, Tick-borne encephalitis virus
AFGQQRVFKDK

SEQ ID NO: 208051 - protein, 11 aa, Tick-borne encephalitis virus
FGQQRVFKDKV

SEQ ID NO: 208052 - protein, 11 aa, Tick-borne encephalitis virus
GQQRVFKDKVD

SEQ ID NO: 208053 - protein, 11 aa, Tick-borne encephalitis virus
QQRVFKDKVDT

SEQ ID NO: 208054 - protein, 11 aa, Tick-borne encephalitis virus
QRVFKDKVDTK

SEQ ID NO: 208055 - protein, 11 aa, Tick-borne encephalitis virus
RVFKDKVDTKA

SEQ ID NO: 208056 - protein, 11 aa, Tick-borne encephalitis virus
VFKDKVDTKAQ

SEQ ID NO: 208057 - protein, 11 aa, Tick-borne encephalitis virus
FKDKVDTKAQE

SEQ ID NO: 208058 - protein, 11 aa, Tick-borne encephalitis virus
KDKVDTKAQEP

SEQ ID NO: 208059 - protein, 11 aa, Tick-borne encephalitis virus
DKVDTKAQEPQ

SEQ ID NO: 208060 - protein, 11 aa, Tick-borne encephalitis virus
NADTKAQEPQP

SEQ ID NO: 208061 - protein, 11 aa, Tick-borne encephalitis virus
ADTKAQEPQPG

SEQ ID NO: 208062 - protein, 11 aa, Tick-borne encephalitis virus
TKAQEPQPGTR

SEQ ID NO: 208063 - protein, 11 aa, Tick-borne encephalitis virus
KAQEPQPGTRV

SEQ ID NO: 208064 - protein, 11 aa, Tick-borne encephalitis virus
AQEPQPGTRVI

SEQ ID NO: 208065 - protein, 11 aa, Tick-borne encephalitis virus
QEPQPGTRVIM

SEQ ID NO: 208066 - protein, 11 aa, Tick-borne encephalitis virus
EPQPGTRVIMR

SEQ ID NO: 208067 - protein, 11 aa, Tick-borne encephalitis virus
PQPGTRVIMRA

SEQ ID NO: 208068 - protein, 11 aa, Tick-borne encephalitis virus
QPGTRVIMRAV

SEQ ID NO: 208069 - protein, 11 aa, Tick-borne encephalitis virus
PGTRVIMRAVN

SEQ ID NO: 208070 - protein, 11 aa, Tick-borne encephalitis virus
GTRVIMRAVND

SEQ ID NO: 208071 - protein, 11 aa, Tick-borne encephalitis virus
TRVIMRAVNDW

SEQ ID NO: 208072 - protein, 11 aa, Tick-borne encephalitis virus
RVIMRAVNDWI

SEQ ID NO: 208073 - protein, 11 aa, Tick-borne encephalitis virus
VIMRAVNDWML

SEQ ID NO: 208074 - protein, 11 aa, Tick-borne encephalitis virus
IMRAVNDWMLD

SEQ ID NO: 208075 - protein, 11 aa, Tick-borne encephalitis virus
MRAVNDWMLDR

SEQ ID NO: 208076 - protein, 11 aa, Tick-borne encephalitis virus
RAVNDWMLDRL

SEQ ID NO: 208077 - protein, 11 aa, Tick-borne encephalitis virus
AVNDWMLDRLA

SEQ ID NO: 208078 - protein, 11 aa, Tick-borne encephalitis virus
VNDWILERLAQ

SEQ ID NO: 208079 - protein, 11 aa, Tick-borne encephalitis virus
NDWILERLAQK

SEQ ID NO: 208080 - protein, 11 aa, Tick-borne encephalitis virus
DWILERLAQKS

SEQ ID NO: 208081 - protein, 11 aa, Tick-borne encephalitis virus
KPRMCSKEEFI

SEQ ID NO: 208082 - protein, 11 aa, Tick-borne encephalitis virus
PRMCSKEEFIA

SEQ ID NO: 208083 - protein, 11 aa, Tick-borne encephalitis virus
RMCSKEEFIAK

SEQ ID NO: 208084 - protein, 11 aa, Tick-borne encephalitis virus
MCSKEEFIAKV

SEQ ID NO: 208085 - protein, 11 aa, Tick-borne encephalitis virus
CSKEEFIAKVK

SEQ ID NO: 208086 - protein, 11 aa, Tick-borne encephalitis virus
SKEEFIAKVKS

SEQ ID NO: 208087 - protein, 11 aa, Tick-borne encephalitis virus
KEEFIAKVKSN

SEQ ID NO: 208088 - protein, 11 aa, Tick-borne encephalitis virus
EEFIAKVRSNA

SEQ ID NO: 208089 - protein, 11 aa, Tick-borne encephalitis virus
EFIAKVKSSAA

SEQ ID NO: 208090 - protein, 11 aa, Tick-borne encephalitis virus
FIAKVKSSAAL

SEQ ID NO: 208091 - protein, 11 aa, Tick-borne encephalitis virus
IAKVKSSAALG

SEQ ID NO: 208092 - protein, 11 aa, Tick-borne encephalitis virus
AKVKSSAALGA

SEQ ID NO: 208093 - protein, 11 aa, Tick-borne encephalitis virus
KVRSNAALGAW

SEQ ID NO: 208094 - protein, 11 aa, Tick-borne encephalitis virus
VKSSAALGAWS

SEQ ID NO: 208095 - protein, 11 aa, Tick-borne encephalitis virus
KSNAALGAWSE

SEQ ID NO: 208096 - protein, 11 aa, Tick-borne encephalitis virus
SNAALGAWSNE

SEQ ID NO: 208097 - protein, 11 aa, Tick-borne encephalitis virus
NAALGAWSEEQ

SEQ ID NO: 208098 - protein, 11 aa, Tick-borne encephalitis virus
AALGAWSNEQN

SEQ ID NO: 208099 - protein, 11 aa, Tick-borne encephalitis virus
ALGAWSNEQNR

SEQ ID NO: 208100 - protein, 11 aa, Tick-borne encephalitis virus
LGAWSNEQNRW

SEQ ID NO: 208101 - protein, 11 aa, Tick-borne encephalitis virus
GAWSDEQNRWA

SEQ ID NO: 208102 - protein, 11 aa, Tick-borne encephalitis virus
SAREAVEDPAF

SEQ ID NO: 208103 - protein, 11 aa, Tick-borne encephalitis virus
AREAVEDPAFW

SEQ ID NO: 208104 - protein, 11 aa, Tick-borne encephalitis virus
EAVEDPAFWHL

SEQ ID NO: 208105 - protein, 11 aa, Tick-borne encephalitis virus
AVEDPAFWHLV

SEQ ID NO: 208106 - protein, 11 aa, Tick-borne encephalitis virus
VEDPAFWHLVD

SEQ ID NO: 208107 - protein, 11 aa, Tick-borne encephalitis virus
EDPAFWHLVDE

SEQ ID NO: 208108 - protein, 11 aa, Tick-borne encephalitis virus
DPAFWHLVDEE

SEQ ID NO: 208109 - protein, 11 aa, Tick-borne encephalitis virus
PAFWHLVDEER

SEQ ID NO: 208110 - protein, 11 aa, Tick-borne encephalitis virus
AFWHLVDEERE

SEQ ID NO: 208111 - protein, 11 aa, Tick-borne encephalitis virus
FWHLVDEERER

SEQ ID NO: 208112 - protein, 11 aa, Tick-borne encephalitis virus
WHLVDEERERH

SEQ ID NO: 208113 - protein, 11 aa, Tick-borne encephalitis virus
HLVDEERERHL

SEQ ID NO: 208114 - protein, 11 aa, Tick-borne encephalitis virus
LVDEERERHLM

SEQ ID NO: 208115 - protein, 11 aa, Tick-borne encephalitis virus
VDEERERHLMG

SEQ ID NO: 208116 - protein, 11 aa, Tick-borne encephalitis virus
DEERERHLMGR

SEQ ID NO: 208117 - protein, 11 aa, Tick-borne encephalitis virus
EERERHLMGRC

SEQ ID NO: 208118 - protein, 11 aa, Tick-borne encephalitis virus
ERERHLMGRCA

SEQ ID NO: 208119 - protein, 11 aa, Tick-borne encephalitis virus
RERHLMGRCAH

SEQ ID NO: 208120 - protein, 11 aa, Tick-borne encephalitis virus
ERHLMGRCAHC

SEQ ID NO: 208121 - protein, 11 aa, Tick-borne encephalitis virus
RHLMGRCAHCV

SEQ ID NO: 208122 - protein, 11 aa, Tick-borne encephalitis virus
GRCAHCVHNMM

SEQ ID NO: 208123 - protein, 11 aa, Tick-borne encephalitis virus
RCAHCVHNMMG

SEQ ID NO: 208124 - protein, 11 aa, Tick-borne encephalitis virus
CAHCVHNMMGK

SEQ ID NO: 208125 - protein, 11 aa, Tick-borne encephalitis virus
AHCVHNMMGKR

SEQ ID NO: 208126 - protein, 11 aa, Tick-borne encephalitis virus
HCVHNMMGKRE

SEQ ID NO: 208127 - protein, 11 aa, Tick-borne encephalitis virus
CVHNMMGKREK

SEQ ID NO: 208128 - protein, 11 aa, Tick-borne encephalitis virus
VHNMMGKREKK

SEQ ID NO: 208129 - protein, 11 aa, Tick-borne encephalitis virus
HNMMGKREKKL

SEQ ID NO: 208130 - protein, 11 aa, Tick-borne encephalitis virus
NIMGKREKKLG

SEQ ID NO: 208131 - protein, 11 aa, Tick-borne encephalitis virus
IMGKREKKLGE

SEQ ID NO: 208132 - protein, 11 aa, Tick-borne encephalitis virus
REKKLGEFGVS

SEQ ID NO: 208133 - protein, 11 aa, Tick-borne encephalitis virus
EKKLGEFGVSK

SEQ ID NO: 208134 - protein, 11 aa, Tick-borne encephalitis virus
KKLGEFGVSKG

SEQ ID NO: 208135 - protein, 11 aa, Tick-borne encephalitis virus
KLGEFGVSKGS

SEQ ID NO: 208136 - protein, 11 aa, Tick-borne encephalitis virus
LGEFGVSKGSR

SEQ ID NO: 208137 - protein, 11 aa, Tick-borne encephalitis virus
GEFGVSKGSRA

SEQ ID NO: 208138 - protein, 11 aa, Tick-borne encephalitis virus
EFGVSKGSRAM

SEQ ID NO: 208139 - protein, 11 aa, Tick-borne encephalitis virus
FGVSKGSRAMW

SEQ ID NO: 208140 - protein, 11 aa, Tick-borne encephalitis virus
GVSKGSRAMWY

SEQ ID NO: 208141 - protein, 11 aa, Tick-borne encephalitis virus
VSKGSRAMWYM

SEQ ID NO: 208142 - protein, 11 aa, Tick-borne encephalitis virus
SKGSRAMWYMW

SEQ ID NO: 208143 - protein, 11 aa, Tick-borne encephalitis virus
KGSRAMWYMWL

SEQ ID NO: 208144 - protein, 11 aa, Tick-borne encephalitis virus
GSRAMWYMWLG

SEQ ID NO: 208145 - protein, 11 aa, Tick-borne encephalitis virus
SRAMWYMWLGS

SEQ ID NO: 208146 - protein, 11 aa, Tick-borne encephalitis virus
RAMWYMWLGSR

SEQ ID NO: 208147 - protein, 11 aa, Tick-borne encephalitis virus
AMWYMWLGSRF

SEQ ID NO: 208148 - protein, 11 aa, Tick-borne encephalitis virus
MWYMWLGSRFQ

SEQ ID NO: 208149 - protein, 11 aa, Tick-borne encephalitis virus
WYMWLGSRFQE

SEQ ID NO: 208150 - protein, 11 aa, Tick-borne encephalitis virus
YMWLGSRFQEF

SEQ ID NO: 208151 - protein, 11 aa, Tick-borne encephalitis virus
MWLGSRFQEFE

SEQ ID NO: 208152 - protein, 11 aa, Tick-borne encephalitis virus
WLGSRFQEFEA

SEQ ID NO: 208153 - protein, 11 aa, Tick-borne encephalitis virus
LGSRFQEFEAL

SEQ ID NO: 208154 - protein, 11 aa, Tick-borne encephalitis virus
GSRFQEFEALG

SEQ ID NO: 208155 - protein, 11 aa, Tick-borne encephalitis virus
SRFQEFEALGF

SEQ ID NO: 208156 - protein, 11 aa, Tick-borne encephalitis virus
RFQEFEALGFL

SEQ ID NO: 208157 - protein, 11 aa, Tick-borne encephalitis virus
FQEFEALGFLN

SEQ ID NO: 208158 - protein, 11 aa, Tick-borne encephalitis virus
QEFEALGFLNE

SEQ ID NO: 208159 - protein, 11 aa, Tick-borne encephalitis virus
FLNEDHWASRE

SEQ ID NO: 208160 - protein, 11 aa, Tick-borne encephalitis virus
LNEDHWASRES

SEQ ID NO: 208161 - protein, 11 aa, Tick-borne encephalitis virus
NEDHWASRESS

SEQ ID NO: 208162 - protein, 11 aa, Tick-borne encephalitis virus
EDHWASRESSG

SEQ ID NO: 208163 - protein, 11 aa, Tick-borne encephalitis virus
DHWASRESSGA

SEQ ID NO: 208164 - protein, 11 aa, Tick-borne encephalitis virus
HWASRESSGAG

SEQ ID NO: 208165 - protein, 11 aa, Tick-borne encephalitis virus
WASRESSGAGV

SEQ ID NO: 208166 - protein, 11 aa, Tick-borne encephalitis virus
ASRESSGAGVE

SEQ ID NO: 208167 - protein, 11 aa, Tick-borne encephalitis virus
SRESSGAGVEG

SEQ ID NO: 208168 - protein, 11 aa, Tick-borne encephalitis virus
RESSGAGVEGI

SEQ ID NO: 208169 - protein, 11 aa, Tick-borne encephalitis virus
ESSGAGVEGIS

SEQ ID NO: 208170 - protein, 11 aa, Tick-borne encephalitis virus
SSGAGVEGISL

SEQ ID NO: 208171 - protein, 11 aa, Tick-borne encephalitis virus
SGAGVEGISLN

SEQ ID NO: 208172 - protein, 11 aa, Tick-borne encephalitis virus
GAGVEGISLNY

SEQ ID NO: 208173 - protein, 11 aa, Tick-borne encephalitis virus
AGVEGISLNYL

SEQ ID NO: 208174 - protein, 11 aa, Tick-borne encephalitis virus
EGISLNYLGWY

SEQ ID NO: 208175 - protein, 11 aa, Tick-borne encephalitis virus
GISLNYLGWYL

SEQ ID NO: 208176 - protein, 11 aa, Tick-borne encephalitis virus
ISLNYLGWYLK

SEQ ID NO: 208177 - protein, 11 aa, Tick-borne encephalitis virus
SLNYLGWHLKK

SEQ ID NO: 208178 - protein, 11 aa, Tick-borne encephalitis virus
LNYLGWYLKGL

SEQ ID NO: 208179 - protein, 11 aa, Tick-borne encephalitis virus
NYLGWHLKKLS

SEQ ID NO: 208180 - protein, 11 aa, Tick-borne encephalitis virus
LSTLNGGLFYA

SEQ ID NO: 208181 - protein, 11 aa, Tick-borne encephalitis virus
STLNGGLFYAD

SEQ ID NO: 208182 - protein, 11 aa, Tick-borne encephalitis virus
TLNGGLFYADD

SEQ ID NO: 208183 - protein, 11 aa, Tick-borne encephalitis virus
LNGGLFYADDT

SEQ ID NO: 208184 - protein, 11 aa, Tick-borne encephalitis virus
NGGLFYADDTA

SEQ ID NO: 208185 - protein, 11 aa, Tick-borne encephalitis virus
TNADLEDEEQI

SEQ ID NO: 208186 - protein, 11 aa, Tick-borne encephalitis virus
NADLEDEEQIL

SEQ ID NO: 208187 - protein, 11 aa, Tick-borne encephalitis virus
ADLEDEEQILR

SEQ ID NO: 208188 - protein, 11 aa, Tick-borne encephalitis virus
DLEDEEQILRY

SEQ ID NO: 208189 - protein, 11 aa, Tick-borne encephalitis virus
LEDEEQILRYM

SEQ ID NO: 208190 - protein, 11 aa, Tick-borne encephalitis virus
EDEEQILRYME

SEQ ID NO: 208191 - protein, 11 aa, Tick-borne encephalitis virus
DEEQILRYMEG

SEQ ID NO: 208192 - protein, 11 aa, Tick-borne encephalitis virus
EEQILRYMEGE

SEQ ID NO: 208193 - protein, 11 aa, Tick-borne encephalitis virus
EQILRYMEGEH

SEQ ID NO: 208194 - protein, 11 aa, Tick-borne encephalitis virus
QILRYMEGEHK

SEQ ID NO: 208195 - protein, 11 aa, Tick-borne encephalitis virus
ILRYMEGEHKQ

SEQ ID NO: 208196 - protein, 11 aa, Tick-borne encephalitis virus
LRYMEGEHRQL

SEQ ID NO: 208197 - protein, 11 aa, Tick-borne encephalitis virus
RYMEGEHRQLA

SEQ ID NO: 208198 - protein, 11 aa, Tick-borne encephalitis virus
YMEGEHKQLAT

SEQ ID NO: 208199 - protein, 11 aa, Tick-borne encephalitis virus
MEGEHKQLATT

SEQ ID NO: 208200 - protein, 11 aa, Tick-borne encephalitis virus
EGEHKQLATTI

SEQ ID NO: 208201 - protein, 11 aa, Tick-borne encephalitis virus
GEHKQLATTIM

SEQ ID NO: 208202 - protein, 11 aa, Tick-borne encephalitis virus
EHKQLATTIMQ

SEQ ID NO: 208203 - protein, 11 aa, Tick-borne encephalitis virus
HKQLATTIMQK

SEQ ID NO: 208204 - protein, 11 aa, Tick-borne encephalitis virus
KQLATTIMQKA

SEQ ID NO: 208205 - protein, 11 aa, Tick-borne encephalitis virus
QLATTIMQKAY

SEQ ID NO: 208206 - protein, 11 aa, Tick-borne encephalitis virus
LATTIMQKAYH

SEQ ID NO: 208207 - protein, 11 aa, Tick-borne encephalitis virus
ATTIMQKAYHA

SEQ ID NO: 208208 - protein, 11 aa, Tick-borne encephalitis virus
TTIMQKAYHAK

SEQ ID NO: 208209 - protein, 11 aa, Tick-borne encephalitis virus
TVMQKAYHAKV

SEQ ID NO: 208210 - protein, 11 aa, Tick-borne encephalitis virus
VMQKAYHAKVV

SEQ ID NO: 208211 - protein, 11 aa, Tick-borne encephalitis virus
KVVKVARPSRE

SEQ ID NO: 208212 - protein, 11 aa, Tick-borne encephalitis virus
VVKVARPSREG

SEQ ID NO: 208213 - protein, 11 aa, Tick-borne encephalitis virus
VKVARPSREGG

SEQ ID NO: 208214 - protein, 11 aa, Tick-borne encephalitis virus
KVARPSREGGC

SEQ ID NO: 208215 - protein, 11 aa, Tick-borne encephalitis virus
VARPSRDGGCV

SEQ ID NO: 208216 - protein, 11 aa, Tick-borne encephalitis virus
ARPSRDGGCVM

SEQ ID NO: 208217 - protein, 11 aa, Tick-borne encephalitis virus
RPSRDGGCVMD

SEQ ID NO: 208218 - protein, 11 aa, Tick-borne encephalitis virus
PSRDGGCVMDV

SEQ ID NO: 208219 - protein, 11 aa, Tick-borne encephalitis virus
SRDGGCVMDVI

SEQ ID NO: 208220 - protein, 11 aa, Tick-borne encephalitis virus
RDGGCVMDVIT

SEQ ID NO: 208221 - protein, 11 aa, Tick-borne encephalitis virus
DGGCVMDVITR

SEQ ID NO: 208222 - protein, 11 aa, Tick-borne encephalitis virus
GGCVMDVITRR

SEQ ID NO: 208223 - protein, 11 aa, Tick-borne encephalitis virus
GCVMDVITRRD

SEQ ID NO: 208224 - protein, 11 aa, Tick-borne encephalitis virus
CVMDVITRRDQ

SEQ ID NO: 208225 - protein, 11 aa, Tick-borne encephalitis virus
VMDVITRRDQR

SEQ ID NO: 208226 - protein, 11 aa, Tick-borne encephalitis virus
VITRRDQRGSV

SEQ ID NO: 208227 - protein, 11 aa, Tick-borne encephalitis virus
ITRRDQRGSVQ

SEQ ID NO: 208228 - protein, 11 aa, Tick-borne encephalitis virus
TRRDQRGSVQV

SEQ ID NO: 208229 - protein, 11 aa, Tick-borne encephalitis virus
RRDQRGSVQVV

SEQ ID NO: 208230 - protein, 11 aa, Tick-borne encephalitis virus
RDQRGSVQVVT

SEQ ID NO: 208231 - protein, 11 aa, Tick-borne encephalitis virus
DQRGSVQVVTY

SEQ ID NO: 208232 - protein, 11 aa, Tick-borne encephalitis virus
QRGSVQVVTYA

SEQ ID NO: 208233 - protein, 11 aa, Tick-borne encephalitis virus
RGSVQVVTYAL

SEQ ID NO: 208234 - protein, 11 aa, Tick-borne encephalitis virus
GSVQVVTYALN

SEQ ID NO: 208235 - protein, 11 aa, Tick-borne encephalitis virus
SVQVVTYALNT

SEQ ID NO: 208236 - protein, 11 aa, Tick-borne encephalitis virus
VQVVTYALNTH

SEQ ID NO: 208237 - protein, 11 aa, Tick-borne encephalitis virus
QVVTYALNTHT

SEQ ID NO: 208238 - protein, 11 aa, Tick-borne encephalitis virus
VVTYALNTHTN

SEQ ID NO: 208239 - protein, 11 aa, Tick-borne encephalitis virus
VTYALNTHTNI

SEQ ID NO: 208240 - protein, 11 aa, Tick-borne encephalitis virus
TYALNTHTNIK

SEQ ID NO: 208241 - protein, 11 aa, Tick-borne encephalitis virus
YALNTHTNIKV

SEQ ID NO: 208242 - protein, 11 aa, Tick-borne encephalitis virus
ALNTHTNIKVQ

SEQ ID NO: 208243 - protein, 11 aa, Tick-borne encephalitis virus
LNTHTNIKVQL

SEQ ID NO: 208244 - protein, 11 aa, Tick-borne encephalitis virus
NTHTNIKVQLI

SEQ ID NO: 208245 - protein, 11 aa, Tick-borne encephalitis virus
THTNIKVQLIR

SEQ ID NO: 208246 - protein, 11 aa, Tick-borne encephalitis virus
HTNIKVQLIRM

SEQ ID NO: 208247 - protein, 11 aa, Tick-borne encephalitis virus
LIRMMEGEGVV

SEQ ID NO: 208248 - protein, 11 aa, Tick-borne encephalitis virus
IRMMEGEGVVE

SEQ ID NO: 208249 - protein, 11 aa, Tick-borne encephalitis virus
RMMEGEGVVEA

SEQ ID NO: 208250 - protein, 11 aa, Tick-borne encephalitis virus
MMEGEGVIEAA

SEQ ID NO: 208251 - protein, 11 aa, Tick-borne encephalitis virus
MEGEGVIEAAD

SEQ ID NO: 208252 - protein, 11 aa, Tick-borne encephalitis virus
EGEGVIEAADA

SEQ ID NO: 208253 - protein, 11 aa, Tick-borne encephalitis virus
GEGVIEAADAH

SEQ ID NO: 208254 - protein, 11 aa, Tick-borne encephalitis virus
EGVIEAADAHN

SEQ ID NO: 208255 - protein, 11 aa, Tick-borne encephalitis virus
GVIEAADAHNP

SEQ ID NO: 208256 - protein, 11 aa, Tick-borne encephalitis virus
VIEAADAHNPR

SEQ ID NO: 208257 - protein, 11 aa, Tick-borne encephalitis virus
IEAADAHNPRL

SEQ ID NO: 208258 - protein, 11 aa, Tick-borne encephalitis virus
EAADAHNPRLL

SEQ ID NO: 208259 - protein, 11 aa, Tick-borne encephalitis virus
AADAHNPRLLR

SEQ ID NO: 208260 - protein, 11 aa, Tick-borne encephalitis virus
ADAHNPRLLRV

SEQ ID NO: 208261 - protein, 11 aa, Tick-borne encephalitis virus
DAHNPRLFRVE

SEQ ID NO: 208262 - protein, 11 aa, Tick-borne encephalitis virus
AHNPRLFRVER

SEQ ID NO: 208263 - protein, 11 aa, Tick-borne encephalitis virus
HNPRLFRVERW

SEQ ID NO: 208264 - protein, 11 aa, Tick-borne encephalitis virus
NPRLFRVERWL

SEQ ID NO: 208265 - protein, 11 aa, Tick-borne encephalitis virus
PRLLRVERWLK

SEQ ID NO: 208266 - protein, 11 aa, Tick-borne encephalitis virus
RLLRVERWLKE

SEQ ID NO: 208267 - protein, 11 aa, Tick-borne encephalitis virus
EHGEERLGRML

SEQ ID NO: 208268 - protein, 11 aa, Tick-borne encephalitis virus
YGEERLGRMLV

SEQ ID NO: 208269 - protein, 11 aa, Tick-borne encephalitis virus
GGERLGRMLVS

SEQ ID NO: 208270 - protein, 11 aa, Tick-borne encephalitis virus
GERLGRMLVSG

SEQ ID NO: 208271 - protein, 11 aa, Tick-borne encephalitis virus
LVSGDDCVVRG

SEQ ID NO: 208272 - protein, 11 aa, Tick-borne encephalitis virus
VSGDDCVVRPL

SEQ ID NO: 208273 - protein, 11 aa, Tick-borne encephalitis virus
SGDDCVVRPLD

SEQ ID NO: 208274 - protein, 11 aa, Tick-borne encephalitis virus
GDDCVVRPLDD

SEQ ID NO: 208275 - protein, 11 aa, Tick-borne encephalitis virus
DDCVVRPLDDR

SEQ ID NO: 208276 - protein, 11 aa, Tick-borne encephalitis virus
DCVVRPLDDRF

SEQ ID NO: 208277 - protein, 11 aa, Tick-borne encephalitis virus
CVVRPLDDRFG

SEQ ID NO: 208278 - protein, 11 aa, Tick-borne encephalitis virus
DDRFSKALYFL

SEQ ID NO: 208279 - protein, 11 aa, Tick-borne encephalitis virus
DRFSKALYFLN

SEQ ID NO: 208280 - protein, 11 aa, Tick-borne encephalitis virus
RFSKALYFLND

SEQ ID NO: 208281 - protein, 11 aa, Tick-borne encephalitis virus
FSKALYFLNDM

SEQ ID NO: 208282 - protein, 11 aa, Tick-borne encephalitis virus
SKALYFLNDMA

SEQ ID NO: 208283 - protein, 11 aa, Tick-borne encephalitis virus
RALYFLNDMAK

SEQ ID NO: 208284 - protein, 11 aa, Tick-borne encephalitis virus
LNDMAKTRKDV

SEQ ID NO: 208285 - protein, 11 aa, Tick-borne encephalitis virus
NDMAKTRKDVG

SEQ ID NO: 208286 - protein, 11 aa, Tick-borne encephalitis virus
DMAKTRKDVGE

SEQ ID NO: 208287 - protein, 11 aa, Tick-borne encephalitis virus
MAKTRKDVGEW

SEQ ID NO: 208288 - protein, 11 aa, Tick-borne encephalitis virus
AKTRKDVGEWE

SEQ ID NO: 208289 - protein, 11 aa, Tick-borne encephalitis virus
KTRKDVGEWEH

SEQ ID NO: 208290 - protein, 11 aa, Tick-borne encephalitis virus
TRKDVGEWEHS

SEQ ID NO: 208291 - protein, 11 aa, Tick-borne encephalitis virus
RKDVGEWEHSV

SEQ ID NO: 208292 - protein, 11 aa, Tick-borne encephalitis virus
KDVGEWEHSVG

SEQ ID NO: 208293 - protein, 11 aa, Tick-borne encephalitis virus
DVGEWEHSVGF

SEQ ID NO: 208294 - protein, 11 aa, Tick-borne encephalitis virus
VGEWEHSVGFS

SEQ ID NO: 208295 - protein, 11 aa, Tick-borne encephalitis virus
SWEEVPFCSHH

SEQ ID NO: 208296 - protein, 11 aa, Tick-borne encephalitis virus
VEEVPFCSHHF

SEQ ID NO: 208297 - protein, 11 aa, Tick-borne encephalitis virus
EAVPFCSHHFH

SEQ ID NO: 208298 - protein, 11 aa, Tick-borne encephalitis virus
AVPFCSHHFHE

SEQ ID NO: 208299 - protein, 11 aa, Tick-borne encephalitis virus
FHELVMKDGRS

SEQ ID NO: 208300 - protein, 11 aa, Tick-borne encephalitis virus
HELVMKDGRSL

SEQ ID NO: 208301 - protein, 11 aa, Tick-borne encephalitis virus
ELVMKDGRTLV

SEQ ID NO: 208302 - protein, 11 aa, Tick-borne encephalitis virus
LVMKDGRSLIV

SEQ ID NO: 208303 - protein, 11 aa, Tick-borne encephalitis virus
VMKDGRSLIVP

SEQ ID NO: 208304 - protein, 11 aa, Tick-borne encephalitis virus
MKDGRSLIVPC

SEQ ID NO: 208305 - protein, 11 aa, Tick-borne encephalitis virus
KDGRTLVVPCR

SEQ ID NO: 208306 - protein, 11 aa, Tick-borne encephalitis virus
DGRSLIVPCRD

SEQ ID NO: 208307 - protein, 11 aa, Tick-borne encephalitis virus
GRTLVVPCRDQ

SEQ ID NO: 208308 - protein, 11 aa, Tick-borne encephalitis virus
RTLVVPCRDQD

SEQ ID NO: 208309 - protein, 11 aa, Tick-borne encephalitis virus
SLIVPCRDQDE

SEQ ID NO: 208310 - protein, 11 aa, Tick-borne encephalitis virus
LVVPCRDQDEL

SEQ ID NO: 208311 - protein, 11 aa, Tick-borne encephalitis virus
VVPCRDQDELV

SEQ ID NO: 208312 - protein, 11 aa, Tick-borne encephalitis virus
RDQDELVGRAP

SEQ ID NO: 208313 - protein, 11 aa, Tick-borne encephalitis virus
DQDELVGRARI

SEQ ID NO: 208314 - protein, 11 aa, Tick-borne encephalitis virus
QDELVGRARIS

SEQ ID NO: 208315 - protein, 11 aa, Tick-borne encephalitis virus
DELVGRARISP

SEQ ID NO: 208316 - protein, 11 aa, Tick-borne encephalitis virus
ELVGRARISPG

SEQ ID NO: 208317 - protein, 11 aa, Tick-borne encephalitis virus
LVGRARISPGC

SEQ ID NO: 208318 - protein, 11 aa, Tick-borne encephalitis virus
VGRARISPGCG

SEQ ID NO: 208319 - protein, 11 aa, Tick-borne encephalitis virus
GRARISPGCGW

SEQ ID NO: 208320 - protein, 11 aa, Tick-borne encephalitis virus
RARISPGCGWS

SEQ ID NO: 208321 - protein, 11 aa, Tick-borne encephalitis virus
ARISPGCGWSV

SEQ ID NO: 208322 - protein, 11 aa, Tick-borne encephalitis virus
RISPGCGWSVR

SEQ ID NO: 208323 - protein, 11 aa, Tick-borne encephalitis virus
ISPGCGWSVRE

SEQ ID NO: 208324 - protein, 11 aa, Tick-borne encephalitis virus
SPGCGWSIRET

SEQ ID NO: 208325 - protein, 11 aa, Tick-borne encephalitis virus
PGCGWSIRETA

SEQ ID NO: 208326 - protein, 11 aa, Tick-borne encephalitis virus
GCGWSIRETAC

SEQ ID NO: 208327 - protein, 11 aa, Tick-borne encephalitis virus
CGWSIRETACL

SEQ ID NO: 208328 - protein, 11 aa, Tick-borne encephalitis virus
GWSIRETACLS

SEQ ID NO: 208329 - protein, 11 aa, Tick-borne encephalitis virus
WSIRETACLSK

SEQ ID NO: 208330 - protein, 11 aa, Tick-borne encephalitis virus
SIRETACLSKA

SEQ ID NO: 208331 - protein, 11 aa, Tick-borne encephalitis virus
IRETACLSKAY

SEQ ID NO: 208332 - protein, 11 aa, Tick-borne encephalitis virus
FHRRDLRTLGF

SEQ ID NO: 208333 - protein, 11 aa, Tick-borne encephalitis virus
HRRDLRTLGLT

SEQ ID NO: 208334 - protein, 11 aa, Tick-borne encephalitis virus
RRDLRTLGFAI

SEQ ID NO: 208335 - protein, 11 aa, Tick-borne encephalitis virus
RDLRTLGLAIN

SEQ ID NO: 208336 - protein, 11 aa, Tick-borne encephalitis virus
DLRTLGLAINS

SEQ ID NO: 208337 - protein, 11 aa, Tick-borne encephalitis virus
LRTLGLAINSA

SEQ ID NO: 208338 - protein, 11 aa, Tick-borne encephalitis virus
RTLGLAINSAV

SEQ ID NO: 208339 - protein, 11 aa, Tick-borne encephalitis virus
TLGLAINSAVP

SEQ ID NO: 208340 - protein, 11 aa, Tick-borne encephalitis virus
SAVPIDWVPTG

SEQ ID NO: 208341 - protein, 11 aa, Tick-borne encephalitis virus
AVPADWVPTGR

SEQ ID NO: 208342 - protein, 11 aa, Tick-borne encephalitis virus
VPIDWVPTGRT

SEQ ID NO: 208343 - protein, 11 aa, Tick-borne encephalitis virus
PIDWVPTGRTT

SEQ ID NO: 208344 - protein, 11 aa, Tick-borne encephalitis virus
IDWVPTGRTTW

SEQ ID NO: 208345 - protein, 11 aa, Tick-borne encephalitis virus
RTTWSIHASGS

SEQ ID NO: 208346 - protein, 11 aa, Tick-borne encephalitis virus
TTWSIHASGSW

SEQ ID NO: 208347 - protein, 11 aa, Tick-borne encephalitis virus
TWSIHASGSWM

SEQ ID NO: 208348 - protein, 11 aa, Tick-borne encephalitis virus
WSIHASGSWMT

SEQ ID NO: 208349 - protein, 11 aa, Tick-borne encephalitis virus
SIHASGAWITT

SEQ ID NO: 208350 - protein, 11 aa, Tick-borne encephalitis virus
IHASGSWMTTE

SEQ ID NO: 208351 - protein, 11 aa, Tick-borne encephalitis virus
HASGSWMTTED

SEQ ID NO: 208352 - protein, 11 aa, Tick-borne encephalitis virus
ASGSWMTTEDM

SEQ ID NO: 208353 - protein, 11 aa, Tick-borne encephalitis virus
SGSWMTTEDML

SEQ ID NO: 208354 - protein, 11 aa, Tick-borne encephalitis virus
GAWMTTENMLD

SEQ ID NO: 208355 - protein, 11 aa, Tick-borne encephalitis virus
AWMTTENMLDV

SEQ ID NO: 208356 - protein, 11 aa, Tick-borne encephalitis virus
WMTTENMLDVW

SEQ ID NO: 208357 - protein, 11 aa, Tick-borne encephalitis virus
MTTENMLDVWN

SEQ ID NO: 208358 - protein, 11 aa, Tick-borne encephalitis virus
TTENMLDVWNR

SEQ ID NO: 208359 - protein, 11 aa, Tick-borne encephalitis virus
TENMLDVWNRV

SEQ ID NO: 208360 - protein, 11 aa, Tick-borne encephalitis virus
ENMLDVWNRVW

SEQ ID NO: 208361 - protein, 11 aa, Tick-borne encephalitis virus
NMLDVWNRVWI

SEQ ID NO: 208362 - protein, 11 aa, Tick-borne encephalitis virus
RVWILDNPFMQ

SEQ ID NO: 208363 - protein, 11 aa, Tick-borne encephalitis virus
VWILDNPFMQN

SEQ ID NO: 208364 - protein, 11 aa, Tick-borne encephalitis virus
WILDNPFMQNK

SEQ ID NO: 208365 - protein, 11 aa, Tick-borne encephalitis virus
ILDNPFMQNKE

SEQ ID NO: 208366 - protein, 11 aa, Tick-borne encephalitis virus
LDNPFMQNKEK

SEQ ID NO: 208367 - protein, 11 aa, Tick-borne encephalitis virus
EWRDVPYLPKA

SEQ ID NO: 208368 - protein, 11 aa, Tick-borne encephalitis virus
VPYLPKAQDML

SEQ ID NO: 208369 - protein, 11 aa, Tick-borne encephalitis virus
PYLPKAQDMLC

SEQ ID NO: 208370 - protein, 11 aa, Tick-borne encephalitis virus
YLPKAQDMLCS

SEQ ID NO: 208371 - protein, 11 aa, Tick-borne encephalitis virus
LPKAQDMLCSS

SEQ ID NO: 208372 - protein, 11 aa, Tick-borne encephalitis virus
PKAQDMLCSSL

SEQ ID NO: 208373 - protein, 11 aa, Tick-borne encephalitis virus
KAQDMLCSSLV

SEQ ID NO: 208374 - protein, 11 aa, Tick-borne encephalitis virus
AQDMLCSSLVG

SEQ ID NO: 208375 - protein, 11 aa, Tick-borne encephalitis virus
QDMLCSSLVGR

SEQ ID NO: 208376 - protein, 11 aa, Tick-borne encephalitis virus
DMLCSSLVGRR

SEQ ID NO: 208377 - protein, 11 aa, Tick-borne encephalitis virus
MLCSSLVGRRE

SEQ ID NO: 208378 - protein, 11 aa, Tick-borne encephalitis virus
LCSSLVGRRER

SEQ ID NO: 208379 - protein, 11 aa, Tick-borne encephalitis virus
CSSLVGRRERA

SEQ ID NO: 208380 - protein, 11 aa, Tick-borne encephalitis virus
SSLVGRRERAE

SEQ ID NO: 208381 - protein, 11 aa, Tick-borne encephalitis virus
SLVGRRERAEW

SEQ ID NO: 208382 - protein, 11 aa, Tick-borne encephalitis virus
LVGRRERAEWA

SEQ ID NO: 208383 - protein, 11 aa, Tick-borne encephalitis virus
VGRRERAEWAK

SEQ ID NO: 208384 - protein, 11 aa, Tick-borne encephalitis virus
GRRERAEWAKN

SEQ ID NO: 208385 - protein, 11 aa, Tick-borne encephalitis virus
RRERAEWAKNI

SEQ ID NO: 208386 - protein, 11 aa, Tick-borne encephalitis virus
RERAEWAKNIW

SEQ ID NO: 208387 - protein, 11 aa, Tick-borne encephalitis virus
ERAEWARNIWG

SEQ ID NO: 208388 - protein, 11 aa, Tick-borne encephalitis virus
RAEWARNIWGA

SEQ ID NO: 208389 - protein, 11 aa, Tick-borne encephalitis virus
AEWARNIWGAV

SEQ ID NO: 208390 - protein, 11 aa, Tick-borne encephalitis virus
EWARNIWGAVE

SEQ ID NO: 208391 - protein, 11 aa, Tick-borne encephalitis virus
WARNIWGAVEK

SEQ ID NO: 208392 - protein, 11 aa, Tick-borne encephalitis virus
ARNIWGAVEKV

SEQ ID NO: 208393 - protein, 11 aa, Tick-borne encephalitis virus
RNIWGAVEKVR

SEQ ID NO: 208394 - protein, 11 aa, Tick-borne encephalitis virus
NIWGAVEKVRR

SEQ ID NO: 208395 - protein, 11 aa, Tick-borne encephalitis virus
IWGAVEKVRRM

SEQ ID NO: 208396 - protein, 11 aa, Tick-borne encephalitis virus
WGAVEKVRRMI

SEQ ID NO: 208397 - protein, 11 aa, Tick-borne encephalitis virus
GAVEKVRRMIG

SEQ ID NO: 208398 - protein, 11 aa, Tick-borne encephalitis virus
KFRDYLSCMDR

SEQ ID NO: 208399 - protein, 11 aa, Tick-borne encephalitis virus
FRDYLSCMDRH

SEQ ID NO: 208400 - protein, 11 aa, Tick-borne encephalitis virus
RDYLSCMDRHD

SEQ ID NO: 208401 - protein, 11 aa, Tick-borne encephalitis virus
DYLSCMDRHYL

SEQ ID NO: 208402 - protein, 11 aa, Tick-borne encephalitis virus
YPSCMDRHDLH

SEQ ID NO: 208403 - protein, 11 aa, Tick-borne encephalitis virus
PSCMDRHDLHW

SEQ ID NO: 208404 - protein, 11 aa, Tick-borne encephalitis virus
SCMDRHYLHWN

SEQ ID NO: 208405 - protein, 11 aa, Tick-borne encephalitis virus
CMDRHYLHWNL

SEQ ID NO: 208406 - protein, 11 aa, Tick-borne encephalitis virus
MDRHDLHWELR

SEQ ID NO: 208407 - protein, 11 aa, Tick-borne encephalitis virus
DRHDLHWELRL

SEQ ID NO: 208408 - protein, 11 aa, Tick-borne encephalitis virus
RHDLHWELRLE

SEQ ID NO: 208409 - protein, 11 aa, Tick-borne encephalitis virus
HDLHWELRLES

SEQ ID NO: 208410 - protein, 11 aa, Tick-borne encephalitis virus
DLHWELRLESS

SEQ ID NO: 208411 - protein, 11 aa, Tick-borne encephalitis virus
LHWELRLESSI

SEQ ID NO: 208412 - protein, 11 aa, Tick-borne encephalitis virus
HWELRLESSII

SEQ ID NO: 208413 - protein, 11 aa, Tick-borne encephalitis virus
MARKAILKGKG

SEQ ID NO: 208414 - protein, 11 aa, Tick-borne encephalitis virus
ARKAILKGKGG

SEQ ID NO: 208415 - protein, 11 aa, Tick-borne encephalitis virus
RKAILKGKGGG

SEQ ID NO: 208416 - protein, 11 aa, Tick-borne encephalitis virus
GGPPRRASKET

SEQ ID NO: 208417 - protein, 11 aa, Tick-borne encephalitis virus
GPPRRVSKEAA

SEQ ID NO: 208418 - protein, 11 aa, Tick-borne encephalitis virus
PPRRVSKETAR

SEQ ID NO: 208419 - protein, 11 aa, Tick-borne encephalitis virus
PRRVSKETARK

SEQ ID NO: 208420 - protein, 11 aa, Tick-borne encephalitis virus
RRVSKETARKT

SEQ ID NO: 208421 - protein, 11 aa, Tick-borne encephalitis virus
RVSKETARKTR

SEQ ID NO: 208422 - protein, 11 aa, Tick-borne encephalitis virus
VSKETARKTRQ

SEQ ID NO: 208423 - protein, 11 aa, Tick-borne encephalitis virus
SKETARKTRQS

SEQ ID NO: 208424 - protein, 11 aa, Tick-borne encephalitis virus
KETARKTRQSR

SEQ ID NO: 208425 - protein, 11 aa, Tick-borne encephalitis virus
ETARKTRQSRV

SEQ ID NO: 208426 - protein, 11 aa, Tick-borne encephalitis virus
TATKTRQPRVQ

SEQ ID NO: 208427 - protein, 11 aa, Tick-borne encephalitis virus
ATKTRQPRVQM

SEQ ID NO: 208428 - protein, 11 aa, Tick-borne encephalitis virus
TKTRQPRVQMP

SEQ ID NO: 208429 - protein, 11 aa, Tick-borne encephalitis virus
KTRQPRVQMPN

SEQ ID NO: 208430 - protein, 11 aa, Tick-borne encephalitis virus
TRQPRVQMPNG

SEQ ID NO: 208431 - protein, 11 aa, Tick-borne encephalitis virus
RQPRVQMPNGL

SEQ ID NO: 208432 - protein, 11 aa, Tick-borne encephalitis virus
QPRVQMPNGLV

SEQ ID NO: 208433 - protein, 11 aa, Tick-borne encephalitis virus
PRVQMPNGLVL

SEQ ID NO: 208434 - protein, 11 aa, Tick-borne encephalitis virus
RVQMPSGLVLM

SEQ ID NO: 208435 - protein, 11 aa, Tick-borne encephalitis virus
VQMPSGLVLMR

SEQ ID NO: 208436 - protein, 11 aa, Tick-borne encephalitis virus
QMPSGLVLMRM

SEQ ID NO: 208437 - protein, 11 aa, Tick-borne encephalitis virus
MPSGLVLMRMM

SEQ ID NO: 208438 - protein, 11 aa, Tick-borne encephalitis virus
PSGLVLMRMMG

SEQ ID NO: 208439 - protein, 11 aa, Tick-borne encephalitis virus
NGLVLMRMMGF

SEQ ID NO: 208440 - protein, 11 aa, Tick-borne encephalitis virus
GLVLMRMMGFL

SEQ ID NO: 208441 - protein, 11 aa, Tick-borne encephalitis virus
LVLMRMMGFLW

SEQ ID NO: 208442 - protein, 11 aa, Tick-borne encephalitis virus
VLMRMMGFLWH

SEQ ID NO: 208443 - protein, 11 aa, Tick-borne encephalitis virus
LMRMMGFLWHA

SEQ ID NO: 208444 - protein, 11 aa, Tick-borne encephalitis virus
MRMLGILWHAV

SEQ ID NO: 208445 - protein, 11 aa, Tick-borne encephalitis virus
RMLGILWHAVA

SEQ ID NO: 208446 - protein, 11 aa, Tick-borne encephalitis virus
MLGILWHAVAG

SEQ ID NO: 208447 - protein, 11 aa, Tick-borne encephalitis virus
LGILWHAVAGT

SEQ ID NO: 208448 - protein, 11 aa, Tick-borne encephalitis virus
GFLWHAIAGTA

SEQ ID NO: 208449 - protein, 11 aa, Tick-borne encephalitis virus
ILWHAVAGTVR

SEQ ID NO: 208450 - protein, 11 aa, Tick-borne encephalitis virus
LWHAIAGTARS

SEQ ID NO: 208451 - protein, 11 aa, Tick-borne encephalitis virus
WHAIAGTARSP

SEQ ID NO: 208452 - protein, 11 aa, Tick-borne encephalitis virus
HAIAGTARSPV

SEQ ID NO: 208453 - protein, 11 aa, Tick-borne encephalitis virus
AIAGTARSPVL

SEQ ID NO: 208454 - protein, 11 aa, Tick-borne encephalitis virus
IAGTARSPVLK

SEQ ID NO: 208455 - protein, 11 aa, Tick-borne encephalitis virus
AGTVRSPVLKS

SEQ ID NO: 208456 - protein, 11 aa, Tick-borne encephalitis virus
GTVRSPVLKSF

SEQ ID NO: 208457 - protein, 11 aa, Tick-borne encephalitis virus
TVRSPVLKSFW

SEQ ID NO: 208458 - protein, 11 aa, Tick-borne encephalitis virus
ARSPVLKSFWK

SEQ ID NO: 208459 - protein, 11 aa, Tick-borne encephalitis virus
RSPVLKSFWKS

SEQ ID NO: 208460 - protein, 11 aa, Tick-borne encephalitis virus
SPVLKSFWKSV

SEQ ID NO: 208461 - protein, 11 aa, Tick-borne encephalitis virus
PVLKSFWKSVP

SEQ ID NO: 208462 - protein, 11 aa, Tick-borne encephalitis virus
VLKSFWKSVPL

SEQ ID NO: 208463 - protein, 11 aa, Tick-borne encephalitis virus
LKAFWNSVPLK

SEQ ID NO: 208464 - protein, 11 aa, Tick-borne encephalitis virus
KAFWNSVPLKQ

SEQ ID NO: 208465 - protein, 11 aa, Tick-borne encephalitis virus
SFWNSVPLRQA

SEQ ID NO: 208466 - protein, 11 aa, Tick-borne encephalitis virus
FWKSVPLKQAT

SEQ ID NO: 208467 - protein, 11 aa, Tick-borne encephalitis virus
SVPLKQAMAAL

SEQ ID NO: 208468 - protein, 11 aa, Tick-borne encephalitis virus
VPLKQAMAALR

SEQ ID NO: 208469 - protein, 11 aa, Tick-borne encephalitis virus
PLKQAMAALRK

SEQ ID NO: 208470 - protein, 11 aa, Tick-borne encephalitis virus
LKQAMAALRKI

SEQ ID NO: 208471 - protein, 11 aa, Tick-borne encephalitis virus
KQAMAALRKIK

SEQ ID NO: 208472 - protein, 11 aa, Tick-borne encephalitis virus
QAMAALRKIKK

SEQ ID NO: 208473 - protein, 11 aa, Tick-borne encephalitis virus
AMAALRKIKKA

SEQ ID NO: 208474 - protein, 11 aa, Tick-borne encephalitis virus
MAALRKIKKAV

SEQ ID NO: 208475 - protein, 11 aa, Tick-borne encephalitis virus
TALRKIKMAVS

SEQ ID NO: 208476 - protein, 11 aa, Tick-borne encephalitis virus
ALRKIKKAVSA

SEQ ID NO: 208477 - protein, 11 aa, Tick-borne encephalitis virus
LRKIKRAVSTL

SEQ ID NO: 208478 - protein, 11 aa, Tick-borne encephalitis virus
RKIKRAVSTLM

SEQ ID NO: 208479 - protein, 11 aa, Tick-borne encephalitis virus
LMIGLQRRGKK

SEQ ID NO: 208480 - protein, 11 aa, Tick-borne encephalitis virus
MIGLQRRGKKR

SEQ ID NO: 208481 - protein, 11 aa, Tick-borne encephalitis virus
IGLQRRGKKRS

SEQ ID NO: 208482 - protein, 11 aa, Tick-borne encephalitis virus
GLQRRGKKRST

SEQ ID NO: 208483 - protein, 11 aa, Tick-borne encephalitis virus
AFAATVRREGD

SEQ ID NO: 208484 - protein, 11 aa, Tick-borne encephalitis virus
AATVRKEGDGT

SEQ ID NO: 208485 - protein, 11 aa, Tick-borne encephalitis virus
ATVRKEGDGTT

SEQ ID NO: 208486 - protein, 11 aa, Tick-borne encephalitis virus
TVRKEGDGTTV

SEQ ID NO: 208487 - protein, 11 aa, Tick-borne encephalitis virus
VRKEGDGTTVI

SEQ ID NO: 208488 - protein, 11 aa, Tick-borne encephalitis virus
RKEGDGTTVIR

SEQ ID NO: 208489 - protein, 11 aa, Tick-borne encephalitis virus
KEGDGTTVIRA

SEQ ID NO: 208490 - protein, 11 aa, Tick-borne encephalitis virus
EGDGTTVIRAE

SEQ ID NO: 208491 - protein, 11 aa, Tick-borne encephalitis virus
GDGTTVIRAEG

SEQ ID NO: 208492 - protein, 11 aa, Tick-borne encephalitis virus
DDTTVIRAEGK

SEQ ID NO: 208493 - protein, 11 aa, Tick-borne encephalitis virus
DTTVIRAEGKD

SEQ ID NO: 208494 - protein, 11 aa, Tick-borne encephalitis virus
TTVIRAEGRDA

SEQ ID NO: 208495 - protein, 11 aa, Tick-borne encephalitis virus
RVENGTCVIMA

SEQ ID NO: 208496 - protein, 11 aa, Tick-borne encephalitis virus
VENGTCVIMAT

SEQ ID NO: 208497 - protein, 11 aa, Tick-borne encephalitis virus
ENGTCVIMATD

SEQ ID NO: 208498 - protein, 11 aa, Tick-borne encephalitis virus
NGTCVIMATDM

SEQ ID NO: 208499 - protein, 11 aa, Tick-borne encephalitis virus
GTCVIMATDMG

SEQ ID NO: 208500 - protein, 11 aa, Tick-borne encephalitis virus
TCVIMATDMGS

SEQ ID NO: 208501 - protein, 11 aa, Tick-borne encephalitis virus
CVIMATDMGSW

SEQ ID NO: 208502 - protein, 11 aa, Tick-borne encephalitis virus
VILATDMGAWC

SEQ ID NO: 208503 - protein, 11 aa, Tick-borne encephalitis virus
ILATDMGAWCD

SEQ ID NO: 208504 - protein, 11 aa, Tick-borne encephalitis virus
LATDMGAWCDD

SEQ ID NO: 208505 - protein, 11 aa, Tick-borne encephalitis virus
ATDMGAWCDDS

SEQ ID NO: 208506 - protein, 11 aa, Tick-borne encephalitis virus
DMGAWCDDSLS

SEQ ID NO: 208507 - protein, 11 aa, Tick-borne encephalitis virus
MGAWCDDSLSY

SEQ ID NO: 208508 - protein, 11 aa, Tick-borne encephalitis virus
GAWCDDSLSYE

SEQ ID NO: 208509 - protein, 11 aa, Tick-borne encephalitis virus
AWCDDSLSYEC

SEQ ID NO: 208510 - protein, 11 aa, Tick-borne encephalitis virus
DCFCRNVDRVY

SEQ ID NO: 208511 - protein, 11 aa, Tick-borne encephalitis virus
CFCRNVDRVYL

SEQ ID NO: 208512 - protein, 11 aa, Tick-borne encephalitis virus
FCRNVDRVYLE

SEQ ID NO: 208513 - protein, 11 aa, Tick-borne encephalitis virus
CRNVDRVYLEY

SEQ ID NO: 208514 - protein, 11 aa, Tick-borne encephalitis virus
RNVDRVYLEYG

SEQ ID NO: 208515 - protein, 11 aa, Tick-borne encephalitis virus
NVDRVYLEYGR

SEQ ID NO: 208516 - protein, 11 aa, Tick-borne encephalitis virus
VDRVYLEYGRC

SEQ ID NO: 208517 - protein, 11 aa, Tick-borne encephalitis virus
DRVYLEYGRCG

SEQ ID NO: 208518 - protein, 11 aa, Tick-borne encephalitis virus
RVYLEYGRCGK

SEQ ID NO: 208519 - protein, 11 aa, Tick-borne encephalitis virus
SVLIRSHAQGD

SEQ ID NO: 208520 - protein, 11 aa, Tick-borne encephalitis virus
VLIRSHAQGDL

SEQ ID NO: 208521 - protein, 11 aa, Tick-borne encephalitis virus
LIRSHAQGDLT

SEQ ID NO: 208522 - protein, 11 aa, Tick-borne encephalitis virus
IRSHAQGDLTG

SEQ ID NO: 208523 - protein, 11 aa, Tick-borne encephalitis virus
RSHAQGDLTGR

SEQ ID NO: 208524 - protein, 11 aa, Tick-borne encephalitis virus
HAQGELTGRGR

SEQ ID NO: 208525 - protein, 11 aa, Tick-borne encephalitis virus
AQGELTGRGRK

SEQ ID NO: 208526 - protein, 11 aa, Tick-borne encephalitis virus
QGELTGRGRKW

SEQ ID NO: 208527 - protein, 11 aa, Tick-borne encephalitis virus
GELTGRGRKWL

SEQ ID NO: 208528 - protein, 11 aa, Tick-borne encephalitis virus
ELTGRGRKWLE

SEQ ID NO: 208529 - protein, 11 aa, Tick-borne encephalitis virus
VWLTLESVVAR

SEQ ID NO: 208530 - protein, 11 aa, Tick-borne encephalitis virus
VVVLFCLAPVY

SEQ ID NO: 208531 - protein, 11 aa, Tick-borne encephalitis virus
VVLFCLAPVYA

SEQ ID NO: 208532 - protein, 11 aa, Tick-borne encephalitis virus
ALLCLAPVYAS

SEQ ID NO: 208533 - protein, 11 aa, Tick-borne encephalitis virus
DVWLDAIYQES

SEQ ID NO: 208534 - protein, 11 aa, Tick-borne encephalitis virus
VWLDAIYQESP

SEQ ID NO: 208535 - protein, 11 aa, Tick-borne encephalitis virus
WLDAIYQESPA

SEQ ID NO: 208536 - protein, 11 aa, Tick-borne encephalitis virus
LDAIYQESPAK

SEQ ID NO: 208537 - protein, 11 aa, Tick-borne encephalitis virus
DAIYQESPAKT

SEQ ID NO: 208538 - protein, 11 aa, Tick-borne encephalitis virus
AIYQESPAKTR

SEQ ID NO: 208539 - protein, 11 aa, Tick-borne encephalitis virus
IYQEKPAKTRE

SEQ ID NO: 208540 - protein, 11 aa, Tick-borne encephalitis virus
YQENPAQTREY

SEQ ID NO: 208541 - protein, 11 aa, Tick-borne encephalitis virus
QENPAQTREYC

SEQ ID NO: 208542 - protein, 11 aa, Tick-borne encephalitis virus
ENPAQTREYCL

SEQ ID NO: 208543 - protein, 11 aa, Tick-borne encephalitis virus
KPAKTREYCLH

SEQ ID NO: 208544 - protein, 11 aa, Tick-borne encephalitis virus
PAQTREYCLHA

SEQ ID NO: 208545 - protein, 11 aa, Tick-borne encephalitis virus
AQTREYCLHAK

SEQ ID NO: 208546 - protein, 11 aa, Tick-borne encephalitis virus
QTREYCLHAKL

SEQ ID NO: 208547 - protein, 11 aa, Tick-borne encephalitis virus
RCPTMGPATLT

SEQ ID NO: 208548 - protein, 11 aa, Tick-borne encephalitis virus
CPTMGPATLTE

SEQ ID NO: 208549 - protein, 11 aa, Tick-borne encephalitis virus
PTTGPATLAEQ

SEQ ID NO: 208550 - protein, 11 aa, Tick-borne encephalitis virus
TTGPATLAEQH

SEQ ID NO: 208551 - protein, 11 aa, Tick-borne encephalitis virus
TGPATLAEQHQ

SEQ ID NO: 208552 - protein, 11 aa, Tick-borne encephalitis virus
GPATLTEEHQG

SEQ ID NO: 208553 - protein, 11 aa, Tick-borne encephalitis virus
PATLAEQHQSG

SEQ ID NO: 208554 - protein, 11 aa, Tick-borne encephalitis virus
ATLAEQHQSGT

SEQ ID NO: 208555 - protein, 11 aa, Tick-borne encephalitis virus
TLTEEHQGGTV

SEQ ID NO: 208556 - protein, 11 aa, Tick-borne encephalitis virus
LAEQHQSGTVC

SEQ ID NO: 208557 - protein, 11 aa, Tick-borne encephalitis virus
AEQHQSGTVCK

SEQ ID NO: 208558 - protein, 11 aa, Tick-borne encephalitis virus
EQHQSGTVCKR

SEQ ID NO: 208559 - protein, 11 aa, Tick-borne encephalitis virus
QHQSGTVCKRD

SEQ ID NO: 208560 - protein, 11 aa, Tick-borne encephalitis virus
GKGSIVTCVKV

SEQ ID NO: 208561 - protein, 11 aa, Tick-borne encephalitis virus
KGSIVTCVKVA

SEQ ID NO: 208562 - protein, 11 aa, Tick-borne encephalitis virus
GSIVTCVKVAC

SEQ ID NO: 208563 - protein, 11 aa, Tick-borne encephalitis virus
SIVTCVKVACE

SEQ ID NO: 208564 - protein, 11 aa, Tick-borne encephalitis virus
IVTCVKVACEA

SEQ ID NO: 208565 - protein, 11 aa, Tick-borne encephalitis virus
VTCVKVACEAK

SEQ ID NO: 208566 - protein, 11 aa, Tick-borne encephalitis virus
TCVKVACEAKK

SEQ ID NO: 208567 - protein, 11 aa, Tick-borne encephalitis virus
CVKVACEAKKK

SEQ ID NO: 208568 - protein, 11 aa, Tick-borne encephalitis virus
VKVACEAKKKA

SEQ ID NO: 208569 - protein, 11 aa, Tick-borne encephalitis virus
KVACEAKKKAT

SEQ ID NO: 208570 - protein, 11 aa, Tick-borne encephalitis virus
VACEAKKKATG

SEQ ID NO: 208571 - protein, 11 aa, Tick-borne encephalitis virus
KATGHVYDANR

SEQ ID NO: 208572 - protein, 11 aa, Tick-borne encephalitis virus
ATGHVYDANRI

SEQ ID NO: 208573 - protein, 11 aa, Tick-borne encephalitis virus
TGHVYDPNKIV

SEQ ID NO: 208574 - protein, 11 aa, Tick-borne encephalitis virus
GHVYDPNKIVY

SEQ ID NO: 208575 - protein, 11 aa, Tick-borne encephalitis virus
HVYDANRIVYT

SEQ ID NO: 208576 - protein, 11 aa, Tick-borne encephalitis virus
VYDANKIVYTI

SEQ ID NO: 208577 - protein, 11 aa, Tick-borne encephalitis virus
YDANRIVYTVK

SEQ ID NO: 208578 - protein, 11 aa, Tick-borne encephalitis virus
DANKIVYTIKV

SEQ ID NO: 208579 - protein, 11 aa, Tick-borne encephalitis virus
ANRIVYTVKVE

SEQ ID NO: 208580 - protein, 11 aa, Tick-borne encephalitis virus
NKIVYPVKVEP

SEQ ID NO: 208581 - protein, 11 aa, Tick-borne encephalitis virus
KIVYPVKVEPH

SEQ ID NO: 208582 - protein, 11 aa, Tick-borne encephalitis virus
IVYPVKVEPHT

SEQ ID NO: 208583 - protein, 11 aa, Tick-borne encephalitis virus
VYPVKVEPHTG

SEQ ID NO: 208584 - protein, 11 aa, Tick-borne encephalitis virus
YTIKVEPHTGD

SEQ ID NO: 208585 - protein, 11 aa, Tick-borne encephalitis virus
TIKVEPHTGDY

SEQ ID NO: 208586 - protein, 11 aa, Tick-borne encephalitis virus
VEPHTGDYVAV

SEQ ID NO: 208587 - protein, 11 aa, Tick-borne encephalitis virus
EPHTGDYVAPH

SEQ ID NO: 208588 - protein, 11 aa, Tick-borne encephalitis virus
PHTGDYVAPHE

SEQ ID NO: 208589 - protein, 11 aa, Tick-borne encephalitis virus
HTGDYVAVNET

SEQ ID NO: 208590 - protein, 11 aa, Tick-borne encephalitis virus
TGDYVAVNETH

SEQ ID NO: 208591 - protein, 11 aa, Tick-borne encephalitis virus
GDYVAVNETHS

SEQ ID NO: 208592 - protein, 11 aa, Tick-borne encephalitis virus
DYVAPHETHSG

SEQ ID NO: 208593 - protein, 11 aa, Tick-borne encephalitis virus
YVAPHETHSGR

SEQ ID NO: 208594 - protein, 11 aa, Tick-borne encephalitis virus
VAVNETHSGRK

SEQ ID NO: 208595 - protein, 11 aa, Tick-borne encephalitis virus
AVNETHSGRKT

SEQ ID NO: 208596 - protein, 11 aa, Tick-borne encephalitis virus
VNETHSGRKTA

SEQ ID NO: 208597 - protein, 11 aa, Tick-borne encephalitis virus
NETHSGRKTPS

SEQ ID NO: 208598 - protein, 11 aa, Tick-borne encephalitis virus
HSGRKTPSFTV

SEQ ID NO: 208599 - protein, 11 aa, Tick-borne encephalitis virus
SGRKTPSFTVS

SEQ ID NO: 208600 - protein, 11 aa, Tick-borne encephalitis virus
GRKTPSFTVSS

SEQ ID NO: 208601 - protein, 11 aa, Tick-borne encephalitis virus
RKTPSFTVSSE

SEQ ID NO: 208602 - protein, 11 aa, Tick-borne encephalitis virus
KTPSFTVSSEK

SEQ ID NO: 208603 - protein, 11 aa, Tick-borne encephalitis virus
TPSFTVSSEKT

SEQ ID NO: 208604 - protein, 11 aa, Tick-borne encephalitis virus
PSFTVSSEKTI

SEQ ID NO: 208605 - protein, 11 aa, Tick-borne encephalitis virus
FTVSSEKTILN

SEQ ID NO: 208606 - protein, 11 aa, Tick-borne encephalitis virus
TVSSEKTILNM

SEQ ID NO: 208607 - protein, 11 aa, Tick-borne encephalitis virus
VSSEKTILNMG

SEQ ID NO: 208608 - protein, 11 aa, Tick-borne encephalitis virus
SSEKTILNMGD

SEQ ID NO: 208609 - protein, 11 aa, Tick-borne encephalitis virus
SEKTILNMGDY

SEQ ID NO: 208610 - protein, 11 aa, Tick-borne encephalitis virus
EKTILNMGDYG

SEQ ID NO: 208611 - protein, 11 aa, Tick-borne encephalitis virus
KTILNMGDYGD

SEQ ID NO: 208612 - protein, 11 aa, Tick-borne encephalitis virus
TILNMGDYGDV

SEQ ID NO: 208613 - protein, 11 aa, Tick-borne encephalitis virus
ILNMGDYGDVS

SEQ ID NO: 208614 - protein, 11 aa, Tick-borne encephalitis virus
LNMGDYGDVSL

SEQ ID NO: 208615 - protein, 11 aa, Tick-borne encephalitis virus
NMGDYGDVSLL

SEQ ID NO: 208616 - protein, 11 aa, Tick-borne encephalitis virus
GDYGDVSLLCK

SEQ ID NO: 208617 - protein, 11 aa, Tick-borne encephalitis virus
DYGDVSLLCKV

SEQ ID NO: 208618 - protein, 11 aa, Tick-borne encephalitis virus
QTVILELDKTL

SEQ ID NO: 208619 - protein, 11 aa, Tick-borne encephalitis virus
TVILELDKTLE

SEQ ID NO: 208620 - protein, 11 aa, Tick-borne encephalitis virus
VILELDKTLEH

SEQ ID NO: 208621 - protein, 11 aa, Tick-borne encephalitis virus
ILELDKTLEHL

SEQ ID NO: 208622 - protein, 11 aa, Tick-borne encephalitis virus
LELDKTLEHLP

SEQ ID NO: 208623 - protein, 11 aa, Tick-borne encephalitis virus
ELDKTLEHLPT

SEQ ID NO: 208624 - protein, 11 aa, Tick-borne encephalitis virus
LDKTLEHLPTA

SEQ ID NO: 208625 - protein, 11 aa, Tick-borne encephalitis virus
DKTLEHLPTAW

SEQ ID NO: 208626 - protein, 11 aa, Tick-borne encephalitis virus
KTLEHLPTAWQ

SEQ ID NO: 208627 - protein, 11 aa, Tick-borne encephalitis virus
TLEHLPTAWQV

SEQ ID NO: 208628 - protein, 11 aa, Tick-borne encephalitis virus
LEHLPTAWQVH

SEQ ID NO: 208629 - protein, 11 aa, Tick-borne encephalitis virus
DLALPWRHEGV

SEQ ID NO: 208630 - protein, 11 aa, Tick-borne encephalitis virus
LALPWRHEGVQ

SEQ ID NO: 208631 - protein, 11 aa, Tick-borne encephalitis virus
HEGAQHWNNAE

SEQ ID NO: 208632 - protein, 11 aa, Tick-borne encephalitis virus
EGAQHWNNAER

SEQ ID NO: 208633 - protein, 11 aa, Tick-borne encephalitis virus
GAQHWNNAERL

SEQ ID NO: 208634 - protein, 11 aa, Tick-borne encephalitis virus
AQHWNNAERLV

SEQ ID NO: 208635 - protein, 11 aa, Tick-borne encephalitis virus
QHWNNAERLVE

SEQ ID NO: 208636 - protein, 11 aa, Tick-borne encephalitis virus
HWNNAERLVEF

SEQ ID NO: 208637 - protein, 11 aa, Tick-borne encephalitis virus
AGVPVAHIDGA

SEQ ID NO: 208638 - protein, 11 aa, Tick-borne encephalitis virus
GVPVAHIDGAK

SEQ ID NO: 208639 - protein, 11 aa, Tick-borne encephalitis virus
VPVAHIDGAKY

SEQ ID NO: 208640 - protein, 11 aa, Tick-borne encephalitis virus
PVAHIDGAKYH

SEQ ID NO: 208641 - protein, 11 aa, Tick-borne encephalitis virus
VAHIDGAKYHL

SEQ ID NO: 208642 - protein, 11 aa, Tick-borne encephalitis virus
AHIDGAKYHLK

SEQ ID NO: 208643 - protein, 11 aa, Tick-borne encephalitis virus
HIDGAKYHLKS

SEQ ID NO: 208644 - protein, 11 aa, Tick-borne encephalitis virus
IDGAKYHLKSG

SEQ ID NO: 208645 - protein, 11 aa, Tick-borne encephalitis virus
DGAKYHLKSGH

SEQ ID NO: 208646 - protein, 11 aa, Tick-borne encephalitis virus
KLKMNGLTYTM

SEQ ID NO: 208647 - protein, 11 aa, Tick-borne encephalitis virus
LKMNGLTYTMC

SEQ ID NO: 208648 - protein, 11 aa, Tick-borne encephalitis virus
KMNGLTYTMCD

SEQ ID NO: 208649 - protein, 11 aa, Tick-borne encephalitis virus
MNGLTYTMCDK

SEQ ID NO: 208650 - protein, 11 aa, Tick-borne encephalitis virus
NGLTYTMCDKT

SEQ ID NO: 208651 - protein, 11 aa, Tick-borne encephalitis virus
TYTVCDKTKFT

SEQ ID NO: 208652 - protein, 11 aa, Tick-borne encephalitis virus
YTVCDKTKFTW

SEQ ID NO: 208653 - protein, 11 aa, Tick-borne encephalitis virus
TVCDKTKFTWK

SEQ ID NO: 208654 - protein, 11 aa, Tick-borne encephalitis virus
VCDKTKFTWKR

SEQ ID NO: 208655 - protein, 11 aa, Tick-borne encephalitis virus
CDKTKFAWKRT

SEQ ID NO: 208656 - protein, 11 aa, Tick-borne encephalitis virus
DKTKFAWKRTP

SEQ ID NO: 208657 - protein, 11 aa, Tick-borne encephalitis virus
KTKFAWKRTPT

SEQ ID NO: 208658 - protein, 11 aa, Tick-borne encephalitis virus
TKFAWKRTPTD

SEQ ID NO: 208659 - protein, 11 aa, Tick-borne encephalitis virus
KFAWKRTPTDS

SEQ ID NO: 208660 - protein, 11 aa, Tick-borne encephalitis virus
FAWKRTPTDSG

SEQ ID NO: 208661 - protein, 11 aa, Tick-borne encephalitis virus
AWKRTPTDSGH

SEQ ID NO: 208662 - protein, 11 aa, Tick-borne encephalitis virus
WKRTPTDSGHD

SEQ ID NO: 208663 - protein, 11 aa, Tick-borne encephalitis virus
KRTPTDSGHDT

SEQ ID NO: 208664 - protein, 11 aa, Tick-borne encephalitis virus
RTPTDSGHDTV

SEQ ID NO: 208665 - protein, 11 aa, Tick-borne encephalitis virus
APTDSGHDTVV

SEQ ID NO: 208666 - protein, 11 aa, Tick-borne encephalitis virus
SGHDTVVMEVS

SEQ ID NO: 208667 - protein, 11 aa, Tick-borne encephalitis virus
GHDTVVMEVSF

SEQ ID NO: 208668 - protein, 11 aa, Tick-borne encephalitis virus
HDTVVMEVSFS

SEQ ID NO: 208669 - protein, 11 aa, Tick-borne encephalitis virus
DTVVMEVSFSG

SEQ ID NO: 208670 - protein, 11 aa, Tick-borne encephalitis virus
TVVMEVSFSGT

SEQ ID NO: 208671 - protein, 11 aa, Tick-borne encephalitis virus
VVMEVSFSGTK

SEQ ID NO: 208672 - protein, 11 aa, Tick-borne encephalitis virus
VMEVSFSGTKP

SEQ ID NO: 208673 - protein, 11 aa, Tick-borne encephalitis virus
MEVSFSGTKPC

SEQ ID NO: 208674 - protein, 11 aa, Tick-borne encephalitis virus
EVSFSGTKPCR

SEQ ID NO: 208675 - protein, 11 aa, Tick-borne encephalitis virus
VSFSGTKPCRI

SEQ ID NO: 208676 - protein, 11 aa, Tick-borne encephalitis virus
SFSGTKPCRIP

SEQ ID NO: 208677 - protein, 11 aa, Tick-borne encephalitis virus
SIGRVFQKTRR

SEQ ID NO: 208678 - protein, 11 aa, Tick-borne encephalitis virus
IGRVFQKTRRG

SEQ ID NO: 208679 - protein, 11 aa, Tick-borne encephalitis virus
GRVFQKTRRGI

SEQ ID NO: 208680 - protein, 11 aa, Tick-borne encephalitis virus
RVFQKTRRGIE

SEQ ID NO: 208681 - protein, 11 aa, Tick-borne encephalitis virus
VFQKTRRGIER

SEQ ID NO: 208682 - protein, 11 aa, Tick-borne encephalitis virus
FQKTRRGIERL

SEQ ID NO: 208683 - protein, 11 aa, Tick-borne encephalitis virus
QKTRRGIERLT

SEQ ID NO: 208684 - protein, 11 aa, Tick-borne encephalitis virus
KTRRGIERLTV

SEQ ID NO: 208685 - protein, 11 aa, Tick-borne encephalitis virus
TRRGIERLTVI

SEQ ID NO: 208686 - protein, 11 aa, Tick-borne encephalitis virus
RRGIERLTVIG

SEQ ID NO: 208687 - protein, 11 aa, Tick-borne encephalitis virus
HAWDFGSTGGL

SEQ ID NO: 208688 - protein, 11 aa, Tick-borne encephalitis virus
AWDFGSTGGLL

SEQ ID NO: 208689 - protein, 11 aa, Tick-borne encephalitis virus
WDFGSTGGFLA

SEQ ID NO: 208690 - protein, 11 aa, Tick-borne encephalitis virus
DFGSTGGFLAS

SEQ ID NO: 208691 - protein, 11 aa, Tick-borne encephalitis virus
FGSTGGFLASV

SEQ ID NO: 208692 - protein, 11 aa, Tick-borne encephalitis virus
GSTGGFLASVG

SEQ ID NO: 208693 - protein, 11 aa, Tick-borne encephalitis virus
STGGFLASVGK

SEQ ID NO: 208694 - protein, 11 aa, Tick-borne encephalitis virus
TGGFLASVGKA

SEQ ID NO: 208695 - protein, 11 aa, Tick-borne encephalitis virus
GGFLASVGKAL

SEQ ID NO: 208696 - protein, 11 aa, Tick-borne encephalitis virus
GFLASVGKALH

SEQ ID NO: 208697 - protein, 11 aa, Tick-borne encephalitis virus
FLASVGKALHT

SEQ ID NO: 208698 - protein, 11 aa, Tick-borne encephalitis virus
LASVGKALHTV

SEQ ID NO: 208699 - protein, 11 aa, Tick-borne encephalitis virus
ASVGKALHTVL

SEQ ID NO: 208700 - protein, 11 aa, Tick-borne encephalitis virus
SIGKALHTVLG

SEQ ID NO: 208701 - protein, 11 aa, Tick-borne encephalitis virus
IGKALHTVLGG

SEQ ID NO: 208702 - protein, 11 aa, Tick-borne encephalitis virus
FNSLFGGVGFI

SEQ ID NO: 208703 - protein, 11 aa, Tick-borne encephalitis virus
NSLFGGVGFIP

SEQ ID NO: 208704 - protein, 11 aa, Tick-borne encephalitis virus
SLFGGVGFIPK

SEQ ID NO: 208705 - protein, 11 aa, Tick-borne encephalitis virus
LFGGVGFIPKL

SEQ ID NO: 208706 - protein, 11 aa, Tick-borne encephalitis virus
FGGVGFIPKLL

SEQ ID NO: 208707 - protein, 11 aa, Tick-borne encephalitis virus
GGVGFLPKILM

SEQ ID NO: 208708 - protein, 11 aa, Tick-borne encephalitis virus
GVGFLPKILMG

SEQ ID NO: 208709 - protein, 11 aa, Tick-borne encephalitis virus
GMALAWLGLNM

SEQ ID NO: 208710 - protein, 11 aa, Tick-borne encephalitis virus
MALAWLGLNMR

SEQ ID NO: 208711 - protein, 11 aa, Tick-borne encephalitis virus
TMSMSFLLAGV

SEQ ID NO: 208712 - protein, 11 aa, Tick-borne encephalitis virus
MSMSFLLAGVL

SEQ ID NO: 208713 - protein, 11 aa, Tick-borne encephalitis virus
SMSFLLAGVLV

SEQ ID NO: 208714 - protein, 11 aa, Tick-borne encephalitis virus
MSFLLAGVLVL

SEQ ID NO: 208715 - protein, 11 aa, Tick-borne encephalitis virus
SFLLAGVLVLA

SEQ ID NO: 208716 - protein, 11 aa, Tick-borne encephalitis virus
PGALASAIRET

SEQ ID NO: 208717 - protein, 11 aa, Tick-borne encephalitis virus
GALASAIRETF

SEQ ID NO: 208718 - protein, 11 aa, Tick-borne encephalitis virus
ALASAIKEAFE

SEQ ID NO: 208719 - protein, 11 aa, Tick-borne encephalitis virus
LASAIRETFEE

SEQ ID NO: 208720 - protein, 11 aa, Tick-borne encephalitis virus
ASAIKEAFEEG

SEQ ID NO: 208721 - protein, 11 aa, Tick-borne encephalitis virus
SAIKETFEEGN

SEQ ID NO: 208722 - protein, 11 aa, Tick-borne encephalitis virus
AIKETFEEGNC

SEQ ID NO: 208723 - protein, 11 aa, Tick-borne encephalitis virus
IKETFEEGNCG

SEQ ID NO: 208724 - protein, 11 aa, Tick-borne encephalitis virus
KETFEEGNCGI

SEQ ID NO: 208725 - protein, 11 aa, Tick-borne encephalitis virus
ETFEEGNCGIV

SEQ ID NO: 208726 - protein, 11 aa, Tick-borne encephalitis virus
TFEEGNCGIVP

SEQ ID NO: 208727 - protein, 11 aa, Tick-borne encephalitis virus
FEEGNCGIVPQ

SEQ ID NO: 208728 - protein, 11 aa, Tick-borne encephalitis virus
EEGNCGIVPQN

SEQ ID NO: 208729 - protein, 11 aa, Tick-borne encephalitis virus
EGNCGIVPQNR

SEQ ID NO: 208730 - protein, 11 aa, Tick-borne encephalitis virus
GNCGIVPQNRL

SEQ ID NO: 208731 - protein, 11 aa, Tick-borne encephalitis virus
NCGIVPQNRLE

SEQ ID NO: 208732 - protein, 11 aa, Tick-borne encephalitis virus
CGILPQNRLEM

SEQ ID NO: 208733 - protein, 11 aa, Tick-borne encephalitis virus
GILPQNRLEMA

SEQ ID NO: 208734 - protein, 11 aa, Tick-borne encephalitis virus
ILPQNRLEMAM

SEQ ID NO: 208735 - protein, 11 aa, Tick-borne encephalitis virus
RLEMAMWRSAV

SEQ ID NO: 208736 - protein, 11 aa, Tick-borne encephalitis virus
LEMAMWRSAVT

SEQ ID NO: 208737 - protein, 11 aa, Tick-borne encephalitis virus
EMAMWRSAVTE

SEQ ID NO: 208738 - protein, 11 aa, Tick-borne encephalitis virus
MAMWRSAVTEL

SEQ ID NO: 208739 - protein, 11 aa, Tick-borne encephalitis virus
AMWRSAVTELN

SEQ ID NO: 208740 - protein, 11 aa, Tick-borne encephalitis virus
MWRSAVTELNL

SEQ ID NO: 208741 - protein, 11 aa, Tick-borne encephalitis virus
WRSAVTELNLA

SEQ ID NO: 208742 - protein, 11 aa, Tick-borne encephalitis virus
RSAVTELNLAL

SEQ ID NO: 208743 - protein, 11 aa, Tick-borne encephalitis virus
SAVTELNLALA

SEQ ID NO: 208744 - protein, 11 aa, Tick-borne encephalitis virus
AVTELNLALAE

SEQ ID NO: 208745 - protein, 11 aa, Tick-borne encephalitis virus
STELNLALAEG

SEQ ID NO: 208746 - protein, 11 aa, Tick-borne encephalitis virus
LAEGEANLTVM

SEQ ID NO: 208747 - protein, 11 aa, Tick-borne encephalitis virus
AEGEANLTVMV

SEQ ID NO: 208748 - protein, 11 aa, Tick-borne encephalitis virus
EGEANLTVMVD

SEQ ID NO: 208749 - protein, 11 aa, Tick-borne encephalitis virus
GEANLTVMVDK

SEQ ID NO: 208750 - protein, 11 aa, Tick-borne encephalitis virus
DANLTVVVDKF

SEQ ID NO: 208751 - protein, 11 aa, Tick-borne encephalitis virus
ANLTVMVDKFD

SEQ ID NO: 208752 - protein, 11 aa, Tick-borne encephalitis virus
NLTVMVDKFDP

SEQ ID NO: 208753 - protein, 11 aa, Tick-borne encephalitis virus
LTVMVDKFDPT

SEQ ID NO: 208754 - protein, 11 aa, Tick-borne encephalitis virus
TVMVDKFDPTD

SEQ ID NO: 208755 - protein, 11 aa, Tick-borne encephalitis virus
VMVDKFDPTDY

SEQ ID NO: 208756 - protein, 11 aa, Tick-borne encephalitis virus
MVDKFDPTDYR

SEQ ID NO: 208757 - protein, 11 aa, Tick-borne encephalitis virus
KLDPTDYRGGV

SEQ ID NO: 208758 - protein, 11 aa, Tick-borne encephalitis virus
LDPTDYRGGVP

SEQ ID NO: 208759 - protein, 11 aa, Tick-borne encephalitis virus
DPTDYRGGVSG

SEQ ID NO: 208760 - protein, 11 aa, Tick-borne encephalitis virus
PTDYRGGVSGL

SEQ ID NO: 208761 - protein, 11 aa, Tick-borne encephalitis virus
TDYRGGVSGLL

SEQ ID NO: 208762 - protein, 11 aa, Tick-borne encephalitis virus
DYRGGVSGLLR

SEQ ID NO: 208763 - protein, 11 aa, Tick-borne encephalitis virus
YRGGVSGLLRK

SEQ ID NO: 208764 - protein, 11 aa, Tick-borne encephalitis virus
RGGVSGLLRKG

SEQ ID NO: 208765 - protein, 11 aa, Tick-borne encephalitis virus
GGIPGLLRKGK

SEQ ID NO: 208766 - protein, 11 aa, Tick-borne encephalitis virus
GIPGLLRKGKD

SEQ ID NO: 208767 - protein, 11 aa, Tick-borne encephalitis virus
IPGLLRKGKDI

SEQ ID NO: 208768 - protein, 11 aa, Tick-borne encephalitis virus
PGLLRKGKDIK

SEQ ID NO: 208769 - protein, 11 aa, Tick-borne encephalitis virus
GLLKKGKDIRV

SEQ ID NO: 208770 - protein, 11 aa, Tick-borne encephalitis virus
LLKKGKDIRVS

SEQ ID NO: 208771 - protein, 11 aa, Tick-borne encephalitis virus
LKKGKDIRVSW

SEQ ID NO: 208772 - protein, 11 aa, Tick-borne encephalitis virus
KKGKDIKVSWR

SEQ ID NO: 208773 - protein, 11 aa, Tick-borne encephalitis virus
KGKDIRVSWKS

SEQ ID NO: 208774 - protein, 11 aa, Tick-borne encephalitis virus
GKDIKVSWRSW

SEQ ID NO: 208775 - protein, 11 aa, Tick-borne encephalitis virus
KDIKVSWRSWG

SEQ ID NO: 208776 - protein, 11 aa, Tick-borne encephalitis virus
DIKVSWRSWGH

SEQ ID NO: 208777 - protein, 11 aa, Tick-borne encephalitis virus
IKVSWKSWGQA

SEQ ID NO: 208778 - protein, 11 aa, Tick-borne encephalitis virus
VIWSIPEAPRR

SEQ ID NO: 208779 - protein, 11 aa, Tick-borne encephalitis virus
IWSIPEASRRF

SEQ ID NO: 208780 - protein, 11 aa, Tick-borne encephalitis virus
WSIPEASRRFM

SEQ ID NO: 208781 - protein, 11 aa, Tick-borne encephalitis virus
SIPEASRRFMV

SEQ ID NO: 208782 - protein, 11 aa, Tick-borne encephalitis virus
IPEASRRFMVG

SEQ ID NO: 208783 - protein, 11 aa, Tick-borne encephalitis virus
PEAPRRFMVGI

SEQ ID NO: 208784 - protein, 11 aa, Tick-borne encephalitis virus
EASRRFMVGTE

SEQ ID NO: 208785 - protein, 11 aa, Tick-borne encephalitis virus
APRRFMVGIEG

SEQ ID NO: 208786 - protein, 11 aa, Tick-borne encephalitis virus
PRRFMVGTEGQ

SEQ ID NO: 208787 - protein, 11 aa, Tick-borne encephalitis virus
SECPPERRKTG

SEQ ID NO: 208788 - protein, 11 aa, Tick-borne encephalitis virus
ECPPERRKTGV

SEQ ID NO: 208789 - protein, 11 aa, Tick-borne encephalitis virus
CPPERRKTGVF

SEQ ID NO: 208790 - protein, 11 aa, Tick-borne encephalitis virus
PLERRKTGIFT

SEQ ID NO: 208791 - protein, 11 aa, Tick-borne encephalitis virus
LERRKTGIFTV

SEQ ID NO: 208792 - protein, 11 aa, Tick-borne encephalitis virus
TKVFLDFRQEA

SEQ ID NO: 208793 - protein, 11 aa, Tick-borne encephalitis virus
KVFVDFRQEST

SEQ ID NO: 208794 - protein, 11 aa, Tick-borne encephalitis virus
VFLDFRQEATH

SEQ ID NO: 208795 - protein, 11 aa, Tick-borne encephalitis virus
FVDFRQESTHE

SEQ ID NO: 208796 - protein, 11 aa, Tick-borne encephalitis virus
VDFRQESTHEC

SEQ ID NO: 208797 - protein, 11 aa, Tick-borne encephalitis virus
DFRQEATHECD

SEQ ID NO: 208798 - protein, 11 aa, Tick-borne encephalitis virus
FRQEATHECDT

SEQ ID NO: 208799 - protein, 11 aa, Tick-borne encephalitis virus
RQEATHECDTG

SEQ ID NO: 208800 - protein, 11 aa, Tick-borne encephalitis virus
QEATHECDTGV

SEQ ID NO: 208801 - protein, 11 aa, Tick-borne encephalitis virus
EATHECDTGVM

SEQ ID NO: 208802 - protein, 11 aa, Tick-borne encephalitis virus
ATHECDTGVMG

SEQ ID NO: 208803 - protein, 11 aa, Tick-borne encephalitis virus
AIHTDQSLWMK

SEQ ID NO: 208804 - protein, 11 aa, Tick-borne encephalitis virus
IHTDQSLWMKS

SEQ ID NO: 208805 - protein, 11 aa, Tick-borne encephalitis virus
HTDQSLWMKSM

SEQ ID NO: 208806 - protein, 11 aa, Tick-borne encephalitis virus
TDQSLWMKSVK

SEQ ID NO: 208807 - protein, 11 aa, Tick-borne encephalitis virus
DQSLWMKSVKN

SEQ ID NO: 208808 - protein, 11 aa, Tick-borne encephalitis virus
QSLWMKSVKND

SEQ ID NO: 208809 - protein, 11 aa, Tick-borne encephalitis virus
SLWMKSVKNDT

SEQ ID NO: 208810 - protein, 11 aa, Tick-borne encephalitis virus
LWMKSVKNDTG

SEQ ID NO: 208811 - protein, 11 aa, Tick-borne encephalitis virus
WMKSVKNDTGT

SEQ ID NO: 208812 - protein, 11 aa, Tick-borne encephalitis virus
MKSVKNDTGTY

SEQ ID NO: 208813 - protein, 11 aa, Tick-borne encephalitis virus
KSVKNDTGTYI

SEQ ID NO: 208814 - protein, 11 aa, Tick-borne encephalitis virus
SVKNDTGTYIV

SEQ ID NO: 208815 - protein, 11 aa, Tick-borne encephalitis virus
VKNDTGTYIVE

SEQ ID NO: 208816 - protein, 11 aa, Tick-borne encephalitis virus
RNETGTYIVEL

SEQ ID NO: 208817 - protein, 11 aa, Tick-borne encephalitis virus
WPASHTIDNPE

SEQ ID NO: 208818 - protein, 11 aa, Tick-borne encephalitis virus
PASHTIDNPEV

SEQ ID NO: 208819 - protein, 11 aa, Tick-borne encephalitis virus
ASHTIDNPEVV

SEQ ID NO: 208820 - protein, 11 aa, Tick-borne encephalitis virus
SHTIDNPEVVD

SEQ ID NO: 208821 - protein, 11 aa, Tick-borne encephalitis virus
HTIDNPEVVDS

SEQ ID NO: 208822 - protein, 11 aa, Tick-borne encephalitis virus
TIDNPEVVDSE

SEQ ID NO: 208823 - protein, 11 aa, Tick-borne encephalitis virus
IDNADVVDSES

SEQ ID NO: 208824 - protein, 11 aa, Tick-borne encephalitis virus
DNADVVDSESF

SEQ ID NO: 208825 - protein, 11 aa, Tick-borne encephalitis virus
NADVVDSESFL

SEQ ID NO: 208826 - protein, 11 aa, Tick-borne encephalitis virus
ADVVDSESFLP

SEQ ID NO: 208827 - protein, 11 aa, Tick-borne encephalitis virus
DVVDSESFLPA

SEQ ID NO: 208828 - protein, 11 aa, Tick-borne encephalitis virus
YAEQVKGPWKY

SEQ ID NO: 208829 - protein, 11 aa, Tick-borne encephalitis virus
AEQVKGPWKYS

SEQ ID NO: 208830 - protein, 11 aa, Tick-borne encephalitis virus
EQVKGPWKYTP

SEQ ID NO: 208831 - protein, 11 aa, Tick-borne encephalitis virus
QVKGPWKYTPI

SEQ ID NO: 208832 - protein, 11 aa, Tick-borne encephalitis virus
VKGPWKYTPIR

SEQ ID NO: 208833 - protein, 11 aa, Tick-borne encephalitis virus
KGPWKYTPIRV

SEQ ID NO: 208834 - protein, 11 aa, Tick-borne encephalitis virus
PIRVVRGECPG

SEQ ID NO: 208835 - protein, 11 aa, Tick-borne encephalitis virus
IRVVRGECPGT

SEQ ID NO: 208836 - protein, 11 aa, Tick-borne encephalitis virus
RVTREECPGTK

SEQ ID NO: 208837 - protein, 11 aa, Tick-borne encephalitis virus
VTREECPGTKV

SEQ ID NO: 208838 - protein, 11 aa, Tick-borne encephalitis virus
ISADCDKRGAS

SEQ ID NO: 208839 - protein, 11 aa, Tick-borne encephalitis virus
SADCDKRGASV

SEQ ID NO: 208840 - protein, 11 aa, Tick-borne encephalitis virus
ADCDRRGASVR

SEQ ID NO: 208841 - protein, 11 aa, Tick-borne encephalitis virus
DCDRRGASVRS

SEQ ID NO: 208842 - protein, 11 aa, Tick-borne encephalitis virus
CRTCTLPPVTI

SEQ ID NO: 208843 - protein, 11 aa, Tick-borne encephalitis virus
RTCTLPPVTIR

SEQ ID NO: 208844 - protein, 11 aa, Tick-borne encephalitis virus
TCTLPPVTIRT

SEQ ID NO: 208845 - protein, 11 aa, Tick-borne encephalitis virus
CTLPPVTIRTG

SEQ ID NO: 208846 - protein, 11 aa, Tick-borne encephalitis virus
TLPPVTIRTGT

SEQ ID NO: 208847 - protein, 11 aa, Tick-borne encephalitis virus
LPPVTIRTGTD

SEQ ID NO: 208848 - protein, 11 aa, Tick-borne encephalitis virus
VHDQGGLVRST

SEQ ID NO: 208849 - protein, 11 aa, Tick-borne encephalitis virus
HDQGGLVRSTV

SEQ ID NO: 208850 - protein, 11 aa, Tick-borne encephalitis virus
DQGGLVRSTVV

SEQ ID NO: 208851 - protein, 11 aa, Tick-borne encephalitis virus
QGGLIRSMVVA

SEQ ID NO: 208852 - protein, 11 aa, Tick-borne encephalitis virus
GGLIRSMVVAD

SEQ ID NO: 208853 - protein, 11 aa, Tick-borne encephalitis virus
GLIRSMVVADN

SEQ ID NO: 208854 - protein, 11 aa, Tick-borne encephalitis virus
LVRSTVVADNG

SEQ ID NO: 208855 - protein, 11 aa, Tick-borne encephalitis virus
VRSTVVADNGE

SEQ ID NO: 208856 - protein, 11 aa, Tick-borne encephalitis virus
YIIRRRPSTGS

SEQ ID NO: 208857 - protein, 11 aa, Tick-borne encephalitis virus
VIRRRPATGTA

SEQ ID NO: 208858 - protein, 11 aa, Tick-borne encephalitis virus
IRRRPATGTAV

SEQ ID NO: 208859 - protein, 11 aa, Tick-borne encephalitis virus
RRRPATGTAVV

SEQ ID NO: 208860 - protein, 11 aa, Tick-borne encephalitis virus
RRPATGTAVVW

SEQ ID NO: 208861 - protein, 11 aa, Tick-borne encephalitis virus
RPATGTAVVWG

SEQ ID NO: 208862 - protein, 11 aa, Tick-borne encephalitis virus
PATGTAVVWGG

SEQ ID NO: 208863 - protein, 11 aa, Tick-borne encephalitis virus
WGGFVVLALLV

SEQ ID NO: 208864 - protein, 11 aa, Tick-borne encephalitis virus
GGFVVLALLVT

SEQ ID NO: 208865 - protein, 11 aa, Tick-borne encephalitis virus
GFVVLALLVTG

SEQ ID NO: 208866 - protein, 11 aa, Tick-borne encephalitis virus
VVFALLVTGLV

SEQ ID NO: 208867 - protein, 11 aa, Tick-borne encephalitis virus
VLALLVTGLVK

SEQ ID NO: 208868 - protein, 11 aa, Tick-borne encephalitis virus
VRMESLVRYVV

SEQ ID NO: 208869 - protein, 11 aa, Tick-borne encephalitis virus
RMESLVRYVVA

SEQ ID NO: 208870 - protein, 11 aa, Tick-borne encephalitis virus
VESLVRYVVAV

SEQ ID NO: 208871 - protein, 11 aa, Tick-borne encephalitis virus
YVVAVGIAFHL

SEQ ID NO: 208872 - protein, 11 aa, Tick-borne encephalitis virus
VVAVGIAFHLE

SEQ ID NO: 208873 - protein, 11 aa, Tick-borne encephalitis virus
VAVGIAFHLEL

SEQ ID NO: 208874 - protein, 11 aa, Tick-borne encephalitis virus
AVGITFHFELG

SEQ ID NO: 208875 - protein, 11 aa, Tick-borne encephalitis virus
VGIAFHLELGP

SEQ ID NO: 208876 - protein, 11 aa, Tick-borne encephalitis virus
GIAFHLELGPE

SEQ ID NO: 208877 - protein, 11 aa, Tick-borne encephalitis virus
IAFHLELGPEI

SEQ ID NO: 208878 - protein, 11 aa, Tick-borne encephalitis virus
AFHLELGPEIV

SEQ ID NO: 208879 - protein, 11 aa, Tick-borne encephalitis virus
FELGPEIVALT

SEQ ID NO: 208880 - protein, 11 aa, Tick-borne encephalitis virus
GLLSAFALRRG

SEQ ID NO: 208881 - protein, 11 aa, Tick-borne encephalitis virus
LLSAFALRRGL

SEQ ID NO: 208882 - protein, 11 aa, Tick-borne encephalitis virus
LSAFALRRGLT

SEQ ID NO: 208883 - protein, 11 aa, Tick-borne encephalitis virus
SAFALRRGLTV

SEQ ID NO: 208884 - protein, 11 aa, Tick-borne encephalitis virus
AFALRRGLTVR

SEQ ID NO: 208885 - protein, 11 aa, Tick-borne encephalitis virus
FALRRGLTVRE

SEQ ID NO: 208886 - protein, 11 aa, Tick-borne encephalitis virus
ALRRGLTVREM

SEQ ID NO: 208887 - protein, 11 aa, Tick-borne encephalitis virus
LRRGLTVREMV

SEQ ID NO: 208888 - protein, 11 aa, Tick-borne encephalitis virus
RRGLTVREMVT

SEQ ID NO: 208889 - protein, 11 aa, Tick-borne encephalitis virus
GLTVREMVTIY

SEQ ID NO: 208890 - protein, 11 aa, Tick-borne encephalitis virus
LTVREMVITYF

SEQ ID NO: 208891 - protein, 11 aa, Tick-borne encephalitis virus
TVREMVITYFL

SEQ ID NO: 208892 - protein, 11 aa, Tick-borne encephalitis virus
VREMVITYFLL

SEQ ID NO: 208893 - protein, 11 aa, Tick-borne encephalitis virus
REMVITYFLLL

SEQ ID NO: 208894 - protein, 11 aa, Tick-borne encephalitis virus
EMVITYFLLLV

SEQ ID NO: 208895 - protein, 11 aa, Tick-borne encephalitis virus
MVITYFLLLVL

SEQ ID NO: 208896 - protein, 11 aa, Tick-borne encephalitis virus
VITYFLLLVLE

SEQ ID NO: 208897 - protein, 11 aa, Tick-borne encephalitis virus
ITYFLLLVLEL

SEQ ID NO: 208898 - protein, 11 aa, Tick-borne encephalitis virus
LLLVLELGLPY

SEQ ID NO: 208899 - protein, 11 aa, Tick-borne encephalitis virus
LWRWGDALAMG

SEQ ID NO: 208900 - protein, 11 aa, Tick-borne encephalitis virus
ALILRACTAEG

SEQ ID NO: 208901 - protein, 11 aa, Tick-borne encephalitis virus
LILRACTAEGK

SEQ ID NO: 208902 - protein, 11 aa, Tick-borne encephalitis virus
IFRACTAEGKA

SEQ ID NO: 208903 - protein, 11 aa, Tick-borne encephalitis virus
FRACTAEGKAG

SEQ ID NO: 208904 - protein, 11 aa, Tick-borne encephalitis virus
RACTAEGKTGV

SEQ ID NO: 208905 - protein, 11 aa, Tick-borne encephalitis virus
ACTAEGKAGVG

SEQ ID NO: 208906 - protein, 11 aa, Tick-borne encephalitis virus
CTAEGKTGVGL

SEQ ID NO: 208907 - protein, 11 aa, Tick-borne encephalitis virus
TAEGKTGVGLL

SEQ ID NO: 208908 - protein, 11 aa, Tick-borne encephalitis virus
AEGKTGVGLLL

SEQ ID NO: 208909 - protein, 11 aa, Tick-borne encephalitis virus
EGKAGVGLLLM

SEQ ID NO: 208910 - protein, 11 aa, Tick-borne encephalitis virus
GKTGVGLLLMA

SEQ ID NO: 208911 - protein, 11 aa, Tick-borne encephalitis virus
KAGVGLLLMAL

SEQ ID NO: 208912 - protein, 11 aa, Tick-borne encephalitis virus
AGVGLLLMALM

SEQ ID NO: 208913 - protein, 11 aa, Tick-borne encephalitis virus
GVGLLLMPLLT

SEQ ID NO: 208914 - protein, 11 aa, Tick-borne encephalitis virus
VGLLLMALITQ

SEQ ID NO: 208915 - protein, 11 aa, Tick-borne encephalitis virus
GLLLMALITQQ

SEQ ID NO: 208916 - protein, 11 aa, Tick-borne encephalitis virus
LLLMALITQQD

SEQ ID NO: 208917 - protein, 11 aa, Tick-borne encephalitis virus
WRLLKGHREQK

SEQ ID NO: 208918 - protein, 11 aa, Tick-borne encephalitis virus
RLLKGHREQKG

SEQ ID NO: 208919 - protein, 11 aa, Tick-borne encephalitis virus
LLRGHREQKGL

SEQ ID NO: 208920 - protein, 11 aa, Tick-borne encephalitis virus
LKGHREQKGLT

SEQ ID NO: 208921 - protein, 11 aa, Tick-borne encephalitis virus
KGHREQKGLTW

SEQ ID NO: 208922 - protein, 11 aa, Tick-borne encephalitis virus
GHREQKGLTWV

SEQ ID NO: 208923 - protein, 11 aa, Tick-borne encephalitis virus
HREQKGLSWIV

SEQ ID NO: 208924 - protein, 11 aa, Tick-borne encephalitis virus
REQKGLSWIVP

SEQ ID NO: 208925 - protein, 11 aa, Tick-borne encephalitis virus
EQKGLSWIVPL

SEQ ID NO: 208926 - protein, 11 aa, Tick-borne encephalitis virus
QKGLSWIVPLA

SEQ ID NO: 208927 - protein, 11 aa, Tick-borne encephalitis virus
VPLAGLMGGEG

SEQ ID NO: 208928 - protein, 11 aa, Tick-borne encephalitis virus
PLAGLMGGEGS

SEQ ID NO: 208929 - protein, 11 aa, Tick-borne encephalitis virus
LAGLMGGEGSG

SEQ ID NO: 208930 - protein, 11 aa, Tick-borne encephalitis virus
AGLLGGEGSGI

SEQ ID NO: 208931 - protein, 11 aa, Tick-borne encephalitis virus
GLLGGEGSGIR

SEQ ID NO: 208932 - protein, 11 aa, Tick-borne encephalitis virus
LMGGEGSGIRL

SEQ ID NO: 208933 - protein, 11 aa, Tick-borne encephalitis virus
MGGEGSGIRLL

SEQ ID NO: 208934 - protein, 11 aa, Tick-borne encephalitis virus
GGEGSGIRLLS

SEQ ID NO: 208935 - protein, 11 aa, Tick-borne encephalitis virus
GEGSGIRLLSF

SEQ ID NO: 208936 - protein, 11 aa, Tick-borne encephalitis virus
EGSGIRLLSFW

SEQ ID NO: 208937 - protein, 11 aa, Tick-borne encephalitis virus
GSGIRLLSFWE

SEQ ID NO: 208938 - protein, 11 aa, Tick-borne encephalitis virus
SGIRLLSFWEL

SEQ ID NO: 208939 - protein, 11 aa, Tick-borne encephalitis virus
GIRLLAFWELA

SEQ ID NO: 208940 - protein, 11 aa, Tick-borne encephalitis virus
HGKRRSFSEPL

SEQ ID NO: 208941 - protein, 11 aa, Tick-borne encephalitis virus
GKRRSFSEPLT

SEQ ID NO: 208942 - protein, 11 aa, Tick-borne encephalitis virus
KRRSFSEPLTV

SEQ ID NO: 208943 - protein, 11 aa, Tick-borne encephalitis virus
TLASGMMRHTP

SEQ ID NO: 208944 - protein, 11 aa, Tick-borne encephalitis virus
LASGMMRHTPQ

SEQ ID NO: 208945 - protein, 11 aa, Tick-borne encephalitis virus
ASGMMRHTPQE

SEQ ID NO: 208946 - protein, 11 aa, Tick-borne encephalitis virus
SGMMRHTPQEA

SEQ ID NO: 208947 - protein, 11 aa, Tick-borne encephalitis virus
SGCVEWYPELV

SEQ ID NO: 208948 - protein, 11 aa, Tick-borne encephalitis virus
GCVEWYPELVN

SEQ ID NO: 208949 - protein, 11 aa, Tick-borne encephalitis virus
CVEWYPELVNE

SEQ ID NO: 208950 - protein, 11 aa, Tick-borne encephalitis virus
VEWYPELVNEG

SEQ ID NO: 208951 - protein, 11 aa, Tick-borne encephalitis virus
EWYPELVNEGG

SEQ ID NO: 208952 - protein, 11 aa, Tick-borne encephalitis virus
WYPELVNEGGE

SEQ ID NO: 208953 - protein, 11 aa, Tick-borne encephalitis virus
YPELVNEGGEV

SEQ ID NO: 208954 - protein, 11 aa, Tick-borne encephalitis virus
KEERMMAFWLI

SEQ ID NO: 208955 - protein, 11 aa, Tick-borne encephalitis virus
EERMMAFWLIA

SEQ ID NO: 208956 - protein, 11 aa, Tick-borne encephalitis virus
ERMMAFWLIAG

SEQ ID NO: 208957 - protein, 11 aa, Tick-borne encephalitis virus
RMMAFWLIAGL

SEQ ID NO: 208958 - protein, 11 aa, Tick-borne encephalitis virus
MMAFWLIAGLA

SEQ ID NO: 208959 - protein, 11 aa, Tick-borne encephalitis virus
MAFWLLAGLSA

SEQ ID NO: 208960 - protein, 11 aa, Tick-borne encephalitis virus
AFWLLAGLSAS

SEQ ID NO: 208961 - protein, 11 aa, Tick-borne encephalitis virus
FWLLAGLSASA

SEQ ID NO: 208962 - protein, 11 aa, Tick-borne encephalitis virus
AGLAASAVHWS

SEQ ID NO: 208963 - protein, 11 aa, Tick-borne encephalitis virus
GLAASAVHWSG

SEQ ID NO: 208964 - protein, 11 aa, Tick-borne encephalitis virus
LAASAVHWSGI

SEQ ID NO: 208965 - protein, 11 aa, Tick-borne encephalitis virus
ASAIHWSGILG

SEQ ID NO: 208966 - protein, 11 aa, Tick-borne encephalitis virus
SAIHWSGILGV

SEQ ID NO: 208967 - protein, 11 aa, Tick-borne encephalitis virus
AIHWSGILGVM

SEQ ID NO: 208968 - protein, 11 aa, Tick-borne encephalitis virus
IHWSGILGVMG

SEQ ID NO: 208969 - protein, 11 aa, Tick-borne encephalitis virus
IIGVMGLWTLT

SEQ ID NO: 208970 - protein, 11 aa, Tick-borne encephalitis virus
IGVMGLWTLTK

SEQ ID NO: 208971 - protein, 11 aa, Tick-borne encephalitis virus
GVMGLWTLTKM

SEQ ID NO: 208972 - protein, 11 aa, Tick-borne encephalitis virus
VMGLWTLSEMM

SEQ ID NO: 208973 - protein, 11 aa, Tick-borne encephalitis virus
MGLWTLSEMMR

SEQ ID NO: 208974 - protein, 11 aa, Tick-borne encephalitis virus
ARRSGLVFSGQ

SEQ ID NO: 208975 - protein, 11 aa, Tick-borne encephalitis virus
RRSDLAFSGQG

SEQ ID NO: 208976 - protein, 11 aa, Tick-borne encephalitis virus
RSDLVFSGQGN

SEQ ID NO: 208977 - protein, 11 aa, Tick-borne encephalitis virus
SDLAFSGQGGR

SEQ ID NO: 208978 - protein, 11 aa, Tick-borne encephalitis virus
DLVFSGQGRGE

SEQ ID NO: 208979 - protein, 11 aa, Tick-borne encephalitis virus
LVFSGQGNRER

SEQ ID NO: 208980 - protein, 11 aa, Tick-borne encephalitis virus
AFSGQGGRERG

SEQ ID NO: 208981 - protein, 11 aa, Tick-borne encephalitis virus
FSGQGNRERGD

SEQ ID NO: 208982 - protein, 11 aa, Tick-borne encephalitis virus
SGQGNRERGDR

SEQ ID NO: 208983 - protein, 11 aa, Tick-borne encephalitis virus
GQGNRERGDRP

SEQ ID NO: 208984 - protein, 11 aa, Tick-borne encephalitis virus
QGNRERGDRPF

SEQ ID NO: 208985 - protein, 11 aa, Tick-borne encephalitis virus
GNRERGDRPFE

SEQ ID NO: 208986 - protein, 11 aa, Tick-borne encephalitis virus
RGERGDKPFEV

SEQ ID NO: 208987 - protein, 11 aa, Tick-borne encephalitis virus
RERGDRPFEVR

SEQ ID NO: 208988 - protein, 11 aa, Tick-borne encephalitis virus
ERGDRPFEVRD

SEQ ID NO: 208989 - protein, 11 aa, Tick-borne encephalitis virus
RGDRPFEVRDG

SEQ ID NO: 208990 - protein, 11 aa, Tick-borne encephalitis virus
GDRPFEVRDGV

SEQ ID NO: 208991 - protein, 11 aa, Tick-borne encephalitis virus
DRPFEVRDGVY

SEQ ID NO: 208992 - protein, 11 aa, Tick-borne encephalitis virus
RPFEVRDGVYR

SEQ ID NO: 208993 - protein, 11 aa, Tick-borne encephalitis virus
IFSPGLFWGQR

SEQ ID NO: 208994 - protein, 11 aa, Tick-borne encephalitis virus
FSPGLFWGQRQ

SEQ ID NO: 208995 - protein, 11 aa, Tick-borne encephalitis virus
SPGLFWGQSQV

SEQ ID NO: 208996 - protein, 11 aa, Tick-borne encephalitis virus
PGLFWGQSQVG

SEQ ID NO: 208997 - protein, 11 aa, Tick-borne encephalitis virus
GLFWGQRQVGV

SEQ ID NO: 208998 - protein, 11 aa, Tick-borne encephalitis virus
LFWGQSQVGVG

SEQ ID NO: 208999 - protein, 11 aa, Tick-borne encephalitis virus
FWGQSQVGVGY

SEQ ID NO: 209000 - protein, 11 aa, Tick-borne encephalitis virus
WGQSQVGVGYG

SEQ ID NO: 209001 - protein, 11 aa, Tick-borne encephalitis virus
GQNQVGVGYGS

SEQ ID NO: 209002 - protein, 11 aa, Tick-borne encephalitis virus
QNQVGVGYGSK

SEQ ID NO: 209003 - protein, 11 aa, Tick-borne encephalitis virus
NQVGVGYGSKG

SEQ ID NO: 209004 - protein, 11 aa, Tick-borne encephalitis virus
QVGVGYGFRGV

SEQ ID NO: 209005 - protein, 11 aa, Tick-borne encephalitis virus
VGVGYGFRGVL

SEQ ID NO: 209006 - protein, 11 aa, Tick-borne encephalitis virus
GVGYGFRGVLH

SEQ ID NO: 209007 - protein, 11 aa, Tick-borne encephalitis virus
VGYGFRGVLHT

SEQ ID NO: 209008 - protein, 11 aa, Tick-borne encephalitis virus
GYGFRGVLHTM

SEQ ID NO: 209009 - protein, 11 aa, Tick-borne encephalitis virus
YGFRGVLHTMW

SEQ ID NO: 209010 - protein, 11 aa, Tick-borne encephalitis virus
GFRGVLHTMWH

SEQ ID NO: 209011 - protein, 11 aa, Tick-borne encephalitis virus
FRGVLHTMWHV

SEQ ID NO: 209012 - protein, 11 aa, Tick-borne encephalitis virus
WHVTRGAALYI

SEQ ID NO: 209013 - protein, 11 aa, Tick-borne encephalitis virus
HVTRGAALSVD

SEQ ID NO: 209014 - protein, 11 aa, Tick-borne encephalitis virus
VTRGAALYIDD

SEQ ID NO: 209015 - protein, 11 aa, Tick-borne encephalitis virus
TRGAALYIDDA

SEQ ID NO: 209016 - protein, 11 aa, Tick-borne encephalitis virus
RGAALSVDDAV

SEQ ID NO: 209017 - protein, 11 aa, Tick-borne encephalitis virus
GAALSIDDAVV

SEQ ID NO: 209018 - protein, 11 aa, Tick-borne encephalitis virus
AALYIDDAVAG

SEQ ID NO: 209019 - protein, 11 aa, Tick-borne encephalitis virus
ALSIDDAVVGP

SEQ ID NO: 209020 - protein, 11 aa, Tick-borne encephalitis virus
LYIDDAVAGPY

SEQ ID NO: 209021 - protein, 11 aa, Tick-borne encephalitis virus
SIDDAVVGPYW

SEQ ID NO: 209022 - protein, 11 aa, Tick-borne encephalitis virus
VDDAVVGPYWA

SEQ ID NO: 209023 - protein, 11 aa, Tick-borne encephalitis virus
DDAVVGPYWAD

SEQ ID NO: 209024 - protein, 11 aa, Tick-borne encephalitis virus
DAVAGPYWSDV

SEQ ID NO: 209025 - protein, 11 aa, Tick-borne encephalitis virus
AVVGPYWADVK

SEQ ID NO: 209026 - protein, 11 aa, Tick-borne encephalitis virus
VVGPYWADVKE

SEQ ID NO: 209027 - protein, 11 aa, Tick-borne encephalitis virus
VGPYWADVKED

SEQ ID NO: 209028 - protein, 11 aa, Tick-borne encephalitis virus
GPYWAEVKEDV

SEQ ID NO: 209029 - protein, 11 aa, Tick-borne encephalitis virus
PYWSDVREDVV

SEQ ID NO: 209030 - protein, 11 aa, Tick-borne encephalitis virus
YWSDVREDVVC

SEQ ID NO: 209031 - protein, 11 aa, Tick-borne encephalitis virus
WAEVKEDVVCY

SEQ ID NO: 209032 - protein, 11 aa, Tick-borne encephalitis virus
SDVREDVVCYG

SEQ ID NO: 209033 - protein, 11 aa, Tick-borne encephalitis virus
EVKEDVVCYGG

SEQ ID NO: 209034 - protein, 11 aa, Tick-borne encephalitis virus
VKEDVVCYGGT

SEQ ID NO: 209035 - protein, 11 aa, Tick-borne encephalitis virus
KEDVVCYGGTW

SEQ ID NO: 209036 - protein, 11 aa, Tick-borne encephalitis virus
GGAWSLEEKWR

SEQ ID NO: 209037 - protein, 11 aa, Tick-borne encephalitis virus
GTWSLEEKWKG

SEQ ID NO: 209038 - protein, 11 aa, Tick-borne encephalitis virus
AWSLEEKWRGE

SEQ ID NO: 209039 - protein, 11 aa, Tick-borne encephalitis virus
QPGELLLDTGG

SEQ ID NO: 209040 - protein, 11 aa, Tick-borne encephalitis virus
PGELLLDTGGR

SEQ ID NO: 209041 - protein, 11 aa, Tick-borne encephalitis virus
GAIPIDLAKGT

SEQ ID NO: 209042 - protein, 11 aa, Tick-borne encephalitis virus
AIPIDLAKGTS

SEQ ID NO: 209043 - protein, 11 aa, Tick-borne encephalitis virus
IPIDLAKGTSG

SEQ ID NO: 209044 - protein, 11 aa, Tick-borne encephalitis virus
LIDLSKGTSRS

SEQ ID NO: 209045 - protein, 11 aa, Tick-borne encephalitis virus
IDLSKGTSRSP

SEQ ID NO: 209046 - protein, 11 aa, Tick-borne encephalitis virus
DLAKGTSGSPT

SEQ ID NO: 209047 - protein, 11 aa, Tick-borne encephalitis virus
LSKGTSRSPIL

SEQ ID NO: 209048 - protein, 11 aa, Tick-borne encephalitis virus
SKGTSRSPILN

SEQ ID NO: 209049 - protein, 11 aa, Tick-borne encephalitis virus
KGTSRSPILNA

SEQ ID NO: 209050 - protein, 11 aa, Tick-borne encephalitis virus
GTSRSPILNAQ

SEQ ID NO: 209051 - protein, 11 aa, Tick-borne encephalitis virus
TSGSPTLNSQG

SEQ ID NO: 209052 - protein, 11 aa, Tick-borne encephalitis virus
SPILNAQGAVV

SEQ ID NO: 209053 - protein, 11 aa, Tick-borne encephalitis virus
PILNAQGAVVG

SEQ ID NO: 209054 - protein, 11 aa, Tick-borne encephalitis virus
ILNAQGAVVGL

SEQ ID NO: 209055 - protein, 11 aa, Tick-borne encephalitis virus
LNAQGAVVGLY

SEQ ID NO: 209056 - protein, 11 aa, Tick-borne encephalitis virus
NAQGAVVGLYG

SEQ ID NO: 209057 - protein, 11 aa, Tick-borne encephalitis virus
AQGAVVGLYGN

SEQ ID NO: 209058 - protein, 11 aa, Tick-borne encephalitis virus
VSSIAQGEAER

SEQ ID NO: 209059 - protein, 11 aa, Tick-borne encephalitis virus
SSIAQGEAERS

SEQ ID NO: 209060 - protein, 11 aa, Tick-borne encephalitis virus
SIAQGEAERSR

SEQ ID NO: 209061 - protein, 11 aa, Tick-borne encephalitis virus
IAQGEAERSRP

SEQ ID NO: 209062 - protein, 11 aa, Tick-borne encephalitis virus
AQGEAERSRPN

SEQ ID NO: 209063 - protein, 11 aa, Tick-borne encephalitis virus
QGEAERSRPNL

SEQ ID NO: 209064 - protein, 11 aa, Tick-borne encephalitis virus
GEAERSRPNLP

SEQ ID NO: 209065 - protein, 11 aa, Tick-borne encephalitis virus
EVEKSRPNLPQ

SEQ ID NO: 209066 - protein, 11 aa, Tick-borne encephalitis virus
VEKSRPNLPQA

SEQ ID NO: 209067 - protein, 11 aa, Tick-borne encephalitis virus
EKSRPSLPPAV

SEQ ID NO: 209068 - protein, 11 aa, Tick-borne encephalitis virus
GMGWTAKGQIT

SEQ ID NO: 209069 - protein, 11 aa, Tick-borne encephalitis virus
MGWTAKGQITV

SEQ ID NO: 209070 - protein, 11 aa, Tick-borne encephalitis virus
VVLKEMERALT

SEQ ID NO: 209071 - protein, 11 aa, Tick-borne encephalitis virus
VLKEMERALTG

SEQ ID NO: 209072 - protein, 11 aa, Tick-borne encephalitis virus
LKEMERALTGK

SEQ ID NO: 209073 - protein, 11 aa, Tick-borne encephalitis virus
KEMERALTGKR

SEQ ID NO: 209074 - protein, 11 aa, Tick-borne encephalitis virus
EMERALTGKRV

SEQ ID NO: 209075 - protein, 11 aa, Tick-borne encephalitis virus
MERALTGKRVR

SEQ ID NO: 209076 - protein, 11 aa, Tick-borne encephalitis virus
ERALTGKRVRF

SEQ ID NO: 209077 - protein, 11 aa, Tick-borne encephalitis virus
RALTGKRVRFL

SEQ ID NO: 209078 - protein, 11 aa, Tick-borne encephalitis virus
ALTGKRVRFLS

SEQ ID NO: 209079 - protein, 11 aa, Tick-borne encephalitis virus
LTGKRVRFLSP

SEQ ID NO: 209080 - protein, 11 aa, Tick-borne encephalitis virus
TGKRVRFLSPA

SEQ ID NO: 209081 - protein, 11 aa, Tick-borne encephalitis virus
GKRVRFHSPVV

SEQ ID NO: 209082 - protein, 11 aa, Tick-borne encephalitis virus
KRVRFHSPVVG

SEQ ID NO: 209083 - protein, 11 aa, Tick-borne encephalitis virus
RVRFLSPAVSD

SEQ ID NO: 209084 - protein, 11 aa, Tick-borne encephalitis virus
VRFHSPAVGDH

SEQ ID NO: 209085 - protein, 11 aa, Tick-borne encephalitis virus
RFHSPVVGDQQ

SEQ ID NO: 209086 - protein, 11 aa, Tick-borne encephalitis virus
GGAIVDLMCHT

SEQ ID NO: 209087 - protein, 11 aa, Tick-borne encephalitis virus
GAIVDLMCHTT

SEQ ID NO: 209088 - protein, 11 aa, Tick-borne encephalitis virus
AIVDLMCHTTY

SEQ ID NO: 209089 - protein, 11 aa, Tick-borne encephalitis virus
VDVMCHATYVS

SEQ ID NO: 209090 - protein, 11 aa, Tick-borne encephalitis virus
DLMCHTTYVNR

SEQ ID NO: 209091 - protein, 11 aa, Tick-borne encephalitis virus
LMCHTTYVNRR

SEQ ID NO: 209092 - protein, 11 aa, Tick-borne encephalitis virus
MCHATYVSRRL

SEQ ID NO: 209093 - protein, 11 aa, Tick-borne encephalitis virus
CHATYVSRRLL

SEQ ID NO: 209094 - protein, 11 aa, Tick-borne encephalitis virus
HATYVSRRLLP

SEQ ID NO: 209095 - protein, 11 aa, Tick-borne encephalitis virus
TTYVNRRLLPQ

SEQ ID NO: 209096 - protein, 11 aa, Tick-borne encephalitis virus
EPFPESNRGIT

SEQ ID NO: 209097 - protein, 11 aa, Tick-borne encephalitis virus
PFPESNRGITS

SEQ ID NO: 209098 - protein, 11 aa, Tick-borne encephalitis virus
FPESNRGITSE

SEQ ID NO: 209099 - protein, 11 aa, Tick-borne encephalitis virus
PESNRGITSEV

SEQ ID NO: 209100 - protein, 11 aa, Tick-borne encephalitis virus
ESNGAITSEER

SEQ ID NO: 209101 - protein, 11 aa, Tick-borne encephalitis virus
SNGAITSEERQ

SEQ ID NO: 209102 - protein, 11 aa, Tick-borne encephalitis virus
NGAITSEERQI

SEQ ID NO: 209103 - protein, 11 aa, Tick-borne encephalitis virus
GAITSEERQIP

SEQ ID NO: 209104 - protein, 11 aa, Tick-borne encephalitis virus
SEEKQIPEGEW

SEQ ID NO: 209105 - protein, 11 aa, Tick-borne encephalitis virus
EEKQIPEGEWR

SEQ ID NO: 209106 - protein, 11 aa, Tick-borne encephalitis virus
EKQIPEGEWRD

SEQ ID NO: 209107 - protein, 11 aa, Tick-borne encephalitis virus
KQIPEGEWRDG

SEQ ID NO: 209108 - protein, 11 aa, Tick-borne encephalitis virus
QIPNGEWRDGF

SEQ ID NO: 209109 - protein, 11 aa, Tick-borne encephalitis virus
IPNGEWRDGFD

SEQ ID NO: 209110 - protein, 11 aa, Tick-borne encephalitis virus
PNGEWRDGFDW

SEQ ID NO: 209111 - protein, 11 aa, Tick-borne encephalitis virus
NGEWRDGFDWI

SEQ ID NO: 209112 - protein, 11 aa, Tick-borne encephalitis virus
GRSAWFVPSIA

SEQ ID NO: 209113 - protein, 11 aa, Tick-borne encephalitis virus
RSAWFVPSIAK

SEQ ID NO: 209114 - protein, 11 aa, Tick-borne encephalitis virus
SAWFVPSIAKG

SEQ ID NO: 209115 - protein, 11 aa, Tick-borne encephalitis virus
WFVPSIAKGGV

SEQ ID NO: 209116 - protein, 11 aa, Tick-borne encephalitis virus
FVPSIAKGGVI

SEQ ID NO: 209117 - protein, 11 aa, Tick-borne encephalitis virus
VPSIAKGGVIA

SEQ ID NO: 209118 - protein, 11 aa, Tick-borne encephalitis virus
PSIAKGGVIAR

SEQ ID NO: 209119 - protein, 11 aa, Tick-borne encephalitis virus
SIAKGGVIART

SEQ ID NO: 209120 - protein, 11 aa, Tick-borne encephalitis virus
IAKGGVIARTL

SEQ ID NO: 209121 - protein, 11 aa, Tick-borne encephalitis virus
AKGGVIARTLR

SEQ ID NO: 209122 - protein, 11 aa, Tick-borne encephalitis virus
KGGVIARTLRQ

SEQ ID NO: 209123 - protein, 11 aa, Tick-borne encephalitis virus
GGVIARTLRQK

SEQ ID NO: 209124 - protein, 11 aa, Tick-borne encephalitis virus
GVIARTLRQKG

SEQ ID NO: 209125 - protein, 11 aa, Tick-borne encephalitis virus
VIARTLRQKGK

SEQ ID NO: 209126 - protein, 11 aa, Tick-borne encephalitis virus
PEEVDGRVELI

SEQ ID NO: 209127 - protein, 11 aa, Tick-borne encephalitis virus
EEVDGRVELIG

SEQ ID NO: 209128 - protein, 11 aa, Tick-borne encephalitis virus
EVDGRVELIGT

SEQ ID NO: 209129 - protein, 11 aa, Tick-borne encephalitis virus
VDGRVELIGTR

SEQ ID NO: 209130 - protein, 11 aa, Tick-borne encephalitis virus
DGRVELIGTRR

SEQ ID NO: 209131 - protein, 11 aa, Tick-borne encephalitis virus
GRVELIGTRRV

SEQ ID NO: 209132 - protein, 11 aa, Tick-borne encephalitis virus
RVELIGTRRVT

SEQ ID NO: 209133 - protein, 11 aa, Tick-borne encephalitis virus
AAPRRGRVGRQ

SEQ ID NO: 209134 - protein, 11 aa, Tick-borne encephalitis virus
AQRRGRVGRHE

SEQ ID NO: 209135 - protein, 11 aa, Tick-borne encephalitis virus
QRRGRVGRHEG

SEQ ID NO: 209136 - protein, 11 aa, Tick-borne encephalitis virus
RRGRVGRHEGR

SEQ ID NO: 209137 - protein, 11 aa, Tick-borne encephalitis virus
RGRVGRHEGRT

SEQ ID NO: 209138 - protein, 11 aa, Tick-borne encephalitis virus
GRVGRHEGRTD

SEQ ID NO: 209139 - protein, 11 aa, Tick-borne encephalitis virus
RVGRHEGRTDE

SEQ ID NO: 209140 - protein, 11 aa, Tick-borne encephalitis virus
VGRHEGRTDEY

SEQ ID NO: 209141 - protein, 11 aa, Tick-borne encephalitis virus
GRHEGRTDEYI

SEQ ID NO: 209142 - protein, 11 aa, Tick-borne encephalitis virus
RHEGRTDEYIY

SEQ ID NO: 209143 - protein, 11 aa, Tick-borne encephalitis virus
HEGRTDEYIYS

SEQ ID NO: 209144 - protein, 11 aa, Tick-borne encephalitis virus
EGRIDEYIYSG

SEQ ID NO: 209145 - protein, 11 aa, Tick-borne encephalitis virus
IYSGQCDDDDG

SEQ ID NO: 209146 - protein, 11 aa, Tick-borne encephalitis virus
YSGQCDDDDSV

SEQ ID NO: 209147 - protein, 11 aa, Tick-borne encephalitis virus
SGQCDEYDSGL

SEQ ID NO: 209148 - protein, 11 aa, Tick-borne encephalitis virus
GQCDEYDSGLV

SEQ ID NO: 209149 - protein, 11 aa, Tick-borne encephalitis virus
QCDDDDSVLVQ

SEQ ID NO: 209150 - protein, 11 aa, Tick-borne encephalitis virus
CDDDDGGLVQW

SEQ ID NO: 209151 - protein, 11 aa, Tick-borne encephalitis virus
DEYDSGLVQWK

SEQ ID NO: 209152 - protein, 11 aa, Tick-borne encephalitis virus
DDDGGLVQWKE

SEQ ID NO: 209153 - protein, 11 aa, Tick-borne encephalitis virus
DDSGLVQWKEG

SEQ ID NO: 209154 - protein, 11 aa, Tick-borne encephalitis virus
DSGLVQWKEGQ

SEQ ID NO: 209155 - protein, 11 aa, Tick-borne encephalitis virus
SVLVQWKEAQI

SEQ ID NO: 209156 - protein, 11 aa, Tick-borne encephalitis virus
VLVQWKEAQIL

SEQ ID NO: 209157 - protein, 11 aa, Tick-borne encephalitis virus
QWKEGQILLDN

SEQ ID NO: 209158 - protein, 11 aa, Tick-borne encephalitis virus
WKEAQILLDDI

SEQ ID NO: 209159 - protein, 11 aa, Tick-borne encephalitis virus
KEAQILLDDIT

SEQ ID NO: 209160 - protein, 11 aa, Tick-borne encephalitis virus
EAQILLDNIIT

SEQ ID NO: 209161 - protein, 11 aa, Tick-borne encephalitis virus
GQILLDNITTL

SEQ ID NO: 209162 - protein, 11 aa, Tick-borne encephalitis virus
QILLDNIITLR

SEQ ID NO: 209163 - protein, 11 aa, Tick-borne encephalitis virus
ILLDNIITLRG

SEQ ID NO: 209164 - protein, 11 aa, Tick-borne encephalitis virus
LLDDITTLRGP

SEQ ID NO: 209165 - protein, 11 aa, Tick-borne encephalitis virus
LDNIITLRGPV

SEQ ID NO: 209166 - protein, 11 aa, Tick-borne encephalitis virus
DDITTLRGPVA

SEQ ID NO: 209167 - protein, 11 aa, Tick-borne encephalitis virus
DITTLRGPVAT

SEQ ID NO: 209168 - protein, 11 aa, Tick-borne encephalitis virus
IITLRGPVATF

SEQ ID NO: 209169 - protein, 11 aa, Tick-borne encephalitis virus
ITLRGPVATFY

SEQ ID NO: 209170 - protein, 11 aa, Tick-borne encephalitis virus
VATFYGPEQDR

SEQ ID NO: 209171 - protein, 11 aa, Tick-borne encephalitis virus
VTFYGPEQDKM

SEQ ID NO: 209172 - protein, 11 aa, Tick-borne encephalitis virus
QDKMPEVAGHY

SEQ ID NO: 209173 - protein, 11 aa, Tick-borne encephalitis virus
DKMPEVAGHYR

SEQ ID NO: 209174 - protein, 11 aa, Tick-borne encephalitis virus
RMPEVAGHFRL

SEQ ID NO: 209175 - protein, 11 aa, Tick-borne encephalitis virus
HVAANVSGVTS

SEQ ID NO: 209176 - protein, 11 aa, Tick-borne encephalitis virus
VAANVSGVTSR

SEQ ID NO: 209177 - protein, 11 aa, Tick-borne encephalitis virus
AANVSSVTSRS

SEQ ID NO: 209178 - protein, 11 aa, Tick-borne encephalitis virus
ANVSSVTSRSW

SEQ ID NO: 209179 - protein, 11 aa, Tick-borne encephalitis virus
NVSGVTSRNWT

SEQ ID NO: 209180 - protein, 11 aa, Tick-borne encephalitis virus
VSSVTSRSWTW

SEQ ID NO: 209181 - protein, 11 aa, Tick-borne encephalitis virus
SSVTSRSWTWE

SEQ ID NO: 209182 - protein, 11 aa, Tick-borne encephalitis virus
SVTSRSWTWEG

SEQ ID NO: 209183 - protein, 11 aa, Tick-borne encephalitis virus
VTSRSWTWEGP

SEQ ID NO: 209184 - protein, 11 aa, Tick-borne encephalitis virus
TSRSWTWEGPE

SEQ ID NO: 209185 - protein, 11 aa, Tick-borne encephalitis virus
SRSWTWEGPEE

SEQ ID NO: 209186 - protein, 11 aa, Tick-borne encephalitis virus
RSWTWEGPEEN

SEQ ID NO: 209187 - protein, 11 aa, Tick-borne encephalitis virus
NWTWEGPEENA

SEQ ID NO: 209188 - protein, 11 aa, Tick-borne encephalitis virus
WTWEGPEANAV

SEQ ID NO: 209189 - protein, 11 aa, Tick-borne encephalitis virus
TWEGPEANAVD

SEQ ID NO: 209190 - protein, 11 aa, Tick-borne encephalitis virus
WEGPEANAVDE

SEQ ID NO: 209191 - protein, 11 aa, Tick-borne encephalitis virus
EGPEANAVDEA

SEQ ID NO: 209192 - protein, 11 aa, Tick-borne encephalitis virus
GPEANAVDEAS

SEQ ID NO: 209193 - protein, 11 aa, Tick-borne encephalitis virus
PEENAVDEANG

SEQ ID NO: 209194 - protein, 11 aa, Tick-borne encephalitis virus
EANAVDEASGD

SEQ ID NO: 209195 - protein, 11 aa, Tick-borne encephalitis virus
ANAVDEASGDL

SEQ ID NO: 209196 - protein, 11 aa, Tick-borne encephalitis virus
NAVDEASGDLV

SEQ ID NO: 209197 - protein, 11 aa, Tick-borne encephalitis virus
AVDEASGDLVT

SEQ ID NO: 209198 - protein, 11 aa, Tick-borne encephalitis virus
VDEASGGLVTF

SEQ ID NO: 209199 - protein, 11 aa, Tick-borne encephalitis virus
DEANGDLVTFK

SEQ ID NO: 209200 - protein, 11 aa, Tick-borne encephalitis virus
EANGDLVTFKS

SEQ ID NO: 209201 - protein, 11 aa, Tick-borne encephalitis virus
ANGDLVTFKSP

SEQ ID NO: 209202 - protein, 11 aa, Tick-borne encephalitis virus
NGDLVTFKSPN

SEQ ID NO: 209203 - protein, 11 aa, Tick-borne encephalitis virus
GGLVTFRSPNG

SEQ ID NO: 209204 - protein, 11 aa, Tick-borne encephalitis virus
GLVTFRSPNGA

SEQ ID NO: 209205 - protein, 11 aa, Tick-borne encephalitis virus
RSPNGAERTLK

SEQ ID NO: 209206 - protein, 11 aa, Tick-borne encephalitis virus
GAERTLKPVWR

SEQ ID NO: 209207 - protein, 11 aa, Tick-borne encephalitis virus
AERTLKPVWRD

SEQ ID NO: 209208 - protein, 11 aa, Tick-borne encephalitis virus
ERTLKPVWRDA

SEQ ID NO: 209209 - protein, 11 aa, Tick-borne encephalitis virus
RTLKPVWRDAR

SEQ ID NO: 209210 - protein, 11 aa, Tick-borne encephalitis virus
TLKPVWRDARM

SEQ ID NO: 209211 - protein, 11 aa, Tick-borne encephalitis virus
LKPVWRDARMF

SEQ ID NO: 209212 - protein, 11 aa, Tick-borne encephalitis virus
KPVWRDARMFR

SEQ ID NO: 209213 - protein, 11 aa, Tick-borne encephalitis virus
FREGRDIREFI

SEQ ID NO: 209214 - protein, 11 aa, Tick-borne encephalitis virus
REGRDIREFIA

SEQ ID NO: 209215 - protein, 11 aa, Tick-borne encephalitis virus
EGRDIREFIAY

SEQ ID NO: 209216 - protein, 11 aa, Tick-borne encephalitis virus
GRDIREFIAYA

SEQ ID NO: 209217 - protein, 11 aa, Tick-borne encephalitis virus
RDIREFIAYAS

SEQ ID NO: 209218 - protein, 11 aa, Tick-borne encephalitis virus
DIREFIAYASG

SEQ ID NO: 209219 - protein, 11 aa, Tick-borne encephalitis virus
IREFIAYASGR

SEQ ID NO: 209220 - protein, 11 aa, Tick-borne encephalitis virus
REFIAYASGRR

SEQ ID NO: 209221 - protein, 11 aa, Tick-borne encephalitis virus
FIAYASGRRSF

SEQ ID NO: 209222 - protein, 11 aa, Tick-borne encephalitis virus
IAYASGRRSFG

SEQ ID NO: 209223 - protein, 11 aa, Tick-borne encephalitis virus
SGRRSIGDVLT

SEQ ID NO: 209224 - protein, 11 aa, Tick-borne encephalitis virus
GRRSIGDVLTG

SEQ ID NO: 209225 - protein, 11 aa, Tick-borne encephalitis virus
RRSIGDVLTGM

SEQ ID NO: 209226 - protein, 11 aa, Tick-borne encephalitis virus
RSIGDVLTGMS

SEQ ID NO: 209227 - protein, 11 aa, Tick-borne encephalitis virus
SIGDVLTGMSG

SEQ ID NO: 209228 - protein, 11 aa, Tick-borne encephalitis virus
IGDVLTGMSGV

SEQ ID NO: 209229 - protein, 11 aa, Tick-borne encephalitis virus
AMDVFYTLMHD

SEQ ID NO: 209230 - protein, 11 aa, Tick-borne encephalitis virus
LDVFYTLMHEK

SEQ ID NO: 209231 - protein, 11 aa, Tick-borne encephalitis virus
DVFYTLMHEKP

SEQ ID NO: 209232 - protein, 11 aa, Tick-borne encephalitis virus
VFYTLMHEKPD

SEQ ID NO: 209233 - protein, 11 aa, Tick-borne encephalitis virus
FYTLMHDEPGS

SEQ ID NO: 209234 - protein, 11 aa, Tick-borne encephalitis virus
YTLMHEKPDSR

SEQ ID NO: 209235 - protein, 11 aa, Tick-borne encephalitis virus
TLMHEKPDSRA

SEQ ID NO: 209236 - protein, 11 aa, Tick-borne encephalitis virus
LMHEKPDSRAM

SEQ ID NO: 209237 - protein, 11 aa, Tick-borne encephalitis virus
MHEKPDSRAMR

SEQ ID NO: 209238 - protein, 11 aa, Tick-borne encephalitis virus
HEKPDSRAMRM

SEQ ID NO: 209239 - protein, 11 aa, Tick-borne encephalitis virus
EKPDSRAMRMA

SEQ ID NO: 209240 - protein, 11 aa, Tick-borne encephalitis virus
KPDSRAMRMAE

SEQ ID NO: 209241 - protein, 11 aa, Tick-borne encephalitis virus
PDSRAMRMAER

SEQ ID NO: 209242 - protein, 11 aa, Tick-borne encephalitis virus
GSSAMRMAERD

SEQ ID NO: 209243 - protein, 11 aa, Tick-borne encephalitis virus
SSAMRMAERDA

SEQ ID NO: 209244 - protein, 11 aa, Tick-borne encephalitis virus
SAMRMAERDAP

SEQ ID NO: 209245 - protein, 11 aa, Tick-borne encephalitis virus
ERDAPEAFLTL

SEQ ID NO: 209246 - protein, 11 aa, Tick-borne encephalitis virus
RDAPEAFLTMA

SEQ ID NO: 209247 - protein, 11 aa, Tick-borne encephalitis virus
DAPEAFLTLVE

SEQ ID NO: 209248 - protein, 11 aa, Tick-borne encephalitis virus
VEVMVLGLATL

SEQ ID NO: 209249 - protein, 11 aa, Tick-borne encephalitis virus
EMMVLGLGTLG

SEQ ID NO: 209250 - protein, 11 aa, Tick-borne encephalitis virus
MLVLGLATLGV

SEQ ID NO: 209251 - protein, 11 aa, Tick-borne encephalitis virus
MVLGLGTLGVV

SEQ ID NO: 209252 - protein, 11 aa, Tick-borne encephalitis virus
VLGLGTLGVVW

SEQ ID NO: 209253 - protein, 11 aa, Tick-borne encephalitis virus
LGLGTLGVVWC

SEQ ID NO: 209254 - protein, 11 aa, Tick-borne encephalitis virus
GLGTLGVVWCF

SEQ ID NO: 209255 - protein, 11 aa, Tick-borne encephalitis virus
LGTLGVVWCFV

SEQ ID NO: 209256 - protein, 11 aa, Tick-borne encephalitis virus
ATLGVVWCFVA

SEQ ID NO: 209257 - protein, 11 aa, Tick-borne encephalitis virus
TLGVVWCFVAR

SEQ ID NO: 209258 - protein, 11 aa, Tick-borne encephalitis virus
LGVVWCFVART

SEQ ID NO: 209259 - protein, 11 aa, Tick-borne encephalitis virus
GVVWCFVARTS

SEQ ID NO: 209260 - protein, 11 aa, Tick-borne encephalitis virus
VVWCFVVRASI

SEQ ID NO: 209261 - protein, 11 aa, Tick-borne encephalitis virus
VWCFVARTSIS

SEQ ID NO: 209262 - protein, 11 aa, Tick-borne encephalitis virus
WCFVVRASISR

SEQ ID NO: 209263 - protein, 11 aa, Tick-borne encephalitis virus
CFVVRASISRM

SEQ ID NO: 209264 - protein, 11 aa, Tick-borne encephalitis virus
FVVRASISRMM

SEQ ID NO: 209265 - protein, 11 aa, Tick-borne encephalitis virus
VARTSISRMML

SEQ ID NO: 209266 - protein, 11 aa, Tick-borne encephalitis virus
ARTSISRMMLG

SEQ ID NO: 209267 - protein, 11 aa, Tick-borne encephalitis virus
LGTLVLLASLV

SEQ ID NO: 209268 - protein, 11 aa, Tick-borne encephalitis virus
GTLVLLASLVL

SEQ ID NO: 209269 - protein, 11 aa, Tick-borne encephalitis virus
TLVLLASLVLL

SEQ ID NO: 209270 - protein, 11 aa, Tick-borne encephalitis virus
LVLLASLVLLW

SEQ ID NO: 209271 - protein, 11 aa, Tick-borne encephalitis virus
VLLASLVLLWA

SEQ ID NO: 209272 - protein, 11 aa, Tick-borne encephalitis virus
LLASLVLLWAG

SEQ ID NO: 209273 - protein, 11 aa, Tick-borne encephalitis virus
LASLVLLWAGG

SEQ ID NO: 209274 - protein, 11 aa, Tick-borne encephalitis virus
ASLVLLWAGGV

SEQ ID NO: 209275 - protein, 11 aa, Tick-borne encephalitis virus
SLALLWAGGVG

SEQ ID NO: 209276 - protein, 11 aa, Tick-borne encephalitis virus
LALLWAGGVGY

SEQ ID NO: 209277 - protein, 11 aa, Tick-borne encephalitis virus
ALLWAGGVGYG

SEQ ID NO: 209278 - protein, 11 aa, Tick-borne encephalitis virus
VAANEMGLLER

SEQ ID NO: 209279 - protein, 11 aa, Tick-borne encephalitis virus
AANEMGLLERT

SEQ ID NO: 209280 - protein, 11 aa, Tick-borne encephalitis virus
ANEMGLLERTK

SEQ ID NO: 209281 - protein, 11 aa, Tick-borne encephalitis virus
NEMGLLERTKA

SEQ ID NO: 209282 - protein, 11 aa, Tick-borne encephalitis virus
EMGLLERTKAD

SEQ ID NO: 209283 - protein, 11 aa, Tick-borne encephalitis virus
MGLLERTKADL

SEQ ID NO: 209284 - protein, 11 aa, Tick-borne encephalitis virus
GLLERTKADLS

SEQ ID NO: 209285 - protein, 11 aa, Tick-borne encephalitis virus
FLEKTKADLSA

SEQ ID NO: 209286 - protein, 11 aa, Tick-borne encephalitis virus
LEKTKADLSTA

SEQ ID NO: 209287 - protein, 11 aa, Tick-borne encephalitis virus
EKTKADLSTAL

SEQ ID NO: 209288 - protein, 11 aa, Tick-borne encephalitis virus
KTKADLSTALW

SEQ ID NO: 209289 - protein, 11 aa, Tick-borne encephalitis virus
TKADLSAVLWS

SEQ ID NO: 209290 - protein, 11 aa, Tick-borne encephalitis virus
EPRSWGEWTNI

SEQ ID NO: 209291 - protein, 11 aa, Tick-borne encephalitis virus
PRSWGEWTNID

SEQ ID NO: 209292 - protein, 11 aa, Tick-borne encephalitis virus
RSWGEWTNIDI

SEQ ID NO: 209293 - protein, 11 aa, Tick-borne encephalitis virus
SWGEWTNIDIQ

SEQ ID NO: 209294 - protein, 11 aa, Tick-borne encephalitis virus
WGEWTNIDIQP

SEQ ID NO: 209295 - protein, 11 aa, Tick-borne encephalitis virus
GEWTNIDIQPA

SEQ ID NO: 209296 - protein, 11 aa, Tick-borne encephalitis virus
IQQLVNSAVVT

SEQ ID NO: 209297 - protein, 11 aa, Tick-borne encephalitis virus
QQLVNSAVVTG

SEQ ID NO: 209298 - protein, 11 aa, Tick-borne encephalitis virus
QLVNSAVVTGA

SEQ ID NO: 209299 - protein, 11 aa, Tick-borne encephalitis virus
LVNSAVVTGAQ

SEQ ID NO: 209300 - protein, 11 aa, Tick-borne encephalitis virus
VNSAVVTGAQA

SEQ ID NO: 209301 - protein, 11 aa, Tick-borne encephalitis virus
NSAVVTGAQAM

SEQ ID NO: 209302 - protein, 11 aa, Tick-borne encephalitis virus
SAVVTGAQAMR

SEQ ID NO: 209303 - protein, 11 aa, Tick-borne encephalitis virus
AVVTGAQAMRD

SEQ ID NO: 209304 - protein, 11 aa, Tick-borne encephalitis virus
VVTGAQAMRDL

SEQ ID NO: 209305 - protein, 11 aa, Tick-borne encephalitis virus
VTGAQAMRDLG

SEQ ID NO: 209306 - protein, 11 aa, Tick-borne encephalitis virus
MRDLGGGAPFL

SEQ ID NO: 209307 - protein, 11 aa, Tick-borne encephalitis virus
RDLGGGAPFIG

SEQ ID NO: 209308 - protein, 11 aa, Tick-borne encephalitis virus
DLGGGAPFFGI

SEQ ID NO: 209309 - protein, 11 aa, Tick-borne encephalitis virus
LGGGAPFLGVA

SEQ ID NO: 209310 - protein, 11 aa, Tick-borne encephalitis virus
GGGAPFFGIAG

SEQ ID NO: 209311 - protein, 11 aa, Tick-borne encephalitis virus
GGAPFFGIAGH

SEQ ID NO: 209312 - protein, 11 aa, Tick-borne encephalitis virus
GAPFIGVAGHV

SEQ ID NO: 209313 - protein, 11 aa, Tick-borne encephalitis virus
GVAGHVVALGV

SEQ ID NO: 209314 - protein, 11 aa, Tick-borne encephalitis virus
VAGHVVALGVV

SEQ ID NO: 209315 - protein, 11 aa, Tick-borne encephalitis virus
AGHVVALGVVS

SEQ ID NO: 209316 - protein, 11 aa, Tick-borne encephalitis virus
GHVVALGVVSL

SEQ ID NO: 209317 - protein, 11 aa, Tick-borne encephalitis virus
HVVALGVVSLV

SEQ ID NO: 209318 - protein, 11 aa, Tick-borne encephalitis virus
VVALGVVSLVG

SEQ ID NO: 209319 - protein, 11 aa, Tick-borne encephalitis virus
VALGVVSLVGA

SEQ ID NO: 209320 - protein, 11 aa, Tick-borne encephalitis virus
SLGVVSLVGAT

SEQ ID NO: 209321 - protein, 11 aa, Tick-borne encephalitis virus
SLMVGVGLAAF

SEQ ID NO: 209322 - protein, 11 aa, Tick-borne encephalitis virus
LMVGVGLAAFH

SEQ ID NO: 209323 - protein, 11 aa, Tick-borne encephalitis virus
MVGVGLAAFHL

SEQ ID NO: 209324 - protein, 11 aa, Tick-borne encephalitis virus
DVIYPFGEGET

SEQ ID NO: 209325 - protein, 11 aa, Tick-borne encephalitis virus
VIYPFGEGETK

SEQ ID NO: 209326 - protein, 11 aa, Tick-borne encephalitis virus
IYPFGEGETKP

SEQ ID NO: 209327 - protein, 11 aa, Tick-borne encephalitis virus
YPFGEGETKPA

SEQ ID NO: 209328 - protein, 11 aa, Tick-borne encephalitis virus
GEAKPALYERR

SEQ ID NO: 209329 - protein, 11 aa, Tick-borne encephalitis virus
EAKPALYERRM

SEQ ID NO: 209330 - protein, 11 aa, Tick-borne encephalitis virus
AKPALYERRMS

SEQ ID NO: 209331 - protein, 11 aa, Tick-borne encephalitis virus
YERKMSLVLAT

SEQ ID NO: 209332 - protein, 11 aa, Tick-borne encephalitis virus
MSLVLAVVLCL

SEQ ID NO: 209333 - protein, 11 aa, Tick-borne encephalitis virus
VLCLMAVVMNR

SEQ ID NO: 209334 - protein, 11 aa, Tick-borne encephalitis virus
LCLISVVMNRT

SEQ ID NO: 209335 - protein, 11 aa, Tick-borne encephalitis virus
CLISVVMNRTV

SEQ ID NO: 209336 - protein, 11 aa, Tick-borne encephalitis virus
AVVMNRTVASI

SEQ ID NO: 209337 - protein, 11 aa, Tick-borne encephalitis virus
VVMNRTVLSIT

SEQ ID NO: 209338 - protein, 11 aa, Tick-borne encephalitis virus
VMNRTVLSITE

SEQ ID NO: 209339 - protein, 11 aa, Tick-borne encephalitis virus
MNRTVLSITEA

SEQ ID NO: 209340 - protein, 11 aa, Tick-borne encephalitis virus
NRTVPSITEAA

SEQ ID NO: 209341 - protein, 11 aa, Tick-borne encephalitis virus
RTVPSITEAAA

SEQ ID NO: 209342 - protein, 11 aa, Tick-borne encephalitis virus
TVPSITEAAAV

SEQ ID NO: 209343 - protein, 11 aa, Tick-borne encephalitis virus
VPSITEAAAVG

SEQ ID NO: 209344 - protein, 11 aa, Tick-borne encephalitis virus
PSITEAAAVGL

SEQ ID NO: 209345 - protein, 11 aa, Tick-borne encephalitis virus
TEASAVGLAAL

SEQ ID NO: 209346 - protein, 11 aa, Tick-borne encephalitis virus
EAAAVGLAAAG

SEQ ID NO: 209347 - protein, 11 aa, Tick-borne encephalitis virus
AAAVGLAAAGQ

SEQ ID NO: 209348 - protein, 11 aa, Tick-borne encephalitis virus
SAVGLAALGQL

SEQ ID NO: 209349 - protein, 11 aa, Tick-borne encephalitis virus
AVGLAALGQLL

SEQ ID NO: 209350 - protein, 11 aa, Tick-borne encephalitis virus
VGLAAAGQLLS

SEQ ID NO: 209351 - protein, 11 aa, Tick-borne encephalitis virus
GLAAAGQLLSP

SEQ ID NO: 209352 - protein, 11 aa, Tick-borne encephalitis virus
LAAAGQLLSPE

SEQ ID NO: 209353 - protein, 11 aa, Tick-borne encephalitis virus
GQLLSPEADTL

SEQ ID NO: 209354 - protein, 11 aa, Tick-borne encephalitis virus
QLLSPEADTLW

SEQ ID NO: 209355 - protein, 11 aa, Tick-borne encephalitis virus
LLSPEADTLWT

SEQ ID NO: 209356 - protein, 11 aa, Tick-borne encephalitis virus
LSPEADTLWTM

SEQ ID NO: 209357 - protein, 11 aa, Tick-borne encephalitis virus
SPEADTLWTMP

SEQ ID NO: 209358 - protein, 11 aa, Tick-borne encephalitis virus
PEEDTLWTMPV

SEQ ID NO: 209359 - protein, 11 aa, Tick-borne encephalitis virus
EEDTLWTMPVA

SEQ ID NO: 209360 - protein, 11 aa, Tick-borne encephalitis virus
EDTLWTMPVAC

SEQ ID NO: 209361 - protein, 11 aa, Tick-borne encephalitis virus
WTMPVACGLSS

SEQ ID NO: 209362 - protein, 11 aa, Tick-borne encephalitis virus
TMPVACGLSSV

SEQ ID NO: 209363 - protein, 11 aa, Tick-borne encephalitis virus
MPVACGLSSVV

SEQ ID NO: 209364 - protein, 11 aa, Tick-borne encephalitis virus
PVACGLSSVVR

SEQ ID NO: 209365 - protein, 11 aa, Tick-borne encephalitis virus
VACGLSSVVRG

SEQ ID NO: 209366 - protein, 11 aa, Tick-borne encephalitis virus
ACGLSSVVRGS

SEQ ID NO: 209367 - protein, 11 aa, Tick-borne encephalitis virus
CGLSSVVRGSL

SEQ ID NO: 209368 - protein, 11 aa, Tick-borne encephalitis virus
GLSSVVRGSLW

SEQ ID NO: 209369 - protein, 11 aa, Tick-borne encephalitis virus
LSSVVRGSLWG

SEQ ID NO: 209370 - protein, 11 aa, Tick-borne encephalitis virus
SGVVTGSLWGF

SEQ ID NO: 209371 - protein, 11 aa, Tick-borne encephalitis virus
GVVTGSLWGFL

SEQ ID NO: 209372 - protein, 11 aa, Tick-borne encephalitis virus
LRASGSRRGGA

SEQ ID NO: 209373 - protein, 11 aa, Tick-borne encephalitis virus
RASGSRRGGAE

SEQ ID NO: 209374 - protein, 11 aa, Tick-borne encephalitis virus
ASGSRRGGAEG

SEQ ID NO: 209375 - protein, 11 aa, Tick-borne encephalitis virus
SGSRRGGAEGD

SEQ ID NO: 209376 - protein, 11 aa, Tick-borne encephalitis virus
GSRRGGAEGDT

SEQ ID NO: 209377 - protein, 11 aa, Tick-borne encephalitis virus
SRRGGAEGDTL

SEQ ID NO: 209378 - protein, 11 aa, Tick-borne encephalitis virus
RRGGSDGDTLG

SEQ ID NO: 209379 - protein, 11 aa, Tick-borne encephalitis virus
RGGSDGDTLGD

SEQ ID NO: 209380 - protein, 11 aa, Tick-borne encephalitis virus
GGSDGDTLGDL

SEQ ID NO: 209381 - protein, 11 aa, Tick-borne encephalitis virus
GSDGDTLGDLW

SEQ ID NO: 209382 - protein, 11 aa, Tick-borne encephalitis virus
SDGDTLGDLWK

SEQ ID NO: 209383 - protein, 11 aa, Tick-borne encephalitis virus
DGDTLGDLWKR

SEQ ID NO: 209384 - protein, 11 aa, Tick-borne encephalitis virus
GDTLGDLWKQR

SEQ ID NO: 209385 - protein, 11 aa, Tick-borne encephalitis virus
DTLGDLWKQRL

SEQ ID NO: 209386 - protein, 11 aa, Tick-borne encephalitis virus
TLGDLWKQRLN

SEQ ID NO: 209387 - protein, 11 aa, Tick-borne encephalitis virus
LNSCTKEEFFV

SEQ ID NO: 209388 - protein, 11 aa, Tick-borne encephalitis virus
NSCTKEEFFVY

SEQ ID NO: 209389 - protein, 11 aa, Tick-borne encephalitis virus
SCTKEEFFVYR

SEQ ID NO: 209390 - protein, 11 aa, Tick-borne encephalitis virus
CTKEEFFVYRR

SEQ ID NO: 209391 - protein, 11 aa, Tick-borne encephalitis virus
EEFFVYRRAGI

SEQ ID NO: 209392 - protein, 11 aa, Tick-borne encephalitis virus
EFFIYRRTGIL

SEQ ID NO: 209393 - protein, 11 aa, Tick-borne encephalitis virus
FFVYRRAGILE

SEQ ID NO: 209394 - protein, 11 aa, Tick-borne encephalitis virus
FVYRRAGILET

SEQ ID NO: 209395 - protein, 11 aa, Tick-borne encephalitis virus
VYRRTGIMETE

SEQ ID NO: 209396 - protein, 11 aa, Tick-borne encephalitis virus
YRRTGIMETER

SEQ ID NO: 209397 - protein, 11 aa, Tick-borne encephalitis virus
RRTGIMETERD

SEQ ID NO: 209398 - protein, 11 aa, Tick-borne encephalitis virus
RAGILETERDK

SEQ ID NO: 209399 - protein, 11 aa, Tick-borne encephalitis virus
AGILETERDKA

SEQ ID NO: 209400 - protein, 11 aa, Tick-borne encephalitis virus
GILETERDRAR

SEQ ID NO: 209401 - protein, 11 aa, Tick-borne encephalitis virus
ILETERDRARE

SEQ ID NO: 209402 - protein, 11 aa, Tick-borne encephalitis virus
METERDKAREL

SEQ ID NO: 209403 - protein, 11 aa, Tick-borne encephalitis virus
TERDRARELLR

SEQ ID NO: 209404 - protein, 11 aa, Tick-borne encephalitis virus
ERDKARELLKK

SEQ ID NO: 209405 - protein, 11 aa, Tick-borne encephalitis virus
RDRARELLRRG

SEQ ID NO: 209406 - protein, 11 aa, Tick-borne encephalitis virus
DRARELLRRGE

SEQ ID NO: 209407 - protein, 11 aa, Tick-borne encephalitis virus
KARELLKKGET

SEQ ID NO: 209408 - protein, 11 aa, Tick-borne encephalitis virus
ARELLKRGETN

SEQ ID NO: 209409 - protein, 11 aa, Tick-borne encephalitis virus
KGETNMGLAVS

SEQ ID NO: 209410 - protein, 11 aa, Tick-borne encephalitis virus
GETNVGLAVSR

SEQ ID NO: 209411 - protein, 11 aa, Tick-borne encephalitis virus
ETNVGLAVSRG

SEQ ID NO: 209412 - protein, 11 aa, Tick-borne encephalitis virus
TNVGLAVSRGT

SEQ ID NO: 209413 - protein, 11 aa, Tick-borne encephalitis virus
NVGLAVSRGTA

SEQ ID NO: 209414 - protein, 11 aa, Tick-borne encephalitis virus
VGLAVSRGTAK

SEQ ID NO: 209415 - protein, 11 aa, Tick-borne encephalitis virus
YYAASRPAVMN

SEQ ID NO: 209416 - protein, 11 aa, Tick-borne encephalitis virus
YAASRPAVMNV

SEQ ID NO: 209417 - protein, 11 aa, Tick-borne encephalitis virus
AASRPAVMNVR

SEQ ID NO: 209418 - protein, 11 aa, Tick-borne encephalitis virus
ASRPSVMSVKA

SEQ ID NO: 209419 - protein, 11 aa, Tick-borne encephalitis virus
SRPSVMSVKAY

SEQ ID NO: 209420 - protein, 11 aa, Tick-borne encephalitis virus
RPSVMSVKAYT

SEQ ID NO: 209421 - protein, 11 aa, Tick-borne encephalitis virus
PSVMSVKAYTI

SEQ ID NO: 209422 - protein, 11 aa, Tick-borne encephalitis virus
SVMSVKAYTIG

SEQ ID NO: 209423 - protein, 11 aa, Tick-borne encephalitis virus
VMNVRAYTIGG

SEQ ID NO: 209424 - protein, 11 aa, Tick-borne encephalitis virus
MSVRAYTIGGK

SEQ ID NO: 209425 - protein, 11 aa, Tick-borne encephalitis virus
SVRAYTIGGKG

SEQ ID NO: 209426 - protein, 11 aa, Tick-borne encephalitis virus
VRAYTIGGKGH

SEQ ID NO: 209427 - protein, 11 aa, Tick-borne encephalitis virus
RAYTIGGKGHE

SEQ ID NO: 209428 - protein, 11 aa, Tick-borne encephalitis virus
AYTIGGKGHEA

SEQ ID NO: 209429 - protein, 11 aa, Tick-borne encephalitis virus
YTIGGKGHEAP

SEQ ID NO: 209430 - protein, 11 aa, Tick-borne encephalitis virus
TIGGKGHEAPK

SEQ ID NO: 209431 - protein, 11 aa, Tick-borne encephalitis virus
IGGKGHEAPKM

SEQ ID NO: 209432 - protein, 11 aa, Tick-borne encephalitis virus
GGKGHEAPKMV

SEQ ID NO: 209433 - protein, 11 aa, Tick-borne encephalitis virus
GKGHEAPKMVT

SEQ ID NO: 209434 - protein, 11 aa, Tick-borne encephalitis virus
KGHEAPKMVTS

SEQ ID NO: 209435 - protein, 11 aa, Tick-borne encephalitis virus
GHETPRMVTSL

SEQ ID NO: 209436 - protein, 11 aa, Tick-borne encephalitis virus
HETPRMVTSLG

SEQ ID NO: 209437 - protein, 11 aa, Tick-borne encephalitis virus
ETPRMVTSLGW

SEQ ID NO: 209438 - protein, 11 aa, Tick-borne encephalitis virus
TPRMVTSLGWN

SEQ ID NO: 209439 - protein, 11 aa, Tick-borne encephalitis virus
GWNLIKFRAGV

SEQ ID NO: 209440 - protein, 11 aa, Tick-borne encephalitis virus
WNLIKFRAGVD

SEQ ID NO: 209441 - protein, 11 aa, Tick-borne encephalitis virus
NLIKFRAGVDV

SEQ ID NO: 209442 - protein, 11 aa, Tick-borne encephalitis virus
LIKFRAGVDVF

SEQ ID NO: 209443 - protein, 11 aa, Tick-borne encephalitis virus
IKFRAGVDVFS

SEQ ID NO: 209444 - protein, 11 aa, Tick-borne encephalitis virus
KFRAGVDVFSM

SEQ ID NO: 209445 - protein, 11 aa, Tick-borne encephalitis virus
FRAGVDVFSMQ

SEQ ID NO: 209446 - protein, 11 aa, Tick-borne encephalitis virus
RAGVDVFSMQP

SEQ ID NO: 209447 - protein, 11 aa, Tick-borne encephalitis virus
AGVDVFSMQPH

SEQ ID NO: 209448 - protein, 11 aa, Tick-borne encephalitis virus
DTIMCDIGESS

SEQ ID NO: 209449 - protein, 11 aa, Tick-borne encephalitis virus
TIMCDIGESSP

SEQ ID NO: 209450 - protein, 11 aa, Tick-borne encephalitis virus
IMCDIGESSPD

SEQ ID NO: 209451 - protein, 11 aa, Tick-borne encephalitis virus
CDIGESNPDAA

SEQ ID NO: 209452 - protein, 11 aa, Tick-borne encephalitis virus
DIGESNPDAAV

SEQ ID NO: 209453 - protein, 11 aa, Tick-borne encephalitis virus
IGESNPDAAVE

SEQ ID NO: 209454 - protein, 11 aa, Tick-borne encephalitis virus
GESNPDAAVEG

SEQ ID NO: 209455 - protein, 11 aa, Tick-borne encephalitis virus
ESNPDAAVEGE

SEQ ID NO: 209456 - protein, 11 aa, Tick-borne encephalitis virus
SNPDAAVEGER

SEQ ID NO: 209457 - protein, 11 aa, Tick-borne encephalitis virus
NPDAAVEGERT

SEQ ID NO: 209458 - protein, 11 aa, Tick-borne encephalitis virus
PDAVVEGEKTR

SEQ ID NO: 209459 - protein, 11 aa, Tick-borne encephalitis virus
DAAVEGERTRR

SEQ ID NO: 209460 - protein, 11 aa, Tick-borne encephalitis virus
AAVEGERTRRV

SEQ ID NO: 209461 - protein, 11 aa, Tick-borne encephalitis virus
AVEGERTRRVI

SEQ ID NO: 209462 - protein, 11 aa, Tick-borne encephalitis virus
VEGEKTRKVIL

SEQ ID NO: 209463 - protein, 11 aa, Tick-borne encephalitis virus
EGEKTRKVILL

SEQ ID NO: 209464 - protein, 11 aa, Tick-borne encephalitis virus
GEKTRKVILLM

SEQ ID NO: 209465 - protein, 11 aa, Tick-borne encephalitis virus
EKTRKVILLME

SEQ ID NO: 209466 - protein, 11 aa, Tick-borne encephalitis virus
KTRKVILLMEQ

SEQ ID NO: 209467 - protein, 11 aa, Tick-borne encephalitis virus
RVILLMEQWKI

SEQ ID NO: 209468 - protein, 11 aa, Tick-borne encephalitis virus
LMEQWKIRNPT

SEQ ID NO: 209469 - protein, 11 aa, Tick-borne encephalitis virus
MEQWKNRNPAA

SEQ ID NO: 209470 - protein, 11 aa, Tick-borne encephalitis virus
EQWKNRNPAAA

SEQ ID NO: 209471 - protein, 11 aa, Tick-borne encephalitis virus
QWKIRNPTATC

SEQ ID NO: 209472 - protein, 11 aa, Tick-borne encephalitis virus
WKNRNPAAACV

SEQ ID NO: 209473 - protein, 11 aa, Tick-borne encephalitis virus
KNRNPAAACVF

SEQ ID NO: 209474 - protein, 11 aa, Tick-borne encephalitis virus
IRNPTATCVFK

SEQ ID NO: 209475 - protein, 11 aa, Tick-borne encephalitis virus
RNPAAACVFKV

SEQ ID NO: 209476 - protein, 11 aa, Tick-borne encephalitis virus
NPAAACVFKVL

SEQ ID NO: 209477 - protein, 11 aa, Tick-borne encephalitis virus
PAAACVFKVLA

SEQ ID NO: 209478 - protein, 11 aa, Tick-borne encephalitis virus
AAACVFKVLAP

SEQ ID NO: 209479 - protein, 11 aa, Tick-borne encephalitis virus
LAPYRPEVIET

SEQ ID NO: 209480 - protein, 11 aa, Tick-borne encephalitis virus
APYRPEVIETL

SEQ ID NO: 209481 - protein, 11 aa, Tick-borne encephalitis virus
PYRPEVIETLH

SEQ ID NO: 209482 - protein, 11 aa, Tick-borne encephalitis virus
YRPEVIETLHR

SEQ ID NO: 209483 - protein, 11 aa, Tick-borne encephalitis virus
RPKVIEALHRF

SEQ ID NO: 209484 - protein, 11 aa, Tick-borne encephalitis virus
PKVIEALHRFQ

SEQ ID NO: 209485 - protein, 11 aa, Tick-borne encephalitis virus
KVIEALHRFQL

SEQ ID NO: 209486 - protein, 11 aa, Tick-borne encephalitis virus
VIEALHRFQLK

SEQ ID NO: 209487 - protein, 11 aa, Tick-borne encephalitis virus
IEALHRFQLKW

SEQ ID NO: 209488 - protein, 11 aa, Tick-borne encephalitis virus
EALHRFQLKWG

SEQ ID NO: 209489 - protein, 11 aa, Tick-borne encephalitis virus
ALHRFQLKWGG

SEQ ID NO: 209490 - protein, 11 aa, Tick-borne encephalitis virus
LHRFQLKWGGG

SEQ ID NO: 209491 - protein, 11 aa, Tick-borne encephalitis virus
HRFQLKWGGGL

SEQ ID NO: 209492 - protein, 11 aa, Tick-borne encephalitis virus
RFQLKWGGGLV

SEQ ID NO: 209493 - protein, 11 aa, Tick-borne encephalitis virus
FQLKWGGGLVR

SEQ ID NO: 209494 - protein, 11 aa, Tick-borne encephalitis virus
QLKWGGGLVRT

SEQ ID NO: 209495 - protein, 11 aa, Tick-borne encephalitis virus
LKWGGGLVRTP

SEQ ID NO: 209496 - protein, 11 aa, Tick-borne encephalitis virus
KWGGGLVRTPF

SEQ ID NO: 209497 - protein, 11 aa, Tick-borne encephalitis virus
STHKVYYSTAV

SEQ ID NO: 209498 - protein, 11 aa, Tick-borne encephalitis virus
THKVYYSTAVT

SEQ ID NO: 209499 - protein, 11 aa, Tick-borne encephalitis virus
HEMYYSTAITG

SEQ ID NO: 209500 - protein, 11 aa, Tick-borne encephalitis virus
EMYYSTAITGN

SEQ ID NO: 209501 - protein, 11 aa, Tick-borne encephalitis virus
MYYSTAITGNI

SEQ ID NO: 209502 - protein, 11 aa, Tick-borne encephalitis virus
ITGNIVNSVNV

SEQ ID NO: 209503 - protein, 11 aa, Tick-borne encephalitis virus
IQSRKLLARFA

SEQ ID NO: 209504 - protein, 11 aa, Tick-borne encephalitis virus
ARFAGQRGPTR

SEQ ID NO: 209505 - protein, 11 aa, Tick-borne encephalitis virus
RFAGQRGPTRV

SEQ ID NO: 209506 - protein, 11 aa, Tick-borne encephalitis virus
FAGQRGPTRVP

SEQ ID NO: 209507 - protein, 11 aa, Tick-borne encephalitis virus
AGQRGPTRVPE

SEQ ID NO: 209508 - protein, 11 aa, Tick-borne encephalitis virus
GQRGPTRVPEL

SEQ ID NO: 209509 - protein, 11 aa, Tick-borne encephalitis virus
PTKVPELDLGV

SEQ ID NO: 209510 - protein, 11 aa, Tick-borne encephalitis virus
TKVPELDLGVG

SEQ ID NO: 209511 - protein, 11 aa, Tick-borne encephalitis virus
KVPELDLGVGT

SEQ ID NO: 209512 - protein, 11 aa, Tick-borne encephalitis virus
LDLGVGTRCVF

SEQ ID NO: 209513 - protein, 11 aa, Tick-borne encephalitis virus
DLGVGTRCVFL

SEQ ID NO: 209514 - protein, 11 aa, Tick-borne encephalitis virus
LGVGTRCVFLA

SEQ ID NO: 209515 - protein, 11 aa, Tick-borne encephalitis virus
GVGTRCVFLAE

SEQ ID NO: 209516 - protein, 11 aa, Tick-borne encephalitis virus
VGTRCVVLADD

SEQ ID NO: 209517 - protein, 11 aa, Tick-borne encephalitis virus
GTRCVVLADDK

SEQ ID NO: 209518 - protein, 11 aa, Tick-borne encephalitis virus
TRCVFLAEDKV

SEQ ID NO: 209519 - protein, 11 aa, Tick-borne encephalitis virus
RCVVLAEDKVR

SEQ ID NO: 209520 - protein, 11 aa, Tick-borne encephalitis virus
CVVLAEDKVRE

SEQ ID NO: 209521 - protein, 11 aa, Tick-borne encephalitis virus
LAEDRVREKDV

SEQ ID NO: 209522 - protein, 11 aa, Tick-borne encephalitis virus
DRVREKDVQER

SEQ ID NO: 209523 - protein, 11 aa, Tick-borne encephalitis virus
RVREKDVQERI

SEQ ID NO: 209524 - protein, 11 aa, Tick-borne encephalitis virus
ALKEQYGETWH

SEQ ID NO: 209525 - protein, 11 aa, Tick-borne encephalitis virus
DGEHPYRTWQY

SEQ ID NO: 209526 - protein, 11 aa, Tick-borne encephalitis virus
GEHPYRTWQYW

SEQ ID NO: 209527 - protein, 11 aa, Tick-borne encephalitis virus
TPAWQQRVFKK

SEQ ID NO: 209528 - protein, 11 aa, Tick-borne encephalitis virus
PAWQQRVFKKN

SEQ ID NO: 209529 - protein, 11 aa, Tick-borne encephalitis virus
AWQQRVFKKNA

SEQ ID NO: 209530 - protein, 11 aa, Tick-borne encephalitis virus
WQQRVFKKNAD

SEQ ID NO: 209531 - protein, 11 aa, Tick-borne encephalitis virus
QQRVFKKNADT

SEQ ID NO: 209532 - protein, 11 aa, Tick-borne encephalitis virus
QRVFKKNADTK

SEQ ID NO: 209533 - protein, 11 aa, Tick-borne encephalitis virus
RVFKKNADTKA

SEQ ID NO: 209534 - protein, 11 aa, Tick-borne encephalitis virus
VFKKNADTKAQ

SEQ ID NO: 209535 - protein, 11 aa, Tick-borne encephalitis virus
FKKNADTKAQE

SEQ ID NO: 209536 - protein, 11 aa, Tick-borne encephalitis virus
KKNADTKAQEP

SEQ ID NO: 209537 - protein, 11 aa, Tick-borne encephalitis virus
KNADTKAQEPQ

SEQ ID NO: 209538 - protein, 11 aa, Tick-borne encephalitis virus
KVIMRAVNDWM

SEQ ID NO: 209539 - protein, 11 aa, Tick-borne encephalitis virus
VNDWMLDRLAQ

SEQ ID NO: 209540 - protein, 11 aa, Tick-borne encephalitis virus
NDWILERLAQR

SEQ ID NO: 209541 - protein, 11 aa, Tick-borne encephalitis virus
DWILERLARKN

SEQ ID NO: 209542 - protein, 11 aa, Tick-borne encephalitis virus
NSRIHSKEEFI

SEQ ID NO: 209543 - protein, 11 aa, Tick-borne encephalitis virus
SRIHSKEEFIA

SEQ ID NO: 209544 - protein, 11 aa, Tick-borne encephalitis virus
RIHSKEEFIAK

SEQ ID NO: 209545 - protein, 11 aa, Tick-borne encephalitis virus
IHSKEEFIAKV

SEQ ID NO: 209546 - protein, 11 aa, Tick-borne encephalitis virus
HSKEEFIAKVK

SEQ ID NO: 209547 - protein, 11 aa, Tick-borne encephalitis virus
SKEEFIAKVRS

SEQ ID NO: 209548 - protein, 11 aa, Tick-borne encephalitis virus
KEEFIAKVRSN

SEQ ID NO: 209549 - protein, 11 aa, Tick-borne encephalitis virus
EEFIAKVKSSA

SEQ ID NO: 209550 - protein, 11 aa, Tick-borne encephalitis virus
EFIAKVRSNAA

SEQ ID NO: 209551 - protein, 11 aa, Tick-borne encephalitis virus
FIAKVRSNAAL

SEQ ID NO: 209552 - protein, 11 aa, Tick-borne encephalitis virus
IAKVRSNAALG

SEQ ID NO: 209553 - protein, 11 aa, Tick-borne encephalitis virus
AKVRSNAALGA

SEQ ID NO: 209554 - protein, 11 aa, Tick-borne encephalitis virus
KVKSSAALGAW

SEQ ID NO: 209555 - protein, 11 aa, Tick-borne encephalitis virus
VRSNAALGAWS

SEQ ID NO: 209556 - protein, 11 aa, Tick-borne encephalitis virus
KSSAALGAWSD

SEQ ID NO: 209557 - protein, 11 aa, Tick-borne encephalitis virus
SNAALGAWSEE

SEQ ID NO: 209558 - protein, 11 aa, Tick-borne encephalitis virus
SAALGAWSDEQ

SEQ ID NO: 209559 - protein, 11 aa, Tick-borne encephalitis virus
AALGAWSEEQN

SEQ ID NO: 209560 - protein, 11 aa, Tick-borne encephalitis virus
ALGAWSEEQNR

SEQ ID NO: 209561 - protein, 11 aa, Tick-borne encephalitis virus
LGAWSEEQNRW

SEQ ID NO: 209562 - protein, 11 aa, Tick-borne encephalitis virus
GAWSNEQNRWS

SEQ ID NO: 209563 - protein, 11 aa, Tick-borne encephalitis virus
NAKEAVEDPVF

SEQ ID NO: 209564 - protein, 11 aa, Tick-borne encephalitis virus
AKEAVEDPVFW

SEQ ID NO: 209565 - protein, 11 aa, Tick-borne encephalitis virus
EAVEDPVFWQL

SEQ ID NO: 209566 - protein, 11 aa, Tick-borne encephalitis virus
AVEDPVFWQLV

SEQ ID NO: 209567 - protein, 11 aa, Tick-borne encephalitis virus
VEDPVFWQLVD

SEQ ID NO: 209568 - protein, 11 aa, Tick-borne encephalitis virus
EDPVFWQLVDE

SEQ ID NO: 209569 - protein, 11 aa, Tick-borne encephalitis virus
DPVFWQLVDEE

SEQ ID NO: 209570 - protein, 11 aa, Tick-borne encephalitis virus
PVFWQLVDEER

SEQ ID NO: 209571 - protein, 11 aa, Tick-borne encephalitis virus
VFWQLVDEERE

SEQ ID NO: 209572 - protein, 11 aa, Tick-borne encephalitis virus
FWRLVDEERER

SEQ ID NO: 209573 - protein, 11 aa, Tick-borne encephalitis virus
WRLVDEERERH

SEQ ID NO: 209574 - protein, 11 aa, Tick-borne encephalitis virus
RLVDEERERHL

SEQ ID NO: 209575 - protein, 11 aa, Tick-borne encephalitis virus
LVDEERERDLA

SEQ ID NO: 209576 - protein, 11 aa, Tick-borne encephalitis virus
VDEERERDLAG

SEQ ID NO: 209577 - protein, 11 aa, Tick-borne encephalitis virus
DEERERHLTGR

SEQ ID NO: 209578 - protein, 11 aa, Tick-borne encephalitis virus
EERERDLAGRS

SEQ ID NO: 209579 - protein, 11 aa, Tick-borne encephalitis virus
ERERDLAGRSA

SEQ ID NO: 209580 - protein, 11 aa, Tick-borne encephalitis virus
RERHLTGRCAH

SEQ ID NO: 209581 - protein, 11 aa, Tick-borne encephalitis virus
ERHLTGRCAHC

SEQ ID NO: 209582 - protein, 11 aa, Tick-borne encephalitis virus
RDLAGRSAHGV

SEQ ID NO: 209583 - protein, 11 aa, Tick-borne encephalitis virus
GRSAHGVFNIM

SEQ ID NO: 209584 - protein, 11 aa, Tick-borne encephalitis virus
RSAHGVFNIMG

SEQ ID NO: 209585 - protein, 11 aa, Tick-borne encephalitis virus
CAHCAYNMMGK

SEQ ID NO: 209586 - protein, 11 aa, Tick-borne encephalitis virus
AHGVFNIMGKR

SEQ ID NO: 209587 - protein, 11 aa, Tick-borne encephalitis virus
HCAYNMMGKRE

SEQ ID NO: 209588 - protein, 11 aa, Tick-borne encephalitis virus
GVFNIMGKREK

SEQ ID NO: 209589 - protein, 11 aa, Tick-borne encephalitis virus
VFNIMGKREKK

SEQ ID NO: 209590 - protein, 11 aa, Tick-borne encephalitis virus
FNIMGKREKKL

SEQ ID NO: 209591 - protein, 11 aa, Tick-borne encephalitis virus
LNEDHWASRGF

SEQ ID NO: 209592 - protein, 11 aa, Tick-borne encephalitis virus
NEDHWASRGFS

SEQ ID NO: 209593 - protein, 11 aa, Tick-borne encephalitis virus
EDHWASRGFSG

SEQ ID NO: 209594 - protein, 11 aa, Tick-borne encephalitis virus
DHWASRGSSGA

SEQ ID NO: 209595 - protein, 11 aa, Tick-borne encephalitis virus
HWASRGSSGAG

SEQ ID NO: 209596 - protein, 11 aa, Tick-borne encephalitis virus
WASRGSSGAGV

SEQ ID NO: 209597 - protein, 11 aa, Tick-borne encephalitis virus
ASRGFSGSGVE

SEQ ID NO: 209598 - protein, 11 aa, Tick-borne encephalitis virus
SRESSGSGVEG

SEQ ID NO: 209599 - protein, 11 aa, Tick-borne encephalitis virus
RGFSGSGVEGI

SEQ ID NO: 209600 - protein, 11 aa, Tick-borne encephalitis virus
GSSGAGVEGIS

SEQ ID NO: 209601 - protein, 11 aa, Tick-borne encephalitis virus
FSGSGVEGISL

SEQ ID NO: 209602 - protein, 11 aa, Tick-borne encephalitis virus
SLNYLGWHLKG

SEQ ID NO: 209603 - protein, 11 aa, Tick-borne encephalitis virus
LNYLGWHLKGL

SEQ ID NO: 209604 - protein, 11 aa, Tick-borne encephalitis virus
NYLGWHLKGLS

SEQ ID NO: 209605 - protein, 11 aa, Tick-borne encephalitis virus
LSILEGGLFYA

SEQ ID NO: 209606 - protein, 11 aa, Tick-borne encephalitis virus
SILEGGLFYAD

SEQ ID NO: 209607 - protein, 11 aa, Tick-borne encephalitis virus
ILEGGLFYADD

SEQ ID NO: 209608 - protein, 11 aa, Tick-borne encephalitis virus
PEGGLFYADDT

SEQ ID NO: 209609 - protein, 11 aa, Tick-borne encephalitis virus
QILRYMEGEHR

SEQ ID NO: 209610 - protein, 11 aa, Tick-borne encephalitis virus
ILRYMEGEHRQ

SEQ ID NO: 209611 - protein, 11 aa, Tick-borne encephalitis virus
YMEGEHRQLAA

SEQ ID NO: 209612 - protein, 11 aa, Tick-borne encephalitis virus
MEGEHRQLAAT

SEQ ID NO: 209613 - protein, 11 aa, Tick-borne encephalitis virus
EGEHRQLAATI

SEQ ID NO: 209614 - protein, 11 aa, Tick-borne encephalitis virus
GEHRQLAATIM

SEQ ID NO: 209615 - protein, 11 aa, Tick-borne encephalitis virus
EHRQLAATIMQ

SEQ ID NO: 209616 - protein, 11 aa, Tick-borne encephalitis virus
HRQLAATIMQK

SEQ ID NO: 209617 - protein, 11 aa, Tick-borne encephalitis virus
RQLAATIMQKA

SEQ ID NO: 209618 - protein, 11 aa, Tick-borne encephalitis virus
QLAATVMQKAY

SEQ ID NO: 209619 - protein, 11 aa, Tick-borne encephalitis virus
LAATVMQKAYH

SEQ ID NO: 209620 - protein, 11 aa, Tick-borne encephalitis virus
AATVMQKAYHA

SEQ ID NO: 209621 - protein, 11 aa, Tick-borne encephalitis virus
ATVMQKAYHAK

SEQ ID NO: 209622 - protein, 11 aa, Tick-borne encephalitis virus
VARPSREGGCV

SEQ ID NO: 209623 - protein, 11 aa, Tick-borne encephalitis virus
ARPSREGGCVM

SEQ ID NO: 209624 - protein, 11 aa, Tick-borne encephalitis virus
RPSREGGCVMD

SEQ ID NO: 209625 - protein, 11 aa, Tick-borne encephalitis virus
PSREGGCVMDV

SEQ ID NO: 209626 - protein, 11 aa, Tick-borne encephalitis virus
SREGGCVMDVI

SEQ ID NO: 209627 - protein, 11 aa, Tick-borne encephalitis virus
REGGCVMDVIT

SEQ ID NO: 209628 - protein, 11 aa, Tick-borne encephalitis virus
EGGCVMDVITR

SEQ ID NO: 209629 - protein, 11 aa, Tick-borne encephalitis virus
MMEGEGVIEAT

SEQ ID NO: 209630 - protein, 11 aa, Tick-borne encephalitis virus
MEGEGVIEATD

SEQ ID NO: 209631 - protein, 11 aa, Tick-borne encephalitis virus
EGEGVIEATDA

SEQ ID NO: 209632 - protein, 11 aa, Tick-borne encephalitis virus
GEGVIEATDAH

SEQ ID NO: 209633 - protein, 11 aa, Tick-borne encephalitis virus
EGVIEATDAHN

SEQ ID NO: 209634 - protein, 11 aa, Tick-borne encephalitis virus
GVIEATDAHNP

SEQ ID NO: 209635 - protein, 11 aa, Tick-borne encephalitis virus
VIEATDAHNPR

SEQ ID NO: 209636 - protein, 11 aa, Tick-borne encephalitis virus
IEATDAHNPRL

SEQ ID NO: 209637 - protein, 11 aa, Tick-borne encephalitis virus
EATDAHNPRLL

SEQ ID NO: 209638 - protein, 11 aa, Tick-borne encephalitis virus
ATDAHNPRLLR

SEQ ID NO: 209639 - protein, 11 aa, Tick-borne encephalitis virus
TDAHNPRLLRV

SEQ ID NO: 209640 - protein, 11 aa, Tick-borne encephalitis virus
PRLFRVERWLR

SEQ ID NO: 209641 - protein, 11 aa, Tick-borne encephalitis virus
RLLRVERWLRE

SEQ ID NO: 209642 - protein, 11 aa, Tick-borne encephalitis virus
NHGEERLGRML

SEQ ID NO: 209643 - protein, 11 aa, Tick-borne encephalitis virus
HGGERLGRMLV

SEQ ID NO: 209644 - protein, 11 aa, Tick-borne encephalitis virus
VSGDDCVVRPI

SEQ ID NO: 209645 - protein, 11 aa, Tick-borne encephalitis virus
SGDDCVVRPID

SEQ ID NO: 209646 - protein, 11 aa, Tick-borne encephalitis virus
GDDCVVRPIDD

SEQ ID NO: 209647 - protein, 11 aa, Tick-borne encephalitis virus
DDCVVRPIDDR

SEQ ID NO: 209648 - protein, 11 aa, Tick-borne encephalitis virus
DCVVRPIDDRF

SEQ ID NO: 209649 - protein, 11 aa, Tick-borne encephalitis virus
CVVRPIDDRFG

SEQ ID NO: 209650 - protein, 11 aa, Tick-borne encephalitis virus
DDRFSRALYFL

SEQ ID NO: 209651 - protein, 11 aa, Tick-borne encephalitis virus
DRFSRALYFLN

SEQ ID NO: 209652 - protein, 11 aa, Tick-borne encephalitis virus
RFSRALYFLND

SEQ ID NO: 209653 - protein, 11 aa, Tick-borne encephalitis virus
FSRALYFLNDM

SEQ ID NO: 209654 - protein, 11 aa, Tick-borne encephalitis virus
SRALYFLNDMA

SEQ ID NO: 209655 - protein, 11 aa, Tick-borne encephalitis virus
GALYFLNDMAK

SEQ ID NO: 209656 - protein, 11 aa, Tick-borne encephalitis virus
RKDIGEWEHSA

SEQ ID NO: 209657 - protein, 11 aa, Tick-borne encephalitis virus
KDIGEWEHSAG

SEQ ID NO: 209658 - protein, 11 aa, Tick-borne encephalitis virus
DIGEWEHSAGF

SEQ ID NO: 209659 - protein, 11 aa, Tick-borne encephalitis virus
IGEWEHSAGFS

SEQ ID NO: 209660 - protein, 11 aa, Tick-borne encephalitis virus
SWEAVPFCSHH

SEQ ID NO: 209661 - protein, 11 aa, Tick-borne encephalitis virus
WEAVPFCSHHF

SEQ ID NO: 209662 - protein, 11 aa, Tick-borne encephalitis virus
FHELVMKDGRT

SEQ ID NO: 209663 - protein, 11 aa, Tick-borne encephalitis virus
HELVMKDGRTL

SEQ ID NO: 209664 - protein, 11 aa, Tick-borne encephalitis virus
ELVMKDGRSLI

SEQ ID NO: 209665 - protein, 11 aa, Tick-borne encephalitis virus
LVMKDGRTLVV

SEQ ID NO: 209666 - protein, 11 aa, Tick-borne encephalitis virus
VMKDGRTLVVP

SEQ ID NO: 209667 - protein, 11 aa, Tick-borne encephalitis virus
MKDGRTLVVPC

SEQ ID NO: 209668 - protein, 11 aa, Tick-borne encephalitis virus
KDGRSLIVPCR

SEQ ID NO: 209669 - protein, 11 aa, Tick-borne encephalitis virus
DGRTLVVPCRD

SEQ ID NO: 209670 - protein, 11 aa, Tick-borne encephalitis virus
GRSLIVPCRDQ

SEQ ID NO: 209671 - protein, 11 aa, Tick-borne encephalitis virus
RSLIVPCRDQD

SEQ ID NO: 209672 - protein, 11 aa, Tick-borne encephalitis virus
TLVVPCRDQDE

SEQ ID NO: 209673 - protein, 11 aa, Tick-borne encephalitis virus
DQDELVGRAPV

SEQ ID NO: 209674 - protein, 11 aa, Tick-borne encephalitis virus
QDELVGRAPVS

SEQ ID NO: 209675 - protein, 11 aa, Tick-borne encephalitis virus
DELVGRAPVSP

SEQ ID NO: 209676 - protein, 11 aa, Tick-borne encephalitis virus
ELVGRAPVSPG

SEQ ID NO: 209677 - protein, 11 aa, Tick-borne encephalitis virus
LVGRAPVSPGC

SEQ ID NO: 209678 - protein, 11 aa, Tick-borne encephalitis virus
VGRAPVSPGCG

SEQ ID NO: 209679 - protein, 11 aa, Tick-borne encephalitis virus
GRAPVSPGCGW

SEQ ID NO: 209680 - protein, 11 aa, Tick-borne encephalitis virus
RAPVSPGCGWS

SEQ ID NO: 209681 - protein, 11 aa, Tick-borne encephalitis virus
APVSPGCGWSV

SEQ ID NO: 209682 - protein, 11 aa, Tick-borne encephalitis virus
PVSPGCGWSVR

SEQ ID NO: 209683 - protein, 11 aa, Tick-borne encephalitis virus
VSPGCGWSIRE

SEQ ID NO: 209684 - protein, 11 aa, Tick-borne encephalitis virus
HRRDLRTLGFA

SEQ ID NO: 209685 - protein, 11 aa, Tick-borne encephalitis virus
RRDLRTLGLTI

SEQ ID NO: 209686 - protein, 11 aa, Tick-borne encephalitis virus
RDLRTLGLTIC

SEQ ID NO: 209687 - protein, 11 aa, Tick-borne encephalitis virus
DLRTLGFAICS

SEQ ID NO: 209688 - protein, 11 aa, Tick-borne encephalitis virus
LRTLGLAISSA

SEQ ID NO: 209689 - protein, 11 aa, Tick-borne encephalitis virus
RTLGLTICSAV

SEQ ID NO: 209690 - protein, 11 aa, Tick-borne encephalitis virus
TLGLTICSAVP

SEQ ID NO: 209691 - protein, 11 aa, Tick-borne encephalitis virus
SAVPADWVPTG

SEQ ID NO: 209692 - protein, 11 aa, Tick-borne encephalitis virus
AVPIDWVPTGR

SEQ ID NO: 209693 - protein, 11 aa, Tick-borne encephalitis virus
VPADWVPTGRT

SEQ ID NO: 209694 - protein, 11 aa, Tick-borne encephalitis virus
PADWVPTGRTT

SEQ ID NO: 209695 - protein, 11 aa, Tick-borne encephalitis virus
ADWVPTGRTTW

SEQ ID NO: 209696 - protein, 11 aa, Tick-borne encephalitis virus
TWSIHASGAWI

SEQ ID NO: 209697 - protein, 11 aa, Tick-borne encephalitis virus
WSIHASGAWIT

SEQ ID NO: 209698 - protein, 11 aa, Tick-borne encephalitis virus
SIHASGSWMTT

SEQ ID NO: 209699 - protein, 11 aa, Tick-borne encephalitis virus
IHASGAWITTE

SEQ ID NO: 209700 - protein, 11 aa, Tick-borne encephalitis virus
HASGAWMTTEN

SEQ ID NO: 209701 - protein, 11 aa, Tick-borne encephalitis virus
ASGAWMTTENM

SEQ ID NO: 209702 - protein, 11 aa, Tick-borne encephalitis virus
SGAWITTEDML

SEQ ID NO: 209703 - protein, 11 aa, Tick-borne encephalitis virus
GAWITTEDMLD

SEQ ID NO: 209704 - protein, 11 aa, Tick-borne encephalitis virus
SWMTTEDMLDV

SEQ ID NO: 209705 - protein, 11 aa, Tick-borne encephalitis virus
WITTEDMLDVW

SEQ ID NO: 209706 - protein, 11 aa, Tick-borne encephalitis virus
ITTEDMLDVWN

SEQ ID NO: 209707 - protein, 11 aa, Tick-borne encephalitis virus
VWILDNPFMHG

SEQ ID NO: 209708 - protein, 11 aa, Tick-borne encephalitis virus
WILDNPFMHGK

SEQ ID NO: 209709 - protein, 11 aa, Tick-borne encephalitis virus
ILDNPFMHGKE

SEQ ID NO: 209710 - protein, 11 aa, Tick-borne encephalitis virus
LDNPFMQNKER

SEQ ID NO: 209711 - protein, 11 aa, Tick-borne encephalitis virus
EWRDIPYLPKA

SEQ ID NO: 209712 - protein, 11 aa, Tick-borne encephalitis virus
IPYLPKAHDML

SEQ ID NO: 209713 - protein, 11 aa, Tick-borne encephalitis virus
PYLPKAHDMLC

SEQ ID NO: 209714 - protein, 11 aa, Tick-borne encephalitis virus
YLPKAHDMLCS

SEQ ID NO: 209715 - protein, 11 aa, Tick-borne encephalitis virus
LPKAHDMLCSS

SEQ ID NO: 209716 - protein, 11 aa, Tick-borne encephalitis virus
PKAHDMLCSSL

SEQ ID NO: 209717 - protein, 11 aa, Tick-borne encephalitis virus
KAHDMLCSSLV

SEQ ID NO: 209718 - protein, 11 aa, Tick-borne encephalitis virus
AHDMLCSSLVG

SEQ ID NO: 209719 - protein, 11 aa, Tick-borne encephalitis virus
DMLCSSLVGRT

SEQ ID NO: 209720 - protein, 11 aa, Tick-borne encephalitis virus
MLCSSLVGRTE

SEQ ID NO: 209721 - protein, 11 aa, Tick-borne encephalitis virus
LCSSLVGRTER

SEQ ID NO: 209722 - protein, 11 aa, Tick-borne encephalitis virus
CSSLVGRTERA

SEQ ID NO: 209723 - protein, 11 aa, Tick-borne encephalitis virus
SSLVGRTERAE

SEQ ID NO: 209724 - protein, 11 aa, Tick-borne encephalitis virus
SLVGRTERAEW

SEQ ID NO: 209725 - protein, 11 aa, Tick-borne encephalitis virus
LVGRTERAEWA

SEQ ID NO: 209726 - protein, 11 aa, Tick-borne encephalitis virus
VGRKERAEWAR

SEQ ID NO: 209727 - protein, 11 aa, Tick-borne encephalitis virus
GRKERAEWARN

SEQ ID NO: 209728 - protein, 11 aa, Tick-borne encephalitis virus
RKERAEWARNI

SEQ ID NO: 209729 - protein, 11 aa, Tick-borne encephalitis virus
KERAEWARNIW

SEQ ID NO: 209730 - protein, 11 aa, Tick-borne encephalitis virus
IWGAVEKVRKI

SEQ ID NO: 209731 - protein, 11 aa, Tick-borne encephalitis virus
WGAVEKVRKMM

SEQ ID NO: 209732 - protein, 11 aa, Tick-borne encephalitis virus
GAVEKVRKIVG

SEQ ID NO: 209733 - protein, 11 aa, Tick-borne encephalitis virus
RFKDYLSCMDR

SEQ ID NO: 209734 - protein, 11 aa, Tick-borne encephalitis virus
CKDYPSCMDRH

SEQ ID NO: 209735 - protein, 11 aa, Tick-borne encephalitis virus
KDYLSCMDRHY

SEQ ID NO: 209736 - protein, 11 aa, Tick-borne encephalitis virus
DYPSCMDRHDL

SEQ ID NO: 209737 - protein, 11 aa, Tick-borne encephalitis virus
YLSCMDRHYLH

SEQ ID NO: 209738 - protein, 11 aa, Tick-borne encephalitis virus
LSCMDRHYLHW

SEQ ID NO: 209739 - protein, 11 aa, Tick-borne encephalitis virus
MDRHYLHWNLK

SEQ ID NO: 209740 - protein, 11 aa, Tick-borne encephalitis virus
DRHYLHWNLKL

SEQ ID NO: 209741 - protein, 11 aa, Tick-borne encephalitis virus
RHYLHWNLKLE

SEQ ID NO: 209742 - protein, 11 aa, Tick-borne encephalitis virus
HDLHWELKLEG

SEQ ID NO: 209743 - protein, 11 aa, Tick-borne encephalitis virus
YLHWNLKLESS

SEQ ID NO: 209744 - protein, 11 aa, Tick-borne encephalitis virus
LHWELKLEGSI

SEQ ID NO: 209745 - protein, 11 aa, Tick-borne encephalitis virus
HWNLKLESSIF

SEQ ID NO: 209746 - protein, 11 aa, Tick-borne encephalitis virus
PPRRASKETAK

SEQ ID NO: 209747 - protein, 11 aa, Tick-borne encephalitis virus
PRRASKETAKK

SEQ ID NO: 209748 - protein, 11 aa, Tick-borne encephalitis virus
RRASKETAKKT

SEQ ID NO: 209749 - protein, 11 aa, Tick-borne encephalitis virus
RVSKEAAKKTR

SEQ ID NO: 209750 - protein, 11 aa, Tick-borne encephalitis virus
VSKEAAKKTRQ

SEQ ID NO: 209751 - protein, 11 aa, Tick-borne encephalitis virus
SKEAAKKTRQS

SEQ ID NO: 209752 - protein, 11 aa, Tick-borne encephalitis virus
KEAAKKTRQSR

SEQ ID NO: 209753 - protein, 11 aa, Tick-borne encephalitis virus
EAAKKTRQSRV

SEQ ID NO: 209754 - protein, 11 aa, Tick-borne encephalitis virus
TARKTRQSRVQ

SEQ ID NO: 209755 - protein, 11 aa, Tick-borne encephalitis virus
ARKTRQSRVQM

SEQ ID NO: 209756 - protein, 11 aa, Tick-borne encephalitis virus
RKTRQSRVQMP

SEQ ID NO: 209757 - protein, 11 aa, Tick-borne encephalitis virus
KTRQSRVQMPS

SEQ ID NO: 209758 - protein, 11 aa, Tick-borne encephalitis virus
TRQSRVQMPSG

SEQ ID NO: 209759 - protein, 11 aa, Tick-borne encephalitis virus
RQSRVQMPSGL

SEQ ID NO: 209760 - protein, 11 aa, Tick-borne encephalitis virus
QSRVQMPSGLV

SEQ ID NO: 209761 - protein, 11 aa, Tick-borne encephalitis virus
SRVQMPSGLVL

SEQ ID NO: 209762 - protein, 11 aa, Tick-borne encephalitis virus
SGLVLMRMMGI

SEQ ID NO: 209763 - protein, 11 aa, Tick-borne encephalitis virus
MRMMGFLWHAI

SEQ ID NO: 209764 - protein, 11 aa, Tick-borne encephalitis virus
RMMGFLWHAIA

SEQ ID NO: 209765 - protein, 11 aa, Tick-borne encephalitis virus
MMGFLWHAIAG

SEQ ID NO: 209766 - protein, 11 aa, Tick-borne encephalitis virus
MGFLWHAIAGT

SEQ ID NO: 209767 - protein, 11 aa, Tick-borne encephalitis virus
GILWHAVAGTV

SEQ ID NO: 209768 - protein, 11 aa, Tick-borne encephalitis virus
FLWHAIAGTAR

SEQ ID NO: 209769 - protein, 11 aa, Tick-borne encephalitis virus
LWHAVAGTVRS

SEQ ID NO: 209770 - protein, 11 aa, Tick-borne encephalitis virus
WHAVAGTVRSP

SEQ ID NO: 209771 - protein, 11 aa, Tick-borne encephalitis virus
HAVAGTVRSPV

SEQ ID NO: 209772 - protein, 11 aa, Tick-borne encephalitis virus
AVAGTVRSPVL

SEQ ID NO: 209773 - protein, 11 aa, Tick-borne encephalitis virus
VAGTVRSPVLK

SEQ ID NO: 209774 - protein, 11 aa, Tick-borne encephalitis virus
VRSPVLKSFWK

SEQ ID NO: 209775 - protein, 11 aa, Tick-borne encephalitis virus
RSPVLKSFWKP

SEQ ID NO: 209776 - protein, 11 aa, Tick-borne encephalitis virus
SPVLKSFWKPV

SEQ ID NO: 209777 - protein, 11 aa, Tick-borne encephalitis virus
PVLKSFWKPVP

SEQ ID NO: 209778 - protein, 11 aa, Tick-borne encephalitis virus
VLKSFWKPVPL

SEQ ID NO: 209779 - protein, 11 aa, Tick-borne encephalitis virus
LKSFWKSVPLK

SEQ ID NO: 209780 - protein, 11 aa, Tick-borne encephalitis virus
KSFWKSVPLKQ

SEQ ID NO: 209781 - protein, 11 aa, Tick-borne encephalitis virus
SFWKSVPLKQA

SEQ ID NO: 209782 - protein, 11 aa, Tick-borne encephalitis virus
FWNSVPLKQAM

SEQ ID NO: 209783 - protein, 11 aa, Tick-borne encephalitis virus
PVPLKQATAAL

SEQ ID NO: 209784 - protein, 11 aa, Tick-borne encephalitis virus
VPLKQATTALR

SEQ ID NO: 209785 - protein, 11 aa, Tick-borne encephalitis virus
PLKQATTALRK

SEQ ID NO: 209786 - protein, 11 aa, Tick-borne encephalitis virus
LKQATTALRKI

SEQ ID NO: 209787 - protein, 11 aa, Tick-borne encephalitis virus
KQATTALRKIK

SEQ ID NO: 209788 - protein, 11 aa, Tick-borne encephalitis virus
QATTALRKIKM

SEQ ID NO: 209789 - protein, 11 aa, Tick-borne encephalitis virus
ATTALRKIKMA

SEQ ID NO: 209790 - protein, 11 aa, Tick-borne encephalitis virus
TTALRKIKMAV

SEQ ID NO: 209791 - protein, 11 aa, Tick-borne encephalitis virus
AALRKIKRAVS

SEQ ID NO: 209792 - protein, 11 aa, Tick-borne encephalitis virus
ALRKIKMAVSA

SEQ ID NO: 209793 - protein, 11 aa, Tick-borne encephalitis virus
LRKIKMAVSAL

SEQ ID NO: 209794 - protein, 11 aa, Tick-borne encephalitis virus
RKIKKAVSALM

SEQ ID NO: 209795 - protein, 11 aa, Tick-borne encephalitis virus
LMVGLQRRGKK

SEQ ID NO: 209796 - protein, 11 aa, Tick-borne encephalitis virus
MVGLQRRGKKR

SEQ ID NO: 209797 - protein, 11 aa, Tick-borne encephalitis virus
VGLQRRGKKRS

SEQ ID NO: 209798 - protein, 11 aa, Tick-borne encephalitis virus
GLQKRGKRRSV

SEQ ID NO: 209799 - protein, 11 aa, Tick-borne encephalitis virus
TFAATVRKERD

SEQ ID NO: 209800 - protein, 11 aa, Tick-borne encephalitis virus
AATVRKERDDT

SEQ ID NO: 209801 - protein, 11 aa, Tick-borne encephalitis virus
ATVRKERDDTT

SEQ ID NO: 209802 - protein, 11 aa, Tick-borne encephalitis virus
TVRKERDDTTV

SEQ ID NO: 209803 - protein, 11 aa, Tick-borne encephalitis virus
VRREGDGTTVI

SEQ ID NO: 209804 - protein, 11 aa, Tick-borne encephalitis virus
RKERDDTTVIR

SEQ ID NO: 209805 - protein, 11 aa, Tick-borne encephalitis virus
KERDDTTVIRA

SEQ ID NO: 209806 - protein, 11 aa, Tick-borne encephalitis virus
ERDDTTVIRAE

SEQ ID NO: 209807 - protein, 11 aa, Tick-borne encephalitis virus
RDDTTVIRAEG

SEQ ID NO: 209808 - protein, 11 aa, Tick-borne encephalitis virus
DGTTVIRAEGR

SEQ ID NO: 209809 - protein, 11 aa, Tick-borne encephalitis virus
GTTVIRAEGRD

SEQ ID NO: 209810 - protein, 11 aa, Tick-borne encephalitis virus
TCVILATDMGA

SEQ ID NO: 209811 - protein, 11 aa, Tick-borne encephalitis virus
CVILATDMGAW

SEQ ID NO: 209812 - protein, 11 aa, Tick-borne encephalitis virus
VIMATDMGSWC

SEQ ID NO: 209813 - protein, 11 aa, Tick-borne encephalitis virus
IMATDMGSWCD

SEQ ID NO: 209814 - protein, 11 aa, Tick-borne encephalitis virus
MATDMGSWCDD

SEQ ID NO: 209815 - protein, 11 aa, Tick-borne encephalitis virus
VWMTVESVVTR

SEQ ID NO: 209816 - protein, 11 aa, Tick-borne encephalitis virus
VAVLLCLAPVY

SEQ ID NO: 209817 - protein, 11 aa, Tick-borne encephalitis virus
AVLLCLAPVYA

SEQ ID NO: 209818 - protein, 11 aa, Tick-borne encephalitis virus
DVWLDAIYQEK

SEQ ID NO: 209819 - protein, 11 aa, Tick-borne encephalitis virus
VWLDAIYQEKP

SEQ ID NO: 209820 - protein, 11 aa, Tick-borne encephalitis virus
WLDAIYQEKPA

SEQ ID NO: 209821 - protein, 11 aa, Tick-borne encephalitis virus
LDAIYQENPAQ

SEQ ID NO: 209822 - protein, 11 aa, Tick-borne encephalitis virus
DAIYQENPAQT

SEQ ID NO: 209823 - protein, 11 aa, Tick-borne encephalitis virus
AIYQENPAQTR

SEQ ID NO: 209824 - protein, 11 aa, Tick-borne encephalitis virus
IYQENPAQTRE

SEQ ID NO: 209825 - protein, 11 aa, Tick-borne encephalitis virus
YQEKPAKTREY

SEQ ID NO: 209826 - protein, 11 aa, Tick-borne encephalitis virus
QEKPAKTREYC

SEQ ID NO: 209827 - protein, 11 aa, Tick-borne encephalitis virus
EKPAKTREYCL

SEQ ID NO: 209828 - protein, 11 aa, Tick-borne encephalitis virus
NPAQTREYCLH

SEQ ID NO: 209829 - protein, 11 aa, Tick-borne encephalitis virus
GPATLAEQHQS

SEQ ID NO: 209830 - protein, 11 aa, Tick-borne encephalitis virus
PATLTEEHQGG

SEQ ID NO: 209831 - protein, 11 aa, Tick-borne encephalitis virus
ATLTEEHQGGT

SEQ ID NO: 209832 - protein, 11 aa, Tick-borne encephalitis virus
TLAEQHQSGTV

SEQ ID NO: 209833 - protein, 11 aa, Tick-borne encephalitis virus
LTEEHQGGTVC

SEQ ID NO: 209834 - protein, 11 aa, Tick-borne encephalitis virus
TEEHQGGTVCK

SEQ ID NO: 209835 - protein, 11 aa, Tick-borne encephalitis virus
KGSIVTCVKAA

SEQ ID NO: 209836 - protein, 11 aa, Tick-borne encephalitis virus
GSIVTCVKAAC

SEQ ID NO: 209837 - protein, 11 aa, Tick-borne encephalitis virus
SIVTCVKAACE

SEQ ID NO: 209838 - protein, 11 aa, Tick-borne encephalitis virus
IVTCVKAACEA

SEQ ID NO: 209839 - protein, 11 aa, Tick-borne encephalitis virus
VTCVKAACEAK

SEQ ID NO: 209840 - protein, 11 aa, Tick-borne encephalitis virus
TCVKAACEAKK

SEQ ID NO: 209841 - protein, 11 aa, Tick-borne encephalitis virus
CVKVSCEAKKK

SEQ ID NO: 209842 - protein, 11 aa, Tick-borne encephalitis virus
VKVSCEAKKKA

SEQ ID NO: 209843 - protein, 11 aa, Tick-borne encephalitis virus
KVSCEAKKKAT

SEQ ID NO: 209844 - protein, 11 aa, Tick-borne encephalitis virus
VSCEAKKKATG

SEQ ID NO: 209845 - protein, 11 aa, Tick-borne encephalitis virus
VYDANRIVYTV

SEQ ID NO: 209846 - protein, 11 aa, Tick-borne encephalitis virus
YDPNKIVYPVK

SEQ ID NO: 209847 - protein, 11 aa, Tick-borne encephalitis virus
DPNKIVYPVKV

SEQ ID NO: 209848 - protein, 11 aa, Tick-borne encephalitis virus
ANKIVYTIKVE

SEQ ID NO: 209849 - protein, 11 aa, Tick-borne encephalitis virus
NKIVYTIKVEP

SEQ ID NO: 209850 - protein, 11 aa, Tick-borne encephalitis virus
KIVYTIKVEPH

SEQ ID NO: 209851 - protein, 11 aa, Tick-borne encephalitis virus
ANETHSGRKTP

SEQ ID NO: 209852 - protein, 11 aa, Tick-borne encephalitis virus
LEHLPTAWQVR

SEQ ID NO: 209853 - protein, 11 aa, Tick-borne encephalitis virus
LALPWKHEGAR

SEQ ID NO: 209854 - protein, 11 aa, Tick-borne encephalitis virus
HEGARNWNNAE

SEQ ID NO: 209855 - protein, 11 aa, Tick-borne encephalitis virus
EGVQNWNNAER

SEQ ID NO: 209856 - protein, 11 aa, Tick-borne encephalitis virus
GVQNWNNAERL

SEQ ID NO: 209857 - protein, 11 aa, Tick-borne encephalitis virus
VQNWNNAERLV

SEQ ID NO: 209858 - protein, 11 aa, Tick-borne encephalitis virus
RNWNNAERLVE

SEQ ID NO: 209859 - protein, 11 aa, Tick-borne encephalitis virus
TMCDKTKFTWR

SEQ ID NO: 209860 - protein, 11 aa, Tick-borne encephalitis virus
MCDKTKFTWRR

SEQ ID NO: 209861 - protein, 11 aa, Tick-borne encephalitis virus
CDKTKFTWKRT

SEQ ID NO: 209862 - protein, 11 aa, Tick-borne encephalitis virus
DKTKFTWKRTP

SEQ ID NO: 209863 - protein, 11 aa, Tick-borne encephalitis virus
KTKFTWKRTPT

SEQ ID NO: 209864 - protein, 11 aa, Tick-borne encephalitis virus
TKFTWKRTPTD

SEQ ID NO: 209865 - protein, 11 aa, Tick-borne encephalitis virus
KFTWKRTPTDS

SEQ ID NO: 209866 - protein, 11 aa, Tick-borne encephalitis virus
FTWKRTPTDSG

SEQ ID NO: 209867 - protein, 11 aa, Tick-borne encephalitis virus
TWKRTPTDSGH

SEQ ID NO: 209868 - protein, 11 aa, Tick-borne encephalitis virus
WRRTPTDSGHD

SEQ ID NO: 209869 - protein, 11 aa, Tick-borne encephalitis virus
RRTPTDSGHDT

SEQ ID NO: 209870 - protein, 11 aa, Tick-borne encephalitis virus
WDFGSTGGLLT

SEQ ID NO: 209871 - protein, 11 aa, Tick-borne encephalitis virus
DFGSTGGLLTS

SEQ ID NO: 209872 - protein, 11 aa, Tick-borne encephalitis virus
FGSTGGLLTSV

SEQ ID NO: 209873 - protein, 11 aa, Tick-borne encephalitis virus
GSTGGLLTSVG

SEQ ID NO: 209874 - protein, 11 aa, Tick-borne encephalitis virus
STGGLLTSVGK

SEQ ID NO: 209875 - protein, 11 aa, Tick-borne encephalitis virus
TGGLLTSVGKA

SEQ ID NO: 209876 - protein, 11 aa, Tick-borne encephalitis virus
GGLLTSVGKAL

SEQ ID NO: 209877 - protein, 11 aa, Tick-borne encephalitis virus
GLLTSVGKALH

SEQ ID NO: 209878 - protein, 11 aa, Tick-borne encephalitis virus
LLTSVGKALHT

SEQ ID NO: 209879 - protein, 11 aa, Tick-borne encephalitis virus
LSSIGKALHTV

SEQ ID NO: 209880 - protein, 11 aa, Tick-borne encephalitis virus
SSIGKALHTVL

SEQ ID NO: 209881 - protein, 11 aa, Tick-borne encephalitis virus
GGVGFLPKILI

SEQ ID NO: 209882 - protein, 11 aa, Tick-borne encephalitis virus
GVGFIPKLLLG

SEQ ID NO: 209883 - protein, 11 aa, Tick-borne encephalitis virus
GAALAWLGLNM

SEQ ID NO: 209884 - protein, 11 aa, Tick-borne encephalitis virus
AALAWLGLNMR

SEQ ID NO: 209885 - protein, 11 aa, Tick-borne encephalitis virus
SAIRETFEEGT

SEQ ID NO: 209886 - protein, 11 aa, Tick-borne encephalitis virus
AIRETFEEGTC

SEQ ID NO: 209887 - protein, 11 aa, Tick-borne encephalitis virus
IKEAFEEGTCG

SEQ ID NO: 209888 - protein, 11 aa, Tick-borne encephalitis virus
RETFEEGTCGI

SEQ ID NO: 209889 - protein, 11 aa, Tick-borne encephalitis virus
ETFEEGTCGIL

SEQ ID NO: 209890 - protein, 11 aa, Tick-borne encephalitis virus
TFEEGTCGILP

SEQ ID NO: 209891 - protein, 11 aa, Tick-borne encephalitis virus
FEEGTCGILPQ

SEQ ID NO: 209892 - protein, 11 aa, Tick-borne encephalitis virus
EEGTCGILPQN

SEQ ID NO: 209893 - protein, 11 aa, Tick-borne encephalitis virus
EGTCGILPQNR

SEQ ID NO: 209894 - protein, 11 aa, Tick-borne encephalitis virus
GTCGILPQNRL

SEQ ID NO: 209895 - protein, 11 aa, Tick-borne encephalitis virus
TCGILPQNRLE

SEQ ID NO: 209896 - protein, 11 aa, Tick-borne encephalitis virus
RLEMAMWRSAA

SEQ ID NO: 209897 - protein, 11 aa, Tick-borne encephalitis virus
LEMAMWRSSST

SEQ ID NO: 209898 - protein, 11 aa, Tick-borne encephalitis virus
EMAMWRSAATE

SEQ ID NO: 209899 - protein, 11 aa, Tick-borne encephalitis virus
MAMWRSSSTEL

SEQ ID NO: 209900 - protein, 11 aa, Tick-borne encephalitis virus
AMWRSAATELN

SEQ ID NO: 209901 - protein, 11 aa, Tick-borne encephalitis virus
MWRSAATELNL

SEQ ID NO: 209902 - protein, 11 aa, Tick-borne encephalitis virus
WRSAATELNLA

SEQ ID NO: 209903 - protein, 11 aa, Tick-borne encephalitis virus
RSAATELNLAL

SEQ ID NO: 209904 - protein, 11 aa, Tick-borne encephalitis virus
SAATELNLALA

SEQ ID NO: 209905 - protein, 11 aa, Tick-borne encephalitis virus
AATELNLALAE

SEQ ID NO: 209906 - protein, 11 aa, Tick-borne encephalitis virus
EANLTVMVDKF

SEQ ID NO: 209907 - protein, 11 aa, Tick-borne encephalitis virus
KFDPTDYRGGI

SEQ ID NO: 209908 - protein, 11 aa, Tick-borne encephalitis virus
FDPTDYRGGVS

SEQ ID NO: 209909 - protein, 11 aa, Tick-borne encephalitis virus
DYRGGIPGLLR

SEQ ID NO: 209910 - protein, 11 aa, Tick-borne encephalitis virus
YRGGIPGLLRK

SEQ ID NO: 209911 - protein, 11 aa, Tick-borne encephalitis virus
RGGIPGLLRKG

SEQ ID NO: 209912 - protein, 11 aa, Tick-borne encephalitis virus
GGVSGLLRKGK

SEQ ID NO: 209913 - protein, 11 aa, Tick-borne encephalitis virus
GVSGLLRKGKD

SEQ ID NO: 209914 - protein, 11 aa, Tick-borne encephalitis virus
VSGLLRKGKDI

SEQ ID NO: 209915 - protein, 11 aa, Tick-borne encephalitis virus
SGLLRKGKDIK

SEQ ID NO: 209916 - protein, 11 aa, Tick-borne encephalitis virus
KKGKDIRVSWK

SEQ ID NO: 209917 - protein, 11 aa, Tick-borne encephalitis virus
DIRVSWKSWGH

SEQ ID NO: 209918 - protein, 11 aa, Tick-borne encephalitis virus
IKVSWRSWGHS

SEQ ID NO: 209919 - protein, 11 aa, Tick-borne encephalitis virus
MIWSIPEASRR

SEQ ID NO: 209920 - protein, 11 aa, Tick-borne encephalitis virus
SRRFMVGTEGS

SEQ ID NO: 209921 - protein, 11 aa, Tick-borne encephalitis virus
TKVFVDFRQES

SEQ ID NO: 209922 - protein, 11 aa, Tick-borne encephalitis virus
KVFLDFRQEAT

SEQ ID NO: 209923 - protein, 11 aa, Tick-borne encephalitis virus
VFVDFRQESTH

SEQ ID NO: 209924 - protein, 11 aa, Tick-borne encephalitis virus
FLDFRQEATHE

SEQ ID NO: 209925 - protein, 11 aa, Tick-borne encephalitis virus
LDFRQEATHEC

SEQ ID NO: 209926 - protein, 11 aa, Tick-borne encephalitis virus
TDQSLWMKSMK

SEQ ID NO: 209927 - protein, 11 aa, Tick-borne encephalitis virus
DQSLWMKSMKN

SEQ ID NO: 209928 - protein, 11 aa, Tick-borne encephalitis virus
QSLWMKSMKND

SEQ ID NO: 209929 - protein, 11 aa, Tick-borne encephalitis virus
SLWMKSMKNDT

SEQ ID NO: 209930 - protein, 11 aa, Tick-borne encephalitis virus
LWMKSMKNDTG

SEQ ID NO: 209931 - protein, 11 aa, Tick-borne encephalitis virus
WMKSMKNDTGT

SEQ ID NO: 209932 - protein, 11 aa, Tick-borne encephalitis virus
MKSMKNDTGTY

SEQ ID NO: 209933 - protein, 11 aa, Tick-borne encephalitis virus
KSMKNDTGTYI

SEQ ID NO: 209934 - protein, 11 aa, Tick-borne encephalitis virus
SVRNETGTYIV

SEQ ID NO: 209935 - protein, 11 aa, Tick-borne encephalitis virus
VRNETGTYIVE

SEQ ID NO: 209936 - protein, 11 aa, Tick-borne encephalitis virus
IDNPEVVDSEL

SEQ ID NO: 209937 - protein, 11 aa, Tick-borne encephalitis virus
DNPEVVDSELF

SEQ ID NO: 209938 - protein, 11 aa, Tick-borne encephalitis virus
NPEVVDSELFL

SEQ ID NO: 209939 - protein, 11 aa, Tick-borne encephalitis virus
PEVVDSELFLP

SEQ ID NO: 209940 - protein, 11 aa, Tick-borne encephalitis virus
SEQVKGPWKYT

SEQ ID NO: 209941 - protein, 11 aa, Tick-borne encephalitis virus
EQVKGPWKYLP

SEQ ID NO: 209942 - protein, 11 aa, Tick-borne encephalitis virus
QVKGPWKYLPI

SEQ ID NO: 209943 - protein, 11 aa, Tick-borne encephalitis virus
VKGPWKYLPIR

SEQ ID NO: 209944 - protein, 11 aa, Tick-borne encephalitis virus
KGPWKYLPIRV

SEQ ID NO: 209945 - protein, 11 aa, Tick-borne encephalitis virus
RVVRGECPGTK

SEQ ID NO: 209946 - protein, 11 aa, Tick-borne encephalitis virus
VIREECPGTRV

SEQ ID NO: 209947 - protein, 11 aa, Tick-borne encephalitis virus
ISADCDRRGAS

SEQ ID NO: 209948 - protein, 11 aa, Tick-borne encephalitis virus
TADCDKRGASV

SEQ ID NO: 209949 - protein, 11 aa, Tick-borne encephalitis virus
IIRRRPSTGST

SEQ ID NO: 209950 - protein, 11 aa, Tick-borne encephalitis virus
IRRRPSTGSTV

SEQ ID NO: 209951 - protein, 11 aa, Tick-borne encephalitis virus
RRRPSTGSTVV

SEQ ID NO: 209952 - protein, 11 aa, Tick-borne encephalitis virus
RRPATGTTAVW

SEQ ID NO: 209953 - protein, 11 aa, Tick-borne encephalitis virus
RPSTGSTVVWG

SEQ ID NO: 209954 - protein, 11 aa, Tick-borne encephalitis virus
PSTGSTVVWGG

SEQ ID NO: 209955 - protein, 11 aa, Tick-borne encephalitis virus
WGGIVVFALLV

SEQ ID NO: 209956 - protein, 11 aa, Tick-borne encephalitis virus
GGLIVLALLVT

SEQ ID NO: 209957 - protein, 11 aa, Tick-borne encephalitis virus
GIVVFALLVTG

SEQ ID NO: 209958 - protein, 11 aa, Tick-borne encephalitis virus
IVLALLVTGMV

SEQ ID NO: 209959 - protein, 11 aa, Tick-borne encephalitis virus
VLALLVTGMVK

SEQ ID NO: 209960 - protein, 11 aa, Tick-borne encephalitis virus
VKVESLVRYVV

SEQ ID NO: 209961 - protein, 11 aa, Tick-borne encephalitis virus
KVESLVRYVVA

SEQ ID NO: 209962 - protein, 11 aa, Tick-borne encephalitis virus
GLLSAFALRRN

SEQ ID NO: 209963 - protein, 11 aa, Tick-borne encephalitis virus
LLSAFALRRNL

SEQ ID NO: 209964 - protein, 11 aa, Tick-borne encephalitis virus
LSAFALRRNLT

SEQ ID NO: 209965 - protein, 11 aa, Tick-borne encephalitis virus
SAFALRRNLTV

SEQ ID NO: 209966 - protein, 11 aa, Tick-borne encephalitis virus
AFALRRNLTVR

SEQ ID NO: 209967 - protein, 11 aa, Tick-borne encephalitis virus
FALRRNLTVRE

SEQ ID NO: 209968 - protein, 11 aa, Tick-borne encephalitis virus
ALRRNLTVREM

SEQ ID NO: 209969 - protein, 11 aa, Tick-borne encephalitis virus
LRRNLTVREMV

SEQ ID NO: 209970 - protein, 11 aa, Tick-borne encephalitis virus
RRSLTVREMVI

SEQ ID NO: 209971 - protein, 11 aa, Tick-borne encephalitis virus
SLTVREMVITY

SEQ ID NO: 209972 - protein, 11 aa, Tick-borne encephalitis virus
ILRACTAEGKA

SEQ ID NO: 209973 - protein, 11 aa, Tick-borne encephalitis virus
LRACTAEGKAG

SEQ ID NO: 209974 - protein, 11 aa, Tick-borne encephalitis virus
RACTAEGKAGV

SEQ ID NO: 209975 - protein, 11 aa, Tick-borne encephalitis virus
ACTAEGKTGVG

SEQ ID NO: 209976 - protein, 11 aa, Tick-borne encephalitis virus
CTAEGKAGVGL

SEQ ID NO: 209977 - protein, 11 aa, Tick-borne encephalitis virus
TAEGKAGVGLL

SEQ ID NO: 209978 - protein, 11 aa, Tick-borne encephalitis virus
AEGKAGVGLLL

SEQ ID NO: 209979 - protein, 11 aa, Tick-borne encephalitis virus
EGKTGVGLLLM

SEQ ID NO: 209980 - protein, 11 aa, Tick-borne encephalitis virus
GKAGVGLLLMA

SEQ ID NO: 209981 - protein, 11 aa, Tick-borne encephalitis virus
KAGVGLLLMPL

SEQ ID NO: 209982 - protein, 11 aa, Tick-borne encephalitis virus
TGVGLLLMALI

SEQ ID NO: 209983 - protein, 11 aa, Tick-borne encephalitis virus
GVGLLLMALIT

SEQ ID NO: 209984 - protein, 11 aa, Tick-borne encephalitis virus
VGLLLMPLLTK

SEQ ID NO: 209985 - protein, 11 aa, Tick-borne encephalitis virus
GLLLMPLLTKR

SEQ ID NO: 209986 - protein, 11 aa, Tick-borne encephalitis virus
LLLMALMTQQN

SEQ ID NO: 209987 - protein, 11 aa, Tick-borne encephalitis virus
WRLLRGHREQK

SEQ ID NO: 209988 - protein, 11 aa, Tick-borne encephalitis virus
RLLRGHREQKG

SEQ ID NO: 209989 - protein, 11 aa, Tick-borne encephalitis virus
LLEGHREQKGL

SEQ ID NO: 209990 - protein, 11 aa, Tick-borne encephalitis virus
LRGHREQKGLT

SEQ ID NO: 209991 - protein, 11 aa, Tick-borne encephalitis virus
EGHREQKGLTW

SEQ ID NO: 209992 - protein, 11 aa, Tick-borne encephalitis virus
GHREQKGLSWT

SEQ ID NO: 209993 - protein, 11 aa, Tick-borne encephalitis virus
HREQKGLSWTV

SEQ ID NO: 209994 - protein, 11 aa, Tick-borne encephalitis virus
REQKGLSWTVP

SEQ ID NO: 209995 - protein, 11 aa, Tick-borne encephalitis virus
EQKGLSWIVPM

SEQ ID NO: 209996 - protein, 11 aa, Tick-borne encephalitis virus
QKGLSWTVPLA

SEQ ID NO: 209997 - protein, 11 aa, Tick-borne encephalitis virus
VPLAGLVGGEG

SEQ ID NO: 209998 - protein, 11 aa, Tick-borne encephalitis virus
PLAGLVGGEGS

SEQ ID NO: 209999 - protein, 11 aa, Tick-borne encephalitis virus
MARLLGGEGSG

SEQ ID NO: 210000 - protein, 11 aa, Tick-borne encephalitis virus
AGLMGGEGSGI

SEQ ID NO: 210001 - protein, 11 aa, Tick-borne encephalitis virus
GLMGGEGSGIR

SEQ ID NO: 210002 - protein, 11 aa, Tick-borne encephalitis virus
LVGGEGSGIRL

SEQ ID NO: 210003 - protein, 11 aa, Tick-borne encephalitis virus
VGGEGSGIRLL

SEQ ID NO: 210004 - protein, 11 aa, Tick-borne encephalitis virus
GIRLLSFWELS

SEQ ID NO: 210005 - protein, 11 aa, Tick-borne encephalitis virus
SGRRRSFSEPL

SEQ ID NO: 210006 - protein, 11 aa, Tick-borne encephalitis virus
VMAFWLLAGLS

SEQ ID NO: 210007 - protein, 11 aa, Tick-borne encephalitis virus
AGLAASALHWS

SEQ ID NO: 210008 - protein, 11 aa, Tick-borne encephalitis virus
GLAASALHWSG

SEQ ID NO: 210009 - protein, 11 aa, Tick-borne encephalitis virus
LSASAFHWSGI

SEQ ID NO: 210010 - protein, 11 aa, Tick-borne encephalitis virus
ASALHWSGILG

SEQ ID NO: 210011 - protein, 11 aa, Tick-borne encephalitis virus
SALHWSGILGV

SEQ ID NO: 210012 - protein, 11 aa, Tick-borne encephalitis virus
ALHWSGILGVM

SEQ ID NO: 210013 - protein, 11 aa, Tick-borne encephalitis virus
IHWSGIIGVMG

SEQ ID NO: 210014 - protein, 11 aa, Tick-borne encephalitis virus
VMGLWTLTKML

SEQ ID NO: 210015 - protein, 11 aa, Tick-borne encephalitis virus
MGLWTLSEMLK

SEQ ID NO: 210016 - protein, 11 aa, Tick-borne encephalitis virus
ARRSDLAFSGQ

SEQ ID NO: 210017 - protein, 11 aa, Tick-borne encephalitis virus
RSDLAFSGQGG

SEQ ID NO: 210018 - protein, 11 aa, Tick-borne encephalitis virus
SDLVFSGQGNR

SEQ ID NO: 210019 - protein, 11 aa, Tick-borne encephalitis virus
GLVFSGQGGRE

SEQ ID NO: 210020 - protein, 11 aa, Tick-borne encephalitis virus
LAFSGQGGRER

SEQ ID NO: 210021 - protein, 11 aa, Tick-borne encephalitis virus
VFSGQGNRERG

SEQ ID NO: 210022 - protein, 11 aa, Tick-borne encephalitis virus
SGQGRGERGDK

SEQ ID NO: 210023 - protein, 11 aa, Tick-borne encephalitis virus
GQGRGERGDKP

SEQ ID NO: 210024 - protein, 11 aa, Tick-borne encephalitis virus
QGRGERGDKPF

SEQ ID NO: 210025 - protein, 11 aa, Tick-borne encephalitis virus
GRGERGDKPFE

SEQ ID NO: 210026 - protein, 11 aa, Tick-borne encephalitis virus
NRERGDRPFEV

SEQ ID NO: 210027 - protein, 11 aa, Tick-borne encephalitis virus
RERGDKPFEVR

SEQ ID NO: 210028 - protein, 11 aa, Tick-borne encephalitis virus
ERGDKPFEVRD

SEQ ID NO: 210029 - protein, 11 aa, Tick-borne encephalitis virus
RGDKPFEVRDG

SEQ ID NO: 210030 - protein, 11 aa, Tick-borne encephalitis virus
GDKPFEVRDGV

SEQ ID NO: 210031 - protein, 11 aa, Tick-borne encephalitis virus
DKPFEVRDGVY

SEQ ID NO: 210032 - protein, 11 aa, Tick-borne encephalitis virus
KPFEVRDGVYR

SEQ ID NO: 210033 - protein, 11 aa, Tick-borne encephalitis virus
IFSPGLFWGQS

SEQ ID NO: 210034 - protein, 11 aa, Tick-borne encephalitis virus
FSPGLFWGQSQ

SEQ ID NO: 210035 - protein, 11 aa, Tick-borne encephalitis virus
SPGLFWGQRQV

SEQ ID NO: 210036 - protein, 11 aa, Tick-borne encephalitis virus
PGLFWGQRQVG

SEQ ID NO: 210037 - protein, 11 aa, Tick-borne encephalitis virus
GLFWGQSQVGV

SEQ ID NO: 210038 - protein, 11 aa, Tick-borne encephalitis virus
LFWGQRQVGVG

SEQ ID NO: 210039 - protein, 11 aa, Tick-borne encephalitis virus
FWGQRQVGVGY

SEQ ID NO: 210040 - protein, 11 aa, Tick-borne encephalitis virus
GQSQVGVGYGS

SEQ ID NO: 210041 - protein, 11 aa, Tick-borne encephalitis virus
QSQVGVGYGSK

SEQ ID NO: 210042 - protein, 11 aa, Tick-borne encephalitis virus
RQVGVGYGFRG

SEQ ID NO: 210043 - protein, 11 aa, Tick-borne encephalitis virus
HVTRGAALYID

SEQ ID NO: 210044 - protein, 11 aa, Tick-borne encephalitis virus
VTRGAALSVDD

SEQ ID NO: 210045 - protein, 11 aa, Tick-borne encephalitis virus
TRGAALSVDDA

SEQ ID NO: 210046 - protein, 11 aa, Tick-borne encephalitis virus
RGAALYIDDAV

SEQ ID NO: 210047 - protein, 11 aa, Tick-borne encephalitis virus
GAALSVDDAVV

SEQ ID NO: 210048 - protein, 11 aa, Tick-borne encephalitis virus
AALSIDDAVVG

SEQ ID NO: 210049 - protein, 11 aa, Tick-borne encephalitis virus
ALSVDDAVVGP

SEQ ID NO: 210050 - protein, 11 aa, Tick-borne encephalitis virus
LSIDDAVVGPY

SEQ ID NO: 210051 - protein, 11 aa, Tick-borne encephalitis virus
SVDDAVVGPYW

SEQ ID NO: 210052 - protein, 11 aa, Tick-borne encephalitis virus
IDDAVVGPYWA

SEQ ID NO: 210053 - protein, 11 aa, Tick-borne encephalitis virus
DDAVAGPYWAE

SEQ ID NO: 210054 - protein, 11 aa, Tick-borne encephalitis virus
DAVAGPYWAEV

SEQ ID NO: 210055 - protein, 11 aa, Tick-borne encephalitis virus
AVAGPYWSDVR

SEQ ID NO: 210056 - protein, 11 aa, Tick-borne encephalitis virus
VAGPYWSDVRE

SEQ ID NO: 210057 - protein, 11 aa, Tick-borne encephalitis virus
AGPYWAEVKED

SEQ ID NO: 210058 - protein, 11 aa, Tick-borne encephalitis virus
GPYWSDVREDV

SEQ ID NO: 210059 - protein, 11 aa, Tick-borne encephalitis virus
PYWAEVKEDVV

SEQ ID NO: 210060 - protein, 11 aa, Tick-borne encephalitis virus
YWAEVKEDVVC

SEQ ID NO: 210061 - protein, 11 aa, Tick-borne encephalitis virus
WSDVREDVVCY

SEQ ID NO: 210062 - protein, 11 aa, Tick-borne encephalitis virus
AEVKEDVVCYG

SEQ ID NO: 210063 - protein, 11 aa, Tick-borne encephalitis virus
GAVLIDLSKGT

SEQ ID NO: 210064 - protein, 11 aa, Tick-borne encephalitis virus
AVLIDLSKGTS

SEQ ID NO: 210065 - protein, 11 aa, Tick-borne encephalitis virus
VLIDLSKGTSR

SEQ ID NO: 210066 - protein, 11 aa, Tick-borne encephalitis virus
DLSKGTSRSPI

SEQ ID NO: 210067 - protein, 11 aa, Tick-borne encephalitis virus
LAKGTSGSPTL

SEQ ID NO: 210068 - protein, 11 aa, Tick-borne encephalitis virus
AKGTSGSPIIN

SEQ ID NO: 210069 - protein, 11 aa, Tick-borne encephalitis virus
KGTSGSPTLNS

SEQ ID NO: 210070 - protein, 11 aa, Tick-borne encephalitis virus
GTSGSPTLNSQ

SEQ ID NO: 210071 - protein, 11 aa, Tick-borne encephalitis virus
TSGSPIINSQG

SEQ ID NO: 210072 - protein, 11 aa, Tick-borne encephalitis virus
SPTLNSQGVVV

SEQ ID NO: 210073 - protein, 11 aa, Tick-borne encephalitis virus
PIINSQGVVVG

SEQ ID NO: 210074 - protein, 11 aa, Tick-borne encephalitis virus
TLNSQGVVVGL

SEQ ID NO: 210075 - protein, 11 aa, Tick-borne encephalitis virus
INSQGVVVGLY

SEQ ID NO: 210076 - protein, 11 aa, Tick-borne encephalitis virus
AQGEAEKSRPS

SEQ ID NO: 210077 - protein, 11 aa, Tick-borne encephalitis virus
QGEAEKSRPSL

SEQ ID NO: 210078 - protein, 11 aa, Tick-borne encephalitis virus
GEAEKSRPSLP

SEQ ID NO: 210079 - protein, 11 aa, Tick-borne encephalitis virus
EAERSRPNLPQ

SEQ ID NO: 210080 - protein, 11 aa, Tick-borne encephalitis virus
AERSRPNLPQA

SEQ ID NO: 210081 - protein, 11 aa, Tick-borne encephalitis virus
ERSRPNLPQAV

SEQ ID NO: 210082 - protein, 11 aa, Tick-borne encephalitis virus
GSGWTAKGQIT

SEQ ID NO: 210083 - protein, 11 aa, Tick-borne encephalitis virus
SGWTAKGQITV

SEQ ID NO: 210084 - protein, 11 aa, Tick-borne encephalitis virus
NGKRVRFHSPV

SEQ ID NO: 210085 - protein, 11 aa, Tick-borne encephalitis virus
KRVRFLSPAVS

SEQ ID NO: 210086 - protein, 11 aa, Tick-borne encephalitis virus
RVRFHSPVVGD

SEQ ID NO: 210087 - protein, 11 aa, Tick-borne encephalitis virus
VRFLSPAVSDQ

SEQ ID NO: 210088 - protein, 11 aa, Tick-borne encephalitis virus
RFLSPAVSDQQ

SEQ ID NO: 210089 - protein, 11 aa, Tick-borne encephalitis virus
ESNRGITSEVK

SEQ ID NO: 210090 - protein, 11 aa, Tick-borne encephalitis virus
SNRGITSEVKQ

SEQ ID NO: 210091 - protein, 11 aa, Tick-borne encephalitis virus
NRGITSEVKQI

SEQ ID NO: 210092 - protein, 11 aa, Tick-borne encephalitis virus
RGITSEVKQIP

SEQ ID NO: 210093 - protein, 11 aa, Tick-borne encephalitis virus
SEERQIPNGEW

SEQ ID NO: 210094 - protein, 11 aa, Tick-borne encephalitis virus
EVKQIPEGEWR

SEQ ID NO: 210095 - protein, 11 aa, Tick-borne encephalitis virus
VKQIPEGEWRD

SEQ ID NO: 210096 - protein, 11 aa, Tick-borne encephalitis virus
RQIPNGEWRDG

SEQ ID NO: 210097 - protein, 11 aa, Tick-borne encephalitis virus
WFVPSIVKGGI

SEQ ID NO: 210098 - protein, 11 aa, Tick-borne encephalitis virus
FVPSIVKGGII

SEQ ID NO: 210099 - protein, 11 aa, Tick-borne encephalitis virus
VPSIVKGGIIA

SEQ ID NO: 210100 - protein, 11 aa, Tick-borne encephalitis virus
PSIVKGGIIAR

SEQ ID NO: 210101 - protein, 11 aa, Tick-borne encephalitis virus
SIAKGGIIARA

SEQ ID NO: 210102 - protein, 11 aa, Tick-borne encephalitis virus
IVKGGIIARTL

SEQ ID NO: 210103 - protein, 11 aa, Tick-borne encephalitis virus
VKGGIIARTLR

SEQ ID NO: 210104 - protein, 11 aa, Tick-borne encephalitis virus
KGGIIARALRQ

SEQ ID NO: 210105 - protein, 11 aa, Tick-borne encephalitis virus
GGIIARALRQK

SEQ ID NO: 210106 - protein, 11 aa, Tick-borne encephalitis virus
GIIARALRQKG

SEQ ID NO: 210107 - protein, 11 aa, Tick-borne encephalitis virus
IIARALRQKGK

SEQ ID NO: 210108 - protein, 11 aa, Tick-borne encephalitis virus
APRRGRVGRQE

SEQ ID NO: 210109 - protein, 11 aa, Tick-borne encephalitis virus
PRRGRVGRQEG

SEQ ID NO: 210110 - protein, 11 aa, Tick-borne encephalitis virus
RGRVGRQEGRI

SEQ ID NO: 210111 - protein, 11 aa, Tick-borne encephalitis virus
GRVGRQEGRID

SEQ ID NO: 210112 - protein, 11 aa, Tick-borne encephalitis virus
RVGRQEGRIDE

SEQ ID NO: 210113 - protein, 11 aa, Tick-borne encephalitis virus
VGRQEGRIDEY

SEQ ID NO: 210114 - protein, 11 aa, Tick-borne encephalitis virus
GRQEGRIDEYI

SEQ ID NO: 210115 - protein, 11 aa, Tick-borne encephalitis virus
RQEGRIDEYIY

SEQ ID NO: 210116 - protein, 11 aa, Tick-borne encephalitis virus
QEGRIDEYIYS

SEQ ID NO: 210117 - protein, 11 aa, Tick-borne encephalitis virus
YSGQCDEYDSG

SEQ ID NO: 210118 - protein, 11 aa, Tick-borne encephalitis virus
SGQCDDDDGGL

SEQ ID NO: 210119 - protein, 11 aa, Tick-borne encephalitis virus
GQCDDDDSVLV

SEQ ID NO: 210120 - protein, 11 aa, Tick-borne encephalitis virus
QCDDDDGGLVQ

SEQ ID NO: 210121 - protein, 11 aa, Tick-borne encephalitis virus
CDDDDSVLVQW

SEQ ID NO: 210122 - protein, 11 aa, Tick-borne encephalitis virus
DDDDGGLVQWK

SEQ ID NO: 210123 - protein, 11 aa, Tick-borne encephalitis virus
DDDSVLVQWKE

SEQ ID NO: 210124 - protein, 11 aa, Tick-borne encephalitis virus
DDSVLVQWKEA

SEQ ID NO: 210125 - protein, 11 aa, Tick-borne encephalitis virus
DSVLVQWKEAQ

SEQ ID NO: 210126 - protein, 11 aa, Tick-borne encephalitis virus
SGLVQWKEGQI

SEQ ID NO: 210127 - protein, 11 aa, Tick-borne encephalitis virus
KEGQILLDNIT

SEQ ID NO: 210128 - protein, 11 aa, Tick-borne encephalitis virus
EGQILLDNITT

SEQ ID NO: 210129 - protein, 11 aa, Tick-borne encephalitis virus
AQILLDDITTL

SEQ ID NO: 210130 - protein, 11 aa, Tick-borne encephalitis virus
DNITTLRGPVV

SEQ ID NO: 210131 - protein, 11 aa, Tick-borne encephalitis virus
NIITLRGPVAT

SEQ ID NO: 210132 - protein, 11 aa, Tick-borne encephalitis virus
AANVSGVTSRN

SEQ ID NO: 210133 - protein, 11 aa, Tick-borne encephalitis virus
ANVSGVTSRNW

SEQ ID NO: 210134 - protein, 11 aa, Tick-borne encephalitis virus
NVSSVTSRSWT

SEQ ID NO: 210135 - protein, 11 aa, Tick-borne encephalitis virus
VSGVTSRNWTW

SEQ ID NO: 210136 - protein, 11 aa, Tick-borne encephalitis virus
SGVTSRNWTWE

SEQ ID NO: 210137 - protein, 11 aa, Tick-borne encephalitis virus
GVTSRNWTWEG

SEQ ID NO: 210138 - protein, 11 aa, Tick-borne encephalitis virus
SWTWEGPEENA

SEQ ID NO: 210139 - protein, 11 aa, Tick-borne encephalitis virus
EANAVDEASGG

SEQ ID NO: 210140 - protein, 11 aa, Tick-borne encephalitis virus
ANAVDEASGGL

SEQ ID NO: 210141 - protein, 11 aa, Tick-borne encephalitis virus
NAVDEASGGLV

SEQ ID NO: 210142 - protein, 11 aa, Tick-borne encephalitis virus
AVDEASGGLVT

SEQ ID NO: 210143 - protein, 11 aa, Tick-borne encephalitis virus
DEASGGLVTFR

SEQ ID NO: 210144 - protein, 11 aa, Tick-borne encephalitis virus
EASGGLVTFRS

SEQ ID NO: 210145 - protein, 11 aa, Tick-borne encephalitis virus
ASGGLVTFRSP

SEQ ID NO: 210146 - protein, 11 aa, Tick-borne encephalitis virus
SGGLVTFRSPN

SEQ ID NO: 210147 - protein, 11 aa, Tick-borne encephalitis virus
MDVFYTLMHDE

SEQ ID NO: 210148 - protein, 11 aa, Tick-borne encephalitis virus
YTLMHEEPGSS

SEQ ID NO: 210149 - protein, 11 aa, Tick-borne encephalitis virus
TLMHEEPGSSA

SEQ ID NO: 210150 - protein, 11 aa, Tick-borne encephalitis virus
LMHDEPGSRAM

SEQ ID NO: 210151 - protein, 11 aa, Tick-borne encephalitis virus
MHEEPGSSAMR

SEQ ID NO: 210152 - protein, 11 aa, Tick-borne encephalitis virus
HDEPGSRAMKM

SEQ ID NO: 210153 - protein, 11 aa, Tick-borne encephalitis virus
EEPGSSAMRMA

SEQ ID NO: 210154 - protein, 11 aa, Tick-borne encephalitis virus
EPGSSAMRMAE

SEQ ID NO: 210155 - protein, 11 aa, Tick-borne encephalitis virus
PGSSAMRMAER

SEQ ID NO: 210156 - protein, 11 aa, Tick-borne encephalitis virus
DSRAMRMAERD

SEQ ID NO: 210157 - protein, 11 aa, Tick-borne encephalitis virus
RDAPEAFLTVA

SEQ ID NO: 210158 - protein, 11 aa, Tick-borne encephalitis virus
DAPEAFLTVAE

SEQ ID NO: 210159 - protein, 11 aa, Tick-borne encephalitis virus
VEMMVLGLGTL

SEQ ID NO: 210160 - protein, 11 aa, Tick-borne encephalitis virus
EMLVLGLATLG

SEQ ID NO: 210161 - protein, 11 aa, Tick-borne encephalitis virus
MMVLGLGTLGV

SEQ ID NO: 210162 - protein, 11 aa, Tick-borne encephalitis virus
LVLGLATLGVV

SEQ ID NO: 210163 - protein, 11 aa, Tick-borne encephalitis virus
GTLGVVWCFVV

SEQ ID NO: 210164 - protein, 11 aa, Tick-borne encephalitis virus
LGVVWCFVVRA

SEQ ID NO: 210165 - protein, 11 aa, Tick-borne encephalitis virus
GVVWCFVVRAS

SEQ ID NO: 210166 - protein, 11 aa, Tick-borne encephalitis virus
VVWCFVARTSI

SEQ ID NO: 210167 - protein, 11 aa, Tick-borne encephalitis virus
VWCFVVRASIS

SEQ ID NO: 210168 - protein, 11 aa, Tick-borne encephalitis virus
SLVLLWAGGVS

SEQ ID NO: 210169 - protein, 11 aa, Tick-borne encephalitis virus
LVLLWAGGVSY

SEQ ID NO: 210170 - protein, 11 aa, Tick-borne encephalitis virus
VLLWAGGVSYG

SEQ ID NO: 210171 - protein, 11 aa, Tick-borne encephalitis virus
LLERTKADLST

SEQ ID NO: 210172 - protein, 11 aa, Tick-borne encephalitis virus
LEKTKADLSAV

SEQ ID NO: 210173 - protein, 11 aa, Tick-borne encephalitis virus
EKTKADLSAVL

SEQ ID NO: 210174 - protein, 11 aa, Tick-borne encephalitis virus
KTKADLSAVLW

SEQ ID NO: 210175 - protein, 11 aa, Tick-borne encephalitis virus
TKADLSTVLWA

SEQ ID NO: 210176 - protein, 11 aa, Tick-borne encephalitis virus
EMRSWEEWTNI

SEQ ID NO: 210177 - protein, 11 aa, Tick-borne encephalitis virus
VRSWEEWTNID

SEQ ID NO: 210178 - protein, 11 aa, Tick-borne encephalitis virus
MRDLGGGAPFI

SEQ ID NO: 210179 - protein, 11 aa, Tick-borne encephalitis virus
RDLGGGAPFLG

SEQ ID NO: 210180 - protein, 11 aa, Tick-borne encephalitis virus
DLGGGAPFIGV

SEQ ID NO: 210181 - protein, 11 aa, Tick-borne encephalitis virus
LGGGAPFIGVA

SEQ ID NO: 210182 - protein, 11 aa, Tick-borne encephalitis virus
GGGAPFIGVAG

SEQ ID NO: 210183 - protein, 11 aa, Tick-borne encephalitis virus
GGAPFIGVAGH

SEQ ID NO: 210184 - protein, 11 aa, Tick-borne encephalitis virus
GAPFLGVAGHV

SEQ ID NO: 210185 - protein, 11 aa, Tick-borne encephalitis virus
GVAGHVMSLGV

SEQ ID NO: 210186 - protein, 11 aa, Tick-borne encephalitis virus
VAGHVMSLGVV

SEQ ID NO: 210187 - protein, 11 aa, Tick-borne encephalitis virus
AGHVMSLGVVS

SEQ ID NO: 210188 - protein, 11 aa, Tick-borne encephalitis virus
GHVMSLGVVSL

SEQ ID NO: 210189 - protein, 11 aa, Tick-borne encephalitis virus
HVMSLGVVSLV

SEQ ID NO: 210190 - protein, 11 aa, Tick-borne encephalitis virus
VMSLGVVSLVG

SEQ ID NO: 210191 - protein, 11 aa, Tick-borne encephalitis virus
MSLGVVSLVGA

SEQ ID NO: 210192 - protein, 11 aa, Tick-borne encephalitis virus
YERRMSLVLAI

SEQ ID NO: 210193 - protein, 11 aa, Tick-borne encephalitis virus
MSLVLATVLCL

SEQ ID NO: 210194 - protein, 11 aa, Tick-borne encephalitis virus
VLCLISVVMNR

SEQ ID NO: 210195 - protein, 11 aa, Tick-borne encephalitis virus
CLMSVVMNRTM

SEQ ID NO: 210196 - protein, 11 aa, Tick-borne encephalitis virus
SVVMNRTMASI

SEQ ID NO: 210197 - protein, 11 aa, Tick-borne encephalitis virus
VVMNRTMASIT

SEQ ID NO: 210198 - protein, 11 aa, Tick-borne encephalitis virus
VMNRTMASITE

SEQ ID NO: 210199 - protein, 11 aa, Tick-borne encephalitis virus
MNRTMASITEA

SEQ ID NO: 210200 - protein, 11 aa, Tick-borne encephalitis virus
NRTVLSITEAS

SEQ ID NO: 210201 - protein, 11 aa, Tick-borne encephalitis virus
RTMASITEASA

SEQ ID NO: 210202 - protein, 11 aa, Tick-borne encephalitis virus
TMASITEASAV

SEQ ID NO: 210203 - protein, 11 aa, Tick-borne encephalitis virus
MASITEASAVG

SEQ ID NO: 210204 - protein, 11 aa, Tick-borne encephalitis virus
LSITEASAVGL

SEQ ID NO: 210205 - protein, 11 aa, Tick-borne encephalitis virus
TEAAAVGLAAA

SEQ ID NO: 210206 - protein, 11 aa, Tick-borne encephalitis virus
EASAVGLAALG

SEQ ID NO: 210207 - protein, 11 aa, Tick-borne encephalitis virus
ASAVGLAALGQ

SEQ ID NO: 210208 - protein, 11 aa, Tick-borne encephalitis virus
AAVGLAAAGQL

SEQ ID NO: 210209 - protein, 11 aa, Tick-borne encephalitis virus
VGLAALGQLLR

SEQ ID NO: 210210 - protein, 11 aa, Tick-borne encephalitis virus
GLAALGQLLRP

SEQ ID NO: 210211 - protein, 11 aa, Tick-borne encephalitis virus
LAALGQLLRPE

SEQ ID NO: 210212 - protein, 11 aa, Tick-borne encephalitis virus
GQLLRPEEDTL

SEQ ID NO: 210213 - protein, 11 aa, Tick-borne encephalitis virus
QLLRPEEDTLW

SEQ ID NO: 210214 - protein, 11 aa, Tick-borne encephalitis virus
LLRPEEDTLWT

SEQ ID NO: 210215 - protein, 11 aa, Tick-borne encephalitis virus
LRPEEDTLWTM

SEQ ID NO: 210216 - protein, 11 aa, Tick-borne encephalitis virus
RPEEDTLWTMP

SEQ ID NO: 210217 - protein, 11 aa, Tick-borne encephalitis virus
PVACGLSGVVT

SEQ ID NO: 210218 - protein, 11 aa, Tick-borne encephalitis virus
VACGLSGVVTG

SEQ ID NO: 210219 - protein, 11 aa, Tick-borne encephalitis virus
ACGLSGVVTGS

SEQ ID NO: 210220 - protein, 11 aa, Tick-borne encephalitis virus
CGLSGVVTGSL

SEQ ID NO: 210221 - protein, 11 aa, Tick-borne encephalitis virus
GLSGVVTGSLW

SEQ ID NO: 210222 - protein, 11 aa, Tick-borne encephalitis virus
LSGVVTGSLWG

SEQ ID NO: 210223 - protein, 11 aa, Tick-borne encephalitis virus
RASGSRRGGSD

SEQ ID NO: 210224 - protein, 11 aa, Tick-borne encephalitis virus
ASGSRRGGSDG

SEQ ID NO: 210225 - protein, 11 aa, Tick-borne encephalitis virus
SGSRRGGSDGD

SEQ ID NO: 210226 - protein, 11 aa, Tick-borne encephalitis virus
GSRRGGSDGDT

SEQ ID NO: 210227 - protein, 11 aa, Tick-borne encephalitis virus
SRRGGSDGDTL

SEQ ID NO: 210228 - protein, 11 aa, Tick-borne encephalitis virus
LNSCTREEFFA

SEQ ID NO: 210229 - protein, 11 aa, Tick-borne encephalitis virus
NSCTREEFFIY

SEQ ID NO: 210230 - protein, 11 aa, Tick-borne encephalitis virus
SCTREEFFAYR

SEQ ID NO: 210231 - protein, 11 aa, Tick-borne encephalitis virus
CTREEFFIYRR

SEQ ID NO: 210232 - protein, 11 aa, Tick-borne encephalitis virus
EEFFIYRRTGI

SEQ ID NO: 210233 - protein, 11 aa, Tick-borne encephalitis virus
EFFVYRRTGIM

SEQ ID NO: 210234 - protein, 11 aa, Tick-borne encephalitis virus
FFIYRRTGILE

SEQ ID NO: 210235 - protein, 11 aa, Tick-borne encephalitis virus
FVYRRTGIMET

SEQ ID NO: 210236 - protein, 11 aa, Tick-borne encephalitis virus
IYRRTGILETE

SEQ ID NO: 210237 - protein, 11 aa, Tick-borne encephalitis virus
RTGIMETERDK

SEQ ID NO: 210238 - protein, 11 aa, Tick-borne encephalitis virus
TGILETERDRA

SEQ ID NO: 210239 - protein, 11 aa, Tick-borne encephalitis virus
ERDRARELLRR

SEQ ID NO: 210240 - protein, 11 aa, Tick-borne encephalitis virus
RDKARELLKKG

SEQ ID NO: 210241 - protein, 11 aa, Tick-borne encephalitis virus
DKARELLKRGE

SEQ ID NO: 210242 - protein, 11 aa, Tick-borne encephalitis virus
KARELLKRGET

SEQ ID NO: 210243 - protein, 11 aa, Tick-borne encephalitis virus
ARELLKKGETN

SEQ ID NO: 210244 - protein, 11 aa, Tick-borne encephalitis virus
RGETNVGLAVS

SEQ ID NO: 210245 - protein, 11 aa, Tick-borne encephalitis virus
AASRPSVMSVK

SEQ ID NO: 210246 - protein, 11 aa, Tick-borne encephalitis virus
ASRPAVMNVRA

SEQ ID NO: 210247 - protein, 11 aa, Tick-borne encephalitis virus
SRPAVMNVRAY

SEQ ID NO: 210248 - protein, 11 aa, Tick-borne encephalitis virus
RPAVMNVRAYT

SEQ ID NO: 210249 - protein, 11 aa, Tick-borne encephalitis virus
PAVMNVRAYTI

SEQ ID NO: 210250 - protein, 11 aa, Tick-borne encephalitis virus
AVMNVRAYTIG

SEQ ID NO: 210251 - protein, 11 aa, Tick-borne encephalitis virus
MSVKAYTIGGR

SEQ ID NO: 210252 - protein, 11 aa, Tick-borne encephalitis virus
NVRAYTIGGKG

SEQ ID NO: 210253 - protein, 11 aa, Tick-borne encephalitis virus
VKAYTIGGRGH

SEQ ID NO: 210254 - protein, 11 aa, Tick-borne encephalitis virus
KAYTIGGRGHE

SEQ ID NO: 210255 - protein, 11 aa, Tick-borne encephalitis virus
AYTIGGRGHET

SEQ ID NO: 210256 - protein, 11 aa, Tick-borne encephalitis virus
YTIGGRGHETP

SEQ ID NO: 210257 - protein, 11 aa, Tick-borne encephalitis virus
TIGGRGHETPK

SEQ ID NO: 210258 - protein, 11 aa, Tick-borne encephalitis virus
IGGRGHETPKM

SEQ ID NO: 210259 - protein, 11 aa, Tick-borne encephalitis virus
GGRGHETPKMV

SEQ ID NO: 210260 - protein, 11 aa, Tick-borne encephalitis virus
GKGHETPRMVT

SEQ ID NO: 210261 - protein, 11 aa, Tick-borne encephalitis virus
RGHETPKMVTS

SEQ ID NO: 210262 - protein, 11 aa, Tick-borne encephalitis virus
DTVMCDIGESN

SEQ ID NO: 210263 - protein, 11 aa, Tick-borne encephalitis virus
TVMCDIGESNP

SEQ ID NO: 210264 - protein, 11 aa, Tick-borne encephalitis virus
VMCDIGESNPD

SEQ ID NO: 210265 - protein, 11 aa, Tick-borne encephalitis virus
SNPDAVVEGEK

SEQ ID NO: 210266 - protein, 11 aa, Tick-borne encephalitis virus
NPDAVVEGEKT

SEQ ID NO: 210267 - protein, 11 aa, Tick-borne encephalitis virus
DAVVEGEKTRK

SEQ ID NO: 210268 - protein, 11 aa, Tick-borne encephalitis virus
AVVEGEKTRKV

SEQ ID NO: 210269 - protein, 11 aa, Tick-borne encephalitis virus
VVEGEKTRKVI

SEQ ID NO: 210270 - protein, 11 aa, Tick-borne encephalitis virus
EQWKIRNPTAT

SEQ ID NO: 210271 - protein, 11 aa, Tick-borne encephalitis virus
QWKNRNPAAAC

SEQ ID NO: 210272 - protein, 11 aa, Tick-borne encephalitis virus
WKIRNPTATCV

SEQ ID NO: 210273 - protein, 11 aa, Tick-borne encephalitis virus
KIRNPTATCVF

SEQ ID NO: 210274 - protein, 11 aa, Tick-borne encephalitis virus
NRNPAAACVFK

SEQ ID NO: 210275 - protein, 11 aa, Tick-borne encephalitis virus
VIETLHRFQLQ

SEQ ID NO: 210276 - protein, 11 aa, Tick-borne encephalitis virus
IETLHRFQLQW

SEQ ID NO: 210277 - protein, 11 aa, Tick-borne encephalitis virus
ETLHRFQLQWG

SEQ ID NO: 210278 - protein, 11 aa, Tick-borne encephalitis virus
TLHRFQLQWGG

SEQ ID NO: 210279 - protein, 11 aa, Tick-borne encephalitis virus
GVGTRCVVLAD

SEQ ID NO: 210280 - protein, 11 aa, Tick-borne encephalitis virus
VGTRCVFLAED

SEQ ID NO: 210281 - protein, 11 aa, Tick-borne encephalitis virus
GTRCVFLAEDK

SEQ ID NO: 210282 - protein, 11 aa, Tick-borne encephalitis virus
TRCVVLADDKV

SEQ ID NO: 210283 - protein, 11 aa, Tick-borne encephalitis virus
RCVVLADDKVK

SEQ ID NO: 210284 - protein, 11 aa, Tick-borne encephalitis virus
CVVLADDKVKE

SEQ ID NO: 210285 - protein, 11 aa, Tick-borne encephalitis virus
LAEDKVREKDV

SEQ ID NO: 210286 - protein, 11 aa, Tick-borne encephalitis virus
DKVREKDVQER

SEQ ID NO: 210287 - protein, 11 aa, Tick-borne encephalitis virus
KVREKDVQERI

SEQ ID NO: 210288 - protein, 11 aa, Tick-borne encephalitis virus
DAEHPYRTWQY

SEQ ID NO: 210289 - protein, 11 aa, Tick-borne encephalitis virus
AEHPYRTWQYW

SEQ ID NO: 210290 - protein, 11 aa, Tick-borne encephalitis virus
NDWMLDRLAQK

SEQ ID NO: 210291 - protein, 11 aa, Tick-borne encephalitis virus
DWILERLAQRS

SEQ ID NO: 210292 - protein, 11 aa, Tick-borne encephalitis virus
RPRMCSKEEFI

SEQ ID NO: 210293 - protein, 11 aa, Tick-borne encephalitis virus
CSKEEFIAKVR

SEQ ID NO: 210294 - protein, 11 aa, Tick-borne encephalitis virus
KEEFIAKVKSS

SEQ ID NO: 210295 - protein, 11 aa, Tick-borne encephalitis virus
KSNAALGAWSN

SEQ ID NO: 210296 - protein, 11 aa, Tick-borne encephalitis virus
SSAALGAWSDE

SEQ ID NO: 210297 - protein, 11 aa, Tick-borne encephalitis virus
NAALGAWSNEQ

SEQ ID NO: 210298 - protein, 11 aa, Tick-borne encephalitis virus
GAWSEEQNRWS

SEQ ID NO: 210299 - protein, 11 aa, Tick-borne encephalitis virus
GAREAVEDPAF

SEQ ID NO: 210300 - protein, 11 aa, Tick-borne encephalitis virus
EAVEDPAFWRL

SEQ ID NO: 210301 - protein, 11 aa, Tick-borne encephalitis virus
AVEDPAFWRLV

SEQ ID NO: 210302 - protein, 11 aa, Tick-borne encephalitis virus
VEDPAFWRLVD

SEQ ID NO: 210303 - protein, 11 aa, Tick-borne encephalitis virus
EDPAFWRLVDE

SEQ ID NO: 210304 - protein, 11 aa, Tick-borne encephalitis virus
DPAFWRLVDEE

SEQ ID NO: 210305 - protein, 11 aa, Tick-borne encephalitis virus
PAFWRLVDEER

SEQ ID NO: 210306 - protein, 11 aa, Tick-borne encephalitis virus
AFWRLVDEERE

SEQ ID NO: 210307 - protein, 11 aa, Tick-borne encephalitis virus
FWKLVDEERER

SEQ ID NO: 210308 - protein, 11 aa, Tick-borne encephalitis virus
WKLVDEERERH

SEQ ID NO: 210309 - protein, 11 aa, Tick-borne encephalitis virus
KLVDEERERHL

SEQ ID NO: 210310 - protein, 11 aa, Tick-borne encephalitis virus
LVDEERERHLT

SEQ ID NO: 210311 - protein, 11 aa, Tick-borne encephalitis virus
VDEERERHLTG

SEQ ID NO: 210312 - protein, 11 aa, Tick-borne encephalitis virus
DEERERDLAGR

SEQ ID NO: 210313 - protein, 11 aa, Tick-borne encephalitis virus
EERERHLTGRC

SEQ ID NO: 210314 - protein, 11 aa, Tick-borne encephalitis virus
ERERHLTGRCA

SEQ ID NO: 210315 - protein, 11 aa, Tick-borne encephalitis virus
RERDLAGRSAH

SEQ ID NO: 210316 - protein, 11 aa, Tick-borne encephalitis virus
ERDLAGRSAHG

SEQ ID NO: 210317 - protein, 11 aa, Tick-borne encephalitis virus
RHLAGRCAHCA

SEQ ID NO: 210318 - protein, 11 aa, Tick-borne encephalitis virus
GRCAHCAYNMM

SEQ ID NO: 210319 - protein, 11 aa, Tick-borne encephalitis virus
RCAHCAYNMMG

SEQ ID NO: 210320 - protein, 11 aa, Tick-borne encephalitis virus
SAHGVFNIMGK

SEQ ID NO: 210321 - protein, 11 aa, Tick-borne encephalitis virus
AHCAYNMMGKR

SEQ ID NO: 210322 - protein, 11 aa, Tick-borne encephalitis virus
HGVFNIMGKRE

SEQ ID NO: 210323 - protein, 11 aa, Tick-borne encephalitis virus
CAYNMMGKREK

SEQ ID NO: 210324 - protein, 11 aa, Tick-borne encephalitis virus
AYNMMGKREKK

SEQ ID NO: 210325 - protein, 11 aa, Tick-borne encephalitis virus
DHWASRESSGS

SEQ ID NO: 210326 - protein, 11 aa, Tick-borne encephalitis virus
HWASRESSGSG

SEQ ID NO: 210327 - protein, 11 aa, Tick-borne encephalitis virus
WASRESSGSGV

SEQ ID NO: 210328 - protein, 11 aa, Tick-borne encephalitis virus
ASRGSSGAGVE

SEQ ID NO: 210329 - protein, 11 aa, Tick-borne encephalitis virus
SRGFSGSGVEG

SEQ ID NO: 210330 - protein, 11 aa, Tick-borne encephalitis virus
RESSGSGVEGI

SEQ ID NO: 210331 - protein, 11 aa, Tick-borne encephalitis virus
ESSGSGVEGIS

SEQ ID NO: 210332 - protein, 11 aa, Tick-borne encephalitis virus
SLNYLGWHLKR

SEQ ID NO: 210333 - protein, 11 aa, Tick-borne encephalitis virus
LNYLGWHLKRL

SEQ ID NO: 210334 - protein, 11 aa, Tick-borne encephalitis virus
NYLGWHLKRLS

SEQ ID NO: 210335 - protein, 11 aa, Tick-borne encephalitis virus
LSTPEGGLFYA

SEQ ID NO: 210336 - protein, 11 aa, Tick-borne encephalitis virus
STPEGGLFYAD

SEQ ID NO: 210337 - protein, 11 aa, Tick-borne encephalitis virus
TPEGGLFYADD

SEQ ID NO: 210338 - protein, 11 aa, Tick-borne encephalitis virus
QLLRYMEGEHR

SEQ ID NO: 210339 - protein, 11 aa, Tick-borne encephalitis virus
LLRYMEGEHRQ

SEQ ID NO: 210340 - protein, 11 aa, Tick-borne encephalitis virus
EGEHKQLAATV

SEQ ID NO: 210341 - protein, 11 aa, Tick-borne encephalitis virus
GEHKQLAATVM

SEQ ID NO: 210342 - protein, 11 aa, Tick-borne encephalitis virus
EHKQLAATVMQ

SEQ ID NO: 210343 - protein, 11 aa, Tick-borne encephalitis virus
HKQLAATVMQK

SEQ ID NO: 210344 - protein, 11 aa, Tick-borne encephalitis virus
KQLAATVMQKA

SEQ ID NO: 210345 - protein, 11 aa, Tick-borne encephalitis virus
MMEGEGVVEAS

SEQ ID NO: 210346 - protein, 11 aa, Tick-borne encephalitis virus
MEGEGVVEASD

SEQ ID NO: 210347 - protein, 11 aa, Tick-borne encephalitis virus
EGEGVVEASDA

SEQ ID NO: 210348 - protein, 11 aa, Tick-borne encephalitis virus
GEGVVEASDAH

SEQ ID NO: 210349 - protein, 11 aa, Tick-borne encephalitis virus
EGVVEASDAHN

SEQ ID NO: 210350 - protein, 11 aa, Tick-borne encephalitis virus
GVVEASDAHNP

SEQ ID NO: 210351 - protein, 11 aa, Tick-borne encephalitis virus
VVEASDAHNPR

SEQ ID NO: 210352 - protein, 11 aa, Tick-borne encephalitis virus
VEASDAHNPRL

SEQ ID NO: 210353 - protein, 11 aa, Tick-borne encephalitis virus
EATDAHNPRLF

SEQ ID NO: 210354 - protein, 11 aa, Tick-borne encephalitis virus
ATDAHNPRLFR

SEQ ID NO: 210355 - protein, 11 aa, Tick-borne encephalitis virus
TDAHNPRLFRV

SEQ ID NO: 210356 - protein, 11 aa, Tick-borne encephalitis virus
RLLRVERWLRN

SEQ ID NO: 210357 - protein, 11 aa, Tick-borne encephalitis virus
EHGGERLGRML

SEQ ID NO: 210358 - protein, 11 aa, Tick-borne encephalitis virus
VSGDDCVVRGI

SEQ ID NO: 210359 - protein, 11 aa, Tick-borne encephalitis virus
SGDDCVVRGID

SEQ ID NO: 210360 - protein, 11 aa, Tick-borne encephalitis virus
GDDCVVRGIDD

SEQ ID NO: 210361 - protein, 11 aa, Tick-borne encephalitis virus
DDCVVRGIDDR

SEQ ID NO: 210362 - protein, 11 aa, Tick-borne encephalitis virus
DCVVRGIDDRF

SEQ ID NO: 210363 - protein, 11 aa, Tick-borne encephalitis virus
CVVRPVDDRFG

SEQ ID NO: 210364 - protein, 11 aa, Tick-borne encephalitis virus
DDRFGRALYFL

SEQ ID NO: 210365 - protein, 11 aa, Tick-borne encephalitis virus
DRFGRALYFLN

SEQ ID NO: 210366 - protein, 11 aa, Tick-borne encephalitis virus
RFGRALYFLND

SEQ ID NO: 210367 - protein, 11 aa, Tick-borne encephalitis virus
FGRALYFLNDM

SEQ ID NO: 210368 - protein, 11 aa, Tick-borne encephalitis virus
GRALYFLNDMA

SEQ ID NO: 210369 - protein, 11 aa, Tick-borne encephalitis virus
DIGEWEHSAGL

SEQ ID NO: 210370 - protein, 11 aa, Tick-borne encephalitis virus
IGEWEHSAGLS

SEQ ID NO: 210371 - protein, 11 aa, Tick-borne encephalitis virus
SVEEVPFCSHH

SEQ ID NO: 210372 - protein, 11 aa, Tick-borne encephalitis virus
ELVMKDGRALV

SEQ ID NO: 210373 - protein, 11 aa, Tick-borne encephalitis virus
LVMKDGRALVV

SEQ ID NO: 210374 - protein, 11 aa, Tick-borne encephalitis virus
VMKDGRALVVP

SEQ ID NO: 210375 - protein, 11 aa, Tick-borne encephalitis virus
MKDGRALVVPC

SEQ ID NO: 210376 - protein, 11 aa, Tick-borne encephalitis virus
KDGRALVVPCR

SEQ ID NO: 210377 - protein, 11 aa, Tick-borne encephalitis virus
DGRALVVPCRD

SEQ ID NO: 210378 - protein, 11 aa, Tick-borne encephalitis virus
GRALVVPCRDQ

SEQ ID NO: 210379 - protein, 11 aa, Tick-borne encephalitis virus
RALVVPCRDQD

SEQ ID NO: 210380 - protein, 11 aa, Tick-borne encephalitis virus
ALVVPCRDQDE

SEQ ID NO: 210381 - protein, 11 aa, Tick-borne encephalitis virus
ARVSPGCGWSI

SEQ ID NO: 210382 - protein, 11 aa, Tick-borne encephalitis virus
RVSPGCGWSIR

SEQ ID NO: 210383 - protein, 11 aa, Tick-borne encephalitis virus
RDLRTLGLAIS

SEQ ID NO: 210384 - protein, 11 aa, Tick-borne encephalitis virus
DLRTLGLTICS

SEQ ID NO: 210385 - protein, 11 aa, Tick-borne encephalitis virus
LRTLGFAICSA

SEQ ID NO: 210386 - protein, 11 aa, Tick-borne encephalitis virus
RTLGLAISSAV

SEQ ID NO: 210387 - protein, 11 aa, Tick-borne encephalitis virus
TLGFAICSAVP

SEQ ID NO: 210388 - protein, 11 aa, Tick-borne encephalitis virus
SAVPTDWVPTG

SEQ ID NO: 210389 - protein, 11 aa, Tick-borne encephalitis virus
AVPTDWVPTGR

SEQ ID NO: 210390 - protein, 11 aa, Tick-borne encephalitis virus
VPTDWVPTGRT

SEQ ID NO: 210391 - protein, 11 aa, Tick-borne encephalitis virus
PTDWVPTGRTT

SEQ ID NO: 210392 - protein, 11 aa, Tick-borne encephalitis virus
TDWVPTGRTTW

SEQ ID NO: 210393 - protein, 11 aa, Tick-borne encephalitis virus
HASGAWITTED

SEQ ID NO: 210394 - protein, 11 aa, Tick-borne encephalitis virus
ASGAWITTEDM

SEQ ID NO: 210395 - protein, 11 aa, Tick-borne encephalitis virus
SGAWMTTENML

SEQ ID NO: 210396 - protein, 11 aa, Tick-borne encephalitis virus
GSWMTTEDMLD

SEQ ID NO: 210397 - protein, 11 aa, Tick-borne encephalitis virus
AWITTEDMLDV

SEQ ID NO: 210398 - protein, 11 aa, Tick-borne encephalitis virus
ILDNPFMQNKG

SEQ ID NO: 210399 - protein, 11 aa, Tick-borne encephalitis virus
LDNPFMQNKGK

SEQ ID NO: 210400 - protein, 11 aa, Tick-borne encephalitis virus
EWRNVPYLPKA

SEQ ID NO: 210401 - protein, 11 aa, Tick-borne encephalitis virus
VPYLPKAHDML

SEQ ID NO: 210402 - protein, 11 aa, Tick-borne encephalitis virus
VGRTERAEWAK

SEQ ID NO: 210403 - protein, 11 aa, Tick-borne encephalitis virus
GRTERAEWAKN

SEQ ID NO: 210404 - protein, 11 aa, Tick-borne encephalitis virus
RTERAEWAKNI

SEQ ID NO: 210405 - protein, 11 aa, Tick-borne encephalitis virus
TERAEWAKNIW

SEQ ID NO: 210406 - protein, 11 aa, Tick-borne encephalitis virus
WGAVEKVRKIV

SEQ ID NO: 210407 - protein, 11 aa, Tick-borne encephalitis virus
GAVEKVRKMVG

SEQ ID NO: 210408 - protein, 11 aa, Tick-borne encephalitis virus
KCKDYPSCMDR

SEQ ID NO: 210409 - protein, 11 aa, Tick-borne encephalitis virus
KDYPSCMDRHD

SEQ ID NO: 210410 - protein, 11 aa, Tick-borne encephalitis virus
HYLHWNLKLES

SEQ ID NO: 210411 - protein, 11 aa, Tick-borne encephalitis virus
DLHWELKLEGS

SEQ ID NO: 210412 - protein, 11 aa, Tick-borne encephalitis virus
LHWNLKLESSI

SEQ ID NO: 210413 - protein, 11 aa, Tick-borne encephalitis virus
HWELKLEGSII

SEQ ID NO: 210414 - protein, 11 aa, Tick-borne encephalitis virus
PPRRVSKEAAK

SEQ ID NO: 210415 - protein, 11 aa, Tick-borne encephalitis virus
PRRVSKEAAKK

SEQ ID NO: 210416 - protein, 11 aa, Tick-borne encephalitis virus
RRVSKEAAKKT

SEQ ID NO: 210417 - protein, 11 aa, Tick-borne encephalitis virus
RASKETAKKTR

SEQ ID NO: 210418 - protein, 11 aa, Tick-borne encephalitis virus
ASKETAKKTRQ

SEQ ID NO: 210419 - protein, 11 aa, Tick-borne encephalitis virus
AAKKTRQSRVQ

SEQ ID NO: 210420 - protein, 11 aa, Tick-borne encephalitis virus
LKSFWKPVPLK

SEQ ID NO: 210421 - protein, 11 aa, Tick-borne encephalitis virus
KSFWKPVPLKQ

SEQ ID NO: 210422 - protein, 11 aa, Tick-borne encephalitis virus
SFWKPVPLKQA

SEQ ID NO: 210423 - protein, 11 aa, Tick-borne encephalitis virus
FWKPVPLKQAT

SEQ ID NO: 210424 - protein, 11 aa, Tick-borne encephalitis virus
SVPLKQATTAL

SEQ ID NO: 210425 - protein, 11 aa, Tick-borne encephalitis virus
ATAALRKIKRA

SEQ ID NO: 210426 - protein, 11 aa, Tick-borne encephalitis virus
TAALRKIKRAV

SEQ ID NO: 210427 - protein, 11 aa, Tick-borne encephalitis virus
ALRKIKRAVST

SEQ ID NO: 210428 - protein, 11 aa, Tick-borne encephalitis virus
LRKIKKAVSAL

SEQ ID NO: 210429 - protein, 11 aa, Tick-borne encephalitis virus
RKIKMAVSALM

SEQ ID NO: 210430 - protein, 11 aa, Tick-borne encephalitis virus
LMVGLQRREKK

SEQ ID NO: 210431 - protein, 11 aa, Tick-borne encephalitis virus
MVGLQRREKKR

SEQ ID NO: 210432 - protein, 11 aa, Tick-borne encephalitis virus
VGLQRREKKRS

SEQ ID NO: 210433 - protein, 11 aa, Tick-borne encephalitis virus
GLQRREKKRST

SEQ ID NO: 210434 - protein, 11 aa, Tick-borne encephalitis virus
TIAATVRKERD

SEQ ID NO: 210435 - protein, 11 aa, Tick-borne encephalitis virus
AATVRREGDGT

SEQ ID NO: 210436 - protein, 11 aa, Tick-borne encephalitis virus
ATVRREGDGTT

SEQ ID NO: 210437 - protein, 11 aa, Tick-borne encephalitis virus
TVRREGDGTTV

SEQ ID NO: 210438 - protein, 11 aa, Tick-borne encephalitis virus
VRKERDDTTVI

SEQ ID NO: 210439 - protein, 11 aa, Tick-borne encephalitis virus
RREGDGTTVIR

SEQ ID NO: 210440 - protein, 11 aa, Tick-borne encephalitis virus
REGDGTTVIRA

SEQ ID NO: 210441 - protein, 11 aa, Tick-borne encephalitis virus
VVALLCLAPVY

SEQ ID NO: 210442 - protein, 11 aa, Tick-borne encephalitis virus
LDAIYQEKPAK

SEQ ID NO: 210443 - protein, 11 aa, Tick-borne encephalitis virus
DAIYQEKPAKT

SEQ ID NO: 210444 - protein, 11 aa, Tick-borne encephalitis virus
AIYQEKPAKTR

SEQ ID NO: 210445 - protein, 11 aa, Tick-borne encephalitis virus
KGSIVTCVKVS

SEQ ID NO: 210446 - protein, 11 aa, Tick-borne encephalitis virus
GSIVTCVKVSC

SEQ ID NO: 210447 - protein, 11 aa, Tick-borne encephalitis virus
SIVTCVKVSCE

SEQ ID NO: 210448 - protein, 11 aa, Tick-borne encephalitis virus
IVTCVKVSCEA

SEQ ID NO: 210449 - protein, 11 aa, Tick-borne encephalitis virus
VTCVKVSCEAK

SEQ ID NO: 210450 - protein, 11 aa, Tick-borne encephalitis virus
TCVKVSCEAKK

SEQ ID NO: 210451 - protein, 11 aa, Tick-borne encephalitis virus
HEGVQNWNNAE

SEQ ID NO: 210452 - protein, 11 aa, Tick-borne encephalitis virus
EGARNWNNAER

SEQ ID NO: 210453 - protein, 11 aa, Tick-borne encephalitis virus
GARNWNNAERL

SEQ ID NO: 210454 - protein, 11 aa, Tick-borne encephalitis virus
ARNWNNAERLV

SEQ ID NO: 210455 - protein, 11 aa, Tick-borne encephalitis virus
CDKTKFTWRRT

SEQ ID NO: 210456 - protein, 11 aa, Tick-borne encephalitis virus
DKTKFTWRRTP

SEQ ID NO: 210457 - protein, 11 aa, Tick-borne encephalitis virus
KTKFTWRRTPT

SEQ ID NO: 210458 - protein, 11 aa, Tick-borne encephalitis virus
TKFTWRRTPTD

SEQ ID NO: 210459 - protein, 11 aa, Tick-borne encephalitis virus
KFTWRRTPTDS

SEQ ID NO: 210460 - protein, 11 aa, Tick-borne encephalitis virus
FTWRRTPTDSG

SEQ ID NO: 210461 - protein, 11 aa, Tick-borne encephalitis virus
TWRRTPTDSGH

SEQ ID NO: 210462 - protein, 11 aa, Tick-borne encephalitis virus
GGFLSSIGKAL

SEQ ID NO: 210463 - protein, 11 aa, Tick-borne encephalitis virus
GFLSSIGKALH

SEQ ID NO: 210464 - protein, 11 aa, Tick-borne encephalitis virus
FLSSIGKALHT

SEQ ID NO: 210465 - protein, 11 aa, Tick-borne encephalitis virus
GGVGFIPKLLL

SEQ ID NO: 210466 - protein, 11 aa, Tick-borne encephalitis virus
GVGFLPKILIG

SEQ ID NO: 210467 - protein, 11 aa, Tick-borne encephalitis virus
SAIKEAFEEGT

SEQ ID NO: 210468 - protein, 11 aa, Tick-borne encephalitis virus
AIKEAFEEGTC

SEQ ID NO: 210469 - protein, 11 aa, Tick-borne encephalitis virus
IRETFEEGTCG

SEQ ID NO: 210470 - protein, 11 aa, Tick-borne encephalitis virus
KEAFEEGTCGI

SEQ ID NO: 210471 - protein, 11 aa, Tick-borne encephalitis virus
EAFEEGTCGIV

SEQ ID NO: 210472 - protein, 11 aa, Tick-borne encephalitis virus
AFEEGTCGIVP

SEQ ID NO: 210473 - protein, 11 aa, Tick-borne encephalitis virus
RLEMAMWRSSS

SEQ ID NO: 210474 - protein, 11 aa, Tick-borne encephalitis virus
LEMAMWRSAAT

SEQ ID NO: 210475 - protein, 11 aa, Tick-borne encephalitis virus
EMAMWRSSSTE

SEQ ID NO: 210476 - protein, 11 aa, Tick-borne encephalitis virus
MAMWRSAATEL

SEQ ID NO: 210477 - protein, 11 aa, Tick-borne encephalitis virus
AMWRSSSTELN

SEQ ID NO: 210478 - protein, 11 aa, Tick-borne encephalitis virus
MWRSSSTELNL

SEQ ID NO: 210479 - protein, 11 aa, Tick-borne encephalitis virus
WRSSSTELNLA

SEQ ID NO: 210480 - protein, 11 aa, Tick-borne encephalitis virus
RSSSTELNLAL

SEQ ID NO: 210481 - protein, 11 aa, Tick-borne encephalitis virus
SSSTELNLALA

SEQ ID NO: 210482 - protein, 11 aa, Tick-borne encephalitis virus
SSTELNLALAE

SEQ ID NO: 210483 - protein, 11 aa, Tick-borne encephalitis virus
FDPTDYRGGIP

SEQ ID NO: 210484 - protein, 11 aa, Tick-borne encephalitis virus
IRVSWKSWGHS

SEQ ID NO: 210485 - protein, 11 aa, Tick-borne encephalitis virus
IIWSIPEAPRR

SEQ ID NO: 210486 - protein, 11 aa, Tick-borne encephalitis virus
PRRFMVGIEGS

SEQ ID NO: 210487 - protein, 11 aa, Tick-borne encephalitis virus
QSLWMKSVRNE

SEQ ID NO: 210488 - protein, 11 aa, Tick-borne encephalitis virus
SLWMKSVRNET

SEQ ID NO: 210489 - protein, 11 aa, Tick-borne encephalitis virus
LWMKSVRNETG

SEQ ID NO: 210490 - protein, 11 aa, Tick-borne encephalitis virus
WMKSVRNETGT

SEQ ID NO: 210491 - protein, 11 aa, Tick-borne encephalitis virus
MKSVRNETGTY

SEQ ID NO: 210492 - protein, 11 aa, Tick-borne encephalitis virus
KSVRNETGTYI

SEQ ID NO: 210493 - protein, 11 aa, Tick-borne encephalitis virus
SEQVKGPWKYL

SEQ ID NO: 210494 - protein, 11 aa, Tick-borne encephalitis virus
RVIREECPGTR

SEQ ID NO: 210495 - protein, 11 aa, Tick-borne encephalitis virus
VVRGECPGTKV

SEQ ID NO: 210496 - protein, 11 aa, Tick-borne encephalitis virus
ITADCDKRGAS

SEQ ID NO: 210497 - protein, 11 aa, Tick-borne encephalitis virus
SADCDRRGASV

SEQ ID NO: 210498 - protein, 11 aa, Tick-borne encephalitis virus
RRRPATGTTAV

SEQ ID NO: 210499 - protein, 11 aa, Tick-borne encephalitis virus
RRPSTGSTVVW

SEQ ID NO: 210500 - protein, 11 aa, Tick-borne encephalitis virus
RPATGTTAVWG

SEQ ID NO: 210501 - protein, 11 aa, Tick-borne encephalitis virus
PATGTTAVWGG

SEQ ID NO: 210502 - protein, 11 aa, Tick-borne encephalitis virus
WGGLIVLALLV

SEQ ID NO: 210503 - protein, 11 aa, Tick-borne encephalitis virus
GGIVVFALLVT

SEQ ID NO: 210504 - protein, 11 aa, Tick-borne encephalitis virus
GLIVLALLVTG

SEQ ID NO: 210505 - protein, 11 aa, Tick-borne encephalitis virus
VFALLVTGLVR

SEQ ID NO: 210506 - protein, 11 aa, Tick-borne encephalitis virus
RRNLTVREMVT

SEQ ID NO: 210507 - protein, 11 aa, Tick-borne encephalitis virus
SLTVREMVTIY

SEQ ID NO: 210508 - protein, 11 aa, Tick-borne encephalitis virus
GKAGVGLLLMP

SEQ ID NO: 210509 - protein, 11 aa, Tick-borne encephalitis virus
AGVGLLLMPLL

SEQ ID NO: 210510 - protein, 11 aa, Tick-borne encephalitis virus
LLLMPLLTKRG

SEQ ID NO: 210511 - protein, 11 aa, Tick-borne encephalitis virus
WRLLEGHREQK

SEQ ID NO: 210512 - protein, 11 aa, Tick-borne encephalitis virus
RLLEGHREQKG

SEQ ID NO: 210513 - protein, 11 aa, Tick-borne encephalitis virus
LEGHREQKGLT

SEQ ID NO: 210514 - protein, 11 aa, Tick-borne encephalitis virus
EQKGLSWTVPL

SEQ ID NO: 210515 - protein, 11 aa, Tick-borne encephalitis virus
QKGLSWIVPMA

SEQ ID NO: 210516 - protein, 11 aa, Tick-borne encephalitis virus
VPMARLLGGEG

SEQ ID NO: 210517 - protein, 11 aa, Tick-borne encephalitis virus
PMARLLGGEGS

SEQ ID NO: 210518 - protein, 11 aa, Tick-borne encephalitis virus
LAGLVGGEGSG

SEQ ID NO: 210519 - protein, 11 aa, Tick-borne encephalitis virus
AGLVGGEGSGI

SEQ ID NO: 210520 - protein, 11 aa, Tick-borne encephalitis virus
GLVGGEGSGIR

SEQ ID NO: 210521 - protein, 11 aa, Tick-borne encephalitis virus
AGLSASAFHWS

SEQ ID NO: 210522 - protein, 11 aa, Tick-borne encephalitis virus
GLSASAFHWSG

SEQ ID NO: 210523 - protein, 11 aa, Tick-borne encephalitis virus
LAASALHWSGI

SEQ ID NO: 210524 - protein, 11 aa, Tick-borne encephalitis virus
ASAIHWSGIIG

SEQ ID NO: 210525 - protein, 11 aa, Tick-borne encephalitis virus
SAIHWSGIIGV

SEQ ID NO: 210526 - protein, 11 aa, Tick-borne encephalitis virus
AIHWSGIIGVM

SEQ ID NO: 210527 - protein, 11 aa, Tick-borne encephalitis virus
LHWSGILGVMG

SEQ ID NO: 210528 - protein, 11 aa, Tick-borne encephalitis virus
MGLWTLTKMLR

SEQ ID NO: 210529 - protein, 11 aa, Tick-borne encephalitis virus
RSGLVFSGQGG

SEQ ID NO: 210530 - protein, 11 aa, Tick-borne encephalitis virus
SDLVFSGQGRG

SEQ ID NO: 210531 - protein, 11 aa, Tick-borne encephalitis virus
DLAFSGQGGRE

SEQ ID NO: 210532 - protein, 11 aa, Tick-borne encephalitis virus
GERGDKPFEVK

SEQ ID NO: 210533 - protein, 11 aa, Tick-borne encephalitis virus
QRQVGVGYGFR

SEQ ID NO: 210534 - protein, 11 aa, Tick-borne encephalitis virus
SQVGVGYGSKG

SEQ ID NO: 210535 - protein, 11 aa, Tick-borne encephalitis virus
GAALYIDDAVA

SEQ ID NO: 210536 - protein, 11 aa, Tick-borne encephalitis virus
AALSVDDAVVG

SEQ ID NO: 210537 - protein, 11 aa, Tick-borne encephalitis virus
ALYIDDAVAGP

SEQ ID NO: 210538 - protein, 11 aa, Tick-borne encephalitis virus
LSVDDAVVGPY

SEQ ID NO: 210539 - protein, 11 aa, Tick-borne encephalitis virus
YIDDAVAGPYW

SEQ ID NO: 210540 - protein, 11 aa, Tick-borne encephalitis virus
IDDAVAGPYWS

SEQ ID NO: 210541 - protein, 11 aa, Tick-borne encephalitis virus
DDAVAGPYWSD

SEQ ID NO: 210542 - protein, 11 aa, Tick-borne encephalitis virus
AVAGPYWAEVK

SEQ ID NO: 210543 - protein, 11 aa, Tick-borne encephalitis virus
VAGPYWAEVKE

SEQ ID NO: 210544 - protein, 11 aa, Tick-borne encephalitis virus
AGPYWSDVRED

SEQ ID NO: 210545 - protein, 11 aa, Tick-borne encephalitis virus
LAKGTSGSPII

SEQ ID NO: 210546 - protein, 11 aa, Tick-borne encephalitis virus
AKGTSGSPTLN

SEQ ID NO: 210547 - protein, 11 aa, Tick-borne encephalitis virus
KGTSGSPIINS

SEQ ID NO: 210548 - protein, 11 aa, Tick-borne encephalitis virus
GTSGSPIINSQ

SEQ ID NO: 210549 - protein, 11 aa, Tick-borne encephalitis virus
TSRSPILNAQG

SEQ ID NO: 210550 - protein, 11 aa, Tick-borne encephalitis virus
SPIINSQGVVV

SEQ ID NO: 210551 - protein, 11 aa, Tick-borne encephalitis virus
PTLNSQGVVVG

SEQ ID NO: 210552 - protein, 11 aa, Tick-borne encephalitis virus
IINSQGVVVGL

SEQ ID NO: 210553 - protein, 11 aa, Tick-borne encephalitis virus
EAEKSRPSLPP

SEQ ID NO: 210554 - protein, 11 aa, Tick-borne encephalitis virus
AEKSRPSLPPA

SEQ ID NO: 210555 - protein, 11 aa, Tick-borne encephalitis virus
GIGWTAKGQIT

SEQ ID NO: 210556 - protein, 11 aa, Tick-borne encephalitis virus
IGWTAKGQITV

SEQ ID NO: 210557 - protein, 11 aa, Tick-borne encephalitis virus
VRFHSPVVGDQ

SEQ ID NO: 210558 - protein, 11 aa, Tick-borne encephalitis virus
RFHSPAVGDHQ

SEQ ID NO: 210559 - protein, 11 aa, Tick-borne encephalitis virus
SEVKQIPEGEW

SEQ ID NO: 210560 - protein, 11 aa, Tick-borne encephalitis virus
EERQIPNGEWR

SEQ ID NO: 210561 - protein, 11 aa, Tick-borne encephalitis virus
ERQIPNGEWRD

SEQ ID NO: 210562 - protein, 11 aa, Tick-borne encephalitis virus
SIVKGGIIART

SEQ ID NO: 210563 - protein, 11 aa, Tick-borne encephalitis virus
IAKGGIIARAL

SEQ ID NO: 210564 - protein, 11 aa, Tick-borne encephalitis virus
AKGGIIARALR

SEQ ID NO: 210565 - protein, 11 aa, Tick-borne encephalitis virus
DDGGLVQWKEA

SEQ ID NO: 210566 - protein, 11 aa, Tick-borne encephalitis virus
MHDEPGSRAMK

SEQ ID NO: 210567 - protein, 11 aa, Tick-borne encephalitis virus
HEEPGSSAMRM

SEQ ID NO: 210568 - protein, 11 aa, Tick-borne encephalitis virus
DEPGSRAMKMA

SEQ ID NO: 210569 - protein, 11 aa, Tick-borne encephalitis virus
RDAPEAFLTLV

SEQ ID NO: 210570 - protein, 11 aa, Tick-borne encephalitis virus
DAPEAFLTMAE

SEQ ID NO: 210571 - protein, 11 aa, Tick-borne encephalitis virus
AEMLVLGLATL

SEQ ID NO: 210572 - protein, 11 aa, Tick-borne encephalitis virus
EVRSWEEWTNI

SEQ ID NO: 210573 - protein, 11 aa, Tick-borne encephalitis virus
MRSWEEWTNID

SEQ ID NO: 210574 - protein, 11 aa, Tick-borne encephalitis virus
DLGGGAPFLGV

SEQ ID NO: 210575 - protein, 11 aa, Tick-borne encephalitis virus
LGGGAPFFGIA

SEQ ID NO: 210576 - protein, 11 aa, Tick-borne encephalitis virus
GGGAPFLGVAG

SEQ ID NO: 210577 - protein, 11 aa, Tick-borne encephalitis virus
GGAPFLGVAGH

SEQ ID NO: 210578 - protein, 11 aa, Tick-borne encephalitis virus
GAPFFGIAGHV

SEQ ID NO: 210579 - protein, 11 aa, Tick-borne encephalitis virus
GIAGHVMALGV

SEQ ID NO: 210580 - protein, 11 aa, Tick-borne encephalitis virus
IAGHVMALGVV

SEQ ID NO: 210581 - protein, 11 aa, Tick-borne encephalitis virus
MSLVLAVALCL

SEQ ID NO: 210582 - protein, 11 aa, Tick-borne encephalitis virus
SVVMNRTVLSI

SEQ ID NO: 210583 - protein, 11 aa, Tick-borne encephalitis virus
NRTMASITEAS

SEQ ID NO: 210584 - protein, 11 aa, Tick-borne encephalitis virus
RTVLSITEASA

SEQ ID NO: 210585 - protein, 11 aa, Tick-borne encephalitis virus
TVLSITEASAV

SEQ ID NO: 210586 - protein, 11 aa, Tick-borne encephalitis virus
VLSITEASAVG

SEQ ID NO: 210587 - protein, 11 aa, Tick-borne encephalitis virus
VGLAAAGQLLK

SEQ ID NO: 210588 - protein, 11 aa, Tick-borne encephalitis virus
GLAAAGQLLKP

SEQ ID NO: 210589 - protein, 11 aa, Tick-borne encephalitis virus
LAAAGQLLKPE

SEQ ID NO: 210590 - protein, 11 aa, Tick-borne encephalitis virus
GQLLKPEADTL

SEQ ID NO: 210591 - protein, 11 aa, Tick-borne encephalitis virus
QLLKPEADTLW

SEQ ID NO: 210592 - protein, 11 aa, Tick-borne encephalitis virus
LLKPEADTLWT

SEQ ID NO: 210593 - protein, 11 aa, Tick-borne encephalitis virus
LKPEADTLWTM

SEQ ID NO: 210594 - protein, 11 aa, Tick-borne encephalitis virus
KPEADTLWTMP

SEQ ID NO: 210595 - protein, 11 aa, Tick-borne encephalitis virus
LNSCTREEFFI

SEQ ID NO: 210596 - protein, 11 aa, Tick-borne encephalitis virus
NSCTREEFFAY

SEQ ID NO: 210597 - protein, 11 aa, Tick-borne encephalitis virus
SCTREEFFIYR

SEQ ID NO: 210598 - protein, 11 aa, Tick-borne encephalitis virus
CTREEFFAYRR

SEQ ID NO: 210599 - protein, 11 aa, Tick-borne encephalitis virus
EFFVYRRAGIL

SEQ ID NO: 210600 - protein, 11 aa, Tick-borne encephalitis virus
FFVYRRTGIME

SEQ ID NO: 210601 - protein, 11 aa, Tick-borne encephalitis virus
FIYRRTGILET

SEQ ID NO: 210602 - protein, 11 aa, Tick-borne encephalitis virus
VYRRAGILETE

SEQ ID NO: 210603 - protein, 11 aa, Tick-borne encephalitis virus
ERDKARELLKR

SEQ ID NO: 210604 - protein, 11 aa, Tick-borne encephalitis virus
RDKARELLKRG

SEQ ID NO: 210605 - protein, 11 aa, Tick-borne encephalitis virus
DKARELLKKGE

SEQ ID NO: 210606 - protein, 11 aa, Tick-borne encephalitis virus
RARELLRRGET

SEQ ID NO: 210607 - protein, 11 aa, Tick-borne encephalitis virus
MNVRAYTIGGK

SEQ ID NO: 210608 - protein, 11 aa, Tick-borne encephalitis virus
SVKAYTIGGRG

SEQ ID NO: 210609 - protein, 11 aa, Tick-borne encephalitis virus
TIGGKGHETPR

SEQ ID NO: 210610 - protein, 11 aa, Tick-borne encephalitis virus
IGGKGHETPRM

SEQ ID NO: 210611 - protein, 11 aa, Tick-borne encephalitis virus
GGKGHETPRMV

SEQ ID NO: 210612 - protein, 11 aa, Tick-borne encephalitis virus
GRGHETPKMVT

SEQ ID NO: 210613 - protein, 11 aa, Tick-borne encephalitis virus
KGHETPRMVTS

SEQ ID NO: 210614 - protein, 11 aa, Tick-borne encephalitis virus
RCVFLAEDKVK

SEQ ID NO: 210615 - protein, 11 aa, Tick-borne encephalitis virus
CVFLAEDKVKE

SEQ ID NO: 210616 - protein, 11 aa, Tick-borne encephalitis virus
LADDKVKEKDV

SEQ ID NO: 210617 - protein, 11 aa, Tick-borne encephalitis virus
DKVKEQDVRER

SEQ ID NO: 210618 - protein, 11 aa, Tick-borne encephalitis virus
KVKEQDVRERI

SEQ ID NO: 210619 - protein, 11 aa, Tick-borne encephalitis virus
NGEHPYRTWQY

SEQ ID NO: 210620 - protein, 11 aa, Tick-borne encephalitis virus
DWMLDRLAQKS

SEQ ID NO: 210621 - protein, 11 aa, Tick-borne encephalitis virus
RPRMCSREEFI

SEQ ID NO: 210622 - protein, 11 aa, Tick-borne encephalitis virus
RSNAALGAWSD

SEQ ID NO: 210623 - protein, 11 aa, Tick-borne encephalitis virus
SAKEAVEDPVF

SEQ ID NO: 210624 - protein, 11 aa, Tick-borne encephalitis virus
EAVEDPAFWKL

SEQ ID NO: 210625 - protein, 11 aa, Tick-borne encephalitis virus
AVEDPAFWKLV

SEQ ID NO: 210626 - protein, 11 aa, Tick-borne encephalitis virus
VEDPAFWKLVD

SEQ ID NO: 210627 - protein, 11 aa, Tick-borne encephalitis virus
EDPAFWKLVDE

SEQ ID NO: 210628 - protein, 11 aa, Tick-borne encephalitis virus
DPAFWKLVDEE

SEQ ID NO: 210629 - protein, 11 aa, Tick-borne encephalitis virus
PAFWKLVDEER

SEQ ID NO: 210630 - protein, 11 aa, Tick-borne encephalitis virus
AFWKLVDEERE

SEQ ID NO: 210631 - protein, 11 aa, Tick-borne encephalitis virus
WQLVDEERERD

SEQ ID NO: 210632 - protein, 11 aa, Tick-borne encephalitis virus
QLVDEERERDL

SEQ ID NO: 210633 - protein, 11 aa, Tick-borne encephalitis virus
RHLTGRCAHCV

SEQ ID NO: 210634 - protein, 11 aa, Tick-borne encephalitis virus
DHWASRGFSGS

SEQ ID NO: 210635 - protein, 11 aa, Tick-borne encephalitis virus
HWASRGFSGSG

SEQ ID NO: 210636 - protein, 11 aa, Tick-borne encephalitis virus
WASRGFSGSGV

SEQ ID NO: 210637 - protein, 11 aa, Tick-borne encephalitis virus
ASRESSGSGVE

SEQ ID NO: 210638 - protein, 11 aa, Tick-borne encephalitis virus
SRGSSGAGVEG

SEQ ID NO: 210639 - protein, 11 aa, Tick-borne encephalitis virus
RGSSGAGVEGI

SEQ ID NO: 210640 - protein, 11 aa, Tick-borne encephalitis virus
GFSGSGVEGIS

SEQ ID NO: 210641 - protein, 11 aa, Tick-borne encephalitis virus
SLNYLGWYLKE

SEQ ID NO: 210642 - protein, 11 aa, Tick-borne encephalitis virus
LNYLGWYLKEL

SEQ ID NO: 210643 - protein, 11 aa, Tick-borne encephalitis virus
NYLGWYLKELS

SEQ ID NO: 210644 - protein, 11 aa, Tick-borne encephalitis virus
RLFRVERWLRD

SEQ ID NO: 210645 - protein, 11 aa, Tick-borne encephalitis virus
DYGEERLGRML

SEQ ID NO: 210646 - protein, 11 aa, Tick-borne encephalitis virus
CVVRGIDDRFG

SEQ ID NO: 210647 - protein, 11 aa, Tick-borne encephalitis virus
DDRFSGALYFL

SEQ ID NO: 210648 - protein, 11 aa, Tick-borne encephalitis virus
DRFSGALYFLN

SEQ ID NO: 210649 - protein, 11 aa, Tick-borne encephalitis virus
RFSGALYFLND

SEQ ID NO: 210650 - protein, 11 aa, Tick-borne encephalitis virus
FSGALYFLNDM

SEQ ID NO: 210651 - protein, 11 aa, Tick-borne encephalitis virus
SGALYFLNDMA

SEQ ID NO: 210652 - protein, 11 aa, Tick-borne encephalitis virus
IGEWEHSAGFA

SEQ ID NO: 210653 - protein, 11 aa, Tick-borne encephalitis virus
GWEEVPFCSHH

SEQ ID NO: 210654 - protein, 11 aa, Tick-borne encephalitis virus
RDLRTLGFAIC

SEQ ID NO: 210655 - protein, 11 aa, Tick-borne encephalitis virus
DLRTLGLAISS

SEQ ID NO: 210656 - protein, 11 aa, Tick-borne encephalitis virus
LRTLGLTICSA

SEQ ID NO: 210657 - protein, 11 aa, Tick-borne encephalitis virus
RTLGFAICSAV

SEQ ID NO: 210658 - protein, 11 aa, Tick-borne encephalitis virus
TLGLAISSAVP

SEQ ID NO: 210659 - protein, 11 aa, Tick-borne encephalitis virus
LDNPFMHGKEK

SEQ ID NO: 210660 - protein, 11 aa, Tick-borne encephalitis virus
IPYLPKAQDML

SEQ ID NO: 210661 - protein, 11 aa, Tick-borne encephalitis virus
WGAVEKVRKMV

SEQ ID NO: 210662 - protein, 11 aa, Tick-borne encephalitis virus
GAVEKVRKMMG

SEQ ID NO: 210663 - protein, 8 aa, Japanese encephalitis virus
MTKKPGGP

SEQ ID NO: 210664 - protein, 8 aa, Japanese encephalitis virus
TKKPGGPG

SEQ ID NO: 210665 - protein, 8 aa, Japanese encephalitis virus
KKPGGPGK

SEQ ID NO: 210666 - protein, 8 aa, Japanese encephalitis virus
KPGGPGKN

SEQ ID NO: 210667 - protein, 8 aa, Japanese encephalitis virus
PGGPGKNR

SEQ ID NO: 210668 - protein, 8 aa, Japanese encephalitis virus
GGPGKNRA

SEQ ID NO: 210669 - protein, 8 aa, Japanese encephalitis virus
GPGKNRAI

SEQ ID NO: 210670 - protein, 8 aa, Japanese encephalitis virus
PGKNRAIN

SEQ ID NO: 210671 - protein, 8 aa, Japanese encephalitis virus
GKNRAINM

SEQ ID NO: 210672 - protein, 8 aa, Japanese encephalitis virus
KNRAINML

SEQ ID NO: 210673 - protein, 8 aa, Japanese encephalitis virus
NRAINMLK

SEQ ID NO: 210674 - protein, 8 aa, Japanese encephalitis virus
RAINMLKR

SEQ ID NO: 210675 - protein, 8 aa, Japanese encephalitis virus
AINMLKRG

SEQ ID NO: 210676 - protein, 8 aa, Japanese encephalitis virus
INMLKRGL

SEQ ID NO: 210677 - protein, 8 aa, Japanese encephalitis virus
NMLKRGLP

SEQ ID NO: 210678 - protein, 8 aa, Japanese encephalitis virus
MLKRGLPR

SEQ ID NO: 210679 - protein, 8 aa, Japanese encephalitis virus
LKRGLPRV

SEQ ID NO: 210680 - protein, 8 aa, Japanese encephalitis virus
KRGLPRVF

SEQ ID NO: 210681 - protein, 8 aa, Japanese encephalitis virus
RGLPRVFP

SEQ ID NO: 210682 - protein, 8 aa, Japanese encephalitis virus
GLPRVFPL

SEQ ID NO: 210683 - protein, 8 aa, Japanese encephalitis virus
LPRVFPLV

SEQ ID NO: 210684 - protein, 8 aa, Japanese encephalitis virus
PRVFPLVG

SEQ ID NO: 210685 - protein, 8 aa, Japanese encephalitis virus
RVFPLVGV

SEQ ID NO: 210686 - protein, 8 aa, Japanese encephalitis virus
VFPLVGVK

SEQ ID NO: 210687 - protein, 8 aa, Japanese encephalitis virus
FPLVGVKR

SEQ ID NO: 210688 - protein, 8 aa, Japanese encephalitis virus
PLVGVKRV

SEQ ID NO: 210689 - protein, 8 aa, Japanese encephalitis virus
LVGVKRVV

SEQ ID NO: 210690 - protein, 8 aa, Japanese encephalitis virus
VGVKRVVM

SEQ ID NO: 210691 - protein, 8 aa, Japanese encephalitis virus
GVKRVVMS

SEQ ID NO: 210692 - protein, 8 aa, Japanese encephalitis virus
VKRVVMSL

SEQ ID NO: 210693 - protein, 8 aa, Japanese encephalitis virus
KRVVMSLL

SEQ ID NO: 210694 - protein, 8 aa, Japanese encephalitis virus
RVVMSLLD

SEQ ID NO: 210695 - protein, 8 aa, Japanese encephalitis virus
VVMSLLDG

SEQ ID NO: 210696 - protein, 8 aa, Japanese encephalitis virus
VMSLLDGR

SEQ ID NO: 210697 - protein, 8 aa, Japanese encephalitis virus
MSLLDGRG

SEQ ID NO: 210698 - protein, 8 aa, Japanese encephalitis virus
SLLDGRGP

SEQ ID NO: 210699 - protein, 8 aa, Japanese encephalitis virus
LLDGRGPV

SEQ ID NO: 210700 - protein, 8 aa, Japanese encephalitis virus
LDGRGPVR

SEQ ID NO: 210701 - protein, 8 aa, Japanese encephalitis virus
DGRGPVRF

SEQ ID NO: 210702 - protein, 8 aa, Japanese encephalitis virus
GRGPVRFV

SEQ ID NO: 210703 - protein, 8 aa, Japanese encephalitis virus
RGPVRFVL

SEQ ID NO: 210704 - protein, 8 aa, Japanese encephalitis virus
GPVRFVLA

SEQ ID NO: 210705 - protein, 8 aa, Japanese encephalitis virus
PVRFVLAL

SEQ ID NO: 210706 - protein, 8 aa, Japanese encephalitis virus
VRFVLALI

SEQ ID NO: 210707 - protein, 8 aa, Japanese encephalitis virus
RFVLALIT

SEQ ID NO: 210708 - protein, 8 aa, Japanese encephalitis virus
FVLALITF

SEQ ID NO: 210709 - protein, 8 aa, Japanese encephalitis virus
VLALITFF

SEQ ID NO: 210710 - protein, 8 aa, Japanese encephalitis virus
LALITFFK

SEQ ID NO: 210711 - protein, 8 aa, Japanese encephalitis virus
ALITFFKF

SEQ ID NO: 210712 - protein, 8 aa, Japanese encephalitis virus
LITFFKFT

SEQ ID NO: 210713 - protein, 8 aa, Japanese encephalitis virus
ITFFKFTA

SEQ ID NO: 210714 - protein, 8 aa, Japanese encephalitis virus
TFFKFTAL

SEQ ID NO: 210715 - protein, 8 aa, Japanese encephalitis virus
FFKFTALA

SEQ ID NO: 210716 - protein, 8 aa, Japanese encephalitis virus
FKFTALAP

SEQ ID NO: 210717 - protein, 8 aa, Japanese encephalitis virus
KFTALAPT

SEQ ID NO: 210718 - protein, 8 aa, Japanese encephalitis virus
FTALAPTK

SEQ ID NO: 210719 - protein, 8 aa, Japanese encephalitis virus
TALAPTKA

SEQ ID NO: 210720 - protein, 8 aa, Japanese encephalitis virus
ALAPTKAL

SEQ ID NO: 210721 - protein, 8 aa, Japanese encephalitis virus
LAPTKALL

SEQ ID NO: 210722 - protein, 8 aa, Japanese encephalitis virus
APTKALLG

SEQ ID NO: 210723 - protein, 8 aa, Japanese encephalitis virus
PTKALLGR

SEQ ID NO: 210724 - protein, 8 aa, Japanese encephalitis virus
TKALLGRW

SEQ ID NO: 210725 - protein, 8 aa, Japanese encephalitis virus
KALLGRWK

SEQ ID NO: 210726 - protein, 8 aa, Japanese encephalitis virus
ALLGRWKA

SEQ ID NO: 210727 - protein, 8 aa, Japanese encephalitis virus
LLGRWKAV

SEQ ID NO: 210728 - protein, 8 aa, Japanese encephalitis virus
LGRWKAVE

SEQ ID NO: 210729 - protein, 8 aa, Japanese encephalitis virus
GRWKAVEK

SEQ ID NO: 210730 - protein, 8 aa, Japanese encephalitis virus
RWKAVEKS

SEQ ID NO: 210731 - protein, 8 aa, Japanese encephalitis virus
WKAVEKSV

SEQ ID NO: 210732 - protein, 8 aa, Japanese encephalitis virus
KAVEKSVA

SEQ ID NO: 210733 - protein, 8 aa, Japanese encephalitis virus
AVEKSVAM

SEQ ID NO: 210734 - protein, 8 aa, Japanese encephalitis virus
VEKSVAMK

SEQ ID NO: 210735 - protein, 8 aa, Japanese encephalitis virus
EKSVAMKH

SEQ ID NO: 210736 - protein, 8 aa, Japanese encephalitis virus
KSVAMKHL

SEQ ID NO: 210737 - protein, 8 aa, Japanese encephalitis virus
SVAMKHLT

SEQ ID NO: 210738 - protein, 8 aa, Japanese encephalitis virus
VAMKHLTS

SEQ ID NO: 210739 - protein, 8 aa, Japanese encephalitis virus
AMKHLTSF

SEQ ID NO: 210740 - protein, 8 aa, Japanese encephalitis virus
MKHLTSFK

SEQ ID NO: 210741 - protein, 8 aa, Japanese encephalitis virus
KHLTSFKR

SEQ ID NO: 210742 - protein, 8 aa, Japanese encephalitis virus
HLTSFKRE

SEQ ID NO: 210743 - protein, 8 aa, Japanese encephalitis virus
LTSFKREL

SEQ ID NO: 210744 - protein, 8 aa, Japanese encephalitis virus
TSFKRELG

SEQ ID NO: 210745 - protein, 8 aa, Japanese encephalitis virus
SFKRELGT

SEQ ID NO: 210746 - protein, 8 aa, Japanese encephalitis virus
FKRELGTL

SEQ ID NO: 210747 - protein, 8 aa, Japanese encephalitis virus
KRELGTLI

SEQ ID NO: 210748 - protein, 8 aa, Japanese encephalitis virus
RELGTLID

SEQ ID NO: 210749 - protein, 8 aa, Japanese encephalitis virus
ELGTLIDA

SEQ ID NO: 210750 - protein, 8 aa, Japanese encephalitis virus
LGTLIDAV

SEQ ID NO: 210751 - protein, 8 aa, Japanese encephalitis virus
GTLIDAVN

SEQ ID NO: 210752 - protein, 8 aa, Japanese encephalitis virus
TLIDAVNK

SEQ ID NO: 210753 - protein, 8 aa, Japanese encephalitis virus
LIDAVNKR

SEQ ID NO: 210754 - protein, 8 aa, Japanese encephalitis virus
IDAVNKRG

SEQ ID NO: 210755 - protein, 8 aa, Japanese encephalitis virus
DAVNKRGR

SEQ ID NO: 210756 - protein, 8 aa, Japanese encephalitis virus
AVNKRGRK

SEQ ID NO: 210757 - protein, 8 aa, Japanese encephalitis virus
VNKRGRKQ

SEQ ID NO: 210758 - protein, 8 aa, Japanese encephalitis virus
NKRGRKQN

SEQ ID NO: 210759 - protein, 8 aa, Japanese encephalitis virus
KRGRKQNK

SEQ ID NO: 210760 - protein, 8 aa, Japanese encephalitis virus
RGRKQNKR

SEQ ID NO: 210761 - protein, 8 aa, Japanese encephalitis virus
GRKQNKRG

SEQ ID NO: 210762 - protein, 8 aa, Japanese encephalitis virus
RKQNKRGG

SEQ ID NO: 210763 - protein, 8 aa, Japanese encephalitis virus
KQNKRGGN

SEQ ID NO: 210764 - protein, 8 aa, Japanese encephalitis virus
QNKRGGNE

SEQ ID NO: 210765 - protein, 8 aa, Japanese encephalitis virus
NKRGGNEG

SEQ ID NO: 210766 - protein, 8 aa, Japanese encephalitis virus
IMWLASLA

SEQ ID NO: 210767 - protein, 8 aa, Japanese encephalitis virus
AGAMKLSN

SEQ ID NO: 210768 - protein, 8 aa, Japanese encephalitis virus
GAMKLSNF

SEQ ID NO: 210769 - protein, 8 aa, Japanese encephalitis virus
AMKLSNFQ

SEQ ID NO: 210770 - protein, 8 aa, Japanese encephalitis virus
MKLSNFQG

SEQ ID NO: 210771 - protein, 8 aa, Japanese encephalitis virus
KLSNFQGK

SEQ ID NO: 210772 - protein, 8 aa, Japanese encephalitis virus
LSNFQGKL

SEQ ID NO: 210773 - protein, 8 aa, Japanese encephalitis virus
SNFQGKLL

SEQ ID NO: 210774 - protein, 8 aa, Japanese encephalitis virus
NFQGKLLM

SEQ ID NO: 210775 - protein, 8 aa, Japanese encephalitis virus
FQGKLLMT

SEQ ID NO: 210776 - protein, 8 aa, Japanese encephalitis virus
QGKLLMTI

SEQ ID NO: 210777 - protein, 8 aa, Japanese encephalitis virus
GKLLMTIN

SEQ ID NO: 210778 - protein, 8 aa, Japanese encephalitis virus
KLLMTINN

SEQ ID NO: 210779 - protein, 8 aa, Japanese encephalitis virus
LLMTINNT

SEQ ID NO: 210780 - protein, 8 aa, Japanese encephalitis virus
LMTINNTD

SEQ ID NO: 210781 - protein, 8 aa, Japanese encephalitis virus
MTINNTDI

SEQ ID NO: 210782 - protein, 8 aa, Japanese encephalitis virus
TINNTDIA

SEQ ID NO: 210783 - protein, 8 aa, Japanese encephalitis virus
INNTDIAD

SEQ ID NO: 210784 - protein, 8 aa, Japanese encephalitis virus
NNTDIADV

SEQ ID NO: 210785 - protein, 8 aa, Japanese encephalitis virus
NTDIADVI

SEQ ID NO: 210786 - protein, 8 aa, Japanese encephalitis virus
TDIADVIV

SEQ ID NO: 210787 - protein, 8 aa, Japanese encephalitis virus
DIADVIVI

SEQ ID NO: 210788 - protein, 8 aa, Japanese encephalitis virus
IADVIVIP

SEQ ID NO: 210789 - protein, 8 aa, Japanese encephalitis virus
ADVIVIPT

SEQ ID NO: 210790 - protein, 8 aa, Japanese encephalitis virus
DVIVIPTS

SEQ ID NO: 210791 - protein, 8 aa, Japanese encephalitis virus
VIVIPTSK

SEQ ID NO: 210792 - protein, 8 aa, Japanese encephalitis virus
IVIPTSKG

SEQ ID NO: 210793 - protein, 8 aa, Japanese encephalitis virus
VIPTSKGE

SEQ ID NO: 210794 - protein, 8 aa, Japanese encephalitis virus
IPTSKGEN

SEQ ID NO: 210795 - protein, 8 aa, Japanese encephalitis virus
PTSKGENR

SEQ ID NO: 210796 - protein, 8 aa, Japanese encephalitis virus
TSKGENRC

SEQ ID NO: 210797 - protein, 8 aa, Japanese encephalitis virus
SKGENRCW

SEQ ID NO: 210798 - protein, 8 aa, Japanese encephalitis virus
KGENRCWV

SEQ ID NO: 210799 - protein, 8 aa, Japanese encephalitis virus
GENRCWVR

SEQ ID NO: 210800 - protein, 8 aa, Japanese encephalitis virus
ENRCWVRA

SEQ ID NO: 210801 - protein, 8 aa, Japanese encephalitis virus
NRCWVRAI

SEQ ID NO: 210802 - protein, 8 aa, Japanese encephalitis virus
RCWVRAID

SEQ ID NO: 210803 - protein, 8 aa, Japanese encephalitis virus
CWVRAIDV

SEQ ID NO: 210804 - protein, 8 aa, Japanese encephalitis virus
WVRAIDVG

SEQ ID NO: 210805 - protein, 8 aa, Japanese encephalitis virus
VRAIDVGY

SEQ ID NO: 210806 - protein, 8 aa, Japanese encephalitis virus
RAIDVGYM

SEQ ID NO: 210807 - protein, 8 aa, Japanese encephalitis virus
AIDVGYMC

SEQ ID NO: 210808 - protein, 8 aa, Japanese encephalitis virus
IDVGYMCE

SEQ ID NO: 210809 - protein, 8 aa, Japanese encephalitis virus
DVGYMCED

SEQ ID NO: 210810 - protein, 8 aa, Japanese encephalitis virus
VGYMCEDT

SEQ ID NO: 210811 - protein, 8 aa, Japanese encephalitis virus
GYMCEDTI

SEQ ID NO: 210812 - protein, 8 aa, Japanese encephalitis virus
YMCEDTIT

SEQ ID NO: 210813 - protein, 8 aa, Japanese encephalitis virus
MCEDTITY

SEQ ID NO: 210814 - protein, 8 aa, Japanese encephalitis virus
CEDTITYE

SEQ ID NO: 210815 - protein, 8 aa, Japanese encephalitis virus
EDTITYEC

SEQ ID NO: 210816 - protein, 8 aa, Japanese encephalitis virus
DTITYECP

SEQ ID NO: 210817 - protein, 8 aa, Japanese encephalitis virus
TITYECPK

SEQ ID NO: 210818 - protein, 8 aa, Japanese encephalitis virus
ITYECPKL

SEQ ID NO: 210819 - protein, 8 aa, Japanese encephalitis virus
TYECPKLT

SEQ ID NO: 210820 - protein, 8 aa, Japanese encephalitis virus
MGNDPEDV

SEQ ID NO: 210821 - protein, 8 aa, Japanese encephalitis virus
GNDPEDVD

SEQ ID NO: 210822 - protein, 8 aa, Japanese encephalitis virus
NDPEDVDC

SEQ ID NO: 210823 - protein, 8 aa, Japanese encephalitis virus
DPEDVDCW

SEQ ID NO: 210824 - protein, 8 aa, Japanese encephalitis virus
PEDVDCWC

SEQ ID NO: 210825 - protein, 8 aa, Japanese encephalitis virus
EDVDCWCD

SEQ ID NO: 210826 - protein, 8 aa, Japanese encephalitis virus
DVDCWCDN

SEQ ID NO: 210827 - protein, 8 aa, Japanese encephalitis virus
VDCWCDNQ

SEQ ID NO: 210828 - protein, 8 aa, Japanese encephalitis virus
DCWCDNQE

SEQ ID NO: 210829 - protein, 8 aa, Japanese encephalitis virus
CWCDNQEV

SEQ ID NO: 210830 - protein, 8 aa, Japanese encephalitis virus
WCDNQEVY

SEQ ID NO: 210831 - protein, 8 aa, Japanese encephalitis virus
CDNQEVYV

SEQ ID NO: 210832 - protein, 8 aa, Japanese encephalitis virus
DNQEVYVQ

SEQ ID NO: 210833 - protein, 8 aa, Japanese encephalitis virus
NQEVYVQY

SEQ ID NO: 210834 - protein, 8 aa, Japanese encephalitis virus
QEVYVQYG

SEQ ID NO: 210835 - protein, 8 aa, Japanese encephalitis virus
EVYVQYGR

SEQ ID NO: 210836 - protein, 8 aa, Japanese encephalitis virus
VYVQYGRC

SEQ ID NO: 210837 - protein, 8 aa, Japanese encephalitis virus
YVQYGRCT

SEQ ID NO: 210838 - protein, 8 aa, Japanese encephalitis virus
VQYGRCTR

SEQ ID NO: 210839 - protein, 8 aa, Japanese encephalitis virus
QYGRCTRT

SEQ ID NO: 210840 - protein, 8 aa, Japanese encephalitis virus
YGRCTRTR

SEQ ID NO: 210841 - protein, 8 aa, Japanese encephalitis virus
GRCTRTRH

SEQ ID NO: 210842 - protein, 8 aa, Japanese encephalitis virus
RCTRTRHS

SEQ ID NO: 210843 - protein, 8 aa, Japanese encephalitis virus
CTRTRHSK

SEQ ID NO: 210844 - protein, 8 aa, Japanese encephalitis virus
TRTRHSKR

SEQ ID NO: 210845 - protein, 8 aa, Japanese encephalitis virus
RTRHSKRS

SEQ ID NO: 210846 - protein, 8 aa, Japanese encephalitis virus
TRHSKRSR

SEQ ID NO: 210847 - protein, 8 aa, Japanese encephalitis virus
RHSKRSRR

SEQ ID NO: 210848 - protein, 8 aa, Japanese encephalitis virus
HSKRSRRS

SEQ ID NO: 210849 - protein, 8 aa, Japanese encephalitis virus
SKRSRRSV

SEQ ID NO: 210850 - protein, 8 aa, Japanese encephalitis virus
KRSRRSVS

SEQ ID NO: 210851 - protein, 8 aa, Japanese encephalitis virus
RSRRSVSV

SEQ ID NO: 210852 - protein, 8 aa, Japanese encephalitis virus
SRRSVSVQ

SEQ ID NO: 210853 - protein, 8 aa, Japanese encephalitis virus
RRSVSVQT

SEQ ID NO: 210854 - protein, 8 aa, Japanese encephalitis virus
RSVSVQTH

SEQ ID NO: 210855 - protein, 8 aa, Japanese encephalitis virus
SVSVQTHG

SEQ ID NO: 210856 - protein, 8 aa, Japanese encephalitis virus
VSVQTHGE

SEQ ID NO: 210857 - protein, 8 aa, Japanese encephalitis virus
SVQTHGES

SEQ ID NO: 210858 - protein, 8 aa, Japanese encephalitis virus
VQTHGESS

SEQ ID NO: 210859 - protein, 8 aa, Japanese encephalitis virus
QTHGESSL

SEQ ID NO: 210860 - protein, 8 aa, Japanese encephalitis virus
THGESSLV

SEQ ID NO: 210861 - protein, 8 aa, Japanese encephalitis virus
HGESSLVN

SEQ ID NO: 210862 - protein, 8 aa, Japanese encephalitis virus
GESSLVNK

SEQ ID NO: 210863 - protein, 8 aa, Japanese encephalitis virus
ESSLVNKK

SEQ ID NO: 210864 - protein, 8 aa, Japanese encephalitis virus
SSLVNKKE

SEQ ID NO: 210865 - protein, 8 aa, Japanese encephalitis virus
SLVNKKEA

SEQ ID NO: 210866 - protein, 8 aa, Japanese encephalitis virus
LVNKKEAW

SEQ ID NO: 210867 - protein, 8 aa, Japanese encephalitis virus
VNKKEAWL

SEQ ID NO: 210868 - protein, 8 aa, Japanese encephalitis virus
NKKEAWLD

SEQ ID NO: 210869 - protein, 8 aa, Japanese encephalitis virus
KKEAWLDS

SEQ ID NO: 210870 - protein, 8 aa, Japanese encephalitis virus
KEAWLDST

SEQ ID NO: 210871 - protein, 8 aa, Japanese encephalitis virus
EAWLDSTK

SEQ ID NO: 210872 - protein, 8 aa, Japanese encephalitis virus
AWLDSTKA

SEQ ID NO: 210873 - protein, 8 aa, Japanese encephalitis virus
WLDSTKAT

SEQ ID NO: 210874 - protein, 8 aa, Japanese encephalitis virus
LDSTKATR

SEQ ID NO: 210875 - protein, 8 aa, Japanese encephalitis virus
DSTKATRY

SEQ ID NO: 210876 - protein, 8 aa, Japanese encephalitis virus
STKATRYL

SEQ ID NO: 210877 - protein, 8 aa, Japanese encephalitis virus
TKATRYLM

SEQ ID NO: 210878 - protein, 8 aa, Japanese encephalitis virus
KATRYLMK

SEQ ID NO: 210879 - protein, 8 aa, Japanese encephalitis virus
ATRYLMKT

SEQ ID NO: 210880 - protein, 8 aa, Japanese encephalitis virus
TRYLMKTE

SEQ ID NO: 210881 - protein, 8 aa, Japanese encephalitis virus
RYLMKTEN

SEQ ID NO: 210882 - protein, 8 aa, Japanese encephalitis virus
YLMKTENW

SEQ ID NO: 210883 - protein, 8 aa, Japanese encephalitis virus
LMKTENWI

SEQ ID NO: 210884 - protein, 8 aa, Japanese encephalitis virus
MKTENWII

SEQ ID NO: 210885 - protein, 8 aa, Japanese encephalitis virus
KTENWIIR

SEQ ID NO: 210886 - protein, 8 aa, Japanese encephalitis virus
TENWIIRN

SEQ ID NO: 210887 - protein, 8 aa, Japanese encephalitis virus
ENWIIRNP

SEQ ID NO: 210888 - protein, 8 aa, Japanese encephalitis virus
NWIIRNPG

SEQ ID NO: 210889 - protein, 8 aa, Japanese encephalitis virus
WIIRNPGY

SEQ ID NO: 210890 - protein, 8 aa, Japanese encephalitis virus
IIRNPGYA

SEQ ID NO: 210891 - protein, 8 aa, Japanese encephalitis virus
IRNPGYAF

SEQ ID NO: 210892 - protein, 8 aa, Japanese encephalitis virus
RNPGYAFL

SEQ ID NO: 210893 - protein, 8 aa, Japanese encephalitis virus
NPGYAFLA

SEQ ID NO: 210894 - protein, 8 aa, Japanese encephalitis virus
PGYAFLAA

SEQ ID NO: 210895 - protein, 8 aa, Japanese encephalitis virus
VLGWMLGS

SEQ ID NO: 210896 - protein, 8 aa, Japanese encephalitis virus
LGWMLGSN

SEQ ID NO: 210897 - protein, 8 aa, Japanese encephalitis virus
GWMLGSNN

SEQ ID NO: 210898 - protein, 8 aa, Japanese encephalitis virus
WMLGSNNG

SEQ ID NO: 210899 - protein, 8 aa, Japanese encephalitis virus
GQRVVFTI

SEQ ID NO: 210900 - protein, 8 aa, Japanese encephalitis virus
QRVVFTIL

SEQ ID NO: 210901 - protein, 8 aa, Japanese encephalitis virus
RVVFTILL

SEQ ID NO: 210902 - protein, 8 aa, Japanese encephalitis virus
VVFTILLL

SEQ ID NO: 210903 - protein, 8 aa, Japanese encephalitis virus
VFTILLLL

SEQ ID NO: 210904 - protein, 8 aa, Japanese encephalitis virus
FTILLLLV

SEQ ID NO: 210905 - protein, 8 aa, Japanese encephalitis virus
TILLLLVA

SEQ ID NO: 210906 - protein, 8 aa, Japanese encephalitis virus
ILLLLVAP

SEQ ID NO: 210907 - protein, 8 aa, Japanese encephalitis virus
LLLLVAPA

SEQ ID NO: 210908 - protein, 8 aa, Japanese encephalitis virus
LLLVAPAY

SEQ ID NO: 210909 - protein, 8 aa, Japanese encephalitis virus
LLVAPAYS

SEQ ID NO: 210910 - protein, 8 aa, Japanese encephalitis virus
LVAPAYSF

SEQ ID NO: 210911 - protein, 8 aa, Japanese encephalitis virus
VAPAYSFN

SEQ ID NO: 210912 - protein, 8 aa, Japanese encephalitis virus
APAYSFNC

SEQ ID NO: 210913 - protein, 8 aa, Japanese encephalitis virus
PAYSFNCL

SEQ ID NO: 210914 - protein, 8 aa, Japanese encephalitis virus
AYSFNCLG

SEQ ID NO: 210915 - protein, 8 aa, Japanese encephalitis virus
YSFNCLGM

SEQ ID NO: 210916 - protein, 8 aa, Japanese encephalitis virus
SFNCLGMG

SEQ ID NO: 210917 - protein, 8 aa, Japanese encephalitis virus
FNCLGMGN

SEQ ID NO: 210918 - protein, 8 aa, Japanese encephalitis virus
NCLGMGNR

SEQ ID NO: 210919 - protein, 8 aa, Japanese encephalitis virus
CLGMGNRD

SEQ ID NO: 210920 - protein, 8 aa, Japanese encephalitis virus
LGMGNRDF

SEQ ID NO: 210921 - protein, 8 aa, Japanese encephalitis virus
GMGNRDFI

SEQ ID NO: 210922 - protein, 8 aa, Japanese encephalitis virus
MGNRDFIE

SEQ ID NO: 210923 - protein, 8 aa, Japanese encephalitis virus
GNRDFIEG

SEQ ID NO: 210924 - protein, 8 aa, Japanese encephalitis virus
NRDFIEGA

SEQ ID NO: 210925 - protein, 8 aa, Japanese encephalitis virus
RDFIEGAS

SEQ ID NO: 210926 - protein, 8 aa, Japanese encephalitis virus
DFIEGASG

SEQ ID NO: 210927 - protein, 8 aa, Japanese encephalitis virus
FIEGASGA

SEQ ID NO: 210928 - protein, 8 aa, Japanese encephalitis virus
IEGASGAT

SEQ ID NO: 210929 - protein, 8 aa, Japanese encephalitis virus
EGASGATW

SEQ ID NO: 210930 - protein, 8 aa, Japanese encephalitis virus
GASGATWV

SEQ ID NO: 210931 - protein, 8 aa, Japanese encephalitis virus
ASGATWVD

SEQ ID NO: 210932 - protein, 8 aa, Japanese encephalitis virus
SGATWVDL

SEQ ID NO: 210933 - protein, 8 aa, Japanese encephalitis virus
GATWVDLV

SEQ ID NO: 210934 - protein, 8 aa, Japanese encephalitis virus
ATWVDLVL

SEQ ID NO: 210935 - protein, 8 aa, Japanese encephalitis virus
TWVDLVLE

SEQ ID NO: 210936 - protein, 8 aa, Japanese encephalitis virus
WVDLVLEG

SEQ ID NO: 210937 - protein, 8 aa, Japanese encephalitis virus
VDLVLEGD

SEQ ID NO: 210938 - protein, 8 aa, Japanese encephalitis virus
DLVLEGDS

SEQ ID NO: 210939 - protein, 8 aa, Japanese encephalitis virus
LVLEGDSC

SEQ ID NO: 210940 - protein, 8 aa, Japanese encephalitis virus
VLEGDSCL

SEQ ID NO: 210941 - protein, 8 aa, Japanese encephalitis virus
LEGDSCLT

SEQ ID NO: 210942 - protein, 8 aa, Japanese encephalitis virus
EGDSCLTI

SEQ ID NO: 210943 - protein, 8 aa, Japanese encephalitis virus
GDSCLTIM

SEQ ID NO: 210944 - protein, 8 aa, Japanese encephalitis virus
DSCLTIMA

SEQ ID NO: 210945 - protein, 8 aa, Japanese encephalitis virus
SCLTIMAN

SEQ ID NO: 210946 - protein, 8 aa, Japanese encephalitis virus
CLTIMAND

SEQ ID NO: 210947 - protein, 8 aa, Japanese encephalitis virus
LTIMANDK

SEQ ID NO: 210948 - protein, 8 aa, Japanese encephalitis virus
TIMANDKP

SEQ ID NO: 210949 - protein, 8 aa, Japanese encephalitis virus
IMANDKPT

SEQ ID NO: 210950 - protein, 8 aa, Japanese encephalitis virus
MANDKPTL

SEQ ID NO: 210951 - protein, 8 aa, Japanese encephalitis virus
ANDKPTLD

SEQ ID NO: 210952 - protein, 8 aa, Japanese encephalitis virus
NDKPTLDV

SEQ ID NO: 210953 - protein, 8 aa, Japanese encephalitis virus
DKPTLDVR

SEQ ID NO: 210954 - protein, 8 aa, Japanese encephalitis virus
KPTLDVRM

SEQ ID NO: 210955 - protein, 8 aa, Japanese encephalitis virus
PTLDVRMI

SEQ ID NO: 210956 - protein, 8 aa, Japanese encephalitis virus
TLDVRMIN

SEQ ID NO: 210957 - protein, 8 aa, Japanese encephalitis virus
LDVRMINI

SEQ ID NO: 210958 - protein, 8 aa, Japanese encephalitis virus
DVRMINIE

SEQ ID NO: 210959 - protein, 8 aa, Japanese encephalitis virus
VRMINIEA

SEQ ID NO: 210960 - protein, 8 aa, Japanese encephalitis virus
RMINIEAS

SEQ ID NO: 210961 - protein, 8 aa, Japanese encephalitis virus
MINIEASQ

SEQ ID NO: 210962 - protein, 8 aa, Japanese encephalitis virus
INIEASQL

SEQ ID NO: 210963 - protein, 8 aa, Japanese encephalitis virus
NIEASQLA

SEQ ID NO: 210964 - protein, 8 aa, Japanese encephalitis virus
IEASQLAE

SEQ ID NO: 210965 - protein, 8 aa, Japanese encephalitis virus
EASQLAEV

SEQ ID NO: 210966 - protein, 8 aa, Japanese encephalitis virus
ASQLAEVR

SEQ ID NO: 210967 - protein, 8 aa, Japanese encephalitis virus
SQLAEVRS

SEQ ID NO: 210968 - protein, 8 aa, Japanese encephalitis virus
QLAEVRSY

SEQ ID NO: 210969 - protein, 8 aa, Japanese encephalitis virus
LAEVRSYC

SEQ ID NO: 210970 - protein, 8 aa, Japanese encephalitis virus
AEVRSYCY

SEQ ID NO: 210971 - protein, 8 aa, Japanese encephalitis virus
EVRSYCYH

SEQ ID NO: 210972 - protein, 8 aa, Japanese encephalitis virus
VRSYCYHA

SEQ ID NO: 210973 - protein, 8 aa, Japanese encephalitis virus
RSYCYHAS

SEQ ID NO: 210974 - protein, 8 aa, Japanese encephalitis virus
SYCYHASV

SEQ ID NO: 210975 - protein, 8 aa, Japanese encephalitis virus
YCYHASVT

SEQ ID NO: 210976 - protein, 8 aa, Japanese encephalitis virus
CYHASVTD

SEQ ID NO: 210977 - protein, 8 aa, Japanese encephalitis virus
YHASVTDI

SEQ ID NO: 210978 - protein, 8 aa, Japanese encephalitis virus
HASVTDIS

SEQ ID NO: 210979 - protein, 8 aa, Japanese encephalitis virus
ASVTDIST

SEQ ID NO: 210980 - protein, 8 aa, Japanese encephalitis virus
SVTDISTV

SEQ ID NO: 210981 - protein, 8 aa, Japanese encephalitis virus
VTDISTVA

SEQ ID NO: 210982 - protein, 8 aa, Japanese encephalitis virus
TDISTVAR

SEQ ID NO: 210983 - protein, 8 aa, Japanese encephalitis virus
DISTVARC

SEQ ID NO: 210984 - protein, 8 aa, Japanese encephalitis virus
ISTVARCP

SEQ ID NO: 210985 - protein, 8 aa, Japanese encephalitis virus
STVARCPT

SEQ ID NO: 210986 - protein, 8 aa, Japanese encephalitis virus
TVARCPTT

SEQ ID NO: 210987 - protein, 8 aa, Japanese encephalitis virus
VARCPTTG

SEQ ID NO: 210988 - protein, 8 aa, Japanese encephalitis virus
ARCPTTGE

SEQ ID NO: 210989 - protein, 8 aa, Japanese encephalitis virus
RCPTTGEA

SEQ ID NO: 210990 - protein, 8 aa, Japanese encephalitis virus
CPTTGEAH

SEQ ID NO: 210991 - protein, 8 aa, Japanese encephalitis virus
PTTGEAHN

SEQ ID NO: 210992 - protein, 8 aa, Japanese encephalitis virus
TTGEAHNE

SEQ ID NO: 210993 - protein, 8 aa, Japanese encephalitis virus
TGEAHNEK

SEQ ID NO: 210994 - protein, 8 aa, Japanese encephalitis virus
GEAHNEKR

SEQ ID NO: 210995 - protein, 8 aa, Japanese encephalitis virus
EAHNEKRA

SEQ ID NO: 210996 - protein, 8 aa, Japanese encephalitis virus
AHNEKRAD

SEQ ID NO: 210997 - protein, 8 aa, Japanese encephalitis virus
HNEKRADS

SEQ ID NO: 210998 - protein, 8 aa, Japanese encephalitis virus
NEKRADSS

SEQ ID NO: 210999 - protein, 8 aa, Japanese encephalitis virus
EKRADSSY

SEQ ID NO: 211000 - protein, 8 aa, Japanese encephalitis virus
KRADSSYV

SEQ ID NO: 211001 - protein, 8 aa, Japanese encephalitis virus
RADSSYVC

SEQ ID NO: 211002 - protein, 8 aa, Japanese encephalitis virus
ADSSYVCK

SEQ ID NO: 211003 - protein, 8 aa, Japanese encephalitis virus
DSSYVCKQ

SEQ ID NO: 211004 - protein, 8 aa, Japanese encephalitis virus
SSYVCKQG

SEQ ID NO: 211005 - protein, 8 aa, Japanese encephalitis virus
SYVCKQGF

SEQ ID NO: 211006 - protein, 8 aa, Japanese encephalitis virus
YVCKQGFT

SEQ ID NO: 211007 - protein, 8 aa, Japanese encephalitis virus
VCKQGFTD

SEQ ID NO: 211008 - protein, 8 aa, Japanese encephalitis virus
CKQGFTDR

SEQ ID NO: 211009 - protein, 8 aa, Japanese encephalitis virus
KQGFTDRG

SEQ ID NO: 211010 - protein, 8 aa, Japanese encephalitis virus
QGFTDRGW

SEQ ID NO: 211011 - protein, 8 aa, Japanese encephalitis virus
GFTDRGWG

SEQ ID NO: 211012 - protein, 8 aa, Japanese encephalitis virus
FTDRGWGN

SEQ ID NO: 211013 - protein, 8 aa, Japanese encephalitis virus
TDRGWGNG

SEQ ID NO: 211014 - protein, 8 aa, Japanese encephalitis virus
DRGWGNGC

SEQ ID NO: 211015 - protein, 8 aa, Japanese encephalitis virus
RGWGNGCG

SEQ ID NO: 211016 - protein, 8 aa, Japanese encephalitis virus
GWGNGCGL

SEQ ID NO: 211017 - protein, 8 aa, Japanese encephalitis virus
WGNGCGLF

SEQ ID NO: 211018 - protein, 8 aa, Japanese encephalitis virus
GNGCGLFG

SEQ ID NO: 211019 - protein, 8 aa, Japanese encephalitis virus
NGCGLFGK

SEQ ID NO: 211020 - protein, 8 aa, Japanese encephalitis virus
GCGLFGKG

SEQ ID NO: 211021 - protein, 8 aa, Japanese encephalitis virus
CGLFGKGS

SEQ ID NO: 211022 - protein, 8 aa, Japanese encephalitis virus
GLFGKGSI

SEQ ID NO: 211023 - protein, 8 aa, Japanese encephalitis virus
LFGKGSID

SEQ ID NO: 211024 - protein, 8 aa, Japanese encephalitis virus
FGKGSIDT

SEQ ID NO: 211025 - protein, 8 aa, Japanese encephalitis virus
GKGSIDTC

SEQ ID NO: 211026 - protein, 8 aa, Japanese encephalitis virus
KGSIDTCA

SEQ ID NO: 211027 - protein, 8 aa, Japanese encephalitis virus
GSIDTCAK

SEQ ID NO: 211028 - protein, 8 aa, Japanese encephalitis virus
SIDTCAKF

SEQ ID NO: 211029 - protein, 8 aa, Japanese encephalitis virus
IDTCAKFS

SEQ ID NO: 211030 - protein, 8 aa, Japanese encephalitis virus
DTCAKFSC

SEQ ID NO: 211031 - protein, 8 aa, Japanese encephalitis virus
TCAKFSCT

SEQ ID NO: 211032 - protein, 8 aa, Japanese encephalitis virus
CAKFSCTS

SEQ ID NO: 211033 - protein, 8 aa, Japanese encephalitis virus
AKFSCTSK

SEQ ID NO: 211034 - protein, 8 aa, Japanese encephalitis virus
KFSCTSKA

SEQ ID NO: 211035 - protein, 8 aa, Japanese encephalitis virus
FSCTSKAI

SEQ ID NO: 211036 - protein, 8 aa, Japanese encephalitis virus
SCTSKAIG

SEQ ID NO: 211037 - protein, 8 aa, Japanese encephalitis virus
CTSKAIGR

SEQ ID NO: 211038 - protein, 8 aa, Japanese encephalitis virus
KAIGRTIQ

SEQ ID NO: 211039 - protein, 8 aa, Japanese encephalitis virus
TIQPENIK

SEQ ID NO: 211040 - protein, 8 aa, Japanese encephalitis virus
IQPENIKY

SEQ ID NO: 211041 - protein, 8 aa, Japanese encephalitis virus
QPENIKYE

SEQ ID NO: 211042 - protein, 8 aa, Japanese encephalitis virus
PENIKYEV

SEQ ID NO: 211043 - protein, 8 aa, Japanese encephalitis virus
ENIKYEVG

SEQ ID NO: 211044 - protein, 8 aa, Japanese encephalitis virus
NIKYEVGI

SEQ ID NO: 211045 - protein, 8 aa, Japanese encephalitis virus
IKYEVGIF

SEQ ID NO: 211046 - protein, 8 aa, Japanese encephalitis virus
KYEVGIFV

SEQ ID NO: 211047 - protein, 8 aa, Japanese encephalitis virus
YEVGIFVH

SEQ ID NO: 211048 - protein, 8 aa, Japanese encephalitis virus
EVGIFVHG

SEQ ID NO: 211049 - protein, 8 aa, Japanese encephalitis virus
VGIFVHGT

SEQ ID NO: 211050 - protein, 8 aa, Japanese encephalitis virus
GIFVHGTT

SEQ ID NO: 211051 - protein, 8 aa, Japanese encephalitis virus
IFVHGTTT

SEQ ID NO: 211052 - protein, 8 aa, Japanese encephalitis virus
FVHGTTTS

SEQ ID NO: 211053 - protein, 8 aa, Japanese encephalitis virus
VHGTTTSE

SEQ ID NO: 211054 - protein, 8 aa, Japanese encephalitis virus
HGTTTSEN

SEQ ID NO: 211055 - protein, 8 aa, Japanese encephalitis virus
GTTTSENH

SEQ ID NO: 211056 - protein, 8 aa, Japanese encephalitis virus
TTTSENHG

SEQ ID NO: 211057 - protein, 8 aa, Japanese encephalitis virus
TTSENHGN

SEQ ID NO: 211058 - protein, 8 aa, Japanese encephalitis virus
TSENHGNY

SEQ ID NO: 211059 - protein, 8 aa, Japanese encephalitis virus
SENHGNYS

SEQ ID NO: 211060 - protein, 8 aa, Japanese encephalitis virus
ENHGNYSA

SEQ ID NO: 211061 - protein, 8 aa, Japanese encephalitis virus
NHGNYSAQ

SEQ ID NO: 211062 - protein, 8 aa, Japanese encephalitis virus
HGNYSAQV

SEQ ID NO: 211063 - protein, 8 aa, Japanese encephalitis virus
GNYSAQVG

SEQ ID NO: 211064 - protein, 8 aa, Japanese encephalitis virus
NYSAQVGA

SEQ ID NO: 211065 - protein, 8 aa, Japanese encephalitis virus
YSAQVGAS

SEQ ID NO: 211066 - protein, 8 aa, Japanese encephalitis virus
SAQVGASQ

SEQ ID NO: 211067 - protein, 8 aa, Japanese encephalitis virus
AQVGASQA

SEQ ID NO: 211068 - protein, 8 aa, Japanese encephalitis virus
QVGASQAA

SEQ ID NO: 211069 - protein, 8 aa, Japanese encephalitis virus
VGASQAAK

SEQ ID NO: 211070 - protein, 8 aa, Japanese encephalitis virus
GASQAAKF

SEQ ID NO: 211071 - protein, 8 aa, Japanese encephalitis virus
ASQAAKFT

SEQ ID NO: 211072 - protein, 8 aa, Japanese encephalitis virus
SQAAKFTV

SEQ ID NO: 211073 - protein, 8 aa, Japanese encephalitis virus
QAAKFTVT

SEQ ID NO: 211074 - protein, 8 aa, Japanese encephalitis virus
AAKFTVTP

SEQ ID NO: 211075 - protein, 8 aa, Japanese encephalitis virus
AKFTVTPN

SEQ ID NO: 211076 - protein, 8 aa, Japanese encephalitis virus
KFTVTPNA

SEQ ID NO: 211077 - protein, 8 aa, Japanese encephalitis virus
FTVTPNAP

SEQ ID NO: 211078 - protein, 8 aa, Japanese encephalitis virus
TVTPNAPS

SEQ ID NO: 211079 - protein, 8 aa, Japanese encephalitis virus
VTPNAPSI

SEQ ID NO: 211080 - protein, 8 aa, Japanese encephalitis virus
TPNAPSIT

SEQ ID NO: 211081 - protein, 8 aa, Japanese encephalitis virus
PNAPSITL

SEQ ID NO: 211082 - protein, 8 aa, Japanese encephalitis virus
NAPSITLK

SEQ ID NO: 211083 - protein, 8 aa, Japanese encephalitis virus
APSITLKL

SEQ ID NO: 211084 - protein, 8 aa, Japanese encephalitis virus
PSITLKLG

SEQ ID NO: 211085 - protein, 8 aa, Japanese encephalitis virus
SITLKLGD

SEQ ID NO: 211086 - protein, 8 aa, Japanese encephalitis virus
TLKLGDYG

SEQ ID NO: 211087 - protein, 8 aa, Japanese encephalitis virus
LKLGDYGE

SEQ ID NO: 211088 - protein, 8 aa, Japanese encephalitis virus
KLGDYGEV

SEQ ID NO: 211089 - protein, 8 aa, Japanese encephalitis virus
LGDYGEVT

SEQ ID NO: 211090 - protein, 8 aa, Japanese encephalitis virus
GDYGEVTL

SEQ ID NO: 211091 - protein, 8 aa, Japanese encephalitis virus
DYGEVTLD

SEQ ID NO: 211092 - protein, 8 aa, Japanese encephalitis virus
YGEVTLDC

SEQ ID NO: 211093 - protein, 8 aa, Japanese encephalitis virus
GEVTLDCE

SEQ ID NO: 211094 - protein, 8 aa, Japanese encephalitis virus
EVTLDCEP

SEQ ID NO: 211095 - protein, 8 aa, Japanese encephalitis virus
VTLDCEPR

SEQ ID NO: 211096 - protein, 8 aa, Japanese encephalitis virus
TLDCEPRS

SEQ ID NO: 211097 - protein, 8 aa, Japanese encephalitis virus
LDCEPRSG

SEQ ID NO: 211098 - protein, 8 aa, Japanese encephalitis virus
DCEPRSGL

SEQ ID NO: 211099 - protein, 8 aa, Japanese encephalitis virus
CEPRSGLN

SEQ ID NO: 211100 - protein, 8 aa, Japanese encephalitis virus
EPRSGLNT

SEQ ID NO: 211101 - protein, 8 aa, Japanese encephalitis virus
PRSGLNTE

SEQ ID NO: 211102 - protein, 8 aa, Japanese encephalitis virus
RSGLNTEA

SEQ ID NO: 211103 - protein, 8 aa, Japanese encephalitis virus
SGLNTEAF

SEQ ID NO: 211104 - protein, 8 aa, Japanese encephalitis virus
GLNTEAFY

SEQ ID NO: 211105 - protein, 8 aa, Japanese encephalitis virus
LNTEAFYV

SEQ ID NO: 211106 - protein, 8 aa, Japanese encephalitis virus
NTEAFYVM

SEQ ID NO: 211107 - protein, 8 aa, Japanese encephalitis virus
TEAFYVMT

SEQ ID NO: 211108 - protein, 8 aa, Japanese encephalitis virus
EAFYVMTV

SEQ ID NO: 211109 - protein, 8 aa, Japanese encephalitis virus
AFYVMTVG

SEQ ID NO: 211110 - protein, 8 aa, Japanese encephalitis virus
FYVMTVGS

SEQ ID NO: 211111 - protein, 8 aa, Japanese encephalitis virus
YVMTVGSK

SEQ ID NO: 211112 - protein, 8 aa, Japanese encephalitis virus
VMTVGSKS

SEQ ID NO: 211113 - protein, 8 aa, Japanese encephalitis virus
MTVGSKSF

SEQ ID NO: 211114 - protein, 8 aa, Japanese encephalitis virus
TVGSKSFL

SEQ ID NO: 211115 - protein, 8 aa, Japanese encephalitis virus
VGSKSFLV

SEQ ID NO: 211116 - protein, 8 aa, Japanese encephalitis virus
GSKSFLVH

SEQ ID NO: 211117 - protein, 8 aa, Japanese encephalitis virus
SKSFLVHR

SEQ ID NO: 211118 - protein, 8 aa, Japanese encephalitis virus
KSFLVHRE

SEQ ID NO: 211119 - protein, 8 aa, Japanese encephalitis virus
SFLVHREW

SEQ ID NO: 211120 - protein, 8 aa, Japanese encephalitis virus
FLVHREWF

SEQ ID NO: 211121 - protein, 8 aa, Japanese encephalitis virus
LVHREWFH

SEQ ID NO: 211122 - protein, 8 aa, Japanese encephalitis virus
VHREWFHD

SEQ ID NO: 211123 - protein, 8 aa, Japanese encephalitis virus
HREWFHDL

SEQ ID NO: 211124 - protein, 8 aa, Japanese encephalitis virus
REWFHDLA

SEQ ID NO: 211125 - protein, 8 aa, Japanese encephalitis virus
EWFHDLAL

SEQ ID NO: 211126 - protein, 8 aa, Japanese encephalitis virus
WFHDLALP

SEQ ID NO: 211127 - protein, 8 aa, Japanese encephalitis virus
FHDLALPW

SEQ ID NO: 211128 - protein, 8 aa, Japanese encephalitis virus
HDLALPWT

SEQ ID NO: 211129 - protein, 8 aa, Japanese encephalitis virus
DLALPWTS

SEQ ID NO: 211130 - protein, 8 aa, Japanese encephalitis virus
LALPWTSP

SEQ ID NO: 211131 - protein, 8 aa, Japanese encephalitis virus
ALPWTSPS

SEQ ID NO: 211132 - protein, 8 aa, Japanese encephalitis virus
LPWTSPSS

SEQ ID NO: 211133 - protein, 8 aa, Japanese encephalitis virus
PWTSPSST

SEQ ID NO: 211134 - protein, 8 aa, Japanese encephalitis virus
WTSPSSTA

SEQ ID NO: 211135 - protein, 8 aa, Japanese encephalitis virus
TSPSSTAW

SEQ ID NO: 211136 - protein, 8 aa, Japanese encephalitis virus
SPSSTAWR

SEQ ID NO: 211137 - protein, 8 aa, Japanese encephalitis virus
PSSTAWRN

SEQ ID NO: 211138 - protein, 8 aa, Japanese encephalitis virus
SSTAWRNR

SEQ ID NO: 211139 - protein, 8 aa, Japanese encephalitis virus
STAWRNRE

SEQ ID NO: 211140 - protein, 8 aa, Japanese encephalitis virus
TAWRNREL

SEQ ID NO: 211141 - protein, 8 aa, Japanese encephalitis virus
AWRNRELL

SEQ ID NO: 211142 - protein, 8 aa, Japanese encephalitis virus
WRNRELLM

SEQ ID NO: 211143 - protein, 8 aa, Japanese encephalitis virus
RNRELLME

SEQ ID NO: 211144 - protein, 8 aa, Japanese encephalitis virus
NRELLMEF

SEQ ID NO: 211145 - protein, 8 aa, Japanese encephalitis virus
RELLMEFE

SEQ ID NO: 211146 - protein, 8 aa, Japanese encephalitis virus
ELLMEFEE

SEQ ID NO: 211147 - protein, 8 aa, Japanese encephalitis virus
LLMEFEEA

SEQ ID NO: 211148 - protein, 8 aa, Japanese encephalitis virus
LMEFEEAH

SEQ ID NO: 211149 - protein, 8 aa, Japanese encephalitis virus
MEFEEAHA

SEQ ID NO: 211150 - protein, 8 aa, Japanese encephalitis virus
EFEEAHAT

SEQ ID NO: 211151 - protein, 8 aa, Japanese encephalitis virus
FEEAHATK

SEQ ID NO: 211152 - protein, 8 aa, Japanese encephalitis virus
EEAHATKQ

SEQ ID NO: 211153 - protein, 8 aa, Japanese encephalitis virus
EAHATKQS

SEQ ID NO: 211154 - protein, 8 aa, Japanese encephalitis virus
AHATKQSV

SEQ ID NO: 211155 - protein, 8 aa, Japanese encephalitis virus
HATKQSVV

SEQ ID NO: 211156 - protein, 8 aa, Japanese encephalitis virus
ATKQSVVA

SEQ ID NO: 211157 - protein, 8 aa, Japanese encephalitis virus
TKQSVVAL

SEQ ID NO: 211158 - protein, 8 aa, Japanese encephalitis virus
KQSVVALG

SEQ ID NO: 211159 - protein, 8 aa, Japanese encephalitis virus
QSVVALGS

SEQ ID NO: 211160 - protein, 8 aa, Japanese encephalitis virus
SVVALGSQ

SEQ ID NO: 211161 - protein, 8 aa, Japanese encephalitis virus
VVALGSQE

SEQ ID NO: 211162 - protein, 8 aa, Japanese encephalitis virus
VALGSQEG

SEQ ID NO: 211163 - protein, 8 aa, Japanese encephalitis virus
ALGSQEGG

SEQ ID NO: 211164 - protein, 8 aa, Japanese encephalitis virus
LGSQEGGL

SEQ ID NO: 211165 - protein, 8 aa, Japanese encephalitis virus
GSQEGGLH

SEQ ID NO: 211166 - protein, 8 aa, Japanese encephalitis virus
SQEGGLHQ

SEQ ID NO: 211167 - protein, 8 aa, Japanese encephalitis virus
QEGGLHQA

SEQ ID NO: 211168 - protein, 8 aa, Japanese encephalitis virus
EGGLHQAL

SEQ ID NO: 211169 - protein, 8 aa, Japanese encephalitis virus
GGLHQALA

SEQ ID NO: 211170 - protein, 8 aa, Japanese encephalitis virus
GLHQALAG

SEQ ID NO: 211171 - protein, 8 aa, Japanese encephalitis virus
LHQALAGA

SEQ ID NO: 211172 - protein, 8 aa, Japanese encephalitis virus
HQALAGAI

SEQ ID NO: 211173 - protein, 8 aa, Japanese encephalitis virus
QALAGAIV

SEQ ID NO: 211174 - protein, 8 aa, Japanese encephalitis virus
ALAGAIVV

SEQ ID NO: 211175 - protein, 8 aa, Japanese encephalitis virus
LAGAIVVE

SEQ ID NO: 211176 - protein, 8 aa, Japanese encephalitis virus
AGAIVVEY

SEQ ID NO: 211177 - protein, 8 aa, Japanese encephalitis virus
GAIVVEYS

SEQ ID NO: 211178 - protein, 8 aa, Japanese encephalitis virus
AIVVEYSS

SEQ ID NO: 211179 - protein, 8 aa, Japanese encephalitis virus
IVVEYSSS

SEQ ID NO: 211180 - protein, 8 aa, Japanese encephalitis virus
VVEYSSSV

SEQ ID NO: 211181 - protein, 8 aa, Japanese encephalitis virus
VEYSSSVK

SEQ ID NO: 211182 - protein, 8 aa, Japanese encephalitis virus
EYSSSVKL

SEQ ID NO: 211183 - protein, 8 aa, Japanese encephalitis virus
YSSSVKLT

SEQ ID NO: 211184 - protein, 8 aa, Japanese encephalitis virus
SSSVKLTS

SEQ ID NO: 211185 - protein, 8 aa, Japanese encephalitis virus
SSVKLTSG

SEQ ID NO: 211186 - protein, 8 aa, Japanese encephalitis virus
SVKLTSGH

SEQ ID NO: 211187 - protein, 8 aa, Japanese encephalitis virus
VKLTSGHL

SEQ ID NO: 211188 - protein, 8 aa, Japanese encephalitis virus
KLTSGHLK

SEQ ID NO: 211189 - protein, 8 aa, Japanese encephalitis virus
LTSGHLKC

SEQ ID NO: 211190 - protein, 8 aa, Japanese encephalitis virus
TSGHLKCR

SEQ ID NO: 211191 - protein, 8 aa, Japanese encephalitis virus
SGHLKCRL

SEQ ID NO: 211192 - protein, 8 aa, Japanese encephalitis virus
GHLKCRLK

SEQ ID NO: 211193 - protein, 8 aa, Japanese encephalitis virus
HLKCRLKM

SEQ ID NO: 211194 - protein, 8 aa, Japanese encephalitis virus
LKCRLKMD

SEQ ID NO: 211195 - protein, 8 aa, Japanese encephalitis virus
KCRLKMDK

SEQ ID NO: 211196 - protein, 8 aa, Japanese encephalitis virus
CRLKMDKL

SEQ ID NO: 211197 - protein, 8 aa, Japanese encephalitis virus
RLKMDKLA

SEQ ID NO: 211198 - protein, 8 aa, Japanese encephalitis virus
LKMDKLAL

SEQ ID NO: 211199 - protein, 8 aa, Japanese encephalitis virus
KMDKLALK

SEQ ID NO: 211200 - protein, 8 aa, Japanese encephalitis virus
MDKLALKG

SEQ ID NO: 211201 - protein, 8 aa, Japanese encephalitis virus
DKLALKGT

SEQ ID NO: 211202 - protein, 8 aa, Japanese encephalitis virus
KLALKGTT

SEQ ID NO: 211203 - protein, 8 aa, Japanese encephalitis virus
LALKGTTY

SEQ ID NO: 211204 - protein, 8 aa, Japanese encephalitis virus
ALKGTTYG

SEQ ID NO: 211205 - protein, 8 aa, Japanese encephalitis virus
LKGTTYGM

SEQ ID NO: 211206 - protein, 8 aa, Japanese encephalitis virus
KGTTYGMC

SEQ ID NO: 211207 - protein, 8 aa, Japanese encephalitis virus
GTTYGMCT

SEQ ID NO: 211208 - protein, 8 aa, Japanese encephalitis virus
TTYGMCTE

SEQ ID NO: 211209 - protein, 8 aa, Japanese encephalitis virus
TYGMCTEK

SEQ ID NO: 211210 - protein, 8 aa, Japanese encephalitis virus
YGMCTEKF

SEQ ID NO: 211211 - protein, 8 aa, Japanese encephalitis virus
GMCTEKFS

SEQ ID NO: 211212 - protein, 8 aa, Japanese encephalitis virus
MCTEKFSF

SEQ ID NO: 211213 - protein, 8 aa, Japanese encephalitis virus
CTEKFSFA

SEQ ID NO: 211214 - protein, 8 aa, Japanese encephalitis virus
TEKFSFAK

SEQ ID NO: 211215 - protein, 8 aa, Japanese encephalitis virus
EKFSFAKN

SEQ ID NO: 211216 - protein, 8 aa, Japanese encephalitis virus
KFSFAKNP

SEQ ID NO: 211217 - protein, 8 aa, Japanese encephalitis virus
FSFAKNPA

SEQ ID NO: 211218 - protein, 8 aa, Japanese encephalitis virus
SFAKNPAD

SEQ ID NO: 211219 - protein, 8 aa, Japanese encephalitis virus
FAKNPADT

SEQ ID NO: 211220 - protein, 8 aa, Japanese encephalitis virus
AKNPADTG

SEQ ID NO: 211221 - protein, 8 aa, Japanese encephalitis virus
KNPADTGH

SEQ ID NO: 211222 - protein, 8 aa, Japanese encephalitis virus
NPADTGHG

SEQ ID NO: 211223 - protein, 8 aa, Japanese encephalitis virus
PADTGHGT

SEQ ID NO: 211224 - protein, 8 aa, Japanese encephalitis virus
ADTGHGTV

SEQ ID NO: 211225 - protein, 8 aa, Japanese encephalitis virus
DTGHGTVV

SEQ ID NO: 211226 - protein, 8 aa, Japanese encephalitis virus
TGHGTVVI

SEQ ID NO: 211227 - protein, 8 aa, Japanese encephalitis virus
GHGTVVIE

SEQ ID NO: 211228 - protein, 8 aa, Japanese encephalitis virus
HGTVVIEL

SEQ ID NO: 211229 - protein, 8 aa, Japanese encephalitis virus
GTVVIELS

SEQ ID NO: 211230 - protein, 8 aa, Japanese encephalitis virus
TVVIELSY

SEQ ID NO: 211231 - protein, 8 aa, Japanese encephalitis virus
VVIELSYS

SEQ ID NO: 211232 - protein, 8 aa, Japanese encephalitis virus
VIELSYSG

SEQ ID NO: 211233 - protein, 8 aa, Japanese encephalitis virus
IELSYSGS

SEQ ID NO: 211234 - protein, 8 aa, Japanese encephalitis virus
ELSYSGSD

SEQ ID NO: 211235 - protein, 8 aa, Japanese encephalitis virus
LSYSGSDG

SEQ ID NO: 211236 - protein, 8 aa, Japanese encephalitis virus
SYSGSDGP

SEQ ID NO: 211237 - protein, 8 aa, Japanese encephalitis virus
YSGSDGPC

SEQ ID NO: 211238 - protein, 8 aa, Japanese encephalitis virus
SGSDGPCK

SEQ ID NO: 211239 - protein, 8 aa, Japanese encephalitis virus
GSDGPCKI

SEQ ID NO: 211240 - protein, 8 aa, Japanese encephalitis virus
SDGPCKIP

SEQ ID NO: 211241 - protein, 8 aa, Japanese encephalitis virus
DGPCKIPI

SEQ ID NO: 211242 - protein, 8 aa, Japanese encephalitis virus
GPCKIPIV

SEQ ID NO: 211243 - protein, 8 aa, Japanese encephalitis virus
PCKIPIVS

SEQ ID NO: 211244 - protein, 8 aa, Japanese encephalitis virus
CKIPIVSV

SEQ ID NO: 211245 - protein, 8 aa, Japanese encephalitis virus
KIPIVSVA

SEQ ID NO: 211246 - protein, 8 aa, Japanese encephalitis virus
IPIVSVAS

SEQ ID NO: 211247 - protein, 8 aa, Japanese encephalitis virus
PIVSVASL

SEQ ID NO: 211248 - protein, 8 aa, Japanese encephalitis virus
IVSVASLN

SEQ ID NO: 211249 - protein, 8 aa, Japanese encephalitis virus
VSVASLND

SEQ ID NO: 211250 - protein, 8 aa, Japanese encephalitis virus
SVASLNDM

SEQ ID NO: 211251 - protein, 8 aa, Japanese encephalitis virus
VASLNDMT

SEQ ID NO: 211252 - protein, 8 aa, Japanese encephalitis virus
ASLNDMTP

SEQ ID NO: 211253 - protein, 8 aa, Japanese encephalitis virus
SLNDMTPV

SEQ ID NO: 211254 - protein, 8 aa, Japanese encephalitis virus
LNDMTPVG

SEQ ID NO: 211255 - protein, 8 aa, Japanese encephalitis virus
NDMTPVGR

SEQ ID NO: 211256 - protein, 8 aa, Japanese encephalitis virus
DMTPVGRL

SEQ ID NO: 211257 - protein, 8 aa, Japanese encephalitis virus
MTPVGRLV

SEQ ID NO: 211258 - protein, 8 aa, Japanese encephalitis virus
TPVGRLVT

SEQ ID NO: 211259 - protein, 8 aa, Japanese encephalitis virus
PVGRLVTV

SEQ ID NO: 211260 - protein, 8 aa, Japanese encephalitis virus
VGRLVTVN

SEQ ID NO: 211261 - protein, 8 aa, Japanese encephalitis virus
GRLVTVNP

SEQ ID NO: 211262 - protein, 8 aa, Japanese encephalitis virus
RLVTVNPF

SEQ ID NO: 211263 - protein, 8 aa, Japanese encephalitis virus
LVTVNPFV

SEQ ID NO: 211264 - protein, 8 aa, Japanese encephalitis virus
VTVNPFVA

SEQ ID NO: 211265 - protein, 8 aa, Japanese encephalitis virus
TVNPFVAT

SEQ ID NO: 211266 - protein, 8 aa, Japanese encephalitis virus
VNPFVATS

SEQ ID NO: 211267 - protein, 8 aa, Japanese encephalitis virus
NPFVATSS

SEQ ID NO: 211268 - protein, 8 aa, Japanese encephalitis virus
PFVATSSA

SEQ ID NO: 211269 - protein, 8 aa, Japanese encephalitis virus
FVATSSAN

SEQ ID NO: 211270 - protein, 8 aa, Japanese encephalitis virus
VATSSANS

SEQ ID NO: 211271 - protein, 8 aa, Japanese encephalitis virus
ATSSANSK

SEQ ID NO: 211272 - protein, 8 aa, Japanese encephalitis virus
TSSANSKV

SEQ ID NO: 211273 - protein, 8 aa, Japanese encephalitis virus
SSANSKVL

SEQ ID NO: 211274 - protein, 8 aa, Japanese encephalitis virus
SANSKVLV

SEQ ID NO: 211275 - protein, 8 aa, Japanese encephalitis virus
ANSKVLVE

SEQ ID NO: 211276 - protein, 8 aa, Japanese encephalitis virus
NSKVLVEM

SEQ ID NO: 211277 - protein, 8 aa, Japanese encephalitis virus
SKVLVEME

SEQ ID NO: 211278 - protein, 8 aa, Japanese encephalitis virus
KVLVEMEP

SEQ ID NO: 211279 - protein, 8 aa, Japanese encephalitis virus
VLVEMEPP

SEQ ID NO: 211280 - protein, 8 aa, Japanese encephalitis virus
LVEMEPPF

SEQ ID NO: 211281 - protein, 8 aa, Japanese encephalitis virus
VEMEPPFG

SEQ ID NO: 211282 - protein, 8 aa, Japanese encephalitis virus
EMEPPFGD

SEQ ID NO: 211283 - protein, 8 aa, Japanese encephalitis virus
MEPPFGDS

SEQ ID NO: 211284 - protein, 8 aa, Japanese encephalitis virus
EPPFGDSY

SEQ ID NO: 211285 - protein, 8 aa, Japanese encephalitis virus
PPFGDSYI

SEQ ID NO: 211286 - protein, 8 aa, Japanese encephalitis virus
PFGDSYIV

SEQ ID NO: 211287 - protein, 8 aa, Japanese encephalitis virus
FGDSYIVV

SEQ ID NO: 211288 - protein, 8 aa, Japanese encephalitis virus
GDSYIVVG

SEQ ID NO: 211289 - protein, 8 aa, Japanese encephalitis virus
DSYIVVGR

SEQ ID NO: 211290 - protein, 8 aa, Japanese encephalitis virus
SYIVVGRG

SEQ ID NO: 211291 - protein, 8 aa, Japanese encephalitis virus
KQINHHWH

SEQ ID NO: 211292 - protein, 8 aa, Japanese encephalitis virus
QINHHWHK

SEQ ID NO: 211293 - protein, 8 aa, Japanese encephalitis virus
HHWHKAGS

SEQ ID NO: 211294 - protein, 8 aa, Japanese encephalitis virus
HWHKAGST

SEQ ID NO: 211295 - protein, 8 aa, Japanese encephalitis virus
WHKAGSTL

SEQ ID NO: 211296 - protein, 8 aa, Japanese encephalitis virus
HKAGSTLG

SEQ ID NO: 211297 - protein, 8 aa, Japanese encephalitis virus
KAGSTLGK

SEQ ID NO: 211298 - protein, 8 aa, Japanese encephalitis virus
AGSTLGKA

SEQ ID NO: 211299 - protein, 8 aa, Japanese encephalitis virus
GSTLGKAF

SEQ ID NO: 211300 - protein, 8 aa, Japanese encephalitis virus
STLGKAFS

SEQ ID NO: 211301 - protein, 8 aa, Japanese encephalitis virus
TLGKAFST

SEQ ID NO: 211302 - protein, 8 aa, Japanese encephalitis virus
LGKAFSTT

SEQ ID NO: 211303 - protein, 8 aa, Japanese encephalitis virus
GKAFSTTL

SEQ ID NO: 211304 - protein, 8 aa, Japanese encephalitis virus
KAFSTTLK

SEQ ID NO: 211305 - protein, 8 aa, Japanese encephalitis virus
AFSTTLKG

SEQ ID NO: 211306 - protein, 8 aa, Japanese encephalitis virus
FSTTLKGA

SEQ ID NO: 211307 - protein, 8 aa, Japanese encephalitis virus
STTLKGAQ

SEQ ID NO: 211308 - protein, 8 aa, Japanese encephalitis virus
TTLKGAQR

SEQ ID NO: 211309 - protein, 8 aa, Japanese encephalitis virus
TLKGAQRL

SEQ ID NO: 211310 - protein, 8 aa, Japanese encephalitis virus
LKGAQRLA

SEQ ID NO: 211311 - protein, 8 aa, Japanese encephalitis virus
KGAQRLAA

SEQ ID NO: 211312 - protein, 8 aa, Japanese encephalitis virus
GAQRLAAL

SEQ ID NO: 211313 - protein, 8 aa, Japanese encephalitis virus
AQRLAALG

SEQ ID NO: 211314 - protein, 8 aa, Japanese encephalitis virus
QRLAALGD

SEQ ID NO: 211315 - protein, 8 aa, Japanese encephalitis virus
RLAALGDT

SEQ ID NO: 211316 - protein, 8 aa, Japanese encephalitis virus
LAALGDTA

SEQ ID NO: 211317 - protein, 8 aa, Japanese encephalitis virus
AALGDTAW

SEQ ID NO: 211318 - protein, 8 aa, Japanese encephalitis virus
ALGDTAWD

SEQ ID NO: 211319 - protein, 8 aa, Japanese encephalitis virus
LGDTAWDF

SEQ ID NO: 211320 - protein, 8 aa, Japanese encephalitis virus
GDTAWDFG

SEQ ID NO: 211321 - protein, 8 aa, Japanese encephalitis virus
DTAWDFGS

SEQ ID NO: 211322 - protein, 8 aa, Japanese encephalitis virus
TAWDFGSI

SEQ ID NO: 211323 - protein, 8 aa, Japanese encephalitis virus
AWDFGSIG

SEQ ID NO: 211324 - protein, 8 aa, Japanese encephalitis virus
WDFGSIGG

SEQ ID NO: 211325 - protein, 8 aa, Japanese encephalitis virus
DFGSIGGV

SEQ ID NO: 211326 - protein, 8 aa, Japanese encephalitis virus
FGSIGGVF

SEQ ID NO: 211327 - protein, 8 aa, Japanese encephalitis virus
GSIGGVFN

SEQ ID NO: 211328 - protein, 8 aa, Japanese encephalitis virus
SIGGVFNS

SEQ ID NO: 211329 - protein, 8 aa, Japanese encephalitis virus
IGGVFNSI

SEQ ID NO: 211330 - protein, 8 aa, Japanese encephalitis virus
GGVFNSIG

SEQ ID NO: 211331 - protein, 8 aa, Japanese encephalitis virus
GVFNSIGK

SEQ ID NO: 211332 - protein, 8 aa, Japanese encephalitis virus
VFNSIGKA

SEQ ID NO: 211333 - protein, 8 aa, Japanese encephalitis virus
FNSIGKAV

SEQ ID NO: 211334 - protein, 8 aa, Japanese encephalitis virus
NSIGKAVH

SEQ ID NO: 211335 - protein, 8 aa, Japanese encephalitis virus
SIGKAVHQ

SEQ ID NO: 211336 - protein, 8 aa, Japanese encephalitis virus
IGKAVHQV

SEQ ID NO: 211337 - protein, 8 aa, Japanese encephalitis virus
GKAVHQVF

SEQ ID NO: 211338 - protein, 8 aa, Japanese encephalitis virus
KAVHQVFG

SEQ ID NO: 211339 - protein, 8 aa, Japanese encephalitis virus
AVHQVFGG

SEQ ID NO: 211340 - protein, 8 aa, Japanese encephalitis virus
VHQVFGGA

SEQ ID NO: 211341 - protein, 8 aa, Japanese encephalitis virus
HQVFGGAF

SEQ ID NO: 211342 - protein, 8 aa, Japanese encephalitis virus
QVFGGAFR

SEQ ID NO: 211343 - protein, 8 aa, Japanese encephalitis virus
VFGGAFRT

SEQ ID NO: 211344 - protein, 8 aa, Japanese encephalitis virus
FGGAFRTL

SEQ ID NO: 211345 - protein, 8 aa, Japanese encephalitis virus
GGAFRTLF

SEQ ID NO: 211346 - protein, 8 aa, Japanese encephalitis virus
GAFRTLFG

SEQ ID NO: 211347 - protein, 8 aa, Japanese encephalitis virus
AFRTLFGG

SEQ ID NO: 211348 - protein, 8 aa, Japanese encephalitis virus
FRTLFGGM

SEQ ID NO: 211349 - protein, 8 aa, Japanese encephalitis virus
RTLFGGMS

SEQ ID NO: 211350 - protein, 8 aa, Japanese encephalitis virus
TLFGGMSW

SEQ ID NO: 211351 - protein, 8 aa, Japanese encephalitis virus
LFGGMSWI

SEQ ID NO: 211352 - protein, 8 aa, Japanese encephalitis virus
FGGMSWIT

SEQ ID NO: 211353 - protein, 8 aa, Japanese encephalitis virus
GGMSWITQ

SEQ ID NO: 211354 - protein, 8 aa, Japanese encephalitis virus
GMSWITQG

SEQ ID NO: 211355 - protein, 8 aa, Japanese encephalitis virus
MSWITQGL

SEQ ID NO: 211356 - protein, 8 aa, Japanese encephalitis virus
SWITQGLM

SEQ ID NO: 211357 - protein, 8 aa, Japanese encephalitis virus
WITQGLMG

SEQ ID NO: 211358 - protein, 8 aa, Japanese encephalitis virus
ITQGLMGA

SEQ ID NO: 211359 - protein, 8 aa, Japanese encephalitis virus
TQGLMGAL

SEQ ID NO: 211360 - protein, 8 aa, Japanese encephalitis virus
QGLMGALL

SEQ ID NO: 211361 - protein, 8 aa, Japanese encephalitis virus
GLMGALLL

SEQ ID NO: 211362 - protein, 8 aa, Japanese encephalitis virus
LMGALLLW

SEQ ID NO: 211363 - protein, 8 aa, Japanese encephalitis virus
MGALLLWM

SEQ ID NO: 211364 - protein, 8 aa, Japanese encephalitis virus
GALLLWMG

SEQ ID NO: 211365 - protein, 8 aa, Japanese encephalitis virus
ALLLWMGV

SEQ ID NO: 211366 - protein, 8 aa, Japanese encephalitis virus
LLLWMGVN

SEQ ID NO: 211367 - protein, 8 aa, Japanese encephalitis virus
LLWMGVNA

SEQ ID NO: 211368 - protein, 8 aa, Japanese encephalitis virus
LWMGVNAR

SEQ ID NO: 211369 - protein, 8 aa, Japanese encephalitis virus
WMGVNARD

SEQ ID NO: 211370 - protein, 8 aa, Japanese encephalitis virus
MGVNARDR

SEQ ID NO: 211371 - protein, 8 aa, Japanese encephalitis virus
GVNARDRS

SEQ ID NO: 211372 - protein, 8 aa, Japanese encephalitis virus
VNARDRSI

SEQ ID NO: 211373 - protein, 8 aa, Japanese encephalitis virus
NARDRSIA

SEQ ID NO: 211374 - protein, 8 aa, Japanese encephalitis virus
ARDRSIAL

SEQ ID NO: 211375 - protein, 8 aa, Japanese encephalitis virus
RDRSIALA

SEQ ID NO: 211376 - protein, 8 aa, Japanese encephalitis virus
DRSIALAF

SEQ ID NO: 211377 - protein, 8 aa, Japanese encephalitis virus
RSIALAFL

SEQ ID NO: 211378 - protein, 8 aa, Japanese encephalitis virus
SIALAFLA

SEQ ID NO: 211379 - protein, 8 aa, Japanese encephalitis virus
IALAFLAT

SEQ ID NO: 211380 - protein, 8 aa, Japanese encephalitis virus
ALAFLATG

SEQ ID NO: 211381 - protein, 8 aa, Japanese encephalitis virus
LAFLATGG

SEQ ID NO: 211382 - protein, 8 aa, Japanese encephalitis virus
AFLATGGV

SEQ ID NO: 211383 - protein, 8 aa, Japanese encephalitis virus
FLATGGVL

SEQ ID NO: 211384 - protein, 8 aa, Japanese encephalitis virus
LATGGVLV

SEQ ID NO: 211385 - protein, 8 aa, Japanese encephalitis virus
ATGGVLVF

SEQ ID NO: 211386 - protein, 8 aa, Japanese encephalitis virus
TGGVLVFL

SEQ ID NO: 211387 - protein, 8 aa, Japanese encephalitis virus
GGVLVFLA

SEQ ID NO: 211388 - protein, 8 aa, Japanese encephalitis virus
GVLVFLAT

SEQ ID NO: 211389 - protein, 8 aa, Japanese encephalitis virus
VLVFLATN

SEQ ID NO: 211390 - protein, 8 aa, Japanese encephalitis virus
LVFLATNV

SEQ ID NO: 211391 - protein, 8 aa, Japanese encephalitis virus
VFLATNVH

SEQ ID NO: 211392 - protein, 8 aa, Japanese encephalitis virus
FLATNVHA

SEQ ID NO: 211393 - protein, 8 aa, Japanese encephalitis virus
LATNVHAD

SEQ ID NO: 211394 - protein, 8 aa, Japanese encephalitis virus
ATNVHADT

SEQ ID NO: 211395 - protein, 8 aa, Japanese encephalitis virus
TNVHADTG

SEQ ID NO: 211396 - protein, 8 aa, Japanese encephalitis virus
NVHADTGC

SEQ ID NO: 211397 - protein, 8 aa, Japanese encephalitis virus
VHADTGCA

SEQ ID NO: 211398 - protein, 8 aa, Japanese encephalitis virus
HADTGCAI

SEQ ID NO: 211399 - protein, 8 aa, Japanese encephalitis virus
ADTGCAID

SEQ ID NO: 211400 - protein, 8 aa, Japanese encephalitis virus
DTGCAIDI

SEQ ID NO: 211401 - protein, 8 aa, Japanese encephalitis virus
TGCAIDIT

SEQ ID NO: 211402 - protein, 8 aa, Japanese encephalitis virus
GCAIDITR

SEQ ID NO: 211403 - protein, 8 aa, Japanese encephalitis virus
TRKEMRCG

SEQ ID NO: 211404 - protein, 8 aa, Japanese encephalitis virus
RKEMRCGS

SEQ ID NO: 211405 - protein, 8 aa, Japanese encephalitis virus
KEMRCGSG

SEQ ID NO: 211406 - protein, 8 aa, Japanese encephalitis virus
EMRCGSGI

SEQ ID NO: 211407 - protein, 8 aa, Japanese encephalitis virus
MRCGSGIF

SEQ ID NO: 211408 - protein, 8 aa, Japanese encephalitis virus
RCGSGIFV

SEQ ID NO: 211409 - protein, 8 aa, Japanese encephalitis virus
CGSGIFVH

SEQ ID NO: 211410 - protein, 8 aa, Japanese encephalitis virus
GSGIFVHN

SEQ ID NO: 211411 - protein, 8 aa, Japanese encephalitis virus
SGIFVHND

SEQ ID NO: 211412 - protein, 8 aa, Japanese encephalitis virus
GIFVHNDV

SEQ ID NO: 211413 - protein, 8 aa, Japanese encephalitis virus
IFVHNDVE

SEQ ID NO: 211414 - protein, 8 aa, Japanese encephalitis virus
FVHNDVEA

SEQ ID NO: 211415 - protein, 8 aa, Japanese encephalitis virus
VHNDVEAW

SEQ ID NO: 211416 - protein, 8 aa, Japanese encephalitis virus
HNDVEAWV

SEQ ID NO: 211417 - protein, 8 aa, Japanese encephalitis virus
NDVEAWVD

SEQ ID NO: 211418 - protein, 8 aa, Japanese encephalitis virus
DVEAWVDR

SEQ ID NO: 211419 - protein, 8 aa, Japanese encephalitis virus
VEAWVDRY

SEQ ID NO: 211420 - protein, 8 aa, Japanese encephalitis virus
EAWVDRYK

SEQ ID NO: 211421 - protein, 8 aa, Japanese encephalitis virus
AWVDRYKY

SEQ ID NO: 211422 - protein, 8 aa, Japanese encephalitis virus
WVDRYKYL

SEQ ID NO: 211423 - protein, 8 aa, Japanese encephalitis virus
VDRYKYLP

SEQ ID NO: 211424 - protein, 8 aa, Japanese encephalitis virus
DRYKYLPE

SEQ ID NO: 211425 - protein, 8 aa, Japanese encephalitis virus
RYKYLPET

SEQ ID NO: 211426 - protein, 8 aa, Japanese encephalitis virus
YKYLPETP

SEQ ID NO: 211427 - protein, 8 aa, Japanese encephalitis virus
KYLPETPR

SEQ ID NO: 211428 - protein, 8 aa, Japanese encephalitis virus
YLPETPRS

SEQ ID NO: 211429 - protein, 8 aa, Japanese encephalitis virus
LPETPRSL

SEQ ID NO: 211430 - protein, 8 aa, Japanese encephalitis virus
PETPRSLA

SEQ ID NO: 211431 - protein, 8 aa, Japanese encephalitis virus
ETPRSLAK

SEQ ID NO: 211432 - protein, 8 aa, Japanese encephalitis virus
TPRSLAKI

SEQ ID NO: 211433 - protein, 8 aa, Japanese encephalitis virus
PRSLAKIV

SEQ ID NO: 211434 - protein, 8 aa, Japanese encephalitis virus
RSLAKIVH

SEQ ID NO: 211435 - protein, 8 aa, Japanese encephalitis virus
SLAKIVHK

SEQ ID NO: 211436 - protein, 8 aa, Japanese encephalitis virus
LAKIVHKA

SEQ ID NO: 211437 - protein, 8 aa, Japanese encephalitis virus
AKIVHKAH

SEQ ID NO: 211438 - protein, 8 aa, Japanese encephalitis virus
KIVHKAHK

SEQ ID NO: 211439 - protein, 8 aa, Japanese encephalitis virus
IVHKAHKE

SEQ ID NO: 211440 - protein, 8 aa, Japanese encephalitis virus
VHKAHKEG

SEQ ID NO: 211441 - protein, 8 aa, Japanese encephalitis virus
HKAHKEGV

SEQ ID NO: 211442 - protein, 8 aa, Japanese encephalitis virus
KAHKEGVC

SEQ ID NO: 211443 - protein, 8 aa, Japanese encephalitis virus
AHKEGVCG

SEQ ID NO: 211444 - protein, 8 aa, Japanese encephalitis virus
HKEGVCGV

SEQ ID NO: 211445 - protein, 8 aa, Japanese encephalitis virus
KEGVCGVR

SEQ ID NO: 211446 - protein, 8 aa, Japanese encephalitis virus
EGVCGVRS

SEQ ID NO: 211447 - protein, 8 aa, Japanese encephalitis virus
GVCGVRSV

SEQ ID NO: 211448 - protein, 8 aa, Japanese encephalitis virus
VCGVRSVT

SEQ ID NO: 211449 - protein, 8 aa, Japanese encephalitis virus
CGVRSVTR

SEQ ID NO: 211450 - protein, 8 aa, Japanese encephalitis virus
GVRSVTRL

SEQ ID NO: 211451 - protein, 8 aa, Japanese encephalitis virus
VRSVTRLE

SEQ ID NO: 211452 - protein, 8 aa, Japanese encephalitis virus
RSVTRLEH

SEQ ID NO: 211453 - protein, 8 aa, Japanese encephalitis virus
SVTRLEHQ

SEQ ID NO: 211454 - protein, 8 aa, Japanese encephalitis virus
VTRLEHQM

SEQ ID NO: 211455 - protein, 8 aa, Japanese encephalitis virus
TRLEHQMW

SEQ ID NO: 211456 - protein, 8 aa, Japanese encephalitis virus
RLEHQMWE

SEQ ID NO: 211457 - protein, 8 aa, Japanese encephalitis virus
LEHQMWEA

SEQ ID NO: 211458 - protein, 8 aa, Japanese encephalitis virus
EHQMWEAV

SEQ ID NO: 211459 - protein, 8 aa, Japanese encephalitis virus
HQMWEAVR

SEQ ID NO: 211460 - protein, 8 aa, Japanese encephalitis virus
QMWEAVRD

SEQ ID NO: 211461 - protein, 8 aa, Japanese encephalitis virus
MWEAVRDE

SEQ ID NO: 211462 - protein, 8 aa, Japanese encephalitis virus
WEAVRDEL

SEQ ID NO: 211463 - protein, 8 aa, Japanese encephalitis virus
EAVRDELN

SEQ ID NO: 211464 - protein, 8 aa, Japanese encephalitis virus
AVRDELNV

SEQ ID NO: 211465 - protein, 8 aa, Japanese encephalitis virus
VRDELNVL

SEQ ID NO: 211466 - protein, 8 aa, Japanese encephalitis virus
RDELNVLL

SEQ ID NO: 211467 - protein, 8 aa, Japanese encephalitis virus
DELNVLLK

SEQ ID NO: 211468 - protein, 8 aa, Japanese encephalitis virus
ELNVLLKE

SEQ ID NO: 211469 - protein, 8 aa, Japanese encephalitis virus
LNVLLKEN

SEQ ID NO: 211470 - protein, 8 aa, Japanese encephalitis virus
NVLLKENA

SEQ ID NO: 211471 - protein, 8 aa, Japanese encephalitis virus
VLLKENAV

SEQ ID NO: 211472 - protein, 8 aa, Japanese encephalitis virus
LLKENAVD

SEQ ID NO: 211473 - protein, 8 aa, Japanese encephalitis virus
LKENAVDL

SEQ ID NO: 211474 - protein, 8 aa, Japanese encephalitis virus
KENAVDLS

SEQ ID NO: 211475 - protein, 8 aa, Japanese encephalitis virus
ENAVDLSV

SEQ ID NO: 211476 - protein, 8 aa, Japanese encephalitis virus
NAVDLSVV

SEQ ID NO: 211477 - protein, 8 aa, Japanese encephalitis virus
AVDLSVVV

SEQ ID NO: 211478 - protein, 8 aa, Japanese encephalitis virus
VDLSVVVN

SEQ ID NO: 211479 - protein, 8 aa, Japanese encephalitis virus
DLSVVVNK

SEQ ID NO: 211480 - protein, 8 aa, Japanese encephalitis virus
LSVVVNKP

SEQ ID NO: 211481 - protein, 8 aa, Japanese encephalitis virus
SVVVNKPV

SEQ ID NO: 211482 - protein, 8 aa, Japanese encephalitis virus
VVVNKPVG

SEQ ID NO: 211483 - protein, 8 aa, Japanese encephalitis virus
VVNKPVGR

SEQ ID NO: 211484 - protein, 8 aa, Japanese encephalitis virus
VNKPVGRY

SEQ ID NO: 211485 - protein, 8 aa, Japanese encephalitis virus
NKPVGRYR

SEQ ID NO: 211486 - protein, 8 aa, Japanese encephalitis virus
KPVGRYRS

SEQ ID NO: 211487 - protein, 8 aa, Japanese encephalitis virus
PVGRYRSA

SEQ ID NO: 211488 - protein, 8 aa, Japanese encephalitis virus
VGRYRSAP

SEQ ID NO: 211489 - protein, 8 aa, Japanese encephalitis virus
GRYRSAPK

SEQ ID NO: 211490 - protein, 8 aa, Japanese encephalitis virus
RYRSAPKR

SEQ ID NO: 211491 - protein, 8 aa, Japanese encephalitis virus
YRSAPKRL

SEQ ID NO: 211492 - protein, 8 aa, Japanese encephalitis virus
RSAPKRLS

SEQ ID NO: 211493 - protein, 8 aa, Japanese encephalitis virus
SAPKRLSM

SEQ ID NO: 211494 - protein, 8 aa, Japanese encephalitis virus
APKRLSMT

SEQ ID NO: 211495 - protein, 8 aa, Japanese encephalitis virus
PKRLSMTQ

SEQ ID NO: 211496 - protein, 8 aa, Japanese encephalitis virus
KRLSMTQE

SEQ ID NO: 211497 - protein, 8 aa, Japanese encephalitis virus
RLSMTQEK

SEQ ID NO: 211498 - protein, 8 aa, Japanese encephalitis virus
LSMTQEKF

SEQ ID NO: 211499 - protein, 8 aa, Japanese encephalitis virus
SMTQEKFE

SEQ ID NO: 211500 - protein, 8 aa, Japanese encephalitis virus
MTQEKFEM

SEQ ID NO: 211501 - protein, 8 aa, Japanese encephalitis virus
TQEKFEMG

SEQ ID NO: 211502 - protein, 8 aa, Japanese encephalitis virus
QEKFEMGW

SEQ ID NO: 211503 - protein, 8 aa, Japanese encephalitis virus
EKFEMGWK

SEQ ID NO: 211504 - protein, 8 aa, Japanese encephalitis virus
KFEMGWKA

SEQ ID NO: 211505 - protein, 8 aa, Japanese encephalitis virus
FEMGWKAW

SEQ ID NO: 211506 - protein, 8 aa, Japanese encephalitis virus
EMGWKAWG

SEQ ID NO: 211507 - protein, 8 aa, Japanese encephalitis virus
MGWKAWGK

SEQ ID NO: 211508 - protein, 8 aa, Japanese encephalitis virus
GWKAWGKS

SEQ ID NO: 211509 - protein, 8 aa, Japanese encephalitis virus
WKAWGKSI

SEQ ID NO: 211510 - protein, 8 aa, Japanese encephalitis virus
KAWGKSIL

SEQ ID NO: 211511 - protein, 8 aa, Japanese encephalitis virus
AWGKSILF

SEQ ID NO: 211512 - protein, 8 aa, Japanese encephalitis virus
WGKSILFA

SEQ ID NO: 211513 - protein, 8 aa, Japanese encephalitis virus
GKSILFAP

SEQ ID NO: 211514 - protein, 8 aa, Japanese encephalitis virus
KSILFAPE

SEQ ID NO: 211515 - protein, 8 aa, Japanese encephalitis virus
SILFAPEL

SEQ ID NO: 211516 - protein, 8 aa, Japanese encephalitis virus
ILFAPELA

SEQ ID NO: 211517 - protein, 8 aa, Japanese encephalitis virus
LFAPELAN

SEQ ID NO: 211518 - protein, 8 aa, Japanese encephalitis virus
FAPELANS

SEQ ID NO: 211519 - protein, 8 aa, Japanese encephalitis virus
APELANST

SEQ ID NO: 211520 - protein, 8 aa, Japanese encephalitis virus
PELANSTF

SEQ ID NO: 211521 - protein, 8 aa, Japanese encephalitis virus
ELANSTFV

SEQ ID NO: 211522 - protein, 8 aa, Japanese encephalitis virus
LANSTFVV

SEQ ID NO: 211523 - protein, 8 aa, Japanese encephalitis virus
ANSTFVVD

SEQ ID NO: 211524 - protein, 8 aa, Japanese encephalitis virus
NSTFVVDG

SEQ ID NO: 211525 - protein, 8 aa, Japanese encephalitis virus
STFVVDGP

SEQ ID NO: 211526 - protein, 8 aa, Japanese encephalitis virus
TFVVDGPE

SEQ ID NO: 211527 - protein, 8 aa, Japanese encephalitis virus
FVVDGPET

SEQ ID NO: 211528 - protein, 8 aa, Japanese encephalitis virus
VVDGPETK

SEQ ID NO: 211529 - protein, 8 aa, Japanese encephalitis virus
VDGPETKE

SEQ ID NO: 211530 - protein, 8 aa, Japanese encephalitis virus
DGPETKEC

SEQ ID NO: 211531 - protein, 8 aa, Japanese encephalitis virus
GPETKECP

SEQ ID NO: 211532 - protein, 8 aa, Japanese encephalitis virus
PETKECPD

SEQ ID NO: 211533 - protein, 8 aa, Japanese encephalitis virus
ETKECPDE

SEQ ID NO: 211534 - protein, 8 aa, Japanese encephalitis virus
TKECPDEH

SEQ ID NO: 211535 - protein, 8 aa, Japanese encephalitis virus
KECPDEHR

SEQ ID NO: 211536 - protein, 8 aa, Japanese encephalitis virus
ECPDEHRA

SEQ ID NO: 211537 - protein, 8 aa, Japanese encephalitis virus
CPDEHRAW

SEQ ID NO: 211538 - protein, 8 aa, Japanese encephalitis virus
PDEHRAWN

SEQ ID NO: 211539 - protein, 8 aa, Japanese encephalitis virus
DEHRAWNS

SEQ ID NO: 211540 - protein, 8 aa, Japanese encephalitis virus
EHRAWNSM

SEQ ID NO: 211541 - protein, 8 aa, Japanese encephalitis virus
HRAWNSMQ

SEQ ID NO: 211542 - protein, 8 aa, Japanese encephalitis virus
RAWNSMQI

SEQ ID NO: 211543 - protein, 8 aa, Japanese encephalitis virus
AWNSMQIE

SEQ ID NO: 211544 - protein, 8 aa, Japanese encephalitis virus
WNSMQIED

SEQ ID NO: 211545 - protein, 8 aa, Japanese encephalitis virus
NSMQIEDF

SEQ ID NO: 211546 - protein, 8 aa, Japanese encephalitis virus
SMQIEDFG

SEQ ID NO: 211547 - protein, 8 aa, Japanese encephalitis virus
MQIEDFGF

SEQ ID NO: 211548 - protein, 8 aa, Japanese encephalitis virus
QIEDFGFG

SEQ ID NO: 211549 - protein, 8 aa, Japanese encephalitis virus
IEDFGFGI

SEQ ID NO: 211550 - protein, 8 aa, Japanese encephalitis virus
EDFGFGIT

SEQ ID NO: 211551 - protein, 8 aa, Japanese encephalitis virus
DFGFGITS

SEQ ID NO: 211552 - protein, 8 aa, Japanese encephalitis virus
FGFGITST

SEQ ID NO: 211553 - protein, 8 aa, Japanese encephalitis virus
GFGITSTR

SEQ ID NO: 211554 - protein, 8 aa, Japanese encephalitis virus
FGITSTRV

SEQ ID NO: 211555 - protein, 8 aa, Japanese encephalitis virus
GITSTRVW

SEQ ID NO: 211556 - protein, 8 aa, Japanese encephalitis virus
ITSTRVWL

SEQ ID NO: 211557 - protein, 8 aa, Japanese encephalitis virus
TSTRVWLK

SEQ ID NO: 211558 - protein, 8 aa, Japanese encephalitis virus
STRVWLKI

SEQ ID NO: 211559 - protein, 8 aa, Japanese encephalitis virus
TRVWLKIR

SEQ ID NO: 211560 - protein, 8 aa, Japanese encephalitis virus
RVWLKIRE

SEQ ID NO: 211561 - protein, 8 aa, Japanese encephalitis virus
VWLKIREE

SEQ ID NO: 211562 - protein, 8 aa, Japanese encephalitis virus
WLKIREES

SEQ ID NO: 211563 - protein, 8 aa, Japanese encephalitis virus
LKIREEST

SEQ ID NO: 211564 - protein, 8 aa, Japanese encephalitis virus
KIREESTD

SEQ ID NO: 211565 - protein, 8 aa, Japanese encephalitis virus
IREESTDE

SEQ ID NO: 211566 - protein, 8 aa, Japanese encephalitis virus
REESTDEC

SEQ ID NO: 211567 - protein, 8 aa, Japanese encephalitis virus
EESTDECD

SEQ ID NO: 211568 - protein, 8 aa, Japanese encephalitis virus
ESTDECDG

SEQ ID NO: 211569 - protein, 8 aa, Japanese encephalitis virus
STDECDGA

SEQ ID NO: 211570 - protein, 8 aa, Japanese encephalitis virus
TDECDGAI

SEQ ID NO: 211571 - protein, 8 aa, Japanese encephalitis virus
DECDGAII

SEQ ID NO: 211572 - protein, 8 aa, Japanese encephalitis virus
ECDGAIIG

SEQ ID NO: 211573 - protein, 8 aa, Japanese encephalitis virus
CDGAIIGT

SEQ ID NO: 211574 - protein, 8 aa, Japanese encephalitis virus
DGAIIGTA

SEQ ID NO: 211575 - protein, 8 aa, Japanese encephalitis virus
GAIIGTAV

SEQ ID NO: 211576 - protein, 8 aa, Japanese encephalitis virus
AIIGTAVK

SEQ ID NO: 211577 - protein, 8 aa, Japanese encephalitis virus
IIGTAVKG

SEQ ID NO: 211578 - protein, 8 aa, Japanese encephalitis virus
IGTAVKGH

SEQ ID NO: 211579 - protein, 8 aa, Japanese encephalitis virus
GTAVKGHV

SEQ ID NO: 211580 - protein, 8 aa, Japanese encephalitis virus
TAVKGHVA

SEQ ID NO: 211581 - protein, 8 aa, Japanese encephalitis virus
AVKGHVAV

SEQ ID NO: 211582 - protein, 8 aa, Japanese encephalitis virus
VKGHVAVH

SEQ ID NO: 211583 - protein, 8 aa, Japanese encephalitis virus
KGHVAVHS

SEQ ID NO: 211584 - protein, 8 aa, Japanese encephalitis virus
GHVAVHSD

SEQ ID NO: 211585 - protein, 8 aa, Japanese encephalitis virus
HVAVHSDL

SEQ ID NO: 211586 - protein, 8 aa, Japanese encephalitis virus
VAVHSDLS

SEQ ID NO: 211587 - protein, 8 aa, Japanese encephalitis virus
AVHSDLSY

SEQ ID NO: 211588 - protein, 8 aa, Japanese encephalitis virus
VHSDLSYW

SEQ ID NO: 211589 - protein, 8 aa, Japanese encephalitis virus
HSDLSYWI

SEQ ID NO: 211590 - protein, 8 aa, Japanese encephalitis virus
SDLSYWIE

SEQ ID NO: 211591 - protein, 8 aa, Japanese encephalitis virus
DLSYWIES

SEQ ID NO: 211592 - protein, 8 aa, Japanese encephalitis virus
LSYWIESR

SEQ ID NO: 211593 - protein, 8 aa, Japanese encephalitis virus
SYWIESRY

SEQ ID NO: 211594 - protein, 8 aa, Japanese encephalitis virus
YWIESRYN

SEQ ID NO: 211595 - protein, 8 aa, Japanese encephalitis virus
WIESRYND

SEQ ID NO: 211596 - protein, 8 aa, Japanese encephalitis virus
NDTWKLER

SEQ ID NO: 211597 - protein, 8 aa, Japanese encephalitis virus
DTWKLERA

SEQ ID NO: 211598 - protein, 8 aa, Japanese encephalitis virus
TWKLERAV

SEQ ID NO: 211599 - protein, 8 aa, Japanese encephalitis virus
WKLERAVF

SEQ ID NO: 211600 - protein, 8 aa, Japanese encephalitis virus
KLERAVFG

SEQ ID NO: 211601 - protein, 8 aa, Japanese encephalitis virus
LERAVFGE

SEQ ID NO: 211602 - protein, 8 aa, Japanese encephalitis virus
ERAVFGEV

SEQ ID NO: 211603 - protein, 8 aa, Japanese encephalitis virus
RAVFGEVK

SEQ ID NO: 211604 - protein, 8 aa, Japanese encephalitis virus
AVFGEVKS

SEQ ID NO: 211605 - protein, 8 aa, Japanese encephalitis virus
VFGEVKSC

SEQ ID NO: 211606 - protein, 8 aa, Japanese encephalitis virus
FGEVKSCT

SEQ ID NO: 211607 - protein, 8 aa, Japanese encephalitis virus
GEVKSCTW

SEQ ID NO: 211608 - protein, 8 aa, Japanese encephalitis virus
EVKSCTWP

SEQ ID NO: 211609 - protein, 8 aa, Japanese encephalitis virus
VKSCTWPE

SEQ ID NO: 211610 - protein, 8 aa, Japanese encephalitis virus
KSCTWPET

SEQ ID NO: 211611 - protein, 8 aa, Japanese encephalitis virus
SCTWPETH

SEQ ID NO: 211612 - protein, 8 aa, Japanese encephalitis virus
CTWPETHT

SEQ ID NO: 211613 - protein, 8 aa, Japanese encephalitis virus
TWPETHTL

SEQ ID NO: 211614 - protein, 8 aa, Japanese encephalitis virus
WPETHTLW

SEQ ID NO: 211615 - protein, 8 aa, Japanese encephalitis virus
PETHTLWG

SEQ ID NO: 211616 - protein, 8 aa, Japanese encephalitis virus
ETHTLWGD

SEQ ID NO: 211617 - protein, 8 aa, Japanese encephalitis virus
THTLWGDG

SEQ ID NO: 211618 - protein, 8 aa, Japanese encephalitis virus
HTLWGDGV

SEQ ID NO: 211619 - protein, 8 aa, Japanese encephalitis virus
TLWGDGVE

SEQ ID NO: 211620 - protein, 8 aa, Japanese encephalitis virus
LWGDGVEE

SEQ ID NO: 211621 - protein, 8 aa, Japanese encephalitis virus
WGDGVEES

SEQ ID NO: 211622 - protein, 8 aa, Japanese encephalitis virus
GDGVEESE

SEQ ID NO: 211623 - protein, 8 aa, Japanese encephalitis virus
DGVEESEL

SEQ ID NO: 211624 - protein, 8 aa, Japanese encephalitis virus
GVEESELI

SEQ ID NO: 211625 - protein, 8 aa, Japanese encephalitis virus
VEESELII

SEQ ID NO: 211626 - protein, 8 aa, Japanese encephalitis virus
EESELIIP

SEQ ID NO: 211627 - protein, 8 aa, Japanese encephalitis virus
ESELIIPH

SEQ ID NO: 211628 - protein, 8 aa, Japanese encephalitis virus
SELIIPHT

SEQ ID NO: 211629 - protein, 8 aa, Japanese encephalitis virus
ELIIPHTI

SEQ ID NO: 211630 - protein, 8 aa, Japanese encephalitis virus
LIIPHTIA

SEQ ID NO: 211631 - protein, 8 aa, Japanese encephalitis virus
IIPHTIAG

SEQ ID NO: 211632 - protein, 8 aa, Japanese encephalitis virus
IPHTIAGP

SEQ ID NO: 211633 - protein, 8 aa, Japanese encephalitis virus
PHTIAGPK

SEQ ID NO: 211634 - protein, 8 aa, Japanese encephalitis virus
HTIAGPKS

SEQ ID NO: 211635 - protein, 8 aa, Japanese encephalitis virus
TIAGPKSK

SEQ ID NO: 211636 - protein, 8 aa, Japanese encephalitis virus
IAGPKSKH

SEQ ID NO: 211637 - protein, 8 aa, Japanese encephalitis virus
AGPKSKHN

SEQ ID NO: 211638 - protein, 8 aa, Japanese encephalitis virus
GPKSKHNR

SEQ ID NO: 211639 - protein, 8 aa, Japanese encephalitis virus
PKSKHNRR

SEQ ID NO: 211640 - protein, 8 aa, Japanese encephalitis virus
KSKHNRRE

SEQ ID NO: 211641 - protein, 8 aa, Japanese encephalitis virus
SKHNRREG

SEQ ID NO: 211642 - protein, 8 aa, Japanese encephalitis virus
KHNRREGY

SEQ ID NO: 211643 - protein, 8 aa, Japanese encephalitis virus
HNRREGYK

SEQ ID NO: 211644 - protein, 8 aa, Japanese encephalitis virus
NRREGYKT

SEQ ID NO: 211645 - protein, 8 aa, Japanese encephalitis virus
RREGYKTQ

SEQ ID NO: 211646 - protein, 8 aa, Japanese encephalitis virus
REGYKTQN

SEQ ID NO: 211647 - protein, 8 aa, Japanese encephalitis virus
EGYKTQNQ

SEQ ID NO: 211648 - protein, 8 aa, Japanese encephalitis virus
GYKTQNQG

SEQ ID NO: 211649 - protein, 8 aa, Japanese encephalitis virus
YKTQNQGP

SEQ ID NO: 211650 - protein, 8 aa, Japanese encephalitis virus
KTQNQGPW

SEQ ID NO: 211651 - protein, 8 aa, Japanese encephalitis virus
TQNQGPWD

SEQ ID NO: 211652 - protein, 8 aa, Japanese encephalitis virus
QNQGPWDE

SEQ ID NO: 211653 - protein, 8 aa, Japanese encephalitis virus
NQGPWDEN

SEQ ID NO: 211654 - protein, 8 aa, Japanese encephalitis virus
QGPWDENG

SEQ ID NO: 211655 - protein, 8 aa, Japanese encephalitis virus
GPWDENGI

SEQ ID NO: 211656 - protein, 8 aa, Japanese encephalitis virus
PWDENGIV

SEQ ID NO: 211657 - protein, 8 aa, Japanese encephalitis virus
WDENGIVL

SEQ ID NO: 211658 - protein, 8 aa, Japanese encephalitis virus
DENGIVLD

SEQ ID NO: 211659 - protein, 8 aa, Japanese encephalitis virus
ENGIVLDF

SEQ ID NO: 211660 - protein, 8 aa, Japanese encephalitis virus
NGIVLDFD

SEQ ID NO: 211661 - protein, 8 aa, Japanese encephalitis virus
GIVLDFDY

SEQ ID NO: 211662 - protein, 8 aa, Japanese encephalitis virus
IVLDFDYC

SEQ ID NO: 211663 - protein, 8 aa, Japanese encephalitis virus
VLDFDYCP

SEQ ID NO: 211664 - protein, 8 aa, Japanese encephalitis virus
LDFDYCPG

SEQ ID NO: 211665 - protein, 8 aa, Japanese encephalitis virus
DFDYCPGT

SEQ ID NO: 211666 - protein, 8 aa, Japanese encephalitis virus
FDYCPGTK

SEQ ID NO: 211667 - protein, 8 aa, Japanese encephalitis virus
DYCPGTKV

SEQ ID NO: 211668 - protein, 8 aa, Japanese encephalitis virus
YCPGTKVT

SEQ ID NO: 211669 - protein, 8 aa, Japanese encephalitis virus
CPGTKVTI

SEQ ID NO: 211670 - protein, 8 aa, Japanese encephalitis virus
PGTKVTIT

SEQ ID NO: 211671 - protein, 8 aa, Japanese encephalitis virus
GTKVTITE

SEQ ID NO: 211672 - protein, 8 aa, Japanese encephalitis virus
TKVTITED

SEQ ID NO: 211673 - protein, 8 aa, Japanese encephalitis virus
KVTITEDC

SEQ ID NO: 211674 - protein, 8 aa, Japanese encephalitis virus
VTITEDCG

SEQ ID NO: 211675 - protein, 8 aa, Japanese encephalitis virus
TITEDCGK

SEQ ID NO: 211676 - protein, 8 aa, Japanese encephalitis virus
ITEDCGKR

SEQ ID NO: 211677 - protein, 8 aa, Japanese encephalitis virus
TEDCGKRG

SEQ ID NO: 211678 - protein, 8 aa, Japanese encephalitis virus
EDCGKRGP

SEQ ID NO: 211679 - protein, 8 aa, Japanese encephalitis virus
DCGKRGPS

SEQ ID NO: 211680 - protein, 8 aa, Japanese encephalitis virus
CGKRGPSV

SEQ ID NO: 211681 - protein, 8 aa, Japanese encephalitis virus
GKRGPSVR

SEQ ID NO: 211682 - protein, 8 aa, Japanese encephalitis virus
KRGPSVRT

SEQ ID NO: 211683 - protein, 8 aa, Japanese encephalitis virus
RGPSVRTT

SEQ ID NO: 211684 - protein, 8 aa, Japanese encephalitis virus
GPSVRTTT

SEQ ID NO: 211685 - protein, 8 aa, Japanese encephalitis virus
PSVRTTTD

SEQ ID NO: 211686 - protein, 8 aa, Japanese encephalitis virus
SVRTTTDS

SEQ ID NO: 211687 - protein, 8 aa, Japanese encephalitis virus
VRTTTDSG

SEQ ID NO: 211688 - protein, 8 aa, Japanese encephalitis virus
RTTTDSGK

SEQ ID NO: 211689 - protein, 8 aa, Japanese encephalitis virus
TTTDSGKL

SEQ ID NO: 211690 - protein, 8 aa, Japanese encephalitis virus
TTDSGKLI

SEQ ID NO: 211691 - protein, 8 aa, Japanese encephalitis virus
TDSGKLIT

SEQ ID NO: 211692 - protein, 8 aa, Japanese encephalitis virus
DSGKLITD

SEQ ID NO: 211693 - protein, 8 aa, Japanese encephalitis virus
SGKLITDW

SEQ ID NO: 211694 - protein, 8 aa, Japanese encephalitis virus
GKLITDWC

SEQ ID NO: 211695 - protein, 8 aa, Japanese encephalitis virus
KLITDWCC

SEQ ID NO: 211696 - protein, 8 aa, Japanese encephalitis virus
LITDWCCR

SEQ ID NO: 211697 - protein, 8 aa, Japanese encephalitis virus
ITDWCCRS

SEQ ID NO: 211698 - protein, 8 aa, Japanese encephalitis virus
TDWCCRSC

SEQ ID NO: 211699 - protein, 8 aa, Japanese encephalitis virus
DWCCRSCS

SEQ ID NO: 211700 - protein, 8 aa, Japanese encephalitis virus
WCCRSCSL

SEQ ID NO: 211701 - protein, 8 aa, Japanese encephalitis virus
CCRSCSLP

SEQ ID NO: 211702 - protein, 8 aa, Japanese encephalitis virus
CRSCSLPP

SEQ ID NO: 211703 - protein, 8 aa, Japanese encephalitis virus
RSCSLPPL

SEQ ID NO: 211704 - protein, 8 aa, Japanese encephalitis virus
SCSLPPLR

SEQ ID NO: 211705 - protein, 8 aa, Japanese encephalitis virus
CSLPPLRF

SEQ ID NO: 211706 - protein, 8 aa, Japanese encephalitis virus
SLPPLRFR

SEQ ID NO: 211707 - protein, 8 aa, Japanese encephalitis virus
LPPLRFRT

SEQ ID NO: 211708 - protein, 8 aa, Japanese encephalitis virus
PPLRFRTE

SEQ ID NO: 211709 - protein, 8 aa, Japanese encephalitis virus
PLRFRTEN

SEQ ID NO: 211710 - protein, 8 aa, Japanese encephalitis virus
LRFRTENG

SEQ ID NO: 211711 - protein, 8 aa, Japanese encephalitis virus
RFRTENGC

SEQ ID NO: 211712 - protein, 8 aa, Japanese encephalitis virus
FRTENGCW

SEQ ID NO: 211713 - protein, 8 aa, Japanese encephalitis virus
RTENGCWY

SEQ ID NO: 211714 - protein, 8 aa, Japanese encephalitis virus
TENGCWYG

SEQ ID NO: 211715 - protein, 8 aa, Japanese encephalitis virus
ENGCWYGM

SEQ ID NO: 211716 - protein, 8 aa, Japanese encephalitis virus
NGCWYGME

SEQ ID NO: 211717 - protein, 8 aa, Japanese encephalitis virus
GCWYGMEI

SEQ ID NO: 211718 - protein, 8 aa, Japanese encephalitis virus
CWYGMEIR

SEQ ID NO: 211719 - protein, 8 aa, Japanese encephalitis virus
WYGMEIRP

SEQ ID NO: 211720 - protein, 8 aa, Japanese encephalitis virus
YGMEIRPV

SEQ ID NO: 211721 - protein, 8 aa, Japanese encephalitis virus
RHDETTLV

SEQ ID NO: 211722 - protein, 8 aa, Japanese encephalitis virus
HDETTLVR

SEQ ID NO: 211723 - protein, 8 aa, Japanese encephalitis virus
DETTLVRS

SEQ ID NO: 211724 - protein, 8 aa, Japanese encephalitis virus
ETTLVRSQ

SEQ ID NO: 211725 - protein, 8 aa, Japanese encephalitis virus
TTLVRSQV

SEQ ID NO: 211726 - protein, 8 aa, Japanese encephalitis virus
TLVRSQVD

SEQ ID NO: 211727 - protein, 8 aa, Japanese encephalitis virus
LVRSQVDA

SEQ ID NO: 211728 - protein, 8 aa, Japanese encephalitis virus
NGEMVDPF

SEQ ID NO: 211729 - protein, 8 aa, Japanese encephalitis virus
GEMVDPFQ

SEQ ID NO: 211730 - protein, 8 aa, Japanese encephalitis virus
EMVDPFQL

SEQ ID NO: 211731 - protein, 8 aa, Japanese encephalitis virus
MVDPFQLG

SEQ ID NO: 211732 - protein, 8 aa, Japanese encephalitis virus
VDPFQLGL

SEQ ID NO: 211733 - protein, 8 aa, Japanese encephalitis virus
DPFQLGLL

SEQ ID NO: 211734 - protein, 8 aa, Japanese encephalitis virus
PFQLGLLV

SEQ ID NO: 211735 - protein, 8 aa, Japanese encephalitis virus
FQLGLLVM

SEQ ID NO: 211736 - protein, 8 aa, Japanese encephalitis virus
QLGLLVMF

SEQ ID NO: 211737 - protein, 8 aa, Japanese encephalitis virus
LGLLVMFL

SEQ ID NO: 211738 - protein, 8 aa, Japanese encephalitis virus
GLLVMFLA

SEQ ID NO: 211739 - protein, 8 aa, Japanese encephalitis virus
LLVMFLAT

SEQ ID NO: 211740 - protein, 8 aa, Japanese encephalitis virus
LVMFLATQ

SEQ ID NO: 211741 - protein, 8 aa, Japanese encephalitis virus
VMFLATQE

SEQ ID NO: 211742 - protein, 8 aa, Japanese encephalitis virus
MFLATQEV

SEQ ID NO: 211743 - protein, 8 aa, Japanese encephalitis virus
FLATQEVL

SEQ ID NO: 211744 - protein, 8 aa, Japanese encephalitis virus
LATQEVLR

SEQ ID NO: 211745 - protein, 8 aa, Japanese encephalitis virus
ATQEVLRK

SEQ ID NO: 211746 - protein, 8 aa, Japanese encephalitis virus
TQEVLRKR

SEQ ID NO: 211747 - protein, 8 aa, Japanese encephalitis virus
QEVLRKRW

SEQ ID NO: 211748 - protein, 8 aa, Japanese encephalitis virus
EVLRKRWT

SEQ ID NO: 211749 - protein, 8 aa, Japanese encephalitis virus
VLRKRWTA

SEQ ID NO: 211750 - protein, 8 aa, Japanese encephalitis virus
LRKRWTAR

SEQ ID NO: 211751 - protein, 8 aa, Japanese encephalitis virus
RKRWTARL

SEQ ID NO: 211752 - protein, 8 aa, Japanese encephalitis virus
KRWTARLT

SEQ ID NO: 211753 - protein, 8 aa, Japanese encephalitis virus
RWTARLTI

SEQ ID NO: 211754 - protein, 8 aa, Japanese encephalitis virus
WTARLTIP

SEQ ID NO: 211755 - protein, 8 aa, Japanese encephalitis virus
TARLTIPA

SEQ ID NO: 211756 - protein, 8 aa, Japanese encephalitis virus
ARLTIPAV

SEQ ID NO: 211757 - protein, 8 aa, Japanese encephalitis virus
RLTIPAVL

SEQ ID NO: 211758 - protein, 8 aa, Japanese encephalitis virus
LTIPAVLG

SEQ ID NO: 211759 - protein, 8 aa, Japanese encephalitis virus
TIPAVLGA

SEQ ID NO: 211760 - protein, 8 aa, Japanese encephalitis virus
IPAVLGAL

SEQ ID NO: 211761 - protein, 8 aa, Japanese encephalitis virus
PAVLGALL

SEQ ID NO: 211762 - protein, 8 aa, Japanese encephalitis virus
AVLGALLV

SEQ ID NO: 211763 - protein, 8 aa, Japanese encephalitis virus
VLGALLVL

SEQ ID NO: 211764 - protein, 8 aa, Japanese encephalitis virus
LGALLVLM

SEQ ID NO: 211765 - protein, 8 aa, Japanese encephalitis virus
GALLVLML

SEQ ID NO: 211766 - protein, 8 aa, Japanese encephalitis virus
ALLVLMLG

SEQ ID NO: 211767 - protein, 8 aa, Japanese encephalitis virus
LLVLMLGG

SEQ ID NO: 211768 - protein, 8 aa, Japanese encephalitis virus
LVLMLGGI

SEQ ID NO: 211769 - protein, 8 aa, Japanese encephalitis virus
VLMLGGIT

SEQ ID NO: 211770 - protein, 8 aa, Japanese encephalitis virus
LMLGGITY

SEQ ID NO: 211771 - protein, 8 aa, Japanese encephalitis virus
MLGGITYT

SEQ ID NO: 211772 - protein, 8 aa, Japanese encephalitis virus
LGGITYTD

SEQ ID NO: 211773 - protein, 8 aa, Japanese encephalitis virus
GGITYTDL

SEQ ID NO: 211774 - protein, 8 aa, Japanese encephalitis virus
GITYTDLA

SEQ ID NO: 211775 - protein, 8 aa, Japanese encephalitis virus
ITYTDLAR

SEQ ID NO: 211776 - protein, 8 aa, Japanese encephalitis virus
TYTDLARY

SEQ ID NO: 211777 - protein, 8 aa, Japanese encephalitis virus
YTDLARYV

SEQ ID NO: 211778 - protein, 8 aa, Japanese encephalitis virus
TDLARYVV

SEQ ID NO: 211779 - protein, 8 aa, Japanese encephalitis virus
DLARYVVL

SEQ ID NO: 211780 - protein, 8 aa, Japanese encephalitis virus
LARYVVLV

SEQ ID NO: 211781 - protein, 8 aa, Japanese encephalitis virus
ARYVVLVA

SEQ ID NO: 211782 - protein, 8 aa, Japanese encephalitis virus
RYVVLVAA

SEQ ID NO: 211783 - protein, 8 aa, Japanese encephalitis virus
YVVLVAAA

SEQ ID NO: 211784 - protein, 8 aa, Japanese encephalitis virus
VVLVAAAF

SEQ ID NO: 211785 - protein, 8 aa, Japanese encephalitis virus
VLVAAAFA

SEQ ID NO: 211786 - protein, 8 aa, Japanese encephalitis virus
LVAAAFAE

SEQ ID NO: 211787 - protein, 8 aa, Japanese encephalitis virus
VAAAFAEA

SEQ ID NO: 211788 - protein, 8 aa, Japanese encephalitis virus
AAAFAEAN

SEQ ID NO: 211789 - protein, 8 aa, Japanese encephalitis virus
AAFAEANS

SEQ ID NO: 211790 - protein, 8 aa, Japanese encephalitis virus
AFAEANSG

SEQ ID NO: 211791 - protein, 8 aa, Japanese encephalitis virus
FAEANSGG

SEQ ID NO: 211792 - protein, 8 aa, Japanese encephalitis virus
AEANSGGD

SEQ ID NO: 211793 - protein, 8 aa, Japanese encephalitis virus
EANSGGDV

SEQ ID NO: 211794 - protein, 8 aa, Japanese encephalitis virus
ANSGGDVL

SEQ ID NO: 211795 - protein, 8 aa, Japanese encephalitis virus
NSGGDVLH

SEQ ID NO: 211796 - protein, 8 aa, Japanese encephalitis virus
SGGDVLHL

SEQ ID NO: 211797 - protein, 8 aa, Japanese encephalitis virus
GGDVLHLA

SEQ ID NO: 211798 - protein, 8 aa, Japanese encephalitis virus
GDVLHLAL

SEQ ID NO: 211799 - protein, 8 aa, Japanese encephalitis virus
DVLHLALI

SEQ ID NO: 211800 - protein, 8 aa, Japanese encephalitis virus
VLHLALIA

SEQ ID NO: 211801 - protein, 8 aa, Japanese encephalitis virus
LHLALIAV

SEQ ID NO: 211802 - protein, 8 aa, Japanese encephalitis virus
HLALIAVF

SEQ ID NO: 211803 - protein, 8 aa, Japanese encephalitis virus
LALIAVFK

SEQ ID NO: 211804 - protein, 8 aa, Japanese encephalitis virus
ALIAVFKI

SEQ ID NO: 211805 - protein, 8 aa, Japanese encephalitis virus
LIAVFKIQ

SEQ ID NO: 211806 - protein, 8 aa, Japanese encephalitis virus
IAVFKIQP

SEQ ID NO: 211807 - protein, 8 aa, Japanese encephalitis virus
AVFKIQPA

SEQ ID NO: 211808 - protein, 8 aa, Japanese encephalitis virus
VFKIQPAF

SEQ ID NO: 211809 - protein, 8 aa, Japanese encephalitis virus
FKIQPAFL

SEQ ID NO: 211810 - protein, 8 aa, Japanese encephalitis virus
KIQPAFLV

SEQ ID NO: 211811 - protein, 8 aa, Japanese encephalitis virus
IQPAFLVM

SEQ ID NO: 211812 - protein, 8 aa, Japanese encephalitis virus
QPAFLVMN

SEQ ID NO: 211813 - protein, 8 aa, Japanese encephalitis virus
PAFLVMNM

SEQ ID NO: 211814 - protein, 8 aa, Japanese encephalitis virus
AFLVMNML

SEQ ID NO: 211815 - protein, 8 aa, Japanese encephalitis virus
FLVMNMLS

SEQ ID NO: 211816 - protein, 8 aa, Japanese encephalitis virus
LVMNMLST

SEQ ID NO: 211817 - protein, 8 aa, Japanese encephalitis virus
NMLSTRWT

SEQ ID NO: 211818 - protein, 8 aa, Japanese encephalitis virus
MLSTRWTN

SEQ ID NO: 211819 - protein, 8 aa, Japanese encephalitis virus
LSTRWTNQ

SEQ ID NO: 211820 - protein, 8 aa, Japanese encephalitis virus
STRWTNQE

SEQ ID NO: 211821 - protein, 8 aa, Japanese encephalitis virus
TRWTNQEN

SEQ ID NO: 211822 - protein, 8 aa, Japanese encephalitis virus
RWTNQENV

SEQ ID NO: 211823 - protein, 8 aa, Japanese encephalitis virus
WTNQENVV

SEQ ID NO: 211824 - protein, 8 aa, Japanese encephalitis virus
TNQENVVL

SEQ ID NO: 211825 - protein, 8 aa, Japanese encephalitis virus
NQENVVLV

SEQ ID NO: 211826 - protein, 8 aa, Japanese encephalitis virus
QENVVLVL

SEQ ID NO: 211827 - protein, 8 aa, Japanese encephalitis virus
ENVVLVLG

SEQ ID NO: 211828 - protein, 8 aa, Japanese encephalitis virus
NVVLVLGA

SEQ ID NO: 211829 - protein, 8 aa, Japanese encephalitis virus
VVLVLGAA

SEQ ID NO: 211830 - protein, 8 aa, Japanese encephalitis virus
VLVLGAAF

SEQ ID NO: 211831 - protein, 8 aa, Japanese encephalitis virus
LVLGAAFF

SEQ ID NO: 211832 - protein, 8 aa, Japanese encephalitis virus
VLGAAFFQ

SEQ ID NO: 211833 - protein, 8 aa, Japanese encephalitis virus
LGAAFFQL

SEQ ID NO: 211834 - protein, 8 aa, Japanese encephalitis virus
GAAFFQLA

SEQ ID NO: 211835 - protein, 8 aa, Japanese encephalitis virus
AAFFQLAS

SEQ ID NO: 211836 - protein, 8 aa, Japanese encephalitis virus
AFFQLASV

SEQ ID NO: 211837 - protein, 8 aa, Japanese encephalitis virus
FFQLASVD

SEQ ID NO: 211838 - protein, 8 aa, Japanese encephalitis virus
FQLASVDL

SEQ ID NO: 211839 - protein, 8 aa, Japanese encephalitis virus
QLASVDLQ

SEQ ID NO: 211840 - protein, 8 aa, Japanese encephalitis virus
LASVDLQI

SEQ ID NO: 211841 - protein, 8 aa, Japanese encephalitis virus
ASVDLQIG

SEQ ID NO: 211842 - protein, 8 aa, Japanese encephalitis virus
SVDLQIGV

SEQ ID NO: 211843 - protein, 8 aa, Japanese encephalitis virus
VDLQIGVH

SEQ ID NO: 211844 - protein, 8 aa, Japanese encephalitis virus
DLQIGVHG

SEQ ID NO: 211845 - protein, 8 aa, Japanese encephalitis virus
LQIGVHGI

SEQ ID NO: 211846 - protein, 8 aa, Japanese encephalitis virus
QIGVHGIL

SEQ ID NO: 211847 - protein, 8 aa, Japanese encephalitis virus
IGVHGILN

SEQ ID NO: 211848 - protein, 8 aa, Japanese encephalitis virus
GVHGILNA

SEQ ID NO: 211849 - protein, 8 aa, Japanese encephalitis virus
VHGILNAA

SEQ ID NO: 211850 - protein, 8 aa, Japanese encephalitis virus
HGILNAAA

SEQ ID NO: 211851 - protein, 8 aa, Japanese encephalitis virus
GILNAAAI

SEQ ID NO: 211852 - protein, 8 aa, Japanese encephalitis virus
ILNAAAIA

SEQ ID NO: 211853 - protein, 8 aa, Japanese encephalitis virus
LNAAAIAW

SEQ ID NO: 211854 - protein, 8 aa, Japanese encephalitis virus
NAAAIAWM

SEQ ID NO: 211855 - protein, 8 aa, Japanese encephalitis virus
AAAIAWMI

SEQ ID NO: 211856 - protein, 8 aa, Japanese encephalitis virus
AAIAWMIV

SEQ ID NO: 211857 - protein, 8 aa, Japanese encephalitis virus
AIAWMIVR

SEQ ID NO: 211858 - protein, 8 aa, Japanese encephalitis virus
IAWMIVRA

SEQ ID NO: 211859 - protein, 8 aa, Japanese encephalitis virus
AWMIVRAI

SEQ ID NO: 211860 - protein, 8 aa, Japanese encephalitis virus
WMIVRAIT

SEQ ID NO: 211861 - protein, 8 aa, Japanese encephalitis virus
MIVRAITF

SEQ ID NO: 211862 - protein, 8 aa, Japanese encephalitis virus
IVRAITFP

SEQ ID NO: 211863 - protein, 8 aa, Japanese encephalitis virus
VRAITFPT

SEQ ID NO: 211864 - protein, 8 aa, Japanese encephalitis virus
RAITFPTT

SEQ ID NO: 211865 - protein, 8 aa, Japanese encephalitis virus
AITFPTTS

SEQ ID NO: 211866 - protein, 8 aa, Japanese encephalitis virus
ITFPTTSS

SEQ ID NO: 211867 - protein, 8 aa, Japanese encephalitis virus
TFPTTSSV

SEQ ID NO: 211868 - protein, 8 aa, Japanese encephalitis virus
FPTTSSVT

SEQ ID NO: 211869 - protein, 8 aa, Japanese encephalitis virus
PTTSSVTM

SEQ ID NO: 211870 - protein, 8 aa, Japanese encephalitis virus
TTSSVTMP

SEQ ID NO: 211871 - protein, 8 aa, Japanese encephalitis virus
MPVLALLT

SEQ ID NO: 211872 - protein, 8 aa, Japanese encephalitis virus
PVLALLTP

SEQ ID NO: 211873 - protein, 8 aa, Japanese encephalitis virus
VLALLTPG

SEQ ID NO: 211874 - protein, 8 aa, Japanese encephalitis virus
LALLTPGM

SEQ ID NO: 211875 - protein, 8 aa, Japanese encephalitis virus
ALLTPGMR

SEQ ID NO: 211876 - protein, 8 aa, Japanese encephalitis virus
LLTPGMRA

SEQ ID NO: 211877 - protein, 8 aa, Japanese encephalitis virus
LTPGMRAL

SEQ ID NO: 211878 - protein, 8 aa, Japanese encephalitis virus
TPGMRALY

SEQ ID NO: 211879 - protein, 8 aa, Japanese encephalitis virus
PGMRALYL

SEQ ID NO: 211880 - protein, 8 aa, Japanese encephalitis virus
GMRALYLD

SEQ ID NO: 211881 - protein, 8 aa, Japanese encephalitis virus
MRALYLDT

SEQ ID NO: 211882 - protein, 8 aa, Japanese encephalitis virus
RALYLDTY

SEQ ID NO: 211883 - protein, 8 aa, Japanese encephalitis virus
ALYLDTYR

SEQ ID NO: 211884 - protein, 8 aa, Japanese encephalitis virus
LYLDTYRI

SEQ ID NO: 211885 - protein, 8 aa, Japanese encephalitis virus
YLDTYRII

SEQ ID NO: 211886 - protein, 8 aa, Japanese encephalitis virus
LDTYRIIL

SEQ ID NO: 211887 - protein, 8 aa, Japanese encephalitis virus
DTYRIILL

SEQ ID NO: 211888 - protein, 8 aa, Japanese encephalitis virus
TYRIILLV

SEQ ID NO: 211889 - protein, 8 aa, Japanese encephalitis virus
YRIILLVI

SEQ ID NO: 211890 - protein, 8 aa, Japanese encephalitis virus
RIILLVIG

SEQ ID NO: 211891 - protein, 8 aa, Japanese encephalitis virus
IILLVIGI

SEQ ID NO: 211892 - protein, 8 aa, Japanese encephalitis virus
ILLVIGIC

SEQ ID NO: 211893 - protein, 8 aa, Japanese encephalitis virus
LLVIGICS

SEQ ID NO: 211894 - protein, 8 aa, Japanese encephalitis virus
LVIGICSL

SEQ ID NO: 211895 - protein, 8 aa, Japanese encephalitis virus
VIGICSLL

SEQ ID NO: 211896 - protein, 8 aa, Japanese encephalitis virus
IGICSLLQ

SEQ ID NO: 211897 - protein, 8 aa, Japanese encephalitis virus
GICSLLQE

SEQ ID NO: 211898 - protein, 8 aa, Japanese encephalitis virus
ICSLLQER

SEQ ID NO: 211899 - protein, 8 aa, Japanese encephalitis virus
CSLLQERK

SEQ ID NO: 211900 - protein, 8 aa, Japanese encephalitis virus
ERKKTMAK

SEQ ID NO: 211901 - protein, 8 aa, Japanese encephalitis virus
RKKTMAKK

SEQ ID NO: 211902 - protein, 8 aa, Japanese encephalitis virus
KKTMAKKK

SEQ ID NO: 211903 - protein, 8 aa, Japanese encephalitis virus
KTMAKKKG

SEQ ID NO: 211904 - protein, 8 aa, Japanese encephalitis virus
TMAKKKGA

SEQ ID NO: 211905 - protein, 8 aa, Japanese encephalitis virus
MAKKKGAV

SEQ ID NO: 211906 - protein, 8 aa, Japanese encephalitis virus
AKKKGAVL

SEQ ID NO: 211907 - protein, 8 aa, Japanese encephalitis virus
KKKGAVLL

SEQ ID NO: 211908 - protein, 8 aa, Japanese encephalitis virus
KKGAVLLG

SEQ ID NO: 211909 - protein, 8 aa, Japanese encephalitis virus
KGAVLLGL

SEQ ID NO: 211910 - protein, 8 aa, Japanese encephalitis virus
GAVLLGLA

SEQ ID NO: 211911 - protein, 8 aa, Japanese encephalitis virus
AVLLGLAL

SEQ ID NO: 211912 - protein, 8 aa, Japanese encephalitis virus
VLLGLALT

SEQ ID NO: 211913 - protein, 8 aa, Japanese encephalitis virus
LLGLALTS

SEQ ID NO: 211914 - protein, 8 aa, Japanese encephalitis virus
LGLALTST

SEQ ID NO: 211915 - protein, 8 aa, Japanese encephalitis virus
GLALTSTG

SEQ ID NO: 211916 - protein, 8 aa, Japanese encephalitis virus
LALTSTGW

SEQ ID NO: 211917 - protein, 8 aa, Japanese encephalitis virus
ALTSTGWF

SEQ ID NO: 211918 - protein, 8 aa, Japanese encephalitis virus
LTSTGWFS

SEQ ID NO: 211919 - protein, 8 aa, Japanese encephalitis virus
TSTGWFSP

SEQ ID NO: 211920 - protein, 8 aa, Japanese encephalitis virus
STGWFSPT

SEQ ID NO: 211921 - protein, 8 aa, Japanese encephalitis virus
TGWFSPTT

SEQ ID NO: 211922 - protein, 8 aa, Japanese encephalitis virus
GWFSPTTI

SEQ ID NO: 211923 - protein, 8 aa, Japanese encephalitis virus
WFSPTTIA

SEQ ID NO: 211924 - protein, 8 aa, Japanese encephalitis virus
FSPTTIAA

SEQ ID NO: 211925 - protein, 8 aa, Japanese encephalitis virus
SPTTIAAG

SEQ ID NO: 211926 - protein, 8 aa, Japanese encephalitis virus
PTTIAAGL

SEQ ID NO: 211927 - protein, 8 aa, Japanese encephalitis virus
TTIAAGLM

SEQ ID NO: 211928 - protein, 8 aa, Japanese encephalitis virus
TIAAGLMV

SEQ ID NO: 211929 - protein, 8 aa, Japanese encephalitis virus
IAAGLMVC

SEQ ID NO: 211930 - protein, 8 aa, Japanese encephalitis virus
AAGLMVCN

SEQ ID NO: 211931 - protein, 8 aa, Japanese encephalitis virus
AGLMVCNP

SEQ ID NO: 211932 - protein, 8 aa, Japanese encephalitis virus
GLMVCNPN

SEQ ID NO: 211933 - protein, 8 aa, Japanese encephalitis virus
LMVCNPNK

SEQ ID NO: 211934 - protein, 8 aa, Japanese encephalitis virus
MVCNPNKK

SEQ ID NO: 211935 - protein, 8 aa, Japanese encephalitis virus
VCNPNKKR

SEQ ID NO: 211936 - protein, 8 aa, Japanese encephalitis virus
CNPNKKRG

SEQ ID NO: 211937 - protein, 8 aa, Japanese encephalitis virus
NPNKKRGW

SEQ ID NO: 211938 - protein, 8 aa, Japanese encephalitis virus
PNKKRGWP

SEQ ID NO: 211939 - protein, 8 aa, Japanese encephalitis virus
NKKRGWPA

SEQ ID NO: 211940 - protein, 8 aa, Japanese encephalitis virus
KKRGWPAT

SEQ ID NO: 211941 - protein, 8 aa, Japanese encephalitis virus
KRGWPATE

SEQ ID NO: 211942 - protein, 8 aa, Japanese encephalitis virus
RGWPATEF

SEQ ID NO: 211943 - protein, 8 aa, Japanese encephalitis virus
GWPATEFL

SEQ ID NO: 211944 - protein, 8 aa, Japanese encephalitis virus
WPATEFLS

SEQ ID NO: 211945 - protein, 8 aa, Japanese encephalitis virus
PATEFLSA

SEQ ID NO: 211946 - protein, 8 aa, Japanese encephalitis virus
ATEFLSAV

SEQ ID NO: 211947 - protein, 8 aa, Japanese encephalitis virus
TEFLSAVG

SEQ ID NO: 211948 - protein, 8 aa, Japanese encephalitis virus
EFLSAVGL

SEQ ID NO: 211949 - protein, 8 aa, Japanese encephalitis virus
FLSAVGLM

SEQ ID NO: 211950 - protein, 8 aa, Japanese encephalitis virus
LSAVGLMF

SEQ ID NO: 211951 - protein, 8 aa, Japanese encephalitis virus
SAVGLMFA

SEQ ID NO: 211952 - protein, 8 aa, Japanese encephalitis virus
AVGLMFAI

SEQ ID NO: 211953 - protein, 8 aa, Japanese encephalitis virus
VGLMFAIV

SEQ ID NO: 211954 - protein, 8 aa, Japanese encephalitis virus
GLMFAIVG

SEQ ID NO: 211955 - protein, 8 aa, Japanese encephalitis virus
LMFAIVGG

SEQ ID NO: 211956 - protein, 8 aa, Japanese encephalitis virus
MFAIVGGL

SEQ ID NO: 211957 - protein, 8 aa, Japanese encephalitis virus
FAIVGGLA

SEQ ID NO: 211958 - protein, 8 aa, Japanese encephalitis virus
AIVGGLAE

SEQ ID NO: 211959 - protein, 8 aa, Japanese encephalitis virus
IVGGLAEL

SEQ ID NO: 211960 - protein, 8 aa, Japanese encephalitis virus
VGGLAELD

SEQ ID NO: 211961 - protein, 8 aa, Japanese encephalitis virus
GGLAELDI

SEQ ID NO: 211962 - protein, 8 aa, Japanese encephalitis virus
GLAELDIE

SEQ ID NO: 211963 - protein, 8 aa, Japanese encephalitis virus
LAELDIES

SEQ ID NO: 211964 - protein, 8 aa, Japanese encephalitis virus
AELDIESM

SEQ ID NO: 211965 - protein, 8 aa, Japanese encephalitis virus
ELDIESMS

SEQ ID NO: 211966 - protein, 8 aa, Japanese encephalitis virus
LDIESMSI

SEQ ID NO: 211967 - protein, 8 aa, Japanese encephalitis virus
DIESMSIP

SEQ ID NO: 211968 - protein, 8 aa, Japanese encephalitis virus
IESMSIPF

SEQ ID NO: 211969 - protein, 8 aa, Japanese encephalitis virus
ESMSIPFM

SEQ ID NO: 211970 - protein, 8 aa, Japanese encephalitis virus
SMSIPFML

SEQ ID NO: 211971 - protein, 8 aa, Japanese encephalitis virus
MSIPFMLA

SEQ ID NO: 211972 - protein, 8 aa, Japanese encephalitis virus
SIPFMLAG

SEQ ID NO: 211973 - protein, 8 aa, Japanese encephalitis virus
IPFMLAGL

SEQ ID NO: 211974 - protein, 8 aa, Japanese encephalitis virus
PFMLAGLM

SEQ ID NO: 211975 - protein, 8 aa, Japanese encephalitis virus
FMLAGLMA

SEQ ID NO: 211976 - protein, 8 aa, Japanese encephalitis virus
MLAGLMAV

SEQ ID NO: 211977 - protein, 8 aa, Japanese encephalitis virus
LAGLMAVS

SEQ ID NO: 211978 - protein, 8 aa, Japanese encephalitis virus
AGLMAVSY

SEQ ID NO: 211979 - protein, 8 aa, Japanese encephalitis virus
GLMAVSYV

SEQ ID NO: 211980 - protein, 8 aa, Japanese encephalitis virus
LMAVSYVV

SEQ ID NO: 211981 - protein, 8 aa, Japanese encephalitis virus
MAVSYVVS

SEQ ID NO: 211982 - protein, 8 aa, Japanese encephalitis virus
AVSYVVSG

SEQ ID NO: 211983 - protein, 8 aa, Japanese encephalitis virus
VSYVVSGK

SEQ ID NO: 211984 - protein, 8 aa, Japanese encephalitis virus
SYVVSGKA

SEQ ID NO: 211985 - protein, 8 aa, Japanese encephalitis virus
YVVSGKAT

SEQ ID NO: 211986 - protein, 8 aa, Japanese encephalitis virus
VVSGKATD

SEQ ID NO: 211987 - protein, 8 aa, Japanese encephalitis virus
VSGKATDM

SEQ ID NO: 211988 - protein, 8 aa, Japanese encephalitis virus
SGKATDMW

SEQ ID NO: 211989 - protein, 8 aa, Japanese encephalitis virus
GKATDMWL

SEQ ID NO: 211990 - protein, 8 aa, Japanese encephalitis virus
KATDMWLE

SEQ ID NO: 211991 - protein, 8 aa, Japanese encephalitis virus
ATDMWLER

SEQ ID NO: 211992 - protein, 8 aa, Japanese encephalitis virus
TDMWLERA

SEQ ID NO: 211993 - protein, 8 aa, Japanese encephalitis virus
DMWLERAA

SEQ ID NO: 211994 - protein, 8 aa, Japanese encephalitis virus
MWLERAAD

SEQ ID NO: 211995 - protein, 8 aa, Japanese encephalitis virus
WLERAADI

SEQ ID NO: 211996 - protein, 8 aa, Japanese encephalitis virus
LERAADIS

SEQ ID NO: 211997 - protein, 8 aa, Japanese encephalitis virus
ERAADISW

SEQ ID NO: 211998 - protein, 8 aa, Japanese encephalitis virus
RAADISWE

SEQ ID NO: 211999 - protein, 8 aa, Japanese encephalitis virus
AADISWEM

SEQ ID NO: 212000 - protein, 8 aa, Japanese encephalitis virus
SWEMDAAI

SEQ ID NO: 212001 - protein, 8 aa, Japanese encephalitis virus
WEMDAAIT

SEQ ID NO: 212002 - protein, 8 aa, Japanese encephalitis virus
EMDAAITG

SEQ ID NO: 212003 - protein, 8 aa, Japanese encephalitis virus
MDAAITGS

SEQ ID NO: 212004 - protein, 8 aa, Japanese encephalitis virus
DAAITGSS

SEQ ID NO: 212005 - protein, 8 aa, Japanese encephalitis virus
AAITGSSR

SEQ ID NO: 212006 - protein, 8 aa, Japanese encephalitis virus
AITGSSRR

SEQ ID NO: 212007 - protein, 8 aa, Japanese encephalitis virus
ITGSSRRL

SEQ ID NO: 212008 - protein, 8 aa, Japanese encephalitis virus
TGSSRRLD

SEQ ID NO: 212009 - protein, 8 aa, Japanese encephalitis virus
GSSRRLDV

SEQ ID NO: 212010 - protein, 8 aa, Japanese encephalitis virus
SSRRLDVK

SEQ ID NO: 212011 - protein, 8 aa, Japanese encephalitis virus
SRRLDVKL

SEQ ID NO: 212012 - protein, 8 aa, Japanese encephalitis virus
RRLDVKLD

SEQ ID NO: 212013 - protein, 8 aa, Japanese encephalitis virus
RLDVKLDD

SEQ ID NO: 212014 - protein, 8 aa, Japanese encephalitis virus
LDVKLDDD

SEQ ID NO: 212015 - protein, 8 aa, Japanese encephalitis virus
DVKLDDDG

SEQ ID NO: 212016 - protein, 8 aa, Japanese encephalitis virus
VKLDDDGD

SEQ ID NO: 212017 - protein, 8 aa, Japanese encephalitis virus
KLDDDGDF

SEQ ID NO: 212018 - protein, 8 aa, Japanese encephalitis virus
LDDDGDFH

SEQ ID NO: 212019 - protein, 8 aa, Japanese encephalitis virus
DDDGDFHL

SEQ ID NO: 212020 - protein, 8 aa, Japanese encephalitis virus
DDGDFHLI

SEQ ID NO: 212021 - protein, 8 aa, Japanese encephalitis virus
DGDFHLID

SEQ ID NO: 212022 - protein, 8 aa, Japanese encephalitis virus
GDFHLIDD

SEQ ID NO: 212023 - protein, 8 aa, Japanese encephalitis virus
DFHLIDDP

SEQ ID NO: 212024 - protein, 8 aa, Japanese encephalitis virus
FHLIDDPG

SEQ ID NO: 212025 - protein, 8 aa, Japanese encephalitis virus
HLIDDPGV

SEQ ID NO: 212026 - protein, 8 aa, Japanese encephalitis virus
LIDDPGVP

SEQ ID NO: 212027 - protein, 8 aa, Japanese encephalitis virus
IDDPGVPW

SEQ ID NO: 212028 - protein, 8 aa, Japanese encephalitis virus
DDPGVPWK

SEQ ID NO: 212029 - protein, 8 aa, Japanese encephalitis virus
DPGVPWKV

SEQ ID NO: 212030 - protein, 8 aa, Japanese encephalitis virus
PGVPWKVW

SEQ ID NO: 212031 - protein, 8 aa, Japanese encephalitis virus
GVPWKVWV

SEQ ID NO: 212032 - protein, 8 aa, Japanese encephalitis virus
VPWKVWVL

SEQ ID NO: 212033 - protein, 8 aa, Japanese encephalitis virus
PWKVWVLR

SEQ ID NO: 212034 - protein, 8 aa, Japanese encephalitis virus
WKVWVLRM

SEQ ID NO: 212035 - protein, 8 aa, Japanese encephalitis virus
KVWVLRMS

SEQ ID NO: 212036 - protein, 8 aa, Japanese encephalitis virus
VWVLRMSC

SEQ ID NO: 212037 - protein, 8 aa, Japanese encephalitis virus
WVLRMSCI

SEQ ID NO: 212038 - protein, 8 aa, Japanese encephalitis virus
VLRMSCIG

SEQ ID NO: 212039 - protein, 8 aa, Japanese encephalitis virus
LRMSCIGL

SEQ ID NO: 212040 - protein, 8 aa, Japanese encephalitis virus
RMSCIGLA

SEQ ID NO: 212041 - protein, 8 aa, Japanese encephalitis virus
MSCIGLAA

SEQ ID NO: 212042 - protein, 8 aa, Japanese encephalitis virus
SCIGLAAL

SEQ ID NO: 212043 - protein, 8 aa, Japanese encephalitis virus
CIGLAALT

SEQ ID NO: 212044 - protein, 8 aa, Japanese encephalitis virus
IGLAALTP

SEQ ID NO: 212045 - protein, 8 aa, Japanese encephalitis virus
GLAALTPW

SEQ ID NO: 212046 - protein, 8 aa, Japanese encephalitis virus
LAALTPWA

SEQ ID NO: 212047 - protein, 8 aa, Japanese encephalitis virus
AALTPWAI

SEQ ID NO: 212048 - protein, 8 aa, Japanese encephalitis virus
ALTPWAIV

SEQ ID NO: 212049 - protein, 8 aa, Japanese encephalitis virus
LTPWAIVP

SEQ ID NO: 212050 - protein, 8 aa, Japanese encephalitis virus
TPWAIVPA

SEQ ID NO: 212051 - protein, 8 aa, Japanese encephalitis virus
PWAIVPAA

SEQ ID NO: 212052 - protein, 8 aa, Japanese encephalitis virus
WAIVPAAF

SEQ ID NO: 212053 - protein, 8 aa, Japanese encephalitis virus
AIVPAAFG

SEQ ID NO: 212054 - protein, 8 aa, Japanese encephalitis virus
IVPAAFGY

SEQ ID NO: 212055 - protein, 8 aa, Japanese encephalitis virus
VPAAFGYW

SEQ ID NO: 212056 - protein, 8 aa, Japanese encephalitis virus
PAAFGYWL

SEQ ID NO: 212057 - protein, 8 aa, Japanese encephalitis virus
AAFGYWLT

SEQ ID NO: 212058 - protein, 8 aa, Japanese encephalitis virus
AFGYWLTL

SEQ ID NO: 212059 - protein, 8 aa, Japanese encephalitis virus
FGYWLTLK

SEQ ID NO: 212060 - protein, 8 aa, Japanese encephalitis virus
GYWLTLKT

SEQ ID NO: 212061 - protein, 8 aa, Japanese encephalitis virus
YWLTLKTT

SEQ ID NO: 212062 - protein, 8 aa, Japanese encephalitis virus
WLTLKTTK

SEQ ID NO: 212063 - protein, 8 aa, Japanese encephalitis virus
LTLKTTKR

SEQ ID NO: 212064 - protein, 8 aa, Japanese encephalitis virus
TLKTTKRG

SEQ ID NO: 212065 - protein, 8 aa, Japanese encephalitis virus
LKTTKRGG

SEQ ID NO: 212066 - protein, 8 aa, Japanese encephalitis virus
KTTKRGGV

SEQ ID NO: 212067 - protein, 8 aa, Japanese encephalitis virus
TTKRGGVF

SEQ ID NO: 212068 - protein, 8 aa, Japanese encephalitis virus
TKRGGVFW

SEQ ID NO: 212069 - protein, 8 aa, Japanese encephalitis virus
KRGGVFWD

SEQ ID NO: 212070 - protein, 8 aa, Japanese encephalitis virus
RGGVFWDT

SEQ ID NO: 212071 - protein, 8 aa, Japanese encephalitis virus
GGVFWDTP

SEQ ID NO: 212072 - protein, 8 aa, Japanese encephalitis virus
GVFWDTPS

SEQ ID NO: 212073 - protein, 8 aa, Japanese encephalitis virus
VFWDTPSP

SEQ ID NO: 212074 - protein, 8 aa, Japanese encephalitis virus
FWDTPSPK

SEQ ID NO: 212075 - protein, 8 aa, Japanese encephalitis virus
WDTPSPKP

SEQ ID NO: 212076 - protein, 8 aa, Japanese encephalitis virus
DTPSPKPC

SEQ ID NO: 212077 - protein, 8 aa, Japanese encephalitis virus
TPSPKPCS

SEQ ID NO: 212078 - protein, 8 aa, Japanese encephalitis virus
PSPKPCSK

SEQ ID NO: 212079 - protein, 8 aa, Japanese encephalitis virus
SPKPCSKG

SEQ ID NO: 212080 - protein, 8 aa, Japanese encephalitis virus
PKPCSKGD

SEQ ID NO: 212081 - protein, 8 aa, Japanese encephalitis virus
KPCSKGDT

SEQ ID NO: 212082 - protein, 8 aa, Japanese encephalitis virus
PCSKGDTT

SEQ ID NO: 212083 - protein, 8 aa, Japanese encephalitis virus
CSKGDTTT

SEQ ID NO: 212084 - protein, 8 aa, Japanese encephalitis virus
SKGDTTTG

SEQ ID NO: 212085 - protein, 8 aa, Japanese encephalitis virus
KGDTTTGV

SEQ ID NO: 212086 - protein, 8 aa, Japanese encephalitis virus
GDTTTGVY

SEQ ID NO: 212087 - protein, 8 aa, Japanese encephalitis virus
DTTTGVYR

SEQ ID NO: 212088 - protein, 8 aa, Japanese encephalitis virus
TTTGVYRI

SEQ ID NO: 212089 - protein, 8 aa, Japanese encephalitis virus
TTGVYRIM

SEQ ID NO: 212090 - protein, 8 aa, Japanese encephalitis virus
TGVYRIMA

SEQ ID NO: 212091 - protein, 8 aa, Japanese encephalitis virus
GVYRIMAR

SEQ ID NO: 212092 - protein, 8 aa, Japanese encephalitis virus
VYRIMARG

SEQ ID NO: 212093 - protein, 8 aa, Japanese encephalitis virus
YRIMARGI

SEQ ID NO: 212094 - protein, 8 aa, Japanese encephalitis virus
RIMARGIL

SEQ ID NO: 212095 - protein, 8 aa, Japanese encephalitis virus
IMARGILG

SEQ ID NO: 212096 - protein, 8 aa, Japanese encephalitis virus
MARGILGT

SEQ ID NO: 212097 - protein, 8 aa, Japanese encephalitis virus
ARGILGTY

SEQ ID NO: 212098 - protein, 8 aa, Japanese encephalitis virus
RGILGTYQ

SEQ ID NO: 212099 - protein, 8 aa, Japanese encephalitis virus
GILGTYQA

SEQ ID NO: 212100 - protein, 8 aa, Japanese encephalitis virus
ILGTYQAG

SEQ ID NO: 212101 - protein, 8 aa, Japanese encephalitis virus
LGTYQAGV

SEQ ID NO: 212102 - protein, 8 aa, Japanese encephalitis virus
GTYQAGVG

SEQ ID NO: 212103 - protein, 8 aa, Japanese encephalitis virus
TYQAGVGV

SEQ ID NO: 212104 - protein, 8 aa, Japanese encephalitis virus
YQAGVGVM

SEQ ID NO: 212105 - protein, 8 aa, Japanese encephalitis virus
QAGVGVMY

SEQ ID NO: 212106 - protein, 8 aa, Japanese encephalitis virus
AGVGVMYE

SEQ ID NO: 212107 - protein, 8 aa, Japanese encephalitis virus
GVGVMYEN

SEQ ID NO: 212108 - protein, 8 aa, Japanese encephalitis virus
VGVMYENV

SEQ ID NO: 212109 - protein, 8 aa, Japanese encephalitis virus
GVMYENVF

SEQ ID NO: 212110 - protein, 8 aa, Japanese encephalitis virus
VMYENVFH

SEQ ID NO: 212111 - protein, 8 aa, Japanese encephalitis virus
MYENVFHT

SEQ ID NO: 212112 - protein, 8 aa, Japanese encephalitis virus
YENVFHTL

SEQ ID NO: 212113 - protein, 8 aa, Japanese encephalitis virus
ENVFHTLW

SEQ ID NO: 212114 - protein, 8 aa, Japanese encephalitis virus
NVFHTLWH

SEQ ID NO: 212115 - protein, 8 aa, Japanese encephalitis virus
VFHTLWHT

SEQ ID NO: 212116 - protein, 8 aa, Japanese encephalitis virus
FHTLWHTT

SEQ ID NO: 212117 - protein, 8 aa, Japanese encephalitis virus
HTLWHTTR

SEQ ID NO: 212118 - protein, 8 aa, Japanese encephalitis virus
TLWHTTRG

SEQ ID NO: 212119 - protein, 8 aa, Japanese encephalitis virus
LWHTTRGA

SEQ ID NO: 212120 - protein, 8 aa, Japanese encephalitis virus
WHTTRGAA

SEQ ID NO: 212121 - protein, 8 aa, Japanese encephalitis virus
HTTRGAAI

SEQ ID NO: 212122 - protein, 8 aa, Japanese encephalitis virus
TTRGAAIM

SEQ ID NO: 212123 - protein, 8 aa, Japanese encephalitis virus
TRGAAIMS

SEQ ID NO: 212124 - protein, 8 aa, Japanese encephalitis virus
RGAAIMSG

SEQ ID NO: 212125 - protein, 8 aa, Japanese encephalitis virus
GAAIMSGE

SEQ ID NO: 212126 - protein, 8 aa, Japanese encephalitis virus
AAIMSGEG

SEQ ID NO: 212127 - protein, 8 aa, Japanese encephalitis virus
AIMSGEGK

SEQ ID NO: 212128 - protein, 8 aa, Japanese encephalitis virus
IMSGEGKL

SEQ ID NO: 212129 - protein, 8 aa, Japanese encephalitis virus
MSGEGKLT

SEQ ID NO: 212130 - protein, 8 aa, Japanese encephalitis virus
SGEGKLTP

SEQ ID NO: 212131 - protein, 8 aa, Japanese encephalitis virus
GEGKLTPY

SEQ ID NO: 212132 - protein, 8 aa, Japanese encephalitis virus
EGKLTPYW

SEQ ID NO: 212133 - protein, 8 aa, Japanese encephalitis virus
GKLTPYWG

SEQ ID NO: 212134 - protein, 8 aa, Japanese encephalitis virus
KLTPYWGS

SEQ ID NO: 212135 - protein, 8 aa, Japanese encephalitis virus
LTPYWGSV

SEQ ID NO: 212136 - protein, 8 aa, Japanese encephalitis virus
TPYWGSVK

SEQ ID NO: 212137 - protein, 8 aa, Japanese encephalitis virus
PYWGSVKE

SEQ ID NO: 212138 - protein, 8 aa, Japanese encephalitis virus
YWGSVKED

SEQ ID NO: 212139 - protein, 8 aa, Japanese encephalitis virus
WGSVKEDR

SEQ ID NO: 212140 - protein, 8 aa, Japanese encephalitis virus
GSVKEDRI

SEQ ID NO: 212141 - protein, 8 aa, Japanese encephalitis virus
SVKEDRIA

SEQ ID NO: 212142 - protein, 8 aa, Japanese encephalitis virus
VKEDRIAY

SEQ ID NO: 212143 - protein, 8 aa, Japanese encephalitis virus
KEDRIAYG

SEQ ID NO: 212144 - protein, 8 aa, Japanese encephalitis virus
EDRIAYGG

SEQ ID NO: 212145 - protein, 8 aa, Japanese encephalitis virus
DRIAYGGP

SEQ ID NO: 212146 - protein, 8 aa, Japanese encephalitis virus
RIAYGGPW

SEQ ID NO: 212147 - protein, 8 aa, Japanese encephalitis virus
IAYGGPWR

SEQ ID NO: 212148 - protein, 8 aa, Japanese encephalitis virus
AYGGPWRF

SEQ ID NO: 212149 - protein, 8 aa, Japanese encephalitis virus
YGGPWRFD

SEQ ID NO: 212150 - protein, 8 aa, Japanese encephalitis virus
GGPWRFDR

SEQ ID NO: 212151 - protein, 8 aa, Japanese encephalitis virus
GPWRFDRK

SEQ ID NO: 212152 - protein, 8 aa, Japanese encephalitis virus
PWRFDRKW

SEQ ID NO: 212153 - protein, 8 aa, Japanese encephalitis virus
WRFDRKWN

SEQ ID NO: 212154 - protein, 8 aa, Japanese encephalitis virus
RFDRKWNG

SEQ ID NO: 212155 - protein, 8 aa, Japanese encephalitis virus
FDRKWNGT

SEQ ID NO: 212156 - protein, 8 aa, Japanese encephalitis virus
DRKWNGTD

SEQ ID NO: 212157 - protein, 8 aa, Japanese encephalitis virus
RKWNGTDD

SEQ ID NO: 212158 - protein, 8 aa, Japanese encephalitis virus
KWNGTDDV

SEQ ID NO: 212159 - protein, 8 aa, Japanese encephalitis virus
WNGTDDVQ

SEQ ID NO: 212160 - protein, 8 aa, Japanese encephalitis virus
NGTDDVQV

SEQ ID NO: 212161 - protein, 8 aa, Japanese encephalitis virus
GTDDVQVI

SEQ ID NO: 212162 - protein, 8 aa, Japanese encephalitis virus
TDDVQVIV

SEQ ID NO: 212163 - protein, 8 aa, Japanese encephalitis virus
DDVQVIVV

SEQ ID NO: 212164 - protein, 8 aa, Japanese encephalitis virus
DVQVIVVE

SEQ ID NO: 212165 - protein, 8 aa, Japanese encephalitis virus
VQVIVVEP

SEQ ID NO: 212166 - protein, 8 aa, Japanese encephalitis virus
QVIVVEPG

SEQ ID NO: 212167 - protein, 8 aa, Japanese encephalitis virus
VIVVEPGK

SEQ ID NO: 212168 - protein, 8 aa, Japanese encephalitis virus
IVVEPGKA

SEQ ID NO: 212169 - protein, 8 aa, Japanese encephalitis virus
VVEPGKAA

SEQ ID NO: 212170 - protein, 8 aa, Japanese encephalitis virus
AVNIQTKP

SEQ ID NO: 212171 - protein, 8 aa, Japanese encephalitis virus
VNIQTKPG

SEQ ID NO: 212172 - protein, 8 aa, Japanese encephalitis virus
NIQTKPGV

SEQ ID NO: 212173 - protein, 8 aa, Japanese encephalitis virus
IQTKPGVF

SEQ ID NO: 212174 - protein, 8 aa, Japanese encephalitis virus
QTKPGVFR

SEQ ID NO: 212175 - protein, 8 aa, Japanese encephalitis virus
TKPGVFRT

SEQ ID NO: 212176 - protein, 8 aa, Japanese encephalitis virus
KPGVFRTP

SEQ ID NO: 212177 - protein, 8 aa, Japanese encephalitis virus
PGVFRTPF

SEQ ID NO: 212178 - protein, 8 aa, Japanese encephalitis virus
GVFRTPFG

SEQ ID NO: 212179 - protein, 8 aa, Japanese encephalitis virus
PFGEVGAV

SEQ ID NO: 212180 - protein, 8 aa, Japanese encephalitis virus
FGEVGAVS

SEQ ID NO: 212181 - protein, 8 aa, Japanese encephalitis virus
GEVGAVSL

SEQ ID NO: 212182 - protein, 8 aa, Japanese encephalitis virus
EVGAVSLD

SEQ ID NO: 212183 - protein, 8 aa, Japanese encephalitis virus
VGAVSLDY

SEQ ID NO: 212184 - protein, 8 aa, Japanese encephalitis virus
GAVSLDYP

SEQ ID NO: 212185 - protein, 8 aa, Japanese encephalitis virus
AVSLDYPR

SEQ ID NO: 212186 - protein, 8 aa, Japanese encephalitis virus
VSLDYPRG

SEQ ID NO: 212187 - protein, 8 aa, Japanese encephalitis virus
SLDYPRGT

SEQ ID NO: 212188 - protein, 8 aa, Japanese encephalitis virus
LDYPRGTS

SEQ ID NO: 212189 - protein, 8 aa, Japanese encephalitis virus
DYPRGTSG

SEQ ID NO: 212190 - protein, 8 aa, Japanese encephalitis virus
YPRGTSGS

SEQ ID NO: 212191 - protein, 8 aa, Japanese encephalitis virus
PRGTSGSP

SEQ ID NO: 212192 - protein, 8 aa, Japanese encephalitis virus
RGTSGSPI

SEQ ID NO: 212193 - protein, 8 aa, Japanese encephalitis virus
GTSGSPIL

SEQ ID NO: 212194 - protein, 8 aa, Japanese encephalitis virus
TSGSPILD

SEQ ID NO: 212195 - protein, 8 aa, Japanese encephalitis virus
SGSPILDS

SEQ ID NO: 212196 - protein, 8 aa, Japanese encephalitis virus
GSPILDSN

SEQ ID NO: 212197 - protein, 8 aa, Japanese encephalitis virus
SPILDSNG

SEQ ID NO: 212198 - protein, 8 aa, Japanese encephalitis virus
PILDSNGD

SEQ ID NO: 212199 - protein, 8 aa, Japanese encephalitis virus
ILDSNGDI

SEQ ID NO: 212200 - protein, 8 aa, Japanese encephalitis virus
LDSNGDII

SEQ ID NO: 212201 - protein, 8 aa, Japanese encephalitis virus
DSNGDIIG

SEQ ID NO: 212202 - protein, 8 aa, Japanese encephalitis virus
SNGDIIGL

SEQ ID NO: 212203 - protein, 8 aa, Japanese encephalitis virus
NGDIIGLY

SEQ ID NO: 212204 - protein, 8 aa, Japanese encephalitis virus
GDIIGLYG

SEQ ID NO: 212205 - protein, 8 aa, Japanese encephalitis virus
DIIGLYGN

SEQ ID NO: 212206 - protein, 8 aa, Japanese encephalitis virus
IIGLYGNG

SEQ ID NO: 212207 - protein, 8 aa, Japanese encephalitis virus
IGLYGNGV

SEQ ID NO: 212208 - protein, 8 aa, Japanese encephalitis virus
GLYGNGVE

SEQ ID NO: 212209 - protein, 8 aa, Japanese encephalitis virus
LYGNGVEL

SEQ ID NO: 212210 - protein, 8 aa, Japanese encephalitis virus
YGNGVELG

SEQ ID NO: 212211 - protein, 8 aa, Japanese encephalitis virus
GNGVELGD

SEQ ID NO: 212212 - protein, 8 aa, Japanese encephalitis virus
NGVELGDG

SEQ ID NO: 212213 - protein, 8 aa, Japanese encephalitis virus
GVELGDGS

SEQ ID NO: 212214 - protein, 8 aa, Japanese encephalitis virus
VELGDGSY

SEQ ID NO: 212215 - protein, 8 aa, Japanese encephalitis virus
ELGDGSYV

SEQ ID NO: 212216 - protein, 8 aa, Japanese encephalitis virus
LGDGSYVS

SEQ ID NO: 212217 - protein, 8 aa, Japanese encephalitis virus
GDGSYVSA

SEQ ID NO: 212218 - protein, 8 aa, Japanese encephalitis virus
DGSYVSAI

SEQ ID NO: 212219 - protein, 8 aa, Japanese encephalitis virus
GSYVSAIV

SEQ ID NO: 212220 - protein, 8 aa, Japanese encephalitis virus
SYVSAIVQ

SEQ ID NO: 212221 - protein, 8 aa, Japanese encephalitis virus
YVSAIVQG

SEQ ID NO: 212222 - protein, 8 aa, Japanese encephalitis virus
VSAIVQGD

SEQ ID NO: 212223 - protein, 8 aa, Japanese encephalitis virus
SAIVQGDR

SEQ ID NO: 212224 - protein, 8 aa, Japanese encephalitis virus
AIVQGDRQ

SEQ ID NO: 212225 - protein, 8 aa, Japanese encephalitis virus
IVQGDRQE

SEQ ID NO: 212226 - protein, 8 aa, Japanese encephalitis virus
VQGDRQEE

SEQ ID NO: 212227 - protein, 8 aa, Japanese encephalitis virus
QGDRQEEP

SEQ ID NO: 212228 - protein, 8 aa, Japanese encephalitis virus
GDRQEEPV

SEQ ID NO: 212229 - protein, 8 aa, Japanese encephalitis virus
DRQEEPVP

SEQ ID NO: 212230 - protein, 8 aa, Japanese encephalitis virus
RQEEPVPE

SEQ ID NO: 212231 - protein, 8 aa, Japanese encephalitis virus
QEEPVPEA

SEQ ID NO: 212232 - protein, 8 aa, Japanese encephalitis virus
EEPVPEAY

SEQ ID NO: 212233 - protein, 8 aa, Japanese encephalitis virus
EPVPEAYT

SEQ ID NO: 212234 - protein, 8 aa, Japanese encephalitis virus
PVPEAYTP

SEQ ID NO: 212235 - protein, 8 aa, Japanese encephalitis virus
VPEAYTPN

SEQ ID NO: 212236 - protein, 8 aa, Japanese encephalitis virus
PEAYTPNM

SEQ ID NO: 212237 - protein, 8 aa, Japanese encephalitis virus
EAYTPNML

SEQ ID NO: 212238 - protein, 8 aa, Japanese encephalitis virus
AYTPNMLR

SEQ ID NO: 212239 - protein, 8 aa, Japanese encephalitis virus
YTPNMLRK

SEQ ID NO: 212240 - protein, 8 aa, Japanese encephalitis virus
PNMLRKRQ

SEQ ID NO: 212241 - protein, 8 aa, Japanese encephalitis virus
MLRKRQMT

SEQ ID NO: 212242 - protein, 8 aa, Japanese encephalitis virus
LRKRQMTV

SEQ ID NO: 212243 - protein, 8 aa, Japanese encephalitis virus
RKRQMTVL

SEQ ID NO: 212244 - protein, 8 aa, Japanese encephalitis virus
KRQMTVLD

SEQ ID NO: 212245 - protein, 8 aa, Japanese encephalitis virus
RQMTVLDL

SEQ ID NO: 212246 - protein, 8 aa, Japanese encephalitis virus
QMTVLDLH

SEQ ID NO: 212247 - protein, 8 aa, Japanese encephalitis virus
MTVLDLHP

SEQ ID NO: 212248 - protein, 8 aa, Japanese encephalitis virus
TVLDLHPG

SEQ ID NO: 212249 - protein, 8 aa, Japanese encephalitis virus
VLDLHPGS

SEQ ID NO: 212250 - protein, 8 aa, Japanese encephalitis virus
LDLHPGSG

SEQ ID NO: 212251 - protein, 8 aa, Japanese encephalitis virus
DLHPGSGK

SEQ ID NO: 212252 - protein, 8 aa, Japanese encephalitis virus
LHPGSGKT

SEQ ID NO: 212253 - protein, 8 aa, Japanese encephalitis virus
HPGSGKTR

SEQ ID NO: 212254 - protein, 8 aa, Japanese encephalitis virus
PGSGKTRK

SEQ ID NO: 212255 - protein, 8 aa, Japanese encephalitis virus
GSGKTRKI

SEQ ID NO: 212256 - protein, 8 aa, Japanese encephalitis virus
SGKTRKIL

SEQ ID NO: 212257 - protein, 8 aa, Japanese encephalitis virus
GKTRKILP

SEQ ID NO: 212258 - protein, 8 aa, Japanese encephalitis virus
KTRKILPQ

SEQ ID NO: 212259 - protein, 8 aa, Japanese encephalitis virus
TRKILPQI

SEQ ID NO: 212260 - protein, 8 aa, Japanese encephalitis virus
RKILPQII

SEQ ID NO: 212261 - protein, 8 aa, Japanese encephalitis virus
KILPQIIK

SEQ ID NO: 212262 - protein, 8 aa, Japanese encephalitis virus
ILPQIIKD

SEQ ID NO: 212263 - protein, 8 aa, Japanese encephalitis virus
LPQIIKDA

SEQ ID NO: 212264 - protein, 8 aa, Japanese encephalitis virus
PQIIKDAI

SEQ ID NO: 212265 - protein, 8 aa, Japanese encephalitis virus
QIIKDAIQ

SEQ ID NO: 212266 - protein, 8 aa, Japanese encephalitis virus
IIKDAIQQ

SEQ ID NO: 212267 - protein, 8 aa, Japanese encephalitis virus
IKDAIQQR

SEQ ID NO: 212268 - protein, 8 aa, Japanese encephalitis virus
KDAIQQRL

SEQ ID NO: 212269 - protein, 8 aa, Japanese encephalitis virus
DAIQQRLR

SEQ ID NO: 212270 - protein, 8 aa, Japanese encephalitis virus
AIQQRLRT

SEQ ID NO: 212271 - protein, 8 aa, Japanese encephalitis virus
IQQRLRTA

SEQ ID NO: 212272 - protein, 8 aa, Japanese encephalitis virus
QQRLRTAV

SEQ ID NO: 212273 - protein, 8 aa, Japanese encephalitis virus
QRLRTAVL

SEQ ID NO: 212274 - protein, 8 aa, Japanese encephalitis virus
RLRTAVLA

SEQ ID NO: 212275 - protein, 8 aa, Japanese encephalitis virus
LRTAVLAP

SEQ ID NO: 212276 - protein, 8 aa, Japanese encephalitis virus
RTAVLAPT

SEQ ID NO: 212277 - protein, 8 aa, Japanese encephalitis virus
TAVLAPTR

SEQ ID NO: 212278 - protein, 8 aa, Japanese encephalitis virus
AVLAPTRV

SEQ ID NO: 212279 - protein, 8 aa, Japanese encephalitis virus
VLAPTRVV

SEQ ID NO: 212280 - protein, 8 aa, Japanese encephalitis virus
LAPTRVVA

SEQ ID NO: 212281 - protein, 8 aa, Japanese encephalitis virus
APTRVVAA

SEQ ID NO: 212282 - protein, 8 aa, Japanese encephalitis virus
PTRVVAAE

SEQ ID NO: 212283 - protein, 8 aa, Japanese encephalitis virus
TRVVAAEM

SEQ ID NO: 212284 - protein, 8 aa, Japanese encephalitis virus
RVVAAEMA

SEQ ID NO: 212285 - protein, 8 aa, Japanese encephalitis virus
VVAAEMAE

SEQ ID NO: 212286 - protein, 8 aa, Japanese encephalitis virus
VAAEMAEA

SEQ ID NO: 212287 - protein, 8 aa, Japanese encephalitis virus
AAEMAEAL

SEQ ID NO: 212288 - protein, 8 aa, Japanese encephalitis virus
AEMAEALR

SEQ ID NO: 212289 - protein, 8 aa, Japanese encephalitis virus
EMAEALRG

SEQ ID NO: 212290 - protein, 8 aa, Japanese encephalitis virus
MAEALRGL

SEQ ID NO: 212291 - protein, 8 aa, Japanese encephalitis virus
AEALRGLP

SEQ ID NO: 212292 - protein, 8 aa, Japanese encephalitis virus
EALRGLPV

SEQ ID NO: 212293 - protein, 8 aa, Japanese encephalitis virus
ALRGLPVR

SEQ ID NO: 212294 - protein, 8 aa, Japanese encephalitis virus
LRGLPVRY

SEQ ID NO: 212295 - protein, 8 aa, Japanese encephalitis virus
RGLPVRYQ

SEQ ID NO: 212296 - protein, 8 aa, Japanese encephalitis virus
GLPVRYQT

SEQ ID NO: 212297 - protein, 8 aa, Japanese encephalitis virus
LPVRYQTS

SEQ ID NO: 212298 - protein, 8 aa, Japanese encephalitis virus
PVRYQTSA

SEQ ID NO: 212299 - protein, 8 aa, Japanese encephalitis virus
VRYQTSAV

SEQ ID NO: 212300 - protein, 8 aa, Japanese encephalitis virus
RYQTSAVQ

SEQ ID NO: 212301 - protein, 8 aa, Japanese encephalitis virus
YQTSAVQR

SEQ ID NO: 212302 - protein, 8 aa, Japanese encephalitis virus
QTSAVQRE

SEQ ID NO: 212303 - protein, 8 aa, Japanese encephalitis virus
TSAVQREH

SEQ ID NO: 212304 - protein, 8 aa, Japanese encephalitis virus
SAVQREHQ

SEQ ID NO: 212305 - protein, 8 aa, Japanese encephalitis virus
AVQREHQG

SEQ ID NO: 212306 - protein, 8 aa, Japanese encephalitis virus
VQREHQGN

SEQ ID NO: 212307 - protein, 8 aa, Japanese encephalitis virus
QREHQGNE

SEQ ID NO: 212308 - protein, 8 aa, Japanese encephalitis virus
REHQGNEI

SEQ ID NO: 212309 - protein, 8 aa, Japanese encephalitis virus
EHQGNEIV

SEQ ID NO: 212310 - protein, 8 aa, Japanese encephalitis virus
HQGNEIVD

SEQ ID NO: 212311 - protein, 8 aa, Japanese encephalitis virus
QGNEIVDV

SEQ ID NO: 212312 - protein, 8 aa, Japanese encephalitis virus
GNEIVDVM

SEQ ID NO: 212313 - protein, 8 aa, Japanese encephalitis virus
NEIVDVMC

SEQ ID NO: 212314 - protein, 8 aa, Japanese encephalitis virus
EIVDVMCH

SEQ ID NO: 212315 - protein, 8 aa, Japanese encephalitis virus
IVDVMCHA

SEQ ID NO: 212316 - protein, 8 aa, Japanese encephalitis virus
VDVMCHAT

SEQ ID NO: 212317 - protein, 8 aa, Japanese encephalitis virus
DVMCHATL

SEQ ID NO: 212318 - protein, 8 aa, Japanese encephalitis virus
VMCHATLT

SEQ ID NO: 212319 - protein, 8 aa, Japanese encephalitis virus
MCHATLTH

SEQ ID NO: 212320 - protein, 8 aa, Japanese encephalitis virus
CHATLTHR

SEQ ID NO: 212321 - protein, 8 aa, Japanese encephalitis virus
HATLTHRL

SEQ ID NO: 212322 - protein, 8 aa, Japanese encephalitis virus
ATLTHRLM

SEQ ID NO: 212323 - protein, 8 aa, Japanese encephalitis virus
TLTHRLMS

SEQ ID NO: 212324 - protein, 8 aa, Japanese encephalitis virus
LTHRLMSP

SEQ ID NO: 212325 - protein, 8 aa, Japanese encephalitis virus
THRLMSPN

SEQ ID NO: 212326 - protein, 8 aa, Japanese encephalitis virus
HRLMSPNR

SEQ ID NO: 212327 - protein, 8 aa, Japanese encephalitis virus
RLMSPNRV

SEQ ID NO: 212328 - protein, 8 aa, Japanese encephalitis virus
LMSPNRVP

SEQ ID NO: 212329 - protein, 8 aa, Japanese encephalitis virus
MSPNRVPN

SEQ ID NO: 212330 - protein, 8 aa, Japanese encephalitis virus
SPNRVPNY

SEQ ID NO: 212331 - protein, 8 aa, Japanese encephalitis virus
PNRVPNYN

SEQ ID NO: 212332 - protein, 8 aa, Japanese encephalitis virus
NRVPNYNL

SEQ ID NO: 212333 - protein, 8 aa, Japanese encephalitis virus
RVPNYNLF

SEQ ID NO: 212334 - protein, 8 aa, Japanese encephalitis virus
VPNYNLFV

SEQ ID NO: 212335 - protein, 8 aa, Japanese encephalitis virus
PNYNLFVM

SEQ ID NO: 212336 - protein, 8 aa, Japanese encephalitis virus
NYNLFVMD

SEQ ID NO: 212337 - protein, 8 aa, Japanese encephalitis virus
YNLFVMDE

SEQ ID NO: 212338 - protein, 8 aa, Japanese encephalitis virus
NLFVMDEA

SEQ ID NO: 212339 - protein, 8 aa, Japanese encephalitis virus
LFVMDEAH

SEQ ID NO: 212340 - protein, 8 aa, Japanese encephalitis virus
FVMDEAHF

SEQ ID NO: 212341 - protein, 8 aa, Japanese encephalitis virus
VMDEAHFT

SEQ ID NO: 212342 - protein, 8 aa, Japanese encephalitis virus
MDEAHFTD

SEQ ID NO: 212343 - protein, 8 aa, Japanese encephalitis virus
DEAHFTDP

SEQ ID NO: 212344 - protein, 8 aa, Japanese encephalitis virus
EAHFTDPA

SEQ ID NO: 212345 - protein, 8 aa, Japanese encephalitis virus
AHFTDPAS

SEQ ID NO: 212346 - protein, 8 aa, Japanese encephalitis virus
HFTDPASI

SEQ ID NO: 212347 - protein, 8 aa, Japanese encephalitis virus
FTDPASIA

SEQ ID NO: 212348 - protein, 8 aa, Japanese encephalitis virus
TDPASIAA

SEQ ID NO: 212349 - protein, 8 aa, Japanese encephalitis virus
DPASIAAR

SEQ ID NO: 212350 - protein, 8 aa, Japanese encephalitis virus
PASIAARG

SEQ ID NO: 212351 - protein, 8 aa, Japanese encephalitis virus
ASIAARGY

SEQ ID NO: 212352 - protein, 8 aa, Japanese encephalitis virus
SIAARGYI

SEQ ID NO: 212353 - protein, 8 aa, Japanese encephalitis virus
IAARGYIA

SEQ ID NO: 212354 - protein, 8 aa, Japanese encephalitis virus
AARGYIAT

SEQ ID NO: 212355 - protein, 8 aa, Japanese encephalitis virus
ARGYIATK

SEQ ID NO: 212356 - protein, 8 aa, Japanese encephalitis virus
RGYIATKV

SEQ ID NO: 212357 - protein, 8 aa, Japanese encephalitis virus
GYIATKVE

SEQ ID NO: 212358 - protein, 8 aa, Japanese encephalitis virus
YIATKVEL

SEQ ID NO: 212359 - protein, 8 aa, Japanese encephalitis virus
IATKVELG

SEQ ID NO: 212360 - protein, 8 aa, Japanese encephalitis virus
ATKVELGE

SEQ ID NO: 212361 - protein, 8 aa, Japanese encephalitis virus
TKVELGEA

SEQ ID NO: 212362 - protein, 8 aa, Japanese encephalitis virus
KVELGEAA

SEQ ID NO: 212363 - protein, 8 aa, Japanese encephalitis virus
VELGEAAA

SEQ ID NO: 212364 - protein, 8 aa, Japanese encephalitis virus
ELGEAAAI

SEQ ID NO: 212365 - protein, 8 aa, Japanese encephalitis virus
LGEAAAIF

SEQ ID NO: 212366 - protein, 8 aa, Japanese encephalitis virus
GEAAAIFM

SEQ ID NO: 212367 - protein, 8 aa, Japanese encephalitis virus
EAAAIFMT

SEQ ID NO: 212368 - protein, 8 aa, Japanese encephalitis virus
AAAIFMTA

SEQ ID NO: 212369 - protein, 8 aa, Japanese encephalitis virus
AAIFMTAT

SEQ ID NO: 212370 - protein, 8 aa, Japanese encephalitis virus
AIFMTATP

SEQ ID NO: 212371 - protein, 8 aa, Japanese encephalitis virus
IFMTATPP

SEQ ID NO: 212372 - protein, 8 aa, Japanese encephalitis virus
FMTATPPG

SEQ ID NO: 212373 - protein, 8 aa, Japanese encephalitis virus
MTATPPGT

SEQ ID NO: 212374 - protein, 8 aa, Japanese encephalitis virus
TATPPGTT

SEQ ID NO: 212375 - protein, 8 aa, Japanese encephalitis virus
ATPPGTTD

SEQ ID NO: 212376 - protein, 8 aa, Japanese encephalitis virus
TPPGTTDP

SEQ ID NO: 212377 - protein, 8 aa, Japanese encephalitis virus
PPGTTDPF

SEQ ID NO: 212378 - protein, 8 aa, Japanese encephalitis virus
PGTTDPFP

SEQ ID NO: 212379 - protein, 8 aa, Japanese encephalitis virus
GTTDPFPD

SEQ ID NO: 212380 - protein, 8 aa, Japanese encephalitis virus
TTDPFPDS

SEQ ID NO: 212381 - protein, 8 aa, Japanese encephalitis virus
TDPFPDSN

SEQ ID NO: 212382 - protein, 8 aa, Japanese encephalitis virus
DPFPDSNA

SEQ ID NO: 212383 - protein, 8 aa, Japanese encephalitis virus
PFPDSNAP

SEQ ID NO: 212384 - protein, 8 aa, Japanese encephalitis virus
FPDSNAPI

SEQ ID NO: 212385 - protein, 8 aa, Japanese encephalitis virus
PDSNAPIH

SEQ ID NO: 212386 - protein, 8 aa, Japanese encephalitis virus
DSNAPIHD

SEQ ID NO: 212387 - protein, 8 aa, Japanese encephalitis virus
SNAPIHDL

SEQ ID NO: 212388 - protein, 8 aa, Japanese encephalitis virus
NAPIHDLQ

SEQ ID NO: 212389 - protein, 8 aa, Japanese encephalitis virus
APIHDLQD

SEQ ID NO: 212390 - protein, 8 aa, Japanese encephalitis virus
PIHDLQDE

SEQ ID NO: 212391 - protein, 8 aa, Japanese encephalitis virus
IHDLQDEI

SEQ ID NO: 212392 - protein, 8 aa, Japanese encephalitis virus
HDLQDEIP

SEQ ID NO: 212393 - protein, 8 aa, Japanese encephalitis virus
DLQDEIPD

SEQ ID NO: 212394 - protein, 8 aa, Japanese encephalitis virus
LQDEIPDR

SEQ ID NO: 212395 - protein, 8 aa, Japanese encephalitis virus
QDEIPDRA

SEQ ID NO: 212396 - protein, 8 aa, Japanese encephalitis virus
DEIPDRAW

SEQ ID NO: 212397 - protein, 8 aa, Japanese encephalitis virus
EIPDRAWS

SEQ ID NO: 212398 - protein, 8 aa, Japanese encephalitis virus
IPDRAWSS

SEQ ID NO: 212399 - protein, 8 aa, Japanese encephalitis virus
PDRAWSSG

SEQ ID NO: 212400 - protein, 8 aa, Japanese encephalitis virus
WITEYAGK

SEQ ID NO: 212401 - protein, 8 aa, Japanese encephalitis virus
ITEYAGKT

SEQ ID NO: 212402 - protein, 8 aa, Japanese encephalitis virus
TEYAGKTV

SEQ ID NO: 212403 - protein, 8 aa, Japanese encephalitis virus
EYAGKTVW

SEQ ID NO: 212404 - protein, 8 aa, Japanese encephalitis virus
YAGKTVWF

SEQ ID NO: 212405 - protein, 8 aa, Japanese encephalitis virus
AGKTVWFV

SEQ ID NO: 212406 - protein, 8 aa, Japanese encephalitis virus
GKTVWFVA

SEQ ID NO: 212407 - protein, 8 aa, Japanese encephalitis virus
KTVWFVAS

SEQ ID NO: 212408 - protein, 8 aa, Japanese encephalitis virus
TVWFVASV

SEQ ID NO: 212409 - protein, 8 aa, Japanese encephalitis virus
VWFVASVK

SEQ ID NO: 212410 - protein, 8 aa, Japanese encephalitis virus
WFVASVKM

SEQ ID NO: 212411 - protein, 8 aa, Japanese encephalitis virus
FVASVKMG

SEQ ID NO: 212412 - protein, 8 aa, Japanese encephalitis virus
VASVKMGN

SEQ ID NO: 212413 - protein, 8 aa, Japanese encephalitis virus
ASVKMGNE

SEQ ID NO: 212414 - protein, 8 aa, Japanese encephalitis virus
SVKMGNEI

SEQ ID NO: 212415 - protein, 8 aa, Japanese encephalitis virus
VKMGNEIA

SEQ ID NO: 212416 - protein, 8 aa, Japanese encephalitis virus
KMGNEIAM

SEQ ID NO: 212417 - protein, 8 aa, Japanese encephalitis virus
MGNEIAMC

SEQ ID NO: 212418 - protein, 8 aa, Japanese encephalitis virus
GNEIAMCL

SEQ ID NO: 212419 - protein, 8 aa, Japanese encephalitis virus
NEIAMCLQ

SEQ ID NO: 212420 - protein, 8 aa, Japanese encephalitis virus
EIAMCLQR

SEQ ID NO: 212421 - protein, 8 aa, Japanese encephalitis virus
IAMCLQRA

SEQ ID NO: 212422 - protein, 8 aa, Japanese encephalitis virus
AMCLQRAG

SEQ ID NO: 212423 - protein, 8 aa, Japanese encephalitis virus
MCLQRAGK

SEQ ID NO: 212424 - protein, 8 aa, Japanese encephalitis virus
CLQRAGKK

SEQ ID NO: 212425 - protein, 8 aa, Japanese encephalitis virus
LQRAGKKV

SEQ ID NO: 212426 - protein, 8 aa, Japanese encephalitis virus
QRAGKKVI

SEQ ID NO: 212427 - protein, 8 aa, Japanese encephalitis virus
RAGKKVIQ

SEQ ID NO: 212428 - protein, 8 aa, Japanese encephalitis virus
AGKKVIQL

SEQ ID NO: 212429 - protein, 8 aa, Japanese encephalitis virus
GKKVIQLN

SEQ ID NO: 212430 - protein, 8 aa, Japanese encephalitis virus
KKVIQLNR

SEQ ID NO: 212431 - protein, 8 aa, Japanese encephalitis virus
KVIQLNRK

SEQ ID NO: 212432 - protein, 8 aa, Japanese encephalitis virus
VIQLNRKS

SEQ ID NO: 212433 - protein, 8 aa, Japanese encephalitis virus
IQLNRKSY

SEQ ID NO: 212434 - protein, 8 aa, Japanese encephalitis virus
QLNRKSYD

SEQ ID NO: 212435 - protein, 8 aa, Japanese encephalitis virus
LNRKSYDT

SEQ ID NO: 212436 - protein, 8 aa, Japanese encephalitis virus
NRKSYDTE

SEQ ID NO: 212437 - protein, 8 aa, Japanese encephalitis virus
RKSYDTEY

SEQ ID NO: 212438 - protein, 8 aa, Japanese encephalitis virus
KSYDTEYP

SEQ ID NO: 212439 - protein, 8 aa, Japanese encephalitis virus
SYDTEYPK

SEQ ID NO: 212440 - protein, 8 aa, Japanese encephalitis virus
YDTEYPKC

SEQ ID NO: 212441 - protein, 8 aa, Japanese encephalitis virus
DTEYPKCK

SEQ ID NO: 212442 - protein, 8 aa, Japanese encephalitis virus
TEYPKCKN

SEQ ID NO: 212443 - protein, 8 aa, Japanese encephalitis virus
EYPKCKNG

SEQ ID NO: 212444 - protein, 8 aa, Japanese encephalitis virus
YPKCKNGD

SEQ ID NO: 212445 - protein, 8 aa, Japanese encephalitis virus
PKCKNGDW

SEQ ID NO: 212446 - protein, 8 aa, Japanese encephalitis virus
KCKNGDWD

SEQ ID NO: 212447 - protein, 8 aa, Japanese encephalitis virus
CKNGDWDF

SEQ ID NO: 212448 - protein, 8 aa, Japanese encephalitis virus
KNGDWDFV

SEQ ID NO: 212449 - protein, 8 aa, Japanese encephalitis virus
NGDWDFVI

SEQ ID NO: 212450 - protein, 8 aa, Japanese encephalitis virus
GDWDFVIT

SEQ ID NO: 212451 - protein, 8 aa, Japanese encephalitis virus
DWDFVITT

SEQ ID NO: 212452 - protein, 8 aa, Japanese encephalitis virus
WDFVITTD

SEQ ID NO: 212453 - protein, 8 aa, Japanese encephalitis virus
DFVITTDI

SEQ ID NO: 212454 - protein, 8 aa, Japanese encephalitis virus
FVITTDIS

SEQ ID NO: 212455 - protein, 8 aa, Japanese encephalitis virus
VITTDISE

SEQ ID NO: 212456 - protein, 8 aa, Japanese encephalitis virus
ITTDISEM

SEQ ID NO: 212457 - protein, 8 aa, Japanese encephalitis virus
TTDISEMG

SEQ ID NO: 212458 - protein, 8 aa, Japanese encephalitis virus
TDISEMGA

SEQ ID NO: 212459 - protein, 8 aa, Japanese encephalitis virus
DISEMGAN

SEQ ID NO: 212460 - protein, 8 aa, Japanese encephalitis virus
ISEMGANF

SEQ ID NO: 212461 - protein, 8 aa, Japanese encephalitis virus
SEMGANFG

SEQ ID NO: 212462 - protein, 8 aa, Japanese encephalitis virus
EMGANFGA

SEQ ID NO: 212463 - protein, 8 aa, Japanese encephalitis virus
MGANFGAS

SEQ ID NO: 212464 - protein, 8 aa, Japanese encephalitis virus
GANFGASR

SEQ ID NO: 212465 - protein, 8 aa, Japanese encephalitis virus
ANFGASRV

SEQ ID NO: 212466 - protein, 8 aa, Japanese encephalitis virus
NFGASRVI

SEQ ID NO: 212467 - protein, 8 aa, Japanese encephalitis virus
FGASRVID

SEQ ID NO: 212468 - protein, 8 aa, Japanese encephalitis virus
GASRVIDC

SEQ ID NO: 212469 - protein, 8 aa, Japanese encephalitis virus
ASRVIDCR

SEQ ID NO: 212470 - protein, 8 aa, Japanese encephalitis virus
SRVIDCRK

SEQ ID NO: 212471 - protein, 8 aa, Japanese encephalitis virus
RVIDCRKS

SEQ ID NO: 212472 - protein, 8 aa, Japanese encephalitis virus
VIDCRKSV

SEQ ID NO: 212473 - protein, 8 aa, Japanese encephalitis virus
IDCRKSVK

SEQ ID NO: 212474 - protein, 8 aa, Japanese encephalitis virus
DCRKSVKP

SEQ ID NO: 212475 - protein, 8 aa, Japanese encephalitis virus
CRKSVKPT

SEQ ID NO: 212476 - protein, 8 aa, Japanese encephalitis virus
RKSVKPTI

SEQ ID NO: 212477 - protein, 8 aa, Japanese encephalitis virus
KSVKPTIL

SEQ ID NO: 212478 - protein, 8 aa, Japanese encephalitis virus
SVKPTILE

SEQ ID NO: 212479 - protein, 8 aa, Japanese encephalitis virus
VKPTILEE

SEQ ID NO: 212480 - protein, 8 aa, Japanese encephalitis virus
KPTILEEG

SEQ ID NO: 212481 - protein, 8 aa, Japanese encephalitis virus
PTILEEGE

SEQ ID NO: 212482 - protein, 8 aa, Japanese encephalitis virus
TILEEGEG

SEQ ID NO: 212483 - protein, 8 aa, Japanese encephalitis virus
ILEEGEGR

SEQ ID NO: 212484 - protein, 8 aa, Japanese encephalitis virus
LEEGEGRV

SEQ ID NO: 212485 - protein, 8 aa, Japanese encephalitis virus
EEGEGRVI

SEQ ID NO: 212486 - protein, 8 aa, Japanese encephalitis virus
EGEGRVIL

SEQ ID NO: 212487 - protein, 8 aa, Japanese encephalitis virus
GEGRVILG

SEQ ID NO: 212488 - protein, 8 aa, Japanese encephalitis virus
EGRVILGN

SEQ ID NO: 212489 - protein, 8 aa, Japanese encephalitis virus
GRVILGNP

SEQ ID NO: 212490 - protein, 8 aa, Japanese encephalitis virus
RVILGNPS

SEQ ID NO: 212491 - protein, 8 aa, Japanese encephalitis virus
VILGNPSP

SEQ ID NO: 212492 - protein, 8 aa, Japanese encephalitis virus
ILGNPSPI

SEQ ID NO: 212493 - protein, 8 aa, Japanese encephalitis virus
LGNPSPIT

SEQ ID NO: 212494 - protein, 8 aa, Japanese encephalitis virus
GNPSPITS

SEQ ID NO: 212495 - protein, 8 aa, Japanese encephalitis virus
NPSPITSA

SEQ ID NO: 212496 - protein, 8 aa, Japanese encephalitis virus
PSPITSAS

SEQ ID NO: 212497 - protein, 8 aa, Japanese encephalitis virus
SPITSASA

SEQ ID NO: 212498 - protein, 8 aa, Japanese encephalitis virus
PITSASAA

SEQ ID NO: 212499 - protein, 8 aa, Japanese encephalitis virus
ITSASAAQ

SEQ ID NO: 212500 - protein, 8 aa, Japanese encephalitis virus
TSASAAQR

SEQ ID NO: 212501 - protein, 8 aa, Japanese encephalitis virus
SASAAQRR

SEQ ID NO: 212502 - protein, 8 aa, Japanese encephalitis virus
ASAAQRRG

SEQ ID NO: 212503 - protein, 8 aa, Japanese encephalitis virus
SAAQRRGR

SEQ ID NO: 212504 - protein, 8 aa, Japanese encephalitis virus
AAQRRGRV

SEQ ID NO: 212505 - protein, 8 aa, Japanese encephalitis virus
AQRRGRVG

SEQ ID NO: 212506 - protein, 8 aa, Japanese encephalitis virus
QRRGRVGR

SEQ ID NO: 212507 - protein, 8 aa, Japanese encephalitis virus
RRGRVGRN

SEQ ID NO: 212508 - protein, 8 aa, Japanese encephalitis virus
RGRVGRNP

SEQ ID NO: 212509 - protein, 8 aa, Japanese encephalitis virus
GRVGRNPN

SEQ ID NO: 212510 - protein, 8 aa, Japanese encephalitis virus
RVGRNPNQ

SEQ ID NO: 212511 - protein, 8 aa, Japanese encephalitis virus
VGRNPNQV

SEQ ID NO: 212512 - protein, 8 aa, Japanese encephalitis virus
GRNPNQVG

SEQ ID NO: 212513 - protein, 8 aa, Japanese encephalitis virus
RNPNQVGD

SEQ ID NO: 212514 - protein, 8 aa, Japanese encephalitis virus
NPNQVGDE

SEQ ID NO: 212515 - protein, 8 aa, Japanese encephalitis virus
PNQVGDEY

SEQ ID NO: 212516 - protein, 8 aa, Japanese encephalitis virus
NQVGDEYH

SEQ ID NO: 212517 - protein, 8 aa, Japanese encephalitis virus
QVGDEYHY

SEQ ID NO: 212518 - protein, 8 aa, Japanese encephalitis virus
VGDEYHYG

SEQ ID NO: 212519 - protein, 8 aa, Japanese encephalitis virus
GDEYHYGG

SEQ ID NO: 212520 - protein, 8 aa, Japanese encephalitis virus
DEYHYGGA

SEQ ID NO: 212521 - protein, 8 aa, Japanese encephalitis virus
EYHYGGAT

SEQ ID NO: 212522 - protein, 8 aa, Japanese encephalitis virus
YHYGGATS

SEQ ID NO: 212523 - protein, 8 aa, Japanese encephalitis virus
HYGGATSE

SEQ ID NO: 212524 - protein, 8 aa, Japanese encephalitis virus
YGGATSED

SEQ ID NO: 212525 - protein, 8 aa, Japanese encephalitis virus
GGATSEDD

SEQ ID NO: 212526 - protein, 8 aa, Japanese encephalitis virus
GATSEDDS

SEQ ID NO: 212527 - protein, 8 aa, Japanese encephalitis virus
ATSEDDSN

SEQ ID NO: 212528 - protein, 8 aa, Japanese encephalitis virus
TSEDDSNL

SEQ ID NO: 212529 - protein, 8 aa, Japanese encephalitis virus
SEDDSNLA

SEQ ID NO: 212530 - protein, 8 aa, Japanese encephalitis virus
EDDSNLAH

SEQ ID NO: 212531 - protein, 8 aa, Japanese encephalitis virus
DDSNLAHW

SEQ ID NO: 212532 - protein, 8 aa, Japanese encephalitis virus
DSNLAHWT

SEQ ID NO: 212533 - protein, 8 aa, Japanese encephalitis virus
SNLAHWTE

SEQ ID NO: 212534 - protein, 8 aa, Japanese encephalitis virus
NLAHWTEA

SEQ ID NO: 212535 - protein, 8 aa, Japanese encephalitis virus
LAHWTEAK

SEQ ID NO: 212536 - protein, 8 aa, Japanese encephalitis virus
AHWTEAKI

SEQ ID NO: 212537 - protein, 8 aa, Japanese encephalitis virus
HWTEAKIM

SEQ ID NO: 212538 - protein, 8 aa, Japanese encephalitis virus
WTEAKIML

SEQ ID NO: 212539 - protein, 8 aa, Japanese encephalitis virus
TEAKIMLD

SEQ ID NO: 212540 - protein, 8 aa, Japanese encephalitis virus
EAKIMLDN

SEQ ID NO: 212541 - protein, 8 aa, Japanese encephalitis virus
AKIMLDNI

SEQ ID NO: 212542 - protein, 8 aa, Japanese encephalitis virus
KIMLDNIH

SEQ ID NO: 212543 - protein, 8 aa, Japanese encephalitis virus
IMLDNIHM

SEQ ID NO: 212544 - protein, 8 aa, Japanese encephalitis virus
MLDNIHMP

SEQ ID NO: 212545 - protein, 8 aa, Japanese encephalitis virus
LDNIHMPN

SEQ ID NO: 212546 - protein, 8 aa, Japanese encephalitis virus
DNIHMPNG

SEQ ID NO: 212547 - protein, 8 aa, Japanese encephalitis virus
NIHMPNGL

SEQ ID NO: 212548 - protein, 8 aa, Japanese encephalitis virus
IHMPNGLV

SEQ ID NO: 212549 - protein, 8 aa, Japanese encephalitis virus
HMPNGLVA

SEQ ID NO: 212550 - protein, 8 aa, Japanese encephalitis virus
MPNGLVAQ

SEQ ID NO: 212551 - protein, 8 aa, Japanese encephalitis virus
PNGLVAQL

SEQ ID NO: 212552 - protein, 8 aa, Japanese encephalitis virus
NGLVAQLY

SEQ ID NO: 212553 - protein, 8 aa, Japanese encephalitis virus
GLVAQLYG

SEQ ID NO: 212554 - protein, 8 aa, Japanese encephalitis virus
LVAQLYGP

SEQ ID NO: 212555 - protein, 8 aa, Japanese encephalitis virus
VAQLYGPE

SEQ ID NO: 212556 - protein, 8 aa, Japanese encephalitis virus
AQLYGPER

SEQ ID NO: 212557 - protein, 8 aa, Japanese encephalitis virus
QLYGPERE

SEQ ID NO: 212558 - protein, 8 aa, Japanese encephalitis virus
LYGPEREK

SEQ ID NO: 212559 - protein, 8 aa, Japanese encephalitis virus
YGPEREKA

SEQ ID NO: 212560 - protein, 8 aa, Japanese encephalitis virus
GPEREKAF

SEQ ID NO: 212561 - protein, 8 aa, Japanese encephalitis virus
PEREKAFT

SEQ ID NO: 212562 - protein, 8 aa, Japanese encephalitis virus
EREKAFTM

SEQ ID NO: 212563 - protein, 8 aa, Japanese encephalitis virus
REKAFTMD

SEQ ID NO: 212564 - protein, 8 aa, Japanese encephalitis virus
EKAFTMDG

SEQ ID NO: 212565 - protein, 8 aa, Japanese encephalitis virus
KAFTMDGE

SEQ ID NO: 212566 - protein, 8 aa, Japanese encephalitis virus
AFTMDGEY

SEQ ID NO: 212567 - protein, 8 aa, Japanese encephalitis virus
FTMDGEYR

SEQ ID NO: 212568 - protein, 8 aa, Japanese encephalitis virus
TMDGEYRL

SEQ ID NO: 212569 - protein, 8 aa, Japanese encephalitis virus
MDGEYRLR

SEQ ID NO: 212570 - protein, 8 aa, Japanese encephalitis virus
DGEYRLRG

SEQ ID NO: 212571 - protein, 8 aa, Japanese encephalitis virus
GEYRLRGE

SEQ ID NO: 212572 - protein, 8 aa, Japanese encephalitis virus
EYRLRGEE

SEQ ID NO: 212573 - protein, 8 aa, Japanese encephalitis virus
YRLRGEEK

SEQ ID NO: 212574 - protein, 8 aa, Japanese encephalitis virus
RLRGEEKK

SEQ ID NO: 212575 - protein, 8 aa, Japanese encephalitis virus
LRGEEKKN

SEQ ID NO: 212576 - protein, 8 aa, Japanese encephalitis virus
RGEEKKNF

SEQ ID NO: 212577 - protein, 8 aa, Japanese encephalitis virus
GEEKKNFL

SEQ ID NO: 212578 - protein, 8 aa, Japanese encephalitis virus
EEKKNFLE

SEQ ID NO: 212579 - protein, 8 aa, Japanese encephalitis virus
EKKNFLEL

SEQ ID NO: 212580 - protein, 8 aa, Japanese encephalitis virus
KKNFLELL

SEQ ID NO: 212581 - protein, 8 aa, Japanese encephalitis virus
KNFLELLR

SEQ ID NO: 212582 - protein, 8 aa, Japanese encephalitis virus
NFLELLRT

SEQ ID NO: 212583 - protein, 8 aa, Japanese encephalitis virus
FLELLRTA

SEQ ID NO: 212584 - protein, 8 aa, Japanese encephalitis virus
LELLRTAD

SEQ ID NO: 212585 - protein, 8 aa, Japanese encephalitis virus
ELLRTADL

SEQ ID NO: 212586 - protein, 8 aa, Japanese encephalitis virus
LLRTADLP

SEQ ID NO: 212587 - protein, 8 aa, Japanese encephalitis virus
LRTADLPV

SEQ ID NO: 212588 - protein, 8 aa, Japanese encephalitis virus
RTADLPVW

SEQ ID NO: 212589 - protein, 8 aa, Japanese encephalitis virus
TADLPVWL

SEQ ID NO: 212590 - protein, 8 aa, Japanese encephalitis virus
ADLPVWLA

SEQ ID NO: 212591 - protein, 8 aa, Japanese encephalitis virus
DLPVWLAY

SEQ ID NO: 212592 - protein, 8 aa, Japanese encephalitis virus
LPVWLAYK

SEQ ID NO: 212593 - protein, 8 aa, Japanese encephalitis virus
PVWLAYKV

SEQ ID NO: 212594 - protein, 8 aa, Japanese encephalitis virus
VWLAYKVA

SEQ ID NO: 212595 - protein, 8 aa, Japanese encephalitis virus
WLAYKVAS

SEQ ID NO: 212596 - protein, 8 aa, Japanese encephalitis virus
LAYKVASN

SEQ ID NO: 212597 - protein, 8 aa, Japanese encephalitis virus
AYKVASNG

SEQ ID NO: 212598 - protein, 8 aa, Japanese encephalitis virus
YKVASNGI

SEQ ID NO: 212599 - protein, 8 aa, Japanese encephalitis virus
KVASNGIQ

SEQ ID NO: 212600 - protein, 8 aa, Japanese encephalitis virus
VASNGIQY

SEQ ID NO: 212601 - protein, 8 aa, Japanese encephalitis virus
ASNGIQYT

SEQ ID NO: 212602 - protein, 8 aa, Japanese encephalitis virus
SNGIQYTD

SEQ ID NO: 212603 - protein, 8 aa, Japanese encephalitis virus
NGIQYTDR

SEQ ID NO: 212604 - protein, 8 aa, Japanese encephalitis virus
GIQYTDRK

SEQ ID NO: 212605 - protein, 8 aa, Japanese encephalitis virus
IQYTDRKW

SEQ ID NO: 212606 - protein, 8 aa, Japanese encephalitis virus
QYTDRKWC

SEQ ID NO: 212607 - protein, 8 aa, Japanese encephalitis virus
YTDRKWCF

SEQ ID NO: 212608 - protein, 8 aa, Japanese encephalitis virus
TDRKWCFD

SEQ ID NO: 212609 - protein, 8 aa, Japanese encephalitis virus
DRKWCFDG

SEQ ID NO: 212610 - protein, 8 aa, Japanese encephalitis virus
RKWCFDGP

SEQ ID NO: 212611 - protein, 8 aa, Japanese encephalitis virus
KWCFDGPR

SEQ ID NO: 212612 - protein, 8 aa, Japanese encephalitis virus
WCFDGPRT

SEQ ID NO: 212613 - protein, 8 aa, Japanese encephalitis virus
CFDGPRTN

SEQ ID NO: 212614 - protein, 8 aa, Japanese encephalitis virus
FDGPRTNA

SEQ ID NO: 212615 - protein, 8 aa, Japanese encephalitis virus
DGPRTNAI

SEQ ID NO: 212616 - protein, 8 aa, Japanese encephalitis virus
GPRTNAIL

SEQ ID NO: 212617 - protein, 8 aa, Japanese encephalitis virus
PRTNAILE

SEQ ID NO: 212618 - protein, 8 aa, Japanese encephalitis virus
RTNAILED

SEQ ID NO: 212619 - protein, 8 aa, Japanese encephalitis virus
TNAILEDN

SEQ ID NO: 212620 - protein, 8 aa, Japanese encephalitis virus
NAILEDNT

SEQ ID NO: 212621 - protein, 8 aa, Japanese encephalitis virus
AILEDNTE

SEQ ID NO: 212622 - protein, 8 aa, Japanese encephalitis virus
ILEDNTEV

SEQ ID NO: 212623 - protein, 8 aa, Japanese encephalitis virus
LEDNTEVE

SEQ ID NO: 212624 - protein, 8 aa, Japanese encephalitis virus
EDNTEVEI

SEQ ID NO: 212625 - protein, 8 aa, Japanese encephalitis virus
DNTEVEIV

SEQ ID NO: 212626 - protein, 8 aa, Japanese encephalitis virus
NTEVEIVT

SEQ ID NO: 212627 - protein, 8 aa, Japanese encephalitis virus
TEVEIVTR

SEQ ID NO: 212628 - protein, 8 aa, Japanese encephalitis virus
EVEIVTRM

SEQ ID NO: 212629 - protein, 8 aa, Japanese encephalitis virus
VEIVTRMG

SEQ ID NO: 212630 - protein, 8 aa, Japanese encephalitis virus
EIVTRMGE

SEQ ID NO: 212631 - protein, 8 aa, Japanese encephalitis virus
IVTRMGER

SEQ ID NO: 212632 - protein, 8 aa, Japanese encephalitis virus
VTRMGERK

SEQ ID NO: 212633 - protein, 8 aa, Japanese encephalitis virus
TRMGERKI

SEQ ID NO: 212634 - protein, 8 aa, Japanese encephalitis virus
RMGERKIL

SEQ ID NO: 212635 - protein, 8 aa, Japanese encephalitis virus
MGERKILK

SEQ ID NO: 212636 - protein, 8 aa, Japanese encephalitis virus
GERKILKP

SEQ ID NO: 212637 - protein, 8 aa, Japanese encephalitis virus
ERKILKPR

SEQ ID NO: 212638 - protein, 8 aa, Japanese encephalitis virus
RKILKPRW

SEQ ID NO: 212639 - protein, 8 aa, Japanese encephalitis virus
KILKPRWL

SEQ ID NO: 212640 - protein, 8 aa, Japanese encephalitis virus
ILKPRWLD

SEQ ID NO: 212641 - protein, 8 aa, Japanese encephalitis virus
LKPRWLDA

SEQ ID NO: 212642 - protein, 8 aa, Japanese encephalitis virus
KPRWLDAR

SEQ ID NO: 212643 - protein, 8 aa, Japanese encephalitis virus
PRWLDARV

SEQ ID NO: 212644 - protein, 8 aa, Japanese encephalitis virus
RWLDARVY

SEQ ID NO: 212645 - protein, 8 aa, Japanese encephalitis virus
WLDARVYA

SEQ ID NO: 212646 - protein, 8 aa, Japanese encephalitis virus
LDARVYAD

SEQ ID NO: 212647 - protein, 8 aa, Japanese encephalitis virus
DARVYADH

SEQ ID NO: 212648 - protein, 8 aa, Japanese encephalitis virus
ARVYADHQ

SEQ ID NO: 212649 - protein, 8 aa, Japanese encephalitis virus
RVYADHQA

SEQ ID NO: 212650 - protein, 8 aa, Japanese encephalitis virus
VYADHQAL

SEQ ID NO: 212651 - protein, 8 aa, Japanese encephalitis virus
YADHQALK

SEQ ID NO: 212652 - protein, 8 aa, Japanese encephalitis virus
ADHQALKW

SEQ ID NO: 212653 - protein, 8 aa, Japanese encephalitis virus
DHQALKWF

SEQ ID NO: 212654 - protein, 8 aa, Japanese encephalitis virus
HQALKWFK

SEQ ID NO: 212655 - protein, 8 aa, Japanese encephalitis virus
QALKWFKD

SEQ ID NO: 212656 - protein, 8 aa, Japanese encephalitis virus
ALKWFKDF

SEQ ID NO: 212657 - protein, 8 aa, Japanese encephalitis virus
LKWFKDFA

SEQ ID NO: 212658 - protein, 8 aa, Japanese encephalitis virus
KWFKDFAA

SEQ ID NO: 212659 - protein, 8 aa, Japanese encephalitis virus
WFKDFAAG

SEQ ID NO: 212660 - protein, 8 aa, Japanese encephalitis virus
FKDFAAGK

SEQ ID NO: 212661 - protein, 8 aa, Japanese encephalitis virus
KDFAAGKR

SEQ ID NO: 212662 - protein, 8 aa, Japanese encephalitis virus
DFAAGKRS

SEQ ID NO: 212663 - protein, 8 aa, Japanese encephalitis virus
FAAGKRSA

SEQ ID NO: 212664 - protein, 8 aa, Japanese encephalitis virus
AAGKRSAV

SEQ ID NO: 212665 - protein, 8 aa, Japanese encephalitis virus
AGKRSAVS

SEQ ID NO: 212666 - protein, 8 aa, Japanese encephalitis virus
GKRSAVSF

SEQ ID NO: 212667 - protein, 8 aa, Japanese encephalitis virus
KRSAVSFI

SEQ ID NO: 212668 - protein, 8 aa, Japanese encephalitis virus
RSAVSFIE

SEQ ID NO: 212669 - protein, 8 aa, Japanese encephalitis virus
SAVSFIEV

SEQ ID NO: 212670 - protein, 8 aa, Japanese encephalitis virus
AVSFIEVL

SEQ ID NO: 212671 - protein, 8 aa, Japanese encephalitis virus
VSFIEVLG

SEQ ID NO: 212672 - protein, 8 aa, Japanese encephalitis virus
SFIEVLGR

SEQ ID NO: 212673 - protein, 8 aa, Japanese encephalitis virus
FIEVLGRM

SEQ ID NO: 212674 - protein, 8 aa, Japanese encephalitis virus
IEVLGRMP

SEQ ID NO: 212675 - protein, 8 aa, Japanese encephalitis virus
EVLGRMPE

SEQ ID NO: 212676 - protein, 8 aa, Japanese encephalitis virus
VLGRMPEH

SEQ ID NO: 212677 - protein, 8 aa, Japanese encephalitis virus
LGRMPEHF

SEQ ID NO: 212678 - protein, 8 aa, Japanese encephalitis virus
GRMPEHFM

SEQ ID NO: 212679 - protein, 8 aa, Japanese encephalitis virus
RMPEHFMG

SEQ ID NO: 212680 - protein, 8 aa, Japanese encephalitis virus
MPEHFMGK

SEQ ID NO: 212681 - protein, 8 aa, Japanese encephalitis virus
PEHFMGKT

SEQ ID NO: 212682 - protein, 8 aa, Japanese encephalitis virus
EHFMGKTR

SEQ ID NO: 212683 - protein, 8 aa, Japanese encephalitis virus
HFMGKTRE

SEQ ID NO: 212684 - protein, 8 aa, Japanese encephalitis virus
FMGKTREA

SEQ ID NO: 212685 - protein, 8 aa, Japanese encephalitis virus
MGKTREAL

SEQ ID NO: 212686 - protein, 8 aa, Japanese encephalitis virus
GKTREALD

SEQ ID NO: 212687 - protein, 8 aa, Japanese encephalitis virus
KTREALDT

SEQ ID NO: 212688 - protein, 8 aa, Japanese encephalitis virus
TREALDTM

SEQ ID NO: 212689 - protein, 8 aa, Japanese encephalitis virus
REALDTMY

SEQ ID NO: 212690 - protein, 8 aa, Japanese encephalitis virus
EALDTMYL

SEQ ID NO: 212691 - protein, 8 aa, Japanese encephalitis virus
ALDTMYLV

SEQ ID NO: 212692 - protein, 8 aa, Japanese encephalitis virus
LDTMYLVA

SEQ ID NO: 212693 - protein, 8 aa, Japanese encephalitis virus
DTMYLVAT

SEQ ID NO: 212694 - protein, 8 aa, Japanese encephalitis virus
TMYLVATA

SEQ ID NO: 212695 - protein, 8 aa, Japanese encephalitis virus
MYLVATAE

SEQ ID NO: 212696 - protein, 8 aa, Japanese encephalitis virus
YLVATAEK

SEQ ID NO: 212697 - protein, 8 aa, Japanese encephalitis virus
LVATAEKG

SEQ ID NO: 212698 - protein, 8 aa, Japanese encephalitis virus
VATAEKGG

SEQ ID NO: 212699 - protein, 8 aa, Japanese encephalitis virus
ATAEKGGK

SEQ ID NO: 212700 - protein, 8 aa, Japanese encephalitis virus
TAEKGGKA

SEQ ID NO: 212701 - protein, 8 aa, Japanese encephalitis virus
AEKGGKAH

SEQ ID NO: 212702 - protein, 8 aa, Japanese encephalitis virus
EKGGKAHR

SEQ ID NO: 212703 - protein, 8 aa, Japanese encephalitis virus
KGGKAHRM

SEQ ID NO: 212704 - protein, 8 aa, Japanese encephalitis virus
GGKAHRMA

SEQ ID NO: 212705 - protein, 8 aa, Japanese encephalitis virus
GKAHRMAL

SEQ ID NO: 212706 - protein, 8 aa, Japanese encephalitis virus
KAHRMALE

SEQ ID NO: 212707 - protein, 8 aa, Japanese encephalitis virus
AHRMALEE

SEQ ID NO: 212708 - protein, 8 aa, Japanese encephalitis virus
HRMALEEL

SEQ ID NO: 212709 - protein, 8 aa, Japanese encephalitis virus
RMALEELP

SEQ ID NO: 212710 - protein, 8 aa, Japanese encephalitis virus
MALEELPD

SEQ ID NO: 212711 - protein, 8 aa, Japanese encephalitis virus
ALEELPDA

SEQ ID NO: 212712 - protein, 8 aa, Japanese encephalitis virus
LEELPDAL

SEQ ID NO: 212713 - protein, 8 aa, Japanese encephalitis virus
EELPDALE

SEQ ID NO: 212714 - protein, 8 aa, Japanese encephalitis virus
ELPDALET

SEQ ID NO: 212715 - protein, 8 aa, Japanese encephalitis virus
LPDALETI

SEQ ID NO: 212716 - protein, 8 aa, Japanese encephalitis virus
PDALETIT

SEQ ID NO: 212717 - protein, 8 aa, Japanese encephalitis virus
DALETITL

SEQ ID NO: 212718 - protein, 8 aa, Japanese encephalitis virus
ALETITLI

SEQ ID NO: 212719 - protein, 8 aa, Japanese encephalitis virus
LETITLIV

SEQ ID NO: 212720 - protein, 8 aa, Japanese encephalitis virus
ETITLIVA

SEQ ID NO: 212721 - protein, 8 aa, Japanese encephalitis virus
TITLIVAI

SEQ ID NO: 212722 - protein, 8 aa, Japanese encephalitis virus
AITVMTGG

SEQ ID NO: 212723 - protein, 8 aa, Japanese encephalitis virus
ITVMTGGF

SEQ ID NO: 212724 - protein, 8 aa, Japanese encephalitis virus
TVMTGGFF

SEQ ID NO: 212725 - protein, 8 aa, Japanese encephalitis virus
VMTGGFFL

SEQ ID NO: 212726 - protein, 8 aa, Japanese encephalitis virus
MTGGFFLL

SEQ ID NO: 212727 - protein, 8 aa, Japanese encephalitis virus
TGGFFLLM

SEQ ID NO: 212728 - protein, 8 aa, Japanese encephalitis virus
GGFFLLMM

SEQ ID NO: 212729 - protein, 8 aa, Japanese encephalitis virus
GFFLLMMQ

SEQ ID NO: 212730 - protein, 8 aa, Japanese encephalitis virus
FFLLMMQR

SEQ ID NO: 212731 - protein, 8 aa, Japanese encephalitis virus
FLLMMQRK

SEQ ID NO: 212732 - protein, 8 aa, Japanese encephalitis virus
LLMMQRKG

SEQ ID NO: 212733 - protein, 8 aa, Japanese encephalitis virus
LMMQRKGI

SEQ ID NO: 212734 - protein, 8 aa, Japanese encephalitis virus
MMQRKGIG

SEQ ID NO: 212735 - protein, 8 aa, Japanese encephalitis virus
MQRKGIGK

SEQ ID NO: 212736 - protein, 8 aa, Japanese encephalitis virus
QRKGIGKM

SEQ ID NO: 212737 - protein, 8 aa, Japanese encephalitis virus
RKGIGKMG

SEQ ID NO: 212738 - protein, 8 aa, Japanese encephalitis virus
KGIGKMGL

SEQ ID NO: 212739 - protein, 8 aa, Japanese encephalitis virus
GIGKMGLG

SEQ ID NO: 212740 - protein, 8 aa, Japanese encephalitis virus
IGKMGLGA

SEQ ID NO: 212741 - protein, 8 aa, Japanese encephalitis virus
GKMGLGAL

SEQ ID NO: 212742 - protein, 8 aa, Japanese encephalitis virus
KMGLGALV

SEQ ID NO: 212743 - protein, 8 aa, Japanese encephalitis virus
MGLGALVL

SEQ ID NO: 212744 - protein, 8 aa, Japanese encephalitis virus
GLGALVLT

SEQ ID NO: 212745 - protein, 8 aa, Japanese encephalitis virus
LGALVLTL

SEQ ID NO: 212746 - protein, 8 aa, Japanese encephalitis virus
GALVLTLA

SEQ ID NO: 212747 - protein, 8 aa, Japanese encephalitis virus
ALVLTLAT

SEQ ID NO: 212748 - protein, 8 aa, Japanese encephalitis virus
LVLTLATF

SEQ ID NO: 212749 - protein, 8 aa, Japanese encephalitis virus
VLTLATFF

SEQ ID NO: 212750 - protein, 8 aa, Japanese encephalitis virus
LTLATFFL

SEQ ID NO: 212751 - protein, 8 aa, Japanese encephalitis virus
TLATFFLW

SEQ ID NO: 212752 - protein, 8 aa, Japanese encephalitis virus
LATFFLWA

SEQ ID NO: 212753 - protein, 8 aa, Japanese encephalitis virus
ATFFLWAA

SEQ ID NO: 212754 - protein, 8 aa, Japanese encephalitis virus
TFFLWAAE

SEQ ID NO: 212755 - protein, 8 aa, Japanese encephalitis virus
FFLWAAEV

SEQ ID NO: 212756 - protein, 8 aa, Japanese encephalitis virus
FLWAAEVP

SEQ ID NO: 212757 - protein, 8 aa, Japanese encephalitis virus
LWAAEVPG

SEQ ID NO: 212758 - protein, 8 aa, Japanese encephalitis virus
WAAEVPGT

SEQ ID NO: 212759 - protein, 8 aa, Japanese encephalitis virus
AAEVPGTK

SEQ ID NO: 212760 - protein, 8 aa, Japanese encephalitis virus
AEVPGTKI

SEQ ID NO: 212761 - protein, 8 aa, Japanese encephalitis virus
EVPGTKIA

SEQ ID NO: 212762 - protein, 8 aa, Japanese encephalitis virus
VPGTKIAG

SEQ ID NO: 212763 - protein, 8 aa, Japanese encephalitis virus
PGTKIAGT

SEQ ID NO: 212764 - protein, 8 aa, Japanese encephalitis virus
GTKIAGTL

SEQ ID NO: 212765 - protein, 8 aa, Japanese encephalitis virus
TKIAGTLL

SEQ ID NO: 212766 - protein, 8 aa, Japanese encephalitis virus
KIAGTLLI

SEQ ID NO: 212767 - protein, 8 aa, Japanese encephalitis virus
IAGTLLIA

SEQ ID NO: 212768 - protein, 8 aa, Japanese encephalitis virus
AGTLLIAL

SEQ ID NO: 212769 - protein, 8 aa, Japanese encephalitis virus
GTLLIALL

SEQ ID NO: 212770 - protein, 8 aa, Japanese encephalitis virus
TLLIALLL

SEQ ID NO: 212771 - protein, 8 aa, Japanese encephalitis virus
LLIALLLM

SEQ ID NO: 212772 - protein, 8 aa, Japanese encephalitis virus
LIALLLMV

SEQ ID NO: 212773 - protein, 8 aa, Japanese encephalitis virus
IALLLMVV

SEQ ID NO: 212774 - protein, 8 aa, Japanese encephalitis virus
ALLLMVVL

SEQ ID NO: 212775 - protein, 8 aa, Japanese encephalitis virus
LLLMVVLI

SEQ ID NO: 212776 - protein, 8 aa, Japanese encephalitis virus
LLMVVLIP

SEQ ID NO: 212777 - protein, 8 aa, Japanese encephalitis virus
LMVVLIPE

SEQ ID NO: 212778 - protein, 8 aa, Japanese encephalitis virus
MVVLIPEP

SEQ ID NO: 212779 - protein, 8 aa, Japanese encephalitis virus
VVLIPEPE

SEQ ID NO: 212780 - protein, 8 aa, Japanese encephalitis virus
VLIPEPEK

SEQ ID NO: 212781 - protein, 8 aa, Japanese encephalitis virus
LIPEPEKQ

SEQ ID NO: 212782 - protein, 8 aa, Japanese encephalitis virus
IPEPEKQR

SEQ ID NO: 212783 - protein, 8 aa, Japanese encephalitis virus
PEPEKQRS

SEQ ID NO: 212784 - protein, 8 aa, Japanese encephalitis virus
EPEKQRSQ

SEQ ID NO: 212785 - protein, 8 aa, Japanese encephalitis virus
PEKQRSQT

SEQ ID NO: 212786 - protein, 8 aa, Japanese encephalitis virus
EKQRSQTD

SEQ ID NO: 212787 - protein, 8 aa, Japanese encephalitis virus
KQRSQTDN

SEQ ID NO: 212788 - protein, 8 aa, Japanese encephalitis virus
QRSQTDNQ

SEQ ID NO: 212789 - protein, 8 aa, Japanese encephalitis virus
RSQTDNQL

SEQ ID NO: 212790 - protein, 8 aa, Japanese encephalitis virus
SQTDNQLA

SEQ ID NO: 212791 - protein, 8 aa, Japanese encephalitis virus
QTDNQLAV

SEQ ID NO: 212792 - protein, 8 aa, Japanese encephalitis virus
TDNQLAVF

SEQ ID NO: 212793 - protein, 8 aa, Japanese encephalitis virus
DNQLAVFL

SEQ ID NO: 212794 - protein, 8 aa, Japanese encephalitis virus
NQLAVFLI

SEQ ID NO: 212795 - protein, 8 aa, Japanese encephalitis virus
QLAVFLIC

SEQ ID NO: 212796 - protein, 8 aa, Japanese encephalitis virus
LAVFLICV

SEQ ID NO: 212797 - protein, 8 aa, Japanese encephalitis virus
AVFLICVL

SEQ ID NO: 212798 - protein, 8 aa, Japanese encephalitis virus
VFLICVLT

SEQ ID NO: 212799 - protein, 8 aa, Japanese encephalitis virus
FLICVLTV

SEQ ID NO: 212800 - protein, 8 aa, Japanese encephalitis virus
LICVLTVV

SEQ ID NO: 212801 - protein, 8 aa, Japanese encephalitis virus
ICVLTVVG

SEQ ID NO: 212802 - protein, 8 aa, Japanese encephalitis virus
CVLTVVGV

SEQ ID NO: 212803 - protein, 8 aa, Japanese encephalitis virus
VLTVVGVV

SEQ ID NO: 212804 - protein, 8 aa, Japanese encephalitis virus
LTVVGVVA

SEQ ID NO: 212805 - protein, 8 aa, Japanese encephalitis virus
TVVGVVAA

SEQ ID NO: 212806 - protein, 8 aa, Japanese encephalitis virus
VVGVVAAN

SEQ ID NO: 212807 - protein, 8 aa, Japanese encephalitis virus
VGVVAANE

SEQ ID NO: 212808 - protein, 8 aa, Japanese encephalitis virus
GVVAANEY

SEQ ID NO: 212809 - protein, 8 aa, Japanese encephalitis virus
VVAANEYG

SEQ ID NO: 212810 - protein, 8 aa, Japanese encephalitis virus
VAANEYGM

SEQ ID NO: 212811 - protein, 8 aa, Japanese encephalitis virus
AANEYGML

SEQ ID NO: 212812 - protein, 8 aa, Japanese encephalitis virus
ANEYGMLE

SEQ ID NO: 212813 - protein, 8 aa, Japanese encephalitis virus
NEYGMLEK

SEQ ID NO: 212814 - protein, 8 aa, Japanese encephalitis virus
EYGMLEKT

SEQ ID NO: 212815 - protein, 8 aa, Japanese encephalitis virus
YGMLEKTK

SEQ ID NO: 212816 - protein, 8 aa, Japanese encephalitis virus
GMLEKTKA

SEQ ID NO: 212817 - protein, 8 aa, Japanese encephalitis virus
MLEKTKAD

SEQ ID NO: 212818 - protein, 8 aa, Japanese encephalitis virus
LEKTKADL

SEQ ID NO: 212819 - protein, 8 aa, Japanese encephalitis virus
EKTKADLK

SEQ ID NO: 212820 - protein, 8 aa, Japanese encephalitis virus
KTKADLKS

SEQ ID NO: 212821 - protein, 8 aa, Japanese encephalitis virus
TKADLKSM

SEQ ID NO: 212822 - protein, 8 aa, Japanese encephalitis virus
KADLKSMF

SEQ ID NO: 212823 - protein, 8 aa, Japanese encephalitis virus
ADLKSMFG

SEQ ID NO: 212824 - protein, 8 aa, Japanese encephalitis virus
DLKSMFGG

SEQ ID NO: 212825 - protein, 8 aa, Japanese encephalitis virus
LKSMFGGK

SEQ ID NO: 212826 - protein, 8 aa, Japanese encephalitis virus
KSMFGGKT

SEQ ID NO: 212827 - protein, 8 aa, Japanese encephalitis virus
SMFGGKTQ

SEQ ID NO: 212828 - protein, 8 aa, Japanese encephalitis virus
MFGGKTQA

SEQ ID NO: 212829 - protein, 8 aa, Japanese encephalitis virus
TQASGLTG

SEQ ID NO: 212830 - protein, 8 aa, Japanese encephalitis virus
QASGLTGL

SEQ ID NO: 212831 - protein, 8 aa, Japanese encephalitis virus
ASGLTGLP

SEQ ID NO: 212832 - protein, 8 aa, Japanese encephalitis virus
SGLTGLPS

SEQ ID NO: 212833 - protein, 8 aa, Japanese encephalitis virus
GLTGLPSM

SEQ ID NO: 212834 - protein, 8 aa, Japanese encephalitis virus
LTGLPSMA

SEQ ID NO: 212835 - protein, 8 aa, Japanese encephalitis virus
TGLPSMAL

SEQ ID NO: 212836 - protein, 8 aa, Japanese encephalitis virus
GLPSMALD

SEQ ID NO: 212837 - protein, 8 aa, Japanese encephalitis virus
LPSMALDL

SEQ ID NO: 212838 - protein, 8 aa, Japanese encephalitis virus
PSMALDLR

SEQ ID NO: 212839 - protein, 8 aa, Japanese encephalitis virus
SMALDLRP

SEQ ID NO: 212840 - protein, 8 aa, Japanese encephalitis virus
MALDLRPA

SEQ ID NO: 212841 - protein, 8 aa, Japanese encephalitis virus
ALDLRPAT

SEQ ID NO: 212842 - protein, 8 aa, Japanese encephalitis virus
LDLRPATA

SEQ ID NO: 212843 - protein, 8 aa, Japanese encephalitis virus
DLRPATAW

SEQ ID NO: 212844 - protein, 8 aa, Japanese encephalitis virus
LRPATAWA

SEQ ID NO: 212845 - protein, 8 aa, Japanese encephalitis virus
RPATAWAL

SEQ ID NO: 212846 - protein, 8 aa, Japanese encephalitis virus
PATAWALY

SEQ ID NO: 212847 - protein, 8 aa, Japanese encephalitis virus
ATAWALYG

SEQ ID NO: 212848 - protein, 8 aa, Japanese encephalitis virus
TAWALYGG

SEQ ID NO: 212849 - protein, 8 aa, Japanese encephalitis virus
AWALYGGS

SEQ ID NO: 212850 - protein, 8 aa, Japanese encephalitis virus
WALYGGST

SEQ ID NO: 212851 - protein, 8 aa, Japanese encephalitis virus
ALYGGSTV

SEQ ID NO: 212852 - protein, 8 aa, Japanese encephalitis virus
LYGGSTVV

SEQ ID NO: 212853 - protein, 8 aa, Japanese encephalitis virus
YGGSTVVL

SEQ ID NO: 212854 - protein, 8 aa, Japanese encephalitis virus
GGSTVVLT

SEQ ID NO: 212855 - protein, 8 aa, Japanese encephalitis virus
GSTVVLTP

SEQ ID NO: 212856 - protein, 8 aa, Japanese encephalitis virus
STVVLTPL

SEQ ID NO: 212857 - protein, 8 aa, Japanese encephalitis virus
TVVLTPLL

SEQ ID NO: 212858 - protein, 8 aa, Japanese encephalitis virus
VVLTPLLK

SEQ ID NO: 212859 - protein, 8 aa, Japanese encephalitis virus
VLTPLLKH

SEQ ID NO: 212860 - protein, 8 aa, Japanese encephalitis virus
LTPLLKHL

SEQ ID NO: 212861 - protein, 8 aa, Japanese encephalitis virus
TPLLKHLI

SEQ ID NO: 212862 - protein, 8 aa, Japanese encephalitis virus
PLLKHLIT

SEQ ID NO: 212863 - protein, 8 aa, Japanese encephalitis virus
LLKHLITS

SEQ ID NO: 212864 - protein, 8 aa, Japanese encephalitis virus
LKHLITSE

SEQ ID NO: 212865 - protein, 8 aa, Japanese encephalitis virus
KHLITSEY

SEQ ID NO: 212866 - protein, 8 aa, Japanese encephalitis virus
HLITSEYV

SEQ ID NO: 212867 - protein, 8 aa, Japanese encephalitis virus
LITSEYVT

SEQ ID NO: 212868 - protein, 8 aa, Japanese encephalitis virus
ITSEYVTT

SEQ ID NO: 212869 - protein, 8 aa, Japanese encephalitis virus
TSEYVTTS

SEQ ID NO: 212870 - protein, 8 aa, Japanese encephalitis virus
SEYVTTSL

SEQ ID NO: 212871 - protein, 8 aa, Japanese encephalitis virus
EYVTTSLA

SEQ ID NO: 212872 - protein, 8 aa, Japanese encephalitis virus
YVTTSLAS

SEQ ID NO: 212873 - protein, 8 aa, Japanese encephalitis virus
VTTSLASI

SEQ ID NO: 212874 - protein, 8 aa, Japanese encephalitis virus
TTSLASIN

SEQ ID NO: 212875 - protein, 8 aa, Japanese encephalitis virus
TSLASINS

SEQ ID NO: 212876 - protein, 8 aa, Japanese encephalitis virus
SLASINSQ

SEQ ID NO: 212877 - protein, 8 aa, Japanese encephalitis virus
LASINSQA

SEQ ID NO: 212878 - protein, 8 aa, Japanese encephalitis virus
ASINSQAG

SEQ ID NO: 212879 - protein, 8 aa, Japanese encephalitis virus
SINSQAGS

SEQ ID NO: 212880 - protein, 8 aa, Japanese encephalitis virus
INSQAGSL

SEQ ID NO: 212881 - protein, 8 aa, Japanese encephalitis virus
NSQAGSLF

SEQ ID NO: 212882 - protein, 8 aa, Japanese encephalitis virus
SQAGSLFV

SEQ ID NO: 212883 - protein, 8 aa, Japanese encephalitis virus
QAGSLFVL

SEQ ID NO: 212884 - protein, 8 aa, Japanese encephalitis virus
AGSLFVLP

SEQ ID NO: 212885 - protein, 8 aa, Japanese encephalitis virus
GSLFVLPR

SEQ ID NO: 212886 - protein, 8 aa, Japanese encephalitis virus
SLFVLPRG

SEQ ID NO: 212887 - protein, 8 aa, Japanese encephalitis virus
LFVLPRGV

SEQ ID NO: 212888 - protein, 8 aa, Japanese encephalitis virus
FVLPRGVP

SEQ ID NO: 212889 - protein, 8 aa, Japanese encephalitis virus
VLPRGVPF

SEQ ID NO: 212890 - protein, 8 aa, Japanese encephalitis virus
LPRGVPFT

SEQ ID NO: 212891 - protein, 8 aa, Japanese encephalitis virus
PRGVPFTD

SEQ ID NO: 212892 - protein, 8 aa, Japanese encephalitis virus
RGVPFTDL

SEQ ID NO: 212893 - protein, 8 aa, Japanese encephalitis virus
GVPFTDLD

SEQ ID NO: 212894 - protein, 8 aa, Japanese encephalitis virus
VPFTDLDL

SEQ ID NO: 212895 - protein, 8 aa, Japanese encephalitis virus
PFTDLDLT

SEQ ID NO: 212896 - protein, 8 aa, Japanese encephalitis virus
FTDLDLTV

SEQ ID NO: 212897 - protein, 8 aa, Japanese encephalitis virus
TDLDLTVG

SEQ ID NO: 212898 - protein, 8 aa, Japanese encephalitis virus
DLDLTVGL

SEQ ID NO: 212899 - protein, 8 aa, Japanese encephalitis virus
LDLTVGLV

SEQ ID NO: 212900 - protein, 8 aa, Japanese encephalitis virus
DLTVGLVF

SEQ ID NO: 212901 - protein, 8 aa, Japanese encephalitis virus
LTVGLVFL

SEQ ID NO: 212902 - protein, 8 aa, Japanese encephalitis virus
TVGLVFLG

SEQ ID NO: 212903 - protein, 8 aa, Japanese encephalitis virus
VGLVFLGC

SEQ ID NO: 212904 - protein, 8 aa, Japanese encephalitis virus
GLVFLGCW

SEQ ID NO: 212905 - protein, 8 aa, Japanese encephalitis virus
LVFLGCWG

SEQ ID NO: 212906 - protein, 8 aa, Japanese encephalitis virus
VFLGCWGQ

SEQ ID NO: 212907 - protein, 8 aa, Japanese encephalitis virus
FLGCWGQI

SEQ ID NO: 212908 - protein, 8 aa, Japanese encephalitis virus
LGCWGQIT

SEQ ID NO: 212909 - protein, 8 aa, Japanese encephalitis virus
GCWGQITL

SEQ ID NO: 212910 - protein, 8 aa, Japanese encephalitis virus
CWGQITLT

SEQ ID NO: 212911 - protein, 8 aa, Japanese encephalitis virus
WGQITLTT

SEQ ID NO: 212912 - protein, 8 aa, Japanese encephalitis virus
GQITLTTF

SEQ ID NO: 212913 - protein, 8 aa, Japanese encephalitis virus
QITLTTFL

SEQ ID NO: 212914 - protein, 8 aa, Japanese encephalitis virus
ITLTTFLT

SEQ ID NO: 212915 - protein, 8 aa, Japanese encephalitis virus
TLTTFLTA

SEQ ID NO: 212916 - protein, 8 aa, Japanese encephalitis virus
LTTFLTAM

SEQ ID NO: 212917 - protein, 8 aa, Japanese encephalitis virus
TTFLTAMV

SEQ ID NO: 212918 - protein, 8 aa, Japanese encephalitis virus
TFLTAMVL

SEQ ID NO: 212919 - protein, 8 aa, Japanese encephalitis virus
LTAMVLAT

SEQ ID NO: 212920 - protein, 8 aa, Japanese encephalitis virus
TAMVLATL

SEQ ID NO: 212921 - protein, 8 aa, Japanese encephalitis virus
AMVLATLH

SEQ ID NO: 212922 - protein, 8 aa, Japanese encephalitis virus
MVLATLHY

SEQ ID NO: 212923 - protein, 8 aa, Japanese encephalitis virus
VLATLHYG

SEQ ID NO: 212924 - protein, 8 aa, Japanese encephalitis virus
LATLHYGY

SEQ ID NO: 212925 - protein, 8 aa, Japanese encephalitis virus
ATLHYGYM

SEQ ID NO: 212926 - protein, 8 aa, Japanese encephalitis virus
TLHYGYML

SEQ ID NO: 212927 - protein, 8 aa, Japanese encephalitis virus
LHYGYMLP

SEQ ID NO: 212928 - protein, 8 aa, Japanese encephalitis virus
HYGYMLPG

SEQ ID NO: 212929 - protein, 8 aa, Japanese encephalitis virus
YGYMLPGW

SEQ ID NO: 212930 - protein, 8 aa, Japanese encephalitis virus
GYMLPGWQ

SEQ ID NO: 212931 - protein, 8 aa, Japanese encephalitis virus
YMLPGWQA

SEQ ID NO: 212932 - protein, 8 aa, Japanese encephalitis virus
MLPGWQAE

SEQ ID NO: 212933 - protein, 8 aa, Japanese encephalitis virus
LPGWQAEA

SEQ ID NO: 212934 - protein, 8 aa, Japanese encephalitis virus
PGWQAEAL

SEQ ID NO: 212935 - protein, 8 aa, Japanese encephalitis virus
GWQAEALR

SEQ ID NO: 212936 - protein, 8 aa, Japanese encephalitis virus
WQAEALRA

SEQ ID NO: 212937 - protein, 8 aa, Japanese encephalitis virus
QAEALRAA

SEQ ID NO: 212938 - protein, 8 aa, Japanese encephalitis virus
AEALRAAQ

SEQ ID NO: 212939 - protein, 8 aa, Japanese encephalitis virus
EALRAAQR

SEQ ID NO: 212940 - protein, 8 aa, Japanese encephalitis virus
ALRAAQRR

SEQ ID NO: 212941 - protein, 8 aa, Japanese encephalitis virus
LRAAQRRT

SEQ ID NO: 212942 - protein, 8 aa, Japanese encephalitis virus
RAAQRRTA

SEQ ID NO: 212943 - protein, 8 aa, Japanese encephalitis virus
AAQRRTAA

SEQ ID NO: 212944 - protein, 8 aa, Japanese encephalitis virus
AQRRTAAG

SEQ ID NO: 212945 - protein, 8 aa, Japanese encephalitis virus
QRRTAAGI

SEQ ID NO: 212946 - protein, 8 aa, Japanese encephalitis virus
RRTAAGIM

SEQ ID NO: 212947 - protein, 8 aa, Japanese encephalitis virus
RTAAGIMK

SEQ ID NO: 212948 - protein, 8 aa, Japanese encephalitis virus
TAAGIMKN

SEQ ID NO: 212949 - protein, 8 aa, Japanese encephalitis virus
AAGIMKNA

SEQ ID NO: 212950 - protein, 8 aa, Japanese encephalitis virus
AGIMKNAV

SEQ ID NO: 212951 - protein, 8 aa, Japanese encephalitis virus
GIMKNAVV

SEQ ID NO: 212952 - protein, 8 aa, Japanese encephalitis virus
IMKNAVVD

SEQ ID NO: 212953 - protein, 8 aa, Japanese encephalitis virus
MKNAVVDG

SEQ ID NO: 212954 - protein, 8 aa, Japanese encephalitis virus
KNAVVDGM

SEQ ID NO: 212955 - protein, 8 aa, Japanese encephalitis virus
NAVVDGMV

SEQ ID NO: 212956 - protein, 8 aa, Japanese encephalitis virus
AVVDGMVA

SEQ ID NO: 212957 - protein, 8 aa, Japanese encephalitis virus
VVDGMVAT

SEQ ID NO: 212958 - protein, 8 aa, Japanese encephalitis virus
VDGMVATD

SEQ ID NO: 212959 - protein, 8 aa, Japanese encephalitis virus
DGMVATDV

SEQ ID NO: 212960 - protein, 8 aa, Japanese encephalitis virus
GMVATDVP

SEQ ID NO: 212961 - protein, 8 aa, Japanese encephalitis virus
MVATDVPE

SEQ ID NO: 212962 - protein, 8 aa, Japanese encephalitis virus
VATDVPEL

SEQ ID NO: 212963 - protein, 8 aa, Japanese encephalitis virus
ATDVPELE

SEQ ID NO: 212964 - protein, 8 aa, Japanese encephalitis virus
TDVPELER

SEQ ID NO: 212965 - protein, 8 aa, Japanese encephalitis virus
DVPELERT

SEQ ID NO: 212966 - protein, 8 aa, Japanese encephalitis virus
VPELERTT

SEQ ID NO: 212967 - protein, 8 aa, Japanese encephalitis virus
PELERTTP

SEQ ID NO: 212968 - protein, 8 aa, Japanese encephalitis virus
ELERTTPL

SEQ ID NO: 212969 - protein, 8 aa, Japanese encephalitis virus
LERTTPLM

SEQ ID NO: 212970 - protein, 8 aa, Japanese encephalitis virus
ERTTPLMQ

SEQ ID NO: 212971 - protein, 8 aa, Japanese encephalitis virus
RTTPLMQK

SEQ ID NO: 212972 - protein, 8 aa, Japanese encephalitis virus
TTPLMQKK

SEQ ID NO: 212973 - protein, 8 aa, Japanese encephalitis virus
TPLMQKKV

SEQ ID NO: 212974 - protein, 8 aa, Japanese encephalitis virus
PLMQKKVG

SEQ ID NO: 212975 - protein, 8 aa, Japanese encephalitis virus
LMQKKVGQ

SEQ ID NO: 212976 - protein, 8 aa, Japanese encephalitis virus
MQKKVGQV

SEQ ID NO: 212977 - protein, 8 aa, Japanese encephalitis virus
QKKVGQVL

SEQ ID NO: 212978 - protein, 8 aa, Japanese encephalitis virus
KKVGQVLL

SEQ ID NO: 212979 - protein, 8 aa, Japanese encephalitis virus
KVGQVLLI

SEQ ID NO: 212980 - protein, 8 aa, Japanese encephalitis virus
VGQVLLIG

SEQ ID NO: 212981 - protein, 8 aa, Japanese encephalitis virus
GQVLLIGV

SEQ ID NO: 212982 - protein, 8 aa, Japanese encephalitis virus
QVLLIGVS

SEQ ID NO: 212983 - protein, 8 aa, Japanese encephalitis virus
VLLIGVSV

SEQ ID NO: 212984 - protein, 8 aa, Japanese encephalitis virus
LLIGVSVA

SEQ ID NO: 212985 - protein, 8 aa, Japanese encephalitis virus
LIGVSVAA

SEQ ID NO: 212986 - protein, 8 aa, Japanese encephalitis virus
IGVSVAAF

SEQ ID NO: 212987 - protein, 8 aa, Japanese encephalitis virus
GVSVAAFL

SEQ ID NO: 212988 - protein, 8 aa, Japanese encephalitis virus
VSVAAFLV

SEQ ID NO: 212989 - protein, 8 aa, Japanese encephalitis virus
SVAAFLVN

SEQ ID NO: 212990 - protein, 8 aa, Japanese encephalitis virus
VAAFLVNP

SEQ ID NO: 212991 - protein, 8 aa, Japanese encephalitis virus
AAFLVNPN

SEQ ID NO: 212992 - protein, 8 aa, Japanese encephalitis virus
AFLVNPNV

SEQ ID NO: 212993 - protein, 8 aa, Japanese encephalitis virus
FLVNPNVT

SEQ ID NO: 212994 - protein, 8 aa, Japanese encephalitis virus
LVNPNVTT

SEQ ID NO: 212995 - protein, 8 aa, Japanese encephalitis virus
VNPNVTTV

SEQ ID NO: 212996 - protein, 8 aa, Japanese encephalitis virus
NPNVTTVR

SEQ ID NO: 212997 - protein, 8 aa, Japanese encephalitis virus
PNVTTVRE

SEQ ID NO: 212998 - protein, 8 aa, Japanese encephalitis virus
NVTTVREA

SEQ ID NO: 212999 - protein, 8 aa, Japanese encephalitis virus
VTTVREAG

SEQ ID NO: 213000 - protein, 8 aa, Japanese encephalitis virus
TTVREAGV

SEQ ID NO: 213001 - protein, 8 aa, Japanese encephalitis virus
TVREAGVL

SEQ ID NO: 213002 - protein, 8 aa, Japanese encephalitis virus
VREAGVLV

SEQ ID NO: 213003 - protein, 8 aa, Japanese encephalitis virus
REAGVLVT

SEQ ID NO: 213004 - protein, 8 aa, Japanese encephalitis virus
EAGVLVTA

SEQ ID NO: 213005 - protein, 8 aa, Japanese encephalitis virus
AGVLVTAA

SEQ ID NO: 213006 - protein, 8 aa, Japanese encephalitis virus
GVLVTAAT

SEQ ID NO: 213007 - protein, 8 aa, Japanese encephalitis virus
VLVTAATL

SEQ ID NO: 213008 - protein, 8 aa, Japanese encephalitis virus
LVTAATLT

SEQ ID NO: 213009 - protein, 8 aa, Japanese encephalitis virus
VTAATLTL

SEQ ID NO: 213010 - protein, 8 aa, Japanese encephalitis virus
TAATLTLW

SEQ ID NO: 213011 - protein, 8 aa, Japanese encephalitis virus
AATLTLWD

SEQ ID NO: 213012 - protein, 8 aa, Japanese encephalitis virus
ATLTLWDN

SEQ ID NO: 213013 - protein, 8 aa, Japanese encephalitis virus
TLTLWDNG

SEQ ID NO: 213014 - protein, 8 aa, Japanese encephalitis virus
LTLWDNGA

SEQ ID NO: 213015 - protein, 8 aa, Japanese encephalitis virus
TLWDNGAS

SEQ ID NO: 213016 - protein, 8 aa, Japanese encephalitis virus
LWDNGASA

SEQ ID NO: 213017 - protein, 8 aa, Japanese encephalitis virus
WDNGASAV

SEQ ID NO: 213018 - protein, 8 aa, Japanese encephalitis virus
DNGASAVW

SEQ ID NO: 213019 - protein, 8 aa, Japanese encephalitis virus
NGASAVWN

SEQ ID NO: 213020 - protein, 8 aa, Japanese encephalitis virus
GASAVWNS

SEQ ID NO: 213021 - protein, 8 aa, Japanese encephalitis virus
ASAVWNST

SEQ ID NO: 213022 - protein, 8 aa, Japanese encephalitis virus
SAVWNSTT

SEQ ID NO: 213023 - protein, 8 aa, Japanese encephalitis virus
AVWNSTTA

SEQ ID NO: 213024 - protein, 8 aa, Japanese encephalitis virus
VWNSTTAT

SEQ ID NO: 213025 - protein, 8 aa, Japanese encephalitis virus
WNSTTATG

SEQ ID NO: 213026 - protein, 8 aa, Japanese encephalitis virus
NSTTATGL

SEQ ID NO: 213027 - protein, 8 aa, Japanese encephalitis virus
STTATGLC

SEQ ID NO: 213028 - protein, 8 aa, Japanese encephalitis virus
TTATGLCH

SEQ ID NO: 213029 - protein, 8 aa, Japanese encephalitis virus
TATGLCHV

SEQ ID NO: 213030 - protein, 8 aa, Japanese encephalitis virus
ATGLCHVM

SEQ ID NO: 213031 - protein, 8 aa, Japanese encephalitis virus
TGLCHVMR

SEQ ID NO: 213032 - protein, 8 aa, Japanese encephalitis virus
GLCHVMRG

SEQ ID NO: 213033 - protein, 8 aa, Japanese encephalitis virus
LCHVMRGS

SEQ ID NO: 213034 - protein, 8 aa, Japanese encephalitis virus
CHVMRGSY

SEQ ID NO: 213035 - protein, 8 aa, Japanese encephalitis virus
HVMRGSYL

SEQ ID NO: 213036 - protein, 8 aa, Japanese encephalitis virus
VMRGSYLA

SEQ ID NO: 213037 - protein, 8 aa, Japanese encephalitis virus
MRGSYLAG

SEQ ID NO: 213038 - protein, 8 aa, Japanese encephalitis virus
RGSYLAGG

SEQ ID NO: 213039 - protein, 8 aa, Japanese encephalitis virus
GSYLAGGS

SEQ ID NO: 213040 - protein, 8 aa, Japanese encephalitis virus
SYLAGGSI

SEQ ID NO: 213041 - protein, 8 aa, Japanese encephalitis virus
YLAGGSIA

SEQ ID NO: 213042 - protein, 8 aa, Japanese encephalitis virus
LAGGSIAW

SEQ ID NO: 213043 - protein, 8 aa, Japanese encephalitis virus
AGGSIAWT

SEQ ID NO: 213044 - protein, 8 aa, Japanese encephalitis virus
GGSIAWTL

SEQ ID NO: 213045 - protein, 8 aa, Japanese encephalitis virus
GSIAWTLI

SEQ ID NO: 213046 - protein, 8 aa, Japanese encephalitis virus
SIAWTLIK

SEQ ID NO: 213047 - protein, 8 aa, Japanese encephalitis virus
IAWTLIKN

SEQ ID NO: 213048 - protein, 8 aa, Japanese encephalitis virus
AWTLIKNA

SEQ ID NO: 213049 - protein, 8 aa, Japanese encephalitis virus
WTLIKNAD

SEQ ID NO: 213050 - protein, 8 aa, Japanese encephalitis virus
TLIKNADK

SEQ ID NO: 213051 - protein, 8 aa, Japanese encephalitis virus
LIKNADKP

SEQ ID NO: 213052 - protein, 8 aa, Japanese encephalitis virus
IKNADKPS

SEQ ID NO: 213053 - protein, 8 aa, Japanese encephalitis virus
KNADKPSL

SEQ ID NO: 213054 - protein, 8 aa, Japanese encephalitis virus
NADKPSLK

SEQ ID NO: 213055 - protein, 8 aa, Japanese encephalitis virus
ADKPSLKR

SEQ ID NO: 213056 - protein, 8 aa, Japanese encephalitis virus
DKPSLKRG

SEQ ID NO: 213057 - protein, 8 aa, Japanese encephalitis virus
KPSLKRGR

SEQ ID NO: 213058 - protein, 8 aa, Japanese encephalitis virus
PSLKRGRP

SEQ ID NO: 213059 - protein, 8 aa, Japanese encephalitis virus
SLKRGRPG

SEQ ID NO: 213060 - protein, 8 aa, Japanese encephalitis virus
LKRGRPGG

SEQ ID NO: 213061 - protein, 8 aa, Japanese encephalitis virus
KRGRPGGR

SEQ ID NO: 213062 - protein, 8 aa, Japanese encephalitis virus
RGRPGGRT

SEQ ID NO: 213063 - protein, 8 aa, Japanese encephalitis virus
GRPGGRTL

SEQ ID NO: 213064 - protein, 8 aa, Japanese encephalitis virus
RPGGRTLG

SEQ ID NO: 213065 - protein, 8 aa, Japanese encephalitis virus
PGGRTLGE

SEQ ID NO: 213066 - protein, 8 aa, Japanese encephalitis virus
GGRTLGEQ

SEQ ID NO: 213067 - protein, 8 aa, Japanese encephalitis virus
GRTLGEQW

SEQ ID NO: 213068 - protein, 8 aa, Japanese encephalitis virus
RTLGEQWK

SEQ ID NO: 213069 - protein, 8 aa, Japanese encephalitis virus
TLGEQWKE

SEQ ID NO: 213070 - protein, 8 aa, Japanese encephalitis virus
LGEQWKEK

SEQ ID NO: 213071 - protein, 8 aa, Japanese encephalitis virus
GEQWKEKL

SEQ ID NO: 213072 - protein, 8 aa, Japanese encephalitis virus
EQWKEKLN

SEQ ID NO: 213073 - protein, 8 aa, Japanese encephalitis virus
QWKEKLNA

SEQ ID NO: 213074 - protein, 8 aa, Japanese encephalitis virus
WKEKLNAM

SEQ ID NO: 213075 - protein, 8 aa, Japanese encephalitis virus
KEKLNAMS

SEQ ID NO: 213076 - protein, 8 aa, Japanese encephalitis virus
EKLNAMSR

SEQ ID NO: 213077 - protein, 8 aa, Japanese encephalitis virus
KLNAMSRE

SEQ ID NO: 213078 - protein, 8 aa, Japanese encephalitis virus
LNAMSREE

SEQ ID NO: 213079 - protein, 8 aa, Japanese encephalitis virus
NAMSREEF

SEQ ID NO: 213080 - protein, 8 aa, Japanese encephalitis virus
AMSREEFF

SEQ ID NO: 213081 - protein, 8 aa, Japanese encephalitis virus
MSREEFFK

SEQ ID NO: 213082 - protein, 8 aa, Japanese encephalitis virus
SREEFFKY

SEQ ID NO: 213083 - protein, 8 aa, Japanese encephalitis virus
REEFFKYR

SEQ ID NO: 213084 - protein, 8 aa, Japanese encephalitis virus
EEFFKYRR

SEQ ID NO: 213085 - protein, 8 aa, Japanese encephalitis virus
EFFKYRRE

SEQ ID NO: 213086 - protein, 8 aa, Japanese encephalitis virus
FFKYRREA

SEQ ID NO: 213087 - protein, 8 aa, Japanese encephalitis virus
FKYRREAI

SEQ ID NO: 213088 - protein, 8 aa, Japanese encephalitis virus
KYRREAII

SEQ ID NO: 213089 - protein, 8 aa, Japanese encephalitis virus
YRREAIIE

SEQ ID NO: 213090 - protein, 8 aa, Japanese encephalitis virus
RREAIIEV

SEQ ID NO: 213091 - protein, 8 aa, Japanese encephalitis virus
REAIIEVD

SEQ ID NO: 213092 - protein, 8 aa, Japanese encephalitis virus
EAIIEVDR

SEQ ID NO: 213093 - protein, 8 aa, Japanese encephalitis virus
AIIEVDRT

SEQ ID NO: 213094 - protein, 8 aa, Japanese encephalitis virus
IIEVDRTE

SEQ ID NO: 213095 - protein, 8 aa, Japanese encephalitis virus
IEVDRTEA

SEQ ID NO: 213096 - protein, 8 aa, Japanese encephalitis virus
EVDRTEAR

SEQ ID NO: 213097 - protein, 8 aa, Japanese encephalitis virus
VDRTEARR

SEQ ID NO: 213098 - protein, 8 aa, Japanese encephalitis virus
DRTEARRA

SEQ ID NO: 213099 - protein, 8 aa, Japanese encephalitis virus
RTEARRAR

SEQ ID NO: 213100 - protein, 8 aa, Japanese encephalitis virus
TEARRARR

SEQ ID NO: 213101 - protein, 8 aa, Japanese encephalitis virus
EARRARRE

SEQ ID NO: 213102 - protein, 8 aa, Japanese encephalitis virus
ARRARREN

SEQ ID NO: 213103 - protein, 8 aa, Japanese encephalitis virus
RRARRENN

SEQ ID NO: 213104 - protein, 8 aa, Japanese encephalitis virus
RARRENNI

SEQ ID NO: 213105 - protein, 8 aa, Japanese encephalitis virus
ARRENNIV

SEQ ID NO: 213106 - protein, 8 aa, Japanese encephalitis virus
RRENNIVG

SEQ ID NO: 213107 - protein, 8 aa, Japanese encephalitis virus
RENNIVGG

SEQ ID NO: 213108 - protein, 8 aa, Japanese encephalitis virus
ENNIVGGH

SEQ ID NO: 213109 - protein, 8 aa, Japanese encephalitis virus
NNIVGGHP

SEQ ID NO: 213110 - protein, 8 aa, Japanese encephalitis virus
NIVGGHPV

SEQ ID NO: 213111 - protein, 8 aa, Japanese encephalitis virus
IVGGHPVS

SEQ ID NO: 213112 - protein, 8 aa, Japanese encephalitis virus
VGGHPVSR

SEQ ID NO: 213113 - protein, 8 aa, Japanese encephalitis virus
GGHPVSRG

SEQ ID NO: 213114 - protein, 8 aa, Japanese encephalitis virus
GHPVSRGS

SEQ ID NO: 213115 - protein, 8 aa, Japanese encephalitis virus
HPVSRGSA

SEQ ID NO: 213116 - protein, 8 aa, Japanese encephalitis virus
PVSRGSAK

SEQ ID NO: 213117 - protein, 8 aa, Japanese encephalitis virus
VSRGSAKL

SEQ ID NO: 213118 - protein, 8 aa, Japanese encephalitis virus
SRGSAKLR

SEQ ID NO: 213119 - protein, 8 aa, Japanese encephalitis virus
RGSAKLRW

SEQ ID NO: 213120 - protein, 8 aa, Japanese encephalitis virus
GSAKLRWL

SEQ ID NO: 213121 - protein, 8 aa, Japanese encephalitis virus
SAKLRWLV

SEQ ID NO: 213122 - protein, 8 aa, Japanese encephalitis virus
AKLRWLVE

SEQ ID NO: 213123 - protein, 8 aa, Japanese encephalitis virus
KLRWLVEK

SEQ ID NO: 213124 - protein, 8 aa, Japanese encephalitis virus
LRWLVEKG

SEQ ID NO: 213125 - protein, 8 aa, Japanese encephalitis virus
RWLVEKGF

SEQ ID NO: 213126 - protein, 8 aa, Japanese encephalitis virus
WLVEKGFV

SEQ ID NO: 213127 - protein, 8 aa, Japanese encephalitis virus
LVEKGFVS

SEQ ID NO: 213128 - protein, 8 aa, Japanese encephalitis virus
VEKGFVSP

SEQ ID NO: 213129 - protein, 8 aa, Japanese encephalitis virus
EKGFVSPI

SEQ ID NO: 213130 - protein, 8 aa, Japanese encephalitis virus
KGFVSPIG

SEQ ID NO: 213131 - protein, 8 aa, Japanese encephalitis virus
GFVSPIGK

SEQ ID NO: 213132 - protein, 8 aa, Japanese encephalitis virus
FVSPIGKV

SEQ ID NO: 213133 - protein, 8 aa, Japanese encephalitis virus
VSPIGKVI

SEQ ID NO: 213134 - protein, 8 aa, Japanese encephalitis virus
SPIGKVID

SEQ ID NO: 213135 - protein, 8 aa, Japanese encephalitis virus
PIGKVIDL

SEQ ID NO: 213136 - protein, 8 aa, Japanese encephalitis virus
IGKVIDLG

SEQ ID NO: 213137 - protein, 8 aa, Japanese encephalitis virus
GKVIDLGC

SEQ ID NO: 213138 - protein, 8 aa, Japanese encephalitis virus
KVIDLGCG

SEQ ID NO: 213139 - protein, 8 aa, Japanese encephalitis virus
VIDLGCGR

SEQ ID NO: 213140 - protein, 8 aa, Japanese encephalitis virus
IDLGCGRG

SEQ ID NO: 213141 - protein, 8 aa, Japanese encephalitis virus
DLGCGRGG

SEQ ID NO: 213142 - protein, 8 aa, Japanese encephalitis virus
LGCGRGGW

SEQ ID NO: 213143 - protein, 8 aa, Japanese encephalitis virus
GCGRGGWS

SEQ ID NO: 213144 - protein, 8 aa, Japanese encephalitis virus
CGRGGWSY

SEQ ID NO: 213145 - protein, 8 aa, Japanese encephalitis virus
GRGGWSYY

SEQ ID NO: 213146 - protein, 8 aa, Japanese encephalitis virus
RGGWSYYA

SEQ ID NO: 213147 - protein, 8 aa, Japanese encephalitis virus
GGWSYYAA

SEQ ID NO: 213148 - protein, 8 aa, Japanese encephalitis virus
GWSYYAAT

SEQ ID NO: 213149 - protein, 8 aa, Japanese encephalitis virus
WSYYAATL

SEQ ID NO: 213150 - protein, 8 aa, Japanese encephalitis virus
SYYAATLK

SEQ ID NO: 213151 - protein, 8 aa, Japanese encephalitis virus
YYAATLKK

SEQ ID NO: 213152 - protein, 8 aa, Japanese encephalitis virus
YAATLKKV

SEQ ID NO: 213153 - protein, 8 aa, Japanese encephalitis virus
AATLKKVQ

SEQ ID NO: 213154 - protein, 8 aa, Japanese encephalitis virus
ATLKKVQE

SEQ ID NO: 213155 - protein, 8 aa, Japanese encephalitis virus
TLKKVQEV

SEQ ID NO: 213156 - protein, 8 aa, Japanese encephalitis virus
LKKVQEVR

SEQ ID NO: 213157 - protein, 8 aa, Japanese encephalitis virus
KKVQEVRG

SEQ ID NO: 213158 - protein, 8 aa, Japanese encephalitis virus
KVQEVRGY

SEQ ID NO: 213159 - protein, 8 aa, Japanese encephalitis virus
VQEVRGYT

SEQ ID NO: 213160 - protein, 8 aa, Japanese encephalitis virus
QEVRGYTK

SEQ ID NO: 213161 - protein, 8 aa, Japanese encephalitis virus
EVRGYTKG

SEQ ID NO: 213162 - protein, 8 aa, Japanese encephalitis virus
VRGYTKGG

SEQ ID NO: 213163 - protein, 8 aa, Japanese encephalitis virus
RGYTKGGA

SEQ ID NO: 213164 - protein, 8 aa, Japanese encephalitis virus
GYTKGGAG

SEQ ID NO: 213165 - protein, 8 aa, Japanese encephalitis virus
YTKGGAGH

SEQ ID NO: 213166 - protein, 8 aa, Japanese encephalitis virus
TKGGAGHE

SEQ ID NO: 213167 - protein, 8 aa, Japanese encephalitis virus
KGGAGHEE

SEQ ID NO: 213168 - protein, 8 aa, Japanese encephalitis virus
GGAGHEEP

SEQ ID NO: 213169 - protein, 8 aa, Japanese encephalitis virus
GAGHEEPM

SEQ ID NO: 213170 - protein, 8 aa, Japanese encephalitis virus
AGHEEPML

SEQ ID NO: 213171 - protein, 8 aa, Japanese encephalitis virus
GHEEPMLM

SEQ ID NO: 213172 - protein, 8 aa, Japanese encephalitis virus
HEEPMLMQ

SEQ ID NO: 213173 - protein, 8 aa, Japanese encephalitis virus
EEPMLMQS

SEQ ID NO: 213174 - protein, 8 aa, Japanese encephalitis virus
EPMLMQSY

SEQ ID NO: 213175 - protein, 8 aa, Japanese encephalitis virus
PMLMQSYG

SEQ ID NO: 213176 - protein, 8 aa, Japanese encephalitis virus
MLMQSYGW

SEQ ID NO: 213177 - protein, 8 aa, Japanese encephalitis virus
LMQSYGWN

SEQ ID NO: 213178 - protein, 8 aa, Japanese encephalitis virus
MQSYGWNL

SEQ ID NO: 213179 - protein, 8 aa, Japanese encephalitis virus
QSYGWNLV

SEQ ID NO: 213180 - protein, 8 aa, Japanese encephalitis virus
SYGWNLVS

SEQ ID NO: 213181 - protein, 8 aa, Japanese encephalitis virus
YGWNLVSL

SEQ ID NO: 213182 - protein, 8 aa, Japanese encephalitis virus
GWNLVSLK

SEQ ID NO: 213183 - protein, 8 aa, Japanese encephalitis virus
WNLVSLKS

SEQ ID NO: 213184 - protein, 8 aa, Japanese encephalitis virus
NLVSLKSG

SEQ ID NO: 213185 - protein, 8 aa, Japanese encephalitis virus
LVSLKSGV

SEQ ID NO: 213186 - protein, 8 aa, Japanese encephalitis virus
VSLKSGVD

SEQ ID NO: 213187 - protein, 8 aa, Japanese encephalitis virus
SLKSGVDV

SEQ ID NO: 213188 - protein, 8 aa, Japanese encephalitis virus
LKSGVDVF

SEQ ID NO: 213189 - protein, 8 aa, Japanese encephalitis virus
KSGVDVFY

SEQ ID NO: 213190 - protein, 8 aa, Japanese encephalitis virus
SGVDVFYK

SEQ ID NO: 213191 - protein, 8 aa, Japanese encephalitis virus
GVDVFYKP

SEQ ID NO: 213192 - protein, 8 aa, Japanese encephalitis virus
VDVFYKPS

SEQ ID NO: 213193 - protein, 8 aa, Japanese encephalitis virus
DVFYKPSE

SEQ ID NO: 213194 - protein, 8 aa, Japanese encephalitis virus
VFYKPSEP

SEQ ID NO: 213195 - protein, 8 aa, Japanese encephalitis virus
FYKPSEPS

SEQ ID NO: 213196 - protein, 8 aa, Japanese encephalitis virus
YKPSEPSD

SEQ ID NO: 213197 - protein, 8 aa, Japanese encephalitis virus
KPSEPSDT

SEQ ID NO: 213198 - protein, 8 aa, Japanese encephalitis virus
PSEPSDTL

SEQ ID NO: 213199 - protein, 8 aa, Japanese encephalitis virus
SEPSDTLF

SEQ ID NO: 213200 - protein, 8 aa, Japanese encephalitis virus
EPSDTLFC

SEQ ID NO: 213201 - protein, 8 aa, Japanese encephalitis virus
PSDTLFCD

SEQ ID NO: 213202 - protein, 8 aa, Japanese encephalitis virus
SDTLFCDI

SEQ ID NO: 213203 - protein, 8 aa, Japanese encephalitis virus
DTLFCDIG

SEQ ID NO: 213204 - protein, 8 aa, Japanese encephalitis virus
TLFCDIGE

SEQ ID NO: 213205 - protein, 8 aa, Japanese encephalitis virus
LFCDIGES

SEQ ID NO: 213206 - protein, 8 aa, Japanese encephalitis virus
FCDIGESS

SEQ ID NO: 213207 - protein, 8 aa, Japanese encephalitis virus
CDIGESSP

SEQ ID NO: 213208 - protein, 8 aa, Japanese encephalitis virus
DIGESSPS

SEQ ID NO: 213209 - protein, 8 aa, Japanese encephalitis virus
IGESSPSP

SEQ ID NO: 213210 - protein, 8 aa, Japanese encephalitis virus
GESSPSPE

SEQ ID NO: 213211 - protein, 8 aa, Japanese encephalitis virus
ESSPSPEV

SEQ ID NO: 213212 - protein, 8 aa, Japanese encephalitis virus
SSPSPEVE

SEQ ID NO: 213213 - protein, 8 aa, Japanese encephalitis virus
SPSPEVEE

SEQ ID NO: 213214 - protein, 8 aa, Japanese encephalitis virus
PSPEVEEQ

SEQ ID NO: 213215 - protein, 8 aa, Japanese encephalitis virus
SPEVEEQR

SEQ ID NO: 213216 - protein, 8 aa, Japanese encephalitis virus
PEVEEQRT

SEQ ID NO: 213217 - protein, 8 aa, Japanese encephalitis virus
EVEEQRTL

SEQ ID NO: 213218 - protein, 8 aa, Japanese encephalitis virus
VEEQRTLR

SEQ ID NO: 213219 - protein, 8 aa, Japanese encephalitis virus
EEQRTLRV

SEQ ID NO: 213220 - protein, 8 aa, Japanese encephalitis virus
EQRTLRVL

SEQ ID NO: 213221 - protein, 8 aa, Japanese encephalitis virus
QRTLRVLE

SEQ ID NO: 213222 - protein, 8 aa, Japanese encephalitis virus
RTLRVLEM

SEQ ID NO: 213223 - protein, 8 aa, Japanese encephalitis virus
TLRVLEMT

SEQ ID NO: 213224 - protein, 8 aa, Japanese encephalitis virus
LRVLEMTS

SEQ ID NO: 213225 - protein, 8 aa, Japanese encephalitis virus
RVLEMTSD

SEQ ID NO: 213226 - protein, 8 aa, Japanese encephalitis virus
VLEMTSDW

SEQ ID NO: 213227 - protein, 8 aa, Japanese encephalitis virus
LEMTSDWL

SEQ ID NO: 213228 - protein, 8 aa, Japanese encephalitis virus
EMTSDWLH

SEQ ID NO: 213229 - protein, 8 aa, Japanese encephalitis virus
MTSDWLHR

SEQ ID NO: 213230 - protein, 8 aa, Japanese encephalitis virus
TSDWLHRG

SEQ ID NO: 213231 - protein, 8 aa, Japanese encephalitis virus
SDWLHRGP

SEQ ID NO: 213232 - protein, 8 aa, Japanese encephalitis virus
DWLHRGPR

SEQ ID NO: 213233 - protein, 8 aa, Japanese encephalitis virus
WLHRGPRE

SEQ ID NO: 213234 - protein, 8 aa, Japanese encephalitis virus
LHRGPREF

SEQ ID NO: 213235 - protein, 8 aa, Japanese encephalitis virus
HRGPREFC

SEQ ID NO: 213236 - protein, 8 aa, Japanese encephalitis virus
RGPREFCI

SEQ ID NO: 213237 - protein, 8 aa, Japanese encephalitis virus
GPREFCIK

SEQ ID NO: 213238 - protein, 8 aa, Japanese encephalitis virus
PREFCIKV

SEQ ID NO: 213239 - protein, 8 aa, Japanese encephalitis virus
REFCIKVL

SEQ ID NO: 213240 - protein, 8 aa, Japanese encephalitis virus
EFCIKVLC

SEQ ID NO: 213241 - protein, 8 aa, Japanese encephalitis virus
FCIKVLCP

SEQ ID NO: 213242 - protein, 8 aa, Japanese encephalitis virus
CIKVLCPY

SEQ ID NO: 213243 - protein, 8 aa, Japanese encephalitis virus
IKVLCPYM

SEQ ID NO: 213244 - protein, 8 aa, Japanese encephalitis virus
KVLCPYMP

SEQ ID NO: 213245 - protein, 8 aa, Japanese encephalitis virus
VLCPYMPK

SEQ ID NO: 213246 - protein, 8 aa, Japanese encephalitis virus
LCPYMPKV

SEQ ID NO: 213247 - protein, 8 aa, Japanese encephalitis virus
CPYMPKVI

SEQ ID NO: 213248 - protein, 8 aa, Japanese encephalitis virus
PYMPKVIE

SEQ ID NO: 213249 - protein, 8 aa, Japanese encephalitis virus
YMPKVIEK

SEQ ID NO: 213250 - protein, 8 aa, Japanese encephalitis virus
MPKVIEKM

SEQ ID NO: 213251 - protein, 8 aa, Japanese encephalitis virus
PKVIEKME

SEQ ID NO: 213252 - protein, 8 aa, Japanese encephalitis virus
KVIEKMEV

SEQ ID NO: 213253 - protein, 8 aa, Japanese encephalitis virus
VIEKMEVL

SEQ ID NO: 213254 - protein, 8 aa, Japanese encephalitis virus
IEKMEVLQ

SEQ ID NO: 213255 - protein, 8 aa, Japanese encephalitis virus
EKMEVLQR

SEQ ID NO: 213256 - protein, 8 aa, Japanese encephalitis virus
KMEVLQRR

SEQ ID NO: 213257 - protein, 8 aa, Japanese encephalitis virus
MEVLQRRF

SEQ ID NO: 213258 - protein, 8 aa, Japanese encephalitis virus
EVLQRRFG

SEQ ID NO: 213259 - protein, 8 aa, Japanese encephalitis virus
VLQRRFGG

SEQ ID NO: 213260 - protein, 8 aa, Japanese encephalitis virus
LQRRFGGG

SEQ ID NO: 213261 - protein, 8 aa, Japanese encephalitis virus
QRRFGGGL

SEQ ID NO: 213262 - protein, 8 aa, Japanese encephalitis virus
RRFGGGLV

SEQ ID NO: 213263 - protein, 8 aa, Japanese encephalitis virus
RFGGGLVR

SEQ ID NO: 213264 - protein, 8 aa, Japanese encephalitis virus
FGGGLVRL

SEQ ID NO: 213265 - protein, 8 aa, Japanese encephalitis virus
GGGLVRLP

SEQ ID NO: 213266 - protein, 8 aa, Japanese encephalitis virus
GGLVRLPL

SEQ ID NO: 213267 - protein, 8 aa, Japanese encephalitis virus
GLVRLPLS

SEQ ID NO: 213268 - protein, 8 aa, Japanese encephalitis virus
LVRLPLSR

SEQ ID NO: 213269 - protein, 8 aa, Japanese encephalitis virus
VRLPLSRN

SEQ ID NO: 213270 - protein, 8 aa, Japanese encephalitis virus
RLPLSRNS

SEQ ID NO: 213271 - protein, 8 aa, Japanese encephalitis virus
LPLSRNSN

SEQ ID NO: 213272 - protein, 8 aa, Japanese encephalitis virus
PLSRNSNH

SEQ ID NO: 213273 - protein, 8 aa, Japanese encephalitis virus
LSRNSNHE

SEQ ID NO: 213274 - protein, 8 aa, Japanese encephalitis virus
SRNSNHEM

SEQ ID NO: 213275 - protein, 8 aa, Japanese encephalitis virus
RNSNHEMY

SEQ ID NO: 213276 - protein, 8 aa, Japanese encephalitis virus
NSNHEMYW

SEQ ID NO: 213277 - protein, 8 aa, Japanese encephalitis virus
SNHEMYWV

SEQ ID NO: 213278 - protein, 8 aa, Japanese encephalitis virus
NHEMYWVS

SEQ ID NO: 213279 - protein, 8 aa, Japanese encephalitis virus
HEMYWVSG

SEQ ID NO: 213280 - protein, 8 aa, Japanese encephalitis virus
EMYWVSGA

SEQ ID NO: 213281 - protein, 8 aa, Japanese encephalitis virus
MYWVSGAA

SEQ ID NO: 213282 - protein, 8 aa, Japanese encephalitis virus
YWVSGAAG

SEQ ID NO: 213283 - protein, 8 aa, Japanese encephalitis virus
WVSGAAGN

SEQ ID NO: 213284 - protein, 8 aa, Japanese encephalitis virus
VSGAAGNV

SEQ ID NO: 213285 - protein, 8 aa, Japanese encephalitis virus
SGAAGNVV

SEQ ID NO: 213286 - protein, 8 aa, Japanese encephalitis virus
GAAGNVVH

SEQ ID NO: 213287 - protein, 8 aa, Japanese encephalitis virus
AAGNVVHA

SEQ ID NO: 213288 - protein, 8 aa, Japanese encephalitis virus
AGNVVHAV

SEQ ID NO: 213289 - protein, 8 aa, Japanese encephalitis virus
GNVVHAVN

SEQ ID NO: 213290 - protein, 8 aa, Japanese encephalitis virus
NVVHAVNM

SEQ ID NO: 213291 - protein, 8 aa, Japanese encephalitis virus
VVHAVNMT

SEQ ID NO: 213292 - protein, 8 aa, Japanese encephalitis virus
VHAVNMTS

SEQ ID NO: 213293 - protein, 8 aa, Japanese encephalitis virus
HAVNMTSQ

SEQ ID NO: 213294 - protein, 8 aa, Japanese encephalitis virus
AVNMTSQV

SEQ ID NO: 213295 - protein, 8 aa, Japanese encephalitis virus
VNMTSQVL

SEQ ID NO: 213296 - protein, 8 aa, Japanese encephalitis virus
NMTSQVLL

SEQ ID NO: 213297 - protein, 8 aa, Japanese encephalitis virus
MTSQVLLG

SEQ ID NO: 213298 - protein, 8 aa, Japanese encephalitis virus
TSQVLLGR

SEQ ID NO: 213299 - protein, 8 aa, Japanese encephalitis virus
SQVLLGRM

SEQ ID NO: 213300 - protein, 8 aa, Japanese encephalitis virus
QVLLGRMD

SEQ ID NO: 213301 - protein, 8 aa, Japanese encephalitis virus
VLLGRMDR

SEQ ID NO: 213302 - protein, 8 aa, Japanese encephalitis virus
LLGRMDRT

SEQ ID NO: 213303 - protein, 8 aa, Japanese encephalitis virus
LGRMDRTV

SEQ ID NO: 213304 - protein, 8 aa, Japanese encephalitis virus
GRMDRTVW

SEQ ID NO: 213305 - protein, 8 aa, Japanese encephalitis virus
RMDRTVWR

SEQ ID NO: 213306 - protein, 8 aa, Japanese encephalitis virus
MDRTVWRG

SEQ ID NO: 213307 - protein, 8 aa, Japanese encephalitis virus
DRTVWRGP

SEQ ID NO: 213308 - protein, 8 aa, Japanese encephalitis virus
RTVWRGPK

SEQ ID NO: 213309 - protein, 8 aa, Japanese encephalitis virus
TVWRGPKY

SEQ ID NO: 213310 - protein, 8 aa, Japanese encephalitis virus
VWRGPKYE

SEQ ID NO: 213311 - protein, 8 aa, Japanese encephalitis virus
WRGPKYEE

SEQ ID NO: 213312 - protein, 8 aa, Japanese encephalitis virus
RGPKYEED

SEQ ID NO: 213313 - protein, 8 aa, Japanese encephalitis virus
GPKYEEDV

SEQ ID NO: 213314 - protein, 8 aa, Japanese encephalitis virus
PKYEEDVN

SEQ ID NO: 213315 - protein, 8 aa, Japanese encephalitis virus
KYEEDVNL

SEQ ID NO: 213316 - protein, 8 aa, Japanese encephalitis virus
YEEDVNLG

SEQ ID NO: 213317 - protein, 8 aa, Japanese encephalitis virus
EEDVNLGS

SEQ ID NO: 213318 - protein, 8 aa, Japanese encephalitis virus
EDVNLGSG

SEQ ID NO: 213319 - protein, 8 aa, Japanese encephalitis virus
DVNLGSGT

SEQ ID NO: 213320 - protein, 8 aa, Japanese encephalitis virus
VNLGSGTR

SEQ ID NO: 213321 - protein, 8 aa, Japanese encephalitis virus
NLGSGTRA

SEQ ID NO: 213322 - protein, 8 aa, Japanese encephalitis virus
LGSGTRAV

SEQ ID NO: 213323 - protein, 8 aa, Japanese encephalitis virus
GSGTRAVG

SEQ ID NO: 213324 - protein, 8 aa, Japanese encephalitis virus
SGTRAVGK

SEQ ID NO: 213325 - protein, 8 aa, Japanese encephalitis virus
GTRAVGKG

SEQ ID NO: 213326 - protein, 8 aa, Japanese encephalitis virus
TRAVGKGE

SEQ ID NO: 213327 - protein, 8 aa, Japanese encephalitis virus
RAVGKGEV

SEQ ID NO: 213328 - protein, 8 aa, Japanese encephalitis virus
AVGKGEVH

SEQ ID NO: 213329 - protein, 8 aa, Japanese encephalitis virus
VGKGEVHS

SEQ ID NO: 213330 - protein, 8 aa, Japanese encephalitis virus
GKGEVHSN

SEQ ID NO: 213331 - protein, 8 aa, Japanese encephalitis virus
KGEVHSNQ

SEQ ID NO: 213332 - protein, 8 aa, Japanese encephalitis virus
QEKIKKRI

SEQ ID NO: 213333 - protein, 8 aa, Japanese encephalitis virus
EKIKKRIQ

SEQ ID NO: 213334 - protein, 8 aa, Japanese encephalitis virus
KIKKRIQK

SEQ ID NO: 213335 - protein, 8 aa, Japanese encephalitis virus
IKKRIQKL

SEQ ID NO: 213336 - protein, 8 aa, Japanese encephalitis virus
KKRIQKLK

SEQ ID NO: 213337 - protein, 8 aa, Japanese encephalitis virus
KRIQKLKE

SEQ ID NO: 213338 - protein, 8 aa, Japanese encephalitis virus
RIQKLKEE

SEQ ID NO: 213339 - protein, 8 aa, Japanese encephalitis virus
IQKLKEEF

SEQ ID NO: 213340 - protein, 8 aa, Japanese encephalitis virus
QKLKEEFA

SEQ ID NO: 213341 - protein, 8 aa, Japanese encephalitis virus
KLKEEFAT

SEQ ID NO: 213342 - protein, 8 aa, Japanese encephalitis virus
LKEEFATT

SEQ ID NO: 213343 - protein, 8 aa, Japanese encephalitis virus
KEEFATTW

SEQ ID NO: 213344 - protein, 8 aa, Japanese encephalitis virus
EEFATTWH

SEQ ID NO: 213345 - protein, 8 aa, Japanese encephalitis virus
EFATTWHK

SEQ ID NO: 213346 - protein, 8 aa, Japanese encephalitis virus
FATTWHKD

SEQ ID NO: 213347 - protein, 8 aa, Japanese encephalitis virus
ATTWHKDP

SEQ ID NO: 213348 - protein, 8 aa, Japanese encephalitis virus
TTWHKDPE

SEQ ID NO: 213349 - protein, 8 aa, Japanese encephalitis virus
TWHKDPEH

SEQ ID NO: 213350 - protein, 8 aa, Japanese encephalitis virus
WHKDPEHP

SEQ ID NO: 213351 - protein, 8 aa, Japanese encephalitis virus
HKDPEHPY

SEQ ID NO: 213352 - protein, 8 aa, Japanese encephalitis virus
KDPEHPYR

SEQ ID NO: 213353 - protein, 8 aa, Japanese encephalitis virus
DPEHPYRT

SEQ ID NO: 213354 - protein, 8 aa, Japanese encephalitis virus
PEHPYRTW

SEQ ID NO: 213355 - protein, 8 aa, Japanese encephalitis virus
EHPYRTWT

SEQ ID NO: 213356 - protein, 8 aa, Japanese encephalitis virus
HPYRTWTY

SEQ ID NO: 213357 - protein, 8 aa, Japanese encephalitis virus
PYRTWTYH

SEQ ID NO: 213358 - protein, 8 aa, Japanese encephalitis virus
YRTWTYHG

SEQ ID NO: 213359 - protein, 8 aa, Japanese encephalitis virus
RTWTYHGS

SEQ ID NO: 213360 - protein, 8 aa, Japanese encephalitis virus
TWTYHGSY

SEQ ID NO: 213361 - protein, 8 aa, Japanese encephalitis virus
WTYHGSYE

SEQ ID NO: 213362 - protein, 8 aa, Japanese encephalitis virus
TYHGSYEV

SEQ ID NO: 213363 - protein, 8 aa, Japanese encephalitis virus
YHGSYEVK

SEQ ID NO: 213364 - protein, 8 aa, Japanese encephalitis virus
HGSYEVKA

SEQ ID NO: 213365 - protein, 8 aa, Japanese encephalitis virus
GSYEVKAT

SEQ ID NO: 213366 - protein, 8 aa, Japanese encephalitis virus
SYEVKATG

SEQ ID NO: 213367 - protein, 8 aa, Japanese encephalitis virus
YEVKATGS

SEQ ID NO: 213368 - protein, 8 aa, Japanese encephalitis virus
EVKATGSA

SEQ ID NO: 213369 - protein, 8 aa, Japanese encephalitis virus
VKATGSAS

SEQ ID NO: 213370 - protein, 8 aa, Japanese encephalitis virus
KATGSASS

SEQ ID NO: 213371 - protein, 8 aa, Japanese encephalitis virus
ATGSASSL

SEQ ID NO: 213372 - protein, 8 aa, Japanese encephalitis virus
TGSASSLV

SEQ ID NO: 213373 - protein, 8 aa, Japanese encephalitis virus
GSASSLVN

SEQ ID NO: 213374 - protein, 8 aa, Japanese encephalitis virus
SASSLVNG

SEQ ID NO: 213375 - protein, 8 aa, Japanese encephalitis virus
ASSLVNGV

SEQ ID NO: 213376 - protein, 8 aa, Japanese encephalitis virus
SSLVNGVV

SEQ ID NO: 213377 - protein, 8 aa, Japanese encephalitis virus
SLVNGVVK

SEQ ID NO: 213378 - protein, 8 aa, Japanese encephalitis virus
LVNGVVKL

SEQ ID NO: 213379 - protein, 8 aa, Japanese encephalitis virus
VNGVVKLM

SEQ ID NO: 213380 - protein, 8 aa, Japanese encephalitis virus
NGVVKLMS

SEQ ID NO: 213381 - protein, 8 aa, Japanese encephalitis virus
GVVKLMSK

SEQ ID NO: 213382 - protein, 8 aa, Japanese encephalitis virus
VVKLMSKP

SEQ ID NO: 213383 - protein, 8 aa, Japanese encephalitis virus
VKLMSKPW

SEQ ID NO: 213384 - protein, 8 aa, Japanese encephalitis virus
KLMSKPWD

SEQ ID NO: 213385 - protein, 8 aa, Japanese encephalitis virus
LMSKPWDA

SEQ ID NO: 213386 - protein, 8 aa, Japanese encephalitis virus
MSKPWDAI

SEQ ID NO: 213387 - protein, 8 aa, Japanese encephalitis virus
SKPWDAIA

SEQ ID NO: 213388 - protein, 8 aa, Japanese encephalitis virus
KPWDAIAN

SEQ ID NO: 213389 - protein, 8 aa, Japanese encephalitis virus
PWDAIANV

SEQ ID NO: 213390 - protein, 8 aa, Japanese encephalitis virus
WDAIANVT

SEQ ID NO: 213391 - protein, 8 aa, Japanese encephalitis virus
DAIANVTT

SEQ ID NO: 213392 - protein, 8 aa, Japanese encephalitis virus
AIANVTTM

SEQ ID NO: 213393 - protein, 8 aa, Japanese encephalitis virus
IANVTTMA

SEQ ID NO: 213394 - protein, 8 aa, Japanese encephalitis virus
ANVTTMAM

SEQ ID NO: 213395 - protein, 8 aa, Japanese encephalitis virus
NVTTMAMT

SEQ ID NO: 213396 - protein, 8 aa, Japanese encephalitis virus
VTTMAMTD

SEQ ID NO: 213397 - protein, 8 aa, Japanese encephalitis virus
TTMAMTDT

SEQ ID NO: 213398 - protein, 8 aa, Japanese encephalitis virus
TMAMTDTT

SEQ ID NO: 213399 - protein, 8 aa, Japanese encephalitis virus
MAMTDTTP

SEQ ID NO: 213400 - protein, 8 aa, Japanese encephalitis virus
AMTDTTPF

SEQ ID NO: 213401 - protein, 8 aa, Japanese encephalitis virus
MTDTTPFG

SEQ ID NO: 213402 - protein, 8 aa, Japanese encephalitis virus
TDTTPFGQ

SEQ ID NO: 213403 - protein, 8 aa, Japanese encephalitis virus
DTTPFGQQ

SEQ ID NO: 213404 - protein, 8 aa, Japanese encephalitis virus
TTPFGQQR

SEQ ID NO: 213405 - protein, 8 aa, Japanese encephalitis virus
TPFGQQRV

SEQ ID NO: 213406 - protein, 8 aa, Japanese encephalitis virus
PFGQQRVF

SEQ ID NO: 213407 - protein, 8 aa, Japanese encephalitis virus
FGQQRVFK

SEQ ID NO: 213408 - protein, 8 aa, Japanese encephalitis virus
GQQRVFKE

SEQ ID NO: 213409 - protein, 8 aa, Japanese encephalitis virus
QQRVFKEK

SEQ ID NO: 213410 - protein, 8 aa, Japanese encephalitis virus
QRVFKEKV

SEQ ID NO: 213411 - protein, 8 aa, Japanese encephalitis virus
RVFKEKVD

SEQ ID NO: 213412 - protein, 8 aa, Japanese encephalitis virus
VFKEKVDT

SEQ ID NO: 213413 - protein, 8 aa, Japanese encephalitis virus
FKEKVDTK

SEQ ID NO: 213414 - protein, 8 aa, Japanese encephalitis virus
KEKVDTKA

SEQ ID NO: 213415 - protein, 8 aa, Japanese encephalitis virus
EKVDTKAP

SEQ ID NO: 213416 - protein, 8 aa, Japanese encephalitis virus
KVDTKAPE

SEQ ID NO: 213417 - protein, 8 aa, Japanese encephalitis virus
VDTKAPEP

SEQ ID NO: 213418 - protein, 8 aa, Japanese encephalitis virus
DTKAPEPP

SEQ ID NO: 213419 - protein, 8 aa, Japanese encephalitis virus
TKAPEPPA

SEQ ID NO: 213420 - protein, 8 aa, Japanese encephalitis virus
KAPEPPAG

SEQ ID NO: 213421 - protein, 8 aa, Japanese encephalitis virus
APEPPAGA

SEQ ID NO: 213422 - protein, 8 aa, Japanese encephalitis virus
GAKEVLNE

SEQ ID NO: 213423 - protein, 8 aa, Japanese encephalitis virus
AKEVLNET

SEQ ID NO: 213424 - protein, 8 aa, Japanese encephalitis virus
KEVLNETT

SEQ ID NO: 213425 - protein, 8 aa, Japanese encephalitis virus
EVLNETTN

SEQ ID NO: 213426 - protein, 8 aa, Japanese encephalitis virus
VLNETTNW

SEQ ID NO: 213427 - protein, 8 aa, Japanese encephalitis virus
LNETTNWL

SEQ ID NO: 213428 - protein, 8 aa, Japanese encephalitis virus
NETTNWLW

SEQ ID NO: 213429 - protein, 8 aa, Japanese encephalitis virus
ETTNWLWA

SEQ ID NO: 213430 - protein, 8 aa, Japanese encephalitis virus
TTNWLWAH

SEQ ID NO: 213431 - protein, 8 aa, Japanese encephalitis virus
TNWLWAHL

SEQ ID NO: 213432 - protein, 8 aa, Japanese encephalitis virus
NWLWAHLS

SEQ ID NO: 213433 - protein, 8 aa, Japanese encephalitis virus
WLWAHLSR

SEQ ID NO: 213434 - protein, 8 aa, Japanese encephalitis virus
LWAHLSRE

SEQ ID NO: 213435 - protein, 8 aa, Japanese encephalitis virus
WAHLSREK

SEQ ID NO: 213436 - protein, 8 aa, Japanese encephalitis virus
AHLSREKR

SEQ ID NO: 213437 - protein, 8 aa, Japanese encephalitis virus
HLSREKRP

SEQ ID NO: 213438 - protein, 8 aa, Japanese encephalitis virus
LSREKRPR

SEQ ID NO: 213439 - protein, 8 aa, Japanese encephalitis virus
SREKRPRL

SEQ ID NO: 213440 - protein, 8 aa, Japanese encephalitis virus
REKRPRLC

SEQ ID NO: 213441 - protein, 8 aa, Japanese encephalitis virus
EKRPRLCT

SEQ ID NO: 213442 - protein, 8 aa, Japanese encephalitis virus
KRPRLCTK

SEQ ID NO: 213443 - protein, 8 aa, Japanese encephalitis virus
RPRLCTKE

SEQ ID NO: 213444 - protein, 8 aa, Japanese encephalitis virus
PRLCTKEE

SEQ ID NO: 213445 - protein, 8 aa, Japanese encephalitis virus
RLCTKEEF

SEQ ID NO: 213446 - protein, 8 aa, Japanese encephalitis virus
LCTKEEFI

SEQ ID NO: 213447 - protein, 8 aa, Japanese encephalitis virus
CTKEEFIK

SEQ ID NO: 213448 - protein, 8 aa, Japanese encephalitis virus
TKEEFIKK

SEQ ID NO: 213449 - protein, 8 aa, Japanese encephalitis virus
KEEFIKKV

SEQ ID NO: 213450 - protein, 8 aa, Japanese encephalitis virus
EEFIKKVN

SEQ ID NO: 213451 - protein, 8 aa, Japanese encephalitis virus
EFIKKVNS

SEQ ID NO: 213452 - protein, 8 aa, Japanese encephalitis virus
FIKKVNSN

SEQ ID NO: 213453 - protein, 8 aa, Japanese encephalitis virus
IKKVNSNA

SEQ ID NO: 213454 - protein, 8 aa, Japanese encephalitis virus
KVNSNAAL

SEQ ID NO: 213455 - protein, 8 aa, Japanese encephalitis virus
VNSNAALG

SEQ ID NO: 213456 - protein, 8 aa, Japanese encephalitis virus
NSNAALGA

SEQ ID NO: 213457 - protein, 8 aa, Japanese encephalitis virus
SNAALGAV

SEQ ID NO: 213458 - protein, 8 aa, Japanese encephalitis virus
NAALGAVF

SEQ ID NO: 213459 - protein, 8 aa, Japanese encephalitis virus
AALGAVFA

SEQ ID NO: 213460 - protein, 8 aa, Japanese encephalitis virus
ALGAVFAE

SEQ ID NO: 213461 - protein, 8 aa, Japanese encephalitis virus
LGAVFAEQ

SEQ ID NO: 213462 - protein, 8 aa, Japanese encephalitis virus
GAVFAEQN

SEQ ID NO: 213463 - protein, 8 aa, Japanese encephalitis virus
AVFAEQNQ

SEQ ID NO: 213464 - protein, 8 aa, Japanese encephalitis virus
VFAEQNQW

SEQ ID NO: 213465 - protein, 8 aa, Japanese encephalitis virus
FAEQNQWS

SEQ ID NO: 213466 - protein, 8 aa, Japanese encephalitis virus
AEQNQWST

SEQ ID NO: 213467 - protein, 8 aa, Japanese encephalitis virus
EQNQWSTA

SEQ ID NO: 213468 - protein, 8 aa, Japanese encephalitis virus
QNQWSTAR

SEQ ID NO: 213469 - protein, 8 aa, Japanese encephalitis virus
NQWSTARE

SEQ ID NO: 213470 - protein, 8 aa, Japanese encephalitis virus
QWSTAREA

SEQ ID NO: 213471 - protein, 8 aa, Japanese encephalitis virus
WSTAREAV

SEQ ID NO: 213472 - protein, 8 aa, Japanese encephalitis virus
STAREAVD

SEQ ID NO: 213473 - protein, 8 aa, Japanese encephalitis virus
TAREAVDD

SEQ ID NO: 213474 - protein, 8 aa, Japanese encephalitis virus
AREAVDDP

SEQ ID NO: 213475 - protein, 8 aa, Japanese encephalitis virus
DPRFWEMV

SEQ ID NO: 213476 - protein, 8 aa, Japanese encephalitis virus
FWEMVDEE

SEQ ID NO: 213477 - protein, 8 aa, Japanese encephalitis virus
WEMVDEER

SEQ ID NO: 213478 - protein, 8 aa, Japanese encephalitis virus
EMVDEERE

SEQ ID NO: 213479 - protein, 8 aa, Japanese encephalitis virus
MVDEEREN

SEQ ID NO: 213480 - protein, 8 aa, Japanese encephalitis virus
VDEERENH

SEQ ID NO: 213481 - protein, 8 aa, Japanese encephalitis virus
DEERENHL

SEQ ID NO: 213482 - protein, 8 aa, Japanese encephalitis virus
EERENHLR

SEQ ID NO: 213483 - protein, 8 aa, Japanese encephalitis virus
ERENHLRG

SEQ ID NO: 213484 - protein, 8 aa, Japanese encephalitis virus
RENHLRGE

SEQ ID NO: 213485 - protein, 8 aa, Japanese encephalitis virus
ENHLRGEC

SEQ ID NO: 213486 - protein, 8 aa, Japanese encephalitis virus
NHLRGECH

SEQ ID NO: 213487 - protein, 8 aa, Japanese encephalitis virus
HLRGECHT

SEQ ID NO: 213488 - protein, 8 aa, Japanese encephalitis virus
LRGECHTC

SEQ ID NO: 213489 - protein, 8 aa, Japanese encephalitis virus
RGECHTCI

SEQ ID NO: 213490 - protein, 8 aa, Japanese encephalitis virus
GECHTCIY

SEQ ID NO: 213491 - protein, 8 aa, Japanese encephalitis virus
ECHTCIYN

SEQ ID NO: 213492 - protein, 8 aa, Japanese encephalitis virus
CHTCIYNM

SEQ ID NO: 213493 - protein, 8 aa, Japanese encephalitis virus
HTCIYNMM

SEQ ID NO: 213494 - protein, 8 aa, Japanese encephalitis virus
TCIYNMMG

SEQ ID NO: 213495 - protein, 8 aa, Japanese encephalitis virus
CIYNMMGK

SEQ ID NO: 213496 - protein, 8 aa, Japanese encephalitis virus
IYNMMGKR

SEQ ID NO: 213497 - protein, 8 aa, Japanese encephalitis virus
YNMMGKRE

SEQ ID NO: 213498 - protein, 8 aa, Japanese encephalitis virus
NMMGKREK

SEQ ID NO: 213499 - protein, 8 aa, Japanese encephalitis virus
MMGKREKK

SEQ ID NO: 213500 - protein, 8 aa, Japanese encephalitis virus
MGKREKKP

SEQ ID NO: 213501 - protein, 8 aa, Japanese encephalitis virus
GKREKKPG

SEQ ID NO: 213502 - protein, 8 aa, Japanese encephalitis virus
KREKKPGE

SEQ ID NO: 213503 - protein, 8 aa, Japanese encephalitis virus
REKKPGEF

SEQ ID NO: 213504 - protein, 8 aa, Japanese encephalitis virus
EKKPGEFG

SEQ ID NO: 213505 - protein, 8 aa, Japanese encephalitis virus
KKPGEFGK

SEQ ID NO: 213506 - protein, 8 aa, Japanese encephalitis virus
KPGEFGKA

SEQ ID NO: 213507 - protein, 8 aa, Japanese encephalitis virus
PGEFGKAK

SEQ ID NO: 213508 - protein, 8 aa, Japanese encephalitis virus
GEFGKAKG

SEQ ID NO: 213509 - protein, 8 aa, Japanese encephalitis virus
EFGKAKGS

SEQ ID NO: 213510 - protein, 8 aa, Japanese encephalitis virus
FGKAKGSR

SEQ ID NO: 213511 - protein, 8 aa, Japanese encephalitis virus
GKAKGSRA

SEQ ID NO: 213512 - protein, 8 aa, Japanese encephalitis virus
KAKGSRAI

SEQ ID NO: 213513 - protein, 8 aa, Japanese encephalitis virus
AKGSRAIW

SEQ ID NO: 213514 - protein, 8 aa, Japanese encephalitis virus
KGSRAIWF

SEQ ID NO: 213515 - protein, 8 aa, Japanese encephalitis virus
GSRAIWFM

SEQ ID NO: 213516 - protein, 8 aa, Japanese encephalitis virus
SRAIWFMW

SEQ ID NO: 213517 - protein, 8 aa, Japanese encephalitis virus
RAIWFMWL

SEQ ID NO: 213518 - protein, 8 aa, Japanese encephalitis virus
AIWFMWLG

SEQ ID NO: 213519 - protein, 8 aa, Japanese encephalitis virus
IWFMWLGA

SEQ ID NO: 213520 - protein, 8 aa, Japanese encephalitis virus
WFMWLGAR

SEQ ID NO: 213521 - protein, 8 aa, Japanese encephalitis virus
FMWLGARY

SEQ ID NO: 213522 - protein, 8 aa, Japanese encephalitis virus
MWLGARYL

SEQ ID NO: 213523 - protein, 8 aa, Japanese encephalitis virus
WLGARYLE

SEQ ID NO: 213524 - protein, 8 aa, Japanese encephalitis virus
LGARYLEF

SEQ ID NO: 213525 - protein, 8 aa, Japanese encephalitis virus
GARYLEFE

SEQ ID NO: 213526 - protein, 8 aa, Japanese encephalitis virus
ARYLEFEA

SEQ ID NO: 213527 - protein, 8 aa, Japanese encephalitis virus
RYLEFEAL

SEQ ID NO: 213528 - protein, 8 aa, Japanese encephalitis virus
YLEFEALG

SEQ ID NO: 213529 - protein, 8 aa, Japanese encephalitis virus
LEFEALGF

SEQ ID NO: 213530 - protein, 8 aa, Japanese encephalitis virus
EFEALGFL

SEQ ID NO: 213531 - protein, 8 aa, Japanese encephalitis virus
FEALGFLN

SEQ ID NO: 213532 - protein, 8 aa, Japanese encephalitis virus
EALGFLNE

SEQ ID NO: 213533 - protein, 8 aa, Japanese encephalitis virus
ALGFLNED

SEQ ID NO: 213534 - protein, 8 aa, Japanese encephalitis virus
LGFLNEDH

SEQ ID NO: 213535 - protein, 8 aa, Japanese encephalitis virus
GFLNEDHW

SEQ ID NO: 213536 - protein, 8 aa, Japanese encephalitis virus
FLNEDHWL

SEQ ID NO: 213537 - protein, 8 aa, Japanese encephalitis virus
LNEDHWLS

SEQ ID NO: 213538 - protein, 8 aa, Japanese encephalitis virus
NEDHWLSR

SEQ ID NO: 213539 - protein, 8 aa, Japanese encephalitis virus
EDHWLSRE

SEQ ID NO: 213540 - protein, 8 aa, Japanese encephalitis virus
DHWLSREN

SEQ ID NO: 213541 - protein, 8 aa, Japanese encephalitis virus
HWLSRENS

SEQ ID NO: 213542 - protein, 8 aa, Japanese encephalitis virus
WLSRENSG

SEQ ID NO: 213543 - protein, 8 aa, Japanese encephalitis virus
LSRENSGG

SEQ ID NO: 213544 - protein, 8 aa, Japanese encephalitis virus
SRENSGGG

SEQ ID NO: 213545 - protein, 8 aa, Japanese encephalitis virus
RENSGGGV

SEQ ID NO: 213546 - protein, 8 aa, Japanese encephalitis virus
ENSGGGVE

SEQ ID NO: 213547 - protein, 8 aa, Japanese encephalitis virus
NSGGGVEG

SEQ ID NO: 213548 - protein, 8 aa, Japanese encephalitis virus
SGGGVEGS

SEQ ID NO: 213549 - protein, 8 aa, Japanese encephalitis virus
GGGVEGSG

SEQ ID NO: 213550 - protein, 8 aa, Japanese encephalitis virus
GGVEGSGV

SEQ ID NO: 213551 - protein, 8 aa, Japanese encephalitis virus
GVEGSGVQ

SEQ ID NO: 213552 - protein, 8 aa, Japanese encephalitis virus
VEGSGVQK

SEQ ID NO: 213553 - protein, 8 aa, Japanese encephalitis virus
EGSGVQKL

SEQ ID NO: 213554 - protein, 8 aa, Japanese encephalitis virus
GSGVQKLG

SEQ ID NO: 213555 - protein, 8 aa, Japanese encephalitis virus
SGVQKLGY

SEQ ID NO: 213556 - protein, 8 aa, Japanese encephalitis virus
GVQKLGYI

SEQ ID NO: 213557 - protein, 8 aa, Japanese encephalitis virus
VQKLGYIL

SEQ ID NO: 213558 - protein, 8 aa, Japanese encephalitis virus
QKLGYILR

SEQ ID NO: 213559 - protein, 8 aa, Japanese encephalitis virus
KLGYILRD

SEQ ID NO: 213560 - protein, 8 aa, Japanese encephalitis virus
LGYILRDI

SEQ ID NO: 213561 - protein, 8 aa, Japanese encephalitis virus
GYILRDIA

SEQ ID NO: 213562 - protein, 8 aa, Japanese encephalitis virus
RDIAGKQG

SEQ ID NO: 213563 - protein, 8 aa, Japanese encephalitis virus
DIAGKQGG

SEQ ID NO: 213564 - protein, 8 aa, Japanese encephalitis virus
IAGKQGGK

SEQ ID NO: 213565 - protein, 8 aa, Japanese encephalitis virus
AGKQGGKM

SEQ ID NO: 213566 - protein, 8 aa, Japanese encephalitis virus
GKQGGKMY

SEQ ID NO: 213567 - protein, 8 aa, Japanese encephalitis virus
KQGGKMYA

SEQ ID NO: 213568 - protein, 8 aa, Japanese encephalitis virus
QGGKMYAD

SEQ ID NO: 213569 - protein, 8 aa, Japanese encephalitis virus
GGKMYADD

SEQ ID NO: 213570 - protein, 8 aa, Japanese encephalitis virus
GKMYADDT

SEQ ID NO: 213571 - protein, 8 aa, Japanese encephalitis virus
KMYADDTA

SEQ ID NO: 213572 - protein, 8 aa, Japanese encephalitis virus
MYADDTAG

SEQ ID NO: 213573 - protein, 8 aa, Japanese encephalitis virus
YADDTAGW

SEQ ID NO: 213574 - protein, 8 aa, Japanese encephalitis virus
ADDTAGWD

SEQ ID NO: 213575 - protein, 8 aa, Japanese encephalitis virus
DDTAGWDT

SEQ ID NO: 213576 - protein, 8 aa, Japanese encephalitis virus
DTAGWDTR

SEQ ID NO: 213577 - protein, 8 aa, Japanese encephalitis virus
TAGWDTRI

SEQ ID NO: 213578 - protein, 8 aa, Japanese encephalitis virus
AGWDTRIT

SEQ ID NO: 213579 - protein, 8 aa, Japanese encephalitis virus
GWDTRITR

SEQ ID NO: 213580 - protein, 8 aa, Japanese encephalitis virus
WDTRITRT

SEQ ID NO: 213581 - protein, 8 aa, Japanese encephalitis virus
DTRITRTD

SEQ ID NO: 213582 - protein, 8 aa, Japanese encephalitis virus
TRITRTDL

SEQ ID NO: 213583 - protein, 8 aa, Japanese encephalitis virus
RITRTDLE

SEQ ID NO: 213584 - protein, 8 aa, Japanese encephalitis virus
ITRTDLEN

SEQ ID NO: 213585 - protein, 8 aa, Japanese encephalitis virus
TRTDLENE

SEQ ID NO: 213586 - protein, 8 aa, Japanese encephalitis virus
RTDLENEA

SEQ ID NO: 213587 - protein, 8 aa, Japanese encephalitis virus
TDLENEAK

SEQ ID NO: 213588 - protein, 8 aa, Japanese encephalitis virus
DLENEAKV

SEQ ID NO: 213589 - protein, 8 aa, Japanese encephalitis virus
LENEAKVL

SEQ ID NO: 213590 - protein, 8 aa, Japanese encephalitis virus
ENEAKVLE

SEQ ID NO: 213591 - protein, 8 aa, Japanese encephalitis virus
NEAKVLEL

SEQ ID NO: 213592 - protein, 8 aa, Japanese encephalitis virus
EAKVLELL

SEQ ID NO: 213593 - protein, 8 aa, Japanese encephalitis virus
AKVLELLD

SEQ ID NO: 213594 - protein, 8 aa, Japanese encephalitis virus
KVLELLDG

SEQ ID NO: 213595 - protein, 8 aa, Japanese encephalitis virus
VLELLDGE

SEQ ID NO: 213596 - protein, 8 aa, Japanese encephalitis virus
LELLDGEH

SEQ ID NO: 213597 - protein, 8 aa, Japanese encephalitis virus
ELLDGEHR

SEQ ID NO: 213598 - protein, 8 aa, Japanese encephalitis virus
LLDGEHRM

SEQ ID NO: 213599 - protein, 8 aa, Japanese encephalitis virus
LDGEHRML

SEQ ID NO: 213600 - protein, 8 aa, Japanese encephalitis virus
DGEHRMLA

SEQ ID NO: 213601 - protein, 8 aa, Japanese encephalitis virus
GEHRMLAR

SEQ ID NO: 213602 - protein, 8 aa, Japanese encephalitis virus
EHRMLARA

SEQ ID NO: 213603 - protein, 8 aa, Japanese encephalitis virus
HRMLARAI

SEQ ID NO: 213604 - protein, 8 aa, Japanese encephalitis virus
RMLARAII

SEQ ID NO: 213605 - protein, 8 aa, Japanese encephalitis virus
MLARAIIE

SEQ ID NO: 213606 - protein, 8 aa, Japanese encephalitis virus
LARAIIEL

SEQ ID NO: 213607 - protein, 8 aa, Japanese encephalitis virus
ARAIIELT

SEQ ID NO: 213608 - protein, 8 aa, Japanese encephalitis virus
RAIIELTY

SEQ ID NO: 213609 - protein, 8 aa, Japanese encephalitis virus
AIIELTYR

SEQ ID NO: 213610 - protein, 8 aa, Japanese encephalitis virus
IIELTYRH

SEQ ID NO: 213611 - protein, 8 aa, Japanese encephalitis virus
IELTYRHK

SEQ ID NO: 213612 - protein, 8 aa, Japanese encephalitis virus
ELTYRHKV

SEQ ID NO: 213613 - protein, 8 aa, Japanese encephalitis virus
LTYRHKVV

SEQ ID NO: 213614 - protein, 8 aa, Japanese encephalitis virus
TYRHKVVK

SEQ ID NO: 213615 - protein, 8 aa, Japanese encephalitis virus
YRHKVVKV

SEQ ID NO: 213616 - protein, 8 aa, Japanese encephalitis virus
RHKVVKVM

SEQ ID NO: 213617 - protein, 8 aa, Japanese encephalitis virus
HKVVKVMR

SEQ ID NO: 213618 - protein, 8 aa, Japanese encephalitis virus
KVVKVMRP

SEQ ID NO: 213619 - protein, 8 aa, Japanese encephalitis virus
VVKVMRPA

SEQ ID NO: 213620 - protein, 8 aa, Japanese encephalitis virus
VKVMRPAA

SEQ ID NO: 213621 - protein, 8 aa, Japanese encephalitis virus
KVMRPAAE

SEQ ID NO: 213622 - protein, 8 aa, Japanese encephalitis virus
VMRPAAEG

SEQ ID NO: 213623 - protein, 8 aa, Japanese encephalitis virus
MRPAAEGK

SEQ ID NO: 213624 - protein, 8 aa, Japanese encephalitis virus
RPAAEGKT

SEQ ID NO: 213625 - protein, 8 aa, Japanese encephalitis virus
PAAEGKTV

SEQ ID NO: 213626 - protein, 8 aa, Japanese encephalitis virus
AAEGKTVM

SEQ ID NO: 213627 - protein, 8 aa, Japanese encephalitis virus
EGKTVMDV

SEQ ID NO: 213628 - protein, 8 aa, Japanese encephalitis virus
GKTVMDVI

SEQ ID NO: 213629 - protein, 8 aa, Japanese encephalitis virus
KTVMDVIS

SEQ ID NO: 213630 - protein, 8 aa, Japanese encephalitis virus
TVMDVISR

SEQ ID NO: 213631 - protein, 8 aa, Japanese encephalitis virus
VMDVISRE

SEQ ID NO: 213632 - protein, 8 aa, Japanese encephalitis virus
MDVISRED

SEQ ID NO: 213633 - protein, 8 aa, Japanese encephalitis virus
DVISREDQ

SEQ ID NO: 213634 - protein, 8 aa, Japanese encephalitis virus
VISREDQR

SEQ ID NO: 213635 - protein, 8 aa, Japanese encephalitis virus
ISREDQRG

SEQ ID NO: 213636 - protein, 8 aa, Japanese encephalitis virus
SREDQRGS

SEQ ID NO: 213637 - protein, 8 aa, Japanese encephalitis virus
REDQRGSG

SEQ ID NO: 213638 - protein, 8 aa, Japanese encephalitis virus
EDQRGSGQ

SEQ ID NO: 213639 - protein, 8 aa, Japanese encephalitis virus
DQRGSGQV

SEQ ID NO: 213640 - protein, 8 aa, Japanese encephalitis virus
QRGSGQVV

SEQ ID NO: 213641 - protein, 8 aa, Japanese encephalitis virus
RGSGQVVT

SEQ ID NO: 213642 - protein, 8 aa, Japanese encephalitis virus
GSGQVVTY

SEQ ID NO: 213643 - protein, 8 aa, Japanese encephalitis virus
SGQVVTYA

SEQ ID NO: 213644 - protein, 8 aa, Japanese encephalitis virus
GQVVTYAL

SEQ ID NO: 213645 - protein, 8 aa, Japanese encephalitis virus
QVVTYALN

SEQ ID NO: 213646 - protein, 8 aa, Japanese encephalitis virus
VVTYALNT

SEQ ID NO: 213647 - protein, 8 aa, Japanese encephalitis virus
VTYALNTF

SEQ ID NO: 213648 - protein, 8 aa, Japanese encephalitis virus
TYALNTFT

SEQ ID NO: 213649 - protein, 8 aa, Japanese encephalitis virus
YALNTFTN

SEQ ID NO: 213650 - protein, 8 aa, Japanese encephalitis virus
ALNTFTNI

SEQ ID NO: 213651 - protein, 8 aa, Japanese encephalitis virus
LNTFTNIA

SEQ ID NO: 213652 - protein, 8 aa, Japanese encephalitis virus
NTFTNIAV

SEQ ID NO: 213653 - protein, 8 aa, Japanese encephalitis virus
TFTNIAVQ

SEQ ID NO: 213654 - protein, 8 aa, Japanese encephalitis virus
FTNIAVQL

SEQ ID NO: 213655 - protein, 8 aa, Japanese encephalitis virus
TNIAVQLV

SEQ ID NO: 213656 - protein, 8 aa, Japanese encephalitis virus
NIAVQLVR

SEQ ID NO: 213657 - protein, 8 aa, Japanese encephalitis virus
IAVQLVRL

SEQ ID NO: 213658 - protein, 8 aa, Japanese encephalitis virus
AVQLVRLM

SEQ ID NO: 213659 - protein, 8 aa, Japanese encephalitis virus
VQLVRLME

SEQ ID NO: 213660 - protein, 8 aa, Japanese encephalitis virus
QLVRLMEA

SEQ ID NO: 213661 - protein, 8 aa, Japanese encephalitis virus
LVRLMEAE

SEQ ID NO: 213662 - protein, 8 aa, Japanese encephalitis virus
VRLMEAEG

SEQ ID NO: 213663 - protein, 8 aa, Japanese encephalitis virus
RLMEAEGV

SEQ ID NO: 213664 - protein, 8 aa, Japanese encephalitis virus
LMEAEGVI

SEQ ID NO: 213665 - protein, 8 aa, Japanese encephalitis virus
MEAEGVIG

SEQ ID NO: 213666 - protein, 8 aa, Japanese encephalitis virus
EAEGVIGP

SEQ ID NO: 213667 - protein, 8 aa, Japanese encephalitis virus
AEGVIGPQ

SEQ ID NO: 213668 - protein, 8 aa, Japanese encephalitis virus
EGVIGPQH

SEQ ID NO: 213669 - protein, 8 aa, Japanese encephalitis virus
GVIGPQHL

SEQ ID NO: 213670 - protein, 8 aa, Japanese encephalitis virus
VIGPQHLE

SEQ ID NO: 213671 - protein, 8 aa, Japanese encephalitis virus
IGPQHLEQ

SEQ ID NO: 213672 - protein, 8 aa, Japanese encephalitis virus
GPQHLEQL

SEQ ID NO: 213673 - protein, 8 aa, Japanese encephalitis virus
PQHLEQLP

SEQ ID NO: 213674 - protein, 8 aa, Japanese encephalitis virus
QHLEQLPR

SEQ ID NO: 213675 - protein, 8 aa, Japanese encephalitis virus
HLEQLPRK

SEQ ID NO: 213676 - protein, 8 aa, Japanese encephalitis virus
EQLPRKNK

SEQ ID NO: 213677 - protein, 8 aa, Japanese encephalitis virus
QLPRKNKI

SEQ ID NO: 213678 - protein, 8 aa, Japanese encephalitis virus
LPRKNKIA

SEQ ID NO: 213679 - protein, 8 aa, Japanese encephalitis virus
PRKNKIAV

SEQ ID NO: 213680 - protein, 8 aa, Japanese encephalitis virus
RKNKIAVR

SEQ ID NO: 213681 - protein, 8 aa, Japanese encephalitis virus
KNKIAVRT

SEQ ID NO: 213682 - protein, 8 aa, Japanese encephalitis virus
NKIAVRTW

SEQ ID NO: 213683 - protein, 8 aa, Japanese encephalitis virus
KIAVRTWL

SEQ ID NO: 213684 - protein, 8 aa, Japanese encephalitis virus
IAVRTWLF

SEQ ID NO: 213685 - protein, 8 aa, Japanese encephalitis virus
AVRTWLFE

SEQ ID NO: 213686 - protein, 8 aa, Japanese encephalitis virus
VRTWLFEN

SEQ ID NO: 213687 - protein, 8 aa, Japanese encephalitis virus
RTWLFENG

SEQ ID NO: 213688 - protein, 8 aa, Japanese encephalitis virus
TWLFENGE

SEQ ID NO: 213689 - protein, 8 aa, Japanese encephalitis virus
WLFENGEE

SEQ ID NO: 213690 - protein, 8 aa, Japanese encephalitis virus
LFENGEER

SEQ ID NO: 213691 - protein, 8 aa, Japanese encephalitis virus
FENGEERV

SEQ ID NO: 213692 - protein, 8 aa, Japanese encephalitis virus
ENGEERVT

SEQ ID NO: 213693 - protein, 8 aa, Japanese encephalitis virus
NGEERVTR

SEQ ID NO: 213694 - protein, 8 aa, Japanese encephalitis virus
GEERVTRM

SEQ ID NO: 213695 - protein, 8 aa, Japanese encephalitis virus
EERVTRMA

SEQ ID NO: 213696 - protein, 8 aa, Japanese encephalitis virus
ERVTRMAI

SEQ ID NO: 213697 - protein, 8 aa, Japanese encephalitis virus
RVTRMAIS

SEQ ID NO: 213698 - protein, 8 aa, Japanese encephalitis virus
VTRMAISG

SEQ ID NO: 213699 - protein, 8 aa, Japanese encephalitis virus
TRMAISGD

SEQ ID NO: 213700 - protein, 8 aa, Japanese encephalitis virus
RMAISGDD

SEQ ID NO: 213701 - protein, 8 aa, Japanese encephalitis virus
MAISGDDC

SEQ ID NO: 213702 - protein, 8 aa, Japanese encephalitis virus
AISGDDCV

SEQ ID NO: 213703 - protein, 8 aa, Japanese encephalitis virus
ISGDDCVV

SEQ ID NO: 213704 - protein, 8 aa, Japanese encephalitis virus
SGDDCVVK

SEQ ID NO: 213705 - protein, 8 aa, Japanese encephalitis virus
GDDCVVKP

SEQ ID NO: 213706 - protein, 8 aa, Japanese encephalitis virus
DDCVVKPL

SEQ ID NO: 213707 - protein, 8 aa, Japanese encephalitis virus
DCVVKPLD

SEQ ID NO: 213708 - protein, 8 aa, Japanese encephalitis virus
CVVKPLDD

SEQ ID NO: 213709 - protein, 8 aa, Japanese encephalitis virus
VVKPLDDR

SEQ ID NO: 213710 - protein, 8 aa, Japanese encephalitis virus
VKPLDDRF

SEQ ID NO: 213711 - protein, 8 aa, Japanese encephalitis virus
KPLDDRFA

SEQ ID NO: 213712 - protein, 8 aa, Japanese encephalitis virus
PLDDRFAT

SEQ ID NO: 213713 - protein, 8 aa, Japanese encephalitis virus
LDDRFATA

SEQ ID NO: 213714 - protein, 8 aa, Japanese encephalitis virus
DDRFATAL

SEQ ID NO: 213715 - protein, 8 aa, Japanese encephalitis virus
DRFATALH

SEQ ID NO: 213716 - protein, 8 aa, Japanese encephalitis virus
RFATALHF

SEQ ID NO: 213717 - protein, 8 aa, Japanese encephalitis virus
FATALHFL

SEQ ID NO: 213718 - protein, 8 aa, Japanese encephalitis virus
ATALHFLN

SEQ ID NO: 213719 - protein, 8 aa, Japanese encephalitis virus
TALHFLNA

SEQ ID NO: 213720 - protein, 8 aa, Japanese encephalitis virus
ALHFLNAM

SEQ ID NO: 213721 - protein, 8 aa, Japanese encephalitis virus
LHFLNAMS

SEQ ID NO: 213722 - protein, 8 aa, Japanese encephalitis virus
HFLNAMSK

SEQ ID NO: 213723 - protein, 8 aa, Japanese encephalitis virus
FLNAMSKV

SEQ ID NO: 213724 - protein, 8 aa, Japanese encephalitis virus
LNAMSKVR

SEQ ID NO: 213725 - protein, 8 aa, Japanese encephalitis virus
NAMSKVRK

SEQ ID NO: 213726 - protein, 8 aa, Japanese encephalitis virus
AMSKVRKD

SEQ ID NO: 213727 - protein, 8 aa, Japanese encephalitis virus
MSKVRKDI

SEQ ID NO: 213728 - protein, 8 aa, Japanese encephalitis virus
SKVRKDIQ

SEQ ID NO: 213729 - protein, 8 aa, Japanese encephalitis virus
KVRKDIQE

SEQ ID NO: 213730 - protein, 8 aa, Japanese encephalitis virus
VRKDIQEW

SEQ ID NO: 213731 - protein, 8 aa, Japanese encephalitis virus
RKDIQEWK

SEQ ID NO: 213732 - protein, 8 aa, Japanese encephalitis virus
KDIQEWKP

SEQ ID NO: 213733 - protein, 8 aa, Japanese encephalitis virus
DIQEWKPS

SEQ ID NO: 213734 - protein, 8 aa, Japanese encephalitis virus
IQEWKPSH

SEQ ID NO: 213735 - protein, 8 aa, Japanese encephalitis virus
QEWKPSHG

SEQ ID NO: 213736 - protein, 8 aa, Japanese encephalitis virus
EWKPSHGW

SEQ ID NO: 213737 - protein, 8 aa, Japanese encephalitis virus
WKPSHGWH

SEQ ID NO: 213738 - protein, 8 aa, Japanese encephalitis virus
KPSHGWHD

SEQ ID NO: 213739 - protein, 8 aa, Japanese encephalitis virus
PSHGWHDW

SEQ ID NO: 213740 - protein, 8 aa, Japanese encephalitis virus
SHGWHDWQ

SEQ ID NO: 213741 - protein, 8 aa, Japanese encephalitis virus
HGWHDWQQ

SEQ ID NO: 213742 - protein, 8 aa, Japanese encephalitis virus
GWHDWQQV

SEQ ID NO: 213743 - protein, 8 aa, Japanese encephalitis virus
WHDWQQVP

SEQ ID NO: 213744 - protein, 8 aa, Japanese encephalitis virus
HDWQQVPF

SEQ ID NO: 213745 - protein, 8 aa, Japanese encephalitis virus
DWQQVPFC

SEQ ID NO: 213746 - protein, 8 aa, Japanese encephalitis virus
WQQVPFCS

SEQ ID NO: 213747 - protein, 8 aa, Japanese encephalitis virus
QQVPFCSN

SEQ ID NO: 213748 - protein, 8 aa, Japanese encephalitis virus
QVPFCSNH

SEQ ID NO: 213749 - protein, 8 aa, Japanese encephalitis virus
VPFCSNHF

SEQ ID NO: 213750 - protein, 8 aa, Japanese encephalitis virus
PFCSNHFQ

SEQ ID NO: 213751 - protein, 8 aa, Japanese encephalitis virus
FCSNHFQE

SEQ ID NO: 213752 - protein, 8 aa, Japanese encephalitis virus
CSNHFQEI

SEQ ID NO: 213753 - protein, 8 aa, Japanese encephalitis virus
SNHFQEIV

SEQ ID NO: 213754 - protein, 8 aa, Japanese encephalitis virus
NHFQEIVM

SEQ ID NO: 213755 - protein, 8 aa, Japanese encephalitis virus
HFQEIVMK

SEQ ID NO: 213756 - protein, 8 aa, Japanese encephalitis virus
FQEIVMKD

SEQ ID NO: 213757 - protein, 8 aa, Japanese encephalitis virus
QEIVMKDG

SEQ ID NO: 213758 - protein, 8 aa, Japanese encephalitis virus
EIVMKDGR

SEQ ID NO: 213759 - protein, 8 aa, Japanese encephalitis virus
IVMKDGRS

SEQ ID NO: 213760 - protein, 8 aa, Japanese encephalitis virus
VMKDGRSI

SEQ ID NO: 213761 - protein, 8 aa, Japanese encephalitis virus
MKDGRSIV

SEQ ID NO: 213762 - protein, 8 aa, Japanese encephalitis virus
KDGRSIVV

SEQ ID NO: 213763 - protein, 8 aa, Japanese encephalitis virus
DGRSIVVP

SEQ ID NO: 213764 - protein, 8 aa, Japanese encephalitis virus
GRSIVVPC

SEQ ID NO: 213765 - protein, 8 aa, Japanese encephalitis virus
RSIVVPCR

SEQ ID NO: 213766 - protein, 8 aa, Japanese encephalitis virus
SIVVPCRG

SEQ ID NO: 213767 - protein, 8 aa, Japanese encephalitis virus
IVVPCRGQ

SEQ ID NO: 213768 - protein, 8 aa, Japanese encephalitis virus
VVPCRGQD

SEQ ID NO: 213769 - protein, 8 aa, Japanese encephalitis virus
VPCRGQDE

SEQ ID NO: 213770 - protein, 8 aa, Japanese encephalitis virus
PCRGQDEL

SEQ ID NO: 213771 - protein, 8 aa, Japanese encephalitis virus
CRGQDELI

SEQ ID NO: 213772 - protein, 8 aa, Japanese encephalitis virus
RGQDELIG

SEQ ID NO: 213773 - protein, 8 aa, Japanese encephalitis virus
GQDELIGR

SEQ ID NO: 213774 - protein, 8 aa, Japanese encephalitis virus
QDELIGRA

SEQ ID NO: 213775 - protein, 8 aa, Japanese encephalitis virus
DELIGRAR

SEQ ID NO: 213776 - protein, 8 aa, Japanese encephalitis virus
ELIGRARI

SEQ ID NO: 213777 - protein, 8 aa, Japanese encephalitis virus
LIGRARIS

SEQ ID NO: 213778 - protein, 8 aa, Japanese encephalitis virus
IGRARISP

SEQ ID NO: 213779 - protein, 8 aa, Japanese encephalitis virus
GRARISPG

SEQ ID NO: 213780 - protein, 8 aa, Japanese encephalitis virus
RARISPGA

SEQ ID NO: 213781 - protein, 8 aa, Japanese encephalitis virus
ARISPGAG

SEQ ID NO: 213782 - protein, 8 aa, Japanese encephalitis virus
RISPGAGW

SEQ ID NO: 213783 - protein, 8 aa, Japanese encephalitis virus
ISPGAGWN

SEQ ID NO: 213784 - protein, 8 aa, Japanese encephalitis virus
SPGAGWNV

SEQ ID NO: 213785 - protein, 8 aa, Japanese encephalitis virus
PGAGWNVK

SEQ ID NO: 213786 - protein, 8 aa, Japanese encephalitis virus
GAGWNVKD

SEQ ID NO: 213787 - protein, 8 aa, Japanese encephalitis virus
AGWNVKDT

SEQ ID NO: 213788 - protein, 8 aa, Japanese encephalitis virus
GWNVKDTA

SEQ ID NO: 213789 - protein, 8 aa, Japanese encephalitis virus
WNVKDTAC

SEQ ID NO: 213790 - protein, 8 aa, Japanese encephalitis virus
NVKDTACL

SEQ ID NO: 213791 - protein, 8 aa, Japanese encephalitis virus
VKDTACLA

SEQ ID NO: 213792 - protein, 8 aa, Japanese encephalitis virus
KDTACLAK

SEQ ID NO: 213793 - protein, 8 aa, Japanese encephalitis virus
DTACLAKA

SEQ ID NO: 213794 - protein, 8 aa, Japanese encephalitis virus
TACLAKAY

SEQ ID NO: 213795 - protein, 8 aa, Japanese encephalitis virus
ACLAKAYA

SEQ ID NO: 213796 - protein, 8 aa, Japanese encephalitis virus
CLAKAYAQ

SEQ ID NO: 213797 - protein, 8 aa, Japanese encephalitis virus
LAKAYAQM

SEQ ID NO: 213798 - protein, 8 aa, Japanese encephalitis virus
AKAYAQMW

SEQ ID NO: 213799 - protein, 8 aa, Japanese encephalitis virus
KAYAQMWL

SEQ ID NO: 213800 - protein, 8 aa, Japanese encephalitis virus
AYAQMWLL

SEQ ID NO: 213801 - protein, 8 aa, Japanese encephalitis virus
YAQMWLLL

SEQ ID NO: 213802 - protein, 8 aa, Japanese encephalitis virus
AQMWLLLY

SEQ ID NO: 213803 - protein, 8 aa, Japanese encephalitis virus
QMWLLLYF

SEQ ID NO: 213804 - protein, 8 aa, Japanese encephalitis virus
MWLLLYFH

SEQ ID NO: 213805 - protein, 8 aa, Japanese encephalitis virus
WLLLYFHR

SEQ ID NO: 213806 - protein, 8 aa, Japanese encephalitis virus
LLLYFHRR

SEQ ID NO: 213807 - protein, 8 aa, Japanese encephalitis virus
LLYFHRRD

SEQ ID NO: 213808 - protein, 8 aa, Japanese encephalitis virus
LYFHRRDL

SEQ ID NO: 213809 - protein, 8 aa, Japanese encephalitis virus
YFHRRDLR

SEQ ID NO: 213810 - protein, 8 aa, Japanese encephalitis virus
FHRRDLRL

SEQ ID NO: 213811 - protein, 8 aa, Japanese encephalitis virus
HRRDLRLM

SEQ ID NO: 213812 - protein, 8 aa, Japanese encephalitis virus
RRDLRLMA

SEQ ID NO: 213813 - protein, 8 aa, Japanese encephalitis virus
RDLRLMAN

SEQ ID NO: 213814 - protein, 8 aa, Japanese encephalitis virus
DLRLMANA

SEQ ID NO: 213815 - protein, 8 aa, Japanese encephalitis virus
LRLMANAI

SEQ ID NO: 213816 - protein, 8 aa, Japanese encephalitis virus
RLMANAIC

SEQ ID NO: 213817 - protein, 8 aa, Japanese encephalitis virus
LMANAICS

SEQ ID NO: 213818 - protein, 8 aa, Japanese encephalitis virus
MANAICSA

SEQ ID NO: 213819 - protein, 8 aa, Japanese encephalitis virus
ANAICSAV

SEQ ID NO: 213820 - protein, 8 aa, Japanese encephalitis virus
NAICSAVP

SEQ ID NO: 213821 - protein, 8 aa, Japanese encephalitis virus
AICSAVPV

SEQ ID NO: 213822 - protein, 8 aa, Japanese encephalitis virus
ICSAVPVD

SEQ ID NO: 213823 - protein, 8 aa, Japanese encephalitis virus
CSAVPVDW

SEQ ID NO: 213824 - protein, 8 aa, Japanese encephalitis virus
SAVPVDWV

SEQ ID NO: 213825 - protein, 8 aa, Japanese encephalitis virus
AVPVDWVP

SEQ ID NO: 213826 - protein, 8 aa, Japanese encephalitis virus
VPVDWVPT

SEQ ID NO: 213827 - protein, 8 aa, Japanese encephalitis virus
PVDWVPTG

SEQ ID NO: 213828 - protein, 8 aa, Japanese encephalitis virus
VDWVPTGR

SEQ ID NO: 213829 - protein, 8 aa, Japanese encephalitis virus
DWVPTGRT

SEQ ID NO: 213830 - protein, 8 aa, Japanese encephalitis virus
WVPTGRTS

SEQ ID NO: 213831 - protein, 8 aa, Japanese encephalitis virus
VPTGRTSW

SEQ ID NO: 213832 - protein, 8 aa, Japanese encephalitis virus
PTGRTSWS

SEQ ID NO: 213833 - protein, 8 aa, Japanese encephalitis virus
TGRTSWSI

SEQ ID NO: 213834 - protein, 8 aa, Japanese encephalitis virus
GRTSWSIH

SEQ ID NO: 213835 - protein, 8 aa, Japanese encephalitis virus
RTSWSIHS

SEQ ID NO: 213836 - protein, 8 aa, Japanese encephalitis virus
TSWSIHSK

SEQ ID NO: 213837 - protein, 8 aa, Japanese encephalitis virus
SWSIHSKG

SEQ ID NO: 213838 - protein, 8 aa, Japanese encephalitis virus
WSIHSKGE

SEQ ID NO: 213839 - protein, 8 aa, Japanese encephalitis virus
SIHSKGEW

SEQ ID NO: 213840 - protein, 8 aa, Japanese encephalitis virus
IHSKGEWM

SEQ ID NO: 213841 - protein, 8 aa, Japanese encephalitis virus
HSKGEWMT

SEQ ID NO: 213842 - protein, 8 aa, Japanese encephalitis virus
SKGEWMTT

SEQ ID NO: 213843 - protein, 8 aa, Japanese encephalitis virus
KGEWMTTE

SEQ ID NO: 213844 - protein, 8 aa, Japanese encephalitis virus
GEWMTTED

SEQ ID NO: 213845 - protein, 8 aa, Japanese encephalitis virus
EWMTTEDM

SEQ ID NO: 213846 - protein, 8 aa, Japanese encephalitis virus
WMTTEDML

SEQ ID NO: 213847 - protein, 8 aa, Japanese encephalitis virus
MTTEDMLQ

SEQ ID NO: 213848 - protein, 8 aa, Japanese encephalitis virus
TTEDMLQV

SEQ ID NO: 213849 - protein, 8 aa, Japanese encephalitis virus
TEDMLQVW

SEQ ID NO: 213850 - protein, 8 aa, Japanese encephalitis virus
EDMLQVWN

SEQ ID NO: 213851 - protein, 8 aa, Japanese encephalitis virus
DMLQVWNR

SEQ ID NO: 213852 - protein, 8 aa, Japanese encephalitis virus
MLQVWNRV

SEQ ID NO: 213853 - protein, 8 aa, Japanese encephalitis virus
LQVWNRVW

SEQ ID NO: 213854 - protein, 8 aa, Japanese encephalitis virus
QVWNRVWI

SEQ ID NO: 213855 - protein, 8 aa, Japanese encephalitis virus
VWNRVWIE

SEQ ID NO: 213856 - protein, 8 aa, Japanese encephalitis virus
WNRVWIEE

SEQ ID NO: 213857 - protein, 8 aa, Japanese encephalitis virus
NRVWIEEN

SEQ ID NO: 213858 - protein, 8 aa, Japanese encephalitis virus
RVWIEENE

SEQ ID NO: 213859 - protein, 8 aa, Japanese encephalitis virus
VWIEENEW

SEQ ID NO: 213860 - protein, 8 aa, Japanese encephalitis virus
WIEENEWM

SEQ ID NO: 213861 - protein, 8 aa, Japanese encephalitis virus
IEENEWMM

SEQ ID NO: 213862 - protein, 8 aa, Japanese encephalitis virus
EENEWMMD

SEQ ID NO: 213863 - protein, 8 aa, Japanese encephalitis virus
ENEWMMDK

SEQ ID NO: 213864 - protein, 8 aa, Japanese encephalitis virus
NEWMMDKT

SEQ ID NO: 213865 - protein, 8 aa, Japanese encephalitis virus
EWMMDKTP

SEQ ID NO: 213866 - protein, 8 aa, Japanese encephalitis virus
DKTPITSW

SEQ ID NO: 213867 - protein, 8 aa, Japanese encephalitis virus
KTPITSWT

SEQ ID NO: 213868 - protein, 8 aa, Japanese encephalitis virus
TPITSWTD

SEQ ID NO: 213869 - protein, 8 aa, Japanese encephalitis virus
PITSWTDV

SEQ ID NO: 213870 - protein, 8 aa, Japanese encephalitis virus
ITSWTDVP

SEQ ID NO: 213871 - protein, 8 aa, Japanese encephalitis virus
TSWTDVPY

SEQ ID NO: 213872 - protein, 8 aa, Japanese encephalitis virus
SWTDVPYV

SEQ ID NO: 213873 - protein, 8 aa, Japanese encephalitis virus
WTDVPYVG

SEQ ID NO: 213874 - protein, 8 aa, Japanese encephalitis virus
TDVPYVGK

SEQ ID NO: 213875 - protein, 8 aa, Japanese encephalitis virus
DVPYVGKR

SEQ ID NO: 213876 - protein, 8 aa, Japanese encephalitis virus
VPYVGKRE

SEQ ID NO: 213877 - protein, 8 aa, Japanese encephalitis virus
PYVGKRED

SEQ ID NO: 213878 - protein, 8 aa, Japanese encephalitis virus
YVGKREDI

SEQ ID NO: 213879 - protein, 8 aa, Japanese encephalitis virus
VGKREDIW

SEQ ID NO: 213880 - protein, 8 aa, Japanese encephalitis virus
GKREDIWC

SEQ ID NO: 213881 - protein, 8 aa, Japanese encephalitis virus
KREDIWCG

SEQ ID NO: 213882 - protein, 8 aa, Japanese encephalitis virus
REDIWCGS

SEQ ID NO: 213883 - protein, 8 aa, Japanese encephalitis virus
EDIWCGSL

SEQ ID NO: 213884 - protein, 8 aa, Japanese encephalitis virus
DIWCGSLI

SEQ ID NO: 213885 - protein, 8 aa, Japanese encephalitis virus
IWCGSLIG

SEQ ID NO: 213886 - protein, 8 aa, Japanese encephalitis virus
WCGSLIGT

SEQ ID NO: 213887 - protein, 8 aa, Japanese encephalitis virus
CGSLIGTR

SEQ ID NO: 213888 - protein, 8 aa, Japanese encephalitis virus
GSLIGTRS

SEQ ID NO: 213889 - protein, 8 aa, Japanese encephalitis virus
SLIGTRSR

SEQ ID NO: 213890 - protein, 8 aa, Japanese encephalitis virus
LIGTRSRA

SEQ ID NO: 213891 - protein, 8 aa, Japanese encephalitis virus
IGTRSRAT

SEQ ID NO: 213892 - protein, 8 aa, Japanese encephalitis virus
GTRSRATW

SEQ ID NO: 213893 - protein, 8 aa, Japanese encephalitis virus
TRSRATWA

SEQ ID NO: 213894 - protein, 8 aa, Japanese encephalitis virus
RSRATWAE

SEQ ID NO: 213895 - protein, 8 aa, Japanese encephalitis virus
SRATWAEN

SEQ ID NO: 213896 - protein, 8 aa, Japanese encephalitis virus
RATWAENI

SEQ ID NO: 213897 - protein, 8 aa, Japanese encephalitis virus
ATWAENIY

SEQ ID NO: 213898 - protein, 8 aa, Japanese encephalitis virus
TWAENIYA

SEQ ID NO: 213899 - protein, 8 aa, Japanese encephalitis virus
WAENIYAA

SEQ ID NO: 213900 - protein, 8 aa, Japanese encephalitis virus
AENIYAAI

SEQ ID NO: 213901 - protein, 8 aa, Japanese encephalitis virus
ENIYAAIN

SEQ ID NO: 213902 - protein, 8 aa, Japanese encephalitis virus
NIYAAINQ

SEQ ID NO: 213903 - protein, 8 aa, Japanese encephalitis virus
IYAAINQV

SEQ ID NO: 213904 - protein, 8 aa, Japanese encephalitis virus
YAAINQVR

SEQ ID NO: 213905 - protein, 8 aa, Japanese encephalitis virus
AAINQVRA

SEQ ID NO: 213906 - protein, 8 aa, Japanese encephalitis virus
AINQVRAV

SEQ ID NO: 213907 - protein, 8 aa, Japanese encephalitis virus
INQVRAVI

SEQ ID NO: 213908 - protein, 8 aa, Japanese encephalitis virus
NQVRAVIG

SEQ ID NO: 213909 - protein, 8 aa, Japanese encephalitis virus
QVRAVIGK

SEQ ID NO: 213910 - protein, 8 aa, Japanese encephalitis virus
VRAVIGKE

SEQ ID NO: 213911 - protein, 8 aa, Japanese encephalitis virus
RAVIGKEN

SEQ ID NO: 213912 - protein, 8 aa, Japanese encephalitis virus
AVIGKENY

SEQ ID NO: 213913 - protein, 8 aa, Japanese encephalitis virus
VIGKENYV

SEQ ID NO: 213914 - protein, 8 aa, Japanese encephalitis virus
IGKENYVD

SEQ ID NO: 213915 - protein, 8 aa, Japanese encephalitis virus
GKENYVDY

SEQ ID NO: 213916 - protein, 8 aa, Japanese encephalitis virus
KENYVDYM

SEQ ID NO: 213917 - protein, 8 aa, Japanese encephalitis virus
ENYVDYMT

SEQ ID NO: 213918 - protein, 8 aa, Japanese encephalitis virus
NYVDYMTS

SEQ ID NO: 213919 - protein, 8 aa, Japanese encephalitis virus
YVDYMTSL

SEQ ID NO: 213920 - protein, 8 aa, Japanese encephalitis virus
VDYMTSLR

SEQ ID NO: 213921 - protein, 8 aa, Japanese encephalitis virus
DYMTSLRR

SEQ ID NO: 213922 - protein, 8 aa, Japanese encephalitis virus
YMTSLRRY

SEQ ID NO: 213923 - protein, 8 aa, Japanese encephalitis virus
MTSLRRYE

SEQ ID NO: 213924 - protein, 8 aa, Japanese encephalitis virus
TSLRRYED

SEQ ID NO: 213925 - protein, 8 aa, Japanese encephalitis virus
SLRRYEDV

SEQ ID NO: 213926 - protein, 8 aa, Japanese encephalitis virus
LRRYEDVL

SEQ ID NO: 213927 - protein, 8 aa, Japanese encephalitis virus
RRYEDVLI

SEQ ID NO: 213928 - protein, 8 aa, Japanese encephalitis virus
RYEDVLIQ

SEQ ID NO: 213929 - protein, 8 aa, Japanese encephalitis virus
YEDVLIQE

SEQ ID NO: 213930 - protein, 8 aa, Japanese encephalitis virus
EDVLIQED

SEQ ID NO: 213931 - protein, 8 aa, Japanese encephalitis virus
DVLIQEDR

SEQ ID NO: 213932 - protein, 8 aa, Japanese encephalitis virus
VLIQEDRV

SEQ ID NO: 213933 - protein, 8 aa, Japanese encephalitis virus
LIQEDRVI

SEQ ID NO: 213934 - protein, 8 aa, Japanese encephalitis virus
MTKKPRGP

SEQ ID NO: 213935 - protein, 8 aa, Japanese encephalitis virus
TKKPRGPG

SEQ ID NO: 213936 - protein, 8 aa, Japanese encephalitis virus
KKPGGPGR

SEQ ID NO: 213937 - protein, 8 aa, Japanese encephalitis virus
KPGGPGRN

SEQ ID NO: 213938 - protein, 8 aa, Japanese encephalitis virus
PGGPGRNR

SEQ ID NO: 213939 - protein, 8 aa, Japanese encephalitis virus
GGPGRNRA

SEQ ID NO: 213940 - protein, 8 aa, Japanese encephalitis virus
GPGRNRAI

SEQ ID NO: 213941 - protein, 8 aa, Japanese encephalitis virus
PGRNRAIN

SEQ ID NO: 213942 - protein, 8 aa, Japanese encephalitis virus
GRNRAINM

SEQ ID NO: 213943 - protein, 8 aa, Japanese encephalitis virus
RNRAINML

SEQ ID NO: 213944 - protein, 8 aa, Japanese encephalitis virus
SRAINMLK

SEQ ID NO: 213945 - protein, 8 aa, Japanese encephalitis virus
RAIYMLKR

SEQ ID NO: 213946 - protein, 8 aa, Japanese encephalitis virus
AIYMLKRG

SEQ ID NO: 213947 - protein, 8 aa, Japanese encephalitis virus
IYMLKRGL

SEQ ID NO: 213948 - protein, 8 aa, Japanese encephalitis virus
YMLKRGLP

SEQ ID NO: 213949 - protein, 8 aa, Japanese encephalitis virus
PRVFPLVR

SEQ ID NO: 213950 - protein, 8 aa, Japanese encephalitis virus
RVFPLVRV

SEQ ID NO: 213951 - protein, 8 aa, Japanese encephalitis virus
VFPLVRVK

SEQ ID NO: 213952 - protein, 8 aa, Japanese encephalitis virus
FPLVGVKK

SEQ ID NO: 213953 - protein, 8 aa, Japanese encephalitis virus
PLVGVKKV

SEQ ID NO: 213954 - protein, 8 aa, Japanese encephalitis virus
LVGVKKVV

SEQ ID NO: 213955 - protein, 8 aa, Japanese encephalitis virus
VGVKKVVM

SEQ ID NO: 213956 - protein, 8 aa, Japanese encephalitis virus
GVKKVVMS

SEQ ID NO: 213957 - protein, 8 aa, Japanese encephalitis virus
VKRVVISL

SEQ ID NO: 213958 - protein, 8 aa, Japanese encephalitis virus
KKVVMSLL

SEQ ID NO: 213959 - protein, 8 aa, Japanese encephalitis virus
RVVISLLD

SEQ ID NO: 213960 - protein, 8 aa, Japanese encephalitis virus
VVISLLDG

SEQ ID NO: 213961 - protein, 8 aa, Japanese encephalitis virus
VISLLDGI

SEQ ID NO: 213962 - protein, 8 aa, Japanese encephalitis virus
ISLLDGIG

SEQ ID NO: 213963 - protein, 8 aa, Japanese encephalitis virus
SLLDGIGP

SEQ ID NO: 213964 - protein, 8 aa, Japanese encephalitis virus
LLDGRGPA

SEQ ID NO: 213965 - protein, 8 aa, Japanese encephalitis virus
LDGRGPAR

SEQ ID NO: 213966 - protein, 8 aa, Japanese encephalitis virus
DGRGPARF

SEQ ID NO: 213967 - protein, 8 aa, Japanese encephalitis virus
GRGPARFV

SEQ ID NO: 213968 - protein, 8 aa, Japanese encephalitis virus
RGPARFVL

SEQ ID NO: 213969 - protein, 8 aa, Japanese encephalitis virus
GPARFVLA

SEQ ID NO: 213970 - protein, 8 aa, Japanese encephalitis virus
PARFVLAL

SEQ ID NO: 213971 - protein, 8 aa, Japanese encephalitis virus
ARFVLALI

SEQ ID NO: 213972 - protein, 8 aa, Japanese encephalitis virus
RFVLALTT

SEQ ID NO: 213973 - protein, 8 aa, Japanese encephalitis virus
FVLALTTF

SEQ ID NO: 213974 - protein, 8 aa, Japanese encephalitis virus
VLALTTFF

SEQ ID NO: 213975 - protein, 8 aa, Japanese encephalitis virus
LALTTFFK

SEQ ID NO: 213976 - protein, 8 aa, Japanese encephalitis virus
ALTTFFKF

SEQ ID NO: 213977 - protein, 8 aa, Japanese encephalitis virus
LTTFFKFT

SEQ ID NO: 213978 - protein, 8 aa, Japanese encephalitis virus
TTFFKFTA

SEQ ID NO: 213979 - protein, 8 aa, Japanese encephalitis virus
SFFKFTAL

SEQ ID NO: 213980 - protein, 8 aa, Japanese encephalitis virus
FFKFTALS

SEQ ID NO: 213981 - protein, 8 aa, Japanese encephalitis virus
FKFTALSP

SEQ ID NO: 213982 - protein, 8 aa, Japanese encephalitis virus
KFTALSPT

SEQ ID NO: 213983 - protein, 8 aa, Japanese encephalitis virus
FTALSPTK

SEQ ID NO: 213984 - protein, 8 aa, Japanese encephalitis virus
TALSPTKA

SEQ ID NO: 213985 - protein, 8 aa, Japanese encephalitis virus
ALSPTKAL

SEQ ID NO: 213986 - protein, 8 aa, Japanese encephalitis virus
LAPTKALS

SEQ ID NO: 213987 - protein, 8 aa, Japanese encephalitis virus
APTKALSG

SEQ ID NO: 213988 - protein, 8 aa, Japanese encephalitis virus
PTKALSGR

SEQ ID NO: 213989 - protein, 8 aa, Japanese encephalitis virus
TKALSGRW

SEQ ID NO: 213990 - protein, 8 aa, Japanese encephalitis virus
KALLGRWR

SEQ ID NO: 213991 - protein, 8 aa, Japanese encephalitis virus
ALLGRWRA

SEQ ID NO: 213992 - protein, 8 aa, Japanese encephalitis virus
LLGRWRAV

SEQ ID NO: 213993 - protein, 8 aa, Japanese encephalitis virus
LGRWRAVE

SEQ ID NO: 213994 - protein, 8 aa, Japanese encephalitis virus
GRWRAVEK

SEQ ID NO: 213995 - protein, 8 aa, Japanese encephalitis virus
RWRAVEKS

SEQ ID NO: 213996 - protein, 8 aa, Japanese encephalitis virus
WRAVEKSV

SEQ ID NO: 213997 - protein, 8 aa, Japanese encephalitis virus
RAVEKSVA

SEQ ID NO: 213998 - protein, 8 aa, Japanese encephalitis virus
ALEKSVAM

SEQ ID NO: 213999 - protein, 8 aa, Japanese encephalitis virus
VERSVAMK

SEQ ID NO: 214000 - protein, 8 aa, Japanese encephalitis virus
ERSVAMKH

SEQ ID NO: 214001 - protein, 8 aa, Japanese encephalitis virus
RSVAMKHL

SEQ ID NO: 214002 - protein, 8 aa, Japanese encephalitis virus
KHLTSFKG

SEQ ID NO: 214003 - protein, 8 aa, Japanese encephalitis virus
HLTSFKGE

SEQ ID NO: 214004 - protein, 8 aa, Japanese encephalitis virus
LTSFKGEL

SEQ ID NO: 214005 - protein, 8 aa, Japanese encephalitis virus
TSFKGELG

SEQ ID NO: 214006 - protein, 8 aa, Japanese encephalitis virus
SFKRELGI

SEQ ID NO: 214007 - protein, 8 aa, Japanese encephalitis virus
FKRELGIL

SEQ ID NO: 214008 - protein, 8 aa, Japanese encephalitis virus
KGELGTLI

SEQ ID NO: 214009 - protein, 8 aa, Japanese encephalitis virus
GELGTLID

SEQ ID NO: 214010 - protein, 8 aa, Japanese encephalitis virus
ELGTLIDT

SEQ ID NO: 214011 - protein, 8 aa, Japanese encephalitis virus
LGTLIDTV

SEQ ID NO: 214012 - protein, 8 aa, Japanese encephalitis virus
GILIDAVN

SEQ ID NO: 214013 - protein, 8 aa, Japanese encephalitis virus
TLIDTVNK

SEQ ID NO: 214014 - protein, 8 aa, Japanese encephalitis virus
LIDVVNKR

SEQ ID NO: 214015 - protein, 8 aa, Japanese encephalitis virus
IDTVNKRG

SEQ ID NO: 214016 - protein, 8 aa, Japanese encephalitis virus
DAVNKRGK

SEQ ID NO: 214017 - protein, 8 aa, Japanese encephalitis virus
AVNKRGKK

SEQ ID NO: 214018 - protein, 8 aa, Japanese encephalitis virus
VNKRGKKQ

SEQ ID NO: 214019 - protein, 8 aa, Japanese encephalitis virus
NKRGKKQN

SEQ ID NO: 214020 - protein, 8 aa, Japanese encephalitis virus
KRGKKQNK

SEQ ID NO: 214021 - protein, 8 aa, Japanese encephalitis virus
RGKKQNKR

SEQ ID NO: 214022 - protein, 8 aa, Japanese encephalitis virus
GKKQNKRG

SEQ ID NO: 214023 - protein, 8 aa, Japanese encephalitis virus
KKQNKRGG

SEQ ID NO: 214024 - protein, 8 aa, Japanese encephalitis virus
KRNKRGGN

SEQ ID NO: 214025 - protein, 8 aa, Japanese encephalitis virus
RNKRGGNE

SEQ ID NO: 214026 - protein, 8 aa, Japanese encephalitis virus
NKRGGNES

SEQ ID NO: 214027 - protein, 8 aa, Japanese encephalitis virus
IMWLTSLA

SEQ ID NO: 214028 - protein, 8 aa, Japanese encephalitis virus
VGAMKLSN

SEQ ID NO: 214029 - protein, 8 aa, Japanese encephalitis virus
GAMRLSNF

SEQ ID NO: 214030 - protein, 8 aa, Japanese encephalitis virus
AMRLSNFQ

SEQ ID NO: 214031 - protein, 8 aa, Japanese encephalitis virus
MRLSNFQG

SEQ ID NO: 214032 - protein, 8 aa, Japanese encephalitis virus
RLSNFQGK

SEQ ID NO: 214033 - protein, 8 aa, Japanese encephalitis virus
FQGKLLMA

SEQ ID NO: 214034 - protein, 8 aa, Japanese encephalitis virus
QGKLLMTV

SEQ ID NO: 214035 - protein, 8 aa, Japanese encephalitis virus
GKLLMTVN

SEQ ID NO: 214036 - protein, 8 aa, Japanese encephalitis virus
KLLMTVNN

SEQ ID NO: 214037 - protein, 8 aa, Japanese encephalitis virus
LLMTVNNT

SEQ ID NO: 214038 - protein, 8 aa, Japanese encephalitis virus
LMTVNNTD

SEQ ID NO: 214039 - protein, 8 aa, Japanese encephalitis virus
MTVNNTDI

SEQ ID NO: 214040 - protein, 8 aa, Japanese encephalitis virus
TVNNTDIA

SEQ ID NO: 214041 - protein, 8 aa, Japanese encephalitis virus
VNNTDIAD

SEQ ID NO: 214042 - protein, 8 aa, Japanese encephalitis virus
VRAIDVGH

SEQ ID NO: 214043 - protein, 8 aa, Japanese encephalitis virus
RAIDVGHM

SEQ ID NO: 214044 - protein, 8 aa, Japanese encephalitis virus
AIDVGYLC

SEQ ID NO: 214045 - protein, 8 aa, Japanese encephalitis virus
IDVGYLCE

SEQ ID NO: 214046 - protein, 8 aa, Japanese encephalitis virus
DVGHMCED

SEQ ID NO: 214047 - protein, 8 aa, Japanese encephalitis virus
VGYLCEDT

SEQ ID NO: 214048 - protein, 8 aa, Japanese encephalitis virus
GYLCEDTI

SEQ ID NO: 214049 - protein, 8 aa, Japanese encephalitis virus
HMCEDTIT

SEQ ID NO: 214050 - protein, 8 aa, Japanese encephalitis virus
LCEDTITY

SEQ ID NO: 214051 - protein, 8 aa, Japanese encephalitis virus
TYECPKLA

SEQ ID NO: 214052 - protein, 8 aa, Japanese encephalitis virus
VGNDPEDV

SEQ ID NO: 214053 - protein, 8 aa, Japanese encephalitis virus
GNDPQDVD

SEQ ID NO: 214054 - protein, 8 aa, Japanese encephalitis virus
NDPQDVDC

SEQ ID NO: 214055 - protein, 8 aa, Japanese encephalitis virus
DPQDVDCW

SEQ ID NO: 214056 - protein, 8 aa, Japanese encephalitis virus
PQDVDCWC

SEQ ID NO: 214057 - protein, 8 aa, Japanese encephalitis virus
QDVDCWCD

SEQ ID NO: 214058 - protein, 8 aa, Japanese encephalitis virus
DVDCWCDH

SEQ ID NO: 214059 - protein, 8 aa, Japanese encephalitis virus
VDCWCDHQ

SEQ ID NO: 214060 - protein, 8 aa, Japanese encephalitis virus
DCWCDNQQ

SEQ ID NO: 214061 - protein, 8 aa, Japanese encephalitis virus
CWCDNQQV

SEQ ID NO: 214062 - protein, 8 aa, Japanese encephalitis virus
WCDNQQVY

SEQ ID NO: 214063 - protein, 8 aa, Japanese encephalitis virus
CDNQQVYV

SEQ ID NO: 214064 - protein, 8 aa, Japanese encephalitis virus
DNQQVYVQ

SEQ ID NO: 214065 - protein, 8 aa, Japanese encephalitis virus
NQQVYVQY

SEQ ID NO: 214066 - protein, 8 aa, Japanese encephalitis virus
QQVYVQYG

SEQ ID NO: 214067 - protein, 8 aa, Japanese encephalitis virus
QVYVQYGP

SEQ ID NO: 214068 - protein, 8 aa, Japanese encephalitis virus
VYVQYGPC

SEQ ID NO: 214069 - protein, 8 aa, Japanese encephalitis virus
YVQYGPCT

SEQ ID NO: 214070 - protein, 8 aa, Japanese encephalitis virus
VQYGPCTR

SEQ ID NO: 214071 - protein, 8 aa, Japanese encephalitis virus
QYGPCTRT

SEQ ID NO: 214072 - protein, 8 aa, Japanese encephalitis virus
YGPCTRTR

SEQ ID NO: 214073 - protein, 8 aa, Japanese encephalitis virus
GPCTRTRH

SEQ ID NO: 214074 - protein, 8 aa, Japanese encephalitis virus
PCTRTRHS

SEQ ID NO: 214075 - protein, 8 aa, Japanese encephalitis virus
CTRTSHSQ

SEQ ID NO: 214076 - protein, 8 aa, Japanese encephalitis virus
TRTSHSQT

SEQ ID NO: 214077 - protein, 8 aa, Japanese encephalitis virus
RTRHSKRT

SEQ ID NO: 214078 - protein, 8 aa, Japanese encephalitis virus
TRHSKRTR

SEQ ID NO: 214079 - protein, 8 aa, Japanese encephalitis virus
RHSKRTRR

SEQ ID NO: 214080 - protein, 8 aa, Japanese encephalitis virus
HSKRTRRS

SEQ ID NO: 214081 - protein, 8 aa, Japanese encephalitis virus
SKRTRRSV

SEQ ID NO: 214082 - protein, 8 aa, Japanese encephalitis virus
KRTRRSVS

SEQ ID NO: 214083 - protein, 8 aa, Japanese encephalitis virus
RTRRSVSV

SEQ ID NO: 214084 - protein, 8 aa, Japanese encephalitis virus
TRRSVSVQ

SEQ ID NO: 214085 - protein, 8 aa, Japanese encephalitis virus
RRSVSVHT

SEQ ID NO: 214086 - protein, 8 aa, Japanese encephalitis virus
RSVSVHTH

SEQ ID NO: 214087 - protein, 8 aa, Japanese encephalitis virus
SVSVQPNG

SEQ ID NO: 214088 - protein, 8 aa, Japanese encephalitis virus
VSVQPNGE

SEQ ID NO: 214089 - protein, 8 aa, Japanese encephalitis virus
SVQPNGER

SEQ ID NO: 214090 - protein, 8 aa, Japanese encephalitis virus
VHTHGESS

SEQ ID NO: 214091 - protein, 8 aa, Japanese encephalitis virus
HTHGESSL

SEQ ID NO: 214092 - protein, 8 aa, Japanese encephalitis virus
PNGERSLV

SEQ ID NO: 214093 - protein, 8 aa, Japanese encephalitis virus
HGESSLEN

SEQ ID NO: 214094 - protein, 8 aa, Japanese encephalitis virus
GERSLVNK

SEQ ID NO: 214095 - protein, 8 aa, Japanese encephalitis virus
ESSLENKK

SEQ ID NO: 214096 - protein, 8 aa, Japanese encephalitis virus
SSLVNKKK

SEQ ID NO: 214097 - protein, 8 aa, Japanese encephalitis virus
SLVNKKKA

SEQ ID NO: 214098 - protein, 8 aa, Japanese encephalitis virus
LVNKKKAW

SEQ ID NO: 214099 - protein, 8 aa, Japanese encephalitis virus
VNKKKAWL

SEQ ID NO: 214100 - protein, 8 aa, Japanese encephalitis virus
NKKEAWLN

SEQ ID NO: 214101 - protein, 8 aa, Japanese encephalitis virus
KKEAWLNS

SEQ ID NO: 214102 - protein, 8 aa, Japanese encephalitis virus
KKAWLDST

SEQ ID NO: 214103 - protein, 8 aa, Japanese encephalitis virus
EAWLNSTK

SEQ ID NO: 214104 - protein, 8 aa, Japanese encephalitis virus
AWLDSTRA

SEQ ID NO: 214105 - protein, 8 aa, Japanese encephalitis virus
WLDSTRAT

SEQ ID NO: 214106 - protein, 8 aa, Japanese encephalitis virus
LDSTRATR

SEQ ID NO: 214107 - protein, 8 aa, Japanese encephalitis virus
DSTRATRY

SEQ ID NO: 214108 - protein, 8 aa, Japanese encephalitis virus
STRATRYL

SEQ ID NO: 214109 - protein, 8 aa, Japanese encephalitis virus
TKATRYLT

SEQ ID NO: 214110 - protein, 8 aa, Japanese encephalitis virus
KATRYLTK

SEQ ID NO: 214111 - protein, 8 aa, Japanese encephalitis virus
ATRYLTKT

SEQ ID NO: 214112 - protein, 8 aa, Japanese encephalitis virus
TRYLTKTE

SEQ ID NO: 214113 - protein, 8 aa, Japanese encephalitis virus
RYLTKTEN

SEQ ID NO: 214114 - protein, 8 aa, Japanese encephalitis virus
YLTKTENW

SEQ ID NO: 214115 - protein, 8 aa, Japanese encephalitis virus
LTKTENWI

SEQ ID NO: 214116 - protein, 8 aa, Japanese encephalitis virus
TKTENWII

SEQ ID NO: 214117 - protein, 8 aa, Japanese encephalitis virus
KTENWIVR

SEQ ID NO: 214118 - protein, 8 aa, Japanese encephalitis virus
TENWIVRN

SEQ ID NO: 214119 - protein, 8 aa, Japanese encephalitis virus
ENWIVRNP

SEQ ID NO: 214120 - protein, 8 aa, Japanese encephalitis virus
NWIVRNPG

SEQ ID NO: 214121 - protein, 8 aa, Japanese encephalitis virus
WIVRNPGY

SEQ ID NO: 214122 - protein, 8 aa, Japanese encephalitis virus
IVRNPGYA

SEQ ID NO: 214123 - protein, 8 aa, Japanese encephalitis virus
VRNPGYAF

SEQ ID NO: 214124 - protein, 8 aa, Japanese encephalitis virus
PGYAFLAV

SEQ ID NO: 214125 - protein, 8 aa, Japanese encephalitis virus
ALGWMLGS

SEQ ID NO: 214126 - protein, 8 aa, Japanese encephalitis virus
LGWMLGST

SEQ ID NO: 214127 - protein, 8 aa, Japanese encephalitis virus
GWMLGSNS

SEQ ID NO: 214128 - protein, 8 aa, Japanese encephalitis virus
WMLGSNSG

SEQ ID NO: 214129 - protein, 8 aa, Japanese encephalitis virus
GHRVVFTI

SEQ ID NO: 214130 - protein, 8 aa, Japanese encephalitis virus
HRVVFTIL

SEQ ID NO: 214131 - protein, 8 aa, Japanese encephalitis virus
RVVFTILP

SEQ ID NO: 214132 - protein, 8 aa, Japanese encephalitis virus
LGFTILLL

SEQ ID NO: 214133 - protein, 8 aa, Japanese encephalitis virus
GFTILLLL

SEQ ID NO: 214134 - protein, 8 aa, Japanese encephalitis virus
FTILPLLV

SEQ ID NO: 214135 - protein, 8 aa, Japanese encephalitis virus
TILPLLVA

SEQ ID NO: 214136 - protein, 8 aa, Japanese encephalitis virus
ILPLLVAP

SEQ ID NO: 214137 - protein, 8 aa, Japanese encephalitis virus
LPLLVAPA

SEQ ID NO: 214138 - protein, 8 aa, Japanese encephalitis virus
PLLVAPAY

SEQ ID NO: 214139 - protein, 8 aa, Japanese encephalitis virus
VAPAYSFT

SEQ ID NO: 214140 - protein, 8 aa, Japanese encephalitis virus
APAYSFTC

SEQ ID NO: 214141 - protein, 8 aa, Japanese encephalitis virus
PAYSFTCL

SEQ ID NO: 214142 - protein, 8 aa, Japanese encephalitis virus
AYSFTCLG

SEQ ID NO: 214143 - protein, 8 aa, Japanese encephalitis virus
YSFTCLGM

SEQ ID NO: 214144 - protein, 8 aa, Japanese encephalitis virus
SFTCLGMG

SEQ ID NO: 214145 - protein, 8 aa, Japanese encephalitis virus
FTCLGMGN

SEQ ID NO: 214146 - protein, 8 aa, Japanese encephalitis virus
TCLGMGNR

SEQ ID NO: 214147 - protein, 8 aa, Japanese encephalitis virus
GMGNRDFV

SEQ ID NO: 214148 - protein, 8 aa, Japanese encephalitis virus
MGNRDFIQ

SEQ ID NO: 214149 - protein, 8 aa, Japanese encephalitis virus
GNRDFIQG

SEQ ID NO: 214150 - protein, 8 aa, Japanese encephalitis virus
NRDFIEGV

SEQ ID NO: 214151 - protein, 8 aa, Japanese encephalitis virus
RDFIERAS

SEQ ID NO: 214152 - protein, 8 aa, Japanese encephalitis virus
DFIEGVSG

SEQ ID NO: 214153 - protein, 8 aa, Japanese encephalitis virus
FIEGVSGA

SEQ ID NO: 214154 - protein, 8 aa, Japanese encephalitis virus
VEGASGAT

SEQ ID NO: 214155 - protein, 8 aa, Japanese encephalitis virus
QGASGATW

SEQ ID NO: 214156 - protein, 8 aa, Japanese encephalitis virus
GVSGATWV

SEQ ID NO: 214157 - protein, 8 aa, Japanese encephalitis virus
VSGATWVD

SEQ ID NO: 214158 - protein, 8 aa, Japanese encephalitis virus
SCLTIMAS

SEQ ID NO: 214159 - protein, 8 aa, Japanese encephalitis virus
CLTIMASD

SEQ ID NO: 214160 - protein, 8 aa, Japanese encephalitis virus
LTIMASDK

SEQ ID NO: 214161 - protein, 8 aa, Japanese encephalitis virus
TIMASDKP

SEQ ID NO: 214162 - protein, 8 aa, Japanese encephalitis virus
IMASDKPT

SEQ ID NO: 214163 - protein, 8 aa, Japanese encephalitis virus
MASDKPTL

SEQ ID NO: 214164 - protein, 8 aa, Japanese encephalitis virus
ASDKPTLD

SEQ ID NO: 214165 - protein, 8 aa, Japanese encephalitis virus
SDKPTLDV

SEQ ID NO: 214166 - protein, 8 aa, Japanese encephalitis virus
DRPTLDVR

SEQ ID NO: 214167 - protein, 8 aa, Japanese encephalitis virus
RPTLDVRM

SEQ ID NO: 214168 - protein, 8 aa, Japanese encephalitis virus
PTLDRRMI

SEQ ID NO: 214169 - protein, 8 aa, Japanese encephalitis virus
TLDVRMTN

SEQ ID NO: 214170 - protein, 8 aa, Japanese encephalitis virus
LDVRMTNI

SEQ ID NO: 214171 - protein, 8 aa, Japanese encephalitis virus
DRRMINIE

SEQ ID NO: 214172 - protein, 8 aa, Japanese encephalitis virus
VRMTNIEA

SEQ ID NO: 214173 - protein, 8 aa, Japanese encephalitis virus
RMINIEAV

SEQ ID NO: 214174 - protein, 8 aa, Japanese encephalitis virus
MINIEAVQ

SEQ ID NO: 214175 - protein, 8 aa, Japanese encephalitis virus
INIEAVQL

SEQ ID NO: 214176 - protein, 8 aa, Japanese encephalitis virus
NIEAVQLA

SEQ ID NO: 214177 - protein, 8 aa, Japanese encephalitis virus
IEAVQLAE

SEQ ID NO: 214178 - protein, 8 aa, Japanese encephalitis virus
EAVQLAEV

SEQ ID NO: 214179 - protein, 8 aa, Japanese encephalitis virus
AVQLAEVR

SEQ ID NO: 214180 - protein, 8 aa, Japanese encephalitis virus
VQLAEVRS

SEQ ID NO: 214181 - protein, 8 aa, Japanese encephalitis virus
LAEVRSYY

SEQ ID NO: 214182 - protein, 8 aa, Japanese encephalitis virus
AEVRSYYY

SEQ ID NO: 214183 - protein, 8 aa, Japanese encephalitis virus
EVRSYYYH

SEQ ID NO: 214184 - protein, 8 aa, Japanese encephalitis virus
VRSYCYRA

SEQ ID NO: 214185 - protein, 8 aa, Japanese encephalitis virus
RSYYYHAS

SEQ ID NO: 214186 - protein, 8 aa, Japanese encephalitis virus
SYCYRASV

SEQ ID NO: 214187 - protein, 8 aa, Japanese encephalitis virus
YCYRASVT

SEQ ID NO: 214188 - protein, 8 aa, Japanese encephalitis virus
CYRASVTD

SEQ ID NO: 214189 - protein, 8 aa, Japanese encephalitis virus
YRASVTDI

SEQ ID NO: 214190 - protein, 8 aa, Japanese encephalitis virus
RASVTDIS

SEQ ID NO: 214191 - protein, 8 aa, Japanese encephalitis virus
STVARCPM

SEQ ID NO: 214192 - protein, 8 aa, Japanese encephalitis virus
TVARCPMT

SEQ ID NO: 214193 - protein, 8 aa, Japanese encephalitis virus
VARCPMTG

SEQ ID NO: 214194 - protein, 8 aa, Japanese encephalitis virus
ARCPMTGE

SEQ ID NO: 214195 - protein, 8 aa, Japanese encephalitis virus
RCPMTGEA

SEQ ID NO: 214196 - protein, 8 aa, Japanese encephalitis virus
CPMTGEAH

SEQ ID NO: 214197 - protein, 8 aa, Japanese encephalitis virus
PMTGEAHN

SEQ ID NO: 214198 - protein, 8 aa, Japanese encephalitis virus
MTGEAHNE

SEQ ID NO: 214199 - protein, 8 aa, Japanese encephalitis virus
TGEAHNKK

SEQ ID NO: 214200 - protein, 8 aa, Japanese encephalitis virus
GEAHNEKQ

SEQ ID NO: 214201 - protein, 8 aa, Japanese encephalitis virus
EAHNEKGA

SEQ ID NO: 214202 - protein, 8 aa, Japanese encephalitis virus
AHNKKRAD

SEQ ID NO: 214203 - protein, 8 aa, Japanese encephalitis virus
HNKKRADS

SEQ ID NO: 214204 - protein, 8 aa, Japanese encephalitis virus
NEKGADSS

SEQ ID NO: 214205 - protein, 8 aa, Japanese encephalitis virus
EKQADSSY

SEQ ID NO: 214206 - protein, 8 aa, Japanese encephalitis virus
KQADSSYV

SEQ ID NO: 214207 - protein, 8 aa, Japanese encephalitis virus
GADSSYVC

SEQ ID NO: 214208 - protein, 8 aa, Japanese encephalitis virus
GFTDRGWR

SEQ ID NO: 214209 - protein, 8 aa, Japanese encephalitis virus
FTDRGWRN

SEQ ID NO: 214210 - protein, 8 aa, Japanese encephalitis virus
TDRGWRNG

SEQ ID NO: 214211 - protein, 8 aa, Japanese encephalitis virus
DRGWGKGC

SEQ ID NO: 214212 - protein, 8 aa, Japanese encephalitis virus
RGWGKGCG

SEQ ID NO: 214213 - protein, 8 aa, Japanese encephalitis virus
GWGNGCGF

SEQ ID NO: 214214 - protein, 8 aa, Japanese encephalitis virus
WGNGCGFF

SEQ ID NO: 214215 - protein, 8 aa, Japanese encephalitis virus
GNGCGFFG

SEQ ID NO: 214216 - protein, 8 aa, Japanese encephalitis virus
NGCGFFGK

SEQ ID NO: 214217 - protein, 8 aa, Japanese encephalitis virus
GCGFFGKG

SEQ ID NO: 214218 - protein, 8 aa, Japanese encephalitis virus
CGFFGKGS

SEQ ID NO: 214219 - protein, 8 aa, Japanese encephalitis virus
GFFGKGSI

SEQ ID NO: 214220 - protein, 8 aa, Japanese encephalitis virus
FFGKGSID

SEQ ID NO: 214221 - protein, 8 aa, Japanese encephalitis virus
SGKGSIDT

SEQ ID NO: 214222 - protein, 8 aa, Japanese encephalitis virus
CAKFSCTR

SEQ ID NO: 214223 - protein, 8 aa, Japanese encephalitis virus
AKFSCTRK

SEQ ID NO: 214224 - protein, 8 aa, Japanese encephalitis virus
KFSCTRKA

SEQ ID NO: 214225 - protein, 8 aa, Japanese encephalitis virus
FSCTRKAI

SEQ ID NO: 214226 - protein, 8 aa, Japanese encephalitis virus
SCTRKAIG

SEQ ID NO: 214227 - protein, 8 aa, Japanese encephalitis virus
CTRKAIGR

SEQ ID NO: 214228 - protein, 8 aa, Japanese encephalitis virus
KAIGRMIQ

SEQ ID NO: 214229 - protein, 8 aa, Japanese encephalitis virus
MIQPENIK

SEQ ID NO: 214230 - protein, 8 aa, Japanese encephalitis virus
IQPENSKY

SEQ ID NO: 214231 - protein, 8 aa, Japanese encephalitis virus
QPENIKYK

SEQ ID NO: 214232 - protein, 8 aa, Japanese encephalitis virus
PENIKYKV

SEQ ID NO: 214233 - protein, 8 aa, Japanese encephalitis virus
ENIKYKVG

SEQ ID NO: 214234 - protein, 8 aa, Japanese encephalitis virus
NIKYKVGI

SEQ ID NO: 214235 - protein, 8 aa, Japanese encephalitis virus
IKYKVGIF

SEQ ID NO: 214236 - protein, 8 aa, Japanese encephalitis virus
KYKVGIFV

SEQ ID NO: 214237 - protein, 8 aa, Japanese encephalitis virus
YKVGIFVH

SEQ ID NO: 214238 - protein, 8 aa, Japanese encephalitis virus
KVGIFVHG

SEQ ID NO: 214239 - protein, 8 aa, Japanese encephalitis virus
VGIFVHGA

SEQ ID NO: 214240 - protein, 8 aa, Japanese encephalitis virus
GIFVHGAT

SEQ ID NO: 214241 - protein, 8 aa, Japanese encephalitis virus
IFVHGATT

SEQ ID NO: 214242 - protein, 8 aa, Japanese encephalitis virus
FVHGATTS

SEQ ID NO: 214243 - protein, 8 aa, Japanese encephalitis virus
VHGATTSE

SEQ ID NO: 214244 - protein, 8 aa, Japanese encephalitis virus
HGATTSEN

SEQ ID NO: 214245 - protein, 8 aa, Japanese encephalitis virus
GATTSENH

SEQ ID NO: 214246 - protein, 8 aa, Japanese encephalitis virus
ATTSENHG

SEQ ID NO: 214247 - protein, 8 aa, Japanese encephalitis virus
SENHGNYT

SEQ ID NO: 214248 - protein, 8 aa, Japanese encephalitis virus
ENHGNYTA

SEQ ID NO: 214249 - protein, 8 aa, Japanese encephalitis virus
NHGNYTAQ

SEQ ID NO: 214250 - protein, 8 aa, Japanese encephalitis virus
HGNYTAQI

SEQ ID NO: 214251 - protein, 8 aa, Japanese encephalitis virus
GNYTAQIG

SEQ ID NO: 214252 - protein, 8 aa, Japanese encephalitis virus
NYSAQVGT

SEQ ID NO: 214253 - protein, 8 aa, Japanese encephalitis virus
YSAQVGTS

SEQ ID NO: 214254 - protein, 8 aa, Japanese encephalitis virus
SAQVGTSQ

SEQ ID NO: 214255 - protein, 8 aa, Japanese encephalitis virus
AQVGTSQA

SEQ ID NO: 214256 - protein, 8 aa, Japanese encephalitis virus
QVGTSQAA

SEQ ID NO: 214257 - protein, 8 aa, Japanese encephalitis virus
VGTSQAAK

SEQ ID NO: 214258 - protein, 8 aa, Japanese encephalitis virus
GTSQAAKF

SEQ ID NO: 214259 - protein, 8 aa, Japanese encephalitis virus
TSQAAKFT

SEQ ID NO: 214260 - protein, 8 aa, Japanese encephalitis virus
SQAAKFTI

SEQ ID NO: 214261 - protein, 8 aa, Japanese encephalitis virus
QAAKFTIT

SEQ ID NO: 214262 - protein, 8 aa, Japanese encephalitis virus
AAKFTITP

SEQ ID NO: 214263 - protein, 8 aa, Japanese encephalitis virus
AKFTITPN

SEQ ID NO: 214264 - protein, 8 aa, Japanese encephalitis virus
KFTITPNA

SEQ ID NO: 214265 - protein, 8 aa, Japanese encephalitis virus
FTITPNAP

SEQ ID NO: 214266 - protein, 8 aa, Japanese encephalitis virus
TITPNAPS

SEQ ID NO: 214267 - protein, 8 aa, Japanese encephalitis virus
VTPNAPSV

SEQ ID NO: 214268 - protein, 8 aa, Japanese encephalitis virus
TPNAPSTT

SEQ ID NO: 214269 - protein, 8 aa, Japanese encephalitis virus
PNAPSTTL

SEQ ID NO: 214270 - protein, 8 aa, Japanese encephalitis virus
NAPSTTLK

SEQ ID NO: 214271 - protein, 8 aa, Japanese encephalitis virus
APSTTLKL

SEQ ID NO: 214272 - protein, 8 aa, Japanese encephalitis virus
PSTTLKLG

SEQ ID NO: 214273 - protein, 8 aa, Japanese encephalitis virus
STTLKLGD

SEQ ID NO: 214274 - protein, 8 aa, Japanese encephalitis virus
ALKLGDYG

SEQ ID NO: 214275 - protein, 8 aa, Japanese encephalitis virus
LKLGDFGE

SEQ ID NO: 214276 - protein, 8 aa, Japanese encephalitis virus
KLGDFGEV

SEQ ID NO: 214277 - protein, 8 aa, Japanese encephalitis virus
LGDFGEVT

SEQ ID NO: 214278 - protein, 8 aa, Japanese encephalitis virus
GDFGEVTL

SEQ ID NO: 214279 - protein, 8 aa, Japanese encephalitis virus
DFGEVTLD

SEQ ID NO: 214280 - protein, 8 aa, Japanese encephalitis virus
FGEVTLDC

SEQ ID NO: 214281 - protein, 8 aa, Japanese encephalitis virus
EVTLDCEA

SEQ ID NO: 214282 - protein, 8 aa, Japanese encephalitis virus
VTLDCEPK

SEQ ID NO: 214283 - protein, 8 aa, Japanese encephalitis virus
TLDCEPKS

SEQ ID NO: 214284 - protein, 8 aa, Japanese encephalitis virus
LDCEPKSG

SEQ ID NO: 214285 - protein, 8 aa, Japanese encephalitis virus
DCEARSGL

SEQ ID NO: 214286 - protein, 8 aa, Japanese encephalitis virus
CEPKSGLN

SEQ ID NO: 214287 - protein, 8 aa, Japanese encephalitis virus
EARSGLNT

SEQ ID NO: 214288 - protein, 8 aa, Japanese encephalitis virus
PKSGLNTE

SEQ ID NO: 214289 - protein, 8 aa, Japanese encephalitis virus
KSGLNTEA

SEQ ID NO: 214290 - protein, 8 aa, Japanese encephalitis virus
FYVMTVGP

SEQ ID NO: 214291 - protein, 8 aa, Japanese encephalitis virus
YVMTVGSR

SEQ ID NO: 214292 - protein, 8 aa, Japanese encephalitis virus
VMTVGSRS

SEQ ID NO: 214293 - protein, 8 aa, Japanese encephalitis virus
MTVGSRSF

SEQ ID NO: 214294 - protein, 8 aa, Japanese encephalitis virus
TVGSRSFL

SEQ ID NO: 214295 - protein, 8 aa, Japanese encephalitis virus
VGSRSFLV

SEQ ID NO: 214296 - protein, 8 aa, Japanese encephalitis virus
GSRSFLVH

SEQ ID NO: 214297 - protein, 8 aa, Japanese encephalitis virus
SRSFLVHR

SEQ ID NO: 214298 - protein, 8 aa, Japanese encephalitis virus
RSFLVHRE

SEQ ID NO: 214299 - protein, 8 aa, Japanese encephalitis virus
SLLVHREW

SEQ ID NO: 214300 - protein, 8 aa, Japanese encephalitis virus
LLVHREWF

SEQ ID NO: 214301 - protein, 8 aa, Japanese encephalitis virus
REWFHDLS

SEQ ID NO: 214302 - protein, 8 aa, Japanese encephalitis virus
EWFHDLSL

SEQ ID NO: 214303 - protein, 8 aa, Japanese encephalitis virus
WFHDLSLP

SEQ ID NO: 214304 - protein, 8 aa, Japanese encephalitis virus
FHDLSLPW

SEQ ID NO: 214305 - protein, 8 aa, Japanese encephalitis virus
HDLSLPWT

SEQ ID NO: 214306 - protein, 8 aa, Japanese encephalitis virus
DLSLPWTS

SEQ ID NO: 214307 - protein, 8 aa, Japanese encephalitis virus
LSLPWTSP

SEQ ID NO: 214308 - protein, 8 aa, Japanese encephalitis virus
SLPWTSPS

SEQ ID NO: 214309 - protein, 8 aa, Japanese encephalitis virus
LPWTPPSS

SEQ ID NO: 214310 - protein, 8 aa, Japanese encephalitis virus
PWTPPSST

SEQ ID NO: 214311 - protein, 8 aa, Japanese encephalitis virus
WTPPSSTA

SEQ ID NO: 214312 - protein, 8 aa, Japanese encephalitis virus
TPPSSTAW

SEQ ID NO: 214313 - protein, 8 aa, Japanese encephalitis virus
PPSSTAWR

SEQ ID NO: 214314 - protein, 8 aa, Japanese encephalitis virus
SSNTAWRN

SEQ ID NO: 214315 - protein, 8 aa, Japanese encephalitis virus
SNTAWRNR

SEQ ID NO: 214316 - protein, 8 aa, Japanese encephalitis virus
NTAWRNRE

SEQ ID NO: 214317 - protein, 8 aa, Japanese encephalitis virus
ELLMEFEG

SEQ ID NO: 214318 - protein, 8 aa, Japanese encephalitis virus
LLMEFEGA

SEQ ID NO: 214319 - protein, 8 aa, Japanese encephalitis virus
LMEFEGAH

SEQ ID NO: 214320 - protein, 8 aa, Japanese encephalitis virus
MEFEGAHA

SEQ ID NO: 214321 - protein, 8 aa, Japanese encephalitis virus
EFEGAHAT

SEQ ID NO: 214322 - protein, 8 aa, Japanese encephalitis virus
FEGAHATK

SEQ ID NO: 214323 - protein, 8 aa, Japanese encephalitis virus
EGAHATKQ

SEQ ID NO: 214324 - protein, 8 aa, Japanese encephalitis virus
GAHATKQS

SEQ ID NO: 214325 - protein, 8 aa, Japanese encephalitis virus
SVVALGSR

SEQ ID NO: 214326 - protein, 8 aa, Japanese encephalitis virus
VVALGSRE

SEQ ID NO: 214327 - protein, 8 aa, Japanese encephalitis virus
VALGSQER

SEQ ID NO: 214328 - protein, 8 aa, Japanese encephalitis virus
ALGSQERA

SEQ ID NO: 214329 - protein, 8 aa, Japanese encephalitis virus
LGSQEGSL

SEQ ID NO: 214330 - protein, 8 aa, Japanese encephalitis virus
GSREGGLH

SEQ ID NO: 214331 - protein, 8 aa, Japanese encephalitis virus
SQEGGLHH

SEQ ID NO: 214332 - protein, 8 aa, Japanese encephalitis virus
QEGGLHHA

SEQ ID NO: 214333 - protein, 8 aa, Japanese encephalitis virus
EGGLHHAL

SEQ ID NO: 214334 - protein, 8 aa, Japanese encephalitis virus
GGLHHALA

SEQ ID NO: 214335 - protein, 8 aa, Japanese encephalitis virus
GLHHALAG

SEQ ID NO: 214336 - protein, 8 aa, Japanese encephalitis virus
LHHALAGA

SEQ ID NO: 214337 - protein, 8 aa, Japanese encephalitis virus
HHALAGAI

SEQ ID NO: 214338 - protein, 8 aa, Japanese encephalitis virus
HALAGAIV

SEQ ID NO: 214339 - protein, 8 aa, Japanese encephalitis virus
GAIVVEYP

SEQ ID NO: 214340 - protein, 8 aa, Japanese encephalitis virus
AIVVEYSN

SEQ ID NO: 214341 - protein, 8 aa, Japanese encephalitis virus
IVVEYSNS

SEQ ID NO: 214342 - protein, 8 aa, Japanese encephalitis virus
VVEYSNSV

SEQ ID NO: 214343 - protein, 8 aa, Japanese encephalitis virus
VEYSSSVM

SEQ ID NO: 214344 - protein, 8 aa, Japanese encephalitis virus
EYSSSVML

SEQ ID NO: 214345 - protein, 8 aa, Japanese encephalitis virus
YSSSVMLT

SEQ ID NO: 214346 - protein, 8 aa, Japanese encephalitis virus
SSSVMLTS

SEQ ID NO: 214347 - protein, 8 aa, Japanese encephalitis virus
SSVMLTSG

SEQ ID NO: 214348 - protein, 8 aa, Japanese encephalitis virus
SVMLTSGH

SEQ ID NO: 214349 - protein, 8 aa, Japanese encephalitis virus
VMLTSGHL

SEQ ID NO: 214350 - protein, 8 aa, Japanese encephalitis virus
MLTSGHLK

SEQ ID NO: 214351 - protein, 8 aa, Japanese encephalitis virus
LTSGHVKR

SEQ ID NO: 214352 - protein, 8 aa, Japanese encephalitis virus
TSGHVKRR

SEQ ID NO: 214353 - protein, 8 aa, Japanese encephalitis virus
SGHVKRRL

SEQ ID NO: 214354 - protein, 8 aa, Japanese encephalitis virus
GHVKRRLK

SEQ ID NO: 214355 - protein, 8 aa, Japanese encephalitis virus
HLKCRLRM

SEQ ID NO: 214356 - protein, 8 aa, Japanese encephalitis virus
VKRRLKMD

SEQ ID NO: 214357 - protein, 8 aa, Japanese encephalitis virus
KCRLRMDK

SEQ ID NO: 214358 - protein, 8 aa, Japanese encephalitis virus
RRLKMDKL

SEQ ID NO: 214359 - protein, 8 aa, Japanese encephalitis virus
RLRMDKLA

SEQ ID NO: 214360 - protein, 8 aa, Japanese encephalitis virus
LRMDKLAL

SEQ ID NO: 214361 - protein, 8 aa, Japanese encephalitis virus
RMDKLALK

SEQ ID NO: 214362 - protein, 8 aa, Japanese encephalitis virus
LKGTTYGV

SEQ ID NO: 214363 - protein, 8 aa, Japanese encephalitis virus
KGTTYGVC

SEQ ID NO: 214364 - protein, 8 aa, Japanese encephalitis virus
GTTYGVCT

SEQ ID NO: 214365 - protein, 8 aa, Japanese encephalitis virus
TTYGMCTG

SEQ ID NO: 214366 - protein, 8 aa, Japanese encephalitis virus
TYGMCTGK

SEQ ID NO: 214367 - protein, 8 aa, Japanese encephalitis virus
YGMCTGKF

SEQ ID NO: 214368 - protein, 8 aa, Japanese encephalitis virus
GMCTGKFS

SEQ ID NO: 214369 - protein, 8 aa, Japanese encephalitis virus
MCTGKFSF

SEQ ID NO: 214370 - protein, 8 aa, Japanese encephalitis virus
CTGKFSFA

SEQ ID NO: 214371 - protein, 8 aa, Japanese encephalitis virus
TGKFSFAK

SEQ ID NO: 214372 - protein, 8 aa, Japanese encephalitis virus
GKFSFAKN

SEQ ID NO: 214373 - protein, 8 aa, Japanese encephalitis virus
NSSFRKNP

SEQ ID NO: 214374 - protein, 8 aa, Japanese encephalitis virus
FSFAKNPV

SEQ ID NO: 214375 - protein, 8 aa, Japanese encephalitis virus
SFAKNPVD

SEQ ID NO: 214376 - protein, 8 aa, Japanese encephalitis virus
FAKNPVDT

SEQ ID NO: 214377 - protein, 8 aa, Japanese encephalitis virus
AKNPVDTG

SEQ ID NO: 214378 - protein, 8 aa, Japanese encephalitis virus
KNPVDTGH

SEQ ID NO: 214379 - protein, 8 aa, Japanese encephalitis virus
NPVDTGHG

SEQ ID NO: 214380 - protein, 8 aa, Japanese encephalitis virus
PVDTGHGT

SEQ ID NO: 214381 - protein, 8 aa, Japanese encephalitis virus
VDTGHGTV

SEQ ID NO: 214382 - protein, 8 aa, Japanese encephalitis virus
GTVVIELT

SEQ ID NO: 214383 - protein, 8 aa, Japanese encephalitis virus
TVVIELTY

SEQ ID NO: 214384 - protein, 8 aa, Japanese encephalitis virus
VVIELTYS

SEQ ID NO: 214385 - protein, 8 aa, Japanese encephalitis virus
VIELTYSG

SEQ ID NO: 214386 - protein, 8 aa, Japanese encephalitis virus
IELTYSGS

SEQ ID NO: 214387 - protein, 8 aa, Japanese encephalitis virus
ELTYSGSD

SEQ ID NO: 214388 - protein, 8 aa, Japanese encephalitis virus
LTYSGSDG

SEQ ID NO: 214389 - protein, 8 aa, Japanese encephalitis virus
TYSGSDGP

SEQ ID NO: 214390 - protein, 8 aa, Japanese encephalitis virus
YSGRDGPC

SEQ ID NO: 214391 - protein, 8 aa, Japanese encephalitis virus
SGRDGPCK

SEQ ID NO: 214392 - protein, 8 aa, Japanese encephalitis virus
GRDGPCKI

SEQ ID NO: 214393 - protein, 8 aa, Japanese encephalitis virus
RDGPCKIP

SEQ ID NO: 214394 - protein, 8 aa, Japanese encephalitis virus
DGSCKIPI

SEQ ID NO: 214395 - protein, 8 aa, Japanese encephalitis virus
GSCKIPIV

SEQ ID NO: 214396 - protein, 8 aa, Japanese encephalitis virus
SCKIPIVS

SEQ ID NO: 214397 - protein, 8 aa, Japanese encephalitis virus
KIPIVSVV

SEQ ID NO: 214398 - protein, 8 aa, Japanese encephalitis virus
IPIVSVAN

SEQ ID NO: 214399 - protein, 8 aa, Japanese encephalitis virus
PIVSVVSL

SEQ ID NO: 214400 - protein, 8 aa, Japanese encephalitis virus
IVSVANLN

SEQ ID NO: 214401 - protein, 8 aa, Japanese encephalitis virus
VSVVSLND

SEQ ID NO: 214402 - protein, 8 aa, Japanese encephalitis virus
SVASLNDL

SEQ ID NO: 214403 - protein, 8 aa, Japanese encephalitis virus
VASLNDLT

SEQ ID NO: 214404 - protein, 8 aa, Japanese encephalitis virus
ASLNDLTP

SEQ ID NO: 214405 - protein, 8 aa, Japanese encephalitis virus
SLNDLTPV

SEQ ID NO: 214406 - protein, 8 aa, Japanese encephalitis virus
LNDLTPVG

SEQ ID NO: 214407 - protein, 8 aa, Japanese encephalitis virus
NDLTPVGR

SEQ ID NO: 214408 - protein, 8 aa, Japanese encephalitis virus
DLTPVGRL

SEQ ID NO: 214409 - protein, 8 aa, Japanese encephalitis virus
LTPVGRLV

SEQ ID NO: 214410 - protein, 8 aa, Japanese encephalitis virus
TPAGRLVT

SEQ ID NO: 214411 - protein, 8 aa, Japanese encephalitis virus
PAGRLVTV

SEQ ID NO: 214412 - protein, 8 aa, Japanese encephalitis virus
AGRLVTVN

SEQ ID NO: 214413 - protein, 8 aa, Japanese encephalitis virus
TVNPFVAA

SEQ ID NO: 214414 - protein, 8 aa, Japanese encephalitis virus
VNPFVAAS

SEQ ID NO: 214415 - protein, 8 aa, Japanese encephalitis virus
NPFVAASS

SEQ ID NO: 214416 - protein, 8 aa, Japanese encephalitis virus
PFVATSSS

SEQ ID NO: 214417 - protein, 8 aa, Japanese encephalitis virus
FVATSSSN

SEQ ID NO: 214418 - protein, 8 aa, Japanese encephalitis virus
VATSSSNS

SEQ ID NO: 214419 - protein, 8 aa, Japanese encephalitis virus
ATSSSNSK

SEQ ID NO: 214420 - protein, 8 aa, Japanese encephalitis virus
TSSSNSKV

SEQ ID NO: 214421 - protein, 8 aa, Japanese encephalitis virus
SSSNSKVL

SEQ ID NO: 214422 - protein, 8 aa, Japanese encephalitis virus
SSNSKVLV

SEQ ID NO: 214423 - protein, 8 aa, Japanese encephalitis virus
SNSKVLVE

SEQ ID NO: 214424 - protein, 8 aa, Japanese encephalitis virus
NSKVLLEI

SEQ ID NO: 214425 - protein, 8 aa, Japanese encephalitis virus
SKALVEME

SEQ ID NO: 214426 - protein, 8 aa, Japanese encephalitis virus
KVLLEIEP

SEQ ID NO: 214427 - protein, 8 aa, Japanese encephalitis virus
VLLEIEPP

SEQ ID NO: 214428 - protein, 8 aa, Japanese encephalitis virus
LLEIEPPF

SEQ ID NO: 214429 - protein, 8 aa, Japanese encephalitis virus
LEIEPPFG

SEQ ID NO: 214430 - protein, 8 aa, Japanese encephalitis virus
EIEPPFGD

SEQ ID NO: 214431 - protein, 8 aa, Japanese encephalitis virus
IEPPFGDS

SEQ ID NO: 214432 - protein, 8 aa, Japanese encephalitis virus
FGDSYIVI

SEQ ID NO: 214433 - protein, 8 aa, Japanese encephalitis virus
GDSYIVIG

SEQ ID NO: 214434 - protein, 8 aa, Japanese encephalitis virus
DSYIVIGR

SEQ ID NO: 214435 - protein, 8 aa, Japanese encephalitis virus
SYIVVGRE

SEQ ID NO: 214436 - protein, 8 aa, Japanese encephalitis virus
KQINHHWY

SEQ ID NO: 214437 - protein, 8 aa, Japanese encephalitis virus
QINHHWHR

SEQ ID NO: 214438 - protein, 8 aa, Japanese encephalitis virus
HHWHRAGS

SEQ ID NO: 214439 - protein, 8 aa, Japanese encephalitis virus
HWHRAGST

SEQ ID NO: 214440 - protein, 8 aa, Japanese encephalitis virus
WHRAGSTL

SEQ ID NO: 214441 - protein, 8 aa, Japanese encephalitis virus
HRAGSTLG

SEQ ID NO: 214442 - protein, 8 aa, Japanese encephalitis virus
RAGSTLGK

SEQ ID NO: 214443 - protein, 8 aa, Japanese encephalitis virus
PGSTLGKA

SEQ ID NO: 214444 - protein, 8 aa, Japanese encephalitis virus
STLGKAFL

SEQ ID NO: 214445 - protein, 8 aa, Japanese encephalitis virus
TLGKAFLT

SEQ ID NO: 214446 - protein, 8 aa, Japanese encephalitis virus
LGKAFLTT

SEQ ID NO: 214447 - protein, 8 aa, Japanese encephalitis virus
GKAFLTTL

SEQ ID NO: 214448 - protein, 8 aa, Japanese encephalitis virus
KAFLTTLK

SEQ ID NO: 214449 - protein, 8 aa, Japanese encephalitis virus
AFLTTLKG

SEQ ID NO: 214450 - protein, 8 aa, Japanese encephalitis virus
FLTTLKGA

SEQ ID NO: 214451 - protein, 8 aa, Japanese encephalitis virus
LTTLKGAQ

SEQ ID NO: 214452 - protein, 8 aa, Japanese encephalitis virus
LKGAQRLV

SEQ ID NO: 214453 - protein, 8 aa, Japanese encephalitis virus
KGAQRLVA

SEQ ID NO: 214454 - protein, 8 aa, Japanese encephalitis virus
GAQRLVAL

SEQ ID NO: 214455 - protein, 8 aa, Japanese encephalitis virus
AQRLVALG

SEQ ID NO: 214456 - protein, 8 aa, Japanese encephalitis virus
QRLVALGD

SEQ ID NO: 214457 - protein, 8 aa, Japanese encephalitis virus
RLVALGDT

SEQ ID NO: 214458 - protein, 8 aa, Japanese encephalitis virus
LVALGDTA

SEQ ID NO: 214459 - protein, 8 aa, Japanese encephalitis virus
VALGDTAW

SEQ ID NO: 214460 - protein, 8 aa, Japanese encephalitis virus
WDFGSIGR

SEQ ID NO: 214461 - protein, 8 aa, Japanese encephalitis virus
DFGSIGRV

SEQ ID NO: 214462 - protein, 8 aa, Japanese encephalitis virus
FGSIGGIF

SEQ ID NO: 214463 - protein, 8 aa, Japanese encephalitis virus
GSIGGIFN

SEQ ID NO: 214464 - protein, 8 aa, Japanese encephalitis virus
SIGGIFNS

SEQ ID NO: 214465 - protein, 8 aa, Japanese encephalitis virus
IGRVFNSI

SEQ ID NO: 214466 - protein, 8 aa, Japanese encephalitis virus
GRVFNSIG

SEQ ID NO: 214467 - protein, 8 aa, Japanese encephalitis virus
GVFNSIGR

SEQ ID NO: 214468 - protein, 8 aa, Japanese encephalitis virus
VFNSIGRA

SEQ ID NO: 214469 - protein, 8 aa, Japanese encephalitis virus
FNSIGRAV

SEQ ID NO: 214470 - protein, 8 aa, Japanese encephalitis virus
NSIGRAVH

SEQ ID NO: 214471 - protein, 8 aa, Japanese encephalitis virus
SIGRAVHQ

SEQ ID NO: 214472 - protein, 8 aa, Japanese encephalitis virus
IGRAVHQV

SEQ ID NO: 214473 - protein, 8 aa, Japanese encephalitis virus
GRAVHQVF

SEQ ID NO: 214474 - protein, 8 aa, Japanese encephalitis virus
RAVHQVFG

SEQ ID NO: 214475 - protein, 8 aa, Japanese encephalitis virus
AVHQVFGD

SEQ ID NO: 214476 - protein, 8 aa, Japanese encephalitis virus
VHQVFGDA

SEQ ID NO: 214477 - protein, 8 aa, Japanese encephalitis virus
HQVFGDAF

SEQ ID NO: 214478 - protein, 8 aa, Japanese encephalitis virus
QVFGDAFR

SEQ ID NO: 214479 - protein, 8 aa, Japanese encephalitis virus
VFGDAFRT

SEQ ID NO: 214480 - protein, 8 aa, Japanese encephalitis virus
FGDAFRTL

SEQ ID NO: 214481 - protein, 8 aa, Japanese encephalitis virus
GDAFRTLF

SEQ ID NO: 214482 - protein, 8 aa, Japanese encephalitis virus
DAFRTLFG

SEQ ID NO: 214483 - protein, 8 aa, Japanese encephalitis virus
ITQGLMGV

SEQ ID NO: 214484 - protein, 8 aa, Japanese encephalitis virus
TQGLMGVL

SEQ ID NO: 214485 - protein, 8 aa, Japanese encephalitis virus
QGLMGVLL

SEQ ID NO: 214486 - protein, 8 aa, Japanese encephalitis virus
GLMGVLLL

SEQ ID NO: 214487 - protein, 8 aa, Japanese encephalitis virus
LMGVLLLW

SEQ ID NO: 214488 - protein, 8 aa, Japanese encephalitis virus
MGVLLLWM

SEQ ID NO: 214489 - protein, 8 aa, Japanese encephalitis virus
GVLLLWMG

SEQ ID NO: 214490 - protein, 8 aa, Japanese encephalitis virus
ALLLWMGI

SEQ ID NO: 214491 - protein, 8 aa, Japanese encephalitis virus
LLLWMGIN

SEQ ID NO: 214492 - protein, 8 aa, Japanese encephalitis virus
LLWMGINA

SEQ ID NO: 214493 - protein, 8 aa, Japanese encephalitis virus
LWMGINAR

SEQ ID NO: 214494 - protein, 8 aa, Japanese encephalitis virus
WMGINARD

SEQ ID NO: 214495 - protein, 8 aa, Japanese encephalitis virus
MGINARDR

SEQ ID NO: 214496 - protein, 8 aa, Japanese encephalitis virus
GINARDRS

SEQ ID NO: 214497 - protein, 8 aa, Japanese encephalitis virus
INARDRSI

SEQ ID NO: 214498 - protein, 8 aa, Japanese encephalitis virus
NARNRSIA

SEQ ID NO: 214499 - protein, 8 aa, Japanese encephalitis virus
ARNRSIAL

SEQ ID NO: 214500 - protein, 8 aa, Japanese encephalitis virus
RDRSIAMA

SEQ ID NO: 214501 - protein, 8 aa, Japanese encephalitis virus
DRSIAMAF

SEQ ID NO: 214502 - protein, 8 aa, Japanese encephalitis virus
RSIAMAFL

SEQ ID NO: 214503 - protein, 8 aa, Japanese encephalitis virus
SIAMAFLV

SEQ ID NO: 214504 - protein, 8 aa, Japanese encephalitis virus
IAMAFLVT

SEQ ID NO: 214505 - protein, 8 aa, Japanese encephalitis virus
AMAFLVTG

SEQ ID NO: 214506 - protein, 8 aa, Japanese encephalitis virus
MAFLVTGG

SEQ ID NO: 214507 - protein, 8 aa, Japanese encephalitis virus
AFLVTGGT

SEQ ID NO: 214508 - protein, 8 aa, Japanese encephalitis virus
FLVTGGTL

SEQ ID NO: 214509 - protein, 8 aa, Japanese encephalitis virus
LVTGGTLL

SEQ ID NO: 214510 - protein, 8 aa, Japanese encephalitis virus
VTGGTLLF

SEQ ID NO: 214511 - protein, 8 aa, Japanese encephalitis virus
TGGTLLFL

SEQ ID NO: 214512 - protein, 8 aa, Japanese encephalitis virus
GGTLLFLA

SEQ ID NO: 214513 - protein, 8 aa, Japanese encephalitis virus
GTLLFLAT

SEQ ID NO: 214514 - protein, 8 aa, Japanese encephalitis virus
TLLFLATN

SEQ ID NO: 214515 - protein, 8 aa, Japanese encephalitis virus
LLFLATNV

SEQ ID NO: 214516 - protein, 8 aa, Japanese encephalitis virus
LFLATNVH

SEQ ID NO: 214517 - protein, 8 aa, Japanese encephalitis virus
NVHADTGS

SEQ ID NO: 214518 - protein, 8 aa, Japanese encephalitis virus
VHADTGSA

SEQ ID NO: 214519 - protein, 8 aa, Japanese encephalitis virus
HADTGSAI

SEQ ID NO: 214520 - protein, 8 aa, Japanese encephalitis virus
ADTGSAID

SEQ ID NO: 214521 - protein, 8 aa, Japanese encephalitis virus
DTGCAIDT

SEQ ID NO: 214522 - protein, 8 aa, Japanese encephalitis virus
TGCAIDIA

SEQ ID NO: 214523 - protein, 8 aa, Japanese encephalitis virus
GCAIDIAR

SEQ ID NO: 214524 - protein, 8 aa, Japanese encephalitis virus
TRREMRCG

SEQ ID NO: 214525 - protein, 8 aa, Japanese encephalitis virus
RREMRCGS

SEQ ID NO: 214526 - protein, 8 aa, Japanese encephalitis virus
REMRCGSG

SEQ ID NO: 214527 - protein, 8 aa, Japanese encephalitis virus
QMRCGSGI

SEQ ID NO: 214528 - protein, 8 aa, Japanese encephalitis virus
KYLPETPK

SEQ ID NO: 214529 - protein, 8 aa, Japanese encephalitis virus
YLPETPKS

SEQ ID NO: 214530 - protein, 8 aa, Japanese encephalitis virus
LPETPRAL

SEQ ID NO: 214531 - protein, 8 aa, Japanese encephalitis virus
PETPKSLA

SEQ ID NO: 214532 - protein, 8 aa, Japanese encephalitis virus
ETPRALAK

SEQ ID NO: 214533 - protein, 8 aa, Japanese encephalitis virus
TPRALAKI

SEQ ID NO: 214534 - protein, 8 aa, Japanese encephalitis virus
PKSLAKIV

SEQ ID NO: 214535 - protein, 8 aa, Japanese encephalitis virus
RALAKIVH

SEQ ID NO: 214536 - protein, 8 aa, Japanese encephalitis virus
ALAKIVHK

SEQ ID NO: 214537 - protein, 8 aa, Japanese encephalitis virus
AKIVHKAY

SEQ ID NO: 214538 - protein, 8 aa, Japanese encephalitis virus
KIVHKAHQ

SEQ ID NO: 214539 - protein, 8 aa, Japanese encephalitis virus
IVHKAHQE

SEQ ID NO: 214540 - protein, 8 aa, Japanese encephalitis virus
VHKAHQEG

SEQ ID NO: 214541 - protein, 8 aa, Japanese encephalitis virus
HKAHQEGV

SEQ ID NO: 214542 - protein, 8 aa, Japanese encephalitis virus
KAHQEGVC

SEQ ID NO: 214543 - protein, 8 aa, Japanese encephalitis virus
AHQEGVCG

SEQ ID NO: 214544 - protein, 8 aa, Japanese encephalitis virus
HQEGVCGV

SEQ ID NO: 214545 - protein, 8 aa, Japanese encephalitis virus
QEGVCGVR

SEQ ID NO: 214546 - protein, 8 aa, Japanese encephalitis virus
EGVCGIRS

SEQ ID NO: 214547 - protein, 8 aa, Japanese encephalitis virus
GVCGIRSV

SEQ ID NO: 214548 - protein, 8 aa, Japanese encephalitis virus
ICGVRSVT

SEQ ID NO: 214549 - protein, 8 aa, Japanese encephalitis virus
CGIRSVTR

SEQ ID NO: 214550 - protein, 8 aa, Japanese encephalitis virus
GIRSVTRL

SEQ ID NO: 214551 - protein, 8 aa, Japanese encephalitis virus
IRSVTRLE

SEQ ID NO: 214552 - protein, 8 aa, Japanese encephalitis virus
LEHQMWES

SEQ ID NO: 214553 - protein, 8 aa, Japanese encephalitis virus
EHQMWESV

SEQ ID NO: 214554 - protein, 8 aa, Japanese encephalitis virus
HQMWESVR

SEQ ID NO: 214555 - protein, 8 aa, Japanese encephalitis virus
QMWESVRD

SEQ ID NO: 214556 - protein, 8 aa, Japanese encephalitis virus
MWESVRDE

SEQ ID NO: 214557 - protein, 8 aa, Japanese encephalitis virus
WESVRDEL

SEQ ID NO: 214558 - protein, 8 aa, Japanese encephalitis virus
ESVRDELN

SEQ ID NO: 214559 - protein, 8 aa, Japanese encephalitis virus
SVRDELNV

SEQ ID NO: 214560 - protein, 8 aa, Japanese encephalitis virus
VRDELNVP

SEQ ID NO: 214561 - protein, 8 aa, Japanese encephalitis virus
RDELNVPL

SEQ ID NO: 214562 - protein, 8 aa, Japanese encephalitis virus
DELNVPLK

SEQ ID NO: 214563 - protein, 8 aa, Japanese encephalitis virus
ELNVPLKE

SEQ ID NO: 214564 - protein, 8 aa, Japanese encephalitis virus
LNVPLKEN

SEQ ID NO: 214565 - protein, 8 aa, Japanese encephalitis virus
NVPLKENA

SEQ ID NO: 214566 - protein, 8 aa, Japanese encephalitis virus
VPLKENAV

SEQ ID NO: 214567 - protein, 8 aa, Japanese encephalitis virus
PLKENAVD

SEQ ID NO: 214568 - protein, 8 aa, Japanese encephalitis virus
PVGRYRST

SEQ ID NO: 214569 - protein, 8 aa, Japanese encephalitis virus
VGRYRSTP

SEQ ID NO: 214570 - protein, 8 aa, Japanese encephalitis virus
GRYRSTPK

SEQ ID NO: 214571 - protein, 8 aa, Japanese encephalitis virus
RYRSTPKR

SEQ ID NO: 214572 - protein, 8 aa, Japanese encephalitis virus
YRSTPKRL

SEQ ID NO: 214573 - protein, 8 aa, Japanese encephalitis virus
RSTPKRLS

SEQ ID NO: 214574 - protein, 8 aa, Japanese encephalitis virus
STPKRLSM

SEQ ID NO: 214575 - protein, 8 aa, Japanese encephalitis virus
APKRLFMT

SEQ ID NO: 214576 - protein, 8 aa, Japanese encephalitis virus
PKRLSMTR

SEQ ID NO: 214577 - protein, 8 aa, Japanese encephalitis virus
KRLSMTRE

SEQ ID NO: 214578 - protein, 8 aa, Japanese encephalitis virus
RLFMTQEK

SEQ ID NO: 214579 - protein, 8 aa, Japanese encephalitis virus
LFMTQEKV

SEQ ID NO: 214580 - protein, 8 aa, Japanese encephalitis virus
FMTQEKVE

SEQ ID NO: 214581 - protein, 8 aa, Japanese encephalitis virus
MTQEKVEM

SEQ ID NO: 214582 - protein, 8 aa, Japanese encephalitis virus
TREKFEMG

SEQ ID NO: 214583 - protein, 8 aa, Japanese encephalitis virus
QEKVEMGW

SEQ ID NO: 214584 - protein, 8 aa, Japanese encephalitis virus
EKVEMGWK

SEQ ID NO: 214585 - protein, 8 aa, Japanese encephalitis virus
KVEMGWKA

SEQ ID NO: 214586 - protein, 8 aa, Japanese encephalitis virus
VEMGWKAW

SEQ ID NO: 214587 - protein, 8 aa, Japanese encephalitis virus
WKAWGKSM

SEQ ID NO: 214588 - protein, 8 aa, Japanese encephalitis virus
KAWGKSML

SEQ ID NO: 214589 - protein, 8 aa, Japanese encephalitis virus
AWGKSMLF

SEQ ID NO: 214590 - protein, 8 aa, Japanese encephalitis virus
WGKSMLFA

SEQ ID NO: 214591 - protein, 8 aa, Japanese encephalitis virus
GKSMLFAP

SEQ ID NO: 214592 - protein, 8 aa, Japanese encephalitis virus
KSLLFAPE

SEQ ID NO: 214593 - protein, 8 aa, Japanese encephalitis virus
SILFAPEM

SEQ ID NO: 214594 - protein, 8 aa, Japanese encephalitis virus
MLFAPELA

SEQ ID NO: 214595 - protein, 8 aa, Japanese encephalitis virus
LFAPEMAN

SEQ ID NO: 214596 - protein, 8 aa, Japanese encephalitis virus
FAPEMANS

SEQ ID NO: 214597 - protein, 8 aa, Japanese encephalitis virus
APEMANST

SEQ ID NO: 214598 - protein, 8 aa, Japanese encephalitis virus
PEMANSTF

SEQ ID NO: 214599 - protein, 8 aa, Japanese encephalitis virus
EMANSTFV

SEQ ID NO: 214600 - protein, 8 aa, Japanese encephalitis virus
MANSTFVV

SEQ ID NO: 214601 - protein, 8 aa, Japanese encephalitis virus
ANSSFVVD

SEQ ID NO: 214602 - protein, 8 aa, Japanese encephalitis virus
NSSFVVDG

SEQ ID NO: 214603 - protein, 8 aa, Japanese encephalitis virus
SSFVVDGP

SEQ ID NO: 214604 - protein, 8 aa, Japanese encephalitis virus
SFVVDGPE

SEQ ID NO: 214605 - protein, 8 aa, Japanese encephalitis virus
PETKECPV

SEQ ID NO: 214606 - protein, 8 aa, Japanese encephalitis virus
ETKECPVV

SEQ ID NO: 214607 - protein, 8 aa, Japanese encephalitis virus
TKECPDER

SEQ ID NO: 214608 - protein, 8 aa, Japanese encephalitis virus
KECPDERR

SEQ ID NO: 214609 - protein, 8 aa, Japanese encephalitis virus
ECPDERRA

SEQ ID NO: 214610 - protein, 8 aa, Japanese encephalitis virus
CPDERRAW

SEQ ID NO: 214611 - protein, 8 aa, Japanese encephalitis virus
PDERRAWN

SEQ ID NO: 214612 - protein, 8 aa, Japanese encephalitis virus
DERRAWNS

SEQ ID NO: 214613 - protein, 8 aa, Japanese encephalitis virus
ERRAWNSM

SEQ ID NO: 214614 - protein, 8 aa, Japanese encephalitis virus
RRAWNSMQ

SEQ ID NO: 214615 - protein, 8 aa, Japanese encephalitis virus
RAWNSTQI

SEQ ID NO: 214616 - protein, 8 aa, Japanese encephalitis virus
AWNSTQIE

SEQ ID NO: 214617 - protein, 8 aa, Japanese encephalitis virus
WNSTQIED

SEQ ID NO: 214618 - protein, 8 aa, Japanese encephalitis virus
NSTQIEDF

SEQ ID NO: 214619 - protein, 8 aa, Japanese encephalitis virus
STQIEDFG

SEQ ID NO: 214620 - protein, 8 aa, Japanese encephalitis virus
TQIEDFGF

SEQ ID NO: 214621 - protein, 8 aa, Japanese encephalitis virus
WLKIREEN

SEQ ID NO: 214622 - protein, 8 aa, Japanese encephalitis virus
LKIREENT

SEQ ID NO: 214623 - protein, 8 aa, Japanese encephalitis virus
KIREENTD

SEQ ID NO: 214624 - protein, 8 aa, Japanese encephalitis virus
IREENTDE

SEQ ID NO: 214625 - protein, 8 aa, Japanese encephalitis virus
REENTDEC

SEQ ID NO: 214626 - protein, 8 aa, Japanese encephalitis virus
EENTDECD

SEQ ID NO: 214627 - protein, 8 aa, Japanese encephalitis virus
ENTDECDG

SEQ ID NO: 214628 - protein, 8 aa, Japanese encephalitis virus
NTDECDGA

SEQ ID NO: 214629 - protein, 8 aa, Japanese encephalitis virus
TDECDGPI

SEQ ID NO: 214630 - protein, 8 aa, Japanese encephalitis virus
DECDGPII

SEQ ID NO: 214631 - protein, 8 aa, Japanese encephalitis virus
ECDGPIIG

SEQ ID NO: 214632 - protein, 8 aa, Japanese encephalitis virus
CDGPIIGT

SEQ ID NO: 214633 - protein, 8 aa, Japanese encephalitis virus
DGPIIGTA

SEQ ID NO: 214634 - protein, 8 aa, Japanese encephalitis virus
GPIIGTAV

SEQ ID NO: 214635 - protein, 8 aa, Japanese encephalitis virus
PIIGTAVK

SEQ ID NO: 214636 - protein, 8 aa, Japanese encephalitis virus
IIGTAIKG

SEQ ID NO: 214637 - protein, 8 aa, Japanese encephalitis virus
IGTAVKGN

SEQ ID NO: 214638 - protein, 8 aa, Japanese encephalitis virus
GTAVKGNV

SEQ ID NO: 214639 - protein, 8 aa, Japanese encephalitis virus
TAVKGNVA

SEQ ID NO: 214640 - protein, 8 aa, Japanese encephalitis virus
AVKGNVAV

SEQ ID NO: 214641 - protein, 8 aa, Japanese encephalitis virus
VKGNVAVH

SEQ ID NO: 214642 - protein, 8 aa, Japanese encephalitis virus
KGNVAVHS

SEQ ID NO: 214643 - protein, 8 aa, Japanese encephalitis virus
GNVAVHSD

SEQ ID NO: 214644 - protein, 8 aa, Japanese encephalitis virus
NVAVHSDL

SEQ ID NO: 214645 - protein, 8 aa, Japanese encephalitis virus
VTVHSDVS

SEQ ID NO: 214646 - protein, 8 aa, Japanese encephalitis virus
ALHSDLSY

SEQ ID NO: 214647 - protein, 8 aa, Japanese encephalitis virus
LHSDLSYW

SEQ ID NO: 214648 - protein, 8 aa, Japanese encephalitis virus
HSDVSYWI

SEQ ID NO: 214649 - protein, 8 aa, Japanese encephalitis virus
SDLSYWIG

SEQ ID NO: 214650 - protein, 8 aa, Japanese encephalitis virus
DLSYWIGS

SEQ ID NO: 214651 - protein, 8 aa, Japanese encephalitis virus
LSYWIGSR

SEQ ID NO: 214652 - protein, 8 aa, Japanese encephalitis virus
SYWIESRL

SEQ ID NO: 214653 - protein, 8 aa, Japanese encephalitis virus
YWIESRLN

SEQ ID NO: 214654 - protein, 8 aa, Japanese encephalitis virus
WIESRLND

SEQ ID NO: 214655 - protein, 8 aa, Japanese encephalitis virus
NDTRKLER

SEQ ID NO: 214656 - protein, 8 aa, Japanese encephalitis virus
DTWKLERL

SEQ ID NO: 214657 - protein, 8 aa, Japanese encephalitis virus
TWKRERAV

SEQ ID NO: 214658 - protein, 8 aa, Japanese encephalitis virus
WKLERLVF

SEQ ID NO: 214659 - protein, 8 aa, Japanese encephalitis virus
KRERAVFE

SEQ ID NO: 214660 - protein, 8 aa, Japanese encephalitis virus
RERAVFEE

SEQ ID NO: 214661 - protein, 8 aa, Japanese encephalitis virus
ERAVFGEI

SEQ ID NO: 214662 - protein, 8 aa, Japanese encephalitis virus
RAVFGEIK

SEQ ID NO: 214663 - protein, 8 aa, Japanese encephalitis virus
AVFGEIKS

SEQ ID NO: 214664 - protein, 8 aa, Japanese encephalitis virus
VFGEIKSC

SEQ ID NO: 214665 - protein, 8 aa, Japanese encephalitis virus
FGEIKSCT

SEQ ID NO: 214666 - protein, 8 aa, Japanese encephalitis virus
GEIKSCTW

SEQ ID NO: 214667 - protein, 8 aa, Japanese encephalitis virus
EIKSCTWP

SEQ ID NO: 214668 - protein, 8 aa, Japanese encephalitis virus
IKSCTWPE

SEQ ID NO: 214669 - protein, 8 aa, Japanese encephalitis virus
CTWPETHS

SEQ ID NO: 214670 - protein, 8 aa, Japanese encephalitis virus
TWPETHSL

SEQ ID NO: 214671 - protein, 8 aa, Japanese encephalitis virus
WPETHSLW

SEQ ID NO: 214672 - protein, 8 aa, Japanese encephalitis virus
PETHSLWG

SEQ ID NO: 214673 - protein, 8 aa, Japanese encephalitis virus
ETHSLWGD

SEQ ID NO: 214674 - protein, 8 aa, Japanese encephalitis virus
THTLWGDD

SEQ ID NO: 214675 - protein, 8 aa, Japanese encephalitis virus
HTLWGDDV

SEQ ID NO: 214676 - protein, 8 aa, Japanese encephalitis virus
TLWGDDVE

SEQ ID NO: 214677 - protein, 8 aa, Japanese encephalitis virus
LWGDDVEE

SEQ ID NO: 214678 - protein, 8 aa, Japanese encephalitis virus
WGDDVEES

SEQ ID NO: 214679 - protein, 8 aa, Japanese encephalitis virus
GDDVEESE

SEQ ID NO: 214680 - protein, 8 aa, Japanese encephalitis virus
DDVEESEL

SEQ ID NO: 214681 - protein, 8 aa, Japanese encephalitis virus
DVEESELI

SEQ ID NO: 214682 - protein, 8 aa, Japanese encephalitis virus
VEESDLVI

SEQ ID NO: 214683 - protein, 8 aa, Japanese encephalitis virus
EESDLVIP

SEQ ID NO: 214684 - protein, 8 aa, Japanese encephalitis virus
ESDLVIPH

SEQ ID NO: 214685 - protein, 8 aa, Japanese encephalitis virus
SDLVIPHT

SEQ ID NO: 214686 - protein, 8 aa, Japanese encephalitis virus
ELIIPHTL

SEQ ID NO: 214687 - protein, 8 aa, Japanese encephalitis virus
LIIPHTLA

SEQ ID NO: 214688 - protein, 8 aa, Japanese encephalitis virus
IIPHTLAG

SEQ ID NO: 214689 - protein, 8 aa, Japanese encephalitis virus
IPHTLAGP

SEQ ID NO: 214690 - protein, 8 aa, Japanese encephalitis virus
PHTIAGPR

SEQ ID NO: 214691 - protein, 8 aa, Japanese encephalitis virus
HTIAGPRS

SEQ ID NO: 214692 - protein, 8 aa, Japanese encephalitis virus
TIAGPRSK

SEQ ID NO: 214693 - protein, 8 aa, Japanese encephalitis virus
IAGPRSKH

SEQ ID NO: 214694 - protein, 8 aa, Japanese encephalitis virus
AGPRSKHN

SEQ ID NO: 214695 - protein, 8 aa, Japanese encephalitis virus
GPRSKHNR

SEQ ID NO: 214696 - protein, 8 aa, Japanese encephalitis virus
PRSKHNRR

SEQ ID NO: 214697 - protein, 8 aa, Japanese encephalitis virus
RSKHNRRE

SEQ ID NO: 214698 - protein, 8 aa, Japanese encephalitis virus
SKHNQREG

SEQ ID NO: 214699 - protein, 8 aa, Japanese encephalitis virus
KHNQREGY

SEQ ID NO: 214700 - protein, 8 aa, Japanese encephalitis virus
HNRREGYR

SEQ ID NO: 214701 - protein, 8 aa, Japanese encephalitis virus
NRREGYRT

SEQ ID NO: 214702 - protein, 8 aa, Japanese encephalitis virus
RREGYRTQ

SEQ ID NO: 214703 - protein, 8 aa, Japanese encephalitis virus
REGYRTQN

SEQ ID NO: 214704 - protein, 8 aa, Japanese encephalitis virus
EGYRTQNQ

SEQ ID NO: 214705 - protein, 8 aa, Japanese encephalitis virus
GYRTQNQG

SEQ ID NO: 214706 - protein, 8 aa, Japanese encephalitis virus
YRTQNQGP

SEQ ID NO: 214707 - protein, 8 aa, Japanese encephalitis virus
RTQNQGPW

SEQ ID NO: 214708 - protein, 8 aa, Japanese encephalitis virus
NQGPWDES

SEQ ID NO: 214709 - protein, 8 aa, Japanese encephalitis virus
QGPWDEDG

SEQ ID NO: 214710 - protein, 8 aa, Japanese encephalitis virus
GPWDENGL

SEQ ID NO: 214711 - protein, 8 aa, Japanese encephalitis virus
PWDEKGIV

SEQ ID NO: 214712 - protein, 8 aa, Japanese encephalitis virus
WDEKGIVL

SEQ ID NO: 214713 - protein, 8 aa, Japanese encephalitis virus
DENGLVPG

SEQ ID NO: 214714 - protein, 8 aa, Japanese encephalitis virus
EDGIVLDF

SEQ ID NO: 214715 - protein, 8 aa, Japanese encephalitis virus
KGIVLDFD

SEQ ID NO: 214716 - protein, 8 aa, Japanese encephalitis virus
GLVPGLDY

SEQ ID NO: 214717 - protein, 8 aa, Japanese encephalitis virus
LVPGLDYC

SEQ ID NO: 214718 - protein, 8 aa, Japanese encephalitis virus
VPGLDYCP

SEQ ID NO: 214719 - protein, 8 aa, Japanese encephalitis virus
PGLDYCPG

SEQ ID NO: 214720 - protein, 8 aa, Japanese encephalitis virus
GLDYCPGT

SEQ ID NO: 214721 - protein, 8 aa, Japanese encephalitis virus
LDYCPGTK

SEQ ID NO: 214722 - protein, 8 aa, Japanese encephalitis virus
DYCPGTTV

SEQ ID NO: 214723 - protein, 8 aa, Japanese encephalitis virus
YCPGTTVT

SEQ ID NO: 214724 - protein, 8 aa, Japanese encephalitis virus
CPGTTVTI

SEQ ID NO: 214725 - protein, 8 aa, Japanese encephalitis virus
PGTTVTIT

SEQ ID NO: 214726 - protein, 8 aa, Japanese encephalitis virus
GTTVTITE

SEQ ID NO: 214727 - protein, 8 aa, Japanese encephalitis virus
TTVTITED

SEQ ID NO: 214728 - protein, 8 aa, Japanese encephalitis virus
TVTITEDC

SEQ ID NO: 214729 - protein, 8 aa, Japanese encephalitis virus
VTITEDCS

SEQ ID NO: 214730 - protein, 8 aa, Japanese encephalitis virus
TITEDCSK

SEQ ID NO: 214731 - protein, 8 aa, Japanese encephalitis virus
ITEDCSKR

SEQ ID NO: 214732 - protein, 8 aa, Japanese encephalitis virus
TEDCSKRG

SEQ ID NO: 214733 - protein, 8 aa, Japanese encephalitis virus
EDCSKRGP

SEQ ID NO: 214734 - protein, 8 aa, Japanese encephalitis virus
DCSKRGPS

SEQ ID NO: 214735 - protein, 8 aa, Japanese encephalitis virus
CGKRGPSI

SEQ ID NO: 214736 - protein, 8 aa, Japanese encephalitis virus
GKRGPSIR

SEQ ID NO: 214737 - protein, 8 aa, Japanese encephalitis virus
KRGPSIRT

SEQ ID NO: 214738 - protein, 8 aa, Japanese encephalitis virus
RGPSIRTT

SEQ ID NO: 214739 - protein, 8 aa, Japanese encephalitis virus
GPSIRTTT

SEQ ID NO: 214740 - protein, 8 aa, Japanese encephalitis virus
PSIRTTTD

SEQ ID NO: 214741 - protein, 8 aa, Japanese encephalitis virus
SIRTTTDS

SEQ ID NO: 214742 - protein, 8 aa, Japanese encephalitis virus
IRTTTDSG

SEQ ID NO: 214743 - protein, 8 aa, Japanese encephalitis virus
RTTTDIGK

SEQ ID NO: 214744 - protein, 8 aa, Japanese encephalitis virus
TTTDIGKL

SEQ ID NO: 214745 - protein, 8 aa, Japanese encephalitis virus
TTDIGKLI

SEQ ID NO: 214746 - protein, 8 aa, Japanese encephalitis virus
TDIGKLIT

SEQ ID NO: 214747 - protein, 8 aa, Japanese encephalitis virus
DIGKLITD

SEQ ID NO: 214748 - protein, 8 aa, Japanese encephalitis virus
IGKLITDW

SEQ ID NO: 214749 - protein, 8 aa, Japanese encephalitis virus
ITDWCCRN

SEQ ID NO: 214750 - protein, 8 aa, Japanese encephalitis virus
TDWCCRNC

SEQ ID NO: 214751 - protein, 8 aa, Japanese encephalitis virus
DWCCRNCS

SEQ ID NO: 214752 - protein, 8 aa, Japanese encephalitis virus
WCCRSCTL

SEQ ID NO: 214753 - protein, 8 aa, Japanese encephalitis virus
CCRNCSLP

SEQ ID NO: 214754 - protein, 8 aa, Japanese encephalitis virus
CRSCTLPP

SEQ ID NO: 214755 - protein, 8 aa, Japanese encephalitis virus
RNCSLPPL

SEQ ID NO: 214756 - protein, 8 aa, Japanese encephalitis virus
SCSLPPLG

SEQ ID NO: 214757 - protein, 8 aa, Japanese encephalitis virus
CSLPPLGF

SEQ ID NO: 214758 - protein, 8 aa, Japanese encephalitis virus
SLPPLGFR

SEQ ID NO: 214759 - protein, 8 aa, Japanese encephalitis virus
LPPLGFRT

SEQ ID NO: 214760 - protein, 8 aa, Japanese encephalitis virus
PPLGFRTE

SEQ ID NO: 214761 - protein, 8 aa, Japanese encephalitis virus
PLGFRTEN

SEQ ID NO: 214762 - protein, 8 aa, Japanese encephalitis virus
LGFRTENG

SEQ ID NO: 214763 - protein, 8 aa, Japanese encephalitis virus
GFRTENGC

SEQ ID NO: 214764 - protein, 8 aa, Japanese encephalitis virus
FRTGSGCW

SEQ ID NO: 214765 - protein, 8 aa, Japanese encephalitis virus
RTDNGCWY

SEQ ID NO: 214766 - protein, 8 aa, Japanese encephalitis virus
TGSGCWYG

SEQ ID NO: 214767 - protein, 8 aa, Japanese encephalitis virus
GSGCWYGM

SEQ ID NO: 214768 - protein, 8 aa, Japanese encephalitis virus
SGCWYGME

SEQ ID NO: 214769 - protein, 8 aa, Japanese encephalitis virus
GCWYGMEV

SEQ ID NO: 214770 - protein, 8 aa, Japanese encephalitis virus
CWYGMEVR

SEQ ID NO: 214771 - protein, 8 aa, Japanese encephalitis virus
WYGMEVRP

SEQ ID NO: 214772 - protein, 8 aa, Japanese encephalitis virus
YGMEIRPL

SEQ ID NO: 214773 - protein, 8 aa, Japanese encephalitis virus
RHDEATLV

SEQ ID NO: 214774 - protein, 8 aa, Japanese encephalitis virus
HDEATLVR

SEQ ID NO: 214775 - protein, 8 aa, Japanese encephalitis virus
DEATLVRS

SEQ ID NO: 214776 - protein, 8 aa, Japanese encephalitis virus
EATLVRSQ

SEQ ID NO: 214777 - protein, 8 aa, Japanese encephalitis virus
ATLVRSQV

SEQ ID NO: 214778 - protein, 8 aa, Japanese encephalitis virus
TLVRSQVH

SEQ ID NO: 214779 - protein, 8 aa, Japanese encephalitis virus
LVRSQVHA

SEQ ID NO: 214780 - protein, 8 aa, Japanese encephalitis virus
NGEMIDPF

SEQ ID NO: 214781 - protein, 8 aa, Japanese encephalitis virus
GEMIDPFQ

SEQ ID NO: 214782 - protein, 8 aa, Japanese encephalitis virus
EMIDPFQL

SEQ ID NO: 214783 - protein, 8 aa, Japanese encephalitis virus
MIDPFQLG

SEQ ID NO: 214784 - protein, 8 aa, Japanese encephalitis virus
IDPFQLGL

SEQ ID NO: 214785 - protein, 8 aa, Japanese encephalitis virus
DPFQMGLL

SEQ ID NO: 214786 - protein, 8 aa, Japanese encephalitis virus
PFQMGLLV

SEQ ID NO: 214787 - protein, 8 aa, Japanese encephalitis virus
FQLGLLVV

SEQ ID NO: 214788 - protein, 8 aa, Japanese encephalitis virus
QLGLLVVF

SEQ ID NO: 214789 - protein, 8 aa, Japanese encephalitis virus
LGLLVVFL

SEQ ID NO: 214790 - protein, 8 aa, Japanese encephalitis virus
GLLVVFLA

SEQ ID NO: 214791 - protein, 8 aa, Japanese encephalitis virus
LLVVFLAT

SEQ ID NO: 214792 - protein, 8 aa, Japanese encephalitis virus
LVVFLATQ

SEQ ID NO: 214793 - protein, 8 aa, Japanese encephalitis virus
VVFLATQE

SEQ ID NO: 214794 - protein, 8 aa, Japanese encephalitis virus
VFLATQEV

SEQ ID NO: 214795 - protein, 8 aa, Japanese encephalitis virus
FLATQEVF

SEQ ID NO: 214796 - protein, 8 aa, Japanese encephalitis virus
LATQEVLG

SEQ ID NO: 214797 - protein, 8 aa, Japanese encephalitis virus
ATQEVLGK

SEQ ID NO: 214798 - protein, 8 aa, Japanese encephalitis virus
TQEVLGKR

SEQ ID NO: 214799 - protein, 8 aa, Japanese encephalitis virus
QEVFRKRW

SEQ ID NO: 214800 - protein, 8 aa, Japanese encephalitis virus
EVLGKRWT

SEQ ID NO: 214801 - protein, 8 aa, Japanese encephalitis virus
VFRKRWTA

SEQ ID NO: 214802 - protein, 8 aa, Japanese encephalitis virus
LGKRWTAR

SEQ ID NO: 214803 - protein, 8 aa, Japanese encephalitis virus
GKRWTARL

SEQ ID NO: 214804 - protein, 8 aa, Japanese encephalitis virus
RWTARLTV

SEQ ID NO: 214805 - protein, 8 aa, Japanese encephalitis virus
WTARLTVP

SEQ ID NO: 214806 - protein, 8 aa, Japanese encephalitis virus
TARLTVPA

SEQ ID NO: 214807 - protein, 8 aa, Japanese encephalitis virus
ARLTVPAV

SEQ ID NO: 214808 - protein, 8 aa, Japanese encephalitis virus
RLTVPAVL

SEQ ID NO: 214809 - protein, 8 aa, Japanese encephalitis virus
LTVPAVLG

SEQ ID NO: 214810 - protein, 8 aa, Japanese encephalitis virus
TIPAVLGV

SEQ ID NO: 214811 - protein, 8 aa, Japanese encephalitis virus
IPAVLGVL

SEQ ID NO: 214812 - protein, 8 aa, Japanese encephalitis virus
PAVLGVLL

SEQ ID NO: 214813 - protein, 8 aa, Japanese encephalitis virus
AVLGVLLV

SEQ ID NO: 214814 - protein, 8 aa, Japanese encephalitis virus
VLGVLLVL

SEQ ID NO: 214815 - protein, 8 aa, Japanese encephalitis virus
LGVLLVLM

SEQ ID NO: 214816 - protein, 8 aa, Japanese encephalitis virus
GVLLVLML

SEQ ID NO: 214817 - protein, 8 aa, Japanese encephalitis virus
VLLVLMLG

SEQ ID NO: 214818 - protein, 8 aa, Japanese encephalitis virus
LLVLMFGG

SEQ ID NO: 214819 - protein, 8 aa, Japanese encephalitis virus
LVLMFGGI

SEQ ID NO: 214820 - protein, 8 aa, Japanese encephalitis virus
VLMFGGIT

SEQ ID NO: 214821 - protein, 8 aa, Japanese encephalitis virus
LMFGGITY

SEQ ID NO: 214822 - protein, 8 aa, Japanese encephalitis virus
MLGGITYI

SEQ ID NO: 214823 - protein, 8 aa, Japanese encephalitis virus
LGGITYID

SEQ ID NO: 214824 - protein, 8 aa, Japanese encephalitis virus
GGITYIDL

SEQ ID NO: 214825 - protein, 8 aa, Japanese encephalitis virus
GITYIDLA

SEQ ID NO: 214826 - protein, 8 aa, Japanese encephalitis virus
ITYIDLAR

SEQ ID NO: 214827 - protein, 8 aa, Japanese encephalitis virus
TYIDLARY

SEQ ID NO: 214828 - protein, 8 aa, Japanese encephalitis virus
YIDLARYV

SEQ ID NO: 214829 - protein, 8 aa, Japanese encephalitis virus
IDLARYVV

SEQ ID NO: 214830 - protein, 8 aa, Japanese encephalitis virus
YVVLVAAV

SEQ ID NO: 214831 - protein, 8 aa, Japanese encephalitis virus
VVLVAASF

SEQ ID NO: 214832 - protein, 8 aa, Japanese encephalitis virus
VLVAAVFA

SEQ ID NO: 214833 - protein, 8 aa, Japanese encephalitis virus
LVAASFAE

SEQ ID NO: 214834 - protein, 8 aa, Japanese encephalitis virus
VAAVFAEA

SEQ ID NO: 214835 - protein, 8 aa, Japanese encephalitis virus
AAVFAEAN

SEQ ID NO: 214836 - protein, 8 aa, Japanese encephalitis virus
AAFAEANN

SEQ ID NO: 214837 - protein, 8 aa, Japanese encephalitis virus
AFAEANNG

SEQ ID NO: 214838 - protein, 8 aa, Japanese encephalitis virus
FAEANNGG

SEQ ID NO: 214839 - protein, 8 aa, Japanese encephalitis virus
AEANNGGD

SEQ ID NO: 214840 - protein, 8 aa, Japanese encephalitis virus
EANNGGDV

SEQ ID NO: 214841 - protein, 8 aa, Japanese encephalitis virus
ANNGGDVL

SEQ ID NO: 214842 - protein, 8 aa, Japanese encephalitis virus
NNGGDVLH

SEQ ID NO: 214843 - protein, 8 aa, Japanese encephalitis virus
NGGDVLHL

SEQ ID NO: 214844 - protein, 8 aa, Japanese encephalitis virus
KIQPAFLA

SEQ ID NO: 214845 - protein, 8 aa, Japanese encephalitis virus
IQPAFLAM

SEQ ID NO: 214846 - protein, 8 aa, Japanese encephalitis virus
QPAFLAMK

SEQ ID NO: 214847 - protein, 8 aa, Japanese encephalitis virus
PAFLAMNT

SEQ ID NO: 214848 - protein, 8 aa, Japanese encephalitis virus
AFLAMKML

SEQ ID NO: 214849 - protein, 8 aa, Japanese encephalitis virus
FLAMKMLS

SEQ ID NO: 214850 - protein, 8 aa, Japanese encephalitis virus
LVMNMLSA

SEQ ID NO: 214851 - protein, 8 aa, Japanese encephalitis virus
NMLSARWT

SEQ ID NO: 214852 - protein, 8 aa, Japanese encephalitis virus
MLSARWTN

SEQ ID NO: 214853 - protein, 8 aa, Japanese encephalitis virus
LSARWTNQ

SEQ ID NO: 214854 - protein, 8 aa, Japanese encephalitis virus
SARWTNQE

SEQ ID NO: 214855 - protein, 8 aa, Japanese encephalitis virus
ARWTNQEN

SEQ ID NO: 214856 - protein, 8 aa, Japanese encephalitis virus
KWTNQENM

SEQ ID NO: 214857 - protein, 8 aa, Japanese encephalitis virus
WTNQENVA

SEQ ID NO: 214858 - protein, 8 aa, Japanese encephalitis virus
TNQENVAL

SEQ ID NO: 214859 - protein, 8 aa, Japanese encephalitis virus
NQENVALV

SEQ ID NO: 214860 - protein, 8 aa, Japanese encephalitis virus
QENVALVL

SEQ ID NO: 214861 - protein, 8 aa, Japanese encephalitis virus
ENVALVLG

SEQ ID NO: 214862 - protein, 8 aa, Japanese encephalitis virus
NVALVLGA

SEQ ID NO: 214863 - protein, 8 aa, Japanese encephalitis virus
VALVLGAA

SEQ ID NO: 214864 - protein, 8 aa, Japanese encephalitis virus
ALVLGAAF

SEQ ID NO: 214865 - protein, 8 aa, Japanese encephalitis virus
LVLGAALF

SEQ ID NO: 214866 - protein, 8 aa, Japanese encephalitis virus
VLGAALFQ

SEQ ID NO: 214867 - protein, 8 aa, Japanese encephalitis virus
LGAALFQL

SEQ ID NO: 214868 - protein, 8 aa, Japanese encephalitis virus
GAALFQLA

SEQ ID NO: 214869 - protein, 8 aa, Japanese encephalitis virus
AALFQLAS

SEQ ID NO: 214870 - protein, 8 aa, Japanese encephalitis virus
AFFQLASA

SEQ ID NO: 214871 - protein, 8 aa, Japanese encephalitis virus
FFQLASAD

SEQ ID NO: 214872 - protein, 8 aa, Japanese encephalitis virus
FQLASADL

SEQ ID NO: 214873 - protein, 8 aa, Japanese encephalitis virus
QLASADLQ

SEQ ID NO: 214874 - protein, 8 aa, Japanese encephalitis virus
LASADLQI

SEQ ID NO: 214875 - protein, 8 aa, Japanese encephalitis virus
ASADLQIG

SEQ ID NO: 214876 - protein, 8 aa, Japanese encephalitis virus
SADLQIGV

SEQ ID NO: 214877 - protein, 8 aa, Japanese encephalitis virus
ADLQIGVH

SEQ ID NO: 214878 - protein, 8 aa, Japanese encephalitis virus
LQIGVHGM

SEQ ID NO: 214879 - protein, 8 aa, Japanese encephalitis virus
QIGVHGML

SEQ ID NO: 214880 - protein, 8 aa, Japanese encephalitis virus
IGVHGMLN

SEQ ID NO: 214881 - protein, 8 aa, Japanese encephalitis virus
GVHGMLNA

SEQ ID NO: 214882 - protein, 8 aa, Japanese encephalitis virus
VHGMLNAA

SEQ ID NO: 214883 - protein, 8 aa, Japanese encephalitis virus
HGMLNAAA

SEQ ID NO: 214884 - protein, 8 aa, Japanese encephalitis virus
GMLNAAAI

SEQ ID NO: 214885 - protein, 8 aa, Japanese encephalitis virus
MLNAAAIA

SEQ ID NO: 214886 - protein, 8 aa, Japanese encephalitis virus
LNAAAMAW

SEQ ID NO: 214887 - protein, 8 aa, Japanese encephalitis virus
NAAAMAWM

SEQ ID NO: 214888 - protein, 8 aa, Japanese encephalitis virus
AAAMAWMI

SEQ ID NO: 214889 - protein, 8 aa, Japanese encephalitis virus
AAMAWMIV

SEQ ID NO: 214890 - protein, 8 aa, Japanese encephalitis virus
AIAWMIIK

SEQ ID NO: 214891 - protein, 8 aa, Japanese encephalitis virus
IAWMIIKA

SEQ ID NO: 214892 - protein, 8 aa, Japanese encephalitis virus
AWMIIKAI

SEQ ID NO: 214893 - protein, 8 aa, Japanese encephalitis virus
WMIIKAIT

SEQ ID NO: 214894 - protein, 8 aa, Japanese encephalitis virus
MIIKAITF

SEQ ID NO: 214895 - protein, 8 aa, Japanese encephalitis virus
IIKAITFP

SEQ ID NO: 214896 - protein, 8 aa, Japanese encephalitis virus
IKAITFPT

SEQ ID NO: 214897 - protein, 8 aa, Japanese encephalitis virus
RAITFPTA

SEQ ID NO: 214898 - protein, 8 aa, Japanese encephalitis virus
AITFPTAS

SEQ ID NO: 214899 - protein, 8 aa, Japanese encephalitis virus
ITFPTTST

SEQ ID NO: 214900 - protein, 8 aa, Japanese encephalitis virus
TFPTTSTV

SEQ ID NO: 214901 - protein, 8 aa, Japanese encephalitis virus
FPTTSTVA

SEQ ID NO: 214902 - protein, 8 aa, Japanese encephalitis virus
PTTSTVAM

SEQ ID NO: 214903 - protein, 8 aa, Japanese encephalitis virus
TTSTVAMP

SEQ ID NO: 214904 - protein, 8 aa, Japanese encephalitis virus
MPILALLT

SEQ ID NO: 214905 - protein, 8 aa, Japanese encephalitis virus
PILALLTP

SEQ ID NO: 214906 - protein, 8 aa, Japanese encephalitis virus
ILALLTPG

SEQ ID NO: 214907 - protein, 8 aa, Japanese encephalitis virus
LTLLTPGM

SEQ ID NO: 214908 - protein, 8 aa, Japanese encephalitis virus
ALLAPGMR

SEQ ID NO: 214909 - protein, 8 aa, Japanese encephalitis virus
LLTPGMKA

SEQ ID NO: 214910 - protein, 8 aa, Japanese encephalitis virus
LTPGMRAF

SEQ ID NO: 214911 - protein, 8 aa, Japanese encephalitis virus
APGMRALY

SEQ ID NO: 214912 - protein, 8 aa, Japanese encephalitis virus
PGMRALCL

SEQ ID NO: 214913 - protein, 8 aa, Japanese encephalitis virus
GMRAFDLD

SEQ ID NO: 214914 - protein, 8 aa, Japanese encephalitis virus
MKALYLDT

SEQ ID NO: 214915 - protein, 8 aa, Japanese encephalitis virus
RALCLDTY

SEQ ID NO: 214916 - protein, 8 aa, Japanese encephalitis virus
ALCLDTYR

SEQ ID NO: 214917 - protein, 8 aa, Japanese encephalitis virus
FDLDTYRI

SEQ ID NO: 214918 - protein, 8 aa, Japanese encephalitis virus
CLDTYRII

SEQ ID NO: 214919 - protein, 8 aa, Japanese encephalitis virus
TYRIILLI

SEQ ID NO: 214920 - protein, 8 aa, Japanese encephalitis virus
YRIILLII

SEQ ID NO: 214921 - protein, 8 aa, Japanese encephalitis virus
RIILLIIG

SEQ ID NO: 214922 - protein, 8 aa, Japanese encephalitis virus
IILLVIGV

SEQ ID NO: 214923 - protein, 8 aa, Japanese encephalitis virus
ILLVIGVC

SEQ ID NO: 214924 - protein, 8 aa, Japanese encephalitis virus
LLVIGVCS

SEQ ID NO: 214925 - protein, 8 aa, Japanese encephalitis virus
LVIGVCSL

SEQ ID NO: 214926 - protein, 8 aa, Japanese encephalitis virus
VIGVCSLL

SEQ ID NO: 214927 - protein, 8 aa, Japanese encephalitis virus
IGICSLLH

SEQ ID NO: 214928 - protein, 8 aa, Japanese encephalitis virus
GICSLLHE

SEQ ID NO: 214929 - protein, 8 aa, Japanese encephalitis virus
ICSLLHER

SEQ ID NO: 214930 - protein, 8 aa, Japanese encephalitis virus
CSLLQERR

SEQ ID NO: 214931 - protein, 8 aa, Japanese encephalitis virus
ERRKTMAK

SEQ ID NO: 214932 - protein, 8 aa, Japanese encephalitis virus
RRKTMAKK

SEQ ID NO: 214933 - protein, 8 aa, Japanese encephalitis virus
RKTMAKKK

SEQ ID NO: 214934 - protein, 8 aa, Japanese encephalitis virus
KAMAKKKG

SEQ ID NO: 214935 - protein, 8 aa, Japanese encephalitis virus
AMAKKKGA

SEQ ID NO: 214936 - protein, 8 aa, Japanese encephalitis virus
KKKGAVLM

SEQ ID NO: 214937 - protein, 8 aa, Japanese encephalitis virus
KKGAVLMG

SEQ ID NO: 214938 - protein, 8 aa, Japanese encephalitis virus
KGAVLMGL

SEQ ID NO: 214939 - protein, 8 aa, Japanese encephalitis virus
GAVLMGLA

SEQ ID NO: 214940 - protein, 8 aa, Japanese encephalitis virus
AVLMGLAL

SEQ ID NO: 214941 - protein, 8 aa, Japanese encephalitis virus
VLMGLALT

SEQ ID NO: 214942 - protein, 8 aa, Japanese encephalitis virus
LMGLALTS

SEQ ID NO: 214943 - protein, 8 aa, Japanese encephalitis virus
MGLALTST

SEQ ID NO: 214944 - protein, 8 aa, Japanese encephalitis virus
WFSPTTIT

SEQ ID NO: 214945 - protein, 8 aa, Japanese encephalitis virus
FSPTTITA

SEQ ID NO: 214946 - protein, 8 aa, Japanese encephalitis virus
SPTTITAG

SEQ ID NO: 214947 - protein, 8 aa, Japanese encephalitis virus
PTTITAGL

SEQ ID NO: 214948 - protein, 8 aa, Japanese encephalitis virus
TTITAGLM

SEQ ID NO: 214949 - protein, 8 aa, Japanese encephalitis virus
TIAAGLMA

SEQ ID NO: 214950 - protein, 8 aa, Japanese encephalitis virus
IAAGLMAC

SEQ ID NO: 214951 - protein, 8 aa, Japanese encephalitis virus
TAGLMVCN

SEQ ID NO: 214952 - protein, 8 aa, Japanese encephalitis virus
AGLMACNP

SEQ ID NO: 214953 - protein, 8 aa, Japanese encephalitis virus
GLMACNPN

SEQ ID NO: 214954 - protein, 8 aa, Japanese encephalitis virus
LMACNPNK

SEQ ID NO: 214955 - protein, 8 aa, Japanese encephalitis virus
MACNPNKK

SEQ ID NO: 214956 - protein, 8 aa, Japanese encephalitis virus
ACNPNKKR

SEQ ID NO: 214957 - protein, 8 aa, Japanese encephalitis virus
RGWPATEV

SEQ ID NO: 214958 - protein, 8 aa, Japanese encephalitis virus
GWPATEVL

SEQ ID NO: 214959 - protein, 8 aa, Japanese encephalitis virus
WPATEVLS

SEQ ID NO: 214960 - protein, 8 aa, Japanese encephalitis virus
PATEVLSA

SEQ ID NO: 214961 - protein, 8 aa, Japanese encephalitis virus
ATEFLSAI

SEQ ID NO: 214962 - protein, 8 aa, Japanese encephalitis virus
TEFLSAIG

SEQ ID NO: 214963 - protein, 8 aa, Japanese encephalitis virus
EFLSAIGL

SEQ ID NO: 214964 - protein, 8 aa, Japanese encephalitis virus
FLSAIGLM

SEQ ID NO: 214965 - protein, 8 aa, Japanese encephalitis virus
LSAIGLMF

SEQ ID NO: 214966 - protein, 8 aa, Japanese encephalitis virus
SAIGLMFA

SEQ ID NO: 214967 - protein, 8 aa, Japanese encephalitis virus
AIGLMFAI

SEQ ID NO: 214968 - protein, 8 aa, Japanese encephalitis virus
IGLMFAIV

SEQ ID NO: 214969 - protein, 8 aa, Japanese encephalitis virus
IVGGLAEM

SEQ ID NO: 214970 - protein, 8 aa, Japanese encephalitis virus
VGGLAEMD

SEQ ID NO: 214971 - protein, 8 aa, Japanese encephalitis virus
GGLAEMDI

SEQ ID NO: 214972 - protein, 8 aa, Japanese encephalitis virus
GLAEMDIE

SEQ ID NO: 214973 - protein, 8 aa, Japanese encephalitis virus
LAEMDIES

SEQ ID NO: 214974 - protein, 8 aa, Japanese encephalitis virus
AEMDIESM

SEQ ID NO: 214975 - protein, 8 aa, Japanese encephalitis virus
EMDIESMS

SEQ ID NO: 214976 - protein, 8 aa, Japanese encephalitis virus
MDIESMSI

SEQ ID NO: 214977 - protein, 8 aa, Japanese encephalitis virus
SIPFMLAV

SEQ ID NO: 214978 - protein, 8 aa, Japanese encephalitis virus
IPFMLAVL

SEQ ID NO: 214979 - protein, 8 aa, Japanese encephalitis virus
PFMLAVLM

SEQ ID NO: 214980 - protein, 8 aa, Japanese encephalitis virus
FMLAVLMA

SEQ ID NO: 214981 - protein, 8 aa, Japanese encephalitis virus
MLAVLMAV

SEQ ID NO: 214982 - protein, 8 aa, Japanese encephalitis virus
LAVLMAVS

SEQ ID NO: 214983 - protein, 8 aa, Japanese encephalitis virus
AVLMAVSY

SEQ ID NO: 214984 - protein, 8 aa, Japanese encephalitis virus
VLMAVSYV

SEQ ID NO: 214985 - protein, 8 aa, Japanese encephalitis virus
KATDMWLD

SEQ ID NO: 214986 - protein, 8 aa, Japanese encephalitis virus
ATDMWLDR

SEQ ID NO: 214987 - protein, 8 aa, Japanese encephalitis virus
TDMWLDRA

SEQ ID NO: 214988 - protein, 8 aa, Japanese encephalitis virus
DMWLDRAA

SEQ ID NO: 214989 - protein, 8 aa, Japanese encephalitis virus
MWLDRAAD

SEQ ID NO: 214990 - protein, 8 aa, Japanese encephalitis virus
WLDRAADI

SEQ ID NO: 214991 - protein, 8 aa, Japanese encephalitis virus
LDRAADIS

SEQ ID NO: 214992 - protein, 8 aa, Japanese encephalitis virus
DRAADISW

SEQ ID NO: 214993 - protein, 8 aa, Japanese encephalitis virus
RAADISWD

SEQ ID NO: 214994 - protein, 8 aa, Japanese encephalitis virus
AADISWDM

SEQ ID NO: 214995 - protein, 8 aa, Japanese encephalitis virus
SWEMEAAI

SEQ ID NO: 214996 - protein, 8 aa, Japanese encephalitis virus
WEMEAAIT

SEQ ID NO: 214997 - protein, 8 aa, Japanese encephalitis virus
EMEAAITG

SEQ ID NO: 214998 - protein, 8 aa, Japanese encephalitis virus
MEAAITGS

SEQ ID NO: 214999 - protein, 8 aa, Japanese encephalitis virus
EAAITGSS

SEQ ID NO: 215000 - protein, 8 aa, Japanese encephalitis virus
RLDVKLDE

SEQ ID NO: 215001 - protein, 8 aa, Japanese encephalitis virus
LDVKLDED

SEQ ID NO: 215002 - protein, 8 aa, Japanese encephalitis virus
DVKLDEDG

SEQ ID NO: 215003 - protein, 8 aa, Japanese encephalitis virus
VKLDEDGD

SEQ ID NO: 215004 - protein, 8 aa, Japanese encephalitis virus
KLDEDGDF

SEQ ID NO: 215005 - protein, 8 aa, Japanese encephalitis virus
LDEDGDFH

SEQ ID NO: 215006 - protein, 8 aa, Japanese encephalitis virus
DEDGDFHL

SEQ ID NO: 215007 - protein, 8 aa, Japanese encephalitis virus
EDGDFHLI

SEQ ID NO: 215008 - protein, 8 aa, Japanese encephalitis virus
DGDFHFID

SEQ ID NO: 215009 - protein, 8 aa, Japanese encephalitis virus
GDFHLIDV

SEQ ID NO: 215010 - protein, 8 aa, Japanese encephalitis virus
DFHLIDVP

SEQ ID NO: 215011 - protein, 8 aa, Japanese encephalitis virus
FHFIDDPG

SEQ ID NO: 215012 - protein, 8 aa, Japanese encephalitis virus
HLIDVPGV

SEQ ID NO: 215013 - protein, 8 aa, Japanese encephalitis virus
LIDVPGVP

SEQ ID NO: 215014 - protein, 8 aa, Japanese encephalitis virus
IDVPGVPW

SEQ ID NO: 215015 - protein, 8 aa, Japanese encephalitis virus
DVPGVPWK

SEQ ID NO: 215016 - protein, 8 aa, Japanese encephalitis virus
DPGVPWKI

SEQ ID NO: 215017 - protein, 8 aa, Japanese encephalitis virus
PGVPWKIW

SEQ ID NO: 215018 - protein, 8 aa, Japanese encephalitis virus
GVPWKVWL

SEQ ID NO: 215019 - protein, 8 aa, Japanese encephalitis virus
VPWKVWLL

SEQ ID NO: 215020 - protein, 8 aa, Japanese encephalitis virus
PWKVWLLR

SEQ ID NO: 215021 - protein, 8 aa, Japanese encephalitis virus
WKVWLLRM

SEQ ID NO: 215022 - protein, 8 aa, Japanese encephalitis virus
KVWLLRMS

SEQ ID NO: 215023 - protein, 8 aa, Japanese encephalitis virus
VWLLRMSC

SEQ ID NO: 215024 - protein, 8 aa, Japanese encephalitis virus
WLLRMSCI

SEQ ID NO: 215025 - protein, 8 aa, Japanese encephalitis virus
LLRMSCIG

SEQ ID NO: 215026 - protein, 8 aa, Japanese encephalitis virus
LRTSCIGL

SEQ ID NO: 215027 - protein, 8 aa, Japanese encephalitis virus
RMSCICLA

SEQ ID NO: 215028 - protein, 8 aa, Japanese encephalitis virus
MSCICLAA

SEQ ID NO: 215029 - protein, 8 aa, Japanese encephalitis virus
SCSGLAAL

SEQ ID NO: 215030 - protein, 8 aa, Japanese encephalitis virus
CSGLAALT

SEQ ID NO: 215031 - protein, 8 aa, Japanese encephalitis virus
ICLAALTP

SEQ ID NO: 215032 - protein, 8 aa, Japanese encephalitis virus
CLAALTPW

SEQ ID NO: 215033 - protein, 8 aa, Japanese encephalitis virus
LVALTPWA

SEQ ID NO: 215034 - protein, 8 aa, Japanese encephalitis virus
VALTPWAI

SEQ ID NO: 215035 - protein, 8 aa, Japanese encephalitis virus
TPSPKPCL

SEQ ID NO: 215036 - protein, 8 aa, Japanese encephalitis virus
PSPKPCLK

SEQ ID NO: 215037 - protein, 8 aa, Japanese encephalitis virus
SPKPCLKG

SEQ ID NO: 215038 - protein, 8 aa, Japanese encephalitis virus
PKPCLKGD

SEQ ID NO: 215039 - protein, 8 aa, Japanese encephalitis virus
KPCLKGDT

SEQ ID NO: 215040 - protein, 8 aa, Japanese encephalitis virus
PCLKGDTT

SEQ ID NO: 215041 - protein, 8 aa, Japanese encephalitis virus
CLKGDTTT

SEQ ID NO: 215042 - protein, 8 aa, Japanese encephalitis virus
LKGDTTTG

SEQ ID NO: 215043 - protein, 8 aa, Japanese encephalitis virus
GVYRIMAC

SEQ ID NO: 215044 - protein, 8 aa, Japanese encephalitis virus
VYRIMACG

SEQ ID NO: 215045 - protein, 8 aa, Japanese encephalitis virus
YRIMACGI

SEQ ID NO: 215046 - protein, 8 aa, Japanese encephalitis virus
RIMACGIL

SEQ ID NO: 215047 - protein, 8 aa, Japanese encephalitis virus
IMACGILG

SEQ ID NO: 215048 - protein, 8 aa, Japanese encephalitis virus
MACGILGT

SEQ ID NO: 215049 - protein, 8 aa, Japanese encephalitis virus
ACGILGTY

SEQ ID NO: 215050 - protein, 8 aa, Japanese encephalitis virus
RGIFGTHQ

SEQ ID NO: 215051 - protein, 8 aa, Japanese encephalitis virus
GILGTYQS

SEQ ID NO: 215052 - protein, 8 aa, Japanese encephalitis virus
IFGTHQAG

SEQ ID NO: 215053 - protein, 8 aa, Japanese encephalitis virus
LGTYQSGV

SEQ ID NO: 215054 - protein, 8 aa, Japanese encephalitis virus
GTHQAGVG

SEQ ID NO: 215055 - protein, 8 aa, Japanese encephalitis virus
TYQSGVGV

SEQ ID NO: 215056 - protein, 8 aa, Japanese encephalitis virus
HQAGVGVM

SEQ ID NO: 215057 - protein, 8 aa, Japanese encephalitis virus
QSGVGVIY

SEQ ID NO: 215058 - protein, 8 aa, Japanese encephalitis virus
SGVGVIYE

SEQ ID NO: 215059 - protein, 8 aa, Japanese encephalitis virus
GVGVMYES

SEQ ID NO: 215060 - protein, 8 aa, Japanese encephalitis virus
VGVMYQNV

SEQ ID NO: 215061 - protein, 8 aa, Japanese encephalitis virus
GVMYESVF

SEQ ID NO: 215062 - protein, 8 aa, Japanese encephalitis virus
VMYESVFH

SEQ ID NO: 215063 - protein, 8 aa, Japanese encephalitis virus
MYQNVFHT

SEQ ID NO: 215064 - protein, 8 aa, Japanese encephalitis virus
YQNVFHTL

SEQ ID NO: 215065 - protein, 8 aa, Japanese encephalitis virus
ENVLHTLW

SEQ ID NO: 215066 - protein, 8 aa, Japanese encephalitis virus
SVFHTLWH

SEQ ID NO: 215067 - protein, 8 aa, Japanese encephalitis virus
VFHTLWHP

SEQ ID NO: 215068 - protein, 8 aa, Japanese encephalitis virus
FHTLWHPT

SEQ ID NO: 215069 - protein, 8 aa, Japanese encephalitis virus
HTLWHPTR

SEQ ID NO: 215070 - protein, 8 aa, Japanese encephalitis virus
TLWHPTRG

SEQ ID NO: 215071 - protein, 8 aa, Japanese encephalitis virus
LWHPTRGA

SEQ ID NO: 215072 - protein, 8 aa, Japanese encephalitis virus
WHPTRGAA

SEQ ID NO: 215073 - protein, 8 aa, Japanese encephalitis virus
HTTRGAAV

SEQ ID NO: 215074 - protein, 8 aa, Japanese encephalitis virus
TTRGAAIV

SEQ ID NO: 215075 - protein, 8 aa, Japanese encephalitis virus
TRGAAIVS

SEQ ID NO: 215076 - protein, 8 aa, Japanese encephalitis virus
RGAAIVSG

SEQ ID NO: 215077 - protein, 8 aa, Japanese encephalitis virus
GAAIVSGE

SEQ ID NO: 215078 - protein, 8 aa, Japanese encephalitis virus
AAIVSGEG

SEQ ID NO: 215079 - protein, 8 aa, Japanese encephalitis virus
AIVSGEGK

SEQ ID NO: 215080 - protein, 8 aa, Japanese encephalitis virus
IVSGEGKL

SEQ ID NO: 215081 - protein, 8 aa, Japanese encephalitis virus
VSGEGKLT

SEQ ID NO: 215082 - protein, 8 aa, Japanese encephalitis virus
SGGGKLTP

SEQ ID NO: 215083 - protein, 8 aa, Japanese encephalitis virus
GKGKLTPY

SEQ ID NO: 215084 - protein, 8 aa, Japanese encephalitis virus
GGKLTPYW

SEQ ID NO: 215085 - protein, 8 aa, Japanese encephalitis virus
TPYWGSVR

SEQ ID NO: 215086 - protein, 8 aa, Japanese encephalitis virus
PYWGSVRE

SEQ ID NO: 215087 - protein, 8 aa, Japanese encephalitis virus
YWGSVRED

SEQ ID NO: 215088 - protein, 8 aa, Japanese encephalitis virus
WGSVREDR

SEQ ID NO: 215089 - protein, 8 aa, Japanese encephalitis virus
GSVREDRI

SEQ ID NO: 215090 - protein, 8 aa, Japanese encephalitis virus
SVKEDRIS

SEQ ID NO: 215091 - protein, 8 aa, Japanese encephalitis virus
VKEDRISY

SEQ ID NO: 215092 - protein, 8 aa, Japanese encephalitis virus
KEDRISYG

SEQ ID NO: 215093 - protein, 8 aa, Japanese encephalitis virus
EDRISYGG

SEQ ID NO: 215094 - protein, 8 aa, Japanese encephalitis virus
DRISYGGP

SEQ ID NO: 215095 - protein, 8 aa, Japanese encephalitis virus
RISYGGPW

SEQ ID NO: 215096 - protein, 8 aa, Japanese encephalitis virus
ISYGGPWR

SEQ ID NO: 215097 - protein, 8 aa, Japanese encephalitis virus
SYGGPWRF

SEQ ID NO: 215098 - protein, 8 aa, Japanese encephalitis virus
DRKWNGTN

SEQ ID NO: 215099 - protein, 8 aa, Japanese encephalitis virus
RKWNGTND

SEQ ID NO: 215100 - protein, 8 aa, Japanese encephalitis virus
KWNGTNDV

SEQ ID NO: 215101 - protein, 8 aa, Japanese encephalitis virus
WNGTNDVQ

SEQ ID NO: 215102 - protein, 8 aa, Japanese encephalitis virus
NGTNDVQV

SEQ ID NO: 215103 - protein, 8 aa, Japanese encephalitis virus
GTNDVQVI

SEQ ID NO: 215104 - protein, 8 aa, Japanese encephalitis virus
TNDVQVIV

SEQ ID NO: 215105 - protein, 8 aa, Japanese encephalitis virus
NDVQVIVV

SEQ ID NO: 215106 - protein, 8 aa, Japanese encephalitis virus
VQVIVVEQ

SEQ ID NO: 215107 - protein, 8 aa, Japanese encephalitis virus
QVIVVEQG

SEQ ID NO: 215108 - protein, 8 aa, Japanese encephalitis virus
VIVVEQGK

SEQ ID NO: 215109 - protein, 8 aa, Japanese encephalitis virus
IVVEPGKP

SEQ ID NO: 215110 - protein, 8 aa, Japanese encephalitis virus
VVEPGKPA

SEQ ID NO: 215111 - protein, 8 aa, Japanese encephalitis virus
AVNFQTKP

SEQ ID NO: 215112 - protein, 8 aa, Japanese encephalitis virus
VSIQTKPG

SEQ ID NO: 215113 - protein, 8 aa, Japanese encephalitis virus
NIQTKPGI

SEQ ID NO: 215114 - protein, 8 aa, Japanese encephalitis virus
IQTKPGIF

SEQ ID NO: 215115 - protein, 8 aa, Japanese encephalitis virus
QTKPGIFP

SEQ ID NO: 215116 - protein, 8 aa, Japanese encephalitis virus
TKPGVFCT

SEQ ID NO: 215117 - protein, 8 aa, Japanese encephalitis virus
KPGIFPTP

SEQ ID NO: 215118 - protein, 8 aa, Japanese encephalitis virus
PGVFRTPL

SEQ ID NO: 215119 - protein, 8 aa, Japanese encephalitis virus
GIFPPPFG

SEQ ID NO: 215120 - protein, 8 aa, Japanese encephalitis virus
PFGEIGAV

SEQ ID NO: 215121 - protein, 8 aa, Japanese encephalitis virus
FGEIGAVS

SEQ ID NO: 215122 - protein, 8 aa, Japanese encephalitis virus
GEIGAVSL

SEQ ID NO: 215123 - protein, 8 aa, Japanese encephalitis virus
EIGAVSLD

SEQ ID NO: 215124 - protein, 8 aa, Japanese encephalitis virus
IGAVSLDY

SEQ ID NO: 215125 - protein, 8 aa, Japanese encephalitis virus
GTVSLDYP

SEQ ID NO: 215126 - protein, 8 aa, Japanese encephalitis virus
TVSLDYPR

SEQ ID NO: 215127 - protein, 8 aa, Japanese encephalitis virus
TSGSPILN

SEQ ID NO: 215128 - protein, 8 aa, Japanese encephalitis virus
SGSPILNS

SEQ ID NO: 215129 - protein, 8 aa, Japanese encephalitis virus
GSPILDFN

SEQ ID NO: 215130 - protein, 8 aa, Japanese encephalitis virus
SPILDFNG

SEQ ID NO: 215131 - protein, 8 aa, Japanese encephalitis virus
PILDFNGD

SEQ ID NO: 215132 - protein, 8 aa, Japanese encephalitis virus
ILNSNGDV

SEQ ID NO: 215133 - protein, 8 aa, Japanese encephalitis virus
LDFNGDII

SEQ ID NO: 215134 - protein, 8 aa, Japanese encephalitis virus
NSNGDVVG

SEQ ID NO: 215135 - protein, 8 aa, Japanese encephalitis virus
SNGDVVGC

SEQ ID NO: 215136 - protein, 8 aa, Japanese encephalitis virus
NGDVVGCL

SEQ ID NO: 215137 - protein, 8 aa, Japanese encephalitis virus
GDVVGCLG

SEQ ID NO: 215138 - protein, 8 aa, Japanese encephalitis virus
DVVGCLGN

SEQ ID NO: 215139 - protein, 8 aa, Japanese encephalitis virus
VVGCLGNG

SEQ ID NO: 215140 - protein, 8 aa, Japanese encephalitis virus
IGLYGNGG

SEQ ID NO: 215141 - protein, 8 aa, Japanese encephalitis virus
GLYGNGGE

SEQ ID NO: 215142 - protein, 8 aa, Japanese encephalitis virus
CLGNGVEL

SEQ ID NO: 215143 - protein, 8 aa, Japanese encephalitis virus
YGNGGELG

SEQ ID NO: 215144 - protein, 8 aa, Japanese encephalitis virus
GNGGELGD

SEQ ID NO: 215145 - protein, 8 aa, Japanese encephalitis virus
NGGELGDG

SEQ ID NO: 215146 - protein, 8 aa, Japanese encephalitis virus
GVELGDRS

SEQ ID NO: 215147 - protein, 8 aa, Japanese encephalitis virus
GELGDGSY

SEQ ID NO: 215148 - protein, 8 aa, Japanese encephalitis virus
ELGDRSYV

SEQ ID NO: 215149 - protein, 8 aa, Japanese encephalitis virus
LGDRSYVS

SEQ ID NO: 215150 - protein, 8 aa, Japanese encephalitis virus
GDRSYVSA

SEQ ID NO: 215151 - protein, 8 aa, Japanese encephalitis virus
DRSYVSAI

SEQ ID NO: 215152 - protein, 8 aa, Japanese encephalitis virus
RSYVSAIV

SEQ ID NO: 215153 - protein, 8 aa, Japanese encephalitis virus
VSAIVQGE

SEQ ID NO: 215154 - protein, 8 aa, Japanese encephalitis virus
SAIVQGER

SEQ ID NO: 215155 - protein, 8 aa, Japanese encephalitis virus
AIVQGERQ

SEQ ID NO: 215156 - protein, 8 aa, Japanese encephalitis virus
IVQGERQE

SEQ ID NO: 215157 - protein, 8 aa, Japanese encephalitis virus
VQGERQEE

SEQ ID NO: 215158 - protein, 8 aa, Japanese encephalitis virus
QGERQEEP

SEQ ID NO: 215159 - protein, 8 aa, Japanese encephalitis virus
GERQEEPV

SEQ ID NO: 215160 - protein, 8 aa, Japanese encephalitis virus
ERQEEPVP

SEQ ID NO: 215161 - protein, 8 aa, Japanese encephalitis virus
RQEEPVPD

SEQ ID NO: 215162 - protein, 8 aa, Japanese encephalitis virus
QEEPVPDA

SEQ ID NO: 215163 - protein, 8 aa, Japanese encephalitis virus
EEPVPDAY

SEQ ID NO: 215164 - protein, 8 aa, Japanese encephalitis virus
EPVPDAYT

SEQ ID NO: 215165 - protein, 8 aa, Japanese encephalitis virus
PVPDAYTP

SEQ ID NO: 215166 - protein, 8 aa, Japanese encephalitis virus
VPDAYTPS

SEQ ID NO: 215167 - protein, 8 aa, Japanese encephalitis virus
PDAYTPSM

SEQ ID NO: 215168 - protein, 8 aa, Japanese encephalitis virus
DAYTPSML

SEQ ID NO: 215169 - protein, 8 aa, Japanese encephalitis virus
AYTPSMLK

SEQ ID NO: 215170 - protein, 8 aa, Japanese encephalitis virus
YTPSMLKK

SEQ ID NO: 215171 - protein, 8 aa, Japanese encephalitis virus
PSMLKKRQ

SEQ ID NO: 215172 - protein, 8 aa, Japanese encephalitis virus
MLKKRQMT

SEQ ID NO: 215173 - protein, 8 aa, Japanese encephalitis virus
LKKRQMTV

SEQ ID NO: 215174 - protein, 8 aa, Japanese encephalitis virus
KKRQMTVL

SEQ ID NO: 215175 - protein, 8 aa, Japanese encephalitis virus
KRQLTVLD

SEQ ID NO: 215176 - protein, 8 aa, Japanese encephalitis virus
RQLTVLDL

SEQ ID NO: 215177 - protein, 8 aa, Japanese encephalitis virus
QLTVLDLH

SEQ ID NO: 215178 - protein, 8 aa, Japanese encephalitis virus
LTVLDLHP

SEQ ID NO: 215179 - protein, 8 aa, Japanese encephalitis virus
TVLDLPPG

SEQ ID NO: 215180 - protein, 8 aa, Japanese encephalitis virus
VLDLHPGL

SEQ ID NO: 215181 - protein, 8 aa, Japanese encephalitis virus
LDLHPGLG

SEQ ID NO: 215182 - protein, 8 aa, Japanese encephalitis virus
DLHPGLGK

SEQ ID NO: 215183 - protein, 8 aa, Japanese encephalitis virus
LHPGLGKT

SEQ ID NO: 215184 - protein, 8 aa, Japanese encephalitis virus
HPGSGKTK

SEQ ID NO: 215185 - protein, 8 aa, Japanese encephalitis virus
PGSGKTKK

SEQ ID NO: 215186 - protein, 8 aa, Japanese encephalitis virus
GSGKTKKI

SEQ ID NO: 215187 - protein, 8 aa, Japanese encephalitis virus
SGKTKKIL

SEQ ID NO: 215188 - protein, 8 aa, Japanese encephalitis virus
GKTKKILP

SEQ ID NO: 215189 - protein, 8 aa, Japanese encephalitis virus
KTKKILPQ

SEQ ID NO: 215190 - protein, 8 aa, Japanese encephalitis virus
TKKILPQI

SEQ ID NO: 215191 - protein, 8 aa, Japanese encephalitis virus
KKILPQII

SEQ ID NO: 215192 - protein, 8 aa, Japanese encephalitis virus
KILPQTIK

SEQ ID NO: 215193 - protein, 8 aa, Japanese encephalitis virus
ILPQIIRD

SEQ ID NO: 215194 - protein, 8 aa, Japanese encephalitis virus
LPQTIKDA

SEQ ID NO: 215195 - protein, 8 aa, Japanese encephalitis virus
PQIIRDAI

SEQ ID NO: 215196 - protein, 8 aa, Japanese encephalitis virus
QIIRDAIQ

SEQ ID NO: 215197 - protein, 8 aa, Japanese encephalitis virus
IIRDAIQQ

SEQ ID NO: 215198 - protein, 8 aa, Japanese encephalitis virus
IKDAIQQH

SEQ ID NO: 215199 - protein, 8 aa, Japanese encephalitis virus
KDAIQQHL

SEQ ID NO: 215200 - protein, 8 aa, Japanese encephalitis virus
DAIQQHLR

SEQ ID NO: 215201 - protein, 8 aa, Japanese encephalitis virus
AIQQRLKT

SEQ ID NO: 215202 - protein, 8 aa, Japanese encephalitis virus
IQQRLKTA

SEQ ID NO: 215203 - protein, 8 aa, Japanese encephalitis virus
QQRLKTAV

SEQ ID NO: 215204 - protein, 8 aa, Japanese encephalitis virus
QRLKTAVL

SEQ ID NO: 215205 - protein, 8 aa, Japanese encephalitis virus
RLKTAVLA

SEQ ID NO: 215206 - protein, 8 aa, Japanese encephalitis virus
LKTAVLAP

SEQ ID NO: 215207 - protein, 8 aa, Japanese encephalitis virus
KTAVLAPT

SEQ ID NO: 215208 - protein, 8 aa, Japanese encephalitis virus
VAAEMAEV

SEQ ID NO: 215209 - protein, 8 aa, Japanese encephalitis virus
AAEMAEVL

SEQ ID NO: 215210 - protein, 8 aa, Japanese encephalitis virus
AEMAEALK

SEQ ID NO: 215211 - protein, 8 aa, Japanese encephalitis virus
EMAEALKG

SEQ ID NO: 215212 - protein, 8 aa, Japanese encephalitis virus
MAEALKGL

SEQ ID NO: 215213 - protein, 8 aa, Japanese encephalitis virus
AEALKGLP

SEQ ID NO: 215214 - protein, 8 aa, Japanese encephalitis virus
EALKGLPV

SEQ ID NO: 215215 - protein, 8 aa, Japanese encephalitis virus
ALKGLPVR

SEQ ID NO: 215216 - protein, 8 aa, Japanese encephalitis virus
LKGLPVRY

SEQ ID NO: 215217 - protein, 8 aa, Japanese encephalitis virus
KGLPVRYQ

SEQ ID NO: 215218 - protein, 8 aa, Japanese encephalitis virus
QTSAVQRS

SEQ ID NO: 215219 - protein, 8 aa, Japanese encephalitis virus
TSAVQRSH

SEQ ID NO: 215220 - protein, 8 aa, Japanese encephalitis virus
SAVQRSHQ

SEQ ID NO: 215221 - protein, 8 aa, Japanese encephalitis virus
AVQRSHQG

SEQ ID NO: 215222 - protein, 8 aa, Japanese encephalitis virus
VQRSHQGN

SEQ ID NO: 215223 - protein, 8 aa, Japanese encephalitis virus
QRSHQGNE

SEQ ID NO: 215224 - protein, 8 aa, Japanese encephalitis virus
RSHQGNEI

SEQ ID NO: 215225 - protein, 8 aa, Japanese encephalitis virus
SHQGNEIV

SEQ ID NO: 215226 - protein, 8 aa, Japanese encephalitis virus
HQGNAIVD

SEQ ID NO: 215227 - protein, 8 aa, Japanese encephalitis virus
QGNAIVDV

SEQ ID NO: 215228 - protein, 8 aa, Japanese encephalitis virus
GNAIVDVM

SEQ ID NO: 215229 - protein, 8 aa, Japanese encephalitis virus
NAIVDVMC

SEQ ID NO: 215230 - protein, 8 aa, Japanese encephalitis virus
AIVDVMCH

SEQ ID NO: 215231 - protein, 8 aa, Japanese encephalitis virus
ATLTHRLT

SEQ ID NO: 215232 - protein, 8 aa, Japanese encephalitis virus
TLTHRLTS

SEQ ID NO: 215233 - protein, 8 aa, Japanese encephalitis virus
LTHRLTSP

SEQ ID NO: 215234 - protein, 8 aa, Japanese encephalitis virus
THRLTSPN

SEQ ID NO: 215235 - protein, 8 aa, Japanese encephalitis virus
HRLTSPNR

SEQ ID NO: 215236 - protein, 8 aa, Japanese encephalitis virus
RLTSPNRV

SEQ ID NO: 215237 - protein, 8 aa, Japanese encephalitis virus
LTSPNRVP

SEQ ID NO: 215238 - protein, 8 aa, Japanese encephalitis virus
TSPNRVPN

SEQ ID NO: 215239 - protein, 8 aa, Japanese encephalitis virus
AHFTDPAG

SEQ ID NO: 215240 - protein, 8 aa, Japanese encephalitis virus
HFTDPAGI

SEQ ID NO: 215241 - protein, 8 aa, Japanese encephalitis virus
FTDPAGIA

SEQ ID NO: 215242 - protein, 8 aa, Japanese encephalitis virus
TDPAGIAA

SEQ ID NO: 215243 - protein, 8 aa, Japanese encephalitis virus
DPAGIAAR

SEQ ID NO: 215244 - protein, 8 aa, Japanese encephalitis virus
PAGIAARG

SEQ ID NO: 215245 - protein, 8 aa, Japanese encephalitis virus
AGIAARGY

SEQ ID NO: 215246 - protein, 8 aa, Japanese encephalitis virus
GIAARGYI

SEQ ID NO: 215247 - protein, 8 aa, Japanese encephalitis virus
AIFMTATS

SEQ ID NO: 215248 - protein, 8 aa, Japanese encephalitis virus
IFMTATSP

SEQ ID NO: 215249 - protein, 8 aa, Japanese encephalitis virus
FMTATSPG

SEQ ID NO: 215250 - protein, 8 aa, Japanese encephalitis virus
MTATSPGT

SEQ ID NO: 215251 - protein, 8 aa, Japanese encephalitis virus
TATSPGTT

SEQ ID NO: 215252 - protein, 8 aa, Japanese encephalitis virus
ATSPGTTD

SEQ ID NO: 215253 - protein, 8 aa, Japanese encephalitis virus
TSPGTTDP

SEQ ID NO: 215254 - protein, 8 aa, Japanese encephalitis virus
SPGTTDPF

SEQ ID NO: 215255 - protein, 8 aa, Japanese encephalitis virus
TDPFPDSD

SEQ ID NO: 215256 - protein, 8 aa, Japanese encephalitis virus
DPFPDSDA

SEQ ID NO: 215257 - protein, 8 aa, Japanese encephalitis virus
PFPDSDAP

SEQ ID NO: 215258 - protein, 8 aa, Japanese encephalitis virus
FPDSDAPI

SEQ ID NO: 215259 - protein, 8 aa, Japanese encephalitis virus
PDSDAPIH

SEQ ID NO: 215260 - protein, 8 aa, Japanese encephalitis virus
DSDAPIHD

SEQ ID NO: 215261 - protein, 8 aa, Japanese encephalitis virus
SDAPIHDL

SEQ ID NO: 215262 - protein, 8 aa, Japanese encephalitis virus
DAPIHDLQ

SEQ ID NO: 215263 - protein, 8 aa, Japanese encephalitis virus
PIHDLQDG

SEQ ID NO: 215264 - protein, 8 aa, Japanese encephalitis virus
IHDLQDET

SEQ ID NO: 215265 - protein, 8 aa, Japanese encephalitis virus
HDLQDEVP

SEQ ID NO: 215266 - protein, 8 aa, Japanese encephalitis virus
DLQDETPD

SEQ ID NO: 215267 - protein, 8 aa, Japanese encephalitis virus
LQDEVPDR

SEQ ID NO: 215268 - protein, 8 aa, Japanese encephalitis virus
QDEIPDWA

SEQ ID NO: 215269 - protein, 8 aa, Japanese encephalitis virus
DEVPDRAW

SEQ ID NO: 215270 - protein, 8 aa, Japanese encephalitis virus
EVPDRAWS

SEQ ID NO: 215271 - protein, 8 aa, Japanese encephalitis virus
IPDWAWSS

SEQ ID NO: 215272 - protein, 8 aa, Japanese encephalitis virus
PDWAWSSG

SEQ ID NO: 215273 - protein, 8 aa, Japanese encephalitis virus
WITDYAGK

SEQ ID NO: 215274 - protein, 8 aa, Japanese encephalitis virus
ITDYAGKT

SEQ ID NO: 215275 - protein, 8 aa, Japanese encephalitis virus
TDYAGKTV

SEQ ID NO: 215276 - protein, 8 aa, Japanese encephalitis virus
DYAGKTVW

SEQ ID NO: 215277 - protein, 8 aa, Japanese encephalitis virus
YSGKTVWF

SEQ ID NO: 215278 - protein, 8 aa, Japanese encephalitis virus
SGKTVWFV

SEQ ID NO: 215279 - protein, 8 aa, Japanese encephalitis virus
VWFVASVR

SEQ ID NO: 215280 - protein, 8 aa, Japanese encephalitis virus
WFVASVRM

SEQ ID NO: 215281 - protein, 8 aa, Japanese encephalitis virus
FVASVRMG

SEQ ID NO: 215282 - protein, 8 aa, Japanese encephalitis virus
VASVRMGN

SEQ ID NO: 215283 - protein, 8 aa, Japanese encephalitis virus
ASVRMGNE

SEQ ID NO: 215284 - protein, 8 aa, Japanese encephalitis virus
SVRMGNEI

SEQ ID NO: 215285 - protein, 8 aa, Japanese encephalitis virus
VRMGNEIA

SEQ ID NO: 215286 - protein, 8 aa, Japanese encephalitis virus
RMGNEIAM

SEQ ID NO: 215287 - protein, 8 aa, Japanese encephalitis virus
MGNEIAVC

SEQ ID NO: 215288 - protein, 8 aa, Japanese encephalitis virus
GNEIAVCL

SEQ ID NO: 215289 - protein, 8 aa, Japanese encephalitis virus
NEIAVCLQ

SEQ ID NO: 215290 - protein, 8 aa, Japanese encephalitis virus
EIAVCLQR

SEQ ID NO: 215291 - protein, 8 aa, Japanese encephalitis virus
IAVCLQRA

SEQ ID NO: 215292 - protein, 8 aa, Japanese encephalitis virus
AVCLQRAG

SEQ ID NO: 215293 - protein, 8 aa, Japanese encephalitis virus
VCLQRAGK

SEQ ID NO: 215294 - protein, 8 aa, Japanese encephalitis virus
CLQRAGKR

SEQ ID NO: 215295 - protein, 8 aa, Japanese encephalitis virus
LQRAGKRV

SEQ ID NO: 215296 - protein, 8 aa, Japanese encephalitis virus
QRAGKRVI

SEQ ID NO: 215297 - protein, 8 aa, Japanese encephalitis virus
RAGKRVIQ

SEQ ID NO: 215298 - protein, 8 aa, Japanese encephalitis virus
AGKRVIQL

SEQ ID NO: 215299 - protein, 8 aa, Japanese encephalitis virus
GKKVIQLS

SEQ ID NO: 215300 - protein, 8 aa, Japanese encephalitis virus
KRVIQLNR

SEQ ID NO: 215301 - protein, 8 aa, Japanese encephalitis virus
KVIQLSRK

SEQ ID NO: 215302 - protein, 8 aa, Japanese encephalitis virus
VIQLSRKS

SEQ ID NO: 215303 - protein, 8 aa, Japanese encephalitis virus
IQLSRKSY

SEQ ID NO: 215304 - protein, 8 aa, Japanese encephalitis virus
QLSRKSYD

SEQ ID NO: 215305 - protein, 8 aa, Japanese encephalitis virus
LSRKSYDT

SEQ ID NO: 215306 - protein, 8 aa, Japanese encephalitis virus
SRKSYDTE

SEQ ID NO: 215307 - protein, 8 aa, Japanese encephalitis virus
ITTDISEV

SEQ ID NO: 215308 - protein, 8 aa, Japanese encephalitis virus
TTDISEVG

SEQ ID NO: 215309 - protein, 8 aa, Japanese encephalitis virus
TDISEVGA

SEQ ID NO: 215310 - protein, 8 aa, Japanese encephalitis virus
DISEVGAN

SEQ ID NO: 215311 - protein, 8 aa, Japanese encephalitis virus
ISEVGANF

SEQ ID NO: 215312 - protein, 8 aa, Japanese encephalitis virus
SEVGANFG

SEQ ID NO: 215313 - protein, 8 aa, Japanese encephalitis virus
EVGANFGA

SEQ ID NO: 215314 - protein, 8 aa, Japanese encephalitis virus
VGANFGAS

SEQ ID NO: 215315 - protein, 8 aa, Japanese encephalitis virus
IDCRKSVE

SEQ ID NO: 215316 - protein, 8 aa, Japanese encephalitis virus
DCRKSVEP

SEQ ID NO: 215317 - protein, 8 aa, Japanese encephalitis virus
CRKSVKPI

SEQ ID NO: 215318 - protein, 8 aa, Japanese encephalitis virus
RKSVEPTI

SEQ ID NO: 215319 - protein, 8 aa, Japanese encephalitis virus
KSVEPTIL

SEQ ID NO: 215320 - protein, 8 aa, Japanese encephalitis virus
SVKPIILE

SEQ ID NO: 215321 - protein, 8 aa, Japanese encephalitis virus
VKPTILEK

SEQ ID NO: 215322 - protein, 8 aa, Japanese encephalitis virus
EPTILEEG

SEQ ID NO: 215323 - protein, 8 aa, Japanese encephalitis virus
PTILEKEE

SEQ ID NO: 215324 - protein, 8 aa, Japanese encephalitis virus
TILEKEEG

SEQ ID NO: 215325 - protein, 8 aa, Japanese encephalitis virus
ILEKEEGR

SEQ ID NO: 215326 - protein, 8 aa, Japanese encephalitis virus
LEKEEGRV

SEQ ID NO: 215327 - protein, 8 aa, Japanese encephalitis virus
EEGEGRVF

SEQ ID NO: 215328 - protein, 8 aa, Japanese encephalitis virus
EGEGRVFL

SEQ ID NO: 215329 - protein, 8 aa, Japanese encephalitis virus
EEGRVILG

SEQ ID NO: 215330 - protein, 8 aa, Japanese encephalitis virus
EGRVFLGN

SEQ ID NO: 215331 - protein, 8 aa, Japanese encephalitis virus
GRVFLGNP

SEQ ID NO: 215332 - protein, 8 aa, Japanese encephalitis virus
RVFLGNPS

SEQ ID NO: 215333 - protein, 8 aa, Japanese encephalitis virus
VFLGNPSP

SEQ ID NO: 215334 - protein, 8 aa, Japanese encephalitis virus
FLGNPSPI

SEQ ID NO: 215335 - protein, 8 aa, Japanese encephalitis virus
GNPSPITN

SEQ ID NO: 215336 - protein, 8 aa, Japanese encephalitis virus
NPSPITNA

SEQ ID NO: 215337 - protein, 8 aa, Japanese encephalitis virus
PSPITNAS

SEQ ID NO: 215338 - protein, 8 aa, Japanese encephalitis virus
SPITNASA

SEQ ID NO: 215339 - protein, 8 aa, Japanese encephalitis virus
PITNASAA

SEQ ID NO: 215340 - protein, 8 aa, Japanese encephalitis virus
ITNASAAQ

SEQ ID NO: 215341 - protein, 8 aa, Japanese encephalitis virus
TNASAAQR

SEQ ID NO: 215342 - protein, 8 aa, Japanese encephalitis virus
NASAAQRR

SEQ ID NO: 215343 - protein, 8 aa, Japanese encephalitis virus
AQRRGRVS

SEQ ID NO: 215344 - protein, 8 aa, Japanese encephalitis virus
QRRGRVSR

SEQ ID NO: 215345 - protein, 8 aa, Japanese encephalitis virus
RRGRVSRN

SEQ ID NO: 215346 - protein, 8 aa, Japanese encephalitis virus
RGRVSRNP

SEQ ID NO: 215347 - protein, 8 aa, Japanese encephalitis virus
GRVGRNPS

SEQ ID NO: 215348 - protein, 8 aa, Japanese encephalitis virus
RVSRNPNQ

SEQ ID NO: 215349 - protein, 8 aa, Japanese encephalitis virus
VSRNPNQV

SEQ ID NO: 215350 - protein, 8 aa, Japanese encephalitis virus
SRNPNQVG

SEQ ID NO: 215351 - protein, 8 aa, Japanese encephalitis virus
RNPSQVGD

SEQ ID NO: 215352 - protein, 8 aa, Japanese encephalitis virus
NPSQVGDE

SEQ ID NO: 215353 - protein, 8 aa, Japanese encephalitis virus
PSQVGDEY

SEQ ID NO: 215354 - protein, 8 aa, Japanese encephalitis virus
SQVGDEYH

SEQ ID NO: 215355 - protein, 8 aa, Japanese encephalitis virus
QVGDEYEY

SEQ ID NO: 215356 - protein, 8 aa, Japanese encephalitis virus
VGDEYEYG

SEQ ID NO: 215357 - protein, 8 aa, Japanese encephalitis virus
GDEYEYGG

SEQ ID NO: 215358 - protein, 8 aa, Japanese encephalitis virus
DEYEYGGA

SEQ ID NO: 215359 - protein, 8 aa, Japanese encephalitis virus
EYHYGGPT

SEQ ID NO: 215360 - protein, 8 aa, Japanese encephalitis virus
YEYGGATS

SEQ ID NO: 215361 - protein, 8 aa, Japanese encephalitis virus
EYGGATSE

SEQ ID NO: 215362 - protein, 8 aa, Japanese encephalitis virus
YGGPTSED

SEQ ID NO: 215363 - protein, 8 aa, Japanese encephalitis virus
GGATSEGD

SEQ ID NO: 215364 - protein, 8 aa, Japanese encephalitis virus
GPTSEDDS

SEQ ID NO: 215365 - protein, 8 aa, Japanese encephalitis virus
ATSEGDSN

SEQ ID NO: 215366 - protein, 8 aa, Japanese encephalitis virus
TSEGDSNL

SEQ ID NO: 215367 - protein, 8 aa, Japanese encephalitis virus
SEDDGNLA

SEQ ID NO: 215368 - protein, 8 aa, Japanese encephalitis virus
EDDGNLAH

SEQ ID NO: 215369 - protein, 8 aa, Japanese encephalitis virus
GDSNLAHW

SEQ ID NO: 215370 - protein, 8 aa, Japanese encephalitis virus
DGNLAHWT

SEQ ID NO: 215371 - protein, 8 aa, Japanese encephalitis virus
GNLAHWTE

SEQ ID NO: 215372 - protein, 8 aa, Japanese encephalitis virus
HWTEAKIL

SEQ ID NO: 215373 - protein, 8 aa, Japanese encephalitis virus
WTEAKILL

SEQ ID NO: 215374 - protein, 8 aa, Japanese encephalitis virus
TEAKILLD

SEQ ID NO: 215375 - protein, 8 aa, Japanese encephalitis virus
EAKILLDN

SEQ ID NO: 215376 - protein, 8 aa, Japanese encephalitis virus
AKILLDNI

SEQ ID NO: 215377 - protein, 8 aa, Japanese encephalitis virus
KILLDNIH

SEQ ID NO: 215378 - protein, 8 aa, Japanese encephalitis virus
ILLDNIHM

SEQ ID NO: 215379 - protein, 8 aa, Japanese encephalitis virus
LLDNIHMP

SEQ ID NO: 215380 - protein, 8 aa, Japanese encephalitis virus
HMPNGLVV

SEQ ID NO: 215381 - protein, 8 aa, Japanese encephalitis virus
MPNGLVVQ

SEQ ID NO: 215382 - protein, 8 aa, Japanese encephalitis virus
PNGLVVQL

SEQ ID NO: 215383 - protein, 8 aa, Japanese encephalitis virus
NGLVVQLY

SEQ ID NO: 215384 - protein, 8 aa, Japanese encephalitis virus
GLVVQLYG

SEQ ID NO: 215385 - protein, 8 aa, Japanese encephalitis virus
LVVQLYGP

SEQ ID NO: 215386 - protein, 8 aa, Japanese encephalitis virus
VVQLYGPE

SEQ ID NO: 215387 - protein, 8 aa, Japanese encephalitis virus
VQLYGPER

SEQ ID NO: 215388 - protein, 8 aa, Japanese encephalitis virus
GPEREKAS

SEQ ID NO: 215389 - protein, 8 aa, Japanese encephalitis virus
PEREKAST

SEQ ID NO: 215390 - protein, 8 aa, Japanese encephalitis virus
EREKASTM

SEQ ID NO: 215391 - protein, 8 aa, Japanese encephalitis virus
REKASTMD

SEQ ID NO: 215392 - protein, 8 aa, Japanese encephalitis virus
EKASTMDG

SEQ ID NO: 215393 - protein, 8 aa, Japanese encephalitis virus
KASTMDGE

SEQ ID NO: 215394 - protein, 8 aa, Japanese encephalitis virus
ASTMDGEY

SEQ ID NO: 215395 - protein, 8 aa, Japanese encephalitis virus
STMDGEYR

SEQ ID NO: 215396 - protein, 8 aa, Japanese encephalitis virus
TMDVEYRL

SEQ ID NO: 215397 - protein, 8 aa, Japanese encephalitis virus
MDVEYRLR

SEQ ID NO: 215398 - protein, 8 aa, Japanese encephalitis virus
DVEYRLRG

SEQ ID NO: 215399 - protein, 8 aa, Japanese encephalitis virus
VEYRLRGE

SEQ ID NO: 215400 - protein, 8 aa, Japanese encephalitis virus
LPVWLAYR

SEQ ID NO: 215401 - protein, 8 aa, Japanese encephalitis virus
PVWLAYRV

SEQ ID NO: 215402 - protein, 8 aa, Japanese encephalitis virus
VWLAYRVA

SEQ ID NO: 215403 - protein, 8 aa, Japanese encephalitis virus
WLAYKVAP

SEQ ID NO: 215404 - protein, 8 aa, Japanese encephalitis virus
LAYRVASN

SEQ ID NO: 215405 - protein, 8 aa, Japanese encephalitis virus
AYKVAPNG

SEQ ID NO: 215406 - protein, 8 aa, Japanese encephalitis virus
YRVASNGI

SEQ ID NO: 215407 - protein, 8 aa, Japanese encephalitis virus
KVAPNGIQ

SEQ ID NO: 215408 - protein, 8 aa, Japanese encephalitis virus
VAPNGIQY

SEQ ID NO: 215409 - protein, 8 aa, Japanese encephalitis virus
APNGIQYT

SEQ ID NO: 215410 - protein, 8 aa, Japanese encephalitis virus
PNGIQYTD

SEQ ID NO: 215411 - protein, 8 aa, Japanese encephalitis virus
GIQYTDRR

SEQ ID NO: 215412 - protein, 8 aa, Japanese encephalitis virus
IQYTDRRW

SEQ ID NO: 215413 - protein, 8 aa, Japanese encephalitis virus
QYTDRRWC

SEQ ID NO: 215414 - protein, 8 aa, Japanese encephalitis virus
YTDRRWCF

SEQ ID NO: 215415 - protein, 8 aa, Japanese encephalitis virus
TDRRWCFD

SEQ ID NO: 215416 - protein, 8 aa, Japanese encephalitis virus
DRRWCFDG

SEQ ID NO: 215417 - protein, 8 aa, Japanese encephalitis virus
RRWCFDGP

SEQ ID NO: 215418 - protein, 8 aa, Japanese encephalitis virus
RWCFDGPR

SEQ ID NO: 215419 - protein, 8 aa, Japanese encephalitis virus
TNAILEDS

SEQ ID NO: 215420 - protein, 8 aa, Japanese encephalitis virus
NAILEDNI

SEQ ID NO: 215421 - protein, 8 aa, Japanese encephalitis virus
AILEDNIE

SEQ ID NO: 215422 - protein, 8 aa, Japanese encephalitis virus
ILEDNIEV

SEQ ID NO: 215423 - protein, 8 aa, Japanese encephalitis virus
LEDNIEVE

SEQ ID NO: 215424 - protein, 8 aa, Japanese encephalitis virus
EDNIEVEI

SEQ ID NO: 215425 - protein, 8 aa, Japanese encephalitis virus
DNIEVEIV

SEQ ID NO: 215426 - protein, 8 aa, Japanese encephalitis virus
NIEVEIVT

SEQ ID NO: 215427 - protein, 8 aa, Japanese encephalitis virus
IEVEIVTR

SEQ ID NO: 215428 - protein, 8 aa, Japanese encephalitis virus
EVEIVTRT

SEQ ID NO: 215429 - protein, 8 aa, Japanese encephalitis virus
VEIVTRTG

SEQ ID NO: 215430 - protein, 8 aa, Japanese encephalitis virus
EIVTRTGE

SEQ ID NO: 215431 - protein, 8 aa, Japanese encephalitis virus
IVTRTGER

SEQ ID NO: 215432 - protein, 8 aa, Japanese encephalitis virus
VTRTGERK

SEQ ID NO: 215433 - protein, 8 aa, Japanese encephalitis virus
TRTGERKV

SEQ ID NO: 215434 - protein, 8 aa, Japanese encephalitis virus
RTGERKVL

SEQ ID NO: 215435 - protein, 8 aa, Japanese encephalitis virus
TGERKVLK

SEQ ID NO: 215436 - protein, 8 aa, Japanese encephalitis virus
GERKVLKP

SEQ ID NO: 215437 - protein, 8 aa, Japanese encephalitis virus
ERKVLKPR

SEQ ID NO: 215438 - protein, 8 aa, Japanese encephalitis virus
RKVLKPRW

SEQ ID NO: 215439 - protein, 8 aa, Japanese encephalitis virus
KVLKPRWL

SEQ ID NO: 215440 - protein, 8 aa, Japanese encephalitis virus
ILKPRWLY

SEQ ID NO: 215441 - protein, 8 aa, Japanese encephalitis virus
LKPRWLYA

SEQ ID NO: 215442 - protein, 8 aa, Japanese encephalitis virus
KPRWLYAR

SEQ ID NO: 215443 - protein, 8 aa, Japanese encephalitis virus
PRWLYARV

SEQ ID NO: 215444 - protein, 8 aa, Japanese encephalitis virus
RWLYARVY

SEQ ID NO: 215445 - protein, 8 aa, Japanese encephalitis virus
WLYARVYA

SEQ ID NO: 215446 - protein, 8 aa, Japanese encephalitis virus
LYARVYAD

SEQ ID NO: 215447 - protein, 8 aa, Japanese encephalitis virus
YARVYADH

SEQ ID NO: 215448 - protein, 8 aa, Japanese encephalitis virus
KWFKDFAS

SEQ ID NO: 215449 - protein, 8 aa, Japanese encephalitis virus
WFKDFASG

SEQ ID NO: 215450 - protein, 8 aa, Japanese encephalitis virus
FKDFASGK

SEQ ID NO: 215451 - protein, 8 aa, Japanese encephalitis virus
KDFASGKR

SEQ ID NO: 215452 - protein, 8 aa, Japanese encephalitis virus
DFASGKRS

SEQ ID NO: 215453 - protein, 8 aa, Japanese encephalitis virus
FASGKRSA

SEQ ID NO: 215454 - protein, 8 aa, Japanese encephalitis virus
AAGKRSAI

SEQ ID NO: 215455 - protein, 8 aa, Japanese encephalitis virus
AGKRSAIS

SEQ ID NO: 215456 - protein, 8 aa, Japanese encephalitis virus
GKRSAISF

SEQ ID NO: 215457 - protein, 8 aa, Japanese encephalitis virus
KRSAISFI

SEQ ID NO: 215458 - protein, 8 aa, Japanese encephalitis virus
RSAISFIE

SEQ ID NO: 215459 - protein, 8 aa, Japanese encephalitis virus
SAISFIEV

SEQ ID NO: 215460 - protein, 8 aa, Japanese encephalitis virus
AISFIEVL

SEQ ID NO: 215461 - protein, 8 aa, Japanese encephalitis virus
ISFIEVLG

SEQ ID NO: 215462 - protein, 8 aa, Japanese encephalitis virus
SFIEEPGR

SEQ ID NO: 215463 - protein, 8 aa, Japanese encephalitis virus
FIEVRGRM

SEQ ID NO: 215464 - protein, 8 aa, Japanese encephalitis virus
IEVRGRMP

SEQ ID NO: 215465 - protein, 8 aa, Japanese encephalitis virus
EVRGRMPE

SEQ ID NO: 215466 - protein, 8 aa, Japanese encephalitis virus
EPGRMPEH

SEQ ID NO: 215467 - protein, 8 aa, Japanese encephalitis virus
RGRMPEHF

SEQ ID NO: 215468 - protein, 8 aa, Japanese encephalitis virus
GRMPEHFA

SEQ ID NO: 215469 - protein, 8 aa, Japanese encephalitis virus
RMPEHFAG

SEQ ID NO: 215470 - protein, 8 aa, Japanese encephalitis virus
MPEHFAGK

SEQ ID NO: 215471 - protein, 8 aa, Japanese encephalitis virus
PEHFAGKT

SEQ ID NO: 215472 - protein, 8 aa, Japanese encephalitis virus
EHFAGKTR

SEQ ID NO: 215473 - protein, 8 aa, Japanese encephalitis virus
HFAGKTRE

SEQ ID NO: 215474 - protein, 8 aa, Japanese encephalitis virus
FAGKTREA

SEQ ID NO: 215475 - protein, 8 aa, Japanese encephalitis virus
AGKTREAL

SEQ ID NO: 215476 - protein, 8 aa, Japanese encephalitis virus
YLVATAER

SEQ ID NO: 215477 - protein, 8 aa, Japanese encephalitis virus
LVATAERG

SEQ ID NO: 215478 - protein, 8 aa, Japanese encephalitis virus
VATAERGG

SEQ ID NO: 215479 - protein, 8 aa, Japanese encephalitis virus
ATAERGGK

SEQ ID NO: 215480 - protein, 8 aa, Japanese encephalitis virus
TAERGGKA

SEQ ID NO: 215481 - protein, 8 aa, Japanese encephalitis virus
AERGGKAH

SEQ ID NO: 215482 - protein, 8 aa, Japanese encephalitis virus
ERGGKAHR

SEQ ID NO: 215483 - protein, 8 aa, Japanese encephalitis virus
RGGKAHRM

SEQ ID NO: 215484 - protein, 8 aa, Japanese encephalitis virus
GGKTHRMA

SEQ ID NO: 215485 - protein, 8 aa, Japanese encephalitis virus
GKTHRMAL

SEQ ID NO: 215486 - protein, 8 aa, Japanese encephalitis virus
KTHRMALE

SEQ ID NO: 215487 - protein, 8 aa, Japanese encephalitis virus
THRMALEE

SEQ ID NO: 215488 - protein, 8 aa, Japanese encephalitis virus
LPDALETV

SEQ ID NO: 215489 - protein, 8 aa, Japanese encephalitis virus
PDALETVT

SEQ ID NO: 215490 - protein, 8 aa, Japanese encephalitis virus
DALETVTL

SEQ ID NO: 215491 - protein, 8 aa, Japanese encephalitis virus
ALETITLT

SEQ ID NO: 215492 - protein, 8 aa, Japanese encephalitis virus
LETITLIA

SEQ ID NO: 215493 - protein, 8 aa, Japanese encephalitis virus
ETITLIAA

SEQ ID NO: 215494 - protein, 8 aa, Japanese encephalitis virus
TITLIAAI

SEQ ID NO: 215495 - protein, 8 aa, Japanese encephalitis virus
AITVMTRG

SEQ ID NO: 215496 - protein, 8 aa, Japanese encephalitis virus
ITAMTGGF

SEQ ID NO: 215497 - protein, 8 aa, Japanese encephalitis virus
TAMTGGFF

SEQ ID NO: 215498 - protein, 8 aa, Japanese encephalitis virus
AMTGGFFL

SEQ ID NO: 215499 - protein, 8 aa, Japanese encephalitis virus
MTRGFFLL

SEQ ID NO: 215500 - protein, 8 aa, Japanese encephalitis virus
TRGFFLLM

SEQ ID NO: 215501 - protein, 8 aa, Japanese encephalitis virus
GGFFLLMK

SEQ ID NO: 215502 - protein, 8 aa, Japanese encephalitis virus
GFFLLMKQ

SEQ ID NO: 215503 - protein, 8 aa, Japanese encephalitis virus
FFLLMKQR

SEQ ID NO: 215504 - protein, 8 aa, Japanese encephalitis virus
FLLMKQRK

SEQ ID NO: 215505 - protein, 8 aa, Japanese encephalitis virus
LLMKQRKG

SEQ ID NO: 215506 - protein, 8 aa, Japanese encephalitis virus
LMKQRKGI

SEQ ID NO: 215507 - protein, 8 aa, Japanese encephalitis virus
MKQRKGIG

SEQ ID NO: 215508 - protein, 8 aa, Japanese encephalitis virus
MQRKGIGR

SEQ ID NO: 215509 - protein, 8 aa, Japanese encephalitis virus
QRKGIGRM

SEQ ID NO: 215510 - protein, 8 aa, Japanese encephalitis virus
RKGIGRMG

SEQ ID NO: 215511 - protein, 8 aa, Japanese encephalitis virus
KGIGRMGL

SEQ ID NO: 215512 - protein, 8 aa, Japanese encephalitis virus
GIGRMGLG

SEQ ID NO: 215513 - protein, 8 aa, Japanese encephalitis virus
IGRMGLGA

SEQ ID NO: 215514 - protein, 8 aa, Japanese encephalitis virus
GRMGLGAL

SEQ ID NO: 215515 - protein, 8 aa, Japanese encephalitis virus
RMGLGALV

SEQ ID NO: 215516 - protein, 8 aa, Japanese encephalitis virus
GLGALVLV

SEQ ID NO: 215517 - protein, 8 aa, Japanese encephalitis virus
LGALVLVL

SEQ ID NO: 215518 - protein, 8 aa, Japanese encephalitis virus
GALVLVLA

SEQ ID NO: 215519 - protein, 8 aa, Japanese encephalitis virus
ALVLVLAT

SEQ ID NO: 215520 - protein, 8 aa, Japanese encephalitis virus
LVLVLATF

SEQ ID NO: 215521 - protein, 8 aa, Japanese encephalitis virus
VLVLATFF

SEQ ID NO: 215522 - protein, 8 aa, Japanese encephalitis virus
LVLATFFL

SEQ ID NO: 215523 - protein, 8 aa, Japanese encephalitis virus
VLATFFLW

SEQ ID NO: 215524 - protein, 8 aa, Japanese encephalitis virus
FLWAAEVS

SEQ ID NO: 215525 - protein, 8 aa, Japanese encephalitis virus
LWAAEVSG

SEQ ID NO: 215526 - protein, 8 aa, Japanese encephalitis virus
WAAEVSGT

SEQ ID NO: 215527 - protein, 8 aa, Japanese encephalitis virus
AAEVSGTK

SEQ ID NO: 215528 - protein, 8 aa, Japanese encephalitis virus
AEVSGTKI

SEQ ID NO: 215529 - protein, 8 aa, Japanese encephalitis virus
EVSGTKIA

SEQ ID NO: 215530 - protein, 8 aa, Japanese encephalitis virus
VSGTKIAG

SEQ ID NO: 215531 - protein, 8 aa, Japanese encephalitis virus
SGTKIAGT

SEQ ID NO: 215532 - protein, 8 aa, Japanese encephalitis virus
KIAGTLLV

SEQ ID NO: 215533 - protein, 8 aa, Japanese encephalitis virus
IAGTLLVA

SEQ ID NO: 215534 - protein, 8 aa, Japanese encephalitis virus
AGTLLVAL

SEQ ID NO: 215535 - protein, 8 aa, Japanese encephalitis virus
GTLLVALL

SEQ ID NO: 215536 - protein, 8 aa, Japanese encephalitis virus
TLLVALLL

SEQ ID NO: 215537 - protein, 8 aa, Japanese encephalitis virus
LLVALLLM

SEQ ID NO: 215538 - protein, 8 aa, Japanese encephalitis virus
LVALLLMV

SEQ ID NO: 215539 - protein, 8 aa, Japanese encephalitis virus
VALLLMVV

SEQ ID NO: 215540 - protein, 8 aa, Japanese encephalitis virus
VVLIPEPG

SEQ ID NO: 215541 - protein, 8 aa, Japanese encephalitis virus
VLIPEPGK

SEQ ID NO: 215542 - protein, 8 aa, Japanese encephalitis virus
LIPEPGKQ

SEQ ID NO: 215543 - protein, 8 aa, Japanese encephalitis virus
IPEPGKQR

SEQ ID NO: 215544 - protein, 8 aa, Japanese encephalitis virus
PEPGKQRS

SEQ ID NO: 215545 - protein, 8 aa, Japanese encephalitis virus
EPGKQRSQ

SEQ ID NO: 215546 - protein, 8 aa, Japanese encephalitis virus
PGKQRSQT

SEQ ID NO: 215547 - protein, 8 aa, Japanese encephalitis virus
GKQRSQTD

SEQ ID NO: 215548 - protein, 8 aa, Japanese encephalitis virus
KQRSQTGN

SEQ ID NO: 215549 - protein, 8 aa, Japanese encephalitis virus
QRSQTGNQ

SEQ ID NO: 215550 - protein, 8 aa, Japanese encephalitis virus
RLQTDNQL

SEQ ID NO: 215551 - protein, 8 aa, Japanese encephalitis virus
SQTGNQLA

SEQ ID NO: 215552 - protein, 8 aa, Japanese encephalitis virus
QTGNQLAV

SEQ ID NO: 215553 - protein, 8 aa, Japanese encephalitis virus
TGNQLAVF

SEQ ID NO: 215554 - protein, 8 aa, Japanese encephalitis virus
GNQLAVFL

SEQ ID NO: 215555 - protein, 8 aa, Japanese encephalitis virus
CVLTVVGM

SEQ ID NO: 215556 - protein, 8 aa, Japanese encephalitis virus
VLTVVGMV

SEQ ID NO: 215557 - protein, 8 aa, Japanese encephalitis virus
LTVVGMVA

SEQ ID NO: 215558 - protein, 8 aa, Japanese encephalitis virus
TVVGMVAA

SEQ ID NO: 215559 - protein, 8 aa, Japanese encephalitis virus
VVGVAAAN

SEQ ID NO: 215560 - protein, 8 aa, Japanese encephalitis virus
VGVAAANE

SEQ ID NO: 215561 - protein, 8 aa, Japanese encephalitis virus
GMVAANEY

SEQ ID NO: 215562 - protein, 8 aa, Japanese encephalitis virus
VAAANEYG

SEQ ID NO: 215563 - protein, 8 aa, Japanese encephalitis virus
AAANEYGM

SEQ ID NO: 215564 - protein, 8 aa, Japanese encephalitis virus
NEYGMLER

SEQ ID NO: 215565 - protein, 8 aa, Japanese encephalitis virus
EYGMLERT

SEQ ID NO: 215566 - protein, 8 aa, Japanese encephalitis virus
YGMLERTK

SEQ ID NO: 215567 - protein, 8 aa, Japanese encephalitis virus
GMLERTKA

SEQ ID NO: 215568 - protein, 8 aa, Japanese encephalitis virus
MLERTKAD

SEQ ID NO: 215569 - protein, 8 aa, Japanese encephalitis virus
LEKTKADI

SEQ ID NO: 215570 - protein, 8 aa, Japanese encephalitis virus
EKTKADIK

SEQ ID NO: 215571 - protein, 8 aa, Japanese encephalitis virus
RTKADLKS

SEQ ID NO: 215572 - protein, 8 aa, Japanese encephalitis virus
TKADIKSM

SEQ ID NO: 215573 - protein, 8 aa, Japanese encephalitis virus
KADIKSMF

SEQ ID NO: 215574 - protein, 8 aa, Japanese encephalitis virus
ADLKSMFA

SEQ ID NO: 215575 - protein, 8 aa, Japanese encephalitis virus
DLKSMFAG

SEQ ID NO: 215576 - protein, 8 aa, Japanese encephalitis virus
LKSMFGGR

SEQ ID NO: 215577 - protein, 8 aa, Japanese encephalitis virus
KSMFGGRT

SEQ ID NO: 215578 - protein, 8 aa, Japanese encephalitis virus
SMFGGRTQ

SEQ ID NO: 215579 - protein, 8 aa, Japanese encephalitis virus
MFGGRTQA

SEQ ID NO: 215580 - protein, 8 aa, Japanese encephalitis virus
TQAPGLTG

SEQ ID NO: 215581 - protein, 8 aa, Japanese encephalitis virus
QAPGLTGL

SEQ ID NO: 215582 - protein, 8 aa, Japanese encephalitis virus
APGLTGLP

SEQ ID NO: 215583 - protein, 8 aa, Japanese encephalitis virus
PGLTGLPS

SEQ ID NO: 215584 - protein, 8 aa, Japanese encephalitis virus
GLTGLPSV

SEQ ID NO: 215585 - protein, 8 aa, Japanese encephalitis virus
LTGLPSMT

SEQ ID NO: 215586 - protein, 8 aa, Japanese encephalitis virus
TGLPSMTL

SEQ ID NO: 215587 - protein, 8 aa, Japanese encephalitis virus
GLPSMTLD

SEQ ID NO: 215588 - protein, 8 aa, Japanese encephalitis virus
LPSMTLDL

SEQ ID NO: 215589 - protein, 8 aa, Japanese encephalitis virus
PGMALDLR

SEQ ID NO: 215590 - protein, 8 aa, Japanese encephalitis virus
SMTLDLRP

SEQ ID NO: 215591 - protein, 8 aa, Japanese encephalitis virus
MTLDLRPA

SEQ ID NO: 215592 - protein, 8 aa, Japanese encephalitis virus
TLDLRPAT

SEQ ID NO: 215593 - protein, 8 aa, Japanese encephalitis virus
RPATAWAW

SEQ ID NO: 215594 - protein, 8 aa, Japanese encephalitis virus
PATAWAWY

SEQ ID NO: 215595 - protein, 8 aa, Japanese encephalitis virus
ATAWAWYG

SEQ ID NO: 215596 - protein, 8 aa, Japanese encephalitis virus
TAWAWYGG

SEQ ID NO: 215597 - protein, 8 aa, Japanese encephalitis virus
AWAWYGGS

SEQ ID NO: 215598 - protein, 8 aa, Japanese encephalitis virus
WAWYGGST

SEQ ID NO: 215599 - protein, 8 aa, Japanese encephalitis virus
AWYGGSTV

SEQ ID NO: 215600 - protein, 8 aa, Japanese encephalitis virus
WYGGSTVV

SEQ ID NO: 215601 - protein, 8 aa, Japanese encephalitis virus
LTPLLKHI

SEQ ID NO: 215602 - protein, 8 aa, Japanese encephalitis virus
TPLLKHII

SEQ ID NO: 215603 - protein, 8 aa, Japanese encephalitis virus
PLLKHIIT

SEQ ID NO: 215604 - protein, 8 aa, Japanese encephalitis virus
LLKHIITS

SEQ ID NO: 215605 - protein, 8 aa, Japanese encephalitis virus
LKHIITSE

SEQ ID NO: 215606 - protein, 8 aa, Japanese encephalitis virus
KHIITSEY

SEQ ID NO: 215607 - protein, 8 aa, Japanese encephalitis virus
HIITSEYV

SEQ ID NO: 215608 - protein, 8 aa, Japanese encephalitis virus
IITSEYVT

SEQ ID NO: 215609 - protein, 8 aa, Japanese encephalitis virus
ITSEYVTP

SEQ ID NO: 215610 - protein, 8 aa, Japanese encephalitis virus
TSEYVTPS

SEQ ID NO: 215611 - protein, 8 aa, Japanese encephalitis virus
SEYVTPSL

SEQ ID NO: 215612 - protein, 8 aa, Japanese encephalitis virus
EYVTPSLA

SEQ ID NO: 215613 - protein, 8 aa, Japanese encephalitis virus
YVTPSLAS

SEQ ID NO: 215614 - protein, 8 aa, Japanese encephalitis virus
VTPSLASI

SEQ ID NO: 215615 - protein, 8 aa, Japanese encephalitis virus
TTSLASIS

SEQ ID NO: 215616 - protein, 8 aa, Japanese encephalitis virus
TSLASISS

SEQ ID NO: 215617 - protein, 8 aa, Japanese encephalitis virus
SLASISSQ

SEQ ID NO: 215618 - protein, 8 aa, Japanese encephalitis virus
LASISSQA

SEQ ID NO: 215619 - protein, 8 aa, Japanese encephalitis virus
ASISSQAG

SEQ ID NO: 215620 - protein, 8 aa, Japanese encephalitis virus
SISSQAGS

SEQ ID NO: 215621 - protein, 8 aa, Japanese encephalitis virus
ISSQAGSL

SEQ ID NO: 215622 - protein, 8 aa, Japanese encephalitis virus
SSQAGSLF

SEQ ID NO: 215623 - protein, 8 aa, Japanese encephalitis virus
VLPRGVPS

SEQ ID NO: 215624 - protein, 8 aa, Japanese encephalitis virus
LPRGVPST

SEQ ID NO: 215625 - protein, 8 aa, Japanese encephalitis virus
PRGVPSTD

SEQ ID NO: 215626 - protein, 8 aa, Japanese encephalitis virus
RGVPSTDL

SEQ ID NO: 215627 - protein, 8 aa, Japanese encephalitis virus
GVPSTDLD

SEQ ID NO: 215628 - protein, 8 aa, Japanese encephalitis virus
VPSTDLDL

SEQ ID NO: 215629 - protein, 8 aa, Japanese encephalitis virus
PSTDLDLT

SEQ ID NO: 215630 - protein, 8 aa, Japanese encephalitis virus
STDLDLTV

SEQ ID NO: 215631 - protein, 8 aa, Japanese encephalitis virus
DLTVGLVL

SEQ ID NO: 215632 - protein, 8 aa, Japanese encephalitis virus
LTVGLVLL

SEQ ID NO: 215633 - protein, 8 aa, Japanese encephalitis virus
TVGLVLLG

SEQ ID NO: 215634 - protein, 8 aa, Japanese encephalitis virus
VGLVLLGC

SEQ ID NO: 215635 - protein, 8 aa, Japanese encephalitis virus
GLVLLGCW

SEQ ID NO: 215636 - protein, 8 aa, Japanese encephalitis virus
LVLLGCWG

SEQ ID NO: 215637 - protein, 8 aa, Japanese encephalitis virus
VLLGCWGQ

SEQ ID NO: 215638 - protein, 8 aa, Japanese encephalitis virus
FLGCWGQV

SEQ ID NO: 215639 - protein, 8 aa, Japanese encephalitis virus
LGCWGQVT

SEQ ID NO: 215640 - protein, 8 aa, Japanese encephalitis virus
GCWGQVTL

SEQ ID NO: 215641 - protein, 8 aa, Japanese encephalitis virus
CWGQVTLT

SEQ ID NO: 215642 - protein, 8 aa, Japanese encephalitis virus
WGQVTLTT

SEQ ID NO: 215643 - protein, 8 aa, Japanese encephalitis virus
GQVTLTTF

SEQ ID NO: 215644 - protein, 8 aa, Japanese encephalitis virus
QVTLTTFL

SEQ ID NO: 215645 - protein, 8 aa, Japanese encephalitis virus
VTLTTFLT

SEQ ID NO: 215646 - protein, 8 aa, Japanese encephalitis virus
TLTTSLTA

SEQ ID NO: 215647 - protein, 8 aa, Japanese encephalitis virus
LTTFLTAV

SEQ ID NO: 215648 - protein, 8 aa, Japanese encephalitis virus
TTFLTAVV

SEQ ID NO: 215649 - protein, 8 aa, Japanese encephalitis virus
TFLTAVVL

SEQ ID NO: 215650 - protein, 8 aa, Japanese encephalitis virus
LTAMVLVT

SEQ ID NO: 215651 - protein, 8 aa, Japanese encephalitis virus
TAMVLVTL

SEQ ID NO: 215652 - protein, 8 aa, Japanese encephalitis virus
AMVLVTLH

SEQ ID NO: 215653 - protein, 8 aa, Japanese encephalitis virus
MVLVTLHY

SEQ ID NO: 215654 - protein, 8 aa, Japanese encephalitis virus
VLVTLHYG

SEQ ID NO: 215655 - protein, 8 aa, Japanese encephalitis virus
LVTLHYGY

SEQ ID NO: 215656 - protein, 8 aa, Japanese encephalitis virus
VTLHYGYM

SEQ ID NO: 215657 - protein, 8 aa, Japanese encephalitis virus
ILHYGYML

SEQ ID NO: 215658 - protein, 8 aa, Japanese encephalitis virus
LHYGFMLP

SEQ ID NO: 215659 - protein, 8 aa, Japanese encephalitis virus
HYGFMLPG

SEQ ID NO: 215660 - protein, 8 aa, Japanese encephalitis virus
YGFMLPGW

SEQ ID NO: 215661 - protein, 8 aa, Japanese encephalitis virus
GFMLPGWQ

SEQ ID NO: 215662 - protein, 8 aa, Japanese encephalitis virus
FMLPGWQA

SEQ ID NO: 215663 - protein, 8 aa, Japanese encephalitis virus
MLPGWQAQ

SEQ ID NO: 215664 - protein, 8 aa, Japanese encephalitis virus
LPGWQAQA

SEQ ID NO: 215665 - protein, 8 aa, Japanese encephalitis virus
PGWQAQAL

SEQ ID NO: 215666 - protein, 8 aa, Japanese encephalitis virus
GWQAQALR

SEQ ID NO: 215667 - protein, 8 aa, Japanese encephalitis virus
WQAQALRA

SEQ ID NO: 215668 - protein, 8 aa, Japanese encephalitis virus
QAQALRAA

SEQ ID NO: 215669 - protein, 8 aa, Japanese encephalitis virus
AQALRAAQ

SEQ ID NO: 215670 - protein, 8 aa, Japanese encephalitis virus
QALRAAQR

SEQ ID NO: 215671 - protein, 8 aa, Japanese encephalitis virus
TDVPELEK

SEQ ID NO: 215672 - protein, 8 aa, Japanese encephalitis virus
DVPELEKT

SEQ ID NO: 215673 - protein, 8 aa, Japanese encephalitis virus
VPELEKTT

SEQ ID NO: 215674 - protein, 8 aa, Japanese encephalitis virus
PELEKTTP

SEQ ID NO: 215675 - protein, 8 aa, Japanese encephalitis virus
ELEKTTPL

SEQ ID NO: 215676 - protein, 8 aa, Japanese encephalitis virus
LEKTTPLM

SEQ ID NO: 215677 - protein, 8 aa, Japanese encephalitis virus
EKTTPLMQ

SEQ ID NO: 215678 - protein, 8 aa, Japanese encephalitis virus
KTTPLMQK

SEQ ID NO: 215679 - protein, 8 aa, Japanese encephalitis virus
TPLMQKKI

SEQ ID NO: 215680 - protein, 8 aa, Japanese encephalitis virus
PLMQKKIG

SEQ ID NO: 215681 - protein, 8 aa, Japanese encephalitis virus
LMQKKIGQ

SEQ ID NO: 215682 - protein, 8 aa, Japanese encephalitis virus
MQKKIGQV

SEQ ID NO: 215683 - protein, 8 aa, Japanese encephalitis virus
QKKIGQVL

SEQ ID NO: 215684 - protein, 8 aa, Japanese encephalitis virus
KKIGQVLL

SEQ ID NO: 215685 - protein, 8 aa, Japanese encephalitis virus
KIGQVLLI

SEQ ID NO: 215686 - protein, 8 aa, Japanese encephalitis virus
IGQVLLIG

SEQ ID NO: 215687 - protein, 8 aa, Japanese encephalitis virus
GQVLLIGG

SEQ ID NO: 215688 - protein, 8 aa, Japanese encephalitis virus
QVLLIGGS

SEQ ID NO: 215689 - protein, 8 aa, Japanese encephalitis virus
VLLIGGSV

SEQ ID NO: 215690 - protein, 8 aa, Japanese encephalitis virus
LLIGGSVA

SEQ ID NO: 215691 - protein, 8 aa, Japanese encephalitis virus
LIGGSVAA

SEQ ID NO: 215692 - protein, 8 aa, Japanese encephalitis virus
IGVSVAAL

SEQ ID NO: 215693 - protein, 8 aa, Japanese encephalitis virus
GVSVAALL

SEQ ID NO: 215694 - protein, 8 aa, Japanese encephalitis virus
VSVAALLV

SEQ ID NO: 215695 - protein, 8 aa, Japanese encephalitis virus
SVAALLVN

SEQ ID NO: 215696 - protein, 8 aa, Japanese encephalitis virus
VAALLVNP

SEQ ID NO: 215697 - protein, 8 aa, Japanese encephalitis virus
AALLVNPN

SEQ ID NO: 215698 - protein, 8 aa, Japanese encephalitis virus
ALLVNPNV

SEQ ID NO: 215699 - protein, 8 aa, Japanese encephalitis virus
LLVNPNVT

SEQ ID NO: 215700 - protein, 8 aa, Japanese encephalitis virus
LVNPNVST

SEQ ID NO: 215701 - protein, 8 aa, Japanese encephalitis virus
VNPKITTV

SEQ ID NO: 215702 - protein, 8 aa, Japanese encephalitis virus
NPNVTTVK

SEQ ID NO: 215703 - protein, 8 aa, Japanese encephalitis virus
PNVTTVKK

SEQ ID NO: 215704 - protein, 8 aa, Japanese encephalitis virus
NVSTVRKA

SEQ ID NO: 215705 - protein, 8 aa, Japanese encephalitis virus
VTTVKKPG

SEQ ID NO: 215706 - protein, 8 aa, Japanese encephalitis virus
TTVKKPGV

SEQ ID NO: 215707 - protein, 8 aa, Japanese encephalitis virus
TVKKPGVL

SEQ ID NO: 215708 - protein, 8 aa, Japanese encephalitis virus
VRKAGVLV

SEQ ID NO: 215709 - protein, 8 aa, Japanese encephalitis virus
RKAGVLVT

SEQ ID NO: 215710 - protein, 8 aa, Japanese encephalitis virus
KAGVLVTA

SEQ ID NO: 215711 - protein, 8 aa, Japanese encephalitis virus
AGVLVTAR

SEQ ID NO: 215712 - protein, 8 aa, Japanese encephalitis virus
GVLVTART

SEQ ID NO: 215713 - protein, 8 aa, Japanese encephalitis virus
VLVTARTL

SEQ ID NO: 215714 - protein, 8 aa, Japanese encephalitis virus
LVTARTLT

SEQ ID NO: 215715 - protein, 8 aa, Japanese encephalitis virus
VTARTLTL

SEQ ID NO: 215716 - protein, 8 aa, Japanese encephalitis virus
TARTLTLW

SEQ ID NO: 215717 - protein, 8 aa, Japanese encephalitis virus
ARTLTLWD

SEQ ID NO: 215718 - protein, 8 aa, Japanese encephalitis virus
RTLTLWDN

SEQ ID NO: 215719 - protein, 8 aa, Japanese encephalitis virus
TLSLWDNG

SEQ ID NO: 215720 - protein, 8 aa, Japanese encephalitis virus
LSLWDNGA

SEQ ID NO: 215721 - protein, 8 aa, Japanese encephalitis virus
SLWDNGAS

SEQ ID NO: 215722 - protein, 8 aa, Japanese encephalitis virus
WDNGASAA

SEQ ID NO: 215723 - protein, 8 aa, Japanese encephalitis virus
DNGASAAW

SEQ ID NO: 215724 - protein, 8 aa, Japanese encephalitis virus
NGASAAWN

SEQ ID NO: 215725 - protein, 8 aa, Japanese encephalitis virus
GASAAWNS

SEQ ID NO: 215726 - protein, 8 aa, Japanese encephalitis virus
ASAAWNST

SEQ ID NO: 215727 - protein, 8 aa, Japanese encephalitis virus
SAAWNSTT

SEQ ID NO: 215728 - protein, 8 aa, Japanese encephalitis virus
AAWNSTTA

SEQ ID NO: 215729 - protein, 8 aa, Japanese encephalitis virus
AWNSTTAT

SEQ ID NO: 215730 - protein, 8 aa, Japanese encephalitis virus
VMRGSYLR

SEQ ID NO: 215731 - protein, 8 aa, Japanese encephalitis virus
MRGSYLRG

SEQ ID NO: 215732 - protein, 8 aa, Japanese encephalitis virus
RGSYLRGG

SEQ ID NO: 215733 - protein, 8 aa, Japanese encephalitis virus
GSYLRGGS

SEQ ID NO: 215734 - protein, 8 aa, Japanese encephalitis virus
SYLRGGSI

SEQ ID NO: 215735 - protein, 8 aa, Japanese encephalitis virus
YLRGGSIA

SEQ ID NO: 215736 - protein, 8 aa, Japanese encephalitis virus
LRGGSIAW

SEQ ID NO: 215737 - protein, 8 aa, Japanese encephalitis virus
RGGSIAWT

SEQ ID NO: 215738 - protein, 8 aa, Japanese encephalitis virus
WTLIKNAN

SEQ ID NO: 215739 - protein, 8 aa, Japanese encephalitis virus
TLIKNANK

SEQ ID NO: 215740 - protein, 8 aa, Japanese encephalitis virus
LIKNANKP

SEQ ID NO: 215741 - protein, 8 aa, Japanese encephalitis virus
IKNADNPS

SEQ ID NO: 215742 - protein, 8 aa, Japanese encephalitis virus
KNANKPSL

SEQ ID NO: 215743 - protein, 8 aa, Japanese encephalitis virus
NADNPSLK

SEQ ID NO: 215744 - protein, 8 aa, Japanese encephalitis virus
ADKPSFKK

SEQ ID NO: 215745 - protein, 8 aa, Japanese encephalitis virus
DKPSFKKG

SEQ ID NO: 215746 - protein, 8 aa, Japanese encephalitis virus
KPSFKKGR

SEQ ID NO: 215747 - protein, 8 aa, Japanese encephalitis virus
PSLKRGRS

SEQ ID NO: 215748 - protein, 8 aa, Japanese encephalitis virus
SLKRGRSG

SEQ ID NO: 215749 - protein, 8 aa, Japanese encephalitis virus
LKRGRSGG

SEQ ID NO: 215750 - protein, 8 aa, Japanese encephalitis virus
KKGRPGGR

SEQ ID NO: 215751 - protein, 8 aa, Japanese encephalitis virus
RGRSGGRT

SEQ ID NO: 215752 - protein, 8 aa, Japanese encephalitis virus
GRSGGRTL

SEQ ID NO: 215753 - protein, 8 aa, Japanese encephalitis virus
RSGGRTLG

SEQ ID NO: 215754 - protein, 8 aa, Japanese encephalitis virus
SGGRTLGE

SEQ ID NO: 215755 - protein, 8 aa, Japanese encephalitis virus
GGRTLGDQ

SEQ ID NO: 215756 - protein, 8 aa, Japanese encephalitis virus
GRTLWEQW

SEQ ID NO: 215757 - protein, 8 aa, Japanese encephalitis virus
RTLGDQWK

SEQ ID NO: 215758 - protein, 8 aa, Japanese encephalitis virus
TLGDQWKE

SEQ ID NO: 215759 - protein, 8 aa, Japanese encephalitis virus
LGEQWKER

SEQ ID NO: 215760 - protein, 8 aa, Japanese encephalitis virus
GEQWKERL

SEQ ID NO: 215761 - protein, 8 aa, Japanese encephalitis virus
DQWKEKLN

SEQ ID NO: 215762 - protein, 8 aa, Japanese encephalitis virus
QWKRKLNA

SEQ ID NO: 215763 - protein, 8 aa, Japanese encephalitis virus
WKERLNAM

SEQ ID NO: 215764 - protein, 8 aa, Japanese encephalitis virus
KERLNAMS

SEQ ID NO: 215765 - protein, 8 aa, Japanese encephalitis virus
EKLNAMGR

SEQ ID NO: 215766 - protein, 8 aa, Japanese encephalitis virus
KLNAMSRD

SEQ ID NO: 215767 - protein, 8 aa, Japanese encephalitis virus
LNAMSRDE

SEQ ID NO: 215768 - protein, 8 aa, Japanese encephalitis virus
NAMSRDEF

SEQ ID NO: 215769 - protein, 8 aa, Japanese encephalitis virus
AMSRDEFF

SEQ ID NO: 215770 - protein, 8 aa, Japanese encephalitis virus
MSRDEFFK

SEQ ID NO: 215771 - protein, 8 aa, Japanese encephalitis virus
SRDEFFKY

SEQ ID NO: 215772 - protein, 8 aa, Japanese encephalitis virus
RDEFFKYR

SEQ ID NO: 215773 - protein, 8 aa, Japanese encephalitis virus
DEFFKYRR

SEQ ID NO: 215774 - protein, 8 aa, Japanese encephalitis virus
EFFQYRRE

SEQ ID NO: 215775 - protein, 8 aa, Japanese encephalitis virus
FFKYRREG

SEQ ID NO: 215776 - protein, 8 aa, Japanese encephalitis virus
FKYRREGI

SEQ ID NO: 215777 - protein, 8 aa, Japanese encephalitis virus
QYRREAII

SEQ ID NO: 215778 - protein, 8 aa, Japanese encephalitis virus
YRREGIIE

SEQ ID NO: 215779 - protein, 8 aa, Japanese encephalitis virus
RREGIIEV

SEQ ID NO: 215780 - protein, 8 aa, Japanese encephalitis virus
REGIIEVD

SEQ ID NO: 215781 - protein, 8 aa, Japanese encephalitis virus
EGIIEVDR

SEQ ID NO: 215782 - protein, 8 aa, Japanese encephalitis virus
GIIEVDRT

SEQ ID NO: 215783 - protein, 8 aa, Japanese encephalitis virus
EVDRTEAC

SEQ ID NO: 215784 - protein, 8 aa, Japanese encephalitis virus
VDRTEACR

SEQ ID NO: 215785 - protein, 8 aa, Japanese encephalitis virus
DRTEACRA

SEQ ID NO: 215786 - protein, 8 aa, Japanese encephalitis virus
RTEACRAR

SEQ ID NO: 215787 - protein, 8 aa, Japanese encephalitis virus
TEACRARR

SEQ ID NO: 215788 - protein, 8 aa, Japanese encephalitis virus
EACRARRE

SEQ ID NO: 215789 - protein, 8 aa, Japanese encephalitis virus
ACRARREN

SEQ ID NO: 215790 - protein, 8 aa, Japanese encephalitis virus
CRARRENN

SEQ ID NO: 215791 - protein, 8 aa, Japanese encephalitis virus
RARRENNV

SEQ ID NO: 215792 - protein, 8 aa, Japanese encephalitis virus
ARRENNVV

SEQ ID NO: 215793 - protein, 8 aa, Japanese encephalitis virus
RRENNVVG

SEQ ID NO: 215794 - protein, 8 aa, Japanese encephalitis virus
RENNVVGG

SEQ ID NO: 215795 - protein, 8 aa, Japanese encephalitis virus
ENNVVGGH

SEQ ID NO: 215796 - protein, 8 aa, Japanese encephalitis virus
NNVVGGHP

SEQ ID NO: 215797 - protein, 8 aa, Japanese encephalitis virus
NVVGGHPV

SEQ ID NO: 215798 - protein, 8 aa, Japanese encephalitis virus
VVGGHPVS

SEQ ID NO: 215799 - protein, 8 aa, Japanese encephalitis virus
LVEKGFVP

SEQ ID NO: 215800 - protein, 8 aa, Japanese encephalitis virus
VEKGFVPP

SEQ ID NO: 215801 - protein, 8 aa, Japanese encephalitis virus
EKGFVPPI

SEQ ID NO: 215802 - protein, 8 aa, Japanese encephalitis virus
KGFVPPIG

SEQ ID NO: 215803 - protein, 8 aa, Japanese encephalitis virus
GFVPPIGK

SEQ ID NO: 215804 - protein, 8 aa, Japanese encephalitis virus
FVPPIGKV

SEQ ID NO: 215805 - protein, 8 aa, Japanese encephalitis virus
VPPIGKVI

SEQ ID NO: 215806 - protein, 8 aa, Japanese encephalitis virus
SPIGKVVD

SEQ ID NO: 215807 - protein, 8 aa, Japanese encephalitis virus
PIGKVVDL

SEQ ID NO: 215808 - protein, 8 aa, Japanese encephalitis virus
IGKVVDLG

SEQ ID NO: 215809 - protein, 8 aa, Japanese encephalitis virus
GKVVDLGC

SEQ ID NO: 215810 - protein, 8 aa, Japanese encephalitis virus
KVVDLGCG

SEQ ID NO: 215811 - protein, 8 aa, Japanese encephalitis virus
VIDLGCGC

SEQ ID NO: 215812 - protein, 8 aa, Japanese encephalitis virus
IDLGCGCG

SEQ ID NO: 215813 - protein, 8 aa, Japanese encephalitis virus
DLGCGRGS

SEQ ID NO: 215814 - protein, 8 aa, Japanese encephalitis virus
LGCGRGSW

SEQ ID NO: 215815 - protein, 8 aa, Japanese encephalitis virus
GCGRGSWN

SEQ ID NO: 215816 - protein, 8 aa, Japanese encephalitis virus
CGRGSWNY

SEQ ID NO: 215817 - protein, 8 aa, Japanese encephalitis virus
GRGSWNYY

SEQ ID NO: 215818 - protein, 8 aa, Japanese encephalitis virus
RGSWNYYA

SEQ ID NO: 215819 - protein, 8 aa, Japanese encephalitis virus
GSWNYYAA

SEQ ID NO: 215820 - protein, 8 aa, Japanese encephalitis virus
SWNYYAAT

SEQ ID NO: 215821 - protein, 8 aa, Japanese encephalitis virus
WNYYAATL

SEQ ID NO: 215822 - protein, 8 aa, Japanese encephalitis virus
NYYAATLK

SEQ ID NO: 215823 - protein, 8 aa, Japanese encephalitis virus
YCAATLKK

SEQ ID NO: 215824 - protein, 8 aa, Japanese encephalitis virus
CAATLKKV

SEQ ID NO: 215825 - protein, 8 aa, Japanese encephalitis virus
AATLKRVQ

SEQ ID NO: 215826 - protein, 8 aa, Japanese encephalitis virus
ATLKRVQE

SEQ ID NO: 215827 - protein, 8 aa, Japanese encephalitis virus
TLKKVQEF

SEQ ID NO: 215828 - protein, 8 aa, Japanese encephalitis virus
LKKVQEVK

SEQ ID NO: 215829 - protein, 8 aa, Japanese encephalitis virus
KKVQEVKG

SEQ ID NO: 215830 - protein, 8 aa, Japanese encephalitis virus
KVQEVKGY

SEQ ID NO: 215831 - protein, 8 aa, Japanese encephalitis virus
VQEVKGYT

SEQ ID NO: 215832 - protein, 8 aa, Japanese encephalitis virus
QEVKGYTK

SEQ ID NO: 215833 - protein, 8 aa, Japanese encephalitis virus
EVKGYTKG

SEQ ID NO: 215834 - protein, 8 aa, Japanese encephalitis virus
VKGYTKGG

SEQ ID NO: 215835 - protein, 8 aa, Japanese encephalitis virus
KGYTKGGA

SEQ ID NO: 215836 - protein, 8 aa, Japanese encephalitis virus
AGHEEPMP

SEQ ID NO: 215837 - protein, 8 aa, Japanese encephalitis virus
GHEEPMPM

SEQ ID NO: 215838 - protein, 8 aa, Japanese encephalitis virus
HEEPMPMQ

SEQ ID NO: 215839 - protein, 8 aa, Japanese encephalitis virus
EEPMPMQS

SEQ ID NO: 215840 - protein, 8 aa, Japanese encephalitis virus
EPMPMQSY

SEQ ID NO: 215841 - protein, 8 aa, Japanese encephalitis virus
PMPMQSYG

SEQ ID NO: 215842 - protein, 8 aa, Japanese encephalitis virus
MLMQSYGR

SEQ ID NO: 215843 - protein, 8 aa, Japanese encephalitis virus
LMQSYGRN

SEQ ID NO: 215844 - protein, 8 aa, Japanese encephalitis virus
MQSYGRNL

SEQ ID NO: 215845 - protein, 8 aa, Japanese encephalitis virus
QSYGRNLV

SEQ ID NO: 215846 - protein, 8 aa, Japanese encephalitis virus
SYGRNLVS

SEQ ID NO: 215847 - protein, 8 aa, Japanese encephalitis virus
YGRNLVSL

SEQ ID NO: 215848 - protein, 8 aa, Japanese encephalitis virus
GRNLVSLK

SEQ ID NO: 215849 - protein, 8 aa, Japanese encephalitis virus
RNLVSLKS

SEQ ID NO: 215850 - protein, 8 aa, Japanese encephalitis virus
NLVSMKSG

SEQ ID NO: 215851 - protein, 8 aa, Japanese encephalitis virus
LVSMKSGV

SEQ ID NO: 215852 - protein, 8 aa, Japanese encephalitis virus
VSLKSGVH

SEQ ID NO: 215853 - protein, 8 aa, Japanese encephalitis virus
SLKSGVHV

SEQ ID NO: 215854 - protein, 8 aa, Japanese encephalitis virus
LKSGVHVF

SEQ ID NO: 215855 - protein, 8 aa, Japanese encephalitis virus
KSGVHVFY

SEQ ID NO: 215856 - protein, 8 aa, Japanese encephalitis virus
SGVHVFYK

SEQ ID NO: 215857 - protein, 8 aa, Japanese encephalitis virus
GVDVFYRP

SEQ ID NO: 215858 - protein, 8 aa, Japanese encephalitis virus
VDVFYRPS

SEQ ID NO: 215859 - protein, 8 aa, Japanese encephalitis virus
HVFYKPSE

SEQ ID NO: 215860 - protein, 8 aa, Japanese encephalitis virus
VFYRPSEP

SEQ ID NO: 215861 - protein, 8 aa, Japanese encephalitis virus
FYRPSEPS

SEQ ID NO: 215862 - protein, 8 aa, Japanese encephalitis virus
YRPSEPSD

SEQ ID NO: 215863 - protein, 8 aa, Japanese encephalitis virus
RPSEPSDT

SEQ ID NO: 215864 - protein, 8 aa, Japanese encephalitis virus
SEPSDTLL

SEQ ID NO: 215865 - protein, 8 aa, Japanese encephalitis virus
EPSDTLLC

SEQ ID NO: 215866 - protein, 8 aa, Japanese encephalitis virus
PSDTLLCD

SEQ ID NO: 215867 - protein, 8 aa, Japanese encephalitis virus
SDTLLCDI

SEQ ID NO: 215868 - protein, 8 aa, Japanese encephalitis virus
DTLLCDIG

SEQ ID NO: 215869 - protein, 8 aa, Japanese encephalitis virus
TLLCDIGE

SEQ ID NO: 215870 - protein, 8 aa, Japanese encephalitis virus
LLCDIGES

SEQ ID NO: 215871 - protein, 8 aa, Japanese encephalitis virus
LCDIGESS

SEQ ID NO: 215872 - protein, 8 aa, Japanese encephalitis virus
GESSPSPD

SEQ ID NO: 215873 - protein, 8 aa, Japanese encephalitis virus
ESSPSPDV

SEQ ID NO: 215874 - protein, 8 aa, Japanese encephalitis virus
SSPSPDVE

SEQ ID NO: 215875 - protein, 8 aa, Japanese encephalitis virus
SPSPDVEE

SEQ ID NO: 215876 - protein, 8 aa, Japanese encephalitis virus
PSPDVEEQ

SEQ ID NO: 215877 - protein, 8 aa, Japanese encephalitis virus
SPDVEEQR

SEQ ID NO: 215878 - protein, 8 aa, Japanese encephalitis virus
PDVEEQRT

SEQ ID NO: 215879 - protein, 8 aa, Japanese encephalitis virus
DVEEQRTL

SEQ ID NO: 215880 - protein, 8 aa, Japanese encephalitis virus
DWLHRGPI

SEQ ID NO: 215881 - protein, 8 aa, Japanese encephalitis virus
WLHRGPIE

SEQ ID NO: 215882 - protein, 8 aa, Japanese encephalitis virus
LHRGPIEF

SEQ ID NO: 215883 - protein, 8 aa, Japanese encephalitis virus
HRGPIEFC

SEQ ID NO: 215884 - protein, 8 aa, Japanese encephalitis virus
RGPIEFCI

SEQ ID NO: 215885 - protein, 8 aa, Japanese encephalitis virus
GPIEFCIK

SEQ ID NO: 215886 - protein, 8 aa, Japanese encephalitis virus
PIEFCIKV

SEQ ID NO: 215887 - protein, 8 aa, Japanese encephalitis virus
IEFCIKVL

SEQ ID NO: 215888 - protein, 8 aa, Japanese encephalitis virus
MPKVIEKN

SEQ ID NO: 215889 - protein, 8 aa, Japanese encephalitis virus
PKVIEKIE

SEQ ID NO: 215890 - protein, 8 aa, Japanese encephalitis virus
KVIEKIEV

SEQ ID NO: 215891 - protein, 8 aa, Japanese encephalitis virus
VIEKNEVL

SEQ ID NO: 215892 - protein, 8 aa, Japanese encephalitis virus
IEKIEVLQ

SEQ ID NO: 215893 - protein, 8 aa, Japanese encephalitis virus
EKNEVLQR

SEQ ID NO: 215894 - protein, 8 aa, Japanese encephalitis virus
KNEVLQRR

SEQ ID NO: 215895 - protein, 8 aa, Japanese encephalitis virus
NEVLQRRF

SEQ ID NO: 215896 - protein, 8 aa, Japanese encephalitis virus
QRRFGGGV

SEQ ID NO: 215897 - protein, 8 aa, Japanese encephalitis virus
RRFGGGVV

SEQ ID NO: 215898 - protein, 8 aa, Japanese encephalitis virus
RFGGGVVR

SEQ ID NO: 215899 - protein, 8 aa, Japanese encephalitis virus
FGGGVVRL

SEQ ID NO: 215900 - protein, 8 aa, Japanese encephalitis virus
GGGVVRLP

SEQ ID NO: 215901 - protein, 8 aa, Japanese encephalitis virus
GGVVRLPL

SEQ ID NO: 215902 - protein, 8 aa, Japanese encephalitis virus
GVVRLPLS

SEQ ID NO: 215903 - protein, 8 aa, Japanese encephalitis virus
VVRLPLSR

SEQ ID NO: 215904 - protein, 8 aa, Japanese encephalitis virus
EMYWVSGP

SEQ ID NO: 215905 - protein, 8 aa, Japanese encephalitis virus
MYWVSGPA

SEQ ID NO: 215906 - protein, 8 aa, Japanese encephalitis virus
YWVSGPAG

SEQ ID NO: 215907 - protein, 8 aa, Japanese encephalitis virus
WVSGPAGN

SEQ ID NO: 215908 - protein, 8 aa, Japanese encephalitis virus
VSGPAGNV

SEQ ID NO: 215909 - protein, 8 aa, Japanese encephalitis virus
SGPAGNVV

SEQ ID NO: 215910 - protein, 8 aa, Japanese encephalitis virus
GPAGNVVH

SEQ ID NO: 215911 - protein, 8 aa, Japanese encephalitis virus
PAGNVVHA

SEQ ID NO: 215912 - protein, 8 aa, Japanese encephalitis virus
QVLLGRMN

SEQ ID NO: 215913 - protein, 8 aa, Japanese encephalitis virus
VLLGRMNR

SEQ ID NO: 215914 - protein, 8 aa, Japanese encephalitis virus
LLGRMNRT

SEQ ID NO: 215915 - protein, 8 aa, Japanese encephalitis virus
LGRMDRAV

SEQ ID NO: 215916 - protein, 8 aa, Japanese encephalitis virus
GRMNRTVW

SEQ ID NO: 215917 - protein, 8 aa, Japanese encephalitis virus
RMNRTVWR

SEQ ID NO: 215918 - protein, 8 aa, Japanese encephalitis virus
MNRTVWRG

SEQ ID NO: 215919 - protein, 8 aa, Japanese encephalitis virus
NRTVWRGP

SEQ ID NO: 215920 - protein, 8 aa, Japanese encephalitis virus
RAVWRGPK

SEQ ID NO: 215921 - protein, 8 aa, Japanese encephalitis virus
TVWRGPRY

SEQ ID NO: 215922 - protein, 8 aa, Japanese encephalitis virus
VWRGPKYK

SEQ ID NO: 215923 - protein, 8 aa, Japanese encephalitis virus
WRGPKYKE

SEQ ID NO: 215924 - protein, 8 aa, Japanese encephalitis virus
RGPKYKED

SEQ ID NO: 215925 - protein, 8 aa, Japanese encephalitis virus
GPRYEEDV

SEQ ID NO: 215926 - protein, 8 aa, Japanese encephalitis virus
PRYEEDVN

SEQ ID NO: 215927 - protein, 8 aa, Japanese encephalitis virus
RYEEDVNL

SEQ ID NO: 215928 - protein, 8 aa, Japanese encephalitis virus
YKEDVNLG

SEQ ID NO: 215929 - protein, 8 aa, Japanese encephalitis virus
KEDVNLGS

SEQ ID NO: 215930 - protein, 8 aa, Japanese encephalitis virus
RAVGKGEI

SEQ ID NO: 215931 - protein, 8 aa, Japanese encephalitis virus
AVGKGEIH

SEQ ID NO: 215932 - protein, 8 aa, Japanese encephalitis virus
VGKGEIHS

SEQ ID NO: 215933 - protein, 8 aa, Japanese encephalitis virus
GKGEIHSN

SEQ ID NO: 215934 - protein, 8 aa, Japanese encephalitis virus
KGEIHSNQ

SEQ ID NO: 215935 - protein, 8 aa, Japanese encephalitis virus
QEKIRKRI

SEQ ID NO: 215936 - protein, 8 aa, Japanese encephalitis virus
EKIRKRIQ

SEQ ID NO: 215937 - protein, 8 aa, Japanese encephalitis virus
KIRKRIQK

SEQ ID NO: 215938 - protein, 8 aa, Japanese encephalitis virus
IRKRIQKL

SEQ ID NO: 215939 - protein, 8 aa, Japanese encephalitis virus
RKRIQKLR

SEQ ID NO: 215940 - protein, 8 aa, Japanese encephalitis virus
KRIQKLRE

SEQ ID NO: 215941 - protein, 8 aa, Japanese encephalitis virus
RIQKLREE

SEQ ID NO: 215942 - protein, 8 aa, Japanese encephalitis virus
IQKLREEF

SEQ ID NO: 215943 - protein, 8 aa, Japanese encephalitis virus
QKLREEFA

SEQ ID NO: 215944 - protein, 8 aa, Japanese encephalitis virus
KLREEFAT

SEQ ID NO: 215945 - protein, 8 aa, Japanese encephalitis virus
LREEFATT

SEQ ID NO: 215946 - protein, 8 aa, Japanese encephalitis virus
REEFATTW

SEQ ID NO: 215947 - protein, 8 aa, Japanese encephalitis virus
EGFATTWH

SEQ ID NO: 215948 - protein, 8 aa, Japanese encephalitis virus
EFGTTWHK

SEQ ID NO: 215949 - protein, 8 aa, Japanese encephalitis virus
FATTWHRD

SEQ ID NO: 215950 - protein, 8 aa, Japanese encephalitis virus
ATTWHKDH

SEQ ID NO: 215951 - protein, 8 aa, Japanese encephalitis virus
TTWHKDHE

SEQ ID NO: 215952 - protein, 8 aa, Japanese encephalitis virus
TWHKDHEH

SEQ ID NO: 215953 - protein, 8 aa, Japanese encephalitis virus
WHRDPEHP

SEQ ID NO: 215954 - protein, 8 aa, Japanese encephalitis virus
HRDPEHPY

SEQ ID NO: 215955 - protein, 8 aa, Japanese encephalitis virus
RDPEHPYR

SEQ ID NO: 215956 - protein, 8 aa, Japanese encephalitis virus
DPEHPYRN

SEQ ID NO: 215957 - protein, 8 aa, Japanese encephalitis virus
PEHPYRNW

SEQ ID NO: 215958 - protein, 8 aa, Japanese encephalitis virus
EHPYRNWT

SEQ ID NO: 215959 - protein, 8 aa, Japanese encephalitis virus
HPYRNWTY

SEQ ID NO: 215960 - protein, 8 aa, Japanese encephalitis virus
PYRNWTYH

SEQ ID NO: 215961 - protein, 8 aa, Japanese encephalitis virus
YRNWTYHG

SEQ ID NO: 215962 - protein, 8 aa, Japanese encephalitis virus
RNWTYHGS

SEQ ID NO: 215963 - protein, 8 aa, Japanese encephalitis virus
NWTYHGSY

SEQ ID NO: 215964 - protein, 8 aa, Japanese encephalitis virus
YHGSYEVR

SEQ ID NO: 215965 - protein, 8 aa, Japanese encephalitis virus
HGSYEVRA

SEQ ID NO: 215966 - protein, 8 aa, Japanese encephalitis virus
GSYEVKAN

SEQ ID NO: 215967 - protein, 8 aa, Japanese encephalitis virus
SYEVRATG

SEQ ID NO: 215968 - protein, 8 aa, Japanese encephalitis virus
YEVKANGS

SEQ ID NO: 215969 - protein, 8 aa, Japanese encephalitis virus
EVRATGSA

SEQ ID NO: 215970 - protein, 8 aa, Japanese encephalitis virus
VRATGSAS

SEQ ID NO: 215971 - protein, 8 aa, Japanese encephalitis virus
KANGSASS

SEQ ID NO: 215972 - protein, 8 aa, Japanese encephalitis virus
ANGSASSL

SEQ ID NO: 215973 - protein, 8 aa, Japanese encephalitis virus
NGSASSLV

SEQ ID NO: 215974 - protein, 8 aa, Japanese encephalitis virus
SLVNGVVE

SEQ ID NO: 215975 - protein, 8 aa, Japanese encephalitis virus
LVNGVVEL

SEQ ID NO: 215976 - protein, 8 aa, Japanese encephalitis virus
VNGVVELM

SEQ ID NO: 215977 - protein, 8 aa, Japanese encephalitis virus
NGVVELMS

SEQ ID NO: 215978 - protein, 8 aa, Japanese encephalitis virus
GVVELMSK

SEQ ID NO: 215979 - protein, 8 aa, Japanese encephalitis virus
VVELMSKP

SEQ ID NO: 215980 - protein, 8 aa, Japanese encephalitis virus
VELMSKPW

SEQ ID NO: 215981 - protein, 8 aa, Japanese encephalitis virus
ELMSKPWD

SEQ ID NO: 215982 - protein, 8 aa, Japanese encephalitis virus
LMSKPWDT

SEQ ID NO: 215983 - protein, 8 aa, Japanese encephalitis virus
MSKPWDTI

SEQ ID NO: 215984 - protein, 8 aa, Japanese encephalitis virus
SKPWDAIS

SEQ ID NO: 215985 - protein, 8 aa, Japanese encephalitis virus
KPWDTIAN

SEQ ID NO: 215986 - protein, 8 aa, Japanese encephalitis virus
PWDTIANV

SEQ ID NO: 215987 - protein, 8 aa, Japanese encephalitis virus
WDTIANVT

SEQ ID NO: 215988 - protein, 8 aa, Japanese encephalitis virus
DAISYVTT

SEQ ID NO: 215989 - protein, 8 aa, Japanese encephalitis virus
TIANVTTM

SEQ ID NO: 215990 - protein, 8 aa, Japanese encephalitis virus
ISYVTTMP

SEQ ID NO: 215991 - protein, 8 aa, Japanese encephalitis virus
SYVTTMPM

SEQ ID NO: 215992 - protein, 8 aa, Japanese encephalitis virus
YVTTMPMT

SEQ ID NO: 215993 - protein, 8 aa, Japanese encephalitis virus
VTTMPMTD

SEQ ID NO: 215994 - protein, 8 aa, Japanese encephalitis virus
TTMPMTDT

SEQ ID NO: 215995 - protein, 8 aa, Japanese encephalitis virus
TMPMTDTT

SEQ ID NO: 215996 - protein, 8 aa, Japanese encephalitis virus
MPMTDTTP

SEQ ID NO: 215997 - protein, 8 aa, Japanese encephalitis virus
PMTDTTPF

SEQ ID NO: 215998 - protein, 8 aa, Japanese encephalitis virus
RVFKEKVG

SEQ ID NO: 215999 - protein, 8 aa, Japanese encephalitis virus
VFKEKVGT

SEQ ID NO: 216000 - protein, 8 aa, Japanese encephalitis virus
FKEKVGTM

SEQ ID NO: 216001 - protein, 8 aa, Japanese encephalitis virus
KEKVGTMA

SEQ ID NO: 216002 - protein, 8 aa, Japanese encephalitis virus
EKVGTKAP

SEQ ID NO: 216003 - protein, 8 aa, Japanese encephalitis virus
KVGTKAPE

SEQ ID NO: 216004 - protein, 8 aa, Japanese encephalitis virus
VGTKAPEP

SEQ ID NO: 216005 - protein, 8 aa, Japanese encephalitis virus
GTMAPEPP

SEQ ID NO: 216006 - protein, 8 aa, Japanese encephalitis virus
TKAPEPPT

SEQ ID NO: 216007 - protein, 8 aa, Japanese encephalitis virus
MAPEPPAG

SEQ ID NO: 216008 - protein, 8 aa, Japanese encephalitis virus
APEPPAGV

SEQ ID NO: 216009 - protein, 8 aa, Japanese encephalitis virus
GVKEVLNE

SEQ ID NO: 216010 - protein, 8 aa, Japanese encephalitis virus
VKEVLNET

SEQ ID NO: 216011 - protein, 8 aa, Japanese encephalitis virus
REVLNETT

SEQ ID NO: 216012 - protein, 8 aa, Japanese encephalitis virus
TTNWLWAY

SEQ ID NO: 216013 - protein, 8 aa, Japanese encephalitis virus
TNWLWAYL

SEQ ID NO: 216014 - protein, 8 aa, Japanese encephalitis virus
NWLWAYLS

SEQ ID NO: 216015 - protein, 8 aa, Japanese encephalitis virus
WLWAYLSR

SEQ ID NO: 216016 - protein, 8 aa, Japanese encephalitis virus
LWAYLSRE

SEQ ID NO: 216017 - protein, 8 aa, Japanese encephalitis virus
WAYLSREK

SEQ ID NO: 216018 - protein, 8 aa, Japanese encephalitis virus
AYLSREKR

SEQ ID NO: 216019 - protein, 8 aa, Japanese encephalitis virus
YLSREKRP

SEQ ID NO: 216020 - protein, 8 aa, Japanese encephalitis virus
LSRKKRPR

SEQ ID NO: 216021 - protein, 8 aa, Japanese encephalitis virus
SRKKRPRL

SEQ ID NO: 216022 - protein, 8 aa, Japanese encephalitis virus
RKKRPRLC

SEQ ID NO: 216023 - protein, 8 aa, Japanese encephalitis virus
KKRPRLCT

SEQ ID NO: 216024 - protein, 8 aa, Japanese encephalitis virus
CTKEEFIR

SEQ ID NO: 216025 - protein, 8 aa, Japanese encephalitis virus
TKEEFIRK

SEQ ID NO: 216026 - protein, 8 aa, Japanese encephalitis virus
KEEFIRKV

SEQ ID NO: 216027 - protein, 8 aa, Japanese encephalitis virus
EEFIRKVN

SEQ ID NO: 216028 - protein, 8 aa, Japanese encephalitis virus
EFIRKVNS

SEQ ID NO: 216029 - protein, 8 aa, Japanese encephalitis virus
FIRKVNSN

SEQ ID NO: 216030 - protein, 8 aa, Japanese encephalitis virus
IRKVNSNA

SEQ ID NO: 216031 - protein, 8 aa, Japanese encephalitis virus
KVNSNASL

SEQ ID NO: 216032 - protein, 8 aa, Japanese encephalitis virus
VNSNASLG

SEQ ID NO: 216033 - protein, 8 aa, Japanese encephalitis virus
NSDAALGA

SEQ ID NO: 216034 - protein, 8 aa, Japanese encephalitis virus
SDAALGAV

SEQ ID NO: 216035 - protein, 8 aa, Japanese encephalitis virus
NASLGAVF

SEQ ID NO: 216036 - protein, 8 aa, Japanese encephalitis virus
ASLGAVFA

SEQ ID NO: 216037 - protein, 8 aa, Japanese encephalitis virus
SLGAVFAE

SEQ ID NO: 216038 - protein, 8 aa, Japanese encephalitis virus
LGTVFAEQ

SEQ ID NO: 216039 - protein, 8 aa, Japanese encephalitis virus
GTVFAEQN

SEQ ID NO: 216040 - protein, 8 aa, Japanese encephalitis virus
TVFAEQNQ

SEQ ID NO: 216041 - protein, 8 aa, Japanese encephalitis virus
STAREAVG

SEQ ID NO: 216042 - protein, 8 aa, Japanese encephalitis virus
TAREAVGD

SEQ ID NO: 216043 - protein, 8 aa, Japanese encephalitis virus
AREAVGDP

SEQ ID NO: 216044 - protein, 8 aa, Japanese encephalitis virus
DPLFWEMV

SEQ ID NO: 216045 - protein, 8 aa, Japanese encephalitis virus
FWEMVNEE

SEQ ID NO: 216046 - protein, 8 aa, Japanese encephalitis virus
WEMVNEER

SEQ ID NO: 216047 - protein, 8 aa, Japanese encephalitis virus
EMVNEERE

SEQ ID NO: 216048 - protein, 8 aa, Japanese encephalitis virus
MVNEEREN

SEQ ID NO: 216049 - protein, 8 aa, Japanese encephalitis virus
VNEERENH

SEQ ID NO: 216050 - protein, 8 aa, Japanese encephalitis virus
NEERENHL

SEQ ID NO: 216051 - protein, 8 aa, Japanese encephalitis virus
VERENHLR

SEQ ID NO: 216052 - protein, 8 aa, Japanese encephalitis virus
LRGECHTR

SEQ ID NO: 216053 - protein, 8 aa, Japanese encephalitis virus
RGECHTCV

SEQ ID NO: 216054 - protein, 8 aa, Japanese encephalitis virus
GECHTCVY

SEQ ID NO: 216055 - protein, 8 aa, Japanese encephalitis virus
ECHTCVYN

SEQ ID NO: 216056 - protein, 8 aa, Japanese encephalitis virus
CHTCVYNM

SEQ ID NO: 216057 - protein, 8 aa, Japanese encephalitis virus
HTCVYNMM

SEQ ID NO: 216058 - protein, 8 aa, Japanese encephalitis virus
TCVYNMMG

SEQ ID NO: 216059 - protein, 8 aa, Japanese encephalitis virus
CVYNMMGK

SEQ ID NO: 216060 - protein, 8 aa, Japanese encephalitis virus
VYNMMGKR

SEQ ID NO: 216061 - protein, 8 aa, Japanese encephalitis virus
YHMMGKRE

SEQ ID NO: 216062 - protein, 8 aa, Japanese encephalitis virus
HMMGKREK

SEQ ID NO: 216063 - protein, 8 aa, Japanese encephalitis virus
LEFEALGS

SEQ ID NO: 216064 - protein, 8 aa, Japanese encephalitis virus
EFEALGSL

SEQ ID NO: 216065 - protein, 8 aa, Japanese encephalitis virus
FEALGSLN

SEQ ID NO: 216066 - protein, 8 aa, Japanese encephalitis virus
EALGFLNL

SEQ ID NO: 216067 - protein, 8 aa, Japanese encephalitis virus
ALGFLNLD

SEQ ID NO: 216068 - protein, 8 aa, Japanese encephalitis virus
LGSLNEDH

SEQ ID NO: 216069 - protein, 8 aa, Japanese encephalitis virus
GFLNLDHW

SEQ ID NO: 216070 - protein, 8 aa, Japanese encephalitis virus
SLNEDHWL

SEQ ID NO: 216071 - protein, 8 aa, Japanese encephalitis virus
LNLDHWLS

SEQ ID NO: 216072 - protein, 8 aa, Japanese encephalitis virus
NENHWLSR

SEQ ID NO: 216073 - protein, 8 aa, Japanese encephalitis virus
ENHWLSRE

SEQ ID NO: 216074 - protein, 8 aa, Japanese encephalitis virus
DHWLSRRN

SEQ ID NO: 216075 - protein, 8 aa, Japanese encephalitis virus
HWLSRRNS

SEQ ID NO: 216076 - protein, 8 aa, Japanese encephalitis virus
WLSRENSR

SEQ ID NO: 216077 - protein, 8 aa, Japanese encephalitis virus
LSRRNSGG

SEQ ID NO: 216078 - protein, 8 aa, Japanese encephalitis virus
SRENSRGG

SEQ ID NO: 216079 - protein, 8 aa, Japanese encephalitis virus
RRNSGGGV

SEQ ID NO: 216080 - protein, 8 aa, Japanese encephalitis virus
RNSGGGVE

SEQ ID NO: 216081 - protein, 8 aa, Japanese encephalitis virus
NSRGGVEG

SEQ ID NO: 216082 - protein, 8 aa, Japanese encephalitis virus
SGGGEEGS

SEQ ID NO: 216083 - protein, 8 aa, Japanese encephalitis virus
GGGVEGSS

SEQ ID NO: 216084 - protein, 8 aa, Japanese encephalitis virus
GGVEGSSV

SEQ ID NO: 216085 - protein, 8 aa, Japanese encephalitis virus
GVEGSSVQ

SEQ ID NO: 216086 - protein, 8 aa, Japanese encephalitis virus
VEGSSVQK

SEQ ID NO: 216087 - protein, 8 aa, Japanese encephalitis virus
EGSSVQKL

SEQ ID NO: 216088 - protein, 8 aa, Japanese encephalitis virus
GSSVQKLG

SEQ ID NO: 216089 - protein, 8 aa, Japanese encephalitis virus
SSVQKLGY

SEQ ID NO: 216090 - protein, 8 aa, Japanese encephalitis virus
SVQKLGYI

SEQ ID NO: 216091 - protein, 8 aa, Japanese encephalitis virus
VQKLGYII

SEQ ID NO: 216092 - protein, 8 aa, Japanese encephalitis virus
QKLGYISG

SEQ ID NO: 216093 - protein, 8 aa, Japanese encephalitis virus
KLGYISGD

SEQ ID NO: 216094 - protein, 8 aa, Japanese encephalitis virus
LGYIFRDI

SEQ ID NO: 216095 - protein, 8 aa, Japanese encephalitis virus
GYISGDIT

SEQ ID NO: 216096 - protein, 8 aa, Japanese encephalitis virus
GDITSRAI

SEQ ID NO: 216097 - protein, 8 aa, Japanese encephalitis virus
DIARKEGG

SEQ ID NO: 216098 - protein, 8 aa, Japanese encephalitis virus
IAVKQGGK

SEQ ID NO: 216099 - protein, 8 aa, Japanese encephalitis virus
AVKQGGKM

SEQ ID NO: 216100 - protein, 8 aa, Japanese encephalitis virus
SRAIGKMY

SEQ ID NO: 216101 - protein, 8 aa, Japanese encephalitis virus
KEGGKMYA

SEQ ID NO: 216102 - protein, 8 aa, Japanese encephalitis virus
EGGKMYAD

SEQ ID NO: 216103 - protein, 8 aa, Japanese encephalitis virus
IGKMYADD

SEQ ID NO: 216104 - protein, 8 aa, Japanese encephalitis virus
GKMYADDP

SEQ ID NO: 216105 - protein, 8 aa, Japanese encephalitis virus
KMYADDPA

SEQ ID NO: 216106 - protein, 8 aa, Japanese encephalitis virus
MYADDPAG

SEQ ID NO: 216107 - protein, 8 aa, Japanese encephalitis virus
YADDPAGW

SEQ ID NO: 216108 - protein, 8 aa, Japanese encephalitis virus
ADDPAGWD

SEQ ID NO: 216109 - protein, 8 aa, Japanese encephalitis virus
DDPAGWDT

SEQ ID NO: 216110 - protein, 8 aa, Japanese encephalitis virus
DPAGWDTR

SEQ ID NO: 216111 - protein, 8 aa, Japanese encephalitis virus
PAGWDTRI

SEQ ID NO: 216112 - protein, 8 aa, Japanese encephalitis virus
GWDTRITK

SEQ ID NO: 216113 - protein, 8 aa, Japanese encephalitis virus
WDTRITRA

SEQ ID NO: 216114 - protein, 8 aa, Japanese encephalitis virus
DTRITRAD

SEQ ID NO: 216115 - protein, 8 aa, Japanese encephalitis virus
TRITRADL

SEQ ID NO: 216116 - protein, 8 aa, Japanese encephalitis virus
RITRADLE

SEQ ID NO: 216117 - protein, 8 aa, Japanese encephalitis virus
ITRADLEN

SEQ ID NO: 216118 - protein, 8 aa, Japanese encephalitis virus
TRADLENE

SEQ ID NO: 216119 - protein, 8 aa, Japanese encephalitis virus
RADLENEA

SEQ ID NO: 216120 - protein, 8 aa, Japanese encephalitis virus
ADLENEAK

SEQ ID NO: 216121 - protein, 8 aa, Japanese encephalitis virus
LLDGEHRK

SEQ ID NO: 216122 - protein, 8 aa, Japanese encephalitis virus
LDGEHRKL

SEQ ID NO: 216123 - protein, 8 aa, Japanese encephalitis virus
DGEHRKLA

SEQ ID NO: 216124 - protein, 8 aa, Japanese encephalitis virus
GEHRKLAR

SEQ ID NO: 216125 - protein, 8 aa, Japanese encephalitis virus
EHRKLARA

SEQ ID NO: 216126 - protein, 8 aa, Japanese encephalitis virus
HRKLARAI

SEQ ID NO: 216127 - protein, 8 aa, Japanese encephalitis virus
RKLARAII

SEQ ID NO: 216128 - protein, 8 aa, Japanese encephalitis virus
KLARAIIE

SEQ ID NO: 216129 - protein, 8 aa, Japanese encephalitis virus
AIIELTYK

SEQ ID NO: 216130 - protein, 8 aa, Japanese encephalitis virus
IIELTYKH

SEQ ID NO: 216131 - protein, 8 aa, Japanese encephalitis virus
IELTYRHQ

SEQ ID NO: 216132 - protein, 8 aa, Japanese encephalitis virus
ELTYKHKV

SEQ ID NO: 216133 - protein, 8 aa, Japanese encephalitis virus
LTYKHKVV

SEQ ID NO: 216134 - protein, 8 aa, Japanese encephalitis virus
TYKHKVVK

SEQ ID NO: 216135 - protein, 8 aa, Japanese encephalitis virus
YRHQVFKV

SEQ ID NO: 216136 - protein, 8 aa, Japanese encephalitis virus
KHKVVKVM

SEQ ID NO: 216137 - protein, 8 aa, Japanese encephalitis virus
HQVFKVMR

SEQ ID NO: 216138 - protein, 8 aa, Japanese encephalitis virus
QVFKVMRP

SEQ ID NO: 216139 - protein, 8 aa, Japanese encephalitis virus
VVKVMRPS

SEQ ID NO: 216140 - protein, 8 aa, Japanese encephalitis virus
VKVMRPST

SEQ ID NO: 216141 - protein, 8 aa, Japanese encephalitis virus
KVMRPAAG

SEQ ID NO: 216142 - protein, 8 aa, Japanese encephalitis virus
VMRPAAGG

SEQ ID NO: 216143 - protein, 8 aa, Japanese encephalitis virus
MRPAAGGK

SEQ ID NO: 216144 - protein, 8 aa, Japanese encephalitis virus
RPAAGGKT

SEQ ID NO: 216145 - protein, 8 aa, Japanese encephalitis virus
PAAGGKTV

SEQ ID NO: 216146 - protein, 8 aa, Japanese encephalitis virus
AAGGKTVM

SEQ ID NO: 216147 - protein, 8 aa, Japanese encephalitis virus
GGKTVMDV

SEQ ID NO: 216148 - protein, 8 aa, Japanese encephalitis virus
GKTGMAVI

SEQ ID NO: 216149 - protein, 8 aa, Japanese encephalitis virus
KTVMVVYS

SEQ ID NO: 216150 - protein, 8 aa, Japanese encephalitis virus
TVMVVYSR

SEQ ID NO: 216151 - protein, 8 aa, Japanese encephalitis virus
GMAVISRE

SEQ ID NO: 216152 - protein, 8 aa, Japanese encephalitis virus
MVVYSRED

SEQ ID NO: 216153 - protein, 8 aa, Japanese encephalitis virus
VVYSREDQ

SEQ ID NO: 216154 - protein, 8 aa, Japanese encephalitis virus
VISRENQR

SEQ ID NO: 216155 - protein, 8 aa, Japanese encephalitis virus
YSREDQRG

SEQ ID NO: 216156 - protein, 8 aa, Japanese encephalitis virus
SRENQRGS

SEQ ID NO: 216157 - protein, 8 aa, Japanese encephalitis virus
RENQRGSG

SEQ ID NO: 216158 - protein, 8 aa, Japanese encephalitis virus
ENQRGSGQ

SEQ ID NO: 216159 - protein, 8 aa, Japanese encephalitis virus
NQRGSGQV

SEQ ID NO: 216160 - protein, 8 aa, Japanese encephalitis virus
FTNIAVQF

SEQ ID NO: 216161 - protein, 8 aa, Japanese encephalitis virus
TNIAVQFV

SEQ ID NO: 216162 - protein, 8 aa, Japanese encephalitis virus
NIAVQFVR

SEQ ID NO: 216163 - protein, 8 aa, Japanese encephalitis virus
IAVQFVRL

SEQ ID NO: 216164 - protein, 8 aa, Japanese encephalitis virus
AVQFVRLM

SEQ ID NO: 216165 - protein, 8 aa, Japanese encephalitis virus
VQLVRLVE

SEQ ID NO: 216166 - protein, 8 aa, Japanese encephalitis virus
QFVRLMKV

SEQ ID NO: 216167 - protein, 8 aa, Japanese encephalitis virus
FVRLMKVE

SEQ ID NO: 216168 - protein, 8 aa, Japanese encephalitis virus
VRLMKVEG

SEQ ID NO: 216169 - protein, 8 aa, Japanese encephalitis virus
RLMKVEGV

SEQ ID NO: 216170 - protein, 8 aa, Japanese encephalitis virus
LMKVEGVI

SEQ ID NO: 216171 - protein, 8 aa, Japanese encephalitis virus
MKVEGVIG

SEQ ID NO: 216172 - protein, 8 aa, Japanese encephalitis virus
KVEGVIGP

SEQ ID NO: 216173 - protein, 8 aa, Japanese encephalitis virus
VEGVIGPQ

SEQ ID NO: 216174 - protein, 8 aa, Japanese encephalitis virus
GVIGPQHV

SEQ ID NO: 216175 - protein, 8 aa, Japanese encephalitis virus
VIGPQHVE

SEQ ID NO: 216176 - protein, 8 aa, Japanese encephalitis virus
IGPQHVEQ

SEQ ID NO: 216177 - protein, 8 aa, Japanese encephalitis virus
GPQHVEQL

SEQ ID NO: 216178 - protein, 8 aa, Japanese encephalitis virus
PQHLEHLP

SEQ ID NO: 216179 - protein, 8 aa, Japanese encephalitis virus
QHVEQLPR

SEQ ID NO: 216180 - protein, 8 aa, Japanese encephalitis virus
HLEQLPRE

SEQ ID NO: 216181 - protein, 8 aa, Japanese encephalitis virus
EQLPRKTK

SEQ ID NO: 216182 - protein, 8 aa, Japanese encephalitis virus
QLPRKTKI

SEQ ID NO: 216183 - protein, 8 aa, Japanese encephalitis virus
LPRKTKIA

SEQ ID NO: 216184 - protein, 8 aa, Japanese encephalitis virus
PRKTKIAV

SEQ ID NO: 216185 - protein, 8 aa, Japanese encephalitis virus
RKTKIAVR

SEQ ID NO: 216186 - protein, 8 aa, Japanese encephalitis virus
KTKIAVRT

SEQ ID NO: 216187 - protein, 8 aa, Japanese encephalitis virus
TKIAVRTW

SEQ ID NO: 216188 - protein, 8 aa, Japanese encephalitis virus
TWLFENGG

SEQ ID NO: 216189 - protein, 8 aa, Japanese encephalitis virus
WLFENGGE

SEQ ID NO: 216190 - protein, 8 aa, Japanese encephalitis virus
LFENGGER

SEQ ID NO: 216191 - protein, 8 aa, Japanese encephalitis virus
FENGGERV

SEQ ID NO: 216192 - protein, 8 aa, Japanese encephalitis virus
ENGEERVS

SEQ ID NO: 216193 - protein, 8 aa, Japanese encephalitis virus
NGEERVSR

SEQ ID NO: 216194 - protein, 8 aa, Japanese encephalitis virus
GEERVSRM

SEQ ID NO: 216195 - protein, 8 aa, Japanese encephalitis virus
EERVSRMA

SEQ ID NO: 216196 - protein, 8 aa, Japanese encephalitis virus
ERVSRMAI

SEQ ID NO: 216197 - protein, 8 aa, Japanese encephalitis virus
RVSRMAIS

SEQ ID NO: 216198 - protein, 8 aa, Japanese encephalitis virus
VSRMAISG

SEQ ID NO: 216199 - protein, 8 aa, Japanese encephalitis virus
SRMAISGD

SEQ ID NO: 216200 - protein, 8 aa, Japanese encephalitis virus
AISGDDCA

SEQ ID NO: 216201 - protein, 8 aa, Japanese encephalitis virus
ISGDDCAV

SEQ ID NO: 216202 - protein, 8 aa, Japanese encephalitis virus
SGDDCAVK

SEQ ID NO: 216203 - protein, 8 aa, Japanese encephalitis virus
GDDCAVKP

SEQ ID NO: 216204 - protein, 8 aa, Japanese encephalitis virus
DDCAVKPL

SEQ ID NO: 216205 - protein, 8 aa, Japanese encephalitis virus
DCAVKPLD

SEQ ID NO: 216206 - protein, 8 aa, Japanese encephalitis virus
CAVKPLDD

SEQ ID NO: 216207 - protein, 8 aa, Japanese encephalitis virus
AVKPLDDR

SEQ ID NO: 216208 - protein, 8 aa, Japanese encephalitis virus
LDDRFATS

SEQ ID NO: 216209 - protein, 8 aa, Japanese encephalitis virus
DDRFATSL

SEQ ID NO: 216210 - protein, 8 aa, Japanese encephalitis virus
DRFATSLH

SEQ ID NO: 216211 - protein, 8 aa, Japanese encephalitis virus
RFATALYF

SEQ ID NO: 216212 - protein, 8 aa, Japanese encephalitis virus
FATALYFL

SEQ ID NO: 216213 - protein, 8 aa, Japanese encephalitis virus
ATSLHFLN

SEQ ID NO: 216214 - protein, 8 aa, Japanese encephalitis virus
TALYFLNA

SEQ ID NO: 216215 - protein, 8 aa, Japanese encephalitis virus
SLHFLNAM

SEQ ID NO: 216216 - protein, 8 aa, Japanese encephalitis virus
LYFLNAMS

SEQ ID NO: 216217 - protein, 8 aa, Japanese encephalitis virus
YFLNAMSK

SEQ ID NO: 216218 - protein, 8 aa, Japanese encephalitis virus
LNAMSKVT

SEQ ID NO: 216219 - protein, 8 aa, Japanese encephalitis virus
NAMSKVRR

SEQ ID NO: 216220 - protein, 8 aa, Japanese encephalitis virus
AMSKVTKD

SEQ ID NO: 216221 - protein, 8 aa, Japanese encephalitis virus
MSKVRRDI

SEQ ID NO: 216222 - protein, 8 aa, Japanese encephalitis virus
SKVRRDIQ

SEQ ID NO: 216223 - protein, 8 aa, Japanese encephalitis virus
KVRRDIQE

SEQ ID NO: 216224 - protein, 8 aa, Japanese encephalitis virus
VRRDIQEW

SEQ ID NO: 216225 - protein, 8 aa, Japanese encephalitis virus
RKDILEWK

SEQ ID NO: 216226 - protein, 8 aa, Japanese encephalitis virus
KDIQQWKP

SEQ ID NO: 216227 - protein, 8 aa, Japanese encephalitis virus
DIQQWKPS

SEQ ID NO: 216228 - protein, 8 aa, Japanese encephalitis virus
ILEWKPSH

SEQ ID NO: 216229 - protein, 8 aa, Japanese encephalitis virus
LEWKPSHG

SEQ ID NO: 216230 - protein, 8 aa, Japanese encephalitis virus
QWKPSHGW

SEQ ID NO: 216231 - protein, 8 aa, Japanese encephalitis virus
WKPSHGWL

SEQ ID NO: 216232 - protein, 8 aa, Japanese encephalitis virus
KPSHGWLD

SEQ ID NO: 216233 - protein, 8 aa, Japanese encephalitis virus
PSHGWLDW

SEQ ID NO: 216234 - protein, 8 aa, Japanese encephalitis virus
SHGWHDWL

SEQ ID NO: 216235 - protein, 8 aa, Japanese encephalitis virus
HGWHDWLH

SEQ ID NO: 216236 - protein, 8 aa, Japanese encephalitis virus
GWHDWLHV

SEQ ID NO: 216237 - protein, 8 aa, Japanese encephalitis virus
WHDWLHVP

SEQ ID NO: 216238 - protein, 8 aa, Japanese encephalitis virus
HDWLHVPF

SEQ ID NO: 216239 - protein, 8 aa, Japanese encephalitis virus
DWLHVPFC

SEQ ID NO: 216240 - protein, 8 aa, Japanese encephalitis virus
WLHVPFCS

SEQ ID NO: 216241 - protein, 8 aa, Japanese encephalitis virus
LHVPFCSN

SEQ ID NO: 216242 - protein, 8 aa, Japanese encephalitis virus
HVPFCSNH

SEQ ID NO: 216243 - protein, 8 aa, Japanese encephalitis virus
PFCSNHFH

SEQ ID NO: 216244 - protein, 8 aa, Japanese encephalitis virus
FCSNHFHE

SEQ ID NO: 216245 - protein, 8 aa, Japanese encephalitis virus
CSNHFHEI

SEQ ID NO: 216246 - protein, 8 aa, Japanese encephalitis virus
SNHFHEIV

SEQ ID NO: 216247 - protein, 8 aa, Japanese encephalitis virus
NHFHEIVM

SEQ ID NO: 216248 - protein, 8 aa, Japanese encephalitis virus
HFHEIVMK

SEQ ID NO: 216249 - protein, 8 aa, Japanese encephalitis virus
FHEIVMKD

SEQ ID NO: 216250 - protein, 8 aa, Japanese encephalitis virus
HEIVMKDG

SEQ ID NO: 216251 - protein, 8 aa, Japanese encephalitis virus
VMKDGRSL

SEQ ID NO: 216252 - protein, 8 aa, Japanese encephalitis virus
MKDGRSLL

SEQ ID NO: 216253 - protein, 8 aa, Japanese encephalitis virus
KDGRSIVD

SEQ ID NO: 216254 - protein, 8 aa, Japanese encephalitis virus
DGRSLLVP

SEQ ID NO: 216255 - protein, 8 aa, Japanese encephalitis virus
GRSIVDPC

SEQ ID NO: 216256 - protein, 8 aa, Japanese encephalitis virus
RSLLVPCR

SEQ ID NO: 216257 - protein, 8 aa, Japanese encephalitis virus
SIVDPCRG

SEQ ID NO: 216258 - protein, 8 aa, Japanese encephalitis virus
LLVPCRGQ

SEQ ID NO: 216259 - protein, 8 aa, Japanese encephalitis virus
VDPCRGQD

SEQ ID NO: 216260 - protein, 8 aa, Japanese encephalitis virus
DPCRGQDE

SEQ ID NO: 216261 - protein, 8 aa, Japanese encephalitis virus
RGQDELID

SEQ ID NO: 216262 - protein, 8 aa, Japanese encephalitis virus
GQDELIDR

SEQ ID NO: 216263 - protein, 8 aa, Japanese encephalitis virus
QDELIDRA

SEQ ID NO: 216264 - protein, 8 aa, Japanese encephalitis virus
DELIDRAR

SEQ ID NO: 216265 - protein, 8 aa, Japanese encephalitis virus
ELIDRARI

SEQ ID NO: 216266 - protein, 8 aa, Japanese encephalitis virus
LIDRARIS

SEQ ID NO: 216267 - protein, 8 aa, Japanese encephalitis virus
IDRARISP

SEQ ID NO: 216268 - protein, 8 aa, Japanese encephalitis virus
DRARISPG

SEQ ID NO: 216269 - protein, 8 aa, Japanese encephalitis virus
RISPGAGC

SEQ ID NO: 216270 - protein, 8 aa, Japanese encephalitis virus
ISPGAGCN

SEQ ID NO: 216271 - protein, 8 aa, Japanese encephalitis virus
SPGAGCNV

SEQ ID NO: 216272 - protein, 8 aa, Japanese encephalitis virus
PGAGCNVK

SEQ ID NO: 216273 - protein, 8 aa, Japanese encephalitis virus
GAGCNVKD

SEQ ID NO: 216274 - protein, 8 aa, Japanese encephalitis virus
AGCNVKDT

SEQ ID NO: 216275 - protein, 8 aa, Japanese encephalitis virus
GCNVKDTA

SEQ ID NO: 216276 - protein, 8 aa, Japanese encephalitis virus
CNVKDTAC

SEQ ID NO: 216277 - protein, 8 aa, Japanese encephalitis virus
NVRDTACL

SEQ ID NO: 216278 - protein, 8 aa, Japanese encephalitis virus
VMDTACLA

SEQ ID NO: 216279 - protein, 8 aa, Japanese encephalitis virus
KDTACLPK

SEQ ID NO: 216280 - protein, 8 aa, Japanese encephalitis virus
DTACLPKA

SEQ ID NO: 216281 - protein, 8 aa, Japanese encephalitis virus
TACLPKAY

SEQ ID NO: 216282 - protein, 8 aa, Japanese encephalitis virus
ACLPKAYA

SEQ ID NO: 216283 - protein, 8 aa, Japanese encephalitis virus
CLPKAYAQ

SEQ ID NO: 216284 - protein, 8 aa, Japanese encephalitis virus
LPKAYAQM

SEQ ID NO: 216285 - protein, 8 aa, Japanese encephalitis virus
AKAYAQMR

SEQ ID NO: 216286 - protein, 8 aa, Japanese encephalitis virus
KAYAQMRL

SEQ ID NO: 216287 - protein, 8 aa, Japanese encephalitis virus
AYAQMRLL

SEQ ID NO: 216288 - protein, 8 aa, Japanese encephalitis virus
YAQMRLLL

SEQ ID NO: 216289 - protein, 8 aa, Japanese encephalitis virus
AQMRLLLY

SEQ ID NO: 216290 - protein, 8 aa, Japanese encephalitis virus
QMRLLLYF

SEQ ID NO: 216291 - protein, 8 aa, Japanese encephalitis virus
MRLLLYFH

SEQ ID NO: 216292 - protein, 8 aa, Japanese encephalitis virus
RLLLYFHR

SEQ ID NO: 216293 - protein, 8 aa, Japanese encephalitis virus
VLLYFHRR

SEQ ID NO: 216294 - protein, 8 aa, Japanese encephalitis virus
LLYFHRRY

SEQ ID NO: 216295 - protein, 8 aa, Japanese encephalitis virus
LYFHRRYL

SEQ ID NO: 216296 - protein, 8 aa, Japanese encephalitis virus
YFHRRYLR

SEQ ID NO: 216297 - protein, 8 aa, Japanese encephalitis virus
FHRRYLRL

SEQ ID NO: 216298 - protein, 8 aa, Japanese encephalitis virus
HRRYLRLM

SEQ ID NO: 216299 - protein, 8 aa, Japanese encephalitis virus
RRYLRLMA

SEQ ID NO: 216300 - protein, 8 aa, Japanese encephalitis virus
RYLRLMAN

SEQ ID NO: 216301 - protein, 8 aa, Japanese encephalitis virus
YLRLMANA

SEQ ID NO: 216302 - protein, 8 aa, Japanese encephalitis virus
LCLMANAI

SEQ ID NO: 216303 - protein, 8 aa, Japanese encephalitis virus
CLMANAIC

SEQ ID NO: 216304 - protein, 8 aa, Japanese encephalitis virus
MANAICST

SEQ ID NO: 216305 - protein, 8 aa, Japanese encephalitis virus
ANAICSTV

SEQ ID NO: 216306 - protein, 8 aa, Japanese encephalitis virus
NAICSTVP

SEQ ID NO: 216307 - protein, 8 aa, Japanese encephalitis virus
AICSAVPL

SEQ ID NO: 216308 - protein, 8 aa, Japanese encephalitis virus
ICSTVPVD

SEQ ID NO: 216309 - protein, 8 aa, Japanese encephalitis virus
CSAVPLDW

SEQ ID NO: 216310 - protein, 8 aa, Japanese encephalitis virus
SAVPLDWV

SEQ ID NO: 216311 - protein, 8 aa, Japanese encephalitis virus
AVPVNWVP

SEQ ID NO: 216312 - protein, 8 aa, Japanese encephalitis virus
VPVNWVPT

SEQ ID NO: 216313 - protein, 8 aa, Japanese encephalitis virus
PVNWVPTG

SEQ ID NO: 216314 - protein, 8 aa, Japanese encephalitis virus
VNWVPTGR

SEQ ID NO: 216315 - protein, 8 aa, Japanese encephalitis virus
NWVPTGRT

SEQ ID NO: 216316 - protein, 8 aa, Japanese encephalitis virus
TGRTSWSK

SEQ ID NO: 216317 - protein, 8 aa, Japanese encephalitis virus
GRTSWSKH

SEQ ID NO: 216318 - protein, 8 aa, Japanese encephalitis virus
RTSWSKHS

SEQ ID NO: 216319 - protein, 8 aa, Japanese encephalitis virus
TSWSKHSK

SEQ ID NO: 216320 - protein, 8 aa, Japanese encephalitis virus
SWSKHSKG

SEQ ID NO: 216321 - protein, 8 aa, Japanese encephalitis virus
WSKHSKGE

SEQ ID NO: 216322 - protein, 8 aa, Japanese encephalitis virus
SKHSKGEW

SEQ ID NO: 216323 - protein, 8 aa, Japanese encephalitis virus
KHSKGEWM

SEQ ID NO: 216324 - protein, 8 aa, Japanese encephalitis virus
HSKGEWIP

SEQ ID NO: 216325 - protein, 8 aa, Japanese encephalitis virus
SKGEWIPT

SEQ ID NO: 216326 - protein, 8 aa, Japanese encephalitis virus
KGEWIPTE

SEQ ID NO: 216327 - protein, 8 aa, Japanese encephalitis virus
GEWMTTEN

SEQ ID NO: 216328 - protein, 8 aa, Japanese encephalitis virus
EWMTTENM

SEQ ID NO: 216329 - protein, 8 aa, Japanese encephalitis virus
WMTTENML

SEQ ID NO: 216330 - protein, 8 aa, Japanese encephalitis virus
MTTENMLQ

SEQ ID NO: 216331 - protein, 8 aa, Japanese encephalitis virus
TTENMLQV

SEQ ID NO: 216332 - protein, 8 aa, Japanese encephalitis virus
TENMLQVW

SEQ ID NO: 216333 - protein, 8 aa, Japanese encephalitis virus
ENMLQVWN

SEQ ID NO: 216334 - protein, 8 aa, Japanese encephalitis virus
NMLQVWNK

SEQ ID NO: 216335 - protein, 8 aa, Japanese encephalitis virus
MLQVWNKV

SEQ ID NO: 216336 - protein, 8 aa, Japanese encephalitis virus
LQVWNKVW

SEQ ID NO: 216337 - protein, 8 aa, Japanese encephalitis virus
QVWNKVWI

SEQ ID NO: 216338 - protein, 8 aa, Japanese encephalitis virus
VWNKVWIE

SEQ ID NO: 216339 - protein, 8 aa, Japanese encephalitis virus
WNKVWIEE

SEQ ID NO: 216340 - protein, 8 aa, Japanese encephalitis virus
NKVWIEEN

SEQ ID NO: 216341 - protein, 8 aa, Japanese encephalitis virus
KVWIEENE

SEQ ID NO: 216342 - protein, 8 aa, Japanese encephalitis virus
IEENEWMV

SEQ ID NO: 216343 - protein, 8 aa, Japanese encephalitis virus
EENEWMVD

SEQ ID NO: 216344 - protein, 8 aa, Japanese encephalitis virus
ENEWMVDK

SEQ ID NO: 216345 - protein, 8 aa, Japanese encephalitis virus
NEWMVDKT

SEQ ID NO: 216346 - protein, 8 aa, Japanese encephalitis virus
EWMVDKTP

SEQ ID NO: 216347 - protein, 8 aa, Japanese encephalitis virus
DKTPVTSW

SEQ ID NO: 216348 - protein, 8 aa, Japanese encephalitis virus
KTPVTSWT

SEQ ID NO: 216349 - protein, 8 aa, Japanese encephalitis virus
TPVTSWTD

SEQ ID NO: 216350 - protein, 8 aa, Japanese encephalitis virus
PVTSWTDV

SEQ ID NO: 216351 - protein, 8 aa, Japanese encephalitis virus
VTSWTDVP

SEQ ID NO: 216352 - protein, 8 aa, Japanese encephalitis virus
ASWTDVPY

SEQ ID NO: 216353 - protein, 8 aa, Japanese encephalitis virus
REDIWCGN

SEQ ID NO: 216354 - protein, 8 aa, Japanese encephalitis virus
EDIWCGNL

SEQ ID NO: 216355 - protein, 8 aa, Japanese encephalitis virus
DIWCGNLI

SEQ ID NO: 216356 - protein, 8 aa, Japanese encephalitis virus
IWCGNLIG

SEQ ID NO: 216357 - protein, 8 aa, Japanese encephalitis virus
WCGNLIGT

SEQ ID NO: 216358 - protein, 8 aa, Japanese encephalitis virus
CGNLIGTR

SEQ ID NO: 216359 - protein, 8 aa, Japanese encephalitis virus
GSLIGTRT

SEQ ID NO: 216360 - protein, 8 aa, Japanese encephalitis virus
SLIGTRTR

SEQ ID NO: 216361 - protein, 8 aa, Japanese encephalitis virus
LIGTRTRA

SEQ ID NO: 216362 - protein, 8 aa, Japanese encephalitis virus
IGTRTRAT

SEQ ID NO: 216363 - protein, 8 aa, Japanese encephalitis virus
GTRTRATW

SEQ ID NO: 216364 - protein, 8 aa, Japanese encephalitis virus
TRTRATWA

SEQ ID NO: 216365 - protein, 8 aa, Japanese encephalitis virus
RTRATWAE

SEQ ID NO: 216366 - protein, 8 aa, Japanese encephalitis virus
TRATWAEN

SEQ ID NO: 216367 - protein, 8 aa, Japanese encephalitis virus
KATWAENI

SEQ ID NO: 216368 - protein, 8 aa, Japanese encephalitis virus
ATWAENVY

SEQ ID NO: 216369 - protein, 8 aa, Japanese encephalitis virus
TWAENVYA

SEQ ID NO: 216370 - protein, 8 aa, Japanese encephalitis virus
WAENVYAA

SEQ ID NO: 216371 - protein, 8 aa, Japanese encephalitis virus
AENVYAAI

SEQ ID NO: 216372 - protein, 8 aa, Japanese encephalitis virus
ENVYAAIN

SEQ ID NO: 216373 - protein, 8 aa, Japanese encephalitis virus
NVYAAINQ

SEQ ID NO: 216374 - protein, 8 aa, Japanese encephalitis virus
VYAAINQV

SEQ ID NO: 216375 - protein, 8 aa, Japanese encephalitis virus
AINQVRAI

SEQ ID NO: 216376 - protein, 8 aa, Japanese encephalitis virus
INQVRAII

SEQ ID NO: 216377 - protein, 8 aa, Japanese encephalitis virus
NQVRAIIG

SEQ ID NO: 216378 - protein, 8 aa, Japanese encephalitis virus
QVRAIIGK

SEQ ID NO: 216379 - protein, 8 aa, Japanese encephalitis virus
VRAIIGKE

SEQ ID NO: 216380 - protein, 8 aa, Japanese encephalitis virus
RAIIGKEN

SEQ ID NO: 216381 - protein, 8 aa, Japanese encephalitis virus
AIIGKENY

SEQ ID NO: 216382 - protein, 8 aa, Japanese encephalitis virus
IIGKENYV

SEQ ID NO: 216383 - protein, 8 aa, Japanese encephalitis virus
IGKEDYVD

SEQ ID NO: 216384 - protein, 8 aa, Japanese encephalitis virus
GKETYVDY

SEQ ID NO: 216385 - protein, 8 aa, Japanese encephalitis virus
KETYVDYM

SEQ ID NO: 216386 - protein, 8 aa, Japanese encephalitis virus
ETYVDYMT

SEQ ID NO: 216387 - protein, 8 aa, Japanese encephalitis virus
TYVDYMTS

SEQ ID NO: 216388 - protein, 8 aa, Japanese encephalitis virus
YVDYMDFP

SEQ ID NO: 216389 - protein, 8 aa, Japanese encephalitis virus
VDYMDFPQ

SEQ ID NO: 216390 - protein, 8 aa, Japanese encephalitis virus
DYMDFPQR

SEQ ID NO: 216391 - protein, 8 aa, Japanese encephalitis virus
YMDFPQRI

SEQ ID NO: 216392 - protein, 8 aa, Japanese encephalitis virus
MLSLRRYE

SEQ ID NO: 216393 - protein, 8 aa, Japanese encephalitis virus
DFPQRIED

SEQ ID NO: 216394 - protein, 8 aa, Japanese encephalitis virus
FPQRIEDV

SEQ ID NO: 216395 - protein, 8 aa, Japanese encephalitis virus
LRRYEDVS

SEQ ID NO: 216396 - protein, 8 aa, Japanese encephalitis virus
RRYEDVLV

SEQ ID NO: 216397 - protein, 8 aa, Japanese encephalitis virus
RYEDVLVQ

SEQ ID NO: 216398 - protein, 8 aa, Japanese encephalitis virus
YEDVLVQE

SEQ ID NO: 216399 - protein, 8 aa, Japanese encephalitis virus
EDVLVQED

SEQ ID NO: 216400 - protein, 8 aa, Japanese encephalitis virus
DVLVQEDR

SEQ ID NO: 216401 - protein, 8 aa, Japanese encephalitis virus
VLVQEDRV

SEQ ID NO: 216402 - protein, 8 aa, Japanese encephalitis virus
LVQEDRVI

SEQ ID NO: 216403 - protein, 8 aa, Japanese encephalitis virus
KKPRGPGI

SEQ ID NO: 216404 - protein, 8 aa, Japanese encephalitis virus
KPRGPGIN

SEQ ID NO: 216405 - protein, 8 aa, Japanese encephalitis virus
PRGPGINR

SEQ ID NO: 216406 - protein, 8 aa, Japanese encephalitis virus
RGPGINRA

SEQ ID NO: 216407 - protein, 8 aa, Japanese encephalitis virus
GPGINRAI

SEQ ID NO: 216408 - protein, 8 aa, Japanese encephalitis virus
PGKSRAIN

SEQ ID NO: 216409 - protein, 8 aa, Japanese encephalitis virus
GINRAIYM

SEQ ID NO: 216410 - protein, 8 aa, Japanese encephalitis virus
INRAIYML

SEQ ID NO: 216411 - protein, 8 aa, Japanese encephalitis virus
NRAIYMLK

SEQ ID NO: 216412 - protein, 8 aa, Japanese encephalitis virus
FPLVRVKR

SEQ ID NO: 216413 - protein, 8 aa, Japanese encephalitis virus
PLVRVKRV

SEQ ID NO: 216414 - protein, 8 aa, Japanese encephalitis virus
LVRVKRVV

SEQ ID NO: 216415 - protein, 8 aa, Japanese encephalitis virus
VRVKRVVM

SEQ ID NO: 216416 - protein, 8 aa, Japanese encephalitis virus
GVKRVVIS

SEQ ID NO: 216417 - protein, 8 aa, Japanese encephalitis virus
VKKVVMSL

SEQ ID NO: 216418 - protein, 8 aa, Japanese encephalitis virus
KRVVISLL

SEQ ID NO: 216419 - protein, 8 aa, Japanese encephalitis virus
KVVMSLLD

SEQ ID NO: 216420 - protein, 8 aa, Japanese encephalitis virus
LLDGIGPL

SEQ ID NO: 216421 - protein, 8 aa, Japanese encephalitis virus
LDGIGPLR

SEQ ID NO: 216422 - protein, 8 aa, Japanese encephalitis virus
DGIGPLRF

SEQ ID NO: 216423 - protein, 8 aa, Japanese encephalitis virus
GIGPLRFV

SEQ ID NO: 216424 - protein, 8 aa, Japanese encephalitis virus
IGPLRFVL

SEQ ID NO: 216425 - protein, 8 aa, Japanese encephalitis virus
GPLRFVLA

SEQ ID NO: 216426 - protein, 8 aa, Japanese encephalitis virus
PLRFVLAL

SEQ ID NO: 216427 - protein, 8 aa, Japanese encephalitis virus
VRFVLALT

SEQ ID NO: 216428 - protein, 8 aa, Japanese encephalitis virus
RFVLAFIT

SEQ ID NO: 216429 - protein, 8 aa, Japanese encephalitis virus
FVLALVSF

SEQ ID NO: 216430 - protein, 8 aa, Japanese encephalitis virus
VLALVSFF

SEQ ID NO: 216431 - protein, 8 aa, Japanese encephalitis virus
LAFITFFK

SEQ ID NO: 216432 - protein, 8 aa, Japanese encephalitis virus
ALVSFFKF

SEQ ID NO: 216433 - protein, 8 aa, Japanese encephalitis virus
FITFFKFT

SEQ ID NO: 216434 - protein, 8 aa, Japanese encephalitis virus
VSFFKFTA

SEQ ID NO: 216435 - protein, 8 aa, Japanese encephalitis virus
LSPTKALL

SEQ ID NO: 216436 - protein, 8 aa, Japanese encephalitis virus
SPTKALLG

SEQ ID NO: 216437 - protein, 8 aa, Japanese encephalitis virus
KALSGRWK

SEQ ID NO: 216438 - protein, 8 aa, Japanese encephalitis virus
ALSGRWKA

SEQ ID NO: 216439 - protein, 8 aa, Japanese encephalitis virus
LSGRWKAV

SEQ ID NO: 216440 - protein, 8 aa, Japanese encephalitis virus
SGRWKAVE

SEQ ID NO: 216441 - protein, 8 aa, Japanese encephalitis virus
GRWRALEK

SEQ ID NO: 216442 - protein, 8 aa, Japanese encephalitis virus
RWKAVERS

SEQ ID NO: 216443 - protein, 8 aa, Japanese encephalitis virus
WKAVERSV

SEQ ID NO: 216444 - protein, 8 aa, Japanese encephalitis virus
KAVERSVA

SEQ ID NO: 216445 - protein, 8 aa, Japanese encephalitis virus
AVERSVAM

SEQ ID NO: 216446 - protein, 8 aa, Japanese encephalitis virus
LEKSVAMK

SEQ ID NO: 216447 - protein, 8 aa, Japanese encephalitis virus
SFKGELGT

SEQ ID NO: 216448 - protein, 8 aa, Japanese encephalitis virus
FKGELGTL

SEQ ID NO: 216449 - protein, 8 aa, Japanese encephalitis virus
KRELGILI

SEQ ID NO: 216450 - protein, 8 aa, Japanese encephalitis virus
RELGILID

SEQ ID NO: 216451 - protein, 8 aa, Japanese encephalitis virus
ELGTLIDG

SEQ ID NO: 216452 - protein, 8 aa, Japanese encephalitis virus
LGTLIDVV

SEQ ID NO: 216453 - protein, 8 aa, Japanese encephalitis virus
GTLIDGVN

SEQ ID NO: 216454 - protein, 8 aa, Japanese encephalitis virus
ILIDAVNK

SEQ ID NO: 216455 - protein, 8 aa, Japanese encephalitis virus
LIDGVNKR

SEQ ID NO: 216456 - protein, 8 aa, Japanese encephalitis virus
IDGVNKRG

SEQ ID NO: 216457 - protein, 8 aa, Japanese encephalitis virus
DGVNKRGR

SEQ ID NO: 216458 - protein, 8 aa, Japanese encephalitis virus
VVNKRGKK

SEQ ID NO: 216459 - protein, 8 aa, Japanese encephalitis virus
VNKRGRKR

SEQ ID NO: 216460 - protein, 8 aa, Japanese encephalitis virus
NKRGRKRN

SEQ ID NO: 216461 - protein, 8 aa, Japanese encephalitis virus
KRGRKRNK

SEQ ID NO: 216462 - protein, 8 aa, Japanese encephalitis virus
RGRKRNKR

SEQ ID NO: 216463 - protein, 8 aa, Japanese encephalitis virus
GRKRNKRG

SEQ ID NO: 216464 - protein, 8 aa, Japanese encephalitis virus
RKRNKRGG

SEQ ID NO: 216465 - protein, 8 aa, Japanese encephalitis virus
QNKRGGNG

SEQ ID NO: 216466 - protein, 8 aa, Japanese encephalitis virus
NKRGGNGG

SEQ ID NO: 216467 - protein, 8 aa, Japanese encephalitis virus
IMWLACLA

SEQ ID NO: 216468 - protein, 8 aa, Japanese encephalitis virus
AGAMRLSN

SEQ ID NO: 216469 - protein, 8 aa, Japanese encephalitis virus
GALKLSNF

SEQ ID NO: 216470 - protein, 8 aa, Japanese encephalitis virus
AIKLSNFQ

SEQ ID NO: 216471 - protein, 8 aa, Japanese encephalitis virus
LKLSNFQG

SEQ ID NO: 216472 - protein, 8 aa, Japanese encephalitis virus
QGKLLMAV

SEQ ID NO: 216473 - protein, 8 aa, Japanese encephalitis virus
GKLLMAVN

SEQ ID NO: 216474 - protein, 8 aa, Japanese encephalitis virus
KLLMAVNN

SEQ ID NO: 216475 - protein, 8 aa, Japanese encephalitis virus
LLMAVNNT

SEQ ID NO: 216476 - protein, 8 aa, Japanese encephalitis virus
LMAVNNTD

SEQ ID NO: 216477 - protein, 8 aa, Japanese encephalitis virus
MAVNNTDI

SEQ ID NO: 216478 - protein, 8 aa, Japanese encephalitis virus
AVNNTDIA

SEQ ID NO: 216479 - protein, 8 aa, Japanese encephalitis virus
RAIDVGYL

SEQ ID NO: 216480 - protein, 8 aa, Japanese encephalitis virus
AIDVGHMC

SEQ ID NO: 216481 - protein, 8 aa, Japanese encephalitis virus
IDVGHMCE

SEQ ID NO: 216482 - protein, 8 aa, Japanese encephalitis virus
DVGYLCED

SEQ ID NO: 216483 - protein, 8 aa, Japanese encephalitis virus
VGHMCEDT

SEQ ID NO: 216484 - protein, 8 aa, Japanese encephalitis virus
GHMCEDTI

SEQ ID NO: 216485 - protein, 8 aa, Japanese encephalitis virus
YLCEDTIT

SEQ ID NO: 216486 - protein, 8 aa, Japanese encephalitis virus
AGNDPEDV

SEQ ID NO: 216487 - protein, 8 aa, Japanese encephalitis virus
DCWCDHQE

SEQ ID NO: 216488 - protein, 8 aa, Japanese encephalitis virus
CWCDHQEV

SEQ ID NO: 216489 - protein, 8 aa, Japanese encephalitis virus
WCDHQEVY

SEQ ID NO: 216490 - protein, 8 aa, Japanese encephalitis virus
CDNQEVYI

SEQ ID NO: 216491 - protein, 8 aa, Japanese encephalitis virus
DHQEVYVQ

SEQ ID NO: 216492 - protein, 8 aa, Japanese encephalitis virus
HQEVYVQY

SEQ ID NO: 216493 - protein, 8 aa, Japanese encephalitis virus
QEVYIQYG

SEQ ID NO: 216494 - protein, 8 aa, Japanese encephalitis virus
EVYIQYGR

SEQ ID NO: 216495 - protein, 8 aa, Japanese encephalitis virus
VYIQYGRC

SEQ ID NO: 216496 - protein, 8 aa, Japanese encephalitis virus
YIQYGRCT

SEQ ID NO: 216497 - protein, 8 aa, Japanese encephalitis virus
IQYGRCTR

SEQ ID NO: 216498 - protein, 8 aa, Japanese encephalitis virus
YGRCTRTS

SEQ ID NO: 216499 - protein, 8 aa, Japanese encephalitis virus
GRCTRTSH

SEQ ID NO: 216500 - protein, 8 aa, Japanese encephalitis virus
RCTRTSHS

SEQ ID NO: 216501 - protein, 8 aa, Japanese encephalitis virus
RTSHSQTS

SEQ ID NO: 216502 - protein, 8 aa, Japanese encephalitis virus
TRHSKRSK

SEQ ID NO: 216503 - protein, 8 aa, Japanese encephalitis virus
SHSQTSRR

SEQ ID NO: 216504 - protein, 8 aa, Japanese encephalitis virus
HSQTSRRS

SEQ ID NO: 216505 - protein, 8 aa, Japanese encephalitis virus
SQTSRRSV

SEQ ID NO: 216506 - protein, 8 aa, Japanese encephalitis virus
QTSRRSVS

SEQ ID NO: 216507 - protein, 8 aa, Japanese encephalitis virus
RSKRSVSV

SEQ ID NO: 216508 - protein, 8 aa, Japanese encephalitis virus
SRRSVSVH

SEQ ID NO: 216509 - protein, 8 aa, Japanese encephalitis virus
KRSVSVQT

SEQ ID NO: 216510 - protein, 8 aa, Japanese encephalitis virus
RSVSVQPN

SEQ ID NO: 216511 - protein, 8 aa, Japanese encephalitis virus
SVSVHTHG

SEQ ID NO: 216512 - protein, 8 aa, Japanese encephalitis virus
VSVHTHGE

SEQ ID NO: 216513 - protein, 8 aa, Japanese encephalitis virus
SVHTHGES

SEQ ID NO: 216514 - protein, 8 aa, Japanese encephalitis virus
VQPNGERS

SEQ ID NO: 216515 - protein, 8 aa, Japanese encephalitis virus
QPNGERSL

SEQ ID NO: 216516 - protein, 8 aa, Japanese encephalitis virus
THGESSLE

SEQ ID NO: 216517 - protein, 8 aa, Japanese encephalitis virus
NGERSLVN

SEQ ID NO: 216518 - protein, 8 aa, Japanese encephalitis virus
GESSLENK

SEQ ID NO: 216519 - protein, 8 aa, Japanese encephalitis virus
ERSLVNKK

SEQ ID NO: 216520 - protein, 8 aa, Japanese encephalitis virus
SSLENKKE

SEQ ID NO: 216521 - protein, 8 aa, Japanese encephalitis virus
SLENKKEA

SEQ ID NO: 216522 - protein, 8 aa, Japanese encephalitis virus
LENKKEAW

SEQ ID NO: 216523 - protein, 8 aa, Japanese encephalitis virus
ENKKEAWL

SEQ ID NO: 216524 - protein, 8 aa, Japanese encephalitis virus
NKKKAWLD

SEQ ID NO: 216525 - protein, 8 aa, Japanese encephalitis virus
KKKAWLDS

SEQ ID NO: 216526 - protein, 8 aa, Japanese encephalitis virus
KEAWLNST

SEQ ID NO: 216527 - protein, 8 aa, Japanese encephalitis virus
KAWLDSTR

SEQ ID NO: 216528 - protein, 8 aa, Japanese encephalitis virus
AWLNSTKA

SEQ ID NO: 216529 - protein, 8 aa, Japanese encephalitis virus
WLNSTKAT

SEQ ID NO: 216530 - protein, 8 aa, Japanese encephalitis virus
LNSTKATR

SEQ ID NO: 216531 - protein, 8 aa, Japanese encephalitis virus
NSTKATRY

SEQ ID NO: 216532 - protein, 8 aa, Japanese encephalitis virus
TRATRYLM

SEQ ID NO: 216533 - protein, 8 aa, Japanese encephalitis virus
RATRYLMK

SEQ ID NO: 216534 - protein, 8 aa, Japanese encephalitis virus
ATRYLVKT

SEQ ID NO: 216535 - protein, 8 aa, Japanese encephalitis virus
TRYLVKTE

SEQ ID NO: 216536 - protein, 8 aa, Japanese encephalitis virus
RYLVKTEN

SEQ ID NO: 216537 - protein, 8 aa, Japanese encephalitis virus
YLVKTENW

SEQ ID NO: 216538 - protein, 8 aa, Japanese encephalitis virus
LVKTENWI

SEQ ID NO: 216539 - protein, 8 aa, Japanese encephalitis virus
MKTENWIV

SEQ ID NO: 216540 - protein, 8 aa, Japanese encephalitis virus
PGYAFLAG

SEQ ID NO: 216541 - protein, 8 aa, Japanese encephalitis virus
ILGWMLGS

SEQ ID NO: 216542 - protein, 8 aa, Japanese encephalitis virus
GWMLGSTT

SEQ ID NO: 216543 - protein, 8 aa, Japanese encephalitis virus
WMLGSTTG

SEQ ID NO: 216544 - protein, 8 aa, Japanese encephalitis virus
GQRLGFTI

SEQ ID NO: 216545 - protein, 8 aa, Japanese encephalitis virus
QRLGFTIL

SEQ ID NO: 216546 - protein, 8 aa, Japanese encephalitis virus
RLGFTILL

SEQ ID NO: 216547 - protein, 8 aa, Japanese encephalitis virus
VVFTILPL

SEQ ID NO: 216548 - protein, 8 aa, Japanese encephalitis virus
VFTILPLL

SEQ ID NO: 216549 - protein, 8 aa, Japanese encephalitis virus
MGNRDFVE

SEQ ID NO: 216550 - protein, 8 aa, Japanese encephalitis virus
GNRDFIER

SEQ ID NO: 216551 - protein, 8 aa, Japanese encephalitis virus
NRDFIERA

SEQ ID NO: 216552 - protein, 8 aa, Japanese encephalitis virus
RDFIQGAS

SEQ ID NO: 216553 - protein, 8 aa, Japanese encephalitis virus
DFIQGASG

SEQ ID NO: 216554 - protein, 8 aa, Japanese encephalitis virus
FIQGASGA

SEQ ID NO: 216555 - protein, 8 aa, Japanese encephalitis virus
IERASGAT

SEQ ID NO: 216556 - protein, 8 aa, Japanese encephalitis virus
EGVSGATW

SEQ ID NO: 216557 - protein, 8 aa, Japanese encephalitis virus
RASGATWV

SEQ ID NO: 216558 - protein, 8 aa, Japanese encephalitis virus
LTIMANDR

SEQ ID NO: 216559 - protein, 8 aa, Japanese encephalitis virus
TIMANDRP

SEQ ID NO: 216560 - protein, 8 aa, Japanese encephalitis virus
IMANDRPT

SEQ ID NO: 216561 - protein, 8 aa, Japanese encephalitis virus
MANDRPTL

SEQ ID NO: 216562 - protein, 8 aa, Japanese encephalitis virus
ANDRPTLD

SEQ ID NO: 216563 - protein, 8 aa, Japanese encephalitis virus
NDRPTLDV

SEQ ID NO: 216564 - protein, 8 aa, Japanese encephalitis virus
DKPTLDRR

SEQ ID NO: 216565 - protein, 8 aa, Japanese encephalitis virus
KPTLDRRM

SEQ ID NO: 216566 - protein, 8 aa, Japanese encephalitis virus
PTLDVRMT

SEQ ID NO: 216567 - protein, 8 aa, Japanese encephalitis virus
TLDRRMIN

SEQ ID NO: 216568 - protein, 8 aa, Japanese encephalitis virus
LDRRMINI

SEQ ID NO: 216569 - protein, 8 aa, Japanese encephalitis virus
DVRMTNIE

SEQ ID NO: 216570 - protein, 8 aa, Japanese encephalitis virus
RRMINIEA

SEQ ID NO: 216571 - protein, 8 aa, Japanese encephalitis virus
RMTNIEAS

SEQ ID NO: 216572 - protein, 8 aa, Japanese encephalitis virus
MTNIEASQ

SEQ ID NO: 216573 - protein, 8 aa, Japanese encephalitis virus
TNIEASQL

SEQ ID NO: 216574 - protein, 8 aa, Japanese encephalitis virus
EVRSYCYR

SEQ ID NO: 216575 - protein, 8 aa, Japanese encephalitis virus
VRSYYYHA

SEQ ID NO: 216576 - protein, 8 aa, Japanese encephalitis virus
RSYCYRAS

SEQ ID NO: 216577 - protein, 8 aa, Japanese encephalitis virus
SYYYHASV

SEQ ID NO: 216578 - protein, 8 aa, Japanese encephalitis virus
YYYHASVT

SEQ ID NO: 216579 - protein, 8 aa, Japanese encephalitis virus
YYHASVTD

SEQ ID NO: 216580 - protein, 8 aa, Japanese encephalitis virus
TTGEAHNK

SEQ ID NO: 216581 - protein, 8 aa, Japanese encephalitis virus
GEAHNKKR

SEQ ID NO: 216582 - protein, 8 aa, Japanese encephalitis virus
EAHNKKRA

SEQ ID NO: 216583 - protein, 8 aa, Japanese encephalitis virus
AHNEKGAD

SEQ ID NO: 216584 - protein, 8 aa, Japanese encephalitis virus
HNEKQADS

SEQ ID NO: 216585 - protein, 8 aa, Japanese encephalitis virus
NEKQADSS

SEQ ID NO: 216586 - protein, 8 aa, Japanese encephalitis virus
KKRADSSY

SEQ ID NO: 216587 - protein, 8 aa, Japanese encephalitis virus
KGADSSYV

SEQ ID NO: 216588 - protein, 8 aa, Japanese encephalitis virus
QADSSYVC

SEQ ID NO: 216589 - protein, 8 aa, Japanese encephalitis virus
FTDRGWGK

SEQ ID NO: 216590 - protein, 8 aa, Japanese encephalitis virus
TDRGWGKG

SEQ ID NO: 216591 - protein, 8 aa, Japanese encephalitis virus
DRGWRNGC

SEQ ID NO: 216592 - protein, 8 aa, Japanese encephalitis virus
RGWRNGCG

SEQ ID NO: 216593 - protein, 8 aa, Japanese encephalitis virus
GWRNGCGL

SEQ ID NO: 216594 - protein, 8 aa, Japanese encephalitis virus
WGKGCGLF

SEQ ID NO: 216595 - protein, 8 aa, Japanese encephalitis virus
GNGCGLSG

SEQ ID NO: 216596 - protein, 8 aa, Japanese encephalitis virus
NGCGLSGK

SEQ ID NO: 216597 - protein, 8 aa, Japanese encephalitis virus
GCGLSGKG

SEQ ID NO: 216598 - protein, 8 aa, Japanese encephalitis virus
CGLSGKGS

SEQ ID NO: 216599 - protein, 8 aa, Japanese encephalitis virus
GLSGKGSI

SEQ ID NO: 216600 - protein, 8 aa, Japanese encephalitis virus
LSGKGSID

SEQ ID NO: 216601 - protein, 8 aa, Japanese encephalitis virus
CAKFSCTN

SEQ ID NO: 216602 - protein, 8 aa, Japanese encephalitis virus
AKFSCTNK

SEQ ID NO: 216603 - protein, 8 aa, Japanese encephalitis virus
KFSCTNKA

SEQ ID NO: 216604 - protein, 8 aa, Japanese encephalitis virus
FSCTNKAI

SEQ ID NO: 216605 - protein, 8 aa, Japanese encephalitis virus
SCTNKAIG

SEQ ID NO: 216606 - protein, 8 aa, Japanese encephalitis virus
CTNKAIGR

SEQ ID NO: 216607 - protein, 8 aa, Japanese encephalitis virus
KATGKTIQ

SEQ ID NO: 216608 - protein, 8 aa, Japanese encephalitis virus
TIQPENSK

SEQ ID NO: 216609 - protein, 8 aa, Japanese encephalitis virus
IQSENIKY

SEQ ID NO: 216610 - protein, 8 aa, Japanese encephalitis virus
QPENSKYE

SEQ ID NO: 216611 - protein, 8 aa, Japanese encephalitis virus
PENSKYEV

SEQ ID NO: 216612 - protein, 8 aa, Japanese encephalitis virus
ENSKYEVG

SEQ ID NO: 216613 - protein, 8 aa, Japanese encephalitis virus
NSKYEVGI

SEQ ID NO: 216614 - protein, 8 aa, Japanese encephalitis virus
SKYEVGIF

SEQ ID NO: 216615 - protein, 8 aa, Japanese encephalitis virus
NYTAQIGA

SEQ ID NO: 216616 - protein, 8 aa, Japanese encephalitis virus
YSAQVGVS

SEQ ID NO: 216617 - protein, 8 aa, Japanese encephalitis virus
SAQVGVSQ

SEQ ID NO: 216618 - protein, 8 aa, Japanese encephalitis virus
AQIGASQA

SEQ ID NO: 216619 - protein, 8 aa, Japanese encephalitis virus
QIGASQAA

SEQ ID NO: 216620 - protein, 8 aa, Japanese encephalitis virus
IGASQAAK

SEQ ID NO: 216621 - protein, 8 aa, Japanese encephalitis virus
GASQAARF

SEQ ID NO: 216622 - protein, 8 aa, Japanese encephalitis virus
VSQAAKFT

SEQ ID NO: 216623 - protein, 8 aa, Japanese encephalitis virus
SQAARFTV

SEQ ID NO: 216624 - protein, 8 aa, Japanese encephalitis virus
QAARFTVT

SEQ ID NO: 216625 - protein, 8 aa, Japanese encephalitis virus
AARFTVTP

SEQ ID NO: 216626 - protein, 8 aa, Japanese encephalitis virus
ARFTVTPN

SEQ ID NO: 216627 - protein, 8 aa, Japanese encephalitis virus
RFTVTPNA

SEQ ID NO: 216628 - protein, 8 aa, Japanese encephalitis virus
ITPNAPSI

SEQ ID NO: 216629 - protein, 8 aa, Japanese encephalitis virus
TPNAPSVA

SEQ ID NO: 216630 - protein, 8 aa, Japanese encephalitis virus
PNAPSVTL

SEQ ID NO: 216631 - protein, 8 aa, Japanese encephalitis virus
NAPSVALK

SEQ ID NO: 216632 - protein, 8 aa, Japanese encephalitis virus
APSVALKL

SEQ ID NO: 216633 - protein, 8 aa, Japanese encephalitis virus
PSVALKLG

SEQ ID NO: 216634 - protein, 8 aa, Japanese encephalitis virus
SVALKLGD

SEQ ID NO: 216635 - protein, 8 aa, Japanese encephalitis virus
TLKLGDFG

SEQ ID NO: 216636 - protein, 8 aa, Japanese encephalitis virus
LELGDYGE

SEQ ID NO: 216637 - protein, 8 aa, Japanese encephalitis virus
ELGDYGEV

SEQ ID NO: 216638 - protein, 8 aa, Japanese encephalitis virus
VTLDCEAR

SEQ ID NO: 216639 - protein, 8 aa, Japanese encephalitis virus
TLDCEARS

SEQ ID NO: 216640 - protein, 8 aa, Japanese encephalitis virus
LDCEARSG

SEQ ID NO: 216641 - protein, 8 aa, Japanese encephalitis virus
DCEPKSGL

SEQ ID NO: 216642 - protein, 8 aa, Japanese encephalitis virus
CEARSGLN

SEQ ID NO: 216643 - protein, 8 aa, Japanese encephalitis virus
EPKSGLNT

SEQ ID NO: 216644 - protein, 8 aa, Japanese encephalitis virus
ARSGLNTE

SEQ ID NO: 216645 - protein, 8 aa, Japanese encephalitis virus
YVMTVGPK

SEQ ID NO: 216646 - protein, 8 aa, Japanese encephalitis virus
VMTVGPKS

SEQ ID NO: 216647 - protein, 8 aa, Japanese encephalitis virus
MTVGPKSF

SEQ ID NO: 216648 - protein, 8 aa, Japanese encephalitis virus
TVGPKSFL

SEQ ID NO: 216649 - protein, 8 aa, Japanese encephalitis virus
VGPKSFLV

SEQ ID NO: 216650 - protein, 8 aa, Japanese encephalitis virus
GPKSFLVH

SEQ ID NO: 216651 - protein, 8 aa, Japanese encephalitis virus
PKSFLVHR

SEQ ID NO: 216652 - protein, 8 aa, Japanese encephalitis virus
KSLLVHRE

SEQ ID NO: 216653 - protein, 8 aa, Japanese encephalitis virus
HDLALPWS

SEQ ID NO: 216654 - protein, 8 aa, Japanese encephalitis virus
DLALPWTP

SEQ ID NO: 216655 - protein, 8 aa, Japanese encephalitis virus
LALPWTPP

SEQ ID NO: 216656 - protein, 8 aa, Japanese encephalitis virus
ALPWTPPS

SEQ ID NO: 216657 - protein, 8 aa, Japanese encephalitis virus
LPWTSSSN

SEQ ID NO: 216658 - protein, 8 aa, Japanese encephalitis virus
PWSSPSST

SEQ ID NO: 216659 - protein, 8 aa, Japanese encephalitis virus
WSSPSSTA

SEQ ID NO: 216660 - protein, 8 aa, Japanese encephalitis virus
SSPSSTAW

SEQ ID NO: 216661 - protein, 8 aa, Japanese encephalitis virus
SSSNTAWR

SEQ ID NO: 216662 - protein, 8 aa, Japanese encephalitis virus
ELLMEFEQ

SEQ ID NO: 216663 - protein, 8 aa, Japanese encephalitis virus
LLMEFEQA

SEQ ID NO: 216664 - protein, 8 aa, Japanese encephalitis virus
LMEFEQAH

SEQ ID NO: 216665 - protein, 8 aa, Japanese encephalitis virus
MEFEQAHA

SEQ ID NO: 216666 - protein, 8 aa, Japanese encephalitis virus
EFEQAHAT

SEQ ID NO: 216667 - protein, 8 aa, Japanese encephalitis virus
FEQAHATK

SEQ ID NO: 216668 - protein, 8 aa, Japanese encephalitis virus
EQAHATKQ

SEQ ID NO: 216669 - protein, 8 aa, Japanese encephalitis virus
QAHATKQS

SEQ ID NO: 216670 - protein, 8 aa, Japanese encephalitis virus
VALGSREG

SEQ ID NO: 216671 - protein, 8 aa, Japanese encephalitis virus
ALGSQEGS

SEQ ID NO: 216672 - protein, 8 aa, Japanese encephalitis virus
LGSQERAL

SEQ ID NO: 216673 - protein, 8 aa, Japanese encephalitis virus
GSQERALH

SEQ ID NO: 216674 - protein, 8 aa, Japanese encephalitis virus
SQEGSLHQ

SEQ ID NO: 216675 - protein, 8 aa, Japanese encephalitis virus
REGGLHQA

SEQ ID NO: 216676 - protein, 8 aa, Japanese encephalitis virus
ERALHQAL

SEQ ID NO: 216677 - protein, 8 aa, Japanese encephalitis virus
GSLHQALA

SEQ ID NO: 216678 - protein, 8 aa, Japanese encephalitis virus
ALHQALAG

SEQ ID NO: 216679 - protein, 8 aa, Japanese encephalitis virus
AIVVEYPS

SEQ ID NO: 216680 - protein, 8 aa, Japanese encephalitis virus
IVVEYPSS

SEQ ID NO: 216681 - protein, 8 aa, Japanese encephalitis virus
VVEYPSSV

SEQ ID NO: 216682 - protein, 8 aa, Japanese encephalitis virus
VEYSNSVK

SEQ ID NO: 216683 - protein, 8 aa, Japanese encephalitis virus
EYPSSVKL

SEQ ID NO: 216684 - protein, 8 aa, Japanese encephalitis virus
YSNSVKLT

SEQ ID NO: 216685 - protein, 8 aa, Japanese encephalitis virus
PSSVKLTS

SEQ ID NO: 216686 - protein, 8 aa, Japanese encephalitis virus
NSVKLTSG

SEQ ID NO: 216687 - protein, 8 aa, Japanese encephalitis virus
VKLTSGHV

SEQ ID NO: 216688 - protein, 8 aa, Japanese encephalitis virus
KLTSGHVK

SEQ ID NO: 216689 - protein, 8 aa, Japanese encephalitis virus
GHLKCRLR

SEQ ID NO: 216690 - protein, 8 aa, Japanese encephalitis virus
HVKRRLKM

SEQ ID NO: 216691 - protein, 8 aa, Japanese encephalitis virus
LKCRLRMD

SEQ ID NO: 216692 - protein, 8 aa, Japanese encephalitis virus
KRRLKMDK

SEQ ID NO: 216693 - protein, 8 aa, Japanese encephalitis virus
CRLRMDKL

SEQ ID NO: 216694 - protein, 8 aa, Japanese encephalitis virus
TTYGMCTK

SEQ ID NO: 216695 - protein, 8 aa, Japanese encephalitis virus
TYGMCTKK

SEQ ID NO: 216696 - protein, 8 aa, Japanese encephalitis virus
YGMCTKKF

SEQ ID NO: 216697 - protein, 8 aa, Japanese encephalitis virus
GMCTKKFS

SEQ ID NO: 216698 - protein, 8 aa, Japanese encephalitis virus
MCTKKFSF

SEQ ID NO: 216699 - protein, 8 aa, Japanese encephalitis virus
CTKKFSFA

SEQ ID NO: 216700 - protein, 8 aa, Japanese encephalitis virus
TKKFSFAK

SEQ ID NO: 216701 - protein, 8 aa, Japanese encephalitis virus
KKFSFAKN

SEQ ID NO: 216702 - protein, 8 aa, Japanese encephalitis virus
SSFRKNPA

SEQ ID NO: 216703 - protein, 8 aa, Japanese encephalitis virus
SFRKNPAD

SEQ ID NO: 216704 - protein, 8 aa, Japanese encephalitis virus
FRKNPADT

SEQ ID NO: 216705 - protein, 8 aa, Japanese encephalitis virus
RKNPADTG

SEQ ID NO: 216706 - protein, 8 aa, Japanese encephalitis virus
GTVVIELL

SEQ ID NO: 216707 - protein, 8 aa, Japanese encephalitis virus
TVVIELLY

SEQ ID NO: 216708 - protein, 8 aa, Japanese encephalitis virus
VVIELLYS

SEQ ID NO: 216709 - protein, 8 aa, Japanese encephalitis virus
VIELLYSG

SEQ ID NO: 216710 - protein, 8 aa, Japanese encephalitis virus
IELLYSGS

SEQ ID NO: 216711 - protein, 8 aa, Japanese encephalitis virus
ELSYSGRD

SEQ ID NO: 216712 - protein, 8 aa, Japanese encephalitis virus
LLYSGSDG

SEQ ID NO: 216713 - protein, 8 aa, Japanese encephalitis virus
SYSGSDGS

SEQ ID NO: 216714 - protein, 8 aa, Japanese encephalitis virus
YSGSDGSC

SEQ ID NO: 216715 - protein, 8 aa, Japanese encephalitis virus
SGSDGSCK

SEQ ID NO: 216716 - protein, 8 aa, Japanese encephalitis virus
GSDGSCKI

SEQ ID NO: 216717 - protein, 8 aa, Japanese encephalitis virus
SDGSCKIP

SEQ ID NO: 216718 - protein, 8 aa, Japanese encephalitis virus
IPIVSVVS

SEQ ID NO: 216719 - protein, 8 aa, Japanese encephalitis virus
PIVSVANL

SEQ ID NO: 216720 - protein, 8 aa, Japanese encephalitis virus
IVSVVSLN

SEQ ID NO: 216721 - protein, 8 aa, Japanese encephalitis virus
VSVANLND

SEQ ID NO: 216722 - protein, 8 aa, Japanese encephalitis virus
SVANLNDM

SEQ ID NO: 216723 - protein, 8 aa, Japanese encephalitis virus
VVSLNDMT

SEQ ID NO: 216724 - protein, 8 aa, Japanese encephalitis virus
ANLNDMTP

SEQ ID NO: 216725 - protein, 8 aa, Japanese encephalitis virus
NLNDMTPV

SEQ ID NO: 216726 - protein, 8 aa, Japanese encephalitis virus
LNDMTPAG

SEQ ID NO: 216727 - protein, 8 aa, Japanese encephalitis virus
NDMTPAGR

SEQ ID NO: 216728 - protein, 8 aa, Japanese encephalitis virus
DMTPAGRL

SEQ ID NO: 216729 - protein, 8 aa, Japanese encephalitis virus
MTPAGRLV

SEQ ID NO: 216730 - protein, 8 aa, Japanese encephalitis virus
PFVAASSA

SEQ ID NO: 216731 - protein, 8 aa, Japanese encephalitis virus
FVAASSAN

SEQ ID NO: 216732 - protein, 8 aa, Japanese encephalitis virus
VAASSANS

SEQ ID NO: 216733 - protein, 8 aa, Japanese encephalitis virus
AASSANSK

SEQ ID NO: 216734 - protein, 8 aa, Japanese encephalitis virus
ASSANSKV

SEQ ID NO: 216735 - protein, 8 aa, Japanese encephalitis virus
SSSNSQVL

SEQ ID NO: 216736 - protein, 8 aa, Japanese encephalitis virus
SSNSKVLL

SEQ ID NO: 216737 - protein, 8 aa, Japanese encephalitis virus
ANSKALVE

SEQ ID NO: 216738 - protein, 8 aa, Japanese encephalitis virus
NSKALVEM

SEQ ID NO: 216739 - protein, 8 aa, Japanese encephalitis virus
SQVLVEME

SEQ ID NO: 216740 - protein, 8 aa, Japanese encephalitis virus
KALVEMEP

SEQ ID NO: 216741 - protein, 8 aa, Japanese encephalitis virus
ALVEMEPP

SEQ ID NO: 216742 - protein, 8 aa, Japanese encephalitis virus
DSYIVVGM

SEQ ID NO: 216743 - protein, 8 aa, Japanese encephalitis virus
SYIVVGRK

SEQ ID NO: 216744 - protein, 8 aa, Japanese encephalitis virus
KQINHHRH

SEQ ID NO: 216745 - protein, 8 aa, Japanese encephalitis virus
QINHHRHK

SEQ ID NO: 216746 - protein, 8 aa, Japanese encephalitis virus
HHWYKAGS

SEQ ID NO: 216747 - protein, 8 aa, Japanese encephalitis virus
HWHKPGST

SEQ ID NO: 216748 - protein, 8 aa, Japanese encephalitis virus
WYKAGSTL

SEQ ID NO: 216749 - protein, 8 aa, Japanese encephalitis virus
YKAGSTLG

SEQ ID NO: 216750 - protein, 8 aa, Japanese encephalitis virus
KPGSTLGK

SEQ ID NO: 216751 - protein, 8 aa, Japanese encephalitis virus
DFGSIGGA

SEQ ID NO: 216752 - protein, 8 aa, Japanese encephalitis virus
FGSIGRVF

SEQ ID NO: 216753 - protein, 8 aa, Japanese encephalitis virus
GSIGRVFN

SEQ ID NO: 216754 - protein, 8 aa, Japanese encephalitis virus
SIGGAFNS

SEQ ID NO: 216755 - protein, 8 aa, Japanese encephalitis virus
IGGAFNSI

SEQ ID NO: 216756 - protein, 8 aa, Japanese encephalitis virus
GGIFNSIG

SEQ ID NO: 216757 - protein, 8 aa, Japanese encephalitis virus
GIFNSIGK

SEQ ID NO: 216758 - protein, 8 aa, Japanese encephalitis virus
AFNSIGKA

SEQ ID NO: 216759 - protein, 8 aa, Japanese encephalitis virus
VLLLWMGI

SEQ ID NO: 216760 - protein, 8 aa, Japanese encephalitis virus
WMGVNARN

SEQ ID NO: 216761 - protein, 8 aa, Japanese encephalitis virus
MGVNARNR

SEQ ID NO: 216762 - protein, 8 aa, Japanese encephalitis virus
GVNARNRS

SEQ ID NO: 216763 - protein, 8 aa, Japanese encephalitis virus
VNARNRSI

SEQ ID NO: 216764 - protein, 8 aa, Japanese encephalitis virus
ARDRSIAM

SEQ ID NO: 216765 - protein, 8 aa, Japanese encephalitis virus
RNRSIALA

SEQ ID NO: 216766 - protein, 8 aa, Japanese encephalitis virus
NRSIALAF

SEQ ID NO: 216767 - protein, 8 aa, Japanese encephalitis virus
DTGCAIDV

SEQ ID NO: 216768 - protein, 8 aa, Japanese encephalitis virus
TGCAIDTT

SEQ ID NO: 216769 - protein, 8 aa, Japanese encephalitis virus
GCAIDTTR

SEQ ID NO: 216770 - protein, 8 aa, Japanese encephalitis virus
ARKEMRCG

SEQ ID NO: 216771 - protein, 8 aa, Japanese encephalitis virus
RNQMRCGS

SEQ ID NO: 216772 - protein, 8 aa, Japanese encephalitis virus
NQMRCGSG

SEQ ID NO: 216773 - protein, 8 aa, Japanese encephalitis virus
YLPETPRA

SEQ ID NO: 216774 - protein, 8 aa, Japanese encephalitis virus
LPETPKSL

SEQ ID NO: 216775 - protein, 8 aa, Japanese encephalitis virus
PETPRALA

SEQ ID NO: 216776 - protein, 8 aa, Japanese encephalitis virus
ETPKSLAK

SEQ ID NO: 216777 - protein, 8 aa, Japanese encephalitis virus
TPKSLAKI

SEQ ID NO: 216778 - protein, 8 aa, Japanese encephalitis virus
PRALAKIV

SEQ ID NO: 216779 - protein, 8 aa, Japanese encephalitis virus
KSLAKIVH

SEQ ID NO: 216780 - protein, 8 aa, Japanese encephalitis virus
KIVHKAHM

SEQ ID NO: 216781 - protein, 8 aa, Japanese encephalitis virus
IVHKAHME

SEQ ID NO: 216782 - protein, 8 aa, Japanese encephalitis virus
VHKAHMEG

SEQ ID NO: 216783 - protein, 8 aa, Japanese encephalitis virus
HKAYKEGV

SEQ ID NO: 216784 - protein, 8 aa, Japanese encephalitis virus
KAYKEGVC

SEQ ID NO: 216785 - protein, 8 aa, Japanese encephalitis virus
AHMEGVCG

SEQ ID NO: 216786 - protein, 8 aa, Japanese encephalitis virus
HMEGICGV

SEQ ID NO: 216787 - protein, 8 aa, Japanese encephalitis virus
MEGICGVR

SEQ ID NO: 216788 - protein, 8 aa, Japanese encephalitis virus
EGICGVRS

SEQ ID NO: 216789 - protein, 8 aa, Japanese encephalitis virus
GICGVRSV

SEQ ID NO: 216790 - protein, 8 aa, Japanese encephalitis virus
VCGIRSVT

SEQ ID NO: 216791 - protein, 8 aa, Japanese encephalitis virus
RSAPKRLF

SEQ ID NO: 216792 - protein, 8 aa, Japanese encephalitis virus
SAPKRLFM

SEQ ID NO: 216793 - protein, 8 aa, Japanese encephalitis virus
TPKRLSMT

SEQ ID NO: 216794 - protein, 8 aa, Japanese encephalitis virus
PKRLFMTQ

SEQ ID NO: 216795 - protein, 8 aa, Japanese encephalitis virus
KRLFMTQE

SEQ ID NO: 216796 - protein, 8 aa, Japanese encephalitis virus
RLSMTREK

SEQ ID NO: 216797 - protein, 8 aa, Japanese encephalitis virus
LSMTREKF

SEQ ID NO: 216798 - protein, 8 aa, Japanese encephalitis virus
SMTREKFE

SEQ ID NO: 216799 - protein, 8 aa, Japanese encephalitis virus
MTREKFEM

SEQ ID NO: 216800 - protein, 8 aa, Japanese encephalitis virus
TQEKVEMG

SEQ ID NO: 216801 - protein, 8 aa, Japanese encephalitis virus
REKFEMGW

SEQ ID NO: 216802 - protein, 8 aa, Japanese encephalitis virus
WKAWGKSL

SEQ ID NO: 216803 - protein, 8 aa, Japanese encephalitis virus
KAWGKSLL

SEQ ID NO: 216804 - protein, 8 aa, Japanese encephalitis virus
AWGKSLLF

SEQ ID NO: 216805 - protein, 8 aa, Japanese encephalitis virus
WGKSLLFA

SEQ ID NO: 216806 - protein, 8 aa, Japanese encephalitis virus
GKSLLFAP

SEQ ID NO: 216807 - protein, 8 aa, Japanese encephalitis virus
KSMLFAPE

SEQ ID NO: 216808 - protein, 8 aa, Japanese encephalitis virus
SMLFAPEL

SEQ ID NO: 216809 - protein, 8 aa, Japanese encephalitis virus
ILFAPEMA

SEQ ID NO: 216810 - protein, 8 aa, Japanese encephalitis virus
APELANSS

SEQ ID NO: 216811 - protein, 8 aa, Japanese encephalitis virus
PELANSSF

SEQ ID NO: 216812 - protein, 8 aa, Japanese encephalitis virus
ELANSSFV

SEQ ID NO: 216813 - protein, 8 aa, Japanese encephalitis virus
LANSSFVV

SEQ ID NO: 216814 - protein, 8 aa, Japanese encephalitis virus
TKECPVVH

SEQ ID NO: 216815 - protein, 8 aa, Japanese encephalitis virus
KECPVVHR

SEQ ID NO: 216816 - protein, 8 aa, Japanese encephalitis virus
ECPVVHRA

SEQ ID NO: 216817 - protein, 8 aa, Japanese encephalitis virus
CPVVHRAW

SEQ ID NO: 216818 - protein, 8 aa, Japanese encephalitis virus
PDEQRAWN

SEQ ID NO: 216819 - protein, 8 aa, Japanese encephalitis virus
VVHRAWNS

SEQ ID NO: 216820 - protein, 8 aa, Japanese encephalitis virus
EQRAWNSM

SEQ ID NO: 216821 - protein, 8 aa, Japanese encephalitis virus
QRAWNSMQ

SEQ ID NO: 216822 - protein, 8 aa, Japanese encephalitis virus
WLKIREET

SEQ ID NO: 216823 - protein, 8 aa, Japanese encephalitis virus
LKIREETT

SEQ ID NO: 216824 - protein, 8 aa, Japanese encephalitis virus
KIREETTD

SEQ ID NO: 216825 - protein, 8 aa, Japanese encephalitis virus
IREETTDE

SEQ ID NO: 216826 - protein, 8 aa, Japanese encephalitis virus
REETTDEC

SEQ ID NO: 216827 - protein, 8 aa, Japanese encephalitis virus
EETTDECD

SEQ ID NO: 216828 - protein, 8 aa, Japanese encephalitis virus
ETTDECDG

SEQ ID NO: 216829 - protein, 8 aa, Japanese encephalitis virus
STDECDGP

SEQ ID NO: 216830 - protein, 8 aa, Japanese encephalitis virus
TDECDGTI

SEQ ID NO: 216831 - protein, 8 aa, Japanese encephalitis virus
DECDGTII

SEQ ID NO: 216832 - protein, 8 aa, Japanese encephalitis virus
ECDGTIIG

SEQ ID NO: 216833 - protein, 8 aa, Japanese encephalitis virus
CDGTIIGT

SEQ ID NO: 216834 - protein, 8 aa, Japanese encephalitis virus
DGTIIGTA

SEQ ID NO: 216835 - protein, 8 aa, Japanese encephalitis virus
GTIIGTAI

SEQ ID NO: 216836 - protein, 8 aa, Japanese encephalitis virus
TIIGTAIK

SEQ ID NO: 216837 - protein, 8 aa, Japanese encephalitis virus
IGTAIKGH

SEQ ID NO: 216838 - protein, 8 aa, Japanese encephalitis virus
GTAIKGHV

SEQ ID NO: 216839 - protein, 8 aa, Japanese encephalitis virus
TAVKGHVT

SEQ ID NO: 216840 - protein, 8 aa, Japanese encephalitis virus
AVKGHVAL

SEQ ID NO: 216841 - protein, 8 aa, Japanese encephalitis virus
VKGHVTVH

SEQ ID NO: 216842 - protein, 8 aa, Japanese encephalitis virus
KGHVALHS

SEQ ID NO: 216843 - protein, 8 aa, Japanese encephalitis virus
GHVTVHSD

SEQ ID NO: 216844 - protein, 8 aa, Japanese encephalitis virus
HVALHSDL

SEQ ID NO: 216845 - protein, 8 aa, Japanese encephalitis virus
VALHSDLS

SEQ ID NO: 216846 - protein, 8 aa, Japanese encephalitis virus
TVHSDVSY

SEQ ID NO: 216847 - protein, 8 aa, Japanese encephalitis virus
VHSDVSYW

SEQ ID NO: 216848 - protein, 8 aa, Japanese encephalitis virus
SDVSYWIE

SEQ ID NO: 216849 - protein, 8 aa, Japanese encephalitis virus
DVSYWIES

SEQ ID NO: 216850 - protein, 8 aa, Japanese encephalitis virus
VSYWIESR

SEQ ID NO: 216851 - protein, 8 aa, Japanese encephalitis virus
SYWIESRF

SEQ ID NO: 216852 - protein, 8 aa, Japanese encephalitis virus
YWIESRFN

SEQ ID NO: 216853 - protein, 8 aa, Japanese encephalitis virus
WIESRFND

SEQ ID NO: 216854 - protein, 8 aa, Japanese encephalitis virus
NDTWKRER

SEQ ID NO: 216855 - protein, 8 aa, Japanese encephalitis virus
DTRKLERA

SEQ ID NO: 216856 - protein, 8 aa, Japanese encephalitis virus
TWKLERLV

SEQ ID NO: 216857 - protein, 8 aa, Japanese encephalitis virus
RKLERAVF

SEQ ID NO: 216858 - protein, 8 aa, Japanese encephalitis virus
KLERLVFG

SEQ ID NO: 216859 - protein, 8 aa, Japanese encephalitis virus
LERLVFGE

SEQ ID NO: 216860 - protein, 8 aa, Japanese encephalitis virus
ERLVFGEV

SEQ ID NO: 216861 - protein, 8 aa, Japanese encephalitis virus
RLVFGEVK

SEQ ID NO: 216862 - protein, 8 aa, Japanese encephalitis virus
AVFEEVKS

SEQ ID NO: 216863 - protein, 8 aa, Japanese encephalitis virus
VFEEVKSC

SEQ ID NO: 216864 - protein, 8 aa, Japanese encephalitis virus
FEEVKSCT

SEQ ID NO: 216865 - protein, 8 aa, Japanese encephalitis virus
EEVKSCTW

SEQ ID NO: 216866 - protein, 8 aa, Japanese encephalitis virus
THSLWGDG

SEQ ID NO: 216867 - protein, 8 aa, Japanese encephalitis virus
HSLWGDGV

SEQ ID NO: 216868 - protein, 8 aa, Japanese encephalitis virus
SLWGDGVE

SEQ ID NO: 216869 - protein, 8 aa, Japanese encephalitis virus
LWGDDAEE

SEQ ID NO: 216870 - protein, 8 aa, Japanese encephalitis virus
WGDDAEES

SEQ ID NO: 216871 - protein, 8 aa, Japanese encephalitis virus
GDGVEESD

SEQ ID NO: 216872 - protein, 8 aa, Japanese encephalitis virus
DDAEESEL

SEQ ID NO: 216873 - protein, 8 aa, Japanese encephalitis virus
DAEESELI

SEQ ID NO: 216874 - protein, 8 aa, Japanese encephalitis virus
AEESELII

SEQ ID NO: 216875 - protein, 8 aa, Japanese encephalitis virus
ESELIIPD

SEQ ID NO: 216876 - protein, 8 aa, Japanese encephalitis virus
SELIIPDT

SEQ ID NO: 216877 - protein, 8 aa, Japanese encephalitis virus
ELIIPDTI

SEQ ID NO: 216878 - protein, 8 aa, Japanese encephalitis virus
LIIPDTIA

SEQ ID NO: 216879 - protein, 8 aa, Japanese encephalitis virus
IIPDTIAG

SEQ ID NO: 216880 - protein, 8 aa, Japanese encephalitis virus
IPDTIAGP

SEQ ID NO: 216881 - protein, 8 aa, Japanese encephalitis virus
PHTLAGPK

SEQ ID NO: 216882 - protein, 8 aa, Japanese encephalitis virus
HTLAGPKS

SEQ ID NO: 216883 - protein, 8 aa, Japanese encephalitis virus
TLAGPKSK

SEQ ID NO: 216884 - protein, 8 aa, Japanese encephalitis virus
LAGPKSKH

SEQ ID NO: 216885 - protein, 8 aa, Japanese encephalitis virus
GPKSKHNQ

SEQ ID NO: 216886 - protein, 8 aa, Japanese encephalitis virus
PKSKHNQR

SEQ ID NO: 216887 - protein, 8 aa, Japanese encephalitis virus
KSKHNQRE

SEQ ID NO: 216888 - protein, 8 aa, Japanese encephalitis virus
HNRREGYM

SEQ ID NO: 216889 - protein, 8 aa, Japanese encephalitis virus
NRREGYMT

SEQ ID NO: 216890 - protein, 8 aa, Japanese encephalitis virus
QREGYKTQ

SEQ ID NO: 216891 - protein, 8 aa, Japanese encephalitis virus
REGYMTQN

SEQ ID NO: 216892 - protein, 8 aa, Japanese encephalitis virus
EGYMTQNQ

SEQ ID NO: 216893 - protein, 8 aa, Japanese encephalitis virus
GYMTQNQG

SEQ ID NO: 216894 - protein, 8 aa, Japanese encephalitis virus
YMTQNQGP

SEQ ID NO: 216895 - protein, 8 aa, Japanese encephalitis virus
MTQNQGPW

SEQ ID NO: 216896 - protein, 8 aa, Japanese encephalitis virus
NQGPWDED

SEQ ID NO: 216897 - protein, 8 aa, Japanese encephalitis virus
QGPWDEKG

SEQ ID NO: 216898 - protein, 8 aa, Japanese encephalitis virus
GPWDESGI

SEQ ID NO: 216899 - protein, 8 aa, Japanese encephalitis virus
PWDEDGIV

SEQ ID NO: 216900 - protein, 8 aa, Japanese encephalitis virus
WDESGIVL

SEQ ID NO: 216901 - protein, 8 aa, Japanese encephalitis virus
DESGIVLD

SEQ ID NO: 216902 - protein, 8 aa, Japanese encephalitis virus
ENGLVPGL

SEQ ID NO: 216903 - protein, 8 aa, Japanese encephalitis virus
SGIVLDFD

SEQ ID NO: 216904 - protein, 8 aa, Japanese encephalitis virus
FDYCPGTT

SEQ ID NO: 216905 - protein, 8 aa, Japanese encephalitis virus
TEDCGKRA

SEQ ID NO: 216906 - protein, 8 aa, Japanese encephalitis virus
EDCGKRAP

SEQ ID NO: 216907 - protein, 8 aa, Japanese encephalitis virus
DCGKRAPW

SEQ ID NO: 216908 - protein, 8 aa, Japanese encephalitis virus
CSKRGPSV

SEQ ID NO: 216909 - protein, 8 aa, Japanese encephalitis virus
SKRGPSVR

SEQ ID NO: 216910 - protein, 8 aa, Japanese encephalitis virus
KRAPWVRT

SEQ ID NO: 216911 - protein, 8 aa, Japanese encephalitis virus
RAPWVRTT

SEQ ID NO: 216912 - protein, 8 aa, Japanese encephalitis virus
APWVRTTT

SEQ ID NO: 216913 - protein, 8 aa, Japanese encephalitis virus
PSLRTTTD

SEQ ID NO: 216914 - protein, 8 aa, Japanese encephalitis virus
WVRTTTDI

SEQ ID NO: 216915 - protein, 8 aa, Japanese encephalitis virus
VRTTTDIG

SEQ ID NO: 216916 - protein, 8 aa, Japanese encephalitis virus
DWCCRSCT

SEQ ID NO: 216917 - protein, 8 aa, Japanese encephalitis virus
WCCRNCSL

SEQ ID NO: 216918 - protein, 8 aa, Japanese encephalitis virus
CCRSCTLP

SEQ ID NO: 216919 - protein, 8 aa, Japanese encephalitis virus
CRNCSLPP

SEQ ID NO: 216920 - protein, 8 aa, Japanese encephalitis virus
RSCTLPPL

SEQ ID NO: 216921 - protein, 8 aa, Japanese encephalitis virus
NCSLPPLR

SEQ ID NO: 216922 - protein, 8 aa, Japanese encephalitis virus
CTLPPLRF

SEQ ID NO: 216923 - protein, 8 aa, Japanese encephalitis virus
TLPPLRFR

SEQ ID NO: 216924 - protein, 8 aa, Japanese encephalitis virus
PPLRFRTG

SEQ ID NO: 216925 - protein, 8 aa, Japanese encephalitis virus
PLRFRTGS

SEQ ID NO: 216926 - protein, 8 aa, Japanese encephalitis virus
LRFRTDNG

SEQ ID NO: 216927 - protein, 8 aa, Japanese encephalitis virus
RFRTDNGC

SEQ ID NO: 216928 - protein, 8 aa, Japanese encephalitis virus
FRTDNGCW

SEQ ID NO: 216929 - protein, 8 aa, Japanese encephalitis virus
RTGSGCWY

SEQ ID NO: 216930 - protein, 8 aa, Japanese encephalitis virus
TDNGCWYG

SEQ ID NO: 216931 - protein, 8 aa, Japanese encephalitis virus
DNGCWYGM

SEQ ID NO: 216932 - protein, 8 aa, Japanese encephalitis virus
YGMEIRPA

SEQ ID NO: 216933 - protein, 8 aa, Japanese encephalitis virus
MHDETTLV

SEQ ID NO: 216934 - protein, 8 aa, Japanese encephalitis virus
DETTLVRW

SEQ ID NO: 216935 - protein, 8 aa, Japanese encephalitis virus
ETTLVRSR

SEQ ID NO: 216936 - protein, 8 aa, Japanese encephalitis virus
ATLVRSQA

SEQ ID NO: 216937 - protein, 8 aa, Japanese encephalitis virus
TLVRSQAD

SEQ ID NO: 216938 - protein, 8 aa, Japanese encephalitis virus
LVRSRVDA

SEQ ID NO: 216939 - protein, 8 aa, Japanese encephalitis virus
KGEMVDPF

SEQ ID NO: 216940 - protein, 8 aa, Japanese encephalitis virus
GGMVDPFQ

SEQ ID NO: 216941 - protein, 8 aa, Japanese encephalitis virus
EMVDPFQM

SEQ ID NO: 216942 - protein, 8 aa, Japanese encephalitis virus
MVDPFQMG

SEQ ID NO: 216943 - protein, 8 aa, Japanese encephalitis virus
VDPFQMGL

SEQ ID NO: 216944 - protein, 8 aa, Japanese encephalitis virus
FQMGLLVM

SEQ ID NO: 216945 - protein, 8 aa, Japanese encephalitis virus
QMGLLVMF

SEQ ID NO: 216946 - protein, 8 aa, Japanese encephalitis virus
MGLLVMFL

SEQ ID NO: 216947 - protein, 8 aa, Japanese encephalitis virus
LATQEVFR

SEQ ID NO: 216948 - protein, 8 aa, Japanese encephalitis virus
ATQEVFRK

SEQ ID NO: 216949 - protein, 8 aa, Japanese encephalitis virus
TQEVFRKR

SEQ ID NO: 216950 - protein, 8 aa, Japanese encephalitis virus
QEVLGKRW

SEQ ID NO: 216951 - protein, 8 aa, Japanese encephalitis virus
EVFRKRWT

SEQ ID NO: 216952 - protein, 8 aa, Japanese encephalitis virus
VLGKRWTA

SEQ ID NO: 216953 - protein, 8 aa, Japanese encephalitis virus
FRKRWTAR

SEQ ID NO: 216954 - protein, 8 aa, Japanese encephalitis virus
TVPAVLGA

SEQ ID NO: 216955 - protein, 8 aa, Japanese encephalitis virus
VPAVLGAL

SEQ ID NO: 216956 - protein, 8 aa, Japanese encephalitis virus
GALLVLMF

SEQ ID NO: 216957 - protein, 8 aa, Japanese encephalitis virus
ALLVLMFG

SEQ ID NO: 216958 - protein, 8 aa, Japanese encephalitis virus
MFGGITYT

SEQ ID NO: 216959 - protein, 8 aa, Japanese encephalitis virus
FGGITYTD

SEQ ID NO: 216960 - protein, 8 aa, Japanese encephalitis virus
YVVLVAAS

SEQ ID NO: 216961 - protein, 8 aa, Japanese encephalitis virus
VVLVAAVF

SEQ ID NO: 216962 - protein, 8 aa, Japanese encephalitis virus
VLVAASFA

SEQ ID NO: 216963 - protein, 8 aa, Japanese encephalitis virus
LVAAVFAE

SEQ ID NO: 216964 - protein, 8 aa, Japanese encephalitis virus
VAASFAEA

SEQ ID NO: 216965 - protein, 8 aa, Japanese encephalitis virus
AASFAEAN

SEQ ID NO: 216966 - protein, 8 aa, Japanese encephalitis virus
ASFAEANS

SEQ ID NO: 216967 - protein, 8 aa, Japanese encephalitis virus
SFAEANSG

SEQ ID NO: 216968 - protein, 8 aa, Japanese encephalitis virus
IQPAFLVA

SEQ ID NO: 216969 - protein, 8 aa, Japanese encephalitis virus
QPAFLAMN

SEQ ID NO: 216970 - protein, 8 aa, Japanese encephalitis virus
PAFLAMKM

SEQ ID NO: 216971 - protein, 8 aa, Japanese encephalitis virus
AFLVANML

SEQ ID NO: 216972 - protein, 8 aa, Japanese encephalitis virus
FLAMNTLS

SEQ ID NO: 216973 - protein, 8 aa, Japanese encephalitis virus
LVANMLST

SEQ ID NO: 216974 - protein, 8 aa, Japanese encephalitis virus
NTLSTRWT

SEQ ID NO: 216975 - protein, 8 aa, Japanese encephalitis virus
MLSAKWTN

SEQ ID NO: 216976 - protein, 8 aa, Japanese encephalitis virus
LSAKWTNQ

SEQ ID NO: 216977 - protein, 8 aa, Japanese encephalitis virus
SAKWTNQE

SEQ ID NO: 216978 - protein, 8 aa, Japanese encephalitis virus
AKWTNQEN

SEQ ID NO: 216979 - protein, 8 aa, Japanese encephalitis virus
WTNQENVI

SEQ ID NO: 216980 - protein, 8 aa, Japanese encephalitis virus
TNQENMVL

SEQ ID NO: 216981 - protein, 8 aa, Japanese encephalitis virus
NQENMVLV

SEQ ID NO: 216982 - protein, 8 aa, Japanese encephalitis virus
QENVILVL

SEQ ID NO: 216983 - protein, 8 aa, Japanese encephalitis virus
ENMVLVLG

SEQ ID NO: 216984 - protein, 8 aa, Japanese encephalitis virus
NMVLVLGA

SEQ ID NO: 216985 - protein, 8 aa, Japanese encephalitis virus
MVLVLGAA

SEQ ID NO: 216986 - protein, 8 aa, Japanese encephalitis virus
VLVLGAAL

SEQ ID NO: 216987 - protein, 8 aa, Japanese encephalitis virus
ALFQLASV

SEQ ID NO: 216988 - protein, 8 aa, Japanese encephalitis virus
LFQLASVD

SEQ ID NO: 216989 - protein, 8 aa, Japanese encephalitis virus
FQLASMDL

SEQ ID NO: 216990 - protein, 8 aa, Japanese encephalitis virus
QLASMDLQ

SEQ ID NO: 216991 - protein, 8 aa, Japanese encephalitis virus
LASMDLQI

SEQ ID NO: 216992 - protein, 8 aa, Japanese encephalitis virus
ASMDLQIG

SEQ ID NO: 216993 - protein, 8 aa, Japanese encephalitis virus
SMDLQIGV

SEQ ID NO: 216994 - protein, 8 aa, Japanese encephalitis virus
MDLQIGVH

SEQ ID NO: 216995 - protein, 8 aa, Japanese encephalitis virus
GILNAAAM

SEQ ID NO: 216996 - protein, 8 aa, Japanese encephalitis virus
ILNAAAMA

SEQ ID NO: 216997 - protein, 8 aa, Japanese encephalitis virus
AAIAWMII

SEQ ID NO: 216998 - protein, 8 aa, Japanese encephalitis virus
AMAWMIVR

SEQ ID NO: 216999 - protein, 8 aa, Japanese encephalitis virus
MAWMIVRA

SEQ ID NO: 217000 - protein, 8 aa, Japanese encephalitis virus
KAITFPTT

SEQ ID NO: 217001 - protein, 8 aa, Japanese encephalitis virus
ITFPTASS

SEQ ID NO: 217002 - protein, 8 aa, Japanese encephalitis virus
TFPTASSV

SEQ ID NO: 217003 - protein, 8 aa, Japanese encephalitis virus
FPTASSVT

SEQ ID NO: 217004 - protein, 8 aa, Japanese encephalitis virus
PTASSVTM

SEQ ID NO: 217005 - protein, 8 aa, Japanese encephalitis virus
TASSVTMP

SEQ ID NO: 217006 - protein, 8 aa, Japanese encephalitis virus
MPVLTLLT

SEQ ID NO: 217007 - protein, 8 aa, Japanese encephalitis virus
PLLALLAP

SEQ ID NO: 217008 - protein, 8 aa, Japanese encephalitis virus
VLTLLTPG

SEQ ID NO: 217009 - protein, 8 aa, Japanese encephalitis virus
LALLAPGM

SEQ ID NO: 217010 - protein, 8 aa, Japanese encephalitis virus
ALLTPGMK

SEQ ID NO: 217011 - protein, 8 aa, Japanese encephalitis virus
LLAPGMRA

SEQ ID NO: 217012 - protein, 8 aa, Japanese encephalitis virus
LTPGMKAL

SEQ ID NO: 217013 - protein, 8 aa, Japanese encephalitis virus
TPGMRALC

SEQ ID NO: 217014 - protein, 8 aa, Japanese encephalitis virus
PGMKALYL

SEQ ID NO: 217015 - protein, 8 aa, Japanese encephalitis virus
GMRALCLD

SEQ ID NO: 217016 - protein, 8 aa, Japanese encephalitis virus
MRALCLDT

SEQ ID NO: 217017 - protein, 8 aa, Japanese encephalitis virus
RAFDLDTY

SEQ ID NO: 217018 - protein, 8 aa, Japanese encephalitis virus
AFDLDTYR

SEQ ID NO: 217019 - protein, 8 aa, Japanese encephalitis virus
LCLDTYRI

SEQ ID NO: 217020 - protein, 8 aa, Japanese encephalitis virus
DLDTYRII

SEQ ID NO: 217021 - protein, 8 aa, Japanese encephalitis virus
IILLIIGV

SEQ ID NO: 217022 - protein, 8 aa, Japanese encephalitis virus
ILLIIGVC

SEQ ID NO: 217023 - protein, 8 aa, Japanese encephalitis virus
LLIIGVCS

SEQ ID NO: 217024 - protein, 8 aa, Japanese encephalitis virus
LIIGVCSL

SEQ ID NO: 217025 - protein, 8 aa, Japanese encephalitis virus
IIGVCSLL

SEQ ID NO: 217026 - protein, 8 aa, Japanese encephalitis virus
IGVCSLLQ

SEQ ID NO: 217027 - protein, 8 aa, Japanese encephalitis virus
GVCSLLQE

SEQ ID NO: 217028 - protein, 8 aa, Japanese encephalitis virus
VCSLLQER

SEQ ID NO: 217029 - protein, 8 aa, Japanese encephalitis virus
CSLLHERK

SEQ ID NO: 217030 - protein, 8 aa, Japanese encephalitis virus
ERKKAMAK

SEQ ID NO: 217031 - protein, 8 aa, Japanese encephalitis virus
RKKAMAKK

SEQ ID NO: 217032 - protein, 8 aa, Japanese encephalitis virus
KKAMAKKK

SEQ ID NO: 217033 - protein, 8 aa, Japanese encephalitis virus
RTMAKKKG

SEQ ID NO: 217034 - protein, 8 aa, Japanese encephalitis virus
TITAGLMV

SEQ ID NO: 217035 - protein, 8 aa, Japanese encephalitis virus
ITAGLMVC

SEQ ID NO: 217036 - protein, 8 aa, Japanese encephalitis virus
AAGLMACN

SEQ ID NO: 217037 - protein, 8 aa, Japanese encephalitis virus
ATEVLSAV

SEQ ID NO: 217038 - protein, 8 aa, Japanese encephalitis virus
TEVLSAVG

SEQ ID NO: 217039 - protein, 8 aa, Japanese encephalitis virus
EVLSAVGL

SEQ ID NO: 217040 - protein, 8 aa, Japanese encephalitis virus
VLSAVGLM

SEQ ID NO: 217041 - protein, 8 aa, Japanese encephalitis virus
ATDMWLEQ

SEQ ID NO: 217042 - protein, 8 aa, Japanese encephalitis virus
TDMWLEQA

SEQ ID NO: 217043 - protein, 8 aa, Japanese encephalitis virus
DMWLEQAA

SEQ ID NO: 217044 - protein, 8 aa, Japanese encephalitis virus
MWLEQAAD

SEQ ID NO: 217045 - protein, 8 aa, Japanese encephalitis virus
WLEQAADI

SEQ ID NO: 217046 - protein, 8 aa, Japanese encephalitis virus
LERAADVS

SEQ ID NO: 217047 - protein, 8 aa, Japanese encephalitis virus
ERAADVSW

SEQ ID NO: 217048 - protein, 8 aa, Japanese encephalitis virus
QAADISWE

SEQ ID NO: 217049 - protein, 8 aa, Japanese encephalitis virus
AADISWGM

SEQ ID NO: 217050 - protein, 8 aa, Japanese encephalitis virus
SWDMGAAI

SEQ ID NO: 217051 - protein, 8 aa, Japanese encephalitis virus
WDMGAAIT

SEQ ID NO: 217052 - protein, 8 aa, Japanese encephalitis virus
DMGAAITG

SEQ ID NO: 217053 - protein, 8 aa, Japanese encephalitis virus
MGAAITGS

SEQ ID NO: 217054 - protein, 8 aa, Japanese encephalitis virus
GAAITGSS

SEQ ID NO: 217055 - protein, 8 aa, Japanese encephalitis virus
DDDGDFHF

SEQ ID NO: 217056 - protein, 8 aa, Japanese encephalitis virus
DDGDFHFI

SEQ ID NO: 217057 - protein, 8 aa, Japanese encephalitis virus
GDFHFIDD

SEQ ID NO: 217058 - protein, 8 aa, Japanese encephalitis virus
DFHFIDDP

SEQ ID NO: 217059 - protein, 8 aa, Japanese encephalitis virus
FHLIDVPG

SEQ ID NO: 217060 - protein, 8 aa, Japanese encephalitis virus
HFIDDPGV

SEQ ID NO: 217061 - protein, 8 aa, Japanese encephalitis virus
FIDDPGVP

SEQ ID NO: 217062 - protein, 8 aa, Japanese encephalitis virus
VPGVPWKV

SEQ ID NO: 217063 - protein, 8 aa, Japanese encephalitis virus
GVPWKIWL

SEQ ID NO: 217064 - protein, 8 aa, Japanese encephalitis virus
VPWKIWLL

SEQ ID NO: 217065 - protein, 8 aa, Japanese encephalitis virus
PWKIWLLR

SEQ ID NO: 217066 - protein, 8 aa, Japanese encephalitis virus
WKIWLLRM

SEQ ID NO: 217067 - protein, 8 aa, Japanese encephalitis virus
KVWVLRTS

SEQ ID NO: 217068 - protein, 8 aa, Japanese encephalitis virus
IWLLRMSC

SEQ ID NO: 217069 - protein, 8 aa, Japanese encephalitis virus
WVLRMSCS

SEQ ID NO: 217070 - protein, 8 aa, Japanese encephalitis virus
VLRMSCIC

SEQ ID NO: 217071 - protein, 8 aa, Japanese encephalitis virus
LRMSCICL

SEQ ID NO: 217072 - protein, 8 aa, Japanese encephalitis virus
RMSCIGLV

SEQ ID NO: 217073 - protein, 8 aa, Japanese encephalitis virus
TSCIGLAA

SEQ ID NO: 217074 - protein, 8 aa, Japanese encephalitis virus
SCIGLVAL

SEQ ID NO: 217075 - protein, 8 aa, Japanese encephalitis virus
CICLAALT

SEQ ID NO: 217076 - protein, 8 aa, Japanese encephalitis virus
IGLVALTP

SEQ ID NO: 217077 - protein, 8 aa, Japanese encephalitis virus
GLVALTPW

SEQ ID NO: 217078 - protein, 8 aa, Japanese encephalitis virus
TPSPKPCA

SEQ ID NO: 217079 - protein, 8 aa, Japanese encephalitis virus
PSPKPCAK

SEQ ID NO: 217080 - protein, 8 aa, Japanese encephalitis virus
SPKPCAKG

SEQ ID NO: 217081 - protein, 8 aa, Japanese encephalitis virus
PKPCAKGD

SEQ ID NO: 217082 - protein, 8 aa, Japanese encephalitis virus
KPCAKGDT

SEQ ID NO: 217083 - protein, 8 aa, Japanese encephalitis virus
PCAKGDTT

SEQ ID NO: 217084 - protein, 8 aa, Japanese encephalitis virus
CAKGDTTT

SEQ ID NO: 217085 - protein, 8 aa, Japanese encephalitis virus
AKGDTTTG

SEQ ID NO: 217086 - protein, 8 aa, Japanese encephalitis virus
RIMARGIF

SEQ ID NO: 217087 - protein, 8 aa, Japanese encephalitis virus
IMARGIFG

SEQ ID NO: 217088 - protein, 8 aa, Japanese encephalitis virus
MARGIFGT

SEQ ID NO: 217089 - protein, 8 aa, Japanese encephalitis virus
ARGIFGTH

SEQ ID NO: 217090 - protein, 8 aa, Japanese encephalitis virus
CGILGTYQ

SEQ ID NO: 217091 - protein, 8 aa, Japanese encephalitis virus
GIFGTHQA

SEQ ID NO: 217092 - protein, 8 aa, Japanese encephalitis virus
ILGTYQSG

SEQ ID NO: 217093 - protein, 8 aa, Japanese encephalitis virus
FGTHQAGV

SEQ ID NO: 217094 - protein, 8 aa, Japanese encephalitis virus
GTYQSGVG

SEQ ID NO: 217095 - protein, 8 aa, Japanese encephalitis virus
THQAGVGV

SEQ ID NO: 217096 - protein, 8 aa, Japanese encephalitis virus
YQSGVGVI

SEQ ID NO: 217097 - protein, 8 aa, Japanese encephalitis virus
AGVGVMYQ

SEQ ID NO: 217098 - protein, 8 aa, Japanese encephalitis virus
GVGVMYQN

SEQ ID NO: 217099 - protein, 8 aa, Japanese encephalitis virus
VGVMYESV

SEQ ID NO: 217100 - protein, 8 aa, Japanese encephalitis virus
GVMYENVL

SEQ ID NO: 217101 - protein, 8 aa, Japanese encephalitis virus
VIYENVFH

SEQ ID NO: 217102 - protein, 8 aa, Japanese encephalitis virus
IYENVFHT

SEQ ID NO: 217103 - protein, 8 aa, Japanese encephalitis virus
YENVLHTL

SEQ ID NO: 217104 - protein, 8 aa, Japanese encephalitis virus
QNVFHTLW

SEQ ID NO: 217105 - protein, 8 aa, Japanese encephalitis virus
NVLHTLWH

SEQ ID NO: 217106 - protein, 8 aa, Japanese encephalitis virus
VLHTLWHT

SEQ ID NO: 217107 - protein, 8 aa, Japanese encephalitis virus
LHTLWHTT

SEQ ID NO: 217108 - protein, 8 aa, Japanese encephalitis virus
HPTRGAAI

SEQ ID NO: 217109 - protein, 8 aa, Japanese encephalitis virus
TTRGAAVM

SEQ ID NO: 217110 - protein, 8 aa, Japanese encephalitis virus
TRGAAVMS

SEQ ID NO: 217111 - protein, 8 aa, Japanese encephalitis virus
RGAAVMSG

SEQ ID NO: 217112 - protein, 8 aa, Japanese encephalitis virus
GAAVMSGE

SEQ ID NO: 217113 - protein, 8 aa, Japanese encephalitis virus
AAVMSGEG

SEQ ID NO: 217114 - protein, 8 aa, Japanese encephalitis virus
AVMSGEGK

SEQ ID NO: 217115 - protein, 8 aa, Japanese encephalitis virus
VMSGEGKL

SEQ ID NO: 217116 - protein, 8 aa, Japanese encephalitis virus
MSGGGKLT

SEQ ID NO: 217117 - protein, 8 aa, Japanese encephalitis virus
SGKGKLTP

SEQ ID NO: 217118 - protein, 8 aa, Japanese encephalitis virus
GGGKLTPY

SEQ ID NO: 217119 - protein, 8 aa, Japanese encephalitis virus
KGKLTPYW

SEQ ID NO: 217120 - protein, 8 aa, Japanese encephalitis virus
SVREDRIA

SEQ ID NO: 217121 - protein, 8 aa, Japanese encephalitis virus
VREDRIAY

SEQ ID NO: 217122 - protein, 8 aa, Japanese encephalitis virus
REDRIAYG

SEQ ID NO: 217123 - protein, 8 aa, Japanese encephalitis virus
IVVEPGKG

SEQ ID NO: 217124 - protein, 8 aa, Japanese encephalitis virus
VVEPGKGA

SEQ ID NO: 217125 - protein, 8 aa, Japanese encephalitis virus
AVSIQTKP

SEQ ID NO: 217126 - protein, 8 aa, Japanese encephalitis virus
ANIQTKPG

SEQ ID NO: 217127 - protein, 8 aa, Japanese encephalitis virus
NFQTKPGV

SEQ ID NO: 217128 - protein, 8 aa, Japanese encephalitis virus
FQTKPGVF

SEQ ID NO: 217129 - protein, 8 aa, Japanese encephalitis virus
QTKPGVFC

SEQ ID NO: 217130 - protein, 8 aa, Japanese encephalitis virus
TKPGIFPT

SEQ ID NO: 217131 - protein, 8 aa, Japanese encephalitis virus
KPGVFCTP

SEQ ID NO: 217132 - protein, 8 aa, Japanese encephalitis virus
PGVFCTPF

SEQ ID NO: 217133 - protein, 8 aa, Japanese encephalitis virus
GVFCTPFG

SEQ ID NO: 217134 - protein, 8 aa, Japanese encephalitis virus
PLGEVGAV

SEQ ID NO: 217135 - protein, 8 aa, Japanese encephalitis virus
FGKVGTVS

SEQ ID NO: 217136 - protein, 8 aa, Japanese encephalitis virus
GKVGAVSL

SEQ ID NO: 217137 - protein, 8 aa, Japanese encephalitis virus
KVGTVSLD

SEQ ID NO: 217138 - protein, 8 aa, Japanese encephalitis virus
VGTVSLDY

SEQ ID NO: 217139 - protein, 8 aa, Japanese encephalitis virus
SGSPILDF

SEQ ID NO: 217140 - protein, 8 aa, Japanese encephalitis virus
GSPILNSN

SEQ ID NO: 217141 - protein, 8 aa, Japanese encephalitis virus
SPILNSNG

SEQ ID NO: 217142 - protein, 8 aa, Japanese encephalitis virus
PILNSNGD

SEQ ID NO: 217143 - protein, 8 aa, Japanese encephalitis virus
ILDFNGDI

SEQ ID NO: 217144 - protein, 8 aa, Japanese encephalitis virus
LNSNGDVV

SEQ ID NO: 217145 - protein, 8 aa, Japanese encephalitis virus
DFNGDIIG

SEQ ID NO: 217146 - protein, 8 aa, Japanese encephalitis virus
FNGDIIGL

SEQ ID NO: 217147 - protein, 8 aa, Japanese encephalitis virus
VGCLGNGV

SEQ ID NO: 217148 - protein, 8 aa, Japanese encephalitis virus
GCLGNGVE

SEQ ID NO: 217149 - protein, 8 aa, Japanese encephalitis virus
LYGNGGEL

SEQ ID NO: 217150 - protein, 8 aa, Japanese encephalitis virus
LGNGVELG

SEQ ID NO: 217151 - protein, 8 aa, Japanese encephalitis virus
NGVELGDR

SEQ ID NO: 217152 - protein, 8 aa, Japanese encephalitis virus
GGELGDGS

SEQ ID NO: 217153 - protein, 8 aa, Japanese encephalitis virus
VELGDRSY

SEQ ID NO: 217154 - protein, 8 aa, Japanese encephalitis virus
GDRQEEPI

SEQ ID NO: 217155 - protein, 8 aa, Japanese encephalitis virus
DRQEEPIP

SEQ ID NO: 217156 - protein, 8 aa, Japanese encephalitis virus
RQEEPIPE

SEQ ID NO: 217157 - protein, 8 aa, Japanese encephalitis virus
QEEPIPEA

SEQ ID NO: 217158 - protein, 8 aa, Japanese encephalitis virus
EEPIPEAY

SEQ ID NO: 217159 - protein, 8 aa, Japanese encephalitis virus
EPIPEAYN

SEQ ID NO: 217160 - protein, 8 aa, Japanese encephalitis virus
PIPEAYNP

SEQ ID NO: 217161 - protein, 8 aa, Japanese encephalitis virus
VPEAYTPS

SEQ ID NO: 217162 - protein, 8 aa, Japanese encephalitis virus
PEAYTPTM

SEQ ID NO: 217163 - protein, 8 aa, Japanese encephalitis virus
EAYNPSML

SEQ ID NO: 217164 - protein, 8 aa, Japanese encephalitis virus
AYNPSMLK

SEQ ID NO: 217165 - protein, 8 aa, Japanese encephalitis virus
YTPNMLKK

SEQ ID NO: 217166 - protein, 8 aa, Japanese encephalitis virus
PNMLKKRQ

SEQ ID NO: 217167 - protein, 8 aa, Japanese encephalitis virus
MLRKRQLT

SEQ ID NO: 217168 - protein, 8 aa, Japanese encephalitis virus
LRKRQLTV

SEQ ID NO: 217169 - protein, 8 aa, Japanese encephalitis virus
RKRQLTVL

SEQ ID NO: 217170 - protein, 8 aa, Japanese encephalitis virus
KKQMTVLD

SEQ ID NO: 217171 - protein, 8 aa, Japanese encephalitis virus
KQMTVLDL

SEQ ID NO: 217172 - protein, 8 aa, Japanese encephalitis virus
QMTVLDLP

SEQ ID NO: 217173 - protein, 8 aa, Japanese encephalitis virus
MTVLDLPP

SEQ ID NO: 217174 - protein, 8 aa, Japanese encephalitis virus
VLDLPPGS

SEQ ID NO: 217175 - protein, 8 aa, Japanese encephalitis virus
LDLPPGSG

SEQ ID NO: 217176 - protein, 8 aa, Japanese encephalitis virus
DLPPGSGK

SEQ ID NO: 217177 - protein, 8 aa, Japanese encephalitis virus
LPPGSGKT

SEQ ID NO: 217178 - protein, 8 aa, Japanese encephalitis virus
PPGSGKTR

SEQ ID NO: 217179 - protein, 8 aa, Japanese encephalitis virus
PGLGKTRK

SEQ ID NO: 217180 - protein, 8 aa, Japanese encephalitis virus
GLGKTRKI

SEQ ID NO: 217181 - protein, 8 aa, Japanese encephalitis virus
LGKTRKIL

SEQ ID NO: 217182 - protein, 8 aa, Japanese encephalitis virus
TRKILPQT

SEQ ID NO: 217183 - protein, 8 aa, Japanese encephalitis virus
RKILPQTI

SEQ ID NO: 217184 - protein, 8 aa, Japanese encephalitis virus
KILPQIIR

SEQ ID NO: 217185 - protein, 8 aa, Japanese encephalitis virus
ILPQTIKD

SEQ ID NO: 217186 - protein, 8 aa, Japanese encephalitis virus
LPQIIRDA

SEQ ID NO: 217187 - protein, 8 aa, Japanese encephalitis virus
PQTIKDAI

SEQ ID NO: 217188 - protein, 8 aa, Japanese encephalitis virus
QTIKDAIQ

SEQ ID NO: 217189 - protein, 8 aa, Japanese encephalitis virus
TIKDAIQQ

SEQ ID NO: 217190 - protein, 8 aa, Japanese encephalitis virus
IRDAIQQR

SEQ ID NO: 217191 - protein, 8 aa, Japanese encephalitis virus
RDAIQQRL

SEQ ID NO: 217192 - protein, 8 aa, Japanese encephalitis virus
DAIQQRLK

SEQ ID NO: 217193 - protein, 8 aa, Japanese encephalitis virus
AIQQHLRT

SEQ ID NO: 217194 - protein, 8 aa, Japanese encephalitis virus
IQQHLRTA

SEQ ID NO: 217195 - protein, 8 aa, Japanese encephalitis virus
QQHLRTAV

SEQ ID NO: 217196 - protein, 8 aa, Japanese encephalitis virus
QHLRTAVL

SEQ ID NO: 217197 - protein, 8 aa, Japanese encephalitis virus
HLRTAVLA

SEQ ID NO: 217198 - protein, 8 aa, Japanese encephalitis virus
AEMAEVLR

SEQ ID NO: 217199 - protein, 8 aa, Japanese encephalitis virus
EMAEVLRG

SEQ ID NO: 217200 - protein, 8 aa, Japanese encephalitis virus
MAEVLRGL

SEQ ID NO: 217201 - protein, 8 aa, Japanese encephalitis virus
AEVLRGLP

SEQ ID NO: 217202 - protein, 8 aa, Japanese encephalitis virus
EVLRGLPV

SEQ ID NO: 217203 - protein, 8 aa, Japanese encephalitis virus
VLRGLPVR

SEQ ID NO: 217204 - protein, 8 aa, Japanese encephalitis virus
QREHQGNA

SEQ ID NO: 217205 - protein, 8 aa, Japanese encephalitis virus
REHQGNAI

SEQ ID NO: 217206 - protein, 8 aa, Japanese encephalitis virus
EHQGNAIV

SEQ ID NO: 217207 - protein, 8 aa, Japanese encephalitis virus
IHDLQDEV

SEQ ID NO: 217208 - protein, 8 aa, Japanese encephalitis virus
HDLQDETP

SEQ ID NO: 217209 - protein, 8 aa, Japanese encephalitis virus
DLQDEVPD

SEQ ID NO: 217210 - protein, 8 aa, Japanese encephalitis virus
LQDEIPDW

SEQ ID NO: 217211 - protein, 8 aa, Japanese encephalitis virus
QDEVPDRA

SEQ ID NO: 217212 - protein, 8 aa, Japanese encephalitis virus
DEIPDWAW

SEQ ID NO: 217213 - protein, 8 aa, Japanese encephalitis virus
EIPDWAWS

SEQ ID NO: 217214 - protein, 8 aa, Japanese encephalitis virus
VPDRAWSS

SEQ ID NO: 217215 - protein, 8 aa, Japanese encephalitis virus
WSTEYAGK

SEQ ID NO: 217216 - protein, 8 aa, Japanese encephalitis virus
STEYAGKT

SEQ ID NO: 217217 - protein, 8 aa, Japanese encephalitis virus
TEYSGKTV

SEQ ID NO: 217218 - protein, 8 aa, Japanese encephalitis virus
EYSGKTVW

SEQ ID NO: 217219 - protein, 8 aa, Japanese encephalitis virus
KMGNEIAV

SEQ ID NO: 217220 - protein, 8 aa, Japanese encephalitis virus
GKRVIQLN

SEQ ID NO: 217221 - protein, 8 aa, Japanese encephalitis virus
KKVIQLSR

SEQ ID NO: 217222 - protein, 8 aa, Japanese encephalitis virus
RVIQLNRK

SEQ ID NO: 217223 - protein, 8 aa, Japanese encephalitis virus
CRKSVEPT

SEQ ID NO: 217224 - protein, 8 aa, Japanese encephalitis virus
RKSVKPII

SEQ ID NO: 217225 - protein, 8 aa, Japanese encephalitis virus
KSVKPIIL

SEQ ID NO: 217226 - protein, 8 aa, Japanese encephalitis virus
SVEPTILE

SEQ ID NO: 217227 - protein, 8 aa, Japanese encephalitis virus
VEPTILEE

SEQ ID NO: 217228 - protein, 8 aa, Japanese encephalitis virus
KPTILEKE

SEQ ID NO: 217229 - protein, 8 aa, Japanese encephalitis virus
PIILEEGE

SEQ ID NO: 217230 - protein, 8 aa, Japanese encephalitis virus
IILEEGEG

SEQ ID NO: 217231 - protein, 8 aa, Japanese encephalitis virus
EKEEGRVI

SEQ ID NO: 217232 - protein, 8 aa, Japanese encephalitis virus
KEEGRVIL

SEQ ID NO: 217233 - protein, 8 aa, Japanese encephalitis virus
GEGRVFLG

SEQ ID NO: 217234 - protein, 8 aa, Japanese encephalitis virus
GRVSRNPN

SEQ ID NO: 217235 - protein, 8 aa, Japanese encephalitis virus
RVGRNPSQ

SEQ ID NO: 217236 - protein, 8 aa, Japanese encephalitis virus
VGRNPSQV

SEQ ID NO: 217237 - protein, 8 aa, Japanese encephalitis virus
GRNPSQVG

SEQ ID NO: 217238 - protein, 8 aa, Japanese encephalitis virus
NQVGDEYE

SEQ ID NO: 217239 - protein, 8 aa, Japanese encephalitis virus
DEYHYGGP

SEQ ID NO: 217240 - protein, 8 aa, Japanese encephalitis virus
EYEYGGAT

SEQ ID NO: 217241 - protein, 8 aa, Japanese encephalitis virus
YHYGGPTS

SEQ ID NO: 217242 - protein, 8 aa, Japanese encephalitis virus
HYGGPTSE

SEQ ID NO: 217243 - protein, 8 aa, Japanese encephalitis virus
YGGATSEG

SEQ ID NO: 217244 - protein, 8 aa, Japanese encephalitis virus
GGPTSEDD

SEQ ID NO: 217245 - protein, 8 aa, Japanese encephalitis virus
GATSEDDG

SEQ ID NO: 217246 - protein, 8 aa, Japanese encephalitis virus
ATSEDDGN

SEQ ID NO: 217247 - protein, 8 aa, Japanese encephalitis virus
TSEDDGNL

SEQ ID NO: 217248 - protein, 8 aa, Japanese encephalitis virus
SEGDSNLA

SEQ ID NO: 217249 - protein, 8 aa, Japanese encephalitis virus
EGDSNLAH

SEQ ID NO: 217250 - protein, 8 aa, Japanese encephalitis virus
DDGNLAHW

SEQ ID NO: 217251 - protein, 8 aa, Japanese encephalitis virus
GPEREKAL

SEQ ID NO: 217252 - protein, 8 aa, Japanese encephalitis virus
PEREKALT

SEQ ID NO: 217253 - protein, 8 aa, Japanese encephalitis virus
EREKALTM

SEQ ID NO: 217254 - protein, 8 aa, Japanese encephalitis virus
REKALTMD

SEQ ID NO: 217255 - protein, 8 aa, Japanese encephalitis virus
EKALTMDG

SEQ ID NO: 217256 - protein, 8 aa, Japanese encephalitis virus
KAFTMDVE

SEQ ID NO: 217257 - protein, 8 aa, Japanese encephalitis virus
ALTMDGEY

SEQ ID NO: 217258 - protein, 8 aa, Japanese encephalitis virus
FTMDVEYR

SEQ ID NO: 217259 - protein, 8 aa, Japanese encephalitis virus
WLAYRVAS

SEQ ID NO: 217260 - protein, 8 aa, Japanese encephalitis virus
LAYKVAPN

SEQ ID NO: 217261 - protein, 8 aa, Japanese encephalitis virus
AYRVASNG

SEQ ID NO: 217262 - protein, 8 aa, Japanese encephalitis virus
YKVAPNGI

SEQ ID NO: 217263 - protein, 8 aa, Japanese encephalitis virus
RVASNGIQ

SEQ ID NO: 217264 - protein, 8 aa, Japanese encephalitis virus
NAILEDST

SEQ ID NO: 217265 - protein, 8 aa, Japanese encephalitis virus
AILEDSTE

SEQ ID NO: 217266 - protein, 8 aa, Japanese encephalitis virus
ILEDSTEV

SEQ ID NO: 217267 - protein, 8 aa, Japanese encephalitis virus
LEDSTEVE

SEQ ID NO: 217268 - protein, 8 aa, Japanese encephalitis virus
EDSTEVEI

SEQ ID NO: 217269 - protein, 8 aa, Japanese encephalitis virus
DSTEVEIV

SEQ ID NO: 217270 - protein, 8 aa, Japanese encephalitis virus
STEVEIVT

SEQ ID NO: 217271 - protein, 8 aa, Japanese encephalitis virus
VLKPRWLD

SEQ ID NO: 217272 - protein, 8 aa, Japanese encephalitis virus
AAGKRSAT

SEQ ID NO: 217273 - protein, 8 aa, Japanese encephalitis virus
SGKRSAVS

SEQ ID NO: 217274 - protein, 8 aa, Japanese encephalitis virus
GKRSATSF

SEQ ID NO: 217275 - protein, 8 aa, Japanese encephalitis virus
KRSATSFI

SEQ ID NO: 217276 - protein, 8 aa, Japanese encephalitis virus
RSATSFIE

SEQ ID NO: 217277 - protein, 8 aa, Japanese encephalitis virus
SATSFIEV

SEQ ID NO: 217278 - protein, 8 aa, Japanese encephalitis virus
ATSFIEVL

SEQ ID NO: 217279 - protein, 8 aa, Japanese encephalitis virus
VSFIEEPG

SEQ ID NO: 217280 - protein, 8 aa, Japanese encephalitis virus
SFIEVRGR

SEQ ID NO: 217281 - protein, 8 aa, Japanese encephalitis virus
FIEEPGRM

SEQ ID NO: 217282 - protein, 8 aa, Japanese encephalitis virus
IEEPGRMP

SEQ ID NO: 217283 - protein, 8 aa, Japanese encephalitis virus
EEPGRMPE

SEQ ID NO: 217284 - protein, 8 aa, Japanese encephalitis virus
VRGRMPEH

SEQ ID NO: 217285 - protein, 8 aa, Japanese encephalitis virus
PGRMPEHF

SEQ ID NO: 217286 - protein, 8 aa, Japanese encephalitis virus
LVATAEKS

SEQ ID NO: 217287 - protein, 8 aa, Japanese encephalitis virus
VATAEKSG

SEQ ID NO: 217288 - protein, 8 aa, Japanese encephalitis virus
ATAEKSGK

SEQ ID NO: 217289 - protein, 8 aa, Japanese encephalitis virus
TAEKSGKA

SEQ ID NO: 217290 - protein, 8 aa, Japanese encephalitis virus
AEKSGKAH

SEQ ID NO: 217291 - protein, 8 aa, Japanese encephalitis virus
EKGGKTHR

SEQ ID NO: 217292 - protein, 8 aa, Japanese encephalitis virus
KGGKTHRM

SEQ ID NO: 217293 - protein, 8 aa, Japanese encephalitis virus
SGKAHRMA

SEQ ID NO: 217294 - protein, 8 aa, Japanese encephalitis virus
ALETVTLI

SEQ ID NO: 217295 - protein, 8 aa, Japanese encephalitis virus
LETVTLIV

SEQ ID NO: 217296 - protein, 8 aa, Japanese encephalitis virus
ETITLTVA

SEQ ID NO: 217297 - protein, 8 aa, Japanese encephalitis virus
TVTLIVAI

SEQ ID NO: 217298 - protein, 8 aa, Japanese encephalitis virus
AIAVMTGG

SEQ ID NO: 217299 - protein, 8 aa, Japanese encephalitis virus
ITVMTRGF

SEQ ID NO: 217300 - protein, 8 aa, Japanese encephalitis virus
AVMTGGFF

SEQ ID NO: 217301 - protein, 8 aa, Japanese encephalitis virus
VMTRGFFL

SEQ ID NO: 217302 - protein, 8 aa, Japanese encephalitis virus
RGFFLLMM

SEQ ID NO: 217303 - protein, 8 aa, Japanese encephalitis virus
MMQRKGIE

SEQ ID NO: 217304 - protein, 8 aa, Japanese encephalitis virus
KQRKGIGK

SEQ ID NO: 217305 - protein, 8 aa, Japanese encephalitis virus
QRKGIEKM

SEQ ID NO: 217306 - protein, 8 aa, Japanese encephalitis virus
RKGIEKMG

SEQ ID NO: 217307 - protein, 8 aa, Japanese encephalitis virus
KGIEKMGL

SEQ ID NO: 217308 - protein, 8 aa, Japanese encephalitis virus
GIEKMGLG

SEQ ID NO: 217309 - protein, 8 aa, Japanese encephalitis virus
IEKMGLGA

SEQ ID NO: 217310 - protein, 8 aa, Japanese encephalitis virus
EKMGLGAL

SEQ ID NO: 217311 - protein, 8 aa, Japanese encephalitis virus
IPEPEKQK

SEQ ID NO: 217312 - protein, 8 aa, Japanese encephalitis virus
PEPEKQKS

SEQ ID NO: 217313 - protein, 8 aa, Japanese encephalitis virus
EPEKQRLQ

SEQ ID NO: 217314 - protein, 8 aa, Japanese encephalitis virus
PEKQRLQT

SEQ ID NO: 217315 - protein, 8 aa, Japanese encephalitis virus
EKQRLQTD

SEQ ID NO: 217316 - protein, 8 aa, Japanese encephalitis virus
KQRLQTDN

SEQ ID NO: 217317 - protein, 8 aa, Japanese encephalitis virus
QKSQTDNQ

SEQ ID NO: 217318 - protein, 8 aa, Japanese encephalitis virus
KSQTDNQL

SEQ ID NO: 217319 - protein, 8 aa, Japanese encephalitis virus
LQTDNQLA

SEQ ID NO: 217320 - protein, 8 aa, Japanese encephalitis virus
VLTVVGVA

SEQ ID NO: 217321 - protein, 8 aa, Japanese encephalitis virus
LTVVGVAA

SEQ ID NO: 217322 - protein, 8 aa, Japanese encephalitis virus
TVVGVAAA

SEQ ID NO: 217323 - protein, 8 aa, Japanese encephalitis virus
VVGMVAAN

SEQ ID NO: 217324 - protein, 8 aa, Japanese encephalitis virus
VGMVAANE

SEQ ID NO: 217325 - protein, 8 aa, Japanese encephalitis virus
GVAAANEY

SEQ ID NO: 217326 - protein, 8 aa, Japanese encephalitis virus
MVAANEYG

SEQ ID NO: 217327 - protein, 8 aa, Japanese encephalitis virus
LERTKADL

SEQ ID NO: 217328 - protein, 8 aa, Japanese encephalitis virus
ERTKADLK

SEQ ID NO: 217329 - protein, 8 aa, Japanese encephalitis virus
KTKADIKS

SEQ ID NO: 217330 - protein, 8 aa, Japanese encephalitis virus
ADLKSMFV

SEQ ID NO: 217331 - protein, 8 aa, Japanese encephalitis virus
DLKSMFVG

SEQ ID NO: 217332 - protein, 8 aa, Japanese encephalitis virus
LKSMFAGK

SEQ ID NO: 217333 - protein, 8 aa, Japanese encephalitis virus
KSMFAGKT

SEQ ID NO: 217334 - protein, 8 aa, Japanese encephalitis virus
SMFAGKTQ

SEQ ID NO: 217335 - protein, 8 aa, Japanese encephalitis virus
MFAGKTQA

SEQ ID NO: 217336 - protein, 8 aa, Japanese encephalitis virus
APVSGMTG

SEQ ID NO: 217337 - protein, 8 aa, Japanese encephalitis virus
QALGLTGL

SEQ ID NO: 217338 - protein, 8 aa, Japanese encephalitis virus
ALGLTGLP

SEQ ID NO: 217339 - protein, 8 aa, Japanese encephalitis virus
LGLTGLPS

SEQ ID NO: 217340 - protein, 8 aa, Japanese encephalitis virus
GMTGLPGM

SEQ ID NO: 217341 - protein, 8 aa, Japanese encephalitis virus
MTGLPGMA

SEQ ID NO: 217342 - protein, 8 aa, Japanese encephalitis virus
TGLPGMAL

SEQ ID NO: 217343 - protein, 8 aa, Japanese encephalitis virus
GLPGMALD

SEQ ID NO: 217344 - protein, 8 aa, Japanese encephalitis virus
LPSVALDL

SEQ ID NO: 217345 - protein, 8 aa, Japanese encephalitis virus
PSMTLDLR

SEQ ID NO: 217346 - protein, 8 aa, Japanese encephalitis virus
SVALDLRP

SEQ ID NO: 217347 - protein, 8 aa, Japanese encephalitis virus
VALDLRPA

SEQ ID NO: 217348 - protein, 8 aa, Japanese encephalitis virus
TPSLASIS

SEQ ID NO: 217349 - protein, 8 aa, Japanese encephalitis virus
PSLASISS

SEQ ID NO: 217350 - protein, 8 aa, Japanese encephalitis virus
LLGCWGQI

SEQ ID NO: 217351 - protein, 8 aa, Japanese encephalitis virus
GQITLTTS

SEQ ID NO: 217352 - protein, 8 aa, Japanese encephalitis virus
QITLTTSL

SEQ ID NO: 217353 - protein, 8 aa, Japanese encephalitis virus
ITLTTSLT

SEQ ID NO: 217354 - protein, 8 aa, Japanese encephalitis virus
TLTTVLTA

SEQ ID NO: 217355 - protein, 8 aa, Japanese encephalitis virus
LTTSLTAM

SEQ ID NO: 217356 - protein, 8 aa, Japanese encephalitis virus
TTSLTAMV

SEQ ID NO: 217357 - protein, 8 aa, Japanese encephalitis virus
TSLTAMVL

SEQ ID NO: 217358 - protein, 8 aa, Japanese encephalitis virus
LTAVVLAT

SEQ ID NO: 217359 - protein, 8 aa, Japanese encephalitis virus
TAVVLATL

SEQ ID NO: 217360 - protein, 8 aa, Japanese encephalitis virus
AVVLATLH

SEQ ID NO: 217361 - protein, 8 aa, Japanese encephalitis virus
VVLATLHY

SEQ ID NO: 217362 - protein, 8 aa, Japanese encephalitis virus
VLAILHYG

SEQ ID NO: 217363 - protein, 8 aa, Japanese encephalitis virus
LTTLHYGY

SEQ ID NO: 217364 - protein, 8 aa, Japanese encephalitis virus
TTLHYGYM

SEQ ID NO: 217365 - protein, 8 aa, Japanese encephalitis virus
TLHYGFML

SEQ ID NO: 217366 - protein, 8 aa, Japanese encephalitis virus
IGGSVAAF

SEQ ID NO: 217367 - protein, 8 aa, Japanese encephalitis virus
GGSVAAFL

SEQ ID NO: 217368 - protein, 8 aa, Japanese encephalitis virus
GSVAAFLV

SEQ ID NO: 217369 - protein, 8 aa, Japanese encephalitis virus
AAFLVNPK

SEQ ID NO: 217370 - protein, 8 aa, Japanese encephalitis virus
AFLVNPKI

SEQ ID NO: 217371 - protein, 8 aa, Japanese encephalitis virus
FLVNPKIT

SEQ ID NO: 217372 - protein, 8 aa, Japanese encephalitis virus
LVNPKITT

SEQ ID NO: 217373 - protein, 8 aa, Japanese encephalitis virus
VNPNVSTV

SEQ ID NO: 217374 - protein, 8 aa, Japanese encephalitis virus
NPNVSTVR

SEQ ID NO: 217375 - protein, 8 aa, Japanese encephalitis virus
PNVSTVRK

SEQ ID NO: 217376 - protein, 8 aa, Japanese encephalitis virus
KITTVREA

SEQ ID NO: 217377 - protein, 8 aa, Japanese encephalitis virus
ITTVREAG

SEQ ID NO: 217378 - protein, 8 aa, Japanese encephalitis virus
STVRKAGV

SEQ ID NO: 217379 - protein, 8 aa, Japanese encephalitis virus
TVRKAGVL

SEQ ID NO: 217380 - protein, 8 aa, Japanese encephalitis virus
VKKPGVLV

SEQ ID NO: 217381 - protein, 8 aa, Japanese encephalitis virus
KKPGVLVT

SEQ ID NO: 217382 - protein, 8 aa, Japanese encephalitis virus
KPGVLVTA

SEQ ID NO: 217383 - protein, 8 aa, Japanese encephalitis virus
PGVLVTAA

SEQ ID NO: 217384 - protein, 8 aa, Japanese encephalitis virus
LVTAATLS

SEQ ID NO: 217385 - protein, 8 aa, Japanese encephalitis virus
VTAATLSL

SEQ ID NO: 217386 - protein, 8 aa, Japanese encephalitis virus
TAATLSLW

SEQ ID NO: 217387 - protein, 8 aa, Japanese encephalitis virus
AATLSLWD

SEQ ID NO: 217388 - protein, 8 aa, Japanese encephalitis virus
ATLSLWDN

SEQ ID NO: 217389 - protein, 8 aa, Japanese encephalitis virus
TLIKNADN

SEQ ID NO: 217390 - protein, 8 aa, Japanese encephalitis virus
LIKNADNP

SEQ ID NO: 217391 - protein, 8 aa, Japanese encephalitis virus
IKNANKPS

SEQ ID NO: 217392 - protein, 8 aa, Japanese encephalitis virus
KNADKPSF

SEQ ID NO: 217393 - protein, 8 aa, Japanese encephalitis virus
NADKPSFK

SEQ ID NO: 217394 - protein, 8 aa, Japanese encephalitis virus
ADNPSLKR

SEQ ID NO: 217395 - protein, 8 aa, Japanese encephalitis virus
NKPSLKRG

SEQ ID NO: 217396 - protein, 8 aa, Japanese encephalitis virus
KPSLKKGR

SEQ ID NO: 217397 - protein, 8 aa, Japanese encephalitis virus
PSFKKGRP

SEQ ID NO: 217398 - protein, 8 aa, Japanese encephalitis virus
SLKKGRPG

SEQ ID NO: 217399 - protein, 8 aa, Japanese encephalitis virus
LKKGRPGG

SEQ ID NO: 217400 - protein, 8 aa, Japanese encephalitis virus
KRGRSGGR

SEQ ID NO: 217401 - protein, 8 aa, Japanese encephalitis virus
KGRPGGRT

SEQ ID NO: 217402 - protein, 8 aa, Japanese encephalitis virus
GGPGGRTL

SEQ ID NO: 217403 - protein, 8 aa, Japanese encephalitis virus
GPGGRTLW

SEQ ID NO: 217404 - protein, 8 aa, Japanese encephalitis virus
PGGRTLGD

SEQ ID NO: 217405 - protein, 8 aa, Japanese encephalitis virus
GGRTLWEQ

SEQ ID NO: 217406 - protein, 8 aa, Japanese encephalitis virus
GRTLGDQW

SEQ ID NO: 217407 - protein, 8 aa, Japanese encephalitis virus
RTLWEQWK

SEQ ID NO: 217408 - protein, 8 aa, Japanese encephalitis virus
TLWEQWKE

SEQ ID NO: 217409 - protein, 8 aa, Japanese encephalitis virus
LGDQWKEK

SEQ ID NO: 217410 - protein, 8 aa, Japanese encephalitis virus
WEQWKEKL

SEQ ID NO: 217411 - protein, 8 aa, Japanese encephalitis virus
EQWKERLN

SEQ ID NO: 217412 - protein, 8 aa, Japanese encephalitis virus
QWKERLNA

SEQ ID NO: 217413 - protein, 8 aa, Japanese encephalitis virus
WKEKLNAL

SEQ ID NO: 217414 - protein, 8 aa, Japanese encephalitis virus
KEKLNAMG

SEQ ID NO: 217415 - protein, 8 aa, Japanese encephalitis virus
ERLNAMSR

SEQ ID NO: 217416 - protein, 8 aa, Japanese encephalitis virus
KLNAMGRD

SEQ ID NO: 217417 - protein, 8 aa, Japanese encephalitis virus
LNAMGRDE

SEQ ID NO: 217418 - protein, 8 aa, Japanese encephalitis virus
NAMGRDEF

SEQ ID NO: 217419 - protein, 8 aa, Japanese encephalitis virus
AMGRDEFF

SEQ ID NO: 217420 - protein, 8 aa, Japanese encephalitis virus
MGRDEFFK

SEQ ID NO: 217421 - protein, 8 aa, Japanese encephalitis virus
GRDEFFKY

SEQ ID NO: 217422 - protein, 8 aa, Japanese encephalitis virus
REEFFQYR

SEQ ID NO: 217423 - protein, 8 aa, Japanese encephalitis virus
EEFFQYRR

SEQ ID NO: 217424 - protein, 8 aa, Japanese encephalitis virus
FFQYRREA

SEQ ID NO: 217425 - protein, 8 aa, Japanese encephalitis virus
FQYRREAI

SEQ ID NO: 217426 - protein, 8 aa, Japanese encephalitis virus
KYRREGII

SEQ ID NO: 217427 - protein, 8 aa, Japanese encephalitis virus
TEARRARS

SEQ ID NO: 217428 - protein, 8 aa, Japanese encephalitis virus
EARRARSE

SEQ ID NO: 217429 - protein, 8 aa, Japanese encephalitis virus
ARRARSEN

SEQ ID NO: 217430 - protein, 8 aa, Japanese encephalitis virus
RRARSENN

SEQ ID NO: 217431 - protein, 8 aa, Japanese encephalitis virus
RARSENNI

SEQ ID NO: 217432 - protein, 8 aa, Japanese encephalitis virus
ARRENNKV

SEQ ID NO: 217433 - protein, 8 aa, Japanese encephalitis virus
RSENNIVG

SEQ ID NO: 217434 - protein, 8 aa, Japanese encephalitis virus
SENNIVGG

SEQ ID NO: 217435 - protein, 8 aa, Japanese encephalitis virus
ENNKVGGH

SEQ ID NO: 217436 - protein, 8 aa, Japanese encephalitis virus
NNKVGGHP

SEQ ID NO: 217437 - protein, 8 aa, Japanese encephalitis virus
NKVGGHPV

SEQ ID NO: 217438 - protein, 8 aa, Japanese encephalitis virus
KVGGHPVS

SEQ ID NO: 217439 - protein, 8 aa, Japanese encephalitis virus
VSPIGKVV

SEQ ID NO: 217440 - protein, 8 aa, Japanese encephalitis virus
PPIGKVID

SEQ ID NO: 217441 - protein, 8 aa, Japanese encephalitis virus
VVDLGCGR

SEQ ID NO: 217442 - protein, 8 aa, Japanese encephalitis virus
VDLGCGRG

SEQ ID NO: 217443 - protein, 8 aa, Japanese encephalitis virus
DLGCGCGG

SEQ ID NO: 217444 - protein, 8 aa, Japanese encephalitis virus
LGCGCGGW

SEQ ID NO: 217445 - protein, 8 aa, Japanese encephalitis virus
GCGCGGWS

SEQ ID NO: 217446 - protein, 8 aa, Japanese encephalitis virus
CGCGGWSY

SEQ ID NO: 217447 - protein, 8 aa, Japanese encephalitis virus
GCGGWSYY

SEQ ID NO: 217448 - protein, 8 aa, Japanese encephalitis virus
CGGWSYYA

SEQ ID NO: 217449 - protein, 8 aa, Japanese encephalitis virus
GGWSYCAA

SEQ ID NO: 217450 - protein, 8 aa, Japanese encephalitis virus
GWSYCAAT

SEQ ID NO: 217451 - protein, 8 aa, Japanese encephalitis virus
WSYCAATL

SEQ ID NO: 217452 - protein, 8 aa, Japanese encephalitis virus
SYCAATLK

SEQ ID NO: 217453 - protein, 8 aa, Japanese encephalitis virus
YYAATLKR

SEQ ID NO: 217454 - protein, 8 aa, Japanese encephalitis virus
YAATLKRV

SEQ ID NO: 217455 - protein, 8 aa, Japanese encephalitis virus
TLKRVQEV

SEQ ID NO: 217456 - protein, 8 aa, Japanese encephalitis virus
LKRVQEVR

SEQ ID NO: 217457 - protein, 8 aa, Japanese encephalitis virus
KKVQEFRG

SEQ ID NO: 217458 - protein, 8 aa, Japanese encephalitis virus
RVQEVRGY

SEQ ID NO: 217459 - protein, 8 aa, Japanese encephalitis virus
VQEFRGYT

SEQ ID NO: 217460 - protein, 8 aa, Japanese encephalitis virus
QEFRGYTK

SEQ ID NO: 217461 - protein, 8 aa, Japanese encephalitis virus
EFRGYTKG

SEQ ID NO: 217462 - protein, 8 aa, Japanese encephalitis virus
FRGYTKGG

SEQ ID NO: 217463 - protein, 8 aa, Japanese encephalitis virus
MPMQSYGW

SEQ ID NO: 217464 - protein, 8 aa, Japanese encephalitis virus
PMQSYGWN

SEQ ID NO: 217465 - protein, 8 aa, Japanese encephalitis virus
YGWNLVSM

SEQ ID NO: 217466 - protein, 8 aa, Japanese encephalitis virus
GWNLVSMK

SEQ ID NO: 217467 - protein, 8 aa, Japanese encephalitis virus
WNLVSMKS

SEQ ID NO: 217468 - protein, 8 aa, Japanese encephalitis virus
VSMKSGVD

SEQ ID NO: 217469 - protein, 8 aa, Japanese encephalitis virus
SMKSGVDV

SEQ ID NO: 217470 - protein, 8 aa, Japanese encephalitis virus
MKSGVDVF

SEQ ID NO: 217471 - protein, 8 aa, Japanese encephalitis virus
SGVDVFYR

SEQ ID NO: 217472 - protein, 8 aa, Japanese encephalitis virus
GVHVFYKP

SEQ ID NO: 217473 - protein, 8 aa, Japanese encephalitis virus
VHVFYKPS

SEQ ID NO: 217474 - protein, 8 aa, Japanese encephalitis virus
DVFYRPSE

SEQ ID NO: 217475 - protein, 8 aa, Japanese encephalitis virus
MPKVIEKI

SEQ ID NO: 217476 - protein, 8 aa, Japanese encephalitis virus
PKVIEKNE

SEQ ID NO: 217477 - protein, 8 aa, Japanese encephalitis virus
KVIEKNEV

SEQ ID NO: 217478 - protein, 8 aa, Japanese encephalitis virus
VIEKIEVL

SEQ ID NO: 217479 - protein, 8 aa, Japanese encephalitis virus
IEKNEVLQ

SEQ ID NO: 217480 - protein, 8 aa, Japanese encephalitis virus
EKIEVLQR

SEQ ID NO: 217481 - protein, 8 aa, Japanese encephalitis virus
KIEVLQRR

SEQ ID NO: 217482 - protein, 8 aa, Japanese encephalitis virus
IEVLQRRF

SEQ ID NO: 217483 - protein, 8 aa, Japanese encephalitis virus
LLGRMDRA

SEQ ID NO: 217484 - protein, 8 aa, Japanese encephalitis virus
LGRMNRTV

SEQ ID NO: 217485 - protein, 8 aa, Japanese encephalitis virus
GRMDRAVW

SEQ ID NO: 217486 - protein, 8 aa, Japanese encephalitis virus
RMDRAVWR

SEQ ID NO: 217487 - protein, 8 aa, Japanese encephalitis virus
MDRAVWRG

SEQ ID NO: 217488 - protein, 8 aa, Japanese encephalitis virus
DRAVWRGP

SEQ ID NO: 217489 - protein, 8 aa, Japanese encephalitis virus
RTVWRGPR

SEQ ID NO: 217490 - protein, 8 aa, Japanese encephalitis virus
AVWRGPKY

SEQ ID NO: 217491 - protein, 8 aa, Japanese encephalitis virus
VWRGPRYE

SEQ ID NO: 217492 - protein, 8 aa, Japanese encephalitis virus
WRGPRYEE

SEQ ID NO: 217493 - protein, 8 aa, Japanese encephalitis virus
RGPRYEED

SEQ ID NO: 217494 - protein, 8 aa, Japanese encephalitis virus
GPKYKEDV

SEQ ID NO: 217495 - protein, 8 aa, Japanese encephalitis virus
PKYKEDVN

SEQ ID NO: 217496 - protein, 8 aa, Japanese encephalitis virus
KYKEDVNL

SEQ ID NO: 217497 - protein, 8 aa, Japanese encephalitis virus
GKGEVHSD

SEQ ID NO: 217498 - protein, 8 aa, Japanese encephalitis virus
KGEVHSDQ

SEQ ID NO: 217499 - protein, 8 aa, Japanese encephalitis virus
QKKIRKRI

SEQ ID NO: 217500 - protein, 8 aa, Japanese encephalitis virus
GKIKKRIQ

SEQ ID NO: 217501 - protein, 8 aa, Japanese encephalitis virus
KIRRRIQK

SEQ ID NO: 217502 - protein, 8 aa, Japanese encephalitis virus
IKKRIQKQ

SEQ ID NO: 217503 - protein, 8 aa, Japanese encephalitis virus
RKRIQKLK

SEQ ID NO: 217504 - protein, 8 aa, Japanese encephalitis virus
RRIQKLRE

SEQ ID NO: 217505 - protein, 8 aa, Japanese encephalitis virus
RIQKQKEE

SEQ ID NO: 217506 - protein, 8 aa, Japanese encephalitis virus
IQKQKEEF

SEQ ID NO: 217507 - protein, 8 aa, Japanese encephalitis virus
QKLREEFG

SEQ ID NO: 217508 - protein, 8 aa, Japanese encephalitis virus
KLREGFAT

SEQ ID NO: 217509 - protein, 8 aa, Japanese encephalitis virus
LREEFGTT

SEQ ID NO: 217510 - protein, 8 aa, Japanese encephalitis virus
REGFATTW

SEQ ID NO: 217511 - protein, 8 aa, Japanese encephalitis virus
EEFGTTWH

SEQ ID NO: 217512 - protein, 8 aa, Japanese encephalitis virus
GFATTWHK

SEQ ID NO: 217513 - protein, 8 aa, Japanese encephalitis virus
FGTTWHKD

SEQ ID NO: 217514 - protein, 8 aa, Japanese encephalitis virus
GTTWHKDP

SEQ ID NO: 217515 - protein, 8 aa, Japanese encephalitis virus
TTWHRDPE

SEQ ID NO: 217516 - protein, 8 aa, Japanese encephalitis virus
TWHRDPEH

SEQ ID NO: 217517 - protein, 8 aa, Japanese encephalitis virus
WHKDHEHP

SEQ ID NO: 217518 - protein, 8 aa, Japanese encephalitis virus
HKDHEHPY

SEQ ID NO: 217519 - protein, 8 aa, Japanese encephalitis virus
KDHEHPYR

SEQ ID NO: 217520 - protein, 8 aa, Japanese encephalitis virus
DHEHPYRT

SEQ ID NO: 217521 - protein, 8 aa, Japanese encephalitis virus
HEHPYRTW

SEQ ID NO: 217522 - protein, 8 aa, Japanese encephalitis virus
GSYEVRAT

SEQ ID NO: 217523 - protein, 8 aa, Japanese encephalitis virus
SYEVKANG

SEQ ID NO: 217524 - protein, 8 aa, Japanese encephalitis virus
YEVRATGS

SEQ ID NO: 217525 - protein, 8 aa, Japanese encephalitis virus
EVKANGSA

SEQ ID NO: 217526 - protein, 8 aa, Japanese encephalitis virus
VKANGSAS

SEQ ID NO: 217527 - protein, 8 aa, Japanese encephalitis virus
RATGSASS

SEQ ID NO: 217528 - protein, 8 aa, Japanese encephalitis virus
SKPWDTIA

SEQ ID NO: 217529 - protein, 8 aa, Japanese encephalitis virus
KPWDAISY

SEQ ID NO: 217530 - protein, 8 aa, Japanese encephalitis virus
PWDAISYV

SEQ ID NO: 217531 - protein, 8 aa, Japanese encephalitis virus
WDAISYVT

SEQ ID NO: 217532 - protein, 8 aa, Japanese encephalitis virus
DTIANVTT

SEQ ID NO: 217533 - protein, 8 aa, Japanese encephalitis virus
AISYVTTM

SEQ ID NO: 217534 - protein, 8 aa, Japanese encephalitis virus
FKEKVGTK

SEQ ID NO: 217535 - protein, 8 aa, Japanese encephalitis virus
KEKVGTKA

SEQ ID NO: 217536 - protein, 8 aa, Japanese encephalitis virus
EKVGTMAP

SEQ ID NO: 217537 - protein, 8 aa, Japanese encephalitis virus
KVGTMAPE

SEQ ID NO: 217538 - protein, 8 aa, Japanese encephalitis virus
VGTMAPEP

SEQ ID NO: 217539 - protein, 8 aa, Japanese encephalitis virus
GTKAPEPP

SEQ ID NO: 217540 - protein, 8 aa, Japanese encephalitis virus
TKAPEPPP

SEQ ID NO: 217541 - protein, 8 aa, Japanese encephalitis virus
KAPEPPTG

SEQ ID NO: 217542 - protein, 8 aa, Japanese encephalitis virus
APEPPVGA

SEQ ID NO: 217543 - protein, 8 aa, Japanese encephalitis virus
GVREVLNE

SEQ ID NO: 217544 - protein, 8 aa, Japanese encephalitis virus
VREVLNET

SEQ ID NO: 217545 - protein, 8 aa, Japanese encephalitis virus
LWAHLSRK

SEQ ID NO: 217546 - protein, 8 aa, Japanese encephalitis virus
WAHLSRKK

SEQ ID NO: 217547 - protein, 8 aa, Japanese encephalitis virus
AHLSRKKR

SEQ ID NO: 217548 - protein, 8 aa, Japanese encephalitis virus
HLSRKKRP

SEQ ID NO: 217549 - protein, 8 aa, Japanese encephalitis virus
CTKEEFIN

SEQ ID NO: 217550 - protein, 8 aa, Japanese encephalitis virus
TKEEFINK

SEQ ID NO: 217551 - protein, 8 aa, Japanese encephalitis virus
KEEFINKV

SEQ ID NO: 217552 - protein, 8 aa, Japanese encephalitis virus
EEFINKVN

SEQ ID NO: 217553 - protein, 8 aa, Japanese encephalitis virus
EFINKVNS

SEQ ID NO: 217554 - protein, 8 aa, Japanese encephalitis virus
FIKKVNSS

SEQ ID NO: 217555 - protein, 8 aa, Japanese encephalitis virus
IKKVNSDA

SEQ ID NO: 217556 - protein, 8 aa, Japanese encephalitis virus
KVNSSAAL

SEQ ID NO: 217557 - protein, 8 aa, Japanese encephalitis virus
VNSDAALG

SEQ ID NO: 217558 - protein, 8 aa, Japanese encephalitis virus
NSSAALGA

SEQ ID NO: 217559 - protein, 8 aa, Japanese encephalitis virus
SNASLGAV

SEQ ID NO: 217560 - protein, 8 aa, Japanese encephalitis virus
SAALGAVF

SEQ ID NO: 217561 - protein, 8 aa, Japanese encephalitis virus
ASLGTVFA

SEQ ID NO: 217562 - protein, 8 aa, Japanese encephalitis virus
SLGTVFAE

SEQ ID NO: 217563 - protein, 8 aa, Japanese encephalitis virus
STAREAVN

SEQ ID NO: 217564 - protein, 8 aa, Japanese encephalitis virus
TAREAVND

SEQ ID NO: 217565 - protein, 8 aa, Japanese encephalitis virus
AREAVNDP

SEQ ID NO: 217566 - protein, 8 aa, Japanese encephalitis virus
DPRLWEMV

SEQ ID NO: 217567 - protein, 8 aa, Japanese encephalitis virus
FWEMVDVE

SEQ ID NO: 217568 - protein, 8 aa, Japanese encephalitis virus
WEMVDVER

SEQ ID NO: 217569 - protein, 8 aa, Japanese encephalitis virus
EMVDVERE

SEQ ID NO: 217570 - protein, 8 aa, Japanese encephalitis virus
MVDVEREN

SEQ ID NO: 217571 - protein, 8 aa, Japanese encephalitis virus
VDVERENH

SEQ ID NO: 217572 - protein, 8 aa, Japanese encephalitis virus
DVERENHL

SEQ ID NO: 217573 - protein, 8 aa, Japanese encephalitis virus
RGECHTRI

SEQ ID NO: 217574 - protein, 8 aa, Japanese encephalitis virus
GECHTRIY

SEQ ID NO: 217575 - protein, 8 aa, Japanese encephalitis virus
ECHTRIYN

SEQ ID NO: 217576 - protein, 8 aa, Japanese encephalitis virus
CHTRIYNM

SEQ ID NO: 217577 - protein, 8 aa, Japanese encephalitis virus
HTCVYHMM

SEQ ID NO: 217578 - protein, 8 aa, Japanese encephalitis virus
TRIYNMMG

SEQ ID NO: 217579 - protein, 8 aa, Japanese encephalitis virus
CVYHMMGK

SEQ ID NO: 217580 - protein, 8 aa, Japanese encephalitis virus
VYHMMGKR

SEQ ID NO: 217581 - protein, 8 aa, Japanese encephalitis virus
EALGSLNE

SEQ ID NO: 217582 - protein, 8 aa, Japanese encephalitis virus
ALGSLNED

SEQ ID NO: 217583 - protein, 8 aa, Japanese encephalitis virus
LGFLNLDH

SEQ ID NO: 217584 - protein, 8 aa, Japanese encephalitis virus
GFLNENHW

SEQ ID NO: 217585 - protein, 8 aa, Japanese encephalitis virus
FLNLDHWL

SEQ ID NO: 217586 - protein, 8 aa, Japanese encephalitis virus
LNENHWLS

SEQ ID NO: 217587 - protein, 8 aa, Japanese encephalitis virus
NLDHWLSR

SEQ ID NO: 217588 - protein, 8 aa, Japanese encephalitis virus
LDHWLSRE

SEQ ID NO: 217589 - protein, 8 aa, Japanese encephalitis virus
NHWLSREN

SEQ ID NO: 217590 - protein, 8 aa, Japanese encephalitis virus
WLSRRNSG

SEQ ID NO: 217591 - protein, 8 aa, Japanese encephalitis virus
LSRENSRG

SEQ ID NO: 217592 - protein, 8 aa, Japanese encephalitis virus
SRRNSGGG

SEQ ID NO: 217593 - protein, 8 aa, Japanese encephalitis virus
RENSGGGE

SEQ ID NO: 217594 - protein, 8 aa, Japanese encephalitis virus
ENSGGGEE

SEQ ID NO: 217595 - protein, 8 aa, Japanese encephalitis virus
NSGGGEEG

SEQ ID NO: 217596 - protein, 8 aa, Japanese encephalitis virus
SRGGVEGS

SEQ ID NO: 217597 - protein, 8 aa, Japanese encephalitis virus
GGGEEGSG

SEQ ID NO: 217598 - protein, 8 aa, Japanese encephalitis virus
GGEEGSGV

SEQ ID NO: 217599 - protein, 8 aa, Japanese encephalitis virus
GVEGLGVQ

SEQ ID NO: 217600 - protein, 8 aa, Japanese encephalitis virus
EEGSGVQK

SEQ ID NO: 217601 - protein, 8 aa, Japanese encephalitis virus
EGLGVQKL

SEQ ID NO: 217602 - protein, 8 aa, Japanese encephalitis virus
GLGVQKLG

SEQ ID NO: 217603 - protein, 8 aa, Japanese encephalitis virus
LGVQKLGY

SEQ ID NO: 217604 - protein, 8 aa, Japanese encephalitis virus
VQKLGYIF

SEQ ID NO: 217605 - protein, 8 aa, Japanese encephalitis virus
QKLGYIIR

SEQ ID NO: 217606 - protein, 8 aa, Japanese encephalitis virus
KLGYIIRD

SEQ ID NO: 217607 - protein, 8 aa, Japanese encephalitis virus
LGYIIRDI

SEQ ID NO: 217608 - protein, 8 aa, Japanese encephalitis virus
GYIFRDIA

SEQ ID NO: 217609 - protein, 8 aa, Japanese encephalitis virus
RDIARKEG

SEQ ID NO: 217610 - protein, 8 aa, Japanese encephalitis virus
DITSRAIG

SEQ ID NO: 217611 - protein, 8 aa, Japanese encephalitis virus
IARKEGGK

SEQ ID NO: 217612 - protein, 8 aa, Japanese encephalitis virus
TSRAIGKM

SEQ ID NO: 217613 - protein, 8 aa, Japanese encephalitis virus
RKEGGKMY

SEQ ID NO: 217614 - protein, 8 aa, Japanese encephalitis virus
RAIGKMYA

SEQ ID NO: 217615 - protein, 8 aa, Japanese encephalitis virus
AIGKMYAD

SEQ ID NO: 217616 - protein, 8 aa, Japanese encephalitis virus
WDTRITKT

SEQ ID NO: 217617 - protein, 8 aa, Japanese encephalitis virus
DTRITKTD

SEQ ID NO: 217618 - protein, 8 aa, Japanese encephalitis virus
TRITKTDL

SEQ ID NO: 217619 - protein, 8 aa, Japanese encephalitis virus
RITKTDLE

SEQ ID NO: 217620 - protein, 8 aa, Japanese encephalitis virus
ITKTDLEN

SEQ ID NO: 217621 - protein, 8 aa, Japanese encephalitis virus
TKTDLENE

SEQ ID NO: 217622 - protein, 8 aa, Japanese encephalitis virus
KTDLENEA

SEQ ID NO: 217623 - protein, 8 aa, Japanese encephalitis virus
IELTYKHK

SEQ ID NO: 217624 - protein, 8 aa, Japanese encephalitis virus
ELTYRHQV

SEQ ID NO: 217625 - protein, 8 aa, Japanese encephalitis virus
LTYRHQVF

SEQ ID NO: 217626 - protein, 8 aa, Japanese encephalitis virus
TYRHQVFK

SEQ ID NO: 217627 - protein, 8 aa, Japanese encephalitis virus
YKHKVVKV

SEQ ID NO: 217628 - protein, 8 aa, Japanese encephalitis virus
RHQVFKVM

SEQ ID NO: 217629 - protein, 8 aa, Japanese encephalitis virus
VFKVMRPA

SEQ ID NO: 217630 - protein, 8 aa, Japanese encephalitis virus
VKVMRPAS

SEQ ID NO: 217631 - protein, 8 aa, Japanese encephalitis virus
KVMRPASG

SEQ ID NO: 217632 - protein, 8 aa, Japanese encephalitis virus
VMRPASGG

SEQ ID NO: 217633 - protein, 8 aa, Japanese encephalitis virus
MRPAAKGK

SEQ ID NO: 217634 - protein, 8 aa, Japanese encephalitis virus
RPSTDGKT

SEQ ID NO: 217635 - protein, 8 aa, Japanese encephalitis virus
PSTDGKTV

SEQ ID NO: 217636 - protein, 8 aa, Japanese encephalitis virus
STDGKTVM

SEQ ID NO: 217637 - protein, 8 aa, Japanese encephalitis virus
EGKTVMVV

SEQ ID NO: 217638 - protein, 8 aa, Japanese encephalitis virus
GKTVMVVY

SEQ ID NO: 217639 - protein, 8 aa, Japanese encephalitis virus
KTGMAVIS

SEQ ID NO: 217640 - protein, 8 aa, Japanese encephalitis virus
TGMAVISR

SEQ ID NO: 217641 - protein, 8 aa, Japanese encephalitis virus
VMVVYSRE

SEQ ID NO: 217642 - protein, 8 aa, Japanese encephalitis virus
MAVISREN

SEQ ID NO: 217643 - protein, 8 aa, Japanese encephalitis virus
AVISRENQ

SEQ ID NO: 217644 - protein, 8 aa, Japanese encephalitis virus
VYSREDQR

SEQ ID NO: 217645 - protein, 8 aa, Japanese encephalitis virus
ISRENQRG

SEQ ID NO: 217646 - protein, 8 aa, Japanese encephalitis virus
AVQLVRLV

SEQ ID NO: 217647 - protein, 8 aa, Japanese encephalitis virus
VQFVRLMK

SEQ ID NO: 217648 - protein, 8 aa, Japanese encephalitis virus
QLVRLVEA

SEQ ID NO: 217649 - protein, 8 aa, Japanese encephalitis virus
LVRLVEAE

SEQ ID NO: 217650 - protein, 8 aa, Japanese encephalitis virus
VRLVEAEG

SEQ ID NO: 217651 - protein, 8 aa, Japanese encephalitis virus
RLVEAEGV

SEQ ID NO: 217652 - protein, 8 aa, Japanese encephalitis virus
LVEAEGVI

SEQ ID NO: 217653 - protein, 8 aa, Japanese encephalitis virus
VEAEGVIG

SEQ ID NO: 217654 - protein, 8 aa, Japanese encephalitis virus
IGPQHLEH

SEQ ID NO: 217655 - protein, 8 aa, Japanese encephalitis virus
GPQHLEHL

SEQ ID NO: 217656 - protein, 8 aa, Japanese encephalitis virus
PQHVEQLP

SEQ ID NO: 217657 - protein, 8 aa, Japanese encephalitis virus
QHLEQLPK

SEQ ID NO: 217658 - protein, 8 aa, Japanese encephalitis virus
HLEQLPKK

SEQ ID NO: 217659 - protein, 8 aa, Japanese encephalitis virus
EQLPKKNK

SEQ ID NO: 217660 - protein, 8 aa, Japanese encephalitis virus
QLPKKNKI

SEQ ID NO: 217661 - protein, 8 aa, Japanese encephalitis virus
LPRENKIA

SEQ ID NO: 217662 - protein, 8 aa, Japanese encephalitis virus
PKKNKIAV

SEQ ID NO: 217663 - protein, 8 aa, Japanese encephalitis virus
KKNKIAVR

SEQ ID NO: 217664 - protein, 8 aa, Japanese encephalitis virus
ENKIAVRT

SEQ ID NO: 217665 - protein, 8 aa, Japanese encephalitis virus
ENGGERVT

SEQ ID NO: 217666 - protein, 8 aa, Japanese encephalitis virus
NGGERVTR

SEQ ID NO: 217667 - protein, 8 aa, Japanese encephalitis virus
GGERVTRM

SEQ ID NO: 217668 - protein, 8 aa, Japanese encephalitis virus
GERVTRMA

SEQ ID NO: 217669 - protein, 8 aa, Japanese encephalitis virus
DRFATALY

SEQ ID NO: 217670 - protein, 8 aa, Japanese encephalitis virus
RFATSLHF

SEQ ID NO: 217671 - protein, 8 aa, Japanese encephalitis virus
FATSLHFL

SEQ ID NO: 217672 - protein, 8 aa, Japanese encephalitis virus
ATALYFLN

SEQ ID NO: 217673 - protein, 8 aa, Japanese encephalitis virus
TSLHFLNA

SEQ ID NO: 217674 - protein, 8 aa, Japanese encephalitis virus
ALYFLNAM

SEQ ID NO: 217675 - protein, 8 aa, Japanese encephalitis virus
NAMSKVTK

SEQ ID NO: 217676 - protein, 8 aa, Japanese encephalitis virus
AMSKVRRD

SEQ ID NO: 217677 - protein, 8 aa, Japanese encephalitis virus
MSKVTKDI

SEQ ID NO: 217678 - protein, 8 aa, Japanese encephalitis virus
SKVTKDIQ

SEQ ID NO: 217679 - protein, 8 aa, Japanese encephalitis virus
KVRKDILE

SEQ ID NO: 217680 - protein, 8 aa, Japanese encephalitis virus
VTKDIQQW

SEQ ID NO: 217681 - protein, 8 aa, Japanese encephalitis virus
TKDIQQWK

SEQ ID NO: 217682 - protein, 8 aa, Japanese encephalitis virus
KDILEWKP

SEQ ID NO: 217683 - protein, 8 aa, Japanese encephalitis virus
DILEWKPS

SEQ ID NO: 217684 - protein, 8 aa, Japanese encephalitis virus
IQQWKPSH

SEQ ID NO: 217685 - protein, 8 aa, Japanese encephalitis virus
QQWKPSHG

SEQ ID NO: 217686 - protein, 8 aa, Japanese encephalitis virus
SHGWLDWQ

SEQ ID NO: 217687 - protein, 8 aa, Japanese encephalitis virus
HGWLDWQQ

SEQ ID NO: 217688 - protein, 8 aa, Japanese encephalitis virus
GWLDWQQV

SEQ ID NO: 217689 - protein, 8 aa, Japanese encephalitis virus
WLDWQQVP

SEQ ID NO: 217690 - protein, 8 aa, Japanese encephalitis virus
LDWQQVPF

SEQ ID NO: 217691 - protein, 8 aa, Japanese encephalitis virus
KDGRSLLV

SEQ ID NO: 217692 - protein, 8 aa, Japanese encephalitis virus
DGRSIVDP

SEQ ID NO: 217693 - protein, 8 aa, Japanese encephalitis virus
GRSLLVPC

SEQ ID NO: 217694 - protein, 8 aa, Japanese encephalitis virus
RSIVDPCR

SEQ ID NO: 217695 - protein, 8 aa, Japanese encephalitis virus
SLLVPCRG

SEQ ID NO: 217696 - protein, 8 aa, Japanese encephalitis virus
IVDPCRGQ

SEQ ID NO: 217697 - protein, 8 aa, Japanese encephalitis virus
LVPCRGQD

SEQ ID NO: 217698 - protein, 8 aa, Japanese encephalitis virus
PGAGWNVR

SEQ ID NO: 217699 - protein, 8 aa, Japanese encephalitis virus
GAGWNVRD

SEQ ID NO: 217700 - protein, 8 aa, Japanese encephalitis virus
AGWNVRDT

SEQ ID NO: 217701 - protein, 8 aa, Japanese encephalitis virus
GWNVMDTA

SEQ ID NO: 217702 - protein, 8 aa, Japanese encephalitis virus
WNVMDTAC

SEQ ID NO: 217703 - protein, 8 aa, Japanese encephalitis virus
NVMDTACL

SEQ ID NO: 217704 - protein, 8 aa, Japanese encephalitis virus
VRDTACLA

SEQ ID NO: 217705 - protein, 8 aa, Japanese encephalitis virus
RDTACLAK

SEQ ID NO: 217706 - protein, 8 aa, Japanese encephalitis virus
PKAYAQMW

SEQ ID NO: 217707 - protein, 8 aa, Japanese encephalitis virus
KAYAQMWV

SEQ ID NO: 217708 - protein, 8 aa, Japanese encephalitis virus
AYAQMWVL

SEQ ID NO: 217709 - protein, 8 aa, Japanese encephalitis virus
YAQMWVLL

SEQ ID NO: 217710 - protein, 8 aa, Japanese encephalitis virus
AQMWVLLY

SEQ ID NO: 217711 - protein, 8 aa, Japanese encephalitis virus
QMWVLLYF

SEQ ID NO: 217712 - protein, 8 aa, Japanese encephalitis virus
MWVLLYFH

SEQ ID NO: 217713 - protein, 8 aa, Japanese encephalitis virus
WVLLYFHR

SEQ ID NO: 217714 - protein, 8 aa, Japanese encephalitis virus
LYFHRRDQ

SEQ ID NO: 217715 - protein, 8 aa, Japanese encephalitis virus
YFHRRDQR

SEQ ID NO: 217716 - protein, 8 aa, Japanese encephalitis virus
FHRRDQRL

SEQ ID NO: 217717 - protein, 8 aa, Japanese encephalitis virus
HRRDLCLM

SEQ ID NO: 217718 - protein, 8 aa, Japanese encephalitis virus
RRDLCLMA

SEQ ID NO: 217719 - protein, 8 aa, Japanese encephalitis virus
RDLCLMAN

SEQ ID NO: 217720 - protein, 8 aa, Japanese encephalitis virus
DLCLMANA

SEQ ID NO: 217721 - protein, 8 aa, Japanese encephalitis virus
QRLMANAI

SEQ ID NO: 217722 - protein, 8 aa, Japanese encephalitis virus
AICSTVPV

SEQ ID NO: 217723 - protein, 8 aa, Japanese encephalitis virus
ICSAVPLD

SEQ ID NO: 217724 - protein, 8 aa, Japanese encephalitis virus
CSTVPVDW

SEQ ID NO: 217725 - protein, 8 aa, Japanese encephalitis virus
STVPVDWV

SEQ ID NO: 217726 - protein, 8 aa, Japanese encephalitis virus
TVPVDWVP

SEQ ID NO: 217727 - protein, 8 aa, Japanese encephalitis virus
VPLDWVPT

SEQ ID NO: 217728 - protein, 8 aa, Japanese encephalitis virus
PLDWVPTG

SEQ ID NO: 217729 - protein, 8 aa, Japanese encephalitis virus
LDWVPTGR

SEQ ID NO: 217730 - protein, 8 aa, Japanese encephalitis virus
IHSKGEWI

SEQ ID NO: 217731 - protein, 8 aa, Japanese encephalitis virus
GEWIPTED

SEQ ID NO: 217732 - protein, 8 aa, Japanese encephalitis virus
EWIPTEDM

SEQ ID NO: 217733 - protein, 8 aa, Japanese encephalitis virus
WIPTEDML

SEQ ID NO: 217734 - protein, 8 aa, Japanese encephalitis virus
IPTEDMLQ

SEQ ID NO: 217735 - protein, 8 aa, Japanese encephalitis virus
PTEDMLQV

SEQ ID NO: 217736 - protein, 8 aa, Japanese encephalitis virus
IEENEWMT

SEQ ID NO: 217737 - protein, 8 aa, Japanese encephalitis virus
EENEWMTD

SEQ ID NO: 217738 - protein, 8 aa, Japanese encephalitis virus
ENEWMMDM

SEQ ID NO: 217739 - protein, 8 aa, Japanese encephalitis virus
NEWMMDMT

SEQ ID NO: 217740 - protein, 8 aa, Japanese encephalitis virus
EWMEDKTP

SEQ ID NO: 217741 - protein, 8 aa, Japanese encephalitis virus
DKTPIASW

SEQ ID NO: 217742 - protein, 8 aa, Japanese encephalitis virus
MTPITSWT

SEQ ID NO: 217743 - protein, 8 aa, Japanese encephalitis virus
TPIASWTD

SEQ ID NO: 217744 - protein, 8 aa, Japanese encephalitis virus
PIASWTDV

SEQ ID NO: 217745 - protein, 8 aa, Japanese encephalitis virus
IASWTDVP

SEQ ID NO: 217746 - protein, 8 aa, Japanese encephalitis virus
GSLIGTRA

SEQ ID NO: 217747 - protein, 8 aa, Japanese encephalitis virus
SLIGTRSK

SEQ ID NO: 217748 - protein, 8 aa, Japanese encephalitis virus
LIGTRSKA

SEQ ID NO: 217749 - protein, 8 aa, Japanese encephalitis virus
IGTRSKAT

SEQ ID NO: 217750 - protein, 8 aa, Japanese encephalitis virus
GTRSKATW

SEQ ID NO: 217751 - protein, 8 aa, Japanese encephalitis virus
TRSKATWA

SEQ ID NO: 217752 - protein, 8 aa, Japanese encephalitis virus
RSKATWAE

SEQ ID NO: 217753 - protein, 8 aa, Japanese encephalitis virus
SKATWAEN

SEQ ID NO: 217754 - protein, 8 aa, Japanese encephalitis virus
RATWAENV

SEQ ID NO: 217755 - protein, 8 aa, Japanese encephalitis virus
INQVRAIL

SEQ ID NO: 217756 - protein, 8 aa, Japanese encephalitis virus
NQVRAILG

SEQ ID NO: 217757 - protein, 8 aa, Japanese encephalitis virus
QVRAILGK

SEQ ID NO: 217758 - protein, 8 aa, Japanese encephalitis virus
VRAILGKE

SEQ ID NO: 217759 - protein, 8 aa, Japanese encephalitis virus
RAILGKEN

SEQ ID NO: 217760 - protein, 8 aa, Japanese encephalitis virus
AIIGKETY

SEQ ID NO: 217761 - protein, 8 aa, Japanese encephalitis virus
ILGKENYV

SEQ ID NO: 217762 - protein, 8 aa, Japanese encephalitis virus
LGKENYVD

SEQ ID NO: 217763 - protein, 8 aa, Japanese encephalitis virus
GKEDYVDY

SEQ ID NO: 217764 - protein, 8 aa, Japanese encephalitis virus
KEDYVDYM

SEQ ID NO: 217765 - protein, 8 aa, Japanese encephalitis virus
ENYVDYML

SEQ ID NO: 217766 - protein, 8 aa, Japanese encephalitis virus
DYVDYMTS

SEQ ID NO: 217767 - protein, 8 aa, Japanese encephalitis virus
YVDYMLSL

SEQ ID NO: 217768 - protein, 8 aa, Japanese encephalitis virus
VDYMLSLR

SEQ ID NO: 217769 - protein, 8 aa, Japanese encephalitis virus
DYMLSLRR

SEQ ID NO: 217770 - protein, 8 aa, Japanese encephalitis virus
YMLSLRRY

SEQ ID NO: 217771 - protein, 8 aa, Japanese encephalitis virus
MDFPQRIE

SEQ ID NO: 217772 - protein, 8 aa, Japanese encephalitis virus
LSLRRYED

SEQ ID NO: 217773 - protein, 8 aa, Japanese encephalitis virus
PQRIEDVL

SEQ ID NO: 217774 - protein, 8 aa, Japanese encephalitis virus
QRIEDVLI

SEQ ID NO: 217775 - protein, 8 aa, Japanese encephalitis virus
RYEDVLTQ

SEQ ID NO: 217776 - protein, 8 aa, Japanese encephalitis virus
IEDVLIQE

SEQ ID NO: 217777 - protein, 8 aa, Japanese encephalitis virus
EDVLTQED

SEQ ID NO: 217778 - protein, 8 aa, Japanese encephalitis virus
DVLTQEDR

SEQ ID NO: 217779 - protein, 8 aa, Japanese encephalitis virus
VSIQEDRV

SEQ ID NO: 217780 - protein, 8 aa, Japanese encephalitis virus
SIQEDRVI

SEQ ID NO: 217781 - protein, 8 aa, Japanese encephalitis virus
KPGGPGKS

SEQ ID NO: 217782 - protein, 8 aa, Japanese encephalitis virus
PGGPGKSR

SEQ ID NO: 217783 - protein, 8 aa, Japanese encephalitis virus
GGPGKSRA

SEQ ID NO: 217784 - protein, 8 aa, Japanese encephalitis virus
GPGKSRAI

SEQ ID NO: 217785 - protein, 8 aa, Japanese encephalitis virus
PGINRAIY

SEQ ID NO: 217786 - protein, 8 aa, Japanese encephalitis virus
GKSRAINM

SEQ ID NO: 217787 - protein, 8 aa, Japanese encephalitis virus
KSRAINML

SEQ ID NO: 217788 - protein, 8 aa, Japanese encephalitis virus
VGVKRVVI

SEQ ID NO: 217789 - protein, 8 aa, Japanese encephalitis virus
RVKRVVMS

SEQ ID NO: 217790 - protein, 8 aa, Japanese encephalitis virus
PVRFVLAF

SEQ ID NO: 217791 - protein, 8 aa, Japanese encephalitis virus
LRFVLALV

SEQ ID NO: 217792 - protein, 8 aa, Japanese encephalitis virus
RFVLALVS

SEQ ID NO: 217793 - protein, 8 aa, Japanese encephalitis virus
FVLAFITF

SEQ ID NO: 217794 - protein, 8 aa, Japanese encephalitis virus
VLAFITFF

SEQ ID NO: 217795 - protein, 8 aa, Japanese encephalitis virus
LALVSFFK

SEQ ID NO: 217796 - protein, 8 aa, Japanese encephalitis virus
AFITFFKF

SEQ ID NO: 217797 - protein, 8 aa, Japanese encephalitis virus
LVSFFKFT

SEQ ID NO: 217798 - protein, 8 aa, Japanese encephalitis virus
LLGRWRAL

SEQ ID NO: 217799 - protein, 8 aa, Japanese encephalitis virus
LGRWRALE

SEQ ID NO: 217800 - protein, 8 aa, Japanese encephalitis virus
GRWKAVER

SEQ ID NO: 217801 - protein, 8 aa, Japanese encephalitis virus
RWRALEKS

SEQ ID NO: 217802 - protein, 8 aa, Japanese encephalitis virus
WRALEKSV

SEQ ID NO: 217803 - protein, 8 aa, Japanese encephalitis virus
RALEKSVA

SEQ ID NO: 217804 - protein, 8 aa, Japanese encephalitis virus
ELGILIDA

SEQ ID NO: 217805 - protein, 8 aa, Japanese encephalitis virus
LGTLIDGV

SEQ ID NO: 217806 - protein, 8 aa, Japanese encephalitis virus
GTLIDVVN

SEQ ID NO: 217807 - protein, 8 aa, Japanese encephalitis virus
TLIDVVNK

SEQ ID NO: 217808 - protein, 8 aa, Japanese encephalitis virus
LIDTVNKR

SEQ ID NO: 217809 - protein, 8 aa, Japanese encephalitis virus
IDVVNKRG

SEQ ID NO: 217810 - protein, 8 aa, Japanese encephalitis virus
DTVNKRGR

SEQ ID NO: 217811 - protein, 8 aa, Japanese encephalitis virus
GVNKRGRK

SEQ ID NO: 217812 - protein, 8 aa, Japanese encephalitis virus
NKRGGNER

SEQ ID NO: 217813 - protein, 8 aa, Japanese encephalitis virus
IMWLASVA

SEQ ID NO: 217814 - protein, 8 aa, Japanese encephalitis virus
VGALKLSN

SEQ ID NO: 217815 - protein, 8 aa, Japanese encephalitis virus
GAIKLSNF

SEQ ID NO: 217816 - protein, 8 aa, Japanese encephalitis virus
ALKLSNFQ

SEQ ID NO: 217817 - protein, 8 aa, Japanese encephalitis virus
IKLSNFQG

SEQ ID NO: 217818 - protein, 8 aa, Japanese encephalitis virus
TGNDPEDV

SEQ ID NO: 217819 - protein, 8 aa, Japanese encephalitis virus
CDHQEVYV

SEQ ID NO: 217820 - protein, 8 aa, Japanese encephalitis virus
DNQEVYIQ

SEQ ID NO: 217821 - protein, 8 aa, Japanese encephalitis virus
NQEVYIQY

SEQ ID NO: 217822 - protein, 8 aa, Japanese encephalitis virus
TSHSQTSR

SEQ ID NO: 217823 - protein, 8 aa, Japanese encephalitis virus
RHSKRSKR

SEQ ID NO: 217824 - protein, 8 aa, Japanese encephalitis virus
HSKRSKRS

SEQ ID NO: 217825 - protein, 8 aa, Japanese encephalitis virus
SKRSKRSV

SEQ ID NO: 217826 - protein, 8 aa, Japanese encephalitis virus
KRSKRSVS

SEQ ID NO: 217827 - protein, 8 aa, Japanese encephalitis virus
TSRRSVSV

SEQ ID NO: 217828 - protein, 8 aa, Japanese encephalitis virus
SKRSVSVQ

SEQ ID NO: 217829 - protein, 8 aa, Japanese encephalitis virus
RRSVSVQP

SEQ ID NO: 217830 - protein, 8 aa, Japanese encephalitis virus
RSLVNKKE

SEQ ID NO: 217831 - protein, 8 aa, Japanese encephalitis virus
EAWLDSTR

SEQ ID NO: 217832 - protein, 8 aa, Japanese encephalitis virus
TKATRYLV

SEQ ID NO: 217833 - protein, 8 aa, Japanese encephalitis virus
KATRYLVK

SEQ ID NO: 217834 - protein, 8 aa, Japanese encephalitis virus
VKTENWIV

SEQ ID NO: 217835 - protein, 8 aa, Japanese encephalitis virus
TLGWMLGS

SEQ ID NO: 217836 - protein, 8 aa, Japanese encephalitis virus
GWMLGSTN

SEQ ID NO: 217837 - protein, 8 aa, Japanese encephalitis virus
WMLGSTNG

SEQ ID NO: 217838 - protein, 8 aa, Japanese encephalitis virus
GPRVVFTI

SEQ ID NO: 217839 - protein, 8 aa, Japanese encephalitis virus
PRVVFTIL

SEQ ID NO: 217840 - protein, 8 aa, Japanese encephalitis virus
GNRDFVEG

SEQ ID NO: 217841 - protein, 8 aa, Japanese encephalitis virus
NRDFVEGA

SEQ ID NO: 217842 - protein, 8 aa, Japanese encephalitis virus
RDFVEGAS

SEQ ID NO: 217843 - protein, 8 aa, Japanese encephalitis virus
DFVEGASG

SEQ ID NO: 217844 - protein, 8 aa, Japanese encephalitis virus
FIERASGA

SEQ ID NO: 217845 - protein, 8 aa, Japanese encephalitis virus
IEGVSGAT

SEQ ID NO: 217846 - protein, 8 aa, Japanese encephalitis virus
ERASGATW

SEQ ID NO: 217847 - protein, 8 aa, Japanese encephalitis virus
NDKPTLDR

SEQ ID NO: 217848 - protein, 8 aa, Japanese encephalitis virus
GEAHNEKG

SEQ ID NO: 217849 - protein, 8 aa, Japanese encephalitis virus
EAHNEKQA

SEQ ID NO: 217850 - protein, 8 aa, Japanese encephalitis virus
AHNEKQAD

SEQ ID NO: 217851 - protein, 8 aa, Japanese encephalitis virus
HNEKGADS

SEQ ID NO: 217852 - protein, 8 aa, Japanese encephalitis virus
NKKRADSS

SEQ ID NO: 217853 - protein, 8 aa, Japanese encephalitis virus
EKGADSSY

SEQ ID NO: 217854 - protein, 8 aa, Japanese encephalitis virus
GWGKGCGL

SEQ ID NO: 217855 - protein, 8 aa, Japanese encephalitis virus
WRNGCGLF

SEQ ID NO: 217856 - protein, 8 aa, Japanese encephalitis virus
GKGCGLFG

SEQ ID NO: 217857 - protein, 8 aa, Japanese encephalitis virus
KGCGLFGK

SEQ ID NO: 217858 - protein, 8 aa, Japanese encephalitis virus
FSCTSKAT

SEQ ID NO: 217859 - protein, 8 aa, Japanese encephalitis virus
SCTSKATG

SEQ ID NO: 217860 - protein, 8 aa, Japanese encephalitis virus
CTSKATGK

SEQ ID NO: 217861 - protein, 8 aa, Japanese encephalitis virus
KAIERTIQ

SEQ ID NO: 217862 - protein, 8 aa, Japanese encephalitis virus
AIQPENIK

SEQ ID NO: 217863 - protein, 8 aa, Japanese encephalitis virus
QSENIKYE

SEQ ID NO: 217864 - protein, 8 aa, Japanese encephalitis virus
SENIKYEV

SEQ ID NO: 217865 - protein, 8 aa, Japanese encephalitis virus
NYSAQVGV

SEQ ID NO: 217866 - protein, 8 aa, Japanese encephalitis virus
YTAQIGAS

SEQ ID NO: 217867 - protein, 8 aa, Japanese encephalitis virus
TAQIGASQ

SEQ ID NO: 217868 - protein, 8 aa, Japanese encephalitis virus
AQVGVSQA

SEQ ID NO: 217869 - protein, 8 aa, Japanese encephalitis virus
QVGVSQAA

SEQ ID NO: 217870 - protein, 8 aa, Japanese encephalitis virus
VGVSQAAK

SEQ ID NO: 217871 - protein, 8 aa, Japanese encephalitis virus
GVSQAAKF

SEQ ID NO: 217872 - protein, 8 aa, Japanese encephalitis virus
ASQAARFT

SEQ ID NO: 217873 - protein, 8 aa, Japanese encephalitis virus
VTPNAPST

SEQ ID NO: 217874 - protein, 8 aa, Japanese encephalitis virus
TPNAPSVT

SEQ ID NO: 217875 - protein, 8 aa, Japanese encephalitis virus
PNAPSVAL

SEQ ID NO: 217876 - protein, 8 aa, Japanese encephalitis virus
NAPSVTLK

SEQ ID NO: 217877 - protein, 8 aa, Japanese encephalitis virus
APSVTLEL

SEQ ID NO: 217878 - protein, 8 aa, Japanese encephalitis virus
PSVTLELG

SEQ ID NO: 217879 - protein, 8 aa, Japanese encephalitis virus
SVTLELGD

SEQ ID NO: 217880 - protein, 8 aa, Japanese encephalitis virus
TLELGDYG

SEQ ID NO: 217881 - protein, 8 aa, Japanese encephalitis virus
MTVGSKSL

SEQ ID NO: 217882 - protein, 8 aa, Japanese encephalitis virus
TVGSKSLL

SEQ ID NO: 217883 - protein, 8 aa, Japanese encephalitis virus
VGSKSLLV

SEQ ID NO: 217884 - protein, 8 aa, Japanese encephalitis virus
GSKSLLVH

SEQ ID NO: 217885 - protein, 8 aa, Japanese encephalitis virus
SKSLLVHR

SEQ ID NO: 217886 - protein, 8 aa, Japanese encephalitis virus
DLALPWSS

SEQ ID NO: 217887 - protein, 8 aa, Japanese encephalitis virus
LALPWTSS

SEQ ID NO: 217888 - protein, 8 aa, Japanese encephalitis virus
ALPWSSPS

SEQ ID NO: 217889 - protein, 8 aa, Japanese encephalitis virus
LPWSSPSS

SEQ ID NO: 217890 - protein, 8 aa, Japanese encephalitis virus
PWTSSSNT

SEQ ID NO: 217891 - protein, 8 aa, Japanese encephalitis virus
WTSSSNTA

SEQ ID NO: 217892 - protein, 8 aa, Japanese encephalitis virus
TSSSNTAW

SEQ ID NO: 217893 - protein, 8 aa, Japanese encephalitis virus
ALGSREGG

SEQ ID NO: 217894 - protein, 8 aa, Japanese encephalitis virus
LGSREGGL

SEQ ID NO: 217895 - protein, 8 aa, Japanese encephalitis virus
GSQEGSLH

SEQ ID NO: 217896 - protein, 8 aa, Japanese encephalitis virus
SQERALHQ

SEQ ID NO: 217897 - protein, 8 aa, Japanese encephalitis virus
QEGSLHQA

SEQ ID NO: 217898 - protein, 8 aa, Japanese encephalitis virus
EGSLHQAL

SEQ ID NO: 217899 - protein, 8 aa, Japanese encephalitis virus
RALHQALA

SEQ ID NO: 217900 - protein, 8 aa, Japanese encephalitis virus
SLHQALAG

SEQ ID NO: 217901 - protein, 8 aa, Japanese encephalitis virus
VEYPSSVK

SEQ ID NO: 217902 - protein, 8 aa, Japanese encephalitis virus
EYSNSVKL

SEQ ID NO: 217903 - protein, 8 aa, Japanese encephalitis virus
YPSSVKLT

SEQ ID NO: 217904 - protein, 8 aa, Japanese encephalitis virus
SNSVKLTS

SEQ ID NO: 217905 - protein, 8 aa, Japanese encephalitis virus
TTYGVCTE

SEQ ID NO: 217906 - protein, 8 aa, Japanese encephalitis virus
TYGVCTEK

SEQ ID NO: 217907 - protein, 8 aa, Japanese encephalitis virus
YGVCTEKF

SEQ ID NO: 217908 - protein, 8 aa, Japanese encephalitis virus
GMCTENSS

SEQ ID NO: 217909 - protein, 8 aa, Japanese encephalitis virus
VCTEKFSF

SEQ ID NO: 217910 - protein, 8 aa, Japanese encephalitis virus
CTENSSFR

SEQ ID NO: 217911 - protein, 8 aa, Japanese encephalitis virus
TENSSFRK

SEQ ID NO: 217912 - protein, 8 aa, Japanese encephalitis virus
ENSSFRKN

SEQ ID NO: 217913 - protein, 8 aa, Japanese encephalitis virus
IELSYSGR

SEQ ID NO: 217914 - protein, 8 aa, Japanese encephalitis virus
ELLYSGSD

SEQ ID NO: 217915 - protein, 8 aa, Japanese encephalitis virus
LSYSGRDG

SEQ ID NO: 217916 - protein, 8 aa, Japanese encephalitis virus
LYSGSDGP

SEQ ID NO: 217917 - protein, 8 aa, Japanese encephalitis virus
SVVSLNDM

SEQ ID NO: 217918 - protein, 8 aa, Japanese encephalitis virus
VANLNDMT

SEQ ID NO: 217919 - protein, 8 aa, Japanese encephalitis virus
VSLNDMTP

SEQ ID NO: 217920 - protein, 8 aa, Japanese encephalitis virus
SLNDMTPA

SEQ ID NO: 217921 - protein, 8 aa, Japanese encephalitis virus
ATSSSNSQ

SEQ ID NO: 217922 - protein, 8 aa, Japanese encephalitis virus
TSSSNSQV

SEQ ID NO: 217923 - protein, 8 aa, Japanese encephalitis virus
SSANSKAL

SEQ ID NO: 217924 - protein, 8 aa, Japanese encephalitis virus
SANSKALV

SEQ ID NO: 217925 - protein, 8 aa, Japanese encephalitis virus
SNSKVLLE

SEQ ID NO: 217926 - protein, 8 aa, Japanese encephalitis virus
NSQVLVEM

SEQ ID NO: 217927 - protein, 8 aa, Japanese encephalitis virus
SKVLLEIE

SEQ ID NO: 217928 - protein, 8 aa, Japanese encephalitis virus
QVLVEMEP

SEQ ID NO: 217929 - protein, 8 aa, Japanese encephalitis virus
SYIVVGMG

SEQ ID NO: 217930 - protein, 8 aa, Japanese encephalitis virus
KQISHHWH

SEQ ID NO: 217931 - protein, 8 aa, Japanese encephalitis virus
QISHHWHK

SEQ ID NO: 217932 - protein, 8 aa, Japanese encephalitis virus
HHWHKPGS

SEQ ID NO: 217933 - protein, 8 aa, Japanese encephalitis virus
HWYKAGST

SEQ ID NO: 217934 - protein, 8 aa, Japanese encephalitis virus
RHKAGSTL

SEQ ID NO: 217935 - protein, 8 aa, Japanese encephalitis virus
HKPGSTLG

SEQ ID NO: 217936 - protein, 8 aa, Japanese encephalitis virus
DFGSIGGI

SEQ ID NO: 217937 - protein, 8 aa, Japanese encephalitis virus
FGSIGGAF

SEQ ID NO: 217938 - protein, 8 aa, Japanese encephalitis virus
GSIGGAFN

SEQ ID NO: 217939 - protein, 8 aa, Japanese encephalitis virus
SIGRVFNS

SEQ ID NO: 217940 - protein, 8 aa, Japanese encephalitis virus
IGGIFNSI

SEQ ID NO: 217941 - protein, 8 aa, Japanese encephalitis virus
GGAFNSIG

SEQ ID NO: 217942 - protein, 8 aa, Japanese encephalitis virus
GAFNSIGK

SEQ ID NO: 217943 - protein, 8 aa, Japanese encephalitis virus
IFNSIGKA

SEQ ID NO: 217944 - protein, 8 aa, Japanese encephalitis virus
DTGSAIDI

SEQ ID NO: 217945 - protein, 8 aa, Japanese encephalitis virus
TGSAIDIT

SEQ ID NO: 217946 - protein, 8 aa, Japanese encephalitis virus
GCAIDVTR

SEQ ID NO: 217947 - protein, 8 aa, Japanese encephalitis virus
TRNQMRCG

SEQ ID NO: 217948 - protein, 8 aa, Japanese encephalitis virus
KIVHKAYK

SEQ ID NO: 217949 - protein, 8 aa, Japanese encephalitis virus
IVHKAYKE

SEQ ID NO: 217950 - protein, 8 aa, Japanese encephalitis virus
VHKAYKEG

SEQ ID NO: 217951 - protein, 8 aa, Japanese encephalitis virus
HKAHMEGI

SEQ ID NO: 217952 - protein, 8 aa, Japanese encephalitis virus
KAHMEGVC

SEQ ID NO: 217953 - protein, 8 aa, Japanese encephalitis virus
AHMEGICG

SEQ ID NO: 217954 - protein, 8 aa, Japanese encephalitis virus
HMEGVCGV

SEQ ID NO: 217955 - protein, 8 aa, Japanese encephalitis virus
KEGVCGIR

SEQ ID NO: 217956 - protein, 8 aa, Japanese encephalitis virus
SLLFAPEL

SEQ ID NO: 217957 - protein, 8 aa, Japanese encephalitis virus
LLFAPELA

SEQ ID NO: 217958 - protein, 8 aa, Japanese encephalitis virus
TKECPDEQ

SEQ ID NO: 217959 - protein, 8 aa, Japanese encephalitis virus
KECPDEQR

SEQ ID NO: 217960 - protein, 8 aa, Japanese encephalitis virus
ECPDEQRA

SEQ ID NO: 217961 - protein, 8 aa, Japanese encephalitis virus
CPDEQRAW

SEQ ID NO: 217962 - protein, 8 aa, Japanese encephalitis virus
PVVHRAWN

SEQ ID NO: 217963 - protein, 8 aa, Japanese encephalitis virus
DEQRAWNS

SEQ ID NO: 217964 - protein, 8 aa, Japanese encephalitis virus
VHRAWNSM

SEQ ID NO: 217965 - protein, 8 aa, Japanese encephalitis virus
RRAWNSTQ

SEQ ID NO: 217966 - protein, 8 aa, Japanese encephalitis virus
TTDECDGA

SEQ ID NO: 217967 - protein, 8 aa, Japanese encephalitis virus
TAIKGHVA

SEQ ID NO: 217968 - protein, 8 aa, Japanese encephalitis virus
AVKGHVTV

SEQ ID NO: 217969 - protein, 8 aa, Japanese encephalitis virus
VKGHVALH

SEQ ID NO: 217970 - protein, 8 aa, Japanese encephalitis virus
KGHVTVHS

SEQ ID NO: 217971 - protein, 8 aa, Japanese encephalitis virus
GHVALHSD

SEQ ID NO: 217972 - protein, 8 aa, Japanese encephalitis virus
HVTVHSDV

SEQ ID NO: 217973 - protein, 8 aa, Japanese encephalitis virus
LSYWIESH

SEQ ID NO: 217974 - protein, 8 aa, Japanese encephalitis virus
SYWIGSRY

SEQ ID NO: 217975 - protein, 8 aa, Japanese encephalitis virus
YWIESHLN

SEQ ID NO: 217976 - protein, 8 aa, Japanese encephalitis virus
WIGSRYND

SEQ ID NO: 217977 - protein, 8 aa, Japanese encephalitis virus
NDSWKLER

SEQ ID NO: 217978 - protein, 8 aa, Japanese encephalitis virus
DTWKRERA

SEQ ID NO: 217979 - protein, 8 aa, Japanese encephalitis virus
TRKLERAV

SEQ ID NO: 217980 - protein, 8 aa, Japanese encephalitis virus
WKRERAVF

SEQ ID NO: 217981 - protein, 8 aa, Japanese encephalitis virus
ERAVFEEV

SEQ ID NO: 217982 - protein, 8 aa, Japanese encephalitis virus
RAVFEEVK

SEQ ID NO: 217983 - protein, 8 aa, Japanese encephalitis virus
LVFGEVKS

SEQ ID NO: 217984 - protein, 8 aa, Japanese encephalitis virus
HTLWGDDA

SEQ ID NO: 217985 - protein, 8 aa, Japanese encephalitis virus
TLWGDDAE

SEQ ID NO: 217986 - protein, 8 aa, Japanese encephalitis virus
GDDAEESE

SEQ ID NO: 217987 - protein, 8 aa, Japanese encephalitis virus
DGVEESDL

SEQ ID NO: 217988 - protein, 8 aa, Japanese encephalitis virus
GVEESDLV

SEQ ID NO: 217989 - protein, 8 aa, Japanese encephalitis virus
DLVIPHTI

SEQ ID NO: 217990 - protein, 8 aa, Japanese encephalitis virus
LVIPHTIA

SEQ ID NO: 217991 - protein, 8 aa, Japanese encephalitis virus
VIPHTIAG

SEQ ID NO: 217992 - protein, 8 aa, Japanese encephalitis virus
PDTIAGPK

SEQ ID NO: 217993 - protein, 8 aa, Japanese encephalitis virus
DTIAGPKS

SEQ ID NO: 217994 - protein, 8 aa, Japanese encephalitis virus
HNQREGYK

SEQ ID NO: 217995 - protein, 8 aa, Japanese encephalitis virus
NQREGYKT

SEQ ID NO: 217996 - protein, 8 aa, Japanese encephalitis virus
RREGYMTQ

SEQ ID NO: 217997 - protein, 8 aa, Japanese encephalitis virus
NQGPWDEK

SEQ ID NO: 217998 - protein, 8 aa, Japanese encephalitis virus
QGPWDESG

SEQ ID NO: 217999 - protein, 8 aa, Japanese encephalitis virus
GPWDEKGI

SEQ ID NO: 218000 - protein, 8 aa, Japanese encephalitis virus
PWDESGIV

SEQ ID NO: 218001 - protein, 8 aa, Japanese encephalitis virus
WDEDGIVL

SEQ ID NO: 218002 - protein, 8 aa, Japanese encephalitis virus
DEDGIVLD

SEQ ID NO: 218003 - protein, 8 aa, Japanese encephalitis virus
EKGIVLDF

SEQ ID NO: 218004 - protein, 8 aa, Japanese encephalitis virus
NGLVPGLD

SEQ ID NO: 218005 - protein, 8 aa, Japanese encephalitis virus
CGKRAPWV

SEQ ID NO: 218006 - protein, 8 aa, Japanese encephalitis virus
GKRAPWVR

SEQ ID NO: 218007 - protein, 8 aa, Japanese encephalitis virus
KRGPSLRT

SEQ ID NO: 218008 - protein, 8 aa, Japanese encephalitis virus
RGPSLRTT

SEQ ID NO: 218009 - protein, 8 aa, Japanese encephalitis virus
GPSLRTTT

SEQ ID NO: 218010 - protein, 8 aa, Japanese encephalitis virus
PWVRTTTD

SEQ ID NO: 218011 - protein, 8 aa, Japanese encephalitis virus
SLRTTTDS

SEQ ID NO: 218012 - protein, 8 aa, Japanese encephalitis virus
LRTTTDSG

SEQ ID NO: 218013 - protein, 8 aa, Japanese encephalitis virus
SCTLPPLR

SEQ ID NO: 218014 - protein, 8 aa, Japanese encephalitis virus
PPLRFRTD

SEQ ID NO: 218015 - protein, 8 aa, Japanese encephalitis virus
PLRFRTDN

SEQ ID NO: 218016 - protein, 8 aa, Japanese encephalitis virus
LRFRTGSG

SEQ ID NO: 218017 - protein, 8 aa, Japanese encephalitis virus
RFRTGSGC

SEQ ID NO: 218018 - protein, 8 aa, Japanese encephalitis virus
YGMEVRPV

SEQ ID NO: 218019 - protein, 8 aa, Japanese encephalitis virus
GHDETTLV

SEQ ID NO: 218020 - protein, 8 aa, Japanese encephalitis virus
ETTLVRWQ

SEQ ID NO: 218021 - protein, 8 aa, Japanese encephalitis virus
TTLVRSRV

SEQ ID NO: 218022 - protein, 8 aa, Japanese encephalitis virus
TLVRWQVD

SEQ ID NO: 218023 - protein, 8 aa, Japanese encephalitis virus
LVRSQADA

SEQ ID NO: 218024 - protein, 8 aa, Japanese encephalitis virus
SGEMIDPF

SEQ ID NO: 218025 - protein, 8 aa, Japanese encephalitis virus
GMVDPFQL

SEQ ID NO: 218026 - protein, 8 aa, Japanese encephalitis virus
AVFAEANS

SEQ ID NO: 218027 - protein, 8 aa, Japanese encephalitis virus
VFAEANSG

SEQ ID NO: 218028 - protein, 8 aa, Japanese encephalitis virus
QPAFLVAN

SEQ ID NO: 218029 - protein, 8 aa, Japanese encephalitis virus
PAFLVANM

SEQ ID NO: 218030 - protein, 8 aa, Japanese encephalitis virus
AFLAMNTL

SEQ ID NO: 218031 - protein, 8 aa, Japanese encephalitis virus
FLVANMLS

SEQ ID NO: 218032 - protein, 8 aa, Japanese encephalitis virus
LAMKMLST

SEQ ID NO: 218033 - protein, 8 aa, Japanese encephalitis virus
NMLSAKWT

SEQ ID NO: 218034 - protein, 8 aa, Japanese encephalitis virus
TLSTRWTN

SEQ ID NO: 218035 - protein, 8 aa, Japanese encephalitis virus
WTNQENMV

SEQ ID NO: 218036 - protein, 8 aa, Japanese encephalitis virus
TNQENVIL

SEQ ID NO: 218037 - protein, 8 aa, Japanese encephalitis virus
NQENVILV

SEQ ID NO: 218038 - protein, 8 aa, Japanese encephalitis virus
QENMVLVL

SEQ ID NO: 218039 - protein, 8 aa, Japanese encephalitis virus
ENVILVLG

SEQ ID NO: 218040 - protein, 8 aa, Japanese encephalitis virus
NVILVLGA

SEQ ID NO: 218041 - protein, 8 aa, Japanese encephalitis virus
VILVLGAA

SEQ ID NO: 218042 - protein, 8 aa, Japanese encephalitis virus
ILVLGAAF

SEQ ID NO: 218043 - protein, 8 aa, Japanese encephalitis virus
AFFQLASM

SEQ ID NO: 218044 - protein, 8 aa, Japanese encephalitis virus
FFQLASMD

SEQ ID NO: 218045 - protein, 8 aa, Japanese encephalitis virus
TFPTTSTI

SEQ ID NO: 218046 - protein, 8 aa, Japanese encephalitis virus
FPTTSTIT

SEQ ID NO: 218047 - protein, 8 aa, Japanese encephalitis virus
PTTSTVTM

SEQ ID NO: 218048 - protein, 8 aa, Japanese encephalitis virus
TTSTVTMP

SEQ ID NO: 218049 - protein, 8 aa, Japanese encephalitis virus
MPLLALLA

SEQ ID NO: 218050 - protein, 8 aa, Japanese encephalitis virus
PVLTLLTP

SEQ ID NO: 218051 - protein, 8 aa, Japanese encephalitis virus
LLALLAPG

SEQ ID NO: 218052 - protein, 8 aa, Japanese encephalitis virus
TLLTPGMR

SEQ ID NO: 218053 - protein, 8 aa, Japanese encephalitis virus
LAPGMRAL

SEQ ID NO: 218054 - protein, 8 aa, Japanese encephalitis virus
TPGMKALY

SEQ ID NO: 218055 - protein, 8 aa, Japanese encephalitis virus
PGMRAFDL

SEQ ID NO: 218056 - protein, 8 aa, Japanese encephalitis virus
GMKALYLD

SEQ ID NO: 218057 - protein, 8 aa, Japanese encephalitis virus
MRAFDLDT

SEQ ID NO: 218058 - protein, 8 aa, Japanese encephalitis virus
KALYLDTY

SEQ ID NO: 218059 - protein, 8 aa, Japanese encephalitis virus
VIGICSLQ

SEQ ID NO: 218060 - protein, 8 aa, Japanese encephalitis virus
IGICSLQQ

SEQ ID NO: 218061 - protein, 8 aa, Japanese encephalitis virus
GICSLQQE

SEQ ID NO: 218062 - protein, 8 aa, Japanese encephalitis virus
ICSLQQER

SEQ ID NO: 218063 - protein, 8 aa, Japanese encephalitis virus
CSLQQERK

SEQ ID NO: 218064 - protein, 8 aa, Japanese encephalitis virus
EREKTMAK

SEQ ID NO: 218065 - protein, 8 aa, Japanese encephalitis virus
RRRTMAKK

SEQ ID NO: 218066 - protein, 8 aa, Japanese encephalitis virus
RRTMAKKK

SEQ ID NO: 218067 - protein, 8 aa, Japanese encephalitis virus
WLERAADV

SEQ ID NO: 218068 - protein, 8 aa, Japanese encephalitis virus
LEQAADIS

SEQ ID NO: 218069 - protein, 8 aa, Japanese encephalitis virus
EQAADISW

SEQ ID NO: 218070 - protein, 8 aa, Japanese encephalitis virus
RAADVSWE

SEQ ID NO: 218071 - protein, 8 aa, Japanese encephalitis virus
AADVSWEM

SEQ ID NO: 218072 - protein, 8 aa, Japanese encephalitis virus
SWEMGAAI

SEQ ID NO: 218073 - protein, 8 aa, Japanese encephalitis virus
WGMDAAIT

SEQ ID NO: 218074 - protein, 8 aa, Japanese encephalitis virus
EMGAAITG

SEQ ID NO: 218075 - protein, 8 aa, Japanese encephalitis virus
WKVWVLRT

SEQ ID NO: 218076 - protein, 8 aa, Japanese encephalitis virus
KIWLLRMS

SEQ ID NO: 218077 - protein, 8 aa, Japanese encephalitis virus
VWVLRTSC

SEQ ID NO: 218078 - protein, 8 aa, Japanese encephalitis virus
WVLRTSCI

SEQ ID NO: 218079 - protein, 8 aa, Japanese encephalitis virus
VLRMSCSG

SEQ ID NO: 218080 - protein, 8 aa, Japanese encephalitis virus
LRMSCSGL

SEQ ID NO: 218081 - protein, 8 aa, Japanese encephalitis virus
RMSCSGLA

SEQ ID NO: 218082 - protein, 8 aa, Japanese encephalitis virus
MSCIGLVA

SEQ ID NO: 218083 - protein, 8 aa, Japanese encephalitis virus
SCICLAAL

SEQ ID NO: 218084 - protein, 8 aa, Japanese encephalitis virus
CIGLVALT

SEQ ID NO: 218085 - protein, 8 aa, Japanese encephalitis virus
SGLAALTP

SEQ ID NO: 218086 - protein, 8 aa, Japanese encephalitis virus
GVGVIYEN

SEQ ID NO: 218087 - protein, 8 aa, Japanese encephalitis virus
VGVIYENV

SEQ ID NO: 218088 - protein, 8 aa, Japanese encephalitis virus
GVMYQNVF

SEQ ID NO: 218089 - protein, 8 aa, Japanese encephalitis virus
VMYQNVFH

SEQ ID NO: 218090 - protein, 8 aa, Japanese encephalitis virus
MYENVLHT

SEQ ID NO: 218091 - protein, 8 aa, Japanese encephalitis virus
YESVFHTL

SEQ ID NO: 218092 - protein, 8 aa, Japanese encephalitis virus
ESVFHTLW

SEQ ID NO: 218093 - protein, 8 aa, Japanese encephalitis virus
PTRGAAIM

SEQ ID NO: 218094 - protein, 8 aa, Japanese encephalitis virus
GAAIMSGG

SEQ ID NO: 218095 - protein, 8 aa, Japanese encephalitis virus
AAIMSGGG

SEQ ID NO: 218096 - protein, 8 aa, Japanese encephalitis virus
AIMSGGGK

SEQ ID NO: 218097 - protein, 8 aa, Japanese encephalitis virus
IMSGKGKL

SEQ ID NO: 218098 - protein, 8 aa, Japanese encephalitis virus
MSGKGKLT

SEQ ID NO: 218099 - protein, 8 aa, Japanese encephalitis virus
IVVEPGKV

SEQ ID NO: 218100 - protein, 8 aa, Japanese encephalitis virus
VVEQGKPA

SEQ ID NO: 218101 - protein, 8 aa, Japanese encephalitis virus
AANIQTKP

SEQ ID NO: 218102 - protein, 8 aa, Japanese encephalitis virus
TNIQTKPG

SEQ ID NO: 218103 - protein, 8 aa, Japanese encephalitis virus
SIQTKPGV

SEQ ID NO: 218104 - protein, 8 aa, Japanese encephalitis virus
TKPGIFPP

SEQ ID NO: 218105 - protein, 8 aa, Japanese encephalitis virus
KPGIFPPP

SEQ ID NO: 218106 - protein, 8 aa, Japanese encephalitis virus
PGIFPPPF

SEQ ID NO: 218107 - protein, 8 aa, Japanese encephalitis virus
GVFRTPLG

SEQ ID NO: 218108 - protein, 8 aa, Japanese encephalitis virus
PFGKVGAV

SEQ ID NO: 218109 - protein, 8 aa, Japanese encephalitis virus
FGKVGAVS

SEQ ID NO: 218110 - protein, 8 aa, Japanese encephalitis virus
GKVGTVSL

SEQ ID NO: 218111 - protein, 8 aa, Japanese encephalitis virus
KVGAVSLD

SEQ ID NO: 218112 - protein, 8 aa, Japanese encephalitis virus
IPEAYNPS

SEQ ID NO: 218113 - protein, 8 aa, Japanese encephalitis virus
PEAYTPSM

SEQ ID NO: 218114 - protein, 8 aa, Japanese encephalitis virus
EAYTPTML

SEQ ID NO: 218115 - protein, 8 aa, Japanese encephalitis virus
AYTPTMLR

SEQ ID NO: 218116 - protein, 8 aa, Japanese encephalitis virus
YTPTMLRK

SEQ ID NO: 218117 - protein, 8 aa, Japanese encephalitis virus
PTMLRKRQ

SEQ ID NO: 218118 - protein, 8 aa, Japanese encephalitis virus
MLKKKQMT

SEQ ID NO: 218119 - protein, 8 aa, Japanese encephalitis virus
LKKKQMTV

SEQ ID NO: 218120 - protein, 8 aa, Japanese encephalitis virus
KKKQMTVL

SEQ ID NO: 218121 - protein, 8 aa, Japanese encephalitis virus
HPGLGKTR

SEQ ID NO: 218122 - protein, 8 aa, Japanese encephalitis virus
LQDETPDR

SEQ ID NO: 218123 - protein, 8 aa, Japanese encephalitis virus
QDETPDRA

SEQ ID NO: 218124 - protein, 8 aa, Japanese encephalitis virus
DETPDRAW

SEQ ID NO: 218125 - protein, 8 aa, Japanese encephalitis virus
ETPDRAWS

SEQ ID NO: 218126 - protein, 8 aa, Japanese encephalitis virus
TPDRAWSS

SEQ ID NO: 218127 - protein, 8 aa, Japanese encephalitis virus
WITEYSGK

SEQ ID NO: 218128 - protein, 8 aa, Japanese encephalitis virus
ITEYSGKT

SEQ ID NO: 218129 - protein, 8 aa, Japanese encephalitis virus
VKPIILEE

SEQ ID NO: 218130 - protein, 8 aa, Japanese encephalitis virus
KPIILEEG

SEQ ID NO: 218131 - protein, 8 aa, Japanese encephalitis virus
GATSEGDS

SEQ ID NO: 218132 - protein, 8 aa, Japanese encephalitis virus
PTSEDDSN

SEQ ID NO: 218133 - protein, 8 aa, Japanese encephalitis virus
EKAFTMDV

SEQ ID NO: 218134 - protein, 8 aa, Japanese encephalitis virus
KALTMDGE

SEQ ID NO: 218135 - protein, 8 aa, Japanese encephalitis virus
AFTMDVEY

SEQ ID NO: 218136 - protein, 8 aa, Japanese encephalitis virus
LTMDGEYR

SEQ ID NO: 218137 - protein, 8 aa, Japanese encephalitis virus
ASGKRSAV

SEQ ID NO: 218138 - protein, 8 aa, Japanese encephalitis virus
AGKRSATS

SEQ ID NO: 218139 - protein, 8 aa, Japanese encephalitis virus
SAVSFIEE

SEQ ID NO: 218140 - protein, 8 aa, Japanese encephalitis virus
AISFIEVR

SEQ ID NO: 218141 - protein, 8 aa, Japanese encephalitis virus
ISFIEVRG

SEQ ID NO: 218142 - protein, 8 aa, Japanese encephalitis virus
TAEKGGKT

SEQ ID NO: 218143 - protein, 8 aa, Japanese encephalitis virus
AEKGGKTH

SEQ ID NO: 218144 - protein, 8 aa, Japanese encephalitis virus
EKSGKAHR

SEQ ID NO: 218145 - protein, 8 aa, Japanese encephalitis virus
KSGKAHRM

SEQ ID NO: 218146 - protein, 8 aa, Japanese encephalitis virus
LETITLTV

SEQ ID NO: 218147 - protein, 8 aa, Japanese encephalitis virus
ETVTLIVA

SEQ ID NO: 218148 - protein, 8 aa, Japanese encephalitis virus
TITLTVAI

SEQ ID NO: 218149 - protein, 8 aa, Japanese encephalitis virus
AITAMTGG

SEQ ID NO: 218150 - protein, 8 aa, Japanese encephalitis virus
IAVMTGGF

SEQ ID NO: 218151 - protein, 8 aa, Japanese encephalitis virus
TVMTRGFF

SEQ ID NO: 218152 - protein, 8 aa, Japanese encephalitis virus
MQRKGIEK

SEQ ID NO: 218153 - protein, 8 aa, Japanese encephalitis virus
PEPEKQRL

SEQ ID NO: 218154 - protein, 8 aa, Japanese encephalitis virus
EPEKQKSQ

SEQ ID NO: 218155 - protein, 8 aa, Japanese encephalitis virus
PEKQKSQT

SEQ ID NO: 218156 - protein, 8 aa, Japanese encephalitis virus
EKQRSQTG

SEQ ID NO: 218157 - protein, 8 aa, Japanese encephalitis virus
KQKSQTDN

SEQ ID NO: 218158 - protein, 8 aa, Japanese encephalitis virus
QRLQTDNQ

SEQ ID NO: 218159 - protein, 8 aa, Japanese encephalitis virus
RSQTGNQL

SEQ ID NO: 218160 - protein, 8 aa, Japanese encephalitis virus
ADIKSMFA

SEQ ID NO: 218161 - protein, 8 aa, Japanese encephalitis virus
DIKSMFAG

SEQ ID NO: 218162 - protein, 8 aa, Japanese encephalitis virus
LKSMFVGK

SEQ ID NO: 218163 - protein, 8 aa, Japanese encephalitis virus
KSMFVGKT

SEQ ID NO: 218164 - protein, 8 aa, Japanese encephalitis virus
SMFVGKTQ

SEQ ID NO: 218165 - protein, 8 aa, Japanese encephalitis virus
MFVGKTQA

SEQ ID NO: 218166 - protein, 8 aa, Japanese encephalitis virus
TQALGLTG

SEQ ID NO: 218167 - protein, 8 aa, Japanese encephalitis virus
PVSGMTGL

SEQ ID NO: 218168 - protein, 8 aa, Japanese encephalitis virus
VSGMTGLP

SEQ ID NO: 218169 - protein, 8 aa, Japanese encephalitis virus
SGMTGLPG

SEQ ID NO: 218170 - protein, 8 aa, Japanese encephalitis virus
LTGLPSVA

SEQ ID NO: 218171 - protein, 8 aa, Japanese encephalitis virus
TGLPSVAL

SEQ ID NO: 218172 - protein, 8 aa, Japanese encephalitis virus
GLPSVALD

SEQ ID NO: 218173 - protein, 8 aa, Japanese encephalitis virus
LPGMALDL

SEQ ID NO: 218174 - protein, 8 aa, Japanese encephalitis virus
PSVALDLR

SEQ ID NO: 218175 - protein, 8 aa, Japanese encephalitis virus
GMALDLRP

SEQ ID NO: 218176 - protein, 8 aa, Japanese encephalitis virus
GQITLTTV

SEQ ID NO: 218177 - protein, 8 aa, Japanese encephalitis virus
QITLTTVL

SEQ ID NO: 218178 - protein, 8 aa, Japanese encephalitis virus
ITLTTVLT

SEQ ID NO: 218179 - protein, 8 aa, Japanese encephalitis virus
LTTVLTAM

SEQ ID NO: 218180 - protein, 8 aa, Japanese encephalitis virus
TTVLTAMV

SEQ ID NO: 218181 - protein, 8 aa, Japanese encephalitis virus
TVLTAMVL

SEQ ID NO: 218182 - protein, 8 aa, Japanese encephalitis virus
LTAVVLTT

SEQ ID NO: 218183 - protein, 8 aa, Japanese encephalitis virus
TAVVLTTL

SEQ ID NO: 218184 - protein, 8 aa, Japanese encephalitis virus
AVVLTTLH

SEQ ID NO: 218185 - protein, 8 aa, Japanese encephalitis virus
MVLAILHY

SEQ ID NO: 218186 - protein, 8 aa, Japanese encephalitis virus
VLTTLHYG

SEQ ID NO: 218187 - protein, 8 aa, Japanese encephalitis virus
LAILHYGY

SEQ ID NO: 218188 - protein, 8 aa, Japanese encephalitis virus
AILHYGYM

SEQ ID NO: 218189 - protein, 8 aa, Japanese encephalitis virus
FLVNPNVS

SEQ ID NO: 218190 - protein, 8 aa, Japanese encephalitis virus
NPKITTVR

SEQ ID NO: 218191 - protein, 8 aa, Japanese encephalitis virus
PKITTVRE

SEQ ID NO: 218192 - protein, 8 aa, Japanese encephalitis virus
NVTTVKKP

SEQ ID NO: 218193 - protein, 8 aa, Japanese encephalitis virus
VSTVRKAG

SEQ ID NO: 218194 - protein, 8 aa, Japanese encephalitis virus
KNADNPSL

SEQ ID NO: 218195 - protein, 8 aa, Japanese encephalitis virus
NANKPSLK

SEQ ID NO: 218196 - protein, 8 aa, Japanese encephalitis virus
ADKPSLKK

SEQ ID NO: 218197 - protein, 8 aa, Japanese encephalitis virus
DKPSLKKG

SEQ ID NO: 218198 - protein, 8 aa, Japanese encephalitis virus
NPSLKRGG

SEQ ID NO: 218199 - protein, 8 aa, Japanese encephalitis virus
PSLKRGGP

SEQ ID NO: 218200 - protein, 8 aa, Japanese encephalitis virus
SFKKGRPG

SEQ ID NO: 218201 - protein, 8 aa, Japanese encephalitis virus
FKKGRPGG

SEQ ID NO: 218202 - protein, 8 aa, Japanese encephalitis virus
KRGGPGGR

SEQ ID NO: 218203 - protein, 8 aa, Japanese encephalitis virus
RGGPGGRT

SEQ ID NO: 218204 - protein, 8 aa, Japanese encephalitis virus
PGGRTLWE

SEQ ID NO: 218205 - protein, 8 aa, Japanese encephalitis virus
TLGEQWKR

SEQ ID NO: 218206 - protein, 8 aa, Japanese encephalitis virus
LWEQWKEK

SEQ ID NO: 218207 - protein, 8 aa, Japanese encephalitis virus
GEQWKRKL

SEQ ID NO: 218208 - protein, 8 aa, Japanese encephalitis virus
EQWKRKLN

SEQ ID NO: 218209 - protein, 8 aa, Japanese encephalitis virus
WKRKLNAM

SEQ ID NO: 218210 - protein, 8 aa, Japanese encephalitis virus
KRKLNAMG

SEQ ID NO: 218211 - protein, 8 aa, Japanese encephalitis virus
EKLNALSR

SEQ ID NO: 218212 - protein, 8 aa, Japanese encephalitis virus
RLNAMSRE

SEQ ID NO: 218213 - protein, 8 aa, Japanese encephalitis virus
LNALSREE

SEQ ID NO: 218214 - protein, 8 aa, Japanese encephalitis virus
NALSREEF

SEQ ID NO: 218215 - protein, 8 aa, Japanese encephalitis virus
ALSREEFF

SEQ ID NO: 218216 - protein, 8 aa, Japanese encephalitis virus
MSREEFFQ

SEQ ID NO: 218217 - protein, 8 aa, Japanese encephalitis virus
SREEFFQY

SEQ ID NO: 218218 - protein, 8 aa, Japanese encephalitis virus
RARRENNK

SEQ ID NO: 218219 - protein, 8 aa, Japanese encephalitis virus
ARSENNIV

SEQ ID NO: 218220 - protein, 8 aa, Japanese encephalitis virus
RRENNKVG

SEQ ID NO: 218221 - protein, 8 aa, Japanese encephalitis virus
RENNKVGG

SEQ ID NO: 218222 - protein, 8 aa, Japanese encephalitis virus
GRGGWSYC

SEQ ID NO: 218223 - protein, 8 aa, Japanese encephalitis virus
RGGWSYCA

SEQ ID NO: 218224 - protein, 8 aa, Japanese encephalitis virus
LKKVQEFR

SEQ ID NO: 218225 - protein, 8 aa, Japanese encephalitis virus
KRVQEVRG

SEQ ID NO: 218226 - protein, 8 aa, Japanese encephalitis virus
KVQEFRGY

SEQ ID NO: 218227 - protein, 8 aa, Japanese encephalitis virus
GKGEVHST

SEQ ID NO: 218228 - protein, 8 aa, Japanese encephalitis virus
KGEVHSTQ

SEQ ID NO: 218229 - protein, 8 aa, Japanese encephalitis virus
QGKIKKRI

SEQ ID NO: 218230 - protein, 8 aa, Japanese encephalitis virus
DKIRRRIQ

SEQ ID NO: 218231 - protein, 8 aa, Japanese encephalitis virus
IRRRIQKL

SEQ ID NO: 218232 - protein, 8 aa, Japanese encephalitis virus
RRRIQKLR

SEQ ID NO: 218233 - protein, 8 aa, Japanese encephalitis virus
KRIQKQKE

SEQ ID NO: 218234 - protein, 8 aa, Japanese encephalitis virus
RIQKLREG

SEQ ID NO: 218235 - protein, 8 aa, Japanese encephalitis virus
IQKLREGF

SEQ ID NO: 218236 - protein, 8 aa, Japanese encephalitis virus
QKQKEEFA

SEQ ID NO: 218237 - protein, 8 aa, Japanese encephalitis virus
KQKEEFAT

SEQ ID NO: 218238 - protein, 8 aa, Japanese encephalitis virus
LREGFATT

SEQ ID NO: 218239 - protein, 8 aa, Japanese encephalitis virus
REEFGTTW

SEQ ID NO: 218240 - protein, 8 aa, Japanese encephalitis virus
EFATTWHR

SEQ ID NO: 218241 - protein, 8 aa, Japanese encephalitis virus
ATTWHRDP

SEQ ID NO: 218242 - protein, 8 aa, Japanese encephalitis virus
TKAPEPPV

SEQ ID NO: 218243 - protein, 8 aa, Japanese encephalitis virus
KAPEPPPG

SEQ ID NO: 218244 - protein, 8 aa, Japanese encephalitis virus
APEPPPGV

SEQ ID NO: 218245 - protein, 8 aa, Japanese encephalitis virus
FIKKVNSD

SEQ ID NO: 218246 - protein, 8 aa, Japanese encephalitis virus
IKKVNSSA

SEQ ID NO: 218247 - protein, 8 aa, Japanese encephalitis virus
KVNSDAAL

SEQ ID NO: 218248 - protein, 8 aa, Japanese encephalitis virus
VNSSAALG

SEQ ID NO: 218249 - protein, 8 aa, Japanese encephalitis virus
NSNASLGA

SEQ ID NO: 218250 - protein, 8 aa, Japanese encephalitis virus
SNASLGTV

SEQ ID NO: 218251 - protein, 8 aa, Japanese encephalitis virus
NASLGTVF

SEQ ID NO: 218252 - protein, 8 aa, Japanese encephalitis virus
STAREAVS

SEQ ID NO: 218253 - protein, 8 aa, Japanese encephalitis virus
TAREAVSD

SEQ ID NO: 218254 - protein, 8 aa, Japanese encephalitis virus
AREAVSDP

SEQ ID NO: 218255 - protein, 8 aa, Japanese encephalitis virus
DSLFWEMV

SEQ ID NO: 218256 - protein, 8 aa, Japanese encephalitis virus
LWEMVDEE

SEQ ID NO: 218257 - protein, 8 aa, Japanese encephalitis virus
WEIVDEER

SEQ ID NO: 218258 - protein, 8 aa, Japanese encephalitis virus
EIVDEERE

SEQ ID NO: 218259 - protein, 8 aa, Japanese encephalitis virus
IVDEEREN

SEQ ID NO: 218260 - protein, 8 aa, Japanese encephalitis virus
ECHTCVYH

SEQ ID NO: 218261 - protein, 8 aa, Japanese encephalitis virus
CHTCVYHM

SEQ ID NO: 218262 - protein, 8 aa, Japanese encephalitis virus
HTRIYNMM

SEQ ID NO: 218263 - protein, 8 aa, Japanese encephalitis virus
TCVYHMMG

SEQ ID NO: 218264 - protein, 8 aa, Japanese encephalitis virus
RIYNMMGK

SEQ ID NO: 218265 - protein, 8 aa, Japanese encephalitis virus
ALGFLNEN

SEQ ID NO: 218266 - protein, 8 aa, Japanese encephalitis virus
LGFLNENH

SEQ ID NO: 218267 - protein, 8 aa, Japanese encephalitis virus
GSLNEDHW

SEQ ID NO: 218268 - protein, 8 aa, Japanese encephalitis virus
FLNENHWL

SEQ ID NO: 218269 - protein, 8 aa, Japanese encephalitis virus
EDHWLSRR

SEQ ID NO: 218270 - protein, 8 aa, Japanese encephalitis virus
RENSRGGV

SEQ ID NO: 218271 - protein, 8 aa, Japanese encephalitis virus
ENSRGGVE

SEQ ID NO: 218272 - protein, 8 aa, Japanese encephalitis virus
SGGGVEGL

SEQ ID NO: 218273 - protein, 8 aa, Japanese encephalitis virus
GGGVEGLG

SEQ ID NO: 218274 - protein, 8 aa, Japanese encephalitis virus
GGVEGLGV

SEQ ID NO: 218275 - protein, 8 aa, Japanese encephalitis virus
GEEGSGVQ

SEQ ID NO: 218276 - protein, 8 aa, Japanese encephalitis virus
VEGLGVQK

SEQ ID NO: 218277 - protein, 8 aa, Japanese encephalitis virus
VQKLGYIS

SEQ ID NO: 218278 - protein, 8 aa, Japanese encephalitis virus
QKLGYIFR

SEQ ID NO: 218279 - protein, 8 aa, Japanese encephalitis virus
KLGYIFRD

SEQ ID NO: 218280 - protein, 8 aa, Japanese encephalitis virus
LGYISGDI

SEQ ID NO: 218281 - protein, 8 aa, Japanese encephalitis virus
GYIIRDIA

SEQ ID NO: 218282 - protein, 8 aa, Japanese encephalitis virus
RDIAVKQG

SEQ ID NO: 218283 - protein, 8 aa, Japanese encephalitis virus
DIAVKQGG

SEQ ID NO: 218284 - protein, 8 aa, Japanese encephalitis virus
ITSRAIGK

SEQ ID NO: 218285 - protein, 8 aa, Japanese encephalitis virus
ARKEGGKM

SEQ ID NO: 218286 - protein, 8 aa, Japanese encephalitis virus
VKQGGKMY

SEQ ID NO: 218287 - protein, 8 aa, Japanese encephalitis virus
FKVMRPAA

SEQ ID NO: 218288 - protein, 8 aa, Japanese encephalitis virus
KVMRPAAK

SEQ ID NO: 218289 - protein, 8 aa, Japanese encephalitis virus
VMRPAAKG

SEQ ID NO: 218290 - protein, 8 aa, Japanese encephalitis virus
MRPSTDGK

SEQ ID NO: 218291 - protein, 8 aa, Japanese encephalitis virus
RPAAKGKT

SEQ ID NO: 218292 - protein, 8 aa, Japanese encephalitis virus
PAAKGKTG

SEQ ID NO: 218293 - protein, 8 aa, Japanese encephalitis virus
ASGGKTVM

SEQ ID NO: 218294 - protein, 8 aa, Japanese encephalitis virus
KGKTGMAV

SEQ ID NO: 218295 - protein, 8 aa, Japanese encephalitis virus
QHLEHLPR

SEQ ID NO: 218296 - protein, 8 aa, Japanese encephalitis virus
HVEQLPRK

SEQ ID NO: 218297 - protein, 8 aa, Japanese encephalitis virus
EHLPRKNK

SEQ ID NO: 218298 - protein, 8 aa, Japanese encephalitis virus
QLPRENKI

SEQ ID NO: 218299 - protein, 8 aa, Japanese encephalitis virus
LPKKNKIA

SEQ ID NO: 218300 - protein, 8 aa, Japanese encephalitis virus
PRENKIAV

SEQ ID NO: 218301 - protein, 8 aa, Japanese encephalitis virus
RENKIAVR

SEQ ID NO: 218302 - protein, 8 aa, Japanese encephalitis virus
SKVRKDIL

SEQ ID NO: 218303 - protein, 8 aa, Japanese encephalitis virus
KVTKDIQQ

SEQ ID NO: 218304 - protein, 8 aa, Japanese encephalitis virus
VRKDILEW

SEQ ID NO: 218305 - protein, 8 aa, Japanese encephalitis virus
RRDIQEWK

SEQ ID NO: 218306 - protein, 8 aa, Japanese encephalitis virus
RDIQEWKP

SEQ ID NO: 218307 - protein, 8 aa, Japanese encephalitis virus
PGAGWNVM

SEQ ID NO: 218308 - protein, 8 aa, Japanese encephalitis virus
GAGWNVMD

SEQ ID NO: 218309 - protein, 8 aa, Japanese encephalitis virus
AGWNVMDT

SEQ ID NO: 218310 - protein, 8 aa, Japanese encephalitis virus
GWNVRDTA

SEQ ID NO: 218311 - protein, 8 aa, Japanese encephalitis virus
WNVRDTAC

SEQ ID NO: 218312 - protein, 8 aa, Japanese encephalitis virus
VKDTACLP

SEQ ID NO: 218313 - protein, 8 aa, Japanese encephalitis virus
MDTACLAK

SEQ ID NO: 218314 - protein, 8 aa, Japanese encephalitis virus
YFHRRDLC

SEQ ID NO: 218315 - protein, 8 aa, Japanese encephalitis virus
FHRRDLCL

SEQ ID NO: 218316 - protein, 8 aa, Japanese encephalitis virus
HRRDQRLM

SEQ ID NO: 218317 - protein, 8 aa, Japanese encephalitis virus
RRDQRLMA

SEQ ID NO: 218318 - protein, 8 aa, Japanese encephalitis virus
RDQRLMAN

SEQ ID NO: 218319 - protein, 8 aa, Japanese encephalitis virus
DQRLMANA

SEQ ID NO: 218320 - protein, 8 aa, Japanese encephalitis virus
ICSAVPVN

SEQ ID NO: 218321 - protein, 8 aa, Japanese encephalitis virus
CSAVPVNW

SEQ ID NO: 218322 - protein, 8 aa, Japanese encephalitis virus
SAVPVNWV

SEQ ID NO: 218323 - protein, 8 aa, Japanese encephalitis virus
AVPLDWVP

SEQ ID NO: 218324 - protein, 8 aa, Japanese encephalitis virus
IEENEWME

SEQ ID NO: 218325 - protein, 8 aa, Japanese encephalitis virus
EENEWMED

SEQ ID NO: 218326 - protein, 8 aa, Japanese encephalitis virus
ENEWMEDK

SEQ ID NO: 218327 - protein, 8 aa, Japanese encephalitis virus
NEWMEDKT

SEQ ID NO: 218328 - protein, 8 aa, Japanese encephalitis virus
EWMTDKTP

SEQ ID NO: 218329 - protein, 8 aa, Japanese encephalitis virus
DMTPITSW

SEQ ID NO: 218330 - protein, 8 aa, Japanese encephalitis virus
KTPIASWT

SEQ ID NO: 218331 - protein, 8 aa, Japanese encephalitis virus
GNLIGTRS

SEQ ID NO: 218332 - protein, 8 aa, Japanese encephalitis virus
SLIGTRAR

SEQ ID NO: 218333 - protein, 8 aa, Japanese encephalitis virus
LIGTRARA

SEQ ID NO: 218334 - protein, 8 aa, Japanese encephalitis virus
IGTRARAT

SEQ ID NO: 218335 - protein, 8 aa, Japanese encephalitis virus
GTRARATW

SEQ ID NO: 218336 - protein, 8 aa, Japanese encephalitis virus
TRARATWA

SEQ ID NO: 218337 - protein, 8 aa, Japanese encephalitis virus
RARATWAE

SEQ ID NO: 218338 - protein, 8 aa, Japanese encephalitis virus
ARATWAEN

SEQ ID NO: 218339 - protein, 8 aa, Japanese encephalitis virus
RAIIGKED

SEQ ID NO: 218340 - protein, 8 aa, Japanese encephalitis virus
AIIGKEDY

SEQ ID NO: 218341 - protein, 8 aa, Japanese encephalitis virus
IIGKEDYV

SEQ ID NO: 218342 - protein, 8 aa, Japanese encephalitis virus
IGKETYVD

SEQ ID NO: 218343 - protein, 8 aa, Japanese encephalitis virus
EDYVDYMT

SEQ ID NO: 218344 - protein, 8 aa, Japanese encephalitis virus
NYVDYMDF

SEQ ID NO: 218345 - protein, 8 aa, Japanese encephalitis virus
RRYEDVLT

SEQ ID NO: 218346 - protein, 8 aa, Japanese encephalitis virus
RIEDVLIQ

SEQ ID NO: 218347 - protein, 8 aa, Japanese encephalitis virus
YEDVSIQE

SEQ ID NO: 218348 - protein, 8 aa, Japanese encephalitis virus
EDVSIQED

SEQ ID NO: 218349 - protein, 8 aa, Japanese encephalitis virus
DVSIQEDR

SEQ ID NO: 218350 - protein, 8 aa, Japanese encephalitis virus
VLTQEDRV

SEQ ID NO: 218351 - protein, 8 aa, Japanese encephalitis virus
LTQEDRVI

SEQ ID NO: 218352 - protein, 8 aa, Japanese encephalitis virus
VRFVLAFI

SEQ ID NO: 218353 - protein, 8 aa, Japanese encephalitis virus
ELGTLIDV

SEQ ID NO: 218354 - protein, 8 aa, Japanese encephalitis virus
LGILIDAV

SEQ ID NO: 218355 - protein, 8 aa, Japanese encephalitis virus
GTLIDTVN

SEQ ID NO: 218356 - protein, 8 aa, Japanese encephalitis virus
TLIDGVNK

SEQ ID NO: 218357 - protein, 8 aa, Japanese encephalitis virus
DVVNKRGK

SEQ ID NO: 218358 - protein, 8 aa, Japanese encephalitis virus
TVNKRGRK

SEQ ID NO: 218359 - protein, 8 aa, Japanese encephalitis virus
TLWFMSLT

SEQ ID NO: 218360 - protein, 8 aa, Japanese encephalitis virus
AGAIKLSN

SEQ ID NO: 218361 - protein, 8 aa, Japanese encephalitis virus
PGNDPQDV

SEQ ID NO: 218362 - protein, 8 aa, Japanese encephalitis virus
NRDFIQGA

SEQ ID NO: 218363 - protein, 8 aa, Japanese encephalitis virus
RDFIEGVS

SEQ ID NO: 218364 - protein, 8 aa, Japanese encephalitis virus
DFIERASG

SEQ ID NO: 218365 - protein, 8 aa, Japanese encephalitis virus
FVEGASGA

SEQ ID NO: 218366 - protein, 8 aa, Japanese encephalitis virus
IQGASGAT

SEQ ID NO: 218367 - protein, 8 aa, Japanese encephalitis virus
WGNGCGLS

SEQ ID NO: 218368 - protein, 8 aa, Japanese encephalitis virus
RNGCGLFG

SEQ ID NO: 218369 - protein, 8 aa, Japanese encephalitis virus
SCTSKAIE

SEQ ID NO: 218370 - protein, 8 aa, Japanese encephalitis virus
CTSKAIER

SEQ ID NO: 218371 - protein, 8 aa, Japanese encephalitis virus
KAIGRAIQ

SEQ ID NO: 218372 - protein, 8 aa, Japanese encephalitis virus
MIQSENIK

SEQ ID NO: 218373 - protein, 8 aa, Japanese encephalitis virus
VGASQAAR

SEQ ID NO: 218374 - protein, 8 aa, Japanese encephalitis virus
NAPSVTLE

SEQ ID NO: 218375 - protein, 8 aa, Japanese encephalitis virus
APSVTLKL

SEQ ID NO: 218376 - protein, 8 aa, Japanese encephalitis virus
PSVTLKLG

SEQ ID NO: 218377 - protein, 8 aa, Japanese encephalitis virus
SVTLKLGD

SEQ ID NO: 218378 - protein, 8 aa, Japanese encephalitis virus
LALPWSSP

SEQ ID NO: 218379 - protein, 8 aa, Japanese encephalitis virus
ALPWTSSS

SEQ ID NO: 218380 - protein, 8 aa, Japanese encephalitis virus
SREGGLHQ

SEQ ID NO: 218381 - protein, 8 aa, Japanese encephalitis virus
QERALHQA

SEQ ID NO: 218382 - protein, 8 aa, Japanese encephalitis virus
TYGMCTEN

SEQ ID NO: 218383 - protein, 8 aa, Japanese encephalitis virus
YGMCTENS

SEQ ID NO: 218384 - protein, 8 aa, Japanese encephalitis virus
GVCTEKFS

SEQ ID NO: 218385 - protein, 8 aa, Japanese encephalitis virus
MCTENSSF

SEQ ID NO: 218386 - protein, 8 aa, Japanese encephalitis virus
SYSGRDGP

SEQ ID NO: 218387 - protein, 8 aa, Japanese encephalitis virus
TSSANSKA

SEQ ID NO: 218388 - protein, 8 aa, Japanese encephalitis virus
SSNSQVLV

SEQ ID NO: 218389 - protein, 8 aa, Japanese encephalitis virus
SNSQVLVE

SEQ ID NO: 218390 - protein, 8 aa, Japanese encephalitis virus
SYIVIGRG

SEQ ID NO: 218391 - protein, 8 aa, Japanese encephalitis virus
QINHHWYK

SEQ ID NO: 218392 - protein, 8 aa, Japanese encephalitis virus
HHRHKAGS

SEQ ID NO: 218393 - protein, 8 aa, Japanese encephalitis virus
HRHKAGST

SEQ ID NO: 218394 - protein, 8 aa, Japanese encephalitis virus
WHKPGSTL

SEQ ID NO: 218395 - protein, 8 aa, Japanese encephalitis virus
RVFNSIGK

SEQ ID NO: 218396 - protein, 8 aa, Japanese encephalitis virus
TGCAIDVT

SEQ ID NO: 218397 - protein, 8 aa, Japanese encephalitis virus
GSAIDITR

SEQ ID NO: 218398 - protein, 8 aa, Japanese encephalitis virus
HKAHMEGV

SEQ ID NO: 218399 - protein, 8 aa, Japanese encephalitis virus
KAHMEGIC

SEQ ID NO: 218400 - protein, 8 aa, Japanese encephalitis virus
AYKEGVCG

SEQ ID NO: 218401 - protein, 8 aa, Japanese encephalitis virus
YKEGVCGI

SEQ ID NO: 218402 - protein, 8 aa, Japanese encephalitis virus
MEGVCGVR

SEQ ID NO: 218403 - protein, 8 aa, Japanese encephalitis virus
ERRAWNST

SEQ ID NO: 218404 - protein, 8 aa, Japanese encephalitis virus
NTDECDGT

SEQ ID NO: 218405 - protein, 8 aa, Japanese encephalitis virus
AIKGHVAV

SEQ ID NO: 218406 - protein, 8 aa, Japanese encephalitis virus
IKGHVAVH

SEQ ID NO: 218407 - protein, 8 aa, Japanese encephalitis virus
SYWIESHL

SEQ ID NO: 218408 - protein, 8 aa, Japanese encephalitis virus
YWIGSRYN

SEQ ID NO: 218409 - protein, 8 aa, Japanese encephalitis virus
WIESHLND

SEQ ID NO: 218410 - protein, 8 aa, Japanese encephalitis virus
DSWKLERA

SEQ ID NO: 218411 - protein, 8 aa, Japanese encephalitis virus
SWKLERAV

SEQ ID NO: 218412 - protein, 8 aa, Japanese encephalitis virus
GPWDEDGI

SEQ ID NO: 218413 - protein, 8 aa, Japanese encephalitis virus
PWDENGLV

SEQ ID NO: 218414 - protein, 8 aa, Japanese encephalitis virus
WDENGLVP

SEQ ID NO: 218415 - protein, 8 aa, Japanese encephalitis virus
DEKGIVLD

SEQ ID NO: 218416 - protein, 8 aa, Japanese encephalitis virus
ESGIVLDF

SEQ ID NO: 218417 - protein, 8 aa, Japanese encephalitis virus
DGIVLDFD

SEQ ID NO: 218418 - protein, 8 aa, Japanese encephalitis virus
CGKRGPSL

SEQ ID NO: 218419 - protein, 8 aa, Japanese encephalitis virus
GKRGPSLR

SEQ ID NO: 218420 - protein, 8 aa, Japanese encephalitis virus
KHDEATLV

SEQ ID NO: 218421 - protein, 8 aa, Japanese encephalitis virus
TTLVRWQV

SEQ ID NO: 218422 - protein, 8 aa, Japanese encephalitis virus
TLVRSRVD

SEQ ID NO: 218423 - protein, 8 aa, Japanese encephalitis virus
LVRWQVDA

SEQ ID NO: 218424 - protein, 8 aa, Japanese encephalitis virus
NGGMVDPF

SEQ ID NO: 218425 - protein, 8 aa, Japanese encephalitis virus
LAMNTLST

SEQ ID NO: 218426 - protein, 8 aa, Japanese encephalitis virus
KMLSTRWT

SEQ ID NO: 218427 - protein, 8 aa, Japanese encephalitis virus
FPTTSTVT

SEQ ID NO: 218428 - protein, 8 aa, Japanese encephalitis virus
PTTSTITM

SEQ ID NO: 218429 - protein, 8 aa, Japanese encephalitis virus
TTSTITMP

SEQ ID NO: 218430 - protein, 8 aa, Japanese encephalitis virus
TPGMRAFD

SEQ ID NO: 218431 - protein, 8 aa, Japanese encephalitis virus
CSLLQERE

SEQ ID NO: 218432 - protein, 8 aa, Japanese encephalitis virus
ERRRTMAK

SEQ ID NO: 218433 - protein, 8 aa, Japanese encephalitis virus
REKTMAKK

SEQ ID NO: 218434 - protein, 8 aa, Japanese encephalitis virus
EKTMAKKK

SEQ ID NO: 218435 - protein, 8 aa, Japanese encephalitis virus
RAADISWG

SEQ ID NO: 218436 - protein, 8 aa, Japanese encephalitis virus
SWGMDAAI

SEQ ID NO: 218437 - protein, 8 aa, Japanese encephalitis virus
WEMGAAIT

SEQ ID NO: 218438 - protein, 8 aa, Japanese encephalitis virus
GMDAAITG

SEQ ID NO: 218439 - protein, 8 aa, Japanese encephalitis virus
VLRTSCIG

SEQ ID NO: 218440 - protein, 8 aa, Japanese encephalitis virus
RTSCIGLA

SEQ ID NO: 218441 - protein, 8 aa, Japanese encephalitis virus
MSCSGLAA

SEQ ID NO: 218442 - protein, 8 aa, Japanese encephalitis virus
GVIYENVF

SEQ ID NO: 218443 - protein, 8 aa, Japanese encephalitis virus
VMYENVLH

SEQ ID NO: 218444 - protein, 8 aa, Japanese encephalitis virus
MYESVFHT

SEQ ID NO: 218445 - protein, 8 aa, Japanese encephalitis virus
GAAIMSGK

SEQ ID NO: 218446 - protein, 8 aa, Japanese encephalitis virus
AAIMSGKG

SEQ ID NO: 218447 - protein, 8 aa, Japanese encephalitis virus
AIMSGKGK

SEQ ID NO: 218448 - protein, 8 aa, Japanese encephalitis virus
IMSGGGKL

SEQ ID NO: 218449 - protein, 8 aa, Japanese encephalitis virus
IVVEQGKP

SEQ ID NO: 218450 - protein, 8 aa, Japanese encephalitis virus
VVEPGKVA

SEQ ID NO: 218451 - protein, 8 aa, Japanese encephalitis virus
ATNIQTKP

SEQ ID NO: 218452 - protein, 8 aa, Japanese encephalitis virus
VNFQTKPG

SEQ ID NO: 218453 - protein, 8 aa, Japanese encephalitis virus
PGIFPTPF

SEQ ID NO: 218454 - protein, 8 aa, Japanese encephalitis virus
GIFPTPFG

SEQ ID NO: 218455 - protein, 8 aa, Japanese encephalitis virus
PFGKVGTV

SEQ ID NO: 218456 - protein, 8 aa, Japanese encephalitis virus
LGEVGAVS

SEQ ID NO: 218457 - protein, 8 aa, Japanese encephalitis virus
VPEAYTPT

SEQ ID NO: 218458 - protein, 8 aa, Japanese encephalitis virus
PEAYNPSM

SEQ ID NO: 218459 - protein, 8 aa, Japanese encephalitis virus
EAYTPSML

SEQ ID NO: 218460 - protein, 8 aa, Japanese encephalitis virus
AYTPNMLK

SEQ ID NO: 218461 - protein, 8 aa, Japanese encephalitis virus
YNPSMLKK

SEQ ID NO: 218462 - protein, 8 aa, Japanese encephalitis virus
PSMLKKKQ

SEQ ID NO: 218463 - protein, 8 aa, Japanese encephalitis virus
AVSFIEEP

SEQ ID NO: 218464 - protein, 8 aa, Japanese encephalitis virus
TSFIEVLG

SEQ ID NO: 218465 - protein, 8 aa, Japanese encephalitis virus
LETITLII

SEQ ID NO: 218466 - protein, 8 aa, Japanese encephalitis virus
ETITLIIA

SEQ ID NO: 218467 - protein, 8 aa, Japanese encephalitis virus
TITLIIAI

SEQ ID NO: 218468 - protein, 8 aa, Japanese encephalitis virus
EKQKSQTD

SEQ ID NO: 218469 - protein, 8 aa, Japanese encephalitis virus
IKSMFAGK

SEQ ID NO: 218470 - protein, 8 aa, Japanese encephalitis virus
KSMFGGKA

SEQ ID NO: 218471 - protein, 8 aa, Japanese encephalitis virus
SMFGGKAP

SEQ ID NO: 218472 - protein, 8 aa, Japanese encephalitis virus
MFGGKAPV

SEQ ID NO: 218473 - protein, 8 aa, Japanese encephalitis virus
LTAMVLAI

SEQ ID NO: 218474 - protein, 8 aa, Japanese encephalitis virus
TAMVLAIL

SEQ ID NO: 218475 - protein, 8 aa, Japanese encephalitis virus
AMVLAILH

SEQ ID NO: 218476 - protein, 8 aa, Japanese encephalitis virus
VVLTTLHY

SEQ ID NO: 218477 - protein, 8 aa, Japanese encephalitis virus
LATLHYGF

SEQ ID NO: 218478 - protein, 8 aa, Japanese encephalitis virus
ATLHYGFM

SEQ ID NO: 218479 - protein, 8 aa, Japanese encephalitis virus
ANKPSLKR

SEQ ID NO: 218480 - protein, 8 aa, Japanese encephalitis virus
DNPSLKRG

SEQ ID NO: 218481 - protein, 8 aa, Japanese encephalitis virus
PSLKKGRP

SEQ ID NO: 218482 - protein, 8 aa, Japanese encephalitis virus
SLKRGGPG

SEQ ID NO: 218483 - protein, 8 aa, Japanese encephalitis virus
LKRGGPGG

SEQ ID NO: 218484 - protein, 8 aa, Japanese encephalitis virus
LGEQWKRK

SEQ ID NO: 218485 - protein, 8 aa, Japanese encephalitis virus
GDQWKEKL

SEQ ID NO: 218486 - protein, 8 aa, Japanese encephalitis virus
KEKLNALS

SEQ ID NO: 218487 - protein, 8 aa, Japanese encephalitis virus
RKLNAMGR

SEQ ID NO: 218488 - protein, 8 aa, Japanese encephalitis virus
KLNALSRE

SEQ ID NO: 218489 - protein, 8 aa, Japanese encephalitis virus
LSREEFFK

SEQ ID NO: 218490 - protein, 8 aa, Japanese encephalitis virus
QDKIRRRI

SEQ ID NO: 218491 - protein, 8 aa, Japanese encephalitis virus
KKIRKRIQ

SEQ ID NO: 218492 - protein, 8 aa, Japanese encephalitis virus
KKRIQKQK

SEQ ID NO: 218493 - protein, 8 aa, Japanese encephalitis virus
QKLREGFA

SEQ ID NO: 218494 - protein, 8 aa, Japanese encephalitis virus
KLREEFGT

SEQ ID NO: 218495 - protein, 8 aa, Japanese encephalitis virus
QKEEFATT

SEQ ID NO: 218496 - protein, 8 aa, Japanese encephalitis virus
TMAPEPPA

SEQ ID NO: 218497 - protein, 8 aa, Japanese encephalitis virus
KAPEPPVG

SEQ ID NO: 218498 - protein, 8 aa, Japanese encephalitis virus
APEPPTGA

SEQ ID NO: 218499 - protein, 8 aa, Japanese encephalitis virus
FINKVNSN

SEQ ID NO: 218500 - protein, 8 aa, Japanese encephalitis virus
INKVNSNA

SEQ ID NO: 218501 - protein, 8 aa, Japanese encephalitis virus
NSNASLGT

SEQ ID NO: 218502 - protein, 8 aa, Japanese encephalitis virus
SSAALGAV

SEQ ID NO: 218503 - protein, 8 aa, Japanese encephalitis virus
DAALGAVF

SEQ ID NO: 218504 - protein, 8 aa, Japanese encephalitis virus
AREAVGDS

SEQ ID NO: 218505 - protein, 8 aa, Japanese encephalitis virus
DPRFWEIV

SEQ ID NO: 218506 - protein, 8 aa, Japanese encephalitis virus
FWEIVDEE

SEQ ID NO: 218507 - protein, 8 aa, Japanese encephalitis virus
RGGVEGSS

SEQ ID NO: 218508 - protein, 8 aa, Japanese encephalitis virus
KVMRPSTD

SEQ ID NO: 218509 - protein, 8 aa, Japanese encephalitis virus
VMRPSTDG

SEQ ID NO: 218510 - protein, 8 aa, Japanese encephalitis virus
MRPASGGK

SEQ ID NO: 218511 - protein, 8 aa, Japanese encephalitis virus
RPASGGKT

SEQ ID NO: 218512 - protein, 8 aa, Japanese encephalitis virus
PASGGKTV

SEQ ID NO: 218513 - protein, 8 aa, Japanese encephalitis virus
AAKGKTGM

SEQ ID NO: 218514 - protein, 8 aa, Japanese encephalitis virus
DGKTVMDV

SEQ ID NO: 218515 - protein, 8 aa, Japanese encephalitis virus
HLEHLPRK

SEQ ID NO: 218516 - protein, 8 aa, Japanese encephalitis virus
EQLPRENK

SEQ ID NO: 218517 - protein, 8 aa, Japanese encephalitis virus
HLPRKNKI

SEQ ID NO: 218518 - protein, 8 aa, Japanese encephalitis virus
ENEWMTDK

SEQ ID NO: 218519 - protein, 8 aa, Japanese encephalitis virus
NEWMTDKT

SEQ ID NO: 218520 - protein, 8 aa, Japanese encephalitis virus
EWMMDMTP

SEQ ID NO: 218521 - protein, 8 aa, Japanese encephalitis virus
NLIGTRSR

SEQ ID NO: 218522 - protein, 8 aa, Japanese encephalitis virus
RAIIGKET

SEQ ID NO: 218523 - protein, 8 aa, Japanese encephalitis virus
AILGKENY

SEQ ID NO: 218524 - protein, 8 aa, Japanese encephalitis virus
IIGKETYV

SEQ ID NO: 218525 - protein, 8 aa, Japanese encephalitis virus
ENYVDYMD

SEQ ID NO: 218526 - protein, 8 aa, Japanese encephalitis virus
NYVDYMLS

SEQ ID NO: 218527 - protein, 8 aa, Japanese encephalitis virus
RRYEDVSI

SEQ ID NO: 218528 - protein, 8 aa, Japanese encephalitis virus
RYEDVSIQ

SEQ ID NO: 218529 - protein, 8 aa, Japanese encephalitis virus
YEDVLTQE

SEQ ID NO: 218530 - protein, 9 aa, Japanese encephalitis virus
MTKKPGGPG

SEQ ID NO: 218531 - protein, 9 aa, Japanese encephalitis virus
TKKPGGPGK

SEQ ID NO: 218532 - protein, 9 aa, Japanese encephalitis virus
KKPGGPGKN

SEQ ID NO: 218533 - protein, 9 aa, Japanese encephalitis virus
KPGGPGKNR

SEQ ID NO: 218534 - protein, 9 aa, Japanese encephalitis virus
PGGPGKNRA

SEQ ID NO: 218535 - protein, 9 aa, Japanese encephalitis virus
GGPGKNRAI

SEQ ID NO: 218536 - protein, 9 aa, Japanese encephalitis virus
GPGKNRAIN

SEQ ID NO: 218537 - protein, 9 aa, Japanese encephalitis virus
PGKNRAINM

SEQ ID NO: 218538 - protein, 9 aa, Japanese encephalitis virus
GKNRAINML

SEQ ID NO: 218539 - protein, 9 aa, Japanese encephalitis virus
KNRAINMLK

SEQ ID NO: 218540 - protein, 9 aa, Japanese encephalitis virus
NRAINMLKR

SEQ ID NO: 218541 - protein, 9 aa, Japanese encephalitis virus
RAINMLKRG

SEQ ID NO: 218542 - protein, 9 aa, Japanese encephalitis virus
AINMLKRGL

SEQ ID NO: 218543 - protein, 9 aa, Japanese encephalitis virus
INMLKRGLP

SEQ ID NO: 218544 - protein, 9 aa, Japanese encephalitis virus
NMLKRGLPR

SEQ ID NO: 218545 - protein, 9 aa, Japanese encephalitis virus
MLKRGLPRV

SEQ ID NO: 218546 - protein, 9 aa, Japanese encephalitis virus
LKRGLPRVF

SEQ ID NO: 218547 - protein, 9 aa, Japanese encephalitis virus
KRGLPRVFP

SEQ ID NO: 218548 - protein, 9 aa, Japanese encephalitis virus
RGLPRVFPL

SEQ ID NO: 218549 - protein, 9 aa, Japanese encephalitis virus
GLPRVFPLV

SEQ ID NO: 218550 - protein, 9 aa, Japanese encephalitis virus
LPRVFPLVG

SEQ ID NO: 218551 - protein, 9 aa, Japanese encephalitis virus
PRVFPLVGV

SEQ ID NO: 218552 - protein, 9 aa, Japanese encephalitis virus
RVFPLVGVK

SEQ ID NO: 218553 - protein, 9 aa, Japanese encephalitis virus
VFPLVGVKR

SEQ ID NO: 218554 - protein, 9 aa, Japanese encephalitis virus
FPLVGVKRV

SEQ ID NO: 218555 - protein, 9 aa, Japanese encephalitis virus
PLVGVKRVV

SEQ ID NO: 218556 - protein, 9 aa, Japanese encephalitis virus
LVGVKRVVM

SEQ ID NO: 218557 - protein, 9 aa, Japanese encephalitis virus
VGVKRVVMS

SEQ ID NO: 218558 - protein, 9 aa, Japanese encephalitis virus
GVKRVVMSL

SEQ ID NO: 218559 - protein, 9 aa, Japanese encephalitis virus
VKRVVMSLL

SEQ ID NO: 218560 - protein, 9 aa, Japanese encephalitis virus
KRVVMSLLD

SEQ ID NO: 218561 - protein, 9 aa, Japanese encephalitis virus
RVVMSLLDG

SEQ ID NO: 218562 - protein, 9 aa, Japanese encephalitis virus
VVMSLLDGR

SEQ ID NO: 218563 - protein, 9 aa, Japanese encephalitis virus
VMSLLDGRG

SEQ ID NO: 218564 - protein, 9 aa, Japanese encephalitis virus
MSLLDGRGP

SEQ ID NO: 218565 - protein, 9 aa, Japanese encephalitis virus
SLLDGRGPV

SEQ ID NO: 218566 - protein, 9 aa, Japanese encephalitis virus
LLDGRGPVR

SEQ ID NO: 218567 - protein, 9 aa, Japanese encephalitis virus
LDGRGPVRF

SEQ ID NO: 218568 - protein, 9 aa, Japanese encephalitis virus
DGRGPVRFV

SEQ ID NO: 218569 - protein, 9 aa, Japanese encephalitis virus
GRGPVRFVL

SEQ ID NO: 218570 - protein, 9 aa, Japanese encephalitis virus
RGPVRFVLA

SEQ ID NO: 218571 - protein, 9 aa, Japanese encephalitis virus
GPVRFVLAL

SEQ ID NO: 218572 - protein, 9 aa, Japanese encephalitis virus
PVRFVLALI

SEQ ID NO: 218573 - protein, 9 aa, Japanese encephalitis virus
VRFVLALIT

SEQ ID NO: 218574 - protein, 9 aa, Japanese encephalitis virus
RFVLALITF

SEQ ID NO: 218575 - protein, 9 aa, Japanese encephalitis virus
FVLALITFF

SEQ ID NO: 218576 - protein, 9 aa, Japanese encephalitis virus
VLALITFFK

SEQ ID NO: 218577 - protein, 9 aa, Japanese encephalitis virus
LALITFFKF

SEQ ID NO: 218578 - protein, 9 aa, Japanese encephalitis virus
ALITFFKFT

SEQ ID NO: 218579 - protein, 9 aa, Japanese encephalitis virus
LITFFKFTA

SEQ ID NO: 218580 - protein, 9 aa, Japanese encephalitis virus
ITFFKFTAL

SEQ ID NO: 218581 - protein, 9 aa, Japanese encephalitis virus
TFFKFTALA

SEQ ID NO: 218582 - protein, 9 aa, Japanese encephalitis virus
FFKFTALAP

SEQ ID NO: 218583 - protein, 9 aa, Japanese encephalitis virus
FKFTALAPT

SEQ ID NO: 218584 - protein, 9 aa, Japanese encephalitis virus
KFTALAPTK

SEQ ID NO: 218585 - protein, 9 aa, Japanese encephalitis virus
FTALAPTKA

SEQ ID NO: 218586 - protein, 9 aa, Japanese encephalitis virus
TALAPTKAL

SEQ ID NO: 218587 - protein, 9 aa, Japanese encephalitis virus
ALAPTKALL

SEQ ID NO: 218588 - protein, 9 aa, Japanese encephalitis virus
LAPTKALLG

SEQ ID NO: 218589 - protein, 9 aa, Japanese encephalitis virus
APTKALLGR

SEQ ID NO: 218590 - protein, 9 aa, Japanese encephalitis virus
PTKALLGRW

SEQ ID NO: 218591 - protein, 9 aa, Japanese encephalitis virus
TKALLGRWK

SEQ ID NO: 218592 - protein, 9 aa, Japanese encephalitis virus
KALLGRWKA

SEQ ID NO: 218593 - protein, 9 aa, Japanese encephalitis virus
ALLGRWKAV

SEQ ID NO: 218594 - protein, 9 aa, Japanese encephalitis virus
LLGRWKAVE

SEQ ID NO: 218595 - protein, 9 aa, Japanese encephalitis virus
LGRWKAVEK

SEQ ID NO: 218596 - protein, 9 aa, Japanese encephalitis virus
GRWKAVEKS

SEQ ID NO: 218597 - protein, 9 aa, Japanese encephalitis virus
RWKAVEKSV

SEQ ID NO: 218598 - protein, 9 aa, Japanese encephalitis virus
WKAVEKSVA

SEQ ID NO: 218599 - protein, 9 aa, Japanese encephalitis virus
KAVEKSVAM

SEQ ID NO: 218600 - protein, 9 aa, Japanese encephalitis virus
AVEKSVAMK

SEQ ID NO: 218601 - protein, 9 aa, Japanese encephalitis virus
VEKSVAMKH

SEQ ID NO: 218602 - protein, 9 aa, Japanese encephalitis virus
EKSVAMKHL

SEQ ID NO: 218603 - protein, 9 aa, Japanese encephalitis virus
KSVAMKHLT

SEQ ID NO: 218604 - protein, 9 aa, Japanese encephalitis virus
SVAMKHLTS

SEQ ID NO: 218605 - protein, 9 aa, Japanese encephalitis virus
VAMKHLTSF

SEQ ID NO: 218606 - protein, 9 aa, Japanese encephalitis virus
AMKHLTSFK

SEQ ID NO: 218607 - protein, 9 aa, Japanese encephalitis virus
MKHLTSFKR

SEQ ID NO: 218608 - protein, 9 aa, Japanese encephalitis virus
KHLTSFKRE

SEQ ID NO: 218609 - protein, 9 aa, Japanese encephalitis virus
HLTSFKREL

SEQ ID NO: 218610 - protein, 9 aa, Japanese encephalitis virus
LTSFKRELG

SEQ ID NO: 218611 - protein, 9 aa, Japanese encephalitis virus
TSFKRELGT

SEQ ID NO: 218612 - protein, 9 aa, Japanese encephalitis virus
SFKRELGTL

SEQ ID NO: 218613 - protein, 9 aa, Japanese encephalitis virus
FKRELGTLI

SEQ ID NO: 218614 - protein, 9 aa, Japanese encephalitis virus
KRELGTLID

SEQ ID NO: 218615 - protein, 9 aa, Japanese encephalitis virus
RELGTLIDA

SEQ ID NO: 218616 - protein, 9 aa, Japanese encephalitis virus
ELGTLIDAV

SEQ ID NO: 218617 - protein, 9 aa, Japanese encephalitis virus
LGTLIDAVN

SEQ ID NO: 218618 - protein, 9 aa, Japanese encephalitis virus
GTLIDAVNK

SEQ ID NO: 218619 - protein, 9 aa, Japanese encephalitis virus
TLIDAVNKR

SEQ ID NO: 218620 - protein, 9 aa, Japanese encephalitis virus
LIDAVNKRG

SEQ ID NO: 218621 - protein, 9 aa, Japanese encephalitis virus
IDAVNKRGR

SEQ ID NO: 218622 - protein, 9 aa, Japanese encephalitis virus
DAVNKRGRK

SEQ ID NO: 218623 - protein, 9 aa, Japanese encephalitis virus
VNKRGRKQN

SEQ ID NO: 218624 - protein, 9 aa, Japanese encephalitis virus
NKRGRKQNK

SEQ ID NO: 218625 - protein, 9 aa, Japanese encephalitis virus
KRGRKQNKR

SEQ ID NO: 218626 - protein, 9 aa, Japanese encephalitis virus
RGRKQNKRG

SEQ ID NO: 218627 - protein, 9 aa, Japanese encephalitis virus
GRKQNKRGG

SEQ ID NO: 218628 - protein, 9 aa, Japanese encephalitis virus
RKQNKRGGN

SEQ ID NO: 218629 - protein, 9 aa, Japanese encephalitis virus
KQNKRGGNE

SEQ ID NO: 218630 - protein, 9 aa, Japanese encephalitis virus
QNKRGGNEG

SEQ ID NO: 218631 - protein, 9 aa, Japanese encephalitis virus
AGAMKLSNF

SEQ ID NO: 218632 - protein, 9 aa, Japanese encephalitis virus
GAMKLSNFQ

SEQ ID NO: 218633 - protein, 9 aa, Japanese encephalitis virus
AMKLSNFQG

SEQ ID NO: 218634 - protein, 9 aa, Japanese encephalitis virus
MKLSNFQGK

SEQ ID NO: 218635 - protein, 9 aa, Japanese encephalitis virus
KLSNFQGKL

SEQ ID NO: 218636 - protein, 9 aa, Japanese encephalitis virus
LSNFQGKLL

SEQ ID NO: 218637 - protein, 9 aa, Japanese encephalitis virus
SNFQGKLLM

SEQ ID NO: 218638 - protein, 9 aa, Japanese encephalitis virus
NFQGKLLMT

SEQ ID NO: 218639 - protein, 9 aa, Japanese encephalitis virus
FQGKLLMTI

SEQ ID NO: 218640 - protein, 9 aa, Japanese encephalitis virus
QGKLLMTIN

SEQ ID NO: 218641 - protein, 9 aa, Japanese encephalitis virus
GKLLMTINN

SEQ ID NO: 218642 - protein, 9 aa, Japanese encephalitis virus
KLLMTINNT

SEQ ID NO: 218643 - protein, 9 aa, Japanese encephalitis virus
LLMTINNTD

SEQ ID NO: 218644 - protein, 9 aa, Japanese encephalitis virus
LMTINNTDI

SEQ ID NO: 218645 - protein, 9 aa, Japanese encephalitis virus
MTINNTDIA

SEQ ID NO: 218646 - protein, 9 aa, Japanese encephalitis virus
TINNTDIAD

SEQ ID NO: 218647 - protein, 9 aa, Japanese encephalitis virus
INNTDIADV

SEQ ID NO: 218648 - protein, 9 aa, Japanese encephalitis virus
NNTDIADVI

SEQ ID NO: 218649 - protein, 9 aa, Japanese encephalitis virus
NTDIADVIV

SEQ ID NO: 218650 - protein, 9 aa, Japanese encephalitis virus
TDIADVIVI

SEQ ID NO: 218651 - protein, 9 aa, Japanese encephalitis virus
DIADVIVIP

SEQ ID NO: 218652 - protein, 9 aa, Japanese encephalitis virus
IADVIVIPT

SEQ ID NO: 218653 - protein, 9 aa, Japanese encephalitis virus
ADVIVIPTS

SEQ ID NO: 218654 - protein, 9 aa, Japanese encephalitis virus
DVIVIPTSK

SEQ ID NO: 218655 - protein, 9 aa, Japanese encephalitis virus
VIVIPTSKG

SEQ ID NO: 218656 - protein, 9 aa, Japanese encephalitis virus
IVIPTSKGE

SEQ ID NO: 218657 - protein, 9 aa, Japanese encephalitis virus
VIPTSKGEN

SEQ ID NO: 218658 - protein, 9 aa, Japanese encephalitis virus
IPTSKGENR

SEQ ID NO: 218659 - protein, 9 aa, Japanese encephalitis virus
PTSKGENRC

SEQ ID NO: 218660 - protein, 9 aa, Japanese encephalitis virus
TSKGENRCW

SEQ ID NO: 218661 - protein, 9 aa, Japanese encephalitis virus
SKGENRCWV

SEQ ID NO: 218662 - protein, 9 aa, Japanese encephalitis virus
KGENRCWVR

SEQ ID NO: 218663 - protein, 9 aa, Japanese encephalitis virus
GENRCWVRA

SEQ ID NO: 218664 - protein, 9 aa, Japanese encephalitis virus
ENRCWVRAI

SEQ ID NO: 218665 - protein, 9 aa, Japanese encephalitis virus
NRCWVRAID

SEQ ID NO: 218666 - protein, 9 aa, Japanese encephalitis virus
RCWVRAIDV

SEQ ID NO: 218667 - protein, 9 aa, Japanese encephalitis virus
CWVRAIDVG

SEQ ID NO: 218668 - protein, 9 aa, Japanese encephalitis virus
WVRAIDVGY

SEQ ID NO: 218669 - protein, 9 aa, Japanese encephalitis virus
VRAIDVGYM

SEQ ID NO: 218670 - protein, 9 aa, Japanese encephalitis virus
RAIDVGYMC

SEQ ID NO: 218671 - protein, 9 aa, Japanese encephalitis virus
AIDVGYMCE

SEQ ID NO: 218672 - protein, 9 aa, Japanese encephalitis virus
IDVGYMCED

SEQ ID NO: 218673 - protein, 9 aa, Japanese encephalitis virus
DVGYMCEDT

SEQ ID NO: 218674 - protein, 9 aa, Japanese encephalitis virus
VGYMCEDTI

SEQ ID NO: 218675 - protein, 9 aa, Japanese encephalitis virus
GYMCEDTIT

SEQ ID NO: 218676 - protein, 9 aa, Japanese encephalitis virus
YMCEDTITY

SEQ ID NO: 218677 - protein, 9 aa, Japanese encephalitis virus
MCEDTITYE

SEQ ID NO: 218678 - protein, 9 aa, Japanese encephalitis virus
CEDTITYEC

SEQ ID NO: 218679 - protein, 9 aa, Japanese encephalitis virus
EDTITYECP

SEQ ID NO: 218680 - protein, 9 aa, Japanese encephalitis virus
DTITYECPK

SEQ ID NO: 218681 - protein, 9 aa, Japanese encephalitis virus
TITYECPKL

SEQ ID NO: 218682 - protein, 9 aa, Japanese encephalitis virus
ITYECPKLT

SEQ ID NO: 218683 - protein, 9 aa, Japanese encephalitis virus
MGNDPEDVD

SEQ ID NO: 218684 - protein, 9 aa, Japanese encephalitis virus
GNDPEDVDC

SEQ ID NO: 218685 - protein, 9 aa, Japanese encephalitis virus
NDPEDVDCW

SEQ ID NO: 218686 - protein, 9 aa, Japanese encephalitis virus
DPEDVDCWC

SEQ ID NO: 218687 - protein, 9 aa, Japanese encephalitis virus
PEDVDCWCD

SEQ ID NO: 218688 - protein, 9 aa, Japanese encephalitis virus
EDVDCWCDN

SEQ ID NO: 218689 - protein, 9 aa, Japanese encephalitis virus
DVDCWCDNQ

SEQ ID NO: 218690 - protein, 9 aa, Japanese encephalitis virus
VDCWCDNQE

SEQ ID NO: 218691 - protein, 9 aa, Japanese encephalitis virus
DCWCDNQEV

SEQ ID NO: 218692 - protein, 9 aa, Japanese encephalitis virus
CWCDNQEVY

SEQ ID NO: 218693 - protein, 9 aa, Japanese encephalitis virus
WCDNQEVYV

SEQ ID NO: 218694 - protein, 9 aa, Japanese encephalitis virus
CDNQEVYVQ

SEQ ID NO: 218695 - protein, 9 aa, Japanese encephalitis virus
DNQEVYVQY

SEQ ID NO: 218696 - protein, 9 aa, Japanese encephalitis virus
NQEVYVQYG

SEQ ID NO: 218697 - protein, 9 aa, Japanese encephalitis virus
QEVYVQYGR

SEQ ID NO: 218698 - protein, 9 aa, Japanese encephalitis virus
EVYVQYGRC

SEQ ID NO: 218699 - protein, 9 aa, Japanese encephalitis virus
VYVQYGRCT

SEQ ID NO: 218700 - protein, 9 aa, Japanese encephalitis virus
YVQYGRCTR

SEQ ID NO: 218701 - protein, 9 aa, Japanese encephalitis virus
VQYGRCTRT

SEQ ID NO: 218702 - protein, 9 aa, Japanese encephalitis virus
QYGRCTRTR

SEQ ID NO: 218703 - protein, 9 aa, Japanese encephalitis virus
YGRCTRTRH

SEQ ID NO: 218704 - protein, 9 aa, Japanese encephalitis virus
GRCTRTRHS

SEQ ID NO: 218705 - protein, 9 aa, Japanese encephalitis virus
RCTRTRHSK

SEQ ID NO: 218706 - protein, 9 aa, Japanese encephalitis virus
CTRTRHSKR

SEQ ID NO: 218707 - protein, 9 aa, Japanese encephalitis virus
TRTRHSKRS

SEQ ID NO: 218708 - protein, 9 aa, Japanese encephalitis virus
RTRHSKRSR

SEQ ID NO: 218709 - protein, 9 aa, Japanese encephalitis virus
TRHSKRSRR

SEQ ID NO: 218710 - protein, 9 aa, Japanese encephalitis virus
RHSKRSRRS

SEQ ID NO: 218711 - protein, 9 aa, Japanese encephalitis virus
HSKRSRRSV

SEQ ID NO: 218712 - protein, 9 aa, Japanese encephalitis virus
SKRSRRSVS

SEQ ID NO: 218713 - protein, 9 aa, Japanese encephalitis virus
KRSRRSVSV

SEQ ID NO: 218714 - protein, 9 aa, Japanese encephalitis virus
RSRRSVSVQ

SEQ ID NO: 218715 - protein, 9 aa, Japanese encephalitis virus
SRRSVSVQT

SEQ ID NO: 218716 - protein, 9 aa, Japanese encephalitis virus
RRSVSVQTH

SEQ ID NO: 218717 - protein, 9 aa, Japanese encephalitis virus
RSVSVQTHG

SEQ ID NO: 218718 - protein, 9 aa, Japanese encephalitis virus
SVSVQTHGE

SEQ ID NO: 218719 - protein, 9 aa, Japanese encephalitis virus
VSVQTHGES

SEQ ID NO: 218720 - protein, 9 aa, Japanese encephalitis virus
SVQTHGESS

SEQ ID NO: 218721 - protein, 9 aa, Japanese encephalitis virus
VQTHGESSL

SEQ ID NO: 218722 - protein, 9 aa, Japanese encephalitis virus
QTHGESSLV

SEQ ID NO: 218723 - protein, 9 aa, Japanese encephalitis virus
THGESSLVN

SEQ ID NO: 218724 - protein, 9 aa, Japanese encephalitis virus
HGESSLVNK

SEQ ID NO: 218725 - protein, 9 aa, Japanese encephalitis virus
GESSLVNKK

SEQ ID NO: 218726 - protein, 9 aa, Japanese encephalitis virus
ESSLVNKKE

SEQ ID NO: 218727 - protein, 9 aa, Japanese encephalitis virus
SSLVNKKEA

SEQ ID NO: 218728 - protein, 9 aa, Japanese encephalitis virus
SLVNKKEAW

SEQ ID NO: 218729 - protein, 9 aa, Japanese encephalitis virus
LVNKKEAWL

SEQ ID NO: 218730 - protein, 9 aa, Japanese encephalitis virus
VNKKEAWLD

SEQ ID NO: 218731 - protein, 9 aa, Japanese encephalitis virus
NKKEAWLDS

SEQ ID NO: 218732 - protein, 9 aa, Japanese encephalitis virus
KKEAWLDST

SEQ ID NO: 218733 - protein, 9 aa, Japanese encephalitis virus
KEAWLDSTK

SEQ ID NO: 218734 - protein, 9 aa, Japanese encephalitis virus
EAWLDSTKA

SEQ ID NO: 218735 - protein, 9 aa, Japanese encephalitis virus
AWLDSTKAT

SEQ ID NO: 218736 - protein, 9 aa, Japanese encephalitis virus
WLDSTKATR

SEQ ID NO: 218737 - protein, 9 aa, Japanese encephalitis virus
LDSTKATRY

SEQ ID NO: 218738 - protein, 9 aa, Japanese encephalitis virus
DSTKATRYL

SEQ ID NO: 218739 - protein, 9 aa, Japanese encephalitis virus
STKATRYLM

SEQ ID NO: 218740 - protein, 9 aa, Japanese encephalitis virus
TKATRYLMK

SEQ ID NO: 218741 - protein, 9 aa, Japanese encephalitis virus
KATRYLMKT

SEQ ID NO: 218742 - protein, 9 aa, Japanese encephalitis virus
ATRYLMKTE

SEQ ID NO: 218743 - protein, 9 aa, Japanese encephalitis virus
TRYLMKTEN

SEQ ID NO: 218744 - protein, 9 aa, Japanese encephalitis virus
RYLMKTENW

SEQ ID NO: 218745 - protein, 9 aa, Japanese encephalitis virus
YLMKTENWI

SEQ ID NO: 218746 - protein, 9 aa, Japanese encephalitis virus
LMKTENWII

SEQ ID NO: 218747 - protein, 9 aa, Japanese encephalitis virus
MKTENWIIR

SEQ ID NO: 218748 - protein, 9 aa, Japanese encephalitis virus
KTENWIIRN

SEQ ID NO: 218749 - protein, 9 aa, Japanese encephalitis virus
TENWIIRNP

SEQ ID NO: 218750 - protein, 9 aa, Japanese encephalitis virus
ENWIIRNPG

SEQ ID NO: 218751 - protein, 9 aa, Japanese encephalitis virus
NWIIRNPGY

SEQ ID NO: 218752 - protein, 9 aa, Japanese encephalitis virus
WIIRNPGYA

SEQ ID NO: 218753 - protein, 9 aa, Japanese encephalitis virus
IIRNPGYAF

SEQ ID NO: 218754 - protein, 9 aa, Japanese encephalitis virus
IRNPGYAFL

SEQ ID NO: 218755 - protein, 9 aa, Japanese encephalitis virus
RNPGYAFLA

SEQ ID NO: 218756 - protein, 9 aa, Japanese encephalitis virus
NPGYAFLAA

SEQ ID NO: 218757 - protein, 9 aa, Japanese encephalitis virus
VLGWMLGSN

SEQ ID NO: 218758 - protein, 9 aa, Japanese encephalitis virus
LGWMLGSNN

SEQ ID NO: 218759 - protein, 9 aa, Japanese encephalitis virus
GWMLGSNNG

SEQ ID NO: 218760 - protein, 9 aa, Japanese encephalitis virus
GQRVVFTIL

SEQ ID NO: 218761 - protein, 9 aa, Japanese encephalitis virus
QRVVFTILL

SEQ ID NO: 218762 - protein, 9 aa, Japanese encephalitis virus
RVVFTILLL

SEQ ID NO: 218763 - protein, 9 aa, Japanese encephalitis virus
VVFTILLLL

SEQ ID NO: 218764 - protein, 9 aa, Japanese encephalitis virus
VFTILLLLV

SEQ ID NO: 218765 - protein, 9 aa, Japanese encephalitis virus
FTILLLLVA

SEQ ID NO: 218766 - protein, 9 aa, Japanese encephalitis virus
TILLLLVAP

SEQ ID NO: 218767 - protein, 9 aa, Japanese encephalitis virus
ILLLLVAPA

SEQ ID NO: 218768 - protein, 9 aa, Japanese encephalitis virus
LLLLVAPAY

SEQ ID NO: 218769 - protein, 9 aa, Japanese encephalitis virus
LLLVAPAYS

SEQ ID NO: 218770 - protein, 9 aa, Japanese encephalitis virus
LLVAPAYSF

SEQ ID NO: 218771 - protein, 9 aa, Japanese encephalitis virus
LVAPAYSFN

SEQ ID NO: 218772 - protein, 9 aa, Japanese encephalitis virus
VAPAYSFNC

SEQ ID NO: 218773 - protein, 9 aa, Japanese encephalitis virus
APAYSFNCL

SEQ ID NO: 218774 - protein, 9 aa, Japanese encephalitis virus
PAYSFNCLG

SEQ ID NO: 218775 - protein, 9 aa, Japanese encephalitis virus
AYSFNCLGM

SEQ ID NO: 218776 - protein, 9 aa, Japanese encephalitis virus
YSFNCLGMG

SEQ ID NO: 218777 - protein, 9 aa, Japanese encephalitis virus
SFNCLGMGN

SEQ ID NO: 218778 - protein, 9 aa, Japanese encephalitis virus
FNCLGMGNR

SEQ ID NO: 218779 - protein, 9 aa, Japanese encephalitis virus
NCLGMGNRD

SEQ ID NO: 218780 - protein, 9 aa, Japanese encephalitis virus
CLGMGNRDF

SEQ ID NO: 218781 - protein, 9 aa, Japanese encephalitis virus
LGMGNRDFI

SEQ ID NO: 218782 - protein, 9 aa, Japanese encephalitis virus
GMGNRDFIE

SEQ ID NO: 218783 - protein, 9 aa, Japanese encephalitis virus
MGNRDFIEG

SEQ ID NO: 218784 - protein, 9 aa, Japanese encephalitis virus
GNRDFIEGA

SEQ ID NO: 218785 - protein, 9 aa, Japanese encephalitis virus
NRDFIEGAS

SEQ ID NO: 218786 - protein, 9 aa, Japanese encephalitis virus
RDFIEGASG

SEQ ID NO: 218787 - protein, 9 aa, Japanese encephalitis virus
DFIEGASGA

SEQ ID NO: 218788 - protein, 9 aa, Japanese encephalitis virus
FIEGASGAT

SEQ ID NO: 218789 - protein, 9 aa, Japanese encephalitis virus
IEGASGATW

SEQ ID NO: 218790 - protein, 9 aa, Japanese encephalitis virus
EGASGATWV

SEQ ID NO: 218791 - protein, 9 aa, Japanese encephalitis virus
GASGATWVD

SEQ ID NO: 218792 - protein, 9 aa, Japanese encephalitis virus
ASGATWVDL

SEQ ID NO: 218793 - protein, 9 aa, Japanese encephalitis virus
SGATWVDLV

SEQ ID NO: 218794 - protein, 9 aa, Japanese encephalitis virus
GATWVDLVL

SEQ ID NO: 218795 - protein, 9 aa, Japanese encephalitis virus
ATWVDLVLE

SEQ ID NO: 218796 - protein, 9 aa, Japanese encephalitis virus
TWVDLVLEG

SEQ ID NO: 218797 - protein, 9 aa, Japanese encephalitis virus
WVDLVLEGD

SEQ ID NO: 218798 - protein, 9 aa, Japanese encephalitis virus
VDLVLEGDS

SEQ ID NO: 218799 - protein, 9 aa, Japanese encephalitis virus
DLVLEGDSC

SEQ ID NO: 218800 - protein, 9 aa, Japanese encephalitis virus
LVLEGDSCL

SEQ ID NO: 218801 - protein, 9 aa, Japanese encephalitis virus
VLEGDSCLT

SEQ ID NO: 218802 - protein, 9 aa, Japanese encephalitis virus
LEGDSCLTI

SEQ ID NO: 218803 - protein, 9 aa, Japanese encephalitis virus
EGDSCLTIM

SEQ ID NO: 218804 - protein, 9 aa, Japanese encephalitis virus
GDSCLTIMA

SEQ ID NO: 218805 - protein, 9 aa, Japanese encephalitis virus
DSCLTIMAN

SEQ ID NO: 218806 - protein, 9 aa, Japanese encephalitis virus
SCLTIMAND

SEQ ID NO: 218807 - protein, 9 aa, Japanese encephalitis virus
CLTIMANDK

SEQ ID NO: 218808 - protein, 9 aa, Japanese encephalitis virus
LTIMANDKP

SEQ ID NO: 218809 - protein, 9 aa, Japanese encephalitis virus
TIMANDKPT

SEQ ID NO: 218810 - protein, 9 aa, Japanese encephalitis virus
IMANDKPTL

SEQ ID NO: 218811 - protein, 9 aa, Japanese encephalitis virus
MANDKPTLD

SEQ ID NO: 218812 - protein, 9 aa, Japanese encephalitis virus
ANDKPTLDV

SEQ ID NO: 218813 - protein, 9 aa, Japanese encephalitis virus
NDKPTLDVR

SEQ ID NO: 218814 - protein, 9 aa, Japanese encephalitis virus
DKPTLDVRM

SEQ ID NO: 218815 - protein, 9 aa, Japanese encephalitis virus
KPTLDVRMI

SEQ ID NO: 218816 - protein, 9 aa, Japanese encephalitis virus
PTLDVRMIN

SEQ ID NO: 218817 - protein, 9 aa, Japanese encephalitis virus
TLDVRMINI

SEQ ID NO: 218818 - protein, 9 aa, Japanese encephalitis virus
LDVRMINIE

SEQ ID NO: 218819 - protein, 9 aa, Japanese encephalitis virus
DVRMINIEA

SEQ ID NO: 218820 - protein, 9 aa, Japanese encephalitis virus
VRMINIEAS

SEQ ID NO: 218821 - protein, 9 aa, Japanese encephalitis virus
RMINIEASQ

SEQ ID NO: 218822 - protein, 9 aa, Japanese encephalitis virus
MINIEASQL

SEQ ID NO: 218823 - protein, 9 aa, Japanese encephalitis virus
INIEASQLA

SEQ ID NO: 218824 - protein, 9 aa, Japanese encephalitis virus
NIEASQLAE

SEQ ID NO: 218825 - protein, 9 aa, Japanese encephalitis virus
IEASQLAEV

SEQ ID NO: 218826 - protein, 9 aa, Japanese encephalitis virus
EASQLAEVR

SEQ ID NO: 218827 - protein, 9 aa, Japanese encephalitis virus
ASQLAEVRS

SEQ ID NO: 218828 - protein, 9 aa, Japanese encephalitis virus
SQLAEVRSY

SEQ ID NO: 218829 - protein, 9 aa, Japanese encephalitis virus
QLAEVRSYC

SEQ ID NO: 218830 - protein, 9 aa, Japanese encephalitis virus
LAEVRSYCY

SEQ ID NO: 218831 - protein, 9 aa, Japanese encephalitis virus
AEVRSYCYH

SEQ ID NO: 218832 - protein, 9 aa, Japanese encephalitis virus
EVRSYCYHA

SEQ ID NO: 218833 - protein, 9 aa, Japanese encephalitis virus
VRSYCYHAS

SEQ ID NO: 218834 - protein, 9 aa, Japanese encephalitis virus
RSYCYHASV

SEQ ID NO: 218835 - protein, 9 aa, Japanese encephalitis virus
SYCYHASVT

SEQ ID NO: 218836 - protein, 9 aa, Japanese encephalitis virus
YCYHASVTD

SEQ ID NO: 218837 - protein, 9 aa, Japanese encephalitis virus
CYHASVTDI

SEQ ID NO: 218838 - protein, 9 aa, Japanese encephalitis virus
YHASVTDIS

SEQ ID NO: 218839 - protein, 9 aa, Japanese encephalitis virus
HASVTDIST

SEQ ID NO: 218840 - protein, 9 aa, Japanese encephalitis virus
ASVTDISTV

SEQ ID NO: 218841 - protein, 9 aa, Japanese encephalitis virus
SVTDISTVA

SEQ ID NO: 218842 - protein, 9 aa, Japanese encephalitis virus
VTDISTVAR

SEQ ID NO: 218843 - protein, 9 aa, Japanese encephalitis virus
TDISTVARC

SEQ ID NO: 218844 - protein, 9 aa, Japanese encephalitis virus
DISTVARCP

SEQ ID NO: 218845 - protein, 9 aa, Japanese encephalitis virus
ISTVARCPT

SEQ ID NO: 218846 - protein, 9 aa, Japanese encephalitis virus
STVARCPTT

SEQ ID NO: 218847 - protein, 9 aa, Japanese encephalitis virus
TVARCPTTG

SEQ ID NO: 218848 - protein, 9 aa, Japanese encephalitis virus
VARCPTTGE

SEQ ID NO: 218849 - protein, 9 aa, Japanese encephalitis virus
ARCPTTGEA

SEQ ID NO: 218850 - protein, 9 aa, Japanese encephalitis virus
RCPTTGEAH

SEQ ID NO: 218851 - protein, 9 aa, Japanese encephalitis virus
CPTTGEAHN

SEQ ID NO: 218852 - protein, 9 aa, Japanese encephalitis virus
PTTGEAHNE

SEQ ID NO: 218853 - protein, 9 aa, Japanese encephalitis virus
TTGEAHNEK

SEQ ID NO: 218854 - protein, 9 aa, Japanese encephalitis virus
TGEAHNEKR

SEQ ID NO: 218855 - protein, 9 aa, Japanese encephalitis virus
GEAHNEKRA

SEQ ID NO: 218856 - protein, 9 aa, Japanese encephalitis virus
EAHNEKRAD

SEQ ID NO: 218857 - protein, 9 aa, Japanese encephalitis virus
AHNEKRADS

SEQ ID NO: 218858 - protein, 9 aa, Japanese encephalitis virus
HNEKRADSS

SEQ ID NO: 218859 - protein, 9 aa, Japanese encephalitis virus
NEKRADSSY

SEQ ID NO: 218860 - protein, 9 aa, Japanese encephalitis virus
EKRADSSYV

SEQ ID NO: 218861 - protein, 9 aa, Japanese encephalitis virus
KRADSSYVC

SEQ ID NO: 218862 - protein, 9 aa, Japanese encephalitis virus
RADSSYVCK

SEQ ID NO: 218863 - protein, 9 aa, Japanese encephalitis virus
ADSSYVCKQ

SEQ ID NO: 218864 - protein, 9 aa, Japanese encephalitis virus
DSSYVCKQG

SEQ ID NO: 218865 - protein, 9 aa, Japanese encephalitis virus
SSYVCKQGF

SEQ ID NO: 218866 - protein, 9 aa, Japanese encephalitis virus
SYVCKQGFT

SEQ ID NO: 218867 - protein, 9 aa, Japanese encephalitis virus
YVCKQGFTD

SEQ ID NO: 218868 - protein, 9 aa, Japanese encephalitis virus
VCKQGFTDR

SEQ ID NO: 218869 - protein, 9 aa, Japanese encephalitis virus
CKQGFTDRG

SEQ ID NO: 218870 - protein, 9 aa, Japanese encephalitis virus
KQGFTDRGW

SEQ ID NO: 218871 - protein, 9 aa, Japanese encephalitis virus
QGFTDRGWG

SEQ ID NO: 218872 - protein, 9 aa, Japanese encephalitis virus
GFTDRGWGN

SEQ ID NO: 218873 - protein, 9 aa, Japanese encephalitis virus
FTDRGWGNG

SEQ ID NO: 218874 - protein, 9 aa, Japanese encephalitis virus
TDRGWGNGC

SEQ ID NO: 218875 - protein, 9 aa, Japanese encephalitis virus
DRGWGNGCG

SEQ ID NO: 218876 - protein, 9 aa, Japanese encephalitis virus
RGWGNGCGL

SEQ ID NO: 218877 - protein, 9 aa, Japanese encephalitis virus
GWGNGCGLF

SEQ ID NO: 218878 - protein, 9 aa, Japanese encephalitis virus
WGNGCGLFG

SEQ ID NO: 218879 - protein, 9 aa, Japanese encephalitis virus
GNGCGLFGK

SEQ ID NO: 218880 - protein, 9 aa, Japanese encephalitis virus
NGCGLFGKG

SEQ ID NO: 218881 - protein, 9 aa, Japanese encephalitis virus
GCGLFGKGS

SEQ ID NO: 218882 - protein, 9 aa, Japanese encephalitis virus
CGLFGKGSI

SEQ ID NO: 218883 - protein, 9 aa, Japanese encephalitis virus
GLFGKGSID

SEQ ID NO: 218884 - protein, 9 aa, Japanese encephalitis virus
LFGKGSIDT

SEQ ID NO: 218885 - protein, 9 aa, Japanese encephalitis virus
FGKGSIDTC

SEQ ID NO: 218886 - protein, 9 aa, Japanese encephalitis virus
GKGSIDTCA

SEQ ID NO: 218887 - protein, 9 aa, Japanese encephalitis virus
KGSIDTCAK

SEQ ID NO: 218888 - protein, 9 aa, Japanese encephalitis virus
GSIDTCAKF

SEQ ID NO: 218889 - protein, 9 aa, Japanese encephalitis virus
SIDTCAKFS

SEQ ID NO: 218890 - protein, 9 aa, Japanese encephalitis virus
IDTCAKFSC

SEQ ID NO: 218891 - protein, 9 aa, Japanese encephalitis virus
DTCAKFSCT

SEQ ID NO: 218892 - protein, 9 aa, Japanese encephalitis virus
TCAKFSCTS

SEQ ID NO: 218893 - protein, 9 aa, Japanese encephalitis virus
CAKFSCTSK

SEQ ID NO: 218894 - protein, 9 aa, Japanese encephalitis virus
AKFSCTSKA

SEQ ID NO: 218895 - protein, 9 aa, Japanese encephalitis virus
KFSCTSKAI

SEQ ID NO: 218896 - protein, 9 aa, Japanese encephalitis virus
FSCTSKAIG

SEQ ID NO: 218897 - protein, 9 aa, Japanese encephalitis virus
SCTSKAIGR

SEQ ID NO: 218898 - protein, 9 aa, Japanese encephalitis virus
TIQPENIKY

SEQ ID NO: 218899 - protein, 9 aa, Japanese encephalitis virus
IQPENIKYE

SEQ ID NO: 218900 - protein, 9 aa, Japanese encephalitis virus
QPENIKYEV

SEQ ID NO: 218901 - protein, 9 aa, Japanese encephalitis virus
PENIKYEVG

SEQ ID NO: 218902 - protein, 9 aa, Japanese encephalitis virus
ENIKYEVGI

SEQ ID NO: 218903 - protein, 9 aa, Japanese encephalitis virus
NIKYEVGIF

SEQ ID NO: 218904 - protein, 9 aa, Japanese encephalitis virus
IKYEVGIFV

SEQ ID NO: 218905 - protein, 9 aa, Japanese encephalitis virus
KYEVGIFVH

SEQ ID NO: 218906 - protein, 9 aa, Japanese encephalitis virus
YEVGIFVHG

SEQ ID NO: 218907 - protein, 9 aa, Japanese encephalitis virus
EVGIFVHGT

SEQ ID NO: 218908 - protein, 9 aa, Japanese encephalitis virus
VGIFVHGTT

SEQ ID NO: 218909 - protein, 9 aa, Japanese encephalitis virus
GIFVHGTTT

SEQ ID NO: 218910 - protein, 9 aa, Japanese encephalitis virus
IFVHGTTTS

SEQ ID NO: 218911 - protein, 9 aa, Japanese encephalitis virus
FVHGTTTSE

SEQ ID NO: 218912 - protein, 9 aa, Japanese encephalitis virus
VHGTTTSEN

SEQ ID NO: 218913 - protein, 9 aa, Japanese encephalitis virus
HGTTTSENH

SEQ ID NO: 218914 - protein, 9 aa, Japanese encephalitis virus
GTTTSENHG

SEQ ID NO: 218915 - protein, 9 aa, Japanese encephalitis virus
TTTSENHGN

SEQ ID NO: 218916 - protein, 9 aa, Japanese encephalitis virus
TTSENHGNY

SEQ ID NO: 218917 - protein, 9 aa, Japanese encephalitis virus
TSENHGNYS

SEQ ID NO: 218918 - protein, 9 aa, Japanese encephalitis virus
SENHGNYSA

SEQ ID NO: 218919 - protein, 9 aa, Japanese encephalitis virus
ENHGNYSAQ

SEQ ID NO: 218920 - protein, 9 aa, Japanese encephalitis virus
NHGNYSAQV

SEQ ID NO: 218921 - protein, 9 aa, Japanese encephalitis virus
HGNYSAQVG

SEQ ID NO: 218922 - protein, 9 aa, Japanese encephalitis virus
GNYSAQVGA

SEQ ID NO: 218923 - protein, 9 aa, Japanese encephalitis virus
NYSAQVGAS

SEQ ID NO: 218924 - protein, 9 aa, Japanese encephalitis virus
YSAQVGASQ

SEQ ID NO: 218925 - protein, 9 aa, Japanese encephalitis virus
SAQVGASQA

SEQ ID NO: 218926 - protein, 9 aa, Japanese encephalitis virus
AQVGASQAA

SEQ ID NO: 218927 - protein, 9 aa, Japanese encephalitis virus
QVGASQAAK

SEQ ID NO: 218928 - protein, 9 aa, Japanese encephalitis virus
VGASQAAKF

SEQ ID NO: 218929 - protein, 9 aa, Japanese encephalitis virus
GASQAAKFT

SEQ ID NO: 218930 - protein, 9 aa, Japanese encephalitis virus
ASQAAKFTV

SEQ ID NO: 218931 - protein, 9 aa, Japanese encephalitis virus
SQAAKFTVT

SEQ ID NO: 218932 - protein, 9 aa, Japanese encephalitis virus
QAAKFTVTP

SEQ ID NO: 218933 - protein, 9 aa, Japanese encephalitis virus
AAKFTVTPN

SEQ ID NO: 218934 - protein, 9 aa, Japanese encephalitis virus
AKFTVTPNA

SEQ ID NO: 218935 - protein, 9 aa, Japanese encephalitis virus
KFTVTPNAP

SEQ ID NO: 218936 - protein, 9 aa, Japanese encephalitis virus
FTVTPNAPS

SEQ ID NO: 218937 - protein, 9 aa, Japanese encephalitis virus
TVTPNAPSI

SEQ ID NO: 218938 - protein, 9 aa, Japanese encephalitis virus
VTPNAPSIT

SEQ ID NO: 218939 - protein, 9 aa, Japanese encephalitis virus
TPNAPSITL

SEQ ID NO: 218940 - protein, 9 aa, Japanese encephalitis virus
PNAPSITLK

SEQ ID NO: 218941 - protein, 9 aa, Japanese encephalitis virus
NAPSITLKL

SEQ ID NO: 218942 - protein, 9 aa, Japanese encephalitis virus
APSITLKLG

SEQ ID NO: 218943 - protein, 9 aa, Japanese encephalitis virus
PSITLKLGD

SEQ ID NO: 218944 - protein, 9 aa, Japanese encephalitis virus
TLKLGDYGE

SEQ ID NO: 218945 - protein, 9 aa, Japanese encephalitis virus
LKLGDYGEV

SEQ ID NO: 218946 - protein, 9 aa, Japanese encephalitis virus
KLGDYGEVT

SEQ ID NO: 218947 - protein, 9 aa, Japanese encephalitis virus
LGDYGEVTL

SEQ ID NO: 218948 - protein, 9 aa, Japanese encephalitis virus
GDYGEVTLD

SEQ ID NO: 218949 - protein, 9 aa, Japanese encephalitis virus
DYGEVTLDC

SEQ ID NO: 218950 - protein, 9 aa, Japanese encephalitis virus
YGEVTLDCE

SEQ ID NO: 218951 - protein, 9 aa, Japanese encephalitis virus
GEVTLDCEP

SEQ ID NO: 218952 - protein, 9 aa, Japanese encephalitis virus
EVTLDCEPR

SEQ ID NO: 218953 - protein, 9 aa, Japanese encephalitis virus
VTLDCEPRS

SEQ ID NO: 218954 - protein, 9 aa, Japanese encephalitis virus
TLDCEPRSG

SEQ ID NO: 218955 - protein, 9 aa, Japanese encephalitis virus
LDCEPRSGL

SEQ ID NO: 218956 - protein, 9 aa, Japanese encephalitis virus
DCEPRSGLN

SEQ ID NO: 218957 - protein, 9 aa, Japanese encephalitis virus
CEPRSGLNT

SEQ ID NO: 218958 - protein, 9 aa, Japanese encephalitis virus
EPRSGLNTE

SEQ ID NO: 218959 - protein, 9 aa, Japanese encephalitis virus
PRSGLNTEA

SEQ ID NO: 218960 - protein, 9 aa, Japanese encephalitis virus
RSGLNTEAF

SEQ ID NO: 218961 - protein, 9 aa, Japanese encephalitis virus
SGLNTEAFY

SEQ ID NO: 218962 - protein, 9 aa, Japanese encephalitis virus
GLNTEAFYV

SEQ ID NO: 218963 - protein, 9 aa, Japanese encephalitis virus
LNTEAFYVM

SEQ ID NO: 218964 - protein, 9 aa, Japanese encephalitis virus
NTEAFYVMT

SEQ ID NO: 218965 - protein, 9 aa, Japanese encephalitis virus
TEAFYVMTV

SEQ ID NO: 218966 - protein, 9 aa, Japanese encephalitis virus
EAFYVMTVG

SEQ ID NO: 218967 - protein, 9 aa, Japanese encephalitis virus
AFYVMTVGS

SEQ ID NO: 218968 - protein, 9 aa, Japanese encephalitis virus
FYVMTVGSK

SEQ ID NO: 218969 - protein, 9 aa, Japanese encephalitis virus
YVMTVGSKS

SEQ ID NO: 218970 - protein, 9 aa, Japanese encephalitis virus
VMTVGSKSF

SEQ ID NO: 218971 - protein, 9 aa, Japanese encephalitis virus
MTVGSKSFL

SEQ ID NO: 218972 - protein, 9 aa, Japanese encephalitis virus
TVGSKSFLV

SEQ ID NO: 218973 - protein, 9 aa, Japanese encephalitis virus
VGSKSFLVH

SEQ ID NO: 218974 - protein, 9 aa, Japanese encephalitis virus
GSKSFLVHR

SEQ ID NO: 218975 - protein, 9 aa, Japanese encephalitis virus
SKSFLVHRE

SEQ ID NO: 218976 - protein, 9 aa, Japanese encephalitis virus
KSFLVHREW

SEQ ID NO: 218977 - protein, 9 aa, Japanese encephalitis virus
SFLVHREWF

SEQ ID NO: 218978 - protein, 9 aa, Japanese encephalitis virus
FLVHREWFH

SEQ ID NO: 218979 - protein, 9 aa, Japanese encephalitis virus
LVHREWFHD

SEQ ID NO: 218980 - protein, 9 aa, Japanese encephalitis virus
VHREWFHDL

SEQ ID NO: 218981 - protein, 9 aa, Japanese encephalitis virus
HREWFHDLA

SEQ ID NO: 218982 - protein, 9 aa, Japanese encephalitis virus
REWFHDLAL

SEQ ID NO: 218983 - protein, 9 aa, Japanese encephalitis virus
EWFHDLALP

SEQ ID NO: 218984 - protein, 9 aa, Japanese encephalitis virus
WFHDLALPW

SEQ ID NO: 218985 - protein, 9 aa, Japanese encephalitis virus
FHDLALPWT

SEQ ID NO: 218986 - protein, 9 aa, Japanese encephalitis virus
HDLALPWTS

SEQ ID NO: 218987 - protein, 9 aa, Japanese encephalitis virus
DLALPWTSP

SEQ ID NO: 218988 - protein, 9 aa, Japanese encephalitis virus
LALPWTSPS

SEQ ID NO: 218989 - protein, 9 aa, Japanese encephalitis virus
ALPWTSPSS

SEQ ID NO: 218990 - protein, 9 aa, Japanese encephalitis virus
LPWTSPSST

SEQ ID NO: 218991 - protein, 9 aa, Japanese encephalitis virus
PWTSPSSTA

SEQ ID NO: 218992 - protein, 9 aa, Japanese encephalitis virus
WTSPSSTAW

SEQ ID NO: 218993 - protein, 9 aa, Japanese encephalitis virus
TSPSSTAWR

SEQ ID NO: 218994 - protein, 9 aa, Japanese encephalitis virus
SPSSTAWRN

SEQ ID NO: 218995 - protein, 9 aa, Japanese encephalitis virus
PSSTAWRNR

SEQ ID NO: 218996 - protein, 9 aa, Japanese encephalitis virus
SSTAWRNRE

SEQ ID NO: 218997 - protein, 9 aa, Japanese encephalitis virus
STAWRNREL

SEQ ID NO: 218998 - protein, 9 aa, Japanese encephalitis virus
TAWRNRELL

SEQ ID NO: 218999 - protein, 9 aa, Japanese encephalitis virus
AWRNRELLM

SEQ ID NO: 219000 - protein, 9 aa, Japanese encephalitis virus
WRNRELLME

SEQ ID NO: 219001 - protein, 9 aa, Japanese encephalitis virus
RNRELLMEF

SEQ ID NO: 219002 - protein, 9 aa, Japanese encephalitis virus
NRELLMEFE

SEQ ID NO: 219003 - protein, 9 aa, Japanese encephalitis virus
RELLMEFEE

SEQ ID NO: 219004 - protein, 9 aa, Japanese encephalitis virus
ELLMEFEEA

SEQ ID NO: 219005 - protein, 9 aa, Japanese encephalitis virus
LLMEFEEAH

SEQ ID NO: 219006 - protein, 9 aa, Japanese encephalitis virus
LMEFEEAHA

SEQ ID NO: 219007 - protein, 9 aa, Japanese encephalitis virus
MEFEEAHAT

SEQ ID NO: 219008 - protein, 9 aa, Japanese encephalitis virus
EFEEAHATK

SEQ ID NO: 219009 - protein, 9 aa, Japanese encephalitis virus
FEEAHATKQ

SEQ ID NO: 219010 - protein, 9 aa, Japanese encephalitis virus
EEAHATKQS

SEQ ID NO: 219011 - protein, 9 aa, Japanese encephalitis virus
EAHATKQSV

SEQ ID NO: 219012 - protein, 9 aa, Japanese encephalitis virus
AHATKQSVV

SEQ ID NO: 219013 - protein, 9 aa, Japanese encephalitis virus
HATKQSVVA

SEQ ID NO: 219014 - protein, 9 aa, Japanese encephalitis virus
ATKQSVVAL

SEQ ID NO: 219015 - protein, 9 aa, Japanese encephalitis virus
TKQSVVALG

SEQ ID NO: 219016 - protein, 9 aa, Japanese encephalitis virus
KQSVVALGS

SEQ ID NO: 219017 - protein, 9 aa, Japanese encephalitis virus
QSVVALGSQ

SEQ ID NO: 219018 - protein, 9 aa, Japanese encephalitis virus
SVVALGSQE

SEQ ID NO: 219019 - protein, 9 aa, Japanese encephalitis virus
VVALGSQEG

SEQ ID NO: 219020 - protein, 9 aa, Japanese encephalitis virus
VALGSQEGG

SEQ ID NO: 219021 - protein, 9 aa, Japanese encephalitis virus
ALGSQEGGL

SEQ ID NO: 219022 - protein, 9 aa, Japanese encephalitis virus
LGSQEGGLH

SEQ ID NO: 219023 - protein, 9 aa, Japanese encephalitis virus
GSQEGGLHQ

SEQ ID NO: 219024 - protein, 9 aa, Japanese encephalitis virus
SQEGGLHQA

SEQ ID NO: 219025 - protein, 9 aa, Japanese encephalitis virus
QEGGLHQAL

SEQ ID NO: 219026 - protein, 9 aa, Japanese encephalitis virus
EGGLHQALA

SEQ ID NO: 219027 - protein, 9 aa, Japanese encephalitis virus
GGLHQALAG

SEQ ID NO: 219028 - protein, 9 aa, Japanese encephalitis virus
GLHQALAGA

SEQ ID NO: 219029 - protein, 9 aa, Japanese encephalitis virus
LHQALAGAI

SEQ ID NO: 219030 - protein, 9 aa, Japanese encephalitis virus
HQALAGAIV

SEQ ID NO: 219031 - protein, 9 aa, Japanese encephalitis virus
QALAGAIVV

SEQ ID NO: 219032 - protein, 9 aa, Japanese encephalitis virus
ALAGAIVVE

SEQ ID NO: 219033 - protein, 9 aa, Japanese encephalitis virus
LAGAIVVEY

SEQ ID NO: 219034 - protein, 9 aa, Japanese encephalitis virus
AGAIVVEYS

SEQ ID NO: 219035 - protein, 9 aa, Japanese encephalitis virus
GAIVVEYSS

SEQ ID NO: 219036 - protein, 9 aa, Japanese encephalitis virus
AIVVEYSSS

SEQ ID NO: 219037 - protein, 9 aa, Japanese encephalitis virus
IVVEYSSSV

SEQ ID NO: 219038 - protein, 9 aa, Japanese encephalitis virus
VVEYSSSVK

SEQ ID NO: 219039 - protein, 9 aa, Japanese encephalitis virus
VEYSSSVKL

SEQ ID NO: 219040 - protein, 9 aa, Japanese encephalitis virus
EYSSSVKLT

SEQ ID NO: 219041 - protein, 9 aa, Japanese encephalitis virus
YSSSVKLTS

SEQ ID NO: 219042 - protein, 9 aa, Japanese encephalitis virus
SSSVKLTSG

SEQ ID NO: 219043 - protein, 9 aa, Japanese encephalitis virus
SSVKLTSGH

SEQ ID NO: 219044 - protein, 9 aa, Japanese encephalitis virus
SVKLTSGHL

SEQ ID NO: 219045 - protein, 9 aa, Japanese encephalitis virus
VKLTSGHLK

SEQ ID NO: 219046 - protein, 9 aa, Japanese encephalitis virus
KLTSGHLKC

SEQ ID NO: 219047 - protein, 9 aa, Japanese encephalitis virus
LTSGHLKCR

SEQ ID NO: 219048 - protein, 9 aa, Japanese encephalitis virus
TSGHLKCRL

SEQ ID NO: 219049 - protein, 9 aa, Japanese encephalitis virus
SGHLKCRLK

SEQ ID NO: 219050 - protein, 9 aa, Japanese encephalitis virus
GHLKCRLKM

SEQ ID NO: 219051 - protein, 9 aa, Japanese encephalitis virus
HLKCRLKMD

SEQ ID NO: 219052 - protein, 9 aa, Japanese encephalitis virus
LKCRLKMDK

SEQ ID NO: 219053 - protein, 9 aa, Japanese encephalitis virus
KCRLKMDKL

SEQ ID NO: 219054 - protein, 9 aa, Japanese encephalitis virus
CRLKMDKLA

SEQ ID NO: 219055 - protein, 9 aa, Japanese encephalitis virus
RLKMDKLAL

SEQ ID NO: 219056 - protein, 9 aa, Japanese encephalitis virus
LKMDKLALK

SEQ ID NO: 219057 - protein, 9 aa, Japanese encephalitis virus
KMDKLALKG

SEQ ID NO: 219058 - protein, 9 aa, Japanese encephalitis virus
MDKLALKGT

SEQ ID NO: 219059 - protein, 9 aa, Japanese encephalitis virus
DKLALKGTT

SEQ ID NO: 219060 - protein, 9 aa, Japanese encephalitis virus
KLALKGTTY

SEQ ID NO: 219061 - protein, 9 aa, Japanese encephalitis virus
LALKGTTYG

SEQ ID NO: 219062 - protein, 9 aa, Japanese encephalitis virus
ALKGTTYGM

SEQ ID NO: 219063 - protein, 9 aa, Japanese encephalitis virus
LKGTTYGMC

SEQ ID NO: 219064 - protein, 9 aa, Japanese encephalitis virus
KGTTYGMCT

SEQ ID NO: 219065 - protein, 9 aa, Japanese encephalitis virus
GTTYGMCTE

SEQ ID NO: 219066 - protein, 9 aa, Japanese encephalitis virus
TTYGMCTEK

SEQ ID NO: 219067 - protein, 9 aa, Japanese encephalitis virus
TYGMCTEKF

SEQ ID NO: 219068 - protein, 9 aa, Japanese encephalitis virus
YGMCTEKFS

SEQ ID NO: 219069 - protein, 9 aa, Japanese encephalitis virus
GMCTEKFSF

SEQ ID NO: 219070 - protein, 9 aa, Japanese encephalitis virus
MCTEKFSFA

SEQ ID NO: 219071 - protein, 9 aa, Japanese encephalitis virus
CTEKFSFAK

SEQ ID NO: 219072 - protein, 9 aa, Japanese encephalitis virus
TEKFSFAKN

SEQ ID NO: 219073 - protein, 9 aa, Japanese encephalitis virus
EKFSFAKNP

SEQ ID NO: 219074 - protein, 9 aa, Japanese encephalitis virus
KFSFAKNPA

SEQ ID NO: 219075 - protein, 9 aa, Japanese encephalitis virus
FSFAKNPAD

SEQ ID NO: 219076 - protein, 9 aa, Japanese encephalitis virus
SFAKNPADT

SEQ ID NO: 219077 - protein, 9 aa, Japanese encephalitis virus
FAKNPADTG

SEQ ID NO: 219078 - protein, 9 aa, Japanese encephalitis virus
AKNPADTGH

SEQ ID NO: 219079 - protein, 9 aa, Japanese encephalitis virus
KNPADTGHG

SEQ ID NO: 219080 - protein, 9 aa, Japanese encephalitis virus
NPADTGHGT

SEQ ID NO: 219081 - protein, 9 aa, Japanese encephalitis virus
PADTGHGTV

SEQ ID NO: 219082 - protein, 9 aa, Japanese encephalitis virus
ADTGHGTVV

SEQ ID NO: 219083 - protein, 9 aa, Japanese encephalitis virus
DTGHGTVVI

SEQ ID NO: 219084 - protein, 9 aa, Japanese encephalitis virus
TGHGTVVIE

SEQ ID NO: 219085 - protein, 9 aa, Japanese encephalitis virus
GHGTVVIEL

SEQ ID NO: 219086 - protein, 9 aa, Japanese encephalitis virus
HGTVVIELS

SEQ ID NO: 219087 - protein, 9 aa, Japanese encephalitis virus
GTVVIELSY

SEQ ID NO: 219088 - protein, 9 aa, Japanese encephalitis virus
TVVIELSYS

SEQ ID NO: 219089 - protein, 9 aa, Japanese encephalitis virus
VVIELSYSG

SEQ ID NO: 219090 - protein, 9 aa, Japanese encephalitis virus
VIELSYSGS

SEQ ID NO: 219091 - protein, 9 aa, Japanese encephalitis virus
IELSYSGSD

SEQ ID NO: 219092 - protein, 9 aa, Japanese encephalitis virus
ELSYSGSDG

SEQ ID NO: 219093 - protein, 9 aa, Japanese encephalitis virus
LSYSGSDGP

SEQ ID NO: 219094 - protein, 9 aa, Japanese encephalitis virus
SYSGSDGPC

SEQ ID NO: 219095 - protein, 9 aa, Japanese encephalitis virus
YSGSDGPCK

SEQ ID NO: 219096 - protein, 9 aa, Japanese encephalitis virus
SGSDGPCKI

SEQ ID NO: 219097 - protein, 9 aa, Japanese encephalitis virus
GSDGPCKIP

SEQ ID NO: 219098 - protein, 9 aa, Japanese encephalitis virus
SDGPCKIPI

SEQ ID NO: 219099 - protein, 9 aa, Japanese encephalitis virus
DGPCKIPIV

SEQ ID NO: 219100 - protein, 9 aa, Japanese encephalitis virus
GPCKIPIVS

SEQ ID NO: 219101 - protein, 9 aa, Japanese encephalitis virus
PCKIPIVSV

SEQ ID NO: 219102 - protein, 9 aa, Japanese encephalitis virus
CKIPIVSVA

SEQ ID NO: 219103 - protein, 9 aa, Japanese encephalitis virus
KIPIVSVAS

SEQ ID NO: 219104 - protein, 9 aa, Japanese encephalitis virus
IPIVSVASL

SEQ ID NO: 219105 - protein, 9 aa, Japanese encephalitis virus
PIVSVASLN

SEQ ID NO: 219106 - protein, 9 aa, Japanese encephalitis virus
IVSVASLND

SEQ ID NO: 219107 - protein, 9 aa, Japanese encephalitis virus
VSVASLNDM

SEQ ID NO: 219108 - protein, 9 aa, Japanese encephalitis virus
SVASLNDMT

SEQ ID NO: 219109 - protein, 9 aa, Japanese encephalitis virus
VASLNDMTP

SEQ ID NO: 219110 - protein, 9 aa, Japanese encephalitis virus
ASLNDMTPV

SEQ ID NO: 219111 - protein, 9 aa, Japanese encephalitis virus
SLNDMTPVG

SEQ ID NO: 219112 - protein, 9 aa, Japanese encephalitis virus
LNDMTPVGR

SEQ ID NO: 219113 - protein, 9 aa, Japanese encephalitis virus
NDMTPVGRL

SEQ ID NO: 219114 - protein, 9 aa, Japanese encephalitis virus
DMTPVGRLV

SEQ ID NO: 219115 - protein, 9 aa, Japanese encephalitis virus
MTPVGRLVT

SEQ ID NO: 219116 - protein, 9 aa, Japanese encephalitis virus
TPVGRLVTV

SEQ ID NO: 219117 - protein, 9 aa, Japanese encephalitis virus
PVGRLVTVN

SEQ ID NO: 219118 - protein, 9 aa, Japanese encephalitis virus
VGRLVTVNP

SEQ ID NO: 219119 - protein, 9 aa, Japanese encephalitis virus
GRLVTVNPF

SEQ ID NO: 219120 - protein, 9 aa, Japanese encephalitis virus
RLVTVNPFV

SEQ ID NO: 219121 - protein, 9 aa, Japanese encephalitis virus
LVTVNPFVA

SEQ ID NO: 219122 - protein, 9 aa, Japanese encephalitis virus
VTVNPFVAT

SEQ ID NO: 219123 - protein, 9 aa, Japanese encephalitis virus
TVNPFVATS

SEQ ID NO: 219124 - protein, 9 aa, Japanese encephalitis virus
VNPFVATSS

SEQ ID NO: 219125 - protein, 9 aa, Japanese encephalitis virus
NPFVATSSA

SEQ ID NO: 219126 - protein, 9 aa, Japanese encephalitis virus
PFVATSSAN

SEQ ID NO: 219127 - protein, 9 aa, Japanese encephalitis virus
FVATSSANS

SEQ ID NO: 219128 - protein, 9 aa, Japanese encephalitis virus
VATSSANSK

SEQ ID NO: 219129 - protein, 9 aa, Japanese encephalitis virus
ATSSANSKV

SEQ ID NO: 219130 - protein, 9 aa, Japanese encephalitis virus
TSSANSKVL

SEQ ID NO: 219131 - protein, 9 aa, Japanese encephalitis virus
SSANSKVLV

SEQ ID NO: 219132 - protein, 9 aa, Japanese encephalitis virus
SANSKVLVE

SEQ ID NO: 219133 - protein, 9 aa, Japanese encephalitis virus
ANSKVLVEM

SEQ ID NO: 219134 - protein, 9 aa, Japanese encephalitis virus
NSKVLVEME

SEQ ID NO: 219135 - protein, 9 aa, Japanese encephalitis virus
SKVLVEMEP

SEQ ID NO: 219136 - protein, 9 aa, Japanese encephalitis virus
KVLVEMEPP

SEQ ID NO: 219137 - protein, 9 aa, Japanese encephalitis virus
VLVEMEPPF

SEQ ID NO: 219138 - protein, 9 aa, Japanese encephalitis virus
LVEMEPPFG

SEQ ID NO: 219139 - protein, 9 aa, Japanese encephalitis virus
VEMEPPFGD

SEQ ID NO: 219140 - protein, 9 aa, Japanese encephalitis virus
EMEPPFGDS

SEQ ID NO: 219141 - protein, 9 aa, Japanese encephalitis virus
MEPPFGDSY

SEQ ID NO: 219142 - protein, 9 aa, Japanese encephalitis virus
EPPFGDSYI

SEQ ID NO: 219143 - protein, 9 aa, Japanese encephalitis virus
PPFGDSYIV

SEQ ID NO: 219144 - protein, 9 aa, Japanese encephalitis virus
PFGDSYIVV

SEQ ID NO: 219145 - protein, 9 aa, Japanese encephalitis virus
FGDSYIVVG

SEQ ID NO: 219146 - protein, 9 aa, Japanese encephalitis virus
GDSYIVVGR

SEQ ID NO: 219147 - protein, 9 aa, Japanese encephalitis virus
DSYIVVGRG

SEQ ID NO: 219148 - protein, 9 aa, Japanese encephalitis virus
KQINHHWHK

SEQ ID NO: 219149 - protein, 9 aa, Japanese encephalitis virus
HHWHKAGST

SEQ ID NO: 219150 - protein, 9 aa, Japanese encephalitis virus
HWHKAGSTL

SEQ ID NO: 219151 - protein, 9 aa, Japanese encephalitis virus
WHKAGSTLG

SEQ ID NO: 219152 - protein, 9 aa, Japanese encephalitis virus
HKAGSTLGK

SEQ ID NO: 219153 - protein, 9 aa, Japanese encephalitis virus
KAGSTLGKA

SEQ ID NO: 219154 - protein, 9 aa, Japanese encephalitis virus
AGSTLGKAF

SEQ ID NO: 219155 - protein, 9 aa, Japanese encephalitis virus
GSTLGKAFS

SEQ ID NO: 219156 - protein, 9 aa, Japanese encephalitis virus
STLGKAFST

SEQ ID NO: 219157 - protein, 9 aa, Japanese encephalitis virus
TLGKAFSTT

SEQ ID NO: 219158 - protein, 9 aa, Japanese encephalitis virus
LGKAFSTTL

SEQ ID NO: 219159 - protein, 9 aa, Japanese encephalitis virus
GKAFSTTLK

SEQ ID NO: 219160 - protein, 9 aa, Japanese encephalitis virus
KAFSTTLKG

SEQ ID NO: 219161 - protein, 9 aa, Japanese encephalitis virus
AFSTTLKGA

SEQ ID NO: 219162 - protein, 9 aa, Japanese encephalitis virus
FSTTLKGAQ

SEQ ID NO: 219163 - protein, 9 aa, Japanese encephalitis virus
STTLKGAQR

SEQ ID NO: 219164 - protein, 9 aa, Japanese encephalitis virus
TTLKGAQRL

SEQ ID NO: 219165 - protein, 9 aa, Japanese encephalitis virus
TLKGAQRLA

SEQ ID NO: 219166 - protein, 9 aa, Japanese encephalitis virus
LKGAQRLAA

SEQ ID NO: 219167 - protein, 9 aa, Japanese encephalitis virus
KGAQRLAAL

SEQ ID NO: 219168 - protein, 9 aa, Japanese encephalitis virus
GAQRLAALG

SEQ ID NO: 219169 - protein, 9 aa, Japanese encephalitis virus
AQRLAALGD

SEQ ID NO: 219170 - protein, 9 aa, Japanese encephalitis virus
QRLAALGDT

SEQ ID NO: 219171 - protein, 9 aa, Japanese encephalitis virus
RLAALGDTA

SEQ ID NO: 219172 - protein, 9 aa, Japanese encephalitis virus
LAALGDTAW

SEQ ID NO: 219173 - protein, 9 aa, Japanese encephalitis virus
AALGDTAWD

SEQ ID NO: 219174 - protein, 9 aa, Japanese encephalitis virus
ALGDTAWDF

SEQ ID NO: 219175 - protein, 9 aa, Japanese encephalitis virus
LGDTAWDFG

SEQ ID NO: 219176 - protein, 9 aa, Japanese encephalitis virus
GDTAWDFGS

SEQ ID NO: 219177 - protein, 9 aa, Japanese encephalitis virus
DTAWDFGSI

SEQ ID NO: 219178 - protein, 9 aa, Japanese encephalitis virus
TAWDFGSIG

SEQ ID NO: 219179 - protein, 9 aa, Japanese encephalitis virus
AWDFGSIGG

SEQ ID NO: 219180 - protein, 9 aa, Japanese encephalitis virus
WDFGSIGGV

SEQ ID NO: 219181 - protein, 9 aa, Japanese encephalitis virus
DFGSIGGVF

SEQ ID NO: 219182 - protein, 9 aa, Japanese encephalitis virus
FGSIGGVFN

SEQ ID NO: 219183 - protein, 9 aa, Japanese encephalitis virus
GSIGGVFNS

SEQ ID NO: 219184 - protein, 9 aa, Japanese encephalitis virus
SIGGVFNSI

SEQ ID NO: 219185 - protein, 9 aa, Japanese encephalitis virus
IGGVFNSIG

SEQ ID NO: 219186 - protein, 9 aa, Japanese encephalitis virus
GGVFNSIGK

SEQ ID NO: 219187 - protein, 9 aa, Japanese encephalitis virus
GVFNSIGKA

SEQ ID NO: 219188 - protein, 9 aa, Japanese encephalitis virus
VFNSIGKAV

SEQ ID NO: 219189 - protein, 9 aa, Japanese encephalitis virus
FNSIGKAVH

SEQ ID NO: 219190 - protein, 9 aa, Japanese encephalitis virus
NSIGKAVHQ

SEQ ID NO: 219191 - protein, 9 aa, Japanese encephalitis virus
SIGKAVHQV

SEQ ID NO: 219192 - protein, 9 aa, Japanese encephalitis virus
IGKAVHQVF

SEQ ID NO: 219193 - protein, 9 aa, Japanese encephalitis virus
GKAVHQVFG

SEQ ID NO: 219194 - protein, 9 aa, Japanese encephalitis virus
KAVHQVFGG

SEQ ID NO: 219195 - protein, 9 aa, Japanese encephalitis virus
AVHQVFGGA

SEQ ID NO: 219196 - protein, 9 aa, Japanese encephalitis virus
VHQVFGGAF

SEQ ID NO: 219197 - protein, 9 aa, Japanese encephalitis virus
HQVFGGAFR

SEQ ID NO: 219198 - protein, 9 aa, Japanese encephalitis virus
QVFGGAFRT

SEQ ID NO: 219199 - protein, 9 aa, Japanese encephalitis virus
VFGGAFRTL

SEQ ID NO: 219200 - protein, 9 aa, Japanese encephalitis virus
FGGAFRTLF

SEQ ID NO: 219201 - protein, 9 aa, Japanese encephalitis virus
GGAFRTLFG

SEQ ID NO: 219202 - protein, 9 aa, Japanese encephalitis virus
GAFRTLFGG

SEQ ID NO: 219203 - protein, 9 aa, Japanese encephalitis virus
AFRTLFGGM

SEQ ID NO: 219204 - protein, 9 aa, Japanese encephalitis virus
FRTLFGGMS

SEQ ID NO: 219205 - protein, 9 aa, Japanese encephalitis virus
RTLFGGMSW

SEQ ID NO: 219206 - protein, 9 aa, Japanese encephalitis virus
TLFGGMSWI

SEQ ID NO: 219207 - protein, 9 aa, Japanese encephalitis virus
LFGGMSWIT

SEQ ID NO: 219208 - protein, 9 aa, Japanese encephalitis virus
FGGMSWITQ

SEQ ID NO: 219209 - protein, 9 aa, Japanese encephalitis virus
GGMSWITQG

SEQ ID NO: 219210 - protein, 9 aa, Japanese encephalitis virus
GMSWITQGL

SEQ ID NO: 219211 - protein, 9 aa, Japanese encephalitis virus
MSWITQGLM

SEQ ID NO: 219212 - protein, 9 aa, Japanese encephalitis virus
SWITQGLMG

SEQ ID NO: 219213 - protein, 9 aa, Japanese encephalitis virus
WITQGLMGA

SEQ ID NO: 219214 - protein, 9 aa, Japanese encephalitis virus
ITQGLMGAL

SEQ ID NO: 219215 - protein, 9 aa, Japanese encephalitis virus
TQGLMGALL

SEQ ID NO: 219216 - protein, 9 aa, Japanese encephalitis virus
QGLMGALLL

SEQ ID NO: 219217 - protein, 9 aa, Japanese encephalitis virus
GLMGALLLW

SEQ ID NO: 219218 - protein, 9 aa, Japanese encephalitis virus
LMGALLLWM

SEQ ID NO: 219219 - protein, 9 aa, Japanese encephalitis virus
MGALLLWMG

SEQ ID NO: 219220 - protein, 9 aa, Japanese encephalitis virus
GALLLWMGV

SEQ ID NO: 219221 - protein, 9 aa, Japanese encephalitis virus
ALLLWMGVN

SEQ ID NO: 219222 - protein, 9 aa, Japanese encephalitis virus
LLLWMGVNA

SEQ ID NO: 219223 - protein, 9 aa, Japanese encephalitis virus
LLWMGVNAR

SEQ ID NO: 219224 - protein, 9 aa, Japanese encephalitis virus
LWMGVNARD

SEQ ID NO: 219225 - protein, 9 aa, Japanese encephalitis virus
WMGVNARDR

SEQ ID NO: 219226 - protein, 9 aa, Japanese encephalitis virus
MGVNARDRS

SEQ ID NO: 219227 - protein, 9 aa, Japanese encephalitis virus
GVNARDRSI

SEQ ID NO: 219228 - protein, 9 aa, Japanese encephalitis virus
VNARDRSIA

SEQ ID NO: 219229 - protein, 9 aa, Japanese encephalitis virus
NARDRSIAL

SEQ ID NO: 219230 - protein, 9 aa, Japanese encephalitis virus
ARDRSIALA

SEQ ID NO: 219231 - protein, 9 aa, Japanese encephalitis virus
RDRSIALAF

SEQ ID NO: 219232 - protein, 9 aa, Japanese encephalitis virus
DRSIALAFL

SEQ ID NO: 219233 - protein, 9 aa, Japanese encephalitis virus
RSIALAFLA

SEQ ID NO: 219234 - protein, 9 aa, Japanese encephalitis virus
SIALAFLAT

SEQ ID NO: 219235 - protein, 9 aa, Japanese encephalitis virus
IALAFLATG

SEQ ID NO: 219236 - protein, 9 aa, Japanese encephalitis virus
ALAFLATGG

SEQ ID NO: 219237 - protein, 9 aa, Japanese encephalitis virus
LAFLATGGV

SEQ ID NO: 219238 - protein, 9 aa, Japanese encephalitis virus
AFLATGGVL

SEQ ID NO: 219239 - protein, 9 aa, Japanese encephalitis virus
FLATGGVLV

SEQ ID NO: 219240 - protein, 9 aa, Japanese encephalitis virus
LATGGVLVF

SEQ ID NO: 219241 - protein, 9 aa, Japanese encephalitis virus
ATGGVLVFL

SEQ ID NO: 219242 - protein, 9 aa, Japanese encephalitis virus
TGGVLVFLA

SEQ ID NO: 219243 - protein, 9 aa, Japanese encephalitis virus
GGVLVFLAT

SEQ ID NO: 219244 - protein, 9 aa, Japanese encephalitis virus
GVLVFLATN

SEQ ID NO: 219245 - protein, 9 aa, Japanese encephalitis virus
VLVFLATNV

SEQ ID NO: 219246 - protein, 9 aa, Japanese encephalitis virus
LVFLATNVH

SEQ ID NO: 219247 - protein, 9 aa, Japanese encephalitis virus
VFLATNVHA

SEQ ID NO: 219248 - protein, 9 aa, Japanese encephalitis virus
FLATNVHAD

SEQ ID NO: 219249 - protein, 9 aa, Japanese encephalitis virus
LATNVHADT

SEQ ID NO: 219250 - protein, 9 aa, Japanese encephalitis virus
ATNVHADTG

SEQ ID NO: 219251 - protein, 9 aa, Japanese encephalitis virus
TNVHADTGC

SEQ ID NO: 219252 - protein, 9 aa, Japanese encephalitis virus
NVHADTGCA

SEQ ID NO: 219253 - protein, 9 aa, Japanese encephalitis virus
VHADTGCAI

SEQ ID NO: 219254 - protein, 9 aa, Japanese encephalitis virus
HADTGCAID

SEQ ID NO: 219255 - protein, 9 aa, Japanese encephalitis virus
ADTGCAIDI

SEQ ID NO: 219256 - protein, 9 aa, Japanese encephalitis virus
DTGCAIDIT

SEQ ID NO: 219257 - protein, 9 aa, Japanese encephalitis virus
TGCAIDITR

SEQ ID NO: 219258 - protein, 9 aa, Japanese encephalitis virus
TRKEMRCGS

SEQ ID NO: 219259 - protein, 9 aa, Japanese encephalitis virus
RKEMRCGSG

SEQ ID NO: 219260 - protein, 9 aa, Japanese encephalitis virus
KEMRCGSGI

SEQ ID NO: 219261 - protein, 9 aa, Japanese encephalitis virus
EMRCGSGIF

SEQ ID NO: 219262 - protein, 9 aa, Japanese encephalitis virus
MRCGSGIFV

SEQ ID NO: 219263 - protein, 9 aa, Japanese encephalitis virus
RCGSGIFVH

SEQ ID NO: 219264 - protein, 9 aa, Japanese encephalitis virus
CGSGIFVHN

SEQ ID NO: 219265 - protein, 9 aa, Japanese encephalitis virus
GSGIFVHND

SEQ ID NO: 219266 - protein, 9 aa, Japanese encephalitis virus
SGIFVHNDV

SEQ ID NO: 219267 - protein, 9 aa, Japanese encephalitis virus
GIFVHNDVE

SEQ ID NO: 219268 - protein, 9 aa, Japanese encephalitis virus
IFVHNDVEA

SEQ ID NO: 219269 - protein, 9 aa, Japanese encephalitis virus
FVHNDVEAW

SEQ ID NO: 219270 - protein, 9 aa, Japanese encephalitis virus
VHNDVEAWV

SEQ ID NO: 219271 - protein, 9 aa, Japanese encephalitis virus
HNDVEAWVD

SEQ ID NO: 219272 - protein, 9 aa, Japanese encephalitis virus
NDVEAWVDR

SEQ ID NO: 219273 - protein, 9 aa, Japanese encephalitis virus
DVEAWVDRY

SEQ ID NO: 219274 - protein, 9 aa, Japanese encephalitis virus
VEAWVDRYK

SEQ ID NO: 219275 - protein, 9 aa, Japanese encephalitis virus
EAWVDRYKY

SEQ ID NO: 219276 - protein, 9 aa, Japanese encephalitis virus
AWVDRYKYL

SEQ ID NO: 219277 - protein, 9 aa, Japanese encephalitis virus
WVDRYKYLP

SEQ ID NO: 219278 - protein, 9 aa, Japanese encephalitis virus
VDRYKYLPE

SEQ ID NO: 219279 - protein, 9 aa, Japanese encephalitis virus
DRYKYLPET

SEQ ID NO: 219280 - protein, 9 aa, Japanese encephalitis virus
RYKYLPETP

SEQ ID NO: 219281 - protein, 9 aa, Japanese encephalitis virus
YKYLPETPR

SEQ ID NO: 219282 - protein, 9 aa, Japanese encephalitis virus
KYLPETPRS

SEQ ID NO: 219283 - protein, 9 aa, Japanese encephalitis virus
YLPETPRSL

SEQ ID NO: 219284 - protein, 9 aa, Japanese encephalitis virus
LPETPRSLA

SEQ ID NO: 219285 - protein, 9 aa, Japanese encephalitis virus
PETPRSLAK

SEQ ID NO: 219286 - protein, 9 aa, Japanese encephalitis virus
ETPRSLAKI

SEQ ID NO: 219287 - protein, 9 aa, Japanese encephalitis virus
TPRSLAKIV

SEQ ID NO: 219288 - protein, 9 aa, Japanese encephalitis virus
PRSLAKIVH

SEQ ID NO: 219289 - protein, 9 aa, Japanese encephalitis virus
RSLAKIVHK

SEQ ID NO: 219290 - protein, 9 aa, Japanese encephalitis virus
SLAKIVHKA

SEQ ID NO: 219291 - protein, 9 aa, Japanese encephalitis virus
LAKIVHKAH

SEQ ID NO: 219292 - protein, 9 aa, Japanese encephalitis virus
AKIVHKAHK

SEQ ID NO: 219293 - protein, 9 aa, Japanese encephalitis virus
KIVHKAHKE

SEQ ID NO: 219294 - protein, 9 aa, Japanese encephalitis virus
IVHKAHKEG

SEQ ID NO: 219295 - protein, 9 aa, Japanese encephalitis virus
VHKAHKEGV

SEQ ID NO: 219296 - protein, 9 aa, Japanese encephalitis virus
HKAHKEGVC

SEQ ID NO: 219297 - protein, 9 aa, Japanese encephalitis virus
KAHKEGVCG

SEQ ID NO: 219298 - protein, 9 aa, Japanese encephalitis virus
AHKEGVCGV

SEQ ID NO: 219299 - protein, 9 aa, Japanese encephalitis virus
HKEGVCGVR

SEQ ID NO: 219300 - protein, 9 aa, Japanese encephalitis virus
KEGVCGVRS

SEQ ID NO: 219301 - protein, 9 aa, Japanese encephalitis virus
EGVCGVRSV

SEQ ID NO: 219302 - protein, 9 aa, Japanese encephalitis virus
GVCGVRSVT

SEQ ID NO: 219303 - protein, 9 aa, Japanese encephalitis virus
VCGVRSVTR

SEQ ID NO: 219304 - protein, 9 aa, Japanese encephalitis virus
CGVRSVTRL

SEQ ID NO: 219305 - protein, 9 aa, Japanese encephalitis virus
GVRSVTRLE

SEQ ID NO: 219306 - protein, 9 aa, Japanese encephalitis virus
VRSVTRLEH

SEQ ID NO: 219307 - protein, 9 aa, Japanese encephalitis virus
RSVTRLEHQ

SEQ ID NO: 219308 - protein, 9 aa, Japanese encephalitis virus
SVTRLEHQM

SEQ ID NO: 219309 - protein, 9 aa, Japanese encephalitis virus
VTRLEHQMW

SEQ ID NO: 219310 - protein, 9 aa, Japanese encephalitis virus
TRLEHQMWE

SEQ ID NO: 219311 - protein, 9 aa, Japanese encephalitis virus
RLEHQMWEA

SEQ ID NO: 219312 - protein, 9 aa, Japanese encephalitis virus
LEHQMWEAV

SEQ ID NO: 219313 - protein, 9 aa, Japanese encephalitis virus
EHQMWEAVR

SEQ ID NO: 219314 - protein, 9 aa, Japanese encephalitis virus
HQMWEAVRD

SEQ ID NO: 219315 - protein, 9 aa, Japanese encephalitis virus
QMWEAVRDE

SEQ ID NO: 219316 - protein, 9 aa, Japanese encephalitis virus
MWEAVRDEL

SEQ ID NO: 219317 - protein, 9 aa, Japanese encephalitis virus
WEAVRDELN

SEQ ID NO: 219318 - protein, 9 aa, Japanese encephalitis virus
EAVRDELNV

SEQ ID NO: 219319 - protein, 9 aa, Japanese encephalitis virus
AVRDELNVL

SEQ ID NO: 219320 - protein, 9 aa, Japanese encephalitis virus
VRDELNVLL

SEQ ID NO: 219321 - protein, 9 aa, Japanese encephalitis virus
RDELNVLLK

SEQ ID NO: 219322 - protein, 9 aa, Japanese encephalitis virus
DELNVLLKE

SEQ ID NO: 219323 - protein, 9 aa, Japanese encephalitis virus
ELNVLLKEN

SEQ ID NO: 219324 - protein, 9 aa, Japanese encephalitis virus
LNVLLKENA

SEQ ID NO: 219325 - protein, 9 aa, Japanese encephalitis virus
NVLLKENAV

SEQ ID NO: 219326 - protein, 9 aa, Japanese encephalitis virus
VLLKENAVD

SEQ ID NO: 219327 - protein, 9 aa, Japanese encephalitis virus
LLKENAVDL

SEQ ID NO: 219328 - protein, 9 aa, Japanese encephalitis virus
LKENAVDLS

SEQ ID NO: 219329 - protein, 9 aa, Japanese encephalitis virus
KENAVDLSV

SEQ ID NO: 219330 - protein, 9 aa, Japanese encephalitis virus
ENAVDLSVV

SEQ ID NO: 219331 - protein, 9 aa, Japanese encephalitis virus
NAVDLSVVV

SEQ ID NO: 219332 - protein, 9 aa, Japanese encephalitis virus
AVDLSVVVN

SEQ ID NO: 219333 - protein, 9 aa, Japanese encephalitis virus
VDLSVVVNK

SEQ ID NO: 219334 - protein, 9 aa, Japanese encephalitis virus
DLSVVVNKP

SEQ ID NO: 219335 - protein, 9 aa, Japanese encephalitis virus
LSVVVNKPV

SEQ ID NO: 219336 - protein, 9 aa, Japanese encephalitis virus
SVVVNKPVG

SEQ ID NO: 219337 - protein, 9 aa, Japanese encephalitis virus
VVVNKPVGR

SEQ ID NO: 219338 - protein, 9 aa, Japanese encephalitis virus
VVNKPVGRY

SEQ ID NO: 219339 - protein, 9 aa, Japanese encephalitis virus
VNKPVGRYR

SEQ ID NO: 219340 - protein, 9 aa, Japanese encephalitis virus
NKPVGRYRS

SEQ ID NO: 219341 - protein, 9 aa, Japanese encephalitis virus
KPVGRYRSA

SEQ ID NO: 219342 - protein, 9 aa, Japanese encephalitis virus
PVGRYRSAP

SEQ ID NO: 219343 - protein, 9 aa, Japanese encephalitis virus
VGRYRSAPK

SEQ ID NO: 219344 - protein, 9 aa, Japanese encephalitis virus
GRYRSAPKR

SEQ ID NO: 219345 - protein, 9 aa, Japanese encephalitis virus
RYRSAPKRL

SEQ ID NO: 219346 - protein, 9 aa, Japanese encephalitis virus
YRSAPKRLS

SEQ ID NO: 219347 - protein, 9 aa, Japanese encephalitis virus
RSAPKRLSM

SEQ ID NO: 219348 - protein, 9 aa, Japanese encephalitis virus
SAPKRLSMT

SEQ ID NO: 219349 - protein, 9 aa, Japanese encephalitis virus
APKRLSMTQ

SEQ ID NO: 219350 - protein, 9 aa, Japanese encephalitis virus
PKRLSMTQE

SEQ ID NO: 219351 - protein, 9 aa, Japanese encephalitis virus
KRLSMTQEK

SEQ ID NO: 219352 - protein, 9 aa, Japanese encephalitis virus
RLSMTQEKF

SEQ ID NO: 219353 - protein, 9 aa, Japanese encephalitis virus
LSMTQEKFE

SEQ ID NO: 219354 - protein, 9 aa, Japanese encephalitis virus
SMTQEKFEM

SEQ ID NO: 219355 - protein, 9 aa, Japanese encephalitis virus
MTQEKFEMG

SEQ ID NO: 219356 - protein, 9 aa, Japanese encephalitis virus
TQEKFEMGW

SEQ ID NO: 219357 - protein, 9 aa, Japanese encephalitis virus
QEKFEMGWK

SEQ ID NO: 219358 - protein, 9 aa, Japanese encephalitis virus
EKFEMGWKA

SEQ ID NO: 219359 - protein, 9 aa, Japanese encephalitis virus
KFEMGWKAW

SEQ ID NO: 219360 - protein, 9 aa, Japanese encephalitis virus
FEMGWKAWG

SEQ ID NO: 219361 - protein, 9 aa, Japanese encephalitis virus
EMGWKAWGK

SEQ ID NO: 219362 - protein, 9 aa, Japanese encephalitis virus
MGWKAWGKS

SEQ ID NO: 219363 - protein, 9 aa, Japanese encephalitis virus
GWKAWGKSI

SEQ ID NO: 219364 - protein, 9 aa, Japanese encephalitis virus
WKAWGKSIL

SEQ ID NO: 219365 - protein, 9 aa, Japanese encephalitis virus
KAWGKSILF

SEQ ID NO: 219366 - protein, 9 aa, Japanese encephalitis virus
AWGKSILFA

SEQ ID NO: 219367 - protein, 9 aa, Japanese encephalitis virus
WGKSILFAP

SEQ ID NO: 219368 - protein, 9 aa, Japanese encephalitis virus
GKSILFAPE

SEQ ID NO: 219369 - protein, 9 aa, Japanese encephalitis virus
KSILFAPEL

SEQ ID NO: 219370 - protein, 9 aa, Japanese encephalitis virus
SILFAPELA

SEQ ID NO: 219371 - protein, 9 aa, Japanese encephalitis virus
ILFAPELAN

SEQ ID NO: 219372 - protein, 9 aa, Japanese encephalitis virus
LFAPELANS

SEQ ID NO: 219373 - protein, 9 aa, Japanese encephalitis virus
FAPELANST

SEQ ID NO: 219374 - protein, 9 aa, Japanese encephalitis virus
APELANSTF

SEQ ID NO: 219375 - protein, 9 aa, Japanese encephalitis virus
PELANSTFV

SEQ ID NO: 219376 - protein, 9 aa, Japanese encephalitis virus
ELANSTFVV

SEQ ID NO: 219377 - protein, 9 aa, Japanese encephalitis virus
LANSTFVVD

SEQ ID NO: 219378 - protein, 9 aa, Japanese encephalitis virus
ANSTFVVDG

SEQ ID NO: 219379 - protein, 9 aa, Japanese encephalitis virus
NSTFVVDGP

SEQ ID NO: 219380 - protein, 9 aa, Japanese encephalitis virus
STFVVDGPE

SEQ ID NO: 219381 - protein, 9 aa, Japanese encephalitis virus
TFVVDGPET

SEQ ID NO: 219382 - protein, 9 aa, Japanese encephalitis virus
FVVDGPETK

SEQ ID NO: 219383 - protein, 9 aa, Japanese encephalitis virus
VVDGPETKE

SEQ ID NO: 219384 - protein, 9 aa, Japanese encephalitis virus
VDGPETKEC

SEQ ID NO: 219385 - protein, 9 aa, Japanese encephalitis virus
DGPETKECP

SEQ ID NO: 219386 - protein, 9 aa, Japanese encephalitis virus
GPETKECPD

SEQ ID NO: 219387 - protein, 9 aa, Japanese encephalitis virus
PETKECPDE

SEQ ID NO: 219388 - protein, 9 aa, Japanese encephalitis virus
ETKECPDEH

SEQ ID NO: 219389 - protein, 9 aa, Japanese encephalitis virus
TKECPDEHR

SEQ ID NO: 219390 - protein, 9 aa, Japanese encephalitis virus
KECPDEHRA

SEQ ID NO: 219391 - protein, 9 aa, Japanese encephalitis virus
ECPDEHRAW

SEQ ID NO: 219392 - protein, 9 aa, Japanese encephalitis virus
CPDEHRAWN

SEQ ID NO: 219393 - protein, 9 aa, Japanese encephalitis virus
PDEHRAWNS

SEQ ID NO: 219394 - protein, 9 aa, Japanese encephalitis virus
DEHRAWNSM

SEQ ID NO: 219395 - protein, 9 aa, Japanese encephalitis virus
EHRAWNSMQ

SEQ ID NO: 219396 - protein, 9 aa, Japanese encephalitis virus
HRAWNSMQI

SEQ ID NO: 219397 - protein, 9 aa, Japanese encephalitis virus
RAWNSMQIE

SEQ ID NO: 219398 - protein, 9 aa, Japanese encephalitis virus
AWNSMQIED

SEQ ID NO: 219399 - protein, 9 aa, Japanese encephalitis virus
WNSMQIEDF

SEQ ID NO: 219400 - protein, 9 aa, Japanese encephalitis virus
NSMQIEDFG

SEQ ID NO: 219401 - protein, 9 aa, Japanese encephalitis virus
SMQIEDFGF

SEQ ID NO: 219402 - protein, 9 aa, Japanese encephalitis virus
MQIEDFGFG

SEQ ID NO: 219403 - protein, 9 aa, Japanese encephalitis virus
QIEDFGFGI

SEQ ID NO: 219404 - protein, 9 aa, Japanese encephalitis virus
IEDFGFGIT

SEQ ID NO: 219405 - protein, 9 aa, Japanese encephalitis virus
EDFGFGITS

SEQ ID NO: 219406 - protein, 9 aa, Japanese encephalitis virus
DFGFGITST

SEQ ID NO: 219407 - protein, 9 aa, Japanese encephalitis virus
FGFGITSTR

SEQ ID NO: 219408 - protein, 9 aa, Japanese encephalitis virus
GFGITSTRV

SEQ ID NO: 219409 - protein, 9 aa, Japanese encephalitis virus
FGITSTRVW

SEQ ID NO: 219410 - protein, 9 aa, Japanese encephalitis virus
GITSTRVWL

SEQ ID NO: 219411 - protein, 9 aa, Japanese encephalitis virus
ITSTRVWLK

SEQ ID NO: 219412 - protein, 9 aa, Japanese encephalitis virus
TSTRVWLKI

SEQ ID NO: 219413 - protein, 9 aa, Japanese encephalitis virus
STRVWLKIR

SEQ ID NO: 219414 - protein, 9 aa, Japanese encephalitis virus
TRVWLKIRE

SEQ ID NO: 219415 - protein, 9 aa, Japanese encephalitis virus
RVWLKIREE

SEQ ID NO: 219416 - protein, 9 aa, Japanese encephalitis virus
VWLKIREES

SEQ ID NO: 219417 - protein, 9 aa, Japanese encephalitis virus
WLKIREEST

SEQ ID NO: 219418 - protein, 9 aa, Japanese encephalitis virus
LKIREESTD

SEQ ID NO: 219419 - protein, 9 aa, Japanese encephalitis virus
KIREESTDE

SEQ ID NO: 219420 - protein, 9 aa, Japanese encephalitis virus
IREESTDEC

SEQ ID NO: 219421 - protein, 9 aa, Japanese encephalitis virus
REESTDECD

SEQ ID NO: 219422 - protein, 9 aa, Japanese encephalitis virus
EESTDECDG

SEQ ID NO: 219423 - protein, 9 aa, Japanese encephalitis virus
ESTDECDGA

SEQ ID NO: 219424 - protein, 9 aa, Japanese encephalitis virus
STDECDGAI

SEQ ID NO: 219425 - protein, 9 aa, Japanese encephalitis virus
TDECDGAII

SEQ ID NO: 219426 - protein, 9 aa, Japanese encephalitis virus
DECDGAIIG

SEQ ID NO: 219427 - protein, 9 aa, Japanese encephalitis virus
ECDGAIIGT

SEQ ID NO: 219428 - protein, 9 aa, Japanese encephalitis virus
CDGAIIGTA

SEQ ID NO: 219429 - protein, 9 aa, Japanese encephalitis virus
DGAIIGTAV

SEQ ID NO: 219430 - protein, 9 aa, Japanese encephalitis virus
GAIIGTAVK

SEQ ID NO: 219431 - protein, 9 aa, Japanese encephalitis virus
AIIGTAVKG

SEQ ID NO: 219432 - protein, 9 aa, Japanese encephalitis virus
IIGTAVKGH

SEQ ID NO: 219433 - protein, 9 aa, Japanese encephalitis virus
IGTAVKGHV

SEQ ID NO: 219434 - protein, 9 aa, Japanese encephalitis virus
GTAVKGHVA

SEQ ID NO: 219435 - protein, 9 aa, Japanese encephalitis virus
TAVKGHVAV

SEQ ID NO: 219436 - protein, 9 aa, Japanese encephalitis virus
AVKGHVAVH

SEQ ID NO: 219437 - protein, 9 aa, Japanese encephalitis virus
VKGHVAVHS

SEQ ID NO: 219438 - protein, 9 aa, Japanese encephalitis virus
KGHVAVHSD

SEQ ID NO: 219439 - protein, 9 aa, Japanese encephalitis virus
GHVAVHSDL

SEQ ID NO: 219440 - protein, 9 aa, Japanese encephalitis virus
HVAVHSDLS

SEQ ID NO: 219441 - protein, 9 aa, Japanese encephalitis virus
VAVHSDLSY

SEQ ID NO: 219442 - protein, 9 aa, Japanese encephalitis virus
AVHSDLSYW

SEQ ID NO: 219443 - protein, 9 aa, Japanese encephalitis virus
VHSDLSYWI

SEQ ID NO: 219444 - protein, 9 aa, Japanese encephalitis virus
HSDLSYWIE

SEQ ID NO: 219445 - protein, 9 aa, Japanese encephalitis virus
SDLSYWIES

SEQ ID NO: 219446 - protein, 9 aa, Japanese encephalitis virus
DLSYWIESR

SEQ ID NO: 219447 - protein, 9 aa, Japanese encephalitis virus
SYWIESRYN

SEQ ID NO: 219448 - protein, 9 aa, Japanese encephalitis virus
YWIESRYND

SEQ ID NO: 219449 - protein, 9 aa, Japanese encephalitis virus
NDTWKLERA

SEQ ID NO: 219450 - protein, 9 aa, Japanese encephalitis virus
DTWKLERAV

SEQ ID NO: 219451 - protein, 9 aa, Japanese encephalitis virus
TWKLERAVF

SEQ ID NO: 219452 - protein, 9 aa, Japanese encephalitis virus
WKLERAVFG

SEQ ID NO: 219453 - protein, 9 aa, Japanese encephalitis virus
KLERAVFGE

SEQ ID NO: 219454 - protein, 9 aa, Japanese encephalitis virus
LERAVFGEV

SEQ ID NO: 219455 - protein, 9 aa, Japanese encephalitis virus
ERAVFGEVK

SEQ ID NO: 219456 - protein, 9 aa, Japanese encephalitis virus
RAVFGEVKS

SEQ ID NO: 219457 - protein, 9 aa, Japanese encephalitis virus
AVFGEVKSC

SEQ ID NO: 219458 - protein, 9 aa, Japanese encephalitis virus
VFGEVKSCT

SEQ ID NO: 219459 - protein, 9 aa, Japanese encephalitis virus
FGEVKSCTW

SEQ ID NO: 219460 - protein, 9 aa, Japanese encephalitis virus
GEVKSCTWP

SEQ ID NO: 219461 - protein, 9 aa, Japanese encephalitis virus
EVKSCTWPE

SEQ ID NO: 219462 - protein, 9 aa, Japanese encephalitis virus
VKSCTWPET

SEQ ID NO: 219463 - protein, 9 aa, Japanese encephalitis virus
KSCTWPETH

SEQ ID NO: 219464 - protein, 9 aa, Japanese encephalitis virus
SCTWPETHT

SEQ ID NO: 219465 - protein, 9 aa, Japanese encephalitis virus
CTWPETHTL

SEQ ID NO: 219466 - protein, 9 aa, Japanese encephalitis virus
TWPETHTLW

SEQ ID NO: 219467 - protein, 9 aa, Japanese encephalitis virus
WPETHTLWG

SEQ ID NO: 219468 - protein, 9 aa, Japanese encephalitis virus
PETHTLWGD

SEQ ID NO: 219469 - protein, 9 aa, Japanese encephalitis virus
ETHTLWGDG

SEQ ID NO: 219470 - protein, 9 aa, Japanese encephalitis virus
THTLWGDGV

SEQ ID NO: 219471 - protein, 9 aa, Japanese encephalitis virus
HTLWGDGVE

SEQ ID NO: 219472 - protein, 9 aa, Japanese encephalitis virus
TLWGDGVEE

SEQ ID NO: 219473 - protein, 9 aa, Japanese encephalitis virus
LWGDGVEES

SEQ ID NO: 219474 - protein, 9 aa, Japanese encephalitis virus
WGDGVEESE

SEQ ID NO: 219475 - protein, 9 aa, Japanese encephalitis virus
GDGVEESEL

SEQ ID NO: 219476 - protein, 9 aa, Japanese encephalitis virus
DGVEESELI

SEQ ID NO: 219477 - protein, 9 aa, Japanese encephalitis virus
GVEESELII

SEQ ID NO: 219478 - protein, 9 aa, Japanese encephalitis virus
VEESELIIP

SEQ ID NO: 219479 - protein, 9 aa, Japanese encephalitis virus
EESELIIPH

SEQ ID NO: 219480 - protein, 9 aa, Japanese encephalitis virus
ESELIIPHT

SEQ ID NO: 219481 - protein, 9 aa, Japanese encephalitis virus
SELIIPHTI

SEQ ID NO: 219482 - protein, 9 aa, Japanese encephalitis virus
ELIIPHTIA

SEQ ID NO: 219483 - protein, 9 aa, Japanese encephalitis virus
LIIPHTIAG

SEQ ID NO: 219484 - protein, 9 aa, Japanese encephalitis virus
IIPHTIAGP

SEQ ID NO: 219485 - protein, 9 aa, Japanese encephalitis virus
IPHTIAGPK

SEQ ID NO: 219486 - protein, 9 aa, Japanese encephalitis virus
PHTIAGPKS

SEQ ID NO: 219487 - protein, 9 aa, Japanese encephalitis virus
HTIAGPKSK

SEQ ID NO: 219488 - protein, 9 aa, Japanese encephalitis virus
TIAGPKSKH

SEQ ID NO: 219489 - protein, 9 aa, Japanese encephalitis virus
IAGPKSKHN

SEQ ID NO: 219490 - protein, 9 aa, Japanese encephalitis virus
AGPKSKHNR

SEQ ID NO: 219491 - protein, 9 aa, Japanese encephalitis virus
GPKSKHNRR

SEQ ID NO: 219492 - protein, 9 aa, Japanese encephalitis virus
PKSKHNRRE

SEQ ID NO: 219493 - protein, 9 aa, Japanese encephalitis virus
KSKHNRREG

SEQ ID NO: 219494 - protein, 9 aa, Japanese encephalitis virus
SKHNRREGY

SEQ ID NO: 219495 - protein, 9 aa, Japanese encephalitis virus
KHNRREGYK

SEQ ID NO: 219496 - protein, 9 aa, Japanese encephalitis virus
HNRREGYKT

SEQ ID NO: 219497 - protein, 9 aa, Japanese encephalitis virus
NRREGYKTQ

SEQ ID NO: 219498 - protein, 9 aa, Japanese encephalitis virus
RREGYKTQN

SEQ ID NO: 219499 - protein, 9 aa, Japanese encephalitis virus
REGYKTQNQ

SEQ ID NO: 219500 - protein, 9 aa, Japanese encephalitis virus
EGYKTQNQG

SEQ ID NO: 219501 - protein, 9 aa, Japanese encephalitis virus
GYKTQNQGP

SEQ ID NO: 219502 - protein, 9 aa, Japanese encephalitis virus
YKTQNQGPW

SEQ ID NO: 219503 - protein, 9 aa, Japanese encephalitis virus
KTQNQGPWD

SEQ ID NO: 219504 - protein, 9 aa, Japanese encephalitis virus
TQNQGPWDE

SEQ ID NO: 219505 - protein, 9 aa, Japanese encephalitis virus
QNQGPWDEN

SEQ ID NO: 219506 - protein, 9 aa, Japanese encephalitis virus
NQGPWDENG

SEQ ID NO: 219507 - protein, 9 aa, Japanese encephalitis virus
QGPWDENGI

SEQ ID NO: 219508 - protein, 9 aa, Japanese encephalitis virus
GPWDENGIV

SEQ ID NO: 219509 - protein, 9 aa, Japanese encephalitis virus
PWDENGIVL

SEQ ID NO: 219510 - protein, 9 aa, Japanese encephalitis virus
WDENGIVLD

SEQ ID NO: 219511 - protein, 9 aa, Japanese encephalitis virus
DENGIVLDF

SEQ ID NO: 219512 - protein, 9 aa, Japanese encephalitis virus
ENGIVLDFD

SEQ ID NO: 219513 - protein, 9 aa, Japanese encephalitis virus
NGIVLDFDY

SEQ ID NO: 219514 - protein, 9 aa, Japanese encephalitis virus
GIVLDFDYC

SEQ ID NO: 219515 - protein, 9 aa, Japanese encephalitis virus
IVLDFDYCP

SEQ ID NO: 219516 - protein, 9 aa, Japanese encephalitis virus
VLDFDYCPG

SEQ ID NO: 219517 - protein, 9 aa, Japanese encephalitis virus
LDFDYCPGT

SEQ ID NO: 219518 - protein, 9 aa, Japanese encephalitis virus
DFDYCPGTK

SEQ ID NO: 219519 - protein, 9 aa, Japanese encephalitis virus
FDYCPGTKV

SEQ ID NO: 219520 - protein, 9 aa, Japanese encephalitis virus
DYCPGTKVT

SEQ ID NO: 219521 - protein, 9 aa, Japanese encephalitis virus
YCPGTKVTI

SEQ ID NO: 219522 - protein, 9 aa, Japanese encephalitis virus
CPGTKVTIT

SEQ ID NO: 219523 - protein, 9 aa, Japanese encephalitis virus
PGTKVTITE

SEQ ID NO: 219524 - protein, 9 aa, Japanese encephalitis virus
GTKVTITED

SEQ ID NO: 219525 - protein, 9 aa, Japanese encephalitis virus
TKVTITEDC

SEQ ID NO: 219526 - protein, 9 aa, Japanese encephalitis virus
KVTITEDCG

SEQ ID NO: 219527 - protein, 9 aa, Japanese encephalitis virus
VTITEDCGK

SEQ ID NO: 219528 - protein, 9 aa, Japanese encephalitis virus
TITEDCGKR

SEQ ID NO: 219529 - protein, 9 aa, Japanese encephalitis virus
ITEDCGKRG

SEQ ID NO: 219530 - protein, 9 aa, Japanese encephalitis virus
TEDCGKRGP

SEQ ID NO: 219531 - protein, 9 aa, Japanese encephalitis virus
EDCGKRGPS

SEQ ID NO: 219532 - protein, 9 aa, Japanese encephalitis virus
DCGKRGPSV

SEQ ID NO: 219533 - protein, 9 aa, Japanese encephalitis virus
CGKRGPSVR

SEQ ID NO: 219534 - protein, 9 aa, Japanese encephalitis virus
GKRGPSVRT

SEQ ID NO: 219535 - protein, 9 aa, Japanese encephalitis virus
KRGPSVRTT

SEQ ID NO: 219536 - protein, 9 aa, Japanese encephalitis virus
RGPSVRTTT

SEQ ID NO: 219537 - protein, 9 aa, Japanese encephalitis virus
GPSVRTTTD

SEQ ID NO: 219538 - protein, 9 aa, Japanese encephalitis virus
PSVRTTTDS

SEQ ID NO: 219539 - protein, 9 aa, Japanese encephalitis virus
SVRTTTDSG

SEQ ID NO: 219540 - protein, 9 aa, Japanese encephalitis virus
VRTTTDSGK

SEQ ID NO: 219541 - protein, 9 aa, Japanese encephalitis virus
RTTTDSGKL

SEQ ID NO: 219542 - protein, 9 aa, Japanese encephalitis virus
TTTDSGKLI

SEQ ID NO: 219543 - protein, 9 aa, Japanese encephalitis virus
TTDSGKLIT

SEQ ID NO: 219544 - protein, 9 aa, Japanese encephalitis virus
TDSGKLITD

SEQ ID NO: 219545 - protein, 9 aa, Japanese encephalitis virus
DSGKLITDW

SEQ ID NO: 219546 - protein, 9 aa, Japanese encephalitis virus
SGKLITDWC

SEQ ID NO: 219547 - protein, 9 aa, Japanese encephalitis virus
GKLITDWCC

SEQ ID NO: 219548 - protein, 9 aa, Japanese encephalitis virus
KLITDWCCR

SEQ ID NO: 219549 - protein, 9 aa, Japanese encephalitis virus
LITDWCCRS

SEQ ID NO: 219550 - protein, 9 aa, Japanese encephalitis virus
ITDWCCRSC

SEQ ID NO: 219551 - protein, 9 aa, Japanese encephalitis virus
TDWCCRSCS

SEQ ID NO: 219552 - protein, 9 aa, Japanese encephalitis virus
DWCCRSCSL

SEQ ID NO: 219553 - protein, 9 aa, Japanese encephalitis virus
WCCRSCSLP

SEQ ID NO: 219554 - protein, 9 aa, Japanese encephalitis virus
CCRSCSLPP

SEQ ID NO: 219555 - protein, 9 aa, Japanese encephalitis virus
CRSCSLPPL

SEQ ID NO: 219556 - protein, 9 aa, Japanese encephalitis virus
RSCSLPPLR

SEQ ID NO: 219557 - protein, 9 aa, Japanese encephalitis virus
SCSLPPLRF

SEQ ID NO: 219558 - protein, 9 aa, Japanese encephalitis virus
CSLPPLRFR

SEQ ID NO: 219559 - protein, 9 aa, Japanese encephalitis virus
SLPPLRFRT

SEQ ID NO: 219560 - protein, 9 aa, Japanese encephalitis virus
LPPLRFRTE

SEQ ID NO: 219561 - protein, 9 aa, Japanese encephalitis virus
PPLRFRTEN

SEQ ID NO: 219562 - protein, 9 aa, Japanese encephalitis virus
PLRFRTENG

SEQ ID NO: 219563 - protein, 9 aa, Japanese encephalitis virus
LRFRTENGC

SEQ ID NO: 219564 - protein, 9 aa, Japanese encephalitis virus
RFRTENGCW

SEQ ID NO: 219565 - protein, 9 aa, Japanese encephalitis virus
FRTENGCWY

SEQ ID NO: 219566 - protein, 9 aa, Japanese encephalitis virus
RTENGCWYG

SEQ ID NO: 219567 - protein, 9 aa, Japanese encephalitis virus
TENGCWYGM

SEQ ID NO: 219568 - protein, 9 aa, Japanese encephalitis virus
ENGCWYGME

SEQ ID NO: 219569 - protein, 9 aa, Japanese encephalitis virus
NGCWYGMEI

SEQ ID NO: 219570 - protein, 9 aa, Japanese encephalitis virus
GCWYGMEIR

SEQ ID NO: 219571 - protein, 9 aa, Japanese encephalitis virus
CWYGMEIRP

SEQ ID NO: 219572 - protein, 9 aa, Japanese encephalitis virus
WYGMEIRPV

SEQ ID NO: 219573 - protein, 9 aa, Japanese encephalitis virus
RHDETTLVR

SEQ ID NO: 219574 - protein, 9 aa, Japanese encephalitis virus
HDETTLVRS

SEQ ID NO: 219575 - protein, 9 aa, Japanese encephalitis virus
DETTLVRSQ

SEQ ID NO: 219576 - protein, 9 aa, Japanese encephalitis virus
ETTLVRSQV

SEQ ID NO: 219577 - protein, 9 aa, Japanese encephalitis virus
TLVRSQVDA

SEQ ID NO: 219578 - protein, 9 aa, Japanese encephalitis virus
NGEMVDPFQ

SEQ ID NO: 219579 - protein, 9 aa, Japanese encephalitis virus
GEMVDPFQL

SEQ ID NO: 219580 - protein, 9 aa, Japanese encephalitis virus
EMVDPFQLG

SEQ ID NO: 219581 - protein, 9 aa, Japanese encephalitis virus
MVDPFQLGL

SEQ ID NO: 219582 - protein, 9 aa, Japanese encephalitis virus
VDPFQLGLL

SEQ ID NO: 219583 - protein, 9 aa, Japanese encephalitis virus
DPFQLGLLV

SEQ ID NO: 219584 - protein, 9 aa, Japanese encephalitis virus
PFQLGLLVM

SEQ ID NO: 219585 - protein, 9 aa, Japanese encephalitis virus
FQLGLLVMF

SEQ ID NO: 219586 - protein, 9 aa, Japanese encephalitis virus
QLGLLVMFL

SEQ ID NO: 219587 - protein, 9 aa, Japanese encephalitis virus
LGLLVMFLA

SEQ ID NO: 219588 - protein, 9 aa, Japanese encephalitis virus
GLLVMFLAT

SEQ ID NO: 219589 - protein, 9 aa, Japanese encephalitis virus
LLVMFLATQ

SEQ ID NO: 219590 - protein, 9 aa, Japanese encephalitis virus
LVMFLATQE

SEQ ID NO: 219591 - protein, 9 aa, Japanese encephalitis virus
VMFLATQEV

SEQ ID NO: 219592 - protein, 9 aa, Japanese encephalitis virus
MFLATQEVL

SEQ ID NO: 219593 - protein, 9 aa, Japanese encephalitis virus
FLATQEVLR

SEQ ID NO: 219594 - protein, 9 aa, Japanese encephalitis virus
LATQEVLRK

SEQ ID NO: 219595 - protein, 9 aa, Japanese encephalitis virus
ATQEVLRKR

SEQ ID NO: 219596 - protein, 9 aa, Japanese encephalitis virus
TQEVLRKRW

SEQ ID NO: 219597 - protein, 9 aa, Japanese encephalitis virus
QEVLRKRWT

SEQ ID NO: 219598 - protein, 9 aa, Japanese encephalitis virus
EVLRKRWTA

SEQ ID NO: 219599 - protein, 9 aa, Japanese encephalitis virus
VLRKRWTAR

SEQ ID NO: 219600 - protein, 9 aa, Japanese encephalitis virus
LRKRWTARL

SEQ ID NO: 219601 - protein, 9 aa, Japanese encephalitis virus
RKRWTARLT

SEQ ID NO: 219602 - protein, 9 aa, Japanese encephalitis virus
KRWTARLTI

SEQ ID NO: 219603 - protein, 9 aa, Japanese encephalitis virus
RWTARLTIP

SEQ ID NO: 219604 - protein, 9 aa, Japanese encephalitis virus
WTARLTIPA

SEQ ID NO: 219605 - protein, 9 aa, Japanese encephalitis virus
TARLTIPAV

SEQ ID NO: 219606 - protein, 9 aa, Japanese encephalitis virus
ARLTIPAVL

SEQ ID NO: 219607 - protein, 9 aa, Japanese encephalitis virus
RLTIPAVLG

SEQ ID NO: 219608 - protein, 9 aa, Japanese encephalitis virus
LTIPAVLGA

SEQ ID NO: 219609 - protein, 9 aa, Japanese encephalitis virus
TIPAVLGAL

SEQ ID NO: 219610 - protein, 9 aa, Japanese encephalitis virus
IPAVLGALL

SEQ ID NO: 219611 - protein, 9 aa, Japanese encephalitis virus
PAVLGALLV

SEQ ID NO: 219612 - protein, 9 aa, Japanese encephalitis virus
AVLGALLVL

SEQ ID NO: 219613 - protein, 9 aa, Japanese encephalitis virus
VLGALLVLM

SEQ ID NO: 219614 - protein, 9 aa, Japanese encephalitis virus
LGALLVLML

SEQ ID NO: 219615 - protein, 9 aa, Japanese encephalitis virus
GALLVLMLG

SEQ ID NO: 219616 - protein, 9 aa, Japanese encephalitis virus
ALLVLMLGG

SEQ ID NO: 219617 - protein, 9 aa, Japanese encephalitis virus
LLVLMLGGI

SEQ ID NO: 219618 - protein, 9 aa, Japanese encephalitis virus
LVLMLGGIT

SEQ ID NO: 219619 - protein, 9 aa, Japanese encephalitis virus
VLMLGGITY

SEQ ID NO: 219620 - protein, 9 aa, Japanese encephalitis virus
LMLGGITYT

SEQ ID NO: 219621 - protein, 9 aa, Japanese encephalitis virus
MLGGITYTD

SEQ ID NO: 219622 - protein, 9 aa, Japanese encephalitis virus
LGGITYTDL

SEQ ID NO: 219623 - protein, 9 aa, Japanese encephalitis virus
GGITYTDLA

SEQ ID NO: 219624 - protein, 9 aa, Japanese encephalitis virus
GITYTDLAR

SEQ ID NO: 219625 - protein, 9 aa, Japanese encephalitis virus
ITYTDLARY

SEQ ID NO: 219626 - protein, 9 aa, Japanese encephalitis virus
TYTDLARYV

SEQ ID NO: 219627 - protein, 9 aa, Japanese encephalitis virus
YTDLARYVV

SEQ ID NO: 219628 - protein, 9 aa, Japanese encephalitis virus
TDLARYVVL

SEQ ID NO: 219629 - protein, 9 aa, Japanese encephalitis virus
DLARYVVLV

SEQ ID NO: 219630 - protein, 9 aa, Japanese encephalitis virus
LARYVVLVA

SEQ ID NO: 219631 - protein, 9 aa, Japanese encephalitis virus
ARYVVLVAA

SEQ ID NO: 219632 - protein, 9 aa, Japanese encephalitis virus
RYVVLVAAA

SEQ ID NO: 219633 - protein, 9 aa, Japanese encephalitis virus
YVVLVAAAF

SEQ ID NO: 219634 - protein, 9 aa, Japanese encephalitis virus
VVLVAAAFA

SEQ ID NO: 219635 - protein, 9 aa, Japanese encephalitis virus
VLVAAAFAE

SEQ ID NO: 219636 - protein, 9 aa, Japanese encephalitis virus
LVAAAFAEA

SEQ ID NO: 219637 - protein, 9 aa, Japanese encephalitis virus
VAAAFAEAN

SEQ ID NO: 219638 - protein, 9 aa, Japanese encephalitis virus
AAAFAEANS

SEQ ID NO: 219639 - protein, 9 aa, Japanese encephalitis virus
AAFAEANSG

SEQ ID NO: 219640 - protein, 9 aa, Japanese encephalitis virus
AFAEANSGG

SEQ ID NO: 219641 - protein, 9 aa, Japanese encephalitis virus
FAEANSGGD

SEQ ID NO: 219642 - protein, 9 aa, Japanese encephalitis virus
AEANSGGDV

SEQ ID NO: 219643 - protein, 9 aa, Japanese encephalitis virus
EANSGGDVL

SEQ ID NO: 219644 - protein, 9 aa, Japanese encephalitis virus
ANSGGDVLH

SEQ ID NO: 219645 - protein, 9 aa, Japanese encephalitis virus
NSGGDVLHL

SEQ ID NO: 219646 - protein, 9 aa, Japanese encephalitis virus
SGGDVLHLA

SEQ ID NO: 219647 - protein, 9 aa, Japanese encephalitis virus
GGDVLHLAL

SEQ ID NO: 219648 - protein, 9 aa, Japanese encephalitis virus
GDVLHLALI

SEQ ID NO: 219649 - protein, 9 aa, Japanese encephalitis virus
DVLHLALIA

SEQ ID NO: 219650 - protein, 9 aa, Japanese encephalitis virus
VLHLALIAV

SEQ ID NO: 219651 - protein, 9 aa, Japanese encephalitis virus
LHLALIAVF

SEQ ID NO: 219652 - protein, 9 aa, Japanese encephalitis virus
HLALIAVFK

SEQ ID NO: 219653 - protein, 9 aa, Japanese encephalitis virus
LALIAVFKI

SEQ ID NO: 219654 - protein, 9 aa, Japanese encephalitis virus
ALIAVFKIQ

SEQ ID NO: 219655 - protein, 9 aa, Japanese encephalitis virus
LIAVFKIQP

SEQ ID NO: 219656 - protein, 9 aa, Japanese encephalitis virus
IAVFKIQPA

SEQ ID NO: 219657 - protein, 9 aa, Japanese encephalitis virus
AVFKIQPAF

SEQ ID NO: 219658 - protein, 9 aa, Japanese encephalitis virus
VFKIQPAFL

SEQ ID NO: 219659 - protein, 9 aa, Japanese encephalitis virus
FKIQPAFLV

SEQ ID NO: 219660 - protein, 9 aa, Japanese encephalitis virus
KIQPAFLVM

SEQ ID NO: 219661 - protein, 9 aa, Japanese encephalitis virus
IQPAFLVMN

SEQ ID NO: 219662 - protein, 9 aa, Japanese encephalitis virus
QPAFLVMNM

SEQ ID NO: 219663 - protein, 9 aa, Japanese encephalitis virus
PAFLVMNML

SEQ ID NO: 219664 - protein, 9 aa, Japanese encephalitis virus
AFLVMNMLS

SEQ ID NO: 219665 - protein, 9 aa, Japanese encephalitis virus
FLVMNMLST

SEQ ID NO: 219666 - protein, 9 aa, Japanese encephalitis virus
NMLSTRWTN

SEQ ID NO: 219667 - protein, 9 aa, Japanese encephalitis virus
MLSTRWTNQ

SEQ ID NO: 219668 - protein, 9 aa, Japanese encephalitis virus
LSTRWTNQE

SEQ ID NO: 219669 - protein, 9 aa, Japanese encephalitis virus
STRWTNQEN

SEQ ID NO: 219670 - protein, 9 aa, Japanese encephalitis virus
TRWTNQENV

SEQ ID NO: 219671 - protein, 9 aa, Japanese encephalitis virus
RWTNQENVV

SEQ ID NO: 219672 - protein, 9 aa, Japanese encephalitis virus
WTNQENVVL

SEQ ID NO: 219673 - protein, 9 aa, Japanese encephalitis virus
TNQENVVLV

SEQ ID NO: 219674 - protein, 9 aa, Japanese encephalitis virus
NQENVVLVL

SEQ ID NO: 219675 - protein, 9 aa, Japanese encephalitis virus
QENVVLVLG

SEQ ID NO: 219676 - protein, 9 aa, Japanese encephalitis virus
ENVVLVLGA

SEQ ID NO: 219677 - protein, 9 aa, Japanese encephalitis virus
NVVLVLGAA

SEQ ID NO: 219678 - protein, 9 aa, Japanese encephalitis virus
VVLVLGAAF

SEQ ID NO: 219679 - protein, 9 aa, Japanese encephalitis virus
VLVLGAAFF

SEQ ID NO: 219680 - protein, 9 aa, Japanese encephalitis virus
LVLGAAFFQ

SEQ ID NO: 219681 - protein, 9 aa, Japanese encephalitis virus
VLGAAFFQL

SEQ ID NO: 219682 - protein, 9 aa, Japanese encephalitis virus
LGAAFFQLA

SEQ ID NO: 219683 - protein, 9 aa, Japanese encephalitis virus
GAAFFQLAS

SEQ ID NO: 219684 - protein, 9 aa, Japanese encephalitis virus
AAFFQLASV

SEQ ID NO: 219685 - protein, 9 aa, Japanese encephalitis virus
AFFQLASVD

SEQ ID NO: 219686 - protein, 9 aa, Japanese encephalitis virus
FFQLASVDL

SEQ ID NO: 219687 - protein, 9 aa, Japanese encephalitis virus
FQLASVDLQ

SEQ ID NO: 219688 - protein, 9 aa, Japanese encephalitis virus
QLASVDLQI

SEQ ID NO: 219689 - protein, 9 aa, Japanese encephalitis virus
LASVDLQIG

SEQ ID NO: 219690 - protein, 9 aa, Japanese encephalitis virus
ASVDLQIGV

SEQ ID NO: 219691 - protein, 9 aa, Japanese encephalitis virus
SVDLQIGVH

SEQ ID NO: 219692 - protein, 9 aa, Japanese encephalitis virus
VDLQIGVHG

SEQ ID NO: 219693 - protein, 9 aa, Japanese encephalitis virus
DLQIGVHGI

SEQ ID NO: 219694 - protein, 9 aa, Japanese encephalitis virus
LQIGVHGIL

SEQ ID NO: 219695 - protein, 9 aa, Japanese encephalitis virus
QIGVHGILN

SEQ ID NO: 219696 - protein, 9 aa, Japanese encephalitis virus
IGVHGILNA

SEQ ID NO: 219697 - protein, 9 aa, Japanese encephalitis virus
GVHGILNAA

SEQ ID NO: 219698 - protein, 9 aa, Japanese encephalitis virus
VHGILNAAA

SEQ ID NO: 219699 - protein, 9 aa, Japanese encephalitis virus
HGILNAAAI

SEQ ID NO: 219700 - protein, 9 aa, Japanese encephalitis virus
GILNAAAIA

SEQ ID NO: 219701 - protein, 9 aa, Japanese encephalitis virus
ILNAAAIAW

SEQ ID NO: 219702 - protein, 9 aa, Japanese encephalitis virus
LNAAAIAWM

SEQ ID NO: 219703 - protein, 9 aa, Japanese encephalitis virus
NAAAIAWMI

SEQ ID NO: 219704 - protein, 9 aa, Japanese encephalitis virus
AAAIAWMIV

SEQ ID NO: 219705 - protein, 9 aa, Japanese encephalitis virus
AAIAWMIVR

SEQ ID NO: 219706 - protein, 9 aa, Japanese encephalitis virus
AIAWMIVRA

SEQ ID NO: 219707 - protein, 9 aa, Japanese encephalitis virus
IAWMIVRAI

SEQ ID NO: 219708 - protein, 9 aa, Japanese encephalitis virus
AWMIVRAIT

SEQ ID NO: 219709 - protein, 9 aa, Japanese encephalitis virus
WMIVRAITF

SEQ ID NO: 219710 - protein, 9 aa, Japanese encephalitis virus
MIVRAITFP

SEQ ID NO: 219711 - protein, 9 aa, Japanese encephalitis virus
IVRAITFPT

SEQ ID NO: 219712 - protein, 9 aa, Japanese encephalitis virus
VRAITFPTT

SEQ ID NO: 219713 - protein, 9 aa, Japanese encephalitis virus
RAITFPTTS

SEQ ID NO: 219714 - protein, 9 aa, Japanese encephalitis virus
AITFPTTSS

SEQ ID NO: 219715 - protein, 9 aa, Japanese encephalitis virus
ITFPTTSSV

SEQ ID NO: 219716 - protein, 9 aa, Japanese encephalitis virus
TFPTTSSVT

SEQ ID NO: 219717 - protein, 9 aa, Japanese encephalitis virus
FPTTSSVTM

SEQ ID NO: 219718 - protein, 9 aa, Japanese encephalitis virus
PTTSSVTMP

SEQ ID NO: 219719 - protein, 9 aa, Japanese encephalitis virus
MPVLALLTP

SEQ ID NO: 219720 - protein, 9 aa, Japanese encephalitis virus
PVLALLTPG

SEQ ID NO: 219721 - protein, 9 aa, Japanese encephalitis virus
VLALLTPGM

SEQ ID NO: 219722 - protein, 9 aa, Japanese encephalitis virus
LALLTPGMR

SEQ ID NO: 219723 - protein, 9 aa, Japanese encephalitis virus
ALLTPGMRA

SEQ ID NO: 219724 - protein, 9 aa, Japanese encephalitis virus
LLTPGMRAL

SEQ ID NO: 219725 - protein, 9 aa, Japanese encephalitis virus
LTPGMRALY

SEQ ID NO: 219726 - protein, 9 aa, Japanese encephalitis virus
TPGMRALYL

SEQ ID NO: 219727 - protein, 9 aa, Japanese encephalitis virus
PGMRALYLD

SEQ ID NO: 219728 - protein, 9 aa, Japanese encephalitis virus
GMRALYLDT

SEQ ID NO: 219729 - protein, 9 aa, Japanese encephalitis virus
MRALYLDTY

SEQ ID NO: 219730 - protein, 9 aa, Japanese encephalitis virus
RALYLDTYR

SEQ ID NO: 219731 - protein, 9 aa, Japanese encephalitis virus
ALYLDTYRI

SEQ ID NO: 219732 - protein, 9 aa, Japanese encephalitis virus
LYLDTYRII

SEQ ID NO: 219733 - protein, 9 aa, Japanese encephalitis virus
YLDTYRIIL

SEQ ID NO: 219734 - protein, 9 aa, Japanese encephalitis virus
LDTYRIILL

SEQ ID NO: 219735 - protein, 9 aa, Japanese encephalitis virus
DTYRIILLV

SEQ ID NO: 219736 - protein, 9 aa, Japanese encephalitis virus
TYRIILLVI

SEQ ID NO: 219737 - protein, 9 aa, Japanese encephalitis virus
YRIILLVIG

SEQ ID NO: 219738 - protein, 9 aa, Japanese encephalitis virus
RIILLVIGI

SEQ ID NO: 219739 - protein, 9 aa, Japanese encephalitis virus
IILLVIGIC

SEQ ID NO: 219740 - protein, 9 aa, Japanese encephalitis virus
ILLVIGICS

SEQ ID NO: 219741 - protein, 9 aa, Japanese encephalitis virus
LLVIGICSL

SEQ ID NO: 219742 - protein, 9 aa, Japanese encephalitis virus
LVIGICSLL

SEQ ID NO: 219743 - protein, 9 aa, Japanese encephalitis virus
VIGICSLLQ

SEQ ID NO: 219744 - protein, 9 aa, Japanese encephalitis virus
IGICSLLQE

SEQ ID NO: 219745 - protein, 9 aa, Japanese encephalitis virus
GICSLLQER

SEQ ID NO: 219746 - protein, 9 aa, Japanese encephalitis virus
ERKKTMAKK

SEQ ID NO: 219747 - protein, 9 aa, Japanese encephalitis virus
RKKTMAKKK

SEQ ID NO: 219748 - protein, 9 aa, Japanese encephalitis virus
KKTMAKKKG

SEQ ID NO: 219749 - protein, 9 aa, Japanese encephalitis virus
KTMAKKKGA

SEQ ID NO: 219750 - protein, 9 aa, Japanese encephalitis virus
TMAKKKGAV

SEQ ID NO: 219751 - protein, 9 aa, Japanese encephalitis virus
MAKKKGAVL

SEQ ID NO: 219752 - protein, 9 aa, Japanese encephalitis virus
AKKKGAVLL

SEQ ID NO: 219753 - protein, 9 aa, Japanese encephalitis virus
KKKGAVLLG

SEQ ID NO: 219754 - protein, 9 aa, Japanese encephalitis virus
KKGAVLLGL

SEQ ID NO: 219755 - protein, 9 aa, Japanese encephalitis virus
KGAVLLGLA

SEQ ID NO: 219756 - protein, 9 aa, Japanese encephalitis virus
GAVLLGLAL

SEQ ID NO: 219757 - protein, 9 aa, Japanese encephalitis virus
AVLLGLALT

SEQ ID NO: 219758 - protein, 9 aa, Japanese encephalitis virus
VLLGLALTS

SEQ ID NO: 219759 - protein, 9 aa, Japanese encephalitis virus
LLGLALTST

SEQ ID NO: 219760 - protein, 9 aa, Japanese encephalitis virus
LGLALTSTG

SEQ ID NO: 219761 - protein, 9 aa, Japanese encephalitis virus
GLALTSTGW

SEQ ID NO: 219762 - protein, 9 aa, Japanese encephalitis virus
LALTSTGWF

SEQ ID NO: 219763 - protein, 9 aa, Japanese encephalitis virus
ALTSTGWFS

SEQ ID NO: 219764 - protein, 9 aa, Japanese encephalitis virus
LTSTGWFSP

SEQ ID NO: 219765 - protein, 9 aa, Japanese encephalitis virus
TSTGWFSPT

SEQ ID NO: 219766 - protein, 9 aa, Japanese encephalitis virus
STGWFSPTT

SEQ ID NO: 219767 - protein, 9 aa, Japanese encephalitis virus
TGWFSPTTI

SEQ ID NO: 219768 - protein, 9 aa, Japanese encephalitis virus
GWFSPTTIA

SEQ ID NO: 219769 - protein, 9 aa, Japanese encephalitis virus
WFSPTTIAA

SEQ ID NO: 219770 - protein, 9 aa, Japanese encephalitis virus
FSPTTIAAG

SEQ ID NO: 219771 - protein, 9 aa, Japanese encephalitis virus
SPTTIAAGL

SEQ ID NO: 219772 - protein, 9 aa, Japanese encephalitis virus
PTTIAAGLM

SEQ ID NO: 219773 - protein, 9 aa, Japanese encephalitis virus
TTIAAGLMV

SEQ ID NO: 219774 - protein, 9 aa, Japanese encephalitis virus
TIAAGLMVC

SEQ ID NO: 219775 - protein, 9 aa, Japanese encephalitis virus
IAAGLMVCN

SEQ ID NO: 219776 - protein, 9 aa, Japanese encephalitis virus
AAGLMVCNP

SEQ ID NO: 219777 - protein, 9 aa, Japanese encephalitis virus
AGLMVCNPN

SEQ ID NO: 219778 - protein, 9 aa, Japanese encephalitis virus
GLMVCNPNK

SEQ ID NO: 219779 - protein, 9 aa, Japanese encephalitis virus
LMVCNPNKK

SEQ ID NO: 219780 - protein, 9 aa, Japanese encephalitis virus
MVCNPNKKR

SEQ ID NO: 219781 - protein, 9 aa, Japanese encephalitis virus
VCNPNKKRG

SEQ ID NO: 219782 - protein, 9 aa, Japanese encephalitis virus
CNPNKKRGW

SEQ ID NO: 219783 - protein, 9 aa, Japanese encephalitis virus
NPNKKRGWP

SEQ ID NO: 219784 - protein, 9 aa, Japanese encephalitis virus
PNKKRGWPA

SEQ ID NO: 219785 - protein, 9 aa, Japanese encephalitis virus
NKKRGWPAT

SEQ ID NO: 219786 - protein, 9 aa, Japanese encephalitis virus
KKRGWPATE

SEQ ID NO: 219787 - protein, 9 aa, Japanese encephalitis virus
KRGWPATEF

SEQ ID NO: 219788 - protein, 9 aa, Japanese encephalitis virus
RGWPATEFL

SEQ ID NO: 219789 - protein, 9 aa, Japanese encephalitis virus
GWPATEFLS

SEQ ID NO: 219790 - protein, 9 aa, Japanese encephalitis virus
WPATEFLSA

SEQ ID NO: 219791 - protein, 9 aa, Japanese encephalitis virus
PATEFLSAV

SEQ ID NO: 219792 - protein, 9 aa, Japanese encephalitis virus
ATEFLSAVG

SEQ ID NO: 219793 - protein, 9 aa, Japanese encephalitis virus
TEFLSAVGL

SEQ ID NO: 219794 - protein, 9 aa, Japanese encephalitis virus
EFLSAVGLM

SEQ ID NO: 219795 - protein, 9 aa, Japanese encephalitis virus
FLSAVGLMF

SEQ ID NO: 219796 - protein, 9 aa, Japanese encephalitis virus
LSAVGLMFA

SEQ ID NO: 219797 - protein, 9 aa, Japanese encephalitis virus
SAVGLMFAI

SEQ ID NO: 219798 - protein, 9 aa, Japanese encephalitis virus
AVGLMFAIV

SEQ ID NO: 219799 - protein, 9 aa, Japanese encephalitis virus
VGLMFAIVG

SEQ ID NO: 219800 - protein, 9 aa, Japanese encephalitis virus
GLMFAIVGG

SEQ ID NO: 219801 - protein, 9 aa, Japanese encephalitis virus
LMFAIVGGL

SEQ ID NO: 219802 - protein, 9 aa, Japanese encephalitis virus
MFAIVGGLA

SEQ ID NO: 219803 - protein, 9 aa, Japanese encephalitis virus
FAIVGGLAE

SEQ ID NO: 219804 - protein, 9 aa, Japanese encephalitis virus
AIVGGLAEL

SEQ ID NO: 219805 - protein, 9 aa, Japanese encephalitis virus
IVGGLAELD

SEQ ID NO: 219806 - protein, 9 aa, Japanese encephalitis virus
VGGLAELDI

SEQ ID NO: 219807 - protein, 9 aa, Japanese encephalitis virus
GGLAELDIE

SEQ ID NO: 219808 - protein, 9 aa, Japanese encephalitis virus
GLAELDIES

SEQ ID NO: 219809 - protein, 9 aa, Japanese encephalitis virus
LAELDIESM

SEQ ID NO: 219810 - protein, 9 aa, Japanese encephalitis virus
AELDIESMS

SEQ ID NO: 219811 - protein, 9 aa, Japanese encephalitis virus
ELDIESMSI

SEQ ID NO: 219812 - protein, 9 aa, Japanese encephalitis virus
LDIESMSIP

SEQ ID NO: 219813 - protein, 9 aa, Japanese encephalitis virus
DIESMSIPF

SEQ ID NO: 219814 - protein, 9 aa, Japanese encephalitis virus
IESMSIPFM

SEQ ID NO: 219815 - protein, 9 aa, Japanese encephalitis virus
ESMSIPFML

SEQ ID NO: 219816 - protein, 9 aa, Japanese encephalitis virus
SMSIPFMLA

SEQ ID NO: 219817 - protein, 9 aa, Japanese encephalitis virus
MSIPFMLAG

SEQ ID NO: 219818 - protein, 9 aa, Japanese encephalitis virus
SIPFMLAGL

SEQ ID NO: 219819 - protein, 9 aa, Japanese encephalitis virus
IPFMLAGLM

SEQ ID NO: 219820 - protein, 9 aa, Japanese encephalitis virus
PFMLAGLMA

SEQ ID NO: 219821 - protein, 9 aa, Japanese encephalitis virus
FMLAGLMAV

SEQ ID NO: 219822 - protein, 9 aa, Japanese encephalitis virus
MLAGLMAVS

SEQ ID NO: 219823 - protein, 9 aa, Japanese encephalitis virus
LAGLMAVSY

SEQ ID NO: 219824 - protein, 9 aa, Japanese encephalitis virus
AGLMAVSYV

SEQ ID NO: 219825 - protein, 9 aa, Japanese encephalitis virus
GLMAVSYVV

SEQ ID NO: 219826 - protein, 9 aa, Japanese encephalitis virus
LMAVSYVVS

SEQ ID NO: 219827 - protein, 9 aa, Japanese encephalitis virus
MAVSYVVSG

SEQ ID NO: 219828 - protein, 9 aa, Japanese encephalitis virus
AVSYVVSGK

SEQ ID NO: 219829 - protein, 9 aa, Japanese encephalitis virus
VSYVVSGKA

SEQ ID NO: 219830 - protein, 9 aa, Japanese encephalitis virus
SYVVSGKAT

SEQ ID NO: 219831 - protein, 9 aa, Japanese encephalitis virus
YVVSGKATD

SEQ ID NO: 219832 - protein, 9 aa, Japanese encephalitis virus
VVSGKATDM

SEQ ID NO: 219833 - protein, 9 aa, Japanese encephalitis virus
VSGKATDMW

SEQ ID NO: 219834 - protein, 9 aa, Japanese encephalitis virus
SGKATDMWL

SEQ ID NO: 219835 - protein, 9 aa, Japanese encephalitis virus
GKATDMWLE

SEQ ID NO: 219836 - protein, 9 aa, Japanese encephalitis virus
KATDMWLER

SEQ ID NO: 219837 - protein, 9 aa, Japanese encephalitis virus
ATDMWLERA

SEQ ID NO: 219838 - protein, 9 aa, Japanese encephalitis virus
TDMWLERAA

SEQ ID NO: 219839 - protein, 9 aa, Japanese encephalitis virus
DMWLERAAD

SEQ ID NO: 219840 - protein, 9 aa, Japanese encephalitis virus
MWLERAADI

SEQ ID NO: 219841 - protein, 9 aa, Japanese encephalitis virus
WLERAADIS

SEQ ID NO: 219842 - protein, 9 aa, Japanese encephalitis virus
LERAADISW

SEQ ID NO: 219843 - protein, 9 aa, Japanese encephalitis virus
RAADISWEM

SEQ ID NO: 219844 - protein, 9 aa, Japanese encephalitis virus
SWEMDAAIT

SEQ ID NO: 219845 - protein, 9 aa, Japanese encephalitis virus
WEMDAAITG

SEQ ID NO: 219846 - protein, 9 aa, Japanese encephalitis virus
EMDAAITGS

SEQ ID NO: 219847 - protein, 9 aa, Japanese encephalitis virus
MDAAITGSS

SEQ ID NO: 219848 - protein, 9 aa, Japanese encephalitis virus
DAAITGSSR

SEQ ID NO: 219849 - protein, 9 aa, Japanese encephalitis virus
AAITGSSRR

SEQ ID NO: 219850 - protein, 9 aa, Japanese encephalitis virus
AITGSSRRL

SEQ ID NO: 219851 - protein, 9 aa, Japanese encephalitis virus
ITGSSRRLD

SEQ ID NO: 219852 - protein, 9 aa, Japanese encephalitis virus
TGSSRRLDV

SEQ ID NO: 219853 - protein, 9 aa, Japanese encephalitis virus
GSSRRLDVK

SEQ ID NO: 219854 - protein, 9 aa, Japanese encephalitis virus
SSRRLDVKL

SEQ ID NO: 219855 - protein, 9 aa, Japanese encephalitis virus
SRRLDVKLD

SEQ ID NO: 219856 - protein, 9 aa, Japanese encephalitis virus
RRLDVKLDD

SEQ ID NO: 219857 - protein, 9 aa, Japanese encephalitis virus
RLDVKLDDD

SEQ ID NO: 219858 - protein, 9 aa, Japanese encephalitis virus
LDVKLDDDG

SEQ ID NO: 219859 - protein, 9 aa, Japanese encephalitis virus
DVKLDDDGD

SEQ ID NO: 219860 - protein, 9 aa, Japanese encephalitis virus
VKLDDDGDF

SEQ ID NO: 219861 - protein, 9 aa, Japanese encephalitis virus
KLDDDGDFH

SEQ ID NO: 219862 - protein, 9 aa, Japanese encephalitis virus
LDDDGDFHL

SEQ ID NO: 219863 - protein, 9 aa, Japanese encephalitis virus
DDDGDFHLI

SEQ ID NO: 219864 - protein, 9 aa, Japanese encephalitis virus
DDGDFHLID

SEQ ID NO: 219865 - protein, 9 aa, Japanese encephalitis virus
DGDFHLIDD

SEQ ID NO: 219866 - protein, 9 aa, Japanese encephalitis virus
GDFHLIDDP

SEQ ID NO: 219867 - protein, 9 aa, Japanese encephalitis virus
DFHLIDDPG

SEQ ID NO: 219868 - protein, 9 aa, Japanese encephalitis virus
FHLIDDPGV

SEQ ID NO: 219869 - protein, 9 aa, Japanese encephalitis virus
HLIDDPGVP

SEQ ID NO: 219870 - protein, 9 aa, Japanese encephalitis virus
LIDDPGVPW

SEQ ID NO: 219871 - protein, 9 aa, Japanese encephalitis virus
IDDPGVPWK

SEQ ID NO: 219872 - protein, 9 aa, Japanese encephalitis virus
DDPGVPWKV

SEQ ID NO: 219873 - protein, 9 aa, Japanese encephalitis virus
DPGVPWKVW

SEQ ID NO: 219874 - protein, 9 aa, Japanese encephalitis virus
PGVPWKVWV

SEQ ID NO: 219875 - protein, 9 aa, Japanese encephalitis virus
GVPWKVWVL

SEQ ID NO: 219876 - protein, 9 aa, Japanese encephalitis virus
VPWKVWVLR

SEQ ID NO: 219877 - protein, 9 aa, Japanese encephalitis virus
PWKVWVLRM

SEQ ID NO: 219878 - protein, 9 aa, Japanese encephalitis virus
WKVWVLRMS

SEQ ID NO: 219879 - protein, 9 aa, Japanese encephalitis virus
KVWVLRMSC

SEQ ID NO: 219880 - protein, 9 aa, Japanese encephalitis virus
VWVLRMSCI

SEQ ID NO: 219881 - protein, 9 aa, Japanese encephalitis virus
WVLRMSCIG

SEQ ID NO: 219882 - protein, 9 aa, Japanese encephalitis virus
VLRMSCIGL

SEQ ID NO: 219883 - protein, 9 aa, Japanese encephalitis virus
LRMSCIGLA

SEQ ID NO: 219884 - protein, 9 aa, Japanese encephalitis virus
RMSCIGLAA

SEQ ID NO: 219885 - protein, 9 aa, Japanese encephalitis virus
MSCIGLAAL

SEQ ID NO: 219886 - protein, 9 aa, Japanese encephalitis virus
SCIGLAALT

SEQ ID NO: 219887 - protein, 9 aa, Japanese encephalitis virus
CIGLAALTP

SEQ ID NO: 219888 - protein, 9 aa, Japanese encephalitis virus
IGLAALTPW

SEQ ID NO: 219889 - protein, 9 aa, Japanese encephalitis virus
GLAALTPWA

SEQ ID NO: 219890 - protein, 9 aa, Japanese encephalitis virus
LAALTPWAI

SEQ ID NO: 219891 - protein, 9 aa, Japanese encephalitis virus
AALTPWAIV

SEQ ID NO: 219892 - protein, 9 aa, Japanese encephalitis virus
ALTPWAIVP

SEQ ID NO: 219893 - protein, 9 aa, Japanese encephalitis virus
LTPWAIVPA

SEQ ID NO: 219894 - protein, 9 aa, Japanese encephalitis virus
TPWAIVPAA

SEQ ID NO: 219895 - protein, 9 aa, Japanese encephalitis virus
PWAIVPAAF

SEQ ID NO: 219896 - protein, 9 aa, Japanese encephalitis virus
WAIVPAAFG

SEQ ID NO: 219897 - protein, 9 aa, Japanese encephalitis virus
AIVPAAFGY

SEQ ID NO: 219898 - protein, 9 aa, Japanese encephalitis virus
IVPAAFGYW

SEQ ID NO: 219899 - protein, 9 aa, Japanese encephalitis virus
VPAAFGYWL

SEQ ID NO: 219900 - protein, 9 aa, Japanese encephalitis virus
PAAFGYWLT

SEQ ID NO: 219901 - protein, 9 aa, Japanese encephalitis virus
AAFGYWLTL

SEQ ID NO: 219902 - protein, 9 aa, Japanese encephalitis virus
AFGYWLTLK

SEQ ID NO: 219903 - protein, 9 aa, Japanese encephalitis virus
FGYWLTLKT

SEQ ID NO: 219904 - protein, 9 aa, Japanese encephalitis virus
GYWLTLKTT

SEQ ID NO: 219905 - protein, 9 aa, Japanese encephalitis virus
YWLTLKTTK

SEQ ID NO: 219906 - protein, 9 aa, Japanese encephalitis virus
WLTLKTTKR

SEQ ID NO: 219907 - protein, 9 aa, Japanese encephalitis virus
LTLKTTKRG

SEQ ID NO: 219908 - protein, 9 aa, Japanese encephalitis virus
TLKTTKRGG

SEQ ID NO: 219909 - protein, 9 aa, Japanese encephalitis virus
LKTTKRGGV

SEQ ID NO: 219910 - protein, 9 aa, Japanese encephalitis virus
KTTKRGGVF

SEQ ID NO: 219911 - protein, 9 aa, Japanese encephalitis virus
TTKRGGVFW

SEQ ID NO: 219912 - protein, 9 aa, Japanese encephalitis virus
TKRGGVFWD

SEQ ID NO: 219913 - protein, 9 aa, Japanese encephalitis virus
KRGGVFWDT

SEQ ID NO: 219914 - protein, 9 aa, Japanese encephalitis virus
RGGVFWDTP

SEQ ID NO: 219915 - protein, 9 aa, Japanese encephalitis virus
GGVFWDTPS

SEQ ID NO: 219916 - protein, 9 aa, Japanese encephalitis virus
GVFWDTPSP

SEQ ID NO: 219917 - protein, 9 aa, Japanese encephalitis virus
VFWDTPSPK

SEQ ID NO: 219918 - protein, 9 aa, Japanese encephalitis virus
FWDTPSPKP

SEQ ID NO: 219919 - protein, 9 aa, Japanese encephalitis virus
WDTPSPKPC

SEQ ID NO: 219920 - protein, 9 aa, Japanese encephalitis virus
DTPSPKPCS

SEQ ID NO: 219921 - protein, 9 aa, Japanese encephalitis virus
TPSPKPCSK

SEQ ID NO: 219922 - protein, 9 aa, Japanese encephalitis virus
PSPKPCSKG

SEQ ID NO: 219923 - protein, 9 aa, Japanese encephalitis virus
SPKPCSKGD

SEQ ID NO: 219924 - protein, 9 aa, Japanese encephalitis virus
PKPCSKGDT

SEQ ID NO: 219925 - protein, 9 aa, Japanese encephalitis virus
KPCSKGDTT

SEQ ID NO: 219926 - protein, 9 aa, Japanese encephalitis virus
PCSKGDTTT

SEQ ID NO: 219927 - protein, 9 aa, Japanese encephalitis virus
CSKGDTTTG

SEQ ID NO: 219928 - protein, 9 aa, Japanese encephalitis virus
SKGDTTTGV

SEQ ID NO: 219929 - protein, 9 aa, Japanese encephalitis virus
KGDTTTGVY

SEQ ID NO: 219930 - protein, 9 aa, Japanese encephalitis virus
GDTTTGVYR

SEQ ID NO: 219931 - protein, 9 aa, Japanese encephalitis virus
DTTTGVYRI

SEQ ID NO: 219932 - protein, 9 aa, Japanese encephalitis virus
TTTGVYRIM

SEQ ID NO: 219933 - protein, 9 aa, Japanese encephalitis virus
TTGVYRIMA

SEQ ID NO: 219934 - protein, 9 aa, Japanese encephalitis virus
TGVYRIMAR

SEQ ID NO: 219935 - protein, 9 aa, Japanese encephalitis virus
GVYRIMARG

SEQ ID NO: 219936 - protein, 9 aa, Japanese encephalitis virus
VYRIMARGI

SEQ ID NO: 219937 - protein, 9 aa, Japanese encephalitis virus
YRIMARGIL

SEQ ID NO: 219938 - protein, 9 aa, Japanese encephalitis virus
RIMARGILG

SEQ ID NO: 219939 - protein, 9 aa, Japanese encephalitis virus
IMARGILGT

SEQ ID NO: 219940 - protein, 9 aa, Japanese encephalitis virus
MARGILGTY

SEQ ID NO: 219941 - protein, 9 aa, Japanese encephalitis virus
ARGILGTYQ

SEQ ID NO: 219942 - protein, 9 aa, Japanese encephalitis virus
RGILGTYQA

SEQ ID NO: 219943 - protein, 9 aa, Japanese encephalitis virus
GILGTYQAG

SEQ ID NO: 219944 - protein, 9 aa, Japanese encephalitis virus
ILGTYQAGV

SEQ ID NO: 219945 - protein, 9 aa, Japanese encephalitis virus
LGTYQAGVG

SEQ ID NO: 219946 - protein, 9 aa, Japanese encephalitis virus
GTYQAGVGV

SEQ ID NO: 219947 - protein, 9 aa, Japanese encephalitis virus
TYQAGVGVM

SEQ ID NO: 219948 - protein, 9 aa, Japanese encephalitis virus
YQAGVGVMY

SEQ ID NO: 219949 - protein, 9 aa, Japanese encephalitis virus
QAGVGVMYE

SEQ ID NO: 219950 - protein, 9 aa, Japanese encephalitis virus
AGVGVMYEN

SEQ ID NO: 219951 - protein, 9 aa, Japanese encephalitis virus
GVGVMYENV

SEQ ID NO: 219952 - protein, 9 aa, Japanese encephalitis virus
VGVMYENVF

SEQ ID NO: 219953 - protein, 9 aa, Japanese encephalitis virus
GVMYENVFH

SEQ ID NO: 219954 - protein, 9 aa, Japanese encephalitis virus
VMYENVFHT

SEQ ID NO: 219955 - protein, 9 aa, Japanese encephalitis virus
MYENVFHTL

SEQ ID NO: 219956 - protein, 9 aa, Japanese encephalitis virus
YENVFHTLW

SEQ ID NO: 219957 - protein, 9 aa, Japanese encephalitis virus
ENVFHTLWH

SEQ ID NO: 219958 - protein, 9 aa, Japanese encephalitis virus
NVFHTLWHT

SEQ ID NO: 219959 - protein, 9 aa, Japanese encephalitis virus
VFHTLWHTT

SEQ ID NO: 219960 - protein, 9 aa, Japanese encephalitis virus
FHTLWHTTR

SEQ ID NO: 219961 - protein, 9 aa, Japanese encephalitis virus
HTLWHTTRG

SEQ ID NO: 219962 - protein, 9 aa, Japanese encephalitis virus
TLWHTTRGA

SEQ ID NO: 219963 - protein, 9 aa, Japanese encephalitis virus
LWHTTRGAA

SEQ ID NO: 219964 - protein, 9 aa, Japanese encephalitis virus
WHTTRGAAI

SEQ ID NO: 219965 - protein, 9 aa, Japanese encephalitis virus
HTTRGAAIM

SEQ ID NO: 219966 - protein, 9 aa, Japanese encephalitis virus
TTRGAAIMS

SEQ ID NO: 219967 - protein, 9 aa, Japanese encephalitis virus
TRGAAIMSG

SEQ ID NO: 219968 - protein, 9 aa, Japanese encephalitis virus
RGAAIMSGE

SEQ ID NO: 219969 - protein, 9 aa, Japanese encephalitis virus
GAAIMSGEG

SEQ ID NO: 219970 - protein, 9 aa, Japanese encephalitis virus
AAIMSGEGK

SEQ ID NO: 219971 - protein, 9 aa, Japanese encephalitis virus
AIMSGEGKL

SEQ ID NO: 219972 - protein, 9 aa, Japanese encephalitis virus
IMSGEGKLT

SEQ ID NO: 219973 - protein, 9 aa, Japanese encephalitis virus
MSGEGKLTP

SEQ ID NO: 219974 - protein, 9 aa, Japanese encephalitis virus
SGEGKLTPY

SEQ ID NO: 219975 - protein, 9 aa, Japanese encephalitis virus
GEGKLTPYW

SEQ ID NO: 219976 - protein, 9 aa, Japanese encephalitis virus
EGKLTPYWG

SEQ ID NO: 219977 - protein, 9 aa, Japanese encephalitis virus
GKLTPYWGS

SEQ ID NO: 219978 - protein, 9 aa, Japanese encephalitis virus
KLTPYWGSV

SEQ ID NO: 219979 - protein, 9 aa, Japanese encephalitis virus
LTPYWGSVK

SEQ ID NO: 219980 - protein, 9 aa, Japanese encephalitis virus
TPYWGSVKE

SEQ ID NO: 219981 - protein, 9 aa, Japanese encephalitis virus
PYWGSVKED

SEQ ID NO: 219982 - protein, 9 aa, Japanese encephalitis virus
YWGSVKEDR

SEQ ID NO: 219983 - protein, 9 aa, Japanese encephalitis virus
WGSVKEDRI

SEQ ID NO: 219984 - protein, 9 aa, Japanese encephalitis virus
GSVKEDRIA

SEQ ID NO: 219985 - protein, 9 aa, Japanese encephalitis virus
SVKEDRIAY

SEQ ID NO: 219986 - protein, 9 aa, Japanese encephalitis virus
VKEDRIAYG

SEQ ID NO: 219987 - protein, 9 aa, Japanese encephalitis virus
KEDRIAYGG

SEQ ID NO: 219988 - protein, 9 aa, Japanese encephalitis virus
EDRIAYGGP

SEQ ID NO: 219989 - protein, 9 aa, Japanese encephalitis virus
DRIAYGGPW

SEQ ID NO: 219990 - protein, 9 aa, Japanese encephalitis virus
RIAYGGPWR

SEQ ID NO: 219991 - protein, 9 aa, Japanese encephalitis virus
IAYGGPWRF

SEQ ID NO: 219992 - protein, 9 aa, Japanese encephalitis virus
AYGGPWRFD

SEQ ID NO: 219993 - protein, 9 aa, Japanese encephalitis virus
YGGPWRFDR

SEQ ID NO: 219994 - protein, 9 aa, Japanese encephalitis virus
GGPWRFDRK

SEQ ID NO: 219995 - protein, 9 aa, Japanese encephalitis virus
GPWRFDRKW

SEQ ID NO: 219996 - protein, 9 aa, Japanese encephalitis virus
PWRFDRKWN

SEQ ID NO: 219997 - protein, 9 aa, Japanese encephalitis virus
WRFDRKWNG

SEQ ID NO: 219998 - protein, 9 aa, Japanese encephalitis virus
RFDRKWNGT

SEQ ID NO: 219999 - protein, 9 aa, Japanese encephalitis virus
FDRKWNGTD

SEQ ID NO: 220000 - protein, 9 aa, Japanese encephalitis virus
DRKWNGTDD

SEQ ID NO: 220001 - protein, 9 aa, Japanese encephalitis virus
RKWNGTDDV

SEQ ID NO: 220002 - protein, 9 aa, Japanese encephalitis virus
KWNGTDDVQ

SEQ ID NO: 220003 - protein, 9 aa, Japanese encephalitis virus
WNGTDDVQV

SEQ ID NO: 220004 - protein, 9 aa, Japanese encephalitis virus
NGTDDVQVI

SEQ ID NO: 220005 - protein, 9 aa, Japanese encephalitis virus
GTDDVQVIV

SEQ ID NO: 220006 - protein, 9 aa, Japanese encephalitis virus
TDDVQVIVV

SEQ ID NO: 220007 - protein, 9 aa, Japanese encephalitis virus
DDVQVIVVE

SEQ ID NO: 220008 - protein, 9 aa, Japanese encephalitis virus
DVQVIVVEP

SEQ ID NO: 220009 - protein, 9 aa, Japanese encephalitis virus
VQVIVVEPG

SEQ ID NO: 220010 - protein, 9 aa, Japanese encephalitis virus
QVIVVEPGK

SEQ ID NO: 220011 - protein, 9 aa, Japanese encephalitis virus
VIVVEPGKA

SEQ ID NO: 220012 - protein, 9 aa, Japanese encephalitis virus
IVVEPGKAA

SEQ ID NO: 220013 - protein, 9 aa, Japanese encephalitis virus
AVNIQTKPG

SEQ ID NO: 220014 - protein, 9 aa, Japanese encephalitis virus
NIQTKPGVF

SEQ ID NO: 220015 - protein, 9 aa, Japanese encephalitis virus
IQTKPGVFR

SEQ ID NO: 220016 - protein, 9 aa, Japanese encephalitis virus
QTKPGVFRT

SEQ ID NO: 220017 - protein, 9 aa, Japanese encephalitis virus
TKPGVFRTP

SEQ ID NO: 220018 - protein, 9 aa, Japanese encephalitis virus
KPGVFRTPF

SEQ ID NO: 220019 - protein, 9 aa, Japanese encephalitis virus
PGVFRTPFG

SEQ ID NO: 220020 - protein, 9 aa, Japanese encephalitis virus
PFGEVGAVS

SEQ ID NO: 220021 - protein, 9 aa, Japanese encephalitis virus
FGEVGAVSL

SEQ ID NO: 220022 - protein, 9 aa, Japanese encephalitis virus
GEVGAVSLD

SEQ ID NO: 220023 - protein, 9 aa, Japanese encephalitis virus
EVGAVSLDY

SEQ ID NO: 220024 - protein, 9 aa, Japanese encephalitis virus
VGAVSLDYP

SEQ ID NO: 220025 - protein, 9 aa, Japanese encephalitis virus
GAVSLDYPR

SEQ ID NO: 220026 - protein, 9 aa, Japanese encephalitis virus
AVSLDYPRG

SEQ ID NO: 220027 - protein, 9 aa, Japanese encephalitis virus
VSLDYPRGT

SEQ ID NO: 220028 - protein, 9 aa, Japanese encephalitis virus
SLDYPRGTS

SEQ ID NO: 220029 - protein, 9 aa, Japanese encephalitis virus
LDYPRGTSG

SEQ ID NO: 220030 - protein, 9 aa, Japanese encephalitis virus
DYPRGTSGS

SEQ ID NO: 220031 - protein, 9 aa, Japanese encephalitis virus
YPRGTSGSP

SEQ ID NO: 220032 - protein, 9 aa, Japanese encephalitis virus
PRGTSGSPI

SEQ ID NO: 220033 - protein, 9 aa, Japanese encephalitis virus
RGTSGSPIL

SEQ ID NO: 220034 - protein, 9 aa, Japanese encephalitis virus
GTSGSPILD

SEQ ID NO: 220035 - protein, 9 aa, Japanese encephalitis virus
TSGSPILDS

SEQ ID NO: 220036 - protein, 9 aa, Japanese encephalitis virus
SGSPILDSN

SEQ ID NO: 220037 - protein, 9 aa, Japanese encephalitis virus
GSPILDSNG

SEQ ID NO: 220038 - protein, 9 aa, Japanese encephalitis virus
SPILDSNGD

SEQ ID NO: 220039 - protein, 9 aa, Japanese encephalitis virus
PILDSNGDI

SEQ ID NO: 220040 - protein, 9 aa, Japanese encephalitis virus
ILDSNGDII

SEQ ID NO: 220041 - protein, 9 aa, Japanese encephalitis virus
LDSNGDIIG

SEQ ID NO: 220042 - protein, 9 aa, Japanese encephalitis virus
DSNGDIIGL

SEQ ID NO: 220043 - protein, 9 aa, Japanese encephalitis virus
SNGDIIGLY

SEQ ID NO: 220044 - protein, 9 aa, Japanese encephalitis virus
NGDIIGLYG

SEQ ID NO: 220045 - protein, 9 aa, Japanese encephalitis virus
GDIIGLYGN

SEQ ID NO: 220046 - protein, 9 aa, Japanese encephalitis virus
DIIGLYGNG

SEQ ID NO: 220047 - protein, 9 aa, Japanese encephalitis virus
IIGLYGNGV

SEQ ID NO: 220048 - protein, 9 aa, Japanese encephalitis virus
IGLYGNGVE

SEQ ID NO: 220049 - protein, 9 aa, Japanese encephalitis virus
GLYGNGVEL

SEQ ID NO: 220050 - protein, 9 aa, Japanese encephalitis virus
LYGNGVELG

SEQ ID NO: 220051 - protein, 9 aa, Japanese encephalitis virus
YGNGVELGD

SEQ ID NO: 220052 - protein, 9 aa, Japanese encephalitis virus
GNGVELGDG

SEQ ID NO: 220053 - protein, 9 aa, Japanese encephalitis virus
NGVELGDGS

SEQ ID NO: 220054 - protein, 9 aa, Japanese encephalitis virus
GVELGDGSY

SEQ ID NO: 220055 - protein, 9 aa, Japanese encephalitis virus
VELGDGSYV

SEQ ID NO: 220056 - protein, 9 aa, Japanese encephalitis virus
ELGDGSYVS

SEQ ID NO: 220057 - protein, 9 aa, Japanese encephalitis virus
LGDGSYVSA

SEQ ID NO: 220058 - protein, 9 aa, Japanese encephalitis virus
GDGSYVSAI

SEQ ID NO: 220059 - protein, 9 aa, Japanese encephalitis virus
DGSYVSAIV

SEQ ID NO: 220060 - protein, 9 aa, Japanese encephalitis virus
GSYVSAIVQ

SEQ ID NO: 220061 - protein, 9 aa, Japanese encephalitis virus
SYVSAIVQG

SEQ ID NO: 220062 - protein, 9 aa, Japanese encephalitis virus
YVSAIVQGD

SEQ ID NO: 220063 - protein, 9 aa, Japanese encephalitis virus
VSAIVQGDR

SEQ ID NO: 220064 - protein, 9 aa, Japanese encephalitis virus
SAIVQGDRQ

SEQ ID NO: 220065 - protein, 9 aa, Japanese encephalitis virus
AIVQGDRQE

SEQ ID NO: 220066 - protein, 9 aa, Japanese encephalitis virus
IVQGDRQEE

SEQ ID NO: 220067 - protein, 9 aa, Japanese encephalitis virus
VQGDRQEEP

SEQ ID NO: 220068 - protein, 9 aa, Japanese encephalitis virus
QGDRQEEPV

SEQ ID NO: 220069 - protein, 9 aa, Japanese encephalitis virus
GDRQEEPVP

SEQ ID NO: 220070 - protein, 9 aa, Japanese encephalitis virus
DRQEEPVPE

SEQ ID NO: 220071 - protein, 9 aa, Japanese encephalitis virus
RQEEPVPEA

SEQ ID NO: 220072 - protein, 9 aa, Japanese encephalitis virus
QEEPVPEAY

SEQ ID NO: 220073 - protein, 9 aa, Japanese encephalitis virus
EEPVPEAYT

SEQ ID NO: 220074 - protein, 9 aa, Japanese encephalitis virus
EPVPEAYTP

SEQ ID NO: 220075 - protein, 9 aa, Japanese encephalitis virus
PVPEAYTPN

SEQ ID NO: 220076 - protein, 9 aa, Japanese encephalitis virus
VPEAYTPNM

SEQ ID NO: 220077 - protein, 9 aa, Japanese encephalitis virus
PEAYTPNML

SEQ ID NO: 220078 - protein, 9 aa, Japanese encephalitis virus
AYTPNMLRK

SEQ ID NO: 220079 - protein, 9 aa, Japanese encephalitis virus
MLRKRQMTV

SEQ ID NO: 220080 - protein, 9 aa, Japanese encephalitis virus
LRKRQMTVL

SEQ ID NO: 220081 - protein, 9 aa, Japanese encephalitis virus
RKRQMTVLD

SEQ ID NO: 220082 - protein, 9 aa, Japanese encephalitis virus
KRQMTVLDL

SEQ ID NO: 220083 - protein, 9 aa, Japanese encephalitis virus
RQMTVLDLH

SEQ ID NO: 220084 - protein, 9 aa, Japanese encephalitis virus
QMTVLDLHP

SEQ ID NO: 220085 - protein, 9 aa, Japanese encephalitis virus
MTVLDLHPG

SEQ ID NO: 220086 - protein, 9 aa, Japanese encephalitis virus
TVLDLHPGS

SEQ ID NO: 220087 - protein, 9 aa, Japanese encephalitis virus
VLDLHPGSG

SEQ ID NO: 220088 - protein, 9 aa, Japanese encephalitis virus
LDLHPGSGK

SEQ ID NO: 220089 - protein, 9 aa, Japanese encephalitis virus
DLHPGSGKT

SEQ ID NO: 220090 - protein, 9 aa, Japanese encephalitis virus
LHPGSGKTR

SEQ ID NO: 220091 - protein, 9 aa, Japanese encephalitis virus
HPGSGKTRK

SEQ ID NO: 220092 - protein, 9 aa, Japanese encephalitis virus
PGSGKTRKI

SEQ ID NO: 220093 - protein, 9 aa, Japanese encephalitis virus
GSGKTRKIL

SEQ ID NO: 220094 - protein, 9 aa, Japanese encephalitis virus
SGKTRKILP

SEQ ID NO: 220095 - protein, 9 aa, Japanese encephalitis virus
GKTRKILPQ

SEQ ID NO: 220096 - protein, 9 aa, Japanese encephalitis virus
KTRKILPQI

SEQ ID NO: 220097 - protein, 9 aa, Japanese encephalitis virus
TRKILPQII

SEQ ID NO: 220098 - protein, 9 aa, Japanese encephalitis virus
RKILPQIIK

SEQ ID NO: 220099 - protein, 9 aa, Japanese encephalitis virus
KILPQIIKD

SEQ ID NO: 220100 - protein, 9 aa, Japanese encephalitis virus
ILPQIIKDA

SEQ ID NO: 220101 - protein, 9 aa, Japanese encephalitis virus
LPQIIKDAI

SEQ ID NO: 220102 - protein, 9 aa, Japanese encephalitis virus
PQIIKDAIQ

SEQ ID NO: 220103 - protein, 9 aa, Japanese encephalitis virus
QIIKDAIQQ

SEQ ID NO: 220104 - protein, 9 aa, Japanese encephalitis virus
IIKDAIQQR

SEQ ID NO: 220105 - protein, 9 aa, Japanese encephalitis virus
IKDAIQQRL

SEQ ID NO: 220106 - protein, 9 aa, Japanese encephalitis virus
KDAIQQRLR

SEQ ID NO: 220107 - protein, 9 aa, Japanese encephalitis virus
DAIQQRLRT

SEQ ID NO: 220108 - protein, 9 aa, Japanese encephalitis virus
AIQQRLRTA

SEQ ID NO: 220109 - protein, 9 aa, Japanese encephalitis virus
IQQRLRTAV

SEQ ID NO: 220110 - protein, 9 aa, Japanese encephalitis virus
QQRLRTAVL

SEQ ID NO: 220111 - protein, 9 aa, Japanese encephalitis virus
QRLRTAVLA

SEQ ID NO: 220112 - protein, 9 aa, Japanese encephalitis virus
RLRTAVLAP

SEQ ID NO: 220113 - protein, 9 aa, Japanese encephalitis virus
LRTAVLAPT

SEQ ID NO: 220114 - protein, 9 aa, Japanese encephalitis virus
RTAVLAPTR

SEQ ID NO: 220115 - protein, 9 aa, Japanese encephalitis virus
TAVLAPTRV

SEQ ID NO: 220116 - protein, 9 aa, Japanese encephalitis virus
AVLAPTRVV

SEQ ID NO: 220117 - protein, 9 aa, Japanese encephalitis virus
VLAPTRVVA

SEQ ID NO: 220118 - protein, 9 aa, Japanese encephalitis virus
LAPTRVVAA

SEQ ID NO: 220119 - protein, 9 aa, Japanese encephalitis virus
APTRVVAAE

SEQ ID NO: 220120 - protein, 9 aa, Japanese encephalitis virus
PTRVVAAEM

SEQ ID NO: 220121 - protein, 9 aa, Japanese encephalitis virus
TRVVAAEMA

SEQ ID NO: 220122 - protein, 9 aa, Japanese encephalitis virus
RVVAAEMAE

SEQ ID NO: 220123 - protein, 9 aa, Japanese encephalitis virus
VVAAEMAEA

SEQ ID NO: 220124 - protein, 9 aa, Japanese encephalitis virus
VAAEMAEAL

SEQ ID NO: 220125 - protein, 9 aa, Japanese encephalitis virus
AAEMAEALR

SEQ ID NO: 220126 - protein, 9 aa, Japanese encephalitis virus
AEMAEALRG

SEQ ID NO: 220127 - protein, 9 aa, Japanese encephalitis virus
EMAEALRGL

SEQ ID NO: 220128 - protein, 9 aa, Japanese encephalitis virus
MAEALRGLP

SEQ ID NO: 220129 - protein, 9 aa, Japanese encephalitis virus
AEALRGLPV

SEQ ID NO: 220130 - protein, 9 aa, Japanese encephalitis virus
EALRGLPVR

SEQ ID NO: 220131 - protein, 9 aa, Japanese encephalitis virus
ALRGLPVRY

SEQ ID NO: 220132 - protein, 9 aa, Japanese encephalitis virus
LRGLPVRYQ

SEQ ID NO: 220133 - protein, 9 aa, Japanese encephalitis virus
RGLPVRYQT

SEQ ID NO: 220134 - protein, 9 aa, Japanese encephalitis virus
GLPVRYQTS

SEQ ID NO: 220135 - protein, 9 aa, Japanese encephalitis virus
LPVRYQTSA

SEQ ID NO: 220136 - protein, 9 aa, Japanese encephalitis virus
PVRYQTSAV

SEQ ID NO: 220137 - protein, 9 aa, Japanese encephalitis virus
VRYQTSAVQ

SEQ ID NO: 220138 - protein, 9 aa, Japanese encephalitis virus
RYQTSAVQR

SEQ ID NO: 220139 - protein, 9 aa, Japanese encephalitis virus
YQTSAVQRE

SEQ ID NO: 220140 - protein, 9 aa, Japanese encephalitis virus
QTSAVQREH

SEQ ID NO: 220141 - protein, 9 aa, Japanese encephalitis virus
TSAVQREHQ

SEQ ID NO: 220142 - protein, 9 aa, Japanese encephalitis virus
SAVQREHQG

SEQ ID NO: 220143 - protein, 9 aa, Japanese encephalitis virus
AVQREHQGN

SEQ ID NO: 220144 - protein, 9 aa, Japanese encephalitis virus
VQREHQGNE

SEQ ID NO: 220145 - protein, 9 aa, Japanese encephalitis virus
QREHQGNEI

SEQ ID NO: 220146 - protein, 9 aa, Japanese encephalitis virus
REHQGNEIV

SEQ ID NO: 220147 - protein, 9 aa, Japanese encephalitis virus
EHQGNEIVD

SEQ ID NO: 220148 - protein, 9 aa, Japanese encephalitis virus
HQGNEIVDV

SEQ ID NO: 220149 - protein, 9 aa, Japanese encephalitis virus
QGNEIVDVM

SEQ ID NO: 220150 - protein, 9 aa, Japanese encephalitis virus
GNEIVDVMC

SEQ ID NO: 220151 - protein, 9 aa, Japanese encephalitis virus
NEIVDVMCH

SEQ ID NO: 220152 - protein, 9 aa, Japanese encephalitis virus
EIVDVMCHA

SEQ ID NO: 220153 - protein, 9 aa, Japanese encephalitis virus
IVDVMCHAT

SEQ ID NO: 220154 - protein, 9 aa, Japanese encephalitis virus
VDVMCHATL

SEQ ID NO: 220155 - protein, 9 aa, Japanese encephalitis virus
DVMCHATLT

SEQ ID NO: 220156 - protein, 9 aa, Japanese encephalitis virus
VMCHATLTH

SEQ ID NO: 220157 - protein, 9 aa, Japanese encephalitis virus
MCHATLTHR

SEQ ID NO: 220158 - protein, 9 aa, Japanese encephalitis virus
CHATLTHRL

SEQ ID NO: 220159 - protein, 9 aa, Japanese encephalitis virus
HATLTHRLM

SEQ ID NO: 220160 - protein, 9 aa, Japanese encephalitis virus
ATLTHRLMS

SEQ ID NO: 220161 - protein, 9 aa, Japanese encephalitis virus
TLTHRLMSP

SEQ ID NO: 220162 - protein, 9 aa, Japanese encephalitis virus
LTHRLMSPN

SEQ ID NO: 220163 - protein, 9 aa, Japanese encephalitis virus
THRLMSPNR

SEQ ID NO: 220164 - protein, 9 aa, Japanese encephalitis virus
HRLMSPNRV

SEQ ID NO: 220165 - protein, 9 aa, Japanese encephalitis virus
RLMSPNRVP

SEQ ID NO: 220166 - protein, 9 aa, Japanese encephalitis virus
LMSPNRVPN

SEQ ID NO: 220167 - protein, 9 aa, Japanese encephalitis virus
MSPNRVPNY

SEQ ID NO: 220168 - protein, 9 aa, Japanese encephalitis virus
SPNRVPNYN

SEQ ID NO: 220169 - protein, 9 aa, Japanese encephalitis virus
PNRVPNYNL

SEQ ID NO: 220170 - protein, 9 aa, Japanese encephalitis virus
NRVPNYNLF

SEQ ID NO: 220171 - protein, 9 aa, Japanese encephalitis virus
RVPNYNLFV

SEQ ID NO: 220172 - protein, 9 aa, Japanese encephalitis virus
VPNYNLFVM

SEQ ID NO: 220173 - protein, 9 aa, Japanese encephalitis virus
PNYNLFVMD

SEQ ID NO: 220174 - protein, 9 aa, Japanese encephalitis virus
NYNLFVMDE

SEQ ID NO: 220175 - protein, 9 aa, Japanese encephalitis virus
YNLFVMDEA

SEQ ID NO: 220176 - protein, 9 aa, Japanese encephalitis virus
NLFVMDEAH

SEQ ID NO: 220177 - protein, 9 aa, Japanese encephalitis virus
LFVMDEAHF

SEQ ID NO: 220178 - protein, 9 aa, Japanese encephalitis virus
FVMDEAHFT

SEQ ID NO: 220179 - protein, 9 aa, Japanese encephalitis virus
VMDEAHFTD

SEQ ID NO: 220180 - protein, 9 aa, Japanese encephalitis virus
MDEAHFTDP

SEQ ID NO: 220181 - protein, 9 aa, Japanese encephalitis virus
DEAHFTDPA

SEQ ID NO: 220182 - protein, 9 aa, Japanese encephalitis virus
EAHFTDPAS

SEQ ID NO: 220183 - protein, 9 aa, Japanese encephalitis virus
AHFTDPASI

SEQ ID NO: 220184 - protein, 9 aa, Japanese encephalitis virus
HFTDPASIA

SEQ ID NO: 220185 - protein, 9 aa, Japanese encephalitis virus
FTDPASIAA

SEQ ID NO: 220186 - protein, 9 aa, Japanese encephalitis virus
TDPASIAAR

SEQ ID NO: 220187 - protein, 9 aa, Japanese encephalitis virus
DPASIAARG

SEQ ID NO: 220188 - protein, 9 aa, Japanese encephalitis virus
PASIAARGY

SEQ ID NO: 220189 - protein, 9 aa, Japanese encephalitis virus
ASIAARGYI

SEQ ID NO: 220190 - protein, 9 aa, Japanese encephalitis virus
SIAARGYIA

SEQ ID NO: 220191 - protein, 9 aa, Japanese encephalitis virus
IAARGYIAT

SEQ ID NO: 220192 - protein, 9 aa, Japanese encephalitis virus
AARGYIATK

SEQ ID NO: 220193 - protein, 9 aa, Japanese encephalitis virus
ARGYIATKV

SEQ ID NO: 220194 - protein, 9 aa, Japanese encephalitis virus
RGYIATKVE

SEQ ID NO: 220195 - protein, 9 aa, Japanese encephalitis virus
GYIATKVEL

SEQ ID NO: 220196 - protein, 9 aa, Japanese encephalitis virus
YIATKVELG

SEQ ID NO: 220197 - protein, 9 aa, Japanese encephalitis virus
IATKVELGE

SEQ ID NO: 220198 - protein, 9 aa, Japanese encephalitis virus
ATKVELGEA

SEQ ID NO: 220199 - protein, 9 aa, Japanese encephalitis virus
TKVELGEAA

SEQ ID NO: 220200 - protein, 9 aa, Japanese encephalitis virus
KVELGEAAA

SEQ ID NO: 220201 - protein, 9 aa, Japanese encephalitis virus
VELGEAAAI

SEQ ID NO: 220202 - protein, 9 aa, Japanese encephalitis virus
ELGEAAAIF

SEQ ID NO: 220203 - protein, 9 aa, Japanese encephalitis virus
LGEAAAIFM

SEQ ID NO: 220204 - protein, 9 aa, Japanese encephalitis virus
GEAAAIFMT

SEQ ID NO: 220205 - protein, 9 aa, Japanese encephalitis virus
EAAAIFMTA

SEQ ID NO: 220206 - protein, 9 aa, Japanese encephalitis virus
AAAIFMTAT

SEQ ID NO: 220207 - protein, 9 aa, Japanese encephalitis virus
AAIFMTATP

SEQ ID NO: 220208 - protein, 9 aa, Japanese encephalitis virus
AIFMTATPP

SEQ ID NO: 220209 - protein, 9 aa, Japanese encephalitis virus
IFMTATPPG

SEQ ID NO: 220210 - protein, 9 aa, Japanese encephalitis virus
FMTATPPGT

SEQ ID NO: 220211 - protein, 9 aa, Japanese encephalitis virus
MTATPPGTT

SEQ ID NO: 220212 - protein, 9 aa, Japanese encephalitis virus
TATPPGTTD

SEQ ID NO: 220213 - protein, 9 aa, Japanese encephalitis virus
ATPPGTTDP

SEQ ID NO: 220214 - protein, 9 aa, Japanese encephalitis virus
TPPGTTDPF

SEQ ID NO: 220215 - protein, 9 aa, Japanese encephalitis virus
PPGTTDPFP

SEQ ID NO: 220216 - protein, 9 aa, Japanese encephalitis virus
PGTTDPFPD

SEQ ID NO: 220217 - protein, 9 aa, Japanese encephalitis virus
GTTDPFPDS

SEQ ID NO: 220218 - protein, 9 aa, Japanese encephalitis virus
TTDPFPDSN

SEQ ID NO: 220219 - protein, 9 aa, Japanese encephalitis virus
TDPFPDSNA

SEQ ID NO: 220220 - protein, 9 aa, Japanese encephalitis virus
DPFPDSNAP

SEQ ID NO: 220221 - protein, 9 aa, Japanese encephalitis virus
PFPDSNAPI

SEQ ID NO: 220222 - protein, 9 aa, Japanese encephalitis virus
FPDSNAPIH

SEQ ID NO: 220223 - protein, 9 aa, Japanese encephalitis virus
PDSNAPIHD

SEQ ID NO: 220224 - protein, 9 aa, Japanese encephalitis virus
DSNAPIHDL

SEQ ID NO: 220225 - protein, 9 aa, Japanese encephalitis virus
SNAPIHDLQ

SEQ ID NO: 220226 - protein, 9 aa, Japanese encephalitis virus
NAPIHDLQD

SEQ ID NO: 220227 - protein, 9 aa, Japanese encephalitis virus
APIHDLQDE

SEQ ID NO: 220228 - protein, 9 aa, Japanese encephalitis virus
PIHDLQDEI

SEQ ID NO: 220229 - protein, 9 aa, Japanese encephalitis virus
IHDLQDEIP

SEQ ID NO: 220230 - protein, 9 aa, Japanese encephalitis virus
HDLQDEIPD

SEQ ID NO: 220231 - protein, 9 aa, Japanese encephalitis virus
DLQDEIPDR

SEQ ID NO: 220232 - protein, 9 aa, Japanese encephalitis virus
LQDEIPDRA

SEQ ID NO: 220233 - protein, 9 aa, Japanese encephalitis virus
QDEIPDRAW

SEQ ID NO: 220234 - protein, 9 aa, Japanese encephalitis virus
DEIPDRAWS

SEQ ID NO: 220235 - protein, 9 aa, Japanese encephalitis virus
EIPDRAWSS

SEQ ID NO: 220236 - protein, 9 aa, Japanese encephalitis virus
IPDRAWSSG

SEQ ID NO: 220237 - protein, 9 aa, Japanese encephalitis virus
WITEYAGKT

SEQ ID NO: 220238 - protein, 9 aa, Japanese encephalitis virus
ITEYAGKTV

SEQ ID NO: 220239 - protein, 9 aa, Japanese encephalitis virus
TEYAGKTVW

SEQ ID NO: 220240 - protein, 9 aa, Japanese encephalitis virus
EYAGKTVWF

SEQ ID NO: 220241 - protein, 9 aa, Japanese encephalitis virus
YAGKTVWFV

SEQ ID NO: 220242 - protein, 9 aa, Japanese encephalitis virus
AGKTVWFVA

SEQ ID NO: 220243 - protein, 9 aa, Japanese encephalitis virus
GKTVWFVAS

SEQ ID NO: 220244 - protein, 9 aa, Japanese encephalitis virus
KTVWFVASV

SEQ ID NO: 220245 - protein, 9 aa, Japanese encephalitis virus
TVWFVASVK

SEQ ID NO: 220246 - protein, 9 aa, Japanese encephalitis virus
VWFVASVKM

SEQ ID NO: 220247 - protein, 9 aa, Japanese encephalitis virus
WFVASVKMG

SEQ ID NO: 220248 - protein, 9 aa, Japanese encephalitis virus
FVASVKMGN

SEQ ID NO: 220249 - protein, 9 aa, Japanese encephalitis virus
VASVKMGNE

SEQ ID NO: 220250 - protein, 9 aa, Japanese encephalitis virus
ASVKMGNEI

SEQ ID NO: 220251 - protein, 9 aa, Japanese encephalitis virus
SVKMGNEIA

SEQ ID NO: 220252 - protein, 9 aa, Japanese encephalitis virus
VKMGNEIAM

SEQ ID NO: 220253 - protein, 9 aa, Japanese encephalitis virus
KMGNEIAMC

SEQ ID NO: 220254 - protein, 9 aa, Japanese encephalitis virus
MGNEIAMCL

SEQ ID NO: 220255 - protein, 9 aa, Japanese encephalitis virus
GNEIAMCLQ

SEQ ID NO: 220256 - protein, 9 aa, Japanese encephalitis virus
NEIAMCLQR

SEQ ID NO: 220257 - protein, 9 aa, Japanese encephalitis virus
EIAMCLQRA

SEQ ID NO: 220258 - protein, 9 aa, Japanese encephalitis virus
IAMCLQRAG

SEQ ID NO: 220259 - protein, 9 aa, Japanese encephalitis virus
AMCLQRAGK

SEQ ID NO: 220260 - protein, 9 aa, Japanese encephalitis virus
MCLQRAGKK

SEQ ID NO: 220261 - protein, 9 aa, Japanese encephalitis virus
CLQRAGKKV

SEQ ID NO: 220262 - protein, 9 aa, Japanese encephalitis virus
LQRAGKKVI

SEQ ID NO: 220263 - protein, 9 aa, Japanese encephalitis virus
QRAGKKVIQ

SEQ ID NO: 220264 - protein, 9 aa, Japanese encephalitis virus
RAGKKVIQL

SEQ ID NO: 220265 - protein, 9 aa, Japanese encephalitis virus
AGKKVIQLN

SEQ ID NO: 220266 - protein, 9 aa, Japanese encephalitis virus
GKKVIQLNR

SEQ ID NO: 220267 - protein, 9 aa, Japanese encephalitis virus
KKVIQLNRK

SEQ ID NO: 220268 - protein, 9 aa, Japanese encephalitis virus
KVIQLNRKS

SEQ ID NO: 220269 - protein, 9 aa, Japanese encephalitis virus
VIQLNRKSY

SEQ ID NO: 220270 - protein, 9 aa, Japanese encephalitis virus
IQLNRKSYD

SEQ ID NO: 220271 - protein, 9 aa, Japanese encephalitis virus
QLNRKSYDT

SEQ ID NO: 220272 - protein, 9 aa, Japanese encephalitis virus
LNRKSYDTE

SEQ ID NO: 220273 - protein, 9 aa, Japanese encephalitis virus
NRKSYDTEY

SEQ ID NO: 220274 - protein, 9 aa, Japanese encephalitis virus
RKSYDTEYP

SEQ ID NO: 220275 - protein, 9 aa, Japanese encephalitis virus
KSYDTEYPK

SEQ ID NO: 220276 - protein, 9 aa, Japanese encephalitis virus
SYDTEYPKC

SEQ ID NO: 220277 - protein, 9 aa, Japanese encephalitis virus
YDTEYPKCK

SEQ ID NO: 220278 - protein, 9 aa, Japanese encephalitis virus
DTEYPKCKN

SEQ ID NO: 220279 - protein, 9 aa, Japanese encephalitis virus
TEYPKCKNG

SEQ ID NO: 220280 - protein, 9 aa, Japanese encephalitis virus
EYPKCKNGD

SEQ ID NO: 220281 - protein, 9 aa, Japanese encephalitis virus
YPKCKNGDW

SEQ ID NO: 220282 - protein, 9 aa, Japanese encephalitis virus
PKCKNGDWD

SEQ ID NO: 220283 - protein, 9 aa, Japanese encephalitis virus
KCKNGDWDF

SEQ ID NO: 220284 - protein, 9 aa, Japanese encephalitis virus
CKNGDWDFV

SEQ ID NO: 220285 - protein, 9 aa, Japanese encephalitis virus
KNGDWDFVI

SEQ ID NO: 220286 - protein, 9 aa, Japanese encephalitis virus
NGDWDFVIT

SEQ ID NO: 220287 - protein, 9 aa, Japanese encephalitis virus
GDWDFVITT

SEQ ID NO: 220288 - protein, 9 aa, Japanese encephalitis virus
DWDFVITTD

SEQ ID NO: 220289 - protein, 9 aa, Japanese encephalitis virus
WDFVITTDI

SEQ ID NO: 220290 - protein, 9 aa, Japanese encephalitis virus
DFVITTDIS

SEQ ID NO: 220291 - protein, 9 aa, Japanese encephalitis virus
FVITTDISE

SEQ ID NO: 220292 - protein, 9 aa, Japanese encephalitis virus
VITTDISEM

SEQ ID NO: 220293 - protein, 9 aa, Japanese encephalitis virus
ITTDISEMG

SEQ ID NO: 220294 - protein, 9 aa, Japanese encephalitis virus
TTDISEMGA

SEQ ID NO: 220295 - protein, 9 aa, Japanese encephalitis virus
TDISEMGAN

SEQ ID NO: 220296 - protein, 9 aa, Japanese encephalitis virus
DISEMGANF

SEQ ID NO: 220297 - protein, 9 aa, Japanese encephalitis virus
ISEMGANFG

SEQ ID NO: 220298 - protein, 9 aa, Japanese encephalitis virus
SEMGANFGA

SEQ ID NO: 220299 - protein, 9 aa, Japanese encephalitis virus
EMGANFGAS

SEQ ID NO: 220300 - protein, 9 aa, Japanese encephalitis virus
MGANFGASR

SEQ ID NO: 220301 - protein, 9 aa, Japanese encephalitis virus
GANFGASRV

SEQ ID NO: 220302 - protein, 9 aa, Japanese encephalitis virus
ANFGASRVI

SEQ ID NO: 220303 - protein, 9 aa, Japanese encephalitis virus
NFGASRVID

SEQ ID NO: 220304 - protein, 9 aa, Japanese encephalitis virus
FGASRVIDC

SEQ ID NO: 220305 - protein, 9 aa, Japanese encephalitis virus
GASRVIDCR

SEQ ID NO: 220306 - protein, 9 aa, Japanese encephalitis virus
ASRVIDCRK

SEQ ID NO: 220307 - protein, 9 aa, Japanese encephalitis virus
SRVIDCRKS

SEQ ID NO: 220308 - protein, 9 aa, Japanese encephalitis virus
RVIDCRKSV

SEQ ID NO: 220309 - protein, 9 aa, Japanese encephalitis virus
VIDCRKSVK

SEQ ID NO: 220310 - protein, 9 aa, Japanese encephalitis virus
IDCRKSVKP

SEQ ID NO: 220311 - protein, 9 aa, Japanese encephalitis virus
DCRKSVKPT

SEQ ID NO: 220312 - protein, 9 aa, Japanese encephalitis virus
CRKSVKPTI

SEQ ID NO: 220313 - protein, 9 aa, Japanese encephalitis virus
RKSVKPTIL

SEQ ID NO: 220314 - protein, 9 aa, Japanese encephalitis virus
KSVKPTILE

SEQ ID NO: 220315 - protein, 9 aa, Japanese encephalitis virus
SVKPTILEE

SEQ ID NO: 220316 - protein, 9 aa, Japanese encephalitis virus
VKPTILEEG

SEQ ID NO: 220317 - protein, 9 aa, Japanese encephalitis virus
KPTILEEGE

SEQ ID NO: 220318 - protein, 9 aa, Japanese encephalitis virus
PTILEEGEG

SEQ ID NO: 220319 - protein, 9 aa, Japanese encephalitis virus
TILEEGEGR

SEQ ID NO: 220320 - protein, 9 aa, Japanese encephalitis virus
ILEEGEGRV

SEQ ID NO: 220321 - protein, 9 aa, Japanese encephalitis virus
LEEGEGRVI

SEQ ID NO: 220322 - protein, 9 aa, Japanese encephalitis virus
EEGEGRVIL

SEQ ID NO: 220323 - protein, 9 aa, Japanese encephalitis virus
EGEGRVILG

SEQ ID NO: 220324 - protein, 9 aa, Japanese encephalitis virus
GEGRVILGN

SEQ ID NO: 220325 - protein, 9 aa, Japanese encephalitis virus
EGRVILGNP

SEQ ID NO: 220326 - protein, 9 aa, Japanese encephalitis virus
GRVILGNPS

SEQ ID NO: 220327 - protein, 9 aa, Japanese encephalitis virus
RVILGNPSP

SEQ ID NO: 220328 - protein, 9 aa, Japanese encephalitis virus
VILGNPSPI

SEQ ID NO: 220329 - protein, 9 aa, Japanese encephalitis virus
ILGNPSPIT

SEQ ID NO: 220330 - protein, 9 aa, Japanese encephalitis virus
LGNPSPITS

SEQ ID NO: 220331 - protein, 9 aa, Japanese encephalitis virus
GNPSPITSA

SEQ ID NO: 220332 - protein, 9 aa, Japanese encephalitis virus
NPSPITSAS

SEQ ID NO: 220333 - protein, 9 aa, Japanese encephalitis virus
PSPITSASA

SEQ ID NO: 220334 - protein, 9 aa, Japanese encephalitis virus
SPITSASAA

SEQ ID NO: 220335 - protein, 9 aa, Japanese encephalitis virus
PITSASAAQ

SEQ ID NO: 220336 - protein, 9 aa, Japanese encephalitis virus
ITSASAAQR

SEQ ID NO: 220337 - protein, 9 aa, Japanese encephalitis virus
TSASAAQRR

SEQ ID NO: 220338 - protein, 9 aa, Japanese encephalitis virus
SASAAQRRG

SEQ ID NO: 220339 - protein, 9 aa, Japanese encephalitis virus
ASAAQRRGR

SEQ ID NO: 220340 - protein, 9 aa, Japanese encephalitis virus
SAAQRRGRV

SEQ ID NO: 220341 - protein, 9 aa, Japanese encephalitis virus
AAQRRGRVG

SEQ ID NO: 220342 - protein, 9 aa, Japanese encephalitis virus
AQRRGRVGR

SEQ ID NO: 220343 - protein, 9 aa, Japanese encephalitis virus
QRRGRVGRN

SEQ ID NO: 220344 - protein, 9 aa, Japanese encephalitis virus
RRGRVGRNP

SEQ ID NO: 220345 - protein, 9 aa, Japanese encephalitis virus
RGRVGRNPN

SEQ ID NO: 220346 - protein, 9 aa, Japanese encephalitis virus
GRVGRNPNQ

SEQ ID NO: 220347 - protein, 9 aa, Japanese encephalitis virus
RVGRNPNQV

SEQ ID NO: 220348 - protein, 9 aa, Japanese encephalitis virus
VGRNPNQVG

SEQ ID NO: 220349 - protein, 9 aa, Japanese encephalitis virus
GRNPNQVGD

SEQ ID NO: 220350 - protein, 9 aa, Japanese encephalitis virus
RNPNQVGDE

SEQ ID NO: 220351 - protein, 9 aa, Japanese encephalitis virus
NPNQVGDEY

SEQ ID NO: 220352 - protein, 9 aa, Japanese encephalitis virus
PNQVGDEYH

SEQ ID NO: 220353 - protein, 9 aa, Japanese encephalitis virus
NQVGDEYHY

SEQ ID NO: 220354 - protein, 9 aa, Japanese encephalitis virus
QVGDEYHYG

SEQ ID NO: 220355 - protein, 9 aa, Japanese encephalitis virus
VGDEYHYGG

SEQ ID NO: 220356 - protein, 9 aa, Japanese encephalitis virus
GDEYHYGGA

SEQ ID NO: 220357 - protein, 9 aa, Japanese encephalitis virus
DEYHYGGAT

SEQ ID NO: 220358 - protein, 9 aa, Japanese encephalitis virus
EYHYGGATS

SEQ ID NO: 220359 - protein, 9 aa, Japanese encephalitis virus
YHYGGATSE

SEQ ID NO: 220360 - protein, 9 aa, Japanese encephalitis virus
HYGGATSED

SEQ ID NO: 220361 - protein, 9 aa, Japanese encephalitis virus
YGGATSEDD

SEQ ID NO: 220362 - protein, 9 aa, Japanese encephalitis virus
GGATSEDDS

SEQ ID NO: 220363 - protein, 9 aa, Japanese encephalitis virus
GATSEDDSN

SEQ ID NO: 220364 - protein, 9 aa, Japanese encephalitis virus
ATSEDDSNL

SEQ ID NO: 220365 - protein, 9 aa, Japanese encephalitis virus
TSEDDSNLA

SEQ ID NO: 220366 - protein, 9 aa, Japanese encephalitis virus
SEDDSNLAH

SEQ ID NO: 220367 - protein, 9 aa, Japanese encephalitis virus
EDDSNLAHW

SEQ ID NO: 220368 - protein, 9 aa, Japanese encephalitis virus
DDSNLAHWT

SEQ ID NO: 220369 - protein, 9 aa, Japanese encephalitis virus
DSNLAHWTE

SEQ ID NO: 220370 - protein, 9 aa, Japanese encephalitis virus
SNLAHWTEA

SEQ ID NO: 220371 - protein, 9 aa, Japanese encephalitis virus
NLAHWTEAK

SEQ ID NO: 220372 - protein, 9 aa, Japanese encephalitis virus
LAHWTEAKI

SEQ ID NO: 220373 - protein, 9 aa, Japanese encephalitis virus
AHWTEAKIM

SEQ ID NO: 220374 - protein, 9 aa, Japanese encephalitis virus
HWTEAKIML

SEQ ID NO: 220375 - protein, 9 aa, Japanese encephalitis virus
WTEAKIMLD

SEQ ID NO: 220376 - protein, 9 aa, Japanese encephalitis virus
TEAKIMLDN

SEQ ID NO: 220377 - protein, 9 aa, Japanese encephalitis virus
EAKIMLDNI

SEQ ID NO: 220378 - protein, 9 aa, Japanese encephalitis virus
AKIMLDNIH

SEQ ID NO: 220379 - protein, 9 aa, Japanese encephalitis virus
KIMLDNIHM

SEQ ID NO: 220380 - protein, 9 aa, Japanese encephalitis virus
IMLDNIHMP

SEQ ID NO: 220381 - protein, 9 aa, Japanese encephalitis virus
MLDNIHMPN

SEQ ID NO: 220382 - protein, 9 aa, Japanese encephalitis virus
LDNIHMPNG

SEQ ID NO: 220383 - protein, 9 aa, Japanese encephalitis virus
DNIHMPNGL

SEQ ID NO: 220384 - protein, 9 aa, Japanese encephalitis virus
NIHMPNGLV

SEQ ID NO: 220385 - protein, 9 aa, Japanese encephalitis virus
IHMPNGLVA

SEQ ID NO: 220386 - protein, 9 aa, Japanese encephalitis virus
HMPNGLVAQ

SEQ ID NO: 220387 - protein, 9 aa, Japanese encephalitis virus
MPNGLVAQL

SEQ ID NO: 220388 - protein, 9 aa, Japanese encephalitis virus
PNGLVAQLY

SEQ ID NO: 220389 - protein, 9 aa, Japanese encephalitis virus
NGLVAQLYG

SEQ ID NO: 220390 - protein, 9 aa, Japanese encephalitis virus
GLVAQLYGP

SEQ ID NO: 220391 - protein, 9 aa, Japanese encephalitis virus
LVAQLYGPE

SEQ ID NO: 220392 - protein, 9 aa, Japanese encephalitis virus
VAQLYGPER

SEQ ID NO: 220393 - protein, 9 aa, Japanese encephalitis virus
AQLYGPERE

SEQ ID NO: 220394 - protein, 9 aa, Japanese encephalitis virus
QLYGPEREK

SEQ ID NO: 220395 - protein, 9 aa, Japanese encephalitis virus
LYGPEREKA

SEQ ID NO: 220396 - protein, 9 aa, Japanese encephalitis virus
YGPEREKAF

SEQ ID NO: 220397 - protein, 9 aa, Japanese encephalitis virus
GPEREKAFT

SEQ ID NO: 220398 - protein, 9 aa, Japanese encephalitis virus
PEREKAFTM

SEQ ID NO: 220399 - protein, 9 aa, Japanese encephalitis virus
EREKAFTMD

SEQ ID NO: 220400 - protein, 9 aa, Japanese encephalitis virus
REKAFTMDG

SEQ ID NO: 220401 - protein, 9 aa, Japanese encephalitis virus
EKAFTMDGE

SEQ ID NO: 220402 - protein, 9 aa, Japanese encephalitis virus
KAFTMDGEY

SEQ ID NO: 220403 - protein, 9 aa, Japanese encephalitis virus
AFTMDGEYR

SEQ ID NO: 220404 - protein, 9 aa, Japanese encephalitis virus
FTMDGEYRL

SEQ ID NO: 220405 - protein, 9 aa, Japanese encephalitis virus
TMDGEYRLR

SEQ ID NO: 220406 - protein, 9 aa, Japanese encephalitis virus
MDGEYRLRG

SEQ ID NO: 220407 - protein, 9 aa, Japanese encephalitis virus
DGEYRLRGE

SEQ ID NO: 220408 - protein, 9 aa, Japanese encephalitis virus
GEYRLRGEE

SEQ ID NO: 220409 - protein, 9 aa, Japanese encephalitis virus
EYRLRGEEK

SEQ ID NO: 220410 - protein, 9 aa, Japanese encephalitis virus
YRLRGEEKK

SEQ ID NO: 220411 - protein, 9 aa, Japanese encephalitis virus
RLRGEEKKN

SEQ ID NO: 220412 - protein, 9 aa, Japanese encephalitis virus
LRGEEKKNF

SEQ ID NO: 220413 - protein, 9 aa, Japanese encephalitis virus
RGEEKKNFL

SEQ ID NO: 220414 - protein, 9 aa, Japanese encephalitis virus
GEEKKNFLE

SEQ ID NO: 220415 - protein, 9 aa, Japanese encephalitis virus
EEKKNFLEL

SEQ ID NO: 220416 - protein, 9 aa, Japanese encephalitis virus
EKKNFLELL

SEQ ID NO: 220417 - protein, 9 aa, Japanese encephalitis virus
KKNFLELLR

SEQ ID NO: 220418 - protein, 9 aa, Japanese encephalitis virus
KNFLELLRT

SEQ ID NO: 220419 - protein, 9 aa, Japanese encephalitis virus
NFLELLRTA

SEQ ID NO: 220420 - protein, 9 aa, Japanese encephalitis virus
FLELLRTAD

SEQ ID NO: 220421 - protein, 9 aa, Japanese encephalitis virus
LELLRTADL

SEQ ID NO: 220422 - protein, 9 aa, Japanese encephalitis virus
ELLRTADLP

SEQ ID NO: 220423 - protein, 9 aa, Japanese encephalitis virus
LLRTADLPV

SEQ ID NO: 220424 - protein, 9 aa, Japanese encephalitis virus
LRTADLPVW

SEQ ID NO: 220425 - protein, 9 aa, Japanese encephalitis virus
RTADLPVWL

SEQ ID NO: 220426 - protein, 9 aa, Japanese encephalitis virus
TADLPVWLA

SEQ ID NO: 220427 - protein, 9 aa, Japanese encephalitis virus
ADLPVWLAY

SEQ ID NO: 220428 - protein, 9 aa, Japanese encephalitis virus
DLPVWLAYK

SEQ ID NO: 220429 - protein, 9 aa, Japanese encephalitis virus
LPVWLAYKV

SEQ ID NO: 220430 - protein, 9 aa, Japanese encephalitis virus
PVWLAYKVA

SEQ ID NO: 220431 - protein, 9 aa, Japanese encephalitis virus
VWLAYKVAS

SEQ ID NO: 220432 - protein, 9 aa, Japanese encephalitis virus
WLAYKVASN

SEQ ID NO: 220433 - protein, 9 aa, Japanese encephalitis virus
LAYKVASNG

SEQ ID NO: 220434 - protein, 9 aa, Japanese encephalitis virus
AYKVASNGI

SEQ ID NO: 220435 - protein, 9 aa, Japanese encephalitis virus
YKVASNGIQ

SEQ ID NO: 220436 - protein, 9 aa, Japanese encephalitis virus
KVASNGIQY

SEQ ID NO: 220437 - protein, 9 aa, Japanese encephalitis virus
VASNGIQYT

SEQ ID NO: 220438 - protein, 9 aa, Japanese encephalitis virus
ASNGIQYTD

SEQ ID NO: 220439 - protein, 9 aa, Japanese encephalitis virus
SNGIQYTDR

SEQ ID NO: 220440 - protein, 9 aa, Japanese encephalitis virus
NGIQYTDRK

SEQ ID NO: 220441 - protein, 9 aa, Japanese encephalitis virus
GIQYTDRKW

SEQ ID NO: 220442 - protein, 9 aa, Japanese encephalitis virus
IQYTDRKWC

SEQ ID NO: 220443 - protein, 9 aa, Japanese encephalitis virus
QYTDRKWCF

SEQ ID NO: 220444 - protein, 9 aa, Japanese encephalitis virus
YTDRKWCFD

SEQ ID NO: 220445 - protein, 9 aa, Japanese encephalitis virus
TDRKWCFDG

SEQ ID NO: 220446 - protein, 9 aa, Japanese encephalitis virus
DRKWCFDGP

SEQ ID NO: 220447 - protein, 9 aa, Japanese encephalitis virus
RKWCFDGPR

SEQ ID NO: 220448 - protein, 9 aa, Japanese encephalitis virus
KWCFDGPRT

SEQ ID NO: 220449 - protein, 9 aa, Japanese encephalitis virus
WCFDGPRTN

SEQ ID NO: 220450 - protein, 9 aa, Japanese encephalitis virus
CFDGPRTNA

SEQ ID NO: 220451 - protein, 9 aa, Japanese encephalitis virus
FDGPRTNAI

SEQ ID NO: 220452 - protein, 9 aa, Japanese encephalitis virus
DGPRTNAIL

SEQ ID NO: 220453 - protein, 9 aa, Japanese encephalitis virus
GPRTNAILE

SEQ ID NO: 220454 - protein, 9 aa, Japanese encephalitis virus
PRTNAILED

SEQ ID NO: 220455 - protein, 9 aa, Japanese encephalitis virus
RTNAILEDN

SEQ ID NO: 220456 - protein, 9 aa, Japanese encephalitis virus
TNAILEDNT

SEQ ID NO: 220457 - protein, 9 aa, Japanese encephalitis virus
NAILEDNTE

SEQ ID NO: 220458 - protein, 9 aa, Japanese encephalitis virus
AILEDNTEV

SEQ ID NO: 220459 - protein, 9 aa, Japanese encephalitis virus
ILEDNTEVE

SEQ ID NO: 220460 - protein, 9 aa, Japanese encephalitis virus
LEDNTEVEI

SEQ ID NO: 220461 - protein, 9 aa, Japanese encephalitis virus
EDNTEVEIV

SEQ ID NO: 220462 - protein, 9 aa, Japanese encephalitis virus
DNTEVEIVT

SEQ ID NO: 220463 - protein, 9 aa, Japanese encephalitis virus
NTEVEIVTR

SEQ ID NO: 220464 - protein, 9 aa, Japanese encephalitis virus
TEVEIVTRM

SEQ ID NO: 220465 - protein, 9 aa, Japanese encephalitis virus
EVEIVTRMG

SEQ ID NO: 220466 - protein, 9 aa, Japanese encephalitis virus
VEIVTRMGE

SEQ ID NO: 220467 - protein, 9 aa, Japanese encephalitis virus
EIVTRMGER

SEQ ID NO: 220468 - protein, 9 aa, Japanese encephalitis virus
IVTRMGERK

SEQ ID NO: 220469 - protein, 9 aa, Japanese encephalitis virus
VTRMGERKI

SEQ ID NO: 220470 - protein, 9 aa, Japanese encephalitis virus
TRMGERKIL

SEQ ID NO: 220471 - protein, 9 aa, Japanese encephalitis virus
RMGERKILK

SEQ ID NO: 220472 - protein, 9 aa, Japanese encephalitis virus
MGERKILKP

SEQ ID NO: 220473 - protein, 9 aa, Japanese encephalitis virus
GERKILKPR

SEQ ID NO: 220474 - protein, 9 aa, Japanese encephalitis virus
ERKILKPRW

SEQ ID NO: 220475 - protein, 9 aa, Japanese encephalitis virus
RKILKPRWL

SEQ ID NO: 220476 - protein, 9 aa, Japanese encephalitis virus
KILKPRWLD

SEQ ID NO: 220477 - protein, 9 aa, Japanese encephalitis virus
ILKPRWLDA

SEQ ID NO: 220478 - protein, 9 aa, Japanese encephalitis virus
LKPRWLDAR

SEQ ID NO: 220479 - protein, 9 aa, Japanese encephalitis virus
KPRWLDARV

SEQ ID NO: 220480 - protein, 9 aa, Japanese encephalitis virus
PRWLDARVY

SEQ ID NO: 220481 - protein, 9 aa, Japanese encephalitis virus
RWLDARVYA

SEQ ID NO: 220482 - protein, 9 aa, Japanese encephalitis virus
WLDARVYAD

SEQ ID NO: 220483 - protein, 9 aa, Japanese encephalitis virus
LDARVYADH

SEQ ID NO: 220484 - protein, 9 aa, Japanese encephalitis virus
DARVYADHQ

SEQ ID NO: 220485 - protein, 9 aa, Japanese encephalitis virus
ARVYADHQA

SEQ ID NO: 220486 - protein, 9 aa, Japanese encephalitis virus
RVYADHQAL

SEQ ID NO: 220487 - protein, 9 aa, Japanese encephalitis virus
VYADHQALK

SEQ ID NO: 220488 - protein, 9 aa, Japanese encephalitis virus
YADHQALKW

SEQ ID NO: 220489 - protein, 9 aa, Japanese encephalitis virus
ADHQALKWF

SEQ ID NO: 220490 - protein, 9 aa, Japanese encephalitis virus
DHQALKWFK

SEQ ID NO: 220491 - protein, 9 aa, Japanese encephalitis virus
HQALKWFKD

SEQ ID NO: 220492 - protein, 9 aa, Japanese encephalitis virus
QALKWFKDF

SEQ ID NO: 220493 - protein, 9 aa, Japanese encephalitis virus
ALKWFKDFA

SEQ ID NO: 220494 - protein, 9 aa, Japanese encephalitis virus
LKWFKDFAA

SEQ ID NO: 220495 - protein, 9 aa, Japanese encephalitis virus
KWFKDFAAG

SEQ ID NO: 220496 - protein, 9 aa, Japanese encephalitis virus
WFKDFAAGK

SEQ ID NO: 220497 - protein, 9 aa, Japanese encephalitis virus
FKDFAAGKR

SEQ ID NO: 220498 - protein, 9 aa, Japanese encephalitis virus
KDFAAGKRS

SEQ ID NO: 220499 - protein, 9 aa, Japanese encephalitis virus
DFAAGKRSA

SEQ ID NO: 220500 - protein, 9 aa, Japanese encephalitis virus
FAAGKRSAV

SEQ ID NO: 220501 - protein, 9 aa, Japanese encephalitis virus
AAGKRSAVS

SEQ ID NO: 220502 - protein, 9 aa, Japanese encephalitis virus
AGKRSAVSF

SEQ ID NO: 220503 - protein, 9 aa, Japanese encephalitis virus
GKRSAVSFI

SEQ ID NO: 220504 - protein, 9 aa, Japanese encephalitis virus
KRSAVSFIE

SEQ ID NO: 220505 - protein, 9 aa, Japanese encephalitis virus
RSAVSFIEV

SEQ ID NO: 220506 - protein, 9 aa, Japanese encephalitis virus
SAVSFIEVL

SEQ ID NO: 220507 - protein, 9 aa, Japanese encephalitis virus
AVSFIEVLG

SEQ ID NO: 220508 - protein, 9 aa, Japanese encephalitis virus
VSFIEVLGR

SEQ ID NO: 220509 - protein, 9 aa, Japanese encephalitis virus
SFIEVLGRM

SEQ ID NO: 220510 - protein, 9 aa, Japanese encephalitis virus
FIEVLGRMP

SEQ ID NO: 220511 - protein, 9 aa, Japanese encephalitis virus
IEVLGRMPE

SEQ ID NO: 220512 - protein, 9 aa, Japanese encephalitis virus
EVLGRMPEH

SEQ ID NO: 220513 - protein, 9 aa, Japanese encephalitis virus
VLGRMPEHF

SEQ ID NO: 220514 - protein, 9 aa, Japanese encephalitis virus
LGRMPEHFM

SEQ ID NO: 220515 - protein, 9 aa, Japanese encephalitis virus
GRMPEHFMG

SEQ ID NO: 220516 - protein, 9 aa, Japanese encephalitis virus
RMPEHFMGK

SEQ ID NO: 220517 - protein, 9 aa, Japanese encephalitis virus
MPEHFMGKT

SEQ ID NO: 220518 - protein, 9 aa, Japanese encephalitis virus
PEHFMGKTR

SEQ ID NO: 220519 - protein, 9 aa, Japanese encephalitis virus
EHFMGKTRE

SEQ ID NO: 220520 - protein, 9 aa, Japanese encephalitis virus
HFMGKTREA

SEQ ID NO: 220521 - protein, 9 aa, Japanese encephalitis virus
FMGKTREAL

SEQ ID NO: 220522 - protein, 9 aa, Japanese encephalitis virus
MGKTREALD

SEQ ID NO: 220523 - protein, 9 aa, Japanese encephalitis virus
GKTREALDT

SEQ ID NO: 220524 - protein, 9 aa, Japanese encephalitis virus
KTREALDTM

SEQ ID NO: 220525 - protein, 9 aa, Japanese encephalitis virus
TREALDTMY

SEQ ID NO: 220526 - protein, 9 aa, Japanese encephalitis virus
REALDTMYL

SEQ ID NO: 220527 - protein, 9 aa, Japanese encephalitis virus
EALDTMYLV

SEQ ID NO: 220528 - protein, 9 aa, Japanese encephalitis virus
ALDTMYLVA

SEQ ID NO: 220529 - protein, 9 aa, Japanese encephalitis virus
LDTMYLVAT

SEQ ID NO: 220530 - protein, 9 aa, Japanese encephalitis virus
DTMYLVATA

SEQ ID NO: 220531 - protein, 9 aa, Japanese encephalitis virus
TMYLVATAE

SEQ ID NO: 220532 - protein, 9 aa, Japanese encephalitis virus
MYLVATAEK

SEQ ID NO: 220533 - protein, 9 aa, Japanese encephalitis virus
YLVATAEKG

SEQ ID NO: 220534 - protein, 9 aa, Japanese encephalitis virus
LVATAEKGG

SEQ ID NO: 220535 - protein, 9 aa, Japanese encephalitis virus
VATAEKGGK

SEQ ID NO: 220536 - protein, 9 aa, Japanese encephalitis virus
ATAEKGGKA

SEQ ID NO: 220537 - protein, 9 aa, Japanese encephalitis virus
TAEKGGKAH

SEQ ID NO: 220538 - protein, 9 aa, Japanese encephalitis virus
AEKGGKAHR

SEQ ID NO: 220539 - protein, 9 aa, Japanese encephalitis virus
EKGGKAHRM

SEQ ID NO: 220540 - protein, 9 aa, Japanese encephalitis virus
KGGKAHRMA

SEQ ID NO: 220541 - protein, 9 aa, Japanese encephalitis virus
GGKAHRMAL

SEQ ID NO: 220542 - protein, 9 aa, Japanese encephalitis virus
GKAHRMALE

SEQ ID NO: 220543 - protein, 9 aa, Japanese encephalitis virus
KAHRMALEE

SEQ ID NO: 220544 - protein, 9 aa, Japanese encephalitis virus
AHRMALEEL

SEQ ID NO: 220545 - protein, 9 aa, Japanese encephalitis virus
HRMALEELP

SEQ ID NO: 220546 - protein, 9 aa, Japanese encephalitis virus
RMALEELPD

SEQ ID NO: 220547 - protein, 9 aa, Japanese encephalitis virus
MALEELPDA

SEQ ID NO: 220548 - protein, 9 aa, Japanese encephalitis virus
ALEELPDAL

SEQ ID NO: 220549 - protein, 9 aa, Japanese encephalitis virus
LEELPDALE

SEQ ID NO: 220550 - protein, 9 aa, Japanese encephalitis virus
EELPDALET

SEQ ID NO: 220551 - protein, 9 aa, Japanese encephalitis virus
ELPDALETI

SEQ ID NO: 220552 - protein, 9 aa, Japanese encephalitis virus
LPDALETIT

SEQ ID NO: 220553 - protein, 9 aa, Japanese encephalitis virus
PDALETITL

SEQ ID NO: 220554 - protein, 9 aa, Japanese encephalitis virus
DALETITLI

SEQ ID NO: 220555 - protein, 9 aa, Japanese encephalitis virus
ALETITLIV

SEQ ID NO: 220556 - protein, 9 aa, Japanese encephalitis virus
LETITLIVA

SEQ ID NO: 220557 - protein, 9 aa, Japanese encephalitis virus
ETITLIVAI

SEQ ID NO: 220558 - protein, 9 aa, Japanese encephalitis virus
AITVMTGGF

SEQ ID NO: 220559 - protein, 9 aa, Japanese encephalitis virus
ITVMTGGFF

SEQ ID NO: 220560 - protein, 9 aa, Japanese encephalitis virus
TVMTGGFFL

SEQ ID NO: 220561 - protein, 9 aa, Japanese encephalitis virus
VMTGGFFLL

SEQ ID NO: 220562 - protein, 9 aa, Japanese encephalitis virus
MTGGFFLLM

SEQ ID NO: 220563 - protein, 9 aa, Japanese encephalitis virus
TGGFFLLMM

SEQ ID NO: 220564 - protein, 9 aa, Japanese encephalitis virus
GGFFLLMMQ

SEQ ID NO: 220565 - protein, 9 aa, Japanese encephalitis virus
GFFLLMMQR

SEQ ID NO: 220566 - protein, 9 aa, Japanese encephalitis virus
FFLLMMQRK

SEQ ID NO: 220567 - protein, 9 aa, Japanese encephalitis virus
FLLMMQRKG

SEQ ID NO: 220568 - protein, 9 aa, Japanese encephalitis virus
LLMMQRKGI

SEQ ID NO: 220569 - protein, 9 aa, Japanese encephalitis virus
LMMQRKGIG

SEQ ID NO: 220570 - protein, 9 aa, Japanese encephalitis virus
MMQRKGIGK

SEQ ID NO: 220571 - protein, 9 aa, Japanese encephalitis virus
MQRKGIGKM

SEQ ID NO: 220572 - protein, 9 aa, Japanese encephalitis virus
QRKGIGKMG

SEQ ID NO: 220573 - protein, 9 aa, Japanese encephalitis virus
RKGIGKMGL

SEQ ID NO: 220574 - protein, 9 aa, Japanese encephalitis virus
KGIGKMGLG

SEQ ID NO: 220575 - protein, 9 aa, Japanese encephalitis virus
GIGKMGLGA

SEQ ID NO: 220576 - protein, 9 aa, Japanese encephalitis virus
IGKMGLGAL

SEQ ID NO: 220577 - protein, 9 aa, Japanese encephalitis virus
GKMGLGALV

SEQ ID NO: 220578 - protein, 9 aa, Japanese encephalitis virus
KMGLGALVL

SEQ ID NO: 220579 - protein, 9 aa, Japanese encephalitis virus
MGLGALVLT

SEQ ID NO: 220580 - protein, 9 aa, Japanese encephalitis virus
GLGALVLTL

SEQ ID NO: 220581 - protein, 9 aa, Japanese encephalitis virus
LGALVLTLA

SEQ ID NO: 220582 - protein, 9 aa, Japanese encephalitis virus
GALVLTLAT

SEQ ID NO: 220583 - protein, 9 aa, Japanese encephalitis virus
ALVLTLATF

SEQ ID NO: 220584 - protein, 9 aa, Japanese encephalitis virus
LVLTLATFF

SEQ ID NO: 220585 - protein, 9 aa, Japanese encephalitis virus
VLTLATFFL

SEQ ID NO: 220586 - protein, 9 aa, Japanese encephalitis virus
LTLATFFLW

SEQ ID NO: 220587 - protein, 9 aa, Japanese encephalitis virus
TLATFFLWA

SEQ ID NO: 220588 - protein, 9 aa, Japanese encephalitis virus
LATFFLWAA

SEQ ID NO: 220589 - protein, 9 aa, Japanese encephalitis virus
ATFFLWAAE

SEQ ID NO: 220590 - protein, 9 aa, Japanese encephalitis virus
TFFLWAAEV

SEQ ID NO: 220591 - protein, 9 aa, Japanese encephalitis virus
FFLWAAEVP

SEQ ID NO: 220592 - protein, 9 aa, Japanese encephalitis virus
FLWAAEVPG

SEQ ID NO: 220593 - protein, 9 aa, Japanese encephalitis virus
LWAAEVPGT

SEQ ID NO: 220594 - protein, 9 aa, Japanese encephalitis virus
WAAEVPGTK

SEQ ID NO: 220595 - protein, 9 aa, Japanese encephalitis virus
AAEVPGTKI

SEQ ID NO: 220596 - protein, 9 aa, Japanese encephalitis virus
AEVPGTKIA

SEQ ID NO: 220597 - protein, 9 aa, Japanese encephalitis virus
EVPGTKIAG

SEQ ID NO: 220598 - protein, 9 aa, Japanese encephalitis virus
VPGTKIAGT

SEQ ID NO: 220599 - protein, 9 aa, Japanese encephalitis virus
PGTKIAGTL

SEQ ID NO: 220600 - protein, 9 aa, Japanese encephalitis virus
GTKIAGTLL

SEQ ID NO: 220601 - protein, 9 aa, Japanese encephalitis virus
TKIAGTLLI

SEQ ID NO: 220602 - protein, 9 aa, Japanese encephalitis virus
KIAGTLLIA

SEQ ID NO: 220603 - protein, 9 aa, Japanese encephalitis virus
IAGTLLIAL

SEQ ID NO: 220604 - protein, 9 aa, Japanese encephalitis virus
AGTLLIALL

SEQ ID NO: 220605 - protein, 9 aa, Japanese encephalitis virus
GTLLIALLL

SEQ ID NO: 220606 - protein, 9 aa, Japanese encephalitis virus
TLLIALLLM

SEQ ID NO: 220607 - protein, 9 aa, Japanese encephalitis virus
LLIALLLMV

SEQ ID NO: 220608 - protein, 9 aa, Japanese encephalitis virus
LIALLLMVV

SEQ ID NO: 220609 - protein, 9 aa, Japanese encephalitis virus
IALLLMVVL

SEQ ID NO: 220610 - protein, 9 aa, Japanese encephalitis virus
ALLLMVVLI

SEQ ID NO: 220611 - protein, 9 aa, Japanese encephalitis virus
LLLMVVLIP

SEQ ID NO: 220612 - protein, 9 aa, Japanese encephalitis virus
LLMVVLIPE

SEQ ID NO: 220613 - protein, 9 aa, Japanese encephalitis virus
LMVVLIPEP

SEQ ID NO: 220614 - protein, 9 aa, Japanese encephalitis virus
MVVLIPEPE

SEQ ID NO: 220615 - protein, 9 aa, Japanese encephalitis virus
VVLIPEPEK

SEQ ID NO: 220616 - protein, 9 aa, Japanese encephalitis virus
VLIPEPEKQ

SEQ ID NO: 220617 - protein, 9 aa, Japanese encephalitis virus
LIPEPEKQR

SEQ ID NO: 220618 - protein, 9 aa, Japanese encephalitis virus
IPEPEKQRS

SEQ ID NO: 220619 - protein, 9 aa, Japanese encephalitis virus
PEPEKQRSQ

SEQ ID NO: 220620 - protein, 9 aa, Japanese encephalitis virus
EPEKQRSQT

SEQ ID NO: 220621 - protein, 9 aa, Japanese encephalitis virus
PEKQRSQTD

SEQ ID NO: 220622 - protein, 9 aa, Japanese encephalitis virus
EKQRSQTDN

SEQ ID NO: 220623 - protein, 9 aa, Japanese encephalitis virus
KQRSQTDNQ

SEQ ID NO: 220624 - protein, 9 aa, Japanese encephalitis virus
QRSQTDNQL

SEQ ID NO: 220625 - protein, 9 aa, Japanese encephalitis virus
RSQTDNQLA

SEQ ID NO: 220626 - protein, 9 aa, Japanese encephalitis virus
SQTDNQLAV

SEQ ID NO: 220627 - protein, 9 aa, Japanese encephalitis virus
QTDNQLAVF

SEQ ID NO: 220628 - protein, 9 aa, Japanese encephalitis virus
TDNQLAVFL

SEQ ID NO: 220629 - protein, 9 aa, Japanese encephalitis virus
DNQLAVFLI

SEQ ID NO: 220630 - protein, 9 aa, Japanese encephalitis virus
NQLAVFLIC

SEQ ID NO: 220631 - protein, 9 aa, Japanese encephalitis virus
QLAVFLICV

SEQ ID NO: 220632 - protein, 9 aa, Japanese encephalitis virus
LAVFLICVL

SEQ ID NO: 220633 - protein, 9 aa, Japanese encephalitis virus
AVFLICVLT

SEQ ID NO: 220634 - protein, 9 aa, Japanese encephalitis virus
VFLICVLTV

SEQ ID NO: 220635 - protein, 9 aa, Japanese encephalitis virus
FLICVLTVV

SEQ ID NO: 220636 - protein, 9 aa, Japanese encephalitis virus
LICVLTVVG

SEQ ID NO: 220637 - protein, 9 aa, Japanese encephalitis virus
ICVLTVVGV

SEQ ID NO: 220638 - protein, 9 aa, Japanese encephalitis virus
CVLTVVGVV

SEQ ID NO: 220639 - protein, 9 aa, Japanese encephalitis virus
VLTVVGVVA

SEQ ID NO: 220640 - protein, 9 aa, Japanese encephalitis virus
LTVVGVVAA

SEQ ID NO: 220641 - protein, 9 aa, Japanese encephalitis virus
TVVGVVAAN

SEQ ID NO: 220642 - protein, 9 aa, Japanese encephalitis virus
VVGVVAANE

SEQ ID NO: 220643 - protein, 9 aa, Japanese encephalitis virus
VGVVAANEY

SEQ ID NO: 220644 - protein, 9 aa, Japanese encephalitis virus
GVVAANEYG

SEQ ID NO: 220645 - protein, 9 aa, Japanese encephalitis virus
VVAANEYGM

SEQ ID NO: 220646 - protein, 9 aa, Japanese encephalitis virus
VAANEYGML

SEQ ID NO: 220647 - protein, 9 aa, Japanese encephalitis virus
AANEYGMLE

SEQ ID NO: 220648 - protein, 9 aa, Japanese encephalitis virus
ANEYGMLEK

SEQ ID NO: 220649 - protein, 9 aa, Japanese encephalitis virus
NEYGMLEKT

SEQ ID NO: 220650 - protein, 9 aa, Japanese encephalitis virus
EYGMLEKTK

SEQ ID NO: 220651 - protein, 9 aa, Japanese encephalitis virus
YGMLEKTKA

SEQ ID NO: 220652 - protein, 9 aa, Japanese encephalitis virus
GMLEKTKAD

SEQ ID NO: 220653 - protein, 9 aa, Japanese encephalitis virus
MLEKTKADL

SEQ ID NO: 220654 - protein, 9 aa, Japanese encephalitis virus
LEKTKADLK

SEQ ID NO: 220655 - protein, 9 aa, Japanese encephalitis virus
EKTKADLKS

SEQ ID NO: 220656 - protein, 9 aa, Japanese encephalitis virus
KTKADLKSM

SEQ ID NO: 220657 - protein, 9 aa, Japanese encephalitis virus
TKADLKSMF

SEQ ID NO: 220658 - protein, 9 aa, Japanese encephalitis virus
KADLKSMFG

SEQ ID NO: 220659 - protein, 9 aa, Japanese encephalitis virus
ADLKSMFGG

SEQ ID NO: 220660 - protein, 9 aa, Japanese encephalitis virus
DLKSMFGGK

SEQ ID NO: 220661 - protein, 9 aa, Japanese encephalitis virus
KSMFGGKTQ

SEQ ID NO: 220662 - protein, 9 aa, Japanese encephalitis virus
SMFGGKTQA

SEQ ID NO: 220663 - protein, 9 aa, Japanese encephalitis virus
TQASGLTGL

SEQ ID NO: 220664 - protein, 9 aa, Japanese encephalitis virus
QASGLTGLP

SEQ ID NO: 220665 - protein, 9 aa, Japanese encephalitis virus
ASGLTGLPS

SEQ ID NO: 220666 - protein, 9 aa, Japanese encephalitis virus
SGLTGLPSM

SEQ ID NO: 220667 - protein, 9 aa, Japanese encephalitis virus
GLTGLPSMA

SEQ ID NO: 220668 - protein, 9 aa, Japanese encephalitis virus
LTGLPSMAL

SEQ ID NO: 220669 - protein, 9 aa, Japanese encephalitis virus
TGLPSMALD

SEQ ID NO: 220670 - protein, 9 aa, Japanese encephalitis virus
GLPSMALDL

SEQ ID NO: 220671 - protein, 9 aa, Japanese encephalitis virus
LPSMALDLR

SEQ ID NO: 220672 - protein, 9 aa, Japanese encephalitis virus
PSMALDLRP

SEQ ID NO: 220673 - protein, 9 aa, Japanese encephalitis virus
SMALDLRPA

SEQ ID NO: 220674 - protein, 9 aa, Japanese encephalitis virus
MALDLRPAT

SEQ ID NO: 220675 - protein, 9 aa, Japanese encephalitis virus
ALDLRPATA

SEQ ID NO: 220676 - protein, 9 aa, Japanese encephalitis virus
LDLRPATAW

SEQ ID NO: 220677 - protein, 9 aa, Japanese encephalitis virus
DLRPATAWA

SEQ ID NO: 220678 - protein, 9 aa, Japanese encephalitis virus
LRPATAWAL

SEQ ID NO: 220679 - protein, 9 aa, Japanese encephalitis virus
RPATAWALY

SEQ ID NO: 220680 - protein, 9 aa, Japanese encephalitis virus
PATAWALYG

SEQ ID NO: 220681 - protein, 9 aa, Japanese encephalitis virus
ATAWALYGG

SEQ ID NO: 220682 - protein, 9 aa, Japanese encephalitis virus
TAWALYGGS

SEQ ID NO: 220683 - protein, 9 aa, Japanese encephalitis virus
AWALYGGST

SEQ ID NO: 220684 - protein, 9 aa, Japanese encephalitis virus
WALYGGSTV

SEQ ID NO: 220685 - protein, 9 aa, Japanese encephalitis virus
ALYGGSTVV

SEQ ID NO: 220686 - protein, 9 aa, Japanese encephalitis virus
LYGGSTVVL

SEQ ID NO: 220687 - protein, 9 aa, Japanese encephalitis virus
YGGSTVVLT

SEQ ID NO: 220688 - protein, 9 aa, Japanese encephalitis virus
GGSTVVLTP

SEQ ID NO: 220689 - protein, 9 aa, Japanese encephalitis virus
GSTVVLTPL

SEQ ID NO: 220690 - protein, 9 aa, Japanese encephalitis virus
STVVLTPLL

SEQ ID NO: 220691 - protein, 9 aa, Japanese encephalitis virus
TVVLTPLLK

SEQ ID NO: 220692 - protein, 9 aa, Japanese encephalitis virus
VVLTPLLKH

SEQ ID NO: 220693 - protein, 9 aa, Japanese encephalitis virus
VLTPLLKHL

SEQ ID NO: 220694 - protein, 9 aa, Japanese encephalitis virus
LTPLLKHLI

SEQ ID NO: 220695 - protein, 9 aa, Japanese encephalitis virus
TPLLKHLIT

SEQ ID NO: 220696 - protein, 9 aa, Japanese encephalitis virus
PLLKHLITS

SEQ ID NO: 220697 - protein, 9 aa, Japanese encephalitis virus
LLKHLITSE

SEQ ID NO: 220698 - protein, 9 aa, Japanese encephalitis virus
LKHLITSEY

SEQ ID NO: 220699 - protein, 9 aa, Japanese encephalitis virus
KHLITSEYV

SEQ ID NO: 220700 - protein, 9 aa, Japanese encephalitis virus
HLITSEYVT

SEQ ID NO: 220701 - protein, 9 aa, Japanese encephalitis virus
LITSEYVTT

SEQ ID NO: 220702 - protein, 9 aa, Japanese encephalitis virus
ITSEYVTTS

SEQ ID NO: 220703 - protein, 9 aa, Japanese encephalitis virus
TSEYVTTSL

SEQ ID NO: 220704 - protein, 9 aa, Japanese encephalitis virus
SEYVTTSLA

SEQ ID NO: 220705 - protein, 9 aa, Japanese encephalitis virus
EYVTTSLAS

SEQ ID NO: 220706 - protein, 9 aa, Japanese encephalitis virus
YVTTSLASI

SEQ ID NO: 220707 - protein, 9 aa, Japanese encephalitis virus
VTTSLASIN

SEQ ID NO: 220708 - protein, 9 aa, Japanese encephalitis virus
TTSLASINS

SEQ ID NO: 220709 - protein, 9 aa, Japanese encephalitis virus
TSLASINSQ

SEQ ID NO: 220710 - protein, 9 aa, Japanese encephalitis virus
SLASINSQA

SEQ ID NO: 220711 - protein, 9 aa, Japanese encephalitis virus
LASINSQAG

SEQ ID NO: 220712 - protein, 9 aa, Japanese encephalitis virus
ASINSQAGS

SEQ ID NO: 220713 - protein, 9 aa, Japanese encephalitis virus
SINSQAGSL

SEQ ID NO: 220714 - protein, 9 aa, Japanese encephalitis virus
INSQAGSLF

SEQ ID NO: 220715 - protein, 9 aa, Japanese encephalitis virus
NSQAGSLFV

SEQ ID NO: 220716 - protein, 9 aa, Japanese encephalitis virus
SQAGSLFVL

SEQ ID NO: 220717 - protein, 9 aa, Japanese encephalitis virus
QAGSLFVLP

SEQ ID NO: 220718 - protein, 9 aa, Japanese encephalitis virus
AGSLFVLPR

SEQ ID NO: 220719 - protein, 9 aa, Japanese encephalitis virus
GSLFVLPRG

SEQ ID NO: 220720 - protein, 9 aa, Japanese encephalitis virus
SLFVLPRGV

SEQ ID NO: 220721 - protein, 9 aa, Japanese encephalitis virus
LFVLPRGVP

SEQ ID NO: 220722 - protein, 9 aa, Japanese encephalitis virus
FVLPRGVPF

SEQ ID NO: 220723 - protein, 9 aa, Japanese encephalitis virus
VLPRGVPFT

SEQ ID NO: 220724 - protein, 9 aa, Japanese encephalitis virus
LPRGVPFTD

SEQ ID NO: 220725 - protein, 9 aa, Japanese encephalitis virus
PRGVPFTDL

SEQ ID NO: 220726 - protein, 9 aa, Japanese encephalitis virus
RGVPFTDLD

SEQ ID NO: 220727 - protein, 9 aa, Japanese encephalitis virus
GVPFTDLDL

SEQ ID NO: 220728 - protein, 9 aa, Japanese encephalitis virus
VPFTDLDLT

SEQ ID NO: 220729 - protein, 9 aa, Japanese encephalitis virus
PFTDLDLTV

SEQ ID NO: 220730 - protein, 9 aa, Japanese encephalitis virus
FTDLDLTVG

SEQ ID NO: 220731 - protein, 9 aa, Japanese encephalitis virus
TDLDLTVGL

SEQ ID NO: 220732 - protein, 9 aa, Japanese encephalitis virus
DLDLTVGLV

SEQ ID NO: 220733 - protein, 9 aa, Japanese encephalitis virus
LDLTVGLVF

SEQ ID NO: 220734 - protein, 9 aa, Japanese encephalitis virus
DLTVGLVFL

SEQ ID NO: 220735 - protein, 9 aa, Japanese encephalitis virus
LTVGLVFLG

SEQ ID NO: 220736 - protein, 9 aa, Japanese encephalitis virus
TVGLVFLGC

SEQ ID NO: 220737 - protein, 9 aa, Japanese encephalitis virus
VGLVFLGCW

SEQ ID NO: 220738 - protein, 9 aa, Japanese encephalitis virus
GLVFLGCWG

SEQ ID NO: 220739 - protein, 9 aa, Japanese encephalitis virus
LVFLGCWGQ

SEQ ID NO: 220740 - protein, 9 aa, Japanese encephalitis virus
VFLGCWGQI

SEQ ID NO: 220741 - protein, 9 aa, Japanese encephalitis virus
FLGCWGQIT

SEQ ID NO: 220742 - protein, 9 aa, Japanese encephalitis virus
LGCWGQITL

SEQ ID NO: 220743 - protein, 9 aa, Japanese encephalitis virus
GCWGQITLT

SEQ ID NO: 220744 - protein, 9 aa, Japanese encephalitis virus
CWGQITLTT

SEQ ID NO: 220745 - protein, 9 aa, Japanese encephalitis virus
WGQITLTTF

SEQ ID NO: 220746 - protein, 9 aa, Japanese encephalitis virus
GQITLTTFL

SEQ ID NO: 220747 - protein, 9 aa, Japanese encephalitis virus
QITLTTFLT

SEQ ID NO: 220748 - protein, 9 aa, Japanese encephalitis virus
ITLTTFLTA

SEQ ID NO: 220749 - protein, 9 aa, Japanese encephalitis virus
TLTTFLTAM

SEQ ID NO: 220750 - protein, 9 aa, Japanese encephalitis virus
LTTFLTAMV

SEQ ID NO: 220751 - protein, 9 aa, Japanese encephalitis virus
TTFLTAMVL

SEQ ID NO: 220752 - protein, 9 aa, Japanese encephalitis virus
LTAMVLATL

SEQ ID NO: 220753 - protein, 9 aa, Japanese encephalitis virus
TAMVLATLH

SEQ ID NO: 220754 - protein, 9 aa, Japanese encephalitis virus
AMVLATLHY

SEQ ID NO: 220755 - protein, 9 aa, Japanese encephalitis virus
MVLATLHYG

SEQ ID NO: 220756 - protein, 9 aa, Japanese encephalitis virus
VLATLHYGY

SEQ ID NO: 220757 - protein, 9 aa, Japanese encephalitis virus
LATLHYGYM

SEQ ID NO: 220758 - protein, 9 aa, Japanese encephalitis virus
ATLHYGYML

SEQ ID NO: 220759 - protein, 9 aa, Japanese encephalitis virus
TLHYGYMLP

SEQ ID NO: 220760 - protein, 9 aa, Japanese encephalitis virus
LHYGYMLPG

SEQ ID NO: 220761 - protein, 9 aa, Japanese encephalitis virus
HYGYMLPGW

SEQ ID NO: 220762 - protein, 9 aa, Japanese encephalitis virus
YGYMLPGWQ

SEQ ID NO: 220763 - protein, 9 aa, Japanese encephalitis virus
GYMLPGWQA

SEQ ID NO: 220764 - protein, 9 aa, Japanese encephalitis virus
YMLPGWQAE

SEQ ID NO: 220765 - protein, 9 aa, Japanese encephalitis virus
MLPGWQAEA

SEQ ID NO: 220766 - protein, 9 aa, Japanese encephalitis virus
LPGWQAEAL

SEQ ID NO: 220767 - protein, 9 aa, Japanese encephalitis virus
PGWQAEALR

SEQ ID NO: 220768 - protein, 9 aa, Japanese encephalitis virus
GWQAEALRA

SEQ ID NO: 220769 - protein, 9 aa, Japanese encephalitis virus
WQAEALRAA

SEQ ID NO: 220770 - protein, 9 aa, Japanese encephalitis virus
QAEALRAAQ

SEQ ID NO: 220771 - protein, 9 aa, Japanese encephalitis virus
AEALRAAQR

SEQ ID NO: 220772 - protein, 9 aa, Japanese encephalitis virus
EALRAAQRR

SEQ ID NO: 220773 - protein, 9 aa, Japanese encephalitis virus
ALRAAQRRT

SEQ ID NO: 220774 - protein, 9 aa, Japanese encephalitis virus
LRAAQRRTA

SEQ ID NO: 220775 - protein, 9 aa, Japanese encephalitis virus
RAAQRRTAA

SEQ ID NO: 220776 - protein, 9 aa, Japanese encephalitis virus
AAQRRTAAG

SEQ ID NO: 220777 - protein, 9 aa, Japanese encephalitis virus
AQRRTAAGI

SEQ ID NO: 220778 - protein, 9 aa, Japanese encephalitis virus
QRRTAAGIM

SEQ ID NO: 220779 - protein, 9 aa, Japanese encephalitis virus
RRTAAGIMK

SEQ ID NO: 220780 - protein, 9 aa, Japanese encephalitis virus
RTAAGIMKN

SEQ ID NO: 220781 - protein, 9 aa, Japanese encephalitis virus
TAAGIMKNA

SEQ ID NO: 220782 - protein, 9 aa, Japanese encephalitis virus
AAGIMKNAV

SEQ ID NO: 220783 - protein, 9 aa, Japanese encephalitis virus
AGIMKNAVV

SEQ ID NO: 220784 - protein, 9 aa, Japanese encephalitis virus
GIMKNAVVD

SEQ ID NO: 220785 - protein, 9 aa, Japanese encephalitis virus
IMKNAVVDG

SEQ ID NO: 220786 - protein, 9 aa, Japanese encephalitis virus
MKNAVVDGM

SEQ ID NO: 220787 - protein, 9 aa, Japanese encephalitis virus
KNAVVDGMV

SEQ ID NO: 220788 - protein, 9 aa, Japanese encephalitis virus
NAVVDGMVA

SEQ ID NO: 220789 - protein, 9 aa, Japanese encephalitis virus
AVVDGMVAT

SEQ ID NO: 220790 - protein, 9 aa, Japanese encephalitis virus
VVDGMVATD

SEQ ID NO: 220791 - protein, 9 aa, Japanese encephalitis virus
VDGMVATDV

SEQ ID NO: 220792 - protein, 9 aa, Japanese encephalitis virus
DGMVATDVP

SEQ ID NO: 220793 - protein, 9 aa, Japanese encephalitis virus
GMVATDVPE

SEQ ID NO: 220794 - protein, 9 aa, Japanese encephalitis virus
MVATDVPEL

SEQ ID NO: 220795 - protein, 9 aa, Japanese encephalitis virus
VATDVPELE

SEQ ID NO: 220796 - protein, 9 aa, Japanese encephalitis virus
ATDVPELER

SEQ ID NO: 220797 - protein, 9 aa, Japanese encephalitis virus
TDVPELERT

SEQ ID NO: 220798 - protein, 9 aa, Japanese encephalitis virus
DVPELERTT

SEQ ID NO: 220799 - protein, 9 aa, Japanese encephalitis virus
VPELERTTP

SEQ ID NO: 220800 - protein, 9 aa, Japanese encephalitis virus
PELERTTPL

SEQ ID NO: 220801 - protein, 9 aa, Japanese encephalitis virus
ELERTTPLM

SEQ ID NO: 220802 - protein, 9 aa, Japanese encephalitis virus
LERTTPLMQ

SEQ ID NO: 220803 - protein, 9 aa, Japanese encephalitis virus
ERTTPLMQK

SEQ ID NO: 220804 - protein, 9 aa, Japanese encephalitis virus
RTTPLMQKK

SEQ ID NO: 220805 - protein, 9 aa, Japanese encephalitis virus
TTPLMQKKV

SEQ ID NO: 220806 - protein, 9 aa, Japanese encephalitis virus
TPLMQKKVG

SEQ ID NO: 220807 - protein, 9 aa, Japanese encephalitis virus
PLMQKKVGQ

SEQ ID NO: 220808 - protein, 9 aa, Japanese encephalitis virus
LMQKKVGQV

SEQ ID NO: 220809 - protein, 9 aa, Japanese encephalitis virus
MQKKVGQVL

SEQ ID NO: 220810 - protein, 9 aa, Japanese encephalitis virus
QKKVGQVLL

SEQ ID NO: 220811 - protein, 9 aa, Japanese encephalitis virus
KKVGQVLLI

SEQ ID NO: 220812 - protein, 9 aa, Japanese encephalitis virus
KVGQVLLIG

SEQ ID NO: 220813 - protein, 9 aa, Japanese encephalitis virus
VGQVLLIGV

SEQ ID NO: 220814 - protein, 9 aa, Japanese encephalitis virus
GQVLLIGVS

SEQ ID NO: 220815 - protein, 9 aa, Japanese encephalitis virus
QVLLIGVSV

SEQ ID NO: 220816 - protein, 9 aa, Japanese encephalitis virus
VLLIGVSVA

SEQ ID NO: 220817 - protein, 9 aa, Japanese encephalitis virus
LLIGVSVAA

SEQ ID NO: 220818 - protein, 9 aa, Japanese encephalitis virus
LIGVSVAAF

SEQ ID NO: 220819 - protein, 9 aa, Japanese encephalitis virus
IGVSVAAFL

SEQ ID NO: 220820 - protein, 9 aa, Japanese encephalitis virus
GVSVAAFLV

SEQ ID NO: 220821 - protein, 9 aa, Japanese encephalitis virus
VSVAAFLVN

SEQ ID NO: 220822 - protein, 9 aa, Japanese encephalitis virus
SVAAFLVNP

SEQ ID NO: 220823 - protein, 9 aa, Japanese encephalitis virus
VAAFLVNPN

SEQ ID NO: 220824 - protein, 9 aa, Japanese encephalitis virus
AAFLVNPNV

SEQ ID NO: 220825 - protein, 9 aa, Japanese encephalitis virus
AFLVNPNVT

SEQ ID NO: 220826 - protein, 9 aa, Japanese encephalitis virus
FLVNPNVTT

SEQ ID NO: 220827 - protein, 9 aa, Japanese encephalitis virus
LVNPNVTTV

SEQ ID NO: 220828 - protein, 9 aa, Japanese encephalitis virus
VNPNVTTVR

SEQ ID NO: 220829 - protein, 9 aa, Japanese encephalitis virus
NPNVTTVRE

SEQ ID NO: 220830 - protein, 9 aa, Japanese encephalitis virus
PNVTTVREA

SEQ ID NO: 220831 - protein, 9 aa, Japanese encephalitis virus
NVTTVREAG

SEQ ID NO: 220832 - protein, 9 aa, Japanese encephalitis virus
VTTVREAGV

SEQ ID NO: 220833 - protein, 9 aa, Japanese encephalitis virus
TTVREAGVL

SEQ ID NO: 220834 - protein, 9 aa, Japanese encephalitis virus
TVREAGVLV

SEQ ID NO: 220835 - protein, 9 aa, Japanese encephalitis virus
VREAGVLVT

SEQ ID NO: 220836 - protein, 9 aa, Japanese encephalitis virus
REAGVLVTA

SEQ ID NO: 220837 - protein, 9 aa, Japanese encephalitis virus
EAGVLVTAA

SEQ ID NO: 220838 - protein, 9 aa, Japanese encephalitis virus
AGVLVTAAT

SEQ ID NO: 220839 - protein, 9 aa, Japanese encephalitis virus
GVLVTAATL

SEQ ID NO: 220840 - protein, 9 aa, Japanese encephalitis virus
VLVTAATLT

SEQ ID NO: 220841 - protein, 9 aa, Japanese encephalitis virus
LVTAATLTL

SEQ ID NO: 220842 - protein, 9 aa, Japanese encephalitis virus
VTAATLTLW

SEQ ID NO: 220843 - protein, 9 aa, Japanese encephalitis virus
TAATLTLWD

SEQ ID NO: 220844 - protein, 9 aa, Japanese encephalitis virus
AATLTLWDN

SEQ ID NO: 220845 - protein, 9 aa, Japanese encephalitis virus
ATLTLWDNG

SEQ ID NO: 220846 - protein, 9 aa, Japanese encephalitis virus
TLTLWDNGA

SEQ ID NO: 220847 - protein, 9 aa, Japanese encephalitis virus
LTLWDNGAS

SEQ ID NO: 220848 - protein, 9 aa, Japanese encephalitis virus
TLWDNGASA

SEQ ID NO: 220849 - protein, 9 aa, Japanese encephalitis virus
LWDNGASAV

SEQ ID NO: 220850 - protein, 9 aa, Japanese encephalitis virus
WDNGASAVW

SEQ ID NO: 220851 - protein, 9 aa, Japanese encephalitis virus
DNGASAVWN

SEQ ID NO: 220852 - protein, 9 aa, Japanese encephalitis virus
NGASAVWNS

SEQ ID NO: 220853 - protein, 9 aa, Japanese encephalitis virus
GASAVWNST

SEQ ID NO: 220854 - protein, 9 aa, Japanese encephalitis virus
ASAVWNSTT

SEQ ID NO: 220855 - protein, 9 aa, Japanese encephalitis virus
SAVWNSTTA

SEQ ID NO: 220856 - protein, 9 aa, Japanese encephalitis virus
AVWNSTTAT

SEQ ID NO: 220857 - protein, 9 aa, Japanese encephalitis virus
VWNSTTATG

SEQ ID NO: 220858 - protein, 9 aa, Japanese encephalitis virus
WNSTTATGL

SEQ ID NO: 220859 - protein, 9 aa, Japanese encephalitis virus
NSTTATGLC

SEQ ID NO: 220860 - protein, 9 aa, Japanese encephalitis virus
STTATGLCH

SEQ ID NO: 220861 - protein, 9 aa, Japanese encephalitis virus
TTATGLCHV

SEQ ID NO: 220862 - protein, 9 aa, Japanese encephalitis virus
TATGLCHVM

SEQ ID NO: 220863 - protein, 9 aa, Japanese encephalitis virus
ATGLCHVMR

SEQ ID NO: 220864 - protein, 9 aa, Japanese encephalitis virus
TGLCHVMRG

SEQ ID NO: 220865 - protein, 9 aa, Japanese encephalitis virus
GLCHVMRGS

SEQ ID NO: 220866 - protein, 9 aa, Japanese encephalitis virus
LCHVMRGSY

SEQ ID NO: 220867 - protein, 9 aa, Japanese encephalitis virus
CHVMRGSYL

SEQ ID NO: 220868 - protein, 9 aa, Japanese encephalitis virus
HVMRGSYLA

SEQ ID NO: 220869 - protein, 9 aa, Japanese encephalitis virus
VMRGSYLAG

SEQ ID NO: 220870 - protein, 9 aa, Japanese encephalitis virus
MRGSYLAGG

SEQ ID NO: 220871 - protein, 9 aa, Japanese encephalitis virus
RGSYLAGGS

SEQ ID NO: 220872 - protein, 9 aa, Japanese encephalitis virus
GSYLAGGSI

SEQ ID NO: 220873 - protein, 9 aa, Japanese encephalitis virus
SYLAGGSIA

SEQ ID NO: 220874 - protein, 9 aa, Japanese encephalitis virus
YLAGGSIAW

SEQ ID NO: 220875 - protein, 9 aa, Japanese encephalitis virus
LAGGSIAWT

SEQ ID NO: 220876 - protein, 9 aa, Japanese encephalitis virus
AGGSIAWTL

SEQ ID NO: 220877 - protein, 9 aa, Japanese encephalitis virus
GGSIAWTLI

SEQ ID NO: 220878 - protein, 9 aa, Japanese encephalitis virus
GSIAWTLIK

SEQ ID NO: 220879 - protein, 9 aa, Japanese encephalitis virus
SIAWTLIKN

SEQ ID NO: 220880 - protein, 9 aa, Japanese encephalitis virus
IAWTLIKNA

SEQ ID NO: 220881 - protein, 9 aa, Japanese encephalitis virus
AWTLIKNAD

SEQ ID NO: 220882 - protein, 9 aa, Japanese encephalitis virus
WTLIKNADK

SEQ ID NO: 220883 - protein, 9 aa, Japanese encephalitis virus
TLIKNADKP

SEQ ID NO: 220884 - protein, 9 aa, Japanese encephalitis virus
LIKNADKPS

SEQ ID NO: 220885 - protein, 9 aa, Japanese encephalitis virus
IKNADKPSL

SEQ ID NO: 220886 - protein, 9 aa, Japanese encephalitis virus
KNADKPSLK

SEQ ID NO: 220887 - protein, 9 aa, Japanese encephalitis virus
NADKPSLKR

SEQ ID NO: 220888 - protein, 9 aa, Japanese encephalitis virus
ADKPSLKRG

SEQ ID NO: 220889 - protein, 9 aa, Japanese encephalitis virus
DKPSLKRGR

SEQ ID NO: 220890 - protein, 9 aa, Japanese encephalitis virus
KPSLKRGRP

SEQ ID NO: 220891 - protein, 9 aa, Japanese encephalitis virus
PSLKRGRPG

SEQ ID NO: 220892 - protein, 9 aa, Japanese encephalitis virus
SLKRGRPGG

SEQ ID NO: 220893 - protein, 9 aa, Japanese encephalitis virus
LKRGRPGGR

SEQ ID NO: 220894 - protein, 9 aa, Japanese encephalitis virus
KRGRPGGRT

SEQ ID NO: 220895 - protein, 9 aa, Japanese encephalitis virus
RGRPGGRTL

SEQ ID NO: 220896 - protein, 9 aa, Japanese encephalitis virus
GRPGGRTLG

SEQ ID NO: 220897 - protein, 9 aa, Japanese encephalitis virus
RPGGRTLGE

SEQ ID NO: 220898 - protein, 9 aa, Japanese encephalitis virus
PGGRTLGEQ

SEQ ID NO: 220899 - protein, 9 aa, Japanese encephalitis virus
GGRTLGEQW

SEQ ID NO: 220900 - protein, 9 aa, Japanese encephalitis virus
GRTLGEQWK

SEQ ID NO: 220901 - protein, 9 aa, Japanese encephalitis virus
RTLGEQWKE

SEQ ID NO: 220902 - protein, 9 aa, Japanese encephalitis virus
TLGEQWKEK

SEQ ID NO: 220903 - protein, 9 aa, Japanese encephalitis virus
LGEQWKEKL

SEQ ID NO: 220904 - protein, 9 aa, Japanese encephalitis virus
GEQWKEKLN

SEQ ID NO: 220905 - protein, 9 aa, Japanese encephalitis virus
EQWKEKLNA

SEQ ID NO: 220906 - protein, 9 aa, Japanese encephalitis virus
QWKEKLNAM

SEQ ID NO: 220907 - protein, 9 aa, Japanese encephalitis virus
WKEKLNAMS

SEQ ID NO: 220908 - protein, 9 aa, Japanese encephalitis virus
KEKLNAMSR

SEQ ID NO: 220909 - protein, 9 aa, Japanese encephalitis virus
KLNAMSREE

SEQ ID NO: 220910 - protein, 9 aa, Japanese encephalitis virus
LNAMSREEF

SEQ ID NO: 220911 - protein, 9 aa, Japanese encephalitis virus
NAMSREEFF

SEQ ID NO: 220912 - protein, 9 aa, Japanese encephalitis virus
AMSREEFFK

SEQ ID NO: 220913 - protein, 9 aa, Japanese encephalitis virus
MSREEFFKY

SEQ ID NO: 220914 - protein, 9 aa, Japanese encephalitis virus
SREEFFKYR

SEQ ID NO: 220915 - protein, 9 aa, Japanese encephalitis virus
REEFFKYRR

SEQ ID NO: 220916 - protein, 9 aa, Japanese encephalitis virus
EEFFKYRRE

SEQ ID NO: 220917 - protein, 9 aa, Japanese encephalitis virus
EFFKYRREA

SEQ ID NO: 220918 - protein, 9 aa, Japanese encephalitis virus
FFKYRREAI

SEQ ID NO: 220919 - protein, 9 aa, Japanese encephalitis virus
FKYRREAII

SEQ ID NO: 220920 - protein, 9 aa, Japanese encephalitis virus
KYRREAIIE

SEQ ID NO: 220921 - protein, 9 aa, Japanese encephalitis virus
YRREAIIEV

SEQ ID NO: 220922 - protein, 9 aa, Japanese encephalitis virus
RREAIIEVD

SEQ ID NO: 220923 - protein, 9 aa, Japanese encephalitis virus
REAIIEVDR

SEQ ID NO: 220924 - protein, 9 aa, Japanese encephalitis virus
EAIIEVDRT

SEQ ID NO: 220925 - protein, 9 aa, Japanese encephalitis virus
AIIEVDRTE

SEQ ID NO: 220926 - protein, 9 aa, Japanese encephalitis virus
IIEVDRTEA

SEQ ID NO: 220927 - protein, 9 aa, Japanese encephalitis virus
IEVDRTEAR

SEQ ID NO: 220928 - protein, 9 aa, Japanese encephalitis virus
EVDRTEARR

SEQ ID NO: 220929 - protein, 9 aa, Japanese encephalitis virus
VDRTEARRA

SEQ ID NO: 220930 - protein, 9 aa, Japanese encephalitis virus
DRTEARRAR

SEQ ID NO: 220931 - protein, 9 aa, Japanese encephalitis virus
RTEARRARR

SEQ ID NO: 220932 - protein, 9 aa, Japanese encephalitis virus
TEARRARRE

SEQ ID NO: 220933 - protein, 9 aa, Japanese encephalitis virus
EARRARREN

SEQ ID NO: 220934 - protein, 9 aa, Japanese encephalitis virus
ARRARRENN

SEQ ID NO: 220935 - protein, 9 aa, Japanese encephalitis virus
RRARRENNI

SEQ ID NO: 220936 - protein, 9 aa, Japanese encephalitis virus
RARRENNIV

SEQ ID NO: 220937 - protein, 9 aa, Japanese encephalitis virus
ARRENNIVG

SEQ ID NO: 220938 - protein, 9 aa, Japanese encephalitis virus
RRENNIVGG

SEQ ID NO: 220939 - protein, 9 aa, Japanese encephalitis virus
RENNIVGGH

SEQ ID NO: 220940 - protein, 9 aa, Japanese encephalitis virus
ENNIVGGHP

SEQ ID NO: 220941 - protein, 9 aa, Japanese encephalitis virus
NNIVGGHPV

SEQ ID NO: 220942 - protein, 9 aa, Japanese encephalitis virus
NIVGGHPVS

SEQ ID NO: 220943 - protein, 9 aa, Japanese encephalitis virus
IVGGHPVSR

SEQ ID NO: 220944 - protein, 9 aa, Japanese encephalitis virus
VGGHPVSRG

SEQ ID NO: 220945 - protein, 9 aa, Japanese encephalitis virus
GGHPVSRGS

SEQ ID NO: 220946 - protein, 9 aa, Japanese encephalitis virus
GHPVSRGSA

SEQ ID NO: 220947 - protein, 9 aa, Japanese encephalitis virus
HPVSRGSAK

SEQ ID NO: 220948 - protein, 9 aa, Japanese encephalitis virus
PVSRGSAKL

SEQ ID NO: 220949 - protein, 9 aa, Japanese encephalitis virus
VSRGSAKLR

SEQ ID NO: 220950 - protein, 9 aa, Japanese encephalitis virus
SRGSAKLRW

SEQ ID NO: 220951 - protein, 9 aa, Japanese encephalitis virus
RGSAKLRWL

SEQ ID NO: 220952 - protein, 9 aa, Japanese encephalitis virus
GSAKLRWLV

SEQ ID NO: 220953 - protein, 9 aa, Japanese encephalitis virus
SAKLRWLVE

SEQ ID NO: 220954 - protein, 9 aa, Japanese encephalitis virus
AKLRWLVEK

SEQ ID NO: 220955 - protein, 9 aa, Japanese encephalitis virus
KLRWLVEKG

SEQ ID NO: 220956 - protein, 9 aa, Japanese encephalitis virus
LRWLVEKGF

SEQ ID NO: 220957 - protein, 9 aa, Japanese encephalitis virus
RWLVEKGFV

SEQ ID NO: 220958 - protein, 9 aa, Japanese encephalitis virus
WLVEKGFVS

SEQ ID NO: 220959 - protein, 9 aa, Japanese encephalitis virus
LVEKGFVSP

SEQ ID NO: 220960 - protein, 9 aa, Japanese encephalitis virus
VEKGFVSPI

SEQ ID NO: 220961 - protein, 9 aa, Japanese encephalitis virus
EKGFVSPIG

SEQ ID NO: 220962 - protein, 9 aa, Japanese encephalitis virus
KGFVSPIGK

SEQ ID NO: 220963 - protein, 9 aa, Japanese encephalitis virus
GFVSPIGKV

SEQ ID NO: 220964 - protein, 9 aa, Japanese encephalitis virus
FVSPIGKVI

SEQ ID NO: 220965 - protein, 9 aa, Japanese encephalitis virus
VSPIGKVID

SEQ ID NO: 220966 - protein, 9 aa, Japanese encephalitis virus
SPIGKVIDL

SEQ ID NO: 220967 - protein, 9 aa, Japanese encephalitis virus
PIGKVIDLG

SEQ ID NO: 220968 - protein, 9 aa, Japanese encephalitis virus
IGKVIDLGC

SEQ ID NO: 220969 - protein, 9 aa, Japanese encephalitis virus
GKVIDLGCG

SEQ ID NO: 220970 - protein, 9 aa, Japanese encephalitis virus
KVIDLGCGR

SEQ ID NO: 220971 - protein, 9 aa, Japanese encephalitis virus
VIDLGCGRG

SEQ ID NO: 220972 - protein, 9 aa, Japanese encephalitis virus
IDLGCGRGG

SEQ ID NO: 220973 - protein, 9 aa, Japanese encephalitis virus
DLGCGRGGW

SEQ ID NO: 220974 - protein, 9 aa, Japanese encephalitis virus
LGCGRGGWS

SEQ ID NO: 220975 - protein, 9 aa, Japanese encephalitis virus
GCGRGGWSY

SEQ ID NO: 220976 - protein, 9 aa, Japanese encephalitis virus
CGRGGWSYY

SEQ ID NO: 220977 - protein, 9 aa, Japanese encephalitis virus
GRGGWSYYA

SEQ ID NO: 220978 - protein, 9 aa, Japanese encephalitis virus
RGGWSYYAA

SEQ ID NO: 220979 - protein, 9 aa, Japanese encephalitis virus
GGWSYYAAT

SEQ ID NO: 220980 - protein, 9 aa, Japanese encephalitis virus
GWSYYAATL

SEQ ID NO: 220981 - protein, 9 aa, Japanese encephalitis virus
WSYYAATLK

SEQ ID NO: 220982 - protein, 9 aa, Japanese encephalitis virus
SYYAATLKK

SEQ ID NO: 220983 - protein, 9 aa, Japanese encephalitis virus
YYAATLKKV

SEQ ID NO: 220984 - protein, 9 aa, Japanese encephalitis virus
YAATLKKVQ

SEQ ID NO: 220985 - protein, 9 aa, Japanese encephalitis virus
AATLKKVQE

SEQ ID NO: 220986 - protein, 9 aa, Japanese encephalitis virus
ATLKKVQEV

SEQ ID NO: 220987 - protein, 9 aa, Japanese encephalitis virus
TLKKVQEVR

SEQ ID NO: 220988 - protein, 9 aa, Japanese encephalitis virus
LKKVQEVRG

SEQ ID NO: 220989 - protein, 9 aa, Japanese encephalitis virus
KKVQEVRGY

SEQ ID NO: 220990 - protein, 9 aa, Japanese encephalitis virus
KVQEVRGYT

SEQ ID NO: 220991 - protein, 9 aa, Japanese encephalitis virus
VQEVRGYTK

SEQ ID NO: 220992 - protein, 9 aa, Japanese encephalitis virus
QEVRGYTKG

SEQ ID NO: 220993 - protein, 9 aa, Japanese encephalitis virus
EVRGYTKGG

SEQ ID NO: 220994 - protein, 9 aa, Japanese encephalitis virus
VRGYTKGGA

SEQ ID NO: 220995 - protein, 9 aa, Japanese encephalitis virus
RGYTKGGAG

SEQ ID NO: 220996 - protein, 9 aa, Japanese encephalitis virus
GYTKGGAGH

SEQ ID NO: 220997 - protein, 9 aa, Japanese encephalitis virus
YTKGGAGHE

SEQ ID NO: 220998 - protein, 9 aa, Japanese encephalitis virus
TKGGAGHEE

SEQ ID NO: 220999 - protein, 9 aa, Japanese encephalitis virus
KGGAGHEEP

SEQ ID NO: 221000 - protein, 9 aa, Japanese encephalitis virus
GGAGHEEPM

SEQ ID NO: 221001 - protein, 9 aa, Japanese encephalitis virus
GAGHEEPML

SEQ ID NO: 221002 - protein, 9 aa, Japanese encephalitis virus
AGHEEPMLM

SEQ ID NO: 221003 - protein, 9 aa, Japanese encephalitis virus
GHEEPMLMQ

SEQ ID NO: 221004 - protein, 9 aa, Japanese encephalitis virus
HEEPMLMQS

SEQ ID NO: 221005 - protein, 9 aa, Japanese encephalitis virus
EEPMLMQSY

SEQ ID NO: 221006 - protein, 9 aa, Japanese encephalitis virus
EPMLMQSYG

SEQ ID NO: 221007 - protein, 9 aa, Japanese encephalitis virus
PMLMQSYGW

SEQ ID NO: 221008 - protein, 9 aa, Japanese encephalitis virus
MLMQSYGWN

SEQ ID NO: 221009 - protein, 9 aa, Japanese encephalitis virus
LMQSYGWNL

SEQ ID NO: 221010 - protein, 9 aa, Japanese encephalitis virus
MQSYGWNLV

SEQ ID NO: 221011 - protein, 9 aa, Japanese encephalitis virus
QSYGWNLVS

SEQ ID NO: 221012 - protein, 9 aa, Japanese encephalitis virus
SYGWNLVSL

SEQ ID NO: 221013 - protein, 9 aa, Japanese encephalitis virus
YGWNLVSLK

SEQ ID NO: 221014 - protein, 9 aa, Japanese encephalitis virus
GWNLVSLKS

SEQ ID NO: 221015 - protein, 9 aa, Japanese encephalitis virus
WNLVSLKSG

SEQ ID NO: 221016 - protein, 9 aa, Japanese encephalitis virus
NLVSLKSGV

SEQ ID NO: 221017 - protein, 9 aa, Japanese encephalitis virus
LVSLKSGVD

SEQ ID NO: 221018 - protein, 9 aa, Japanese encephalitis virus
VSLKSGVDV

SEQ ID NO: 221019 - protein, 9 aa, Japanese encephalitis virus
SLKSGVDVF

SEQ ID NO: 221020 - protein, 9 aa, Japanese encephalitis virus
LKSGVDVFY

SEQ ID NO: 221021 - protein, 9 aa, Japanese encephalitis virus
KSGVDVFYK

SEQ ID NO: 221022 - protein, 9 aa, Japanese encephalitis virus
SGVDVFYKP

SEQ ID NO: 221023 - protein, 9 aa, Japanese encephalitis virus
GVDVFYKPS

SEQ ID NO: 221024 - protein, 9 aa, Japanese encephalitis virus
VDVFYKPSE

SEQ ID NO: 221025 - protein, 9 aa, Japanese encephalitis virus
DVFYKPSEP

SEQ ID NO: 221026 - protein, 9 aa, Japanese encephalitis virus
VFYKPSEPS

SEQ ID NO: 221027 - protein, 9 aa, Japanese encephalitis virus
FYKPSEPSD

SEQ ID NO: 221028 - protein, 9 aa, Japanese encephalitis virus
YKPSEPSDT

SEQ ID NO: 221029 - protein, 9 aa, Japanese encephalitis virus
KPSEPSDTL

SEQ ID NO: 221030 - protein, 9 aa, Japanese encephalitis virus
PSEPSDTLF

SEQ ID NO: 221031 - protein, 9 aa, Japanese encephalitis virus
SEPSDTLFC

SEQ ID NO: 221032 - protein, 9 aa, Japanese encephalitis virus
EPSDTLFCD

SEQ ID NO: 221033 - protein, 9 aa, Japanese encephalitis virus
PSDTLFCDI

SEQ ID NO: 221034 - protein, 9 aa, Japanese encephalitis virus
SDTLFCDIG

SEQ ID NO: 221035 - protein, 9 aa, Japanese encephalitis virus
DTLFCDIGE

SEQ ID NO: 221036 - protein, 9 aa, Japanese encephalitis virus
TLFCDIGES

SEQ ID NO: 221037 - protein, 9 aa, Japanese encephalitis virus
LFCDIGESS

SEQ ID NO: 221038 - protein, 9 aa, Japanese encephalitis virus
FCDIGESSP

SEQ ID NO: 221039 - protein, 9 aa, Japanese encephalitis virus
CDIGESSPS

SEQ ID NO: 221040 - protein, 9 aa, Japanese encephalitis virus
DIGESSPSP

SEQ ID NO: 221041 - protein, 9 aa, Japanese encephalitis virus
IGESSPSPE

SEQ ID NO: 221042 - protein, 9 aa, Japanese encephalitis virus
GESSPSPEV

SEQ ID NO: 221043 - protein, 9 aa, Japanese encephalitis virus
ESSPSPEVE

SEQ ID NO: 221044 - protein, 9 aa, Japanese encephalitis virus
SSPSPEVEE

SEQ ID NO: 221045 - protein, 9 aa, Japanese encephalitis virus
SPSPEVEEQ

SEQ ID NO: 221046 - protein, 9 aa, Japanese encephalitis virus
PSPEVEEQR

SEQ ID NO: 221047 - protein, 9 aa, Japanese encephalitis virus
SPEVEEQRT

SEQ ID NO: 221048 - protein, 9 aa, Japanese encephalitis virus
PEVEEQRTL

SEQ ID NO: 221049 - protein, 9 aa, Japanese encephalitis virus
EVEEQRTLR

SEQ ID NO: 221050 - protein, 9 aa, Japanese encephalitis virus
VEEQRTLRV

SEQ ID NO: 221051 - protein, 9 aa, Japanese encephalitis virus
EEQRTLRVL

SEQ ID NO: 221052 - protein, 9 aa, Japanese encephalitis virus
EQRTLRVLE

SEQ ID NO: 221053 - protein, 9 aa, Japanese encephalitis virus
QRTLRVLEM

SEQ ID NO: 221054 - protein, 9 aa, Japanese encephalitis virus
RTLRVLEMT

SEQ ID NO: 221055 - protein, 9 aa, Japanese encephalitis virus
TLRVLEMTS

SEQ ID NO: 221056 - protein, 9 aa, Japanese encephalitis virus
LRVLEMTSD

SEQ ID NO: 221057 - protein, 9 aa, Japanese encephalitis virus
RVLEMTSDW

SEQ ID NO: 221058 - protein, 9 aa, Japanese encephalitis virus
VLEMTSDWL

SEQ ID NO: 221059 - protein, 9 aa, Japanese encephalitis virus
LEMTSDWLH

SEQ ID NO: 221060 - protein, 9 aa, Japanese encephalitis virus
EMTSDWLHR

SEQ ID NO: 221061 - protein, 9 aa, Japanese encephalitis virus
MTSDWLHRG

SEQ ID NO: 221062 - protein, 9 aa, Japanese encephalitis virus
TSDWLHRGP

SEQ ID NO: 221063 - protein, 9 aa, Japanese encephalitis virus
SDWLHRGPR

SEQ ID NO: 221064 - protein, 9 aa, Japanese encephalitis virus
DWLHRGPRE

SEQ ID NO: 221065 - protein, 9 aa, Japanese encephalitis virus
WLHRGPREF

SEQ ID NO: 221066 - protein, 9 aa, Japanese encephalitis virus
LHRGPREFC

SEQ ID NO: 221067 - protein, 9 aa, Japanese encephalitis virus
HRGPREFCI

SEQ ID NO: 221068 - protein, 9 aa, Japanese encephalitis virus
RGPREFCIK

SEQ ID NO: 221069 - protein, 9 aa, Japanese encephalitis virus
GPREFCIKV

SEQ ID NO: 221070 - protein, 9 aa, Japanese encephalitis virus
PREFCIKVL

SEQ ID NO: 221071 - protein, 9 aa, Japanese encephalitis virus
REFCIKVLC

SEQ ID NO: 221072 - protein, 9 aa, Japanese encephalitis virus
EFCIKVLCP

SEQ ID NO: 221073 - protein, 9 aa, Japanese encephalitis virus
FCIKVLCPY

SEQ ID NO: 221074 - protein, 9 aa, Japanese encephalitis virus
CIKVLCPYM

SEQ ID NO: 221075 - protein, 9 aa, Japanese encephalitis virus
IKVLCPYMP

SEQ ID NO: 221076 - protein, 9 aa, Japanese encephalitis virus
KVLCPYMPK

SEQ ID NO: 221077 - protein, 9 aa, Japanese encephalitis virus
VLCPYMPKV

SEQ ID NO: 221078 - protein, 9 aa, Japanese encephalitis virus
LCPYMPKVI

SEQ ID NO: 221079 - protein, 9 aa, Japanese encephalitis virus
CPYMPKVIE

SEQ ID NO: 221080 - protein, 9 aa, Japanese encephalitis virus
PYMPKVIEK

SEQ ID NO: 221081 - protein, 9 aa, Japanese encephalitis virus
YMPKVIEKM

SEQ ID NO: 221082 - protein, 9 aa, Japanese encephalitis virus
MPKVIEKME

SEQ ID NO: 221083 - protein, 9 aa, Japanese encephalitis virus
PKVIEKMEV

SEQ ID NO: 221084 - protein, 9 aa, Japanese encephalitis virus
KVIEKMEVL

SEQ ID NO: 221085 - protein, 9 aa, Japanese encephalitis virus
VIEKMEVLQ

SEQ ID NO: 221086 - protein, 9 aa, Japanese encephalitis virus
IEKMEVLQR

SEQ ID NO: 221087 - protein, 9 aa, Japanese encephalitis virus
EKMEVLQRR

SEQ ID NO: 221088 - protein, 9 aa, Japanese encephalitis virus
KMEVLQRRF

SEQ ID NO: 221089 - protein, 9 aa, Japanese encephalitis virus
MEVLQRRFG

SEQ ID NO: 221090 - protein, 9 aa, Japanese encephalitis virus
EVLQRRFGG

SEQ ID NO: 221091 - protein, 9 aa, Japanese encephalitis virus
VLQRRFGGG

SEQ ID NO: 221092 - protein, 9 aa, Japanese encephalitis virus
LQRRFGGGL

SEQ ID NO: 221093 - protein, 9 aa, Japanese encephalitis virus
QRRFGGGLV

SEQ ID NO: 221094 - protein, 9 aa, Japanese encephalitis virus
RRFGGGLVR

SEQ ID NO: 221095 - protein, 9 aa, Japanese encephalitis virus
RFGGGLVRL

SEQ ID NO: 221096 - protein, 9 aa, Japanese encephalitis virus
FGGGLVRLP

SEQ ID NO: 221097 - protein, 9 aa, Japanese encephalitis virus
GGGLVRLPL

SEQ ID NO: 221098 - protein, 9 aa, Japanese encephalitis virus
GGLVRLPLS

SEQ ID NO: 221099 - protein, 9 aa, Japanese encephalitis virus
GLVRLPLSR

SEQ ID NO: 221100 - protein, 9 aa, Japanese encephalitis virus
LVRLPLSRN

SEQ ID NO: 221101 - protein, 9 aa, Japanese encephalitis virus
VRLPLSRNS

SEQ ID NO: 221102 - protein, 9 aa, Japanese encephalitis virus
RLPLSRNSN

SEQ ID NO: 221103 - protein, 9 aa, Japanese encephalitis virus
LPLSRNSNH

SEQ ID NO: 221104 - protein, 9 aa, Japanese encephalitis virus
PLSRNSNHE

SEQ ID NO: 221105 - protein, 9 aa, Japanese encephalitis virus
LSRNSNHEM

SEQ ID NO: 221106 - protein, 9 aa, Japanese encephalitis virus
SRNSNHEMY

SEQ ID NO: 221107 - protein, 9 aa, Japanese encephalitis virus
RNSNHEMYW

SEQ ID NO: 221108 - protein, 9 aa, Japanese encephalitis virus
NSNHEMYWV

SEQ ID NO: 221109 - protein, 9 aa, Japanese encephalitis virus
SNHEMYWVS

SEQ ID NO: 221110 - protein, 9 aa, Japanese encephalitis virus
NHEMYWVSG

SEQ ID NO: 221111 - protein, 9 aa, Japanese encephalitis virus
HEMYWVSGA

SEQ ID NO: 221112 - protein, 9 aa, Japanese encephalitis virus
EMYWVSGAA

SEQ ID NO: 221113 - protein, 9 aa, Japanese encephalitis virus
MYWVSGAAG

SEQ ID NO: 221114 - protein, 9 aa, Japanese encephalitis virus
YWVSGAAGN

SEQ ID NO: 221115 - protein, 9 aa, Japanese encephalitis virus
WVSGAAGNV

SEQ ID NO: 221116 - protein, 9 aa, Japanese encephalitis virus
VSGAAGNVV

SEQ ID NO: 221117 - protein, 9 aa, Japanese encephalitis virus
SGAAGNVVH

SEQ ID NO: 221118 - protein, 9 aa, Japanese encephalitis virus
GAAGNVVHA

SEQ ID NO: 221119 - protein, 9 aa, Japanese encephalitis virus
AAGNVVHAV

SEQ ID NO: 221120 - protein, 9 aa, Japanese encephalitis virus
AGNVVHAVN

SEQ ID NO: 221121 - protein, 9 aa, Japanese encephalitis virus
GNVVHAVNM

SEQ ID NO: 221122 - protein, 9 aa, Japanese encephalitis virus
NVVHAVNMT

SEQ ID NO: 221123 - protein, 9 aa, Japanese encephalitis virus
VVHAVNMTS

SEQ ID NO: 221124 - protein, 9 aa, Japanese encephalitis virus
VHAVNMTSQ

SEQ ID NO: 221125 - protein, 9 aa, Japanese encephalitis virus
HAVNMTSQV

SEQ ID NO: 221126 - protein, 9 aa, Japanese encephalitis virus
AVNMTSQVL

SEQ ID NO: 221127 - protein, 9 aa, Japanese encephalitis virus
VNMTSQVLL

SEQ ID NO: 221128 - protein, 9 aa, Japanese encephalitis virus
NMTSQVLLG

SEQ ID NO: 221129 - protein, 9 aa, Japanese encephalitis virus
MTSQVLLGR

SEQ ID NO: 221130 - protein, 9 aa, Japanese encephalitis virus
TSQVLLGRM

SEQ ID NO: 221131 - protein, 9 aa, Japanese encephalitis virus
SQVLLGRMD

SEQ ID NO: 221132 - protein, 9 aa, Japanese encephalitis virus
QVLLGRMDR

SEQ ID NO: 221133 - protein, 9 aa, Japanese encephalitis virus
VLLGRMDRT

SEQ ID NO: 221134 - protein, 9 aa, Japanese encephalitis virus
LLGRMDRTV

SEQ ID NO: 221135 - protein, 9 aa, Japanese encephalitis virus
LGRMDRTVW

SEQ ID NO: 221136 - protein, 9 aa, Japanese encephalitis virus
GRMDRTVWR

SEQ ID NO: 221137 - protein, 9 aa, Japanese encephalitis virus
RMDRTVWRG

SEQ ID NO: 221138 - protein, 9 aa, Japanese encephalitis virus
MDRTVWRGP

SEQ ID NO: 221139 - protein, 9 aa, Japanese encephalitis virus
DRTVWRGPK

SEQ ID NO: 221140 - protein, 9 aa, Japanese encephalitis virus
RTVWRGPKY

SEQ ID NO: 221141 - protein, 9 aa, Japanese encephalitis virus
TVWRGPKYE

SEQ ID NO: 221142 - protein, 9 aa, Japanese encephalitis virus
VWRGPKYEE

SEQ ID NO: 221143 - protein, 9 aa, Japanese encephalitis virus
WRGPKYEED

SEQ ID NO: 221144 - protein, 9 aa, Japanese encephalitis virus
RGPKYEEDV

SEQ ID NO: 221145 - protein, 9 aa, Japanese encephalitis virus
GPKYEEDVN

SEQ ID NO: 221146 - protein, 9 aa, Japanese encephalitis virus
PKYEEDVNL

SEQ ID NO: 221147 - protein, 9 aa, Japanese encephalitis virus
KYEEDVNLG

SEQ ID NO: 221148 - protein, 9 aa, Japanese encephalitis virus
YEEDVNLGS

SEQ ID NO: 221149 - protein, 9 aa, Japanese encephalitis virus
EEDVNLGSG

SEQ ID NO: 221150 - protein, 9 aa, Japanese encephalitis virus
EDVNLGSGT

SEQ ID NO: 221151 - protein, 9 aa, Japanese encephalitis virus
DVNLGSGTR

SEQ ID NO: 221152 - protein, 9 aa, Japanese encephalitis virus
VNLGSGTRA

SEQ ID NO: 221153 - protein, 9 aa, Japanese encephalitis virus
NLGSGTRAV

SEQ ID NO: 221154 - protein, 9 aa, Japanese encephalitis virus
LGSGTRAVG

SEQ ID NO: 221155 - protein, 9 aa, Japanese encephalitis virus
GSGTRAVGK

SEQ ID NO: 221156 - protein, 9 aa, Japanese encephalitis virus
SGTRAVGKG

SEQ ID NO: 221157 - protein, 9 aa, Japanese encephalitis virus
GTRAVGKGE

SEQ ID NO: 221158 - protein, 9 aa, Japanese encephalitis virus
TRAVGKGEV

SEQ ID NO: 221159 - protein, 9 aa, Japanese encephalitis virus
RAVGKGEVH

SEQ ID NO: 221160 - protein, 9 aa, Japanese encephalitis virus
AVGKGEVHS

SEQ ID NO: 221161 - protein, 9 aa, Japanese encephalitis virus
VGKGEVHSN

SEQ ID NO: 221162 - protein, 9 aa, Japanese encephalitis virus
GKGEVHSNQ

SEQ ID NO: 221163 - protein, 9 aa, Japanese encephalitis virus
QEKIKKRIQ

SEQ ID NO: 221164 - protein, 9 aa, Japanese encephalitis virus
EKIKKRIQK

SEQ ID NO: 221165 - protein, 9 aa, Japanese encephalitis virus
KIKKRIQKL

SEQ ID NO: 221166 - protein, 9 aa, Japanese encephalitis virus
IKKRIQKLK

SEQ ID NO: 221167 - protein, 9 aa, Japanese encephalitis virus
KKRIQKLKE

SEQ ID NO: 221168 - protein, 9 aa, Japanese encephalitis virus
KRIQKLKEE

SEQ ID NO: 221169 - protein, 9 aa, Japanese encephalitis virus
RIQKLKEEF

SEQ ID NO: 221170 - protein, 9 aa, Japanese encephalitis virus
IQKLKEEFA

SEQ ID NO: 221171 - protein, 9 aa, Japanese encephalitis virus
QKLKEEFAT

SEQ ID NO: 221172 - protein, 9 aa, Japanese encephalitis virus
KLKEEFATT

SEQ ID NO: 221173 - protein, 9 aa, Japanese encephalitis virus
LKEEFATTW

SEQ ID NO: 221174 - protein, 9 aa, Japanese encephalitis virus
KEEFATTWH

SEQ ID NO: 221175 - protein, 9 aa, Japanese encephalitis virus
EEFATTWHK

SEQ ID NO: 221176 - protein, 9 aa, Japanese encephalitis virus
EFATTWHKD

SEQ ID NO: 221177 - protein, 9 aa, Japanese encephalitis virus
FATTWHKDP

SEQ ID NO: 221178 - protein, 9 aa, Japanese encephalitis virus
ATTWHKDPE

SEQ ID NO: 221179 - protein, 9 aa, Japanese encephalitis virus
TTWHKDPEH

SEQ ID NO: 221180 - protein, 9 aa, Japanese encephalitis virus
TWHKDPEHP

SEQ ID NO: 221181 - protein, 9 aa, Japanese encephalitis virus
WHKDPEHPY

SEQ ID NO: 221182 - protein, 9 aa, Japanese encephalitis virus
HKDPEHPYR

SEQ ID NO: 221183 - protein, 9 aa, Japanese encephalitis virus
KDPEHPYRT

SEQ ID NO: 221184 - protein, 9 aa, Japanese encephalitis virus
DPEHPYRTW

SEQ ID NO: 221185 - protein, 9 aa, Japanese encephalitis virus
PEHPYRTWT

SEQ ID NO: 221186 - protein, 9 aa, Japanese encephalitis virus
EHPYRTWTY

SEQ ID NO: 221187 - protein, 9 aa, Japanese encephalitis virus
HPYRTWTYH

SEQ ID NO: 221188 - protein, 9 aa, Japanese encephalitis virus
PYRTWTYHG

SEQ ID NO: 221189 - protein, 9 aa, Japanese encephalitis virus
YRTWTYHGS

SEQ ID NO: 221190 - protein, 9 aa, Japanese encephalitis virus
RTWTYHGSY

SEQ ID NO: 221191 - protein, 9 aa, Japanese encephalitis virus
TWTYHGSYE

SEQ ID NO: 221192 - protein, 9 aa, Japanese encephalitis virus
WTYHGSYEV

SEQ ID NO: 221193 - protein, 9 aa, Japanese encephalitis virus
TYHGSYEVK

SEQ ID NO: 221194 - protein, 9 aa, Japanese encephalitis virus
YHGSYEVKA

SEQ ID NO: 221195 - protein, 9 aa, Japanese encephalitis virus
HGSYEVKAT

SEQ ID NO: 221196 - protein, 9 aa, Japanese encephalitis virus
GSYEVKATG

SEQ ID NO: 221197 - protein, 9 aa, Japanese encephalitis virus
SYEVKATGS

SEQ ID NO: 221198 - protein, 9 aa, Japanese encephalitis virus
YEVKATGSA

SEQ ID NO: 221199 - protein, 9 aa, Japanese encephalitis virus
EVKATGSAS

SEQ ID NO: 221200 - protein, 9 aa, Japanese encephalitis virus
VKATGSASS

SEQ ID NO: 221201 - protein, 9 aa, Japanese encephalitis virus
KATGSASSL

SEQ ID NO: 221202 - protein, 9 aa, Japanese encephalitis virus
ATGSASSLV

SEQ ID NO: 221203 - protein, 9 aa, Japanese encephalitis virus
TGSASSLVN

SEQ ID NO: 221204 - protein, 9 aa, Japanese encephalitis virus
GSASSLVNG

SEQ ID NO: 221205 - protein, 9 aa, Japanese encephalitis virus
SASSLVNGV

SEQ ID NO: 221206 - protein, 9 aa, Japanese encephalitis virus
ASSLVNGVV

SEQ ID NO: 221207 - protein, 9 aa, Japanese encephalitis virus
SSLVNGVVK

SEQ ID NO: 221208 - protein, 9 aa, Japanese encephalitis virus
SLVNGVVKL

SEQ ID NO: 221209 - protein, 9 aa, Japanese encephalitis virus
LVNGVVKLM

SEQ ID NO: 221210 - protein, 9 aa, Japanese encephalitis virus
VNGVVKLMS

SEQ ID NO: 221211 - protein, 9 aa, Japanese encephalitis virus
NGVVKLMSK

SEQ ID NO: 221212 - protein, 9 aa, Japanese encephalitis virus
GVVKLMSKP

SEQ ID NO: 221213 - protein, 9 aa, Japanese encephalitis virus
VVKLMSKPW

SEQ ID NO: 221214 - protein, 9 aa, Japanese encephalitis virus
VKLMSKPWD

SEQ ID NO: 221215 - protein, 9 aa, Japanese encephalitis virus
KLMSKPWDA

SEQ ID NO: 221216 - protein, 9 aa, Japanese encephalitis virus
LMSKPWDAI

SEQ ID NO: 221217 - protein, 9 aa, Japanese encephalitis virus
MSKPWDAIA

SEQ ID NO: 221218 - protein, 9 aa, Japanese encephalitis virus
SKPWDAIAN

SEQ ID NO: 221219 - protein, 9 aa, Japanese encephalitis virus
KPWDAIANV

SEQ ID NO: 221220 - protein, 9 aa, Japanese encephalitis virus
PWDAIANVT

SEQ ID NO: 221221 - protein, 9 aa, Japanese encephalitis virus
WDAIANVTT

SEQ ID NO: 221222 - protein, 9 aa, Japanese encephalitis virus
DAIANVTTM

SEQ ID NO: 221223 - protein, 9 aa, Japanese encephalitis virus
AIANVTTMA

SEQ ID NO: 221224 - protein, 9 aa, Japanese encephalitis virus
IANVTTMAM

SEQ ID NO: 221225 - protein, 9 aa, Japanese encephalitis virus
ANVTTMAMT

SEQ ID NO: 221226 - protein, 9 aa, Japanese encephalitis virus
NVTTMAMTD

SEQ ID NO: 221227 - protein, 9 aa, Japanese encephalitis virus
VTTMAMTDT

SEQ ID NO: 221228 - protein, 9 aa, Japanese encephalitis virus
TTMAMTDTT

SEQ ID NO: 221229 - protein, 9 aa, Japanese encephalitis virus
TMAMTDTTP

SEQ ID NO: 221230 - protein, 9 aa, Japanese encephalitis virus
MAMTDTTPF

SEQ ID NO: 221231 - protein, 9 aa, Japanese encephalitis virus
AMTDTTPFG

SEQ ID NO: 221232 - protein, 9 aa, Japanese encephalitis virus
MTDTTPFGQ

SEQ ID NO: 221233 - protein, 9 aa, Japanese encephalitis virus
TDTTPFGQQ

SEQ ID NO: 221234 - protein, 9 aa, Japanese encephalitis virus
DTTPFGQQR

SEQ ID NO: 221235 - protein, 9 aa, Japanese encephalitis virus
TTPFGQQRV

SEQ ID NO: 221236 - protein, 9 aa, Japanese encephalitis virus
TPFGQQRVF

SEQ ID NO: 221237 - protein, 9 aa, Japanese encephalitis virus
PFGQQRVFK

SEQ ID NO: 221238 - protein, 9 aa, Japanese encephalitis virus
FGQQRVFKE

SEQ ID NO: 221239 - protein, 9 aa, Japanese encephalitis virus
GQQRVFKEK

SEQ ID NO: 221240 - protein, 9 aa, Japanese encephalitis virus
QQRVFKEKV

SEQ ID NO: 221241 - protein, 9 aa, Japanese encephalitis virus
QRVFKEKVD

SEQ ID NO: 221242 - protein, 9 aa, Japanese encephalitis virus
RVFKEKVDT

SEQ ID NO: 221243 - protein, 9 aa, Japanese encephalitis virus
VFKEKVDTK

SEQ ID NO: 221244 - protein, 9 aa, Japanese encephalitis virus
FKEKVDTKA

SEQ ID NO: 221245 - protein, 9 aa, Japanese encephalitis virus
KEKVDTKAP

SEQ ID NO: 221246 - protein, 9 aa, Japanese encephalitis virus
EKVDTKAPE

SEQ ID NO: 221247 - protein, 9 aa, Japanese encephalitis virus
KVDTKAPEP

SEQ ID NO: 221248 - protein, 9 aa, Japanese encephalitis virus
VDTKAPEPP

SEQ ID NO: 221249 - protein, 9 aa, Japanese encephalitis virus
TKAPEPPAG

SEQ ID NO: 221250 - protein, 9 aa, Japanese encephalitis virus
GAKEVLNET

SEQ ID NO: 221251 - protein, 9 aa, Japanese encephalitis virus
AKEVLNETT

SEQ ID NO: 221252 - protein, 9 aa, Japanese encephalitis virus
KEVLNETTN

SEQ ID NO: 221253 - protein, 9 aa, Japanese encephalitis virus
EVLNETTNW

SEQ ID NO: 221254 - protein, 9 aa, Japanese encephalitis virus
VLNETTNWL

SEQ ID NO: 221255 - protein, 9 aa, Japanese encephalitis virus
LNETTNWLW

SEQ ID NO: 221256 - protein, 9 aa, Japanese encephalitis virus
NETTNWLWA

SEQ ID NO: 221257 - protein, 9 aa, Japanese encephalitis virus
ETTNWLWAH

SEQ ID NO: 221258 - protein, 9 aa, Japanese encephalitis virus
TTNWLWAHL

SEQ ID NO: 221259 - protein, 9 aa, Japanese encephalitis virus
TNWLWAHLS

SEQ ID NO: 221260 - protein, 9 aa, Japanese encephalitis virus
NWLWAHLSR

SEQ ID NO: 221261 - protein, 9 aa, Japanese encephalitis virus
WLWAHLSRE

SEQ ID NO: 221262 - protein, 9 aa, Japanese encephalitis virus
LWAHLSREK

SEQ ID NO: 221263 - protein, 9 aa, Japanese encephalitis virus
WAHLSREKR

SEQ ID NO: 221264 - protein, 9 aa, Japanese encephalitis virus
AHLSREKRP

SEQ ID NO: 221265 - protein, 9 aa, Japanese encephalitis virus
HLSREKRPR

SEQ ID NO: 221266 - protein, 9 aa, Japanese encephalitis virus
LSREKRPRL

SEQ ID NO: 221267 - protein, 9 aa, Japanese encephalitis virus
SREKRPRLC

SEQ ID NO: 221268 - protein, 9 aa, Japanese encephalitis virus
REKRPRLCT

SEQ ID NO: 221269 - protein, 9 aa, Japanese encephalitis virus
EKRPRLCTK

SEQ ID NO: 221270 - protein, 9 aa, Japanese encephalitis virus
KRPRLCTKE

SEQ ID NO: 221271 - protein, 9 aa, Japanese encephalitis virus
RPRLCTKEE

SEQ ID NO: 221272 - protein, 9 aa, Japanese encephalitis virus
PRLCTKEEF

SEQ ID NO: 221273 - protein, 9 aa, Japanese encephalitis virus
RLCTKEEFI

SEQ ID NO: 221274 - protein, 9 aa, Japanese encephalitis virus
LCTKEEFIK

SEQ ID NO: 221275 - protein, 9 aa, Japanese encephalitis virus
CTKEEFIKK

SEQ ID NO: 221276 - protein, 9 aa, Japanese encephalitis virus
TKEEFIKKV

SEQ ID NO: 221277 - protein, 9 aa, Japanese encephalitis virus
KEEFIKKVN

SEQ ID NO: 221278 - protein, 9 aa, Japanese encephalitis virus
EEFIKKVNS

SEQ ID NO: 221279 - protein, 9 aa, Japanese encephalitis virus
EFIKKVNSN

SEQ ID NO: 221280 - protein, 9 aa, Japanese encephalitis virus
FIKKVNSNA

SEQ ID NO: 221281 - protein, 9 aa, Japanese encephalitis virus
KVNSNAALG

SEQ ID NO: 221282 - protein, 9 aa, Japanese encephalitis virus
VNSNAALGA

SEQ ID NO: 221283 - protein, 9 aa, Japanese encephalitis virus
NSNAALGAV

SEQ ID NO: 221284 - protein, 9 aa, Japanese encephalitis virus
SNAALGAVF

SEQ ID NO: 221285 - protein, 9 aa, Japanese encephalitis virus
NAALGAVFA

SEQ ID NO: 221286 - protein, 9 aa, Japanese encephalitis virus
AALGAVFAE

SEQ ID NO: 221287 - protein, 9 aa, Japanese encephalitis virus
ALGAVFAEQ

SEQ ID NO: 221288 - protein, 9 aa, Japanese encephalitis virus
LGAVFAEQN

SEQ ID NO: 221289 - protein, 9 aa, Japanese encephalitis virus
GAVFAEQNQ

SEQ ID NO: 221290 - protein, 9 aa, Japanese encephalitis virus
AVFAEQNQW

SEQ ID NO: 221291 - protein, 9 aa, Japanese encephalitis virus
VFAEQNQWS

SEQ ID NO: 221292 - protein, 9 aa, Japanese encephalitis virus
FAEQNQWST

SEQ ID NO: 221293 - protein, 9 aa, Japanese encephalitis virus
AEQNQWSTA

SEQ ID NO: 221294 - protein, 9 aa, Japanese encephalitis virus
EQNQWSTAR

SEQ ID NO: 221295 - protein, 9 aa, Japanese encephalitis virus
QNQWSTARE

SEQ ID NO: 221296 - protein, 9 aa, Japanese encephalitis virus
NQWSTAREA

SEQ ID NO: 221297 - protein, 9 aa, Japanese encephalitis virus
QWSTAREAV

SEQ ID NO: 221298 - protein, 9 aa, Japanese encephalitis virus
WSTAREAVD

SEQ ID NO: 221299 - protein, 9 aa, Japanese encephalitis virus
STAREAVDD

SEQ ID NO: 221300 - protein, 9 aa, Japanese encephalitis virus
TAREAVDDP

SEQ ID NO: 221301 - protein, 9 aa, Japanese encephalitis virus
FWEMVDEER

SEQ ID NO: 221302 - protein, 9 aa, Japanese encephalitis virus
WEMVDEERE

SEQ ID NO: 221303 - protein, 9 aa, Japanese encephalitis virus
EMVDEEREN

SEQ ID NO: 221304 - protein, 9 aa, Japanese encephalitis virus
MVDEERENH

SEQ ID NO: 221305 - protein, 9 aa, Japanese encephalitis virus
VDEERENHL

SEQ ID NO: 221306 - protein, 9 aa, Japanese encephalitis virus
DEERENHLR

SEQ ID NO: 221307 - protein, 9 aa, Japanese encephalitis virus
EERENHLRG

SEQ ID NO: 221308 - protein, 9 aa, Japanese encephalitis virus
ERENHLRGE

SEQ ID NO: 221309 - protein, 9 aa, Japanese encephalitis virus
RENHLRGEC

SEQ ID NO: 221310 - protein, 9 aa, Japanese encephalitis virus
ENHLRGECH

SEQ ID NO: 221311 - protein, 9 aa, Japanese encephalitis virus
NHLRGECHT

SEQ ID NO: 221312 - protein, 9 aa, Japanese encephalitis virus
HLRGECHTC

SEQ ID NO: 221313 - protein, 9 aa, Japanese encephalitis virus
LRGECHTCI

SEQ ID NO: 221314 - protein, 9 aa, Japanese encephalitis virus
RGECHTCIY

SEQ ID NO: 221315 - protein, 9 aa, Japanese encephalitis virus
GECHTCIYN

SEQ ID NO: 221316 - protein, 9 aa, Japanese encephalitis virus
ECHTCIYNM

SEQ ID NO: 221317 - protein, 9 aa, Japanese encephalitis virus
CHTCIYNMM

SEQ ID NO: 221318 - protein, 9 aa, Japanese encephalitis virus
HTCIYNMMG

SEQ ID NO: 221319 - protein, 9 aa, Japanese encephalitis virus
TCIYNMMGK

SEQ ID NO: 221320 - protein, 9 aa, Japanese encephalitis virus
CIYNMMGKR

SEQ ID NO: 221321 - protein, 9 aa, Japanese encephalitis virus
IYNMMGKRE

SEQ ID NO: 221322 - protein, 9 aa, Japanese encephalitis virus
YNMMGKREK

SEQ ID NO: 221323 - protein, 9 aa, Japanese encephalitis virus
NMMGKREKK

SEQ ID NO: 221324 - protein, 9 aa, Japanese encephalitis virus
MMGKREKKP

SEQ ID NO: 221325 - protein, 9 aa, Japanese encephalitis virus
MGKREKKPG

SEQ ID NO: 221326 - protein, 9 aa, Japanese encephalitis virus
GKREKKPGE

SEQ ID NO: 221327 - protein, 9 aa, Japanese encephalitis virus
KREKKPGEF

SEQ ID NO: 221328 - protein, 9 aa, Japanese encephalitis virus
REKKPGEFG

SEQ ID NO: 221329 - protein, 9 aa, Japanese encephalitis virus
EKKPGEFGK

SEQ ID NO: 221330 - protein, 9 aa, Japanese encephalitis virus
KKPGEFGKA

SEQ ID NO: 221331 - protein, 9 aa, Japanese encephalitis virus
KPGEFGKAK

SEQ ID NO: 221332 - protein, 9 aa, Japanese encephalitis virus
PGEFGKAKG

SEQ ID NO: 221333 - protein, 9 aa, Japanese encephalitis virus
GEFGKAKGS

SEQ ID NO: 221334 - protein, 9 aa, Japanese encephalitis virus
EFGKAKGSR

SEQ ID NO: 221335 - protein, 9 aa, Japanese encephalitis virus
FGKAKGSRA

SEQ ID NO: 221336 - protein, 9 aa, Japanese encephalitis virus
GKAKGSRAI

SEQ ID NO: 221337 - protein, 9 aa, Japanese encephalitis virus
KAKGSRAIW

SEQ ID NO: 221338 - protein, 9 aa, Japanese encephalitis virus
AKGSRAIWF

SEQ ID NO: 221339 - protein, 9 aa, Japanese encephalitis virus
KGSRAIWFM

SEQ ID NO: 221340 - protein, 9 aa, Japanese encephalitis virus
GSRAIWFMW

SEQ ID NO: 221341 - protein, 9 aa, Japanese encephalitis virus
SRAIWFMWL

SEQ ID NO: 221342 - protein, 9 aa, Japanese encephalitis virus
RAIWFMWLG

SEQ ID NO: 221343 - protein, 9 aa, Japanese encephalitis virus
AIWFMWLGA

SEQ ID NO: 221344 - protein, 9 aa, Japanese encephalitis virus
IWFMWLGAR

SEQ ID NO: 221345 - protein, 9 aa, Japanese encephalitis virus
WFMWLGARY

SEQ ID NO: 221346 - protein, 9 aa, Japanese encephalitis virus
FMWLGARYL

SEQ ID NO: 221347 - protein, 9 aa, Japanese encephalitis virus
MWLGARYLE

SEQ ID NO: 221348 - protein, 9 aa, Japanese encephalitis virus
WLGARYLEF

SEQ ID NO: 221349 - protein, 9 aa, Japanese encephalitis virus
LGARYLEFE

SEQ ID NO: 221350 - protein, 9 aa, Japanese encephalitis virus
GARYLEFEA

SEQ ID NO: 221351 - protein, 9 aa, Japanese encephalitis virus
ARYLEFEAL

SEQ ID NO: 221352 - protein, 9 aa, Japanese encephalitis virus
RYLEFEALG

SEQ ID NO: 221353 - protein, 9 aa, Japanese encephalitis virus
YLEFEALGF

SEQ ID NO: 221354 - protein, 9 aa, Japanese encephalitis virus
LEFEALGFL

SEQ ID NO: 221355 - protein, 9 aa, Japanese encephalitis virus
EFEALGFLN

SEQ ID NO: 221356 - protein, 9 aa, Japanese encephalitis virus
FEALGFLNE

SEQ ID NO: 221357 - protein, 9 aa, Japanese encephalitis virus
EALGFLNED

SEQ ID NO: 221358 - protein, 9 aa, Japanese encephalitis virus
ALGFLNEDH

SEQ ID NO: 221359 - protein, 9 aa, Japanese encephalitis virus
LGFLNEDHW

SEQ ID NO: 221360 - protein, 9 aa, Japanese encephalitis virus
GFLNEDHWL

SEQ ID NO: 221361 - protein, 9 aa, Japanese encephalitis virus
FLNEDHWLS

SEQ ID NO: 221362 - protein, 9 aa, Japanese encephalitis virus
LNEDHWLSR

SEQ ID NO: 221363 - protein, 9 aa, Japanese encephalitis virus
NEDHWLSRE

SEQ ID NO: 221364 - protein, 9 aa, Japanese encephalitis virus
EDHWLSREN

SEQ ID NO: 221365 - protein, 9 aa, Japanese encephalitis virus
DHWLSRENS

SEQ ID NO: 221366 - protein, 9 aa, Japanese encephalitis virus
HWLSRENSG

SEQ ID NO: 221367 - protein, 9 aa, Japanese encephalitis virus
WLSRENSGG

SEQ ID NO: 221368 - protein, 9 aa, Japanese encephalitis virus
LSRENSGGG

SEQ ID NO: 221369 - protein, 9 aa, Japanese encephalitis virus
SRENSGGGV

SEQ ID NO: 221370 - protein, 9 aa, Japanese encephalitis virus
RENSGGGVE

SEQ ID NO: 221371 - protein, 9 aa, Japanese encephalitis virus
ENSGGGVEG

SEQ ID NO: 221372 - protein, 9 aa, Japanese encephalitis virus
NSGGGVEGS

SEQ ID NO: 221373 - protein, 9 aa, Japanese encephalitis virus
SGGGVEGSG

SEQ ID NO: 221374 - protein, 9 aa, Japanese encephalitis virus
GGGVEGSGV

SEQ ID NO: 221375 - protein, 9 aa, Japanese encephalitis virus
GGVEGSGVQ

SEQ ID NO: 221376 - protein, 9 aa, Japanese encephalitis virus
GVEGSGVQK

SEQ ID NO: 221377 - protein, 9 aa, Japanese encephalitis virus
VEGSGVQKL

SEQ ID NO: 221378 - protein, 9 aa, Japanese encephalitis virus
EGSGVQKLG

SEQ ID NO: 221379 - protein, 9 aa, Japanese encephalitis virus
GSGVQKLGY

SEQ ID NO: 221380 - protein, 9 aa, Japanese encephalitis virus
SGVQKLGYI

SEQ ID NO: 221381 - protein, 9 aa, Japanese encephalitis virus
GVQKLGYIL

SEQ ID NO: 221382 - protein, 9 aa, Japanese encephalitis virus
VQKLGYILR

SEQ ID NO: 221383 - protein, 9 aa, Japanese encephalitis virus
QKLGYILRD

SEQ ID NO: 221384 - protein, 9 aa, Japanese encephalitis virus
KLGYILRDI

SEQ ID NO: 221385 - protein, 9 aa, Japanese encephalitis virus
LGYILRDIA

SEQ ID NO: 221386 - protein, 9 aa, Japanese encephalitis virus
RDIAGKQGG

SEQ ID NO: 221387 - protein, 9 aa, Japanese encephalitis virus
DIAGKQGGK

SEQ ID NO: 221388 - protein, 9 aa, Japanese encephalitis virus
IAGKQGGKM

SEQ ID NO: 221389 - protein, 9 aa, Japanese encephalitis virus
AGKQGGKMY

SEQ ID NO: 221390 - protein, 9 aa, Japanese encephalitis virus
GKQGGKMYA

SEQ ID NO: 221391 - protein, 9 aa, Japanese encephalitis virus
KQGGKMYAD

SEQ ID NO: 221392 - protein, 9 aa, Japanese encephalitis virus
QGGKMYADD

SEQ ID NO: 221393 - protein, 9 aa, Japanese encephalitis virus
GGKMYADDT

SEQ ID NO: 221394 - protein, 9 aa, Japanese encephalitis virus
GKMYADDTA

SEQ ID NO: 221395 - protein, 9 aa, Japanese encephalitis virus
KMYADDTAG

SEQ ID NO: 221396 - protein, 9 aa, Japanese encephalitis virus
MYADDTAGW

SEQ ID NO: 221397 - protein, 9 aa, Japanese encephalitis virus
YADDTAGWD

SEQ ID NO: 221398 - protein, 9 aa, Japanese encephalitis virus
ADDTAGWDT

SEQ ID NO: 221399 - protein, 9 aa, Japanese encephalitis virus
DDTAGWDTR

SEQ ID NO: 221400 - protein, 9 aa, Japanese encephalitis virus
DTAGWDTRI

SEQ ID NO: 221401 - protein, 9 aa, Japanese encephalitis virus
TAGWDTRIT

SEQ ID NO: 221402 - protein, 9 aa, Japanese encephalitis virus
AGWDTRITR

SEQ ID NO: 221403 - protein, 9 aa, Japanese encephalitis virus
GWDTRITRT

SEQ ID NO: 221404 - protein, 9 aa, Japanese encephalitis virus
WDTRITRTD

SEQ ID NO: 221405 - protein, 9 aa, Japanese encephalitis virus
DTRITRTDL

SEQ ID NO: 221406 - protein, 9 aa, Japanese encephalitis virus
TRITRTDLE

SEQ ID NO: 221407 - protein, 9 aa, Japanese encephalitis virus
RITRTDLEN

SEQ ID NO: 221408 - protein, 9 aa, Japanese encephalitis virus
ITRTDLENE

SEQ ID NO: 221409 - protein, 9 aa, Japanese encephalitis virus
TRTDLENEA

SEQ ID NO: 221410 - protein, 9 aa, Japanese encephalitis virus
RTDLENEAK

SEQ ID NO: 221411 - protein, 9 aa, Japanese encephalitis virus
TDLENEAKV

SEQ ID NO: 221412 - protein, 9 aa, Japanese encephalitis virus
DLENEAKVL

SEQ ID NO: 221413 - protein, 9 aa, Japanese encephalitis virus
LENEAKVLE

SEQ ID NO: 221414 - protein, 9 aa, Japanese encephalitis virus
ENEAKVLEL

SEQ ID NO: 221415 - protein, 9 aa, Japanese encephalitis virus
NEAKVLELL

SEQ ID NO: 221416 - protein, 9 aa, Japanese encephalitis virus
EAKVLELLD

SEQ ID NO: 221417 - protein, 9 aa, Japanese encephalitis virus
AKVLELLDG

SEQ ID NO: 221418 - protein, 9 aa, Japanese encephalitis virus
KVLELLDGE

SEQ ID NO: 221419 - protein, 9 aa, Japanese encephalitis virus
VLELLDGEH

SEQ ID NO: 221420 - protein, 9 aa, Japanese encephalitis virus
LELLDGEHR

SEQ ID NO: 221421 - protein, 9 aa, Japanese encephalitis virus
ELLDGEHRM

SEQ ID NO: 221422 - protein, 9 aa, Japanese encephalitis virus
LLDGEHRML

SEQ ID NO: 221423 - protein, 9 aa, Japanese encephalitis virus
LDGEHRMLA

SEQ ID NO: 221424 - protein, 9 aa, Japanese encephalitis virus
DGEHRMLAR

SEQ ID NO: 221425 - protein, 9 aa, Japanese encephalitis virus
GEHRMLARA

SEQ ID NO: 221426 - protein, 9 aa, Japanese encephalitis virus
EHRMLARAI

SEQ ID NO: 221427 - protein, 9 aa, Japanese encephalitis virus
HRMLARAII

SEQ ID NO: 221428 - protein, 9 aa, Japanese encephalitis virus
RMLARAIIE

SEQ ID NO: 221429 - protein, 9 aa, Japanese encephalitis virus
MLARAIIEL

SEQ ID NO: 221430 - protein, 9 aa, Japanese encephalitis virus
LARAIIELT

SEQ ID NO: 221431 - protein, 9 aa, Japanese encephalitis virus
ARAIIELTY

SEQ ID NO: 221432 - protein, 9 aa, Japanese encephalitis virus
RAIIELTYR

SEQ ID NO: 221433 - protein, 9 aa, Japanese encephalitis virus
AIIELTYRH

SEQ ID NO: 221434 - protein, 9 aa, Japanese encephalitis virus
IIELTYRHK

SEQ ID NO: 221435 - protein, 9 aa, Japanese encephalitis virus
IELTYRHKV

SEQ ID NO: 221436 - protein, 9 aa, Japanese encephalitis virus
ELTYRHKVV

SEQ ID NO: 221437 - protein, 9 aa, Japanese encephalitis virus
LTYRHKVVK

SEQ ID NO: 221438 - protein, 9 aa, Japanese encephalitis virus
TYRHKVVKV

SEQ ID NO: 221439 - protein, 9 aa, Japanese encephalitis virus
YRHKVVKVM

SEQ ID NO: 221440 - protein, 9 aa, Japanese encephalitis virus
RHKVVKVMR

SEQ ID NO: 221441 - protein, 9 aa, Japanese encephalitis virus
HKVVKVMRP

SEQ ID NO: 221442 - protein, 9 aa, Japanese encephalitis virus
KVVKVMRPA

SEQ ID NO: 221443 - protein, 9 aa, Japanese encephalitis virus
VVKVMRPAA

SEQ ID NO: 221444 - protein, 9 aa, Japanese encephalitis virus
KVMRPAAEG

SEQ ID NO: 221445 - protein, 9 aa, Japanese encephalitis virus
VMRPAAEGK

SEQ ID NO: 221446 - protein, 9 aa, Japanese encephalitis virus
MRPAAEGKT

SEQ ID NO: 221447 - protein, 9 aa, Japanese encephalitis virus
RPAAEGKTV

SEQ ID NO: 221448 - protein, 9 aa, Japanese encephalitis virus
PAAEGKTVM

SEQ ID NO: 221449 - protein, 9 aa, Japanese encephalitis virus
EGKTVMDVI

SEQ ID NO: 221450 - protein, 9 aa, Japanese encephalitis virus
GKTVMDVIS

SEQ ID NO: 221451 - protein, 9 aa, Japanese encephalitis virus
KTVMDVISR

SEQ ID NO: 221452 - protein, 9 aa, Japanese encephalitis virus
TVMDVISRE

SEQ ID NO: 221453 - protein, 9 aa, Japanese encephalitis virus
VMDVISRED

SEQ ID NO: 221454 - protein, 9 aa, Japanese encephalitis virus
MDVISREDQ

SEQ ID NO: 221455 - protein, 9 aa, Japanese encephalitis virus
DVISREDQR

SEQ ID NO: 221456 - protein, 9 aa, Japanese encephalitis virus
VISREDQRG

SEQ ID NO: 221457 - protein, 9 aa, Japanese encephalitis virus
ISREDQRGS

SEQ ID NO: 221458 - protein, 9 aa, Japanese encephalitis virus
SREDQRGSG

SEQ ID NO: 221459 - protein, 9 aa, Japanese encephalitis virus
REDQRGSGQ

SEQ ID NO: 221460 - protein, 9 aa, Japanese encephalitis virus
EDQRGSGQV

SEQ ID NO: 221461 - protein, 9 aa, Japanese encephalitis virus
DQRGSGQVV

SEQ ID NO: 221462 - protein, 9 aa, Japanese encephalitis virus
QRGSGQVVT

SEQ ID NO: 221463 - protein, 9 aa, Japanese encephalitis virus
RGSGQVVTY

SEQ ID NO: 221464 - protein, 9 aa, Japanese encephalitis virus
GSGQVVTYA

SEQ ID NO: 221465 - protein, 9 aa, Japanese encephalitis virus
SGQVVTYAL

SEQ ID NO: 221466 - protein, 9 aa, Japanese encephalitis virus
GQVVTYALN

SEQ ID NO: 221467 - protein, 9 aa, Japanese encephalitis virus
QVVTYALNT

SEQ ID NO: 221468 - protein, 9 aa, Japanese encephalitis virus
VVTYALNTF

SEQ ID NO: 221469 - protein, 9 aa, Japanese encephalitis virus
VTYALNTFT

SEQ ID NO: 221470 - protein, 9 aa, Japanese encephalitis virus
TYALNTFTN

SEQ ID NO: 221471 - protein, 9 aa, Japanese encephalitis virus
YALNTFTNI

SEQ ID NO: 221472 - protein, 9 aa, Japanese encephalitis virus
ALNTFTNIA

SEQ ID NO: 221473 - protein, 9 aa, Japanese encephalitis virus
LNTFTNIAV

SEQ ID NO: 221474 - protein, 9 aa, Japanese encephalitis virus
NTFTNIAVQ

SEQ ID NO: 221475 - protein, 9 aa, Japanese encephalitis virus
TFTNIAVQL

SEQ ID NO: 221476 - protein, 9 aa, Japanese encephalitis virus
FTNIAVQLV

SEQ ID NO: 221477 - protein, 9 aa, Japanese encephalitis virus
TNIAVQLVR

SEQ ID NO: 221478 - protein, 9 aa, Japanese encephalitis virus
NIAVQLVRL

SEQ ID NO: 221479 - protein, 9 aa, Japanese encephalitis virus
IAVQLVRLM

SEQ ID NO: 221480 - protein, 9 aa, Japanese encephalitis virus
AVQLVRLME

SEQ ID NO: 221481 - protein, 9 aa, Japanese encephalitis virus
VQLVRLMEA

SEQ ID NO: 221482 - protein, 9 aa, Japanese encephalitis virus
QLVRLMEAE

SEQ ID NO: 221483 - protein, 9 aa, Japanese encephalitis virus
LVRLMEAEG

SEQ ID NO: 221484 - protein, 9 aa, Japanese encephalitis virus
VRLMEAEGV

SEQ ID NO: 221485 - protein, 9 aa, Japanese encephalitis virus
RLMEAEGVI

SEQ ID NO: 221486 - protein, 9 aa, Japanese encephalitis virus
LMEAEGVIG

SEQ ID NO: 221487 - protein, 9 aa, Japanese encephalitis virus
MEAEGVIGP

SEQ ID NO: 221488 - protein, 9 aa, Japanese encephalitis virus
EAEGVIGPQ

SEQ ID NO: 221489 - protein, 9 aa, Japanese encephalitis virus
AEGVIGPQH

SEQ ID NO: 221490 - protein, 9 aa, Japanese encephalitis virus
EGVIGPQHL

SEQ ID NO: 221491 - protein, 9 aa, Japanese encephalitis virus
GVIGPQHLE

SEQ ID NO: 221492 - protein, 9 aa, Japanese encephalitis virus
VIGPQHLEQ

SEQ ID NO: 221493 - protein, 9 aa, Japanese encephalitis virus
IGPQHLEQL

SEQ ID NO: 221494 - protein, 9 aa, Japanese encephalitis virus
GPQHLEQLP

SEQ ID NO: 221495 - protein, 9 aa, Japanese encephalitis virus
PQHLEQLPR

SEQ ID NO: 221496 - protein, 9 aa, Japanese encephalitis virus
QHLEQLPRK

SEQ ID NO: 221497 - protein, 9 aa, Japanese encephalitis virus
EQLPRKNKI

SEQ ID NO: 221498 - protein, 9 aa, Japanese encephalitis virus
QLPRKNKIA

SEQ ID NO: 221499 - protein, 9 aa, Japanese encephalitis virus
LPRKNKIAV

SEQ ID NO: 221500 - protein, 9 aa, Japanese encephalitis virus
PRKNKIAVR

SEQ ID NO: 221501 - protein, 9 aa, Japanese encephalitis virus
RKNKIAVRT

SEQ ID NO: 221502 - protein, 9 aa, Japanese encephalitis virus
KNKIAVRTW

SEQ ID NO: 221503 - protein, 9 aa, Japanese encephalitis virus
NKIAVRTWL

SEQ ID NO: 221504 - protein, 9 aa, Japanese encephalitis virus
KIAVRTWLF

SEQ ID NO: 221505 - protein, 9 aa, Japanese encephalitis virus
IAVRTWLFE

SEQ ID NO: 221506 - protein, 9 aa, Japanese encephalitis virus
AVRTWLFEN

SEQ ID NO: 221507 - protein, 9 aa, Japanese encephalitis virus
VRTWLFENG

SEQ ID NO: 221508 - protein, 9 aa, Japanese encephalitis virus
RTWLFENGE

SEQ ID NO: 221509 - protein, 9 aa, Japanese encephalitis virus
TWLFENGEE

SEQ ID NO: 221510 - protein, 9 aa, Japanese encephalitis virus
WLFENGEER

SEQ ID NO: 221511 - protein, 9 aa, Japanese encephalitis virus
LFENGEERV

SEQ ID NO: 221512 - protein, 9 aa, Japanese encephalitis virus
FENGEERVT

SEQ ID NO: 221513 - protein, 9 aa, Japanese encephalitis virus
ENGEERVTR

SEQ ID NO: 221514 - protein, 9 aa, Japanese encephalitis virus
NGEERVTRM

SEQ ID NO: 221515 - protein, 9 aa, Japanese encephalitis virus
GEERVTRMA

SEQ ID NO: 221516 - protein, 9 aa, Japanese encephalitis virus
EERVTRMAI

SEQ ID NO: 221517 - protein, 9 aa, Japanese encephalitis virus
ERVTRMAIS

SEQ ID NO: 221518 - protein, 9 aa, Japanese encephalitis virus
RVTRMAISG

SEQ ID NO: 221519 - protein, 9 aa, Japanese encephalitis virus
VTRMAISGD

SEQ ID NO: 221520 - protein, 9 aa, Japanese encephalitis virus
TRMAISGDD

SEQ ID NO: 221521 - protein, 9 aa, Japanese encephalitis virus
RMAISGDDC

SEQ ID NO: 221522 - protein, 9 aa, Japanese encephalitis virus
MAISGDDCV

SEQ ID NO: 221523 - protein, 9 aa, Japanese encephalitis virus
AISGDDCVV

SEQ ID NO: 221524 - protein, 9 aa, Japanese encephalitis virus
ISGDDCVVK

SEQ ID NO: 221525 - protein, 9 aa, Japanese encephalitis virus
SGDDCVVKP

SEQ ID NO: 221526 - protein, 9 aa, Japanese encephalitis virus
GDDCVVKPL

SEQ ID NO: 221527 - protein, 9 aa, Japanese encephalitis virus
DDCVVKPLD

SEQ ID NO: 221528 - protein, 9 aa, Japanese encephalitis virus
DCVVKPLDD

SEQ ID NO: 221529 - protein, 9 aa, Japanese encephalitis virus
CVVKPLDDR

SEQ ID NO: 221530 - protein, 9 aa, Japanese encephalitis virus
VVKPLDDRF

SEQ ID NO: 221531 - protein, 9 aa, Japanese encephalitis virus
VKPLDDRFA

SEQ ID NO: 221532 - protein, 9 aa, Japanese encephalitis virus
KPLDDRFAT

SEQ ID NO: 221533 - protein, 9 aa, Japanese encephalitis virus
PLDDRFATA

SEQ ID NO: 221534 - protein, 9 aa, Japanese encephalitis virus
LDDRFATAL

SEQ ID NO: 221535 - protein, 9 aa, Japanese encephalitis virus
DDRFATALH

SEQ ID NO: 221536 - protein, 9 aa, Japanese encephalitis virus
DRFATALHF

SEQ ID NO: 221537 - protein, 9 aa, Japanese encephalitis virus
RFATALHFL

SEQ ID NO: 221538 - protein, 9 aa, Japanese encephalitis virus
FATALHFLN

SEQ ID NO: 221539 - protein, 9 aa, Japanese encephalitis virus
ATALHFLNA

SEQ ID NO: 221540 - protein, 9 aa, Japanese encephalitis virus
TALHFLNAM

SEQ ID NO: 221541 - protein, 9 aa, Japanese encephalitis virus
ALHFLNAMS

SEQ ID NO: 221542 - protein, 9 aa, Japanese encephalitis virus
LHFLNAMSK

SEQ ID NO: 221543 - protein, 9 aa, Japanese encephalitis virus
HFLNAMSKV

SEQ ID NO: 221544 - protein, 9 aa, Japanese encephalitis virus
FLNAMSKVR

SEQ ID NO: 221545 - protein, 9 aa, Japanese encephalitis virus
LNAMSKVRK

SEQ ID NO: 221546 - protein, 9 aa, Japanese encephalitis virus
NAMSKVRKD

SEQ ID NO: 221547 - protein, 9 aa, Japanese encephalitis virus
AMSKVRKDI

SEQ ID NO: 221548 - protein, 9 aa, Japanese encephalitis virus
MSKVRKDIQ

SEQ ID NO: 221549 - protein, 9 aa, Japanese encephalitis virus
SKVRKDIQE

SEQ ID NO: 221550 - protein, 9 aa, Japanese encephalitis virus
KVRKDIQEW

SEQ ID NO: 221551 - protein, 9 aa, Japanese encephalitis virus
VRKDIQEWK

SEQ ID NO: 221552 - protein, 9 aa, Japanese encephalitis virus
RKDIQEWKP

SEQ ID NO: 221553 - protein, 9 aa, Japanese encephalitis virus
KDIQEWKPS

SEQ ID NO: 221554 - protein, 9 aa, Japanese encephalitis virus
DIQEWKPSH

SEQ ID NO: 221555 - protein, 9 aa, Japanese encephalitis virus
IQEWKPSHG

SEQ ID NO: 221556 - protein, 9 aa, Japanese encephalitis virus
QEWKPSHGW

SEQ ID NO: 221557 - protein, 9 aa, Japanese encephalitis virus
EWKPSHGWH

SEQ ID NO: 221558 - protein, 9 aa, Japanese encephalitis virus
WKPSHGWHD

SEQ ID NO: 221559 - protein, 9 aa, Japanese encephalitis virus
KPSHGWHDW

SEQ ID NO: 221560 - protein, 9 aa, Japanese encephalitis virus
PSHGWHDWQ

SEQ ID NO: 221561 - protein, 9 aa, Japanese encephalitis virus
SHGWHDWQQ

SEQ ID NO: 221562 - protein, 9 aa, Japanese encephalitis virus
HGWHDWQQV

SEQ ID NO: 221563 - protein, 9 aa, Japanese encephalitis virus
GWHDWQQVP

SEQ ID NO: 221564 - protein, 9 aa, Japanese encephalitis virus
WHDWQQVPF

SEQ ID NO: 221565 - protein, 9 aa, Japanese encephalitis virus
HDWQQVPFC

SEQ ID NO: 221566 - protein, 9 aa, Japanese encephalitis virus
DWQQVPFCS

SEQ ID NO: 221567 - protein, 9 aa, Japanese encephalitis virus
WQQVPFCSN

SEQ ID NO: 221568 - protein, 9 aa, Japanese encephalitis virus
QQVPFCSNH

SEQ ID NO: 221569 - protein, 9 aa, Japanese encephalitis virus
QVPFCSNHF

SEQ ID NO: 221570 - protein, 9 aa, Japanese encephalitis virus
VPFCSNHFQ

SEQ ID NO: 221571 - protein, 9 aa, Japanese encephalitis virus
PFCSNHFQE

SEQ ID NO: 221572 - protein, 9 aa, Japanese encephalitis virus
FCSNHFQEI

SEQ ID NO: 221573 - protein, 9 aa, Japanese encephalitis virus
CSNHFQEIV

SEQ ID NO: 221574 - protein, 9 aa, Japanese encephalitis virus
SNHFQEIVM

SEQ ID NO: 221575 - protein, 9 aa, Japanese encephalitis virus
NHFQEIVMK

SEQ ID NO: 221576 - protein, 9 aa, Japanese encephalitis virus
HFQEIVMKD

SEQ ID NO: 221577 - protein, 9 aa, Japanese encephalitis virus
FQEIVMKDG

SEQ ID NO: 221578 - protein, 9 aa, Japanese encephalitis virus
QEIVMKDGR

SEQ ID NO: 221579 - protein, 9 aa, Japanese encephalitis virus
EIVMKDGRS

SEQ ID NO: 221580 - protein, 9 aa, Japanese encephalitis virus
IVMKDGRSI

SEQ ID NO: 221581 - protein, 9 aa, Japanese encephalitis virus
VMKDGRSIV

SEQ ID NO: 221582 - protein, 9 aa, Japanese encephalitis virus
MKDGRSIVV

SEQ ID NO: 221583 - protein, 9 aa, Japanese encephalitis virus
KDGRSIVVP

SEQ ID NO: 221584 - protein, 9 aa, Japanese encephalitis virus
DGRSIVVPC

SEQ ID NO: 221585 - protein, 9 aa, Japanese encephalitis virus
GRSIVVPCR

SEQ ID NO: 221586 - protein, 9 aa, Japanese encephalitis virus
RSIVVPCRG

SEQ ID NO: 221587 - protein, 9 aa, Japanese encephalitis virus
SIVVPCRGQ

SEQ ID NO: 221588 - protein, 9 aa, Japanese encephalitis virus
IVVPCRGQD

SEQ ID NO: 221589 - protein, 9 aa, Japanese encephalitis virus
VVPCRGQDE

SEQ ID NO: 221590 - protein, 9 aa, Japanese encephalitis virus
VPCRGQDEL

SEQ ID NO: 221591 - protein, 9 aa, Japanese encephalitis virus
PCRGQDELI

SEQ ID NO: 221592 - protein, 9 aa, Japanese encephalitis virus
CRGQDELIG

SEQ ID NO: 221593 - protein, 9 aa, Japanese encephalitis virus
RGQDELIGR

SEQ ID NO: 221594 - protein, 9 aa, Japanese encephalitis virus
GQDELIGRA

SEQ ID NO: 221595 - protein, 9 aa, Japanese encephalitis virus
QDELIGRAR

SEQ ID NO: 221596 - protein, 9 aa, Japanese encephalitis virus
DELIGRARI

SEQ ID NO: 221597 - protein, 9 aa, Japanese encephalitis virus
ELIGRARIS

SEQ ID NO: 221598 - protein, 9 aa, Japanese encephalitis virus
LIGRARISP

SEQ ID NO: 221599 - protein, 9 aa, Japanese encephalitis virus
IGRARISPG

SEQ ID NO: 221600 - protein, 9 aa, Japanese encephalitis virus
GRARISPGA

SEQ ID NO: 221601 - protein, 9 aa, Japanese encephalitis virus
RARISPGAG

SEQ ID NO: 221602 - protein, 9 aa, Japanese encephalitis virus
ARISPGAGW

SEQ ID NO: 221603 - protein, 9 aa, Japanese encephalitis virus
RISPGAGWN

SEQ ID NO: 221604 - protein, 9 aa, Japanese encephalitis virus
ISPGAGWNV

SEQ ID NO: 221605 - protein, 9 aa, Japanese encephalitis virus
SPGAGWNVK

SEQ ID NO: 221606 - protein, 9 aa, Japanese encephalitis virus
PGAGWNVKD

SEQ ID NO: 221607 - protein, 9 aa, Japanese encephalitis virus
GAGWNVKDT

SEQ ID NO: 221608 - protein, 9 aa, Japanese encephalitis virus
AGWNVKDTA

SEQ ID NO: 221609 - protein, 9 aa, Japanese encephalitis virus
GWNVKDTAC

SEQ ID NO: 221610 - protein, 9 aa, Japanese encephalitis virus
WNVKDTACL

SEQ ID NO: 221611 - protein, 9 aa, Japanese encephalitis virus
NVKDTACLA

SEQ ID NO: 221612 - protein, 9 aa, Japanese encephalitis virus
VKDTACLAK

SEQ ID NO: 221613 - protein, 9 aa, Japanese encephalitis virus
KDTACLAKA

SEQ ID NO: 221614 - protein, 9 aa, Japanese encephalitis virus
DTACLAKAY

SEQ ID NO: 221615 - protein, 9 aa, Japanese encephalitis virus
TACLAKAYA

SEQ ID NO: 221616 - protein, 9 aa, Japanese encephalitis virus
ACLAKAYAQ

SEQ ID NO: 221617 - protein, 9 aa, Japanese encephalitis virus
CLAKAYAQM

SEQ ID NO: 221618 - protein, 9 aa, Japanese encephalitis virus
LAKAYAQMW

SEQ ID NO: 221619 - protein, 9 aa, Japanese encephalitis virus
AKAYAQMWL

SEQ ID NO: 221620 - protein, 9 aa, Japanese encephalitis virus
KAYAQMWLL

SEQ ID NO: 221621 - protein, 9 aa, Japanese encephalitis virus
AYAQMWLLL

SEQ ID NO: 221622 - protein, 9 aa, Japanese encephalitis virus
YAQMWLLLY

SEQ ID NO: 221623 - protein, 9 aa, Japanese encephalitis virus
AQMWLLLYF

SEQ ID NO: 221624 - protein, 9 aa, Japanese encephalitis virus
QMWLLLYFH

SEQ ID NO: 221625 - protein, 9 aa, Japanese encephalitis virus
MWLLLYFHR

SEQ ID NO: 221626 - protein, 9 aa, Japanese encephalitis virus
WLLLYFHRR

SEQ ID NO: 221627 - protein, 9 aa, Japanese encephalitis virus
LLLYFHRRD

SEQ ID NO: 221628 - protein, 9 aa, Japanese encephalitis virus
LLYFHRRDL

SEQ ID NO: 221629 - protein, 9 aa, Japanese encephalitis virus
LYFHRRDLR

SEQ ID NO: 221630 - protein, 9 aa, Japanese encephalitis virus
YFHRRDLRL

SEQ ID NO: 221631 - protein, 9 aa, Japanese encephalitis virus
FHRRDLRLM

SEQ ID NO: 221632 - protein, 9 aa, Japanese encephalitis virus
HRRDLRLMA

SEQ ID NO: 221633 - protein, 9 aa, Japanese encephalitis virus
RRDLRLMAN

SEQ ID NO: 221634 - protein, 9 aa, Japanese encephalitis virus
RDLRLMANA

SEQ ID NO: 221635 - protein, 9 aa, Japanese encephalitis virus
DLRLMANAI

SEQ ID NO: 221636 - protein, 9 aa, Japanese encephalitis virus
LRLMANAIC

SEQ ID NO: 221637 - protein, 9 aa, Japanese encephalitis virus
RLMANAICS

SEQ ID NO: 221638 - protein, 9 aa, Japanese encephalitis virus
LMANAICSA

SEQ ID NO: 221639 - protein, 9 aa, Japanese encephalitis virus
MANAICSAV

SEQ ID NO: 221640 - protein, 9 aa, Japanese encephalitis virus
ANAICSAVP

SEQ ID NO: 221641 - protein, 9 aa, Japanese encephalitis virus
NAICSAVPV

SEQ ID NO: 221642 - protein, 9 aa, Japanese encephalitis virus
AICSAVPVD

SEQ ID NO: 221643 - protein, 9 aa, Japanese encephalitis virus
ICSAVPVDW

SEQ ID NO: 221644 - protein, 9 aa, Japanese encephalitis virus
CSAVPVDWV

SEQ ID NO: 221645 - protein, 9 aa, Japanese encephalitis virus
SAVPVDWVP

SEQ ID NO: 221646 - protein, 9 aa, Japanese encephalitis virus
AVPVDWVPT

SEQ ID NO: 221647 - protein, 9 aa, Japanese encephalitis virus
VPVDWVPTG

SEQ ID NO: 221648 - protein, 9 aa, Japanese encephalitis virus
PVDWVPTGR

SEQ ID NO: 221649 - protein, 9 aa, Japanese encephalitis virus
VDWVPTGRT

SEQ ID NO: 221650 - protein, 9 aa, Japanese encephalitis virus
DWVPTGRTS

SEQ ID NO: 221651 - protein, 9 aa, Japanese encephalitis virus
WVPTGRTSW

SEQ ID NO: 221652 - protein, 9 aa, Japanese encephalitis virus
VPTGRTSWS

SEQ ID NO: 221653 - protein, 9 aa, Japanese encephalitis virus
PTGRTSWSI

SEQ ID NO: 221654 - protein, 9 aa, Japanese encephalitis virus
TGRTSWSIH

SEQ ID NO: 221655 - protein, 9 aa, Japanese encephalitis virus
GRTSWSIHS

SEQ ID NO: 221656 - protein, 9 aa, Japanese encephalitis virus
RTSWSIHSK

SEQ ID NO: 221657 - protein, 9 aa, Japanese encephalitis virus
TSWSIHSKG

SEQ ID NO: 221658 - protein, 9 aa, Japanese encephalitis virus
SWSIHSKGE

SEQ ID NO: 221659 - protein, 9 aa, Japanese encephalitis virus
WSIHSKGEW

SEQ ID NO: 221660 - protein, 9 aa, Japanese encephalitis virus
SIHSKGEWM

SEQ ID NO: 221661 - protein, 9 aa, Japanese encephalitis virus
IHSKGEWMT

SEQ ID NO: 221662 - protein, 9 aa, Japanese encephalitis virus
HSKGEWMTT

SEQ ID NO: 221663 - protein, 9 aa, Japanese encephalitis virus
SKGEWMTTE

SEQ ID NO: 221664 - protein, 9 aa, Japanese encephalitis virus
KGEWMTTED

SEQ ID NO: 221665 - protein, 9 aa, Japanese encephalitis virus
GEWMTTEDM

SEQ ID NO: 221666 - protein, 9 aa, Japanese encephalitis virus
EWMTTEDML

SEQ ID NO: 221667 - protein, 9 aa, Japanese encephalitis virus
WMTTEDMLQ

SEQ ID NO: 221668 - protein, 9 aa, Japanese encephalitis virus
MTTEDMLQV

SEQ ID NO: 221669 - protein, 9 aa, Japanese encephalitis virus
TTEDMLQVW

SEQ ID NO: 221670 - protein, 9 aa, Japanese encephalitis virus
TEDMLQVWN

SEQ ID NO: 221671 - protein, 9 aa, Japanese encephalitis virus
EDMLQVWNR

SEQ ID NO: 221672 - protein, 9 aa, Japanese encephalitis virus
DMLQVWNRV

SEQ ID NO: 221673 - protein, 9 aa, Japanese encephalitis virus
MLQVWNRVW

SEQ ID NO: 221674 - protein, 9 aa, Japanese encephalitis virus
LQVWNRVWI

SEQ ID NO: 221675 - protein, 9 aa, Japanese encephalitis virus
QVWNRVWIE

SEQ ID NO: 221676 - protein, 9 aa, Japanese encephalitis virus
VWNRVWIEE

SEQ ID NO: 221677 - protein, 9 aa, Japanese encephalitis virus
WNRVWIEEN

SEQ ID NO: 221678 - protein, 9 aa, Japanese encephalitis virus
NRVWIEENE

SEQ ID NO: 221679 - protein, 9 aa, Japanese encephalitis virus
RVWIEENEW

SEQ ID NO: 221680 - protein, 9 aa, Japanese encephalitis virus
VWIEENEWM

SEQ ID NO: 221681 - protein, 9 aa, Japanese encephalitis virus
WIEENEWMM

SEQ ID NO: 221682 - protein, 9 aa, Japanese encephalitis virus
IEENEWMMD

SEQ ID NO: 221683 - protein, 9 aa, Japanese encephalitis virus
EENEWMMDK

SEQ ID NO: 221684 - protein, 9 aa, Japanese encephalitis virus
ENEWMMDKT

SEQ ID NO: 221685 - protein, 9 aa, Japanese encephalitis virus
NEWMMDKTP

SEQ ID NO: 221686 - protein, 9 aa, Japanese encephalitis virus
DKTPITSWT

SEQ ID NO: 221687 - protein, 9 aa, Japanese encephalitis virus
KTPITSWTD

SEQ ID NO: 221688 - protein, 9 aa, Japanese encephalitis virus
TPITSWTDV

SEQ ID NO: 221689 - protein, 9 aa, Japanese encephalitis virus
PITSWTDVP

SEQ ID NO: 221690 - protein, 9 aa, Japanese encephalitis virus
ITSWTDVPY

SEQ ID NO: 221691 - protein, 9 aa, Japanese encephalitis virus
TSWTDVPYV

SEQ ID NO: 221692 - protein, 9 aa, Japanese encephalitis virus
SWTDVPYVG

SEQ ID NO: 221693 - protein, 9 aa, Japanese encephalitis virus
WTDVPYVGK

SEQ ID NO: 221694 - protein, 9 aa, Japanese encephalitis virus
TDVPYVGKR

SEQ ID NO: 221695 - protein, 9 aa, Japanese encephalitis virus
DVPYVGKRE

SEQ ID NO: 221696 - protein, 9 aa, Japanese encephalitis virus
VPYVGKRED

SEQ ID NO: 221697 - protein, 9 aa, Japanese encephalitis virus
PYVGKREDI

SEQ ID NO: 221698 - protein, 9 aa, Japanese encephalitis virus
YVGKREDIW

SEQ ID NO: 221699 - protein, 9 aa, Japanese encephalitis virus
VGKREDIWC

SEQ ID NO: 221700 - protein, 9 aa, Japanese encephalitis virus
GKREDIWCG

SEQ ID NO: 221701 - protein, 9 aa, Japanese encephalitis virus
KREDIWCGS

SEQ ID NO: 221702 - protein, 9 aa, Japanese encephalitis virus
REDIWCGSL

SEQ ID NO: 221703 - protein, 9 aa, Japanese encephalitis virus
EDIWCGSLI

SEQ ID NO: 221704 - protein, 9 aa, Japanese encephalitis virus
DIWCGSLIG

SEQ ID NO: 221705 - protein, 9 aa, Japanese encephalitis virus
IWCGSLIGT

SEQ ID NO: 221706 - protein, 9 aa, Japanese encephalitis virus
WCGSLIGTR

SEQ ID NO: 221707 - protein, 9 aa, Japanese encephalitis virus
CGSLIGTRS

SEQ ID NO: 221708 - protein, 9 aa, Japanese encephalitis virus
GSLIGTRSR

SEQ ID NO: 221709 - protein, 9 aa, Japanese encephalitis virus
SLIGTRSRA

SEQ ID NO: 221710 - protein, 9 aa, Japanese encephalitis virus
LIGTRSRAT

SEQ ID NO: 221711 - protein, 9 aa, Japanese encephalitis virus
IGTRSRATW

SEQ ID NO: 221712 - protein, 9 aa, Japanese encephalitis virus
GTRSRATWA

SEQ ID NO: 221713 - protein, 9 aa, Japanese encephalitis virus
TRSRATWAE

SEQ ID NO: 221714 - protein, 9 aa, Japanese encephalitis virus
RSRATWAEN

SEQ ID NO: 221715 - protein, 9 aa, Japanese encephalitis virus
SRATWAENI

SEQ ID NO: 221716 - protein, 9 aa, Japanese encephalitis virus
RATWAENIY

SEQ ID NO: 221717 - protein, 9 aa, Japanese encephalitis virus
ATWAENIYA

SEQ ID NO: 221718 - protein, 9 aa, Japanese encephalitis virus
TWAENIYAA

SEQ ID NO: 221719 - protein, 9 aa, Japanese encephalitis virus
WAENIYAAI

SEQ ID NO: 221720 - protein, 9 aa, Japanese encephalitis virus
AENIYAAIN

SEQ ID NO: 221721 - protein, 9 aa, Japanese encephalitis virus
ENIYAAINQ

SEQ ID NO: 221722 - protein, 9 aa, Japanese encephalitis virus
NIYAAINQV

SEQ ID NO: 221723 - protein, 9 aa, Japanese encephalitis virus
IYAAINQVR

SEQ ID NO: 221724 - protein, 9 aa, Japanese encephalitis virus
YAAINQVRA

SEQ ID NO: 221725 - protein, 9 aa, Japanese encephalitis virus
AAINQVRAV

SEQ ID NO: 221726 - protein, 9 aa, Japanese encephalitis virus
AINQVRAVI

SEQ ID NO: 221727 - protein, 9 aa, Japanese encephalitis virus
INQVRAVIG

SEQ ID NO: 221728 - protein, 9 aa, Japanese encephalitis virus
NQVRAVIGK

SEQ ID NO: 221729 - protein, 9 aa, Japanese encephalitis virus
QVRAVIGKE

SEQ ID NO: 221730 - protein, 9 aa, Japanese encephalitis virus
VRAVIGKEN

SEQ ID NO: 221731 - protein, 9 aa, Japanese encephalitis virus
RAVIGKENY

SEQ ID NO: 221732 - protein, 9 aa, Japanese encephalitis virus
AVIGKENYV

SEQ ID NO: 221733 - protein, 9 aa, Japanese encephalitis virus
VIGKENYVD

SEQ ID NO: 221734 - protein, 9 aa, Japanese encephalitis virus
IGKENYVDY

SEQ ID NO: 221735 - protein, 9 aa, Japanese encephalitis virus
GKENYVDYM

SEQ ID NO: 221736 - protein, 9 aa, Japanese encephalitis virus
KENYVDYMT

SEQ ID NO: 221737 - protein, 9 aa, Japanese encephalitis virus
ENYVDYMTS

SEQ ID NO: 221738 - protein, 9 aa, Japanese encephalitis virus
NYVDYMTSL

SEQ ID NO: 221739 - protein, 9 aa, Japanese encephalitis virus
YVDYMTSLR

SEQ ID NO: 221740 - protein, 9 aa, Japanese encephalitis virus
VDYMTSLRR

SEQ ID NO: 221741 - protein, 9 aa, Japanese encephalitis virus
DYMTSLRRY

SEQ ID NO: 221742 - protein, 9 aa, Japanese encephalitis virus
YMTSLRRYE

SEQ ID NO: 221743 - protein, 9 aa, Japanese encephalitis virus
MTSLRRYED

SEQ ID NO: 221744 - protein, 9 aa, Japanese encephalitis virus
TSLRRYEDV

SEQ ID NO: 221745 - protein, 9 aa, Japanese encephalitis virus
SLRRYEDVL

SEQ ID NO: 221746 - protein, 9 aa, Japanese encephalitis virus
LRRYEDVLI

SEQ ID NO: 221747 - protein, 9 aa, Japanese encephalitis virus
RRYEDVLIQ

SEQ ID NO: 221748 - protein, 9 aa, Japanese encephalitis virus
RYEDVLIQE

SEQ ID NO: 221749 - protein, 9 aa, Japanese encephalitis virus
YEDVLIQED

SEQ ID NO: 221750 - protein, 9 aa, Japanese encephalitis virus
EDVLIQEDR

SEQ ID NO: 221751 - protein, 9 aa, Japanese encephalitis virus
DVLIQEDRV

SEQ ID NO: 221752 - protein, 9 aa, Japanese encephalitis virus
VLIQEDRVI

SEQ ID NO: 221753 - protein, 9 aa, Japanese encephalitis virus
MTKKPRGPG

SEQ ID NO: 221754 - protein, 9 aa, Japanese encephalitis virus
TKKPGGPGR

SEQ ID NO: 221755 - protein, 9 aa, Japanese encephalitis virus
KKPGGPGRN

SEQ ID NO: 221756 - protein, 9 aa, Japanese encephalitis virus
KPGGPGRNR

SEQ ID NO: 221757 - protein, 9 aa, Japanese encephalitis virus
PGGPGRNRA

SEQ ID NO: 221758 - protein, 9 aa, Japanese encephalitis virus
GGPGRNRAI

SEQ ID NO: 221759 - protein, 9 aa, Japanese encephalitis virus
GPGRNRAIN

SEQ ID NO: 221760 - protein, 9 aa, Japanese encephalitis virus
PGRNRAINM

SEQ ID NO: 221761 - protein, 9 aa, Japanese encephalitis virus
GRNRAINML

SEQ ID NO: 221762 - protein, 9 aa, Japanese encephalitis virus
RNRAINMLK

SEQ ID NO: 221763 - protein, 9 aa, Japanese encephalitis virus
NRAIYMLKR

SEQ ID NO: 221764 - protein, 9 aa, Japanese encephalitis virus
RAIYMLKRG

SEQ ID NO: 221765 - protein, 9 aa, Japanese encephalitis virus
AIYMLKRGL

SEQ ID NO: 221766 - protein, 9 aa, Japanese encephalitis virus
IYMLKRGLP

SEQ ID NO: 221767 - protein, 9 aa, Japanese encephalitis virus
YMLKRGLPR

SEQ ID NO: 221768 - protein, 9 aa, Japanese encephalitis virus
LPRVFPLVR

SEQ ID NO: 221769 - protein, 9 aa, Japanese encephalitis virus
PRVFPLVRV

SEQ ID NO: 221770 - protein, 9 aa, Japanese encephalitis virus
RVFPLVRVK

SEQ ID NO: 221771 - protein, 9 aa, Japanese encephalitis virus
VFPLVRVKR

SEQ ID NO: 221772 - protein, 9 aa, Japanese encephalitis virus
FPLVGVKKV

SEQ ID NO: 221773 - protein, 9 aa, Japanese encephalitis virus
PLVRVKRVV

SEQ ID NO: 221774 - protein, 9 aa, Japanese encephalitis virus
LVRVKRVVM

SEQ ID NO: 221775 - protein, 9 aa, Japanese encephalitis virus
VGVKKVVMS

SEQ ID NO: 221776 - protein, 9 aa, Japanese encephalitis virus
GVKRVVISL

SEQ ID NO: 221777 - protein, 9 aa, Japanese encephalitis virus
VKKVVMSLL

SEQ ID NO: 221778 - protein, 9 aa, Japanese encephalitis virus
KRVVISLLD

SEQ ID NO: 221779 - protein, 9 aa, Japanese encephalitis virus
KVVMSLLDG

SEQ ID NO: 221780 - protein, 9 aa, Japanese encephalitis virus
VVISLLDGI

SEQ ID NO: 221781 - protein, 9 aa, Japanese encephalitis virus
VISLLDGIG

SEQ ID NO: 221782 - protein, 9 aa, Japanese encephalitis virus
ISLLDGIGP

SEQ ID NO: 221783 - protein, 9 aa, Japanese encephalitis virus
SLLDGRGPA

SEQ ID NO: 221784 - protein, 9 aa, Japanese encephalitis virus
LLDGRGPAR

SEQ ID NO: 221785 - protein, 9 aa, Japanese encephalitis virus
LDGRGPARF

SEQ ID NO: 221786 - protein, 9 aa, Japanese encephalitis virus
DGRGPARFV

SEQ ID NO: 221787 - protein, 9 aa, Japanese encephalitis virus
GRGPARFVL

SEQ ID NO: 221788 - protein, 9 aa, Japanese encephalitis virus
RGPARFVLA

SEQ ID NO: 221789 - protein, 9 aa, Japanese encephalitis virus
GPARFVLAL

SEQ ID NO: 221790 - protein, 9 aa, Japanese encephalitis virus
PVRFVLALT

SEQ ID NO: 221791 - protein, 9 aa, Japanese encephalitis virus
ARFVLALIT

SEQ ID NO: 221792 - protein, 9 aa, Japanese encephalitis virus
RFVLALTTF

SEQ ID NO: 221793 - protein, 9 aa, Japanese encephalitis virus
FVLALTTFF

SEQ ID NO: 221794 - protein, 9 aa, Japanese encephalitis virus
VLALTTFFK

SEQ ID NO: 221795 - protein, 9 aa, Japanese encephalitis virus
LALTTFFKF

SEQ ID NO: 221796 - protein, 9 aa, Japanese encephalitis virus
ALTTFFKFT

SEQ ID NO: 221797 - protein, 9 aa, Japanese encephalitis virus
LTTFFKFTA

SEQ ID NO: 221798 - protein, 9 aa, Japanese encephalitis virus
TTFFKFTAL

SEQ ID NO: 221799 - protein, 9 aa, Japanese encephalitis virus
SFFKFTALS

SEQ ID NO: 221800 - protein, 9 aa, Japanese encephalitis virus
FFKFTALSP

SEQ ID NO: 221801 - protein, 9 aa, Japanese encephalitis virus
FKFTALSPT

SEQ ID NO: 221802 - protein, 9 aa, Japanese encephalitis virus
KFTALSPTK

SEQ ID NO: 221803 - protein, 9 aa, Japanese encephalitis virus
FTALSPTKA

SEQ ID NO: 221804 - protein, 9 aa, Japanese encephalitis virus
TALSPTKAL

SEQ ID NO: 221805 - protein, 9 aa, Japanese encephalitis virus
ALAPTKALS

SEQ ID NO: 221806 - protein, 9 aa, Japanese encephalitis virus
LAPTKALSG

SEQ ID NO: 221807 - protein, 9 aa, Japanese encephalitis virus
APTKALSGR

SEQ ID NO: 221808 - protein, 9 aa, Japanese encephalitis virus
PTKALSGRW

SEQ ID NO: 221809 - protein, 9 aa, Japanese encephalitis virus
TKALLGRWR

SEQ ID NO: 221810 - protein, 9 aa, Japanese encephalitis virus
KALLGRWRA

SEQ ID NO: 221811 - protein, 9 aa, Japanese encephalitis virus
ALLGRWRAV

SEQ ID NO: 221812 - protein, 9 aa, Japanese encephalitis virus
LLGRWRAVE

SEQ ID NO: 221813 - protein, 9 aa, Japanese encephalitis virus
LGRWRAVEK

SEQ ID NO: 221814 - protein, 9 aa, Japanese encephalitis virus
GRWRAVEKS

SEQ ID NO: 221815 - protein, 9 aa, Japanese encephalitis virus
RWRAVEKSV

SEQ ID NO: 221816 - protein, 9 aa, Japanese encephalitis virus
WRAVEKSVA

SEQ ID NO: 221817 - protein, 9 aa, Japanese encephalitis virus
RAVEKSVAM

SEQ ID NO: 221818 - protein, 9 aa, Japanese encephalitis virus
ALEKSVAMK

SEQ ID NO: 221819 - protein, 9 aa, Japanese encephalitis virus
VERSVAMKH

SEQ ID NO: 221820 - protein, 9 aa, Japanese encephalitis virus
ERSVAMKHL

SEQ ID NO: 221821 - protein, 9 aa, Japanese encephalitis virus
RSVAMKHLT

SEQ ID NO: 221822 - protein, 9 aa, Japanese encephalitis virus
MKHLTSFKG

SEQ ID NO: 221823 - protein, 9 aa, Japanese encephalitis virus
KHLTSFKGE

SEQ ID NO: 221824 - protein, 9 aa, Japanese encephalitis virus
HLTSFKGEL

SEQ ID NO: 221825 - protein, 9 aa, Japanese encephalitis virus
LTSFKGELG

SEQ ID NO: 221826 - protein, 9 aa, Japanese encephalitis virus
TSFKGELGT

SEQ ID NO: 221827 - protein, 9 aa, Japanese encephalitis virus
SFKGELGTL

SEQ ID NO: 221828 - protein, 9 aa, Japanese encephalitis virus
FKRELGILI

SEQ ID NO: 221829 - protein, 9 aa, Japanese encephalitis virus
KRELGILID

SEQ ID NO: 221830 - protein, 9 aa, Japanese encephalitis virus
RELGILIDA

SEQ ID NO: 221831 - protein, 9 aa, Japanese encephalitis virus
ELGTLIDVV

SEQ ID NO: 221832 - protein, 9 aa, Japanese encephalitis virus
LGTLIDTVN

SEQ ID NO: 221833 - protein, 9 aa, Japanese encephalitis virus
GILIDAVNK

SEQ ID NO: 221834 - protein, 9 aa, Japanese encephalitis virus
TLIDVVNKR

SEQ ID NO: 221835 - protein, 9 aa, Japanese encephalitis virus
LIDTVNKRG

SEQ ID NO: 221836 - protein, 9 aa, Japanese encephalitis virus
IDAVNKRGK

SEQ ID NO: 221837 - protein, 9 aa, Japanese encephalitis virus
DAVNKRGKK

SEQ ID NO: 221838 - protein, 9 aa, Japanese encephalitis virus
VNKRGKKQN

SEQ ID NO: 221839 - protein, 9 aa, Japanese encephalitis virus
NKRGKKQNK

SEQ ID NO: 221840 - protein, 9 aa, Japanese encephalitis virus
KRGKKQNKR

SEQ ID NO: 221841 - protein, 9 aa, Japanese encephalitis virus
RGKKQNKRG

SEQ ID NO: 221842 - protein, 9 aa, Japanese encephalitis virus
GKKQNKRGG

SEQ ID NO: 221843 - protein, 9 aa, Japanese encephalitis virus
KKQNKRGGN

SEQ ID NO: 221844 - protein, 9 aa, Japanese encephalitis virus
KRNKRGGNE

SEQ ID NO: 221845 - protein, 9 aa, Japanese encephalitis virus
QNKRGGNES

SEQ ID NO: 221846 - protein, 9 aa, Japanese encephalitis virus
VGAMKLSNF

SEQ ID NO: 221847 - protein, 9 aa, Japanese encephalitis virus
GAMRLSNFQ

SEQ ID NO: 221848 - protein, 9 aa, Japanese encephalitis virus
AMRLSNFQG

SEQ ID NO: 221849 - protein, 9 aa, Japanese encephalitis virus
MRLSNFQGK

SEQ ID NO: 221850 - protein, 9 aa, Japanese encephalitis virus
RLSNFQGKL

SEQ ID NO: 221851 - protein, 9 aa, Japanese encephalitis virus
NFQGKLLMA

SEQ ID NO: 221852 - protein, 9 aa, Japanese encephalitis virus
FQGKLLMTV

SEQ ID NO: 221853 - protein, 9 aa, Japanese encephalitis virus
QGKLLMTVN

SEQ ID NO: 221854 - protein, 9 aa, Japanese encephalitis virus
GKLLMTVNN

SEQ ID NO: 221855 - protein, 9 aa, Japanese encephalitis virus
KLLMTVNNT

SEQ ID NO: 221856 - protein, 9 aa, Japanese encephalitis virus
LLMTVNNTD

SEQ ID NO: 221857 - protein, 9 aa, Japanese encephalitis virus
LMTVNNTDI

SEQ ID NO: 221858 - protein, 9 aa, Japanese encephalitis virus
MTVNNTDIA

SEQ ID NO: 221859 - protein, 9 aa, Japanese encephalitis virus
TVNNTDIAD

SEQ ID NO: 221860 - protein, 9 aa, Japanese encephalitis virus
VNNTDIADV

SEQ ID NO: 221861 - protein, 9 aa, Japanese encephalitis virus
WVRAIDVGH

SEQ ID NO: 221862 - protein, 9 aa, Japanese encephalitis virus
VRAIDVGYL

SEQ ID NO: 221863 - protein, 9 aa, Japanese encephalitis virus
RAIDVGHMC

SEQ ID NO: 221864 - protein, 9 aa, Japanese encephalitis virus
AIDVGHMCE

SEQ ID NO: 221865 - protein, 9 aa, Japanese encephalitis virus
IDVGYLCED

SEQ ID NO: 221866 - protein, 9 aa, Japanese encephalitis virus
DVGHMCEDT

SEQ ID NO: 221867 - protein, 9 aa, Japanese encephalitis virus
VGYLCEDTI

SEQ ID NO: 221868 - protein, 9 aa, Japanese encephalitis virus
GYLCEDTIT

SEQ ID NO: 221869 - protein, 9 aa, Japanese encephalitis virus
HMCEDTITY

SEQ ID NO: 221870 - protein, 9 aa, Japanese encephalitis virus
LCEDTITYE

SEQ ID NO: 221871 - protein, 9 aa, Japanese encephalitis virus
ITYECPKLA

SEQ ID NO: 221872 - protein, 9 aa, Japanese encephalitis virus
VGNDPEDVD

SEQ ID NO: 221873 - protein, 9 aa, Japanese encephalitis virus
GNDPQDVDC

SEQ ID NO: 221874 - protein, 9 aa, Japanese encephalitis virus
NDPQDVDCW

SEQ ID NO: 221875 - protein, 9 aa, Japanese encephalitis virus
DPQDVDCWC

SEQ ID NO: 221876 - protein, 9 aa, Japanese encephalitis virus
PQDVDCWCD

SEQ ID NO: 221877 - protein, 9 aa, Japanese encephalitis virus
QDVDCWCDH

SEQ ID NO: 221878 - protein, 9 aa, Japanese encephalitis virus
DVDCWCDHQ

SEQ ID NO: 221879 - protein, 9 aa, Japanese encephalitis virus
VDCWCDNQQ

SEQ ID NO: 221880 - protein, 9 aa, Japanese encephalitis virus
DCWCDNQQV

SEQ ID NO: 221881 - protein, 9 aa, Japanese encephalitis virus
CWCDNQQVY

SEQ ID NO: 221882 - protein, 9 aa, Japanese encephalitis virus
WCDNQQVYV

SEQ ID NO: 221883 - protein, 9 aa, Japanese encephalitis virus
CDNQQVYVQ

SEQ ID NO: 221884 - protein, 9 aa, Japanese encephalitis virus
DNQQVYVQY

SEQ ID NO: 221885 - protein, 9 aa, Japanese encephalitis virus
NQQVYVQYG

SEQ ID NO: 221886 - protein, 9 aa, Japanese encephalitis virus
QQVYVQYGP

SEQ ID NO: 221887 - protein, 9 aa, Japanese encephalitis virus
QVYVQYGPC

SEQ ID NO: 221888 - protein, 9 aa, Japanese encephalitis virus
VYVQYGPCT

SEQ ID NO: 221889 - protein, 9 aa, Japanese encephalitis virus
YVQYGPCTR

SEQ ID NO: 221890 - protein, 9 aa, Japanese encephalitis virus
VQYGPCTRT

SEQ ID NO: 221891 - protein, 9 aa, Japanese encephalitis virus
QYGPCTRTR

SEQ ID NO: 221892 - protein, 9 aa, Japanese encephalitis virus
YGPCTRTRH

SEQ ID NO: 221893 - protein, 9 aa, Japanese encephalitis virus
GPCTRTRHS

SEQ ID NO: 221894 - protein, 9 aa, Japanese encephalitis virus
PCTRTRHSK

SEQ ID NO: 221895 - protein, 9 aa, Japanese encephalitis virus
CTRTSHSQT

SEQ ID NO: 221896 - protein, 9 aa, Japanese encephalitis virus
TRTRHSKRT

SEQ ID NO: 221897 - protein, 9 aa, Japanese encephalitis virus
RTRHSKRTR

SEQ ID NO: 221898 - protein, 9 aa, Japanese encephalitis virus
TRHSKRTRR

SEQ ID NO: 221899 - protein, 9 aa, Japanese encephalitis virus
RHSKRTRRS

SEQ ID NO: 221900 - protein, 9 aa, Japanese encephalitis virus
HSKRTRRSV

SEQ ID NO: 221901 - protein, 9 aa, Japanese encephalitis virus
SKRTRRSVS

SEQ ID NO: 221902 - protein, 9 aa, Japanese encephalitis virus
KRTRRSVSV

SEQ ID NO: 221903 - protein, 9 aa, Japanese encephalitis virus
RTRRSVSVQ

SEQ ID NO: 221904 - protein, 9 aa, Japanese encephalitis virus
TRRSVSVQT

SEQ ID NO: 221905 - protein, 9 aa, Japanese encephalitis virus
RRSVSVQPN

SEQ ID NO: 221906 - protein, 9 aa, Japanese encephalitis virus
RSVSVQPNG

SEQ ID NO: 221907 - protein, 9 aa, Japanese encephalitis virus
SVSVQPNGE

SEQ ID NO: 221908 - protein, 9 aa, Japanese encephalitis virus
VSVHTHGES

SEQ ID NO: 221909 - protein, 9 aa, Japanese encephalitis virus
SVHTHGESS

SEQ ID NO: 221910 - protein, 9 aa, Japanese encephalitis virus
VHTHGESSL

SEQ ID NO: 221911 - protein, 9 aa, Japanese encephalitis virus
HTHGESSLV

SEQ ID NO: 221912 - protein, 9 aa, Japanese encephalitis virus
PNGERSLVN

SEQ ID NO: 221913 - protein, 9 aa, Japanese encephalitis virus
HGESSLENK

SEQ ID NO: 221914 - protein, 9 aa, Japanese encephalitis virus
GESSLENKK

SEQ ID NO: 221915 - protein, 9 aa, Japanese encephalitis virus
ESSLENKKE

SEQ ID NO: 221916 - protein, 9 aa, Japanese encephalitis virus
RSLVNKKEA

SEQ ID NO: 221917 - protein, 9 aa, Japanese encephalitis virus
SLVNKKKAW

SEQ ID NO: 221918 - protein, 9 aa, Japanese encephalitis virus
LENKKEAWL

SEQ ID NO: 221919 - protein, 9 aa, Japanese encephalitis virus
VNKKEAWLN

SEQ ID NO: 221920 - protein, 9 aa, Japanese encephalitis virus
NKKKAWLDS

SEQ ID NO: 221921 - protein, 9 aa, Japanese encephalitis virus
KKEAWLNST

SEQ ID NO: 221922 - protein, 9 aa, Japanese encephalitis virus
KEAWLDSTR

SEQ ID NO: 221923 - protein, 9 aa, Japanese encephalitis virus
KAWLDSTRA

SEQ ID NO: 221924 - protein, 9 aa, Japanese encephalitis virus
AWLDSTRAT

SEQ ID NO: 221925 - protein, 9 aa, Japanese encephalitis virus
WLDSTRATR

SEQ ID NO: 221926 - protein, 9 aa, Japanese encephalitis virus
LDSTRATRY

SEQ ID NO: 221927 - protein, 9 aa, Japanese encephalitis virus
DSTRATRYL

SEQ ID NO: 221928 - protein, 9 aa, Japanese encephalitis virus
STKATRYLT

SEQ ID NO: 221929 - protein, 9 aa, Japanese encephalitis virus
TKATRYLTK

SEQ ID NO: 221930 - protein, 9 aa, Japanese encephalitis virus
KATRYLTKT

SEQ ID NO: 221931 - protein, 9 aa, Japanese encephalitis virus
ATRYLTKTE

SEQ ID NO: 221932 - protein, 9 aa, Japanese encephalitis virus
TRYLTKTEN

SEQ ID NO: 221933 - protein, 9 aa, Japanese encephalitis virus
RYLTKTENW

SEQ ID NO: 221934 - protein, 9 aa, Japanese encephalitis virus
YLTKTENWI

SEQ ID NO: 221935 - protein, 9 aa, Japanese encephalitis virus
LTKTENWII

SEQ ID NO: 221936 - protein, 9 aa, Japanese encephalitis virus
MKTENWIVR

SEQ ID NO: 221937 - protein, 9 aa, Japanese encephalitis virus
KTENWIVRN

SEQ ID NO: 221938 - protein, 9 aa, Japanese encephalitis virus
TENWIVRNP

SEQ ID NO: 221939 - protein, 9 aa, Japanese encephalitis virus
ENWIVRNPG

SEQ ID NO: 221940 - protein, 9 aa, Japanese encephalitis virus
NWIVRNPGY

SEQ ID NO: 221941 - protein, 9 aa, Japanese encephalitis virus
WIVRNPGYA

SEQ ID NO: 221942 - protein, 9 aa, Japanese encephalitis virus
IVRNPGYAF

SEQ ID NO: 221943 - protein, 9 aa, Japanese encephalitis virus
VRNPGYAFL

SEQ ID NO: 221944 - protein, 9 aa, Japanese encephalitis virus
NPGYAFLAV

SEQ ID NO: 221945 - protein, 9 aa, Japanese encephalitis virus
ALGWMLGSN

SEQ ID NO: 221946 - protein, 9 aa, Japanese encephalitis virus
LGWMLGSNS

SEQ ID NO: 221947 - protein, 9 aa, Japanese encephalitis virus
GWMLGSNSG

SEQ ID NO: 221948 - protein, 9 aa, Japanese encephalitis virus
GPRVVFTIL

SEQ ID NO: 221949 - protein, 9 aa, Japanese encephalitis virus
HRVVFTILL

SEQ ID NO: 221950 - protein, 9 aa, Japanese encephalitis virus
RVVFTILPL

SEQ ID NO: 221951 - protein, 9 aa, Japanese encephalitis virus
LGFTILLLL

SEQ ID NO: 221952 - protein, 9 aa, Japanese encephalitis virus
VFTILPLLV

SEQ ID NO: 221953 - protein, 9 aa, Japanese encephalitis virus
FTILPLLVA

SEQ ID NO: 221954 - protein, 9 aa, Japanese encephalitis virus
TILPLLVAP

SEQ ID NO: 221955 - protein, 9 aa, Japanese encephalitis virus
ILPLLVAPA

SEQ ID NO: 221956 - protein, 9 aa, Japanese encephalitis virus
LPLLVAPAY

SEQ ID NO: 221957 - protein, 9 aa, Japanese encephalitis virus
PLLVAPAYS

SEQ ID NO: 221958 - protein, 9 aa, Japanese encephalitis virus
LVAPAYSFT

SEQ ID NO: 221959 - protein, 9 aa, Japanese encephalitis virus
VAPAYSFTC

SEQ ID NO: 221960 - protein, 9 aa, Japanese encephalitis virus
APAYSFTCL

SEQ ID NO: 221961 - protein, 9 aa, Japanese encephalitis virus
PAYSFTCLG

SEQ ID NO: 221962 - protein, 9 aa, Japanese encephalitis virus
AYSFTCLGM

SEQ ID NO: 221963 - protein, 9 aa, Japanese encephalitis virus
YSFTCLGMG

SEQ ID NO: 221964 - protein, 9 aa, Japanese encephalitis virus
SFTCLGMGN

SEQ ID NO: 221965 - protein, 9 aa, Japanese encephalitis virus
FTCLGMGNR

SEQ ID NO: 221966 - protein, 9 aa, Japanese encephalitis virus
TCLGMGNRD

SEQ ID NO: 221967 - protein, 9 aa, Japanese encephalitis virus
LGMGNRDFV

SEQ ID NO: 221968 - protein, 9 aa, Japanese encephalitis virus
GMGNRDFVE

SEQ ID NO: 221969 - protein, 9 aa, Japanese encephalitis virus
MGNRDFVEG

SEQ ID NO: 221970 - protein, 9 aa, Japanese encephalitis virus
GNRDFIQGA

SEQ ID NO: 221971 - protein, 9 aa, Japanese encephalitis virus
NRDFIEGVS

SEQ ID NO: 221972 - protein, 9 aa, Japanese encephalitis virus
RDFIEGVSG

SEQ ID NO: 221973 - protein, 9 aa, Japanese encephalitis virus
DFIEGVSGA

SEQ ID NO: 221974 - protein, 9 aa, Japanese encephalitis virus
FIQGASGAT

SEQ ID NO: 221975 - protein, 9 aa, Japanese encephalitis virus
VEGASGATW

SEQ ID NO: 221976 - protein, 9 aa, Japanese encephalitis virus
EGVSGATWV

SEQ ID NO: 221977 - protein, 9 aa, Japanese encephalitis virus
GVSGATWVD

SEQ ID NO: 221978 - protein, 9 aa, Japanese encephalitis virus
VSGATWVDL

SEQ ID NO: 221979 - protein, 9 aa, Japanese encephalitis virus
DSCLTIMAS

SEQ ID NO: 221980 - protein, 9 aa, Japanese encephalitis virus
SCLTIMASD

SEQ ID NO: 221981 - protein, 9 aa, Japanese encephalitis virus
CLTIMASDK

SEQ ID NO: 221982 - protein, 9 aa, Japanese encephalitis virus
LTIMASDKP

SEQ ID NO: 221983 - protein, 9 aa, Japanese encephalitis virus
TIMASDKPT

SEQ ID NO: 221984 - protein, 9 aa, Japanese encephalitis virus
IMASDKPTL

SEQ ID NO: 221985 - protein, 9 aa, Japanese encephalitis virus
MASDKPTLD

SEQ ID NO: 221986 - protein, 9 aa, Japanese encephalitis virus
ASDKPTLDV

SEQ ID NO: 221987 - protein, 9 aa, Japanese encephalitis virus
SDKPTLDVR

SEQ ID NO: 221988 - protein, 9 aa, Japanese encephalitis virus
DKPTLDRRM

SEQ ID NO: 221989 - protein, 9 aa, Japanese encephalitis virus
KPTLDRRMI

SEQ ID NO: 221990 - protein, 9 aa, Japanese encephalitis virus
PTLDRRMIN

SEQ ID NO: 221991 - protein, 9 aa, Japanese encephalitis virus
TLDRRMINI

SEQ ID NO: 221992 - protein, 9 aa, Japanese encephalitis virus
LDRRMINIE

SEQ ID NO: 221993 - protein, 9 aa, Japanese encephalitis virus
DRRMINIEA

SEQ ID NO: 221994 - protein, 9 aa, Japanese encephalitis virus
VRMINIEAV

SEQ ID NO: 221995 - protein, 9 aa, Japanese encephalitis virus
RMINIEAVQ

SEQ ID NO: 221996 - protein, 9 aa, Japanese encephalitis virus
MINIEAVQL

SEQ ID NO: 221997 - protein, 9 aa, Japanese encephalitis virus
INIEAVQLA

SEQ ID NO: 221998 - protein, 9 aa, Japanese encephalitis virus
NIEAVQLAE

SEQ ID NO: 221999 - protein, 9 aa, Japanese encephalitis virus
IEAVQLAEV

SEQ ID NO: 222000 - protein, 9 aa, Japanese encephalitis virus
EAVQLAEVR

SEQ ID NO: 222001 - protein, 9 aa, Japanese encephalitis virus
AVQLAEVRS

SEQ ID NO: 222002 - protein, 9 aa, Japanese encephalitis virus
VQLAEVRSY

SEQ ID NO: 222003 - protein, 9 aa, Japanese encephalitis virus
QLAEVRSYY

SEQ ID NO: 222004 - protein, 9 aa, Japanese encephalitis virus
LAEVRSYYY

SEQ ID NO: 222005 - protein, 9 aa, Japanese encephalitis virus
AEVRSYCYR

SEQ ID NO: 222006 - protein, 9 aa, Japanese encephalitis virus
EVRSYYYHA

SEQ ID NO: 222007 - protein, 9 aa, Japanese encephalitis virus
VRSYCYRAS

SEQ ID NO: 222008 - protein, 9 aa, Japanese encephalitis virus
RSYCYRASV

SEQ ID NO: 222009 - protein, 9 aa, Japanese encephalitis virus
SYCYRASVT

SEQ ID NO: 222010 - protein, 9 aa, Japanese encephalitis virus
YYYHASVTD

SEQ ID NO: 222011 - protein, 9 aa, Japanese encephalitis virus
YYHASVTDI

SEQ ID NO: 222012 - protein, 9 aa, Japanese encephalitis virus
YRASVTDIS

SEQ ID NO: 222013 - protein, 9 aa, Japanese encephalitis virus
RASVTDIST

SEQ ID NO: 222014 - protein, 9 aa, Japanese encephalitis virus
ISTVARCPM

SEQ ID NO: 222015 - protein, 9 aa, Japanese encephalitis virus
STVARCPMT

SEQ ID NO: 222016 - protein, 9 aa, Japanese encephalitis virus
TVARCPMTG

SEQ ID NO: 222017 - protein, 9 aa, Japanese encephalitis virus
VARCPMTGE

SEQ ID NO: 222018 - protein, 9 aa, Japanese encephalitis virus
ARCPMTGEA

SEQ ID NO: 222019 - protein, 9 aa, Japanese encephalitis virus
RCPMTGEAH

SEQ ID NO: 222020 - protein, 9 aa, Japanese encephalitis virus
CPMTGEAHN

SEQ ID NO: 222021 - protein, 9 aa, Japanese encephalitis virus
PMTGEAHNE

SEQ ID NO: 222022 - protein, 9 aa, Japanese encephalitis virus
MTGEAHNEK

SEQ ID NO: 222023 - protein, 9 aa, Japanese encephalitis virus
TGEAHNEKQ

SEQ ID NO: 222024 - protein, 9 aa, Japanese encephalitis virus
GEAHNEKQA

SEQ ID NO: 222025 - protein, 9 aa, Japanese encephalitis virus
EAHNEKGAD

SEQ ID NO: 222026 - protein, 9 aa, Japanese encephalitis virus
AHNEKGADS

SEQ ID NO: 222027 - protein, 9 aa, Japanese encephalitis virus
HNEKQADSS

SEQ ID NO: 222028 - protein, 9 aa, Japanese encephalitis virus
NEKQADSSY

SEQ ID NO: 222029 - protein, 9 aa, Japanese encephalitis virus
KKRADSSYV

SEQ ID NO: 222030 - protein, 9 aa, Japanese encephalitis virus
KGADSSYVC

SEQ ID NO: 222031 - protein, 9 aa, Japanese encephalitis virus
GADSSYVCK

SEQ ID NO: 222032 - protein, 9 aa, Japanese encephalitis virus
QGFTDRGWR

SEQ ID NO: 222033 - protein, 9 aa, Japanese encephalitis virus
GFTDRGWRN

SEQ ID NO: 222034 - protein, 9 aa, Japanese encephalitis virus
FTDRGWRNG

SEQ ID NO: 222035 - protein, 9 aa, Japanese encephalitis virus
TDRGWGKGC

SEQ ID NO: 222036 - protein, 9 aa, Japanese encephalitis virus
DRGWRNGCG

SEQ ID NO: 222037 - protein, 9 aa, Japanese encephalitis virus
RGWGNGCGF

SEQ ID NO: 222038 - protein, 9 aa, Japanese encephalitis virus
GWGNGCGFF

SEQ ID NO: 222039 - protein, 9 aa, Japanese encephalitis virus
WGNGCGFFG

SEQ ID NO: 222040 - protein, 9 aa, Japanese encephalitis virus
GNGCGFFGK

SEQ ID NO: 222041 - protein, 9 aa, Japanese encephalitis virus
NGCGFFGKG

SEQ ID NO: 222042 - protein, 9 aa, Japanese encephalitis virus
GCGFFGKGS

SEQ ID NO: 222043 - protein, 9 aa, Japanese encephalitis virus
CGFFGKGSI

SEQ ID NO: 222044 - protein, 9 aa, Japanese encephalitis virus
GFFGKGSID

SEQ ID NO: 222045 - protein, 9 aa, Japanese encephalitis virus
FFGKGSIDT

SEQ ID NO: 222046 - protein, 9 aa, Japanese encephalitis virus
SGKGSIDTC

SEQ ID NO: 222047 - protein, 9 aa, Japanese encephalitis virus
TCAKFSCTR

SEQ ID NO: 222048 - protein, 9 aa, Japanese encephalitis virus
CAKFSCTRK

SEQ ID NO: 222049 - protein, 9 aa, Japanese encephalitis virus
AKFSCTRKA

SEQ ID NO: 222050 - protein, 9 aa, Japanese encephalitis virus
KFSCTRKAI

SEQ ID NO: 222051 - protein, 9 aa, Japanese encephalitis virus
FSCTRKAIG

SEQ ID NO: 222052 - protein, 9 aa, Japanese encephalitis virus
SCTRKAIGR

SEQ ID NO: 222053 - protein, 9 aa, Japanese encephalitis virus
MIQPENIKY

SEQ ID NO: 222054 - protein, 9 aa, Japanese encephalitis virus
IQPENIKYK

SEQ ID NO: 222055 - protein, 9 aa, Japanese encephalitis virus
QPENIKYKV

SEQ ID NO: 222056 - protein, 9 aa, Japanese encephalitis virus
PENIKYKVG

SEQ ID NO: 222057 - protein, 9 aa, Japanese encephalitis virus
ENIKYKVGI

SEQ ID NO: 222058 - protein, 9 aa, Japanese encephalitis virus
NIKYKVGIF

SEQ ID NO: 222059 - protein, 9 aa, Japanese encephalitis virus
IKYKVGIFV

SEQ ID NO: 222060 - protein, 9 aa, Japanese encephalitis virus
KYKVGIFVH

SEQ ID NO: 222061 - protein, 9 aa, Japanese encephalitis virus
YKVGIFVHG

SEQ ID NO: 222062 - protein, 9 aa, Japanese encephalitis virus
KVGIFVHGT

SEQ ID NO: 222063 - protein, 9 aa, Japanese encephalitis virus
VGIFVHGAT

SEQ ID NO: 222064 - protein, 9 aa, Japanese encephalitis virus
GIFVHGATT

SEQ ID NO: 222065 - protein, 9 aa, Japanese encephalitis virus
IFVHGATTS

SEQ ID NO: 222066 - protein, 9 aa, Japanese encephalitis virus
FVHGATTSE

SEQ ID NO: 222067 - protein, 9 aa, Japanese encephalitis virus
VHGATTSEN

SEQ ID NO: 222068 - protein, 9 aa, Japanese encephalitis virus
HGATTSENH

SEQ ID NO: 222069 - protein, 9 aa, Japanese encephalitis virus
GATTSENHG

SEQ ID NO: 222070 - protein, 9 aa, Japanese encephalitis virus
ATTSENHGN

SEQ ID NO: 222071 - protein, 9 aa, Japanese encephalitis virus
TSENHGNYT

SEQ ID NO: 222072 - protein, 9 aa, Japanese encephalitis virus
SENHGNYTA

SEQ ID NO: 222073 - protein, 9 aa, Japanese encephalitis virus
ENHGNYTAQ

SEQ ID NO: 222074 - protein, 9 aa, Japanese encephalitis virus
NHGNYTAQI

SEQ ID NO: 222075 - protein, 9 aa, Japanese encephalitis virus
HGNYTAQIG

SEQ ID NO: 222076 - protein, 9 aa, Japanese encephalitis virus
GNYSAQVGT

SEQ ID NO: 222077 - protein, 9 aa, Japanese encephalitis virus
NYSAQVGTS

SEQ ID NO: 222078 - protein, 9 aa, Japanese encephalitis virus
YSAQVGTSQ

SEQ ID NO: 222079 - protein, 9 aa, Japanese encephalitis virus
SAQVGTSQA

SEQ ID NO: 222080 - protein, 9 aa, Japanese encephalitis virus
AQVGTSQAA

SEQ ID NO: 222081 - protein, 9 aa, Japanese encephalitis virus
QVGTSQAAK

SEQ ID NO: 222082 - protein, 9 aa, Japanese encephalitis virus
VGTSQAAKF

SEQ ID NO: 222083 - protein, 9 aa, Japanese encephalitis virus
GTSQAAKFT

SEQ ID NO: 222084 - protein, 9 aa, Japanese encephalitis virus
ASQAAKFTI

SEQ ID NO: 222085 - protein, 9 aa, Japanese encephalitis virus
SQAAKFTIT

SEQ ID NO: 222086 - protein, 9 aa, Japanese encephalitis virus
QAAKFTITP

SEQ ID NO: 222087 - protein, 9 aa, Japanese encephalitis virus
AAKFTITPN

SEQ ID NO: 222088 - protein, 9 aa, Japanese encephalitis virus
AKFTITPNA

SEQ ID NO: 222089 - protein, 9 aa, Japanese encephalitis virus
KFTITPNAP

SEQ ID NO: 222090 - protein, 9 aa, Japanese encephalitis virus
FTITPNAPS

SEQ ID NO: 222091 - protein, 9 aa, Japanese encephalitis virus
TVTPNAPSV

SEQ ID NO: 222092 - protein, 9 aa, Japanese encephalitis virus
VTPNAPSTT

SEQ ID NO: 222093 - protein, 9 aa, Japanese encephalitis virus
TPNAPSTTL

SEQ ID NO: 222094 - protein, 9 aa, Japanese encephalitis virus
PNAPSTTLK

SEQ ID NO: 222095 - protein, 9 aa, Japanese encephalitis virus
NAPSTTLKL

SEQ ID NO: 222096 - protein, 9 aa, Japanese encephalitis virus
APSTTLKLG

SEQ ID NO: 222097 - protein, 9 aa, Japanese encephalitis virus
PSTTLKLGD

SEQ ID NO: 222098 - protein, 9 aa, Japanese encephalitis virus
ALKLGDYGE

SEQ ID NO: 222099 - protein, 9 aa, Japanese encephalitis virus
LKLGDFGEV

SEQ ID NO: 222100 - protein, 9 aa, Japanese encephalitis virus
ELGDYGEVT

SEQ ID NO: 222101 - protein, 9 aa, Japanese encephalitis virus
LGDFGEVTL

SEQ ID NO: 222102 - protein, 9 aa, Japanese encephalitis virus
GDFGEVTLD

SEQ ID NO: 222103 - protein, 9 aa, Japanese encephalitis virus
DFGEVTLDC

SEQ ID NO: 222104 - protein, 9 aa, Japanese encephalitis virus
FGEVTLDCE

SEQ ID NO: 222105 - protein, 9 aa, Japanese encephalitis virus
GEVTLDCEA

SEQ ID NO: 222106 - protein, 9 aa, Japanese encephalitis virus
EVTLDCEPK

SEQ ID NO: 222107 - protein, 9 aa, Japanese encephalitis virus
VTLDCEARS

SEQ ID NO: 222108 - protein, 9 aa, Japanese encephalitis virus
TLDCEARSG

SEQ ID NO: 222109 - protein, 9 aa, Japanese encephalitis virus
LDCEPKSGL

SEQ ID NO: 222110 - protein, 9 aa, Japanese encephalitis virus
DCEPKSGLN

SEQ ID NO: 222111 - protein, 9 aa, Japanese encephalitis virus
CEARSGLNT

SEQ ID NO: 222112 - protein, 9 aa, Japanese encephalitis virus
EARSGLNTE

SEQ ID NO: 222113 - protein, 9 aa, Japanese encephalitis virus
PKSGLNTEA

SEQ ID NO: 222114 - protein, 9 aa, Japanese encephalitis virus
KSGLNTEAF

SEQ ID NO: 222115 - protein, 9 aa, Japanese encephalitis virus
AFYVMTVGP

SEQ ID NO: 222116 - protein, 9 aa, Japanese encephalitis virus
FYVMTVGSR

SEQ ID NO: 222117 - protein, 9 aa, Japanese encephalitis virus
YVMTVGSRS

SEQ ID NO: 222118 - protein, 9 aa, Japanese encephalitis virus
VMTVGSRSF

SEQ ID NO: 222119 - protein, 9 aa, Japanese encephalitis virus
MTVGSRSFL

SEQ ID NO: 222120 - protein, 9 aa, Japanese encephalitis virus
TVGSRSFLV

SEQ ID NO: 222121 - protein, 9 aa, Japanese encephalitis virus
VGSRSFLVH

SEQ ID NO: 222122 - protein, 9 aa, Japanese encephalitis virus
GSRSFLVHR

SEQ ID NO: 222123 - protein, 9 aa, Japanese encephalitis virus
SRSFLVHRE

SEQ ID NO: 222124 - protein, 9 aa, Japanese encephalitis virus
RSFLVHREW

SEQ ID NO: 222125 - protein, 9 aa, Japanese encephalitis virus
SLLVHREWF

SEQ ID NO: 222126 - protein, 9 aa, Japanese encephalitis virus
LLVHREWFH

SEQ ID NO: 222127 - protein, 9 aa, Japanese encephalitis virus
HREWFHDLS

SEQ ID NO: 222128 - protein, 9 aa, Japanese encephalitis virus
REWFHDLSL

SEQ ID NO: 222129 - protein, 9 aa, Japanese encephalitis virus
EWFHDLSLP

SEQ ID NO: 222130 - protein, 9 aa, Japanese encephalitis virus
WFHDLSLPW

SEQ ID NO: 222131 - protein, 9 aa, Japanese encephalitis virus
FHDLSLPWT

SEQ ID NO: 222132 - protein, 9 aa, Japanese encephalitis virus
HDLSLPWTS

SEQ ID NO: 222133 - protein, 9 aa, Japanese encephalitis virus
DLSLPWTSP

SEQ ID NO: 222134 - protein, 9 aa, Japanese encephalitis virus
LSLPWTSPS

SEQ ID NO: 222135 - protein, 9 aa, Japanese encephalitis virus
SLPWTSPSS

SEQ ID NO: 222136 - protein, 9 aa, Japanese encephalitis virus
LPWTPPSST

SEQ ID NO: 222137 - protein, 9 aa, Japanese encephalitis virus
PWTPPSSTA

SEQ ID NO: 222138 - protein, 9 aa, Japanese encephalitis virus
WTPPSSTAW

SEQ ID NO: 222139 - protein, 9 aa, Japanese encephalitis virus
TPPSSTAWR

SEQ ID NO: 222140 - protein, 9 aa, Japanese encephalitis virus
PPSSTAWRN

SEQ ID NO: 222141 - protein, 9 aa, Japanese encephalitis virus
SSNTAWRNR

SEQ ID NO: 222142 - protein, 9 aa, Japanese encephalitis virus
SNTAWRNRE

SEQ ID NO: 222143 - protein, 9 aa, Japanese encephalitis virus
NTAWRNREL

SEQ ID NO: 222144 - protein, 9 aa, Japanese encephalitis virus
RELLMEFEG

SEQ ID NO: 222145 - protein, 9 aa, Japanese encephalitis virus
ELLMEFEGA

SEQ ID NO: 222146 - protein, 9 aa, Japanese encephalitis virus
LLMEFEGAH

SEQ ID NO: 222147 - protein, 9 aa, Japanese encephalitis virus
LMEFEGAHA

SEQ ID NO: 222148 - protein, 9 aa, Japanese encephalitis virus
MEFEGAHAT

SEQ ID NO: 222149 - protein, 9 aa, Japanese encephalitis virus
EFEGAHATK

SEQ ID NO: 222150 - protein, 9 aa, Japanese encephalitis virus
FEGAHATKQ

SEQ ID NO: 222151 - protein, 9 aa, Japanese encephalitis virus
EGAHATKQS

SEQ ID NO: 222152 - protein, 9 aa, Japanese encephalitis virus
GAHATKQSV

SEQ ID NO: 222153 - protein, 9 aa, Japanese encephalitis virus
QSVVALGSR

SEQ ID NO: 222154 - protein, 9 aa, Japanese encephalitis virus
SVVALGSRE

SEQ ID NO: 222155 - protein, 9 aa, Japanese encephalitis virus
VVALGSQER

SEQ ID NO: 222156 - protein, 9 aa, Japanese encephalitis virus
VALGSREGG

SEQ ID NO: 222157 - protein, 9 aa, Japanese encephalitis virus
ALGSQEGSL

SEQ ID NO: 222158 - protein, 9 aa, Japanese encephalitis virus
LGSQEGSLH

SEQ ID NO: 222159 - protein, 9 aa, Japanese encephalitis virus
GSQEGGLHH

SEQ ID NO: 222160 - protein, 9 aa, Japanese encephalitis virus
SQEGGLHHA

SEQ ID NO: 222161 - protein, 9 aa, Japanese encephalitis virus
QEGGLHHAL

SEQ ID NO: 222162 - protein, 9 aa, Japanese encephalitis virus
EGGLHHALA

SEQ ID NO: 222163 - protein, 9 aa, Japanese encephalitis virus
GGLHHALAG

SEQ ID NO: 222164 - protein, 9 aa, Japanese encephalitis virus
GLHHALAGA

SEQ ID NO: 222165 - protein, 9 aa, Japanese encephalitis virus
LHHALAGAI

SEQ ID NO: 222166 - protein, 9 aa, Japanese encephalitis virus
HHALAGAIV

SEQ ID NO: 222167 - protein, 9 aa, Japanese encephalitis virus
HALAGAIVV

SEQ ID NO: 222168 - protein, 9 aa, Japanese encephalitis virus
AGAIVVEYP

SEQ ID NO: 222169 - protein, 9 aa, Japanese encephalitis virus
GAIVVEYPS

SEQ ID NO: 222170 - protein, 9 aa, Japanese encephalitis virus
AIVVEYPSS

SEQ ID NO: 222171 - protein, 9 aa, Japanese encephalitis virus
IVVEYPSSV

SEQ ID NO: 222172 - protein, 9 aa, Japanese encephalitis virus
VVEYSSSVM

SEQ ID NO: 222173 - protein, 9 aa, Japanese encephalitis virus
VEYSSSVML

SEQ ID NO: 222174 - protein, 9 aa, Japanese encephalitis virus
EYSSSVMLT

SEQ ID NO: 222175 - protein, 9 aa, Japanese encephalitis virus
YSSSVMLTS

SEQ ID NO: 222176 - protein, 9 aa, Japanese encephalitis virus
SSSVMLTSG

SEQ ID NO: 222177 - protein, 9 aa, Japanese encephalitis virus
SSVMLTSGH

SEQ ID NO: 222178 - protein, 9 aa, Japanese encephalitis virus
SVMLTSGHL

SEQ ID NO: 222179 - protein, 9 aa, Japanese encephalitis virus
VMLTSGHLK

SEQ ID NO: 222180 - protein, 9 aa, Japanese encephalitis virus
MLTSGHLKC

SEQ ID NO: 222181 - protein, 9 aa, Japanese encephalitis virus
LTSGHVKRR

SEQ ID NO: 222182 - protein, 9 aa, Japanese encephalitis virus
TSGHVKRRL

SEQ ID NO: 222183 - protein, 9 aa, Japanese encephalitis virus
SGHVKRRLK

SEQ ID NO: 222184 - protein, 9 aa, Japanese encephalitis virus
GHVKRRLKM

SEQ ID NO: 222185 - protein, 9 aa, Japanese encephalitis virus
HLKCRLRMD

SEQ ID NO: 222186 - protein, 9 aa, Japanese encephalitis virus
VKRRLKMDK

SEQ ID NO: 222187 - protein, 9 aa, Japanese encephalitis virus
KCRLRMDKL

SEQ ID NO: 222188 - protein, 9 aa, Japanese encephalitis virus
CRLRMDKLA

SEQ ID NO: 222189 - protein, 9 aa, Japanese encephalitis virus
RLRMDKLAL

SEQ ID NO: 222190 - protein, 9 aa, Japanese encephalitis virus
LRMDKLALK

SEQ ID NO: 222191 - protein, 9 aa, Japanese encephalitis virus
RMDKLALKG

SEQ ID NO: 222192 - protein, 9 aa, Japanese encephalitis virus
ALKGTTYGV

SEQ ID NO: 222193 - protein, 9 aa, Japanese encephalitis virus
LKGTTYGVC

SEQ ID NO: 222194 - protein, 9 aa, Japanese encephalitis virus
KGTTYGVCT

SEQ ID NO: 222195 - protein, 9 aa, Japanese encephalitis virus
GTTYGMCTG

SEQ ID NO: 222196 - protein, 9 aa, Japanese encephalitis virus
TTYGMCTGK

SEQ ID NO: 222197 - protein, 9 aa, Japanese encephalitis virus
TYGMCTGKF

SEQ ID NO: 222198 - protein, 9 aa, Japanese encephalitis virus
YGMCTGKFS

SEQ ID NO: 222199 - protein, 9 aa, Japanese encephalitis virus
GMCTGKFSF

SEQ ID NO: 222200 - protein, 9 aa, Japanese encephalitis virus
MCTGKFSFA

SEQ ID NO: 222201 - protein, 9 aa, Japanese encephalitis virus
CTGKFSFAK

SEQ ID NO: 222202 - protein, 9 aa, Japanese encephalitis virus
TGKFSFAKN

SEQ ID NO: 222203 - protein, 9 aa, Japanese encephalitis virus
GKFSFAKNP

SEQ ID NO: 222204 - protein, 9 aa, Japanese encephalitis virus
KFSFAKNPV

SEQ ID NO: 222205 - protein, 9 aa, Japanese encephalitis virus
FSFAKNPVD

SEQ ID NO: 222206 - protein, 9 aa, Japanese encephalitis virus
SFAKNPVDT

SEQ ID NO: 222207 - protein, 9 aa, Japanese encephalitis virus
FAKNPVDTG

SEQ ID NO: 222208 - protein, 9 aa, Japanese encephalitis virus
AKNPVDTGH

SEQ ID NO: 222209 - protein, 9 aa, Japanese encephalitis virus
KNPVDTGHG

SEQ ID NO: 222210 - protein, 9 aa, Japanese encephalitis virus
NPVDTGHGT

SEQ ID NO: 222211 - protein, 9 aa, Japanese encephalitis virus
PVDTGHGTV

SEQ ID NO: 222212 - protein, 9 aa, Japanese encephalitis virus
VDTGHGTVV

SEQ ID NO: 222213 - protein, 9 aa, Japanese encephalitis virus
HGTVVIELT

SEQ ID NO: 222214 - protein, 9 aa, Japanese encephalitis virus
GTVVIELTY

SEQ ID NO: 222215 - protein, 9 aa, Japanese encephalitis virus
TVVIELTYS

SEQ ID NO: 222216 - protein, 9 aa, Japanese encephalitis virus
VVIELTYSG

SEQ ID NO: 222217 - protein, 9 aa, Japanese encephalitis virus
VIELTYSGS

SEQ ID NO: 222218 - protein, 9 aa, Japanese encephalitis virus
IELTYSGSD

SEQ ID NO: 222219 - protein, 9 aa, Japanese encephalitis virus
ELTYSGSDG

SEQ ID NO: 222220 - protein, 9 aa, Japanese encephalitis virus
LTYSGSDGP

SEQ ID NO: 222221 - protein, 9 aa, Japanese encephalitis virus
TYSGSDGPC

SEQ ID NO: 222222 - protein, 9 aa, Japanese encephalitis virus
YSGRDGPCK

SEQ ID NO: 222223 - protein, 9 aa, Japanese encephalitis virus
SGRDGPCKI

SEQ ID NO: 222224 - protein, 9 aa, Japanese encephalitis virus
GRDGPCKIP

SEQ ID NO: 222225 - protein, 9 aa, Japanese encephalitis virus
SDGSCKIPI

SEQ ID NO: 222226 - protein, 9 aa, Japanese encephalitis virus
DGSCKIPIV

SEQ ID NO: 222227 - protein, 9 aa, Japanese encephalitis virus
GSCKIPIVS

SEQ ID NO: 222228 - protein, 9 aa, Japanese encephalitis virus
SCKIPIVSV

SEQ ID NO: 222229 - protein, 9 aa, Japanese encephalitis virus
CKIPIVSVV

SEQ ID NO: 222230 - protein, 9 aa, Japanese encephalitis virus
KIPIVSVVS

SEQ ID NO: 222231 - protein, 9 aa, Japanese encephalitis virus
IPIVSVVSL

SEQ ID NO: 222232 - protein, 9 aa, Japanese encephalitis virus
PIVSVVSLN

SEQ ID NO: 222233 - protein, 9 aa, Japanese encephalitis virus
IVSVVSLND

SEQ ID NO: 222234 - protein, 9 aa, Japanese encephalitis virus
VSVASLNDL

SEQ ID NO: 222235 - protein, 9 aa, Japanese encephalitis virus
SVASLNDLT

SEQ ID NO: 222236 - protein, 9 aa, Japanese encephalitis virus
VASLNDLTP

SEQ ID NO: 222237 - protein, 9 aa, Japanese encephalitis virus
ASLNDLTPV

SEQ ID NO: 222238 - protein, 9 aa, Japanese encephalitis virus
SLNDLTPVG

SEQ ID NO: 222239 - protein, 9 aa, Japanese encephalitis virus
LNDLTPVGR

SEQ ID NO: 222240 - protein, 9 aa, Japanese encephalitis virus
NDLTPVGRL

SEQ ID NO: 222241 - protein, 9 aa, Japanese encephalitis virus
DLTPVGRLV

SEQ ID NO: 222242 - protein, 9 aa, Japanese encephalitis virus
LTPVGRLVT

SEQ ID NO: 222243 - protein, 9 aa, Japanese encephalitis virus
TPAGRLVTV

SEQ ID NO: 222244 - protein, 9 aa, Japanese encephalitis virus
PAGRLVTVN

SEQ ID NO: 222245 - protein, 9 aa, Japanese encephalitis virus
AGRLVTVNP

SEQ ID NO: 222246 - protein, 9 aa, Japanese encephalitis virus
VTVNPFVAA

SEQ ID NO: 222247 - protein, 9 aa, Japanese encephalitis virus
TVNPFVAAS

SEQ ID NO: 222248 - protein, 9 aa, Japanese encephalitis virus
VNPFVAASS

SEQ ID NO: 222249 - protein, 9 aa, Japanese encephalitis virus
NPFVATSSS

SEQ ID NO: 222250 - protein, 9 aa, Japanese encephalitis virus
PFVATSSSN

SEQ ID NO: 222251 - protein, 9 aa, Japanese encephalitis virus
FVATSSSNS

SEQ ID NO: 222252 - protein, 9 aa, Japanese encephalitis virus
VATSSSNSK

SEQ ID NO: 222253 - protein, 9 aa, Japanese encephalitis virus
ATSSSNSKV

SEQ ID NO: 222254 - protein, 9 aa, Japanese encephalitis virus
TSSSNSKVL

SEQ ID NO: 222255 - protein, 9 aa, Japanese encephalitis virus
SSSNSKVLV

SEQ ID NO: 222256 - protein, 9 aa, Japanese encephalitis virus
SSNSKVLVE

SEQ ID NO: 222257 - protein, 9 aa, Japanese encephalitis virus
SNSKVLVEM

SEQ ID NO: 222258 - protein, 9 aa, Japanese encephalitis virus
NSKALVEME

SEQ ID NO: 222259 - protein, 9 aa, Japanese encephalitis virus
SKVLLEIEP

SEQ ID NO: 222260 - protein, 9 aa, Japanese encephalitis virus
QVLVEMEPP

SEQ ID NO: 222261 - protein, 9 aa, Japanese encephalitis virus
VLLEIEPPF

SEQ ID NO: 222262 - protein, 9 aa, Japanese encephalitis virus
LLEIEPPFG

SEQ ID NO: 222263 - protein, 9 aa, Japanese encephalitis virus
LEIEPPFGD

SEQ ID NO: 222264 - protein, 9 aa, Japanese encephalitis virus
EIEPPFGDS

SEQ ID NO: 222265 - protein, 9 aa, Japanese encephalitis virus
IEPPFGDSY

SEQ ID NO: 222266 - protein, 9 aa, Japanese encephalitis virus
PFGDSYIVI

SEQ ID NO: 222267 - protein, 9 aa, Japanese encephalitis virus
FGDSYIVIG

SEQ ID NO: 222268 - protein, 9 aa, Japanese encephalitis virus
GDSYIVIGR

SEQ ID NO: 222269 - protein, 9 aa, Japanese encephalitis virus
DSYIVVGRK

SEQ ID NO: 222270 - protein, 9 aa, Japanese encephalitis virus
KQINHHWHR

SEQ ID NO: 222271 - protein, 9 aa, Japanese encephalitis virus
HHWHRAGST

SEQ ID NO: 222272 - protein, 9 aa, Japanese encephalitis virus
HWHRAGSTL

SEQ ID NO: 222273 - protein, 9 aa, Japanese encephalitis virus
WHRAGSTLG

SEQ ID NO: 222274 - protein, 9 aa, Japanese encephalitis virus
HRAGSTLGK

SEQ ID NO: 222275 - protein, 9 aa, Japanese encephalitis virus
RAGSTLGKA

SEQ ID NO: 222276 - protein, 9 aa, Japanese encephalitis virus
PGSTLGKAF

SEQ ID NO: 222277 - protein, 9 aa, Japanese encephalitis virus
GSTLGKAFL

SEQ ID NO: 222278 - protein, 9 aa, Japanese encephalitis virus
STLGKAFLT

SEQ ID NO: 222279 - protein, 9 aa, Japanese encephalitis virus
TLGKAFLTT

SEQ ID NO: 222280 - protein, 9 aa, Japanese encephalitis virus
LGKAFLTTL

SEQ ID NO: 222281 - protein, 9 aa, Japanese encephalitis virus
GKAFLTTLK

SEQ ID NO: 222282 - protein, 9 aa, Japanese encephalitis virus
KAFLTTLKG

SEQ ID NO: 222283 - protein, 9 aa, Japanese encephalitis virus
AFLTTLKGA

SEQ ID NO: 222284 - protein, 9 aa, Japanese encephalitis virus
FLTTLKGAQ

SEQ ID NO: 222285 - protein, 9 aa, Japanese encephalitis virus
LTTLKGAQR

SEQ ID NO: 222286 - protein, 9 aa, Japanese encephalitis virus
TLKGAQRLV

SEQ ID NO: 222287 - protein, 9 aa, Japanese encephalitis virus
LKGAQRLVA

SEQ ID NO: 222288 - protein, 9 aa, Japanese encephalitis virus
KGAQRLVAL

SEQ ID NO: 222289 - protein, 9 aa, Japanese encephalitis virus
GAQRLVALG

SEQ ID NO: 222290 - protein, 9 aa, Japanese encephalitis virus
AQRLVALGD

SEQ ID NO: 222291 - protein, 9 aa, Japanese encephalitis virus
QRLVALGDT

SEQ ID NO: 222292 - protein, 9 aa, Japanese encephalitis virus
RLVALGDTA

SEQ ID NO: 222293 - protein, 9 aa, Japanese encephalitis virus
LVALGDTAW

SEQ ID NO: 222294 - protein, 9 aa, Japanese encephalitis virus
VALGDTAWD

SEQ ID NO: 222295 - protein, 9 aa, Japanese encephalitis virus
AWDFGSIGR

SEQ ID NO: 222296 - protein, 9 aa, Japanese encephalitis virus
WDFGSIGRV

SEQ ID NO: 222297 - protein, 9 aa, Japanese encephalitis virus
DFGSIGRVF

SEQ ID NO: 222298 - protein, 9 aa, Japanese encephalitis virus
FGSIGGIFN

SEQ ID NO: 222299 - protein, 9 aa, Japanese encephalitis virus
GSIGGIFNS

SEQ ID NO: 222300 - protein, 9 aa, Japanese encephalitis virus
SIGRVFNSI

SEQ ID NO: 222301 - protein, 9 aa, Japanese encephalitis virus
IGGIFNSIG

SEQ ID NO: 222302 - protein, 9 aa, Japanese encephalitis virus
GGVFNSIGR

SEQ ID NO: 222303 - protein, 9 aa, Japanese encephalitis virus
GVFNSIGRA

SEQ ID NO: 222304 - protein, 9 aa, Japanese encephalitis virus
VFNSIGRAV

SEQ ID NO: 222305 - protein, 9 aa, Japanese encephalitis virus
FNSIGRAVH

SEQ ID NO: 222306 - protein, 9 aa, Japanese encephalitis virus
NSIGRAVHQ

SEQ ID NO: 222307 - protein, 9 aa, Japanese encephalitis virus
SIGRAVHQV

SEQ ID NO: 222308 - protein, 9 aa, Japanese encephalitis virus
IGRAVHQVF

SEQ ID NO: 222309 - protein, 9 aa, Japanese encephalitis virus
GRAVHQVFG

SEQ ID NO: 222310 - protein, 9 aa, Japanese encephalitis virus
RAVHQVFGG

SEQ ID NO: 222311 - protein, 9 aa, Japanese encephalitis virus
AVHQVFGDA

SEQ ID NO: 222312 - protein, 9 aa, Japanese encephalitis virus
VHQVFGDAF

SEQ ID NO: 222313 - protein, 9 aa, Japanese encephalitis virus
HQVFGDAFR

SEQ ID NO: 222314 - protein, 9 aa, Japanese encephalitis virus
QVFGDAFRT

SEQ ID NO: 222315 - protein, 9 aa, Japanese encephalitis virus
VFGDAFRTL

SEQ ID NO: 222316 - protein, 9 aa, Japanese encephalitis virus
FGDAFRTLF

SEQ ID NO: 222317 - protein, 9 aa, Japanese encephalitis virus
GDAFRTLFG

SEQ ID NO: 222318 - protein, 9 aa, Japanese encephalitis virus
DAFRTLFGG

SEQ ID NO: 222319 - protein, 9 aa, Japanese encephalitis virus
WITQGLMGV

SEQ ID NO: 222320 - protein, 9 aa, Japanese encephalitis virus
ITQGLMGVL

SEQ ID NO: 222321 - protein, 9 aa, Japanese encephalitis virus
TQGLMGVLL

SEQ ID NO: 222322 - protein, 9 aa, Japanese encephalitis virus
QGLMGVLLL

SEQ ID NO: 222323 - protein, 9 aa, Japanese encephalitis virus
GLMGVLLLW

SEQ ID NO: 222324 - protein, 9 aa, Japanese encephalitis virus
LMGVLLLWM

SEQ ID NO: 222325 - protein, 9 aa, Japanese encephalitis virus
MGVLLLWMG

SEQ ID NO: 222326 - protein, 9 aa, Japanese encephalitis virus
GALLLWMGI

SEQ ID NO: 222327 - protein, 9 aa, Japanese encephalitis virus
ALLLWMGIN

SEQ ID NO: 222328 - protein, 9 aa, Japanese encephalitis virus
LLLWMGINA

SEQ ID NO: 222329 - protein, 9 aa, Japanese encephalitis virus
LLWMGINAR

SEQ ID NO: 222330 - protein, 9 aa, Japanese encephalitis virus
LWMGINARD

SEQ ID NO: 222331 - protein, 9 aa, Japanese encephalitis virus
WMGINARDR

SEQ ID NO: 222332 - protein, 9 aa, Japanese encephalitis virus
MGINARDRS

SEQ ID NO: 222333 - protein, 9 aa, Japanese encephalitis virus
GINARDRSI

SEQ ID NO: 222334 - protein, 9 aa, Japanese encephalitis virus
INARDRSIA

SEQ ID NO: 222335 - protein, 9 aa, Japanese encephalitis virus
NARDRSIAM

SEQ ID NO: 222336 - protein, 9 aa, Japanese encephalitis virus
ARNRSIALA

SEQ ID NO: 222337 - protein, 9 aa, Japanese encephalitis virus
RNRSIALAF

SEQ ID NO: 222338 - protein, 9 aa, Japanese encephalitis virus
NRSIALAFL

SEQ ID NO: 222339 - protein, 9 aa, Japanese encephalitis virus
RSIAMAFLV

SEQ ID NO: 222340 - protein, 9 aa, Japanese encephalitis virus
SIAMAFLVT

SEQ ID NO: 222341 - protein, 9 aa, Japanese encephalitis virus
IAMAFLVTG

SEQ ID NO: 222342 - protein, 9 aa, Japanese encephalitis virus
AMAFLVTGG

SEQ ID NO: 222343 - protein, 9 aa, Japanese encephalitis virus
MAFLVTGGT

SEQ ID NO: 222344 - protein, 9 aa, Japanese encephalitis virus
AFLVTGGTL

SEQ ID NO: 222345 - protein, 9 aa, Japanese encephalitis virus
FLVTGGTLL

SEQ ID NO: 222346 - protein, 9 aa, Japanese encephalitis virus
LVTGGTLLF

SEQ ID NO: 222347 - protein, 9 aa, Japanese encephalitis virus
VTGGTLLFL

SEQ ID NO: 222348 - protein, 9 aa, Japanese encephalitis virus
TGGTLLFLA

SEQ ID NO: 222349 - protein, 9 aa, Japanese encephalitis virus
GGTLLFLAT

SEQ ID NO: 222350 - protein, 9 aa, Japanese encephalitis virus
GTLLFLATN

SEQ ID NO: 222351 - protein, 9 aa, Japanese encephalitis virus
TLLFLATNV

SEQ ID NO: 222352 - protein, 9 aa, Japanese encephalitis virus
LLFLATNVH

SEQ ID NO: 222353 - protein, 9 aa, Japanese encephalitis virus
LFLATNVHA

SEQ ID NO: 222354 - protein, 9 aa, Japanese encephalitis virus
TNVHADTGS

SEQ ID NO: 222355 - protein, 9 aa, Japanese encephalitis virus
NVHADTGSA

SEQ ID NO: 222356 - protein, 9 aa, Japanese encephalitis virus
VHADTGSAI

SEQ ID NO: 222357 - protein, 9 aa, Japanese encephalitis virus
HADTGSAID

SEQ ID NO: 222358 - protein, 9 aa, Japanese encephalitis virus
ADTGCAIDT

SEQ ID NO: 222359 - protein, 9 aa, Japanese encephalitis virus
DTGCAIDIA

SEQ ID NO: 222360 - protein, 9 aa, Japanese encephalitis virus
TGCAIDIAR

SEQ ID NO: 222361 - protein, 9 aa, Japanese encephalitis virus
TRREMRCGS

SEQ ID NO: 222362 - protein, 9 aa, Japanese encephalitis virus
RREMRCGSG

SEQ ID NO: 222363 - protein, 9 aa, Japanese encephalitis virus
REMRCGSGI

SEQ ID NO: 222364 - protein, 9 aa, Japanese encephalitis virus
QMRCGSGIF

SEQ ID NO: 222365 - protein, 9 aa, Japanese encephalitis virus
YKYLPETPK

SEQ ID NO: 222366 - protein, 9 aa, Japanese encephalitis virus
KYLPETPKS

SEQ ID NO: 222367 - protein, 9 aa, Japanese encephalitis virus
YLPETPKSL

SEQ ID NO: 222368 - protein, 9 aa, Japanese encephalitis virus
LPETPKSLA

SEQ ID NO: 222369 - protein, 9 aa, Japanese encephalitis virus
PETPKSLAK

SEQ ID NO: 222370 - protein, 9 aa, Japanese encephalitis virus
ETPRALAKI

SEQ ID NO: 222371 - protein, 9 aa, Japanese encephalitis virus
TPRALAKIV

SEQ ID NO: 222372 - protein, 9 aa, Japanese encephalitis virus
PKSLAKIVH

SEQ ID NO: 222373 - protein, 9 aa, Japanese encephalitis virus
RALAKIVHK

SEQ ID NO: 222374 - protein, 9 aa, Japanese encephalitis virus
ALAKIVHKA

SEQ ID NO: 222375 - protein, 9 aa, Japanese encephalitis virus
LAKIVHKAY

SEQ ID NO: 222376 - protein, 9 aa, Japanese encephalitis virus
AKIVHKAHQ

SEQ ID NO: 222377 - protein, 9 aa, Japanese encephalitis virus
KIVHKAHQE

SEQ ID NO: 222378 - protein, 9 aa, Japanese encephalitis virus
IVHKAHQEG

SEQ ID NO: 222379 - protein, 9 aa, Japanese encephalitis virus
VHKAHQEGV

SEQ ID NO: 222380 - protein, 9 aa, Japanese encephalitis virus
HKAHQEGVC

SEQ ID NO: 222381 - protein, 9 aa, Japanese encephalitis virus
KAHQEGVCG

SEQ ID NO: 222382 - protein, 9 aa, Japanese encephalitis virus
AHQEGVCGV

SEQ ID NO: 222383 - protein, 9 aa, Japanese encephalitis virus
HQEGVCGVR

SEQ ID NO: 222384 - protein, 9 aa, Japanese encephalitis virus
QEGVCGVRS

SEQ ID NO: 222385 - protein, 9 aa, Japanese encephalitis virus
EGVCGIRSV

SEQ ID NO: 222386 - protein, 9 aa, Japanese encephalitis virus
GVCGIRSVT

SEQ ID NO: 222387 - protein, 9 aa, Japanese encephalitis virus
ICGVRSVTR

SEQ ID NO: 222388 - protein, 9 aa, Japanese encephalitis virus
CGIRSVTRL

SEQ ID NO: 222389 - protein, 9 aa, Japanese encephalitis virus
GIRSVTRLE

SEQ ID NO: 222390 - protein, 9 aa, Japanese encephalitis virus
IRSVTRLEH

SEQ ID NO: 222391 - protein, 9 aa, Japanese encephalitis virus
RLEHQMWES

SEQ ID NO: 222392 - protein, 9 aa, Japanese encephalitis virus
LEHQMWESV

SEQ ID NO: 222393 - protein, 9 aa, Japanese encephalitis virus
EHQMWESVR

SEQ ID NO: 222394 - protein, 9 aa, Japanese encephalitis virus
HQMWESVRD

SEQ ID NO: 222395 - protein, 9 aa, Japanese encephalitis virus
QMWESVRDE

SEQ ID NO: 222396 - protein, 9 aa, Japanese encephalitis virus
MWESVRDEL

SEQ ID NO: 222397 - protein, 9 aa, Japanese encephalitis virus
WESVRDELN

SEQ ID NO: 222398 - protein, 9 aa, Japanese encephalitis virus
ESVRDELNV

SEQ ID NO: 222399 - protein, 9 aa, Japanese encephalitis virus
SVRDELNVL

SEQ ID NO: 222400 - protein, 9 aa, Japanese encephalitis virus
VRDELNVPL

SEQ ID NO: 222401 - protein, 9 aa, Japanese encephalitis virus
RDELNVPLK

SEQ ID NO: 222402 - protein, 9 aa, Japanese encephalitis virus
DELNVPLKE

SEQ ID NO: 222403 - protein, 9 aa, Japanese encephalitis virus
ELNVPLKEN

SEQ ID NO: 222404 - protein, 9 aa, Japanese encephalitis virus
LNVPLKENA

SEQ ID NO: 222405 - protein, 9 aa, Japanese encephalitis virus
NVPLKENAV

SEQ ID NO: 222406 - protein, 9 aa, Japanese encephalitis virus
VPLKENAVD

SEQ ID NO: 222407 - protein, 9 aa, Japanese encephalitis virus
PLKENAVDL

SEQ ID NO: 222408 - protein, 9 aa, Japanese encephalitis virus
KPVGRYRST

SEQ ID NO: 222409 - protein, 9 aa, Japanese encephalitis virus
PVGRYRSTP

SEQ ID NO: 222410 - protein, 9 aa, Japanese encephalitis virus
VGRYRSTPK

SEQ ID NO: 222411 - protein, 9 aa, Japanese encephalitis virus
GRYRSTPKR

SEQ ID NO: 222412 - protein, 9 aa, Japanese encephalitis virus
RYRSTPKRL

SEQ ID NO: 222413 - protein, 9 aa, Japanese encephalitis virus
YRSTPKRLS

SEQ ID NO: 222414 - protein, 9 aa, Japanese encephalitis virus
RSTPKRLSM

SEQ ID NO: 222415 - protein, 9 aa, Japanese encephalitis virus
STPKRLSMT

SEQ ID NO: 222416 - protein, 9 aa, Japanese encephalitis virus
APKRLSMTR

SEQ ID NO: 222417 - protein, 9 aa, Japanese encephalitis virus
PKRLFMTQE

SEQ ID NO: 222418 - protein, 9 aa, Japanese encephalitis virus
KRLFMTQEK

SEQ ID NO: 222419 - protein, 9 aa, Japanese encephalitis virus
RLFMTQEKV

SEQ ID NO: 222420 - protein, 9 aa, Japanese encephalitis virus
LFMTQEKVE

SEQ ID NO: 222421 - protein, 9 aa, Japanese encephalitis virus
FMTQEKVEM

SEQ ID NO: 222422 - protein, 9 aa, Japanese encephalitis virus
MTQEKVEMG

SEQ ID NO: 222423 - protein, 9 aa, Japanese encephalitis virus
TREKFEMGW

SEQ ID NO: 222424 - protein, 9 aa, Japanese encephalitis virus
REKFEMGWK

SEQ ID NO: 222425 - protein, 9 aa, Japanese encephalitis virus
EKVEMGWKA

SEQ ID NO: 222426 - protein, 9 aa, Japanese encephalitis virus
KVEMGWKAW

SEQ ID NO: 222427 - protein, 9 aa, Japanese encephalitis virus
VEMGWKAWG

SEQ ID NO: 222428 - protein, 9 aa, Japanese encephalitis virus
GWKAWGKSL

SEQ ID NO: 222429 - protein, 9 aa, Japanese encephalitis virus
WKAWGKSML

SEQ ID NO: 222430 - protein, 9 aa, Japanese encephalitis virus
KAWGKSLLF

SEQ ID NO: 222431 - protein, 9 aa, Japanese encephalitis virus
AWGKSMLFA

SEQ ID NO: 222432 - protein, 9 aa, Japanese encephalitis virus
WGKSLLFAP

SEQ ID NO: 222433 - protein, 9 aa, Japanese encephalitis virus
GKSLLFAPE

SEQ ID NO: 222434 - protein, 9 aa, Japanese encephalitis virus
KSLLFAPEL

SEQ ID NO: 222435 - protein, 9 aa, Japanese encephalitis virus
SMLFAPELA

SEQ ID NO: 222436 - protein, 9 aa, Japanese encephalitis virus
ILFAPEMAN

SEQ ID NO: 222437 - protein, 9 aa, Japanese encephalitis virus
LFAPEMANS

SEQ ID NO: 222438 - protein, 9 aa, Japanese encephalitis virus
FAPEMANST

SEQ ID NO: 222439 - protein, 9 aa, Japanese encephalitis virus
APEMANSTF

SEQ ID NO: 222440 - protein, 9 aa, Japanese encephalitis virus
PEMANSTFV

SEQ ID NO: 222441 - protein, 9 aa, Japanese encephalitis virus
ELANSSFVV

SEQ ID NO: 222442 - protein, 9 aa, Japanese encephalitis virus
MANSTFVVD

SEQ ID NO: 222443 - protein, 9 aa, Japanese encephalitis virus
ANSSFVVDG

SEQ ID NO: 222444 - protein, 9 aa, Japanese encephalitis virus
NSSFVVDGP

SEQ ID NO: 222445 - protein, 9 aa, Japanese encephalitis virus
SSFVVDGPE

SEQ ID NO: 222446 - protein, 9 aa, Japanese encephalitis virus
SFVVDGPET

SEQ ID NO: 222447 - protein, 9 aa, Japanese encephalitis virus
GPETKECPV

SEQ ID NO: 222448 - protein, 9 aa, Japanese encephalitis virus
PETKECPVV

SEQ ID NO: 222449 - protein, 9 aa, Japanese encephalitis virus
ETKECPDER

SEQ ID NO: 222450 - protein, 9 aa, Japanese encephalitis virus
TKECPDERR

SEQ ID NO: 222451 - protein, 9 aa, Japanese encephalitis virus
KECPDERRA

SEQ ID NO: 222452 - protein, 9 aa, Japanese encephalitis virus
ECPDERRAW

SEQ ID NO: 222453 - protein, 9 aa, Japanese encephalitis virus
CPDERRAWN

SEQ ID NO: 222454 - protein, 9 aa, Japanese encephalitis virus
PDERRAWNS

SEQ ID NO: 222455 - protein, 9 aa, Japanese encephalitis virus
DERRAWNSM

SEQ ID NO: 222456 - protein, 9 aa, Japanese encephalitis virus
ERRAWNSMQ

SEQ ID NO: 222457 - protein, 9 aa, Japanese encephalitis virus
RRAWNSMQI

SEQ ID NO: 222458 - protein, 9 aa, Japanese encephalitis virus
RAWNSTQIE

SEQ ID NO: 222459 - protein, 9 aa, Japanese encephalitis virus
AWNSTQIED

SEQ ID NO: 222460 - protein, 9 aa, Japanese encephalitis virus
WNSTQIEDF

SEQ ID NO: 222461 - protein, 9 aa, Japanese encephalitis virus
NSTQIEDFG

SEQ ID NO: 222462 - protein, 9 aa, Japanese encephalitis virus
STQIEDFGF

SEQ ID NO: 222463 - protein, 9 aa, Japanese encephalitis virus
TQIEDFGFG

SEQ ID NO: 222464 - protein, 9 aa, Japanese encephalitis virus
VWLKIREEN

SEQ ID NO: 222465 - protein, 9 aa, Japanese encephalitis virus
WLKIREENT

SEQ ID NO: 222466 - protein, 9 aa, Japanese encephalitis virus
LKIREENTD

SEQ ID NO: 222467 - protein, 9 aa, Japanese encephalitis virus
KIREENTDE

SEQ ID NO: 222468 - protein, 9 aa, Japanese encephalitis virus
IREENTDEC

SEQ ID NO: 222469 - protein, 9 aa, Japanese encephalitis virus
REENTDECD

SEQ ID NO: 222470 - protein, 9 aa, Japanese encephalitis virus
EENTDECDG

SEQ ID NO: 222471 - protein, 9 aa, Japanese encephalitis virus
ENTDECDGA

SEQ ID NO: 222472 - protein, 9 aa, Japanese encephalitis virus
NTDECDGAI

SEQ ID NO: 222473 - protein, 9 aa, Japanese encephalitis virus
TDECDGPII

SEQ ID NO: 222474 - protein, 9 aa, Japanese encephalitis virus
DECDGPIIG

SEQ ID NO: 222475 - protein, 9 aa, Japanese encephalitis virus
ECDGPIIGT

SEQ ID NO: 222476 - protein, 9 aa, Japanese encephalitis virus
CDGPIIGTA

SEQ ID NO: 222477 - protein, 9 aa, Japanese encephalitis virus
DGPIIGTAV

SEQ ID NO: 222478 - protein, 9 aa, Japanese encephalitis virus
GPIIGTAVK

SEQ ID NO: 222479 - protein, 9 aa, Japanese encephalitis virus
PIIGTAVKG

SEQ ID NO: 222480 - protein, 9 aa, Japanese encephalitis virus
IIGTAVKGN

SEQ ID NO: 222481 - protein, 9 aa, Japanese encephalitis virus
IGTAVKGNV

SEQ ID NO: 222482 - protein, 9 aa, Japanese encephalitis virus
GTAVKGNVA

SEQ ID NO: 222483 - protein, 9 aa, Japanese encephalitis virus
TAVKGNVAV

SEQ ID NO: 222484 - protein, 9 aa, Japanese encephalitis virus
AVKGNVAVH

SEQ ID NO: 222485 - protein, 9 aa, Japanese encephalitis virus
VKGNVAVHS

SEQ ID NO: 222486 - protein, 9 aa, Japanese encephalitis virus
KGNVAVHSD

SEQ ID NO: 222487 - protein, 9 aa, Japanese encephalitis virus
GNVAVHSDL

SEQ ID NO: 222488 - protein, 9 aa, Japanese encephalitis virus
NVAVHSDLS

SEQ ID NO: 222489 - protein, 9 aa, Japanese encephalitis virus
VTVHSDVSY

SEQ ID NO: 222490 - protein, 9 aa, Japanese encephalitis virus
ALHSDLSYW

SEQ ID NO: 222491 - protein, 9 aa, Japanese encephalitis virus
VHSDVSYWI

SEQ ID NO: 222492 - protein, 9 aa, Japanese encephalitis virus
HSDLSYWIG

SEQ ID NO: 222493 - protein, 9 aa, Japanese encephalitis virus
SDVSYWIES

SEQ ID NO: 222494 - protein, 9 aa, Japanese encephalitis virus
DLSYWIESH

SEQ ID NO: 222495 - protein, 9 aa, Japanese encephalitis virus
SYWIESRLN

SEQ ID NO: 222496 - protein, 9 aa, Japanese encephalitis virus
YWIESRLND

SEQ ID NO: 222497 - protein, 9 aa, Japanese encephalitis virus
NDTWKLERL

SEQ ID NO: 222498 - protein, 9 aa, Japanese encephalitis virus
DTWKRERAV

SEQ ID NO: 222499 - protein, 9 aa, Japanese encephalitis virus
TWKRERAVF

SEQ ID NO: 222500 - protein, 9 aa, Japanese encephalitis virus
RKLERAVFG

SEQ ID NO: 222501 - protein, 9 aa, Japanese encephalitis virus
KRERAVFEE

SEQ ID NO: 222502 - protein, 9 aa, Japanese encephalitis virus
LERAVFGEI

SEQ ID NO: 222503 - protein, 9 aa, Japanese encephalitis virus
ERAVFGEIK

SEQ ID NO: 222504 - protein, 9 aa, Japanese encephalitis virus
RAVFGEIKS

SEQ ID NO: 222505 - protein, 9 aa, Japanese encephalitis virus
AVFGEIKSC

SEQ ID NO: 222506 - protein, 9 aa, Japanese encephalitis virus
VFGEIKSCT

SEQ ID NO: 222507 - protein, 9 aa, Japanese encephalitis virus
FGEIKSCTW

SEQ ID NO: 222508 - protein, 9 aa, Japanese encephalitis virus
GEIKSCTWP

SEQ ID NO: 222509 - protein, 9 aa, Japanese encephalitis virus
EIKSCTWPE

SEQ ID NO: 222510 - protein, 9 aa, Japanese encephalitis virus
IKSCTWPET

SEQ ID NO: 222511 - protein, 9 aa, Japanese encephalitis virus
SCTWPETHS

SEQ ID NO: 222512 - protein, 9 aa, Japanese encephalitis virus
CTWPETHSL

SEQ ID NO: 222513 - protein, 9 aa, Japanese encephalitis virus
TWPETHSLW

SEQ ID NO: 222514 - protein, 9 aa, Japanese encephalitis virus
WPETHSLWG

SEQ ID NO: 222515 - protein, 9 aa, Japanese encephalitis virus
PETHSLWGD

SEQ ID NO: 222516 - protein, 9 aa, Japanese encephalitis virus
ETHTLWGDD

SEQ ID NO: 222517 - protein, 9 aa, Japanese encephalitis virus
THTLWGDDV

SEQ ID NO: 222518 - protein, 9 aa, Japanese encephalitis virus
HTLWGDDVE

SEQ ID NO: 222519 - protein, 9 aa, Japanese encephalitis virus
TLWGDDVEE

SEQ ID NO: 222520 - protein, 9 aa, Japanese encephalitis virus
LWGDDVEES

SEQ ID NO: 222521 - protein, 9 aa, Japanese encephalitis virus
WGDDVEESE

SEQ ID NO: 222522 - protein, 9 aa, Japanese encephalitis virus
GDDVEESEL

SEQ ID NO: 222523 - protein, 9 aa, Japanese encephalitis virus
DDVEESELI

SEQ ID NO: 222524 - protein, 9 aa, Japanese encephalitis virus
DVEESELII

SEQ ID NO: 222525 - protein, 9 aa, Japanese encephalitis virus
VEESDLVIP

SEQ ID NO: 222526 - protein, 9 aa, Japanese encephalitis virus
EESELIIPD

SEQ ID NO: 222527 - protein, 9 aa, Japanese encephalitis virus
ESDLVIPHT

SEQ ID NO: 222528 - protein, 9 aa, Japanese encephalitis virus
SELIIPHTL

SEQ ID NO: 222529 - protein, 9 aa, Japanese encephalitis virus
ELIIPHTLA

SEQ ID NO: 222530 - protein, 9 aa, Japanese encephalitis virus
LIIPHTLAG

SEQ ID NO: 222531 - protein, 9 aa, Japanese encephalitis virus
IIPHTLAGP

SEQ ID NO: 222532 - protein, 9 aa, Japanese encephalitis virus
IPHTIAGPR

SEQ ID NO: 222533 - protein, 9 aa, Japanese encephalitis virus
PHTIAGPRS

SEQ ID NO: 222534 - protein, 9 aa, Japanese encephalitis virus
HTIAGPRSK

SEQ ID NO: 222535 - protein, 9 aa, Japanese encephalitis virus
TIAGPRSKH

SEQ ID NO: 222536 - protein, 9 aa, Japanese encephalitis virus
IAGPRSKHN

SEQ ID NO: 222537 - protein, 9 aa, Japanese encephalitis virus
AGPRSKHNR

SEQ ID NO: 222538 - protein, 9 aa, Japanese encephalitis virus
GPRSKHNRR

SEQ ID NO: 222539 - protein, 9 aa, Japanese encephalitis virus
PRSKHNRRE

SEQ ID NO: 222540 - protein, 9 aa, Japanese encephalitis virus
RSKHNRREG

SEQ ID NO: 222541 - protein, 9 aa, Japanese encephalitis virus
SKHNQREGY

SEQ ID NO: 222542 - protein, 9 aa, Japanese encephalitis virus
KHNRREGYR

SEQ ID NO: 222543 - protein, 9 aa, Japanese encephalitis virus
HNRREGYRT

SEQ ID NO: 222544 - protein, 9 aa, Japanese encephalitis virus
NRREGYRTQ

SEQ ID NO: 222545 - protein, 9 aa, Japanese encephalitis virus
RREGYRTQN

SEQ ID NO: 222546 - protein, 9 aa, Japanese encephalitis virus
REGYRTQNQ

SEQ ID NO: 222547 - protein, 9 aa, Japanese encephalitis virus
EGYRTQNQG

SEQ ID NO: 222548 - protein, 9 aa, Japanese encephalitis virus
GYRTQNQGP

SEQ ID NO: 222549 - protein, 9 aa, Japanese encephalitis virus
YRTQNQGPW

SEQ ID NO: 222550 - protein, 9 aa, Japanese encephalitis virus
RTQNQGPWD

SEQ ID NO: 222551 - protein, 9 aa, Japanese encephalitis virus
QNQGPWDEK

SEQ ID NO: 222552 - protein, 9 aa, Japanese encephalitis virus
NQGPWDEDG

SEQ ID NO: 222553 - protein, 9 aa, Japanese encephalitis virus
QGPWDENGL

SEQ ID NO: 222554 - protein, 9 aa, Japanese encephalitis virus
GPWDENGLV

SEQ ID NO: 222555 - protein, 9 aa, Japanese encephalitis virus
PWDENGLVP

SEQ ID NO: 222556 - protein, 9 aa, Japanese encephalitis virus
WDEKGIVLD

SEQ ID NO: 222557 - protein, 9 aa, Japanese encephalitis virus
DEKGIVLDF

SEQ ID NO: 222558 - protein, 9 aa, Japanese encephalitis virus
ESGIVLDFD

SEQ ID NO: 222559 - protein, 9 aa, Japanese encephalitis virus
NGLVPGLDY

SEQ ID NO: 222560 - protein, 9 aa, Japanese encephalitis virus
GLVPGLDYC

SEQ ID NO: 222561 - protein, 9 aa, Japanese encephalitis virus
LVPGLDYCP

SEQ ID NO: 222562 - protein, 9 aa, Japanese encephalitis virus
VPGLDYCPG

SEQ ID NO: 222563 - protein, 9 aa, Japanese encephalitis virus
PGLDYCPGT

SEQ ID NO: 222564 - protein, 9 aa, Japanese encephalitis virus
DFDYCPGTT

SEQ ID NO: 222565 - protein, 9 aa, Japanese encephalitis virus
LDYCPGTKV

SEQ ID NO: 222566 - protein, 9 aa, Japanese encephalitis virus
DYCPGTTVT

SEQ ID NO: 222567 - protein, 9 aa, Japanese encephalitis virus
YCPGTTVTI

SEQ ID NO: 222568 - protein, 9 aa, Japanese encephalitis virus
CPGTTVTIT

SEQ ID NO: 222569 - protein, 9 aa, Japanese encephalitis virus
PGTTVTITE

SEQ ID NO: 222570 - protein, 9 aa, Japanese encephalitis virus
GTTVTITED

SEQ ID NO: 222571 - protein, 9 aa, Japanese encephalitis virus
TTVTITEDC

SEQ ID NO: 222572 - protein, 9 aa, Japanese encephalitis virus
KVTITEDCS

SEQ ID NO: 222573 - protein, 9 aa, Japanese encephalitis virus
VTITEDCSK

SEQ ID NO: 222574 - protein, 9 aa, Japanese encephalitis virus
TITEDCSKR

SEQ ID NO: 222575 - protein, 9 aa, Japanese encephalitis virus
ITEDCSKRG

SEQ ID NO: 222576 - protein, 9 aa, Japanese encephalitis virus
TEDCSKRGP

SEQ ID NO: 222577 - protein, 9 aa, Japanese encephalitis virus
EDCSKRGPS

SEQ ID NO: 222578 - protein, 9 aa, Japanese encephalitis virus
DCGKRGPSI

SEQ ID NO: 222579 - protein, 9 aa, Japanese encephalitis virus
CGKRGPSIR

SEQ ID NO: 222580 - protein, 9 aa, Japanese encephalitis virus
GKRGPSIRT

SEQ ID NO: 222581 - protein, 9 aa, Japanese encephalitis virus
KRGPSIRTT

SEQ ID NO: 222582 - protein, 9 aa, Japanese encephalitis virus
RGPSIRTTT

SEQ ID NO: 222583 - protein, 9 aa, Japanese encephalitis virus
GPSIRTTTD

SEQ ID NO: 222584 - protein, 9 aa, Japanese encephalitis virus
PSIRTTTDS

SEQ ID NO: 222585 - protein, 9 aa, Japanese encephalitis virus
SIRTTTDSG

SEQ ID NO: 222586 - protein, 9 aa, Japanese encephalitis virus
IRTTTDSGK

SEQ ID NO: 222587 - protein, 9 aa, Japanese encephalitis virus
RTTTDIGKL

SEQ ID NO: 222588 - protein, 9 aa, Japanese encephalitis virus
TTTDIGKLI

SEQ ID NO: 222589 - protein, 9 aa, Japanese encephalitis virus
TTDIGKLIT

SEQ ID NO: 222590 - protein, 9 aa, Japanese encephalitis virus
TDIGKLITD

SEQ ID NO: 222591 - protein, 9 aa, Japanese encephalitis virus
DIGKLITDW

SEQ ID NO: 222592 - protein, 9 aa, Japanese encephalitis virus
IGKLITDWC

SEQ ID NO: 222593 - protein, 9 aa, Japanese encephalitis virus
LITDWCCRN

SEQ ID NO: 222594 - protein, 9 aa, Japanese encephalitis virus
ITDWCCRNC

SEQ ID NO: 222595 - protein, 9 aa, Japanese encephalitis virus
TDWCCRNCS

SEQ ID NO: 222596 - protein, 9 aa, Japanese encephalitis virus
DWCCRSCTL

SEQ ID NO: 222597 - protein, 9 aa, Japanese encephalitis virus
WCCRSCTLP

SEQ ID NO: 222598 - protein, 9 aa, Japanese encephalitis virus
CCRNCSLPP

SEQ ID NO: 222599 - protein, 9 aa, Japanese encephalitis virus
CRSCTLPPL

SEQ ID NO: 222600 - protein, 9 aa, Japanese encephalitis virus
RSCSLPPLG

SEQ ID NO: 222601 - protein, 9 aa, Japanese encephalitis virus
SCSLPPLGF

SEQ ID NO: 222602 - protein, 9 aa, Japanese encephalitis virus
CSLPPLGFR

SEQ ID NO: 222603 - protein, 9 aa, Japanese encephalitis virus
SLPPLGFRT

SEQ ID NO: 222604 - protein, 9 aa, Japanese encephalitis virus
LPPLGFRTE

SEQ ID NO: 222605 - protein, 9 aa, Japanese encephalitis virus
PPLGFRTEN

SEQ ID NO: 222606 - protein, 9 aa, Japanese encephalitis virus
PLGFRTENG

SEQ ID NO: 222607 - protein, 9 aa, Japanese encephalitis virus
LGFRTENGC

SEQ ID NO: 222608 - protein, 9 aa, Japanese encephalitis virus
GFRTENGCW

SEQ ID NO: 222609 - protein, 9 aa, Japanese encephalitis virus
FRTGSGCWY

SEQ ID NO: 222610 - protein, 9 aa, Japanese encephalitis virus
RTGSGCWYG

SEQ ID NO: 222611 - protein, 9 aa, Japanese encephalitis virus
TDNGCWYGM

SEQ ID NO: 222612 - protein, 9 aa, Japanese encephalitis virus
GSGCWYGME

SEQ ID NO: 222613 - protein, 9 aa, Japanese encephalitis virus
SGCWYGMEV

SEQ ID NO: 222614 - protein, 9 aa, Japanese encephalitis virus
GCWYGMEVR

SEQ ID NO: 222615 - protein, 9 aa, Japanese encephalitis virus
CWYGMEVRP

SEQ ID NO: 222616 - protein, 9 aa, Japanese encephalitis virus
WYGMEIRPL

SEQ ID NO: 222617 - protein, 9 aa, Japanese encephalitis virus
RHDEATLVR

SEQ ID NO: 222618 - protein, 9 aa, Japanese encephalitis virus
HDEATLVRS

SEQ ID NO: 222619 - protein, 9 aa, Japanese encephalitis virus
DEATLVRSQ

SEQ ID NO: 222620 - protein, 9 aa, Japanese encephalitis virus
EATLVRSQV

SEQ ID NO: 222621 - protein, 9 aa, Japanese encephalitis virus
TLVRSQVHA

SEQ ID NO: 222622 - protein, 9 aa, Japanese encephalitis virus
NGEMIDPFQ

SEQ ID NO: 222623 - protein, 9 aa, Japanese encephalitis virus
GEMIDPFQL

SEQ ID NO: 222624 - protein, 9 aa, Japanese encephalitis virus
EMIDPFQLG

SEQ ID NO: 222625 - protein, 9 aa, Japanese encephalitis virus
MIDPFQLGL

SEQ ID NO: 222626 - protein, 9 aa, Japanese encephalitis virus
IDPFQLGLL

SEQ ID NO: 222627 - protein, 9 aa, Japanese encephalitis virus
DPFQMGLLV

SEQ ID NO: 222628 - protein, 9 aa, Japanese encephalitis virus
PFQLGLLVV

SEQ ID NO: 222629 - protein, 9 aa, Japanese encephalitis virus
FQLGLLVVF

SEQ ID NO: 222630 - protein, 9 aa, Japanese encephalitis virus
QLGLLVVFL

SEQ ID NO: 222631 - protein, 9 aa, Japanese encephalitis virus
LGLLVVFLA

SEQ ID NO: 222632 - protein, 9 aa, Japanese encephalitis virus
GLLVVFLAT

SEQ ID NO: 222633 - protein, 9 aa, Japanese encephalitis virus
LLVVFLATQ

SEQ ID NO: 222634 - protein, 9 aa, Japanese encephalitis virus
LVVFLATQE

SEQ ID NO: 222635 - protein, 9 aa, Japanese encephalitis virus
VVFLATQEV

SEQ ID NO: 222636 - protein, 9 aa, Japanese encephalitis virus
VFLATQEVL

SEQ ID NO: 222637 - protein, 9 aa, Japanese encephalitis virus
FLATQEVLG

SEQ ID NO: 222638 - protein, 9 aa, Japanese encephalitis virus
LATQEVLGK

SEQ ID NO: 222639 - protein, 9 aa, Japanese encephalitis virus
ATQEVFRKR

SEQ ID NO: 222640 - protein, 9 aa, Japanese encephalitis virus
TQEVFRKRW

SEQ ID NO: 222641 - protein, 9 aa, Japanese encephalitis virus
QEVLGKRWT

SEQ ID NO: 222642 - protein, 9 aa, Japanese encephalitis virus
EVFRKRWTA

SEQ ID NO: 222643 - protein, 9 aa, Japanese encephalitis virus
VFRKRWTAR

SEQ ID NO: 222644 - protein, 9 aa, Japanese encephalitis virus
FRKRWTARL

SEQ ID NO: 222645 - protein, 9 aa, Japanese encephalitis virus
GKRWTARLT

SEQ ID NO: 222646 - protein, 9 aa, Japanese encephalitis virus
KRWTARLTV

SEQ ID NO: 222647 - protein, 9 aa, Japanese encephalitis virus
RWTARLTVP

SEQ ID NO: 222648 - protein, 9 aa, Japanese encephalitis virus
WTARLTVPA

SEQ ID NO: 222649 - protein, 9 aa, Japanese encephalitis virus
TARLTVPAV

SEQ ID NO: 222650 - protein, 9 aa, Japanese encephalitis virus
ARLTVPAVL

SEQ ID NO: 222651 - protein, 9 aa, Japanese encephalitis virus
RLTVPAVLG

SEQ ID NO: 222652 - protein, 9 aa, Japanese encephalitis virus
LTIPAVLGV

SEQ ID NO: 222653 - protein, 9 aa, Japanese encephalitis virus
TIPAVLGVL

SEQ ID NO: 222654 - protein, 9 aa, Japanese encephalitis virus
IPAVLGVLL

SEQ ID NO: 222655 - protein, 9 aa, Japanese encephalitis virus
PAVLGVLLV

SEQ ID NO: 222656 - protein, 9 aa, Japanese encephalitis virus
AVLGVLLVL

SEQ ID NO: 222657 - protein, 9 aa, Japanese encephalitis virus
VLGVLLVLM

SEQ ID NO: 222658 - protein, 9 aa, Japanese encephalitis virus
LGVLLVLML

SEQ ID NO: 222659 - protein, 9 aa, Japanese encephalitis virus
GVLLVLMLG

SEQ ID NO: 222660 - protein, 9 aa, Japanese encephalitis virus
VLLVLMLGG

SEQ ID NO: 222661 - protein, 9 aa, Japanese encephalitis virus
LLVLMFGGI

SEQ ID NO: 222662 - protein, 9 aa, Japanese encephalitis virus
LVLMFGGIT

SEQ ID NO: 222663 - protein, 9 aa, Japanese encephalitis virus
VLMFGGITY

SEQ ID NO: 222664 - protein, 9 aa, Japanese encephalitis virus
LMLGGITYI

SEQ ID NO: 222665 - protein, 9 aa, Japanese encephalitis virus
MLGGITYID

SEQ ID NO: 222666 - protein, 9 aa, Japanese encephalitis virus
LGGITYIDL

SEQ ID NO: 222667 - protein, 9 aa, Japanese encephalitis virus
GGITYIDLA

SEQ ID NO: 222668 - protein, 9 aa, Japanese encephalitis virus
GITYIDLAR

SEQ ID NO: 222669 - protein, 9 aa, Japanese encephalitis virus
ITYIDLARY

SEQ ID NO: 222670 - protein, 9 aa, Japanese encephalitis virus
TYIDLARYV

SEQ ID NO: 222671 - protein, 9 aa, Japanese encephalitis virus
YIDLARYVV

SEQ ID NO: 222672 - protein, 9 aa, Japanese encephalitis virus
IDLARYVVL

SEQ ID NO: 222673 - protein, 9 aa, Japanese encephalitis virus
RYVVLVAAV

SEQ ID NO: 222674 - protein, 9 aa, Japanese encephalitis virus
YVVLVAASF

SEQ ID NO: 222675 - protein, 9 aa, Japanese encephalitis virus
VVLVAASFA

SEQ ID NO: 222676 - protein, 9 aa, Japanese encephalitis virus
VLVAAVFAE

SEQ ID NO: 222677 - protein, 9 aa, Japanese encephalitis virus
LVAAVFAEA

SEQ ID NO: 222678 - protein, 9 aa, Japanese encephalitis virus
VAAVFAEAN

SEQ ID NO: 222679 - protein, 9 aa, Japanese encephalitis virus
AAAFAEANN

SEQ ID NO: 222680 - protein, 9 aa, Japanese encephalitis virus
AAFAEANNG

SEQ ID NO: 222681 - protein, 9 aa, Japanese encephalitis virus
AFAEANNGG

SEQ ID NO: 222682 - protein, 9 aa, Japanese encephalitis virus
FAEANNGGD

SEQ ID NO: 222683 - protein, 9 aa, Japanese encephalitis virus
AEANNGGDV

SEQ ID NO: 222684 - protein, 9 aa, Japanese encephalitis virus
EANNGGDVL

SEQ ID NO: 222685 - protein, 9 aa, Japanese encephalitis virus
ANNGGDVLH

SEQ ID NO: 222686 - protein, 9 aa, Japanese encephalitis virus
NNGGDVLHL

SEQ ID NO: 222687 - protein, 9 aa, Japanese encephalitis virus
NGGDVLHLA

SEQ ID NO: 222688 - protein, 9 aa, Japanese encephalitis virus
FKIQPAFLA

SEQ ID NO: 222689 - protein, 9 aa, Japanese encephalitis virus
KIQPAFLAM

SEQ ID NO: 222690 - protein, 9 aa, Japanese encephalitis virus
IQPAFLAMK

SEQ ID NO: 222691 - protein, 9 aa, Japanese encephalitis virus
QPAFLAMKM

SEQ ID NO: 222692 - protein, 9 aa, Japanese encephalitis virus
PAFLAMNTL

SEQ ID NO: 222693 - protein, 9 aa, Japanese encephalitis virus
AFLAMKMLS

SEQ ID NO: 222694 - protein, 9 aa, Japanese encephalitis virus
FLVMNMLSA

SEQ ID NO: 222695 - protein, 9 aa, Japanese encephalitis virus
NMLSARWTN

SEQ ID NO: 222696 - protein, 9 aa, Japanese encephalitis virus
MLSARWTNQ

SEQ ID NO: 222697 - protein, 9 aa, Japanese encephalitis virus
LSARWTNQE

SEQ ID NO: 222698 - protein, 9 aa, Japanese encephalitis virus
SARWTNQEN

SEQ ID NO: 222699 - protein, 9 aa, Japanese encephalitis virus
ARWTNQENV

SEQ ID NO: 222700 - protein, 9 aa, Japanese encephalitis virus
RWTNQENVA

SEQ ID NO: 222701 - protein, 9 aa, Japanese encephalitis virus
WTNQENVAL

SEQ ID NO: 222702 - protein, 9 aa, Japanese encephalitis virus
TNQENVALV

SEQ ID NO: 222703 - protein, 9 aa, Japanese encephalitis virus
NQENVALVL

SEQ ID NO: 222704 - protein, 9 aa, Japanese encephalitis virus
QENVALVLG

SEQ ID NO: 222705 - protein, 9 aa, Japanese encephalitis virus
ENVALVLGA

SEQ ID NO: 222706 - protein, 9 aa, Japanese encephalitis virus
NVALVLGAA

SEQ ID NO: 222707 - protein, 9 aa, Japanese encephalitis virus
VALVLGAAF

SEQ ID NO: 222708 - protein, 9 aa, Japanese encephalitis virus
ALVLGAAFF

SEQ ID NO: 222709 - protein, 9 aa, Japanese encephalitis virus
LVLGAALFQ

SEQ ID NO: 222710 - protein, 9 aa, Japanese encephalitis virus
VLGAALFQL

SEQ ID NO: 222711 - protein, 9 aa, Japanese encephalitis virus
LGAALFQLA

SEQ ID NO: 222712 - protein, 9 aa, Japanese encephalitis virus
GAALFQLAS

SEQ ID NO: 222713 - protein, 9 aa, Japanese encephalitis virus
AAFFQLASA

SEQ ID NO: 222714 - protein, 9 aa, Japanese encephalitis virus
AFFQLASAD

SEQ ID NO: 222715 - protein, 9 aa, Japanese encephalitis virus
FFQLASADL

SEQ ID NO: 222716 - protein, 9 aa, Japanese encephalitis virus
FQLASADLQ

SEQ ID NO: 222717 - protein, 9 aa, Japanese encephalitis virus
QLASADLQI

SEQ ID NO: 222718 - protein, 9 aa, Japanese encephalitis virus
LASADLQIG

SEQ ID NO: 222719 - protein, 9 aa, Japanese encephalitis virus
ASADLQIGV

SEQ ID NO: 222720 - protein, 9 aa, Japanese encephalitis virus
SADLQIGVH

SEQ ID NO: 222721 - protein, 9 aa, Japanese encephalitis virus
ADLQIGVHG

SEQ ID NO: 222722 - protein, 9 aa, Japanese encephalitis virus
DLQIGVHGM

SEQ ID NO: 222723 - protein, 9 aa, Japanese encephalitis virus
LQIGVHGML

SEQ ID NO: 222724 - protein, 9 aa, Japanese encephalitis virus
QIGVHGMLN

SEQ ID NO: 222725 - protein, 9 aa, Japanese encephalitis virus
IGVHGMLNA

SEQ ID NO: 222726 - protein, 9 aa, Japanese encephalitis virus
GVHGMLNAA

SEQ ID NO: 222727 - protein, 9 aa, Japanese encephalitis virus
VHGMLNAAA

SEQ ID NO: 222728 - protein, 9 aa, Japanese encephalitis virus
HGMLNAAAI

SEQ ID NO: 222729 - protein, 9 aa, Japanese encephalitis virus
GMLNAAAIA

SEQ ID NO: 222730 - protein, 9 aa, Japanese encephalitis virus
ILNAAAMAW

SEQ ID NO: 222731 - protein, 9 aa, Japanese encephalitis virus
LNAAAMAWM

SEQ ID NO: 222732 - protein, 9 aa, Japanese encephalitis virus
NAAAMAWMI

SEQ ID NO: 222733 - protein, 9 aa, Japanese encephalitis virus
AAAIAWMII

SEQ ID NO: 222734 - protein, 9 aa, Japanese encephalitis virus
AAMAWMIVR

SEQ ID NO: 222735 - protein, 9 aa, Japanese encephalitis virus
AIAWMIIKA

SEQ ID NO: 222736 - protein, 9 aa, Japanese encephalitis virus
MAWMIVRAI

SEQ ID NO: 222737 - protein, 9 aa, Japanese encephalitis virus
AWMIIKAIT

SEQ ID NO: 222738 - protein, 9 aa, Japanese encephalitis virus
WMIIKAITF

SEQ ID NO: 222739 - protein, 9 aa, Japanese encephalitis virus
MIIKAITFP

SEQ ID NO: 222740 - protein, 9 aa, Japanese encephalitis virus
IIKAITFPT

SEQ ID NO: 222741 - protein, 9 aa, Japanese encephalitis virus
VRAITFPTA

SEQ ID NO: 222742 - protein, 9 aa, Japanese encephalitis virus
RAITFPTAS

SEQ ID NO: 222743 - protein, 9 aa, Japanese encephalitis virus
AITFPTTST

SEQ ID NO: 222744 - protein, 9 aa, Japanese encephalitis virus
ITFPTTSTV

SEQ ID NO: 222745 - protein, 9 aa, Japanese encephalitis virus
TFPTTSTVA

SEQ ID NO: 222746 - protein, 9 aa, Japanese encephalitis virus
FPTTSTVAM

SEQ ID NO: 222747 - protein, 9 aa, Japanese encephalitis virus
PTTSTVAMP

SEQ ID NO: 222748 - protein, 9 aa, Japanese encephalitis virus
MPILALLTP

SEQ ID NO: 222749 - protein, 9 aa, Japanese encephalitis virus
PILALLTPG

SEQ ID NO: 222750 - protein, 9 aa, Japanese encephalitis virus
ILALLTPGM

SEQ ID NO: 222751 - protein, 9 aa, Japanese encephalitis virus
LTLLTPGMR

SEQ ID NO: 222752 - protein, 9 aa, Japanese encephalitis virus
ALLTPGMKA

SEQ ID NO: 222753 - protein, 9 aa, Japanese encephalitis virus
LLTPGMKAL

SEQ ID NO: 222754 - protein, 9 aa, Japanese encephalitis virus
LTPGMKALY

SEQ ID NO: 222755 - protein, 9 aa, Japanese encephalitis virus
TPGMRALCL

SEQ ID NO: 222756 - protein, 9 aa, Japanese encephalitis virus
PGMRALCLD

SEQ ID NO: 222757 - protein, 9 aa, Japanese encephalitis virus
GMKALYLDT

SEQ ID NO: 222758 - protein, 9 aa, Japanese encephalitis virus
MKALYLDTY

SEQ ID NO: 222759 - protein, 9 aa, Japanese encephalitis virus
RAFDLDTYR

SEQ ID NO: 222760 - protein, 9 aa, Japanese encephalitis virus
AFDLDTYRI

SEQ ID NO: 222761 - protein, 9 aa, Japanese encephalitis virus
LCLDTYRII

SEQ ID NO: 222762 - protein, 9 aa, Japanese encephalitis virus
CLDTYRIIL

SEQ ID NO: 222763 - protein, 9 aa, Japanese encephalitis virus
DTYRIILLI

SEQ ID NO: 222764 - protein, 9 aa, Japanese encephalitis virus
TYRIILLII

SEQ ID NO: 222765 - protein, 9 aa, Japanese encephalitis virus
YRIILLIIG

SEQ ID NO: 222766 - protein, 9 aa, Japanese encephalitis virus
RIILLVIGV

SEQ ID NO: 222767 - protein, 9 aa, Japanese encephalitis virus
IILLVIGVC

SEQ ID NO: 222768 - protein, 9 aa, Japanese encephalitis virus
ILLVIGVCS

SEQ ID NO: 222769 - protein, 9 aa, Japanese encephalitis virus
LLVIGVCSL

SEQ ID NO: 222770 - protein, 9 aa, Japanese encephalitis virus
LVIGVCSLL

SEQ ID NO: 222771 - protein, 9 aa, Japanese encephalitis virus
VIGICSLLH

SEQ ID NO: 222772 - protein, 9 aa, Japanese encephalitis virus
IGICSLLHE

SEQ ID NO: 222773 - protein, 9 aa, Japanese encephalitis virus
GICSLLHER

SEQ ID NO: 222774 - protein, 9 aa, Japanese encephalitis virus
ERRKTMAKK

SEQ ID NO: 222775 - protein, 9 aa, Japanese encephalitis virus
RRKTMAKKK

SEQ ID NO: 222776 - protein, 9 aa, Japanese encephalitis virus
RKTMAKKKG

SEQ ID NO: 222777 - protein, 9 aa, Japanese encephalitis virus
KAMAKKKGA

SEQ ID NO: 222778 - protein, 9 aa, Japanese encephalitis virus
AMAKKKGAV

SEQ ID NO: 222779 - protein, 9 aa, Japanese encephalitis virus
AKKKGAVLM

SEQ ID NO: 222780 - protein, 9 aa, Japanese encephalitis virus
KKKGAVLMG

SEQ ID NO: 222781 - protein, 9 aa, Japanese encephalitis virus
KKGAVLMGL

SEQ ID NO: 222782 - protein, 9 aa, Japanese encephalitis virus
KGAVLMGLA

SEQ ID NO: 222783 - protein, 9 aa, Japanese encephalitis virus
GAVLMGLAL

SEQ ID NO: 222784 - protein, 9 aa, Japanese encephalitis virus
AVLMGLALT

SEQ ID NO: 222785 - protein, 9 aa, Japanese encephalitis virus
VLMGLALTS

SEQ ID NO: 222786 - protein, 9 aa, Japanese encephalitis virus
LMGLALTST

SEQ ID NO: 222787 - protein, 9 aa, Japanese encephalitis virus
MGLALTSTG

SEQ ID NO: 222788 - protein, 9 aa, Japanese encephalitis virus
GWFSPTTIT

SEQ ID NO: 222789 - protein, 9 aa, Japanese encephalitis virus
WFSPTTITA

SEQ ID NO: 222790 - protein, 9 aa, Japanese encephalitis virus
FSPTTITAG

SEQ ID NO: 222791 - protein, 9 aa, Japanese encephalitis virus
SPTTITAGL

SEQ ID NO: 222792 - protein, 9 aa, Japanese encephalitis virus
PTTITAGLM

SEQ ID NO: 222793 - protein, 9 aa, Japanese encephalitis virus
TTITAGLMV

SEQ ID NO: 222794 - protein, 9 aa, Japanese encephalitis virus
TITAGLMVC

SEQ ID NO: 222795 - protein, 9 aa, Japanese encephalitis virus
ITAGLMVCN

SEQ ID NO: 222796 - protein, 9 aa, Japanese encephalitis virus
TAGLMVCNP

SEQ ID NO: 222797 - protein, 9 aa, Japanese encephalitis virus
AGLMACNPN

SEQ ID NO: 222798 - protein, 9 aa, Japanese encephalitis virus
GLMACNPNK

SEQ ID NO: 222799 - protein, 9 aa, Japanese encephalitis virus
LMACNPNKK

SEQ ID NO: 222800 - protein, 9 aa, Japanese encephalitis virus
MACNPNKKR

SEQ ID NO: 222801 - protein, 9 aa, Japanese encephalitis virus
ACNPNKKRG

SEQ ID NO: 222802 - protein, 9 aa, Japanese encephalitis virus
KRGWPATEV

SEQ ID NO: 222803 - protein, 9 aa, Japanese encephalitis virus
RGWPATEVL

SEQ ID NO: 222804 - protein, 9 aa, Japanese encephalitis virus
GWPATEVLS

SEQ ID NO: 222805 - protein, 9 aa, Japanese encephalitis virus
WPATEVLSA

SEQ ID NO: 222806 - protein, 9 aa, Japanese encephalitis virus
PATEFLSAI

SEQ ID NO: 222807 - protein, 9 aa, Japanese encephalitis virus
ATEFLSAIG

SEQ ID NO: 222808 - protein, 9 aa, Japanese encephalitis virus
TEFLSAIGL

SEQ ID NO: 222809 - protein, 9 aa, Japanese encephalitis virus
EFLSAIGLM

SEQ ID NO: 222810 - protein, 9 aa, Japanese encephalitis virus
FLSAIGLMF

SEQ ID NO: 222811 - protein, 9 aa, Japanese encephalitis virus
LSAIGLMFA

SEQ ID NO: 222812 - protein, 9 aa, Japanese encephalitis virus
SAIGLMFAI

SEQ ID NO: 222813 - protein, 9 aa, Japanese encephalitis virus
AIGLMFAIV

SEQ ID NO: 222814 - protein, 9 aa, Japanese encephalitis virus
IGLMFAIVG

SEQ ID NO: 222815 - protein, 9 aa, Japanese encephalitis virus
AIVGGLAEM

SEQ ID NO: 222816 - protein, 9 aa, Japanese encephalitis virus
IVGGLAEMD

SEQ ID NO: 222817 - protein, 9 aa, Japanese encephalitis virus
VGGLAEMDI

SEQ ID NO: 222818 - protein, 9 aa, Japanese encephalitis virus
GGLAEMDIE

SEQ ID NO: 222819 - protein, 9 aa, Japanese encephalitis virus
GLAEMDIES

SEQ ID NO: 222820 - protein, 9 aa, Japanese encephalitis virus
LAEMDIESM

SEQ ID NO: 222821 - protein, 9 aa, Japanese encephalitis virus
AEMDIESMS

SEQ ID NO: 222822 - protein, 9 aa, Japanese encephalitis virus
EMDIESMSI

SEQ ID NO: 222823 - protein, 9 aa, Japanese encephalitis virus
MDIESMSIP

SEQ ID NO: 222824 - protein, 9 aa, Japanese encephalitis virus
MSIPFMLAV

SEQ ID NO: 222825 - protein, 9 aa, Japanese encephalitis virus
SIPFMLAVL

SEQ ID NO: 222826 - protein, 9 aa, Japanese encephalitis virus
IPFMLAVLM

SEQ ID NO: 222827 - protein, 9 aa, Japanese encephalitis virus
PFMLAVLMA

SEQ ID NO: 222828 - protein, 9 aa, Japanese encephalitis virus
FMLAVLMAV

SEQ ID NO: 222829 - protein, 9 aa, Japanese encephalitis virus
MLAVLMAVS

SEQ ID NO: 222830 - protein, 9 aa, Japanese encephalitis virus
LAVLMAVSY

SEQ ID NO: 222831 - protein, 9 aa, Japanese encephalitis virus
AVLMAVSYV

SEQ ID NO: 222832 - protein, 9 aa, Japanese encephalitis virus
VLMAVSYVV

SEQ ID NO: 222833 - protein, 9 aa, Japanese encephalitis virus
GKATDMWLD

SEQ ID NO: 222834 - protein, 9 aa, Japanese encephalitis virus
KATDMWLDR

SEQ ID NO: 222835 - protein, 9 aa, Japanese encephalitis virus
ATDMWLDRA

SEQ ID NO: 222836 - protein, 9 aa, Japanese encephalitis virus
TDMWLDRAA

SEQ ID NO: 222837 - protein, 9 aa, Japanese encephalitis virus
DMWLDRAAD

SEQ ID NO: 222838 - protein, 9 aa, Japanese encephalitis virus
MWLDRAADI

SEQ ID NO: 222839 - protein, 9 aa, Japanese encephalitis virus
WLDRAADIS

SEQ ID NO: 222840 - protein, 9 aa, Japanese encephalitis virus
LDRAADISW

SEQ ID NO: 222841 - protein, 9 aa, Japanese encephalitis virus
RAADISWDM

SEQ ID NO: 222842 - protein, 9 aa, Japanese encephalitis virus
SWEMEAAIT

SEQ ID NO: 222843 - protein, 9 aa, Japanese encephalitis virus
WEMEAAITG

SEQ ID NO: 222844 - protein, 9 aa, Japanese encephalitis virus
EMEAAITGS

SEQ ID NO: 222845 - protein, 9 aa, Japanese encephalitis virus
MEAAITGSS

SEQ ID NO: 222846 - protein, 9 aa, Japanese encephalitis virus
EAAITGSSR

SEQ ID NO: 222847 - protein, 9 aa, Japanese encephalitis virus
RRLDVKLDE

SEQ ID NO: 222848 - protein, 9 aa, Japanese encephalitis virus
RLDVKLDED

SEQ ID NO: 222849 - protein, 9 aa, Japanese encephalitis virus
LDVKLDEDG

SEQ ID NO: 222850 - protein, 9 aa, Japanese encephalitis virus
DVKLDEDGD

SEQ ID NO: 222851 - protein, 9 aa, Japanese encephalitis virus
VKLDEDGDF

SEQ ID NO: 222852 - protein, 9 aa, Japanese encephalitis virus
KLDEDGDFH

SEQ ID NO: 222853 - protein, 9 aa, Japanese encephalitis virus
LDEDGDFHL

SEQ ID NO: 222854 - protein, 9 aa, Japanese encephalitis virus
DEDGDFHLI

SEQ ID NO: 222855 - protein, 9 aa, Japanese encephalitis virus
EDGDFHLID

SEQ ID NO: 222856 - protein, 9 aa, Japanese encephalitis virus
DGDFHFIDD

SEQ ID NO: 222857 - protein, 9 aa, Japanese encephalitis virus
GDFHFIDDP

SEQ ID NO: 222858 - protein, 9 aa, Japanese encephalitis virus
DFHLIDVPG

SEQ ID NO: 222859 - protein, 9 aa, Japanese encephalitis virus
FHFIDDPGV

SEQ ID NO: 222860 - protein, 9 aa, Japanese encephalitis virus
HLIDVPGVP

SEQ ID NO: 222861 - protein, 9 aa, Japanese encephalitis virus
LIDVPGVPW

SEQ ID NO: 222862 - protein, 9 aa, Japanese encephalitis virus
IDVPGVPWK

SEQ ID NO: 222863 - protein, 9 aa, Japanese encephalitis virus
DDPGVPWKI

SEQ ID NO: 222864 - protein, 9 aa, Japanese encephalitis virus
VPGVPWKVW

SEQ ID NO: 222865 - protein, 9 aa, Japanese encephalitis virus
PGVPWKVWL

SEQ ID NO: 222866 - protein, 9 aa, Japanese encephalitis virus
GVPWKVWLL

SEQ ID NO: 222867 - protein, 9 aa, Japanese encephalitis virus
VPWKVWLLR

SEQ ID NO: 222868 - protein, 9 aa, Japanese encephalitis virus
PWKVWLLRM

SEQ ID NO: 222869 - protein, 9 aa, Japanese encephalitis virus
WKVWLLRMS

SEQ ID NO: 222870 - protein, 9 aa, Japanese encephalitis virus
KVWLLRMSC

SEQ ID NO: 222871 - protein, 9 aa, Japanese encephalitis virus
VWLLRMSCI

SEQ ID NO: 222872 - protein, 9 aa, Japanese encephalitis virus
WLLRMSCIG

SEQ ID NO: 222873 - protein, 9 aa, Japanese encephalitis virus
LLRMSCIGL

SEQ ID NO: 222874 - protein, 9 aa, Japanese encephalitis virus
LRMSCSGLA

SEQ ID NO: 222875 - protein, 9 aa, Japanese encephalitis virus
RMSCIGLVA

SEQ ID NO: 222876 - protein, 9 aa, Japanese encephalitis virus
MSCSGLAAL

SEQ ID NO: 222877 - protein, 9 aa, Japanese encephalitis virus
SCIGLVALT

SEQ ID NO: 222878 - protein, 9 aa, Japanese encephalitis virus
CIGLVALTP

SEQ ID NO: 222879 - protein, 9 aa, Japanese encephalitis virus
ICLAALTPW

SEQ ID NO: 222880 - protein, 9 aa, Japanese encephalitis virus
CLAALTPWA

SEQ ID NO: 222881 - protein, 9 aa, Japanese encephalitis virus
LVALTPWAI

SEQ ID NO: 222882 - protein, 9 aa, Japanese encephalitis virus
VALTPWAIV

SEQ ID NO: 222883 - protein, 9 aa, Japanese encephalitis virus
DTPSPKPCL

SEQ ID NO: 222884 - protein, 9 aa, Japanese encephalitis virus
TPSPKPCLK

SEQ ID NO: 222885 - protein, 9 aa, Japanese encephalitis virus
PSPKPCLKG

SEQ ID NO: 222886 - protein, 9 aa, Japanese encephalitis virus
SPKPCLKGD

SEQ ID NO: 222887 - protein, 9 aa, Japanese encephalitis virus
PKPCLKGDT

SEQ ID NO: 222888 - protein, 9 aa, Japanese encephalitis virus
KPCLKGDTT

SEQ ID NO: 222889 - protein, 9 aa, Japanese encephalitis virus
PCLKGDTTT

SEQ ID NO: 222890 - protein, 9 aa, Japanese encephalitis virus
CLKGDTTTG

SEQ ID NO: 222891 - protein, 9 aa, Japanese encephalitis virus
LKGDTTTGV

SEQ ID NO: 222892 - protein, 9 aa, Japanese encephalitis virus
TGVYRIMAC

SEQ ID NO: 222893 - protein, 9 aa, Japanese encephalitis virus
GVYRIMACG

SEQ ID NO: 222894 - protein, 9 aa, Japanese encephalitis virus
VYRIMACGI

SEQ ID NO: 222895 - protein, 9 aa, Japanese encephalitis virus
YRIMARGIF

SEQ ID NO: 222896 - protein, 9 aa, Japanese encephalitis virus
RIMARGIFG

SEQ ID NO: 222897 - protein, 9 aa, Japanese encephalitis virus
IMARGIFGT

SEQ ID NO: 222898 - protein, 9 aa, Japanese encephalitis virus
MACGILGTY

SEQ ID NO: 222899 - protein, 9 aa, Japanese encephalitis virus
ARGIFGTHQ

SEQ ID NO: 222900 - protein, 9 aa, Japanese encephalitis virus
RGIFGTHQA

SEQ ID NO: 222901 - protein, 9 aa, Japanese encephalitis virus
GILGTYQSG

SEQ ID NO: 222902 - protein, 9 aa, Japanese encephalitis virus
ILGTYQSGV

SEQ ID NO: 222903 - protein, 9 aa, Japanese encephalitis virus
LGTYQSGVG

SEQ ID NO: 222904 - protein, 9 aa, Japanese encephalitis virus
GTYQSGVGV

SEQ ID NO: 222905 - protein, 9 aa, Japanese encephalitis virus
THQAGVGVM

SEQ ID NO: 222906 - protein, 9 aa, Japanese encephalitis virus
YQSGVGVIY

SEQ ID NO: 222907 - protein, 9 aa, Japanese encephalitis virus
QAGVGVMYQ

SEQ ID NO: 222908 - protein, 9 aa, Japanese encephalitis virus
SGVGVIYEN

SEQ ID NO: 222909 - protein, 9 aa, Japanese encephalitis virus
GVGVMYESV

SEQ ID NO: 222910 - protein, 9 aa, Japanese encephalitis virus
VGVMYESVF

SEQ ID NO: 222911 - protein, 9 aa, Japanese encephalitis virus
GVMYQNVFH

SEQ ID NO: 222912 - protein, 9 aa, Japanese encephalitis virus
VMYQNVFHT

SEQ ID NO: 222913 - protein, 9 aa, Japanese encephalitis virus
MYESVFHTL

SEQ ID NO: 222914 - protein, 9 aa, Japanese encephalitis virus
YESVFHTLW

SEQ ID NO: 222915 - protein, 9 aa, Japanese encephalitis virus
ESVFHTLWH

SEQ ID NO: 222916 - protein, 9 aa, Japanese encephalitis virus
NVLHTLWHT

SEQ ID NO: 222917 - protein, 9 aa, Japanese encephalitis virus
VLHTLWHTT

SEQ ID NO: 222918 - protein, 9 aa, Japanese encephalitis virus
LHTLWHTTR

SEQ ID NO: 222919 - protein, 9 aa, Japanese encephalitis virus
HTLWHPTRG

SEQ ID NO: 222920 - protein, 9 aa, Japanese encephalitis virus
TLWHPTRGA

SEQ ID NO: 222921 - protein, 9 aa, Japanese encephalitis virus
LWHPTRGAA

SEQ ID NO: 222922 - protein, 9 aa, Japanese encephalitis virus
WHTTRGAAV

SEQ ID NO: 222923 - protein, 9 aa, Japanese encephalitis virus
HTTRGAAIV

SEQ ID NO: 222924 - protein, 9 aa, Japanese encephalitis virus
TTRGAAIVS

SEQ ID NO: 222925 - protein, 9 aa, Japanese encephalitis virus
TRGAAIVSG

SEQ ID NO: 222926 - protein, 9 aa, Japanese encephalitis virus
RGAAIVSGE

SEQ ID NO: 222927 - protein, 9 aa, Japanese encephalitis virus
GAAIVSGEG

SEQ ID NO: 222928 - protein, 9 aa, Japanese encephalitis virus
AAIVSGEGK

SEQ ID NO: 222929 - protein, 9 aa, Japanese encephalitis virus
AIVSGEGKL

SEQ ID NO: 222930 - protein, 9 aa, Japanese encephalitis virus
IVSGEGKLT

SEQ ID NO: 222931 - protein, 9 aa, Japanese encephalitis virus
VSGEGKLTP

SEQ ID NO: 222932 - protein, 9 aa, Japanese encephalitis virus
SGGGKLTPY

SEQ ID NO: 222933 - protein, 9 aa, Japanese encephalitis virus
GGGKLTPYW

SEQ ID NO: 222934 - protein, 9 aa, Japanese encephalitis virus
KGKLTPYWG

SEQ ID NO: 222935 - protein, 9 aa, Japanese encephalitis virus
LTPYWGSVR

SEQ ID NO: 222936 - protein, 9 aa, Japanese encephalitis virus
TPYWGSVRE

SEQ ID NO: 222937 - protein, 9 aa, Japanese encephalitis virus
PYWGSVRED

SEQ ID NO: 222938 - protein, 9 aa, Japanese encephalitis virus
YWGSVREDR

SEQ ID NO: 222939 - protein, 9 aa, Japanese encephalitis virus
WGSVREDRI

SEQ ID NO: 222940 - protein, 9 aa, Japanese encephalitis virus
GSVKEDRIS

SEQ ID NO: 222941 - protein, 9 aa, Japanese encephalitis virus
SVKEDRISY

SEQ ID NO: 222942 - protein, 9 aa, Japanese encephalitis virus
VKEDRISYG

SEQ ID NO: 222943 - protein, 9 aa, Japanese encephalitis virus
KEDRISYGG

SEQ ID NO: 222944 - protein, 9 aa, Japanese encephalitis virus
EDRISYGGP

SEQ ID NO: 222945 - protein, 9 aa, Japanese encephalitis virus
DRISYGGPW

SEQ ID NO: 222946 - protein, 9 aa, Japanese encephalitis virus
RISYGGPWR

SEQ ID NO: 222947 - protein, 9 aa, Japanese encephalitis virus
ISYGGPWRF

SEQ ID NO: 222948 - protein, 9 aa, Japanese encephalitis virus
SYGGPWRFD

SEQ ID NO: 222949 - protein, 9 aa, Japanese encephalitis virus
FDRKWNGTN

SEQ ID NO: 222950 - protein, 9 aa, Japanese encephalitis virus
DRKWNGTND

SEQ ID NO: 222951 - protein, 9 aa, Japanese encephalitis virus
RKWNGTNDV

SEQ ID NO: 222952 - protein, 9 aa, Japanese encephalitis virus
KWNGTNDVQ

SEQ ID NO: 222953 - protein, 9 aa, Japanese encephalitis virus
WNGTNDVQV

SEQ ID NO: 222954 - protein, 9 aa, Japanese encephalitis virus
NGTNDVQVI

SEQ ID NO: 222955 - protein, 9 aa, Japanese encephalitis virus
GTNDVQVIV

SEQ ID NO: 222956 - protein, 9 aa, Japanese encephalitis virus
TNDVQVIVV

SEQ ID NO: 222957 - protein, 9 aa, Japanese encephalitis virus
NDVQVIVVE

SEQ ID NO: 222958 - protein, 9 aa, Japanese encephalitis virus
DVQVIVVEQ

SEQ ID NO: 222959 - protein, 9 aa, Japanese encephalitis virus
VQVIVVEQG

SEQ ID NO: 222960 - protein, 9 aa, Japanese encephalitis virus
QVIVVEQGK

SEQ ID NO: 222961 - protein, 9 aa, Japanese encephalitis virus
VIVVEPGKP

SEQ ID NO: 222962 - protein, 9 aa, Japanese encephalitis virus
IVVEPGKPA

SEQ ID NO: 222963 - protein, 9 aa, Japanese encephalitis virus
AVNFQTKPG

SEQ ID NO: 222964 - protein, 9 aa, Japanese encephalitis virus
NIQTKPGIF

SEQ ID NO: 222965 - protein, 9 aa, Japanese encephalitis virus
IQTKPGIFP

SEQ ID NO: 222966 - protein, 9 aa, Japanese encephalitis virus
QTKPGIFPP

SEQ ID NO: 222967 - protein, 9 aa, Japanese encephalitis virus
TKPGIFPTP

SEQ ID NO: 222968 - protein, 9 aa, Japanese encephalitis virus
KPGVFRTPL

SEQ ID NO: 222969 - protein, 9 aa, Japanese encephalitis virus
PGVFRTPLG

SEQ ID NO: 222970 - protein, 9 aa, Japanese encephalitis virus
PFGEIGAVS

SEQ ID NO: 222971 - protein, 9 aa, Japanese encephalitis virus
FGEIGAVSL

SEQ ID NO: 222972 - protein, 9 aa, Japanese encephalitis virus
GEIGAVSLD

SEQ ID NO: 222973 - protein, 9 aa, Japanese encephalitis virus
EIGAVSLDY

SEQ ID NO: 222974 - protein, 9 aa, Japanese encephalitis virus
IGAVSLDYP

SEQ ID NO: 222975 - protein, 9 aa, Japanese encephalitis virus
GTVSLDYPR

SEQ ID NO: 222976 - protein, 9 aa, Japanese encephalitis virus
TVSLDYPRG

SEQ ID NO: 222977 - protein, 9 aa, Japanese encephalitis virus
GTSGSPILN

SEQ ID NO: 222978 - protein, 9 aa, Japanese encephalitis virus
TSGSPILDF

SEQ ID NO: 222979 - protein, 9 aa, Japanese encephalitis virus
SGSPILNSN

SEQ ID NO: 222980 - protein, 9 aa, Japanese encephalitis virus
GSPILNSNG

SEQ ID NO: 222981 - protein, 9 aa, Japanese encephalitis virus
SPILDFNGD

SEQ ID NO: 222982 - protein, 9 aa, Japanese encephalitis virus
PILNSNGDV

SEQ ID NO: 222983 - protein, 9 aa, Japanese encephalitis virus
ILDFNGDII

SEQ ID NO: 222984 - protein, 9 aa, Japanese encephalitis virus
LNSNGDVVG

SEQ ID NO: 222985 - protein, 9 aa, Japanese encephalitis virus
NSNGDVVGC

SEQ ID NO: 222986 - protein, 9 aa, Japanese encephalitis virus
FNGDIIGLY

SEQ ID NO: 222987 - protein, 9 aa, Japanese encephalitis virus
NGDVVGCLG

SEQ ID NO: 222988 - protein, 9 aa, Japanese encephalitis virus
GDVVGCLGN

SEQ ID NO: 222989 - protein, 9 aa, Japanese encephalitis virus
DVVGCLGNG

SEQ ID NO: 222990 - protein, 9 aa, Japanese encephalitis virus
VVGCLGNGV

SEQ ID NO: 222991 - protein, 9 aa, Japanese encephalitis virus
VGCLGNGVE

SEQ ID NO: 222992 - protein, 9 aa, Japanese encephalitis virus
GLYGNGGEL

SEQ ID NO: 222993 - protein, 9 aa, Japanese encephalitis virus
CLGNGVELG

SEQ ID NO: 222994 - protein, 9 aa, Japanese encephalitis virus
LGNGVELGD

SEQ ID NO: 222995 - protein, 9 aa, Japanese encephalitis virus
GNGGELGDG

SEQ ID NO: 222996 - protein, 9 aa, Japanese encephalitis virus
NGVELGDRS

SEQ ID NO: 222997 - protein, 9 aa, Japanese encephalitis virus
GGELGDGSY

SEQ ID NO: 222998 - protein, 9 aa, Japanese encephalitis virus
VELGDRSYV

SEQ ID NO: 222999 - protein, 9 aa, Japanese encephalitis virus
ELGDRSYVS

SEQ ID NO: 223000 - protein, 9 aa, Japanese encephalitis virus
LGDRSYVSA

SEQ ID NO: 223001 - protein, 9 aa, Japanese encephalitis virus
GDRSYVSAI

SEQ ID NO: 223002 - protein, 9 aa, Japanese encephalitis virus
DRSYVSAIV

SEQ ID NO: 223003 - protein, 9 aa, Japanese encephalitis virus
RSYVSAIVQ

SEQ ID NO: 223004 - protein, 9 aa, Japanese encephalitis virus
YVSAIVQGE

SEQ ID NO: 223005 - protein, 9 aa, Japanese encephalitis virus
VSAIVQGER

SEQ ID NO: 223006 - protein, 9 aa, Japanese encephalitis virus
SAIVQGERQ

SEQ ID NO: 223007 - protein, 9 aa, Japanese encephalitis virus
AIVQGERQE

SEQ ID NO: 223008 - protein, 9 aa, Japanese encephalitis virus
IVQGERQEE

SEQ ID NO: 223009 - protein, 9 aa, Japanese encephalitis virus
VQGERQEEP

SEQ ID NO: 223010 - protein, 9 aa, Japanese encephalitis virus
QGERQEEPV

SEQ ID NO: 223011 - protein, 9 aa, Japanese encephalitis virus
GERQEEPVP

SEQ ID NO: 223012 - protein, 9 aa, Japanese encephalitis virus
DRQEEPVPD

SEQ ID NO: 223013 - protein, 9 aa, Japanese encephalitis virus
RQEEPVPDA

SEQ ID NO: 223014 - protein, 9 aa, Japanese encephalitis virus
QEEPVPDAY

SEQ ID NO: 223015 - protein, 9 aa, Japanese encephalitis virus
EEPVPDAYT

SEQ ID NO: 223016 - protein, 9 aa, Japanese encephalitis virus
EPVPDAYTP

SEQ ID NO: 223017 - protein, 9 aa, Japanese encephalitis virus
PVPDAYTPS

SEQ ID NO: 223018 - protein, 9 aa, Japanese encephalitis virus
VPDAYTPSM

SEQ ID NO: 223019 - protein, 9 aa, Japanese encephalitis virus
PDAYTPSML

SEQ ID NO: 223020 - protein, 9 aa, Japanese encephalitis virus
AYTPSMLKK

SEQ ID NO: 223021 - protein, 9 aa, Japanese encephalitis virus
MLKKRQMTV

SEQ ID NO: 223022 - protein, 9 aa, Japanese encephalitis virus
LKKRQMTVL

SEQ ID NO: 223023 - protein, 9 aa, Japanese encephalitis virus
KKRQMTVLD

SEQ ID NO: 223024 - protein, 9 aa, Japanese encephalitis virus
KRQLTVLDL

SEQ ID NO: 223025 - protein, 9 aa, Japanese encephalitis virus
RQLTVLDLH

SEQ ID NO: 223026 - protein, 9 aa, Japanese encephalitis virus
QLTVLDLHP

SEQ ID NO: 223027 - protein, 9 aa, Japanese encephalitis virus
LTVLDLHPG

SEQ ID NO: 223028 - protein, 9 aa, Japanese encephalitis virus
TVLDLPPGS

SEQ ID NO: 223029 - protein, 9 aa, Japanese encephalitis virus
VLDLPPGSG

SEQ ID NO: 223030 - protein, 9 aa, Japanese encephalitis virus
LDLPPGSGK

SEQ ID NO: 223031 - protein, 9 aa, Japanese encephalitis virus
DLHPGLGKT

SEQ ID NO: 223032 - protein, 9 aa, Japanese encephalitis virus
LHPGSGKTK

SEQ ID NO: 223033 - protein, 9 aa, Japanese encephalitis virus
HPGSGKTKK

SEQ ID NO: 223034 - protein, 9 aa, Japanese encephalitis virus
PGSGKTKKI

SEQ ID NO: 223035 - protein, 9 aa, Japanese encephalitis virus
GSGKTKKIL

SEQ ID NO: 223036 - protein, 9 aa, Japanese encephalitis virus
SGKTKKILP

SEQ ID NO: 223037 - protein, 9 aa, Japanese encephalitis virus
GKTKKILPQ

SEQ ID NO: 223038 - protein, 9 aa, Japanese encephalitis virus
KTKKILPQI

SEQ ID NO: 223039 - protein, 9 aa, Japanese encephalitis virus
TKKILPQII

SEQ ID NO: 223040 - protein, 9 aa, Japanese encephalitis virus
KKILPQIIK

SEQ ID NO: 223041 - protein, 9 aa, Japanese encephalitis virus
KILPQTIKD

SEQ ID NO: 223042 - protein, 9 aa, Japanese encephalitis virus
ILPQIIRDA

SEQ ID NO: 223043 - protein, 9 aa, Japanese encephalitis virus
LPQTIKDAI

SEQ ID NO: 223044 - protein, 9 aa, Japanese encephalitis virus
PQTIKDAIQ

SEQ ID NO: 223045 - protein, 9 aa, Japanese encephalitis virus
QIIRDAIQQ

SEQ ID NO: 223046 - protein, 9 aa, Japanese encephalitis virus
IIKDAIQQH

SEQ ID NO: 223047 - protein, 9 aa, Japanese encephalitis virus
IKDAIQQHL

SEQ ID NO: 223048 - protein, 9 aa, Japanese encephalitis virus
KDAIQQHLR

SEQ ID NO: 223049 - protein, 9 aa, Japanese encephalitis virus
DAIQQHLRT

SEQ ID NO: 223050 - protein, 9 aa, Japanese encephalitis virus
AIQQHLRTA

SEQ ID NO: 223051 - protein, 9 aa, Japanese encephalitis virus
IQQRLKTAV

SEQ ID NO: 223052 - protein, 9 aa, Japanese encephalitis virus
QQRLKTAVL

SEQ ID NO: 223053 - protein, 9 aa, Japanese encephalitis virus
QHLRTAVLA

SEQ ID NO: 223054 - protein, 9 aa, Japanese encephalitis virus
HLRTAVLAP

SEQ ID NO: 223055 - protein, 9 aa, Japanese encephalitis virus
LKTAVLAPT

SEQ ID NO: 223056 - protein, 9 aa, Japanese encephalitis virus
KTAVLAPTR

SEQ ID NO: 223057 - protein, 9 aa, Japanese encephalitis virus
VVAAEMAEV

SEQ ID NO: 223058 - protein, 9 aa, Japanese encephalitis virus
VAAEMAEVL

SEQ ID NO: 223059 - protein, 9 aa, Japanese encephalitis virus
AAEMAEALK

SEQ ID NO: 223060 - protein, 9 aa, Japanese encephalitis virus
AEMAEALKG

SEQ ID NO: 223061 - protein, 9 aa, Japanese encephalitis virus
EMAEALKGL

SEQ ID NO: 223062 - protein, 9 aa, Japanese encephalitis virus
MAEALKGLP

SEQ ID NO: 223063 - protein, 9 aa, Japanese encephalitis virus
AEALKGLPV

SEQ ID NO: 223064 - protein, 9 aa, Japanese encephalitis virus
EALKGLPVR

SEQ ID NO: 223065 - protein, 9 aa, Japanese encephalitis virus
ALKGLPVRY

SEQ ID NO: 223066 - protein, 9 aa, Japanese encephalitis virus
LKGLPVRYQ

SEQ ID NO: 223067 - protein, 9 aa, Japanese encephalitis virus
KGLPVRYQT

SEQ ID NO: 223068 - protein, 9 aa, Japanese encephalitis virus
YQTSAVQRS

SEQ ID NO: 223069 - protein, 9 aa, Japanese encephalitis virus
QTSAVQRSH

SEQ ID NO: 223070 - protein, 9 aa, Japanese encephalitis virus
TSAVQRSHQ

SEQ ID NO: 223071 - protein, 9 aa, Japanese encephalitis virus
SAVQRSHQG

SEQ ID NO: 223072 - protein, 9 aa, Japanese encephalitis virus
AVQRSHQGN

SEQ ID NO: 223073 - protein, 9 aa, Japanese encephalitis virus
VQREHQGNA

SEQ ID NO: 223074 - protein, 9 aa, Japanese encephalitis virus
QRSHQGNEI

SEQ ID NO: 223075 - protein, 9 aa, Japanese encephalitis virus
REHQGNAIV

SEQ ID NO: 223076 - protein, 9 aa, Japanese encephalitis virus
SHQGNEIVD

SEQ ID NO: 223077 - protein, 9 aa, Japanese encephalitis virus
HQGNAIVDV

SEQ ID NO: 223078 - protein, 9 aa, Japanese encephalitis virus
QGNAIVDVM

SEQ ID NO: 223079 - protein, 9 aa, Japanese encephalitis virus
GNAIVDVMC

SEQ ID NO: 223080 - protein, 9 aa, Japanese encephalitis virus
NAIVDVMCH

SEQ ID NO: 223081 - protein, 9 aa, Japanese encephalitis virus
AIVDVMCHA

SEQ ID NO: 223082 - protein, 9 aa, Japanese encephalitis virus
HATLTHRLT

SEQ ID NO: 223083 - protein, 9 aa, Japanese encephalitis virus
ATLTHRLTS

SEQ ID NO: 223084 - protein, 9 aa, Japanese encephalitis virus
TLTHRLTSP

SEQ ID NO: 223085 - protein, 9 aa, Japanese encephalitis virus
LTHRLTSPN

SEQ ID NO: 223086 - protein, 9 aa, Japanese encephalitis virus
THRLTSPNR

SEQ ID NO: 223087 - protein, 9 aa, Japanese encephalitis virus
HRLTSPNRV

SEQ ID NO: 223088 - protein, 9 aa, Japanese encephalitis virus
RLTSPNRVP

SEQ ID NO: 223089 - protein, 9 aa, Japanese encephalitis virus
LTSPNRVPN

SEQ ID NO: 223090 - protein, 9 aa, Japanese encephalitis virus
TSPNRVPNY

SEQ ID NO: 223091 - protein, 9 aa, Japanese encephalitis virus
EAHFTDPAG

SEQ ID NO: 223092 - protein, 9 aa, Japanese encephalitis virus
AHFTDPAGI

SEQ ID NO: 223093 - protein, 9 aa, Japanese encephalitis virus
HFTDPAGIA

SEQ ID NO: 223094 - protein, 9 aa, Japanese encephalitis virus
FTDPAGIAA

SEQ ID NO: 223095 - protein, 9 aa, Japanese encephalitis virus
TDPAGIAAR

SEQ ID NO: 223096 - protein, 9 aa, Japanese encephalitis virus
DPAGIAARG

SEQ ID NO: 223097 - protein, 9 aa, Japanese encephalitis virus
PAGIAARGY

SEQ ID NO: 223098 - protein, 9 aa, Japanese encephalitis virus
AGIAARGYI

SEQ ID NO: 223099 - protein, 9 aa, Japanese encephalitis virus
GIAARGYIA

SEQ ID NO: 223100 - protein, 9 aa, Japanese encephalitis virus
AAIFMTATS

SEQ ID NO: 223101 - protein, 9 aa, Japanese encephalitis virus
AIFMTATSP

SEQ ID NO: 223102 - protein, 9 aa, Japanese encephalitis virus
IFMTATSPG

SEQ ID NO: 223103 - protein, 9 aa, Japanese encephalitis virus
FMTATSPGT

SEQ ID NO: 223104 - protein, 9 aa, Japanese encephalitis virus
MTATSPGTT

SEQ ID NO: 223105 - protein, 9 aa, Japanese encephalitis virus
TATSPGTTD

SEQ ID NO: 223106 - protein, 9 aa, Japanese encephalitis virus
ATSPGTTDP

SEQ ID NO: 223107 - protein, 9 aa, Japanese encephalitis virus
TSPGTTDPF

SEQ ID NO: 223108 - protein, 9 aa, Japanese encephalitis virus
SPGTTDPFP

SEQ ID NO: 223109 - protein, 9 aa, Japanese encephalitis virus
TTDPFPDSD

SEQ ID NO: 223110 - protein, 9 aa, Japanese encephalitis virus
TDPFPDSDA

SEQ ID NO: 223111 - protein, 9 aa, Japanese encephalitis virus
DPFPDSDAP

SEQ ID NO: 223112 - protein, 9 aa, Japanese encephalitis virus
PFPDSDAPI

SEQ ID NO: 223113 - protein, 9 aa, Japanese encephalitis virus
FPDSDAPIH

SEQ ID NO: 223114 - protein, 9 aa, Japanese encephalitis virus
PDSDAPIHD

SEQ ID NO: 223115 - protein, 9 aa, Japanese encephalitis virus
DSDAPIHDL

SEQ ID NO: 223116 - protein, 9 aa, Japanese encephalitis virus
SDAPIHDLQ

SEQ ID NO: 223117 - protein, 9 aa, Japanese encephalitis virus
DAPIHDLQD

SEQ ID NO: 223118 - protein, 9 aa, Japanese encephalitis virus
APIHDLQDG

SEQ ID NO: 223119 - protein, 9 aa, Japanese encephalitis virus
PIHDLQDEV

SEQ ID NO: 223120 - protein, 9 aa, Japanese encephalitis virus
IHDLQDETP

SEQ ID NO: 223121 - protein, 9 aa, Japanese encephalitis virus
HDLQDEVPD

SEQ ID NO: 223122 - protein, 9 aa, Japanese encephalitis virus
DLQDEVPDR

SEQ ID NO: 223123 - protein, 9 aa, Japanese encephalitis virus
LQDEVPDRA

SEQ ID NO: 223124 - protein, 9 aa, Japanese encephalitis virus
QDETPDRAW

SEQ ID NO: 223125 - protein, 9 aa, Japanese encephalitis virus
DETPDRAWS

SEQ ID NO: 223126 - protein, 9 aa, Japanese encephalitis virus
EVPDRAWSS

SEQ ID NO: 223127 - protein, 9 aa, Japanese encephalitis virus
VPDRAWSSG

SEQ ID NO: 223128 - protein, 9 aa, Japanese encephalitis virus
WITDYAGKT

SEQ ID NO: 223129 - protein, 9 aa, Japanese encephalitis virus
ITDYAGKTV

SEQ ID NO: 223130 - protein, 9 aa, Japanese encephalitis virus
TDYAGKTVW

SEQ ID NO: 223131 - protein, 9 aa, Japanese encephalitis virus
DYAGKTVWF

SEQ ID NO: 223132 - protein, 9 aa, Japanese encephalitis virus
YSGKTVWFV

SEQ ID NO: 223133 - protein, 9 aa, Japanese encephalitis virus
SGKTVWFVA

SEQ ID NO: 223134 - protein, 9 aa, Japanese encephalitis virus
TVWFVASVR

SEQ ID NO: 223135 - protein, 9 aa, Japanese encephalitis virus
VWFVASVRM

SEQ ID NO: 223136 - protein, 9 aa, Japanese encephalitis virus
WFVASVRMG

SEQ ID NO: 223137 - protein, 9 aa, Japanese encephalitis virus
FVASVRMGN

SEQ ID NO: 223138 - protein, 9 aa, Japanese encephalitis virus
VASVRMGNE

SEQ ID NO: 223139 - protein, 9 aa, Japanese encephalitis virus
ASVRMGNEI

SEQ ID NO: 223140 - protein, 9 aa, Japanese encephalitis virus
SVRMGNEIA

SEQ ID NO: 223141 - protein, 9 aa, Japanese encephalitis virus
VRMGNEIAM

SEQ ID NO: 223142 - protein, 9 aa, Japanese encephalitis virus
RMGNEIAMC

SEQ ID NO: 223143 - protein, 9 aa, Japanese encephalitis virus
MGNEIAVCL

SEQ ID NO: 223144 - protein, 9 aa, Japanese encephalitis virus
GNEIAVCLQ

SEQ ID NO: 223145 - protein, 9 aa, Japanese encephalitis virus
NEIAVCLQR

SEQ ID NO: 223146 - protein, 9 aa, Japanese encephalitis virus
EIAVCLQRA

SEQ ID NO: 223147 - protein, 9 aa, Japanese encephalitis virus
IAVCLQRAG

SEQ ID NO: 223148 - protein, 9 aa, Japanese encephalitis virus
AVCLQRAGK

SEQ ID NO: 223149 - protein, 9 aa, Japanese encephalitis virus
MCLQRAGKR

SEQ ID NO: 223150 - protein, 9 aa, Japanese encephalitis virus
CLQRAGKRV

SEQ ID NO: 223151 - protein, 9 aa, Japanese encephalitis virus
LQRAGKRVI

SEQ ID NO: 223152 - protein, 9 aa, Japanese encephalitis virus
QRAGKRVIQ

SEQ ID NO: 223153 - protein, 9 aa, Japanese encephalitis virus
RAGKRVIQL

SEQ ID NO: 223154 - protein, 9 aa, Japanese encephalitis virus
AGKKVIQLS

SEQ ID NO: 223155 - protein, 9 aa, Japanese encephalitis virus
GKKVIQLSR

SEQ ID NO: 223156 - protein, 9 aa, Japanese encephalitis virus
KRVIQLNRK

SEQ ID NO: 223157 - protein, 9 aa, Japanese encephalitis virus
KVIQLSRKS

SEQ ID NO: 223158 - protein, 9 aa, Japanese encephalitis virus
VIQLSRKSY

SEQ ID NO: 223159 - protein, 9 aa, Japanese encephalitis virus
IQLSRKSYD

SEQ ID NO: 223160 - protein, 9 aa, Japanese encephalitis virus
QLSRKSYDT

SEQ ID NO: 223161 - protein, 9 aa, Japanese encephalitis virus
LSRKSYDTE

SEQ ID NO: 223162 - protein, 9 aa, Japanese encephalitis virus
SRKSYDTEY

SEQ ID NO: 223163 - protein, 9 aa, Japanese encephalitis virus
VITTDISEV

SEQ ID NO: 223164 - protein, 9 aa, Japanese encephalitis virus
ITTDISEVG

SEQ ID NO: 223165 - protein, 9 aa, Japanese encephalitis virus
TTDISEVGA

SEQ ID NO: 223166 - protein, 9 aa, Japanese encephalitis virus
TDISEVGAN

SEQ ID NO: 223167 - protein, 9 aa, Japanese encephalitis virus
DISEVGANF

SEQ ID NO: 223168 - protein, 9 aa, Japanese encephalitis virus
ISEVGANFG

SEQ ID NO: 223169 - protein, 9 aa, Japanese encephalitis virus
SEVGANFGA

SEQ ID NO: 223170 - protein, 9 aa, Japanese encephalitis virus
EVGANFGAS

SEQ ID NO: 223171 - protein, 9 aa, Japanese encephalitis virus
VGANFGASR

SEQ ID NO: 223172 - protein, 9 aa, Japanese encephalitis virus
VIDCRKSVE

SEQ ID NO: 223173 - protein, 9 aa, Japanese encephalitis virus
IDCRKSVEP

SEQ ID NO: 223174 - protein, 9 aa, Japanese encephalitis virus
DCRKSVKPI

SEQ ID NO: 223175 - protein, 9 aa, Japanese encephalitis virus
CRKSVKPII

SEQ ID NO: 223176 - protein, 9 aa, Japanese encephalitis virus
RKSVKPIIL

SEQ ID NO: 223177 - protein, 9 aa, Japanese encephalitis virus
KSVKPIILE

SEQ ID NO: 223178 - protein, 9 aa, Japanese encephalitis virus
SVKPIILEE

SEQ ID NO: 223179 - protein, 9 aa, Japanese encephalitis virus
VKPIILEEG

SEQ ID NO: 223180 - protein, 9 aa, Japanese encephalitis virus
KPTILEKEE

SEQ ID NO: 223181 - protein, 9 aa, Japanese encephalitis virus
PTILEKEEG

SEQ ID NO: 223182 - protein, 9 aa, Japanese encephalitis virus
IILEEGEGR

SEQ ID NO: 223183 - protein, 9 aa, Japanese encephalitis virus
ILEKEEGRV

SEQ ID NO: 223184 - protein, 9 aa, Japanese encephalitis virus
LEEGEGRVF

SEQ ID NO: 223185 - protein, 9 aa, Japanese encephalitis virus
EEGEGRVFL

SEQ ID NO: 223186 - protein, 9 aa, Japanese encephalitis virus
EGEGRVFLG

SEQ ID NO: 223187 - protein, 9 aa, Japanese encephalitis virus
GEGRVFLGN

SEQ ID NO: 223188 - protein, 9 aa, Japanese encephalitis virus
EGRVFLGNP

SEQ ID NO: 223189 - protein, 9 aa, Japanese encephalitis virus
GRVFLGNPS

SEQ ID NO: 223190 - protein, 9 aa, Japanese encephalitis virus
RVFLGNPSP

SEQ ID NO: 223191 - protein, 9 aa, Japanese encephalitis virus
VFLGNPSPI

SEQ ID NO: 223192 - protein, 9 aa, Japanese encephalitis virus
FLGNPSPIT

SEQ ID NO: 223193 - protein, 9 aa, Japanese encephalitis virus
LGNPSPITN

SEQ ID NO: 223194 - protein, 9 aa, Japanese encephalitis virus
GNPSPITNA

SEQ ID NO: 223195 - protein, 9 aa, Japanese encephalitis virus
NPSPITNAS

SEQ ID NO: 223196 - protein, 9 aa, Japanese encephalitis virus
PSPITNASA

SEQ ID NO: 223197 - protein, 9 aa, Japanese encephalitis virus
SPITNASAA

SEQ ID NO: 223198 - protein, 9 aa, Japanese encephalitis virus
PITNASAAQ

SEQ ID NO: 223199 - protein, 9 aa, Japanese encephalitis virus
ITNASAAQR

SEQ ID NO: 223200 - protein, 9 aa, Japanese encephalitis virus
TNASAAQRR

SEQ ID NO: 223201 - protein, 9 aa, Japanese encephalitis virus
NASAAQRRG

SEQ ID NO: 223202 - protein, 9 aa, Japanese encephalitis virus
AAQRRGRVS

SEQ ID NO: 223203 - protein, 9 aa, Japanese encephalitis virus
AQRRGRVSR

SEQ ID NO: 223204 - protein, 9 aa, Japanese encephalitis virus
QRRGRVSRN

SEQ ID NO: 223205 - protein, 9 aa, Japanese encephalitis virus
RRGRVSRNP

SEQ ID NO: 223206 - protein, 9 aa, Japanese encephalitis virus
RGRVGRNPS

SEQ ID NO: 223207 - protein, 9 aa, Japanese encephalitis virus
GRVGRNPSQ

SEQ ID NO: 223208 - protein, 9 aa, Japanese encephalitis virus
RVGRNPSQV

SEQ ID NO: 223209 - protein, 9 aa, Japanese encephalitis virus
VSRNPNQVG

SEQ ID NO: 223210 - protein, 9 aa, Japanese encephalitis virus
SRNPNQVGD

SEQ ID NO: 223211 - protein, 9 aa, Japanese encephalitis virus
RNPSQVGDE

SEQ ID NO: 223212 - protein, 9 aa, Japanese encephalitis virus
NPSQVGDEY

SEQ ID NO: 223213 - protein, 9 aa, Japanese encephalitis virus
PNQVGDEYE

SEQ ID NO: 223214 - protein, 9 aa, Japanese encephalitis virus
SQVGDEYHY

SEQ ID NO: 223215 - protein, 9 aa, Japanese encephalitis virus
QVGDEYEYG

SEQ ID NO: 223216 - protein, 9 aa, Japanese encephalitis virus
VGDEYEYGG

SEQ ID NO: 223217 - protein, 9 aa, Japanese encephalitis virus
GDEYHYGGP

SEQ ID NO: 223218 - protein, 9 aa, Japanese encephalitis virus
DEYEYGGAT

SEQ ID NO: 223219 - protein, 9 aa, Japanese encephalitis virus
EYHYGGPTS

SEQ ID NO: 223220 - protein, 9 aa, Japanese encephalitis virus
YEYGGATSE

SEQ ID NO: 223221 - protein, 9 aa, Japanese encephalitis virus
HYGGPTSED

SEQ ID NO: 223222 - protein, 9 aa, Japanese encephalitis virus
YGGATSEGD

SEQ ID NO: 223223 - protein, 9 aa, Japanese encephalitis virus
GGPTSEDDS

SEQ ID NO: 223224 - protein, 9 aa, Japanese encephalitis virus
GPTSEDDSN

SEQ ID NO: 223225 - protein, 9 aa, Japanese encephalitis virus
ATSEDDGNL

SEQ ID NO: 223226 - protein, 9 aa, Japanese encephalitis virus
TSEDDGNLA

SEQ ID NO: 223227 - protein, 9 aa, Japanese encephalitis virus
SEDDGNLAH

SEQ ID NO: 223228 - protein, 9 aa, Japanese encephalitis virus
EGDSNLAHW

SEQ ID NO: 223229 - protein, 9 aa, Japanese encephalitis virus
GDSNLAHWT

SEQ ID NO: 223230 - protein, 9 aa, Japanese encephalitis virus
DGNLAHWTE

SEQ ID NO: 223231 - protein, 9 aa, Japanese encephalitis virus
GNLAHWTEA

SEQ ID NO: 223232 - protein, 9 aa, Japanese encephalitis virus
AHWTEAKIL

SEQ ID NO: 223233 - protein, 9 aa, Japanese encephalitis virus
HWTEAKILL

SEQ ID NO: 223234 - protein, 9 aa, Japanese encephalitis virus
WTEAKILLD

SEQ ID NO: 223235 - protein, 9 aa, Japanese encephalitis virus
TEAKILLDN

SEQ ID NO: 223236 - protein, 9 aa, Japanese encephalitis virus
EAKILLDNI

SEQ ID NO: 223237 - protein, 9 aa, Japanese encephalitis virus
AKILLDNIH

SEQ ID NO: 223238 - protein, 9 aa, Japanese encephalitis virus
KILLDNIHM

SEQ ID NO: 223239 - protein, 9 aa, Japanese encephalitis virus
ILLDNIHMP

SEQ ID NO: 223240 - protein, 9 aa, Japanese encephalitis virus
LLDNIHMPN

SEQ ID NO: 223241 - protein, 9 aa, Japanese encephalitis virus
IHMPNGLVV

SEQ ID NO: 223242 - protein, 9 aa, Japanese encephalitis virus
HMPNGLVVQ

SEQ ID NO: 223243 - protein, 9 aa, Japanese encephalitis virus
MPNGLVVQL

SEQ ID NO: 223244 - protein, 9 aa, Japanese encephalitis virus
PNGLVVQLY

SEQ ID NO: 223245 - protein, 9 aa, Japanese encephalitis virus
NGLVVQLYG

SEQ ID NO: 223246 - protein, 9 aa, Japanese encephalitis virus
GLVVQLYGP

SEQ ID NO: 223247 - protein, 9 aa, Japanese encephalitis virus
LVVQLYGPE

SEQ ID NO: 223248 - protein, 9 aa, Japanese encephalitis virus
VVQLYGPER

SEQ ID NO: 223249 - protein, 9 aa, Japanese encephalitis virus
VQLYGPERE

SEQ ID NO: 223250 - protein, 9 aa, Japanese encephalitis virus
YGPEREKAS

SEQ ID NO: 223251 - protein, 9 aa, Japanese encephalitis virus
GPEREKAST

SEQ ID NO: 223252 - protein, 9 aa, Japanese encephalitis virus
PEREKASTM

SEQ ID NO: 223253 - protein, 9 aa, Japanese encephalitis virus
EREKASTMD

SEQ ID NO: 223254 - protein, 9 aa, Japanese encephalitis virus
REKASTMDG

SEQ ID NO: 223255 - protein, 9 aa, Japanese encephalitis virus
EKASTMDGE

SEQ ID NO: 223256 - protein, 9 aa, Japanese encephalitis virus
KASTMDGEY

SEQ ID NO: 223257 - protein, 9 aa, Japanese encephalitis virus
ASTMDGEYR

SEQ ID NO: 223258 - protein, 9 aa, Japanese encephalitis virus
STMDGEYRL

SEQ ID NO: 223259 - protein, 9 aa, Japanese encephalitis virus
TMDVEYRLR

SEQ ID NO: 223260 - protein, 9 aa, Japanese encephalitis virus
MDVEYRLRG

SEQ ID NO: 223261 - protein, 9 aa, Japanese encephalitis virus
DVEYRLRGE

SEQ ID NO: 223262 - protein, 9 aa, Japanese encephalitis virus
VEYRLRGEE

SEQ ID NO: 223263 - protein, 9 aa, Japanese encephalitis virus
DLPVWLAYR

SEQ ID NO: 223264 - protein, 9 aa, Japanese encephalitis virus
LPVWLAYRV

SEQ ID NO: 223265 - protein, 9 aa, Japanese encephalitis virus
PVWLAYRVA

SEQ ID NO: 223266 - protein, 9 aa, Japanese encephalitis virus
VWLAYKVAP

SEQ ID NO: 223267 - protein, 9 aa, Japanese encephalitis virus
WLAYRVASN

SEQ ID NO: 223268 - protein, 9 aa, Japanese encephalitis virus
LAYRVASNG

SEQ ID NO: 223269 - protein, 9 aa, Japanese encephalitis virus
AYRVASNGI

SEQ ID NO: 223270 - protein, 9 aa, Japanese encephalitis virus
YRVASNGIQ

SEQ ID NO: 223271 - protein, 9 aa, Japanese encephalitis virus
KVAPNGIQY

SEQ ID NO: 223272 - protein, 9 aa, Japanese encephalitis virus
VAPNGIQYT

SEQ ID NO: 223273 - protein, 9 aa, Japanese encephalitis virus
APNGIQYTD

SEQ ID NO: 223274 - protein, 9 aa, Japanese encephalitis virus
PNGIQYTDR

SEQ ID NO: 223275 - protein, 9 aa, Japanese encephalitis virus
NGIQYTDRR

SEQ ID NO: 223276 - protein, 9 aa, Japanese encephalitis virus
GIQYTDRRW

SEQ ID NO: 223277 - protein, 9 aa, Japanese encephalitis virus
IQYTDRRWC

SEQ ID NO: 223278 - protein, 9 aa, Japanese encephalitis virus
QYTDRRWCF

SEQ ID NO: 223279 - protein, 9 aa, Japanese encephalitis virus
YTDRRWCFD

SEQ ID NO: 223280 - protein, 9 aa, Japanese encephalitis virus
TDRRWCFDG

SEQ ID NO: 223281 - protein, 9 aa, Japanese encephalitis virus
DRRWCFDGP

SEQ ID NO: 223282 - protein, 9 aa, Japanese encephalitis virus
RRWCFDGPR

SEQ ID NO: 223283 - protein, 9 aa, Japanese encephalitis virus
RWCFDGPRT

SEQ ID NO: 223284 - protein, 9 aa, Japanese encephalitis virus
RTNAILEDS

SEQ ID NO: 223285 - protein, 9 aa, Japanese encephalitis virus
TNAILEDNI

SEQ ID NO: 223286 - protein, 9 aa, Japanese encephalitis virus
NAILEDNIE

SEQ ID NO: 223287 - protein, 9 aa, Japanese encephalitis virus
AILEDNIEV

SEQ ID NO: 223288 - protein, 9 aa, Japanese encephalitis virus
ILEDNIEVE

SEQ ID NO: 223289 - protein, 9 aa, Japanese encephalitis virus
LEDNIEVEI

SEQ ID NO: 223290 - protein, 9 aa, Japanese encephalitis virus
EDNIEVEIV

SEQ ID NO: 223291 - protein, 9 aa, Japanese encephalitis virus
DNIEVEIVT

SEQ ID NO: 223292 - protein, 9 aa, Japanese encephalitis virus
NIEVEIVTR

SEQ ID NO: 223293 - protein, 9 aa, Japanese encephalitis virus
IEVEIVTRM

SEQ ID NO: 223294 - protein, 9 aa, Japanese encephalitis virus
EVEIVTRTG

SEQ ID NO: 223295 - protein, 9 aa, Japanese encephalitis virus
VEIVTRTGE

SEQ ID NO: 223296 - protein, 9 aa, Japanese encephalitis virus
EIVTRTGER

SEQ ID NO: 223297 - protein, 9 aa, Japanese encephalitis virus
IVTRTGERK

SEQ ID NO: 223298 - protein, 9 aa, Japanese encephalitis virus
VTRTGERKV

SEQ ID NO: 223299 - protein, 9 aa, Japanese encephalitis virus
TRTGERKVL

SEQ ID NO: 223300 - protein, 9 aa, Japanese encephalitis virus
RTGERKVLK

SEQ ID NO: 223301 - protein, 9 aa, Japanese encephalitis virus
TGERKVLKP

SEQ ID NO: 223302 - protein, 9 aa, Japanese encephalitis virus
GERKVLKPR

SEQ ID NO: 223303 - protein, 9 aa, Japanese encephalitis virus
ERKVLKPRW

SEQ ID NO: 223304 - protein, 9 aa, Japanese encephalitis virus
RKVLKPRWL

SEQ ID NO: 223305 - protein, 9 aa, Japanese encephalitis virus
KVLKPRWLD

SEQ ID NO: 223306 - protein, 9 aa, Japanese encephalitis virus
ILKPRWLYA

SEQ ID NO: 223307 - protein, 9 aa, Japanese encephalitis virus
LKPRWLYAR

SEQ ID NO: 223308 - protein, 9 aa, Japanese encephalitis virus
KPRWLYARV

SEQ ID NO: 223309 - protein, 9 aa, Japanese encephalitis virus
PRWLYARVY

SEQ ID NO: 223310 - protein, 9 aa, Japanese encephalitis virus
RWLYARVYA

SEQ ID NO: 223311 - protein, 9 aa, Japanese encephalitis virus
WLYARVYAD

SEQ ID NO: 223312 - protein, 9 aa, Japanese encephalitis virus
LYARVYADH

SEQ ID NO: 223313 - protein, 9 aa, Japanese encephalitis virus
YARVYADHQ

SEQ ID NO: 223314 - protein, 9 aa, Japanese encephalitis virus
LKWFKDFAS

SEQ ID NO: 223315 - protein, 9 aa, Japanese encephalitis virus
KWFKDFASG

SEQ ID NO: 223316 - protein, 9 aa, Japanese encephalitis virus
WFKDFASGK

SEQ ID NO: 223317 - protein, 9 aa, Japanese encephalitis virus
FKDFASGKR

SEQ ID NO: 223318 - protein, 9 aa, Japanese encephalitis virus
KDFASGKRS

SEQ ID NO: 223319 - protein, 9 aa, Japanese encephalitis virus
DFASGKRSA

SEQ ID NO: 223320 - protein, 9 aa, Japanese encephalitis virus
FAAGKRSAI

SEQ ID NO: 223321 - protein, 9 aa, Japanese encephalitis virus
AAGKRSAIS

SEQ ID NO: 223322 - protein, 9 aa, Japanese encephalitis virus
AGKRSAISF

SEQ ID NO: 223323 - protein, 9 aa, Japanese encephalitis virus
GKRSAISFI

SEQ ID NO: 223324 - protein, 9 aa, Japanese encephalitis virus
KRSAISFIE

SEQ ID NO: 223325 - protein, 9 aa, Japanese encephalitis virus
RSAISFIEV

SEQ ID NO: 223326 - protein, 9 aa, Japanese encephalitis virus
SAISFIEVL

SEQ ID NO: 223327 - protein, 9 aa, Japanese encephalitis virus
AISFIEVLG

SEQ ID NO: 223328 - protein, 9 aa, Japanese encephalitis virus
ISFIEVLGR

SEQ ID NO: 223329 - protein, 9 aa, Japanese encephalitis virus
SFIEVRGRM

SEQ ID NO: 223330 - protein, 9 aa, Japanese encephalitis virus
FIEVRGRMP

SEQ ID NO: 223331 - protein, 9 aa, Japanese encephalitis virus
IEVRGRMPE

SEQ ID NO: 223332 - protein, 9 aa, Japanese encephalitis virus
EEPGRMPEH

SEQ ID NO: 223333 - protein, 9 aa, Japanese encephalitis virus
EPGRMPEHF

SEQ ID NO: 223334 - protein, 9 aa, Japanese encephalitis virus
RGRMPEHFM

SEQ ID NO: 223335 - protein, 9 aa, Japanese encephalitis virus
GRMPEHFAG

SEQ ID NO: 223336 - protein, 9 aa, Japanese encephalitis virus
RMPEHFAGK

SEQ ID NO: 223337 - protein, 9 aa, Japanese encephalitis virus
MPEHFAGKT

SEQ ID NO: 223338 - protein, 9 aa, Japanese encephalitis virus
PEHFAGKTR

SEQ ID NO: 223339 - protein, 9 aa, Japanese encephalitis virus
EHFAGKTRE

SEQ ID NO: 223340 - protein, 9 aa, Japanese encephalitis virus
HFAGKTREA

SEQ ID NO: 223341 - protein, 9 aa, Japanese encephalitis virus
FAGKTREAL

SEQ ID NO: 223342 - protein, 9 aa, Japanese encephalitis virus
AGKTREALD

SEQ ID NO: 223343 - protein, 9 aa, Japanese encephalitis virus
MYLVATAER

SEQ ID NO: 223344 - protein, 9 aa, Japanese encephalitis virus
YLVATAERG

SEQ ID NO: 223345 - protein, 9 aa, Japanese encephalitis virus
LVATAERGG

SEQ ID NO: 223346 - protein, 9 aa, Japanese encephalitis virus
VATAERGGK

SEQ ID NO: 223347 - protein, 9 aa, Japanese encephalitis virus
ATAERGGKA

SEQ ID NO: 223348 - protein, 9 aa, Japanese encephalitis virus
TAERGGKAH

SEQ ID NO: 223349 - protein, 9 aa, Japanese encephalitis virus
AERGGKAHR

SEQ ID NO: 223350 - protein, 9 aa, Japanese encephalitis virus
ERGGKAHRM

SEQ ID NO: 223351 - protein, 9 aa, Japanese encephalitis virus
RGGKAHRMA

SEQ ID NO: 223352 - protein, 9 aa, Japanese encephalitis virus
SGKAHRMAL

SEQ ID NO: 223353 - protein, 9 aa, Japanese encephalitis virus
GKTHRMALE

SEQ ID NO: 223354 - protein, 9 aa, Japanese encephalitis virus
KTHRMALEE

SEQ ID NO: 223355 - protein, 9 aa, Japanese encephalitis virus
THRMALEEL

SEQ ID NO: 223356 - protein, 9 aa, Japanese encephalitis virus
ELPDALETV

SEQ ID NO: 223357 - protein, 9 aa, Japanese encephalitis virus
LPDALETVT

SEQ ID NO: 223358 - protein, 9 aa, Japanese encephalitis virus
PDALETVTL

SEQ ID NO: 223359 - protein, 9 aa, Japanese encephalitis virus
DALETITLT

SEQ ID NO: 223360 - protein, 9 aa, Japanese encephalitis virus
ALETITLIA

SEQ ID NO: 223361 - protein, 9 aa, Japanese encephalitis virus
LETITLIAA

SEQ ID NO: 223362 - protein, 9 aa, Japanese encephalitis virus
ETITLIAAI

SEQ ID NO: 223363 - protein, 9 aa, Japanese encephalitis virus
AITAMTGGF

SEQ ID NO: 223364 - protein, 9 aa, Japanese encephalitis virus
ITAMTGGFF

SEQ ID NO: 223365 - protein, 9 aa, Japanese encephalitis virus
TVMTRGFFL

SEQ ID NO: 223366 - protein, 9 aa, Japanese encephalitis virus
AMTGGFFLL

SEQ ID NO: 223367 - protein, 9 aa, Japanese encephalitis virus
MTRGFFLLM

SEQ ID NO: 223368 - protein, 9 aa, Japanese encephalitis virus
TGGFFLLMK

SEQ ID NO: 223369 - protein, 9 aa, Japanese encephalitis virus
GGFFLLMKQ

SEQ ID NO: 223370 - protein, 9 aa, Japanese encephalitis virus
GFFLLMKQR

SEQ ID NO: 223371 - protein, 9 aa, Japanese encephalitis virus
FFLLMKQRK

SEQ ID NO: 223372 - protein, 9 aa, Japanese encephalitis virus
FLLMKQRKG

SEQ ID NO: 223373 - protein, 9 aa, Japanese encephalitis virus
LLMKQRKGI

SEQ ID NO: 223374 - protein, 9 aa, Japanese encephalitis virus
LMMQRKGIE

SEQ ID NO: 223375 - protein, 9 aa, Japanese encephalitis virus
MMQRKGIGR

SEQ ID NO: 223376 - protein, 9 aa, Japanese encephalitis virus
MQRKGIGRM

SEQ ID NO: 223377 - protein, 9 aa, Japanese encephalitis virus
QRKGIGRMG

SEQ ID NO: 223378 - protein, 9 aa, Japanese encephalitis virus
RKGIGRMGL

SEQ ID NO: 223379 - protein, 9 aa, Japanese encephalitis virus
KGIGRMGLG

SEQ ID NO: 223380 - protein, 9 aa, Japanese encephalitis virus
GIGRMGLGA

SEQ ID NO: 223381 - protein, 9 aa, Japanese encephalitis virus
IGRMGLGAL

SEQ ID NO: 223382 - protein, 9 aa, Japanese encephalitis virus
GRMGLGALV

SEQ ID NO: 223383 - protein, 9 aa, Japanese encephalitis virus
RMGLGALVL

SEQ ID NO: 223384 - protein, 9 aa, Japanese encephalitis virus
MGLGALVLV

SEQ ID NO: 223385 - protein, 9 aa, Japanese encephalitis virus
GLGALVLVL

SEQ ID NO: 223386 - protein, 9 aa, Japanese encephalitis virus
LGALVLVLA

SEQ ID NO: 223387 - protein, 9 aa, Japanese encephalitis virus
GALVLVLAT

SEQ ID NO: 223388 - protein, 9 aa, Japanese encephalitis virus
ALVLVLATF

SEQ ID NO: 223389 - protein, 9 aa, Japanese encephalitis virus
LVLVLATFF

SEQ ID NO: 223390 - protein, 9 aa, Japanese encephalitis virus
VLVLATFFL

SEQ ID NO: 223391 - protein, 9 aa, Japanese encephalitis virus
LVLATFFLW

SEQ ID NO: 223392 - protein, 9 aa, Japanese encephalitis virus
VLATFFLWA

SEQ ID NO: 223393 - protein, 9 aa, Japanese encephalitis virus
FFLWAAEVS

SEQ ID NO: 223394 - protein, 9 aa, Japanese encephalitis virus
FLWAAEVSG

SEQ ID NO: 223395 - protein, 9 aa, Japanese encephalitis virus
LWAAEVSGT

SEQ ID NO: 223396 - protein, 9 aa, Japanese encephalitis virus
WAAEVSGTK

SEQ ID NO: 223397 - protein, 9 aa, Japanese encephalitis virus
AAEVSGTKI

SEQ ID NO: 223398 - protein, 9 aa, Japanese encephalitis virus
AEVSGTKIA

SEQ ID NO: 223399 - protein, 9 aa, Japanese encephalitis virus
EVSGTKIAG

SEQ ID NO: 223400 - protein, 9 aa, Japanese encephalitis virus
VSGTKIAGT

SEQ ID NO: 223401 - protein, 9 aa, Japanese encephalitis virus
SGTKIAGTL

SEQ ID NO: 223402 - protein, 9 aa, Japanese encephalitis virus
TKIAGTLLV

SEQ ID NO: 223403 - protein, 9 aa, Japanese encephalitis virus
KIAGTLLVA

SEQ ID NO: 223404 - protein, 9 aa, Japanese encephalitis virus
IAGTLLVAL

SEQ ID NO: 223405 - protein, 9 aa, Japanese encephalitis virus
AGTLLVALL

SEQ ID NO: 223406 - protein, 9 aa, Japanese encephalitis virus
GTLLVALLL

SEQ ID NO: 223407 - protein, 9 aa, Japanese encephalitis virus
TLLVALLLM

SEQ ID NO: 223408 - protein, 9 aa, Japanese encephalitis virus
LLVALLLMV

SEQ ID NO: 223409 - protein, 9 aa, Japanese encephalitis virus
LVALLLMVV

SEQ ID NO: 223410 - protein, 9 aa, Japanese encephalitis virus
VALLLMVVL

SEQ ID NO: 223411 - protein, 9 aa, Japanese encephalitis virus
MVVLIPEPG

SEQ ID NO: 223412 - protein, 9 aa, Japanese encephalitis virus
VVLIPEPGK

SEQ ID NO: 223413 - protein, 9 aa, Japanese encephalitis virus
VLIPEPGKQ

SEQ ID NO: 223414 - protein, 9 aa, Japanese encephalitis virus
LIPEPGKQR

SEQ ID NO: 223415 - protein, 9 aa, Japanese encephalitis virus
IPEPGKQRS

SEQ ID NO: 223416 - protein, 9 aa, Japanese encephalitis virus
PEPGKQRSQ

SEQ ID NO: 223417 - protein, 9 aa, Japanese encephalitis virus
EPGKQRSQT

SEQ ID NO: 223418 - protein, 9 aa, Japanese encephalitis virus
PGKQRSQTD

SEQ ID NO: 223419 - protein, 9 aa, Japanese encephalitis virus
GKQRSQTDN

SEQ ID NO: 223420 - protein, 9 aa, Japanese encephalitis virus
KQRSQTGNQ

SEQ ID NO: 223421 - protein, 9 aa, Japanese encephalitis virus
QRSQTGNQL

SEQ ID NO: 223422 - protein, 9 aa, Japanese encephalitis virus
RLQTDNQLA

SEQ ID NO: 223423 - protein, 9 aa, Japanese encephalitis virus
SQTGNQLAV

SEQ ID NO: 223424 - protein, 9 aa, Japanese encephalitis virus
QTGNQLAVF

SEQ ID NO: 223425 - protein, 9 aa, Japanese encephalitis virus
TGNQLAVFL

SEQ ID NO: 223426 - protein, 9 aa, Japanese encephalitis virus
GNQLAVFLI

SEQ ID NO: 223427 - protein, 9 aa, Japanese encephalitis virus
ICVLTVVGM

SEQ ID NO: 223428 - protein, 9 aa, Japanese encephalitis virus
CVLTVVGVA

SEQ ID NO: 223429 - protein, 9 aa, Japanese encephalitis virus
VLTVVGMVA

SEQ ID NO: 223430 - protein, 9 aa, Japanese encephalitis virus
LTVVGVAAA

SEQ ID NO: 223431 - protein, 9 aa, Japanese encephalitis virus
TVVGVAAAN

SEQ ID NO: 223432 - protein, 9 aa, Japanese encephalitis virus
VVGVAAANE

SEQ ID NO: 223433 - protein, 9 aa, Japanese encephalitis virus
VGVAAANEY

SEQ ID NO: 223434 - protein, 9 aa, Japanese encephalitis virus
GVAAANEYG

SEQ ID NO: 223435 - protein, 9 aa, Japanese encephalitis virus
VAAANEYGM

SEQ ID NO: 223436 - protein, 9 aa, Japanese encephalitis virus
AAANEYGML

SEQ ID NO: 223437 - protein, 9 aa, Japanese encephalitis virus
ANEYGMLER

SEQ ID NO: 223438 - protein, 9 aa, Japanese encephalitis virus
NEYGMLERT

SEQ ID NO: 223439 - protein, 9 aa, Japanese encephalitis virus
EYGMLERTK

SEQ ID NO: 223440 - protein, 9 aa, Japanese encephalitis virus
YGMLERTKA

SEQ ID NO: 223441 - protein, 9 aa, Japanese encephalitis virus
GMLERTKAD

SEQ ID NO: 223442 - protein, 9 aa, Japanese encephalitis virus
MLEKTKADI

SEQ ID NO: 223443 - protein, 9 aa, Japanese encephalitis virus
LERTKADLK

SEQ ID NO: 223444 - protein, 9 aa, Japanese encephalitis virus
EKTKADIKS

SEQ ID NO: 223445 - protein, 9 aa, Japanese encephalitis virus
RTKADLKSM

SEQ ID NO: 223446 - protein, 9 aa, Japanese encephalitis virus
TKADIKSMF

SEQ ID NO: 223447 - protein, 9 aa, Japanese encephalitis virus
KADLKSMFA

SEQ ID NO: 223448 - protein, 9 aa, Japanese encephalitis virus
ADLKSMFAG

SEQ ID NO: 223449 - protein, 9 aa, Japanese encephalitis virus
DLKSMFGGR

SEQ ID NO: 223450 - protein, 9 aa, Japanese encephalitis virus
KSMFGGRTQ

SEQ ID NO: 223451 - protein, 9 aa, Japanese encephalitis virus
SMFGGRTQA

SEQ ID NO: 223452 - protein, 9 aa, Japanese encephalitis virus
TQAPGLTGL

SEQ ID NO: 223453 - protein, 9 aa, Japanese encephalitis virus
QAPGLTGLP

SEQ ID NO: 223454 - protein, 9 aa, Japanese encephalitis virus
APGLTGLPS

SEQ ID NO: 223455 - protein, 9 aa, Japanese encephalitis virus
PGLTGLPSM

SEQ ID NO: 223456 - protein, 9 aa, Japanese encephalitis virus
GMTGLPGMA

SEQ ID NO: 223457 - protein, 9 aa, Japanese encephalitis virus
LTGLPSVAL

SEQ ID NO: 223458 - protein, 9 aa, Japanese encephalitis virus
TGLPSVALD

SEQ ID NO: 223459 - protein, 9 aa, Japanese encephalitis virus
GLPSMTLDL

SEQ ID NO: 223460 - protein, 9 aa, Japanese encephalitis virus
LPSVALDLR

SEQ ID NO: 223461 - protein, 9 aa, Japanese encephalitis virus
PSVALDLRP

SEQ ID NO: 223462 - protein, 9 aa, Japanese encephalitis virus
SMTLDLRPA

SEQ ID NO: 223463 - protein, 9 aa, Japanese encephalitis virus
VALDLRPAT

SEQ ID NO: 223464 - protein, 9 aa, Japanese encephalitis virus
TLDLRPATA

SEQ ID NO: 223465 - protein, 9 aa, Japanese encephalitis virus
LRPATAWAW

SEQ ID NO: 223466 - protein, 9 aa, Japanese encephalitis virus
RPATAWAWY

SEQ ID NO: 223467 - protein, 9 aa, Japanese encephalitis virus
PATAWAWYG

SEQ ID NO: 223468 - protein, 9 aa, Japanese encephalitis virus
ATAWAWYGG

SEQ ID NO: 223469 - protein, 9 aa, Japanese encephalitis virus
TAWAWYGGS

SEQ ID NO: 223470 - protein, 9 aa, Japanese encephalitis virus
AWAWYGGST

SEQ ID NO: 223471 - protein, 9 aa, Japanese encephalitis virus
WAWYGGSTV

SEQ ID NO: 223472 - protein, 9 aa, Japanese encephalitis virus
AWYGGSTVV

SEQ ID NO: 223473 - protein, 9 aa, Japanese encephalitis virus
WYGGSTVVL

SEQ ID NO: 223474 - protein, 9 aa, Japanese encephalitis virus
VLTPLLKHI

SEQ ID NO: 223475 - protein, 9 aa, Japanese encephalitis virus
LTPLLKHII

SEQ ID NO: 223476 - protein, 9 aa, Japanese encephalitis virus
TPLLKHIIT

SEQ ID NO: 223477 - protein, 9 aa, Japanese encephalitis virus
PLLKHIITS

SEQ ID NO: 223478 - protein, 9 aa, Japanese encephalitis virus
LLKHIITSE

SEQ ID NO: 223479 - protein, 9 aa, Japanese encephalitis virus
LKHIITSEY

SEQ ID NO: 223480 - protein, 9 aa, Japanese encephalitis virus
KHIITSEYV

SEQ ID NO: 223481 - protein, 9 aa, Japanese encephalitis virus
HIITSEYVT

SEQ ID NO: 223482 - protein, 9 aa, Japanese encephalitis virus
IITSEYVTT

SEQ ID NO: 223483 - protein, 9 aa, Japanese encephalitis virus
ITSEYVTPS

SEQ ID NO: 223484 - protein, 9 aa, Japanese encephalitis virus
TSEYVTPSL

SEQ ID NO: 223485 - protein, 9 aa, Japanese encephalitis virus
SEYVTPSLA

SEQ ID NO: 223486 - protein, 9 aa, Japanese encephalitis virus
EYVTPSLAS

SEQ ID NO: 223487 - protein, 9 aa, Japanese encephalitis virus
YVTPSLASI

SEQ ID NO: 223488 - protein, 9 aa, Japanese encephalitis virus
VTTSLASIS

SEQ ID NO: 223489 - protein, 9 aa, Japanese encephalitis virus
TTSLASISS

SEQ ID NO: 223490 - protein, 9 aa, Japanese encephalitis virus
TSLASISSQ

SEQ ID NO: 223491 - protein, 9 aa, Japanese encephalitis virus
SLASISSQA

SEQ ID NO: 223492 - protein, 9 aa, Japanese encephalitis virus
LASISSQAG

SEQ ID NO: 223493 - protein, 9 aa, Japanese encephalitis virus
ASISSQAGS

SEQ ID NO: 223494 - protein, 9 aa, Japanese encephalitis virus
SISSQAGSL

SEQ ID NO: 223495 - protein, 9 aa, Japanese encephalitis virus
ISSQAGSLF

SEQ ID NO: 223496 - protein, 9 aa, Japanese encephalitis virus
SSQAGSLFV

SEQ ID NO: 223497 - protein, 9 aa, Japanese encephalitis virus
FVLPRGVPS

SEQ ID NO: 223498 - protein, 9 aa, Japanese encephalitis virus
VLPRGVPST

SEQ ID NO: 223499 - protein, 9 aa, Japanese encephalitis virus
LPRGVPSTD

SEQ ID NO: 223500 - protein, 9 aa, Japanese encephalitis virus
PRGVPSTDL

SEQ ID NO: 223501 - protein, 9 aa, Japanese encephalitis virus
RGVPSTDLD

SEQ ID NO: 223502 - protein, 9 aa, Japanese encephalitis virus
GVPSTDLDL

SEQ ID NO: 223503 - protein, 9 aa, Japanese encephalitis virus
VPSTDLDLT

SEQ ID NO: 223504 - protein, 9 aa, Japanese encephalitis virus
PSTDLDLTV

SEQ ID NO: 223505 - protein, 9 aa, Japanese encephalitis virus
STDLDLTVG

SEQ ID NO: 223506 - protein, 9 aa, Japanese encephalitis virus
LDLTVGLVL

SEQ ID NO: 223507 - protein, 9 aa, Japanese encephalitis virus
DLTVGLVLL

SEQ ID NO: 223508 - protein, 9 aa, Japanese encephalitis virus
LTVGLVLLG

SEQ ID NO: 223509 - protein, 9 aa, Japanese encephalitis virus
TVGLVLLGC

SEQ ID NO: 223510 - protein, 9 aa, Japanese encephalitis virus
VGLVLLGCW

SEQ ID NO: 223511 - protein, 9 aa, Japanese encephalitis virus
GLVLLGCWG

SEQ ID NO: 223512 - protein, 9 aa, Japanese encephalitis virus
LVLLGCWGQ

SEQ ID NO: 223513 - protein, 9 aa, Japanese encephalitis virus
VFLGCWGQV

SEQ ID NO: 223514 - protein, 9 aa, Japanese encephalitis virus
FLGCWGQVT

SEQ ID NO: 223515 - protein, 9 aa, Japanese encephalitis virus
LGCWGQVTL

SEQ ID NO: 223516 - protein, 9 aa, Japanese encephalitis virus
GCWGQVTLT

SEQ ID NO: 223517 - protein, 9 aa, Japanese encephalitis virus
CWGQVTLTT

SEQ ID NO: 223518 - protein, 9 aa, Japanese encephalitis virus
WGQVTLTTF

SEQ ID NO: 223519 - protein, 9 aa, Japanese encephalitis virus
GQVTLTTFL

SEQ ID NO: 223520 - protein, 9 aa, Japanese encephalitis virus
QVTLTTFLT

SEQ ID NO: 223521 - protein, 9 aa, Japanese encephalitis virus
VTLTTFLTA

SEQ ID NO: 223522 - protein, 9 aa, Japanese encephalitis virus
TLTTFLTAV

SEQ ID NO: 223523 - protein, 9 aa, Japanese encephalitis virus
LTTFLTAVV

SEQ ID NO: 223524 - protein, 9 aa, Japanese encephalitis virus
TTFLTAVVL

SEQ ID NO: 223525 - protein, 9 aa, Japanese encephalitis virus
LTAMVLVTL

SEQ ID NO: 223526 - protein, 9 aa, Japanese encephalitis virus
TAMVLVTLH

SEQ ID NO: 223527 - protein, 9 aa, Japanese encephalitis virus
AMVLVTLHY

SEQ ID NO: 223528 - protein, 9 aa, Japanese encephalitis virus
MVLVTLHYG

SEQ ID NO: 223529 - protein, 9 aa, Japanese encephalitis virus
VLVTLHYGY

SEQ ID NO: 223530 - protein, 9 aa, Japanese encephalitis virus
LVTLHYGYM

SEQ ID NO: 223531 - protein, 9 aa, Japanese encephalitis virus
VTLHYGYML

SEQ ID NO: 223532 - protein, 9 aa, Japanese encephalitis virus
TLHYGFMLP

SEQ ID NO: 223533 - protein, 9 aa, Japanese encephalitis virus
LHYGFMLPG

SEQ ID NO: 223534 - protein, 9 aa, Japanese encephalitis virus
HYGFMLPGW

SEQ ID NO: 223535 - protein, 9 aa, Japanese encephalitis virus
YGFMLPGWQ

SEQ ID NO: 223536 - protein, 9 aa, Japanese encephalitis virus
GFMLPGWQA

SEQ ID NO: 223537 - protein, 9 aa, Japanese encephalitis virus
FMLPGWQAQ

SEQ ID NO: 223538 - protein, 9 aa, Japanese encephalitis virus
MLPGWQAQA

SEQ ID NO: 223539 - protein, 9 aa, Japanese encephalitis virus
LPGWQAQAL

SEQ ID NO: 223540 - protein, 9 aa, Japanese encephalitis virus
PGWQAQALR

SEQ ID NO: 223541 - protein, 9 aa, Japanese encephalitis virus
GWQAQALRA

SEQ ID NO: 223542 - protein, 9 aa, Japanese encephalitis virus
WQAQALRAA

SEQ ID NO: 223543 - protein, 9 aa, Japanese encephalitis virus
QAQALRAAQ

SEQ ID NO: 223544 - protein, 9 aa, Japanese encephalitis virus
AQALRAAQR

SEQ ID NO: 223545 - protein, 9 aa, Japanese encephalitis virus
QALRAAQRR

SEQ ID NO: 223546 - protein, 9 aa, Japanese encephalitis virus
ATDVPELEK

SEQ ID NO: 223547 - protein, 9 aa, Japanese encephalitis virus
TDVPELEKT

SEQ ID NO: 223548 - protein, 9 aa, Japanese encephalitis virus
DVPELEKTT

SEQ ID NO: 223549 - protein, 9 aa, Japanese encephalitis virus
VPELEKTTP

SEQ ID NO: 223550 - protein, 9 aa, Japanese encephalitis virus
PELEKTTPL

SEQ ID NO: 223551 - protein, 9 aa, Japanese encephalitis virus
ELEKTTPLM

SEQ ID NO: 223552 - protein, 9 aa, Japanese encephalitis virus
LEKTTPLMQ

SEQ ID NO: 223553 - protein, 9 aa, Japanese encephalitis virus
EKTTPLMQK

SEQ ID NO: 223554 - protein, 9 aa, Japanese encephalitis virus
KTTPLMQKK

SEQ ID NO: 223555 - protein, 9 aa, Japanese encephalitis virus
TTPLMQKKI

SEQ ID NO: 223556 - protein, 9 aa, Japanese encephalitis virus
TPLMQKKIG

SEQ ID NO: 223557 - protein, 9 aa, Japanese encephalitis virus
PLMQKKIGQ

SEQ ID NO: 223558 - protein, 9 aa, Japanese encephalitis virus
LMQKKIGQV

SEQ ID NO: 223559 - protein, 9 aa, Japanese encephalitis virus
MQKKIGQVL

SEQ ID NO: 223560 - protein, 9 aa, Japanese encephalitis virus
QKKIGQVLL

SEQ ID NO: 223561 - protein, 9 aa, Japanese encephalitis virus
KKIGQVLLI

SEQ ID NO: 223562 - protein, 9 aa, Japanese encephalitis virus
KIGQVLLIG

SEQ ID NO: 223563 - protein, 9 aa, Japanese encephalitis virus
IGQVLLIGG

SEQ ID NO: 223564 - protein, 9 aa, Japanese encephalitis virus
GQVLLIGGS

SEQ ID NO: 223565 - protein, 9 aa, Japanese encephalitis virus
QVLLIGGSV

SEQ ID NO: 223566 - protein, 9 aa, Japanese encephalitis virus
VLLIGGSVA

SEQ ID NO: 223567 - protein, 9 aa, Japanese encephalitis virus
LLIGGSVAA

SEQ ID NO: 223568 - protein, 9 aa, Japanese encephalitis virus
LIGVSVAAL

SEQ ID NO: 223569 - protein, 9 aa, Japanese encephalitis virus
IGVSVAALL

SEQ ID NO: 223570 - protein, 9 aa, Japanese encephalitis virus
GVSVAALLV

SEQ ID NO: 223571 - protein, 9 aa, Japanese encephalitis virus
VSVAALLVN

SEQ ID NO: 223572 - protein, 9 aa, Japanese encephalitis virus
SVAALLVNP

SEQ ID NO: 223573 - protein, 9 aa, Japanese encephalitis virus
VAALLVNPN

SEQ ID NO: 223574 - protein, 9 aa, Japanese encephalitis virus
AALLVNPNV

SEQ ID NO: 223575 - protein, 9 aa, Japanese encephalitis virus
ALLVNPNVT

SEQ ID NO: 223576 - protein, 9 aa, Japanese encephalitis virus
LLVNPNVTT

SEQ ID NO: 223577 - protein, 9 aa, Japanese encephalitis virus
LVNPKITTV

SEQ ID NO: 223578 - protein, 9 aa, Japanese encephalitis virus
VNPNVSTVR

SEQ ID NO: 223579 - protein, 9 aa, Japanese encephalitis virus
NPKITTVRE

SEQ ID NO: 223580 - protein, 9 aa, Japanese encephalitis virus
PNVTTVKKP

SEQ ID NO: 223581 - protein, 9 aa, Japanese encephalitis virus
NVSTVRKAG

SEQ ID NO: 223582 - protein, 9 aa, Japanese encephalitis virus
ITTVREAGV

SEQ ID NO: 223583 - protein, 9 aa, Japanese encephalitis virus
STVRKAGVL

SEQ ID NO: 223584 - protein, 9 aa, Japanese encephalitis virus
TVKKPGVLV

SEQ ID NO: 223585 - protein, 9 aa, Japanese encephalitis virus
VRKAGVLVT

SEQ ID NO: 223586 - protein, 9 aa, Japanese encephalitis virus
KKPGVLVTA

SEQ ID NO: 223587 - protein, 9 aa, Japanese encephalitis virus
EAGVLVTAR

SEQ ID NO: 223588 - protein, 9 aa, Japanese encephalitis virus
AGVLVTART

SEQ ID NO: 223589 - protein, 9 aa, Japanese encephalitis virus
GVLVTARTL

SEQ ID NO: 223590 - protein, 9 aa, Japanese encephalitis virus
VLVTARTLT

SEQ ID NO: 223591 - protein, 9 aa, Japanese encephalitis virus
LVTARTLTL

SEQ ID NO: 223592 - protein, 9 aa, Japanese encephalitis virus
VTARTLTLW

SEQ ID NO: 223593 - protein, 9 aa, Japanese encephalitis virus
TARTLTLWD

SEQ ID NO: 223594 - protein, 9 aa, Japanese encephalitis virus
ARTLTLWDN

SEQ ID NO: 223595 - protein, 9 aa, Japanese encephalitis virus
RTLTLWDNG

SEQ ID NO: 223596 - protein, 9 aa, Japanese encephalitis virus
TLSLWDNGA

SEQ ID NO: 223597 - protein, 9 aa, Japanese encephalitis virus
LSLWDNGAS

SEQ ID NO: 223598 - protein, 9 aa, Japanese encephalitis virus
SLWDNGASA

SEQ ID NO: 223599 - protein, 9 aa, Japanese encephalitis virus
LWDNGASAA

SEQ ID NO: 223600 - protein, 9 aa, Japanese encephalitis virus
WDNGASAAW

SEQ ID NO: 223601 - protein, 9 aa, Japanese encephalitis virus
DNGASAAWN

SEQ ID NO: 223602 - protein, 9 aa, Japanese encephalitis virus
NGASAAWNS

SEQ ID NO: 223603 - protein, 9 aa, Japanese encephalitis virus
GASAAWNST

SEQ ID NO: 223604 - protein, 9 aa, Japanese encephalitis virus
ASAAWNSTT

SEQ ID NO: 223605 - protein, 9 aa, Japanese encephalitis virus
SAAWNSTTA

SEQ ID NO: 223606 - protein, 9 aa, Japanese encephalitis virus
AAWNSTTAT

SEQ ID NO: 223607 - protein, 9 aa, Japanese encephalitis virus
AWNSTTATG

SEQ ID NO: 223608 - protein, 9 aa, Japanese encephalitis virus
HVMRGSYLR

SEQ ID NO: 223609 - protein, 9 aa, Japanese encephalitis virus
VMRGSYLRG

SEQ ID NO: 223610 - protein, 9 aa, Japanese encephalitis virus
MRGSYLRGG

SEQ ID NO: 223611 - protein, 9 aa, Japanese encephalitis virus
RGSYLRGGS

SEQ ID NO: 223612 - protein, 9 aa, Japanese encephalitis virus
GSYLRGGSI

SEQ ID NO: 223613 - protein, 9 aa, Japanese encephalitis virus
SYLRGGSIA

SEQ ID NO: 223614 - protein, 9 aa, Japanese encephalitis virus
YLRGGSIAW

SEQ ID NO: 223615 - protein, 9 aa, Japanese encephalitis virus
LRGGSIAWT

SEQ ID NO: 223616 - protein, 9 aa, Japanese encephalitis virus
RGGSIAWTL

SEQ ID NO: 223617 - protein, 9 aa, Japanese encephalitis virus
AWTLIKNAN

SEQ ID NO: 223618 - protein, 9 aa, Japanese encephalitis virus
WTLIKNADN

SEQ ID NO: 223619 - protein, 9 aa, Japanese encephalitis virus
TLIKNADNP

SEQ ID NO: 223620 - protein, 9 aa, Japanese encephalitis virus
LIKNANKPS

SEQ ID NO: 223621 - protein, 9 aa, Japanese encephalitis virus
IKNADKPSF

SEQ ID NO: 223622 - protein, 9 aa, Japanese encephalitis virus
KNADKPSFK

SEQ ID NO: 223623 - protein, 9 aa, Japanese encephalitis virus
NANKPSLKR

SEQ ID NO: 223624 - protein, 9 aa, Japanese encephalitis virus
ADKPSLKKG

SEQ ID NO: 223625 - protein, 9 aa, Japanese encephalitis virus
DKPSFKKGR

SEQ ID NO: 223626 - protein, 9 aa, Japanese encephalitis virus
KPSLKRGRS

SEQ ID NO: 223627 - protein, 9 aa, Japanese encephalitis virus
PSLKRGRSG

SEQ ID NO: 223628 - protein, 9 aa, Japanese encephalitis virus
SLKRGRSGG

SEQ ID NO: 223629 - protein, 9 aa, Japanese encephalitis virus
LKRGRSGGR

SEQ ID NO: 223630 - protein, 9 aa, Japanese encephalitis virus
KRGRSGGRT

SEQ ID NO: 223631 - protein, 9 aa, Japanese encephalitis virus
KGRPGGRTL

SEQ ID NO: 223632 - protein, 9 aa, Japanese encephalitis virus
GRSGGRTLG

SEQ ID NO: 223633 - protein, 9 aa, Japanese encephalitis virus
RSGGRTLGE

SEQ ID NO: 223634 - protein, 9 aa, Japanese encephalitis virus
SGGRTLGEQ

SEQ ID NO: 223635 - protein, 9 aa, Japanese encephalitis virus
GGRTLGDQW

SEQ ID NO: 223636 - protein, 9 aa, Japanese encephalitis virus
GRTLGDQWK

SEQ ID NO: 223637 - protein, 9 aa, Japanese encephalitis virus
RTLGEQWKR

SEQ ID NO: 223638 - protein, 9 aa, Japanese encephalitis virus
TLGEQWKRK

SEQ ID NO: 223639 - protein, 9 aa, Japanese encephalitis virus
LWEQWKEKL

SEQ ID NO: 223640 - protein, 9 aa, Japanese encephalitis virus
GEQWKRKLN

SEQ ID NO: 223641 - protein, 9 aa, Japanese encephalitis virus
EQWKERLNA

SEQ ID NO: 223642 - protein, 9 aa, Japanese encephalitis virus
QWKRKLNAM

SEQ ID NO: 223643 - protein, 9 aa, Japanese encephalitis virus
WKRKLNAMG

SEQ ID NO: 223644 - protein, 9 aa, Japanese encephalitis virus
KERLNAMSR

SEQ ID NO: 223645 - protein, 9 aa, Japanese encephalitis virus
KLNAMSRDE

SEQ ID NO: 223646 - protein, 9 aa, Japanese encephalitis virus
LNAMSRDEF

SEQ ID NO: 223647 - protein, 9 aa, Japanese encephalitis virus
NAMSRDEFF

SEQ ID NO: 223648 - protein, 9 aa, Japanese encephalitis virus
AMSRDEFFK

SEQ ID NO: 223649 - protein, 9 aa, Japanese encephalitis virus
MSRDEFFKY

SEQ ID NO: 223650 - protein, 9 aa, Japanese encephalitis virus
SRDEFFKYR

SEQ ID NO: 223651 - protein, 9 aa, Japanese encephalitis virus
RDEFFKYRR

SEQ ID NO: 223652 - protein, 9 aa, Japanese encephalitis virus
DEFFKYRRE

SEQ ID NO: 223653 - protein, 9 aa, Japanese encephalitis virus
EFFKYRREG

SEQ ID NO: 223654 - protein, 9 aa, Japanese encephalitis virus
FFKYRREGI

SEQ ID NO: 223655 - protein, 9 aa, Japanese encephalitis virus
FKYRREGII

SEQ ID NO: 223656 - protein, 9 aa, Japanese encephalitis virus
KYRREGIIE

SEQ ID NO: 223657 - protein, 9 aa, Japanese encephalitis virus
YRREGIIEV

SEQ ID NO: 223658 - protein, 9 aa, Japanese encephalitis virus
RREGIIEVD

SEQ ID NO: 223659 - protein, 9 aa, Japanese encephalitis virus
REGIIEVDR

SEQ ID NO: 223660 - protein, 9 aa, Japanese encephalitis virus
EGIIEVDRT

SEQ ID NO: 223661 - protein, 9 aa, Japanese encephalitis virus
GIIEVDRTE

SEQ ID NO: 223662 - protein, 9 aa, Japanese encephalitis virus
IEVDRTEAC

SEQ ID NO: 223663 - protein, 9 aa, Japanese encephalitis virus
EVDRTEACR

SEQ ID NO: 223664 - protein, 9 aa, Japanese encephalitis virus
VDRTEACRA

SEQ ID NO: 223665 - protein, 9 aa, Japanese encephalitis virus
DRTEACRAR

SEQ ID NO: 223666 - protein, 9 aa, Japanese encephalitis virus
RTEACRARR

SEQ ID NO: 223667 - protein, 9 aa, Japanese encephalitis virus
TEACRARRE

SEQ ID NO: 223668 - protein, 9 aa, Japanese encephalitis virus
EACRARREN

SEQ ID NO: 223669 - protein, 9 aa, Japanese encephalitis virus
ACRARRENN

SEQ ID NO: 223670 - protein, 9 aa, Japanese encephalitis virus
RRARRENNV

SEQ ID NO: 223671 - protein, 9 aa, Japanese encephalitis virus
RARRENNVV

SEQ ID NO: 223672 - protein, 9 aa, Japanese encephalitis virus
ARRENNVVG

SEQ ID NO: 223673 - protein, 9 aa, Japanese encephalitis virus
RRENNVVGG

SEQ ID NO: 223674 - protein, 9 aa, Japanese encephalitis virus
RENNVVGGH

SEQ ID NO: 223675 - protein, 9 aa, Japanese encephalitis virus
ENNVVGGHP

SEQ ID NO: 223676 - protein, 9 aa, Japanese encephalitis virus
NNVVGGHPV

SEQ ID NO: 223677 - protein, 9 aa, Japanese encephalitis virus
NVVGGHPVS

SEQ ID NO: 223678 - protein, 9 aa, Japanese encephalitis virus
VVGGHPVSR

SEQ ID NO: 223679 - protein, 9 aa, Japanese encephalitis virus
WLVEKGFVP

SEQ ID NO: 223680 - protein, 9 aa, Japanese encephalitis virus
LVEKGFVPP

SEQ ID NO: 223681 - protein, 9 aa, Japanese encephalitis virus
VEKGFVPPI

SEQ ID NO: 223682 - protein, 9 aa, Japanese encephalitis virus
EKGFVPPIG

SEQ ID NO: 223683 - protein, 9 aa, Japanese encephalitis virus
KGFVPPIGK

SEQ ID NO: 223684 - protein, 9 aa, Japanese encephalitis virus
GFVPPIGKV

SEQ ID NO: 223685 - protein, 9 aa, Japanese encephalitis virus
FVSPIGKVV

SEQ ID NO: 223686 - protein, 9 aa, Japanese encephalitis virus
VSPIGKVVD

SEQ ID NO: 223687 - protein, 9 aa, Japanese encephalitis virus
SPIGKVVDL

SEQ ID NO: 223688 - protein, 9 aa, Japanese encephalitis virus
PIGKVVDLG

SEQ ID NO: 223689 - protein, 9 aa, Japanese encephalitis virus
IGKVVDLGC

SEQ ID NO: 223690 - protein, 9 aa, Japanese encephalitis virus
GKVVDLGCG

SEQ ID NO: 223691 - protein, 9 aa, Japanese encephalitis virus
KVVDLGCGR

SEQ ID NO: 223692 - protein, 9 aa, Japanese encephalitis virus
VIDLGCGCG

SEQ ID NO: 223693 - protein, 9 aa, Japanese encephalitis virus
IDLGCGRGS

SEQ ID NO: 223694 - protein, 9 aa, Japanese encephalitis virus
DLGCGRGSW

SEQ ID NO: 223695 - protein, 9 aa, Japanese encephalitis virus
LGCGRGSWN

SEQ ID NO: 223696 - protein, 9 aa, Japanese encephalitis virus
GCGRGSWNY

SEQ ID NO: 223697 - protein, 9 aa, Japanese encephalitis virus
CGRGSWNYY

SEQ ID NO: 223698 - protein, 9 aa, Japanese encephalitis virus
GRGSWNYYA

SEQ ID NO: 223699 - protein, 9 aa, Japanese encephalitis virus
RGSWNYYAA

SEQ ID NO: 223700 - protein, 9 aa, Japanese encephalitis virus
GSWNYYAAT

SEQ ID NO: 223701 - protein, 9 aa, Japanese encephalitis virus
SWNYYAATL

SEQ ID NO: 223702 - protein, 9 aa, Japanese encephalitis virus
WNYYAATLK

SEQ ID NO: 223703 - protein, 9 aa, Japanese encephalitis virus
NYYAATLKK

SEQ ID NO: 223704 - protein, 9 aa, Japanese encephalitis virus
YYAATLKRV

SEQ ID NO: 223705 - protein, 9 aa, Japanese encephalitis virus
CAATLKKVQ

SEQ ID NO: 223706 - protein, 9 aa, Japanese encephalitis virus
AATLKRVQE

SEQ ID NO: 223707 - protein, 9 aa, Japanese encephalitis virus
ATLKRVQEV

SEQ ID NO: 223708 - protein, 9 aa, Japanese encephalitis virus
TLKKVQEVK

SEQ ID NO: 223709 - protein, 9 aa, Japanese encephalitis virus
LKKVQEVKG

SEQ ID NO: 223710 - protein, 9 aa, Japanese encephalitis virus
KKVQEVKGY

SEQ ID NO: 223711 - protein, 9 aa, Japanese encephalitis virus
KVQEVKGYT

SEQ ID NO: 223712 - protein, 9 aa, Japanese encephalitis virus
VQEVKGYTK

SEQ ID NO: 223713 - protein, 9 aa, Japanese encephalitis virus
QEVKGYTKG

SEQ ID NO: 223714 - protein, 9 aa, Japanese encephalitis virus
EVKGYTKGG

SEQ ID NO: 223715 - protein, 9 aa, Japanese encephalitis virus
VKGYTKGGA

SEQ ID NO: 223716 - protein, 9 aa, Japanese encephalitis virus
KGYTKGGAG

SEQ ID NO: 223717 - protein, 9 aa, Japanese encephalitis virus
GAGHEEPMP

SEQ ID NO: 223718 - protein, 9 aa, Japanese encephalitis virus
AGHEEPMPM

SEQ ID NO: 223719 - protein, 9 aa, Japanese encephalitis virus
GHEEPMPMQ

SEQ ID NO: 223720 - protein, 9 aa, Japanese encephalitis virus
HEEPMPMQS

SEQ ID NO: 223721 - protein, 9 aa, Japanese encephalitis virus
EEPMPMQSY

SEQ ID NO: 223722 - protein, 9 aa, Japanese encephalitis virus
EPMPMQSYG

SEQ ID NO: 223723 - protein, 9 aa, Japanese encephalitis virus
PMLMQSYGR

SEQ ID NO: 223724 - protein, 9 aa, Japanese encephalitis virus
MLMQSYGRN

SEQ ID NO: 223725 - protein, 9 aa, Japanese encephalitis virus
LMQSYGRNL

SEQ ID NO: 223726 - protein, 9 aa, Japanese encephalitis virus
MQSYGRNLV

SEQ ID NO: 223727 - protein, 9 aa, Japanese encephalitis virus
QSYGRNLVS

SEQ ID NO: 223728 - protein, 9 aa, Japanese encephalitis virus
SYGRNLVSL

SEQ ID NO: 223729 - protein, 9 aa, Japanese encephalitis virus
YGRNLVSLK

SEQ ID NO: 223730 - protein, 9 aa, Japanese encephalitis virus
GRNLVSLKS

SEQ ID NO: 223731 - protein, 9 aa, Japanese encephalitis virus
RNLVSLKSG

SEQ ID NO: 223732 - protein, 9 aa, Japanese encephalitis virus
NLVSMKSGV

SEQ ID NO: 223733 - protein, 9 aa, Japanese encephalitis virus
LVSLKSGVH

SEQ ID NO: 223734 - protein, 9 aa, Japanese encephalitis virus
VSMKSGVDV

SEQ ID NO: 223735 - protein, 9 aa, Japanese encephalitis virus
SLKSGVHVF

SEQ ID NO: 223736 - protein, 9 aa, Japanese encephalitis virus
LKSGVHVFY

SEQ ID NO: 223737 - protein, 9 aa, Japanese encephalitis virus
KSGVDVFYR

SEQ ID NO: 223738 - protein, 9 aa, Japanese encephalitis virus
SGVDVFYRP

SEQ ID NO: 223739 - protein, 9 aa, Japanese encephalitis virus
GVDVFYRPS

SEQ ID NO: 223740 - protein, 9 aa, Japanese encephalitis virus
VHVFYKPSE

SEQ ID NO: 223741 - protein, 9 aa, Japanese encephalitis virus
HVFYKPSEP

SEQ ID NO: 223742 - protein, 9 aa, Japanese encephalitis virus
VFYRPSEPS

SEQ ID NO: 223743 - protein, 9 aa, Japanese encephalitis virus
FYRPSEPSD

SEQ ID NO: 223744 - protein, 9 aa, Japanese encephalitis virus
YRPSEPSDT

SEQ ID NO: 223745 - protein, 9 aa, Japanese encephalitis virus
RPSEPSDTL

SEQ ID NO: 223746 - protein, 9 aa, Japanese encephalitis virus
PSEPSDTLL

SEQ ID NO: 223747 - protein, 9 aa, Japanese encephalitis virus
SEPSDTLLC

SEQ ID NO: 223748 - protein, 9 aa, Japanese encephalitis virus
EPSDTLLCD

SEQ ID NO: 223749 - protein, 9 aa, Japanese encephalitis virus
PSDTLLCDI

SEQ ID NO: 223750 - protein, 9 aa, Japanese encephalitis virus
SDTLLCDIG

SEQ ID NO: 223751 - protein, 9 aa, Japanese encephalitis virus
DTLLCDIGE

SEQ ID NO: 223752 - protein, 9 aa, Japanese encephalitis virus
TLLCDIGES

SEQ ID NO: 223753 - protein, 9 aa, Japanese encephalitis virus
LLCDIGESS

SEQ ID NO: 223754 - protein, 9 aa, Japanese encephalitis virus
LCDIGESSP

SEQ ID NO: 223755 - protein, 9 aa, Japanese encephalitis virus
IGESSPSPD

SEQ ID NO: 223756 - protein, 9 aa, Japanese encephalitis virus
GESSPSPDV

SEQ ID NO: 223757 - protein, 9 aa, Japanese encephalitis virus
ESSPSPDVE

SEQ ID NO: 223758 - protein, 9 aa, Japanese encephalitis virus
SSPSPDVEE

SEQ ID NO: 223759 - protein, 9 aa, Japanese encephalitis virus
SPSPDVEEQ

SEQ ID NO: 223760 - protein, 9 aa, Japanese encephalitis virus
PSPDVEEQR

SEQ ID NO: 223761 - protein, 9 aa, Japanese encephalitis virus
SPDVEEQRT

SEQ ID NO: 223762 - protein, 9 aa, Japanese encephalitis virus
PDVEEQRTL

SEQ ID NO: 223763 - protein, 9 aa, Japanese encephalitis virus
DVEEQRTLR

SEQ ID NO: 223764 - protein, 9 aa, Japanese encephalitis virus
SDWLHRGPI

SEQ ID NO: 223765 - protein, 9 aa, Japanese encephalitis virus
DWLHRGPIE

SEQ ID NO: 223766 - protein, 9 aa, Japanese encephalitis virus
WLHRGPIEF

SEQ ID NO: 223767 - protein, 9 aa, Japanese encephalitis virus
LHRGPIEFC

SEQ ID NO: 223768 - protein, 9 aa, Japanese encephalitis virus
HRGPIEFCI

SEQ ID NO: 223769 - protein, 9 aa, Japanese encephalitis virus
RGPIEFCIK

SEQ ID NO: 223770 - protein, 9 aa, Japanese encephalitis virus
GPIEFCIKV

SEQ ID NO: 223771 - protein, 9 aa, Japanese encephalitis virus
PIEFCIKVL

SEQ ID NO: 223772 - protein, 9 aa, Japanese encephalitis virus
IEFCIKVLC

SEQ ID NO: 223773 - protein, 9 aa, Japanese encephalitis virus
YMPKVIEKN

SEQ ID NO: 223774 - protein, 9 aa, Japanese encephalitis virus
MPKVIEKNE

SEQ ID NO: 223775 - protein, 9 aa, Japanese encephalitis virus
PKVIEKNEV

SEQ ID NO: 223776 - protein, 9 aa, Japanese encephalitis virus
KVIEKNEVL

SEQ ID NO: 223777 - protein, 9 aa, Japanese encephalitis virus
VIEKNEVLQ

SEQ ID NO: 223778 - protein, 9 aa, Japanese encephalitis virus
IEKNEVLQR

SEQ ID NO: 223779 - protein, 9 aa, Japanese encephalitis virus
EKNEVLQRR

SEQ ID NO: 223780 - protein, 9 aa, Japanese encephalitis virus
KIEVLQRRF

SEQ ID NO: 223781 - protein, 9 aa, Japanese encephalitis virus
IEVLQRRFG

SEQ ID NO: 223782 - protein, 9 aa, Japanese encephalitis virus
LQRRFGGGV

SEQ ID NO: 223783 - protein, 9 aa, Japanese encephalitis virus
QRRFGGGVV

SEQ ID NO: 223784 - protein, 9 aa, Japanese encephalitis virus
RRFGGGVVR

SEQ ID NO: 223785 - protein, 9 aa, Japanese encephalitis virus
RFGGGVVRL

SEQ ID NO: 223786 - protein, 9 aa, Japanese encephalitis virus
FGGGVVRLP

SEQ ID NO: 223787 - protein, 9 aa, Japanese encephalitis virus
GGGVVRLPL

SEQ ID NO: 223788 - protein, 9 aa, Japanese encephalitis virus
GGVVRLPLS

SEQ ID NO: 223789 - protein, 9 aa, Japanese encephalitis virus
GVVRLPLSR

SEQ ID NO: 223790 - protein, 9 aa, Japanese encephalitis virus
VVRLPLSRN

SEQ ID NO: 223791 - protein, 9 aa, Japanese encephalitis virus
HEMYWVSGP

SEQ ID NO: 223792 - protein, 9 aa, Japanese encephalitis virus
EMYWVSGPA

SEQ ID NO: 223793 - protein, 9 aa, Japanese encephalitis virus
MYWVSGPAG

SEQ ID NO: 223794 - protein, 9 aa, Japanese encephalitis virus
YWVSGPAGN

SEQ ID NO: 223795 - protein, 9 aa, Japanese encephalitis virus
WVSGPAGNV

SEQ ID NO: 223796 - protein, 9 aa, Japanese encephalitis virus
VSGPAGNVV

SEQ ID NO: 223797 - protein, 9 aa, Japanese encephalitis virus
SGPAGNVVH

SEQ ID NO: 223798 - protein, 9 aa, Japanese encephalitis virus
GPAGNVVHA

SEQ ID NO: 223799 - protein, 9 aa, Japanese encephalitis virus
PAGNVVHAV

SEQ ID NO: 223800 - protein, 9 aa, Japanese encephalitis virus
SQVLLGRMN

SEQ ID NO: 223801 - protein, 9 aa, Japanese encephalitis virus
QVLLGRMNR

SEQ ID NO: 223802 - protein, 9 aa, Japanese encephalitis virus
VLLGRMNRT

SEQ ID NO: 223803 - protein, 9 aa, Japanese encephalitis virus
LLGRMNRTV

SEQ ID NO: 223804 - protein, 9 aa, Japanese encephalitis virus
LGRMDRAVW

SEQ ID NO: 223805 - protein, 9 aa, Japanese encephalitis virus
GRMNRTVWR

SEQ ID NO: 223806 - protein, 9 aa, Japanese encephalitis virus
RMDRAVWRG

SEQ ID NO: 223807 - protein, 9 aa, Japanese encephalitis virus
MNRTVWRGP

SEQ ID NO: 223808 - protein, 9 aa, Japanese encephalitis virus
DRAVWRGPK

SEQ ID NO: 223809 - protein, 9 aa, Japanese encephalitis virus
RTVWRGPRY

SEQ ID NO: 223810 - protein, 9 aa, Japanese encephalitis virus
TVWRGPRYE

SEQ ID NO: 223811 - protein, 9 aa, Japanese encephalitis virus
VWRGPKYKE

SEQ ID NO: 223812 - protein, 9 aa, Japanese encephalitis virus
WRGPKYKED

SEQ ID NO: 223813 - protein, 9 aa, Japanese encephalitis virus
RGPKYKEDV

SEQ ID NO: 223814 - protein, 9 aa, Japanese encephalitis virus
GPRYEEDVN

SEQ ID NO: 223815 - protein, 9 aa, Japanese encephalitis virus
PKYKEDVNL

SEQ ID NO: 223816 - protein, 9 aa, Japanese encephalitis virus
KYKEDVNLG

SEQ ID NO: 223817 - protein, 9 aa, Japanese encephalitis virus
YKEDVNLGS

SEQ ID NO: 223818 - protein, 9 aa, Japanese encephalitis virus
KEDVNLGSG

SEQ ID NO: 223819 - protein, 9 aa, Japanese encephalitis virus
TRAVGKGEI

SEQ ID NO: 223820 - protein, 9 aa, Japanese encephalitis virus
RAVGKGEIH

SEQ ID NO: 223821 - protein, 9 aa, Japanese encephalitis virus
AVGKGEIHS

SEQ ID NO: 223822 - protein, 9 aa, Japanese encephalitis virus
VGKGEIHSN

SEQ ID NO: 223823 - protein, 9 aa, Japanese encephalitis virus
GKGEIHSNQ

SEQ ID NO: 223824 - protein, 9 aa, Japanese encephalitis virus
QEKIRKRIQ

SEQ ID NO: 223825 - protein, 9 aa, Japanese encephalitis virus
EKIRKRIQK

SEQ ID NO: 223826 - protein, 9 aa, Japanese encephalitis virus
KIRKRIQKL

SEQ ID NO: 223827 - protein, 9 aa, Japanese encephalitis virus
IRKRIQKLR

SEQ ID NO: 223828 - protein, 9 aa, Japanese encephalitis virus
RKRIQKLRE

SEQ ID NO: 223829 - protein, 9 aa, Japanese encephalitis virus
KRIQKLREE

SEQ ID NO: 223830 - protein, 9 aa, Japanese encephalitis virus
RIQKLREEF

SEQ ID NO: 223831 - protein, 9 aa, Japanese encephalitis virus
IQKLREEFA

SEQ ID NO: 223832 - protein, 9 aa, Japanese encephalitis virus
QKLREEFAT

SEQ ID NO: 223833 - protein, 9 aa, Japanese encephalitis virus
KLREEFATT

SEQ ID NO: 223834 - protein, 9 aa, Japanese encephalitis virus
LREEFATTW

SEQ ID NO: 223835 - protein, 9 aa, Japanese encephalitis virus
REEFATTWH

SEQ ID NO: 223836 - protein, 9 aa, Japanese encephalitis virus
EGFATTWHK

SEQ ID NO: 223837 - protein, 9 aa, Japanese encephalitis virus
GFATTWHKD

SEQ ID NO: 223838 - protein, 9 aa, Japanese encephalitis virus
FATTWHRDP

SEQ ID NO: 223839 - protein, 9 aa, Japanese encephalitis virus
GTTWHKDPE

SEQ ID NO: 223840 - protein, 9 aa, Japanese encephalitis virus
TTWHRDPEH

SEQ ID NO: 223841 - protein, 9 aa, Japanese encephalitis virus
TWHRDPEHP

SEQ ID NO: 223842 - protein, 9 aa, Japanese encephalitis virus
WHRDPEHPY

SEQ ID NO: 223843 - protein, 9 aa, Japanese encephalitis virus
HKDHEHPYR

SEQ ID NO: 223844 - protein, 9 aa, Japanese encephalitis virus
KDHEHPYRT

SEQ ID NO: 223845 - protein, 9 aa, Japanese encephalitis virus
DHEHPYRTW

SEQ ID NO: 223846 - protein, 9 aa, Japanese encephalitis virus
HEHPYRTWT

SEQ ID NO: 223847 - protein, 9 aa, Japanese encephalitis virus
EHPYRNWTY

SEQ ID NO: 223848 - protein, 9 aa, Japanese encephalitis virus
HPYRNWTYH

SEQ ID NO: 223849 - protein, 9 aa, Japanese encephalitis virus
PYRNWTYHG

SEQ ID NO: 223850 - protein, 9 aa, Japanese encephalitis virus
YRNWTYHGS

SEQ ID NO: 223851 - protein, 9 aa, Japanese encephalitis virus
RNWTYHGSY

SEQ ID NO: 223852 - protein, 9 aa, Japanese encephalitis virus
NWTYHGSYE

SEQ ID NO: 223853 - protein, 9 aa, Japanese encephalitis virus
TYHGSYEVR

SEQ ID NO: 223854 - protein, 9 aa, Japanese encephalitis virus
YHGSYEVRA

SEQ ID NO: 223855 - protein, 9 aa, Japanese encephalitis virus
HGSYEVKAN

SEQ ID NO: 223856 - protein, 9 aa, Japanese encephalitis virus
GSYEVRATG

SEQ ID NO: 223857 - protein, 9 aa, Japanese encephalitis virus
SYEVKANGS

SEQ ID NO: 223858 - protein, 9 aa, Japanese encephalitis virus
YEVRATGSA

SEQ ID NO: 223859 - protein, 9 aa, Japanese encephalitis virus
EVRATGSAS

SEQ ID NO: 223860 - protein, 9 aa, Japanese encephalitis virus
VKANGSASS

SEQ ID NO: 223861 - protein, 9 aa, Japanese encephalitis virus
KANGSASSL

SEQ ID NO: 223862 - protein, 9 aa, Japanese encephalitis virus
ANGSASSLV

SEQ ID NO: 223863 - protein, 9 aa, Japanese encephalitis virus
NGSASSLVN

SEQ ID NO: 223864 - protein, 9 aa, Japanese encephalitis virus
SSLVNGVVE

SEQ ID NO: 223865 - protein, 9 aa, Japanese encephalitis virus
SLVNGVVEL

SEQ ID NO: 223866 - protein, 9 aa, Japanese encephalitis virus
LVNGVVELM

SEQ ID NO: 223867 - protein, 9 aa, Japanese encephalitis virus
VNGVVELMS

SEQ ID NO: 223868 - protein, 9 aa, Japanese encephalitis virus
NGVVELMSK

SEQ ID NO: 223869 - protein, 9 aa, Japanese encephalitis virus
GVVELMSKP

SEQ ID NO: 223870 - protein, 9 aa, Japanese encephalitis virus
VVELMSKPW

SEQ ID NO: 223871 - protein, 9 aa, Japanese encephalitis virus
VELMSKPWD

SEQ ID NO: 223872 - protein, 9 aa, Japanese encephalitis virus
KLMSKPWDT

SEQ ID NO: 223873 - protein, 9 aa, Japanese encephalitis virus
LMSKPWDTI

SEQ ID NO: 223874 - protein, 9 aa, Japanese encephalitis virus
MSKPWDAIS

SEQ ID NO: 223875 - protein, 9 aa, Japanese encephalitis virus
SKPWDTIAN

SEQ ID NO: 223876 - protein, 9 aa, Japanese encephalitis virus
KPWDAISYV

SEQ ID NO: 223877 - protein, 9 aa, Japanese encephalitis virus
PWDAISYVT

SEQ ID NO: 223878 - protein, 9 aa, Japanese encephalitis virus
WDTIANVTT

SEQ ID NO: 223879 - protein, 9 aa, Japanese encephalitis virus
DAISYVTTM

SEQ ID NO: 223880 - protein, 9 aa, Japanese encephalitis virus
TIANVTTMA

SEQ ID NO: 223881 - protein, 9 aa, Japanese encephalitis virus
ISYVTTMPM

SEQ ID NO: 223882 - protein, 9 aa, Japanese encephalitis virus
SYVTTMPMT

SEQ ID NO: 223883 - protein, 9 aa, Japanese encephalitis virus
YVTTMPMTD

SEQ ID NO: 223884 - protein, 9 aa, Japanese encephalitis virus
VTTMPMTDT

SEQ ID NO: 223885 - protein, 9 aa, Japanese encephalitis virus
TTMPMTDTT

SEQ ID NO: 223886 - protein, 9 aa, Japanese encephalitis virus
TMPMTDTTP

SEQ ID NO: 223887 - protein, 9 aa, Japanese encephalitis virus
MPMTDTTPF

SEQ ID NO: 223888 - protein, 9 aa, Japanese encephalitis virus
PMTDTTPFG

SEQ ID NO: 223889 - protein, 9 aa, Japanese encephalitis virus
QRVFKEKVG

SEQ ID NO: 223890 - protein, 9 aa, Japanese encephalitis virus
RVFKEKVGT

SEQ ID NO: 223891 - protein, 9 aa, Japanese encephalitis virus
VFKEKVGTM

SEQ ID NO: 223892 - protein, 9 aa, Japanese encephalitis virus
FKEKVGTMA

SEQ ID NO: 223893 - protein, 9 aa, Japanese encephalitis virus
KEKVGTKAP

SEQ ID NO: 223894 - protein, 9 aa, Japanese encephalitis virus
EKVGTKAPE

SEQ ID NO: 223895 - protein, 9 aa, Japanese encephalitis virus
KVGTKAPEP

SEQ ID NO: 223896 - protein, 9 aa, Japanese encephalitis virus
VGTKAPEPP

SEQ ID NO: 223897 - protein, 9 aa, Japanese encephalitis virus
TKAPEPPTG

SEQ ID NO: 223898 - protein, 9 aa, Japanese encephalitis virus
GVKEVLNET

SEQ ID NO: 223899 - protein, 9 aa, Japanese encephalitis virus
VKEVLNETT

SEQ ID NO: 223900 - protein, 9 aa, Japanese encephalitis virus
REVLNETTN

SEQ ID NO: 223901 - protein, 9 aa, Japanese encephalitis virus
ETTNWLWAY

SEQ ID NO: 223902 - protein, 9 aa, Japanese encephalitis virus
TTNWLWAYL

SEQ ID NO: 223903 - protein, 9 aa, Japanese encephalitis virus
TNWLWAYLS

SEQ ID NO: 223904 - protein, 9 aa, Japanese encephalitis virus
NWLWAYLSR

SEQ ID NO: 223905 - protein, 9 aa, Japanese encephalitis virus
WLWAYLSRE

SEQ ID NO: 223906 - protein, 9 aa, Japanese encephalitis virus
LWAYLSREK

SEQ ID NO: 223907 - protein, 9 aa, Japanese encephalitis virus
WAYLSREKR

SEQ ID NO: 223908 - protein, 9 aa, Japanese encephalitis virus
AYLSREKRP

SEQ ID NO: 223909 - protein, 9 aa, Japanese encephalitis virus
YLSREKRPR

SEQ ID NO: 223910 - protein, 9 aa, Japanese encephalitis virus
LSRKKRPRL

SEQ ID NO: 223911 - protein, 9 aa, Japanese encephalitis virus
SRKKRPRLC

SEQ ID NO: 223912 - protein, 9 aa, Japanese encephalitis virus
RKKRPRLCT

SEQ ID NO: 223913 - protein, 9 aa, Japanese encephalitis virus
KKRPRLCTK

SEQ ID NO: 223914 - protein, 9 aa, Japanese encephalitis virus
LCTKEEFIR

SEQ ID NO: 223915 - protein, 9 aa, Japanese encephalitis virus
CTKEEFIRK

SEQ ID NO: 223916 - protein, 9 aa, Japanese encephalitis virus
TKEEFIRKV

SEQ ID NO: 223917 - protein, 9 aa, Japanese encephalitis virus
KEEFIRKVN

SEQ ID NO: 223918 - protein, 9 aa, Japanese encephalitis virus
EEFIRKVNS

SEQ ID NO: 223919 - protein, 9 aa, Japanese encephalitis virus
EFIRKVNSN

SEQ ID NO: 223920 - protein, 9 aa, Japanese encephalitis virus
FIRKVNSNA

SEQ ID NO: 223921 - protein, 9 aa, Japanese encephalitis virus
KVNSNASLG

SEQ ID NO: 223922 - protein, 9 aa, Japanese encephalitis virus
VNSNASLGT

SEQ ID NO: 223923 - protein, 9 aa, Japanese encephalitis virus
NSSAALGAV

SEQ ID NO: 223924 - protein, 9 aa, Japanese encephalitis virus
SSAALGAVF

SEQ ID NO: 223925 - protein, 9 aa, Japanese encephalitis virus
NASLGTVFA

SEQ ID NO: 223926 - protein, 9 aa, Japanese encephalitis virus
ASLGTVFAE

SEQ ID NO: 223927 - protein, 9 aa, Japanese encephalitis virus
SLGAVFAEQ

SEQ ID NO: 223928 - protein, 9 aa, Japanese encephalitis virus
LGTVFAEQN

SEQ ID NO: 223929 - protein, 9 aa, Japanese encephalitis virus
GTVFAEQNQ

SEQ ID NO: 223930 - protein, 9 aa, Japanese encephalitis virus
TVFAEQNQW

SEQ ID NO: 223931 - protein, 9 aa, Japanese encephalitis virus
WSTAREAVG

SEQ ID NO: 223932 - protein, 9 aa, Japanese encephalitis virus
STAREAVGD

SEQ ID NO: 223933 - protein, 9 aa, Japanese encephalitis virus
TAREAVGDP

SEQ ID NO: 223934 - protein, 9 aa, Japanese encephalitis virus
FWEMVNEER

SEQ ID NO: 223935 - protein, 9 aa, Japanese encephalitis virus
WEMVNEERE

SEQ ID NO: 223936 - protein, 9 aa, Japanese encephalitis virus
EMVNEEREN

SEQ ID NO: 223937 - protein, 9 aa, Japanese encephalitis virus
MVNEERENH

SEQ ID NO: 223938 - protein, 9 aa, Japanese encephalitis virus
VNEERENHL

SEQ ID NO: 223939 - protein, 9 aa, Japanese encephalitis virus
NEERENHLR

SEQ ID NO: 223940 - protein, 9 aa, Japanese encephalitis virus
VERENHLRG

SEQ ID NO: 223941 - protein, 9 aa, Japanese encephalitis virus
HLRGECHTR

SEQ ID NO: 223942 - protein, 9 aa, Japanese encephalitis virus
LRGECHTCV

SEQ ID NO: 223943 - protein, 9 aa, Japanese encephalitis virus
RGECHTCVY

SEQ ID NO: 223944 - protein, 9 aa, Japanese encephalitis virus
GECHTCVYN

SEQ ID NO: 223945 - protein, 9 aa, Japanese encephalitis virus
ECHTCVYNM

SEQ ID NO: 223946 - protein, 9 aa, Japanese encephalitis virus
CHTCVYNMM

SEQ ID NO: 223947 - protein, 9 aa, Japanese encephalitis virus
HTCVYNMMG

SEQ ID NO: 223948 - protein, 9 aa, Japanese encephalitis virus
TCVYNMMGK

SEQ ID NO: 223949 - protein, 9 aa, Japanese encephalitis virus
CVYNMMGKR

SEQ ID NO: 223950 - protein, 9 aa, Japanese encephalitis virus
VYNMMGKRE

SEQ ID NO: 223951 - protein, 9 aa, Japanese encephalitis virus
YHMMGKREK

SEQ ID NO: 223952 - protein, 9 aa, Japanese encephalitis virus
HMMGKREKK

SEQ ID NO: 223953 - protein, 9 aa, Japanese encephalitis virus
YLEFEALGS

SEQ ID NO: 223954 - protein, 9 aa, Japanese encephalitis virus
LEFEALGSL

SEQ ID NO: 223955 - protein, 9 aa, Japanese encephalitis virus
EFEALGSLN

SEQ ID NO: 223956 - protein, 9 aa, Japanese encephalitis virus
FEALGFLNL

SEQ ID NO: 223957 - protein, 9 aa, Japanese encephalitis virus
EALGFLNEN

SEQ ID NO: 223958 - protein, 9 aa, Japanese encephalitis virus
ALGSLNEDH

SEQ ID NO: 223959 - protein, 9 aa, Japanese encephalitis virus
LGSLNEDHW

SEQ ID NO: 223960 - protein, 9 aa, Japanese encephalitis virus
GFLNENHWL

SEQ ID NO: 223961 - protein, 9 aa, Japanese encephalitis virus
FLNLDHWLS

SEQ ID NO: 223962 - protein, 9 aa, Japanese encephalitis virus
LNLDHWLSR

SEQ ID NO: 223963 - protein, 9 aa, Japanese encephalitis virus
NEDHWLSRR

SEQ ID NO: 223964 - protein, 9 aa, Japanese encephalitis virus
EDHWLSRRN

SEQ ID NO: 223965 - protein, 9 aa, Japanese encephalitis virus
NHWLSRENS

SEQ ID NO: 223966 - protein, 9 aa, Japanese encephalitis virus
HWLSRENSR

SEQ ID NO: 223967 - protein, 9 aa, Japanese encephalitis virus
WLSRRNSGG

SEQ ID NO: 223968 - protein, 9 aa, Japanese encephalitis virus
LSRRNSGGG

SEQ ID NO: 223969 - protein, 9 aa, Japanese encephalitis virus
SRENSGGGE

SEQ ID NO: 223970 - protein, 9 aa, Japanese encephalitis virus
RENSGGGEE

SEQ ID NO: 223971 - protein, 9 aa, Japanese encephalitis virus
ENSGGGEEG

SEQ ID NO: 223972 - protein, 9 aa, Japanese encephalitis virus
NSGGGVEGL

SEQ ID NO: 223973 - protein, 9 aa, Japanese encephalitis virus
SGGGVEGLG

SEQ ID NO: 223974 - protein, 9 aa, Japanese encephalitis virus
GGGVEGSSV

SEQ ID NO: 223975 - protein, 9 aa, Japanese encephalitis virus
GGVEGSSVQ

SEQ ID NO: 223976 - protein, 9 aa, Japanese encephalitis virus
GVEGSSVQK

SEQ ID NO: 223977 - protein, 9 aa, Japanese encephalitis virus
VEGSSVQKL

SEQ ID NO: 223978 - protein, 9 aa, Japanese encephalitis virus
EGSSVQKLG

SEQ ID NO: 223979 - protein, 9 aa, Japanese encephalitis virus
GSSVQKLGY

SEQ ID NO: 223980 - protein, 9 aa, Japanese encephalitis virus
SSVQKLGYI

SEQ ID NO: 223981 - protein, 9 aa, Japanese encephalitis virus
SVQKLGYIL

SEQ ID NO: 223982 - protein, 9 aa, Japanese encephalitis virus
VQKLGYISG

SEQ ID NO: 223983 - protein, 9 aa, Japanese encephalitis virus
QKLGYISGD

SEQ ID NO: 223984 - protein, 9 aa, Japanese encephalitis virus
KLGYISGDI

SEQ ID NO: 223985 - protein, 9 aa, Japanese encephalitis virus
LGYIFRDIA

SEQ ID NO: 223986 - protein, 9 aa, Japanese encephalitis virus
RDIARKEGG

SEQ ID NO: 223987 - protein, 9 aa, Japanese encephalitis virus
DIAVKQGGK

SEQ ID NO: 223988 - protein, 9 aa, Japanese encephalitis virus
IARKEGGKM

SEQ ID NO: 223989 - protein, 9 aa, Japanese encephalitis virus
TSRAIGKMY

SEQ ID NO: 223990 - protein, 9 aa, Japanese encephalitis virus
VKQGGKMYA

SEQ ID NO: 223991 - protein, 9 aa, Japanese encephalitis virus
KEGGKMYAD

SEQ ID NO: 223992 - protein, 9 aa, Japanese encephalitis virus
AIGKMYADD

SEQ ID NO: 223993 - protein, 9 aa, Japanese encephalitis virus
IGKMYADDT

SEQ ID NO: 223994 - protein, 9 aa, Japanese encephalitis virus
GKMYADDPA

SEQ ID NO: 223995 - protein, 9 aa, Japanese encephalitis virus
KMYADDPAG

SEQ ID NO: 223996 - protein, 9 aa, Japanese encephalitis virus
MYADDPAGW

SEQ ID NO: 223997 - protein, 9 aa, Japanese encephalitis virus
YADDPAGWD

SEQ ID NO: 223998 - protein, 9 aa, Japanese encephalitis virus
ADDPAGWDT

SEQ ID NO: 223999 - protein, 9 aa, Japanese encephalitis virus
DDPAGWDTR

SEQ ID NO: 224000 - protein, 9 aa, Japanese encephalitis virus
DPAGWDTRI

SEQ ID NO: 224001 - protein, 9 aa, Japanese encephalitis virus
PAGWDTRIT

SEQ ID NO: 224002 - protein, 9 aa, Japanese encephalitis virus
AGWDTRITK

SEQ ID NO: 224003 - protein, 9 aa, Japanese encephalitis virus
GWDTRITRA

SEQ ID NO: 224004 - protein, 9 aa, Japanese encephalitis virus
WDTRITRAD

SEQ ID NO: 224005 - protein, 9 aa, Japanese encephalitis virus
DTRITRADL

SEQ ID NO: 224006 - protein, 9 aa, Japanese encephalitis virus
TRITRADLE

SEQ ID NO: 224007 - protein, 9 aa, Japanese encephalitis virus
RITRADLEN

SEQ ID NO: 224008 - protein, 9 aa, Japanese encephalitis virus
ITRADLENE

SEQ ID NO: 224009 - protein, 9 aa, Japanese encephalitis virus
TRADLENEA

SEQ ID NO: 224010 - protein, 9 aa, Japanese encephalitis virus
RADLENEAK

SEQ ID NO: 224011 - protein, 9 aa, Japanese encephalitis virus
ADLENEAKV

SEQ ID NO: 224012 - protein, 9 aa, Japanese encephalitis virus
ELLDGEHRK

SEQ ID NO: 224013 - protein, 9 aa, Japanese encephalitis virus
LLDGEHRKL

SEQ ID NO: 224014 - protein, 9 aa, Japanese encephalitis virus
LDGEHRKLA

SEQ ID NO: 224015 - protein, 9 aa, Japanese encephalitis virus
DGEHRKLAR

SEQ ID NO: 224016 - protein, 9 aa, Japanese encephalitis virus
GEHRKLARA

SEQ ID NO: 224017 - protein, 9 aa, Japanese encephalitis virus
EHRKLARAI

SEQ ID NO: 224018 - protein, 9 aa, Japanese encephalitis virus
HRKLARAII

SEQ ID NO: 224019 - protein, 9 aa, Japanese encephalitis virus
RKLARAIIE

SEQ ID NO: 224020 - protein, 9 aa, Japanese encephalitis virus
KLARAIIEL

SEQ ID NO: 224021 - protein, 9 aa, Japanese encephalitis virus
RAIIELTYK

SEQ ID NO: 224022 - protein, 9 aa, Japanese encephalitis virus
AIIELTYKH

SEQ ID NO: 224023 - protein, 9 aa, Japanese encephalitis virus
IIELTYKHK

SEQ ID NO: 224024 - protein, 9 aa, Japanese encephalitis virus
IELTYRHQV

SEQ ID NO: 224025 - protein, 9 aa, Japanese encephalitis virus
ELTYRHQVF

SEQ ID NO: 224026 - protein, 9 aa, Japanese encephalitis virus
LTYRHQVFK

SEQ ID NO: 224027 - protein, 9 aa, Japanese encephalitis virus
TYKHKVVKV

SEQ ID NO: 224028 - protein, 9 aa, Japanese encephalitis virus
YKHKVVKVM

SEQ ID NO: 224029 - protein, 9 aa, Japanese encephalitis virus
KHKVVKVMR

SEQ ID NO: 224030 - protein, 9 aa, Japanese encephalitis virus
HQVFKVMRP

SEQ ID NO: 224031 - protein, 9 aa, Japanese encephalitis virus
QVFKVMRPA

SEQ ID NO: 224032 - protein, 9 aa, Japanese encephalitis virus
VFKVMRPAA

SEQ ID NO: 224033 - protein, 9 aa, Japanese encephalitis virus
KVMRPAAGG

SEQ ID NO: 224034 - protein, 9 aa, Japanese encephalitis virus
VMRPAAGGK

SEQ ID NO: 224035 - protein, 9 aa, Japanese encephalitis virus
MRPAAGGKT

SEQ ID NO: 224036 - protein, 9 aa, Japanese encephalitis virus
RPAAGGKTV

SEQ ID NO: 224037 - protein, 9 aa, Japanese encephalitis virus
PAAGGKTVM

SEQ ID NO: 224038 - protein, 9 aa, Japanese encephalitis virus
GGKTVMDVI

SEQ ID NO: 224039 - protein, 9 aa, Japanese encephalitis virus
GKTGMAVIS

SEQ ID NO: 224040 - protein, 9 aa, Japanese encephalitis virus
KTVMVVYSR

SEQ ID NO: 224041 - protein, 9 aa, Japanese encephalitis virus
TVMVVYSRE

SEQ ID NO: 224042 - protein, 9 aa, Japanese encephalitis virus
VMVVYSRED

SEQ ID NO: 224043 - protein, 9 aa, Japanese encephalitis virus
MVVYSREDQ

SEQ ID NO: 224044 - protein, 9 aa, Japanese encephalitis virus
VVYSREDQR

SEQ ID NO: 224045 - protein, 9 aa, Japanese encephalitis virus
VYSREDQRG

SEQ ID NO: 224046 - protein, 9 aa, Japanese encephalitis virus
YSREDQRGS

SEQ ID NO: 224047 - protein, 9 aa, Japanese encephalitis virus
SRENQRGSG

SEQ ID NO: 224048 - protein, 9 aa, Japanese encephalitis virus
RENQRGSGQ

SEQ ID NO: 224049 - protein, 9 aa, Japanese encephalitis virus
ENQRGSGQV

SEQ ID NO: 224050 - protein, 9 aa, Japanese encephalitis virus
NQRGSGQVV

SEQ ID NO: 224051 - protein, 9 aa, Japanese encephalitis virus
TFTNIAVQF

SEQ ID NO: 224052 - protein, 9 aa, Japanese encephalitis virus
FTNIAVQFV

SEQ ID NO: 224053 - protein, 9 aa, Japanese encephalitis virus
TNIAVQFVR

SEQ ID NO: 224054 - protein, 9 aa, Japanese encephalitis virus
NIAVQFVRL

SEQ ID NO: 224055 - protein, 9 aa, Japanese encephalitis virus
IAVQFVRLM

SEQ ID NO: 224056 - protein, 9 aa, Japanese encephalitis virus
AVQFVRLMK

SEQ ID NO: 224057 - protein, 9 aa, Japanese encephalitis virus
VQLVRLVEA

SEQ ID NO: 224058 - protein, 9 aa, Japanese encephalitis virus
QFVRLMKVE

SEQ ID NO: 224059 - protein, 9 aa, Japanese encephalitis virus
LVRLVEAEG

SEQ ID NO: 224060 - protein, 9 aa, Japanese encephalitis virus
VRLMKVEGV

SEQ ID NO: 224061 - protein, 9 aa, Japanese encephalitis virus
RLVEAEGVI

SEQ ID NO: 224062 - protein, 9 aa, Japanese encephalitis virus
LVEAEGVIG

SEQ ID NO: 224063 - protein, 9 aa, Japanese encephalitis virus
MKVEGVIGP

SEQ ID NO: 224064 - protein, 9 aa, Japanese encephalitis virus
KVEGVIGPQ

SEQ ID NO: 224065 - protein, 9 aa, Japanese encephalitis virus
VEGVIGPQH

SEQ ID NO: 224066 - protein, 9 aa, Japanese encephalitis virus
EGVIGPQHV

SEQ ID NO: 224067 - protein, 9 aa, Japanese encephalitis virus
GVIGPQHVE

SEQ ID NO: 224068 - protein, 9 aa, Japanese encephalitis virus
VIGPQHLEH

SEQ ID NO: 224069 - protein, 9 aa, Japanese encephalitis virus
IGPQHLEHL

SEQ ID NO: 224070 - protein, 9 aa, Japanese encephalitis virus
GPQHLEHLP

SEQ ID NO: 224071 - protein, 9 aa, Japanese encephalitis virus
PQHVEQLPR

SEQ ID NO: 224072 - protein, 9 aa, Japanese encephalitis virus
QHLEHLPRK

SEQ ID NO: 224073 - protein, 9 aa, Japanese encephalitis virus
EQLPRKTKI

SEQ ID NO: 224074 - protein, 9 aa, Japanese encephalitis virus
QLPRKTKIA

SEQ ID NO: 224075 - protein, 9 aa, Japanese encephalitis virus
LPRKTKIAV

SEQ ID NO: 224076 - protein, 9 aa, Japanese encephalitis virus
PRKTKIAVR

SEQ ID NO: 224077 - protein, 9 aa, Japanese encephalitis virus
RKTKIAVRT

SEQ ID NO: 224078 - protein, 9 aa, Japanese encephalitis virus
KTKIAVRTW

SEQ ID NO: 224079 - protein, 9 aa, Japanese encephalitis virus
TKIAVRTWL

SEQ ID NO: 224080 - protein, 9 aa, Japanese encephalitis virus
RTWLFENGG

SEQ ID NO: 224081 - protein, 9 aa, Japanese encephalitis virus
TWLFENGGE

SEQ ID NO: 224082 - protein, 9 aa, Japanese encephalitis virus
WLFENGGER

SEQ ID NO: 224083 - protein, 9 aa, Japanese encephalitis virus
LFENGGERV

SEQ ID NO: 224084 - protein, 9 aa, Japanese encephalitis virus
FENGEERVS

SEQ ID NO: 224085 - protein, 9 aa, Japanese encephalitis virus
ENGEERVSR

SEQ ID NO: 224086 - protein, 9 aa, Japanese encephalitis virus
NGEERVSRM

SEQ ID NO: 224087 - protein, 9 aa, Japanese encephalitis virus
GEERVSRMA

SEQ ID NO: 224088 - protein, 9 aa, Japanese encephalitis virus
EERVSRMAI

SEQ ID NO: 224089 - protein, 9 aa, Japanese encephalitis virus
ERVSRMAIS

SEQ ID NO: 224090 - protein, 9 aa, Japanese encephalitis virus
RVSRMAISG

SEQ ID NO: 224091 - protein, 9 aa, Japanese encephalitis virus
VSRMAISGD

SEQ ID NO: 224092 - protein, 9 aa, Japanese encephalitis virus
SRMAISGDD

SEQ ID NO: 224093 - protein, 9 aa, Japanese encephalitis virus
MAISGDDCA

SEQ ID NO: 224094 - protein, 9 aa, Japanese encephalitis virus
AISGDDCAV

SEQ ID NO: 224095 - protein, 9 aa, Japanese encephalitis virus
ISGDDCAVK

SEQ ID NO: 224096 - protein, 9 aa, Japanese encephalitis virus
SGDDCAVKP

SEQ ID NO: 224097 - protein, 9 aa, Japanese encephalitis virus
GDDCAVKPL

SEQ ID NO: 224098 - protein, 9 aa, Japanese encephalitis virus
DDCAVKPLD

SEQ ID NO: 224099 - protein, 9 aa, Japanese encephalitis virus
DCAVKPLDD

SEQ ID NO: 224100 - protein, 9 aa, Japanese encephalitis virus
CAVKPLDDR

SEQ ID NO: 224101 - protein, 9 aa, Japanese encephalitis virus
AVKPLDDRF

SEQ ID NO: 224102 - protein, 9 aa, Japanese encephalitis virus
PLDDRFATS

SEQ ID NO: 224103 - protein, 9 aa, Japanese encephalitis virus
LDDRFATSL

SEQ ID NO: 224104 - protein, 9 aa, Japanese encephalitis virus
DDRFATSLH

SEQ ID NO: 224105 - protein, 9 aa, Japanese encephalitis virus
DRFATALYF

SEQ ID NO: 224106 - protein, 9 aa, Japanese encephalitis virus
RFATALYFL

SEQ ID NO: 224107 - protein, 9 aa, Japanese encephalitis virus
FATSLHFLN

SEQ ID NO: 224108 - protein, 9 aa, Japanese encephalitis virus
ATALYFLNA

SEQ ID NO: 224109 - protein, 9 aa, Japanese encephalitis virus
TSLHFLNAM

SEQ ID NO: 224110 - protein, 9 aa, Japanese encephalitis virus
SLHFLNAMS

SEQ ID NO: 224111 - protein, 9 aa, Japanese encephalitis virus
LYFLNAMSK

SEQ ID NO: 224112 - protein, 9 aa, Japanese encephalitis virus
YFLNAMSKV

SEQ ID NO: 224113 - protein, 9 aa, Japanese encephalitis virus
FLNAMSKVT

SEQ ID NO: 224114 - protein, 9 aa, Japanese encephalitis virus
LNAMSKVTK

SEQ ID NO: 224115 - protein, 9 aa, Japanese encephalitis virus
NAMSKVRRD

SEQ ID NO: 224116 - protein, 9 aa, Japanese encephalitis virus
AMSKVTKDI

SEQ ID NO: 224117 - protein, 9 aa, Japanese encephalitis virus
MSKVRKDIL

SEQ ID NO: 224118 - protein, 9 aa, Japanese encephalitis virus
SKVRRDIQE

SEQ ID NO: 224119 - protein, 9 aa, Japanese encephalitis virus
KVTKDIQQW

SEQ ID NO: 224120 - protein, 9 aa, Japanese encephalitis virus
VRRDIQEWK

SEQ ID NO: 224121 - protein, 9 aa, Japanese encephalitis virus
TKDIQQWKP

SEQ ID NO: 224122 - protein, 9 aa, Japanese encephalitis virus
RDIQEWKPS

SEQ ID NO: 224123 - protein, 9 aa, Japanese encephalitis virus
DILEWKPSH

SEQ ID NO: 224124 - protein, 9 aa, Japanese encephalitis virus
IQQWKPSHG

SEQ ID NO: 224125 - protein, 9 aa, Japanese encephalitis virus
QQWKPSHGW

SEQ ID NO: 224126 - protein, 9 aa, Japanese encephalitis virus
QWKPSHGWH

SEQ ID NO: 224127 - protein, 9 aa, Japanese encephalitis virus
WKPSHGWLD

SEQ ID NO: 224128 - protein, 9 aa, Japanese encephalitis virus
KPSHGWLDW

SEQ ID NO: 224129 - protein, 9 aa, Japanese encephalitis virus
PSHGWHDWL

SEQ ID NO: 224130 - protein, 9 aa, Japanese encephalitis virus
SHGWHDWLH

SEQ ID NO: 224131 - protein, 9 aa, Japanese encephalitis virus
HGWHDWLHV

SEQ ID NO: 224132 - protein, 9 aa, Japanese encephalitis virus
GWHDWLHVP

SEQ ID NO: 224133 - protein, 9 aa, Japanese encephalitis virus
WHDWLHVPF

SEQ ID NO: 224134 - protein, 9 aa, Japanese encephalitis virus
LDWQQVPFC

SEQ ID NO: 224135 - protein, 9 aa, Japanese encephalitis virus
DWLHVPFCS

SEQ ID NO: 224136 - protein, 9 aa, Japanese encephalitis virus
WLHVPFCSN

SEQ ID NO: 224137 - protein, 9 aa, Japanese encephalitis virus
LHVPFCSNH

SEQ ID NO: 224138 - protein, 9 aa, Japanese encephalitis virus
HVPFCSNHF

SEQ ID NO: 224139 - protein, 9 aa, Japanese encephalitis virus
VPFCSNHFH

SEQ ID NO: 224140 - protein, 9 aa, Japanese encephalitis virus
PFCSNHFHE

SEQ ID NO: 224141 - protein, 9 aa, Japanese encephalitis virus
FCSNHFHEI

SEQ ID NO: 224142 - protein, 9 aa, Japanese encephalitis virus
CSNHFHEIV

SEQ ID NO: 224143 - protein, 9 aa, Japanese encephalitis virus
SNHFHEIVM

SEQ ID NO: 224144 - protein, 9 aa, Japanese encephalitis virus
NHFHEIVMK

SEQ ID NO: 224145 - protein, 9 aa, Japanese encephalitis virus
HFHEIVMKD

SEQ ID NO: 224146 - protein, 9 aa, Japanese encephalitis virus
FHEIVMKDG

SEQ ID NO: 224147 - protein, 9 aa, Japanese encephalitis virus
HEIVMKDGR

SEQ ID NO: 224148 - protein, 9 aa, Japanese encephalitis virus
IVMKDGRSL

SEQ ID NO: 224149 - protein, 9 aa, Japanese encephalitis virus
VMKDGRSLL

SEQ ID NO: 224150 - protein, 9 aa, Japanese encephalitis virus
MKDGRSLLV

SEQ ID NO: 224151 - protein, 9 aa, Japanese encephalitis virus
KDGRSLLVP

SEQ ID NO: 224152 - protein, 9 aa, Japanese encephalitis virus
DGRSLLVPC

SEQ ID NO: 224153 - protein, 9 aa, Japanese encephalitis virus
GRSLLVPCR

SEQ ID NO: 224154 - protein, 9 aa, Japanese encephalitis virus
RSIVDPCRG

SEQ ID NO: 224155 - protein, 9 aa, Japanese encephalitis virus
SLLVPCRGQ

SEQ ID NO: 224156 - protein, 9 aa, Japanese encephalitis virus
LLVPCRGQD

SEQ ID NO: 224157 - protein, 9 aa, Japanese encephalitis virus
VDPCRGQDE

SEQ ID NO: 224158 - protein, 9 aa, Japanese encephalitis virus
DPCRGQDEL

SEQ ID NO: 224159 - protein, 9 aa, Japanese encephalitis virus
CRGQDELID

SEQ ID NO: 224160 - protein, 9 aa, Japanese encephalitis virus
RGQDELIDR

SEQ ID NO: 224161 - protein, 9 aa, Japanese encephalitis virus
GQDELIDRA

SEQ ID NO: 224162 - protein, 9 aa, Japanese encephalitis virus
QDELIDRAR

SEQ ID NO: 224163 - protein, 9 aa, Japanese encephalitis virus
DELIDRARI

SEQ ID NO: 224164 - protein, 9 aa, Japanese encephalitis virus
ELIDRARIS

SEQ ID NO: 224165 - protein, 9 aa, Japanese encephalitis virus
LIDRARISP

SEQ ID NO: 224166 - protein, 9 aa, Japanese encephalitis virus
IDRARISPG

SEQ ID NO: 224167 - protein, 9 aa, Japanese encephalitis virus
DRARISPGA

SEQ ID NO: 224168 - protein, 9 aa, Japanese encephalitis virus
ARISPGAGC

SEQ ID NO: 224169 - protein, 9 aa, Japanese encephalitis virus
RISPGAGCN

SEQ ID NO: 224170 - protein, 9 aa, Japanese encephalitis virus
ISPGAGCNV

SEQ ID NO: 224171 - protein, 9 aa, Japanese encephalitis virus
SPGAGCNVK

SEQ ID NO: 224172 - protein, 9 aa, Japanese encephalitis virus
PGAGCNVKD

SEQ ID NO: 224173 - protein, 9 aa, Japanese encephalitis virus
GAGCNVKDT

SEQ ID NO: 224174 - protein, 9 aa, Japanese encephalitis virus
AGCNVKDTA

SEQ ID NO: 224175 - protein, 9 aa, Japanese encephalitis virus
GCNVKDTAC

SEQ ID NO: 224176 - protein, 9 aa, Japanese encephalitis virus
CNVKDTACL

SEQ ID NO: 224177 - protein, 9 aa, Japanese encephalitis virus
NVKDTACLP

SEQ ID NO: 224178 - protein, 9 aa, Japanese encephalitis virus
VKDTACLPK

SEQ ID NO: 224179 - protein, 9 aa, Japanese encephalitis virus
MDTACLAKA

SEQ ID NO: 224180 - protein, 9 aa, Japanese encephalitis virus
DTACLPKAY

SEQ ID NO: 224181 - protein, 9 aa, Japanese encephalitis virus
TACLPKAYA

SEQ ID NO: 224182 - protein, 9 aa, Japanese encephalitis virus
ACLPKAYAQ

SEQ ID NO: 224183 - protein, 9 aa, Japanese encephalitis virus
CLPKAYAQM

SEQ ID NO: 224184 - protein, 9 aa, Japanese encephalitis virus
LAKAYAQMR

SEQ ID NO: 224185 - protein, 9 aa, Japanese encephalitis virus
AKAYAQMRL

SEQ ID NO: 224186 - protein, 9 aa, Japanese encephalitis virus
KAYAQMRLL

SEQ ID NO: 224187 - protein, 9 aa, Japanese encephalitis virus
AYAQMRLLL

SEQ ID NO: 224188 - protein, 9 aa, Japanese encephalitis virus
YAQMRLLLY

SEQ ID NO: 224189 - protein, 9 aa, Japanese encephalitis virus
AQMRLLLYF

SEQ ID NO: 224190 - protein, 9 aa, Japanese encephalitis virus
QMRLLLYFH

SEQ ID NO: 224191 - protein, 9 aa, Japanese encephalitis virus
MRLLLYFHR

SEQ ID NO: 224192 - protein, 9 aa, Japanese encephalitis virus
RLLLYFHRR

SEQ ID NO: 224193 - protein, 9 aa, Japanese encephalitis virus
LLLYFHRRY

SEQ ID NO: 224194 - protein, 9 aa, Japanese encephalitis virus
LLYFHRRYL

SEQ ID NO: 224195 - protein, 9 aa, Japanese encephalitis virus
LYFHRRYLR

SEQ ID NO: 224196 - protein, 9 aa, Japanese encephalitis virus
YFHRRYLRL

SEQ ID NO: 224197 - protein, 9 aa, Japanese encephalitis virus
FHRRYLRLM

SEQ ID NO: 224198 - protein, 9 aa, Japanese encephalitis virus
HRRYLRLMA

SEQ ID NO: 224199 - protein, 9 aa, Japanese encephalitis virus
RRYLRLMAN

SEQ ID NO: 224200 - protein, 9 aa, Japanese encephalitis virus
RYLRLMANA

SEQ ID NO: 224201 - protein, 9 aa, Japanese encephalitis virus
YLRLMANAI

SEQ ID NO: 224202 - protein, 9 aa, Japanese encephalitis virus
LCLMANAIC

SEQ ID NO: 224203 - protein, 9 aa, Japanese encephalitis virus
CLMANAICS

SEQ ID NO: 224204 - protein, 9 aa, Japanese encephalitis virus
LMANAICST

SEQ ID NO: 224205 - protein, 9 aa, Japanese encephalitis virus
MANAICSTV

SEQ ID NO: 224206 - protein, 9 aa, Japanese encephalitis virus
ANAICSTVP

SEQ ID NO: 224207 - protein, 9 aa, Japanese encephalitis virus
NAICSAVPL

SEQ ID NO: 224208 - protein, 9 aa, Japanese encephalitis virus
AICSAVPVN

SEQ ID NO: 224209 - protein, 9 aa, Japanese encephalitis virus
ICSTVPVDW

SEQ ID NO: 224210 - protein, 9 aa, Japanese encephalitis virus
CSAVPVNWV

SEQ ID NO: 224211 - protein, 9 aa, Japanese encephalitis virus
STVPVDWVP

SEQ ID NO: 224212 - protein, 9 aa, Japanese encephalitis virus
AVPVNWVPT

SEQ ID NO: 224213 - protein, 9 aa, Japanese encephalitis virus
VPLDWVPTG

SEQ ID NO: 224214 - protein, 9 aa, Japanese encephalitis virus
PLDWVPTGR

SEQ ID NO: 224215 - protein, 9 aa, Japanese encephalitis virus
LDWVPTGRT

SEQ ID NO: 224216 - protein, 9 aa, Japanese encephalitis virus
NWVPTGRTS

SEQ ID NO: 224217 - protein, 9 aa, Japanese encephalitis virus
PTGRTSWSK

SEQ ID NO: 224218 - protein, 9 aa, Japanese encephalitis virus
TGRTSWSKH

SEQ ID NO: 224219 - protein, 9 aa, Japanese encephalitis virus
GRTSWSKHS

SEQ ID NO: 224220 - protein, 9 aa, Japanese encephalitis virus
RTSWSKHSK

SEQ ID NO: 224221 - protein, 9 aa, Japanese encephalitis virus
TSWSKHSKG

SEQ ID NO: 224222 - protein, 9 aa, Japanese encephalitis virus
SWSKHSKGE

SEQ ID NO: 224223 - protein, 9 aa, Japanese encephalitis virus
WSKHSKGEW

SEQ ID NO: 224224 - protein, 9 aa, Japanese encephalitis virus
SKHSKGEWM

SEQ ID NO: 224225 - protein, 9 aa, Japanese encephalitis virus
KHSKGEWMT

SEQ ID NO: 224226 - protein, 9 aa, Japanese encephalitis virus
HSKGEWIPT

SEQ ID NO: 224227 - protein, 9 aa, Japanese encephalitis virus
SKGEWIPTE

SEQ ID NO: 224228 - protein, 9 aa, Japanese encephalitis virus
KGEWMTTEN

SEQ ID NO: 224229 - protein, 9 aa, Japanese encephalitis virus
GEWMTTENM

SEQ ID NO: 224230 - protein, 9 aa, Japanese encephalitis virus
EWMTTENML

SEQ ID NO: 224231 - protein, 9 aa, Japanese encephalitis virus
WMTTENMLQ

SEQ ID NO: 224232 - protein, 9 aa, Japanese encephalitis virus
MTTENMLQV

SEQ ID NO: 224233 - protein, 9 aa, Japanese encephalitis virus
TTENMLQVW

SEQ ID NO: 224234 - protein, 9 aa, Japanese encephalitis virus
TENMLQVWN

SEQ ID NO: 224235 - protein, 9 aa, Japanese encephalitis virus
ENMLQVWNK

SEQ ID NO: 224236 - protein, 9 aa, Japanese encephalitis virus
NMLQVWNKV

SEQ ID NO: 224237 - protein, 9 aa, Japanese encephalitis virus
MLQVWNKVW

SEQ ID NO: 224238 - protein, 9 aa, Japanese encephalitis virus
LQVWNKVWI

SEQ ID NO: 224239 - protein, 9 aa, Japanese encephalitis virus
QVWNKVWIE

SEQ ID NO: 224240 - protein, 9 aa, Japanese encephalitis virus
VWNKVWIEE

SEQ ID NO: 224241 - protein, 9 aa, Japanese encephalitis virus
WNKVWIEEN

SEQ ID NO: 224242 - protein, 9 aa, Japanese encephalitis virus
NKVWIEENE

SEQ ID NO: 224243 - protein, 9 aa, Japanese encephalitis virus
KVWIEENEW

SEQ ID NO: 224244 - protein, 9 aa, Japanese encephalitis virus
WIEENEWMV

SEQ ID NO: 224245 - protein, 9 aa, Japanese encephalitis virus
IEENEWMVD

SEQ ID NO: 224246 - protein, 9 aa, Japanese encephalitis virus
EENEWMVDK

SEQ ID NO: 224247 - protein, 9 aa, Japanese encephalitis virus
ENEWMVDKT

SEQ ID NO: 224248 - protein, 9 aa, Japanese encephalitis virus
NEWMVDKTP

SEQ ID NO: 224249 - protein, 9 aa, Japanese encephalitis virus
DKTPVTSWT

SEQ ID NO: 224250 - protein, 9 aa, Japanese encephalitis virus
KTPVTSWTD

SEQ ID NO: 224251 - protein, 9 aa, Japanese encephalitis virus
TPVTSWTDV

SEQ ID NO: 224252 - protein, 9 aa, Japanese encephalitis virus
PVTSWTDVP

SEQ ID NO: 224253 - protein, 9 aa, Japanese encephalitis virus
VTSWTDVPY

SEQ ID NO: 224254 - protein, 9 aa, Japanese encephalitis virus
ASWTDVPYV

SEQ ID NO: 224255 - protein, 9 aa, Japanese encephalitis virus
KREDIWCGN

SEQ ID NO: 224256 - protein, 9 aa, Japanese encephalitis virus
REDIWCGNL

SEQ ID NO: 224257 - protein, 9 aa, Japanese encephalitis virus
EDIWCGNLI

SEQ ID NO: 224258 - protein, 9 aa, Japanese encephalitis virus
DIWCGNLIG

SEQ ID NO: 224259 - protein, 9 aa, Japanese encephalitis virus
IWCGNLIGT

SEQ ID NO: 224260 - protein, 9 aa, Japanese encephalitis virus
WCGNLIGTR

SEQ ID NO: 224261 - protein, 9 aa, Japanese encephalitis virus
CGSLIGTRT

SEQ ID NO: 224262 - protein, 9 aa, Japanese encephalitis virus
GSLIGTRTR

SEQ ID NO: 224263 - protein, 9 aa, Japanese encephalitis virus
SLIGTRTRA

SEQ ID NO: 224264 - protein, 9 aa, Japanese encephalitis virus
LIGTRTRAT

SEQ ID NO: 224265 - protein, 9 aa, Japanese encephalitis virus
IGTRTRATW

SEQ ID NO: 224266 - protein, 9 aa, Japanese encephalitis virus
GTRTRATWA

SEQ ID NO: 224267 - protein, 9 aa, Japanese encephalitis virus
TRTRATWAE

SEQ ID NO: 224268 - protein, 9 aa, Japanese encephalitis virus
RTRATWAEN

SEQ ID NO: 224269 - protein, 9 aa, Japanese encephalitis virus
TRATWAENI

SEQ ID NO: 224270 - protein, 9 aa, Japanese encephalitis virus
KATWAENIY

SEQ ID NO: 224271 - protein, 9 aa, Japanese encephalitis virus
ATWAENVYA

SEQ ID NO: 224272 - protein, 9 aa, Japanese encephalitis virus
TWAENVYAA

SEQ ID NO: 224273 - protein, 9 aa, Japanese encephalitis virus
WAENVYAAI

SEQ ID NO: 224274 - protein, 9 aa, Japanese encephalitis virus
AENVYAAIN

SEQ ID NO: 224275 - protein, 9 aa, Japanese encephalitis virus
ENVYAAINQ

SEQ ID NO: 224276 - protein, 9 aa, Japanese encephalitis virus
NVYAAINQV

SEQ ID NO: 224277 - protein, 9 aa, Japanese encephalitis virus
VYAAINQVR

SEQ ID NO: 224278 - protein, 9 aa, Japanese encephalitis virus
AAINQVRAI

SEQ ID NO: 224279 - protein, 9 aa, Japanese encephalitis virus
AINQVRAII

SEQ ID NO: 224280 - protein, 9 aa, Japanese encephalitis virus
INQVRAIIG

SEQ ID NO: 224281 - protein, 9 aa, Japanese encephalitis virus
NQVRAIIGK

SEQ ID NO: 224282 - protein, 9 aa, Japanese encephalitis virus
QVRAIIGKE

SEQ ID NO: 224283 - protein, 9 aa, Japanese encephalitis virus
VRAIIGKEN

SEQ ID NO: 224284 - protein, 9 aa, Japanese encephalitis virus
RAIIGKENY

SEQ ID NO: 224285 - protein, 9 aa, Japanese encephalitis virus
AIIGKENYV

SEQ ID NO: 224286 - protein, 9 aa, Japanese encephalitis virus
IIGKENYVD

SEQ ID NO: 224287 - protein, 9 aa, Japanese encephalitis virus
IGKETYVDY

SEQ ID NO: 224288 - protein, 9 aa, Japanese encephalitis virus
GKEDYVDYM

SEQ ID NO: 224289 - protein, 9 aa, Japanese encephalitis virus
KENYVDYMD

SEQ ID NO: 224290 - protein, 9 aa, Japanese encephalitis virus
EDYVDYMTS

SEQ ID NO: 224291 - protein, 9 aa, Japanese encephalitis virus
NYVDYMLSL

SEQ ID NO: 224292 - protein, 9 aa, Japanese encephalitis virus
YVDYMDFPQ

SEQ ID NO: 224293 - protein, 9 aa, Japanese encephalitis virus
VDYMDFPQR

SEQ ID NO: 224294 - protein, 9 aa, Japanese encephalitis virus
DYMLSLRRY

SEQ ID NO: 224295 - protein, 9 aa, Japanese encephalitis virus
YMLSLRRYE

SEQ ID NO: 224296 - protein, 9 aa, Japanese encephalitis virus
MLSLRRYED

SEQ ID NO: 224297 - protein, 9 aa, Japanese encephalitis virus
LSLRRYEDV

SEQ ID NO: 224298 - protein, 9 aa, Japanese encephalitis virus
SLRRYEDVS

SEQ ID NO: 224299 - protein, 9 aa, Japanese encephalitis virus
LRRYEDVLV

SEQ ID NO: 224300 - protein, 9 aa, Japanese encephalitis virus
RRYEDVLVQ

SEQ ID NO: 224301 - protein, 9 aa, Japanese encephalitis virus
RYEDVLVQE

SEQ ID NO: 224302 - protein, 9 aa, Japanese encephalitis virus
YEDVLVQED

SEQ ID NO: 224303 - protein, 9 aa, Japanese encephalitis virus
EDVLVQEDR

SEQ ID NO: 224304 - protein, 9 aa, Japanese encephalitis virus
DVLVQEDRV

SEQ ID NO: 224305 - protein, 9 aa, Japanese encephalitis virus
VLVQEDRVI

SEQ ID NO: 224306 - protein, 9 aa, Japanese encephalitis virus
TKKPRGPGI

SEQ ID NO: 224307 - protein, 9 aa, Japanese encephalitis virus
KKPRGPGIN

SEQ ID NO: 224308 - protein, 9 aa, Japanese encephalitis virus
KPGGPGKSR

SEQ ID NO: 224309 - protein, 9 aa, Japanese encephalitis virus
PRGPGINRA

SEQ ID NO: 224310 - protein, 9 aa, Japanese encephalitis virus
GGPGKSRAI

SEQ ID NO: 224311 - protein, 9 aa, Japanese encephalitis virus
GPGINRAIY

SEQ ID NO: 224312 - protein, 9 aa, Japanese encephalitis virus
PGKSRAINM

SEQ ID NO: 224313 - protein, 9 aa, Japanese encephalitis virus
GINRAIYML

SEQ ID NO: 224314 - protein, 9 aa, Japanese encephalitis virus
INRAIYMLK

SEQ ID NO: 224315 - protein, 9 aa, Japanese encephalitis virus
SRAINMLKR

SEQ ID NO: 224316 - protein, 9 aa, Japanese encephalitis virus
VFPLVGVKK

SEQ ID NO: 224317 - protein, 9 aa, Japanese encephalitis virus
FPLVRVKRV

SEQ ID NO: 224318 - protein, 9 aa, Japanese encephalitis virus
PLVGVKKVV

SEQ ID NO: 224319 - protein, 9 aa, Japanese encephalitis virus
LVGVKKVVM

SEQ ID NO: 224320 - protein, 9 aa, Japanese encephalitis virus
VRVKRVVMS

SEQ ID NO: 224321 - protein, 9 aa, Japanese encephalitis virus
GVKKVVMSL

SEQ ID NO: 224322 - protein, 9 aa, Japanese encephalitis virus
VKRVVISLL

SEQ ID NO: 224323 - protein, 9 aa, Japanese encephalitis virus
KKVVMSLLD

SEQ ID NO: 224324 - protein, 9 aa, Japanese encephalitis virus
RVVISLLDG

SEQ ID NO: 224325 - protein, 9 aa, Japanese encephalitis virus
SLLDGIGPL

SEQ ID NO: 224326 - protein, 9 aa, Japanese encephalitis virus
LLDGIGPLR

SEQ ID NO: 224327 - protein, 9 aa, Japanese encephalitis virus
LDGIGPLRF

SEQ ID NO: 224328 - protein, 9 aa, Japanese encephalitis virus
DGIGPLRFV

SEQ ID NO: 224329 - protein, 9 aa, Japanese encephalitis virus
GIGPLRFVL

SEQ ID NO: 224330 - protein, 9 aa, Japanese encephalitis virus
IGPLRFVLA

SEQ ID NO: 224331 - protein, 9 aa, Japanese encephalitis virus
GPLRFVLAL

SEQ ID NO: 224332 - protein, 9 aa, Japanese encephalitis virus
PARFVLALI

SEQ ID NO: 224333 - protein, 9 aa, Japanese encephalitis virus
VRFVLALTT

SEQ ID NO: 224334 - protein, 9 aa, Japanese encephalitis virus
RFVLAFITF

SEQ ID NO: 224335 - protein, 9 aa, Japanese encephalitis virus
FVLAFITFF

SEQ ID NO: 224336 - protein, 9 aa, Japanese encephalitis virus
VLAFITFFK

SEQ ID NO: 224337 - protein, 9 aa, Japanese encephalitis virus
LALVSFFKF

SEQ ID NO: 224338 - protein, 9 aa, Japanese encephalitis virus
AFITFFKFT

SEQ ID NO: 224339 - protein, 9 aa, Japanese encephalitis virus
LVSFFKFTA

SEQ ID NO: 224340 - protein, 9 aa, Japanese encephalitis virus
VSFFKFTAL

SEQ ID NO: 224341 - protein, 9 aa, Japanese encephalitis virus
ALSPTKALL

SEQ ID NO: 224342 - protein, 9 aa, Japanese encephalitis virus
LSPTKALLG

SEQ ID NO: 224343 - protein, 9 aa, Japanese encephalitis virus
SPTKALLGR

SEQ ID NO: 224344 - protein, 9 aa, Japanese encephalitis virus
TKALSGRWK

SEQ ID NO: 224345 - protein, 9 aa, Japanese encephalitis virus
KALSGRWKA

SEQ ID NO: 224346 - protein, 9 aa, Japanese encephalitis virus
ALSGRWKAV

SEQ ID NO: 224347 - protein, 9 aa, Japanese encephalitis virus
LSGRWKAVE

SEQ ID NO: 224348 - protein, 9 aa, Japanese encephalitis virus
SGRWKAVEK

SEQ ID NO: 224349 - protein, 9 aa, Japanese encephalitis virus
GRWKAVERS

SEQ ID NO: 224350 - protein, 9 aa, Japanese encephalitis virus
RWKAVERSV

SEQ ID NO: 224351 - protein, 9 aa, Japanese encephalitis virus
WRALEKSVA

SEQ ID NO: 224352 - protein, 9 aa, Japanese encephalitis virus
KAVERSVAM

SEQ ID NO: 224353 - protein, 9 aa, Japanese encephalitis virus
AVERSVAMK

SEQ ID NO: 224354 - protein, 9 aa, Japanese encephalitis virus
LEKSVAMKH

SEQ ID NO: 224355 - protein, 9 aa, Japanese encephalitis virus
TSFKRELGI

SEQ ID NO: 224356 - protein, 9 aa, Japanese encephalitis virus
SFKRELGIL

SEQ ID NO: 224357 - protein, 9 aa, Japanese encephalitis virus
FKGELGTLI

SEQ ID NO: 224358 - protein, 9 aa, Japanese encephalitis virus
KGELGTLID

SEQ ID NO: 224359 - protein, 9 aa, Japanese encephalitis virus
GELGTLIDG

SEQ ID NO: 224360 - protein, 9 aa, Japanese encephalitis virus
ELGTLIDTV

SEQ ID NO: 224361 - protein, 9 aa, Japanese encephalitis virus
LGILIDAVN

SEQ ID NO: 224362 - protein, 9 aa, Japanese encephalitis virus
GTLIDTVNK

SEQ ID NO: 224363 - protein, 9 aa, Japanese encephalitis virus
TLIDGVNKR

SEQ ID NO: 224364 - protein, 9 aa, Japanese encephalitis virus
LIDGVNKRG

SEQ ID NO: 224365 - protein, 9 aa, Japanese encephalitis virus
IDGVNKRGR

SEQ ID NO: 224366 - protein, 9 aa, Japanese encephalitis virus
DVVNKRGKK

SEQ ID NO: 224367 - protein, 9 aa, Japanese encephalitis virus
VNKRGRKRN

SEQ ID NO: 224368 - protein, 9 aa, Japanese encephalitis virus
NKRGRKRNK

SEQ ID NO: 224369 - protein, 9 aa, Japanese encephalitis virus
KRGRKRNKR

SEQ ID NO: 224370 - protein, 9 aa, Japanese encephalitis virus
RGRKRNKRG

SEQ ID NO: 224371 - protein, 9 aa, Japanese encephalitis virus
GRKRNKRGG

SEQ ID NO: 224372 - protein, 9 aa, Japanese encephalitis virus
RKRNKRGGN

SEQ ID NO: 224373 - protein, 9 aa, Japanese encephalitis virus
KQNKRGGNG

SEQ ID NO: 224374 - protein, 9 aa, Japanese encephalitis virus
QNKRGGNGG

SEQ ID NO: 224375 - protein, 9 aa, Japanese encephalitis virus
AGAMRLSNF

SEQ ID NO: 224376 - protein, 9 aa, Japanese encephalitis virus
GAIKLSNFQ

SEQ ID NO: 224377 - protein, 9 aa, Japanese encephalitis virus
AIKLSNFQG

SEQ ID NO: 224378 - protein, 9 aa, Japanese encephalitis virus
LKLSNFQGK

SEQ ID NO: 224379 - protein, 9 aa, Japanese encephalitis virus
FQGKLLMAV

SEQ ID NO: 224380 - protein, 9 aa, Japanese encephalitis virus
QGKLLMAVN

SEQ ID NO: 224381 - protein, 9 aa, Japanese encephalitis virus
GKLLMAVNN

SEQ ID NO: 224382 - protein, 9 aa, Japanese encephalitis virus
KLLMAVNNT

SEQ ID NO: 224383 - protein, 9 aa, Japanese encephalitis virus
LLMAVNNTD

SEQ ID NO: 224384 - protein, 9 aa, Japanese encephalitis virus
LMAVNNTDI

SEQ ID NO: 224385 - protein, 9 aa, Japanese encephalitis virus
MAVNNTDIA

SEQ ID NO: 224386 - protein, 9 aa, Japanese encephalitis virus
AVNNTDIAD

SEQ ID NO: 224387 - protein, 9 aa, Japanese encephalitis virus
VRAIDVGHM

SEQ ID NO: 224388 - protein, 9 aa, Japanese encephalitis virus
RAIDVGYLC

SEQ ID NO: 224389 - protein, 9 aa, Japanese encephalitis virus
AIDVGYLCE

SEQ ID NO: 224390 - protein, 9 aa, Japanese encephalitis virus
IDVGHMCED

SEQ ID NO: 224391 - protein, 9 aa, Japanese encephalitis virus
DVGYLCEDT

SEQ ID NO: 224392 - protein, 9 aa, Japanese encephalitis virus
VGHMCEDTI

SEQ ID NO: 224393 - protein, 9 aa, Japanese encephalitis virus
GHMCEDTIT

SEQ ID NO: 224394 - protein, 9 aa, Japanese encephalitis virus
YLCEDTITY

SEQ ID NO: 224395 - protein, 9 aa, Japanese encephalitis virus
AGNDPEDVD

SEQ ID NO: 224396 - protein, 9 aa, Japanese encephalitis virus
VDCWCDHQE

SEQ ID NO: 224397 - protein, 9 aa, Japanese encephalitis virus
DCWCDHQEV

SEQ ID NO: 224398 - protein, 9 aa, Japanese encephalitis virus
CWCDHQEVY

SEQ ID NO: 224399 - protein, 9 aa, Japanese encephalitis virus
WCDNQEVYI

SEQ ID NO: 224400 - protein, 9 aa, Japanese encephalitis virus
CDHQEVYVQ

SEQ ID NO: 224401 - protein, 9 aa, Japanese encephalitis virus
DNQEVYIQY

SEQ ID NO: 224402 - protein, 9 aa, Japanese encephalitis virus
NQEVYIQYG

SEQ ID NO: 224403 - protein, 9 aa, Japanese encephalitis virus
QEVYIQYGR

SEQ ID NO: 224404 - protein, 9 aa, Japanese encephalitis virus
EVYIQYGRC

SEQ ID NO: 224405 - protein, 9 aa, Japanese encephalitis virus
VYIQYGRCT

SEQ ID NO: 224406 - protein, 9 aa, Japanese encephalitis virus
YIQYGRCTR

SEQ ID NO: 224407 - protein, 9 aa, Japanese encephalitis virus
IQYGRCTRT

SEQ ID NO: 224408 - protein, 9 aa, Japanese encephalitis virus
QYGRCTRTS

SEQ ID NO: 224409 - protein, 9 aa, Japanese encephalitis virus
YGRCTRTSH

SEQ ID NO: 224410 - protein, 9 aa, Japanese encephalitis virus
GRCTRTSHS

SEQ ID NO: 224411 - protein, 9 aa, Japanese encephalitis virus
RCTRTSHSQ

SEQ ID NO: 224412 - protein, 9 aa, Japanese encephalitis virus
TRTSHSQTS

SEQ ID NO: 224413 - protein, 9 aa, Japanese encephalitis virus
RTRHSKRSK

SEQ ID NO: 224414 - protein, 9 aa, Japanese encephalitis virus
TSHSQTSRR

SEQ ID NO: 224415 - protein, 9 aa, Japanese encephalitis virus
RHSKRSKRS

SEQ ID NO: 224416 - protein, 9 aa, Japanese encephalitis virus
HSKRSKRSV

SEQ ID NO: 224417 - protein, 9 aa, Japanese encephalitis virus
SQTSRRSVS

SEQ ID NO: 224418 - protein, 9 aa, Japanese encephalitis virus
QTSRRSVSV

SEQ ID NO: 224419 - protein, 9 aa, Japanese encephalitis virus
RSKRSVSVQ

SEQ ID NO: 224420 - protein, 9 aa, Japanese encephalitis virus
SRRSVSVQP

SEQ ID NO: 224421 - protein, 9 aa, Japanese encephalitis virus
RRSVSVHTH

SEQ ID NO: 224422 - protein, 9 aa, Japanese encephalitis virus
RSVSVHTHG

SEQ ID NO: 224423 - protein, 9 aa, Japanese encephalitis virus
SVSVHTHGE

SEQ ID NO: 224424 - protein, 9 aa, Japanese encephalitis virus
VSVQPNGER

SEQ ID NO: 224425 - protein, 9 aa, Japanese encephalitis virus
SVQPNGERS

SEQ ID NO: 224426 - protein, 9 aa, Japanese encephalitis virus
VQPNGERSL

SEQ ID NO: 224427 - protein, 9 aa, Japanese encephalitis virus
QPNGERSLV

SEQ ID NO: 224428 - protein, 9 aa, Japanese encephalitis virus
THGESSLEN

SEQ ID NO: 224429 - protein, 9 aa, Japanese encephalitis virus
NGERSLVNK

SEQ ID NO: 224430 - protein, 9 aa, Japanese encephalitis virus
GERSLVNKK

SEQ ID NO: 224431 - protein, 9 aa, Japanese encephalitis virus
ESSLVNKKK

SEQ ID NO: 224432 - protein, 9 aa, Japanese encephalitis virus
SSLVNKKKA

SEQ ID NO: 224433 - protein, 9 aa, Japanese encephalitis virus
SLENKKEAW

SEQ ID NO: 224434 - protein, 9 aa, Japanese encephalitis virus
LVNKKKAWL

SEQ ID NO: 224435 - protein, 9 aa, Japanese encephalitis virus
ENKKEAWLD

SEQ ID NO: 224436 - protein, 9 aa, Japanese encephalitis virus
NKKEAWLNS

SEQ ID NO: 224437 - protein, 9 aa, Japanese encephalitis virus
KKKAWLDST

SEQ ID NO: 224438 - protein, 9 aa, Japanese encephalitis virus
KEAWLNSTK

SEQ ID NO: 224439 - protein, 9 aa, Japanese encephalitis virus
EAWLNSTKA

SEQ ID NO: 224440 - protein, 9 aa, Japanese encephalitis virus
AWLNSTKAT

SEQ ID NO: 224441 - protein, 9 aa, Japanese encephalitis virus
WLNSTKATR

SEQ ID NO: 224442 - protein, 9 aa, Japanese encephalitis virus
LNSTKATRY

SEQ ID NO: 224443 - protein, 9 aa, Japanese encephalitis virus
NSTKATRYL

SEQ ID NO: 224444 - protein, 9 aa, Japanese encephalitis virus
STRATRYLM

SEQ ID NO: 224445 - protein, 9 aa, Japanese encephalitis virus
TRATRYLMK

SEQ ID NO: 224446 - protein, 9 aa, Japanese encephalitis virus
RATRYLMKT

SEQ ID NO: 224447 - protein, 9 aa, Japanese encephalitis virus
ATRYLVKTE

SEQ ID NO: 224448 - protein, 9 aa, Japanese encephalitis virus
TRYLVKTEN

SEQ ID NO: 224449 - protein, 9 aa, Japanese encephalitis virus
RYLVKTENW

SEQ ID NO: 224450 - protein, 9 aa, Japanese encephalitis virus
YLVKTENWI

SEQ ID NO: 224451 - protein, 9 aa, Japanese encephalitis virus
LMKTENWIV

SEQ ID NO: 224452 - protein, 9 aa, Japanese encephalitis virus
TKTENWIIR

SEQ ID NO: 224453 - protein, 9 aa, Japanese encephalitis virus
NPGYAFLAG

SEQ ID NO: 224454 - protein, 9 aa, Japanese encephalitis virus
ILGWMLGSN

SEQ ID NO: 224455 - protein, 9 aa, Japanese encephalitis virus
LGWMLGSTT

SEQ ID NO: 224456 - protein, 9 aa, Japanese encephalitis virus
GWMLGSTTG

SEQ ID NO: 224457 - protein, 9 aa, Japanese encephalitis virus
GHRVVFTIL

SEQ ID NO: 224458 - protein, 9 aa, Japanese encephalitis virus
QRVVFTILP

SEQ ID NO: 224459 - protein, 9 aa, Japanese encephalitis virus
RLGFTILLL

SEQ ID NO: 224460 - protein, 9 aa, Japanese encephalitis virus
VVFTILPLL

SEQ ID NO: 224461 - protein, 9 aa, Japanese encephalitis virus
GFTILLLLV

SEQ ID NO: 224462 - protein, 9 aa, Japanese encephalitis virus
GMGNRDFIQ

SEQ ID NO: 224463 - protein, 9 aa, Japanese encephalitis virus
MGNRDFIQG

SEQ ID NO: 224464 - protein, 9 aa, Japanese encephalitis virus
GNRDFVEGA

SEQ ID NO: 224465 - protein, 9 aa, Japanese encephalitis virus
NRDFVEGAS

SEQ ID NO: 224466 - protein, 9 aa, Japanese encephalitis virus
RDFIQGASG

SEQ ID NO: 224467 - protein, 9 aa, Japanese encephalitis virus
DFVEGASGA

SEQ ID NO: 224468 - protein, 9 aa, Japanese encephalitis virus
FIEGVSGAT

SEQ ID NO: 224469 - protein, 9 aa, Japanese encephalitis virus
IERASGATW

SEQ ID NO: 224470 - protein, 9 aa, Japanese encephalitis virus
QGASGATWV

SEQ ID NO: 224471 - protein, 9 aa, Japanese encephalitis virus
RASGATWVD

SEQ ID NO: 224472 - protein, 9 aa, Japanese encephalitis virus
CLTIMANDR

SEQ ID NO: 224473 - protein, 9 aa, Japanese encephalitis virus
LTIMANDRP

SEQ ID NO: 224474 - protein, 9 aa, Japanese encephalitis virus
TIMANDRPT

SEQ ID NO: 224475 - protein, 9 aa, Japanese encephalitis virus
IMANDRPTL

SEQ ID NO: 224476 - protein, 9 aa, Japanese encephalitis virus
MANDRPTLD

SEQ ID NO: 224477 - protein, 9 aa, Japanese encephalitis virus
ANDRPTLDV

SEQ ID NO: 224478 - protein, 9 aa, Japanese encephalitis virus
NDRPTLDVR

SEQ ID NO: 224479 - protein, 9 aa, Japanese encephalitis virus
DRPTLDVRM

SEQ ID NO: 224480 - protein, 9 aa, Japanese encephalitis virus
RPTLDVRMI

SEQ ID NO: 224481 - protein, 9 aa, Japanese encephalitis virus
PTLDVRMTN

SEQ ID NO: 224482 - protein, 9 aa, Japanese encephalitis virus
TLDVRMTNI

SEQ ID NO: 224483 - protein, 9 aa, Japanese encephalitis virus
LDVRMTNIE

SEQ ID NO: 224484 - protein, 9 aa, Japanese encephalitis virus
DVRMTNIEA

SEQ ID NO: 224485 - protein, 9 aa, Japanese encephalitis virus
RRMINIEAS

SEQ ID NO: 224486 - protein, 9 aa, Japanese encephalitis virus
RMTNIEASQ

SEQ ID NO: 224487 - protein, 9 aa, Japanese encephalitis virus
MTNIEASQL

SEQ ID NO: 224488 - protein, 9 aa, Japanese encephalitis virus
TNIEASQLA

SEQ ID NO: 224489 - protein, 9 aa, Japanese encephalitis virus
AEVRSYYYH

SEQ ID NO: 224490 - protein, 9 aa, Japanese encephalitis virus
EVRSYCYRA

SEQ ID NO: 224491 - protein, 9 aa, Japanese encephalitis virus
VRSYYYHAS

SEQ ID NO: 224492 - protein, 9 aa, Japanese encephalitis virus
RSYYYHASV

SEQ ID NO: 224493 - protein, 9 aa, Japanese encephalitis virus
SYYYHASVT

SEQ ID NO: 224494 - protein, 9 aa, Japanese encephalitis virus
YCYRASVTD

SEQ ID NO: 224495 - protein, 9 aa, Japanese encephalitis virus
CYRASVTDI

SEQ ID NO: 224496 - protein, 9 aa, Japanese encephalitis virus
PTTGEAHNK

SEQ ID NO: 224497 - protein, 9 aa, Japanese encephalitis virus
TTGEAHNKK

SEQ ID NO: 224498 - protein, 9 aa, Japanese encephalitis virus
TGEAHNKKR

SEQ ID NO: 224499 - protein, 9 aa, Japanese encephalitis virus
GEAHNKKRA

SEQ ID NO: 224500 - protein, 9 aa, Japanese encephalitis virus
EAHNKKRAD

SEQ ID NO: 224501 - protein, 9 aa, Japanese encephalitis virus
AHNKKRADS

SEQ ID NO: 224502 - protein, 9 aa, Japanese encephalitis virus
HNEKGADSS

SEQ ID NO: 224503 - protein, 9 aa, Japanese encephalitis virus
NEKGADSSY

SEQ ID NO: 224504 - protein, 9 aa, Japanese encephalitis virus
EKGADSSYV

SEQ ID NO: 224505 - protein, 9 aa, Japanese encephalitis virus
KQADSSYVC

SEQ ID NO: 224506 - protein, 9 aa, Japanese encephalitis virus
QADSSYVCK

SEQ ID NO: 224507 - protein, 9 aa, Japanese encephalitis virus
GFTDRGWGK

SEQ ID NO: 224508 - protein, 9 aa, Japanese encephalitis virus
FTDRGWGKG

SEQ ID NO: 224509 - protein, 9 aa, Japanese encephalitis virus
TDRGWRNGC

SEQ ID NO: 224510 - protein, 9 aa, Japanese encephalitis virus
DRGWGKGCG

SEQ ID NO: 224511 - protein, 9 aa, Japanese encephalitis virus
RGWGKGCGL

SEQ ID NO: 224512 - protein, 9 aa, Japanese encephalitis virus
GWGNGCGLS

SEQ ID NO: 224513 - protein, 9 aa, Japanese encephalitis virus
WGKGCGLFG

SEQ ID NO: 224514 - protein, 9 aa, Japanese encephalitis virus
RNGCGLFGK

SEQ ID NO: 224515 - protein, 9 aa, Japanese encephalitis virus
KGCGLFGKG

SEQ ID NO: 224516 - protein, 9 aa, Japanese encephalitis virus
GCGLSGKGS

SEQ ID NO: 224517 - protein, 9 aa, Japanese encephalitis virus
CGLSGKGSI

SEQ ID NO: 224518 - protein, 9 aa, Japanese encephalitis virus
GLSGKGSID

SEQ ID NO: 224519 - protein, 9 aa, Japanese encephalitis virus
LSGKGSIDT

SEQ ID NO: 224520 - protein, 9 aa, Japanese encephalitis virus
TCAKFSCTN

SEQ ID NO: 224521 - protein, 9 aa, Japanese encephalitis virus
CAKFSCTNK

SEQ ID NO: 224522 - protein, 9 aa, Japanese encephalitis virus
AKFSCTNKA

SEQ ID NO: 224523 - protein, 9 aa, Japanese encephalitis virus
KFSCTSKAT

SEQ ID NO: 224524 - protein, 9 aa, Japanese encephalitis virus
FSCTNKAIG

SEQ ID NO: 224525 - protein, 9 aa, Japanese encephalitis virus
SCTNKAIGR

SEQ ID NO: 224526 - protein, 9 aa, Japanese encephalitis virus
MIQSENIKY

SEQ ID NO: 224527 - protein, 9 aa, Japanese encephalitis virus
IQSENIKYE

SEQ ID NO: 224528 - protein, 9 aa, Japanese encephalitis virus
QSENIKYEV

SEQ ID NO: 224529 - protein, 9 aa, Japanese encephalitis virus
SENIKYEVG

SEQ ID NO: 224530 - protein, 9 aa, Japanese encephalitis virus
ENSKYEVGI

SEQ ID NO: 224531 - protein, 9 aa, Japanese encephalitis virus
NSKYEVGIF

SEQ ID NO: 224532 - protein, 9 aa, Japanese encephalitis virus
SKYEVGIFV

SEQ ID NO: 224533 - protein, 9 aa, Japanese encephalitis virus
EVGIFVHGA

SEQ ID NO: 224534 - protein, 9 aa, Japanese encephalitis virus
GNYTAQIGA

SEQ ID NO: 224535 - protein, 9 aa, Japanese encephalitis virus
NYSAQVGVS

SEQ ID NO: 224536 - protein, 9 aa, Japanese encephalitis virus
YSAQVGVSQ

SEQ ID NO: 224537 - protein, 9 aa, Japanese encephalitis virus
TAQIGASQA

SEQ ID NO: 224538 - protein, 9 aa, Japanese encephalitis virus
AQVGVSQAA

SEQ ID NO: 224539 - protein, 9 aa, Japanese encephalitis virus
QVGVSQAAK

SEQ ID NO: 224540 - protein, 9 aa, Japanese encephalitis virus
VGASQAARF

SEQ ID NO: 224541 - protein, 9 aa, Japanese encephalitis virus
GVSQAAKFT

SEQ ID NO: 224542 - protein, 9 aa, Japanese encephalitis virus
TSQAAKFTV

SEQ ID NO: 224543 - protein, 9 aa, Japanese encephalitis virus
SQAARFTVT

SEQ ID NO: 224544 - protein, 9 aa, Japanese encephalitis virus
QAARFTVTP

SEQ ID NO: 224545 - protein, 9 aa, Japanese encephalitis virus
AARFTVTPN

SEQ ID NO: 224546 - protein, 9 aa, Japanese encephalitis virus
ARFTVTPNA

SEQ ID NO: 224547 - protein, 9 aa, Japanese encephalitis virus
RFTVTPNAP

SEQ ID NO: 224548 - protein, 9 aa, Japanese encephalitis virus
TITPNAPSI

SEQ ID NO: 224549 - protein, 9 aa, Japanese encephalitis virus
ITPNAPSIT

SEQ ID NO: 224550 - protein, 9 aa, Japanese encephalitis virus
TPNAPSVAL

SEQ ID NO: 224551 - protein, 9 aa, Japanese encephalitis virus
PNAPSVALK

SEQ ID NO: 224552 - protein, 9 aa, Japanese encephalitis virus
NAPSVALKL

SEQ ID NO: 224553 - protein, 9 aa, Japanese encephalitis virus
APSVALKLG

SEQ ID NO: 224554 - protein, 9 aa, Japanese encephalitis virus
PSVALKLGD

SEQ ID NO: 224555 - protein, 9 aa, Japanese encephalitis virus
TLELGDYGE

SEQ ID NO: 224556 - protein, 9 aa, Japanese encephalitis virus
LELGDYGEV

SEQ ID NO: 224557 - protein, 9 aa, Japanese encephalitis virus
KLGDFGEVT

SEQ ID NO: 224558 - protein, 9 aa, Japanese encephalitis virus
EVTLDCEAR

SEQ ID NO: 224559 - protein, 9 aa, Japanese encephalitis virus
VTLDCEPKS

SEQ ID NO: 224560 - protein, 9 aa, Japanese encephalitis virus
TLDCEPKSG

SEQ ID NO: 224561 - protein, 9 aa, Japanese encephalitis virus
LDCEARSGL

SEQ ID NO: 224562 - protein, 9 aa, Japanese encephalitis virus
DCEARSGLN

SEQ ID NO: 224563 - protein, 9 aa, Japanese encephalitis virus
CEPKSGLNT

SEQ ID NO: 224564 - protein, 9 aa, Japanese encephalitis virus
EPKSGLNTE

SEQ ID NO: 224565 - protein, 9 aa, Japanese encephalitis virus
ARSGLNTEA

SEQ ID NO: 224566 - protein, 9 aa, Japanese encephalitis virus
FYVMTVGPK

SEQ ID NO: 224567 - protein, 9 aa, Japanese encephalitis virus
YVMTVGPKS

SEQ ID NO: 224568 - protein, 9 aa, Japanese encephalitis virus
VMTVGPKSF

SEQ ID NO: 224569 - protein, 9 aa, Japanese encephalitis virus
MTVGPKSFL

SEQ ID NO: 224570 - protein, 9 aa, Japanese encephalitis virus
TVGSKSLLV

SEQ ID NO: 224571 - protein, 9 aa, Japanese encephalitis virus
VGPKSFLVH

SEQ ID NO: 224572 - protein, 9 aa, Japanese encephalitis virus
GPKSFLVHR

SEQ ID NO: 224573 - protein, 9 aa, Japanese encephalitis virus
SKSLLVHRE

SEQ ID NO: 224574 - protein, 9 aa, Japanese encephalitis virus
KSLLVHREW

SEQ ID NO: 224575 - protein, 9 aa, Japanese encephalitis virus
FHDLALPWS

SEQ ID NO: 224576 - protein, 9 aa, Japanese encephalitis virus
HDLALPWTP

SEQ ID NO: 224577 - protein, 9 aa, Japanese encephalitis virus
DLALPWTPP

SEQ ID NO: 224578 - protein, 9 aa, Japanese encephalitis virus
LALPWTPPS

SEQ ID NO: 224579 - protein, 9 aa, Japanese encephalitis virus
ALPWTPPSS

SEQ ID NO: 224580 - protein, 9 aa, Japanese encephalitis virus
LPWSSPSST

SEQ ID NO: 224581 - protein, 9 aa, Japanese encephalitis virus
PWTSSSNTA

SEQ ID NO: 224582 - protein, 9 aa, Japanese encephalitis virus
WTSSSNTAW

SEQ ID NO: 224583 - protein, 9 aa, Japanese encephalitis virus
TSSSNTAWR

SEQ ID NO: 224584 - protein, 9 aa, Japanese encephalitis virus
SSSNTAWRN

SEQ ID NO: 224585 - protein, 9 aa, Japanese encephalitis virus
RELLMEFEQ

SEQ ID NO: 224586 - protein, 9 aa, Japanese encephalitis virus
ELLMEFEQA

SEQ ID NO: 224587 - protein, 9 aa, Japanese encephalitis virus
LLMEFEQAH

SEQ ID NO: 224588 - protein, 9 aa, Japanese encephalitis virus
LMEFEQAHA

SEQ ID NO: 224589 - protein, 9 aa, Japanese encephalitis virus
MEFEQAHAT

SEQ ID NO: 224590 - protein, 9 aa, Japanese encephalitis virus
EFEQAHATK

SEQ ID NO: 224591 - protein, 9 aa, Japanese encephalitis virus
FEQAHATKQ

SEQ ID NO: 224592 - protein, 9 aa, Japanese encephalitis virus
EQAHATKQS

SEQ ID NO: 224593 - protein, 9 aa, Japanese encephalitis virus
QAHATKQSV

SEQ ID NO: 224594 - protein, 9 aa, Japanese encephalitis virus
VVALGSREG

SEQ ID NO: 224595 - protein, 9 aa, Japanese encephalitis virus
VALGSQERA

SEQ ID NO: 224596 - protein, 9 aa, Japanese encephalitis virus
ALGSQERAL

SEQ ID NO: 224597 - protein, 9 aa, Japanese encephalitis virus
LGSREGGLH

SEQ ID NO: 224598 - protein, 9 aa, Japanese encephalitis virus
GSQEGSLHQ

SEQ ID NO: 224599 - protein, 9 aa, Japanese encephalitis virus
SREGGLHQA

SEQ ID NO: 224600 - protein, 9 aa, Japanese encephalitis virus
REGGLHQAL

SEQ ID NO: 224601 - protein, 9 aa, Japanese encephalitis virus
ERALHQALA

SEQ ID NO: 224602 - protein, 9 aa, Japanese encephalitis virus
GSLHQALAG

SEQ ID NO: 224603 - protein, 9 aa, Japanese encephalitis virus
ALHQALAGA

SEQ ID NO: 224604 - protein, 9 aa, Japanese encephalitis virus
GAIVVEYSN

SEQ ID NO: 224605 - protein, 9 aa, Japanese encephalitis virus
AIVVEYSNS

SEQ ID NO: 224606 - protein, 9 aa, Japanese encephalitis virus
IVVEYSNSV

SEQ ID NO: 224607 - protein, 9 aa, Japanese encephalitis virus
VVEYPSSVK

SEQ ID NO: 224608 - protein, 9 aa, Japanese encephalitis virus
VEYSNSVKL

SEQ ID NO: 224609 - protein, 9 aa, Japanese encephalitis virus
EYPSSVKLT

SEQ ID NO: 224610 - protein, 9 aa, Japanese encephalitis virus
YPSSVKLTS

SEQ ID NO: 224611 - protein, 9 aa, Japanese encephalitis virus
SNSVKLTSG

SEQ ID NO: 224612 - protein, 9 aa, Japanese encephalitis virus
NSVKLTSGH

SEQ ID NO: 224613 - protein, 9 aa, Japanese encephalitis virus
SVKLTSGHV

SEQ ID NO: 224614 - protein, 9 aa, Japanese encephalitis virus
VKLTSGHVK

SEQ ID NO: 224615 - protein, 9 aa, Japanese encephalitis virus
KLTSGHVKR

SEQ ID NO: 224616 - protein, 9 aa, Japanese encephalitis virus
SGHLKCRLR

SEQ ID NO: 224617 - protein, 9 aa, Japanese encephalitis virus
GHLKCRLRM

SEQ ID NO: 224618 - protein, 9 aa, Japanese encephalitis virus
HVKRRLKMD

SEQ ID NO: 224619 - protein, 9 aa, Japanese encephalitis virus
LKCRLRMDK

SEQ ID NO: 224620 - protein, 9 aa, Japanese encephalitis virus
KRRLKMDKL

SEQ ID NO: 224621 - protein, 9 aa, Japanese encephalitis virus
RRLKMDKLA

SEQ ID NO: 224622 - protein, 9 aa, Japanese encephalitis virus
GTTYGMCTK

SEQ ID NO: 224623 - protein, 9 aa, Japanese encephalitis virus
TTYGMCTKK

SEQ ID NO: 224624 - protein, 9 aa, Japanese encephalitis virus
TYGMCTKKF

SEQ ID NO: 224625 - protein, 9 aa, Japanese encephalitis virus
YGMCTKKFS

SEQ ID NO: 224626 - protein, 9 aa, Japanese encephalitis virus
GMCTKKFSF

SEQ ID NO: 224627 - protein, 9 aa, Japanese encephalitis virus
MCTKKFSFA

SEQ ID NO: 224628 - protein, 9 aa, Japanese encephalitis virus
CTKKFSFAK

SEQ ID NO: 224629 - protein, 9 aa, Japanese encephalitis virus
TKKFSFAKN

SEQ ID NO: 224630 - protein, 9 aa, Japanese encephalitis virus
KKFSFAKNP

SEQ ID NO: 224631 - protein, 9 aa, Japanese encephalitis virus
NSSFRKNPA

SEQ ID NO: 224632 - protein, 9 aa, Japanese encephalitis virus
SSFRKNPAD

SEQ ID NO: 224633 - protein, 9 aa, Japanese encephalitis virus
SFRKNPADT

SEQ ID NO: 224634 - protein, 9 aa, Japanese encephalitis virus
FRKNPADTG

SEQ ID NO: 224635 - protein, 9 aa, Japanese encephalitis virus
RKNPADTGH

SEQ ID NO: 224636 - protein, 9 aa, Japanese encephalitis virus
HGTVVIELL

SEQ ID NO: 224637 - protein, 9 aa, Japanese encephalitis virus
GTVVIELLY

SEQ ID NO: 224638 - protein, 9 aa, Japanese encephalitis virus
TVVIELLYS

SEQ ID NO: 224639 - protein, 9 aa, Japanese encephalitis virus
VVIELLYSG

SEQ ID NO: 224640 - protein, 9 aa, Japanese encephalitis virus
VIELLYSGS

SEQ ID NO: 224641 - protein, 9 aa, Japanese encephalitis virus
IELLYSGSD

SEQ ID NO: 224642 - protein, 9 aa, Japanese encephalitis virus
ELSYSGRDG

SEQ ID NO: 224643 - protein, 9 aa, Japanese encephalitis virus
LLYSGSDGP

SEQ ID NO: 224644 - protein, 9 aa, Japanese encephalitis virus
SYSGSDGSC

SEQ ID NO: 224645 - protein, 9 aa, Japanese encephalitis virus
YSGSDGSCK

SEQ ID NO: 224646 - protein, 9 aa, Japanese encephalitis virus
SGSDGSCKI

SEQ ID NO: 224647 - protein, 9 aa, Japanese encephalitis virus
GSDGSCKIP

SEQ ID NO: 224648 - protein, 9 aa, Japanese encephalitis virus
RDGPCKIPI

SEQ ID NO: 224649 - protein, 9 aa, Japanese encephalitis virus
KIPIVSVAN

SEQ ID NO: 224650 - protein, 9 aa, Japanese encephalitis virus
IPIVSVANL

SEQ ID NO: 224651 - protein, 9 aa, Japanese encephalitis virus
PIVSVANLN

SEQ ID NO: 224652 - protein, 9 aa, Japanese encephalitis virus
IVSVANLND

SEQ ID NO: 224653 - protein, 9 aa, Japanese encephalitis virus
VSVANLNDM

SEQ ID NO: 224654 - protein, 9 aa, Japanese encephalitis virus
SVANLNDMT

SEQ ID NO: 224655 - protein, 9 aa, Japanese encephalitis virus
VVSLNDMTP

SEQ ID NO: 224656 - protein, 9 aa, Japanese encephalitis virus
ANLNDMTPV

SEQ ID NO: 224657 - protein, 9 aa, Japanese encephalitis virus
SLNDMTPAG

SEQ ID NO: 224658 - protein, 9 aa, Japanese encephalitis virus
LNDMTPAGR

SEQ ID NO: 224659 - protein, 9 aa, Japanese encephalitis virus
NDMTPAGRL

SEQ ID NO: 224660 - protein, 9 aa, Japanese encephalitis virus
DMTPAGRLV

SEQ ID NO: 224661 - protein, 9 aa, Japanese encephalitis virus
MTPAGRLVT

SEQ ID NO: 224662 - protein, 9 aa, Japanese encephalitis virus
NPFVAASSA

SEQ ID NO: 224663 - protein, 9 aa, Japanese encephalitis virus
PFVAASSAN

SEQ ID NO: 224664 - protein, 9 aa, Japanese encephalitis virus
FVAASSANS

SEQ ID NO: 224665 - protein, 9 aa, Japanese encephalitis virus
VAASSANSK

SEQ ID NO: 224666 - protein, 9 aa, Japanese encephalitis virus
AASSANSKV

SEQ ID NO: 224667 - protein, 9 aa, Japanese encephalitis virus
ASSANSKVL

SEQ ID NO: 224668 - protein, 9 aa, Japanese encephalitis virus
SSSNSQVLV

SEQ ID NO: 224669 - protein, 9 aa, Japanese encephalitis virus
SANSKALVE

SEQ ID NO: 224670 - protein, 9 aa, Japanese encephalitis virus
ANSKALVEM

SEQ ID NO: 224671 - protein, 9 aa, Japanese encephalitis virus
NSQVLVEME

SEQ ID NO: 224672 - protein, 9 aa, Japanese encephalitis virus
SQVLVEMEP

SEQ ID NO: 224673 - protein, 9 aa, Japanese encephalitis virus
KVLLEIEPP

SEQ ID NO: 224674 - protein, 9 aa, Japanese encephalitis virus
ALVEMEPPF

SEQ ID NO: 224675 - protein, 9 aa, Japanese encephalitis virus
GDSYIVVGM

SEQ ID NO: 224676 - protein, 9 aa, Japanese encephalitis virus
DSYIVVGRE

SEQ ID NO: 224677 - protein, 9 aa, Japanese encephalitis virus
KQISHHWHK

SEQ ID NO: 224678 - protein, 9 aa, Japanese encephalitis virus
HHWHKPGST

SEQ ID NO: 224679 - protein, 9 aa, Japanese encephalitis virus
HRHKAGSTL

SEQ ID NO: 224680 - protein, 9 aa, Japanese encephalitis virus
WYKAGSTLG

SEQ ID NO: 224681 - protein, 9 aa, Japanese encephalitis virus
YKAGSTLGK

SEQ ID NO: 224682 - protein, 9 aa, Japanese encephalitis virus
KPGSTLGKA

SEQ ID NO: 224683 - protein, 9 aa, Japanese encephalitis virus
WDFGSIGGA

SEQ ID NO: 224684 - protein, 9 aa, Japanese encephalitis virus
DFGSIGGAF

SEQ ID NO: 224685 - protein, 9 aa, Japanese encephalitis virus
FGSIGRVFN

SEQ ID NO: 224686 - protein, 9 aa, Japanese encephalitis virus
GSIGRVFNS

SEQ ID NO: 224687 - protein, 9 aa, Japanese encephalitis virus
SIGGIFNSI

SEQ ID NO: 224688 - protein, 9 aa, Japanese encephalitis virus
IGGAFNSIG

SEQ ID NO: 224689 - protein, 9 aa, Japanese encephalitis virus
GGIFNSIGK

SEQ ID NO: 224690 - protein, 9 aa, Japanese encephalitis virus
GIFNSIGKA

SEQ ID NO: 224691 - protein, 9 aa, Japanese encephalitis virus
IFNSIGKAV

SEQ ID NO: 224692 - protein, 9 aa, Japanese encephalitis virus
RAVHQVFGD

SEQ ID NO: 224693 - protein, 9 aa, Japanese encephalitis virus
GVLLLWMGI

SEQ ID NO: 224694 - protein, 9 aa, Japanese encephalitis virus
VLLLWMGIN

SEQ ID NO: 224695 - protein, 9 aa, Japanese encephalitis virus
LWMGVNARN

SEQ ID NO: 224696 - protein, 9 aa, Japanese encephalitis virus
WMGVNARNR

SEQ ID NO: 224697 - protein, 9 aa, Japanese encephalitis virus
MGVNARNRS

SEQ ID NO: 224698 - protein, 9 aa, Japanese encephalitis virus
GVNARNRSI

SEQ ID NO: 224699 - protein, 9 aa, Japanese encephalitis virus
VNARNRSIA

SEQ ID NO: 224700 - protein, 9 aa, Japanese encephalitis virus
NARNRSIAL

SEQ ID NO: 224701 - protein, 9 aa, Japanese encephalitis virus
ARDRSIAMA

SEQ ID NO: 224702 - protein, 9 aa, Japanese encephalitis virus
RDRSIAMAF

SEQ ID NO: 224703 - protein, 9 aa, Japanese encephalitis virus
DRSIAMAFL

SEQ ID NO: 224704 - protein, 9 aa, Japanese encephalitis virus
ADTGCAIDV

SEQ ID NO: 224705 - protein, 9 aa, Japanese encephalitis virus
DTGCAIDTT

SEQ ID NO: 224706 - protein, 9 aa, Japanese encephalitis virus
TGCAIDTTR

SEQ ID NO: 224707 - protein, 9 aa, Japanese encephalitis virus
ARKEMRCGS

SEQ ID NO: 224708 - protein, 9 aa, Japanese encephalitis virus
RNQMRCGSG

SEQ ID NO: 224709 - protein, 9 aa, Japanese encephalitis virus
NQMRCGSGI

SEQ ID NO: 224710 - protein, 9 aa, Japanese encephalitis virus
KYLPETPRA

SEQ ID NO: 224711 - protein, 9 aa, Japanese encephalitis virus
YLPETPRAL

SEQ ID NO: 224712 - protein, 9 aa, Japanese encephalitis virus
LPETPRALA

SEQ ID NO: 224713 - protein, 9 aa, Japanese encephalitis virus
PETPRALAK

SEQ ID NO: 224714 - protein, 9 aa, Japanese encephalitis virus
ETPKSLAKI

SEQ ID NO: 224715 - protein, 9 aa, Japanese encephalitis virus
TPKSLAKIV

SEQ ID NO: 224716 - protein, 9 aa, Japanese encephalitis virus
PRALAKIVH

SEQ ID NO: 224717 - protein, 9 aa, Japanese encephalitis virus
KSLAKIVHK

SEQ ID NO: 224718 - protein, 9 aa, Japanese encephalitis virus
AKIVHKAHM

SEQ ID NO: 224719 - protein, 9 aa, Japanese encephalitis virus
KIVHKAHME

SEQ ID NO: 224720 - protein, 9 aa, Japanese encephalitis virus
IVHKAHMEG

SEQ ID NO: 224721 - protein, 9 aa, Japanese encephalitis virus
VHKAYKEGV

SEQ ID NO: 224722 - protein, 9 aa, Japanese encephalitis virus
HKAHMEGIC

SEQ ID NO: 224723 - protein, 9 aa, Japanese encephalitis virus
KAHMEGICG

SEQ ID NO: 224724 - protein, 9 aa, Japanese encephalitis virus
AHMEGVCGV

SEQ ID NO: 224725 - protein, 9 aa, Japanese encephalitis virus
HMEGICGVR

SEQ ID NO: 224726 - protein, 9 aa, Japanese encephalitis virus
KEGVCGIRS

SEQ ID NO: 224727 - protein, 9 aa, Japanese encephalitis virus
EGICGVRSV

SEQ ID NO: 224728 - protein, 9 aa, Japanese encephalitis virus
GICGVRSVT

SEQ ID NO: 224729 - protein, 9 aa, Japanese encephalitis virus
VCGIRSVTR

SEQ ID NO: 224730 - protein, 9 aa, Japanese encephalitis virus
AVRDELNVP

SEQ ID NO: 224731 - protein, 9 aa, Japanese encephalitis virus
YRSAPKRLF

SEQ ID NO: 224732 - protein, 9 aa, Japanese encephalitis virus
RSAPKRLFM

SEQ ID NO: 224733 - protein, 9 aa, Japanese encephalitis virus
SAPKRLFMT

SEQ ID NO: 224734 - protein, 9 aa, Japanese encephalitis virus
APKRLFMTQ

SEQ ID NO: 224735 - protein, 9 aa, Japanese encephalitis virus
PKRLSMTRE

SEQ ID NO: 224736 - protein, 9 aa, Japanese encephalitis virus
KRLSMTREK

SEQ ID NO: 224737 - protein, 9 aa, Japanese encephalitis virus
RLSMTREKF

SEQ ID NO: 224738 - protein, 9 aa, Japanese encephalitis virus
LSMTREKFE

SEQ ID NO: 224739 - protein, 9 aa, Japanese encephalitis virus
SMTREKFEM

SEQ ID NO: 224740 - protein, 9 aa, Japanese encephalitis virus
MTREKFEMG

SEQ ID NO: 224741 - protein, 9 aa, Japanese encephalitis virus
TQEKVEMGW

SEQ ID NO: 224742 - protein, 9 aa, Japanese encephalitis virus
QEKVEMGWK

SEQ ID NO: 224743 - protein, 9 aa, Japanese encephalitis virus
GWKAWGKSM

SEQ ID NO: 224744 - protein, 9 aa, Japanese encephalitis virus
WKAWGKSLL

SEQ ID NO: 224745 - protein, 9 aa, Japanese encephalitis virus
KAWGKSMLF

SEQ ID NO: 224746 - protein, 9 aa, Japanese encephalitis virus
AWGKSLLFA

SEQ ID NO: 224747 - protein, 9 aa, Japanese encephalitis virus
WGKSMLFAP

SEQ ID NO: 224748 - protein, 9 aa, Japanese encephalitis virus
GKSMLFAPE

SEQ ID NO: 224749 - protein, 9 aa, Japanese encephalitis virus
KSMLFAPEL

SEQ ID NO: 224750 - protein, 9 aa, Japanese encephalitis virus
SILFAPEMA

SEQ ID NO: 224751 - protein, 9 aa, Japanese encephalitis virus
MLFAPELAN

SEQ ID NO: 224752 - protein, 9 aa, Japanese encephalitis virus
FAPELANSS

SEQ ID NO: 224753 - protein, 9 aa, Japanese encephalitis virus
APELANSSF

SEQ ID NO: 224754 - protein, 9 aa, Japanese encephalitis virus
PELANSSFV

SEQ ID NO: 224755 - protein, 9 aa, Japanese encephalitis virus
EMANSTFVV

SEQ ID NO: 224756 - protein, 9 aa, Japanese encephalitis virus
LANSSFVVD

SEQ ID NO: 224757 - protein, 9 aa, Japanese encephalitis virus
ETKECPDEQ

SEQ ID NO: 224758 - protein, 9 aa, Japanese encephalitis virus
TKECPVVHR

SEQ ID NO: 224759 - protein, 9 aa, Japanese encephalitis virus
KECPDEQRA

SEQ ID NO: 224760 - protein, 9 aa, Japanese encephalitis virus
ECPDEQRAW

SEQ ID NO: 224761 - protein, 9 aa, Japanese encephalitis virus
CPVVHRAWN

SEQ ID NO: 224762 - protein, 9 aa, Japanese encephalitis virus
PVVHRAWNS

SEQ ID NO: 224763 - protein, 9 aa, Japanese encephalitis virus
VVHRAWNSM

SEQ ID NO: 224764 - protein, 9 aa, Japanese encephalitis virus
VHRAWNSMQ

SEQ ID NO: 224765 - protein, 9 aa, Japanese encephalitis virus
RRAWNSTQI

SEQ ID NO: 224766 - protein, 9 aa, Japanese encephalitis virus
VWLKIREET

SEQ ID NO: 224767 - protein, 9 aa, Japanese encephalitis virus
WLKIREETT

SEQ ID NO: 224768 - protein, 9 aa, Japanese encephalitis virus
LKIREETTD

SEQ ID NO: 224769 - protein, 9 aa, Japanese encephalitis virus
KIREETTDE

SEQ ID NO: 224770 - protein, 9 aa, Japanese encephalitis virus
IREETTDEC

SEQ ID NO: 224771 - protein, 9 aa, Japanese encephalitis virus
REETTDECD

SEQ ID NO: 224772 - protein, 9 aa, Japanese encephalitis virus
EETTDECDG

SEQ ID NO: 224773 - protein, 9 aa, Japanese encephalitis virus
ESTDECDGP

SEQ ID NO: 224774 - protein, 9 aa, Japanese encephalitis virus
STDECDGPI

SEQ ID NO: 224775 - protein, 9 aa, Japanese encephalitis virus
TDECDGTII

SEQ ID NO: 224776 - protein, 9 aa, Japanese encephalitis virus
DECDGTIIG

SEQ ID NO: 224777 - protein, 9 aa, Japanese encephalitis virus
ECDGTIIGT

SEQ ID NO: 224778 - protein, 9 aa, Japanese encephalitis virus
CDGTIIGTA

SEQ ID NO: 224779 - protein, 9 aa, Japanese encephalitis virus
DGTIIGTAI

SEQ ID NO: 224780 - protein, 9 aa, Japanese encephalitis virus
GTIIGTAIK

SEQ ID NO: 224781 - protein, 9 aa, Japanese encephalitis virus
TIIGTAIKG

SEQ ID NO: 224782 - protein, 9 aa, Japanese encephalitis virus
IIGTAIKGH

SEQ ID NO: 224783 - protein, 9 aa, Japanese encephalitis virus
IGTAIKGHV

SEQ ID NO: 224784 - protein, 9 aa, Japanese encephalitis virus
GTAVKGHVT

SEQ ID NO: 224785 - protein, 9 aa, Japanese encephalitis virus
TAVKGHVAL

SEQ ID NO: 224786 - protein, 9 aa, Japanese encephalitis virus
AIKGHVAVH

SEQ ID NO: 224787 - protein, 9 aa, Japanese encephalitis virus
IKGHVAVHS

SEQ ID NO: 224788 - protein, 9 aa, Japanese encephalitis virus
KGHVTVHSD

SEQ ID NO: 224789 - protein, 9 aa, Japanese encephalitis virus
GHVALHSDL

SEQ ID NO: 224790 - protein, 9 aa, Japanese encephalitis virus
HVTVHSDVS

SEQ ID NO: 224791 - protein, 9 aa, Japanese encephalitis virus
VALHSDLSY

SEQ ID NO: 224792 - protein, 9 aa, Japanese encephalitis virus
TVHSDVSYW

SEQ ID NO: 224793 - protein, 9 aa, Japanese encephalitis virus
LHSDLSYWI

SEQ ID NO: 224794 - protein, 9 aa, Japanese encephalitis virus
HSDVSYWIE

SEQ ID NO: 224795 - protein, 9 aa, Japanese encephalitis virus
SDLSYWIGS

SEQ ID NO: 224796 - protein, 9 aa, Japanese encephalitis virus
DLSYWIGSR

SEQ ID NO: 224797 - protein, 9 aa, Japanese encephalitis virus
SYWIESRFN

SEQ ID NO: 224798 - protein, 9 aa, Japanese encephalitis virus
YWIESRFND

SEQ ID NO: 224799 - protein, 9 aa, Japanese encephalitis virus
NDSWKLERA

SEQ ID NO: 224800 - protein, 9 aa, Japanese encephalitis virus
DTWKLERLV

SEQ ID NO: 224801 - protein, 9 aa, Japanese encephalitis virus
TRKLERAVF

SEQ ID NO: 224802 - protein, 9 aa, Japanese encephalitis virus
WKLERLVFG

SEQ ID NO: 224803 - protein, 9 aa, Japanese encephalitis virus
KLERLVFGE

SEQ ID NO: 224804 - protein, 9 aa, Japanese encephalitis virus
RERAVFEEV

SEQ ID NO: 224805 - protein, 9 aa, Japanese encephalitis virus
ERLVFGEVK

SEQ ID NO: 224806 - protein, 9 aa, Japanese encephalitis virus
RLVFGEVKS

SEQ ID NO: 224807 - protein, 9 aa, Japanese encephalitis virus
LVFGEVKSC

SEQ ID NO: 224808 - protein, 9 aa, Japanese encephalitis virus
VFEEVKSCT

SEQ ID NO: 224809 - protein, 9 aa, Japanese encephalitis virus
FEEVKSCTW

SEQ ID NO: 224810 - protein, 9 aa, Japanese encephalitis virus
EEVKSCTWP

SEQ ID NO: 224811 - protein, 9 aa, Japanese encephalitis virus
ETHSLWGDG

SEQ ID NO: 224812 - protein, 9 aa, Japanese encephalitis virus
THSLWGDGV

SEQ ID NO: 224813 - protein, 9 aa, Japanese encephalitis virus
HSLWGDGVE

SEQ ID NO: 224814 - protein, 9 aa, Japanese encephalitis virus
SLWGDGVEE

SEQ ID NO: 224815 - protein, 9 aa, Japanese encephalitis virus
LWGDDAEES

SEQ ID NO: 224816 - protein, 9 aa, Japanese encephalitis virus
WGDGVEESD

SEQ ID NO: 224817 - protein, 9 aa, Japanese encephalitis virus
GDDAEESEL

SEQ ID NO: 224818 - protein, 9 aa, Japanese encephalitis virus
DDAEESELI

SEQ ID NO: 224819 - protein, 9 aa, Japanese encephalitis virus
GVEESDLVI

SEQ ID NO: 224820 - protein, 9 aa, Japanese encephalitis virus
AEESELIIP

SEQ ID NO: 224821 - protein, 9 aa, Japanese encephalitis virus
EESDLVIPH

SEQ ID NO: 224822 - protein, 9 aa, Japanese encephalitis virus
ESELIIPDT

SEQ ID NO: 224823 - protein, 9 aa, Japanese encephalitis virus
SELIIPDTI

SEQ ID NO: 224824 - protein, 9 aa, Japanese encephalitis virus
DLVIPHTIA

SEQ ID NO: 224825 - protein, 9 aa, Japanese encephalitis virus
LVIPHTIAG

SEQ ID NO: 224826 - protein, 9 aa, Japanese encephalitis virus
VIPHTIAGP

SEQ ID NO: 224827 - protein, 9 aa, Japanese encephalitis virus
IPHTLAGPK

SEQ ID NO: 224828 - protein, 9 aa, Japanese encephalitis virus
PHTLAGPKS

SEQ ID NO: 224829 - protein, 9 aa, Japanese encephalitis virus
HTLAGPKSK

SEQ ID NO: 224830 - protein, 9 aa, Japanese encephalitis virus
TLAGPKSKH

SEQ ID NO: 224831 - protein, 9 aa, Japanese encephalitis virus
LAGPKSKHN

SEQ ID NO: 224832 - protein, 9 aa, Japanese encephalitis virus
AGPKSKHNQ

SEQ ID NO: 224833 - protein, 9 aa, Japanese encephalitis virus
GPKSKHNQR

SEQ ID NO: 224834 - protein, 9 aa, Japanese encephalitis virus
PKSKHNQRE

SEQ ID NO: 224835 - protein, 9 aa, Japanese encephalitis virus
KSKHNQREG

SEQ ID NO: 224836 - protein, 9 aa, Japanese encephalitis virus
KHNQREGYK

SEQ ID NO: 224837 - protein, 9 aa, Japanese encephalitis virus
HNQREGYKT

SEQ ID NO: 224838 - protein, 9 aa, Japanese encephalitis virus
NRREGYMTQ

SEQ ID NO: 224839 - protein, 9 aa, Japanese encephalitis virus
QREGYKTQN

SEQ ID NO: 224840 - protein, 9 aa, Japanese encephalitis virus
REGYMTQNQ

SEQ ID NO: 224841 - protein, 9 aa, Japanese encephalitis virus
EGYMTQNQG

SEQ ID NO: 224842 - protein, 9 aa, Japanese encephalitis virus
GYMTQNQGP

SEQ ID NO: 224843 - protein, 9 aa, Japanese encephalitis virus
YMTQNQGPW

SEQ ID NO: 224844 - protein, 9 aa, Japanese encephalitis virus
MTQNQGPWD

SEQ ID NO: 224845 - protein, 9 aa, Japanese encephalitis virus
QNQGPWDES

SEQ ID NO: 224846 - protein, 9 aa, Japanese encephalitis virus
NQGPWDEKG

SEQ ID NO: 224847 - protein, 9 aa, Japanese encephalitis virus
QGPWDEDGI

SEQ ID NO: 224848 - protein, 9 aa, Japanese encephalitis virus
GPWDEDGIV

SEQ ID NO: 224849 - protein, 9 aa, Japanese encephalitis virus
PWDESGIVL

SEQ ID NO: 224850 - protein, 9 aa, Japanese encephalitis virus
WDEDGIVLD

SEQ ID NO: 224851 - protein, 9 aa, Japanese encephalitis virus
DESGIVLDF

SEQ ID NO: 224852 - protein, 9 aa, Japanese encephalitis virus
ENGLVPGLD

SEQ ID NO: 224853 - protein, 9 aa, Japanese encephalitis virus
KGIVLDFDY

SEQ ID NO: 224854 - protein, 9 aa, Japanese encephalitis virus
GLDYCPGTK

SEQ ID NO: 224855 - protein, 9 aa, Japanese encephalitis virus
FDYCPGTTV

SEQ ID NO: 224856 - protein, 9 aa, Japanese encephalitis virus
TVTITEDCG

SEQ ID NO: 224857 - protein, 9 aa, Japanese encephalitis virus
ITEDCGKRA

SEQ ID NO: 224858 - protein, 9 aa, Japanese encephalitis virus
TEDCGKRAP

SEQ ID NO: 224859 - protein, 9 aa, Japanese encephalitis virus
EDCGKRAPW

SEQ ID NO: 224860 - protein, 9 aa, Japanese encephalitis virus
DCSKRGPSV

SEQ ID NO: 224861 - protein, 9 aa, Japanese encephalitis virus
CSKRGPSVR

SEQ ID NO: 224862 - protein, 9 aa, Japanese encephalitis virus
SKRGPSVRT

SEQ ID NO: 224863 - protein, 9 aa, Japanese encephalitis virus
KRGPSLRTT

SEQ ID NO: 224864 - protein, 9 aa, Japanese encephalitis virus
RGPSLRTTT

SEQ ID NO: 224865 - protein, 9 aa, Japanese encephalitis virus
GPSLRTTTD

SEQ ID NO: 224866 - protein, 9 aa, Japanese encephalitis virus
PSLRTTTDS

SEQ ID NO: 224867 - protein, 9 aa, Japanese encephalitis virus
SLRTTTDSG

SEQ ID NO: 224868 - protein, 9 aa, Japanese encephalitis virus
LRTTTDSGK

SEQ ID NO: 224869 - protein, 9 aa, Japanese encephalitis virus
TDWCCRSCT

SEQ ID NO: 224870 - protein, 9 aa, Japanese encephalitis virus
DWCCRNCSL

SEQ ID NO: 224871 - protein, 9 aa, Japanese encephalitis virus
WCCRNCSLP

SEQ ID NO: 224872 - protein, 9 aa, Japanese encephalitis virus
CCRSCTLPP

SEQ ID NO: 224873 - protein, 9 aa, Japanese encephalitis virus
CRNCSLPPL

SEQ ID NO: 224874 - protein, 9 aa, Japanese encephalitis virus
RSCTLPPLR

SEQ ID NO: 224875 - protein, 9 aa, Japanese encephalitis virus
NCSLPPLRF

SEQ ID NO: 224876 - protein, 9 aa, Japanese encephalitis virus
CTLPPLRFR

SEQ ID NO: 224877 - protein, 9 aa, Japanese encephalitis virus
TLPPLRFRT

SEQ ID NO: 224878 - protein, 9 aa, Japanese encephalitis virus
LPPLRFRTG

SEQ ID NO: 224879 - protein, 9 aa, Japanese encephalitis virus
PPLRFRTGS

SEQ ID NO: 224880 - protein, 9 aa, Japanese encephalitis virus
PLRFRTGSG

SEQ ID NO: 224881 - protein, 9 aa, Japanese encephalitis virus
LRFRTDNGC

SEQ ID NO: 224882 - protein, 9 aa, Japanese encephalitis virus
RFRTDNGCW

SEQ ID NO: 224883 - protein, 9 aa, Japanese encephalitis virus
FRTDNGCWY

SEQ ID NO: 224884 - protein, 9 aa, Japanese encephalitis virus
RTDNGCWYG

SEQ ID NO: 224885 - protein, 9 aa, Japanese encephalitis virus
TGSGCWYGM

SEQ ID NO: 224886 - protein, 9 aa, Japanese encephalitis virus
DNGCWYGME

SEQ ID NO: 224887 - protein, 9 aa, Japanese encephalitis virus
WYGMEIRPA

SEQ ID NO: 224888 - protein, 9 aa, Japanese encephalitis virus
MHDETTLVR

SEQ ID NO: 224889 - protein, 9 aa, Japanese encephalitis virus
HDETTLVRW

SEQ ID NO: 224890 - protein, 9 aa, Japanese encephalitis virus
DETTLVRSR

SEQ ID NO: 224891 - protein, 9 aa, Japanese encephalitis virus
ETTLVRWQV

SEQ ID NO: 224892 - protein, 9 aa, Japanese encephalitis virus
TLVRSQADA

SEQ ID NO: 224893 - protein, 9 aa, Japanese encephalitis virus
KGEMVDPFQ

SEQ ID NO: 224894 - protein, 9 aa, Japanese encephalitis virus
GGMVDPFQL

SEQ ID NO: 224895 - protein, 9 aa, Japanese encephalitis virus
GMVDPFQLG

SEQ ID NO: 224896 - protein, 9 aa, Japanese encephalitis virus
MVDPFQMGL

SEQ ID NO: 224897 - protein, 9 aa, Japanese encephalitis virus
VDPFQMGLL

SEQ ID NO: 224898 - protein, 9 aa, Japanese encephalitis virus
PFQMGLLVM

SEQ ID NO: 224899 - protein, 9 aa, Japanese encephalitis virus
FQMGLLVMF

SEQ ID NO: 224900 - protein, 9 aa, Japanese encephalitis virus
QMGLLVMFL

SEQ ID NO: 224901 - protein, 9 aa, Japanese encephalitis virus
MGLLVMFLA

SEQ ID NO: 224902 - protein, 9 aa, Japanese encephalitis virus
MFLATQEVF

SEQ ID NO: 224903 - protein, 9 aa, Japanese encephalitis virus
FLATQEVFR

SEQ ID NO: 224904 - protein, 9 aa, Japanese encephalitis virus
LATQEVFRK

SEQ ID NO: 224905 - protein, 9 aa, Japanese encephalitis virus
ATQEVLGKR

SEQ ID NO: 224906 - protein, 9 aa, Japanese encephalitis virus
TQEVLGKRW

SEQ ID NO: 224907 - protein, 9 aa, Japanese encephalitis virus
QEVFRKRWT

SEQ ID NO: 224908 - protein, 9 aa, Japanese encephalitis virus
EVLGKRWTA

SEQ ID NO: 224909 - protein, 9 aa, Japanese encephalitis virus
VLGKRWTAR

SEQ ID NO: 224910 - protein, 9 aa, Japanese encephalitis virus
LGKRWTARL

SEQ ID NO: 224911 - protein, 9 aa, Japanese encephalitis virus
LTVPAVLGA

SEQ ID NO: 224912 - protein, 9 aa, Japanese encephalitis virus
TVPAVLGAL

SEQ ID NO: 224913 - protein, 9 aa, Japanese encephalitis virus
VPAVLGALL

SEQ ID NO: 224914 - protein, 9 aa, Japanese encephalitis virus
LGALLVLMF

SEQ ID NO: 224915 - protein, 9 aa, Japanese encephalitis virus
GALLVLMFG

SEQ ID NO: 224916 - protein, 9 aa, Japanese encephalitis virus
ALLVLMFGG

SEQ ID NO: 224917 - protein, 9 aa, Japanese encephalitis virus
LMFGGITYT

SEQ ID NO: 224918 - protein, 9 aa, Japanese encephalitis virus
MFGGITYTD

SEQ ID NO: 224919 - protein, 9 aa, Japanese encephalitis virus
FGGITYTDL

SEQ ID NO: 224920 - protein, 9 aa, Japanese encephalitis virus
RYVVLVAAS

SEQ ID NO: 224921 - protein, 9 aa, Japanese encephalitis virus
YVVLVAAVF

SEQ ID NO: 224922 - protein, 9 aa, Japanese encephalitis virus
VVLVAAVFA

SEQ ID NO: 224923 - protein, 9 aa, Japanese encephalitis virus
VLVAASFAE

SEQ ID NO: 224924 - protein, 9 aa, Japanese encephalitis virus
LVAASFAEA

SEQ ID NO: 224925 - protein, 9 aa, Japanese encephalitis virus
VAASFAEAN

SEQ ID NO: 224926 - protein, 9 aa, Japanese encephalitis virus
AASFAEANS

SEQ ID NO: 224927 - protein, 9 aa, Japanese encephalitis virus
ASFAEANSG

SEQ ID NO: 224928 - protein, 9 aa, Japanese encephalitis virus
SFAEANSGG

SEQ ID NO: 224929 - protein, 9 aa, Japanese encephalitis virus
KIQPAFLVA

SEQ ID NO: 224930 - protein, 9 aa, Japanese encephalitis virus
IQPAFLVAN

SEQ ID NO: 224931 - protein, 9 aa, Japanese encephalitis virus
QPAFLAMNT

SEQ ID NO: 224932 - protein, 9 aa, Japanese encephalitis virus
PAFLAMKML

SEQ ID NO: 224933 - protein, 9 aa, Japanese encephalitis virus
AFLAMNTLS

SEQ ID NO: 224934 - protein, 9 aa, Japanese encephalitis virus
FLVANMLST

SEQ ID NO: 224935 - protein, 9 aa, Japanese encephalitis virus
NMLSAKWTN

SEQ ID NO: 224936 - protein, 9 aa, Japanese encephalitis virus
TLSTRWTNQ

SEQ ID NO: 224937 - protein, 9 aa, Japanese encephalitis virus
LSAKWTNQE

SEQ ID NO: 224938 - protein, 9 aa, Japanese encephalitis virus
SAKWTNQEN

SEQ ID NO: 224939 - protein, 9 aa, Japanese encephalitis virus
AKWTNQENM

SEQ ID NO: 224940 - protein, 9 aa, Japanese encephalitis virus
RWTNQENVI

SEQ ID NO: 224941 - protein, 9 aa, Japanese encephalitis virus
WTNQENMVL

SEQ ID NO: 224942 - protein, 9 aa, Japanese encephalitis virus
TNQENMVLV

SEQ ID NO: 224943 - protein, 9 aa, Japanese encephalitis virus
NQENVILVL

SEQ ID NO: 224944 - protein, 9 aa, Japanese encephalitis virus
QENVILVLG

SEQ ID NO: 224945 - protein, 9 aa, Japanese encephalitis virus
ENVILVLGA

SEQ ID NO: 224946 - protein, 9 aa, Japanese encephalitis virus
NMVLVLGAA

SEQ ID NO: 224947 - protein, 9 aa, Japanese encephalitis virus
VVLVLGAAL

SEQ ID NO: 224948 - protein, 9 aa, Japanese encephalitis virus
VLVLGAALF

SEQ ID NO: 224949 - protein, 9 aa, Japanese encephalitis virus
AALFQLASV

SEQ ID NO: 224950 - protein, 9 aa, Japanese encephalitis virus
ALFQLASVD

SEQ ID NO: 224951 - protein, 9 aa, Japanese encephalitis virus
LFQLASVDL

SEQ ID NO: 224952 - protein, 9 aa, Japanese encephalitis virus
FQLASMDLQ

SEQ ID NO: 224953 - protein, 9 aa, Japanese encephalitis virus
QLASMDLQI

SEQ ID NO: 224954 - protein, 9 aa, Japanese encephalitis virus
LASMDLQIG

SEQ ID NO: 224955 - protein, 9 aa, Japanese encephalitis virus
ASMDLQIGV

SEQ ID NO: 224956 - protein, 9 aa, Japanese encephalitis virus
SMDLQIGVH

SEQ ID NO: 224957 - protein, 9 aa, Japanese encephalitis virus
MDLQIGVHG

SEQ ID NO: 224958 - protein, 9 aa, Japanese encephalitis virus
HGILNAAAM

SEQ ID NO: 224959 - protein, 9 aa, Japanese encephalitis virus
GILNAAAMA

SEQ ID NO: 224960 - protein, 9 aa, Japanese encephalitis virus
MLNAAAIAW

SEQ ID NO: 224961 - protein, 9 aa, Japanese encephalitis virus
AAAMAWMIV

SEQ ID NO: 224962 - protein, 9 aa, Japanese encephalitis virus
AAIAWMIIK

SEQ ID NO: 224963 - protein, 9 aa, Japanese encephalitis virus
AMAWMIVRA

SEQ ID NO: 224964 - protein, 9 aa, Japanese encephalitis virus
IAWMIIKAI

SEQ ID NO: 224965 - protein, 9 aa, Japanese encephalitis virus
IKAITFPTT

SEQ ID NO: 224966 - protein, 9 aa, Japanese encephalitis virus
KAITFPTTS

SEQ ID NO: 224967 - protein, 9 aa, Japanese encephalitis virus
AITFPTASS

SEQ ID NO: 224968 - protein, 9 aa, Japanese encephalitis virus
ITFPTASSV

SEQ ID NO: 224969 - protein, 9 aa, Japanese encephalitis virus
TFPTASSVT

SEQ ID NO: 224970 - protein, 9 aa, Japanese encephalitis virus
FPTASSVTM

SEQ ID NO: 224971 - protein, 9 aa, Japanese encephalitis virus
PTASSVTMP

SEQ ID NO: 224972 - protein, 9 aa, Japanese encephalitis virus
MPLLALLAP

SEQ ID NO: 224973 - protein, 9 aa, Japanese encephalitis virus
PLLALLAPG

SEQ ID NO: 224974 - protein, 9 aa, Japanese encephalitis virus
LLALLAPGM

SEQ ID NO: 224975 - protein, 9 aa, Japanese encephalitis virus
LALLTPGMK

SEQ ID NO: 224976 - protein, 9 aa, Japanese encephalitis virus
ALLAPGMRA

SEQ ID NO: 224977 - protein, 9 aa, Japanese encephalitis virus
LLAPGMRAL

SEQ ID NO: 224978 - protein, 9 aa, Japanese encephalitis virus
LAPGMRALY

SEQ ID NO: 224979 - protein, 9 aa, Japanese encephalitis virus
TPGMKALYL

SEQ ID NO: 224980 - protein, 9 aa, Japanese encephalitis virus
PGMKALYLD

SEQ ID NO: 224981 - protein, 9 aa, Japanese encephalitis virus
GMRALCLDT

SEQ ID NO: 224982 - protein, 9 aa, Japanese encephalitis virus
MRALCLDTY

SEQ ID NO: 224983 - protein, 9 aa, Japanese encephalitis virus
KALYLDTYR

SEQ ID NO: 224984 - protein, 9 aa, Japanese encephalitis virus
ALCLDTYRI

SEQ ID NO: 224985 - protein, 9 aa, Japanese encephalitis virus
FDLDTYRII

SEQ ID NO: 224986 - protein, 9 aa, Japanese encephalitis virus
DLDTYRIIL

SEQ ID NO: 224987 - protein, 9 aa, Japanese encephalitis virus
RIILLIIGV

SEQ ID NO: 224988 - protein, 9 aa, Japanese encephalitis virus
IILLIIGVC

SEQ ID NO: 224989 - protein, 9 aa, Japanese encephalitis virus
ILLIIGVCS

SEQ ID NO: 224990 - protein, 9 aa, Japanese encephalitis virus
LLIIGVCSL

SEQ ID NO: 224991 - protein, 9 aa, Japanese encephalitis virus
LIIGVCSLL

SEQ ID NO: 224992 - protein, 9 aa, Japanese encephalitis virus
VIGVCSLLQ

SEQ ID NO: 224993 - protein, 9 aa, Japanese encephalitis virus
IGVCSLLQE

SEQ ID NO: 224994 - protein, 9 aa, Japanese encephalitis virus
GVCSLLQER

SEQ ID NO: 224995 - protein, 9 aa, Japanese encephalitis virus
ERKKAMAKK

SEQ ID NO: 224996 - protein, 9 aa, Japanese encephalitis virus
RKKAMAKKK

SEQ ID NO: 224997 - protein, 9 aa, Japanese encephalitis virus
KKAMAKKKG

SEQ ID NO: 224998 - protein, 9 aa, Japanese encephalitis virus
RTMAKKKGA

SEQ ID NO: 224999 - protein, 9 aa, Japanese encephalitis virus
TTIAAGLMA

SEQ ID NO: 225000 - protein, 9 aa, Japanese encephalitis virus
TIAAGLMAC

SEQ ID NO: 225001 - protein, 9 aa, Japanese encephalitis virus
IAAGLMACN

SEQ ID NO: 225002 - protein, 9 aa, Japanese encephalitis virus
AAGLMACNP

SEQ ID NO: 225003 - protein, 9 aa, Japanese encephalitis virus
PATEVLSAV

SEQ ID NO: 225004 - protein, 9 aa, Japanese encephalitis virus
ATEVLSAVG

SEQ ID NO: 225005 - protein, 9 aa, Japanese encephalitis virus
TEVLSAVGL

SEQ ID NO: 225006 - protein, 9 aa, Japanese encephalitis virus
EVLSAVGLM

SEQ ID NO: 225007 - protein, 9 aa, Japanese encephalitis virus
VLSAVGLMF

SEQ ID NO: 225008 - protein, 9 aa, Japanese encephalitis virus
KATDMWLEQ

SEQ ID NO: 225009 - protein, 9 aa, Japanese encephalitis virus
ATDMWLEQA

SEQ ID NO: 225010 - protein, 9 aa, Japanese encephalitis virus
TDMWLEQAA

SEQ ID NO: 225011 - protein, 9 aa, Japanese encephalitis virus
DMWLEQAAD

SEQ ID NO: 225012 - protein, 9 aa, Japanese encephalitis virus
MWLERAADV

SEQ ID NO: 225013 - protein, 9 aa, Japanese encephalitis virus
WLEQAADIS

SEQ ID NO: 225014 - protein, 9 aa, Japanese encephalitis virus
LERAADVSW

SEQ ID NO: 225015 - protein, 9 aa, Japanese encephalitis virus
QAADISWEM

SEQ ID NO: 225016 - protein, 9 aa, Japanese encephalitis virus
SWDMGAAIT

SEQ ID NO: 225017 - protein, 9 aa, Japanese encephalitis virus
WDMGAAITG

SEQ ID NO: 225018 - protein, 9 aa, Japanese encephalitis virus
DMGAAITGS

SEQ ID NO: 225019 - protein, 9 aa, Japanese encephalitis virus
MGAAITGSS

SEQ ID NO: 225020 - protein, 9 aa, Japanese encephalitis virus
GAAITGSSR

SEQ ID NO: 225021 - protein, 9 aa, Japanese encephalitis virus
LDDDGDFHF

SEQ ID NO: 225022 - protein, 9 aa, Japanese encephalitis virus
DDDGDFHFI

SEQ ID NO: 225023 - protein, 9 aa, Japanese encephalitis virus
DDGDFHFID

SEQ ID NO: 225024 - protein, 9 aa, Japanese encephalitis virus
DGDFHLIDV

SEQ ID NO: 225025 - protein, 9 aa, Japanese encephalitis virus
GDFHLIDVP

SEQ ID NO: 225026 - protein, 9 aa, Japanese encephalitis virus
DFHFIDDPG

SEQ ID NO: 225027 - protein, 9 aa, Japanese encephalitis virus
FHLIDVPGV

SEQ ID NO: 225028 - protein, 9 aa, Japanese encephalitis virus
HFIDDPGVP

SEQ ID NO: 225029 - protein, 9 aa, Japanese encephalitis virus
FIDDPGVPW

SEQ ID NO: 225030 - protein, 9 aa, Japanese encephalitis virus
DVPGVPWKV

SEQ ID NO: 225031 - protein, 9 aa, Japanese encephalitis virus
DPGVPWKIW

SEQ ID NO: 225032 - protein, 9 aa, Japanese encephalitis virus
PGVPWKIWL

SEQ ID NO: 225033 - protein, 9 aa, Japanese encephalitis virus
GVPWKIWLL

SEQ ID NO: 225034 - protein, 9 aa, Japanese encephalitis virus
VPWKIWLLR

SEQ ID NO: 225035 - protein, 9 aa, Japanese encephalitis virus
PWKVWVLRT

SEQ ID NO: 225036 - protein, 9 aa, Japanese encephalitis virus
WKVWVLRTS

SEQ ID NO: 225037 - protein, 9 aa, Japanese encephalitis virus
KIWLLRMSC

SEQ ID NO: 225038 - protein, 9 aa, Japanese encephalitis virus
IWLLRMSCI

SEQ ID NO: 225039 - protein, 9 aa, Japanese encephalitis virus
WVLRMSCSG

SEQ ID NO: 225040 - protein, 9 aa, Japanese encephalitis virus
VLRMSCSGL

SEQ ID NO: 225041 - protein, 9 aa, Japanese encephalitis virus
LRMSCICLA

SEQ ID NO: 225042 - protein, 9 aa, Japanese encephalitis virus
RTSCIGLAA

SEQ ID NO: 225043 - protein, 9 aa, Japanese encephalitis virus
TSCIGLAAL

SEQ ID NO: 225044 - protein, 9 aa, Japanese encephalitis virus
SCICLAALT

SEQ ID NO: 225045 - protein, 9 aa, Japanese encephalitis virus
CICLAALTP

SEQ ID NO: 225046 - protein, 9 aa, Japanese encephalitis virus
IGLVALTPW

SEQ ID NO: 225047 - protein, 9 aa, Japanese encephalitis virus
GLVALTPWA

SEQ ID NO: 225048 - protein, 9 aa, Japanese encephalitis virus
DTPSPKPCA

SEQ ID NO: 225049 - protein, 9 aa, Japanese encephalitis virus
TPSPKPCAK

SEQ ID NO: 225050 - protein, 9 aa, Japanese encephalitis virus
PSPKPCAKG

SEQ ID NO: 225051 - protein, 9 aa, Japanese encephalitis virus
SPKPCAKGD

SEQ ID NO: 225052 - protein, 9 aa, Japanese encephalitis virus
PKPCAKGDT

SEQ ID NO: 225053 - protein, 9 aa, Japanese encephalitis virus
KPCAKGDTT

SEQ ID NO: 225054 - protein, 9 aa, Japanese encephalitis virus
PCAKGDTTT

SEQ ID NO: 225055 - protein, 9 aa, Japanese encephalitis virus
CAKGDTTTG

SEQ ID NO: 225056 - protein, 9 aa, Japanese encephalitis virus
AKGDTTTGV

SEQ ID NO: 225057 - protein, 9 aa, Japanese encephalitis virus
YRIMACGIL

SEQ ID NO: 225058 - protein, 9 aa, Japanese encephalitis virus
RIMACGILG

SEQ ID NO: 225059 - protein, 9 aa, Japanese encephalitis virus
IMACGILGT

SEQ ID NO: 225060 - protein, 9 aa, Japanese encephalitis virus
MARGIFGTH

SEQ ID NO: 225061 - protein, 9 aa, Japanese encephalitis virus
ACGILGTYQ

SEQ ID NO: 225062 - protein, 9 aa, Japanese encephalitis virus
CGILGTYQS

SEQ ID NO: 225063 - protein, 9 aa, Japanese encephalitis virus
GIFGTHQAG

SEQ ID NO: 225064 - protein, 9 aa, Japanese encephalitis virus
IFGTHQAGV

SEQ ID NO: 225065 - protein, 9 aa, Japanese encephalitis virus
FGTHQAGVG

SEQ ID NO: 225066 - protein, 9 aa, Japanese encephalitis virus
GTHQAGVGV

SEQ ID NO: 225067 - protein, 9 aa, Japanese encephalitis virus
TYQSGVGVI

SEQ ID NO: 225068 - protein, 9 aa, Japanese encephalitis virus
HQAGVGVMY

SEQ ID NO: 225069 - protein, 9 aa, Japanese encephalitis virus
QSGVGVIYE

SEQ ID NO: 225070 - protein, 9 aa, Japanese encephalitis virus
AGVGVMYES

SEQ ID NO: 225071 - protein, 9 aa, Japanese encephalitis virus
GVGVIYENV

SEQ ID NO: 225072 - protein, 9 aa, Japanese encephalitis virus
VGVMYENVL

SEQ ID NO: 225073 - protein, 9 aa, Japanese encephalitis virus
GVIYENVFH

SEQ ID NO: 225074 - protein, 9 aa, Japanese encephalitis virus
VMYESVFHT

SEQ ID NO: 225075 - protein, 9 aa, Japanese encephalitis virus
MYENVLHTL

SEQ ID NO: 225076 - protein, 9 aa, Japanese encephalitis virus
YENVLHTLW

SEQ ID NO: 225077 - protein, 9 aa, Japanese encephalitis virus
QNVFHTLWH

SEQ ID NO: 225078 - protein, 9 aa, Japanese encephalitis virus
NVFHTLWHP

SEQ ID NO: 225079 - protein, 9 aa, Japanese encephalitis virus
VFHTLWHPT

SEQ ID NO: 225080 - protein, 9 aa, Japanese encephalitis virus
FHTLWHPTR

SEQ ID NO: 225081 - protein, 9 aa, Japanese encephalitis virus
WHPTRGAAI

SEQ ID NO: 225082 - protein, 9 aa, Japanese encephalitis virus
HTTRGAAVM

SEQ ID NO: 225083 - protein, 9 aa, Japanese encephalitis virus
TTRGAAVMS

SEQ ID NO: 225084 - protein, 9 aa, Japanese encephalitis virus
TRGAAVMSG

SEQ ID NO: 225085 - protein, 9 aa, Japanese encephalitis virus
RGAAVMSGE

SEQ ID NO: 225086 - protein, 9 aa, Japanese encephalitis virus
GAAVMSGEG

SEQ ID NO: 225087 - protein, 9 aa, Japanese encephalitis virus
AAVMSGEGK

SEQ ID NO: 225088 - protein, 9 aa, Japanese encephalitis virus
AVMSGEGKL

SEQ ID NO: 225089 - protein, 9 aa, Japanese encephalitis virus
VMSGEGKLT

SEQ ID NO: 225090 - protein, 9 aa, Japanese encephalitis virus
MSGGGKLTP

SEQ ID NO: 225091 - protein, 9 aa, Japanese encephalitis virus
SGKGKLTPY

SEQ ID NO: 225092 - protein, 9 aa, Japanese encephalitis virus
GKGKLTPYW

SEQ ID NO: 225093 - protein, 9 aa, Japanese encephalitis virus
GGKLTPYWG

SEQ ID NO: 225094 - protein, 9 aa, Japanese encephalitis virus
GSVREDRIA

SEQ ID NO: 225095 - protein, 9 aa, Japanese encephalitis virus
SVREDRIAY

SEQ ID NO: 225096 - protein, 9 aa, Japanese encephalitis virus
VREDRIAYG

SEQ ID NO: 225097 - protein, 9 aa, Japanese encephalitis virus
REDRIAYGG

SEQ ID NO: 225098 - protein, 9 aa, Japanese encephalitis virus
VIVVEPGKG

SEQ ID NO: 225099 - protein, 9 aa, Japanese encephalitis virus
IVVEPGKGA

SEQ ID NO: 225100 - protein, 9 aa, Japanese encephalitis virus
AANIQTKPG

SEQ ID NO: 225101 - protein, 9 aa, Japanese encephalitis virus
NFQTKPGVF

SEQ ID NO: 225102 - protein, 9 aa, Japanese encephalitis virus
IQTKPGVFC

SEQ ID NO: 225103 - protein, 9 aa, Japanese encephalitis virus
QTKPGIFPT

SEQ ID NO: 225104 - protein, 9 aa, Japanese encephalitis virus
TKPGVFCTP

SEQ ID NO: 225105 - protein, 9 aa, Japanese encephalitis virus
KPGVFCTPF

SEQ ID NO: 225106 - protein, 9 aa, Japanese encephalitis virus
PGVFCTPFG

SEQ ID NO: 225107 - protein, 9 aa, Japanese encephalitis virus
PLGEVGAVS

SEQ ID NO: 225108 - protein, 9 aa, Japanese encephalitis virus
FGKVGAVSL

SEQ ID NO: 225109 - protein, 9 aa, Japanese encephalitis virus
GKVGAVSLD

SEQ ID NO: 225110 - protein, 9 aa, Japanese encephalitis virus
KVGAVSLDY

SEQ ID NO: 225111 - protein, 9 aa, Japanese encephalitis virus
VGTVSLDYP

SEQ ID NO: 225112 - protein, 9 aa, Japanese encephalitis virus
TSGSPILNS

SEQ ID NO: 225113 - protein, 9 aa, Japanese encephalitis virus
SGSPILDFN

SEQ ID NO: 225114 - protein, 9 aa, Japanese encephalitis virus
GSPILDFNG

SEQ ID NO: 225115 - protein, 9 aa, Japanese encephalitis virus
SPILNSNGD

SEQ ID NO: 225116 - protein, 9 aa, Japanese encephalitis virus
PILDFNGDI

SEQ ID NO: 225117 - protein, 9 aa, Japanese encephalitis virus
ILNSNGDVV

SEQ ID NO: 225118 - protein, 9 aa, Japanese encephalitis virus
LDFNGDIIG

SEQ ID NO: 225119 - protein, 9 aa, Japanese encephalitis virus
DFNGDIIGL

SEQ ID NO: 225120 - protein, 9 aa, Japanese encephalitis virus
SNGDVVGCL

SEQ ID NO: 225121 - protein, 9 aa, Japanese encephalitis virus
IIGLYGNGG

SEQ ID NO: 225122 - protein, 9 aa, Japanese encephalitis virus
IGLYGNGGE

SEQ ID NO: 225123 - protein, 9 aa, Japanese encephalitis virus
GCLGNGVEL

SEQ ID NO: 225124 - protein, 9 aa, Japanese encephalitis virus
LYGNGGELG

SEQ ID NO: 225125 - protein, 9 aa, Japanese encephalitis virus
YGNGGELGD

SEQ ID NO: 225126 - protein, 9 aa, Japanese encephalitis virus
GNGVELGDR

SEQ ID NO: 225127 - protein, 9 aa, Japanese encephalitis virus
NGGELGDGS

SEQ ID NO: 225128 - protein, 9 aa, Japanese encephalitis virus
GVELGDRSY

SEQ ID NO: 225129 - protein, 9 aa, Japanese encephalitis virus
GELGDGSYV

SEQ ID NO: 225130 - protein, 9 aa, Japanese encephalitis virus
QGDRQEEPI

SEQ ID NO: 225131 - protein, 9 aa, Japanese encephalitis virus
GDRQEEPIP

SEQ ID NO: 225132 - protein, 9 aa, Japanese encephalitis virus
ERQEEPVPE

SEQ ID NO: 225133 - protein, 9 aa, Japanese encephalitis virus
RQEEPIPEA

SEQ ID NO: 225134 - protein, 9 aa, Japanese encephalitis virus
QEEPIPEAY

SEQ ID NO: 225135 - protein, 9 aa, Japanese encephalitis virus
EEPIPEAYN

SEQ ID NO: 225136 - protein, 9 aa, Japanese encephalitis virus
EPIPEAYNP

SEQ ID NO: 225137 - protein, 9 aa, Japanese encephalitis virus
PVPEAYTPT

SEQ ID NO: 225138 - protein, 9 aa, Japanese encephalitis virus
VPEAYTPSM

SEQ ID NO: 225139 - protein, 9 aa, Japanese encephalitis virus
PEAYTPTML

SEQ ID NO: 225140 - protein, 9 aa, Japanese encephalitis virus
AYNPSMLKK

SEQ ID NO: 225141 - protein, 9 aa, Japanese encephalitis virus
MLRKRQLTV

SEQ ID NO: 225142 - protein, 9 aa, Japanese encephalitis virus
LRKRQLTVL

SEQ ID NO: 225143 - protein, 9 aa, Japanese encephalitis virus
RKRQLTVLD

SEQ ID NO: 225144 - protein, 9 aa, Japanese encephalitis virus
KKQMTVLDL

SEQ ID NO: 225145 - protein, 9 aa, Japanese encephalitis virus
KQMTVLDLP

SEQ ID NO: 225146 - protein, 9 aa, Japanese encephalitis virus
QMTVLDLPP

SEQ ID NO: 225147 - protein, 9 aa, Japanese encephalitis virus
MTVLDLPPG

SEQ ID NO: 225148 - protein, 9 aa, Japanese encephalitis virus
TVLDLHPGL

SEQ ID NO: 225149 - protein, 9 aa, Japanese encephalitis virus
VLDLHPGLG

SEQ ID NO: 225150 - protein, 9 aa, Japanese encephalitis virus
LDLHPGLGK

SEQ ID NO: 225151 - protein, 9 aa, Japanese encephalitis virus
DLPPGSGKT

SEQ ID NO: 225152 - protein, 9 aa, Japanese encephalitis virus
LPPGSGKTR

SEQ ID NO: 225153 - protein, 9 aa, Japanese encephalitis virus
HPGLGKTRK

SEQ ID NO: 225154 - protein, 9 aa, Japanese encephalitis virus
PGLGKTRKI

SEQ ID NO: 225155 - protein, 9 aa, Japanese encephalitis virus
GLGKTRKIL

SEQ ID NO: 225156 - protein, 9 aa, Japanese encephalitis virus
LGKTRKILP

SEQ ID NO: 225157 - protein, 9 aa, Japanese encephalitis virus
KTRKILPQT

SEQ ID NO: 225158 - protein, 9 aa, Japanese encephalitis virus
TRKILPQTI

SEQ ID NO: 225159 - protein, 9 aa, Japanese encephalitis virus
RKILPQIIR

SEQ ID NO: 225160 - protein, 9 aa, Japanese encephalitis virus
KILPQIIRD

SEQ ID NO: 225161 - protein, 9 aa, Japanese encephalitis virus
ILPQTIKDA

SEQ ID NO: 225162 - protein, 9 aa, Japanese encephalitis virus
LPQIIRDAI

SEQ ID NO: 225163 - protein, 9 aa, Japanese encephalitis virus
PQIIRDAIQ

SEQ ID NO: 225164 - protein, 9 aa, Japanese encephalitis virus
QTIKDAIQQ

SEQ ID NO: 225165 - protein, 9 aa, Japanese encephalitis virus
IIRDAIQQR

SEQ ID NO: 225166 - protein, 9 aa, Japanese encephalitis virus
IRDAIQQRL

SEQ ID NO: 225167 - protein, 9 aa, Japanese encephalitis virus
KDAIQQRLK

SEQ ID NO: 225168 - protein, 9 aa, Japanese encephalitis virus
DAIQQRLKT

SEQ ID NO: 225169 - protein, 9 aa, Japanese encephalitis virus
AIQQRLKTA

SEQ ID NO: 225170 - protein, 9 aa, Japanese encephalitis virus
IQQHLRTAV

SEQ ID NO: 225171 - protein, 9 aa, Japanese encephalitis virus
QQHLRTAVL

SEQ ID NO: 225172 - protein, 9 aa, Japanese encephalitis virus
QRLKTAVLA

SEQ ID NO: 225173 - protein, 9 aa, Japanese encephalitis virus
RLKTAVLAP

SEQ ID NO: 225174 - protein, 9 aa, Japanese encephalitis virus
AAEMAEVLR

SEQ ID NO: 225175 - protein, 9 aa, Japanese encephalitis virus
AEMAEVLRG

SEQ ID NO: 225176 - protein, 9 aa, Japanese encephalitis virus
EMAEVLRGL

SEQ ID NO: 225177 - protein, 9 aa, Japanese encephalitis virus
MAEVLRGLP

SEQ ID NO: 225178 - protein, 9 aa, Japanese encephalitis virus
AEVLRGLPV

SEQ ID NO: 225179 - protein, 9 aa, Japanese encephalitis virus
EVLRGLPVR

SEQ ID NO: 225180 - protein, 9 aa, Japanese encephalitis virus
VLRGLPVRY

SEQ ID NO: 225181 - protein, 9 aa, Japanese encephalitis virus
VQRSHQGNE

SEQ ID NO: 225182 - protein, 9 aa, Japanese encephalitis virus
QREHQGNAI

SEQ ID NO: 225183 - protein, 9 aa, Japanese encephalitis virus
RSHQGNEIV

SEQ ID NO: 225184 - protein, 9 aa, Japanese encephalitis virus
EHQGNAIVD

SEQ ID NO: 225185 - protein, 9 aa, Japanese encephalitis virus
PIHDLQDET

SEQ ID NO: 225186 - protein, 9 aa, Japanese encephalitis virus
IHDLQDEVP

SEQ ID NO: 225187 - protein, 9 aa, Japanese encephalitis virus
HDLQDETPD

SEQ ID NO: 225188 - protein, 9 aa, Japanese encephalitis virus
DLQDETPDR

SEQ ID NO: 225189 - protein, 9 aa, Japanese encephalitis virus
LQDEIPDWA

SEQ ID NO: 225190 - protein, 9 aa, Japanese encephalitis virus
QDEIPDWAW

SEQ ID NO: 225191 - protein, 9 aa, Japanese encephalitis virus
DEIPDWAWS

SEQ ID NO: 225192 - protein, 9 aa, Japanese encephalitis virus
EIPDWAWSS

SEQ ID NO: 225193 - protein, 9 aa, Japanese encephalitis virus
TPDRAWSSG

SEQ ID NO: 225194 - protein, 9 aa, Japanese encephalitis virus
WITEYSGKT

SEQ ID NO: 225195 - protein, 9 aa, Japanese encephalitis virus
STEYAGKTV

SEQ ID NO: 225196 - protein, 9 aa, Japanese encephalitis virus
TEYSGKTVW

SEQ ID NO: 225197 - protein, 9 aa, Japanese encephalitis virus
EYSGKTVWF

SEQ ID NO: 225198 - protein, 9 aa, Japanese encephalitis virus
VKMGNEIAV

SEQ ID NO: 225199 - protein, 9 aa, Japanese encephalitis virus
KMGNEIAVC

SEQ ID NO: 225200 - protein, 9 aa, Japanese encephalitis virus
VCLQRAGKK

SEQ ID NO: 225201 - protein, 9 aa, Japanese encephalitis virus
AGKRVIQLN

SEQ ID NO: 225202 - protein, 9 aa, Japanese encephalitis virus
GKRVIQLNR

SEQ ID NO: 225203 - protein, 9 aa, Japanese encephalitis virus
KKVIQLSRK

SEQ ID NO: 225204 - protein, 9 aa, Japanese encephalitis virus
RVIQLNRKS

SEQ ID NO: 225205 - protein, 9 aa, Japanese encephalitis virus
DCRKSVEPT

SEQ ID NO: 225206 - protein, 9 aa, Japanese encephalitis virus
CRKSVEPTI

SEQ ID NO: 225207 - protein, 9 aa, Japanese encephalitis virus
RKSVEPTIL

SEQ ID NO: 225208 - protein, 9 aa, Japanese encephalitis virus
KSVEPTILE

SEQ ID NO: 225209 - protein, 9 aa, Japanese encephalitis virus
SVKPTILEK

SEQ ID NO: 225210 - protein, 9 aa, Japanese encephalitis virus
VEPTILEEG

SEQ ID NO: 225211 - protein, 9 aa, Japanese encephalitis virus
EPTILEEGE

SEQ ID NO: 225212 - protein, 9 aa, Japanese encephalitis virus
PIILEEGEG

SEQ ID NO: 225213 - protein, 9 aa, Japanese encephalitis virus
TILEKEEGR

SEQ ID NO: 225214 - protein, 9 aa, Japanese encephalitis virus
LEKEEGRVI

SEQ ID NO: 225215 - protein, 9 aa, Japanese encephalitis virus
EKEEGRVIL

SEQ ID NO: 225216 - protein, 9 aa, Japanese encephalitis virus
KEEGRVILG

SEQ ID NO: 225217 - protein, 9 aa, Japanese encephalitis virus
EEGRVILGN

SEQ ID NO: 225218 - protein, 9 aa, Japanese encephalitis virus
RGRVSRNPN

SEQ ID NO: 225219 - protein, 9 aa, Japanese encephalitis virus
GRVSRNPNQ

SEQ ID NO: 225220 - protein, 9 aa, Japanese encephalitis virus
RVSRNPNQV

SEQ ID NO: 225221 - protein, 9 aa, Japanese encephalitis virus
VGRNPSQVG

SEQ ID NO: 225222 - protein, 9 aa, Japanese encephalitis virus
GRNPSQVGD

SEQ ID NO: 225223 - protein, 9 aa, Japanese encephalitis virus
PSQVGDEYH

SEQ ID NO: 225224 - protein, 9 aa, Japanese encephalitis virus
NQVGDEYEY

SEQ ID NO: 225225 - protein, 9 aa, Japanese encephalitis virus
GDEYEYGGA

SEQ ID NO: 225226 - protein, 9 aa, Japanese encephalitis virus
DEYHYGGPT

SEQ ID NO: 225227 - protein, 9 aa, Japanese encephalitis virus
EYEYGGATS

SEQ ID NO: 225228 - protein, 9 aa, Japanese encephalitis virus
YHYGGPTSE

SEQ ID NO: 225229 - protein, 9 aa, Japanese encephalitis virus
EYGGATSED

SEQ ID NO: 225230 - protein, 9 aa, Japanese encephalitis virus
YGGPTSEDD

SEQ ID NO: 225231 - protein, 9 aa, Japanese encephalitis virus
GGATSEDDG

SEQ ID NO: 225232 - protein, 9 aa, Japanese encephalitis virus
GATSEGDSN

SEQ ID NO: 225233 - protein, 9 aa, Japanese encephalitis virus
ATSEGDSNL

SEQ ID NO: 225234 - protein, 9 aa, Japanese encephalitis virus
TSEGDSNLA

SEQ ID NO: 225235 - protein, 9 aa, Japanese encephalitis virus
SEGDSNLAH

SEQ ID NO: 225236 - protein, 9 aa, Japanese encephalitis virus
EDDGNLAHW

SEQ ID NO: 225237 - protein, 9 aa, Japanese encephalitis virus
DDGNLAHWT

SEQ ID NO: 225238 - protein, 9 aa, Japanese encephalitis virus
YGPEREKAL

SEQ ID NO: 225239 - protein, 9 aa, Japanese encephalitis virus
GPEREKALT

SEQ ID NO: 225240 - protein, 9 aa, Japanese encephalitis virus
PEREKALTM

SEQ ID NO: 225241 - protein, 9 aa, Japanese encephalitis virus
EREKALTMD

SEQ ID NO: 225242 - protein, 9 aa, Japanese encephalitis virus
REKALTMDG

SEQ ID NO: 225243 - protein, 9 aa, Japanese encephalitis virus
EKALTMDGE

SEQ ID NO: 225244 - protein, 9 aa, Japanese encephalitis virus
KALTMDGEY

SEQ ID NO: 225245 - protein, 9 aa, Japanese encephalitis virus
AFTMDVEYR

SEQ ID NO: 225246 - protein, 9 aa, Japanese encephalitis virus
LTMDGEYRL

SEQ ID NO: 225247 - protein, 9 aa, Japanese encephalitis virus
VWLAYRVAS

SEQ ID NO: 225248 - protein, 9 aa, Japanese encephalitis virus
WLAYKVAPN

SEQ ID NO: 225249 - protein, 9 aa, Japanese encephalitis virus
LAYKVAPNG

SEQ ID NO: 225250 - protein, 9 aa, Japanese encephalitis virus
AYKVAPNGI

SEQ ID NO: 225251 - protein, 9 aa, Japanese encephalitis virus
YKVAPNGIQ

SEQ ID NO: 225252 - protein, 9 aa, Japanese encephalitis virus
RVASNGIQY

SEQ ID NO: 225253 - protein, 9 aa, Japanese encephalitis virus
TNAILEDST

SEQ ID NO: 225254 - protein, 9 aa, Japanese encephalitis virus
NAILEDSTE

SEQ ID NO: 225255 - protein, 9 aa, Japanese encephalitis virus
AILEDSTEV

SEQ ID NO: 225256 - protein, 9 aa, Japanese encephalitis virus
ILEDSTEVE

SEQ ID NO: 225257 - protein, 9 aa, Japanese encephalitis virus
LEDSTEVEI

SEQ ID NO: 225258 - protein, 9 aa, Japanese encephalitis virus
EDSTEVEIV

SEQ ID NO: 225259 - protein, 9 aa, Japanese encephalitis virus
DSTEVEIVT

SEQ ID NO: 225260 - protein, 9 aa, Japanese encephalitis virus
STEVEIVTR

SEQ ID NO: 225261 - protein, 9 aa, Japanese encephalitis virus
TEVEIVTRT

SEQ ID NO: 225262 - protein, 9 aa, Japanese encephalitis virus
KILKPRWLY

SEQ ID NO: 225263 - protein, 9 aa, Japanese encephalitis virus
VLKPRWLDA

SEQ ID NO: 225264 - protein, 9 aa, Japanese encephalitis virus
FAAGKRSAT

SEQ ID NO: 225265 - protein, 9 aa, Japanese encephalitis virus
AAGKRSATS

SEQ ID NO: 225266 - protein, 9 aa, Japanese encephalitis virus
AGKRSATSF

SEQ ID NO: 225267 - protein, 9 aa, Japanese encephalitis virus
GKRSATSFI

SEQ ID NO: 225268 - protein, 9 aa, Japanese encephalitis virus
KRSATSFIE

SEQ ID NO: 225269 - protein, 9 aa, Japanese encephalitis virus
RSATSFIEV

SEQ ID NO: 225270 - protein, 9 aa, Japanese encephalitis virus
SATSFIEVL

SEQ ID NO: 225271 - protein, 9 aa, Japanese encephalitis virus
AVSFIEEPG

SEQ ID NO: 225272 - protein, 9 aa, Japanese encephalitis virus
ISFIEVRGR

SEQ ID NO: 225273 - protein, 9 aa, Japanese encephalitis virus
SFIEEPGRM

SEQ ID NO: 225274 - protein, 9 aa, Japanese encephalitis virus
FIEEPGRMP

SEQ ID NO: 225275 - protein, 9 aa, Japanese encephalitis virus
IEEPGRMPE

SEQ ID NO: 225276 - protein, 9 aa, Japanese encephalitis virus
EVRGRMPEH

SEQ ID NO: 225277 - protein, 9 aa, Japanese encephalitis virus
VRGRMPEHF

SEQ ID NO: 225278 - protein, 9 aa, Japanese encephalitis virus
PGRMPEHFM

SEQ ID NO: 225279 - protein, 9 aa, Japanese encephalitis virus
YLVATAEKS

SEQ ID NO: 225280 - protein, 9 aa, Japanese encephalitis virus
LVATAEKSG

SEQ ID NO: 225281 - protein, 9 aa, Japanese encephalitis virus
VATAEKSGK

SEQ ID NO: 225282 - protein, 9 aa, Japanese encephalitis virus
ATAEKSGKA

SEQ ID NO: 225283 - protein, 9 aa, Japanese encephalitis virus
TAEKSGKAH

SEQ ID NO: 225284 - protein, 9 aa, Japanese encephalitis virus
AEKGGKTHR

SEQ ID NO: 225285 - protein, 9 aa, Japanese encephalitis virus
EKSGKAHRM

SEQ ID NO: 225286 - protein, 9 aa, Japanese encephalitis virus
KSGKAHRMA

SEQ ID NO: 225287 - protein, 9 aa, Japanese encephalitis virus
GGKTHRMAL

SEQ ID NO: 225288 - protein, 9 aa, Japanese encephalitis virus
DALETVTLI

SEQ ID NO: 225289 - protein, 9 aa, Japanese encephalitis virus
ALETITLTV

SEQ ID NO: 225290 - protein, 9 aa, Japanese encephalitis virus
LETVTLIVA

SEQ ID NO: 225291 - protein, 9 aa, Japanese encephalitis virus
ETITLTVAI

SEQ ID NO: 225292 - protein, 9 aa, Japanese encephalitis virus
AITVMTRGF

SEQ ID NO: 225293 - protein, 9 aa, Japanese encephalitis virus
IAVMTGGFF

SEQ ID NO: 225294 - protein, 9 aa, Japanese encephalitis virus
AVMTGGFFL

SEQ ID NO: 225295 - protein, 9 aa, Japanese encephalitis virus
VMTRGFFLL

SEQ ID NO: 225296 - protein, 9 aa, Japanese encephalitis virus
TRGFFLLMM

SEQ ID NO: 225297 - protein, 9 aa, Japanese encephalitis virus
RGFFLLMMQ

SEQ ID NO: 225298 - protein, 9 aa, Japanese encephalitis virus
LMKQRKGIG

SEQ ID NO: 225299 - protein, 9 aa, Japanese encephalitis virus
MKQRKGIGK

SEQ ID NO: 225300 - protein, 9 aa, Japanese encephalitis virus
MQRKGIEKM

SEQ ID NO: 225301 - protein, 9 aa, Japanese encephalitis virus
QRKGIEKMG

SEQ ID NO: 225302 - protein, 9 aa, Japanese encephalitis virus
RKGIEKMGL

SEQ ID NO: 225303 - protein, 9 aa, Japanese encephalitis virus
KGIEKMGLG

SEQ ID NO: 225304 - protein, 9 aa, Japanese encephalitis virus
GIEKMGLGA

SEQ ID NO: 225305 - protein, 9 aa, Japanese encephalitis virus
IEKMGLGAL

SEQ ID NO: 225306 - protein, 9 aa, Japanese encephalitis virus
EKMGLGALV

SEQ ID NO: 225307 - protein, 9 aa, Japanese encephalitis virus
LIPEPEKQK

SEQ ID NO: 225308 - protein, 9 aa, Japanese encephalitis virus
IPEPEKQKS

SEQ ID NO: 225309 - protein, 9 aa, Japanese encephalitis virus
PEPEKQKSQ

SEQ ID NO: 225310 - protein, 9 aa, Japanese encephalitis virus
EPEKQRLQT

SEQ ID NO: 225311 - protein, 9 aa, Japanese encephalitis virus
PEKQRLQTD

SEQ ID NO: 225312 - protein, 9 aa, Japanese encephalitis virus
EKQRSQTGN

SEQ ID NO: 225313 - protein, 9 aa, Japanese encephalitis virus
KQKSQTDNQ

SEQ ID NO: 225314 - protein, 9 aa, Japanese encephalitis virus
QRLQTDNQL

SEQ ID NO: 225315 - protein, 9 aa, Japanese encephalitis virus
KSQTDNQLA

SEQ ID NO: 225316 - protein, 9 aa, Japanese encephalitis virus
LQTDNQLAV

SEQ ID NO: 225317 - protein, 9 aa, Japanese encephalitis virus
CVLTVVGMV

SEQ ID NO: 225318 - protein, 9 aa, Japanese encephalitis virus
VLTVVGVAA

SEQ ID NO: 225319 - protein, 9 aa, Japanese encephalitis virus
LTVVGMVAA

SEQ ID NO: 225320 - protein, 9 aa, Japanese encephalitis virus
TVVGMVAAN

SEQ ID NO: 225321 - protein, 9 aa, Japanese encephalitis virus
VVGMVAANE

SEQ ID NO: 225322 - protein, 9 aa, Japanese encephalitis virus
VGMVAANEY

SEQ ID NO: 225323 - protein, 9 aa, Japanese encephalitis virus
GMVAANEYG

SEQ ID NO: 225324 - protein, 9 aa, Japanese encephalitis virus
MVAANEYGM

SEQ ID NO: 225325 - protein, 9 aa, Japanese encephalitis virus
MLERTKADL

SEQ ID NO: 225326 - protein, 9 aa, Japanese encephalitis virus
LEKTKADIK

SEQ ID NO: 225327 - protein, 9 aa, Japanese encephalitis virus
ERTKADLKS

SEQ ID NO: 225328 - protein, 9 aa, Japanese encephalitis virus
KTKADIKSM

SEQ ID NO: 225329 - protein, 9 aa, Japanese encephalitis virus
KADLKSMFV

SEQ ID NO: 225330 - protein, 9 aa, Japanese encephalitis virus
ADLKSMFVG

SEQ ID NO: 225331 - protein, 9 aa, Japanese encephalitis virus
DLKSMFAGK

SEQ ID NO: 225332 - protein, 9 aa, Japanese encephalitis virus
KSMFAGKTQ

SEQ ID NO: 225333 - protein, 9 aa, Japanese encephalitis virus
SMFAGKTQA

SEQ ID NO: 225334 - protein, 9 aa, Japanese encephalitis virus
APVSGMTGL

SEQ ID NO: 225335 - protein, 9 aa, Japanese encephalitis virus
PVSGMTGLP

SEQ ID NO: 225336 - protein, 9 aa, Japanese encephalitis virus
ALGLTGLPS

SEQ ID NO: 225337 - protein, 9 aa, Japanese encephalitis virus
SGLTGLPSV

SEQ ID NO: 225338 - protein, 9 aa, Japanese encephalitis virus
GLTGLPSMT

SEQ ID NO: 225339 - protein, 9 aa, Japanese encephalitis virus
MTGLPGMAL

SEQ ID NO: 225340 - protein, 9 aa, Japanese encephalitis virus
TGLPGMALD

SEQ ID NO: 225341 - protein, 9 aa, Japanese encephalitis virus
GLPGMALDL

SEQ ID NO: 225342 - protein, 9 aa, Japanese encephalitis virus
LPSMTLDLR

SEQ ID NO: 225343 - protein, 9 aa, Japanese encephalitis virus
PSMTLDLRP

SEQ ID NO: 225344 - protein, 9 aa, Japanese encephalitis virus
SVALDLRPA

SEQ ID NO: 225345 - protein, 9 aa, Japanese encephalitis virus
MTLDLRPAT

SEQ ID NO: 225346 - protein, 9 aa, Japanese encephalitis virus
LITSEYVTP

SEQ ID NO: 225347 - protein, 9 aa, Japanese encephalitis virus
VTPSLASIS

SEQ ID NO: 225348 - protein, 9 aa, Japanese encephalitis virus
TPSLASISS

SEQ ID NO: 225349 - protein, 9 aa, Japanese encephalitis virus
PSLASISSQ

SEQ ID NO: 225350 - protein, 9 aa, Japanese encephalitis virus
VLLGCWGQI

SEQ ID NO: 225351 - protein, 9 aa, Japanese encephalitis virus
LLGCWGQIT

SEQ ID NO: 225352 - protein, 9 aa, Japanese encephalitis virus
WGQITLTTS

SEQ ID NO: 225353 - protein, 9 aa, Japanese encephalitis virus
GQITLTTSL

SEQ ID NO: 225354 - protein, 9 aa, Japanese encephalitis virus
QITLTTSLT

SEQ ID NO: 225355 - protein, 9 aa, Japanese encephalitis virus
ITLTTSLTA

SEQ ID NO: 225356 - protein, 9 aa, Japanese encephalitis virus
TLTTSLTAM

SEQ ID NO: 225357 - protein, 9 aa, Japanese encephalitis virus
LTTSLTAMV

SEQ ID NO: 225358 - protein, 9 aa, Japanese encephalitis virus
TTSLTAMVL

SEQ ID NO: 225359 - protein, 9 aa, Japanese encephalitis virus
LTAVVLATL

SEQ ID NO: 225360 - protein, 9 aa, Japanese encephalitis virus
TAVVLATLH

SEQ ID NO: 225361 - protein, 9 aa, Japanese encephalitis virus
AVVLATLHY

SEQ ID NO: 225362 - protein, 9 aa, Japanese encephalitis virus
VVLATLHYG

SEQ ID NO: 225363 - protein, 9 aa, Japanese encephalitis virus
VLAILHYGY

SEQ ID NO: 225364 - protein, 9 aa, Japanese encephalitis virus
LATLHYGFM

SEQ ID NO: 225365 - protein, 9 aa, Japanese encephalitis virus
AILHYGYML

SEQ ID NO: 225366 - protein, 9 aa, Japanese encephalitis virus
ILHYGYMLP

SEQ ID NO: 225367 - protein, 9 aa, Japanese encephalitis virus
LIGGSVAAF

SEQ ID NO: 225368 - protein, 9 aa, Japanese encephalitis virus
IGGSVAAFL

SEQ ID NO: 225369 - protein, 9 aa, Japanese encephalitis virus
GGSVAAFLV

SEQ ID NO: 225370 - protein, 9 aa, Japanese encephalitis virus
GSVAAFLVN

SEQ ID NO: 225371 - protein, 9 aa, Japanese encephalitis virus
VAAFLVNPK

SEQ ID NO: 225372 - protein, 9 aa, Japanese encephalitis virus
AAFLVNPKI

SEQ ID NO: 225373 - protein, 9 aa, Japanese encephalitis virus
AFLVNPKIT

SEQ ID NO: 225374 - protein, 9 aa, Japanese encephalitis virus
FLVNPNVST

SEQ ID NO: 225375 - protein, 9 aa, Japanese encephalitis virus
LVNPNVSTV

SEQ ID NO: 225376 - protein, 9 aa, Japanese encephalitis virus
VNPNVTTVK

SEQ ID NO: 225377 - protein, 9 aa, Japanese encephalitis virus
NPNVTTVKK

SEQ ID NO: 225378 - protein, 9 aa, Japanese encephalitis virus
PNVSTVRKA

SEQ ID NO: 225379 - protein, 9 aa, Japanese encephalitis virus
NVTTVKKPG

SEQ ID NO: 225380 - protein, 9 aa, Japanese encephalitis virus
VSTVRKAGV

SEQ ID NO: 225381 - protein, 9 aa, Japanese encephalitis virus
TTVKKPGVL

SEQ ID NO: 225382 - protein, 9 aa, Japanese encephalitis virus
TVRKAGVLV

SEQ ID NO: 225383 - protein, 9 aa, Japanese encephalitis virus
VKKPGVLVT

SEQ ID NO: 225384 - protein, 9 aa, Japanese encephalitis virus
RKAGVLVTA

SEQ ID NO: 225385 - protein, 9 aa, Japanese encephalitis virus
KAGVLVTAA

SEQ ID NO: 225386 - protein, 9 aa, Japanese encephalitis virus
PGVLVTAAT

SEQ ID NO: 225387 - protein, 9 aa, Japanese encephalitis virus
VLVTAATLS

SEQ ID NO: 225388 - protein, 9 aa, Japanese encephalitis virus
LVTAATLSL

SEQ ID NO: 225389 - protein, 9 aa, Japanese encephalitis virus
VTAATLSLW

SEQ ID NO: 225390 - protein, 9 aa, Japanese encephalitis virus
TAATLSLWD

SEQ ID NO: 225391 - protein, 9 aa, Japanese encephalitis virus
AATLSLWDN

SEQ ID NO: 225392 - protein, 9 aa, Japanese encephalitis virus
ATLSLWDNG

SEQ ID NO: 225393 - protein, 9 aa, Japanese encephalitis virus
WTLIKNANK

SEQ ID NO: 225394 - protein, 9 aa, Japanese encephalitis virus
TLIKNANKP

SEQ ID NO: 225395 - protein, 9 aa, Japanese encephalitis virus
LIKNADNPS

SEQ ID NO: 225396 - protein, 9 aa, Japanese encephalitis virus
IKNADNPSL

SEQ ID NO: 225397 - protein, 9 aa, Japanese encephalitis virus
KNANKPSLK

SEQ ID NO: 225398 - protein, 9 aa, Japanese encephalitis virus
NADKPSFKK

SEQ ID NO: 225399 - protein, 9 aa, Japanese encephalitis virus
ANKPSLKRG

SEQ ID NO: 225400 - protein, 9 aa, Japanese encephalitis virus
DKPSLKKGR

SEQ ID NO: 225401 - protein, 9 aa, Japanese encephalitis virus
KPSLKKGRP

SEQ ID NO: 225402 - protein, 9 aa, Japanese encephalitis virus
PSLKRGGPG

SEQ ID NO: 225403 - protein, 9 aa, Japanese encephalitis virus
SLKKGRPGG

SEQ ID NO: 225404 - protein, 9 aa, Japanese encephalitis virus
LKKGRPGGR

SEQ ID NO: 225405 - protein, 9 aa, Japanese encephalitis virus
KKGRPGGRT

SEQ ID NO: 225406 - protein, 9 aa, Japanese encephalitis virus
RGRSGGRTL

SEQ ID NO: 225407 - protein, 9 aa, Japanese encephalitis virus
GGPGGRTLW

SEQ ID NO: 225408 - protein, 9 aa, Japanese encephalitis virus
RPGGRTLGD

SEQ ID NO: 225409 - protein, 9 aa, Japanese encephalitis virus
PGGRTLWEQ

SEQ ID NO: 225410 - protein, 9 aa, Japanese encephalitis virus
GGRTLWEQW

SEQ ID NO: 225411 - protein, 9 aa, Japanese encephalitis virus
GRTLWEQWK

SEQ ID NO: 225412 - protein, 9 aa, Japanese encephalitis virus
RTLWEQWKE

SEQ ID NO: 225413 - protein, 9 aa, Japanese encephalitis virus
TLGDQWKEK

SEQ ID NO: 225414 - protein, 9 aa, Japanese encephalitis virus
LGEQWKRKL

SEQ ID NO: 225415 - protein, 9 aa, Japanese encephalitis virus
WEQWKEKLN

SEQ ID NO: 225416 - protein, 9 aa, Japanese encephalitis virus
EQWKRKLNA

SEQ ID NO: 225417 - protein, 9 aa, Japanese encephalitis virus
QWKERLNAM

SEQ ID NO: 225418 - protein, 9 aa, Japanese encephalitis virus
WKERLNAMS

SEQ ID NO: 225419 - protein, 9 aa, Japanese encephalitis virus
KEKLNALSR

SEQ ID NO: 225420 - protein, 9 aa, Japanese encephalitis virus
KLNAMGRDE

SEQ ID NO: 225421 - protein, 9 aa, Japanese encephalitis virus
LNAMGRDEF

SEQ ID NO: 225422 - protein, 9 aa, Japanese encephalitis virus
NAMGRDEFF

SEQ ID NO: 225423 - protein, 9 aa, Japanese encephalitis virus
AMGRDEFFK

SEQ ID NO: 225424 - protein, 9 aa, Japanese encephalitis virus
MGRDEFFKY

SEQ ID NO: 225425 - protein, 9 aa, Japanese encephalitis virus
GRDEFFKYR

SEQ ID NO: 225426 - protein, 9 aa, Japanese encephalitis virus
REEFFQYRR

SEQ ID NO: 225427 - protein, 9 aa, Japanese encephalitis virus
EEFFQYRRE

SEQ ID NO: 225428 - protein, 9 aa, Japanese encephalitis virus
EFFQYRREA

SEQ ID NO: 225429 - protein, 9 aa, Japanese encephalitis virus
FFQYRREAI

SEQ ID NO: 225430 - protein, 9 aa, Japanese encephalitis virus
FQYRREAII

SEQ ID NO: 225431 - protein, 9 aa, Japanese encephalitis virus
QYRREAIIE

SEQ ID NO: 225432 - protein, 9 aa, Japanese encephalitis virus
RTEARRARS

SEQ ID NO: 225433 - protein, 9 aa, Japanese encephalitis virus
TEARRARSE

SEQ ID NO: 225434 - protein, 9 aa, Japanese encephalitis virus
EARRARSEN

SEQ ID NO: 225435 - protein, 9 aa, Japanese encephalitis virus
ARRARSENN

SEQ ID NO: 225436 - protein, 9 aa, Japanese encephalitis virus
CRARRENNI

SEQ ID NO: 225437 - protein, 9 aa, Japanese encephalitis virus
RARRENNKV

SEQ ID NO: 225438 - protein, 9 aa, Japanese encephalitis virus
ARSENNIVG

SEQ ID NO: 225439 - protein, 9 aa, Japanese encephalitis virus
RRENNKVGG

SEQ ID NO: 225440 - protein, 9 aa, Japanese encephalitis virus
SENNIVGGH

SEQ ID NO: 225441 - protein, 9 aa, Japanese encephalitis virus
ENNKVGGHP

SEQ ID NO: 225442 - protein, 9 aa, Japanese encephalitis virus
NNKVGGHPV

SEQ ID NO: 225443 - protein, 9 aa, Japanese encephalitis virus
NKVGGHPVS

SEQ ID NO: 225444 - protein, 9 aa, Japanese encephalitis virus
KVGGHPVSR

SEQ ID NO: 225445 - protein, 9 aa, Japanese encephalitis virus
FVPPIGKVI

SEQ ID NO: 225446 - protein, 9 aa, Japanese encephalitis virus
VPPIGKVID

SEQ ID NO: 225447 - protein, 9 aa, Japanese encephalitis virus
PPIGKVIDL

SEQ ID NO: 225448 - protein, 9 aa, Japanese encephalitis virus
KVIDLGCGC

SEQ ID NO: 225449 - protein, 9 aa, Japanese encephalitis virus
VVDLGCGRG

SEQ ID NO: 225450 - protein, 9 aa, Japanese encephalitis virus
IDLGCGCGG

SEQ ID NO: 225451 - protein, 9 aa, Japanese encephalitis virus
DLGCGCGGW

SEQ ID NO: 225452 - protein, 9 aa, Japanese encephalitis virus
LGCGCGGWS

SEQ ID NO: 225453 - protein, 9 aa, Japanese encephalitis virus
GCGCGGWSY

SEQ ID NO: 225454 - protein, 9 aa, Japanese encephalitis virus
CGRGGWSYC

SEQ ID NO: 225455 - protein, 9 aa, Japanese encephalitis virus
GCGGWSYYA

SEQ ID NO: 225456 - protein, 9 aa, Japanese encephalitis virus
RGGWSYCAA

SEQ ID NO: 225457 - protein, 9 aa, Japanese encephalitis virus
GGWSYCAAT

SEQ ID NO: 225458 - protein, 9 aa, Japanese encephalitis virus
GWSYCAATL

SEQ ID NO: 225459 - protein, 9 aa, Japanese encephalitis virus
WSYCAATLK

SEQ ID NO: 225460 - protein, 9 aa, Japanese encephalitis virus
SYYAATLKR

SEQ ID NO: 225461 - protein, 9 aa, Japanese encephalitis virus
YCAATLKKV

SEQ ID NO: 225462 - protein, 9 aa, Japanese encephalitis virus
YAATLKRVQ

SEQ ID NO: 225463 - protein, 9 aa, Japanese encephalitis virus
ATLKKVQEF

SEQ ID NO: 225464 - protein, 9 aa, Japanese encephalitis virus
TLKKVQEFR

SEQ ID NO: 225465 - protein, 9 aa, Japanese encephalitis virus
LKKVQEFRG

SEQ ID NO: 225466 - protein, 9 aa, Japanese encephalitis virus
KKVQEFRGY

SEQ ID NO: 225467 - protein, 9 aa, Japanese encephalitis virus
KVQEFRGYT

SEQ ID NO: 225468 - protein, 9 aa, Japanese encephalitis virus
VQEFRGYTK

SEQ ID NO: 225469 - protein, 9 aa, Japanese encephalitis virus
QEFRGYTKG

SEQ ID NO: 225470 - protein, 9 aa, Japanese encephalitis virus
EFRGYTKGG

SEQ ID NO: 225471 - protein, 9 aa, Japanese encephalitis virus
FRGYTKGGA

SEQ ID NO: 225472 - protein, 9 aa, Japanese encephalitis virus
PMPMQSYGW

SEQ ID NO: 225473 - protein, 9 aa, Japanese encephalitis virus
MPMQSYGWN

SEQ ID NO: 225474 - protein, 9 aa, Japanese encephalitis virus
PMQSYGWNL

SEQ ID NO: 225475 - protein, 9 aa, Japanese encephalitis virus
SYGWNLVSM

SEQ ID NO: 225476 - protein, 9 aa, Japanese encephalitis virus
YGWNLVSMK

SEQ ID NO: 225477 - protein, 9 aa, Japanese encephalitis virus
GWNLVSMKS

SEQ ID NO: 225478 - protein, 9 aa, Japanese encephalitis virus
WNLVSMKSG

SEQ ID NO: 225479 - protein, 9 aa, Japanese encephalitis virus
LVSMKSGVD

SEQ ID NO: 225480 - protein, 9 aa, Japanese encephalitis virus
VSLKSGVHV

SEQ ID NO: 225481 - protein, 9 aa, Japanese encephalitis virus
SMKSGVDVF

SEQ ID NO: 225482 - protein, 9 aa, Japanese encephalitis virus
MKSGVDVFY

SEQ ID NO: 225483 - protein, 9 aa, Japanese encephalitis virus
KSGVHVFYK

SEQ ID NO: 225484 - protein, 9 aa, Japanese encephalitis virus
SGVHVFYKP

SEQ ID NO: 225485 - protein, 9 aa, Japanese encephalitis virus
GVHVFYKPS

SEQ ID NO: 225486 - protein, 9 aa, Japanese encephalitis virus
VDVFYRPSE

SEQ ID NO: 225487 - protein, 9 aa, Japanese encephalitis virus
DVFYRPSEP

SEQ ID NO: 225488 - protein, 9 aa, Japanese encephalitis virus
YMPKVIEKI

SEQ ID NO: 225489 - protein, 9 aa, Japanese encephalitis virus
MPKVIEKIE

SEQ ID NO: 225490 - protein, 9 aa, Japanese encephalitis virus
PKVIEKIEV

SEQ ID NO: 225491 - protein, 9 aa, Japanese encephalitis virus
KVIEKIEVL

SEQ ID NO: 225492 - protein, 9 aa, Japanese encephalitis virus
VIEKIEVLQ

SEQ ID NO: 225493 - protein, 9 aa, Japanese encephalitis virus
IEKIEVLQR

SEQ ID NO: 225494 - protein, 9 aa, Japanese encephalitis virus
EKIEVLQRR

SEQ ID NO: 225495 - protein, 9 aa, Japanese encephalitis virus
KNEVLQRRF

SEQ ID NO: 225496 - protein, 9 aa, Japanese encephalitis virus
NEVLQRRFG

SEQ ID NO: 225497 - protein, 9 aa, Japanese encephalitis virus
VLLGRMDRA

SEQ ID NO: 225498 - protein, 9 aa, Japanese encephalitis virus
LLGRMDRAV

SEQ ID NO: 225499 - protein, 9 aa, Japanese encephalitis virus
LGRMNRTVW

SEQ ID NO: 225500 - protein, 9 aa, Japanese encephalitis virus
GRMDRAVWR

SEQ ID NO: 225501 - protein, 9 aa, Japanese encephalitis virus
RMNRTVWRG

SEQ ID NO: 225502 - protein, 9 aa, Japanese encephalitis virus
MDRAVWRGP

SEQ ID NO: 225503 - protein, 9 aa, Japanese encephalitis virus
DRTVWRGPR

SEQ ID NO: 225504 - protein, 9 aa, Japanese encephalitis virus
RAVWRGPKY

SEQ ID NO: 225505 - protein, 9 aa, Japanese encephalitis virus
TVWRGPKYK

SEQ ID NO: 225506 - protein, 9 aa, Japanese encephalitis virus
VWRGPRYEE

SEQ ID NO: 225507 - protein, 9 aa, Japanese encephalitis virus
WRGPRYEED

SEQ ID NO: 225508 - protein, 9 aa, Japanese encephalitis virus
RGPRYEEDV

SEQ ID NO: 225509 - protein, 9 aa, Japanese encephalitis virus
GPKYKEDVN

SEQ ID NO: 225510 - protein, 9 aa, Japanese encephalitis virus
PRYEEDVNL

SEQ ID NO: 225511 - protein, 9 aa, Japanese encephalitis virus
RYEEDVNLG

SEQ ID NO: 225512 - protein, 9 aa, Japanese encephalitis virus
VGKGEVHSD

SEQ ID NO: 225513 - protein, 9 aa, Japanese encephalitis virus
GKGEVHSDQ

SEQ ID NO: 225514 - protein, 9 aa, Japanese encephalitis virus
QKKIRKRIQ

SEQ ID NO: 225515 - protein, 9 aa, Japanese encephalitis virus
KKIRKRIQK

SEQ ID NO: 225516 - protein, 9 aa, Japanese encephalitis virus
KIRRRIQKL

SEQ ID NO: 225517 - protein, 9 aa, Japanese encephalitis virus
IRKRIQKLK

SEQ ID NO: 225518 - protein, 9 aa, Japanese encephalitis virus
RKRIQKLKE

SEQ ID NO: 225519 - protein, 9 aa, Japanese encephalitis virus
KRIQKLREG

SEQ ID NO: 225520 - protein, 9 aa, Japanese encephalitis virus
RIQKQKEEF

SEQ ID NO: 225521 - protein, 9 aa, Japanese encephalitis virus
IQKLREGFA

SEQ ID NO: 225522 - protein, 9 aa, Japanese encephalitis virus
QKQKEEFAT

SEQ ID NO: 225523 - protein, 9 aa, Japanese encephalitis virus
KLREEFGTT

SEQ ID NO: 225524 - protein, 9 aa, Japanese encephalitis virus
QKEEFATTW

SEQ ID NO: 225525 - protein, 9 aa, Japanese encephalitis virus
REEFGTTWH

SEQ ID NO: 225526 - protein, 9 aa, Japanese encephalitis virus
EEFGTTWHK

SEQ ID NO: 225527 - protein, 9 aa, Japanese encephalitis virus
EFATTWHRD

SEQ ID NO: 225528 - protein, 9 aa, Japanese encephalitis virus
FATTWHKDH

SEQ ID NO: 225529 - protein, 9 aa, Japanese encephalitis virus
ATTWHRDPE

SEQ ID NO: 225530 - protein, 9 aa, Japanese encephalitis virus
TTWHKDHEH

SEQ ID NO: 225531 - protein, 9 aa, Japanese encephalitis virus
TWHKDHEHP

SEQ ID NO: 225532 - protein, 9 aa, Japanese encephalitis virus
WHKDHEHPY

SEQ ID NO: 225533 - protein, 9 aa, Japanese encephalitis virus
HRDPEHPYR

SEQ ID NO: 225534 - protein, 9 aa, Japanese encephalitis virus
KDPEHPYRN

SEQ ID NO: 225535 - protein, 9 aa, Japanese encephalitis virus
DPEHPYRNW

SEQ ID NO: 225536 - protein, 9 aa, Japanese encephalitis virus
PEHPYRNWT

SEQ ID NO: 225537 - protein, 9 aa, Japanese encephalitis virus
HGSYEVRAT

SEQ ID NO: 225538 - protein, 9 aa, Japanese encephalitis virus
GSYEVKANG

SEQ ID NO: 225539 - protein, 9 aa, Japanese encephalitis virus
SYEVRATGS

SEQ ID NO: 225540 - protein, 9 aa, Japanese encephalitis virus
YEVKANGSA

SEQ ID NO: 225541 - protein, 9 aa, Japanese encephalitis virus
EVKANGSAS

SEQ ID NO: 225542 - protein, 9 aa, Japanese encephalitis virus
VRATGSASS

SEQ ID NO: 225543 - protein, 9 aa, Japanese encephalitis virus
RATGSASSL

SEQ ID NO: 225544 - protein, 9 aa, Japanese encephalitis virus
ELMSKPWDA

SEQ ID NO: 225545 - protein, 9 aa, Japanese encephalitis virus
MSKPWDTIA

SEQ ID NO: 225546 - protein, 9 aa, Japanese encephalitis virus
SKPWDAISY

SEQ ID NO: 225547 - protein, 9 aa, Japanese encephalitis virus
KPWDTIANV

SEQ ID NO: 225548 - protein, 9 aa, Japanese encephalitis virus
PWDTIANVT

SEQ ID NO: 225549 - protein, 9 aa, Japanese encephalitis virus
WDAISYVTT

SEQ ID NO: 225550 - protein, 9 aa, Japanese encephalitis virus
DTIANVTTM

SEQ ID NO: 225551 - protein, 9 aa, Japanese encephalitis virus
AISYVTTMP

SEQ ID NO: 225552 - protein, 9 aa, Japanese encephalitis virus
VFKEKVGTK

SEQ ID NO: 225553 - protein, 9 aa, Japanese encephalitis virus
FKEKVGTKA

SEQ ID NO: 225554 - protein, 9 aa, Japanese encephalitis virus
KEKVGTMAP

SEQ ID NO: 225555 - protein, 9 aa, Japanese encephalitis virus
EKVGTMAPE

SEQ ID NO: 225556 - protein, 9 aa, Japanese encephalitis virus
KVGTMAPEP

SEQ ID NO: 225557 - protein, 9 aa, Japanese encephalitis virus
VGTMAPEPP

SEQ ID NO: 225558 - protein, 9 aa, Japanese encephalitis virus
TKAPEPPVG

SEQ ID NO: 225559 - protein, 9 aa, Japanese encephalitis virus
GVREVLNET

SEQ ID NO: 225560 - protein, 9 aa, Japanese encephalitis virus
VREVLNETT

SEQ ID NO: 225561 - protein, 9 aa, Japanese encephalitis virus
WLWAHLSRK

SEQ ID NO: 225562 - protein, 9 aa, Japanese encephalitis virus
LWAHLSRKK

SEQ ID NO: 225563 - protein, 9 aa, Japanese encephalitis virus
WAHLSRKKR

SEQ ID NO: 225564 - protein, 9 aa, Japanese encephalitis virus
AHLSRKKRP

SEQ ID NO: 225565 - protein, 9 aa, Japanese encephalitis virus
HLSRKKRPR

SEQ ID NO: 225566 - protein, 9 aa, Japanese encephalitis virus
LCTKEEFIN

SEQ ID NO: 225567 - protein, 9 aa, Japanese encephalitis virus
CTKEEFINK

SEQ ID NO: 225568 - protein, 9 aa, Japanese encephalitis virus
TKEEFINKV

SEQ ID NO: 225569 - protein, 9 aa, Japanese encephalitis virus
KEEFINKVN

SEQ ID NO: 225570 - protein, 9 aa, Japanese encephalitis virus
EEFINKVNS

SEQ ID NO: 225571 - protein, 9 aa, Japanese encephalitis virus
EFIKKVNSD

SEQ ID NO: 225572 - protein, 9 aa, Japanese encephalitis virus
FIKKVNSDA

SEQ ID NO: 225573 - protein, 9 aa, Japanese encephalitis virus
KVNSDAALG

SEQ ID NO: 225574 - protein, 9 aa, Japanese encephalitis virus
VNSNASLGA

SEQ ID NO: 225575 - protein, 9 aa, Japanese encephalitis virus
NSDAALGAV

SEQ ID NO: 225576 - protein, 9 aa, Japanese encephalitis virus
SDAALGAVF

SEQ ID NO: 225577 - protein, 9 aa, Japanese encephalitis virus
NASLGAVFA

SEQ ID NO: 225578 - protein, 9 aa, Japanese encephalitis virus
ASLGAVFAE

SEQ ID NO: 225579 - protein, 9 aa, Japanese encephalitis virus
SLGTVFAEQ

SEQ ID NO: 225580 - protein, 9 aa, Japanese encephalitis virus
WSTAREAVS

SEQ ID NO: 225581 - protein, 9 aa, Japanese encephalitis virus
STAREAVSD

SEQ ID NO: 225582 - protein, 9 aa, Japanese encephalitis virus
TAREAVNDP

SEQ ID NO: 225583 - protein, 9 aa, Japanese encephalitis virus
LWEMVDEER

SEQ ID NO: 225584 - protein, 9 aa, Japanese encephalitis virus
WEMVDVERE

SEQ ID NO: 225585 - protein, 9 aa, Japanese encephalitis virus
EMVDVEREN

SEQ ID NO: 225586 - protein, 9 aa, Japanese encephalitis virus
MVDVERENH

SEQ ID NO: 225587 - protein, 9 aa, Japanese encephalitis virus
VDVERENHL

SEQ ID NO: 225588 - protein, 9 aa, Japanese encephalitis virus
DVERENHLR

SEQ ID NO: 225589 - protein, 9 aa, Japanese encephalitis virus
LRGECHTRI

SEQ ID NO: 225590 - protein, 9 aa, Japanese encephalitis virus
RGECHTRIY

SEQ ID NO: 225591 - protein, 9 aa, Japanese encephalitis virus
GECHTRIYN

SEQ ID NO: 225592 - protein, 9 aa, Japanese encephalitis virus
ECHTRIYNM

SEQ ID NO: 225593 - protein, 9 aa, Japanese encephalitis virus
CHTCVYHMM

SEQ ID NO: 225594 - protein, 9 aa, Japanese encephalitis virus
HTCVYHMMG

SEQ ID NO: 225595 - protein, 9 aa, Japanese encephalitis virus
TCVYHMMGK

SEQ ID NO: 225596 - protein, 9 aa, Japanese encephalitis virus
RIYNMMGKR

SEQ ID NO: 225597 - protein, 9 aa, Japanese encephalitis virus
VYHMMGKRE

SEQ ID NO: 225598 - protein, 9 aa, Japanese encephalitis virus
FEALGSLNE

SEQ ID NO: 225599 - protein, 9 aa, Japanese encephalitis virus
EALGFLNLD

SEQ ID NO: 225600 - protein, 9 aa, Japanese encephalitis virus
ALGFLNLDH

SEQ ID NO: 225601 - protein, 9 aa, Japanese encephalitis virus
LGFLNLDHW

SEQ ID NO: 225602 - protein, 9 aa, Japanese encephalitis virus
GSLNEDHWL

SEQ ID NO: 225603 - protein, 9 aa, Japanese encephalitis virus
SLNEDHWLS

SEQ ID NO: 225604 - protein, 9 aa, Japanese encephalitis virus
LNENHWLSR

SEQ ID NO: 225605 - protein, 9 aa, Japanese encephalitis virus
NLDHWLSRE

SEQ ID NO: 225606 - protein, 9 aa, Japanese encephalitis virus
ENHWLSREN

SEQ ID NO: 225607 - protein, 9 aa, Japanese encephalitis virus
DHWLSRRNS

SEQ ID NO: 225608 - protein, 9 aa, Japanese encephalitis virus
HWLSRRNSG

SEQ ID NO: 225609 - protein, 9 aa, Japanese encephalitis virus
WLSRENSRG

SEQ ID NO: 225610 - protein, 9 aa, Japanese encephalitis virus
LSRENSRGG

SEQ ID NO: 225611 - protein, 9 aa, Japanese encephalitis virus
SRRNSGGGV

SEQ ID NO: 225612 - protein, 9 aa, Japanese encephalitis virus
RRNSGGGVE

SEQ ID NO: 225613 - protein, 9 aa, Japanese encephalitis virus
ENSRGGVEG

SEQ ID NO: 225614 - protein, 9 aa, Japanese encephalitis virus
NSRGGVEGS

SEQ ID NO: 225615 - protein, 9 aa, Japanese encephalitis virus
SGGGEEGSG

SEQ ID NO: 225616 - protein, 9 aa, Japanese encephalitis virus
GGGEEGSGV

SEQ ID NO: 225617 - protein, 9 aa, Japanese encephalitis virus
GGVEGLGVQ

SEQ ID NO: 225618 - protein, 9 aa, Japanese encephalitis virus
GVEGLGVQK

SEQ ID NO: 225619 - protein, 9 aa, Japanese encephalitis virus
EEGSGVQKL

SEQ ID NO: 225620 - protein, 9 aa, Japanese encephalitis virus
EGLGVQKLG

SEQ ID NO: 225621 - protein, 9 aa, Japanese encephalitis virus
GLGVQKLGY

SEQ ID NO: 225622 - protein, 9 aa, Japanese encephalitis virus
LGVQKLGYI

SEQ ID NO: 225623 - protein, 9 aa, Japanese encephalitis virus
GVQKLGYIF

SEQ ID NO: 225624 - protein, 9 aa, Japanese encephalitis virus
VQKLGYIFR

SEQ ID NO: 225625 - protein, 9 aa, Japanese encephalitis virus
QKLGYIFRD

SEQ ID NO: 225626 - protein, 9 aa, Japanese encephalitis virus
KLGYIIRDI

SEQ ID NO: 225627 - protein, 9 aa, Japanese encephalitis virus
LGYISGDIT

SEQ ID NO: 225628 - protein, 9 aa, Japanese encephalitis virus
RDIAVKQGG

SEQ ID NO: 225629 - protein, 9 aa, Japanese encephalitis virus
DITSRAIGK

SEQ ID NO: 225630 - protein, 9 aa, Japanese encephalitis virus
ITSRAIGKM

SEQ ID NO: 225631 - protein, 9 aa, Japanese encephalitis virus
AVKQGGKMY

SEQ ID NO: 225632 - protein, 9 aa, Japanese encephalitis virus
SRAIGKMYA

SEQ ID NO: 225633 - protein, 9 aa, Japanese encephalitis virus
RAIGKMYAD

SEQ ID NO: 225634 - protein, 9 aa, Japanese encephalitis virus
EGGKMYADD

SEQ ID NO: 225635 - protein, 9 aa, Japanese encephalitis virus
GGKMYADDP

SEQ ID NO: 225636 - protein, 9 aa, Japanese encephalitis virus
GWDTRITKT

SEQ ID NO: 225637 - protein, 9 aa, Japanese encephalitis virus
WDTRITKTD

SEQ ID NO: 225638 - protein, 9 aa, Japanese encephalitis virus
DTRITKTDL

SEQ ID NO: 225639 - protein, 9 aa, Japanese encephalitis virus
TRITKTDLE

SEQ ID NO: 225640 - protein, 9 aa, Japanese encephalitis virus
RITKTDLEN

SEQ ID NO: 225641 - protein, 9 aa, Japanese encephalitis virus
ITKTDLENE

SEQ ID NO: 225642 - protein, 9 aa, Japanese encephalitis virus
TKTDLENEA

SEQ ID NO: 225643 - protein, 9 aa, Japanese encephalitis virus
KTDLENEAK

SEQ ID NO: 225644 - protein, 9 aa, Japanese encephalitis virus
IIELTYRHQ

SEQ ID NO: 225645 - protein, 9 aa, Japanese encephalitis virus
IELTYKHKV

SEQ ID NO: 225646 - protein, 9 aa, Japanese encephalitis virus
ELTYKHKVV

SEQ ID NO: 225647 - protein, 9 aa, Japanese encephalitis virus
LTYKHKVVK

SEQ ID NO: 225648 - protein, 9 aa, Japanese encephalitis virus
TYRHQVFKV

SEQ ID NO: 225649 - protein, 9 aa, Japanese encephalitis virus
YRHQVFKVM

SEQ ID NO: 225650 - protein, 9 aa, Japanese encephalitis virus
RHQVFKVMR

SEQ ID NO: 225651 - protein, 9 aa, Japanese encephalitis virus
KVVKVMRPS

SEQ ID NO: 225652 - protein, 9 aa, Japanese encephalitis virus
VVKVMRPAS

SEQ ID NO: 225653 - protein, 9 aa, Japanese encephalitis virus
KVMRPASGG

SEQ ID NO: 225654 - protein, 9 aa, Japanese encephalitis virus
VMRPAAKGK

SEQ ID NO: 225655 - protein, 9 aa, Japanese encephalitis virus
MRPAAKGKT

SEQ ID NO: 225656 - protein, 9 aa, Japanese encephalitis virus
RPAAKGKTG

SEQ ID NO: 225657 - protein, 9 aa, Japanese encephalitis virus
PASGGKTVM

SEQ ID NO: 225658 - protein, 9 aa, Japanese encephalitis virus
DGKTVMDVI

SEQ ID NO: 225659 - protein, 9 aa, Japanese encephalitis virus
GKTVMVVYS

SEQ ID NO: 225660 - protein, 9 aa, Japanese encephalitis virus
KTGMAVISR

SEQ ID NO: 225661 - protein, 9 aa, Japanese encephalitis virus
TGMAVISRE

SEQ ID NO: 225662 - protein, 9 aa, Japanese encephalitis virus
GMAVISREN

SEQ ID NO: 225663 - protein, 9 aa, Japanese encephalitis virus
MAVISRENQ

SEQ ID NO: 225664 - protein, 9 aa, Japanese encephalitis virus
AVISRENQR

SEQ ID NO: 225665 - protein, 9 aa, Japanese encephalitis virus
VISRENQRG

SEQ ID NO: 225666 - protein, 9 aa, Japanese encephalitis virus
ISRENQRGS

SEQ ID NO: 225667 - protein, 9 aa, Japanese encephalitis virus
IAVQLVRLV

SEQ ID NO: 225668 - protein, 9 aa, Japanese encephalitis virus
AVQLVRLVE

SEQ ID NO: 225669 - protein, 9 aa, Japanese encephalitis virus
VQFVRLMKV

SEQ ID NO: 225670 - protein, 9 aa, Japanese encephalitis virus
QLVRLVEAE

SEQ ID NO: 225671 - protein, 9 aa, Japanese encephalitis virus
FVRLMKVEG

SEQ ID NO: 225672 - protein, 9 aa, Japanese encephalitis virus
VRLVEAEGV

SEQ ID NO: 225673 - protein, 9 aa, Japanese encephalitis virus
RLMKVEGVI

SEQ ID NO: 225674 - protein, 9 aa, Japanese encephalitis virus
LMKVEGVIG

SEQ ID NO: 225675 - protein, 9 aa, Japanese encephalitis virus
VEAEGVIGP

SEQ ID NO: 225676 - protein, 9 aa, Japanese encephalitis virus
VIGPQHVEQ

SEQ ID NO: 225677 - protein, 9 aa, Japanese encephalitis virus
IGPQHVEQL

SEQ ID NO: 225678 - protein, 9 aa, Japanese encephalitis virus
GPQHVEQLP

SEQ ID NO: 225679 - protein, 9 aa, Japanese encephalitis virus
PQHLEQLPK

SEQ ID NO: 225680 - protein, 9 aa, Japanese encephalitis virus
QHLEQLPRE

SEQ ID NO: 225681 - protein, 9 aa, Japanese encephalitis virus
EHLPRKNKI

SEQ ID NO: 225682 - protein, 9 aa, Japanese encephalitis virus
QLPKKNKIA

SEQ ID NO: 225683 - protein, 9 aa, Japanese encephalitis virus
LPKKNKIAV

SEQ ID NO: 225684 - protein, 9 aa, Japanese encephalitis virus
PKKNKIAVR

SEQ ID NO: 225685 - protein, 9 aa, Japanese encephalitis virus
RENKIAVRT

SEQ ID NO: 225686 - protein, 9 aa, Japanese encephalitis virus
ENKIAVRTW

SEQ ID NO: 225687 - protein, 9 aa, Japanese encephalitis virus
FENGGERVT

SEQ ID NO: 225688 - protein, 9 aa, Japanese encephalitis virus
ENGGERVTR

SEQ ID NO: 225689 - protein, 9 aa, Japanese encephalitis virus
NGGERVTRM

SEQ ID NO: 225690 - protein, 9 aa, Japanese encephalitis virus
GGERVTRMA

SEQ ID NO: 225691 - protein, 9 aa, Japanese encephalitis virus
GERVTRMAI

SEQ ID NO: 225692 - protein, 9 aa, Japanese encephalitis virus
DDRFATALY

SEQ ID NO: 225693 - protein, 9 aa, Japanese encephalitis virus
DRFATSLHF

SEQ ID NO: 225694 - protein, 9 aa, Japanese encephalitis virus
RFATSLHFL

SEQ ID NO: 225695 - protein, 9 aa, Japanese encephalitis virus
FATALYFLN

SEQ ID NO: 225696 - protein, 9 aa, Japanese encephalitis virus
ATSLHFLNA

SEQ ID NO: 225697 - protein, 9 aa, Japanese encephalitis virus
TALYFLNAM

SEQ ID NO: 225698 - protein, 9 aa, Japanese encephalitis virus
ALYFLNAMS

SEQ ID NO: 225699 - protein, 9 aa, Japanese encephalitis virus
LNAMSKVRR

SEQ ID NO: 225700 - protein, 9 aa, Japanese encephalitis virus
NAMSKVTKD

SEQ ID NO: 225701 - protein, 9 aa, Japanese encephalitis virus
AMSKVRRDI

SEQ ID NO: 225702 - protein, 9 aa, Japanese encephalitis virus
MSKVTKDIQ

SEQ ID NO: 225703 - protein, 9 aa, Japanese encephalitis virus
SKVRKDILE

SEQ ID NO: 225704 - protein, 9 aa, Japanese encephalitis virus
KVRKDILEW

SEQ ID NO: 225705 - protein, 9 aa, Japanese encephalitis virus
VTKDIQQWK

SEQ ID NO: 225706 - protein, 9 aa, Japanese encephalitis virus
RRDIQEWKP

SEQ ID NO: 225707 - protein, 9 aa, Japanese encephalitis virus
KDIQQWKPS

SEQ ID NO: 225708 - protein, 9 aa, Japanese encephalitis virus
DIQQWKPSH

SEQ ID NO: 225709 - protein, 9 aa, Japanese encephalitis virus
ILEWKPSHG

SEQ ID NO: 225710 - protein, 9 aa, Japanese encephalitis virus
LEWKPSHGW

SEQ ID NO: 225711 - protein, 9 aa, Japanese encephalitis virus
EWKPSHGWL

SEQ ID NO: 225712 - protein, 9 aa, Japanese encephalitis virus
PSHGWLDWQ

SEQ ID NO: 225713 - protein, 9 aa, Japanese encephalitis virus
SHGWLDWQQ

SEQ ID NO: 225714 - protein, 9 aa, Japanese encephalitis virus
HGWLDWQQV

SEQ ID NO: 225715 - protein, 9 aa, Japanese encephalitis virus
GWLDWQQVP

SEQ ID NO: 225716 - protein, 9 aa, Japanese encephalitis virus
WLDWQQVPF

SEQ ID NO: 225717 - protein, 9 aa, Japanese encephalitis virus
HDWLHVPFC

SEQ ID NO: 225718 - protein, 9 aa, Japanese encephalitis virus
MKDGRSIVD

SEQ ID NO: 225719 - protein, 9 aa, Japanese encephalitis virus
KDGRSIVDP

SEQ ID NO: 225720 - protein, 9 aa, Japanese encephalitis virus
DGRSIVDPC

SEQ ID NO: 225721 - protein, 9 aa, Japanese encephalitis virus
GRSIVDPCR

SEQ ID NO: 225722 - protein, 9 aa, Japanese encephalitis virus
RSLLVPCRG

SEQ ID NO: 225723 - protein, 9 aa, Japanese encephalitis virus
SIVDPCRGQ

SEQ ID NO: 225724 - protein, 9 aa, Japanese encephalitis virus
IVDPCRGQD

SEQ ID NO: 225725 - protein, 9 aa, Japanese encephalitis virus
LVPCRGQDE

SEQ ID NO: 225726 - protein, 9 aa, Japanese encephalitis virus
SPGAGWNVM

SEQ ID NO: 225727 - protein, 9 aa, Japanese encephalitis virus
PGAGWNVMD

SEQ ID NO: 225728 - protein, 9 aa, Japanese encephalitis virus
GAGWNVMDT

SEQ ID NO: 225729 - protein, 9 aa, Japanese encephalitis virus
AGWNVMDTA

SEQ ID NO: 225730 - protein, 9 aa, Japanese encephalitis virus
GWNVMDTAC

SEQ ID NO: 225731 - protein, 9 aa, Japanese encephalitis virus
WNVRDTACL

SEQ ID NO: 225732 - protein, 9 aa, Japanese encephalitis virus
NVMDTACLA

SEQ ID NO: 225733 - protein, 9 aa, Japanese encephalitis virus
VRDTACLAK

SEQ ID NO: 225734 - protein, 9 aa, Japanese encephalitis virus
KDTACLPKA

SEQ ID NO: 225735 - protein, 9 aa, Japanese encephalitis virus
LPKAYAQMW

SEQ ID NO: 225736 - protein, 9 aa, Japanese encephalitis virus
PKAYAQMWV

SEQ ID NO: 225737 - protein, 9 aa, Japanese encephalitis virus
KAYAQMWVL

SEQ ID NO: 225738 - protein, 9 aa, Japanese encephalitis virus
AYAQMWVLL

SEQ ID NO: 225739 - protein, 9 aa, Japanese encephalitis virus
YAQMWVLLY

SEQ ID NO: 225740 - protein, 9 aa, Japanese encephalitis virus
AQMWVLLYF

SEQ ID NO: 225741 - protein, 9 aa, Japanese encephalitis virus
QMWVLLYFH

SEQ ID NO: 225742 - protein, 9 aa, Japanese encephalitis virus
MWVLLYFHR

SEQ ID NO: 225743 - protein, 9 aa, Japanese encephalitis virus
WVLLYFHRR

SEQ ID NO: 225744 - protein, 9 aa, Japanese encephalitis virus
VLLYFHRRD

SEQ ID NO: 225745 - protein, 9 aa, Japanese encephalitis virus
LLYFHRRDQ

SEQ ID NO: 225746 - protein, 9 aa, Japanese encephalitis virus
LYFHRRDQR

SEQ ID NO: 225747 - protein, 9 aa, Japanese encephalitis virus
YFHRRDQRL

SEQ ID NO: 225748 - protein, 9 aa, Japanese encephalitis virus
FHRRDLCLM

SEQ ID NO: 225749 - protein, 9 aa, Japanese encephalitis virus
HRRDQRLMA

SEQ ID NO: 225750 - protein, 9 aa, Japanese encephalitis virus
RRDLCLMAN

SEQ ID NO: 225751 - protein, 9 aa, Japanese encephalitis virus
RDQRLMANA

SEQ ID NO: 225752 - protein, 9 aa, Japanese encephalitis virus
DLCLMANAI

SEQ ID NO: 225753 - protein, 9 aa, Japanese encephalitis virus
QRLMANAIC

SEQ ID NO: 225754 - protein, 9 aa, Japanese encephalitis virus
NAICSTVPV

SEQ ID NO: 225755 - protein, 9 aa, Japanese encephalitis virus
AICSAVPLD

SEQ ID NO: 225756 - protein, 9 aa, Japanese encephalitis virus
ICSAVPVNW

SEQ ID NO: 225757 - protein, 9 aa, Japanese encephalitis virus
CSTVPVDWV

SEQ ID NO: 225758 - protein, 9 aa, Japanese encephalitis virus
SAVPVNWVP

SEQ ID NO: 225759 - protein, 9 aa, Japanese encephalitis virus
TVPVDWVPT

SEQ ID NO: 225760 - protein, 9 aa, Japanese encephalitis virus
VPVNWVPTG

SEQ ID NO: 225761 - protein, 9 aa, Japanese encephalitis virus
PVNWVPTGR

SEQ ID NO: 225762 - protein, 9 aa, Japanese encephalitis virus
VNWVPTGRT

SEQ ID NO: 225763 - protein, 9 aa, Japanese encephalitis virus
SIHSKGEWI

SEQ ID NO: 225764 - protein, 9 aa, Japanese encephalitis virus
IHSKGEWIP

SEQ ID NO: 225765 - protein, 9 aa, Japanese encephalitis virus
KGEWIPTED

SEQ ID NO: 225766 - protein, 9 aa, Japanese encephalitis virus
GEWIPTEDM

SEQ ID NO: 225767 - protein, 9 aa, Japanese encephalitis virus
EWIPTEDML

SEQ ID NO: 225768 - protein, 9 aa, Japanese encephalitis virus
WIPTEDMLQ

SEQ ID NO: 225769 - protein, 9 aa, Japanese encephalitis virus
IPTEDMLQV

SEQ ID NO: 225770 - protein, 9 aa, Japanese encephalitis virus
PTEDMLQVW

SEQ ID NO: 225771 - protein, 9 aa, Japanese encephalitis virus
WIEENEWMT

SEQ ID NO: 225772 - protein, 9 aa, Japanese encephalitis virus
IEENEWMTD

SEQ ID NO: 225773 - protein, 9 aa, Japanese encephalitis virus
EENEWMTDK

SEQ ID NO: 225774 - protein, 9 aa, Japanese encephalitis virus
ENEWMEDKT

SEQ ID NO: 225775 - protein, 9 aa, Japanese encephalitis virus
NEWMMDMTP

SEQ ID NO: 225776 - protein, 9 aa, Japanese encephalitis virus
DKTPIASWT

SEQ ID NO: 225777 - protein, 9 aa, Japanese encephalitis virus
KTPIASWTD

SEQ ID NO: 225778 - protein, 9 aa, Japanese encephalitis virus
TPIASWTDV

SEQ ID NO: 225779 - protein, 9 aa, Japanese encephalitis virus
PIASWTDVP

SEQ ID NO: 225780 - protein, 9 aa, Japanese encephalitis virus
IASWTDVPY

SEQ ID NO: 225781 - protein, 9 aa, Japanese encephalitis virus
CGSLIGTRA

SEQ ID NO: 225782 - protein, 9 aa, Japanese encephalitis virus
GSLIGTRSK

SEQ ID NO: 225783 - protein, 9 aa, Japanese encephalitis virus
SLIGTRSKA

SEQ ID NO: 225784 - protein, 9 aa, Japanese encephalitis virus
LIGTRSKAT

SEQ ID NO: 225785 - protein, 9 aa, Japanese encephalitis virus
IGTRSKATW

SEQ ID NO: 225786 - protein, 9 aa, Japanese encephalitis virus
GTRSKATWA

SEQ ID NO: 225787 - protein, 9 aa, Japanese encephalitis virus
TRSKATWAE

SEQ ID NO: 225788 - protein, 9 aa, Japanese encephalitis virus
RSKATWAEN

SEQ ID NO: 225789 - protein, 9 aa, Japanese encephalitis virus
SKATWAENI

SEQ ID NO: 225790 - protein, 9 aa, Japanese encephalitis virus
RATWAENVY

SEQ ID NO: 225791 - protein, 9 aa, Japanese encephalitis virus
AINQVRAIL

SEQ ID NO: 225792 - protein, 9 aa, Japanese encephalitis virus
INQVRAILG

SEQ ID NO: 225793 - protein, 9 aa, Japanese encephalitis virus
NQVRAILGK

SEQ ID NO: 225794 - protein, 9 aa, Japanese encephalitis virus
QVRAILGKE

SEQ ID NO: 225795 - protein, 9 aa, Japanese encephalitis virus
VRAIIGKET

SEQ ID NO: 225796 - protein, 9 aa, Japanese encephalitis virus
RAILGKENY

SEQ ID NO: 225797 - protein, 9 aa, Japanese encephalitis virus
AIIGKEDYV

SEQ ID NO: 225798 - protein, 9 aa, Japanese encephalitis virus
ILGKENYVD

SEQ ID NO: 225799 - protein, 9 aa, Japanese encephalitis virus
IGKEDYVDY

SEQ ID NO: 225800 - protein, 9 aa, Japanese encephalitis virus
GKETYVDYM

SEQ ID NO: 225801 - protein, 9 aa, Japanese encephalitis virus
KENYVDYML

SEQ ID NO: 225802 - protein, 9 aa, Japanese encephalitis virus
ETYVDYMTS

SEQ ID NO: 225803 - protein, 9 aa, Japanese encephalitis virus
DYVDYMTSL

SEQ ID NO: 225804 - protein, 9 aa, Japanese encephalitis virus
YVDYMLSLR

SEQ ID NO: 225805 - protein, 9 aa, Japanese encephalitis virus
VDYMLSLRR

SEQ ID NO: 225806 - protein, 9 aa, Japanese encephalitis virus
DYMDFPQRI

SEQ ID NO: 225807 - protein, 9 aa, Japanese encephalitis virus
YMDFPQRIE

SEQ ID NO: 225808 - protein, 9 aa, Japanese encephalitis virus
MDFPQRIED

SEQ ID NO: 225809 - protein, 9 aa, Japanese encephalitis virus
DFPQRIEDV

SEQ ID NO: 225810 - protein, 9 aa, Japanese encephalitis virus
FPQRIEDVL

SEQ ID NO: 225811 - protein, 9 aa, Japanese encephalitis virus
LRRYEDVLT

SEQ ID NO: 225812 - protein, 9 aa, Japanese encephalitis virus
QRIEDVLIQ

SEQ ID NO: 225813 - protein, 9 aa, Japanese encephalitis virus
RIEDVLIQE

SEQ ID NO: 225814 - protein, 9 aa, Japanese encephalitis virus
YEDVLTQED

SEQ ID NO: 225815 - protein, 9 aa, Japanese encephalitis virus
EDVLTQEDR

SEQ ID NO: 225816 - protein, 9 aa, Japanese encephalitis virus
DVSIQEDRV

SEQ ID NO: 225817 - protein, 9 aa, Japanese encephalitis virus
VLTQEDRVI

SEQ ID NO: 225818 - protein, 9 aa, Japanese encephalitis virus
KKPGGPGKS

SEQ ID NO: 225819 - protein, 9 aa, Japanese encephalitis virus
KPRGPGINR

SEQ ID NO: 225820 - protein, 9 aa, Japanese encephalitis virus
PGGPGKSRA

SEQ ID NO: 225821 - protein, 9 aa, Japanese encephalitis virus
RGPGINRAI

SEQ ID NO: 225822 - protein, 9 aa, Japanese encephalitis virus
GPGKSRAIN

SEQ ID NO: 225823 - protein, 9 aa, Japanese encephalitis virus
PGINRAIYM

SEQ ID NO: 225824 - protein, 9 aa, Japanese encephalitis virus
GKSRAINML

SEQ ID NO: 225825 - protein, 9 aa, Japanese encephalitis virus
KSRAINMLK

SEQ ID NO: 225826 - protein, 9 aa, Japanese encephalitis virus
LVGVKRVVI

SEQ ID NO: 225827 - protein, 9 aa, Japanese encephalitis virus
VGVKRVVIS

SEQ ID NO: 225828 - protein, 9 aa, Japanese encephalitis virus
RVKRVVMSL

SEQ ID NO: 225829 - protein, 9 aa, Japanese encephalitis virus
GPVRFVLAF

SEQ ID NO: 225830 - protein, 9 aa, Japanese encephalitis virus
PVRFVLAFI

SEQ ID NO: 225831 - protein, 9 aa, Japanese encephalitis virus
LRFVLALVS

SEQ ID NO: 225832 - protein, 9 aa, Japanese encephalitis virus
RFVLALVSF

SEQ ID NO: 225833 - protein, 9 aa, Japanese encephalitis virus
FVLALVSFF

SEQ ID NO: 225834 - protein, 9 aa, Japanese encephalitis virus
VLALVSFFK

SEQ ID NO: 225835 - protein, 9 aa, Japanese encephalitis virus
LAFITFFKF

SEQ ID NO: 225836 - protein, 9 aa, Japanese encephalitis virus
ALVSFFKFT

SEQ ID NO: 225837 - protein, 9 aa, Japanese encephalitis virus
FITFFKFTA

SEQ ID NO: 225838 - protein, 9 aa, Japanese encephalitis virus
ALLGRWRAL

SEQ ID NO: 225839 - protein, 9 aa, Japanese encephalitis virus
LLGRWRALE

SEQ ID NO: 225840 - protein, 9 aa, Japanese encephalitis virus
LGRWRALEK

SEQ ID NO: 225841 - protein, 9 aa, Japanese encephalitis virus
GRWRALEKS

SEQ ID NO: 225842 - protein, 9 aa, Japanese encephalitis virus
RWRALEKSV

SEQ ID NO: 225843 - protein, 9 aa, Japanese encephalitis virus
WKAVERSVA

SEQ ID NO: 225844 - protein, 9 aa, Japanese encephalitis virus
RALEKSVAM

SEQ ID NO: 225845 - protein, 9 aa, Japanese encephalitis virus
RELGTLIDT

SEQ ID NO: 225846 - protein, 9 aa, Japanese encephalitis virus
ELGILIDAV

SEQ ID NO: 225847 - protein, 9 aa, Japanese encephalitis virus
LGTLIDGVN

SEQ ID NO: 225848 - protein, 9 aa, Japanese encephalitis virus
GTLIDVVNK

SEQ ID NO: 225849 - protein, 9 aa, Japanese encephalitis virus
ILIDAVNKR

SEQ ID NO: 225850 - protein, 9 aa, Japanese encephalitis virus
LIDVVNKRG

SEQ ID NO: 225851 - protein, 9 aa, Japanese encephalitis virus
IDVVNKRGK

SEQ ID NO: 225852 - protein, 9 aa, Japanese encephalitis virus
DTVNKRGRK

SEQ ID NO: 225853 - protein, 9 aa, Japanese encephalitis virus
QNKRGGNER

SEQ ID NO: 225854 - protein, 9 aa, Japanese encephalitis virus
VGALKLSNF

SEQ ID NO: 225855 - protein, 9 aa, Japanese encephalitis virus
GALKLSNFQ

SEQ ID NO: 225856 - protein, 9 aa, Japanese encephalitis virus
ALKLSNFQG

SEQ ID NO: 225857 - protein, 9 aa, Japanese encephalitis virus
IKLSNFQGK

SEQ ID NO: 225858 - protein, 9 aa, Japanese encephalitis virus
TGNDPEDVD

SEQ ID NO: 225859 - protein, 9 aa, Japanese encephalitis virus
WCDHQEVYV

SEQ ID NO: 225860 - protein, 9 aa, Japanese encephalitis virus
CDNQEVYIQ

SEQ ID NO: 225861 - protein, 9 aa, Japanese encephalitis virus
DHQEVYVQY

SEQ ID NO: 225862 - protein, 9 aa, Japanese encephalitis virus
HQEVYVQYG

SEQ ID NO: 225863 - protein, 9 aa, Japanese encephalitis virus
RTSHSQTSR

SEQ ID NO: 225864 - protein, 9 aa, Japanese encephalitis virus
TRHSKRSKR

SEQ ID NO: 225865 - protein, 9 aa, Japanese encephalitis virus
SHSQTSRRS

SEQ ID NO: 225866 - protein, 9 aa, Japanese encephalitis virus
HSQTSRRSV

SEQ ID NO: 225867 - protein, 9 aa, Japanese encephalitis virus
SKRSKRSVS

SEQ ID NO: 225868 - protein, 9 aa, Japanese encephalitis virus
KRSKRSVSV

SEQ ID NO: 225869 - protein, 9 aa, Japanese encephalitis virus
TSRRSVSVH

SEQ ID NO: 225870 - protein, 9 aa, Japanese encephalitis virus
SRRSVSVHT

SEQ ID NO: 225871 - protein, 9 aa, Japanese encephalitis virus
KRSVSVQTH

SEQ ID NO: 225872 - protein, 9 aa, Japanese encephalitis virus
QTHGESSLE

SEQ ID NO: 225873 - protein, 9 aa, Japanese encephalitis virus
ERSLVNKKE

SEQ ID NO: 225874 - protein, 9 aa, Japanese encephalitis virus
SSLENKKEA

SEQ ID NO: 225875 - protein, 9 aa, Japanese encephalitis virus
VNKKKAWLD

SEQ ID NO: 225876 - protein, 9 aa, Japanese encephalitis virus
KKAWLDSTR

SEQ ID NO: 225877 - protein, 9 aa, Japanese encephalitis virus
EAWLDSTRA

SEQ ID NO: 225878 - protein, 9 aa, Japanese encephalitis virus
STKATRYLV

SEQ ID NO: 225879 - protein, 9 aa, Japanese encephalitis virus
TKATRYLVK

SEQ ID NO: 225880 - protein, 9 aa, Japanese encephalitis virus
KATRYLVKT

SEQ ID NO: 225881 - protein, 9 aa, Japanese encephalitis virus
LVKTENWIV

SEQ ID NO: 225882 - protein, 9 aa, Japanese encephalitis virus
VKTENWIVR

SEQ ID NO: 225883 - protein, 9 aa, Japanese encephalitis virus
VLGWMLGST

SEQ ID NO: 225884 - protein, 9 aa, Japanese encephalitis virus
LGWMLGSTN

SEQ ID NO: 225885 - protein, 9 aa, Japanese encephalitis virus
GWMLGSTNG

SEQ ID NO: 225886 - protein, 9 aa, Japanese encephalitis virus
GQRLGFTIL

SEQ ID NO: 225887 - protein, 9 aa, Japanese encephalitis virus
QRLGFTILL

SEQ ID NO: 225888 - protein, 9 aa, Japanese encephalitis virus
MGNRDFIER

SEQ ID NO: 225889 - protein, 9 aa, Japanese encephalitis virus
GNRDFIEGV

SEQ ID NO: 225890 - protein, 9 aa, Japanese encephalitis virus
NRDFIERAS

SEQ ID NO: 225891 - protein, 9 aa, Japanese encephalitis virus
RDFIERASG

SEQ ID NO: 225892 - protein, 9 aa, Japanese encephalitis virus
DFIERASGA

SEQ ID NO: 225893 - protein, 9 aa, Japanese encephalitis virus
FIERASGAT

SEQ ID NO: 225894 - protein, 9 aa, Japanese encephalitis virus
IQGASGATW

SEQ ID NO: 225895 - protein, 9 aa, Japanese encephalitis virus
ERASGATWV

SEQ ID NO: 225896 - protein, 9 aa, Japanese encephalitis virus
ANDKPTLDR

SEQ ID NO: 225897 - protein, 9 aa, Japanese encephalitis virus
NDKPTLDRR

SEQ ID NO: 225898 - protein, 9 aa, Japanese encephalitis virus
KPTLDVRMT

SEQ ID NO: 225899 - protein, 9 aa, Japanese encephalitis virus
VRMTNIEAS

SEQ ID NO: 225900 - protein, 9 aa, Japanese encephalitis virus
TGEAHNEKG

SEQ ID NO: 225901 - protein, 9 aa, Japanese encephalitis virus
GEAHNEKGA

SEQ ID NO: 225902 - protein, 9 aa, Japanese encephalitis virus
EAHNEKQAD

SEQ ID NO: 225903 - protein, 9 aa, Japanese encephalitis virus
AHNEKQADS

SEQ ID NO: 225904 - protein, 9 aa, Japanese encephalitis virus
HNKKRADSS

SEQ ID NO: 225905 - protein, 9 aa, Japanese encephalitis virus
NKKRADSSY

SEQ ID NO: 225906 - protein, 9 aa, Japanese encephalitis virus
EKQADSSYV

SEQ ID NO: 225907 - protein, 9 aa, Japanese encephalitis virus
RGWRNGCGL

SEQ ID NO: 225908 - protein, 9 aa, Japanese encephalitis virus
GWGKGCGLF

SEQ ID NO: 225909 - protein, 9 aa, Japanese encephalitis virus
WGNGCGLSG

SEQ ID NO: 225910 - protein, 9 aa, Japanese encephalitis virus
GNGCGLSGK

SEQ ID NO: 225911 - protein, 9 aa, Japanese encephalitis virus
NGCGLSGKG

SEQ ID NO: 225912 - protein, 9 aa, Japanese encephalitis virus
KFSCTNKAI

SEQ ID NO: 225913 - protein, 9 aa, Japanese encephalitis virus
FSCTSKATG

SEQ ID NO: 225914 - protein, 9 aa, Japanese encephalitis virus
SCTSKATGK

SEQ ID NO: 225915 - protein, 9 aa, Japanese encephalitis virus
TIQPENSKY

SEQ ID NO: 225916 - protein, 9 aa, Japanese encephalitis virus
IQPENSKYE

SEQ ID NO: 225917 - protein, 9 aa, Japanese encephalitis virus
QPENSKYEV

SEQ ID NO: 225918 - protein, 9 aa, Japanese encephalitis virus
PENSKYEVG

SEQ ID NO: 225919 - protein, 9 aa, Japanese encephalitis virus
KVGIFVHGA

SEQ ID NO: 225920 - protein, 9 aa, Japanese encephalitis virus
GNYSAQVGV

SEQ ID NO: 225921 - protein, 9 aa, Japanese encephalitis virus
NYTAQIGAS

SEQ ID NO: 225922 - protein, 9 aa, Japanese encephalitis virus
YTAQIGASQ

SEQ ID NO: 225923 - protein, 9 aa, Japanese encephalitis virus
SAQVGVSQA

SEQ ID NO: 225924 - protein, 9 aa, Japanese encephalitis virus
AQIGASQAA

SEQ ID NO: 225925 - protein, 9 aa, Japanese encephalitis virus
QVGASQAAR

SEQ ID NO: 225926 - protein, 9 aa, Japanese encephalitis virus
IGASQAAKF

SEQ ID NO: 225927 - protein, 9 aa, Japanese encephalitis virus
GASQAARFT

SEQ ID NO: 225928 - protein, 9 aa, Japanese encephalitis virus
VSQAAKFTV

SEQ ID NO: 225929 - protein, 9 aa, Japanese encephalitis virus
TVTPNAPST

SEQ ID NO: 225930 - protein, 9 aa, Japanese encephalitis virus
VTPNAPSVT

SEQ ID NO: 225931 - protein, 9 aa, Japanese encephalitis virus
TPNAPSVTL

SEQ ID NO: 225932 - protein, 9 aa, Japanese encephalitis virus
PNAPSVTLK

SEQ ID NO: 225933 - protein, 9 aa, Japanese encephalitis virus
NAPSVTLEL

SEQ ID NO: 225934 - protein, 9 aa, Japanese encephalitis virus
APSVTLELG

SEQ ID NO: 225935 - protein, 9 aa, Japanese encephalitis virus
PSVTLELGD

SEQ ID NO: 225936 - protein, 9 aa, Japanese encephalitis virus
TLKLGDFGE

SEQ ID NO: 225937 - protein, 9 aa, Japanese encephalitis virus
VMTVGSKSL

SEQ ID NO: 225938 - protein, 9 aa, Japanese encephalitis virus
MTVGSKSLL

SEQ ID NO: 225939 - protein, 9 aa, Japanese encephalitis virus
TVGPKSFLV

SEQ ID NO: 225940 - protein, 9 aa, Japanese encephalitis virus
VGSKSLLVH

SEQ ID NO: 225941 - protein, 9 aa, Japanese encephalitis virus
GSKSLLVHR

SEQ ID NO: 225942 - protein, 9 aa, Japanese encephalitis virus
PKSFLVHRE

SEQ ID NO: 225943 - protein, 9 aa, Japanese encephalitis virus
HDLALPWSS

SEQ ID NO: 225944 - protein, 9 aa, Japanese encephalitis virus
DLALPWSSP

SEQ ID NO: 225945 - protein, 9 aa, Japanese encephalitis virus
LALPWTSSS

SEQ ID NO: 225946 - protein, 9 aa, Japanese encephalitis virus
ALPWSSPSS

SEQ ID NO: 225947 - protein, 9 aa, Japanese encephalitis virus
LPWTSSSNT

SEQ ID NO: 225948 - protein, 9 aa, Japanese encephalitis virus
PWSSPSSTA

SEQ ID NO: 225949 - protein, 9 aa, Japanese encephalitis virus
WSSPSSTAW

SEQ ID NO: 225950 - protein, 9 aa, Japanese encephalitis virus
SSPSSTAWR

SEQ ID NO: 225951 - protein, 9 aa, Japanese encephalitis virus
VALGSQEGS

SEQ ID NO: 225952 - protein, 9 aa, Japanese encephalitis virus
ALGSREGGL

SEQ ID NO: 225953 - protein, 9 aa, Japanese encephalitis virus
LGSQERALH

SEQ ID NO: 225954 - protein, 9 aa, Japanese encephalitis virus
GSREGGLHQ

SEQ ID NO: 225955 - protein, 9 aa, Japanese encephalitis virus
SQEGSLHQA

SEQ ID NO: 225956 - protein, 9 aa, Japanese encephalitis virus
QERALHQAL

SEQ ID NO: 225957 - protein, 9 aa, Japanese encephalitis virus
EGSLHQALA

SEQ ID NO: 225958 - protein, 9 aa, Japanese encephalitis virus
RALHQALAG

SEQ ID NO: 225959 - protein, 9 aa, Japanese encephalitis virus
SLHQALAGA

SEQ ID NO: 225960 - protein, 9 aa, Japanese encephalitis virus
VVEYSNSVK

SEQ ID NO: 225961 - protein, 9 aa, Japanese encephalitis virus
VEYPSSVKL

SEQ ID NO: 225962 - protein, 9 aa, Japanese encephalitis virus
EYSNSVKLT

SEQ ID NO: 225963 - protein, 9 aa, Japanese encephalitis virus
YSNSVKLTS

SEQ ID NO: 225964 - protein, 9 aa, Japanese encephalitis virus
PSSVKLTSG

SEQ ID NO: 225965 - protein, 9 aa, Japanese encephalitis virus
GTTYGVCTE

SEQ ID NO: 225966 - protein, 9 aa, Japanese encephalitis virus
TTYGVCTEK

SEQ ID NO: 225967 - protein, 9 aa, Japanese encephalitis virus
TYGMCTENS

SEQ ID NO: 225968 - protein, 9 aa, Japanese encephalitis virus
YGMCTENSS

SEQ ID NO: 225969 - protein, 9 aa, Japanese encephalitis virus
GVCTEKFSF

SEQ ID NO: 225970 - protein, 9 aa, Japanese encephalitis virus
MCTENSSFR

SEQ ID NO: 225971 - protein, 9 aa, Japanese encephalitis virus
CTENSSFRK

SEQ ID NO: 225972 - protein, 9 aa, Japanese encephalitis virus
TENSSFRKN

SEQ ID NO: 225973 - protein, 9 aa, Japanese encephalitis virus
ENSSFRKNP

SEQ ID NO: 225974 - protein, 9 aa, Japanese encephalitis virus
VIELSYSGR

SEQ ID NO: 225975 - protein, 9 aa, Japanese encephalitis virus
IELSYSGRD

SEQ ID NO: 225976 - protein, 9 aa, Japanese encephalitis virus
ELLYSGSDG

SEQ ID NO: 225977 - protein, 9 aa, Japanese encephalitis virus
LSYSGSDGS

SEQ ID NO: 225978 - protein, 9 aa, Japanese encephalitis virus
SYSGRDGPC

SEQ ID NO: 225979 - protein, 9 aa, Japanese encephalitis virus
VSVVSLNDM

SEQ ID NO: 225980 - protein, 9 aa, Japanese encephalitis virus
SVVSLNDMT

SEQ ID NO: 225981 - protein, 9 aa, Japanese encephalitis virus
VANLNDMTP

SEQ ID NO: 225982 - protein, 9 aa, Japanese encephalitis virus
ASLNDMTPA

SEQ ID NO: 225983 - protein, 9 aa, Japanese encephalitis virus
NLNDMTPVG

SEQ ID NO: 225984 - protein, 9 aa, Japanese encephalitis virus
VATSSSNSQ

SEQ ID NO: 225985 - protein, 9 aa, Japanese encephalitis virus
ATSSANSKA

SEQ ID NO: 225986 - protein, 9 aa, Japanese encephalitis virus
TSSSNSQVL

SEQ ID NO: 225987 - protein, 9 aa, Japanese encephalitis virus
SSSNSKVLL

SEQ ID NO: 225988 - protein, 9 aa, Japanese encephalitis virus
SSNSKVLLE

SEQ ID NO: 225989 - protein, 9 aa, Japanese encephalitis virus
SNSKVLLEI

SEQ ID NO: 225990 - protein, 9 aa, Japanese encephalitis virus
NSKVLLEIE

SEQ ID NO: 225991 - protein, 9 aa, Japanese encephalitis virus
SKALVEMEP

SEQ ID NO: 225992 - protein, 9 aa, Japanese encephalitis virus
KALVEMEPP

SEQ ID NO: 225993 - protein, 9 aa, Japanese encephalitis virus
DSYIVVGMG

SEQ ID NO: 225994 - protein, 9 aa, Japanese encephalitis virus
KQINHHWYK

SEQ ID NO: 225995 - protein, 9 aa, Japanese encephalitis virus
HHRHKAGST

SEQ ID NO: 225996 - protein, 9 aa, Japanese encephalitis virus
HWYKAGSTL

SEQ ID NO: 225997 - protein, 9 aa, Japanese encephalitis virus
WHKPGSTLG

SEQ ID NO: 225998 - protein, 9 aa, Japanese encephalitis virus
HKPGSTLGK

SEQ ID NO: 225999 - protein, 9 aa, Japanese encephalitis virus
WDFGSIGGI

SEQ ID NO: 226000 - protein, 9 aa, Japanese encephalitis virus
DFGSIGGIF

SEQ ID NO: 226001 - protein, 9 aa, Japanese encephalitis virus
FGSIGGAFN

SEQ ID NO: 226002 - protein, 9 aa, Japanese encephalitis virus
GSIGGAFNS

SEQ ID NO: 226003 - protein, 9 aa, Japanese encephalitis virus
SIGGAFNSI

SEQ ID NO: 226004 - protein, 9 aa, Japanese encephalitis virus
IGRVFNSIG

SEQ ID NO: 226005 - protein, 9 aa, Japanese encephalitis virus
GRVFNSIGK

SEQ ID NO: 226006 - protein, 9 aa, Japanese encephalitis virus
GAFNSIGKA

SEQ ID NO: 226007 - protein, 9 aa, Japanese encephalitis virus
AFNSIGKAV

SEQ ID NO: 226008 - protein, 9 aa, Japanese encephalitis virus
ADTGSAIDI

SEQ ID NO: 226009 - protein, 9 aa, Japanese encephalitis virus
DTGSAIDIT

SEQ ID NO: 226010 - protein, 9 aa, Japanese encephalitis virus
TGCAIDVTR

SEQ ID NO: 226011 - protein, 9 aa, Japanese encephalitis virus
TRNQMRCGS

SEQ ID NO: 226012 - protein, 9 aa, Japanese encephalitis virus
AKIVHKAYK

SEQ ID NO: 226013 - protein, 9 aa, Japanese encephalitis virus
KIVHKAYKE

SEQ ID NO: 226014 - protein, 9 aa, Japanese encephalitis virus
IVHKAYKEG

SEQ ID NO: 226015 - protein, 9 aa, Japanese encephalitis virus
VHKAHMEGV

SEQ ID NO: 226016 - protein, 9 aa, Japanese encephalitis virus
HKAHMEGVC

SEQ ID NO: 226017 - protein, 9 aa, Japanese encephalitis virus
KAHMEGVCG

SEQ ID NO: 226018 - protein, 9 aa, Japanese encephalitis virus
AYKEGVCGI

SEQ ID NO: 226019 - protein, 9 aa, Japanese encephalitis virus
YKEGVCGIR

SEQ ID NO: 226020 - protein, 9 aa, Japanese encephalitis virus
MEGICGVRS

SEQ ID NO: 226021 - protein, 9 aa, Japanese encephalitis virus
TPKRLSMTQ

SEQ ID NO: 226022 - protein, 9 aa, Japanese encephalitis virus
KSILFAPEM

SEQ ID NO: 226023 - protein, 9 aa, Japanese encephalitis virus
SLLFAPELA

SEQ ID NO: 226024 - protein, 9 aa, Japanese encephalitis virus
LLFAPELAN

SEQ ID NO: 226025 - protein, 9 aa, Japanese encephalitis virus
ETKECPVVH

SEQ ID NO: 226026 - protein, 9 aa, Japanese encephalitis virus
TKECPDEQR

SEQ ID NO: 226027 - protein, 9 aa, Japanese encephalitis virus
KECPVVHRA

SEQ ID NO: 226028 - protein, 9 aa, Japanese encephalitis virus
ECPVVHRAW

SEQ ID NO: 226029 - protein, 9 aa, Japanese encephalitis virus
CPDEQRAWN

SEQ ID NO: 226030 - protein, 9 aa, Japanese encephalitis virus
PDEQRAWNS

SEQ ID NO: 226031 - protein, 9 aa, Japanese encephalitis virus
DEQRAWNSM

SEQ ID NO: 226032 - protein, 9 aa, Japanese encephalitis virus
ERRAWNSTQ

SEQ ID NO: 226033 - protein, 9 aa, Japanese encephalitis virus
QRAWNSMQI

SEQ ID NO: 226034 - protein, 9 aa, Japanese encephalitis virus
ENTDECDGT

SEQ ID NO: 226035 - protein, 9 aa, Japanese encephalitis virus
NTDECDGTI

SEQ ID NO: 226036 - protein, 9 aa, Japanese encephalitis virus
GTAIKGHVA

SEQ ID NO: 226037 - protein, 9 aa, Japanese encephalitis virus
TAIKGHVAV

SEQ ID NO: 226038 - protein, 9 aa, Japanese encephalitis virus
AVKGHVTVH

SEQ ID NO: 226039 - protein, 9 aa, Japanese encephalitis virus
VKGHVALHS

SEQ ID NO: 226040 - protein, 9 aa, Japanese encephalitis virus
KGHVALHSD

SEQ ID NO: 226041 - protein, 9 aa, Japanese encephalitis virus
GHVTVHSDV

SEQ ID NO: 226042 - protein, 9 aa, Japanese encephalitis virus
HVALHSDLS

SEQ ID NO: 226043 - protein, 9 aa, Japanese encephalitis virus
DVSYWIESR

SEQ ID NO: 226044 - protein, 9 aa, Japanese encephalitis virus
SYWIESHLN

SEQ ID NO: 226045 - protein, 9 aa, Japanese encephalitis virus
YWIESHLND

SEQ ID NO: 226046 - protein, 9 aa, Japanese encephalitis virus
NDTWKRERA

SEQ ID NO: 226047 - protein, 9 aa, Japanese encephalitis virus
DTRKLERAV

SEQ ID NO: 226048 - protein, 9 aa, Japanese encephalitis virus
SWKLERAVF

SEQ ID NO: 226049 - protein, 9 aa, Japanese encephalitis virus
WKRERAVFE

SEQ ID NO: 226050 - protein, 9 aa, Japanese encephalitis virus
LERLVFGEV

SEQ ID NO: 226051 - protein, 9 aa, Japanese encephalitis virus
ERAVFEEVK

SEQ ID NO: 226052 - protein, 9 aa, Japanese encephalitis virus
RAVFEEVKS

SEQ ID NO: 226053 - protein, 9 aa, Japanese encephalitis virus
AVFEEVKSC

SEQ ID NO: 226054 - protein, 9 aa, Japanese encephalitis virus
THTLWGDDA

SEQ ID NO: 226055 - protein, 9 aa, Japanese encephalitis virus
HTLWGDDAE

SEQ ID NO: 226056 - protein, 9 aa, Japanese encephalitis virus
TLWGDDAEE

SEQ ID NO: 226057 - protein, 9 aa, Japanese encephalitis virus
WGDDAEESE

SEQ ID NO: 226058 - protein, 9 aa, Japanese encephalitis virus
GDGVEESDL

SEQ ID NO: 226059 - protein, 9 aa, Japanese encephalitis virus
DGVEESDLV

SEQ ID NO: 226060 - protein, 9 aa, Japanese encephalitis virus
DAEESELII

SEQ ID NO: 226061 - protein, 9 aa, Japanese encephalitis virus
SDLVIPHTI

SEQ ID NO: 226062 - protein, 9 aa, Japanese encephalitis virus
ELIIPDTIA

SEQ ID NO: 226063 - protein, 9 aa, Japanese encephalitis virus
LIIPDTIAG

SEQ ID NO: 226064 - protein, 9 aa, Japanese encephalitis virus
IIPDTIAGP

SEQ ID NO: 226065 - protein, 9 aa, Japanese encephalitis virus
IPDTIAGPK

SEQ ID NO: 226066 - protein, 9 aa, Japanese encephalitis virus
PDTIAGPKS

SEQ ID NO: 226067 - protein, 9 aa, Japanese encephalitis virus
DTIAGPKSK

SEQ ID NO: 226068 - protein, 9 aa, Japanese encephalitis virus
KHNRREGYM

SEQ ID NO: 226069 - protein, 9 aa, Japanese encephalitis virus
HNRREGYMT

SEQ ID NO: 226070 - protein, 9 aa, Japanese encephalitis virus
NQREGYKTQ

SEQ ID NO: 226071 - protein, 9 aa, Japanese encephalitis virus
RREGYMTQN

SEQ ID NO: 226072 - protein, 9 aa, Japanese encephalitis virus
QNQGPWDED

SEQ ID NO: 226073 - protein, 9 aa, Japanese encephalitis virus
NQGPWDESG

SEQ ID NO: 226074 - protein, 9 aa, Japanese encephalitis virus
QGPWDESGI

SEQ ID NO: 226075 - protein, 9 aa, Japanese encephalitis virus
GPWDEKGIV

SEQ ID NO: 226076 - protein, 9 aa, Japanese encephalitis virus
PWDEKGIVL

SEQ ID NO: 226077 - protein, 9 aa, Japanese encephalitis virus
WDENGLVPG

SEQ ID NO: 226078 - protein, 9 aa, Japanese encephalitis virus
DENGLVPGL

SEQ ID NO: 226079 - protein, 9 aa, Japanese encephalitis virus
EKGIVLDFD

SEQ ID NO: 226080 - protein, 9 aa, Japanese encephalitis virus
SGIVLDFDY

SEQ ID NO: 226081 - protein, 9 aa, Japanese encephalitis virus
DCGKRGPSL

SEQ ID NO: 226082 - protein, 9 aa, Japanese encephalitis virus
CGKRAPWVR

SEQ ID NO: 226083 - protein, 9 aa, Japanese encephalitis virus
GKRGPSLRT

SEQ ID NO: 226084 - protein, 9 aa, Japanese encephalitis virus
KRAPWVRTT

SEQ ID NO: 226085 - protein, 9 aa, Japanese encephalitis virus
RAPWVRTTT

SEQ ID NO: 226086 - protein, 9 aa, Japanese encephalitis virus
APWVRTTTD

SEQ ID NO: 226087 - protein, 9 aa, Japanese encephalitis virus
PWVRTTTDI

SEQ ID NO: 226088 - protein, 9 aa, Japanese encephalitis virus
WVRTTTDIG

SEQ ID NO: 226089 - protein, 9 aa, Japanese encephalitis virus
VRTTTDIGK

SEQ ID NO: 226090 - protein, 9 aa, Japanese encephalitis virus
RNCSLPPLR

SEQ ID NO: 226091 - protein, 9 aa, Japanese encephalitis virus
SCTLPPLRF

SEQ ID NO: 226092 - protein, 9 aa, Japanese encephalitis virus
LPPLRFRTD

SEQ ID NO: 226093 - protein, 9 aa, Japanese encephalitis virus
PPLRFRTDN

SEQ ID NO: 226094 - protein, 9 aa, Japanese encephalitis virus
PLRFRTDNG

SEQ ID NO: 226095 - protein, 9 aa, Japanese encephalitis virus
LRFRTGSGC

SEQ ID NO: 226096 - protein, 9 aa, Japanese encephalitis virus
RFRTGSGCW

SEQ ID NO: 226097 - protein, 9 aa, Japanese encephalitis virus
WYGMEVRPV

SEQ ID NO: 226098 - protein, 9 aa, Japanese encephalitis virus
KHDEATLVR

SEQ ID NO: 226099 - protein, 9 aa, Japanese encephalitis virus
DETTLVRWQ

SEQ ID NO: 226100 - protein, 9 aa, Japanese encephalitis virus
ETTLVRSRV

SEQ ID NO: 226101 - protein, 9 aa, Japanese encephalitis virus
TLVRSRVDA

SEQ ID NO: 226102 - protein, 9 aa, Japanese encephalitis virus
SGEMIDPFQ

SEQ ID NO: 226103 - protein, 9 aa, Japanese encephalitis virus
GEMVDPFQM

SEQ ID NO: 226104 - protein, 9 aa, Japanese encephalitis virus
EMVDPFQMG

SEQ ID NO: 226105 - protein, 9 aa, Japanese encephalitis virus
AAVFAEANS

SEQ ID NO: 226106 - protein, 9 aa, Japanese encephalitis virus
AVFAEANSG

SEQ ID NO: 226107 - protein, 9 aa, Japanese encephalitis virus
VFAEANSGG

SEQ ID NO: 226108 - protein, 9 aa, Japanese encephalitis virus
IQPAFLAMN

SEQ ID NO: 226109 - protein, 9 aa, Japanese encephalitis virus
QPAFLVANM

SEQ ID NO: 226110 - protein, 9 aa, Japanese encephalitis virus
PAFLVANML

SEQ ID NO: 226111 - protein, 9 aa, Japanese encephalitis virus
AFLVANMLS

SEQ ID NO: 226112 - protein, 9 aa, Japanese encephalitis virus
FLAMKMLST

SEQ ID NO: 226113 - protein, 9 aa, Japanese encephalitis virus
KMLSTRWTN

SEQ ID NO: 226114 - protein, 9 aa, Japanese encephalitis virus
MLSAKWTNQ

SEQ ID NO: 226115 - protein, 9 aa, Japanese encephalitis virus
KWTNQENMV

SEQ ID NO: 226116 - protein, 9 aa, Japanese encephalitis virus
WTNQENVIL

SEQ ID NO: 226117 - protein, 9 aa, Japanese encephalitis virus
TNQENVILV

SEQ ID NO: 226118 - protein, 9 aa, Japanese encephalitis virus
NQENMVLVL

SEQ ID NO: 226119 - protein, 9 aa, Japanese encephalitis virus
QENMVLVLG

SEQ ID NO: 226120 - protein, 9 aa, Japanese encephalitis virus
ENMVLVLGA

SEQ ID NO: 226121 - protein, 9 aa, Japanese encephalitis virus
NVILVLGAA

SEQ ID NO: 226122 - protein, 9 aa, Japanese encephalitis virus
VILVLGAAF

SEQ ID NO: 226123 - protein, 9 aa, Japanese encephalitis virus
ILVLGAAFF

SEQ ID NO: 226124 - protein, 9 aa, Japanese encephalitis virus
AAFFQLASM

SEQ ID NO: 226125 - protein, 9 aa, Japanese encephalitis virus
AFFQLASMD

SEQ ID NO: 226126 - protein, 9 aa, Japanese encephalitis virus
FFQLASMDL

SEQ ID NO: 226127 - protein, 9 aa, Japanese encephalitis virus
ITFPTTSTI

SEQ ID NO: 226128 - protein, 9 aa, Japanese encephalitis virus
TFPTTSTVT

SEQ ID NO: 226129 - protein, 9 aa, Japanese encephalitis virus
FPTTSTVTM

SEQ ID NO: 226130 - protein, 9 aa, Japanese encephalitis virus
PTTSTITMP

SEQ ID NO: 226131 - protein, 9 aa, Japanese encephalitis virus
MPVLTLLTP

SEQ ID NO: 226132 - protein, 9 aa, Japanese encephalitis virus
PVLTLLTPG

SEQ ID NO: 226133 - protein, 9 aa, Japanese encephalitis virus
VLTLLTPGM

SEQ ID NO: 226134 - protein, 9 aa, Japanese encephalitis virus
LALLAPGMR

SEQ ID NO: 226135 - protein, 9 aa, Japanese encephalitis virus
TLLTPGMRA

SEQ ID NO: 226136 - protein, 9 aa, Japanese encephalitis virus
LLTPGMRAF

SEQ ID NO: 226137 - protein, 9 aa, Japanese encephalitis virus
LTPGMRALC

SEQ ID NO: 226138 - protein, 9 aa, Japanese encephalitis virus
APGMRALYL

SEQ ID NO: 226139 - protein, 9 aa, Japanese encephalitis virus
PGMRAFDLD

SEQ ID NO: 226140 - protein, 9 aa, Japanese encephalitis virus
GMRAFDLDT

SEQ ID NO: 226141 - protein, 9 aa, Japanese encephalitis virus
MRAFDLDTY

SEQ ID NO: 226142 - protein, 9 aa, Japanese encephalitis virus
RALCLDTYR

SEQ ID NO: 226143 - protein, 9 aa, Japanese encephalitis virus
LVIGICSLQ

SEQ ID NO: 226144 - protein, 9 aa, Japanese encephalitis virus
IIGVCSLLQ

SEQ ID NO: 226145 - protein, 9 aa, Japanese encephalitis virus
IGICSLQQE

SEQ ID NO: 226146 - protein, 9 aa, Japanese encephalitis virus
GICSLQQER

SEQ ID NO: 226147 - protein, 9 aa, Japanese encephalitis virus
ERRRTMAKK

SEQ ID NO: 226148 - protein, 9 aa, Japanese encephalitis virus
RRRTMAKKK

SEQ ID NO: 226149 - protein, 9 aa, Japanese encephalitis virus
EKTMAKKKG

SEQ ID NO: 226150 - protein, 9 aa, Japanese encephalitis virus
MWLEQAADI

SEQ ID NO: 226151 - protein, 9 aa, Japanese encephalitis virus
WLERAADVS

SEQ ID NO: 226152 - protein, 9 aa, Japanese encephalitis virus
LEQAADISW

SEQ ID NO: 226153 - protein, 9 aa, Japanese encephalitis virus
RAADVSWEM

SEQ ID NO: 226154 - protein, 9 aa, Japanese encephalitis virus
SWGMDAAIT

SEQ ID NO: 226155 - protein, 9 aa, Japanese encephalitis virus
WGMDAAITG

SEQ ID NO: 226156 - protein, 9 aa, Japanese encephalitis virus
EMGAAITGS

SEQ ID NO: 226157 - protein, 9 aa, Japanese encephalitis virus
PWKIWLLRM

SEQ ID NO: 226158 - protein, 9 aa, Japanese encephalitis virus
WKIWLLRMS

SEQ ID NO: 226159 - protein, 9 aa, Japanese encephalitis virus
KVWVLRTSC

SEQ ID NO: 226160 - protein, 9 aa, Japanese encephalitis virus
VWVLRMSCS

SEQ ID NO: 226161 - protein, 9 aa, Japanese encephalitis virus
WVLRMSCIC

SEQ ID NO: 226162 - protein, 9 aa, Japanese encephalitis virus
VLRMSCICL

SEQ ID NO: 226163 - protein, 9 aa, Japanese encephalitis virus
LRMSCIGLV

SEQ ID NO: 226164 - protein, 9 aa, Japanese encephalitis virus
RMSCICLAA

SEQ ID NO: 226165 - protein, 9 aa, Japanese encephalitis virus
MSCICLAAL

SEQ ID NO: 226166 - protein, 9 aa, Japanese encephalitis virus
SCSGLAALT

SEQ ID NO: 226167 - protein, 9 aa, Japanese encephalitis virus
CSGLAALTP

SEQ ID NO: 226168 - protein, 9 aa, Japanese encephalitis virus
SGLAALTPW

SEQ ID NO: 226169 - protein, 9 aa, Japanese encephalitis virus
AGVGVMYQN

SEQ ID NO: 226170 - protein, 9 aa, Japanese encephalitis virus
GVGVMYQNV

SEQ ID NO: 226171 - protein, 9 aa, Japanese encephalitis virus
VGVMYQNVF

SEQ ID NO: 226172 - protein, 9 aa, Japanese encephalitis virus
GVMYENVLH

SEQ ID NO: 226173 - protein, 9 aa, Japanese encephalitis virus
VIYENVFHT

SEQ ID NO: 226174 - protein, 9 aa, Japanese encephalitis virus
MYQNVFHTL

SEQ ID NO: 226175 - protein, 9 aa, Japanese encephalitis virus
YQNVFHTLW

SEQ ID NO: 226176 - protein, 9 aa, Japanese encephalitis virus
ENVLHTLWH

SEQ ID NO: 226177 - protein, 9 aa, Japanese encephalitis virus
SVFHTLWHT

SEQ ID NO: 226178 - protein, 9 aa, Japanese encephalitis virus
HPTRGAAIM

SEQ ID NO: 226179 - protein, 9 aa, Japanese encephalitis virus
PTRGAAIMS

SEQ ID NO: 226180 - protein, 9 aa, Japanese encephalitis virus
RGAAIMSGG

SEQ ID NO: 226181 - protein, 9 aa, Japanese encephalitis virus
GAAIMSGGG

SEQ ID NO: 226182 - protein, 9 aa, Japanese encephalitis virus
AAIMSGKGK

SEQ ID NO: 226183 - protein, 9 aa, Japanese encephalitis virus
AIMSGGGKL

SEQ ID NO: 226184 - protein, 9 aa, Japanese encephalitis virus
IMSGKGKLT

SEQ ID NO: 226185 - protein, 9 aa, Japanese encephalitis virus
MSGKGKLTP

SEQ ID NO: 226186 - protein, 9 aa, Japanese encephalitis virus
VIVVEQGKP

SEQ ID NO: 226187 - protein, 9 aa, Japanese encephalitis virus
IVVEPGKVA

SEQ ID NO: 226188 - protein, 9 aa, Japanese encephalitis virus
AVSIQTKPG

SEQ ID NO: 226189 - protein, 9 aa, Japanese encephalitis virus
SIQTKPGVF

SEQ ID NO: 226190 - protein, 9 aa, Japanese encephalitis virus
FQTKPGVFR

SEQ ID NO: 226191 - protein, 9 aa, Japanese encephalitis virus
QTKPGVFCT

SEQ ID NO: 226192 - protein, 9 aa, Japanese encephalitis virus
TKPGIFPPP

SEQ ID NO: 226193 - protein, 9 aa, Japanese encephalitis virus
KPGIFPPPF

SEQ ID NO: 226194 - protein, 9 aa, Japanese encephalitis virus
PGIFPTPFG

SEQ ID NO: 226195 - protein, 9 aa, Japanese encephalitis virus
PFGKVGTVS

SEQ ID NO: 226196 - protein, 9 aa, Japanese encephalitis virus
LGEVGAVSL

SEQ ID NO: 226197 - protein, 9 aa, Japanese encephalitis virus
GKVGTVSLD

SEQ ID NO: 226198 - protein, 9 aa, Japanese encephalitis virus
KVGTVSLDY

SEQ ID NO: 226199 - protein, 9 aa, Japanese encephalitis virus
DRQEEPIPE

SEQ ID NO: 226200 - protein, 9 aa, Japanese encephalitis virus
PVPEAYTPS

SEQ ID NO: 226201 - protein, 9 aa, Japanese encephalitis virus
VPEAYTPTM

SEQ ID NO: 226202 - protein, 9 aa, Japanese encephalitis virus
PEAYNPSML

SEQ ID NO: 226203 - protein, 9 aa, Japanese encephalitis virus
AYTPTMLRK

SEQ ID NO: 226204 - protein, 9 aa, Japanese encephalitis virus
MLKKKQMTV

SEQ ID NO: 226205 - protein, 9 aa, Japanese encephalitis virus
LKKKQMTVL

SEQ ID NO: 226206 - protein, 9 aa, Japanese encephalitis virus
KKKQMTVLD

SEQ ID NO: 226207 - protein, 9 aa, Japanese encephalitis virus
LHPGLGKTR

SEQ ID NO: 226208 - protein, 9 aa, Japanese encephalitis virus
PPGSGKTRK

SEQ ID NO: 226209 - protein, 9 aa, Japanese encephalitis virus
RKILPQTIK

SEQ ID NO: 226210 - protein, 9 aa, Japanese encephalitis virus
TIKDAIQQR

SEQ ID NO: 226211 - protein, 9 aa, Japanese encephalitis virus
RDAIQQRLR

SEQ ID NO: 226212 - protein, 9 aa, Japanese encephalitis virus
DLQDEIPDW

SEQ ID NO: 226213 - protein, 9 aa, Japanese encephalitis virus
LQDETPDRA

SEQ ID NO: 226214 - protein, 9 aa, Japanese encephalitis virus
QDEVPDRAW

SEQ ID NO: 226215 - protein, 9 aa, Japanese encephalitis virus
DEVPDRAWS

SEQ ID NO: 226216 - protein, 9 aa, Japanese encephalitis virus
ETPDRAWSS

SEQ ID NO: 226217 - protein, 9 aa, Japanese encephalitis virus
IPDWAWSSG

SEQ ID NO: 226218 - protein, 9 aa, Japanese encephalitis virus
WSTEYAGKT

SEQ ID NO: 226219 - protein, 9 aa, Japanese encephalitis virus
ITEYSGKTV

SEQ ID NO: 226220 - protein, 9 aa, Japanese encephalitis virus
SVEPTILEE

SEQ ID NO: 226221 - protein, 9 aa, Japanese encephalitis virus
VKPTILEKE

SEQ ID NO: 226222 - protein, 9 aa, Japanese encephalitis virus
KPIILEEGE

SEQ ID NO: 226223 - protein, 9 aa, Japanese encephalitis virus
HYGGATSEG

SEQ ID NO: 226224 - protein, 9 aa, Japanese encephalitis virus
GGATSEGDS

SEQ ID NO: 226225 - protein, 9 aa, Japanese encephalitis virus
GATSEDDGN

SEQ ID NO: 226226 - protein, 9 aa, Japanese encephalitis virus
PTSEDDSNL

SEQ ID NO: 226227 - protein, 9 aa, Japanese encephalitis virus
REKAFTMDV

SEQ ID NO: 226228 - protein, 9 aa, Japanese encephalitis virus
EKAFTMDVE

SEQ ID NO: 226229 - protein, 9 aa, Japanese encephalitis virus
KAFTMDVEY

SEQ ID NO: 226230 - protein, 9 aa, Japanese encephalitis virus
ALTMDGEYR

SEQ ID NO: 226231 - protein, 9 aa, Japanese encephalitis virus
FTMDVEYRL

SEQ ID NO: 226232 - protein, 9 aa, Japanese encephalitis virus
FASGKRSAV

SEQ ID NO: 226233 - protein, 9 aa, Japanese encephalitis virus
ASGKRSAVS

SEQ ID NO: 226234 - protein, 9 aa, Japanese encephalitis virus
SGKRSAVSF

SEQ ID NO: 226235 - protein, 9 aa, Japanese encephalitis virus
RSAVSFIEE

SEQ ID NO: 226236 - protein, 9 aa, Japanese encephalitis virus
SAVSFIEEP

SEQ ID NO: 226237 - protein, 9 aa, Japanese encephalitis virus
AISFIEVRG

SEQ ID NO: 226238 - protein, 9 aa, Japanese encephalitis virus
VSFIEEPGR

SEQ ID NO: 226239 - protein, 9 aa, Japanese encephalitis virus
LGRMPEHFA

SEQ ID NO: 226240 - protein, 9 aa, Japanese encephalitis virus
ATAEKGGKT

SEQ ID NO: 226241 - protein, 9 aa, Japanese encephalitis virus
TAEKGGKTH

SEQ ID NO: 226242 - protein, 9 aa, Japanese encephalitis virus
AEKSGKAHR

SEQ ID NO: 226243 - protein, 9 aa, Japanese encephalitis virus
EKGGKTHRM

SEQ ID NO: 226244 - protein, 9 aa, Japanese encephalitis virus
KGGKTHRMA

SEQ ID NO: 226245 - protein, 9 aa, Japanese encephalitis virus
ALETITLII

SEQ ID NO: 226246 - protein, 9 aa, Japanese encephalitis virus
LETITLTVA

SEQ ID NO: 226247 - protein, 9 aa, Japanese encephalitis virus
ETVTLIVAI

SEQ ID NO: 226248 - protein, 9 aa, Japanese encephalitis virus
AIAVMTGGF

SEQ ID NO: 226249 - protein, 9 aa, Japanese encephalitis virus
ITVMTRGFF

SEQ ID NO: 226250 - protein, 9 aa, Japanese encephalitis virus
TAMTGGFFL

SEQ ID NO: 226251 - protein, 9 aa, Japanese encephalitis virus
MMQRKGIEK

SEQ ID NO: 226252 - protein, 9 aa, Japanese encephalitis virus
KQRKGIGKM

SEQ ID NO: 226253 - protein, 9 aa, Japanese encephalitis virus
IPEPEKQRL

SEQ ID NO: 226254 - protein, 9 aa, Japanese encephalitis virus
PEPEKQRLQ

SEQ ID NO: 226255 - protein, 9 aa, Japanese encephalitis virus
EPEKQKSQT

SEQ ID NO: 226256 - protein, 9 aa, Japanese encephalitis virus
PEKQRSQTG

SEQ ID NO: 226257 - protein, 9 aa, Japanese encephalitis virus
EKQKSQTDN

SEQ ID NO: 226258 - protein, 9 aa, Japanese encephalitis virus
KQRLQTDNQ

SEQ ID NO: 226259 - protein, 9 aa, Japanese encephalitis virus
QKSQTDNQL

SEQ ID NO: 226260 - protein, 9 aa, Japanese encephalitis virus
RSQTGNQLA

SEQ ID NO: 226261 - protein, 9 aa, Japanese encephalitis virus
KADIKSMFA

SEQ ID NO: 226262 - protein, 9 aa, Japanese encephalitis virus
ADIKSMFAG

SEQ ID NO: 226263 - protein, 9 aa, Japanese encephalitis virus
DLKSMFVGK

SEQ ID NO: 226264 - protein, 9 aa, Japanese encephalitis virus
KSMFVGKTQ

SEQ ID NO: 226265 - protein, 9 aa, Japanese encephalitis virus
SMFVGKTQA

SEQ ID NO: 226266 - protein, 9 aa, Japanese encephalitis virus
TQALGLTGL

SEQ ID NO: 226267 - protein, 9 aa, Japanese encephalitis virus
QALGLTGLP

SEQ ID NO: 226268 - protein, 9 aa, Japanese encephalitis virus
VSGMTGLPG

SEQ ID NO: 226269 - protein, 9 aa, Japanese encephalitis virus
SGMTGLPGM

SEQ ID NO: 226270 - protein, 9 aa, Japanese encephalitis virus
GLTGLPSVA

SEQ ID NO: 226271 - protein, 9 aa, Japanese encephalitis virus
LTGLPSMTL

SEQ ID NO: 226272 - protein, 9 aa, Japanese encephalitis virus
TGLPSMTLD

SEQ ID NO: 226273 - protein, 9 aa, Japanese encephalitis virus
GLPSVALDL

SEQ ID NO: 226274 - protein, 9 aa, Japanese encephalitis virus
LPGMALDLR

SEQ ID NO: 226275 - protein, 9 aa, Japanese encephalitis virus
PGMALDLRP

SEQ ID NO: 226276 - protein, 9 aa, Japanese encephalitis virus
GMALDLRPA

SEQ ID NO: 226277 - protein, 9 aa, Japanese encephalitis virus
WGQITLTTV

SEQ ID NO: 226278 - protein, 9 aa, Japanese encephalitis virus
GQITLTTVL

SEQ ID NO: 226279 - protein, 9 aa, Japanese encephalitis virus
QITLTTVLT

SEQ ID NO: 226280 - protein, 9 aa, Japanese encephalitis virus
ITLTTVLTA

SEQ ID NO: 226281 - protein, 9 aa, Japanese encephalitis virus
TLTTVLTAM

SEQ ID NO: 226282 - protein, 9 aa, Japanese encephalitis virus
LTTVLTAMV

SEQ ID NO: 226283 - protein, 9 aa, Japanese encephalitis virus
TTVLTAMVL

SEQ ID NO: 226284 - protein, 9 aa, Japanese encephalitis virus
LTAMVLAIL

SEQ ID NO: 226285 - protein, 9 aa, Japanese encephalitis virus
TAVVLTTLH

SEQ ID NO: 226286 - protein, 9 aa, Japanese encephalitis virus
AVVLTTLHY

SEQ ID NO: 226287 - protein, 9 aa, Japanese encephalitis virus
VVLTTLHYG

SEQ ID NO: 226288 - protein, 9 aa, Japanese encephalitis virus
VLATLHYGF

SEQ ID NO: 226289 - protein, 9 aa, Japanese encephalitis virus
LAILHYGYM

SEQ ID NO: 226290 - protein, 9 aa, Japanese encephalitis virus
ATLHYGFML

SEQ ID NO: 226291 - protein, 9 aa, Japanese encephalitis virus
AFLVNPNVS

SEQ ID NO: 226292 - protein, 9 aa, Japanese encephalitis virus
FLVNPKITT

SEQ ID NO: 226293 - protein, 9 aa, Japanese encephalitis virus
VNPKITTVR

SEQ ID NO: 226294 - protein, 9 aa, Japanese encephalitis virus
NPNVSTVRK

SEQ ID NO: 226295 - protein, 9 aa, Japanese encephalitis virus
PKITTVREA

SEQ ID NO: 226296 - protein, 9 aa, Japanese encephalitis virus
KITTVREAG

SEQ ID NO: 226297 - protein, 9 aa, Japanese encephalitis virus
VTTVKKPGV

SEQ ID NO: 226298 - protein, 9 aa, Japanese encephalitis virus
KPGVLVTAA

SEQ ID NO: 226299 - protein, 9 aa, Japanese encephalitis virus
IKNANKPSL

SEQ ID NO: 226300 - protein, 9 aa, Japanese encephalitis virus
KNADNPSLK

SEQ ID NO: 226301 - protein, 9 aa, Japanese encephalitis virus
NADNPSLKR

SEQ ID NO: 226302 - protein, 9 aa, Japanese encephalitis virus
ADNPSLKRG

SEQ ID NO: 226303 - protein, 9 aa, Japanese encephalitis virus
NKPSLKRGR

SEQ ID NO: 226304 - protein, 9 aa, Japanese encephalitis virus
NPSLKRGGP

SEQ ID NO: 226305 - protein, 9 aa, Japanese encephalitis virus
PSLKKGRPG

SEQ ID NO: 226306 - protein, 9 aa, Japanese encephalitis virus
SLKRGGPGG

SEQ ID NO: 226307 - protein, 9 aa, Japanese encephalitis virus
FKKGRPGGR

SEQ ID NO: 226308 - protein, 9 aa, Japanese encephalitis virus
KRGGPGGRT

SEQ ID NO: 226309 - protein, 9 aa, Japanese encephalitis virus
RGGPGGRTL

SEQ ID NO: 226310 - protein, 9 aa, Japanese encephalitis virus
GPGGRTLWE

SEQ ID NO: 226311 - protein, 9 aa, Japanese encephalitis virus
PGGRTLGDQ

SEQ ID NO: 226312 - protein, 9 aa, Japanese encephalitis virus
RTLGDQWKE

SEQ ID NO: 226313 - protein, 9 aa, Japanese encephalitis virus
TLGEQWKER

SEQ ID NO: 226314 - protein, 9 aa, Japanese encephalitis virus
LGEQWKERL

SEQ ID NO: 226315 - protein, 9 aa, Japanese encephalitis virus
GDQWKEKLN

SEQ ID NO: 226316 - protein, 9 aa, Japanese encephalitis virus
DQWKEKLNA

SEQ ID NO: 226317 - protein, 9 aa, Japanese encephalitis virus
QWKEKLNAL

SEQ ID NO: 226318 - protein, 9 aa, Japanese encephalitis virus
WKEKLNALS

SEQ ID NO: 226319 - protein, 9 aa, Japanese encephalitis virus
KRKLNAMGR

SEQ ID NO: 226320 - protein, 9 aa, Japanese encephalitis virus
KLNALSREE

SEQ ID NO: 226321 - protein, 9 aa, Japanese encephalitis virus
LNALSREEF

SEQ ID NO: 226322 - protein, 9 aa, Japanese encephalitis virus
NALSREEFF

SEQ ID NO: 226323 - protein, 9 aa, Japanese encephalitis virus
ALSREEFFK

SEQ ID NO: 226324 - protein, 9 aa, Japanese encephalitis virus
LSREEFFKY

SEQ ID NO: 226325 - protein, 9 aa, Japanese encephalitis virus
SREEFFQYR

SEQ ID NO: 226326 - protein, 9 aa, Japanese encephalitis virus
RRARRENNK

SEQ ID NO: 226327 - protein, 9 aa, Japanese encephalitis virus
RARSENNIV

SEQ ID NO: 226328 - protein, 9 aa, Japanese encephalitis virus
ARRENNKVG

SEQ ID NO: 226329 - protein, 9 aa, Japanese encephalitis virus
RSENNIVGG

SEQ ID NO: 226330 - protein, 9 aa, Japanese encephalitis virus
RENNKVGGH

SEQ ID NO: 226331 - protein, 9 aa, Japanese encephalitis virus
VDLGCGRGG

SEQ ID NO: 226332 - protein, 9 aa, Japanese encephalitis virus
CGCGGWSYY

SEQ ID NO: 226333 - protein, 9 aa, Japanese encephalitis virus
GRGGWSYCA

SEQ ID NO: 226334 - protein, 9 aa, Japanese encephalitis virus
CGGWSYYAA

SEQ ID NO: 226335 - protein, 9 aa, Japanese encephalitis virus
SYCAATLKK

SEQ ID NO: 226336 - protein, 9 aa, Japanese encephalitis virus
TLKRVQEVR

SEQ ID NO: 226337 - protein, 9 aa, Japanese encephalitis virus
LKRVQEVRG

SEQ ID NO: 226338 - protein, 9 aa, Japanese encephalitis virus
KRVQEVRGY

SEQ ID NO: 226339 - protein, 9 aa, Japanese encephalitis virus
RVQEVRGYT

SEQ ID NO: 226340 - protein, 9 aa, Japanese encephalitis virus
NRTVWRGPK

SEQ ID NO: 226341 - protein, 9 aa, Japanese encephalitis virus
AVWRGPKYE

SEQ ID NO: 226342 - protein, 9 aa, Japanese encephalitis virus
VGKGEVHST

SEQ ID NO: 226343 - protein, 9 aa, Japanese encephalitis virus
GKGEVHSTQ

SEQ ID NO: 226344 - protein, 9 aa, Japanese encephalitis virus
QDKIRRRIQ

SEQ ID NO: 226345 - protein, 9 aa, Japanese encephalitis virus
DKIRRRIQK

SEQ ID NO: 226346 - protein, 9 aa, Japanese encephalitis virus
KIKKRIQKQ

SEQ ID NO: 226347 - protein, 9 aa, Japanese encephalitis virus
IRRRIQKLR

SEQ ID NO: 226348 - protein, 9 aa, Japanese encephalitis virus
KKRIQKQKE

SEQ ID NO: 226349 - protein, 9 aa, Japanese encephalitis virus
KRIQKQKEE

SEQ ID NO: 226350 - protein, 9 aa, Japanese encephalitis virus
RIQKLREGF

SEQ ID NO: 226351 - protein, 9 aa, Japanese encephalitis virus
IQKQKEEFA

SEQ ID NO: 226352 - protein, 9 aa, Japanese encephalitis virus
QKLREEFGT

SEQ ID NO: 226353 - protein, 9 aa, Japanese encephalitis virus
KLREGFATT

SEQ ID NO: 226354 - protein, 9 aa, Japanese encephalitis virus
LREGFATTW

SEQ ID NO: 226355 - protein, 9 aa, Japanese encephalitis virus
REGFATTWH

SEQ ID NO: 226356 - protein, 9 aa, Japanese encephalitis virus
EEFATTWHR

SEQ ID NO: 226357 - protein, 9 aa, Japanese encephalitis virus
EFGTTWHKD

SEQ ID NO: 226358 - protein, 9 aa, Japanese encephalitis virus
FGTTWHKDP

SEQ ID NO: 226359 - protein, 9 aa, Japanese encephalitis virus
ATTWHKDHE

SEQ ID NO: 226360 - protein, 9 aa, Japanese encephalitis virus
RDPEHPYRT

SEQ ID NO: 226361 - protein, 9 aa, Japanese encephalitis virus
TKAPEPPPG

SEQ ID NO: 226362 - protein, 9 aa, Japanese encephalitis virus
EFIKKVNSS

SEQ ID NO: 226363 - protein, 9 aa, Japanese encephalitis virus
FIKKVNSSA

SEQ ID NO: 226364 - protein, 9 aa, Japanese encephalitis virus
KVNSSAALG

SEQ ID NO: 226365 - protein, 9 aa, Japanese encephalitis virus
VNSSAALGA

SEQ ID NO: 226366 - protein, 9 aa, Japanese encephalitis virus
NSNASLGTV

SEQ ID NO: 226367 - protein, 9 aa, Japanese encephalitis virus
SNASLGAVF

SEQ ID NO: 226368 - protein, 9 aa, Japanese encephalitis virus
DAALGAVFA

SEQ ID NO: 226369 - protein, 9 aa, Japanese encephalitis virus
WSTAREAVN

SEQ ID NO: 226370 - protein, 9 aa, Japanese encephalitis virus
STAREAVND

SEQ ID NO: 226371 - protein, 9 aa, Japanese encephalitis virus
TAREAVSDP

SEQ ID NO: 226372 - protein, 9 aa, Japanese encephalitis virus
FWEIVDEER

SEQ ID NO: 226373 - protein, 9 aa, Japanese encephalitis virus
WEIVDEERE

SEQ ID NO: 226374 - protein, 9 aa, Japanese encephalitis virus
EIVDEEREN

SEQ ID NO: 226375 - protein, 9 aa, Japanese encephalitis virus
IVDEERENH

SEQ ID NO: 226376 - protein, 9 aa, Japanese encephalitis virus
GECHTCVYH

SEQ ID NO: 226377 - protein, 9 aa, Japanese encephalitis virus
ECHTCVYHM

SEQ ID NO: 226378 - protein, 9 aa, Japanese encephalitis virus
CHTRIYNMM

SEQ ID NO: 226379 - protein, 9 aa, Japanese encephalitis virus
HTRIYNMMG

SEQ ID NO: 226380 - protein, 9 aa, Japanese encephalitis virus
TRIYNMMGK

SEQ ID NO: 226381 - protein, 9 aa, Japanese encephalitis virus
CVYHMMGKR

SEQ ID NO: 226382 - protein, 9 aa, Japanese encephalitis virus
EALGSLNED

SEQ ID NO: 226383 - protein, 9 aa, Japanese encephalitis virus
ALGFLNENH

SEQ ID NO: 226384 - protein, 9 aa, Japanese encephalitis virus
LGFLNENHW

SEQ ID NO: 226385 - protein, 9 aa, Japanese encephalitis virus
GFLNLDHWL

SEQ ID NO: 226386 - protein, 9 aa, Japanese encephalitis virus
FLNENHWLS

SEQ ID NO: 226387 - protein, 9 aa, Japanese encephalitis virus
NENHWLSRE

SEQ ID NO: 226388 - protein, 9 aa, Japanese encephalitis virus
LDHWLSREN

SEQ ID NO: 226389 - protein, 9 aa, Japanese encephalitis virus
SRENSRGGV

SEQ ID NO: 226390 - protein, 9 aa, Japanese encephalitis virus
RENSRGGVE

SEQ ID NO: 226391 - protein, 9 aa, Japanese encephalitis virus
RNSGGGVEG

SEQ ID NO: 226392 - protein, 9 aa, Japanese encephalitis virus
NSGGGEEGS

SEQ ID NO: 226393 - protein, 9 aa, Japanese encephalitis virus
SRGGVEGSS

SEQ ID NO: 226394 - protein, 9 aa, Japanese encephalitis virus
RGGVEGSSV

SEQ ID NO: 226395 - protein, 9 aa, Japanese encephalitis virus
GGEEGSGVQ

SEQ ID NO: 226396 - protein, 9 aa, Japanese encephalitis virus
GEEGSGVQK

SEQ ID NO: 226397 - protein, 9 aa, Japanese encephalitis virus
VEGLGVQKL

SEQ ID NO: 226398 - protein, 9 aa, Japanese encephalitis virus
GVQKLGYII

SEQ ID NO: 226399 - protein, 9 aa, Japanese encephalitis virus
VQKLGYIIR

SEQ ID NO: 226400 - protein, 9 aa, Japanese encephalitis virus
QKLGYIIRD

SEQ ID NO: 226401 - protein, 9 aa, Japanese encephalitis virus
KLGYIFRDI

SEQ ID NO: 226402 - protein, 9 aa, Japanese encephalitis virus
LGYIIRDIA

SEQ ID NO: 226403 - protein, 9 aa, Japanese encephalitis virus
GDITSRAIG

SEQ ID NO: 226404 - protein, 9 aa, Japanese encephalitis virus
DIARKEGGK

SEQ ID NO: 226405 - protein, 9 aa, Japanese encephalitis virus
IAVKQGGKM

SEQ ID NO: 226406 - protein, 9 aa, Japanese encephalitis virus
ARKEGGKMY

SEQ ID NO: 226407 - protein, 9 aa, Japanese encephalitis virus
RKEGGKMYA

SEQ ID NO: 226408 - protein, 9 aa, Japanese encephalitis virus
VVKVMRPST

SEQ ID NO: 226409 - protein, 9 aa, Japanese encephalitis virus
KVMRPSTDG

SEQ ID NO: 226410 - protein, 9 aa, Japanese encephalitis virus
VMRPSTDGK

SEQ ID NO: 226411 - protein, 9 aa, Japanese encephalitis virus
MRPSTDGKT

SEQ ID NO: 226412 - protein, 9 aa, Japanese encephalitis virus
RPASGGKTV

SEQ ID NO: 226413 - protein, 9 aa, Japanese encephalitis virus
PSTDGKTVM

SEQ ID NO: 226414 - protein, 9 aa, Japanese encephalitis virus
KGKTGMAVI

SEQ ID NO: 226415 - protein, 9 aa, Japanese encephalitis virus
PQHLEHLPR

SEQ ID NO: 226416 - protein, 9 aa, Japanese encephalitis virus
QHLEQLPKK

SEQ ID NO: 226417 - protein, 9 aa, Japanese encephalitis virus
EQLPRENKI

SEQ ID NO: 226418 - protein, 9 aa, Japanese encephalitis virus
HLPRKNKIA

SEQ ID NO: 226419 - protein, 9 aa, Japanese encephalitis virus
LPRENKIAV

SEQ ID NO: 226420 - protein, 9 aa, Japanese encephalitis virus
PRENKIAVR

SEQ ID NO: 226421 - protein, 9 aa, Japanese encephalitis virus
KKNKIAVRT

SEQ ID NO: 226422 - protein, 9 aa, Japanese encephalitis virus
MSKVRRDIQ

SEQ ID NO: 226423 - protein, 9 aa, Japanese encephalitis virus
SKVTKDIQQ

SEQ ID NO: 226424 - protein, 9 aa, Japanese encephalitis virus
KVRRDIQEW

SEQ ID NO: 226425 - protein, 9 aa, Japanese encephalitis virus
VRKDILEWK

SEQ ID NO: 226426 - protein, 9 aa, Japanese encephalitis virus
RKDILEWKP

SEQ ID NO: 226427 - protein, 9 aa, Japanese encephalitis virus
KDILEWKPS

SEQ ID NO: 226428 - protein, 9 aa, Japanese encephalitis virus
SPGAGWNVR

SEQ ID NO: 226429 - protein, 9 aa, Japanese encephalitis virus
PGAGWNVRD

SEQ ID NO: 226430 - protein, 9 aa, Japanese encephalitis virus
GAGWNVRDT

SEQ ID NO: 226431 - protein, 9 aa, Japanese encephalitis virus
AGWNVRDTA

SEQ ID NO: 226432 - protein, 9 aa, Japanese encephalitis virus
GWNVRDTAC

SEQ ID NO: 226433 - protein, 9 aa, Japanese encephalitis virus
WNVMDTACL

SEQ ID NO: 226434 - protein, 9 aa, Japanese encephalitis virus
NVRDTACLA

SEQ ID NO: 226435 - protein, 9 aa, Japanese encephalitis virus
VMDTACLAK

SEQ ID NO: 226436 - protein, 9 aa, Japanese encephalitis virus
RDTACLAKA

SEQ ID NO: 226437 - protein, 9 aa, Japanese encephalitis virus
LYFHRRDLC

SEQ ID NO: 226438 - protein, 9 aa, Japanese encephalitis virus
YFHRRDLCL

SEQ ID NO: 226439 - protein, 9 aa, Japanese encephalitis virus
FHRRDQRLM

SEQ ID NO: 226440 - protein, 9 aa, Japanese encephalitis virus
HRRDLCLMA

SEQ ID NO: 226441 - protein, 9 aa, Japanese encephalitis virus
RRDQRLMAN

SEQ ID NO: 226442 - protein, 9 aa, Japanese encephalitis virus
RDLCLMANA

SEQ ID NO: 226443 - protein, 9 aa, Japanese encephalitis virus
DQRLMANAI

SEQ ID NO: 226444 - protein, 9 aa, Japanese encephalitis virus
AICSTVPVD

SEQ ID NO: 226445 - protein, 9 aa, Japanese encephalitis virus
ICSAVPLDW

SEQ ID NO: 226446 - protein, 9 aa, Japanese encephalitis virus
CSAVPLDWV

SEQ ID NO: 226447 - protein, 9 aa, Japanese encephalitis virus
SAVPLDWVP

SEQ ID NO: 226448 - protein, 9 aa, Japanese encephalitis virus
AVPLDWVPT

SEQ ID NO: 226449 - protein, 9 aa, Japanese encephalitis virus
WIEENEWME

SEQ ID NO: 226450 - protein, 9 aa, Japanese encephalitis virus
IEENEWMED

SEQ ID NO: 226451 - protein, 9 aa, Japanese encephalitis virus
EENEWMMDM

SEQ ID NO: 226452 - protein, 9 aa, Japanese encephalitis virus
ENEWMMDMT

SEQ ID NO: 226453 - protein, 9 aa, Japanese encephalitis virus
NEWMTDKTP

SEQ ID NO: 226454 - protein, 9 aa, Japanese encephalitis virus
DMTPITSWT

SEQ ID NO: 226455 - protein, 9 aa, Japanese encephalitis virus
MTPITSWTD

SEQ ID NO: 226456 - protein, 9 aa, Japanese encephalitis virus
CGNLIGTRS

SEQ ID NO: 226457 - protein, 9 aa, Japanese encephalitis virus
GNLIGTRSR

SEQ ID NO: 226458 - protein, 9 aa, Japanese encephalitis virus
NLIGTRSRA

SEQ ID NO: 226459 - protein, 9 aa, Japanese encephalitis virus
LIGTRARAT

SEQ ID NO: 226460 - protein, 9 aa, Japanese encephalitis virus
IGTRARATW

SEQ ID NO: 226461 - protein, 9 aa, Japanese encephalitis virus
GTRARATWA

SEQ ID NO: 226462 - protein, 9 aa, Japanese encephalitis virus
TRARATWAE

SEQ ID NO: 226463 - protein, 9 aa, Japanese encephalitis virus
RARATWAEN

SEQ ID NO: 226464 - protein, 9 aa, Japanese encephalitis virus
SRATWAENV

SEQ ID NO: 226465 - protein, 9 aa, Japanese encephalitis virus
VRAIIGKED

SEQ ID NO: 226466 - protein, 9 aa, Japanese encephalitis virus
RAIIGKEDY

SEQ ID NO: 226467 - protein, 9 aa, Japanese encephalitis virus
AILGKENYV

SEQ ID NO: 226468 - protein, 9 aa, Japanese encephalitis virus
IIGKETYVD

SEQ ID NO: 226469 - protein, 9 aa, Japanese encephalitis virus
LGKENYVDY

SEQ ID NO: 226470 - protein, 9 aa, Japanese encephalitis virus
KEDYVDYMT

SEQ ID NO: 226471 - protein, 9 aa, Japanese encephalitis virus
ENYVDYMDF

SEQ ID NO: 226472 - protein, 9 aa, Japanese encephalitis virus
TYVDYMTSL

SEQ ID NO: 226473 - protein, 9 aa, Japanese encephalitis virus
LRRYEDVSI

SEQ ID NO: 226474 - protein, 9 aa, Japanese encephalitis virus
RRYEDVSIQ

SEQ ID NO: 226475 - protein, 9 aa, Japanese encephalitis virus
RYEDVLTQE

SEQ ID NO: 226476 - protein, 9 aa, Japanese encephalitis virus
YEDVSIQED

SEQ ID NO: 226477 - protein, 9 aa, Japanese encephalitis virus
EDVSIQEDR

SEQ ID NO: 226478 - protein, 9 aa, Japanese encephalitis virus
DVLTQEDRV

SEQ ID NO: 226479 - protein, 9 aa, Japanese encephalitis virus
VSIQEDRVI

SEQ ID NO: 226480 - protein, 9 aa, Japanese encephalitis virus
PLRFVLALV

SEQ ID NO: 226481 - protein, 9 aa, Japanese encephalitis virus
VRFVLAFIT

SEQ ID NO: 226482 - protein, 9 aa, Japanese encephalitis virus
SGRWKAVER

SEQ ID NO: 226483 - protein, 9 aa, Japanese encephalitis virus
RELGTLIDV

SEQ ID NO: 226484 - protein, 9 aa, Japanese encephalitis virus
ELGTLIDGV

SEQ ID NO: 226485 - protein, 9 aa, Japanese encephalitis virus
LGTLIDVVN

SEQ ID NO: 226486 - protein, 9 aa, Japanese encephalitis virus
GTLIDGVNK

SEQ ID NO: 226487 - protein, 9 aa, Japanese encephalitis virus
TLIDTVNKR

SEQ ID NO: 226488 - protein, 9 aa, Japanese encephalitis virus
IDTVNKRGR

SEQ ID NO: 226489 - protein, 9 aa, Japanese encephalitis virus
DGVNKRGRK

SEQ ID NO: 226490 - protein, 9 aa, Japanese encephalitis virus
RNKRGGNEG

SEQ ID NO: 226491 - protein, 9 aa, Japanese encephalitis virus
AGAIKLSNF

SEQ ID NO: 226492 - protein, 9 aa, Japanese encephalitis virus
PGNDPQDVD

SEQ ID NO: 226493 - protein, 9 aa, Japanese encephalitis virus
SKRSVSVQT

SEQ ID NO: 226494 - protein, 9 aa, Japanese encephalitis virus
TLGWMLGSN

SEQ ID NO: 226495 - protein, 9 aa, Japanese encephalitis virus
PRVVFTILL

SEQ ID NO: 226496 - protein, 9 aa, Japanese encephalitis virus
GNRDFIERA

SEQ ID NO: 226497 - protein, 9 aa, Japanese encephalitis virus
NRDFIQGAS

SEQ ID NO: 226498 - protein, 9 aa, Japanese encephalitis virus
RDFVEGASG

SEQ ID NO: 226499 - protein, 9 aa, Japanese encephalitis virus
DFIQGASGA

SEQ ID NO: 226500 - protein, 9 aa, Japanese encephalitis virus
FVEGASGAT

SEQ ID NO: 226501 - protein, 9 aa, Japanese encephalitis virus
IEGVSGATW

SEQ ID NO: 226502 - protein, 9 aa, Japanese encephalitis virus
GWRNGCGLF

SEQ ID NO: 226503 - protein, 9 aa, Japanese encephalitis virus
WRNGCGLFG

SEQ ID NO: 226504 - protein, 9 aa, Japanese encephalitis virus
GKGCGLFGK

SEQ ID NO: 226505 - protein, 9 aa, Japanese encephalitis virus
FSCTSKAIE

SEQ ID NO: 226506 - protein, 9 aa, Japanese encephalitis virus
SCTSKAIER

SEQ ID NO: 226507 - protein, 9 aa, Japanese encephalitis virus
AIQPENIKY

SEQ ID NO: 226508 - protein, 9 aa, Japanese encephalitis virus
QIGASQAAK

SEQ ID NO: 226509 - protein, 9 aa, Japanese encephalitis virus
VGVSQAAKF

SEQ ID NO: 226510 - protein, 9 aa, Japanese encephalitis virus
ASQAARFTV

SEQ ID NO: 226511 - protein, 9 aa, Japanese encephalitis virus
VTPNAPSVA

SEQ ID NO: 226512 - protein, 9 aa, Japanese encephalitis virus
PNAPSVTLE

SEQ ID NO: 226513 - protein, 9 aa, Japanese encephalitis virus
NAPSVTLKL

SEQ ID NO: 226514 - protein, 9 aa, Japanese encephalitis virus
APSVTLKLG

SEQ ID NO: 226515 - protein, 9 aa, Japanese encephalitis virus
PSVTLKLGD

SEQ ID NO: 226516 - protein, 9 aa, Japanese encephalitis virus
DLALPWTSS

SEQ ID NO: 226517 - protein, 9 aa, Japanese encephalitis virus
LALPWSSPS

SEQ ID NO: 226518 - protein, 9 aa, Japanese encephalitis virus
ALPWTSSSN

SEQ ID NO: 226519 - protein, 9 aa, Japanese encephalitis virus
GSQERALHQ

SEQ ID NO: 226520 - protein, 9 aa, Japanese encephalitis virus
SQERALHQA

SEQ ID NO: 226521 - protein, 9 aa, Japanese encephalitis virus
QEGSLHQAL

SEQ ID NO: 226522 - protein, 9 aa, Japanese encephalitis virus
TTYGMCTEN

SEQ ID NO: 226523 - protein, 9 aa, Japanese encephalitis virus
TYGVCTEKF

SEQ ID NO: 226524 - protein, 9 aa, Japanese encephalitis virus
YGVCTEKFS

SEQ ID NO: 226525 - protein, 9 aa, Japanese encephalitis virus
GMCTENSSF

SEQ ID NO: 226526 - protein, 9 aa, Japanese encephalitis virus
VCTEKFSFA

SEQ ID NO: 226527 - protein, 9 aa, Japanese encephalitis virus
LSYSGRDGP

SEQ ID NO: 226528 - protein, 9 aa, Japanese encephalitis virus
LYSGSDGPC

SEQ ID NO: 226529 - protein, 9 aa, Japanese encephalitis virus
VSLNDMTPV

SEQ ID NO: 226530 - protein, 9 aa, Japanese encephalitis virus
ATSSSNSQV

SEQ ID NO: 226531 - protein, 9 aa, Japanese encephalitis virus
TSSANSKAL

SEQ ID NO: 226532 - protein, 9 aa, Japanese encephalitis virus
SSANSKALV

SEQ ID NO: 226533 - protein, 9 aa, Japanese encephalitis virus
SSNSQVLVE

SEQ ID NO: 226534 - protein, 9 aa, Japanese encephalitis virus
SNSQVLVEM

SEQ ID NO: 226535 - protein, 9 aa, Japanese encephalitis virus
DSYIVIGRG

SEQ ID NO: 226536 - protein, 9 aa, Japanese encephalitis virus
KQINHHRHK

SEQ ID NO: 226537 - protein, 9 aa, Japanese encephalitis virus
HHWYKAGST

SEQ ID NO: 226538 - protein, 9 aa, Japanese encephalitis virus
HWHKPGSTL

SEQ ID NO: 226539 - protein, 9 aa, Japanese encephalitis virus
RHKAGSTLG

SEQ ID NO: 226540 - protein, 9 aa, Japanese encephalitis virus
GGAFNSIGK

SEQ ID NO: 226541 - protein, 9 aa, Japanese encephalitis virus
RVFNSIGKA

SEQ ID NO: 226542 - protein, 9 aa, Japanese encephalitis virus
DTGCAIDVT

SEQ ID NO: 226543 - protein, 9 aa, Japanese encephalitis virus
TGSAIDITR

SEQ ID NO: 226544 - protein, 9 aa, Japanese encephalitis virus
VHKAHMEGI

SEQ ID NO: 226545 - protein, 9 aa, Japanese encephalitis virus
HKAYKEGVC

SEQ ID NO: 226546 - protein, 9 aa, Japanese encephalitis virus
KAYKEGVCG

SEQ ID NO: 226547 - protein, 9 aa, Japanese encephalitis virus
AHMEGICGV

SEQ ID NO: 226548 - protein, 9 aa, Japanese encephalitis virus
HMEGVCGVR

SEQ ID NO: 226549 - protein, 9 aa, Japanese encephalitis virus
MEGVCGVRS

SEQ ID NO: 226550 - protein, 9 aa, Japanese encephalitis virus
DERRAWNST

SEQ ID NO: 226551 - protein, 9 aa, Japanese encephalitis virus
EQRAWNSMQ

SEQ ID NO: 226552 - protein, 9 aa, Japanese encephalitis virus
ETTDECDGA

SEQ ID NO: 226553 - protein, 9 aa, Japanese encephalitis virus
TTDECDGAI

SEQ ID NO: 226554 - protein, 9 aa, Japanese encephalitis virus
TAVKGHVTV

SEQ ID NO: 226555 - protein, 9 aa, Japanese encephalitis virus
AVKGHVALH

SEQ ID NO: 226556 - protein, 9 aa, Japanese encephalitis virus
VKGHVTVHS

SEQ ID NO: 226557 - protein, 9 aa, Japanese encephalitis virus
SYWIGSRYN

SEQ ID NO: 226558 - protein, 9 aa, Japanese encephalitis virus
YWIGSRYND

SEQ ID NO: 226559 - protein, 9 aa, Japanese encephalitis virus
NDTRKLERA

SEQ ID NO: 226560 - protein, 9 aa, Japanese encephalitis virus
DSWKLERAV

SEQ ID NO: 226561 - protein, 9 aa, Japanese encephalitis virus
TWKLERLVF

SEQ ID NO: 226562 - protein, 9 aa, Japanese encephalitis virus
QGPWDEKGI

SEQ ID NO: 226563 - protein, 9 aa, Japanese encephalitis virus
GPWDESGIV

SEQ ID NO: 226564 - protein, 9 aa, Japanese encephalitis virus
PWDEDGIVL

SEQ ID NO: 226565 - protein, 9 aa, Japanese encephalitis virus
WDESGIVLD

SEQ ID NO: 226566 - protein, 9 aa, Japanese encephalitis virus
DEDGIVLDF

SEQ ID NO: 226567 - protein, 9 aa, Japanese encephalitis virus
EDGIVLDFD

SEQ ID NO: 226568 - protein, 9 aa, Japanese encephalitis virus
DGIVLDFDY

SEQ ID NO: 226569 - protein, 9 aa, Japanese encephalitis virus
DCGKRAPWV

SEQ ID NO: 226570 - protein, 9 aa, Japanese encephalitis virus
CGKRGPSLR

SEQ ID NO: 226571 - protein, 9 aa, Japanese encephalitis virus
GKRAPWVRT

SEQ ID NO: 226572 - protein, 9 aa, Japanese encephalitis virus
GHDETTLVR

SEQ ID NO: 226573 - protein, 9 aa, Japanese encephalitis virus
EATLVRSQA

SEQ ID NO: 226574 - protein, 9 aa, Japanese encephalitis virus
TLVRWQVDA

SEQ ID NO: 226575 - protein, 9 aa, Japanese encephalitis virus
NGGMVDPFQ

SEQ ID NO: 226576 - protein, 9 aa, Japanese encephalitis virus
FLAMNTLST

SEQ ID NO: 226577 - protein, 9 aa, Japanese encephalitis virus
NTLSTRWTN

SEQ ID NO: 226578 - protein, 9 aa, Japanese encephalitis virus
MVLVLGAAF

SEQ ID NO: 226579 - protein, 9 aa, Japanese encephalitis virus
TFPTTSTIT

SEQ ID NO: 226580 - protein, 9 aa, Japanese encephalitis virus
FPTTSTITM

SEQ ID NO: 226581 - protein, 9 aa, Japanese encephalitis virus
PTTSTVTMP

SEQ ID NO: 226582 - protein, 9 aa, Japanese encephalitis virus
LTPGMRAFD

SEQ ID NO: 226583 - protein, 9 aa, Japanese encephalitis virus
TPGMRAFDL

SEQ ID NO: 226584 - protein, 9 aa, Japanese encephalitis virus
VIGICSLQQ

SEQ ID NO: 226585 - protein, 9 aa, Japanese encephalitis virus
EREKTMAKK

SEQ ID NO: 226586 - protein, 9 aa, Japanese encephalitis virus
REKTMAKKK

SEQ ID NO: 226587 - protein, 9 aa, Japanese encephalitis virus
RRTMAKKKG

SEQ ID NO: 226588 - protein, 9 aa, Japanese encephalitis virus
RAADISWGM

SEQ ID NO: 226589 - protein, 9 aa, Japanese encephalitis virus
SWEMGAAIT

SEQ ID NO: 226590 - protein, 9 aa, Japanese encephalitis virus
WEMGAAITG

SEQ ID NO: 226591 - protein, 9 aa, Japanese encephalitis virus
GMDAAITGS

SEQ ID NO: 226592 - protein, 9 aa, Japanese encephalitis virus
VWVLRTSCI

SEQ ID NO: 226593 - protein, 9 aa, Japanese encephalitis virus
WVLRTSCIG

SEQ ID NO: 226594 - protein, 9 aa, Japanese encephalitis virus
VLRTSCIGL

SEQ ID NO: 226595 - protein, 9 aa, Japanese encephalitis virus
LRTSCIGLA

SEQ ID NO: 226596 - protein, 9 aa, Japanese encephalitis virus
RMSCSGLAA

SEQ ID NO: 226597 - protein, 9 aa, Japanese encephalitis virus
MSCIGLVAL

SEQ ID NO: 226598 - protein, 9 aa, Japanese encephalitis virus
VGVIYENVF

SEQ ID NO: 226599 - protein, 9 aa, Japanese encephalitis virus
GVMYESVFH

SEQ ID NO: 226600 - protein, 9 aa, Japanese encephalitis virus
VMYENVLHT

SEQ ID NO: 226601 - protein, 9 aa, Japanese encephalitis virus
IYENVFHTL

SEQ ID NO: 226602 - protein, 9 aa, Japanese encephalitis virus
RGAAIMSGK

SEQ ID NO: 226603 - protein, 9 aa, Japanese encephalitis virus
GAAIMSGKG

SEQ ID NO: 226604 - protein, 9 aa, Japanese encephalitis virus
AAIMSGGGK

SEQ ID NO: 226605 - protein, 9 aa, Japanese encephalitis virus
AIMSGKGKL

SEQ ID NO: 226606 - protein, 9 aa, Japanese encephalitis virus
IMSGGGKLT

SEQ ID NO: 226607 - protein, 9 aa, Japanese encephalitis virus
VIVVEPGKV

SEQ ID NO: 226608 - protein, 9 aa, Japanese encephalitis virus
IVVEQGKPA

SEQ ID NO: 226609 - protein, 9 aa, Japanese encephalitis virus
ATNIQTKPG

SEQ ID NO: 226610 - protein, 9 aa, Japanese encephalitis virus
KPGIFPTPF

SEQ ID NO: 226611 - protein, 9 aa, Japanese encephalitis virus
PGIFPPPFG

SEQ ID NO: 226612 - protein, 9 aa, Japanese encephalitis virus
PFGKVGAVS

SEQ ID NO: 226613 - protein, 9 aa, Japanese encephalitis virus
FGKVGTVSL

SEQ ID NO: 226614 - protein, 9 aa, Japanese encephalitis virus
PIPEAYNPS

SEQ ID NO: 226615 - protein, 9 aa, Japanese encephalitis virus
IPEAYNPSM

SEQ ID NO: 226616 - protein, 9 aa, Japanese encephalitis virus
PEAYTPSML

SEQ ID NO: 226617 - protein, 9 aa, Japanese encephalitis virus
AYTPNMLKK

SEQ ID NO: 226618 - protein, 9 aa, Japanese encephalitis virus
SAISFIEVR

SEQ ID NO: 226619 - protein, 9 aa, Japanese encephalitis virus
ATSFIEVLG

SEQ ID NO: 226620 - protein, 9 aa, Japanese encephalitis virus
TSFIEVLGR

SEQ ID NO: 226621 - protein, 9 aa, Japanese encephalitis virus
ALETVTLIV

SEQ ID NO: 226622 - protein, 9 aa, Japanese encephalitis virus
LETITLIIA

SEQ ID NO: 226623 - protein, 9 aa, Japanese encephalitis virus
ETITLIIAI

SEQ ID NO: 226624 - protein, 9 aa, Japanese encephalitis virus
PEKQKSQTD

SEQ ID NO: 226625 - protein, 9 aa, Japanese encephalitis virus
EKQRLQTDN

SEQ ID NO: 226626 - protein, 9 aa, Japanese encephalitis virus
DIKSMFAGK

SEQ ID NO: 226627 - protein, 9 aa, Japanese encephalitis virus
KSMFGGKAP

SEQ ID NO: 226628 - protein, 9 aa, Japanese encephalitis virus
SMFGGKAPV

SEQ ID NO: 226629 - protein, 9 aa, Japanese encephalitis virus
LGLTGLPSM

SEQ ID NO: 226630 - protein, 9 aa, Japanese encephalitis virus
LTAVVLTTL

SEQ ID NO: 226631 - protein, 9 aa, Japanese encephalitis virus
TAMVLAILH

SEQ ID NO: 226632 - protein, 9 aa, Japanese encephalitis virus
AMVLAILHY

SEQ ID NO: 226633 - protein, 9 aa, Japanese encephalitis virus
MVLAILHYG

SEQ ID NO: 226634 - protein, 9 aa, Japanese encephalitis virus
VLTTLHYGY

SEQ ID NO: 226635 - protein, 9 aa, Japanese encephalitis virus
LTTLHYGYM

SEQ ID NO: 226636 - protein, 9 aa, Japanese encephalitis virus
TTLHYGYML

SEQ ID NO: 226637 - protein, 9 aa, Japanese encephalitis virus
NADKPSLKK

SEQ ID NO: 226638 - protein, 9 aa, Japanese encephalitis virus
ADKPSFKKG

SEQ ID NO: 226639 - protein, 9 aa, Japanese encephalitis virus
DNPSLKRGG

SEQ ID NO: 226640 - protein, 9 aa, Japanese encephalitis virus
KPSFKKGRP

SEQ ID NO: 226641 - protein, 9 aa, Japanese encephalitis virus
PSFKKGRPG

SEQ ID NO: 226642 - protein, 9 aa, Japanese encephalitis virus
SFKKGRPGG

SEQ ID NO: 226643 - protein, 9 aa, Japanese encephalitis virus
LKRGGPGGR

SEQ ID NO: 226644 - protein, 9 aa, Japanese encephalitis virus
TLWEQWKEK

SEQ ID NO: 226645 - protein, 9 aa, Japanese encephalitis virus
LGDQWKEKL

SEQ ID NO: 226646 - protein, 9 aa, Japanese encephalitis virus
GEQWKERLN

SEQ ID NO: 226647 - protein, 9 aa, Japanese encephalitis virus
WKEKLNAMG

SEQ ID NO: 226648 - protein, 9 aa, Japanese encephalitis virus
KEKLNAMGR

SEQ ID NO: 226649 - protein, 9 aa, Japanese encephalitis virus
RLNAMSREE

SEQ ID NO: 226650 - protein, 9 aa, Japanese encephalitis virus
AMSREEFFQ

SEQ ID NO: 226651 - protein, 9 aa, Japanese encephalitis virus
MSREEFFQY

SEQ ID NO: 226652 - protein, 9 aa, Japanese encephalitis virus
RRARSENNI

SEQ ID NO: 226653 - protein, 9 aa, Japanese encephalitis virus
QGKIKKRIQ

SEQ ID NO: 226654 - protein, 9 aa, Japanese encephalitis virus
GKIKKRIQK

SEQ ID NO: 226655 - protein, 9 aa, Japanese encephalitis virus
IKKRIQKQK

SEQ ID NO: 226656 - protein, 9 aa, Japanese encephalitis virus
RRRIQKLRE

SEQ ID NO: 226657 - protein, 9 aa, Japanese encephalitis virus
RRIQKLREE

SEQ ID NO: 226658 - protein, 9 aa, Japanese encephalitis virus
IQKLREEFG

SEQ ID NO: 226659 - protein, 9 aa, Japanese encephalitis virus
QKLREGFAT

SEQ ID NO: 226660 - protein, 9 aa, Japanese encephalitis virus
KQKEEFATT

SEQ ID NO: 226661 - protein, 9 aa, Japanese encephalitis virus
LREEFGTTW

SEQ ID NO: 226662 - protein, 9 aa, Japanese encephalitis virus
TMAPEPPAG

SEQ ID NO: 226663 - protein, 9 aa, Japanese encephalitis virus
EFINKVNSN

SEQ ID NO: 226664 - protein, 9 aa, Japanese encephalitis virus
FINKVNSNA

SEQ ID NO: 226665 - protein, 9 aa, Japanese encephalitis virus
VNSDAALGA

SEQ ID NO: 226666 - protein, 9 aa, Japanese encephalitis virus
NSNASLGAV

SEQ ID NO: 226667 - protein, 9 aa, Japanese encephalitis virus
SNASLGTVF

SEQ ID NO: 226668 - protein, 9 aa, Japanese encephalitis virus
SAALGAVFA

SEQ ID NO: 226669 - protein, 9 aa, Japanese encephalitis virus
TAREAVGDS

SEQ ID NO: 226670 - protein, 9 aa, Japanese encephalitis virus
FWEMVDVER

SEQ ID NO: 226671 - protein, 9 aa, Japanese encephalitis virus
SGGGVEGSS

SEQ ID NO: 226672 - protein, 9 aa, Japanese encephalitis virus
GGGVEGLGV

SEQ ID NO: 226673 - protein, 9 aa, Japanese encephalitis virus
GVQKLGYIS

SEQ ID NO: 226674 - protein, 9 aa, Japanese encephalitis virus
KVMRPAAKG

SEQ ID NO: 226675 - protein, 9 aa, Japanese encephalitis virus
VMRPASGGK

SEQ ID NO: 226676 - protein, 9 aa, Japanese encephalitis virus
MRPASGGKT

SEQ ID NO: 226677 - protein, 9 aa, Japanese encephalitis virus
RPSTDGKTV

SEQ ID NO: 226678 - protein, 9 aa, Japanese encephalitis virus
PAAKGKTGM

SEQ ID NO: 226679 - protein, 9 aa, Japanese encephalitis virus
EGKTVMVVY

SEQ ID NO: 226680 - protein, 9 aa, Japanese encephalitis virus
QHVEQLPRK

SEQ ID NO: 226681 - protein, 9 aa, Japanese encephalitis virus
EQLPKKNKI

SEQ ID NO: 226682 - protein, 9 aa, Japanese encephalitis virus
QLPRENKIA

SEQ ID NO: 226683 - protein, 9 aa, Japanese encephalitis virus
EENEWMEDK

SEQ ID NO: 226684 - protein, 9 aa, Japanese encephalitis virus
ENEWMTDKT

SEQ ID NO: 226685 - protein, 9 aa, Japanese encephalitis virus
NEWMEDKTP

SEQ ID NO: 226686 - protein, 9 aa, Japanese encephalitis virus
GSLIGTRAR

SEQ ID NO: 226687 - protein, 9 aa, Japanese encephalitis virus
SLIGTRARA

SEQ ID NO: 226688 - protein, 9 aa, Japanese encephalitis virus
ARATWAENI

SEQ ID NO: 226689 - protein, 9 aa, Japanese encephalitis virus
VRAILGKEN

SEQ ID NO: 226690 - protein, 9 aa, Japanese encephalitis virus
RAIIGKETY

SEQ ID NO: 226691 - protein, 9 aa, Japanese encephalitis virus
AIIGKETYV

SEQ ID NO: 226692 - protein, 9 aa, Japanese encephalitis virus
IIGKEDYVD

SEQ ID NO: 226693 - protein, 9 aa, Japanese encephalitis virus
KETYVDYMT

SEQ ID NO: 226694 - protein, 9 aa, Japanese encephalitis virus
ENYVDYMLS

SEQ ID NO: 226695 - protein, 9 aa, Japanese encephalitis virus
NYVDYMDFP

SEQ ID NO: 226696 - protein, 9 aa, Japanese encephalitis virus
PQRIEDVLI

SEQ ID NO: 226697 - protein, 9 aa, Japanese encephalitis virus
RRYEDVLTQ

SEQ ID NO: 226698 - protein, 9 aa, Japanese encephalitis virus
RYEDVSIQE

SEQ ID NO: 226699 - protein, 9 aa, Japanese encephalitis virus
IEDVLIQED

SEQ ID NO: 226700 - protein, 10 aa, Japanese encephalitis virus
MTKKPGGPGK

SEQ ID NO: 226701 - protein, 10 aa, Japanese encephalitis virus
TKKPGGPGKN

SEQ ID NO: 226702 - protein, 10 aa, Japanese encephalitis virus
KKPGGPGKNR

SEQ ID NO: 226703 - protein, 10 aa, Japanese encephalitis virus
KPGGPGKNRA

SEQ ID NO: 226704 - protein, 10 aa, Japanese encephalitis virus
PGGPGKNRAI

SEQ ID NO: 226705 - protein, 10 aa, Japanese encephalitis virus
GGPGKNRAIN

SEQ ID NO: 226706 - protein, 10 aa, Japanese encephalitis virus
GPGKNRAINM

SEQ ID NO: 226707 - protein, 10 aa, Japanese encephalitis virus
PGKNRAINML

SEQ ID NO: 226708 - protein, 10 aa, Japanese encephalitis virus
GKNRAINMLK

SEQ ID NO: 226709 - protein, 10 aa, Japanese encephalitis virus
KNRAINMLKR

SEQ ID NO: 226710 - protein, 10 aa, Japanese encephalitis virus
NRAINMLKRG

SEQ ID NO: 226711 - protein, 10 aa, Japanese encephalitis virus
RAINMLKRGL

SEQ ID NO: 226712 - protein, 10 aa, Japanese encephalitis virus
AINMLKRGLP

SEQ ID NO: 226713 - protein, 10 aa, Japanese encephalitis virus
INMLKRGLPR

SEQ ID NO: 226714 - protein, 10 aa, Japanese encephalitis virus
NMLKRGLPRV

SEQ ID NO: 226715 - protein, 10 aa, Japanese encephalitis virus
MLKRGLPRVF

SEQ ID NO: 226716 - protein, 10 aa, Japanese encephalitis virus
LKRGLPRVFP

SEQ ID NO: 226717 - protein, 10 aa, Japanese encephalitis virus
KRGLPRVFPL

SEQ ID NO: 226718 - protein, 10 aa, Japanese encephalitis virus
RGLPRVFPLV

SEQ ID NO: 226719 - protein, 10 aa, Japanese encephalitis virus
GLPRVFPLVG

SEQ ID NO: 226720 - protein, 10 aa, Japanese encephalitis virus
LPRVFPLVGV

SEQ ID NO: 226721 - protein, 10 aa, Japanese encephalitis virus
PRVFPLVGVK

SEQ ID NO: 226722 - protein, 10 aa, Japanese encephalitis virus
RVFPLVGVKR

SEQ ID NO: 226723 - protein, 10 aa, Japanese encephalitis virus
VFPLVGVKRV

SEQ ID NO: 226724 - protein, 10 aa, Japanese encephalitis virus
FPLVGVKRVV

SEQ ID NO: 226725 - protein, 10 aa, Japanese encephalitis virus
PLVGVKRVVM

SEQ ID NO: 226726 - protein, 10 aa, Japanese encephalitis virus
LVGVKRVVMS

SEQ ID NO: 226727 - protein, 10 aa, Japanese encephalitis virus
VGVKRVVMSL

SEQ ID NO: 226728 - protein, 10 aa, Japanese encephalitis virus
GVKRVVMSLL

SEQ ID NO: 226729 - protein, 10 aa, Japanese encephalitis virus
VKRVVMSLLD

SEQ ID NO: 226730 - protein, 10 aa, Japanese encephalitis virus
KRVVMSLLDG

SEQ ID NO: 226731 - protein, 10 aa, Japanese encephalitis virus
RVVMSLLDGR

SEQ ID NO: 226732 - protein, 10 aa, Japanese encephalitis virus
VVMSLLDGRG

SEQ ID NO: 226733 - protein, 10 aa, Japanese encephalitis virus
VMSLLDGRGP

SEQ ID NO: 226734 - protein, 10 aa, Japanese encephalitis virus
MSLLDGRGPV

SEQ ID NO: 226735 - protein, 10 aa, Japanese encephalitis virus
SLLDGRGPVR

SEQ ID NO: 226736 - protein, 10 aa, Japanese encephalitis virus
LLDGRGPVRF

SEQ ID NO: 226737 - protein, 10 aa, Japanese encephalitis virus
LDGRGPVRFV

SEQ ID NO: 226738 - protein, 10 aa, Japanese encephalitis virus
DGRGPVRFVL

SEQ ID NO: 226739 - protein, 10 aa, Japanese encephalitis virus
GRGPVRFVLA

SEQ ID NO: 226740 - protein, 10 aa, Japanese encephalitis virus
RGPVRFVLAL

SEQ ID NO: 226741 - protein, 10 aa, Japanese encephalitis virus
GPVRFVLALI

SEQ ID NO: 226742 - protein, 10 aa, Japanese encephalitis virus
PVRFVLALIT

SEQ ID NO: 226743 - protein, 10 aa, Japanese encephalitis virus
VRFVLALITF

SEQ ID NO: 226744 - protein, 10 aa, Japanese encephalitis virus
RFVLALITFF

SEQ ID NO: 226745 - protein, 10 aa, Japanese encephalitis virus
FVLALITFFK

SEQ ID NO: 226746 - protein, 10 aa, Japanese encephalitis virus
VLALITFFKF

SEQ ID NO: 226747 - protein, 10 aa, Japanese encephalitis virus
LALITFFKFT

SEQ ID NO: 226748 - protein, 10 aa, Japanese encephalitis virus
ALITFFKFTA

SEQ ID NO: 226749 - protein, 10 aa, Japanese encephalitis virus
LITFFKFTAL

SEQ ID NO: 226750 - protein, 10 aa, Japanese encephalitis virus
ITFFKFTALA

SEQ ID NO: 226751 - protein, 10 aa, Japanese encephalitis virus
TFFKFTALAP

SEQ ID NO: 226752 - protein, 10 aa, Japanese encephalitis virus
FFKFTALAPT

SEQ ID NO: 226753 - protein, 10 aa, Japanese encephalitis virus
FKFTALAPTK

SEQ ID NO: 226754 - protein, 10 aa, Japanese encephalitis virus
KFTALAPTKA

SEQ ID NO: 226755 - protein, 10 aa, Japanese encephalitis virus
FTALAPTKAL

SEQ ID NO: 226756 - protein, 10 aa, Japanese encephalitis virus
TALAPTKALL

SEQ ID NO: 226757 - protein, 10 aa, Japanese encephalitis virus
ALAPTKALLG

SEQ ID NO: 226758 - protein, 10 aa, Japanese encephalitis virus
LAPTKALLGR

SEQ ID NO: 226759 - protein, 10 aa, Japanese encephalitis virus
APTKALLGRW

SEQ ID NO: 226760 - protein, 10 aa, Japanese encephalitis virus
PTKALLGRWK

SEQ ID NO: 226761 - protein, 10 aa, Japanese encephalitis virus
TKALLGRWKA

SEQ ID NO: 226762 - protein, 10 aa, Japanese encephalitis virus
KALLGRWKAV

SEQ ID NO: 226763 - protein, 10 aa, Japanese encephalitis virus
ALLGRWKAVE

SEQ ID NO: 226764 - protein, 10 aa, Japanese encephalitis virus
LLGRWKAVEK

SEQ ID NO: 226765 - protein, 10 aa, Japanese encephalitis virus
LGRWKAVEKS

SEQ ID NO: 226766 - protein, 10 aa, Japanese encephalitis virus
GRWKAVEKSV

SEQ ID NO: 226767 - protein, 10 aa, Japanese encephalitis virus
RWKAVEKSVA

SEQ ID NO: 226768 - protein, 10 aa, Japanese encephalitis virus
WKAVEKSVAM

SEQ ID NO: 226769 - protein, 10 aa, Japanese encephalitis virus
KAVEKSVAMK

SEQ ID NO: 226770 - protein, 10 aa, Japanese encephalitis virus
AVEKSVAMKH

SEQ ID NO: 226771 - protein, 10 aa, Japanese encephalitis virus
VEKSVAMKHL

SEQ ID NO: 226772 - protein, 10 aa, Japanese encephalitis virus
EKSVAMKHLT

SEQ ID NO: 226773 - protein, 10 aa, Japanese encephalitis virus
KSVAMKHLTS

SEQ ID NO: 226774 - protein, 10 aa, Japanese encephalitis virus
SVAMKHLTSF

SEQ ID NO: 226775 - protein, 10 aa, Japanese encephalitis virus
VAMKHLTSFK

SEQ ID NO: 226776 - protein, 10 aa, Japanese encephalitis virus
AMKHLTSFKR

SEQ ID NO: 226777 - protein, 10 aa, Japanese encephalitis virus
MKHLTSFKRE

SEQ ID NO: 226778 - protein, 10 aa, Japanese encephalitis virus
KHLTSFKREL

SEQ ID NO: 226779 - protein, 10 aa, Japanese encephalitis virus
HLTSFKRELG

SEQ ID NO: 226780 - protein, 10 aa, Japanese encephalitis virus
LTSFKRELGT

SEQ ID NO: 226781 - protein, 10 aa, Japanese encephalitis virus
TSFKRELGTL

SEQ ID NO: 226782 - protein, 10 aa, Japanese encephalitis virus
SFKRELGTLI

SEQ ID NO: 226783 - protein, 10 aa, Japanese encephalitis virus
FKRELGTLID

SEQ ID NO: 226784 - protein, 10 aa, Japanese encephalitis virus
KRELGTLIDA

SEQ ID NO: 226785 - protein, 10 aa, Japanese encephalitis virus
RELGTLIDAV

SEQ ID NO: 226786 - protein, 10 aa, Japanese encephalitis virus
ELGTLIDAVN

SEQ ID NO: 226787 - protein, 10 aa, Japanese encephalitis virus
LGTLIDAVNK

SEQ ID NO: 226788 - protein, 10 aa, Japanese encephalitis virus
GTLIDAVNKR

SEQ ID NO: 226789 - protein, 10 aa, Japanese encephalitis virus
TLIDAVNKRG

SEQ ID NO: 226790 - protein, 10 aa, Japanese encephalitis virus
LIDAVNKRGR

SEQ ID NO: 226791 - protein, 10 aa, Japanese encephalitis virus
IDAVNKRGRK

SEQ ID NO: 226792 - protein, 10 aa, Japanese encephalitis virus
VNKRGRKQNK

SEQ ID NO: 226793 - protein, 10 aa, Japanese encephalitis virus
NKRGRKQNKR

SEQ ID NO: 226794 - protein, 10 aa, Japanese encephalitis virus
KRGRKQNKRG

SEQ ID NO: 226795 - protein, 10 aa, Japanese encephalitis virus
RGRKQNKRGG

SEQ ID NO: 226796 - protein, 10 aa, Japanese encephalitis virus
GRKQNKRGGN

SEQ ID NO: 226797 - protein, 10 aa, Japanese encephalitis virus
RKQNKRGGNE

SEQ ID NO: 226798 - protein, 10 aa, Japanese encephalitis virus
KQNKRGGNEG

SEQ ID NO: 226799 - protein, 10 aa, Japanese encephalitis virus
AGAMKLSNFQ

SEQ ID NO: 226800 - protein, 10 aa, Japanese encephalitis virus
GAMKLSNFQG

SEQ ID NO: 226801 - protein, 10 aa, Japanese encephalitis virus
AMKLSNFQGK

SEQ ID NO: 226802 - protein, 10 aa, Japanese encephalitis virus
MKLSNFQGKL

SEQ ID NO: 226803 - protein, 10 aa, Japanese encephalitis virus
KLSNFQGKLL

SEQ ID NO: 226804 - protein, 10 aa, Japanese encephalitis virus
LSNFQGKLLM

SEQ ID NO: 226805 - protein, 10 aa, Japanese encephalitis virus
SNFQGKLLMT

SEQ ID NO: 226806 - protein, 10 aa, Japanese encephalitis virus
NFQGKLLMTI

SEQ ID NO: 226807 - protein, 10 aa, Japanese encephalitis virus
FQGKLLMTIN

SEQ ID NO: 226808 - protein, 10 aa, Japanese encephalitis virus
QGKLLMTINN

SEQ ID NO: 226809 - protein, 10 aa, Japanese encephalitis virus
GKLLMTINNT

SEQ ID NO: 226810 - protein, 10 aa, Japanese encephalitis virus
KLLMTINNTD

SEQ ID NO: 226811 - protein, 10 aa, Japanese encephalitis virus
LLMTINNTDI

SEQ ID NO: 226812 - protein, 10 aa, Japanese encephalitis virus
LMTINNTDIA

SEQ ID NO: 226813 - protein, 10 aa, Japanese encephalitis virus
MTINNTDIAD

SEQ ID NO: 226814 - protein, 10 aa, Japanese encephalitis virus
TINNTDIADV

SEQ ID NO: 226815 - protein, 10 aa, Japanese encephalitis virus
INNTDIADVI

SEQ ID NO: 226816 - protein, 10 aa, Japanese encephalitis virus
NNTDIADVIV

SEQ ID NO: 226817 - protein, 10 aa, Japanese encephalitis virus
NTDIADVIVI

SEQ ID NO: 226818 - protein, 10 aa, Japanese encephalitis virus
TDIADVIVIP

SEQ ID NO: 226819 - protein, 10 aa, Japanese encephalitis virus
DIADVIVIPT

SEQ ID NO: 226820 - protein, 10 aa, Japanese encephalitis virus
IADVIVIPTS

SEQ ID NO: 226821 - protein, 10 aa, Japanese encephalitis virus
ADVIVIPTSK

SEQ ID NO: 226822 - protein, 10 aa, Japanese encephalitis virus
DVIVIPTSKG

SEQ ID NO: 226823 - protein, 10 aa, Japanese encephalitis virus
VIVIPTSKGE

SEQ ID NO: 226824 - protein, 10 aa, Japanese encephalitis virus
IVIPTSKGEN

SEQ ID NO: 226825 - protein, 10 aa, Japanese encephalitis virus
VIPTSKGENR

SEQ ID NO: 226826 - protein, 10 aa, Japanese encephalitis virus
IPTSKGENRC

SEQ ID NO: 226827 - protein, 10 aa, Japanese encephalitis virus
PTSKGENRCW

SEQ ID NO: 226828 - protein, 10 aa, Japanese encephalitis virus
TSKGENRCWV

SEQ ID NO: 226829 - protein, 10 aa, Japanese encephalitis virus
SKGENRCWVR

SEQ ID NO: 226830 - protein, 10 aa, Japanese encephalitis virus
KGENRCWVRA

SEQ ID NO: 226831 - protein, 10 aa, Japanese encephalitis virus
GENRCWVRAI

SEQ ID NO: 226832 - protein, 10 aa, Japanese encephalitis virus
ENRCWVRAID

SEQ ID NO: 226833 - protein, 10 aa, Japanese encephalitis virus
NRCWVRAIDV

SEQ ID NO: 226834 - protein, 10 aa, Japanese encephalitis virus
RCWVRAIDVG

SEQ ID NO: 226835 - protein, 10 aa, Japanese encephalitis virus
CWVRAIDVGY

SEQ ID NO: 226836 - protein, 10 aa, Japanese encephalitis virus
WVRAIDVGYM

SEQ ID NO: 226837 - protein, 10 aa, Japanese encephalitis virus
VRAIDVGYMC

SEQ ID NO: 226838 - protein, 10 aa, Japanese encephalitis virus
RAIDVGYMCE

SEQ ID NO: 226839 - protein, 10 aa, Japanese encephalitis virus
AIDVGYMCED

SEQ ID NO: 226840 - protein, 10 aa, Japanese encephalitis virus
IDVGYMCEDT

SEQ ID NO: 226841 - protein, 10 aa, Japanese encephalitis virus
DVGYMCEDTI

SEQ ID NO: 226842 - protein, 10 aa, Japanese encephalitis virus
VGYMCEDTIT

SEQ ID NO: 226843 - protein, 10 aa, Japanese encephalitis virus
GYMCEDTITY

SEQ ID NO: 226844 - protein, 10 aa, Japanese encephalitis virus
YMCEDTITYE

SEQ ID NO: 226845 - protein, 10 aa, Japanese encephalitis virus
MCEDTITYEC

SEQ ID NO: 226846 - protein, 10 aa, Japanese encephalitis virus
CEDTITYECP

SEQ ID NO: 226847 - protein, 10 aa, Japanese encephalitis virus
EDTITYECPK

SEQ ID NO: 226848 - protein, 10 aa, Japanese encephalitis virus
DTITYECPKL

SEQ ID NO: 226849 - protein, 10 aa, Japanese encephalitis virus
TITYECPKLT

SEQ ID NO: 226850 - protein, 10 aa, Japanese encephalitis virus
MGNDPEDVDC

SEQ ID NO: 226851 - protein, 10 aa, Japanese encephalitis virus
GNDPEDVDCW

SEQ ID NO: 226852 - protein, 10 aa, Japanese encephalitis virus
NDPEDVDCWC

SEQ ID NO: 226853 - protein, 10 aa, Japanese encephalitis virus
DPEDVDCWCD

SEQ ID NO: 226854 - protein, 10 aa, Japanese encephalitis virus
PEDVDCWCDN

SEQ ID NO: 226855 - protein, 10 aa, Japanese encephalitis virus
EDVDCWCDNQ

SEQ ID NO: 226856 - protein, 10 aa, Japanese encephalitis virus
DVDCWCDNQE

SEQ ID NO: 226857 - protein, 10 aa, Japanese encephalitis virus
VDCWCDNQEV

SEQ ID NO: 226858 - protein, 10 aa, Japanese encephalitis virus
DCWCDNQEVY

SEQ ID NO: 226859 - protein, 10 aa, Japanese encephalitis virus
CWCDNQEVYV

SEQ ID NO: 226860 - protein, 10 aa, Japanese encephalitis virus
WCDNQEVYVQ

SEQ ID NO: 226861 - protein, 10 aa, Japanese encephalitis virus
CDNQEVYVQY

SEQ ID NO: 226862 - protein, 10 aa, Japanese encephalitis virus
DNQEVYVQYG

SEQ ID NO: 226863 - protein, 10 aa, Japanese encephalitis virus
NQEVYVQYGR

SEQ ID NO: 226864 - protein, 10 aa, Japanese encephalitis virus
QEVYVQYGRC

SEQ ID NO: 226865 - protein, 10 aa, Japanese encephalitis virus
EVYVQYGRCT

SEQ ID NO: 226866 - protein, 10 aa, Japanese encephalitis virus
VYVQYGRCTR

SEQ ID NO: 226867 - protein, 10 aa, Japanese encephalitis virus
YVQYGRCTRT

SEQ ID NO: 226868 - protein, 10 aa, Japanese encephalitis virus
VQYGRCTRTR

SEQ ID NO: 226869 - protein, 10 aa, Japanese encephalitis virus
QYGRCTRTRH

SEQ ID NO: 226870 - protein, 10 aa, Japanese encephalitis virus
YGRCTRTRHS

SEQ ID NO: 226871 - protein, 10 aa, Japanese encephalitis virus
GRCTRTRHSK

SEQ ID NO: 226872 - protein, 10 aa, Japanese encephalitis virus
RCTRTRHSKR

SEQ ID NO: 226873 - protein, 10 aa, Japanese encephalitis virus
CTRTRHSKRS

SEQ ID NO: 226874 - protein, 10 aa, Japanese encephalitis virus
TRTRHSKRSR

SEQ ID NO: 226875 - protein, 10 aa, Japanese encephalitis virus
RTRHSKRSRR

SEQ ID NO: 226876 - protein, 10 aa, Japanese encephalitis virus
TRHSKRSRRS

SEQ ID NO: 226877 - protein, 10 aa, Japanese encephalitis virus
RHSKRSRRSV

SEQ ID NO: 226878 - protein, 10 aa, Japanese encephalitis virus
HSKRSRRSVS

SEQ ID NO: 226879 - protein, 10 aa, Japanese encephalitis virus
SKRSRRSVSV

SEQ ID NO: 226880 - protein, 10 aa, Japanese encephalitis virus
KRSRRSVSVQ

SEQ ID NO: 226881 - protein, 10 aa, Japanese encephalitis virus
RSRRSVSVQT

SEQ ID NO: 226882 - protein, 10 aa, Japanese encephalitis virus
SRRSVSVQTH

SEQ ID NO: 226883 - protein, 10 aa, Japanese encephalitis virus
RRSVSVQTHG

SEQ ID NO: 226884 - protein, 10 aa, Japanese encephalitis virus
RSVSVQTHGE

SEQ ID NO: 226885 - protein, 10 aa, Japanese encephalitis virus
SVSVQTHGES

SEQ ID NO: 226886 - protein, 10 aa, Japanese encephalitis virus
VSVQTHGESS

SEQ ID NO: 226887 - protein, 10 aa, Japanese encephalitis virus
SVQTHGESSL

SEQ ID NO: 226888 - protein, 10 aa, Japanese encephalitis virus
VQTHGESSLV

SEQ ID NO: 226889 - protein, 10 aa, Japanese encephalitis virus
QTHGESSLVN

SEQ ID NO: 226890 - protein, 10 aa, Japanese encephalitis virus
THGESSLVNK

SEQ ID NO: 226891 - protein, 10 aa, Japanese encephalitis virus
HGESSLVNKK

SEQ ID NO: 226892 - protein, 10 aa, Japanese encephalitis virus
GESSLVNKKE

SEQ ID NO: 226893 - protein, 10 aa, Japanese encephalitis virus
ESSLVNKKEA

SEQ ID NO: 226894 - protein, 10 aa, Japanese encephalitis virus
SSLVNKKEAW

SEQ ID NO: 226895 - protein, 10 aa, Japanese encephalitis virus
SLVNKKEAWL

SEQ ID NO: 226896 - protein, 10 aa, Japanese encephalitis virus
LVNKKEAWLD

SEQ ID NO: 226897 - protein, 10 aa, Japanese encephalitis virus
VNKKEAWLDS

SEQ ID NO: 226898 - protein, 10 aa, Japanese encephalitis virus
NKKEAWLDST

SEQ ID NO: 226899 - protein, 10 aa, Japanese encephalitis virus
KKEAWLDSTK

SEQ ID NO: 226900 - protein, 10 aa, Japanese encephalitis virus
KEAWLDSTKA

SEQ ID NO: 226901 - protein, 10 aa, Japanese encephalitis virus
EAWLDSTKAT

SEQ ID NO: 226902 - protein, 10 aa, Japanese encephalitis virus
AWLDSTKATR

SEQ ID NO: 226903 - protein, 10 aa, Japanese encephalitis virus
WLDSTKATRY

SEQ ID NO: 226904 - protein, 10 aa, Japanese encephalitis virus
LDSTKATRYL

SEQ ID NO: 226905 - protein, 10 aa, Japanese encephalitis virus
DSTKATRYLM

SEQ ID NO: 226906 - protein, 10 aa, Japanese encephalitis virus
STKATRYLMK

SEQ ID NO: 226907 - protein, 10 aa, Japanese encephalitis virus
TKATRYLMKT

SEQ ID NO: 226908 - protein, 10 aa, Japanese encephalitis virus
KATRYLMKTE

SEQ ID NO: 226909 - protein, 10 aa, Japanese encephalitis virus
ATRYLMKTEN

SEQ ID NO: 226910 - protein, 10 aa, Japanese encephalitis virus
TRYLMKTENW

SEQ ID NO: 226911 - protein, 10 aa, Japanese encephalitis virus
RYLMKTENWI

SEQ ID NO: 226912 - protein, 10 aa, Japanese encephalitis virus
YLMKTENWII

SEQ ID NO: 226913 - protein, 10 aa, Japanese encephalitis virus
LMKTENWIIR

SEQ ID NO: 226914 - protein, 10 aa, Japanese encephalitis virus
MKTENWIIRN

SEQ ID NO: 226915 - protein, 10 aa, Japanese encephalitis virus
KTENWIIRNP

SEQ ID NO: 226916 - protein, 10 aa, Japanese encephalitis virus
TENWIIRNPG

SEQ ID NO: 226917 - protein, 10 aa, Japanese encephalitis virus
ENWIIRNPGY

SEQ ID NO: 226918 - protein, 10 aa, Japanese encephalitis virus
NWIIRNPGYA

SEQ ID NO: 226919 - protein, 10 aa, Japanese encephalitis virus
WIIRNPGYAF

SEQ ID NO: 226920 - protein, 10 aa, Japanese encephalitis virus
IIRNPGYAFL

SEQ ID NO: 226921 - protein, 10 aa, Japanese encephalitis virus
IRNPGYAFLA

SEQ ID NO: 226922 - protein, 10 aa, Japanese encephalitis virus
RNPGYAFLAA

SEQ ID NO: 226923 - protein, 10 aa, Japanese encephalitis virus
LGWMLGSNNG

SEQ ID NO: 226924 - protein, 10 aa, Japanese encephalitis virus
GQRVVFTILL

SEQ ID NO: 226925 - protein, 10 aa, Japanese encephalitis virus
QRVVFTILLL

SEQ ID NO: 226926 - protein, 10 aa, Japanese encephalitis virus
RVVFTILLLL

SEQ ID NO: 226927 - protein, 10 aa, Japanese encephalitis virus
VVFTILLLLV

SEQ ID NO: 226928 - protein, 10 aa, Japanese encephalitis virus
VFTILLLLVA

SEQ ID NO: 226929 - protein, 10 aa, Japanese encephalitis virus
FTILLLLVAP

SEQ ID NO: 226930 - protein, 10 aa, Japanese encephalitis virus
TILLLLVAPA

SEQ ID NO: 226931 - protein, 10 aa, Japanese encephalitis virus
ILLLLVAPAY

SEQ ID NO: 226932 - protein, 10 aa, Japanese encephalitis virus
LLLLVAPAYS

SEQ ID NO: 226933 - protein, 10 aa, Japanese encephalitis virus
LLLVAPAYSF

SEQ ID NO: 226934 - protein, 10 aa, Japanese encephalitis virus
LLVAPAYSFN

SEQ ID NO: 226935 - protein, 10 aa, Japanese encephalitis virus
LVAPAYSFNC

SEQ ID NO: 226936 - protein, 10 aa, Japanese encephalitis virus
VAPAYSFNCL

SEQ ID NO: 226937 - protein, 10 aa, Japanese encephalitis virus
APAYSFNCLG

SEQ ID NO: 226938 - protein, 10 aa, Japanese encephalitis virus
PAYSFNCLGM

SEQ ID NO: 226939 - protein, 10 aa, Japanese encephalitis virus
AYSFNCLGMG

SEQ ID NO: 226940 - protein, 10 aa, Japanese encephalitis virus
YSFNCLGMGN

SEQ ID NO: 226941 - protein, 10 aa, Japanese encephalitis virus
SFNCLGMGNR

SEQ ID NO: 226942 - protein, 10 aa, Japanese encephalitis virus
FNCLGMGNRD

SEQ ID NO: 226943 - protein, 10 aa, Japanese encephalitis virus
NCLGMGNRDF

SEQ ID NO: 226944 - protein, 10 aa, Japanese encephalitis virus
CLGMGNRDFI

SEQ ID NO: 226945 - protein, 10 aa, Japanese encephalitis virus
LGMGNRDFIE

SEQ ID NO: 226946 - protein, 10 aa, Japanese encephalitis virus
GMGNRDFIEG

SEQ ID NO: 226947 - protein, 10 aa, Japanese encephalitis virus
MGNRDFIEGA

SEQ ID NO: 226948 - protein, 10 aa, Japanese encephalitis virus
GNRDFIEGAS

SEQ ID NO: 226949 - protein, 10 aa, Japanese encephalitis virus
NRDFIEGASG

SEQ ID NO: 226950 - protein, 10 aa, Japanese encephalitis virus
RDFIEGASGA

SEQ ID NO: 226951 - protein, 10 aa, Japanese encephalitis virus
DFIEGASGAT

SEQ ID NO: 226952 - protein, 10 aa, Japanese encephalitis virus
FIEGASGATW

SEQ ID NO: 226953 - protein, 10 aa, Japanese encephalitis virus
IEGASGATWV

SEQ ID NO: 226954 - protein, 10 aa, Japanese encephalitis virus
EGASGATWVD

SEQ ID NO: 226955 - protein, 10 aa, Japanese encephalitis virus
GASGATWVDL

SEQ ID NO: 226956 - protein, 10 aa, Japanese encephalitis virus
ASGATWVDLV

SEQ ID NO: 226957 - protein, 10 aa, Japanese encephalitis virus
SGATWVDLVL

SEQ ID NO: 226958 - protein, 10 aa, Japanese encephalitis virus
GATWVDLVLE

SEQ ID NO: 226959 - protein, 10 aa, Japanese encephalitis virus
ATWVDLVLEG

SEQ ID NO: 226960 - protein, 10 aa, Japanese encephalitis virus
TWVDLVLEGD

SEQ ID NO: 226961 - protein, 10 aa, Japanese encephalitis virus
WVDLVLEGDS

SEQ ID NO: 226962 - protein, 10 aa, Japanese encephalitis virus
VDLVLEGDSC

SEQ ID NO: 226963 - protein, 10 aa, Japanese encephalitis virus
DLVLEGDSCL

SEQ ID NO: 226964 - protein, 10 aa, Japanese encephalitis virus
LVLEGDSCLT

SEQ ID NO: 226965 - protein, 10 aa, Japanese encephalitis virus
VLEGDSCLTI

SEQ ID NO: 226966 - protein, 10 aa, Japanese encephalitis virus
LEGDSCLTIM

SEQ ID NO: 226967 - protein, 10 aa, Japanese encephalitis virus
EGDSCLTIMA

SEQ ID NO: 226968 - protein, 10 aa, Japanese encephalitis virus
GDSCLTIMAN

SEQ ID NO: 226969 - protein, 10 aa, Japanese encephalitis virus
DSCLTIMAND

SEQ ID NO: 226970 - protein, 10 aa, Japanese encephalitis virus
SCLTIMANDK

SEQ ID NO: 226971 - protein, 10 aa, Japanese encephalitis virus
CLTIMANDKP

SEQ ID NO: 226972 - protein, 10 aa, Japanese encephalitis virus
LTIMANDKPT

SEQ ID NO: 226973 - protein, 10 aa, Japanese encephalitis virus
TIMANDKPTL

SEQ ID NO: 226974 - protein, 10 aa, Japanese encephalitis virus
IMANDKPTLD

SEQ ID NO: 226975 - protein, 10 aa, Japanese encephalitis virus
MANDKPTLDV

SEQ ID NO: 226976 - protein, 10 aa, Japanese encephalitis virus
ANDKPTLDVR

SEQ ID NO: 226977 - protein, 10 aa, Japanese encephalitis virus
NDKPTLDVRM

SEQ ID NO: 226978 - protein, 10 aa, Japanese encephalitis virus
DKPTLDVRMI

SEQ ID NO: 226979 - protein, 10 aa, Japanese encephalitis virus
KPTLDVRMIN

SEQ ID NO: 226980 - protein, 10 aa, Japanese encephalitis virus
PTLDVRMINI

SEQ ID NO: 226981 - protein, 10 aa, Japanese encephalitis virus
TLDVRMINIE

SEQ ID NO: 226982 - protein, 10 aa, Japanese encephalitis virus
LDVRMINIEA

SEQ ID NO: 226983 - protein, 10 aa, Japanese encephalitis virus
DVRMINIEAS

SEQ ID NO: 226984 - protein, 10 aa, Japanese encephalitis virus
VRMINIEASQ

SEQ ID NO: 226985 - protein, 10 aa, Japanese encephalitis virus
RMINIEASQL

SEQ ID NO: 226986 - protein, 10 aa, Japanese encephalitis virus
MINIEASQLA

SEQ ID NO: 226987 - protein, 10 aa, Japanese encephalitis virus
INIEASQLAE

SEQ ID NO: 226988 - protein, 10 aa, Japanese encephalitis virus
NIEASQLAEV

SEQ ID NO: 226989 - protein, 10 aa, Japanese encephalitis virus
IEASQLAEVR

SEQ ID NO: 226990 - protein, 10 aa, Japanese encephalitis virus
EASQLAEVRS

SEQ ID NO: 226991 - protein, 10 aa, Japanese encephalitis virus
ASQLAEVRSY

SEQ ID NO: 226992 - protein, 10 aa, Japanese encephalitis virus
SQLAEVRSYC

SEQ ID NO: 226993 - protein, 10 aa, Japanese encephalitis virus
QLAEVRSYCY

SEQ ID NO: 226994 - protein, 10 aa, Japanese encephalitis virus
LAEVRSYCYH

SEQ ID NO: 226995 - protein, 10 aa, Japanese encephalitis virus
AEVRSYCYHA

SEQ ID NO: 226996 - protein, 10 aa, Japanese encephalitis virus
EVRSYCYHAS

SEQ ID NO: 226997 - protein, 10 aa, Japanese encephalitis virus
VRSYCYHASV

SEQ ID NO: 226998 - protein, 10 aa, Japanese encephalitis virus
RSYCYHASVT

SEQ ID NO: 226999 - protein, 10 aa, Japanese encephalitis virus
SYCYHASVTD

SEQ ID NO: 227000 - protein, 10 aa, Japanese encephalitis virus
YCYHASVTDI

SEQ ID NO: 227001 - protein, 10 aa, Japanese encephalitis virus
CYHASVTDIS

SEQ ID NO: 227002 - protein, 10 aa, Japanese encephalitis virus
YHASVTDIST

SEQ ID NO: 227003 - protein, 10 aa, Japanese encephalitis virus
HASVTDISTV

SEQ ID NO: 227004 - protein, 10 aa, Japanese encephalitis virus
ASVTDISTVA

SEQ ID NO: 227005 - protein, 10 aa, Japanese encephalitis virus
SVTDISTVAR

SEQ ID NO: 227006 - protein, 10 aa, Japanese encephalitis virus
VTDISTVARC

SEQ ID NO: 227007 - protein, 10 aa, Japanese encephalitis virus
TDISTVARCP

SEQ ID NO: 227008 - protein, 10 aa, Japanese encephalitis virus
DISTVARCPT

SEQ ID NO: 227009 - protein, 10 aa, Japanese encephalitis virus
ISTVARCPTT

SEQ ID NO: 227010 - protein, 10 aa, Japanese encephalitis virus
STVARCPTTG

SEQ ID NO: 227011 - protein, 10 aa, Japanese encephalitis virus
TVARCPTTGE

SEQ ID NO: 227012 - protein, 10 aa, Japanese encephalitis virus
VARCPTTGEA

SEQ ID NO: 227013 - protein, 10 aa, Japanese encephalitis virus
ARCPTTGEAH

SEQ ID NO: 227014 - protein, 10 aa, Japanese encephalitis virus
RCPTTGEAHN

SEQ ID NO: 227015 - protein, 10 aa, Japanese encephalitis virus
CPTTGEAHNE

SEQ ID NO: 227016 - protein, 10 aa, Japanese encephalitis virus
PTTGEAHNEK

SEQ ID NO: 227017 - protein, 10 aa, Japanese encephalitis virus
TTGEAHNEKR

SEQ ID NO: 227018 - protein, 10 aa, Japanese encephalitis virus
TGEAHNEKRA

SEQ ID NO: 227019 - protein, 10 aa, Japanese encephalitis virus
GEAHNEKRAD

SEQ ID NO: 227020 - protein, 10 aa, Japanese encephalitis virus
EAHNEKRADS

SEQ ID NO: 227021 - protein, 10 aa, Japanese encephalitis virus
AHNEKRADSS

SEQ ID NO: 227022 - protein, 10 aa, Japanese encephalitis virus
HNEKRADSSY

SEQ ID NO: 227023 - protein, 10 aa, Japanese encephalitis virus
NEKRADSSYV

SEQ ID NO: 227024 - protein, 10 aa, Japanese encephalitis virus
EKRADSSYVC

SEQ ID NO: 227025 - protein, 10 aa, Japanese encephalitis virus
KRADSSYVCK

SEQ ID NO: 227026 - protein, 10 aa, Japanese encephalitis virus
RADSSYVCKQ

SEQ ID NO: 227027 - protein, 10 aa, Japanese encephalitis virus
ADSSYVCKQG

SEQ ID NO: 227028 - protein, 10 aa, Japanese encephalitis virus
DSSYVCKQGF

SEQ ID NO: 227029 - protein, 10 aa, Japanese encephalitis virus
SSYVCKQGFT

SEQ ID NO: 227030 - protein, 10 aa, Japanese encephalitis virus
SYVCKQGFTD

SEQ ID NO: 227031 - protein, 10 aa, Japanese encephalitis virus
YVCKQGFTDR

SEQ ID NO: 227032 - protein, 10 aa, Japanese encephalitis virus
VCKQGFTDRG

SEQ ID NO: 227033 - protein, 10 aa, Japanese encephalitis virus
CKQGFTDRGW

SEQ ID NO: 227034 - protein, 10 aa, Japanese encephalitis virus
KQGFTDRGWG

SEQ ID NO: 227035 - protein, 10 aa, Japanese encephalitis virus
QGFTDRGWGN

SEQ ID NO: 227036 - protein, 10 aa, Japanese encephalitis virus
GFTDRGWGNG

SEQ ID NO: 227037 - protein, 10 aa, Japanese encephalitis virus
FTDRGWGNGC

SEQ ID NO: 227038 - protein, 10 aa, Japanese encephalitis virus
TDRGWGNGCG

SEQ ID NO: 227039 - protein, 10 aa, Japanese encephalitis virus
DRGWGNGCGL

SEQ ID NO: 227040 - protein, 10 aa, Japanese encephalitis virus
RGWGNGCGLF

SEQ ID NO: 227041 - protein, 10 aa, Japanese encephalitis virus
GWGNGCGLFG

SEQ ID NO: 227042 - protein, 10 aa, Japanese encephalitis virus
WGNGCGLFGK

SEQ ID NO: 227043 - protein, 10 aa, Japanese encephalitis virus
GNGCGLFGKG

SEQ ID NO: 227044 - protein, 10 aa, Japanese encephalitis virus
NGCGLFGKGS

SEQ ID NO: 227045 - protein, 10 aa, Japanese encephalitis virus
GCGLFGKGSI

SEQ ID NO: 227046 - protein, 10 aa, Japanese encephalitis virus
CGLFGKGSID

SEQ ID NO: 227047 - protein, 10 aa, Japanese encephalitis virus
GLFGKGSIDT

SEQ ID NO: 227048 - protein, 10 aa, Japanese encephalitis virus
LFGKGSIDTC

SEQ ID NO: 227049 - protein, 10 aa, Japanese encephalitis virus
FGKGSIDTCA

SEQ ID NO: 227050 - protein, 10 aa, Japanese encephalitis virus
GKGSIDTCAK

SEQ ID NO: 227051 - protein, 10 aa, Japanese encephalitis virus
KGSIDTCAKF

SEQ ID NO: 227052 - protein, 10 aa, Japanese encephalitis virus
GSIDTCAKFS

SEQ ID NO: 227053 - protein, 10 aa, Japanese encephalitis virus
SIDTCAKFSC

SEQ ID NO: 227054 - protein, 10 aa, Japanese encephalitis virus
IDTCAKFSCT

SEQ ID NO: 227055 - protein, 10 aa, Japanese encephalitis virus
DTCAKFSCTS

SEQ ID NO: 227056 - protein, 10 aa, Japanese encephalitis virus
TCAKFSCTSK

SEQ ID NO: 227057 - protein, 10 aa, Japanese encephalitis virus
CAKFSCTSKA

SEQ ID NO: 227058 - protein, 10 aa, Japanese encephalitis virus
AKFSCTSKAI

SEQ ID NO: 227059 - protein, 10 aa, Japanese encephalitis virus
KFSCTSKAIG

SEQ ID NO: 227060 - protein, 10 aa, Japanese encephalitis virus
FSCTSKAIGR

SEQ ID NO: 227061 - protein, 10 aa, Japanese encephalitis virus
IQPENIKYEV

SEQ ID NO: 227062 - protein, 10 aa, Japanese encephalitis virus
QPENIKYEVG

SEQ ID NO: 227063 - protein, 10 aa, Japanese encephalitis virus
PENIKYEVGI

SEQ ID NO: 227064 - protein, 10 aa, Japanese encephalitis virus
ENIKYEVGIF

SEQ ID NO: 227065 - protein, 10 aa, Japanese encephalitis virus
NIKYEVGIFV

SEQ ID NO: 227066 - protein, 10 aa, Japanese encephalitis virus
IKYEVGIFVH

SEQ ID NO: 227067 - protein, 10 aa, Japanese encephalitis virus
KYEVGIFVHG

SEQ ID NO: 227068 - protein, 10 aa, Japanese encephalitis virus
YEVGIFVHGT

SEQ ID NO: 227069 - protein, 10 aa, Japanese encephalitis virus
EVGIFVHGTT

SEQ ID NO: 227070 - protein, 10 aa, Japanese encephalitis virus
VGIFVHGTTT

SEQ ID NO: 227071 - protein, 10 aa, Japanese encephalitis virus
GIFVHGTTTS

SEQ ID NO: 227072 - protein, 10 aa, Japanese encephalitis virus
IFVHGTTTSE

SEQ ID NO: 227073 - protein, 10 aa, Japanese encephalitis virus
FVHGTTTSEN

SEQ ID NO: 227074 - protein, 10 aa, Japanese encephalitis virus
VHGTTTSENH

SEQ ID NO: 227075 - protein, 10 aa, Japanese encephalitis virus
HGTTTSENHG

SEQ ID NO: 227076 - protein, 10 aa, Japanese encephalitis virus
GTTTSENHGN

SEQ ID NO: 227077 - protein, 10 aa, Japanese encephalitis virus
TTTSENHGNY

SEQ ID NO: 227078 - protein, 10 aa, Japanese encephalitis virus
TTSENHGNYS

SEQ ID NO: 227079 - protein, 10 aa, Japanese encephalitis virus
TSENHGNYSA

SEQ ID NO: 227080 - protein, 10 aa, Japanese encephalitis virus
SENHGNYSAQ

SEQ ID NO: 227081 - protein, 10 aa, Japanese encephalitis virus
ENHGNYSAQV

SEQ ID NO: 227082 - protein, 10 aa, Japanese encephalitis virus
NHGNYSAQVG

SEQ ID NO: 227083 - protein, 10 aa, Japanese encephalitis virus
HGNYSAQVGA

SEQ ID NO: 227084 - protein, 10 aa, Japanese encephalitis virus
GNYSAQVGAS

SEQ ID NO: 227085 - protein, 10 aa, Japanese encephalitis virus
NYSAQVGASQ

SEQ ID NO: 227086 - protein, 10 aa, Japanese encephalitis virus
YSAQVGASQA

SEQ ID NO: 227087 - protein, 10 aa, Japanese encephalitis virus
SAQVGASQAA

SEQ ID NO: 227088 - protein, 10 aa, Japanese encephalitis virus
AQVGASQAAK

SEQ ID NO: 227089 - protein, 10 aa, Japanese encephalitis virus
QVGASQAAKF

SEQ ID NO: 227090 - protein, 10 aa, Japanese encephalitis virus
VGASQAAKFT

SEQ ID NO: 227091 - protein, 10 aa, Japanese encephalitis virus
GASQAAKFTV

SEQ ID NO: 227092 - protein, 10 aa, Japanese encephalitis virus
ASQAAKFTVT

SEQ ID NO: 227093 - protein, 10 aa, Japanese encephalitis virus
SQAAKFTVTP

SEQ ID NO: 227094 - protein, 10 aa, Japanese encephalitis virus
QAAKFTVTPN

SEQ ID NO: 227095 - protein, 10 aa, Japanese encephalitis virus
AAKFTVTPNA

SEQ ID NO: 227096 - protein, 10 aa, Japanese encephalitis virus
AKFTVTPNAP

SEQ ID NO: 227097 - protein, 10 aa, Japanese encephalitis virus
KFTVTPNAPS

SEQ ID NO: 227098 - protein, 10 aa, Japanese encephalitis virus
FTVTPNAPSI

SEQ ID NO: 227099 - protein, 10 aa, Japanese encephalitis virus
TVTPNAPSIT

SEQ ID NO: 227100 - protein, 10 aa, Japanese encephalitis virus
VTPNAPSITL

SEQ ID NO: 227101 - protein, 10 aa, Japanese encephalitis virus
TPNAPSITLK

SEQ ID NO: 227102 - protein, 10 aa, Japanese encephalitis virus
PNAPSITLKL

SEQ ID NO: 227103 - protein, 10 aa, Japanese encephalitis virus
NAPSITLKLG

SEQ ID NO: 227104 - protein, 10 aa, Japanese encephalitis virus
APSITLKLGD

SEQ ID NO: 227105 - protein, 10 aa, Japanese encephalitis virus
TLKLGDYGEV

SEQ ID NO: 227106 - protein, 10 aa, Japanese encephalitis virus
LKLGDYGEVT

SEQ ID NO: 227107 - protein, 10 aa, Japanese encephalitis virus
KLGDYGEVTL

SEQ ID NO: 227108 - protein, 10 aa, Japanese encephalitis virus
LGDYGEVTLD

SEQ ID NO: 227109 - protein, 10 aa, Japanese encephalitis virus
GDYGEVTLDC

SEQ ID NO: 227110 - protein, 10 aa, Japanese encephalitis virus
DYGEVTLDCE

SEQ ID NO: 227111 - protein, 10 aa, Japanese encephalitis virus
YGEVTLDCEP

SEQ ID NO: 227112 - protein, 10 aa, Japanese encephalitis virus
GEVTLDCEPR

SEQ ID NO: 227113 - protein, 10 aa, Japanese encephalitis virus
EVTLDCEPRS

SEQ ID NO: 227114 - protein, 10 aa, Japanese encephalitis virus
VTLDCEPRSG

SEQ ID NO: 227115 - protein, 10 aa, Japanese encephalitis virus
TLDCEPRSGL

SEQ ID NO: 227116 - protein, 10 aa, Japanese encephalitis virus
LDCEPRSGLN

SEQ ID NO: 227117 - protein, 10 aa, Japanese encephalitis virus
DCEPRSGLNT

SEQ ID NO: 227118 - protein, 10 aa, Japanese encephalitis virus
CEPRSGLNTE

SEQ ID NO: 227119 - protein, 10 aa, Japanese encephalitis virus
EPRSGLNTEA

SEQ ID NO: 227120 - protein, 10 aa, Japanese encephalitis virus
PRSGLNTEAF

SEQ ID NO: 227121 - protein, 10 aa, Japanese encephalitis virus
RSGLNTEAFY

SEQ ID NO: 227122 - protein, 10 aa, Japanese encephalitis virus
SGLNTEAFYV

SEQ ID NO: 227123 - protein, 10 aa, Japanese encephalitis virus
GLNTEAFYVM

SEQ ID NO: 227124 - protein, 10 aa, Japanese encephalitis virus
LNTEAFYVMT

SEQ ID NO: 227125 - protein, 10 aa, Japanese encephalitis virus
NTEAFYVMTV

SEQ ID NO: 227126 - protein, 10 aa, Japanese encephalitis virus
TEAFYVMTVG

SEQ ID NO: 227127 - protein, 10 aa, Japanese encephalitis virus
EAFYVMTVGS

SEQ ID NO: 227128 - protein, 10 aa, Japanese encephalitis virus
AFYVMTVGSK

SEQ ID NO: 227129 - protein, 10 aa, Japanese encephalitis virus
FYVMTVGSKS

SEQ ID NO: 227130 - protein, 10 aa, Japanese encephalitis virus
YVMTVGSKSF

SEQ ID NO: 227131 - protein, 10 aa, Japanese encephalitis virus
VMTVGSKSFL

SEQ ID NO: 227132 - protein, 10 aa, Japanese encephalitis virus
MTVGSKSFLV

SEQ ID NO: 227133 - protein, 10 aa, Japanese encephalitis virus
TVGSKSFLVH

SEQ ID NO: 227134 - protein, 10 aa, Japanese encephalitis virus
VGSKSFLVHR

SEQ ID NO: 227135 - protein, 10 aa, Japanese encephalitis virus
GSKSFLVHRE

SEQ ID NO: 227136 - protein, 10 aa, Japanese encephalitis virus
SKSFLVHREW

SEQ ID NO: 227137 - protein, 10 aa, Japanese encephalitis virus
KSFLVHREWF

SEQ ID NO: 227138 - protein, 10 aa, Japanese encephalitis virus
SFLVHREWFH

SEQ ID NO: 227139 - protein, 10 aa, Japanese encephalitis virus
FLVHREWFHD

SEQ ID NO: 227140 - protein, 10 aa, Japanese encephalitis virus
LVHREWFHDL

SEQ ID NO: 227141 - protein, 10 aa, Japanese encephalitis virus
VHREWFHDLA

SEQ ID NO: 227142 - protein, 10 aa, Japanese encephalitis virus
HREWFHDLAL

SEQ ID NO: 227143 - protein, 10 aa, Japanese encephalitis virus
REWFHDLALP

SEQ ID NO: 227144 - protein, 10 aa, Japanese encephalitis virus
EWFHDLALPW

SEQ ID NO: 227145 - protein, 10 aa, Japanese encephalitis virus
WFHDLALPWT

SEQ ID NO: 227146 - protein, 10 aa, Japanese encephalitis virus
FHDLALPWTS

SEQ ID NO: 227147 - protein, 10 aa, Japanese encephalitis virus
HDLALPWTSP

SEQ ID NO: 227148 - protein, 10 aa, Japanese encephalitis virus
DLALPWTSPS

SEQ ID NO: 227149 - protein, 10 aa, Japanese encephalitis virus
LALPWTSPSS

SEQ ID NO: 227150 - protein, 10 aa, Japanese encephalitis virus
ALPWTSPSST

SEQ ID NO: 227151 - protein, 10 aa, Japanese encephalitis virus
LPWTSPSSTA

SEQ ID NO: 227152 - protein, 10 aa, Japanese encephalitis virus
PWTSPSSTAW

SEQ ID NO: 227153 - protein, 10 aa, Japanese encephalitis virus
WTSPSSTAWR

SEQ ID NO: 227154 - protein, 10 aa, Japanese encephalitis virus
TSPSSTAWRN

SEQ ID NO: 227155 - protein, 10 aa, Japanese encephalitis virus
SPSSTAWRNR

SEQ ID NO: 227156 - protein, 10 aa, Japanese encephalitis virus
PSSTAWRNRE

SEQ ID NO: 227157 - protein, 10 aa, Japanese encephalitis virus
SSTAWRNREL

SEQ ID NO: 227158 - protein, 10 aa, Japanese encephalitis virus
STAWRNRELL

SEQ ID NO: 227159 - protein, 10 aa, Japanese encephalitis virus
TAWRNRELLM

SEQ ID NO: 227160 - protein, 10 aa, Japanese encephalitis virus
AWRNRELLME

SEQ ID NO: 227161 - protein, 10 aa, Japanese encephalitis virus
WRNRELLMEF

SEQ ID NO: 227162 - protein, 10 aa, Japanese encephalitis virus
RNRELLMEFE

SEQ ID NO: 227163 - protein, 10 aa, Japanese encephalitis virus
NRELLMEFEE

SEQ ID NO: 227164 - protein, 10 aa, Japanese encephalitis virus
RELLMEFEEA

SEQ ID NO: 227165 - protein, 10 aa, Japanese encephalitis virus
ELLMEFEEAH

SEQ ID NO: 227166 - protein, 10 aa, Japanese encephalitis virus
LLMEFEEAHA

SEQ ID NO: 227167 - protein, 10 aa, Japanese encephalitis virus
LMEFEEAHAT

SEQ ID NO: 227168 - protein, 10 aa, Japanese encephalitis virus
MEFEEAHATK

SEQ ID NO: 227169 - protein, 10 aa, Japanese encephalitis virus
EFEEAHATKQ

SEQ ID NO: 227170 - protein, 10 aa, Japanese encephalitis virus
FEEAHATKQS

SEQ ID NO: 227171 - protein, 10 aa, Japanese encephalitis virus
EEAHATKQSV

SEQ ID NO: 227172 - protein, 10 aa, Japanese encephalitis virus
EAHATKQSVV

SEQ ID NO: 227173 - protein, 10 aa, Japanese encephalitis virus
AHATKQSVVA

SEQ ID NO: 227174 - protein, 10 aa, Japanese encephalitis virus
HATKQSVVAL

SEQ ID NO: 227175 - protein, 10 aa, Japanese encephalitis virus
ATKQSVVALG

SEQ ID NO: 227176 - protein, 10 aa, Japanese encephalitis virus
TKQSVVALGS

SEQ ID NO: 227177 - protein, 10 aa, Japanese encephalitis virus
KQSVVALGSQ

SEQ ID NO: 227178 - protein, 10 aa, Japanese encephalitis virus
QSVVALGSQE

SEQ ID NO: 227179 - protein, 10 aa, Japanese encephalitis virus
SVVALGSQEG

SEQ ID NO: 227180 - protein, 10 aa, Japanese encephalitis virus
VVALGSQEGG

SEQ ID NO: 227181 - protein, 10 aa, Japanese encephalitis virus
VALGSQEGGL

SEQ ID NO: 227182 - protein, 10 aa, Japanese encephalitis virus
ALGSQEGGLH

SEQ ID NO: 227183 - protein, 10 aa, Japanese encephalitis virus
LGSQEGGLHQ

SEQ ID NO: 227184 - protein, 10 aa, Japanese encephalitis virus
GSQEGGLHQA

SEQ ID NO: 227185 - protein, 10 aa, Japanese encephalitis virus
SQEGGLHQAL

SEQ ID NO: 227186 - protein, 10 aa, Japanese encephalitis virus
QEGGLHQALA

SEQ ID NO: 227187 - protein, 10 aa, Japanese encephalitis virus
EGGLHQALAG

SEQ ID NO: 227188 - protein, 10 aa, Japanese encephalitis virus
GGLHQALAGA

SEQ ID NO: 227189 - protein, 10 aa, Japanese encephalitis virus
GLHQALAGAI

SEQ ID NO: 227190 - protein, 10 aa, Japanese encephalitis virus
LHQALAGAIV

SEQ ID NO: 227191 - protein, 10 aa, Japanese encephalitis virus
HQALAGAIVV

SEQ ID NO: 227192 - protein, 10 aa, Japanese encephalitis virus
QALAGAIVVE

SEQ ID NO: 227193 - protein, 10 aa, Japanese encephalitis virus
ALAGAIVVEY

SEQ ID NO: 227194 - protein, 10 aa, Japanese encephalitis virus
LAGAIVVEYS

SEQ ID NO: 227195 - protein, 10 aa, Japanese encephalitis virus
AGAIVVEYSS

SEQ ID NO: 227196 - protein, 10 aa, Japanese encephalitis virus
GAIVVEYSSS

SEQ ID NO: 227197 - protein, 10 aa, Japanese encephalitis virus
AIVVEYSSSV

SEQ ID NO: 227198 - protein, 10 aa, Japanese encephalitis virus
IVVEYSSSVK

SEQ ID NO: 227199 - protein, 10 aa, Japanese encephalitis virus
VVEYSSSVKL

SEQ ID NO: 227200 - protein, 10 aa, Japanese encephalitis virus
VEYSSSVKLT

SEQ ID NO: 227201 - protein, 10 aa, Japanese encephalitis virus
EYSSSVKLTS

SEQ ID NO: 227202 - protein, 10 aa, Japanese encephalitis virus
YSSSVKLTSG

SEQ ID NO: 227203 - protein, 10 aa, Japanese encephalitis virus
SSSVKLTSGH

SEQ ID NO: 227204 - protein, 10 aa, Japanese encephalitis virus
SSVKLTSGHL

SEQ ID NO: 227205 - protein, 10 aa, Japanese encephalitis virus
SVKLTSGHLK

SEQ ID NO: 227206 - protein, 10 aa, Japanese encephalitis virus
VKLTSGHLKC

SEQ ID NO: 227207 - protein, 10 aa, Japanese encephalitis virus
KLTSGHLKCR

SEQ ID NO: 227208 - protein, 10 aa, Japanese encephalitis virus
LTSGHLKCRL

SEQ ID NO: 227209 - protein, 10 aa, Japanese encephalitis virus
TSGHLKCRLK

SEQ ID NO: 227210 - protein, 10 aa, Japanese encephalitis virus
SGHLKCRLKM

SEQ ID NO: 227211 - protein, 10 aa, Japanese encephalitis virus
GHLKCRLKMD

SEQ ID NO: 227212 - protein, 10 aa, Japanese encephalitis virus
HLKCRLKMDK

SEQ ID NO: 227213 - protein, 10 aa, Japanese encephalitis virus
LKCRLKMDKL

SEQ ID NO: 227214 - protein, 10 aa, Japanese encephalitis virus
KCRLKMDKLA

SEQ ID NO: 227215 - protein, 10 aa, Japanese encephalitis virus
CRLKMDKLAL

SEQ ID NO: 227216 - protein, 10 aa, Japanese encephalitis virus
RLKMDKLALK

SEQ ID NO: 227217 - protein, 10 aa, Japanese encephalitis virus
LKMDKLALKG

SEQ ID NO: 227218 - protein, 10 aa, Japanese encephalitis virus
KMDKLALKGT

SEQ ID NO: 227219 - protein, 10 aa, Japanese encephalitis virus
MDKLALKGTT

SEQ ID NO: 227220 - protein, 10 aa, Japanese encephalitis virus
DKLALKGTTY

SEQ ID NO: 227221 - protein, 10 aa, Japanese encephalitis virus
KLALKGTTYG

SEQ ID NO: 227222 - protein, 10 aa, Japanese encephalitis virus
LALKGTTYGM

SEQ ID NO: 227223 - protein, 10 aa, Japanese encephalitis virus
ALKGTTYGMC

SEQ ID NO: 227224 - protein, 10 aa, Japanese encephalitis virus
LKGTTYGMCT

SEQ ID NO: 227225 - protein, 10 aa, Japanese encephalitis virus
KGTTYGMCTE

SEQ ID NO: 227226 - protein, 10 aa, Japanese encephalitis virus
GTTYGMCTEK

SEQ ID NO: 227227 - protein, 10 aa, Japanese encephalitis virus
TTYGMCTEKF

SEQ ID NO: 227228 - protein, 10 aa, Japanese encephalitis virus
TYGMCTEKFS

SEQ ID NO: 227229 - protein, 10 aa, Japanese encephalitis virus
YGMCTEKFSF

SEQ ID NO: 227230 - protein, 10 aa, Japanese encephalitis virus
GMCTEKFSFA

SEQ ID NO: 227231 - protein, 10 aa, Japanese encephalitis virus
MCTEKFSFAK

SEQ ID NO: 227232 - protein, 10 aa, Japanese encephalitis virus
CTEKFSFAKN

SEQ ID NO: 227233 - protein, 10 aa, Japanese encephalitis virus
TEKFSFAKNP

SEQ ID NO: 227234 - protein, 10 aa, Japanese encephalitis virus
EKFSFAKNPA

SEQ ID NO: 227235 - protein, 10 aa, Japanese encephalitis virus
KFSFAKNPAD

SEQ ID NO: 227236 - protein, 10 aa, Japanese encephalitis virus
FSFAKNPADT

SEQ ID NO: 227237 - protein, 10 aa, Japanese encephalitis virus
SFAKNPADTG

SEQ ID NO: 227238 - protein, 10 aa, Japanese encephalitis virus
FAKNPADTGH

SEQ ID NO: 227239 - protein, 10 aa, Japanese encephalitis virus
AKNPADTGHG

SEQ ID NO: 227240 - protein, 10 aa, Japanese encephalitis virus
KNPADTGHGT

SEQ ID NO: 227241 - protein, 10 aa, Japanese encephalitis virus
NPADTGHGTV

SEQ ID NO: 227242 - protein, 10 aa, Japanese encephalitis virus
PADTGHGTVV

SEQ ID NO: 227243 - protein, 10 aa, Japanese encephalitis virus
ADTGHGTVVI

SEQ ID NO: 227244 - protein, 10 aa, Japanese encephalitis virus
DTGHGTVVIE

SEQ ID NO: 227245 - protein, 10 aa, Japanese encephalitis virus
TGHGTVVIEL

SEQ ID NO: 227246 - protein, 10 aa, Japanese encephalitis virus
GHGTVVIELS

SEQ ID NO: 227247 - protein, 10 aa, Japanese encephalitis virus
HGTVVIELSY

SEQ ID NO: 227248 - protein, 10 aa, Japanese encephalitis virus
GTVVIELSYS

SEQ ID NO: 227249 - protein, 10 aa, Japanese encephalitis virus
TVVIELSYSG

SEQ ID NO: 227250 - protein, 10 aa, Japanese encephalitis virus
VVIELSYSGS

SEQ ID NO: 227251 - protein, 10 aa, Japanese encephalitis virus
VIELSYSGSD

SEQ ID NO: 227252 - protein, 10 aa, Japanese encephalitis virus
IELSYSGSDG

SEQ ID NO: 227253 - protein, 10 aa, Japanese encephalitis virus
ELSYSGSDGP

SEQ ID NO: 227254 - protein, 10 aa, Japanese encephalitis virus
LSYSGSDGPC

SEQ ID NO: 227255 - protein, 10 aa, Japanese encephalitis virus
SYSGSDGPCK

SEQ ID NO: 227256 - protein, 10 aa, Japanese encephalitis virus
YSGSDGPCKI

SEQ ID NO: 227257 - protein, 10 aa, Japanese encephalitis virus
SGSDGPCKIP

SEQ ID NO: 227258 - protein, 10 aa, Japanese encephalitis virus
GSDGPCKIPI

SEQ ID NO: 227259 - protein, 10 aa, Japanese encephalitis virus
SDGPCKIPIV

SEQ ID NO: 227260 - protein, 10 aa, Japanese encephalitis virus
DGPCKIPIVS

SEQ ID NO: 227261 - protein, 10 aa, Japanese encephalitis virus
GPCKIPIVSV

SEQ ID NO: 227262 - protein, 10 aa, Japanese encephalitis virus
PCKIPIVSVA

SEQ ID NO: 227263 - protein, 10 aa, Japanese encephalitis virus
CKIPIVSVAS

SEQ ID NO: 227264 - protein, 10 aa, Japanese encephalitis virus
KIPIVSVASL

SEQ ID NO: 227265 - protein, 10 aa, Japanese encephalitis virus
IPIVSVASLN

SEQ ID NO: 227266 - protein, 10 aa, Japanese encephalitis virus
PIVSVASLND

SEQ ID NO: 227267 - protein, 10 aa, Japanese encephalitis virus
IVSVASLNDM

SEQ ID NO: 227268 - protein, 10 aa, Japanese encephalitis virus
VSVASLNDMT

SEQ ID NO: 227269 - protein, 10 aa, Japanese encephalitis virus
SVASLNDMTP

SEQ ID NO: 227270 - protein, 10 aa, Japanese encephalitis virus
VASLNDMTPV

SEQ ID NO: 227271 - protein, 10 aa, Japanese encephalitis virus
ASLNDMTPVG

SEQ ID NO: 227272 - protein, 10 aa, Japanese encephalitis virus
SLNDMTPVGR

SEQ ID NO: 227273 - protein, 10 aa, Japanese encephalitis virus
LNDMTPVGRL

SEQ ID NO: 227274 - protein, 10 aa, Japanese encephalitis virus
NDMTPVGRLV

SEQ ID NO: 227275 - protein, 10 aa, Japanese encephalitis virus
DMTPVGRLVT

SEQ ID NO: 227276 - protein, 10 aa, Japanese encephalitis virus
MTPVGRLVTV

SEQ ID NO: 227277 - protein, 10 aa, Japanese encephalitis virus
TPVGRLVTVN

SEQ ID NO: 227278 - protein, 10 aa, Japanese encephalitis virus
PVGRLVTVNP

SEQ ID NO: 227279 - protein, 10 aa, Japanese encephalitis virus
VGRLVTVNPF

SEQ ID NO: 227280 - protein, 10 aa, Japanese encephalitis virus
GRLVTVNPFV

SEQ ID NO: 227281 - protein, 10 aa, Japanese encephalitis virus
RLVTVNPFVA

SEQ ID NO: 227282 - protein, 10 aa, Japanese encephalitis virus
LVTVNPFVAT

SEQ ID NO: 227283 - protein, 10 aa, Japanese encephalitis virus
VTVNPFVATS

SEQ ID NO: 227284 - protein, 10 aa, Japanese encephalitis virus
TVNPFVATSS

SEQ ID NO: 227285 - protein, 10 aa, Japanese encephalitis virus
VNPFVATSSA

SEQ ID NO: 227286 - protein, 10 aa, Japanese encephalitis virus
NPFVATSSAN

SEQ ID NO: 227287 - protein, 10 aa, Japanese encephalitis virus
PFVATSSANS

SEQ ID NO: 227288 - protein, 10 aa, Japanese encephalitis virus
FVATSSANSK

SEQ ID NO: 227289 - protein, 10 aa, Japanese encephalitis virus
VATSSANSKV

SEQ ID NO: 227290 - protein, 10 aa, Japanese encephalitis virus
ATSSANSKVL

SEQ ID NO: 227291 - protein, 10 aa, Japanese encephalitis virus
SSANSKVLVE

SEQ ID NO: 227292 - protein, 10 aa, Japanese encephalitis virus
SANSKVLVEM

SEQ ID NO: 227293 - protein, 10 aa, Japanese encephalitis virus
ANSKVLVEME

SEQ ID NO: 227294 - protein, 10 aa, Japanese encephalitis virus
NSKVLVEMEP

SEQ ID NO: 227295 - protein, 10 aa, Japanese encephalitis virus
SKVLVEMEPP

SEQ ID NO: 227296 - protein, 10 aa, Japanese encephalitis virus
KVLVEMEPPF

SEQ ID NO: 227297 - protein, 10 aa, Japanese encephalitis virus
VLVEMEPPFG

SEQ ID NO: 227298 - protein, 10 aa, Japanese encephalitis virus
LVEMEPPFGD

SEQ ID NO: 227299 - protein, 10 aa, Japanese encephalitis virus
VEMEPPFGDS

SEQ ID NO: 227300 - protein, 10 aa, Japanese encephalitis virus
EMEPPFGDSY

SEQ ID NO: 227301 - protein, 10 aa, Japanese encephalitis virus
MEPPFGDSYI

SEQ ID NO: 227302 - protein, 10 aa, Japanese encephalitis virus
EPPFGDSYIV

SEQ ID NO: 227303 - protein, 10 aa, Japanese encephalitis virus
PPFGDSYIVV

SEQ ID NO: 227304 - protein, 10 aa, Japanese encephalitis virus
PFGDSYIVVG

SEQ ID NO: 227305 - protein, 10 aa, Japanese encephalitis virus
FGDSYIVVGR

SEQ ID NO: 227306 - protein, 10 aa, Japanese encephalitis virus
GDSYIVVGRG

SEQ ID NO: 227307 - protein, 10 aa, Japanese encephalitis virus
HHWHKAGSTL

SEQ ID NO: 227308 - protein, 10 aa, Japanese encephalitis virus
HWHKAGSTLG

SEQ ID NO: 227309 - protein, 10 aa, Japanese encephalitis virus
WHKAGSTLGK

SEQ ID NO: 227310 - protein, 10 aa, Japanese encephalitis virus
HKAGSTLGKA

SEQ ID NO: 227311 - protein, 10 aa, Japanese encephalitis virus
KAGSTLGKAF

SEQ ID NO: 227312 - protein, 10 aa, Japanese encephalitis virus
AGSTLGKAFS

SEQ ID NO: 227313 - protein, 10 aa, Japanese encephalitis virus
GSTLGKAFST

SEQ ID NO: 227314 - protein, 10 aa, Japanese encephalitis virus
STLGKAFSTT

SEQ ID NO: 227315 - protein, 10 aa, Japanese encephalitis virus
TLGKAFSTTL

SEQ ID NO: 227316 - protein, 10 aa, Japanese encephalitis virus
LGKAFSTTLK

SEQ ID NO: 227317 - protein, 10 aa, Japanese encephalitis virus
GKAFSTTLKG

SEQ ID NO: 227318 - protein, 10 aa, Japanese encephalitis virus
KAFSTTLKGA

SEQ ID NO: 227319 - protein, 10 aa, Japanese encephalitis virus
AFSTTLKGAQ

SEQ ID NO: 227320 - protein, 10 aa, Japanese encephalitis virus
FSTTLKGAQR

SEQ ID NO: 227321 - protein, 10 aa, Japanese encephalitis virus
STTLKGAQRL

SEQ ID NO: 227322 - protein, 10 aa, Japanese encephalitis virus
TTLKGAQRLA

SEQ ID NO: 227323 - protein, 10 aa, Japanese encephalitis virus
TLKGAQRLAA

SEQ ID NO: 227324 - protein, 10 aa, Japanese encephalitis virus
LKGAQRLAAL

SEQ ID NO: 227325 - protein, 10 aa, Japanese encephalitis virus
KGAQRLAALG

SEQ ID NO: 227326 - protein, 10 aa, Japanese encephalitis virus
GAQRLAALGD

SEQ ID NO: 227327 - protein, 10 aa, Japanese encephalitis virus
AQRLAALGDT

SEQ ID NO: 227328 - protein, 10 aa, Japanese encephalitis virus
QRLAALGDTA

SEQ ID NO: 227329 - protein, 10 aa, Japanese encephalitis virus
RLAALGDTAW

SEQ ID NO: 227330 - protein, 10 aa, Japanese encephalitis virus
LAALGDTAWD

SEQ ID NO: 227331 - protein, 10 aa, Japanese encephalitis virus
AALGDTAWDF

SEQ ID NO: 227332 - protein, 10 aa, Japanese encephalitis virus
ALGDTAWDFG

SEQ ID NO: 227333 - protein, 10 aa, Japanese encephalitis virus
LGDTAWDFGS

SEQ ID NO: 227334 - protein, 10 aa, Japanese encephalitis virus
GDTAWDFGSI

SEQ ID NO: 227335 - protein, 10 aa, Japanese encephalitis virus
DTAWDFGSIG

SEQ ID NO: 227336 - protein, 10 aa, Japanese encephalitis virus
TAWDFGSIGG

SEQ ID NO: 227337 - protein, 10 aa, Japanese encephalitis virus
AWDFGSIGGV

SEQ ID NO: 227338 - protein, 10 aa, Japanese encephalitis virus
WDFGSIGGVF

SEQ ID NO: 227339 - protein, 10 aa, Japanese encephalitis virus
DFGSIGGVFN

SEQ ID NO: 227340 - protein, 10 aa, Japanese encephalitis virus
FGSIGGVFNS

SEQ ID NO: 227341 - protein, 10 aa, Japanese encephalitis virus
GSIGGVFNSI

SEQ ID NO: 227342 - protein, 10 aa, Japanese encephalitis virus
SIGGVFNSIG

SEQ ID NO: 227343 - protein, 10 aa, Japanese encephalitis virus
IGGVFNSIGK

SEQ ID NO: 227344 - protein, 10 aa, Japanese encephalitis virus
GGVFNSIGKA

SEQ ID NO: 227345 - protein, 10 aa, Japanese encephalitis virus
GVFNSIGKAV

SEQ ID NO: 227346 - protein, 10 aa, Japanese encephalitis virus
VFNSIGKAVH

SEQ ID NO: 227347 - protein, 10 aa, Japanese encephalitis virus
FNSIGKAVHQ

SEQ ID NO: 227348 - protein, 10 aa, Japanese encephalitis virus
NSIGKAVHQV

SEQ ID NO: 227349 - protein, 10 aa, Japanese encephalitis virus
SIGKAVHQVF

SEQ ID NO: 227350 - protein, 10 aa, Japanese encephalitis virus
IGKAVHQVFG

SEQ ID NO: 227351 - protein, 10 aa, Japanese encephalitis virus
GKAVHQVFGG

SEQ ID NO: 227352 - protein, 10 aa, Japanese encephalitis virus
KAVHQVFGGA

SEQ ID NO: 227353 - protein, 10 aa, Japanese encephalitis virus
AVHQVFGGAF

SEQ ID NO: 227354 - protein, 10 aa, Japanese encephalitis virus
VHQVFGGAFR

SEQ ID NO: 227355 - protein, 10 aa, Japanese encephalitis virus
HQVFGGAFRT

SEQ ID NO: 227356 - protein, 10 aa, Japanese encephalitis virus
QVFGGAFRTL

SEQ ID NO: 227357 - protein, 10 aa, Japanese encephalitis virus
VFGGAFRTLF

SEQ ID NO: 227358 - protein, 10 aa, Japanese encephalitis virus
FGGAFRTLFG

SEQ ID NO: 227359 - protein, 10 aa, Japanese encephalitis virus
GGAFRTLFGG

SEQ ID NO: 227360 - protein, 10 aa, Japanese encephalitis virus
GAFRTLFGGM

SEQ ID NO: 227361 - protein, 10 aa, Japanese encephalitis virus
AFRTLFGGMS

SEQ ID NO: 227362 - protein, 10 aa, Japanese encephalitis virus
FRTLFGGMSW

SEQ ID NO: 227363 - protein, 10 aa, Japanese encephalitis virus
RTLFGGMSWI

SEQ ID NO: 227364 - protein, 10 aa, Japanese encephalitis virus
TLFGGMSWIT

SEQ ID NO: 227365 - protein, 10 aa, Japanese encephalitis virus
LFGGMSWITQ

SEQ ID NO: 227366 - protein, 10 aa, Japanese encephalitis virus
FGGMSWITQG

SEQ ID NO: 227367 - protein, 10 aa, Japanese encephalitis virus
GGMSWITQGL

SEQ ID NO: 227368 - protein, 10 aa, Japanese encephalitis virus
GMSWITQGLM

SEQ ID NO: 227369 - protein, 10 aa, Japanese encephalitis virus
MSWITQGLMG

SEQ ID NO: 227370 - protein, 10 aa, Japanese encephalitis virus
SWITQGLMGA

SEQ ID NO: 227371 - protein, 10 aa, Japanese encephalitis virus
WITQGLMGAL

SEQ ID NO: 227372 - protein, 10 aa, Japanese encephalitis virus
ITQGLMGALL

SEQ ID NO: 227373 - protein, 10 aa, Japanese encephalitis virus
TQGLMGALLL

SEQ ID NO: 227374 - protein, 10 aa, Japanese encephalitis virus
QGLMGALLLW

SEQ ID NO: 227375 - protein, 10 aa, Japanese encephalitis virus
GLMGALLLWM

SEQ ID NO: 227376 - protein, 10 aa, Japanese encephalitis virus
LMGALLLWMG

SEQ ID NO: 227377 - protein, 10 aa, Japanese encephalitis virus
MGALLLWMGV

SEQ ID NO: 227378 - protein, 10 aa, Japanese encephalitis virus
GALLLWMGVN

SEQ ID NO: 227379 - protein, 10 aa, Japanese encephalitis virus
ALLLWMGVNA

SEQ ID NO: 227380 - protein, 10 aa, Japanese encephalitis virus
LLLWMGVNAR

SEQ ID NO: 227381 - protein, 10 aa, Japanese encephalitis virus
LLWMGVNARD

SEQ ID NO: 227382 - protein, 10 aa, Japanese encephalitis virus
LWMGVNARDR

SEQ ID NO: 227383 - protein, 10 aa, Japanese encephalitis virus
WMGVNARDRS

SEQ ID NO: 227384 - protein, 10 aa, Japanese encephalitis virus
MGVNARDRSI

SEQ ID NO: 227385 - protein, 10 aa, Japanese encephalitis virus
GVNARDRSIA

SEQ ID NO: 227386 - protein, 10 aa, Japanese encephalitis virus
VNARDRSIAL

SEQ ID NO: 227387 - protein, 10 aa, Japanese encephalitis virus
NARDRSIALA

SEQ ID NO: 227388 - protein, 10 aa, Japanese encephalitis virus
ARDRSIALAF

SEQ ID NO: 227389 - protein, 10 aa, Japanese encephalitis virus
RDRSIALAFL

SEQ ID NO: 227390 - protein, 10 aa, Japanese encephalitis virus
DRSIALAFLA

SEQ ID NO: 227391 - protein, 10 aa, Japanese encephalitis virus
RSIALAFLAT

SEQ ID NO: 227392 - protein, 10 aa, Japanese encephalitis virus
SIALAFLATG

SEQ ID NO: 227393 - protein, 10 aa, Japanese encephalitis virus
IALAFLATGG

SEQ ID NO: 227394 - protein, 10 aa, Japanese encephalitis virus
ALAFLATGGV

SEQ ID NO: 227395 - protein, 10 aa, Japanese encephalitis virus
LAFLATGGVL

SEQ ID NO: 227396 - protein, 10 aa, Japanese encephalitis virus
AFLATGGVLV

SEQ ID NO: 227397 - protein, 10 aa, Japanese encephalitis virus
FLATGGVLVF

SEQ ID NO: 227398 - protein, 10 aa, Japanese encephalitis virus
LATGGVLVFL

SEQ ID NO: 227399 - protein, 10 aa, Japanese encephalitis virus
ATGGVLVFLA

SEQ ID NO: 227400 - protein, 10 aa, Japanese encephalitis virus
TGGVLVFLAT

SEQ ID NO: 227401 - protein, 10 aa, Japanese encephalitis virus
GGVLVFLATN

SEQ ID NO: 227402 - protein, 10 aa, Japanese encephalitis virus
GVLVFLATNV

SEQ ID NO: 227403 - protein, 10 aa, Japanese encephalitis virus
VLVFLATNVH

SEQ ID NO: 227404 - protein, 10 aa, Japanese encephalitis virus
LVFLATNVHA

SEQ ID NO: 227405 - protein, 10 aa, Japanese encephalitis virus
VFLATNVHAD

SEQ ID NO: 227406 - protein, 10 aa, Japanese encephalitis virus
FLATNVHADT

SEQ ID NO: 227407 - protein, 10 aa, Japanese encephalitis virus
LATNVHADTG

SEQ ID NO: 227408 - protein, 10 aa, Japanese encephalitis virus
ATNVHADTGC

SEQ ID NO: 227409 - protein, 10 aa, Japanese encephalitis virus
TNVHADTGCA

SEQ ID NO: 227410 - protein, 10 aa, Japanese encephalitis virus
NVHADTGCAI

SEQ ID NO: 227411 - protein, 10 aa, Japanese encephalitis virus
VHADTGCAID

SEQ ID NO: 227412 - protein, 10 aa, Japanese encephalitis virus
HADTGCAIDI

SEQ ID NO: 227413 - protein, 10 aa, Japanese encephalitis virus
ADTGCAIDIT

SEQ ID NO: 227414 - protein, 10 aa, Japanese encephalitis virus
DTGCAIDITR

SEQ ID NO: 227415 - protein, 10 aa, Japanese encephalitis virus
TRKEMRCGSG

SEQ ID NO: 227416 - protein, 10 aa, Japanese encephalitis virus
RKEMRCGSGI

SEQ ID NO: 227417 - protein, 10 aa, Japanese encephalitis virus
KEMRCGSGIF

SEQ ID NO: 227418 - protein, 10 aa, Japanese encephalitis virus
EMRCGSGIFV

SEQ ID NO: 227419 - protein, 10 aa, Japanese encephalitis virus
MRCGSGIFVH

SEQ ID NO: 227420 - protein, 10 aa, Japanese encephalitis virus
RCGSGIFVHN

SEQ ID NO: 227421 - protein, 10 aa, Japanese encephalitis virus
CGSGIFVHND

SEQ ID NO: 227422 - protein, 10 aa, Japanese encephalitis virus
GSGIFVHNDV

SEQ ID NO: 227423 - protein, 10 aa, Japanese encephalitis virus
SGIFVHNDVE

SEQ ID NO: 227424 - protein, 10 aa, Japanese encephalitis virus
GIFVHNDVEA

SEQ ID NO: 227425 - protein, 10 aa, Japanese encephalitis virus
IFVHNDVEAW

SEQ ID NO: 227426 - protein, 10 aa, Japanese encephalitis virus
FVHNDVEAWV

SEQ ID NO: 227427 - protein, 10 aa, Japanese encephalitis virus
VHNDVEAWVD

SEQ ID NO: 227428 - protein, 10 aa, Japanese encephalitis virus
HNDVEAWVDR

SEQ ID NO: 227429 - protein, 10 aa, Japanese encephalitis virus
NDVEAWVDRY

SEQ ID NO: 227430 - protein, 10 aa, Japanese encephalitis virus
DVEAWVDRYK

SEQ ID NO: 227431 - protein, 10 aa, Japanese encephalitis virus
VEAWVDRYKY

SEQ ID NO: 227432 - protein, 10 aa, Japanese encephalitis virus
EAWVDRYKYL

SEQ ID NO: 227433 - protein, 10 aa, Japanese encephalitis virus
AWVDRYKYLP

SEQ ID NO: 227434 - protein, 10 aa, Japanese encephalitis virus
WVDRYKYLPE

SEQ ID NO: 227435 - protein, 10 aa, Japanese encephalitis virus
VDRYKYLPET

SEQ ID NO: 227436 - protein, 10 aa, Japanese encephalitis virus
DRYKYLPETP

SEQ ID NO: 227437 - protein, 10 aa, Japanese encephalitis virus
RYKYLPETPR

SEQ ID NO: 227438 - protein, 10 aa, Japanese encephalitis virus
YKYLPETPRS

SEQ ID NO: 227439 - protein, 10 aa, Japanese encephalitis virus
KYLPETPRSL

SEQ ID NO: 227440 - protein, 10 aa, Japanese encephalitis virus
YLPETPRSLA

SEQ ID NO: 227441 - protein, 10 aa, Japanese encephalitis virus
LPETPRSLAK

SEQ ID NO: 227442 - protein, 10 aa, Japanese encephalitis virus
PETPRSLAKI

SEQ ID NO: 227443 - protein, 10 aa, Japanese encephalitis virus
ETPRSLAKIV

SEQ ID NO: 227444 - protein, 10 aa, Japanese encephalitis virus
TPRSLAKIVH

SEQ ID NO: 227445 - protein, 10 aa, Japanese encephalitis virus
PRSLAKIVHK

SEQ ID NO: 227446 - protein, 10 aa, Japanese encephalitis virus
RSLAKIVHKA

SEQ ID NO: 227447 - protein, 10 aa, Japanese encephalitis virus
SLAKIVHKAH

SEQ ID NO: 227448 - protein, 10 aa, Japanese encephalitis virus
LAKIVHKAHK

SEQ ID NO: 227449 - protein, 10 aa, Japanese encephalitis virus
AKIVHKAHKE

SEQ ID NO: 227450 - protein, 10 aa, Japanese encephalitis virus
KIVHKAHKEG

SEQ ID NO: 227451 - protein, 10 aa, Japanese encephalitis virus
IVHKAHKEGV

SEQ ID NO: 227452 - protein, 10 aa, Japanese encephalitis virus
VHKAHKEGVC

SEQ ID NO: 227453 - protein, 10 aa, Japanese encephalitis virus
HKAHKEGVCG

SEQ ID NO: 227454 - protein, 10 aa, Japanese encephalitis virus
KAHKEGVCGV

SEQ ID NO: 227455 - protein, 10 aa, Japanese encephalitis virus
AHKEGVCGVR

SEQ ID NO: 227456 - protein, 10 aa, Japanese encephalitis virus
HKEGVCGVRS

SEQ ID NO: 227457 - protein, 10 aa, Japanese encephalitis virus
KEGVCGVRSV

SEQ ID NO: 227458 - protein, 10 aa, Japanese encephalitis virus
EGVCGVRSVT

SEQ ID NO: 227459 - protein, 10 aa, Japanese encephalitis virus
GVCGVRSVTR

SEQ ID NO: 227460 - protein, 10 aa, Japanese encephalitis virus
VCGVRSVTRL

SEQ ID NO: 227461 - protein, 10 aa, Japanese encephalitis virus
CGVRSVTRLE

SEQ ID NO: 227462 - protein, 10 aa, Japanese encephalitis virus
GVRSVTRLEH

SEQ ID NO: 227463 - protein, 10 aa, Japanese encephalitis virus
VRSVTRLEHQ

SEQ ID NO: 227464 - protein, 10 aa, Japanese encephalitis virus
RSVTRLEHQM

SEQ ID NO: 227465 - protein, 10 aa, Japanese encephalitis virus
SVTRLEHQMW

SEQ ID NO: 227466 - protein, 10 aa, Japanese encephalitis virus
VTRLEHQMWE

SEQ ID NO: 227467 - protein, 10 aa, Japanese encephalitis virus
TRLEHQMWEA

SEQ ID NO: 227468 - protein, 10 aa, Japanese encephalitis virus
RLEHQMWEAV

SEQ ID NO: 227469 - protein, 10 aa, Japanese encephalitis virus
LEHQMWEAVR

SEQ ID NO: 227470 - protein, 10 aa, Japanese encephalitis virus
EHQMWEAVRD

SEQ ID NO: 227471 - protein, 10 aa, Japanese encephalitis virus
HQMWEAVRDE

SEQ ID NO: 227472 - protein, 10 aa, Japanese encephalitis virus
QMWEAVRDEL

SEQ ID NO: 227473 - protein, 10 aa, Japanese encephalitis virus
MWEAVRDELN

SEQ ID NO: 227474 - protein, 10 aa, Japanese encephalitis virus
WEAVRDELNV

SEQ ID NO: 227475 - protein, 10 aa, Japanese encephalitis virus
EAVRDELNVL

SEQ ID NO: 227476 - protein, 10 aa, Japanese encephalitis virus
AVRDELNVLL

SEQ ID NO: 227477 - protein, 10 aa, Japanese encephalitis virus
VRDELNVLLK

SEQ ID NO: 227478 - protein, 10 aa, Japanese encephalitis virus
RDELNVLLKE

SEQ ID NO: 227479 - protein, 10 aa, Japanese encephalitis virus
DELNVLLKEN

SEQ ID NO: 227480 - protein, 10 aa, Japanese encephalitis virus
ELNVLLKENA

SEQ ID NO: 227481 - protein, 10 aa, Japanese encephalitis virus
LNVLLKENAV

SEQ ID NO: 227482 - protein, 10 aa, Japanese encephalitis virus
NVLLKENAVD

SEQ ID NO: 227483 - protein, 10 aa, Japanese encephalitis virus
VLLKENAVDL

SEQ ID NO: 227484 - protein, 10 aa, Japanese encephalitis virus
LLKENAVDLS

SEQ ID NO: 227485 - protein, 10 aa, Japanese encephalitis virus
LKENAVDLSV

SEQ ID NO: 227486 - protein, 10 aa, Japanese encephalitis virus
KENAVDLSVV

SEQ ID NO: 227487 - protein, 10 aa, Japanese encephalitis virus
ENAVDLSVVV

SEQ ID NO: 227488 - protein, 10 aa, Japanese encephalitis virus
NAVDLSVVVN

SEQ ID NO: 227489 - protein, 10 aa, Japanese encephalitis virus
AVDLSVVVNK

SEQ ID NO: 227490 - protein, 10 aa, Japanese encephalitis virus
VDLSVVVNKP

SEQ ID NO: 227491 - protein, 10 aa, Japanese encephalitis virus
DLSVVVNKPV

SEQ ID NO: 227492 - protein, 10 aa, Japanese encephalitis virus
LSVVVNKPVG

SEQ ID NO: 227493 - protein, 10 aa, Japanese encephalitis virus
SVVVNKPVGR

SEQ ID NO: 227494 - protein, 10 aa, Japanese encephalitis virus
VVVNKPVGRY

SEQ ID NO: 227495 - protein, 10 aa, Japanese encephalitis virus
VVNKPVGRYR

SEQ ID NO: 227496 - protein, 10 aa, Japanese encephalitis virus
VNKPVGRYRS

SEQ ID NO: 227497 - protein, 10 aa, Japanese encephalitis virus
NKPVGRYRSA

SEQ ID NO: 227498 - protein, 10 aa, Japanese encephalitis virus
KPVGRYRSAP

SEQ ID NO: 227499 - protein, 10 aa, Japanese encephalitis virus
PVGRYRSAPK

SEQ ID NO: 227500 - protein, 10 aa, Japanese encephalitis virus
VGRYRSAPKR

SEQ ID NO: 227501 - protein, 10 aa, Japanese encephalitis virus
GRYRSAPKRL

SEQ ID NO: 227502 - protein, 10 aa, Japanese encephalitis virus
RYRSAPKRLS

SEQ ID NO: 227503 - protein, 10 aa, Japanese encephalitis virus
YRSAPKRLSM

SEQ ID NO: 227504 - protein, 10 aa, Japanese encephalitis virus
RSAPKRLSMT

SEQ ID NO: 227505 - protein, 10 aa, Japanese encephalitis virus
SAPKRLSMTQ

SEQ ID NO: 227506 - protein, 10 aa, Japanese encephalitis virus
APKRLSMTQE

SEQ ID NO: 227507 - protein, 10 aa, Japanese encephalitis virus
PKRLSMTQEK

SEQ ID NO: 227508 - protein, 10 aa, Japanese encephalitis virus
KRLSMTQEKF

SEQ ID NO: 227509 - protein, 10 aa, Japanese encephalitis virus
RLSMTQEKFE

SEQ ID NO: 227510 - protein, 10 aa, Japanese encephalitis virus
LSMTQEKFEM

SEQ ID NO: 227511 - protein, 10 aa, Japanese encephalitis virus
SMTQEKFEMG

SEQ ID NO: 227512 - protein, 10 aa, Japanese encephalitis virus
MTQEKFEMGW

SEQ ID NO: 227513 - protein, 10 aa, Japanese encephalitis virus
TQEKFEMGWK

SEQ ID NO: 227514 - protein, 10 aa, Japanese encephalitis virus
QEKFEMGWKA

SEQ ID NO: 227515 - protein, 10 aa, Japanese encephalitis virus
EKFEMGWKAW

SEQ ID NO: 227516 - protein, 10 aa, Japanese encephalitis virus
KFEMGWKAWG

SEQ ID NO: 227517 - protein, 10 aa, Japanese encephalitis virus
FEMGWKAWGK

SEQ ID NO: 227518 - protein, 10 aa, Japanese encephalitis virus
EMGWKAWGKS

SEQ ID NO: 227519 - protein, 10 aa, Japanese encephalitis virus
MGWKAWGKSI

SEQ ID NO: 227520 - protein, 10 aa, Japanese encephalitis virus
GWKAWGKSIL

SEQ ID NO: 227521 - protein, 10 aa, Japanese encephalitis virus
WKAWGKSILF

SEQ ID NO: 227522 - protein, 10 aa, Japanese encephalitis virus
KAWGKSILFA

SEQ ID NO: 227523 - protein, 10 aa, Japanese encephalitis virus
AWGKSILFAP

SEQ ID NO: 227524 - protein, 10 aa, Japanese encephalitis virus
WGKSILFAPE

SEQ ID NO: 227525 - protein, 10 aa, Japanese encephalitis virus
GKSILFAPEL

SEQ ID NO: 227526 - protein, 10 aa, Japanese encephalitis virus
KSILFAPELA

SEQ ID NO: 227527 - protein, 10 aa, Japanese encephalitis virus
SILFAPELAN

SEQ ID NO: 227528 - protein, 10 aa, Japanese encephalitis virus
ILFAPELANS

SEQ ID NO: 227529 - protein, 10 aa, Japanese encephalitis virus
LFAPELANST

SEQ ID NO: 227530 - protein, 10 aa, Japanese encephalitis virus
FAPELANSTF

SEQ ID NO: 227531 - protein, 10 aa, Japanese encephalitis virus
APELANSTFV

SEQ ID NO: 227532 - protein, 10 aa, Japanese encephalitis virus
PELANSTFVV

SEQ ID NO: 227533 - protein, 10 aa, Japanese encephalitis virus
ELANSTFVVD

SEQ ID NO: 227534 - protein, 10 aa, Japanese encephalitis virus
LANSTFVVDG

SEQ ID NO: 227535 - protein, 10 aa, Japanese encephalitis virus
ANSTFVVDGP

SEQ ID NO: 227536 - protein, 10 aa, Japanese encephalitis virus
NSTFVVDGPE

SEQ ID NO: 227537 - protein, 10 aa, Japanese encephalitis virus
STFVVDGPET

SEQ ID NO: 227538 - protein, 10 aa, Japanese encephalitis virus
TFVVDGPETK

SEQ ID NO: 227539 - protein, 10 aa, Japanese encephalitis virus
FVVDGPETKE

SEQ ID NO: 227540 - protein, 10 aa, Japanese encephalitis virus
VVDGPETKEC

SEQ ID NO: 227541 - protein, 10 aa, Japanese encephalitis virus
VDGPETKECP

SEQ ID NO: 227542 - protein, 10 aa, Japanese encephalitis virus
DGPETKECPD

SEQ ID NO: 227543 - protein, 10 aa, Japanese encephalitis virus
GPETKECPDE

SEQ ID NO: 227544 - protein, 10 aa, Japanese encephalitis virus
PETKECPDEH

SEQ ID NO: 227545 - protein, 10 aa, Japanese encephalitis virus
ETKECPDEHR

SEQ ID NO: 227546 - protein, 10 aa, Japanese encephalitis virus
TKECPDEHRA

SEQ ID NO: 227547 - protein, 10 aa, Japanese encephalitis virus
KECPDEHRAW

SEQ ID NO: 227548 - protein, 10 aa, Japanese encephalitis virus
ECPDEHRAWN

SEQ ID NO: 227549 - protein, 10 aa, Japanese encephalitis virus
CPDEHRAWNS

SEQ ID NO: 227550 - protein, 10 aa, Japanese encephalitis virus
PDEHRAWNSM

SEQ ID NO: 227551 - protein, 10 aa, Japanese encephalitis virus
DEHRAWNSMQ

SEQ ID NO: 227552 - protein, 10 aa, Japanese encephalitis virus
EHRAWNSMQI

SEQ ID NO: 227553 - protein, 10 aa, Japanese encephalitis virus
HRAWNSMQIE

SEQ ID NO: 227554 - protein, 10 aa, Japanese encephalitis virus
RAWNSMQIED

SEQ ID NO: 227555 - protein, 10 aa, Japanese encephalitis virus
AWNSMQIEDF

SEQ ID NO: 227556 - protein, 10 aa, Japanese encephalitis virus
WNSMQIEDFG

SEQ ID NO: 227557 - protein, 10 aa, Japanese encephalitis virus
NSMQIEDFGF

SEQ ID NO: 227558 - protein, 10 aa, Japanese encephalitis virus
SMQIEDFGFG

SEQ ID NO: 227559 - protein, 10 aa, Japanese encephalitis virus
MQIEDFGFGI

SEQ ID NO: 227560 - protein, 10 aa, Japanese encephalitis virus
QIEDFGFGIT

SEQ ID NO: 227561 - protein, 10 aa, Japanese encephalitis virus
IEDFGFGITS

SEQ ID NO: 227562 - protein, 10 aa, Japanese encephalitis virus
EDFGFGITST

SEQ ID NO: 227563 - protein, 10 aa, Japanese encephalitis virus
DFGFGITSTR

SEQ ID NO: 227564 - protein, 10 aa, Japanese encephalitis virus
FGFGITSTRV

SEQ ID NO: 227565 - protein, 10 aa, Japanese encephalitis virus
GFGITSTRVW

SEQ ID NO: 227566 - protein, 10 aa, Japanese encephalitis virus
FGITSTRVWL

SEQ ID NO: 227567 - protein, 10 aa, Japanese encephalitis virus
GITSTRVWLK

SEQ ID NO: 227568 - protein, 10 aa, Japanese encephalitis virus
ITSTRVWLKI

SEQ ID NO: 227569 - protein, 10 aa, Japanese encephalitis virus
TSTRVWLKIR

SEQ ID NO: 227570 - protein, 10 aa, Japanese encephalitis virus
STRVWLKIRE

SEQ ID NO: 227571 - protein, 10 aa, Japanese encephalitis virus
TRVWLKIREE

SEQ ID NO: 227572 - protein, 10 aa, Japanese encephalitis virus
RVWLKIREES

SEQ ID NO: 227573 - protein, 10 aa, Japanese encephalitis virus
VWLKIREEST

SEQ ID NO: 227574 - protein, 10 aa, Japanese encephalitis virus
WLKIREESTD

SEQ ID NO: 227575 - protein, 10 aa, Japanese encephalitis virus
LKIREESTDE

SEQ ID NO: 227576 - protein, 10 aa, Japanese encephalitis virus
KIREESTDEC

SEQ ID NO: 227577 - protein, 10 aa, Japanese encephalitis virus
IREESTDECD

SEQ ID NO: 227578 - protein, 10 aa, Japanese encephalitis virus
REESTDECDG

SEQ ID NO: 227579 - protein, 10 aa, Japanese encephalitis virus
EESTDECDGA

SEQ ID NO: 227580 - protein, 10 aa, Japanese encephalitis virus
ESTDECDGAI

SEQ ID NO: 227581 - protein, 10 aa, Japanese encephalitis virus
STDECDGAII

SEQ ID NO: 227582 - protein, 10 aa, Japanese encephalitis virus
TDECDGAIIG

SEQ ID NO: 227583 - protein, 10 aa, Japanese encephalitis virus
DECDGAIIGT

SEQ ID NO: 227584 - protein, 10 aa, Japanese encephalitis virus
ECDGAIIGTA

SEQ ID NO: 227585 - protein, 10 aa, Japanese encephalitis virus
CDGAIIGTAV

SEQ ID NO: 227586 - protein, 10 aa, Japanese encephalitis virus
DGAIIGTAVK

SEQ ID NO: 227587 - protein, 10 aa, Japanese encephalitis virus
GAIIGTAVKG

SEQ ID NO: 227588 - protein, 10 aa, Japanese encephalitis virus
AIIGTAVKGH

SEQ ID NO: 227589 - protein, 10 aa, Japanese encephalitis virus
IIGTAVKGHV

SEQ ID NO: 227590 - protein, 10 aa, Japanese encephalitis virus
IGTAVKGHVA

SEQ ID NO: 227591 - protein, 10 aa, Japanese encephalitis virus
GTAVKGHVAV

SEQ ID NO: 227592 - protein, 10 aa, Japanese encephalitis virus
TAVKGHVAVH

SEQ ID NO: 227593 - protein, 10 aa, Japanese encephalitis virus
AVKGHVAVHS

SEQ ID NO: 227594 - protein, 10 aa, Japanese encephalitis virus
VKGHVAVHSD

SEQ ID NO: 227595 - protein, 10 aa, Japanese encephalitis virus
KGHVAVHSDL

SEQ ID NO: 227596 - protein, 10 aa, Japanese encephalitis virus
GHVAVHSDLS

SEQ ID NO: 227597 - protein, 10 aa, Japanese encephalitis virus
HVAVHSDLSY

SEQ ID NO: 227598 - protein, 10 aa, Japanese encephalitis virus
VAVHSDLSYW

SEQ ID NO: 227599 - protein, 10 aa, Japanese encephalitis virus
AVHSDLSYWI

SEQ ID NO: 227600 - protein, 10 aa, Japanese encephalitis virus
VHSDLSYWIE

SEQ ID NO: 227601 - protein, 10 aa, Japanese encephalitis virus
HSDLSYWIES

SEQ ID NO: 227602 - protein, 10 aa, Japanese encephalitis virus
SDLSYWIESR

SEQ ID NO: 227603 - protein, 10 aa, Japanese encephalitis virus
SYWIESRYND

SEQ ID NO: 227604 - protein, 10 aa, Japanese encephalitis virus
NDTWKLERAV

SEQ ID NO: 227605 - protein, 10 aa, Japanese encephalitis virus
DTWKLERAVF

SEQ ID NO: 227606 - protein, 10 aa, Japanese encephalitis virus
TWKLERAVFG

SEQ ID NO: 227607 - protein, 10 aa, Japanese encephalitis virus
WKLERAVFGE

SEQ ID NO: 227608 - protein, 10 aa, Japanese encephalitis virus
KLERAVFGEV

SEQ ID NO: 227609 - protein, 10 aa, Japanese encephalitis virus
LERAVFGEVK

SEQ ID NO: 227610 - protein, 10 aa, Japanese encephalitis virus
ERAVFGEVKS

SEQ ID NO: 227611 - protein, 10 aa, Japanese encephalitis virus
RAVFGEVKSC

SEQ ID NO: 227612 - protein, 10 aa, Japanese encephalitis virus
AVFGEVKSCT

SEQ ID NO: 227613 - protein, 10 aa, Japanese encephalitis virus
VFGEVKSCTW

SEQ ID NO: 227614 - protein, 10 aa, Japanese encephalitis virus
FGEVKSCTWP

SEQ ID NO: 227615 - protein, 10 aa, Japanese encephalitis virus
GEVKSCTWPE

SEQ ID NO: 227616 - protein, 10 aa, Japanese encephalitis virus
EVKSCTWPET

SEQ ID NO: 227617 - protein, 10 aa, Japanese encephalitis virus
VKSCTWPETH

SEQ ID NO: 227618 - protein, 10 aa, Japanese encephalitis virus
KSCTWPETHT

SEQ ID NO: 227619 - protein, 10 aa, Japanese encephalitis virus
SCTWPETHTL

SEQ ID NO: 227620 - protein, 10 aa, Japanese encephalitis virus
CTWPETHTLW

SEQ ID NO: 227621 - protein, 10 aa, Japanese encephalitis virus
TWPETHTLWG

SEQ ID NO: 227622 - protein, 10 aa, Japanese encephalitis virus
WPETHTLWGD

SEQ ID NO: 227623 - protein, 10 aa, Japanese encephalitis virus
PETHTLWGDG

SEQ ID NO: 227624 - protein, 10 aa, Japanese encephalitis virus
ETHTLWGDGV

SEQ ID NO: 227625 - protein, 10 aa, Japanese encephalitis virus
THTLWGDGVE

SEQ ID NO: 227626 - protein, 10 aa, Japanese encephalitis virus
HTLWGDGVEE

SEQ ID NO: 227627 - protein, 10 aa, Japanese encephalitis virus
TLWGDGVEES

SEQ ID NO: 227628 - protein, 10 aa, Japanese encephalitis virus
LWGDGVEESE

SEQ ID NO: 227629 - protein, 10 aa, Japanese encephalitis virus
WGDGVEESEL

SEQ ID NO: 227630 - protein, 10 aa, Japanese encephalitis virus
GDGVEESELI

SEQ ID NO: 227631 - protein, 10 aa, Japanese encephalitis virus
DGVEESELII

SEQ ID NO: 227632 - protein, 10 aa, Japanese encephalitis virus
GVEESELIIP

SEQ ID NO: 227633 - protein, 10 aa, Japanese encephalitis virus
VEESELIIPH

SEQ ID NO: 227634 - protein, 10 aa, Japanese encephalitis virus
EESELIIPHT

SEQ ID NO: 227635 - protein, 10 aa, Japanese encephalitis virus
ESELIIPHTI

SEQ ID NO: 227636 - protein, 10 aa, Japanese encephalitis virus
SELIIPHTIA

SEQ ID NO: 227637 - protein, 10 aa, Japanese encephalitis virus
ELIIPHTIAG

SEQ ID NO: 227638 - protein, 10 aa, Japanese encephalitis virus
LIIPHTIAGP

SEQ ID NO: 227639 - protein, 10 aa, Japanese encephalitis virus
IIPHTIAGPK

SEQ ID NO: 227640 - protein, 10 aa, Japanese encephalitis virus
IPHTIAGPKS

SEQ ID NO: 227641 - protein, 10 aa, Japanese encephalitis virus
PHTIAGPKSK

SEQ ID NO: 227642 - protein, 10 aa, Japanese encephalitis virus
HTIAGPKSKH

SEQ ID NO: 227643 - protein, 10 aa, Japanese encephalitis virus
TIAGPKSKHN

SEQ ID NO: 227644 - protein, 10 aa, Japanese encephalitis virus
IAGPKSKHNR

SEQ ID NO: 227645 - protein, 10 aa, Japanese encephalitis virus
AGPKSKHNRR

SEQ ID NO: 227646 - protein, 10 aa, Japanese encephalitis virus
GPKSKHNRRE

SEQ ID NO: 227647 - protein, 10 aa, Japanese encephalitis virus
PKSKHNRREG

SEQ ID NO: 227648 - protein, 10 aa, Japanese encephalitis virus
KSKHNRREGY

SEQ ID NO: 227649 - protein, 10 aa, Japanese encephalitis virus
SKHNRREGYK

SEQ ID NO: 227650 - protein, 10 aa, Japanese encephalitis virus
KHNRREGYKT

SEQ ID NO: 227651 - protein, 10 aa, Japanese encephalitis virus
HNRREGYKTQ

SEQ ID NO: 227652 - protein, 10 aa, Japanese encephalitis virus
NRREGYKTQN

SEQ ID NO: 227653 - protein, 10 aa, Japanese encephalitis virus
RREGYKTQNQ

SEQ ID NO: 227654 - protein, 10 aa, Japanese encephalitis virus
REGYKTQNQG

SEQ ID NO: 227655 - protein, 10 aa, Japanese encephalitis virus
EGYKTQNQGP

SEQ ID NO: 227656 - protein, 10 aa, Japanese encephalitis virus
GYKTQNQGPW

SEQ ID NO: 227657 - protein, 10 aa, Japanese encephalitis virus
YKTQNQGPWD

SEQ ID NO: 227658 - protein, 10 aa, Japanese encephalitis virus
KTQNQGPWDE

SEQ ID NO: 227659 - protein, 10 aa, Japanese encephalitis virus
TQNQGPWDEN

SEQ ID NO: 227660 - protein, 10 aa, Japanese encephalitis virus
QNQGPWDENG

SEQ ID NO: 227661 - protein, 10 aa, Japanese encephalitis virus
NQGPWDENGI

SEQ ID NO: 227662 - protein, 10 aa, Japanese encephalitis virus
QGPWDENGIV

SEQ ID NO: 227663 - protein, 10 aa, Japanese encephalitis virus
GPWDENGIVL

SEQ ID NO: 227664 - protein, 10 aa, Japanese encephalitis virus
PWDENGIVLD

SEQ ID NO: 227665 - protein, 10 aa, Japanese encephalitis virus
WDENGIVLDF

SEQ ID NO: 227666 - protein, 10 aa, Japanese encephalitis virus
DENGIVLDFD

SEQ ID NO: 227667 - protein, 10 aa, Japanese encephalitis virus
ENGIVLDFDY

SEQ ID NO: 227668 - protein, 10 aa, Japanese encephalitis virus
NGIVLDFDYC

SEQ ID NO: 227669 - protein, 10 aa, Japanese encephalitis virus
GIVLDFDYCP

SEQ ID NO: 227670 - protein, 10 aa, Japanese encephalitis virus
IVLDFDYCPG

SEQ ID NO: 227671 - protein, 10 aa, Japanese encephalitis virus
VLDFDYCPGT

SEQ ID NO: 227672 - protein, 10 aa, Japanese encephalitis virus
LDFDYCPGTK

SEQ ID NO: 227673 - protein, 10 aa, Japanese encephalitis virus
DFDYCPGTKV

SEQ ID NO: 227674 - protein, 10 aa, Japanese encephalitis virus
FDYCPGTKVT

SEQ ID NO: 227675 - protein, 10 aa, Japanese encephalitis virus
DYCPGTKVTI

SEQ ID NO: 227676 - protein, 10 aa, Japanese encephalitis virus
YCPGTKVTIT

SEQ ID NO: 227677 - protein, 10 aa, Japanese encephalitis virus
CPGTKVTITE

SEQ ID NO: 227678 - protein, 10 aa, Japanese encephalitis virus
PGTKVTITED

SEQ ID NO: 227679 - protein, 10 aa, Japanese encephalitis virus
GTKVTITEDC

SEQ ID NO: 227680 - protein, 10 aa, Japanese encephalitis virus
TKVTITEDCG

SEQ ID NO: 227681 - protein, 10 aa, Japanese encephalitis virus
KVTITEDCGK

SEQ ID NO: 227682 - protein, 10 aa, Japanese encephalitis virus
VTITEDCGKR

SEQ ID NO: 227683 - protein, 10 aa, Japanese encephalitis virus
TITEDCGKRG

SEQ ID NO: 227684 - protein, 10 aa, Japanese encephalitis virus
ITEDCGKRGP

SEQ ID NO: 227685 - protein, 10 aa, Japanese encephalitis virus
TEDCGKRGPS

SEQ ID NO: 227686 - protein, 10 aa, Japanese encephalitis virus
EDCGKRGPSV

SEQ ID NO: 227687 - protein, 10 aa, Japanese encephalitis virus
DCGKRGPSVR

SEQ ID NO: 227688 - protein, 10 aa, Japanese encephalitis virus
CGKRGPSVRT

SEQ ID NO: 227689 - protein, 10 aa, Japanese encephalitis virus
GKRGPSVRTT

SEQ ID NO: 227690 - protein, 10 aa, Japanese encephalitis virus
KRGPSVRTTT

SEQ ID NO: 227691 - protein, 10 aa, Japanese encephalitis virus
RGPSVRTTTD

SEQ ID NO: 227692 - protein, 10 aa, Japanese encephalitis virus
GPSVRTTTDS

SEQ ID NO: 227693 - protein, 10 aa, Japanese encephalitis virus
PSVRTTTDSG

SEQ ID NO: 227694 - protein, 10 aa, Japanese encephalitis virus
SVRTTTDSGK

SEQ ID NO: 227695 - protein, 10 aa, Japanese encephalitis virus
VRTTTDSGKL

SEQ ID NO: 227696 - protein, 10 aa, Japanese encephalitis virus
RTTTDSGKLI

SEQ ID NO: 227697 - protein, 10 aa, Japanese encephalitis virus
TTTDSGKLIT

SEQ ID NO: 227698 - protein, 10 aa, Japanese encephalitis virus
TTDSGKLITD

SEQ ID NO: 227699 - protein, 10 aa, Japanese encephalitis virus
TDSGKLITDW

SEQ ID NO: 227700 - protein, 10 aa, Japanese encephalitis virus
DSGKLITDWC

SEQ ID NO: 227701 - protein, 10 aa, Japanese encephalitis virus
SGKLITDWCC

SEQ ID NO: 227702 - protein, 10 aa, Japanese encephalitis virus
GKLITDWCCR

SEQ ID NO: 227703 - protein, 10 aa, Japanese encephalitis virus
KLITDWCCRS

SEQ ID NO: 227704 - protein, 10 aa, Japanese encephalitis virus
LITDWCCRSC

SEQ ID NO: 227705 - protein, 10 aa, Japanese encephalitis virus
ITDWCCRSCS

SEQ ID NO: 227706 - protein, 10 aa, Japanese encephalitis virus
TDWCCRSCSL

SEQ ID NO: 227707 - protein, 10 aa, Japanese encephalitis virus
DWCCRSCSLP

SEQ ID NO: 227708 - protein, 10 aa, Japanese encephalitis virus
WCCRSCSLPP

SEQ ID NO: 227709 - protein, 10 aa, Japanese encephalitis virus
CCRSCSLPPL

SEQ ID NO: 227710 - protein, 10 aa, Japanese encephalitis virus
CRSCSLPPLR

SEQ ID NO: 227711 - protein, 10 aa, Japanese encephalitis virus
RSCSLPPLRF

SEQ ID NO: 227712 - protein, 10 aa, Japanese encephalitis virus
SCSLPPLRFR

SEQ ID NO: 227713 - protein, 10 aa, Japanese encephalitis virus
CSLPPLRFRT

SEQ ID NO: 227714 - protein, 10 aa, Japanese encephalitis virus
SLPPLRFRTE

SEQ ID NO: 227715 - protein, 10 aa, Japanese encephalitis virus
LPPLRFRTEN

SEQ ID NO: 227716 - protein, 10 aa, Japanese encephalitis virus
PPLRFRTENG

SEQ ID NO: 227717 - protein, 10 aa, Japanese encephalitis virus
PLRFRTENGC

SEQ ID NO: 227718 - protein, 10 aa, Japanese encephalitis virus
LRFRTENGCW

SEQ ID NO: 227719 - protein, 10 aa, Japanese encephalitis virus
RFRTENGCWY

SEQ ID NO: 227720 - protein, 10 aa, Japanese encephalitis virus
FRTENGCWYG

SEQ ID NO: 227721 - protein, 10 aa, Japanese encephalitis virus
RTENGCWYGM

SEQ ID NO: 227722 - protein, 10 aa, Japanese encephalitis virus
TENGCWYGME

SEQ ID NO: 227723 - protein, 10 aa, Japanese encephalitis virus
ENGCWYGMEI

SEQ ID NO: 227724 - protein, 10 aa, Japanese encephalitis virus
NGCWYGMEIR

SEQ ID NO: 227725 - protein, 10 aa, Japanese encephalitis virus
GCWYGMEIRP

SEQ ID NO: 227726 - protein, 10 aa, Japanese encephalitis virus
CWYGMEIRPV

SEQ ID NO: 227727 - protein, 10 aa, Japanese encephalitis virus
HDETTLVRSQ

SEQ ID NO: 227728 - protein, 10 aa, Japanese encephalitis virus
DETTLVRSQV

SEQ ID NO: 227729 - protein, 10 aa, Japanese encephalitis virus
GEMVDPFQLG

SEQ ID NO: 227730 - protein, 10 aa, Japanese encephalitis virus
EMVDPFQLGL

SEQ ID NO: 227731 - protein, 10 aa, Japanese encephalitis virus
MVDPFQLGLL

SEQ ID NO: 227732 - protein, 10 aa, Japanese encephalitis virus
VDPFQLGLLV

SEQ ID NO: 227733 - protein, 10 aa, Japanese encephalitis virus
DPFQLGLLVM

SEQ ID NO: 227734 - protein, 10 aa, Japanese encephalitis virus
PFQLGLLVMF

SEQ ID NO: 227735 - protein, 10 aa, Japanese encephalitis virus
FQLGLLVMFL

SEQ ID NO: 227736 - protein, 10 aa, Japanese encephalitis virus
QLGLLVMFLA

SEQ ID NO: 227737 - protein, 10 aa, Japanese encephalitis virus
LGLLVMFLAT

SEQ ID NO: 227738 - protein, 10 aa, Japanese encephalitis virus
GLLVMFLATQ

SEQ ID NO: 227739 - protein, 10 aa, Japanese encephalitis virus
LLVMFLATQE

SEQ ID NO: 227740 - protein, 10 aa, Japanese encephalitis virus
LVMFLATQEV

SEQ ID NO: 227741 - protein, 10 aa, Japanese encephalitis virus
VMFLATQEVL

SEQ ID NO: 227742 - protein, 10 aa, Japanese encephalitis virus
MFLATQEVLR

SEQ ID NO: 227743 - protein, 10 aa, Japanese encephalitis virus
FLATQEVLRK

SEQ ID NO: 227744 - protein, 10 aa, Japanese encephalitis virus
LATQEVLRKR

SEQ ID NO: 227745 - protein, 10 aa, Japanese encephalitis virus
ATQEVLRKRW

SEQ ID NO: 227746 - protein, 10 aa, Japanese encephalitis virus
TQEVLRKRWT

SEQ ID NO: 227747 - protein, 10 aa, Japanese encephalitis virus
QEVLRKRWTA

SEQ ID NO: 227748 - protein, 10 aa, Japanese encephalitis virus
EVLRKRWTAR

SEQ ID NO: 227749 - protein, 10 aa, Japanese encephalitis virus
VLRKRWTARL

SEQ ID NO: 227750 - protein, 10 aa, Japanese encephalitis virus
LRKRWTARLT

SEQ ID NO: 227751 - protein, 10 aa, Japanese encephalitis virus
RKRWTARLTI

SEQ ID NO: 227752 - protein, 10 aa, Japanese encephalitis virus
KRWTARLTIP

SEQ ID NO: 227753 - protein, 10 aa, Japanese encephalitis virus
RWTARLTIPA

SEQ ID NO: 227754 - protein, 10 aa, Japanese encephalitis virus
WTARLTIPAV

SEQ ID NO: 227755 - protein, 10 aa, Japanese encephalitis virus
TARLTIPAVL

SEQ ID NO: 227756 - protein, 10 aa, Japanese encephalitis virus
ARLTIPAVLG

SEQ ID NO: 227757 - protein, 10 aa, Japanese encephalitis virus
RLTIPAVLGA

SEQ ID NO: 227758 - protein, 10 aa, Japanese encephalitis virus
LTIPAVLGAL

SEQ ID NO: 227759 - protein, 10 aa, Japanese encephalitis virus
TIPAVLGALL

SEQ ID NO: 227760 - protein, 10 aa, Japanese encephalitis virus
IPAVLGALLV

SEQ ID NO: 227761 - protein, 10 aa, Japanese encephalitis virus
PAVLGALLVL

SEQ ID NO: 227762 - protein, 10 aa, Japanese encephalitis virus
AVLGALLVLM

SEQ ID NO: 227763 - protein, 10 aa, Japanese encephalitis virus
VLGALLVLML

SEQ ID NO: 227764 - protein, 10 aa, Japanese encephalitis virus
LGALLVLMLG

SEQ ID NO: 227765 - protein, 10 aa, Japanese encephalitis virus
GALLVLMLGG

SEQ ID NO: 227766 - protein, 10 aa, Japanese encephalitis virus
ALLVLMLGGI

SEQ ID NO: 227767 - protein, 10 aa, Japanese encephalitis virus
LLVLMLGGIT

SEQ ID NO: 227768 - protein, 10 aa, Japanese encephalitis virus
LVLMLGGITY

SEQ ID NO: 227769 - protein, 10 aa, Japanese encephalitis virus
VLMLGGITYT

SEQ ID NO: 227770 - protein, 10 aa, Japanese encephalitis virus
LMLGGITYTD

SEQ ID NO: 227771 - protein, 10 aa, Japanese encephalitis virus
MLGGITYTDL

SEQ ID NO: 227772 - protein, 10 aa, Japanese encephalitis virus
LGGITYTDLA

SEQ ID NO: 227773 - protein, 10 aa, Japanese encephalitis virus
GGITYTDLAR

SEQ ID NO: 227774 - protein, 10 aa, Japanese encephalitis virus
GITYTDLARY

SEQ ID NO: 227775 - protein, 10 aa, Japanese encephalitis virus
ITYTDLARYV

SEQ ID NO: 227776 - protein, 10 aa, Japanese encephalitis virus
TYTDLARYVV

SEQ ID NO: 227777 - protein, 10 aa, Japanese encephalitis virus
YTDLARYVVL

SEQ ID NO: 227778 - protein, 10 aa, Japanese encephalitis virus
TDLARYVVLV

SEQ ID NO: 227779 - protein, 10 aa, Japanese encephalitis virus
DLARYVVLVA

SEQ ID NO: 227780 - protein, 10 aa, Japanese encephalitis virus
LARYVVLVAA

SEQ ID NO: 227781 - protein, 10 aa, Japanese encephalitis virus
ARYVVLVAAA

SEQ ID NO: 227782 - protein, 10 aa, Japanese encephalitis virus
RYVVLVAAAF

SEQ ID NO: 227783 - protein, 10 aa, Japanese encephalitis virus
YVVLVAAAFA

SEQ ID NO: 227784 - protein, 10 aa, Japanese encephalitis virus
VVLVAAAFAE

SEQ ID NO: 227785 - protein, 10 aa, Japanese encephalitis virus
VLVAAAFAEA

SEQ ID NO: 227786 - protein, 10 aa, Japanese encephalitis virus
LVAAAFAEAN

SEQ ID NO: 227787 - protein, 10 aa, Japanese encephalitis virus
VAAAFAEANS

SEQ ID NO: 227788 - protein, 10 aa, Japanese encephalitis virus
AAAFAEANSG

SEQ ID NO: 227789 - protein, 10 aa, Japanese encephalitis virus
AAFAEANSGG

SEQ ID NO: 227790 - protein, 10 aa, Japanese encephalitis virus
AFAEANSGGD

SEQ ID NO: 227791 - protein, 10 aa, Japanese encephalitis virus
FAEANSGGDV

SEQ ID NO: 227792 - protein, 10 aa, Japanese encephalitis virus
AEANSGGDVL

SEQ ID NO: 227793 - protein, 10 aa, Japanese encephalitis virus
EANSGGDVLH

SEQ ID NO: 227794 - protein, 10 aa, Japanese encephalitis virus
ANSGGDVLHL

SEQ ID NO: 227795 - protein, 10 aa, Japanese encephalitis virus
NSGGDVLHLA

SEQ ID NO: 227796 - protein, 10 aa, Japanese encephalitis virus
SGGDVLHLAL

SEQ ID NO: 227797 - protein, 10 aa, Japanese encephalitis virus
GGDVLHLALI

SEQ ID NO: 227798 - protein, 10 aa, Japanese encephalitis virus
GDVLHLALIA

SEQ ID NO: 227799 - protein, 10 aa, Japanese encephalitis virus
DVLHLALIAV

SEQ ID NO: 227800 - protein, 10 aa, Japanese encephalitis virus
VLHLALIAVF

SEQ ID NO: 227801 - protein, 10 aa, Japanese encephalitis virus
LHLALIAVFK

SEQ ID NO: 227802 - protein, 10 aa, Japanese encephalitis virus
HLALIAVFKI

SEQ ID NO: 227803 - protein, 10 aa, Japanese encephalitis virus
LALIAVFKIQ

SEQ ID NO: 227804 - protein, 10 aa, Japanese encephalitis virus
ALIAVFKIQP

SEQ ID NO: 227805 - protein, 10 aa, Japanese encephalitis virus
LIAVFKIQPA

SEQ ID NO: 227806 - protein, 10 aa, Japanese encephalitis virus
IAVFKIQPAF

SEQ ID NO: 227807 - protein, 10 aa, Japanese encephalitis virus
AVFKIQPAFL

SEQ ID NO: 227808 - protein, 10 aa, Japanese encephalitis virus
VFKIQPAFLV

SEQ ID NO: 227809 - protein, 10 aa, Japanese encephalitis virus
FKIQPAFLVM

SEQ ID NO: 227810 - protein, 10 aa, Japanese encephalitis virus
KIQPAFLVMN

SEQ ID NO: 227811 - protein, 10 aa, Japanese encephalitis virus
IQPAFLVMNM

SEQ ID NO: 227812 - protein, 10 aa, Japanese encephalitis virus
QPAFLVMNML

SEQ ID NO: 227813 - protein, 10 aa, Japanese encephalitis virus
PAFLVMNMLS

SEQ ID NO: 227814 - protein, 10 aa, Japanese encephalitis virus
AFLVMNMLST

SEQ ID NO: 227815 - protein, 10 aa, Japanese encephalitis virus
NMLSTRWTNQ

SEQ ID NO: 227816 - protein, 10 aa, Japanese encephalitis virus
MLSTRWTNQE

SEQ ID NO: 227817 - protein, 10 aa, Japanese encephalitis virus
LSTRWTNQEN

SEQ ID NO: 227818 - protein, 10 aa, Japanese encephalitis virus
STRWTNQENV

SEQ ID NO: 227819 - protein, 10 aa, Japanese encephalitis virus
TRWTNQENVV

SEQ ID NO: 227820 - protein, 10 aa, Japanese encephalitis virus
RWTNQENVVL

SEQ ID NO: 227821 - protein, 10 aa, Japanese encephalitis virus
WTNQENVVLV

SEQ ID NO: 227822 - protein, 10 aa, Japanese encephalitis virus
TNQENVVLVL

SEQ ID NO: 227823 - protein, 10 aa, Japanese encephalitis virus
NQENVVLVLG

SEQ ID NO: 227824 - protein, 10 aa, Japanese encephalitis virus
QENVVLVLGA

SEQ ID NO: 227825 - protein, 10 aa, Japanese encephalitis virus
ENVVLVLGAA

SEQ ID NO: 227826 - protein, 10 aa, Japanese encephalitis virus
NVVLVLGAAF

SEQ ID NO: 227827 - protein, 10 aa, Japanese encephalitis virus
VVLVLGAAFF

SEQ ID NO: 227828 - protein, 10 aa, Japanese encephalitis virus
VLVLGAAFFQ

SEQ ID NO: 227829 - protein, 10 aa, Japanese encephalitis virus
LVLGAAFFQL

SEQ ID NO: 227830 - protein, 10 aa, Japanese encephalitis virus
VLGAAFFQLA

SEQ ID NO: 227831 - protein, 10 aa, Japanese encephalitis virus
LGAAFFQLAS

SEQ ID NO: 227832 - protein, 10 aa, Japanese encephalitis virus
GAAFFQLASV

SEQ ID NO: 227833 - protein, 10 aa, Japanese encephalitis virus
AAFFQLASVD

SEQ ID NO: 227834 - protein, 10 aa, Japanese encephalitis virus
AFFQLASVDL

SEQ ID NO: 227835 - protein, 10 aa, Japanese encephalitis virus
FFQLASVDLQ

SEQ ID NO: 227836 - protein, 10 aa, Japanese encephalitis virus
FQLASVDLQI

SEQ ID NO: 227837 - protein, 10 aa, Japanese encephalitis virus
QLASVDLQIG

SEQ ID NO: 227838 - protein, 10 aa, Japanese encephalitis virus
LASVDLQIGV

SEQ ID NO: 227839 - protein, 10 aa, Japanese encephalitis virus
ASVDLQIGVH

SEQ ID NO: 227840 - protein, 10 aa, Japanese encephalitis virus
SVDLQIGVHG

SEQ ID NO: 227841 - protein, 10 aa, Japanese encephalitis virus
VDLQIGVHGI

SEQ ID NO: 227842 - protein, 10 aa, Japanese encephalitis virus
DLQIGVHGIL

SEQ ID NO: 227843 - protein, 10 aa, Japanese encephalitis virus
LQIGVHGILN

SEQ ID NO: 227844 - protein, 10 aa, Japanese encephalitis virus
QIGVHGILNA

SEQ ID NO: 227845 - protein, 10 aa, Japanese encephalitis virus
IGVHGILNAA

SEQ ID NO: 227846 - protein, 10 aa, Japanese encephalitis virus
GVHGILNAAA

SEQ ID NO: 227847 - protein, 10 aa, Japanese encephalitis virus
VHGILNAAAI

SEQ ID NO: 227848 - protein, 10 aa, Japanese encephalitis virus
HGILNAAAIA

SEQ ID NO: 227849 - protein, 10 aa, Japanese encephalitis virus
GILNAAAIAW

SEQ ID NO: 227850 - protein, 10 aa, Japanese encephalitis virus
ILNAAAIAWM

SEQ ID NO: 227851 - protein, 10 aa, Japanese encephalitis virus
LNAAAIAWMI

SEQ ID NO: 227852 - protein, 10 aa, Japanese encephalitis virus
NAAAIAWMIV

SEQ ID NO: 227853 - protein, 10 aa, Japanese encephalitis virus
AAAIAWMIVR

SEQ ID NO: 227854 - protein, 10 aa, Japanese encephalitis virus
AAIAWMIVRA

SEQ ID NO: 227855 - protein, 10 aa, Japanese encephalitis virus
AIAWMIVRAI

SEQ ID NO: 227856 - protein, 10 aa, Japanese encephalitis virus
IAWMIVRAIT

SEQ ID NO: 227857 - protein, 10 aa, Japanese encephalitis virus
AWMIVRAITF

SEQ ID NO: 227858 - protein, 10 aa, Japanese encephalitis virus
WMIVRAITFP

SEQ ID NO: 227859 - protein, 10 aa, Japanese encephalitis virus
MIVRAITFPT

SEQ ID NO: 227860 - protein, 10 aa, Japanese encephalitis virus
IVRAITFPTT

SEQ ID NO: 227861 - protein, 10 aa, Japanese encephalitis virus
VRAITFPTTS

SEQ ID NO: 227862 - protein, 10 aa, Japanese encephalitis virus
RAITFPTTSS

SEQ ID NO: 227863 - protein, 10 aa, Japanese encephalitis virus
AITFPTTSSV

SEQ ID NO: 227864 - protein, 10 aa, Japanese encephalitis virus
ITFPTTSSVT

SEQ ID NO: 227865 - protein, 10 aa, Japanese encephalitis virus
TFPTTSSVTM

SEQ ID NO: 227866 - protein, 10 aa, Japanese encephalitis virus
FPTTSSVTMP

SEQ ID NO: 227867 - protein, 10 aa, Japanese encephalitis virus
MPVLALLTPG

SEQ ID NO: 227868 - protein, 10 aa, Japanese encephalitis virus
PVLALLTPGM

SEQ ID NO: 227869 - protein, 10 aa, Japanese encephalitis virus
VLALLTPGMR

SEQ ID NO: 227870 - protein, 10 aa, Japanese encephalitis virus
LALLTPGMRA

SEQ ID NO: 227871 - protein, 10 aa, Japanese encephalitis virus
ALLTPGMRAL

SEQ ID NO: 227872 - protein, 10 aa, Japanese encephalitis virus
LLTPGMRALY

SEQ ID NO: 227873 - protein, 10 aa, Japanese encephalitis virus
LTPGMRALYL

SEQ ID NO: 227874 - protein, 10 aa, Japanese encephalitis virus
TPGMRALYLD

SEQ ID NO: 227875 - protein, 10 aa, Japanese encephalitis virus
PGMRALYLDT

SEQ ID NO: 227876 - protein, 10 aa, Japanese encephalitis virus
GMRALYLDTY

SEQ ID NO: 227877 - protein, 10 aa, Japanese encephalitis virus
MRALYLDTYR

SEQ ID NO: 227878 - protein, 10 aa, Japanese encephalitis virus
RALYLDTYRI

SEQ ID NO: 227879 - protein, 10 aa, Japanese encephalitis virus
ALYLDTYRII

SEQ ID NO: 227880 - protein, 10 aa, Japanese encephalitis virus
LYLDTYRIIL

SEQ ID NO: 227881 - protein, 10 aa, Japanese encephalitis virus
YLDTYRIILL

SEQ ID NO: 227882 - protein, 10 aa, Japanese encephalitis virus
LDTYRIILLV

SEQ ID NO: 227883 - protein, 10 aa, Japanese encephalitis virus
DTYRIILLVI

SEQ ID NO: 227884 - protein, 10 aa, Japanese encephalitis virus
TYRIILLVIG

SEQ ID NO: 227885 - protein, 10 aa, Japanese encephalitis virus
YRIILLVIGI

SEQ ID NO: 227886 - protein, 10 aa, Japanese encephalitis virus
RIILLVIGIC

SEQ ID NO: 227887 - protein, 10 aa, Japanese encephalitis virus
IILLVIGICS

SEQ ID NO: 227888 - protein, 10 aa, Japanese encephalitis virus
ILLVIGICSL

SEQ ID NO: 227889 - protein, 10 aa, Japanese encephalitis virus
LLVIGICSLL

SEQ ID NO: 227890 - protein, 10 aa, Japanese encephalitis virus
LVIGICSLLQ

SEQ ID NO: 227891 - protein, 10 aa, Japanese encephalitis virus
VIGICSLLQE

SEQ ID NO: 227892 - protein, 10 aa, Japanese encephalitis virus
IGICSLLQER

SEQ ID NO: 227893 - protein, 10 aa, Japanese encephalitis virus
ERKKTMAKKK

SEQ ID NO: 227894 - protein, 10 aa, Japanese encephalitis virus
RKKTMAKKKG

SEQ ID NO: 227895 - protein, 10 aa, Japanese encephalitis virus
KKTMAKKKGA

SEQ ID NO: 227896 - protein, 10 aa, Japanese encephalitis virus
KTMAKKKGAV

SEQ ID NO: 227897 - protein, 10 aa, Japanese encephalitis virus
TMAKKKGAVL

SEQ ID NO: 227898 - protein, 10 aa, Japanese encephalitis virus
MAKKKGAVLL

SEQ ID NO: 227899 - protein, 10 aa, Japanese encephalitis virus
AKKKGAVLLG

SEQ ID NO: 227900 - protein, 10 aa, Japanese encephalitis virus
KKKGAVLLGL

SEQ ID NO: 227901 - protein, 10 aa, Japanese encephalitis virus
KKGAVLLGLA

SEQ ID NO: 227902 - protein, 10 aa, Japanese encephalitis virus
KGAVLLGLAL

SEQ ID NO: 227903 - protein, 10 aa, Japanese encephalitis virus
GAVLLGLALT

SEQ ID NO: 227904 - protein, 10 aa, Japanese encephalitis virus
AVLLGLALTS

SEQ ID NO: 227905 - protein, 10 aa, Japanese encephalitis virus
VLLGLALTST

SEQ ID NO: 227906 - protein, 10 aa, Japanese encephalitis virus
LLGLALTSTG

SEQ ID NO: 227907 - protein, 10 aa, Japanese encephalitis virus
LGLALTSTGW

SEQ ID NO: 227908 - protein, 10 aa, Japanese encephalitis virus
GLALTSTGWF

SEQ ID NO: 227909 - protein, 10 aa, Japanese encephalitis virus
LALTSTGWFS

SEQ ID NO: 227910 - protein, 10 aa, Japanese encephalitis virus
ALTSTGWFSP

SEQ ID NO: 227911 - protein, 10 aa, Japanese encephalitis virus
LTSTGWFSPT

SEQ ID NO: 227912 - protein, 10 aa, Japanese encephalitis virus
TSTGWFSPTT

SEQ ID NO: 227913 - protein, 10 aa, Japanese encephalitis virus
STGWFSPTTI

SEQ ID NO: 227914 - protein, 10 aa, Japanese encephalitis virus
TGWFSPTTIA

SEQ ID NO: 227915 - protein, 10 aa, Japanese encephalitis virus
GWFSPTTIAA

SEQ ID NO: 227916 - protein, 10 aa, Japanese encephalitis virus
WFSPTTIAAG

SEQ ID NO: 227917 - protein, 10 aa, Japanese encephalitis virus
FSPTTIAAGL

SEQ ID NO: 227918 - protein, 10 aa, Japanese encephalitis virus
SPTTIAAGLM

SEQ ID NO: 227919 - protein, 10 aa, Japanese encephalitis virus
PTTIAAGLMV

SEQ ID NO: 227920 - protein, 10 aa, Japanese encephalitis virus
TTIAAGLMVC

SEQ ID NO: 227921 - protein, 10 aa, Japanese encephalitis virus
TIAAGLMVCN

SEQ ID NO: 227922 - protein, 10 aa, Japanese encephalitis virus
IAAGLMVCNP

SEQ ID NO: 227923 - protein, 10 aa, Japanese encephalitis virus
AAGLMVCNPN

SEQ ID NO: 227924 - protein, 10 aa, Japanese encephalitis virus
AGLMVCNPNK

SEQ ID NO: 227925 - protein, 10 aa, Japanese encephalitis virus
GLMVCNPNKK

SEQ ID NO: 227926 - protein, 10 aa, Japanese encephalitis virus
LMVCNPNKKR

SEQ ID NO: 227927 - protein, 10 aa, Japanese encephalitis virus
MVCNPNKKRG

SEQ ID NO: 227928 - protein, 10 aa, Japanese encephalitis virus
VCNPNKKRGW

SEQ ID NO: 227929 - protein, 10 aa, Japanese encephalitis virus
CNPNKKRGWP

SEQ ID NO: 227930 - protein, 10 aa, Japanese encephalitis virus
NPNKKRGWPA

SEQ ID NO: 227931 - protein, 10 aa, Japanese encephalitis virus
PNKKRGWPAT

SEQ ID NO: 227932 - protein, 10 aa, Japanese encephalitis virus
NKKRGWPATE

SEQ ID NO: 227933 - protein, 10 aa, Japanese encephalitis virus
KKRGWPATEF

SEQ ID NO: 227934 - protein, 10 aa, Japanese encephalitis virus
KRGWPATEFL

SEQ ID NO: 227935 - protein, 10 aa, Japanese encephalitis virus
RGWPATEFLS

SEQ ID NO: 227936 - protein, 10 aa, Japanese encephalitis virus
GWPATEFLSA

SEQ ID NO: 227937 - protein, 10 aa, Japanese encephalitis virus
WPATEFLSAV

SEQ ID NO: 227938 - protein, 10 aa, Japanese encephalitis virus
PATEFLSAVG

SEQ ID NO: 227939 - protein, 10 aa, Japanese encephalitis virus
ATEFLSAVGL

SEQ ID NO: 227940 - protein, 10 aa, Japanese encephalitis virus
TEFLSAVGLM

SEQ ID NO: 227941 - protein, 10 aa, Japanese encephalitis virus
EFLSAVGLMF

SEQ ID NO: 227942 - protein, 10 aa, Japanese encephalitis virus
FLSAVGLMFA

SEQ ID NO: 227943 - protein, 10 aa, Japanese encephalitis virus
LSAVGLMFAI

SEQ ID NO: 227944 - protein, 10 aa, Japanese encephalitis virus
SAVGLMFAIV

SEQ ID NO: 227945 - protein, 10 aa, Japanese encephalitis virus
AVGLMFAIVG

SEQ ID NO: 227946 - protein, 10 aa, Japanese encephalitis virus
VGLMFAIVGG

SEQ ID NO: 227947 - protein, 10 aa, Japanese encephalitis virus
GLMFAIVGGL

SEQ ID NO: 227948 - protein, 10 aa, Japanese encephalitis virus
LMFAIVGGLA

SEQ ID NO: 227949 - protein, 10 aa, Japanese encephalitis virus
MFAIVGGLAE

SEQ ID NO: 227950 - protein, 10 aa, Japanese encephalitis virus
FAIVGGLAEL

SEQ ID NO: 227951 - protein, 10 aa, Japanese encephalitis virus
AIVGGLAELD

SEQ ID NO: 227952 - protein, 10 aa, Japanese encephalitis virus
IVGGLAELDI

SEQ ID NO: 227953 - protein, 10 aa, Japanese encephalitis virus
VGGLAELDIE

SEQ ID NO: 227954 - protein, 10 aa, Japanese encephalitis virus
GGLAELDIES

SEQ ID NO: 227955 - protein, 10 aa, Japanese encephalitis virus
GLAELDIESM

SEQ ID NO: 227956 - protein, 10 aa, Japanese encephalitis virus
LAELDIESMS

SEQ ID NO: 227957 - protein, 10 aa, Japanese encephalitis virus
AELDIESMSI

SEQ ID NO: 227958 - protein, 10 aa, Japanese encephalitis virus
ELDIESMSIP

SEQ ID NO: 227959 - protein, 10 aa, Japanese encephalitis virus
LDIESMSIPF

SEQ ID NO: 227960 - protein, 10 aa, Japanese encephalitis virus
DIESMSIPFM

SEQ ID NO: 227961 - protein, 10 aa, Japanese encephalitis virus
IESMSIPFML

SEQ ID NO: 227962 - protein, 10 aa, Japanese encephalitis virus
ESMSIPFMLA

SEQ ID NO: 227963 - protein, 10 aa, Japanese encephalitis virus
SMSIPFMLAG

SEQ ID NO: 227964 - protein, 10 aa, Japanese encephalitis virus
MSIPFMLAGL

SEQ ID NO: 227965 - protein, 10 aa, Japanese encephalitis virus
SIPFMLAGLM

SEQ ID NO: 227966 - protein, 10 aa, Japanese encephalitis virus
IPFMLAGLMA

SEQ ID NO: 227967 - protein, 10 aa, Japanese encephalitis virus
PFMLAGLMAV

SEQ ID NO: 227968 - protein, 10 aa, Japanese encephalitis virus
FMLAGLMAVS

SEQ ID NO: 227969 - protein, 10 aa, Japanese encephalitis virus
MLAGLMAVSY

SEQ ID NO: 227970 - protein, 10 aa, Japanese encephalitis virus
LAGLMAVSYV

SEQ ID NO: 227971 - protein, 10 aa, Japanese encephalitis virus
AGLMAVSYVV

SEQ ID NO: 227972 - protein, 10 aa, Japanese encephalitis virus
GLMAVSYVVS

SEQ ID NO: 227973 - protein, 10 aa, Japanese encephalitis virus
LMAVSYVVSG

SEQ ID NO: 227974 - protein, 10 aa, Japanese encephalitis virus
MAVSYVVSGK

SEQ ID NO: 227975 - protein, 10 aa, Japanese encephalitis virus
AVSYVVSGKA

SEQ ID NO: 227976 - protein, 10 aa, Japanese encephalitis virus
VSYVVSGKAT

SEQ ID NO: 227977 - protein, 10 aa, Japanese encephalitis virus
SYVVSGKATD

SEQ ID NO: 227978 - protein, 10 aa, Japanese encephalitis virus
YVVSGKATDM

SEQ ID NO: 227979 - protein, 10 aa, Japanese encephalitis virus
VVSGKATDMW

SEQ ID NO: 227980 - protein, 10 aa, Japanese encephalitis virus
VSGKATDMWL

SEQ ID NO: 227981 - protein, 10 aa, Japanese encephalitis virus
SGKATDMWLE

SEQ ID NO: 227982 - protein, 10 aa, Japanese encephalitis virus
GKATDMWLER

SEQ ID NO: 227983 - protein, 10 aa, Japanese encephalitis virus
KATDMWLERA

SEQ ID NO: 227984 - protein, 10 aa, Japanese encephalitis virus
ATDMWLERAA

SEQ ID NO: 227985 - protein, 10 aa, Japanese encephalitis virus
TDMWLERAAD

SEQ ID NO: 227986 - protein, 10 aa, Japanese encephalitis virus
DMWLERAADI

SEQ ID NO: 227987 - protein, 10 aa, Japanese encephalitis virus
MWLERAADIS

SEQ ID NO: 227988 - protein, 10 aa, Japanese encephalitis virus
WLERAADISW

SEQ ID NO: 227989 - protein, 10 aa, Japanese encephalitis virus
SWEMDAAITG

SEQ ID NO: 227990 - protein, 10 aa, Japanese encephalitis virus
WEMDAAITGS

SEQ ID NO: 227991 - protein, 10 aa, Japanese encephalitis virus
EMDAAITGSS

SEQ ID NO: 227992 - protein, 10 aa, Japanese encephalitis virus
MDAAITGSSR

SEQ ID NO: 227993 - protein, 10 aa, Japanese encephalitis virus
DAAITGSSRR

SEQ ID NO: 227994 - protein, 10 aa, Japanese encephalitis virus
AAITGSSRRL

SEQ ID NO: 227995 - protein, 10 aa, Japanese encephalitis virus
AITGSSRRLD

SEQ ID NO: 227996 - protein, 10 aa, Japanese encephalitis virus
ITGSSRRLDV

SEQ ID NO: 227997 - protein, 10 aa, Japanese encephalitis virus
TGSSRRLDVK

SEQ ID NO: 227998 - protein, 10 aa, Japanese encephalitis virus
GSSRRLDVKL

SEQ ID NO: 227999 - protein, 10 aa, Japanese encephalitis virus
SSRRLDVKLD

SEQ ID NO: 228000 - protein, 10 aa, Japanese encephalitis virus
SRRLDVKLDD

SEQ ID NO: 228001 - protein, 10 aa, Japanese encephalitis virus
RRLDVKLDDD

SEQ ID NO: 228002 - protein, 10 aa, Japanese encephalitis virus
RLDVKLDDDG

SEQ ID NO: 228003 - protein, 10 aa, Japanese encephalitis virus
LDVKLDDDGD

SEQ ID NO: 228004 - protein, 10 aa, Japanese encephalitis virus
DVKLDDDGDF

SEQ ID NO: 228005 - protein, 10 aa, Japanese encephalitis virus
VKLDDDGDFH

SEQ ID NO: 228006 - protein, 10 aa, Japanese encephalitis virus
KLDDDGDFHL

SEQ ID NO: 228007 - protein, 10 aa, Japanese encephalitis virus
LDDDGDFHLI

SEQ ID NO: 228008 - protein, 10 aa, Japanese encephalitis virus
DDDGDFHLID

SEQ ID NO: 228009 - protein, 10 aa, Japanese encephalitis virus
DDGDFHLIDD

SEQ ID NO: 228010 - protein, 10 aa, Japanese encephalitis virus
DGDFHLIDDP

SEQ ID NO: 228011 - protein, 10 aa, Japanese encephalitis virus
GDFHLIDDPG

SEQ ID NO: 228012 - protein, 10 aa, Japanese encephalitis virus
DFHLIDDPGV

SEQ ID NO: 228013 - protein, 10 aa, Japanese encephalitis virus
FHLIDDPGVP

SEQ ID NO: 228014 - protein, 10 aa, Japanese encephalitis virus
HLIDDPGVPW

SEQ ID NO: 228015 - protein, 10 aa, Japanese encephalitis virus
LIDDPGVPWK

SEQ ID NO: 228016 - protein, 10 aa, Japanese encephalitis virus
IDDPGVPWKV

SEQ ID NO: 228017 - protein, 10 aa, Japanese encephalitis virus
DDPGVPWKVW

SEQ ID NO: 228018 - protein, 10 aa, Japanese encephalitis virus
DPGVPWKVWV

SEQ ID NO: 228019 - protein, 10 aa, Japanese encephalitis virus
PGVPWKVWVL

SEQ ID NO: 228020 - protein, 10 aa, Japanese encephalitis virus
GVPWKVWVLR

SEQ ID NO: 228021 - protein, 10 aa, Japanese encephalitis virus
VPWKVWVLRM

SEQ ID NO: 228022 - protein, 10 aa, Japanese encephalitis virus
PWKVWVLRMS

SEQ ID NO: 228023 - protein, 10 aa, Japanese encephalitis virus
WKVWVLRMSC

SEQ ID NO: 228024 - protein, 10 aa, Japanese encephalitis virus
KVWVLRMSCI

SEQ ID NO: 228025 - protein, 10 aa, Japanese encephalitis virus
WVLRMSCIGL

SEQ ID NO: 228026 - protein, 10 aa, Japanese encephalitis virus
LRMSCIGLAA

SEQ ID NO: 228027 - protein, 10 aa, Japanese encephalitis virus
RMSCIGLAAL

SEQ ID NO: 228028 - protein, 10 aa, Japanese encephalitis virus
MSCIGLAALT

SEQ ID NO: 228029 - protein, 10 aa, Japanese encephalitis virus
SCIGLAALTP

SEQ ID NO: 228030 - protein, 10 aa, Japanese encephalitis virus
CIGLAALTPW

SEQ ID NO: 228031 - protein, 10 aa, Japanese encephalitis virus
IGLAALTPWA

SEQ ID NO: 228032 - protein, 10 aa, Japanese encephalitis virus
GLAALTPWAI

SEQ ID NO: 228033 - protein, 10 aa, Japanese encephalitis virus
LAALTPWAIV

SEQ ID NO: 228034 - protein, 10 aa, Japanese encephalitis virus
AALTPWAIVP

SEQ ID NO: 228035 - protein, 10 aa, Japanese encephalitis virus
ALTPWAIVPA

SEQ ID NO: 228036 - protein, 10 aa, Japanese encephalitis virus
LTPWAIVPAA

SEQ ID NO: 228037 - protein, 10 aa, Japanese encephalitis virus
TPWAIVPAAF

SEQ ID NO: 228038 - protein, 10 aa, Japanese encephalitis virus
PWAIVPAAFG

SEQ ID NO: 228039 - protein, 10 aa, Japanese encephalitis virus
WAIVPAAFGY

SEQ ID NO: 228040 - protein, 10 aa, Japanese encephalitis virus
AIVPAAFGYW

SEQ ID NO: 228041 - protein, 10 aa, Japanese encephalitis virus
IVPAAFGYWL

SEQ ID NO: 228042 - protein, 10 aa, Japanese encephalitis virus
VPAAFGYWLT

SEQ ID NO: 228043 - protein, 10 aa, Japanese encephalitis virus
PAAFGYWLTL

SEQ ID NO: 228044 - protein, 10 aa, Japanese encephalitis virus
AAFGYWLTLK

SEQ ID NO: 228045 - protein, 10 aa, Japanese encephalitis virus
AFGYWLTLKT

SEQ ID NO: 228046 - protein, 10 aa, Japanese encephalitis virus
FGYWLTLKTT

SEQ ID NO: 228047 - protein, 10 aa, Japanese encephalitis virus
GYWLTLKTTK

SEQ ID NO: 228048 - protein, 10 aa, Japanese encephalitis virus
YWLTLKTTKR

SEQ ID NO: 228049 - protein, 10 aa, Japanese encephalitis virus
WLTLKTTKRG

SEQ ID NO: 228050 - protein, 10 aa, Japanese encephalitis virus
LTLKTTKRGG

SEQ ID NO: 228051 - protein, 10 aa, Japanese encephalitis virus
TLKTTKRGGV

SEQ ID NO: 228052 - protein, 10 aa, Japanese encephalitis virus
LKTTKRGGVF

SEQ ID NO: 228053 - protein, 10 aa, Japanese encephalitis virus
KTTKRGGVFW

SEQ ID NO: 228054 - protein, 10 aa, Japanese encephalitis virus
TTKRGGVFWD

SEQ ID NO: 228055 - protein, 10 aa, Japanese encephalitis virus
TKRGGVFWDT

SEQ ID NO: 228056 - protein, 10 aa, Japanese encephalitis virus
KRGGVFWDTP

SEQ ID NO: 228057 - protein, 10 aa, Japanese encephalitis virus
RGGVFWDTPS

SEQ ID NO: 228058 - protein, 10 aa, Japanese encephalitis virus
GGVFWDTPSP

SEQ ID NO: 228059 - protein, 10 aa, Japanese encephalitis virus
GVFWDTPSPK

SEQ ID NO: 228060 - protein, 10 aa, Japanese encephalitis virus
VFWDTPSPKP

SEQ ID NO: 228061 - protein, 10 aa, Japanese encephalitis virus
FWDTPSPKPC

SEQ ID NO: 228062 - protein, 10 aa, Japanese encephalitis virus
WDTPSPKPCS

SEQ ID NO: 228063 - protein, 10 aa, Japanese encephalitis virus
DTPSPKPCSK

SEQ ID NO: 228064 - protein, 10 aa, Japanese encephalitis virus
TPSPKPCSKG

SEQ ID NO: 228065 - protein, 10 aa, Japanese encephalitis virus
PSPKPCSKGD

SEQ ID NO: 228066 - protein, 10 aa, Japanese encephalitis virus
SPKPCSKGDT

SEQ ID NO: 228067 - protein, 10 aa, Japanese encephalitis virus
PKPCSKGDTT

SEQ ID NO: 228068 - protein, 10 aa, Japanese encephalitis virus
KPCSKGDTTT

SEQ ID NO: 228069 - protein, 10 aa, Japanese encephalitis virus
PCSKGDTTTG

SEQ ID NO: 228070 - protein, 10 aa, Japanese encephalitis virus
CSKGDTTTGV

SEQ ID NO: 228071 - protein, 10 aa, Japanese encephalitis virus
SKGDTTTGVY

SEQ ID NO: 228072 - protein, 10 aa, Japanese encephalitis virus
KGDTTTGVYR

SEQ ID NO: 228073 - protein, 10 aa, Japanese encephalitis virus
GDTTTGVYRI

SEQ ID NO: 228074 - protein, 10 aa, Japanese encephalitis virus
DTTTGVYRIM

SEQ ID NO: 228075 - protein, 10 aa, Japanese encephalitis virus
TTTGVYRIMA

SEQ ID NO: 228076 - protein, 10 aa, Japanese encephalitis virus
TTGVYRIMAR

SEQ ID NO: 228077 - protein, 10 aa, Japanese encephalitis virus
TGVYRIMARG

SEQ ID NO: 228078 - protein, 10 aa, Japanese encephalitis virus
GVYRIMARGI

SEQ ID NO: 228079 - protein, 10 aa, Japanese encephalitis virus
VYRIMARGIL

SEQ ID NO: 228080 - protein, 10 aa, Japanese encephalitis virus
YRIMARGILG

SEQ ID NO: 228081 - protein, 10 aa, Japanese encephalitis virus
RIMARGILGT

SEQ ID NO: 228082 - protein, 10 aa, Japanese encephalitis virus
IMARGILGTY

SEQ ID NO: 228083 - protein, 10 aa, Japanese encephalitis virus
MARGILGTYQ

SEQ ID NO: 228084 - protein, 10 aa, Japanese encephalitis virus
ARGILGTYQA

SEQ ID NO: 228085 - protein, 10 aa, Japanese encephalitis virus
RGILGTYQAG

SEQ ID NO: 228086 - protein, 10 aa, Japanese encephalitis virus
GILGTYQAGV

SEQ ID NO: 228087 - protein, 10 aa, Japanese encephalitis virus
ILGTYQAGVG

SEQ ID NO: 228088 - protein, 10 aa, Japanese encephalitis virus
LGTYQAGVGV

SEQ ID NO: 228089 - protein, 10 aa, Japanese encephalitis virus
GTYQAGVGVM

SEQ ID NO: 228090 - protein, 10 aa, Japanese encephalitis virus
TYQAGVGVMY

SEQ ID NO: 228091 - protein, 10 aa, Japanese encephalitis virus
YQAGVGVMYE

SEQ ID NO: 228092 - protein, 10 aa, Japanese encephalitis virus
QAGVGVMYEN

SEQ ID NO: 228093 - protein, 10 aa, Japanese encephalitis virus
AGVGVMYENV

SEQ ID NO: 228094 - protein, 10 aa, Japanese encephalitis virus
GVGVMYENVF

SEQ ID NO: 228095 - protein, 10 aa, Japanese encephalitis virus
VGVMYENVFH

SEQ ID NO: 228096 - protein, 10 aa, Japanese encephalitis virus
GVMYENVFHT

SEQ ID NO: 228097 - protein, 10 aa, Japanese encephalitis virus
VMYENVFHTL

SEQ ID NO: 228098 - protein, 10 aa, Japanese encephalitis virus
MYENVFHTLW

SEQ ID NO: 228099 - protein, 10 aa, Japanese encephalitis virus
YENVFHTLWH

SEQ ID NO: 228100 - protein, 10 aa, Japanese encephalitis virus
ENVFHTLWHT

SEQ ID NO: 228101 - protein, 10 aa, Japanese encephalitis virus
NVFHTLWHTT

SEQ ID NO: 228102 - protein, 10 aa, Japanese encephalitis virus
VFHTLWHTTR

SEQ ID NO: 228103 - protein, 10 aa, Japanese encephalitis virus
FHTLWHTTRG

SEQ ID NO: 228104 - protein, 10 aa, Japanese encephalitis virus
HTLWHTTRGA

SEQ ID NO: 228105 - protein, 10 aa, Japanese encephalitis virus
TLWHTTRGAA

SEQ ID NO: 228106 - protein, 10 aa, Japanese encephalitis virus
LWHTTRGAAI

SEQ ID NO: 228107 - protein, 10 aa, Japanese encephalitis virus
WHTTRGAAIM

SEQ ID NO: 228108 - protein, 10 aa, Japanese encephalitis virus
HTTRGAAIMS

SEQ ID NO: 228109 - protein, 10 aa, Japanese encephalitis virus
TTRGAAIMSG

SEQ ID NO: 228110 - protein, 10 aa, Japanese encephalitis virus
TRGAAIMSGE

SEQ ID NO: 228111 - protein, 10 aa, Japanese encephalitis virus
RGAAIMSGEG

SEQ ID NO: 228112 - protein, 10 aa, Japanese encephalitis virus
GAAIMSGEGK

SEQ ID NO: 228113 - protein, 10 aa, Japanese encephalitis virus
AAIMSGEGKL

SEQ ID NO: 228114 - protein, 10 aa, Japanese encephalitis virus
AIMSGEGKLT

SEQ ID NO: 228115 - protein, 10 aa, Japanese encephalitis virus
IMSGEGKLTP

SEQ ID NO: 228116 - protein, 10 aa, Japanese encephalitis virus
MSGEGKLTPY

SEQ ID NO: 228117 - protein, 10 aa, Japanese encephalitis virus
SGEGKLTPYW

SEQ ID NO: 228118 - protein, 10 aa, Japanese encephalitis virus
GEGKLTPYWG

SEQ ID NO: 228119 - protein, 10 aa, Japanese encephalitis virus
EGKLTPYWGS

SEQ ID NO: 228120 - protein, 10 aa, Japanese encephalitis virus
GKLTPYWGSV

SEQ ID NO: 228121 - protein, 10 aa, Japanese encephalitis virus
KLTPYWGSVK

SEQ ID NO: 228122 - protein, 10 aa, Japanese encephalitis virus
LTPYWGSVKE

SEQ ID NO: 228123 - protein, 10 aa, Japanese encephalitis virus
TPYWGSVKED

SEQ ID NO: 228124 - protein, 10 aa, Japanese encephalitis virus
PYWGSVKEDR

SEQ ID NO: 228125 - protein, 10 aa, Japanese encephalitis virus
YWGSVKEDRI

SEQ ID NO: 228126 - protein, 10 aa, Japanese encephalitis virus
WGSVKEDRIA

SEQ ID NO: 228127 - protein, 10 aa, Japanese encephalitis virus
GSVKEDRIAY

SEQ ID NO: 228128 - protein, 10 aa, Japanese encephalitis virus
SVKEDRIAYG

SEQ ID NO: 228129 - protein, 10 aa, Japanese encephalitis virus
VKEDRIAYGG

SEQ ID NO: 228130 - protein, 10 aa, Japanese encephalitis virus
KEDRIAYGGP

SEQ ID NO: 228131 - protein, 10 aa, Japanese encephalitis virus
EDRIAYGGPW

SEQ ID NO: 228132 - protein, 10 aa, Japanese encephalitis virus
DRIAYGGPWR

SEQ ID NO: 228133 - protein, 10 aa, Japanese encephalitis virus
RIAYGGPWRF

SEQ ID NO: 228134 - protein, 10 aa, Japanese encephalitis virus
IAYGGPWRFD

SEQ ID NO: 228135 - protein, 10 aa, Japanese encephalitis virus
AYGGPWRFDR

SEQ ID NO: 228136 - protein, 10 aa, Japanese encephalitis virus
YGGPWRFDRK

SEQ ID NO: 228137 - protein, 10 aa, Japanese encephalitis virus
GGPWRFDRKW

SEQ ID NO: 228138 - protein, 10 aa, Japanese encephalitis virus
GPWRFDRKWN

SEQ ID NO: 228139 - protein, 10 aa, Japanese encephalitis virus
PWRFDRKWNG

SEQ ID NO: 228140 - protein, 10 aa, Japanese encephalitis virus
WRFDRKWNGT

SEQ ID NO: 228141 - protein, 10 aa, Japanese encephalitis virus
RFDRKWNGTD

SEQ ID NO: 228142 - protein, 10 aa, Japanese encephalitis virus
FDRKWNGTDD

SEQ ID NO: 228143 - protein, 10 aa, Japanese encephalitis virus
DRKWNGTDDV

SEQ ID NO: 228144 - protein, 10 aa, Japanese encephalitis virus
RKWNGTDDVQ

SEQ ID NO: 228145 - protein, 10 aa, Japanese encephalitis virus
KWNGTDDVQV

SEQ ID NO: 228146 - protein, 10 aa, Japanese encephalitis virus
WNGTDDVQVI

SEQ ID NO: 228147 - protein, 10 aa, Japanese encephalitis virus
NGTDDVQVIV

SEQ ID NO: 228148 - protein, 10 aa, Japanese encephalitis virus
GTDDVQVIVV

SEQ ID NO: 228149 - protein, 10 aa, Japanese encephalitis virus
TDDVQVIVVE

SEQ ID NO: 228150 - protein, 10 aa, Japanese encephalitis virus
DDVQVIVVEP

SEQ ID NO: 228151 - protein, 10 aa, Japanese encephalitis virus
DVQVIVVEPG

SEQ ID NO: 228152 - protein, 10 aa, Japanese encephalitis virus
VQVIVVEPGK

SEQ ID NO: 228153 - protein, 10 aa, Japanese encephalitis virus
QVIVVEPGKA

SEQ ID NO: 228154 - protein, 10 aa, Japanese encephalitis virus
VIVVEPGKAA

SEQ ID NO: 228155 - protein, 10 aa, Japanese encephalitis virus
NIQTKPGVFR

SEQ ID NO: 228156 - protein, 10 aa, Japanese encephalitis virus
IQTKPGVFRT

SEQ ID NO: 228157 - protein, 10 aa, Japanese encephalitis virus
QTKPGVFRTP

SEQ ID NO: 228158 - protein, 10 aa, Japanese encephalitis virus
TKPGVFRTPF

SEQ ID NO: 228159 - protein, 10 aa, Japanese encephalitis virus
KPGVFRTPFG

SEQ ID NO: 228160 - protein, 10 aa, Japanese encephalitis virus
PFGEVGAVSL

SEQ ID NO: 228161 - protein, 10 aa, Japanese encephalitis virus
FGEVGAVSLD

SEQ ID NO: 228162 - protein, 10 aa, Japanese encephalitis virus
GEVGAVSLDY

SEQ ID NO: 228163 - protein, 10 aa, Japanese encephalitis virus
EVGAVSLDYP

SEQ ID NO: 228164 - protein, 10 aa, Japanese encephalitis virus
VGAVSLDYPR

SEQ ID NO: 228165 - protein, 10 aa, Japanese encephalitis virus
GAVSLDYPRG

SEQ ID NO: 228166 - protein, 10 aa, Japanese encephalitis virus
AVSLDYPRGT

SEQ ID NO: 228167 - protein, 10 aa, Japanese encephalitis virus
VSLDYPRGTS

SEQ ID NO: 228168 - protein, 10 aa, Japanese encephalitis virus
SLDYPRGTSG

SEQ ID NO: 228169 - protein, 10 aa, Japanese encephalitis virus
LDYPRGTSGS

SEQ ID NO: 228170 - protein, 10 aa, Japanese encephalitis virus
DYPRGTSGSP

SEQ ID NO: 228171 - protein, 10 aa, Japanese encephalitis virus
YPRGTSGSPI

SEQ ID NO: 228172 - protein, 10 aa, Japanese encephalitis virus
PRGTSGSPIL

SEQ ID NO: 228173 - protein, 10 aa, Japanese encephalitis virus
RGTSGSPILD

SEQ ID NO: 228174 - protein, 10 aa, Japanese encephalitis virus
GTSGSPILDS

SEQ ID NO: 228175 - protein, 10 aa, Japanese encephalitis virus
TSGSPILDSN

SEQ ID NO: 228176 - protein, 10 aa, Japanese encephalitis virus
SGSPILDSNG

SEQ ID NO: 228177 - protein, 10 aa, Japanese encephalitis virus
GSPILDSNGD

SEQ ID NO: 228178 - protein, 10 aa, Japanese encephalitis virus
SPILDSNGDI

SEQ ID NO: 228179 - protein, 10 aa, Japanese encephalitis virus
PILDSNGDII

SEQ ID NO: 228180 - protein, 10 aa, Japanese encephalitis virus
ILDSNGDIIG

SEQ ID NO: 228181 - protein, 10 aa, Japanese encephalitis virus
LDSNGDIIGL

SEQ ID NO: 228182 - protein, 10 aa, Japanese encephalitis virus
DSNGDIIGLY

SEQ ID NO: 228183 - protein, 10 aa, Japanese encephalitis virus
SNGDIIGLYG

SEQ ID NO: 228184 - protein, 10 aa, Japanese encephalitis virus
NGDIIGLYGN

SEQ ID NO: 228185 - protein, 10 aa, Japanese encephalitis virus
GDIIGLYGNG

SEQ ID NO: 228186 - protein, 10 aa, Japanese encephalitis virus
DIIGLYGNGV

SEQ ID NO: 228187 - protein, 10 aa, Japanese encephalitis virus
IIGLYGNGVE

SEQ ID NO: 228188 - protein, 10 aa, Japanese encephalitis virus
IGLYGNGVEL

SEQ ID NO: 228189 - protein, 10 aa, Japanese encephalitis virus
GLYGNGVELG

SEQ ID NO: 228190 - protein, 10 aa, Japanese encephalitis virus
LYGNGVELGD

SEQ ID NO: 228191 - protein, 10 aa, Japanese encephalitis virus
YGNGVELGDG

SEQ ID NO: 228192 - protein, 10 aa, Japanese encephalitis virus
GNGVELGDGS

SEQ ID NO: 228193 - protein, 10 aa, Japanese encephalitis virus
NGVELGDGSY

SEQ ID NO: 228194 - protein, 10 aa, Japanese encephalitis virus
GVELGDGSYV

SEQ ID NO: 228195 - protein, 10 aa, Japanese encephalitis virus
VELGDGSYVS

SEQ ID NO: 228196 - protein, 10 aa, Japanese encephalitis virus
ELGDGSYVSA

SEQ ID NO: 228197 - protein, 10 aa, Japanese encephalitis virus
LGDGSYVSAI

SEQ ID NO: 228198 - protein, 10 aa, Japanese encephalitis virus
GDGSYVSAIV

SEQ ID NO: 228199 - protein, 10 aa, Japanese encephalitis virus
DGSYVSAIVQ

SEQ ID NO: 228200 - protein, 10 aa, Japanese encephalitis virus
GSYVSAIVQG

SEQ ID NO: 228201 - protein, 10 aa, Japanese encephalitis virus
SYVSAIVQGD

SEQ ID NO: 228202 - protein, 10 aa, Japanese encephalitis virus
YVSAIVQGDR

SEQ ID NO: 228203 - protein, 10 aa, Japanese encephalitis virus
VSAIVQGDRQ

SEQ ID NO: 228204 - protein, 10 aa, Japanese encephalitis virus
SAIVQGDRQE

SEQ ID NO: 228205 - protein, 10 aa, Japanese encephalitis virus
AIVQGDRQEE

SEQ ID NO: 228206 - protein, 10 aa, Japanese encephalitis virus
IVQGDRQEEP

SEQ ID NO: 228207 - protein, 10 aa, Japanese encephalitis virus
VQGDRQEEPV

SEQ ID NO: 228208 - protein, 10 aa, Japanese encephalitis virus
QGDRQEEPVP

SEQ ID NO: 228209 - protein, 10 aa, Japanese encephalitis virus
GDRQEEPVPE

SEQ ID NO: 228210 - protein, 10 aa, Japanese encephalitis virus
DRQEEPVPEA

SEQ ID NO: 228211 - protein, 10 aa, Japanese encephalitis virus
RQEEPVPEAY

SEQ ID NO: 228212 - protein, 10 aa, Japanese encephalitis virus
QEEPVPEAYT

SEQ ID NO: 228213 - protein, 10 aa, Japanese encephalitis virus
EEPVPEAYTP

SEQ ID NO: 228214 - protein, 10 aa, Japanese encephalitis virus
EPVPEAYTPN

SEQ ID NO: 228215 - protein, 10 aa, Japanese encephalitis virus
PVPEAYTPNM

SEQ ID NO: 228216 - protein, 10 aa, Japanese encephalitis virus
VPEAYTPNML

SEQ ID NO: 228217 - protein, 10 aa, Japanese encephalitis virus
MLRKRQMTVL

SEQ ID NO: 228218 - protein, 10 aa, Japanese encephalitis virus
LRKRQMTVLD

SEQ ID NO: 228219 - protein, 10 aa, Japanese encephalitis virus
RKRQMTVLDL

SEQ ID NO: 228220 - protein, 10 aa, Japanese encephalitis virus
KRQMTVLDLH

SEQ ID NO: 228221 - protein, 10 aa, Japanese encephalitis virus
RQMTVLDLHP

SEQ ID NO: 228222 - protein, 10 aa, Japanese encephalitis virus
QMTVLDLHPG

SEQ ID NO: 228223 - protein, 10 aa, Japanese encephalitis virus
MTVLDLHPGS

SEQ ID NO: 228224 - protein, 10 aa, Japanese encephalitis virus
TVLDLHPGSG

SEQ ID NO: 228225 - protein, 10 aa, Japanese encephalitis virus
VLDLHPGSGK

SEQ ID NO: 228226 - protein, 10 aa, Japanese encephalitis virus
LDLHPGSGKT

SEQ ID NO: 228227 - protein, 10 aa, Japanese encephalitis virus
DLHPGSGKTR

SEQ ID NO: 228228 - protein, 10 aa, Japanese encephalitis virus
LHPGSGKTRK

SEQ ID NO: 228229 - protein, 10 aa, Japanese encephalitis virus
HPGSGKTRKI

SEQ ID NO: 228230 - protein, 10 aa, Japanese encephalitis virus
PGSGKTRKIL

SEQ ID NO: 228231 - protein, 10 aa, Japanese encephalitis virus
GSGKTRKILP

SEQ ID NO: 228232 - protein, 10 aa, Japanese encephalitis virus
SGKTRKILPQ

SEQ ID NO: 228233 - protein, 10 aa, Japanese encephalitis virus
GKTRKILPQI

SEQ ID NO: 228234 - protein, 10 aa, Japanese encephalitis virus
KTRKILPQII

SEQ ID NO: 228235 - protein, 10 aa, Japanese encephalitis virus
TRKILPQIIK

SEQ ID NO: 228236 - protein, 10 aa, Japanese encephalitis virus
RKILPQIIKD

SEQ ID NO: 228237 - protein, 10 aa, Japanese encephalitis virus
KILPQIIKDA

SEQ ID NO: 228238 - protein, 10 aa, Japanese encephalitis virus
ILPQIIKDAI

SEQ ID NO: 228239 - protein, 10 aa, Japanese encephalitis virus
LPQIIKDAIQ

SEQ ID NO: 228240 - protein, 10 aa, Japanese encephalitis virus
PQIIKDAIQQ

SEQ ID NO: 228241 - protein, 10 aa, Japanese encephalitis virus
QIIKDAIQQR

SEQ ID NO: 228242 - protein, 10 aa, Japanese encephalitis virus
IIKDAIQQRL

SEQ ID NO: 228243 - protein, 10 aa, Japanese encephalitis virus
IKDAIQQRLR

SEQ ID NO: 228244 - protein, 10 aa, Japanese encephalitis virus
KDAIQQRLRT

SEQ ID NO: 228245 - protein, 10 aa, Japanese encephalitis virus
DAIQQRLRTA

SEQ ID NO: 228246 - protein, 10 aa, Japanese encephalitis virus
AIQQRLRTAV

SEQ ID NO: 228247 - protein, 10 aa, Japanese encephalitis virus
IQQRLRTAVL

SEQ ID NO: 228248 - protein, 10 aa, Japanese encephalitis virus
QQRLRTAVLA

SEQ ID NO: 228249 - protein, 10 aa, Japanese encephalitis virus
QRLRTAVLAP

SEQ ID NO: 228250 - protein, 10 aa, Japanese encephalitis virus
RLRTAVLAPT

SEQ ID NO: 228251 - protein, 10 aa, Japanese encephalitis virus
LRTAVLAPTR

SEQ ID NO: 228252 - protein, 10 aa, Japanese encephalitis virus
RTAVLAPTRV

SEQ ID NO: 228253 - protein, 10 aa, Japanese encephalitis virus
TAVLAPTRVV

SEQ ID NO: 228254 - protein, 10 aa, Japanese encephalitis virus
AVLAPTRVVA

SEQ ID NO: 228255 - protein, 10 aa, Japanese encephalitis virus
VLAPTRVVAA

SEQ ID NO: 228256 - protein, 10 aa, Japanese encephalitis virus
LAPTRVVAAE

SEQ ID NO: 228257 - protein, 10 aa, Japanese encephalitis virus
APTRVVAAEM

SEQ ID NO: 228258 - protein, 10 aa, Japanese encephalitis virus
PTRVVAAEMA

SEQ ID NO: 228259 - protein, 10 aa, Japanese encephalitis virus
TRVVAAEMAE

SEQ ID NO: 228260 - protein, 10 aa, Japanese encephalitis virus
RVVAAEMAEA

SEQ ID NO: 228261 - protein, 10 aa, Japanese encephalitis virus
VVAAEMAEAL

SEQ ID NO: 228262 - protein, 10 aa, Japanese encephalitis virus
VAAEMAEALR

SEQ ID NO: 228263 - protein, 10 aa, Japanese encephalitis virus
AAEMAEALRG

SEQ ID NO: 228264 - protein, 10 aa, Japanese encephalitis virus
AEMAEALRGL

SEQ ID NO: 228265 - protein, 10 aa, Japanese encephalitis virus
EMAEALRGLP

SEQ ID NO: 228266 - protein, 10 aa, Japanese encephalitis virus
MAEALRGLPV

SEQ ID NO: 228267 - protein, 10 aa, Japanese encephalitis virus
AEALRGLPVR

SEQ ID NO: 228268 - protein, 10 aa, Japanese encephalitis virus
EALRGLPVRY

SEQ ID NO: 228269 - protein, 10 aa, Japanese encephalitis virus
ALRGLPVRYQ

SEQ ID NO: 228270 - protein, 10 aa, Japanese encephalitis virus
LRGLPVRYQT

SEQ ID NO: 228271 - protein, 10 aa, Japanese encephalitis virus
RGLPVRYQTS

SEQ ID NO: 228272 - protein, 10 aa, Japanese encephalitis virus
GLPVRYQTSA

SEQ ID NO: 228273 - protein, 10 aa, Japanese encephalitis virus
LPVRYQTSAV

SEQ ID NO: 228274 - protein, 10 aa, Japanese encephalitis virus
PVRYQTSAVQ

SEQ ID NO: 228275 - protein, 10 aa, Japanese encephalitis virus
VRYQTSAVQR

SEQ ID NO: 228276 - protein, 10 aa, Japanese encephalitis virus
RYQTSAVQRE

SEQ ID NO: 228277 - protein, 10 aa, Japanese encephalitis virus
YQTSAVQREH

SEQ ID NO: 228278 - protein, 10 aa, Japanese encephalitis virus
QTSAVQREHQ

SEQ ID NO: 228279 - protein, 10 aa, Japanese encephalitis virus
TSAVQREHQG

SEQ ID NO: 228280 - protein, 10 aa, Japanese encephalitis virus
SAVQREHQGN

SEQ ID NO: 228281 - protein, 10 aa, Japanese encephalitis virus
AVQREHQGNE

SEQ ID NO: 228282 - protein, 10 aa, Japanese encephalitis virus
VQREHQGNEI

SEQ ID NO: 228283 - protein, 10 aa, Japanese encephalitis virus
QREHQGNEIV

SEQ ID NO: 228284 - protein, 10 aa, Japanese encephalitis virus
REHQGNEIVD

SEQ ID NO: 228285 - protein, 10 aa, Japanese encephalitis virus
EHQGNEIVDV

SEQ ID NO: 228286 - protein, 10 aa, Japanese encephalitis virus
HQGNEIVDVM

SEQ ID NO: 228287 - protein, 10 aa, Japanese encephalitis virus
QGNEIVDVMC

SEQ ID NO: 228288 - protein, 10 aa, Japanese encephalitis virus
GNEIVDVMCH

SEQ ID NO: 228289 - protein, 10 aa, Japanese encephalitis virus
NEIVDVMCHA

SEQ ID NO: 228290 - protein, 10 aa, Japanese encephalitis virus
EIVDVMCHAT

SEQ ID NO: 228291 - protein, 10 aa, Japanese encephalitis virus
IVDVMCHATL

SEQ ID NO: 228292 - protein, 10 aa, Japanese encephalitis virus
VDVMCHATLT

SEQ ID NO: 228293 - protein, 10 aa, Japanese encephalitis virus
DVMCHATLTH

SEQ ID NO: 228294 - protein, 10 aa, Japanese encephalitis virus
VMCHATLTHR

SEQ ID NO: 228295 - protein, 10 aa, Japanese encephalitis virus
MCHATLTHRL

SEQ ID NO: 228296 - protein, 10 aa, Japanese encephalitis virus
CHATLTHRLM

SEQ ID NO: 228297 - protein, 10 aa, Japanese encephalitis virus
HATLTHRLMS

SEQ ID NO: 228298 - protein, 10 aa, Japanese encephalitis virus
ATLTHRLMSP

SEQ ID NO: 228299 - protein, 10 aa, Japanese encephalitis virus
TLTHRLMSPN

SEQ ID NO: 228300 - protein, 10 aa, Japanese encephalitis virus
LTHRLMSPNR

SEQ ID NO: 228301 - protein, 10 aa, Japanese encephalitis virus
THRLMSPNRV

SEQ ID NO: 228302 - protein, 10 aa, Japanese encephalitis virus
HRLMSPNRVP

SEQ ID NO: 228303 - protein, 10 aa, Japanese encephalitis virus
RLMSPNRVPN

SEQ ID NO: 228304 - protein, 10 aa, Japanese encephalitis virus
LMSPNRVPNY

SEQ ID NO: 228305 - protein, 10 aa, Japanese encephalitis virus
MSPNRVPNYN

SEQ ID NO: 228306 - protein, 10 aa, Japanese encephalitis virus
SPNRVPNYNL

SEQ ID NO: 228307 - protein, 10 aa, Japanese encephalitis virus
PNRVPNYNLF

SEQ ID NO: 228308 - protein, 10 aa, Japanese encephalitis virus
NRVPNYNLFV

SEQ ID NO: 228309 - protein, 10 aa, Japanese encephalitis virus
RVPNYNLFVM

SEQ ID NO: 228310 - protein, 10 aa, Japanese encephalitis virus
VPNYNLFVMD

SEQ ID NO: 228311 - protein, 10 aa, Japanese encephalitis virus
PNYNLFVMDE

SEQ ID NO: 228312 - protein, 10 aa, Japanese encephalitis virus
NYNLFVMDEA

SEQ ID NO: 228313 - protein, 10 aa, Japanese encephalitis virus
YNLFVMDEAH

SEQ ID NO: 228314 - protein, 10 aa, Japanese encephalitis virus
NLFVMDEAHF

SEQ ID NO: 228315 - protein, 10 aa, Japanese encephalitis virus
LFVMDEAHFT

SEQ ID NO: 228316 - protein, 10 aa, Japanese encephalitis virus
FVMDEAHFTD

SEQ ID NO: 228317 - protein, 10 aa, Japanese encephalitis virus
VMDEAHFTDP

SEQ ID NO: 228318 - protein, 10 aa, Japanese encephalitis virus
MDEAHFTDPA

SEQ ID NO: 228319 - protein, 10 aa, Japanese encephalitis virus
DEAHFTDPAS

SEQ ID NO: 228320 - protein, 10 aa, Japanese encephalitis virus
EAHFTDPASI

SEQ ID NO: 228321 - protein, 10 aa, Japanese encephalitis virus
AHFTDPASIA

SEQ ID NO: 228322 - protein, 10 aa, Japanese encephalitis virus
HFTDPASIAA

SEQ ID NO: 228323 - protein, 10 aa, Japanese encephalitis virus
FTDPASIAAR

SEQ ID NO: 228324 - protein, 10 aa, Japanese encephalitis virus
TDPASIAARG

SEQ ID NO: 228325 - protein, 10 aa, Japanese encephalitis virus
DPASIAARGY

SEQ ID NO: 228326 - protein, 10 aa, Japanese encephalitis virus
PASIAARGYI

SEQ ID NO: 228327 - protein, 10 aa, Japanese encephalitis virus
ASIAARGYIA

SEQ ID NO: 228328 - protein, 10 aa, Japanese encephalitis virus
SIAARGYIAT

SEQ ID NO: 228329 - protein, 10 aa, Japanese encephalitis virus
IAARGYIATK

SEQ ID NO: 228330 - protein, 10 aa, Japanese encephalitis virus
AARGYIATKV

SEQ ID NO: 228331 - protein, 10 aa, Japanese encephalitis virus
ARGYIATKVE

SEQ ID NO: 228332 - protein, 10 aa, Japanese encephalitis virus
RGYIATKVEL

SEQ ID NO: 228333 - protein, 10 aa, Japanese encephalitis virus
GYIATKVELG

SEQ ID NO: 228334 - protein, 10 aa, Japanese encephalitis virus
YIATKVELGE

SEQ ID NO: 228335 - protein, 10 aa, Japanese encephalitis virus
IATKVELGEA

SEQ ID NO: 228336 - protein, 10 aa, Japanese encephalitis virus
ATKVELGEAA

SEQ ID NO: 228337 - protein, 10 aa, Japanese encephalitis virus
TKVELGEAAA

SEQ ID NO: 228338 - protein, 10 aa, Japanese encephalitis virus
KVELGEAAAI

SEQ ID NO: 228339 - protein, 10 aa, Japanese encephalitis virus
VELGEAAAIF

SEQ ID NO: 228340 - protein, 10 aa, Japanese encephalitis virus
ELGEAAAIFM

SEQ ID NO: 228341 - protein, 10 aa, Japanese encephalitis virus
LGEAAAIFMT

SEQ ID NO: 228342 - protein, 10 aa, Japanese encephalitis virus
GEAAAIFMTA

SEQ ID NO: 228343 - protein, 10 aa, Japanese encephalitis virus
EAAAIFMTAT

SEQ ID NO: 228344 - protein, 10 aa, Japanese encephalitis virus
AAAIFMTATP

SEQ ID NO: 228345 - protein, 10 aa, Japanese encephalitis virus
AAIFMTATPP

SEQ ID NO: 228346 - protein, 10 aa, Japanese encephalitis virus
AIFMTATPPG

SEQ ID NO: 228347 - protein, 10 aa, Japanese encephalitis virus
IFMTATPPGT

SEQ ID NO: 228348 - protein, 10 aa, Japanese encephalitis virus
FMTATPPGTT

SEQ ID NO: 228349 - protein, 10 aa, Japanese encephalitis virus
MTATPPGTTD

SEQ ID NO: 228350 - protein, 10 aa, Japanese encephalitis virus
TATPPGTTDP

SEQ ID NO: 228351 - protein, 10 aa, Japanese encephalitis virus
ATPPGTTDPF

SEQ ID NO: 228352 - protein, 10 aa, Japanese encephalitis virus
TPPGTTDPFP

SEQ ID NO: 228353 - protein, 10 aa, Japanese encephalitis virus
PPGTTDPFPD

SEQ ID NO: 228354 - protein, 10 aa, Japanese encephalitis virus
PGTTDPFPDS

SEQ ID NO: 228355 - protein, 10 aa, Japanese encephalitis virus
GTTDPFPDSN

SEQ ID NO: 228356 - protein, 10 aa, Japanese encephalitis virus
TTDPFPDSNA

SEQ ID NO: 228357 - protein, 10 aa, Japanese encephalitis virus
TDPFPDSNAP

SEQ ID NO: 228358 - protein, 10 aa, Japanese encephalitis virus
DPFPDSNAPI

SEQ ID NO: 228359 - protein, 10 aa, Japanese encephalitis virus
PFPDSNAPIH

SEQ ID NO: 228360 - protein, 10 aa, Japanese encephalitis virus
FPDSNAPIHD

SEQ ID NO: 228361 - protein, 10 aa, Japanese encephalitis virus
PDSNAPIHDL

SEQ ID NO: 228362 - protein, 10 aa, Japanese encephalitis virus
DSNAPIHDLQ

SEQ ID NO: 228363 - protein, 10 aa, Japanese encephalitis virus
SNAPIHDLQD

SEQ ID NO: 228364 - protein, 10 aa, Japanese encephalitis virus
NAPIHDLQDE

SEQ ID NO: 228365 - protein, 10 aa, Japanese encephalitis virus
APIHDLQDEI

SEQ ID NO: 228366 - protein, 10 aa, Japanese encephalitis virus
PIHDLQDEIP

SEQ ID NO: 228367 - protein, 10 aa, Japanese encephalitis virus
IHDLQDEIPD

SEQ ID NO: 228368 - protein, 10 aa, Japanese encephalitis virus
HDLQDEIPDR

SEQ ID NO: 228369 - protein, 10 aa, Japanese encephalitis virus
DLQDEIPDRA

SEQ ID NO: 228370 - protein, 10 aa, Japanese encephalitis virus
LQDEIPDRAW

SEQ ID NO: 228371 - protein, 10 aa, Japanese encephalitis virus
QDEIPDRAWS

SEQ ID NO: 228372 - protein, 10 aa, Japanese encephalitis virus
DEIPDRAWSS

SEQ ID NO: 228373 - protein, 10 aa, Japanese encephalitis virus
EIPDRAWSSG

SEQ ID NO: 228374 - protein, 10 aa, Japanese encephalitis virus
WITEYAGKTV

SEQ ID NO: 228375 - protein, 10 aa, Japanese encephalitis virus
ITEYAGKTVW

SEQ ID NO: 228376 - protein, 10 aa, Japanese encephalitis virus
TEYAGKTVWF

SEQ ID NO: 228377 - protein, 10 aa, Japanese encephalitis virus
EYAGKTVWFV

SEQ ID NO: 228378 - protein, 10 aa, Japanese encephalitis virus
YAGKTVWFVA

SEQ ID NO: 228379 - protein, 10 aa, Japanese encephalitis virus
AGKTVWFVAS

SEQ ID NO: 228380 - protein, 10 aa, Japanese encephalitis virus
GKTVWFVASV

SEQ ID NO: 228381 - protein, 10 aa, Japanese encephalitis virus
KTVWFVASVK

SEQ ID NO: 228382 - protein, 10 aa, Japanese encephalitis virus
TVWFVASVKM

SEQ ID NO: 228383 - protein, 10 aa, Japanese encephalitis virus
VWFVASVKMG

SEQ ID NO: 228384 - protein, 10 aa, Japanese encephalitis virus
WFVASVKMGN

SEQ ID NO: 228385 - protein, 10 aa, Japanese encephalitis virus
FVASVKMGNE

SEQ ID NO: 228386 - protein, 10 aa, Japanese encephalitis virus
VASVKMGNEI

SEQ ID NO: 228387 - protein, 10 aa, Japanese encephalitis virus
ASVKMGNEIA

SEQ ID NO: 228388 - protein, 10 aa, Japanese encephalitis virus
SVKMGNEIAM

SEQ ID NO: 228389 - protein, 10 aa, Japanese encephalitis virus
VKMGNEIAMC

SEQ ID NO: 228390 - protein, 10 aa, Japanese encephalitis virus
KMGNEIAMCL

SEQ ID NO: 228391 - protein, 10 aa, Japanese encephalitis virus
MGNEIAMCLQ

SEQ ID NO: 228392 - protein, 10 aa, Japanese encephalitis virus
GNEIAMCLQR

SEQ ID NO: 228393 - protein, 10 aa, Japanese encephalitis virus
NEIAMCLQRA

SEQ ID NO: 228394 - protein, 10 aa, Japanese encephalitis virus
EIAMCLQRAG

SEQ ID NO: 228395 - protein, 10 aa, Japanese encephalitis virus
IAMCLQRAGK

SEQ ID NO: 228396 - protein, 10 aa, Japanese encephalitis virus
AMCLQRAGKK

SEQ ID NO: 228397 - protein, 10 aa, Japanese encephalitis virus
MCLQRAGKKV

SEQ ID NO: 228398 - protein, 10 aa, Japanese encephalitis virus
CLQRAGKKVI

SEQ ID NO: 228399 - protein, 10 aa, Japanese encephalitis virus
LQRAGKKVIQ

SEQ ID NO: 228400 - protein, 10 aa, Japanese encephalitis virus
QRAGKKVIQL

SEQ ID NO: 228401 - protein, 10 aa, Japanese encephalitis virus
RAGKKVIQLN

SEQ ID NO: 228402 - protein, 10 aa, Japanese encephalitis virus
AGKKVIQLNR

SEQ ID NO: 228403 - protein, 10 aa, Japanese encephalitis virus
GKKVIQLNRK

SEQ ID NO: 228404 - protein, 10 aa, Japanese encephalitis virus
KKVIQLNRKS

SEQ ID NO: 228405 - protein, 10 aa, Japanese encephalitis virus
KVIQLNRKSY

SEQ ID NO: 228406 - protein, 10 aa, Japanese encephalitis virus
VIQLNRKSYD

SEQ ID NO: 228407 - protein, 10 aa, Japanese encephalitis virus
IQLNRKSYDT

SEQ ID NO: 228408 - protein, 10 aa, Japanese encephalitis virus
QLNRKSYDTE

SEQ ID NO: 228409 - protein, 10 aa, Japanese encephalitis virus
LNRKSYDTEY

SEQ ID NO: 228410 - protein, 10 aa, Japanese encephalitis virus
NRKSYDTEYP

SEQ ID NO: 228411 - protein, 10 aa, Japanese encephalitis virus
RKSYDTEYPK

SEQ ID NO: 228412 - protein, 10 aa, Japanese encephalitis virus
KSYDTEYPKC

SEQ ID NO: 228413 - protein, 10 aa, Japanese encephalitis virus
SYDTEYPKCK

SEQ ID NO: 228414 - protein, 10 aa, Japanese encephalitis virus
YDTEYPKCKN

SEQ ID NO: 228415 - protein, 10 aa, Japanese encephalitis virus
DTEYPKCKNG

SEQ ID NO: 228416 - protein, 10 aa, Japanese encephalitis virus
TEYPKCKNGD

SEQ ID NO: 228417 - protein, 10 aa, Japanese encephalitis virus
EYPKCKNGDW

SEQ ID NO: 228418 - protein, 10 aa, Japanese encephalitis virus
YPKCKNGDWD

SEQ ID NO: 228419 - protein, 10 aa, Japanese encephalitis virus
PKCKNGDWDF

SEQ ID NO: 228420 - protein, 10 aa, Japanese encephalitis virus
KCKNGDWDFV

SEQ ID NO: 228421 - protein, 10 aa, Japanese encephalitis virus
CKNGDWDFVI

SEQ ID NO: 228422 - protein, 10 aa, Japanese encephalitis virus
KNGDWDFVIT

SEQ ID NO: 228423 - protein, 10 aa, Japanese encephalitis virus
NGDWDFVITT

SEQ ID NO: 228424 - protein, 10 aa, Japanese encephalitis virus
GDWDFVITTD

SEQ ID NO: 228425 - protein, 10 aa, Japanese encephalitis virus
DWDFVITTDI

SEQ ID NO: 228426 - protein, 10 aa, Japanese encephalitis virus
WDFVITTDIS

SEQ ID NO: 228427 - protein, 10 aa, Japanese encephalitis virus
DFVITTDISE

SEQ ID NO: 228428 - protein, 10 aa, Japanese encephalitis virus
FVITTDISEM

SEQ ID NO: 228429 - protein, 10 aa, Japanese encephalitis virus
VITTDISEMG

SEQ ID NO: 228430 - protein, 10 aa, Japanese encephalitis virus
ITTDISEMGA

SEQ ID NO: 228431 - protein, 10 aa, Japanese encephalitis virus
TTDISEMGAN

SEQ ID NO: 228432 - protein, 10 aa, Japanese encephalitis virus
TDISEMGANF

SEQ ID NO: 228433 - protein, 10 aa, Japanese encephalitis virus
DISEMGANFG

SEQ ID NO: 228434 - protein, 10 aa, Japanese encephalitis virus
ISEMGANFGA

SEQ ID NO: 228435 - protein, 10 aa, Japanese encephalitis virus
SEMGANFGAS

SEQ ID NO: 228436 - protein, 10 aa, Japanese encephalitis virus
EMGANFGASR

SEQ ID NO: 228437 - protein, 10 aa, Japanese encephalitis virus
MGANFGASRV

SEQ ID NO: 228438 - protein, 10 aa, Japanese encephalitis virus
GANFGASRVI

SEQ ID NO: 228439 - protein, 10 aa, Japanese encephalitis virus
ANFGASRVID

SEQ ID NO: 228440 - protein, 10 aa, Japanese encephalitis virus
NFGASRVIDC

SEQ ID NO: 228441 - protein, 10 aa, Japanese encephalitis virus
FGASRVIDCR

SEQ ID NO: 228442 - protein, 10 aa, Japanese encephalitis virus
GASRVIDCRK

SEQ ID NO: 228443 - protein, 10 aa, Japanese encephalitis virus
ASRVIDCRKS

SEQ ID NO: 228444 - protein, 10 aa, Japanese encephalitis virus
SRVIDCRKSV

SEQ ID NO: 228445 - protein, 10 aa, Japanese encephalitis virus
RVIDCRKSVK

SEQ ID NO: 228446 - protein, 10 aa, Japanese encephalitis virus
VIDCRKSVKP

SEQ ID NO: 228447 - protein, 10 aa, Japanese encephalitis virus
IDCRKSVKPT

SEQ ID NO: 228448 - protein, 10 aa, Japanese encephalitis virus
DCRKSVKPTI

SEQ ID NO: 228449 - protein, 10 aa, Japanese encephalitis virus
CRKSVKPTIL

SEQ ID NO: 228450 - protein, 10 aa, Japanese encephalitis virus
RKSVKPTILE

SEQ ID NO: 228451 - protein, 10 aa, Japanese encephalitis virus
KSVKPTILEE

SEQ ID NO: 228452 - protein, 10 aa, Japanese encephalitis virus
SVKPTILEEG

SEQ ID NO: 228453 - protein, 10 aa, Japanese encephalitis virus
VKPTILEEGE

SEQ ID NO: 228454 - protein, 10 aa, Japanese encephalitis virus
KPTILEEGEG

SEQ ID NO: 228455 - protein, 10 aa, Japanese encephalitis virus
PTILEEGEGR

SEQ ID NO: 228456 - protein, 10 aa, Japanese encephalitis virus
TILEEGEGRV

SEQ ID NO: 228457 - protein, 10 aa, Japanese encephalitis virus
ILEEGEGRVI

SEQ ID NO: 228458 - protein, 10 aa, Japanese encephalitis virus
LEEGEGRVIL

SEQ ID NO: 228459 - protein, 10 aa, Japanese encephalitis virus
EEGEGRVILG

SEQ ID NO: 228460 - protein, 10 aa, Japanese encephalitis virus
EGEGRVILGN

SEQ ID NO: 228461 - protein, 10 aa, Japanese encephalitis virus
GEGRVILGNP

SEQ ID NO: 228462 - protein, 10 aa, Japanese encephalitis virus
EGRVILGNPS

SEQ ID NO: 228463 - protein, 10 aa, Japanese encephalitis virus
GRVILGNPSP

SEQ ID NO: 228464 - protein, 10 aa, Japanese encephalitis virus
RVILGNPSPI

SEQ ID NO: 228465 - protein, 10 aa, Japanese encephalitis virus
VILGNPSPIT

SEQ ID NO: 228466 - protein, 10 aa, Japanese encephalitis virus
ILGNPSPITS

SEQ ID NO: 228467 - protein, 10 aa, Japanese encephalitis virus
LGNPSPITSA

SEQ ID NO: 228468 - protein, 10 aa, Japanese encephalitis virus
GNPSPITSAS

SEQ ID NO: 228469 - protein, 10 aa, Japanese encephalitis virus
NPSPITSASA

SEQ ID NO: 228470 - protein, 10 aa, Japanese encephalitis virus
PSPITSASAA

SEQ ID NO: 228471 - protein, 10 aa, Japanese encephalitis virus
SPITSASAAQ

SEQ ID NO: 228472 - protein, 10 aa, Japanese encephalitis virus
PITSASAAQR

SEQ ID NO: 228473 - protein, 10 aa, Japanese encephalitis virus
ITSASAAQRR

SEQ ID NO: 228474 - protein, 10 aa, Japanese encephalitis virus
TSASAAQRRG

SEQ ID NO: 228475 - protein, 10 aa, Japanese encephalitis virus
SASAAQRRGR

SEQ ID NO: 228476 - protein, 10 aa, Japanese encephalitis virus
ASAAQRRGRV

SEQ ID NO: 228477 - protein, 10 aa, Japanese encephalitis virus
SAAQRRGRVG

SEQ ID NO: 228478 - protein, 10 aa, Japanese encephalitis virus
AAQRRGRVGR

SEQ ID NO: 228479 - protein, 10 aa, Japanese encephalitis virus
AQRRGRVGRN

SEQ ID NO: 228480 - protein, 10 aa, Japanese encephalitis virus
QRRGRVGRNP

SEQ ID NO: 228481 - protein, 10 aa, Japanese encephalitis virus
RRGRVGRNPN

SEQ ID NO: 228482 - protein, 10 aa, Japanese encephalitis virus
RGRVGRNPNQ

SEQ ID NO: 228483 - protein, 10 aa, Japanese encephalitis virus
GRVGRNPNQV

SEQ ID NO: 228484 - protein, 10 aa, Japanese encephalitis virus
RVGRNPNQVG

SEQ ID NO: 228485 - protein, 10 aa, Japanese encephalitis virus
VGRNPNQVGD

SEQ ID NO: 228486 - protein, 10 aa, Japanese encephalitis virus
GRNPNQVGDE

SEQ ID NO: 228487 - protein, 10 aa, Japanese encephalitis virus
RNPNQVGDEY

SEQ ID NO: 228488 - protein, 10 aa, Japanese encephalitis virus
NPNQVGDEYH

SEQ ID NO: 228489 - protein, 10 aa, Japanese encephalitis virus
PNQVGDEYHY

SEQ ID NO: 228490 - protein, 10 aa, Japanese encephalitis virus
NQVGDEYHYG

SEQ ID NO: 228491 - protein, 10 aa, Japanese encephalitis virus
QVGDEYHYGG

SEQ ID NO: 228492 - protein, 10 aa, Japanese encephalitis virus
VGDEYHYGGA

SEQ ID NO: 228493 - protein, 10 aa, Japanese encephalitis virus
GDEYHYGGAT

SEQ ID NO: 228494 - protein, 10 aa, Japanese encephalitis virus
DEYHYGGATS

SEQ ID NO: 228495 - protein, 10 aa, Japanese encephalitis virus
EYHYGGATSE

SEQ ID NO: 228496 - protein, 10 aa, Japanese encephalitis virus
YHYGGATSED

SEQ ID NO: 228497 - protein, 10 aa, Japanese encephalitis virus
HYGGATSEDD

SEQ ID NO: 228498 - protein, 10 aa, Japanese encephalitis virus
YGGATSEDDS

SEQ ID NO: 228499 - protein, 10 aa, Japanese encephalitis virus
GGATSEDDSN

SEQ ID NO: 228500 - protein, 10 aa, Japanese encephalitis virus
GATSEDDSNL

SEQ ID NO: 228501 - protein, 10 aa, Japanese encephalitis virus
ATSEDDSNLA

SEQ ID NO: 228502 - protein, 10 aa, Japanese encephalitis virus
TSEDDSNLAH

SEQ ID NO: 228503 - protein, 10 aa, Japanese encephalitis virus
SEDDSNLAHW

SEQ ID NO: 228504 - protein, 10 aa, Japanese encephalitis virus
EDDSNLAHWT

SEQ ID NO: 228505 - protein, 10 aa, Japanese encephalitis virus
DDSNLAHWTE

SEQ ID NO: 228506 - protein, 10 aa, Japanese encephalitis virus
DSNLAHWTEA

SEQ ID NO: 228507 - protein, 10 aa, Japanese encephalitis virus
SNLAHWTEAK

SEQ ID NO: 228508 - protein, 10 aa, Japanese encephalitis virus
NLAHWTEAKI

SEQ ID NO: 228509 - protein, 10 aa, Japanese encephalitis virus
LAHWTEAKIM

SEQ ID NO: 228510 - protein, 10 aa, Japanese encephalitis virus
AHWTEAKIML

SEQ ID NO: 228511 - protein, 10 aa, Japanese encephalitis virus
HWTEAKIMLD

SEQ ID NO: 228512 - protein, 10 aa, Japanese encephalitis virus
WTEAKIMLDN

SEQ ID NO: 228513 - protein, 10 aa, Japanese encephalitis virus
TEAKIMLDNI

SEQ ID NO: 228514 - protein, 10 aa, Japanese encephalitis virus
EAKIMLDNIH

SEQ ID NO: 228515 - protein, 10 aa, Japanese encephalitis virus
AKIMLDNIHM

SEQ ID NO: 228516 - protein, 10 aa, Japanese encephalitis virus
KIMLDNIHMP

SEQ ID NO: 228517 - protein, 10 aa, Japanese encephalitis virus
IMLDNIHMPN

SEQ ID NO: 228518 - protein, 10 aa, Japanese encephalitis virus
MLDNIHMPNG

SEQ ID NO: 228519 - protein, 10 aa, Japanese encephalitis virus
LDNIHMPNGL

SEQ ID NO: 228520 - protein, 10 aa, Japanese encephalitis virus
DNIHMPNGLV

SEQ ID NO: 228521 - protein, 10 aa, Japanese encephalitis virus
NIHMPNGLVA

SEQ ID NO: 228522 - protein, 10 aa, Japanese encephalitis virus
IHMPNGLVAQ

SEQ ID NO: 228523 - protein, 10 aa, Japanese encephalitis virus
HMPNGLVAQL

SEQ ID NO: 228524 - protein, 10 aa, Japanese encephalitis virus
MPNGLVAQLY

SEQ ID NO: 228525 - protein, 10 aa, Japanese encephalitis virus
PNGLVAQLYG

SEQ ID NO: 228526 - protein, 10 aa, Japanese encephalitis virus
NGLVAQLYGP

SEQ ID NO: 228527 - protein, 10 aa, Japanese encephalitis virus
GLVAQLYGPE

SEQ ID NO: 228528 - protein, 10 aa, Japanese encephalitis virus
LVAQLYGPER

SEQ ID NO: 228529 - protein, 10 aa, Japanese encephalitis virus
VAQLYGPERE

SEQ ID NO: 228530 - protein, 10 aa, Japanese encephalitis virus
AQLYGPEREK

SEQ ID NO: 228531 - protein, 10 aa, Japanese encephalitis virus
QLYGPEREKA

SEQ ID NO: 228532 - protein, 10 aa, Japanese encephalitis virus
LYGPEREKAF

SEQ ID NO: 228533 - protein, 10 aa, Japanese encephalitis virus
YGPEREKAFT

SEQ ID NO: 228534 - protein, 10 aa, Japanese encephalitis virus
GPEREKAFTM

SEQ ID NO: 228535 - protein, 10 aa, Japanese encephalitis virus
PEREKAFTMD

SEQ ID NO: 228536 - protein, 10 aa, Japanese encephalitis virus
EREKAFTMDG

SEQ ID NO: 228537 - protein, 10 aa, Japanese encephalitis virus
REKAFTMDGE

SEQ ID NO: 228538 - protein, 10 aa, Japanese encephalitis virus
EKAFTMDGEY

SEQ ID NO: 228539 - protein, 10 aa, Japanese encephalitis virus
KAFTMDGEYR

SEQ ID NO: 228540 - protein, 10 aa, Japanese encephalitis virus
AFTMDGEYRL

SEQ ID NO: 228541 - protein, 10 aa, Japanese encephalitis virus
FTMDGEYRLR

SEQ ID NO: 228542 - protein, 10 aa, Japanese encephalitis virus
TMDGEYRLRG

SEQ ID NO: 228543 - protein, 10 aa, Japanese encephalitis virus
MDGEYRLRGE

SEQ ID NO: 228544 - protein, 10 aa, Japanese encephalitis virus
DGEYRLRGEE

SEQ ID NO: 228545 - protein, 10 aa, Japanese encephalitis virus
GEYRLRGEEK

SEQ ID NO: 228546 - protein, 10 aa, Japanese encephalitis virus
EYRLRGEEKK

SEQ ID NO: 228547 - protein, 10 aa, Japanese encephalitis virus
YRLRGEEKKN

SEQ ID NO: 228548 - protein, 10 aa, Japanese encephalitis virus
RLRGEEKKNF

SEQ ID NO: 228549 - protein, 10 aa, Japanese encephalitis virus
LRGEEKKNFL

SEQ ID NO: 228550 - protein, 10 aa, Japanese encephalitis virus
RGEEKKNFLE

SEQ ID NO: 228551 - protein, 10 aa, Japanese encephalitis virus
GEEKKNFLEL

SEQ ID NO: 228552 - protein, 10 aa, Japanese encephalitis virus
EEKKNFLELL

SEQ ID NO: 228553 - protein, 10 aa, Japanese encephalitis virus
EKKNFLELLR

SEQ ID NO: 228554 - protein, 10 aa, Japanese encephalitis virus
KKNFLELLRT

SEQ ID NO: 228555 - protein, 10 aa, Japanese encephalitis virus
KNFLELLRTA

SEQ ID NO: 228556 - protein, 10 aa, Japanese encephalitis virus
NFLELLRTAD

SEQ ID NO: 228557 - protein, 10 aa, Japanese encephalitis virus
FLELLRTADL

SEQ ID NO: 228558 - protein, 10 aa, Japanese encephalitis virus
LELLRTADLP

SEQ ID NO: 228559 - protein, 10 aa, Japanese encephalitis virus
ELLRTADLPV

SEQ ID NO: 228560 - protein, 10 aa, Japanese encephalitis virus
LLRTADLPVW

SEQ ID NO: 228561 - protein, 10 aa, Japanese encephalitis virus
LRTADLPVWL

SEQ ID NO: 228562 - protein, 10 aa, Japanese encephalitis virus
RTADLPVWLA

SEQ ID NO: 228563 - protein, 10 aa, Japanese encephalitis virus
TADLPVWLAY

SEQ ID NO: 228564 - protein, 10 aa, Japanese encephalitis virus
ADLPVWLAYK

SEQ ID NO: 228565 - protein, 10 aa, Japanese encephalitis virus
DLPVWLAYKV

SEQ ID NO: 228566 - protein, 10 aa, Japanese encephalitis virus
LPVWLAYKVA

SEQ ID NO: 228567 - protein, 10 aa, Japanese encephalitis virus
PVWLAYKVAS

SEQ ID NO: 228568 - protein, 10 aa, Japanese encephalitis virus
VWLAYKVASN

SEQ ID NO: 228569 - protein, 10 aa, Japanese encephalitis virus
WLAYKVASNG

SEQ ID NO: 228570 - protein, 10 aa, Japanese encephalitis virus
LAYKVASNGI

SEQ ID NO: 228571 - protein, 10 aa, Japanese encephalitis virus
AYKVASNGIQ

SEQ ID NO: 228572 - protein, 10 aa, Japanese encephalitis virus
YKVASNGIQY

SEQ ID NO: 228573 - protein, 10 aa, Japanese encephalitis virus
KVASNGIQYT

SEQ ID NO: 228574 - protein, 10 aa, Japanese encephalitis virus
VASNGIQYTD

SEQ ID NO: 228575 - protein, 10 aa, Japanese encephalitis virus
ASNGIQYTDR

SEQ ID NO: 228576 - protein, 10 aa, Japanese encephalitis virus
SNGIQYTDRK

SEQ ID NO: 228577 - protein, 10 aa, Japanese encephalitis virus
NGIQYTDRKW

SEQ ID NO: 228578 - protein, 10 aa, Japanese encephalitis virus
GIQYTDRKWC

SEQ ID NO: 228579 - protein, 10 aa, Japanese encephalitis virus
IQYTDRKWCF

SEQ ID NO: 228580 - protein, 10 aa, Japanese encephalitis virus
QYTDRKWCFD

SEQ ID NO: 228581 - protein, 10 aa, Japanese encephalitis virus
YTDRKWCFDG

SEQ ID NO: 228582 - protein, 10 aa, Japanese encephalitis virus
TDRKWCFDGP

SEQ ID NO: 228583 - protein, 10 aa, Japanese encephalitis virus
DRKWCFDGPR

SEQ ID NO: 228584 - protein, 10 aa, Japanese encephalitis virus
RKWCFDGPRT

SEQ ID NO: 228585 - protein, 10 aa, Japanese encephalitis virus
KWCFDGPRTN

SEQ ID NO: 228586 - protein, 10 aa, Japanese encephalitis virus
WCFDGPRTNA

SEQ ID NO: 228587 - protein, 10 aa, Japanese encephalitis virus
CFDGPRTNAI

SEQ ID NO: 228588 - protein, 10 aa, Japanese encephalitis virus
FDGPRTNAIL

SEQ ID NO: 228589 - protein, 10 aa, Japanese encephalitis virus
DGPRTNAILE

SEQ ID NO: 228590 - protein, 10 aa, Japanese encephalitis virus
GPRTNAILED

SEQ ID NO: 228591 - protein, 10 aa, Japanese encephalitis virus
PRTNAILEDN

SEQ ID NO: 228592 - protein, 10 aa, Japanese encephalitis virus
RTNAILEDNT

SEQ ID NO: 228593 - protein, 10 aa, Japanese encephalitis virus
TNAILEDNTE

SEQ ID NO: 228594 - protein, 10 aa, Japanese encephalitis virus
NAILEDNTEV

SEQ ID NO: 228595 - protein, 10 aa, Japanese encephalitis virus
AILEDNTEVE

SEQ ID NO: 228596 - protein, 10 aa, Japanese encephalitis virus
ILEDNTEVEI

SEQ ID NO: 228597 - protein, 10 aa, Japanese encephalitis virus
LEDNTEVEIV

SEQ ID NO: 228598 - protein, 10 aa, Japanese encephalitis virus
EDNTEVEIVT

SEQ ID NO: 228599 - protein, 10 aa, Japanese encephalitis virus
DNTEVEIVTR

SEQ ID NO: 228600 - protein, 10 aa, Japanese encephalitis virus
NTEVEIVTRM

SEQ ID NO: 228601 - protein, 10 aa, Japanese encephalitis virus
TEVEIVTRMG

SEQ ID NO: 228602 - protein, 10 aa, Japanese encephalitis virus
EVEIVTRMGE

SEQ ID NO: 228603 - protein, 10 aa, Japanese encephalitis virus
VEIVTRMGER

SEQ ID NO: 228604 - protein, 10 aa, Japanese encephalitis virus
EIVTRMGERK

SEQ ID NO: 228605 - protein, 10 aa, Japanese encephalitis virus
IVTRMGERKI

SEQ ID NO: 228606 - protein, 10 aa, Japanese encephalitis virus
VTRMGERKIL

SEQ ID NO: 228607 - protein, 10 aa, Japanese encephalitis virus
TRMGERKILK

SEQ ID NO: 228608 - protein, 10 aa, Japanese encephalitis virus
RMGERKILKP

SEQ ID NO: 228609 - protein, 10 aa, Japanese encephalitis virus
MGERKILKPR

SEQ ID NO: 228610 - protein, 10 aa, Japanese encephalitis virus
GERKILKPRW

SEQ ID NO: 228611 - protein, 10 aa, Japanese encephalitis virus
ERKILKPRWL

SEQ ID NO: 228612 - protein, 10 aa, Japanese encephalitis virus
RKILKPRWLD

SEQ ID NO: 228613 - protein, 10 aa, Japanese encephalitis virus
KILKPRWLDA

SEQ ID NO: 228614 - protein, 10 aa, Japanese encephalitis virus
ILKPRWLDAR

SEQ ID NO: 228615 - protein, 10 aa, Japanese encephalitis virus
LKPRWLDARV

SEQ ID NO: 228616 - protein, 10 aa, Japanese encephalitis virus
KPRWLDARVY

SEQ ID NO: 228617 - protein, 10 aa, Japanese encephalitis virus
PRWLDARVYA

SEQ ID NO: 228618 - protein, 10 aa, Japanese encephalitis virus
RWLDARVYAD

SEQ ID NO: 228619 - protein, 10 aa, Japanese encephalitis virus
WLDARVYADH

SEQ ID NO: 228620 - protein, 10 aa, Japanese encephalitis virus
LDARVYADHQ

SEQ ID NO: 228621 - protein, 10 aa, Japanese encephalitis virus
DARVYADHQA

SEQ ID NO: 228622 - protein, 10 aa, Japanese encephalitis virus
ARVYADHQAL

SEQ ID NO: 228623 - protein, 10 aa, Japanese encephalitis virus
RVYADHQALK

SEQ ID NO: 228624 - protein, 10 aa, Japanese encephalitis virus
VYADHQALKW

SEQ ID NO: 228625 - protein, 10 aa, Japanese encephalitis virus
YADHQALKWF

SEQ ID NO: 228626 - protein, 10 aa, Japanese encephalitis virus
ADHQALKWFK

SEQ ID NO: 228627 - protein, 10 aa, Japanese encephalitis virus
DHQALKWFKD

SEQ ID NO: 228628 - protein, 10 aa, Japanese encephalitis virus
HQALKWFKDF

SEQ ID NO: 228629 - protein, 10 aa, Japanese encephalitis virus
QALKWFKDFA

SEQ ID NO: 228630 - protein, 10 aa, Japanese encephalitis virus
ALKWFKDFAA

SEQ ID NO: 228631 - protein, 10 aa, Japanese encephalitis virus
LKWFKDFAAG

SEQ ID NO: 228632 - protein, 10 aa, Japanese encephalitis virus
KWFKDFAAGK

SEQ ID NO: 228633 - protein, 10 aa, Japanese encephalitis virus
WFKDFAAGKR

SEQ ID NO: 228634 - protein, 10 aa, Japanese encephalitis virus
FKDFAAGKRS

SEQ ID NO: 228635 - protein, 10 aa, Japanese encephalitis virus
KDFAAGKRSA

SEQ ID NO: 228636 - protein, 10 aa, Japanese encephalitis virus
DFAAGKRSAV

SEQ ID NO: 228637 - protein, 10 aa, Japanese encephalitis virus
FAAGKRSAVS

SEQ ID NO: 228638 - protein, 10 aa, Japanese encephalitis virus
AAGKRSAVSF

SEQ ID NO: 228639 - protein, 10 aa, Japanese encephalitis virus
AGKRSAVSFI

SEQ ID NO: 228640 - protein, 10 aa, Japanese encephalitis virus
GKRSAVSFIE

SEQ ID NO: 228641 - protein, 10 aa, Japanese encephalitis virus
KRSAVSFIEV

SEQ ID NO: 228642 - protein, 10 aa, Japanese encephalitis virus
RSAVSFIEVL

SEQ ID NO: 228643 - protein, 10 aa, Japanese encephalitis virus
SAVSFIEVLG

SEQ ID NO: 228644 - protein, 10 aa, Japanese encephalitis virus
AVSFIEVLGR

SEQ ID NO: 228645 - protein, 10 aa, Japanese encephalitis virus
VSFIEVLGRM

SEQ ID NO: 228646 - protein, 10 aa, Japanese encephalitis virus
SFIEVLGRMP

SEQ ID NO: 228647 - protein, 10 aa, Japanese encephalitis virus
FIEVLGRMPE

SEQ ID NO: 228648 - protein, 10 aa, Japanese encephalitis virus
IEVLGRMPEH

SEQ ID NO: 228649 - protein, 10 aa, Japanese encephalitis virus
EVLGRMPEHF

SEQ ID NO: 228650 - protein, 10 aa, Japanese encephalitis virus
VLGRMPEHFM

SEQ ID NO: 228651 - protein, 10 aa, Japanese encephalitis virus
LGRMPEHFMG

SEQ ID NO: 228652 - protein, 10 aa, Japanese encephalitis virus
GRMPEHFMGK

SEQ ID NO: 228653 - protein, 10 aa, Japanese encephalitis virus
RMPEHFMGKT

SEQ ID NO: 228654 - protein, 10 aa, Japanese encephalitis virus
MPEHFMGKTR

SEQ ID NO: 228655 - protein, 10 aa, Japanese encephalitis virus
PEHFMGKTRE

SEQ ID NO: 228656 - protein, 10 aa, Japanese encephalitis virus
EHFMGKTREA

SEQ ID NO: 228657 - protein, 10 aa, Japanese encephalitis virus
HFMGKTREAL

SEQ ID NO: 228658 - protein, 10 aa, Japanese encephalitis virus
FMGKTREALD

SEQ ID NO: 228659 - protein, 10 aa, Japanese encephalitis virus
MGKTREALDT

SEQ ID NO: 228660 - protein, 10 aa, Japanese encephalitis virus
GKTREALDTM

SEQ ID NO: 228661 - protein, 10 aa, Japanese encephalitis virus
KTREALDTMY

SEQ ID NO: 228662 - protein, 10 aa, Japanese encephalitis virus
TREALDTMYL

SEQ ID NO: 228663 - protein, 10 aa, Japanese encephalitis virus
REALDTMYLV

SEQ ID NO: 228664 - protein, 10 aa, Japanese encephalitis virus
EALDTMYLVA

SEQ ID NO: 228665 - protein, 10 aa, Japanese encephalitis virus
ALDTMYLVAT

SEQ ID NO: 228666 - protein, 10 aa, Japanese encephalitis virus
LDTMYLVATA

SEQ ID NO: 228667 - protein, 10 aa, Japanese encephalitis virus
DTMYLVATAE

SEQ ID NO: 228668 - protein, 10 aa, Japanese encephalitis virus
TMYLVATAEK

SEQ ID NO: 228669 - protein, 10 aa, Japanese encephalitis virus
MYLVATAEKG

SEQ ID NO: 228670 - protein, 10 aa, Japanese encephalitis virus
YLVATAEKGG

SEQ ID NO: 228671 - protein, 10 aa, Japanese encephalitis virus
LVATAEKGGK

SEQ ID NO: 228672 - protein, 10 aa, Japanese encephalitis virus
VATAEKGGKA

SEQ ID NO: 228673 - protein, 10 aa, Japanese encephalitis virus
ATAEKGGKAH

SEQ ID NO: 228674 - protein, 10 aa, Japanese encephalitis virus
TAEKGGKAHR

SEQ ID NO: 228675 - protein, 10 aa, Japanese encephalitis virus
AEKGGKAHRM

SEQ ID NO: 228676 - protein, 10 aa, Japanese encephalitis virus
EKGGKAHRMA

SEQ ID NO: 228677 - protein, 10 aa, Japanese encephalitis virus
KGGKAHRMAL

SEQ ID NO: 228678 - protein, 10 aa, Japanese encephalitis virus
GGKAHRMALE

SEQ ID NO: 228679 - protein, 10 aa, Japanese encephalitis virus
GKAHRMALEE

SEQ ID NO: 228680 - protein, 10 aa, Japanese encephalitis virus
KAHRMALEEL

SEQ ID NO: 228681 - protein, 10 aa, Japanese encephalitis virus
AHRMALEELP

SEQ ID NO: 228682 - protein, 10 aa, Japanese encephalitis virus
HRMALEELPD

SEQ ID NO: 228683 - protein, 10 aa, Japanese encephalitis virus
RMALEELPDA

SEQ ID NO: 228684 - protein, 10 aa, Japanese encephalitis virus
MALEELPDAL

SEQ ID NO: 228685 - protein, 10 aa, Japanese encephalitis virus
ALEELPDALE

SEQ ID NO: 228686 - protein, 10 aa, Japanese encephalitis virus
LEELPDALET

SEQ ID NO: 228687 - protein, 10 aa, Japanese encephalitis virus
EELPDALETI

SEQ ID NO: 228688 - protein, 10 aa, Japanese encephalitis virus
ELPDALETIT

SEQ ID NO: 228689 - protein, 10 aa, Japanese encephalitis virus
LPDALETITL

SEQ ID NO: 228690 - protein, 10 aa, Japanese encephalitis virus
PDALETITLI

SEQ ID NO: 228691 - protein, 10 aa, Japanese encephalitis virus
DALETITLIV

SEQ ID NO: 228692 - protein, 10 aa, Japanese encephalitis virus
ALETITLIVA

SEQ ID NO: 228693 - protein, 10 aa, Japanese encephalitis virus
LETITLIVAI

SEQ ID NO: 228694 - protein, 10 aa, Japanese encephalitis virus
AITVMTGGFF

SEQ ID NO: 228695 - protein, 10 aa, Japanese encephalitis virus
ITVMTGGFFL

SEQ ID NO: 228696 - protein, 10 aa, Japanese encephalitis virus
TVMTGGFFLL

SEQ ID NO: 228697 - protein, 10 aa, Japanese encephalitis virus
VMTGGFFLLM

SEQ ID NO: 228698 - protein, 10 aa, Japanese encephalitis virus
MTGGFFLLMM

SEQ ID NO: 228699 - protein, 10 aa, Japanese encephalitis virus
TGGFFLLMMQ

SEQ ID NO: 228700 - protein, 10 aa, Japanese encephalitis virus
GGFFLLMMQR

SEQ ID NO: 228701 - protein, 10 aa, Japanese encephalitis virus
GFFLLMMQRK

SEQ ID NO: 228702 - protein, 10 aa, Japanese encephalitis virus
FFLLMMQRKG

SEQ ID NO: 228703 - protein, 10 aa, Japanese encephalitis virus
FLLMMQRKGI

SEQ ID NO: 228704 - protein, 10 aa, Japanese encephalitis virus
LLMMQRKGIG

SEQ ID NO: 228705 - protein, 10 aa, Japanese encephalitis virus
LMMQRKGIGK

SEQ ID NO: 228706 - protein, 10 aa, Japanese encephalitis virus
MMQRKGIGKM

SEQ ID NO: 228707 - protein, 10 aa, Japanese encephalitis virus
MQRKGIGKMG

SEQ ID NO: 228708 - protein, 10 aa, Japanese encephalitis virus
QRKGIGKMGL

SEQ ID NO: 228709 - protein, 10 aa, Japanese encephalitis virus
RKGIGKMGLG

SEQ ID NO: 228710 - protein, 10 aa, Japanese encephalitis virus
KGIGKMGLGA

SEQ ID NO: 228711 - protein, 10 aa, Japanese encephalitis virus
GIGKMGLGAL

SEQ ID NO: 228712 - protein, 10 aa, Japanese encephalitis virus
IGKMGLGALV

SEQ ID NO: 228713 - protein, 10 aa, Japanese encephalitis virus
GKMGLGALVL

SEQ ID NO: 228714 - protein, 10 aa, Japanese encephalitis virus
KMGLGALVLT

SEQ ID NO: 228715 - protein, 10 aa, Japanese encephalitis virus
MGLGALVLTL

SEQ ID NO: 228716 - protein, 10 aa, Japanese encephalitis virus
GLGALVLTLA

SEQ ID NO: 228717 - protein, 10 aa, Japanese encephalitis virus
LGALVLTLAT

SEQ ID NO: 228718 - protein, 10 aa, Japanese encephalitis virus
GALVLTLATF

SEQ ID NO: 228719 - protein, 10 aa, Japanese encephalitis virus
ALVLTLATFF

SEQ ID NO: 228720 - protein, 10 aa, Japanese encephalitis virus
LVLTLATFFL

SEQ ID NO: 228721 - protein, 10 aa, Japanese encephalitis virus
VLTLATFFLW

SEQ ID NO: 228722 - protein, 10 aa, Japanese encephalitis virus
LTLATFFLWA

SEQ ID NO: 228723 - protein, 10 aa, Japanese encephalitis virus
TLATFFLWAA

SEQ ID NO: 228724 - protein, 10 aa, Japanese encephalitis virus
LATFFLWAAE

SEQ ID NO: 228725 - protein, 10 aa, Japanese encephalitis virus
ATFFLWAAEV

SEQ ID NO: 228726 - protein, 10 aa, Japanese encephalitis virus
TFFLWAAEVP

SEQ ID NO: 228727 - protein, 10 aa, Japanese encephalitis virus
FFLWAAEVPG

SEQ ID NO: 228728 - protein, 10 aa, Japanese encephalitis virus
FLWAAEVPGT

SEQ ID NO: 228729 - protein, 10 aa, Japanese encephalitis virus
LWAAEVPGTK

SEQ ID NO: 228730 - protein, 10 aa, Japanese encephalitis virus
WAAEVPGTKI

SEQ ID NO: 228731 - protein, 10 aa, Japanese encephalitis virus
AAEVPGTKIA

SEQ ID NO: 228732 - protein, 10 aa, Japanese encephalitis virus
AEVPGTKIAG

SEQ ID NO: 228733 - protein, 10 aa, Japanese encephalitis virus
EVPGTKIAGT

SEQ ID NO: 228734 - protein, 10 aa, Japanese encephalitis virus
VPGTKIAGTL

SEQ ID NO: 228735 - protein, 10 aa, Japanese encephalitis virus
PGTKIAGTLL

SEQ ID NO: 228736 - protein, 10 aa, Japanese encephalitis virus
GTKIAGTLLI

SEQ ID NO: 228737 - protein, 10 aa, Japanese encephalitis virus
TKIAGTLLIA

SEQ ID NO: 228738 - protein, 10 aa, Japanese encephalitis virus
KIAGTLLIAL

SEQ ID NO: 228739 - protein, 10 aa, Japanese encephalitis virus
IAGTLLIALL

SEQ ID NO: 228740 - protein, 10 aa, Japanese encephalitis virus
AGTLLIALLL

SEQ ID NO: 228741 - protein, 10 aa, Japanese encephalitis virus
GTLLIALLLM

SEQ ID NO: 228742 - protein, 10 aa, Japanese encephalitis virus
TLLIALLLMV

SEQ ID NO: 228743 - protein, 10 aa, Japanese encephalitis virus
LLIALLLMVV

SEQ ID NO: 228744 - protein, 10 aa, Japanese encephalitis virus
LIALLLMVVL

SEQ ID NO: 228745 - protein, 10 aa, Japanese encephalitis virus
IALLLMVVLI

SEQ ID NO: 228746 - protein, 10 aa, Japanese encephalitis virus
ALLLMVVLIP

SEQ ID NO: 228747 - protein, 10 aa, Japanese encephalitis virus
LLLMVVLIPE

SEQ ID NO: 228748 - protein, 10 aa, Japanese encephalitis virus
LLMVVLIPEP

SEQ ID NO: 228749 - protein, 10 aa, Japanese encephalitis virus
LMVVLIPEPE

SEQ ID NO: 228750 - protein, 10 aa, Japanese encephalitis virus
MVVLIPEPEK

SEQ ID NO: 228751 - protein, 10 aa, Japanese encephalitis virus
VVLIPEPEKQ

SEQ ID NO: 228752 - protein, 10 aa, Japanese encephalitis virus
VLIPEPEKQR

SEQ ID NO: 228753 - protein, 10 aa, Japanese encephalitis virus
LIPEPEKQRS

SEQ ID NO: 228754 - protein, 10 aa, Japanese encephalitis virus
IPEPEKQRSQ

SEQ ID NO: 228755 - protein, 10 aa, Japanese encephalitis virus
PEPEKQRSQT

SEQ ID NO: 228756 - protein, 10 aa, Japanese encephalitis virus
EPEKQRSQTD

SEQ ID NO: 228757 - protein, 10 aa, Japanese encephalitis virus
PEKQRSQTDN

SEQ ID NO: 228758 - protein, 10 aa, Japanese encephalitis virus
EKQRSQTDNQ

SEQ ID NO: 228759 - protein, 10 aa, Japanese encephalitis virus
KQRSQTDNQL

SEQ ID NO: 228760 - protein, 10 aa, Japanese encephalitis virus
QRSQTDNQLA

SEQ ID NO: 228761 - protein, 10 aa, Japanese encephalitis virus
RSQTDNQLAV

SEQ ID NO: 228762 - protein, 10 aa, Japanese encephalitis virus
SQTDNQLAVF

SEQ ID NO: 228763 - protein, 10 aa, Japanese encephalitis virus
QTDNQLAVFL

SEQ ID NO: 228764 - protein, 10 aa, Japanese encephalitis virus
TDNQLAVFLI

SEQ ID NO: 228765 - protein, 10 aa, Japanese encephalitis virus
DNQLAVFLIC

SEQ ID NO: 228766 - protein, 10 aa, Japanese encephalitis virus
NQLAVFLICV

SEQ ID NO: 228767 - protein, 10 aa, Japanese encephalitis virus
QLAVFLICVL

SEQ ID NO: 228768 - protein, 10 aa, Japanese encephalitis virus
LAVFLICVLT

SEQ ID NO: 228769 - protein, 10 aa, Japanese encephalitis virus
AVFLICVLTV

SEQ ID NO: 228770 - protein, 10 aa, Japanese encephalitis virus
VFLICVLTVV

SEQ ID NO: 228771 - protein, 10 aa, Japanese encephalitis virus
FLICVLTVVG

SEQ ID NO: 228772 - protein, 10 aa, Japanese encephalitis virus
LICVLTVVGV

SEQ ID NO: 228773 - protein, 10 aa, Japanese encephalitis virus
ICVLTVVGVV

SEQ ID NO: 228774 - protein, 10 aa, Japanese encephalitis virus
CVLTVVGVVA

SEQ ID NO: 228775 - protein, 10 aa, Japanese encephalitis virus
VLTVVGVVAA

SEQ ID NO: 228776 - protein, 10 aa, Japanese encephalitis virus
LTVVGVVAAN

SEQ ID NO: 228777 - protein, 10 aa, Japanese encephalitis virus
TVVGVVAANE

SEQ ID NO: 228778 - protein, 10 aa, Japanese encephalitis virus
VVGVVAANEY

SEQ ID NO: 228779 - protein, 10 aa, Japanese encephalitis virus
VGVVAANEYG

SEQ ID NO: 228780 - protein, 10 aa, Japanese encephalitis virus
GVVAANEYGM

SEQ ID NO: 228781 - protein, 10 aa, Japanese encephalitis virus
VVAANEYGML

SEQ ID NO: 228782 - protein, 10 aa, Japanese encephalitis virus
VAANEYGMLE

SEQ ID NO: 228783 - protein, 10 aa, Japanese encephalitis virus
AANEYGMLEK

SEQ ID NO: 228784 - protein, 10 aa, Japanese encephalitis virus
ANEYGMLEKT

SEQ ID NO: 228785 - protein, 10 aa, Japanese encephalitis virus
NEYGMLEKTK

SEQ ID NO: 228786 - protein, 10 aa, Japanese encephalitis virus
EYGMLEKTKA

SEQ ID NO: 228787 - protein, 10 aa, Japanese encephalitis virus
YGMLEKTKAD

SEQ ID NO: 228788 - protein, 10 aa, Japanese encephalitis virus
GMLEKTKADL

SEQ ID NO: 228789 - protein, 10 aa, Japanese encephalitis virus
MLEKTKADLK

SEQ ID NO: 228790 - protein, 10 aa, Japanese encephalitis virus
LEKTKADLKS

SEQ ID NO: 228791 - protein, 10 aa, Japanese encephalitis virus
EKTKADLKSM

SEQ ID NO: 228792 - protein, 10 aa, Japanese encephalitis virus
KTKADLKSMF

SEQ ID NO: 228793 - protein, 10 aa, Japanese encephalitis virus
TKADLKSMFG

SEQ ID NO: 228794 - protein, 10 aa, Japanese encephalitis virus
KADLKSMFGG

SEQ ID NO: 228795 - protein, 10 aa, Japanese encephalitis virus
ADLKSMFGGK

SEQ ID NO: 228796 - protein, 10 aa, Japanese encephalitis virus
KSMFGGKTQA

SEQ ID NO: 228797 - protein, 10 aa, Japanese encephalitis virus
TQASGLTGLP

SEQ ID NO: 228798 - protein, 10 aa, Japanese encephalitis virus
QASGLTGLPS

SEQ ID NO: 228799 - protein, 10 aa, Japanese encephalitis virus
ASGLTGLPSM

SEQ ID NO: 228800 - protein, 10 aa, Japanese encephalitis virus
GLTGLPSMAL

SEQ ID NO: 228801 - protein, 10 aa, Japanese encephalitis virus
LTGLPSMALD

SEQ ID NO: 228802 - protein, 10 aa, Japanese encephalitis virus
TGLPSMALDL

SEQ ID NO: 228803 - protein, 10 aa, Japanese encephalitis virus
GLPSMALDLR

SEQ ID NO: 228804 - protein, 10 aa, Japanese encephalitis virus
LPSMALDLRP

SEQ ID NO: 228805 - protein, 10 aa, Japanese encephalitis virus
PSMALDLRPA

SEQ ID NO: 228806 - protein, 10 aa, Japanese encephalitis virus
SMALDLRPAT

SEQ ID NO: 228807 - protein, 10 aa, Japanese encephalitis virus
MALDLRPATA

SEQ ID NO: 228808 - protein, 10 aa, Japanese encephalitis virus
ALDLRPATAW

SEQ ID NO: 228809 - protein, 10 aa, Japanese encephalitis virus
LDLRPATAWA

SEQ ID NO: 228810 - protein, 10 aa, Japanese encephalitis virus
DLRPATAWAL

SEQ ID NO: 228811 - protein, 10 aa, Japanese encephalitis virus
LRPATAWALY

SEQ ID NO: 228812 - protein, 10 aa, Japanese encephalitis virus
RPATAWALYG

SEQ ID NO: 228813 - protein, 10 aa, Japanese encephalitis virus
PATAWALYGG

SEQ ID NO: 228814 - protein, 10 aa, Japanese encephalitis virus
ATAWALYGGS

SEQ ID NO: 228815 - protein, 10 aa, Japanese encephalitis virus
TAWALYGGST

SEQ ID NO: 228816 - protein, 10 aa, Japanese encephalitis virus
AWALYGGSTV

SEQ ID NO: 228817 - protein, 10 aa, Japanese encephalitis virus
WALYGGSTVV

SEQ ID NO: 228818 - protein, 10 aa, Japanese encephalitis virus
ALYGGSTVVL

SEQ ID NO: 228819 - protein, 10 aa, Japanese encephalitis virus
LYGGSTVVLT

SEQ ID NO: 228820 - protein, 10 aa, Japanese encephalitis virus
YGGSTVVLTP

SEQ ID NO: 228821 - protein, 10 aa, Japanese encephalitis virus
GGSTVVLTPL

SEQ ID NO: 228822 - protein, 10 aa, Japanese encephalitis virus
GSTVVLTPLL

SEQ ID NO: 228823 - protein, 10 aa, Japanese encephalitis virus
STVVLTPLLK

SEQ ID NO: 228824 - protein, 10 aa, Japanese encephalitis virus
TVVLTPLLKH

SEQ ID NO: 228825 - protein, 10 aa, Japanese encephalitis virus
VVLTPLLKHL

SEQ ID NO: 228826 - protein, 10 aa, Japanese encephalitis virus
VLTPLLKHLI

SEQ ID NO: 228827 - protein, 10 aa, Japanese encephalitis virus
LTPLLKHLIT

SEQ ID NO: 228828 - protein, 10 aa, Japanese encephalitis virus
TPLLKHLITS

SEQ ID NO: 228829 - protein, 10 aa, Japanese encephalitis virus
PLLKHLITSE

SEQ ID NO: 228830 - protein, 10 aa, Japanese encephalitis virus
LLKHLITSEY

SEQ ID NO: 228831 - protein, 10 aa, Japanese encephalitis virus
LKHLITSEYV

SEQ ID NO: 228832 - protein, 10 aa, Japanese encephalitis virus
KHLITSEYVT

SEQ ID NO: 228833 - protein, 10 aa, Japanese encephalitis virus
HLITSEYVTT

SEQ ID NO: 228834 - protein, 10 aa, Japanese encephalitis virus
LITSEYVTTS

SEQ ID NO: 228835 - protein, 10 aa, Japanese encephalitis virus
ITSEYVTTSL

SEQ ID NO: 228836 - protein, 10 aa, Japanese encephalitis virus
TSEYVTTSLA

SEQ ID NO: 228837 - protein, 10 aa, Japanese encephalitis virus
SEYVTTSLAS

SEQ ID NO: 228838 - protein, 10 aa, Japanese encephalitis virus
EYVTTSLASI

SEQ ID NO: 228839 - protein, 10 aa, Japanese encephalitis virus
YVTTSLASIN

SEQ ID NO: 228840 - protein, 10 aa, Japanese encephalitis virus
VTTSLASINS

SEQ ID NO: 228841 - protein, 10 aa, Japanese encephalitis virus
TTSLASINSQ

SEQ ID NO: 228842 - protein, 10 aa, Japanese encephalitis virus
TSLASINSQA

SEQ ID NO: 228843 - protein, 10 aa, Japanese encephalitis virus
SLASINSQAG

SEQ ID NO: 228844 - protein, 10 aa, Japanese encephalitis virus
LASINSQAGS

SEQ ID NO: 228845 - protein, 10 aa, Japanese encephalitis virus
ASINSQAGSL

SEQ ID NO: 228846 - protein, 10 aa, Japanese encephalitis virus
SINSQAGSLF

SEQ ID NO: 228847 - protein, 10 aa, Japanese encephalitis virus
INSQAGSLFV

SEQ ID NO: 228848 - protein, 10 aa, Japanese encephalitis virus
NSQAGSLFVL

SEQ ID NO: 228849 - protein, 10 aa, Japanese encephalitis virus
SQAGSLFVLP

SEQ ID NO: 228850 - protein, 10 aa, Japanese encephalitis virus
QAGSLFVLPR

SEQ ID NO: 228851 - protein, 10 aa, Japanese encephalitis virus
AGSLFVLPRG

SEQ ID NO: 228852 - protein, 10 aa, Japanese encephalitis virus
GSLFVLPRGV

SEQ ID NO: 228853 - protein, 10 aa, Japanese encephalitis virus
SLFVLPRGVP

SEQ ID NO: 228854 - protein, 10 aa, Japanese encephalitis virus
LFVLPRGVPF

SEQ ID NO: 228855 - protein, 10 aa, Japanese encephalitis virus
FVLPRGVPFT

SEQ ID NO: 228856 - protein, 10 aa, Japanese encephalitis virus
VLPRGVPFTD

SEQ ID NO: 228857 - protein, 10 aa, Japanese encephalitis virus
LPRGVPFTDL

SEQ ID NO: 228858 - protein, 10 aa, Japanese encephalitis virus
PRGVPFTDLD

SEQ ID NO: 228859 - protein, 10 aa, Japanese encephalitis virus
RGVPFTDLDL

SEQ ID NO: 228860 - protein, 10 aa, Japanese encephalitis virus
GVPFTDLDLT

SEQ ID NO: 228861 - protein, 10 aa, Japanese encephalitis virus
VPFTDLDLTV

SEQ ID NO: 228862 - protein, 10 aa, Japanese encephalitis virus
PFTDLDLTVG

SEQ ID NO: 228863 - protein, 10 aa, Japanese encephalitis virus
FTDLDLTVGL

SEQ ID NO: 228864 - protein, 10 aa, Japanese encephalitis virus
TDLDLTVGLV

SEQ ID NO: 228865 - protein, 10 aa, Japanese encephalitis virus
DLDLTVGLVF

SEQ ID NO: 228866 - protein, 10 aa, Japanese encephalitis virus
LDLTVGLVFL

SEQ ID NO: 228867 - protein, 10 aa, Japanese encephalitis virus
DLTVGLVFLG

SEQ ID NO: 228868 - protein, 10 aa, Japanese encephalitis virus
LTVGLVFLGC

SEQ ID NO: 228869 - protein, 10 aa, Japanese encephalitis virus
TVGLVFLGCW

SEQ ID NO: 228870 - protein, 10 aa, Japanese encephalitis virus
VGLVFLGCWG

SEQ ID NO: 228871 - protein, 10 aa, Japanese encephalitis virus
GLVFLGCWGQ

SEQ ID NO: 228872 - protein, 10 aa, Japanese encephalitis virus
LVFLGCWGQI

SEQ ID NO: 228873 - protein, 10 aa, Japanese encephalitis virus
VFLGCWGQIT

SEQ ID NO: 228874 - protein, 10 aa, Japanese encephalitis virus
FLGCWGQITL

SEQ ID NO: 228875 - protein, 10 aa, Japanese encephalitis virus
LGCWGQITLT

SEQ ID NO: 228876 - protein, 10 aa, Japanese encephalitis virus
GCWGQITLTT

SEQ ID NO: 228877 - protein, 10 aa, Japanese encephalitis virus
CWGQITLTTF

SEQ ID NO: 228878 - protein, 10 aa, Japanese encephalitis virus
WGQITLTTFL

SEQ ID NO: 228879 - protein, 10 aa, Japanese encephalitis virus
GQITLTTFLT

SEQ ID NO: 228880 - protein, 10 aa, Japanese encephalitis virus
QITLTTFLTA

SEQ ID NO: 228881 - protein, 10 aa, Japanese encephalitis virus
ITLTTFLTAM

SEQ ID NO: 228882 - protein, 10 aa, Japanese encephalitis virus
TLTTFLTAMV

SEQ ID NO: 228883 - protein, 10 aa, Japanese encephalitis virus
LTTFLTAMVL

SEQ ID NO: 228884 - protein, 10 aa, Japanese encephalitis virus
LTAMVLATLH

SEQ ID NO: 228885 - protein, 10 aa, Japanese encephalitis virus
TAMVLATLHY

SEQ ID NO: 228886 - protein, 10 aa, Japanese encephalitis virus
AMVLATLHYG

SEQ ID NO: 228887 - protein, 10 aa, Japanese encephalitis virus
VLATLHYGYM

SEQ ID NO: 228888 - protein, 10 aa, Japanese encephalitis virus
LATLHYGYML

SEQ ID NO: 228889 - protein, 10 aa, Japanese encephalitis virus
ATLHYGYMLP

SEQ ID NO: 228890 - protein, 10 aa, Japanese encephalitis virus
TLHYGYMLPG

SEQ ID NO: 228891 - protein, 10 aa, Japanese encephalitis virus
LHYGYMLPGW

SEQ ID NO: 228892 - protein, 10 aa, Japanese encephalitis virus
HYGYMLPGWQ

SEQ ID NO: 228893 - protein, 10 aa, Japanese encephalitis virus
YGYMLPGWQA

SEQ ID NO: 228894 - protein, 10 aa, Japanese encephalitis virus
GYMLPGWQAE

SEQ ID NO: 228895 - protein, 10 aa, Japanese encephalitis virus
YMLPGWQAEA

SEQ ID NO: 228896 - protein, 10 aa, Japanese encephalitis virus
MLPGWQAEAL

SEQ ID NO: 228897 - protein, 10 aa, Japanese encephalitis virus
LPGWQAEALR

SEQ ID NO: 228898 - protein, 10 aa, Japanese encephalitis virus
PGWQAEALRA

SEQ ID NO: 228899 - protein, 10 aa, Japanese encephalitis virus
GWQAEALRAA

SEQ ID NO: 228900 - protein, 10 aa, Japanese encephalitis virus
WQAEALRAAQ

SEQ ID NO: 228901 - protein, 10 aa, Japanese encephalitis virus
QAEALRAAQR

SEQ ID NO: 228902 - protein, 10 aa, Japanese encephalitis virus
AEALRAAQRR

SEQ ID NO: 228903 - protein, 10 aa, Japanese encephalitis virus
EALRAAQRRT

SEQ ID NO: 228904 - protein, 10 aa, Japanese encephalitis virus
ALRAAQRRTA

SEQ ID NO: 228905 - protein, 10 aa, Japanese encephalitis virus
LRAAQRRTAA

SEQ ID NO: 228906 - protein, 10 aa, Japanese encephalitis virus
RAAQRRTAAG

SEQ ID NO: 228907 - protein, 10 aa, Japanese encephalitis virus
AAQRRTAAGI

SEQ ID NO: 228908 - protein, 10 aa, Japanese encephalitis virus
AQRRTAAGIM

SEQ ID NO: 228909 - protein, 10 aa, Japanese encephalitis virus
QRRTAAGIMK

SEQ ID NO: 228910 - protein, 10 aa, Japanese encephalitis virus
RRTAAGIMKN

SEQ ID NO: 228911 - protein, 10 aa, Japanese encephalitis virus
RTAAGIMKNA

SEQ ID NO: 228912 - protein, 10 aa, Japanese encephalitis virus
TAAGIMKNAV

SEQ ID NO: 228913 - protein, 10 aa, Japanese encephalitis virus
AAGIMKNAVV

SEQ ID NO: 228914 - protein, 10 aa, Japanese encephalitis virus
AGIMKNAVVD

SEQ ID NO: 228915 - protein, 10 aa, Japanese encephalitis virus
GIMKNAVVDG

SEQ ID NO: 228916 - protein, 10 aa, Japanese encephalitis virus
IMKNAVVDGM

SEQ ID NO: 228917 - protein, 10 aa, Japanese encephalitis virus
MKNAVVDGMV

SEQ ID NO: 228918 - protein, 10 aa, Japanese encephalitis virus
KNAVVDGMVA

SEQ ID NO: 228919 - protein, 10 aa, Japanese encephalitis virus
NAVVDGMVAT

SEQ ID NO: 228920 - protein, 10 aa, Japanese encephalitis virus
AVVDGMVATD

SEQ ID NO: 228921 - protein, 10 aa, Japanese encephalitis virus
VVDGMVATDV

SEQ ID NO: 228922 - protein, 10 aa, Japanese encephalitis virus
VDGMVATDVP

SEQ ID NO: 228923 - protein, 10 aa, Japanese encephalitis virus
DGMVATDVPE

SEQ ID NO: 228924 - protein, 10 aa, Japanese encephalitis virus
GMVATDVPEL

SEQ ID NO: 228925 - protein, 10 aa, Japanese encephalitis virus
MVATDVPELE

SEQ ID NO: 228926 - protein, 10 aa, Japanese encephalitis virus
VATDVPELER

SEQ ID NO: 228927 - protein, 10 aa, Japanese encephalitis virus
ATDVPELERT

SEQ ID NO: 228928 - protein, 10 aa, Japanese encephalitis virus
TDVPELERTT

SEQ ID NO: 228929 - protein, 10 aa, Japanese encephalitis virus
DVPELERTTP

SEQ ID NO: 228930 - protein, 10 aa, Japanese encephalitis virus
VPELERTTPL

SEQ ID NO: 228931 - protein, 10 aa, Japanese encephalitis virus
PELERTTPLM

SEQ ID NO: 228932 - protein, 10 aa, Japanese encephalitis virus
ELERTTPLMQ

SEQ ID NO: 228933 - protein, 10 aa, Japanese encephalitis virus
LERTTPLMQK

SEQ ID NO: 228934 - protein, 10 aa, Japanese encephalitis virus
ERTTPLMQKK

SEQ ID NO: 228935 - protein, 10 aa, Japanese encephalitis virus
RTTPLMQKKV

SEQ ID NO: 228936 - protein, 10 aa, Japanese encephalitis virus
TTPLMQKKVG

SEQ ID NO: 228937 - protein, 10 aa, Japanese encephalitis virus
TPLMQKKVGQ

SEQ ID NO: 228938 - protein, 10 aa, Japanese encephalitis virus
PLMQKKVGQV

SEQ ID NO: 228939 - protein, 10 aa, Japanese encephalitis virus
LMQKKVGQVL

SEQ ID NO: 228940 - protein, 10 aa, Japanese encephalitis virus
MQKKVGQVLL

SEQ ID NO: 228941 - protein, 10 aa, Japanese encephalitis virus
QKKVGQVLLI

SEQ ID NO: 228942 - protein, 10 aa, Japanese encephalitis virus
KKVGQVLLIG

SEQ ID NO: 228943 - protein, 10 aa, Japanese encephalitis virus
KVGQVLLIGV

SEQ ID NO: 228944 - protein, 10 aa, Japanese encephalitis virus
VGQVLLIGVS

SEQ ID NO: 228945 - protein, 10 aa, Japanese encephalitis virus
GQVLLIGVSV

SEQ ID NO: 228946 - protein, 10 aa, Japanese encephalitis virus
QVLLIGVSVA

SEQ ID NO: 228947 - protein, 10 aa, Japanese encephalitis virus
VLLIGVSVAA

SEQ ID NO: 228948 - protein, 10 aa, Japanese encephalitis virus
LLIGVSVAAF

SEQ ID NO: 228949 - protein, 10 aa, Japanese encephalitis virus
LIGVSVAAFL

SEQ ID NO: 228950 - protein, 10 aa, Japanese encephalitis virus
IGVSVAAFLV

SEQ ID NO: 228951 - protein, 10 aa, Japanese encephalitis virus
GVSVAAFLVN

SEQ ID NO: 228952 - protein, 10 aa, Japanese encephalitis virus
VSVAAFLVNP

SEQ ID NO: 228953 - protein, 10 aa, Japanese encephalitis virus
SVAAFLVNPN

SEQ ID NO: 228954 - protein, 10 aa, Japanese encephalitis virus
VAAFLVNPNV

SEQ ID NO: 228955 - protein, 10 aa, Japanese encephalitis virus
AAFLVNPNVT

SEQ ID NO: 228956 - protein, 10 aa, Japanese encephalitis virus
AFLVNPNVTT

SEQ ID NO: 228957 - protein, 10 aa, Japanese encephalitis virus
FLVNPNVTTV

SEQ ID NO: 228958 - protein, 10 aa, Japanese encephalitis virus
LVNPNVTTVR

SEQ ID NO: 228959 - protein, 10 aa, Japanese encephalitis virus
VNPNVTTVRE

SEQ ID NO: 228960 - protein, 10 aa, Japanese encephalitis virus
NPNVTTVREA

SEQ ID NO: 228961 - protein, 10 aa, Japanese encephalitis virus
PNVTTVREAG

SEQ ID NO: 228962 - protein, 10 aa, Japanese encephalitis virus
NVTTVREAGV

SEQ ID NO: 228963 - protein, 10 aa, Japanese encephalitis virus
VTTVREAGVL

SEQ ID NO: 228964 - protein, 10 aa, Japanese encephalitis virus
TTVREAGVLV

SEQ ID NO: 228965 - protein, 10 aa, Japanese encephalitis virus
TVREAGVLVT

SEQ ID NO: 228966 - protein, 10 aa, Japanese encephalitis virus
VREAGVLVTA

SEQ ID NO: 228967 - protein, 10 aa, Japanese encephalitis virus
REAGVLVTAA

SEQ ID NO: 228968 - protein, 10 aa, Japanese encephalitis virus
EAGVLVTAAT

SEQ ID NO: 228969 - protein, 10 aa, Japanese encephalitis virus
AGVLVTAATL

SEQ ID NO: 228970 - protein, 10 aa, Japanese encephalitis virus
GVLVTAATLT

SEQ ID NO: 228971 - protein, 10 aa, Japanese encephalitis virus
VLVTAATLTL

SEQ ID NO: 228972 - protein, 10 aa, Japanese encephalitis virus
LVTAATLTLW

SEQ ID NO: 228973 - protein, 10 aa, Japanese encephalitis virus
VTAATLTLWD

SEQ ID NO: 228974 - protein, 10 aa, Japanese encephalitis virus
TAATLTLWDN

SEQ ID NO: 228975 - protein, 10 aa, Japanese encephalitis virus
AATLTLWDNG

SEQ ID NO: 228976 - protein, 10 aa, Japanese encephalitis virus
ATLTLWDNGA

SEQ ID NO: 228977 - protein, 10 aa, Japanese encephalitis virus
TLTLWDNGAS

SEQ ID NO: 228978 - protein, 10 aa, Japanese encephalitis virus
LTLWDNGASA

SEQ ID NO: 228979 - protein, 10 aa, Japanese encephalitis virus
TLWDNGASAV

SEQ ID NO: 228980 - protein, 10 aa, Japanese encephalitis virus
LWDNGASAVW

SEQ ID NO: 228981 - protein, 10 aa, Japanese encephalitis virus
WDNGASAVWN

SEQ ID NO: 228982 - protein, 10 aa, Japanese encephalitis virus
DNGASAVWNS

SEQ ID NO: 228983 - protein, 10 aa, Japanese encephalitis virus
NGASAVWNST

SEQ ID NO: 228984 - protein, 10 aa, Japanese encephalitis virus
GASAVWNSTT

SEQ ID NO: 228985 - protein, 10 aa, Japanese encephalitis virus
ASAVWNSTTA

SEQ ID NO: 228986 - protein, 10 aa, Japanese encephalitis virus
SAVWNSTTAT

SEQ ID NO: 228987 - protein, 10 aa, Japanese encephalitis virus
AVWNSTTATG

SEQ ID NO: 228988 - protein, 10 aa, Japanese encephalitis virus
VWNSTTATGL

SEQ ID NO: 228989 - protein, 10 aa, Japanese encephalitis virus
WNSTTATGLC

SEQ ID NO: 228990 - protein, 10 aa, Japanese encephalitis virus
NSTTATGLCH

SEQ ID NO: 228991 - protein, 10 aa, Japanese encephalitis virus
STTATGLCHV

SEQ ID NO: 228992 - protein, 10 aa, Japanese encephalitis virus
TTATGLCHVM

SEQ ID NO: 228993 - protein, 10 aa, Japanese encephalitis virus
TATGLCHVMR

SEQ ID NO: 228994 - protein, 10 aa, Japanese encephalitis virus
ATGLCHVMRG

SEQ ID NO: 228995 - protein, 10 aa, Japanese encephalitis virus
TGLCHVMRGS

SEQ ID NO: 228996 - protein, 10 aa, Japanese encephalitis virus
GLCHVMRGSY

SEQ ID NO: 228997 - protein, 10 aa, Japanese encephalitis virus
LCHVMRGSYL

SEQ ID NO: 228998 - protein, 10 aa, Japanese encephalitis virus
CHVMRGSYLA

SEQ ID NO: 228999 - protein, 10 aa, Japanese encephalitis virus
HVMRGSYLAG

SEQ ID NO: 229000 - protein, 10 aa, Japanese encephalitis virus
VMRGSYLAGG

SEQ ID NO: 229001 - protein, 10 aa, Japanese encephalitis virus
MRGSYLAGGS

SEQ ID NO: 229002 - protein, 10 aa, Japanese encephalitis virus
RGSYLAGGSI

SEQ ID NO: 229003 - protein, 10 aa, Japanese encephalitis virus
GSYLAGGSIA

SEQ ID NO: 229004 - protein, 10 aa, Japanese encephalitis virus
SYLAGGSIAW

SEQ ID NO: 229005 - protein, 10 aa, Japanese encephalitis virus
YLAGGSIAWT

SEQ ID NO: 229006 - protein, 10 aa, Japanese encephalitis virus
LAGGSIAWTL

SEQ ID NO: 229007 - protein, 10 aa, Japanese encephalitis virus
AGGSIAWTLI

SEQ ID NO: 229008 - protein, 10 aa, Japanese encephalitis virus
GGSIAWTLIK

SEQ ID NO: 229009 - protein, 10 aa, Japanese encephalitis virus
GSIAWTLIKN

SEQ ID NO: 229010 - protein, 10 aa, Japanese encephalitis virus
SIAWTLIKNA

SEQ ID NO: 229011 - protein, 10 aa, Japanese encephalitis virus
IAWTLIKNAD

SEQ ID NO: 229012 - protein, 10 aa, Japanese encephalitis virus
AWTLIKNADK

SEQ ID NO: 229013 - protein, 10 aa, Japanese encephalitis virus
WTLIKNADKP

SEQ ID NO: 229014 - protein, 10 aa, Japanese encephalitis virus
TLIKNADKPS

SEQ ID NO: 229015 - protein, 10 aa, Japanese encephalitis virus
LIKNADKPSL

SEQ ID NO: 229016 - protein, 10 aa, Japanese encephalitis virus
IKNADKPSLK

SEQ ID NO: 229017 - protein, 10 aa, Japanese encephalitis virus
KNADKPSLKR

SEQ ID NO: 229018 - protein, 10 aa, Japanese encephalitis virus
NADKPSLKRG

SEQ ID NO: 229019 - protein, 10 aa, Japanese encephalitis virus
ADKPSLKRGR

SEQ ID NO: 229020 - protein, 10 aa, Japanese encephalitis virus
KPSLKRGRPG

SEQ ID NO: 229021 - protein, 10 aa, Japanese encephalitis virus
PSLKRGRPGG

SEQ ID NO: 229022 - protein, 10 aa, Japanese encephalitis virus
SLKRGRPGGR

SEQ ID NO: 229023 - protein, 10 aa, Japanese encephalitis virus
LKRGRPGGRT

SEQ ID NO: 229024 - protein, 10 aa, Japanese encephalitis virus
KRGRPGGRTL

SEQ ID NO: 229025 - protein, 10 aa, Japanese encephalitis virus
RGRPGGRTLG

SEQ ID NO: 229026 - protein, 10 aa, Japanese encephalitis virus
GRPGGRTLGE

SEQ ID NO: 229027 - protein, 10 aa, Japanese encephalitis virus
RPGGRTLGEQ

SEQ ID NO: 229028 - protein, 10 aa, Japanese encephalitis virus
PGGRTLGEQW

SEQ ID NO: 229029 - protein, 10 aa, Japanese encephalitis virus
GGRTLGEQWK

SEQ ID NO: 229030 - protein, 10 aa, Japanese encephalitis virus
GRTLGEQWKE

SEQ ID NO: 229031 - protein, 10 aa, Japanese encephalitis virus
RTLGEQWKEK

SEQ ID NO: 229032 - protein, 10 aa, Japanese encephalitis virus
TLGEQWKEKL

SEQ ID NO: 229033 - protein, 10 aa, Japanese encephalitis virus
LGEQWKEKLN

SEQ ID NO: 229034 - protein, 10 aa, Japanese encephalitis virus
GEQWKEKLNA

SEQ ID NO: 229035 - protein, 10 aa, Japanese encephalitis virus
EQWKEKLNAM

SEQ ID NO: 229036 - protein, 10 aa, Japanese encephalitis virus
QWKEKLNAMS

SEQ ID NO: 229037 - protein, 10 aa, Japanese encephalitis virus
WKEKLNAMSR

SEQ ID NO: 229038 - protein, 10 aa, Japanese encephalitis virus
KLNAMSREEF

SEQ ID NO: 229039 - protein, 10 aa, Japanese encephalitis virus
LNAMSREEFF

SEQ ID NO: 229040 - protein, 10 aa, Japanese encephalitis virus
NAMSREEFFK

SEQ ID NO: 229041 - protein, 10 aa, Japanese encephalitis virus
AMSREEFFKY

SEQ ID NO: 229042 - protein, 10 aa, Japanese encephalitis virus
MSREEFFKYR

SEQ ID NO: 229043 - protein, 10 aa, Japanese encephalitis virus
SREEFFKYRR

SEQ ID NO: 229044 - protein, 10 aa, Japanese encephalitis virus
REEFFKYRRE

SEQ ID NO: 229045 - protein, 10 aa, Japanese encephalitis virus
EEFFKYRREA

SEQ ID NO: 229046 - protein, 10 aa, Japanese encephalitis virus
EFFKYRREAI

SEQ ID NO: 229047 - protein, 10 aa, Japanese encephalitis virus
FFKYRREAII

SEQ ID NO: 229048 - protein, 10 aa, Japanese encephalitis virus
FKYRREAIIE

SEQ ID NO: 229049 - protein, 10 aa, Japanese encephalitis virus
KYRREAIIEV

SEQ ID NO: 229050 - protein, 10 aa, Japanese encephalitis virus
YRREAIIEVD

SEQ ID NO: 229051 - protein, 10 aa, Japanese encephalitis virus
RREAIIEVDR

SEQ ID NO: 229052 - protein, 10 aa, Japanese encephalitis virus
REAIIEVDRT

SEQ ID NO: 229053 - protein, 10 aa, Japanese encephalitis virus
EAIIEVDRTE

SEQ ID NO: 229054 - protein, 10 aa, Japanese encephalitis virus
AIIEVDRTEA

SEQ ID NO: 229055 - protein, 10 aa, Japanese encephalitis virus
IIEVDRTEAR

SEQ ID NO: 229056 - protein, 10 aa, Japanese encephalitis virus
IEVDRTEARR

SEQ ID NO: 229057 - protein, 10 aa, Japanese encephalitis virus
EVDRTEARRA

SEQ ID NO: 229058 - protein, 10 aa, Japanese encephalitis virus
VDRTEARRAR

SEQ ID NO: 229059 - protein, 10 aa, Japanese encephalitis virus
DRTEARRARR

SEQ ID NO: 229060 - protein, 10 aa, Japanese encephalitis virus
RTEARRARRE

SEQ ID NO: 229061 - protein, 10 aa, Japanese encephalitis virus
TEARRARREN

SEQ ID NO: 229062 - protein, 10 aa, Japanese encephalitis virus
EARRARRENN

SEQ ID NO: 229063 - protein, 10 aa, Japanese encephalitis virus
ARRARRENNI

SEQ ID NO: 229064 - protein, 10 aa, Japanese encephalitis virus
RRARRENNIV

SEQ ID NO: 229065 - protein, 10 aa, Japanese encephalitis virus
RARRENNIVG

SEQ ID NO: 229066 - protein, 10 aa, Japanese encephalitis virus
ARRENNIVGG

SEQ ID NO: 229067 - protein, 10 aa, Japanese encephalitis virus
RRENNIVGGH

SEQ ID NO: 229068 - protein, 10 aa, Japanese encephalitis virus
RENNIVGGHP

SEQ ID NO: 229069 - protein, 10 aa, Japanese encephalitis virus
ENNIVGGHPV

SEQ ID NO: 229070 - protein, 10 aa, Japanese encephalitis virus
NNIVGGHPVS

SEQ ID NO: 229071 - protein, 10 aa, Japanese encephalitis virus
NIVGGHPVSR

SEQ ID NO: 229072 - protein, 10 aa, Japanese encephalitis virus
IVGGHPVSRG

SEQ ID NO: 229073 - protein, 10 aa, Japanese encephalitis virus
VGGHPVSRGS

SEQ ID NO: 229074 - protein, 10 aa, Japanese encephalitis virus
GGHPVSRGSA

SEQ ID NO: 229075 - protein, 10 aa, Japanese encephalitis virus
GHPVSRGSAK

SEQ ID NO: 229076 - protein, 10 aa, Japanese encephalitis virus
HPVSRGSAKL

SEQ ID NO: 229077 - protein, 10 aa, Japanese encephalitis virus
PVSRGSAKLR

SEQ ID NO: 229078 - protein, 10 aa, Japanese encephalitis virus
VSRGSAKLRW

SEQ ID NO: 229079 - protein, 10 aa, Japanese encephalitis virus
SRGSAKLRWL

SEQ ID NO: 229080 - protein, 10 aa, Japanese encephalitis virus
RGSAKLRWLV

SEQ ID NO: 229081 - protein, 10 aa, Japanese encephalitis virus
GSAKLRWLVE

SEQ ID NO: 229082 - protein, 10 aa, Japanese encephalitis virus
SAKLRWLVEK

SEQ ID NO: 229083 - protein, 10 aa, Japanese encephalitis virus
AKLRWLVEKG

SEQ ID NO: 229084 - protein, 10 aa, Japanese encephalitis virus
KLRWLVEKGF

SEQ ID NO: 229085 - protein, 10 aa, Japanese encephalitis virus
LRWLVEKGFV

SEQ ID NO: 229086 - protein, 10 aa, Japanese encephalitis virus
RWLVEKGFVS

SEQ ID NO: 229087 - protein, 10 aa, Japanese encephalitis virus
WLVEKGFVSP

SEQ ID NO: 229088 - protein, 10 aa, Japanese encephalitis virus
LVEKGFVSPI

SEQ ID NO: 229089 - protein, 10 aa, Japanese encephalitis virus
VEKGFVSPIG

SEQ ID NO: 229090 - protein, 10 aa, Japanese encephalitis virus
EKGFVSPIGK

SEQ ID NO: 229091 - protein, 10 aa, Japanese encephalitis virus
KGFVSPIGKV

SEQ ID NO: 229092 - protein, 10 aa, Japanese encephalitis virus
GFVSPIGKVI

SEQ ID NO: 229093 - protein, 10 aa, Japanese encephalitis virus
FVSPIGKVID

SEQ ID NO: 229094 - protein, 10 aa, Japanese encephalitis virus
VSPIGKVIDL

SEQ ID NO: 229095 - protein, 10 aa, Japanese encephalitis virus
SPIGKVIDLG

SEQ ID NO: 229096 - protein, 10 aa, Japanese encephalitis virus
PIGKVIDLGC

SEQ ID NO: 229097 - protein, 10 aa, Japanese encephalitis virus
IGKVIDLGCG

SEQ ID NO: 229098 - protein, 10 aa, Japanese encephalitis virus
GKVIDLGCGR

SEQ ID NO: 229099 - protein, 10 aa, Japanese encephalitis virus
KVIDLGCGRG

SEQ ID NO: 229100 - protein, 10 aa, Japanese encephalitis virus
VIDLGCGRGG

SEQ ID NO: 229101 - protein, 10 aa, Japanese encephalitis virus
IDLGCGRGGW

SEQ ID NO: 229102 - protein, 10 aa, Japanese encephalitis virus
DLGCGRGGWS

SEQ ID NO: 229103 - protein, 10 aa, Japanese encephalitis virus
LGCGRGGWSY

SEQ ID NO: 229104 - protein, 10 aa, Japanese encephalitis virus
GCGRGGWSYY

SEQ ID NO: 229105 - protein, 10 aa, Japanese encephalitis virus
CGRGGWSYYA

SEQ ID NO: 229106 - protein, 10 aa, Japanese encephalitis virus
GRGGWSYYAA

SEQ ID NO: 229107 - protein, 10 aa, Japanese encephalitis virus
RGGWSYYAAT

SEQ ID NO: 229108 - protein, 10 aa, Japanese encephalitis virus
GGWSYYAATL

SEQ ID NO: 229109 - protein, 10 aa, Japanese encephalitis virus
GWSYYAATLK

SEQ ID NO: 229110 - protein, 10 aa, Japanese encephalitis virus
WSYYAATLKK

SEQ ID NO: 229111 - protein, 10 aa, Japanese encephalitis virus
SYYAATLKKV

SEQ ID NO: 229112 - protein, 10 aa, Japanese encephalitis virus
YYAATLKKVQ

SEQ ID NO: 229113 - protein, 10 aa, Japanese encephalitis virus
YAATLKKVQE

SEQ ID NO: 229114 - protein, 10 aa, Japanese encephalitis virus
AATLKKVQEV

SEQ ID NO: 229115 - protein, 10 aa, Japanese encephalitis virus
ATLKKVQEVR

SEQ ID NO: 229116 - protein, 10 aa, Japanese encephalitis virus
TLKKVQEVRG

SEQ ID NO: 229117 - protein, 10 aa, Japanese encephalitis virus
LKKVQEVRGY

SEQ ID NO: 229118 - protein, 10 aa, Japanese encephalitis virus
KKVQEVRGYT

SEQ ID NO: 229119 - protein, 10 aa, Japanese encephalitis virus
KVQEVRGYTK

SEQ ID NO: 229120 - protein, 10 aa, Japanese encephalitis virus
VQEVRGYTKG

SEQ ID NO: 229121 - protein, 10 aa, Japanese encephalitis virus
QEVRGYTKGG

SEQ ID NO: 229122 - protein, 10 aa, Japanese encephalitis virus
EVRGYTKGGA

SEQ ID NO: 229123 - protein, 10 aa, Japanese encephalitis virus
VRGYTKGGAG

SEQ ID NO: 229124 - protein, 10 aa, Japanese encephalitis virus
RGYTKGGAGH

SEQ ID NO: 229125 - protein, 10 aa, Japanese encephalitis virus
GYTKGGAGHE

SEQ ID NO: 229126 - protein, 10 aa, Japanese encephalitis virus
YTKGGAGHEE

SEQ ID NO: 229127 - protein, 10 aa, Japanese encephalitis virus
TKGGAGHEEP

SEQ ID NO: 229128 - protein, 10 aa, Japanese encephalitis virus
KGGAGHEEPM

SEQ ID NO: 229129 - protein, 10 aa, Japanese encephalitis virus
GGAGHEEPML

SEQ ID NO: 229130 - protein, 10 aa, Japanese encephalitis virus
GAGHEEPMLM

SEQ ID NO: 229131 - protein, 10 aa, Japanese encephalitis virus
AGHEEPMLMQ

SEQ ID NO: 229132 - protein, 10 aa, Japanese encephalitis virus
GHEEPMLMQS

SEQ ID NO: 229133 - protein, 10 aa, Japanese encephalitis virus
HEEPMLMQSY

SEQ ID NO: 229134 - protein, 10 aa, Japanese encephalitis virus
EEPMLMQSYG

SEQ ID NO: 229135 - protein, 10 aa, Japanese encephalitis virus
EPMLMQSYGW

SEQ ID NO: 229136 - protein, 10 aa, Japanese encephalitis virus
PMLMQSYGWN

SEQ ID NO: 229137 - protein, 10 aa, Japanese encephalitis virus
MLMQSYGWNL

SEQ ID NO: 229138 - protein, 10 aa, Japanese encephalitis virus
LMQSYGWNLV

SEQ ID NO: 229139 - protein, 10 aa, Japanese encephalitis virus
MQSYGWNLVS

SEQ ID NO: 229140 - protein, 10 aa, Japanese encephalitis virus
QSYGWNLVSL

SEQ ID NO: 229141 - protein, 10 aa, Japanese encephalitis virus
SYGWNLVSLK

SEQ ID NO: 229142 - protein, 10 aa, Japanese encephalitis virus
YGWNLVSLKS

SEQ ID NO: 229143 - protein, 10 aa, Japanese encephalitis virus
GWNLVSLKSG

SEQ ID NO: 229144 - protein, 10 aa, Japanese encephalitis virus
WNLVSLKSGV

SEQ ID NO: 229145 - protein, 10 aa, Japanese encephalitis virus
NLVSLKSGVD

SEQ ID NO: 229146 - protein, 10 aa, Japanese encephalitis virus
LVSLKSGVDV

SEQ ID NO: 229147 - protein, 10 aa, Japanese encephalitis virus
VSLKSGVDVF

SEQ ID NO: 229148 - protein, 10 aa, Japanese encephalitis virus
SLKSGVDVFY

SEQ ID NO: 229149 - protein, 10 aa, Japanese encephalitis virus
LKSGVDVFYK

SEQ ID NO: 229150 - protein, 10 aa, Japanese encephalitis virus
KSGVDVFYKP

SEQ ID NO: 229151 - protein, 10 aa, Japanese encephalitis virus
SGVDVFYKPS

SEQ ID NO: 229152 - protein, 10 aa, Japanese encephalitis virus
GVDVFYKPSE

SEQ ID NO: 229153 - protein, 10 aa, Japanese encephalitis virus
VDVFYKPSEP

SEQ ID NO: 229154 - protein, 10 aa, Japanese encephalitis virus
DVFYKPSEPS

SEQ ID NO: 229155 - protein, 10 aa, Japanese encephalitis virus
VFYKPSEPSD

SEQ ID NO: 229156 - protein, 10 aa, Japanese encephalitis virus
FYKPSEPSDT

SEQ ID NO: 229157 - protein, 10 aa, Japanese encephalitis virus
YKPSEPSDTL

SEQ ID NO: 229158 - protein, 10 aa, Japanese encephalitis virus
KPSEPSDTLF

SEQ ID NO: 229159 - protein, 10 aa, Japanese encephalitis virus
PSEPSDTLFC

SEQ ID NO: 229160 - protein, 10 aa, Japanese encephalitis virus
SEPSDTLFCD

SEQ ID NO: 229161 - protein, 10 aa, Japanese encephalitis virus
EPSDTLFCDI

SEQ ID NO: 229162 - protein, 10 aa, Japanese encephalitis virus
PSDTLFCDIG

SEQ ID NO: 229163 - protein, 10 aa, Japanese encephalitis virus
SDTLFCDIGE

SEQ ID NO: 229164 - protein, 10 aa, Japanese encephalitis virus
DTLFCDIGES

SEQ ID NO: 229165 - protein, 10 aa, Japanese encephalitis virus
TLFCDIGESS

SEQ ID NO: 229166 - protein, 10 aa, Japanese encephalitis virus
LFCDIGESSP

SEQ ID NO: 229167 - protein, 10 aa, Japanese encephalitis virus
FCDIGESSPS

SEQ ID NO: 229168 - protein, 10 aa, Japanese encephalitis virus
CDIGESSPSP

SEQ ID NO: 229169 - protein, 10 aa, Japanese encephalitis virus
DIGESSPSPE

SEQ ID NO: 229170 - protein, 10 aa, Japanese encephalitis virus
IGESSPSPEV

SEQ ID NO: 229171 - protein, 10 aa, Japanese encephalitis virus
GESSPSPEVE

SEQ ID NO: 229172 - protein, 10 aa, Japanese encephalitis virus
ESSPSPEVEE

SEQ ID NO: 229173 - protein, 10 aa, Japanese encephalitis virus
SSPSPEVEEQ

SEQ ID NO: 229174 - protein, 10 aa, Japanese encephalitis virus
SPSPEVEEQR

SEQ ID NO: 229175 - protein, 10 aa, Japanese encephalitis virus
PSPEVEEQRT

SEQ ID NO: 229176 - protein, 10 aa, Japanese encephalitis virus
SPEVEEQRTL

SEQ ID NO: 229177 - protein, 10 aa, Japanese encephalitis virus
PEVEEQRTLR

SEQ ID NO: 229178 - protein, 10 aa, Japanese encephalitis virus
EVEEQRTLRV

SEQ ID NO: 229179 - protein, 10 aa, Japanese encephalitis virus
VEEQRTLRVL

SEQ ID NO: 229180 - protein, 10 aa, Japanese encephalitis virus
EEQRTLRVLE

SEQ ID NO: 229181 - protein, 10 aa, Japanese encephalitis virus
EQRTLRVLEM

SEQ ID NO: 229182 - protein, 10 aa, Japanese encephalitis virus
QRTLRVLEMT

SEQ ID NO: 229183 - protein, 10 aa, Japanese encephalitis virus
RTLRVLEMTS

SEQ ID NO: 229184 - protein, 10 aa, Japanese encephalitis virus
TLRVLEMTSD

SEQ ID NO: 229185 - protein, 10 aa, Japanese encephalitis virus
LRVLEMTSDW

SEQ ID NO: 229186 - protein, 10 aa, Japanese encephalitis virus
RVLEMTSDWL

SEQ ID NO: 229187 - protein, 10 aa, Japanese encephalitis virus
VLEMTSDWLH

SEQ ID NO: 229188 - protein, 10 aa, Japanese encephalitis virus
LEMTSDWLHR

SEQ ID NO: 229189 - protein, 10 aa, Japanese encephalitis virus
EMTSDWLHRG

SEQ ID NO: 229190 - protein, 10 aa, Japanese encephalitis virus
MTSDWLHRGP

SEQ ID NO: 229191 - protein, 10 aa, Japanese encephalitis virus
TSDWLHRGPR

SEQ ID NO: 229192 - protein, 10 aa, Japanese encephalitis virus
SDWLHRGPRE

SEQ ID NO: 229193 - protein, 10 aa, Japanese encephalitis virus
DWLHRGPREF

SEQ ID NO: 229194 - protein, 10 aa, Japanese encephalitis virus
WLHRGPREFC

SEQ ID NO: 229195 - protein, 10 aa, Japanese encephalitis virus
LHRGPREFCI

SEQ ID NO: 229196 - protein, 10 aa, Japanese encephalitis virus
HRGPREFCIK

SEQ ID NO: 229197 - protein, 10 aa, Japanese encephalitis virus
RGPREFCIKV

SEQ ID NO: 229198 - protein, 10 aa, Japanese encephalitis virus
GPREFCIKVL

SEQ ID NO: 229199 - protein, 10 aa, Japanese encephalitis virus
PREFCIKVLC

SEQ ID NO: 229200 - protein, 10 aa, Japanese encephalitis virus
REFCIKVLCP

SEQ ID NO: 229201 - protein, 10 aa, Japanese encephalitis virus
EFCIKVLCPY

SEQ ID NO: 229202 - protein, 10 aa, Japanese encephalitis virus
FCIKVLCPYM

SEQ ID NO: 229203 - protein, 10 aa, Japanese encephalitis virus
CIKVLCPYMP

SEQ ID NO: 229204 - protein, 10 aa, Japanese encephalitis virus
IKVLCPYMPK

SEQ ID NO: 229205 - protein, 10 aa, Japanese encephalitis virus
KVLCPYMPKV

SEQ ID NO: 229206 - protein, 10 aa, Japanese encephalitis virus
VLCPYMPKVI

SEQ ID NO: 229207 - protein, 10 aa, Japanese encephalitis virus
LCPYMPKVIE

SEQ ID NO: 229208 - protein, 10 aa, Japanese encephalitis virus
CPYMPKVIEK

SEQ ID NO: 229209 - protein, 10 aa, Japanese encephalitis virus
PYMPKVIEKM

SEQ ID NO: 229210 - protein, 10 aa, Japanese encephalitis virus
YMPKVIEKME

SEQ ID NO: 229211 - protein, 10 aa, Japanese encephalitis virus
MPKVIEKMEV

SEQ ID NO: 229212 - protein, 10 aa, Japanese encephalitis virus
PKVIEKMEVL

SEQ ID NO: 229213 - protein, 10 aa, Japanese encephalitis virus
KVIEKMEVLQ

SEQ ID NO: 229214 - protein, 10 aa, Japanese encephalitis virus
VIEKMEVLQR

SEQ ID NO: 229215 - protein, 10 aa, Japanese encephalitis virus
IEKMEVLQRR

SEQ ID NO: 229216 - protein, 10 aa, Japanese encephalitis virus
EKMEVLQRRF

SEQ ID NO: 229217 - protein, 10 aa, Japanese encephalitis virus
KMEVLQRRFG

SEQ ID NO: 229218 - protein, 10 aa, Japanese encephalitis virus
MEVLQRRFGG

SEQ ID NO: 229219 - protein, 10 aa, Japanese encephalitis virus
EVLQRRFGGG

SEQ ID NO: 229220 - protein, 10 aa, Japanese encephalitis virus
VLQRRFGGGL

SEQ ID NO: 229221 - protein, 10 aa, Japanese encephalitis virus
LQRRFGGGLV

SEQ ID NO: 229222 - protein, 10 aa, Japanese encephalitis virus
QRRFGGGLVR

SEQ ID NO: 229223 - protein, 10 aa, Japanese encephalitis virus
RRFGGGLVRL

SEQ ID NO: 229224 - protein, 10 aa, Japanese encephalitis virus
RFGGGLVRLP

SEQ ID NO: 229225 - protein, 10 aa, Japanese encephalitis virus
FGGGLVRLPL

SEQ ID NO: 229226 - protein, 10 aa, Japanese encephalitis virus
GGGLVRLPLS

SEQ ID NO: 229227 - protein, 10 aa, Japanese encephalitis virus
GGLVRLPLSR

SEQ ID NO: 229228 - protein, 10 aa, Japanese encephalitis virus
GLVRLPLSRN

SEQ ID NO: 229229 - protein, 10 aa, Japanese encephalitis virus
LVRLPLSRNS

SEQ ID NO: 229230 - protein, 10 aa, Japanese encephalitis virus
VRLPLSRNSN

SEQ ID NO: 229231 - protein, 10 aa, Japanese encephalitis virus
RLPLSRNSNH

SEQ ID NO: 229232 - protein, 10 aa, Japanese encephalitis virus
LPLSRNSNHE

SEQ ID NO: 229233 - protein, 10 aa, Japanese encephalitis virus
PLSRNSNHEM

SEQ ID NO: 229234 - protein, 10 aa, Japanese encephalitis virus
LSRNSNHEMY

SEQ ID NO: 229235 - protein, 10 aa, Japanese encephalitis virus
SRNSNHEMYW

SEQ ID NO: 229236 - protein, 10 aa, Japanese encephalitis virus
RNSNHEMYWV

SEQ ID NO: 229237 - protein, 10 aa, Japanese encephalitis virus
NSNHEMYWVS

SEQ ID NO: 229238 - protein, 10 aa, Japanese encephalitis virus
SNHEMYWVSG

SEQ ID NO: 229239 - protein, 10 aa, Japanese encephalitis virus
NHEMYWVSGA

SEQ ID NO: 229240 - protein, 10 aa, Japanese encephalitis virus
HEMYWVSGAA

SEQ ID NO: 229241 - protein, 10 aa, Japanese encephalitis virus
EMYWVSGAAG

SEQ ID NO: 229242 - protein, 10 aa, Japanese encephalitis virus
MYWVSGAAGN

SEQ ID NO: 229243 - protein, 10 aa, Japanese encephalitis virus
YWVSGAAGNV

SEQ ID NO: 229244 - protein, 10 aa, Japanese encephalitis virus
WVSGAAGNVV

SEQ ID NO: 229245 - protein, 10 aa, Japanese encephalitis virus
VSGAAGNVVH

SEQ ID NO: 229246 - protein, 10 aa, Japanese encephalitis virus
SGAAGNVVHA

SEQ ID NO: 229247 - protein, 10 aa, Japanese encephalitis virus
GAAGNVVHAV

SEQ ID NO: 229248 - protein, 10 aa, Japanese encephalitis virus
AAGNVVHAVN

SEQ ID NO: 229249 - protein, 10 aa, Japanese encephalitis virus
AGNVVHAVNM

SEQ ID NO: 229250 - protein, 10 aa, Japanese encephalitis virus
GNVVHAVNMT

SEQ ID NO: 229251 - protein, 10 aa, Japanese encephalitis virus
NVVHAVNMTS

SEQ ID NO: 229252 - protein, 10 aa, Japanese encephalitis virus
VVHAVNMTSQ

SEQ ID NO: 229253 - protein, 10 aa, Japanese encephalitis virus
VHAVNMTSQV

SEQ ID NO: 229254 - protein, 10 aa, Japanese encephalitis virus
HAVNMTSQVL

SEQ ID NO: 229255 - protein, 10 aa, Japanese encephalitis virus
AVNMTSQVLL

SEQ ID NO: 229256 - protein, 10 aa, Japanese encephalitis virus
VNMTSQVLLG

SEQ ID NO: 229257 - protein, 10 aa, Japanese encephalitis virus
NMTSQVLLGR

SEQ ID NO: 229258 - protein, 10 aa, Japanese encephalitis virus
MTSQVLLGRM

SEQ ID NO: 229259 - protein, 10 aa, Japanese encephalitis virus
TSQVLLGRMD

SEQ ID NO: 229260 - protein, 10 aa, Japanese encephalitis virus
SQVLLGRMDR

SEQ ID NO: 229261 - protein, 10 aa, Japanese encephalitis virus
QVLLGRMDRT

SEQ ID NO: 229262 - protein, 10 aa, Japanese encephalitis virus
VLLGRMDRTV

SEQ ID NO: 229263 - protein, 10 aa, Japanese encephalitis virus
LLGRMDRTVW

SEQ ID NO: 229264 - protein, 10 aa, Japanese encephalitis virus
LGRMDRTVWR

SEQ ID NO: 229265 - protein, 10 aa, Japanese encephalitis virus
GRMDRTVWRG

SEQ ID NO: 229266 - protein, 10 aa, Japanese encephalitis virus
RMDRTVWRGP

SEQ ID NO: 229267 - protein, 10 aa, Japanese encephalitis virus
MDRTVWRGPK

SEQ ID NO: 229268 - protein, 10 aa, Japanese encephalitis virus
DRTVWRGPKY

SEQ ID NO: 229269 - protein, 10 aa, Japanese encephalitis virus
RTVWRGPKYE

SEQ ID NO: 229270 - protein, 10 aa, Japanese encephalitis virus
TVWRGPKYEE

SEQ ID NO: 229271 - protein, 10 aa, Japanese encephalitis virus
VWRGPKYEED

SEQ ID NO: 229272 - protein, 10 aa, Japanese encephalitis virus
WRGPKYEEDV

SEQ ID NO: 229273 - protein, 10 aa, Japanese encephalitis virus
RGPKYEEDVN

SEQ ID NO: 229274 - protein, 10 aa, Japanese encephalitis virus
GPKYEEDVNL

SEQ ID NO: 229275 - protein, 10 aa, Japanese encephalitis virus
PKYEEDVNLG

SEQ ID NO: 229276 - protein, 10 aa, Japanese encephalitis virus
KYEEDVNLGS

SEQ ID NO: 229277 - protein, 10 aa, Japanese encephalitis virus
YEEDVNLGSG

SEQ ID NO: 229278 - protein, 10 aa, Japanese encephalitis virus
EEDVNLGSGT

SEQ ID NO: 229279 - protein, 10 aa, Japanese encephalitis virus
EDVNLGSGTR

SEQ ID NO: 229280 - protein, 10 aa, Japanese encephalitis virus
DVNLGSGTRA

SEQ ID NO: 229281 - protein, 10 aa, Japanese encephalitis virus
VNLGSGTRAV

SEQ ID NO: 229282 - protein, 10 aa, Japanese encephalitis virus
NLGSGTRAVG

SEQ ID NO: 229283 - protein, 10 aa, Japanese encephalitis virus
LGSGTRAVGK

SEQ ID NO: 229284 - protein, 10 aa, Japanese encephalitis virus
GSGTRAVGKG

SEQ ID NO: 229285 - protein, 10 aa, Japanese encephalitis virus
SGTRAVGKGE

SEQ ID NO: 229286 - protein, 10 aa, Japanese encephalitis virus
GTRAVGKGEV

SEQ ID NO: 229287 - protein, 10 aa, Japanese encephalitis virus
TRAVGKGEVH

SEQ ID NO: 229288 - protein, 10 aa, Japanese encephalitis virus
RAVGKGEVHS

SEQ ID NO: 229289 - protein, 10 aa, Japanese encephalitis virus
AVGKGEVHSN

SEQ ID NO: 229290 - protein, 10 aa, Japanese encephalitis virus
VGKGEVHSNQ

SEQ ID NO: 229291 - protein, 10 aa, Japanese encephalitis virus
QEKIKKRIQK

SEQ ID NO: 229292 - protein, 10 aa, Japanese encephalitis virus
KIKKRIQKLK

SEQ ID NO: 229293 - protein, 10 aa, Japanese encephalitis virus
IKKRIQKLKE

SEQ ID NO: 229294 - protein, 10 aa, Japanese encephalitis virus
KRIQKLKEEF

SEQ ID NO: 229295 - protein, 10 aa, Japanese encephalitis virus
RIQKLKEEFA

SEQ ID NO: 229296 - protein, 10 aa, Japanese encephalitis virus
IQKLKEEFAT

SEQ ID NO: 229297 - protein, 10 aa, Japanese encephalitis virus
QKLKEEFATT

SEQ ID NO: 229298 - protein, 10 aa, Japanese encephalitis virus
KLKEEFATTW

SEQ ID NO: 229299 - protein, 10 aa, Japanese encephalitis virus
LKEEFATTWH

SEQ ID NO: 229300 - protein, 10 aa, Japanese encephalitis virus
KEEFATTWHK

SEQ ID NO: 229301 - protein, 10 aa, Japanese encephalitis virus
EEFATTWHKD

SEQ ID NO: 229302 - protein, 10 aa, Japanese encephalitis virus
EFATTWHKDP

SEQ ID NO: 229303 - protein, 10 aa, Japanese encephalitis virus
FATTWHKDPE

SEQ ID NO: 229304 - protein, 10 aa, Japanese encephalitis virus
ATTWHKDPEH

SEQ ID NO: 229305 - protein, 10 aa, Japanese encephalitis virus
TTWHKDPEHP

SEQ ID NO: 229306 - protein, 10 aa, Japanese encephalitis virus
TWHKDPEHPY

SEQ ID NO: 229307 - protein, 10 aa, Japanese encephalitis virus
WHKDPEHPYR

SEQ ID NO: 229308 - protein, 10 aa, Japanese encephalitis virus
HKDPEHPYRT

SEQ ID NO: 229309 - protein, 10 aa, Japanese encephalitis virus
KDPEHPYRTW

SEQ ID NO: 229310 - protein, 10 aa, Japanese encephalitis virus
DPEHPYRTWT

SEQ ID NO: 229311 - protein, 10 aa, Japanese encephalitis virus
PEHPYRTWTY

SEQ ID NO: 229312 - protein, 10 aa, Japanese encephalitis virus
EHPYRTWTYH

SEQ ID NO: 229313 - protein, 10 aa, Japanese encephalitis virus
HPYRTWTYHG

SEQ ID NO: 229314 - protein, 10 aa, Japanese encephalitis virus
PYRTWTYHGS

SEQ ID NO: 229315 - protein, 10 aa, Japanese encephalitis virus
YRTWTYHGSY

SEQ ID NO: 229316 - protein, 10 aa, Japanese encephalitis virus
RTWTYHGSYE

SEQ ID NO: 229317 - protein, 10 aa, Japanese encephalitis virus
TWTYHGSYEV

SEQ ID NO: 229318 - protein, 10 aa, Japanese encephalitis virus
WTYHGSYEVK

SEQ ID NO: 229319 - protein, 10 aa, Japanese encephalitis virus
TYHGSYEVKA

SEQ ID NO: 229320 - protein, 10 aa, Japanese encephalitis virus
YHGSYEVKAT

SEQ ID NO: 229321 - protein, 10 aa, Japanese encephalitis virus
HGSYEVKATG

SEQ ID NO: 229322 - protein, 10 aa, Japanese encephalitis virus
GSYEVKATGS

SEQ ID NO: 229323 - protein, 10 aa, Japanese encephalitis virus
SYEVKATGSA

SEQ ID NO: 229324 - protein, 10 aa, Japanese encephalitis virus
YEVKATGSAS

SEQ ID NO: 229325 - protein, 10 aa, Japanese encephalitis virus
EVKATGSASS

SEQ ID NO: 229326 - protein, 10 aa, Japanese encephalitis virus
VKATGSASSL

SEQ ID NO: 229327 - protein, 10 aa, Japanese encephalitis virus
KATGSASSLV

SEQ ID NO: 229328 - protein, 10 aa, Japanese encephalitis virus
ATGSASSLVN

SEQ ID NO: 229329 - protein, 10 aa, Japanese encephalitis virus
TGSASSLVNG

SEQ ID NO: 229330 - protein, 10 aa, Japanese encephalitis virus
GSASSLVNGV

SEQ ID NO: 229331 - protein, 10 aa, Japanese encephalitis virus
SASSLVNGVV

SEQ ID NO: 229332 - protein, 10 aa, Japanese encephalitis virus
ASSLVNGVVK

SEQ ID NO: 229333 - protein, 10 aa, Japanese encephalitis virus
SSLVNGVVKL

SEQ ID NO: 229334 - protein, 10 aa, Japanese encephalitis virus
SLVNGVVKLM

SEQ ID NO: 229335 - protein, 10 aa, Japanese encephalitis virus
LVNGVVKLMS

SEQ ID NO: 229336 - protein, 10 aa, Japanese encephalitis virus
VNGVVKLMSK

SEQ ID NO: 229337 - protein, 10 aa, Japanese encephalitis virus
NGVVKLMSKP

SEQ ID NO: 229338 - protein, 10 aa, Japanese encephalitis virus
GVVKLMSKPW

SEQ ID NO: 229339 - protein, 10 aa, Japanese encephalitis virus
VVKLMSKPWD

SEQ ID NO: 229340 - protein, 10 aa, Japanese encephalitis virus
VKLMSKPWDA

SEQ ID NO: 229341 - protein, 10 aa, Japanese encephalitis virus
KLMSKPWDAI

SEQ ID NO: 229342 - protein, 10 aa, Japanese encephalitis virus
LMSKPWDAIA

SEQ ID NO: 229343 - protein, 10 aa, Japanese encephalitis virus
MSKPWDAIAN

SEQ ID NO: 229344 - protein, 10 aa, Japanese encephalitis virus
SKPWDAIANV

SEQ ID NO: 229345 - protein, 10 aa, Japanese encephalitis virus
KPWDAIANVT

SEQ ID NO: 229346 - protein, 10 aa, Japanese encephalitis virus
PWDAIANVTT

SEQ ID NO: 229347 - protein, 10 aa, Japanese encephalitis virus
WDAIANVTTM

SEQ ID NO: 229348 - protein, 10 aa, Japanese encephalitis virus
DAIANVTTMA

SEQ ID NO: 229349 - protein, 10 aa, Japanese encephalitis virus
AIANVTTMAM

SEQ ID NO: 229350 - protein, 10 aa, Japanese encephalitis virus
IANVTTMAMT

SEQ ID NO: 229351 - protein, 10 aa, Japanese encephalitis virus
ANVTTMAMTD

SEQ ID NO: 229352 - protein, 10 aa, Japanese encephalitis virus
NVTTMAMTDT

SEQ ID NO: 229353 - protein, 10 aa, Japanese encephalitis virus
VTTMAMTDTT

SEQ ID NO: 229354 - protein, 10 aa, Japanese encephalitis virus
TTMAMTDTTP

SEQ ID NO: 229355 - protein, 10 aa, Japanese encephalitis virus
TMAMTDTTPF

SEQ ID NO: 229356 - protein, 10 aa, Japanese encephalitis virus
MAMTDTTPFG

SEQ ID NO: 229357 - protein, 10 aa, Japanese encephalitis virus
AMTDTTPFGQ

SEQ ID NO: 229358 - protein, 10 aa, Japanese encephalitis virus
MTDTTPFGQQ

SEQ ID NO: 229359 - protein, 10 aa, Japanese encephalitis virus
TDTTPFGQQR

SEQ ID NO: 229360 - protein, 10 aa, Japanese encephalitis virus
DTTPFGQQRV

SEQ ID NO: 229361 - protein, 10 aa, Japanese encephalitis virus
TTPFGQQRVF

SEQ ID NO: 229362 - protein, 10 aa, Japanese encephalitis virus
TPFGQQRVFK

SEQ ID NO: 229363 - protein, 10 aa, Japanese encephalitis virus
PFGQQRVFKE

SEQ ID NO: 229364 - protein, 10 aa, Japanese encephalitis virus
FGQQRVFKEK

SEQ ID NO: 229365 - protein, 10 aa, Japanese encephalitis virus
GQQRVFKEKV

SEQ ID NO: 229366 - protein, 10 aa, Japanese encephalitis virus
QQRVFKEKVD

SEQ ID NO: 229367 - protein, 10 aa, Japanese encephalitis virus
QRVFKEKVDT

SEQ ID NO: 229368 - protein, 10 aa, Japanese encephalitis virus
RVFKEKVDTK

SEQ ID NO: 229369 - protein, 10 aa, Japanese encephalitis virus
VFKEKVDTKA

SEQ ID NO: 229370 - protein, 10 aa, Japanese encephalitis virus
FKEKVDTKAP

SEQ ID NO: 229371 - protein, 10 aa, Japanese encephalitis virus
KEKVDTKAPE

SEQ ID NO: 229372 - protein, 10 aa, Japanese encephalitis virus
EKVDTKAPEP

SEQ ID NO: 229373 - protein, 10 aa, Japanese encephalitis virus
KVDTKAPEPP

SEQ ID NO: 229374 - protein, 10 aa, Japanese encephalitis virus
GAKEVLNETT

SEQ ID NO: 229375 - protein, 10 aa, Japanese encephalitis virus
AKEVLNETTN

SEQ ID NO: 229376 - protein, 10 aa, Japanese encephalitis virus
KEVLNETTNW

SEQ ID NO: 229377 - protein, 10 aa, Japanese encephalitis virus
EVLNETTNWL

SEQ ID NO: 229378 - protein, 10 aa, Japanese encephalitis virus
VLNETTNWLW

SEQ ID NO: 229379 - protein, 10 aa, Japanese encephalitis virus
LNETTNWLWA

SEQ ID NO: 229380 - protein, 10 aa, Japanese encephalitis virus
NETTNWLWAH

SEQ ID NO: 229381 - protein, 10 aa, Japanese encephalitis virus
ETTNWLWAHL

SEQ ID NO: 229382 - protein, 10 aa, Japanese encephalitis virus
TTNWLWAHLS

SEQ ID NO: 229383 - protein, 10 aa, Japanese encephalitis virus
TNWLWAHLSR

SEQ ID NO: 229384 - protein, 10 aa, Japanese encephalitis virus
NWLWAHLSRE

SEQ ID NO: 229385 - protein, 10 aa, Japanese encephalitis virus
WLWAHLSREK

SEQ ID NO: 229386 - protein, 10 aa, Japanese encephalitis virus
LWAHLSREKR

SEQ ID NO: 229387 - protein, 10 aa, Japanese encephalitis virus
WAHLSREKRP

SEQ ID NO: 229388 - protein, 10 aa, Japanese encephalitis virus
AHLSREKRPR

SEQ ID NO: 229389 - protein, 10 aa, Japanese encephalitis virus
HLSREKRPRL

SEQ ID NO: 229390 - protein, 10 aa, Japanese encephalitis virus
LSREKRPRLC

SEQ ID NO: 229391 - protein, 10 aa, Japanese encephalitis virus
SREKRPRLCT

SEQ ID NO: 229392 - protein, 10 aa, Japanese encephalitis virus
REKRPRLCTK

SEQ ID NO: 229393 - protein, 10 aa, Japanese encephalitis virus
EKRPRLCTKE

SEQ ID NO: 229394 - protein, 10 aa, Japanese encephalitis virus
KRPRLCTKEE

SEQ ID NO: 229395 - protein, 10 aa, Japanese encephalitis virus
RPRLCTKEEF

SEQ ID NO: 229396 - protein, 10 aa, Japanese encephalitis virus
PRLCTKEEFI

SEQ ID NO: 229397 - protein, 10 aa, Japanese encephalitis virus
RLCTKEEFIK

SEQ ID NO: 229398 - protein, 10 aa, Japanese encephalitis virus
LCTKEEFIKK

SEQ ID NO: 229399 - protein, 10 aa, Japanese encephalitis virus
CTKEEFIKKV

SEQ ID NO: 229400 - protein, 10 aa, Japanese encephalitis virus
TKEEFIKKVN

SEQ ID NO: 229401 - protein, 10 aa, Japanese encephalitis virus
KEEFIKKVNS

SEQ ID NO: 229402 - protein, 10 aa, Japanese encephalitis virus
EEFIKKVNSN

SEQ ID NO: 229403 - protein, 10 aa, Japanese encephalitis virus
EFIKKVNSNA

SEQ ID NO: 229404 - protein, 10 aa, Japanese encephalitis virus
KVNSNAALGA

SEQ ID NO: 229405 - protein, 10 aa, Japanese encephalitis virus
VNSNAALGAV

SEQ ID NO: 229406 - protein, 10 aa, Japanese encephalitis virus
NSNAALGAVF

SEQ ID NO: 229407 - protein, 10 aa, Japanese encephalitis virus
SNAALGAVFA

SEQ ID NO: 229408 - protein, 10 aa, Japanese encephalitis virus
NAALGAVFAE

SEQ ID NO: 229409 - protein, 10 aa, Japanese encephalitis virus
AALGAVFAEQ

SEQ ID NO: 229410 - protein, 10 aa, Japanese encephalitis virus
ALGAVFAEQN

SEQ ID NO: 229411 - protein, 10 aa, Japanese encephalitis virus
LGAVFAEQNQ

SEQ ID NO: 229412 - protein, 10 aa, Japanese encephalitis virus
GAVFAEQNQW

SEQ ID NO: 229413 - protein, 10 aa, Japanese encephalitis virus
AVFAEQNQWS

SEQ ID NO: 229414 - protein, 10 aa, Japanese encephalitis virus
VFAEQNQWST

SEQ ID NO: 229415 - protein, 10 aa, Japanese encephalitis virus
FAEQNQWSTA

SEQ ID NO: 229416 - protein, 10 aa, Japanese encephalitis virus
AEQNQWSTAR

SEQ ID NO: 229417 - protein, 10 aa, Japanese encephalitis virus
EQNQWSTARE

SEQ ID NO: 229418 - protein, 10 aa, Japanese encephalitis virus
QNQWSTAREA

SEQ ID NO: 229419 - protein, 10 aa, Japanese encephalitis virus
NQWSTAREAV

SEQ ID NO: 229420 - protein, 10 aa, Japanese encephalitis virus
QWSTAREAVD

SEQ ID NO: 229421 - protein, 10 aa, Japanese encephalitis virus
WSTAREAVDD

SEQ ID NO: 229422 - protein, 10 aa, Japanese encephalitis virus
STAREAVDDP

SEQ ID NO: 229423 - protein, 10 aa, Japanese encephalitis virus
FWEMVDEERE

SEQ ID NO: 229424 - protein, 10 aa, Japanese encephalitis virus
WEMVDEEREN

SEQ ID NO: 229425 - protein, 10 aa, Japanese encephalitis virus
EMVDEERENH

SEQ ID NO: 229426 - protein, 10 aa, Japanese encephalitis virus
MVDEERENHL

SEQ ID NO: 229427 - protein, 10 aa, Japanese encephalitis virus
VDEERENHLR

SEQ ID NO: 229428 - protein, 10 aa, Japanese encephalitis virus
DEERENHLRG

SEQ ID NO: 229429 - protein, 10 aa, Japanese encephalitis virus
EERENHLRGE

SEQ ID NO: 229430 - protein, 10 aa, Japanese encephalitis virus
ERENHLRGEC

SEQ ID NO: 229431 - protein, 10 aa, Japanese encephalitis virus
RENHLRGECH

SEQ ID NO: 229432 - protein, 10 aa, Japanese encephalitis virus
ENHLRGECHT

SEQ ID NO: 229433 - protein, 10 aa, Japanese encephalitis virus
NHLRGECHTC

SEQ ID NO: 229434 - protein, 10 aa, Japanese encephalitis virus
HLRGECHTCI

SEQ ID NO: 229435 - protein, 10 aa, Japanese encephalitis virus
LRGECHTCIY

SEQ ID NO: 229436 - protein, 10 aa, Japanese encephalitis virus
RGECHTCIYN

SEQ ID NO: 229437 - protein, 10 aa, Japanese encephalitis virus
GECHTCIYNM

SEQ ID NO: 229438 - protein, 10 aa, Japanese encephalitis virus
ECHTCIYNMM

SEQ ID NO: 229439 - protein, 10 aa, Japanese encephalitis virus
CHTCIYNMMG

SEQ ID NO: 229440 - protein, 10 aa, Japanese encephalitis virus
HTCIYNMMGK

SEQ ID NO: 229441 - protein, 10 aa, Japanese encephalitis virus
TCIYNMMGKR

SEQ ID NO: 229442 - protein, 10 aa, Japanese encephalitis virus
CIYNMMGKRE

SEQ ID NO: 229443 - protein, 10 aa, Japanese encephalitis virus
IYNMMGKREK

SEQ ID NO: 229444 - protein, 10 aa, Japanese encephalitis virus
YNMMGKREKK

SEQ ID NO: 229445 - protein, 10 aa, Japanese encephalitis virus
NMMGKREKKP

SEQ ID NO: 229446 - protein, 10 aa, Japanese encephalitis virus
MMGKREKKPG

SEQ ID NO: 229447 - protein, 10 aa, Japanese encephalitis virus
MGKREKKPGE

SEQ ID NO: 229448 - protein, 10 aa, Japanese encephalitis virus
GKREKKPGEF

SEQ ID NO: 229449 - protein, 10 aa, Japanese encephalitis virus
KREKKPGEFG

SEQ ID NO: 229450 - protein, 10 aa, Japanese encephalitis virus
REKKPGEFGK

SEQ ID NO: 229451 - protein, 10 aa, Japanese encephalitis virus
EKKPGEFGKA

SEQ ID NO: 229452 - protein, 10 aa, Japanese encephalitis virus
KKPGEFGKAK

SEQ ID NO: 229453 - protein, 10 aa, Japanese encephalitis virus
KPGEFGKAKG

SEQ ID NO: 229454 - protein, 10 aa, Japanese encephalitis virus
PGEFGKAKGS

SEQ ID NO: 229455 - protein, 10 aa, Japanese encephalitis virus
GEFGKAKGSR

SEQ ID NO: 229456 - protein, 10 aa, Japanese encephalitis virus
EFGKAKGSRA

SEQ ID NO: 229457 - protein, 10 aa, Japanese encephalitis virus
FGKAKGSRAI

SEQ ID NO: 229458 - protein, 10 aa, Japanese encephalitis virus
GKAKGSRAIW

SEQ ID NO: 229459 - protein, 10 aa, Japanese encephalitis virus
KAKGSRAIWF

SEQ ID NO: 229460 - protein, 10 aa, Japanese encephalitis virus
AKGSRAIWFM

SEQ ID NO: 229461 - protein, 10 aa, Japanese encephalitis virus
KGSRAIWFMW

SEQ ID NO: 229462 - protein, 10 aa, Japanese encephalitis virus
GSRAIWFMWL

SEQ ID NO: 229463 - protein, 10 aa, Japanese encephalitis virus
SRAIWFMWLG

SEQ ID NO: 229464 - protein, 10 aa, Japanese encephalitis virus
RAIWFMWLGA

SEQ ID NO: 229465 - protein, 10 aa, Japanese encephalitis virus
AIWFMWLGAR

SEQ ID NO: 229466 - protein, 10 aa, Japanese encephalitis virus
IWFMWLGARY

SEQ ID NO: 229467 - protein, 10 aa, Japanese encephalitis virus
WFMWLGARYL

SEQ ID NO: 229468 - protein, 10 aa, Japanese encephalitis virus
FMWLGARYLE

SEQ ID NO: 229469 - protein, 10 aa, Japanese encephalitis virus
MWLGARYLEF

SEQ ID NO: 229470 - protein, 10 aa, Japanese encephalitis virus
WLGARYLEFE

SEQ ID NO: 229471 - protein, 10 aa, Japanese encephalitis virus
LGARYLEFEA

SEQ ID NO: 229472 - protein, 10 aa, Japanese encephalitis virus
GARYLEFEAL

SEQ ID NO: 229473 - protein, 10 aa, Japanese encephalitis virus
ARYLEFEALG

SEQ ID NO: 229474 - protein, 10 aa, Japanese encephalitis virus
RYLEFEALGF

SEQ ID NO: 229475 - protein, 10 aa, Japanese encephalitis virus
YLEFEALGFL

SEQ ID NO: 229476 - protein, 10 aa, Japanese encephalitis virus
LEFEALGFLN

SEQ ID NO: 229477 - protein, 10 aa, Japanese encephalitis virus
EFEALGFLNE

SEQ ID NO: 229478 - protein, 10 aa, Japanese encephalitis virus
FEALGFLNED

SEQ ID NO: 229479 - protein, 10 aa, Japanese encephalitis virus
EALGFLNEDH

SEQ ID NO: 229480 - protein, 10 aa, Japanese encephalitis virus
ALGFLNEDHW

SEQ ID NO: 229481 - protein, 10 aa, Japanese encephalitis virus
LGFLNEDHWL

SEQ ID NO: 229482 - protein, 10 aa, Japanese encephalitis virus
GFLNEDHWLS

SEQ ID NO: 229483 - protein, 10 aa, Japanese encephalitis virus
FLNEDHWLSR

SEQ ID NO: 229484 - protein, 10 aa, Japanese encephalitis virus
LNEDHWLSRE

SEQ ID NO: 229485 - protein, 10 aa, Japanese encephalitis virus
NEDHWLSREN

SEQ ID NO: 229486 - protein, 10 aa, Japanese encephalitis virus
EDHWLSRENS

SEQ ID NO: 229487 - protein, 10 aa, Japanese encephalitis virus
DHWLSRENSG

SEQ ID NO: 229488 - protein, 10 aa, Japanese encephalitis virus
HWLSRENSGG

SEQ ID NO: 229489 - protein, 10 aa, Japanese encephalitis virus
WLSRENSGGG

SEQ ID NO: 229490 - protein, 10 aa, Japanese encephalitis virus
LSRENSGGGV

SEQ ID NO: 229491 - protein, 10 aa, Japanese encephalitis virus
SRENSGGGVE

SEQ ID NO: 229492 - protein, 10 aa, Japanese encephalitis virus
RENSGGGVEG

SEQ ID NO: 229493 - protein, 10 aa, Japanese encephalitis virus
ENSGGGVEGS

SEQ ID NO: 229494 - protein, 10 aa, Japanese encephalitis virus
NSGGGVEGSG

SEQ ID NO: 229495 - protein, 10 aa, Japanese encephalitis virus
SGGGVEGSGV

SEQ ID NO: 229496 - protein, 10 aa, Japanese encephalitis virus
GGGVEGSGVQ

SEQ ID NO: 229497 - protein, 10 aa, Japanese encephalitis virus
GGVEGSGVQK

SEQ ID NO: 229498 - protein, 10 aa, Japanese encephalitis virus
GVEGSGVQKL

SEQ ID NO: 229499 - protein, 10 aa, Japanese encephalitis virus
VEGSGVQKLG

SEQ ID NO: 229500 - protein, 10 aa, Japanese encephalitis virus
EGSGVQKLGY

SEQ ID NO: 229501 - protein, 10 aa, Japanese encephalitis virus
GSGVQKLGYI

SEQ ID NO: 229502 - protein, 10 aa, Japanese encephalitis virus
GVQKLGYILR

SEQ ID NO: 229503 - protein, 10 aa, Japanese encephalitis virus
VQKLGYILRD

SEQ ID NO: 229504 - protein, 10 aa, Japanese encephalitis virus
QKLGYILRDI

SEQ ID NO: 229505 - protein, 10 aa, Japanese encephalitis virus
KLGYILRDIA

SEQ ID NO: 229506 - protein, 10 aa, Japanese encephalitis virus
RDIAGKQGGK

SEQ ID NO: 229507 - protein, 10 aa, Japanese encephalitis virus
DIAGKQGGKM

SEQ ID NO: 229508 - protein, 10 aa, Japanese encephalitis virus
IAGKQGGKMY

SEQ ID NO: 229509 - protein, 10 aa, Japanese encephalitis virus
AGKQGGKMYA

SEQ ID NO: 229510 - protein, 10 aa, Japanese encephalitis virus
GKQGGKMYAD

SEQ ID NO: 229511 - protein, 10 aa, Japanese encephalitis virus
KQGGKMYADD

SEQ ID NO: 229512 - protein, 10 aa, Japanese encephalitis virus
QGGKMYADDT

SEQ ID NO: 229513 - protein, 10 aa, Japanese encephalitis virus
GGKMYADDTA

SEQ ID NO: 229514 - protein, 10 aa, Japanese encephalitis virus
GKMYADDTAG

SEQ ID NO: 229515 - protein, 10 aa, Japanese encephalitis virus
KMYADDTAGW

SEQ ID NO: 229516 - protein, 10 aa, Japanese encephalitis virus
MYADDTAGWD

SEQ ID NO: 229517 - protein, 10 aa, Japanese encephalitis virus
YADDTAGWDT

SEQ ID NO: 229518 - protein, 10 aa, Japanese encephalitis virus
ADDTAGWDTR

SEQ ID NO: 229519 - protein, 10 aa, Japanese encephalitis virus
DDTAGWDTRI

SEQ ID NO: 229520 - protein, 10 aa, Japanese encephalitis virus
DTAGWDTRIT

SEQ ID NO: 229521 - protein, 10 aa, Japanese encephalitis virus
TAGWDTRITR

SEQ ID NO: 229522 - protein, 10 aa, Japanese encephalitis virus
AGWDTRITRT

SEQ ID NO: 229523 - protein, 10 aa, Japanese encephalitis virus
GWDTRITRTD

SEQ ID NO: 229524 - protein, 10 aa, Japanese encephalitis virus
WDTRITRTDL

SEQ ID NO: 229525 - protein, 10 aa, Japanese encephalitis virus
DTRITRTDLE

SEQ ID NO: 229526 - protein, 10 aa, Japanese encephalitis virus
TRITRTDLEN

SEQ ID NO: 229527 - protein, 10 aa, Japanese encephalitis virus
RITRTDLENE

SEQ ID NO: 229528 - protein, 10 aa, Japanese encephalitis virus
ITRTDLENEA

SEQ ID NO: 229529 - protein, 10 aa, Japanese encephalitis virus
TRTDLENEAK

SEQ ID NO: 229530 - protein, 10 aa, Japanese encephalitis virus
RTDLENEAKV

SEQ ID NO: 229531 - protein, 10 aa, Japanese encephalitis virus
TDLENEAKVL

SEQ ID NO: 229532 - protein, 10 aa, Japanese encephalitis virus
DLENEAKVLE

SEQ ID NO: 229533 - protein, 10 aa, Japanese encephalitis virus
LENEAKVLEL

SEQ ID NO: 229534 - protein, 10 aa, Japanese encephalitis virus
ENEAKVLELL

SEQ ID NO: 229535 - protein, 10 aa, Japanese encephalitis virus
NEAKVLELLD

SEQ ID NO: 229536 - protein, 10 aa, Japanese encephalitis virus
EAKVLELLDG

SEQ ID NO: 229537 - protein, 10 aa, Japanese encephalitis virus
AKVLELLDGE

SEQ ID NO: 229538 - protein, 10 aa, Japanese encephalitis virus
KVLELLDGEH

SEQ ID NO: 229539 - protein, 10 aa, Japanese encephalitis virus
VLELLDGEHR

SEQ ID NO: 229540 - protein, 10 aa, Japanese encephalitis virus
LELLDGEHRM

SEQ ID NO: 229541 - protein, 10 aa, Japanese encephalitis virus
ELLDGEHRML

SEQ ID NO: 229542 - protein, 10 aa, Japanese encephalitis virus
LLDGEHRMLA

SEQ ID NO: 229543 - protein, 10 aa, Japanese encephalitis virus
LDGEHRMLAR

SEQ ID NO: 229544 - protein, 10 aa, Japanese encephalitis virus
DGEHRMLARA

SEQ ID NO: 229545 - protein, 10 aa, Japanese encephalitis virus
GEHRMLARAI

SEQ ID NO: 229546 - protein, 10 aa, Japanese encephalitis virus
EHRMLARAII

SEQ ID NO: 229547 - protein, 10 aa, Japanese encephalitis virus
HRMLARAIIE

SEQ ID NO: 229548 - protein, 10 aa, Japanese encephalitis virus
RMLARAIIEL

SEQ ID NO: 229549 - protein, 10 aa, Japanese encephalitis virus
MLARAIIELT

SEQ ID NO: 229550 - protein, 10 aa, Japanese encephalitis virus
LARAIIELTY

SEQ ID NO: 229551 - protein, 10 aa, Japanese encephalitis virus
ARAIIELTYR

SEQ ID NO: 229552 - protein, 10 aa, Japanese encephalitis virus
RAIIELTYRH

SEQ ID NO: 229553 - protein, 10 aa, Japanese encephalitis virus
AIIELTYRHK

SEQ ID NO: 229554 - protein, 10 aa, Japanese encephalitis virus
IIELTYRHKV

SEQ ID NO: 229555 - protein, 10 aa, Japanese encephalitis virus
IELTYRHKVV

SEQ ID NO: 229556 - protein, 10 aa, Japanese encephalitis virus
ELTYRHKVVK

SEQ ID NO: 229557 - protein, 10 aa, Japanese encephalitis virus
LTYRHKVVKV

SEQ ID NO: 229558 - protein, 10 aa, Japanese encephalitis virus
TYRHKVVKVM

SEQ ID NO: 229559 - protein, 10 aa, Japanese encephalitis virus
YRHKVVKVMR

SEQ ID NO: 229560 - protein, 10 aa, Japanese encephalitis virus
RHKVVKVMRP

SEQ ID NO: 229561 - protein, 10 aa, Japanese encephalitis virus
HKVVKVMRPA

SEQ ID NO: 229562 - protein, 10 aa, Japanese encephalitis virus
KVVKVMRPAA

SEQ ID NO: 229563 - protein, 10 aa, Japanese encephalitis virus
KVMRPAAEGK

SEQ ID NO: 229564 - protein, 10 aa, Japanese encephalitis virus
VMRPAAEGKT

SEQ ID NO: 229565 - protein, 10 aa, Japanese encephalitis virus
MRPAAEGKTV

SEQ ID NO: 229566 - protein, 10 aa, Japanese encephalitis virus
RPAAEGKTVM

SEQ ID NO: 229567 - protein, 10 aa, Japanese encephalitis virus
EGKTVMDVIS

SEQ ID NO: 229568 - protein, 10 aa, Japanese encephalitis virus
GKTVMDVISR

SEQ ID NO: 229569 - protein, 10 aa, Japanese encephalitis virus
KTVMDVISRE

SEQ ID NO: 229570 - protein, 10 aa, Japanese encephalitis virus
TVMDVISRED

SEQ ID NO: 229571 - protein, 10 aa, Japanese encephalitis virus
VMDVISREDQ

SEQ ID NO: 229572 - protein, 10 aa, Japanese encephalitis virus
MDVISREDQR

SEQ ID NO: 229573 - protein, 10 aa, Japanese encephalitis virus
DVISREDQRG

SEQ ID NO: 229574 - protein, 10 aa, Japanese encephalitis virus
VISREDQRGS

SEQ ID NO: 229575 - protein, 10 aa, Japanese encephalitis virus
ISREDQRGSG

SEQ ID NO: 229576 - protein, 10 aa, Japanese encephalitis virus
SREDQRGSGQ

SEQ ID NO: 229577 - protein, 10 aa, Japanese encephalitis virus
REDQRGSGQV

SEQ ID NO: 229578 - protein, 10 aa, Japanese encephalitis virus
EDQRGSGQVV

SEQ ID NO: 229579 - protein, 10 aa, Japanese encephalitis virus
DQRGSGQVVT

SEQ ID NO: 229580 - protein, 10 aa, Japanese encephalitis virus
QRGSGQVVTY

SEQ ID NO: 229581 - protein, 10 aa, Japanese encephalitis virus
RGSGQVVTYA

SEQ ID NO: 229582 - protein, 10 aa, Japanese encephalitis virus
GSGQVVTYAL

SEQ ID NO: 229583 - protein, 10 aa, Japanese encephalitis virus
SGQVVTYALN

SEQ ID NO: 229584 - protein, 10 aa, Japanese encephalitis virus
GQVVTYALNT

SEQ ID NO: 229585 - protein, 10 aa, Japanese encephalitis virus
QVVTYALNTF

SEQ ID NO: 229586 - protein, 10 aa, Japanese encephalitis virus
VVTYALNTFT

SEQ ID NO: 229587 - protein, 10 aa, Japanese encephalitis virus
VTYALNTFTN

SEQ ID NO: 229588 - protein, 10 aa, Japanese encephalitis virus
TYALNTFTNI

SEQ ID NO: 229589 - protein, 10 aa, Japanese encephalitis virus
YALNTFTNIA

SEQ ID NO: 229590 - protein, 10 aa, Japanese encephalitis virus
ALNTFTNIAV

SEQ ID NO: 229591 - protein, 10 aa, Japanese encephalitis virus
LNTFTNIAVQ

SEQ ID NO: 229592 - protein, 10 aa, Japanese encephalitis virus
NTFTNIAVQL

SEQ ID NO: 229593 - protein, 10 aa, Japanese encephalitis virus
TFTNIAVQLV

SEQ ID NO: 229594 - protein, 10 aa, Japanese encephalitis virus
FTNIAVQLVR

SEQ ID NO: 229595 - protein, 10 aa, Japanese encephalitis virus
TNIAVQLVRL

SEQ ID NO: 229596 - protein, 10 aa, Japanese encephalitis virus
NIAVQLVRLM

SEQ ID NO: 229597 - protein, 10 aa, Japanese encephalitis virus
IAVQLVRLME

SEQ ID NO: 229598 - protein, 10 aa, Japanese encephalitis virus
AVQLVRLMEA

SEQ ID NO: 229599 - protein, 10 aa, Japanese encephalitis virus
VQLVRLMEAE

SEQ ID NO: 229600 - protein, 10 aa, Japanese encephalitis virus
QLVRLMEAEG

SEQ ID NO: 229601 - protein, 10 aa, Japanese encephalitis virus
LVRLMEAEGV

SEQ ID NO: 229602 - protein, 10 aa, Japanese encephalitis virus
VRLMEAEGVI

SEQ ID NO: 229603 - protein, 10 aa, Japanese encephalitis virus
RLMEAEGVIG

SEQ ID NO: 229604 - protein, 10 aa, Japanese encephalitis virus
LMEAEGVIGP

SEQ ID NO: 229605 - protein, 10 aa, Japanese encephalitis virus
MEAEGVIGPQ

SEQ ID NO: 229606 - protein, 10 aa, Japanese encephalitis virus
EAEGVIGPQH

SEQ ID NO: 229607 - protein, 10 aa, Japanese encephalitis virus
AEGVIGPQHL

SEQ ID NO: 229608 - protein, 10 aa, Japanese encephalitis virus
EGVIGPQHLE

SEQ ID NO: 229609 - protein, 10 aa, Japanese encephalitis virus
GVIGPQHLEQ

SEQ ID NO: 229610 - protein, 10 aa, Japanese encephalitis virus
VIGPQHLEQL

SEQ ID NO: 229611 - protein, 10 aa, Japanese encephalitis virus
IGPQHLEQLP

SEQ ID NO: 229612 - protein, 10 aa, Japanese encephalitis virus
GPQHLEQLPR

SEQ ID NO: 229613 - protein, 10 aa, Japanese encephalitis virus
PQHLEQLPRK

SEQ ID NO: 229614 - protein, 10 aa, Japanese encephalitis virus
EQLPRKNKIA

SEQ ID NO: 229615 - protein, 10 aa, Japanese encephalitis virus
QLPRKNKIAV

SEQ ID NO: 229616 - protein, 10 aa, Japanese encephalitis virus
LPRKNKIAVR

SEQ ID NO: 229617 - protein, 10 aa, Japanese encephalitis virus
PRKNKIAVRT

SEQ ID NO: 229618 - protein, 10 aa, Japanese encephalitis virus
RKNKIAVRTW

SEQ ID NO: 229619 - protein, 10 aa, Japanese encephalitis virus
KNKIAVRTWL

SEQ ID NO: 229620 - protein, 10 aa, Japanese encephalitis virus
NKIAVRTWLF

SEQ ID NO: 229621 - protein, 10 aa, Japanese encephalitis virus
KIAVRTWLFE

SEQ ID NO: 229622 - protein, 10 aa, Japanese encephalitis virus
IAVRTWLFEN

SEQ ID NO: 229623 - protein, 10 aa, Japanese encephalitis virus
AVRTWLFENG

SEQ ID NO: 229624 - protein, 10 aa, Japanese encephalitis virus
VRTWLFENGE

SEQ ID NO: 229625 - protein, 10 aa, Japanese encephalitis virus
RTWLFENGEE

SEQ ID NO: 229626 - protein, 10 aa, Japanese encephalitis virus
TWLFENGEER

SEQ ID NO: 229627 - protein, 10 aa, Japanese encephalitis virus
WLFENGEERV

SEQ ID NO: 229628 - protein, 10 aa, Japanese encephalitis virus
LFENGEERVT

SEQ ID NO: 229629 - protein, 10 aa, Japanese encephalitis virus
FENGEERVTR

SEQ ID NO: 229630 - protein, 10 aa, Japanese encephalitis virus
ENGEERVTRM

SEQ ID NO: 229631 - protein, 10 aa, Japanese encephalitis virus
NGEERVTRMA

SEQ ID NO: 229632 - protein, 10 aa, Japanese encephalitis virus
GEERVTRMAI

SEQ ID NO: 229633 - protein, 10 aa, Japanese encephalitis virus
EERVTRMAIS

SEQ ID NO: 229634 - protein, 10 aa, Japanese encephalitis virus
ERVTRMAISG

SEQ ID NO: 229635 - protein, 10 aa, Japanese encephalitis virus
RVTRMAISGD

SEQ ID NO: 229636 - protein, 10 aa, Japanese encephalitis virus
VTRMAISGDD

SEQ ID NO: 229637 - protein, 10 aa, Japanese encephalitis virus
TRMAISGDDC

SEQ ID NO: 229638 - protein, 10 aa, Japanese encephalitis virus
RMAISGDDCV

SEQ ID NO: 229639 - protein, 10 aa, Japanese encephalitis virus
MAISGDDCVV

SEQ ID NO: 229640 - protein, 10 aa, Japanese encephalitis virus
AISGDDCVVK

SEQ ID NO: 229641 - protein, 10 aa, Japanese encephalitis virus
ISGDDCVVKP

SEQ ID NO: 229642 - protein, 10 aa, Japanese encephalitis virus
SGDDCVVKPL

SEQ ID NO: 229643 - protein, 10 aa, Japanese encephalitis virus
GDDCVVKPLD

SEQ ID NO: 229644 - protein, 10 aa, Japanese encephalitis virus
DDCVVKPLDD

SEQ ID NO: 229645 - protein, 10 aa, Japanese encephalitis virus
DCVVKPLDDR

SEQ ID NO: 229646 - protein, 10 aa, Japanese encephalitis virus
CVVKPLDDRF

SEQ ID NO: 229647 - protein, 10 aa, Japanese encephalitis virus
VVKPLDDRFA

SEQ ID NO: 229648 - protein, 10 aa, Japanese encephalitis virus
VKPLDDRFAT

SEQ ID NO: 229649 - protein, 10 aa, Japanese encephalitis virus
KPLDDRFATA

SEQ ID NO: 229650 - protein, 10 aa, Japanese encephalitis virus
PLDDRFATAL

SEQ ID NO: 229651 - protein, 10 aa, Japanese encephalitis virus
LDDRFATALH

SEQ ID NO: 229652 - protein, 10 aa, Japanese encephalitis virus
DDRFATALHF

SEQ ID NO: 229653 - protein, 10 aa, Japanese encephalitis virus
DRFATALHFL

SEQ ID NO: 229654 - protein, 10 aa, Japanese encephalitis virus
RFATALHFLN

SEQ ID NO: 229655 - protein, 10 aa, Japanese encephalitis virus
FATALHFLNA

SEQ ID NO: 229656 - protein, 10 aa, Japanese encephalitis virus
ATALHFLNAM

SEQ ID NO: 229657 - protein, 10 aa, Japanese encephalitis virus
TALHFLNAMS

SEQ ID NO: 229658 - protein, 10 aa, Japanese encephalitis virus
ALHFLNAMSK

SEQ ID NO: 229659 - protein, 10 aa, Japanese encephalitis virus
LHFLNAMSKV

SEQ ID NO: 229660 - protein, 10 aa, Japanese encephalitis virus
HFLNAMSKVR

SEQ ID NO: 229661 - protein, 10 aa, Japanese encephalitis virus
FLNAMSKVRK

SEQ ID NO: 229662 - protein, 10 aa, Japanese encephalitis virus
LNAMSKVRKD

SEQ ID NO: 229663 - protein, 10 aa, Japanese encephalitis virus
NAMSKVRKDI

SEQ ID NO: 229664 - protein, 10 aa, Japanese encephalitis virus
AMSKVRKDIQ

SEQ ID NO: 229665 - protein, 10 aa, Japanese encephalitis virus
MSKVRKDIQE

SEQ ID NO: 229666 - protein, 10 aa, Japanese encephalitis virus
SKVRKDIQEW

SEQ ID NO: 229667 - protein, 10 aa, Japanese encephalitis virus
KVRKDIQEWK

SEQ ID NO: 229668 - protein, 10 aa, Japanese encephalitis virus
VRKDIQEWKP

SEQ ID NO: 229669 - protein, 10 aa, Japanese encephalitis virus
RKDIQEWKPS

SEQ ID NO: 229670 - protein, 10 aa, Japanese encephalitis virus
KDIQEWKPSH

SEQ ID NO: 229671 - protein, 10 aa, Japanese encephalitis virus
DIQEWKPSHG

SEQ ID NO: 229672 - protein, 10 aa, Japanese encephalitis virus
IQEWKPSHGW

SEQ ID NO: 229673 - protein, 10 aa, Japanese encephalitis virus
QEWKPSHGWH

SEQ ID NO: 229674 - protein, 10 aa, Japanese encephalitis virus
EWKPSHGWHD

SEQ ID NO: 229675 - protein, 10 aa, Japanese encephalitis virus
WKPSHGWHDW

SEQ ID NO: 229676 - protein, 10 aa, Japanese encephalitis virus
KPSHGWHDWQ

SEQ ID NO: 229677 - protein, 10 aa, Japanese encephalitis virus
PSHGWHDWQQ

SEQ ID NO: 229678 - protein, 10 aa, Japanese encephalitis virus
SHGWHDWQQV

SEQ ID NO: 229679 - protein, 10 aa, Japanese encephalitis virus
HGWHDWQQVP

SEQ ID NO: 229680 - protein, 10 aa, Japanese encephalitis virus
GWHDWQQVPF

SEQ ID NO: 229681 - protein, 10 aa, Japanese encephalitis virus
WHDWQQVPFC

SEQ ID NO: 229682 - protein, 10 aa, Japanese encephalitis virus
HDWQQVPFCS

SEQ ID NO: 229683 - protein, 10 aa, Japanese encephalitis virus
DWQQVPFCSN

SEQ ID NO: 229684 - protein, 10 aa, Japanese encephalitis virus
WQQVPFCSNH

SEQ ID NO: 229685 - protein, 10 aa, Japanese encephalitis virus
QQVPFCSNHF

SEQ ID NO: 229686 - protein, 10 aa, Japanese encephalitis virus
QVPFCSNHFQ

SEQ ID NO: 229687 - protein, 10 aa, Japanese encephalitis virus
VPFCSNHFQE

SEQ ID NO: 229688 - protein, 10 aa, Japanese encephalitis virus
PFCSNHFQEI

SEQ ID NO: 229689 - protein, 10 aa, Japanese encephalitis virus
FCSNHFQEIV

SEQ ID NO: 229690 - protein, 10 aa, Japanese encephalitis virus
CSNHFQEIVM

SEQ ID NO: 229691 - protein, 10 aa, Japanese encephalitis virus
SNHFQEIVMK

SEQ ID NO: 229692 - protein, 10 aa, Japanese encephalitis virus
NHFQEIVMKD

SEQ ID NO: 229693 - protein, 10 aa, Japanese encephalitis virus
HFQEIVMKDG

SEQ ID NO: 229694 - protein, 10 aa, Japanese encephalitis virus
FQEIVMKDGR

SEQ ID NO: 229695 - protein, 10 aa, Japanese encephalitis virus
QEIVMKDGRS

SEQ ID NO: 229696 - protein, 10 aa, Japanese encephalitis virus
EIVMKDGRSI

SEQ ID NO: 229697 - protein, 10 aa, Japanese encephalitis virus
IVMKDGRSIV

SEQ ID NO: 229698 - protein, 10 aa, Japanese encephalitis virus
VMKDGRSIVV

SEQ ID NO: 229699 - protein, 10 aa, Japanese encephalitis virus
MKDGRSIVVP

SEQ ID NO: 229700 - protein, 10 aa, Japanese encephalitis virus
KDGRSIVVPC

SEQ ID NO: 229701 - protein, 10 aa, Japanese encephalitis virus
DGRSIVVPCR

SEQ ID NO: 229702 - protein, 10 aa, Japanese encephalitis virus
GRSIVVPCRG

SEQ ID NO: 229703 - protein, 10 aa, Japanese encephalitis virus
RSIVVPCRGQ

SEQ ID NO: 229704 - protein, 10 aa, Japanese encephalitis virus
SIVVPCRGQD

SEQ ID NO: 229705 - protein, 10 aa, Japanese encephalitis virus
IVVPCRGQDE

SEQ ID NO: 229706 - protein, 10 aa, Japanese encephalitis virus
VVPCRGQDEL

SEQ ID NO: 229707 - protein, 10 aa, Japanese encephalitis virus
VPCRGQDELI

SEQ ID NO: 229708 - protein, 10 aa, Japanese encephalitis virus
PCRGQDELIG

SEQ ID NO: 229709 - protein, 10 aa, Japanese encephalitis virus
CRGQDELIGR

SEQ ID NO: 229710 - protein, 10 aa, Japanese encephalitis virus
RGQDELIGRA

SEQ ID NO: 229711 - protein, 10 aa, Japanese encephalitis virus
GQDELIGRAR

SEQ ID NO: 229712 - protein, 10 aa, Japanese encephalitis virus
QDELIGRARI

SEQ ID NO: 229713 - protein, 10 aa, Japanese encephalitis virus
DELIGRARIS

SEQ ID NO: 229714 - protein, 10 aa, Japanese encephalitis virus
ELIGRARISP

SEQ ID NO: 229715 - protein, 10 aa, Japanese encephalitis virus
LIGRARISPG

SEQ ID NO: 229716 - protein, 10 aa, Japanese encephalitis virus
IGRARISPGA

SEQ ID NO: 229717 - protein, 10 aa, Japanese encephalitis virus
GRARISPGAG

SEQ ID NO: 229718 - protein, 10 aa, Japanese encephalitis virus
RARISPGAGW

SEQ ID NO: 229719 - protein, 10 aa, Japanese encephalitis virus
ARISPGAGWN

SEQ ID NO: 229720 - protein, 10 aa, Japanese encephalitis virus
RISPGAGWNV

SEQ ID NO: 229721 - protein, 10 aa, Japanese encephalitis virus
ISPGAGWNVK

SEQ ID NO: 229722 - protein, 10 aa, Japanese encephalitis virus
SPGAGWNVKD

SEQ ID NO: 229723 - protein, 10 aa, Japanese encephalitis virus
PGAGWNVKDT

SEQ ID NO: 229724 - protein, 10 aa, Japanese encephalitis virus
GAGWNVKDTA

SEQ ID NO: 229725 - protein, 10 aa, Japanese encephalitis virus
AGWNVKDTAC

SEQ ID NO: 229726 - protein, 10 aa, Japanese encephalitis virus
GWNVKDTACL

SEQ ID NO: 229727 - protein, 10 aa, Japanese encephalitis virus
WNVKDTACLA

SEQ ID NO: 229728 - protein, 10 aa, Japanese encephalitis virus
NVKDTACLAK

SEQ ID NO: 229729 - protein, 10 aa, Japanese encephalitis virus
VKDTACLAKA

SEQ ID NO: 229730 - protein, 10 aa, Japanese encephalitis virus
KDTACLAKAY

SEQ ID NO: 229731 - protein, 10 aa, Japanese encephalitis virus
DTACLAKAYA

SEQ ID NO: 229732 - protein, 10 aa, Japanese encephalitis virus
TACLAKAYAQ

SEQ ID NO: 229733 - protein, 10 aa, Japanese encephalitis virus
ACLAKAYAQM

SEQ ID NO: 229734 - protein, 10 aa, Japanese encephalitis virus
CLAKAYAQMW

SEQ ID NO: 229735 - protein, 10 aa, Japanese encephalitis virus
LAKAYAQMWL

SEQ ID NO: 229736 - protein, 10 aa, Japanese encephalitis virus
AKAYAQMWLL

SEQ ID NO: 229737 - protein, 10 aa, Japanese encephalitis virus
KAYAQMWLLL

SEQ ID NO: 229738 - protein, 10 aa, Japanese encephalitis virus
AYAQMWLLLY

SEQ ID NO: 229739 - protein, 10 aa, Japanese encephalitis virus
YAQMWLLLYF

SEQ ID NO: 229740 - protein, 10 aa, Japanese encephalitis virus
AQMWLLLYFH

SEQ ID NO: 229741 - protein, 10 aa, Japanese encephalitis virus
QMWLLLYFHR

SEQ ID NO: 229742 - protein, 10 aa, Japanese encephalitis virus
MWLLLYFHRR

SEQ ID NO: 229743 - protein, 10 aa, Japanese encephalitis virus
WLLLYFHRRD

SEQ ID NO: 229744 - protein, 10 aa, Japanese encephalitis virus
LLLYFHRRDL

SEQ ID NO: 229745 - protein, 10 aa, Japanese encephalitis virus
LLYFHRRDLR

SEQ ID NO: 229746 - protein, 10 aa, Japanese encephalitis virus
LYFHRRDLRL

SEQ ID NO: 229747 - protein, 10 aa, Japanese encephalitis virus
YFHRRDLRLM

SEQ ID NO: 229748 - protein, 10 aa, Japanese encephalitis virus
FHRRDLRLMA

SEQ ID NO: 229749 - protein, 10 aa, Japanese encephalitis virus
HRRDLRLMAN

SEQ ID NO: 229750 - protein, 10 aa, Japanese encephalitis virus
RRDLRLMANA

SEQ ID NO: 229751 - protein, 10 aa, Japanese encephalitis virus
RDLRLMANAI

SEQ ID NO: 229752 - protein, 10 aa, Japanese encephalitis virus
DLRLMANAIC

SEQ ID NO: 229753 - protein, 10 aa, Japanese encephalitis virus
LRLMANAICS

SEQ ID NO: 229754 - protein, 10 aa, Japanese encephalitis virus
RLMANAICSA

SEQ ID NO: 229755 - protein, 10 aa, Japanese encephalitis virus
LMANAICSAV

SEQ ID NO: 229756 - protein, 10 aa, Japanese encephalitis virus
MANAICSAVP

SEQ ID NO: 229757 - protein, 10 aa, Japanese encephalitis virus
ANAICSAVPV

SEQ ID NO: 229758 - protein, 10 aa, Japanese encephalitis virus
NAICSAVPVD

SEQ ID NO: 229759 - protein, 10 aa, Japanese encephalitis virus
AICSAVPVDW

SEQ ID NO: 229760 - protein, 10 aa, Japanese encephalitis virus
ICSAVPVDWV

SEQ ID NO: 229761 - protein, 10 aa, Japanese encephalitis virus
CSAVPVDWVP

SEQ ID NO: 229762 - protein, 10 aa, Japanese encephalitis virus
SAVPVDWVPT

SEQ ID NO: 229763 - protein, 10 aa, Japanese encephalitis virus
AVPVDWVPTG

SEQ ID NO: 229764 - protein, 10 aa, Japanese encephalitis virus
VPVDWVPTGR

SEQ ID NO: 229765 - protein, 10 aa, Japanese encephalitis virus
PVDWVPTGRT

SEQ ID NO: 229766 - protein, 10 aa, Japanese encephalitis virus
VDWVPTGRTS

SEQ ID NO: 229767 - protein, 10 aa, Japanese encephalitis virus
DWVPTGRTSW

SEQ ID NO: 229768 - protein, 10 aa, Japanese encephalitis virus
WVPTGRTSWS

SEQ ID NO: 229769 - protein, 10 aa, Japanese encephalitis virus
VPTGRTSWSI

SEQ ID NO: 229770 - protein, 10 aa, Japanese encephalitis virus
PTGRTSWSIH

SEQ ID NO: 229771 - protein, 10 aa, Japanese encephalitis virus
TGRTSWSIHS

SEQ ID NO: 229772 - protein, 10 aa, Japanese encephalitis virus
GRTSWSIHSK

SEQ ID NO: 229773 - protein, 10 aa, Japanese encephalitis virus
RTSWSIHSKG

SEQ ID NO: 229774 - protein, 10 aa, Japanese encephalitis virus
TSWSIHSKGE

SEQ ID NO: 229775 - protein, 10 aa, Japanese encephalitis virus
SWSIHSKGEW

SEQ ID NO: 229776 - protein, 10 aa, Japanese encephalitis virus
WSIHSKGEWM

SEQ ID NO: 229777 - protein, 10 aa, Japanese encephalitis virus
SIHSKGEWMT

SEQ ID NO: 229778 - protein, 10 aa, Japanese encephalitis virus
IHSKGEWMTT

SEQ ID NO: 229779 - protein, 10 aa, Japanese encephalitis virus
HSKGEWMTTE

SEQ ID NO: 229780 - protein, 10 aa, Japanese encephalitis virus
SKGEWMTTED

SEQ ID NO: 229781 - protein, 10 aa, Japanese encephalitis virus
KGEWMTTEDM

SEQ ID NO: 229782 - protein, 10 aa, Japanese encephalitis virus
GEWMTTEDML

SEQ ID NO: 229783 - protein, 10 aa, Japanese encephalitis virus
EWMTTEDMLQ

SEQ ID NO: 229784 - protein, 10 aa, Japanese encephalitis virus
WMTTEDMLQV

SEQ ID NO: 229785 - protein, 10 aa, Japanese encephalitis virus
MTTEDMLQVW

SEQ ID NO: 229786 - protein, 10 aa, Japanese encephalitis virus
TTEDMLQVWN

SEQ ID NO: 229787 - protein, 10 aa, Japanese encephalitis virus
TEDMLQVWNR

SEQ ID NO: 229788 - protein, 10 aa, Japanese encephalitis virus
EDMLQVWNRV

SEQ ID NO: 229789 - protein, 10 aa, Japanese encephalitis virus
DMLQVWNRVW

SEQ ID NO: 229790 - protein, 10 aa, Japanese encephalitis virus
MLQVWNRVWI

SEQ ID NO: 229791 - protein, 10 aa, Japanese encephalitis virus
LQVWNRVWIE

SEQ ID NO: 229792 - protein, 10 aa, Japanese encephalitis virus
QVWNRVWIEE

SEQ ID NO: 229793 - protein, 10 aa, Japanese encephalitis virus
VWNRVWIEEN

SEQ ID NO: 229794 - protein, 10 aa, Japanese encephalitis virus
WNRVWIEENE

SEQ ID NO: 229795 - protein, 10 aa, Japanese encephalitis virus
NRVWIEENEW

SEQ ID NO: 229796 - protein, 10 aa, Japanese encephalitis virus
RVWIEENEWM

SEQ ID NO: 229797 - protein, 10 aa, Japanese encephalitis virus
VWIEENEWMM

SEQ ID NO: 229798 - protein, 10 aa, Japanese encephalitis virus
WIEENEWMMD

SEQ ID NO: 229799 - protein, 10 aa, Japanese encephalitis virus
IEENEWMMDK

SEQ ID NO: 229800 - protein, 10 aa, Japanese encephalitis virus
EENEWMMDKT

SEQ ID NO: 229801 - protein, 10 aa, Japanese encephalitis virus
ENEWMMDKTP

SEQ ID NO: 229802 - protein, 10 aa, Japanese encephalitis virus
DKTPITSWTD

SEQ ID NO: 229803 - protein, 10 aa, Japanese encephalitis virus
KTPITSWTDV

SEQ ID NO: 229804 - protein, 10 aa, Japanese encephalitis virus
TPITSWTDVP

SEQ ID NO: 229805 - protein, 10 aa, Japanese encephalitis virus
PITSWTDVPY

SEQ ID NO: 229806 - protein, 10 aa, Japanese encephalitis virus
ITSWTDVPYV

SEQ ID NO: 229807 - protein, 10 aa, Japanese encephalitis virus
TSWTDVPYVG

SEQ ID NO: 229808 - protein, 10 aa, Japanese encephalitis virus
SWTDVPYVGK

SEQ ID NO: 229809 - protein, 10 aa, Japanese encephalitis virus
WTDVPYVGKR

SEQ ID NO: 229810 - protein, 10 aa, Japanese encephalitis virus
TDVPYVGKRE

SEQ ID NO: 229811 - protein, 10 aa, Japanese encephalitis virus
DVPYVGKRED

SEQ ID NO: 229812 - protein, 10 aa, Japanese encephalitis virus
VPYVGKREDI

SEQ ID NO: 229813 - protein, 10 aa, Japanese encephalitis virus
PYVGKREDIW

SEQ ID NO: 229814 - protein, 10 aa, Japanese encephalitis virus
YVGKREDIWC

SEQ ID NO: 229815 - protein, 10 aa, Japanese encephalitis virus
VGKREDIWCG

SEQ ID NO: 229816 - protein, 10 aa, Japanese encephalitis virus
GKREDIWCGS

SEQ ID NO: 229817 - protein, 10 aa, Japanese encephalitis virus
KREDIWCGSL

SEQ ID NO: 229818 - protein, 10 aa, Japanese encephalitis virus
REDIWCGSLI

SEQ ID NO: 229819 - protein, 10 aa, Japanese encephalitis virus
EDIWCGSLIG

SEQ ID NO: 229820 - protein, 10 aa, Japanese encephalitis virus
DIWCGSLIGT

SEQ ID NO: 229821 - protein, 10 aa, Japanese encephalitis virus
IWCGSLIGTR

SEQ ID NO: 229822 - protein, 10 aa, Japanese encephalitis virus
WCGSLIGTRS

SEQ ID NO: 229823 - protein, 10 aa, Japanese encephalitis virus
CGSLIGTRSR

SEQ ID NO: 229824 - protein, 10 aa, Japanese encephalitis virus
GSLIGTRSRA

SEQ ID NO: 229825 - protein, 10 aa, Japanese encephalitis virus
SLIGTRSRAT

SEQ ID NO: 229826 - protein, 10 aa, Japanese encephalitis virus
LIGTRSRATW

SEQ ID NO: 229827 - protein, 10 aa, Japanese encephalitis virus
IGTRSRATWA

SEQ ID NO: 229828 - protein, 10 aa, Japanese encephalitis virus
GTRSRATWAE

SEQ ID NO: 229829 - protein, 10 aa, Japanese encephalitis virus
TRSRATWAEN

SEQ ID NO: 229830 - protein, 10 aa, Japanese encephalitis virus
RSRATWAENI

SEQ ID NO: 229831 - protein, 10 aa, Japanese encephalitis virus
SRATWAENIY

SEQ ID NO: 229832 - protein, 10 aa, Japanese encephalitis virus
RATWAENIYA

SEQ ID NO: 229833 - protein, 10 aa, Japanese encephalitis virus
ATWAENIYAA

SEQ ID NO: 229834 - protein, 10 aa, Japanese encephalitis virus
TWAENIYAAI

SEQ ID NO: 229835 - protein, 10 aa, Japanese encephalitis virus
WAENIYAAIN

SEQ ID NO: 229836 - protein, 10 aa, Japanese encephalitis virus
AENIYAAINQ

SEQ ID NO: 229837 - protein, 10 aa, Japanese encephalitis virus
ENIYAAINQV

SEQ ID NO: 229838 - protein, 10 aa, Japanese encephalitis virus
NIYAAINQVR

SEQ ID NO: 229839 - protein, 10 aa, Japanese encephalitis virus
IYAAINQVRA

SEQ ID NO: 229840 - protein, 10 aa, Japanese encephalitis virus
YAAINQVRAV

SEQ ID NO: 229841 - protein, 10 aa, Japanese encephalitis virus
AAINQVRAVI

SEQ ID NO: 229842 - protein, 10 aa, Japanese encephalitis virus
AINQVRAVIG

SEQ ID NO: 229843 - protein, 10 aa, Japanese encephalitis virus
INQVRAVIGK

SEQ ID NO: 229844 - protein, 10 aa, Japanese encephalitis virus
NQVRAVIGKE

SEQ ID NO: 229845 - protein, 10 aa, Japanese encephalitis virus
QVRAVIGKEN

SEQ ID NO: 229846 - protein, 10 aa, Japanese encephalitis virus
VRAVIGKENY

SEQ ID NO: 229847 - protein, 10 aa, Japanese encephalitis virus
RAVIGKENYV

SEQ ID NO: 229848 - protein, 10 aa, Japanese encephalitis virus
AVIGKENYVD

SEQ ID NO: 229849 - protein, 10 aa, Japanese encephalitis virus
VIGKENYVDY

SEQ ID NO: 229850 - protein, 10 aa, Japanese encephalitis virus
IGKENYVDYM

SEQ ID NO: 229851 - protein, 10 aa, Japanese encephalitis virus
GKENYVDYMT

SEQ ID NO: 229852 - protein, 10 aa, Japanese encephalitis virus
KENYVDYMTS

SEQ ID NO: 229853 - protein, 10 aa, Japanese encephalitis virus
ENYVDYMTSL

SEQ ID NO: 229854 - protein, 10 aa, Japanese encephalitis virus
NYVDYMTSLR

SEQ ID NO: 229855 - protein, 10 aa, Japanese encephalitis virus
YVDYMTSLRR

SEQ ID NO: 229856 - protein, 10 aa, Japanese encephalitis virus
VDYMTSLRRY

SEQ ID NO: 229857 - protein, 10 aa, Japanese encephalitis virus
DYMTSLRRYE

SEQ ID NO: 229858 - protein, 10 aa, Japanese encephalitis virus
YMTSLRRYED

SEQ ID NO: 229859 - protein, 10 aa, Japanese encephalitis virus
MTSLRRYEDV

SEQ ID NO: 229860 - protein, 10 aa, Japanese encephalitis virus
TSLRRYEDVL

SEQ ID NO: 229861 - protein, 10 aa, Japanese encephalitis virus
SLRRYEDVLI

SEQ ID NO: 229862 - protein, 10 aa, Japanese encephalitis virus
LRRYEDVLIQ

SEQ ID NO: 229863 - protein, 10 aa, Japanese encephalitis virus
RRYEDVLIQE

SEQ ID NO: 229864 - protein, 10 aa, Japanese encephalitis virus
RYEDVLIQED

SEQ ID NO: 229865 - protein, 10 aa, Japanese encephalitis virus
YEDVLIQEDR

SEQ ID NO: 229866 - protein, 10 aa, Japanese encephalitis virus
EDVLIQEDRV

SEQ ID NO: 229867 - protein, 10 aa, Japanese encephalitis virus
DVLIQEDRVI

SEQ ID NO: 229868 - protein, 10 aa, Japanese encephalitis virus
MTKKPGGPGR

SEQ ID NO: 229869 - protein, 10 aa, Japanese encephalitis virus
TKKPGGPGRN

SEQ ID NO: 229870 - protein, 10 aa, Japanese encephalitis virus
KKPGGPGRNR

SEQ ID NO: 229871 - protein, 10 aa, Japanese encephalitis virus
KPGGPGRNRA

SEQ ID NO: 229872 - protein, 10 aa, Japanese encephalitis virus
PGGPGRNRAI

SEQ ID NO: 229873 - protein, 10 aa, Japanese encephalitis virus
GGPGRNRAIN

SEQ ID NO: 229874 - protein, 10 aa, Japanese encephalitis virus
GPGRNRAINM

SEQ ID NO: 229875 - protein, 10 aa, Japanese encephalitis virus
PGRNRAINML

SEQ ID NO: 229876 - protein, 10 aa, Japanese encephalitis virus
GRNRAINMLK

SEQ ID NO: 229877 - protein, 10 aa, Japanese encephalitis virus
RNRAINMLKR

SEQ ID NO: 229878 - protein, 10 aa, Japanese encephalitis virus
NRAIYMLKRG

SEQ ID NO: 229879 - protein, 10 aa, Japanese encephalitis virus
RAIYMLKRGL

SEQ ID NO: 229880 - protein, 10 aa, Japanese encephalitis virus
AIYMLKRGLP

SEQ ID NO: 229881 - protein, 10 aa, Japanese encephalitis virus
IYMLKRGLPR

SEQ ID NO: 229882 - protein, 10 aa, Japanese encephalitis virus
YMLKRGLPRV

SEQ ID NO: 229883 - protein, 10 aa, Japanese encephalitis virus
GLPRVFPLVR

SEQ ID NO: 229884 - protein, 10 aa, Japanese encephalitis virus
LPRVFPLVRV

SEQ ID NO: 229885 - protein, 10 aa, Japanese encephalitis virus
PRVFPLVRVK

SEQ ID NO: 229886 - protein, 10 aa, Japanese encephalitis virus
RVFPLVGVKK

SEQ ID NO: 229887 - protein, 10 aa, Japanese encephalitis virus
VFPLVRVKRV

SEQ ID NO: 229888 - protein, 10 aa, Japanese encephalitis virus
FPLVGVKKVV

SEQ ID NO: 229889 - protein, 10 aa, Japanese encephalitis virus
PLVRVKRVVM

SEQ ID NO: 229890 - protein, 10 aa, Japanese encephalitis virus
LVGVKKVVMS

SEQ ID NO: 229891 - protein, 10 aa, Japanese encephalitis virus
VRVKRVVMSL

SEQ ID NO: 229892 - protein, 10 aa, Japanese encephalitis virus
GVKKVVMSLL

SEQ ID NO: 229893 - protein, 10 aa, Japanese encephalitis virus
VKKVVMSLLD

SEQ ID NO: 229894 - protein, 10 aa, Japanese encephalitis virus
KKVVMSLLDG

SEQ ID NO: 229895 - protein, 10 aa, Japanese encephalitis virus
RVVISLLDGI

SEQ ID NO: 229896 - protein, 10 aa, Japanese encephalitis virus
VVISLLDGIG

SEQ ID NO: 229897 - protein, 10 aa, Japanese encephalitis virus
VISLLDGIGP

SEQ ID NO: 229898 - protein, 10 aa, Japanese encephalitis virus
MSLLDGRGPA

SEQ ID NO: 229899 - protein, 10 aa, Japanese encephalitis virus
SLLDGRGPAR

SEQ ID NO: 229900 - protein, 10 aa, Japanese encephalitis virus
LLDGRGPARF

SEQ ID NO: 229901 - protein, 10 aa, Japanese encephalitis virus
LDGRGPARFV

SEQ ID NO: 229902 - protein, 10 aa, Japanese encephalitis virus
DGRGPARFVL

SEQ ID NO: 229903 - protein, 10 aa, Japanese encephalitis virus
GRGPARFVLA

SEQ ID NO: 229904 - protein, 10 aa, Japanese encephalitis virus
RGPARFVLAL

SEQ ID NO: 229905 - protein, 10 aa, Japanese encephalitis virus
GPARFVLALI

SEQ ID NO: 229906 - protein, 10 aa, Japanese encephalitis virus
PARFVLALIT

SEQ ID NO: 229907 - protein, 10 aa, Japanese encephalitis virus
VRFVLALTTF

SEQ ID NO: 229908 - protein, 10 aa, Japanese encephalitis virus
RFVLALTTFF

SEQ ID NO: 229909 - protein, 10 aa, Japanese encephalitis virus
FVLALTTFFK

SEQ ID NO: 229910 - protein, 10 aa, Japanese encephalitis virus
VLALTTFFKF

SEQ ID NO: 229911 - protein, 10 aa, Japanese encephalitis virus
LALTTFFKFT

SEQ ID NO: 229912 - protein, 10 aa, Japanese encephalitis virus
ALTTFFKFTA

SEQ ID NO: 229913 - protein, 10 aa, Japanese encephalitis virus
LTTFFKFTAL

SEQ ID NO: 229914 - protein, 10 aa, Japanese encephalitis virus
TTFFKFTALA

SEQ ID NO: 229915 - protein, 10 aa, Japanese encephalitis virus
SFFKFTALSP

SEQ ID NO: 229916 - protein, 10 aa, Japanese encephalitis virus
FFKFTALSPT

SEQ ID NO: 229917 - protein, 10 aa, Japanese encephalitis virus
FKFTALSPTK

SEQ ID NO: 229918 - protein, 10 aa, Japanese encephalitis virus
KFTALSPTKA

SEQ ID NO: 229919 - protein, 10 aa, Japanese encephalitis virus
FTALSPTKAL

SEQ ID NO: 229920 - protein, 10 aa, Japanese encephalitis virus
TALAPTKALS

SEQ ID NO: 229921 - protein, 10 aa, Japanese encephalitis virus
ALAPTKALSG

SEQ ID NO: 229922 - protein, 10 aa, Japanese encephalitis virus
LAPTKALSGR

SEQ ID NO: 229923 - protein, 10 aa, Japanese encephalitis virus
APTKALSGRW

SEQ ID NO: 229924 - protein, 10 aa, Japanese encephalitis virus
PTKALLGRWR

SEQ ID NO: 229925 - protein, 10 aa, Japanese encephalitis virus
TKALLGRWRA

SEQ ID NO: 229926 - protein, 10 aa, Japanese encephalitis virus
KALLGRWRAV

SEQ ID NO: 229927 - protein, 10 aa, Japanese encephalitis virus
ALLGRWRAVE

SEQ ID NO: 229928 - protein, 10 aa, Japanese encephalitis virus
LLGRWRAVEK

SEQ ID NO: 229929 - protein, 10 aa, Japanese encephalitis virus
LGRWRAVEKS

SEQ ID NO: 229930 - protein, 10 aa, Japanese encephalitis virus
GRWRAVEKSV

SEQ ID NO: 229931 - protein, 10 aa, Japanese encephalitis virus
RWRAVEKSVA

SEQ ID NO: 229932 - protein, 10 aa, Japanese encephalitis virus
WRAVEKSVAM

SEQ ID NO: 229933 - protein, 10 aa, Japanese encephalitis virus
RAVEKSVAMK

SEQ ID NO: 229934 - protein, 10 aa, Japanese encephalitis virus
ALEKSVAMKH

SEQ ID NO: 229935 - protein, 10 aa, Japanese encephalitis virus
LEKSVAMKHL

SEQ ID NO: 229936 - protein, 10 aa, Japanese encephalitis virus
ERSVAMKHLT

SEQ ID NO: 229937 - protein, 10 aa, Japanese encephalitis virus
RSVAMKHLTS

SEQ ID NO: 229938 - protein, 10 aa, Japanese encephalitis virus
AMKHLTSFKG

SEQ ID NO: 229939 - protein, 10 aa, Japanese encephalitis virus
MKHLTSFKGE

SEQ ID NO: 229940 - protein, 10 aa, Japanese encephalitis virus
KHLTSFKGEL

SEQ ID NO: 229941 - protein, 10 aa, Japanese encephalitis virus
HLTSFKGELG

SEQ ID NO: 229942 - protein, 10 aa, Japanese encephalitis virus
LTSFKRELGI

SEQ ID NO: 229943 - protein, 10 aa, Japanese encephalitis virus
TSFKGELGTL

SEQ ID NO: 229944 - protein, 10 aa, Japanese encephalitis virus
SFKGELGTLI

SEQ ID NO: 229945 - protein, 10 aa, Japanese encephalitis virus
FKRELGILID

SEQ ID NO: 229946 - protein, 10 aa, Japanese encephalitis virus
KGELGTLIDG

SEQ ID NO: 229947 - protein, 10 aa, Japanese encephalitis virus
RELGTLIDVV

SEQ ID NO: 229948 - protein, 10 aa, Japanese encephalitis virus
ELGTLIDTVN

SEQ ID NO: 229949 - protein, 10 aa, Japanese encephalitis virus
LGTLIDTVNK

SEQ ID NO: 229950 - protein, 10 aa, Japanese encephalitis virus
GTLIDVVNKR

SEQ ID NO: 229951 - protein, 10 aa, Japanese encephalitis virus
TLIDGVNKRG

SEQ ID NO: 229952 - protein, 10 aa, Japanese encephalitis virus
LIDAVNKRGK

SEQ ID NO: 229953 - protein, 10 aa, Japanese encephalitis virus
IDAVNKRGKK

SEQ ID NO: 229954 - protein, 10 aa, Japanese encephalitis virus
VNKRGKKQNK

SEQ ID NO: 229955 - protein, 10 aa, Japanese encephalitis virus
NKRGKKQNKR

SEQ ID NO: 229956 - protein, 10 aa, Japanese encephalitis virus
KRGKKQNKRG

SEQ ID NO: 229957 - protein, 10 aa, Japanese encephalitis virus
RGKKQNKRGG

SEQ ID NO: 229958 - protein, 10 aa, Japanese encephalitis virus
GKKQNKRGGN

SEQ ID NO: 229959 - protein, 10 aa, Japanese encephalitis virus
KKQNKRGGNE

SEQ ID NO: 229960 - protein, 10 aa, Japanese encephalitis virus
KQNKRGGNES

SEQ ID NO: 229961 - protein, 10 aa, Japanese encephalitis virus
VGAMKLSNFQ

SEQ ID NO: 229962 - protein, 10 aa, Japanese encephalitis virus
GAMRLSNFQG

SEQ ID NO: 229963 - protein, 10 aa, Japanese encephalitis virus
AMRLSNFQGK

SEQ ID NO: 229964 - protein, 10 aa, Japanese encephalitis virus
MRLSNFQGKL

SEQ ID NO: 229965 - protein, 10 aa, Japanese encephalitis virus
RLSNFQGKLL

SEQ ID NO: 229966 - protein, 10 aa, Japanese encephalitis virus
SNFQGKLLMA

SEQ ID NO: 229967 - protein, 10 aa, Japanese encephalitis virus
NFQGKLLMTV

SEQ ID NO: 229968 - protein, 10 aa, Japanese encephalitis virus
FQGKLLMTVN

SEQ ID NO: 229969 - protein, 10 aa, Japanese encephalitis virus
QGKLLMTVNN

SEQ ID NO: 229970 - protein, 10 aa, Japanese encephalitis virus
GKLLMTVNNT

SEQ ID NO: 229971 - protein, 10 aa, Japanese encephalitis virus
KLLMTVNNTD

SEQ ID NO: 229972 - protein, 10 aa, Japanese encephalitis virus
LLMTVNNTDI

SEQ ID NO: 229973 - protein, 10 aa, Japanese encephalitis virus
LMTVNNTDIA

SEQ ID NO: 229974 - protein, 10 aa, Japanese encephalitis virus
MTVNNTDIAD

SEQ ID NO: 229975 - protein, 10 aa, Japanese encephalitis virus
TVNNTDIADV

SEQ ID NO: 229976 - protein, 10 aa, Japanese encephalitis virus
VNNTDIADVI

SEQ ID NO: 229977 - protein, 10 aa, Japanese encephalitis virus
CWVRAIDVGH

SEQ ID NO: 229978 - protein, 10 aa, Japanese encephalitis virus
WVRAIDVGHM

SEQ ID NO: 229979 - protein, 10 aa, Japanese encephalitis virus
VRAIDVGHMC

SEQ ID NO: 229980 - protein, 10 aa, Japanese encephalitis virus
RAIDVGYLCE

SEQ ID NO: 229981 - protein, 10 aa, Japanese encephalitis virus
AIDVGHMCED

SEQ ID NO: 229982 - protein, 10 aa, Japanese encephalitis virus
IDVGYLCEDT

SEQ ID NO: 229983 - protein, 10 aa, Japanese encephalitis virus
DVGYLCEDTI

SEQ ID NO: 229984 - protein, 10 aa, Japanese encephalitis virus
VGYLCEDTIT

SEQ ID NO: 229985 - protein, 10 aa, Japanese encephalitis virus
GHMCEDTITY

SEQ ID NO: 229986 - protein, 10 aa, Japanese encephalitis virus
YLCEDTITYE

SEQ ID NO: 229987 - protein, 10 aa, Japanese encephalitis virus
LCEDTITYEC

SEQ ID NO: 229988 - protein, 10 aa, Japanese encephalitis virus
TITYECPKLA

SEQ ID NO: 229989 - protein, 10 aa, Japanese encephalitis virus
VGNDPEDVDC

SEQ ID NO: 229990 - protein, 10 aa, Japanese encephalitis virus
GNDPQDVDCW

SEQ ID NO: 229991 - protein, 10 aa, Japanese encephalitis virus
NDPQDVDCWC

SEQ ID NO: 229992 - protein, 10 aa, Japanese encephalitis virus
DPQDVDCWCD

SEQ ID NO: 229993 - protein, 10 aa, Japanese encephalitis virus
PQDVDCWCDH

SEQ ID NO: 229994 - protein, 10 aa, Japanese encephalitis virus
QDVDCWCDHQ

SEQ ID NO: 229995 - protein, 10 aa, Japanese encephalitis virus
DVDCWCDNQQ

SEQ ID NO: 229996 - protein, 10 aa, Japanese encephalitis virus
VDCWCDNQQV

SEQ ID NO: 229997 - protein, 10 aa, Japanese encephalitis virus
DCWCDNQQVY

SEQ ID NO: 229998 - protein, 10 aa, Japanese encephalitis virus
CWCDNQQVYV

SEQ ID NO: 229999 - protein, 10 aa, Japanese encephalitis virus
WCDNQQVYVQ

SEQ ID NO: 230000 - protein, 10 aa, Japanese encephalitis virus
CDNQQVYVQY

SEQ ID NO: 230001 - protein, 10 aa, Japanese encephalitis virus
DNQQVYVQYG

SEQ ID NO: 230002 - protein, 10 aa, Japanese encephalitis virus
NQQVYVQYGP

SEQ ID NO: 230003 - protein, 10 aa, Japanese encephalitis virus
QQVYVQYGPC

SEQ ID NO: 230004 - protein, 10 aa, Japanese encephalitis virus
QVYVQYGPCT

SEQ ID NO: 230005 - protein, 10 aa, Japanese encephalitis virus
VYVQYGPCTR

SEQ ID NO: 230006 - protein, 10 aa, Japanese encephalitis virus
YVQYGPCTRT

SEQ ID NO: 230007 - protein, 10 aa, Japanese encephalitis virus
VQYGPCTRTR

SEQ ID NO: 230008 - protein, 10 aa, Japanese encephalitis virus
QYGPCTRTRH

SEQ ID NO: 230009 - protein, 10 aa, Japanese encephalitis virus
YGPCTRTRHS

SEQ ID NO: 230010 - protein, 10 aa, Japanese encephalitis virus
GPCTRTRHSK

SEQ ID NO: 230011 - protein, 10 aa, Japanese encephalitis virus
PCTRTRHSKR

SEQ ID NO: 230012 - protein, 10 aa, Japanese encephalitis virus
CTRTRHSKRT

SEQ ID NO: 230013 - protein, 10 aa, Japanese encephalitis virus
TRTRHSKRTR

SEQ ID NO: 230014 - protein, 10 aa, Japanese encephalitis virus
RTRHSKRTRR

SEQ ID NO: 230015 - protein, 10 aa, Japanese encephalitis virus
TRHSKRTRRS

SEQ ID NO: 230016 - protein, 10 aa, Japanese encephalitis virus
RHSKRTRRSV

SEQ ID NO: 230017 - protein, 10 aa, Japanese encephalitis virus
HSKRTRRSVS

SEQ ID NO: 230018 - protein, 10 aa, Japanese encephalitis virus
SKRTRRSVSV

SEQ ID NO: 230019 - protein, 10 aa, Japanese encephalitis virus
KRTRRSVSVQ

SEQ ID NO: 230020 - protein, 10 aa, Japanese encephalitis virus
RTRRSVSVQT

SEQ ID NO: 230021 - protein, 10 aa, Japanese encephalitis virus
TRRSVSVQTH

SEQ ID NO: 230022 - protein, 10 aa, Japanese encephalitis virus
RRSVSVQPNG

SEQ ID NO: 230023 - protein, 10 aa, Japanese encephalitis virus
RSVSVQPNGE

SEQ ID NO: 230024 - protein, 10 aa, Japanese encephalitis virus
SVSVQPNGER

SEQ ID NO: 230025 - protein, 10 aa, Japanese encephalitis virus
VSVQPNGERS

SEQ ID NO: 230026 - protein, 10 aa, Japanese encephalitis virus
SVHTHGESSL

SEQ ID NO: 230027 - protein, 10 aa, Japanese encephalitis virus
VQTHGESSLE

SEQ ID NO: 230028 - protein, 10 aa, Japanese encephalitis virus
HTHGESSLVN

SEQ ID NO: 230029 - protein, 10 aa, Japanese encephalitis virus
THGESSLENK

SEQ ID NO: 230030 - protein, 10 aa, Japanese encephalitis virus
NGERSLVNKK

SEQ ID NO: 230031 - protein, 10 aa, Japanese encephalitis virus
GERSLVNKKE

SEQ ID NO: 230032 - protein, 10 aa, Japanese encephalitis virus
ERSLVNKKEA

SEQ ID NO: 230033 - protein, 10 aa, Japanese encephalitis virus
SSLENKKEAW

SEQ ID NO: 230034 - protein, 10 aa, Japanese encephalitis virus
SLVNKKKAWL

SEQ ID NO: 230035 - protein, 10 aa, Japanese encephalitis virus
LVNKKKAWLD

SEQ ID NO: 230036 - protein, 10 aa, Japanese encephalitis virus
ENKKEAWLDS

SEQ ID NO: 230037 - protein, 10 aa, Japanese encephalitis virus
NKKKAWLDST

SEQ ID NO: 230038 - protein, 10 aa, Japanese encephalitis virus
KKKAWLDSTR

SEQ ID NO: 230039 - protein, 10 aa, Japanese encephalitis virus
KEAWLNSTKA

SEQ ID NO: 230040 - protein, 10 aa, Japanese encephalitis virus
KAWLDSTRAT

SEQ ID NO: 230041 - protein, 10 aa, Japanese encephalitis virus
AWLDSTRATR

SEQ ID NO: 230042 - protein, 10 aa, Japanese encephalitis virus
WLDSTRATRY

SEQ ID NO: 230043 - protein, 10 aa, Japanese encephalitis virus
LDSTRATRYL

SEQ ID NO: 230044 - protein, 10 aa, Japanese encephalitis virus
DSTKATRYLT

SEQ ID NO: 230045 - protein, 10 aa, Japanese encephalitis virus
STKATRYLTK

SEQ ID NO: 230046 - protein, 10 aa, Japanese encephalitis virus
TKATRYLTKT

SEQ ID NO: 230047 - protein, 10 aa, Japanese encephalitis virus
KATRYLTKTE

SEQ ID NO: 230048 - protein, 10 aa, Japanese encephalitis virus
ATRYLTKTEN

SEQ ID NO: 230049 - protein, 10 aa, Japanese encephalitis virus
TRYLTKTENW

SEQ ID NO: 230050 - protein, 10 aa, Japanese encephalitis virus
RYLTKTENWI

SEQ ID NO: 230051 - protein, 10 aa, Japanese encephalitis virus
YLMKTENWIV

SEQ ID NO: 230052 - protein, 10 aa, Japanese encephalitis virus
LTKTENWIIR

SEQ ID NO: 230053 - protein, 10 aa, Japanese encephalitis virus
TKTENWIIRN

SEQ ID NO: 230054 - protein, 10 aa, Japanese encephalitis virus
KTENWIVRNP

SEQ ID NO: 230055 - protein, 10 aa, Japanese encephalitis virus
TENWIVRNPG

SEQ ID NO: 230056 - protein, 10 aa, Japanese encephalitis virus
ENWIVRNPGY

SEQ ID NO: 230057 - protein, 10 aa, Japanese encephalitis virus
NWIVRNPGYA

SEQ ID NO: 230058 - protein, 10 aa, Japanese encephalitis virus
WIVRNPGYAF

SEQ ID NO: 230059 - protein, 10 aa, Japanese encephalitis virus
IVRNPGYAFL

SEQ ID NO: 230060 - protein, 10 aa, Japanese encephalitis virus
VRNPGYAFLA

SEQ ID NO: 230061 - protein, 10 aa, Japanese encephalitis virus
RNPGYAFLAG

SEQ ID NO: 230062 - protein, 10 aa, Japanese encephalitis virus
LGWMLGSNSG

SEQ ID NO: 230063 - protein, 10 aa, Japanese encephalitis virus
GPRVVFTILL

SEQ ID NO: 230064 - protein, 10 aa, Japanese encephalitis virus
QRLGFTILLL

SEQ ID NO: 230065 - protein, 10 aa, Japanese encephalitis virus
RLGFTILLLL

SEQ ID NO: 230066 - protein, 10 aa, Japanese encephalitis virus
VVFTILPLLV

SEQ ID NO: 230067 - protein, 10 aa, Japanese encephalitis virus
VFTILPLLVA

SEQ ID NO: 230068 - protein, 10 aa, Japanese encephalitis virus
FTILPLLVAP

SEQ ID NO: 230069 - protein, 10 aa, Japanese encephalitis virus
TILPLLVAPA

SEQ ID NO: 230070 - protein, 10 aa, Japanese encephalitis virus
ILPLLVAPAY

SEQ ID NO: 230071 - protein, 10 aa, Japanese encephalitis virus
LPLLVAPAYS

SEQ ID NO: 230072 - protein, 10 aa, Japanese encephalitis virus
PLLVAPAYSF

SEQ ID NO: 230073 - protein, 10 aa, Japanese encephalitis virus
LLVAPAYSFT

SEQ ID NO: 230074 - protein, 10 aa, Japanese encephalitis virus
LVAPAYSFTC

SEQ ID NO: 230075 - protein, 10 aa, Japanese encephalitis virus
VAPAYSFTCL

SEQ ID NO: 230076 - protein, 10 aa, Japanese encephalitis virus
APAYSFTCLG

SEQ ID NO: 230077 - protein, 10 aa, Japanese encephalitis virus
PAYSFTCLGM

SEQ ID NO: 230078 - protein, 10 aa, Japanese encephalitis virus
AYSFTCLGMG

SEQ ID NO: 230079 - protein, 10 aa, Japanese encephalitis virus
YSFTCLGMGN

SEQ ID NO: 230080 - protein, 10 aa, Japanese encephalitis virus
SFTCLGMGNR

SEQ ID NO: 230081 - protein, 10 aa, Japanese encephalitis virus
FTCLGMGNRD

SEQ ID NO: 230082 - protein, 10 aa, Japanese encephalitis virus
TCLGMGNRDF

SEQ ID NO: 230083 - protein, 10 aa, Japanese encephalitis virus
CLGMGNRDFV

SEQ ID NO: 230084 - protein, 10 aa, Japanese encephalitis virus
LGMGNRDFVE

SEQ ID NO: 230085 - protein, 10 aa, Japanese encephalitis virus
GMGNRDFVEG

SEQ ID NO: 230086 - protein, 10 aa, Japanese encephalitis virus
MGNRDFIQGA

SEQ ID NO: 230087 - protein, 10 aa, Japanese encephalitis virus
GNRDFVEGAS

SEQ ID NO: 230088 - protein, 10 aa, Japanese encephalitis virus
NRDFIQGASG

SEQ ID NO: 230089 - protein, 10 aa, Japanese encephalitis virus
RDFVEGASGA

SEQ ID NO: 230090 - protein, 10 aa, Japanese encephalitis virus
DFIERASGAT

SEQ ID NO: 230091 - protein, 10 aa, Japanese encephalitis virus
FVEGASGATW

SEQ ID NO: 230092 - protein, 10 aa, Japanese encephalitis virus
IEGVSGATWV

SEQ ID NO: 230093 - protein, 10 aa, Japanese encephalitis virus
EGVSGATWVD

SEQ ID NO: 230094 - protein, 10 aa, Japanese encephalitis virus
RASGATWVDL

SEQ ID NO: 230095 - protein, 10 aa, Japanese encephalitis virus
VSGATWVDLV

SEQ ID NO: 230096 - protein, 10 aa, Japanese encephalitis virus
GDSCLTIMAS

SEQ ID NO: 230097 - protein, 10 aa, Japanese encephalitis virus
DSCLTIMASD

SEQ ID NO: 230098 - protein, 10 aa, Japanese encephalitis virus
SCLTIMASDK

SEQ ID NO: 230099 - protein, 10 aa, Japanese encephalitis virus
CLTIMASDKP

SEQ ID NO: 230100 - protein, 10 aa, Japanese encephalitis virus
LTIMASDKPT

SEQ ID NO: 230101 - protein, 10 aa, Japanese encephalitis virus
TIMASDKPTL

SEQ ID NO: 230102 - protein, 10 aa, Japanese encephalitis virus
IMASDKPTLD

SEQ ID NO: 230103 - protein, 10 aa, Japanese encephalitis virus
MASDKPTLDV

SEQ ID NO: 230104 - protein, 10 aa, Japanese encephalitis virus
ASDKPTLDVR

SEQ ID NO: 230105 - protein, 10 aa, Japanese encephalitis virus
SDKPTLDVRM

SEQ ID NO: 230106 - protein, 10 aa, Japanese encephalitis virus
DKPTLDVRMT

SEQ ID NO: 230107 - protein, 10 aa, Japanese encephalitis virus
RPTLDVRMIN

SEQ ID NO: 230108 - protein, 10 aa, Japanese encephalitis virus
PTLDRRMINI

SEQ ID NO: 230109 - protein, 10 aa, Japanese encephalitis virus
TLDRRMINIE

SEQ ID NO: 230110 - protein, 10 aa, Japanese encephalitis virus
LDRRMINIEA

SEQ ID NO: 230111 - protein, 10 aa, Japanese encephalitis virus
DVRMINIEAV

SEQ ID NO: 230112 - protein, 10 aa, Japanese encephalitis virus
VRMINIEAVQ

SEQ ID NO: 230113 - protein, 10 aa, Japanese encephalitis virus
RMINIEAVQL

SEQ ID NO: 230114 - protein, 10 aa, Japanese encephalitis virus
MINIEAVQLA

SEQ ID NO: 230115 - protein, 10 aa, Japanese encephalitis virus
INIEAVQLAE

SEQ ID NO: 230116 - protein, 10 aa, Japanese encephalitis virus
NIEAVQLAEV

SEQ ID NO: 230117 - protein, 10 aa, Japanese encephalitis virus
IEAVQLAEVR

SEQ ID NO: 230118 - protein, 10 aa, Japanese encephalitis virus
EAVQLAEVRS

SEQ ID NO: 230119 - protein, 10 aa, Japanese encephalitis virus
AVQLAEVRSY

SEQ ID NO: 230120 - protein, 10 aa, Japanese encephalitis virus
VQLAEVRSYC

SEQ ID NO: 230121 - protein, 10 aa, Japanese encephalitis virus
QLAEVRSYYY

SEQ ID NO: 230122 - protein, 10 aa, Japanese encephalitis virus
LAEVRSYYYH

SEQ ID NO: 230123 - protein, 10 aa, Japanese encephalitis virus
AEVRSYCYRA

SEQ ID NO: 230124 - protein, 10 aa, Japanese encephalitis virus
EVRSYYYHAS

SEQ ID NO: 230125 - protein, 10 aa, Japanese encephalitis virus
VRSYCYRASV

SEQ ID NO: 230126 - protein, 10 aa, Japanese encephalitis virus
RSYCYRASVT

SEQ ID NO: 230127 - protein, 10 aa, Japanese encephalitis virus
SYCYRASVTD

SEQ ID NO: 230128 - protein, 10 aa, Japanese encephalitis virus
YYYHASVTDI

SEQ ID NO: 230129 - protein, 10 aa, Japanese encephalitis virus
YYHASVTDIS

SEQ ID NO: 230130 - protein, 10 aa, Japanese encephalitis virus
YRASVTDIST

SEQ ID NO: 230131 - protein, 10 aa, Japanese encephalitis virus
RASVTDISTV

SEQ ID NO: 230132 - protein, 10 aa, Japanese encephalitis virus
DISTVARCPM

SEQ ID NO: 230133 - protein, 10 aa, Japanese encephalitis virus
ISTVARCPMT

SEQ ID NO: 230134 - protein, 10 aa, Japanese encephalitis virus
STVARCPMTG

SEQ ID NO: 230135 - protein, 10 aa, Japanese encephalitis virus
TVARCPMTGE

SEQ ID NO: 230136 - protein, 10 aa, Japanese encephalitis virus
VARCPMTGEA

SEQ ID NO: 230137 - protein, 10 aa, Japanese encephalitis virus
ARCPMTGEAH

SEQ ID NO: 230138 - protein, 10 aa, Japanese encephalitis virus
RCPMTGEAHN

SEQ ID NO: 230139 - protein, 10 aa, Japanese encephalitis virus
CPMTGEAHNE

SEQ ID NO: 230140 - protein, 10 aa, Japanese encephalitis virus
PMTGEAHNEK

SEQ ID NO: 230141 - protein, 10 aa, Japanese encephalitis virus
MTGEAHNEKR

SEQ ID NO: 230142 - protein, 10 aa, Japanese encephalitis virus
TGEAHNKKRA

SEQ ID NO: 230143 - protein, 10 aa, Japanese encephalitis virus
GEAHNKKRAD

SEQ ID NO: 230144 - protein, 10 aa, Japanese encephalitis virus
EAHNEKGADS

SEQ ID NO: 230145 - protein, 10 aa, Japanese encephalitis virus
AHNEKGADSS

SEQ ID NO: 230146 - protein, 10 aa, Japanese encephalitis virus
HNEKQADSSY

SEQ ID NO: 230147 - protein, 10 aa, Japanese encephalitis virus
NEKQADSSYV

SEQ ID NO: 230148 - protein, 10 aa, Japanese encephalitis virus
EKGADSSYVC

SEQ ID NO: 230149 - protein, 10 aa, Japanese encephalitis virus
KGADSSYVCK

SEQ ID NO: 230150 - protein, 10 aa, Japanese encephalitis virus
QADSSYVCKQ

SEQ ID NO: 230151 - protein, 10 aa, Japanese encephalitis virus
KQGFTDRGWR

SEQ ID NO: 230152 - protein, 10 aa, Japanese encephalitis virus
QGFTDRGWRN

SEQ ID NO: 230153 - protein, 10 aa, Japanese encephalitis virus
GFTDRGWRNG

SEQ ID NO: 230154 - protein, 10 aa, Japanese encephalitis virus
FTDRGWRNGC

SEQ ID NO: 230155 - protein, 10 aa, Japanese encephalitis virus
TDRGWGKGCG

SEQ ID NO: 230156 - protein, 10 aa, Japanese encephalitis virus
DRGWGNGCGF

SEQ ID NO: 230157 - protein, 10 aa, Japanese encephalitis virus
RGWGNGCGFF

SEQ ID NO: 230158 - protein, 10 aa, Japanese encephalitis virus
GWGNGCGFFG

SEQ ID NO: 230159 - protein, 10 aa, Japanese encephalitis virus
WGNGCGFFGK

SEQ ID NO: 230160 - protein, 10 aa, Japanese encephalitis virus
GNGCGFFGKG

SEQ ID NO: 230161 - protein, 10 aa, Japanese encephalitis virus
NGCGFFGKGS

SEQ ID NO: 230162 - protein, 10 aa, Japanese encephalitis virus
GCGFFGKGSI

SEQ ID NO: 230163 - protein, 10 aa, Japanese encephalitis virus
CGFFGKGSID

SEQ ID NO: 230164 - protein, 10 aa, Japanese encephalitis virus
GFFGKGSIDT

SEQ ID NO: 230165 - protein, 10 aa, Japanese encephalitis virus
FFGKGSIDTC

SEQ ID NO: 230166 - protein, 10 aa, Japanese encephalitis virus
SGKGSIDTCA

SEQ ID NO: 230167 - protein, 10 aa, Japanese encephalitis virus
DTCAKFSCTR

SEQ ID NO: 230168 - protein, 10 aa, Japanese encephalitis virus
TCAKFSCTRK

SEQ ID NO: 230169 - protein, 10 aa, Japanese encephalitis virus
CAKFSCTRKA

SEQ ID NO: 230170 - protein, 10 aa, Japanese encephalitis virus
AKFSCTRKAI

SEQ ID NO: 230171 - protein, 10 aa, Japanese encephalitis virus
KFSCTRKAIG

SEQ ID NO: 230172 - protein, 10 aa, Japanese encephalitis virus
FSCTRKAIGR

SEQ ID NO: 230173 - protein, 10 aa, Japanese encephalitis virus
IQPENIKYKV

SEQ ID NO: 230174 - protein, 10 aa, Japanese encephalitis virus
QPENIKYKVG

SEQ ID NO: 230175 - protein, 10 aa, Japanese encephalitis virus
PENIKYKVGI

SEQ ID NO: 230176 - protein, 10 aa, Japanese encephalitis virus
ENIKYKVGIF

SEQ ID NO: 230177 - protein, 10 aa, Japanese encephalitis virus
NIKYKVGIFV

SEQ ID NO: 230178 - protein, 10 aa, Japanese encephalitis virus
IKYKVGIFVH

SEQ ID NO: 230179 - protein, 10 aa, Japanese encephalitis virus
KYKVGIFVHG

SEQ ID NO: 230180 - protein, 10 aa, Japanese encephalitis virus
YKVGIFVHGT

SEQ ID NO: 230181 - protein, 10 aa, Japanese encephalitis virus
KVGIFVHGTT

SEQ ID NO: 230182 - protein, 10 aa, Japanese encephalitis virus
VGIFVHGATT

SEQ ID NO: 230183 - protein, 10 aa, Japanese encephalitis virus
GIFVHGATTS

SEQ ID NO: 230184 - protein, 10 aa, Japanese encephalitis virus
IFVHGATTSE

SEQ ID NO: 230185 - protein, 10 aa, Japanese encephalitis virus
FVHGATTSEN

SEQ ID NO: 230186 - protein, 10 aa, Japanese encephalitis virus
VHGATTSENH

SEQ ID NO: 230187 - protein, 10 aa, Japanese encephalitis virus
HGATTSENHG

SEQ ID NO: 230188 - protein, 10 aa, Japanese encephalitis virus
GATTSENHGN

SEQ ID NO: 230189 - protein, 10 aa, Japanese encephalitis virus
ATTSENHGNY

SEQ ID NO: 230190 - protein, 10 aa, Japanese encephalitis virus
TTSENHGNYT

SEQ ID NO: 230191 - protein, 10 aa, Japanese encephalitis virus
TSENHGNYTA

SEQ ID NO: 230192 - protein, 10 aa, Japanese encephalitis virus
SENHGNYTAQ

SEQ ID NO: 230193 - protein, 10 aa, Japanese encephalitis virus
ENHGNYTAQI

SEQ ID NO: 230194 - protein, 10 aa, Japanese encephalitis virus
NHGNYTAQIG

SEQ ID NO: 230195 - protein, 10 aa, Japanese encephalitis virus
HGNYSAQVGT

SEQ ID NO: 230196 - protein, 10 aa, Japanese encephalitis virus
GNYSAQVGTS

SEQ ID NO: 230197 - protein, 10 aa, Japanese encephalitis virus
NYSAQVGTSQ

SEQ ID NO: 230198 - protein, 10 aa, Japanese encephalitis virus
YSAQVGTSQA

SEQ ID NO: 230199 - protein, 10 aa, Japanese encephalitis virus
SAQVGTSQAA

SEQ ID NO: 230200 - protein, 10 aa, Japanese encephalitis virus
AQVGTSQAAK

SEQ ID NO: 230201 - protein, 10 aa, Japanese encephalitis virus
QVGTSQAAKF

SEQ ID NO: 230202 - protein, 10 aa, Japanese encephalitis virus
VGTSQAAKFT

SEQ ID NO: 230203 - protein, 10 aa, Japanese encephalitis virus
GASQAAKFTI

SEQ ID NO: 230204 - protein, 10 aa, Japanese encephalitis virus
ASQAAKFTIT

SEQ ID NO: 230205 - protein, 10 aa, Japanese encephalitis virus
SQAAKFTITP

SEQ ID NO: 230206 - protein, 10 aa, Japanese encephalitis virus
QAAKFTITPN

SEQ ID NO: 230207 - protein, 10 aa, Japanese encephalitis virus
AAKFTITPNA

SEQ ID NO: 230208 - protein, 10 aa, Japanese encephalitis virus
AKFTITPNAP

SEQ ID NO: 230209 - protein, 10 aa, Japanese encephalitis virus
KFTITPNAPS

SEQ ID NO: 230210 - protein, 10 aa, Japanese encephalitis virus
FTVTPNAPSV

SEQ ID NO: 230211 - protein, 10 aa, Japanese encephalitis virus
TVTPNAPSTT

SEQ ID NO: 230212 - protein, 10 aa, Japanese encephalitis virus
VTPNAPSTTL

SEQ ID NO: 230213 - protein, 10 aa, Japanese encephalitis virus
TPNAPSTTLK

SEQ ID NO: 230214 - protein, 10 aa, Japanese encephalitis virus
PNAPSTTLKL

SEQ ID NO: 230215 - protein, 10 aa, Japanese encephalitis virus
NAPSTTLKLG

SEQ ID NO: 230216 - protein, 10 aa, Japanese encephalitis virus
APSTTLKLGD

SEQ ID NO: 230217 - protein, 10 aa, Japanese encephalitis virus
ALKLGDYGEV

SEQ ID NO: 230218 - protein, 10 aa, Japanese encephalitis virus
LELGDYGEVT

SEQ ID NO: 230219 - protein, 10 aa, Japanese encephalitis virus
ELGDYGEVTL

SEQ ID NO: 230220 - protein, 10 aa, Japanese encephalitis virus
LGDFGEVTLD

SEQ ID NO: 230221 - protein, 10 aa, Japanese encephalitis virus
GDFGEVTLDC

SEQ ID NO: 230222 - protein, 10 aa, Japanese encephalitis virus
DFGEVTLDCE

SEQ ID NO: 230223 - protein, 10 aa, Japanese encephalitis virus
YGEVTLDCEA

SEQ ID NO: 230224 - protein, 10 aa, Japanese encephalitis virus
GEVTLDCEAR

SEQ ID NO: 230225 - protein, 10 aa, Japanese encephalitis virus
EVTLDCEPKS

SEQ ID NO: 230226 - protein, 10 aa, Japanese encephalitis virus
VTLDCEARSG

SEQ ID NO: 230227 - protein, 10 aa, Japanese encephalitis virus
TLDCEPKSGL

SEQ ID NO: 230228 - protein, 10 aa, Japanese encephalitis virus
LDCEPKSGLN

SEQ ID NO: 230229 - protein, 10 aa, Japanese encephalitis virus
DCEPKSGLNT

SEQ ID NO: 230230 - protein, 10 aa, Japanese encephalitis virus
CEPKSGLNTE

SEQ ID NO: 230231 - protein, 10 aa, Japanese encephalitis virus
EPKSGLNTEA

SEQ ID NO: 230232 - protein, 10 aa, Japanese encephalitis virus
PKSGLNTEAF

SEQ ID NO: 230233 - protein, 10 aa, Japanese encephalitis virus
KSGLNTEAFY

SEQ ID NO: 230234 - protein, 10 aa, Japanese encephalitis virus
EAFYVMTVGP

SEQ ID NO: 230235 - protein, 10 aa, Japanese encephalitis virus
AFYVMTVGSR

SEQ ID NO: 230236 - protein, 10 aa, Japanese encephalitis virus
FYVMTVGSRS

SEQ ID NO: 230237 - protein, 10 aa, Japanese encephalitis virus
YVMTVGSRSF

SEQ ID NO: 230238 - protein, 10 aa, Japanese encephalitis virus
VMTVGSRSFL

SEQ ID NO: 230239 - protein, 10 aa, Japanese encephalitis virus
MTVGSRSFLV

SEQ ID NO: 230240 - protein, 10 aa, Japanese encephalitis virus
TVGSRSFLVH

SEQ ID NO: 230241 - protein, 10 aa, Japanese encephalitis virus
VGSRSFLVHR

SEQ ID NO: 230242 - protein, 10 aa, Japanese encephalitis virus
GSRSFLVHRE

SEQ ID NO: 230243 - protein, 10 aa, Japanese encephalitis virus
SRSFLVHREW

SEQ ID NO: 230244 - protein, 10 aa, Japanese encephalitis virus
RSFLVHREWF

SEQ ID NO: 230245 - protein, 10 aa, Japanese encephalitis virus
SLLVHREWFH

SEQ ID NO: 230246 - protein, 10 aa, Japanese encephalitis virus
LLVHREWFHD

SEQ ID NO: 230247 - protein, 10 aa, Japanese encephalitis virus
VHREWFHDLS

SEQ ID NO: 230248 - protein, 10 aa, Japanese encephalitis virus
HREWFHDLSL

SEQ ID NO: 230249 - protein, 10 aa, Japanese encephalitis virus
REWFHDLSLP

SEQ ID NO: 230250 - protein, 10 aa, Japanese encephalitis virus
EWFHDLSLPW

SEQ ID NO: 230251 - protein, 10 aa, Japanese encephalitis virus
WFHDLSLPWT

SEQ ID NO: 230252 - protein, 10 aa, Japanese encephalitis virus
FHDLSLPWTS

SEQ ID NO: 230253 - protein, 10 aa, Japanese encephalitis virus
HDLSLPWTSP

SEQ ID NO: 230254 - protein, 10 aa, Japanese encephalitis virus
DLSLPWTSPS

SEQ ID NO: 230255 - protein, 10 aa, Japanese encephalitis virus
LSLPWTSPSS

SEQ ID NO: 230256 - protein, 10 aa, Japanese encephalitis virus
SLPWTSPSST

SEQ ID NO: 230257 - protein, 10 aa, Japanese encephalitis virus
LPWTPPSSTA

SEQ ID NO: 230258 - protein, 10 aa, Japanese encephalitis virus
PWTPPSSTAW

SEQ ID NO: 230259 - protein, 10 aa, Japanese encephalitis virus
WTPPSSTAWR

SEQ ID NO: 230260 - protein, 10 aa, Japanese encephalitis virus
TPPSSTAWRN

SEQ ID NO: 230261 - protein, 10 aa, Japanese encephalitis virus
PPSSTAWRNR

SEQ ID NO: 230262 - protein, 10 aa, Japanese encephalitis virus
SSNTAWRNRE

SEQ ID NO: 230263 - protein, 10 aa, Japanese encephalitis virus
SNTAWRNREL

SEQ ID NO: 230264 - protein, 10 aa, Japanese encephalitis virus
NTAWRNRELL

SEQ ID NO: 230265 - protein, 10 aa, Japanese encephalitis virus
NRELLMEFEG

SEQ ID NO: 230266 - protein, 10 aa, Japanese encephalitis virus
RELLMEFEGA

SEQ ID NO: 230267 - protein, 10 aa, Japanese encephalitis virus
ELLMEFEGAH

SEQ ID NO: 230268 - protein, 10 aa, Japanese encephalitis virus
LLMEFEGAHA

SEQ ID NO: 230269 - protein, 10 aa, Japanese encephalitis virus
LMEFEGAHAT

SEQ ID NO: 230270 - protein, 10 aa, Japanese encephalitis virus
MEFEGAHATK

SEQ ID NO: 230271 - protein, 10 aa, Japanese encephalitis virus
EFEGAHATKQ

SEQ ID NO: 230272 - protein, 10 aa, Japanese encephalitis virus
FEGAHATKQS

SEQ ID NO: 230273 - protein, 10 aa, Japanese encephalitis virus
EGAHATKQSV

SEQ ID NO: 230274 - protein, 10 aa, Japanese encephalitis virus
GAHATKQSVV

SEQ ID NO: 230275 - protein, 10 aa, Japanese encephalitis virus
KQSVVALGSR

SEQ ID NO: 230276 - protein, 10 aa, Japanese encephalitis virus
QSVVALGSRE

SEQ ID NO: 230277 - protein, 10 aa, Japanese encephalitis virus
SVVALGSREG

SEQ ID NO: 230278 - protein, 10 aa, Japanese encephalitis virus
VVALGSREGG

SEQ ID NO: 230279 - protein, 10 aa, Japanese encephalitis virus
VALGSQERAL

SEQ ID NO: 230280 - protein, 10 aa, Japanese encephalitis virus
ALGSQEGSLH

SEQ ID NO: 230281 - protein, 10 aa, Japanese encephalitis virus
LGSQEGGLHH

SEQ ID NO: 230282 - protein, 10 aa, Japanese encephalitis virus
GSQEGGLHHA

SEQ ID NO: 230283 - protein, 10 aa, Japanese encephalitis virus
SQEGGLHHAL

SEQ ID NO: 230284 - protein, 10 aa, Japanese encephalitis virus
QEGGLHHALA

SEQ ID NO: 230285 - protein, 10 aa, Japanese encephalitis virus
EGGLHHALAG

SEQ ID NO: 230286 - protein, 10 aa, Japanese encephalitis virus
GGLHHALAGA

SEQ ID NO: 230287 - protein, 10 aa, Japanese encephalitis virus
GLHHALAGAI

SEQ ID NO: 230288 - protein, 10 aa, Japanese encephalitis virus
LHHALAGAIV

SEQ ID NO: 230289 - protein, 10 aa, Japanese encephalitis virus
HHALAGAIVV

SEQ ID NO: 230290 - protein, 10 aa, Japanese encephalitis virus
HALAGAIVVE

SEQ ID NO: 230291 - protein, 10 aa, Japanese encephalitis virus
LAGAIVVEYP

SEQ ID NO: 230292 - protein, 10 aa, Japanese encephalitis virus
AGAIVVEYPS

SEQ ID NO: 230293 - protein, 10 aa, Japanese encephalitis virus
GAIVVEYPSS

SEQ ID NO: 230294 - protein, 10 aa, Japanese encephalitis virus
AIVVEYSNSV

SEQ ID NO: 230295 - protein, 10 aa, Japanese encephalitis virus
IVVEYSSSVM

SEQ ID NO: 230296 - protein, 10 aa, Japanese encephalitis virus
VVEYSSSVML

SEQ ID NO: 230297 - protein, 10 aa, Japanese encephalitis virus
VEYSSSVMLT

SEQ ID NO: 230298 - protein, 10 aa, Japanese encephalitis virus
EYSSSVMLTS

SEQ ID NO: 230299 - protein, 10 aa, Japanese encephalitis virus
YSSSVMLTSG

SEQ ID NO: 230300 - protein, 10 aa, Japanese encephalitis virus
SSSVMLTSGH

SEQ ID NO: 230301 - protein, 10 aa, Japanese encephalitis virus
SSVMLTSGHL

SEQ ID NO: 230302 - protein, 10 aa, Japanese encephalitis virus
SVMLTSGHLK

SEQ ID NO: 230303 - protein, 10 aa, Japanese encephalitis virus
VMLTSGHLKC

SEQ ID NO: 230304 - protein, 10 aa, Japanese encephalitis virus
MLTSGHLKCR

SEQ ID NO: 230305 - protein, 10 aa, Japanese encephalitis virus
LTSGHVKRRL

SEQ ID NO: 230306 - protein, 10 aa, Japanese encephalitis virus
TSGHLKCRLR

SEQ ID NO: 230307 - protein, 10 aa, Japanese encephalitis virus
SGHLKCRLRM

SEQ ID NO: 230308 - protein, 10 aa, Japanese encephalitis virus
GHVKRRLKMD

SEQ ID NO: 230309 - protein, 10 aa, Japanese encephalitis virus
HVKRRLKMDK

SEQ ID NO: 230310 - protein, 10 aa, Japanese encephalitis virus
LKCRLRMDKL

SEQ ID NO: 230311 - protein, 10 aa, Japanese encephalitis virus
KRRLKMDKLA

SEQ ID NO: 230312 - protein, 10 aa, Japanese encephalitis virus
CRLRMDKLAL

SEQ ID NO: 230313 - protein, 10 aa, Japanese encephalitis virus
RLRMDKLALK

SEQ ID NO: 230314 - protein, 10 aa, Japanese encephalitis virus
LRMDKLALKG

SEQ ID NO: 230315 - protein, 10 aa, Japanese encephalitis virus
RMDKLALKGT

SEQ ID NO: 230316 - protein, 10 aa, Japanese encephalitis virus
LALKGTTYGV

SEQ ID NO: 230317 - protein, 10 aa, Japanese encephalitis virus
ALKGTTYGVC

SEQ ID NO: 230318 - protein, 10 aa, Japanese encephalitis virus
LKGTTYGVCT

SEQ ID NO: 230319 - protein, 10 aa, Japanese encephalitis virus
KGTTYGMCTG

SEQ ID NO: 230320 - protein, 10 aa, Japanese encephalitis virus
GTTYGMCTGK

SEQ ID NO: 230321 - protein, 10 aa, Japanese encephalitis virus
TTYGMCTGKF

SEQ ID NO: 230322 - protein, 10 aa, Japanese encephalitis virus
TYGMCTGKFS

SEQ ID NO: 230323 - protein, 10 aa, Japanese encephalitis virus
YGMCTGKFSF

SEQ ID NO: 230324 - protein, 10 aa, Japanese encephalitis virus
GMCTGKFSFA

SEQ ID NO: 230325 - protein, 10 aa, Japanese encephalitis virus
MCTGKFSFAK

SEQ ID NO: 230326 - protein, 10 aa, Japanese encephalitis virus
CTGKFSFAKN

SEQ ID NO: 230327 - protein, 10 aa, Japanese encephalitis virus
TGKFSFAKNP

SEQ ID NO: 230328 - protein, 10 aa, Japanese encephalitis virus
GKFSFAKNPA

SEQ ID NO: 230329 - protein, 10 aa, Japanese encephalitis virus
KFSFAKNPVD

SEQ ID NO: 230330 - protein, 10 aa, Japanese encephalitis virus
FSFAKNPVDT

SEQ ID NO: 230331 - protein, 10 aa, Japanese encephalitis virus
SFAKNPVDTG

SEQ ID NO: 230332 - protein, 10 aa, Japanese encephalitis virus
FAKNPVDTGH

SEQ ID NO: 230333 - protein, 10 aa, Japanese encephalitis virus
AKNPVDTGHG

SEQ ID NO: 230334 - protein, 10 aa, Japanese encephalitis virus
KNPVDTGHGT

SEQ ID NO: 230335 - protein, 10 aa, Japanese encephalitis virus
NPVDTGHGTV

SEQ ID NO: 230336 - protein, 10 aa, Japanese encephalitis virus
PVDTGHGTVV

SEQ ID NO: 230337 - protein, 10 aa, Japanese encephalitis virus
VDTGHGTVVI

SEQ ID NO: 230338 - protein, 10 aa, Japanese encephalitis virus
GHGTVVIELT

SEQ ID NO: 230339 - protein, 10 aa, Japanese encephalitis virus
HGTVVIELTY

SEQ ID NO: 230340 - protein, 10 aa, Japanese encephalitis virus
GTVVIELTYS

SEQ ID NO: 230341 - protein, 10 aa, Japanese encephalitis virus
TVVIELTYSG

SEQ ID NO: 230342 - protein, 10 aa, Japanese encephalitis virus
VVIELTYSGS

SEQ ID NO: 230343 - protein, 10 aa, Japanese encephalitis virus
VIELTYSGSD

SEQ ID NO: 230344 - protein, 10 aa, Japanese encephalitis virus
IELTYSGSDG

SEQ ID NO: 230345 - protein, 10 aa, Japanese encephalitis virus
ELTYSGSDGP

SEQ ID NO: 230346 - protein, 10 aa, Japanese encephalitis virus
LTYSGSDGPC

SEQ ID NO: 230347 - protein, 10 aa, Japanese encephalitis virus
TYSGSDGPCK

SEQ ID NO: 230348 - protein, 10 aa, Japanese encephalitis virus
YSGSDGSCKI

SEQ ID NO: 230349 - protein, 10 aa, Japanese encephalitis virus
SGSDGSCKIP

SEQ ID NO: 230350 - protein, 10 aa, Japanese encephalitis virus
GRDGPCKIPI

SEQ ID NO: 230351 - protein, 10 aa, Japanese encephalitis virus
RDGPCKIPIV

SEQ ID NO: 230352 - protein, 10 aa, Japanese encephalitis virus
DGSCKIPIVS

SEQ ID NO: 230353 - protein, 10 aa, Japanese encephalitis virus
GSCKIPIVSV

SEQ ID NO: 230354 - protein, 10 aa, Japanese encephalitis virus
SCKIPIVSVA

SEQ ID NO: 230355 - protein, 10 aa, Japanese encephalitis virus
CKIPIVSVAN

SEQ ID NO: 230356 - protein, 10 aa, Japanese encephalitis virus
KIPIVSVVSL

SEQ ID NO: 230357 - protein, 10 aa, Japanese encephalitis virus
IPIVSVANLN

SEQ ID NO: 230358 - protein, 10 aa, Japanese encephalitis virus
PIVSVVSLND

SEQ ID NO: 230359 - protein, 10 aa, Japanese encephalitis virus
IVSVASLNDL

SEQ ID NO: 230360 - protein, 10 aa, Japanese encephalitis virus
VSVASLNDLT

SEQ ID NO: 230361 - protein, 10 aa, Japanese encephalitis virus
SVASLNDLTP

SEQ ID NO: 230362 - protein, 10 aa, Japanese encephalitis virus
VASLNDLTPV

SEQ ID NO: 230363 - protein, 10 aa, Japanese encephalitis virus
ASLNDLTPVG

SEQ ID NO: 230364 - protein, 10 aa, Japanese encephalitis virus
SLNDLTPVGR

SEQ ID NO: 230365 - protein, 10 aa, Japanese encephalitis virus
LNDLTPVGRL

SEQ ID NO: 230366 - protein, 10 aa, Japanese encephalitis virus
NDLTPVGRLV

SEQ ID NO: 230367 - protein, 10 aa, Japanese encephalitis virus
DLTPVGRLVT

SEQ ID NO: 230368 - protein, 10 aa, Japanese encephalitis virus
LTPVGRLVTV

SEQ ID NO: 230369 - protein, 10 aa, Japanese encephalitis virus
TPAGRLVTVN

SEQ ID NO: 230370 - protein, 10 aa, Japanese encephalitis virus
PAGRLVTVNP

SEQ ID NO: 230371 - protein, 10 aa, Japanese encephalitis virus
AGRLVTVNPF

SEQ ID NO: 230372 - protein, 10 aa, Japanese encephalitis virus
LVTVNPFVAA

SEQ ID NO: 230373 - protein, 10 aa, Japanese encephalitis virus
VTVNPFVAAS

SEQ ID NO: 230374 - protein, 10 aa, Japanese encephalitis virus
TVNPFVAASS

SEQ ID NO: 230375 - protein, 10 aa, Japanese encephalitis virus
VNPFVATSSS

SEQ ID NO: 230376 - protein, 10 aa, Japanese encephalitis virus
NPFVATSSSN

SEQ ID NO: 230377 - protein, 10 aa, Japanese encephalitis virus
PFVATSSSNS

SEQ ID NO: 230378 - protein, 10 aa, Japanese encephalitis virus
FVATSSSNSK

SEQ ID NO: 230379 - protein, 10 aa, Japanese encephalitis virus
VATSSSNSKV

SEQ ID NO: 230380 - protein, 10 aa, Japanese encephalitis virus
ATSSSNSKVL

SEQ ID NO: 230381 - protein, 10 aa, Japanese encephalitis virus
SSSNSKVLVE

SEQ ID NO: 230382 - protein, 10 aa, Japanese encephalitis virus
SSNSKVLVEM

SEQ ID NO: 230383 - protein, 10 aa, Japanese encephalitis virus
SNSKVLVEME

SEQ ID NO: 230384 - protein, 10 aa, Japanese encephalitis virus
NSQVLVEMEP

SEQ ID NO: 230385 - protein, 10 aa, Japanese encephalitis virus
SKVLLEIEPP

SEQ ID NO: 230386 - protein, 10 aa, Japanese encephalitis virus
QVLVEMEPPF

SEQ ID NO: 230387 - protein, 10 aa, Japanese encephalitis virus
VLLEIEPPFG

SEQ ID NO: 230388 - protein, 10 aa, Japanese encephalitis virus
LLEIEPPFGD

SEQ ID NO: 230389 - protein, 10 aa, Japanese encephalitis virus
LEIEPPFGDS

SEQ ID NO: 230390 - protein, 10 aa, Japanese encephalitis virus
EIEPPFGDSY

SEQ ID NO: 230391 - protein, 10 aa, Japanese encephalitis virus
IEPPFGDSYI

SEQ ID NO: 230392 - protein, 10 aa, Japanese encephalitis virus
PPFGDSYIVI

SEQ ID NO: 230393 - protein, 10 aa, Japanese encephalitis virus
PFGDSYIVIG

SEQ ID NO: 230394 - protein, 10 aa, Japanese encephalitis virus
FGDSYIVIGR

SEQ ID NO: 230395 - protein, 10 aa, Japanese encephalitis virus
GDSYIVIGRG

SEQ ID NO: 230396 - protein, 10 aa, Japanese encephalitis virus
HHWHRAGSTL

SEQ ID NO: 230397 - protein, 10 aa, Japanese encephalitis virus
HWHRAGSTLG

SEQ ID NO: 230398 - protein, 10 aa, Japanese encephalitis virus
WHRAGSTLGK

SEQ ID NO: 230399 - protein, 10 aa, Japanese encephalitis virus
HRAGSTLGKA

SEQ ID NO: 230400 - protein, 10 aa, Japanese encephalitis virus
RAGSTLGKAF

SEQ ID NO: 230401 - protein, 10 aa, Japanese encephalitis virus
AGSTLGKAFL

SEQ ID NO: 230402 - protein, 10 aa, Japanese encephalitis virus
GSTLGKAFLT

SEQ ID NO: 230403 - protein, 10 aa, Japanese encephalitis virus
STLGKAFLTT

SEQ ID NO: 230404 - protein, 10 aa, Japanese encephalitis virus
TLGKAFLTTL

SEQ ID NO: 230405 - protein, 10 aa, Japanese encephalitis virus
LGKAFLTTLK

SEQ ID NO: 230406 - protein, 10 aa, Japanese encephalitis virus
GKAFLTTLKG

SEQ ID NO: 230407 - protein, 10 aa, Japanese encephalitis virus
KAFLTTLKGA

SEQ ID NO: 230408 - protein, 10 aa, Japanese encephalitis virus
AFLTTLKGAQ

SEQ ID NO: 230409 - protein, 10 aa, Japanese encephalitis virus
FLTTLKGAQR

SEQ ID NO: 230410 - protein, 10 aa, Japanese encephalitis virus
LTTLKGAQRL

SEQ ID NO: 230411 - protein, 10 aa, Japanese encephalitis virus
TTLKGAQRLV

SEQ ID NO: 230412 - protein, 10 aa, Japanese encephalitis virus
TLKGAQRLVA

SEQ ID NO: 230413 - protein, 10 aa, Japanese encephalitis virus
LKGAQRLVAL

SEQ ID NO: 230414 - protein, 10 aa, Japanese encephalitis virus
KGAQRLVALG

SEQ ID NO: 230415 - protein, 10 aa, Japanese encephalitis virus
GAQRLVALGD

SEQ ID NO: 230416 - protein, 10 aa, Japanese encephalitis virus
AQRLVALGDT

SEQ ID NO: 230417 - protein, 10 aa, Japanese encephalitis virus
QRLVALGDTA

SEQ ID NO: 230418 - protein, 10 aa, Japanese encephalitis virus
RLVALGDTAW

SEQ ID NO: 230419 - protein, 10 aa, Japanese encephalitis virus
LVALGDTAWD

SEQ ID NO: 230420 - protein, 10 aa, Japanese encephalitis virus
VALGDTAWDF

SEQ ID NO: 230421 - protein, 10 aa, Japanese encephalitis virus
TAWDFGSIGR

SEQ ID NO: 230422 - protein, 10 aa, Japanese encephalitis virus
AWDFGSIGRV

SEQ ID NO: 230423 - protein, 10 aa, Japanese encephalitis virus
WDFGSIGGAF

SEQ ID NO: 230424 - protein, 10 aa, Japanese encephalitis virus
DFGSIGGIFN

SEQ ID NO: 230425 - protein, 10 aa, Japanese encephalitis virus
FGSIGGAFNS

SEQ ID NO: 230426 - protein, 10 aa, Japanese encephalitis virus
GSIGGAFNSI

SEQ ID NO: 230427 - protein, 10 aa, Japanese encephalitis virus
SIGGIFNSIG

SEQ ID NO: 230428 - protein, 10 aa, Japanese encephalitis virus
IGGVFNSIGR

SEQ ID NO: 230429 - protein, 10 aa, Japanese encephalitis virus
GGVFNSIGRA

SEQ ID NO: 230430 - protein, 10 aa, Japanese encephalitis virus
GVFNSIGRAV

SEQ ID NO: 230431 - protein, 10 aa, Japanese encephalitis virus
VFNSIGRAVH

SEQ ID NO: 230432 - protein, 10 aa, Japanese encephalitis virus
FNSIGRAVHQ

SEQ ID NO: 230433 - protein, 10 aa, Japanese encephalitis virus
NSIGRAVHQV

SEQ ID NO: 230434 - protein, 10 aa, Japanese encephalitis virus
SIGRAVHQVF

SEQ ID NO: 230435 - protein, 10 aa, Japanese encephalitis virus
IGRAVHQVFG

SEQ ID NO: 230436 - protein, 10 aa, Japanese encephalitis virus
GRAVHQVFGG

SEQ ID NO: 230437 - protein, 10 aa, Japanese encephalitis virus
RAVHQVFGGA

SEQ ID NO: 230438 - protein, 10 aa, Japanese encephalitis virus
AVHQVFGDAF

SEQ ID NO: 230439 - protein, 10 aa, Japanese encephalitis virus
VHQVFGDAFR

SEQ ID NO: 230440 - protein, 10 aa, Japanese encephalitis virus
HQVFGDAFRT

SEQ ID NO: 230441 - protein, 10 aa, Japanese encephalitis virus
QVFGDAFRTL

SEQ ID NO: 230442 - protein, 10 aa, Japanese encephalitis virus
VFGDAFRTLF

SEQ ID NO: 230443 - protein, 10 aa, Japanese encephalitis virus
FGDAFRTLFG

SEQ ID NO: 230444 - protein, 10 aa, Japanese encephalitis virus
GDAFRTLFGG

SEQ ID NO: 230445 - protein, 10 aa, Japanese encephalitis virus
DAFRTLFGGM

SEQ ID NO: 230446 - protein, 10 aa, Japanese encephalitis virus
SWITQGLMGV

SEQ ID NO: 230447 - protein, 10 aa, Japanese encephalitis virus
WITQGLMGVL

SEQ ID NO: 230448 - protein, 10 aa, Japanese encephalitis virus
ITQGLMGVLL

SEQ ID NO: 230449 - protein, 10 aa, Japanese encephalitis virus
TQGLMGVLLL

SEQ ID NO: 230450 - protein, 10 aa, Japanese encephalitis virus
QGLMGVLLLW

SEQ ID NO: 230451 - protein, 10 aa, Japanese encephalitis virus
GLMGVLLLWM

SEQ ID NO: 230452 - protein, 10 aa, Japanese encephalitis virus
LMGVLLLWMG

SEQ ID NO: 230453 - protein, 10 aa, Japanese encephalitis virus
MGALLLWMGI

SEQ ID NO: 230454 - protein, 10 aa, Japanese encephalitis virus
GALLLWMGIN

SEQ ID NO: 230455 - protein, 10 aa, Japanese encephalitis virus
ALLLWMGINA

SEQ ID NO: 230456 - protein, 10 aa, Japanese encephalitis virus
LLLWMGINAR

SEQ ID NO: 230457 - protein, 10 aa, Japanese encephalitis virus
LLWMGINARD

SEQ ID NO: 230458 - protein, 10 aa, Japanese encephalitis virus
LWMGINARDR

SEQ ID NO: 230459 - protein, 10 aa, Japanese encephalitis virus
WMGINARDRS

SEQ ID NO: 230460 - protein, 10 aa, Japanese encephalitis virus
MGINARDRSI

SEQ ID NO: 230461 - protein, 10 aa, Japanese encephalitis virus
GINARDRSIA

SEQ ID NO: 230462 - protein, 10 aa, Japanese encephalitis virus
INARDRSIAL

SEQ ID NO: 230463 - protein, 10 aa, Japanese encephalitis virus
NARDRSIAMA

SEQ ID NO: 230464 - protein, 10 aa, Japanese encephalitis virus
ARNRSIALAF

SEQ ID NO: 230465 - protein, 10 aa, Japanese encephalitis virus
RDRSIAMAFL

SEQ ID NO: 230466 - protein, 10 aa, Japanese encephalitis virus
DRSIAMAFLV

SEQ ID NO: 230467 - protein, 10 aa, Japanese encephalitis virus
RSIAMAFLVT

SEQ ID NO: 230468 - protein, 10 aa, Japanese encephalitis virus
SIAMAFLVTG

SEQ ID NO: 230469 - protein, 10 aa, Japanese encephalitis virus
IAMAFLVTGG

SEQ ID NO: 230470 - protein, 10 aa, Japanese encephalitis virus
AMAFLVTGGT

SEQ ID NO: 230471 - protein, 10 aa, Japanese encephalitis virus
MAFLVTGGTL

SEQ ID NO: 230472 - protein, 10 aa, Japanese encephalitis virus
AFLVTGGTLL

SEQ ID NO: 230473 - protein, 10 aa, Japanese encephalitis virus
FLVTGGTLLF

SEQ ID NO: 230474 - protein, 10 aa, Japanese encephalitis virus
LVTGGTLLFL

SEQ ID NO: 230475 - protein, 10 aa, Japanese encephalitis virus
VTGGTLLFLA

SEQ ID NO: 230476 - protein, 10 aa, Japanese encephalitis virus
TGGTLLFLAT

SEQ ID NO: 230477 - protein, 10 aa, Japanese encephalitis virus
GGTLLFLATN

SEQ ID NO: 230478 - protein, 10 aa, Japanese encephalitis virus
GTLLFLATNV

SEQ ID NO: 230479 - protein, 10 aa, Japanese encephalitis virus
TLLFLATNVH

SEQ ID NO: 230480 - protein, 10 aa, Japanese encephalitis virus
LLFLATNVHA

SEQ ID NO: 230481 - protein, 10 aa, Japanese encephalitis virus
LFLATNVHAD

SEQ ID NO: 230482 - protein, 10 aa, Japanese encephalitis virus
ATNVHADTGS

SEQ ID NO: 230483 - protein, 10 aa, Japanese encephalitis virus
TNVHADTGSA

SEQ ID NO: 230484 - protein, 10 aa, Japanese encephalitis virus
NVHADTGSAI

SEQ ID NO: 230485 - protein, 10 aa, Japanese encephalitis virus
VHADTGSAID

SEQ ID NO: 230486 - protein, 10 aa, Japanese encephalitis virus
HADTGCAIDT

SEQ ID NO: 230487 - protein, 10 aa, Japanese encephalitis virus
ADTGCAIDIA

SEQ ID NO: 230488 - protein, 10 aa, Japanese encephalitis virus
DTGCAIDIAR

SEQ ID NO: 230489 - protein, 10 aa, Japanese encephalitis virus
TRREMRCGSG

SEQ ID NO: 230490 - protein, 10 aa, Japanese encephalitis virus
RREMRCGSGI

SEQ ID NO: 230491 - protein, 10 aa, Japanese encephalitis virus
REMRCGSGIF

SEQ ID NO: 230492 - protein, 10 aa, Japanese encephalitis virus
QMRCGSGIFV

SEQ ID NO: 230493 - protein, 10 aa, Japanese encephalitis virus
RYKYLPETPK

SEQ ID NO: 230494 - protein, 10 aa, Japanese encephalitis virus
YKYLPETPRA

SEQ ID NO: 230495 - protein, 10 aa, Japanese encephalitis virus
KYLPETPKSL

SEQ ID NO: 230496 - protein, 10 aa, Japanese encephalitis virus
YLPETPRALA

SEQ ID NO: 230497 - protein, 10 aa, Japanese encephalitis virus
LPETPKSLAK

SEQ ID NO: 230498 - protein, 10 aa, Japanese encephalitis virus
PETPRALAKI

SEQ ID NO: 230499 - protein, 10 aa, Japanese encephalitis virus
ETPKSLAKIV

SEQ ID NO: 230500 - protein, 10 aa, Japanese encephalitis virus
TPRALAKIVH

SEQ ID NO: 230501 - protein, 10 aa, Japanese encephalitis virus
PKSLAKIVHK

SEQ ID NO: 230502 - protein, 10 aa, Japanese encephalitis virus
RALAKIVHKA

SEQ ID NO: 230503 - protein, 10 aa, Japanese encephalitis virus
SLAKIVHKAY

SEQ ID NO: 230504 - protein, 10 aa, Japanese encephalitis virus
LAKIVHKAHQ

SEQ ID NO: 230505 - protein, 10 aa, Japanese encephalitis virus
AKIVHKAHQE

SEQ ID NO: 230506 - protein, 10 aa, Japanese encephalitis virus
KIVHKAHQEG

SEQ ID NO: 230507 - protein, 10 aa, Japanese encephalitis virus
IVHKAHQEGV

SEQ ID NO: 230508 - protein, 10 aa, Japanese encephalitis virus
VHKAHQEGVC

SEQ ID NO: 230509 - protein, 10 aa, Japanese encephalitis virus
HKAHQEGVCG

SEQ ID NO: 230510 - protein, 10 aa, Japanese encephalitis virus
KAHQEGVCGV

SEQ ID NO: 230511 - protein, 10 aa, Japanese encephalitis virus
AHQEGVCGVR

SEQ ID NO: 230512 - protein, 10 aa, Japanese encephalitis virus
HQEGVCGVRS

SEQ ID NO: 230513 - protein, 10 aa, Japanese encephalitis virus
QEGVCGVRSV

SEQ ID NO: 230514 - protein, 10 aa, Japanese encephalitis virus
EGICGVRSVT

SEQ ID NO: 230515 - protein, 10 aa, Japanese encephalitis virus
GICGVRSVTR

SEQ ID NO: 230516 - protein, 10 aa, Japanese encephalitis virus
VCGIRSVTRL

SEQ ID NO: 230517 - protein, 10 aa, Japanese encephalitis virus
CGIRSVTRLE

SEQ ID NO: 230518 - protein, 10 aa, Japanese encephalitis virus
GIRSVTRLEH

SEQ ID NO: 230519 - protein, 10 aa, Japanese encephalitis virus
IRSVTRLEHQ

SEQ ID NO: 230520 - protein, 10 aa, Japanese encephalitis virus
TRLEHQMWES

SEQ ID NO: 230521 - protein, 10 aa, Japanese encephalitis virus
RLEHQMWESV

SEQ ID NO: 230522 - protein, 10 aa, Japanese encephalitis virus
LEHQMWESVR

SEQ ID NO: 230523 - protein, 10 aa, Japanese encephalitis virus
EHQMWESVRD

SEQ ID NO: 230524 - protein, 10 aa, Japanese encephalitis virus
HQMWESVRDE

SEQ ID NO: 230525 - protein, 10 aa, Japanese encephalitis virus
QMWESVRDEL

SEQ ID NO: 230526 - protein, 10 aa, Japanese encephalitis virus
MWESVRDELN

SEQ ID NO: 230527 - protein, 10 aa, Japanese encephalitis virus
WESVRDELNV

SEQ ID NO: 230528 - protein, 10 aa, Japanese encephalitis virus
ESVRDELNVL

SEQ ID NO: 230529 - protein, 10 aa, Japanese encephalitis virus
SVRDELNVLL

SEQ ID NO: 230530 - protein, 10 aa, Japanese encephalitis virus
VRDELNVPLK

SEQ ID NO: 230531 - protein, 10 aa, Japanese encephalitis virus
RDELNVPLKE

SEQ ID NO: 230532 - protein, 10 aa, Japanese encephalitis virus
DELNVPLKEN

SEQ ID NO: 230533 - protein, 10 aa, Japanese encephalitis virus
ELNVPLKENA

SEQ ID NO: 230534 - protein, 10 aa, Japanese encephalitis virus
LNVPLKENAV

SEQ ID NO: 230535 - protein, 10 aa, Japanese encephalitis virus
NVPLKENAVD

SEQ ID NO: 230536 - protein, 10 aa, Japanese encephalitis virus
VPLKENAVDL

SEQ ID NO: 230537 - protein, 10 aa, Japanese encephalitis virus
PLKENAVDLS

SEQ ID NO: 230538 - protein, 10 aa, Japanese encephalitis virus
NKPVGRYRST

SEQ ID NO: 230539 - protein, 10 aa, Japanese encephalitis virus
KPVGRYRSTP

SEQ ID NO: 230540 - protein, 10 aa, Japanese encephalitis virus
PVGRYRSTPK

SEQ ID NO: 230541 - protein, 10 aa, Japanese encephalitis virus
VGRYRSTPKR

SEQ ID NO: 230542 - protein, 10 aa, Japanese encephalitis virus
GRYRSTPKRL

SEQ ID NO: 230543 - protein, 10 aa, Japanese encephalitis virus
RYRSTPKRLS

SEQ ID NO: 230544 - protein, 10 aa, Japanese encephalitis virus
YRSTPKRLSM

SEQ ID NO: 230545 - protein, 10 aa, Japanese encephalitis virus
RSAPKRLFMT

SEQ ID NO: 230546 - protein, 10 aa, Japanese encephalitis virus
SAPKRLSMTR

SEQ ID NO: 230547 - protein, 10 aa, Japanese encephalitis virus
APKRLSMTRE

SEQ ID NO: 230548 - protein, 10 aa, Japanese encephalitis virus
PKRLSMTREK

SEQ ID NO: 230549 - protein, 10 aa, Japanese encephalitis virus
KRLFMTQEKV

SEQ ID NO: 230550 - protein, 10 aa, Japanese encephalitis virus
RLSMTREKFE

SEQ ID NO: 230551 - protein, 10 aa, Japanese encephalitis virus
LFMTQEKVEM

SEQ ID NO: 230552 - protein, 10 aa, Japanese encephalitis virus
FMTQEKVEMG

SEQ ID NO: 230553 - protein, 10 aa, Japanese encephalitis virus
MTQEKVEMGW

SEQ ID NO: 230554 - protein, 10 aa, Japanese encephalitis virus
TREKFEMGWK

SEQ ID NO: 230555 - protein, 10 aa, Japanese encephalitis virus
QEKVEMGWKA

SEQ ID NO: 230556 - protein, 10 aa, Japanese encephalitis virus
EKVEMGWKAW

SEQ ID NO: 230557 - protein, 10 aa, Japanese encephalitis virus
KVEMGWKAWG

SEQ ID NO: 230558 - protein, 10 aa, Japanese encephalitis virus
VEMGWKAWGK

SEQ ID NO: 230559 - protein, 10 aa, Japanese encephalitis virus
MGWKAWGKSL

SEQ ID NO: 230560 - protein, 10 aa, Japanese encephalitis virus
GWKAWGKSLL

SEQ ID NO: 230561 - protein, 10 aa, Japanese encephalitis virus
WKAWGKSLLF

SEQ ID NO: 230562 - protein, 10 aa, Japanese encephalitis virus
KAWGKSLLFA

SEQ ID NO: 230563 - protein, 10 aa, Japanese encephalitis virus
AWGKSLLFAP

SEQ ID NO: 230564 - protein, 10 aa, Japanese encephalitis virus
WGKSMLFAPE

SEQ ID NO: 230565 - protein, 10 aa, Japanese encephalitis virus
GKSMLFAPEL

SEQ ID NO: 230566 - protein, 10 aa, Japanese encephalitis virus
KSILFAPEMA

SEQ ID NO: 230567 - protein, 10 aa, Japanese encephalitis virus
SILFAPEMAN

SEQ ID NO: 230568 - protein, 10 aa, Japanese encephalitis virus
MLFAPELANS

SEQ ID NO: 230569 - protein, 10 aa, Japanese encephalitis virus
LFAPEMANST

SEQ ID NO: 230570 - protein, 10 aa, Japanese encephalitis virus
FAPEMANSTF

SEQ ID NO: 230571 - protein, 10 aa, Japanese encephalitis virus
APELANSSFV

SEQ ID NO: 230572 - protein, 10 aa, Japanese encephalitis virus
PELANSSFVV

SEQ ID NO: 230573 - protein, 10 aa, Japanese encephalitis virus
ELANSSFVVD

SEQ ID NO: 230574 - protein, 10 aa, Japanese encephalitis virus
LANSSFVVDG

SEQ ID NO: 230575 - protein, 10 aa, Japanese encephalitis virus
ANSSFVVDGP

SEQ ID NO: 230576 - protein, 10 aa, Japanese encephalitis virus
NSSFVVDGPE

SEQ ID NO: 230577 - protein, 10 aa, Japanese encephalitis virus
SSFVVDGPET

SEQ ID NO: 230578 - protein, 10 aa, Japanese encephalitis virus
SFVVDGPETK

SEQ ID NO: 230579 - protein, 10 aa, Japanese encephalitis virus
DGPETKECPV

SEQ ID NO: 230580 - protein, 10 aa, Japanese encephalitis virus
GPETKECPVV

SEQ ID NO: 230581 - protein, 10 aa, Japanese encephalitis virus
PETKECPDER

SEQ ID NO: 230582 - protein, 10 aa, Japanese encephalitis virus
ETKECPDERR

SEQ ID NO: 230583 - protein, 10 aa, Japanese encephalitis virus
TKECPDERRA

SEQ ID NO: 230584 - protein, 10 aa, Japanese encephalitis virus
KECPDERRAW

SEQ ID NO: 230585 - protein, 10 aa, Japanese encephalitis virus
ECPDERRAWN

SEQ ID NO: 230586 - protein, 10 aa, Japanese encephalitis virus
CPDERRAWNS

SEQ ID NO: 230587 - protein, 10 aa, Japanese encephalitis virus
PDERRAWNSM

SEQ ID NO: 230588 - protein, 10 aa, Japanese encephalitis virus
DERRAWNSMQ

SEQ ID NO: 230589 - protein, 10 aa, Japanese encephalitis virus
ERRAWNSMQI

SEQ ID NO: 230590 - protein, 10 aa, Japanese encephalitis virus
RRAWNSMQIE

SEQ ID NO: 230591 - protein, 10 aa, Japanese encephalitis virus
RAWNSTQIED

SEQ ID NO: 230592 - protein, 10 aa, Japanese encephalitis virus
AWNSTQIEDF

SEQ ID NO: 230593 - protein, 10 aa, Japanese encephalitis virus
WNSTQIEDFG

SEQ ID NO: 230594 - protein, 10 aa, Japanese encephalitis virus
NSTQIEDFGF

SEQ ID NO: 230595 - protein, 10 aa, Japanese encephalitis virus
STQIEDFGFG

SEQ ID NO: 230596 - protein, 10 aa, Japanese encephalitis virus
TQIEDFGFGI

SEQ ID NO: 230597 - protein, 10 aa, Japanese encephalitis virus
RVWLKIREEN

SEQ ID NO: 230598 - protein, 10 aa, Japanese encephalitis virus
VWLKIREENT

SEQ ID NO: 230599 - protein, 10 aa, Japanese encephalitis virus
WLKIREENTD

SEQ ID NO: 230600 - protein, 10 aa, Japanese encephalitis virus
LKIREENTDE

SEQ ID NO: 230601 - protein, 10 aa, Japanese encephalitis virus
KIREENTDEC

SEQ ID NO: 230602 - protein, 10 aa, Japanese encephalitis virus
IREENTDECD

SEQ ID NO: 230603 - protein, 10 aa, Japanese encephalitis virus
REENTDECDG

SEQ ID NO: 230604 - protein, 10 aa, Japanese encephalitis virus
EENTDECDGA

SEQ ID NO: 230605 - protein, 10 aa, Japanese encephalitis virus
ENTDECDGAI

SEQ ID NO: 230606 - protein, 10 aa, Japanese encephalitis virus
NTDECDGAII

SEQ ID NO: 230607 - protein, 10 aa, Japanese encephalitis virus
TDECDGPIIG

SEQ ID NO: 230608 - protein, 10 aa, Japanese encephalitis virus
DECDGPIIGT

SEQ ID NO: 230609 - protein, 10 aa, Japanese encephalitis virus
ECDGPIIGTA

SEQ ID NO: 230610 - protein, 10 aa, Japanese encephalitis virus
CDGPIIGTAV

SEQ ID NO: 230611 - protein, 10 aa, Japanese encephalitis virus
DGPIIGTAVK

SEQ ID NO: 230612 - protein, 10 aa, Japanese encephalitis virus
GPIIGTAVKG

SEQ ID NO: 230613 - protein, 10 aa, Japanese encephalitis virus
PIIGTAVKGH

SEQ ID NO: 230614 - protein, 10 aa, Japanese encephalitis virus
IIGTAVKGNV

SEQ ID NO: 230615 - protein, 10 aa, Japanese encephalitis virus
IGTAVKGNVA

SEQ ID NO: 230616 - protein, 10 aa, Japanese encephalitis virus
GTAVKGNVAV

SEQ ID NO: 230617 - protein, 10 aa, Japanese encephalitis virus
TAVKGNVAVH

SEQ ID NO: 230618 - protein, 10 aa, Japanese encephalitis virus
AVKGNVAVHS

SEQ ID NO: 230619 - protein, 10 aa, Japanese encephalitis virus
VKGNVAVHSD

SEQ ID NO: 230620 - protein, 10 aa, Japanese encephalitis virus
KGNVAVHSDL

SEQ ID NO: 230621 - protein, 10 aa, Japanese encephalitis virus
GNVAVHSDLS

SEQ ID NO: 230622 - protein, 10 aa, Japanese encephalitis virus
NVAVHSDLSY

SEQ ID NO: 230623 - protein, 10 aa, Japanese encephalitis virus
VALHSDLSYW

SEQ ID NO: 230624 - protein, 10 aa, Japanese encephalitis virus
ALHSDLSYWI

SEQ ID NO: 230625 - protein, 10 aa, Japanese encephalitis virus
VHSDLSYWIG

SEQ ID NO: 230626 - protein, 10 aa, Japanese encephalitis virus
HSDVSYWIES

SEQ ID NO: 230627 - protein, 10 aa, Japanese encephalitis virus
SDLSYWIESH

SEQ ID NO: 230628 - protein, 10 aa, Japanese encephalitis virus
SYWIESRLND

SEQ ID NO: 230629 - protein, 10 aa, Japanese encephalitis virus
NDSWKLERAV

SEQ ID NO: 230630 - protein, 10 aa, Japanese encephalitis virus
DTWKRERAVF

SEQ ID NO: 230631 - protein, 10 aa, Japanese encephalitis virus
SWKLERAVFG

SEQ ID NO: 230632 - protein, 10 aa, Japanese encephalitis virus
WKLERLVFGE

SEQ ID NO: 230633 - protein, 10 aa, Japanese encephalitis virus
KLERAVFGEI

SEQ ID NO: 230634 - protein, 10 aa, Japanese encephalitis virus
LERAVFGEIK

SEQ ID NO: 230635 - protein, 10 aa, Japanese encephalitis virus
ERAVFGEIKS

SEQ ID NO: 230636 - protein, 10 aa, Japanese encephalitis virus
RAVFGEIKSC

SEQ ID NO: 230637 - protein, 10 aa, Japanese encephalitis virus
AVFGEIKSCT

SEQ ID NO: 230638 - protein, 10 aa, Japanese encephalitis virus
VFGEIKSCTW

SEQ ID NO: 230639 - protein, 10 aa, Japanese encephalitis virus
FGEIKSCTWP

SEQ ID NO: 230640 - protein, 10 aa, Japanese encephalitis virus
GEIKSCTWPE

SEQ ID NO: 230641 - protein, 10 aa, Japanese encephalitis virus
EIKSCTWPET

SEQ ID NO: 230642 - protein, 10 aa, Japanese encephalitis virus
IKSCTWPETH

SEQ ID NO: 230643 - protein, 10 aa, Japanese encephalitis virus
KSCTWPETHS

SEQ ID NO: 230644 - protein, 10 aa, Japanese encephalitis virus
SCTWPETHSL

SEQ ID NO: 230645 - protein, 10 aa, Japanese encephalitis virus
CTWPETHSLW

SEQ ID NO: 230646 - protein, 10 aa, Japanese encephalitis virus
TWPETHSLWG

SEQ ID NO: 230647 - protein, 10 aa, Japanese encephalitis virus
WPETHSLWGD

SEQ ID NO: 230648 - protein, 10 aa, Japanese encephalitis virus
PETHTLWGDD

SEQ ID NO: 230649 - protein, 10 aa, Japanese encephalitis virus
ETHTLWGDDV

SEQ ID NO: 230650 - protein, 10 aa, Japanese encephalitis virus
THTLWGDDVE

SEQ ID NO: 230651 - protein, 10 aa, Japanese encephalitis virus
HTLWGDDVEE

SEQ ID NO: 230652 - protein, 10 aa, Japanese encephalitis virus
TLWGDDVEES

SEQ ID NO: 230653 - protein, 10 aa, Japanese encephalitis virus
LWGDDVEESE

SEQ ID NO: 230654 - protein, 10 aa, Japanese encephalitis virus
WGDDVEESEL

SEQ ID NO: 230655 - protein, 10 aa, Japanese encephalitis virus
GDDVEESELI

SEQ ID NO: 230656 - protein, 10 aa, Japanese encephalitis virus
DDVEESELII

SEQ ID NO: 230657 - protein, 10 aa, Japanese encephalitis virus
DVEESELIIP

SEQ ID NO: 230658 - protein, 10 aa, Japanese encephalitis virus
AEESELIIPH

SEQ ID NO: 230659 - protein, 10 aa, Japanese encephalitis virus
EESDLVIPHT

SEQ ID NO: 230660 - protein, 10 aa, Japanese encephalitis virus
ESELIIPHTL

SEQ ID NO: 230661 - protein, 10 aa, Japanese encephalitis virus
SELIIPHTLA

SEQ ID NO: 230662 - protein, 10 aa, Japanese encephalitis virus
ELIIPHTLAG

SEQ ID NO: 230663 - protein, 10 aa, Japanese encephalitis virus
LIIPHTLAGP

SEQ ID NO: 230664 - protein, 10 aa, Japanese encephalitis virus
IIPHTIAGPR

SEQ ID NO: 230665 - protein, 10 aa, Japanese encephalitis virus
IPHTIAGPRS

SEQ ID NO: 230666 - protein, 10 aa, Japanese encephalitis virus
PHTIAGPRSK

SEQ ID NO: 230667 - protein, 10 aa, Japanese encephalitis virus
HTIAGPRSKH

SEQ ID NO: 230668 - protein, 10 aa, Japanese encephalitis virus
TIAGPRSKHN

SEQ ID NO: 230669 - protein, 10 aa, Japanese encephalitis virus
IAGPRSKHNR

SEQ ID NO: 230670 - protein, 10 aa, Japanese encephalitis virus
AGPRSKHNRR

SEQ ID NO: 230671 - protein, 10 aa, Japanese encephalitis virus
GPRSKHNRRE

SEQ ID NO: 230672 - protein, 10 aa, Japanese encephalitis virus
PRSKHNRREG

SEQ ID NO: 230673 - protein, 10 aa, Japanese encephalitis virus
RSKHNRREGY

SEQ ID NO: 230674 - protein, 10 aa, Japanese encephalitis virus
SKHNRREGYR

SEQ ID NO: 230675 - protein, 10 aa, Japanese encephalitis virus
KHNRREGYRT

SEQ ID NO: 230676 - protein, 10 aa, Japanese encephalitis virus
HNRREGYRTQ

SEQ ID NO: 230677 - protein, 10 aa, Japanese encephalitis virus
NRREGYRTQN

SEQ ID NO: 230678 - protein, 10 aa, Japanese encephalitis virus
RREGYRTQNQ

SEQ ID NO: 230679 - protein, 10 aa, Japanese encephalitis virus
REGYRTQNQG

SEQ ID NO: 230680 - protein, 10 aa, Japanese encephalitis virus
EGYRTQNQGP

SEQ ID NO: 230681 - protein, 10 aa, Japanese encephalitis virus
GYRTQNQGPW

SEQ ID NO: 230682 - protein, 10 aa, Japanese encephalitis virus
YRTQNQGPWD

SEQ ID NO: 230683 - protein, 10 aa, Japanese encephalitis virus
RTQNQGPWDE

SEQ ID NO: 230684 - protein, 10 aa, Japanese encephalitis virus
TQNQGPWDED

SEQ ID NO: 230685 - protein, 10 aa, Japanese encephalitis virus
QNQGPWDESG

SEQ ID NO: 230686 - protein, 10 aa, Japanese encephalitis virus
NQGPWDEDGI

SEQ ID NO: 230687 - protein, 10 aa, Japanese encephalitis virus
QGPWDESGIV

SEQ ID NO: 230688 - protein, 10 aa, Japanese encephalitis virus
GPWDENGLVP

SEQ ID NO: 230689 - protein, 10 aa, Japanese encephalitis virus
PWDEDGIVLD

SEQ ID NO: 230690 - protein, 10 aa, Japanese encephalitis virus
WDEKGIVLDF

SEQ ID NO: 230691 - protein, 10 aa, Japanese encephalitis virus
DEDGIVLDFD

SEQ ID NO: 230692 - protein, 10 aa, Japanese encephalitis virus
EKGIVLDFDY

SEQ ID NO: 230693 - protein, 10 aa, Japanese encephalitis virus
KGIVLDFDYC

SEQ ID NO: 230694 - protein, 10 aa, Japanese encephalitis virus
GLVPGLDYCP

SEQ ID NO: 230695 - protein, 10 aa, Japanese encephalitis virus
LVPGLDYCPG

SEQ ID NO: 230696 - protein, 10 aa, Japanese encephalitis virus
VPGLDYCPGT

SEQ ID NO: 230697 - protein, 10 aa, Japanese encephalitis virus
LDFDYCPGTT

SEQ ID NO: 230698 - protein, 10 aa, Japanese encephalitis virus
GLDYCPGTKV

SEQ ID NO: 230699 - protein, 10 aa, Japanese encephalitis virus
FDYCPGTTVT

SEQ ID NO: 230700 - protein, 10 aa, Japanese encephalitis virus
DYCPGTTVTI

SEQ ID NO: 230701 - protein, 10 aa, Japanese encephalitis virus
YCPGTTVTIT

SEQ ID NO: 230702 - protein, 10 aa, Japanese encephalitis virus
CPGTTVTITE

SEQ ID NO: 230703 - protein, 10 aa, Japanese encephalitis virus
PGTTVTITED

SEQ ID NO: 230704 - protein, 10 aa, Japanese encephalitis virus
GTTVTITEDC

SEQ ID NO: 230705 - protein, 10 aa, Japanese encephalitis virus
TKVTITEDCS

SEQ ID NO: 230706 - protein, 10 aa, Japanese encephalitis virus
KVTITEDCSK

SEQ ID NO: 230707 - protein, 10 aa, Japanese encephalitis virus
VTITEDCSKR

SEQ ID NO: 230708 - protein, 10 aa, Japanese encephalitis virus
TITEDCSKRG

SEQ ID NO: 230709 - protein, 10 aa, Japanese encephalitis virus
ITEDCSKRGP

SEQ ID NO: 230710 - protein, 10 aa, Japanese encephalitis virus
TEDCSKRGPS

SEQ ID NO: 230711 - protein, 10 aa, Japanese encephalitis virus
EDCGKRGPSI

SEQ ID NO: 230712 - protein, 10 aa, Japanese encephalitis virus
DCGKRGPSIR

SEQ ID NO: 230713 - protein, 10 aa, Japanese encephalitis virus
CGKRGPSIRT

SEQ ID NO: 230714 - protein, 10 aa, Japanese encephalitis virus
GKRGPSIRTT

SEQ ID NO: 230715 - protein, 10 aa, Japanese encephalitis virus
KRGPSIRTTT

SEQ ID NO: 230716 - protein, 10 aa, Japanese encephalitis virus
RGPSIRTTTD

SEQ ID NO: 230717 - protein, 10 aa, Japanese encephalitis virus
GPSIRTTTDS

SEQ ID NO: 230718 - protein, 10 aa, Japanese encephalitis virus
PSIRTTTDSG

SEQ ID NO: 230719 - protein, 10 aa, Japanese encephalitis virus
SIRTTTDSGK

SEQ ID NO: 230720 - protein, 10 aa, Japanese encephalitis virus
IRTTTDSGKL

SEQ ID NO: 230721 - protein, 10 aa, Japanese encephalitis virus
RTTTDIGKLI

SEQ ID NO: 230722 - protein, 10 aa, Japanese encephalitis virus
TTTDIGKLIT

SEQ ID NO: 230723 - protein, 10 aa, Japanese encephalitis virus
TTDIGKLITD

SEQ ID NO: 230724 - protein, 10 aa, Japanese encephalitis virus
TDIGKLITDW

SEQ ID NO: 230725 - protein, 10 aa, Japanese encephalitis virus
DIGKLITDWC

SEQ ID NO: 230726 - protein, 10 aa, Japanese encephalitis virus
IGKLITDWCC

SEQ ID NO: 230727 - protein, 10 aa, Japanese encephalitis virus
KLITDWCCRN

SEQ ID NO: 230728 - protein, 10 aa, Japanese encephalitis virus
LITDWCCRNC

SEQ ID NO: 230729 - protein, 10 aa, Japanese encephalitis virus
ITDWCCRNCS

SEQ ID NO: 230730 - protein, 10 aa, Japanese encephalitis virus
TDWCCRNCSL

SEQ ID NO: 230731 - protein, 10 aa, Japanese encephalitis virus
DWCCRNCSLP

SEQ ID NO: 230732 - protein, 10 aa, Japanese encephalitis virus
WCCRSCTLPP

SEQ ID NO: 230733 - protein, 10 aa, Japanese encephalitis virus
CCRNCSLPPL

SEQ ID NO: 230734 - protein, 10 aa, Japanese encephalitis virus
CRSCSLPPLG

SEQ ID NO: 230735 - protein, 10 aa, Japanese encephalitis virus
RSCSLPPLGF

SEQ ID NO: 230736 - protein, 10 aa, Japanese encephalitis virus
SCSLPPLGFR

SEQ ID NO: 230737 - protein, 10 aa, Japanese encephalitis virus
CSLPPLGFRT

SEQ ID NO: 230738 - protein, 10 aa, Japanese encephalitis virus
SLPPLGFRTE

SEQ ID NO: 230739 - protein, 10 aa, Japanese encephalitis virus
LPPLGFRTEN

SEQ ID NO: 230740 - protein, 10 aa, Japanese encephalitis virus
PPLGFRTENG

SEQ ID NO: 230741 - protein, 10 aa, Japanese encephalitis virus
PLGFRTENGC

SEQ ID NO: 230742 - protein, 10 aa, Japanese encephalitis virus
LGFRTENGCW

SEQ ID NO: 230743 - protein, 10 aa, Japanese encephalitis virus
GFRTENGCWY

SEQ ID NO: 230744 - protein, 10 aa, Japanese encephalitis virus
FRTGSGCWYG

SEQ ID NO: 230745 - protein, 10 aa, Japanese encephalitis virus
RTDNGCWYGM

SEQ ID NO: 230746 - protein, 10 aa, Japanese encephalitis virus
TDNGCWYGME

SEQ ID NO: 230747 - protein, 10 aa, Japanese encephalitis virus
DNGCWYGMEI

SEQ ID NO: 230748 - protein, 10 aa, Japanese encephalitis virus
SGCWYGMEVR

SEQ ID NO: 230749 - protein, 10 aa, Japanese encephalitis virus
GCWYGMEVRP

SEQ ID NO: 230750 - protein, 10 aa, Japanese encephalitis virus
CWYGMEIRPL

SEQ ID NO: 230751 - protein, 10 aa, Japanese encephalitis virus
HDEATLVRSQ

SEQ ID NO: 230752 - protein, 10 aa, Japanese encephalitis virus
DEATLVRSQV

SEQ ID NO: 230753 - protein, 10 aa, Japanese encephalitis virus
GEMIDPFQLG

SEQ ID NO: 230754 - protein, 10 aa, Japanese encephalitis virus
EMIDPFQLGL

SEQ ID NO: 230755 - protein, 10 aa, Japanese encephalitis virus
MIDPFQLGLL

SEQ ID NO: 230756 - protein, 10 aa, Japanese encephalitis virus
IDPFQLGLLV

SEQ ID NO: 230757 - protein, 10 aa, Japanese encephalitis virus
DPFQLGLLVV

SEQ ID NO: 230758 - protein, 10 aa, Japanese encephalitis virus
PFQLGLLVVF

SEQ ID NO: 230759 - protein, 10 aa, Japanese encephalitis virus
FQLGLLVVFL

SEQ ID NO: 230760 - protein, 10 aa, Japanese encephalitis virus
QLGLLVVFLA

SEQ ID NO: 230761 - protein, 10 aa, Japanese encephalitis virus
LGLLVVFLAT

SEQ ID NO: 230762 - protein, 10 aa, Japanese encephalitis virus
GLLVVFLATQ

SEQ ID NO: 230763 - protein, 10 aa, Japanese encephalitis virus
LLVVFLATQE

SEQ ID NO: 230764 - protein, 10 aa, Japanese encephalitis virus
LVVFLATQEV

SEQ ID NO: 230765 - protein, 10 aa, Japanese encephalitis virus
VVFLATQEVL

SEQ ID NO: 230766 - protein, 10 aa, Japanese encephalitis virus
VFLATQEVLR

SEQ ID NO: 230767 - protein, 10 aa, Japanese encephalitis virus
FLATQEVFRK

SEQ ID NO: 230768 - protein, 10 aa, Japanese encephalitis virus
LATQEVFRKR

SEQ ID NO: 230769 - protein, 10 aa, Japanese encephalitis virus
ATQEVLGKRW

SEQ ID NO: 230770 - protein, 10 aa, Japanese encephalitis virus
TQEVFRKRWT

SEQ ID NO: 230771 - protein, 10 aa, Japanese encephalitis virus
QEVLGKRWTA

SEQ ID NO: 230772 - protein, 10 aa, Japanese encephalitis virus
EVLGKRWTAR

SEQ ID NO: 230773 - protein, 10 aa, Japanese encephalitis virus
VLGKRWTARL

SEQ ID NO: 230774 - protein, 10 aa, Japanese encephalitis virus
LGKRWTARLT

SEQ ID NO: 230775 - protein, 10 aa, Japanese encephalitis virus
RKRWTARLTV

SEQ ID NO: 230776 - protein, 10 aa, Japanese encephalitis virus
KRWTARLTVP

SEQ ID NO: 230777 - protein, 10 aa, Japanese encephalitis virus
RWTARLTVPA

SEQ ID NO: 230778 - protein, 10 aa, Japanese encephalitis virus
WTARLTVPAV

SEQ ID NO: 230779 - protein, 10 aa, Japanese encephalitis virus
TARLTVPAVL

SEQ ID NO: 230780 - protein, 10 aa, Japanese encephalitis virus
ARLTVPAVLG

SEQ ID NO: 230781 - protein, 10 aa, Japanese encephalitis virus
RLTIPAVLGV

SEQ ID NO: 230782 - protein, 10 aa, Japanese encephalitis virus
LTIPAVLGVL

SEQ ID NO: 230783 - protein, 10 aa, Japanese encephalitis virus
TIPAVLGVLL

SEQ ID NO: 230784 - protein, 10 aa, Japanese encephalitis virus
IPAVLGVLLV

SEQ ID NO: 230785 - protein, 10 aa, Japanese encephalitis virus
PAVLGVLLVL

SEQ ID NO: 230786 - protein, 10 aa, Japanese encephalitis virus
AVLGVLLVLM

SEQ ID NO: 230787 - protein, 10 aa, Japanese encephalitis virus
VLGVLLVLML

SEQ ID NO: 230788 - protein, 10 aa, Japanese encephalitis virus
LGVLLVLMLG

SEQ ID NO: 230789 - protein, 10 aa, Japanese encephalitis virus
GVLLVLMLGG

SEQ ID NO: 230790 - protein, 10 aa, Japanese encephalitis virus
VLLVLMLGGI

SEQ ID NO: 230791 - protein, 10 aa, Japanese encephalitis virus
LLVLMFGGIT

SEQ ID NO: 230792 - protein, 10 aa, Japanese encephalitis virus
LVLMFGGITY

SEQ ID NO: 230793 - protein, 10 aa, Japanese encephalitis virus
VLMLGGITYI

SEQ ID NO: 230794 - protein, 10 aa, Japanese encephalitis virus
LMLGGITYID

SEQ ID NO: 230795 - protein, 10 aa, Japanese encephalitis virus
MLGGITYIDL

SEQ ID NO: 230796 - protein, 10 aa, Japanese encephalitis virus
LGGITYIDLA

SEQ ID NO: 230797 - protein, 10 aa, Japanese encephalitis virus
GGITYIDLAR

SEQ ID NO: 230798 - protein, 10 aa, Japanese encephalitis virus
GITYIDLARY

SEQ ID NO: 230799 - protein, 10 aa, Japanese encephalitis virus
ITYIDLARYV

SEQ ID NO: 230800 - protein, 10 aa, Japanese encephalitis virus
TYIDLARYVV

SEQ ID NO: 230801 - protein, 10 aa, Japanese encephalitis virus
YIDLARYVVL

SEQ ID NO: 230802 - protein, 10 aa, Japanese encephalitis virus
IDLARYVVLV

SEQ ID NO: 230803 - protein, 10 aa, Japanese encephalitis virus
ARYVVLVAAS

SEQ ID NO: 230804 - protein, 10 aa, Japanese encephalitis virus
RYVVLVAASF

SEQ ID NO: 230805 - protein, 10 aa, Japanese encephalitis virus
YVVLVAASFA

SEQ ID NO: 230806 - protein, 10 aa, Japanese encephalitis virus
VVLVAAVFAE

SEQ ID NO: 230807 - protein, 10 aa, Japanese encephalitis virus
VLVAASFAEA

SEQ ID NO: 230808 - protein, 10 aa, Japanese encephalitis virus
LVAAVFAEAN

SEQ ID NO: 230809 - protein, 10 aa, Japanese encephalitis virus
VAAAFAEANN

SEQ ID NO: 230810 - protein, 10 aa, Japanese encephalitis virus
AAAFAEANNG

SEQ ID NO: 230811 - protein, 10 aa, Japanese encephalitis virus
AAFAEANNGG

SEQ ID NO: 230812 - protein, 10 aa, Japanese encephalitis virus
AFAEANNGGD

SEQ ID NO: 230813 - protein, 10 aa, Japanese encephalitis virus
FAEANNGGDV

SEQ ID NO: 230814 - protein, 10 aa, Japanese encephalitis virus
AEANNGGDVL

SEQ ID NO: 230815 - protein, 10 aa, Japanese encephalitis virus
EANNGGDVLH

SEQ ID NO: 230816 - protein, 10 aa, Japanese encephalitis virus
ANNGGDVLHL

SEQ ID NO: 230817 - protein, 10 aa, Japanese encephalitis virus
NNGGDVLHLA

SEQ ID NO: 230818 - protein, 10 aa, Japanese encephalitis virus
NGGDVLHLAL

SEQ ID NO: 230819 - protein, 10 aa, Japanese encephalitis virus
VFKIQPAFLA

SEQ ID NO: 230820 - protein, 10 aa, Japanese encephalitis virus
FKIQPAFLAM

SEQ ID NO: 230821 - protein, 10 aa, Japanese encephalitis virus
KIQPAFLVAN

SEQ ID NO: 230822 - protein, 10 aa, Japanese encephalitis virus
IQPAFLAMKM

SEQ ID NO: 230823 - protein, 10 aa, Japanese encephalitis virus
QPAFLVANML

SEQ ID NO: 230824 - protein, 10 aa, Japanese encephalitis virus
PAFLVANMLS

SEQ ID NO: 230825 - protein, 10 aa, Japanese encephalitis virus
AFLVMNMLSA

SEQ ID NO: 230826 - protein, 10 aa, Japanese encephalitis virus
NMLSARWTNQ

SEQ ID NO: 230827 - protein, 10 aa, Japanese encephalitis virus
MLSARWTNQE

SEQ ID NO: 230828 - protein, 10 aa, Japanese encephalitis virus
LSARWTNQEN

SEQ ID NO: 230829 - protein, 10 aa, Japanese encephalitis virus
SARWTNQENV

SEQ ID NO: 230830 - protein, 10 aa, Japanese encephalitis virus
ARWTNQENVV

SEQ ID NO: 230831 - protein, 10 aa, Japanese encephalitis virus
RWTNQENVAL

SEQ ID NO: 230832 - protein, 10 aa, Japanese encephalitis virus
WTNQENVALV

SEQ ID NO: 230833 - protein, 10 aa, Japanese encephalitis virus
TNQENVALVL

SEQ ID NO: 230834 - protein, 10 aa, Japanese encephalitis virus
NQENVALVLG

SEQ ID NO: 230835 - protein, 10 aa, Japanese encephalitis virus
QENVALVLGA

SEQ ID NO: 230836 - protein, 10 aa, Japanese encephalitis virus
ENVALVLGAA

SEQ ID NO: 230837 - protein, 10 aa, Japanese encephalitis virus
NVALVLGAAF

SEQ ID NO: 230838 - protein, 10 aa, Japanese encephalitis virus
VALVLGAAFF

SEQ ID NO: 230839 - protein, 10 aa, Japanese encephalitis virus
ALVLGAAFFQ

SEQ ID NO: 230840 - protein, 10 aa, Japanese encephalitis virus
LVLGAALFQL

SEQ ID NO: 230841 - protein, 10 aa, Japanese encephalitis virus
VLGAALFQLA

SEQ ID NO: 230842 - protein, 10 aa, Japanese encephalitis virus
LGAALFQLAS

SEQ ID NO: 230843 - protein, 10 aa, Japanese encephalitis virus
GAAFFQLASA

SEQ ID NO: 230844 - protein, 10 aa, Japanese encephalitis virus
AAFFQLASAD

SEQ ID NO: 230845 - protein, 10 aa, Japanese encephalitis virus
AFFQLASADL

SEQ ID NO: 230846 - protein, 10 aa, Japanese encephalitis virus
FFQLASADLQ

SEQ ID NO: 230847 - protein, 10 aa, Japanese encephalitis virus
FQLASADLQI

SEQ ID NO: 230848 - protein, 10 aa, Japanese encephalitis virus
QLASADLQIG

SEQ ID NO: 230849 - protein, 10 aa, Japanese encephalitis virus
LASADLQIGV

SEQ ID NO: 230850 - protein, 10 aa, Japanese encephalitis virus
ASADLQIGVH

SEQ ID NO: 230851 - protein, 10 aa, Japanese encephalitis virus
SADLQIGVHG

SEQ ID NO: 230852 - protein, 10 aa, Japanese encephalitis virus
ADLQIGVHGI

SEQ ID NO: 230853 - protein, 10 aa, Japanese encephalitis virus
DLQIGVHGML

SEQ ID NO: 230854 - protein, 10 aa, Japanese encephalitis virus
LQIGVHGMLN

SEQ ID NO: 230855 - protein, 10 aa, Japanese encephalitis virus
QIGVHGMLNA

SEQ ID NO: 230856 - protein, 10 aa, Japanese encephalitis virus
IGVHGMLNAA

SEQ ID NO: 230857 - protein, 10 aa, Japanese encephalitis virus
GVHGMLNAAA

SEQ ID NO: 230858 - protein, 10 aa, Japanese encephalitis virus
VHGILNAAAM

SEQ ID NO: 230859 - protein, 10 aa, Japanese encephalitis virus
HGMLNAAAIA

SEQ ID NO: 230860 - protein, 10 aa, Japanese encephalitis virus
GMLNAAAIAW

SEQ ID NO: 230861 - protein, 10 aa, Japanese encephalitis virus
MLNAAAIAWM

SEQ ID NO: 230862 - protein, 10 aa, Japanese encephalitis virus
LNAAAMAWMI

SEQ ID NO: 230863 - protein, 10 aa, Japanese encephalitis virus
NAAAMAWMIV

SEQ ID NO: 230864 - protein, 10 aa, Japanese encephalitis virus
AAAMAWMIVR

SEQ ID NO: 230865 - protein, 10 aa, Japanese encephalitis virus
AAIAWMIIKA

SEQ ID NO: 230866 - protein, 10 aa, Japanese encephalitis virus
AMAWMIVRAI

SEQ ID NO: 230867 - protein, 10 aa, Japanese encephalitis virus
MAWMIVRAIT

SEQ ID NO: 230868 - protein, 10 aa, Japanese encephalitis virus
AWMIIKAITF

SEQ ID NO: 230869 - protein, 10 aa, Japanese encephalitis virus
WMIIKAITFP

SEQ ID NO: 230870 - protein, 10 aa, Japanese encephalitis virus
MIIKAITFPT

SEQ ID NO: 230871 - protein, 10 aa, Japanese encephalitis virus
IVRAITFPTA

SEQ ID NO: 230872 - protein, 10 aa, Japanese encephalitis virus
VRAITFPTAS

SEQ ID NO: 230873 - protein, 10 aa, Japanese encephalitis virus
RAITFPTTST

SEQ ID NO: 230874 - protein, 10 aa, Japanese encephalitis virus
AITFPTTSTV

SEQ ID NO: 230875 - protein, 10 aa, Japanese encephalitis virus
ITFPTTSTVA

SEQ ID NO: 230876 - protein, 10 aa, Japanese encephalitis virus
TFPTTSTVAM

SEQ ID NO: 230877 - protein, 10 aa, Japanese encephalitis virus
FPTTSTVAMP

SEQ ID NO: 230878 - protein, 10 aa, Japanese encephalitis virus
MPILALLTPG

SEQ ID NO: 230879 - protein, 10 aa, Japanese encephalitis virus
PILALLTPGM

SEQ ID NO: 230880 - protein, 10 aa, Japanese encephalitis virus
ILALLTPGMR

SEQ ID NO: 230881 - protein, 10 aa, Japanese encephalitis virus
LALLAPGMRA

SEQ ID NO: 230882 - protein, 10 aa, Japanese encephalitis virus
ALLAPGMRAL

SEQ ID NO: 230883 - protein, 10 aa, Japanese encephalitis virus
LLAPGMRALY

SEQ ID NO: 230884 - protein, 10 aa, Japanese encephalitis virus
LTPGMKALYL

SEQ ID NO: 230885 - protein, 10 aa, Japanese encephalitis virus
TPGMKALYLD

SEQ ID NO: 230886 - protein, 10 aa, Japanese encephalitis virus
PGMRAFDLDT

SEQ ID NO: 230887 - protein, 10 aa, Japanese encephalitis virus
GMRAFDLDTY

SEQ ID NO: 230888 - protein, 10 aa, Japanese encephalitis virus
MRALCLDTYR

SEQ ID NO: 230889 - protein, 10 aa, Japanese encephalitis virus
KALYLDTYRI

SEQ ID NO: 230890 - protein, 10 aa, Japanese encephalitis virus
AFDLDTYRII

SEQ ID NO: 230891 - protein, 10 aa, Japanese encephalitis virus
FDLDTYRIIL

SEQ ID NO: 230892 - protein, 10 aa, Japanese encephalitis virus
DLDTYRIILL

SEQ ID NO: 230893 - protein, 10 aa, Japanese encephalitis virus
LDTYRIILLI

SEQ ID NO: 230894 - protein, 10 aa, Japanese encephalitis virus
DTYRIILLII

SEQ ID NO: 230895 - protein, 10 aa, Japanese encephalitis virus
TYRIILLIIG

SEQ ID NO: 230896 - protein, 10 aa, Japanese encephalitis virus
YRIILLVIGV

SEQ ID NO: 230897 - protein, 10 aa, Japanese encephalitis virus
RIILLVIGVC

SEQ ID NO: 230898 - protein, 10 aa, Japanese encephalitis virus
IILLVIGVCS

SEQ ID NO: 230899 - protein, 10 aa, Japanese encephalitis virus
ILLVIGVCSL

SEQ ID NO: 230900 - protein, 10 aa, Japanese encephalitis virus
LLVIGVCSLL

SEQ ID NO: 230901 - protein, 10 aa, Japanese encephalitis virus
LVIGICSLLH

SEQ ID NO: 230902 - protein, 10 aa, Japanese encephalitis virus
VIGICSLLHE

SEQ ID NO: 230903 - protein, 10 aa, Japanese encephalitis virus
IGICSLLHER

SEQ ID NO: 230904 - protein, 10 aa, Japanese encephalitis virus
ERRKTMAKKK

SEQ ID NO: 230905 - protein, 10 aa, Japanese encephalitis virus
RRKTMAKKKG

SEQ ID NO: 230906 - protein, 10 aa, Japanese encephalitis virus
RKTMAKKKGA

SEQ ID NO: 230907 - protein, 10 aa, Japanese encephalitis virus
KAMAKKKGAV

SEQ ID NO: 230908 - protein, 10 aa, Japanese encephalitis virus
AMAKKKGAVL

SEQ ID NO: 230909 - protein, 10 aa, Japanese encephalitis virus
MAKKKGAVLM

SEQ ID NO: 230910 - protein, 10 aa, Japanese encephalitis virus
AKKKGAVLMG

SEQ ID NO: 230911 - protein, 10 aa, Japanese encephalitis virus
KKKGAVLMGL

SEQ ID NO: 230912 - protein, 10 aa, Japanese encephalitis virus
KKGAVLMGLA

SEQ ID NO: 230913 - protein, 10 aa, Japanese encephalitis virus
KGAVLMGLAL

SEQ ID NO: 230914 - protein, 10 aa, Japanese encephalitis virus
GAVLMGLALT

SEQ ID NO: 230915 - protein, 10 aa, Japanese encephalitis virus
AVLMGLALTS

SEQ ID NO: 230916 - protein, 10 aa, Japanese encephalitis virus
VLMGLALTST

SEQ ID NO: 230917 - protein, 10 aa, Japanese encephalitis virus
LMGLALTSTG

SEQ ID NO: 230918 - protein, 10 aa, Japanese encephalitis virus
MGLALTSTGW

SEQ ID NO: 230919 - protein, 10 aa, Japanese encephalitis virus
TGWFSPTTIT

SEQ ID NO: 230920 - protein, 10 aa, Japanese encephalitis virus
GWFSPTTITA

SEQ ID NO: 230921 - protein, 10 aa, Japanese encephalitis virus
WFSPTTITAG

SEQ ID NO: 230922 - protein, 10 aa, Japanese encephalitis virus
FSPTTITAGL

SEQ ID NO: 230923 - protein, 10 aa, Japanese encephalitis virus
SPTTITAGLM

SEQ ID NO: 230924 - protein, 10 aa, Japanese encephalitis virus
PTTITAGLMV

SEQ ID NO: 230925 - protein, 10 aa, Japanese encephalitis virus
TTIAAGLMAC

SEQ ID NO: 230926 - protein, 10 aa, Japanese encephalitis virus
TITAGLMVCN

SEQ ID NO: 230927 - protein, 10 aa, Japanese encephalitis virus
IAAGLMACNP

SEQ ID NO: 230928 - protein, 10 aa, Japanese encephalitis virus
TAGLMVCNPN

SEQ ID NO: 230929 - protein, 10 aa, Japanese encephalitis virus
AGLMACNPNK

SEQ ID NO: 230930 - protein, 10 aa, Japanese encephalitis virus
GLMACNPNKK

SEQ ID NO: 230931 - protein, 10 aa, Japanese encephalitis virus
LMACNPNKKR

SEQ ID NO: 230932 - protein, 10 aa, Japanese encephalitis virus
MACNPNKKRG

SEQ ID NO: 230933 - protein, 10 aa, Japanese encephalitis virus
ACNPNKKRGW

SEQ ID NO: 230934 - protein, 10 aa, Japanese encephalitis virus
KKRGWPATEV

SEQ ID NO: 230935 - protein, 10 aa, Japanese encephalitis virus
KRGWPATEVL

SEQ ID NO: 230936 - protein, 10 aa, Japanese encephalitis virus
RGWPATEVLS

SEQ ID NO: 230937 - protein, 10 aa, Japanese encephalitis virus
GWPATEVLSA

SEQ ID NO: 230938 - protein, 10 aa, Japanese encephalitis virus
WPATEFLSAI

SEQ ID NO: 230939 - protein, 10 aa, Japanese encephalitis virus
PATEFLSAIG

SEQ ID NO: 230940 - protein, 10 aa, Japanese encephalitis virus
ATEFLSAIGL

SEQ ID NO: 230941 - protein, 10 aa, Japanese encephalitis virus
TEFLSAIGLM

SEQ ID NO: 230942 - protein, 10 aa, Japanese encephalitis virus
EFLSAIGLMF

SEQ ID NO: 230943 - protein, 10 aa, Japanese encephalitis virus
FLSAIGLMFA

SEQ ID NO: 230944 - protein, 10 aa, Japanese encephalitis virus
LSAIGLMFAI

SEQ ID NO: 230945 - protein, 10 aa, Japanese encephalitis virus
SAIGLMFAIV

SEQ ID NO: 230946 - protein, 10 aa, Japanese encephalitis virus
AIGLMFAIVG

SEQ ID NO: 230947 - protein, 10 aa, Japanese encephalitis virus
IGLMFAIVGG

SEQ ID NO: 230948 - protein, 10 aa, Japanese encephalitis virus
FAIVGGLAEM

SEQ ID NO: 230949 - protein, 10 aa, Japanese encephalitis virus
AIVGGLAEMD

SEQ ID NO: 230950 - protein, 10 aa, Japanese encephalitis virus
IVGGLAEMDI

SEQ ID NO: 230951 - protein, 10 aa, Japanese encephalitis virus
VGGLAEMDIE

SEQ ID NO: 230952 - protein, 10 aa, Japanese encephalitis virus
GGLAEMDIES

SEQ ID NO: 230953 - protein, 10 aa, Japanese encephalitis virus
GLAEMDIESM

SEQ ID NO: 230954 - protein, 10 aa, Japanese encephalitis virus
LAEMDIESMS

SEQ ID NO: 230955 - protein, 10 aa, Japanese encephalitis virus
AEMDIESMSI

SEQ ID NO: 230956 - protein, 10 aa, Japanese encephalitis virus
EMDIESMSIP

SEQ ID NO: 230957 - protein, 10 aa, Japanese encephalitis virus
MDIESMSIPF

SEQ ID NO: 230958 - protein, 10 aa, Japanese encephalitis virus
SMSIPFMLAV

SEQ ID NO: 230959 - protein, 10 aa, Japanese encephalitis virus
MSIPFMLAVL

SEQ ID NO: 230960 - protein, 10 aa, Japanese encephalitis virus
SIPFMLAVLM

SEQ ID NO: 230961 - protein, 10 aa, Japanese encephalitis virus
IPFMLAVLMA

SEQ ID NO: 230962 - protein, 10 aa, Japanese encephalitis virus
PFMLAVLMAV

SEQ ID NO: 230963 - protein, 10 aa, Japanese encephalitis virus
FMLAVLMAVS

SEQ ID NO: 230964 - protein, 10 aa, Japanese encephalitis virus
MLAVLMAVSY

SEQ ID NO: 230965 - protein, 10 aa, Japanese encephalitis virus
LAVLMAVSYV

SEQ ID NO: 230966 - protein, 10 aa, Japanese encephalitis virus
AVLMAVSYVV

SEQ ID NO: 230967 - protein, 10 aa, Japanese encephalitis virus
VLMAVSYVVS

SEQ ID NO: 230968 - protein, 10 aa, Japanese encephalitis virus
SGKATDMWLD

SEQ ID NO: 230969 - protein, 10 aa, Japanese encephalitis virus
GKATDMWLDR

SEQ ID NO: 230970 - protein, 10 aa, Japanese encephalitis virus
KATDMWLDRA

SEQ ID NO: 230971 - protein, 10 aa, Japanese encephalitis virus
ATDMWLDRAA

SEQ ID NO: 230972 - protein, 10 aa, Japanese encephalitis virus
TDMWLDRAAD

SEQ ID NO: 230973 - protein, 10 aa, Japanese encephalitis virus
DMWLDRAADI

SEQ ID NO: 230974 - protein, 10 aa, Japanese encephalitis virus
MWLDRAADIS

SEQ ID NO: 230975 - protein, 10 aa, Japanese encephalitis virus
WLDRAADISW

SEQ ID NO: 230976 - protein, 10 aa, Japanese encephalitis virus
SWEMEAAITG

SEQ ID NO: 230977 - protein, 10 aa, Japanese encephalitis virus
WEMEAAITGS

SEQ ID NO: 230978 - protein, 10 aa, Japanese encephalitis virus
EMEAAITGSS

SEQ ID NO: 230979 - protein, 10 aa, Japanese encephalitis virus
MEAAITGSSR

SEQ ID NO: 230980 - protein, 10 aa, Japanese encephalitis virus
EAAITGSSRR

SEQ ID NO: 230981 - protein, 10 aa, Japanese encephalitis virus
SRRLDVKLDE

SEQ ID NO: 230982 - protein, 10 aa, Japanese encephalitis virus
RRLDVKLDED

SEQ ID NO: 230983 - protein, 10 aa, Japanese encephalitis virus
RLDVKLDEDG

SEQ ID NO: 230984 - protein, 10 aa, Japanese encephalitis virus
LDVKLDEDGD

SEQ ID NO: 230985 - protein, 10 aa, Japanese encephalitis virus
DVKLDEDGDF

SEQ ID NO: 230986 - protein, 10 aa, Japanese encephalitis virus
VKLDEDGDFH

SEQ ID NO: 230987 - protein, 10 aa, Japanese encephalitis virus
KLDEDGDFHL

SEQ ID NO: 230988 - protein, 10 aa, Japanese encephalitis virus
LDEDGDFHLI

SEQ ID NO: 230989 - protein, 10 aa, Japanese encephalitis virus
DEDGDFHLID

SEQ ID NO: 230990 - protein, 10 aa, Japanese encephalitis virus
EDGDFHLIDD

SEQ ID NO: 230991 - protein, 10 aa, Japanese encephalitis virus
DGDFHFIDDP

SEQ ID NO: 230992 - protein, 10 aa, Japanese encephalitis virus
GDFHLIDVPG

SEQ ID NO: 230993 - protein, 10 aa, Japanese encephalitis virus
DFHLIDVPGV

SEQ ID NO: 230994 - protein, 10 aa, Japanese encephalitis virus
FHFIDDPGVP

SEQ ID NO: 230995 - protein, 10 aa, Japanese encephalitis virus
HFIDDPGVPW

SEQ ID NO: 230996 - protein, 10 aa, Japanese encephalitis virus
LIDVPGVPWK

SEQ ID NO: 230997 - protein, 10 aa, Japanese encephalitis virus
IDVPGVPWKV

SEQ ID NO: 230998 - protein, 10 aa, Japanese encephalitis virus
DVPGVPWKVW

SEQ ID NO: 230999 - protein, 10 aa, Japanese encephalitis virus
DPGVPWKVWL

SEQ ID NO: 231000 - protein, 10 aa, Japanese encephalitis virus
PGVPWKVWLL

SEQ ID NO: 231001 - protein, 10 aa, Japanese encephalitis virus
GVPWKVWLLR

SEQ ID NO: 231002 - protein, 10 aa, Japanese encephalitis virus
VPWKVWLLRM

SEQ ID NO: 231003 - protein, 10 aa, Japanese encephalitis virus
PWKVWLLRMS

SEQ ID NO: 231004 - protein, 10 aa, Japanese encephalitis virus
WKVWLLRMSC

SEQ ID NO: 231005 - protein, 10 aa, Japanese encephalitis virus
KVWLLRMSCI

SEQ ID NO: 231006 - protein, 10 aa, Japanese encephalitis virus
WLLRMSCIGL

SEQ ID NO: 231007 - protein, 10 aa, Japanese encephalitis virus
LRTSCIGLAA

SEQ ID NO: 231008 - protein, 10 aa, Japanese encephalitis virus
RMSCICLAAL

SEQ ID NO: 231009 - protein, 10 aa, Japanese encephalitis virus
MSCSGLAALT

SEQ ID NO: 231010 - protein, 10 aa, Japanese encephalitis virus
SCIGLVALTP

SEQ ID NO: 231011 - protein, 10 aa, Japanese encephalitis virus
CIGLVALTPW

SEQ ID NO: 231012 - protein, 10 aa, Japanese encephalitis virus
SGLAALTPWA

SEQ ID NO: 231013 - protein, 10 aa, Japanese encephalitis virus
CLAALTPWAI

SEQ ID NO: 231014 - protein, 10 aa, Japanese encephalitis virus
LVALTPWAIV

SEQ ID NO: 231015 - protein, 10 aa, Japanese encephalitis virus
VALTPWAIVP

SEQ ID NO: 231016 - protein, 10 aa, Japanese encephalitis virus
WDTPSPKPCL

SEQ ID NO: 231017 - protein, 10 aa, Japanese encephalitis virus
DTPSPKPCLK

SEQ ID NO: 231018 - protein, 10 aa, Japanese encephalitis virus
TPSPKPCLKG

SEQ ID NO: 231019 - protein, 10 aa, Japanese encephalitis virus
PSPKPCLKGD

SEQ ID NO: 231020 - protein, 10 aa, Japanese encephalitis virus
SPKPCLKGDT

SEQ ID NO: 231021 - protein, 10 aa, Japanese encephalitis virus
PKPCLKGDTT

SEQ ID NO: 231022 - protein, 10 aa, Japanese encephalitis virus
KPCLKGDTTT

SEQ ID NO: 231023 - protein, 10 aa, Japanese encephalitis virus
PCLKGDTTTG

SEQ ID NO: 231024 - protein, 10 aa, Japanese encephalitis virus
CLKGDTTTGV

SEQ ID NO: 231025 - protein, 10 aa, Japanese encephalitis virus
LKGDTTTGVY

SEQ ID NO: 231026 - protein, 10 aa, Japanese encephalitis virus
TTGVYRIMAC

SEQ ID NO: 231027 - protein, 10 aa, Japanese encephalitis virus
TGVYRIMACG

SEQ ID NO: 231028 - protein, 10 aa, Japanese encephalitis virus
GVYRIMACGI

SEQ ID NO: 231029 - protein, 10 aa, Japanese encephalitis virus
VYRIMACGIL

SEQ ID NO: 231030 - protein, 10 aa, Japanese encephalitis virus
YRIMACGILG

SEQ ID NO: 231031 - protein, 10 aa, Japanese encephalitis virus
RIMACGILGT

SEQ ID NO: 231032 - protein, 10 aa, Japanese encephalitis virus
IMARGIFGTH

SEQ ID NO: 231033 - protein, 10 aa, Japanese encephalitis virus
MACGILGTYQ

SEQ ID NO: 231034 - protein, 10 aa, Japanese encephalitis virus
ACGILGTYQS

SEQ ID NO: 231035 - protein, 10 aa, Japanese encephalitis virus
RGIFGTHQAG

SEQ ID NO: 231036 - protein, 10 aa, Japanese encephalitis virus
GIFGTHQAGV

SEQ ID NO: 231037 - protein, 10 aa, Japanese encephalitis virus
ILGTYQSGVG

SEQ ID NO: 231038 - protein, 10 aa, Japanese encephalitis virus
FGTHQAGVGV

SEQ ID NO: 231039 - protein, 10 aa, Japanese encephalitis virus
GTYQSGVGVI

SEQ ID NO: 231040 - protein, 10 aa, Japanese encephalitis virus
THQAGVGVMY

SEQ ID NO: 231041 - protein, 10 aa, Japanese encephalitis virus
HQAGVGVMYE

SEQ ID NO: 231042 - protein, 10 aa, Japanese encephalitis virus
QAGVGVMYQN

SEQ ID NO: 231043 - protein, 10 aa, Japanese encephalitis virus
SGVGVIYENV

SEQ ID NO: 231044 - protein, 10 aa, Japanese encephalitis virus
GVGVMYENVL

SEQ ID NO: 231045 - protein, 10 aa, Japanese encephalitis virus
VGVMYESVFH

SEQ ID NO: 231046 - protein, 10 aa, Japanese encephalitis virus
GVMYESVFHT

SEQ ID NO: 231047 - protein, 10 aa, Japanese encephalitis virus
VMYENVLHTL

SEQ ID NO: 231048 - protein, 10 aa, Japanese encephalitis virus
MYQNVFHTLW

SEQ ID NO: 231049 - protein, 10 aa, Japanese encephalitis virus
YENVLHTLWH

SEQ ID NO: 231050 - protein, 10 aa, Japanese encephalitis virus
QNVFHTLWHT

SEQ ID NO: 231051 - protein, 10 aa, Japanese encephalitis virus
NVLHTLWHTT

SEQ ID NO: 231052 - protein, 10 aa, Japanese encephalitis virus
VFHTLWHPTR

SEQ ID NO: 231053 - protein, 10 aa, Japanese encephalitis virus
FHTLWHPTRG

SEQ ID NO: 231054 - protein, 10 aa, Japanese encephalitis virus
HTLWHPTRGA

SEQ ID NO: 231055 - protein, 10 aa, Japanese encephalitis virus
TLWHPTRGAA

SEQ ID NO: 231056 - protein, 10 aa, Japanese encephalitis virus
LWHTTRGAAV

SEQ ID NO: 231057 - protein, 10 aa, Japanese encephalitis virus
WHTTRGAAIV

SEQ ID NO: 231058 - protein, 10 aa, Japanese encephalitis virus
HTTRGAAIVS

SEQ ID NO: 231059 - protein, 10 aa, Japanese encephalitis virus
TTRGAAIVSG

SEQ ID NO: 231060 - protein, 10 aa, Japanese encephalitis virus
TRGAAIVSGE

SEQ ID NO: 231061 - protein, 10 aa, Japanese encephalitis virus
RGAAIVSGEG

SEQ ID NO: 231062 - protein, 10 aa, Japanese encephalitis virus
GAAIVSGEGK

SEQ ID NO: 231063 - protein, 10 aa, Japanese encephalitis virus
AAIVSGEGKL

SEQ ID NO: 231064 - protein, 10 aa, Japanese encephalitis virus
AIVSGEGKLT

SEQ ID NO: 231065 - protein, 10 aa, Japanese encephalitis virus
IVSGEGKLTP

SEQ ID NO: 231066 - protein, 10 aa, Japanese encephalitis virus
VSGEGKLTPY

SEQ ID NO: 231067 - protein, 10 aa, Japanese encephalitis virus
SGKGKLTPYW

SEQ ID NO: 231068 - protein, 10 aa, Japanese encephalitis virus
GGGKLTPYWG

SEQ ID NO: 231069 - protein, 10 aa, Japanese encephalitis virus
KGKLTPYWGS

SEQ ID NO: 231070 - protein, 10 aa, Japanese encephalitis virus
KLTPYWGSVR

SEQ ID NO: 231071 - protein, 10 aa, Japanese encephalitis virus
LTPYWGSVRE

SEQ ID NO: 231072 - protein, 10 aa, Japanese encephalitis virus
TPYWGSVRED

SEQ ID NO: 231073 - protein, 10 aa, Japanese encephalitis virus
PYWGSVREDR

SEQ ID NO: 231074 - protein, 10 aa, Japanese encephalitis virus
YWGSVREDRI

SEQ ID NO: 231075 - protein, 10 aa, Japanese encephalitis virus
WGSVKEDRIS

SEQ ID NO: 231076 - protein, 10 aa, Japanese encephalitis virus
GSVKEDRISY

SEQ ID NO: 231077 - protein, 10 aa, Japanese encephalitis virus
SVKEDRISYG

SEQ ID NO: 231078 - protein, 10 aa, Japanese encephalitis virus
VKEDRISYGG

SEQ ID NO: 231079 - protein, 10 aa, Japanese encephalitis virus
KEDRISYGGP

SEQ ID NO: 231080 - protein, 10 aa, Japanese encephalitis virus
EDRISYGGPW

SEQ ID NO: 231081 - protein, 10 aa, Japanese encephalitis virus
DRISYGGPWR

SEQ ID NO: 231082 - protein, 10 aa, Japanese encephalitis virus
RISYGGPWRF

SEQ ID NO: 231083 - protein, 10 aa, Japanese encephalitis virus
ISYGGPWRFD

SEQ ID NO: 231084 - protein, 10 aa, Japanese encephalitis virus
SYGGPWRFDR

SEQ ID NO: 231085 - protein, 10 aa, Japanese encephalitis virus
RFDRKWNGTN

SEQ ID NO: 231086 - protein, 10 aa, Japanese encephalitis virus
FDRKWNGTND

SEQ ID NO: 231087 - protein, 10 aa, Japanese encephalitis virus
DRKWNGTNDV

SEQ ID NO: 231088 - protein, 10 aa, Japanese encephalitis virus
RKWNGTNDVQ

SEQ ID NO: 231089 - protein, 10 aa, Japanese encephalitis virus
KWNGTNDVQV

SEQ ID NO: 231090 - protein, 10 aa, Japanese encephalitis virus
WNGTNDVQVI

SEQ ID NO: 231091 - protein, 10 aa, Japanese encephalitis virus
NGTNDVQVIV

SEQ ID NO: 231092 - protein, 10 aa, Japanese encephalitis virus
GTNDVQVIVV

SEQ ID NO: 231093 - protein, 10 aa, Japanese encephalitis virus
TNDVQVIVVE

SEQ ID NO: 231094 - protein, 10 aa, Japanese encephalitis virus
DDVQVIVVEQ

SEQ ID NO: 231095 - protein, 10 aa, Japanese encephalitis virus
DVQVIVVEQG

SEQ ID NO: 231096 - protein, 10 aa, Japanese encephalitis virus
VQVIVVEQGK

SEQ ID NO: 231097 - protein, 10 aa, Japanese encephalitis virus
QVIVVEPGKP

SEQ ID NO: 231098 - protein, 10 aa, Japanese encephalitis virus
VIVVEPGKPA

SEQ ID NO: 231099 - protein, 10 aa, Japanese encephalitis virus
NIQTKPGIFP

SEQ ID NO: 231100 - protein, 10 aa, Japanese encephalitis virus
FQTKPGVFRT

SEQ ID NO: 231101 - protein, 10 aa, Japanese encephalitis virus
QTKPGVFCTP

SEQ ID NO: 231102 - protein, 10 aa, Japanese encephalitis virus
TKPGIFPTPF

SEQ ID NO: 231103 - protein, 10 aa, Japanese encephalitis virus
KPGVFRTPLG

SEQ ID NO: 231104 - protein, 10 aa, Japanese encephalitis virus
PFGEIGAVSL

SEQ ID NO: 231105 - protein, 10 aa, Japanese encephalitis virus
FGEIGAVSLD

SEQ ID NO: 231106 - protein, 10 aa, Japanese encephalitis virus
GEIGAVSLDY

SEQ ID NO: 231107 - protein, 10 aa, Japanese encephalitis virus
EIGAVSLDYP

SEQ ID NO: 231108 - protein, 10 aa, Japanese encephalitis virus
IGAVSLDYPR

SEQ ID NO: 231109 - protein, 10 aa, Japanese encephalitis virus
GTVSLDYPRG

SEQ ID NO: 231110 - protein, 10 aa, Japanese encephalitis virus
TVSLDYPRGT

SEQ ID NO: 231111 - protein, 10 aa, Japanese encephalitis virus
RGTSGSPILN

SEQ ID NO: 231112 - protein, 10 aa, Japanese encephalitis virus
GTSGSPILNS

SEQ ID NO: 231113 - protein, 10 aa, Japanese encephalitis virus
TSGSPILNSN

SEQ ID NO: 231114 - protein, 10 aa, Japanese encephalitis virus
SGSPILNSNG

SEQ ID NO: 231115 - protein, 10 aa, Japanese encephalitis virus
GSPILDFNGD

SEQ ID NO: 231116 - protein, 10 aa, Japanese encephalitis virus
SPILDFNGDI

SEQ ID NO: 231117 - protein, 10 aa, Japanese encephalitis virus
PILDFNGDII

SEQ ID NO: 231118 - protein, 10 aa, Japanese encephalitis virus
ILDFNGDIIG

SEQ ID NO: 231119 - protein, 10 aa, Japanese encephalitis virus
LDFNGDIIGL

SEQ ID NO: 231120 - protein, 10 aa, Japanese encephalitis virus
NSNGDVVGCL

SEQ ID NO: 231121 - protein, 10 aa, Japanese encephalitis virus
SNGDVVGCLG

SEQ ID NO: 231122 - protein, 10 aa, Japanese encephalitis virus
NGDVVGCLGN

SEQ ID NO: 231123 - protein, 10 aa, Japanese encephalitis virus
GDVVGCLGNG

SEQ ID NO: 231124 - protein, 10 aa, Japanese encephalitis virus
DVVGCLGNGV

SEQ ID NO: 231125 - protein, 10 aa, Japanese encephalitis virus
IIGLYGNGGE

SEQ ID NO: 231126 - protein, 10 aa, Japanese encephalitis virus
IGLYGNGGEL

SEQ ID NO: 231127 - protein, 10 aa, Japanese encephalitis virus
GLYGNGGELG

SEQ ID NO: 231128 - protein, 10 aa, Japanese encephalitis virus
CLGNGVELGD

SEQ ID NO: 231129 - protein, 10 aa, Japanese encephalitis virus
LGNGVELGDG

SEQ ID NO: 231130 - protein, 10 aa, Japanese encephalitis virus
GNGVELGDRS

SEQ ID NO: 231131 - protein, 10 aa, Japanese encephalitis virus
NGGELGDGSY

SEQ ID NO: 231132 - protein, 10 aa, Japanese encephalitis virus
GGELGDGSYV

SEQ ID NO: 231133 - protein, 10 aa, Japanese encephalitis virus
GELGDGSYVS

SEQ ID NO: 231134 - protein, 10 aa, Japanese encephalitis virus
ELGDRSYVSA

SEQ ID NO: 231135 - protein, 10 aa, Japanese encephalitis virus
LGDRSYVSAI

SEQ ID NO: 231136 - protein, 10 aa, Japanese encephalitis virus
GDRSYVSAIV

SEQ ID NO: 231137 - protein, 10 aa, Japanese encephalitis virus
DRSYVSAIVQ

SEQ ID NO: 231138 - protein, 10 aa, Japanese encephalitis virus
RSYVSAIVQG

SEQ ID NO: 231139 - protein, 10 aa, Japanese encephalitis virus
SYVSAIVQGE

SEQ ID NO: 231140 - protein, 10 aa, Japanese encephalitis virus
YVSAIVQGER

SEQ ID NO: 231141 - protein, 10 aa, Japanese encephalitis virus
VSAIVQGERQ

SEQ ID NO: 231142 - protein, 10 aa, Japanese encephalitis virus
SAIVQGERQE

SEQ ID NO: 231143 - protein, 10 aa, Japanese encephalitis virus
AIVQGERQEE

SEQ ID NO: 231144 - protein, 10 aa, Japanese encephalitis virus
IVQGERQEEP

SEQ ID NO: 231145 - protein, 10 aa, Japanese encephalitis virus
VQGERQEEPV

SEQ ID NO: 231146 - protein, 10 aa, Japanese encephalitis virus
QGERQEEPVP

SEQ ID NO: 231147 - protein, 10 aa, Japanese encephalitis virus
GDRQEEPVPD

SEQ ID NO: 231148 - protein, 10 aa, Japanese encephalitis virus
DRQEEPVPDA

SEQ ID NO: 231149 - protein, 10 aa, Japanese encephalitis virus
RQEEPVPDAY

SEQ ID NO: 231150 - protein, 10 aa, Japanese encephalitis virus
QEEPVPDAYT

SEQ ID NO: 231151 - protein, 10 aa, Japanese encephalitis virus
EEPVPDAYTP

SEQ ID NO: 231152 - protein, 10 aa, Japanese encephalitis virus
EPVPDAYTPS

SEQ ID NO: 231153 - protein, 10 aa, Japanese encephalitis virus
PVPDAYTPSM

SEQ ID NO: 231154 - protein, 10 aa, Japanese encephalitis virus
VPDAYTPSML

SEQ ID NO: 231155 - protein, 10 aa, Japanese encephalitis virus
MLKKRQMTVL

SEQ ID NO: 231156 - protein, 10 aa, Japanese encephalitis virus
LKKRQMTVLD

SEQ ID NO: 231157 - protein, 10 aa, Japanese encephalitis virus
KKRQMTVLDL

SEQ ID NO: 231158 - protein, 10 aa, Japanese encephalitis virus
KRQLTVLDLH

SEQ ID NO: 231159 - protein, 10 aa, Japanese encephalitis virus
RQLTVLDLHP

SEQ ID NO: 231160 - protein, 10 aa, Japanese encephalitis virus
QLTVLDLHPG

SEQ ID NO: 231161 - protein, 10 aa, Japanese encephalitis virus
LTVLDLHPGS

SEQ ID NO: 231162 - protein, 10 aa, Japanese encephalitis virus
TVLDLPPGSG

SEQ ID NO: 231163 - protein, 10 aa, Japanese encephalitis virus
VLDLHPGLGK

SEQ ID NO: 231164 - protein, 10 aa, Japanese encephalitis virus
LDLHPGLGKT

SEQ ID NO: 231165 - protein, 10 aa, Japanese encephalitis virus
DLHPGSGKTK

SEQ ID NO: 231166 - protein, 10 aa, Japanese encephalitis virus
LHPGSGKTKK

SEQ ID NO: 231167 - protein, 10 aa, Japanese encephalitis virus
HPGSGKTKKI

SEQ ID NO: 231168 - protein, 10 aa, Japanese encephalitis virus
PGSGKTKKIL

SEQ ID NO: 231169 - protein, 10 aa, Japanese encephalitis virus
GSGKTKKILP

SEQ ID NO: 231170 - protein, 10 aa, Japanese encephalitis virus
SGKTKKILPQ

SEQ ID NO: 231171 - protein, 10 aa, Japanese encephalitis virus
GKTKKILPQI

SEQ ID NO: 231172 - protein, 10 aa, Japanese encephalitis virus
KTKKILPQII

SEQ ID NO: 231173 - protein, 10 aa, Japanese encephalitis virus
TKKILPQIIK

SEQ ID NO: 231174 - protein, 10 aa, Japanese encephalitis virus
KKILPQIIKD

SEQ ID NO: 231175 - protein, 10 aa, Japanese encephalitis virus
KILPQIIRDA

SEQ ID NO: 231176 - protein, 10 aa, Japanese encephalitis virus
ILPQTIKDAI

SEQ ID NO: 231177 - protein, 10 aa, Japanese encephalitis virus
LPQIIRDAIQ

SEQ ID NO: 231178 - protein, 10 aa, Japanese encephalitis virus
PQTIKDAIQQ

SEQ ID NO: 231179 - protein, 10 aa, Japanese encephalitis virus
QIIKDAIQQH

SEQ ID NO: 231180 - protein, 10 aa, Japanese encephalitis virus
IIKDAIQQHL

SEQ ID NO: 231181 - protein, 10 aa, Japanese encephalitis virus
IKDAIQQRLK

SEQ ID NO: 231182 - protein, 10 aa, Japanese encephalitis virus
KDAIQQRLKT

SEQ ID NO: 231183 - protein, 10 aa, Japanese encephalitis virus
DAIQQHLRTA

SEQ ID NO: 231184 - protein, 10 aa, Japanese encephalitis virus
AIQQRLKTAV

SEQ ID NO: 231185 - protein, 10 aa, Japanese encephalitis virus
IQQHLRTAVL

SEQ ID NO: 231186 - protein, 10 aa, Japanese encephalitis virus
QQHLRTAVLA

SEQ ID NO: 231187 - protein, 10 aa, Japanese encephalitis virus
QHLRTAVLAP

SEQ ID NO: 231188 - protein, 10 aa, Japanese encephalitis virus
RLKTAVLAPT

SEQ ID NO: 231189 - protein, 10 aa, Japanese encephalitis virus
LKTAVLAPTR

SEQ ID NO: 231190 - protein, 10 aa, Japanese encephalitis virus
KTAVLAPTRV

SEQ ID NO: 231191 - protein, 10 aa, Japanese encephalitis virus
RVVAAEMAEV

SEQ ID NO: 231192 - protein, 10 aa, Japanese encephalitis virus
VVAAEMAEVL

SEQ ID NO: 231193 - protein, 10 aa, Japanese encephalitis virus
VAAEMAEALK

SEQ ID NO: 231194 - protein, 10 aa, Japanese encephalitis virus
AAEMAEALKG

SEQ ID NO: 231195 - protein, 10 aa, Japanese encephalitis virus
AEMAEALKGL

SEQ ID NO: 231196 - protein, 10 aa, Japanese encephalitis virus
EMAEALKGLP

SEQ ID NO: 231197 - protein, 10 aa, Japanese encephalitis virus
MAEALKGLPV

SEQ ID NO: 231198 - protein, 10 aa, Japanese encephalitis virus
AEALKGLPVR

SEQ ID NO: 231199 - protein, 10 aa, Japanese encephalitis virus
EALKGLPVRY

SEQ ID NO: 231200 - protein, 10 aa, Japanese encephalitis virus
ALKGLPVRYQ

SEQ ID NO: 231201 - protein, 10 aa, Japanese encephalitis virus
LKGLPVRYQT

SEQ ID NO: 231202 - protein, 10 aa, Japanese encephalitis virus
KGLPVRYQTS

SEQ ID NO: 231203 - protein, 10 aa, Japanese encephalitis virus
RYQTSAVQRS

SEQ ID NO: 231204 - protein, 10 aa, Japanese encephalitis virus
YQTSAVQRSH

SEQ ID NO: 231205 - protein, 10 aa, Japanese encephalitis virus
QTSAVQRSHQ

SEQ ID NO: 231206 - protein, 10 aa, Japanese encephalitis virus
TSAVQRSHQG

SEQ ID NO: 231207 - protein, 10 aa, Japanese encephalitis virus
SAVQRSHQGN

SEQ ID NO: 231208 - protein, 10 aa, Japanese encephalitis virus
AVQREHQGNA

SEQ ID NO: 231209 - protein, 10 aa, Japanese encephalitis virus
VQREHQGNAI

SEQ ID NO: 231210 - protein, 10 aa, Japanese encephalitis virus
QREHQGNAIV

SEQ ID NO: 231211 - protein, 10 aa, Japanese encephalitis virus
RSHQGNEIVD

SEQ ID NO: 231212 - protein, 10 aa, Japanese encephalitis virus
EHQGNAIVDV

SEQ ID NO: 231213 - protein, 10 aa, Japanese encephalitis virus
HQGNAIVDVM

SEQ ID NO: 231214 - protein, 10 aa, Japanese encephalitis virus
QGNAIVDVMC

SEQ ID NO: 231215 - protein, 10 aa, Japanese encephalitis virus
GNAIVDVMCH

SEQ ID NO: 231216 - protein, 10 aa, Japanese encephalitis virus
NAIVDVMCHA

SEQ ID NO: 231217 - protein, 10 aa, Japanese encephalitis virus
AIVDVMCHAT

SEQ ID NO: 231218 - protein, 10 aa, Japanese encephalitis virus
CHATLTHRLT

SEQ ID NO: 231219 - protein, 10 aa, Japanese encephalitis virus
HATLTHRLTS

SEQ ID NO: 231220 - protein, 10 aa, Japanese encephalitis virus
ATLTHRLTSP

SEQ ID NO: 231221 - protein, 10 aa, Japanese encephalitis virus
TLTHRLTSPN

SEQ ID NO: 231222 - protein, 10 aa, Japanese encephalitis virus
LTHRLTSPNR

SEQ ID NO: 231223 - protein, 10 aa, Japanese encephalitis virus
THRLTSPNRV

SEQ ID NO: 231224 - protein, 10 aa, Japanese encephalitis virus
HRLTSPNRVP

SEQ ID NO: 231225 - protein, 10 aa, Japanese encephalitis virus
RLTSPNRVPN

SEQ ID NO: 231226 - protein, 10 aa, Japanese encephalitis virus
LTSPNRVPNY

SEQ ID NO: 231227 - protein, 10 aa, Japanese encephalitis virus
TSPNRVPNYN

SEQ ID NO: 231228 - protein, 10 aa, Japanese encephalitis virus
DEAHFTDPAG

SEQ ID NO: 231229 - protein, 10 aa, Japanese encephalitis virus
EAHFTDPAGI

SEQ ID NO: 231230 - protein, 10 aa, Japanese encephalitis virus
AHFTDPAGIA

SEQ ID NO: 231231 - protein, 10 aa, Japanese encephalitis virus
HFTDPAGIAA

SEQ ID NO: 231232 - protein, 10 aa, Japanese encephalitis virus
FTDPAGIAAR

SEQ ID NO: 231233 - protein, 10 aa, Japanese encephalitis virus
TDPAGIAARG

SEQ ID NO: 231234 - protein, 10 aa, Japanese encephalitis virus
DPAGIAARGY

SEQ ID NO: 231235 - protein, 10 aa, Japanese encephalitis virus
PAGIAARGYI

SEQ ID NO: 231236 - protein, 10 aa, Japanese encephalitis virus
AGIAARGYIA

SEQ ID NO: 231237 - protein, 10 aa, Japanese encephalitis virus
GIAARGYIAT

SEQ ID NO: 231238 - protein, 10 aa, Japanese encephalitis virus
AAAIFMTATS

SEQ ID NO: 231239 - protein, 10 aa, Japanese encephalitis virus
AAIFMTATSP

SEQ ID NO: 231240 - protein, 10 aa, Japanese encephalitis virus
AIFMTATSPG

SEQ ID NO: 231241 - protein, 10 aa, Japanese encephalitis virus
IFMTATSPGT

SEQ ID NO: 231242 - protein, 10 aa, Japanese encephalitis virus
FMTATSPGTT

SEQ ID NO: 231243 - protein, 10 aa, Japanese encephalitis virus
MTATSPGTTD

SEQ ID NO: 231244 - protein, 10 aa, Japanese encephalitis virus
TATSPGTTDP

SEQ ID NO: 231245 - protein, 10 aa, Japanese encephalitis virus
ATSPGTTDPF

SEQ ID NO: 231246 - protein, 10 aa, Japanese encephalitis virus
TSPGTTDPFP

SEQ ID NO: 231247 - protein, 10 aa, Japanese encephalitis virus
SPGTTDPFPD

SEQ ID NO: 231248 - protein, 10 aa, Japanese encephalitis virus
GTTDPFPDSD

SEQ ID NO: 231249 - protein, 10 aa, Japanese encephalitis virus
TTDPFPDSDA

SEQ ID NO: 231250 - protein, 10 aa, Japanese encephalitis virus
TDPFPDSDAP

SEQ ID NO: 231251 - protein, 10 aa, Japanese encephalitis virus
DPFPDSDAPI

SEQ ID NO: 231252 - protein, 10 aa, Japanese encephalitis virus
PFPDSDAPIH

SEQ ID NO: 231253 - protein, 10 aa, Japanese encephalitis virus
FPDSDAPIHD

SEQ ID NO: 231254 - protein, 10 aa, Japanese encephalitis virus
PDSDAPIHDL

SEQ ID NO: 231255 - protein, 10 aa, Japanese encephalitis virus
DSDAPIHDLQ

SEQ ID NO: 231256 - protein, 10 aa, Japanese encephalitis virus
SDAPIHDLQD

SEQ ID NO: 231257 - protein, 10 aa, Japanese encephalitis virus
NAPIHDLQDG

SEQ ID NO: 231258 - protein, 10 aa, Japanese encephalitis virus
APIHDLQDEV

SEQ ID NO: 231259 - protein, 10 aa, Japanese encephalitis virus
PIHDLQDETP

SEQ ID NO: 231260 - protein, 10 aa, Japanese encephalitis virus
IHDLQDEVPD

SEQ ID NO: 231261 - protein, 10 aa, Japanese encephalitis virus
HDLQDETPDR

SEQ ID NO: 231262 - protein, 10 aa, Japanese encephalitis virus
DLQDETPDRA

SEQ ID NO: 231263 - protein, 10 aa, Japanese encephalitis virus
LQDEVPDRAW

SEQ ID NO: 231264 - protein, 10 aa, Japanese encephalitis virus
QDEVPDRAWS

SEQ ID NO: 231265 - protein, 10 aa, Japanese encephalitis virus
DEIPDWAWSS

SEQ ID NO: 231266 - protein, 10 aa, Japanese encephalitis virus
EVPDRAWSSG

SEQ ID NO: 231267 - protein, 10 aa, Japanese encephalitis virus
WITDYAGKTV

SEQ ID NO: 231268 - protein, 10 aa, Japanese encephalitis virus
ITDYAGKTVW

SEQ ID NO: 231269 - protein, 10 aa, Japanese encephalitis virus
TDYAGKTVWF

SEQ ID NO: 231270 - protein, 10 aa, Japanese encephalitis virus
DYAGKTVWFV

SEQ ID NO: 231271 - protein, 10 aa, Japanese encephalitis virus
YSGKTVWFVA

SEQ ID NO: 231272 - protein, 10 aa, Japanese encephalitis virus
SGKTVWFVAS

SEQ ID NO: 231273 - protein, 10 aa, Japanese encephalitis virus
KTVWFVASVR

SEQ ID NO: 231274 - protein, 10 aa, Japanese encephalitis virus
TVWFVASVRM

SEQ ID NO: 231275 - protein, 10 aa, Japanese encephalitis virus
VWFVASVRMG

SEQ ID NO: 231276 - protein, 10 aa, Japanese encephalitis virus
WFVASVRMGN

SEQ ID NO: 231277 - protein, 10 aa, Japanese encephalitis virus
FVASVRMGNE

SEQ ID NO: 231278 - protein, 10 aa, Japanese encephalitis virus
VASVRMGNEI

SEQ ID NO: 231279 - protein, 10 aa, Japanese encephalitis virus
ASVRMGNEIA

SEQ ID NO: 231280 - protein, 10 aa, Japanese encephalitis virus
SVRMGNEIAM

SEQ ID NO: 231281 - protein, 10 aa, Japanese encephalitis virus
VRMGNEIAMC

SEQ ID NO: 231282 - protein, 10 aa, Japanese encephalitis virus
RMGNEIAMCL

SEQ ID NO: 231283 - protein, 10 aa, Japanese encephalitis virus
MGNEIAVCLQ

SEQ ID NO: 231284 - protein, 10 aa, Japanese encephalitis virus
GNEIAVCLQR

SEQ ID NO: 231285 - protein, 10 aa, Japanese encephalitis virus
NEIAVCLQRA

SEQ ID NO: 231286 - protein, 10 aa, Japanese encephalitis virus
EIAVCLQRAG

SEQ ID NO: 231287 - protein, 10 aa, Japanese encephalitis virus
IAVCLQRAGK

SEQ ID NO: 231288 - protein, 10 aa, Japanese encephalitis virus
AVCLQRAGKK

SEQ ID NO: 231289 - protein, 10 aa, Japanese encephalitis virus
VCLQRAGKKV

SEQ ID NO: 231290 - protein, 10 aa, Japanese encephalitis virus
CLQRAGKRVI

SEQ ID NO: 231291 - protein, 10 aa, Japanese encephalitis virus
LQRAGKRVIQ

SEQ ID NO: 231292 - protein, 10 aa, Japanese encephalitis virus
QRAGKRVIQL

SEQ ID NO: 231293 - protein, 10 aa, Japanese encephalitis virus
RAGKRVIQLN

SEQ ID NO: 231294 - protein, 10 aa, Japanese encephalitis virus
AGKKVIQLSR

SEQ ID NO: 231295 - protein, 10 aa, Japanese encephalitis virus
GKRVIQLNRK

SEQ ID NO: 231296 - protein, 10 aa, Japanese encephalitis virus
KKVIQLSRKS

SEQ ID NO: 231297 - protein, 10 aa, Japanese encephalitis virus
KVIQLSRKSY

SEQ ID NO: 231298 - protein, 10 aa, Japanese encephalitis virus
VIQLSRKSYD

SEQ ID NO: 231299 - protein, 10 aa, Japanese encephalitis virus
IQLSRKSYDT

SEQ ID NO: 231300 - protein, 10 aa, Japanese encephalitis virus
QLSRKSYDTE

SEQ ID NO: 231301 - protein, 10 aa, Japanese encephalitis virus
LSRKSYDTEY

SEQ ID NO: 231302 - protein, 10 aa, Japanese encephalitis virus
SRKSYDTEYP

SEQ ID NO: 231303 - protein, 10 aa, Japanese encephalitis virus
FVITTDISEV

SEQ ID NO: 231304 - protein, 10 aa, Japanese encephalitis virus
VITTDISEVG

SEQ ID NO: 231305 - protein, 10 aa, Japanese encephalitis virus
ITTDISEVGA

SEQ ID NO: 231306 - protein, 10 aa, Japanese encephalitis virus
TTDISEVGAN

SEQ ID NO: 231307 - protein, 10 aa, Japanese encephalitis virus
TDISEVGANF

SEQ ID NO: 231308 - protein, 10 aa, Japanese encephalitis virus
DISEVGANFG

SEQ ID NO: 231309 - protein, 10 aa, Japanese encephalitis virus
ISEVGANFGA

SEQ ID NO: 231310 - protein, 10 aa, Japanese encephalitis virus
SEVGANFGAS

SEQ ID NO: 231311 - protein, 10 aa, Japanese encephalitis virus
EVGANFGASR

SEQ ID NO: 231312 - protein, 10 aa, Japanese encephalitis virus
VGANFGASRV

SEQ ID NO: 231313 - protein, 10 aa, Japanese encephalitis virus
RVIDCRKSVE

SEQ ID NO: 231314 - protein, 10 aa, Japanese encephalitis virus
VIDCRKSVEP

SEQ ID NO: 231315 - protein, 10 aa, Japanese encephalitis virus
IDCRKSVEPT

SEQ ID NO: 231316 - protein, 10 aa, Japanese encephalitis virus
DCRKSVKPII

SEQ ID NO: 231317 - protein, 10 aa, Japanese encephalitis virus
CRKSVKPIIL

SEQ ID NO: 231318 - protein, 10 aa, Japanese encephalitis virus
RKSVEPTILE

SEQ ID NO: 231319 - protein, 10 aa, Japanese encephalitis virus
KSVEPTILEE

SEQ ID NO: 231320 - protein, 10 aa, Japanese encephalitis virus
SVEPTILEEG

SEQ ID NO: 231321 - protein, 10 aa, Japanese encephalitis virus
VEPTILEEGE

SEQ ID NO: 231322 - protein, 10 aa, Japanese encephalitis virus
EPTILEEGEG

SEQ ID NO: 231323 - protein, 10 aa, Japanese encephalitis virus
PTILEKEEGR

SEQ ID NO: 231324 - protein, 10 aa, Japanese encephalitis virus
IILEEGEGRV

SEQ ID NO: 231325 - protein, 10 aa, Japanese encephalitis virus
ILEEGEGRVF

SEQ ID NO: 231326 - protein, 10 aa, Japanese encephalitis virus
LEEGEGRVFL

SEQ ID NO: 231327 - protein, 10 aa, Japanese encephalitis virus
EEGEGRVFLG

SEQ ID NO: 231328 - protein, 10 aa, Japanese encephalitis virus
KEEGRVILGN

SEQ ID NO: 231329 - protein, 10 aa, Japanese encephalitis virus
GEGRVFLGNP

SEQ ID NO: 231330 - protein, 10 aa, Japanese encephalitis virus
EGRVFLGNPS

SEQ ID NO: 231331 - protein, 10 aa, Japanese encephalitis virus
GRVFLGNPSP

SEQ ID NO: 231332 - protein, 10 aa, Japanese encephalitis virus
RVFLGNPSPI

SEQ ID NO: 231333 - protein, 10 aa, Japanese encephalitis virus
VFLGNPSPIT

SEQ ID NO: 231334 - protein, 10 aa, Japanese encephalitis virus
FLGNPSPITS

SEQ ID NO: 231335 - protein, 10 aa, Japanese encephalitis virus
LGNPSPITNA

SEQ ID NO: 231336 - protein, 10 aa, Japanese encephalitis virus
GNPSPITNAS

SEQ ID NO: 231337 - protein, 10 aa, Japanese encephalitis virus
NPSPITNASA

SEQ ID NO: 231338 - protein, 10 aa, Japanese encephalitis virus
PSPITNASAA

SEQ ID NO: 231339 - protein, 10 aa, Japanese encephalitis virus
SPITNASAAQ

SEQ ID NO: 231340 - protein, 10 aa, Japanese encephalitis virus
PITNASAAQR

SEQ ID NO: 231341 - protein, 10 aa, Japanese encephalitis virus
ITNASAAQRR

SEQ ID NO: 231342 - protein, 10 aa, Japanese encephalitis virus
TNASAAQRRG

SEQ ID NO: 231343 - protein, 10 aa, Japanese encephalitis virus
NASAAQRRGR

SEQ ID NO: 231344 - protein, 10 aa, Japanese encephalitis virus
SAAQRRGRVS

SEQ ID NO: 231345 - protein, 10 aa, Japanese encephalitis virus
AAQRRGRVSR

SEQ ID NO: 231346 - protein, 10 aa, Japanese encephalitis virus
AQRRGRVSRN

SEQ ID NO: 231347 - protein, 10 aa, Japanese encephalitis virus
QRRGRVSRNP

SEQ ID NO: 231348 - protein, 10 aa, Japanese encephalitis virus
RRGRVSRNPN

SEQ ID NO: 231349 - protein, 10 aa, Japanese encephalitis virus
RGRVGRNPSQ

SEQ ID NO: 231350 - protein, 10 aa, Japanese encephalitis virus
GRVGRNPSQV

SEQ ID NO: 231351 - protein, 10 aa, Japanese encephalitis virus
RVGRNPSQVG

SEQ ID NO: 231352 - protein, 10 aa, Japanese encephalitis virus
VSRNPNQVGD

SEQ ID NO: 231353 - protein, 10 aa, Japanese encephalitis virus
GRNPSQVGDE

SEQ ID NO: 231354 - protein, 10 aa, Japanese encephalitis virus
RNPSQVGDEY

SEQ ID NO: 231355 - protein, 10 aa, Japanese encephalitis virus
NPNQVGDEYE

SEQ ID NO: 231356 - protein, 10 aa, Japanese encephalitis virus
PSQVGDEYHY

SEQ ID NO: 231357 - protein, 10 aa, Japanese encephalitis virus
NQVGDEYEYG

SEQ ID NO: 231358 - protein, 10 aa, Japanese encephalitis virus
QVGDEYEYGG

SEQ ID NO: 231359 - protein, 10 aa, Japanese encephalitis virus
VGDEYEYGGA

SEQ ID NO: 231360 - protein, 10 aa, Japanese encephalitis virus
GDEYHYGGPT

SEQ ID NO: 231361 - protein, 10 aa, Japanese encephalitis virus
DEYHYGGPTS

SEQ ID NO: 231362 - protein, 10 aa, Japanese encephalitis virus
EYHYGGPTSE

SEQ ID NO: 231363 - protein, 10 aa, Japanese encephalitis virus
YEYGGATSED

SEQ ID NO: 231364 - protein, 10 aa, Japanese encephalitis virus
HYGGATSEGD

SEQ ID NO: 231365 - protein, 10 aa, Japanese encephalitis virus
YGGPTSEDDS

SEQ ID NO: 231366 - protein, 10 aa, Japanese encephalitis virus
GGATSEGDSN

SEQ ID NO: 231367 - protein, 10 aa, Japanese encephalitis virus
GATSEGDSNL

SEQ ID NO: 231368 - protein, 10 aa, Japanese encephalitis virus
PTSEDDSNLA

SEQ ID NO: 231369 - protein, 10 aa, Japanese encephalitis virus
TSEGDSNLAH

SEQ ID NO: 231370 - protein, 10 aa, Japanese encephalitis virus
SEGDSNLAHW

SEQ ID NO: 231371 - protein, 10 aa, Japanese encephalitis virus
EGDSNLAHWT

SEQ ID NO: 231372 - protein, 10 aa, Japanese encephalitis virus
GDSNLAHWTE

SEQ ID NO: 231373 - protein, 10 aa, Japanese encephalitis virus
DGNLAHWTEA

SEQ ID NO: 231374 - protein, 10 aa, Japanese encephalitis virus
GNLAHWTEAK

SEQ ID NO: 231375 - protein, 10 aa, Japanese encephalitis virus
LAHWTEAKIL

SEQ ID NO: 231376 - protein, 10 aa, Japanese encephalitis virus
AHWTEAKILL

SEQ ID NO: 231377 - protein, 10 aa, Japanese encephalitis virus
HWTEAKILLD

SEQ ID NO: 231378 - protein, 10 aa, Japanese encephalitis virus
WTEAKILLDN

SEQ ID NO: 231379 - protein, 10 aa, Japanese encephalitis virus
TEAKILLDNI

SEQ ID NO: 231380 - protein, 10 aa, Japanese encephalitis virus
EAKILLDNIH

SEQ ID NO: 231381 - protein, 10 aa, Japanese encephalitis virus
AKILLDNIHM

SEQ ID NO: 231382 - protein, 10 aa, Japanese encephalitis virus
KILLDNIHMP

SEQ ID NO: 231383 - protein, 10 aa, Japanese encephalitis virus
ILLDNIHMPN

SEQ ID NO: 231384 - protein, 10 aa, Japanese encephalitis virus
LLDNIHMPNG

SEQ ID NO: 231385 - protein, 10 aa, Japanese encephalitis virus
NIHMPNGLVV

SEQ ID NO: 231386 - protein, 10 aa, Japanese encephalitis virus
IHMPNGLVVQ

SEQ ID NO: 231387 - protein, 10 aa, Japanese encephalitis virus
HMPNGLVVQL

SEQ ID NO: 231388 - protein, 10 aa, Japanese encephalitis virus
MPNGLVVQLY

SEQ ID NO: 231389 - protein, 10 aa, Japanese encephalitis virus
PNGLVVQLYG

SEQ ID NO: 231390 - protein, 10 aa, Japanese encephalitis virus
NGLVVQLYGP

SEQ ID NO: 231391 - protein, 10 aa, Japanese encephalitis virus
GLVVQLYGPE

SEQ ID NO: 231392 - protein, 10 aa, Japanese encephalitis virus
LVVQLYGPER

SEQ ID NO: 231393 - protein, 10 aa, Japanese encephalitis virus
VVQLYGPERE

SEQ ID NO: 231394 - protein, 10 aa, Japanese encephalitis virus
VQLYGPEREK

SEQ ID NO: 231395 - protein, 10 aa, Japanese encephalitis virus
LYGPEREKAS

SEQ ID NO: 231396 - protein, 10 aa, Japanese encephalitis virus
YGPEREKAST

SEQ ID NO: 231397 - protein, 10 aa, Japanese encephalitis virus
GPEREKASTM

SEQ ID NO: 231398 - protein, 10 aa, Japanese encephalitis virus
PEREKASTMD

SEQ ID NO: 231399 - protein, 10 aa, Japanese encephalitis virus
EREKASTMDG

SEQ ID NO: 231400 - protein, 10 aa, Japanese encephalitis virus
REKASTMDGE

SEQ ID NO: 231401 - protein, 10 aa, Japanese encephalitis virus
EKASTMDGEY

SEQ ID NO: 231402 - protein, 10 aa, Japanese encephalitis virus
KASTMDGEYR

SEQ ID NO: 231403 - protein, 10 aa, Japanese encephalitis virus
ASTMDGEYRL

SEQ ID NO: 231404 - protein, 10 aa, Japanese encephalitis virus
STMDGEYRLR

SEQ ID NO: 231405 - protein, 10 aa, Japanese encephalitis virus
TMDVEYRLRG

SEQ ID NO: 231406 - protein, 10 aa, Japanese encephalitis virus
MDVEYRLRGE

SEQ ID NO: 231407 - protein, 10 aa, Japanese encephalitis virus
DVEYRLRGEE

SEQ ID NO: 231408 - protein, 10 aa, Japanese encephalitis virus
VEYRLRGEEK

SEQ ID NO: 231409 - protein, 10 aa, Japanese encephalitis virus
ADLPVWLAYR

SEQ ID NO: 231410 - protein, 10 aa, Japanese encephalitis virus
DLPVWLAYRV

SEQ ID NO: 231411 - protein, 10 aa, Japanese encephalitis virus
LPVWLAYRVA

SEQ ID NO: 231412 - protein, 10 aa, Japanese encephalitis virus
PVWLAYRVAS

SEQ ID NO: 231413 - protein, 10 aa, Japanese encephalitis virus
VWLAYRVASN

SEQ ID NO: 231414 - protein, 10 aa, Japanese encephalitis virus
WLAYRVASNG

SEQ ID NO: 231415 - protein, 10 aa, Japanese encephalitis virus
LAYKVAPNGI

SEQ ID NO: 231416 - protein, 10 aa, Japanese encephalitis virus
AYKVAPNGIQ

SEQ ID NO: 231417 - protein, 10 aa, Japanese encephalitis virus
YKVAPNGIQY

SEQ ID NO: 231418 - protein, 10 aa, Japanese encephalitis virus
RVASNGIQYT

SEQ ID NO: 231419 - protein, 10 aa, Japanese encephalitis virus
VAPNGIQYTD

SEQ ID NO: 231420 - protein, 10 aa, Japanese encephalitis virus
APNGIQYTDR

SEQ ID NO: 231421 - protein, 10 aa, Japanese encephalitis virus
SNGIQYTDRR

SEQ ID NO: 231422 - protein, 10 aa, Japanese encephalitis virus
NGIQYTDRRW

SEQ ID NO: 231423 - protein, 10 aa, Japanese encephalitis virus
GIQYTDRRWC

SEQ ID NO: 231424 - protein, 10 aa, Japanese encephalitis virus
IQYTDRRWCF

SEQ ID NO: 231425 - protein, 10 aa, Japanese encephalitis virus
QYTDRRWCFD

SEQ ID NO: 231426 - protein, 10 aa, Japanese encephalitis virus
YTDRRWCFDG

SEQ ID NO: 231427 - protein, 10 aa, Japanese encephalitis virus
TDRRWCFDGP

SEQ ID NO: 231428 - protein, 10 aa, Japanese encephalitis virus
DRRWCFDGPR

SEQ ID NO: 231429 - protein, 10 aa, Japanese encephalitis virus
RRWCFDGPRT

SEQ ID NO: 231430 - protein, 10 aa, Japanese encephalitis virus
RWCFDGPRTN

SEQ ID NO: 231431 - protein, 10 aa, Japanese encephalitis virus
PRTNAILEDS

SEQ ID NO: 231432 - protein, 10 aa, Japanese encephalitis virus
RTNAILEDNI

SEQ ID NO: 231433 - protein, 10 aa, Japanese encephalitis virus
TNAILEDNIE

SEQ ID NO: 231434 - protein, 10 aa, Japanese encephalitis virus
NAILEDNIEV

SEQ ID NO: 231435 - protein, 10 aa, Japanese encephalitis virus
AILEDNIEVE

SEQ ID NO: 231436 - protein, 10 aa, Japanese encephalitis virus
ILEDNIEVEI

SEQ ID NO: 231437 - protein, 10 aa, Japanese encephalitis virus
LEDNIEVEIV

SEQ ID NO: 231438 - protein, 10 aa, Japanese encephalitis virus
EDNIEVEIVT

SEQ ID NO: 231439 - protein, 10 aa, Japanese encephalitis virus
DNIEVEIVTR

SEQ ID NO: 231440 - protein, 10 aa, Japanese encephalitis virus
NIEVEIVTRM

SEQ ID NO: 231441 - protein, 10 aa, Japanese encephalitis virus
IEVEIVTRMG

SEQ ID NO: 231442 - protein, 10 aa, Japanese encephalitis virus
EVEIVTRTGE

SEQ ID NO: 231443 - protein, 10 aa, Japanese encephalitis virus
VEIVTRTGER

SEQ ID NO: 231444 - protein, 10 aa, Japanese encephalitis virus
EIVTRTGERK

SEQ ID NO: 231445 - protein, 10 aa, Japanese encephalitis virus
IVTRTGERKV

SEQ ID NO: 231446 - protein, 10 aa, Japanese encephalitis virus
VTRTGERKVL

SEQ ID NO: 231447 - protein, 10 aa, Japanese encephalitis virus
TRTGERKVLK

SEQ ID NO: 231448 - protein, 10 aa, Japanese encephalitis virus
RTGERKVLKP

SEQ ID NO: 231449 - protein, 10 aa, Japanese encephalitis virus
TGERKVLKPR

SEQ ID NO: 231450 - protein, 10 aa, Japanese encephalitis virus
GERKVLKPRW

SEQ ID NO: 231451 - protein, 10 aa, Japanese encephalitis virus
ERKVLKPRWL

SEQ ID NO: 231452 - protein, 10 aa, Japanese encephalitis virus
RKILKPRWLY

SEQ ID NO: 231453 - protein, 10 aa, Japanese encephalitis virus
KILKPRWLYA

SEQ ID NO: 231454 - protein, 10 aa, Japanese encephalitis virus
ILKPRWLYAR

SEQ ID NO: 231455 - protein, 10 aa, Japanese encephalitis virus
LKPRWLYARV

SEQ ID NO: 231456 - protein, 10 aa, Japanese encephalitis virus
KPRWLYARVY

SEQ ID NO: 231457 - protein, 10 aa, Japanese encephalitis virus
PRWLYARVYA

SEQ ID NO: 231458 - protein, 10 aa, Japanese encephalitis virus
RWLYARVYAD

SEQ ID NO: 231459 - protein, 10 aa, Japanese encephalitis virus
WLYARVYADH

SEQ ID NO: 231460 - protein, 10 aa, Japanese encephalitis virus
LYARVYADHQ

SEQ ID NO: 231461 - protein, 10 aa, Japanese encephalitis virus
YARVYADHQA

SEQ ID NO: 231462 - protein, 10 aa, Japanese encephalitis virus
ALKWFKDFAS

SEQ ID NO: 231463 - protein, 10 aa, Japanese encephalitis virus
LKWFKDFASG

SEQ ID NO: 231464 - protein, 10 aa, Japanese encephalitis virus
KWFKDFASGK

SEQ ID NO: 231465 - protein, 10 aa, Japanese encephalitis virus
WFKDFASGKR

SEQ ID NO: 231466 - protein, 10 aa, Japanese encephalitis virus
FKDFASGKRS

SEQ ID NO: 231467 - protein, 10 aa, Japanese encephalitis virus
KDFASGKRSA

SEQ ID NO: 231468 - protein, 10 aa, Japanese encephalitis virus
DFAAGKRSAI

SEQ ID NO: 231469 - protein, 10 aa, Japanese encephalitis virus
FAAGKRSAIS

SEQ ID NO: 231470 - protein, 10 aa, Japanese encephalitis virus
AAGKRSAISF

SEQ ID NO: 231471 - protein, 10 aa, Japanese encephalitis virus
AGKRSAISFI

SEQ ID NO: 231472 - protein, 10 aa, Japanese encephalitis virus
GKRSAISFIE

SEQ ID NO: 231473 - protein, 10 aa, Japanese encephalitis virus
KRSAISFIEV

SEQ ID NO: 231474 - protein, 10 aa, Japanese encephalitis virus
RSAISFIEVL

SEQ ID NO: 231475 - protein, 10 aa, Japanese encephalitis virus
SAISFIEVLG

SEQ ID NO: 231476 - protein, 10 aa, Japanese encephalitis virus
AISFIEVLGR

SEQ ID NO: 231477 - protein, 10 aa, Japanese encephalitis virus
ISFIEVLGRM

SEQ ID NO: 231478 - protein, 10 aa, Japanese encephalitis virus
SFIEVRGRMP

SEQ ID NO: 231479 - protein, 10 aa, Japanese encephalitis virus
FIEVRGRMPE

SEQ ID NO: 231480 - protein, 10 aa, Japanese encephalitis virus
IEVRGRMPEH

SEQ ID NO: 231481 - protein, 10 aa, Japanese encephalitis virus
EEPGRMPEHF

SEQ ID NO: 231482 - protein, 10 aa, Japanese encephalitis virus
VRGRMPEHFM

SEQ ID NO: 231483 - protein, 10 aa, Japanese encephalitis virus
RGRMPEHFMG

SEQ ID NO: 231484 - protein, 10 aa, Japanese encephalitis virus
GRMPEHFAGK

SEQ ID NO: 231485 - protein, 10 aa, Japanese encephalitis virus
RMPEHFAGKT

SEQ ID NO: 231486 - protein, 10 aa, Japanese encephalitis virus
MPEHFAGKTR

SEQ ID NO: 231487 - protein, 10 aa, Japanese encephalitis virus
PEHFAGKTRE

SEQ ID NO: 231488 - protein, 10 aa, Japanese encephalitis virus
EHFAGKTREA

SEQ ID NO: 231489 - protein, 10 aa, Japanese encephalitis virus
HFAGKTREAL

SEQ ID NO: 231490 - protein, 10 aa, Japanese encephalitis virus
FAGKTREALD

SEQ ID NO: 231491 - protein, 10 aa, Japanese encephalitis virus
AGKTREALDT

SEQ ID NO: 231492 - protein, 10 aa, Japanese encephalitis virus
TMYLVATAER

SEQ ID NO: 231493 - protein, 10 aa, Japanese encephalitis virus
MYLVATAERG

SEQ ID NO: 231494 - protein, 10 aa, Japanese encephalitis virus
YLVATAERGG

SEQ ID NO: 231495 - protein, 10 aa, Japanese encephalitis virus
LVATAERGGK

SEQ ID NO: 231496 - protein, 10 aa, Japanese encephalitis virus
VATAERGGKA

SEQ ID NO: 231497 - protein, 10 aa, Japanese encephalitis virus
ATAERGGKAH

SEQ ID NO: 231498 - protein, 10 aa, Japanese encephalitis virus
TAERGGKAHR

SEQ ID NO: 231499 - protein, 10 aa, Japanese encephalitis virus
AERGGKAHRM

SEQ ID NO: 231500 - protein, 10 aa, Japanese encephalitis virus
ERGGKAHRMA

SEQ ID NO: 231501 - protein, 10 aa, Japanese encephalitis virus
RGGKAHRMAL

SEQ ID NO: 231502 - protein, 10 aa, Japanese encephalitis virus
SGKAHRMALE

SEQ ID NO: 231503 - protein, 10 aa, Japanese encephalitis virus
GKTHRMALEE

SEQ ID NO: 231504 - protein, 10 aa, Japanese encephalitis virus
KTHRMALEEL

SEQ ID NO: 231505 - protein, 10 aa, Japanese encephalitis virus
THRMALEELP

SEQ ID NO: 231506 - protein, 10 aa, Japanese encephalitis virus
EELPDALETV

SEQ ID NO: 231507 - protein, 10 aa, Japanese encephalitis virus
ELPDALETVT

SEQ ID NO: 231508 - protein, 10 aa, Japanese encephalitis virus
LPDALETVTL

SEQ ID NO: 231509 - protein, 10 aa, Japanese encephalitis virus
PDALETITLT

SEQ ID NO: 231510 - protein, 10 aa, Japanese encephalitis virus
DALETITLIA

SEQ ID NO: 231511 - protein, 10 aa, Japanese encephalitis virus
ALETITLIAA

SEQ ID NO: 231512 - protein, 10 aa, Japanese encephalitis virus
LETITLIAAI

SEQ ID NO: 231513 - protein, 10 aa, Japanese encephalitis virus
AITAMTGGFF

SEQ ID NO: 231514 - protein, 10 aa, Japanese encephalitis virus
ITAMTGGFFL

SEQ ID NO: 231515 - protein, 10 aa, Japanese encephalitis virus
TVMTRGFFLL

SEQ ID NO: 231516 - protein, 10 aa, Japanese encephalitis virus
VMTRGFFLLM

SEQ ID NO: 231517 - protein, 10 aa, Japanese encephalitis virus
MTGGFFLLMK

SEQ ID NO: 231518 - protein, 10 aa, Japanese encephalitis virus
TGGFFLLMKQ

SEQ ID NO: 231519 - protein, 10 aa, Japanese encephalitis virus
GGFFLLMKQR

SEQ ID NO: 231520 - protein, 10 aa, Japanese encephalitis virus
GFFLLMKQRK

SEQ ID NO: 231521 - protein, 10 aa, Japanese encephalitis virus
FFLLMKQRKG

SEQ ID NO: 231522 - protein, 10 aa, Japanese encephalitis virus
FLLMKQRKGI

SEQ ID NO: 231523 - protein, 10 aa, Japanese encephalitis virus
LLMKQRKGIG

SEQ ID NO: 231524 - protein, 10 aa, Japanese encephalitis virus
LMMQRKGIGR

SEQ ID NO: 231525 - protein, 10 aa, Japanese encephalitis virus
MMQRKGIGRM

SEQ ID NO: 231526 - protein, 10 aa, Japanese encephalitis virus
MQRKGIGRMG

SEQ ID NO: 231527 - protein, 10 aa, Japanese encephalitis virus
QRKGIGRMGL

SEQ ID NO: 231528 - protein, 10 aa, Japanese encephalitis virus
RKGIGRMGLG

SEQ ID NO: 231529 - protein, 10 aa, Japanese encephalitis virus
KGIGRMGLGA

SEQ ID NO: 231530 - protein, 10 aa, Japanese encephalitis virus
GIGRMGLGAL

SEQ ID NO: 231531 - protein, 10 aa, Japanese encephalitis virus
IGRMGLGALV

SEQ ID NO: 231532 - protein, 10 aa, Japanese encephalitis virus
GRMGLGALVL

SEQ ID NO: 231533 - protein, 10 aa, Japanese encephalitis virus
RMGLGALVLT

SEQ ID NO: 231534 - protein, 10 aa, Japanese encephalitis virus
MGLGALVLVL

SEQ ID NO: 231535 - protein, 10 aa, Japanese encephalitis virus
GLGALVLVLA

SEQ ID NO: 231536 - protein, 10 aa, Japanese encephalitis virus
LGALVLVLAT

SEQ ID NO: 231537 - protein, 10 aa, Japanese encephalitis virus
GALVLVLATF

SEQ ID NO: 231538 - protein, 10 aa, Japanese encephalitis virus
ALVLVLATFF

SEQ ID NO: 231539 - protein, 10 aa, Japanese encephalitis virus
LVLVLATFFL

SEQ ID NO: 231540 - protein, 10 aa, Japanese encephalitis virus
VLVLATFFLW

SEQ ID NO: 231541 - protein, 10 aa, Japanese encephalitis virus
LVLATFFLWA

SEQ ID NO: 231542 - protein, 10 aa, Japanese encephalitis virus
VLATFFLWAA

SEQ ID NO: 231543 - protein, 10 aa, Japanese encephalitis virus
TFFLWAAEVS

SEQ ID NO: 231544 - protein, 10 aa, Japanese encephalitis virus
FFLWAAEVSG

SEQ ID NO: 231545 - protein, 10 aa, Japanese encephalitis virus
FLWAAEVSGT

SEQ ID NO: 231546 - protein, 10 aa, Japanese encephalitis virus
LWAAEVSGTK

SEQ ID NO: 231547 - protein, 10 aa, Japanese encephalitis virus
WAAEVSGTKI

SEQ ID NO: 231548 - protein, 10 aa, Japanese encephalitis virus
AAEVSGTKIA

SEQ ID NO: 231549 - protein, 10 aa, Japanese encephalitis virus
AEVSGTKIAG

SEQ ID NO: 231550 - protein, 10 aa, Japanese encephalitis virus
EVSGTKIAGT

SEQ ID NO: 231551 - protein, 10 aa, Japanese encephalitis virus
VSGTKIAGTL

SEQ ID NO: 231552 - protein, 10 aa, Japanese encephalitis virus
SGTKIAGTLL

SEQ ID NO: 231553 - protein, 10 aa, Japanese encephalitis virus
GTKIAGTLLV

SEQ ID NO: 231554 - protein, 10 aa, Japanese encephalitis virus
TKIAGTLLVA

SEQ ID NO: 231555 - protein, 10 aa, Japanese encephalitis virus
KIAGTLLVAL

SEQ ID NO: 231556 - protein, 10 aa, Japanese encephalitis virus
IAGTLLVALL

SEQ ID NO: 231557 - protein, 10 aa, Japanese encephalitis virus
AGTLLVALLL

SEQ ID NO: 231558 - protein, 10 aa, Japanese encephalitis virus
GTLLVALLLM

SEQ ID NO: 231559 - protein, 10 aa, Japanese encephalitis virus
TLLVALLLMV

SEQ ID NO: 231560 - protein, 10 aa, Japanese encephalitis virus
LLVALLLMVV

SEQ ID NO: 231561 - protein, 10 aa, Japanese encephalitis virus
LVALLLMVVL

SEQ ID NO: 231562 - protein, 10 aa, Japanese encephalitis virus
VALLLMVVLI

SEQ ID NO: 231563 - protein, 10 aa, Japanese encephalitis virus
LMVVLIPEPG

SEQ ID NO: 231564 - protein, 10 aa, Japanese encephalitis virus
MVVLIPEPGK

SEQ ID NO: 231565 - protein, 10 aa, Japanese encephalitis virus
VVLIPEPGKQ

SEQ ID NO: 231566 - protein, 10 aa, Japanese encephalitis virus
VLIPEPGKQR

SEQ ID NO: 231567 - protein, 10 aa, Japanese encephalitis virus
LIPEPGKQRS

SEQ ID NO: 231568 - protein, 10 aa, Japanese encephalitis virus
IPEPGKQRSQ

SEQ ID NO: 231569 - protein, 10 aa, Japanese encephalitis virus
PEPGKQRSQT

SEQ ID NO: 231570 - protein, 10 aa, Japanese encephalitis virus
EPGKQRSQTD

SEQ ID NO: 231571 - protein, 10 aa, Japanese encephalitis virus
PGKQRSQTDN

SEQ ID NO: 231572 - protein, 10 aa, Japanese encephalitis virus
GKQRSQTDNQ

SEQ ID NO: 231573 - protein, 10 aa, Japanese encephalitis virus
KQKSQTDNQL

SEQ ID NO: 231574 - protein, 10 aa, Japanese encephalitis virus
QKSQTDNQLA

SEQ ID NO: 231575 - protein, 10 aa, Japanese encephalitis virus
RSQTGNQLAV

SEQ ID NO: 231576 - protein, 10 aa, Japanese encephalitis virus
SQTGNQLAVF

SEQ ID NO: 231577 - protein, 10 aa, Japanese encephalitis virus
QTGNQLAVFL

SEQ ID NO: 231578 - protein, 10 aa, Japanese encephalitis virus
TGNQLAVFLI

SEQ ID NO: 231579 - protein, 10 aa, Japanese encephalitis virus
GNQLAVFLIC

SEQ ID NO: 231580 - protein, 10 aa, Japanese encephalitis virus
LICVLTVVGM

SEQ ID NO: 231581 - protein, 10 aa, Japanese encephalitis virus
ICVLTVVGVA

SEQ ID NO: 231582 - protein, 10 aa, Japanese encephalitis virus
CVLTVVGMVA

SEQ ID NO: 231583 - protein, 10 aa, Japanese encephalitis virus
VLTVVGMVAA

SEQ ID NO: 231584 - protein, 10 aa, Japanese encephalitis virus
LTVVGMVAAN

SEQ ID NO: 231585 - protein, 10 aa, Japanese encephalitis virus
TVVGVAAANE

SEQ ID NO: 231586 - protein, 10 aa, Japanese encephalitis virus
VVGMVAANEY

SEQ ID NO: 231587 - protein, 10 aa, Japanese encephalitis virus
VGVAAANEYG

SEQ ID NO: 231588 - protein, 10 aa, Japanese encephalitis virus
GVAAANEYGM

SEQ ID NO: 231589 - protein, 10 aa, Japanese encephalitis virus
MVAANEYGML

SEQ ID NO: 231590 - protein, 10 aa, Japanese encephalitis virus
AAANEYGMLE

SEQ ID NO: 231591 - protein, 10 aa, Japanese encephalitis virus
AANEYGMLER

SEQ ID NO: 231592 - protein, 10 aa, Japanese encephalitis virus
ANEYGMLERT

SEQ ID NO: 231593 - protein, 10 aa, Japanese encephalitis virus
NEYGMLERTK

SEQ ID NO: 231594 - protein, 10 aa, Japanese encephalitis virus
EYGMLERTKA

SEQ ID NO: 231595 - protein, 10 aa, Japanese encephalitis virus
YGMLERTKAD

SEQ ID NO: 231596 - protein, 10 aa, Japanese encephalitis virus
GMLEKTKADI

SEQ ID NO: 231597 - protein, 10 aa, Japanese encephalitis virus
MLEKTKADIK

SEQ ID NO: 231598 - protein, 10 aa, Japanese encephalitis virus
LEKTKADIKS

SEQ ID NO: 231599 - protein, 10 aa, Japanese encephalitis virus
ERTKADLKSM

SEQ ID NO: 231600 - protein, 10 aa, Japanese encephalitis virus
KTKADIKSMF

SEQ ID NO: 231601 - protein, 10 aa, Japanese encephalitis virus
TKADLKSMFA

SEQ ID NO: 231602 - protein, 10 aa, Japanese encephalitis virus
KADLKSMFAG

SEQ ID NO: 231603 - protein, 10 aa, Japanese encephalitis virus
ADLKSMFGGR

SEQ ID NO: 231604 - protein, 10 aa, Japanese encephalitis virus
KSMFGGRTQA

SEQ ID NO: 231605 - protein, 10 aa, Japanese encephalitis virus
TQAPGLTGLP

SEQ ID NO: 231606 - protein, 10 aa, Japanese encephalitis virus
QAPGLTGLPS

SEQ ID NO: 231607 - protein, 10 aa, Japanese encephalitis virus
APGLTGLPSM

SEQ ID NO: 231608 - protein, 10 aa, Japanese encephalitis virus
GMTGLPGMAL

SEQ ID NO: 231609 - protein, 10 aa, Japanese encephalitis virus
MTGLPGMALD

SEQ ID NO: 231610 - protein, 10 aa, Japanese encephalitis virus
TGLPGMALDL

SEQ ID NO: 231611 - protein, 10 aa, Japanese encephalitis virus
GLPSVALDLR

SEQ ID NO: 231612 - protein, 10 aa, Japanese encephalitis virus
LPSVALDLRP

SEQ ID NO: 231613 - protein, 10 aa, Japanese encephalitis virus
PGMALDLRPA

SEQ ID NO: 231614 - protein, 10 aa, Japanese encephalitis virus
GMALDLRPAT

SEQ ID NO: 231615 - protein, 10 aa, Japanese encephalitis virus
MTLDLRPATA

SEQ ID NO: 231616 - protein, 10 aa, Japanese encephalitis virus
TLDLRPATAW

SEQ ID NO: 231617 - protein, 10 aa, Japanese encephalitis virus
DLRPATAWAW

SEQ ID NO: 231618 - protein, 10 aa, Japanese encephalitis virus
LRPATAWAWY

SEQ ID NO: 231619 - protein, 10 aa, Japanese encephalitis virus
RPATAWAWYG

SEQ ID NO: 231620 - protein, 10 aa, Japanese encephalitis virus
PATAWAWYGG

SEQ ID NO: 231621 - protein, 10 aa, Japanese encephalitis virus
ATAWAWYGGS

SEQ ID NO: 231622 - protein, 10 aa, Japanese encephalitis virus
TAWAWYGGST

SEQ ID NO: 231623 - protein, 10 aa, Japanese encephalitis virus
AWAWYGGSTV

SEQ ID NO: 231624 - protein, 10 aa, Japanese encephalitis virus
WAWYGGSTVV

SEQ ID NO: 231625 - protein, 10 aa, Japanese encephalitis virus
AWYGGSTVVL

SEQ ID NO: 231626 - protein, 10 aa, Japanese encephalitis virus
WYGGSTVVLT

SEQ ID NO: 231627 - protein, 10 aa, Japanese encephalitis virus
VVLTPLLKHI

SEQ ID NO: 231628 - protein, 10 aa, Japanese encephalitis virus
VLTPLLKHII

SEQ ID NO: 231629 - protein, 10 aa, Japanese encephalitis virus
LTPLLKHIIT

SEQ ID NO: 231630 - protein, 10 aa, Japanese encephalitis virus
TPLLKHIITS

SEQ ID NO: 231631 - protein, 10 aa, Japanese encephalitis virus
PLLKHIITSE

SEQ ID NO: 231632 - protein, 10 aa, Japanese encephalitis virus
LLKHIITSEY

SEQ ID NO: 231633 - protein, 10 aa, Japanese encephalitis virus
LKHIITSEYV

SEQ ID NO: 231634 - protein, 10 aa, Japanese encephalitis virus
KHIITSEYVT

SEQ ID NO: 231635 - protein, 10 aa, Japanese encephalitis virus
HLITSEYVTP

SEQ ID NO: 231636 - protein, 10 aa, Japanese encephalitis virus
IITSEYVTTS

SEQ ID NO: 231637 - protein, 10 aa, Japanese encephalitis virus
ITSEYVTPSL

SEQ ID NO: 231638 - protein, 10 aa, Japanese encephalitis virus
TSEYVTPSLA

SEQ ID NO: 231639 - protein, 10 aa, Japanese encephalitis virus
SEYVTPSLAS

SEQ ID NO: 231640 - protein, 10 aa, Japanese encephalitis virus
EYVTPSLASI

SEQ ID NO: 231641 - protein, 10 aa, Japanese encephalitis virus
YVTTSLASIS

SEQ ID NO: 231642 - protein, 10 aa, Japanese encephalitis virus
VTTSLASISS

SEQ ID NO: 231643 - protein, 10 aa, Japanese encephalitis virus
TTSLASISSQ

SEQ ID NO: 231644 - protein, 10 aa, Japanese encephalitis virus
TSLASISSQA

SEQ ID NO: 231645 - protein, 10 aa, Japanese encephalitis virus
SLASISSQAG

SEQ ID NO: 231646 - protein, 10 aa, Japanese encephalitis virus
LASISSQAGS

SEQ ID NO: 231647 - protein, 10 aa, Japanese encephalitis virus
ASISSQAGSL

SEQ ID NO: 231648 - protein, 10 aa, Japanese encephalitis virus
SISSQAGSLF

SEQ ID NO: 231649 - protein, 10 aa, Japanese encephalitis virus
ISSQAGSLFV

SEQ ID NO: 231650 - protein, 10 aa, Japanese encephalitis virus
SSQAGSLFVL

SEQ ID NO: 231651 - protein, 10 aa, Japanese encephalitis virus
LFVLPRGVPS

SEQ ID NO: 231652 - protein, 10 aa, Japanese encephalitis virus
FVLPRGVPST

SEQ ID NO: 231653 - protein, 10 aa, Japanese encephalitis virus
VLPRGVPSTD

SEQ ID NO: 231654 - protein, 10 aa, Japanese encephalitis virus
LPRGVPSTDL

SEQ ID NO: 231655 - protein, 10 aa, Japanese encephalitis virus
PRGVPSTDLD

SEQ ID NO: 231656 - protein, 10 aa, Japanese encephalitis virus
RGVPSTDLDL

SEQ ID NO: 231657 - protein, 10 aa, Japanese encephalitis virus
GVPSTDLDLT

SEQ ID NO: 231658 - protein, 10 aa, Japanese encephalitis virus
VPSTDLDLTV

SEQ ID NO: 231659 - protein, 10 aa, Japanese encephalitis virus
PSTDLDLTVG

SEQ ID NO: 231660 - protein, 10 aa, Japanese encephalitis virus
STDLDLTVGL

SEQ ID NO: 231661 - protein, 10 aa, Japanese encephalitis virus
DLDLTVGLVL

SEQ ID NO: 231662 - protein, 10 aa, Japanese encephalitis virus
LDLTVGLVLL

SEQ ID NO: 231663 - protein, 10 aa, Japanese encephalitis virus
DLTVGLVLLG

SEQ ID NO: 231664 - protein, 10 aa, Japanese encephalitis virus
LTVGLVLLGC

SEQ ID NO: 231665 - protein, 10 aa, Japanese encephalitis virus
TVGLVLLGCW

SEQ ID NO: 231666 - protein, 10 aa, Japanese encephalitis virus
VGLVLLGCWG

SEQ ID NO: 231667 - protein, 10 aa, Japanese encephalitis virus
GLVLLGCWGQ

SEQ ID NO: 231668 - protein, 10 aa, Japanese encephalitis virus
LVFLGCWGQV

SEQ ID NO: 231669 - protein, 10 aa, Japanese encephalitis virus
VFLGCWGQVT

SEQ ID NO: 231670 - protein, 10 aa, Japanese encephalitis virus
FLGCWGQVTL

SEQ ID NO: 231671 - protein, 10 aa, Japanese encephalitis virus
LGCWGQVTLT

SEQ ID NO: 231672 - protein, 10 aa, Japanese encephalitis virus
GCWGQVTLTT

SEQ ID NO: 231673 - protein, 10 aa, Japanese encephalitis virus
CWGQVTLTTF

SEQ ID NO: 231674 - protein, 10 aa, Japanese encephalitis virus
WGQVTLTTFL

SEQ ID NO: 231675 - protein, 10 aa, Japanese encephalitis virus
GQVTLTTFLT

SEQ ID NO: 231676 - protein, 10 aa, Japanese encephalitis virus
QVTLTTFLTA

SEQ ID NO: 231677 - protein, 10 aa, Japanese encephalitis virus
ITLTTFLTAV

SEQ ID NO: 231678 - protein, 10 aa, Japanese encephalitis virus
TLTTFLTAVV

SEQ ID NO: 231679 - protein, 10 aa, Japanese encephalitis virus
LTTFLTAVVL

SEQ ID NO: 231680 - protein, 10 aa, Japanese encephalitis virus
LTAMVLVTLH

SEQ ID NO: 231681 - protein, 10 aa, Japanese encephalitis virus
TAMVLVTLHY

SEQ ID NO: 231682 - protein, 10 aa, Japanese encephalitis virus
AMVLVTLHYG

SEQ ID NO: 231683 - protein, 10 aa, Japanese encephalitis virus
VLVTLHYGYM

SEQ ID NO: 231684 - protein, 10 aa, Japanese encephalitis virus
LVTLHYGYML

SEQ ID NO: 231685 - protein, 10 aa, Japanese encephalitis virus
VTLHYGYMLP

SEQ ID NO: 231686 - protein, 10 aa, Japanese encephalitis virus
TLHYGFMLPG

SEQ ID NO: 231687 - protein, 10 aa, Japanese encephalitis virus
LHYGFMLPGW

SEQ ID NO: 231688 - protein, 10 aa, Japanese encephalitis virus
HYGFMLPGWQ

SEQ ID NO: 231689 - protein, 10 aa, Japanese encephalitis virus
YGFMLPGWQA

SEQ ID NO: 231690 - protein, 10 aa, Japanese encephalitis virus
GFMLPGWQAQ

SEQ ID NO: 231691 - protein, 10 aa, Japanese encephalitis virus
FMLPGWQAQA

SEQ ID NO: 231692 - protein, 10 aa, Japanese encephalitis virus
MLPGWQAQAL

SEQ ID NO: 231693 - protein, 10 aa, Japanese encephalitis virus
LPGWQAQALR

SEQ ID NO: 231694 - protein, 10 aa, Japanese encephalitis virus
PGWQAQALRA

SEQ ID NO: 231695 - protein, 10 aa, Japanese encephalitis virus
GWQAQALRAA

SEQ ID NO: 231696 - protein, 10 aa, Japanese encephalitis virus
WQAQALRAAQ

SEQ ID NO: 231697 - protein, 10 aa, Japanese encephalitis virus
QAQALRAAQR

SEQ ID NO: 231698 - protein, 10 aa, Japanese encephalitis virus
AQALRAAQRR

SEQ ID NO: 231699 - protein, 10 aa, Japanese encephalitis virus
QALRAAQRRT

SEQ ID NO: 231700 - protein, 10 aa, Japanese encephalitis virus
VATDVPELEK

SEQ ID NO: 231701 - protein, 10 aa, Japanese encephalitis virus
ATDVPELEKT

SEQ ID NO: 231702 - protein, 10 aa, Japanese encephalitis virus
TDVPELEKTT

SEQ ID NO: 231703 - protein, 10 aa, Japanese encephalitis virus
DVPELEKTTP

SEQ ID NO: 231704 - protein, 10 aa, Japanese encephalitis virus
VPELEKTTPL

SEQ ID NO: 231705 - protein, 10 aa, Japanese encephalitis virus
PELEKTTPLM

SEQ ID NO: 231706 - protein, 10 aa, Japanese encephalitis virus
ELEKTTPLMQ

SEQ ID NO: 231707 - protein, 10 aa, Japanese encephalitis virus
LEKTTPLMQK

SEQ ID NO: 231708 - protein, 10 aa, Japanese encephalitis virus
EKTTPLMQKK

SEQ ID NO: 231709 - protein, 10 aa, Japanese encephalitis virus
KTTPLMQKKI

SEQ ID NO: 231710 - protein, 10 aa, Japanese encephalitis virus
TTPLMQKKIG

SEQ ID NO: 231711 - protein, 10 aa, Japanese encephalitis virus
TPLMQKKIGQ

SEQ ID NO: 231712 - protein, 10 aa, Japanese encephalitis virus
PLMQKKIGQV

SEQ ID NO: 231713 - protein, 10 aa, Japanese encephalitis virus
LMQKKIGQVL

SEQ ID NO: 231714 - protein, 10 aa, Japanese encephalitis virus
MQKKIGQVLL

SEQ ID NO: 231715 - protein, 10 aa, Japanese encephalitis virus
QKKIGQVLLI

SEQ ID NO: 231716 - protein, 10 aa, Japanese encephalitis virus
KKIGQVLLIG

SEQ ID NO: 231717 - protein, 10 aa, Japanese encephalitis virus
KIGQVLLIGG

SEQ ID NO: 231718 - protein, 10 aa, Japanese encephalitis virus
IGQVLLIGGS

SEQ ID NO: 231719 - protein, 10 aa, Japanese encephalitis virus
GQVLLIGGSV

SEQ ID NO: 231720 - protein, 10 aa, Japanese encephalitis virus
QVLLIGGSVA

SEQ ID NO: 231721 - protein, 10 aa, Japanese encephalitis virus
VLLIGGSVAA

SEQ ID NO: 231722 - protein, 10 aa, Japanese encephalitis virus
LLIGVSVAAL

SEQ ID NO: 231723 - protein, 10 aa, Japanese encephalitis virus
LIGVSVAALL

SEQ ID NO: 231724 - protein, 10 aa, Japanese encephalitis virus
IGVSVAALLV

SEQ ID NO: 231725 - protein, 10 aa, Japanese encephalitis virus
GVSVAALLVN

SEQ ID NO: 231726 - protein, 10 aa, Japanese encephalitis virus
VSVAALLVNP

SEQ ID NO: 231727 - protein, 10 aa, Japanese encephalitis virus
SVAALLVNPN

SEQ ID NO: 231728 - protein, 10 aa, Japanese encephalitis virus
VAALLVNPNV

SEQ ID NO: 231729 - protein, 10 aa, Japanese encephalitis virus
AALLVNPNVT

SEQ ID NO: 231730 - protein, 10 aa, Japanese encephalitis virus
ALLVNPNVTT

SEQ ID NO: 231731 - protein, 10 aa, Japanese encephalitis virus
LLVNPNVTTV

SEQ ID NO: 231732 - protein, 10 aa, Japanese encephalitis virus
LVNPNVSTVR

SEQ ID NO: 231733 - protein, 10 aa, Japanese encephalitis virus
VNPKITTVRE

SEQ ID NO: 231734 - protein, 10 aa, Japanese encephalitis virus
NPKITTVREA

SEQ ID NO: 231735 - protein, 10 aa, Japanese encephalitis virus
PKITTVREAG

SEQ ID NO: 231736 - protein, 10 aa, Japanese encephalitis virus
KITTVREAGV

SEQ ID NO: 231737 - protein, 10 aa, Japanese encephalitis virus
VSTVRKAGVL

SEQ ID NO: 231738 - protein, 10 aa, Japanese encephalitis virus
STVRKAGVLV

SEQ ID NO: 231739 - protein, 10 aa, Japanese encephalitis virus
TVKKPGVLVT

SEQ ID NO: 231740 - protein, 10 aa, Japanese encephalitis virus
VRKAGVLVTA

SEQ ID NO: 231741 - protein, 10 aa, Japanese encephalitis virus
REAGVLVTAR

SEQ ID NO: 231742 - protein, 10 aa, Japanese encephalitis virus
EAGVLVTART

SEQ ID NO: 231743 - protein, 10 aa, Japanese encephalitis virus
AGVLVTARTL

SEQ ID NO: 231744 - protein, 10 aa, Japanese encephalitis virus
GVLVTARTLT

SEQ ID NO: 231745 - protein, 10 aa, Japanese encephalitis virus
VLVTARTLTL

SEQ ID NO: 231746 - protein, 10 aa, Japanese encephalitis virus
LVTARTLTLW

SEQ ID NO: 231747 - protein, 10 aa, Japanese encephalitis virus
VTARTLTLWD

SEQ ID NO: 231748 - protein, 10 aa, Japanese encephalitis virus
TARTLTLWDN

SEQ ID NO: 231749 - protein, 10 aa, Japanese encephalitis virus
ARTLTLWDNG

SEQ ID NO: 231750 - protein, 10 aa, Japanese encephalitis virus
RTLTLWDNGA

SEQ ID NO: 231751 - protein, 10 aa, Japanese encephalitis virus
TLSLWDNGAS

SEQ ID NO: 231752 - protein, 10 aa, Japanese encephalitis virus
LSLWDNGASA

SEQ ID NO: 231753 - protein, 10 aa, Japanese encephalitis virus
TLWDNGASAA

SEQ ID NO: 231754 - protein, 10 aa, Japanese encephalitis virus
LWDNGASAAW

SEQ ID NO: 231755 - protein, 10 aa, Japanese encephalitis virus
WDNGASAAWN

SEQ ID NO: 231756 - protein, 10 aa, Japanese encephalitis virus
DNGASAAWNS

SEQ ID NO: 231757 - protein, 10 aa, Japanese encephalitis virus
NGASAAWNST

SEQ ID NO: 231758 - protein, 10 aa, Japanese encephalitis virus
GASAAWNSTT

SEQ ID NO: 231759 - protein, 10 aa, Japanese encephalitis virus
ASAAWNSTTA

SEQ ID NO: 231760 - protein, 10 aa, Japanese encephalitis virus
SAAWNSTTAT

SEQ ID NO: 231761 - protein, 10 aa, Japanese encephalitis virus
AAWNSTTATG

SEQ ID NO: 231762 - protein, 10 aa, Japanese encephalitis virus
AWNSTTATGL

SEQ ID NO: 231763 - protein, 10 aa, Japanese encephalitis virus
CHVMRGSYLR

SEQ ID NO: 231764 - protein, 10 aa, Japanese encephalitis virus
HVMRGSYLRG

SEQ ID NO: 231765 - protein, 10 aa, Japanese encephalitis virus
VMRGSYLRGG

SEQ ID NO: 231766 - protein, 10 aa, Japanese encephalitis virus
MRGSYLRGGS

SEQ ID NO: 231767 - protein, 10 aa, Japanese encephalitis virus
RGSYLRGGSI

SEQ ID NO: 231768 - protein, 10 aa, Japanese encephalitis virus
GSYLRGGSIA

SEQ ID NO: 231769 - protein, 10 aa, Japanese encephalitis virus
SYLRGGSIAW

SEQ ID NO: 231770 - protein, 10 aa, Japanese encephalitis virus
YLRGGSIAWT

SEQ ID NO: 231771 - protein, 10 aa, Japanese encephalitis virus
LRGGSIAWTL

SEQ ID NO: 231772 - protein, 10 aa, Japanese encephalitis virus
RGGSIAWTLI

SEQ ID NO: 231773 - protein, 10 aa, Japanese encephalitis virus
IAWTLIKNAN

SEQ ID NO: 231774 - protein, 10 aa, Japanese encephalitis virus
AWTLIKNADN

SEQ ID NO: 231775 - protein, 10 aa, Japanese encephalitis virus
WTLIKNANKP

SEQ ID NO: 231776 - protein, 10 aa, Japanese encephalitis virus
TLIKNANKPS

SEQ ID NO: 231777 - protein, 10 aa, Japanese encephalitis virus
LIKNANKPSL

SEQ ID NO: 231778 - protein, 10 aa, Japanese encephalitis virus
IKNADKPSFK

SEQ ID NO: 231779 - protein, 10 aa, Japanese encephalitis virus
KNADNPSLKR

SEQ ID NO: 231780 - protein, 10 aa, Japanese encephalitis virus
NADKPSLKKG

SEQ ID NO: 231781 - protein, 10 aa, Japanese encephalitis virus
ADKPSFKKGR

SEQ ID NO: 231782 - protein, 10 aa, Japanese encephalitis virus
KPSLKRGRSG

SEQ ID NO: 231783 - protein, 10 aa, Japanese encephalitis virus
PSLKRGRSGG

SEQ ID NO: 231784 - protein, 10 aa, Japanese encephalitis virus
SLKRGRSGGR

SEQ ID NO: 231785 - protein, 10 aa, Japanese encephalitis virus
LKRGRSGGRT

SEQ ID NO: 231786 - protein, 10 aa, Japanese encephalitis virus
KKGRPGGRTL

SEQ ID NO: 231787 - protein, 10 aa, Japanese encephalitis virus
KGRPGGRTLG

SEQ ID NO: 231788 - protein, 10 aa, Japanese encephalitis virus
GRSGGRTLGE

SEQ ID NO: 231789 - protein, 10 aa, Japanese encephalitis virus
RSGGRTLGEQ

SEQ ID NO: 231790 - protein, 10 aa, Japanese encephalitis virus
SGGRTLGEQW

SEQ ID NO: 231791 - protein, 10 aa, Japanese encephalitis virus
GGRTLGDQWK

SEQ ID NO: 231792 - protein, 10 aa, Japanese encephalitis virus
GRTLWEQWKE

SEQ ID NO: 231793 - protein, 10 aa, Japanese encephalitis virus
RTLGEQWKRK

SEQ ID NO: 231794 - protein, 10 aa, Japanese encephalitis virus
TLGEQWKERL

SEQ ID NO: 231795 - protein, 10 aa, Japanese encephalitis virus
LGEQWKRKLN

SEQ ID NO: 231796 - protein, 10 aa, Japanese encephalitis virus
GEQWKERLNA

SEQ ID NO: 231797 - protein, 10 aa, Japanese encephalitis virus
EQWKEKLNAL

SEQ ID NO: 231798 - protein, 10 aa, Japanese encephalitis virus
QWKEKLNAMG

SEQ ID NO: 231799 - protein, 10 aa, Japanese encephalitis virus
WKERLNAMSR

SEQ ID NO: 231800 - protein, 10 aa, Japanese encephalitis virus
KLNAMSRDEF

SEQ ID NO: 231801 - protein, 10 aa, Japanese encephalitis virus
LNAMSRDEFF

SEQ ID NO: 231802 - protein, 10 aa, Japanese encephalitis virus
NAMSRDEFFK

SEQ ID NO: 231803 - protein, 10 aa, Japanese encephalitis virus
AMSRDEFFKY

SEQ ID NO: 231804 - protein, 10 aa, Japanese encephalitis virus
MSRDEFFKYR

SEQ ID NO: 231805 - protein, 10 aa, Japanese encephalitis virus
SRDEFFKYRR

SEQ ID NO: 231806 - protein, 10 aa, Japanese encephalitis virus
RDEFFKYRRE

SEQ ID NO: 231807 - protein, 10 aa, Japanese encephalitis virus
DEFFKYRREA

SEQ ID NO: 231808 - protein, 10 aa, Japanese encephalitis virus
EFFKYRREGI

SEQ ID NO: 231809 - protein, 10 aa, Japanese encephalitis virus
FFKYRREGII

SEQ ID NO: 231810 - protein, 10 aa, Japanese encephalitis virus
FQYRREAIIE

SEQ ID NO: 231811 - protein, 10 aa, Japanese encephalitis virus
QYRREAIIEV

SEQ ID NO: 231812 - protein, 10 aa, Japanese encephalitis virus
YRREGIIEVD

SEQ ID NO: 231813 - protein, 10 aa, Japanese encephalitis virus
RREGIIEVDR

SEQ ID NO: 231814 - protein, 10 aa, Japanese encephalitis virus
REGIIEVDRT

SEQ ID NO: 231815 - protein, 10 aa, Japanese encephalitis virus
EGIIEVDRTE

SEQ ID NO: 231816 - protein, 10 aa, Japanese encephalitis virus
GIIEVDRTEA

SEQ ID NO: 231817 - protein, 10 aa, Japanese encephalitis virus
IIEVDRTEAC

SEQ ID NO: 231818 - protein, 10 aa, Japanese encephalitis virus
IEVDRTEACR

SEQ ID NO: 231819 - protein, 10 aa, Japanese encephalitis virus
EVDRTEACRA

SEQ ID NO: 231820 - protein, 10 aa, Japanese encephalitis virus
VDRTEACRAR

SEQ ID NO: 231821 - protein, 10 aa, Japanese encephalitis virus
DRTEACRARR

SEQ ID NO: 231822 - protein, 10 aa, Japanese encephalitis virus
RTEACRARRE

SEQ ID NO: 231823 - protein, 10 aa, Japanese encephalitis virus
TEACRARREN

SEQ ID NO: 231824 - protein, 10 aa, Japanese encephalitis virus
EACRARRENN

SEQ ID NO: 231825 - protein, 10 aa, Japanese encephalitis virus
ARRARRENNV

SEQ ID NO: 231826 - protein, 10 aa, Japanese encephalitis virus
RRARRENNVV

SEQ ID NO: 231827 - protein, 10 aa, Japanese encephalitis virus
RARRENNVVG

SEQ ID NO: 231828 - protein, 10 aa, Japanese encephalitis virus
ARRENNVVGG

SEQ ID NO: 231829 - protein, 10 aa, Japanese encephalitis virus
RRENNVVGGH

SEQ ID NO: 231830 - protein, 10 aa, Japanese encephalitis virus
RENNVVGGHP

SEQ ID NO: 231831 - protein, 10 aa, Japanese encephalitis virus
ENNVVGGHPV

SEQ ID NO: 231832 - protein, 10 aa, Japanese encephalitis virus
NNVVGGHPVS

SEQ ID NO: 231833 - protein, 10 aa, Japanese encephalitis virus
NVVGGHPVSR

SEQ ID NO: 231834 - protein, 10 aa, Japanese encephalitis virus
VVGGHPVSRG

SEQ ID NO: 231835 - protein, 10 aa, Japanese encephalitis virus
RWLVEKGFVP

SEQ ID NO: 231836 - protein, 10 aa, Japanese encephalitis virus
WLVEKGFVPP

SEQ ID NO: 231837 - protein, 10 aa, Japanese encephalitis virus
LVEKGFVPPI

SEQ ID NO: 231838 - protein, 10 aa, Japanese encephalitis virus
VEKGFVPPIG

SEQ ID NO: 231839 - protein, 10 aa, Japanese encephalitis virus
EKGFVPPIGK

SEQ ID NO: 231840 - protein, 10 aa, Japanese encephalitis virus
KGFVPPIGKV

SEQ ID NO: 231841 - protein, 10 aa, Japanese encephalitis virus
GFVSPIGKVV

SEQ ID NO: 231842 - protein, 10 aa, Japanese encephalitis virus
FVSPIGKVVD

SEQ ID NO: 231843 - protein, 10 aa, Japanese encephalitis virus
VSPIGKVVDL

SEQ ID NO: 231844 - protein, 10 aa, Japanese encephalitis virus
PPIGKVIDLG

SEQ ID NO: 231845 - protein, 10 aa, Japanese encephalitis virus
PIGKVVDLGC

SEQ ID NO: 231846 - protein, 10 aa, Japanese encephalitis virus
IGKVVDLGCG

SEQ ID NO: 231847 - protein, 10 aa, Japanese encephalitis virus
GKVVDLGCGR

SEQ ID NO: 231848 - protein, 10 aa, Japanese encephalitis virus
KVIDLGCGCG

SEQ ID NO: 231849 - protein, 10 aa, Japanese encephalitis virus
VIDLGCGRGS

SEQ ID NO: 231850 - protein, 10 aa, Japanese encephalitis virus
IDLGCGRGSW

SEQ ID NO: 231851 - protein, 10 aa, Japanese encephalitis virus
DLGCGRGSWN

SEQ ID NO: 231852 - protein, 10 aa, Japanese encephalitis virus
LGCGRGSWNY

SEQ ID NO: 231853 - protein, 10 aa, Japanese encephalitis virus
GCGRGSWNYY

SEQ ID NO: 231854 - protein, 10 aa, Japanese encephalitis virus
CGRGSWNYYA

SEQ ID NO: 231855 - protein, 10 aa, Japanese encephalitis virus
GRGSWNYYAA

SEQ ID NO: 231856 - protein, 10 aa, Japanese encephalitis virus
RGSWNYYAAT

SEQ ID NO: 231857 - protein, 10 aa, Japanese encephalitis virus
GSWNYYAATL

SEQ ID NO: 231858 - protein, 10 aa, Japanese encephalitis virus
SWNYYAATLK

SEQ ID NO: 231859 - protein, 10 aa, Japanese encephalitis virus
WNYYAATLKK

SEQ ID NO: 231860 - protein, 10 aa, Japanese encephalitis virus
NYYAATLKKV

SEQ ID NO: 231861 - protein, 10 aa, Japanese encephalitis virus
YYAATLKRVQ

SEQ ID NO: 231862 - protein, 10 aa, Japanese encephalitis virus
YAATLKRVQE

SEQ ID NO: 231863 - protein, 10 aa, Japanese encephalitis virus
AATLKRVQEV

SEQ ID NO: 231864 - protein, 10 aa, Japanese encephalitis virus
ATLKKVQEVK

SEQ ID NO: 231865 - protein, 10 aa, Japanese encephalitis virus
TLKKVQEVKG

SEQ ID NO: 231866 - protein, 10 aa, Japanese encephalitis virus
LKKVQEVKGY

SEQ ID NO: 231867 - protein, 10 aa, Japanese encephalitis virus
KKVQEVKGYT

SEQ ID NO: 231868 - protein, 10 aa, Japanese encephalitis virus
KVQEVKGYTK

SEQ ID NO: 231869 - protein, 10 aa, Japanese encephalitis virus
VQEVKGYTKG

SEQ ID NO: 231870 - protein, 10 aa, Japanese encephalitis virus
QEVKGYTKGG

SEQ ID NO: 231871 - protein, 10 aa, Japanese encephalitis virus
EVKGYTKGGA

SEQ ID NO: 231872 - protein, 10 aa, Japanese encephalitis virus
VKGYTKGGAG

SEQ ID NO: 231873 - protein, 10 aa, Japanese encephalitis virus
KGYTKGGAGH

SEQ ID NO: 231874 - protein, 10 aa, Japanese encephalitis virus
GGAGHEEPMP

SEQ ID NO: 231875 - protein, 10 aa, Japanese encephalitis virus
GAGHEEPMPM

SEQ ID NO: 231876 - protein, 10 aa, Japanese encephalitis virus
AGHEEPMPMQ

SEQ ID NO: 231877 - protein, 10 aa, Japanese encephalitis virus
GHEEPMPMQS

SEQ ID NO: 231878 - protein, 10 aa, Japanese encephalitis virus
HEEPMPMQSY

SEQ ID NO: 231879 - protein, 10 aa, Japanese encephalitis virus
EEPMPMQSYG

SEQ ID NO: 231880 - protein, 10 aa, Japanese encephalitis virus
EPMLMQSYGR

SEQ ID NO: 231881 - protein, 10 aa, Japanese encephalitis virus
PMLMQSYGRN

SEQ ID NO: 231882 - protein, 10 aa, Japanese encephalitis virus
MLMQSYGRNL

SEQ ID NO: 231883 - protein, 10 aa, Japanese encephalitis virus
LMQSYGRNLV

SEQ ID NO: 231884 - protein, 10 aa, Japanese encephalitis virus
MQSYGRNLVS

SEQ ID NO: 231885 - protein, 10 aa, Japanese encephalitis virus
QSYGRNLVSL

SEQ ID NO: 231886 - protein, 10 aa, Japanese encephalitis virus
SYGRNLVSLK

SEQ ID NO: 231887 - protein, 10 aa, Japanese encephalitis virus
YGRNLVSLKS

SEQ ID NO: 231888 - protein, 10 aa, Japanese encephalitis virus
GRNLVSLKSG

SEQ ID NO: 231889 - protein, 10 aa, Japanese encephalitis virus
RNLVSLKSGV

SEQ ID NO: 231890 - protein, 10 aa, Japanese encephalitis virus
NLVSMKSGVD

SEQ ID NO: 231891 - protein, 10 aa, Japanese encephalitis virus
LVSMKSGVDV

SEQ ID NO: 231892 - protein, 10 aa, Japanese encephalitis virus
VSMKSGVDVF

SEQ ID NO: 231893 - protein, 10 aa, Japanese encephalitis virus
SLKSGVHVFY

SEQ ID NO: 231894 - protein, 10 aa, Japanese encephalitis virus
LKSGVHVFYK

SEQ ID NO: 231895 - protein, 10 aa, Japanese encephalitis virus
KSGVDVFYRP

SEQ ID NO: 231896 - protein, 10 aa, Japanese encephalitis virus
SGVDVFYRPS

SEQ ID NO: 231897 - protein, 10 aa, Japanese encephalitis virus
GVDVFYRPSE

SEQ ID NO: 231898 - protein, 10 aa, Japanese encephalitis virus
VHVFYKPSEP

SEQ ID NO: 231899 - protein, 10 aa, Japanese encephalitis virus
DVFYRPSEPS

SEQ ID NO: 231900 - protein, 10 aa, Japanese encephalitis virus
VFYRPSEPSD

SEQ ID NO: 231901 - protein, 10 aa, Japanese encephalitis virus
FYRPSEPSDT

SEQ ID NO: 231902 - protein, 10 aa, Japanese encephalitis virus
YRPSEPSDTL

SEQ ID NO: 231903 - protein, 10 aa, Japanese encephalitis virus
RPSEPSDTLL

SEQ ID NO: 231904 - protein, 10 aa, Japanese encephalitis virus
PSEPSDTLLC

SEQ ID NO: 231905 - protein, 10 aa, Japanese encephalitis virus
SEPSDTLLCD

SEQ ID NO: 231906 - protein, 10 aa, Japanese encephalitis virus
EPSDTLLCDI

SEQ ID NO: 231907 - protein, 10 aa, Japanese encephalitis virus
PSDTLLCDIG

SEQ ID NO: 231908 - protein, 10 aa, Japanese encephalitis virus
SDTLLCDIGE

SEQ ID NO: 231909 - protein, 10 aa, Japanese encephalitis virus
DTLLCDIGES

SEQ ID NO: 231910 - protein, 10 aa, Japanese encephalitis virus
TLLCDIGESS

SEQ ID NO: 231911 - protein, 10 aa, Japanese encephalitis virus
LLCDIGESSP

SEQ ID NO: 231912 - protein, 10 aa, Japanese encephalitis virus
LCDIGESSPS

SEQ ID NO: 231913 - protein, 10 aa, Japanese encephalitis virus
DIGESSPSPD

SEQ ID NO: 231914 - protein, 10 aa, Japanese encephalitis virus
IGESSPSPDV

SEQ ID NO: 231915 - protein, 10 aa, Japanese encephalitis virus
GESSPSPDVE

SEQ ID NO: 231916 - protein, 10 aa, Japanese encephalitis virus
ESSPSPDVEE

SEQ ID NO: 231917 - protein, 10 aa, Japanese encephalitis virus
SSPSPDVEEQ

SEQ ID NO: 231918 - protein, 10 aa, Japanese encephalitis virus
SPSPDVEEQR

SEQ ID NO: 231919 - protein, 10 aa, Japanese encephalitis virus
PSPDVEEQRT

SEQ ID NO: 231920 - protein, 10 aa, Japanese encephalitis virus
SPDVEEQRTL

SEQ ID NO: 231921 - protein, 10 aa, Japanese encephalitis virus
PDVEEQRTLR

SEQ ID NO: 231922 - protein, 10 aa, Japanese encephalitis virus
DVEEQRTLRV

SEQ ID NO: 231923 - protein, 10 aa, Japanese encephalitis virus
TSDWLHRGPI

SEQ ID NO: 231924 - protein, 10 aa, Japanese encephalitis virus
SDWLHRGPIE

SEQ ID NO: 231925 - protein, 10 aa, Japanese encephalitis virus
DWLHRGPIEF

SEQ ID NO: 231926 - protein, 10 aa, Japanese encephalitis virus
WLHRGPIEFC

SEQ ID NO: 231927 - protein, 10 aa, Japanese encephalitis virus
LHRGPIEFCI

SEQ ID NO: 231928 - protein, 10 aa, Japanese encephalitis virus
HRGPIEFCIK

SEQ ID NO: 231929 - protein, 10 aa, Japanese encephalitis virus
RGPIEFCIKV

SEQ ID NO: 231930 - protein, 10 aa, Japanese encephalitis virus
GPIEFCIKVL

SEQ ID NO: 231931 - protein, 10 aa, Japanese encephalitis virus
PIEFCIKVLC

SEQ ID NO: 231932 - protein, 10 aa, Japanese encephalitis virus
IEFCIKVLCP

SEQ ID NO: 231933 - protein, 10 aa, Japanese encephalitis virus
PYMPKVIEKI

SEQ ID NO: 231934 - protein, 10 aa, Japanese encephalitis virus
YMPKVIEKNE

SEQ ID NO: 231935 - protein, 10 aa, Japanese encephalitis virus
MPKVIEKIEV

SEQ ID NO: 231936 - protein, 10 aa, Japanese encephalitis virus
PKVIEKNEVL

SEQ ID NO: 231937 - protein, 10 aa, Japanese encephalitis virus
KVIEKIEVLQ

SEQ ID NO: 231938 - protein, 10 aa, Japanese encephalitis virus
VIEKIEVLQR

SEQ ID NO: 231939 - protein, 10 aa, Japanese encephalitis virus
IEKNEVLQRR

SEQ ID NO: 231940 - protein, 10 aa, Japanese encephalitis virus
EKIEVLQRRF

SEQ ID NO: 231941 - protein, 10 aa, Japanese encephalitis virus
KNEVLQRRFG

SEQ ID NO: 231942 - protein, 10 aa, Japanese encephalitis virus
IEVLQRRFGG

SEQ ID NO: 231943 - protein, 10 aa, Japanese encephalitis virus
VLQRRFGGGV

SEQ ID NO: 231944 - protein, 10 aa, Japanese encephalitis virus
LQRRFGGGVV

SEQ ID NO: 231945 - protein, 10 aa, Japanese encephalitis virus
QRRFGGGVVR

SEQ ID NO: 231946 - protein, 10 aa, Japanese encephalitis virus
RRFGGGVVRL

SEQ ID NO: 231947 - protein, 10 aa, Japanese encephalitis virus
RFGGGVVRLP

SEQ ID NO: 231948 - protein, 10 aa, Japanese encephalitis virus
FGGGVVRLPL

SEQ ID NO: 231949 - protein, 10 aa, Japanese encephalitis virus
GGGVVRLPLS

SEQ ID NO: 231950 - protein, 10 aa, Japanese encephalitis virus
GGVVRLPLSR

SEQ ID NO: 231951 - protein, 10 aa, Japanese encephalitis virus
GVVRLPLSRN

SEQ ID NO: 231952 - protein, 10 aa, Japanese encephalitis virus
VVRLPLSRNS

SEQ ID NO: 231953 - protein, 10 aa, Japanese encephalitis virus
NHEMYWVSGP

SEQ ID NO: 231954 - protein, 10 aa, Japanese encephalitis virus
HEMYWVSGPA

SEQ ID NO: 231955 - protein, 10 aa, Japanese encephalitis virus
EMYWVSGPAG

SEQ ID NO: 231956 - protein, 10 aa, Japanese encephalitis virus
MYWVSGPAGN

SEQ ID NO: 231957 - protein, 10 aa, Japanese encephalitis virus
YWVSGPAGNV

SEQ ID NO: 231958 - protein, 10 aa, Japanese encephalitis virus
WVSGPAGNVV

SEQ ID NO: 231959 - protein, 10 aa, Japanese encephalitis virus
VSGPAGNVVH

SEQ ID NO: 231960 - protein, 10 aa, Japanese encephalitis virus
SGPAGNVVHA

SEQ ID NO: 231961 - protein, 10 aa, Japanese encephalitis virus
GPAGNVVHAV

SEQ ID NO: 231962 - protein, 10 aa, Japanese encephalitis virus
PAGNVVHAVN

SEQ ID NO: 231963 - protein, 10 aa, Japanese encephalitis virus
TSQVLLGRMN

SEQ ID NO: 231964 - protein, 10 aa, Japanese encephalitis virus
SQVLLGRMNR

SEQ ID NO: 231965 - protein, 10 aa, Japanese encephalitis virus
QVLLGRMNRT

SEQ ID NO: 231966 - protein, 10 aa, Japanese encephalitis virus
VLLGRMNRTV

SEQ ID NO: 231967 - protein, 10 aa, Japanese encephalitis virus
LLGRMNRTVW

SEQ ID NO: 231968 - protein, 10 aa, Japanese encephalitis virus
LGRMDRAVWR

SEQ ID NO: 231969 - protein, 10 aa, Japanese encephalitis virus
GRMDRAVWRG

SEQ ID NO: 231970 - protein, 10 aa, Japanese encephalitis virus
RMNRTVWRGP

SEQ ID NO: 231971 - protein, 10 aa, Japanese encephalitis virus
MNRTVWRGPK

SEQ ID NO: 231972 - protein, 10 aa, Japanese encephalitis virus
DRTVWRGPRY

SEQ ID NO: 231973 - protein, 10 aa, Japanese encephalitis virus
RAVWRGPKYE

SEQ ID NO: 231974 - protein, 10 aa, Japanese encephalitis virus
TVWRGPKYKE

SEQ ID NO: 231975 - protein, 10 aa, Japanese encephalitis virus
VWRGPRYEED

SEQ ID NO: 231976 - protein, 10 aa, Japanese encephalitis virus
WRGPRYEEDV

SEQ ID NO: 231977 - protein, 10 aa, Japanese encephalitis virus
RGPRYEEDVN

SEQ ID NO: 231978 - protein, 10 aa, Japanese encephalitis virus
GPKYKEDVNL

SEQ ID NO: 231979 - protein, 10 aa, Japanese encephalitis virus
PKYKEDVNLG

SEQ ID NO: 231980 - protein, 10 aa, Japanese encephalitis virus
KYKEDVNLGS

SEQ ID NO: 231981 - protein, 10 aa, Japanese encephalitis virus
YKEDVNLGSG

SEQ ID NO: 231982 - protein, 10 aa, Japanese encephalitis virus
KEDVNLGSGT

SEQ ID NO: 231983 - protein, 10 aa, Japanese encephalitis virus
GTRAVGKGEI

SEQ ID NO: 231984 - protein, 10 aa, Japanese encephalitis virus
TRAVGKGEIH

SEQ ID NO: 231985 - protein, 10 aa, Japanese encephalitis virus
RAVGKGEIHS

SEQ ID NO: 231986 - protein, 10 aa, Japanese encephalitis virus
AVGKGEIHSN

SEQ ID NO: 231987 - protein, 10 aa, Japanese encephalitis virus
VGKGEIHSNQ

SEQ ID NO: 231988 - protein, 10 aa, Japanese encephalitis virus
QEKIRKRIQK

SEQ ID NO: 231989 - protein, 10 aa, Japanese encephalitis virus
KIRKRIQKLR

SEQ ID NO: 231990 - protein, 10 aa, Japanese encephalitis virus
IRKRIQKLRE

SEQ ID NO: 231991 - protein, 10 aa, Japanese encephalitis virus
KRIQKLREEF

SEQ ID NO: 231992 - protein, 10 aa, Japanese encephalitis virus
RIQKLREEFA

SEQ ID NO: 231993 - protein, 10 aa, Japanese encephalitis virus
IQKLREEFAT

SEQ ID NO: 231994 - protein, 10 aa, Japanese encephalitis virus
QKLREEFATT

SEQ ID NO: 231995 - protein, 10 aa, Japanese encephalitis virus
KLREEFATTW

SEQ ID NO: 231996 - protein, 10 aa, Japanese encephalitis virus
LREEFATTWH

SEQ ID NO: 231997 - protein, 10 aa, Japanese encephalitis virus
REEFATTWHK

SEQ ID NO: 231998 - protein, 10 aa, Japanese encephalitis virus
EEFGTTWHKD

SEQ ID NO: 231999 - protein, 10 aa, Japanese encephalitis virus
GFATTWHKDP

SEQ ID NO: 232000 - protein, 10 aa, Japanese encephalitis virus
FGTTWHKDPE

SEQ ID NO: 232001 - protein, 10 aa, Japanese encephalitis virus
ATTWHKDHEH

SEQ ID NO: 232002 - protein, 10 aa, Japanese encephalitis virus
TTWHRDPEHP

SEQ ID NO: 232003 - protein, 10 aa, Japanese encephalitis virus
TWHKDHEHPY

SEQ ID NO: 232004 - protein, 10 aa, Japanese encephalitis virus
WHKDHEHPYR

SEQ ID NO: 232005 - protein, 10 aa, Japanese encephalitis virus
HRDPEHPYRT

SEQ ID NO: 232006 - protein, 10 aa, Japanese encephalitis virus
RDPEHPYRTW

SEQ ID NO: 232007 - protein, 10 aa, Japanese encephalitis virus
DPEHPYRNWT

SEQ ID NO: 232008 - protein, 10 aa, Japanese encephalitis virus
HEHPYRTWTY

SEQ ID NO: 232009 - protein, 10 aa, Japanese encephalitis virus
EHPYRNWTYH

SEQ ID NO: 232010 - protein, 10 aa, Japanese encephalitis virus
HPYRNWTYHG

SEQ ID NO: 232011 - protein, 10 aa, Japanese encephalitis virus
PYRNWTYHGS

SEQ ID NO: 232012 - protein, 10 aa, Japanese encephalitis virus
YRNWTYHGSY

SEQ ID NO: 232013 - protein, 10 aa, Japanese encephalitis virus
RNWTYHGSYE

SEQ ID NO: 232014 - protein, 10 aa, Japanese encephalitis virus
NWTYHGSYEV

SEQ ID NO: 232015 - protein, 10 aa, Japanese encephalitis virus
WTYHGSYEVR

SEQ ID NO: 232016 - protein, 10 aa, Japanese encephalitis virus
TYHGSYEVRA

SEQ ID NO: 232017 - protein, 10 aa, Japanese encephalitis virus
YHGSYEVKAN

SEQ ID NO: 232018 - protein, 10 aa, Japanese encephalitis virus
HGSYEVRATG

SEQ ID NO: 232019 - protein, 10 aa, Japanese encephalitis virus
GSYEVKANGS

SEQ ID NO: 232020 - protein, 10 aa, Japanese encephalitis virus
SYEVKANGSA

SEQ ID NO: 232021 - protein, 10 aa, Japanese encephalitis virus
YEVKANGSAS

SEQ ID NO: 232022 - protein, 10 aa, Japanese encephalitis virus
EVKANGSASS

SEQ ID NO: 232023 - protein, 10 aa, Japanese encephalitis virus
VKANGSASSL

SEQ ID NO: 232024 - protein, 10 aa, Japanese encephalitis virus
KANGSASSLV

SEQ ID NO: 232025 - protein, 10 aa, Japanese encephalitis virus
ANGSASSLVN

SEQ ID NO: 232026 - protein, 10 aa, Japanese encephalitis virus
NGSASSLVNG

SEQ ID NO: 232027 - protein, 10 aa, Japanese encephalitis virus
ASSLVNGVVE

SEQ ID NO: 232028 - protein, 10 aa, Japanese encephalitis virus
SSLVNGVVEL

SEQ ID NO: 232029 - protein, 10 aa, Japanese encephalitis virus
SLVNGVVELM

SEQ ID NO: 232030 - protein, 10 aa, Japanese encephalitis virus
LVNGVVELMS

SEQ ID NO: 232031 - protein, 10 aa, Japanese encephalitis virus
VNGVVELMSK

SEQ ID NO: 232032 - protein, 10 aa, Japanese encephalitis virus
NGVVELMSKP

SEQ ID NO: 232033 - protein, 10 aa, Japanese encephalitis virus
GVVELMSKPW

SEQ ID NO: 232034 - protein, 10 aa, Japanese encephalitis virus
VVELMSKPWD

SEQ ID NO: 232035 - protein, 10 aa, Japanese encephalitis virus
VKLMSKPWDT

SEQ ID NO: 232036 - protein, 10 aa, Japanese encephalitis virus
ELMSKPWDAI

SEQ ID NO: 232037 - protein, 10 aa, Japanese encephalitis virus
LMSKPWDTIA

SEQ ID NO: 232038 - protein, 10 aa, Japanese encephalitis virus
MSKPWDTIAN

SEQ ID NO: 232039 - protein, 10 aa, Japanese encephalitis virus
SKPWDAISYV

SEQ ID NO: 232040 - protein, 10 aa, Japanese encephalitis virus
KPWDTIANVT

SEQ ID NO: 232041 - protein, 10 aa, Japanese encephalitis virus
PWDAISYVTT

SEQ ID NO: 232042 - protein, 10 aa, Japanese encephalitis virus
WDAISYVTTM

SEQ ID NO: 232043 - protein, 10 aa, Japanese encephalitis virus
DTIANVTTMA

SEQ ID NO: 232044 - protein, 10 aa, Japanese encephalitis virus
AISYVTTMPM

SEQ ID NO: 232045 - protein, 10 aa, Japanese encephalitis virus
ISYVTTMPMT

SEQ ID NO: 232046 - protein, 10 aa, Japanese encephalitis virus
SYVTTMPMTD

SEQ ID NO: 232047 - protein, 10 aa, Japanese encephalitis virus
YVTTMPMTDT

SEQ ID NO: 232048 - protein, 10 aa, Japanese encephalitis virus
VTTMPMTDTT

SEQ ID NO: 232049 - protein, 10 aa, Japanese encephalitis virus
TTMPMTDTTP

SEQ ID NO: 232050 - protein, 10 aa, Japanese encephalitis virus
TMPMTDTTPF

SEQ ID NO: 232051 - protein, 10 aa, Japanese encephalitis virus
MPMTDTTPFG

SEQ ID NO: 232052 - protein, 10 aa, Japanese encephalitis virus
PMTDTTPFGQ

SEQ ID NO: 232053 - protein, 10 aa, Japanese encephalitis virus
QQRVFKEKVG

SEQ ID NO: 232054 - protein, 10 aa, Japanese encephalitis virus
QRVFKEKVGT

SEQ ID NO: 232055 - protein, 10 aa, Japanese encephalitis virus
RVFKEKVGTK

SEQ ID NO: 232056 - protein, 10 aa, Japanese encephalitis virus
VFKEKVGTKA

SEQ ID NO: 232057 - protein, 10 aa, Japanese encephalitis virus
FKEKVGTMAP

SEQ ID NO: 232058 - protein, 10 aa, Japanese encephalitis virus
KEKVGTKAPE

SEQ ID NO: 232059 - protein, 10 aa, Japanese encephalitis virus
EKVGTKAPEP

SEQ ID NO: 232060 - protein, 10 aa, Japanese encephalitis virus
KVGTMAPEPP

SEQ ID NO: 232061 - protein, 10 aa, Japanese encephalitis virus
GVKEVLNETT

SEQ ID NO: 232062 - protein, 10 aa, Japanese encephalitis virus
VKEVLNETTN

SEQ ID NO: 232063 - protein, 10 aa, Japanese encephalitis virus
REVLNETTNW

SEQ ID NO: 232064 - protein, 10 aa, Japanese encephalitis virus
NETTNWLWAY

SEQ ID NO: 232065 - protein, 10 aa, Japanese encephalitis virus
ETTNWLWAYL

SEQ ID NO: 232066 - protein, 10 aa, Japanese encephalitis virus
TTNWLWAYLS

SEQ ID NO: 232067 - protein, 10 aa, Japanese encephalitis virus
TNWLWAYLSR

SEQ ID NO: 232068 - protein, 10 aa, Japanese encephalitis virus
NWLWAYLSRE

SEQ ID NO: 232069 - protein, 10 aa, Japanese encephalitis virus
WLWAYLSREK

SEQ ID NO: 232070 - protein, 10 aa, Japanese encephalitis virus
LWAYLSREKR

SEQ ID NO: 232071 - protein, 10 aa, Japanese encephalitis virus
WAYLSREKRP

SEQ ID NO: 232072 - protein, 10 aa, Japanese encephalitis virus
AYLSREKRPR

SEQ ID NO: 232073 - protein, 10 aa, Japanese encephalitis virus
YLSREKRPRL

SEQ ID NO: 232074 - protein, 10 aa, Japanese encephalitis virus
LSRKKRPRLC

SEQ ID NO: 232075 - protein, 10 aa, Japanese encephalitis virus
SRKKRPRLCT

SEQ ID NO: 232076 - protein, 10 aa, Japanese encephalitis virus
RKKRPRLCTK

SEQ ID NO: 232077 - protein, 10 aa, Japanese encephalitis virus
KKRPRLCTKE

SEQ ID NO: 232078 - protein, 10 aa, Japanese encephalitis virus
RLCTKEEFIR

SEQ ID NO: 232079 - protein, 10 aa, Japanese encephalitis virus
LCTKEEFIRK

SEQ ID NO: 232080 - protein, 10 aa, Japanese encephalitis virus
CTKEEFIRKV

SEQ ID NO: 232081 - protein, 10 aa, Japanese encephalitis virus
TKEEFIRKVN

SEQ ID NO: 232082 - protein, 10 aa, Japanese encephalitis virus
KEEFIRKVNS

SEQ ID NO: 232083 - protein, 10 aa, Japanese encephalitis virus
EEFIRKVNSN

SEQ ID NO: 232084 - protein, 10 aa, Japanese encephalitis virus
EFIRKVNSNA

SEQ ID NO: 232085 - protein, 10 aa, Japanese encephalitis virus
KVNSNASLGT

SEQ ID NO: 232086 - protein, 10 aa, Japanese encephalitis virus
VNSDAALGAV

SEQ ID NO: 232087 - protein, 10 aa, Japanese encephalitis virus
NSSAALGAVF

SEQ ID NO: 232088 - protein, 10 aa, Japanese encephalitis virus
SSAALGAVFA

SEQ ID NO: 232089 - protein, 10 aa, Japanese encephalitis virus
DAALGAVFAE

SEQ ID NO: 232090 - protein, 10 aa, Japanese encephalitis virus
ASLGTVFAEQ

SEQ ID NO: 232091 - protein, 10 aa, Japanese encephalitis virus
SLGTVFAEQN

SEQ ID NO: 232092 - protein, 10 aa, Japanese encephalitis virus
LGTVFAEQNQ

SEQ ID NO: 232093 - protein, 10 aa, Japanese encephalitis virus
GTVFAEQNQW

SEQ ID NO: 232094 - protein, 10 aa, Japanese encephalitis virus
TVFAEQNQWS

SEQ ID NO: 232095 - protein, 10 aa, Japanese encephalitis virus
QWSTAREAVG

SEQ ID NO: 232096 - protein, 10 aa, Japanese encephalitis virus
WSTAREAVGD

SEQ ID NO: 232097 - protein, 10 aa, Japanese encephalitis virus
STAREAVGDP

SEQ ID NO: 232098 - protein, 10 aa, Japanese encephalitis virus
FWEMVNEERE

SEQ ID NO: 232099 - protein, 10 aa, Japanese encephalitis virus
WEMVNEEREN

SEQ ID NO: 232100 - protein, 10 aa, Japanese encephalitis virus
EMVNEERENH

SEQ ID NO: 232101 - protein, 10 aa, Japanese encephalitis virus
MVNEERENHL

SEQ ID NO: 232102 - protein, 10 aa, Japanese encephalitis virus
VNEERENHLR

SEQ ID NO: 232103 - protein, 10 aa, Japanese encephalitis virus
NEERENHLRG

SEQ ID NO: 232104 - protein, 10 aa, Japanese encephalitis virus
VERENHLRGE

SEQ ID NO: 232105 - protein, 10 aa, Japanese encephalitis virus
NHLRGECHTR

SEQ ID NO: 232106 - protein, 10 aa, Japanese encephalitis virus
HLRGECHTCV

SEQ ID NO: 232107 - protein, 10 aa, Japanese encephalitis virus
LRGECHTCVY

SEQ ID NO: 232108 - protein, 10 aa, Japanese encephalitis virus
RGECHTCVYN

SEQ ID NO: 232109 - protein, 10 aa, Japanese encephalitis virus
GECHTCVYNM

SEQ ID NO: 232110 - protein, 10 aa, Japanese encephalitis virus
ECHTCVYNMM

SEQ ID NO: 232111 - protein, 10 aa, Japanese encephalitis virus
CHTCVYNMMG

SEQ ID NO: 232112 - protein, 10 aa, Japanese encephalitis virus
HTCVYNMMGK

SEQ ID NO: 232113 - protein, 10 aa, Japanese encephalitis virus
TCVYNMMGKR

SEQ ID NO: 232114 - protein, 10 aa, Japanese encephalitis virus
CVYNMMGKRE

SEQ ID NO: 232115 - protein, 10 aa, Japanese encephalitis virus
VYNMMGKREK

SEQ ID NO: 232116 - protein, 10 aa, Japanese encephalitis virus
YHMMGKREKK

SEQ ID NO: 232117 - protein, 10 aa, Japanese encephalitis virus
HMMGKREKKP

SEQ ID NO: 232118 - protein, 10 aa, Japanese encephalitis virus
RYLEFEALGS

SEQ ID NO: 232119 - protein, 10 aa, Japanese encephalitis virus
YLEFEALGSL

SEQ ID NO: 232120 - protein, 10 aa, Japanese encephalitis virus
LEFEALGSLN

SEQ ID NO: 232121 - protein, 10 aa, Japanese encephalitis virus
EFEALGFLNL

SEQ ID NO: 232122 - protein, 10 aa, Japanese encephalitis virus
FEALGFLNEN

SEQ ID NO: 232123 - protein, 10 aa, Japanese encephalitis virus
EALGFLNLDH

SEQ ID NO: 232124 - protein, 10 aa, Japanese encephalitis virus
ALGFLNENHW

SEQ ID NO: 232125 - protein, 10 aa, Japanese encephalitis virus
LGSLNEDHWL

SEQ ID NO: 232126 - protein, 10 aa, Japanese encephalitis virus
GFLNLDHWLS

SEQ ID NO: 232127 - protein, 10 aa, Japanese encephalitis virus
FLNLDHWLSR

SEQ ID NO: 232128 - protein, 10 aa, Japanese encephalitis virus
LNENHWLSRE

SEQ ID NO: 232129 - protein, 10 aa, Japanese encephalitis virus
NLDHWLSREN

SEQ ID NO: 232130 - protein, 10 aa, Japanese encephalitis virus
ENHWLSRENS

SEQ ID NO: 232131 - protein, 10 aa, Japanese encephalitis virus
NHWLSRENSG

SEQ ID NO: 232132 - protein, 10 aa, Japanese encephalitis virus
HWLSRRNSGG

SEQ ID NO: 232133 - protein, 10 aa, Japanese encephalitis virus
WLSRENSRGG

SEQ ID NO: 232134 - protein, 10 aa, Japanese encephalitis virus
LSRENSRGGV

SEQ ID NO: 232135 - protein, 10 aa, Japanese encephalitis virus
SRRNSGGGVE

SEQ ID NO: 232136 - protein, 10 aa, Japanese encephalitis virus
RENSGGGEEG

SEQ ID NO: 232137 - protein, 10 aa, Japanese encephalitis virus
RNSGGGVEGS

SEQ ID NO: 232138 - protein, 10 aa, Japanese encephalitis virus
NSRGGVEGSS

SEQ ID NO: 232139 - protein, 10 aa, Japanese encephalitis virus
SGGGVEGLGV

SEQ ID NO: 232140 - protein, 10 aa, Japanese encephalitis virus
GGGVEGSSVQ

SEQ ID NO: 232141 - protein, 10 aa, Japanese encephalitis virus
GGVEGSSVQK

SEQ ID NO: 232142 - protein, 10 aa, Japanese encephalitis virus
GVEGSSVQKL

SEQ ID NO: 232143 - protein, 10 aa, Japanese encephalitis virus
VEGSSVQKLG

SEQ ID NO: 232144 - protein, 10 aa, Japanese encephalitis virus
EGSSVQKLGY

SEQ ID NO: 232145 - protein, 10 aa, Japanese encephalitis virus
GSSVQKLGYI

SEQ ID NO: 232146 - protein, 10 aa, Japanese encephalitis virus
SVQKLGYILR

SEQ ID NO: 232147 - protein, 10 aa, Japanese encephalitis virus
VQKLGYIIRD

SEQ ID NO: 232148 - protein, 10 aa, Japanese encephalitis virus
QKLGYISGDI

SEQ ID NO: 232149 - protein, 10 aa, Japanese encephalitis virus
KLGYIFRDIA

SEQ ID NO: 232150 - protein, 10 aa, Japanese encephalitis virus
RDIARKEGGK

SEQ ID NO: 232151 - protein, 10 aa, Japanese encephalitis virus
DIARKEGGKM

SEQ ID NO: 232152 - protein, 10 aa, Japanese encephalitis virus
ITSRAIGKMY

SEQ ID NO: 232153 - protein, 10 aa, Japanese encephalitis virus
ARKEGGKMYA

SEQ ID NO: 232154 - protein, 10 aa, Japanese encephalitis virus
RKEGGKMYAD

SEQ ID NO: 232155 - protein, 10 aa, Japanese encephalitis virus
RAIGKMYADD

SEQ ID NO: 232156 - protein, 10 aa, Japanese encephalitis virus
EGGKMYADDT

SEQ ID NO: 232157 - protein, 10 aa, Japanese encephalitis virus
IGKMYADDTA

SEQ ID NO: 232158 - protein, 10 aa, Japanese encephalitis virus
GKMYADDPAG

SEQ ID NO: 232159 - protein, 10 aa, Japanese encephalitis virus
KMYADDPAGW

SEQ ID NO: 232160 - protein, 10 aa, Japanese encephalitis virus
MYADDPAGWD

SEQ ID NO: 232161 - protein, 10 aa, Japanese encephalitis virus
YADDPAGWDT

SEQ ID NO: 232162 - protein, 10 aa, Japanese encephalitis virus
ADDPAGWDTR

SEQ ID NO: 232163 - protein, 10 aa, Japanese encephalitis virus
DDPAGWDTRI

SEQ ID NO: 232164 - protein, 10 aa, Japanese encephalitis virus
DPAGWDTRIT

SEQ ID NO: 232165 - protein, 10 aa, Japanese encephalitis virus
TAGWDTRITK

SEQ ID NO: 232166 - protein, 10 aa, Japanese encephalitis virus
AGWDTRITRA

SEQ ID NO: 232167 - protein, 10 aa, Japanese encephalitis virus
GWDTRITRAD

SEQ ID NO: 232168 - protein, 10 aa, Japanese encephalitis virus
WDTRITRADL

SEQ ID NO: 232169 - protein, 10 aa, Japanese encephalitis virus
DTRITRADLE

SEQ ID NO: 232170 - protein, 10 aa, Japanese encephalitis virus
TRITRADLEN

SEQ ID NO: 232171 - protein, 10 aa, Japanese encephalitis virus
RITRADLENE

SEQ ID NO: 232172 - protein, 10 aa, Japanese encephalitis virus
ITRADLENEA

SEQ ID NO: 232173 - protein, 10 aa, Japanese encephalitis virus
TRADLENEAK

SEQ ID NO: 232174 - protein, 10 aa, Japanese encephalitis virus
RADLENEAKV

SEQ ID NO: 232175 - protein, 10 aa, Japanese encephalitis virus
ADLENEAKVL

SEQ ID NO: 232176 - protein, 10 aa, Japanese encephalitis virus
LELLDGEHRK

SEQ ID NO: 232177 - protein, 10 aa, Japanese encephalitis virus
ELLDGEHRKL

SEQ ID NO: 232178 - protein, 10 aa, Japanese encephalitis virus
LLDGEHRKLA

SEQ ID NO: 232179 - protein, 10 aa, Japanese encephalitis virus
LDGEHRKLAR

SEQ ID NO: 232180 - protein, 10 aa, Japanese encephalitis virus
DGEHRKLARA

SEQ ID NO: 232181 - protein, 10 aa, Japanese encephalitis virus
GEHRKLARAI

SEQ ID NO: 232182 - protein, 10 aa, Japanese encephalitis virus
EHRKLARAII

SEQ ID NO: 232183 - protein, 10 aa, Japanese encephalitis virus
HRKLARAIIE

SEQ ID NO: 232184 - protein, 10 aa, Japanese encephalitis virus
RKLARAIIEL

SEQ ID NO: 232185 - protein, 10 aa, Japanese encephalitis virus
KLARAIIELT

SEQ ID NO: 232186 - protein, 10 aa, Japanese encephalitis virus
ARAIIELTYK

SEQ ID NO: 232187 - protein, 10 aa, Japanese encephalitis virus
RAIIELTYKH

SEQ ID NO: 232188 - protein, 10 aa, Japanese encephalitis virus
AIIELTYRHQ

SEQ ID NO: 232189 - protein, 10 aa, Japanese encephalitis virus
IIELTYKHKV

SEQ ID NO: 232190 - protein, 10 aa, Japanese encephalitis virus
IELTYRHQVF

SEQ ID NO: 232191 - protein, 10 aa, Japanese encephalitis virus
ELTYRHQVFK

SEQ ID NO: 232192 - protein, 10 aa, Japanese encephalitis virus
LTYKHKVVKV

SEQ ID NO: 232193 - protein, 10 aa, Japanese encephalitis virus
TYKHKVVKVM

SEQ ID NO: 232194 - protein, 10 aa, Japanese encephalitis virus
YRHQVFKVMR

SEQ ID NO: 232195 - protein, 10 aa, Japanese encephalitis virus
KHKVVKVMRP

SEQ ID NO: 232196 - protein, 10 aa, Japanese encephalitis virus
HQVFKVMRPA

SEQ ID NO: 232197 - protein, 10 aa, Japanese encephalitis virus
KVVKVMRPST

SEQ ID NO: 232198 - protein, 10 aa, Japanese encephalitis virus
KVMRPAAGGK

SEQ ID NO: 232199 - protein, 10 aa, Japanese encephalitis virus
VMRPAAGGKT

SEQ ID NO: 232200 - protein, 10 aa, Japanese encephalitis virus
MRPAAGGKTV

SEQ ID NO: 232201 - protein, 10 aa, Japanese encephalitis virus
RPAAGGKTVM

SEQ ID NO: 232202 - protein, 10 aa, Japanese encephalitis virus
GGKTVMDVIS

SEQ ID NO: 232203 - protein, 10 aa, Japanese encephalitis virus
GKTVMVVYSR

SEQ ID NO: 232204 - protein, 10 aa, Japanese encephalitis virus
KTVMVVYSRE

SEQ ID NO: 232205 - protein, 10 aa, Japanese encephalitis virus
TGMAVISREN

SEQ ID NO: 232206 - protein, 10 aa, Japanese encephalitis virus
GMAVISRENQ

SEQ ID NO: 232207 - protein, 10 aa, Japanese encephalitis virus
MAVISRENQR

SEQ ID NO: 232208 - protein, 10 aa, Japanese encephalitis virus
VVYSREDQRG

SEQ ID NO: 232209 - protein, 10 aa, Japanese encephalitis virus
VYSREDQRGS

SEQ ID NO: 232210 - protein, 10 aa, Japanese encephalitis virus
ISRENQRGSG

SEQ ID NO: 232211 - protein, 10 aa, Japanese encephalitis virus
SRENQRGSGQ

SEQ ID NO: 232212 - protein, 10 aa, Japanese encephalitis virus
RENQRGSGQV

SEQ ID NO: 232213 - protein, 10 aa, Japanese encephalitis virus
ENQRGSGQVV

SEQ ID NO: 232214 - protein, 10 aa, Japanese encephalitis virus
NQRGSGQVVT

SEQ ID NO: 232215 - protein, 10 aa, Japanese encephalitis virus
NTFTNIAVQF

SEQ ID NO: 232216 - protein, 10 aa, Japanese encephalitis virus
TFTNIAVQFV

SEQ ID NO: 232217 - protein, 10 aa, Japanese encephalitis virus
FTNIAVQFVR

SEQ ID NO: 232218 - protein, 10 aa, Japanese encephalitis virus
TNIAVQFVRL

SEQ ID NO: 232219 - protein, 10 aa, Japanese encephalitis virus
NIAVQFVRLM

SEQ ID NO: 232220 - protein, 10 aa, Japanese encephalitis virus
IAVQLVRLVE

SEQ ID NO: 232221 - protein, 10 aa, Japanese encephalitis virus
AVQLVRLVEA

SEQ ID NO: 232222 - protein, 10 aa, Japanese encephalitis virus
VQFVRLMKVE

SEQ ID NO: 232223 - protein, 10 aa, Japanese encephalitis virus
QFVRLMKVEG

SEQ ID NO: 232224 - protein, 10 aa, Japanese encephalitis virus
FVRLMKVEGV

SEQ ID NO: 232225 - protein, 10 aa, Japanese encephalitis virus
VRLVEAEGVI

SEQ ID NO: 232226 - protein, 10 aa, Japanese encephalitis virus
RLVEAEGVIG

SEQ ID NO: 232227 - protein, 10 aa, Japanese encephalitis virus
LVEAEGVIGP

SEQ ID NO: 232228 - protein, 10 aa, Japanese encephalitis virus
MKVEGVIGPQ

SEQ ID NO: 232229 - protein, 10 aa, Japanese encephalitis virus
KVEGVIGPQH

SEQ ID NO: 232230 - protein, 10 aa, Japanese encephalitis virus
AEGVIGPQHV

SEQ ID NO: 232231 - protein, 10 aa, Japanese encephalitis virus
EGVIGPQHVE

SEQ ID NO: 232232 - protein, 10 aa, Japanese encephalitis virus
GVIGPQHVEQ

SEQ ID NO: 232233 - protein, 10 aa, Japanese encephalitis virus
VIGPQHVEQL

SEQ ID NO: 232234 - protein, 10 aa, Japanese encephalitis virus
IGPQHLEHLP

SEQ ID NO: 232235 - protein, 10 aa, Japanese encephalitis virus
GPQHVEQLPR

SEQ ID NO: 232236 - protein, 10 aa, Japanese encephalitis virus
PQHLEQLPRE

SEQ ID NO: 232237 - protein, 10 aa, Japanese encephalitis virus
EQLPRKTKIA

SEQ ID NO: 232238 - protein, 10 aa, Japanese encephalitis virus
QLPRKTKIAV

SEQ ID NO: 232239 - protein, 10 aa, Japanese encephalitis virus
LPRKTKIAVR

SEQ ID NO: 232240 - protein, 10 aa, Japanese encephalitis virus
PRKTKIAVRT

SEQ ID NO: 232241 - protein, 10 aa, Japanese encephalitis virus
RKTKIAVRTW

SEQ ID NO: 232242 - protein, 10 aa, Japanese encephalitis virus
KTKIAVRTWL

SEQ ID NO: 232243 - protein, 10 aa, Japanese encephalitis virus
TKIAVRTWLF

SEQ ID NO: 232244 - protein, 10 aa, Japanese encephalitis virus
VRTWLFENGG

SEQ ID NO: 232245 - protein, 10 aa, Japanese encephalitis virus
RTWLFENGGE

SEQ ID NO: 232246 - protein, 10 aa, Japanese encephalitis virus
TWLFENGGER

SEQ ID NO: 232247 - protein, 10 aa, Japanese encephalitis virus
WLFENGGERV

SEQ ID NO: 232248 - protein, 10 aa, Japanese encephalitis virus
LFENGEERVS

SEQ ID NO: 232249 - protein, 10 aa, Japanese encephalitis virus
FENGEERVSR

SEQ ID NO: 232250 - protein, 10 aa, Japanese encephalitis virus
ENGEERVSRM

SEQ ID NO: 232251 - protein, 10 aa, Japanese encephalitis virus
NGEERVSRMA

SEQ ID NO: 232252 - protein, 10 aa, Japanese encephalitis virus
GEERVSRMAI

SEQ ID NO: 232253 - protein, 10 aa, Japanese encephalitis virus
EERVSRMAIS

SEQ ID NO: 232254 - protein, 10 aa, Japanese encephalitis virus
ERVSRMAISG

SEQ ID NO: 232255 - protein, 10 aa, Japanese encephalitis virus
RVSRMAISGD

SEQ ID NO: 232256 - protein, 10 aa, Japanese encephalitis virus
VSRMAISGDD

SEQ ID NO: 232257 - protein, 10 aa, Japanese encephalitis virus
SRMAISGDDC

SEQ ID NO: 232258 - protein, 10 aa, Japanese encephalitis virus
RMAISGDDCA

SEQ ID NO: 232259 - protein, 10 aa, Japanese encephalitis virus
MAISGDDCAV

SEQ ID NO: 232260 - protein, 10 aa, Japanese encephalitis virus
AISGDDCAVK

SEQ ID NO: 232261 - protein, 10 aa, Japanese encephalitis virus
ISGDDCAVKP

SEQ ID NO: 232262 - protein, 10 aa, Japanese encephalitis virus
SGDDCAVKPL

SEQ ID NO: 232263 - protein, 10 aa, Japanese encephalitis virus
GDDCAVKPLD

SEQ ID NO: 232264 - protein, 10 aa, Japanese encephalitis virus
DDCAVKPLDD

SEQ ID NO: 232265 - protein, 10 aa, Japanese encephalitis virus
DCAVKPLDDR

SEQ ID NO: 232266 - protein, 10 aa, Japanese encephalitis virus
CAVKPLDDRF

SEQ ID NO: 232267 - protein, 10 aa, Japanese encephalitis virus
AVKPLDDRFA

SEQ ID NO: 232268 - protein, 10 aa, Japanese encephalitis virus
KPLDDRFATS

SEQ ID NO: 232269 - protein, 10 aa, Japanese encephalitis virus
PLDDRFATSL

SEQ ID NO: 232270 - protein, 10 aa, Japanese encephalitis virus
LDDRFATALY

SEQ ID NO: 232271 - protein, 10 aa, Japanese encephalitis virus
DDRFATALYF

SEQ ID NO: 232272 - protein, 10 aa, Japanese encephalitis virus
DRFATSLHFL

SEQ ID NO: 232273 - protein, 10 aa, Japanese encephalitis virus
RFATALYFLN

SEQ ID NO: 232274 - protein, 10 aa, Japanese encephalitis virus
FATSLHFLNA

SEQ ID NO: 232275 - protein, 10 aa, Japanese encephalitis virus
ATSLHFLNAM

SEQ ID NO: 232276 - protein, 10 aa, Japanese encephalitis virus
TALYFLNAMS

SEQ ID NO: 232277 - protein, 10 aa, Japanese encephalitis virus
ALYFLNAMSK

SEQ ID NO: 232278 - protein, 10 aa, Japanese encephalitis virus
LYFLNAMSKV

SEQ ID NO: 232279 - protein, 10 aa, Japanese encephalitis virus
YFLNAMSKVR

SEQ ID NO: 232280 - protein, 10 aa, Japanese encephalitis virus
FLNAMSKVTK

SEQ ID NO: 232281 - protein, 10 aa, Japanese encephalitis virus
LNAMSKVTKD

SEQ ID NO: 232282 - protein, 10 aa, Japanese encephalitis virus
NAMSKVRRDI

SEQ ID NO: 232283 - protein, 10 aa, Japanese encephalitis virus
AMSKVRKDIL

SEQ ID NO: 232284 - protein, 10 aa, Japanese encephalitis virus
MSKVRRDIQE

SEQ ID NO: 232285 - protein, 10 aa, Japanese encephalitis virus
SKVRKDILEW

SEQ ID NO: 232286 - protein, 10 aa, Japanese encephalitis virus
KVRRDIQEWK

SEQ ID NO: 232287 - protein, 10 aa, Japanese encephalitis virus
VRRDIQEWKP

SEQ ID NO: 232288 - protein, 10 aa, Japanese encephalitis virus
TKDIQQWKPS

SEQ ID NO: 232289 - protein, 10 aa, Japanese encephalitis virus
KDILEWKPSH

SEQ ID NO: 232290 - protein, 10 aa, Japanese encephalitis virus
DILEWKPSHG

SEQ ID NO: 232291 - protein, 10 aa, Japanese encephalitis virus
IQQWKPSHGW

SEQ ID NO: 232292 - protein, 10 aa, Japanese encephalitis virus
QEWKPSHGWL

SEQ ID NO: 232293 - protein, 10 aa, Japanese encephalitis virus
EWKPSHGWLD

SEQ ID NO: 232294 - protein, 10 aa, Japanese encephalitis virus
WKPSHGWLDW

SEQ ID NO: 232295 - protein, 10 aa, Japanese encephalitis virus
KPSHGWHDWL

SEQ ID NO: 232296 - protein, 10 aa, Japanese encephalitis virus
PSHGWHDWLH

SEQ ID NO: 232297 - protein, 10 aa, Japanese encephalitis virus
SHGWLDWQQV

SEQ ID NO: 232298 - protein, 10 aa, Japanese encephalitis virus
HGWHDWLHVP

SEQ ID NO: 232299 - protein, 10 aa, Japanese encephalitis virus
GWHDWLHVPF

SEQ ID NO: 232300 - protein, 10 aa, Japanese encephalitis virus
WHDWLHVPFC

SEQ ID NO: 232301 - protein, 10 aa, Japanese encephalitis virus
HDWLHVPFCS

SEQ ID NO: 232302 - protein, 10 aa, Japanese encephalitis virus
DWLHVPFCSN

SEQ ID NO: 232303 - protein, 10 aa, Japanese encephalitis virus
WLHVPFCSNH

SEQ ID NO: 232304 - protein, 10 aa, Japanese encephalitis virus
LHVPFCSNHF

SEQ ID NO: 232305 - protein, 10 aa, Japanese encephalitis virus
HVPFCSNHFH

SEQ ID NO: 232306 - protein, 10 aa, Japanese encephalitis virus
VPFCSNHFHE

SEQ ID NO: 232307 - protein, 10 aa, Japanese encephalitis virus
PFCSNHFHEI

SEQ ID NO: 232308 - protein, 10 aa, Japanese encephalitis virus
FCSNHFHEIV

SEQ ID NO: 232309 - protein, 10 aa, Japanese encephalitis virus
CSNHFHEIVM

SEQ ID NO: 232310 - protein, 10 aa, Japanese encephalitis virus
SNHFHEIVMK

SEQ ID NO: 232311 - protein, 10 aa, Japanese encephalitis virus
NHFHEIVMKD

SEQ ID NO: 232312 - protein, 10 aa, Japanese encephalitis virus
HFHEIVMKDG

SEQ ID NO: 232313 - protein, 10 aa, Japanese encephalitis virus
FHEIVMKDGR

SEQ ID NO: 232314 - protein, 10 aa, Japanese encephalitis virus
HEIVMKDGRS

SEQ ID NO: 232315 - protein, 10 aa, Japanese encephalitis virus
EIVMKDGRSL

SEQ ID NO: 232316 - protein, 10 aa, Japanese encephalitis virus
IVMKDGRSLL

SEQ ID NO: 232317 - protein, 10 aa, Japanese encephalitis virus
VMKDGRSIVD

SEQ ID NO: 232318 - protein, 10 aa, Japanese encephalitis virus
MKDGRSIVDP

SEQ ID NO: 232319 - protein, 10 aa, Japanese encephalitis virus
KDGRSIVDPC

SEQ ID NO: 232320 - protein, 10 aa, Japanese encephalitis virus
DGRSLLVPCR

SEQ ID NO: 232321 - protein, 10 aa, Japanese encephalitis virus
GRSLLVPCRG

SEQ ID NO: 232322 - protein, 10 aa, Japanese encephalitis virus
RSIVDPCRGQ

SEQ ID NO: 232323 - protein, 10 aa, Japanese encephalitis virus
SIVDPCRGQD

SEQ ID NO: 232324 - protein, 10 aa, Japanese encephalitis virus
IVDPCRGQDE

SEQ ID NO: 232325 - protein, 10 aa, Japanese encephalitis virus
LVPCRGQDEL

SEQ ID NO: 232326 - protein, 10 aa, Japanese encephalitis virus
DPCRGQDELI

SEQ ID NO: 232327 - protein, 10 aa, Japanese encephalitis virus
PCRGQDELID

SEQ ID NO: 232328 - protein, 10 aa, Japanese encephalitis virus
CRGQDELIDR

SEQ ID NO: 232329 - protein, 10 aa, Japanese encephalitis virus
RGQDELIDRA

SEQ ID NO: 232330 - protein, 10 aa, Japanese encephalitis virus
GQDELIDRAR

SEQ ID NO: 232331 - protein, 10 aa, Japanese encephalitis virus
QDELIDRARI

SEQ ID NO: 232332 - protein, 10 aa, Japanese encephalitis virus
DELIDRARIS

SEQ ID NO: 232333 - protein, 10 aa, Japanese encephalitis virus
ELIDRARISP

SEQ ID NO: 232334 - protein, 10 aa, Japanese encephalitis virus
LIDRARISPG

SEQ ID NO: 232335 - protein, 10 aa, Japanese encephalitis virus
IDRARISPGA

SEQ ID NO: 232336 - protein, 10 aa, Japanese encephalitis virus
DRARISPGAG

SEQ ID NO: 232337 - protein, 10 aa, Japanese encephalitis virus
RARISPGAGC

SEQ ID NO: 232338 - protein, 10 aa, Japanese encephalitis virus
ARISPGAGCN

SEQ ID NO: 232339 - protein, 10 aa, Japanese encephalitis virus
RISPGAGCNV

SEQ ID NO: 232340 - protein, 10 aa, Japanese encephalitis virus
ISPGAGCNVK

SEQ ID NO: 232341 - protein, 10 aa, Japanese encephalitis virus
SPGAGCNVKD

SEQ ID NO: 232342 - protein, 10 aa, Japanese encephalitis virus
PGAGCNVKDT

SEQ ID NO: 232343 - protein, 10 aa, Japanese encephalitis virus
GAGCNVKDTA

SEQ ID NO: 232344 - protein, 10 aa, Japanese encephalitis virus
AGCNVKDTAC

SEQ ID NO: 232345 - protein, 10 aa, Japanese encephalitis virus
GCNVKDTACL

SEQ ID NO: 232346 - protein, 10 aa, Japanese encephalitis virus
CNVKDTACLA

SEQ ID NO: 232347 - protein, 10 aa, Japanese encephalitis virus
NVKDTACLPK

SEQ ID NO: 232348 - protein, 10 aa, Japanese encephalitis virus
VRDTACLAKA

SEQ ID NO: 232349 - protein, 10 aa, Japanese encephalitis virus
RDTACLAKAY

SEQ ID NO: 232350 - protein, 10 aa, Japanese encephalitis virus
DTACLPKAYA

SEQ ID NO: 232351 - protein, 10 aa, Japanese encephalitis virus
TACLPKAYAQ

SEQ ID NO: 232352 - protein, 10 aa, Japanese encephalitis virus
ACLPKAYAQM

SEQ ID NO: 232353 - protein, 10 aa, Japanese encephalitis virus
CLAKAYAQMR

SEQ ID NO: 232354 - protein, 10 aa, Japanese encephalitis virus
LAKAYAQMRL

SEQ ID NO: 232355 - protein, 10 aa, Japanese encephalitis virus
AKAYAQMRLL

SEQ ID NO: 232356 - protein, 10 aa, Japanese encephalitis virus
KAYAQMRLLL

SEQ ID NO: 232357 - protein, 10 aa, Japanese encephalitis virus
AYAQMRLLLY

SEQ ID NO: 232358 - protein, 10 aa, Japanese encephalitis virus
YAQMRLLLYF

SEQ ID NO: 232359 - protein, 10 aa, Japanese encephalitis virus
AQMRLLLYFH

SEQ ID NO: 232360 - protein, 10 aa, Japanese encephalitis virus
QMRLLLYFHR

SEQ ID NO: 232361 - protein, 10 aa, Japanese encephalitis virus
MRLLLYFHRR

SEQ ID NO: 232362 - protein, 10 aa, Japanese encephalitis virus
RLLLYFHRRD

SEQ ID NO: 232363 - protein, 10 aa, Japanese encephalitis virus
LLLYFHRRYL

SEQ ID NO: 232364 - protein, 10 aa, Japanese encephalitis virus
LLYFHRRYLR

SEQ ID NO: 232365 - protein, 10 aa, Japanese encephalitis virus
LYFHRRYLRL

SEQ ID NO: 232366 - protein, 10 aa, Japanese encephalitis virus
YFHRRYLRLM

SEQ ID NO: 232367 - protein, 10 aa, Japanese encephalitis virus
FHRRYLRLMA

SEQ ID NO: 232368 - protein, 10 aa, Japanese encephalitis virus
HRRYLRLMAN

SEQ ID NO: 232369 - protein, 10 aa, Japanese encephalitis virus
RRYLRLMANA

SEQ ID NO: 232370 - protein, 10 aa, Japanese encephalitis virus
RYLRLMANAI

SEQ ID NO: 232371 - protein, 10 aa, Japanese encephalitis virus
YLRLMANAIC

SEQ ID NO: 232372 - protein, 10 aa, Japanese encephalitis virus
LCLMANAICS

SEQ ID NO: 232373 - protein, 10 aa, Japanese encephalitis virus
CLMANAICSA

SEQ ID NO: 232374 - protein, 10 aa, Japanese encephalitis virus
LMANAICSTV

SEQ ID NO: 232375 - protein, 10 aa, Japanese encephalitis virus
MANAICSTVP

SEQ ID NO: 232376 - protein, 10 aa, Japanese encephalitis virus
ANAICSTVPV

SEQ ID NO: 232377 - protein, 10 aa, Japanese encephalitis virus
NAICSAVPVN

SEQ ID NO: 232378 - protein, 10 aa, Japanese encephalitis virus
AICSTVPVDW

SEQ ID NO: 232379 - protein, 10 aa, Japanese encephalitis virus
ICSTVPVDWV

SEQ ID NO: 232380 - protein, 10 aa, Japanese encephalitis virus
CSTVPVDWVP

SEQ ID NO: 232381 - protein, 10 aa, Japanese encephalitis virus
SAVPVNWVPT

SEQ ID NO: 232382 - protein, 10 aa, Japanese encephalitis virus
TVPVDWVPTG

SEQ ID NO: 232383 - protein, 10 aa, Japanese encephalitis virus
VPLDWVPTGR

SEQ ID NO: 232384 - protein, 10 aa, Japanese encephalitis virus
PVNWVPTGRT

SEQ ID NO: 232385 - protein, 10 aa, Japanese encephalitis virus
LDWVPTGRTS

SEQ ID NO: 232386 - protein, 10 aa, Japanese encephalitis virus
NWVPTGRTSW

SEQ ID NO: 232387 - protein, 10 aa, Japanese encephalitis virus
VPTGRTSWSK

SEQ ID NO: 232388 - protein, 10 aa, Japanese encephalitis virus
PTGRTSWSKH

SEQ ID NO: 232389 - protein, 10 aa, Japanese encephalitis virus
TGRTSWSKHS

SEQ ID NO: 232390 - protein, 10 aa, Japanese encephalitis virus
GRTSWSKHSK

SEQ ID NO: 232391 - protein, 10 aa, Japanese encephalitis virus
RTSWSKHSKG

SEQ ID NO: 232392 - protein, 10 aa, Japanese encephalitis virus
TSWSKHSKGE

SEQ ID NO: 232393 - protein, 10 aa, Japanese encephalitis virus
SWSKHSKGEW

SEQ ID NO: 232394 - protein, 10 aa, Japanese encephalitis virus
WSKHSKGEWM

SEQ ID NO: 232395 - protein, 10 aa, Japanese encephalitis virus
SKHSKGEWMT

SEQ ID NO: 232396 - protein, 10 aa, Japanese encephalitis virus
KHSKGEWMTT

SEQ ID NO: 232397 - protein, 10 aa, Japanese encephalitis virus
HSKGEWIPTE

SEQ ID NO: 232398 - protein, 10 aa, Japanese encephalitis virus
SKGEWMTTEN

SEQ ID NO: 232399 - protein, 10 aa, Japanese encephalitis virus
KGEWMTTENM

SEQ ID NO: 232400 - protein, 10 aa, Japanese encephalitis virus
GEWMTTENML

SEQ ID NO: 232401 - protein, 10 aa, Japanese encephalitis virus
EWMTTENMLQ

SEQ ID NO: 232402 - protein, 10 aa, Japanese encephalitis virus
WMTTENMLQV

SEQ ID NO: 232403 - protein, 10 aa, Japanese encephalitis virus
MTTENMLQVW

SEQ ID NO: 232404 - protein, 10 aa, Japanese encephalitis virus
TTENMLQVWN

SEQ ID NO: 232405 - protein, 10 aa, Japanese encephalitis virus
TENMLQVWNK

SEQ ID NO: 232406 - protein, 10 aa, Japanese encephalitis virus
ENMLQVWNKV

SEQ ID NO: 232407 - protein, 10 aa, Japanese encephalitis virus
NMLQVWNKVW

SEQ ID NO: 232408 - protein, 10 aa, Japanese encephalitis virus
MLQVWNKVWI

SEQ ID NO: 232409 - protein, 10 aa, Japanese encephalitis virus
LQVWNKVWIE

SEQ ID NO: 232410 - protein, 10 aa, Japanese encephalitis virus
QVWNKVWIEE

SEQ ID NO: 232411 - protein, 10 aa, Japanese encephalitis virus
VWNKVWIEEN

SEQ ID NO: 232412 - protein, 10 aa, Japanese encephalitis virus
WNKVWIEENE

SEQ ID NO: 232413 - protein, 10 aa, Japanese encephalitis virus
NKVWIEENEW

SEQ ID NO: 232414 - protein, 10 aa, Japanese encephalitis virus
KVWIEENEWM

SEQ ID NO: 232415 - protein, 10 aa, Japanese encephalitis virus
VWIEENEWMV

SEQ ID NO: 232416 - protein, 10 aa, Japanese encephalitis virus
WIEENEWMVD

SEQ ID NO: 232417 - protein, 10 aa, Japanese encephalitis virus
IEENEWMVDK

SEQ ID NO: 232418 - protein, 10 aa, Japanese encephalitis virus
EENEWMVDKT

SEQ ID NO: 232419 - protein, 10 aa, Japanese encephalitis virus
ENEWMVDKTP

SEQ ID NO: 232420 - protein, 10 aa, Japanese encephalitis virus
DKTPVTSWTD

SEQ ID NO: 232421 - protein, 10 aa, Japanese encephalitis virus
KTPVTSWTDV

SEQ ID NO: 232422 - protein, 10 aa, Japanese encephalitis virus
TPVTSWTDVP

SEQ ID NO: 232423 - protein, 10 aa, Japanese encephalitis virus
PVTSWTDVPY

SEQ ID NO: 232424 - protein, 10 aa, Japanese encephalitis virus
VTSWTDVPYV

SEQ ID NO: 232425 - protein, 10 aa, Japanese encephalitis virus
ASWTDVPYVG

SEQ ID NO: 232426 - protein, 10 aa, Japanese encephalitis virus
GKREDIWCGN

SEQ ID NO: 232427 - protein, 10 aa, Japanese encephalitis virus
KREDIWCGNL

SEQ ID NO: 232428 - protein, 10 aa, Japanese encephalitis virus
REDIWCGNLI

SEQ ID NO: 232429 - protein, 10 aa, Japanese encephalitis virus
EDIWCGNLIG

SEQ ID NO: 232430 - protein, 10 aa, Japanese encephalitis virus
DIWCGNLIGT

SEQ ID NO: 232431 - protein, 10 aa, Japanese encephalitis virus
IWCGNLIGTR

SEQ ID NO: 232432 - protein, 10 aa, Japanese encephalitis virus
WCGSLIGTRT

SEQ ID NO: 232433 - protein, 10 aa, Japanese encephalitis virus
CGSLIGTRTR

SEQ ID NO: 232434 - protein, 10 aa, Japanese encephalitis virus
GSLIGTRTRA

SEQ ID NO: 232435 - protein, 10 aa, Japanese encephalitis virus
SLIGTRTRAT

SEQ ID NO: 232436 - protein, 10 aa, Japanese encephalitis virus
LIGTRTRATW

SEQ ID NO: 232437 - protein, 10 aa, Japanese encephalitis virus
IGTRTRATWA

SEQ ID NO: 232438 - protein, 10 aa, Japanese encephalitis virus
GTRTRATWAE

SEQ ID NO: 232439 - protein, 10 aa, Japanese encephalitis virus
TRTRATWAEN

SEQ ID NO: 232440 - protein, 10 aa, Japanese encephalitis virus
RTRATWAENI

SEQ ID NO: 232441 - protein, 10 aa, Japanese encephalitis virus
TRATWAENIY

SEQ ID NO: 232442 - protein, 10 aa, Japanese encephalitis virus
KATWAENIYA

SEQ ID NO: 232443 - protein, 10 aa, Japanese encephalitis virus
ATWAENVYAA

SEQ ID NO: 232444 - protein, 10 aa, Japanese encephalitis virus
TWAENVYAAI

SEQ ID NO: 232445 - protein, 10 aa, Japanese encephalitis virus
WAENVYAAIN

SEQ ID NO: 232446 - protein, 10 aa, Japanese encephalitis virus
AENVYAAINQ

SEQ ID NO: 232447 - protein, 10 aa, Japanese encephalitis virus
ENVYAAINQV

SEQ ID NO: 232448 - protein, 10 aa, Japanese encephalitis virus
NVYAAINQVR

SEQ ID NO: 232449 - protein, 10 aa, Japanese encephalitis virus
VYAAINQVRA

SEQ ID NO: 232450 - protein, 10 aa, Japanese encephalitis virus
YAAINQVRAI

SEQ ID NO: 232451 - protein, 10 aa, Japanese encephalitis virus
AAINQVRAII

SEQ ID NO: 232452 - protein, 10 aa, Japanese encephalitis virus
AINQVRAIIG

SEQ ID NO: 232453 - protein, 10 aa, Japanese encephalitis virus
INQVRAIIGK

SEQ ID NO: 232454 - protein, 10 aa, Japanese encephalitis virus
NQVRAIIGKE

SEQ ID NO: 232455 - protein, 10 aa, Japanese encephalitis virus
QVRAIIGKEN

SEQ ID NO: 232456 - protein, 10 aa, Japanese encephalitis virus
VRAIIGKENY

SEQ ID NO: 232457 - protein, 10 aa, Japanese encephalitis virus
RAIIGKENYV

SEQ ID NO: 232458 - protein, 10 aa, Japanese encephalitis virus
AIIGKENYVD

SEQ ID NO: 232459 - protein, 10 aa, Japanese encephalitis virus
IIGKENYVDY

SEQ ID NO: 232460 - protein, 10 aa, Japanese encephalitis virus
IGKETYVDYM

SEQ ID NO: 232461 - protein, 10 aa, Japanese encephalitis virus
GKEDYVDYMT

SEQ ID NO: 232462 - protein, 10 aa, Japanese encephalitis virus
KENYVDYMDF

SEQ ID NO: 232463 - protein, 10 aa, Japanese encephalitis virus
EDYVDYMTSL

SEQ ID NO: 232464 - protein, 10 aa, Japanese encephalitis virus
NYVDYMLSLR

SEQ ID NO: 232465 - protein, 10 aa, Japanese encephalitis virus
YVDYMLSLRR

SEQ ID NO: 232466 - protein, 10 aa, Japanese encephalitis virus
VDYMDFPQRI

SEQ ID NO: 232467 - protein, 10 aa, Japanese encephalitis virus
DYMDFPQRIE

SEQ ID NO: 232468 - protein, 10 aa, Japanese encephalitis virus
YMLSLRRYED

SEQ ID NO: 232469 - protein, 10 aa, Japanese encephalitis virus
MLSLRRYEDV

SEQ ID NO: 232470 - protein, 10 aa, Japanese encephalitis virus
TSLRRYEDVS

SEQ ID NO: 232471 - protein, 10 aa, Japanese encephalitis virus
SLRRYEDVLV

SEQ ID NO: 232472 - protein, 10 aa, Japanese encephalitis virus
LRRYEDVLVQ

SEQ ID NO: 232473 - protein, 10 aa, Japanese encephalitis virus
RRYEDVLVQE

SEQ ID NO: 232474 - protein, 10 aa, Japanese encephalitis virus
RYEDVLVQED

SEQ ID NO: 232475 - protein, 10 aa, Japanese encephalitis virus
YEDVLVQEDR

SEQ ID NO: 232476 - protein, 10 aa, Japanese encephalitis virus
EDVLVQEDRV

SEQ ID NO: 232477 - protein, 10 aa, Japanese encephalitis virus
DVLVQEDRVI

SEQ ID NO: 232478 - protein, 10 aa, Japanese encephalitis virus
MTKKPRGPGI

SEQ ID NO: 232479 - protein, 10 aa, Japanese encephalitis virus
TKKPRGPGIN

SEQ ID NO: 232480 - protein, 10 aa, Japanese encephalitis virus
KKPRGPGINR

SEQ ID NO: 232481 - protein, 10 aa, Japanese encephalitis virus
KPGGPGKSRA

SEQ ID NO: 232482 - protein, 10 aa, Japanese encephalitis virus
PRGPGINRAI

SEQ ID NO: 232483 - protein, 10 aa, Japanese encephalitis virus
RGPGINRAIY

SEQ ID NO: 232484 - protein, 10 aa, Japanese encephalitis virus
GPGINRAIYM

SEQ ID NO: 232485 - protein, 10 aa, Japanese encephalitis virus
PGKSRAINML

SEQ ID NO: 232486 - protein, 10 aa, Japanese encephalitis virus
GKSRAINMLK

SEQ ID NO: 232487 - protein, 10 aa, Japanese encephalitis virus
INRAIYMLKR

SEQ ID NO: 232488 - protein, 10 aa, Japanese encephalitis virus
SRAINMLKRG

SEQ ID NO: 232489 - protein, 10 aa, Japanese encephalitis virus
RVFPLVRVKR

SEQ ID NO: 232490 - protein, 10 aa, Japanese encephalitis virus
VFPLVGVKKV

SEQ ID NO: 232491 - protein, 10 aa, Japanese encephalitis virus
FPLVRVKRVV

SEQ ID NO: 232492 - protein, 10 aa, Japanese encephalitis virus
PLVGVKKVVM

SEQ ID NO: 232493 - protein, 10 aa, Japanese encephalitis virus
LVRVKRVVMS

SEQ ID NO: 232494 - protein, 10 aa, Japanese encephalitis virus
VGVKKVVMSL

SEQ ID NO: 232495 - protein, 10 aa, Japanese encephalitis virus
RVKRVVMSLL

SEQ ID NO: 232496 - protein, 10 aa, Japanese encephalitis virus
VKRVVISLLD

SEQ ID NO: 232497 - protein, 10 aa, Japanese encephalitis virus
KRVVISLLDG

SEQ ID NO: 232498 - protein, 10 aa, Japanese encephalitis virus
KVVMSLLDGR

SEQ ID NO: 232499 - protein, 10 aa, Japanese encephalitis virus
ISLLDGIGPL

SEQ ID NO: 232500 - protein, 10 aa, Japanese encephalitis virus
SLLDGIGPLR

SEQ ID NO: 232501 - protein, 10 aa, Japanese encephalitis virus
LLDGIGPLRF

SEQ ID NO: 232502 - protein, 10 aa, Japanese encephalitis virus
LDGIGPLRFV

SEQ ID NO: 232503 - protein, 10 aa, Japanese encephalitis virus
DGIGPLRFVL

SEQ ID NO: 232504 - protein, 10 aa, Japanese encephalitis virus
GIGPLRFVLA

SEQ ID NO: 232505 - protein, 10 aa, Japanese encephalitis virus
RGPVRFVLAF

SEQ ID NO: 232506 - protein, 10 aa, Japanese encephalitis virus
GPVRFVLALT

SEQ ID NO: 232507 - protein, 10 aa, Japanese encephalitis virus
PVRFVLALTT

SEQ ID NO: 232508 - protein, 10 aa, Japanese encephalitis virus
ARFVLALITF

SEQ ID NO: 232509 - protein, 10 aa, Japanese encephalitis virus
RFVLALVSFF

SEQ ID NO: 232510 - protein, 10 aa, Japanese encephalitis virus
FVLALVSFFK

SEQ ID NO: 232511 - protein, 10 aa, Japanese encephalitis virus
VLALVSFFKF

SEQ ID NO: 232512 - protein, 10 aa, Japanese encephalitis virus
LAFITFFKFT

SEQ ID NO: 232513 - protein, 10 aa, Japanese encephalitis virus
AFITFFKFTA

SEQ ID NO: 232514 - protein, 10 aa, Japanese encephalitis virus
LVSFFKFTAL

SEQ ID NO: 232515 - protein, 10 aa, Japanese encephalitis virus
VSFFKFTALS

SEQ ID NO: 232516 - protein, 10 aa, Japanese encephalitis virus
TALSPTKALL

SEQ ID NO: 232517 - protein, 10 aa, Japanese encephalitis virus
ALSPTKALLG

SEQ ID NO: 232518 - protein, 10 aa, Japanese encephalitis virus
LSPTKALLGR

SEQ ID NO: 232519 - protein, 10 aa, Japanese encephalitis virus
SPTKALLGRW

SEQ ID NO: 232520 - protein, 10 aa, Japanese encephalitis virus
PTKALSGRWK

SEQ ID NO: 232521 - protein, 10 aa, Japanese encephalitis virus
TKALSGRWKA

SEQ ID NO: 232522 - protein, 10 aa, Japanese encephalitis virus
KALSGRWKAV

SEQ ID NO: 232523 - protein, 10 aa, Japanese encephalitis virus
ALSGRWKAVE

SEQ ID NO: 232524 - protein, 10 aa, Japanese encephalitis virus
LSGRWKAVEK

SEQ ID NO: 232525 - protein, 10 aa, Japanese encephalitis virus
SGRWKAVEKS

SEQ ID NO: 232526 - protein, 10 aa, Japanese encephalitis virus
GRWKAVERSV

SEQ ID NO: 232527 - protein, 10 aa, Japanese encephalitis virus
RWKAVERSVA

SEQ ID NO: 232528 - protein, 10 aa, Japanese encephalitis virus
WKAVERSVAM

SEQ ID NO: 232529 - protein, 10 aa, Japanese encephalitis virus
KAVERSVAMK

SEQ ID NO: 232530 - protein, 10 aa, Japanese encephalitis virus
AVERSVAMKH

SEQ ID NO: 232531 - protein, 10 aa, Japanese encephalitis virus
VERSVAMKHL

SEQ ID NO: 232532 - protein, 10 aa, Japanese encephalitis virus
LTSFKGELGT

SEQ ID NO: 232533 - protein, 10 aa, Japanese encephalitis virus
TSFKRELGIL

SEQ ID NO: 232534 - protein, 10 aa, Japanese encephalitis virus
SFKRELGILI

SEQ ID NO: 232535 - protein, 10 aa, Japanese encephalitis virus
FKGELGTLID

SEQ ID NO: 232536 - protein, 10 aa, Japanese encephalitis virus
KRELGTLIDT

SEQ ID NO: 232537 - protein, 10 aa, Japanese encephalitis virus
RELGTLIDTV

SEQ ID NO: 232538 - protein, 10 aa, Japanese encephalitis virus
ELGTLIDVVN

SEQ ID NO: 232539 - protein, 10 aa, Japanese encephalitis virus
LGTLIDGVNK

SEQ ID NO: 232540 - protein, 10 aa, Japanese encephalitis virus
GTLIDGVNKR

SEQ ID NO: 232541 - protein, 10 aa, Japanese encephalitis virus
TLIDVVNKRG

SEQ ID NO: 232542 - protein, 10 aa, Japanese encephalitis virus
LIDTVNKRGR

SEQ ID NO: 232543 - protein, 10 aa, Japanese encephalitis virus
IDTVNKRGRK

SEQ ID NO: 232544 - protein, 10 aa, Japanese encephalitis virus
VNKRGRKRNK

SEQ ID NO: 232545 - protein, 10 aa, Japanese encephalitis virus
NKRGRKRNKR

SEQ ID NO: 232546 - protein, 10 aa, Japanese encephalitis virus
KRGRKRNKRG

SEQ ID NO: 232547 - protein, 10 aa, Japanese encephalitis virus
RGRKRNKRGG

SEQ ID NO: 232548 - protein, 10 aa, Japanese encephalitis virus
GRKRNKRGGN

SEQ ID NO: 232549 - protein, 10 aa, Japanese encephalitis virus
RKQNKRGGNG

SEQ ID NO: 232550 - protein, 10 aa, Japanese encephalitis virus
KQNKRGGNGG

SEQ ID NO: 232551 - protein, 10 aa, Japanese encephalitis virus
AGAMRLSNFQ

SEQ ID NO: 232552 - protein, 10 aa, Japanese encephalitis virus
GAIKLSNFQG

SEQ ID NO: 232553 - protein, 10 aa, Japanese encephalitis virus
AIKLSNFQGK

SEQ ID NO: 232554 - protein, 10 aa, Japanese encephalitis virus
LKLSNFQGKL

SEQ ID NO: 232555 - protein, 10 aa, Japanese encephalitis virus
NFQGKLLMAV

SEQ ID NO: 232556 - protein, 10 aa, Japanese encephalitis virus
FQGKLLMAVN

SEQ ID NO: 232557 - protein, 10 aa, Japanese encephalitis virus
QGKLLMAVNN

SEQ ID NO: 232558 - protein, 10 aa, Japanese encephalitis virus
GKLLMAVNNT

SEQ ID NO: 232559 - protein, 10 aa, Japanese encephalitis virus
KLLMAVNNTD

SEQ ID NO: 232560 - protein, 10 aa, Japanese encephalitis virus
LLMAVNNTDI

SEQ ID NO: 232561 - protein, 10 aa, Japanese encephalitis virus
LMAVNNTDIA

SEQ ID NO: 232562 - protein, 10 aa, Japanese encephalitis virus
MAVNNTDIAD

SEQ ID NO: 232563 - protein, 10 aa, Japanese encephalitis virus
AVNNTDIADV

SEQ ID NO: 232564 - protein, 10 aa, Japanese encephalitis virus
WVRAIDVGYL

SEQ ID NO: 232565 - protein, 10 aa, Japanese encephalitis virus
VRAIDVGYLC

SEQ ID NO: 232566 - protein, 10 aa, Japanese encephalitis virus
RAIDVGHMCE

SEQ ID NO: 232567 - protein, 10 aa, Japanese encephalitis virus
AIDVGYLCED

SEQ ID NO: 232568 - protein, 10 aa, Japanese encephalitis virus
IDVGHMCEDT

SEQ ID NO: 232569 - protein, 10 aa, Japanese encephalitis virus
DVGHMCEDTI

SEQ ID NO: 232570 - protein, 10 aa, Japanese encephalitis virus
VGHMCEDTIT

SEQ ID NO: 232571 - protein, 10 aa, Japanese encephalitis virus
GYLCEDTITY

SEQ ID NO: 232572 - protein, 10 aa, Japanese encephalitis virus
HMCEDTITYE

SEQ ID NO: 232573 - protein, 10 aa, Japanese encephalitis virus
AGNDPEDVDC

SEQ ID NO: 232574 - protein, 10 aa, Japanese encephalitis virus
DVDCWCDHQE

SEQ ID NO: 232575 - protein, 10 aa, Japanese encephalitis virus
VDCWCDHQEV

SEQ ID NO: 232576 - protein, 10 aa, Japanese encephalitis virus
DCWCDHQEVY

SEQ ID NO: 232577 - protein, 10 aa, Japanese encephalitis virus
CWCDNQEVYI

SEQ ID NO: 232578 - protein, 10 aa, Japanese encephalitis virus
WCDNQEVYIQ

SEQ ID NO: 232579 - protein, 10 aa, Japanese encephalitis virus
CDNQEVYIQY

SEQ ID NO: 232580 - protein, 10 aa, Japanese encephalitis virus
DNQEVYIQYG

SEQ ID NO: 232581 - protein, 10 aa, Japanese encephalitis virus
HQEVYVQYGR

SEQ ID NO: 232582 - protein, 10 aa, Japanese encephalitis virus
QEVYIQYGRC

SEQ ID NO: 232583 - protein, 10 aa, Japanese encephalitis virus
EVYIQYGRCT

SEQ ID NO: 232584 - protein, 10 aa, Japanese encephalitis virus
VYIQYGRCTR

SEQ ID NO: 232585 - protein, 10 aa, Japanese encephalitis virus
YIQYGRCTRT

SEQ ID NO: 232586 - protein, 10 aa, Japanese encephalitis virus
VQYGRCTRTS

SEQ ID NO: 232587 - protein, 10 aa, Japanese encephalitis virus
QYGRCTRTSH

SEQ ID NO: 232588 - protein, 10 aa, Japanese encephalitis virus
YGRCTRTSHS

SEQ ID NO: 232589 - protein, 10 aa, Japanese encephalitis virus
GRCTRTSHSQ

SEQ ID NO: 232590 - protein, 10 aa, Japanese encephalitis virus
RCTRTSHSQT

SEQ ID NO: 232591 - protein, 10 aa, Japanese encephalitis virus
CTRTSHSQTS

SEQ ID NO: 232592 - protein, 10 aa, Japanese encephalitis virus
TRTSHSQTSR

SEQ ID NO: 232593 - protein, 10 aa, Japanese encephalitis virus
RTRHSKRSKR

SEQ ID NO: 232594 - protein, 10 aa, Japanese encephalitis virus
TSHSQTSRRS

SEQ ID NO: 232595 - protein, 10 aa, Japanese encephalitis virus
SHSQTSRRSV

SEQ ID NO: 232596 - protein, 10 aa, Japanese encephalitis virus
HSKRSKRSVS

SEQ ID NO: 232597 - protein, 10 aa, Japanese encephalitis virus
SKRSKRSVSV

SEQ ID NO: 232598 - protein, 10 aa, Japanese encephalitis virus
KRSKRSVSVQ

SEQ ID NO: 232599 - protein, 10 aa, Japanese encephalitis virus
RSKRSVSVQT

SEQ ID NO: 232600 - protein, 10 aa, Japanese encephalitis virus
SRRSVSVQPN

SEQ ID NO: 232601 - protein, 10 aa, Japanese encephalitis virus
RRSVSVHTHG

SEQ ID NO: 232602 - protein, 10 aa, Japanese encephalitis virus
RSVSVHTHGE

SEQ ID NO: 232603 - protein, 10 aa, Japanese encephalitis virus
SVSVHTHGES

SEQ ID NO: 232604 - protein, 10 aa, Japanese encephalitis virus
VSVHTHGESS

SEQ ID NO: 232605 - protein, 10 aa, Japanese encephalitis virus
SVQPNGERSL

SEQ ID NO: 232606 - protein, 10 aa, Japanese encephalitis virus
VHTHGESSLV

SEQ ID NO: 232607 - protein, 10 aa, Japanese encephalitis virus
QTHGESSLEN

SEQ ID NO: 232608 - protein, 10 aa, Japanese encephalitis virus
PNGERSLVNK

SEQ ID NO: 232609 - protein, 10 aa, Japanese encephalitis virus
HGESSLENKK

SEQ ID NO: 232610 - protein, 10 aa, Japanese encephalitis virus
GESSLENKKE

SEQ ID NO: 232611 - protein, 10 aa, Japanese encephalitis virus
ESSLENKKEA

SEQ ID NO: 232612 - protein, 10 aa, Japanese encephalitis virus
SSLVNKKKAW

SEQ ID NO: 232613 - protein, 10 aa, Japanese encephalitis virus
SLENKKEAWL

SEQ ID NO: 232614 - protein, 10 aa, Japanese encephalitis virus
LENKKEAWLD

SEQ ID NO: 232615 - protein, 10 aa, Japanese encephalitis virus
VNKKEAWLNS

SEQ ID NO: 232616 - protein, 10 aa, Japanese encephalitis virus
NKKEAWLNST

SEQ ID NO: 232617 - protein, 10 aa, Japanese encephalitis virus
KKEAWLDSTR

SEQ ID NO: 232618 - protein, 10 aa, Japanese encephalitis virus
KEAWLDSTRA

SEQ ID NO: 232619 - protein, 10 aa, Japanese encephalitis virus
EAWLNSTKAT

SEQ ID NO: 232620 - protein, 10 aa, Japanese encephalitis virus
AWLNSTKATR

SEQ ID NO: 232621 - protein, 10 aa, Japanese encephalitis virus
WLNSTKATRY

SEQ ID NO: 232622 - protein, 10 aa, Japanese encephalitis virus
LNSTKATRYL

SEQ ID NO: 232623 - protein, 10 aa, Japanese encephalitis virus
DSTRATRYLM

SEQ ID NO: 232624 - protein, 10 aa, Japanese encephalitis virus
STRATRYLMK

SEQ ID NO: 232625 - protein, 10 aa, Japanese encephalitis virus
TRATRYLMKT

SEQ ID NO: 232626 - protein, 10 aa, Japanese encephalitis virus
RATRYLMKTE

SEQ ID NO: 232627 - protein, 10 aa, Japanese encephalitis virus
ATRYLVKTEN

SEQ ID NO: 232628 - protein, 10 aa, Japanese encephalitis virus
TRYLVKTENW

SEQ ID NO: 232629 - protein, 10 aa, Japanese encephalitis virus
RYLVKTENWI

SEQ ID NO: 232630 - protein, 10 aa, Japanese encephalitis virus
YLTKTENWII

SEQ ID NO: 232631 - protein, 10 aa, Japanese encephalitis virus
LMKTENWIVR

SEQ ID NO: 232632 - protein, 10 aa, Japanese encephalitis virus
MKTENWIVRN

SEQ ID NO: 232633 - protein, 10 aa, Japanese encephalitis virus
RNPGYAFLAV

SEQ ID NO: 232634 - protein, 10 aa, Japanese encephalitis virus
LGWMLGSTTG

SEQ ID NO: 232635 - protein, 10 aa, Japanese encephalitis virus
GHRVVFTILL

SEQ ID NO: 232636 - protein, 10 aa, Japanese encephalitis virus
PRVVFTILLL

SEQ ID NO: 232637 - protein, 10 aa, Japanese encephalitis virus
RVVFTILPLL

SEQ ID NO: 232638 - protein, 10 aa, Japanese encephalitis virus
LGFTILLLLV

SEQ ID NO: 232639 - protein, 10 aa, Japanese encephalitis virus
GFTILLLLVA

SEQ ID NO: 232640 - protein, 10 aa, Japanese encephalitis virus
LGMGNRDFIQ

SEQ ID NO: 232641 - protein, 10 aa, Japanese encephalitis virus
GMGNRDFIER

SEQ ID NO: 232642 - protein, 10 aa, Japanese encephalitis virus
MGNRDFIERA

SEQ ID NO: 232643 - protein, 10 aa, Japanese encephalitis virus
GNRDFIEGVS

SEQ ID NO: 232644 - protein, 10 aa, Japanese encephalitis virus
NRDFIEGVSG

SEQ ID NO: 232645 - protein, 10 aa, Japanese encephalitis virus
RDFIQGASGA

SEQ ID NO: 232646 - protein, 10 aa, Japanese encephalitis virus
DFIQGASGAT

SEQ ID NO: 232647 - protein, 10 aa, Japanese encephalitis virus
FIERASGATW

SEQ ID NO: 232648 - protein, 10 aa, Japanese encephalitis virus
IERASGATWV

SEQ ID NO: 232649 - protein, 10 aa, Japanese encephalitis virus
ERASGATWVD

SEQ ID NO: 232650 - protein, 10 aa, Japanese encephalitis virus
GVSGATWVDL

SEQ ID NO: 232651 - protein, 10 aa, Japanese encephalitis virus
SCLTIMANDR

SEQ ID NO: 232652 - protein, 10 aa, Japanese encephalitis virus
CLTIMANDRP

SEQ ID NO: 232653 - protein, 10 aa, Japanese encephalitis virus
LTIMANDRPT

SEQ ID NO: 232654 - protein, 10 aa, Japanese encephalitis virus
TIMANDRPTL

SEQ ID NO: 232655 - protein, 10 aa, Japanese encephalitis virus
IMANDRPTLD

SEQ ID NO: 232656 - protein, 10 aa, Japanese encephalitis virus
MANDKPTLDR

SEQ ID NO: 232657 - protein, 10 aa, Japanese encephalitis virus
ANDRPTLDVR

SEQ ID NO: 232658 - protein, 10 aa, Japanese encephalitis virus
NDKPTLDRRM

SEQ ID NO: 232659 - protein, 10 aa, Japanese encephalitis virus
DRPTLDVRMI

SEQ ID NO: 232660 - protein, 10 aa, Japanese encephalitis virus
KPTLDVRMTN

SEQ ID NO: 232661 - protein, 10 aa, Japanese encephalitis virus
PTLDVRMTNI

SEQ ID NO: 232662 - protein, 10 aa, Japanese encephalitis virus
TLDVRMTNIE

SEQ ID NO: 232663 - protein, 10 aa, Japanese encephalitis virus
LDVRMTNIEA

SEQ ID NO: 232664 - protein, 10 aa, Japanese encephalitis virus
DRRMINIEAS

SEQ ID NO: 232665 - protein, 10 aa, Japanese encephalitis virus
VRMTNIEASQ

SEQ ID NO: 232666 - protein, 10 aa, Japanese encephalitis virus
RMTNIEASQL

SEQ ID NO: 232667 - protein, 10 aa, Japanese encephalitis virus
MTNIEASQLA

SEQ ID NO: 232668 - protein, 10 aa, Japanese encephalitis virus
TNIEASQLAE

SEQ ID NO: 232669 - protein, 10 aa, Japanese encephalitis virus
SQLAEVRSYY

SEQ ID NO: 232670 - protein, 10 aa, Japanese encephalitis virus
LAEVRSYCYR

SEQ ID NO: 232671 - protein, 10 aa, Japanese encephalitis virus
AEVRSYYYHA

SEQ ID NO: 232672 - protein, 10 aa, Japanese encephalitis virus
EVRSYCYRAS

SEQ ID NO: 232673 - protein, 10 aa, Japanese encephalitis virus
VRSYYYHASV

SEQ ID NO: 232674 - protein, 10 aa, Japanese encephalitis virus
RSYYYHASVT

SEQ ID NO: 232675 - protein, 10 aa, Japanese encephalitis virus
SYYYHASVTD

SEQ ID NO: 232676 - protein, 10 aa, Japanese encephalitis virus
YCYRASVTDI

SEQ ID NO: 232677 - protein, 10 aa, Japanese encephalitis virus
CYRASVTDIS

SEQ ID NO: 232678 - protein, 10 aa, Japanese encephalitis virus
CPTTGEAHNK

SEQ ID NO: 232679 - protein, 10 aa, Japanese encephalitis virus
PTTGEAHNKK

SEQ ID NO: 232680 - protein, 10 aa, Japanese encephalitis virus
TTGEAHNEKG

SEQ ID NO: 232681 - protein, 10 aa, Japanese encephalitis virus
TGEAHNEKGA

SEQ ID NO: 232682 - protein, 10 aa, Japanese encephalitis virus
GEAHNEKGAD

SEQ ID NO: 232683 - protein, 10 aa, Japanese encephalitis virus
EAHNEKQADS

SEQ ID NO: 232684 - protein, 10 aa, Japanese encephalitis virus
AHNEKQADSS

SEQ ID NO: 232685 - protein, 10 aa, Japanese encephalitis virus
HNKKRADSSY

SEQ ID NO: 232686 - protein, 10 aa, Japanese encephalitis virus
NEKGADSSYV

SEQ ID NO: 232687 - protein, 10 aa, Japanese encephalitis virus
KKRADSSYVC

SEQ ID NO: 232688 - protein, 10 aa, Japanese encephalitis virus
KQADSSYVCK

SEQ ID NO: 232689 - protein, 10 aa, Japanese encephalitis virus
GADSSYVCKQ

SEQ ID NO: 232690 - protein, 10 aa, Japanese encephalitis virus
QGFTDRGWGK

SEQ ID NO: 232691 - protein, 10 aa, Japanese encephalitis virus
GFTDRGWGKG

SEQ ID NO: 232692 - protein, 10 aa, Japanese encephalitis virus
FTDRGWGKGC

SEQ ID NO: 232693 - protein, 10 aa, Japanese encephalitis virus
TDRGWRNGCG

SEQ ID NO: 232694 - protein, 10 aa, Japanese encephalitis virus
DRGWGKGCGL

SEQ ID NO: 232695 - protein, 10 aa, Japanese encephalitis virus
RGWRNGCGLF

SEQ ID NO: 232696 - protein, 10 aa, Japanese encephalitis virus
GWRNGCGLFG

SEQ ID NO: 232697 - protein, 10 aa, Japanese encephalitis virus
WRNGCGLFGK

SEQ ID NO: 232698 - protein, 10 aa, Japanese encephalitis virus
RNGCGLFGKG

SEQ ID NO: 232699 - protein, 10 aa, Japanese encephalitis virus
NGCGLSGKGS

SEQ ID NO: 232700 - protein, 10 aa, Japanese encephalitis virus
GCGLSGKGSI

SEQ ID NO: 232701 - protein, 10 aa, Japanese encephalitis virus
CGLSGKGSID

SEQ ID NO: 232702 - protein, 10 aa, Japanese encephalitis virus
GLSGKGSIDT

SEQ ID NO: 232703 - protein, 10 aa, Japanese encephalitis virus
LSGKGSIDTC

SEQ ID NO: 232704 - protein, 10 aa, Japanese encephalitis virus
DTCAKFSCTN

SEQ ID NO: 232705 - protein, 10 aa, Japanese encephalitis virus
TCAKFSCTNK

SEQ ID NO: 232706 - protein, 10 aa, Japanese encephalitis virus
CAKFSCTNKA

SEQ ID NO: 232707 - protein, 10 aa, Japanese encephalitis virus
AKFSCTSKAT

SEQ ID NO: 232708 - protein, 10 aa, Japanese encephalitis virus
KFSCTSKATG

SEQ ID NO: 232709 - protein, 10 aa, Japanese encephalitis virus
FSCTSKATGK

SEQ ID NO: 232710 - protein, 10 aa, Japanese encephalitis virus
IQSENIKYEV

SEQ ID NO: 232711 - protein, 10 aa, Japanese encephalitis virus
QSENIKYEVG

SEQ ID NO: 232712 - protein, 10 aa, Japanese encephalitis virus
PENSKYEVGI

SEQ ID NO: 232713 - protein, 10 aa, Japanese encephalitis virus
ENSKYEVGIF

SEQ ID NO: 232714 - protein, 10 aa, Japanese encephalitis virus
NSKYEVGIFV

SEQ ID NO: 232715 - protein, 10 aa, Japanese encephalitis virus
SKYEVGIFVH

SEQ ID NO: 232716 - protein, 10 aa, Japanese encephalitis virus
YKVGIFVHGA

SEQ ID NO: 232717 - protein, 10 aa, Japanese encephalitis virus
EVGIFVHGAT

SEQ ID NO: 232718 - protein, 10 aa, Japanese encephalitis virus
HGNYTAQIGA

SEQ ID NO: 232719 - protein, 10 aa, Japanese encephalitis virus
GNYTAQIGAS

SEQ ID NO: 232720 - protein, 10 aa, Japanese encephalitis virus
NYTAQIGASQ

SEQ ID NO: 232721 - protein, 10 aa, Japanese encephalitis virus
YSAQVGVSQA

SEQ ID NO: 232722 - protein, 10 aa, Japanese encephalitis virus
SAQVGVSQAA

SEQ ID NO: 232723 - protein, 10 aa, Japanese encephalitis virus
AQVGASQAAR

SEQ ID NO: 232724 - protein, 10 aa, Japanese encephalitis virus
QVGASQAARF

SEQ ID NO: 232725 - protein, 10 aa, Japanese encephalitis virus
VGASQAARFT

SEQ ID NO: 232726 - protein, 10 aa, Japanese encephalitis virus
GTSQAAKFTV

SEQ ID NO: 232727 - protein, 10 aa, Japanese encephalitis virus
TSQAAKFTVT

SEQ ID NO: 232728 - protein, 10 aa, Japanese encephalitis virus
SQAARFTVTP

SEQ ID NO: 232729 - protein, 10 aa, Japanese encephalitis virus
QAARFTVTPN

SEQ ID NO: 232730 - protein, 10 aa, Japanese encephalitis virus
AARFTVTPNA

SEQ ID NO: 232731 - protein, 10 aa, Japanese encephalitis virus
ARFTVTPNAP

SEQ ID NO: 232732 - protein, 10 aa, Japanese encephalitis virus
RFTVTPNAPS

SEQ ID NO: 232733 - protein, 10 aa, Japanese encephalitis virus
FTITPNAPSI

SEQ ID NO: 232734 - protein, 10 aa, Japanese encephalitis virus
TITPNAPSIT

SEQ ID NO: 232735 - protein, 10 aa, Japanese encephalitis virus
ITPNAPSITL

SEQ ID NO: 232736 - protein, 10 aa, Japanese encephalitis virus
TPNAPSVALK

SEQ ID NO: 232737 - protein, 10 aa, Japanese encephalitis virus
PNAPSVALKL

SEQ ID NO: 232738 - protein, 10 aa, Japanese encephalitis virus
NAPSVALKLG

SEQ ID NO: 232739 - protein, 10 aa, Japanese encephalitis virus
APSVALKLGD

SEQ ID NO: 232740 - protein, 10 aa, Japanese encephalitis virus
TLKLGDFGEV

SEQ ID NO: 232741 - protein, 10 aa, Japanese encephalitis virus
LKLGDFGEVT

SEQ ID NO: 232742 - protein, 10 aa, Japanese encephalitis virus
KLGDFGEVTL

SEQ ID NO: 232743 - protein, 10 aa, Japanese encephalitis virus
FGEVTLDCEP

SEQ ID NO: 232744 - protein, 10 aa, Japanese encephalitis virus
GEVTLDCEPK

SEQ ID NO: 232745 - protein, 10 aa, Japanese encephalitis virus
EVTLDCEARS

SEQ ID NO: 232746 - protein, 10 aa, Japanese encephalitis virus
VTLDCEPKSG

SEQ ID NO: 232747 - protein, 10 aa, Japanese encephalitis virus
TLDCEARSGL

SEQ ID NO: 232748 - protein, 10 aa, Japanese encephalitis virus
LDCEARSGLN

SEQ ID NO: 232749 - protein, 10 aa, Japanese encephalitis virus
DCEARSGLNT

SEQ ID NO: 232750 - protein, 10 aa, Japanese encephalitis virus
CEARSGLNTE

SEQ ID NO: 232751 - protein, 10 aa, Japanese encephalitis virus
EARSGLNTEA

SEQ ID NO: 232752 - protein, 10 aa, Japanese encephalitis virus
ARSGLNTEAF

SEQ ID NO: 232753 - protein, 10 aa, Japanese encephalitis virus
AFYVMTVGPK

SEQ ID NO: 232754 - protein, 10 aa, Japanese encephalitis virus
FYVMTVGPKS

SEQ ID NO: 232755 - protein, 10 aa, Japanese encephalitis virus
YVMTVGPKSF

SEQ ID NO: 232756 - protein, 10 aa, Japanese encephalitis virus
VMTVGPKSFL

SEQ ID NO: 232757 - protein, 10 aa, Japanese encephalitis virus
MTVGPKSFLV

SEQ ID NO: 232758 - protein, 10 aa, Japanese encephalitis virus
TVGPKSFLVH

SEQ ID NO: 232759 - protein, 10 aa, Japanese encephalitis virus
VGPKSFLVHR

SEQ ID NO: 232760 - protein, 10 aa, Japanese encephalitis virus
GPKSFLVHRE

SEQ ID NO: 232761 - protein, 10 aa, Japanese encephalitis virus
SKSLLVHREW

SEQ ID NO: 232762 - protein, 10 aa, Japanese encephalitis virus
KSLLVHREWF

SEQ ID NO: 232763 - protein, 10 aa, Japanese encephalitis virus
WFHDLALPWS

SEQ ID NO: 232764 - protein, 10 aa, Japanese encephalitis virus
FHDLALPWTP

SEQ ID NO: 232765 - protein, 10 aa, Japanese encephalitis virus
HDLALPWTPP

SEQ ID NO: 232766 - protein, 10 aa, Japanese encephalitis virus
DLALPWTPPS

SEQ ID NO: 232767 - protein, 10 aa, Japanese encephalitis virus
LALPWTPPSS

SEQ ID NO: 232768 - protein, 10 aa, Japanese encephalitis virus
ALPWTPPSST

SEQ ID NO: 232769 - protein, 10 aa, Japanese encephalitis virus
LPWTSSSNTA

SEQ ID NO: 232770 - protein, 10 aa, Japanese encephalitis virus
PWTSSSNTAW

SEQ ID NO: 232771 - protein, 10 aa, Japanese encephalitis virus
WTSSSNTAWR

SEQ ID NO: 232772 - protein, 10 aa, Japanese encephalitis virus
SSPSSTAWRN

SEQ ID NO: 232773 - protein, 10 aa, Japanese encephalitis virus
SSSNTAWRNR

SEQ ID NO: 232774 - protein, 10 aa, Japanese encephalitis virus
NRELLMEFEQ

SEQ ID NO: 232775 - protein, 10 aa, Japanese encephalitis virus
RELLMEFEQA

SEQ ID NO: 232776 - protein, 10 aa, Japanese encephalitis virus
ELLMEFEQAH

SEQ ID NO: 232777 - protein, 10 aa, Japanese encephalitis virus
LLMEFEQAHA

SEQ ID NO: 232778 - protein, 10 aa, Japanese encephalitis virus
LMEFEQAHAT

SEQ ID NO: 232779 - protein, 10 aa, Japanese encephalitis virus
MEFEQAHATK

SEQ ID NO: 232780 - protein, 10 aa, Japanese encephalitis virus
EFEQAHATKQ

SEQ ID NO: 232781 - protein, 10 aa, Japanese encephalitis virus
FEQAHATKQS

SEQ ID NO: 232782 - protein, 10 aa, Japanese encephalitis virus
EQAHATKQSV

SEQ ID NO: 232783 - protein, 10 aa, Japanese encephalitis virus
QAHATKQSVV

SEQ ID NO: 232784 - protein, 10 aa, Japanese encephalitis virus
SVVALGSQER

SEQ ID NO: 232785 - protein, 10 aa, Japanese encephalitis virus
VVALGSQERA

SEQ ID NO: 232786 - protein, 10 aa, Japanese encephalitis virus
VALGSQEGSL

SEQ ID NO: 232787 - protein, 10 aa, Japanese encephalitis virus
ALGSREGGLH

SEQ ID NO: 232788 - protein, 10 aa, Japanese encephalitis virus
LGSQEGSLHQ

SEQ ID NO: 232789 - protein, 10 aa, Japanese encephalitis virus
GSQERALHQA

SEQ ID NO: 232790 - protein, 10 aa, Japanese encephalitis virus
SQERALHQAL

SEQ ID NO: 232791 - protein, 10 aa, Japanese encephalitis virus
QEGSLHQALA

SEQ ID NO: 232792 - protein, 10 aa, Japanese encephalitis virus
EGSLHQALAG

SEQ ID NO: 232793 - protein, 10 aa, Japanese encephalitis virus
RALHQALAGA

SEQ ID NO: 232794 - protein, 10 aa, Japanese encephalitis virus
SLHQALAGAI

SEQ ID NO: 232795 - protein, 10 aa, Japanese encephalitis virus
AGAIVVEYSN

SEQ ID NO: 232796 - protein, 10 aa, Japanese encephalitis virus
GAIVVEYSNS

SEQ ID NO: 232797 - protein, 10 aa, Japanese encephalitis virus
AIVVEYPSSV

SEQ ID NO: 232798 - protein, 10 aa, Japanese encephalitis virus
IVVEYPSSVK

SEQ ID NO: 232799 - protein, 10 aa, Japanese encephalitis virus
VVEYPSSVKL

SEQ ID NO: 232800 - protein, 10 aa, Japanese encephalitis virus
VEYPSSVKLT

SEQ ID NO: 232801 - protein, 10 aa, Japanese encephalitis virus
EYPSSVKLTS

SEQ ID NO: 232802 - protein, 10 aa, Japanese encephalitis virus
YPSSVKLTSG

SEQ ID NO: 232803 - protein, 10 aa, Japanese encephalitis virus
PSSVKLTSGH

SEQ ID NO: 232804 - protein, 10 aa, Japanese encephalitis virus
SSVKLTSGHV

SEQ ID NO: 232805 - protein, 10 aa, Japanese encephalitis virus
SVKLTSGHVK

SEQ ID NO: 232806 - protein, 10 aa, Japanese encephalitis virus
VKLTSGHVKR

SEQ ID NO: 232807 - protein, 10 aa, Japanese encephalitis virus
KLTSGHVKRR

SEQ ID NO: 232808 - protein, 10 aa, Japanese encephalitis virus
TSGHVKRRLK

SEQ ID NO: 232809 - protein, 10 aa, Japanese encephalitis virus
SGHVKRRLKM

SEQ ID NO: 232810 - protein, 10 aa, Japanese encephalitis virus
GHLKCRLRMD

SEQ ID NO: 232811 - protein, 10 aa, Japanese encephalitis virus
HLKCRLRMDK

SEQ ID NO: 232812 - protein, 10 aa, Japanese encephalitis virus
VKRRLKMDKL

SEQ ID NO: 232813 - protein, 10 aa, Japanese encephalitis virus
KCRLRMDKLA

SEQ ID NO: 232814 - protein, 10 aa, Japanese encephalitis virus
RRLKMDKLAL

SEQ ID NO: 232815 - protein, 10 aa, Japanese encephalitis virus
KGTTYGMCTK

SEQ ID NO: 232816 - protein, 10 aa, Japanese encephalitis virus
GTTYGMCTKK

SEQ ID NO: 232817 - protein, 10 aa, Japanese encephalitis virus
TTYGMCTKKF

SEQ ID NO: 232818 - protein, 10 aa, Japanese encephalitis virus
TYGMCTKKFS

SEQ ID NO: 232819 - protein, 10 aa, Japanese encephalitis virus
YGMCTKKFSF

SEQ ID NO: 232820 - protein, 10 aa, Japanese encephalitis virus
GMCTKKFSFA

SEQ ID NO: 232821 - protein, 10 aa, Japanese encephalitis virus
MCTKKFSFAK

SEQ ID NO: 232822 - protein, 10 aa, Japanese encephalitis virus
CTKKFSFAKN

SEQ ID NO: 232823 - protein, 10 aa, Japanese encephalitis virus
TKKFSFAKNP

SEQ ID NO: 232824 - protein, 10 aa, Japanese encephalitis virus
EKFSFAKNPV

SEQ ID NO: 232825 - protein, 10 aa, Japanese encephalitis virus
NSSFRKNPAD

SEQ ID NO: 232826 - protein, 10 aa, Japanese encephalitis virus
SSFRKNPADT

SEQ ID NO: 232827 - protein, 10 aa, Japanese encephalitis virus
SFRKNPADTG

SEQ ID NO: 232828 - protein, 10 aa, Japanese encephalitis virus
FRKNPADTGH

SEQ ID NO: 232829 - protein, 10 aa, Japanese encephalitis virus
RKNPADTGHG

SEQ ID NO: 232830 - protein, 10 aa, Japanese encephalitis virus
GHGTVVIELL

SEQ ID NO: 232831 - protein, 10 aa, Japanese encephalitis virus
HGTVVIELLY

SEQ ID NO: 232832 - protein, 10 aa, Japanese encephalitis virus
GTVVIELLYS

SEQ ID NO: 232833 - protein, 10 aa, Japanese encephalitis virus
TVVIELLYSG

SEQ ID NO: 232834 - protein, 10 aa, Japanese encephalitis virus
VVIELSYSGR

SEQ ID NO: 232835 - protein, 10 aa, Japanese encephalitis virus
VIELSYSGRD

SEQ ID NO: 232836 - protein, 10 aa, Japanese encephalitis virus
IELLYSGSDG

SEQ ID NO: 232837 - protein, 10 aa, Japanese encephalitis virus
ELSYSGSDGS

SEQ ID NO: 232838 - protein, 10 aa, Japanese encephalitis virus
LSYSGSDGSC

SEQ ID NO: 232839 - protein, 10 aa, Japanese encephalitis virus
LYSGSDGPCK

SEQ ID NO: 232840 - protein, 10 aa, Japanese encephalitis virus
YSGRDGPCKI

SEQ ID NO: 232841 - protein, 10 aa, Japanese encephalitis virus
SGRDGPCKIP

SEQ ID NO: 232842 - protein, 10 aa, Japanese encephalitis virus
GSDGSCKIPI

SEQ ID NO: 232843 - protein, 10 aa, Japanese encephalitis virus
SDGSCKIPIV

SEQ ID NO: 232844 - protein, 10 aa, Japanese encephalitis virus
PCKIPIVSVV

SEQ ID NO: 232845 - protein, 10 aa, Japanese encephalitis virus
CKIPIVSVVS

SEQ ID NO: 232846 - protein, 10 aa, Japanese encephalitis virus
KIPIVSVANL

SEQ ID NO: 232847 - protein, 10 aa, Japanese encephalitis virus
IPIVSVVSLN

SEQ ID NO: 232848 - protein, 10 aa, Japanese encephalitis virus
PIVSVANLND

SEQ ID NO: 232849 - protein, 10 aa, Japanese encephalitis virus
IVSVANLNDM

SEQ ID NO: 232850 - protein, 10 aa, Japanese encephalitis virus
VSVANLNDMT

SEQ ID NO: 232851 - protein, 10 aa, Japanese encephalitis virus
SVVSLNDMTP

SEQ ID NO: 232852 - protein, 10 aa, Japanese encephalitis virus
VANLNDMTPV

SEQ ID NO: 232853 - protein, 10 aa, Japanese encephalitis virus
VSLNDMTPVG

SEQ ID NO: 232854 - protein, 10 aa, Japanese encephalitis virus
SLNDMTPAGR

SEQ ID NO: 232855 - protein, 10 aa, Japanese encephalitis virus
LNDMTPAGRL

SEQ ID NO: 232856 - protein, 10 aa, Japanese encephalitis virus
NDMTPAGRLV

SEQ ID NO: 232857 - protein, 10 aa, Japanese encephalitis virus
DMTPAGRLVT

SEQ ID NO: 232858 - protein, 10 aa, Japanese encephalitis virus
MTPAGRLVTV

SEQ ID NO: 232859 - protein, 10 aa, Japanese encephalitis virus
VNPFVAASSA

SEQ ID NO: 232860 - protein, 10 aa, Japanese encephalitis virus
NPFVAASSAN

SEQ ID NO: 232861 - protein, 10 aa, Japanese encephalitis virus
PFVAASSANS

SEQ ID NO: 232862 - protein, 10 aa, Japanese encephalitis virus
FVAASSANSK

SEQ ID NO: 232863 - protein, 10 aa, Japanese encephalitis virus
VAASSANSKV

SEQ ID NO: 232864 - protein, 10 aa, Japanese encephalitis virus
AASSANSKVL

SEQ ID NO: 232865 - protein, 10 aa, Japanese encephalitis virus
SSANSKALVE

SEQ ID NO: 232866 - protein, 10 aa, Japanese encephalitis virus
SSNSKVLLEI

SEQ ID NO: 232867 - protein, 10 aa, Japanese encephalitis virus
ANSKALVEME

SEQ ID NO: 232868 - protein, 10 aa, Japanese encephalitis virus
NSKVLLEIEP

SEQ ID NO: 232869 - protein, 10 aa, Japanese encephalitis virus
SKALVEMEPP

SEQ ID NO: 232870 - protein, 10 aa, Japanese encephalitis virus
KVLLEIEPPF

SEQ ID NO: 232871 - protein, 10 aa, Japanese encephalitis virus
ALVEMEPPFG

SEQ ID NO: 232872 - protein, 10 aa, Japanese encephalitis virus
FGDSYIVVGM

SEQ ID NO: 232873 - protein, 10 aa, Japanese encephalitis virus
GDSYIVVGMG

SEQ ID NO: 232874 - protein, 10 aa, Japanese encephalitis virus
HHWYKAGSTL

SEQ ID NO: 232875 - protein, 10 aa, Japanese encephalitis virus
HRHKAGSTLG

SEQ ID NO: 232876 - protein, 10 aa, Japanese encephalitis virus
WYKAGSTLGK

SEQ ID NO: 232877 - protein, 10 aa, Japanese encephalitis virus
YKAGSTLGKA

SEQ ID NO: 232878 - protein, 10 aa, Japanese encephalitis virus
KPGSTLGKAF

SEQ ID NO: 232879 - protein, 10 aa, Japanese encephalitis virus
PGSTLGKAFS

SEQ ID NO: 232880 - protein, 10 aa, Japanese encephalitis virus
AWDFGSIGGA

SEQ ID NO: 232881 - protein, 10 aa, Japanese encephalitis virus
WDFGSIGRVF

SEQ ID NO: 232882 - protein, 10 aa, Japanese encephalitis virus
DFGSIGRVFN

SEQ ID NO: 232883 - protein, 10 aa, Japanese encephalitis virus
FGSIGRVFNS

SEQ ID NO: 232884 - protein, 10 aa, Japanese encephalitis virus
GSIGRVFNSI

SEQ ID NO: 232885 - protein, 10 aa, Japanese encephalitis virus
SIGRVFNSIG

SEQ ID NO: 232886 - protein, 10 aa, Japanese encephalitis virus
IGRVFNSIGK

SEQ ID NO: 232887 - protein, 10 aa, Japanese encephalitis virus
GGAFNSIGKA

SEQ ID NO: 232888 - protein, 10 aa, Japanese encephalitis virus
GIFNSIGKAV

SEQ ID NO: 232889 - protein, 10 aa, Japanese encephalitis virus
IFNSIGKAVH

SEQ ID NO: 232890 - protein, 10 aa, Japanese encephalitis virus
GRAVHQVFGD

SEQ ID NO: 232891 - protein, 10 aa, Japanese encephalitis virus
RAVHQVFGDA

SEQ ID NO: 232892 - protein, 10 aa, Japanese encephalitis virus
MGVLLLWMGI

SEQ ID NO: 232893 - protein, 10 aa, Japanese encephalitis virus
GVLLLWMGIN

SEQ ID NO: 232894 - protein, 10 aa, Japanese encephalitis virus
VLLLWMGINA

SEQ ID NO: 232895 - protein, 10 aa, Japanese encephalitis virus
LLWMGVNARN

SEQ ID NO: 232896 - protein, 10 aa, Japanese encephalitis virus
LWMGVNARNR

SEQ ID NO: 232897 - protein, 10 aa, Japanese encephalitis virus
WMGVNARNRS

SEQ ID NO: 232898 - protein, 10 aa, Japanese encephalitis virus
MGVNARNRSI

SEQ ID NO: 232899 - protein, 10 aa, Japanese encephalitis virus
GVNARNRSIA

SEQ ID NO: 232900 - protein, 10 aa, Japanese encephalitis virus
VNARNRSIAL

SEQ ID NO: 232901 - protein, 10 aa, Japanese encephalitis virus
NARNRSIALA

SEQ ID NO: 232902 - protein, 10 aa, Japanese encephalitis virus
ARDRSIAMAF

SEQ ID NO: 232903 - protein, 10 aa, Japanese encephalitis virus
RNRSIALAFL

SEQ ID NO: 232904 - protein, 10 aa, Japanese encephalitis virus
NRSIALAFLA

SEQ ID NO: 232905 - protein, 10 aa, Japanese encephalitis virus
HADTGSAIDI

SEQ ID NO: 232906 - protein, 10 aa, Japanese encephalitis virus
ADTGCAIDTT

SEQ ID NO: 232907 - protein, 10 aa, Japanese encephalitis virus
DTGCAIDTTR

SEQ ID NO: 232908 - protein, 10 aa, Japanese encephalitis virus
ARKEMRCGSG

SEQ ID NO: 232909 - protein, 10 aa, Japanese encephalitis virus
RNQMRCGSGI

SEQ ID NO: 232910 - protein, 10 aa, Japanese encephalitis virus
NQMRCGSGIF

SEQ ID NO: 232911 - protein, 10 aa, Japanese encephalitis virus
YKYLPETPKS

SEQ ID NO: 232912 - protein, 10 aa, Japanese encephalitis virus
KYLPETPRAL

SEQ ID NO: 232913 - protein, 10 aa, Japanese encephalitis virus
YLPETPKSLA

SEQ ID NO: 232914 - protein, 10 aa, Japanese encephalitis virus
LPETPRALAK

SEQ ID NO: 232915 - protein, 10 aa, Japanese encephalitis virus
PETPKSLAKI

SEQ ID NO: 232916 - protein, 10 aa, Japanese encephalitis virus
ETPRALAKIV

SEQ ID NO: 232917 - protein, 10 aa, Japanese encephalitis virus
TPKSLAKIVH

SEQ ID NO: 232918 - protein, 10 aa, Japanese encephalitis virus
PRALAKIVHK

SEQ ID NO: 232919 - protein, 10 aa, Japanese encephalitis virus
KSLAKIVHKA

SEQ ID NO: 232920 - protein, 10 aa, Japanese encephalitis virus
ALAKIVHKAH

SEQ ID NO: 232921 - protein, 10 aa, Japanese encephalitis virus
LAKIVHKAHM

SEQ ID NO: 232922 - protein, 10 aa, Japanese encephalitis virus
AKIVHKAHME

SEQ ID NO: 232923 - protein, 10 aa, Japanese encephalitis virus
KIVHKAHMEG

SEQ ID NO: 232924 - protein, 10 aa, Japanese encephalitis virus
IVHKAHMEGI

SEQ ID NO: 232925 - protein, 10 aa, Japanese encephalitis virus
VHKAYKEGVC

SEQ ID NO: 232926 - protein, 10 aa, Japanese encephalitis virus
HKAHMEGVCG

SEQ ID NO: 232927 - protein, 10 aa, Japanese encephalitis virus
KAHMEGVCGV

SEQ ID NO: 232928 - protein, 10 aa, Japanese encephalitis virus
AHMEGVCGVR

SEQ ID NO: 232929 - protein, 10 aa, Japanese encephalitis virus
HMEGICGVRS

SEQ ID NO: 232930 - protein, 10 aa, Japanese encephalitis virus
MEGICGVRSV

SEQ ID NO: 232931 - protein, 10 aa, Japanese encephalitis virus
EGVCGIRSVT

SEQ ID NO: 232932 - protein, 10 aa, Japanese encephalitis virus
GVCGIRSVTR

SEQ ID NO: 232933 - protein, 10 aa, Japanese encephalitis virus
ICGVRSVTRL

SEQ ID NO: 232934 - protein, 10 aa, Japanese encephalitis virus
EAVRDELNVP

SEQ ID NO: 232935 - protein, 10 aa, Japanese encephalitis virus
AVRDELNVPL

SEQ ID NO: 232936 - protein, 10 aa, Japanese encephalitis virus
RYRSAPKRLF

SEQ ID NO: 232937 - protein, 10 aa, Japanese encephalitis virus
YRSAPKRLFM

SEQ ID NO: 232938 - protein, 10 aa, Japanese encephalitis virus
RSTPKRLSMT

SEQ ID NO: 232939 - protein, 10 aa, Japanese encephalitis virus
SAPKRLFMTQ

SEQ ID NO: 232940 - protein, 10 aa, Japanese encephalitis virus
TPKRLSMTQE

SEQ ID NO: 232941 - protein, 10 aa, Japanese encephalitis virus
PKRLFMTQEK

SEQ ID NO: 232942 - protein, 10 aa, Japanese encephalitis virus
KRLSMTREKF

SEQ ID NO: 232943 - protein, 10 aa, Japanese encephalitis virus
RLFMTQEKVE

SEQ ID NO: 232944 - protein, 10 aa, Japanese encephalitis virus
LSMTREKFEM

SEQ ID NO: 232945 - protein, 10 aa, Japanese encephalitis virus
SMTREKFEMG

SEQ ID NO: 232946 - protein, 10 aa, Japanese encephalitis virus
MTREKFEMGW

SEQ ID NO: 232947 - protein, 10 aa, Japanese encephalitis virus
TQEKVEMGWK

SEQ ID NO: 232948 - protein, 10 aa, Japanese encephalitis virus
REKFEMGWKA

SEQ ID NO: 232949 - protein, 10 aa, Japanese encephalitis virus
MGWKAWGKSM

SEQ ID NO: 232950 - protein, 10 aa, Japanese encephalitis virus
GWKAWGKSML

SEQ ID NO: 232951 - protein, 10 aa, Japanese encephalitis virus
WKAWGKSMLF

SEQ ID NO: 232952 - protein, 10 aa, Japanese encephalitis virus
KAWGKSMLFA

SEQ ID NO: 232953 - protein, 10 aa, Japanese encephalitis virus
AWGKSMLFAP

SEQ ID NO: 232954 - protein, 10 aa, Japanese encephalitis virus
WGKSLLFAPE

SEQ ID NO: 232955 - protein, 10 aa, Japanese encephalitis virus
GKSILFAPEM

SEQ ID NO: 232956 - protein, 10 aa, Japanese encephalitis virus
KSMLFAPELA

SEQ ID NO: 232957 - protein, 10 aa, Japanese encephalitis virus
SLLFAPELAN

SEQ ID NO: 232958 - protein, 10 aa, Japanese encephalitis virus
LLFAPELANS

SEQ ID NO: 232959 - protein, 10 aa, Japanese encephalitis virus
LFAPELANSS

SEQ ID NO: 232960 - protein, 10 aa, Japanese encephalitis virus
FAPELANSSF

SEQ ID NO: 232961 - protein, 10 aa, Japanese encephalitis virus
APEMANSTFV

SEQ ID NO: 232962 - protein, 10 aa, Japanese encephalitis virus
PEMANSTFVV

SEQ ID NO: 232963 - protein, 10 aa, Japanese encephalitis virus
EMANSTFVVD

SEQ ID NO: 232964 - protein, 10 aa, Japanese encephalitis virus
MANSTFVVDG

SEQ ID NO: 232965 - protein, 10 aa, Japanese encephalitis virus
PETKECPVVH

SEQ ID NO: 232966 - protein, 10 aa, Japanese encephalitis virus
ETKECPVVHR

SEQ ID NO: 232967 - protein, 10 aa, Japanese encephalitis virus
TKECPVVHRA

SEQ ID NO: 232968 - protein, 10 aa, Japanese encephalitis virus
KECPDEQRAW

SEQ ID NO: 232969 - protein, 10 aa, Japanese encephalitis virus
ECPVVHRAWN

SEQ ID NO: 232970 - protein, 10 aa, Japanese encephalitis virus
CPDEQRAWNS

SEQ ID NO: 232971 - protein, 10 aa, Japanese encephalitis virus
PDEQRAWNSM

SEQ ID NO: 232972 - protein, 10 aa, Japanese encephalitis virus
DERRAWNSTQ

SEQ ID NO: 232973 - protein, 10 aa, Japanese encephalitis virus
VHRAWNSMQI

SEQ ID NO: 232974 - protein, 10 aa, Japanese encephalitis virus
RRAWNSTQIE

SEQ ID NO: 232975 - protein, 10 aa, Japanese encephalitis virus
RVWLKIREET

SEQ ID NO: 232976 - protein, 10 aa, Japanese encephalitis virus
VWLKIREETT

SEQ ID NO: 232977 - protein, 10 aa, Japanese encephalitis virus
WLKIREETTD

SEQ ID NO: 232978 - protein, 10 aa, Japanese encephalitis virus
LKIREETTDE

SEQ ID NO: 232979 - protein, 10 aa, Japanese encephalitis virus
KIREETTDEC

SEQ ID NO: 232980 - protein, 10 aa, Japanese encephalitis virus
IREETTDECD

SEQ ID NO: 232981 - protein, 10 aa, Japanese encephalitis virus
REETTDECDG

SEQ ID NO: 232982 - protein, 10 aa, Japanese encephalitis virus
EESTDECDGP

SEQ ID NO: 232983 - protein, 10 aa, Japanese encephalitis virus
ESTDECDGPI

SEQ ID NO: 232984 - protein, 10 aa, Japanese encephalitis virus
STDECDGPII

SEQ ID NO: 232985 - protein, 10 aa, Japanese encephalitis virus
TDECDGTIIG

SEQ ID NO: 232986 - protein, 10 aa, Japanese encephalitis virus
DECDGTIIGT

SEQ ID NO: 232987 - protein, 10 aa, Japanese encephalitis virus
ECDGTIIGTA

SEQ ID NO: 232988 - protein, 10 aa, Japanese encephalitis virus
CDGTIIGTAI

SEQ ID NO: 232989 - protein, 10 aa, Japanese encephalitis virus
DGTIIGTAIK

SEQ ID NO: 232990 - protein, 10 aa, Japanese encephalitis virus
GTIIGTAIKG

SEQ ID NO: 232991 - protein, 10 aa, Japanese encephalitis virus
AIIGTAVKGN

SEQ ID NO: 232992 - protein, 10 aa, Japanese encephalitis virus
IIGTAIKGHV

SEQ ID NO: 232993 - protein, 10 aa, Japanese encephalitis virus
IGTAIKGHVA

SEQ ID NO: 232994 - protein, 10 aa, Japanese encephalitis virus
GTAIKGHVAV

SEQ ID NO: 232995 - protein, 10 aa, Japanese encephalitis virus
TAVKGHVALH

SEQ ID NO: 232996 - protein, 10 aa, Japanese encephalitis virus
AVKGHVALHS

SEQ ID NO: 232997 - protein, 10 aa, Japanese encephalitis virus
VKGHVALHSD

SEQ ID NO: 232998 - protein, 10 aa, Japanese encephalitis virus
KGHVALHSDL

SEQ ID NO: 232999 - protein, 10 aa, Japanese encephalitis virus
GHVALHSDLS

SEQ ID NO: 233000 - protein, 10 aa, Japanese encephalitis virus
HVALHSDLSY

SEQ ID NO: 233001 - protein, 10 aa, Japanese encephalitis virus
VTVHSDVSYW

SEQ ID NO: 233002 - protein, 10 aa, Japanese encephalitis virus
TVHSDVSYWI

SEQ ID NO: 233003 - protein, 10 aa, Japanese encephalitis virus
LHSDLSYWIE

SEQ ID NO: 233004 - protein, 10 aa, Japanese encephalitis virus
HSDLSYWIGS

SEQ ID NO: 233005 - protein, 10 aa, Japanese encephalitis virus
SDVSYWIESR

SEQ ID NO: 233006 - protein, 10 aa, Japanese encephalitis virus
SYWIESRFND

SEQ ID NO: 233007 - protein, 10 aa, Japanese encephalitis virus
NDTWKRERAV

SEQ ID NO: 233008 - protein, 10 aa, Japanese encephalitis virus
DTWKLERLVF

SEQ ID NO: 233009 - protein, 10 aa, Japanese encephalitis virus
TWKLERLVFG

SEQ ID NO: 233010 - protein, 10 aa, Japanese encephalitis virus
WKRERAVFEE

SEQ ID NO: 233011 - protein, 10 aa, Japanese encephalitis virus
KLERLVFGEV

SEQ ID NO: 233012 - protein, 10 aa, Japanese encephalitis virus
LERLVFGEVK

SEQ ID NO: 233013 - protein, 10 aa, Japanese encephalitis virus
ERAVFEEVKS

SEQ ID NO: 233014 - protein, 10 aa, Japanese encephalitis virus
RAVFEEVKSC

SEQ ID NO: 233015 - protein, 10 aa, Japanese encephalitis virus
LVFGEVKSCT

SEQ ID NO: 233016 - protein, 10 aa, Japanese encephalitis virus
VFEEVKSCTW

SEQ ID NO: 233017 - protein, 10 aa, Japanese encephalitis virus
FEEVKSCTWP

SEQ ID NO: 233018 - protein, 10 aa, Japanese encephalitis virus
EEVKSCTWPE

SEQ ID NO: 233019 - protein, 10 aa, Japanese encephalitis virus
PETHSLWGDG

SEQ ID NO: 233020 - protein, 10 aa, Japanese encephalitis virus
ETHSLWGDGV

SEQ ID NO: 233021 - protein, 10 aa, Japanese encephalitis virus
THSLWGDGVE

SEQ ID NO: 233022 - protein, 10 aa, Japanese encephalitis virus
HSLWGDGVEE

SEQ ID NO: 233023 - protein, 10 aa, Japanese encephalitis virus
SLWGDGVEES

SEQ ID NO: 233024 - protein, 10 aa, Japanese encephalitis virus
LWGDDAEESE

SEQ ID NO: 233025 - protein, 10 aa, Japanese encephalitis virus
WGDDAEESEL

SEQ ID NO: 233026 - protein, 10 aa, Japanese encephalitis virus
GDDAEESELI

SEQ ID NO: 233027 - protein, 10 aa, Japanese encephalitis virus
DGVEESDLVI

SEQ ID NO: 233028 - protein, 10 aa, Japanese encephalitis virus
DAEESELIIP

SEQ ID NO: 233029 - protein, 10 aa, Japanese encephalitis virus
VEESELIIPD

SEQ ID NO: 233030 - protein, 10 aa, Japanese encephalitis virus
EESELIIPDT

SEQ ID NO: 233031 - protein, 10 aa, Japanese encephalitis virus
ESDLVIPHTI

SEQ ID NO: 233032 - protein, 10 aa, Japanese encephalitis virus
SDLVIPHTIA

SEQ ID NO: 233033 - protein, 10 aa, Japanese encephalitis virus
DLVIPHTIAG

SEQ ID NO: 233034 - protein, 10 aa, Japanese encephalitis virus
LIIPDTIAGP

SEQ ID NO: 233035 - protein, 10 aa, Japanese encephalitis virus
IIPHTLAGPK

SEQ ID NO: 233036 - protein, 10 aa, Japanese encephalitis virus
IPHTLAGPKS

SEQ ID NO: 233037 - protein, 10 aa, Japanese encephalitis virus
PHTLAGPKSK

SEQ ID NO: 233038 - protein, 10 aa, Japanese encephalitis virus
HTLAGPKSKH

SEQ ID NO: 233039 - protein, 10 aa, Japanese encephalitis virus
TLAGPKSKHN

SEQ ID NO: 233040 - protein, 10 aa, Japanese encephalitis virus
LAGPKSKHNR

SEQ ID NO: 233041 - protein, 10 aa, Japanese encephalitis virus
AGPKSKHNQR

SEQ ID NO: 233042 - protein, 10 aa, Japanese encephalitis virus
GPKSKHNQRE

SEQ ID NO: 233043 - protein, 10 aa, Japanese encephalitis virus
PKSKHNQREG

SEQ ID NO: 233044 - protein, 10 aa, Japanese encephalitis virus
KSKHNQREGY

SEQ ID NO: 233045 - protein, 10 aa, Japanese encephalitis virus
SKHNQREGYK

SEQ ID NO: 233046 - protein, 10 aa, Japanese encephalitis virus
KHNQREGYKT

SEQ ID NO: 233047 - protein, 10 aa, Japanese encephalitis virus
HNQREGYKTQ

SEQ ID NO: 233048 - protein, 10 aa, Japanese encephalitis virus
NQREGYKTQN

SEQ ID NO: 233049 - protein, 10 aa, Japanese encephalitis virus
RREGYMTQNQ

SEQ ID NO: 233050 - protein, 10 aa, Japanese encephalitis virus
REGYMTQNQG

SEQ ID NO: 233051 - protein, 10 aa, Japanese encephalitis virus
EGYMTQNQGP

SEQ ID NO: 233052 - protein, 10 aa, Japanese encephalitis virus
GYMTQNQGPW

SEQ ID NO: 233053 - protein, 10 aa, Japanese encephalitis virus
YMTQNQGPWD

SEQ ID NO: 233054 - protein, 10 aa, Japanese encephalitis virus
MTQNQGPWDE

SEQ ID NO: 233055 - protein, 10 aa, Japanese encephalitis virus
TQNQGPWDES

SEQ ID NO: 233056 - protein, 10 aa, Japanese encephalitis virus
QNQGPWDEKG

SEQ ID NO: 233057 - protein, 10 aa, Japanese encephalitis virus
NQGPWDENGL

SEQ ID NO: 233058 - protein, 10 aa, Japanese encephalitis virus
QGPWDEDGIV

SEQ ID NO: 233059 - protein, 10 aa, Japanese encephalitis virus
GPWDESGIVL

SEQ ID NO: 233060 - protein, 10 aa, Japanese encephalitis virus
PWDEKGIVLD

SEQ ID NO: 233061 - protein, 10 aa, Japanese encephalitis virus
WDESGIVLDF

SEQ ID NO: 233062 - protein, 10 aa, Japanese encephalitis virus
DENGLVPGLD

SEQ ID NO: 233063 - protein, 10 aa, Japanese encephalitis virus
ENGLVPGLDY

SEQ ID NO: 233064 - protein, 10 aa, Japanese encephalitis virus
NGLVPGLDYC

SEQ ID NO: 233065 - protein, 10 aa, Japanese encephalitis virus
PGLDYCPGTK

SEQ ID NO: 233066 - protein, 10 aa, Japanese encephalitis virus
DFDYCPGTTV

SEQ ID NO: 233067 - protein, 10 aa, Japanese encephalitis virus
LDYCPGTKVT

SEQ ID NO: 233068 - protein, 10 aa, Japanese encephalitis virus
TTVTITEDCG

SEQ ID NO: 233069 - protein, 10 aa, Japanese encephalitis virus
TVTITEDCGK

SEQ ID NO: 233070 - protein, 10 aa, Japanese encephalitis virus
TITEDCGKRA

SEQ ID NO: 233071 - protein, 10 aa, Japanese encephalitis virus
ITEDCGKRAP

SEQ ID NO: 233072 - protein, 10 aa, Japanese encephalitis virus
TEDCGKRAPW

SEQ ID NO: 233073 - protein, 10 aa, Japanese encephalitis virus
EDCSKRGPSV

SEQ ID NO: 233074 - protein, 10 aa, Japanese encephalitis virus
DCSKRGPSVR

SEQ ID NO: 233075 - protein, 10 aa, Japanese encephalitis virus
CSKRGPSVRT

SEQ ID NO: 233076 - protein, 10 aa, Japanese encephalitis virus
SKRGPSVRTT

SEQ ID NO: 233077 - protein, 10 aa, Japanese encephalitis virus
KRGPSLRTTT

SEQ ID NO: 233078 - protein, 10 aa, Japanese encephalitis virus
RGPSLRTTTD

SEQ ID NO: 233079 - protein, 10 aa, Japanese encephalitis virus
APWVRTTTDI

SEQ ID NO: 233080 - protein, 10 aa, Japanese encephalitis virus
PWVRTTTDIG

SEQ ID NO: 233081 - protein, 10 aa, Japanese encephalitis virus
SLRTTTDSGK

SEQ ID NO: 233082 - protein, 10 aa, Japanese encephalitis virus
LRTTTDSGKL

SEQ ID NO: 233083 - protein, 10 aa, Japanese encephalitis virus
ITDWCCRSCT

SEQ ID NO: 233084 - protein, 10 aa, Japanese encephalitis virus
TDWCCRSCTL

SEQ ID NO: 233085 - protein, 10 aa, Japanese encephalitis virus
DWCCRSCTLP

SEQ ID NO: 233086 - protein, 10 aa, Japanese encephalitis virus
WCCRNCSLPP

SEQ ID NO: 233087 - protein, 10 aa, Japanese encephalitis virus
CCRSCTLPPL

SEQ ID NO: 233088 - protein, 10 aa, Japanese encephalitis virus
CRSCTLPPLR

SEQ ID NO: 233089 - protein, 10 aa, Japanese encephalitis virus
RNCSLPPLRF

SEQ ID NO: 233090 - protein, 10 aa, Japanese encephalitis virus
NCSLPPLRFR

SEQ ID NO: 233091 - protein, 10 aa, Japanese encephalitis virus
CTLPPLRFRT

SEQ ID NO: 233092 - protein, 10 aa, Japanese encephalitis virus
SLPPLRFRTD

SEQ ID NO: 233093 - protein, 10 aa, Japanese encephalitis virus
LPPLRFRTDN

SEQ ID NO: 233094 - protein, 10 aa, Japanese encephalitis virus
PPLRFRTGSG

SEQ ID NO: 233095 - protein, 10 aa, Japanese encephalitis virus
PLRFRTDNGC

SEQ ID NO: 233096 - protein, 10 aa, Japanese encephalitis virus
LRFRTGSGCW

SEQ ID NO: 233097 - protein, 10 aa, Japanese encephalitis virus
RFRTGSGCWY

SEQ ID NO: 233098 - protein, 10 aa, Japanese encephalitis virus
FRTDNGCWYG

SEQ ID NO: 233099 - protein, 10 aa, Japanese encephalitis virus
RTGSGCWYGM

SEQ ID NO: 233100 - protein, 10 aa, Japanese encephalitis virus
TGSGCWYGME

SEQ ID NO: 233101 - protein, 10 aa, Japanese encephalitis virus
GSGCWYGMEV

SEQ ID NO: 233102 - protein, 10 aa, Japanese encephalitis virus
CWYGMEIRPA

SEQ ID NO: 233103 - protein, 10 aa, Japanese encephalitis virus
HDETTLVRWQ

SEQ ID NO: 233104 - protein, 10 aa, Japanese encephalitis virus
DETTLVRSRV

SEQ ID NO: 233105 - protein, 10 aa, Japanese encephalitis virus
GGMVDPFQLG

SEQ ID NO: 233106 - protein, 10 aa, Japanese encephalitis virus
EMVDPFQMGL

SEQ ID NO: 233107 - protein, 10 aa, Japanese encephalitis virus
MVDPFQMGLL

SEQ ID NO: 233108 - protein, 10 aa, Japanese encephalitis virus
VDPFQMGLLV

SEQ ID NO: 233109 - protein, 10 aa, Japanese encephalitis virus
DPFQMGLLVM

SEQ ID NO: 233110 - protein, 10 aa, Japanese encephalitis virus
PFQMGLLVMF

SEQ ID NO: 233111 - protein, 10 aa, Japanese encephalitis virus
FQMGLLVMFL

SEQ ID NO: 233112 - protein, 10 aa, Japanese encephalitis virus
QMGLLVMFLA

SEQ ID NO: 233113 - protein, 10 aa, Japanese encephalitis virus
MGLLVMFLAT

SEQ ID NO: 233114 - protein, 10 aa, Japanese encephalitis virus
VMFLATQEVF

SEQ ID NO: 233115 - protein, 10 aa, Japanese encephalitis virus
MFLATQEVFR

SEQ ID NO: 233116 - protein, 10 aa, Japanese encephalitis virus
FLATQEVLGK

SEQ ID NO: 233117 - protein, 10 aa, Japanese encephalitis virus
LATQEVLGKR

SEQ ID NO: 233118 - protein, 10 aa, Japanese encephalitis virus
ATQEVFRKRW

SEQ ID NO: 233119 - protein, 10 aa, Japanese encephalitis virus
TQEVLGKRWT

SEQ ID NO: 233120 - protein, 10 aa, Japanese encephalitis virus
QEVFRKRWTA

SEQ ID NO: 233121 - protein, 10 aa, Japanese encephalitis virus
EVFRKRWTAR

SEQ ID NO: 233122 - protein, 10 aa, Japanese encephalitis virus
VFRKRWTARL

SEQ ID NO: 233123 - protein, 10 aa, Japanese encephalitis virus
FRKRWTARLT

SEQ ID NO: 233124 - protein, 10 aa, Japanese encephalitis virus
GKRWTARLTI

SEQ ID NO: 233125 - protein, 10 aa, Japanese encephalitis virus
RLTVPAVLGA

SEQ ID NO: 233126 - protein, 10 aa, Japanese encephalitis virus
LTVPAVLGAL

SEQ ID NO: 233127 - protein, 10 aa, Japanese encephalitis virus
TVPAVLGALL

SEQ ID NO: 233128 - protein, 10 aa, Japanese encephalitis virus
VPAVLGALLV

SEQ ID NO: 233129 - protein, 10 aa, Japanese encephalitis virus
VLGALLVLMF

SEQ ID NO: 233130 - protein, 10 aa, Japanese encephalitis virus
LGALLVLMFG

SEQ ID NO: 233131 - protein, 10 aa, Japanese encephalitis virus
GALLVLMFGG

SEQ ID NO: 233132 - protein, 10 aa, Japanese encephalitis virus
ALLVLMFGGI

SEQ ID NO: 233133 - protein, 10 aa, Japanese encephalitis virus
VLMFGGITYT

SEQ ID NO: 233134 - protein, 10 aa, Japanese encephalitis virus
LMFGGITYTD

SEQ ID NO: 233135 - protein, 10 aa, Japanese encephalitis virus
MFGGITYTDL

SEQ ID NO: 233136 - protein, 10 aa, Japanese encephalitis virus
FGGITYTDLA

SEQ ID NO: 233137 - protein, 10 aa, Japanese encephalitis virus
ARYVVLVAAV

SEQ ID NO: 233138 - protein, 10 aa, Japanese encephalitis virus
RYVVLVAAVF

SEQ ID NO: 233139 - protein, 10 aa, Japanese encephalitis virus
YVVLVAAVFA

SEQ ID NO: 233140 - protein, 10 aa, Japanese encephalitis virus
VVLVAASFAE

SEQ ID NO: 233141 - protein, 10 aa, Japanese encephalitis virus
VLVAAVFAEA

SEQ ID NO: 233142 - protein, 10 aa, Japanese encephalitis virus
LVAASFAEAN

SEQ ID NO: 233143 - protein, 10 aa, Japanese encephalitis virus
VAASFAEANS

SEQ ID NO: 233144 - protein, 10 aa, Japanese encephalitis virus
AASFAEANSG

SEQ ID NO: 233145 - protein, 10 aa, Japanese encephalitis virus
AVFAEANSGG

SEQ ID NO: 233146 - protein, 10 aa, Japanese encephalitis virus
VFAEANSGGD

SEQ ID NO: 233147 - protein, 10 aa, Japanese encephalitis virus
FKIQPAFLVA

SEQ ID NO: 233148 - protein, 10 aa, Japanese encephalitis virus
KIQPAFLAMN

SEQ ID NO: 233149 - protein, 10 aa, Japanese encephalitis virus
IQPAFLAMNT

SEQ ID NO: 233150 - protein, 10 aa, Japanese encephalitis virus
QPAFLAMNTL

SEQ ID NO: 233151 - protein, 10 aa, Japanese encephalitis virus
PAFLAMNTLS

SEQ ID NO: 233152 - protein, 10 aa, Japanese encephalitis virus
AFLAMNTLST

SEQ ID NO: 233153 - protein, 10 aa, Japanese encephalitis virus
NMLSAKWTNQ

SEQ ID NO: 233154 - protein, 10 aa, Japanese encephalitis virus
MLSAKWTNQE

SEQ ID NO: 233155 - protein, 10 aa, Japanese encephalitis virus
LSAKWTNQEN

SEQ ID NO: 233156 - protein, 10 aa, Japanese encephalitis virus
SAKWTNQENM

SEQ ID NO: 233157 - protein, 10 aa, Japanese encephalitis virus
TRWTNQENVA

SEQ ID NO: 233158 - protein, 10 aa, Japanese encephalitis virus
RWTNQENVIL

SEQ ID NO: 233159 - protein, 10 aa, Japanese encephalitis virus
WTNQENVILV

SEQ ID NO: 233160 - protein, 10 aa, Japanese encephalitis virus
TNQENMVLVL

SEQ ID NO: 233161 - protein, 10 aa, Japanese encephalitis virus
NQENVILVLG

SEQ ID NO: 233162 - protein, 10 aa, Japanese encephalitis virus
QENVILVLGA

SEQ ID NO: 233163 - protein, 10 aa, Japanese encephalitis virus
ENVILVLGAA

SEQ ID NO: 233164 - protein, 10 aa, Japanese encephalitis virus
NVVLVLGAAL

SEQ ID NO: 233165 - protein, 10 aa, Japanese encephalitis virus
VVLVLGAALF

SEQ ID NO: 233166 - protein, 10 aa, Japanese encephalitis virus
VLVLGAALFQ

SEQ ID NO: 233167 - protein, 10 aa, Japanese encephalitis virus
GAALFQLASV

SEQ ID NO: 233168 - protein, 10 aa, Japanese encephalitis virus
AALFQLASVD

SEQ ID NO: 233169 - protein, 10 aa, Japanese encephalitis virus
ALFQLASVDL

SEQ ID NO: 233170 - protein, 10 aa, Japanese encephalitis virus
LFQLASVDLQ

SEQ ID NO: 233171 - protein, 10 aa, Japanese encephalitis virus
FQLASMDLQI

SEQ ID NO: 233172 - protein, 10 aa, Japanese encephalitis virus
QLASMDLQIG

SEQ ID NO: 233173 - protein, 10 aa, Japanese encephalitis virus
LASMDLQIGV

SEQ ID NO: 233174 - protein, 10 aa, Japanese encephalitis virus
ASMDLQIGVH

SEQ ID NO: 233175 - protein, 10 aa, Japanese encephalitis virus
SMDLQIGVHG

SEQ ID NO: 233176 - protein, 10 aa, Japanese encephalitis virus
ADLQIGVHGM

SEQ ID NO: 233177 - protein, 10 aa, Japanese encephalitis virus
VHGMLNAAAI

SEQ ID NO: 233178 - protein, 10 aa, Japanese encephalitis virus
HGILNAAAMA

SEQ ID NO: 233179 - protein, 10 aa, Japanese encephalitis virus
GILNAAAMAW

SEQ ID NO: 233180 - protein, 10 aa, Japanese encephalitis virus
ILNAAAMAWM

SEQ ID NO: 233181 - protein, 10 aa, Japanese encephalitis virus
NAAAIAWMII

SEQ ID NO: 233182 - protein, 10 aa, Japanese encephalitis virus
AAAIAWMIIK

SEQ ID NO: 233183 - protein, 10 aa, Japanese encephalitis virus
AAMAWMIVRA

SEQ ID NO: 233184 - protein, 10 aa, Japanese encephalitis virus
AIAWMIIKAI

SEQ ID NO: 233185 - protein, 10 aa, Japanese encephalitis virus
IAWMIIKAIT

SEQ ID NO: 233186 - protein, 10 aa, Japanese encephalitis virus
IIKAITFPTT

SEQ ID NO: 233187 - protein, 10 aa, Japanese encephalitis virus
IKAITFPTTS

SEQ ID NO: 233188 - protein, 10 aa, Japanese encephalitis virus
RAITFPTASS

SEQ ID NO: 233189 - protein, 10 aa, Japanese encephalitis virus
AITFPTASSV

SEQ ID NO: 233190 - protein, 10 aa, Japanese encephalitis virus
ITFPTASSVT

SEQ ID NO: 233191 - protein, 10 aa, Japanese encephalitis virus
TFPTASSVTM

SEQ ID NO: 233192 - protein, 10 aa, Japanese encephalitis virus
FPTASSVTMP

SEQ ID NO: 233193 - protein, 10 aa, Japanese encephalitis virus
MPVLTLLTPG

SEQ ID NO: 233194 - protein, 10 aa, Japanese encephalitis virus
PLLALLAPGM

SEQ ID NO: 233195 - protein, 10 aa, Japanese encephalitis virus
VLTLLTPGMR

SEQ ID NO: 233196 - protein, 10 aa, Japanese encephalitis virus
LALLTPGMKA

SEQ ID NO: 233197 - protein, 10 aa, Japanese encephalitis virus
ALLTPGMKAL

SEQ ID NO: 233198 - protein, 10 aa, Japanese encephalitis virus
LLTPGMRALC

SEQ ID NO: 233199 - protein, 10 aa, Japanese encephalitis virus
LTPGMRALCL

SEQ ID NO: 233200 - protein, 10 aa, Japanese encephalitis virus
TPGMRALCLD

SEQ ID NO: 233201 - protein, 10 aa, Japanese encephalitis virus
PGMRALCLDT

SEQ ID NO: 233202 - protein, 10 aa, Japanese encephalitis virus
GMRALCLDTY

SEQ ID NO: 233203 - protein, 10 aa, Japanese encephalitis virus
MRAFDLDTYR

SEQ ID NO: 233204 - protein, 10 aa, Japanese encephalitis virus
RAFDLDTYRI

SEQ ID NO: 233205 - protein, 10 aa, Japanese encephalitis virus
ALCLDTYRII

SEQ ID NO: 233206 - protein, 10 aa, Japanese encephalitis virus
LCLDTYRIIL

SEQ ID NO: 233207 - protein, 10 aa, Japanese encephalitis virus
CLDTYRIILL

SEQ ID NO: 233208 - protein, 10 aa, Japanese encephalitis virus
YRIILLIIGV

SEQ ID NO: 233209 - protein, 10 aa, Japanese encephalitis virus
RIILLIIGVC

SEQ ID NO: 233210 - protein, 10 aa, Japanese encephalitis virus
IILLIIGVCS

SEQ ID NO: 233211 - protein, 10 aa, Japanese encephalitis virus
ILLIIGVCSL

SEQ ID NO: 233212 - protein, 10 aa, Japanese encephalitis virus
LLVIGICSLQ

SEQ ID NO: 233213 - protein, 10 aa, Japanese encephalitis virus
LVIGVCSLLQ

SEQ ID NO: 233214 - protein, 10 aa, Japanese encephalitis virus
VIGVCSLLQE

SEQ ID NO: 233215 - protein, 10 aa, Japanese encephalitis virus
IGVCSLLQER

SEQ ID NO: 233216 - protein, 10 aa, Japanese encephalitis virus
ERKKAMAKKK

SEQ ID NO: 233217 - protein, 10 aa, Japanese encephalitis virus
RKKAMAKKKG

SEQ ID NO: 233218 - protein, 10 aa, Japanese encephalitis virus
KKAMAKKKGA

SEQ ID NO: 233219 - protein, 10 aa, Japanese encephalitis virus
RTMAKKKGAV

SEQ ID NO: 233220 - protein, 10 aa, Japanese encephalitis virus
PTTIAAGLMA

SEQ ID NO: 233221 - protein, 10 aa, Japanese encephalitis virus
TTITAGLMVC

SEQ ID NO: 233222 - protein, 10 aa, Japanese encephalitis virus
TIAAGLMACN

SEQ ID NO: 233223 - protein, 10 aa, Japanese encephalitis virus
ITAGLMVCNP

SEQ ID NO: 233224 - protein, 10 aa, Japanese encephalitis virus
AAGLMACNPN

SEQ ID NO: 233225 - protein, 10 aa, Japanese encephalitis virus
WPATEVLSAV

SEQ ID NO: 233226 - protein, 10 aa, Japanese encephalitis virus
PATEVLSAVG

SEQ ID NO: 233227 - protein, 10 aa, Japanese encephalitis virus
ATEVLSAVGL

SEQ ID NO: 233228 - protein, 10 aa, Japanese encephalitis virus
TEVLSAVGLM

SEQ ID NO: 233229 - protein, 10 aa, Japanese encephalitis virus
EVLSAVGLMF

SEQ ID NO: 233230 - protein, 10 aa, Japanese encephalitis virus
VLSAVGLMFA

SEQ ID NO: 233231 - protein, 10 aa, Japanese encephalitis virus
GKATDMWLEQ

SEQ ID NO: 233232 - protein, 10 aa, Japanese encephalitis virus
KATDMWLEQA

SEQ ID NO: 233233 - protein, 10 aa, Japanese encephalitis virus
ATDMWLEQAA

SEQ ID NO: 233234 - protein, 10 aa, Japanese encephalitis virus
TDMWLEQAAD

SEQ ID NO: 233235 - protein, 10 aa, Japanese encephalitis virus
DMWLEQAADI

SEQ ID NO: 233236 - protein, 10 aa, Japanese encephalitis virus
MWLERAADVS

SEQ ID NO: 233237 - protein, 10 aa, Japanese encephalitis virus
WLEQAADISW

SEQ ID NO: 233238 - protein, 10 aa, Japanese encephalitis virus
SWDMGAAITG

SEQ ID NO: 233239 - protein, 10 aa, Japanese encephalitis virus
WDMGAAITGS

SEQ ID NO: 233240 - protein, 10 aa, Japanese encephalitis virus
DMGAAITGSS

SEQ ID NO: 233241 - protein, 10 aa, Japanese encephalitis virus
MGAAITGSSR

SEQ ID NO: 233242 - protein, 10 aa, Japanese encephalitis virus
GAAITGSSRR

SEQ ID NO: 233243 - protein, 10 aa, Japanese encephalitis virus
KLDDDGDFHF

SEQ ID NO: 233244 - protein, 10 aa, Japanese encephalitis virus
LDDDGDFHFI

SEQ ID NO: 233245 - protein, 10 aa, Japanese encephalitis virus
DDDGDFHFID

SEQ ID NO: 233246 - protein, 10 aa, Japanese encephalitis virus
DDGDFHFIDD

SEQ ID NO: 233247 - protein, 10 aa, Japanese encephalitis virus
DGDFHLIDVP

SEQ ID NO: 233248 - protein, 10 aa, Japanese encephalitis virus
GDFHFIDDPG

SEQ ID NO: 233249 - protein, 10 aa, Japanese encephalitis virus
DFHFIDDPGV

SEQ ID NO: 233250 - protein, 10 aa, Japanese encephalitis virus
FHLIDVPGVP

SEQ ID NO: 233251 - protein, 10 aa, Japanese encephalitis virus
HLIDVPGVPW

SEQ ID NO: 233252 - protein, 10 aa, Japanese encephalitis virus
FIDDPGVPWK

SEQ ID NO: 233253 - protein, 10 aa, Japanese encephalitis virus
IDDPGVPWKI

SEQ ID NO: 233254 - protein, 10 aa, Japanese encephalitis virus
DDPGVPWKIW

SEQ ID NO: 233255 - protein, 10 aa, Japanese encephalitis virus
VPGVPWKVWV

SEQ ID NO: 233256 - protein, 10 aa, Japanese encephalitis virus
PGVPWKIWLL

SEQ ID NO: 233257 - protein, 10 aa, Japanese encephalitis virus
GVPWKIWLLR

SEQ ID NO: 233258 - protein, 10 aa, Japanese encephalitis virus
VPWKVWVLRT

SEQ ID NO: 233259 - protein, 10 aa, Japanese encephalitis virus
PWKVWVLRTS

SEQ ID NO: 233260 - protein, 10 aa, Japanese encephalitis virus
WKIWLLRMSC

SEQ ID NO: 233261 - protein, 10 aa, Japanese encephalitis virus
KIWLLRMSCI

SEQ ID NO: 233262 - protein, 10 aa, Japanese encephalitis virus
WVLRTSCIGL

SEQ ID NO: 233263 - protein, 10 aa, Japanese encephalitis virus
LRMSCIGLVA

SEQ ID NO: 233264 - protein, 10 aa, Japanese encephalitis virus
RMSCSGLAAL

SEQ ID NO: 233265 - protein, 10 aa, Japanese encephalitis virus
MSCICLAALT

SEQ ID NO: 233266 - protein, 10 aa, Japanese encephalitis virus
SCSGLAALTP

SEQ ID NO: 233267 - protein, 10 aa, Japanese encephalitis virus
CICLAALTPW

SEQ ID NO: 233268 - protein, 10 aa, Japanese encephalitis virus
IGLVALTPWA

SEQ ID NO: 233269 - protein, 10 aa, Japanese encephalitis virus
GLVALTPWAI

SEQ ID NO: 233270 - protein, 10 aa, Japanese encephalitis virus
WDTPSPKPCA

SEQ ID NO: 233271 - protein, 10 aa, Japanese encephalitis virus
DTPSPKPCAK

SEQ ID NO: 233272 - protein, 10 aa, Japanese encephalitis virus
TPSPKPCAKG

SEQ ID NO: 233273 - protein, 10 aa, Japanese encephalitis virus
PSPKPCAKGD

SEQ ID NO: 233274 - protein, 10 aa, Japanese encephalitis virus
SPKPCAKGDT

SEQ ID NO: 233275 - protein, 10 aa, Japanese encephalitis virus
PKPCAKGDTT

SEQ ID NO: 233276 - protein, 10 aa, Japanese encephalitis virus
KPCAKGDTTT

SEQ ID NO: 233277 - protein, 10 aa, Japanese encephalitis virus
PCAKGDTTTG

SEQ ID NO: 233278 - protein, 10 aa, Japanese encephalitis virus
CAKGDTTTGV

SEQ ID NO: 233279 - protein, 10 aa, Japanese encephalitis virus
AKGDTTTGVY

SEQ ID NO: 233280 - protein, 10 aa, Japanese encephalitis virus
VYRIMARGIF

SEQ ID NO: 233281 - protein, 10 aa, Japanese encephalitis virus
YRIMARGIFG

SEQ ID NO: 233282 - protein, 10 aa, Japanese encephalitis virus
RIMARGIFGT

SEQ ID NO: 233283 - protein, 10 aa, Japanese encephalitis virus
IMACGILGTY

SEQ ID NO: 233284 - protein, 10 aa, Japanese encephalitis virus
MARGIFGTHQ

SEQ ID NO: 233285 - protein, 10 aa, Japanese encephalitis virus
ARGIFGTHQA

SEQ ID NO: 233286 - protein, 10 aa, Japanese encephalitis virus
CGILGTYQSG

SEQ ID NO: 233287 - protein, 10 aa, Japanese encephalitis virus
GILGTYQSGV

SEQ ID NO: 233288 - protein, 10 aa, Japanese encephalitis virus
IFGTHQAGVG

SEQ ID NO: 233289 - protein, 10 aa, Japanese encephalitis virus
LGTYQSGVGV

SEQ ID NO: 233290 - protein, 10 aa, Japanese encephalitis virus
GTHQAGVGVM

SEQ ID NO: 233291 - protein, 10 aa, Japanese encephalitis virus
TYQSGVGVIY

SEQ ID NO: 233292 - protein, 10 aa, Japanese encephalitis virus
YQAGVGVMYQ

SEQ ID NO: 233293 - protein, 10 aa, Japanese encephalitis virus
QAGVGVMYES

SEQ ID NO: 233294 - protein, 10 aa, Japanese encephalitis virus
AGVGVMYESV

SEQ ID NO: 233295 - protein, 10 aa, Japanese encephalitis virus
GVGVMYESVF

SEQ ID NO: 233296 - protein, 10 aa, Japanese encephalitis virus
VGVMYQNVFH

SEQ ID NO: 233297 - protein, 10 aa, Japanese encephalitis virus
GVMYQNVFHT

SEQ ID NO: 233298 - protein, 10 aa, Japanese encephalitis virus
VMYESVFHTL

SEQ ID NO: 233299 - protein, 10 aa, Japanese encephalitis virus
MYENVLHTLW

SEQ ID NO: 233300 - protein, 10 aa, Japanese encephalitis virus
YESVFHTLWH

SEQ ID NO: 233301 - protein, 10 aa, Japanese encephalitis virus
ENVLHTLWHT

SEQ ID NO: 233302 - protein, 10 aa, Japanese encephalitis virus
NVFHTLWHPT

SEQ ID NO: 233303 - protein, 10 aa, Japanese encephalitis virus
VLHTLWHTTR

SEQ ID NO: 233304 - protein, 10 aa, Japanese encephalitis virus
LHTLWHTTRG

SEQ ID NO: 233305 - protein, 10 aa, Japanese encephalitis virus
LWHPTRGAAI

SEQ ID NO: 233306 - protein, 10 aa, Japanese encephalitis virus
WHTTRGAAVM

SEQ ID NO: 233307 - protein, 10 aa, Japanese encephalitis virus
HTTRGAAVMS

SEQ ID NO: 233308 - protein, 10 aa, Japanese encephalitis virus
TTRGAAVMSG

SEQ ID NO: 233309 - protein, 10 aa, Japanese encephalitis virus
TRGAAVMSGE

SEQ ID NO: 233310 - protein, 10 aa, Japanese encephalitis virus
RGAAVMSGEG

SEQ ID NO: 233311 - protein, 10 aa, Japanese encephalitis virus
GAAVMSGEGK

SEQ ID NO: 233312 - protein, 10 aa, Japanese encephalitis virus
AAVMSGEGKL

SEQ ID NO: 233313 - protein, 10 aa, Japanese encephalitis virus
AVMSGEGKLT

SEQ ID NO: 233314 - protein, 10 aa, Japanese encephalitis virus
VMSGEGKLTP

SEQ ID NO: 233315 - protein, 10 aa, Japanese encephalitis virus
MSGGGKLTPY

SEQ ID NO: 233316 - protein, 10 aa, Japanese encephalitis virus
SGGGKLTPYW

SEQ ID NO: 233317 - protein, 10 aa, Japanese encephalitis virus
GKGKLTPYWG

SEQ ID NO: 233318 - protein, 10 aa, Japanese encephalitis virus
GGKLTPYWGS

SEQ ID NO: 233319 - protein, 10 aa, Japanese encephalitis virus
WGSVREDRIA

SEQ ID NO: 233320 - protein, 10 aa, Japanese encephalitis virus
GSVREDRIAY

SEQ ID NO: 233321 - protein, 10 aa, Japanese encephalitis virus
SVREDRIAYG

SEQ ID NO: 233322 - protein, 10 aa, Japanese encephalitis virus
VREDRIAYGG

SEQ ID NO: 233323 - protein, 10 aa, Japanese encephalitis virus
REDRIAYGGP

SEQ ID NO: 233324 - protein, 10 aa, Japanese encephalitis virus
NDVQVIVVEP

SEQ ID NO: 233325 - protein, 10 aa, Japanese encephalitis virus
QVIVVEPGKG

SEQ ID NO: 233326 - protein, 10 aa, Japanese encephalitis virus
VIVVEPGKGA

SEQ ID NO: 233327 - protein, 10 aa, Japanese encephalitis virus
SIQTKPGVFR

SEQ ID NO: 233328 - protein, 10 aa, Japanese encephalitis virus
IQTKPGIFPP

SEQ ID NO: 233329 - protein, 10 aa, Japanese encephalitis virus
QTKPGIFPPP

SEQ ID NO: 233330 - protein, 10 aa, Japanese encephalitis virus
TKPGIFPPPF

SEQ ID NO: 233331 - protein, 10 aa, Japanese encephalitis virus
KPGVFCTPFG

SEQ ID NO: 233332 - protein, 10 aa, Japanese encephalitis virus
PFGKVGTVSL

SEQ ID NO: 233333 - protein, 10 aa, Japanese encephalitis virus
FGKVGAVSLD

SEQ ID NO: 233334 - protein, 10 aa, Japanese encephalitis virus
GKVGTVSLDY

SEQ ID NO: 233335 - protein, 10 aa, Japanese encephalitis virus
KVGTVSLDYP

SEQ ID NO: 233336 - protein, 10 aa, Japanese encephalitis virus
VGTVSLDYPR

SEQ ID NO: 233337 - protein, 10 aa, Japanese encephalitis virus
GTSGSPILDF

SEQ ID NO: 233338 - protein, 10 aa, Japanese encephalitis virus
TSGSPILDFN

SEQ ID NO: 233339 - protein, 10 aa, Japanese encephalitis virus
SGSPILDFNG

SEQ ID NO: 233340 - protein, 10 aa, Japanese encephalitis virus
GSPILNSNGD

SEQ ID NO: 233341 - protein, 10 aa, Japanese encephalitis virus
SPILNSNGDV

SEQ ID NO: 233342 - protein, 10 aa, Japanese encephalitis virus
PILNSNGDVV

SEQ ID NO: 233343 - protein, 10 aa, Japanese encephalitis virus
ILNSNGDVVG

SEQ ID NO: 233344 - protein, 10 aa, Japanese encephalitis virus
LNSNGDVVGC

SEQ ID NO: 233345 - protein, 10 aa, Japanese encephalitis virus
DFNGDIIGLY

SEQ ID NO: 233346 - protein, 10 aa, Japanese encephalitis virus
FNGDIIGLYG

SEQ ID NO: 233347 - protein, 10 aa, Japanese encephalitis virus
DIIGLYGNGG

SEQ ID NO: 233348 - protein, 10 aa, Japanese encephalitis virus
VVGCLGNGVE

SEQ ID NO: 233349 - protein, 10 aa, Japanese encephalitis virus
VGCLGNGVEL

SEQ ID NO: 233350 - protein, 10 aa, Japanese encephalitis virus
GCLGNGVELG

SEQ ID NO: 233351 - protein, 10 aa, Japanese encephalitis virus
LYGNGGELGD

SEQ ID NO: 233352 - protein, 10 aa, Japanese encephalitis virus
YGNGVELGDR

SEQ ID NO: 233353 - protein, 10 aa, Japanese encephalitis virus
GNGGELGDGS

SEQ ID NO: 233354 - protein, 10 aa, Japanese encephalitis virus
NGVELGDRSY

SEQ ID NO: 233355 - protein, 10 aa, Japanese encephalitis virus
GVELGDRSYV

SEQ ID NO: 233356 - protein, 10 aa, Japanese encephalitis virus
VELGDRSYVS

SEQ ID NO: 233357 - protein, 10 aa, Japanese encephalitis virus
VQGDRQEEPI

SEQ ID NO: 233358 - protein, 10 aa, Japanese encephalitis virus
QGDRQEEPIP

SEQ ID NO: 233359 - protein, 10 aa, Japanese encephalitis virus
GERQEEPVPE

SEQ ID NO: 233360 - protein, 10 aa, Japanese encephalitis virus
ERQEEPVPEA

SEQ ID NO: 233361 - protein, 10 aa, Japanese encephalitis virus
RQEEPIPEAY

SEQ ID NO: 233362 - protein, 10 aa, Japanese encephalitis virus
QEEPIPEAYN

SEQ ID NO: 233363 - protein, 10 aa, Japanese encephalitis virus
EEPIPEAYNP

SEQ ID NO: 233364 - protein, 10 aa, Japanese encephalitis virus
EPVPEAYTPT

SEQ ID NO: 233365 - protein, 10 aa, Japanese encephalitis virus
PVPEAYTPTM

SEQ ID NO: 233366 - protein, 10 aa, Japanese encephalitis virus
VPEAYTPSML

SEQ ID NO: 233367 - protein, 10 aa, Japanese encephalitis virus
MLRKRQLTVL

SEQ ID NO: 233368 - protein, 10 aa, Japanese encephalitis virus
LRKRQLTVLD

SEQ ID NO: 233369 - protein, 10 aa, Japanese encephalitis virus
RKRQLTVLDL

SEQ ID NO: 233370 - protein, 10 aa, Japanese encephalitis virus
KKQMTVLDLP

SEQ ID NO: 233371 - protein, 10 aa, Japanese encephalitis virus
KQMTVLDLPP

SEQ ID NO: 233372 - protein, 10 aa, Japanese encephalitis virus
QMTVLDLPPG

SEQ ID NO: 233373 - protein, 10 aa, Japanese encephalitis virus
MTVLDLPPGS

SEQ ID NO: 233374 - protein, 10 aa, Japanese encephalitis virus
TVLDLHPGLG

SEQ ID NO: 233375 - protein, 10 aa, Japanese encephalitis virus
VLDLPPGSGK

SEQ ID NO: 233376 - protein, 10 aa, Japanese encephalitis virus
LDLPPGSGKT

SEQ ID NO: 233377 - protein, 10 aa, Japanese encephalitis virus
DLHPGLGKTR

SEQ ID NO: 233378 - protein, 10 aa, Japanese encephalitis virus
LHPGLGKTRK

SEQ ID NO: 233379 - protein, 10 aa, Japanese encephalitis virus
PPGSGKTRKI

SEQ ID NO: 233380 - protein, 10 aa, Japanese encephalitis virus
PGLGKTRKIL

SEQ ID NO: 233381 - protein, 10 aa, Japanese encephalitis virus
GLGKTRKILP

SEQ ID NO: 233382 - protein, 10 aa, Japanese encephalitis virus
LGKTRKILPQ

SEQ ID NO: 233383 - protein, 10 aa, Japanese encephalitis virus
GKTRKILPQT

SEQ ID NO: 233384 - protein, 10 aa, Japanese encephalitis virus
KTRKILPQTI

SEQ ID NO: 233385 - protein, 10 aa, Japanese encephalitis virus
TRKILPQTIK

SEQ ID NO: 233386 - protein, 10 aa, Japanese encephalitis virus
RKILPQTIKD

SEQ ID NO: 233387 - protein, 10 aa, Japanese encephalitis virus
KILPQTIKDA

SEQ ID NO: 233388 - protein, 10 aa, Japanese encephalitis virus
ILPQIIRDAI

SEQ ID NO: 233389 - protein, 10 aa, Japanese encephalitis virus
LPQTIKDAIQ

SEQ ID NO: 233390 - protein, 10 aa, Japanese encephalitis virus
PQIIRDAIQQ

SEQ ID NO: 233391 - protein, 10 aa, Japanese encephalitis virus
QTIKDAIQQR

SEQ ID NO: 233392 - protein, 10 aa, Japanese encephalitis virus
TIKDAIQQRL

SEQ ID NO: 233393 - protein, 10 aa, Japanese encephalitis virus
IKDAIQQHLR

SEQ ID NO: 233394 - protein, 10 aa, Japanese encephalitis virus
KDAIQQHLRT

SEQ ID NO: 233395 - protein, 10 aa, Japanese encephalitis virus
DAIQQRLKTA

SEQ ID NO: 233396 - protein, 10 aa, Japanese encephalitis virus
AIQQHLRTAV

SEQ ID NO: 233397 - protein, 10 aa, Japanese encephalitis virus
IQQRLKTAVL

SEQ ID NO: 233398 - protein, 10 aa, Japanese encephalitis virus
QQRLKTAVLA

SEQ ID NO: 233399 - protein, 10 aa, Japanese encephalitis virus
QRLKTAVLAP

SEQ ID NO: 233400 - protein, 10 aa, Japanese encephalitis virus
HLRTAVLAPT

SEQ ID NO: 233401 - protein, 10 aa, Japanese encephalitis virus
VAAEMAEVLR

SEQ ID NO: 233402 - protein, 10 aa, Japanese encephalitis virus
AAEMAEVLRG

SEQ ID NO: 233403 - protein, 10 aa, Japanese encephalitis virus
AEMAEVLRGL

SEQ ID NO: 233404 - protein, 10 aa, Japanese encephalitis virus
EMAEVLRGLP

SEQ ID NO: 233405 - protein, 10 aa, Japanese encephalitis virus
MAEVLRGLPV

SEQ ID NO: 233406 - protein, 10 aa, Japanese encephalitis virus
AEVLRGLPVR

SEQ ID NO: 233407 - protein, 10 aa, Japanese encephalitis virus
EVLRGLPVRY

SEQ ID NO: 233408 - protein, 10 aa, Japanese encephalitis virus
VLRGLPVRYQ

SEQ ID NO: 233409 - protein, 10 aa, Japanese encephalitis virus
AVQRSHQGNE

SEQ ID NO: 233410 - protein, 10 aa, Japanese encephalitis virus
VQRSHQGNEI

SEQ ID NO: 233411 - protein, 10 aa, Japanese encephalitis virus
QRSHQGNEIV

SEQ ID NO: 233412 - protein, 10 aa, Japanese encephalitis virus
REHQGNAIVD

SEQ ID NO: 233413 - protein, 10 aa, Japanese encephalitis virus
SHQGNEIVDV

SEQ ID NO: 233414 - protein, 10 aa, Japanese encephalitis virus
DAPIHDLQDE

SEQ ID NO: 233415 - protein, 10 aa, Japanese encephalitis virus
APIHDLQDET

SEQ ID NO: 233416 - protein, 10 aa, Japanese encephalitis virus
PIHDLQDEVP

SEQ ID NO: 233417 - protein, 10 aa, Japanese encephalitis virus
IHDLQDETPD

SEQ ID NO: 233418 - protein, 10 aa, Japanese encephalitis virus
HDLQDEIPDW

SEQ ID NO: 233419 - protein, 10 aa, Japanese encephalitis virus
DLQDEVPDRA

SEQ ID NO: 233420 - protein, 10 aa, Japanese encephalitis virus
LQDEIPDWAW

SEQ ID NO: 233421 - protein, 10 aa, Japanese encephalitis virus
QDETPDRAWS

SEQ ID NO: 233422 - protein, 10 aa, Japanese encephalitis virus
DETPDRAWSS

SEQ ID NO: 233423 - protein, 10 aa, Japanese encephalitis virus
ETPDRAWSSG

SEQ ID NO: 233424 - protein, 10 aa, Japanese encephalitis virus
WSTEYAGKTV

SEQ ID NO: 233425 - protein, 10 aa, Japanese encephalitis virus
STEYAGKTVW

SEQ ID NO: 233426 - protein, 10 aa, Japanese encephalitis virus
TEYSGKTVWF

SEQ ID NO: 233427 - protein, 10 aa, Japanese encephalitis virus
EYSGKTVWFV

SEQ ID NO: 233428 - protein, 10 aa, Japanese encephalitis virus
SVKMGNEIAV

SEQ ID NO: 233429 - protein, 10 aa, Japanese encephalitis virus
VKMGNEIAVC

SEQ ID NO: 233430 - protein, 10 aa, Japanese encephalitis virus
KMGNEIAVCL

SEQ ID NO: 233431 - protein, 10 aa, Japanese encephalitis virus
AMCLQRAGKR

SEQ ID NO: 233432 - protein, 10 aa, Japanese encephalitis virus
MCLQRAGKRV

SEQ ID NO: 233433 - protein, 10 aa, Japanese encephalitis virus
RAGKKVIQLS

SEQ ID NO: 233434 - protein, 10 aa, Japanese encephalitis virus
AGKRVIQLNR

SEQ ID NO: 233435 - protein, 10 aa, Japanese encephalitis virus
GKKVIQLSRK

SEQ ID NO: 233436 - protein, 10 aa, Japanese encephalitis virus
KRVIQLNRKS

SEQ ID NO: 233437 - protein, 10 aa, Japanese encephalitis virus
RVIQLNRKSY

SEQ ID NO: 233438 - protein, 10 aa, Japanese encephalitis virus
IDCRKSVKPI

SEQ ID NO: 233439 - protein, 10 aa, Japanese encephalitis virus
DCRKSVEPTI

SEQ ID NO: 233440 - protein, 10 aa, Japanese encephalitis virus
CRKSVEPTIL

SEQ ID NO: 233441 - protein, 10 aa, Japanese encephalitis virus
RKSVKPIILE

SEQ ID NO: 233442 - protein, 10 aa, Japanese encephalitis virus
KSVKPTILEK

SEQ ID NO: 233443 - protein, 10 aa, Japanese encephalitis virus
SVKPTILEKE

SEQ ID NO: 233444 - protein, 10 aa, Japanese encephalitis virus
VKPTILEKEE

SEQ ID NO: 233445 - protein, 10 aa, Japanese encephalitis virus
KPTILEKEEG

SEQ ID NO: 233446 - protein, 10 aa, Japanese encephalitis virus
PIILEEGEGR

SEQ ID NO: 233447 - protein, 10 aa, Japanese encephalitis virus
TILEKEEGRV

SEQ ID NO: 233448 - protein, 10 aa, Japanese encephalitis virus
ILEKEEGRVI

SEQ ID NO: 233449 - protein, 10 aa, Japanese encephalitis virus
LEKEEGRVIL

SEQ ID NO: 233450 - protein, 10 aa, Japanese encephalitis virus
EKEEGRVILG

SEQ ID NO: 233451 - protein, 10 aa, Japanese encephalitis virus
EGEGRVFLGN

SEQ ID NO: 233452 - protein, 10 aa, Japanese encephalitis virus
EEGRVILGNP

SEQ ID NO: 233453 - protein, 10 aa, Japanese encephalitis virus
ILGNPSPITN

SEQ ID NO: 233454 - protein, 10 aa, Japanese encephalitis virus
RRGRVGRNPS

SEQ ID NO: 233455 - protein, 10 aa, Japanese encephalitis virus
RGRVSRNPNQ

SEQ ID NO: 233456 - protein, 10 aa, Japanese encephalitis virus
GRVSRNPNQV

SEQ ID NO: 233457 - protein, 10 aa, Japanese encephalitis virus
RVSRNPNQVG

SEQ ID NO: 233458 - protein, 10 aa, Japanese encephalitis virus
VGRNPSQVGD

SEQ ID NO: 233459 - protein, 10 aa, Japanese encephalitis virus
SRNPNQVGDE

SEQ ID NO: 233460 - protein, 10 aa, Japanese encephalitis virus
NPSQVGDEYH

SEQ ID NO: 233461 - protein, 10 aa, Japanese encephalitis virus
PNQVGDEYEY

SEQ ID NO: 233462 - protein, 10 aa, Japanese encephalitis virus
SQVGDEYHYG

SEQ ID NO: 233463 - protein, 10 aa, Japanese encephalitis virus
VGDEYHYGGP

SEQ ID NO: 233464 - protein, 10 aa, Japanese encephalitis virus
GDEYEYGGAT

SEQ ID NO: 233465 - protein, 10 aa, Japanese encephalitis virus
DEYEYGGATS

SEQ ID NO: 233466 - protein, 10 aa, Japanese encephalitis virus
EYEYGGATSE

SEQ ID NO: 233467 - protein, 10 aa, Japanese encephalitis virus
YHYGGATSEG

SEQ ID NO: 233468 - protein, 10 aa, Japanese encephalitis virus
EYGGATSEDD

SEQ ID NO: 233469 - protein, 10 aa, Japanese encephalitis virus
YGGATSEGDS

SEQ ID NO: 233470 - protein, 10 aa, Japanese encephalitis virus
GGPTSEDDSN

SEQ ID NO: 233471 - protein, 10 aa, Japanese encephalitis virus
GATSEDDGNL

SEQ ID NO: 233472 - protein, 10 aa, Japanese encephalitis virus
ATSEDDGNLA

SEQ ID NO: 233473 - protein, 10 aa, Japanese encephalitis virus
TSEDDGNLAH

SEQ ID NO: 233474 - protein, 10 aa, Japanese encephalitis virus
SEDDGNLAHW

SEQ ID NO: 233475 - protein, 10 aa, Japanese encephalitis virus
EDDGNLAHWT

SEQ ID NO: 233476 - protein, 10 aa, Japanese encephalitis virus
DDGNLAHWTE

SEQ ID NO: 233477 - protein, 10 aa, Japanese encephalitis virus
LYGPEREKAL

SEQ ID NO: 233478 - protein, 10 aa, Japanese encephalitis virus
YGPEREKALT

SEQ ID NO: 233479 - protein, 10 aa, Japanese encephalitis virus
GPEREKALTM

SEQ ID NO: 233480 - protein, 10 aa, Japanese encephalitis virus
PEREKALTMD

SEQ ID NO: 233481 - protein, 10 aa, Japanese encephalitis virus
EREKALTMDG

SEQ ID NO: 233482 - protein, 10 aa, Japanese encephalitis virus
REKALTMDGE

SEQ ID NO: 233483 - protein, 10 aa, Japanese encephalitis virus
EKAFTMDVEY

SEQ ID NO: 233484 - protein, 10 aa, Japanese encephalitis virus
KAFTMDVEYR

SEQ ID NO: 233485 - protein, 10 aa, Japanese encephalitis virus
AFTMDVEYRL

SEQ ID NO: 233486 - protein, 10 aa, Japanese encephalitis virus
FTMDVEYRLR

SEQ ID NO: 233487 - protein, 10 aa, Japanese encephalitis virus
PVWLAYKVAP

SEQ ID NO: 233488 - protein, 10 aa, Japanese encephalitis virus
VWLAYKVAPN

SEQ ID NO: 233489 - protein, 10 aa, Japanese encephalitis virus
WLAYKVAPNG

SEQ ID NO: 233490 - protein, 10 aa, Japanese encephalitis virus
LAYRVASNGI

SEQ ID NO: 233491 - protein, 10 aa, Japanese encephalitis virus
AYRVASNGIQ

SEQ ID NO: 233492 - protein, 10 aa, Japanese encephalitis virus
YRVASNGIQY

SEQ ID NO: 233493 - protein, 10 aa, Japanese encephalitis virus
KVAPNGIQYT

SEQ ID NO: 233494 - protein, 10 aa, Japanese encephalitis virus
PNGIQYTDRK

SEQ ID NO: 233495 - protein, 10 aa, Japanese encephalitis virus
RTNAILEDST

SEQ ID NO: 233496 - protein, 10 aa, Japanese encephalitis virus
TNAILEDSTE

SEQ ID NO: 233497 - protein, 10 aa, Japanese encephalitis virus
NAILEDSTEV

SEQ ID NO: 233498 - protein, 10 aa, Japanese encephalitis virus
AILEDSTEVE

SEQ ID NO: 233499 - protein, 10 aa, Japanese encephalitis virus
ILEDSTEVEI

SEQ ID NO: 233500 - protein, 10 aa, Japanese encephalitis virus
LEDSTEVEIV

SEQ ID NO: 233501 - protein, 10 aa, Japanese encephalitis virus
EDSTEVEIVT

SEQ ID NO: 233502 - protein, 10 aa, Japanese encephalitis virus
DSTEVEIVTR

SEQ ID NO: 233503 - protein, 10 aa, Japanese encephalitis virus
NTEVEIVTRT

SEQ ID NO: 233504 - protein, 10 aa, Japanese encephalitis virus
TEVEIVTRTG

SEQ ID NO: 233505 - protein, 10 aa, Japanese encephalitis virus
RKVLKPRWLD

SEQ ID NO: 233506 - protein, 10 aa, Japanese encephalitis virus
KVLKPRWLDA

SEQ ID NO: 233507 - protein, 10 aa, Japanese encephalitis virus
VLKPRWLDAR

SEQ ID NO: 233508 - protein, 10 aa, Japanese encephalitis virus
DFAAGKRSAT

SEQ ID NO: 233509 - protein, 10 aa, Japanese encephalitis virus
FAAGKRSATS

SEQ ID NO: 233510 - protein, 10 aa, Japanese encephalitis virus
AAGKRSATSF

SEQ ID NO: 233511 - protein, 10 aa, Japanese encephalitis virus
SGKRSAVSFI

SEQ ID NO: 233512 - protein, 10 aa, Japanese encephalitis virus
GKRSATSFIE

SEQ ID NO: 233513 - protein, 10 aa, Japanese encephalitis virus
KRSAVSFIEE

SEQ ID NO: 233514 - protein, 10 aa, Japanese encephalitis virus
RSAISFIEVR

SEQ ID NO: 233515 - protein, 10 aa, Japanese encephalitis virus
SATSFIEVLG

SEQ ID NO: 233516 - protein, 10 aa, Japanese encephalitis virus
AISFIEVRGR

SEQ ID NO: 233517 - protein, 10 aa, Japanese encephalitis virus
TSFIEVLGRM

SEQ ID NO: 233518 - protein, 10 aa, Japanese encephalitis virus
SFIEEPGRMP

SEQ ID NO: 233519 - protein, 10 aa, Japanese encephalitis virus
FIEEPGRMPE

SEQ ID NO: 233520 - protein, 10 aa, Japanese encephalitis virus
IEEPGRMPEH

SEQ ID NO: 233521 - protein, 10 aa, Japanese encephalitis virus
EVRGRMPEHF

SEQ ID NO: 233522 - protein, 10 aa, Japanese encephalitis virus
VLGRMPEHFA

SEQ ID NO: 233523 - protein, 10 aa, Japanese encephalitis virus
PGRMPEHFMG

SEQ ID NO: 233524 - protein, 10 aa, Japanese encephalitis virus
MYLVATAEKS

SEQ ID NO: 233525 - protein, 10 aa, Japanese encephalitis virus
YLVATAEKSG

SEQ ID NO: 233526 - protein, 10 aa, Japanese encephalitis virus
LVATAEKSGK

SEQ ID NO: 233527 - protein, 10 aa, Japanese encephalitis virus
VATAEKSGKA

SEQ ID NO: 233528 - protein, 10 aa, Japanese encephalitis virus
ATAEKSGKAH

SEQ ID NO: 233529 - protein, 10 aa, Japanese encephalitis virus
TAEKGGKTHR

SEQ ID NO: 233530 - protein, 10 aa, Japanese encephalitis virus
AEKGGKTHRM

SEQ ID NO: 233531 - protein, 10 aa, Japanese encephalitis virus
EKSGKAHRMA

SEQ ID NO: 233532 - protein, 10 aa, Japanese encephalitis virus
KSGKAHRMAL

SEQ ID NO: 233533 - protein, 10 aa, Japanese encephalitis virus
GGKTHRMALE

SEQ ID NO: 233534 - protein, 10 aa, Japanese encephalitis virus
PDALETVTLI

SEQ ID NO: 233535 - protein, 10 aa, Japanese encephalitis virus
DALETITLTV

SEQ ID NO: 233536 - protein, 10 aa, Japanese encephalitis virus
ALETITLTVA

SEQ ID NO: 233537 - protein, 10 aa, Japanese encephalitis virus
LETVTLIVAI

SEQ ID NO: 233538 - protein, 10 aa, Japanese encephalitis virus
AIAVMTGGFF

SEQ ID NO: 233539 - protein, 10 aa, Japanese encephalitis virus
IAVMTGGFFL

SEQ ID NO: 233540 - protein, 10 aa, Japanese encephalitis virus
AVMTGGFFLL

SEQ ID NO: 233541 - protein, 10 aa, Japanese encephalitis virus
AMTGGFFLLM

SEQ ID NO: 233542 - protein, 10 aa, Japanese encephalitis virus
MTRGFFLLMM

SEQ ID NO: 233543 - protein, 10 aa, Japanese encephalitis virus
TRGFFLLMMQ

SEQ ID NO: 233544 - protein, 10 aa, Japanese encephalitis virus
RGFFLLMMQR

SEQ ID NO: 233545 - protein, 10 aa, Japanese encephalitis virus
LLMMQRKGIE

SEQ ID NO: 233546 - protein, 10 aa, Japanese encephalitis virus
LMKQRKGIGK

SEQ ID NO: 233547 - protein, 10 aa, Japanese encephalitis virus
MMQRKGIEKM

SEQ ID NO: 233548 - protein, 10 aa, Japanese encephalitis virus
MQRKGIEKMG

SEQ ID NO: 233549 - protein, 10 aa, Japanese encephalitis virus
QRKGIEKMGL

SEQ ID NO: 233550 - protein, 10 aa, Japanese encephalitis virus
RKGIEKMGLG

SEQ ID NO: 233551 - protein, 10 aa, Japanese encephalitis virus
KGIEKMGLGA

SEQ ID NO: 233552 - protein, 10 aa, Japanese encephalitis virus
GIEKMGLGAL

SEQ ID NO: 233553 - protein, 10 aa, Japanese encephalitis virus
IEKMGLGALV

SEQ ID NO: 233554 - protein, 10 aa, Japanese encephalitis virus
EKMGLGALVL

SEQ ID NO: 233555 - protein, 10 aa, Japanese encephalitis virus
KMGLGALVLV

SEQ ID NO: 233556 - protein, 10 aa, Japanese encephalitis virus
VLIPEPEKQK

SEQ ID NO: 233557 - protein, 10 aa, Japanese encephalitis virus
LIPEPEKQKS

SEQ ID NO: 233558 - protein, 10 aa, Japanese encephalitis virus
IPEPEKQRLQ

SEQ ID NO: 233559 - protein, 10 aa, Japanese encephalitis virus
PEPEKQRLQT

SEQ ID NO: 233560 - protein, 10 aa, Japanese encephalitis virus
EPEKQRLQTD

SEQ ID NO: 233561 - protein, 10 aa, Japanese encephalitis virus
PEKQRSQTGN

SEQ ID NO: 233562 - protein, 10 aa, Japanese encephalitis virus
EKQKSQTDNQ

SEQ ID NO: 233563 - protein, 10 aa, Japanese encephalitis virus
KQRLQTDNQL

SEQ ID NO: 233564 - protein, 10 aa, Japanese encephalitis virus
QRSQTGNQLA

SEQ ID NO: 233565 - protein, 10 aa, Japanese encephalitis virus
KSQTDNQLAV

SEQ ID NO: 233566 - protein, 10 aa, Japanese encephalitis virus
LQTDNQLAVF

SEQ ID NO: 233567 - protein, 10 aa, Japanese encephalitis virus
ICVLTVVGMV

SEQ ID NO: 233568 - protein, 10 aa, Japanese encephalitis virus
CVLTVVGVAA

SEQ ID NO: 233569 - protein, 10 aa, Japanese encephalitis virus
VLTVVGVAAA

SEQ ID NO: 233570 - protein, 10 aa, Japanese encephalitis virus
LTVVGVAAAN

SEQ ID NO: 233571 - protein, 10 aa, Japanese encephalitis virus
TVVGMVAANE

SEQ ID NO: 233572 - protein, 10 aa, Japanese encephalitis virus
VVGVAAANEY

SEQ ID NO: 233573 - protein, 10 aa, Japanese encephalitis virus
VGMVAANEYG

SEQ ID NO: 233574 - protein, 10 aa, Japanese encephalitis virus
GMVAANEYGM

SEQ ID NO: 233575 - protein, 10 aa, Japanese encephalitis virus
VAAANEYGML

SEQ ID NO: 233576 - protein, 10 aa, Japanese encephalitis virus
GMLERTKADL

SEQ ID NO: 233577 - protein, 10 aa, Japanese encephalitis virus
MLERTKADLK

SEQ ID NO: 233578 - protein, 10 aa, Japanese encephalitis virus
LERTKADLKS

SEQ ID NO: 233579 - protein, 10 aa, Japanese encephalitis virus
EKTKADIKSM

SEQ ID NO: 233580 - protein, 10 aa, Japanese encephalitis virus
RTKADLKSMF

SEQ ID NO: 233581 - protein, 10 aa, Japanese encephalitis virus
TKADLKSMFV

SEQ ID NO: 233582 - protein, 10 aa, Japanese encephalitis virus
KADLKSMFVG

SEQ ID NO: 233583 - protein, 10 aa, Japanese encephalitis virus
ADLKSMFAGK

SEQ ID NO: 233584 - protein, 10 aa, Japanese encephalitis virus
KSMFAGKTQA

SEQ ID NO: 233585 - protein, 10 aa, Japanese encephalitis virus
TQALGLTGLP

SEQ ID NO: 233586 - protein, 10 aa, Japanese encephalitis virus
QALGLTGLPS

SEQ ID NO: 233587 - protein, 10 aa, Japanese encephalitis virus
VSGMTGLPGM

SEQ ID NO: 233588 - protein, 10 aa, Japanese encephalitis virus
GLTGLPSMTL

SEQ ID NO: 233589 - protein, 10 aa, Japanese encephalitis virus
LTGLPSVALD

SEQ ID NO: 233590 - protein, 10 aa, Japanese encephalitis virus
TGLPSVALDL

SEQ ID NO: 233591 - protein, 10 aa, Japanese encephalitis virus
GLPGMALDLR

SEQ ID NO: 233592 - protein, 10 aa, Japanese encephalitis virus
LPGMALDLRP

SEQ ID NO: 233593 - protein, 10 aa, Japanese encephalitis virus
PSMTLDLRPA

SEQ ID NO: 233594 - protein, 10 aa, Japanese encephalitis virus
SVALDLRPAT

SEQ ID NO: 233595 - protein, 10 aa, Japanese encephalitis virus
VALDLRPATA

SEQ ID NO: 233596 - protein, 10 aa, Japanese encephalitis virus
HIITSEYVTT

SEQ ID NO: 233597 - protein, 10 aa, Japanese encephalitis virus
LITSEYVTPS

SEQ ID NO: 233598 - protein, 10 aa, Japanese encephalitis virus
YVTPSLASIS

SEQ ID NO: 233599 - protein, 10 aa, Japanese encephalitis virus
VTPSLASISS

SEQ ID NO: 233600 - protein, 10 aa, Japanese encephalitis virus
TPSLASISSQ

SEQ ID NO: 233601 - protein, 10 aa, Japanese encephalitis virus
PSLASISSQA

SEQ ID NO: 233602 - protein, 10 aa, Japanese encephalitis virus
LVLLGCWGQI

SEQ ID NO: 233603 - protein, 10 aa, Japanese encephalitis virus
VLLGCWGQIT

SEQ ID NO: 233604 - protein, 10 aa, Japanese encephalitis virus
LLGCWGQITL

SEQ ID NO: 233605 - protein, 10 aa, Japanese encephalitis virus
CWGQITLTTS

SEQ ID NO: 233606 - protein, 10 aa, Japanese encephalitis virus
WGQITLTTSL

SEQ ID NO: 233607 - protein, 10 aa, Japanese encephalitis virus
GQITLTTSLT

SEQ ID NO: 233608 - protein, 10 aa, Japanese encephalitis virus
QITLTTSLTA

SEQ ID NO: 233609 - protein, 10 aa, Japanese encephalitis virus
VTLTTFLTAM

SEQ ID NO: 233610 - protein, 10 aa, Japanese encephalitis virus
TLTTSLTAMV

SEQ ID NO: 233611 - protein, 10 aa, Japanese encephalitis virus
LTTSLTAMVL

SEQ ID NO: 233612 - protein, 10 aa, Japanese encephalitis virus
LTAVVLATLH

SEQ ID NO: 233613 - protein, 10 aa, Japanese encephalitis virus
TAVVLATLHY

SEQ ID NO: 233614 - protein, 10 aa, Japanese encephalitis virus
AVVLATLHYG

SEQ ID NO: 233615 - protein, 10 aa, Japanese encephalitis virus
VLATLHYGFM

SEQ ID NO: 233616 - protein, 10 aa, Japanese encephalitis virus
LTTLHYGYML

SEQ ID NO: 233617 - protein, 10 aa, Japanese encephalitis virus
AILHYGYMLP

SEQ ID NO: 233618 - protein, 10 aa, Japanese encephalitis virus
ILHYGYMLPG

SEQ ID NO: 233619 - protein, 10 aa, Japanese encephalitis virus
LLIGGSVAAF

SEQ ID NO: 233620 - protein, 10 aa, Japanese encephalitis virus
LIGGSVAAFL

SEQ ID NO: 233621 - protein, 10 aa, Japanese encephalitis virus
IGGSVAAFLV

SEQ ID NO: 233622 - protein, 10 aa, Japanese encephalitis virus
GGSVAAFLVN

SEQ ID NO: 233623 - protein, 10 aa, Japanese encephalitis virus
GSVAAFLVNP

SEQ ID NO: 233624 - protein, 10 aa, Japanese encephalitis virus
SVAAFLVNPK

SEQ ID NO: 233625 - protein, 10 aa, Japanese encephalitis virus
VAAFLVNPKI

SEQ ID NO: 233626 - protein, 10 aa, Japanese encephalitis virus
AAFLVNPKIT

SEQ ID NO: 233627 - protein, 10 aa, Japanese encephalitis virus
AFLVNPKITT

SEQ ID NO: 233628 - protein, 10 aa, Japanese encephalitis virus
FLVNPKITTV

SEQ ID NO: 233629 - protein, 10 aa, Japanese encephalitis virus
LVNPNVTTVK

SEQ ID NO: 233630 - protein, 10 aa, Japanese encephalitis virus
VNPNVTTVKK

SEQ ID NO: 233631 - protein, 10 aa, Japanese encephalitis virus
NPNVSTVRKA

SEQ ID NO: 233632 - protein, 10 aa, Japanese encephalitis virus
PNVSTVRKAG

SEQ ID NO: 233633 - protein, 10 aa, Japanese encephalitis virus
NVSTVRKAGV

SEQ ID NO: 233634 - protein, 10 aa, Japanese encephalitis virus
VTTVKKPGVL

SEQ ID NO: 233635 - protein, 10 aa, Japanese encephalitis virus
TTVKKPGVLV

SEQ ID NO: 233636 - protein, 10 aa, Japanese encephalitis virus
TVRKAGVLVT

SEQ ID NO: 233637 - protein, 10 aa, Japanese encephalitis virus
VKKPGVLVTA

SEQ ID NO: 233638 - protein, 10 aa, Japanese encephalitis virus
RKAGVLVTAA

SEQ ID NO: 233639 - protein, 10 aa, Japanese encephalitis virus
KAGVLVTAAT

SEQ ID NO: 233640 - protein, 10 aa, Japanese encephalitis virus
PGVLVTAATL

SEQ ID NO: 233641 - protein, 10 aa, Japanese encephalitis virus
GVLVTAATLS

SEQ ID NO: 233642 - protein, 10 aa, Japanese encephalitis virus
VLVTAATLSL

SEQ ID NO: 233643 - protein, 10 aa, Japanese encephalitis virus
LVTAATLSLW

SEQ ID NO: 233644 - protein, 10 aa, Japanese encephalitis virus
VTAATLSLWD

SEQ ID NO: 233645 - protein, 10 aa, Japanese encephalitis virus
TAATLSLWDN

SEQ ID NO: 233646 - protein, 10 aa, Japanese encephalitis virus
AATLSLWDNG

SEQ ID NO: 233647 - protein, 10 aa, Japanese encephalitis virus
ATLSLWDNGA

SEQ ID NO: 233648 - protein, 10 aa, Japanese encephalitis virus
SLWDNGASAV

SEQ ID NO: 233649 - protein, 10 aa, Japanese encephalitis virus
AWTLIKNANK

SEQ ID NO: 233650 - protein, 10 aa, Japanese encephalitis virus
WTLIKNADNP

SEQ ID NO: 233651 - protein, 10 aa, Japanese encephalitis virus
TLIKNADNPS

SEQ ID NO: 233652 - protein, 10 aa, Japanese encephalitis virus
LIKNADNPSL

SEQ ID NO: 233653 - protein, 10 aa, Japanese encephalitis virus
IKNANKPSLK

SEQ ID NO: 233654 - protein, 10 aa, Japanese encephalitis virus
KNADKPSLKK

SEQ ID NO: 233655 - protein, 10 aa, Japanese encephalitis virus
NANKPSLKRG

SEQ ID NO: 233656 - protein, 10 aa, Japanese encephalitis virus
ADNPSLKRGG

SEQ ID NO: 233657 - protein, 10 aa, Japanese encephalitis virus
NPSLKRGGPG

SEQ ID NO: 233658 - protein, 10 aa, Japanese encephalitis virus
PSFKKGRPGG

SEQ ID NO: 233659 - protein, 10 aa, Japanese encephalitis virus
SLKRGGPGGR

SEQ ID NO: 233660 - protein, 10 aa, Japanese encephalitis virus
LKRGGPGGRT

SEQ ID NO: 233661 - protein, 10 aa, Japanese encephalitis virus
KRGRSGGRTL

SEQ ID NO: 233662 - protein, 10 aa, Japanese encephalitis virus
RGRSGGRTLG

SEQ ID NO: 233663 - protein, 10 aa, Japanese encephalitis virus
GRPGGRTLGD

SEQ ID NO: 233664 - protein, 10 aa, Japanese encephalitis virus
GPGGRTLWEQ

SEQ ID NO: 233665 - protein, 10 aa, Japanese encephalitis virus
PGGRTLWEQW

SEQ ID NO: 233666 - protein, 10 aa, Japanese encephalitis virus
GGRTLWEQWK

SEQ ID NO: 233667 - protein, 10 aa, Japanese encephalitis virus
GRTLGEQWKR

SEQ ID NO: 233668 - protein, 10 aa, Japanese encephalitis virus
RTLWEQWKEK

SEQ ID NO: 233669 - protein, 10 aa, Japanese encephalitis virus
TLGEQWKRKL

SEQ ID NO: 233670 - protein, 10 aa, Japanese encephalitis virus
LWEQWKEKLN

SEQ ID NO: 233671 - protein, 10 aa, Japanese encephalitis virus
GDQWKEKLNA

SEQ ID NO: 233672 - protein, 10 aa, Japanese encephalitis virus
DQWKEKLNAM

SEQ ID NO: 233673 - protein, 10 aa, Japanese encephalitis virus
QWKERLNAMS

SEQ ID NO: 233674 - protein, 10 aa, Japanese encephalitis virus
WKRKLNAMGR

SEQ ID NO: 233675 - protein, 10 aa, Japanese encephalitis virus
KLNAMGRDEF

SEQ ID NO: 233676 - protein, 10 aa, Japanese encephalitis virus
LNAMGRDEFF

SEQ ID NO: 233677 - protein, 10 aa, Japanese encephalitis virus
NAMGRDEFFK

SEQ ID NO: 233678 - protein, 10 aa, Japanese encephalitis virus
AMGRDEFFKY

SEQ ID NO: 233679 - protein, 10 aa, Japanese encephalitis virus
MGRDEFFKYR

SEQ ID NO: 233680 - protein, 10 aa, Japanese encephalitis virus
GRDEFFKYRR

SEQ ID NO: 233681 - protein, 10 aa, Japanese encephalitis virus
REEFFQYRRE

SEQ ID NO: 233682 - protein, 10 aa, Japanese encephalitis virus
EEFFQYRREA

SEQ ID NO: 233683 - protein, 10 aa, Japanese encephalitis virus
EFFQYRREAI

SEQ ID NO: 233684 - protein, 10 aa, Japanese encephalitis virus
FFQYRREAII

SEQ ID NO: 233685 - protein, 10 aa, Japanese encephalitis virus
FKYRREGIIE

SEQ ID NO: 233686 - protein, 10 aa, Japanese encephalitis virus
KYRREGIIEV

SEQ ID NO: 233687 - protein, 10 aa, Japanese encephalitis virus
DRTEARRARS

SEQ ID NO: 233688 - protein, 10 aa, Japanese encephalitis virus
RTEARRARSE

SEQ ID NO: 233689 - protein, 10 aa, Japanese encephalitis virus
TEARRARSEN

SEQ ID NO: 233690 - protein, 10 aa, Japanese encephalitis virus
EARRARSENN

SEQ ID NO: 233691 - protein, 10 aa, Japanese encephalitis virus
ACRARRENNI

SEQ ID NO: 233692 - protein, 10 aa, Japanese encephalitis virus
CRARRENNIV

SEQ ID NO: 233693 - protein, 10 aa, Japanese encephalitis virus
RARRENNKVG

SEQ ID NO: 233694 - protein, 10 aa, Japanese encephalitis virus
ARSENNIVGG

SEQ ID NO: 233695 - protein, 10 aa, Japanese encephalitis virus
RRENNKVGGH

SEQ ID NO: 233696 - protein, 10 aa, Japanese encephalitis virus
SENNIVGGHP

SEQ ID NO: 233697 - protein, 10 aa, Japanese encephalitis virus
ENNKVGGHPV

SEQ ID NO: 233698 - protein, 10 aa, Japanese encephalitis virus
NNKVGGHPVS

SEQ ID NO: 233699 - protein, 10 aa, Japanese encephalitis virus
NKVGGHPVSR

SEQ ID NO: 233700 - protein, 10 aa, Japanese encephalitis virus
KVGGHPVSRG

SEQ ID NO: 233701 - protein, 10 aa, Japanese encephalitis virus
GFVPPIGKVI

SEQ ID NO: 233702 - protein, 10 aa, Japanese encephalitis virus
FVPPIGKVID

SEQ ID NO: 233703 - protein, 10 aa, Japanese encephalitis virus
VPPIGKVIDL

SEQ ID NO: 233704 - protein, 10 aa, Japanese encephalitis virus
SPIGKVVDLG

SEQ ID NO: 233705 - protein, 10 aa, Japanese encephalitis virus
GKVIDLGCGC

SEQ ID NO: 233706 - protein, 10 aa, Japanese encephalitis virus
KVVDLGCGRG

SEQ ID NO: 233707 - protein, 10 aa, Japanese encephalitis virus
VIDLGCGCGG

SEQ ID NO: 233708 - protein, 10 aa, Japanese encephalitis virus
VDLGCGRGGW

SEQ ID NO: 233709 - protein, 10 aa, Japanese encephalitis virus
DLGCGCGGWS

SEQ ID NO: 233710 - protein, 10 aa, Japanese encephalitis virus
LGCGCGGWSY

SEQ ID NO: 233711 - protein, 10 aa, Japanese encephalitis virus
GCGRGGWSYC

SEQ ID NO: 233712 - protein, 10 aa, Japanese encephalitis virus
CGCGGWSYYA

SEQ ID NO: 233713 - protein, 10 aa, Japanese encephalitis virus
GRGGWSYCAA

SEQ ID NO: 233714 - protein, 10 aa, Japanese encephalitis virus
RGGWSYCAAT

SEQ ID NO: 233715 - protein, 10 aa, Japanese encephalitis virus
GGWSYCAATL

SEQ ID NO: 233716 - protein, 10 aa, Japanese encephalitis virus
GWSYCAATLK

SEQ ID NO: 233717 - protein, 10 aa, Japanese encephalitis virus
WSYCAATLKK

SEQ ID NO: 233718 - protein, 10 aa, Japanese encephalitis virus
SYCAATLKKV

SEQ ID NO: 233719 - protein, 10 aa, Japanese encephalitis virus
YCAATLKKVQ

SEQ ID NO: 233720 - protein, 10 aa, Japanese encephalitis virus
CAATLKKVQE

SEQ ID NO: 233721 - protein, 10 aa, Japanese encephalitis virus
AATLKKVQEF

SEQ ID NO: 233722 - protein, 10 aa, Japanese encephalitis virus
ATLKRVQEVR

SEQ ID NO: 233723 - protein, 10 aa, Japanese encephalitis virus
TLKKVQEFRG

SEQ ID NO: 233724 - protein, 10 aa, Japanese encephalitis virus
LKKVQEFRGY

SEQ ID NO: 233725 - protein, 10 aa, Japanese encephalitis virus
KRVQEVRGYT

SEQ ID NO: 233726 - protein, 10 aa, Japanese encephalitis virus
KVQEFRGYTK

SEQ ID NO: 233727 - protein, 10 aa, Japanese encephalitis virus
VQEFRGYTKG

SEQ ID NO: 233728 - protein, 10 aa, Japanese encephalitis virus
QEFRGYTKGG

SEQ ID NO: 233729 - protein, 10 aa, Japanese encephalitis virus
EFRGYTKGGA

SEQ ID NO: 233730 - protein, 10 aa, Japanese encephalitis virus
FRGYTKGGAG

SEQ ID NO: 233731 - protein, 10 aa, Japanese encephalitis virus
EPMPMQSYGW

SEQ ID NO: 233732 - protein, 10 aa, Japanese encephalitis virus
PMPMQSYGWN

SEQ ID NO: 233733 - protein, 10 aa, Japanese encephalitis virus
MPMQSYGWNL

SEQ ID NO: 233734 - protein, 10 aa, Japanese encephalitis virus
PMQSYGWNLV

SEQ ID NO: 233735 - protein, 10 aa, Japanese encephalitis virus
QSYGWNLVSM

SEQ ID NO: 233736 - protein, 10 aa, Japanese encephalitis virus
SYGWNLVSMK

SEQ ID NO: 233737 - protein, 10 aa, Japanese encephalitis virus
YGWNLVSMKS

SEQ ID NO: 233738 - protein, 10 aa, Japanese encephalitis virus
GWNLVSMKSG

SEQ ID NO: 233739 - protein, 10 aa, Japanese encephalitis virus
WNLVSMKSGV

SEQ ID NO: 233740 - protein, 10 aa, Japanese encephalitis virus
NLVSLKSGVH

SEQ ID NO: 233741 - protein, 10 aa, Japanese encephalitis virus
LVSLKSGVHV

SEQ ID NO: 233742 - protein, 10 aa, Japanese encephalitis virus
VSLKSGVHVF

SEQ ID NO: 233743 - protein, 10 aa, Japanese encephalitis virus
SMKSGVDVFY

SEQ ID NO: 233744 - protein, 10 aa, Japanese encephalitis virus
MKSGVDVFYK

SEQ ID NO: 233745 - protein, 10 aa, Japanese encephalitis virus
KSGVHVFYKP

SEQ ID NO: 233746 - protein, 10 aa, Japanese encephalitis virus
SGVHVFYKPS

SEQ ID NO: 233747 - protein, 10 aa, Japanese encephalitis virus
GVHVFYKPSE

SEQ ID NO: 233748 - protein, 10 aa, Japanese encephalitis virus
VDVFYRPSEP

SEQ ID NO: 233749 - protein, 10 aa, Japanese encephalitis virus
HVFYKPSEPS

SEQ ID NO: 233750 - protein, 10 aa, Japanese encephalitis virus
PYMPKVIEKN

SEQ ID NO: 233751 - protein, 10 aa, Japanese encephalitis virus
YMPKVIEKIE

SEQ ID NO: 233752 - protein, 10 aa, Japanese encephalitis virus
MPKVIEKNEV

SEQ ID NO: 233753 - protein, 10 aa, Japanese encephalitis virus
PKVIEKIEVL

SEQ ID NO: 233754 - protein, 10 aa, Japanese encephalitis virus
KVIEKNEVLQ

SEQ ID NO: 233755 - protein, 10 aa, Japanese encephalitis virus
VIEKNEVLQR

SEQ ID NO: 233756 - protein, 10 aa, Japanese encephalitis virus
IEKIEVLQRR

SEQ ID NO: 233757 - protein, 10 aa, Japanese encephalitis virus
EKNEVLQRRF

SEQ ID NO: 233758 - protein, 10 aa, Japanese encephalitis virus
KIEVLQRRFG

SEQ ID NO: 233759 - protein, 10 aa, Japanese encephalitis virus
NEVLQRRFGG

SEQ ID NO: 233760 - protein, 10 aa, Japanese encephalitis virus
QVLLGRMDRA

SEQ ID NO: 233761 - protein, 10 aa, Japanese encephalitis virus
VLLGRMDRAV

SEQ ID NO: 233762 - protein, 10 aa, Japanese encephalitis virus
LLGRMDRAVW

SEQ ID NO: 233763 - protein, 10 aa, Japanese encephalitis virus
LGRMNRTVWR

SEQ ID NO: 233764 - protein, 10 aa, Japanese encephalitis virus
GRMNRTVWRG

SEQ ID NO: 233765 - protein, 10 aa, Japanese encephalitis virus
RMDRAVWRGP

SEQ ID NO: 233766 - protein, 10 aa, Japanese encephalitis virus
MDRTVWRGPR

SEQ ID NO: 233767 - protein, 10 aa, Japanese encephalitis virus
DRAVWRGPKY

SEQ ID NO: 233768 - protein, 10 aa, Japanese encephalitis virus
RTVWRGPRYE

SEQ ID NO: 233769 - protein, 10 aa, Japanese encephalitis virus
AVWRGPKYEE

SEQ ID NO: 233770 - protein, 10 aa, Japanese encephalitis virus
VWRGPKYKED

SEQ ID NO: 233771 - protein, 10 aa, Japanese encephalitis virus
WRGPKYKEDV

SEQ ID NO: 233772 - protein, 10 aa, Japanese encephalitis virus
RGPKYKEDVN

SEQ ID NO: 233773 - protein, 10 aa, Japanese encephalitis virus
GPRYEEDVNL

SEQ ID NO: 233774 - protein, 10 aa, Japanese encephalitis virus
PRYEEDVNLG

SEQ ID NO: 233775 - protein, 10 aa, Japanese encephalitis virus
RYEEDVNLGS

SEQ ID NO: 233776 - protein, 10 aa, Japanese encephalitis virus
AVGKGEVHSD

SEQ ID NO: 233777 - protein, 10 aa, Japanese encephalitis virus
VGKGEVHSDQ

SEQ ID NO: 233778 - protein, 10 aa, Japanese encephalitis virus
QDKIRRRIQK

SEQ ID NO: 233779 - protein, 10 aa, Japanese encephalitis virus
KIRKRIQKLK

SEQ ID NO: 233780 - protein, 10 aa, Japanese encephalitis virus
IRKRIQKLKE

SEQ ID NO: 233781 - protein, 10 aa, Japanese encephalitis virus
RRIQKLREEF

SEQ ID NO: 233782 - protein, 10 aa, Japanese encephalitis virus
RIQKLREGFA

SEQ ID NO: 233783 - protein, 10 aa, Japanese encephalitis virus
IQKQKEEFAT

SEQ ID NO: 233784 - protein, 10 aa, Japanese encephalitis virus
QKQKEEFATT

SEQ ID NO: 233785 - protein, 10 aa, Japanese encephalitis virus
KLREEFGTTW

SEQ ID NO: 233786 - protein, 10 aa, Japanese encephalitis virus
LREGFATTWH

SEQ ID NO: 233787 - protein, 10 aa, Japanese encephalitis virus
REEFGTTWHK

SEQ ID NO: 233788 - protein, 10 aa, Japanese encephalitis virus
EGFATTWHKD

SEQ ID NO: 233789 - protein, 10 aa, Japanese encephalitis virus
EFATTWHRDP

SEQ ID NO: 233790 - protein, 10 aa, Japanese encephalitis virus
FATTWHKDHE

SEQ ID NO: 233791 - protein, 10 aa, Japanese encephalitis virus
GTTWHKDPEH

SEQ ID NO: 233792 - protein, 10 aa, Japanese encephalitis virus
TTWHKDHEHP

SEQ ID NO: 233793 - protein, 10 aa, Japanese encephalitis virus
TWHRDPEHPY

SEQ ID NO: 233794 - protein, 10 aa, Japanese encephalitis virus
WHRDPEHPYR

SEQ ID NO: 233795 - protein, 10 aa, Japanese encephalitis virus
HKDPEHPYRN

SEQ ID NO: 233796 - protein, 10 aa, Japanese encephalitis virus
KDPEHPYRNW

SEQ ID NO: 233797 - protein, 10 aa, Japanese encephalitis virus
DHEHPYRTWT

SEQ ID NO: 233798 - protein, 10 aa, Japanese encephalitis virus
PEHPYRNWTY

SEQ ID NO: 233799 - protein, 10 aa, Japanese encephalitis virus
YHGSYEVRAT

SEQ ID NO: 233800 - protein, 10 aa, Japanese encephalitis virus
HGSYEVKANG

SEQ ID NO: 233801 - protein, 10 aa, Japanese encephalitis virus
GSYEVRATGS

SEQ ID NO: 233802 - protein, 10 aa, Japanese encephalitis virus
SYEVRATGSA

SEQ ID NO: 233803 - protein, 10 aa, Japanese encephalitis virus
YEVRATGSAS

SEQ ID NO: 233804 - protein, 10 aa, Japanese encephalitis virus
EVRATGSASS

SEQ ID NO: 233805 - protein, 10 aa, Japanese encephalitis virus
VRATGSASSL

SEQ ID NO: 233806 - protein, 10 aa, Japanese encephalitis virus
RATGSASSLV

SEQ ID NO: 233807 - protein, 10 aa, Japanese encephalitis virus
VELMSKPWDA

SEQ ID NO: 233808 - protein, 10 aa, Japanese encephalitis virus
KLMSKPWDTI

SEQ ID NO: 233809 - protein, 10 aa, Japanese encephalitis virus
LMSKPWDAIS

SEQ ID NO: 233810 - protein, 10 aa, Japanese encephalitis virus
MSKPWDAISY

SEQ ID NO: 233811 - protein, 10 aa, Japanese encephalitis virus
SKPWDTIANV

SEQ ID NO: 233812 - protein, 10 aa, Japanese encephalitis virus
KPWDAISYVT

SEQ ID NO: 233813 - protein, 10 aa, Japanese encephalitis virus
PWDTIANVTT

SEQ ID NO: 233814 - protein, 10 aa, Japanese encephalitis virus
WDTIANVTTM

SEQ ID NO: 233815 - protein, 10 aa, Japanese encephalitis virus
DAISYVTTMP

SEQ ID NO: 233816 - protein, 10 aa, Japanese encephalitis virus
TIANVTTMAM

SEQ ID NO: 233817 - protein, 10 aa, Japanese encephalitis virus
RVFKEKVGTM

SEQ ID NO: 233818 - protein, 10 aa, Japanese encephalitis virus
VFKEKVGTMA

SEQ ID NO: 233819 - protein, 10 aa, Japanese encephalitis virus
FKEKVGTKAP

SEQ ID NO: 233820 - protein, 10 aa, Japanese encephalitis virus
KEKVGTMAPE

SEQ ID NO: 233821 - protein, 10 aa, Japanese encephalitis virus
EKVGTMAPEP

SEQ ID NO: 233822 - protein, 10 aa, Japanese encephalitis virus
KVGTKAPEPP

SEQ ID NO: 233823 - protein, 10 aa, Japanese encephalitis virus
GVREVLNETT

SEQ ID NO: 233824 - protein, 10 aa, Japanese encephalitis virus
VREVLNETTN

SEQ ID NO: 233825 - protein, 10 aa, Japanese encephalitis virus
NWLWAHLSRK

SEQ ID NO: 233826 - protein, 10 aa, Japanese encephalitis virus
WLWAHLSRKK

SEQ ID NO: 233827 - protein, 10 aa, Japanese encephalitis virus
LWAHLSRKKR

SEQ ID NO: 233828 - protein, 10 aa, Japanese encephalitis virus
WAHLSRKKRP

SEQ ID NO: 233829 - protein, 10 aa, Japanese encephalitis virus
AHLSRKKRPR

SEQ ID NO: 233830 - protein, 10 aa, Japanese encephalitis virus
HLSRKKRPRL

SEQ ID NO: 233831 - protein, 10 aa, Japanese encephalitis virus
RLCTKEEFIN

SEQ ID NO: 233832 - protein, 10 aa, Japanese encephalitis virus
LCTKEEFINK

SEQ ID NO: 233833 - protein, 10 aa, Japanese encephalitis virus
CTKEEFINKV

SEQ ID NO: 233834 - protein, 10 aa, Japanese encephalitis virus
TKEEFINKVN

SEQ ID NO: 233835 - protein, 10 aa, Japanese encephalitis virus
KEEFINKVNS

SEQ ID NO: 233836 - protein, 10 aa, Japanese encephalitis virus
EEFIKKVNSD

SEQ ID NO: 233837 - protein, 10 aa, Japanese encephalitis virus
EFIKKVNSSA

SEQ ID NO: 233838 - protein, 10 aa, Japanese encephalitis virus
KVNSNASLGA

SEQ ID NO: 233839 - protein, 10 aa, Japanese encephalitis virus
VNSSAALGAV

SEQ ID NO: 233840 - protein, 10 aa, Japanese encephalitis virus
NSNASLGAVF

SEQ ID NO: 233841 - protein, 10 aa, Japanese encephalitis virus
SNASLGTVFA

SEQ ID NO: 233842 - protein, 10 aa, Japanese encephalitis virus
NASLGTVFAE

SEQ ID NO: 233843 - protein, 10 aa, Japanese encephalitis virus
ASLGAVFAEQ

SEQ ID NO: 233844 - protein, 10 aa, Japanese encephalitis virus
SLGAVFAEQN

SEQ ID NO: 233845 - protein, 10 aa, Japanese encephalitis virus
QWSTAREAVS

SEQ ID NO: 233846 - protein, 10 aa, Japanese encephalitis virus
WSTAREAVSD

SEQ ID NO: 233847 - protein, 10 aa, Japanese encephalitis virus
STAREAVSDP

SEQ ID NO: 233848 - protein, 10 aa, Japanese encephalitis virus
LWEMVDEERE

SEQ ID NO: 233849 - protein, 10 aa, Japanese encephalitis virus
WEMVDVEREN

SEQ ID NO: 233850 - protein, 10 aa, Japanese encephalitis virus
EMVDVERENH

SEQ ID NO: 233851 - protein, 10 aa, Japanese encephalitis virus
IVDEERENHL

SEQ ID NO: 233852 - protein, 10 aa, Japanese encephalitis virus
VDVERENHLR

SEQ ID NO: 233853 - protein, 10 aa, Japanese encephalitis virus
DVERENHLRG

SEQ ID NO: 233854 - protein, 10 aa, Japanese encephalitis virus
HLRGECHTRI

SEQ ID NO: 233855 - protein, 10 aa, Japanese encephalitis virus
LRGECHTRIY

SEQ ID NO: 233856 - protein, 10 aa, Japanese encephalitis virus
RGECHTCVYH

SEQ ID NO: 233857 - protein, 10 aa, Japanese encephalitis virus
GECHTCVYHM

SEQ ID NO: 233858 - protein, 10 aa, Japanese encephalitis virus
ECHTRIYNMM

SEQ ID NO: 233859 - protein, 10 aa, Japanese encephalitis virus
CHTCVYHMMG

SEQ ID NO: 233860 - protein, 10 aa, Japanese encephalitis virus
HTRIYNMMGK

SEQ ID NO: 233861 - protein, 10 aa, Japanese encephalitis virus
TCVYHMMGKR

SEQ ID NO: 233862 - protein, 10 aa, Japanese encephalitis virus
CVYHMMGKRE

SEQ ID NO: 233863 - protein, 10 aa, Japanese encephalitis virus
VYHMMGKREK

SEQ ID NO: 233864 - protein, 10 aa, Japanese encephalitis virus
EFEALGSLNE

SEQ ID NO: 233865 - protein, 10 aa, Japanese encephalitis virus
FEALGFLNLD

SEQ ID NO: 233866 - protein, 10 aa, Japanese encephalitis virus
EALGSLNEDH

SEQ ID NO: 233867 - protein, 10 aa, Japanese encephalitis virus
ALGFLNLDHW

SEQ ID NO: 233868 - protein, 10 aa, Japanese encephalitis virus
LGFLNLDHWL

SEQ ID NO: 233869 - protein, 10 aa, Japanese encephalitis virus
GFLNENHWLS

SEQ ID NO: 233870 - protein, 10 aa, Japanese encephalitis virus
FLNENHWLSR

SEQ ID NO: 233871 - protein, 10 aa, Japanese encephalitis virus
LNLDHWLSRE

SEQ ID NO: 233872 - protein, 10 aa, Japanese encephalitis virus
NEDHWLSRRN

SEQ ID NO: 233873 - protein, 10 aa, Japanese encephalitis virus
EDHWLSRRNS

SEQ ID NO: 233874 - protein, 10 aa, Japanese encephalitis virus
DHWLSRRNSG

SEQ ID NO: 233875 - protein, 10 aa, Japanese encephalitis virus
HWLSRENSRG

SEQ ID NO: 233876 - protein, 10 aa, Japanese encephalitis virus
WLSRRNSGGG

SEQ ID NO: 233877 - protein, 10 aa, Japanese encephalitis virus
LSRENSGGGE

SEQ ID NO: 233878 - protein, 10 aa, Japanese encephalitis virus
SRENSRGGVE

SEQ ID NO: 233879 - protein, 10 aa, Japanese encephalitis virus
RENSRGGVEG

SEQ ID NO: 233880 - protein, 10 aa, Japanese encephalitis virus
ENSGGGEEGS

SEQ ID NO: 233881 - protein, 10 aa, Japanese encephalitis virus
NSGGGEEGSG

SEQ ID NO: 233882 - protein, 10 aa, Japanese encephalitis virus
SRGGVEGSSV

SEQ ID NO: 233883 - protein, 10 aa, Japanese encephalitis virus
GGGEEGSGVQ

SEQ ID NO: 233884 - protein, 10 aa, Japanese encephalitis virus
GGEEGSGVQK

SEQ ID NO: 233885 - protein, 10 aa, Japanese encephalitis virus
GEEGSGVQKL

SEQ ID NO: 233886 - protein, 10 aa, Japanese encephalitis virus
EEGSGVQKLG

SEQ ID NO: 233887 - protein, 10 aa, Japanese encephalitis virus
EGLGVQKLGY

SEQ ID NO: 233888 - protein, 10 aa, Japanese encephalitis virus
GLGVQKLGYI

SEQ ID NO: 233889 - protein, 10 aa, Japanese encephalitis virus
GVQKLGYISG

SEQ ID NO: 233890 - protein, 10 aa, Japanese encephalitis virus
VQKLGYISGD

SEQ ID NO: 233891 - protein, 10 aa, Japanese encephalitis virus
QKLGYIIRDI

SEQ ID NO: 233892 - protein, 10 aa, Japanese encephalitis virus
KLGYIIRDIA

SEQ ID NO: 233893 - protein, 10 aa, Japanese encephalitis virus
RDIAVKQGGK

SEQ ID NO: 233894 - protein, 10 aa, Japanese encephalitis virus
DIAVKQGGKM

SEQ ID NO: 233895 - protein, 10 aa, Japanese encephalitis virus
IAVKQGGKMY

SEQ ID NO: 233896 - protein, 10 aa, Japanese encephalitis virus
AVKQGGKMYA

SEQ ID NO: 233897 - protein, 10 aa, Japanese encephalitis virus
VKQGGKMYAD

SEQ ID NO: 233898 - protein, 10 aa, Japanese encephalitis virus
KEGGKMYADD

SEQ ID NO: 233899 - protein, 10 aa, Japanese encephalitis virus
QGGKMYADDP

SEQ ID NO: 233900 - protein, 10 aa, Japanese encephalitis virus
GGKMYADDPA

SEQ ID NO: 233901 - protein, 10 aa, Japanese encephalitis virus
PAGWDTRITR

SEQ ID NO: 233902 - protein, 10 aa, Japanese encephalitis virus
AGWDTRITKT

SEQ ID NO: 233903 - protein, 10 aa, Japanese encephalitis virus
GWDTRITKTD

SEQ ID NO: 233904 - protein, 10 aa, Japanese encephalitis virus
WDTRITKTDL

SEQ ID NO: 233905 - protein, 10 aa, Japanese encephalitis virus
DTRITKTDLE

SEQ ID NO: 233906 - protein, 10 aa, Japanese encephalitis virus
TRITKTDLEN

SEQ ID NO: 233907 - protein, 10 aa, Japanese encephalitis virus
RITKTDLENE

SEQ ID NO: 233908 - protein, 10 aa, Japanese encephalitis virus
ITKTDLENEA

SEQ ID NO: 233909 - protein, 10 aa, Japanese encephalitis virus
TKTDLENEAK

SEQ ID NO: 233910 - protein, 10 aa, Japanese encephalitis virus
KTDLENEAKV

SEQ ID NO: 233911 - protein, 10 aa, Japanese encephalitis virus
AIIELTYKHK

SEQ ID NO: 233912 - protein, 10 aa, Japanese encephalitis virus
IIELTYRHQV

SEQ ID NO: 233913 - protein, 10 aa, Japanese encephalitis virus
IELTYKHKVV

SEQ ID NO: 233914 - protein, 10 aa, Japanese encephalitis virus
ELTYKHKVVK

SEQ ID NO: 233915 - protein, 10 aa, Japanese encephalitis virus
LTYRHQVFKV

SEQ ID NO: 233916 - protein, 10 aa, Japanese encephalitis virus
TYRHQVFKVM

SEQ ID NO: 233917 - protein, 10 aa, Japanese encephalitis virus
YKHKVVKVMR

SEQ ID NO: 233918 - protein, 10 aa, Japanese encephalitis virus
RHQVFKVMRP

SEQ ID NO: 233919 - protein, 10 aa, Japanese encephalitis virus
HKVVKVMRPS

SEQ ID NO: 233920 - protein, 10 aa, Japanese encephalitis virus
QVFKVMRPAA

SEQ ID NO: 233921 - protein, 10 aa, Japanese encephalitis virus
KVMRPAAKGK

SEQ ID NO: 233922 - protein, 10 aa, Japanese encephalitis virus
VMRPAAKGKT

SEQ ID NO: 233923 - protein, 10 aa, Japanese encephalitis virus
MRPAAKGKTG

SEQ ID NO: 233924 - protein, 10 aa, Japanese encephalitis virus
RPASGGKTVM

SEQ ID NO: 233925 - protein, 10 aa, Japanese encephalitis virus
KGKTGMAVIS

SEQ ID NO: 233926 - protein, 10 aa, Japanese encephalitis virus
GKTGMAVISR

SEQ ID NO: 233927 - protein, 10 aa, Japanese encephalitis virus
KTGMAVISRE

SEQ ID NO: 233928 - protein, 10 aa, Japanese encephalitis virus
TVMVVYSRED

SEQ ID NO: 233929 - protein, 10 aa, Japanese encephalitis virus
VMVVYSREDQ

SEQ ID NO: 233930 - protein, 10 aa, Japanese encephalitis virus
MVVYSREDQR

SEQ ID NO: 233931 - protein, 10 aa, Japanese encephalitis virus
AVISRENQRG

SEQ ID NO: 233932 - protein, 10 aa, Japanese encephalitis virus
VISRENQRGS

SEQ ID NO: 233933 - protein, 10 aa, Japanese encephalitis virus
YSREDQRGSG

SEQ ID NO: 233934 - protein, 10 aa, Japanese encephalitis virus
NIAVQLVRLV

SEQ ID NO: 233935 - protein, 10 aa, Japanese encephalitis virus
IAVQFVRLMK

SEQ ID NO: 233936 - protein, 10 aa, Japanese encephalitis virus
AVQFVRLMKV

SEQ ID NO: 233937 - protein, 10 aa, Japanese encephalitis virus
VQLVRLVEAE

SEQ ID NO: 233938 - protein, 10 aa, Japanese encephalitis virus
QLVRLVEAEG

SEQ ID NO: 233939 - protein, 10 aa, Japanese encephalitis virus
LVRLVEAEGV

SEQ ID NO: 233940 - protein, 10 aa, Japanese encephalitis virus
VRLMKVEGVI

SEQ ID NO: 233941 - protein, 10 aa, Japanese encephalitis virus
RLMKVEGVIG

SEQ ID NO: 233942 - protein, 10 aa, Japanese encephalitis virus
LMKVEGVIGP

SEQ ID NO: 233943 - protein, 10 aa, Japanese encephalitis virus
VEAEGVIGPQ

SEQ ID NO: 233944 - protein, 10 aa, Japanese encephalitis virus
VEGVIGPQHL

SEQ ID NO: 233945 - protein, 10 aa, Japanese encephalitis virus
GVIGPQHLEH

SEQ ID NO: 233946 - protein, 10 aa, Japanese encephalitis virus
VIGPQHLEHL

SEQ ID NO: 233947 - protein, 10 aa, Japanese encephalitis virus
IGPQHVEQLP

SEQ ID NO: 233948 - protein, 10 aa, Japanese encephalitis virus
GPQHLEQLPK

SEQ ID NO: 233949 - protein, 10 aa, Japanese encephalitis virus
PQHLEHLPRK

SEQ ID NO: 233950 - protein, 10 aa, Japanese encephalitis virus
EHLPRKNKIA

SEQ ID NO: 233951 - protein, 10 aa, Japanese encephalitis virus
HLPRKNKIAV

SEQ ID NO: 233952 - protein, 10 aa, Japanese encephalitis virus
LPKKNKIAVR

SEQ ID NO: 233953 - protein, 10 aa, Japanese encephalitis virus
PRENKIAVRT

SEQ ID NO: 233954 - protein, 10 aa, Japanese encephalitis virus
RENKIAVRTW

SEQ ID NO: 233955 - protein, 10 aa, Japanese encephalitis virus
ENKIAVRTWL

SEQ ID NO: 233956 - protein, 10 aa, Japanese encephalitis virus
LFENGGERVT

SEQ ID NO: 233957 - protein, 10 aa, Japanese encephalitis virus
FENGGERVTR

SEQ ID NO: 233958 - protein, 10 aa, Japanese encephalitis virus
ENGGERVTRM

SEQ ID NO: 233959 - protein, 10 aa, Japanese encephalitis virus
NGGERVTRMA

SEQ ID NO: 233960 - protein, 10 aa, Japanese encephalitis virus
GGERVTRMAI

SEQ ID NO: 233961 - protein, 10 aa, Japanese encephalitis virus
GERVTRMAIS

SEQ ID NO: 233962 - protein, 10 aa, Japanese encephalitis virus
LDDRFATSLH

SEQ ID NO: 233963 - protein, 10 aa, Japanese encephalitis virus
DDRFATSLHF

SEQ ID NO: 233964 - protein, 10 aa, Japanese encephalitis virus
DRFATALYFL

SEQ ID NO: 233965 - protein, 10 aa, Japanese encephalitis virus
RFATSLHFLN

SEQ ID NO: 233966 - protein, 10 aa, Japanese encephalitis virus
FATALYFLNA

SEQ ID NO: 233967 - protein, 10 aa, Japanese encephalitis virus
ATALYFLNAM

SEQ ID NO: 233968 - protein, 10 aa, Japanese encephalitis virus
TSLHFLNAMS

SEQ ID NO: 233969 - protein, 10 aa, Japanese encephalitis virus
SLHFLNAMSK

SEQ ID NO: 233970 - protein, 10 aa, Japanese encephalitis virus
HFLNAMSKVT

SEQ ID NO: 233971 - protein, 10 aa, Japanese encephalitis virus
FLNAMSKVRR

SEQ ID NO: 233972 - protein, 10 aa, Japanese encephalitis virus
LNAMSKVRRD

SEQ ID NO: 233973 - protein, 10 aa, Japanese encephalitis virus
NAMSKVTKDI

SEQ ID NO: 233974 - protein, 10 aa, Japanese encephalitis virus
AMSKVTKDIQ

SEQ ID NO: 233975 - protein, 10 aa, Japanese encephalitis virus
MSKVTKDIQQ

SEQ ID NO: 233976 - protein, 10 aa, Japanese encephalitis virus
SKVTKDIQQW

SEQ ID NO: 233977 - protein, 10 aa, Japanese encephalitis virus
KVRKDILEWK

SEQ ID NO: 233978 - protein, 10 aa, Japanese encephalitis virus
VRKDILEWKP

SEQ ID NO: 233979 - protein, 10 aa, Japanese encephalitis virus
RRDIQEWKPS

SEQ ID NO: 233980 - protein, 10 aa, Japanese encephalitis virus
RDIQEWKPSH

SEQ ID NO: 233981 - protein, 10 aa, Japanese encephalitis virus
DIQQWKPSHG

SEQ ID NO: 233982 - protein, 10 aa, Japanese encephalitis virus
ILEWKPSHGW

SEQ ID NO: 233983 - protein, 10 aa, Japanese encephalitis virus
LEWKPSHGWH

SEQ ID NO: 233984 - protein, 10 aa, Japanese encephalitis virus
QWKPSHGWHD

SEQ ID NO: 233985 - protein, 10 aa, Japanese encephalitis virus
KPSHGWLDWQ

SEQ ID NO: 233986 - protein, 10 aa, Japanese encephalitis virus
PSHGWLDWQQ

SEQ ID NO: 233987 - protein, 10 aa, Japanese encephalitis virus
SHGWHDWLHV

SEQ ID NO: 233988 - protein, 10 aa, Japanese encephalitis virus
HGWLDWQQVP

SEQ ID NO: 233989 - protein, 10 aa, Japanese encephalitis virus
GWLDWQQVPF

SEQ ID NO: 233990 - protein, 10 aa, Japanese encephalitis virus
WLDWQQVPFC

SEQ ID NO: 233991 - protein, 10 aa, Japanese encephalitis virus
LDWQQVPFCS

SEQ ID NO: 233992 - protein, 10 aa, Japanese encephalitis virus
VMKDGRSLLV

SEQ ID NO: 233993 - protein, 10 aa, Japanese encephalitis virus
MKDGRSLLVP

SEQ ID NO: 233994 - protein, 10 aa, Japanese encephalitis virus
KDGRSLLVPC

SEQ ID NO: 233995 - protein, 10 aa, Japanese encephalitis virus
DGRSIVDPCR

SEQ ID NO: 233996 - protein, 10 aa, Japanese encephalitis virus
GRSIVDPCRG

SEQ ID NO: 233997 - protein, 10 aa, Japanese encephalitis virus
RSLLVPCRGQ

SEQ ID NO: 233998 - protein, 10 aa, Japanese encephalitis virus
SLLVPCRGQD

SEQ ID NO: 233999 - protein, 10 aa, Japanese encephalitis virus
LLVPCRGQDE

SEQ ID NO: 234000 - protein, 10 aa, Japanese encephalitis virus
VDPCRGQDEL

SEQ ID NO: 234001 - protein, 10 aa, Japanese encephalitis virus
ISPGAGWNVM

SEQ ID NO: 234002 - protein, 10 aa, Japanese encephalitis virus
SPGAGWNVRD

SEQ ID NO: 234003 - protein, 10 aa, Japanese encephalitis virus
PGAGWNVMDT

SEQ ID NO: 234004 - protein, 10 aa, Japanese encephalitis virus
GAGWNVRDTA

SEQ ID NO: 234005 - protein, 10 aa, Japanese encephalitis virus
AGWNVMDTAC

SEQ ID NO: 234006 - protein, 10 aa, Japanese encephalitis virus
GWNVMDTACL

SEQ ID NO: 234007 - protein, 10 aa, Japanese encephalitis virus
WNVMDTACLA

SEQ ID NO: 234008 - protein, 10 aa, Japanese encephalitis virus
NVMDTACLAK

SEQ ID NO: 234009 - protein, 10 aa, Japanese encephalitis virus
VKDTACLPKA

SEQ ID NO: 234010 - protein, 10 aa, Japanese encephalitis virus
KDTACLPKAY

SEQ ID NO: 234011 - protein, 10 aa, Japanese encephalitis virus
CLPKAYAQMW

SEQ ID NO: 234012 - protein, 10 aa, Japanese encephalitis virus
LPKAYAQMWV

SEQ ID NO: 234013 - protein, 10 aa, Japanese encephalitis virus
PKAYAQMWVL

SEQ ID NO: 234014 - protein, 10 aa, Japanese encephalitis virus
KAYAQMWVLL

SEQ ID NO: 234015 - protein, 10 aa, Japanese encephalitis virus
AYAQMWVLLY

SEQ ID NO: 234016 - protein, 10 aa, Japanese encephalitis virus
YAQMWVLLYF

SEQ ID NO: 234017 - protein, 10 aa, Japanese encephalitis virus
AQMWVLLYFH

SEQ ID NO: 234018 - protein, 10 aa, Japanese encephalitis virus
QMWVLLYFHR

SEQ ID NO: 234019 - protein, 10 aa, Japanese encephalitis virus
MWVLLYFHRR

SEQ ID NO: 234020 - protein, 10 aa, Japanese encephalitis virus
WLLLYFHRRY

SEQ ID NO: 234021 - protein, 10 aa, Japanese encephalitis virus
LLLYFHRRDQ

SEQ ID NO: 234022 - protein, 10 aa, Japanese encephalitis virus
LLYFHRRDQR

SEQ ID NO: 234023 - protein, 10 aa, Japanese encephalitis virus
LYFHRRDLCL

SEQ ID NO: 234024 - protein, 10 aa, Japanese encephalitis virus
YFHRRDQRLM

SEQ ID NO: 234025 - protein, 10 aa, Japanese encephalitis virus
FHRRDLCLMA

SEQ ID NO: 234026 - protein, 10 aa, Japanese encephalitis virus
HRRDLCLMAN

SEQ ID NO: 234027 - protein, 10 aa, Japanese encephalitis virus
RRDQRLMANA

SEQ ID NO: 234028 - protein, 10 aa, Japanese encephalitis virus
RDQRLMANAI

SEQ ID NO: 234029 - protein, 10 aa, Japanese encephalitis virus
DLCLMANAIC

SEQ ID NO: 234030 - protein, 10 aa, Japanese encephalitis virus
QRLMANAICS

SEQ ID NO: 234031 - protein, 10 aa, Japanese encephalitis virus
RLMANAICST

SEQ ID NO: 234032 - protein, 10 aa, Japanese encephalitis virus
ANAICSAVPL

SEQ ID NO: 234033 - protein, 10 aa, Japanese encephalitis virus
NAICSAVPLD

SEQ ID NO: 234034 - protein, 10 aa, Japanese encephalitis virus
AICSAVPVNW

SEQ ID NO: 234035 - protein, 10 aa, Japanese encephalitis virus
ICSAVPLDWV

SEQ ID NO: 234036 - protein, 10 aa, Japanese encephalitis virus
CSAVPLDWVP

SEQ ID NO: 234037 - protein, 10 aa, Japanese encephalitis virus
STVPVDWVPT

SEQ ID NO: 234038 - protein, 10 aa, Japanese encephalitis virus
AVPLDWVPTG

SEQ ID NO: 234039 - protein, 10 aa, Japanese encephalitis virus
VPVNWVPTGR

SEQ ID NO: 234040 - protein, 10 aa, Japanese encephalitis virus
PLDWVPTGRT

SEQ ID NO: 234041 - protein, 10 aa, Japanese encephalitis virus
VNWVPTGRTS

SEQ ID NO: 234042 - protein, 10 aa, Japanese encephalitis virus
WSIHSKGEWI

SEQ ID NO: 234043 - protein, 10 aa, Japanese encephalitis virus
SIHSKGEWIP

SEQ ID NO: 234044 - protein, 10 aa, Japanese encephalitis virus
IHSKGEWIPT

SEQ ID NO: 234045 - protein, 10 aa, Japanese encephalitis virus
SKGEWIPTED

SEQ ID NO: 234046 - protein, 10 aa, Japanese encephalitis virus
KGEWIPTEDM

SEQ ID NO: 234047 - protein, 10 aa, Japanese encephalitis virus
GEWIPTEDML

SEQ ID NO: 234048 - protein, 10 aa, Japanese encephalitis virus
EWIPTEDMLQ

SEQ ID NO: 234049 - protein, 10 aa, Japanese encephalitis virus
WIPTEDMLQV

SEQ ID NO: 234050 - protein, 10 aa, Japanese encephalitis virus
IPTEDMLQVW

SEQ ID NO: 234051 - protein, 10 aa, Japanese encephalitis virus
PTEDMLQVWN

SEQ ID NO: 234052 - protein, 10 aa, Japanese encephalitis virus
VWIEENEWMT

SEQ ID NO: 234053 - protein, 10 aa, Japanese encephalitis virus
WIEENEWMED

SEQ ID NO: 234054 - protein, 10 aa, Japanese encephalitis virus
IEENEWMEDK

SEQ ID NO: 234055 - protein, 10 aa, Japanese encephalitis virus
EENEWMMDMT

SEQ ID NO: 234056 - protein, 10 aa, Japanese encephalitis virus
ENEWMTDKTP

SEQ ID NO: 234057 - protein, 10 aa, Japanese encephalitis virus
DKTPIASWTD

SEQ ID NO: 234058 - protein, 10 aa, Japanese encephalitis virus
MTPITSWTDV

SEQ ID NO: 234059 - protein, 10 aa, Japanese encephalitis virus
TPIASWTDVP

SEQ ID NO: 234060 - protein, 10 aa, Japanese encephalitis virus
PIASWTDVPY

SEQ ID NO: 234061 - protein, 10 aa, Japanese encephalitis virus
IASWTDVPYV

SEQ ID NO: 234062 - protein, 10 aa, Japanese encephalitis virus
WCGSLIGTRA

SEQ ID NO: 234063 - protein, 10 aa, Japanese encephalitis virus
CGSLIGTRSK

SEQ ID NO: 234064 - protein, 10 aa, Japanese encephalitis virus
GSLIGTRSKA

SEQ ID NO: 234065 - protein, 10 aa, Japanese encephalitis virus
SLIGTRSKAT

SEQ ID NO: 234066 - protein, 10 aa, Japanese encephalitis virus
LIGTRSKATW

SEQ ID NO: 234067 - protein, 10 aa, Japanese encephalitis virus
IGTRSKATWA

SEQ ID NO: 234068 - protein, 10 aa, Japanese encephalitis virus
GTRSKATWAE

SEQ ID NO: 234069 - protein, 10 aa, Japanese encephalitis virus
TRSKATWAEN

SEQ ID NO: 234070 - protein, 10 aa, Japanese encephalitis virus
RSKATWAENI

SEQ ID NO: 234071 - protein, 10 aa, Japanese encephalitis virus
SKATWAENIY

SEQ ID NO: 234072 - protein, 10 aa, Japanese encephalitis virus
RATWAENVYA

SEQ ID NO: 234073 - protein, 10 aa, Japanese encephalitis virus
AAINQVRAIL

SEQ ID NO: 234074 - protein, 10 aa, Japanese encephalitis virus
AINQVRAILG

SEQ ID NO: 234075 - protein, 10 aa, Japanese encephalitis virus
INQVRAILGK

SEQ ID NO: 234076 - protein, 10 aa, Japanese encephalitis virus
NQVRAILGKE

SEQ ID NO: 234077 - protein, 10 aa, Japanese encephalitis virus
QVRAILGKEN

SEQ ID NO: 234078 - protein, 10 aa, Japanese encephalitis virus
VRAIIGKEDY

SEQ ID NO: 234079 - protein, 10 aa, Japanese encephalitis virus
RAIIGKEDYV

SEQ ID NO: 234080 - protein, 10 aa, Japanese encephalitis virus
AIIGKEDYVD

SEQ ID NO: 234081 - protein, 10 aa, Japanese encephalitis virus
ILGKENYVDY

SEQ ID NO: 234082 - protein, 10 aa, Japanese encephalitis virus
IGKEDYVDYM

SEQ ID NO: 234083 - protein, 10 aa, Japanese encephalitis virus
GKENYVDYMD

SEQ ID NO: 234084 - protein, 10 aa, Japanese encephalitis virus
KENYVDYMLS

SEQ ID NO: 234085 - protein, 10 aa, Japanese encephalitis virus
ETYVDYMTSL

SEQ ID NO: 234086 - protein, 10 aa, Japanese encephalitis virus
DYVDYMTSLR

SEQ ID NO: 234087 - protein, 10 aa, Japanese encephalitis virus
YVDYMDFPQR

SEQ ID NO: 234088 - protein, 10 aa, Japanese encephalitis virus
VDYMLSLRRY

SEQ ID NO: 234089 - protein, 10 aa, Japanese encephalitis virus
DYMLSLRRYE

SEQ ID NO: 234090 - protein, 10 aa, Japanese encephalitis virus
YMDFPQRIED

SEQ ID NO: 234091 - protein, 10 aa, Japanese encephalitis virus
MDFPQRIEDV

SEQ ID NO: 234092 - protein, 10 aa, Japanese encephalitis virus
LSLRRYEDVL

SEQ ID NO: 234093 - protein, 10 aa, Japanese encephalitis virus
FPQRIEDVLI

SEQ ID NO: 234094 - protein, 10 aa, Japanese encephalitis virus
PQRIEDVLIQ

SEQ ID NO: 234095 - protein, 10 aa, Japanese encephalitis virus
RRYEDVSIQE

SEQ ID NO: 234096 - protein, 10 aa, Japanese encephalitis virus
RYEDVLTQED

SEQ ID NO: 234097 - protein, 10 aa, Japanese encephalitis virus
YEDVSIQEDR

SEQ ID NO: 234098 - protein, 10 aa, Japanese encephalitis virus
EDVLTQEDRV

SEQ ID NO: 234099 - protein, 10 aa, Japanese encephalitis virus
DVLTQEDRVI

SEQ ID NO: 234100 - protein, 10 aa, Japanese encephalitis virus
TKKPGGPGKS

SEQ ID NO: 234101 - protein, 10 aa, Japanese encephalitis virus
KKPGGPGKSR

SEQ ID NO: 234102 - protein, 10 aa, Japanese encephalitis virus
KPRGPGINRA

SEQ ID NO: 234103 - protein, 10 aa, Japanese encephalitis virus
PGGPGKSRAI

SEQ ID NO: 234104 - protein, 10 aa, Japanese encephalitis virus
GGPGKSRAIN

SEQ ID NO: 234105 - protein, 10 aa, Japanese encephalitis virus
GPGKSRAINM

SEQ ID NO: 234106 - protein, 10 aa, Japanese encephalitis virus
PGINRAIYML

SEQ ID NO: 234107 - protein, 10 aa, Japanese encephalitis virus
GINRAIYMLK

SEQ ID NO: 234108 - protein, 10 aa, Japanese encephalitis virus
KSRAINMLKR

SEQ ID NO: 234109 - protein, 10 aa, Japanese encephalitis virus
PLVGVKRVVI

SEQ ID NO: 234110 - protein, 10 aa, Japanese encephalitis virus
LVGVKRVVIS

SEQ ID NO: 234111 - protein, 10 aa, Japanese encephalitis virus
VGVKRVVISL

SEQ ID NO: 234112 - protein, 10 aa, Japanese encephalitis virus
GVKRVVISLL

SEQ ID NO: 234113 - protein, 10 aa, Japanese encephalitis virus
IGPLRFVLAL

SEQ ID NO: 234114 - protein, 10 aa, Japanese encephalitis virus
GPVRFVLAFI

SEQ ID NO: 234115 - protein, 10 aa, Japanese encephalitis virus
PLRFVLALVS

SEQ ID NO: 234116 - protein, 10 aa, Japanese encephalitis virus
VRFVLAFITF

SEQ ID NO: 234117 - protein, 10 aa, Japanese encephalitis virus
RFVLAFITFF

SEQ ID NO: 234118 - protein, 10 aa, Japanese encephalitis virus
FVLAFITFFK

SEQ ID NO: 234119 - protein, 10 aa, Japanese encephalitis virus
VLAFITFFKF

SEQ ID NO: 234120 - protein, 10 aa, Japanese encephalitis virus
LALVSFFKFT

SEQ ID NO: 234121 - protein, 10 aa, Japanese encephalitis virus
ALVSFFKFTA

SEQ ID NO: 234122 - protein, 10 aa, Japanese encephalitis virus
FITFFKFTAL

SEQ ID NO: 234123 - protein, 10 aa, Japanese encephalitis virus
KALLGRWRAL

SEQ ID NO: 234124 - protein, 10 aa, Japanese encephalitis virus
ALLGRWRALE

SEQ ID NO: 234125 - protein, 10 aa, Japanese encephalitis virus
LLGRWRALEK

SEQ ID NO: 234126 - protein, 10 aa, Japanese encephalitis virus
SGRWKAVERS

SEQ ID NO: 234127 - protein, 10 aa, Japanese encephalitis virus
GRWRALEKSV

SEQ ID NO: 234128 - protein, 10 aa, Japanese encephalitis virus
RWRALEKSVA

SEQ ID NO: 234129 - protein, 10 aa, Japanese encephalitis virus
WRALEKSVAM

SEQ ID NO: 234130 - protein, 10 aa, Japanese encephalitis virus
RALEKSVAMK

SEQ ID NO: 234131 - protein, 10 aa, Japanese encephalitis virus
KRELGTLIDV

SEQ ID NO: 234132 - protein, 10 aa, Japanese encephalitis virus
RELGILIDAV

SEQ ID NO: 234133 - protein, 10 aa, Japanese encephalitis virus
ELGILIDAVN

SEQ ID NO: 234134 - protein, 10 aa, Japanese encephalitis virus
LGTLIDVVNK

SEQ ID NO: 234135 - protein, 10 aa, Japanese encephalitis virus
GTLIDTVNKR

SEQ ID NO: 234136 - protein, 10 aa, Japanese encephalitis virus
ILIDAVNKRG

SEQ ID NO: 234137 - protein, 10 aa, Japanese encephalitis virus
LIDGVNKRGR

SEQ ID NO: 234138 - protein, 10 aa, Japanese encephalitis virus
IDGVNKRGRK

SEQ ID NO: 234139 - protein, 10 aa, Japanese encephalitis virus
RKRNKRGGNE

SEQ ID NO: 234140 - protein, 10 aa, Japanese encephalitis virus
KRNKRGGNEG

SEQ ID NO: 234141 - protein, 10 aa, Japanese encephalitis virus
AGAIKLSNFQ

SEQ ID NO: 234142 - protein, 10 aa, Japanese encephalitis virus
GALKLSNFQG

SEQ ID NO: 234143 - protein, 10 aa, Japanese encephalitis virus
ALKLSNFQGK

SEQ ID NO: 234144 - protein, 10 aa, Japanese encephalitis virus
IKLSNFQGKL

SEQ ID NO: 234145 - protein, 10 aa, Japanese encephalitis virus
PGNDPQDVDC

SEQ ID NO: 234146 - protein, 10 aa, Japanese encephalitis virus
CWCDHQEVYV

SEQ ID NO: 234147 - protein, 10 aa, Japanese encephalitis virus
WCDHQEVYVQ

SEQ ID NO: 234148 - protein, 10 aa, Japanese encephalitis virus
CDHQEVYVQY

SEQ ID NO: 234149 - protein, 10 aa, Japanese encephalitis virus
DHQEVYVQYG

SEQ ID NO: 234150 - protein, 10 aa, Japanese encephalitis virus
NQEVYIQYGR

SEQ ID NO: 234151 - protein, 10 aa, Japanese encephalitis virus
IQYGRCTRTR

SEQ ID NO: 234152 - protein, 10 aa, Japanese encephalitis virus
TRTRHSKRSK

SEQ ID NO: 234153 - protein, 10 aa, Japanese encephalitis virus
RTSHSQTSRR

SEQ ID NO: 234154 - protein, 10 aa, Japanese encephalitis virus
TRHSKRSKRS

SEQ ID NO: 234155 - protein, 10 aa, Japanese encephalitis virus
RHSKRSKRSV

SEQ ID NO: 234156 - protein, 10 aa, Japanese encephalitis virus
HSQTSRRSVS

SEQ ID NO: 234157 - protein, 10 aa, Japanese encephalitis virus
SQTSRRSVSV

SEQ ID NO: 234158 - protein, 10 aa, Japanese encephalitis virus
QTSRRSVSVH

SEQ ID NO: 234159 - protein, 10 aa, Japanese encephalitis virus
TSRRSVSVHT

SEQ ID NO: 234160 - protein, 10 aa, Japanese encephalitis virus
SKRSVSVQTH

SEQ ID NO: 234161 - protein, 10 aa, Japanese encephalitis virus
KRSVSVQTHG

SEQ ID NO: 234162 - protein, 10 aa, Japanese encephalitis virus
VQPNGERSLV

SEQ ID NO: 234163 - protein, 10 aa, Japanese encephalitis virus
QPNGERSLVN

SEQ ID NO: 234164 - protein, 10 aa, Japanese encephalitis virus
GESSLVNKKK

SEQ ID NO: 234165 - protein, 10 aa, Japanese encephalitis virus
ESSLVNKKKA

SEQ ID NO: 234166 - protein, 10 aa, Japanese encephalitis virus
RSLVNKKEAW

SEQ ID NO: 234167 - protein, 10 aa, Japanese encephalitis virus
LVNKKEAWLN

SEQ ID NO: 234168 - protein, 10 aa, Japanese encephalitis virus
VNKKKAWLDS

SEQ ID NO: 234169 - protein, 10 aa, Japanese encephalitis virus
KKEAWLNSTK

SEQ ID NO: 234170 - protein, 10 aa, Japanese encephalitis virus
KKAWLDSTRA

SEQ ID NO: 234171 - protein, 10 aa, Japanese encephalitis virus
EAWLDSTRAT

SEQ ID NO: 234172 - protein, 10 aa, Japanese encephalitis virus
NSTKATRYLV

SEQ ID NO: 234173 - protein, 10 aa, Japanese encephalitis virus
STKATRYLVK

SEQ ID NO: 234174 - protein, 10 aa, Japanese encephalitis virus
TKATRYLVKT

SEQ ID NO: 234175 - protein, 10 aa, Japanese encephalitis virus
KATRYLVKTE

SEQ ID NO: 234176 - protein, 10 aa, Japanese encephalitis virus
YLVKTENWIV

SEQ ID NO: 234177 - protein, 10 aa, Japanese encephalitis virus
LVKTENWIVR

SEQ ID NO: 234178 - protein, 10 aa, Japanese encephalitis virus
VKTENWIVRN

SEQ ID NO: 234179 - protein, 10 aa, Japanese encephalitis virus
LGWMLGSTNG

SEQ ID NO: 234180 - protein, 10 aa, Japanese encephalitis virus
GQRVVFTILP

SEQ ID NO: 234181 - protein, 10 aa, Japanese encephalitis virus
QRVVFTILPL

SEQ ID NO: 234182 - protein, 10 aa, Japanese encephalitis virus
GMGNRDFIQG

SEQ ID NO: 234183 - protein, 10 aa, Japanese encephalitis virus
MGNRDFIEGV

SEQ ID NO: 234184 - protein, 10 aa, Japanese encephalitis virus
GNRDFIQGAS

SEQ ID NO: 234185 - protein, 10 aa, Japanese encephalitis virus
NRDFVEGASG

SEQ ID NO: 234186 - protein, 10 aa, Japanese encephalitis virus
RDFIEGVSGA

SEQ ID NO: 234187 - protein, 10 aa, Japanese encephalitis virus
DFVEGASGAT

SEQ ID NO: 234188 - protein, 10 aa, Japanese encephalitis virus
FIQGASGATW

SEQ ID NO: 234189 - protein, 10 aa, Japanese encephalitis virus
VEGASGATWV

SEQ ID NO: 234190 - protein, 10 aa, Japanese encephalitis virus
QGASGATWVD

SEQ ID NO: 234191 - protein, 10 aa, Japanese encephalitis virus
MANDRPTLDV

SEQ ID NO: 234192 - protein, 10 aa, Japanese encephalitis virus
ANDKPTLDRR

SEQ ID NO: 234193 - protein, 10 aa, Japanese encephalitis virus
NDRPTLDVRM

SEQ ID NO: 234194 - protein, 10 aa, Japanese encephalitis virus
DKPTLDRRMI

SEQ ID NO: 234195 - protein, 10 aa, Japanese encephalitis virus
KPTLDRRMIN

SEQ ID NO: 234196 - protein, 10 aa, Japanese encephalitis virus
DVRMTNIEAS

SEQ ID NO: 234197 - protein, 10 aa, Japanese encephalitis virus
RRMINIEASQ

SEQ ID NO: 234198 - protein, 10 aa, Japanese encephalitis virus
TTGEAHNKKR

SEQ ID NO: 234199 - protein, 10 aa, Japanese encephalitis virus
TGEAHNEKQA

SEQ ID NO: 234200 - protein, 10 aa, Japanese encephalitis virus
GEAHNEKQAD

SEQ ID NO: 234201 - protein, 10 aa, Japanese encephalitis virus
EAHNKKRADS

SEQ ID NO: 234202 - protein, 10 aa, Japanese encephalitis virus
AHNKKRADSS

SEQ ID NO: 234203 - protein, 10 aa, Japanese encephalitis virus
HNEKGADSSY

SEQ ID NO: 234204 - protein, 10 aa, Japanese encephalitis virus
NKKRADSSYV

SEQ ID NO: 234205 - protein, 10 aa, Japanese encephalitis virus
EKQADSSYVC

SEQ ID NO: 234206 - protein, 10 aa, Japanese encephalitis virus
DRGWRNGCGL

SEQ ID NO: 234207 - protein, 10 aa, Japanese encephalitis virus
RGWGKGCGLF

SEQ ID NO: 234208 - protein, 10 aa, Japanese encephalitis virus
GWGNGCGLSG

SEQ ID NO: 234209 - protein, 10 aa, Japanese encephalitis virus
WGNGCGLSGK

SEQ ID NO: 234210 - protein, 10 aa, Japanese encephalitis virus
GKGCGLFGKG

SEQ ID NO: 234211 - protein, 10 aa, Japanese encephalitis virus
KGCGLFGKGS

SEQ ID NO: 234212 - protein, 10 aa, Japanese encephalitis virus
AKFSCTNKAI

SEQ ID NO: 234213 - protein, 10 aa, Japanese encephalitis virus
KFSCTNKAIG

SEQ ID NO: 234214 - protein, 10 aa, Japanese encephalitis virus
FSCTNKAIGR

SEQ ID NO: 234215 - protein, 10 aa, Japanese encephalitis virus
IQPENSKYEV

SEQ ID NO: 234216 - protein, 10 aa, Japanese encephalitis virus
QPENSKYEVG

SEQ ID NO: 234217 - protein, 10 aa, Japanese encephalitis virus
SENIKYEVGI

SEQ ID NO: 234218 - protein, 10 aa, Japanese encephalitis virus
YEVGIFVHGA

SEQ ID NO: 234219 - protein, 10 aa, Japanese encephalitis virus
KVGIFVHGAT

SEQ ID NO: 234220 - protein, 10 aa, Japanese encephalitis virus
HGNYSAQVGV

SEQ ID NO: 234221 - protein, 10 aa, Japanese encephalitis virus
GNYSAQVGVS

SEQ ID NO: 234222 - protein, 10 aa, Japanese encephalitis virus
NYSAQVGVSQ

SEQ ID NO: 234223 - protein, 10 aa, Japanese encephalitis virus
YTAQIGASQA

SEQ ID NO: 234224 - protein, 10 aa, Japanese encephalitis virus
TAQIGASQAA

SEQ ID NO: 234225 - protein, 10 aa, Japanese encephalitis virus
AQVGVSQAAK

SEQ ID NO: 234226 - protein, 10 aa, Japanese encephalitis virus
QVGVSQAAKF

SEQ ID NO: 234227 - protein, 10 aa, Japanese encephalitis virus
IGASQAAKFT

SEQ ID NO: 234228 - protein, 10 aa, Japanese encephalitis virus
GASQAARFTV

SEQ ID NO: 234229 - protein, 10 aa, Japanese encephalitis virus
ASQAARFTVT

SEQ ID NO: 234230 - protein, 10 aa, Japanese encephalitis virus
FTVTPNAPST

SEQ ID NO: 234231 - protein, 10 aa, Japanese encephalitis virus
TVTPNAPSVT

SEQ ID NO: 234232 - protein, 10 aa, Japanese encephalitis virus
VTPNAPSVAL

SEQ ID NO: 234233 - protein, 10 aa, Japanese encephalitis virus
TPNAPSVTLE

SEQ ID NO: 234234 - protein, 10 aa, Japanese encephalitis virus
PNAPSVTLEL

SEQ ID NO: 234235 - protein, 10 aa, Japanese encephalitis virus
NAPSVTLKLG

SEQ ID NO: 234236 - protein, 10 aa, Japanese encephalitis virus
APSVTLKLGD

SEQ ID NO: 234237 - protein, 10 aa, Japanese encephalitis virus
TLELGDYGEV

SEQ ID NO: 234238 - protein, 10 aa, Japanese encephalitis virus
YVMTVGSKSL

SEQ ID NO: 234239 - protein, 10 aa, Japanese encephalitis virus
VMTVGSKSLL

SEQ ID NO: 234240 - protein, 10 aa, Japanese encephalitis virus
MTVGSKSLLV

SEQ ID NO: 234241 - protein, 10 aa, Japanese encephalitis virus
TVGSKSLLVH

SEQ ID NO: 234242 - protein, 10 aa, Japanese encephalitis virus
VGSKSLLVHR

SEQ ID NO: 234243 - protein, 10 aa, Japanese encephalitis virus
GSKSLLVHRE

SEQ ID NO: 234244 - protein, 10 aa, Japanese encephalitis virus
PKSFLVHREW

SEQ ID NO: 234245 - protein, 10 aa, Japanese encephalitis virus
FHDLALPWSS

SEQ ID NO: 234246 - protein, 10 aa, Japanese encephalitis virus
HDLALPWTSS

SEQ ID NO: 234247 - protein, 10 aa, Japanese encephalitis virus
DLALPWTSSS

SEQ ID NO: 234248 - protein, 10 aa, Japanese encephalitis virus
LALPWSSPSS

SEQ ID NO: 234249 - protein, 10 aa, Japanese encephalitis virus
ALPWSSPSST

SEQ ID NO: 234250 - protein, 10 aa, Japanese encephalitis virus
LPWSSPSSTA

SEQ ID NO: 234251 - protein, 10 aa, Japanese encephalitis virus
PWSSPSSTAW

SEQ ID NO: 234252 - protein, 10 aa, Japanese encephalitis virus
WSSPSSTAWR

SEQ ID NO: 234253 - protein, 10 aa, Japanese encephalitis virus
TSSSNTAWRN

SEQ ID NO: 234254 - protein, 10 aa, Japanese encephalitis virus
VVALGSQEGS

SEQ ID NO: 234255 - protein, 10 aa, Japanese encephalitis virus
VALGSREGGL

SEQ ID NO: 234256 - protein, 10 aa, Japanese encephalitis virus
ALGSQERALH

SEQ ID NO: 234257 - protein, 10 aa, Japanese encephalitis virus
LGSREGGLHQ

SEQ ID NO: 234258 - protein, 10 aa, Japanese encephalitis virus
GSQEGSLHQA

SEQ ID NO: 234259 - protein, 10 aa, Japanese encephalitis virus
SREGGLHQAL

SEQ ID NO: 234260 - protein, 10 aa, Japanese encephalitis virus
REGGLHQALA

SEQ ID NO: 234261 - protein, 10 aa, Japanese encephalitis virus
ERALHQALAG

SEQ ID NO: 234262 - protein, 10 aa, Japanese encephalitis virus
GSLHQALAGA

SEQ ID NO: 234263 - protein, 10 aa, Japanese encephalitis virus
ALHQALAGAI

SEQ ID NO: 234264 - protein, 10 aa, Japanese encephalitis virus
IVVEYSNSVK

SEQ ID NO: 234265 - protein, 10 aa, Japanese encephalitis virus
VVEYSNSVKL

SEQ ID NO: 234266 - protein, 10 aa, Japanese encephalitis virus
VEYSNSVKLT

SEQ ID NO: 234267 - protein, 10 aa, Japanese encephalitis virus
EYSNSVKLTS

SEQ ID NO: 234268 - protein, 10 aa, Japanese encephalitis virus
YSNSVKLTSG

SEQ ID NO: 234269 - protein, 10 aa, Japanese encephalitis virus
SNSVKLTSGH

SEQ ID NO: 234270 - protein, 10 aa, Japanese encephalitis virus
NSVKLTSGHL

SEQ ID NO: 234271 - protein, 10 aa, Japanese encephalitis virus
KGTTYGVCTE

SEQ ID NO: 234272 - protein, 10 aa, Japanese encephalitis virus
GTTYGMCTEN

SEQ ID NO: 234273 - protein, 10 aa, Japanese encephalitis virus
TTYGVCTEKF

SEQ ID NO: 234274 - protein, 10 aa, Japanese encephalitis virus
TYGVCTEKFS

SEQ ID NO: 234275 - protein, 10 aa, Japanese encephalitis virus
YGVCTEKFSF

SEQ ID NO: 234276 - protein, 10 aa, Japanese encephalitis virus
GMCTENSSFR

SEQ ID NO: 234277 - protein, 10 aa, Japanese encephalitis virus
VCTEKFSFAK

SEQ ID NO: 234278 - protein, 10 aa, Japanese encephalitis virus
CTENSSFRKN

SEQ ID NO: 234279 - protein, 10 aa, Japanese encephalitis virus
TENSSFRKNP

SEQ ID NO: 234280 - protein, 10 aa, Japanese encephalitis virus
KKFSFAKNPA

SEQ ID NO: 234281 - protein, 10 aa, Japanese encephalitis virus
VVIELLYSGS

SEQ ID NO: 234282 - protein, 10 aa, Japanese encephalitis virus
VIELLYSGSD

SEQ ID NO: 234283 - protein, 10 aa, Japanese encephalitis virus
IELSYSGRDG

SEQ ID NO: 234284 - protein, 10 aa, Japanese encephalitis virus
ELSYSGRDGP

SEQ ID NO: 234285 - protein, 10 aa, Japanese encephalitis virus
LSYSGRDGPC

SEQ ID NO: 234286 - protein, 10 aa, Japanese encephalitis virus
SYSGRDGPCK

SEQ ID NO: 234287 - protein, 10 aa, Japanese encephalitis virus
IVSVVSLNDM

SEQ ID NO: 234288 - protein, 10 aa, Japanese encephalitis virus
VSVVSLNDMT

SEQ ID NO: 234289 - protein, 10 aa, Japanese encephalitis virus
SVANLNDMTP

SEQ ID NO: 234290 - protein, 10 aa, Japanese encephalitis virus
VASLNDMTPA

SEQ ID NO: 234291 - protein, 10 aa, Japanese encephalitis virus
ANLNDMTPVG

SEQ ID NO: 234292 - protein, 10 aa, Japanese encephalitis virus
NLNDMTPVGR

SEQ ID NO: 234293 - protein, 10 aa, Japanese encephalitis virus
FVATSSSNSQ

SEQ ID NO: 234294 - protein, 10 aa, Japanese encephalitis virus
VATSSANSKA

SEQ ID NO: 234295 - protein, 10 aa, Japanese encephalitis virus
ATSSSNSQVL

SEQ ID NO: 234296 - protein, 10 aa, Japanese encephalitis virus
SSSNSKVLLE

SEQ ID NO: 234297 - protein, 10 aa, Japanese encephalitis virus
SANSKALVEM

SEQ ID NO: 234298 - protein, 10 aa, Japanese encephalitis virus
SNSQVLVEME

SEQ ID NO: 234299 - protein, 10 aa, Japanese encephalitis virus
NSKALVEMEP

SEQ ID NO: 234300 - protein, 10 aa, Japanese encephalitis virus
SQVLVEMEPP

SEQ ID NO: 234301 - protein, 10 aa, Japanese encephalitis virus
KALVEMEPPF

SEQ ID NO: 234302 - protein, 10 aa, Japanese encephalitis virus
GDSYIVVGRK

SEQ ID NO: 234303 - protein, 10 aa, Japanese encephalitis virus
HHWHKPGSTL

SEQ ID NO: 234304 - protein, 10 aa, Japanese encephalitis virus
HWHKPGSTLG

SEQ ID NO: 234305 - protein, 10 aa, Japanese encephalitis virus
RHKAGSTLGK

SEQ ID NO: 234306 - protein, 10 aa, Japanese encephalitis virus
HKPGSTLGKA

SEQ ID NO: 234307 - protein, 10 aa, Japanese encephalitis virus
AWDFGSIGGI

SEQ ID NO: 234308 - protein, 10 aa, Japanese encephalitis virus
WDFGSIGGIF

SEQ ID NO: 234309 - protein, 10 aa, Japanese encephalitis virus
DFGSIGGAFN

SEQ ID NO: 234310 - protein, 10 aa, Japanese encephalitis virus
FGSIGGIFNS

SEQ ID NO: 234311 - protein, 10 aa, Japanese encephalitis virus
GSIGGIFNSI

SEQ ID NO: 234312 - protein, 10 aa, Japanese encephalitis virus
SIGGAFNSIG

SEQ ID NO: 234313 - protein, 10 aa, Japanese encephalitis virus
IGGIFNSIGK

SEQ ID NO: 234314 - protein, 10 aa, Japanese encephalitis virus
GGIFNSIGKA

SEQ ID NO: 234315 - protein, 10 aa, Japanese encephalitis virus
RVFNSIGKAV

SEQ ID NO: 234316 - protein, 10 aa, Japanese encephalitis virus
AFNSIGKAVH

SEQ ID NO: 234317 - protein, 10 aa, Japanese encephalitis virus
INARDRSIAM

SEQ ID NO: 234318 - protein, 10 aa, Japanese encephalitis virus
HADTGCAIDV

SEQ ID NO: 234319 - protein, 10 aa, Japanese encephalitis virus
ADTGCAIDVT

SEQ ID NO: 234320 - protein, 10 aa, Japanese encephalitis virus
DTGSAIDITR

SEQ ID NO: 234321 - protein, 10 aa, Japanese encephalitis virus
TRNQMRCGSG

SEQ ID NO: 234322 - protein, 10 aa, Japanese encephalitis virus
LAKIVHKAYK

SEQ ID NO: 234323 - protein, 10 aa, Japanese encephalitis virus
AKIVHKAYKE

SEQ ID NO: 234324 - protein, 10 aa, Japanese encephalitis virus
KIVHKAYKEG

SEQ ID NO: 234325 - protein, 10 aa, Japanese encephalitis virus
IVHKAYKEGV

SEQ ID NO: 234326 - protein, 10 aa, Japanese encephalitis virus
VHKAHMEGIC

SEQ ID NO: 234327 - protein, 10 aa, Japanese encephalitis virus
HKAYKEGVCG

SEQ ID NO: 234328 - protein, 10 aa, Japanese encephalitis virus
KAYKEGVCGI

SEQ ID NO: 234329 - protein, 10 aa, Japanese encephalitis virus
AYKEGVCGIR

SEQ ID NO: 234330 - protein, 10 aa, Japanese encephalitis virus
HMEGVCGVRS

SEQ ID NO: 234331 - protein, 10 aa, Japanese encephalitis virus
MEGVCGVRSV

SEQ ID NO: 234332 - protein, 10 aa, Japanese encephalitis virus
STPKRLSMTQ

SEQ ID NO: 234333 - protein, 10 aa, Japanese encephalitis virus
APKRLFMTQE

SEQ ID NO: 234334 - protein, 10 aa, Japanese encephalitis virus
GKSLLFAPEL

SEQ ID NO: 234335 - protein, 10 aa, Japanese encephalitis virus
KSLLFAPELA

SEQ ID NO: 234336 - protein, 10 aa, Japanese encephalitis virus
SMLFAPELAN

SEQ ID NO: 234337 - protein, 10 aa, Japanese encephalitis virus
ILFAPEMANS

SEQ ID NO: 234338 - protein, 10 aa, Japanese encephalitis virus
PETKECPDEQ

SEQ ID NO: 234339 - protein, 10 aa, Japanese encephalitis virus
ETKECPDEQR

SEQ ID NO: 234340 - protein, 10 aa, Japanese encephalitis virus
TKECPDEQRA

SEQ ID NO: 234341 - protein, 10 aa, Japanese encephalitis virus
KECPVVHRAW

SEQ ID NO: 234342 - protein, 10 aa, Japanese encephalitis virus
ECPDEQRAWN

SEQ ID NO: 234343 - protein, 10 aa, Japanese encephalitis virus
CPVVHRAWNS

SEQ ID NO: 234344 - protein, 10 aa, Japanese encephalitis virus
PVVHRAWNSM

SEQ ID NO: 234345 - protein, 10 aa, Japanese encephalitis virus
VVHRAWNSMQ

SEQ ID NO: 234346 - protein, 10 aa, Japanese encephalitis virus
EQRAWNSMQI

SEQ ID NO: 234347 - protein, 10 aa, Japanese encephalitis virus
QRAWNSMQIE

SEQ ID NO: 234348 - protein, 10 aa, Japanese encephalitis virus
EETTDECDGA

SEQ ID NO: 234349 - protein, 10 aa, Japanese encephalitis virus
ETTDECDGAI

SEQ ID NO: 234350 - protein, 10 aa, Japanese encephalitis virus
NTDECDGTII

SEQ ID NO: 234351 - protein, 10 aa, Japanese encephalitis virus
TIIGTAIKGH

SEQ ID NO: 234352 - protein, 10 aa, Japanese encephalitis virus
IGTAVKGHVT

SEQ ID NO: 234353 - protein, 10 aa, Japanese encephalitis virus
GTAVKGHVTV

SEQ ID NO: 234354 - protein, 10 aa, Japanese encephalitis virus
TAVKGHVTVH

SEQ ID NO: 234355 - protein, 10 aa, Japanese encephalitis virus
AIKGHVAVHS

SEQ ID NO: 234356 - protein, 10 aa, Japanese encephalitis virus
IKGHVAVHSD

SEQ ID NO: 234357 - protein, 10 aa, Japanese encephalitis virus
KGHVTVHSDV

SEQ ID NO: 234358 - protein, 10 aa, Japanese encephalitis virus
GHVTVHSDVS

SEQ ID NO: 234359 - protein, 10 aa, Japanese encephalitis virus
HVTVHSDVSY

SEQ ID NO: 234360 - protein, 10 aa, Japanese encephalitis virus
VHSDVSYWIE

SEQ ID NO: 234361 - protein, 10 aa, Japanese encephalitis virus
SDLSYWIGSR

SEQ ID NO: 234362 - protein, 10 aa, Japanese encephalitis virus
SYWIESHLND

SEQ ID NO: 234363 - protein, 10 aa, Japanese encephalitis virus
NDTWKLERLV

SEQ ID NO: 234364 - protein, 10 aa, Japanese encephalitis virus
DTRKLERAVF

SEQ ID NO: 234365 - protein, 10 aa, Japanese encephalitis virus
TWKRERAVFE

SEQ ID NO: 234366 - protein, 10 aa, Japanese encephalitis virus
RKLERAVFGE

SEQ ID NO: 234367 - protein, 10 aa, Japanese encephalitis virus
KRERAVFEEV

SEQ ID NO: 234368 - protein, 10 aa, Japanese encephalitis virus
RERAVFEEVK

SEQ ID NO: 234369 - protein, 10 aa, Japanese encephalitis virus
ERLVFGEVKS

SEQ ID NO: 234370 - protein, 10 aa, Japanese encephalitis virus
RLVFGEVKSC

SEQ ID NO: 234371 - protein, 10 aa, Japanese encephalitis virus
AVFEEVKSCT

SEQ ID NO: 234372 - protein, 10 aa, Japanese encephalitis virus
ETHTLWGDDA

SEQ ID NO: 234373 - protein, 10 aa, Japanese encephalitis virus
THTLWGDDAE

SEQ ID NO: 234374 - protein, 10 aa, Japanese encephalitis virus
HTLWGDDAEE

SEQ ID NO: 234375 - protein, 10 aa, Japanese encephalitis virus
TLWGDDAEES

SEQ ID NO: 234376 - protein, 10 aa, Japanese encephalitis virus
LWGDGVEESD

SEQ ID NO: 234377 - protein, 10 aa, Japanese encephalitis virus
WGDGVEESDL

SEQ ID NO: 234378 - protein, 10 aa, Japanese encephalitis virus
GDGVEESDLV

SEQ ID NO: 234379 - protein, 10 aa, Japanese encephalitis virus
DDAEESELII

SEQ ID NO: 234380 - protein, 10 aa, Japanese encephalitis virus
GVEESDLVIP

SEQ ID NO: 234381 - protein, 10 aa, Japanese encephalitis virus
VEESDLVIPH

SEQ ID NO: 234382 - protein, 10 aa, Japanese encephalitis virus
ESELIIPDTI

SEQ ID NO: 234383 - protein, 10 aa, Japanese encephalitis virus
SELIIPDTIA

SEQ ID NO: 234384 - protein, 10 aa, Japanese encephalitis virus
ELIIPDTIAG

SEQ ID NO: 234385 - protein, 10 aa, Japanese encephalitis virus
LVIPHTIAGP

SEQ ID NO: 234386 - protein, 10 aa, Japanese encephalitis virus
IIPDTIAGPK

SEQ ID NO: 234387 - protein, 10 aa, Japanese encephalitis virus
IPDTIAGPKS

SEQ ID NO: 234388 - protein, 10 aa, Japanese encephalitis virus
PDTIAGPKSK

SEQ ID NO: 234389 - protein, 10 aa, Japanese encephalitis virus
DTIAGPKSKH

SEQ ID NO: 234390 - protein, 10 aa, Japanese encephalitis virus
IAGPKSKHNQ

SEQ ID NO: 234391 - protein, 10 aa, Japanese encephalitis virus
SKHNRREGYM

SEQ ID NO: 234392 - protein, 10 aa, Japanese encephalitis virus
KHNRREGYMT

SEQ ID NO: 234393 - protein, 10 aa, Japanese encephalitis virus
HNRREGYMTQ

SEQ ID NO: 234394 - protein, 10 aa, Japanese encephalitis virus
NRREGYMTQN

SEQ ID NO: 234395 - protein, 10 aa, Japanese encephalitis virus
QREGYKTQNQ

SEQ ID NO: 234396 - protein, 10 aa, Japanese encephalitis virus
TQNQGPWDEK

SEQ ID NO: 234397 - protein, 10 aa, Japanese encephalitis virus
QNQGPWDEDG

SEQ ID NO: 234398 - protein, 10 aa, Japanese encephalitis virus
NQGPWDESGI

SEQ ID NO: 234399 - protein, 10 aa, Japanese encephalitis virus
QGPWDEKGIV

SEQ ID NO: 234400 - protein, 10 aa, Japanese encephalitis virus
GPWDEDGIVL

SEQ ID NO: 234401 - protein, 10 aa, Japanese encephalitis virus
PWDESGIVLD

SEQ ID NO: 234402 - protein, 10 aa, Japanese encephalitis virus
WDEDGIVLDF

SEQ ID NO: 234403 - protein, 10 aa, Japanese encephalitis virus
DESGIVLDFD

SEQ ID NO: 234404 - protein, 10 aa, Japanese encephalitis virus
EDGIVLDFDY

SEQ ID NO: 234405 - protein, 10 aa, Japanese encephalitis virus
DGIVLDFDYC

SEQ ID NO: 234406 - protein, 10 aa, Japanese encephalitis virus
EDCGKRAPWV

SEQ ID NO: 234407 - protein, 10 aa, Japanese encephalitis virus
DCGKRGPSLR

SEQ ID NO: 234408 - protein, 10 aa, Japanese encephalitis virus
CGKRAPWVRT

SEQ ID NO: 234409 - protein, 10 aa, Japanese encephalitis virus
GKRGPSLRTT

SEQ ID NO: 234410 - protein, 10 aa, Japanese encephalitis virus
KRAPWVRTTT

SEQ ID NO: 234411 - protein, 10 aa, Japanese encephalitis virus
RAPWVRTTTD

SEQ ID NO: 234412 - protein, 10 aa, Japanese encephalitis virus
GPSLRTTTDS

SEQ ID NO: 234413 - protein, 10 aa, Japanese encephalitis virus
PSLRTTTDSG

SEQ ID NO: 234414 - protein, 10 aa, Japanese encephalitis virus
WVRTTTDIGK

SEQ ID NO: 234415 - protein, 10 aa, Japanese encephalitis virus
VRTTTDIGKL

SEQ ID NO: 234416 - protein, 10 aa, Japanese encephalitis virus
CRNCSLPPLR

SEQ ID NO: 234417 - protein, 10 aa, Japanese encephalitis virus
RSCTLPPLRF

SEQ ID NO: 234418 - protein, 10 aa, Japanese encephalitis virus
SCTLPPLRFR

SEQ ID NO: 234419 - protein, 10 aa, Japanese encephalitis virus
TLPPLRFRTG

SEQ ID NO: 234420 - protein, 10 aa, Japanese encephalitis virus
LPPLRFRTGS

SEQ ID NO: 234421 - protein, 10 aa, Japanese encephalitis virus
PPLRFRTDNG

SEQ ID NO: 234422 - protein, 10 aa, Japanese encephalitis virus
PLRFRTGSGC

SEQ ID NO: 234423 - protein, 10 aa, Japanese encephalitis virus
LRFRTDNGCW

SEQ ID NO: 234424 - protein, 10 aa, Japanese encephalitis virus
RFRTDNGCWY

SEQ ID NO: 234425 - protein, 10 aa, Japanese encephalitis virus
CWYGMEVRPV

SEQ ID NO: 234426 - protein, 10 aa, Japanese encephalitis virus
HDETTLVRSR

SEQ ID NO: 234427 - protein, 10 aa, Japanese encephalitis virus
DEATLVRSQA

SEQ ID NO: 234428 - protein, 10 aa, Japanese encephalitis virus
GEMVDPFQMG

SEQ ID NO: 234429 - protein, 10 aa, Japanese encephalitis virus
GMVDPFQLGL

SEQ ID NO: 234430 - protein, 10 aa, Japanese encephalitis virus
MFLATQEVLG

SEQ ID NO: 234431 - protein, 10 aa, Japanese encephalitis virus
VAAVFAEANS

SEQ ID NO: 234432 - protein, 10 aa, Japanese encephalitis virus
AAVFAEANSG

SEQ ID NO: 234433 - protein, 10 aa, Japanese encephalitis virus
ASFAEANSGG

SEQ ID NO: 234434 - protein, 10 aa, Japanese encephalitis virus
SFAEANSGGD

SEQ ID NO: 234435 - protein, 10 aa, Japanese encephalitis virus
KIQPAFLAMK

SEQ ID NO: 234436 - protein, 10 aa, Japanese encephalitis virus
IQPAFLVANM

SEQ ID NO: 234437 - protein, 10 aa, Japanese encephalitis virus
QPAFLAMKML

SEQ ID NO: 234438 - protein, 10 aa, Japanese encephalitis virus
PAFLAMKMLS

SEQ ID NO: 234439 - protein, 10 aa, Japanese encephalitis virus
AFLAMKMLST

SEQ ID NO: 234440 - protein, 10 aa, Japanese encephalitis virus
KMLSTRWTNQ

SEQ ID NO: 234441 - protein, 10 aa, Japanese encephalitis virus
TLSTRWTNQE

SEQ ID NO: 234442 - protein, 10 aa, Japanese encephalitis virus
TRWTNQENVI

SEQ ID NO: 234443 - protein, 10 aa, Japanese encephalitis virus
KWTNQENMVL

SEQ ID NO: 234444 - protein, 10 aa, Japanese encephalitis virus
WTNQENMVLV

SEQ ID NO: 234445 - protein, 10 aa, Japanese encephalitis virus
TNQENVILVL

SEQ ID NO: 234446 - protein, 10 aa, Japanese encephalitis virus
NQENMVLVLG

SEQ ID NO: 234447 - protein, 10 aa, Japanese encephalitis virus
QENMVLVLGA

SEQ ID NO: 234448 - protein, 10 aa, Japanese encephalitis virus
ENMVLVLGAA

SEQ ID NO: 234449 - protein, 10 aa, Japanese encephalitis virus
NVILVLGAAF

SEQ ID NO: 234450 - protein, 10 aa, Japanese encephalitis virus
MVLVLGAAFF

SEQ ID NO: 234451 - protein, 10 aa, Japanese encephalitis virus
ILVLGAAFFQ

SEQ ID NO: 234452 - protein, 10 aa, Japanese encephalitis virus
GAAFFQLASM

SEQ ID NO: 234453 - protein, 10 aa, Japanese encephalitis virus
AAFFQLASMD

SEQ ID NO: 234454 - protein, 10 aa, Japanese encephalitis virus
AFFQLASMDL

SEQ ID NO: 234455 - protein, 10 aa, Japanese encephalitis virus
FFQLASMDLQ

SEQ ID NO: 234456 - protein, 10 aa, Japanese encephalitis virus
MDLQIGVHGI

SEQ ID NO: 234457 - protein, 10 aa, Japanese encephalitis virus
KAITFPTTST

SEQ ID NO: 234458 - protein, 10 aa, Japanese encephalitis virus
AITFPTTSTI

SEQ ID NO: 234459 - protein, 10 aa, Japanese encephalitis virus
ITFPTTSTIT

SEQ ID NO: 234460 - protein, 10 aa, Japanese encephalitis virus
TFPTTSTVTM

SEQ ID NO: 234461 - protein, 10 aa, Japanese encephalitis virus
FPTTSTVTMP

SEQ ID NO: 234462 - protein, 10 aa, Japanese encephalitis virus
MPLLALLAPG

SEQ ID NO: 234463 - protein, 10 aa, Japanese encephalitis virus
PVLTLLTPGM

SEQ ID NO: 234464 - protein, 10 aa, Japanese encephalitis virus
LLALLAPGMR

SEQ ID NO: 234465 - protein, 10 aa, Japanese encephalitis virus
LTLLTPGMRA

SEQ ID NO: 234466 - protein, 10 aa, Japanese encephalitis virus
TLLTPGMRAL

SEQ ID NO: 234467 - protein, 10 aa, Japanese encephalitis virus
LLTPGMKALY

SEQ ID NO: 234468 - protein, 10 aa, Japanese encephalitis virus
LTPGMRAFDL

SEQ ID NO: 234469 - protein, 10 aa, Japanese encephalitis virus
APGMRALYLD

SEQ ID NO: 234470 - protein, 10 aa, Japanese encephalitis virus
PGMKALYLDT

SEQ ID NO: 234471 - protein, 10 aa, Japanese encephalitis virus
GMKALYLDTY

SEQ ID NO: 234472 - protein, 10 aa, Japanese encephalitis virus
MKALYLDTYR

SEQ ID NO: 234473 - protein, 10 aa, Japanese encephalitis virus
RALCLDTYRI

SEQ ID NO: 234474 - protein, 10 aa, Japanese encephalitis virus
LLIIGVCSLL

SEQ ID NO: 234475 - protein, 10 aa, Japanese encephalitis virus
LIIGVCSLLQ

SEQ ID NO: 234476 - protein, 10 aa, Japanese encephalitis virus
IIGVCSLLQE

SEQ ID NO: 234477 - protein, 10 aa, Japanese encephalitis virus
IGICSLQQER

SEQ ID NO: 234478 - protein, 10 aa, Japanese encephalitis virus
EREKTMAKKK

SEQ ID NO: 234479 - protein, 10 aa, Japanese encephalitis virus
RRRTMAKKKG

SEQ ID NO: 234480 - protein, 10 aa, Japanese encephalitis virus
EKTMAKKKGA

SEQ ID NO: 234481 - protein, 10 aa, Japanese encephalitis virus
DMWLERAADV

SEQ ID NO: 234482 - protein, 10 aa, Japanese encephalitis virus
MWLEQAADIS

SEQ ID NO: 234483 - protein, 10 aa, Japanese encephalitis virus
WLERAADVSW

SEQ ID NO: 234484 - protein, 10 aa, Japanese encephalitis virus
SWGMDAAITG

SEQ ID NO: 234485 - protein, 10 aa, Japanese encephalitis virus
WGMDAAITGS

SEQ ID NO: 234486 - protein, 10 aa, Japanese encephalitis virus
GMDAAITGSS

SEQ ID NO: 234487 - protein, 10 aa, Japanese encephalitis virus
EDGDFHLIDV

SEQ ID NO: 234488 - protein, 10 aa, Japanese encephalitis virus
DPGVPWKIWL

SEQ ID NO: 234489 - protein, 10 aa, Japanese encephalitis virus
VPWKIWLLRM

SEQ ID NO: 234490 - protein, 10 aa, Japanese encephalitis virus
PWKIWLLRMS

SEQ ID NO: 234491 - protein, 10 aa, Japanese encephalitis virus
WKVWVLRTSC

SEQ ID NO: 234492 - protein, 10 aa, Japanese encephalitis virus
KVWVLRTSCI

SEQ ID NO: 234493 - protein, 10 aa, Japanese encephalitis virus
WVLRMSCSGL

SEQ ID NO: 234494 - protein, 10 aa, Japanese encephalitis virus
LRMSCSGLAA

SEQ ID NO: 234495 - protein, 10 aa, Japanese encephalitis virus
RMSCIGLVAL

SEQ ID NO: 234496 - protein, 10 aa, Japanese encephalitis virus
MSCIGLVALT

SEQ ID NO: 234497 - protein, 10 aa, Japanese encephalitis virus
SCICLAALTP

SEQ ID NO: 234498 - protein, 10 aa, Japanese encephalitis virus
CSGLAALTPW

SEQ ID NO: 234499 - protein, 10 aa, Japanese encephalitis virus
ICLAALTPWA

SEQ ID NO: 234500 - protein, 10 aa, Japanese encephalitis virus
YQSGVGVIYE

SEQ ID NO: 234501 - protein, 10 aa, Japanese encephalitis virus
QSGVGVIYEN

SEQ ID NO: 234502 - protein, 10 aa, Japanese encephalitis virus
AGVGVMYQNV

SEQ ID NO: 234503 - protein, 10 aa, Japanese encephalitis virus
GVGVMYQNVF

SEQ ID NO: 234504 - protein, 10 aa, Japanese encephalitis virus
VGVIYENVFH

SEQ ID NO: 234505 - protein, 10 aa, Japanese encephalitis virus
GVMYENVLHT

SEQ ID NO: 234506 - protein, 10 aa, Japanese encephalitis virus
VMYQNVFHTL

SEQ ID NO: 234507 - protein, 10 aa, Japanese encephalitis virus
IYENVFHTLW

SEQ ID NO: 234508 - protein, 10 aa, Japanese encephalitis virus
YQNVFHTLWH

SEQ ID NO: 234509 - protein, 10 aa, Japanese encephalitis virus
ENVFHTLWHP

SEQ ID NO: 234510 - protein, 10 aa, Japanese encephalitis virus
SVFHTLWHTT

SEQ ID NO: 234511 - protein, 10 aa, Japanese encephalitis virus
WHPTRGAAIM

SEQ ID NO: 234512 - protein, 10 aa, Japanese encephalitis virus
HPTRGAAIMS

SEQ ID NO: 234513 - protein, 10 aa, Japanese encephalitis virus
PTRGAAIMSG

SEQ ID NO: 234514 - protein, 10 aa, Japanese encephalitis virus
TRGAAIMSGK

SEQ ID NO: 234515 - protein, 10 aa, Japanese encephalitis virus
RGAAIMSGGG

SEQ ID NO: 234516 - protein, 10 aa, Japanese encephalitis virus
GAAIMSGKGK

SEQ ID NO: 234517 - protein, 10 aa, Japanese encephalitis virus
AAIMSGGGKL

SEQ ID NO: 234518 - protein, 10 aa, Japanese encephalitis virus
AIMSGGGKLT

SEQ ID NO: 234519 - protein, 10 aa, Japanese encephalitis virus
IMSGKGKLTP

SEQ ID NO: 234520 - protein, 10 aa, Japanese encephalitis virus
MSGKGKLTPY

SEQ ID NO: 234521 - protein, 10 aa, Japanese encephalitis virus
QVIVVEQGKP

SEQ ID NO: 234522 - protein, 10 aa, Japanese encephalitis virus
VIVVEQGKPA

SEQ ID NO: 234523 - protein, 10 aa, Japanese encephalitis virus
NIQTKPGVFC

SEQ ID NO: 234524 - protein, 10 aa, Japanese encephalitis virus
IQTKPGVFCT

SEQ ID NO: 234525 - protein, 10 aa, Japanese encephalitis virus
QTKPGIFPTP

SEQ ID NO: 234526 - protein, 10 aa, Japanese encephalitis virus
TKPGVFCTPF

SEQ ID NO: 234527 - protein, 10 aa, Japanese encephalitis virus
KPGIFPPPFG

SEQ ID NO: 234528 - protein, 10 aa, Japanese encephalitis virus
PFGKVGAVSL

SEQ ID NO: 234529 - protein, 10 aa, Japanese encephalitis virus
FGKVGTVSLD

SEQ ID NO: 234530 - protein, 10 aa, Japanese encephalitis virus
GKVGAVSLDY

SEQ ID NO: 234531 - protein, 10 aa, Japanese encephalitis virus
KVGAVSLDYP

SEQ ID NO: 234532 - protein, 10 aa, Japanese encephalitis virus
YGNGGELGDG

SEQ ID NO: 234533 - protein, 10 aa, Japanese encephalitis virus
GDRQEEPIPE

SEQ ID NO: 234534 - protein, 10 aa, Japanese encephalitis virus
DRQEEPIPEA

SEQ ID NO: 234535 - protein, 10 aa, Japanese encephalitis virus
EPVPEAYTPS

SEQ ID NO: 234536 - protein, 10 aa, Japanese encephalitis virus
PVPEAYTPSM

SEQ ID NO: 234537 - protein, 10 aa, Japanese encephalitis virus
VPEAYTPTML

SEQ ID NO: 234538 - protein, 10 aa, Japanese encephalitis virus
MLKKKQMTVL

SEQ ID NO: 234539 - protein, 10 aa, Japanese encephalitis virus
LKKKQMTVLD

SEQ ID NO: 234540 - protein, 10 aa, Japanese encephalitis virus
KKKQMTVLDL

SEQ ID NO: 234541 - protein, 10 aa, Japanese encephalitis virus
LTVLDLHPGL

SEQ ID NO: 234542 - protein, 10 aa, Japanese encephalitis virus
DLPPGSGKTR

SEQ ID NO: 234543 - protein, 10 aa, Japanese encephalitis virus
LPPGSGKTRK

SEQ ID NO: 234544 - protein, 10 aa, Japanese encephalitis virus
HPGLGKTRKI

SEQ ID NO: 234545 - protein, 10 aa, Japanese encephalitis virus
TRKILPQIIR

SEQ ID NO: 234546 - protein, 10 aa, Japanese encephalitis virus
RKILPQIIRD

SEQ ID NO: 234547 - protein, 10 aa, Japanese encephalitis virus
QIIRDAIQQR

SEQ ID NO: 234548 - protein, 10 aa, Japanese encephalitis virus
IIRDAIQQRL

SEQ ID NO: 234549 - protein, 10 aa, Japanese encephalitis virus
IRDAIQQRLR

SEQ ID NO: 234550 - protein, 10 aa, Japanese encephalitis virus
RDAIQQRLRT

SEQ ID NO: 234551 - protein, 10 aa, Japanese encephalitis virus
HDLQDEVPDR

SEQ ID NO: 234552 - protein, 10 aa, Japanese encephalitis virus
DLQDEIPDWA

SEQ ID NO: 234553 - protein, 10 aa, Japanese encephalitis virus
LQDETPDRAW

SEQ ID NO: 234554 - protein, 10 aa, Japanese encephalitis virus
QDEIPDWAWS

SEQ ID NO: 234555 - protein, 10 aa, Japanese encephalitis virus
DEVPDRAWSS

SEQ ID NO: 234556 - protein, 10 aa, Japanese encephalitis virus
EIPDWAWSSG

SEQ ID NO: 234557 - protein, 10 aa, Japanese encephalitis virus
WITEYSGKTV

SEQ ID NO: 234558 - protein, 10 aa, Japanese encephalitis virus
ITEYSGKTVW

SEQ ID NO: 234559 - protein, 10 aa, Japanese encephalitis virus
KSVKPIILEE

SEQ ID NO: 234560 - protein, 10 aa, Japanese encephalitis virus
SVKPIILEEG

SEQ ID NO: 234561 - protein, 10 aa, Japanese encephalitis virus
VKPIILEEGE

SEQ ID NO: 234562 - protein, 10 aa, Japanese encephalitis virus
KPIILEEGEG

SEQ ID NO: 234563 - protein, 10 aa, Japanese encephalitis virus
YHYGGPTSED

SEQ ID NO: 234564 - protein, 10 aa, Japanese encephalitis virus
HYGGPTSEDD

SEQ ID NO: 234565 - protein, 10 aa, Japanese encephalitis virus
YGGATSEDDG

SEQ ID NO: 234566 - protein, 10 aa, Japanese encephalitis virus
GGATSEDDGN

SEQ ID NO: 234567 - protein, 10 aa, Japanese encephalitis virus
GPTSEDDSNL

SEQ ID NO: 234568 - protein, 10 aa, Japanese encephalitis virus
ATSEGDSNLA

SEQ ID NO: 234569 - protein, 10 aa, Japanese encephalitis virus
EREKAFTMDV

SEQ ID NO: 234570 - protein, 10 aa, Japanese encephalitis virus
REKAFTMDVE

SEQ ID NO: 234571 - protein, 10 aa, Japanese encephalitis virus
EKALTMDGEY

SEQ ID NO: 234572 - protein, 10 aa, Japanese encephalitis virus
KALTMDGEYR

SEQ ID NO: 234573 - protein, 10 aa, Japanese encephalitis virus
ALTMDGEYRL

SEQ ID NO: 234574 - protein, 10 aa, Japanese encephalitis virus
LTMDGEYRLR

SEQ ID NO: 234575 - protein, 10 aa, Japanese encephalitis virus
STEVEIVTRM

SEQ ID NO: 234576 - protein, 10 aa, Japanese encephalitis virus
DFASGKRSAV

SEQ ID NO: 234577 - protein, 10 aa, Japanese encephalitis virus
FASGKRSAVS

SEQ ID NO: 234578 - protein, 10 aa, Japanese encephalitis virus
ASGKRSAVSF

SEQ ID NO: 234579 - protein, 10 aa, Japanese encephalitis virus
AGKRSATSFI

SEQ ID NO: 234580 - protein, 10 aa, Japanese encephalitis virus
KRSATSFIEV

SEQ ID NO: 234581 - protein, 10 aa, Japanese encephalitis virus
RSAVSFIEEP

SEQ ID NO: 234582 - protein, 10 aa, Japanese encephalitis virus
SAVSFIEEPG

SEQ ID NO: 234583 - protein, 10 aa, Japanese encephalitis virus
ATSFIEVLGR

SEQ ID NO: 234584 - protein, 10 aa, Japanese encephalitis virus
VSFIEEPGRM

SEQ ID NO: 234585 - protein, 10 aa, Japanese encephalitis virus
EPGRMPEHFM

SEQ ID NO: 234586 - protein, 10 aa, Japanese encephalitis virus
LGRMPEHFAG

SEQ ID NO: 234587 - protein, 10 aa, Japanese encephalitis virus
VATAEKGGKT

SEQ ID NO: 234588 - protein, 10 aa, Japanese encephalitis virus
ATAEKGGKTH

SEQ ID NO: 234589 - protein, 10 aa, Japanese encephalitis virus
TAEKSGKAHR

SEQ ID NO: 234590 - protein, 10 aa, Japanese encephalitis virus
AEKSGKAHRM

SEQ ID NO: 234591 - protein, 10 aa, Japanese encephalitis virus
EKGGKTHRMA

SEQ ID NO: 234592 - protein, 10 aa, Japanese encephalitis virus
KGGKTHRMAL

SEQ ID NO: 234593 - protein, 10 aa, Japanese encephalitis virus
DALETVTLIV

SEQ ID NO: 234594 - protein, 10 aa, Japanese encephalitis virus
ALETITLIIA

SEQ ID NO: 234595 - protein, 10 aa, Japanese encephalitis virus
LETITLIIAI

SEQ ID NO: 234596 - protein, 10 aa, Japanese encephalitis virus
AITVMTRGFF

SEQ ID NO: 234597 - protein, 10 aa, Japanese encephalitis virus
ITVMTRGFFL

SEQ ID NO: 234598 - protein, 10 aa, Japanese encephalitis virus
TAMTGGFFLL

SEQ ID NO: 234599 - protein, 10 aa, Japanese encephalitis virus
LMMQRKGIEK

SEQ ID NO: 234600 - protein, 10 aa, Japanese encephalitis virus
MKQRKGIGKM

SEQ ID NO: 234601 - protein, 10 aa, Japanese encephalitis virus
KQRKGIGKMG

SEQ ID NO: 234602 - protein, 10 aa, Japanese encephalitis virus
LIPEPEKQRL

SEQ ID NO: 234603 - protein, 10 aa, Japanese encephalitis virus
IPEPEKQKSQ

SEQ ID NO: 234604 - protein, 10 aa, Japanese encephalitis virus
PEPEKQKSQT

SEQ ID NO: 234605 - protein, 10 aa, Japanese encephalitis virus
EPEKQRSQTG

SEQ ID NO: 234606 - protein, 10 aa, Japanese encephalitis virus
PEKQKSQTDN

SEQ ID NO: 234607 - protein, 10 aa, Japanese encephalitis virus
EKQRLQTDNQ

SEQ ID NO: 234608 - protein, 10 aa, Japanese encephalitis virus
KQRSQTGNQL

SEQ ID NO: 234609 - protein, 10 aa, Japanese encephalitis virus
QRLQTDNQLA

SEQ ID NO: 234610 - protein, 10 aa, Japanese encephalitis virus
RLQTDNQLAV

SEQ ID NO: 234611 - protein, 10 aa, Japanese encephalitis virus
TKADIKSMFA

SEQ ID NO: 234612 - protein, 10 aa, Japanese encephalitis virus
KADIKSMFAG

SEQ ID NO: 234613 - protein, 10 aa, Japanese encephalitis virus
ADLKSMFVGK

SEQ ID NO: 234614 - protein, 10 aa, Japanese encephalitis virus
KSMFVGKTQA

SEQ ID NO: 234615 - protein, 10 aa, Japanese encephalitis virus
APVSGMTGLP

SEQ ID NO: 234616 - protein, 10 aa, Japanese encephalitis virus
PVSGMTGLPG

SEQ ID NO: 234617 - protein, 10 aa, Japanese encephalitis virus
ALGLTGLPSM

SEQ ID NO: 234618 - protein, 10 aa, Japanese encephalitis virus
GLTGLPSVAL

SEQ ID NO: 234619 - protein, 10 aa, Japanese encephalitis virus
LTGLPSMTLD

SEQ ID NO: 234620 - protein, 10 aa, Japanese encephalitis virus
TGLPSMTLDL

SEQ ID NO: 234621 - protein, 10 aa, Japanese encephalitis virus
GLPSMTLDLR

SEQ ID NO: 234622 - protein, 10 aa, Japanese encephalitis virus
LPSMTLDLRP

SEQ ID NO: 234623 - protein, 10 aa, Japanese encephalitis virus
PSVALDLRPA

SEQ ID NO: 234624 - protein, 10 aa, Japanese encephalitis virus
SMTLDLRPAT

SEQ ID NO: 234625 - protein, 10 aa, Japanese encephalitis virus
CWGQITLTTV

SEQ ID NO: 234626 - protein, 10 aa, Japanese encephalitis virus
WGQITLTTVL

SEQ ID NO: 234627 - protein, 10 aa, Japanese encephalitis virus
GQITLTTVLT

SEQ ID NO: 234628 - protein, 10 aa, Japanese encephalitis virus
QITLTTVLTA

SEQ ID NO: 234629 - protein, 10 aa, Japanese encephalitis virus
ITLTTSLTAM

SEQ ID NO: 234630 - protein, 10 aa, Japanese encephalitis virus
TLTTVLTAMV

SEQ ID NO: 234631 - protein, 10 aa, Japanese encephalitis virus
LTTVLTAMVL

SEQ ID NO: 234632 - protein, 10 aa, Japanese encephalitis virus
LTAMVLAILH

SEQ ID NO: 234633 - protein, 10 aa, Japanese encephalitis virus
TAVVLTTLHY

SEQ ID NO: 234634 - protein, 10 aa, Japanese encephalitis virus
AMVLAILHYG

SEQ ID NO: 234635 - protein, 10 aa, Japanese encephalitis virus
VLTTLHYGYM

SEQ ID NO: 234636 - protein, 10 aa, Japanese encephalitis virus
LATLHYGFML

SEQ ID NO: 234637 - protein, 10 aa, Japanese encephalitis virus
TTLHYGYMLP

SEQ ID NO: 234638 - protein, 10 aa, Japanese encephalitis virus
AAFLVNPNVS

SEQ ID NO: 234639 - protein, 10 aa, Japanese encephalitis virus
AFLVNPNVST

SEQ ID NO: 234640 - protein, 10 aa, Japanese encephalitis virus
FLVNPNVSTV

SEQ ID NO: 234641 - protein, 10 aa, Japanese encephalitis virus
LVNPKITTVR

SEQ ID NO: 234642 - protein, 10 aa, Japanese encephalitis virus
VNPNVSTVRK

SEQ ID NO: 234643 - protein, 10 aa, Japanese encephalitis virus
NPNVTTVKKP

SEQ ID NO: 234644 - protein, 10 aa, Japanese encephalitis virus
PNVTTVKKPG

SEQ ID NO: 234645 - protein, 10 aa, Japanese encephalitis virus
NVTTVKKPGV

SEQ ID NO: 234646 - protein, 10 aa, Japanese encephalitis virus
ITTVREAGVL

SEQ ID NO: 234647 - protein, 10 aa, Japanese encephalitis virus
KKPGVLVTAA

SEQ ID NO: 234648 - protein, 10 aa, Japanese encephalitis virus
KPGVLVTAAT

SEQ ID NO: 234649 - protein, 10 aa, Japanese encephalitis virus
LIKNADKPSF

SEQ ID NO: 234650 - protein, 10 aa, Japanese encephalitis virus
IKNADNPSLK

SEQ ID NO: 234651 - protein, 10 aa, Japanese encephalitis virus
KNANKPSLKR

SEQ ID NO: 234652 - protein, 10 aa, Japanese encephalitis virus
NADKPSFKKG

SEQ ID NO: 234653 - protein, 10 aa, Japanese encephalitis virus
ANKPSLKRGR

SEQ ID NO: 234654 - protein, 10 aa, Japanese encephalitis virus
KPSFKKGRPG

SEQ ID NO: 234655 - protein, 10 aa, Japanese encephalitis virus
PSLKKGRPGG

SEQ ID NO: 234656 - protein, 10 aa, Japanese encephalitis virus
SLKKGRPGGR

SEQ ID NO: 234657 - protein, 10 aa, Japanese encephalitis virus
FKKGRPGGRT

SEQ ID NO: 234658 - protein, 10 aa, Japanese encephalitis virus
KRGGPGGRTL

SEQ ID NO: 234659 - protein, 10 aa, Japanese encephalitis virus
RGGPGGRTLW

SEQ ID NO: 234660 - protein, 10 aa, Japanese encephalitis virus
GGPGGRTLWE

SEQ ID NO: 234661 - protein, 10 aa, Japanese encephalitis virus
RPGGRTLGDQ

SEQ ID NO: 234662 - protein, 10 aa, Japanese encephalitis virus
PGGRTLGDQW

SEQ ID NO: 234663 - protein, 10 aa, Japanese encephalitis virus
GRTLGDQWKE

SEQ ID NO: 234664 - protein, 10 aa, Japanese encephalitis virus
RTLGDQWKEK

SEQ ID NO: 234665 - protein, 10 aa, Japanese encephalitis virus
TLGDQWKEKL

SEQ ID NO: 234666 - protein, 10 aa, Japanese encephalitis virus
LGDQWKEKLN

SEQ ID NO: 234667 - protein, 10 aa, Japanese encephalitis virus
GEQWKRKLNA

SEQ ID NO: 234668 - protein, 10 aa, Japanese encephalitis virus
EQWKRKLNAM

SEQ ID NO: 234669 - protein, 10 aa, Japanese encephalitis virus
QWKRKLNAMG

SEQ ID NO: 234670 - protein, 10 aa, Japanese encephalitis virus
WKEKLNAMGR

SEQ ID NO: 234671 - protein, 10 aa, Japanese encephalitis virus
KLNALSREEF

SEQ ID NO: 234672 - protein, 10 aa, Japanese encephalitis virus
LNALSREEFF

SEQ ID NO: 234673 - protein, 10 aa, Japanese encephalitis virus
NALSREEFFK

SEQ ID NO: 234674 - protein, 10 aa, Japanese encephalitis virus
AMSREEFFQY

SEQ ID NO: 234675 - protein, 10 aa, Japanese encephalitis virus
MSREEFFQYR

SEQ ID NO: 234676 - protein, 10 aa, Japanese encephalitis virus
SREEFFQYRR

SEQ ID NO: 234677 - protein, 10 aa, Japanese encephalitis virus
EEFFKYRREG

SEQ ID NO: 234678 - protein, 10 aa, Japanese encephalitis virus
ARRARSENNI

SEQ ID NO: 234679 - protein, 10 aa, Japanese encephalitis virus
RRARSENNIV

SEQ ID NO: 234680 - protein, 10 aa, Japanese encephalitis virus
RARSENNIVG

SEQ ID NO: 234681 - protein, 10 aa, Japanese encephalitis virus
ARRENNKVGG

SEQ ID NO: 234682 - protein, 10 aa, Japanese encephalitis virus
RSENNIVGGH

SEQ ID NO: 234683 - protein, 10 aa, Japanese encephalitis virus
RENNKVGGHP

SEQ ID NO: 234684 - protein, 10 aa, Japanese encephalitis virus
VVDLGCGRGG

SEQ ID NO: 234685 - protein, 10 aa, Japanese encephalitis virus
IDLGCGCGGW

SEQ ID NO: 234686 - protein, 10 aa, Japanese encephalitis virus
GCGCGGWSYY

SEQ ID NO: 234687 - protein, 10 aa, Japanese encephalitis virus
CGRGGWSYCA

SEQ ID NO: 234688 - protein, 10 aa, Japanese encephalitis virus
GCGGWSYYAA

SEQ ID NO: 234689 - protein, 10 aa, Japanese encephalitis virus
CGGWSYYAAT

SEQ ID NO: 234690 - protein, 10 aa, Japanese encephalitis virus
WSYYAATLKR

SEQ ID NO: 234691 - protein, 10 aa, Japanese encephalitis virus
SYYAATLKRV

SEQ ID NO: 234692 - protein, 10 aa, Japanese encephalitis virus
ATLKKVQEFR

SEQ ID NO: 234693 - protein, 10 aa, Japanese encephalitis virus
TLKRVQEVRG

SEQ ID NO: 234694 - protein, 10 aa, Japanese encephalitis virus
LKRVQEVRGY

SEQ ID NO: 234695 - protein, 10 aa, Japanese encephalitis virus
KKVQEFRGYT

SEQ ID NO: 234696 - protein, 10 aa, Japanese encephalitis virus
RVQEVRGYTK

SEQ ID NO: 234697 - protein, 10 aa, Japanese encephalitis virus
LKSGVDVFYR

SEQ ID NO: 234698 - protein, 10 aa, Japanese encephalitis virus
MDRAVWRGPK

SEQ ID NO: 234699 - protein, 10 aa, Japanese encephalitis virus
NRTVWRGPKY

SEQ ID NO: 234700 - protein, 10 aa, Japanese encephalitis virus
RTVWRGPKYK

SEQ ID NO: 234701 - protein, 10 aa, Japanese encephalitis virus
TVWRGPRYEE

SEQ ID NO: 234702 - protein, 10 aa, Japanese encephalitis virus
AVGKGEVHST

SEQ ID NO: 234703 - protein, 10 aa, Japanese encephalitis virus
VGKGEVHSTQ

SEQ ID NO: 234704 - protein, 10 aa, Japanese encephalitis virus
QGKIKKRIQK

SEQ ID NO: 234705 - protein, 10 aa, Japanese encephalitis virus
KIRRRIQKLR

SEQ ID NO: 234706 - protein, 10 aa, Japanese encephalitis virus
IKKRIQKQKE

SEQ ID NO: 234707 - protein, 10 aa, Japanese encephalitis virus
KRIQKLREGF

SEQ ID NO: 234708 - protein, 10 aa, Japanese encephalitis virus
RIQKLREEFG

SEQ ID NO: 234709 - protein, 10 aa, Japanese encephalitis virus
IQKLREEFGT

SEQ ID NO: 234710 - protein, 10 aa, Japanese encephalitis virus
QKLREEFGTT

SEQ ID NO: 234711 - protein, 10 aa, Japanese encephalitis virus
KQKEEFATTW

SEQ ID NO: 234712 - protein, 10 aa, Japanese encephalitis virus
QKEEFATTWH

SEQ ID NO: 234713 - protein, 10 aa, Japanese encephalitis virus
REGFATTWHK

SEQ ID NO: 234714 - protein, 10 aa, Japanese encephalitis virus
EEFATTWHRD

SEQ ID NO: 234715 - protein, 10 aa, Japanese encephalitis virus
EFATTWHKDH

SEQ ID NO: 234716 - protein, 10 aa, Japanese encephalitis virus
FATTWHRDPE

SEQ ID NO: 234717 - protein, 10 aa, Japanese encephalitis virus
ATTWHRDPEH

SEQ ID NO: 234718 - protein, 10 aa, Japanese encephalitis virus
HKDHEHPYRT

SEQ ID NO: 234719 - protein, 10 aa, Japanese encephalitis virus
KDHEHPYRTW

SEQ ID NO: 234720 - protein, 10 aa, Japanese encephalitis virus
EEFIKKVNSS

SEQ ID NO: 234721 - protein, 10 aa, Japanese encephalitis virus
EFINKVNSNA

SEQ ID NO: 234722 - protein, 10 aa, Japanese encephalitis virus
KVNSSAALGA

SEQ ID NO: 234723 - protein, 10 aa, Japanese encephalitis virus
VNSNASLGTV

SEQ ID NO: 234724 - protein, 10 aa, Japanese encephalitis virus
NSNASLGTVF

SEQ ID NO: 234725 - protein, 10 aa, Japanese encephalitis virus
SDAALGAVFA

SEQ ID NO: 234726 - protein, 10 aa, Japanese encephalitis virus
NASLGAVFAE

SEQ ID NO: 234727 - protein, 10 aa, Japanese encephalitis virus
QWSTAREAVN

SEQ ID NO: 234728 - protein, 10 aa, Japanese encephalitis virus
WSTAREAVND

SEQ ID NO: 234729 - protein, 10 aa, Japanese encephalitis virus
STAREAVNDP

SEQ ID NO: 234730 - protein, 10 aa, Japanese encephalitis virus
FWEIVDEERE

SEQ ID NO: 234731 - protein, 10 aa, Japanese encephalitis virus
WEIVDEEREN

SEQ ID NO: 234732 - protein, 10 aa, Japanese encephalitis virus
EIVDEERENH

SEQ ID NO: 234733 - protein, 10 aa, Japanese encephalitis virus
MVDVERENHL

SEQ ID NO: 234734 - protein, 10 aa, Japanese encephalitis virus
RGECHTRIYN

SEQ ID NO: 234735 - protein, 10 aa, Japanese encephalitis virus
GECHTRIYNM

SEQ ID NO: 234736 - protein, 10 aa, Japanese encephalitis virus
ECHTCVYHMM

SEQ ID NO: 234737 - protein, 10 aa, Japanese encephalitis virus
CHTRIYNMMG

SEQ ID NO: 234738 - protein, 10 aa, Japanese encephalitis virus
HTCVYHMMGK

SEQ ID NO: 234739 - protein, 10 aa, Japanese encephalitis virus
TRIYNMMGKR

SEQ ID NO: 234740 - protein, 10 aa, Japanese encephalitis virus
RIYNMMGKRE

SEQ ID NO: 234741 - protein, 10 aa, Japanese encephalitis virus
FEALGSLNED

SEQ ID NO: 234742 - protein, 10 aa, Japanese encephalitis virus
EALGFLNENH

SEQ ID NO: 234743 - protein, 10 aa, Japanese encephalitis virus
ALGSLNEDHW

SEQ ID NO: 234744 - protein, 10 aa, Japanese encephalitis virus
LGFLNENHWL

SEQ ID NO: 234745 - protein, 10 aa, Japanese encephalitis virus
GSLNEDHWLS

SEQ ID NO: 234746 - protein, 10 aa, Japanese encephalitis virus
SLNEDHWLSR

SEQ ID NO: 234747 - protein, 10 aa, Japanese encephalitis virus
LNEDHWLSRR

SEQ ID NO: 234748 - protein, 10 aa, Japanese encephalitis virus
NENHWLSREN

SEQ ID NO: 234749 - protein, 10 aa, Japanese encephalitis virus
LDHWLSRENS

SEQ ID NO: 234750 - protein, 10 aa, Japanese encephalitis virus
DHWLSRENSR

SEQ ID NO: 234751 - protein, 10 aa, Japanese encephalitis virus
LSRRNSGGGV

SEQ ID NO: 234752 - protein, 10 aa, Japanese encephalitis virus
SRENSGGGEE

SEQ ID NO: 234753 - protein, 10 aa, Japanese encephalitis virus
RRNSGGGVEG

SEQ ID NO: 234754 - protein, 10 aa, Japanese encephalitis virus
ENSRGGVEGS

SEQ ID NO: 234755 - protein, 10 aa, Japanese encephalitis virus
NSGGGVEGSS

SEQ ID NO: 234756 - protein, 10 aa, Japanese encephalitis virus
SGGGEEGSGV

SEQ ID NO: 234757 - protein, 10 aa, Japanese encephalitis virus
GGGVEGLGVQ

SEQ ID NO: 234758 - protein, 10 aa, Japanese encephalitis virus
GGVEGLGVQK

SEQ ID NO: 234759 - protein, 10 aa, Japanese encephalitis virus
GVEGLGVQKL

SEQ ID NO: 234760 - protein, 10 aa, Japanese encephalitis virus
VEGLGVQKLG

SEQ ID NO: 234761 - protein, 10 aa, Japanese encephalitis virus
GVQKLGYIFR

SEQ ID NO: 234762 - protein, 10 aa, Japanese encephalitis virus
VQKLGYIFRD

SEQ ID NO: 234763 - protein, 10 aa, Japanese encephalitis virus
QKLGYIFRDI

SEQ ID NO: 234764 - protein, 10 aa, Japanese encephalitis virus
KLGYISGDIT

SEQ ID NO: 234765 - protein, 10 aa, Japanese encephalitis virus
GDITSRAIGK

SEQ ID NO: 234766 - protein, 10 aa, Japanese encephalitis virus
DITSRAIGKM

SEQ ID NO: 234767 - protein, 10 aa, Japanese encephalitis virus
IARKEGGKMY

SEQ ID NO: 234768 - protein, 10 aa, Japanese encephalitis virus
TSRAIGKMYA

SEQ ID NO: 234769 - protein, 10 aa, Japanese encephalitis virus
SRAIGKMYAD

SEQ ID NO: 234770 - protein, 10 aa, Japanese encephalitis virus
AIGKMYADDT

SEQ ID NO: 234771 - protein, 10 aa, Japanese encephalitis virus
KVVKVMRPAS

SEQ ID NO: 234772 - protein, 10 aa, Japanese encephalitis virus
KVMRPASGGK

SEQ ID NO: 234773 - protein, 10 aa, Japanese encephalitis virus
VMRPASGGKT

SEQ ID NO: 234774 - protein, 10 aa, Japanese encephalitis virus
MRPASGGKTV

SEQ ID NO: 234775 - protein, 10 aa, Japanese encephalitis virus
RPAAKGKTGM

SEQ ID NO: 234776 - protein, 10 aa, Japanese encephalitis virus
EGKTVMVVYS

SEQ ID NO: 234777 - protein, 10 aa, Japanese encephalitis virus
GPQHLEHLPR

SEQ ID NO: 234778 - protein, 10 aa, Japanese encephalitis virus
PQHLEQLPKK

SEQ ID NO: 234779 - protein, 10 aa, Japanese encephalitis virus
EQLPKKNKIA

SEQ ID NO: 234780 - protein, 10 aa, Japanese encephalitis virus
QLPRENKIAV

SEQ ID NO: 234781 - protein, 10 aa, Japanese encephalitis virus
LPRENKIAVR

SEQ ID NO: 234782 - protein, 10 aa, Japanese encephalitis virus
PKKNKIAVRT

SEQ ID NO: 234783 - protein, 10 aa, Japanese encephalitis virus
KKNKIAVRTW

SEQ ID NO: 234784 - protein, 10 aa, Japanese encephalitis virus
AMSKVRRDIQ

SEQ ID NO: 234785 - protein, 10 aa, Japanese encephalitis virus
MSKVRKDILE

SEQ ID NO: 234786 - protein, 10 aa, Japanese encephalitis virus
SKVRRDIQEW

SEQ ID NO: 234787 - protein, 10 aa, Japanese encephalitis virus
KVTKDIQQWK

SEQ ID NO: 234788 - protein, 10 aa, Japanese encephalitis virus
VTKDIQQWKP

SEQ ID NO: 234789 - protein, 10 aa, Japanese encephalitis virus
RKDILEWKPS

SEQ ID NO: 234790 - protein, 10 aa, Japanese encephalitis virus
KDIQQWKPSH

SEQ ID NO: 234791 - protein, 10 aa, Japanese encephalitis virus
QQWKPSHGWH

SEQ ID NO: 234792 - protein, 10 aa, Japanese encephalitis virus
ISPGAGWNVR

SEQ ID NO: 234793 - protein, 10 aa, Japanese encephalitis virus
SPGAGWNVMD

SEQ ID NO: 234794 - protein, 10 aa, Japanese encephalitis virus
PGAGWNVRDT

SEQ ID NO: 234795 - protein, 10 aa, Japanese encephalitis virus
GAGWNVMDTA

SEQ ID NO: 234796 - protein, 10 aa, Japanese encephalitis virus
AGWNVRDTAC

SEQ ID NO: 234797 - protein, 10 aa, Japanese encephalitis virus
GWNVRDTACL

SEQ ID NO: 234798 - protein, 10 aa, Japanese encephalitis virus
WNVRDTACLA

SEQ ID NO: 234799 - protein, 10 aa, Japanese encephalitis virus
NVRDTACLAK

SEQ ID NO: 234800 - protein, 10 aa, Japanese encephalitis virus
VMDTACLAKA

SEQ ID NO: 234801 - protein, 10 aa, Japanese encephalitis virus
MDTACLAKAY

SEQ ID NO: 234802 - protein, 10 aa, Japanese encephalitis virus
WVLLYFHRRD

SEQ ID NO: 234803 - protein, 10 aa, Japanese encephalitis virus
VLLYFHRRDL

SEQ ID NO: 234804 - protein, 10 aa, Japanese encephalitis virus
LLYFHRRDLC

SEQ ID NO: 234805 - protein, 10 aa, Japanese encephalitis virus
LYFHRRDQRL

SEQ ID NO: 234806 - protein, 10 aa, Japanese encephalitis virus
YFHRRDLCLM

SEQ ID NO: 234807 - protein, 10 aa, Japanese encephalitis virus
FHRRDQRLMA

SEQ ID NO: 234808 - protein, 10 aa, Japanese encephalitis virus
HRRDQRLMAN

SEQ ID NO: 234809 - protein, 10 aa, Japanese encephalitis virus
RRDLCLMANA

SEQ ID NO: 234810 - protein, 10 aa, Japanese encephalitis virus
RDLCLMANAI

SEQ ID NO: 234811 - protein, 10 aa, Japanese encephalitis virus
DQRLMANAIC

SEQ ID NO: 234812 - protein, 10 aa, Japanese encephalitis virus
NAICSTVPVD

SEQ ID NO: 234813 - protein, 10 aa, Japanese encephalitis virus
AICSAVPLDW

SEQ ID NO: 234814 - protein, 10 aa, Japanese encephalitis virus
ICSAVPVNWV

SEQ ID NO: 234815 - protein, 10 aa, Japanese encephalitis virus
CSAVPVNWVP

SEQ ID NO: 234816 - protein, 10 aa, Japanese encephalitis virus
SAVPLDWVPT

SEQ ID NO: 234817 - protein, 10 aa, Japanese encephalitis virus
AVPVNWVPTG

SEQ ID NO: 234818 - protein, 10 aa, Japanese encephalitis virus
VWIEENEWME

SEQ ID NO: 234819 - protein, 10 aa, Japanese encephalitis virus
WIEENEWMTD

SEQ ID NO: 234820 - protein, 10 aa, Japanese encephalitis virus
IEENEWMTDK

SEQ ID NO: 234821 - protein, 10 aa, Japanese encephalitis virus
EENEWMTDKT

SEQ ID NO: 234822 - protein, 10 aa, Japanese encephalitis virus
ENEWMMDMTP

SEQ ID NO: 234823 - protein, 10 aa, Japanese encephalitis virus
DMTPITSWTD

SEQ ID NO: 234824 - protein, 10 aa, Japanese encephalitis virus
KTPIASWTDV

SEQ ID NO: 234825 - protein, 10 aa, Japanese encephalitis virus
WCGNLIGTRS

SEQ ID NO: 234826 - protein, 10 aa, Japanese encephalitis virus
CGNLIGTRSR

SEQ ID NO: 234827 - protein, 10 aa, Japanese encephalitis virus
GNLIGTRSRA

SEQ ID NO: 234828 - protein, 10 aa, Japanese encephalitis virus
NLIGTRSRAT

SEQ ID NO: 234829 - protein, 10 aa, Japanese encephalitis virus
LIGTRARATW

SEQ ID NO: 234830 - protein, 10 aa, Japanese encephalitis virus
IGTRARATWA

SEQ ID NO: 234831 - protein, 10 aa, Japanese encephalitis virus
GTRARATWAE

SEQ ID NO: 234832 - protein, 10 aa, Japanese encephalitis virus
TRARATWAEN

SEQ ID NO: 234833 - protein, 10 aa, Japanese encephalitis virus
RARATWAENI

SEQ ID NO: 234834 - protein, 10 aa, Japanese encephalitis virus
ARATWAENIY

SEQ ID NO: 234835 - protein, 10 aa, Japanese encephalitis virus
QVRAIIGKET

SEQ ID NO: 234836 - protein, 10 aa, Japanese encephalitis virus
VRAIIGKETY

SEQ ID NO: 234837 - protein, 10 aa, Japanese encephalitis virus
RAILGKENYV

SEQ ID NO: 234838 - protein, 10 aa, Japanese encephalitis virus
AIIGKETYVD

SEQ ID NO: 234839 - protein, 10 aa, Japanese encephalitis virus
IIGKEDYVDY

SEQ ID NO: 234840 - protein, 10 aa, Japanese encephalitis virus
LGKENYVDYM

SEQ ID NO: 234841 - protein, 10 aa, Japanese encephalitis virus
GKETYVDYMT

SEQ ID NO: 234842 - protein, 10 aa, Japanese encephalitis virus
KEDYVDYMTS

SEQ ID NO: 234843 - protein, 10 aa, Japanese encephalitis virus
ENYVDYMDFP

SEQ ID NO: 234844 - protein, 10 aa, Japanese encephalitis virus
TYVDYMTSLR

SEQ ID NO: 234845 - protein, 10 aa, Japanese encephalitis virus
DFPQRIEDVL

SEQ ID NO: 234846 - protein, 10 aa, Japanese encephalitis virus
SLRRYEDVSI

SEQ ID NO: 234847 - protein, 10 aa, Japanese encephalitis virus
LRRYEDVLTQ

SEQ ID NO: 234848 - protein, 10 aa, Japanese encephalitis virus
RRYEDVLTQE

SEQ ID NO: 234849 - protein, 10 aa, Japanese encephalitis virus
RYEDVSIQED

SEQ ID NO: 234850 - protein, 10 aa, Japanese encephalitis virus
YEDVLTQEDR

SEQ ID NO: 234851 - protein, 10 aa, Japanese encephalitis virus
EDVSIQEDRV

SEQ ID NO: 234852 - protein, 10 aa, Japanese encephalitis virus
DVSIQEDRVI

SEQ ID NO: 234853 - protein, 10 aa, Japanese encephalitis virus
GPLRFVLALV

SEQ ID NO: 234854 - protein, 10 aa, Japanese encephalitis virus
PVRFVLAFIT

SEQ ID NO: 234855 - protein, 10 aa, Japanese encephalitis virus
LRFVLALVSF

SEQ ID NO: 234856 - protein, 10 aa, Japanese encephalitis virus
LSGRWKAVER

SEQ ID NO: 234857 - protein, 10 aa, Japanese encephalitis virus
LGRWRALEKS

SEQ ID NO: 234858 - protein, 10 aa, Japanese encephalitis virus
KRELGILIDA

SEQ ID NO: 234859 - protein, 10 aa, Japanese encephalitis virus
GELGTLIDGV

SEQ ID NO: 234860 - protein, 10 aa, Japanese encephalitis virus
ELGTLIDGVN

SEQ ID NO: 234861 - protein, 10 aa, Japanese encephalitis virus
LGILIDAVNK

SEQ ID NO: 234862 - protein, 10 aa, Japanese encephalitis virus
GILIDAVNKR

SEQ ID NO: 234863 - protein, 10 aa, Japanese encephalitis virus
TLIDTVNKRG

SEQ ID NO: 234864 - protein, 10 aa, Japanese encephalitis virus
LIDVVNKRGK

SEQ ID NO: 234865 - protein, 10 aa, Japanese encephalitis virus
IDVVNKRGKK

SEQ ID NO: 234866 - protein, 10 aa, Japanese encephalitis virus
KQNKRGGNER

SEQ ID NO: 234867 - protein, 10 aa, Japanese encephalitis virus
VGALKLSNFQ

SEQ ID NO: 234868 - protein, 10 aa, Japanese encephalitis virus
TGNDPEDVDC

SEQ ID NO: 234869 - protein, 10 aa, Japanese encephalitis virus
RSRRSVSVQP

SEQ ID NO: 234870 - protein, 10 aa, Japanese encephalitis virus
SRRSVSVHTH

SEQ ID NO: 234871 - protein, 10 aa, Japanese encephalitis virus
GQRLGFTILL

SEQ ID NO: 234872 - protein, 10 aa, Japanese encephalitis virus
HRVVFTILLL

SEQ ID NO: 234873 - protein, 10 aa, Japanese encephalitis virus
MGNRDFVEGA

SEQ ID NO: 234874 - protein, 10 aa, Japanese encephalitis virus
GNRDFIERAS

SEQ ID NO: 234875 - protein, 10 aa, Japanese encephalitis virus
NRDFIERASG

SEQ ID NO: 234876 - protein, 10 aa, Japanese encephalitis virus
RDFIERASGA

SEQ ID NO: 234877 - protein, 10 aa, Japanese encephalitis virus
DFIEGVSGAT

SEQ ID NO: 234878 - protein, 10 aa, Japanese encephalitis virus
FIEGVSGATW

SEQ ID NO: 234879 - protein, 10 aa, Japanese encephalitis virus
IQGASGATWV

SEQ ID NO: 234880 - protein, 10 aa, Japanese encephalitis virus
TTGEAHNEKQ

SEQ ID NO: 234881 - protein, 10 aa, Japanese encephalitis virus
RGWGNGCGLS

SEQ ID NO: 234882 - protein, 10 aa, Japanese encephalitis virus
GWGKGCGLFG

SEQ ID NO: 234883 - protein, 10 aa, Japanese encephalitis virus
WGKGCGLFGK

SEQ ID NO: 234884 - protein, 10 aa, Japanese encephalitis virus
GNGCGLSGKG

SEQ ID NO: 234885 - protein, 10 aa, Japanese encephalitis virus
KFSCTSKAIE

SEQ ID NO: 234886 - protein, 10 aa, Japanese encephalitis virus
FSCTSKAIER

SEQ ID NO: 234887 - protein, 10 aa, Japanese encephalitis virus
AQIGASQAAK

SEQ ID NO: 234888 - protein, 10 aa, Japanese encephalitis virus
QIGASQAAKF

SEQ ID NO: 234889 - protein, 10 aa, Japanese encephalitis virus
VGVSQAAKFT

SEQ ID NO: 234890 - protein, 10 aa, Japanese encephalitis virus
GVSQAAKFTV

SEQ ID NO: 234891 - protein, 10 aa, Japanese encephalitis virus
VSQAAKFTVT

SEQ ID NO: 234892 - protein, 10 aa, Japanese encephalitis virus
TVTPNAPSVA

SEQ ID NO: 234893 - protein, 10 aa, Japanese encephalitis virus
VTPNAPSVTL

SEQ ID NO: 234894 - protein, 10 aa, Japanese encephalitis virus
TPNAPSVTLK

SEQ ID NO: 234895 - protein, 10 aa, Japanese encephalitis virus
PNAPSVTLKL

SEQ ID NO: 234896 - protein, 10 aa, Japanese encephalitis virus
NAPSVTLELG

SEQ ID NO: 234897 - protein, 10 aa, Japanese encephalitis virus
APSVTLELGD

SEQ ID NO: 234898 - protein, 10 aa, Japanese encephalitis virus
HDLALPWSSP

SEQ ID NO: 234899 - protein, 10 aa, Japanese encephalitis virus
DLALPWSSPS

SEQ ID NO: 234900 - protein, 10 aa, Japanese encephalitis virus
LALPWTSSSN

SEQ ID NO: 234901 - protein, 10 aa, Japanese encephalitis virus
ALPWTSSSNT

SEQ ID NO: 234902 - protein, 10 aa, Japanese encephalitis virus
LGSQERALHQ

SEQ ID NO: 234903 - protein, 10 aa, Japanese encephalitis virus
GSREGGLHQA

SEQ ID NO: 234904 - protein, 10 aa, Japanese encephalitis virus
SQEGSLHQAL

SEQ ID NO: 234905 - protein, 10 aa, Japanese encephalitis virus
QERALHQALA

SEQ ID NO: 234906 - protein, 10 aa, Japanese encephalitis virus
GTTYGVCTEK

SEQ ID NO: 234907 - protein, 10 aa, Japanese encephalitis virus
TTYGMCTENS

SEQ ID NO: 234908 - protein, 10 aa, Japanese encephalitis virus
TYGMCTENSS

SEQ ID NO: 234909 - protein, 10 aa, Japanese encephalitis virus
YGMCTENSSF

SEQ ID NO: 234910 - protein, 10 aa, Japanese encephalitis virus
GVCTEKFSFA

SEQ ID NO: 234911 - protein, 10 aa, Japanese encephalitis virus
MCTENSSFRK

SEQ ID NO: 234912 - protein, 10 aa, Japanese encephalitis virus
ENSSFRKNPA

SEQ ID NO: 234913 - protein, 10 aa, Japanese encephalitis virus
ELLYSGSDGP

SEQ ID NO: 234914 - protein, 10 aa, Japanese encephalitis virus
LLYSGSDGPC

SEQ ID NO: 234915 - protein, 10 aa, Japanese encephalitis virus
SYSGSDGSCK

SEQ ID NO: 234916 - protein, 10 aa, Japanese encephalitis virus
VVSLNDMTPV

SEQ ID NO: 234917 - protein, 10 aa, Japanese encephalitis virus
ASLNDMTPAG

SEQ ID NO: 234918 - protein, 10 aa, Japanese encephalitis virus
VATSSSNSQV

SEQ ID NO: 234919 - protein, 10 aa, Japanese encephalitis virus
ATSSANSKAL

SEQ ID NO: 234920 - protein, 10 aa, Japanese encephalitis virus
SSSNSQVLVE

SEQ ID NO: 234921 - protein, 10 aa, Japanese encephalitis virus
SSNSQVLVEM

SEQ ID NO: 234922 - protein, 10 aa, Japanese encephalitis virus
SNSKVLLEIE

SEQ ID NO: 234923 - protein, 10 aa, Japanese encephalitis virus
GDSYIVVGRE

SEQ ID NO: 234924 - protein, 10 aa, Japanese encephalitis virus
HHRHKAGSTL

SEQ ID NO: 234925 - protein, 10 aa, Japanese encephalitis virus
HWYKAGSTLG

SEQ ID NO: 234926 - protein, 10 aa, Japanese encephalitis virus
WHKPGSTLGK

SEQ ID NO: 234927 - protein, 10 aa, Japanese encephalitis virus
IGGAFNSIGK

SEQ ID NO: 234928 - protein, 10 aa, Japanese encephalitis virus
GRVFNSIGKA

SEQ ID NO: 234929 - protein, 10 aa, Japanese encephalitis virus
GAFNSIGKAV

SEQ ID NO: 234930 - protein, 10 aa, Japanese encephalitis virus
ADTGSAIDIT

SEQ ID NO: 234931 - protein, 10 aa, Japanese encephalitis virus
DTGCAIDVTR

SEQ ID NO: 234932 - protein, 10 aa, Japanese encephalitis virus
IVHKAHMEGV

SEQ ID NO: 234933 - protein, 10 aa, Japanese encephalitis virus
VHKAHMEGVC

SEQ ID NO: 234934 - protein, 10 aa, Japanese encephalitis virus
HKAHMEGICG

SEQ ID NO: 234935 - protein, 10 aa, Japanese encephalitis virus
KAHMEGICGV

SEQ ID NO: 234936 - protein, 10 aa, Japanese encephalitis virus
AHMEGICGVR

SEQ ID NO: 234937 - protein, 10 aa, Japanese encephalitis virus
YKEGVCGIRS

SEQ ID NO: 234938 - protein, 10 aa, Japanese encephalitis virus
KEGVCGIRSV

SEQ ID NO: 234939 - protein, 10 aa, Japanese encephalitis virus
PDERRAWNST

SEQ ID NO: 234940 - protein, 10 aa, Japanese encephalitis virus
DEQRAWNSMQ

SEQ ID NO: 234941 - protein, 10 aa, Japanese encephalitis virus
ERRAWNSTQI

SEQ ID NO: 234942 - protein, 10 aa, Japanese encephalitis virus
EENTDECDGT

SEQ ID NO: 234943 - protein, 10 aa, Japanese encephalitis virus
ENTDECDGTI

SEQ ID NO: 234944 - protein, 10 aa, Japanese encephalitis virus
TTDECDGAII

SEQ ID NO: 234945 - protein, 10 aa, Japanese encephalitis virus
GTAVKGHVAL

SEQ ID NO: 234946 - protein, 10 aa, Japanese encephalitis virus
TAIKGHVAVH

SEQ ID NO: 234947 - protein, 10 aa, Japanese encephalitis virus
AVKGHVTVHS

SEQ ID NO: 234948 - protein, 10 aa, Japanese encephalitis virus
VKGHVTVHSD

SEQ ID NO: 234949 - protein, 10 aa, Japanese encephalitis virus
SYWIGSRYND

SEQ ID NO: 234950 - protein, 10 aa, Japanese encephalitis virus
NDTRKLERAV

SEQ ID NO: 234951 - protein, 10 aa, Japanese encephalitis virus
DSWKLERAVF

SEQ ID NO: 234952 - protein, 10 aa, Japanese encephalitis virus
TRKLERAVFG

SEQ ID NO: 234953 - protein, 10 aa, Japanese encephalitis virus
VIPHTIAGPR

SEQ ID NO: 234954 - protein, 10 aa, Japanese encephalitis virus
NQGPWDEKGI

SEQ ID NO: 234955 - protein, 10 aa, Japanese encephalitis virus
QGPWDENGLV

SEQ ID NO: 234956 - protein, 10 aa, Japanese encephalitis virus
GPWDEKGIVL

SEQ ID NO: 234957 - protein, 10 aa, Japanese encephalitis virus
PWDENGLVPG

SEQ ID NO: 234958 - protein, 10 aa, Japanese encephalitis virus
WDENGLVPGL

SEQ ID NO: 234959 - protein, 10 aa, Japanese encephalitis virus
DEKGIVLDFD

SEQ ID NO: 234960 - protein, 10 aa, Japanese encephalitis virus
ESGIVLDFDY

SEQ ID NO: 234961 - protein, 10 aa, Japanese encephalitis virus
SGIVLDFDYC

SEQ ID NO: 234962 - protein, 10 aa, Japanese encephalitis virus
EDCGKRGPSL

SEQ ID NO: 234963 - protein, 10 aa, Japanese encephalitis virus
DCGKRAPWVR

SEQ ID NO: 234964 - protein, 10 aa, Japanese encephalitis virus
CGKRGPSLRT

SEQ ID NO: 234965 - protein, 10 aa, Japanese encephalitis virus
GKRAPWVRTT

SEQ ID NO: 234966 - protein, 10 aa, Japanese encephalitis virus
DETTLVRWQV

SEQ ID NO: 234967 - protein, 10 aa, Japanese encephalitis virus
AFLVANMLST

SEQ ID NO: 234968 - protein, 10 aa, Japanese encephalitis virus
NTLSTRWTNQ

SEQ ID NO: 234969 - protein, 10 aa, Japanese encephalitis virus
AKWTNQENMV

SEQ ID NO: 234970 - protein, 10 aa, Japanese encephalitis virus
NMVLVLGAAF

SEQ ID NO: 234971 - protein, 10 aa, Japanese encephalitis virus
VILVLGAAFF

SEQ ID NO: 234972 - protein, 10 aa, Japanese encephalitis virus
ITFPTTSTVT

SEQ ID NO: 234973 - protein, 10 aa, Japanese encephalitis virus
TFPTTSTITM

SEQ ID NO: 234974 - protein, 10 aa, Japanese encephalitis virus
FPTTSTITMP

SEQ ID NO: 234975 - protein, 10 aa, Japanese encephalitis virus
VLALLTPGMK

SEQ ID NO: 234976 - protein, 10 aa, Japanese encephalitis virus
ALLTPGMRAF

SEQ ID NO: 234977 - protein, 10 aa, Japanese encephalitis virus
LLTPGMRAFD

SEQ ID NO: 234978 - protein, 10 aa, Japanese encephalitis virus
LAPGMRALYL

SEQ ID NO: 234979 - protein, 10 aa, Japanese encephalitis virus
TPGMRAFDLD

SEQ ID NO: 234980 - protein, 10 aa, Japanese encephalitis virus
LVIGICSLQQ

SEQ ID NO: 234981 - protein, 10 aa, Japanese encephalitis virus
VIGICSLQQE

SEQ ID NO: 234982 - protein, 10 aa, Japanese encephalitis virus
ERRRTMAKKK

SEQ ID NO: 234983 - protein, 10 aa, Japanese encephalitis virus
REKTMAKKKG

SEQ ID NO: 234984 - protein, 10 aa, Japanese encephalitis virus
RRTMAKKKGA

SEQ ID NO: 234985 - protein, 10 aa, Japanese encephalitis virus
SWEMGAAITG

SEQ ID NO: 234986 - protein, 10 aa, Japanese encephalitis virus
WEMGAAITGS

SEQ ID NO: 234987 - protein, 10 aa, Japanese encephalitis virus
EMGAAITGSS

SEQ ID NO: 234988 - protein, 10 aa, Japanese encephalitis virus
KVWVLRMSCS

SEQ ID NO: 234989 - protein, 10 aa, Japanese encephalitis virus
WVLRMSCICL

SEQ ID NO: 234990 - protein, 10 aa, Japanese encephalitis virus
LRMSCICLAA

SEQ ID NO: 234991 - protein, 10 aa, Japanese encephalitis virus
RTSCIGLAAL

SEQ ID NO: 234992 - protein, 10 aa, Japanese encephalitis virus
TSCIGLAALT

SEQ ID NO: 234993 - protein, 10 aa, Japanese encephalitis virus
GVGVIYENVF

SEQ ID NO: 234994 - protein, 10 aa, Japanese encephalitis virus
VGVMYENVLH

SEQ ID NO: 234995 - protein, 10 aa, Japanese encephalitis virus
GVIYENVFHT

SEQ ID NO: 234996 - protein, 10 aa, Japanese encephalitis virus
VIYENVFHTL

SEQ ID NO: 234997 - protein, 10 aa, Japanese encephalitis virus
MYESVFHTLW

SEQ ID NO: 234998 - protein, 10 aa, Japanese encephalitis virus
ESVFHTLWHT

SEQ ID NO: 234999 - protein, 10 aa, Japanese encephalitis virus
TRGAAIMSGG

SEQ ID NO: 235000 - protein, 10 aa, Japanese encephalitis virus
RGAAIMSGKG

SEQ ID NO: 235001 - protein, 10 aa, Japanese encephalitis virus
GAAIMSGGGK

SEQ ID NO: 235002 - protein, 10 aa, Japanese encephalitis virus
AAIMSGKGKL

SEQ ID NO: 235003 - protein, 10 aa, Japanese encephalitis virus
AIMSGKGKLT

SEQ ID NO: 235004 - protein, 10 aa, Japanese encephalitis virus
IMSGGGKLTP

SEQ ID NO: 235005 - protein, 10 aa, Japanese encephalitis virus
QVIVVEPGKV

SEQ ID NO: 235006 - protein, 10 aa, Japanese encephalitis virus
VIVVEPGKVA

SEQ ID NO: 235007 - protein, 10 aa, Japanese encephalitis virus
NFQTKPGVFR

SEQ ID NO: 235008 - protein, 10 aa, Japanese encephalitis virus
IQTKPGIFPT

SEQ ID NO: 235009 - protein, 10 aa, Japanese encephalitis virus
TKPGVFRTPL

SEQ ID NO: 235010 - protein, 10 aa, Japanese encephalitis virus
KPGIFPTPFG

SEQ ID NO: 235011 - protein, 10 aa, Japanese encephalitis virus
PLGEVGAVSL

SEQ ID NO: 235012 - protein, 10 aa, Japanese encephalitis virus
LGEVGAVSLD

SEQ ID NO: 235013 - protein, 10 aa, Japanese encephalitis virus
EPIPEAYNPS

SEQ ID NO: 235014 - protein, 10 aa, Japanese encephalitis virus
PIPEAYNPSM

SEQ ID NO: 235015 - protein, 10 aa, Japanese encephalitis virus
IPEAYNPSML

SEQ ID NO: 235016 - protein, 10 aa, Japanese encephalitis virus
RSATSFIEVL

SEQ ID NO: 235017 - protein, 10 aa, Japanese encephalitis virus
SAISFIEVRG

SEQ ID NO: 235018 - protein, 10 aa, Japanese encephalitis virus
AVSFIEEPGR

SEQ ID NO: 235019 - protein, 10 aa, Japanese encephalitis virus
ISFIEVRGRM

SEQ ID NO: 235020 - protein, 10 aa, Japanese encephalitis virus
DALETITLII

SEQ ID NO: 235021 - protein, 10 aa, Japanese encephalitis virus
ALETVTLIVA

SEQ ID NO: 235022 - protein, 10 aa, Japanese encephalitis virus
LETITLTVAI

SEQ ID NO: 235023 - protein, 10 aa, Japanese encephalitis virus
EPEKQKSQTD

SEQ ID NO: 235024 - protein, 10 aa, Japanese encephalitis virus
PEKQRLQTDN

SEQ ID NO: 235025 - protein, 10 aa, Japanese encephalitis virus
EKQRSQTGNQ

SEQ ID NO: 235026 - protein, 10 aa, Japanese encephalitis virus
ADIKSMFAGK

SEQ ID NO: 235027 - protein, 10 aa, Japanese encephalitis virus
KSMFGGKAPV

SEQ ID NO: 235028 - protein, 10 aa, Japanese encephalitis virus
ASGLTGLPSV

SEQ ID NO: 235029 - protein, 10 aa, Japanese encephalitis virus
ITLTTVLTAM

SEQ ID NO: 235030 - protein, 10 aa, Japanese encephalitis virus
LTAVVLTTLH

SEQ ID NO: 235031 - protein, 10 aa, Japanese encephalitis virus
TAMVLAILHY

SEQ ID NO: 235032 - protein, 10 aa, Japanese encephalitis virus
AVVLTTLHYG

SEQ ID NO: 235033 - protein, 10 aa, Japanese encephalitis virus
VLAILHYGYM

SEQ ID NO: 235034 - protein, 10 aa, Japanese encephalitis virus
LAILHYGYML

SEQ ID NO: 235035 - protein, 10 aa, Japanese encephalitis virus
ATLHYGFMLP

SEQ ID NO: 235036 - protein, 10 aa, Japanese encephalitis virus
KNADKPSFKK

SEQ ID NO: 235037 - protein, 10 aa, Japanese encephalitis virus
NADNPSLKRG

SEQ ID NO: 235038 - protein, 10 aa, Japanese encephalitis virus
ADKPSLKKGR

SEQ ID NO: 235039 - protein, 10 aa, Japanese encephalitis virus
KPSLKKGRPG

SEQ ID NO: 235040 - protein, 10 aa, Japanese encephalitis virus
PSLKRGGPGG

SEQ ID NO: 235041 - protein, 10 aa, Japanese encephalitis virus
SFKKGRPGGR

SEQ ID NO: 235042 - protein, 10 aa, Japanese encephalitis virus
LKKGRPGGRT

SEQ ID NO: 235043 - protein, 10 aa, Japanese encephalitis virus
RTLGEQWKER

SEQ ID NO: 235044 - protein, 10 aa, Japanese encephalitis virus
TLWEQWKEKL

SEQ ID NO: 235045 - protein, 10 aa, Japanese encephalitis virus
LGEQWKERLN

SEQ ID NO: 235046 - protein, 10 aa, Japanese encephalitis virus
WEQWKEKLNA

SEQ ID NO: 235047 - protein, 10 aa, Japanese encephalitis virus
EQWKERLNAM

SEQ ID NO: 235048 - protein, 10 aa, Japanese encephalitis virus
QWKEKLNALS

SEQ ID NO: 235049 - protein, 10 aa, Japanese encephalitis virus
WKEKLNALSR

SEQ ID NO: 235050 - protein, 10 aa, Japanese encephalitis virus
RLNAMSREEF

SEQ ID NO: 235051 - protein, 10 aa, Japanese encephalitis virus
NAMSREEFFQ

SEQ ID NO: 235052 - protein, 10 aa, Japanese encephalitis virus
ALSREEFFKY

SEQ ID NO: 235053 - protein, 10 aa, Japanese encephalitis virus
LSREEFFKYR

SEQ ID NO: 235054 - protein, 10 aa, Japanese encephalitis virus
ARRARRENNK

SEQ ID NO: 235055 - protein, 10 aa, Japanese encephalitis virus
RRARRENNKV

SEQ ID NO: 235056 - protein, 10 aa, Japanese encephalitis virus
QKKIRKRIQK

SEQ ID NO: 235057 - protein, 10 aa, Japanese encephalitis virus
KIKKRIQKQK

SEQ ID NO: 235058 - protein, 10 aa, Japanese encephalitis virus
IRRRIQKLRE

SEQ ID NO: 235059 - protein, 10 aa, Japanese encephalitis virus
KRIQKQKEEF

SEQ ID NO: 235060 - protein, 10 aa, Japanese encephalitis virus
RIQKQKEEFA

SEQ ID NO: 235061 - protein, 10 aa, Japanese encephalitis virus
IQKLREGFAT

SEQ ID NO: 235062 - protein, 10 aa, Japanese encephalitis virus
QKLREGFATT

SEQ ID NO: 235063 - protein, 10 aa, Japanese encephalitis virus
KLREGFATTW

SEQ ID NO: 235064 - protein, 10 aa, Japanese encephalitis virus
LREEFGTTWH

SEQ ID NO: 235065 - protein, 10 aa, Japanese encephalitis virus
KEEFATTWHR

SEQ ID NO: 235066 - protein, 10 aa, Japanese encephalitis virus
EFGTTWHKDP

SEQ ID NO: 235067 - protein, 10 aa, Japanese encephalitis virus
EEFINKVNSN

SEQ ID NO: 235068 - protein, 10 aa, Japanese encephalitis virus
EFIKKVNSDA

SEQ ID NO: 235069 - protein, 10 aa, Japanese encephalitis virus
KVNSDAALGA

SEQ ID NO: 235070 - protein, 10 aa, Japanese encephalitis virus
VNSNASLGAV

SEQ ID NO: 235071 - protein, 10 aa, Japanese encephalitis virus
NSDAALGAVF

SEQ ID NO: 235072 - protein, 10 aa, Japanese encephalitis virus
SNASLGAVFA

SEQ ID NO: 235073 - protein, 10 aa, Japanese encephalitis virus
SAALGAVFAE

SEQ ID NO: 235074 - protein, 10 aa, Japanese encephalitis virus
STAREAVGDS

SEQ ID NO: 235075 - protein, 10 aa, Japanese encephalitis virus
FWEMVDVERE

SEQ ID NO: 235076 - protein, 10 aa, Japanese encephalitis virus
ENSGGGVEGL

SEQ ID NO: 235077 - protein, 10 aa, Japanese encephalitis virus
NSGGGVEGLG

SEQ ID NO: 235078 - protein, 10 aa, Japanese encephalitis virus
SGGGVEGSSV

SEQ ID NO: 235079 - protein, 10 aa, Japanese encephalitis virus
RGGVEGSSVQ

SEQ ID NO: 235080 - protein, 10 aa, Japanese encephalitis virus
GVQKLGYIIR

SEQ ID NO: 235081 - protein, 10 aa, Japanese encephalitis virus
KVMRPSTDGK

SEQ ID NO: 235082 - protein, 10 aa, Japanese encephalitis virus
VMRPSTDGKT

SEQ ID NO: 235083 - protein, 10 aa, Japanese encephalitis virus
MRPSTDGKTV

SEQ ID NO: 235084 - protein, 10 aa, Japanese encephalitis virus
RPSTDGKTVM

SEQ ID NO: 235085 - protein, 10 aa, Japanese encephalitis virus
DGKTVMDVIS

SEQ ID NO: 235086 - protein, 10 aa, Japanese encephalitis virus
PQHVEQLPRK

SEQ ID NO: 235087 - protein, 10 aa, Japanese encephalitis virus
EQLPRENKIA

SEQ ID NO: 235088 - protein, 10 aa, Japanese encephalitis virus
QLPKKNKIAV

SEQ ID NO: 235089 - protein, 10 aa, Japanese encephalitis virus
WNVKDTACLP

SEQ ID NO: 235090 - protein, 10 aa, Japanese encephalitis virus
IEENEWMMDM

SEQ ID NO: 235091 - protein, 10 aa, Japanese encephalitis virus
EENEWMEDKT

SEQ ID NO: 235092 - protein, 10 aa, Japanese encephalitis virus
ENEWMEDKTP

SEQ ID NO: 235093 - protein, 10 aa, Japanese encephalitis virus
CGSLIGTRAR

SEQ ID NO: 235094 - protein, 10 aa, Japanese encephalitis virus
GSLIGTRARA

SEQ ID NO: 235095 - protein, 10 aa, Japanese encephalitis virus
SLIGTRARAT

SEQ ID NO: 235096 - protein, 10 aa, Japanese encephalitis virus
RSRATWAENV

SEQ ID NO: 235097 - protein, 10 aa, Japanese encephalitis virus
SRATWAENVY

SEQ ID NO: 235098 - protein, 10 aa, Japanese encephalitis virus
QVRAIIGKED

SEQ ID NO: 235099 - protein, 10 aa, Japanese encephalitis virus
VRAILGKENY

SEQ ID NO: 235100 - protein, 10 aa, Japanese encephalitis virus
RAIIGKETYV

SEQ ID NO: 235101 - protein, 10 aa, Japanese encephalitis virus
AILGKENYVD

SEQ ID NO: 235102 - protein, 10 aa, Japanese encephalitis virus
IIGKETYVDY

SEQ ID NO: 235103 - protein, 10 aa, Japanese encephalitis virus
GKENYVDYML

SEQ ID NO: 235104 - protein, 10 aa, Japanese encephalitis virus
KETYVDYMTS

SEQ ID NO: 235105 - protein, 10 aa, Japanese encephalitis virus
ENYVDYMLSL

SEQ ID NO: 235106 - protein, 10 aa, Japanese encephalitis virus
NYVDYMDFPQ

SEQ ID NO: 235107 - protein, 10 aa, Japanese encephalitis virus
SLRRYEDVLT

SEQ ID NO: 235108 - protein, 10 aa, Japanese encephalitis virus
LRRYEDVSIQ

SEQ ID NO: 235109 - protein, 10 aa, Japanese encephalitis virus
QRIEDVLIQE

SEQ ID NO: 235110 - protein, 10 aa, Japanese encephalitis virus
RIEDVLIQED

SEQ ID NO: 235111 - protein, 10 aa, Japanese encephalitis virus
IEDVLIQEDR

SEQ ID NO: 235112 - protein, 11 aa, Japanese encephalitis virus
MTKKPGGPGKN

SEQ ID NO: 235113 - protein, 11 aa, Japanese encephalitis virus
TKKPGGPGKNR

SEQ ID NO: 235114 - protein, 11 aa, Japanese encephalitis virus
KKPGGPGKNRA

SEQ ID NO: 235115 - protein, 11 aa, Japanese encephalitis virus
KPGGPGKNRAI

SEQ ID NO: 235116 - protein, 11 aa, Japanese encephalitis virus
PGGPGKNRAIN

SEQ ID NO: 235117 - protein, 11 aa, Japanese encephalitis virus
GGPGKNRAINM

SEQ ID NO: 235118 - protein, 11 aa, Japanese encephalitis virus
GPGKNRAINML

SEQ ID NO: 235119 - protein, 11 aa, Japanese encephalitis virus
PGKNRAINMLK

SEQ ID NO: 235120 - protein, 11 aa, Japanese encephalitis virus
GKNRAINMLKR

SEQ ID NO: 235121 - protein, 11 aa, Japanese encephalitis virus
KNRAINMLKRG

SEQ ID NO: 235122 - protein, 11 aa, Japanese encephalitis virus
NRAINMLKRGL

SEQ ID NO: 235123 - protein, 11 aa, Japanese encephalitis virus
RAINMLKRGLP

SEQ ID NO: 235124 - protein, 11 aa, Japanese encephalitis virus
AINMLKRGLPR

SEQ ID NO: 235125 - protein, 11 aa, Japanese encephalitis virus
INMLKRGLPRV

SEQ ID NO: 235126 - protein, 11 aa, Japanese encephalitis virus
NMLKRGLPRVF

SEQ ID NO: 235127 - protein, 11 aa, Japanese encephalitis virus
MLKRGLPRVFP

SEQ ID NO: 235128 - protein, 11 aa, Japanese encephalitis virus
LKRGLPRVFPL

SEQ ID NO: 235129 - protein, 11 aa, Japanese encephalitis virus
KRGLPRVFPLV

SEQ ID NO: 235130 - protein, 11 aa, Japanese encephalitis virus
RGLPRVFPLVG

SEQ ID NO: 235131 - protein, 11 aa, Japanese encephalitis virus
GLPRVFPLVGV

SEQ ID NO: 235132 - protein, 11 aa, Japanese encephalitis virus
LPRVFPLVGVK

SEQ ID NO: 235133 - protein, 11 aa, Japanese encephalitis virus
PRVFPLVGVKR

SEQ ID NO: 235134 - protein, 11 aa, Japanese encephalitis virus
RVFPLVGVKRV

SEQ ID NO: 235135 - protein, 11 aa, Japanese encephalitis virus
VFPLVGVKRVV

SEQ ID NO: 235136 - protein, 11 aa, Japanese encephalitis virus
FPLVGVKRVVM

SEQ ID NO: 235137 - protein, 11 aa, Japanese encephalitis virus
PLVGVKRVVMS

SEQ ID NO: 235138 - protein, 11 aa, Japanese encephalitis virus
LVGVKRVVMSL

SEQ ID NO: 235139 - protein, 11 aa, Japanese encephalitis virus
VGVKRVVMSLL

SEQ ID NO: 235140 - protein, 11 aa, Japanese encephalitis virus
GVKRVVMSLLD

SEQ ID NO: 235141 - protein, 11 aa, Japanese encephalitis virus
VKRVVMSLLDG

SEQ ID NO: 235142 - protein, 11 aa, Japanese encephalitis virus
KRVVMSLLDGR

SEQ ID NO: 235143 - protein, 11 aa, Japanese encephalitis virus
RVVMSLLDGRG

SEQ ID NO: 235144 - protein, 11 aa, Japanese encephalitis virus
VVMSLLDGRGP

SEQ ID NO: 235145 - protein, 11 aa, Japanese encephalitis virus
VMSLLDGRGPV

SEQ ID NO: 235146 - protein, 11 aa, Japanese encephalitis virus
MSLLDGRGPVR

SEQ ID NO: 235147 - protein, 11 aa, Japanese encephalitis virus
SLLDGRGPVRF

SEQ ID NO: 235148 - protein, 11 aa, Japanese encephalitis virus
LLDGRGPVRFV

SEQ ID NO: 235149 - protein, 11 aa, Japanese encephalitis virus
LDGRGPVRFVL

SEQ ID NO: 235150 - protein, 11 aa, Japanese encephalitis virus
DGRGPVRFVLA

SEQ ID NO: 235151 - protein, 11 aa, Japanese encephalitis virus
GRGPVRFVLAL

SEQ ID NO: 235152 - protein, 11 aa, Japanese encephalitis virus
RGPVRFVLALI

SEQ ID NO: 235153 - protein, 11 aa, Japanese encephalitis virus
GPVRFVLALIT

SEQ ID NO: 235154 - protein, 11 aa, Japanese encephalitis virus
PVRFVLALITF

SEQ ID NO: 235155 - protein, 11 aa, Japanese encephalitis virus
VRFVLALITFF

SEQ ID NO: 235156 - protein, 11 aa, Japanese encephalitis virus
RFVLALITFFK

SEQ ID NO: 235157 - protein, 11 aa, Japanese encephalitis virus
FVLALITFFKF

SEQ ID NO: 235158 - protein, 11 aa, Japanese encephalitis virus
VLALITFFKFT

SEQ ID NO: 235159 - protein, 11 aa, Japanese encephalitis virus
LALITFFKFTA

SEQ ID NO: 235160 - protein, 11 aa, Japanese encephalitis virus
ALITFFKFTAL

SEQ ID NO: 235161 - protein, 11 aa, Japanese encephalitis virus
LITFFKFTALA

SEQ ID NO: 235162 - protein, 11 aa, Japanese encephalitis virus
ITFFKFTALAP

SEQ ID NO: 235163 - protein, 11 aa, Japanese encephalitis virus
TFFKFTALAPT

SEQ ID NO: 235164 - protein, 11 aa, Japanese encephalitis virus
FFKFTALAPTK

SEQ ID NO: 235165 - protein, 11 aa, Japanese encephalitis virus
FKFTALAPTKA

SEQ ID NO: 235166 - protein, 11 aa, Japanese encephalitis virus
KFTALAPTKAL

SEQ ID NO: 235167 - protein, 11 aa, Japanese encephalitis virus
FTALAPTKALL

SEQ ID NO: 235168 - protein, 11 aa, Japanese encephalitis virus
TALAPTKALLG

SEQ ID NO: 235169 - protein, 11 aa, Japanese encephalitis virus
ALAPTKALLGR

SEQ ID NO: 235170 - protein, 11 aa, Japanese encephalitis virus
LAPTKALLGRW

SEQ ID NO: 235171 - protein, 11 aa, Japanese encephalitis virus
APTKALLGRWK

SEQ ID NO: 235172 - protein, 11 aa, Japanese encephalitis virus
PTKALLGRWKA

SEQ ID NO: 235173 - protein, 11 aa, Japanese encephalitis virus
TKALLGRWKAV

SEQ ID NO: 235174 - protein, 11 aa, Japanese encephalitis virus
KALLGRWKAVE

SEQ ID NO: 235175 - protein, 11 aa, Japanese encephalitis virus
ALLGRWKAVEK

SEQ ID NO: 235176 - protein, 11 aa, Japanese encephalitis virus
LLGRWKAVEKS

SEQ ID NO: 235177 - protein, 11 aa, Japanese encephalitis virus
LGRWKAVEKSV

SEQ ID NO: 235178 - protein, 11 aa, Japanese encephalitis virus
GRWKAVEKSVA

SEQ ID NO: 235179 - protein, 11 aa, Japanese encephalitis virus
RWKAVEKSVAM

SEQ ID NO: 235180 - protein, 11 aa, Japanese encephalitis virus
WKAVEKSVAMK

SEQ ID NO: 235181 - protein, 11 aa, Japanese encephalitis virus
KAVEKSVAMKH

SEQ ID NO: 235182 - protein, 11 aa, Japanese encephalitis virus
AVEKSVAMKHL

SEQ ID NO: 235183 - protein, 11 aa, Japanese encephalitis virus
VEKSVAMKHLT

SEQ ID NO: 235184 - protein, 11 aa, Japanese encephalitis virus
EKSVAMKHLTS

SEQ ID NO: 235185 - protein, 11 aa, Japanese encephalitis virus
KSVAMKHLTSF

SEQ ID NO: 235186 - protein, 11 aa, Japanese encephalitis virus
SVAMKHLTSFK

SEQ ID NO: 235187 - protein, 11 aa, Japanese encephalitis virus
VAMKHLTSFKR

SEQ ID NO: 235188 - protein, 11 aa, Japanese encephalitis virus
AMKHLTSFKRE

SEQ ID NO: 235189 - protein, 11 aa, Japanese encephalitis virus
MKHLTSFKREL

SEQ ID NO: 235190 - protein, 11 aa, Japanese encephalitis virus
KHLTSFKRELG

SEQ ID NO: 235191 - protein, 11 aa, Japanese encephalitis virus
HLTSFKRELGT

SEQ ID NO: 235192 - protein, 11 aa, Japanese encephalitis virus
LTSFKRELGTL

SEQ ID NO: 235193 - protein, 11 aa, Japanese encephalitis virus
TSFKRELGTLI

SEQ ID NO: 235194 - protein, 11 aa, Japanese encephalitis virus
SFKRELGTLID

SEQ ID NO: 235195 - protein, 11 aa, Japanese encephalitis virus
FKRELGTLIDA

SEQ ID NO: 235196 - protein, 11 aa, Japanese encephalitis virus
KRELGTLIDAV

SEQ ID NO: 235197 - protein, 11 aa, Japanese encephalitis virus
RELGTLIDAVN

SEQ ID NO: 235198 - protein, 11 aa, Japanese encephalitis virus
ELGTLIDAVNK

SEQ ID NO: 235199 - protein, 11 aa, Japanese encephalitis virus
LGTLIDAVNKR

SEQ ID NO: 235200 - protein, 11 aa, Japanese encephalitis virus
GTLIDAVNKRG

SEQ ID NO: 235201 - protein, 11 aa, Japanese encephalitis virus
LIDAVNKRGRK

SEQ ID NO: 235202 - protein, 11 aa, Japanese encephalitis virus
VNKRGRKQNKR

SEQ ID NO: 235203 - protein, 11 aa, Japanese encephalitis virus
NKRGRKQNKRG

SEQ ID NO: 235204 - protein, 11 aa, Japanese encephalitis virus
KRGRKQNKRGG

SEQ ID NO: 235205 - protein, 11 aa, Japanese encephalitis virus
RGRKQNKRGGN

SEQ ID NO: 235206 - protein, 11 aa, Japanese encephalitis virus
GRKQNKRGGNE

SEQ ID NO: 235207 - protein, 11 aa, Japanese encephalitis virus
AGAMKLSNFQG

SEQ ID NO: 235208 - protein, 11 aa, Japanese encephalitis virus
GAMKLSNFQGK

SEQ ID NO: 235209 - protein, 11 aa, Japanese encephalitis virus
AMKLSNFQGKL

SEQ ID NO: 235210 - protein, 11 aa, Japanese encephalitis virus
MKLSNFQGKLL

SEQ ID NO: 235211 - protein, 11 aa, Japanese encephalitis virus
KLSNFQGKLLM

SEQ ID NO: 235212 - protein, 11 aa, Japanese encephalitis virus
LSNFQGKLLMT

SEQ ID NO: 235213 - protein, 11 aa, Japanese encephalitis virus
SNFQGKLLMTI

SEQ ID NO: 235214 - protein, 11 aa, Japanese encephalitis virus
NFQGKLLMTIN

SEQ ID NO: 235215 - protein, 11 aa, Japanese encephalitis virus
FQGKLLMTINN

SEQ ID NO: 235216 - protein, 11 aa, Japanese encephalitis virus
QGKLLMTINNT

SEQ ID NO: 235217 - protein, 11 aa, Japanese encephalitis virus
GKLLMTINNTD

SEQ ID NO: 235218 - protein, 11 aa, Japanese encephalitis virus
KLLMTINNTDI

SEQ ID NO: 235219 - protein, 11 aa, Japanese encephalitis virus
LLMTINNTDIA

SEQ ID NO: 235220 - protein, 11 aa, Japanese encephalitis virus
LMTINNTDIAD

SEQ ID NO: 235221 - protein, 11 aa, Japanese encephalitis virus
MTINNTDIADV

SEQ ID NO: 235222 - protein, 11 aa, Japanese encephalitis virus
TINNTDIADVI

SEQ ID NO: 235223 - protein, 11 aa, Japanese encephalitis virus
INNTDIADVIV

SEQ ID NO: 235224 - protein, 11 aa, Japanese encephalitis virus
NNTDIADVIVI

SEQ ID NO: 235225 - protein, 11 aa, Japanese encephalitis virus
NTDIADVIVIP

SEQ ID NO: 235226 - protein, 11 aa, Japanese encephalitis virus
TDIADVIVIPT

SEQ ID NO: 235227 - protein, 11 aa, Japanese encephalitis virus
DIADVIVIPTS

SEQ ID NO: 235228 - protein, 11 aa, Japanese encephalitis virus
IADVIVIPTSK

SEQ ID NO: 235229 - protein, 11 aa, Japanese encephalitis virus
ADVIVIPTSKG

SEQ ID NO: 235230 - protein, 11 aa, Japanese encephalitis virus
DVIVIPTSKGE

SEQ ID NO: 235231 - protein, 11 aa, Japanese encephalitis virus
VIVIPTSKGEN

SEQ ID NO: 235232 - protein, 11 aa, Japanese encephalitis virus
IVIPTSKGENR

SEQ ID NO: 235233 - protein, 11 aa, Japanese encephalitis virus
VIPTSKGENRC

SEQ ID NO: 235234 - protein, 11 aa, Japanese encephalitis virus
IPTSKGENRCW

SEQ ID NO: 235235 - protein, 11 aa, Japanese encephalitis virus
PTSKGENRCWV

SEQ ID NO: 235236 - protein, 11 aa, Japanese encephalitis virus
TSKGENRCWVR

SEQ ID NO: 235237 - protein, 11 aa, Japanese encephalitis virus
SKGENRCWVRA

SEQ ID NO: 235238 - protein, 11 aa, Japanese encephalitis virus
KGENRCWVRAI

SEQ ID NO: 235239 - protein, 11 aa, Japanese encephalitis virus
GENRCWVRAID

SEQ ID NO: 235240 - protein, 11 aa, Japanese encephalitis virus
ENRCWVRAIDV

SEQ ID NO: 235241 - protein, 11 aa, Japanese encephalitis virus
NRCWVRAIDVG

SEQ ID NO: 235242 - protein, 11 aa, Japanese encephalitis virus
RCWVRAIDVGY

SEQ ID NO: 235243 - protein, 11 aa, Japanese encephalitis virus
CWVRAIDVGYM

SEQ ID NO: 235244 - protein, 11 aa, Japanese encephalitis virus
WVRAIDVGYMC

SEQ ID NO: 235245 - protein, 11 aa, Japanese encephalitis virus
VRAIDVGYMCE

SEQ ID NO: 235246 - protein, 11 aa, Japanese encephalitis virus
RAIDVGYMCED

SEQ ID NO: 235247 - protein, 11 aa, Japanese encephalitis virus
AIDVGYMCEDT

SEQ ID NO: 235248 - protein, 11 aa, Japanese encephalitis virus
IDVGYMCEDTI

SEQ ID NO: 235249 - protein, 11 aa, Japanese encephalitis virus
DVGYMCEDTIT

SEQ ID NO: 235250 - protein, 11 aa, Japanese encephalitis virus
VGYMCEDTITY

SEQ ID NO: 235251 - protein, 11 aa, Japanese encephalitis virus
GYMCEDTITYE

SEQ ID NO: 235252 - protein, 11 aa, Japanese encephalitis virus
YMCEDTITYEC

SEQ ID NO: 235253 - protein, 11 aa, Japanese encephalitis virus
MCEDTITYECP

SEQ ID NO: 235254 - protein, 11 aa, Japanese encephalitis virus
CEDTITYECPK

SEQ ID NO: 235255 - protein, 11 aa, Japanese encephalitis virus
EDTITYECPKL

SEQ ID NO: 235256 - protein, 11 aa, Japanese encephalitis virus
DTITYECPKLT

SEQ ID NO: 235257 - protein, 11 aa, Japanese encephalitis virus
MGNDPEDVDCW

SEQ ID NO: 235258 - protein, 11 aa, Japanese encephalitis virus
GNDPEDVDCWC

SEQ ID NO: 235259 - protein, 11 aa, Japanese encephalitis virus
NDPEDVDCWCD

SEQ ID NO: 235260 - protein, 11 aa, Japanese encephalitis virus
DPEDVDCWCDN

SEQ ID NO: 235261 - protein, 11 aa, Japanese encephalitis virus
PEDVDCWCDNQ

SEQ ID NO: 235262 - protein, 11 aa, Japanese encephalitis virus
EDVDCWCDNQE

SEQ ID NO: 235263 - protein, 11 aa, Japanese encephalitis virus
DVDCWCDNQEV

SEQ ID NO: 235264 - protein, 11 aa, Japanese encephalitis virus
VDCWCDNQEVY

SEQ ID NO: 235265 - protein, 11 aa, Japanese encephalitis virus
DCWCDNQEVYV

SEQ ID NO: 235266 - protein, 11 aa, Japanese encephalitis virus
CWCDNQEVYVQ

SEQ ID NO: 235267 - protein, 11 aa, Japanese encephalitis virus
WCDNQEVYVQY

SEQ ID NO: 235268 - protein, 11 aa, Japanese encephalitis virus
CDNQEVYVQYG

SEQ ID NO: 235269 - protein, 11 aa, Japanese encephalitis virus
DNQEVYVQYGR

SEQ ID NO: 235270 - protein, 11 aa, Japanese encephalitis virus
NQEVYVQYGRC

SEQ ID NO: 235271 - protein, 11 aa, Japanese encephalitis virus
QEVYVQYGRCT

SEQ ID NO: 235272 - protein, 11 aa, Japanese encephalitis virus
EVYVQYGRCTR

SEQ ID NO: 235273 - protein, 11 aa, Japanese encephalitis virus
VYVQYGRCTRT

SEQ ID NO: 235274 - protein, 11 aa, Japanese encephalitis virus
YVQYGRCTRTR

SEQ ID NO: 235275 - protein, 11 aa, Japanese encephalitis virus
VQYGRCTRTRH

SEQ ID NO: 235276 - protein, 11 aa, Japanese encephalitis virus
QYGRCTRTRHS

SEQ ID NO: 235277 - protein, 11 aa, Japanese encephalitis virus
YGRCTRTRHSK

SEQ ID NO: 235278 - protein, 11 aa, Japanese encephalitis virus
GRCTRTRHSKR

SEQ ID NO: 235279 - protein, 11 aa, Japanese encephalitis virus
RCTRTRHSKRS

SEQ ID NO: 235280 - protein, 11 aa, Japanese encephalitis virus
CTRTRHSKRSR

SEQ ID NO: 235281 - protein, 11 aa, Japanese encephalitis virus
TRTRHSKRSRR

SEQ ID NO: 235282 - protein, 11 aa, Japanese encephalitis virus
RTRHSKRSRRS

SEQ ID NO: 235283 - protein, 11 aa, Japanese encephalitis virus
TRHSKRSRRSV

SEQ ID NO: 235284 - protein, 11 aa, Japanese encephalitis virus
RHSKRSRRSVS

SEQ ID NO: 235285 - protein, 11 aa, Japanese encephalitis virus
HSKRSRRSVSV

SEQ ID NO: 235286 - protein, 11 aa, Japanese encephalitis virus
SKRSRRSVSVQ

SEQ ID NO: 235287 - protein, 11 aa, Japanese encephalitis virus
KRSRRSVSVQT

SEQ ID NO: 235288 - protein, 11 aa, Japanese encephalitis virus
RSRRSVSVQTH

SEQ ID NO: 235289 - protein, 11 aa, Japanese encephalitis virus
SRRSVSVQTHG

SEQ ID NO: 235290 - protein, 11 aa, Japanese encephalitis virus
RRSVSVQTHGE

SEQ ID NO: 235291 - protein, 11 aa, Japanese encephalitis virus
RSVSVQTHGES

SEQ ID NO: 235292 - protein, 11 aa, Japanese encephalitis virus
SVSVQTHGESS

SEQ ID NO: 235293 - protein, 11 aa, Japanese encephalitis virus
VSVQTHGESSL

SEQ ID NO: 235294 - protein, 11 aa, Japanese encephalitis virus
SVQTHGESSLV

SEQ ID NO: 235295 - protein, 11 aa, Japanese encephalitis virus
VQTHGESSLVN

SEQ ID NO: 235296 - protein, 11 aa, Japanese encephalitis virus
QTHGESSLVNK

SEQ ID NO: 235297 - protein, 11 aa, Japanese encephalitis virus
THGESSLVNKK

SEQ ID NO: 235298 - protein, 11 aa, Japanese encephalitis virus
HGESSLVNKKE

SEQ ID NO: 235299 - protein, 11 aa, Japanese encephalitis virus
GESSLVNKKEA

SEQ ID NO: 235300 - protein, 11 aa, Japanese encephalitis virus
ESSLVNKKEAW

SEQ ID NO: 235301 - protein, 11 aa, Japanese encephalitis virus
SSLVNKKEAWL

SEQ ID NO: 235302 - protein, 11 aa, Japanese encephalitis virus
SLVNKKEAWLD

SEQ ID NO: 235303 - protein, 11 aa, Japanese encephalitis virus
LVNKKEAWLDS

SEQ ID NO: 235304 - protein, 11 aa, Japanese encephalitis virus
VNKKEAWLDST

SEQ ID NO: 235305 - protein, 11 aa, Japanese encephalitis virus
NKKEAWLDSTK

SEQ ID NO: 235306 - protein, 11 aa, Japanese encephalitis virus
KKEAWLDSTKA

SEQ ID NO: 235307 - protein, 11 aa, Japanese encephalitis virus
KEAWLDSTKAT

SEQ ID NO: 235308 - protein, 11 aa, Japanese encephalitis virus
EAWLDSTKATR

SEQ ID NO: 235309 - protein, 11 aa, Japanese encephalitis virus
AWLDSTKATRY

SEQ ID NO: 235310 - protein, 11 aa, Japanese encephalitis virus
WLDSTKATRYL

SEQ ID NO: 235311 - protein, 11 aa, Japanese encephalitis virus
LDSTKATRYLM

SEQ ID NO: 235312 - protein, 11 aa, Japanese encephalitis virus
DSTKATRYLMK

SEQ ID NO: 235313 - protein, 11 aa, Japanese encephalitis virus
STKATRYLMKT

SEQ ID NO: 235314 - protein, 11 aa, Japanese encephalitis virus
TKATRYLMKTE

SEQ ID NO: 235315 - protein, 11 aa, Japanese encephalitis virus
KATRYLMKTEN

SEQ ID NO: 235316 - protein, 11 aa, Japanese encephalitis virus
ATRYLMKTENW

SEQ ID NO: 235317 - protein, 11 aa, Japanese encephalitis virus
TRYLMKTENWI

SEQ ID NO: 235318 - protein, 11 aa, Japanese encephalitis virus
RYLMKTENWII

SEQ ID NO: 235319 - protein, 11 aa, Japanese encephalitis virus
YLMKTENWIIR

SEQ ID NO: 235320 - protein, 11 aa, Japanese encephalitis virus
LMKTENWIIRN

SEQ ID NO: 235321 - protein, 11 aa, Japanese encephalitis virus
MKTENWIIRNP

SEQ ID NO: 235322 - protein, 11 aa, Japanese encephalitis virus
KTENWIIRNPG

SEQ ID NO: 235323 - protein, 11 aa, Japanese encephalitis virus
TENWIIRNPGY

SEQ ID NO: 235324 - protein, 11 aa, Japanese encephalitis virus
ENWIIRNPGYA

SEQ ID NO: 235325 - protein, 11 aa, Japanese encephalitis virus
NWIIRNPGYAF

SEQ ID NO: 235326 - protein, 11 aa, Japanese encephalitis virus
WIIRNPGYAFL

SEQ ID NO: 235327 - protein, 11 aa, Japanese encephalitis virus
IIRNPGYAFLA

SEQ ID NO: 235328 - protein, 11 aa, Japanese encephalitis virus
IRNPGYAFLAA

SEQ ID NO: 235329 - protein, 11 aa, Japanese encephalitis virus
GQRVVFTILLL

SEQ ID NO: 235330 - protein, 11 aa, Japanese encephalitis virus
QRVVFTILLLL

SEQ ID NO: 235331 - protein, 11 aa, Japanese encephalitis virus
RVVFTILLLLV

SEQ ID NO: 235332 - protein, 11 aa, Japanese encephalitis virus
VVFTILLLLVA

SEQ ID NO: 235333 - protein, 11 aa, Japanese encephalitis virus
VFTILLLLVAP

SEQ ID NO: 235334 - protein, 11 aa, Japanese encephalitis virus
FTILLLLVAPA

SEQ ID NO: 235335 - protein, 11 aa, Japanese encephalitis virus
TILLLLVAPAY

SEQ ID NO: 235336 - protein, 11 aa, Japanese encephalitis virus
ILLLLVAPAYS

SEQ ID NO: 235337 - protein, 11 aa, Japanese encephalitis virus
LLLLVAPAYSF

SEQ ID NO: 235338 - protein, 11 aa, Japanese encephalitis virus
LLLVAPAYSFN

SEQ ID NO: 235339 - protein, 11 aa, Japanese encephalitis virus
LLVAPAYSFNC

SEQ ID NO: 235340 - protein, 11 aa, Japanese encephalitis virus
LVAPAYSFNCL

SEQ ID NO: 235341 - protein, 11 aa, Japanese encephalitis virus
VAPAYSFNCLG

SEQ ID NO: 235342 - protein, 11 aa, Japanese encephalitis virus
APAYSFNCLGM

SEQ ID NO: 235343 - protein, 11 aa, Japanese encephalitis virus
PAYSFNCLGMG

SEQ ID NO: 235344 - protein, 11 aa, Japanese encephalitis virus
AYSFNCLGMGN

SEQ ID NO: 235345 - protein, 11 aa, Japanese encephalitis virus
YSFNCLGMGNR

SEQ ID NO: 235346 - protein, 11 aa, Japanese encephalitis virus
SFNCLGMGNRD

SEQ ID NO: 235347 - protein, 11 aa, Japanese encephalitis virus
FNCLGMGNRDF

SEQ ID NO: 235348 - protein, 11 aa, Japanese encephalitis virus
NCLGMGNRDFI

SEQ ID NO: 235349 - protein, 11 aa, Japanese encephalitis virus
CLGMGNRDFIE

SEQ ID NO: 235350 - protein, 11 aa, Japanese encephalitis virus
LGMGNRDFIEG

SEQ ID NO: 235351 - protein, 11 aa, Japanese encephalitis virus
GMGNRDFIEGA

SEQ ID NO: 235352 - protein, 11 aa, Japanese encephalitis virus
MGNRDFIEGAS

SEQ ID NO: 235353 - protein, 11 aa, Japanese encephalitis virus
GNRDFIEGASG

SEQ ID NO: 235354 - protein, 11 aa, Japanese encephalitis virus
NRDFIEGASGA

SEQ ID NO: 235355 - protein, 11 aa, Japanese encephalitis virus
RDFIEGASGAT

SEQ ID NO: 235356 - protein, 11 aa, Japanese encephalitis virus
DFIEGASGATW

SEQ ID NO: 235357 - protein, 11 aa, Japanese encephalitis virus
FIEGASGATWV

SEQ ID NO: 235358 - protein, 11 aa, Japanese encephalitis virus
IEGASGATWVD

SEQ ID NO: 235359 - protein, 11 aa, Japanese encephalitis virus
EGASGATWVDL

SEQ ID NO: 235360 - protein, 11 aa, Japanese encephalitis virus
GASGATWVDLV

SEQ ID NO: 235361 - protein, 11 aa, Japanese encephalitis virus
ASGATWVDLVL

SEQ ID NO: 235362 - protein, 11 aa, Japanese encephalitis virus
SGATWVDLVLE

SEQ ID NO: 235363 - protein, 11 aa, Japanese encephalitis virus
GATWVDLVLEG

SEQ ID NO: 235364 - protein, 11 aa, Japanese encephalitis virus
ATWVDLVLEGD

SEQ ID NO: 235365 - protein, 11 aa, Japanese encephalitis virus
TWVDLVLEGDS

SEQ ID NO: 235366 - protein, 11 aa, Japanese encephalitis virus
WVDLVLEGDSC

SEQ ID NO: 235367 - protein, 11 aa, Japanese encephalitis virus
VDLVLEGDSCL

SEQ ID NO: 235368 - protein, 11 aa, Japanese encephalitis virus
DLVLEGDSCLT

SEQ ID NO: 235369 - protein, 11 aa, Japanese encephalitis virus
LVLEGDSCLTI

SEQ ID NO: 235370 - protein, 11 aa, Japanese encephalitis virus
VLEGDSCLTIM

SEQ ID NO: 235371 - protein, 11 aa, Japanese encephalitis virus
LEGDSCLTIMA

SEQ ID NO: 235372 - protein, 11 aa, Japanese encephalitis virus
EGDSCLTIMAN

SEQ ID NO: 235373 - protein, 11 aa, Japanese encephalitis virus
GDSCLTIMAND

SEQ ID NO: 235374 - protein, 11 aa, Japanese encephalitis virus
DSCLTIMANDK

SEQ ID NO: 235375 - protein, 11 aa, Japanese encephalitis virus
SCLTIMANDKP

SEQ ID NO: 235376 - protein, 11 aa, Japanese encephalitis virus
CLTIMANDKPT

SEQ ID NO: 235377 - protein, 11 aa, Japanese encephalitis virus
LTIMANDKPTL

SEQ ID NO: 235378 - protein, 11 aa, Japanese encephalitis virus
TIMANDKPTLD

SEQ ID NO: 235379 - protein, 11 aa, Japanese encephalitis virus
IMANDKPTLDV

SEQ ID NO: 235380 - protein, 11 aa, Japanese encephalitis virus
MANDKPTLDVR

SEQ ID NO: 235381 - protein, 11 aa, Japanese encephalitis virus
ANDKPTLDVRM

SEQ ID NO: 235382 - protein, 11 aa, Japanese encephalitis virus
NDKPTLDVRMI

SEQ ID NO: 235383 - protein, 11 aa, Japanese encephalitis virus
DKPTLDVRMIN

SEQ ID NO: 235384 - protein, 11 aa, Japanese encephalitis virus
KPTLDVRMINI

SEQ ID NO: 235385 - protein, 11 aa, Japanese encephalitis virus
PTLDVRMINIE

SEQ ID NO: 235386 - protein, 11 aa, Japanese encephalitis virus
TLDVRMINIEA

SEQ ID NO: 235387 - protein, 11 aa, Japanese encephalitis virus
LDVRMINIEAS

SEQ ID NO: 235388 - protein, 11 aa, Japanese encephalitis virus
DVRMINIEASQ

SEQ ID NO: 235389 - protein, 11 aa, Japanese encephalitis virus
VRMINIEASQL

SEQ ID NO: 235390 - protein, 11 aa, Japanese encephalitis virus
RMINIEASQLA

SEQ ID NO: 235391 - protein, 11 aa, Japanese encephalitis virus
MINIEASQLAE

SEQ ID NO: 235392 - protein, 11 aa, Japanese encephalitis virus
INIEASQLAEV

SEQ ID NO: 235393 - protein, 11 aa, Japanese encephalitis virus
NIEASQLAEVR

SEQ ID NO: 235394 - protein, 11 aa, Japanese encephalitis virus
IEASQLAEVRS

SEQ ID NO: 235395 - protein, 11 aa, Japanese encephalitis virus
EASQLAEVRSY

SEQ ID NO: 235396 - protein, 11 aa, Japanese encephalitis virus
ASQLAEVRSYC

SEQ ID NO: 235397 - protein, 11 aa, Japanese encephalitis virus
SQLAEVRSYCY

SEQ ID NO: 235398 - protein, 11 aa, Japanese encephalitis virus
QLAEVRSYCYH

SEQ ID NO: 235399 - protein, 11 aa, Japanese encephalitis virus
LAEVRSYCYHA

SEQ ID NO: 235400 - protein, 11 aa, Japanese encephalitis virus
AEVRSYCYHAS

SEQ ID NO: 235401 - protein, 11 aa, Japanese encephalitis virus
EVRSYCYHASV

SEQ ID NO: 235402 - protein, 11 aa, Japanese encephalitis virus
VRSYCYHASVT

SEQ ID NO: 235403 - protein, 11 aa, Japanese encephalitis virus
RSYCYHASVTD

SEQ ID NO: 235404 - protein, 11 aa, Japanese encephalitis virus
SYCYHASVTDI

SEQ ID NO: 235405 - protein, 11 aa, Japanese encephalitis virus
YCYHASVTDIS

SEQ ID NO: 235406 - protein, 11 aa, Japanese encephalitis virus
CYHASVTDIST

SEQ ID NO: 235407 - protein, 11 aa, Japanese encephalitis virus
YHASVTDISTV

SEQ ID NO: 235408 - protein, 11 aa, Japanese encephalitis virus
HASVTDISTVA

SEQ ID NO: 235409 - protein, 11 aa, Japanese encephalitis virus
ASVTDISTVAR

SEQ ID NO: 235410 - protein, 11 aa, Japanese encephalitis virus
SVTDISTVARC

SEQ ID NO: 235411 - protein, 11 aa, Japanese encephalitis virus
VTDISTVARCP

SEQ ID NO: 235412 - protein, 11 aa, Japanese encephalitis virus
TDISTVARCPT

SEQ ID NO: 235413 - protein, 11 aa, Japanese encephalitis virus
DISTVARCPTT

SEQ ID NO: 235414 - protein, 11 aa, Japanese encephalitis virus
ISTVARCPTTG

SEQ ID NO: 235415 - protein, 11 aa, Japanese encephalitis virus
STVARCPTTGE

SEQ ID NO: 235416 - protein, 11 aa, Japanese encephalitis virus
TVARCPTTGEA

SEQ ID NO: 235417 - protein, 11 aa, Japanese encephalitis virus
VARCPTTGEAH

SEQ ID NO: 235418 - protein, 11 aa, Japanese encephalitis virus
ARCPTTGEAHN

SEQ ID NO: 235419 - protein, 11 aa, Japanese encephalitis virus
RCPTTGEAHNE

SEQ ID NO: 235420 - protein, 11 aa, Japanese encephalitis virus
CPTTGEAHNEK

SEQ ID NO: 235421 - protein, 11 aa, Japanese encephalitis virus
PTTGEAHNEKR

SEQ ID NO: 235422 - protein, 11 aa, Japanese encephalitis virus
TTGEAHNEKRA

SEQ ID NO: 235423 - protein, 11 aa, Japanese encephalitis virus
TGEAHNEKRAD

SEQ ID NO: 235424 - protein, 11 aa, Japanese encephalitis virus
GEAHNEKRADS

SEQ ID NO: 235425 - protein, 11 aa, Japanese encephalitis virus
EAHNEKRADSS

SEQ ID NO: 235426 - protein, 11 aa, Japanese encephalitis virus
AHNEKRADSSY

SEQ ID NO: 235427 - protein, 11 aa, Japanese encephalitis virus
HNEKRADSSYV

SEQ ID NO: 235428 - protein, 11 aa, Japanese encephalitis virus
NEKRADSSYVC

SEQ ID NO: 235429 - protein, 11 aa, Japanese encephalitis virus
EKRADSSYVCK

SEQ ID NO: 235430 - protein, 11 aa, Japanese encephalitis virus
KRADSSYVCKQ

SEQ ID NO: 235431 - protein, 11 aa, Japanese encephalitis virus
RADSSYVCKQG

SEQ ID NO: 235432 - protein, 11 aa, Japanese encephalitis virus
ADSSYVCKQGF

SEQ ID NO: 235433 - protein, 11 aa, Japanese encephalitis virus
DSSYVCKQGFT

SEQ ID NO: 235434 - protein, 11 aa, Japanese encephalitis virus
SSYVCKQGFTD

SEQ ID NO: 235435 - protein, 11 aa, Japanese encephalitis virus
SYVCKQGFTDR

SEQ ID NO: 235436 - protein, 11 aa, Japanese encephalitis virus
YVCKQGFTDRG

SEQ ID NO: 235437 - protein, 11 aa, Japanese encephalitis virus
VCKQGFTDRGW

SEQ ID NO: 235438 - protein, 11 aa, Japanese encephalitis virus
CKQGFTDRGWG

SEQ ID NO: 235439 - protein, 11 aa, Japanese encephalitis virus
KQGFTDRGWGN

SEQ ID NO: 235440 - protein, 11 aa, Japanese encephalitis virus
QGFTDRGWGNG

SEQ ID NO: 235441 - protein, 11 aa, Japanese encephalitis virus
GFTDRGWGNGC

SEQ ID NO: 235442 - protein, 11 aa, Japanese encephalitis virus
FTDRGWGNGCG

SEQ ID NO: 235443 - protein, 11 aa, Japanese encephalitis virus
TDRGWGNGCGL

SEQ ID NO: 235444 - protein, 11 aa, Japanese encephalitis virus
DRGWGNGCGLF

SEQ ID NO: 235445 - protein, 11 aa, Japanese encephalitis virus
RGWGNGCGLFG

SEQ ID NO: 235446 - protein, 11 aa, Japanese encephalitis virus
GWGNGCGLFGK

SEQ ID NO: 235447 - protein, 11 aa, Japanese encephalitis virus
WGNGCGLFGKG

SEQ ID NO: 235448 - protein, 11 aa, Japanese encephalitis virus
GNGCGLFGKGS

SEQ ID NO: 235449 - protein, 11 aa, Japanese encephalitis virus
NGCGLFGKGSI

SEQ ID NO: 235450 - protein, 11 aa, Japanese encephalitis virus
GCGLFGKGSID

SEQ ID NO: 235451 - protein, 11 aa, Japanese encephalitis virus
CGLFGKGSIDT

SEQ ID NO: 235452 - protein, 11 aa, Japanese encephalitis virus
GLFGKGSIDTC

SEQ ID NO: 235453 - protein, 11 aa, Japanese encephalitis virus
LFGKGSIDTCA

SEQ ID NO: 235454 - protein, 11 aa, Japanese encephalitis virus
FGKGSIDTCAK

SEQ ID NO: 235455 - protein, 11 aa, Japanese encephalitis virus
GKGSIDTCAKF

SEQ ID NO: 235456 - protein, 11 aa, Japanese encephalitis virus
KGSIDTCAKFS

SEQ ID NO: 235457 - protein, 11 aa, Japanese encephalitis virus
GSIDTCAKFSC

SEQ ID NO: 235458 - protein, 11 aa, Japanese encephalitis virus
SIDTCAKFSCT

SEQ ID NO: 235459 - protein, 11 aa, Japanese encephalitis virus
IDTCAKFSCTS

SEQ ID NO: 235460 - protein, 11 aa, Japanese encephalitis virus
DTCAKFSCTSK

SEQ ID NO: 235461 - protein, 11 aa, Japanese encephalitis virus
TCAKFSCTSKA

SEQ ID NO: 235462 - protein, 11 aa, Japanese encephalitis virus
CAKFSCTSKAI

SEQ ID NO: 235463 - protein, 11 aa, Japanese encephalitis virus
AKFSCTSKAIG

SEQ ID NO: 235464 - protein, 11 aa, Japanese encephalitis virus
KFSCTSKAIGR

SEQ ID NO: 235465 - protein, 11 aa, Japanese encephalitis virus
IQPENIKYEVG

SEQ ID NO: 235466 - protein, 11 aa, Japanese encephalitis virus
QPENIKYEVGI

SEQ ID NO: 235467 - protein, 11 aa, Japanese encephalitis virus
PENIKYEVGIF

SEQ ID NO: 235468 - protein, 11 aa, Japanese encephalitis virus
ENIKYEVGIFV

SEQ ID NO: 235469 - protein, 11 aa, Japanese encephalitis virus
NIKYEVGIFVH

SEQ ID NO: 235470 - protein, 11 aa, Japanese encephalitis virus
IKYEVGIFVHG

SEQ ID NO: 235471 - protein, 11 aa, Japanese encephalitis virus
KYEVGIFVHGT

SEQ ID NO: 235472 - protein, 11 aa, Japanese encephalitis virus
YEVGIFVHGTT

SEQ ID NO: 235473 - protein, 11 aa, Japanese encephalitis virus
EVGIFVHGTTT

SEQ ID NO: 235474 - protein, 11 aa, Japanese encephalitis virus
VGIFVHGTTTS

SEQ ID NO: 235475 - protein, 11 aa, Japanese encephalitis virus
GIFVHGTTTSE

SEQ ID NO: 235476 - protein, 11 aa, Japanese encephalitis virus
IFVHGTTTSEN

SEQ ID NO: 235477 - protein, 11 aa, Japanese encephalitis virus
FVHGTTTSENH

SEQ ID NO: 235478 - protein, 11 aa, Japanese encephalitis virus
VHGTTTSENHG

SEQ ID NO: 235479 - protein, 11 aa, Japanese encephalitis virus
HGTTTSENHGN

SEQ ID NO: 235480 - protein, 11 aa, Japanese encephalitis virus
GTTTSENHGNY

SEQ ID NO: 235481 - protein, 11 aa, Japanese encephalitis virus
TTTSENHGNYS

SEQ ID NO: 235482 - protein, 11 aa, Japanese encephalitis virus
TTSENHGNYSA

SEQ ID NO: 235483 - protein, 11 aa, Japanese encephalitis virus
TSENHGNYSAQ

SEQ ID NO: 235484 - protein, 11 aa, Japanese encephalitis virus
SENHGNYSAQV

SEQ ID NO: 235485 - protein, 11 aa, Japanese encephalitis virus
ENHGNYSAQVG

SEQ ID NO: 235486 - protein, 11 aa, Japanese encephalitis virus
NHGNYSAQVGA

SEQ ID NO: 235487 - protein, 11 aa, Japanese encephalitis virus
HGNYSAQVGAS

SEQ ID NO: 235488 - protein, 11 aa, Japanese encephalitis virus
GNYSAQVGASQ

SEQ ID NO: 235489 - protein, 11 aa, Japanese encephalitis virus
NYSAQVGASQA

SEQ ID NO: 235490 - protein, 11 aa, Japanese encephalitis virus
YSAQVGASQAA

SEQ ID NO: 235491 - protein, 11 aa, Japanese encephalitis virus
SAQVGASQAAK

SEQ ID NO: 235492 - protein, 11 aa, Japanese encephalitis virus
AQVGASQAAKF

SEQ ID NO: 235493 - protein, 11 aa, Japanese encephalitis virus
QVGASQAAKFT

SEQ ID NO: 235494 - protein, 11 aa, Japanese encephalitis virus
GASQAAKFTVT

SEQ ID NO: 235495 - protein, 11 aa, Japanese encephalitis virus
ASQAAKFTVTP

SEQ ID NO: 235496 - protein, 11 aa, Japanese encephalitis virus
SQAAKFTVTPN

SEQ ID NO: 235497 - protein, 11 aa, Japanese encephalitis virus
QAAKFTVTPNA

SEQ ID NO: 235498 - protein, 11 aa, Japanese encephalitis virus
AAKFTVTPNAP

SEQ ID NO: 235499 - protein, 11 aa, Japanese encephalitis virus
AKFTVTPNAPS

SEQ ID NO: 235500 - protein, 11 aa, Japanese encephalitis virus
KFTVTPNAPSI

SEQ ID NO: 235501 - protein, 11 aa, Japanese encephalitis virus
FTVTPNAPSIT

SEQ ID NO: 235502 - protein, 11 aa, Japanese encephalitis virus
TVTPNAPSITL

SEQ ID NO: 235503 - protein, 11 aa, Japanese encephalitis virus
TPNAPSITLKL

SEQ ID NO: 235504 - protein, 11 aa, Japanese encephalitis virus
PNAPSITLKLG

SEQ ID NO: 235505 - protein, 11 aa, Japanese encephalitis virus
NAPSITLKLGD

SEQ ID NO: 235506 - protein, 11 aa, Japanese encephalitis virus
TLKLGDYGEVT

SEQ ID NO: 235507 - protein, 11 aa, Japanese encephalitis virus
LKLGDYGEVTL

SEQ ID NO: 235508 - protein, 11 aa, Japanese encephalitis virus
KLGDYGEVTLD

SEQ ID NO: 235509 - protein, 11 aa, Japanese encephalitis virus
LGDYGEVTLDC

SEQ ID NO: 235510 - protein, 11 aa, Japanese encephalitis virus
GDYGEVTLDCE

SEQ ID NO: 235511 - protein, 11 aa, Japanese encephalitis virus
DYGEVTLDCEP

SEQ ID NO: 235512 - protein, 11 aa, Japanese encephalitis virus
YGEVTLDCEPR

SEQ ID NO: 235513 - protein, 11 aa, Japanese encephalitis virus
GEVTLDCEPRS

SEQ ID NO: 235514 - protein, 11 aa, Japanese encephalitis virus
EVTLDCEPRSG

SEQ ID NO: 235515 - protein, 11 aa, Japanese encephalitis virus
VTLDCEPRSGL

SEQ ID NO: 235516 - protein, 11 aa, Japanese encephalitis virus
TLDCEPRSGLN

SEQ ID NO: 235517 - protein, 11 aa, Japanese encephalitis virus
LDCEPRSGLNT

SEQ ID NO: 235518 - protein, 11 aa, Japanese encephalitis virus
DCEPRSGLNTE

SEQ ID NO: 235519 - protein, 11 aa, Japanese encephalitis virus
CEPRSGLNTEA

SEQ ID NO: 235520 - protein, 11 aa, Japanese encephalitis virus
EPRSGLNTEAF

SEQ ID NO: 235521 - protein, 11 aa, Japanese encephalitis virus
PRSGLNTEAFY

SEQ ID NO: 235522 - protein, 11 aa, Japanese encephalitis virus
RSGLNTEAFYV

SEQ ID NO: 235523 - protein, 11 aa, Japanese encephalitis virus
SGLNTEAFYVM

SEQ ID NO: 235524 - protein, 11 aa, Japanese encephalitis virus
GLNTEAFYVMT

SEQ ID NO: 235525 - protein, 11 aa, Japanese encephalitis virus
LNTEAFYVMTV

SEQ ID NO: 235526 - protein, 11 aa, Japanese encephalitis virus
NTEAFYVMTVG

SEQ ID NO: 235527 - protein, 11 aa, Japanese encephalitis virus
TEAFYVMTVGS

SEQ ID NO: 235528 - protein, 11 aa, Japanese encephalitis virus
EAFYVMTVGSK

SEQ ID NO: 235529 - protein, 11 aa, Japanese encephalitis virus
AFYVMTVGSKS

SEQ ID NO: 235530 - protein, 11 aa, Japanese encephalitis virus
FYVMTVGSKSF

SEQ ID NO: 235531 - protein, 11 aa, Japanese encephalitis virus
YVMTVGSKSFL

SEQ ID NO: 235532 - protein, 11 aa, Japanese encephalitis virus
VMTVGSKSFLV

SEQ ID NO: 235533 - protein, 11 aa, Japanese encephalitis virus
MTVGSKSFLVH

SEQ ID NO: 235534 - protein, 11 aa, Japanese encephalitis virus
TVGSKSFLVHR

SEQ ID NO: 235535 - protein, 11 aa, Japanese encephalitis virus
VGSKSFLVHRE

SEQ ID NO: 235536 - protein, 11 aa, Japanese encephalitis virus
GSKSFLVHREW

SEQ ID NO: 235537 - protein, 11 aa, Japanese encephalitis virus
SKSFLVHREWF

SEQ ID NO: 235538 - protein, 11 aa, Japanese encephalitis virus
KSFLVHREWFH

SEQ ID NO: 235539 - protein, 11 aa, Japanese encephalitis virus
SFLVHREWFHD

SEQ ID NO: 235540 - protein, 11 aa, Japanese encephalitis virus
FLVHREWFHDL

SEQ ID NO: 235541 - protein, 11 aa, Japanese encephalitis virus
LVHREWFHDLA

SEQ ID NO: 235542 - protein, 11 aa, Japanese encephalitis virus
VHREWFHDLAL

SEQ ID NO: 235543 - protein, 11 aa, Japanese encephalitis virus
HREWFHDLALP

SEQ ID NO: 235544 - protein, 11 aa, Japanese encephalitis virus
REWFHDLALPW

SEQ ID NO: 235545 - protein, 11 aa, Japanese encephalitis virus
EWFHDLALPWT

SEQ ID NO: 235546 - protein, 11 aa, Japanese encephalitis virus
WFHDLALPWTS

SEQ ID NO: 235547 - protein, 11 aa, Japanese encephalitis virus
FHDLALPWTSP

SEQ ID NO: 235548 - protein, 11 aa, Japanese encephalitis virus
HDLALPWTSPS

SEQ ID NO: 235549 - protein, 11 aa, Japanese encephalitis virus
DLALPWTSPSS

SEQ ID NO: 235550 - protein, 11 aa, Japanese encephalitis virus
LALPWTSPSST

SEQ ID NO: 235551 - protein, 11 aa, Japanese encephalitis virus
ALPWTSPSSTA

SEQ ID NO: 235552 - protein, 11 aa, Japanese encephalitis virus
LPWTSPSSTAW

SEQ ID NO: 235553 - protein, 11 aa, Japanese encephalitis virus
PWTSPSSTAWR

SEQ ID NO: 235554 - protein, 11 aa, Japanese encephalitis virus
WTSPSSTAWRN

SEQ ID NO: 235555 - protein, 11 aa, Japanese encephalitis virus
TSPSSTAWRNR

SEQ ID NO: 235556 - protein, 11 aa, Japanese encephalitis virus
SPSSTAWRNRE

SEQ ID NO: 235557 - protein, 11 aa, Japanese encephalitis virus
PSSTAWRNREL

SEQ ID NO: 235558 - protein, 11 aa, Japanese encephalitis virus
SSTAWRNRELL

SEQ ID NO: 235559 - protein, 11 aa, Japanese encephalitis virus
STAWRNRELLM

SEQ ID NO: 235560 - protein, 11 aa, Japanese encephalitis virus
TAWRNRELLME

SEQ ID NO: 235561 - protein, 11 aa, Japanese encephalitis virus
AWRNRELLMEF

SEQ ID NO: 235562 - protein, 11 aa, Japanese encephalitis virus
WRNRELLMEFE

SEQ ID NO: 235563 - protein, 11 aa, Japanese encephalitis virus
RNRELLMEFEE

SEQ ID NO: 235564 - protein, 11 aa, Japanese encephalitis virus
NRELLMEFEEA

SEQ ID NO: 235565 - protein, 11 aa, Japanese encephalitis virus
RELLMEFEEAH

SEQ ID NO: 235566 - protein, 11 aa, Japanese encephalitis virus
ELLMEFEEAHA

SEQ ID NO: 235567 - protein, 11 aa, Japanese encephalitis virus
LLMEFEEAHAT

SEQ ID NO: 235568 - protein, 11 aa, Japanese encephalitis virus
LMEFEEAHATK

SEQ ID NO: 235569 - protein, 11 aa, Japanese encephalitis virus
MEFEEAHATKQ

SEQ ID NO: 235570 - protein, 11 aa, Japanese encephalitis virus
EFEEAHATKQS

SEQ ID NO: 235571 - protein, 11 aa, Japanese encephalitis virus
FEEAHATKQSV

SEQ ID NO: 235572 - protein, 11 aa, Japanese encephalitis virus
EEAHATKQSVV

SEQ ID NO: 235573 - protein, 11 aa, Japanese encephalitis virus
EAHATKQSVVA

SEQ ID NO: 235574 - protein, 11 aa, Japanese encephalitis virus
AHATKQSVVAL

SEQ ID NO: 235575 - protein, 11 aa, Japanese encephalitis virus
HATKQSVVALG

SEQ ID NO: 235576 - protein, 11 aa, Japanese encephalitis virus
ATKQSVVALGS

SEQ ID NO: 235577 - protein, 11 aa, Japanese encephalitis virus
TKQSVVALGSQ

SEQ ID NO: 235578 - protein, 11 aa, Japanese encephalitis virus
KQSVVALGSQE

SEQ ID NO: 235579 - protein, 11 aa, Japanese encephalitis virus
QSVVALGSQEG

SEQ ID NO: 235580 - protein, 11 aa, Japanese encephalitis virus
SVVALGSQEGG

SEQ ID NO: 235581 - protein, 11 aa, Japanese encephalitis virus
VVALGSQEGGL

SEQ ID NO: 235582 - protein, 11 aa, Japanese encephalitis virus
VALGSQEGGLH

SEQ ID NO: 235583 - protein, 11 aa, Japanese encephalitis virus
ALGSQEGGLHQ

SEQ ID NO: 235584 - protein, 11 aa, Japanese encephalitis virus
LGSQEGGLHQA

SEQ ID NO: 235585 - protein, 11 aa, Japanese encephalitis virus
GSQEGGLHQAL

SEQ ID NO: 235586 - protein, 11 aa, Japanese encephalitis virus
SQEGGLHQALA

SEQ ID NO: 235587 - protein, 11 aa, Japanese encephalitis virus
QEGGLHQALAG

SEQ ID NO: 235588 - protein, 11 aa, Japanese encephalitis virus
EGGLHQALAGA

SEQ ID NO: 235589 - protein, 11 aa, Japanese encephalitis virus
GGLHQALAGAI

SEQ ID NO: 235590 - protein, 11 aa, Japanese encephalitis virus
GLHQALAGAIV

SEQ ID NO: 235591 - protein, 11 aa, Japanese encephalitis virus
LHQALAGAIVV

SEQ ID NO: 235592 - protein, 11 aa, Japanese encephalitis virus
HQALAGAIVVE

SEQ ID NO: 235593 - protein, 11 aa, Japanese encephalitis virus
QALAGAIVVEY

SEQ ID NO: 235594 - protein, 11 aa, Japanese encephalitis virus
ALAGAIVVEYS

SEQ ID NO: 235595 - protein, 11 aa, Japanese encephalitis virus
LAGAIVVEYSS

SEQ ID NO: 235596 - protein, 11 aa, Japanese encephalitis virus
AGAIVVEYSSS

SEQ ID NO: 235597 - protein, 11 aa, Japanese encephalitis virus
GAIVVEYSSSV

SEQ ID NO: 235598 - protein, 11 aa, Japanese encephalitis virus
AIVVEYSSSVK

SEQ ID NO: 235599 - protein, 11 aa, Japanese encephalitis virus
IVVEYSSSVKL

SEQ ID NO: 235600 - protein, 11 aa, Japanese encephalitis virus
VVEYSSSVKLT

SEQ ID NO: 235601 - protein, 11 aa, Japanese encephalitis virus
VEYSSSVKLTS

SEQ ID NO: 235602 - protein, 11 aa, Japanese encephalitis virus
EYSSSVKLTSG

SEQ ID NO: 235603 - protein, 11 aa, Japanese encephalitis virus
YSSSVKLTSGH

SEQ ID NO: 235604 - protein, 11 aa, Japanese encephalitis virus
SSSVKLTSGHL

SEQ ID NO: 235605 - protein, 11 aa, Japanese encephalitis virus
SSVKLTSGHLK

SEQ ID NO: 235606 - protein, 11 aa, Japanese encephalitis virus
SVKLTSGHLKC

SEQ ID NO: 235607 - protein, 11 aa, Japanese encephalitis virus
VKLTSGHLKCR

SEQ ID NO: 235608 - protein, 11 aa, Japanese encephalitis virus
KLTSGHLKCRL

SEQ ID NO: 235609 - protein, 11 aa, Japanese encephalitis virus
LTSGHLKCRLK

SEQ ID NO: 235610 - protein, 11 aa, Japanese encephalitis virus
TSGHLKCRLKM

SEQ ID NO: 235611 - protein, 11 aa, Japanese encephalitis virus
SGHLKCRLKMD

SEQ ID NO: 235612 - protein, 11 aa, Japanese encephalitis virus
GHLKCRLKMDK

SEQ ID NO: 235613 - protein, 11 aa, Japanese encephalitis virus
HLKCRLKMDKL

SEQ ID NO: 235614 - protein, 11 aa, Japanese encephalitis virus
LKCRLKMDKLA

SEQ ID NO: 235615 - protein, 11 aa, Japanese encephalitis virus
KCRLKMDKLAL

SEQ ID NO: 235616 - protein, 11 aa, Japanese encephalitis virus
CRLKMDKLALK

SEQ ID NO: 235617 - protein, 11 aa, Japanese encephalitis virus
RLKMDKLALKG

SEQ ID NO: 235618 - protein, 11 aa, Japanese encephalitis virus
LKMDKLALKGT

SEQ ID NO: 235619 - protein, 11 aa, Japanese encephalitis virus
KMDKLALKGTT

SEQ ID NO: 235620 - protein, 11 aa, Japanese encephalitis virus
MDKLALKGTTY

SEQ ID NO: 235621 - protein, 11 aa, Japanese encephalitis virus
DKLALKGTTYG

SEQ ID NO: 235622 - protein, 11 aa, Japanese encephalitis virus
KLALKGTTYGM

SEQ ID NO: 235623 - protein, 11 aa, Japanese encephalitis virus
LALKGTTYGMC

SEQ ID NO: 235624 - protein, 11 aa, Japanese encephalitis virus
ALKGTTYGMCT

SEQ ID NO: 235625 - protein, 11 aa, Japanese encephalitis virus
LKGTTYGMCTE

SEQ ID NO: 235626 - protein, 11 aa, Japanese encephalitis virus
KGTTYGMCTEK

SEQ ID NO: 235627 - protein, 11 aa, Japanese encephalitis virus
GTTYGMCTEKF

SEQ ID NO: 235628 - protein, 11 aa, Japanese encephalitis virus
TTYGMCTEKFS

SEQ ID NO: 235629 - protein, 11 aa, Japanese encephalitis virus
TYGMCTEKFSF

SEQ ID NO: 235630 - protein, 11 aa, Japanese encephalitis virus
YGMCTEKFSFA

SEQ ID NO: 235631 - protein, 11 aa, Japanese encephalitis virus
GMCTEKFSFAK

SEQ ID NO: 235632 - protein, 11 aa, Japanese encephalitis virus
MCTEKFSFAKN

SEQ ID NO: 235633 - protein, 11 aa, Japanese encephalitis virus
CTEKFSFAKNP

SEQ ID NO: 235634 - protein, 11 aa, Japanese encephalitis virus
TEKFSFAKNPA

SEQ ID NO: 235635 - protein, 11 aa, Japanese encephalitis virus
EKFSFAKNPAD

SEQ ID NO: 235636 - protein, 11 aa, Japanese encephalitis virus
KFSFAKNPADT

SEQ ID NO: 235637 - protein, 11 aa, Japanese encephalitis virus
FSFAKNPADTG

SEQ ID NO: 235638 - protein, 11 aa, Japanese encephalitis virus
SFAKNPADTGH

SEQ ID NO: 235639 - protein, 11 aa, Japanese encephalitis virus
FAKNPADTGHG

SEQ ID NO: 235640 - protein, 11 aa, Japanese encephalitis virus
AKNPADTGHGT

SEQ ID NO: 235641 - protein, 11 aa, Japanese encephalitis virus
KNPADTGHGTV

SEQ ID NO: 235642 - protein, 11 aa, Japanese encephalitis virus
NPADTGHGTVV

SEQ ID NO: 235643 - protein, 11 aa, Japanese encephalitis virus
PADTGHGTVVI

SEQ ID NO: 235644 - protein, 11 aa, Japanese encephalitis virus
ADTGHGTVVIE

SEQ ID NO: 235645 - protein, 11 aa, Japanese encephalitis virus
DTGHGTVVIEL

SEQ ID NO: 235646 - protein, 11 aa, Japanese encephalitis virus
TGHGTVVIELS

SEQ ID NO: 235647 - protein, 11 aa, Japanese encephalitis virus
GHGTVVIELSY

SEQ ID NO: 235648 - protein, 11 aa, Japanese encephalitis virus
HGTVVIELSYS

SEQ ID NO: 235649 - protein, 11 aa, Japanese encephalitis virus
GTVVIELSYSG

SEQ ID NO: 235650 - protein, 11 aa, Japanese encephalitis virus
TVVIELSYSGS

SEQ ID NO: 235651 - protein, 11 aa, Japanese encephalitis virus
VVIELSYSGSD

SEQ ID NO: 235652 - protein, 11 aa, Japanese encephalitis virus
VIELSYSGSDG

SEQ ID NO: 235653 - protein, 11 aa, Japanese encephalitis virus
IELSYSGSDGP

SEQ ID NO: 235654 - protein, 11 aa, Japanese encephalitis virus
ELSYSGSDGPC

SEQ ID NO: 235655 - protein, 11 aa, Japanese encephalitis virus
LSYSGSDGPCK

SEQ ID NO: 235656 - protein, 11 aa, Japanese encephalitis virus
SYSGSDGPCKI

SEQ ID NO: 235657 - protein, 11 aa, Japanese encephalitis virus
YSGSDGPCKIP

SEQ ID NO: 235658 - protein, 11 aa, Japanese encephalitis virus
SGSDGPCKIPI

SEQ ID NO: 235659 - protein, 11 aa, Japanese encephalitis virus
GSDGPCKIPIV

SEQ ID NO: 235660 - protein, 11 aa, Japanese encephalitis virus
SDGPCKIPIVS

SEQ ID NO: 235661 - protein, 11 aa, Japanese encephalitis virus
DGPCKIPIVSV

SEQ ID NO: 235662 - protein, 11 aa, Japanese encephalitis virus
GPCKIPIVSVA

SEQ ID NO: 235663 - protein, 11 aa, Japanese encephalitis virus
PCKIPIVSVAS

SEQ ID NO: 235664 - protein, 11 aa, Japanese encephalitis virus
CKIPIVSVASL

SEQ ID NO: 235665 - protein, 11 aa, Japanese encephalitis virus
KIPIVSVASLN

SEQ ID NO: 235666 - protein, 11 aa, Japanese encephalitis virus
IPIVSVASLND

SEQ ID NO: 235667 - protein, 11 aa, Japanese encephalitis virus
PIVSVASLNDM

SEQ ID NO: 235668 - protein, 11 aa, Japanese encephalitis virus
IVSVASLNDMT

SEQ ID NO: 235669 - protein, 11 aa, Japanese encephalitis virus
VSVASLNDMTP

SEQ ID NO: 235670 - protein, 11 aa, Japanese encephalitis virus
SVASLNDMTPV

SEQ ID NO: 235671 - protein, 11 aa, Japanese encephalitis virus
VASLNDMTPVG

SEQ ID NO: 235672 - protein, 11 aa, Japanese encephalitis virus
ASLNDMTPVGR

SEQ ID NO: 235673 - protein, 11 aa, Japanese encephalitis virus
SLNDMTPVGRL

SEQ ID NO: 235674 - protein, 11 aa, Japanese encephalitis virus
LNDMTPVGRLV

SEQ ID NO: 235675 - protein, 11 aa, Japanese encephalitis virus
NDMTPVGRLVT

SEQ ID NO: 235676 - protein, 11 aa, Japanese encephalitis virus
DMTPVGRLVTV

SEQ ID NO: 235677 - protein, 11 aa, Japanese encephalitis virus
MTPVGRLVTVN

SEQ ID NO: 235678 - protein, 11 aa, Japanese encephalitis virus
TPVGRLVTVNP

SEQ ID NO: 235679 - protein, 11 aa, Japanese encephalitis virus
PVGRLVTVNPF

SEQ ID NO: 235680 - protein, 11 aa, Japanese encephalitis virus
VGRLVTVNPFV

SEQ ID NO: 235681 - protein, 11 aa, Japanese encephalitis virus
GRLVTVNPFVA

SEQ ID NO: 235682 - protein, 11 aa, Japanese encephalitis virus
RLVTVNPFVAT

SEQ ID NO: 235683 - protein, 11 aa, Japanese encephalitis virus
LVTVNPFVATS

SEQ ID NO: 235684 - protein, 11 aa, Japanese encephalitis virus
VTVNPFVATSS

SEQ ID NO: 235685 - protein, 11 aa, Japanese encephalitis virus
TVNPFVATSSA

SEQ ID NO: 235686 - protein, 11 aa, Japanese encephalitis virus
VNPFVATSSAN

SEQ ID NO: 235687 - protein, 11 aa, Japanese encephalitis virus
NPFVATSSANS

SEQ ID NO: 235688 - protein, 11 aa, Japanese encephalitis virus
PFVATSSANSK

SEQ ID NO: 235689 - protein, 11 aa, Japanese encephalitis virus
FVATSSANSKV

SEQ ID NO: 235690 - protein, 11 aa, Japanese encephalitis virus
VATSSANSKVL

SEQ ID NO: 235691 - protein, 11 aa, Japanese encephalitis virus
SSANSKVLVEM

SEQ ID NO: 235692 - protein, 11 aa, Japanese encephalitis virus
SANSKVLVEME

SEQ ID NO: 235693 - protein, 11 aa, Japanese encephalitis virus
ANSKVLVEMEP

SEQ ID NO: 235694 - protein, 11 aa, Japanese encephalitis virus
NSKVLVEMEPP

SEQ ID NO: 235695 - protein, 11 aa, Japanese encephalitis virus
SKVLVEMEPPF

SEQ ID NO: 235696 - protein, 11 aa, Japanese encephalitis virus
KVLVEMEPPFG

SEQ ID NO: 235697 - protein, 11 aa, Japanese encephalitis virus
VLVEMEPPFGD

SEQ ID NO: 235698 - protein, 11 aa, Japanese encephalitis virus
LVEMEPPFGDS

SEQ ID NO: 235699 - protein, 11 aa, Japanese encephalitis virus
VEMEPPFGDSY

SEQ ID NO: 235700 - protein, 11 aa, Japanese encephalitis virus
EMEPPFGDSYI

SEQ ID NO: 235701 - protein, 11 aa, Japanese encephalitis virus
MEPPFGDSYIV

SEQ ID NO: 235702 - protein, 11 aa, Japanese encephalitis virus
EPPFGDSYIVV

SEQ ID NO: 235703 - protein, 11 aa, Japanese encephalitis virus
PPFGDSYIVVG

SEQ ID NO: 235704 - protein, 11 aa, Japanese encephalitis virus
PFGDSYIVVGR

SEQ ID NO: 235705 - protein, 11 aa, Japanese encephalitis virus
FGDSYIVVGRG

SEQ ID NO: 235706 - protein, 11 aa, Japanese encephalitis virus
HHWHKAGSTLG

SEQ ID NO: 235707 - protein, 11 aa, Japanese encephalitis virus
HWHKAGSTLGK

SEQ ID NO: 235708 - protein, 11 aa, Japanese encephalitis virus
WHKAGSTLGKA

SEQ ID NO: 235709 - protein, 11 aa, Japanese encephalitis virus
HKAGSTLGKAF

SEQ ID NO: 235710 - protein, 11 aa, Japanese encephalitis virus
KAGSTLGKAFS

SEQ ID NO: 235711 - protein, 11 aa, Japanese encephalitis virus
AGSTLGKAFST

SEQ ID NO: 235712 - protein, 11 aa, Japanese encephalitis virus
GSTLGKAFSTT

SEQ ID NO: 235713 - protein, 11 aa, Japanese encephalitis virus
STLGKAFSTTL

SEQ ID NO: 235714 - protein, 11 aa, Japanese encephalitis virus
TLGKAFSTTLK

SEQ ID NO: 235715 - protein, 11 aa, Japanese encephalitis virus
LGKAFSTTLKG

SEQ ID NO: 235716 - protein, 11 aa, Japanese encephalitis virus
GKAFSTTLKGA

SEQ ID NO: 235717 - protein, 11 aa, Japanese encephalitis virus
KAFSTTLKGAQ

SEQ ID NO: 235718 - protein, 11 aa, Japanese encephalitis virus
AFSTTLKGAQR

SEQ ID NO: 235719 - protein, 11 aa, Japanese encephalitis virus
FSTTLKGAQRL

SEQ ID NO: 235720 - protein, 11 aa, Japanese encephalitis virus
STTLKGAQRLA

SEQ ID NO: 235721 - protein, 11 aa, Japanese encephalitis virus
TTLKGAQRLAA

SEQ ID NO: 235722 - protein, 11 aa, Japanese encephalitis virus
TLKGAQRLAAL

SEQ ID NO: 235723 - protein, 11 aa, Japanese encephalitis virus
LKGAQRLAALG

SEQ ID NO: 235724 - protein, 11 aa, Japanese encephalitis virus
KGAQRLAALGD

SEQ ID NO: 235725 - protein, 11 aa, Japanese encephalitis virus
GAQRLAALGDT

SEQ ID NO: 235726 - protein, 11 aa, Japanese encephalitis virus
AQRLAALGDTA

SEQ ID NO: 235727 - protein, 11 aa, Japanese encephalitis virus
QRLAALGDTAW

SEQ ID NO: 235728 - protein, 11 aa, Japanese encephalitis virus
RLAALGDTAWD

SEQ ID NO: 235729 - protein, 11 aa, Japanese encephalitis virus
LAALGDTAWDF

SEQ ID NO: 235730 - protein, 11 aa, Japanese encephalitis virus
AALGDTAWDFG

SEQ ID NO: 235731 - protein, 11 aa, Japanese encephalitis virus
ALGDTAWDFGS

SEQ ID NO: 235732 - protein, 11 aa, Japanese encephalitis virus
LGDTAWDFGSI

SEQ ID NO: 235733 - protein, 11 aa, Japanese encephalitis virus
GDTAWDFGSIG

SEQ ID NO: 235734 - protein, 11 aa, Japanese encephalitis virus
DTAWDFGSIGG

SEQ ID NO: 235735 - protein, 11 aa, Japanese encephalitis virus
TAWDFGSIGGV

SEQ ID NO: 235736 - protein, 11 aa, Japanese encephalitis virus
AWDFGSIGGVF

SEQ ID NO: 235737 - protein, 11 aa, Japanese encephalitis virus
WDFGSIGGVFN

SEQ ID NO: 235738 - protein, 11 aa, Japanese encephalitis virus
DFGSIGGVFNS

SEQ ID NO: 235739 - protein, 11 aa, Japanese encephalitis virus
FGSIGGVFNSI

SEQ ID NO: 235740 - protein, 11 aa, Japanese encephalitis virus
GSIGGVFNSIG

SEQ ID NO: 235741 - protein, 11 aa, Japanese encephalitis virus
SIGGVFNSIGK

SEQ ID NO: 235742 - protein, 11 aa, Japanese encephalitis virus
IGGVFNSIGKA

SEQ ID NO: 235743 - protein, 11 aa, Japanese encephalitis virus
GGVFNSIGKAV

SEQ ID NO: 235744 - protein, 11 aa, Japanese encephalitis virus
GVFNSIGKAVH

SEQ ID NO: 235745 - protein, 11 aa, Japanese encephalitis virus
VFNSIGKAVHQ

SEQ ID NO: 235746 - protein, 11 aa, Japanese encephalitis virus
FNSIGKAVHQV

SEQ ID NO: 235747 - protein, 11 aa, Japanese encephalitis virus
NSIGKAVHQVF

SEQ ID NO: 235748 - protein, 11 aa, Japanese encephalitis virus
SIGKAVHQVFG

SEQ ID NO: 235749 - protein, 11 aa, Japanese encephalitis virus
IGKAVHQVFGG

SEQ ID NO: 235750 - protein, 11 aa, Japanese encephalitis virus
GKAVHQVFGGA

SEQ ID NO: 235751 - protein, 11 aa, Japanese encephalitis virus
KAVHQVFGGAF

SEQ ID NO: 235752 - protein, 11 aa, Japanese encephalitis virus
AVHQVFGGAFR

SEQ ID NO: 235753 - protein, 11 aa, Japanese encephalitis virus
VHQVFGGAFRT

SEQ ID NO: 235754 - protein, 11 aa, Japanese encephalitis virus
HQVFGGAFRTL

SEQ ID NO: 235755 - protein, 11 aa, Japanese encephalitis virus
QVFGGAFRTLF

SEQ ID NO: 235756 - protein, 11 aa, Japanese encephalitis virus
VFGGAFRTLFG

SEQ ID NO: 235757 - protein, 11 aa, Japanese encephalitis virus
FGGAFRTLFGG

SEQ ID NO: 235758 - protein, 11 aa, Japanese encephalitis virus
GGAFRTLFGGM

SEQ ID NO: 235759 - protein, 11 aa, Japanese encephalitis virus
GAFRTLFGGMS

SEQ ID NO: 235760 - protein, 11 aa, Japanese encephalitis virus
AFRTLFGGMSW

SEQ ID NO: 235761 - protein, 11 aa, Japanese encephalitis virus
FRTLFGGMSWI

SEQ ID NO: 235762 - protein, 11 aa, Japanese encephalitis virus
RTLFGGMSWIT

SEQ ID NO: 235763 - protein, 11 aa, Japanese encephalitis virus
TLFGGMSWITQ

SEQ ID NO: 235764 - protein, 11 aa, Japanese encephalitis virus
LFGGMSWITQG

SEQ ID NO: 235765 - protein, 11 aa, Japanese encephalitis virus
FGGMSWITQGL

SEQ ID NO: 235766 - protein, 11 aa, Japanese encephalitis virus
GGMSWITQGLM

SEQ ID NO: 235767 - protein, 11 aa, Japanese encephalitis virus
GMSWITQGLMG

SEQ ID NO: 235768 - protein, 11 aa, Japanese encephalitis virus
MSWITQGLMGA

SEQ ID NO: 235769 - protein, 11 aa, Japanese encephalitis virus
SWITQGLMGAL

SEQ ID NO: 235770 - protein, 11 aa, Japanese encephalitis virus
WITQGLMGALL

SEQ ID NO: 235771 - protein, 11 aa, Japanese encephalitis virus
ITQGLMGALLL

SEQ ID NO: 235772 - protein, 11 aa, Japanese encephalitis virus
TQGLMGALLLW

SEQ ID NO: 235773 - protein, 11 aa, Japanese encephalitis virus
QGLMGALLLWM

SEQ ID NO: 235774 - protein, 11 aa, Japanese encephalitis virus
GLMGALLLWMG

SEQ ID NO: 235775 - protein, 11 aa, Japanese encephalitis virus
LMGALLLWMGV

SEQ ID NO: 235776 - protein, 11 aa, Japanese encephalitis virus
MGALLLWMGVN

SEQ ID NO: 235777 - protein, 11 aa, Japanese encephalitis virus
GALLLWMGVNA

SEQ ID NO: 235778 - protein, 11 aa, Japanese encephalitis virus
ALLLWMGVNAR

SEQ ID NO: 235779 - protein, 11 aa, Japanese encephalitis virus
LLLWMGVNARD

SEQ ID NO: 235780 - protein, 11 aa, Japanese encephalitis virus
LLWMGVNARDR

SEQ ID NO: 235781 - protein, 11 aa, Japanese encephalitis virus
LWMGVNARDRS

SEQ ID NO: 235782 - protein, 11 aa, Japanese encephalitis virus
WMGVNARDRSI

SEQ ID NO: 235783 - protein, 11 aa, Japanese encephalitis virus
MGVNARDRSIA

SEQ ID NO: 235784 - protein, 11 aa, Japanese encephalitis virus
GVNARDRSIAL

SEQ ID NO: 235785 - protein, 11 aa, Japanese encephalitis virus
VNARDRSIALA

SEQ ID NO: 235786 - protein, 11 aa, Japanese encephalitis virus
NARDRSIALAF

SEQ ID NO: 235787 - protein, 11 aa, Japanese encephalitis virus
ARDRSIALAFL

SEQ ID NO: 235788 - protein, 11 aa, Japanese encephalitis virus
RDRSIALAFLA

SEQ ID NO: 235789 - protein, 11 aa, Japanese encephalitis virus
DRSIALAFLAT

SEQ ID NO: 235790 - protein, 11 aa, Japanese encephalitis virus
RSIALAFLATG

SEQ ID NO: 235791 - protein, 11 aa, Japanese encephalitis virus
SIALAFLATGG

SEQ ID NO: 235792 - protein, 11 aa, Japanese encephalitis virus
IALAFLATGGV

SEQ ID NO: 235793 - protein, 11 aa, Japanese encephalitis virus
ALAFLATGGVL

SEQ ID NO: 235794 - protein, 11 aa, Japanese encephalitis virus
LAFLATGGVLV

SEQ ID NO: 235795 - protein, 11 aa, Japanese encephalitis virus
AFLATGGVLVF

SEQ ID NO: 235796 - protein, 11 aa, Japanese encephalitis virus
FLATGGVLVFL

SEQ ID NO: 235797 - protein, 11 aa, Japanese encephalitis virus
LATGGVLVFLA

SEQ ID NO: 235798 - protein, 11 aa, Japanese encephalitis virus
ATGGVLVFLAT

SEQ ID NO: 235799 - protein, 11 aa, Japanese encephalitis virus
TGGVLVFLATN

SEQ ID NO: 235800 - protein, 11 aa, Japanese encephalitis virus
GGVLVFLATNV

SEQ ID NO: 235801 - protein, 11 aa, Japanese encephalitis virus
GVLVFLATNVH

SEQ ID NO: 235802 - protein, 11 aa, Japanese encephalitis virus
VLVFLATNVHA

SEQ ID NO: 235803 - protein, 11 aa, Japanese encephalitis virus
LVFLATNVHAD

SEQ ID NO: 235804 - protein, 11 aa, Japanese encephalitis virus
VFLATNVHADT

SEQ ID NO: 235805 - protein, 11 aa, Japanese encephalitis virus
FLATNVHADTG

SEQ ID NO: 235806 - protein, 11 aa, Japanese encephalitis virus
LATNVHADTGC

SEQ ID NO: 235807 - protein, 11 aa, Japanese encephalitis virus
ATNVHADTGCA

SEQ ID NO: 235808 - protein, 11 aa, Japanese encephalitis virus
TNVHADTGCAI

SEQ ID NO: 235809 - protein, 11 aa, Japanese encephalitis virus
NVHADTGCAID

SEQ ID NO: 235810 - protein, 11 aa, Japanese encephalitis virus
VHADTGCAIDI

SEQ ID NO: 235811 - protein, 11 aa, Japanese encephalitis virus
HADTGCAIDIT

SEQ ID NO: 235812 - protein, 11 aa, Japanese encephalitis virus
ADTGCAIDITR

SEQ ID NO: 235813 - protein, 11 aa, Japanese encephalitis virus
TRKEMRCGSGI

SEQ ID NO: 235814 - protein, 11 aa, Japanese encephalitis virus
RKEMRCGSGIF

SEQ ID NO: 235815 - protein, 11 aa, Japanese encephalitis virus
KEMRCGSGIFV

SEQ ID NO: 235816 - protein, 11 aa, Japanese encephalitis virus
EMRCGSGIFVH

SEQ ID NO: 235817 - protein, 11 aa, Japanese encephalitis virus
MRCGSGIFVHN

SEQ ID NO: 235818 - protein, 11 aa, Japanese encephalitis virus
RCGSGIFVHND

SEQ ID NO: 235819 - protein, 11 aa, Japanese encephalitis virus
CGSGIFVHNDV

SEQ ID NO: 235820 - protein, 11 aa, Japanese encephalitis virus
GSGIFVHNDVE

SEQ ID NO: 235821 - protein, 11 aa, Japanese encephalitis virus
SGIFVHNDVEA

SEQ ID NO: 235822 - protein, 11 aa, Japanese encephalitis virus
GIFVHNDVEAW

SEQ ID NO: 235823 - protein, 11 aa, Japanese encephalitis virus
IFVHNDVEAWV

SEQ ID NO: 235824 - protein, 11 aa, Japanese encephalitis virus
FVHNDVEAWVD

SEQ ID NO: 235825 - protein, 11 aa, Japanese encephalitis virus
VHNDVEAWVDR

SEQ ID NO: 235826 - protein, 11 aa, Japanese encephalitis virus
HNDVEAWVDRY

SEQ ID NO: 235827 - protein, 11 aa, Japanese encephalitis virus
NDVEAWVDRYK

SEQ ID NO: 235828 - protein, 11 aa, Japanese encephalitis virus
DVEAWVDRYKY

SEQ ID NO: 235829 - protein, 11 aa, Japanese encephalitis virus
VEAWVDRYKYL

SEQ ID NO: 235830 - protein, 11 aa, Japanese encephalitis virus
EAWVDRYKYLP

SEQ ID NO: 235831 - protein, 11 aa, Japanese encephalitis virus
AWVDRYKYLPE

SEQ ID NO: 235832 - protein, 11 aa, Japanese encephalitis virus
WVDRYKYLPET

SEQ ID NO: 235833 - protein, 11 aa, Japanese encephalitis virus
VDRYKYLPETP

SEQ ID NO: 235834 - protein, 11 aa, Japanese encephalitis virus
DRYKYLPETPR

SEQ ID NO: 235835 - protein, 11 aa, Japanese encephalitis virus
RYKYLPETPRS

SEQ ID NO: 235836 - protein, 11 aa, Japanese encephalitis virus
YKYLPETPRSL

SEQ ID NO: 235837 - protein, 11 aa, Japanese encephalitis virus
KYLPETPRSLA

SEQ ID NO: 235838 - protein, 11 aa, Japanese encephalitis virus
YLPETPRSLAK

SEQ ID NO: 235839 - protein, 11 aa, Japanese encephalitis virus
LPETPRSLAKI

SEQ ID NO: 235840 - protein, 11 aa, Japanese encephalitis virus
PETPRSLAKIV

SEQ ID NO: 235841 - protein, 11 aa, Japanese encephalitis virus
ETPRSLAKIVH

SEQ ID NO: 235842 - protein, 11 aa, Japanese encephalitis virus
TPRSLAKIVHK

SEQ ID NO: 235843 - protein, 11 aa, Japanese encephalitis virus
PRSLAKIVHKA

SEQ ID NO: 235844 - protein, 11 aa, Japanese encephalitis virus
RSLAKIVHKAH

SEQ ID NO: 235845 - protein, 11 aa, Japanese encephalitis virus
SLAKIVHKAHK

SEQ ID NO: 235846 - protein, 11 aa, Japanese encephalitis virus
LAKIVHKAHKE

SEQ ID NO: 235847 - protein, 11 aa, Japanese encephalitis virus
AKIVHKAHKEG

SEQ ID NO: 235848 - protein, 11 aa, Japanese encephalitis virus
KIVHKAHKEGV

SEQ ID NO: 235849 - protein, 11 aa, Japanese encephalitis virus
IVHKAHKEGVC

SEQ ID NO: 235850 - protein, 11 aa, Japanese encephalitis virus
VHKAHKEGVCG

SEQ ID NO: 235851 - protein, 11 aa, Japanese encephalitis virus
HKAHKEGVCGV

SEQ ID NO: 235852 - protein, 11 aa, Japanese encephalitis virus
KAHKEGVCGVR

SEQ ID NO: 235853 - protein, 11 aa, Japanese encephalitis virus
AHKEGVCGVRS

SEQ ID NO: 235854 - protein, 11 aa, Japanese encephalitis virus
HKEGVCGVRSV

SEQ ID NO: 235855 - protein, 11 aa, Japanese encephalitis virus
KEGVCGVRSVT

SEQ ID NO: 235856 - protein, 11 aa, Japanese encephalitis virus
EGVCGVRSVTR

SEQ ID NO: 235857 - protein, 11 aa, Japanese encephalitis virus
GVCGVRSVTRL

SEQ ID NO: 235858 - protein, 11 aa, Japanese encephalitis virus
VCGVRSVTRLE

SEQ ID NO: 235859 - protein, 11 aa, Japanese encephalitis virus
CGVRSVTRLEH

SEQ ID NO: 235860 - protein, 11 aa, Japanese encephalitis virus
GVRSVTRLEHQ

SEQ ID NO: 235861 - protein, 11 aa, Japanese encephalitis virus
VRSVTRLEHQM

SEQ ID NO: 235862 - protein, 11 aa, Japanese encephalitis virus
RSVTRLEHQMW

SEQ ID NO: 235863 - protein, 11 aa, Japanese encephalitis virus
SVTRLEHQMWE

SEQ ID NO: 235864 - protein, 11 aa, Japanese encephalitis virus
VTRLEHQMWEA

SEQ ID NO: 235865 - protein, 11 aa, Japanese encephalitis virus
TRLEHQMWEAV

SEQ ID NO: 235866 - protein, 11 aa, Japanese encephalitis virus
RLEHQMWEAVR

SEQ ID NO: 235867 - protein, 11 aa, Japanese encephalitis virus
LEHQMWEAVRD

SEQ ID NO: 235868 - protein, 11 aa, Japanese encephalitis virus
EHQMWEAVRDE

SEQ ID NO: 235869 - protein, 11 aa, Japanese encephalitis virus
HQMWEAVRDEL

SEQ ID NO: 235870 - protein, 11 aa, Japanese encephalitis virus
QMWEAVRDELN

SEQ ID NO: 235871 - protein, 11 aa, Japanese encephalitis virus
MWEAVRDELNV

SEQ ID NO: 235872 - protein, 11 aa, Japanese encephalitis virus
WEAVRDELNVL

SEQ ID NO: 235873 - protein, 11 aa, Japanese encephalitis virus
EAVRDELNVLL

SEQ ID NO: 235874 - protein, 11 aa, Japanese encephalitis virus
AVRDELNVLLK

SEQ ID NO: 235875 - protein, 11 aa, Japanese encephalitis virus
VRDELNVLLKE

SEQ ID NO: 235876 - protein, 11 aa, Japanese encephalitis virus
RDELNVLLKEN

SEQ ID NO: 235877 - protein, 11 aa, Japanese encephalitis virus
DELNVLLKENA

SEQ ID NO: 235878 - protein, 11 aa, Japanese encephalitis virus
ELNVLLKENAV

SEQ ID NO: 235879 - protein, 11 aa, Japanese encephalitis virus
LNVLLKENAVD

SEQ ID NO: 235880 - protein, 11 aa, Japanese encephalitis virus
NVLLKENAVDL

SEQ ID NO: 235881 - protein, 11 aa, Japanese encephalitis virus
VLLKENAVDLS

SEQ ID NO: 235882 - protein, 11 aa, Japanese encephalitis virus
LLKENAVDLSV

SEQ ID NO: 235883 - protein, 11 aa, Japanese encephalitis virus
LKENAVDLSVV

SEQ ID NO: 235884 - protein, 11 aa, Japanese encephalitis virus
KENAVDLSVVV

SEQ ID NO: 235885 - protein, 11 aa, Japanese encephalitis virus
ENAVDLSVVVN

SEQ ID NO: 235886 - protein, 11 aa, Japanese encephalitis virus
NAVDLSVVVNK

SEQ ID NO: 235887 - protein, 11 aa, Japanese encephalitis virus
AVDLSVVVNKP

SEQ ID NO: 235888 - protein, 11 aa, Japanese encephalitis virus
VDLSVVVNKPV

SEQ ID NO: 235889 - protein, 11 aa, Japanese encephalitis virus
DLSVVVNKPVG

SEQ ID NO: 235890 - protein, 11 aa, Japanese encephalitis virus
LSVVVNKPVGR

SEQ ID NO: 235891 - protein, 11 aa, Japanese encephalitis virus
SVVVNKPVGRY

SEQ ID NO: 235892 - protein, 11 aa, Japanese encephalitis virus
VVVNKPVGRYR

SEQ ID NO: 235893 - protein, 11 aa, Japanese encephalitis virus
VVNKPVGRYRS

SEQ ID NO: 235894 - protein, 11 aa, Japanese encephalitis virus
VNKPVGRYRSA

SEQ ID NO: 235895 - protein, 11 aa, Japanese encephalitis virus
NKPVGRYRSAP

SEQ ID NO: 235896 - protein, 11 aa, Japanese encephalitis virus
KPVGRYRSAPK

SEQ ID NO: 235897 - protein, 11 aa, Japanese encephalitis virus
PVGRYRSAPKR

SEQ ID NO: 235898 - protein, 11 aa, Japanese encephalitis virus
VGRYRSAPKRL

SEQ ID NO: 235899 - protein, 11 aa, Japanese encephalitis virus
GRYRSAPKRLS

SEQ ID NO: 235900 - protein, 11 aa, Japanese encephalitis virus
RYRSAPKRLSM

SEQ ID NO: 235901 - protein, 11 aa, Japanese encephalitis virus
YRSAPKRLSMT

SEQ ID NO: 235902 - protein, 11 aa, Japanese encephalitis virus
RSAPKRLSMTQ

SEQ ID NO: 235903 - protein, 11 aa, Japanese encephalitis virus
SAPKRLSMTQE

SEQ ID NO: 235904 - protein, 11 aa, Japanese encephalitis virus
APKRLSMTQEK

SEQ ID NO: 235905 - protein, 11 aa, Japanese encephalitis virus
PKRLSMTQEKF

SEQ ID NO: 235906 - protein, 11 aa, Japanese encephalitis virus
KRLSMTQEKFE

SEQ ID NO: 235907 - protein, 11 aa, Japanese encephalitis virus
RLSMTQEKFEM

SEQ ID NO: 235908 - protein, 11 aa, Japanese encephalitis virus
LSMTQEKFEMG

SEQ ID NO: 235909 - protein, 11 aa, Japanese encephalitis virus
SMTQEKFEMGW

SEQ ID NO: 235910 - protein, 11 aa, Japanese encephalitis virus
MTQEKFEMGWK

SEQ ID NO: 235911 - protein, 11 aa, Japanese encephalitis virus
TQEKFEMGWKA

SEQ ID NO: 235912 - protein, 11 aa, Japanese encephalitis virus
QEKFEMGWKAW

SEQ ID NO: 235913 - protein, 11 aa, Japanese encephalitis virus
EKFEMGWKAWG

SEQ ID NO: 235914 - protein, 11 aa, Japanese encephalitis virus
KFEMGWKAWGK

SEQ ID NO: 235915 - protein, 11 aa, Japanese encephalitis virus
FEMGWKAWGKS

SEQ ID NO: 235916 - protein, 11 aa, Japanese encephalitis virus
EMGWKAWGKSI

SEQ ID NO: 235917 - protein, 11 aa, Japanese encephalitis virus
MGWKAWGKSIL

SEQ ID NO: 235918 - protein, 11 aa, Japanese encephalitis virus
GWKAWGKSILF

SEQ ID NO: 235919 - protein, 11 aa, Japanese encephalitis virus
WKAWGKSILFA

SEQ ID NO: 235920 - protein, 11 aa, Japanese encephalitis virus
KAWGKSILFAP

SEQ ID NO: 235921 - protein, 11 aa, Japanese encephalitis virus
AWGKSILFAPE

SEQ ID NO: 235922 - protein, 11 aa, Japanese encephalitis virus
WGKSILFAPEL

SEQ ID NO: 235923 - protein, 11 aa, Japanese encephalitis virus
GKSILFAPELA

SEQ ID NO: 235924 - protein, 11 aa, Japanese encephalitis virus
KSILFAPELAN

SEQ ID NO: 235925 - protein, 11 aa, Japanese encephalitis virus
SILFAPELANS

SEQ ID NO: 235926 - protein, 11 aa, Japanese encephalitis virus
ILFAPELANST

SEQ ID NO: 235927 - protein, 11 aa, Japanese encephalitis virus
LFAPELANSTF

SEQ ID NO: 235928 - protein, 11 aa, Japanese encephalitis virus
FAPELANSTFV

SEQ ID NO: 235929 - protein, 11 aa, Japanese encephalitis virus
APELANSTFVV

SEQ ID NO: 235930 - protein, 11 aa, Japanese encephalitis virus
PELANSTFVVD

SEQ ID NO: 235931 - protein, 11 aa, Japanese encephalitis virus
ELANSTFVVDG

SEQ ID NO: 235932 - protein, 11 aa, Japanese encephalitis virus
LANSTFVVDGP

SEQ ID NO: 235933 - protein, 11 aa, Japanese encephalitis virus
ANSTFVVDGPE

SEQ ID NO: 235934 - protein, 11 aa, Japanese encephalitis virus
NSTFVVDGPET

SEQ ID NO: 235935 - protein, 11 aa, Japanese encephalitis virus
STFVVDGPETK

SEQ ID NO: 235936 - protein, 11 aa, Japanese encephalitis virus
TFVVDGPETKE

SEQ ID NO: 235937 - protein, 11 aa, Japanese encephalitis virus
FVVDGPETKEC

SEQ ID NO: 235938 - protein, 11 aa, Japanese encephalitis virus
VVDGPETKECP

SEQ ID NO: 235939 - protein, 11 aa, Japanese encephalitis virus
VDGPETKECPD

SEQ ID NO: 235940 - protein, 11 aa, Japanese encephalitis virus
DGPETKECPDE

SEQ ID NO: 235941 - protein, 11 aa, Japanese encephalitis virus
GPETKECPDEH

SEQ ID NO: 235942 - protein, 11 aa, Japanese encephalitis virus
PETKECPDEHR

SEQ ID NO: 235943 - protein, 11 aa, Japanese encephalitis virus
ETKECPDEHRA

SEQ ID NO: 235944 - protein, 11 aa, Japanese encephalitis virus
TKECPDEHRAW

SEQ ID NO: 235945 - protein, 11 aa, Japanese encephalitis virus
KECPDEHRAWN

SEQ ID NO: 235946 - protein, 11 aa, Japanese encephalitis virus
ECPDEHRAWNS

SEQ ID NO: 235947 - protein, 11 aa, Japanese encephalitis virus
CPDEHRAWNSM

SEQ ID NO: 235948 - protein, 11 aa, Japanese encephalitis virus
PDEHRAWNSMQ

SEQ ID NO: 235949 - protein, 11 aa, Japanese encephalitis virus
DEHRAWNSMQI

SEQ ID NO: 235950 - protein, 11 aa, Japanese encephalitis virus
EHRAWNSMQIE

SEQ ID NO: 235951 - protein, 11 aa, Japanese encephalitis virus
HRAWNSMQIED

SEQ ID NO: 235952 - protein, 11 aa, Japanese encephalitis virus
RAWNSMQIEDF

SEQ ID NO: 235953 - protein, 11 aa, Japanese encephalitis virus
AWNSMQIEDFG

SEQ ID NO: 235954 - protein, 11 aa, Japanese encephalitis virus
WNSMQIEDFGF

SEQ ID NO: 235955 - protein, 11 aa, Japanese encephalitis virus
NSMQIEDFGFG

SEQ ID NO: 235956 - protein, 11 aa, Japanese encephalitis virus
SMQIEDFGFGI

SEQ ID NO: 235957 - protein, 11 aa, Japanese encephalitis virus
MQIEDFGFGIT

SEQ ID NO: 235958 - protein, 11 aa, Japanese encephalitis virus
QIEDFGFGITS

SEQ ID NO: 235959 - protein, 11 aa, Japanese encephalitis virus
IEDFGFGITST

SEQ ID NO: 235960 - protein, 11 aa, Japanese encephalitis virus
EDFGFGITSTR

SEQ ID NO: 235961 - protein, 11 aa, Japanese encephalitis virus
DFGFGITSTRV

SEQ ID NO: 235962 - protein, 11 aa, Japanese encephalitis virus
FGFGITSTRVW

SEQ ID NO: 235963 - protein, 11 aa, Japanese encephalitis virus
GFGITSTRVWL

SEQ ID NO: 235964 - protein, 11 aa, Japanese encephalitis virus
FGITSTRVWLK

SEQ ID NO: 235965 - protein, 11 aa, Japanese encephalitis virus
GITSTRVWLKI

SEQ ID NO: 235966 - protein, 11 aa, Japanese encephalitis virus
ITSTRVWLKIR

SEQ ID NO: 235967 - protein, 11 aa, Japanese encephalitis virus
TSTRVWLKIRE

SEQ ID NO: 235968 - protein, 11 aa, Japanese encephalitis virus
STRVWLKIREE

SEQ ID NO: 235969 - protein, 11 aa, Japanese encephalitis virus
TRVWLKIREES

SEQ ID NO: 235970 - protein, 11 aa, Japanese encephalitis virus
RVWLKIREEST

SEQ ID NO: 235971 - protein, 11 aa, Japanese encephalitis virus
VWLKIREESTD

SEQ ID NO: 235972 - protein, 11 aa, Japanese encephalitis virus
WLKIREESTDE

SEQ ID NO: 235973 - protein, 11 aa, Japanese encephalitis virus
LKIREESTDEC

SEQ ID NO: 235974 - protein, 11 aa, Japanese encephalitis virus
KIREESTDECD

SEQ ID NO: 235975 - protein, 11 aa, Japanese encephalitis virus
IREESTDECDG

SEQ ID NO: 235976 - protein, 11 aa, Japanese encephalitis virus
REESTDECDGA

SEQ ID NO: 235977 - protein, 11 aa, Japanese encephalitis virus
EESTDECDGAI

SEQ ID NO: 235978 - protein, 11 aa, Japanese encephalitis virus
ESTDECDGAII

SEQ ID NO: 235979 - protein, 11 aa, Japanese encephalitis virus
STDECDGAIIG

SEQ ID NO: 235980 - protein, 11 aa, Japanese encephalitis virus
TDECDGAIIGT

SEQ ID NO: 235981 - protein, 11 aa, Japanese encephalitis virus
DECDGAIIGTA

SEQ ID NO: 235982 - protein, 11 aa, Japanese encephalitis virus
ECDGAIIGTAV

SEQ ID NO: 235983 - protein, 11 aa, Japanese encephalitis virus
CDGAIIGTAVK

SEQ ID NO: 235984 - protein, 11 aa, Japanese encephalitis virus
DGAIIGTAVKG

SEQ ID NO: 235985 - protein, 11 aa, Japanese encephalitis virus
GAIIGTAVKGH

SEQ ID NO: 235986 - protein, 11 aa, Japanese encephalitis virus
AIIGTAVKGHV

SEQ ID NO: 235987 - protein, 11 aa, Japanese encephalitis virus
IIGTAVKGHVA

SEQ ID NO: 235988 - protein, 11 aa, Japanese encephalitis virus
IGTAVKGHVAV

SEQ ID NO: 235989 - protein, 11 aa, Japanese encephalitis virus
GTAVKGHVAVH

SEQ ID NO: 235990 - protein, 11 aa, Japanese encephalitis virus
TAVKGHVAVHS

SEQ ID NO: 235991 - protein, 11 aa, Japanese encephalitis virus
AVKGHVAVHSD

SEQ ID NO: 235992 - protein, 11 aa, Japanese encephalitis virus
VKGHVAVHSDL

SEQ ID NO: 235993 - protein, 11 aa, Japanese encephalitis virus
KGHVAVHSDLS

SEQ ID NO: 235994 - protein, 11 aa, Japanese encephalitis virus
GHVAVHSDLSY

SEQ ID NO: 235995 - protein, 11 aa, Japanese encephalitis virus
HVAVHSDLSYW

SEQ ID NO: 235996 - protein, 11 aa, Japanese encephalitis virus
VAVHSDLSYWI

SEQ ID NO: 235997 - protein, 11 aa, Japanese encephalitis virus
AVHSDLSYWIE

SEQ ID NO: 235998 - protein, 11 aa, Japanese encephalitis virus
VHSDLSYWIES

SEQ ID NO: 235999 - protein, 11 aa, Japanese encephalitis virus
HSDLSYWIESR

SEQ ID NO: 236000 - protein, 11 aa, Japanese encephalitis virus
NDTWKLERAVF

SEQ ID NO: 236001 - protein, 11 aa, Japanese encephalitis virus
DTWKLERAVFG

SEQ ID NO: 236002 - protein, 11 aa, Japanese encephalitis virus
TWKLERAVFGE

SEQ ID NO: 236003 - protein, 11 aa, Japanese encephalitis virus
WKLERAVFGEV

SEQ ID NO: 236004 - protein, 11 aa, Japanese encephalitis virus
KLERAVFGEVK

SEQ ID NO: 236005 - protein, 11 aa, Japanese encephalitis virus
LERAVFGEVKS

SEQ ID NO: 236006 - protein, 11 aa, Japanese encephalitis virus
ERAVFGEVKSC

SEQ ID NO: 236007 - protein, 11 aa, Japanese encephalitis virus
RAVFGEVKSCT

SEQ ID NO: 236008 - protein, 11 aa, Japanese encephalitis virus
AVFGEVKSCTW

SEQ ID NO: 236009 - protein, 11 aa, Japanese encephalitis virus
VFGEVKSCTWP

SEQ ID NO: 236010 - protein, 11 aa, Japanese encephalitis virus
FGEVKSCTWPE

SEQ ID NO: 236011 - protein, 11 aa, Japanese encephalitis virus
GEVKSCTWPET

SEQ ID NO: 236012 - protein, 11 aa, Japanese encephalitis virus
EVKSCTWPETH

SEQ ID NO: 236013 - protein, 11 aa, Japanese encephalitis virus
VKSCTWPETHT

SEQ ID NO: 236014 - protein, 11 aa, Japanese encephalitis virus
KSCTWPETHTL

SEQ ID NO: 236015 - protein, 11 aa, Japanese encephalitis virus
SCTWPETHTLW

SEQ ID NO: 236016 - protein, 11 aa, Japanese encephalitis virus
CTWPETHTLWG

SEQ ID NO: 236017 - protein, 11 aa, Japanese encephalitis virus
TWPETHTLWGD

SEQ ID NO: 236018 - protein, 11 aa, Japanese encephalitis virus
WPETHTLWGDG

SEQ ID NO: 236019 - protein, 11 aa, Japanese encephalitis virus
PETHTLWGDGV

SEQ ID NO: 236020 - protein, 11 aa, Japanese encephalitis virus
ETHTLWGDGVE

SEQ ID NO: 236021 - protein, 11 aa, Japanese encephalitis virus
THTLWGDGVEE

SEQ ID NO: 236022 - protein, 11 aa, Japanese encephalitis virus
HTLWGDGVEES

SEQ ID NO: 236023 - protein, 11 aa, Japanese encephalitis virus
TLWGDGVEESE

SEQ ID NO: 236024 - protein, 11 aa, Japanese encephalitis virus
LWGDGVEESEL

SEQ ID NO: 236025 - protein, 11 aa, Japanese encephalitis virus
WGDGVEESELI

SEQ ID NO: 236026 - protein, 11 aa, Japanese encephalitis virus
GDGVEESELII

SEQ ID NO: 236027 - protein, 11 aa, Japanese encephalitis virus
DGVEESELIIP

SEQ ID NO: 236028 - protein, 11 aa, Japanese encephalitis virus
GVEESELIIPH

SEQ ID NO: 236029 - protein, 11 aa, Japanese encephalitis virus
VEESELIIPHT

SEQ ID NO: 236030 - protein, 11 aa, Japanese encephalitis virus
EESELIIPHTI

SEQ ID NO: 236031 - protein, 11 aa, Japanese encephalitis virus
ESELIIPHTIA

SEQ ID NO: 236032 - protein, 11 aa, Japanese encephalitis virus
SELIIPHTIAG

SEQ ID NO: 236033 - protein, 11 aa, Japanese encephalitis virus
ELIIPHTIAGP

SEQ ID NO: 236034 - protein, 11 aa, Japanese encephalitis virus
LIIPHTIAGPK

SEQ ID NO: 236035 - protein, 11 aa, Japanese encephalitis virus
IIPHTIAGPKS

SEQ ID NO: 236036 - protein, 11 aa, Japanese encephalitis virus
IPHTIAGPKSK

SEQ ID NO: 236037 - protein, 11 aa, Japanese encephalitis virus
PHTIAGPKSKH

SEQ ID NO: 236038 - protein, 11 aa, Japanese encephalitis virus
HTIAGPKSKHN

SEQ ID NO: 236039 - protein, 11 aa, Japanese encephalitis virus
TIAGPKSKHNR

SEQ ID NO: 236040 - protein, 11 aa, Japanese encephalitis virus
IAGPKSKHNRR

SEQ ID NO: 236041 - protein, 11 aa, Japanese encephalitis virus
AGPKSKHNRRE

SEQ ID NO: 236042 - protein, 11 aa, Japanese encephalitis virus
GPKSKHNRREG

SEQ ID NO: 236043 - protein, 11 aa, Japanese encephalitis virus
PKSKHNRREGY

SEQ ID NO: 236044 - protein, 11 aa, Japanese encephalitis virus
KSKHNRREGYK

SEQ ID NO: 236045 - protein, 11 aa, Japanese encephalitis virus
SKHNRREGYKT

SEQ ID NO: 236046 - protein, 11 aa, Japanese encephalitis virus
KHNRREGYKTQ

SEQ ID NO: 236047 - protein, 11 aa, Japanese encephalitis virus
HNRREGYKTQN

SEQ ID NO: 236048 - protein, 11 aa, Japanese encephalitis virus
NRREGYKTQNQ

SEQ ID NO: 236049 - protein, 11 aa, Japanese encephalitis virus
RREGYKTQNQG

SEQ ID NO: 236050 - protein, 11 aa, Japanese encephalitis virus
REGYKTQNQGP

SEQ ID NO: 236051 - protein, 11 aa, Japanese encephalitis virus
EGYKTQNQGPW

SEQ ID NO: 236052 - protein, 11 aa, Japanese encephalitis virus
GYKTQNQGPWD

SEQ ID NO: 236053 - protein, 11 aa, Japanese encephalitis virus
YKTQNQGPWDE

SEQ ID NO: 236054 - protein, 11 aa, Japanese encephalitis virus
TQNQGPWDENG

SEQ ID NO: 236055 - protein, 11 aa, Japanese encephalitis virus
QNQGPWDENGI

SEQ ID NO: 236056 - protein, 11 aa, Japanese encephalitis virus
NQGPWDENGIV

SEQ ID NO: 236057 - protein, 11 aa, Japanese encephalitis virus
QGPWDENGIVL

SEQ ID NO: 236058 - protein, 11 aa, Japanese encephalitis virus
GPWDENGIVLD

SEQ ID NO: 236059 - protein, 11 aa, Japanese encephalitis virus
PWDENGIVLDF

SEQ ID NO: 236060 - protein, 11 aa, Japanese encephalitis virus
WDENGIVLDFD

SEQ ID NO: 236061 - protein, 11 aa, Japanese encephalitis virus
DENGIVLDFDY

SEQ ID NO: 236062 - protein, 11 aa, Japanese encephalitis virus
ENGIVLDFDYC

SEQ ID NO: 236063 - protein, 11 aa, Japanese encephalitis virus
NGIVLDFDYCP

SEQ ID NO: 236064 - protein, 11 aa, Japanese encephalitis virus
GIVLDFDYCPG

SEQ ID NO: 236065 - protein, 11 aa, Japanese encephalitis virus
IVLDFDYCPGT

SEQ ID NO: 236066 - protein, 11 aa, Japanese encephalitis virus
VLDFDYCPGTK

SEQ ID NO: 236067 - protein, 11 aa, Japanese encephalitis virus
LDFDYCPGTKV

SEQ ID NO: 236068 - protein, 11 aa, Japanese encephalitis virus
DFDYCPGTKVT

SEQ ID NO: 236069 - protein, 11 aa, Japanese encephalitis virus
FDYCPGTKVTI

SEQ ID NO: 236070 - protein, 11 aa, Japanese encephalitis virus
DYCPGTKVTIT

SEQ ID NO: 236071 - protein, 11 aa, Japanese encephalitis virus
YCPGTKVTITE

SEQ ID NO: 236072 - protein, 11 aa, Japanese encephalitis virus
CPGTKVTITED

SEQ ID NO: 236073 - protein, 11 aa, Japanese encephalitis virus
PGTKVTITEDC

SEQ ID NO: 236074 - protein, 11 aa, Japanese encephalitis virus
GTKVTITEDCG

SEQ ID NO: 236075 - protein, 11 aa, Japanese encephalitis virus
TKVTITEDCGK

SEQ ID NO: 236076 - protein, 11 aa, Japanese encephalitis virus
KVTITEDCGKR

SEQ ID NO: 236077 - protein, 11 aa, Japanese encephalitis virus
VTITEDCGKRG

SEQ ID NO: 236078 - protein, 11 aa, Japanese encephalitis virus
TITEDCGKRGP

SEQ ID NO: 236079 - protein, 11 aa, Japanese encephalitis virus
ITEDCGKRGPS

SEQ ID NO: 236080 - protein, 11 aa, Japanese encephalitis virus
TEDCGKRGPSV

SEQ ID NO: 236081 - protein, 11 aa, Japanese encephalitis virus
EDCGKRGPSVR

SEQ ID NO: 236082 - protein, 11 aa, Japanese encephalitis virus
DCGKRGPSVRT

SEQ ID NO: 236083 - protein, 11 aa, Japanese encephalitis virus
CGKRGPSVRTT

SEQ ID NO: 236084 - protein, 11 aa, Japanese encephalitis virus
GKRGPSVRTTT

SEQ ID NO: 236085 - protein, 11 aa, Japanese encephalitis virus
KRGPSVRTTTD

SEQ ID NO: 236086 - protein, 11 aa, Japanese encephalitis virus
RGPSVRTTTDS

SEQ ID NO: 236087 - protein, 11 aa, Japanese encephalitis virus
GPSVRTTTDSG

SEQ ID NO: 236088 - protein, 11 aa, Japanese encephalitis virus
PSVRTTTDSGK

SEQ ID NO: 236089 - protein, 11 aa, Japanese encephalitis virus
SVRTTTDSGKL

SEQ ID NO: 236090 - protein, 11 aa, Japanese encephalitis virus
VRTTTDSGKLI

SEQ ID NO: 236091 - protein, 11 aa, Japanese encephalitis virus
RTTTDSGKLIT

SEQ ID NO: 236092 - protein, 11 aa, Japanese encephalitis virus
TTTDSGKLITD

SEQ ID NO: 236093 - protein, 11 aa, Japanese encephalitis virus
TTDSGKLITDW

SEQ ID NO: 236094 - protein, 11 aa, Japanese encephalitis virus
TDSGKLITDWC

SEQ ID NO: 236095 - protein, 11 aa, Japanese encephalitis virus
DSGKLITDWCC

SEQ ID NO: 236096 - protein, 11 aa, Japanese encephalitis virus
SGKLITDWCCR

SEQ ID NO: 236097 - protein, 11 aa, Japanese encephalitis virus
GKLITDWCCRS

SEQ ID NO: 236098 - protein, 11 aa, Japanese encephalitis virus
KLITDWCCRSC

SEQ ID NO: 236099 - protein, 11 aa, Japanese encephalitis virus
LITDWCCRSCS

SEQ ID NO: 236100 - protein, 11 aa, Japanese encephalitis virus
ITDWCCRSCSL

SEQ ID NO: 236101 - protein, 11 aa, Japanese encephalitis virus
TDWCCRSCSLP

SEQ ID NO: 236102 - protein, 11 aa, Japanese encephalitis virus
DWCCRSCSLPP

SEQ ID NO: 236103 - protein, 11 aa, Japanese encephalitis virus
WCCRSCSLPPL

SEQ ID NO: 236104 - protein, 11 aa, Japanese encephalitis virus
CCRSCSLPPLR

SEQ ID NO: 236105 - protein, 11 aa, Japanese encephalitis virus
CRSCSLPPLRF

SEQ ID NO: 236106 - protein, 11 aa, Japanese encephalitis virus
RSCSLPPLRFR

SEQ ID NO: 236107 - protein, 11 aa, Japanese encephalitis virus
SCSLPPLRFRT

SEQ ID NO: 236108 - protein, 11 aa, Japanese encephalitis virus
CSLPPLRFRTE

SEQ ID NO: 236109 - protein, 11 aa, Japanese encephalitis virus
SLPPLRFRTEN

SEQ ID NO: 236110 - protein, 11 aa, Japanese encephalitis virus
LPPLRFRTENG

SEQ ID NO: 236111 - protein, 11 aa, Japanese encephalitis virus
PPLRFRTENGC

SEQ ID NO: 236112 - protein, 11 aa, Japanese encephalitis virus
PLRFRTENGCW

SEQ ID NO: 236113 - protein, 11 aa, Japanese encephalitis virus
LRFRTENGCWY

SEQ ID NO: 236114 - protein, 11 aa, Japanese encephalitis virus
RFRTENGCWYG

SEQ ID NO: 236115 - protein, 11 aa, Japanese encephalitis virus
FRTENGCWYGM

SEQ ID NO: 236116 - protein, 11 aa, Japanese encephalitis virus
RTENGCWYGME

SEQ ID NO: 236117 - protein, 11 aa, Japanese encephalitis virus
TENGCWYGMEI

SEQ ID NO: 236118 - protein, 11 aa, Japanese encephalitis virus
ENGCWYGMEIR

SEQ ID NO: 236119 - protein, 11 aa, Japanese encephalitis virus
NGCWYGMEIRP

SEQ ID NO: 236120 - protein, 11 aa, Japanese encephalitis virus
GCWYGMEIRPV

SEQ ID NO: 236121 - protein, 11 aa, Japanese encephalitis virus
HDETTLVRSQV

SEQ ID NO: 236122 - protein, 11 aa, Japanese encephalitis virus
GEMVDPFQLGL

SEQ ID NO: 236123 - protein, 11 aa, Japanese encephalitis virus
EMVDPFQLGLL

SEQ ID NO: 236124 - protein, 11 aa, Japanese encephalitis virus
MVDPFQLGLLV

SEQ ID NO: 236125 - protein, 11 aa, Japanese encephalitis virus
VDPFQLGLLVM

SEQ ID NO: 236126 - protein, 11 aa, Japanese encephalitis virus
DPFQLGLLVMF

SEQ ID NO: 236127 - protein, 11 aa, Japanese encephalitis virus
PFQLGLLVMFL

SEQ ID NO: 236128 - protein, 11 aa, Japanese encephalitis virus
FQLGLLVMFLA

SEQ ID NO: 236129 - protein, 11 aa, Japanese encephalitis virus
QLGLLVMFLAT

SEQ ID NO: 236130 - protein, 11 aa, Japanese encephalitis virus
LGLLVMFLATQ

SEQ ID NO: 236131 - protein, 11 aa, Japanese encephalitis virus
GLLVMFLATQE

SEQ ID NO: 236132 - protein, 11 aa, Japanese encephalitis virus
LLVMFLATQEV

SEQ ID NO: 236133 - protein, 11 aa, Japanese encephalitis virus
LVMFLATQEVL

SEQ ID NO: 236134 - protein, 11 aa, Japanese encephalitis virus
VMFLATQEVLR

SEQ ID NO: 236135 - protein, 11 aa, Japanese encephalitis virus
MFLATQEVLRK

SEQ ID NO: 236136 - protein, 11 aa, Japanese encephalitis virus
FLATQEVLRKR

SEQ ID NO: 236137 - protein, 11 aa, Japanese encephalitis virus
LATQEVLRKRW

SEQ ID NO: 236138 - protein, 11 aa, Japanese encephalitis virus
ATQEVLRKRWT

SEQ ID NO: 236139 - protein, 11 aa, Japanese encephalitis virus
TQEVLRKRWTA

SEQ ID NO: 236140 - protein, 11 aa, Japanese encephalitis virus
QEVLRKRWTAR

SEQ ID NO: 236141 - protein, 11 aa, Japanese encephalitis virus
EVLRKRWTARL

SEQ ID NO: 236142 - protein, 11 aa, Japanese encephalitis virus
VLRKRWTARLT

SEQ ID NO: 236143 - protein, 11 aa, Japanese encephalitis virus
LRKRWTARLTI

SEQ ID NO: 236144 - protein, 11 aa, Japanese encephalitis virus
RKRWTARLTIP

SEQ ID NO: 236145 - protein, 11 aa, Japanese encephalitis virus
KRWTARLTIPA

SEQ ID NO: 236146 - protein, 11 aa, Japanese encephalitis virus
RWTARLTIPAV

SEQ ID NO: 236147 - protein, 11 aa, Japanese encephalitis virus
WTARLTIPAVL

SEQ ID NO: 236148 - protein, 11 aa, Japanese encephalitis virus
TARLTIPAVLG

SEQ ID NO: 236149 - protein, 11 aa, Japanese encephalitis virus
ARLTIPAVLGA

SEQ ID NO: 236150 - protein, 11 aa, Japanese encephalitis virus
RLTIPAVLGAL

SEQ ID NO: 236151 - protein, 11 aa, Japanese encephalitis virus
LTIPAVLGALL

SEQ ID NO: 236152 - protein, 11 aa, Japanese encephalitis virus
TIPAVLGALLV

SEQ ID NO: 236153 - protein, 11 aa, Japanese encephalitis virus
IPAVLGALLVL

SEQ ID NO: 236154 - protein, 11 aa, Japanese encephalitis virus
PAVLGALLVLM

SEQ ID NO: 236155 - protein, 11 aa, Japanese encephalitis virus
AVLGALLVLML

SEQ ID NO: 236156 - protein, 11 aa, Japanese encephalitis virus
VLGALLVLMLG

SEQ ID NO: 236157 - protein, 11 aa, Japanese encephalitis virus
LGALLVLMLGG

SEQ ID NO: 236158 - protein, 11 aa, Japanese encephalitis virus
GALLVLMLGGI

SEQ ID NO: 236159 - protein, 11 aa, Japanese encephalitis virus
ALLVLMLGGIT

SEQ ID NO: 236160 - protein, 11 aa, Japanese encephalitis virus
LLVLMLGGITY

SEQ ID NO: 236161 - protein, 11 aa, Japanese encephalitis virus
LVLMLGGITYT

SEQ ID NO: 236162 - protein, 11 aa, Japanese encephalitis virus
VLMLGGITYTD

SEQ ID NO: 236163 - protein, 11 aa, Japanese encephalitis virus
LMLGGITYTDL

SEQ ID NO: 236164 - protein, 11 aa, Japanese encephalitis virus
MLGGITYTDLA

SEQ ID NO: 236165 - protein, 11 aa, Japanese encephalitis virus
LGGITYTDLAR

SEQ ID NO: 236166 - protein, 11 aa, Japanese encephalitis virus
GGITYTDLARY

SEQ ID NO: 236167 - protein, 11 aa, Japanese encephalitis virus
GITYTDLARYV

SEQ ID NO: 236168 - protein, 11 aa, Japanese encephalitis virus
ITYTDLARYVV

SEQ ID NO: 236169 - protein, 11 aa, Japanese encephalitis virus
TYTDLARYVVL

SEQ ID NO: 236170 - protein, 11 aa, Japanese encephalitis virus
YTDLARYVVLV

SEQ ID NO: 236171 - protein, 11 aa, Japanese encephalitis virus
TDLARYVVLVA

SEQ ID NO: 236172 - protein, 11 aa, Japanese encephalitis virus
DLARYVVLVAA

SEQ ID NO: 236173 - protein, 11 aa, Japanese encephalitis virus
LARYVVLVAAA

SEQ ID NO: 236174 - protein, 11 aa, Japanese encephalitis virus
ARYVVLVAAAF

SEQ ID NO: 236175 - protein, 11 aa, Japanese encephalitis virus
RYVVLVAAAFA

SEQ ID NO: 236176 - protein, 11 aa, Japanese encephalitis virus
YVVLVAAAFAE

SEQ ID NO: 236177 - protein, 11 aa, Japanese encephalitis virus
VVLVAAAFAEA

SEQ ID NO: 236178 - protein, 11 aa, Japanese encephalitis virus
VLVAAAFAEAN

SEQ ID NO: 236179 - protein, 11 aa, Japanese encephalitis virus
LVAAAFAEANS

SEQ ID NO: 236180 - protein, 11 aa, Japanese encephalitis virus
VAAAFAEANSG

SEQ ID NO: 236181 - protein, 11 aa, Japanese encephalitis virus
AAAFAEANSGG

SEQ ID NO: 236182 - protein, 11 aa, Japanese encephalitis virus
AAFAEANSGGD

SEQ ID NO: 236183 - protein, 11 aa, Japanese encephalitis virus
AFAEANSGGDV

SEQ ID NO: 236184 - protein, 11 aa, Japanese encephalitis virus
FAEANSGGDVL

SEQ ID NO: 236185 - protein, 11 aa, Japanese encephalitis virus
AEANSGGDVLH

SEQ ID NO: 236186 - protein, 11 aa, Japanese encephalitis virus
EANSGGDVLHL

SEQ ID NO: 236187 - protein, 11 aa, Japanese encephalitis virus
ANSGGDVLHLA

SEQ ID NO: 236188 - protein, 11 aa, Japanese encephalitis virus
NSGGDVLHLAL

SEQ ID NO: 236189 - protein, 11 aa, Japanese encephalitis virus
SGGDVLHLALI

SEQ ID NO: 236190 - protein, 11 aa, Japanese encephalitis virus
GGDVLHLALIA

SEQ ID NO: 236191 - protein, 11 aa, Japanese encephalitis virus
GDVLHLALIAV

SEQ ID NO: 236192 - protein, 11 aa, Japanese encephalitis virus
DVLHLALIAVF

SEQ ID NO: 236193 - protein, 11 aa, Japanese encephalitis virus
VLHLALIAVFK

SEQ ID NO: 236194 - protein, 11 aa, Japanese encephalitis virus
LHLALIAVFKI

SEQ ID NO: 236195 - protein, 11 aa, Japanese encephalitis virus
HLALIAVFKIQ

SEQ ID NO: 236196 - protein, 11 aa, Japanese encephalitis virus
LALIAVFKIQP

SEQ ID NO: 236197 - protein, 11 aa, Japanese encephalitis virus
ALIAVFKIQPA

SEQ ID NO: 236198 - protein, 11 aa, Japanese encephalitis virus
LIAVFKIQPAF

SEQ ID NO: 236199 - protein, 11 aa, Japanese encephalitis virus
IAVFKIQPAFL

SEQ ID NO: 236200 - protein, 11 aa, Japanese encephalitis virus
AVFKIQPAFLV

SEQ ID NO: 236201 - protein, 11 aa, Japanese encephalitis virus
VFKIQPAFLVM

SEQ ID NO: 236202 - protein, 11 aa, Japanese encephalitis virus
FKIQPAFLVMN

SEQ ID NO: 236203 - protein, 11 aa, Japanese encephalitis virus
KIQPAFLVMNM

SEQ ID NO: 236204 - protein, 11 aa, Japanese encephalitis virus
IQPAFLVMNML

SEQ ID NO: 236205 - protein, 11 aa, Japanese encephalitis virus
QPAFLVMNMLS

SEQ ID NO: 236206 - protein, 11 aa, Japanese encephalitis virus
PAFLVMNMLST

SEQ ID NO: 236207 - protein, 11 aa, Japanese encephalitis virus
NMLSTRWTNQE

SEQ ID NO: 236208 - protein, 11 aa, Japanese encephalitis virus
MLSTRWTNQEN

SEQ ID NO: 236209 - protein, 11 aa, Japanese encephalitis virus
LSTRWTNQENV

SEQ ID NO: 236210 - protein, 11 aa, Japanese encephalitis virus
STRWTNQENVV

SEQ ID NO: 236211 - protein, 11 aa, Japanese encephalitis virus
TRWTNQENVVL

SEQ ID NO: 236212 - protein, 11 aa, Japanese encephalitis virus
RWTNQENVVLV

SEQ ID NO: 236213 - protein, 11 aa, Japanese encephalitis virus
WTNQENVVLVL

SEQ ID NO: 236214 - protein, 11 aa, Japanese encephalitis virus
TNQENVVLVLG

SEQ ID NO: 236215 - protein, 11 aa, Japanese encephalitis virus
NQENVVLVLGA

SEQ ID NO: 236216 - protein, 11 aa, Japanese encephalitis virus
QENVVLVLGAA

SEQ ID NO: 236217 - protein, 11 aa, Japanese encephalitis virus
ENVVLVLGAAF

SEQ ID NO: 236218 - protein, 11 aa, Japanese encephalitis virus
NVVLVLGAAFF

SEQ ID NO: 236219 - protein, 11 aa, Japanese encephalitis virus
VVLVLGAAFFQ

SEQ ID NO: 236220 - protein, 11 aa, Japanese encephalitis virus
VLVLGAAFFQL

SEQ ID NO: 236221 - protein, 11 aa, Japanese encephalitis virus
LVLGAAFFQLA

SEQ ID NO: 236222 - protein, 11 aa, Japanese encephalitis virus
VLGAAFFQLAS

SEQ ID NO: 236223 - protein, 11 aa, Japanese encephalitis virus
LGAAFFQLASV

SEQ ID NO: 236224 - protein, 11 aa, Japanese encephalitis virus
GAAFFQLASVD

SEQ ID NO: 236225 - protein, 11 aa, Japanese encephalitis virus
AAFFQLASVDL

SEQ ID NO: 236226 - protein, 11 aa, Japanese encephalitis virus
AFFQLASVDLQ

SEQ ID NO: 236227 - protein, 11 aa, Japanese encephalitis virus
FFQLASVDLQI

SEQ ID NO: 236228 - protein, 11 aa, Japanese encephalitis virus
FQLASVDLQIG

SEQ ID NO: 236229 - protein, 11 aa, Japanese encephalitis virus
QLASVDLQIGV

SEQ ID NO: 236230 - protein, 11 aa, Japanese encephalitis virus
LASVDLQIGVH

SEQ ID NO: 236231 - protein, 11 aa, Japanese encephalitis virus
ASVDLQIGVHG

SEQ ID NO: 236232 - protein, 11 aa, Japanese encephalitis virus
SVDLQIGVHGI

SEQ ID NO: 236233 - protein, 11 aa, Japanese encephalitis virus
VDLQIGVHGIL

SEQ ID NO: 236234 - protein, 11 aa, Japanese encephalitis virus
DLQIGVHGILN

SEQ ID NO: 236235 - protein, 11 aa, Japanese encephalitis virus
LQIGVHGILNA

SEQ ID NO: 236236 - protein, 11 aa, Japanese encephalitis virus
QIGVHGILNAA

SEQ ID NO: 236237 - protein, 11 aa, Japanese encephalitis virus
IGVHGILNAAA

SEQ ID NO: 236238 - protein, 11 aa, Japanese encephalitis virus
GVHGILNAAAI

SEQ ID NO: 236239 - protein, 11 aa, Japanese encephalitis virus
VHGILNAAAIA

SEQ ID NO: 236240 - protein, 11 aa, Japanese encephalitis virus
HGILNAAAIAW

SEQ ID NO: 236241 - protein, 11 aa, Japanese encephalitis virus
GILNAAAIAWM

SEQ ID NO: 236242 - protein, 11 aa, Japanese encephalitis virus
ILNAAAIAWMI

SEQ ID NO: 236243 - protein, 11 aa, Japanese encephalitis virus
LNAAAIAWMIV

SEQ ID NO: 236244 - protein, 11 aa, Japanese encephalitis virus
NAAAIAWMIVR

SEQ ID NO: 236245 - protein, 11 aa, Japanese encephalitis virus
AAAIAWMIVRA

SEQ ID NO: 236246 - protein, 11 aa, Japanese encephalitis virus
AAIAWMIVRAI

SEQ ID NO: 236247 - protein, 11 aa, Japanese encephalitis virus
AIAWMIVRAIT

SEQ ID NO: 236248 - protein, 11 aa, Japanese encephalitis virus
IAWMIVRAITF

SEQ ID NO: 236249 - protein, 11 aa, Japanese encephalitis virus
AWMIVRAITFP

SEQ ID NO: 236250 - protein, 11 aa, Japanese encephalitis virus
WMIVRAITFPT

SEQ ID NO: 236251 - protein, 11 aa, Japanese encephalitis virus
MIVRAITFPTT

SEQ ID NO: 236252 - protein, 11 aa, Japanese encephalitis virus
IVRAITFPTTS

SEQ ID NO: 236253 - protein, 11 aa, Japanese encephalitis virus
VRAITFPTTSS

SEQ ID NO: 236254 - protein, 11 aa, Japanese encephalitis virus
RAITFPTTSSV

SEQ ID NO: 236255 - protein, 11 aa, Japanese encephalitis virus
AITFPTTSSVT

SEQ ID NO: 236256 - protein, 11 aa, Japanese encephalitis virus
ITFPTTSSVTM

SEQ ID NO: 236257 - protein, 11 aa, Japanese encephalitis virus
TFPTTSSVTMP

SEQ ID NO: 236258 - protein, 11 aa, Japanese encephalitis virus
MPVLALLTPGM

SEQ ID NO: 236259 - protein, 11 aa, Japanese encephalitis virus
PVLALLTPGMR

SEQ ID NO: 236260 - protein, 11 aa, Japanese encephalitis virus
VLALLTPGMRA

SEQ ID NO: 236261 - protein, 11 aa, Japanese encephalitis virus
LALLTPGMRAL

SEQ ID NO: 236262 - protein, 11 aa, Japanese encephalitis virus
LLTPGMRALYL

SEQ ID NO: 236263 - protein, 11 aa, Japanese encephalitis virus
LTPGMRALYLD

SEQ ID NO: 236264 - protein, 11 aa, Japanese encephalitis virus
TPGMRALYLDT

SEQ ID NO: 236265 - protein, 11 aa, Japanese encephalitis virus
PGMRALYLDTY

SEQ ID NO: 236266 - protein, 11 aa, Japanese encephalitis virus
GMRALYLDTYR

SEQ ID NO: 236267 - protein, 11 aa, Japanese encephalitis virus
MRALYLDTYRI

SEQ ID NO: 236268 - protein, 11 aa, Japanese encephalitis virus
RALYLDTYRII

SEQ ID NO: 236269 - protein, 11 aa, Japanese encephalitis virus
ALYLDTYRIIL

SEQ ID NO: 236270 - protein, 11 aa, Japanese encephalitis virus
LYLDTYRIILL

SEQ ID NO: 236271 - protein, 11 aa, Japanese encephalitis virus
YLDTYRIILLV

SEQ ID NO: 236272 - protein, 11 aa, Japanese encephalitis virus
LDTYRIILLVI

SEQ ID NO: 236273 - protein, 11 aa, Japanese encephalitis virus
DTYRIILLVIG

SEQ ID NO: 236274 - protein, 11 aa, Japanese encephalitis virus
TYRIILLVIGI

SEQ ID NO: 236275 - protein, 11 aa, Japanese encephalitis virus
YRIILLVIGIC

SEQ ID NO: 236276 - protein, 11 aa, Japanese encephalitis virus
RIILLVIGICS

SEQ ID NO: 236277 - protein, 11 aa, Japanese encephalitis virus
IILLVIGICSL

SEQ ID NO: 236278 - protein, 11 aa, Japanese encephalitis virus
ILLVIGICSLL

SEQ ID NO: 236279 - protein, 11 aa, Japanese encephalitis virus
LLVIGICSLLQ

SEQ ID NO: 236280 - protein, 11 aa, Japanese encephalitis virus
LVIGICSLLQE

SEQ ID NO: 236281 - protein, 11 aa, Japanese encephalitis virus
VIGICSLLQER

SEQ ID NO: 236282 - protein, 11 aa, Japanese encephalitis virus
ERKKTMAKKKG

SEQ ID NO: 236283 - protein, 11 aa, Japanese encephalitis virus
RKKTMAKKKGA

SEQ ID NO: 236284 - protein, 11 aa, Japanese encephalitis virus
KKTMAKKKGAV

SEQ ID NO: 236285 - protein, 11 aa, Japanese encephalitis virus
KTMAKKKGAVL

SEQ ID NO: 236286 - protein, 11 aa, Japanese encephalitis virus
TMAKKKGAVLL

SEQ ID NO: 236287 - protein, 11 aa, Japanese encephalitis virus
MAKKKGAVLLG

SEQ ID NO: 236288 - protein, 11 aa, Japanese encephalitis virus
AKKKGAVLLGL

SEQ ID NO: 236289 - protein, 11 aa, Japanese encephalitis virus
KKKGAVLLGLA

SEQ ID NO: 236290 - protein, 11 aa, Japanese encephalitis virus
KKGAVLLGLAL

SEQ ID NO: 236291 - protein, 11 aa, Japanese encephalitis virus
KGAVLLGLALT

SEQ ID NO: 236292 - protein, 11 aa, Japanese encephalitis virus
GAVLLGLALTS

SEQ ID NO: 236293 - protein, 11 aa, Japanese encephalitis virus
AVLLGLALTST

SEQ ID NO: 236294 - protein, 11 aa, Japanese encephalitis virus
VLLGLALTSTG

SEQ ID NO: 236295 - protein, 11 aa, Japanese encephalitis virus
LLGLALTSTGW

SEQ ID NO: 236296 - protein, 11 aa, Japanese encephalitis virus
LGLALTSTGWF

SEQ ID NO: 236297 - protein, 11 aa, Japanese encephalitis virus
GLALTSTGWFS

SEQ ID NO: 236298 - protein, 11 aa, Japanese encephalitis virus
LALTSTGWFSP

SEQ ID NO: 236299 - protein, 11 aa, Japanese encephalitis virus
ALTSTGWFSPT

SEQ ID NO: 236300 - protein, 11 aa, Japanese encephalitis virus
LTSTGWFSPTT

SEQ ID NO: 236301 - protein, 11 aa, Japanese encephalitis virus
TSTGWFSPTTI

SEQ ID NO: 236302 - protein, 11 aa, Japanese encephalitis virus
STGWFSPTTIA

SEQ ID NO: 236303 - protein, 11 aa, Japanese encephalitis virus
TGWFSPTTIAA

SEQ ID NO: 236304 - protein, 11 aa, Japanese encephalitis virus
GWFSPTTIAAG

SEQ ID NO: 236305 - protein, 11 aa, Japanese encephalitis virus
WFSPTTIAAGL

SEQ ID NO: 236306 - protein, 11 aa, Japanese encephalitis virus
FSPTTIAAGLM

SEQ ID NO: 236307 - protein, 11 aa, Japanese encephalitis virus
SPTTIAAGLMV

SEQ ID NO: 236308 - protein, 11 aa, Japanese encephalitis virus
PTTIAAGLMVC

SEQ ID NO: 236309 - protein, 11 aa, Japanese encephalitis virus
TTIAAGLMVCN

SEQ ID NO: 236310 - protein, 11 aa, Japanese encephalitis virus
TIAAGLMVCNP

SEQ ID NO: 236311 - protein, 11 aa, Japanese encephalitis virus
IAAGLMVCNPN

SEQ ID NO: 236312 - protein, 11 aa, Japanese encephalitis virus
AAGLMVCNPNK

SEQ ID NO: 236313 - protein, 11 aa, Japanese encephalitis virus
AGLMVCNPNKK

SEQ ID NO: 236314 - protein, 11 aa, Japanese encephalitis virus
GLMVCNPNKKR

SEQ ID NO: 236315 - protein, 11 aa, Japanese encephalitis virus
LMVCNPNKKRG

SEQ ID NO: 236316 - protein, 11 aa, Japanese encephalitis virus
MVCNPNKKRGW

SEQ ID NO: 236317 - protein, 11 aa, Japanese encephalitis virus
VCNPNKKRGWP

SEQ ID NO: 236318 - protein, 11 aa, Japanese encephalitis virus
CNPNKKRGWPA

SEQ ID NO: 236319 - protein, 11 aa, Japanese encephalitis virus
NPNKKRGWPAT

SEQ ID NO: 236320 - protein, 11 aa, Japanese encephalitis virus
PNKKRGWPATE

SEQ ID NO: 236321 - protein, 11 aa, Japanese encephalitis virus
NKKRGWPATEF

SEQ ID NO: 236322 - protein, 11 aa, Japanese encephalitis virus
KKRGWPATEFL

SEQ ID NO: 236323 - protein, 11 aa, Japanese encephalitis virus
KRGWPATEFLS

SEQ ID NO: 236324 - protein, 11 aa, Japanese encephalitis virus
RGWPATEFLSA

SEQ ID NO: 236325 - protein, 11 aa, Japanese encephalitis virus
GWPATEFLSAV

SEQ ID NO: 236326 - protein, 11 aa, Japanese encephalitis virus
WPATEFLSAVG

SEQ ID NO: 236327 - protein, 11 aa, Japanese encephalitis virus
PATEFLSAVGL

SEQ ID NO: 236328 - protein, 11 aa, Japanese encephalitis virus
ATEFLSAVGLM

SEQ ID NO: 236329 - protein, 11 aa, Japanese encephalitis virus
TEFLSAVGLMF

SEQ ID NO: 236330 - protein, 11 aa, Japanese encephalitis virus
EFLSAVGLMFA

SEQ ID NO: 236331 - protein, 11 aa, Japanese encephalitis virus
FLSAVGLMFAI

SEQ ID NO: 236332 - protein, 11 aa, Japanese encephalitis virus
LSAVGLMFAIV

SEQ ID NO: 236333 - protein, 11 aa, Japanese encephalitis virus
SAVGLMFAIVG

SEQ ID NO: 236334 - protein, 11 aa, Japanese encephalitis virus
AVGLMFAIVGG

SEQ ID NO: 236335 - protein, 11 aa, Japanese encephalitis virus
VGLMFAIVGGL

SEQ ID NO: 236336 - protein, 11 aa, Japanese encephalitis virus
GLMFAIVGGLA

SEQ ID NO: 236337 - protein, 11 aa, Japanese encephalitis virus
LMFAIVGGLAE

SEQ ID NO: 236338 - protein, 11 aa, Japanese encephalitis virus
MFAIVGGLAEL

SEQ ID NO: 236339 - protein, 11 aa, Japanese encephalitis virus
FAIVGGLAELD

SEQ ID NO: 236340 - protein, 11 aa, Japanese encephalitis virus
AIVGGLAELDI

SEQ ID NO: 236341 - protein, 11 aa, Japanese encephalitis virus
IVGGLAELDIE

SEQ ID NO: 236342 - protein, 11 aa, Japanese encephalitis virus
VGGLAELDIES

SEQ ID NO: 236343 - protein, 11 aa, Japanese encephalitis virus
GGLAELDIESM

SEQ ID NO: 236344 - protein, 11 aa, Japanese encephalitis virus
GLAELDIESMS

SEQ ID NO: 236345 - protein, 11 aa, Japanese encephalitis virus
LAELDIESMSI

SEQ ID NO: 236346 - protein, 11 aa, Japanese encephalitis virus
AELDIESMSIP

SEQ ID NO: 236347 - protein, 11 aa, Japanese encephalitis virus
ELDIESMSIPF

SEQ ID NO: 236348 - protein, 11 aa, Japanese encephalitis virus
LDIESMSIPFM

SEQ ID NO: 236349 - protein, 11 aa, Japanese encephalitis virus
DIESMSIPFML

SEQ ID NO: 236350 - protein, 11 aa, Japanese encephalitis virus
IESMSIPFMLA

SEQ ID NO: 236351 - protein, 11 aa, Japanese encephalitis virus
ESMSIPFMLAG

SEQ ID NO: 236352 - protein, 11 aa, Japanese encephalitis virus
SMSIPFMLAGL

SEQ ID NO: 236353 - protein, 11 aa, Japanese encephalitis virus
MSIPFMLAGLM

SEQ ID NO: 236354 - protein, 11 aa, Japanese encephalitis virus
SIPFMLAGLMA

SEQ ID NO: 236355 - protein, 11 aa, Japanese encephalitis virus
IPFMLAGLMAV

SEQ ID NO: 236356 - protein, 11 aa, Japanese encephalitis virus
PFMLAGLMAVS

SEQ ID NO: 236357 - protein, 11 aa, Japanese encephalitis virus
FMLAGLMAVSY

SEQ ID NO: 236358 - protein, 11 aa, Japanese encephalitis virus
MLAGLMAVSYV

SEQ ID NO: 236359 - protein, 11 aa, Japanese encephalitis virus
LAGLMAVSYVV

SEQ ID NO: 236360 - protein, 11 aa, Japanese encephalitis virus
AGLMAVSYVVS

SEQ ID NO: 236361 - protein, 11 aa, Japanese encephalitis virus
GLMAVSYVVSG

SEQ ID NO: 236362 - protein, 11 aa, Japanese encephalitis virus
LMAVSYVVSGK

SEQ ID NO: 236363 - protein, 11 aa, Japanese encephalitis virus
MAVSYVVSGKA

SEQ ID NO: 236364 - protein, 11 aa, Japanese encephalitis virus
AVSYVVSGKAT

SEQ ID NO: 236365 - protein, 11 aa, Japanese encephalitis virus
VSYVVSGKATD

SEQ ID NO: 236366 - protein, 11 aa, Japanese encephalitis virus
SYVVSGKATDM

SEQ ID NO: 236367 - protein, 11 aa, Japanese encephalitis virus
YVVSGKATDMW

SEQ ID NO: 236368 - protein, 11 aa, Japanese encephalitis virus
VVSGKATDMWL

SEQ ID NO: 236369 - protein, 11 aa, Japanese encephalitis virus
VSGKATDMWLE

SEQ ID NO: 236370 - protein, 11 aa, Japanese encephalitis virus
SGKATDMWLER

SEQ ID NO: 236371 - protein, 11 aa, Japanese encephalitis virus
GKATDMWLERA

SEQ ID NO: 236372 - protein, 11 aa, Japanese encephalitis virus
KATDMWLERAA

SEQ ID NO: 236373 - protein, 11 aa, Japanese encephalitis virus
ATDMWLERAAD

SEQ ID NO: 236374 - protein, 11 aa, Japanese encephalitis virus
TDMWLERAADI

SEQ ID NO: 236375 - protein, 11 aa, Japanese encephalitis virus
DMWLERAADIS

SEQ ID NO: 236376 - protein, 11 aa, Japanese encephalitis virus
MWLERAADISW

SEQ ID NO: 236377 - protein, 11 aa, Japanese encephalitis virus
SWEMDAAITGS

SEQ ID NO: 236378 - protein, 11 aa, Japanese encephalitis virus
WEMDAAITGSS

SEQ ID NO: 236379 - protein, 11 aa, Japanese encephalitis virus
EMDAAITGSSR

SEQ ID NO: 236380 - protein, 11 aa, Japanese encephalitis virus
MDAAITGSSRR

SEQ ID NO: 236381 - protein, 11 aa, Japanese encephalitis virus
DAAITGSSRRL

SEQ ID NO: 236382 - protein, 11 aa, Japanese encephalitis virus
AAITGSSRRLD

SEQ ID NO: 236383 - protein, 11 aa, Japanese encephalitis virus
AITGSSRRLDV

SEQ ID NO: 236384 - protein, 11 aa, Japanese encephalitis virus
ITGSSRRLDVK

SEQ ID NO: 236385 - protein, 11 aa, Japanese encephalitis virus
TGSSRRLDVKL

SEQ ID NO: 236386 - protein, 11 aa, Japanese encephalitis virus
GSSRRLDVKLD

SEQ ID NO: 236387 - protein, 11 aa, Japanese encephalitis virus
SSRRLDVKLDD

SEQ ID NO: 236388 - protein, 11 aa, Japanese encephalitis virus
SRRLDVKLDDD

SEQ ID NO: 236389 - protein, 11 aa, Japanese encephalitis virus
RRLDVKLDDDG

SEQ ID NO: 236390 - protein, 11 aa, Japanese encephalitis virus
RLDVKLDDDGD

SEQ ID NO: 236391 - protein, 11 aa, Japanese encephalitis virus
LDVKLDDDGDF

SEQ ID NO: 236392 - protein, 11 aa, Japanese encephalitis virus
DVKLDDDGDFH

SEQ ID NO: 236393 - protein, 11 aa, Japanese encephalitis virus
VKLDDDGDFHL

SEQ ID NO: 236394 - protein, 11 aa, Japanese encephalitis virus
KLDDDGDFHLI

SEQ ID NO: 236395 - protein, 11 aa, Japanese encephalitis virus
LDDDGDFHLID

SEQ ID NO: 236396 - protein, 11 aa, Japanese encephalitis virus
DDDGDFHLIDD

SEQ ID NO: 236397 - protein, 11 aa, Japanese encephalitis virus
DDGDFHLIDDP

SEQ ID NO: 236398 - protein, 11 aa, Japanese encephalitis virus
DGDFHLIDDPG

SEQ ID NO: 236399 - protein, 11 aa, Japanese encephalitis virus
GDFHLIDDPGV

SEQ ID NO: 236400 - protein, 11 aa, Japanese encephalitis virus
DFHLIDDPGVP

SEQ ID NO: 236401 - protein, 11 aa, Japanese encephalitis virus
FHLIDDPGVPW

SEQ ID NO: 236402 - protein, 11 aa, Japanese encephalitis virus
HLIDDPGVPWK

SEQ ID NO: 236403 - protein, 11 aa, Japanese encephalitis virus
LIDDPGVPWKV

SEQ ID NO: 236404 - protein, 11 aa, Japanese encephalitis virus
IDDPGVPWKVW

SEQ ID NO: 236405 - protein, 11 aa, Japanese encephalitis virus
DDPGVPWKVWV

SEQ ID NO: 236406 - protein, 11 aa, Japanese encephalitis virus
DPGVPWKVWVL

SEQ ID NO: 236407 - protein, 11 aa, Japanese encephalitis virus
PGVPWKVWVLR

SEQ ID NO: 236408 - protein, 11 aa, Japanese encephalitis virus
GVPWKVWVLRM

SEQ ID NO: 236409 - protein, 11 aa, Japanese encephalitis virus
VPWKVWVLRMS

SEQ ID NO: 236410 - protein, 11 aa, Japanese encephalitis virus
PWKVWVLRMSC

SEQ ID NO: 236411 - protein, 11 aa, Japanese encephalitis virus
WKVWVLRMSCI

SEQ ID NO: 236412 - protein, 11 aa, Japanese encephalitis virus
LRMSCIGLAAL

SEQ ID NO: 236413 - protein, 11 aa, Japanese encephalitis virus
RMSCIGLAALT

SEQ ID NO: 236414 - protein, 11 aa, Japanese encephalitis virus
MSCIGLAALTP

SEQ ID NO: 236415 - protein, 11 aa, Japanese encephalitis virus
SCIGLAALTPW

SEQ ID NO: 236416 - protein, 11 aa, Japanese encephalitis virus
CIGLAALTPWA

SEQ ID NO: 236417 - protein, 11 aa, Japanese encephalitis virus
IGLAALTPWAI

SEQ ID NO: 236418 - protein, 11 aa, Japanese encephalitis virus
GLAALTPWAIV

SEQ ID NO: 236419 - protein, 11 aa, Japanese encephalitis virus
LAALTPWAIVP

SEQ ID NO: 236420 - protein, 11 aa, Japanese encephalitis virus
AALTPWAIVPA

SEQ ID NO: 236421 - protein, 11 aa, Japanese encephalitis virus
ALTPWAIVPAA

SEQ ID NO: 236422 - protein, 11 aa, Japanese encephalitis virus
LTPWAIVPAAF

SEQ ID NO: 236423 - protein, 11 aa, Japanese encephalitis virus
TPWAIVPAAFG

SEQ ID NO: 236424 - protein, 11 aa, Japanese encephalitis virus
PWAIVPAAFGY

SEQ ID NO: 236425 - protein, 11 aa, Japanese encephalitis virus
WAIVPAAFGYW

SEQ ID NO: 236426 - protein, 11 aa, Japanese encephalitis virus
AIVPAAFGYWL

SEQ ID NO: 236427 - protein, 11 aa, Japanese encephalitis virus
IVPAAFGYWLT

SEQ ID NO: 236428 - protein, 11 aa, Japanese encephalitis virus
VPAAFGYWLTL

SEQ ID NO: 236429 - protein, 11 aa, Japanese encephalitis virus
PAAFGYWLTLK

SEQ ID NO: 236430 - protein, 11 aa, Japanese encephalitis virus
AAFGYWLTLKT

SEQ ID NO: 236431 - protein, 11 aa, Japanese encephalitis virus
AFGYWLTLKTT

SEQ ID NO: 236432 - protein, 11 aa, Japanese encephalitis virus
FGYWLTLKTTK

SEQ ID NO: 236433 - protein, 11 aa, Japanese encephalitis virus
GYWLTLKTTKR

SEQ ID NO: 236434 - protein, 11 aa, Japanese encephalitis virus
YWLTLKTTKRG

SEQ ID NO: 236435 - protein, 11 aa, Japanese encephalitis virus
WLTLKTTKRGG

SEQ ID NO: 236436 - protein, 11 aa, Japanese encephalitis virus
LTLKTTKRGGV

SEQ ID NO: 236437 - protein, 11 aa, Japanese encephalitis virus
TLKTTKRGGVF

SEQ ID NO: 236438 - protein, 11 aa, Japanese encephalitis virus
LKTTKRGGVFW

SEQ ID NO: 236439 - protein, 11 aa, Japanese encephalitis virus
KTTKRGGVFWD

SEQ ID NO: 236440 - protein, 11 aa, Japanese encephalitis virus
TTKRGGVFWDT

SEQ ID NO: 236441 - protein, 11 aa, Japanese encephalitis virus
TKRGGVFWDTP

SEQ ID NO: 236442 - protein, 11 aa, Japanese encephalitis virus
KRGGVFWDTPS

SEQ ID NO: 236443 - protein, 11 aa, Japanese encephalitis virus
RGGVFWDTPSP

SEQ ID NO: 236444 - protein, 11 aa, Japanese encephalitis virus
GGVFWDTPSPK

SEQ ID NO: 236445 - protein, 11 aa, Japanese encephalitis virus
GVFWDTPSPKP

SEQ ID NO: 236446 - protein, 11 aa, Japanese encephalitis virus
VFWDTPSPKPC

SEQ ID NO: 236447 - protein, 11 aa, Japanese encephalitis virus
FWDTPSPKPCS

SEQ ID NO: 236448 - protein, 11 aa, Japanese encephalitis virus
WDTPSPKPCSK

SEQ ID NO: 236449 - protein, 11 aa, Japanese encephalitis virus
DTPSPKPCSKG

SEQ ID NO: 236450 - protein, 11 aa, Japanese encephalitis virus
TPSPKPCSKGD

SEQ ID NO: 236451 - protein, 11 aa, Japanese encephalitis virus
PSPKPCSKGDT

SEQ ID NO: 236452 - protein, 11 aa, Japanese encephalitis virus
SPKPCSKGDTT

SEQ ID NO: 236453 - protein, 11 aa, Japanese encephalitis virus
PKPCSKGDTTT

SEQ ID NO: 236454 - protein, 11 aa, Japanese encephalitis virus
KPCSKGDTTTG

SEQ ID NO: 236455 - protein, 11 aa, Japanese encephalitis virus
PCSKGDTTTGV

SEQ ID NO: 236456 - protein, 11 aa, Japanese encephalitis virus
CSKGDTTTGVY

SEQ ID NO: 236457 - protein, 11 aa, Japanese encephalitis virus
SKGDTTTGVYR

SEQ ID NO: 236458 - protein, 11 aa, Japanese encephalitis virus
KGDTTTGVYRI

SEQ ID NO: 236459 - protein, 11 aa, Japanese encephalitis virus
GDTTTGVYRIM

SEQ ID NO: 236460 - protein, 11 aa, Japanese encephalitis virus
DTTTGVYRIMA

SEQ ID NO: 236461 - protein, 11 aa, Japanese encephalitis virus
TTTGVYRIMAR

SEQ ID NO: 236462 - protein, 11 aa, Japanese encephalitis virus
TTGVYRIMARG

SEQ ID NO: 236463 - protein, 11 aa, Japanese encephalitis virus
TGVYRIMARGI

SEQ ID NO: 236464 - protein, 11 aa, Japanese encephalitis virus
GVYRIMARGIL

SEQ ID NO: 236465 - protein, 11 aa, Japanese encephalitis virus
VYRIMARGILG

SEQ ID NO: 236466 - protein, 11 aa, Japanese encephalitis virus
YRIMARGILGT

SEQ ID NO: 236467 - protein, 11 aa, Japanese encephalitis virus
RIMARGILGTY

SEQ ID NO: 236468 - protein, 11 aa, Japanese encephalitis virus
IMARGILGTYQ

SEQ ID NO: 236469 - protein, 11 aa, Japanese encephalitis virus
MARGILGTYQA

SEQ ID NO: 236470 - protein, 11 aa, Japanese encephalitis virus
ARGILGTYQAG

SEQ ID NO: 236471 - protein, 11 aa, Japanese encephalitis virus
RGILGTYQAGV

SEQ ID NO: 236472 - protein, 11 aa, Japanese encephalitis virus
GILGTYQAGVG

SEQ ID NO: 236473 - protein, 11 aa, Japanese encephalitis virus
ILGTYQAGVGV

SEQ ID NO: 236474 - protein, 11 aa, Japanese encephalitis virus
LGTYQAGVGVM

SEQ ID NO: 236475 - protein, 11 aa, Japanese encephalitis virus
GTYQAGVGVMY

SEQ ID NO: 236476 - protein, 11 aa, Japanese encephalitis virus
TYQAGVGVMYE

SEQ ID NO: 236477 - protein, 11 aa, Japanese encephalitis virus
YQAGVGVMYEN

SEQ ID NO: 236478 - protein, 11 aa, Japanese encephalitis virus
QAGVGVMYENV

SEQ ID NO: 236479 - protein, 11 aa, Japanese encephalitis virus
AGVGVMYENVF

SEQ ID NO: 236480 - protein, 11 aa, Japanese encephalitis virus
GVGVMYENVFH

SEQ ID NO: 236481 - protein, 11 aa, Japanese encephalitis virus
VGVMYENVFHT

SEQ ID NO: 236482 - protein, 11 aa, Japanese encephalitis virus
GVMYENVFHTL

SEQ ID NO: 236483 - protein, 11 aa, Japanese encephalitis virus
VMYENVFHTLW

SEQ ID NO: 236484 - protein, 11 aa, Japanese encephalitis virus
MYENVFHTLWH

SEQ ID NO: 236485 - protein, 11 aa, Japanese encephalitis virus
YENVFHTLWHT

SEQ ID NO: 236486 - protein, 11 aa, Japanese encephalitis virus
ENVFHTLWHTT

SEQ ID NO: 236487 - protein, 11 aa, Japanese encephalitis virus
NVFHTLWHTTR

SEQ ID NO: 236488 - protein, 11 aa, Japanese encephalitis virus
VFHTLWHTTRG

SEQ ID NO: 236489 - protein, 11 aa, Japanese encephalitis virus
FHTLWHTTRGA

SEQ ID NO: 236490 - protein, 11 aa, Japanese encephalitis virus
HTLWHTTRGAA

SEQ ID NO: 236491 - protein, 11 aa, Japanese encephalitis virus
TLWHTTRGAAI

SEQ ID NO: 236492 - protein, 11 aa, Japanese encephalitis virus
LWHTTRGAAIM

SEQ ID NO: 236493 - protein, 11 aa, Japanese encephalitis virus
WHTTRGAAIMS

SEQ ID NO: 236494 - protein, 11 aa, Japanese encephalitis virus
HTTRGAAIMSG

SEQ ID NO: 236495 - protein, 11 aa, Japanese encephalitis virus
TRGAAIMSGEG

SEQ ID NO: 236496 - protein, 11 aa, Japanese encephalitis virus
RGAAIMSGEGK

SEQ ID NO: 236497 - protein, 11 aa, Japanese encephalitis virus
GAAIMSGEGKL

SEQ ID NO: 236498 - protein, 11 aa, Japanese encephalitis virus
AAIMSGEGKLT

SEQ ID NO: 236499 - protein, 11 aa, Japanese encephalitis virus
AIMSGEGKLTP

SEQ ID NO: 236500 - protein, 11 aa, Japanese encephalitis virus
IMSGEGKLTPY

SEQ ID NO: 236501 - protein, 11 aa, Japanese encephalitis virus
MSGEGKLTPYW

SEQ ID NO: 236502 - protein, 11 aa, Japanese encephalitis virus
SGEGKLTPYWG

SEQ ID NO: 236503 - protein, 11 aa, Japanese encephalitis virus
GEGKLTPYWGS

SEQ ID NO: 236504 - protein, 11 aa, Japanese encephalitis virus
EGKLTPYWGSV

SEQ ID NO: 236505 - protein, 11 aa, Japanese encephalitis virus
GKLTPYWGSVK

SEQ ID NO: 236506 - protein, 11 aa, Japanese encephalitis virus
KLTPYWGSVKE

SEQ ID NO: 236507 - protein, 11 aa, Japanese encephalitis virus
LTPYWGSVKED

SEQ ID NO: 236508 - protein, 11 aa, Japanese encephalitis virus
TPYWGSVKEDR

SEQ ID NO: 236509 - protein, 11 aa, Japanese encephalitis virus
PYWGSVKEDRI

SEQ ID NO: 236510 - protein, 11 aa, Japanese encephalitis virus
YWGSVKEDRIA

SEQ ID NO: 236511 - protein, 11 aa, Japanese encephalitis virus
WGSVKEDRIAY

SEQ ID NO: 236512 - protein, 11 aa, Japanese encephalitis virus
GSVKEDRIAYG

SEQ ID NO: 236513 - protein, 11 aa, Japanese encephalitis virus
SVKEDRIAYGG

SEQ ID NO: 236514 - protein, 11 aa, Japanese encephalitis virus
VKEDRIAYGGP

SEQ ID NO: 236515 - protein, 11 aa, Japanese encephalitis virus
KEDRIAYGGPW

SEQ ID NO: 236516 - protein, 11 aa, Japanese encephalitis virus
EDRIAYGGPWR

SEQ ID NO: 236517 - protein, 11 aa, Japanese encephalitis virus
DRIAYGGPWRF

SEQ ID NO: 236518 - protein, 11 aa, Japanese encephalitis virus
RIAYGGPWRFD

SEQ ID NO: 236519 - protein, 11 aa, Japanese encephalitis virus
IAYGGPWRFDR

SEQ ID NO: 236520 - protein, 11 aa, Japanese encephalitis virus
AYGGPWRFDRK

SEQ ID NO: 236521 - protein, 11 aa, Japanese encephalitis virus
YGGPWRFDRKW

SEQ ID NO: 236522 - protein, 11 aa, Japanese encephalitis virus
GGPWRFDRKWN

SEQ ID NO: 236523 - protein, 11 aa, Japanese encephalitis virus
GPWRFDRKWNG

SEQ ID NO: 236524 - protein, 11 aa, Japanese encephalitis virus
PWRFDRKWNGT

SEQ ID NO: 236525 - protein, 11 aa, Japanese encephalitis virus
WRFDRKWNGTD

SEQ ID NO: 236526 - protein, 11 aa, Japanese encephalitis virus
RFDRKWNGTDD

SEQ ID NO: 236527 - protein, 11 aa, Japanese encephalitis virus
FDRKWNGTDDV

SEQ ID NO: 236528 - protein, 11 aa, Japanese encephalitis virus
DRKWNGTDDVQ

SEQ ID NO: 236529 - protein, 11 aa, Japanese encephalitis virus
RKWNGTDDVQV

SEQ ID NO: 236530 - protein, 11 aa, Japanese encephalitis virus
KWNGTDDVQVI

SEQ ID NO: 236531 - protein, 11 aa, Japanese encephalitis virus
WNGTDDVQVIV

SEQ ID NO: 236532 - protein, 11 aa, Japanese encephalitis virus
NGTDDVQVIVV

SEQ ID NO: 236533 - protein, 11 aa, Japanese encephalitis virus
GTDDVQVIVVE

SEQ ID NO: 236534 - protein, 11 aa, Japanese encephalitis virus
TDDVQVIVVEP

SEQ ID NO: 236535 - protein, 11 aa, Japanese encephalitis virus
DDVQVIVVEPG

SEQ ID NO: 236536 - protein, 11 aa, Japanese encephalitis virus
DVQVIVVEPGK

SEQ ID NO: 236537 - protein, 11 aa, Japanese encephalitis virus
VQVIVVEPGKA

SEQ ID NO: 236538 - protein, 11 aa, Japanese encephalitis virus
QVIVVEPGKAA

SEQ ID NO: 236539 - protein, 11 aa, Japanese encephalitis virus
IQTKPGVFRTP

SEQ ID NO: 236540 - protein, 11 aa, Japanese encephalitis virus
QTKPGVFRTPF

SEQ ID NO: 236541 - protein, 11 aa, Japanese encephalitis virus
TKPGVFRTPFG

SEQ ID NO: 236542 - protein, 11 aa, Japanese encephalitis virus
PFGEVGAVSLD

SEQ ID NO: 236543 - protein, 11 aa, Japanese encephalitis virus
FGEVGAVSLDY

SEQ ID NO: 236544 - protein, 11 aa, Japanese encephalitis virus
GEVGAVSLDYP

SEQ ID NO: 236545 - protein, 11 aa, Japanese encephalitis virus
EVGAVSLDYPR

SEQ ID NO: 236546 - protein, 11 aa, Japanese encephalitis virus
VGAVSLDYPRG

SEQ ID NO: 236547 - protein, 11 aa, Japanese encephalitis virus
GAVSLDYPRGT

SEQ ID NO: 236548 - protein, 11 aa, Japanese encephalitis virus
AVSLDYPRGTS

SEQ ID NO: 236549 - protein, 11 aa, Japanese encephalitis virus
VSLDYPRGTSG

SEQ ID NO: 236550 - protein, 11 aa, Japanese encephalitis virus
SLDYPRGTSGS

SEQ ID NO: 236551 - protein, 11 aa, Japanese encephalitis virus
LDYPRGTSGSP

SEQ ID NO: 236552 - protein, 11 aa, Japanese encephalitis virus
DYPRGTSGSPI

SEQ ID NO: 236553 - protein, 11 aa, Japanese encephalitis virus
YPRGTSGSPIL

SEQ ID NO: 236554 - protein, 11 aa, Japanese encephalitis virus
PRGTSGSPILD

SEQ ID NO: 236555 - protein, 11 aa, Japanese encephalitis virus
RGTSGSPILDS

SEQ ID NO: 236556 - protein, 11 aa, Japanese encephalitis virus
GTSGSPILDSN

SEQ ID NO: 236557 - protein, 11 aa, Japanese encephalitis virus
TSGSPILDSNG

SEQ ID NO: 236558 - protein, 11 aa, Japanese encephalitis virus
SGSPILDSNGD

SEQ ID NO: 236559 - protein, 11 aa, Japanese encephalitis virus
GSPILDSNGDI

SEQ ID NO: 236560 - protein, 11 aa, Japanese encephalitis virus
SPILDSNGDII

SEQ ID NO: 236561 - protein, 11 aa, Japanese encephalitis virus
PILDSNGDIIG

SEQ ID NO: 236562 - protein, 11 aa, Japanese encephalitis virus
ILDSNGDIIGL

SEQ ID NO: 236563 - protein, 11 aa, Japanese encephalitis virus
LDSNGDIIGLY

SEQ ID NO: 236564 - protein, 11 aa, Japanese encephalitis virus
DSNGDIIGLYG

SEQ ID NO: 236565 - protein, 11 aa, Japanese encephalitis virus
SNGDIIGLYGN

SEQ ID NO: 236566 - protein, 11 aa, Japanese encephalitis virus
NGDIIGLYGNG

SEQ ID NO: 236567 - protein, 11 aa, Japanese encephalitis virus
GDIIGLYGNGV

SEQ ID NO: 236568 - protein, 11 aa, Japanese encephalitis virus
DIIGLYGNGVE

SEQ ID NO: 236569 - protein, 11 aa, Japanese encephalitis virus
IIGLYGNGVEL

SEQ ID NO: 236570 - protein, 11 aa, Japanese encephalitis virus
IGLYGNGVELG

SEQ ID NO: 236571 - protein, 11 aa, Japanese encephalitis virus
GLYGNGVELGD

SEQ ID NO: 236572 - protein, 11 aa, Japanese encephalitis virus
LYGNGVELGDG

SEQ ID NO: 236573 - protein, 11 aa, Japanese encephalitis virus
YGNGVELGDGS

SEQ ID NO: 236574 - protein, 11 aa, Japanese encephalitis virus
GNGVELGDGSY

SEQ ID NO: 236575 - protein, 11 aa, Japanese encephalitis virus
NGVELGDGSYV

SEQ ID NO: 236576 - protein, 11 aa, Japanese encephalitis virus
GVELGDGSYVS

SEQ ID NO: 236577 - protein, 11 aa, Japanese encephalitis virus
VELGDGSYVSA

SEQ ID NO: 236578 - protein, 11 aa, Japanese encephalitis virus
ELGDGSYVSAI

SEQ ID NO: 236579 - protein, 11 aa, Japanese encephalitis virus
LGDGSYVSAIV

SEQ ID NO: 236580 - protein, 11 aa, Japanese encephalitis virus
GDGSYVSAIVQ

SEQ ID NO: 236581 - protein, 11 aa, Japanese encephalitis virus
DGSYVSAIVQG

SEQ ID NO: 236582 - protein, 11 aa, Japanese encephalitis virus
GSYVSAIVQGD

SEQ ID NO: 236583 - protein, 11 aa, Japanese encephalitis virus
SYVSAIVQGDR

SEQ ID NO: 236584 - protein, 11 aa, Japanese encephalitis virus
YVSAIVQGDRQ

SEQ ID NO: 236585 - protein, 11 aa, Japanese encephalitis virus
VSAIVQGDRQE

SEQ ID NO: 236586 - protein, 11 aa, Japanese encephalitis virus
SAIVQGDRQEE

SEQ ID NO: 236587 - protein, 11 aa, Japanese encephalitis virus
AIVQGDRQEEP

SEQ ID NO: 236588 - protein, 11 aa, Japanese encephalitis virus
IVQGDRQEEPV

SEQ ID NO: 236589 - protein, 11 aa, Japanese encephalitis virus
VQGDRQEEPVP

SEQ ID NO: 236590 - protein, 11 aa, Japanese encephalitis virus
QGDRQEEPVPE

SEQ ID NO: 236591 - protein, 11 aa, Japanese encephalitis virus
GDRQEEPVPEA

SEQ ID NO: 236592 - protein, 11 aa, Japanese encephalitis virus
DRQEEPVPEAY

SEQ ID NO: 236593 - protein, 11 aa, Japanese encephalitis virus
RQEEPVPEAYT

SEQ ID NO: 236594 - protein, 11 aa, Japanese encephalitis virus
QEEPVPEAYTP

SEQ ID NO: 236595 - protein, 11 aa, Japanese encephalitis virus
EEPVPEAYTPN

SEQ ID NO: 236596 - protein, 11 aa, Japanese encephalitis virus
EPVPEAYTPNM

SEQ ID NO: 236597 - protein, 11 aa, Japanese encephalitis virus
PVPEAYTPNML

SEQ ID NO: 236598 - protein, 11 aa, Japanese encephalitis virus
MLRKRQMTVLD

SEQ ID NO: 236599 - protein, 11 aa, Japanese encephalitis virus
LRKRQMTVLDL

SEQ ID NO: 236600 - protein, 11 aa, Japanese encephalitis virus
RKRQMTVLDLH

SEQ ID NO: 236601 - protein, 11 aa, Japanese encephalitis virus
KRQMTVLDLHP

SEQ ID NO: 236602 - protein, 11 aa, Japanese encephalitis virus
RQMTVLDLHPG

SEQ ID NO: 236603 - protein, 11 aa, Japanese encephalitis virus
QMTVLDLHPGS

SEQ ID NO: 236604 - protein, 11 aa, Japanese encephalitis virus
MTVLDLHPGSG

SEQ ID NO: 236605 - protein, 11 aa, Japanese encephalitis virus
TVLDLHPGSGK

SEQ ID NO: 236606 - protein, 11 aa, Japanese encephalitis virus
VLDLHPGSGKT

SEQ ID NO: 236607 - protein, 11 aa, Japanese encephalitis virus
LDLHPGSGKTR

SEQ ID NO: 236608 - protein, 11 aa, Japanese encephalitis virus
DLHPGSGKTRK

SEQ ID NO: 236609 - protein, 11 aa, Japanese encephalitis virus
LHPGSGKTRKI

SEQ ID NO: 236610 - protein, 11 aa, Japanese encephalitis virus
HPGSGKTRKIL

SEQ ID NO: 236611 - protein, 11 aa, Japanese encephalitis virus
PGSGKTRKILP

SEQ ID NO: 236612 - protein, 11 aa, Japanese encephalitis virus
GSGKTRKILPQ

SEQ ID NO: 236613 - protein, 11 aa, Japanese encephalitis virus
SGKTRKILPQI

SEQ ID NO: 236614 - protein, 11 aa, Japanese encephalitis virus
GKTRKILPQII

SEQ ID NO: 236615 - protein, 11 aa, Japanese encephalitis virus
KTRKILPQIIK

SEQ ID NO: 236616 - protein, 11 aa, Japanese encephalitis virus
TRKILPQIIKD

SEQ ID NO: 236617 - protein, 11 aa, Japanese encephalitis virus
RKILPQIIKDA

SEQ ID NO: 236618 - protein, 11 aa, Japanese encephalitis virus
KILPQIIKDAI

SEQ ID NO: 236619 - protein, 11 aa, Japanese encephalitis virus
ILPQIIKDAIQ

SEQ ID NO: 236620 - protein, 11 aa, Japanese encephalitis virus
LPQIIKDAIQQ

SEQ ID NO: 236621 - protein, 11 aa, Japanese encephalitis virus
PQIIKDAIQQR

SEQ ID NO: 236622 - protein, 11 aa, Japanese encephalitis virus
QIIKDAIQQRL

SEQ ID NO: 236623 - protein, 11 aa, Japanese encephalitis virus
IIKDAIQQRLR

SEQ ID NO: 236624 - protein, 11 aa, Japanese encephalitis virus
IKDAIQQRLRT

SEQ ID NO: 236625 - protein, 11 aa, Japanese encephalitis virus
KDAIQQRLRTA

SEQ ID NO: 236626 - protein, 11 aa, Japanese encephalitis virus
DAIQQRLRTAV

SEQ ID NO: 236627 - protein, 11 aa, Japanese encephalitis virus
AIQQRLRTAVL

SEQ ID NO: 236628 - protein, 11 aa, Japanese encephalitis virus
IQQRLRTAVLA

SEQ ID NO: 236629 - protein, 11 aa, Japanese encephalitis virus
QQRLRTAVLAP

SEQ ID NO: 236630 - protein, 11 aa, Japanese encephalitis virus
QRLRTAVLAPT

SEQ ID NO: 236631 - protein, 11 aa, Japanese encephalitis virus
RLRTAVLAPTR

SEQ ID NO: 236632 - protein, 11 aa, Japanese encephalitis virus
LRTAVLAPTRV

SEQ ID NO: 236633 - protein, 11 aa, Japanese encephalitis virus
RTAVLAPTRVV

SEQ ID NO: 236634 - protein, 11 aa, Japanese encephalitis virus
TAVLAPTRVVA

SEQ ID NO: 236635 - protein, 11 aa, Japanese encephalitis virus
AVLAPTRVVAA

SEQ ID NO: 236636 - protein, 11 aa, Japanese encephalitis virus
VLAPTRVVAAE

SEQ ID NO: 236637 - protein, 11 aa, Japanese encephalitis virus
LAPTRVVAAEM

SEQ ID NO: 236638 - protein, 11 aa, Japanese encephalitis virus
APTRVVAAEMA

SEQ ID NO: 236639 - protein, 11 aa, Japanese encephalitis virus
PTRVVAAEMAE

SEQ ID NO: 236640 - protein, 11 aa, Japanese encephalitis virus
TRVVAAEMAEA

SEQ ID NO: 236641 - protein, 11 aa, Japanese encephalitis virus
RVVAAEMAEAL

SEQ ID NO: 236642 - protein, 11 aa, Japanese encephalitis virus
VVAAEMAEALR

SEQ ID NO: 236643 - protein, 11 aa, Japanese encephalitis virus
VAAEMAEALRG

SEQ ID NO: 236644 - protein, 11 aa, Japanese encephalitis virus
AAEMAEALRGL

SEQ ID NO: 236645 - protein, 11 aa, Japanese encephalitis virus
AEMAEALRGLP

SEQ ID NO: 236646 - protein, 11 aa, Japanese encephalitis virus
EMAEALRGLPV

SEQ ID NO: 236647 - protein, 11 aa, Japanese encephalitis virus
MAEALRGLPVR

SEQ ID NO: 236648 - protein, 11 aa, Japanese encephalitis virus
AEALRGLPVRY

SEQ ID NO: 236649 - protein, 11 aa, Japanese encephalitis virus
EALRGLPVRYQ

SEQ ID NO: 236650 - protein, 11 aa, Japanese encephalitis virus
ALRGLPVRYQT

SEQ ID NO: 236651 - protein, 11 aa, Japanese encephalitis virus
LRGLPVRYQTS

SEQ ID NO: 236652 - protein, 11 aa, Japanese encephalitis virus
RGLPVRYQTSA

SEQ ID NO: 236653 - protein, 11 aa, Japanese encephalitis virus
GLPVRYQTSAV

SEQ ID NO: 236654 - protein, 11 aa, Japanese encephalitis virus
LPVRYQTSAVQ

SEQ ID NO: 236655 - protein, 11 aa, Japanese encephalitis virus
PVRYQTSAVQR

SEQ ID NO: 236656 - protein, 11 aa, Japanese encephalitis virus
VRYQTSAVQRE

SEQ ID NO: 236657 - protein, 11 aa, Japanese encephalitis virus
RYQTSAVQREH

SEQ ID NO: 236658 - protein, 11 aa, Japanese encephalitis virus
YQTSAVQREHQ

SEQ ID NO: 236659 - protein, 11 aa, Japanese encephalitis virus
QTSAVQREHQG

SEQ ID NO: 236660 - protein, 11 aa, Japanese encephalitis virus
TSAVQREHQGN

SEQ ID NO: 236661 - protein, 11 aa, Japanese encephalitis virus
SAVQREHQGNE

SEQ ID NO: 236662 - protein, 11 aa, Japanese encephalitis virus
AVQREHQGNEI

SEQ ID NO: 236663 - protein, 11 aa, Japanese encephalitis virus
VQREHQGNEIV

SEQ ID NO: 236664 - protein, 11 aa, Japanese encephalitis virus
QREHQGNEIVD

SEQ ID NO: 236665 - protein, 11 aa, Japanese encephalitis virus
REHQGNEIVDV

SEQ ID NO: 236666 - protein, 11 aa, Japanese encephalitis virus
EHQGNEIVDVM

SEQ ID NO: 236667 - protein, 11 aa, Japanese encephalitis virus
HQGNEIVDVMC

SEQ ID NO: 236668 - protein, 11 aa, Japanese encephalitis virus
QGNEIVDVMCH

SEQ ID NO: 236669 - protein, 11 aa, Japanese encephalitis virus
GNEIVDVMCHA

SEQ ID NO: 236670 - protein, 11 aa, Japanese encephalitis virus
NEIVDVMCHAT

SEQ ID NO: 236671 - protein, 11 aa, Japanese encephalitis virus
EIVDVMCHATL

SEQ ID NO: 236672 - protein, 11 aa, Japanese encephalitis virus
IVDVMCHATLT

SEQ ID NO: 236673 - protein, 11 aa, Japanese encephalitis virus
VDVMCHATLTH

SEQ ID NO: 236674 - protein, 11 aa, Japanese encephalitis virus
DVMCHATLTHR

SEQ ID NO: 236675 - protein, 11 aa, Japanese encephalitis virus
VMCHATLTHRL

SEQ ID NO: 236676 - protein, 11 aa, Japanese encephalitis virus
MCHATLTHRLM

SEQ ID NO: 236677 - protein, 11 aa, Japanese encephalitis virus
CHATLTHRLMS

SEQ ID NO: 236678 - protein, 11 aa, Japanese encephalitis virus
HATLTHRLMSP

SEQ ID NO: 236679 - protein, 11 aa, Japanese encephalitis virus
ATLTHRLMSPN

SEQ ID NO: 236680 - protein, 11 aa, Japanese encephalitis virus
TLTHRLMSPNR

SEQ ID NO: 236681 - protein, 11 aa, Japanese encephalitis virus
LTHRLMSPNRV

SEQ ID NO: 236682 - protein, 11 aa, Japanese encephalitis virus
THRLMSPNRVP

SEQ ID NO: 236683 - protein, 11 aa, Japanese encephalitis virus
HRLMSPNRVPN

SEQ ID NO: 236684 - protein, 11 aa, Japanese encephalitis virus
RLMSPNRVPNY

SEQ ID NO: 236685 - protein, 11 aa, Japanese encephalitis virus
LMSPNRVPNYN

SEQ ID NO: 236686 - protein, 11 aa, Japanese encephalitis virus
MSPNRVPNYNL

SEQ ID NO: 236687 - protein, 11 aa, Japanese encephalitis virus
SPNRVPNYNLF

SEQ ID NO: 236688 - protein, 11 aa, Japanese encephalitis virus
PNRVPNYNLFV

SEQ ID NO: 236689 - protein, 11 aa, Japanese encephalitis virus
NRVPNYNLFVM

SEQ ID NO: 236690 - protein, 11 aa, Japanese encephalitis virus
RVPNYNLFVMD

SEQ ID NO: 236691 - protein, 11 aa, Japanese encephalitis virus
VPNYNLFVMDE

SEQ ID NO: 236692 - protein, 11 aa, Japanese encephalitis virus
PNYNLFVMDEA

SEQ ID NO: 236693 - protein, 11 aa, Japanese encephalitis virus
NYNLFVMDEAH

SEQ ID NO: 236694 - protein, 11 aa, Japanese encephalitis virus
YNLFVMDEAHF

SEQ ID NO: 236695 - protein, 11 aa, Japanese encephalitis virus
NLFVMDEAHFT

SEQ ID NO: 236696 - protein, 11 aa, Japanese encephalitis virus
LFVMDEAHFTD

SEQ ID NO: 236697 - protein, 11 aa, Japanese encephalitis virus
FVMDEAHFTDP

SEQ ID NO: 236698 - protein, 11 aa, Japanese encephalitis virus
VMDEAHFTDPA

SEQ ID NO: 236699 - protein, 11 aa, Japanese encephalitis virus
MDEAHFTDPAS

SEQ ID NO: 236700 - protein, 11 aa, Japanese encephalitis virus
DEAHFTDPASI

SEQ ID NO: 236701 - protein, 11 aa, Japanese encephalitis virus
EAHFTDPASIA

SEQ ID NO: 236702 - protein, 11 aa, Japanese encephalitis virus
AHFTDPASIAA

SEQ ID NO: 236703 - protein, 11 aa, Japanese encephalitis virus
HFTDPASIAAR

SEQ ID NO: 236704 - protein, 11 aa, Japanese encephalitis virus
FTDPASIAARG

SEQ ID NO: 236705 - protein, 11 aa, Japanese encephalitis virus
TDPASIAARGY

SEQ ID NO: 236706 - protein, 11 aa, Japanese encephalitis virus
DPASIAARGYI

SEQ ID NO: 236707 - protein, 11 aa, Japanese encephalitis virus
PASIAARGYIA

SEQ ID NO: 236708 - protein, 11 aa, Japanese encephalitis virus
ASIAARGYIAT

SEQ ID NO: 236709 - protein, 11 aa, Japanese encephalitis virus
SIAARGYIATK

SEQ ID NO: 236710 - protein, 11 aa, Japanese encephalitis virus
IAARGYIATKV

SEQ ID NO: 236711 - protein, 11 aa, Japanese encephalitis virus
AARGYIATKVE

SEQ ID NO: 236712 - protein, 11 aa, Japanese encephalitis virus
ARGYIATKVEL

SEQ ID NO: 236713 - protein, 11 aa, Japanese encephalitis virus
RGYIATKVELG

SEQ ID NO: 236714 - protein, 11 aa, Japanese encephalitis virus
GYIATKVELGE

SEQ ID NO: 236715 - protein, 11 aa, Japanese encephalitis virus
YIATKVELGEA

SEQ ID NO: 236716 - protein, 11 aa, Japanese encephalitis virus
IATKVELGEAA

SEQ ID NO: 236717 - protein, 11 aa, Japanese encephalitis virus
ATKVELGEAAA

SEQ ID NO: 236718 - protein, 11 aa, Japanese encephalitis virus
TKVELGEAAAI

SEQ ID NO: 236719 - protein, 11 aa, Japanese encephalitis virus
KVELGEAAAIF

SEQ ID NO: 236720 - protein, 11 aa, Japanese encephalitis virus
VELGEAAAIFM

SEQ ID NO: 236721 - protein, 11 aa, Japanese encephalitis virus
ELGEAAAIFMT

SEQ ID NO: 236722 - protein, 11 aa, Japanese encephalitis virus
LGEAAAIFMTA

SEQ ID NO: 236723 - protein, 11 aa, Japanese encephalitis virus
GEAAAIFMTAT

SEQ ID NO: 236724 - protein, 11 aa, Japanese encephalitis virus
EAAAIFMTATP

SEQ ID NO: 236725 - protein, 11 aa, Japanese encephalitis virus
AAAIFMTATPP

SEQ ID NO: 236726 - protein, 11 aa, Japanese encephalitis virus
AAIFMTATPPG

SEQ ID NO: 236727 - protein, 11 aa, Japanese encephalitis virus
AIFMTATPPGT

SEQ ID NO: 236728 - protein, 11 aa, Japanese encephalitis virus
IFMTATPPGTT

SEQ ID NO: 236729 - protein, 11 aa, Japanese encephalitis virus
FMTATPPGTTD

SEQ ID NO: 236730 - protein, 11 aa, Japanese encephalitis virus
MTATPPGTTDP

SEQ ID NO: 236731 - protein, 11 aa, Japanese encephalitis virus
TATPPGTTDPF

SEQ ID NO: 236732 - protein, 11 aa, Japanese encephalitis virus
ATPPGTTDPFP

SEQ ID NO: 236733 - protein, 11 aa, Japanese encephalitis virus
TPPGTTDPFPD

SEQ ID NO: 236734 - protein, 11 aa, Japanese encephalitis virus
PPGTTDPFPDS

SEQ ID NO: 236735 - protein, 11 aa, Japanese encephalitis virus
PGTTDPFPDSN

SEQ ID NO: 236736 - protein, 11 aa, Japanese encephalitis virus
GTTDPFPDSNA

SEQ ID NO: 236737 - protein, 11 aa, Japanese encephalitis virus
TTDPFPDSNAP

SEQ ID NO: 236738 - protein, 11 aa, Japanese encephalitis virus
TDPFPDSNAPI

SEQ ID NO: 236739 - protein, 11 aa, Japanese encephalitis virus
DPFPDSNAPIH

SEQ ID NO: 236740 - protein, 11 aa, Japanese encephalitis virus
PFPDSNAPIHD

SEQ ID NO: 236741 - protein, 11 aa, Japanese encephalitis virus
FPDSNAPIHDL

SEQ ID NO: 236742 - protein, 11 aa, Japanese encephalitis virus
PDSNAPIHDLQ

SEQ ID NO: 236743 - protein, 11 aa, Japanese encephalitis virus
DSNAPIHDLQD

SEQ ID NO: 236744 - protein, 11 aa, Japanese encephalitis virus
SNAPIHDLQDE

SEQ ID NO: 236745 - protein, 11 aa, Japanese encephalitis virus
NAPIHDLQDEI

SEQ ID NO: 236746 - protein, 11 aa, Japanese encephalitis virus
APIHDLQDEIP

SEQ ID NO: 236747 - protein, 11 aa, Japanese encephalitis virus
PIHDLQDEIPD

SEQ ID NO: 236748 - protein, 11 aa, Japanese encephalitis virus
IHDLQDEIPDR

SEQ ID NO: 236749 - protein, 11 aa, Japanese encephalitis virus
HDLQDEIPDRA

SEQ ID NO: 236750 - protein, 11 aa, Japanese encephalitis virus
DLQDEIPDRAW

SEQ ID NO: 236751 - protein, 11 aa, Japanese encephalitis virus
LQDEIPDRAWS

SEQ ID NO: 236752 - protein, 11 aa, Japanese encephalitis virus
QDEIPDRAWSS

SEQ ID NO: 236753 - protein, 11 aa, Japanese encephalitis virus
DEIPDRAWSSG

SEQ ID NO: 236754 - protein, 11 aa, Japanese encephalitis virus
WITEYAGKTVW

SEQ ID NO: 236755 - protein, 11 aa, Japanese encephalitis virus
ITEYAGKTVWF

SEQ ID NO: 236756 - protein, 11 aa, Japanese encephalitis virus
TEYAGKTVWFV

SEQ ID NO: 236757 - protein, 11 aa, Japanese encephalitis virus
EYAGKTVWFVA

SEQ ID NO: 236758 - protein, 11 aa, Japanese encephalitis virus
YAGKTVWFVAS

SEQ ID NO: 236759 - protein, 11 aa, Japanese encephalitis virus
AGKTVWFVASV

SEQ ID NO: 236760 - protein, 11 aa, Japanese encephalitis virus
GKTVWFVASVK

SEQ ID NO: 236761 - protein, 11 aa, Japanese encephalitis virus
KTVWFVASVKM

SEQ ID NO: 236762 - protein, 11 aa, Japanese encephalitis virus
TVWFVASVKMG

SEQ ID NO: 236763 - protein, 11 aa, Japanese encephalitis virus
VWFVASVKMGN

SEQ ID NO: 236764 - protein, 11 aa, Japanese encephalitis virus
WFVASVKMGNE

SEQ ID NO: 236765 - protein, 11 aa, Japanese encephalitis virus
FVASVKMGNEI

SEQ ID NO: 236766 - protein, 11 aa, Japanese encephalitis virus
VASVKMGNEIA

SEQ ID NO: 236767 - protein, 11 aa, Japanese encephalitis virus
ASVKMGNEIAM

SEQ ID NO: 236768 - protein, 11 aa, Japanese encephalitis virus
SVKMGNEIAMC

SEQ ID NO: 236769 - protein, 11 aa, Japanese encephalitis virus
VKMGNEIAMCL

SEQ ID NO: 236770 - protein, 11 aa, Japanese encephalitis virus
KMGNEIAMCLQ

SEQ ID NO: 236771 - protein, 11 aa, Japanese encephalitis virus
MGNEIAMCLQR

SEQ ID NO: 236772 - protein, 11 aa, Japanese encephalitis virus
GNEIAMCLQRA

SEQ ID NO: 236773 - protein, 11 aa, Japanese encephalitis virus
NEIAMCLQRAG

SEQ ID NO: 236774 - protein, 11 aa, Japanese encephalitis virus
EIAMCLQRAGK

SEQ ID NO: 236775 - protein, 11 aa, Japanese encephalitis virus
IAMCLQRAGKK

SEQ ID NO: 236776 - protein, 11 aa, Japanese encephalitis virus
AMCLQRAGKKV

SEQ ID NO: 236777 - protein, 11 aa, Japanese encephalitis virus
MCLQRAGKKVI

SEQ ID NO: 236778 - protein, 11 aa, Japanese encephalitis virus
CLQRAGKKVIQ

SEQ ID NO: 236779 - protein, 11 aa, Japanese encephalitis virus
LQRAGKKVIQL

SEQ ID NO: 236780 - protein, 11 aa, Japanese encephalitis virus
QRAGKKVIQLN

SEQ ID NO: 236781 - protein, 11 aa, Japanese encephalitis virus
RAGKKVIQLNR

SEQ ID NO: 236782 - protein, 11 aa, Japanese encephalitis virus
AGKKVIQLNRK

SEQ ID NO: 236783 - protein, 11 aa, Japanese encephalitis virus
GKKVIQLNRKS

SEQ ID NO: 236784 - protein, 11 aa, Japanese encephalitis virus
KKVIQLNRKSY

SEQ ID NO: 236785 - protein, 11 aa, Japanese encephalitis virus
KVIQLNRKSYD

SEQ ID NO: 236786 - protein, 11 aa, Japanese encephalitis virus
VIQLNRKSYDT

SEQ ID NO: 236787 - protein, 11 aa, Japanese encephalitis virus
IQLNRKSYDTE

SEQ ID NO: 236788 - protein, 11 aa, Japanese encephalitis virus
QLNRKSYDTEY

SEQ ID NO: 236789 - protein, 11 aa, Japanese encephalitis virus
LNRKSYDTEYP

SEQ ID NO: 236790 - protein, 11 aa, Japanese encephalitis virus
NRKSYDTEYPK

SEQ ID NO: 236791 - protein, 11 aa, Japanese encephalitis virus
RKSYDTEYPKC

SEQ ID NO: 236792 - protein, 11 aa, Japanese encephalitis virus
KSYDTEYPKCK

SEQ ID NO: 236793 - protein, 11 aa, Japanese encephalitis virus
SYDTEYPKCKN

SEQ ID NO: 236794 - protein, 11 aa, Japanese encephalitis virus
YDTEYPKCKNG

SEQ ID NO: 236795 - protein, 11 aa, Japanese encephalitis virus
DTEYPKCKNGD

SEQ ID NO: 236796 - protein, 11 aa, Japanese encephalitis virus
TEYPKCKNGDW

SEQ ID NO: 236797 - protein, 11 aa, Japanese encephalitis virus
EYPKCKNGDWD

SEQ ID NO: 236798 - protein, 11 aa, Japanese encephalitis virus
YPKCKNGDWDF

SEQ ID NO: 236799 - protein, 11 aa, Japanese encephalitis virus
PKCKNGDWDFV

SEQ ID NO: 236800 - protein, 11 aa, Japanese encephalitis virus
KCKNGDWDFVI

SEQ ID NO: 236801 - protein, 11 aa, Japanese encephalitis virus
CKNGDWDFVIT

SEQ ID NO: 236802 - protein, 11 aa, Japanese encephalitis virus
KNGDWDFVITT

SEQ ID NO: 236803 - protein, 11 aa, Japanese encephalitis virus
NGDWDFVITTD

SEQ ID NO: 236804 - protein, 11 aa, Japanese encephalitis virus
GDWDFVITTDI

SEQ ID NO: 236805 - protein, 11 aa, Japanese encephalitis virus
DWDFVITTDIS

SEQ ID NO: 236806 - protein, 11 aa, Japanese encephalitis virus
WDFVITTDISE

SEQ ID NO: 236807 - protein, 11 aa, Japanese encephalitis virus
DFVITTDISEM

SEQ ID NO: 236808 - protein, 11 aa, Japanese encephalitis virus
FVITTDISEMG

SEQ ID NO: 236809 - protein, 11 aa, Japanese encephalitis virus
VITTDISEMGA

SEQ ID NO: 236810 - protein, 11 aa, Japanese encephalitis virus
ITTDISEMGAN

SEQ ID NO: 236811 - protein, 11 aa, Japanese encephalitis virus
TTDISEMGANF

SEQ ID NO: 236812 - protein, 11 aa, Japanese encephalitis virus
TDISEMGANFG

SEQ ID NO: 236813 - protein, 11 aa, Japanese encephalitis virus
DISEMGANFGA

SEQ ID NO: 236814 - protein, 11 aa, Japanese encephalitis virus
ISEMGANFGAS

SEQ ID NO: 236815 - protein, 11 aa, Japanese encephalitis virus
SEMGANFGASR

SEQ ID NO: 236816 - protein, 11 aa, Japanese encephalitis virus
EMGANFGASRV

SEQ ID NO: 236817 - protein, 11 aa, Japanese encephalitis virus
MGANFGASRVI

SEQ ID NO: 236818 - protein, 11 aa, Japanese encephalitis virus
GANFGASRVID

SEQ ID NO: 236819 - protein, 11 aa, Japanese encephalitis virus
ANFGASRVIDC

SEQ ID NO: 236820 - protein, 11 aa, Japanese encephalitis virus
NFGASRVIDCR

SEQ ID NO: 236821 - protein, 11 aa, Japanese encephalitis virus
FGASRVIDCRK

SEQ ID NO: 236822 - protein, 11 aa, Japanese encephalitis virus
GASRVIDCRKS

SEQ ID NO: 236823 - protein, 11 aa, Japanese encephalitis virus
ASRVIDCRKSV

SEQ ID NO: 236824 - protein, 11 aa, Japanese encephalitis virus
SRVIDCRKSVK

SEQ ID NO: 236825 - protein, 11 aa, Japanese encephalitis virus
RVIDCRKSVKP

SEQ ID NO: 236826 - protein, 11 aa, Japanese encephalitis virus
VIDCRKSVKPT

SEQ ID NO: 236827 - protein, 11 aa, Japanese encephalitis virus
IDCRKSVKPTI

SEQ ID NO: 236828 - protein, 11 aa, Japanese encephalitis virus
DCRKSVKPTIL

SEQ ID NO: 236829 - protein, 11 aa, Japanese encephalitis virus
CRKSVKPTILE

SEQ ID NO: 236830 - protein, 11 aa, Japanese encephalitis virus
RKSVKPTILEE

SEQ ID NO: 236831 - protein, 11 aa, Japanese encephalitis virus
KSVKPTILEEG

SEQ ID NO: 236832 - protein, 11 aa, Japanese encephalitis virus
SVKPTILEEGE

SEQ ID NO: 236833 - protein, 11 aa, Japanese encephalitis virus
VKPTILEEGEG

SEQ ID NO: 236834 - protein, 11 aa, Japanese encephalitis virus
KPTILEEGEGR

SEQ ID NO: 236835 - protein, 11 aa, Japanese encephalitis virus
PTILEEGEGRV

SEQ ID NO: 236836 - protein, 11 aa, Japanese encephalitis virus
TILEEGEGRVI

SEQ ID NO: 236837 - protein, 11 aa, Japanese encephalitis virus
ILEEGEGRVIL

SEQ ID NO: 236838 - protein, 11 aa, Japanese encephalitis virus
LEEGEGRVILG

SEQ ID NO: 236839 - protein, 11 aa, Japanese encephalitis virus
EEGEGRVILGN

SEQ ID NO: 236840 - protein, 11 aa, Japanese encephalitis virus
EGEGRVILGNP

SEQ ID NO: 236841 - protein, 11 aa, Japanese encephalitis virus
GEGRVILGNPS

SEQ ID NO: 236842 - protein, 11 aa, Japanese encephalitis virus
EGRVILGNPSP

SEQ ID NO: 236843 - protein, 11 aa, Japanese encephalitis virus
GRVILGNPSPI

SEQ ID NO: 236844 - protein, 11 aa, Japanese encephalitis virus
RVILGNPSPIT

SEQ ID NO: 236845 - protein, 11 aa, Japanese encephalitis virus
VILGNPSPITS

SEQ ID NO: 236846 - protein, 11 aa, Japanese encephalitis virus
ILGNPSPITSA

SEQ ID NO: 236847 - protein, 11 aa, Japanese encephalitis virus
LGNPSPITSAS

SEQ ID NO: 236848 - protein, 11 aa, Japanese encephalitis virus
GNPSPITSASA

SEQ ID NO: 236849 - protein, 11 aa, Japanese encephalitis virus
NPSPITSASAA

SEQ ID NO: 236850 - protein, 11 aa, Japanese encephalitis virus
PSPITSASAAQ

SEQ ID NO: 236851 - protein, 11 aa, Japanese encephalitis virus
SPITSASAAQR

SEQ ID NO: 236852 - protein, 11 aa, Japanese encephalitis virus
PITSASAAQRR

SEQ ID NO: 236853 - protein, 11 aa, Japanese encephalitis virus
ITSASAAQRRG

SEQ ID NO: 236854 - protein, 11 aa, Japanese encephalitis virus
TSASAAQRRGR

SEQ ID NO: 236855 - protein, 11 aa, Japanese encephalitis virus
SASAAQRRGRV

SEQ ID NO: 236856 - protein, 11 aa, Japanese encephalitis virus
ASAAQRRGRVG

SEQ ID NO: 236857 - protein, 11 aa, Japanese encephalitis virus
SAAQRRGRVGR

SEQ ID NO: 236858 - protein, 11 aa, Japanese encephalitis virus
AAQRRGRVGRN

SEQ ID NO: 236859 - protein, 11 aa, Japanese encephalitis virus
AQRRGRVGRNP

SEQ ID NO: 236860 - protein, 11 aa, Japanese encephalitis virus
QRRGRVGRNPN

SEQ ID NO: 236861 - protein, 11 aa, Japanese encephalitis virus
RRGRVGRNPNQ

SEQ ID NO: 236862 - protein, 11 aa, Japanese encephalitis virus
RGRVGRNPNQV

SEQ ID NO: 236863 - protein, 11 aa, Japanese encephalitis virus
GRVGRNPNQVG

SEQ ID NO: 236864 - protein, 11 aa, Japanese encephalitis virus
RVGRNPNQVGD

SEQ ID NO: 236865 - protein, 11 aa, Japanese encephalitis virus
VGRNPNQVGDE

SEQ ID NO: 236866 - protein, 11 aa, Japanese encephalitis virus
GRNPNQVGDEY

SEQ ID NO: 236867 - protein, 11 aa, Japanese encephalitis virus
RNPNQVGDEYH

SEQ ID NO: 236868 - protein, 11 aa, Japanese encephalitis virus
NPNQVGDEYHY

SEQ ID NO: 236869 - protein, 11 aa, Japanese encephalitis virus
PNQVGDEYHYG

SEQ ID NO: 236870 - protein, 11 aa, Japanese encephalitis virus
NQVGDEYHYGG

SEQ ID NO: 236871 - protein, 11 aa, Japanese encephalitis virus
QVGDEYHYGGA

SEQ ID NO: 236872 - protein, 11 aa, Japanese encephalitis virus
VGDEYHYGGAT

SEQ ID NO: 236873 - protein, 11 aa, Japanese encephalitis virus
GDEYHYGGATS

SEQ ID NO: 236874 - protein, 11 aa, Japanese encephalitis virus
DEYHYGGATSE

SEQ ID NO: 236875 - protein, 11 aa, Japanese encephalitis virus
EYHYGGATSED

SEQ ID NO: 236876 - protein, 11 aa, Japanese encephalitis virus
YHYGGATSEDD

SEQ ID NO: 236877 - protein, 11 aa, Japanese encephalitis virus
HYGGATSEDDS

SEQ ID NO: 236878 - protein, 11 aa, Japanese encephalitis virus
YGGATSEDDSN

SEQ ID NO: 236879 - protein, 11 aa, Japanese encephalitis virus
GGATSEDDSNL

SEQ ID NO: 236880 - protein, 11 aa, Japanese encephalitis virus
GATSEDDSNLA

SEQ ID NO: 236881 - protein, 11 aa, Japanese encephalitis virus
ATSEDDSNLAH

SEQ ID NO: 236882 - protein, 11 aa, Japanese encephalitis virus
TSEDDSNLAHW

SEQ ID NO: 236883 - protein, 11 aa, Japanese encephalitis virus
SEDDSNLAHWT

SEQ ID NO: 236884 - protein, 11 aa, Japanese encephalitis virus
EDDSNLAHWTE

SEQ ID NO: 236885 - protein, 11 aa, Japanese encephalitis virus
DDSNLAHWTEA

SEQ ID NO: 236886 - protein, 11 aa, Japanese encephalitis virus
DSNLAHWTEAK

SEQ ID NO: 236887 - protein, 11 aa, Japanese encephalitis virus
SNLAHWTEAKI

SEQ ID NO: 236888 - protein, 11 aa, Japanese encephalitis virus
NLAHWTEAKIM

SEQ ID NO: 236889 - protein, 11 aa, Japanese encephalitis virus
LAHWTEAKIML

SEQ ID NO: 236890 - protein, 11 aa, Japanese encephalitis virus
AHWTEAKIMLD

SEQ ID NO: 236891 - protein, 11 aa, Japanese encephalitis virus
HWTEAKIMLDN

SEQ ID NO: 236892 - protein, 11 aa, Japanese encephalitis virus
WTEAKIMLDNI

SEQ ID NO: 236893 - protein, 11 aa, Japanese encephalitis virus
TEAKIMLDNIH

SEQ ID NO: 236894 - protein, 11 aa, Japanese encephalitis virus
EAKIMLDNIHM

SEQ ID NO: 236895 - protein, 11 aa, Japanese encephalitis virus
AKIMLDNIHMP

SEQ ID NO: 236896 - protein, 11 aa, Japanese encephalitis virus
KIMLDNIHMPN

SEQ ID NO: 236897 - protein, 11 aa, Japanese encephalitis virus
IMLDNIHMPNG

SEQ ID NO: 236898 - protein, 11 aa, Japanese encephalitis virus
MLDNIHMPNGL

SEQ ID NO: 236899 - protein, 11 aa, Japanese encephalitis virus
LDNIHMPNGLV

SEQ ID NO: 236900 - protein, 11 aa, Japanese encephalitis virus
DNIHMPNGLVA

SEQ ID NO: 236901 - protein, 11 aa, Japanese encephalitis virus
NIHMPNGLVAQ

SEQ ID NO: 236902 - protein, 11 aa, Japanese encephalitis virus
IHMPNGLVAQL

SEQ ID NO: 236903 - protein, 11 aa, Japanese encephalitis virus
HMPNGLVAQLY

SEQ ID NO: 236904 - protein, 11 aa, Japanese encephalitis virus
MPNGLVAQLYG

SEQ ID NO: 236905 - protein, 11 aa, Japanese encephalitis virus
PNGLVAQLYGP

SEQ ID NO: 236906 - protein, 11 aa, Japanese encephalitis virus
NGLVAQLYGPE

SEQ ID NO: 236907 - protein, 11 aa, Japanese encephalitis virus
GLVAQLYGPER

SEQ ID NO: 236908 - protein, 11 aa, Japanese encephalitis virus
LVAQLYGPERE

SEQ ID NO: 236909 - protein, 11 aa, Japanese encephalitis virus
VAQLYGPEREK

SEQ ID NO: 236910 - protein, 11 aa, Japanese encephalitis virus
AQLYGPEREKA

SEQ ID NO: 236911 - protein, 11 aa, Japanese encephalitis virus
QLYGPEREKAF

SEQ ID NO: 236912 - protein, 11 aa, Japanese encephalitis virus
LYGPEREKAFT

SEQ ID NO: 236913 - protein, 11 aa, Japanese encephalitis virus
YGPEREKAFTM

SEQ ID NO: 236914 - protein, 11 aa, Japanese encephalitis virus
GPEREKAFTMD

SEQ ID NO: 236915 - protein, 11 aa, Japanese encephalitis virus
PEREKAFTMDG

SEQ ID NO: 236916 - protein, 11 aa, Japanese encephalitis virus
EREKAFTMDGE

SEQ ID NO: 236917 - protein, 11 aa, Japanese encephalitis virus
REKAFTMDGEY

SEQ ID NO: 236918 - protein, 11 aa, Japanese encephalitis virus
EKAFTMDGEYR

SEQ ID NO: 236919 - protein, 11 aa, Japanese encephalitis virus
KAFTMDGEYRL

SEQ ID NO: 236920 - protein, 11 aa, Japanese encephalitis virus
AFTMDGEYRLR

SEQ ID NO: 236921 - protein, 11 aa, Japanese encephalitis virus
FTMDGEYRLRG

SEQ ID NO: 236922 - protein, 11 aa, Japanese encephalitis virus
TMDGEYRLRGE

SEQ ID NO: 236923 - protein, 11 aa, Japanese encephalitis virus
MDGEYRLRGEE

SEQ ID NO: 236924 - protein, 11 aa, Japanese encephalitis virus
DGEYRLRGEEK

SEQ ID NO: 236925 - protein, 11 aa, Japanese encephalitis virus
GEYRLRGEEKK

SEQ ID NO: 236926 - protein, 11 aa, Japanese encephalitis virus
EYRLRGEEKKN

SEQ ID NO: 236927 - protein, 11 aa, Japanese encephalitis virus
YRLRGEEKKNF

SEQ ID NO: 236928 - protein, 11 aa, Japanese encephalitis virus
RLRGEEKKNFL

SEQ ID NO: 236929 - protein, 11 aa, Japanese encephalitis virus
LRGEEKKNFLE

SEQ ID NO: 236930 - protein, 11 aa, Japanese encephalitis virus
RGEEKKNFLEL

SEQ ID NO: 236931 - protein, 11 aa, Japanese encephalitis virus
GEEKKNFLELL

SEQ ID NO: 236932 - protein, 11 aa, Japanese encephalitis virus
EEKKNFLELLR

SEQ ID NO: 236933 - protein, 11 aa, Japanese encephalitis virus
EKKNFLELLRT

SEQ ID NO: 236934 - protein, 11 aa, Japanese encephalitis virus
KKNFLELLRTA

SEQ ID NO: 236935 - protein, 11 aa, Japanese encephalitis virus
KNFLELLRTAD

SEQ ID NO: 236936 - protein, 11 aa, Japanese encephalitis virus
NFLELLRTADL

SEQ ID NO: 236937 - protein, 11 aa, Japanese encephalitis virus
FLELLRTADLP

SEQ ID NO: 236938 - protein, 11 aa, Japanese encephalitis virus
LELLRTADLPV

SEQ ID NO: 236939 - protein, 11 aa, Japanese encephalitis virus
ELLRTADLPVW

SEQ ID NO: 236940 - protein, 11 aa, Japanese encephalitis virus
LLRTADLPVWL

SEQ ID NO: 236941 - protein, 11 aa, Japanese encephalitis virus
LRTADLPVWLA

SEQ ID NO: 236942 - protein, 11 aa, Japanese encephalitis virus
RTADLPVWLAY

SEQ ID NO: 236943 - protein, 11 aa, Japanese encephalitis virus
TADLPVWLAYK

SEQ ID NO: 236944 - protein, 11 aa, Japanese encephalitis virus
ADLPVWLAYKV

SEQ ID NO: 236945 - protein, 11 aa, Japanese encephalitis virus
DLPVWLAYKVA

SEQ ID NO: 236946 - protein, 11 aa, Japanese encephalitis virus
LPVWLAYKVAS

SEQ ID NO: 236947 - protein, 11 aa, Japanese encephalitis virus
PVWLAYKVASN

SEQ ID NO: 236948 - protein, 11 aa, Japanese encephalitis virus
VWLAYKVASNG

SEQ ID NO: 236949 - protein, 11 aa, Japanese encephalitis virus
WLAYKVASNGI

SEQ ID NO: 236950 - protein, 11 aa, Japanese encephalitis virus
LAYKVASNGIQ

SEQ ID NO: 236951 - protein, 11 aa, Japanese encephalitis virus
AYKVASNGIQY

SEQ ID NO: 236952 - protein, 11 aa, Japanese encephalitis virus
YKVASNGIQYT

SEQ ID NO: 236953 - protein, 11 aa, Japanese encephalitis virus
KVASNGIQYTD

SEQ ID NO: 236954 - protein, 11 aa, Japanese encephalitis virus
VASNGIQYTDR

SEQ ID NO: 236955 - protein, 11 aa, Japanese encephalitis virus
ASNGIQYTDRK

SEQ ID NO: 236956 - protein, 11 aa, Japanese encephalitis virus
SNGIQYTDRKW

SEQ ID NO: 236957 - protein, 11 aa, Japanese encephalitis virus
NGIQYTDRKWC

SEQ ID NO: 236958 - protein, 11 aa, Japanese encephalitis virus
GIQYTDRKWCF

SEQ ID NO: 236959 - protein, 11 aa, Japanese encephalitis virus
IQYTDRKWCFD

SEQ ID NO: 236960 - protein, 11 aa, Japanese encephalitis virus
QYTDRKWCFDG

SEQ ID NO: 236961 - protein, 11 aa, Japanese encephalitis virus
YTDRKWCFDGP

SEQ ID NO: 236962 - protein, 11 aa, Japanese encephalitis virus
TDRKWCFDGPR

SEQ ID NO: 236963 - protein, 11 aa, Japanese encephalitis virus
DRKWCFDGPRT

SEQ ID NO: 236964 - protein, 11 aa, Japanese encephalitis virus
RKWCFDGPRTN

SEQ ID NO: 236965 - protein, 11 aa, Japanese encephalitis virus
KWCFDGPRTNA

SEQ ID NO: 236966 - protein, 11 aa, Japanese encephalitis virus
WCFDGPRTNAI

SEQ ID NO: 236967 - protein, 11 aa, Japanese encephalitis virus
CFDGPRTNAIL

SEQ ID NO: 236968 - protein, 11 aa, Japanese encephalitis virus
FDGPRTNAILE

SEQ ID NO: 236969 - protein, 11 aa, Japanese encephalitis virus
DGPRTNAILED

SEQ ID NO: 236970 - protein, 11 aa, Japanese encephalitis virus
GPRTNAILEDN

SEQ ID NO: 236971 - protein, 11 aa, Japanese encephalitis virus
PRTNAILEDNT

SEQ ID NO: 236972 - protein, 11 aa, Japanese encephalitis virus
RTNAILEDNTE

SEQ ID NO: 236973 - protein, 11 aa, Japanese encephalitis virus
TNAILEDNTEV

SEQ ID NO: 236974 - protein, 11 aa, Japanese encephalitis virus
NAILEDNTEVE

SEQ ID NO: 236975 - protein, 11 aa, Japanese encephalitis virus
AILEDNTEVEI

SEQ ID NO: 236976 - protein, 11 aa, Japanese encephalitis virus
ILEDNTEVEIV

SEQ ID NO: 236977 - protein, 11 aa, Japanese encephalitis virus
LEDNTEVEIVT

SEQ ID NO: 236978 - protein, 11 aa, Japanese encephalitis virus
EDNTEVEIVTR

SEQ ID NO: 236979 - protein, 11 aa, Japanese encephalitis virus
DNTEVEIVTRM

SEQ ID NO: 236980 - protein, 11 aa, Japanese encephalitis virus
NTEVEIVTRMG

SEQ ID NO: 236981 - protein, 11 aa, Japanese encephalitis virus
TEVEIVTRMGE

SEQ ID NO: 236982 - protein, 11 aa, Japanese encephalitis virus
EVEIVTRMGER

SEQ ID NO: 236983 - protein, 11 aa, Japanese encephalitis virus
VEIVTRMGERK

SEQ ID NO: 236984 - protein, 11 aa, Japanese encephalitis virus
EIVTRMGERKI

SEQ ID NO: 236985 - protein, 11 aa, Japanese encephalitis virus
IVTRMGERKIL

SEQ ID NO: 236986 - protein, 11 aa, Japanese encephalitis virus
VTRMGERKILK

SEQ ID NO: 236987 - protein, 11 aa, Japanese encephalitis virus
TRMGERKILKP

SEQ ID NO: 236988 - protein, 11 aa, Japanese encephalitis virus
RMGERKILKPR

SEQ ID NO: 236989 - protein, 11 aa, Japanese encephalitis virus
MGERKILKPRW

SEQ ID NO: 236990 - protein, 11 aa, Japanese encephalitis virus
GERKILKPRWL

SEQ ID NO: 236991 - protein, 11 aa, Japanese encephalitis virus
ERKILKPRWLD

SEQ ID NO: 236992 - protein, 11 aa, Japanese encephalitis virus
RKILKPRWLDA

SEQ ID NO: 236993 - protein, 11 aa, Japanese encephalitis virus
KILKPRWLDAR

SEQ ID NO: 236994 - protein, 11 aa, Japanese encephalitis virus
ILKPRWLDARV

SEQ ID NO: 236995 - protein, 11 aa, Japanese encephalitis virus
LKPRWLDARVY

SEQ ID NO: 236996 - protein, 11 aa, Japanese encephalitis virus
KPRWLDARVYA

SEQ ID NO: 236997 - protein, 11 aa, Japanese encephalitis virus
PRWLDARVYAD

SEQ ID NO: 236998 - protein, 11 aa, Japanese encephalitis virus
RWLDARVYADH

SEQ ID NO: 236999 - protein, 11 aa, Japanese encephalitis virus
WLDARVYADHQ

SEQ ID NO: 237000 - protein, 11 aa, Japanese encephalitis virus
LDARVYADHQA

SEQ ID NO: 237001 - protein, 11 aa, Japanese encephalitis virus
DARVYADHQAL

SEQ ID NO: 237002 - protein, 11 aa, Japanese encephalitis virus
ARVYADHQALK

SEQ ID NO: 237003 - protein, 11 aa, Japanese encephalitis virus
RVYADHQALKW

SEQ ID NO: 237004 - protein, 11 aa, Japanese encephalitis virus
VYADHQALKWF

SEQ ID NO: 237005 - protein, 11 aa, Japanese encephalitis virus
YADHQALKWFK

SEQ ID NO: 237006 - protein, 11 aa, Japanese encephalitis virus
ADHQALKWFKD

SEQ ID NO: 237007 - protein, 11 aa, Japanese encephalitis virus
DHQALKWFKDF

SEQ ID NO: 237008 - protein, 11 aa, Japanese encephalitis virus
HQALKWFKDFA

SEQ ID NO: 237009 - protein, 11 aa, Japanese encephalitis virus
QALKWFKDFAA

SEQ ID NO: 237010 - protein, 11 aa, Japanese encephalitis virus
ALKWFKDFAAG

SEQ ID NO: 237011 - protein, 11 aa, Japanese encephalitis virus
LKWFKDFAAGK

SEQ ID NO: 237012 - protein, 11 aa, Japanese encephalitis virus
KWFKDFAAGKR

SEQ ID NO: 237013 - protein, 11 aa, Japanese encephalitis virus
WFKDFAAGKRS

SEQ ID NO: 237014 - protein, 11 aa, Japanese encephalitis virus
FKDFAAGKRSA

SEQ ID NO: 237015 - protein, 11 aa, Japanese encephalitis virus
KDFAAGKRSAV

SEQ ID NO: 237016 - protein, 11 aa, Japanese encephalitis virus
DFAAGKRSAVS

SEQ ID NO: 237017 - protein, 11 aa, Japanese encephalitis virus
FAAGKRSAVSF

SEQ ID NO: 237018 - protein, 11 aa, Japanese encephalitis virus
AAGKRSAVSFI

SEQ ID NO: 237019 - protein, 11 aa, Japanese encephalitis virus
AGKRSAVSFIE

SEQ ID NO: 237020 - protein, 11 aa, Japanese encephalitis virus
GKRSAVSFIEV

SEQ ID NO: 237021 - protein, 11 aa, Japanese encephalitis virus
KRSAVSFIEVL

SEQ ID NO: 237022 - protein, 11 aa, Japanese encephalitis virus
RSAVSFIEVLG

SEQ ID NO: 237023 - protein, 11 aa, Japanese encephalitis virus
SAVSFIEVLGR

SEQ ID NO: 237024 - protein, 11 aa, Japanese encephalitis virus
AVSFIEVLGRM

SEQ ID NO: 237025 - protein, 11 aa, Japanese encephalitis virus
VSFIEVLGRMP

SEQ ID NO: 237026 - protein, 11 aa, Japanese encephalitis virus
SFIEVLGRMPE

SEQ ID NO: 237027 - protein, 11 aa, Japanese encephalitis virus
FIEVLGRMPEH

SEQ ID NO: 237028 - protein, 11 aa, Japanese encephalitis virus
IEVLGRMPEHF

SEQ ID NO: 237029 - protein, 11 aa, Japanese encephalitis virus
EVLGRMPEHFM

SEQ ID NO: 237030 - protein, 11 aa, Japanese encephalitis virus
VLGRMPEHFMG

SEQ ID NO: 237031 - protein, 11 aa, Japanese encephalitis virus
LGRMPEHFMGK

SEQ ID NO: 237032 - protein, 11 aa, Japanese encephalitis virus
GRMPEHFMGKT

SEQ ID NO: 237033 - protein, 11 aa, Japanese encephalitis virus
RMPEHFMGKTR

SEQ ID NO: 237034 - protein, 11 aa, Japanese encephalitis virus
MPEHFMGKTRE

SEQ ID NO: 237035 - protein, 11 aa, Japanese encephalitis virus
PEHFMGKTREA

SEQ ID NO: 237036 - protein, 11 aa, Japanese encephalitis virus
EHFMGKTREAL

SEQ ID NO: 237037 - protein, 11 aa, Japanese encephalitis virus
HFMGKTREALD

SEQ ID NO: 237038 - protein, 11 aa, Japanese encephalitis virus
FMGKTREALDT

SEQ ID NO: 237039 - protein, 11 aa, Japanese encephalitis virus
MGKTREALDTM

SEQ ID NO: 237040 - protein, 11 aa, Japanese encephalitis virus
GKTREALDTMY

SEQ ID NO: 237041 - protein, 11 aa, Japanese encephalitis virus
KTREALDTMYL

SEQ ID NO: 237042 - protein, 11 aa, Japanese encephalitis virus
TREALDTMYLV

SEQ ID NO: 237043 - protein, 11 aa, Japanese encephalitis virus
REALDTMYLVA

SEQ ID NO: 237044 - protein, 11 aa, Japanese encephalitis virus
EALDTMYLVAT

SEQ ID NO: 237045 - protein, 11 aa, Japanese encephalitis virus
ALDTMYLVATA

SEQ ID NO: 237046 - protein, 11 aa, Japanese encephalitis virus
LDTMYLVATAE

SEQ ID NO: 237047 - protein, 11 aa, Japanese encephalitis virus
DTMYLVATAEK

SEQ ID NO: 237048 - protein, 11 aa, Japanese encephalitis virus
TMYLVATAEKG

SEQ ID NO: 237049 - protein, 11 aa, Japanese encephalitis virus
MYLVATAEKGG

SEQ ID NO: 237050 - protein, 11 aa, Japanese encephalitis virus
YLVATAEKGGK

SEQ ID NO: 237051 - protein, 11 aa, Japanese encephalitis virus
LVATAEKGGKA

SEQ ID NO: 237052 - protein, 11 aa, Japanese encephalitis virus
VATAEKGGKAH

SEQ ID NO: 237053 - protein, 11 aa, Japanese encephalitis virus
ATAEKGGKAHR

SEQ ID NO: 237054 - protein, 11 aa, Japanese encephalitis virus
TAEKGGKAHRM

SEQ ID NO: 237055 - protein, 11 aa, Japanese encephalitis virus
AEKGGKAHRMA

SEQ ID NO: 237056 - protein, 11 aa, Japanese encephalitis virus
EKGGKAHRMAL

SEQ ID NO: 237057 - protein, 11 aa, Japanese encephalitis virus
KGGKAHRMALE

SEQ ID NO: 237058 - protein, 11 aa, Japanese encephalitis virus
GGKAHRMALEE

SEQ ID NO: 237059 - protein, 11 aa, Japanese encephalitis virus
GKAHRMALEEL

SEQ ID NO: 237060 - protein, 11 aa, Japanese encephalitis virus
KAHRMALEELP

SEQ ID NO: 237061 - protein, 11 aa, Japanese encephalitis virus
AHRMALEELPD

SEQ ID NO: 237062 - protein, 11 aa, Japanese encephalitis virus
HRMALEELPDA

SEQ ID NO: 237063 - protein, 11 aa, Japanese encephalitis virus
RMALEELPDAL

SEQ ID NO: 237064 - protein, 11 aa, Japanese encephalitis virus
MALEELPDALE

SEQ ID NO: 237065 - protein, 11 aa, Japanese encephalitis virus
ALEELPDALET

SEQ ID NO: 237066 - protein, 11 aa, Japanese encephalitis virus
LEELPDALETI

SEQ ID NO: 237067 - protein, 11 aa, Japanese encephalitis virus
EELPDALETIT

SEQ ID NO: 237068 - protein, 11 aa, Japanese encephalitis virus
ELPDALETITL

SEQ ID NO: 237069 - protein, 11 aa, Japanese encephalitis virus
LPDALETITLI

SEQ ID NO: 237070 - protein, 11 aa, Japanese encephalitis virus
PDALETITLIV

SEQ ID NO: 237071 - protein, 11 aa, Japanese encephalitis virus
DALETITLIVA

SEQ ID NO: 237072 - protein, 11 aa, Japanese encephalitis virus
ALETITLIVAI

SEQ ID NO: 237073 - protein, 11 aa, Japanese encephalitis virus
AITVMTGGFFL

SEQ ID NO: 237074 - protein, 11 aa, Japanese encephalitis virus
ITVMTGGFFLL

SEQ ID NO: 237075 - protein, 11 aa, Japanese encephalitis virus
TVMTGGFFLLM

SEQ ID NO: 237076 - protein, 11 aa, Japanese encephalitis virus
VMTGGFFLLMM

SEQ ID NO: 237077 - protein, 11 aa, Japanese encephalitis virus
MTGGFFLLMMQ

SEQ ID NO: 237078 - protein, 11 aa, Japanese encephalitis virus
TGGFFLLMMQR

SEQ ID NO: 237079 - protein, 11 aa, Japanese encephalitis virus
GGFFLLMMQRK

SEQ ID NO: 237080 - protein, 11 aa, Japanese encephalitis virus
GFFLLMMQRKG

SEQ ID NO: 237081 - protein, 11 aa, Japanese encephalitis virus
FFLLMMQRKGI

SEQ ID NO: 237082 - protein, 11 aa, Japanese encephalitis virus
FLLMMQRKGIG

SEQ ID NO: 237083 - protein, 11 aa, Japanese encephalitis virus
LLMMQRKGIGK

SEQ ID NO: 237084 - protein, 11 aa, Japanese encephalitis virus
LMMQRKGIGKM

SEQ ID NO: 237085 - protein, 11 aa, Japanese encephalitis virus
MMQRKGIGKMG

SEQ ID NO: 237086 - protein, 11 aa, Japanese encephalitis virus
MQRKGIGKMGL

SEQ ID NO: 237087 - protein, 11 aa, Japanese encephalitis virus
QRKGIGKMGLG

SEQ ID NO: 237088 - protein, 11 aa, Japanese encephalitis virus
RKGIGKMGLGA

SEQ ID NO: 237089 - protein, 11 aa, Japanese encephalitis virus
KGIGKMGLGAL

SEQ ID NO: 237090 - protein, 11 aa, Japanese encephalitis virus
GIGKMGLGALV

SEQ ID NO: 237091 - protein, 11 aa, Japanese encephalitis virus
IGKMGLGALVL

SEQ ID NO: 237092 - protein, 11 aa, Japanese encephalitis virus
GKMGLGALVLT

SEQ ID NO: 237093 - protein, 11 aa, Japanese encephalitis virus
KMGLGALVLTL

SEQ ID NO: 237094 - protein, 11 aa, Japanese encephalitis virus
MGLGALVLTLA

SEQ ID NO: 237095 - protein, 11 aa, Japanese encephalitis virus
GLGALVLTLAT

SEQ ID NO: 237096 - protein, 11 aa, Japanese encephalitis virus
LGALVLTLATF

SEQ ID NO: 237097 - protein, 11 aa, Japanese encephalitis virus
GALVLTLATFF

SEQ ID NO: 237098 - protein, 11 aa, Japanese encephalitis virus
ALVLTLATFFL

SEQ ID NO: 237099 - protein, 11 aa, Japanese encephalitis virus
LVLTLATFFLW

SEQ ID NO: 237100 - protein, 11 aa, Japanese encephalitis virus
VLTLATFFLWA

SEQ ID NO: 237101 - protein, 11 aa, Japanese encephalitis virus
LTLATFFLWAA

SEQ ID NO: 237102 - protein, 11 aa, Japanese encephalitis virus
TLATFFLWAAE

SEQ ID NO: 237103 - protein, 11 aa, Japanese encephalitis virus
LATFFLWAAEV

SEQ ID NO: 237104 - protein, 11 aa, Japanese encephalitis virus
ATFFLWAAEVP

SEQ ID NO: 237105 - protein, 11 aa, Japanese encephalitis virus
TFFLWAAEVPG

SEQ ID NO: 237106 - protein, 11 aa, Japanese encephalitis virus
FFLWAAEVPGT

SEQ ID NO: 237107 - protein, 11 aa, Japanese encephalitis virus
FLWAAEVPGTK

SEQ ID NO: 237108 - protein, 11 aa, Japanese encephalitis virus
LWAAEVPGTKI

SEQ ID NO: 237109 - protein, 11 aa, Japanese encephalitis virus
WAAEVPGTKIA

SEQ ID NO: 237110 - protein, 11 aa, Japanese encephalitis virus
AAEVPGTKIAG

SEQ ID NO: 237111 - protein, 11 aa, Japanese encephalitis virus
AEVPGTKIAGT

SEQ ID NO: 237112 - protein, 11 aa, Japanese encephalitis virus
EVPGTKIAGTL

SEQ ID NO: 237113 - protein, 11 aa, Japanese encephalitis virus
VPGTKIAGTLL

SEQ ID NO: 237114 - protein, 11 aa, Japanese encephalitis virus
PGTKIAGTLLI

SEQ ID NO: 237115 - protein, 11 aa, Japanese encephalitis virus
GTKIAGTLLIA

SEQ ID NO: 237116 - protein, 11 aa, Japanese encephalitis virus
TKIAGTLLIAL

SEQ ID NO: 237117 - protein, 11 aa, Japanese encephalitis virus
KIAGTLLIALL

SEQ ID NO: 237118 - protein, 11 aa, Japanese encephalitis virus
IAGTLLIALLL

SEQ ID NO: 237119 - protein, 11 aa, Japanese encephalitis virus
AGTLLIALLLM

SEQ ID NO: 237120 - protein, 11 aa, Japanese encephalitis virus
GTLLIALLLMV

SEQ ID NO: 237121 - protein, 11 aa, Japanese encephalitis virus
TLLIALLLMVV

SEQ ID NO: 237122 - protein, 11 aa, Japanese encephalitis virus
LLIALLLMVVL

SEQ ID NO: 237123 - protein, 11 aa, Japanese encephalitis virus
LIALLLMVVLI

SEQ ID NO: 237124 - protein, 11 aa, Japanese encephalitis virus
IALLLMVVLIP

SEQ ID NO: 237125 - protein, 11 aa, Japanese encephalitis virus
ALLLMVVLIPE

SEQ ID NO: 237126 - protein, 11 aa, Japanese encephalitis virus
LLLMVVLIPEP

SEQ ID NO: 237127 - protein, 11 aa, Japanese encephalitis virus
LLMVVLIPEPE

SEQ ID NO: 237128 - protein, 11 aa, Japanese encephalitis virus
LMVVLIPEPEK

SEQ ID NO: 237129 - protein, 11 aa, Japanese encephalitis virus
MVVLIPEPEKQ

SEQ ID NO: 237130 - protein, 11 aa, Japanese encephalitis virus
VVLIPEPEKQR

SEQ ID NO: 237131 - protein, 11 aa, Japanese encephalitis virus
VLIPEPEKQRS

SEQ ID NO: 237132 - protein, 11 aa, Japanese encephalitis virus
LIPEPEKQRSQ

SEQ ID NO: 237133 - protein, 11 aa, Japanese encephalitis virus
IPEPEKQRSQT

SEQ ID NO: 237134 - protein, 11 aa, Japanese encephalitis virus
PEPEKQRSQTD

SEQ ID NO: 237135 - protein, 11 aa, Japanese encephalitis virus
EPEKQRSQTDN

SEQ ID NO: 237136 - protein, 11 aa, Japanese encephalitis virus
PEKQRSQTDNQ

SEQ ID NO: 237137 - protein, 11 aa, Japanese encephalitis virus
EKQRSQTDNQL

SEQ ID NO: 237138 - protein, 11 aa, Japanese encephalitis virus
KQRSQTDNQLA

SEQ ID NO: 237139 - protein, 11 aa, Japanese encephalitis virus
QRSQTDNQLAV

SEQ ID NO: 237140 - protein, 11 aa, Japanese encephalitis virus
RSQTDNQLAVF

SEQ ID NO: 237141 - protein, 11 aa, Japanese encephalitis virus
SQTDNQLAVFL

SEQ ID NO: 237142 - protein, 11 aa, Japanese encephalitis virus
QTDNQLAVFLI

SEQ ID NO: 237143 - protein, 11 aa, Japanese encephalitis virus
TDNQLAVFLIC

SEQ ID NO: 237144 - protein, 11 aa, Japanese encephalitis virus
DNQLAVFLICV

SEQ ID NO: 237145 - protein, 11 aa, Japanese encephalitis virus
NQLAVFLICVL

SEQ ID NO: 237146 - protein, 11 aa, Japanese encephalitis virus
QLAVFLICVLT

SEQ ID NO: 237147 - protein, 11 aa, Japanese encephalitis virus
LAVFLICVLTV

SEQ ID NO: 237148 - protein, 11 aa, Japanese encephalitis virus
AVFLICVLTVV

SEQ ID NO: 237149 - protein, 11 aa, Japanese encephalitis virus
VFLICVLTVVG

SEQ ID NO: 237150 - protein, 11 aa, Japanese encephalitis virus
FLICVLTVVGV

SEQ ID NO: 237151 - protein, 11 aa, Japanese encephalitis virus
LICVLTVVGVV

SEQ ID NO: 237152 - protein, 11 aa, Japanese encephalitis virus
ICVLTVVGVVA

SEQ ID NO: 237153 - protein, 11 aa, Japanese encephalitis virus
CVLTVVGVVAA

SEQ ID NO: 237154 - protein, 11 aa, Japanese encephalitis virus
VLTVVGVVAAN

SEQ ID NO: 237155 - protein, 11 aa, Japanese encephalitis virus
LTVVGVVAANE

SEQ ID NO: 237156 - protein, 11 aa, Japanese encephalitis virus
TVVGVVAANEY

SEQ ID NO: 237157 - protein, 11 aa, Japanese encephalitis virus
VVGVVAANEYG

SEQ ID NO: 237158 - protein, 11 aa, Japanese encephalitis virus
VGVVAANEYGM

SEQ ID NO: 237159 - protein, 11 aa, Japanese encephalitis virus
GVVAANEYGML

SEQ ID NO: 237160 - protein, 11 aa, Japanese encephalitis virus
VVAANEYGMLE

SEQ ID NO: 237161 - protein, 11 aa, Japanese encephalitis virus
VAANEYGMLEK

SEQ ID NO: 237162 - protein, 11 aa, Japanese encephalitis virus
AANEYGMLEKT

SEQ ID NO: 237163 - protein, 11 aa, Japanese encephalitis virus
ANEYGMLEKTK

SEQ ID NO: 237164 - protein, 11 aa, Japanese encephalitis virus
NEYGMLEKTKA

SEQ ID NO: 237165 - protein, 11 aa, Japanese encephalitis virus
EYGMLEKTKAD

SEQ ID NO: 237166 - protein, 11 aa, Japanese encephalitis virus
YGMLEKTKADL

SEQ ID NO: 237167 - protein, 11 aa, Japanese encephalitis virus
GMLEKTKADLK

SEQ ID NO: 237168 - protein, 11 aa, Japanese encephalitis virus
MLEKTKADLKS

SEQ ID NO: 237169 - protein, 11 aa, Japanese encephalitis virus
LEKTKADLKSM

SEQ ID NO: 237170 - protein, 11 aa, Japanese encephalitis virus
EKTKADLKSMF

SEQ ID NO: 237171 - protein, 11 aa, Japanese encephalitis virus
KTKADLKSMFG

SEQ ID NO: 237172 - protein, 11 aa, Japanese encephalitis virus
TKADLKSMFGG

SEQ ID NO: 237173 - protein, 11 aa, Japanese encephalitis virus
KADLKSMFGGK

SEQ ID NO: 237174 - protein, 11 aa, Japanese encephalitis virus
TQASGLTGLPS

SEQ ID NO: 237175 - protein, 11 aa, Japanese encephalitis virus
QASGLTGLPSM

SEQ ID NO: 237176 - protein, 11 aa, Japanese encephalitis virus
GLTGLPSMALD

SEQ ID NO: 237177 - protein, 11 aa, Japanese encephalitis virus
LTGLPSMALDL

SEQ ID NO: 237178 - protein, 11 aa, Japanese encephalitis virus
TGLPSMALDLR

SEQ ID NO: 237179 - protein, 11 aa, Japanese encephalitis virus
GLPSMALDLRP

SEQ ID NO: 237180 - protein, 11 aa, Japanese encephalitis virus
LPSMALDLRPA

SEQ ID NO: 237181 - protein, 11 aa, Japanese encephalitis virus
PSMALDLRPAT

SEQ ID NO: 237182 - protein, 11 aa, Japanese encephalitis virus
SMALDLRPATA

SEQ ID NO: 237183 - protein, 11 aa, Japanese encephalitis virus
MALDLRPATAW

SEQ ID NO: 237184 - protein, 11 aa, Japanese encephalitis virus
ALDLRPATAWA

SEQ ID NO: 237185 - protein, 11 aa, Japanese encephalitis virus
LDLRPATAWAL

SEQ ID NO: 237186 - protein, 11 aa, Japanese encephalitis virus
DLRPATAWALY

SEQ ID NO: 237187 - protein, 11 aa, Japanese encephalitis virus
LRPATAWALYG

SEQ ID NO: 237188 - protein, 11 aa, Japanese encephalitis virus
RPATAWALYGG

SEQ ID NO: 237189 - protein, 11 aa, Japanese encephalitis virus
PATAWALYGGS

SEQ ID NO: 237190 - protein, 11 aa, Japanese encephalitis virus
ATAWALYGGST

SEQ ID NO: 237191 - protein, 11 aa, Japanese encephalitis virus
TAWALYGGSTV

SEQ ID NO: 237192 - protein, 11 aa, Japanese encephalitis virus
AWALYGGSTVV

SEQ ID NO: 237193 - protein, 11 aa, Japanese encephalitis virus
WALYGGSTVVL

SEQ ID NO: 237194 - protein, 11 aa, Japanese encephalitis virus
ALYGGSTVVLT

SEQ ID NO: 237195 - protein, 11 aa, Japanese encephalitis virus
LYGGSTVVLTP

SEQ ID NO: 237196 - protein, 11 aa, Japanese encephalitis virus
YGGSTVVLTPL

SEQ ID NO: 237197 - protein, 11 aa, Japanese encephalitis virus
GGSTVVLTPLL

SEQ ID NO: 237198 - protein, 11 aa, Japanese encephalitis virus
GSTVVLTPLLK

SEQ ID NO: 237199 - protein, 11 aa, Japanese encephalitis virus
STVVLTPLLKH

SEQ ID NO: 237200 - protein, 11 aa, Japanese encephalitis virus
TVVLTPLLKHL

SEQ ID NO: 237201 - protein, 11 aa, Japanese encephalitis virus
VVLTPLLKHLI

SEQ ID NO: 237202 - protein, 11 aa, Japanese encephalitis virus
VLTPLLKHLIT

SEQ ID NO: 237203 - protein, 11 aa, Japanese encephalitis virus
LTPLLKHLITS

SEQ ID NO: 237204 - protein, 11 aa, Japanese encephalitis virus
TPLLKHLITSE

SEQ ID NO: 237205 - protein, 11 aa, Japanese encephalitis virus
PLLKHLITSEY

SEQ ID NO: 237206 - protein, 11 aa, Japanese encephalitis virus
LLKHLITSEYV

SEQ ID NO: 237207 - protein, 11 aa, Japanese encephalitis virus
LKHLITSEYVT

SEQ ID NO: 237208 - protein, 11 aa, Japanese encephalitis virus
KHLITSEYVTT

SEQ ID NO: 237209 - protein, 11 aa, Japanese encephalitis virus
HLITSEYVTTS

SEQ ID NO: 237210 - protein, 11 aa, Japanese encephalitis virus
LITSEYVTTSL

SEQ ID NO: 237211 - protein, 11 aa, Japanese encephalitis virus
ITSEYVTTSLA

SEQ ID NO: 237212 - protein, 11 aa, Japanese encephalitis virus
TSEYVTTSLAS

SEQ ID NO: 237213 - protein, 11 aa, Japanese encephalitis virus
SEYVTTSLASI

SEQ ID NO: 237214 - protein, 11 aa, Japanese encephalitis virus
EYVTTSLASIN

SEQ ID NO: 237215 - protein, 11 aa, Japanese encephalitis virus
YVTTSLASINS

SEQ ID NO: 237216 - protein, 11 aa, Japanese encephalitis virus
VTTSLASINSQ

SEQ ID NO: 237217 - protein, 11 aa, Japanese encephalitis virus
TTSLASINSQA

SEQ ID NO: 237218 - protein, 11 aa, Japanese encephalitis virus
TSLASINSQAG

SEQ ID NO: 237219 - protein, 11 aa, Japanese encephalitis virus
SLASINSQAGS

SEQ ID NO: 237220 - protein, 11 aa, Japanese encephalitis virus
LASINSQAGSL

SEQ ID NO: 237221 - protein, 11 aa, Japanese encephalitis virus
ASINSQAGSLF

SEQ ID NO: 237222 - protein, 11 aa, Japanese encephalitis virus
SINSQAGSLFV

SEQ ID NO: 237223 - protein, 11 aa, Japanese encephalitis virus
INSQAGSLFVL

SEQ ID NO: 237224 - protein, 11 aa, Japanese encephalitis virus
NSQAGSLFVLP

SEQ ID NO: 237225 - protein, 11 aa, Japanese encephalitis virus
SQAGSLFVLPR

SEQ ID NO: 237226 - protein, 11 aa, Japanese encephalitis virus
QAGSLFVLPRG

SEQ ID NO: 237227 - protein, 11 aa, Japanese encephalitis virus
AGSLFVLPRGV

SEQ ID NO: 237228 - protein, 11 aa, Japanese encephalitis virus
GSLFVLPRGVP

SEQ ID NO: 237229 - protein, 11 aa, Japanese encephalitis virus
SLFVLPRGVPF

SEQ ID NO: 237230 - protein, 11 aa, Japanese encephalitis virus
LFVLPRGVPFT

SEQ ID NO: 237231 - protein, 11 aa, Japanese encephalitis virus
FVLPRGVPFTD

SEQ ID NO: 237232 - protein, 11 aa, Japanese encephalitis virus
VLPRGVPFTDL

SEQ ID NO: 237233 - protein, 11 aa, Japanese encephalitis virus
LPRGVPFTDLD

SEQ ID NO: 237234 - protein, 11 aa, Japanese encephalitis virus
PRGVPFTDLDL

SEQ ID NO: 237235 - protein, 11 aa, Japanese encephalitis virus
RGVPFTDLDLT

SEQ ID NO: 237236 - protein, 11 aa, Japanese encephalitis virus
GVPFTDLDLTV

SEQ ID NO: 237237 - protein, 11 aa, Japanese encephalitis virus
VPFTDLDLTVG

SEQ ID NO: 237238 - protein, 11 aa, Japanese encephalitis virus
PFTDLDLTVGL

SEQ ID NO: 237239 - protein, 11 aa, Japanese encephalitis virus
FTDLDLTVGLV

SEQ ID NO: 237240 - protein, 11 aa, Japanese encephalitis virus
TDLDLTVGLVF

SEQ ID NO: 237241 - protein, 11 aa, Japanese encephalitis virus
DLDLTVGLVFL

SEQ ID NO: 237242 - protein, 11 aa, Japanese encephalitis virus
LDLTVGLVFLG

SEQ ID NO: 237243 - protein, 11 aa, Japanese encephalitis virus
DLTVGLVFLGC

SEQ ID NO: 237244 - protein, 11 aa, Japanese encephalitis virus
LTVGLVFLGCW

SEQ ID NO: 237245 - protein, 11 aa, Japanese encephalitis virus
TVGLVFLGCWG

SEQ ID NO: 237246 - protein, 11 aa, Japanese encephalitis virus
VGLVFLGCWGQ

SEQ ID NO: 237247 - protein, 11 aa, Japanese encephalitis virus
GLVFLGCWGQI

SEQ ID NO: 237248 - protein, 11 aa, Japanese encephalitis virus
LVFLGCWGQIT

SEQ ID NO: 237249 - protein, 11 aa, Japanese encephalitis virus
VFLGCWGQITL

SEQ ID NO: 237250 - protein, 11 aa, Japanese encephalitis virus
FLGCWGQITLT

SEQ ID NO: 237251 - protein, 11 aa, Japanese encephalitis virus
LGCWGQITLTT

SEQ ID NO: 237252 - protein, 11 aa, Japanese encephalitis virus
GCWGQITLTTF

SEQ ID NO: 237253 - protein, 11 aa, Japanese encephalitis virus
CWGQITLTTFL

SEQ ID NO: 237254 - protein, 11 aa, Japanese encephalitis virus
WGQITLTTFLT

SEQ ID NO: 237255 - protein, 11 aa, Japanese encephalitis virus
GQITLTTFLTA

SEQ ID NO: 237256 - protein, 11 aa, Japanese encephalitis virus
QITLTTFLTAM

SEQ ID NO: 237257 - protein, 11 aa, Japanese encephalitis virus
ITLTTFLTAMV

SEQ ID NO: 237258 - protein, 11 aa, Japanese encephalitis virus
TLTTFLTAMVL

SEQ ID NO: 237259 - protein, 11 aa, Japanese encephalitis virus
LTAMVLATLHY

SEQ ID NO: 237260 - protein, 11 aa, Japanese encephalitis virus
TAMVLATLHYG

SEQ ID NO: 237261 - protein, 11 aa, Japanese encephalitis virus
VLATLHYGYML

SEQ ID NO: 237262 - protein, 11 aa, Japanese encephalitis virus
LATLHYGYMLP

SEQ ID NO: 237263 - protein, 11 aa, Japanese encephalitis virus
ATLHYGYMLPG

SEQ ID NO: 237264 - protein, 11 aa, Japanese encephalitis virus
TLHYGYMLPGW

SEQ ID NO: 237265 - protein, 11 aa, Japanese encephalitis virus
LHYGYMLPGWQ

SEQ ID NO: 237266 - protein, 11 aa, Japanese encephalitis virus
HYGYMLPGWQA

SEQ ID NO: 237267 - protein, 11 aa, Japanese encephalitis virus
YGYMLPGWQAE

SEQ ID NO: 237268 - protein, 11 aa, Japanese encephalitis virus
GYMLPGWQAEA

SEQ ID NO: 237269 - protein, 11 aa, Japanese encephalitis virus
YMLPGWQAEAL

SEQ ID NO: 237270 - protein, 11 aa, Japanese encephalitis virus
MLPGWQAEALR

SEQ ID NO: 237271 - protein, 11 aa, Japanese encephalitis virus
LPGWQAEALRA

SEQ ID NO: 237272 - protein, 11 aa, Japanese encephalitis virus
PGWQAEALRAA

SEQ ID NO: 237273 - protein, 11 aa, Japanese encephalitis virus
GWQAEALRAAQ

SEQ ID NO: 237274 - protein, 11 aa, Japanese encephalitis virus
WQAEALRAAQR

SEQ ID NO: 237275 - protein, 11 aa, Japanese encephalitis virus
QAEALRAAQRR

SEQ ID NO: 237276 - protein, 11 aa, Japanese encephalitis virus
AEALRAAQRRT

SEQ ID NO: 237277 - protein, 11 aa, Japanese encephalitis virus
EALRAAQRRTA

SEQ ID NO: 237278 - protein, 11 aa, Japanese encephalitis virus
ALRAAQRRTAA

SEQ ID NO: 237279 - protein, 11 aa, Japanese encephalitis virus
LRAAQRRTAAG

SEQ ID NO: 237280 - protein, 11 aa, Japanese encephalitis virus
RAAQRRTAAGI

SEQ ID NO: 237281 - protein, 11 aa, Japanese encephalitis virus
AAQRRTAAGIM

SEQ ID NO: 237282 - protein, 11 aa, Japanese encephalitis virus
AQRRTAAGIMK

SEQ ID NO: 237283 - protein, 11 aa, Japanese encephalitis virus
QRRTAAGIMKN

SEQ ID NO: 237284 - protein, 11 aa, Japanese encephalitis virus
RRTAAGIMKNA

SEQ ID NO: 237285 - protein, 11 aa, Japanese encephalitis virus
RTAAGIMKNAV

SEQ ID NO: 237286 - protein, 11 aa, Japanese encephalitis virus
TAAGIMKNAVV

SEQ ID NO: 237287 - protein, 11 aa, Japanese encephalitis virus
AAGIMKNAVVD

SEQ ID NO: 237288 - protein, 11 aa, Japanese encephalitis virus
AGIMKNAVVDG

SEQ ID NO: 237289 - protein, 11 aa, Japanese encephalitis virus
GIMKNAVVDGM

SEQ ID NO: 237290 - protein, 11 aa, Japanese encephalitis virus
IMKNAVVDGMV

SEQ ID NO: 237291 - protein, 11 aa, Japanese encephalitis virus
MKNAVVDGMVA

SEQ ID NO: 237292 - protein, 11 aa, Japanese encephalitis virus
KNAVVDGMVAT

SEQ ID NO: 237293 - protein, 11 aa, Japanese encephalitis virus
NAVVDGMVATD

SEQ ID NO: 237294 - protein, 11 aa, Japanese encephalitis virus
AVVDGMVATDV

SEQ ID NO: 237295 - protein, 11 aa, Japanese encephalitis virus
VVDGMVATDVP

SEQ ID NO: 237296 - protein, 11 aa, Japanese encephalitis virus
VDGMVATDVPE

SEQ ID NO: 237297 - protein, 11 aa, Japanese encephalitis virus
DGMVATDVPEL

SEQ ID NO: 237298 - protein, 11 aa, Japanese encephalitis virus
GMVATDVPELE

SEQ ID NO: 237299 - protein, 11 aa, Japanese encephalitis virus
MVATDVPELER

SEQ ID NO: 237300 - protein, 11 aa, Japanese encephalitis virus
VATDVPELERT

SEQ ID NO: 237301 - protein, 11 aa, Japanese encephalitis virus
ATDVPELERTT

SEQ ID NO: 237302 - protein, 11 aa, Japanese encephalitis virus
TDVPELERTTP

SEQ ID NO: 237303 - protein, 11 aa, Japanese encephalitis virus
DVPELERTTPL

SEQ ID NO: 237304 - protein, 11 aa, Japanese encephalitis virus
VPELERTTPLM

SEQ ID NO: 237305 - protein, 11 aa, Japanese encephalitis virus
PELERTTPLMQ

SEQ ID NO: 237306 - protein, 11 aa, Japanese encephalitis virus
ELERTTPLMQK

SEQ ID NO: 237307 - protein, 11 aa, Japanese encephalitis virus
LERTTPLMQKK

SEQ ID NO: 237308 - protein, 11 aa, Japanese encephalitis virus
ERTTPLMQKKV

SEQ ID NO: 237309 - protein, 11 aa, Japanese encephalitis virus
RTTPLMQKKVG

SEQ ID NO: 237310 - protein, 11 aa, Japanese encephalitis virus
TTPLMQKKVGQ

SEQ ID NO: 237311 - protein, 11 aa, Japanese encephalitis virus
TPLMQKKVGQV

SEQ ID NO: 237312 - protein, 11 aa, Japanese encephalitis virus
PLMQKKVGQVL

SEQ ID NO: 237313 - protein, 11 aa, Japanese encephalitis virus
LMQKKVGQVLL

SEQ ID NO: 237314 - protein, 11 aa, Japanese encephalitis virus
MQKKVGQVLLI

SEQ ID NO: 237315 - protein, 11 aa, Japanese encephalitis virus
QKKVGQVLLIG

SEQ ID NO: 237316 - protein, 11 aa, Japanese encephalitis virus
KKVGQVLLIGV

SEQ ID NO: 237317 - protein, 11 aa, Japanese encephalitis virus
KVGQVLLIGVS

SEQ ID NO: 237318 - protein, 11 aa, Japanese encephalitis virus
VGQVLLIGVSV

SEQ ID NO: 237319 - protein, 11 aa, Japanese encephalitis virus
GQVLLIGVSVA

SEQ ID NO: 237320 - protein, 11 aa, Japanese encephalitis virus
QVLLIGVSVAA

SEQ ID NO: 237321 - protein, 11 aa, Japanese encephalitis virus
VLLIGVSVAAF

SEQ ID NO: 237322 - protein, 11 aa, Japanese encephalitis virus
LLIGVSVAAFL

SEQ ID NO: 237323 - protein, 11 aa, Japanese encephalitis virus
LIGVSVAAFLV

SEQ ID NO: 237324 - protein, 11 aa, Japanese encephalitis virus
IGVSVAAFLVN

SEQ ID NO: 237325 - protein, 11 aa, Japanese encephalitis virus
GVSVAAFLVNP

SEQ ID NO: 237326 - protein, 11 aa, Japanese encephalitis virus
VSVAAFLVNPN

SEQ ID NO: 237327 - protein, 11 aa, Japanese encephalitis virus
SVAAFLVNPNV

SEQ ID NO: 237328 - protein, 11 aa, Japanese encephalitis virus
VAAFLVNPNVT

SEQ ID NO: 237329 - protein, 11 aa, Japanese encephalitis virus
AAFLVNPNVTT

SEQ ID NO: 237330 - protein, 11 aa, Japanese encephalitis virus
AFLVNPNVTTV

SEQ ID NO: 237331 - protein, 11 aa, Japanese encephalitis virus
FLVNPNVTTVR

SEQ ID NO: 237332 - protein, 11 aa, Japanese encephalitis virus
LVNPNVTTVRE

SEQ ID NO: 237333 - protein, 11 aa, Japanese encephalitis virus
VNPNVTTVREA

SEQ ID NO: 237334 - protein, 11 aa, Japanese encephalitis virus
NPNVTTVREAG

SEQ ID NO: 237335 - protein, 11 aa, Japanese encephalitis virus
PNVTTVREAGV

SEQ ID NO: 237336 - protein, 11 aa, Japanese encephalitis virus
NVTTVREAGVL

SEQ ID NO: 237337 - protein, 11 aa, Japanese encephalitis virus
VTTVREAGVLV

SEQ ID NO: 237338 - protein, 11 aa, Japanese encephalitis virus
TTVREAGVLVT

SEQ ID NO: 237339 - protein, 11 aa, Japanese encephalitis virus
TVREAGVLVTA

SEQ ID NO: 237340 - protein, 11 aa, Japanese encephalitis virus
VREAGVLVTAA

SEQ ID NO: 237341 - protein, 11 aa, Japanese encephalitis virus
REAGVLVTAAT

SEQ ID NO: 237342 - protein, 11 aa, Japanese encephalitis virus
EAGVLVTAATL

SEQ ID NO: 237343 - protein, 11 aa, Japanese encephalitis virus
AGVLVTAATLT

SEQ ID NO: 237344 - protein, 11 aa, Japanese encephalitis virus
GVLVTAATLTL

SEQ ID NO: 237345 - protein, 11 aa, Japanese encephalitis virus
VLVTAATLTLW

SEQ ID NO: 237346 - protein, 11 aa, Japanese encephalitis virus
LVTAATLTLWD

SEQ ID NO: 237347 - protein, 11 aa, Japanese encephalitis virus
VTAATLTLWDN

SEQ ID NO: 237348 - protein, 11 aa, Japanese encephalitis virus
TAATLTLWDNG

SEQ ID NO: 237349 - protein, 11 aa, Japanese encephalitis virus
AATLTLWDNGA

SEQ ID NO: 237350 - protein, 11 aa, Japanese encephalitis virus
ATLTLWDNGAS

SEQ ID NO: 237351 - protein, 11 aa, Japanese encephalitis virus
TLTLWDNGASA

SEQ ID NO: 237352 - protein, 11 aa, Japanese encephalitis virus
LTLWDNGASAV

SEQ ID NO: 237353 - protein, 11 aa, Japanese encephalitis virus
TLWDNGASAVW

SEQ ID NO: 237354 - protein, 11 aa, Japanese encephalitis virus
LWDNGASAVWN

SEQ ID NO: 237355 - protein, 11 aa, Japanese encephalitis virus
WDNGASAVWNS

SEQ ID NO: 237356 - protein, 11 aa, Japanese encephalitis virus
DNGASAVWNST

SEQ ID NO: 237357 - protein, 11 aa, Japanese encephalitis virus
NGASAVWNSTT

SEQ ID NO: 237358 - protein, 11 aa, Japanese encephalitis virus
GASAVWNSTTA

SEQ ID NO: 237359 - protein, 11 aa, Japanese encephalitis virus
ASAVWNSTTAT

SEQ ID NO: 237360 - protein, 11 aa, Japanese encephalitis virus
SAVWNSTTATG

SEQ ID NO: 237361 - protein, 11 aa, Japanese encephalitis virus
AVWNSTTATGL

SEQ ID NO: 237362 - protein, 11 aa, Japanese encephalitis virus
VWNSTTATGLC

SEQ ID NO: 237363 - protein, 11 aa, Japanese encephalitis virus
WNSTTATGLCH

SEQ ID NO: 237364 - protein, 11 aa, Japanese encephalitis virus
NSTTATGLCHV

SEQ ID NO: 237365 - protein, 11 aa, Japanese encephalitis virus
STTATGLCHVM

SEQ ID NO: 237366 - protein, 11 aa, Japanese encephalitis virus
TTATGLCHVMR

SEQ ID NO: 237367 - protein, 11 aa, Japanese encephalitis virus
TATGLCHVMRG

SEQ ID NO: 237368 - protein, 11 aa, Japanese encephalitis virus
ATGLCHVMRGS

SEQ ID NO: 237369 - protein, 11 aa, Japanese encephalitis virus
TGLCHVMRGSY

SEQ ID NO: 237370 - protein, 11 aa, Japanese encephalitis virus
GLCHVMRGSYL

SEQ ID NO: 237371 - protein, 11 aa, Japanese encephalitis virus
LCHVMRGSYLA

SEQ ID NO: 237372 - protein, 11 aa, Japanese encephalitis virus
CHVMRGSYLAG

SEQ ID NO: 237373 - protein, 11 aa, Japanese encephalitis virus
HVMRGSYLAGG

SEQ ID NO: 237374 - protein, 11 aa, Japanese encephalitis virus
VMRGSYLAGGS

SEQ ID NO: 237375 - protein, 11 aa, Japanese encephalitis virus
MRGSYLAGGSI

SEQ ID NO: 237376 - protein, 11 aa, Japanese encephalitis virus
RGSYLAGGSIA

SEQ ID NO: 237377 - protein, 11 aa, Japanese encephalitis virus
GSYLAGGSIAW

SEQ ID NO: 237378 - protein, 11 aa, Japanese encephalitis virus
SYLAGGSIAWT

SEQ ID NO: 237379 - protein, 11 aa, Japanese encephalitis virus
YLAGGSIAWTL

SEQ ID NO: 237380 - protein, 11 aa, Japanese encephalitis virus
LAGGSIAWTLI

SEQ ID NO: 237381 - protein, 11 aa, Japanese encephalitis virus
AGGSIAWTLIK

SEQ ID NO: 237382 - protein, 11 aa, Japanese encephalitis virus
GGSIAWTLIKN

SEQ ID NO: 237383 - protein, 11 aa, Japanese encephalitis virus
GSIAWTLIKNA

SEQ ID NO: 237384 - protein, 11 aa, Japanese encephalitis virus
SIAWTLIKNAD

SEQ ID NO: 237385 - protein, 11 aa, Japanese encephalitis virus
IAWTLIKNADK

SEQ ID NO: 237386 - protein, 11 aa, Japanese encephalitis virus
AWTLIKNADKP

SEQ ID NO: 237387 - protein, 11 aa, Japanese encephalitis virus
WTLIKNADKPS

SEQ ID NO: 237388 - protein, 11 aa, Japanese encephalitis virus
TLIKNADKPSL

SEQ ID NO: 237389 - protein, 11 aa, Japanese encephalitis virus
LIKNADKPSLK

SEQ ID NO: 237390 - protein, 11 aa, Japanese encephalitis virus
IKNADKPSLKR

SEQ ID NO: 237391 - protein, 11 aa, Japanese encephalitis virus
KNADKPSLKRG

SEQ ID NO: 237392 - protein, 11 aa, Japanese encephalitis virus
NADKPSLKRGR

SEQ ID NO: 237393 - protein, 11 aa, Japanese encephalitis virus
KPSLKRGRPGG

SEQ ID NO: 237394 - protein, 11 aa, Japanese encephalitis virus
PSLKRGRPGGR

SEQ ID NO: 237395 - protein, 11 aa, Japanese encephalitis virus
SLKRGRPGGRT

SEQ ID NO: 237396 - protein, 11 aa, Japanese encephalitis virus
LKRGRPGGRTL

SEQ ID NO: 237397 - protein, 11 aa, Japanese encephalitis virus
KRGRPGGRTLG

SEQ ID NO: 237398 - protein, 11 aa, Japanese encephalitis virus
RGRPGGRTLGE

SEQ ID NO: 237399 - protein, 11 aa, Japanese encephalitis virus
GRPGGRTLGEQ

SEQ ID NO: 237400 - protein, 11 aa, Japanese encephalitis virus
RPGGRTLGEQW

SEQ ID NO: 237401 - protein, 11 aa, Japanese encephalitis virus
PGGRTLGEQWK

SEQ ID NO: 237402 - protein, 11 aa, Japanese encephalitis virus
GGRTLGEQWKE

SEQ ID NO: 237403 - protein, 11 aa, Japanese encephalitis virus
GRTLGEQWKEK

SEQ ID NO: 237404 - protein, 11 aa, Japanese encephalitis virus
RTLGEQWKEKL

SEQ ID NO: 237405 - protein, 11 aa, Japanese encephalitis virus
TLGEQWKEKLN

SEQ ID NO: 237406 - protein, 11 aa, Japanese encephalitis virus
LGEQWKEKLNA

SEQ ID NO: 237407 - protein, 11 aa, Japanese encephalitis virus
QWKEKLNAMSR

SEQ ID NO: 237408 - protein, 11 aa, Japanese encephalitis virus
KLNAMSREEFF

SEQ ID NO: 237409 - protein, 11 aa, Japanese encephalitis virus
LNAMSREEFFK

SEQ ID NO: 237410 - protein, 11 aa, Japanese encephalitis virus
NAMSREEFFKY

SEQ ID NO: 237411 - protein, 11 aa, Japanese encephalitis virus
AMSREEFFKYR

SEQ ID NO: 237412 - protein, 11 aa, Japanese encephalitis virus
MSREEFFKYRR

SEQ ID NO: 237413 - protein, 11 aa, Japanese encephalitis virus
SREEFFKYRRE

SEQ ID NO: 237414 - protein, 11 aa, Japanese encephalitis virus
REEFFKYRREA

SEQ ID NO: 237415 - protein, 11 aa, Japanese encephalitis virus
EEFFKYRREAI

SEQ ID NO: 237416 - protein, 11 aa, Japanese encephalitis virus
EFFKYRREAII

SEQ ID NO: 237417 - protein, 11 aa, Japanese encephalitis virus
FFKYRREAIIE

SEQ ID NO: 237418 - protein, 11 aa, Japanese encephalitis virus
FKYRREAIIEV

SEQ ID NO: 237419 - protein, 11 aa, Japanese encephalitis virus
KYRREAIIEVD

SEQ ID NO: 237420 - protein, 11 aa, Japanese encephalitis virus
YRREAIIEVDR

SEQ ID NO: 237421 - protein, 11 aa, Japanese encephalitis virus
RREAIIEVDRT
